United States Patent 11,293,017 (OLIGONUCLEOTIDE PROBES AND USES THEREOF) - sequence listing, part 6

SEQ ID NO: 129005 - DNA, 35 bp, Artificial Sequence
  Synthetic oligonucleotide
gacacggggagggtgggtgtggcatgagatagatt

SEQ ID NO: 129006 - DNA, 35 bp, Artificial Sequence
  Synthetic oligonucleotide
ggaccgccgcctgtccatccgctaatcttttcaca

SEQ ID NO: 129007 - DNA, 31 bp, Artificial Sequence
  Synthetic oligonucleotide
gttatctgccccccgtaagctctgctggcca

SEQ ID NO: 129008 - DNA, 37 bp, Artificial Sequence
  Synthetic oligonucleotide
aaagaggccgagcggtaggacaagggggagctgggga

SEQ ID NO: 129009 - DNA, 36 bp, Artificial Sequence
  Synthetic oligonucleotide
tcctcggagggcgggtaatcacgggagggacactga

SEQ ID NO: 129010 - DNA, 37 bp, Artificial Sequence
  Synthetic oligonucleotide
acgttccacccacgttaacgcgaccctcccttcctga

SEQ ID NO: 129011 - DNA, 38 bp, Artificial Sequence
  Synthetic oligonucleotide
ggtcggggaaggggtggggagggcctatagataggtga

SEQ ID NO: 129012 - DNA, 38 bp, Artificial Sequence
  Synthetic oligonucleotide
gggaggggtctgtctggggccacatttactaggggtga

SEQ ID NO: 129013 - DNA, 36 bp, Artificial Sequence
  Synthetic oligonucleotide
tcttgcctccgccccgatccacacgcttcagcttta

SEQ ID NO: 129014 - DNA, 35 bp, Artificial Sequence
  Synthetic oligonucleotide
ggaaagtctgtcgccgttaccgttccttcctacac

SEQ ID NO: 129015 - DNA, 35 bp, Artificial Sequence
  Synthetic oligonucleotide
gctggccttgccacacttcatgtattctttcccac

SEQ ID NO: 129016 - DNA, 35 bp, Artificial Sequence
  Synthetic oligonucleotide
tgctcacccccgctccgcgactgttatctttgcac

SEQ ID NO: 129017 - DNA, 35 bp, Artificial Sequence
  Synthetic oligonucleotide
tctacgcccgttcgcacttcctcggttccttaacc

SEQ ID NO: 129018 - DNA, 35 bp, Artificial Sequence
  Synthetic oligonucleotide
accgatacaccagctgtgatcgtacacctctgtcc

SEQ ID NO: 129019 - DNA, 35 bp, Artificial Sequence
  Synthetic oligonucleotide
gacccaactcccgcctctggaatgaacactgcctc

SEQ ID NO: 129020 - DNA, 35 bp, Artificial Sequence
  Synthetic oligonucleotide
tgcgtagcccttcatcatttatcgtcaccactctc

SEQ ID NO: 129021 - DNA, 35 bp, Artificial Sequence
  Synthetic oligonucleotide
acccgcccccgctatgatcaccaactttcagttag

SEQ ID NO: 129022 - DNA, 35 bp, Artificial Sequence
  Synthetic oligonucleotide
gagatgcatgataggggggggtggcgggttgactg

SEQ ID NO: 129023 - DNA, 35 bp, Artificial Sequence
  Synthetic oligonucleotide
gtcacatcccaggcgttggtcggcctttcattact

SEQ ID NO: 129024 - DNA, 35 bp, Artificial Sequence
  Synthetic oligonucleotide
gacatgtgcctgcccggattgctccgcccatacct

SEQ ID NO: 129025 - DNA, 35 bp, Artificial Sequence
  Synthetic oligonucleotide
gacccctcaccgcccccatgcatgcgcataagtgt

SEQ ID NO: 129026 - DNA, 35 bp, Artificial Sequence
  Synthetic oligonucleotide
gttgctcgcccactggtcctagctcagccatcctt

SEQ ID NO: 129027 - DNA, 36 bp, Artificial Sequence
  Synthetic oligonucleotide
acaccctgctttgtgttttcaatcacgccctcccca

SEQ ID NO: 129028 - DNA, 35 bp, Artificial Sequence
  Synthetic oligonucleotide
ccagcctctctgctccacccgtacatgccgtgcca

SEQ ID NO: 129029 - DNA, 37 bp, Artificial Sequence
  Synthetic oligonucleotide
acgactaacgcccgcatctttgaacgaatcctcctga

SEQ ID NO: 129030 - DNA, 37 bp, Artificial Sequence
  Synthetic oligonucleotide
agaggggggggagtggaggggcgggtaaataacgtga

SEQ ID NO: 129031 - DNA, 38 bp, Artificial Sequence
  Synthetic oligonucleotide
tccgagagggggaggaaagatggagaggggattattga

SEQ ID NO: 129032 - DNA, 38 bp, Artificial Sequence
  Synthetic oligonucleotide
gccaccacatgtatcacgctttgcttcaccgcccttga

SEQ ID NO: 129033 - DNA, 35 bp, Artificial Sequence
  Synthetic oligonucleotide
tatcccaccgctcccgagccgggtacactccttga

SEQ ID NO: 129034 - DNA, 35 bp, Artificial Sequence
  Synthetic oligonucleotide
ttgatccaccgcctcataatggcgatattgccata

SEQ ID NO: 129035 - DNA, 35 bp, Artificial Sequence
  Synthetic oligonucleotide
tgtttgctagcgtgcacttcccccttctgcccgcc

SEQ ID NO: 129036 - DNA, 35 bp, Artificial Sequence
  Synthetic oligonucleotide
tgtgactcatactgattatctccccgctactccgc

SEQ ID NO: 129037 - DNA, 35 bp, Artificial Sequence
  Synthetic oligonucleotide
tgtatgccattcgtttcgcccctttcattgttcgc

SEQ ID NO: 129038 - DNA, 35 bp, Artificial Sequence
  Synthetic oligonucleotide
gagaggacgcggcaaggggaagtgggagtgtcagg

SEQ ID NO: 129039 - DNA, 35 bp, Artificial Sequence
  Synthetic oligonucleotide
tttcaacccgcattggcttttgtacctttctcctg

SEQ ID NO: 129040 - DNA, 36 bp, Artificial Sequence
  Synthetic oligonucleotide
gatgcctcagctatactccgttcttctaccgctcca

SEQ ID NO: 129041 - DNA, 37 bp, Artificial Sequence
  Synthetic oligonucleotide
ggcggggacggcctttgtaggaggggaggtgaaccga

SEQ ID NO: 129042 - DNA, 37 bp, Artificial Sequence
  Synthetic oligonucleotide
tgtccagccccctaccccgtacgccaatcgccctgga

SEQ ID NO: 129043 - DNA, 35 bp, Artificial Sequence
  Synthetic oligonucleotide
tagacgcctgtaggtccctattcccacccgtttta

SEQ ID NO: 129044 - DNA, 35 bp, Artificial Sequence
  Synthetic oligonucleotide
atcgccatgtgtcgtgatttcgcccgcccgtttcc

SEQ ID NO: 129045 - DNA, 35 bp, Artificial Sequence
  Synthetic oligonucleotide
agcgaccccagttatatttctgcccttcctctagc

SEQ ID NO: 129046 - DNA, 35 bp, Artificial Sequence
  Synthetic oligonucleotide
gtgacgcctttgaaacgaccaccgctccacctggc

SEQ ID NO: 129047 - DNA, 35 bp, Artificial Sequence
  Synthetic oligonucleotide
ggtcgaccaccgcatactcccgctcacattgcatc

SEQ ID NO: 129048 - DNA, 35 bp, Artificial Sequence
  Synthetic oligonucleotide
gtcgacgatctgcctcgagcctcctctactacttc

SEQ ID NO: 129049 - DNA, 35 bp, Artificial Sequence
  Synthetic oligonucleotide
tgcccctcccacatcataatacccaccgatcaacg

SEQ ID NO: 129050 - DNA, 35 bp, Artificial Sequence
  Synthetic oligonucleotide
gccttaccgcctcccgcagatccctctatcgatcg

SEQ ID NO: 129051 - DNA, 35 bp, Artificial Sequence
  Synthetic oligonucleotide
agtggtggggtgaaggaggcgacaggaagggggtg

SEQ ID NO: 129052 - DNA, 35 bp, Artificial Sequence
  Synthetic oligonucleotide
gacacgagccattccctgccttaacgacttttttg

SEQ ID NO: 129053 - DNA, 35 bp, Artificial Sequence
  Synthetic oligonucleotide
accgaacgccttgtgtctcggtaacttctcttact

SEQ ID NO: 129054 - DNA, 35 bp, Artificial Sequence
  Synthetic oligonucleotide
acttacccccgcgacaactgagagcggccttccct

SEQ ID NO: 129055 - DNA, 35 bp, Artificial Sequence
  Synthetic oligonucleotide
tgttgtcgccacattgtacgttgcttcttctctct

SEQ ID NO: 129056 - DNA, 35 bp, Artificial Sequence
  Synthetic oligonucleotide
agcgagccaccagggtctgtcccttcctttctcgt

SEQ ID NO: 129057 - DNA, 35 bp, Artificial Sequence
  Synthetic oligonucleotide
acgcacgtgcgaacttatctcggtccatctctttt

SEQ ID NO: 129058 - DNA, 36 bp, Artificial Sequence
  Synthetic oligonucleotide
tccccaccgacatctctttcccagcccccagtagaa

SEQ ID NO: 129059 - DNA, 36 bp, Artificial Sequence
  Synthetic oligonucleotide
tggtgctcagccattttaccttcgcgcccccctgaa

SEQ ID NO: 129060 - DNA, 36 bp, Artificial Sequence
  Synthetic oligonucleotide
gatcaactcccattgtaccttgtactggtctctcca

SEQ ID NO: 129061 - DNA, 36 bp, Artificial Sequence
  Synthetic oligonucleotide
gggtgcagtcgcgcccccgtgcccttgtcatttcca

SEQ ID NO: 129062 - DNA, 37 bp, Artificial Sequence
  Synthetic oligonucleotide
gcaccccccacgtgtcgtcttcaatgttgctcctcga

SEQ ID NO: 129063 - DNA, 36 bp, Artificial Sequence
  Synthetic oligonucleotide
gtgggagcgcggtgcatgcgggggggcggggtaata

SEQ ID NO: 129064 - DNA, 35 bp, Artificial Sequence
  Synthetic oligonucleotide
gactctgcccatacgttgttcagtgtgctccgccc

SEQ ID NO: 129065 - DNA, 35 bp, Artificial Sequence
  Synthetic oligonucleotide
tacccgtctgtgtacgcctccgctcgctcaacgcc

SEQ ID NO: 129066 - DNA, 35 bp, Artificial Sequence
  Synthetic oligonucleotide
gcacccccgcacagattctgccctgccttacttcc

SEQ ID NO: 129067 - DNA, 35 bp, Artificial Sequence
  Synthetic oligonucleotide
tgcgcgcgccgcactccgttacctgactctacctc

SEQ ID NO: 129068 - DNA, 35 bp, Artificial Sequence
  Synthetic oligonucleotide
gccctcgatattcggtatattgctcccgctccttc

SEQ ID NO: 129069 - DNA, 35 bp, Artificial Sequence
  Synthetic oligonucleotide
gactctctccaccgccccagaccccgcatctcctg

SEQ ID NO: 129070 - DNA, 35 bp, Artificial Sequence
  Synthetic oligonucleotide
gtccgctgtaccattcgcatcctacgtcgccgcct

SEQ ID NO: 129071 - DNA, 35 bp, Artificial Sequence
  Synthetic oligonucleotide
attagcacagtacggtccgccccccgcacattcct

SEQ ID NO: 129072 - DNA, 35 bp, Artificial Sequence
  Synthetic oligonucleotide
gcttgtccggatcgatgcgtcacccccccattcct

SEQ ID NO: 129073 - DNA, 35 bp, Artificial Sequence
  Synthetic oligonucleotide
tcccccgcctacacgtttcagcgcgaattccctgt

SEQ ID NO: 129074 - DNA, 35 bp, Artificial Sequence
  Synthetic oligonucleotide
agaacgtgctgccctgtcctgagcccttccattgt

SEQ ID NO: 129075 - DNA, 35 bp, Artificial Sequence
  Synthetic oligonucleotide
gagcaccaccgtcgtagccgccgtccctcgaactt

SEQ ID NO: 129076 - DNA, 35 bp, Artificial Sequence
  Synthetic oligonucleotide
gtcggaaccgttaccgtttgcccgccgatgccctt

SEQ ID NO: 129077 - DNA, 35 bp, Artificial Sequence
  Synthetic oligonucleotide
atgtgtgcctaccgatcctgccgggcccccatgtt

SEQ ID NO: 129078 - DNA, 35 bp, Artificial Sequence
  Synthetic oligonucleotide
tgattcgtcacgttggctcccctcccatactcttt

SEQ ID NO: 129079 - DNA, 35 bp, Artificial Sequence
  Synthetic oligonucleotide
ggaacgcccccatatgaccgtcatatctcctgttt

SEQ ID NO: 129080 - DNA, 35 bp, Artificial Sequence
  Synthetic oligonucleotide
gacccaccgcacgcctggaagcttcctgccctttt

SEQ ID NO: 129081 - DNA, 36 bp, Artificial Sequence
  Synthetic oligonucleotide
atcacctgccttcccaactgctcatatgccacggaa

SEQ ID NO: 129082 - DNA, 36 bp, Artificial Sequence
  Synthetic oligonucleotide
gactacactcatctgccgacgcggtcacccctgtca

SEQ ID NO: 129083 - DNA, 36 bp, Artificial Sequence
  Synthetic oligonucleotide
acacccccccctgttcttaaggagagcaatctacta

SEQ ID NO: 129084 - DNA, 36 bp, Artificial Sequence
  Synthetic oligonucleotide
tagtccatcatcctgccgcctggagccacgcatcta

SEQ ID NO: 129085 - DNA, 36 bp, Artificial Sequence
  Synthetic oligonucleotide
acgccccaccaccatgtccgccaatgaatcccggta

SEQ ID NO: 129086 - DNA, 36 bp, Artificial Sequence
  Synthetic oligonucleotide
acctgcgcgcaccatttgcgtacgttctcccactta

SEQ ID NO: 129087 - DNA, 34 bp, Artificial Sequence
  Synthetic oligonucleotide
gacattgtccgtttcttctccagttccttgctta

SEQ ID NO: 129088 - DNA, 35 bp, Artificial Sequence
  Synthetic oligonucleotide
gtcccattccctgttctgtcgtcaagacgcccccc

SEQ ID NO: 129089 - DNA, 35 bp, Artificial Sequence
  Synthetic oligonucleotide
gcctgatacatgtactctctcctgcggagctttcc

SEQ ID NO: 129090 - DNA, 35 bp, Artificial Sequence
  Synthetic oligonucleotide
gcacacacccctcactgctccgttctgggtctcgc

SEQ ID NO: 129091 - DNA, 35 bp, Artificial Sequence
  Synthetic oligonucleotide
ttcctcccctgatcgctaaagcacgccgtagcctc

SEQ ID NO: 129092 - DNA, 35 bp, Artificial Sequence
  Synthetic oligonucleotide
gcgaaccctcccggtgttatgcctacctctatctc

SEQ ID NO: 129093 - DNA, 35 bp, Artificial Sequence
  Synthetic oligonucleotide
ttcgagcaggtctacccccatagccgctccgtttc

SEQ ID NO: 129094 - DNA, 35 bp, Artificial Sequence
  Synthetic oligonucleotide
gtacgccgacagcttgcccgcctcgccacgttttc

SEQ ID NO: 129095 - DNA, 35 bp, Artificial Sequence
  Synthetic oligonucleotide
gcgctccgcaccctgttaactacgccccccagaag

SEQ ID NO: 129096 - DNA, 35 bp, Artificial Sequence
  Synthetic oligonucleotide
tatgccccatctcggtgtccttgtccccacaccgg

SEQ ID NO: 129097 - DNA, 35 bp, Artificial Sequence
  Synthetic oligonucleotide
gataggggggaggaatgatacatgagcagtcgatg

SEQ ID NO: 129098 - DNA, 35 bp, Artificial Sequence
  Synthetic oligonucleotide
tctcctgccaccacttcgcatgcgctcctcacctg

SEQ ID NO: 129099 - DNA, 35 bp, Artificial Sequence
  Synthetic oligonucleotide
gccgacacggtccgcgtattactgttcgtccatct

SEQ ID NO: 129100 - DNA, 35 bp, Artificial Sequence
  Synthetic oligonucleotide
gcacatcgaccttgtcaaccgccattagttcctgt

SEQ ID NO: 129101 - DNA, 35 bp, Artificial Sequence
  Synthetic oligonucleotide
aacgccactgctttttctgtccgccctgctctgtt

SEQ ID NO: 129102 - DNA, 36 bp, Artificial Sequence
  Synthetic oligonucleotide
gcccgctctcacccagcccgccgccgcttttcacaa

SEQ ID NO: 129103 - DNA, 36 bp, Artificial Sequence
  Synthetic oligonucleotide
actcctgctgcctcccatatgctaagtccccctaca

SEQ ID NO: 129104 - DNA, 35 bp, Artificial Sequence
  Synthetic oligonucleotide
agtgtacgccccactatccggtactttgtctccca

SEQ ID NO: 129105 - DNA, 36 bp, Artificial Sequence
  Synthetic oligonucleotide
tccaccttctgcacacacatcgccacgaccctgcca

SEQ ID NO: 129106 - DNA, 37 bp, Artificial Sequence
  Synthetic oligonucleotide
gcgaccaaggagggggggtagggtagatcaaatagga

SEQ ID NO: 129107 - DNA, 36 bp, Artificial Sequence
  Synthetic oligonucleotide
gatgtaggggcgggcgatgggcagggatgcagacta

SEQ ID NO: 129108 - DNA, 35 bp, Artificial Sequence
  Synthetic oligonucleotide
acccacaccccccgactgccgttacgtgacccgta

SEQ ID NO: 129109 - DNA, 36 bp, Artificial Sequence
  Synthetic oligonucleotide
acccaaacccaccgtgcccctcgtacaggcaatgta

SEQ ID NO: 129110 - DNA, 35 bp, Artificial Sequence
  Synthetic oligonucleotide
ttgagcatcacgctgcctaattcacgcctgtctac

SEQ ID NO: 129111 - DNA, 35 bp, Artificial Sequence
  Synthetic oligonucleotide
tccattgtccctgaccgccggttacacccttaccc

SEQ ID NO: 129112 - DNA, 35 bp, Artificial Sequence
  Synthetic oligonucleotide
tcattctacccagtgttgtcatccgatcgctgtcc

SEQ ID NO: 129113 - DNA, 35 bp, Artificial Sequence
  Synthetic oligonucleotide
gtccttccatcacatgcaccgaaccgtacccacgc

SEQ ID NO: 129114 - DNA, 35 bp, Artificial Sequence
  Synthetic oligonucleotide
aatactcacgccgcatgtcccctatcctgtttgtc

SEQ ID NO: 129115 - DNA, 35 bp, Artificial Sequence
  Synthetic oligonucleotide
actgctccatcctcaagcgtctacccacattaccg

SEQ ID NO: 129116 - DNA, 35 bp, Artificial Sequence
  Synthetic oligonucleotide
gagccctgcccacagtctcgcctaactaccccccg

SEQ ID NO: 129117 - DNA, 35 bp, Artificial Sequence
  Synthetic oligonucleotide
agtgcaagagggtcgtttggggagggcgggacgtg

SEQ ID NO: 129118 - DNA, 35 bp, Artificial Sequence
  Synthetic oligonucleotide
gctccactacaacgtcccgctgccgctccaccgat

SEQ ID NO: 129119 - DNA, 35 bp, Artificial Sequence
  Synthetic oligonucleotide
acactccccgccgattcggtgttactactatcgct

SEQ ID NO: 129120 - DNA, 36 bp, Artificial Sequence
  Synthetic oligonucleotide
ttcctacccagcgcctctttgcctccctcgcgttaa

SEQ ID NO: 129121 - DNA, 37 bp, Artificial Sequence
  Synthetic oligonucleotide
gaggagggaggggggtaggtagttcagccagcgacga

SEQ ID NO: 129122 - DNA, 36 bp, Artificial Sequence
  Synthetic oligonucleotide
gtccatccgccaatccgcgttcttgcttccatcgga

SEQ ID NO: 129123 - DNA, 37 bp, Artificial Sequence
  Synthetic oligonucleotide
tcgtgggtgtgccggggagaagtcggggtcagtggga

SEQ ID NO: 129124 - DNA, 38 bp, Artificial Sequence
  Synthetic oligonucleotide
gtgggggggaccatggaggggagtgaaggtgggactga

SEQ ID NO: 129125 - DNA, 37 bp, Artificial Sequence
  Synthetic oligonucleotide
tccccgcctatcttctgtcgctcgccctatgccttga

SEQ ID NO: 129126 - DNA, 35 bp, Artificial Sequence
  Synthetic oligonucleotide
gcccagtgcgagtactgccccacgtaacactttcc

SEQ ID NO: 129127 - DNA, 35 bp, Artificial Sequence
  Synthetic oligonucleotide
tgcccgtgctaacctggacacagacctgacccctc

SEQ ID NO: 129128 - DNA, 35 bp, Artificial Sequence
  Synthetic oligonucleotide
gcgttggcccgccccgcctcaaccttctggtattc

SEQ ID NO: 129129 - DNA, 35 bp, Artificial Sequence
  Synthetic oligonucleotide
gtcccccccatagcggactcgtacccttccttgcg

SEQ ID NO: 129130 - DNA, 35 bp, Artificial Sequence
  Synthetic oligonucleotide
gactacacccaccacgtgccacgtcacagctcttg

SEQ ID NO: 129131 - DNA, 35 bp, Artificial Sequence
  Synthetic oligonucleotide
tccaccctcggactgagcattgtttctcccaccgt

SEQ ID NO: 129132 - DNA, 35 bp, Artificial Sequence
  Synthetic oligonucleotide
acccagcctacatgtcaccgtccctccgctctggt

SEQ ID NO: 129133 - DNA, 35 bp, Artificial Sequence
  Synthetic oligonucleotide
ttaacccccccgcctgcacttttcgtaatagcctt

SEQ ID NO: 129134 - DNA, 36 bp, Artificial Sequence
  Synthetic oligonucleotide
gcgccgaccggcattcttcatccgctacccctgcca

SEQ ID NO: 129135 - DNA, 37 bp, Artificial Sequence
  Synthetic oligonucleotide
gacagaataagggagcgaggcgaagggggaggagaga

SEQ ID NO: 129136 - DNA, 35 bp, Artificial Sequence
  Synthetic oligonucleotide
ttgcccccacggtcgttttatcatttccttctgga

SEQ ID NO: 129137 - DNA, 35 bp, Artificial Sequence
  Synthetic oligonucleotide
tcgccgcctcggccctggttctatcccaccactga

SEQ ID NO: 129138 - DNA, 38 bp, Artificial Sequence
  Synthetic oligonucleotide
ttcgaacgcacaagttcctcgcaccagcccccccgtga

SEQ ID NO: 129139 - DNA, 35 bp, Artificial Sequence
  Synthetic oligonucleotide
gtacctgcctgtacgcttttgccatcctgccacta

SEQ ID NO: 129140 - DNA, 35 bp, Artificial Sequence
  Synthetic oligonucleotide
accactctccgtacgcctgccggtttctcttatac

SEQ ID NO: 129141 - DNA, 35 bp, Artificial Sequence
  Synthetic oligonucleotide
tgtgggccggcctgtcctttaatatttcgcgcacc

SEQ ID NO: 129142 - DNA, 35 bp, Artificial Sequence
  Synthetic oligonucleotide
accatacacacatcgagttgcccatcagttcccgc

SEQ ID NO: 129143 - DNA, 35 bp, Artificial Sequence
  Synthetic oligonucleotide
acatgctgtctgcattagtcaaccaccccttccgc

SEQ ID NO: 129144 - DNA, 35 bp, Artificial Sequence
  Synthetic oligonucleotide
gtactaccgcccagccttttccctccctggtaggc

SEQ ID NO: 129145 - DNA, 35 bp, Artificial Sequence
  Synthetic oligonucleotide
gtctgggtgctacccttctgcgttccttgccctgc

SEQ ID NO: 129146 - DNA, 35 bp, Artificial Sequence
  Synthetic oligonucleotide
acaccttccgccttggtgccgcccgtgccacgctc

SEQ ID NO: 129147 - DNA, 35 bp, Artificial Sequence
  Synthetic oligonucleotide
tgacgccaaccctctgcttaagaccccgcattgtc

SEQ ID NO: 129148 - DNA, 35 bp, Artificial Sequence
  Synthetic oligonucleotide
ttacccagttgcccccccttttagccacgcctccg

SEQ ID NO: 129149 - DNA, 35 bp, Artificial Sequence
  Synthetic oligonucleotide
gtggaccgccgcaccatccgccacaatagtattat

SEQ ID NO: 129150 - DNA, 35 bp, Artificial Sequence
  Synthetic oligonucleotide
gcgcggatcatcgcctggttcgtcctacctcccct

SEQ ID NO: 129151 - DNA, 35 bp, Artificial Sequence
  Synthetic oligonucleotide
gtctccaccgtcatgggtctctcgtctctctcgct

SEQ ID NO: 129152 - DNA, 35 bp, Artificial Sequence
  Synthetic oligonucleotide
gccccacagacaatgattcactgtgcctttcctct

SEQ ID NO: 129153 - DNA, 35 bp, Artificial Sequence
  Synthetic oligonucleotide
gaacatgatggagggggtgaataggggtgagacgt

SEQ ID NO: 129154 - DNA, 35 bp, Artificial Sequence
  Synthetic oligonucleotide
ggtgcgtaccacctgttggccttaacgttcccctt

SEQ ID NO: 129155 - DNA, 35 bp, Artificial Sequence
  Synthetic oligonucleotide
tgacccctcaccaggttcgatagcaacttgtcctt

SEQ ID NO: 129156 - DNA, 36 bp, Artificial Sequence
  Synthetic oligonucleotide
ttcctcccgcccgtcccactggtccacggatcttaa

SEQ ID NO: 129157 - DNA, 36 bp, Artificial Sequence
  Synthetic oligonucleotide
atggtcccgtctagacatttctgcgcctcctgttca

SEQ ID NO: 129158 - DNA, 35 bp, Artificial Sequence
  Synthetic oligonucleotide
gtggccccccttgccccattagtatctccgtagga

SEQ ID NO: 129159 - DNA, 35 bp, Artificial Sequence
  Synthetic oligonucleotide
gctgggtgggcggggtgtgcagctgatcgacggga

SEQ ID NO: 129160 - DNA, 37 bp, Artificial Sequence
  Synthetic oligonucleotide
atggccacctgaccctcctgtactcgctctcctggga

SEQ ID NO: 129161 - DNA, 36 bp, Artificial Sequence
  Synthetic oligonucleotide
ttgcccacccccgagtcttgccgcctcccccggcta

SEQ ID NO: 129162 - DNA, 35 bp, Artificial Sequence
  Synthetic oligonucleotide
gcgagggaagagaggtatggggtagggtgagcgta

SEQ ID NO: 129163 - DNA, 35 bp, Artificial Sequence
  Synthetic oligonucleotide
tacgccccacacccgttcctgttacatcacgttta

SEQ ID NO: 129164 - DNA, 35 bp, Artificial Sequence
  Synthetic oligonucleotide
gcgtgactcatcgggtctcatgcaactgcttccac

SEQ ID NO: 129165 - DNA, 35 bp, Artificial Sequence
  Synthetic oligonucleotide
aattccttcaccgccgccctccgattctcgcgacc

SEQ ID NO: 129166 - DNA, 35 bp, Artificial Sequence
  Synthetic oligonucleotide
tgcatctaaacgcagatgtactgttccccccgccc

SEQ ID NO: 129167 - DNA, 35 bp, Artificial Sequence
  Synthetic oligonucleotide
tcgccaacctgaacattcgaccgccaacacttcgc

SEQ ID NO: 129168 - DNA, 34 bp, Artificial Sequence
  Synthetic oligonucleotide
tgccacacggatcgccgcatctcccgttacttgc

SEQ ID NO: 129169 - DNA, 35 bp, Artificial Sequence
  Synthetic oligonucleotide
gactacacaccattccaattagcagactcccttgc

SEQ ID NO: 129170 - DNA, 33 bp, Artificial Sequence
  Synthetic oligonucleotide
gcccccgtccacgggaaccgagccgcctccctt

SEQ ID NO: 129171 - DNA, 36 bp, Artificial Sequence
  Synthetic oligonucleotide
tacgtcacctgcattacctccctccgcctagtcaca

SEQ ID NO: 129172 - DNA, 36 bp, Artificial Sequence
  Synthetic oligonucleotide
tccgcctcagccattccgtactgtaactccggccca

SEQ ID NO: 129173 - DNA, 36 bp, Artificial Sequence
  Synthetic oligonucleotide
gtccttaccagccccgcccatcccgttccggatcca

SEQ ID NO: 129174 - DNA, 36 bp, Artificial Sequence
  Synthetic oligonucleotide
tgccacgccccgcccgctcattctgttttcgaccga

SEQ ID NO: 129175 - DNA, 36 bp, Artificial Sequence
  Synthetic oligonucleotide
tgtatgtcaactcggtcttgaaccaccctctccgga

SEQ ID NO: 129176 - DNA, 36 bp, Artificial Sequence
  Synthetic oligonucleotide
ttgtaactggtggacgggagggggcaagggggcgga

SEQ ID NO: 129177 - DNA, 35 bp, Artificial Sequence
  Synthetic oligonucleotide
agtggacggtagtaggggggccacggaagaaggga

SEQ ID NO: 129178 - DNA, 37 bp, Artificial Sequence
  Synthetic oligonucleotide
gagacaggaggaagggtcacgggagggggcgcaggga

SEQ ID NO: 129179 - DNA, 38 bp, Artificial Sequence
  Synthetic oligonucleotide
aagaaggggcaatggggggggcgaagttgagggagtga

SEQ ID NO: 129180 - DNA, 35 bp, Artificial Sequence
  Synthetic oligonucleotide
tccaccttcccctacgtggttattggttcacttga

SEQ ID NO: 129181 - DNA, 38 bp, Artificial Sequence
  Synthetic oligonucleotide
tggaccccgccccccgtgtaatttcacccccgtgttga

SEQ ID NO: 129182 - DNA, 35 bp, Artificial Sequence
  Synthetic oligonucleotide
acctcctccgaacagctgcctcgccggcttcccta

SEQ ID NO: 129183 - DNA, 35 bp, Artificial Sequence
  Synthetic oligonucleotide
ggtactgccgcttgtccctcgcctaatttacgccc

SEQ ID NO: 129184 - DNA, 35 bp, Artificial Sequence
  Synthetic oligonucleotide
tcacagaccgcccactgttcggccgaactgcctcc

SEQ ID NO: 129185 - DNA, 35 bp, Artificial Sequence
  Synthetic oligonucleotide
tgagttcccctcctgtattgttgcttacgaattcc

SEQ ID NO: 129186 - DNA, 35 bp, Artificial Sequence
  Synthetic oligonucleotide
agaggataaacgggagggacggaacgaagcggggc

SEQ ID NO: 129187 - DNA, 35 bp, Artificial Sequence
  Synthetic oligonucleotide
tcacgccaccgcattagtggttcccatcccccttc

SEQ ID NO: 129188 - DNA, 35 bp, Artificial Sequence
  Synthetic oligonucleotide
gcccatcccagacaattatatctagcctcatctcg

SEQ ID NO: 129189 - DNA, 35 bp, Artificial Sequence
  Synthetic oligonucleotide
tcgaccctccgcctgttattagcctgttcttccgg

SEQ ID NO: 129190 - DNA, 35 bp, Artificial Sequence
  Synthetic oligonucleotide
tcctggcccttcgcagagcccccccgcactcctgt

SEQ ID NO: 129191 - DNA, 36 bp, Artificial Sequence
  Synthetic oligonucleotide
tccacccctgttttacgccttatccctgaggtataa

SEQ ID NO: 129192 - DNA, 35 bp, Artificial Sequence
  Synthetic oligonucleotide
tccctccggggagggttatgggtgggtatcctgca

SEQ ID NO: 129193 - DNA, 37 bp, Artificial Sequence
  Synthetic oligonucleotide
gagtagtgtccgcgtgggcatgggtgggggggggcga

SEQ ID NO: 129194 - DNA, 38 bp, Artificial Sequence
  Synthetic oligonucleotide
gtcgccgtacaattggcctatcatccacccgctgctga

SEQ ID NO: 129195 - DNA, 35 bp, Artificial Sequence
  Synthetic oligonucleotide
acccacctccacgcatcaagccccgcctgcggtga

SEQ ID NO: 129196 - DNA, 35 bp, Artificial Sequence
  Synthetic oligonucleotide
tagcacccccggacgcaattttggccattacctac

SEQ ID NO: 129197 - DNA, 35 bp, Artificial Sequence
  Synthetic oligonucleotide
gccccgccccggatagtgcgaccagtgccgtaccc

SEQ ID NO: 129198 - DNA, 35 bp, Artificial Sequence
  Synthetic oligonucleotide
tcccgcagggcacagcttcaccgcctgctcgcccc

SEQ ID NO: 129199 - DNA, 35 bp, Artificial Sequence
  Synthetic oligonucleotide
atcacccacgagtactgtgggttctttgttatccc

SEQ ID NO: 129200 - DNA, 35 bp, Artificial Sequence
  Synthetic oligonucleotide
gttagacacgcactctgctctgacctccctccgcc

SEQ ID NO: 129201 - DNA, 35 bp, Artificial Sequence
  Synthetic oligonucleotide
gcgaggtaagttcgttcgcacctgtccttctcgcc

SEQ ID NO: 129202 - DNA, 35 bp, Artificial Sequence
  Synthetic oligonucleotide
gaacccacgaatgaagcgaatagcgcacctcccgc

SEQ ID NO: 129203 - DNA, 35 bp, Artificial Sequence
  Synthetic oligonucleotide
gtccgtggtgggtggaggtatgggaggaggggatg

SEQ ID NO: 129204 - DNA, 35 bp, Artificial Sequence
  Synthetic oligonucleotide
acacccccgtatcatgctgatgtcccttgccattg

SEQ ID NO: 129205 - DNA, 34 bp, Artificial Sequence
  Synthetic oligonucleotide
gccgtaggcggcttgcagttatcccccccttgtt

SEQ ID NO: 129206 - DNA, 35 bp, Artificial Sequence
  Synthetic oligonucleotide
tgagacggcaaggggaaaaaggtggctcgggggaa

SEQ ID NO: 129207 - DNA, 36 bp, Artificial Sequence
  Synthetic oligonucleotide
gctgtaagtatccatcccccttccgtgttcccggca

SEQ ID NO: 129208 - DNA, 37 bp, Artificial Sequence
  Synthetic oligonucleotide
tctcgccctgattgcgtccatgccttccactcgccga

SEQ ID NO: 129209 - DNA, 37 bp, Artificial Sequence
  Synthetic oligonucleotide
atcgttccgcccaacctcgcctccagtcgcgtatcga

SEQ ID NO: 129210 - DNA, 36 bp, Artificial Sequence
  Synthetic oligonucleotide
gcggaggtgggtggggaggcgcgagggtgtggggga

SEQ ID NO: 129211 - DNA, 36 bp, Artificial Sequence
  Synthetic oligonucleotide
gtgtccctcttgctgcctccgtgtctcctctcgtga

SEQ ID NO: 129212 - DNA, 35 bp, Artificial Sequence
  Synthetic oligonucleotide
tcaccatctcaattgccacgagttcacctgctaac

SEQ ID NO: 129213 - DNA, 35 bp, Artificial Sequence
  Synthetic oligonucleotide
gcctccctatgatcgcgctacctgacttacttgac

SEQ ID NO: 129214 - DNA, 35 bp, Artificial Sequence
  Synthetic oligonucleotide
tgcaggtgccggtgccgccgcttattcctccaccc

SEQ ID NO: 129215 - DNA, 35 bp, Artificial Sequence
  Synthetic oligonucleotide
caacaaccccagcgtgccgtcaccccggaccccgc

SEQ ID NO: 129216 - DNA, 35 bp, Artificial Sequence
  Synthetic oligonucleotide
gaccgtcctgccagtgcaacgtgttccgtcgccgc

SEQ ID NO: 129217 - DNA, 35 bp, Artificial Sequence
  Synthetic oligonucleotide
gtcccgttcctatcctgcttaacacagcttccggc

SEQ ID NO: 129218 - DNA, 35 bp, Artificial Sequence
  Synthetic oligonucleotide
tccgtgcccgacccccccgttgccctccgtatggg

SEQ ID NO: 129219 - DNA, 35 bp, Artificial Sequence
  Synthetic oligonucleotide
acgtacaccagcgcgctctcggcttccccctccat

SEQ ID NO: 129220 - DNA, 35 bp, Artificial Sequence
  Synthetic oligonucleotide
gtgttccgcctgtctaccctccgaagcacacccct

SEQ ID NO: 129221 - DNA, 35 bp, Artificial Sequence
  Synthetic oligonucleotide
aacgcaaagcgcgctccgcccccgttcgatctcct

SEQ ID NO: 129222 - DNA, 35 bp, Artificial Sequence
  Synthetic oligonucleotide
tcttaccaccaccctccgtaaagagatcgttcgct

SEQ ID NO: 129223 - DNA, 35 bp, Artificial Sequence
  Synthetic oligonucleotide
aactaaccaggccgtcctcctgcgctcctatccgt

SEQ ID NO: 129224 - DNA, 35 bp, Artificial Sequence
  Synthetic oligonucleotide
tccgacacccccctcacgcgcaccggaaccatggt

SEQ ID NO: 129225 - DNA, 35 bp, Artificial Sequence
  Synthetic oligonucleotide
gtgcttagcctcccttgtttccctgtgcctcacaa

SEQ ID NO: 129226 - DNA, 36 bp, Artificial Sequence
  Synthetic oligonucleotide
gactccccgtagctctgtacctgtttcccattccaa

SEQ ID NO: 129227 - DNA, 36 bp, Artificial Sequence
  Synthetic oligonucleotide
tgttggttgagggagggaggaaggagggaagggtga

SEQ ID NO: 129228 - DNA, 35 bp, Artificial Sequence
  Synthetic oligonucleotide
ttcgacgcatctttcgcgtttttgcctttctgtta

SEQ ID NO: 129229 - DNA, 35 bp, Artificial Sequence
  Synthetic oligonucleotide
tggtctaccacagtcgctctcctccgttaccttac

SEQ ID NO: 129230 - DNA, 35 bp, Artificial Sequence
  Synthetic oligonucleotide
accctccgctccttccccgatacgggttaacgacc

SEQ ID NO: 129231 - DNA, 35 bp, Artificial Sequence
  Synthetic oligonucleotide
gacacccccccctgctgcatatgtctcggctcccc

SEQ ID NO: 129232 - DNA, 35 bp, Artificial Sequence
  Synthetic oligonucleotide
ggaggggccaacggggatacatggatgaggtggag

SEQ ID NO: 129233 - DNA, 35 bp, Artificial Sequence
  Synthetic oligonucleotide
atcaccctcgactattggcaaaatgcatacccccg

SEQ ID NO: 129234 - DNA, 35 bp, Artificial Sequence
  Synthetic oligonucleotide
gtctgtgctgaccgtgtcctccttctttgtccccg

SEQ ID NO: 129235 - DNA, 35 bp, Artificial Sequence
  Synthetic oligonucleotide
atgcctcactgctcgcgctattactgtccttctat

SEQ ID NO: 129236 - DNA, 35 bp, Artificial Sequence
  Synthetic oligonucleotide
tgatcgttcgcgcaagttcattattgcccctccct

SEQ ID NO: 129237 - DNA, 37 bp, Artificial Sequence
  Synthetic oligonucleotide
accgcgacatcgcccacttattcctgcccctgcacga

SEQ ID NO: 129238 - DNA, 37 bp, Artificial Sequence
  Synthetic oligonucleotide
acgcccccctacaatgttgcatcccttcctgtcatga

SEQ ID NO: 129239 - DNA, 36 bp, Artificial Sequence
  Synthetic oligonucleotide
tatgagagggaagggaggccccggccaaggggatga

SEQ ID NO: 129240 - DNA, 38 bp, Artificial Sequence
  Synthetic oligonucleotide
tgccccagccatccgcttctcccctgtagaccctgtga

SEQ ID NO: 129241 - DNA, 35 bp, Artificial Sequence
  Synthetic oligonucleotide
acccgccctcgcctgcttgtctacgcttccggtac

SEQ ID NO: 129242 - DNA, 35 bp, Artificial Sequence
  Synthetic oligonucleotide
gtgtgtcgcgacctccgccctcattccactggccc

SEQ ID NO: 129243 - DNA, 35 bp, Artificial Sequence
  Synthetic oligonucleotide
gcagaccagcatgcatatgttcttatcctcgcctc

SEQ ID NO: 129244 - DNA, 35 bp, Artificial Sequence
  Synthetic oligonucleotide
gaggcacccgcgccctcatccctgttctactgctg

SEQ ID NO: 129245 - DNA, 35 bp, Artificial Sequence
  Synthetic oligonucleotide
ttcccgccgccttgccttcgcactctatcgaacat

SEQ ID NO: 129246 - DNA, 35 bp, Artificial Sequence
  Synthetic oligonucleotide
acacgcacccggttctgcatctccgcgtgttcttt

SEQ ID NO: 129247 - DNA, 36 bp, Artificial Sequence
  Synthetic oligonucleotide
tcacgcccgccctgtattctccccgttctatccaaa

SEQ ID NO: 129248 - DNA, 36 bp, Artificial Sequence
  Synthetic oligonucleotide
gcccggtcgccgttgagcgttcgcttccctcttaca

SEQ ID NO: 129249 - DNA, 36 bp, Artificial Sequence
  Synthetic oligonucleotide
acctccctacgcctcagttttatgttcctgcaccca

SEQ ID NO: 129250 - DNA, 37 bp, Artificial Sequence
  Synthetic oligonucleotide
ttgatacccgctccaatggtttgctcctctccttaga

SEQ ID NO: 129251 - DNA, 38 bp, Artificial Sequence
  Synthetic oligonucleotide
atgcgggtagggaggcggggattggcatcagggtgtga

SEQ ID NO: 129252 - DNA, 36 bp, Artificial Sequence
  Synthetic oligonucleotide
acgtcgagccgcaccatcgtccataccaacaccgta

SEQ ID NO: 129253 - DNA, 35 bp, Artificial Sequence
  Synthetic oligonucleotide
tcatcctcctctagtcgttcttttatccgggtcac

SEQ ID NO: 129254 - DNA, 35 bp, Artificial Sequence
  Synthetic oligonucleotide
tgtcccatccacaccgcacacctcgcttgtgtcac

SEQ ID NO: 129255 - DNA, 35 bp, Artificial Sequence
  Synthetic oligonucleotide
gcccctccccgcataatggcttgacgaaagcctcc

SEQ ID NO: 129256 - DNA, 35 bp, Artificial Sequence
  Synthetic oligonucleotide
taccccgcttgctgcctgatcccattgtcacccgc

SEQ ID NO: 129257 - DNA, 35 bp, Artificial Sequence
  Synthetic oligonucleotide
gtccaccgaaccacttgtacacgggtttccctcgc

SEQ ID NO: 129258 - DNA, 35 bp, Artificial Sequence
  Synthetic oligonucleotide
tgccaggctccctttatgctagcgattacaccttc

SEQ ID NO: 129259 - DNA, 35 bp, Artificial Sequence
  Synthetic oligonucleotide
gagggacaacgggggactaagggggcaaaagtaag

SEQ ID NO: 129260 - DNA, 35 bp, Artificial Sequence
  Synthetic oligonucleotide
acccactgcccctcccctacctctcgtttcgcggt

SEQ ID NO: 129261 - DNA, 35 bp, Artificial Sequence
  Synthetic oligonucleotide
acgccccctcgcattctctcgggctggctttacca

SEQ ID NO: 129262 - DNA, 36 bp, Artificial Sequence
  Synthetic oligonucleotide
gggtacgtccgccctctgtctaccgcacacgcctca

SEQ ID NO: 129263 - DNA, 36 bp, Artificial Sequence
  Synthetic oligonucleotide
gacgcccataggatataggtccgcccgccctccaga

SEQ ID NO: 129264 - DNA, 37 bp, Artificial Sequence
  Synthetic oligonucleotide
tgcccaaccctcgagttccctggccattgctttacga

SEQ ID NO: 129265 - DNA, 35 bp, Artificial Sequence
  Synthetic oligonucleotide
gcgtgcccggacacccgttcttcttcttccgccga

SEQ ID NO: 129266 - DNA, 37 bp, Artificial Sequence
  Synthetic oligonucleotide
gtcaacacccggcaggtcaacgcgcacccactctcga

SEQ ID NO: 129267 - DNA, 35 bp, Artificial Sequence
  Synthetic oligonucleotide
agacggagaaggggcggagcgatagggacgaggga

SEQ ID NO: 129268 - DNA, 37 bp, Artificial Sequence
  Synthetic oligonucleotide
aggggaggcgggcgggggaatggaggtttttggggga

SEQ ID NO: 129269 - DNA, 37 bp, Artificial Sequence
  Synthetic oligonucleotide
tctcagccgctttttcttgtctttcgcctcctctgga

SEQ ID NO: 129270 - DNA, 38 bp, Artificial Sequence
  Synthetic oligonucleotide
gcgaggaggcgagggcggagagggtgggaagatagtga

SEQ ID NO: 129271 - DNA, 37 bp, Artificial Sequence
  Synthetic oligonucleotide
acgcggtttgggcgggtggtggaagggggggtggtga

SEQ ID NO: 129272 - DNA, 35 bp, Artificial Sequence
  Synthetic oligonucleotide
ggacaacacctagggtgctgtttgtttccttcccc

SEQ ID NO: 129273 - DNA, 35 bp, Artificial Sequence
  Synthetic oligonucleotide
atgtctgcgcacaactatgcttctctgctccagcc

SEQ ID NO: 129274 - DNA, 33 bp, Artificial Sequence
  Synthetic oligonucleotide
gtgggaggaatgcgggggggggaatcacggaat

SEQ ID NO: 129275 - DNA, 36 bp, Artificial Sequence
  Synthetic oligonucleotide
accacctgccgccgccacgcctcttttgctcctaca

SEQ ID NO: 129276 - DNA, 36 bp, Artificial Sequence
  Synthetic oligonucleotide
accaaccccaccccgcgcgcacactacgctgcagca

SEQ ID NO: 129277 - DNA, 36 bp, Artificial Sequence
  Synthetic oligonucleotide
gagggcggtggaacggagacggagggagcgtgtaga

SEQ ID NO: 129278 - DNA, 37 bp, Artificial Sequence
  Synthetic oligonucleotide
tgcacccgccctcgcccttccacgggagttttgacga

SEQ ID NO: 129279 - DNA, 37 bp, Artificial Sequence
  Synthetic oligonucleotide
taacaacgtatgctatcccctcacgccctgccctcga

SEQ ID NO: 129280 - DNA, 38 bp, Artificial Sequence
  Synthetic oligonucleotide
gacgccctagccgtccgcacgttttccatcgtacctga

SEQ ID NO: 129281 - DNA, 38 bp, Artificial Sequence
  Synthetic oligonucleotide
tcgtgggggaggtacgggggaagggtaagaacgggtga

SEQ ID NO: 129282 - DNA, 35 bp, Artificial Sequence
  Synthetic oligonucleotide
gaccatgctctgcacctgggtactatcctccttga

SEQ ID NO: 129283 - DNA, 35 bp, Artificial Sequence
  Synthetic oligonucleotide
tccgcaccctcatcttcttcagctgctatgggccc

SEQ ID NO: 129284 - DNA, 35 bp, Artificial Sequence
  Synthetic oligonucleotide
ccactacccctttcgatgtcttatcgcccagttcc

SEQ ID NO: 129285 - DNA, 35 bp, Artificial Sequence
  Synthetic oligonucleotide
tcaaccactcgttgctcttatagtctttcctactc

SEQ ID NO: 129286 - DNA, 35 bp, Artificial Sequence
  Synthetic oligonucleotide
aatccgcgcccccttttgtcggttcacgaattttc

SEQ ID NO: 129287 - DNA, 35 bp, Artificial Sequence
  Synthetic oligonucleotide
tagccactcgtgctctacaacattatgcctccccg

SEQ ID NO: 129288 - DNA, 35 bp, Artificial Sequence
  Synthetic oligonucleotide
ggaccctccccgctgaaaagttcacctaccgcccg

SEQ ID NO: 129289 - DNA, 35 bp, Artificial Sequence
  Synthetic oligonucleotide
tccaccgcacccacgtttttgcgccatccatctat

SEQ ID NO: 129290 - DNA, 35 bp, Artificial Sequence
  Synthetic oligonucleotide
acgactcatctcgcaccgacgcccgacccagccct

SEQ ID NO: 129291 - DNA, 35 bp, Artificial Sequence
  Synthetic oligonucleotide
acatccccgcctagacgagtattgactccgtctct

SEQ ID NO: 129292 - DNA, 35 bp, Artificial Sequence
  Synthetic oligonucleotide
tccagcatccactcttccgccgtcatcacagctgt

SEQ ID NO: 129293 - DNA, 36 bp, Artificial Sequence
  Synthetic oligonucleotide
atgggggggaggagggggatcgactacgtatccgaa

SEQ ID NO: 129294 - DNA, 35 bp, Artificial Sequence
  Synthetic oligonucleotide
gggggtaaagggggggtaagtgggcggtcgtataa

SEQ ID NO: 129295 - DNA, 35 bp, Artificial Sequence
  Synthetic oligonucleotide
gttgcaccgcccaggttttgcctctgtccccaaca

SEQ ID NO: 129296 - DNA, 36 bp, Artificial Sequence
  Synthetic oligonucleotide
gacccccctcaactcgactcgagaagtcgctttgca

SEQ ID NO: 129297 - DNA, 36 bp, Artificial Sequence
  Synthetic oligonucleotide
tccgtcgcccctcgtgctgcacggtaactttactca

SEQ ID NO: 129298 - DNA, 37 bp, Artificial Sequence
  Synthetic oligonucleotide
actacgtcaaagggccggggagggaggggcgccgcga

SEQ ID NO: 129299 - DNA, 36 bp, Artificial Sequence
  Synthetic oligonucleotide
ttaggggggaggacgagctgaaacgggagggcgcga

SEQ ID NO: 129300 - DNA, 36 bp, Artificial Sequence
  Synthetic oligonucleotide
gagagctgcgaaagaggggggaatgggaagcgggga

SEQ ID NO: 129301 - DNA, 38 bp, Artificial Sequence
  Synthetic oligonucleotide
ttggggcgcctgggggtttaggggttgctgggaattga

SEQ ID NO: 129302 - DNA, 36 bp, Artificial Sequence
  Synthetic oligonucleotide
accggtgcgaccctccgtgctctcctccgcccttga

SEQ ID NO: 129303 - DNA, 38 bp, Artificial Sequence
  Synthetic oligonucleotide
tgcgacacctctgtgcgtccattcgcctccttcgttga

SEQ ID NO: 129304 - DNA, 36 bp, Artificial Sequence
  Synthetic oligonucleotide
gaccgtccatcgactcgcacacactgctttttcata

SEQ ID NO: 129305 - DNA, 35 bp, Artificial Sequence
  Synthetic oligonucleotide
gtcgggggaccgctctgtccgcattccatccttac

SEQ ID NO: 129306 - DNA, 35 bp, Artificial Sequence
  Synthetic oligonucleotide
tctcattccgcctccagggtttttcccagctttac

SEQ ID NO: 129307 - DNA, 35 bp, Artificial Sequence
  Synthetic oligonucleotide
tacctcgccggccttgctatctttaacacttcacg

SEQ ID NO: 129308 - DNA, 35 bp, Artificial Sequence
  Synthetic oligonucleotide
gtctatccctgttgctctatacagttcctgtttcg

SEQ ID NO: 129309 - DNA, 35 bp, Artificial Sequence
  Synthetic oligonucleotide
agtgacacctcagctagcttggcatcttcccctgt

SEQ ID NO: 129310 - DNA, 35 bp, Artificial Sequence
  Synthetic oligonucleotide
gagatccacgactctgacggtttccttagcccttt

SEQ ID NO: 129311 - DNA, 36 bp, Artificial Sequence
  Synthetic oligonucleotide
actgtaggggggcgggcgagggcgcaagaatagcaa

SEQ ID NO: 129312 - DNA, 35 bp, Artificial Sequence
  Synthetic oligonucleotide
tacgtacgacccacatgccaacttcgaaccttcaa

SEQ ID NO: 129313 - DNA, 36 bp, Artificial Sequence
  Synthetic oligonucleotide
gcgacggcccccgcttccacctgttttcatggcaca

SEQ ID NO: 129314 - DNA, 36 bp, Artificial Sequence
  Synthetic oligonucleotide
acgttcgccgttgctatctgccttttcagcccgcca

SEQ ID NO: 129315 - DNA, 36 bp, Artificial Sequence
  Synthetic oligonucleotide
tccccccgccgatatatatttccttgttctgtagca

SEQ ID NO: 129316 - DNA, 37 bp, Artificial Sequence
  Synthetic oligonucleotide
gcacgggtgggagtggagggaaggacagctgttagga

SEQ ID NO: 129317 - DNA, 37 bp, Artificial Sequence
  Synthetic oligonucleotide
tcctgtcatcagtcttttccctgtctcccctcctgga

SEQ ID NO: 129318 - DNA, 37 bp, Artificial Sequence
  Synthetic oligonucleotide
tcacacagcctctgccgcctgctttaccgtgccctga

SEQ ID NO: 129319 - DNA, 37 bp, Artificial Sequence
  Synthetic oligonucleotide
tcacccgcctttccccctacatatccagtccaagtga

SEQ ID NO: 129320 - DNA, 37 bp, Artificial Sequence
  Synthetic oligonucleotide
ttcaccacctcacgacgctctccaaccacccgtgtga

SEQ ID NO: 129321 - DNA, 37 bp, Artificial Sequence
  Synthetic oligonucleotide
acgcgtgcctcctgacccttttcagccgcccttttga

SEQ ID NO: 129322 - DNA, 36 bp, Artificial Sequence
  Synthetic oligonucleotide
acgttacgcccgcaccgctcccgacccctgcccata

SEQ ID NO: 129323 - DNA, 36 bp, Artificial Sequence
  Synthetic oligonucleotide
tgaggtgcgttttgtgtctttgccccccgcccccta

SEQ ID NO: 129324 - DNA, 36 bp, Artificial Sequence
  Synthetic oligonucleotide
agttagccccagcggttatacccgtctcacctctta

SEQ ID NO: 129325 - DNA, 35 bp, Artificial Sequence
  Synthetic oligonucleotide
gacgccgcctgacgaaccctccttcctccccgccc

SEQ ID NO: 129326 - DNA, 35 bp, Artificial Sequence
  Synthetic oligonucleotide
gaatgatgctcgggcggggggggcatgggtgttcc

SEQ ID NO: 129327 - DNA, 35 bp, Artificial Sequence
  Synthetic oligonucleotide
gcccctccctgccctacacactgtcaacgagcagc

SEQ ID NO: 129328 - DNA, 35 bp, Artificial Sequence
  Synthetic oligonucleotide
taagccgcccgccgacaccattggttctcatctgc

SEQ ID NO: 129329 - DNA, 35 bp, Artificial Sequence
  Synthetic oligonucleotide
acctgtcccgtccctgacgtatctctcggtcaatc

SEQ ID NO: 129330 - DNA, 35 bp, Artificial Sequence
  Synthetic oligonucleotide
tgattcctgccgcacgatcattccctctcctcatc

SEQ ID NO: 129331 - DNA, 35 bp, Artificial Sequence
  Synthetic oligonucleotide
tatgtcctccttccagcattcccctttgggctatc

SEQ ID NO: 129332 - DNA, 35 bp, Artificial Sequence
  Synthetic oligonucleotide
tcacgtctgccccccctgttcatgagcgaaacccg

SEQ ID NO: 129333 - DNA, 35 bp, Artificial Sequence
  Synthetic oligonucleotide
ggttggcggggggcaaggcaaggaaagttggaagg

SEQ ID NO: 129334 - DNA, 35 bp, Artificial Sequence
  Synthetic oligonucleotide
aactcacgtaaggtccatcgttcccctccctttgg

SEQ ID NO: 129335 - DNA, 35 bp, Artificial Sequence
  Synthetic oligonucleotide
tactgccccacttgtcgttgctcgagtgctttcat

SEQ ID NO: 129336 - DNA, 35 bp, Artificial Sequence
  Synthetic oligonucleotide
tgcaccactctgcccttttcgttactctgctccct

SEQ ID NO: 129337 - DNA, 35 bp, Artificial Sequence
  Synthetic oligonucleotide
gcccgtgcgttctcctcccttccgccaagctcgct

SEQ ID NO: 129338 - DNA, 34 bp, Artificial Sequence
  Synthetic oligonucleotide
tcccccacgaccccctgtagcggactttgtcgct

SEQ ID NO: 129339 - DNA, 35 bp, Artificial Sequence
  Synthetic oligonucleotide
gaggtgcgccgtgcaccgttcctacattgtcctgt

SEQ ID NO: 129340 - DNA, 35 bp, Artificial Sequence
  Synthetic oligonucleotide
accatccagtcgtgctgtctccatctcccccactt

SEQ ID NO: 129341 - DNA, 35 bp, Artificial Sequence
  Synthetic oligonucleotide
gtggacccgccgccccctgtgtaacgatctttcca

SEQ ID NO: 129342 - DNA, 37 bp, Artificial Sequence
  Synthetic oligonucleotide
tgcccctcccgatataggtatccatgcctcactccga

SEQ ID NO: 129343 - DNA, 37 bp, Artificial Sequence
  Synthetic oligonucleotide
gccccccctcaattccacgtacgtccttcctacagga

SEQ ID NO: 129344 - DNA, 35 bp, Artificial Sequence
  Synthetic oligonucleotide
tcgcaccgccatgacacttttccgcccgccacata

SEQ ID NO: 129345 - DNA, 36 bp, Artificial Sequence
  Synthetic oligonucleotide
gtgaacaaaggcaaggaggaaaacgatgaaggggta

SEQ ID NO: 129346 - DNA, 35 bp, Artificial Sequence
  Synthetic oligonucleotide
gttcgtacctccccgcactgcctcagtggcctacc

SEQ ID NO: 129347 - DNA, 35 bp, Artificial Sequence
  Synthetic oligonucleotide
gtgcggaaacgccatttttcgtcttactctagccc

SEQ ID NO: 129348 - DNA, 35 bp, Artificial Sequence
  Synthetic oligonucleotide
gcccaccacgtgtgtacctctagcctttccatgcc

SEQ ID NO: 129349 - DNA, 35 bp, Artificial Sequence
  Synthetic oligonucleotide
tcttgcctccgcaggtttcattgccgaatcgccgc

SEQ ID NO: 129350 - DNA, 35 bp, Artificial Sequence
  Synthetic oligonucleotide
tcaagcccctctatgcggtccctctcacaattctg

SEQ ID NO: 129351 - DNA, 35 bp, Artificial Sequence
  Synthetic oligonucleotide
tgagtacccgctccaccatacattgccttggccat

SEQ ID NO: 129352 - DNA, 35 bp, Artificial Sequence
  Synthetic oligonucleotide
gtgggacgggggggatagggcaagatatgcccatt

SEQ ID NO: 129353 - DNA, 35 bp, Artificial Sequence
  Synthetic oligonucleotide
tatacccactcgcctctaccattctcaggagactt

SEQ ID NO: 129354 - DNA, 35 bp, Artificial Sequence
  Synthetic oligonucleotide
acgctggcttccaatgtccaatgcccaccgcacca

SEQ ID NO: 129355 - DNA, 35 bp, Artificial Sequence
  Synthetic oligonucleotide
gacccccccctctatgccttctcgtggctccatca

SEQ ID NO: 129356 - DNA, 37 bp, Artificial Sequence
  Synthetic oligonucleotide
gatgaacgcaagggcgggtgttaggggggggagagga

SEQ ID NO: 129357 - DNA, 36 bp, Artificial Sequence
  Synthetic oligonucleotide
gttcgcgagcggacgggggattggggtaggggagga

SEQ ID NO: 129358 - DNA, 37 bp, Artificial Sequence
  Synthetic oligonucleotide
catgggggtttgctgtcgttcccgggtggggcgggga

SEQ ID NO: 129359 - DNA, 37 bp, Artificial Sequence
  Synthetic oligonucleotide
ttatgtcgtacgggtggtggagggcgggcggggtgga

SEQ ID NO: 129360 - DNA, 38 bp, Artificial Sequence
  Synthetic oligonucleotide
acgctcccgctaccactcctcgtccccggatgacctga

SEQ ID NO: 129361 - DNA, 37 bp, Artificial Sequence
  Synthetic oligonucleotide
agacgctcagcacacgcgcgaactagcctttccctga

SEQ ID NO: 129362 - DNA, 35 bp, Artificial Sequence
  Synthetic oligonucleotide
gtcgcccctagctgtttttaggtcactaatccgcc

SEQ ID NO: 129363 - DNA, 35 bp, Artificial Sequence
  Synthetic oligonucleotide
tagtccccccctatgagtgaatcatggtgcccctc

SEQ ID NO: 129364 - DNA, 36 bp, Artificial Sequence
  Synthetic oligonucleotide
atggtggggagagggagggtcagggagctagagtag

SEQ ID NO: 129365 - DNA, 35 bp, Artificial Sequence
  Synthetic oligonucleotide
gctaagcccatcacttgtccctctcgattcgtacg

SEQ ID NO: 129366 - DNA, 35 bp, Artificial Sequence
  Synthetic oligonucleotide
tcaactgcactatcgaccgctccacgtctattccg

SEQ ID NO: 129367 - DNA, 35 bp, Artificial Sequence
  Synthetic oligonucleotide
atccaaccacctcattgattccaccgaatttatcg

SEQ ID NO: 129368 - DNA, 35 bp, Artificial Sequence
  Synthetic oligonucleotide
tctgcgatcccggttcgtcttacacttgtcccttg

SEQ ID NO: 129369 - DNA, 35 bp, Artificial Sequence
  Synthetic oligonucleotide
gaccgtaggagcggtattctctgtctgtcccccat

SEQ ID NO: 129370 - DNA, 35 bp, Artificial Sequence
  Synthetic oligonucleotide
agcacgcacacagactctggccttctcctcacttt

SEQ ID NO: 129371 - DNA, 37 bp, Artificial Sequence
  Synthetic oligonucleotide
tgtacatccgacgttatcccctgtccccctgatctga

SEQ ID NO: 129372 - DNA, 35 bp, Artificial Sequence
  Synthetic oligonucleotide
tcacctttccatcgttcatcagccatggtcttcac

SEQ ID NO: 129373 - DNA, 35 bp, Artificial Sequence
  Synthetic oligonucleotide
gtagcggtccattgcctatgctgctaactgctccc

SEQ ID NO: 129374 - DNA, 35 bp, Artificial Sequence
  Synthetic oligonucleotide
gctctgtcctgtcgcgcactttgcttacaccgctc

SEQ ID NO: 129375 - DNA, 35 bp, Artificial Sequence
  Synthetic oligonucleotide
acataggctcgcactcggtcattccactgcttctc

SEQ ID NO: 129376 - DNA, 35 bp, Artificial Sequence
  Synthetic oligonucleotide
acgatcaccccccccactcgcccaggatcgtgttc

SEQ ID NO: 129377 - DNA, 35 bp, Artificial Sequence
  Synthetic oligonucleotide
tcattcgcatccttgtggtaacccgttcttcctcg

SEQ ID NO: 129378 - DNA, 34 bp, Artificial Sequence
  Synthetic oligonucleotide
agtcgaccgaggggggaggagggttggggtaagg

SEQ ID NO: 129379 - DNA, 35 bp, Artificial Sequence
  Synthetic oligonucleotide
ttcaacgccccgccgatactcaatcctgcctgtgg

SEQ ID NO: 129380 - DNA, 35 bp, Artificial Sequence
  Synthetic oligonucleotide
accaccctgcagggacgggtgggtgggtgacactg

SEQ ID NO: 129381 - DNA, 35 bp, Artificial Sequence
  Synthetic oligonucleotide
cttacggcgtatcacaccgcacctgccgcctgcct

SEQ ID NO: 129382 - DNA, 35 bp, Artificial Sequence
  Synthetic oligonucleotide
tccaactcgccgacgcctttcctacaatgctgttt

SEQ ID NO: 129383 - DNA, 36 bp, Artificial Sequence
  Synthetic oligonucleotide
ggaacacggtggaggaaggcttcgaaagggaggaaa

SEQ ID NO: 129384 - DNA, 35 bp, Artificial Sequence
  Synthetic oligonucleotide
tccgtagagcccccgtccactcgtaaccgctacca

SEQ ID NO: 129385 - DNA, 30 bp, Artificial Sequence
  Synthetic oligonucleotide
tacatcccccctgccttcccgtatctagca

SEQ ID NO: 129386 - DNA, 37 bp, Artificial Sequence
  Synthetic oligonucleotide
tcgctaccatcgcctttgcccgaccctgctccccaga

SEQ ID NO: 129387 - DNA, 37 bp, Artificial Sequence
  Synthetic oligonucleotide
gtgtacatcagacgaagaagtaggcgggtggggggga

SEQ ID NO: 129388 - DNA, 38 bp, Artificial Sequence
  Synthetic oligonucleotide
agccaccccctgccccacgtcgttgcccgatacaatga

SEQ ID NO: 129389 - DNA, 35 bp, Artificial Sequence
  Synthetic oligonucleotide
ttgcccctacgcgtcgacctccccatgctccctga

SEQ ID NO: 129390 - DNA, 35 bp, Artificial Sequence
  Synthetic oligonucleotide
ttccgtggccccacatattataccaacgacctaac

SEQ ID NO: 129391 - DNA, 35 bp, Artificial Sequence
  Synthetic oligonucleotide
gagccttcgcccacacccttaccgcgtttctcacc

SEQ ID NO: 129392 - DNA, 35 bp, Artificial Sequence
  Synthetic oligonucleotide
tacttggcgcaacccacccccattagctacgtgcc

SEQ ID NO: 129393 - DNA, 35 bp, Artificial Sequence
  Synthetic oligonucleotide
tccgccatcatcttgaccatgcgtgagccacatcc

SEQ ID NO: 129394 - DNA, 35 bp, Artificial Sequence
  Synthetic oligonucleotide
aacgcatccccctggacggctccgcgatcccctcc

SEQ ID NO: 129395 - DNA, 35 bp, Artificial Sequence
  Synthetic oligonucleotide
ttcactctcctgtccagtatcagcccctacactgc

SEQ ID NO: 129396 - DNA, 36 bp, Artificial Sequence
  Synthetic oligonucleotide
gaggtcggcctccctgcctgctccccgacgaccctc

SEQ ID NO: 129397 - DNA, 35 bp, Artificial Sequence
  Synthetic oligonucleotide
gcaagccactcacttccccttgcccgtcctcgttc

SEQ ID NO: 129398 - DNA, 35 bp, Artificial Sequence
  Synthetic oligonucleotide
gaagaaagggtgggtagggttgagaggatcgggag

SEQ ID NO: 129399 - DNA, 35 bp, Artificial Sequence
  Synthetic oligonucleotide
tgtccgggggcaagaagagagggggaaggaactag

SEQ ID NO: 129400 - DNA, 35 bp, Artificial Sequence
  Synthetic oligonucleotide
atacccagccccccgacccgtaaagttcctggcgt

SEQ ID NO: 129401 - DNA, 35 bp, Artificial Sequence
  Synthetic oligonucleotide
gggtaagggggtggtaagggaattaaggtgaaggt

SEQ ID NO: 129402 - DNA, 36 bp, Artificial Sequence
  Synthetic oligonucleotide
ttgacaccccctgccgtgctcgtcaccctagtacaa

SEQ ID NO: 129403 - DNA, 36 bp, Artificial Sequence
  Synthetic oligonucleotide
acttcccacgctagctatgctctcgcgcactctcca

SEQ ID NO: 129404 - DNA, 36 bp, Artificial Sequence
  Synthetic oligonucleotide
ggacccacctacaccaagtacttctgctataccgca

SEQ ID NO: 129405 - DNA, 36 bp, Artificial Sequence
  Synthetic oligonucleotide
gccacccaaacttggtggtactatgaccctcactca

SEQ ID NO: 129406 - DNA, 37 bp, Artificial Sequence
  Synthetic oligonucleotide
tagcgggcgggaggggcgttgaagggtatctctggga

SEQ ID NO: 129407 - DNA, 37 bp, Artificial Sequence
  Synthetic oligonucleotide
gcccactttcatgcatcgctgccccctcactactgga

SEQ ID NO: 129408 - DNA, 37 bp, Artificial Sequence
  Synthetic oligonucleotide
agggaagggagggacaaaccaaaggggacgggagtga

SEQ ID NO: 129409 - DNA, 36 bp, Artificial Sequence
  Synthetic oligonucleotide
ggtggtgcagacgccccctgtagccccccccaagta

SEQ ID NO: 129410 - DNA, 35 bp, Artificial Sequence
  Synthetic oligonucleotide
tgccatgcccacttccgtctttggacaattgtcac

SEQ ID NO: 129411 - DNA, 35 bp, Artificial Sequence
  Synthetic oligonucleotide
tagatcgcctcccatttgccccaagtgtaactact

SEQ ID NO: 129412 - DNA, 35 bp, Artificial Sequence
  Synthetic oligonucleotide
tcctatcgcccttgtggttttacttcgttcaccct

SEQ ID NO: 129413 - DNA, 35 bp, Artificial Sequence
  Synthetic oligonucleotide
acttcgccgctagatgctcccgcttcaccatcgct

SEQ ID NO: 129414 - DNA, 36 bp, Artificial Sequence
  Synthetic oligonucleotide
tgcccctcaatcgacgttgagccccgcccctgtaca

SEQ ID NO: 129415 - DNA, 35 bp, Artificial Sequence
  Synthetic oligonucleotide
tgcacggcacaggcctttctcgtcactacatttca

SEQ ID NO: 129416 - DNA, 35 bp, Artificial Sequence
  Synthetic oligonucleotide
gtaacaccacccgacgcactatacttagcatttca

SEQ ID NO: 129417 - DNA, 37 bp, Artificial Sequence
  Synthetic oligonucleotide
gcccatcccttacgcacggatctcactcgtttcccga

SEQ ID NO: 129418 - DNA, 35 bp, Artificial Sequence
  Synthetic oligonucleotide
ttcagctacgtccggcacgatccccccttcgccac

SEQ ID NO: 129419 - DNA, 35 bp, Artificial Sequence
  Synthetic oligonucleotide
acccgccctcgcacccacattttacgacgtgaccc

SEQ ID NO: 129420 - DNA, 35 bp, Artificial Sequence
  Synthetic oligonucleotide
aatccctgcactatgtaaacgcctctctacctgcc

SEQ ID NO: 129421 - DNA, 35 bp, Artificial Sequence
  Synthetic oligonucleotide
acctggcatccgtgtactgcgcctcccccggatcc

SEQ ID NO: 129422 - DNA, 35 bp, Artificial Sequence
  Synthetic oligonucleotide
gacgcccacccgttgactgtaacgaatatgtctcc

SEQ ID NO: 129423 - DNA, 35 bp, Artificial Sequence
  Synthetic oligonucleotide
gactccgacctttgcgccatcctcgactcgtgtcc

SEQ ID NO: 129424 - DNA, 35 bp, Artificial Sequence
  Synthetic oligonucleotide
gtcggactcggaggttttcgctcgccccacgttcc

SEQ ID NO: 129425 - DNA, 35 bp, Artificial Sequence
  Synthetic oligonucleotide
gatccccccccctgcgatagaatacccctagtcgc

SEQ ID NO: 129426 - DNA, 34 bp, Artificial Sequence
  Synthetic oligonucleotide
tacgctacgtacattttctcactccaccgcgtgc

SEQ ID NO: 129427 - DNA, 35 bp, Artificial Sequence
  Synthetic oligonucleotide
aagaaaccggcgcggtgccgtccccctcccccatc

SEQ ID NO: 129428 - DNA, 36 bp, Artificial Sequence
  Synthetic oligonucleotide
gccgatgtccatgtcccagttcctcgttcgtaactc

SEQ ID NO: 129429 - DNA, 35 bp, Artificial Sequence
  Synthetic oligonucleotide
ggacatccgtccgcagcccacgcctcactgccttc

SEQ ID NO: 129430 - DNA, 35 bp, Artificial Sequence
  Synthetic oligonucleotide
gcgatgccggcgcgcccacgaacttttggtccttc

SEQ ID NO: 129431 - DNA, 35 bp, Artificial Sequence
  Synthetic oligonucleotide
agctgtacgctggcctccgttttttggtcctttcg

SEQ ID NO: 129432 - DNA, 35 bp, Artificial Sequence
  Synthetic oligonucleotide
gcgaccaacagcggtgaaggggggaactggagggg

SEQ ID NO: 129433 - DNA, 35 bp, Artificial Sequence
  Synthetic oligonucleotide
ttggtggccatctgcccgtccttaatatcatcctg

SEQ ID NO: 129434 - DNA, 35 bp, Artificial Sequence
  Synthetic oligonucleotide
atgtgtacacaccgcccgtcgctccggtttctctg

SEQ ID NO: 129435 - DNA, 35 bp, Artificial Sequence
  Synthetic oligonucleotide
agtctacacccgctccctatcttaagcctggttct

SEQ ID NO: 129436 - DNA, 35 bp, Artificial Sequence
  Synthetic oligonucleotide
ttcacctgcctgcccgtcctgtctctatagttggt

SEQ ID NO: 129437 - DNA, 36 bp, Artificial Sequence
  Synthetic oligonucleotide
acacgcccccctgcccctaagctgctcccaggtaca

SEQ ID NO: 129438 - DNA, 35 bp, Artificial Sequence
  Synthetic oligonucleotide
taatgcctcgaccgctgcgccgcatctcaccttca

SEQ ID NO: 129439 - DNA, 37 bp, Artificial Sequence
  Synthetic oligonucleotide
tcataaggaggaggaggggagacaaggtggtgtaaga

SEQ ID NO: 129440 - DNA, 37 bp, Artificial Sequence
  Synthetic oligonucleotide
tccgacgacgccctcccttccacctgtatccgctcga

SEQ ID NO: 129441 - DNA, 37 bp, Artificial Sequence
  Synthetic oligonucleotide
accgagtgagggggtggataggaaaagaaggcgtcga

SEQ ID NO: 129442 - DNA, 35 bp, Artificial Sequence
  Synthetic oligonucleotide
gcacatctcgaacgttcacagtacactcctaccac

SEQ ID NO: 129443 - DNA, 35 bp, Artificial Sequence
  Synthetic oligonucleotide
ttttgccaccgtcctaattcccatcattcgccgcc

SEQ ID NO: 129444 - DNA, 35 bp, Artificial Sequence
  Synthetic oligonucleotide
tttcaacgcttgccccatccctgttcttaatcgcc

SEQ ID NO: 129445 - DNA, 35 bp, Artificial Sequence
  Synthetic oligonucleotide
gggacacgtcaagtttacggccttcccatcgcatc

SEQ ID NO: 129446 - DNA, 34 bp, Artificial Sequence
  Synthetic oligonucleotide
tcaacggctcaacctgctccctccgacccgccag

SEQ ID NO: 129447 - DNA, 36 bp, Artificial Sequence
  Synthetic oligonucleotide
gttgggacacggacatgataacggaatggaaagcag

SEQ ID NO: 129448 - DNA, 35 bp, Artificial Sequence
  Synthetic oligonucleotide
accgactcccccggccactagagcccctctcactg

SEQ ID NO: 129449 - DNA, 36 bp, Artificial Sequence
  Synthetic oligonucleotide
tcgaggagggggcatacaacggtggaggggcgggca

SEQ ID NO: 129450 - DNA, 37 bp, Artificial Sequence
  Synthetic oligonucleotide
gacgaaatggaggaaggtgggatatagggggcataga

SEQ ID NO: 129451 - DNA, 36 bp, Artificial Sequence
  Synthetic oligonucleotide
tatgacagcatgtctagacccgctccttcgctccta

SEQ ID NO: 129452 - DNA, 35 bp, Artificial Sequence
  Synthetic oligonucleotide
accctccaccaccacgtttgttcgcactgctccac

SEQ ID NO: 129453 - DNA, 35 bp, Artificial Sequence
  Synthetic oligonucleotide
agtctcgccccctgtttcatgctcctttcgtagcc

SEQ ID NO: 129454 - DNA, 35 bp, Artificial Sequence
  Synthetic oligonucleotide
actgccctgactatgcactccccgccggtgtccgc

SEQ ID NO: 129455 - DNA, 35 bp, Artificial Sequence
  Synthetic oligonucleotide
tgcccccgtgaattgtctggtccactgctgtcttc

SEQ ID NO: 129456 - DNA, 35 bp, Artificial Sequence
  Synthetic oligonucleotide
acccgccgccctgcctccctccacgttcaccggag

SEQ ID NO: 129457 - DNA, 35 bp, Artificial Sequence
  Synthetic oligonucleotide
gtccttcacagctctgctcgtcccatctctacctg

SEQ ID NO: 129458 - DNA, 35 bp, Artificial Sequence
  Synthetic oligonucleotide
gtgtcagtcgctcgtcttgctccagtcctgcattg

SEQ ID NO: 129459 - DNA, 35 bp, Artificial Sequence
  Synthetic oligonucleotide
gagctcgccgcctttattccggtgtccctgtttct

SEQ ID NO: 129460 - DNA, 35 bp, Artificial Sequence
  Synthetic oligonucleotide
tttcgcaaccccgacatcgttgcattctacacttt

SEQ ID NO: 129461 - DNA, 36 bp, Artificial Sequence
  Synthetic oligonucleotide
tccttgcgtcgagttcctgcccatcagcgctatcca

SEQ ID NO: 129462 - DNA, 37 bp, Artificial Sequence
  Synthetic oligonucleotide
aaaggccacgggcggggggaagaggggtcagaaggga

SEQ ID NO: 129463 - DNA, 37 bp, Artificial Sequence
  Synthetic oligonucleotide
gtgtgtaggggaaggaatctgtgggaaggggatggga

SEQ ID NO: 129464 - DNA, 37 bp, Artificial Sequence
  Synthetic oligonucleotide
acaggggaggaacgaggggtggttatgcgggggatga

SEQ ID NO: 129465 - DNA, 36 bp, Artificial Sequence
  Synthetic oligonucleotide
gagggtggtgggcgggggacatagggcgccgtatga

SEQ ID NO: 129466 - DNA, 37 bp, Artificial Sequence
  Synthetic oligonucleotide
atctcccgcctgtacgcccccgcccgtaacatactga

SEQ ID NO: 129467 - DNA, 34 bp, Artificial Sequence
  Synthetic oligonucleotide
tcatcgtccactgctttctccccattctccttga

SEQ ID NO: 129468 - DNA, 36 bp, Artificial Sequence
  Synthetic oligonucleotide
tatgctcccgactagtcttcttcaaccgctgcttta

SEQ ID NO: 129469 - DNA, 35 bp, Artificial Sequence
  Synthetic oligonucleotide
gcctctctatctgtgcgccctatactaactcgtcc

SEQ ID NO: 129470 - DNA, 35 bp, Artificial Sequence
  Synthetic oligonucleotide
gaatcgccccagccgtgtttgccctctccttcgtc

SEQ ID NO: 129471 - DNA, 35 bp, Artificial Sequence
  Synthetic oligonucleotide
gagaacgttcagcataagggagggcggtagggggg

SEQ ID NO: 129472 - DNA, 35 bp, Artificial Sequence
  Synthetic oligonucleotide
gataccgcactccgtaccttccacatacctcacgt

SEQ ID NO: 129473 - DNA, 35 bp, Artificial Sequence
  Synthetic oligonucleotide
tgactcaacctgtctgccttccccacgattgcctt

SEQ ID NO: 129474 - DNA, 35 bp, Artificial Sequence
  Synthetic oligonucleotide
tacctgccggcgcacctgtctgttgacacctccca

SEQ ID NO: 129475 - DNA, 35 bp, Artificial Sequence
  Synthetic oligonucleotide
gtcgttccccggccggtttccttctcagcttatca

SEQ ID NO: 129476 - DNA, 36 bp, Artificial Sequence
  Synthetic oligonucleotide
gtaggccctccgtccacttttaccgcgcttgtttca

SEQ ID NO: 129477 - DNA, 37 bp, Artificial Sequence
  Synthetic oligonucleotide
ccaggaggacggactgcgggggtaccaggggggagga

SEQ ID NO: 129478 - DNA, 35 bp, Artificial Sequence
  Synthetic oligonucleotide
aatggcgtatcgtaagggggggggagggaagggga

SEQ ID NO: 129479 - DNA, 38 bp, Artificial Sequence
  Synthetic oligonucleotide
tgtcacgggggggtacacgaagggcgggaaaaagatga

SEQ ID NO: 129480 - DNA, 37 bp, Artificial Sequence
  Synthetic oligonucleotide
gaaaaggaagagaggaggaaagaaagggcgattatga

SEQ ID NO: 129481 - DNA, 36 bp, Artificial Sequence
  Synthetic oligonucleotide
gcactgccgcttgctgtcatccttctttgtcctgta

SEQ ID NO: 129482 - DNA, 35 bp, Artificial Sequence
  Synthetic oligonucleotide
gttgacgatcaccggcattttaacctgctctccac

SEQ ID NO: 129483 - DNA, 35 bp, Artificial Sequence
  Synthetic oligonucleotide
atagcgcagggtaagccgccagttaccattccccc

SEQ ID NO: 129484 - DNA, 35 bp, Artificial Sequence
  Synthetic oligonucleotide
tgagacgcccacttgcttcttaccctcacgccgcc

SEQ ID NO: 129485 - DNA, 35 bp, Artificial Sequence
  Synthetic oligonucleotide
actcgctgctttaaccccccgtccgccgttgcctc

SEQ ID NO: 129486 - DNA, 35 bp, Artificial Sequence
  Synthetic oligonucleotide
tcataccacctttcatcgtcttttcacagacgttc

SEQ ID NO: 129487 - DNA, 35 bp, Artificial Sequence
  Synthetic oligonucleotide
gcgccccgaccatcgctctgcgactcgcgcctttc

SEQ ID NO: 129488 - DNA, 35 bp, Artificial Sequence
  Synthetic oligonucleotide
gggggggggatggcacaaaggaacgtagcaaagag

SEQ ID NO: 129489 - DNA, 35 bp, Artificial Sequence
  Synthetic oligonucleotide
gcccgccgctggtgctctccatcttctacgttagg

SEQ ID NO: 129490 - DNA, 35 bp, Artificial Sequence
  Synthetic oligonucleotide
tgtgacacccacgcatttttctgacacatccccat

SEQ ID NO: 129491 - DNA, 35 bp, Artificial Sequence
  Synthetic oligonucleotide
gaccccctctcatgtctgtttcaattacagccgat

SEQ ID NO: 129492 - DNA, 35 bp, Artificial Sequence
  Synthetic oligonucleotide
agacaccctccttcggccctctgctactgacttat

SEQ ID NO: 129493 - DNA, 35 bp, Artificial Sequence
  Synthetic oligonucleotide
gtaccccgccttgttgttttacttcgcaaacctgt

SEQ ID NO: 129494 - DNA, 35 bp, Artificial Sequence
  Synthetic oligonucleotide
ggtccatgcagcctctgtgccccgtcccgctttgt

SEQ ID NO: 129495 - DNA, 37 bp, Artificial Sequence
  Synthetic oligonucleotide
gtaggaagaggaaacggggcaagggagggccaaagga

SEQ ID NO: 129496 - DNA, 38 bp, Artificial Sequence
  Synthetic oligonucleotide
gtagtgggtagggcgggaagggaggtaatgtaacgtga

SEQ ID NO: 129497 - DNA, 38 bp, Artificial Sequence
  Synthetic oligonucleotide
attcaccgccctaattagttcgccccccgtacacgtga

SEQ ID NO: 129498 - DNA, 38 bp, Artificial Sequence
  Synthetic oligonucleotide
gaatccaggggagggaagggaagggaaggcctcattga

SEQ ID NO: 129499 - DNA, 35 bp, Artificial Sequence
  Synthetic oligonucleotide
atgcacccggatctgtcaccccccgctgctcacct

SEQ ID NO: 129500 - DNA, 35 bp, Artificial Sequence
  Synthetic oligonucleotide
gtacgccgccacaccccgctatactccttcattct

SEQ ID NO: 129501 - DNA, 35 bp, Artificial Sequence
  Synthetic oligonucleotide
tgctcccacgcggtctcgccgaagctccctgttct

SEQ ID NO: 129502 - DNA, 35 bp, Artificial Sequence
  Synthetic oligonucleotide
tcagattgttcgtttcgttgctgcccttctacctt

SEQ ID NO: 129503 - DNA, 36 bp, Artificial Sequence
  Synthetic oligonucleotide
gtagacgcggaggaggaggggacgggaagtaaatca

SEQ ID NO: 129504 - DNA, 38 bp, Artificial Sequence
  Synthetic oligonucleotide
tcaacgcagtgcccctttgcgctatcctgtccccatga

SEQ ID NO: 129505 - DNA, 38 bp, Artificial Sequence
  Synthetic oligonucleotide
tgaacagtacgtacaggtggggtggggggggatggtga

SEQ ID NO: 129506 - DNA, 38 bp, Artificial Sequence
  Synthetic oligonucleotide
tcacgtcctgctccctctaccgtggcgtctcccattga

SEQ ID NO: 129507 - DNA, 36 bp, Artificial Sequence
  Synthetic oligonucleotide
gccaccccacgctcctgttgaaagtcgccgcctata

SEQ ID NO: 129508 - DNA, 36 bp, Artificial Sequence
  Synthetic oligonucleotide
gactccatctcgcccggttttcaactccagtgccta

SEQ ID NO: 129509 - DNA, 35 bp, Artificial Sequence
  Synthetic oligonucleotide
tacgccacctctcgcgctgtgcatgctcattccta

SEQ ID NO: 129510 - DNA, 35 bp, Artificial Sequence
  Synthetic oligonucleotide
gaccgcgccgcaagacctccagccacgtctccaac

SEQ ID NO: 129511 - DNA, 35 bp, Artificial Sequence
  Synthetic oligonucleotide
tagcatgcatcgcccttgtactgcaccctgattac

SEQ ID NO: 129512 - DNA, 35 bp, Artificial Sequence
  Synthetic oligonucleotide
aactgtctcaccccctgtcctcctcgttttgtgcc

SEQ ID NO: 129513 - DNA, 35 bp, Artificial Sequence
  Synthetic oligonucleotide
tcgtgaccggcctgttttcgcccctgggctcttcc

SEQ ID NO: 129514 - DNA, 34 bp, Artificial Sequence
  Synthetic oligonucleotide
atcccggggccgtacacgcacattctccttgttc

SEQ ID NO: 129515 - DNA, 35 bp, Artificial Sequence
  Synthetic oligonucleotide
tatcatgcaagggtgtaacgggggcgggtggaggg

SEQ ID NO: 129516 - DNA, 35 bp, Artificial Sequence
  Synthetic oligonucleotide
tcgatgcgccgcatactctctcaccttgttcatgg

SEQ ID NO: 129517 - DNA, 35 bp, Artificial Sequence
  Synthetic oligonucleotide
tgatactttccgccgttttgcacactgactctctg

SEQ ID NO: 129518 - DNA, 35 bp, Artificial Sequence
  Synthetic oligonucleotide
gtatgtccagccctttactggcgccccctgtccct

SEQ ID NO: 129519 - DNA, 35 bp, Artificial Sequence
  Synthetic oligonucleotide
tcacaccgtccagcatatcgtaccggccttatcgt

SEQ ID NO: 129520 - DNA, 35 bp, Artificial Sequence
  Synthetic oligonucleotide
tcgcacccctaatgtactcgctccggctccatggt

SEQ ID NO: 129521 - DNA, 35 bp, Artificial Sequence
  Synthetic oligonucleotide
ggatccccctgccgttttacccgtatcgtgccctt

SEQ ID NO: 129522 - DNA, 35 bp, Artificial Sequence
  Synthetic oligonucleotide
gattacaccgagcaggatgctccacccccttcgtt

SEQ ID NO: 129523 - DNA, 35 bp, Artificial Sequence
  Synthetic oligonucleotide
gtggccctctactgtcttgccccccttcgaccttt

SEQ ID NO: 129524 - DNA, 35 bp, Artificial Sequence
  Synthetic oligonucleotide
gcgatccgaccttcgcctgctacctgcctctgttt

SEQ ID NO: 129525 - DNA, 36 bp, Artificial Sequence
  Synthetic oligonucleotide
ggtgggtggggggagaacaatgggtgcagctagaaa

SEQ ID NO: 129526 - DNA, 35 bp, Artificial Sequence
  Synthetic oligonucleotide
attggcgggtcccgatcccatcccaccctgtctca

SEQ ID NO: 129527 - DNA, 36 bp, Artificial Sequence
  Synthetic oligonucleotide
gacccaccgccacttgctccgtacccttgaccaaga

SEQ ID NO: 129528 - DNA, 35 bp, Artificial Sequence
  Synthetic oligonucleotide
gcccaccccggtcatggaacatccccctctttata

SEQ ID NO: 129529 - DNA, 35 bp, Artificial Sequence
  Synthetic oligonucleotide
gttggagcccgtcactcccgttcccttgcatcaac

SEQ ID NO: 129530 - DNA, 35 bp, Artificial Sequence
  Synthetic oligonucleotide
agcccatccctcttcgtctttcgacttgttaccac

SEQ ID NO: 129531 - DNA, 35 bp, Artificial Sequence
  Synthetic oligonucleotide
gagagggtgggagtgtactcattgctccgggggac

SEQ ID NO: 129532 - DNA, 35 bp, Artificial Sequence
  Synthetic oligonucleotide
tgcccatccgccatttttccatggagttttttacc

SEQ ID NO: 129533 - DNA, 35 bp, Artificial Sequence
  Synthetic oligonucleotide
gtcattccagtgtctacggccacactcacctcccc

SEQ ID NO: 129534 - DNA, 35 bp, Artificial Sequence
  Synthetic oligonucleotide
tcccggtcctgtctcggttcgcctccacatctccc

SEQ ID NO: 129535 - DNA, 35 bp, Artificial Sequence
  Synthetic oligonucleotide
agtctccatgcctacgatctgtggttctcgcctcc

SEQ ID NO: 129536 - DNA, 35 bp, Artificial Sequence
  Synthetic oligonucleotide
gacgcctccgcgggtatttgccctttcacgcttcc

SEQ ID NO: 129537 - DNA, 35 bp, Artificial Sequence
  Synthetic oligonucleotide
tgtgcgagttcccgttccgcgttcctgtcgccctc

SEQ ID NO: 129538 - DNA, 35 bp, Artificial Sequence
  Synthetic oligonucleotide
acgacacgccgcacgccgccgatatacaccccctg

SEQ ID NO: 129539 - DNA, 35 bp, Artificial Sequence
  Synthetic oligonucleotide
tagtcccatcccgcacacgccgatatattgccctg

SEQ ID NO: 129540 - DNA, 35 bp, Artificial Sequence
  Synthetic oligonucleotide
gctccccttgccccgtccgactcgccttatttctg

SEQ ID NO: 129541 - DNA, 34 bp, Artificial Sequence
  Synthetic oligonucleotide
cccttcacgctagccatgcctgcccgcttattgt

SEQ ID NO: 129542 - DNA, 36 bp, Artificial Sequence
  Synthetic oligonucleotide
gtcgcccgcttgctctccttgccccgcctatttgca

SEQ ID NO: 129543 - DNA, 35 bp, Artificial Sequence
  Synthetic oligonucleotide
ttcagcctcccttgttcagttatcccacctttgca

SEQ ID NO: 129544 - DNA, 37 bp, Artificial Sequence
  Synthetic oligonucleotide
tgacctcccaccgcccgacccagccttttcaagtgga

SEQ ID NO: 129545 - DNA, 38 bp, Artificial Sequence
  Synthetic oligonucleotide
tatcaccctacccatggccaccctgacagtctgcgtga

SEQ ID NO: 129546 - DNA, 38 bp, Artificial Sequence
  Synthetic oligonucleotide
tagagggcgaggggggacggggggagggctgatattga

SEQ ID NO: 129547 - DNA, 28 bp, Artificial Sequence
  Synthetic oligonucleotide
attacccgttccttcccgagctatccta

SEQ ID NO: 129548 - DNA, 36 bp, Artificial Sequence
  Synthetic oligonucleotide
acccaactgcacggtcctgttctttggtcccctcta

SEQ ID NO: 129549 - DNA, 35 bp, Artificial Sequence
  Synthetic oligonucleotide
tcactccacccgactttatctcaacgtgctaaccg

SEQ ID NO: 129550 - DNA, 34 bp, Artificial Sequence
  Synthetic oligonucleotide
tgtcccgccgttttgcgccaacagttttccaccg

SEQ ID NO: 129551 - DNA, 35 bp, Artificial Sequence
  Synthetic oligonucleotide
gcaatcccagctccactttcacaacgccctgcccg

SEQ ID NO: 129552 - DNA, 35 bp, Artificial Sequence
  Synthetic oligonucleotide
gccgacccgccgtttatccaccactgttgtacatg

SEQ ID NO: 129553 - DNA, 35 bp, Artificial Sequence
  Synthetic oligonucleotide
tgcactccgctccccctgcagacagattatctctg

SEQ ID NO: 129554 - DNA, 35 bp, Artificial Sequence
  Synthetic oligonucleotide
gcggacgcctctccgttacgtgttgccttcttcct

SEQ ID NO: 129555 - DNA, 35 bp, Artificial Sequence
  Synthetic oligonucleotide
tgccccccgtactcggttttgcgcctttcactgct

SEQ ID NO: 129556 - DNA, 35 bp, Artificial Sequence
  Synthetic oligonucleotide
tacacaacccgcaccatcccctatatgtaactttt

SEQ ID NO: 129557 - DNA, 35 bp, Artificial Sequence
  Synthetic oligonucleotide
gggagccactgcctttccttgtccctgattgtgaa

SEQ ID NO: 129558 - DNA, 36 bp, Artificial Sequence
  Synthetic oligonucleotide
tagcaccaccaggtaccccccctcgcccccgctgca

SEQ ID NO: 129559 - DNA, 37 bp, Artificial Sequence
  Synthetic oligonucleotide
tcacccctgcctcccgaactcgttttaaaccctagga

SEQ ID NO: 129560 - DNA, 37 bp, Artificial Sequence
  Synthetic oligonucleotide
tcatactgccctcttgcctgcttcccggtgatcggga

SEQ ID NO: 129561 - DNA, 36 bp, Artificial Sequence
  Synthetic oligonucleotide
tgccatcacttggcaactctgaccatcattttggga

SEQ ID NO: 129562 - DNA, 37 bp, Artificial Sequence
  Synthetic oligonucleotide
gagggggcgtggaatactgggatgggagggaggtgga

SEQ ID NO: 129563 - DNA, 38 bp, Artificial Sequence
  Synthetic oligonucleotide
gtgcgacgcctgagcctcatctgacctccccactttga

SEQ ID NO: 129564 - DNA, 37 bp, Artificial Sequence
  Synthetic oligonucleotide
gtatcgcccttagtgcccgggcccccagtcctcccta

SEQ ID NO: 129565 - DNA, 32 bp, Artificial Sequence
  Synthetic oligonucleotide
gtattctccggagtgacctccatgccccttta

SEQ ID NO: 129566 - DNA, 35 bp, Artificial Sequence
  Synthetic oligonucleotide
tagttaccgccccgccgaggcccgttatgcttacc

SEQ ID NO: 129567 - DNA, 35 bp, Artificial Sequence
  Synthetic oligonucleotide
tacaccccccatgccatacactcctctaggtgccc

SEQ ID NO: 129568 - DNA, 35 bp, Artificial Sequence
  Synthetic oligonucleotide
tgtgtcactctcgaccgcccctcactaggactgcc

SEQ ID NO: 129569 - DNA, 35 bp, Artificial Sequence
  Synthetic oligonucleotide
gcgatcgtacgggctctgcggtcctctcattctcc

SEQ ID NO: 129570 - DNA, 35 bp, Artificial Sequence
  Synthetic oligonucleotide
ttcaccaccccgtatctgggcctttcgatttactc

SEQ ID NO: 129571 - DNA, 35 bp, Artificial Sequence
  Synthetic oligonucleotide
gaagacgggataaggtggtggaggtcaaaaaaaag

SEQ ID NO: 129572 - DNA, 35 bp, Artificial Sequence
  Synthetic oligonucleotide
tgaagaggtgagaggagtggagggtgagtactgag

SEQ ID NO: 129573 - DNA, 35 bp, Artificial Sequence
  Synthetic oligonucleotide
agtggcccgcctcccgtcagtattttacccgcacg

SEQ ID NO: 129574 - DNA, 35 bp, Artificial Sequence
  Synthetic oligonucleotide
gcaaccgccgggtttgctggcaccttctatctacg

SEQ ID NO: 129575 - DNA, 35 bp, Artificial Sequence
  Synthetic oligonucleotide
tccccacaacacattctgctctatgacgccctccg

SEQ ID NO: 129576 - DNA, 35 bp, Artificial Sequence
  Synthetic oligonucleotide
gaacacggggttgagggtggggggggcatagttcg

SEQ ID NO: 129577 - DNA, 35 bp, Artificial Sequence
  Synthetic oligonucleotide
gctcgagtacgcgagcaccgcttattacacccttg

SEQ ID NO: 129578 - DNA, 35 bp, Artificial Sequence
  Synthetic oligonucleotide
tcaactctcactcatggttccttttcgacctcttg

SEQ ID NO: 129579 - DNA, 37 bp, Artificial Sequence
  Synthetic oligonucleotide
aagcatgggttacgacgggggggagggaggcgtaaga

SEQ ID NO: 129580 - DNA, 37 bp, Artificial Sequence
  Synthetic oligonucleotide
gactacctgtctgccgttttccgtccccgtcctagga

SEQ ID NO: 129581 - DNA, 38 bp, Artificial Sequence
  Synthetic oligonucleotide
aaccaccaccacatgttattctaacgccacactgctga

SEQ ID NO: 129582 - DNA, 38 bp, Artificial Sequence
  Synthetic oligonucleotide
gaaccgccgggccttcaaacacacactcctccccgtga

SEQ ID NO: 129583 - DNA, 35 bp, Artificial Sequence
  Synthetic oligonucleotide
ggatagcgtgaagggggcgcggaatgggaaggtga

SEQ ID NO: 129584 - DNA, 35 bp, Artificial Sequence
  Synthetic oligonucleotide
gtcagtagtcgatcccctctcgcgccaccatttcc

SEQ ID NO: 129585 - DNA, 35 bp, Artificial Sequence
  Synthetic oligonucleotide
gactccgacactgaacttgacaccccacgaactgc

SEQ ID NO: 129586 - DNA, 35 bp, Artificial Sequence
  Synthetic oligonucleotide
ttactgcacccctttggcccatacatgactctctg

SEQ ID NO: 129587 - DNA, 35 bp, Artificial Sequence
  Synthetic oligonucleotide
tgaagggcgggcgggcaggggtatgacggtctcat

SEQ ID NO: 129588 - DNA, 35 bp, Artificial Sequence
  Synthetic oligonucleotide
ttagccatccctctcagtttttcctggtacgacct

SEQ ID NO: 129589 - DNA, 35 bp, Artificial Sequence
  Synthetic oligonucleotide
accaccgctggctttcccatgcaagttctttccct

SEQ ID NO: 129590 - DNA, 34 bp, Artificial Sequence
  Synthetic oligonucleotide
accgctaccctgccacgtctcagtctaccggttt

SEQ ID NO: 129591 - DNA, 35 bp, Artificial Sequence
  Synthetic oligonucleotide
acacaccccaccaccggcactatgccgtatcccga

SEQ ID NO: 129592 - DNA, 36 bp, Artificial Sequence
  Synthetic oligonucleotide
gacgaggggggggcaaaaattggagctatgggagga

SEQ ID NO: 129593 - DNA, 36 bp, Artificial Sequence
  Synthetic oligonucleotide
accttcgcccctgttgctgattctcttgatcccgga

SEQ ID NO: 129594 - DNA, 37 bp, Artificial Sequence
  Synthetic oligonucleotide
agctccgccgccctccttcacggtcaccagtcactga

SEQ ID NO: 129595 - DNA, 38 bp, Artificial Sequence
  Synthetic oligonucleotide
tgtccctcctcctcatgtgcgcctactccctttactga

SEQ ID NO: 129596 - DNA, 35 bp, Artificial Sequence
  Synthetic oligonucleotide
tacgcaccccgcctccatgtcgtgtcgctcacccg

SEQ ID NO: 129597 - DNA, 35 bp, Artificial Sequence
  Synthetic oligonucleotide
acccgccacccaaatcgctgttattcaatccccgg

SEQ ID NO: 129598 - DNA, 35 bp, Artificial Sequence
  Synthetic oligonucleotide
ccacaacacagctgccactttcctgtccttcctgt

SEQ ID NO: 129599 - DNA, 36 bp, Artificial Sequence
  Synthetic oligonucleotide
tatgcacctccgcctcttcttgggccgctgcaccca

SEQ ID NO: 129600 - DNA, 36 bp, Artificial Sequence
  Synthetic oligonucleotide
acctgatacaggttgtcccctatgccctgccgccca

SEQ ID NO: 129601 - DNA, 36 bp, Artificial Sequence
  Synthetic oligonucleotide
gtcgccacaggcccgccacccaacacaccgttctca

SEQ ID NO: 129602 - DNA, 36 bp, Artificial Sequence
  Synthetic oligonucleotide
aagggaggggggagcgggtgcaaaggagggcaaaga

SEQ ID NO: 129603 - DNA, 37 bp, Artificial Sequence
  Synthetic oligonucleotide
ggaccatcgcacccccccgacccacagtccccatcga

SEQ ID NO: 129604 - DNA, 38 bp, Artificial Sequence
  Synthetic oligonucleotide
gacagcccgctcctatctgaatcgtccctcgccgctga

SEQ ID NO: 129605 - DNA, 38 bp, Artificial Sequence
  Synthetic oligonucleotide
gtcaccctcgtctgtcgtttcttatatggcctccttga

SEQ ID NO: 129606 - DNA, 36 bp, Artificial Sequence
  Synthetic oligonucleotide
gcgatagaaggggaggctggcgggggcatttgagta

SEQ ID NO: 129607 - DNA, 35 bp, Artificial Sequence
  Synthetic oligonucleotide
gatgtaacgtacactgcctggctctctgtccaccc

SEQ ID NO: 129608 - DNA, 35 bp, Artificial Sequence
  Synthetic oligonucleotide
tgtcacaccccgtttttaatgcgcttcgccttccc

SEQ ID NO: 129609 - DNA, 35 bp, Artificial Sequence
  Synthetic oligonucleotide
gacacctgtagggtgtcgcttcccctgcatccgcc

SEQ ID NO: 129610 - DNA, 35 bp, Artificial Sequence
  Synthetic oligonucleotide
tgcacattcatcccgttcttccatcgtccgaaggc

SEQ ID NO: 129611 - DNA, 35 bp, Artificial Sequence
  Synthetic oligonucleotide
gagagctcgcgagcaagcgaggagggagggtgtgg

SEQ ID NO: 129612 - DNA, 35 bp, Artificial Sequence
  Synthetic oligonucleotide
taccacgccctccagcgcaccacgccttgaatcat

SEQ ID NO: 129613 - DNA, 35 bp, Artificial Sequence
  Synthetic oligonucleotide
attgtcccgccctgccaccctaaggaatccttcca

SEQ ID NO: 129614 - DNA, 37 bp, Artificial Sequence
  Synthetic oligonucleotide
agtgggagggagagggcgggttatgaagtctaaagga

SEQ ID NO: 129615 - DNA, 37 bp, Artificial Sequence
  Synthetic oligonucleotide
gctcaatggccagtttggggcgggaggatggggggga

SEQ ID NO: 129616 - DNA, 37 bp, Artificial Sequence
  Synthetic oligonucleotide
tcgtgtggggggtttgtcataggggcgggagtgggga

SEQ ID NO: 129617 - DNA, 38 bp, Artificial Sequence
  Synthetic oligonucleotide
aatccccgcccgaatgatcattggcgtcctcctcttga

SEQ ID NO: 129618 - DNA, 36 bp, Artificial Sequence
  Synthetic oligonucleotide
tgtggcatcccacctgtttgctgctattccccggta

SEQ ID NO: 129619 - DNA, 36 bp, Artificial Sequence
  Synthetic oligonucleotide
tgcatgcctatgtaccgtttccgccccttgcatgta

SEQ ID NO: 129620 - DNA, 35 bp, Artificial Sequence
  Synthetic oligonucleotide
acactcgcccacactctcattcatctgattggcac

SEQ ID NO: 129621 - DNA, 35 bp, Artificial Sequence
  Synthetic oligonucleotide
atctaccctgcacgtgcacattttgactcccatcc

SEQ ID NO: 129622 - DNA, 35 bp, Artificial Sequence
  Synthetic oligonucleotide
atccgcgcccattccgagtggctacatcatactcc

SEQ ID NO: 129623 - DNA, 35 bp, Artificial Sequence
  Synthetic oligonucleotide
tgaccctcgcattcgcctatttgaaataccctggc

SEQ ID NO: 129624 - DNA, 35 bp, Artificial Sequence
  Synthetic oligonucleotide
attcgtcgccgcccttccgttctgttactatcgtc

SEQ ID NO: 129625 - DNA, 35 bp, Artificial Sequence
  Synthetic oligonucleotide
tgactgcacctgccttcgactgtcctctctcgctg

SEQ ID NO: 129626 - DNA, 35 bp, Artificial Sequence
  Synthetic oligonucleotide
atcggtccaagccccccgacgcaccatatagccct

SEQ ID NO: 129627 - DNA, 35 bp, Artificial Sequence
  Synthetic oligonucleotide
gacgcatgtcgccagcaattctaactcaccctgct

SEQ ID NO: 129628 - DNA, 35 bp, Artificial Sequence
  Synthetic oligonucleotide
tcaccgtactcctgtctcgtggcatccaccactgt

SEQ ID NO: 129629 - DNA, 35 bp, Artificial Sequence
  Synthetic oligonucleotide
gagccctcgccccatcacatcttagatgaccgaca

SEQ ID NO: 129630 - DNA, 36 bp, Artificial Sequence
  Synthetic oligonucleotide
atctcagcagcccctctcctgtacaccgcgttccca

SEQ ID NO: 129631 - DNA, 36 bp, Artificial Sequence
  Synthetic oligonucleotide
atcgcccgacaccttctgccatgtaacctgtgccga

SEQ ID NO: 129632 - DNA, 37 bp, Artificial Sequence
  Synthetic oligonucleotide
gaacgaggaggagtggagcaatagtatggagggatga

SEQ ID NO: 129633 - DNA, 36 bp, Artificial Sequence
  Synthetic oligonucleotide
acagagacgggggcaggttacggaggaggtttggta

SEQ ID NO: 129634 - DNA, 35 bp, Artificial Sequence
  Synthetic oligonucleotide
acagcaggtactgcggttgtctccaccttccttac

SEQ ID NO: 129635 - DNA, 35 bp, Artificial Sequence
  Synthetic oligonucleotide
accgaccgtaaacatgctgagcccctctcgtcccc

SEQ ID NO: 129636 - DNA, 35 bp, Artificial Sequence
  Synthetic oligonucleotide
tctggtgtgctatcggtccctgcttactcttcatc

SEQ ID NO: 129637 - DNA, 34 bp, Artificial Sequence
  Synthetic oligonucleotide
ttccgcaaccctcccgcgtacctttttcgcgctc

SEQ ID NO: 129638 - DNA, 35 bp, Artificial Sequence
  Synthetic oligonucleotide
ttgacccgtgctcgttattgctggcccgctcgctc

SEQ ID NO: 129639 - DNA, 35 bp, Artificial Sequence
  Synthetic oligonucleotide
gatgcagttcaagtgcttctctcagttcctccccg

SEQ ID NO: 129640 - DNA, 35 bp, Artificial Sequence
  Synthetic oligonucleotide
gcaaggagtacgggattggggggagtggtgaagcg

SEQ ID NO: 129641 - DNA, 35 bp, Artificial Sequence
  Synthetic oligonucleotide
tccctcatccgtgatcgcactcctactacttcttg

SEQ ID NO: 129642 - DNA, 35 bp, Artificial Sequence
  Synthetic oligonucleotide
gcctaccgacgctctttcagcctgcatgccaccat

SEQ ID NO: 129643 - DNA, 35 bp, Artificial Sequence
  Synthetic oligonucleotide
acgtcagtcactccacgtgctacttcctggtccct

SEQ ID NO: 129644 - DNA, 35 bp, Artificial Sequence
  Synthetic oligonucleotide
tcatccctccggttagaacacaactgtccctgcct

SEQ ID NO: 129645 - DNA, 35 bp, Artificial Sequence
  Synthetic oligonucleotide
gctgccacatgctccctacgcacgtttcacccgtt

SEQ ID NO: 129646 - DNA, 36 bp, Artificial Sequence
  Synthetic oligonucleotide
gagcacccaccaacgtaactccacctcgcgttcgca

SEQ ID NO: 129647 - DNA, 35 bp, Artificial Sequence
  Synthetic oligonucleotide
gatgccacgcccgctttgctctgatctgcccacga

SEQ ID NO: 129648 - DNA, 37 bp, Artificial Sequence
  Synthetic oligonucleotide
ggcgaccgccgcaccgttcccctcgccttctagccga

SEQ ID NO: 129649 - DNA, 37 bp, Artificial Sequence
  Synthetic oligonucleotide
gataccaccccccatatagttcattccagacagggga

SEQ ID NO: 129650 - DNA, 38 bp, Artificial Sequence
  Synthetic oligonucleotide
gggttcaggggagggatgcaggggggggcgggaaatga

SEQ ID NO: 129651 - DNA, 38 bp, Artificial Sequence
  Synthetic oligonucleotide
tgatgggagggtggagcagggttaagggaatgagctga

SEQ ID NO: 129652 - DNA, 36 bp, Artificial Sequence
  Synthetic oligonucleotide
ggaccttgccctccgccagtacgctttgatccacta

SEQ ID NO: 129653 - DNA, 35 bp, Artificial Sequence
  Synthetic oligonucleotide
actaatgcacgcactatccgttacgccctccacac

SEQ ID NO: 129654 - DNA, 35 bp, Artificial Sequence
  Synthetic oligonucleotide
atgccctgctcacgagcgtcatggcttaccccgtc

SEQ ID NO: 129655 - DNA, 35 bp, Artificial Sequence
  Synthetic oligonucleotide
gccatgtcctgttacatcccatgatatgcccgttc

SEQ ID NO: 129656 - DNA, 35 bp, Artificial Sequence
  Synthetic oligonucleotide
gtagtgggcgaagggccaagggcgggggcaaaaag

SEQ ID NO: 129657 - DNA, 35 bp, Artificial Sequence
  Synthetic oligonucleotide
ggagcactgcctgatccatcgccctccaatttgtg

SEQ ID NO: 129658 - DNA, 35 bp, Artificial Sequence
  Synthetic oligonucleotide
aagtcccgcctcgcatcccgttttgcatcaaatct

SEQ ID NO: 129659 - DNA, 35 bp, Artificial Sequence
  Synthetic oligonucleotide
tgtaaccgcattgagatcctgtccactttcgctct

SEQ ID NO: 129660 - DNA, 35 bp, Artificial Sequence
  Synthetic oligonucleotide
ttttcaccgcccatgagttttaccaatccctcacc

SEQ ID NO: 129661 - DNA, 35 bp, Artificial Sequence
  Synthetic oligonucleotide
tggagcaccactttcgtttctttccggaccgtccc

SEQ ID NO: 129662 - DNA, 35 bp, Artificial Sequence
  Synthetic oligonucleotide
tcgcacactccccgtacacgcatggctcccacgcc

SEQ ID NO: 129663 - DNA, 35 bp, Artificial Sequence
  Synthetic oligonucleotide
gcgtggtctcttccccccccgtgcctttgaggtcc

SEQ ID NO: 129664 - DNA, 35 bp, Artificial Sequence
  Synthetic oligonucleotide
tgtacgcagcagcacggtctttcgctctagtttcc

SEQ ID NO: 129665 - DNA, 35 bp, Artificial Sequence
  Synthetic oligonucleotide
ggtgctccccccccactccgctcgtgctttccggg

SEQ ID NO: 129666 - DNA, 35 bp, Artificial Sequence
  Synthetic oligonucleotide
gtgcgacctcgctggttttggcgcttccatttcct

SEQ ID NO: 129667 - DNA, 36 bp, Artificial Sequence
  Synthetic oligonucleotide
gatttgctcctccccccccagacgtatggctggtct

SEQ ID NO: 129668 - DNA, 36 bp, Artificial Sequence
  Synthetic oligonucleotide
ttggacgggggaagggagcagggggtgttcgataaa

SEQ ID NO: 129669 - DNA, 35 bp, Artificial Sequence
  Synthetic oligonucleotide
tcctatctgcctccgtagtcttaccgctctttgaa

SEQ ID NO: 129670 - DNA, 36 bp, Artificial Sequence
  Synthetic oligonucleotide
gtcacctcaaccgtcataaggtctcccgccctgcca

SEQ ID NO: 129671 - DNA, 36 bp, Artificial Sequence
  Synthetic oligonucleotide
ggggacagggaaggtcagggaggggatggcaacgca

SEQ ID NO: 129672 - DNA, 37 bp, Artificial Sequence
  Synthetic oligonucleotide
gtgcatgcgcctcccccccgccatcctttgccgccga

SEQ ID NO: 129673 - DNA, 37 bp, Artificial Sequence
  Synthetic oligonucleotide
gaatgccctgccctatatccctcccccttccgaggga

SEQ ID NO: 129674 - DNA, 36 bp, Artificial Sequence
  Synthetic oligonucleotide
ggggcccatcaaagggggggtcgttttgcagtggga

SEQ ID NO: 129675 - DNA, 35 bp, Artificial Sequence
  Synthetic oligonucleotide
tgccgtgcccaaccgatctgcgccgcccccaatga

SEQ ID NO: 129676 - DNA, 38 bp, Artificial Sequence
  Synthetic oligonucleotide
gaggggagtagaggaaaaagggagttcgggagggatga

SEQ ID NO: 129677 - DNA, 35 bp, Artificial Sequence
  Synthetic oligonucleotide
agttgacgagtgggaggcgaagggaagggtgatga

SEQ ID NO: 129678 - DNA, 37 bp, Artificial Sequence
  Synthetic oligonucleotide
gcctgtgcccaccgctaccttaaaaccgtcctcctga

SEQ ID NO: 129679 - DNA, 38 bp, Artificial Sequence
  Synthetic oligonucleotide
atggccccctctgcaccacatgctccgccccgccgtga

SEQ ID NO: 129680 - DNA, 36 bp, Artificial Sequence
  Synthetic oligonucleotide
ttgcaactccatctatgccccgtcgcaattgcccta

SEQ ID NO: 129681 - DNA, 35 bp, Artificial Sequence
  Synthetic oligonucleotide
agcgctatcacactgctccacgccagtcatactcc

SEQ ID NO: 129682 - DNA, 35 bp, Artificial Sequence
  Synthetic oligonucleotide
tccccccgtgtgcaacaatctaacgtgcctggtcc

SEQ ID NO: 129683 - DNA, 35 bp, Artificial Sequence
  Synthetic oligonucleotide
atcatctgcaccaatgccaccagcctgcttccccg

SEQ ID NO: 129684 - DNA, 35 bp, Artificial Sequence
  Synthetic oligonucleotide
tccaccgacgcaaccgcctcctgtagatatgcact

SEQ ID NO: 129685 - DNA, 34 bp, Artificial Sequence
  Synthetic oligonucleotide
acccaaccaccccccagttgccgtttccatgact

SEQ ID NO: 129686 - DNA, 35 bp, Artificial Sequence
  Synthetic oligonucleotide
gccgtactgccccccttgtttctcaggatgttttt

SEQ ID NO: 129687 - DNA, 36 bp, Artificial Sequence
  Synthetic oligonucleotide
atccccgtctcccatcgttcagctgcctctgcccaa

SEQ ID NO: 129688 - DNA, 36 bp, Artificial Sequence
  Synthetic oligonucleotide
gaacgaggggggaggggattgcgacggagcagccaa

SEQ ID NO: 129689 - DNA, 36 bp, Artificial Sequence
  Synthetic oligonucleotide
gtcgcctcatttcgctcctgttctgtcctttaggca

SEQ ID NO: 129690 - DNA, 36 bp, Artificial Sequence
  Synthetic oligonucleotide
tgccgtttgctgtccttttctcgtcgcccgtttgca

SEQ ID NO: 129691 - DNA, 37 bp, Artificial Sequence
  Synthetic oligonucleotide
gtttgcctccgtagcgatcaactagttcctcctccga

SEQ ID NO: 129692 - DNA, 37 bp, Artificial Sequence
  Synthetic oligonucleotide
ttacggtgagggcgggaaacaaaggggggacaaggga

SEQ ID NO: 129693 - DNA, 38 bp, Artificial Sequence
  Synthetic oligonucleotide
tcaacatccgcaatgctttaggctccatcaactcctga

SEQ ID NO: 129694 - DNA, 38 bp, Artificial Sequence
  Synthetic oligonucleotide
acatccgccccctcgtgaccacttaagactaccgttga

SEQ ID NO: 129695 - DNA, 36 bp, Artificial Sequence
  Synthetic oligonucleotide
aacgactctcccaccgttatctgatcctgtctcata

SEQ ID NO: 129696 - DNA, 36 bp, Artificial Sequence
  Synthetic oligonucleotide
tccacacccggagtgtcaccgagcacctcgttccta

SEQ ID NO: 129697 - DNA, 36 bp, Artificial Sequence
  Synthetic oligonucleotide
ttgcctccccaccgattccgagtaacacggttccta

SEQ ID NO: 129698 - DNA, 35 bp, Artificial Sequence
  Synthetic oligonucleotide
gtgagctgtcgtagacgcgtacgcactaccccccc

SEQ ID NO: 129699 - DNA, 35 bp, Artificial Sequence
  Synthetic oligonucleotide
gcagataccaacggcacgtcctactgtcgcccccc

SEQ ID NO: 129700 - DNA, 35 bp, Artificial Sequence
  Synthetic oligonucleotide
attggccgtccttcgtatgaattcctcgccggtcc

SEQ ID NO: 129701 - DNA, 35 bp, Artificial Sequence
  Synthetic oligonucleotide
ttcacgccctggagcataggcgaccatactattcc

SEQ ID NO: 129702 - DNA, 36 bp, Artificial Sequence
  Synthetic oligonucleotide
acccttgcccaggcactgtctcgtacccgctcttgc

SEQ ID NO: 129703 - DNA, 35 bp, Artificial Sequence
  Synthetic oligonucleotide
tagaccgccggtaccatctgttatcacctctgctc

SEQ ID NO: 129704 - DNA, 35 bp, Artificial Sequence
  Synthetic oligonucleotide
gcgaagggcgggcggggaatacacgtgggccggtc

SEQ ID NO: 129705 - DNA, 35 bp, Artificial Sequence
  Synthetic oligonucleotide
tcccgaccgcccaagccctctatactgggatattc

SEQ ID NO: 129706 - DNA, 34 bp, Artificial Sequence
  Synthetic oligonucleotide
acactgtccctaggtgcatcctggccgtaccttc

SEQ ID NO: 129707 - DNA, 35 bp, Artificial Sequence
  Synthetic oligonucleotide
gcgcgcctagccatactccgtcaccttccacccgg

SEQ ID NO: 129708 - DNA, 35 bp, Artificial Sequence
  Synthetic oligonucleotide
ttgggagggagcggtgggtcaacggtaatccatgg

SEQ ID NO: 129709 - DNA, 35 bp, Artificial Sequence
  Synthetic oligonucleotide
tacccgccatcccttgttctttgcattgcttcctg

SEQ ID NO: 129710 - DNA, 35 bp, Artificial Sequence
  Synthetic oligonucleotide
gcacactcgcatattactggccctgttcattcatt

SEQ ID NO: 129711 - DNA, 35 bp, Artificial Sequence
  Synthetic oligonucleotide
accgtccgcctctaaggttatgctccctcttggtt

SEQ ID NO: 129712 - DNA, 35 bp, Artificial Sequence
  Synthetic oligonucleotide
tgccccgttgttcgtcccgcctgctcctagtgcaa

SEQ ID NO: 129713 - DNA, 35 bp, Artificial Sequence
  Synthetic oligonucleotide
agtacgccctctgcacctctcgcgccctttgtcca

SEQ ID NO: 129714 - DNA, 36 bp, Artificial Sequence
  Synthetic oligonucleotide
atcggactcgcgcagttatcttctccctcccgcgca

SEQ ID NO: 129715 - DNA, 35 bp, Artificial Sequence
  Synthetic oligonucleotide
gtatccccgcctttaatgccgtttctgtgctggca

SEQ ID NO: 129716 - DNA, 36 bp, Artificial Sequence
  Synthetic oligonucleotide
tccaccctaccagatctagtcctgttcttactttca

SEQ ID NO: 129717 - DNA, 38 bp, Artificial Sequence
  Synthetic oligonucleotide
actgggcgggggaagggtggggcgtcgattttgcgtga

SEQ ID NO: 129718 - DNA, 38 bp, Artificial Sequence
  Synthetic oligonucleotide
acaacaacaccacaggcctcattgatcttcgcccttga

SEQ ID NO: 129719 - DNA, 36 bp, Artificial Sequence
  Synthetic oligonucleotide
ttaccccgccttcatcagctttaagcgcccttacta

SEQ ID NO: 129720 - DNA, 36 bp, Artificial Sequence
  Synthetic oligonucleotide
aagtcaccccactcgcgcttgcctgttataccgtta

SEQ ID NO: 129721 - DNA, 35 bp, Artificial Sequence
  Synthetic oligonucleotide
tgaccaccatacggaacgtggcccttccatgctac

SEQ ID NO: 129722 - DNA, 35 bp, Artificial Sequence
  Synthetic oligonucleotide
gtgctccccttcccgctgcccctgtatcttgatcc

SEQ ID NO: 129723 - DNA, 35 bp, Artificial Sequence
  Synthetic oligonucleotide
tctcacccgcaaccatgtcacgtacaacgtactcc

SEQ ID NO: 129724 - DNA, 35 bp, Artificial Sequence
  Synthetic oligonucleotide
accgtgtccctctgaggttcagtcccccccgtatc

SEQ ID NO: 129725 - DNA, 35 bp, Artificial Sequence
  Synthetic oligonucleotide
tccccgtgagtatcgtaggatcccacaacctcctc

SEQ ID NO: 129726 - DNA, 35 bp, Artificial Sequence
  Synthetic oligonucleotide
tacaccccgcactgcctaccatctatgcctataag

SEQ ID NO: 129727 - DNA, 35 bp, Artificial Sequence
  Synthetic oligonucleotide
aatctccgcccatccccctgtgtattgtgtctgcg

SEQ ID NO: 129728 - DNA, 35 bp, Artificial Sequence
  Synthetic oligonucleotide
atgtacggccaggaaggagaaacggggcgggcagg

SEQ ID NO: 129729 - DNA, 35 bp, Artificial Sequence
  Synthetic oligonucleotide
gcttcccccccggcgccattacttctgagcctcct

SEQ ID NO: 129730 - DNA, 35 bp, Artificial Sequence
  Synthetic oligonucleotide
gccacaacatatgctcccctcaagcctggccctct

SEQ ID NO: 129731 - DNA, 36 bp, Artificial Sequence
  Synthetic oligonucleotide
gttgacgaacttgtgaggactcgcccttccttgcca

SEQ ID NO: 129732 - DNA, 35 bp, Artificial Sequence
  Synthetic oligonucleotide
gtgctgctcactactgctcctcgcgccctctacga

SEQ ID NO: 129733 - DNA, 36 bp, Artificial Sequence
  Synthetic oligonucleotide
gacgacccccccggtgacaacgctctcctctctcga

SEQ ID NO: 129734 - DNA, 36 bp, Artificial Sequence
  Synthetic oligonucleotide
gtcccatcgccacatcccccgagtgattcgtttcga

SEQ ID NO: 129735 - DNA, 35 bp, Artificial Sequence
  Synthetic oligonucleotide
gatgaggccgaggggcgagggcggtaaattgggga

SEQ ID NO: 129736 - DNA, 38 bp, Artificial Sequence
  Synthetic oligonucleotide
tgttacccgccccatttgtctttgcgcctgtcggttga

SEQ ID NO: 129737 - DNA, 37 bp, Artificial Sequence
  Synthetic oligonucleotide
tcgcccccctctgttagtccctgttcgcacgctttga

SEQ ID NO: 129738 - DNA, 35 bp, Artificial Sequence
  Synthetic oligonucleotide
atcgcccctccgcttctcggtatgtcggtcaccac

SEQ ID NO: 129739 - DNA, 35 bp, Artificial Sequence
  Synthetic oligonucleotide
gttgcccccccttccgtctgctccccctggtgccc

SEQ ID NO: 129740 - DNA, 35 bp, Artificial Sequence
  Synthetic oligonucleotide
tgatcccccgcagtagttttagtccgtcgcgctgc

SEQ ID NO: 129741 - DNA, 35 bp, Artificial Sequence
  Synthetic oligonucleotide
ggtacgtgtgccactcccccgttgctctgttcttc

SEQ ID NO: 129742 - DNA, 35 bp, Artificial Sequence
  Synthetic oligonucleotide
aaggatgggcgagtgagggatagggcatatgggag

SEQ ID NO: 129743 - DNA, 35 bp, Artificial Sequence
  Synthetic oligonucleotide
atccagccacacgtccccaaactcccgtactcacg

SEQ ID NO: 129744 - DNA, 35 bp, Artificial Sequence
  Synthetic oligonucleotide
atcccgcctcatggtgcaccctgacttactatccg

SEQ ID NO: 129745 - DNA, 35 bp, Artificial Sequence
  Synthetic oligonucleotide
gccccgctgcttatgttcctgccatctgttcgctg

SEQ ID NO: 129746 - DNA, 35 bp, Artificial Sequence
  Synthetic oligonucleotide
ttgtgtatgtgctctccgaccgcctatccgcccct

SEQ ID NO: 129747 - DNA, 35 bp, Artificial Sequence
  Synthetic oligonucleotide
atcctgcagacgcctaggccccgtttacccccaca

SEQ ID NO: 129748 - DNA, 35 bp, Artificial Sequence
  Synthetic oligonucleotide
gcccaccatcacgcgtcttaacacgtcaacgccca

SEQ ID NO: 129749 - DNA, 36 bp, Artificial Sequence
  Synthetic oligonucleotide
tagccggcctcgtatacgcctgtctcttcgcctcca

SEQ ID NO: 129750 - DNA, 38 bp, Artificial Sequence
  Synthetic oligonucleotide
gccccccctcctctgtttataggttgttgccactctga

SEQ ID NO: 129751 - DNA, 38 bp, Artificial Sequence
  Synthetic oligonucleotide
tacccccgcacctgcccaccagtcctgctaagcagtga

SEQ ID NO: 129752 - DNA, 38 bp, Artificial Sequence
  Synthetic oligonucleotide
tgccaggtccgtgatcctcgccccccgcccgctggtga

SEQ ID NO: 129753 - DNA, 38 bp, Artificial Sequence
  Synthetic oligonucleotide
gccaccctcggacagtagatcctcccttgcctgcttga

SEQ ID NO: 129754 - DNA, 36 bp, Artificial Sequence
  Synthetic oligonucleotide
tctcccccgcccgacgtatcgagtcttgctctagta

SEQ ID NO: 129755 - DNA, 35 bp, Artificial Sequence
  Synthetic oligonucleotide
atgcacgtacgttgctccgttcatcctatccttta

SEQ ID NO: 129756 - DNA, 30 bp, Artificial Sequence
  Synthetic oligonucleotide
gcgcccgccatttcgccctccaccgttacc

SEQ ID NO: 129757 - DNA, 35 bp, Artificial Sequence
  Synthetic oligonucleotide
actacattccgcgtatgtttctatgcccctcccgc

SEQ ID NO: 129758 - DNA, 35 bp, Artificial Sequence
  Synthetic oligonucleotide
gtgaacaccgagctatgcttctcgcccatcttggc

SEQ ID NO: 129759 - DNA, 35 bp, Artificial Sequence
  Synthetic oligonucleotide
acttgtcatcagttgttgcccccccgacgcgcctc

SEQ ID NO: 129760 - DNA, 34 bp, Artificial Sequence
  Synthetic oligonucleotide
aagccattgtccgacctactatgcacccgtcttc

SEQ ID NO: 129761 - DNA, 35 bp, Artificial Sequence
  Synthetic oligonucleotide
gaccgccctgcccggacccagtactctccctgttc

SEQ ID NO: 129762 - DNA, 35 bp, Artificial Sequence
  Synthetic oligonucleotide
gcccccgactttgtcgtcacggttccctcctttcg

SEQ ID NO: 129763 - DNA, 35 bp, Artificial Sequence
  Synthetic oligonucleotide
gtgccccttacctcctgtatcgtgtttttcccagg

SEQ ID NO: 129764 - DNA, 35 bp, Artificial Sequence
  Synthetic oligonucleotide
acaagtcagaggacacgggtaggggctggggggtg

SEQ ID NO: 129765 - DNA, 35 bp, Artificial Sequence
  Synthetic oligonucleotide
tgcgggctccgttgtccgccacctcctgcctcttg

SEQ ID NO: 129766 - DNA, 35 bp, Artificial Sequence
  Synthetic oligonucleotide
tgcgacatgtccatgcgctctctattattgcttct

SEQ ID NO: 129767 - DNA, 35 bp, Artificial Sequence
  Synthetic oligonucleotide
gtacccgtccctcgctcctccataaccagaccatt

SEQ ID NO: 129768 - DNA, 35 bp, Artificial Sequence
  Synthetic oligonucleotide
tcacactcgcgttgcagcttttacatagccccttt

SEQ ID NO: 129769 - DNA, 36 bp, Artificial Sequence
  Synthetic oligonucleotide
accacaaagactggaggggaggagtggggatgggca

SEQ ID NO: 129770 - DNA, 34 bp, Artificial Sequence
  Synthetic oligonucleotide
tgtgcgcccacgtccactccttcaccgcgtttca

SEQ ID NO: 129771 - DNA, 37 bp, Artificial Sequence
  Synthetic oligonucleotide
gacagaggggaaggaagggagcggccggtagtatgga

SEQ ID NO: 129772 - DNA, 38 bp, Artificial Sequence
  Synthetic oligonucleotide
gtgcgcaacattctctggcctccgtcttccctcgttga

SEQ ID NO: 129773 - DNA, 37 bp, Artificial Sequence
  Synthetic oligonucleotide
gccccatcctgccacttcttgagtcattcctgtttga

SEQ ID NO: 129774 - DNA, 34 bp, Artificial Sequence
  Synthetic oligonucleotide
tgctcctcctcgcttgcacctgtgccccttgata

SEQ ID NO: 129775 - DNA, 35 bp, Artificial Sequence
  Synthetic oligonucleotide
tatcgccgaatcctgcctgaggtcgctacccaccc

SEQ ID NO: 129776 - DNA, 35 bp, Artificial Sequence
  Synthetic oligonucleotide
acccttgcacgtactctctgctgccttgccactcc

SEQ ID NO: 129777 - DNA, 35 bp, Artificial Sequence
  Synthetic oligonucleotide
gtctgtgcacggtacgccccaatcgccatgcctcc

SEQ ID NO: 129778 - DNA, 35 bp, Artificial Sequence
  Synthetic oligonucleotide
tgcgcattccgatagccgtttctccacgctgctcc

SEQ ID NO: 129779 - DNA, 35 bp, Artificial Sequence
  Synthetic oligonucleotide
gttgccgtcgaccactcccggttcctgtcccactc

SEQ ID NO: 129780 - DNA, 34 bp, Artificial Sequence
  Synthetic oligonucleotide
gacgttctgcaccacccccgcccatgttctactc

SEQ ID NO: 129781 - DNA, 35 bp, Artificial Sequence
  Synthetic oligonucleotide
acgcccccccagggacccctcccttctcattgctc

SEQ ID NO: 129782 - DNA, 35 bp, Artificial Sequence
  Synthetic oligonucleotide
tgtaccgccccccacgccgaatcataccactgaag

SEQ ID NO: 129783 - DNA, 35 bp, Artificial Sequence
  Synthetic oligonucleotide
tgcattacaccagattccaccgctcctgcttaccg

SEQ ID NO: 129784 - DNA, 35 bp, Artificial Sequence
  Synthetic oligonucleotide
gcgccatgcaagcgctgatctccgcctccattccg

SEQ ID NO: 129785 - DNA, 35 bp, Artificial Sequence
  Synthetic oligonucleotide
aacccgtccatccgcgtactgctcattaaccttat

SEQ ID NO: 129786 - DNA, 35 bp, Artificial Sequence
  Synthetic oligonucleotide
gatattcgcggcacctgttacccacacactcccct

SEQ ID NO: 129787 - DNA, 34 bp, Artificial Sequence
  Synthetic oligonucleotide
tgccgagggcctctcctgtctagacgctgttaca

SEQ ID NO: 129788 - DNA, 36 bp, Artificial Sequence
  Synthetic oligonucleotide
actaggagggcgaaaggcggggcaggtaggttggca

SEQ ID NO: 129789 - DNA, 37 bp, Artificial Sequence
  Synthetic oligonucleotide
gactgacagatatcgggaggggaggcgtgggcacaga

SEQ ID NO: 129790 - DNA, 38 bp, Artificial Sequence
  Synthetic oligonucleotide
gaccgccgcctttcctcgtctcatacccgtccgtatga

SEQ ID NO: 129791 - DNA, 36 bp, Artificial Sequence
  Synthetic oligonucleotide
aagggggacgggggggcataacaaggtagtgggtga

SEQ ID NO: 129792 - DNA, 38 bp, Artificial Sequence
  Synthetic oligonucleotide
accacacgccgtgctggccatttaccttcacacattga

SEQ ID NO: 129793 - DNA, 35 bp, Artificial Sequence
  Synthetic oligonucleotide
tcccttcccatccgcccgcagtcccaataggggta

SEQ ID NO: 129794 - DNA, 35 bp, Artificial Sequence
  Synthetic oligonucleotide
tgcatccttcctgtctttaagtcttttcctcctta

SEQ ID NO: 129795 - DNA, 35 bp, Artificial Sequence
  Synthetic oligonucleotide
tctgcgacagcactgagccccatcccgtcatctac

SEQ ID NO: 129796 - DNA, 35 bp, Artificial Sequence
  Synthetic oligonucleotide
tcaacactgttattatgtccctctgtactcacgcc

SEQ ID NO: 129797 - DNA, 35 bp, Artificial Sequence
  Synthetic oligonucleotide
gcctagctccccgttctagcacgattcgcctcgcc

SEQ ID NO: 129798 - DNA, 35 bp, Artificial Sequence
  Synthetic oligonucleotide
tcagtacccatgccagtttcgtccagcctctctgc

SEQ ID NO: 129799 - DNA, 35 bp, Artificial Sequence
  Synthetic oligonucleotide
gatgacatgttgggggaggataggctggccgggag

SEQ ID NO: 129800 - DNA, 35 bp, Artificial Sequence
  Synthetic oligonucleotide
gagcgcaaggagggtgagaggagggacgggaagcg

SEQ ID NO: 129801 - DNA, 35 bp, Artificial Sequence
  Synthetic oligonucleotide
taccgcgagcaagcgtgttccctgtgcctgtcctg

SEQ ID NO: 129802 - DNA, 35 bp, Artificial Sequence
  Synthetic oligonucleotide
tatttcaccaccgccctgtttatcatgttcctttg

SEQ ID NO: 129803 - DNA, 35 bp, Artificial Sequence
  Synthetic oligonucleotide
agctccaacgccccttttgtgccaagctctctcat

SEQ ID NO: 129804 - DNA, 36 bp, Artificial Sequence
  Synthetic oligonucleotide
gcccattcgttccaccctcccttgtctctcgagact

SEQ ID NO: 129805 - DNA, 35 bp, Artificial Sequence
  Synthetic oligonucleotide
accttctccagtccgcgtgcctttctccagtgcct

SEQ ID NO: 129806 - DNA, 35 bp, Artificial Sequence
  Synthetic oligonucleotide
ttcaagcgcatgcccatcatataacgcccttgtct

SEQ ID NO: 129807 - DNA, 35 bp, Artificial Sequence
  Synthetic oligonucleotide
agccacaccccattcccggtctatatacgccttaa

SEQ ID NO: 129808 - DNA, 36 bp, Artificial Sequence
  Synthetic oligonucleotide
gtcaaggttatgggaagggagggtggggtccgggca

SEQ ID NO: 129809 - DNA, 36 bp, Artificial Sequence
  Synthetic oligonucleotide
aagcctctacccgtttcgttcagcactgctccatca

SEQ ID NO: 129810 - DNA, 37 bp, Artificial Sequence
  Synthetic oligonucleotide
gaacagggaggcggagtagaaaggccggtgcgtccga

SEQ ID NO: 129811 - DNA, 36 bp, Artificial Sequence
  Synthetic oligonucleotide
tagaaatgcacagggcagggagcaagggaggaagga

SEQ ID NO: 129812 - DNA, 38 bp, Artificial Sequence
  Synthetic oligonucleotide
gcactctgccgcctagtctctatacacccaccccgtga

SEQ ID NO: 129813 - DNA, 36 bp, Artificial Sequence
  Synthetic oligonucleotide
tcaccccgctacatgcccgtatctaagcgcgcccta

SEQ ID NO: 129814 - DNA, 35 bp, Artificial Sequence
  Synthetic oligonucleotide
cacacaccctcctgcacggtacctgtcctcaccac

SEQ ID NO: 129815 - DNA, 35 bp, Artificial Sequence
  Synthetic oligonucleotide
gaacgtccacgcgcgtactacctcaattgctaccc

SEQ ID NO: 129816 - DNA, 35 bp, Artificial Sequence
  Synthetic oligonucleotide
acacaacgacatgtcatctcgctcatacttgcccc

SEQ ID NO: 129817 - DNA, 35 bp, Artificial Sequence
  Synthetic oligonucleotide
tccagggcaggttattttagcccttcttcatgtcc

SEQ ID NO: 129818 - DNA, 35 bp, Artificial Sequence
  Synthetic oligonucleotide
agtgcactccatgtcatcgcctctatgccgtttcc

SEQ ID NO: 129819 - DNA, 35 bp, Artificial Sequence
  Synthetic oligonucleotide
gctcacccggtcttcttgttacggtactcaccttc

SEQ ID NO: 129820 - DNA, 35 bp, Artificial Sequence
  Synthetic oligonucleotide
tcattaaggcgacggggatgaaggggcggggggag

SEQ ID NO: 129821 - DNA, 35 bp, Artificial Sequence
  Synthetic oligonucleotide
tagacatgagggggaacggaggaacaggcaccagg

SEQ ID NO: 129822 - DNA, 35 bp, Artificial Sequence
  Synthetic oligonucleotide
gaaggggatggggtaggatggcgtagcggggccgg

SEQ ID NO: 129823 - DNA, 35 bp, Artificial Sequence
  Synthetic oligonucleotide
gatgccccccgattcgcccatgtggtactgcgcgg

SEQ ID NO: 129824 - DNA, 35 bp, Artificial Sequence
  Synthetic oligonucleotide
gagtgggaggggggcgcggtacagttagtcgtctg

SEQ ID NO: 129825 - DNA, 35 bp, Artificial Sequence
  Synthetic oligonucleotide
actcaccccgtatacgctgccatttatgagcccat

SEQ ID NO: 129826 - DNA, 35 bp, Artificial Sequence
  Synthetic oligonucleotide
gacgacctccatgacttcgctactttgttccgact

SEQ ID NO: 129827 - DNA, 35 bp, Artificial Sequence
  Synthetic oligonucleotide
tacgactctgcctccccacccctgcaagcggtact

SEQ ID NO: 129828 - DNA, 35 bp, Artificial Sequence
  Synthetic oligonucleotide
atatcccagacgccgcccttacgactgttcactct

SEQ ID NO: 129829 - DNA, 35 bp, Artificial Sequence
  Synthetic oligonucleotide
tctctccaccgctgcggtccattcgtcttatctgt

SEQ ID NO: 129830 - DNA, 35 bp, Artificial Sequence
  Synthetic oligonucleotide
tcaccttagtgcgtacatcccccggcccaatttgt

SEQ ID NO: 129831 - DNA, 35 bp, Artificial Sequence
  Synthetic oligonucleotide
gtagccagttcgtcacccgctttaacactcgcctt

SEQ ID NO: 129832 - DNA, 35 bp, Artificial Sequence
  Synthetic oligonucleotide
gtcccagcacaccggttctatctcccttcctggtt

SEQ ID NO: 129833 - DNA, 29 bp, Artificial Sequence
  Synthetic oligonucleotide
ggggtgggagggctctgggggtgcccttt

SEQ ID NO: 129834 - DNA, 35 bp, Artificial Sequence
  Synthetic oligonucleotide
tcctagccaccacccgcgtcgaatatctgcttaca

SEQ ID NO: 129835 - DNA, 37 bp, Artificial Sequence
  Synthetic oligonucleotide
ggaggtaggaaagggttcggagagagggggaaggcga

SEQ ID NO: 129836 - DNA, 37 bp, Artificial Sequence
  Synthetic oligonucleotide
gtagccccctgacccatcttgtgccgcctcttaagga

SEQ ID NO: 129837 - DNA, 35 bp, Artificial Sequence
  Synthetic oligonucleotide
tcccaccctctcgtcccctcttacgttcacacgga

SEQ ID NO: 129838 - DNA, 37 bp, Artificial Sequence
  Synthetic oligonucleotide
agaccaccgccttagccccgtacctctgcctttatga

SEQ ID NO: 129839 - DNA, 38 bp, Artificial Sequence
  Synthetic oligonucleotide
acgccctcttcccatgtaattagcctgcctttccgtga

SEQ ID NO: 129840 - DNA, 38 bp, Artificial Sequence
  Synthetic oligonucleotide
tcgacccacctccccttgactaaacacagtttccttga

SEQ ID NO: 129841 - DNA, 35 bp, Artificial Sequence
  Synthetic oligonucleotide
ttgtgcccaattccgttgcgtctaggcctctttcc

SEQ ID NO: 129842 - DNA, 35 bp, Artificial Sequence
  Synthetic oligonucleotide
gccggactcatctggggttcctcaacttctccctc

SEQ ID NO: 129843 - DNA, 35 bp, Artificial Sequence
  Synthetic oligonucleotide
atctcctccgtacagtcagcctggccttcgatctc

SEQ ID NO: 129844 - DNA, 35 bp, Artificial Sequence
  Synthetic oligonucleotide
agcgggggtgaaggtgaagagtgtgaacgtcaggg

SEQ ID NO: 129845 - DNA, 35 bp, Artificial Sequence
  Synthetic oligonucleotide
tgaagggtagggggggggaaaaactaccagttggg

SEQ ID NO: 129846 - DNA, 31 bp, Artificial Sequence
  Synthetic oligonucleotide
agttacggtcctccatcttgatctgttccat

SEQ ID NO: 129847 - DNA, 35 bp, Artificial Sequence
  Synthetic oligonucleotide
tgtgtgggggcggtggagggagggtgacagtgtat

SEQ ID NO: 129848 - DNA, 35 bp, Artificial Sequence
  Synthetic oligonucleotide
taccctctattgcttacgacctgcccgattcgcct

SEQ ID NO: 129849 - DNA, 35 bp, Artificial Sequence
  Synthetic oligonucleotide
tgggctccgtcacagcccccgtcctccccgatgct

SEQ ID NO: 129850 - DNA, 35 bp, Artificial Sequence
  Synthetic oligonucleotide
tacaccgctccttgtctcaacttagggtccttttt

SEQ ID NO: 129851 - DNA, 36 bp, Artificial Sequence
  Synthetic oligonucleotide
gctacctgccgtgcttccatcgttcttccagtcaca

SEQ ID NO: 129852 - DNA, 36 bp, Artificial Sequence
  Synthetic oligonucleotide
tgctcccatccgcctcgttgtcgcccaattcctaca

SEQ ID NO: 129853 - DNA, 35 bp, Artificial Sequence
  Synthetic oligonucleotide
gttccaccacttctgccactttctgttttacagca

SEQ ID NO: 129854 - DNA, 30 bp, Artificial Sequence
  Synthetic oligonucleotide
tacatcccccctgcctgcccttatctagca

SEQ ID NO: 129855 - DNA, 36 bp, Artificial Sequence
  Synthetic oligonucleotide
gtacgactcgccactatcccatgtccgtgcttctca

SEQ ID NO: 129856 - DNA, 37 bp, Artificial Sequence
  Synthetic oligonucleotide
gtgacgtggaaaaggtgcaaggagcgtggaggggaga

SEQ ID NO: 129857 - DNA, 37 bp, Artificial Sequence
  Synthetic oligonucleotide
gatacgtgcggagcagggggaggggggcacgggtaga

SEQ ID NO: 129858 - DNA, 37 bp, Artificial Sequence
  Synthetic oligonucleotide
tgacacatccgcttccgttctaaggttcctacttcga

SEQ ID NO: 129859 - DNA, 36 bp, Artificial Sequence
  Synthetic oligonucleotide
gacatctgcctcctgtacgtttcgttgttacttcga

SEQ ID NO: 129860 - DNA, 36 bp, Artificial Sequence
  Synthetic oligonucleotide
gttaggagaaggaagggtaagggaggaaacttggga

SEQ ID NO: 129861 - DNA, 37 bp, Artificial Sequence
  Synthetic oligonucleotide
atcccaccgccatcggcttccctgcccaaatcctgga

SEQ ID NO: 129862 - DNA, 37 bp, Artificial Sequence
  Synthetic oligonucleotide
gatgtcgttccaatgttgccccctctctcgcccttga

SEQ ID NO: 129863 - DNA, 38 bp, Artificial Sequence
  Synthetic oligonucleotide
acatcgcctcgtttttgcagcctcccttccgccgttga

SEQ ID NO: 129864 - DNA, 35 bp, Artificial Sequence
  Synthetic oligonucleotide
tccactttcccgtgatttacagattctgccccacc

SEQ ID NO: 129865 - DNA, 35 bp, Artificial Sequence
  Synthetic oligonucleotide
tgggtcccgacagtctgcctctccgtctccatacc

SEQ ID NO: 129866 - DNA, 35 bp, Artificial Sequence
  Synthetic oligonucleotide
tggacgcccccttgtgcctctttcgcatgcttacc

SEQ ID NO: 129867 - DNA, 35 bp, Artificial Sequence
  Synthetic oligonucleotide
atcacaacctgccttctagtcgttcagttcaacgc

SEQ ID NO: 129868 - DNA, 35 bp, Artificial Sequence
  Synthetic oligonucleotide
gttcaacaccattgctgtttccctattgacgccgc

SEQ ID NO: 129869 - DNA, 35 bp, Artificial Sequence
  Synthetic oligonucleotide
gcgtatgcaccgttccggcctctctgctaaccatc

SEQ ID NO: 129870 - DNA, 35 bp, Artificial Sequence
  Synthetic oligonucleotide
atggaccagttgcctcgttccgcccttacccgctc

SEQ ID NO: 129871 - DNA, 35 bp, Artificial Sequence
  Synthetic oligonucleotide
agtgcccgctgccactgccattacgctttacattc

SEQ ID NO: 129872 - DNA, 35 bp, Artificial Sequence
  Synthetic oligonucleotide
ttagctcgcccccttttgactatttccactctcgg

SEQ ID NO: 129873 - DNA, 35 bp, Artificial Sequence
  Synthetic oligonucleotide
ttaccggtggaagggaggtgtggtggaaatgatgg

SEQ ID NO: 129874 - DNA, 35 bp, Artificial Sequence
  Synthetic oligonucleotide
tcccacgcccaccctgcctacctgcaagcctattg

SEQ ID NO: 129875 - DNA, 35 bp, Artificial Sequence
  Synthetic oligonucleotide
tcacgcgctggttctgccctggccctgcctcccct

SEQ ID NO: 129876 - DNA, 36 bp, Artificial Sequence
  Synthetic oligonucleotide
tcatcttcccaggtggaccgaccatcacgctcctca

SEQ ID NO: 129877 - DNA, 37 bp, Artificial Sequence
  Synthetic oligonucleotide
acctgtgctctagccgtgatatctttccccctgccga

SEQ ID NO: 129878 - DNA, 37 bp, Artificial Sequence
  Synthetic oligonucleotide
ttggggctggagcgggaatacgggtggcggggaagga

SEQ ID NO: 129879 - DNA, 37 bp, Artificial Sequence
  Synthetic oligonucleotide
gaactgtcagggatcagcggggggagcgggaacggga

SEQ ID NO: 129880 - DNA, 36 bp, Artificial Sequence
  Synthetic oligonucleotide
gagtaacaaggggatgcgggaggggcgataggggga

SEQ ID NO: 129881 - DNA, 37 bp, Artificial Sequence
  Synthetic oligonucleotide
acaggtgaagtggtggtggcgggggaacgtgtgggga

SEQ ID NO: 129882 - DNA, 38 bp, Artificial Sequence
  Synthetic oligonucleotide
gccacagcggaggaaggacggatggctgggcgggtgga

SEQ ID NO: 129883 - DNA, 38 bp, Artificial Sequence
  Synthetic oligonucleotide
tctcgcatcgcagatcctcctcgccgaacgccccctga

SEQ ID NO: 129884 - DNA, 38 bp, Artificial Sequence
  Synthetic oligonucleotide
tgtgactacgccacccgctccacacactgtcaccttga

SEQ ID NO: 129885 - DNA, 36 bp, Artificial Sequence
  Synthetic oligonucleotide
aagtccggccccatctttgtcccttcgtcgtactta

SEQ ID NO: 129886 - DNA, 35 bp, Artificial Sequence
  Synthetic oligonucleotide
gagccctcccccctttgtactctgcctggtctcac

SEQ ID NO: 129887 - DNA, 35 bp, Artificial Sequence
  Synthetic oligonucleotide
tcgatttccgcacccctgtttcgaccgctctttac

SEQ ID NO: 129888 - DNA, 36 bp, Artificial Sequence
  Synthetic oligonucleotide
tcctcccgcatctgtactccatcgtcaggttacccc

SEQ ID NO: 129889 - DNA, 35 bp, Artificial Sequence
  Synthetic oligonucleotide
gtcaccaccccgccatgtgccctatttcattcccc

SEQ ID NO: 129890 - DNA, 35 bp, Artificial Sequence
  Synthetic oligonucleotide
gtgaactaagaggagtgggggagggaagggctaag

SEQ ID NO: 129891 - DNA, 35 bp, Artificial Sequence
  Synthetic oligonucleotide
tcgacccccgcttctcgccgtccaattatctaccg

SEQ ID NO: 129892 - DNA, 36 bp, Artificial Sequence
  Synthetic oligonucleotide
actcagcctcccagtccccatcgtcaggctttacca

SEQ ID NO: 129893 - DNA, 36 bp, Artificial Sequence
  Synthetic oligonucleotide
gtctacaatcagccttacgccccacactgcttgcca

SEQ ID NO: 129894 - DNA, 37 bp, Artificial Sequence
  Synthetic oligonucleotide
gacgccacccgcatacctctttggacctctgatacga

SEQ ID NO: 129895 - DNA, 37 bp, Artificial Sequence
  Synthetic oligonucleotide
gccgcggagcagggagagcgggagggcgggtcaccga

SEQ ID NO: 129896 - DNA, 37 bp, Artificial Sequence
  Synthetic oligonucleotide
actgcgcccatccgccaccgcttctagttctcgccga

SEQ ID NO: 129897 - DNA, 36 bp, Artificial Sequence
  Synthetic oligonucleotide
atccggcggagggagggggcacgcataggcggagga

SEQ ID NO: 129898 - DNA, 37 bp, Artificial Sequence
  Synthetic oligonucleotide
tgtagcatgggggggggagggcaaaaggaggtgggga

SEQ ID NO: 129899 - DNA, 34 bp, Artificial Sequence
  Synthetic oligonucleotide
tcctagccctgaacatgagcctccaccccactga

SEQ ID NO: 129900 - DNA, 38 bp, Artificial Sequence
  Synthetic oligonucleotide
acgtggtgggcgggtgggatgcagtgggcggggagtga

SEQ ID NO: 129901 - DNA, 38 bp, Artificial Sequence
  Synthetic oligonucleotide
tgccacctccatctacgccactgaggatcttcccttga

SEQ ID NO: 129902 - DNA, 35 bp, Artificial Sequence
  Synthetic oligonucleotide
gacacgtatctgcctacgttctttgtccctccata

SEQ ID NO: 129903 - DNA, 35 bp, Artificial Sequence
  Synthetic oligonucleotide
ttgatgcatcactctatctgcctcgtttttcaccc

SEQ ID NO: 129904 - DNA, 35 bp, Artificial Sequence
  Synthetic oligonucleotide
gtaccatgtccacccactaatgcacgaccactgcc

SEQ ID NO: 129905 - DNA, 35 bp, Artificial Sequence
  Synthetic oligonucleotide
ttggatgcactgcccgttcatgtctctcgcactgc

SEQ ID NO: 129906 - DNA, 35 bp, Artificial Sequence
  Synthetic oligonucleotide
gtaacgtctgcgcaccaccactctccgcgttctgc

SEQ ID NO: 129907 - DNA, 35 bp, Artificial Sequence
  Synthetic oligonucleotide
gtctggtcctgacgttttttccgaccctacctgtc

SEQ ID NO: 129908 - DNA, 35 bp, Artificial Sequence
  Synthetic oligonucleotide
ggtgccgctcttgtccccggtagcctcctcttgtc

SEQ ID NO: 129909 - DNA, 35 bp, Artificial Sequence
  Synthetic oligonucleotide
atgggcgccagaccgccactctgtccctcttttag

SEQ ID NO: 129910 - DNA, 35 bp, Artificial Sequence
  Synthetic oligonucleotide
gatacagccgccgcagccgatttccgccattcacg

SEQ ID NO: 129911 - DNA, 35 bp, Artificial Sequence
  Synthetic oligonucleotide
ccccccatccaatttgtatgttctacccttatgcg

SEQ ID NO: 129912 - DNA, 35 bp, Artificial Sequence
  Synthetic oligonucleotide
gttgccgtatgcatgccccatcgcttctccgctct

SEQ ID NO: 129913 - DNA, 36 bp, Artificial Sequence
  Synthetic oligonucleotide
accacaccccagttggaatgttacgctctttgccca

SEQ ID NO: 129914 - DNA, 36 bp, Artificial Sequence
  Synthetic oligonucleotide
gcccagactactgcctgccccgaacgatctccgcca

SEQ ID NO: 129915 - DNA, 36 bp, Artificial Sequence
  Synthetic oligonucleotide
gcctcgcttccgtccctaatcacccccccggacgca

SEQ ID NO: 129916 - DNA, 36 bp, Artificial Sequence
  Synthetic oligonucleotide
tccgcgtatggctcccctcgtcgatcgcttcactca

SEQ ID NO: 129917 - DNA, 37 bp, Artificial Sequence
  Synthetic oligonucleotide
gataaccaacgtcagcctgtcccttcccgttccccga

SEQ ID NO: 129918 - DNA, 37 bp, Artificial Sequence
  Synthetic oligonucleotide
agcccggaggtggctgggatggatgggtggaatccga

SEQ ID NO: 129919 - DNA, 36 bp, Artificial Sequence
  Synthetic oligonucleotide
gtccgtggaggggaaagggggcgcgggagggatcga

SEQ ID NO: 129920 - DNA, 36 bp, Artificial Sequence
  Synthetic oligonucleotide
gccaatctcagccgcttgcaactccctccgctagga

SEQ ID NO: 129921 - DNA, 37 bp, Artificial Sequence
  Synthetic oligonucleotide
ttccctacacaccgtatcagtgcccaccccccccgga

SEQ ID NO: 129922 - DNA, 37 bp, Artificial Sequence
  Synthetic oligonucleotide
tgtacgagggccgatggggaaggggctgcggggtgga

SEQ ID NO: 129923 - DNA, 38 bp, Artificial Sequence
  Synthetic oligonucleotide
atgctgccccaccatacactagtgaccacccccgctga

SEQ ID NO: 129924 - DNA, 38 bp, Artificial Sequence
  Synthetic oligonucleotide
gaaatggggcggaggggggaagattagcagtggggtga

SEQ ID NO: 129925 - DNA, 37 bp, Artificial Sequence
  Synthetic oligonucleotide
agatgaagcggggagggaaatagggcccggggattga

SEQ ID NO: 129926 - DNA, 36 bp, Artificial Sequence
  Synthetic oligonucleotide
gcgcccccctggcatcccgtttaatcaccccacgta

SEQ ID NO: 129927 - DNA, 35 bp, Artificial Sequence
  Synthetic oligonucleotide
ttcgacggtagtcggtcatgcccccacacccttac

SEQ ID NO: 129928 - DNA, 35 bp, Artificial Sequence
  Synthetic oligonucleotide
acgacgtcgtagcatcttatagttgtcccgcccgc

SEQ ID NO: 129929 - DNA, 35 bp, Artificial Sequence
  Synthetic oligonucleotide
accgaacctcccccgactcccgctcgcctcgggtc

SEQ ID NO: 129930 - DNA, 35 bp, Artificial Sequence
  Synthetic oligonucleotide
agtcctaacgcctgctggtcctctctccacctcat

SEQ ID NO: 129931 - DNA, 35 bp, Artificial Sequence
  Synthetic oligonucleotide
gcctggttcctcgtgcagtcatcttcctgccccct

SEQ ID NO: 129932 - DNA, 35 bp, Artificial Sequence
  Synthetic oligonucleotide
aacatcttccgctcgctcgttttcgcccaagttct

SEQ ID NO: 129933 - DNA, 35 bp, Artificial Sequence
  Synthetic oligonucleotide
atggcgcccatatcctgcaattcagccgcctttct

SEQ ID NO: 129934 - DNA, 32 bp, Artificial Sequence
  Synthetic oligonucleotide
tccaggccgtactacccgccatcgccgtccgt

SEQ ID NO: 129935 - DNA, 36 bp, Artificial Sequence
  Synthetic oligonucleotide
tttgcgctccagactcctatgcgcactcccttaaca

SEQ ID NO: 129936 - DNA, 35 bp, Artificial Sequence
  Synthetic oligonucleotide
tgtggtccaattcgttcctaagtcccactgcccca

SEQ ID NO: 129937 - DNA, 35 bp, Artificial Sequence
  Synthetic oligonucleotide
tacagcccacgccgcccttcgcatccgacactaga

SEQ ID NO: 129938 - DNA, 34 bp, Artificial Sequence
  Synthetic oligonucleotide
gtcgacacgtgcgcccctcccactacaccaccga

SEQ ID NO: 129939 - DNA, 35 bp, Artificial Sequence
  Synthetic oligonucleotide
actcgtgcgtgtcacttagttactccctcctccga

SEQ ID NO: 129940 - DNA, 37 bp, Artificial Sequence
  Synthetic oligonucleotide
tgttatcgcctgttcatatcccgctgaccctcttcga

SEQ ID NO: 129941 - DNA, 37 bp, Artificial Sequence
  Synthetic oligonucleotide
gagccgacgggtgtgatttggtcgggggggcaaagga

SEQ ID NO: 129942 - DNA, 36 bp, Artificial Sequence
  Synthetic oligonucleotide
tgatgcgccgcctcccaatatgcctcctcccttgga

SEQ ID NO: 129943 - DNA, 38 bp, Artificial Sequence
  Synthetic oligonucleotide
aacagaggtagcagaggaaggggatgggcagatggtga

SEQ ID NO: 129944 - DNA, 36 bp, Artificial Sequence
  Synthetic oligonucleotide
agctggaggtggagggtggaaggagtgtggtcaata

SEQ ID NO: 129945 - DNA, 35 bp, Artificial Sequence
  Synthetic oligonucleotide
gatgctcggatctgttctttgtctctgttttccac

SEQ ID NO: 129946 - DNA, 35 bp, Artificial Sequence
  Synthetic oligonucleotide
accacccctgctccttatcattgccgaacgtatac

SEQ ID NO: 129947 - DNA, 35 bp, Artificial Sequence
  Synthetic oligonucleotide
gctggtttgatctccgccagccgaacctactttac

SEQ ID NO: 129948 - DNA, 35 bp, Artificial Sequence
  Synthetic oligonucleotide
tacgtatgcaattcctctgttctttcgtgctcccc

SEQ ID NO: 129949 - DNA, 35 bp, Artificial Sequence
  Synthetic oligonucleotide
atgccgtggtccgttcgccaatctagtttccatcc

SEQ ID NO: 129950 - DNA, 35 bp, Artificial Sequence
  Synthetic oligonucleotide
gaggagggggatctgacggtaattagaaggggaag

SEQ ID NO: 129951 - DNA, 35 bp, Artificial Sequence
  Synthetic oligonucleotide
acaacccttcgcccagcggtagtatgacctccctg

SEQ ID NO: 129952 - DNA, 35 bp, Artificial Sequence
  Synthetic oligonucleotide
tgaaggccgattgccgcactgttctatccttcttg

SEQ ID NO: 129953 - DNA, 35 bp, Artificial Sequence
  Synthetic oligonucleotide
gtcataccatcaaccgcgtcctgctcgctcgatct

SEQ ID NO: 129954 - DNA, 36 bp, Artificial Sequence
  Synthetic oligonucleotide
actgaccccctgcctcactcgaccgagagtgtaaca

SEQ ID NO: 129955 - DNA, 36 bp, Artificial Sequence
  Synthetic oligonucleotide
atccaccaccacgccctccgctccgttcgtatcaca

SEQ ID NO: 129956 - DNA, 35 bp, Artificial Sequence
  Synthetic oligonucleotide
tagcgcaccctcacgtcttgcgtcttcacctgtca

SEQ ID NO: 129957 - DNA, 37 bp, Artificial Sequence
  Synthetic oligonucleotide
gtacaaggaacacggaatgagggggagggaagagaga

SEQ ID NO: 129958 - DNA, 37 bp, Artificial Sequence
  Synthetic oligonucleotide
tatccccgcagccacaccctgcgtccattgaacccga

SEQ ID NO: 129959 - DNA, 37 bp, Artificial Sequence
  Synthetic oligonucleotide
tagtgcgaggctaggaaaggaggcgttgggggcggga

SEQ ID NO: 129960 - DNA, 38 bp, Artificial Sequence
  Synthetic oligonucleotide
gcaccgtgtgatcacgctctggcttcctctctccctga

SEQ ID NO: 129961 - DNA, 38 bp, Artificial Sequence
  Synthetic oligonucleotide
agccccccctgtatgttcacccttgcccacggtcctga

SEQ ID NO: 129962 - DNA, 36 bp, Artificial Sequence
  Synthetic oligonucleotide
gccttcccctgtggctcgtgccttatctgccttcta

SEQ ID NO: 129963 - DNA, 36 bp, Artificial Sequence
  Synthetic oligonucleotide
gggaggaagcaagggaggaatcatggatgggaagta

SEQ ID NO: 129964 - DNA, 34 bp, Artificial Sequence
  Synthetic oligonucleotide
tcatcctccacatgagataccttgcacgtggccc

SEQ ID NO: 129965 - DNA, 35 bp, Artificial Sequence
  Synthetic oligonucleotide
tacgtcgccggccttcccaaaccgtccctgctccc

SEQ ID NO: 129966 - DNA, 35 bp, Artificial Sequence
  Synthetic oligonucleotide
tccgcccctttaaagccgcaccgatccttcctgcc

SEQ ID NO: 129967 - DNA, 35 bp, Artificial Sequence
  Synthetic oligonucleotide
atcagtgtgccctgtccgtacccctcaacccttcc

SEQ ID NO: 129968 - DNA, 35 bp, Artificial Sequence
  Synthetic oligonucleotide
ttgggtgcctcgctctgtagccgtaacatccatgc

SEQ ID NO: 129969 - DNA, 35 bp, Artificial Sequence
  Synthetic oligonucleotide
tcccacgttatgttcgttcctgttttttgcatctc

SEQ ID NO: 129970 - DNA, 31 bp, Artificial Sequence
  Synthetic oligonucleotide
gccggagcgtgtttctccgccattaccgttc

SEQ ID NO: 129971 - DNA, 35 bp, Artificial Sequence
  Synthetic oligonucleotide
ttgtgcccgaccactacttacagtatcacctcccg

SEQ ID NO: 129972 - DNA, 35 bp, Artificial Sequence
  Synthetic oligonucleotide
gtctccccgccgagtccttctgttcacccttggct

SEQ ID NO: 129973 - DNA, 35 bp, Artificial Sequence
  Synthetic oligonucleotide
acgccgtggcgaccgtcgctcctaccctgaactct

SEQ ID NO: 129974 - DNA, 36 bp, Artificial Sequence
  Synthetic oligonucleotide
gatagcctcggtaccttcccactctagcttcgccca

SEQ ID NO: 129975 - DNA, 37 bp, Artificial Sequence
  Synthetic oligonucleotide
ggggaaagggtgggtaaggggagtaagacgaaccaga

SEQ ID NO: 129976 - DNA, 35 bp, Artificial Sequence
  Synthetic oligonucleotide
ttggtgcgacccgcagcatctctctctcgccccga

SEQ ID NO: 129977 - DNA, 37 bp, Artificial Sequence
  Synthetic oligonucleotide
accaccccatatgtcggatccaccccaccttgtagga

SEQ ID NO: 129978 - DNA, 37 bp, Artificial Sequence
  Synthetic oligonucleotide
ttcggaggagggggcatagtggaggtgccgcagggga

SEQ ID NO: 129979 - DNA, 36 bp, Artificial Sequence
  Synthetic oligonucleotide
acctgctcaccaggtttttgtttgttctaccgccta

SEQ ID NO: 129980 - DNA, 35 bp, Artificial Sequence
  Synthetic oligonucleotide
acacgctagcccactcctgtagctttgaatctcac

SEQ ID NO: 129981 - DNA, 35 bp, Artificial Sequence
  Synthetic oligonucleotide
ggtgaacccgctgctcccaactttttgtcgcctcc

SEQ ID NO: 129982 - DNA, 35 bp, Artificial Sequence
  Synthetic oligonucleotide
tgctctccgcctctctcgaattgtttcaatgttcc

SEQ ID NO: 129983 - DNA, 35 bp, Artificial Sequence
  Synthetic oligonucleotide
gacgccccccgtttcccgtaagtttcggttaaatc

SEQ ID NO: 129984 - DNA, 35 bp, Artificial Sequence
  Synthetic oligonucleotide
gaagagcaagataggggagaaagagggggaatagg

SEQ ID NO: 129985 - DNA, 35 bp, Artificial Sequence
  Synthetic oligonucleotide
agcaccgcctgcagttatcctgctattacccgcct

SEQ ID NO: 129986 - DNA, 35 bp, Artificial Sequence
  Synthetic oligonucleotide
ttccacccctgttcctcagccggtacgaccgactt

SEQ ID NO: 129987 - DNA, 35 bp, Artificial Sequence
  Synthetic oligonucleotide
gctccaccgctacgtcctcacgcccatcgttgttt

SEQ ID NO: 129988 - DNA, 35 bp, Artificial Sequence
  Synthetic oligonucleotide
taacacctcaatacgccaccccccgtgccccgtaa

SEQ ID NO: 129989 - DNA, 36 bp, Artificial Sequence
  Synthetic oligonucleotide
atcgatccccgcccgcacaccccccaacagttggca

SEQ ID NO: 129990 - DNA, 36 bp, Artificial Sequence
  Synthetic oligonucleotide
gttgctgtcccctgtcttccgcccgagcttcgccga

SEQ ID NO: 129991 - DNA, 35 bp, Artificial Sequence
  Synthetic oligonucleotide
gacccaaccgtaatccgccacccccactctggtga

SEQ ID NO: 129992 - DNA, 37 bp, Artificial Sequence
  Synthetic oligonucleotide
tgccacctacgctgtacccgcacactgatttacttga

SEQ ID NO: 129993 - DNA, 38 bp, Artificial Sequence
  Synthetic oligonucleotide
tgccacatctgaccttattacgttgtccccggccttga

SEQ ID NO: 129994 - DNA, 35 bp, Artificial Sequence
  Synthetic oligonucleotide
gtcactcccgccaagccgcctgcgagcccctgtcc

SEQ ID NO: 129995 - DNA, 35 bp, Artificial Sequence
  Synthetic oligonucleotide
ttcgacatcctttccgtgagcccctcgagctgtcc

SEQ ID NO: 129996 - DNA, 35 bp, Artificial Sequence
  Synthetic oligonucleotide
tacaacgcagcactccgcgccttttgatcgattcc

SEQ ID NO: 129997 - DNA, 35 bp, Artificial Sequence
  Synthetic oligonucleotide
tccatgtccctcacgccagccatcgtttgctgatc

SEQ ID NO: 129998 - DNA, 35 bp, Artificial Sequence
  Synthetic oligonucleotide
gaccacacgggggttagggcgggtgggcattgctc

SEQ ID NO: 129999 - DNA, 35 bp, Artificial Sequence
  Synthetic oligonucleotide
gaaggccgccttccattcgcagtatcctatctccg

SEQ ID NO: 130000 - DNA, 35 bp, Artificial Sequence
  Synthetic oligonucleotide
gatcagcccacatccccttttccccactcgatcgg

SEQ ID NO: 130001 - DNA, 35 bp, Artificial Sequence
  Synthetic oligonucleotide
aatgagagggaagggaataggtaagggacaaggtg

SEQ ID NO: 130002 - DNA, 35 bp, Artificial Sequence
  Synthetic oligonucleotide
attctccgcgcctgctttctcttatggtccacttg

SEQ ID NO: 130003 - DNA, 35 bp, Artificial Sequence
  Synthetic oligonucleotide
gcatcgctcgctcatattaagccctgtttccactt

SEQ ID NO: 130004 - DNA, 36 bp, Artificial Sequence
  Synthetic oligonucleotide
acggaagtggggcggaagggcgggaaaactcggaca

SEQ ID NO: 130005 - DNA, 37 bp, Artificial Sequence
  Synthetic oligonucleotide
tattcctgccgccttgtttcgctatcctccccccgga

SEQ ID NO: 130006 - DNA, 37 bp, Artificial Sequence
  Synthetic oligonucleotide
gactaccacaacaccatctgtattcgtgccgaattga

SEQ ID NO: 130007 - DNA, 35 bp, Artificial Sequence
  Synthetic oligonucleotide
actgcccaatcctgttgctcacttaatgccatcta

SEQ ID NO: 130008 - DNA, 35 bp, Artificial Sequence
  Synthetic oligonucleotide
gcctagcaggctgtcttttatcctttaccttcgcc

SEQ ID NO: 130009 - DNA, 35 bp, Artificial Sequence
  Synthetic oligonucleotide
tgtccgtcacatctgcgcccaaagctgtcttatcc

SEQ ID NO: 130010 - DNA, 35 bp, Artificial Sequence
  Synthetic oligonucleotide
tgtgtgccccgccccgctcttaattacctcgcatc

SEQ ID NO: 130011 - DNA, 35 bp, Artificial Sequence
  Synthetic oligonucleotide
gatccgctgcccctctcacagtacaagccgcattc

SEQ ID NO: 130012 - DNA, 35 bp, Artificial Sequence
  Synthetic oligonucleotide
ggaaccaccgcgtcgccaccctccggtccctgttc

SEQ ID NO: 130013 - DNA, 35 bp, Artificial Sequence
  Synthetic oligonucleotide
gctcccgccgcccttattattaccgtatgtcatcg

SEQ ID NO: 130014 - DNA, 35 bp, Artificial Sequence
  Synthetic oligonucleotide
caccccgcctctccgtctaaagacgcaccgcaggg

SEQ ID NO: 130015 - DNA, 34 bp, Artificial Sequence
  Synthetic oligonucleotide
ggacaccccgcgcctgccgttacaccacttcaat

SEQ ID NO: 130016 - DNA, 34 bp, Artificial Sequence
  Synthetic oligonucleotide
acgttgccccgcctcactcagcaaatttggccct

SEQ ID NO: 130017 - DNA, 35 bp, Artificial Sequence
  Synthetic oligonucleotide
tcccccgcgaaccggatgtcgccatcgccgtttct

SEQ ID NO: 130018 - DNA, 35 bp, Artificial Sequence
  Synthetic oligonucleotide
tccgcccttacgccgcctaccgcttccacgtggtt

SEQ ID NO: 130019 - DNA, 36 bp, Artificial Sequence
  Synthetic oligonucleotide
gcccattccatacttgtaacagatcctccgccccga

SEQ ID NO: 130020 - DNA, 35 bp, Artificial Sequence
  Synthetic oligonucleotide
taccccgcatgccaatcttcgccaccatttcctga

SEQ ID NO: 130021 - DNA, 37 bp, Artificial Sequence
  Synthetic oligonucleotide
gatgcgtccttccgtgtcctcttcaccgctcctctga

SEQ ID NO: 130022 - DNA, 36 bp, Artificial Sequence
  Synthetic oligonucleotide
tccaccctctgtcttagacgccctgtcgttttctta

SEQ ID NO: 130023 - DNA, 35 bp, Artificial Sequence
  Synthetic oligonucleotide
tcgacgccctctatctcgaatctacaccctcgcac

SEQ ID NO: 130024 - DNA, 35 bp, Artificial Sequence
  Synthetic oligonucleotide
gccccgccccggaaaccaccatgttcggtcttacc

SEQ ID NO: 130025 - DNA, 35 bp, Artificial Sequence
  Synthetic oligonucleotide
tcacatcctcacatatttgccttcgtccggtacgc

SEQ ID NO: 130026 - DNA, 36 bp, Artificial Sequence
  Synthetic oligonucleotide
tgccaccaccattgtacacttagctgcctgacgcgc

SEQ ID NO: 130027 - DNA, 35 bp, Artificial Sequence
  Synthetic oligonucleotide
tcccaagcctgagcgcggctttccccctgccttgc

SEQ ID NO: 130028 - DNA, 35 bp, Artificial Sequence
  Synthetic oligonucleotide
ccacgcgtagtttccaggcctgtctccatcacctc

SEQ ID NO: 130029 - DNA, 35 bp, Artificial Sequence
  Synthetic oligonucleotide
tcctgcccaactggttccgacgtccatcataatcg

SEQ ID NO: 130030 - DNA, 35 bp, Artificial Sequence
  Synthetic oligonucleotide
ttgtaactcgccaccacccttatcagacccgctgg

SEQ ID NO: 130031 - DNA, 35 bp, Artificial Sequence
  Synthetic oligonucleotide
tatacatccgatagccttccgtccctgccgtgcct

SEQ ID NO: 130032 - DNA, 35 bp, Artificial Sequence
  Synthetic oligonucleotide
gacccttctacgccccatcgacactccccgtatgt

SEQ ID NO: 130033 - DNA, 35 bp, Artificial Sequence
  Synthetic oligonucleotide
ttgcacaccccaaatactgtcgaaagcacgccctt

SEQ ID NO: 130034 - DNA, 35 bp, Artificial Sequence
  Synthetic oligonucleotide
atgacaaagccacccccccgcccagcctttctgtt

SEQ ID NO: 130035 - DNA, 36 bp, Artificial Sequence
  Synthetic oligonucleotide
gtggctcggacgccattgccgttccatcctgttcca

SEQ ID NO: 130036 - DNA, 35 bp, Artificial Sequence
  Synthetic oligonucleotide
tccccatcacgccatggtgttcagctcccgccgca

SEQ ID NO: 130037 - DNA, 35 bp, Artificial Sequence
  Synthetic oligonucleotide
agctcaccacccatcctaccgtgcattctgtctca

SEQ ID NO: 130038 - DNA, 35 bp, Artificial Sequence
  Synthetic oligonucleotide
tcagactccacgcatcaggcccagtatcctcttca

SEQ ID NO: 130039 - DNA, 37 bp, Artificial Sequence
  Synthetic oligonucleotide
tctaagacgggtggggagggagggaggtatgatatga

SEQ ID NO: 130040 - DNA, 37 bp, Artificial Sequence
  Synthetic oligonucleotide
gccttcctccctgccgtcaactagccgcgcttactga

SEQ ID NO: 130041 - DNA, 37 bp, Artificial Sequence
  Synthetic oligonucleotide
acgccctcgcccagctcctactatcgagctgccttga

SEQ ID NO: 130042 - DNA, 38 bp, Artificial Sequence
  Synthetic oligonucleotide
tgcacccagcccagatgctatcacccgcacccctttga

SEQ ID NO: 130043 - DNA, 35 bp, Artificial Sequence
  Synthetic oligonucleotide
tcatgcagccgccacctactcttctacgcactcac

SEQ ID NO: 130044 - DNA, 35 bp, Artificial Sequence
  Synthetic oligonucleotide
agcctcccgatcgtttctttctctctggccggacc

SEQ ID NO: 130045 - DNA, 35 bp, Artificial Sequence
  Synthetic oligonucleotide
acatgcacactgctcttagtccggcttatcccccc

SEQ ID NO: 130046 - DNA, 35 bp, Artificial Sequence
  Synthetic oligonucleotide
tgttgacagccgtaccactgctccgccatccagcc

SEQ ID NO: 130047 - DNA, 35 bp, Artificial Sequence
  Synthetic oligonucleotide
gaagtctgcctccgccgtgaggaccccacctagcc

SEQ ID NO: 130048 - DNA, 35 bp, Artificial Sequence
  Synthetic oligonucleotide
aatcgcccttgccctgtcgtgccttggtttattcc

SEQ ID NO: 130049 - DNA, 35 bp, Artificial Sequence
  Synthetic oligonucleotide
gccggggtccatccggtgctaaaccgctcccttcc

SEQ ID NO: 130050 - DNA, 35 bp, Artificial Sequence
  Synthetic oligonucleotide
tcagagagctgctgccttaatgactctttctccgc

SEQ ID NO: 130051 - DNA, 35 bp, Artificial Sequence
  Synthetic oligonucleotide
gctaccacgtccttataccactcccgcgcccttgc

SEQ ID NO: 130052 - DNA, 35 bp, Artificial Sequence
  Synthetic oligonucleotide
agaatggatggaaggatcggagggcggaaggggag

SEQ ID NO: 130053 - DNA, 35 bp, Artificial Sequence
  Synthetic oligonucleotide
ggagtagggggaaaggtgtggggggcgaacttgag

SEQ ID NO: 130054 - DNA, 35 bp, Artificial Sequence
  Synthetic oligonucleotide
tctgtgcgcagtagcctgtccttcgtgcctcaccg

SEQ ID NO: 130055 - DNA, 35 bp, Artificial Sequence
  Synthetic oligonucleotide
tggaggtcaaccatcgcctttcccgtcgcccatcg

SEQ ID NO: 130056 - DNA, 35 bp, Artificial Sequence
  Synthetic oligonucleotide
tgtgactatatgctcctactcgcccgctaacgcct

SEQ ID NO: 130057 - DNA, 35 bp, Artificial Sequence
  Synthetic oligonucleotide
gtggaaggcgaggagagggagggcgggattcagct

SEQ ID NO: 130058 - DNA, 35 bp, Artificial Sequence
  Synthetic oligonucleotide
tgccccttcctgttccatcccaagacgatcactct

SEQ ID NO: 130059 - DNA, 35 bp, Artificial Sequence
  Synthetic oligonucleotide
aacccctgccagtcctgcctgtcccgctttccatt

SEQ ID NO: 130060 - DNA, 35 bp, Artificial Sequence
  Synthetic oligonucleotide
agtgccctgccccactttacccggactcgcccctt

SEQ ID NO: 130061 - DNA, 37 bp, Artificial Sequence
  Synthetic oligonucleotide
accgcgcaaggcttggggggtgacgagggtgggcgga

SEQ ID NO: 130062 - DNA, 36 bp, Artificial Sequence
  Synthetic oligonucleotide
tggaaagggcactgaggcggtaaagggagggaggga

SEQ ID NO: 130063 - DNA, 35 bp, Artificial Sequence
  Synthetic oligonucleotide
tatgacccgccctcttagtagcctatcagtcacta

SEQ ID NO: 130064 - DNA, 35 bp, Artificial Sequence
  Synthetic oligonucleotide
gtgaccactacagtttttttatacctgcctcctta

SEQ ID NO: 130065 - DNA, 35 bp, Artificial Sequence
  Synthetic oligonucleotide
aacagccccatccttgtctaatctggcgcccgaac

SEQ ID NO: 130066 - DNA, 35 bp, Artificial Sequence
  Synthetic oligonucleotide
gccttcatgccgcctcaatcgctcatctgatccac

SEQ ID NO: 130067 - DNA, 35 bp, Artificial Sequence
  Synthetic oligonucleotide
tctcccctccagctatagccggcctcgtgttccac

SEQ ID NO: 130068 - DNA, 35 bp, Artificial Sequence
  Synthetic oligonucleotide
aattcgcctgccctcgtttgttcttctgtcttgcg

SEQ ID NO: 130069 - DNA, 35 bp, Artificial Sequence
  Synthetic oligonucleotide
gagctcgtcgttggtcctgttccattcctcacctg

SEQ ID NO: 130070 - DNA, 35 bp, Artificial Sequence
  Synthetic oligonucleotide
atcccaccgatcgacgctcctgcaatattcctgtg

SEQ ID NO: 130071 - DNA, 35 bp, Artificial Sequence
  Synthetic oligonucleotide
aaccactgccccttgtgccatcttgtctttcgcat

SEQ ID NO: 130072 - DNA, 36 bp, Artificial Sequence
  Synthetic oligonucleotide
gaccccttacatctgagccccggtacagttgactaa

SEQ ID NO: 130073 - DNA, 35 bp, Artificial Sequence
  Synthetic oligonucleotide
actccacatagatcgctgtcccccttcctttagca

SEQ ID NO: 130074 - DNA, 36 bp, Artificial Sequence
  Synthetic oligonucleotide
gtggcttcacggataatgggagggaggggacgggca

SEQ ID NO: 130075 - DNA, 35 bp, Artificial Sequence
  Synthetic oligonucleotide
tagtagtggaggcgggcaaggaccagaggggggca

SEQ ID NO: 130076 - DNA, 36 bp, Artificial Sequence
  Synthetic oligonucleotide
gttccaccccgttcatccgccccgcctactattgca

SEQ ID NO: 130077 - DNA, 37 bp, Artificial Sequence
  Synthetic oligonucleotide
gcgatctccctctgcgcgcccccgtttccgtctacga

SEQ ID NO: 130078 - DNA, 37 bp, Artificial Sequence
  Synthetic oligonucleotide
tgctcgcctgccccccttctgtcaacacgcaccccga

SEQ ID NO: 130079 - DNA, 37 bp, Artificial Sequence
  Synthetic oligonucleotide
tgccgcacccaagtgcttcaagcctcgcttccctcga

SEQ ID NO: 130080 - DNA, 36 bp, Artificial Sequence
  Synthetic oligonucleotide
acccacttcggtctcccgtgccatctccgtcctcga

SEQ ID NO: 130081 - DNA, 36 bp, Artificial Sequence
  Synthetic oligonucleotide
tggaggaaggttgagagggggtgcgggtgcggggga

SEQ ID NO: 130082 - DNA, 35 bp, Artificial Sequence
  Synthetic oligonucleotide
gatcggggatgggcgggaggaacggttgagggtga

SEQ ID NO: 130083 - DNA, 35 bp, Artificial Sequence
  Synthetic oligonucleotide
gcacgtgtcgctttcccctgcctagtgccatcata

SEQ ID NO: 130084 - DNA, 35 bp, Artificial Sequence
  Synthetic oligonucleotide
taaccccggcgcccactttgcttaaacgccctata

SEQ ID NO: 130085 - DNA, 35 bp, Artificial Sequence
  Synthetic oligonucleotide
aacccgccatctgccgcccgcttgcccctcggaac

SEQ ID NO: 130086 - DNA, 35 bp, Artificial Sequence
  Synthetic oligonucleotide
gccgcaagcactttgtcttcggcctgattcacacc

SEQ ID NO: 130087 - DNA, 35 bp, Artificial Sequence
  Synthetic oligonucleotide
gtcacccatgccgctgcccccgggggattgccacc

SEQ ID NO: 130088 - DNA, 36 bp, Artificial Sequence
  Synthetic oligonucleotide
gaccacttctcatccgggacttagccacgtactccc

SEQ ID NO: 130089 - DNA, 35 bp, Artificial Sequence
  Synthetic oligonucleotide
tgtgtctccctcagccgttgcaataactacatctc

SEQ ID NO: 130090 - DNA, 35 bp, Artificial Sequence
  Synthetic oligonucleotide
acactagcatcgctcctatgacctgctttcctctc

SEQ ID NO: 130091 - DNA, 35 bp, Artificial Sequence
  Synthetic oligonucleotide
ttcgcccgcacctccccctaactcttgttgacgcg

SEQ ID NO: 130092 - DNA, 35 bp, Artificial Sequence
  Synthetic oligonucleotide
tttgactccgcctgctcagcgtcacattccttgcg

SEQ ID NO: 130093 - DNA, 35 bp, Artificial Sequence
  Synthetic oligonucleotide
tgagactgtacgggatgggggggtgaacgggttcg

SEQ ID NO: 130094 - DNA, 35 bp, Artificial Sequence
  Synthetic oligonucleotide
taatcctccgacctcagtttccccgttcaccaggg

SEQ ID NO: 130095 - DNA, 35 bp, Artificial Sequence
  Synthetic oligonucleotide
tcccccctcgccaccttagccccccgcttttcggg

SEQ ID NO: 130096 - DNA, 35 bp, Artificial Sequence
  Synthetic oligonucleotide
tcttacgcaccttctccgacctgtccttgcctgtg

SEQ ID NO: 130097 - DNA, 35 bp, Artificial Sequence
  Synthetic oligonucleotide
atcgaacgcgttacccgctgctgctacgttttcct

SEQ ID NO: 130098 - DNA, 35 bp, Artificial Sequence
  Synthetic oligonucleotide
tgcacgaacgtcctgcacactcccaagtccccgct

SEQ ID NO: 130099 - DNA, 35 bp, Artificial Sequence
  Synthetic oligonucleotide
agccaagcgcactttccatcacctgccacgcgagt

SEQ ID NO: 130100 - DNA, 35 bp, Artificial Sequence
  Synthetic oligonucleotide
tccacccgccgaaatgctcactttagtccttgggt

SEQ ID NO: 130101 - DNA, 36 bp, Artificial Sequence
  Synthetic oligonucleotide
ttccccccgtgacaagctccgtacttgtgcctccca

SEQ ID NO: 130102 - DNA, 36 bp, Artificial Sequence
  Synthetic oligonucleotide
tttgccccaccgcactggctactcccgagcttccca

SEQ ID NO: 130103 - DNA, 37 bp, Artificial Sequence
  Synthetic oligonucleotide
gcgcaacctacacatactagtgatcacccgcccccga

SEQ ID NO: 130104 - DNA, 36 bp, Artificial Sequence
  Synthetic oligonucleotide
tttgccccgccctcgtagcccccatcaattatggga

SEQ ID NO: 130105 - DNA, 27 bp, Artificial Sequence
  Synthetic oligonucleotide
ttgacgcccgcaccactgtcccgctga

SEQ ID NO: 130106 - DNA, 35 bp, Artificial Sequence
  Synthetic oligonucleotide
ttggccaactcttcagcaccgaccccgccccttga

SEQ ID NO: 130107 - DNA, 38 bp, Artificial Sequence
  Synthetic oligonucleotide
tgtaccacgccgttcggttctgcgatttcccctcttga

SEQ ID NO: 130108 - DNA, 33 bp, Artificial Sequence
  Synthetic oligonucleotide
tcaaccaccgccattcgcaacataattgcacta

SEQ ID NO: 130109 - DNA, 35 bp, Artificial Sequence
  Synthetic oligonucleotide
acgccatctctgcctaagtgctccttgtccgccac

SEQ ID NO: 130110 - DNA, 35 bp, Artificial Sequence
  Synthetic oligonucleotide
tcgaatgccatcaccgtctccgcgaccccagcacc

SEQ ID NO: 130111 - DNA, 35 bp, Artificial Sequence
  Synthetic oligonucleotide
tcgtcccatcctccttgagtctctctggttgcacc

SEQ ID NO: 130112 - DNA, 35 bp, Artificial Sequence
  Synthetic oligonucleotide
tgaccatcgctcttgactgcacttaggccccttcc

SEQ ID NO: 130113 - DNA, 35 bp, Artificial Sequence
  Synthetic oligonucleotide
acctccacacctcatgtatagtcttttcacacatc

SEQ ID NO: 130114 - DNA, 35 bp, Artificial Sequence
  Synthetic oligonucleotide
tttccccgtcacaaatcggcgccatttgtcccatc

SEQ ID NO: 130115 - DNA, 35 bp, Artificial Sequence
  Synthetic oligonucleotide
tgtcgtcgccattttgctgcccccttcctatctag

SEQ ID NO: 130116 - DNA, 35 bp, Artificial Sequence
  Synthetic oligonucleotide
ccacactcccgttgctgtctcgtactttcttctcg

SEQ ID NO: 130117 - DNA, 35 bp, Artificial Sequence
  Synthetic oligonucleotide
tctgacccgacgccgtaacaatactaccaccattg

SEQ ID NO: 130118 - DNA, 35 bp, Artificial Sequence
  Synthetic oligonucleotide
agatcgtcagccgcaacttctcccacatgtcccgt

SEQ ID NO: 130119 - DNA, 36 bp, Artificial Sequence
  Synthetic oligonucleotide
ttgcacacgtccttcctccactctcgctcccatgtt

SEQ ID NO: 130120 - DNA, 37 bp, Artificial Sequence
  Synthetic oligonucleotide
actactcgacgagtgtacgcatcaacccgccccccga

SEQ ID NO: 130121 - DNA, 37 bp, Artificial Sequence
  Synthetic oligonucleotide
cccgccgatccaccgtttatcttgcctgccacctcga

SEQ ID NO: 130122 - DNA, 37 bp, Artificial Sequence
  Synthetic oligonucleotide
tgtggccccacttagtttttaagccccgtcccctcga

SEQ ID NO: 130123 - DNA, 38 bp, Artificial Sequence
  Synthetic oligonucleotide
ttgcccgctccatctatcctcagctcggtcatgagtga

SEQ ID NO: 130124 - DNA, 37 bp, Artificial Sequence
  Synthetic oligonucleotide
tcatacccgttgtagcctgccatatactccctcgtga

SEQ ID NO: 130125 - DNA, 38 bp, Artificial Sequence
  Synthetic oligonucleotide
actgagacggcggggtaggaggcattgggggatggtga

SEQ ID NO: 130126 - DNA, 37 bp, Artificial Sequence
  Synthetic oligonucleotide
acagccccactctggtcacccgtccactttcacttga

SEQ ID NO: 130127 - DNA, 35 bp, Artificial Sequence
  Synthetic oligonucleotide
tggaccctctgcccgccccccccgtttacactgta

SEQ ID NO: 130128 - DNA, 35 bp, Artificial Sequence
  Synthetic oligonucleotide
acgcccatcgagcctgttggctacttaacccaccc

SEQ ID NO: 130129 - DNA, 35 bp, Artificial Sequence
  Synthetic oligonucleotide
acgttaacacctctgcctcgatgactcccttacgc

SEQ ID NO: 130130 - DNA, 35 bp, Artificial Sequence
  Synthetic oligonucleotide
gcctgtggtcgcgcttcgcatggtcctatcccctc

SEQ ID NO: 130131 - DNA, 35 bp, Artificial Sequence
  Synthetic oligonucleotide
tcacaccatggttcacgctcccgcttcccgttctc

SEQ ID NO: 130132 - DNA, 35 bp, Artificial Sequence
  Synthetic oligonucleotide
tgtaagcctatgggcggagggggaggggcttggct

SEQ ID NO: 130133 - DNA, 35 bp, Artificial Sequence
  Synthetic oligonucleotide
gccagtccgttgattctttgtcacgtgccacctct

SEQ ID NO: 130134 - DNA, 35 bp, Artificial Sequence
  Synthetic oligonucleotide
acttgcctccgcccgccagctggtccgcgctttct

SEQ ID NO: 130135 - DNA, 35 bp, Artificial Sequence
  Synthetic oligonucleotide
tgtgcgcacgtccgcccgctttcccggttgtcttt

SEQ ID NO: 130136 - DNA, 35 bp, Artificial Sequence
  Synthetic oligonucleotide
tattcacgccgttcgcctgctgctatttccactaa

SEQ ID NO: 130137 - DNA, 35 bp, Artificial Sequence
  Synthetic oligonucleotide
ttttcgccgcatgcccatgttcgccccacctcgca

SEQ ID NO: 130138 - DNA, 36 bp, Artificial Sequence
  Synthetic oligonucleotide
tacacgtgtccacgttctatcacgccttgttattca

SEQ ID NO: 130139 - DNA, 35 bp, Artificial Sequence
  Synthetic oligonucleotide
gctcacctgcttgtttcgttccctcgcgcccccta

SEQ ID NO: 130140 - DNA, 35 bp, Artificial Sequence
  Synthetic oligonucleotide
tccccgtatcactggtatcttcctgttcgttcgcc

SEQ ID NO: 130141 - DNA, 35 bp, Artificial Sequence
  Synthetic oligonucleotide
gcacttccatcccgccagcgtgtggcccccttgcc

SEQ ID NO: 130142 - DNA, 35 bp, Artificial Sequence
  Synthetic oligonucleotide
gacatcttcggtgccgcacacatcccccatttgcc

SEQ ID NO: 130143 - DNA, 35 bp, Artificial Sequence
  Synthetic oligonucleotide
gcaatgcgctcgttgacctccaccctcataacgtc

SEQ ID NO: 130144 - DNA, 34 bp, Artificial Sequence
  Synthetic oligonucleotide
actgtccgggaagggaagggtggggtatgcgcag

SEQ ID NO: 130145 - DNA, 35 bp, Artificial Sequence
  Synthetic oligonucleotide
aacccacccacagaatcccatctttatgcatcccg

SEQ ID NO: 130146 - DNA, 36 bp, Artificial Sequence
  Synthetic oligonucleotide
tgccctcccgtcctcactatctgcatgtccagcaaa

SEQ ID NO: 130147 - DNA, 36 bp, Artificial Sequence
  Synthetic oligonucleotide
gctccaccccccctgtgatcatggtactatgtggca

SEQ ID NO: 130148 - DNA, 37 bp, Artificial Sequence
  Synthetic oligonucleotide
aagagtgagggccgggaagaagaaggagcgtcacaga

SEQ ID NO: 130149 - DNA, 37 bp, Artificial Sequence
  Synthetic oligonucleotide
atcctggggccgatactggggacgatggggcgggaga

SEQ ID NO: 130150 - DNA, 37 bp, Artificial Sequence
  Synthetic oligonucleotide
acacgaagagggaagtggggagttaatcgggaaggga

SEQ ID NO: 130151 - DNA, 37 bp, Artificial Sequence
  Synthetic oligonucleotide
gttacaggtcgcccgtatttttccctcctctcgtgga

SEQ ID NO: 130152 - DNA, 38 bp, Artificial Sequence
  Synthetic oligonucleotide
tgatgccctcccccctgttatttcgccacagtcaatga

SEQ ID NO: 130153 - DNA, 35 bp, Artificial Sequence
  Synthetic oligonucleotide
gagacaccatcgattcgccctcgcttggtctacac

SEQ ID NO: 130154 - DNA, 35 bp, Artificial Sequence
  Synthetic oligonucleotide
gtcgccacttctcgccctggttcctttgaaatgac

SEQ ID NO: 130155 - DNA, 34 bp, Artificial Sequence
  Synthetic oligonucleotide
atttcctgcccgtctgagcgtcttactttgcccc

SEQ ID NO: 130156 - DNA, 35 bp, Artificial Sequence
  Synthetic oligonucleotide
aacactgtctggtccgcctatatgctactgcctcc

SEQ ID NO: 130157 - DNA, 35 bp, Artificial Sequence
  Synthetic oligonucleotide
atgcatggcccatgcccgatgatttccaccgtttc

SEQ ID NO: 130158 - DNA, 35 bp, Artificial Sequence
  Synthetic oligonucleotide
gaatgacgggggggaaaagggataccagccgatgg

SEQ ID NO: 130159 - DNA, 35 bp, Artificial Sequence
  Synthetic oligonucleotide
acacagcctagttatcctttgccgtgcctcccctg

SEQ ID NO: 130160 - DNA, 35 bp, Artificial Sequence
  Synthetic oligonucleotide
ggaggggcgacgggaggaaaacggtttagcgcttg

SEQ ID NO: 130161 - DNA, 35 bp, Artificial Sequence
  Synthetic oligonucleotide
gatgcggttcatcagtgcaagctcttcacctccat

SEQ ID NO: 130162 - DNA, 35 bp, Artificial Sequence
  Synthetic oligonucleotide
atagcaagcgcacgctctcttccattgctgtacct

SEQ ID NO: 130163 - DNA, 35 bp, Artificial Sequence
  Synthetic oligonucleotide
tccatggcactcgcatccctatatggtgcccctct

SEQ ID NO: 130164 - DNA, 35 bp, Artificial Sequence
  Synthetic oligonucleotide
ttgggggagttctggggaggggagggggaaaggaa

SEQ ID NO: 130165 - DNA, 35 bp, Artificial Sequence
  Synthetic oligonucleotide
tacgtatggcccttcctgtgaacactccgccccca

SEQ ID NO: 130166 - DNA, 36 bp, Artificial Sequence
  Synthetic oligonucleotide
tctgcccggtgaggagtggggggggagatggggcca

SEQ ID NO: 130167 - DNA, 37 bp, Artificial Sequence
  Synthetic oligonucleotide
gcgcaggtaggggaaggaggggctggggtcgaggcga

SEQ ID NO: 130168 - DNA, 38 bp, Artificial Sequence
  Synthetic oligonucleotide
gatggacaggaaagtacagggggaggcggttaaaggga

SEQ ID NO: 130169 - DNA, 37 bp, Artificial Sequence
  Synthetic oligonucleotide
gagggagaagggatgctagaacgggggaagaagggga

SEQ ID NO: 130170 - DNA, 38 bp, Artificial Sequence
  Synthetic oligonucleotide
acatcaccgcgcccatccgtccacgtcgcatcctctga

SEQ ID NO: 130171 - DNA, 36 bp, Artificial Sequence
  Synthetic oligonucleotide
acagtcacctgtccagacctcctccgatcgttgtga

SEQ ID NO: 130172 - DNA, 35 bp, Artificial Sequence
  Synthetic oligonucleotide
tctgatgtccctcttgttgtccactgtcttgtacc

SEQ ID NO: 130173 - DNA, 35 bp, Artificial Sequence
  Synthetic oligonucleotide
agctaccgccctactatcatgctcccgcaagtgcc

SEQ ID NO: 130174 - DNA, 35 bp, Artificial Sequence
  Synthetic oligonucleotide
gtgaccggccaaatcacccgccccttcttgagtcc

SEQ ID NO: 130175 - DNA, 35 bp, Artificial Sequence
  Synthetic oligonucleotide
tccgaacgctatgccgtttttccacctgttcctgc

SEQ ID NO: 130176 - DNA, 35 bp, Artificial Sequence
  Synthetic oligonucleotide
tccaccttctcggtctcgactacacggtctcttgc

SEQ ID NO: 130177 - DNA, 35 bp, Artificial Sequence
  Synthetic oligonucleotide
gagcattccgccattaccaccccccgctcgagtag

SEQ ID NO: 130178 - DNA, 35 bp, Artificial Sequence
  Synthetic oligonucleotide
gacctacgctatgtgttttatcataccaccctccg

SEQ ID NO: 130179 - DNA, 35 bp, Artificial Sequence
  Synthetic oligonucleotide
acccctctccgacgactaatgttttccctgtctcg

SEQ ID NO: 130180 - DNA, 35 bp, Artificial Sequence
  Synthetic oligonucleotide
tgctggtcacgtgaccatcctcgttattgcctctg

SEQ ID NO: 130181 - DNA, 35 bp, Artificial Sequence
  Synthetic oligonucleotide
tccccgtacactgtctacgccaactcctttttgat

SEQ ID NO: 130182 - DNA, 35 bp, Artificial Sequence
  Synthetic oligonucleotide
tccggagtacgcccggttactggacctcgccccct

SEQ ID NO: 130183 - DNA, 35 bp, Artificial Sequence
  Synthetic oligonucleotide
tcttgccctccactgcaccggcccccggcccatct

SEQ ID NO: 130184 - DNA, 35 bp, Artificial Sequence
  Synthetic oligonucleotide
gcgactaccccgcctccggtgtcaacttctcttct

SEQ ID NO: 130185 - DNA, 36 bp, Artificial Sequence
  Synthetic oligonucleotide
gcaccccccgcggttcatttcctgggttcaacacca

SEQ ID NO: 130186 - DNA, 38 bp, Artificial Sequence
  Synthetic oligonucleotide
tgtgcccctcacgtccattaccctcctcgcgcccgtga

SEQ ID NO: 130187 - DNA, 38 bp, Artificial Sequence
  Synthetic oligonucleotide
agtttgcgccgtcgtctattcgctctcttctctgttga

SEQ ID NO: 130188 - DNA, 36 bp, Artificial Sequence
  Synthetic oligonucleotide
tagctggtcacgcaccagtaatcgcctcccccccta

SEQ ID NO: 130189 - DNA, 35 bp, Artificial Sequence
  Synthetic oligonucleotide
actgtgacggcacacttagtttcggcctcctttac

SEQ ID NO: 130190 - DNA, 35 bp, Artificial Sequence
  Synthetic oligonucleotide
acaacgcccgcatggctgactcatatccctcgccc

SEQ ID NO: 130191 - DNA, 35 bp, Artificial Sequence
  Synthetic oligonucleotide
atccgtactctcctattgctatatcgtgcctagcc

SEQ ID NO: 130192 - DNA, 35 bp, Artificial Sequence
  Synthetic oligonucleotide
gtgcatgcccgcaccgcctcccgtgcctacatcgc

SEQ ID NO: 130193 - DNA, 35 bp, Artificial Sequence
  Synthetic oligonucleotide
tagttccaccgccgattgatacgttctccgtgctc

SEQ ID NO: 130194 - DNA, 34 bp, Artificial Sequence
  Synthetic oligonucleotide
tcctccaccaccgcctccccaaaggaagcactag

SEQ ID NO: 130195 - DNA, 35 bp, Artificial Sequence
  Synthetic oligonucleotide
tgcctcctgcgcacgacctccgaccatcccctctg

SEQ ID NO: 130196 - DNA, 35 bp, Artificial Sequence
  Synthetic oligonucleotide
taattccccgcctcagtgtccccccggcgcaccct

SEQ ID NO: 130197 - DNA, 35 bp, Artificial Sequence
  Synthetic oligonucleotide
ttggtggggggtcagggggctgagggtggatgggt

SEQ ID NO: 130198 - DNA, 36 bp, Artificial Sequence
  Synthetic oligonucleotide
gttcagcctcggcctgctacttcatcgttcgttcaa

SEQ ID NO: 130199 - DNA, 36 bp, Artificial Sequence
  Synthetic oligonucleotide
atgtcctcccaccgaatatgtactatcggacctaca

SEQ ID NO: 130200 - DNA, 35 bp, Artificial Sequence
  Synthetic oligonucleotide
ggagttcccatccgttatccgtgcagatctaccca

SEQ ID NO: 130201 - DNA, 36 bp, Artificial Sequence
  Synthetic oligonucleotide
atggggaggaaattggggacaaaggagcgacgggca

SEQ ID NO: 130202 - DNA, 35 bp, Artificial Sequence
  Synthetic oligonucleotide
tccccgcagccgcttttgccgcttgttcctctgca

SEQ ID NO: 130203 - DNA, 36 bp, Artificial Sequence
  Synthetic oligonucleotide
ttgtgccacctcgcatcgaattgttctgccctaaga

SEQ ID NO: 130204 - DNA, 35 bp, Artificial Sequence
  Synthetic oligonucleotide
tgatcaccgccgccgacgagccttaccatcatcga

SEQ ID NO: 130205 - DNA, 35 bp, Artificial Sequence
  Synthetic oligonucleotide
atttgggaggggtagagggaggatcaggaatcgga

SEQ ID NO: 130206 - DNA, 36 bp, Artificial Sequence
  Synthetic oligonucleotide
tcaccctcgccacagggccctatcacaccaggaata

SEQ ID NO: 130207 - DNA, 36 bp, Artificial Sequence
  Synthetic oligonucleotide
agcgggggggcatgggaatgggtgggtattactgta

SEQ ID NO: 130208 - DNA, 35 bp, Artificial Sequence
  Synthetic oligonucleotide
aacattcgccccattacccttcgcggacaggctta

SEQ ID NO: 130209 - DNA, 35 bp, Artificial Sequence
  Synthetic oligonucleotide
tcggtcatcatgcagtccgttccttttcgttctac

SEQ ID NO: 130210 - DNA, 35 bp, Artificial Sequence
  Synthetic oligonucleotide
aatgccatcaccattcgcctattaggaattccgcc

SEQ ID NO: 130211 - DNA, 35 bp, Artificial Sequence
  Synthetic oligonucleotide
tcacacctgactctcctagtatcagccattttatc

SEQ ID NO: 130212 - DNA, 35 bp, Artificial Sequence
  Synthetic oligonucleotide
gtccccgtgtggtgtttcggtgtctcgttccccct

SEQ ID NO: 130213 - DNA, 35 bp, Artificial Sequence
  Synthetic oligonucleotide
tacattcgccgctcacccctcttgtttacttgtct

SEQ ID NO: 130214 - DNA, 35 bp, Artificial Sequence
  Synthetic oligonucleotide
atcagcacagctcagtccttccttccctcccccgt

SEQ ID NO: 130215 - DNA, 35 bp, Artificial Sequence
  Synthetic oligonucleotide
acacgtagcctcatctttttcccatccgtgcactt

SEQ ID NO: 130216 - DNA, 36 bp, Artificial Sequence
  Synthetic oligonucleotide
tccacccactacttttcccgcaaggacagtgtacaa

SEQ ID NO: 130217 - DNA, 35 bp, Artificial Sequence
  Synthetic oligonucleotide
atgaccacccgcccaatatattagcctgataccaa

SEQ ID NO: 130218 - DNA, 35 bp, Artificial Sequence
  Synthetic oligonucleotide
actgtccaccttcacttagagtccgttcactccca

SEQ ID NO: 130219 - DNA, 36 bp, Artificial Sequence
  Synthetic oligonucleotide
gccgctgccttcgtttcttacctgcctgttaccgca

SEQ ID NO: 130220 - DNA, 35 bp, Artificial Sequence
  Synthetic oligonucleotide
gtctgttacatcgccgcctatcccccctgcattca

SEQ ID NO: 130221 - DNA, 35 bp, Artificial Sequence
  Synthetic oligonucleotide
aatgcacctacttggttgtccccgtttcgcactta

SEQ ID NO: 130222 - DNA, 35 bp, Artificial Sequence
  Synthetic oligonucleotide
tgcacccccattgttacctcagcatacgctcctta

SEQ ID NO: 130223 - DNA, 35 bp, Artificial Sequence
  Synthetic oligonucleotide
tattgctatccgcacgtgtgcctccctcgccaaac

SEQ ID NO: 130224 - DNA, 32 bp, Artificial Sequence
  Synthetic oligonucleotide
aacatccccgcgcccccctaacaacactccgc

SEQ ID NO: 130225 - DNA, 35 bp, Artificial Sequence
  Synthetic oligonucleotide
acgcacacagcagctaccgcgtactttccctgggc

SEQ ID NO: 130226 - DNA, 35 bp, Artificial Sequence
  Synthetic oligonucleotide
gttccaccagcccccacattatcgcctaccatcgg

SEQ ID NO: 130227 - DNA, 35 bp, Artificial Sequence
  Synthetic oligonucleotide
tgttaacccagttcgcacttatatccagttcccat

SEQ ID NO: 130228 - DNA, 35 bp, Artificial Sequence
  Synthetic oligonucleotide
tcgatgtaccgcgcacgtactcacgctcatcccct

SEQ ID NO: 130229 - DNA, 35 bp, Artificial Sequence
  Synthetic oligonucleotide
acccccagacgggcactccgaacaagtacactcct

SEQ ID NO: 130230 - DNA, 35 bp, Artificial Sequence
  Synthetic oligonucleotide
gacgcgcttgtagtacttctcgcccaccaatcctt

SEQ ID NO: 130231 - DNA, 35 bp, Artificial Sequence
  Synthetic oligonucleotide
tgatccattccgttgcccttccgagaagttcgttt

SEQ ID NO: 130232 - DNA, 36 bp, Artificial Sequence
  Synthetic oligonucleotide
gccatcctcttgcctcatggtcgccgtttgttgcca

SEQ ID NO: 130233 - DNA, 36 bp, Artificial Sequence
  Synthetic oligonucleotide
gctgacacgattccttgctgcttatatagcccctca

SEQ ID NO: 130234 - DNA, 36 bp, Artificial Sequence
  Synthetic oligonucleotide
ggtcaccgccattgatcgcacgccttctccctttca

SEQ ID NO: 130235 - DNA, 37 bp, Artificial Sequence
  Synthetic oligonucleotide
tattcccacctcccaccttcttgtgtcgtgccctgga

SEQ ID NO: 130236 - DNA, 38 bp, Artificial Sequence
  Synthetic oligonucleotide
gttgctgtcactccgtgtctgtcctttcccagtcatga

SEQ ID NO: 130237 - DNA, 36 bp, Artificial Sequence
  Synthetic oligonucleotide
tcgctaccacttagctatgtgcctccccctgccata

SEQ ID NO: 130238 - DNA, 35 bp, Artificial Sequence
  Synthetic oligonucleotide
atcacgccctcggcttggtacccttccctgaacta

SEQ ID NO: 130239 - DNA, 35 bp, Artificial Sequence
  Synthetic oligonucleotide
tccgcgccgcctccccaccgacctaccactgcgta

SEQ ID NO: 130240 - DNA, 35 bp, Artificial Sequence
  Synthetic oligonucleotide
accctacgctgatgtcacggcctaccaccatacac

SEQ ID NO: 130241 - DNA, 35 bp, Artificial Sequence
  Synthetic oligonucleotide
tgtccacttccctgcccacttgcgcccccgtgcac

SEQ ID NO: 130242 - DNA, 35 bp, Artificial Sequence
  Synthetic oligonucleotide
tatggggccccggtcctggttctgttcttgcctgc

SEQ ID NO: 130243 - DNA, 35 bp, Artificial Sequence
  Synthetic oligonucleotide
actttccaccggcgacctctatacgctgtctcctc

SEQ ID NO: 130244 - DNA, 35 bp, Artificial Sequence
  Synthetic oligonucleotide
tgtgcgcctatattctccggttccgttttgctgtc

SEQ ID NO: 130245 - DNA, 35 bp, Artificial Sequence
  Synthetic oligonucleotide
gaatcgagcgcctacctaccgtgccttcccctttc

SEQ ID NO: 130246 - DNA, 35 bp, Artificial Sequence
  Synthetic oligonucleotide
gcccacgcgtgtctgtttaacgtttccctttcacg

SEQ ID NO: 130247 - DNA, 35 bp, Artificial Sequence
  Synthetic oligonucleotide
tccgcgccttctcacgctctctccatgcaccaccg

SEQ ID NO: 130248 - DNA, 35 bp, Artificial Sequence
  Synthetic oligonucleotide
gccatatgggagggggggaaaatgggttgctgtcg

SEQ ID NO: 130249 - DNA, 35 bp, Artificial Sequence
  Synthetic oligonucleotide
gcacctgcacccgggcactcagctctttcgcctct

SEQ ID NO: 130250 - DNA, 35 bp, Artificial Sequence
  Synthetic oligonucleotide
tgttcctgcctctttcccctgtcctatcagccgtt

SEQ ID NO: 130251 - DNA, 35 bp, Artificial Sequence
  Synthetic oligonucleotide
aggggatggccggggggagggaagacgcagggtaa

SEQ ID NO: 130252 - DNA, 36 bp, Artificial Sequence
  Synthetic oligonucleotide
gacgcccctccccctgttgagtttctcgttcttaca

SEQ ID NO: 130253 - DNA, 36 bp, Artificial Sequence
  Synthetic oligonucleotide
gccgtcccgtctatctcagccttgctcctcgcggca

SEQ ID NO: 130254 - DNA, 36 bp, Artificial Sequence
  Synthetic oligonucleotide
actcactctccgctctcgtatcttacctggctatca

SEQ ID NO: 130255 - DNA, 35 bp, Artificial Sequence
  Synthetic oligonucleotide
agctctccgccccatcgtatgaacaatatccctca

SEQ ID NO: 130256 - DNA, 37 bp, Artificial Sequence
  Synthetic oligonucleotide
ttgaaccgcatgcttttttcgcctgtcccactaccga

SEQ ID NO: 130257 - DNA, 37 bp, Artificial Sequence
  Synthetic oligonucleotide
ggttggcaatggggaaggggaaaggagggaagatcga

SEQ ID NO: 130258 - DNA, 37 bp, Artificial Sequence
  Synthetic oligonucleotide
gcaccgcctgctaagccctccgactccccgaatctga

SEQ ID NO: 130259 - DNA, 38 bp, Artificial Sequence
  Synthetic oligonucleotide
gtactgcccgctgactttgacttttgccctctgtttga

SEQ ID NO: 130260 - DNA, 35 bp, Artificial Sequence
  Synthetic oligonucleotide
gcgtggccctaggttcctgtctcttatgccttacc

SEQ ID NO: 130261 - DNA, 35 bp, Artificial Sequence
  Synthetic oligonucleotide
tctagccggttactggttatttcgcctgacctccc

SEQ ID NO: 130262 - DNA, 35 bp, Artificial Sequence
  Synthetic oligonucleotide
tcctaccgccactgctcccttaccgccacccccgc

SEQ ID NO: 130263 - DNA, 35 bp, Artificial Sequence
  Synthetic oligonucleotide
tggtcccgcctcccgcctacggaaagaccctccgc

SEQ ID NO: 130264 - DNA, 35 bp, Artificial Sequence
  Synthetic oligonucleotide
gcagtaggcatcgaaatagggcgggggggcaagag

SEQ ID NO: 130265 - DNA, 35 bp, Artificial Sequence
  Synthetic oligonucleotide
ggtccacccttcgcgcctgcacatgcacattcctg

SEQ ID NO: 130266 - DNA, 35 bp, Artificial Sequence
  Synthetic oligonucleotide
ttgacgccctactcgcagcaactacccgcttcctg

SEQ ID NO: 130267 - DNA, 35 bp, Artificial Sequence
  Synthetic oligonucleotide
gcgcaaccgcctttctccatgctatggatcccttt

SEQ ID NO: 130268 - DNA, 35 bp, Artificial Sequence
  Synthetic oligonucleotide
gttgtcctcgccacctaccccgaccgctctgctaa

SEQ ID NO: 130269 - DNA, 35 bp, Artificial Sequence
  Synthetic oligonucleotide
acccaccgaccctgccccttggtctctctcgacga

SEQ ID NO: 130270 - DNA, 35 bp, Artificial Sequence
  Synthetic oligonucleotide
gtcaagcctcttgcgtcgttctcatctccgcccga

SEQ ID NO: 130271 - DNA, 37 bp, Artificial Sequence
  Synthetic oligonucleotide
gtccgagagacagggggacggaaggcggacaaacgga

SEQ ID NO: 130272 - DNA, 37 bp, Artificial Sequence
  Synthetic oligonucleotide
tgaatgtggccaaggggggaggaaggtgaggtgcgga

SEQ ID NO: 130273 - DNA, 37 bp, Artificial Sequence
  Synthetic oligonucleotide
tcacagggtgggggtggtgggggcacagaaaggtgga

SEQ ID NO: 130274 - DNA, 35 bp, Artificial Sequence
  Synthetic oligonucleotide
agtcgccgcccctcccattgtaaccgttcccatga

SEQ ID NO: 130275 - DNA, 38 bp, Artificial Sequence
  Synthetic oligonucleotide
aaagggtgggaagggggggattcaacgggaaacggtga

SEQ ID NO: 130276 - DNA, 36 bp, Artificial Sequence
  Synthetic oligonucleotide
gtcatccaaccggccttgctccgccccactacgtta

SEQ ID NO: 130277 - DNA, 35 bp, Artificial Sequence
  Synthetic oligonucleotide
gacactgaccttccctgtacaattccccgtaggcc

SEQ ID NO: 130278 - DNA, 35 bp, Artificial Sequence
  Synthetic oligonucleotide
acttcccacccgctgccacgctaaccactgatctc

SEQ ID NO: 130279 - DNA, 35 bp, Artificial Sequence
  Synthetic oligonucleotide
aaccctccgtcagccaccgctttcttcagttcgtc

SEQ ID NO: 130280 - DNA, 35 bp, Artificial Sequence
  Synthetic oligonucleotide
gggtggcgggggggttttgctgatggcacatcgcg

SEQ ID NO: 130281 - DNA, 35 bp, Artificial Sequence
  Synthetic oligonucleotide
tcagagggggtgggataaacggggtagttggcatg

SEQ ID NO: 130282 - DNA, 35 bp, Artificial Sequence
  Synthetic oligonucleotide
tctgctcccgcaccctgagttaccctgcctccctg

SEQ ID NO: 130283 - DNA, 35 bp, Artificial Sequence
  Synthetic oligonucleotide
tatgccacatacaacgtctatctcccctcctgctg

SEQ ID NO: 130284 - DNA, 35 bp, Artificial Sequence
  Synthetic oligonucleotide
agaccgctcatatacgtgcgtcacctctctccttg

SEQ ID NO: 130285 - DNA, 36 bp, Artificial Sequence
  Synthetic oligonucleotide
tcacctcccatgctgttgtcacttccacctagttaa

SEQ ID NO: 130286 - DNA, 37 bp, Artificial Sequence
  Synthetic oligonucleotide
tcacacccctccgagccacatacaactggagacacga

SEQ ID NO: 130287 - DNA, 35 bp, Artificial Sequence
  Synthetic oligonucleotide
tcccatcaaccgatctttgtctttcgtcgacccga

SEQ ID NO: 130288 - DNA, 37 bp, Artificial Sequence
  Synthetic oligonucleotide
ggatgcaggaagggaagggcgttgaagccggggagga

SEQ ID NO: 130289 - DNA, 37 bp, Artificial Sequence
  Synthetic oligonucleotide
gcaaaggtaggaggaaacacaagaggaacacggcgga

SEQ ID NO: 130290 - DNA, 37 bp, Artificial Sequence
  Synthetic oligonucleotide
tcacacttccctccgcccgatctggcccttttaggga

SEQ ID NO: 130291 - DNA, 35 bp, Artificial Sequence
  Synthetic oligonucleotide
gtatggtgggggacggagtggcggatatgagggga

SEQ ID NO: 130292 - DNA, 36 bp, Artificial Sequence
  Synthetic oligonucleotide
gaccgttagtcacggggaaaaggattgcggggggga

SEQ ID NO: 130293 - DNA, 26 bp, Artificial Sequence
  Synthetic oligonucleotide
gcccgatgccctcgtgatccctttga

SEQ ID NO: 130294 - DNA, 35 bp, Artificial Sequence
  Synthetic oligonucleotide
gactcccgtacgttactgtctgttcactattttac

SEQ ID NO: 130295 - DNA, 35 bp, Artificial Sequence
  Synthetic oligonucleotide
tttggtcgcccgttgtctacatcgttctcttttac

SEQ ID NO: 130296 - DNA, 35 bp, Artificial Sequence
  Synthetic oligonucleotide
tactcgtaccctctcacgtaactatgtctatggtc

SEQ ID NO: 130297 - DNA, 35 bp, Artificial Sequence
  Synthetic oligonucleotide
tcccccatccgacccgcactccgtttacagcctgg

SEQ ID NO: 130298 - DNA, 35 bp, Artificial Sequence
  Synthetic oligonucleotide
tccgttaccgcctgatatcacgccggcctattgct

SEQ ID NO: 130299 - DNA, 35 bp, Artificial Sequence
  Synthetic oligonucleotide
gtccgtccacctggtatttctgctccccctatatt

SEQ ID NO: 130300 - DNA, 37 bp, Artificial Sequence
  Synthetic oligonucleotide
tcaacagaccgccagctaggtcatacacccccaccaa

SEQ ID NO: 130301 - DNA, 35 bp, Artificial Sequence
  Synthetic oligonucleotide
gcgagcacaccccgattctgtccaccttgcttcca

SEQ ID NO: 130302 - DNA, 36 bp, Artificial Sequence
  Synthetic oligonucleotide
tcaatgcgcggcaatcgtccatcccctgatccctca

SEQ ID NO: 130303 - DNA, 37 bp, Artificial Sequence
  Synthetic oligonucleotide
gaagagagtgtgaagggggtggtaaaagggacagaga

SEQ ID NO: 130304 - DNA, 37 bp, Artificial Sequence
  Synthetic oligonucleotide
tagagggggtgccaggaaggagggagggccgtgcgga

SEQ ID NO: 130305 - DNA, 35 bp, Artificial Sequence
  Synthetic oligonucleotide
gcacacgccgtctgcgcccataccgccacctcgga

SEQ ID NO: 130306 - DNA, 36 bp, Artificial Sequence
  Synthetic oligonucleotide
gacaaggtcggtatgtgaggaatagggagggaggga

SEQ ID NO: 130307 - DNA, 35 bp, Artificial Sequence
  Synthetic oligonucleotide
tcacgcacttatccgctgccccttagtacagggta

SEQ ID NO: 130308 - DNA, 35 bp, Artificial Sequence
  Synthetic oligonucleotide
atccttcacccgcattatgttccctgctacttaac

SEQ ID NO: 130309 - DNA, 35 bp, Artificial Sequence
  Synthetic oligonucleotide
gccccgcttacccgccaaatgtcctgctcttctac

SEQ ID NO: 130310 - DNA, 35 bp, Artificial Sequence; identical to SEQ ID NO: 17509
  Synthetic oligonucleotide

SEQ ID NO: 130311 - DNA, 35 bp, Artificial Sequence
  Synthetic oligonucleotide
gacacgccgctatctgcccgggcttttttcgtacc

SEQ ID NO: 130312 - DNA, 35 bp, Artificial Sequence
  Synthetic oligonucleotide
gtcctccgccactcggtaaacttcatagtaactcc

SEQ ID NO: 130313 - DNA, 35 bp, Artificial Sequence
  Synthetic oligonucleotide
tcaccccgtacaaagcaaacccacgcttctcctgc

SEQ ID NO: 130314 - DNA, 35 bp, Artificial Sequence
  Synthetic oligonucleotide
tccaccctgggccggtctgcctgtctttcgctatc

SEQ ID NO: 130315 - DNA, 35 bp, Artificial Sequence
  Synthetic oligonucleotide
aacccagtgtcccttttcatgccttgtccccgctc

SEQ ID NO: 130316 - DNA, 36 bp, Artificial Sequence
  Synthetic oligonucleotide
gccaaggctctcgatagtgtccatcgccgcccgctc

SEQ ID NO: 130317 - DNA, 35 bp, Artificial Sequence
  Synthetic oligonucleotide
gactccccgtggtactactaacgcctccactgttc

SEQ ID NO: 130318 - DNA, 35 bp, Artificial Sequence
  Synthetic oligonucleotide
aagtgggagatagaggcggaggggatggcggaatg

SEQ ID NO: 130319 - DNA, 35 bp, Artificial Sequence
  Synthetic oligonucleotide
gatgtgagcagcagggtagggagggaaaggagttg

SEQ ID NO: 130320 - DNA, 35 bp, Artificial Sequence
  Synthetic oligonucleotide
gctacgtccgtgcactctacaccatcccctttcat

SEQ ID NO: 130321 - DNA, 35 bp, Artificial Sequence
  Synthetic oligonucleotide
tcacaactctgtctggcctacacaacgttctcgct

SEQ ID NO: 130322 - DNA, 35 bp, Artificial Sequence
  Synthetic oligonucleotide
gagaagggaaagggcgttaagaaggaagtccgcgt

SEQ ID NO: 130323 - DNA, 36 bp, Artificial Sequence
  Synthetic oligonucleotide
gaatgacgggagggatgggtatagggctgtgacgaa

SEQ ID NO: 130324 - DNA, 37 bp, Artificial Sequence
  Synthetic oligonucleotide
attgacaaggggggtcggggggtggaggaagagcaga

SEQ ID NO: 130325 - DNA, 35 bp, Artificial Sequence
  Synthetic oligonucleotide
gctgtccacgcccctcttcctgtttaggtactcga

SEQ ID NO: 130326 - DNA, 37 bp, Artificial Sequence
  Synthetic oligonucleotide
ttaacacccgcctcatcccgcagcgcaactcgttcga

SEQ ID NO: 130327 - DNA, 35 bp, Artificial Sequence
  Synthetic oligonucleotide
agtgatgacaggggaggcgggagaaaggcacagga

SEQ ID NO: 130328 - DNA, 37 bp, Artificial Sequence
  Synthetic oligonucleotide
gacagagaagcagggggaggatgaaggagttgtatga

SEQ ID NO: 130329 - DNA, 38 bp, Artificial Sequence
  Synthetic oligonucleotide
tgagaccgcaggtctaataacgatcgctccctctctga

SEQ ID NO: 130330 - DNA, 34 bp, Artificial Sequence
  Synthetic oligonucleotide
tctgcgtgagtcgcagctactctccatcgcccta

SEQ ID NO: 130331 - DNA, 35 bp, Artificial Sequence
  Synthetic oligonucleotide
cccaccccggctactctcgttcttattgccctgcc

SEQ ID NO: 130332 - DNA, 35 bp, Artificial Sequence
  Synthetic oligonucleotide
gatgaccggggagggcggagagggttgttcgttgc

SEQ ID NO: 130333 - DNA, 35 bp, Artificial Sequence
  Synthetic oligonucleotide
atcagccccggcctcatttctttctctagcctctc

SEQ ID NO: 130334 - DNA, 35 bp, Artificial Sequence
  Synthetic oligonucleotide
aacaccccggctgctaaccgcacgcaccccgtttc

SEQ ID NO: 130335 - DNA, 35 bp, Artificial Sequence
  Synthetic oligonucleotide
atgtcgctagcgggtagggggcgcagggagggggg

SEQ ID NO: 130336 - DNA, 35 bp, Artificial Sequence
  Synthetic oligonucleotide
acactcgaccgccccgtttaaaaactccccccctg

SEQ ID NO: 130337 - DNA, 35 bp, Artificial Sequence
  Synthetic oligonucleotide
taagccatctccgggtcttgcatttctcctgcctg

SEQ ID NO: 130338 - DNA, 35 bp, Artificial Sequence
  Synthetic oligonucleotide
acataccctgatgctagtgcggtccatctctcctg

SEQ ID NO: 130339 - DNA, 35 bp, Artificial Sequence
  Synthetic oligonucleotide
aaaaacgtaggcgggggggagggaggatttgagtg

SEQ ID NO: 130340 - DNA, 35 bp, Artificial Sequence
  Synthetic oligonucleotide
gtagccgtttcattcggttaatgttgcctccccct

SEQ ID NO: 130341 - DNA, 35 bp, Artificial Sequence
  Synthetic oligonucleotide
tgggacccgagcagggtggggaacgatcttgggct

SEQ ID NO: 130342 - DNA, 36 bp, Artificial Sequence
  Synthetic oligonucleotide
acaccacctctattatcccgggaccggtttcccgca

SEQ ID NO: 130343 - DNA, 36 bp, Artificial Sequence
  Synthetic oligonucleotide
gacgagagtcacaaatttgcggcgtgttccatctca

SEQ ID NO: 130344 - DNA, 37 bp, Artificial Sequence
  Synthetic oligonucleotide
gcctgaggagagagcggataaggggggagggtacaga

SEQ ID NO: 130345 - DNA, 37 bp, Artificial Sequence
  Synthetic oligonucleotide
tgtgccacccctgcacctgtgaacgttacacatccga

SEQ ID NO: 130346 - DNA, 37 bp, Artificial Sequence
  Synthetic oligonucleotide
gtgttgggaggggctcgataggggccctcaatgggga

SEQ ID NO: 130347 - DNA, 37 bp, Artificial Sequence
  Synthetic oligonucleotide
gttcccgacccacgctctcttcgccctgctcacctga

SEQ ID NO: 130348 - DNA, 36 bp, Artificial Sequence
  Synthetic oligonucleotide
gctgagtcaacgagcggggaaaggggaggagcgtga

SEQ ID NO: 130349 - DNA, 37 bp, Artificial Sequence
  Synthetic oligonucleotide
atgcgcccgctcctgaatgcgcacttccctcctttga

SEQ ID NO: 130350 - DNA, 35 bp, Artificial Sequence
  Synthetic oligonucleotide
gaacgccacgacccgccgccatcccgcaataacac

SEQ ID NO: 130351 - DNA, 35 bp, Artificial Sequence
  Synthetic oligonucleotide
tgttacgtaccattcctatagtgctccctactacc

SEQ ID NO: 130352 - DNA, 35 bp, Artificial Sequence
  Synthetic oligonucleotide
gccccgagccgtcgggactcgtctctccgttccgc

SEQ ID NO: 130353 - DNA, 35 bp, Artificial Sequence
  Synthetic oligonucleotide
tttaggcaccttgcgcaccccccgtcatcattgtc

SEQ ID NO: 130354 - DNA, 35 bp, Artificial Sequence
  Synthetic oligonucleotide
agcaggacgggcggagggagggagagtcacgggag

SEQ ID NO: 130355 - DNA, 35 bp, Artificial Sequence
  Synthetic oligonucleotide
gaggagggcagataagcgggacgaagggcggggag

SEQ ID NO: 130356 - DNA, 35 bp, Artificial Sequence
  Synthetic oligonucleotide
tactcgctccttactgcttatacatgactcccacg

SEQ ID NO: 130357 - DNA, 35 bp, Artificial Sequence
  Synthetic oligonucleotide
tttgctcccatagtacgtgcctgaacccatcctcg

SEQ ID NO: 130358 - DNA, 36 bp, Artificial Sequence
  Synthetic oligonucleotide
gatacaccctcattcacaacgcgtcctccgttctcg

SEQ ID NO: 130359 - DNA, 35 bp, Artificial Sequence
  Synthetic oligonucleotide
atccacccgtgtaatcgtgctcccctatttctgtg

SEQ ID NO: 130360 - DNA, 35 bp, Artificial Sequence
  Synthetic oligonucleotide
gtgcgcacaatcggtggcttcgttactgcacctct

SEQ ID NO: 130361 - DNA, 36 bp, Artificial Sequence
  Synthetic oligonucleotide
tcgcccctctgttacacttgagcccatctcttcgaa

SEQ ID NO: 130362 - DNA, 36 bp, Artificial Sequence
  Synthetic oligonucleotide
tgtcgccctctgttccaacgctccctggcatgccca

SEQ ID NO: 130363 - DNA, 35 bp, Artificial Sequence
  Synthetic oligonucleotide
gatcgaccctcaccctctatcctgtaaatgtacga

SEQ ID NO: 130364 - DNA, 37 bp, Artificial Sequence
  Synthetic oligonucleotide
caggaggggaacaaggtggggggaagagggggaagga

SEQ ID NO: 130365 - DNA, 37 bp, Artificial Sequence
  Synthetic oligonucleotide
accccccctcattcccctgtcaacagttctgcatgga

SEQ ID NO: 130366 - DNA, 35 bp, Artificial Sequence
  Synthetic oligonucleotide
tccccacccgcccatagcaggattactcgcgtaac

SEQ ID NO: 130367 - DNA, 35 bp, Artificial Sequence
  Synthetic oligonucleotide
tgtcgccgctcctgctttgtccgtcaccgcccgcc

SEQ ID NO: 130368 - DNA, 35 bp, Artificial Sequence
  Synthetic oligonucleotide
taccaccggccaatattttcgccccgattctcgcc

SEQ ID NO: 130369 - DNA, 35 bp, Artificial Sequence
  Synthetic oligonucleotide
ttgacgttctgcagtagtcgtctttgacccgctcc

SEQ ID NO: 130370 - DNA, 35 bp, Artificial Sequence
  Synthetic oligonucleotide
tcaccgtagtgagtacatcacgcacgcctcgttcc

SEQ ID NO: 130371 - DNA, 35 bp, Artificial Sequence
  Synthetic oligonucleotide
tagtcggaggccaagcactatccctgtcattcatc

SEQ ID NO: 130372 - DNA, 35 bp, Artificial Sequence
  Synthetic oligonucleotide
tgttccgctccacctaccgactagaccgcgacctc

SEQ ID NO: 130373 - DNA, 35 bp, Artificial Sequence
  Synthetic oligonucleotide
gtctgccgctacctctctgtttgccatgtggcctc

SEQ ID NO: 130374 - DNA, 35 bp, Artificial Sequence
  Synthetic oligonucleotide
acgagtatgcaacctgttacccgtcctgtcctgtc

SEQ ID NO: 130375 - DNA, 35 bp, Artificial Sequence
  Synthetic oligonucleotide
gcattgccggcccgccctaacccccgccgctacct

SEQ ID NO: 130376 - DNA, 35 bp, Artificial Sequence
  Synthetic oligonucleotide
gatgtcctcagtccagttccagcaaacgtgcccct

SEQ ID NO: 130377 - DNA, 35 bp, Artificial Sequence
  Synthetic oligonucleotide
gtgctgagcacatatttcctgttttgccacttatt

SEQ ID NO: 130378 - DNA, 35 bp, Artificial Sequence
  Synthetic oligonucleotide
gccgaatgtccgccccccgtttttaaagtgccctt

SEQ ID NO: 130379 - DNA, 36 bp, Artificial Sequence
  Synthetic oligonucleotide
ggatacaacacgaagggaatgaaaggggagggcaaa

SEQ ID NO: 130380 - DNA, 37 bp, Artificial Sequence
  Synthetic oligonucleotide
gacacggtaaggaaggggcgggttaagggcgcgtaga

SEQ ID NO: 130381 - DNA, 37 bp, Artificial Sequence
  Synthetic oligonucleotide
cgaacacaccggttgcatatgctccctccctgcagga

SEQ ID NO: 130382 - DNA, 35 bp, Artificial Sequence
  Synthetic oligonucleotide
atgtcacctcgcctcttcgttcgcccggtttatga

SEQ ID NO: 130383 - DNA, 38 bp, Artificial Sequence
  Synthetic oligonucleotide
atgcccccccaactgcttatactctcagtacctcctga

SEQ ID NO: 130384 - DNA, 35 bp, Artificial Sequence
  Synthetic oligonucleotide
tgcaagcgaggtagttagccgccgtcccagtcccc

SEQ ID NO: 130385 - DNA, 35 bp, Artificial Sequence
  Synthetic oligonucleotide
tcacgtctcattcatccccacatggccgttgcctc

SEQ ID NO: 130386 - DNA, 35 bp, Artificial Sequence
  Synthetic oligonucleotide
tgcaacctcgctccacatattacgccggctttctc

SEQ ID NO: 130387 - DNA, 35 bp, Artificial Sequence
  Synthetic oligonucleotide
tcaccccacgcttcgttccccattacaccgcaagg

SEQ ID NO: 130388 - DNA, 35 bp, Artificial Sequence
  Synthetic oligonucleotide
tgcccctggacccaccgtcacggtattttctccct

SEQ ID NO: 130389 - DNA, 35 bp, Artificial Sequence
  Synthetic oligonucleotide
gttccgtccctcgtcgttacggagtaccgctctct

SEQ ID NO: 130390 - DNA, 35 bp, Artificial Sequence
  Synthetic oligonucleotide
acttgccctcacgcccaacgacgcccgtaatcctt

SEQ ID NO: 130391 - DNA, 35 bp, Artificial Sequence
  Synthetic oligonucleotide
tcattgcaagccttacgattacgccgcccgttcca

SEQ ID NO: 130392 - DNA, 37 bp, Artificial Sequence
  Synthetic oligonucleotide
gtgtgggggtttggggagggtttaatgaggggctcga

SEQ ID NO: 130393 - DNA, 35 bp, Artificial Sequence
  Synthetic oligonucleotide
gcccaatgccgacgcatcactactccattcctgta

SEQ ID NO: 130394 - DNA, 35 bp, Artificial Sequence
  Synthetic oligonucleotide
atgcgctccctaggtcctgtccaagcctctcctta

SEQ ID NO: 130395 - DNA, 35 bp, Artificial Sequence
  Synthetic oligonucleotide
gttcgcgcgcacattgtacttgcaccccctctaac

SEQ ID NO: 130396 - DNA, 35 bp, Artificial Sequence
  Synthetic oligonucleotide
tcccttgtacgacgcgtatcgtaagcccccccacc

SEQ ID NO: 130397 - DNA, 34 bp, Artificial Sequence
  Synthetic oligonucleotide
ttgatgcaaccgcactgcaacccacgaatacccc

SEQ ID NO: 130398 - DNA, 35 bp, Artificial Sequence
  Synthetic oligonucleotide
gacattcacgccctatgcacctacgcgggaccccc

SEQ ID NO: 130399 - DNA, 35 bp, Artificial Sequence
  Synthetic oligonucleotide
acgcccgtgttcggtctatcgttatatccgctccc

SEQ ID NO: 130400 - DNA, 35 bp, Artificial Sequence
  Synthetic oligonucleotide
tcgcactccatccatgcaagatcaccccccgtccc

SEQ ID NO: 130401 - DNA, 35 bp, Artificial Sequence
  Synthetic oligonucleotide
atgccgccccctgagcggcaagaacccttcttccc

SEQ ID NO: 130402 - DNA, 35 bp, Artificial Sequence
  Synthetic oligonucleotide
gagtctgggtgtcccttagtccgtcgtcccccgcc

SEQ ID NO: 130403 - DNA, 35 bp, Artificial Sequence
  Synthetic oligonucleotide
tccgcaagccctctactctatctggtttgtcctcc

SEQ ID NO: 130404 - DNA, 31 bp, Artificial Sequence
  Synthetic oligonucleotide
aacgcccccgcgatacctactttgcaacctc

SEQ ID NO: 130405 - DNA, 35 bp, Artificial Sequence
  Synthetic oligonucleotide
gcacctccgccatatcttccagtagtctgaacact

SEQ ID NO: 130406 - DNA, 35 bp, Artificial Sequence
  Synthetic oligonucleotide
acactggcttccccagtattctttatgttgccctt

SEQ ID NO: 130407 - DNA, 35 bp, Artificial Sequence
  Synthetic oligonucleotide
aacgggcgggtcaaggggagggtaggaaacaacaa

SEQ ID NO: 130408 - DNA, 35 bp, Artificial Sequence
  Synthetic oligonucleotide
aacaaccacatccgctccttgtcgttatcatacca

SEQ ID NO: 130409 - DNA, 35 bp, Artificial Sequence
  Synthetic oligonucleotide
tatcccgctacccctcctgccgtatttcgcgtgca

SEQ ID NO: 130410 - DNA, 36 bp, Artificial Sequence
  Synthetic oligonucleotide
agtttgcccacccagcgtcccgcatgccgtccatca

SEQ ID NO: 130411 - DNA, 37 bp, Artificial Sequence
  Synthetic oligonucleotide
atgtcactccagcactgttcactcaattgcccttcga

SEQ ID NO: 130412 - DNA, 37 bp, Artificial Sequence
  Synthetic oligonucleotide
gcaccgtattgtcgtctccgtcgtccgcccctttcga

SEQ ID NO: 130413 - DNA, 37 bp, Artificial Sequence
  Synthetic oligonucleotide
tcgctagtgacgggggaaggcggagtagggtggtgga

SEQ ID NO: 130414 - DNA, 38 bp, Artificial Sequence
  Synthetic oligonucleotide
gtgaggaggaagggatgaaggagacaggggtggaatga

SEQ ID NO: 130415 - DNA, 38 bp, Artificial Sequence
  Synthetic oligonucleotide
tcgcaatccccgcatgcgtatgctcactttatccctga

SEQ ID NO: 130416 - DNA, 38 bp, Artificial Sequence
  Synthetic oligonucleotide
gtgccgtcacaggcattttttcgaaccatccacgctga

SEQ ID NO: 130417 - DNA, 38 bp, Artificial Sequence
  Synthetic oligonucleotide
tcccatccccccatgtcgacttgattgactacacttga

SEQ ID NO: 130418 - DNA, 36 bp, Artificial Sequence
  Synthetic oligonucleotide
gagtgcgccaccttattagcctgccccctcccccta

SEQ ID NO: 130419 - DNA, 35 bp, Artificial Sequence
  Synthetic oligonucleotide
ttggccgggccgatctttctatccgcggttgctcc

SEQ ID NO: 130420 - DNA, 35 bp, Artificial Sequence
  Synthetic oligonucleotide
gcttctacgccctcgccccgcccactgaccgccgc

SEQ ID NO: 130421 - DNA, 35 bp, Artificial Sequence
  Synthetic oligonucleotide
gcgtgaccgtcacccacgctacgctcctatgccgc

SEQ ID NO: 130422 - DNA, 35 bp, Artificial Sequence
  Synthetic oligonucleotide
atggatcccgccactcctgtctttccaacctattc

SEQ ID NO: 130423 - DNA, 35 bp, Artificial Sequence
  Synthetic oligonucleotide
gcctcatgcctcttttgttgtttaccgcactggcg

SEQ ID NO: 130424 - DNA, 35 bp, Artificial Sequence
  Synthetic oligonucleotide
gccacgtgccgtatataatcgtttctatcccctcg

SEQ ID NO: 130425 - DNA, 35 bp, Artificial Sequence
  Synthetic oligonucleotide
acccatcatgtccatgccgctacaccacgttactg

SEQ ID NO: 130426 - DNA, 35 bp, Artificial Sequence
  Synthetic oligonucleotide
ggggggaagtacagtacggggggaaacggtggaat

SEQ ID NO: 130427 - DNA, 35 bp, Artificial Sequence
  Synthetic oligonucleotide
acaacctcacaagcccgacgccactaagtcgccct

SEQ ID NO: 130428 - DNA, 35 bp, Artificial Sequence
  Synthetic oligonucleotide
ttcgcacggctcatcggtcgcgagcaccaccctct

SEQ ID NO: 130429 - DNA, 35 bp, Artificial Sequence
  Synthetic oligonucleotide
gttgcctcccgaatgcgcccgattccctctaccgt

SEQ ID NO: 130430 - DNA, 35 bp, Artificial Sequence
  Synthetic oligonucleotide
tgcgagcaactatcatcgttcgggcctggttcttt

SEQ ID NO: 130431 - DNA, 36 bp, Artificial Sequence
  Synthetic oligonucleotide
gacactcaccgggtcatactgcccgcacttccctaa

SEQ ID NO: 130432 - DNA, 32 bp, Artificial Sequence
  Synthetic oligonucleotide
gcccgtaacggtactcctatgccctctccaca

SEQ ID NO: 130433 - DNA, 35 bp, Artificial Sequence
  Synthetic oligonucleotide
tgcctgtcctggcacaagtgcttactctacctcca

SEQ ID NO: 130434 - DNA, 37 bp, Artificial Sequence
  Synthetic oligonucleotide
tccaacctccaccccccctctacgactcagccggaga

SEQ ID NO: 130435 - DNA, 37 bp, Artificial Sequence
  Synthetic oligonucleotide
atctaccatcctcgtgcgtattactctcttctatgga

SEQ ID NO: 130436 - DNA, 37 bp, Artificial Sequence
  Synthetic oligonucleotide
gacgcgggtggggggggcggtagaaatggccgactga

SEQ ID NO: 130437 - DNA, 38 bp, Artificial Sequence
  Synthetic oligonucleotide
accccatgtctgccattgctccccttcactcctcctga

SEQ ID NO: 130438 - DNA, 35 bp, Artificial Sequence
  Synthetic oligonucleotide
gagagggtgggagggtactcattgctccggggtac

SEQ ID NO: 130439 - DNA, 35 bp, Artificial Sequence
  Synthetic oligonucleotide
tgctcacctcagctcggacgtccgctccccctccc

SEQ ID NO: 130440 - DNA, 35 bp, Artificial Sequence
  Synthetic oligonucleotide
atccactaccggccgttttccagttagtcctgtcc

SEQ ID NO: 130441 - DNA, 33 bp, Artificial Sequence
  Synthetic oligonucleotide
tactcccccctccgtcgttcacgccgtatcagc

SEQ ID NO: 130442 - DNA, 35 bp, Artificial Sequence
  Synthetic oligonucleotide
ggatgcactgccgccgacgtcgatatctcccacgc

SEQ ID NO: 130443 - DNA, 35 bp, Artificial Sequence
  Synthetic oligonucleotide
gaaaccctgccctacttgcttcgtagtcacctacg

SEQ ID NO: 130444 - DNA, 35 bp, Artificial Sequence
  Synthetic oligonucleotide
ttggccaactcagccgctgaacccttgctactccg

SEQ ID NO: 130445 - DNA, 35 bp, Artificial Sequence
  Synthetic oligonucleotide
gttgtgcatgcaacacccgtttctttcgcccacct

SEQ ID NO: 130446 - DNA, 35 bp, Artificial Sequence
  Synthetic oligonucleotide
ggaaccggcctgtgctatctcggtcgtccctttct

SEQ ID NO: 130447 - DNA, 35 bp, Artificial Sequence
  Synthetic oligonucleotide
tgccccgcccctgccatttgtagccctccgctgtt

SEQ ID NO: 130448 - DNA, 35 bp, Artificial Sequence
  Synthetic oligonucleotide
atgccagcggccctctcgtcgttcgccatgtcttt

SEQ ID NO: 130449 - DNA, 36 bp, Artificial Sequence
  Synthetic oligonucleotide
actaccacccgttccagtcccgccctcgatgtgtaa

SEQ ID NO: 130450 - DNA, 35 bp, Artificial Sequence
  Synthetic oligonucleotide
gaattcgccagactctgttcacctcccctcgctga

SEQ ID NO: 130451 - DNA, 36 bp, Artificial Sequence
  Synthetic oligonucleotide
tcacgacttgcccgctgctagaacaatgcccaccta

SEQ ID NO: 130452 - DNA, 35 bp, Artificial Sequence
  Synthetic oligonucleotide
tcatccggtgtcatcgctttgtccttcccgttcta

SEQ ID NO: 130453 - DNA, 35 bp, Artificial Sequence
  Synthetic oligonucleotide
acccccccagggccgtaggacgacgctctccgtac

SEQ ID NO: 130454 - DNA, 35 bp, Artificial Sequence
  Synthetic oligonucleotide
attctccccaaattgtactctgccgacccgttgcc

SEQ ID NO: 130455 - DNA, 35 bp, Artificial Sequence
  Synthetic oligonucleotide
gcaacccctcggaccggaccccagacctcccccgc

SEQ ID NO: 130456 - DNA, 35 bp, Artificial Sequence
  Synthetic oligonucleotide
tgatgggccacaatccgctcccgatcacctcctgc

SEQ ID NO: 130457 - DNA, 35 bp, Artificial Sequence
  Synthetic oligonucleotide
gtctacgcctttatcttttcgcccttctcgtgtgc

SEQ ID NO: 130458 - DNA, 35 bp, Artificial Sequence
  Synthetic oligonucleotide
gctgtcccgtcggctcactttgggccttctctctc

SEQ ID NO: 130459 - DNA, 35 bp, Artificial Sequence
  Synthetic oligonucleotide
accacctcgttcatcttccggtatttgctctggtc

SEQ ID NO: 130460 - DNA, 35 bp, Artificial Sequence
  Synthetic oligonucleotide
tgcaaccccaaccaccaccgctccccggaacgttc

SEQ ID NO: 130461 - DNA, 35 bp, Artificial Sequence
  Synthetic oligonucleotide
tacgcccctcatttctgtcctgcccgccctgtacg

SEQ ID NO: 130462 - DNA, 35 bp, Artificial Sequence
  Synthetic oligonucleotide
gccctaccgcccctgccccttctcgtaaatccgat

SEQ ID NO: 130463 - DNA, 36 bp, Artificial Sequence
  Synthetic oligonucleotide
gaaatggggcagtcgagaaatcgggagggtggttat

SEQ ID NO: 130464 - DNA, 35 bp, Artificial Sequence
  Synthetic oligonucleotide
ttccccaacgtccccccgccgtgaaaggtgtcctt

SEQ ID NO: 130465 - DNA, 35 bp, Artificial Sequence
  Synthetic oligonucleotide
tgcatgttggtcggggcgcgtatgtatggtggctt

SEQ ID NO: 130466 - DNA, 35 bp, Artificial Sequence
  Synthetic oligonucleotide
tcaacaatgcctcaactgtccggtacatccttctt

SEQ ID NO: 130467 - DNA, 37 bp, Artificial Sequence
  Synthetic oligonucleotide
ggtcagagcagccttgctattcctttcgctcctccga

SEQ ID NO: 130468 - DNA, 37 bp, Artificial Sequence
  Synthetic oligonucleotide
gatccccgcctcctcgttagaccttccagcccccgga

SEQ ID NO: 130469 - DNA, 37 bp, Artificial Sequence
  Synthetic oligonucleotide
tgcctccctcccgctgcaactcccctctcgttccgga

SEQ ID NO: 130470 - DNA, 37 bp, Artificial Sequence
  Synthetic oligonucleotide
aaccccacgcgcccctacttcctaactgcccctcgga

SEQ ID NO: 130471 - DNA, 38 bp, Artificial Sequence
  Synthetic oligonucleotide
gcgcacatccagtgtcgcacgtaatagcccccttctga

SEQ ID NO: 130472 - DNA, 37 bp, Artificial Sequence
  Synthetic oligonucleotide
accccacgccctctatttggaccgccactccgattga

SEQ ID NO: 130473 - DNA, 35 bp, Artificial Sequence
  Synthetic oligonucleotide
gacccacgtggtttatctgcatagccccgacctac

SEQ ID NO: 130474 - DNA, 35 bp, Artificial Sequence
  Synthetic oligonucleotide
ttcaccatcaactgcccgagtgtcaactcgatacc

SEQ ID NO: 130475 - DNA, 35 bp, Artificial Sequence
  Synthetic oligonucleotide
aatgcgaaccccagccgtggaaaccgtcccctacc

SEQ ID NO: 130476 - DNA, 35 bp, Artificial Sequence
  Synthetic oligonucleotide
ctagcgcgcgggactaccagtcactaggctccccc

SEQ ID NO: 130477 - DNA, 35 bp, Artificial Sequence
  Synthetic oligonucleotide
acaagtgccactgtcgcttgtctgtttctttactc

SEQ ID NO: 130478 - DNA, 35 bp, Artificial Sequence
  Synthetic oligonucleotide
gtggcttgacgcgactgagattcccgccccccctc

SEQ ID NO: 130479 - DNA, 35 bp, Artificial Sequence
  Synthetic oligonucleotide
gaacgcatctgcctcccttatttgtctgtttttag

SEQ ID NO: 130480 - DNA, 35 bp, Artificial Sequence
  Synthetic oligonucleotide
gtcctcgtcccgccatccatcctacattgtccatg

SEQ ID NO: 130481 - DNA, 35 bp, Artificial Sequence
  Synthetic oligonucleotide
tcccgaccgtggtcccatgcccccaatagctattg

SEQ ID NO: 130482 - DNA, 35 bp, Artificial Sequence
  Synthetic oligonucleotide
actggccctccgcccatgcttggtttcacttgcct

SEQ ID NO: 130483 - DNA, 35 bp, Artificial Sequence
  Synthetic oligonucleotide
gtaagatcagcccagtcatcccccgcccgtccgct

SEQ ID NO: 130484 - DNA, 35 bp, Artificial Sequence
  Synthetic oligonucleotide
agcggacgggggtgagttgaggagggcggaggagt

SEQ ID NO: 130485 - DNA, 35 bp, Artificial Sequence
  Synthetic oligonucleotide
ggttcccccacctgcgttttacccgtccacctcgt

SEQ ID NO: 130486 - DNA, 35 bp, Artificial Sequence
  Synthetic oligonucleotide
gatggcgtcggccggccactataccccgctcctgt

SEQ ID NO: 130487 - DNA, 35 bp, Artificial Sequence
  Synthetic oligonucleotide
tccggattcccgtcctgtcgcttcccaacccttgt

SEQ ID NO: 130488 - DNA, 35 bp, Artificial Sequence
  Synthetic oligonucleotide
ttcagccgcctgacctccaccttcagcaatggctt

SEQ ID NO: 130489 - DNA, 35 bp, Artificial Sequence
  Synthetic oligonucleotide
agtgtcgtcgatcctcccccgctttcacccccgtt

SEQ ID NO: 130490 - DNA, 36 bp, Artificial Sequence
  Synthetic oligonucleotide
gcgctatccacaggctgccctatctgctccactaaa

SEQ ID NO: 130491 - DNA, 35 bp, Artificial Sequence
  Synthetic oligonucleotide
gcccctgcccactgacttcgtgcccgttgagacaa

SEQ ID NO: 130492 - DNA, 36 bp, Artificial Sequence
  Synthetic oligonucleotide
gaggtgaggtaaacgagggagaagagaaggagggaa

SEQ ID NO: 130493 - DNA, 35 bp, Artificial Sequence
  Synthetic oligonucleotide
tacatgctcagcattgccttactgctccatcctca

SEQ ID NO: 130494 - DNA, 36 bp, Artificial Sequence
  Synthetic oligonucleotide
gccctacctcatcttccgcgcatcagtctgacaaga

SEQ ID NO: 130495 - DNA, 37 bp, Artificial Sequence
  Synthetic oligonucleotide
gacaaacgccaacgcctatatgcctgccacacaccga

SEQ ID NO: 130496 - DNA, 37 bp, Artificial Sequence
  Synthetic oligonucleotide
ttccgcatccagcccttcatcttcgactcccactcga

SEQ ID NO: 130497 - DNA, 36 bp, Artificial Sequence
  Synthetic oligonucleotide
tcctgtggggccccgtcactatcacttccgtcctga

SEQ ID NO: 130498 - DNA, 35 bp, Artificial Sequence
  Synthetic oligonucleotide
gaggtgcacgctccgttcattgccctgtttcgtta

SEQ ID NO: 130499 - DNA, 35 bp, Artificial Sequence
  Synthetic oligonucleotide
ttccacatgtgcgcccgccgacagccctcccgacc

SEQ ID NO: 130500 - DNA, 35 bp, Artificial Sequence
  Synthetic oligonucleotide
gaccgtccacgccccgctgtatttcgcttccctcc

SEQ ID NO: 130501 - DNA, 34 bp, Artificial Sequence
  Synthetic oligonucleotide
ctcattggggccacctgttcatccatgcaccatc

SEQ ID NO: 130502 - DNA, 35 bp, Artificial Sequence
  Synthetic oligonucleotide
gtcgagcacccttgtctgccgcctctgttacagtc

SEQ ID NO: 130503 - DNA, 35 bp, Artificial Sequence
  Synthetic oligonucleotide
gaatccccgcctgtggtgtcggcgtatcatccttc

SEQ ID NO: 130504 - DNA, 36 bp, Artificial Sequence
  Synthetic oligonucleotide
ttatgggaggacacggagggggtgagaacggggaaa

SEQ ID NO: 130505 - DNA, 36 bp, Artificial Sequence
  Synthetic oligonucleotide
gtcccccatgccatcagcgtcacatcccagctacca

SEQ ID NO: 130506 - DNA, 36 bp, Artificial Sequence
  Synthetic oligonucleotide
gccacattcccttcgtgcaatagatccccatttcca

SEQ ID NO: 130507 - DNA, 35 bp, Artificial Sequence
  Synthetic oligonucleotide
gagaagcctccggttcctttgcccccccccacgca

SEQ ID NO: 130508 - DNA, 36 bp, Artificial Sequence
  Synthetic oligonucleotide
ggagggcggggggggcaaggtacatattagcgcgga

SEQ ID NO: 130509 - DNA, 35 bp, Artificial Sequence
  Synthetic oligonucleotide
tccgatgtgtcctgcgttgctctctgcctgattta

SEQ ID NO: 130510 - DNA, 35 bp, Artificial Sequence
  Synthetic oligonucleotide
tgttcgcctcccgtattttgccctgtcgctaccac

SEQ ID NO: 130511 - DNA, 35 bp, Artificial Sequence
  Synthetic oligonucleotide
gtccgcccgcccggtggtcacataccttacccgac

SEQ ID NO: 130512 - DNA, 35 bp, Artificial Sequence
  Synthetic oligonucleotide
tcactttaccgtgccctcctgcccagtgctcttcc

SEQ ID NO: 130513 - DNA, 35 bp, Artificial Sequence
  Synthetic oligonucleotide
agcgtccaccaacgtccttaggagtttaggccttc

SEQ ID NO: 130514 - DNA, 35 bp, Artificial Sequence
  Synthetic oligonucleotide
tcatagcctcctgccctggacccctaaagtctttc

SEQ ID NO: 130515 - DNA, 35 bp, Artificial Sequence
  Synthetic oligonucleotide
agaggtgagtagggagaagaaggggtggggacggg

SEQ ID NO: 130516 - DNA, 35 bp, Artificial Sequence
  Synthetic oligonucleotide
gaaaaagggagtgcggtgaatgggggtaggaagtg

SEQ ID NO: 130517 - DNA, 35 bp, Artificial Sequence
  Synthetic oligonucleotide
tcccctcctgctcgcctcacatattataccgggat

SEQ ID NO: 130518 - DNA, 35 bp, Artificial Sequence
  Synthetic oligonucleotide
gacactccttgacctgctttatcacgctcgtccct

SEQ ID NO: 130519 - DNA, 35 bp, Artificial Sequence
  Synthetic oligonucleotide
acaccacccacttttgaaggaaacgcttcctgcct

SEQ ID NO: 130520 - DNA, 35 bp, Artificial Sequence
  Synthetic oligonucleotide
tacgggcggcggggcctgggggcggtggtttcaca

SEQ ID NO: 130521 - DNA, 35 bp, Artificial Sequence
  Synthetic oligonucleotide
gacgagcctcctcctgcctccgttgtacgtttaca

SEQ ID NO: 130522 - DNA, 37 bp, Artificial Sequence
  Synthetic oligonucleotide
acgttccacccccatatgaagtccatctccgtcccga

SEQ ID NO: 130523 - DNA, 37 bp, Artificial Sequence
  Synthetic oligonucleotide
ggatgccgggtgaagggggaagggggccgcgagccga

SEQ ID NO: 130524 - DNA, 37 bp, Artificial Sequence
  Synthetic oligonucleotide
ttgccccctgcccattgtcattatcctcctacttcga

SEQ ID NO: 130525 - DNA, 37 bp, Artificial Sequence
  Synthetic oligonucleotide
actcatggcggcctcaggggttatgggggaaggcgga

SEQ ID NO: 130526 - DNA, 38 bp, Artificial Sequence
  Synthetic oligonucleotide
aggaaaaggagcagggggggacagagatggtggaatga

SEQ ID NO: 130527 - DNA, 38 bp, Artificial Sequence
  Synthetic oligonucleotide
gatccgccccatcacccgtgttatcacccccgtaatga

SEQ ID NO: 130528 - DNA, 35 bp, Artificial Sequence
  Synthetic oligonucleotide
tgcaccagagtcctctatccgccgtttccccctga

SEQ ID NO: 130529 - DNA, 38 bp, Artificial Sequence
  Synthetic oligonucleotide
tcgccactcctgtcttctatccagcctgcatgccttga

SEQ ID NO: 130530 - DNA, 37 bp, Artificial Sequence
  Synthetic oligonucleotide
ttgttactccgccactcgtaccacgaccctctgttga

SEQ ID NO: 130531 - DNA, 35 bp, Artificial Sequence
  Synthetic oligonucleotide
atcgtcctgagctatcccctggctgtcactcccta

SEQ ID NO: 130532 - DNA, 35 bp, Artificial Sequence
  Synthetic oligonucleotide
tagacgtcgagttgcgccctggtcctgttgttcac

SEQ ID NO: 130533 - DNA, 35 bp, Artificial Sequence
  Synthetic oligonucleotide
tgaccgtctcccctcgttctccttacagttgttcc

SEQ ID NO: 130534 - DNA, 35 bp, Artificial Sequence
  Synthetic oligonucleotide
taacgagaggaaaacggggggaggcatgcgggggc

SEQ ID NO: 130535 - DNA, 35 bp, Artificial Sequence
  Synthetic oligonucleotide
gagcacggcacacacccgacctacccttttctggc

SEQ ID NO: 130536 - DNA, 35 bp, Artificial Sequence
  Synthetic oligonucleotide
tgagacagtggcgtggggagcaggatggggagcag

SEQ ID NO: 130537 - DNA, 35 bp, Artificial Sequence
  Synthetic oligonucleotide
tgtagcgcgatcgctaccgtcacccattctacctg

SEQ ID NO: 130538 - DNA, 35 bp, Artificial Sequence
  Synthetic oligonucleotide
gaccctaggcagactgccgacaagccgccgccctt

SEQ ID NO: 130539 - DNA, 35 bp, Artificial Sequence
  Synthetic oligonucleotide
tgactggtgttccgcccctgagccattaccgtttt

SEQ ID NO: 130540 - DNA, 36 bp, Artificial Sequence
  Synthetic oligonucleotide
gaagccgtagggaagggaaattgggaccaagggcaa

SEQ ID NO: 130541 - DNA, 36 bp, Artificial Sequence
  Synthetic oligonucleotide
tttaccgcaagtcacttctgccccccgcctgttcaa

SEQ ID NO: 130542 - DNA, 36 bp, Artificial Sequence
  Synthetic oligonucleotide
gtccgcgccccatttggttggttcttctgctcgcca

SEQ ID NO: 130543 - DNA, 36 bp, Artificial Sequence
  Synthetic oligonucleotide
agagggagggtgggttggtgggtcgcgcgtctttca

SEQ ID NO: 130544 - DNA, 37 bp, Artificial Sequence
  Synthetic oligonucleotide
aagctgaggagtggcggggtggaggtgggaggggaga

SEQ ID NO: 130545 - DNA, 37 bp, Artificial Sequence
  Synthetic oligonucleotide
gagagcagtcgggtggagaggggacggtgagggagga

SEQ ID NO: 130546 - DNA, 35 bp, Artificial Sequence
  Synthetic oligonucleotide
tagttacctcctgctccactagacagtcctcgcta

SEQ ID NO: 130547 - DNA, 35 bp, Artificial Sequence
  Synthetic oligonucleotide
acaccgcacgccctgttagcagttgcgccctcatc

SEQ ID NO: 130548 - DNA, 35 bp, Artificial Sequence
  Synthetic oligonucleotide
agaccgccctatcctgcttccgaacatcgaggttc

SEQ ID NO: 130549 - DNA, 35 bp, Artificial Sequence
  Synthetic oligonucleotide
gaagggggggaagaccaaatggtgggaggcaaaag

SEQ ID NO: 130550 - DNA, 35 bp, Artificial Sequence
  Synthetic oligonucleotide
tcacgtgccctgttttgtctaccatcccccctgag

SEQ ID NO: 130551 - DNA, 35 bp, Artificial Sequence
  Synthetic oligonucleotide
tgatttctccgcaggtcgtggcccctgtccctccg

SEQ ID NO: 130552 - DNA, 35 bp, Artificial Sequence
  Synthetic oligonucleotide
tctgggaaggggaggaacggtatgcgggaattgcg

SEQ ID NO: 130553 - DNA, 36 bp, Artificial Sequence
  Synthetic oligonucleotide
actcgccccactgtgctttatgttcgttgtaccatg

SEQ ID NO: 130554 - DNA, 37 bp, Artificial Sequence
  Synthetic oligonucleotide
atgtgctgaggagagggagaagggagagtcgtgcgga

SEQ ID NO: 130555 - DNA, 36 bp, Artificial Sequence
  Synthetic oligonucleotide
tggacatgaaaaggtggagggggcaaacgcggggga

SEQ ID NO: 130556 - DNA, 37 bp, Artificial Sequence
  Synthetic oligonucleotide
tgtttgcatcactgtccccctgcgctctccatcatga

SEQ ID NO: 130557 - DNA, 38 bp, Artificial Sequence
  Synthetic oligonucleotide
acaccaccatcccatttggccaatgaacactggcttga

SEQ ID NO: 130558 - DNA, 38 bp, Artificial Sequence
  Synthetic oligonucleotide
tcagccactcgccggtctggtttttccctctagtttga

SEQ ID NO: 130559 - DNA, 36 bp, Artificial Sequence
  Synthetic oligonucleotide
gcccagtcggtcggctctgtacttccactctctata

SEQ ID NO: 130560 - DNA, 35 bp, Artificial Sequence
  Synthetic oligonucleotide
gcccatccccctgtagatccgagcctctcattata

SEQ ID NO: 130561 - DNA, 35 bp, Artificial Sequence
  Synthetic oligonucleotide
tccccctcgtttgtttcctcccgtgctaacgctta

SEQ ID NO: 130562 - DNA, 35 bp, Artificial Sequence
  Synthetic oligonucleotide
taaccccaggtcagttctaatgcctccgtcctcac

SEQ ID NO: 130563 - DNA, 35 bp, Artificial Sequence
  Synthetic oligonucleotide
tcaacagcgtgtgccgttttgattcgcgcctcccc

SEQ ID NO: 130564 - DNA, 35 bp, Artificial Sequence
  Synthetic oligonucleotide
accgtgctgggctatttgtctaccgccgtctcccc

SEQ ID NO: 130565 - DNA, 35 bp, Artificial Sequence
  Synthetic oligonucleotide
gtgcacgctctccgcctccctcaagtgacgctgcc

SEQ ID NO: 130566 - DNA, 35 bp, Artificial Sequence
  Synthetic oligonucleotide
ggtcccaacgcggctagcagcccctccctccctcc

SEQ ID NO: 130567 - DNA, 35 bp, Artificial Sequence
  Synthetic oligonucleotide
cacgctcttgtccgttaatctctgcgcctccgtcc

SEQ ID NO: 130568 - DNA, 35 bp, Artificial Sequence
  Synthetic oligonucleotide
tcagatatgtccttttagccgcctgtgccccttcc

SEQ ID NO: 130569 - DNA, 35 bp, Artificial Sequence
  Synthetic oligonucleotide
tctccatacattgggcctatatctacacgttcctc

SEQ ID NO: 130570 - DNA, 35 bp, Artificial Sequence
  Synthetic oligonucleotide
tcacgtctccaagctcggtctcccagttcccgctc

SEQ ID NO: 130571 - DNA, 35 bp, Artificial Sequence
  Synthetic oligonucleotide
tccttgcccctgttttattccactcgttattgcct

SEQ ID NO: 130572 - DNA, 35 bp, Artificial Sequence
  Synthetic oligonucleotide
tctgtggggcgggcagggtggggtaagggcgtgct

SEQ ID NO: 130573 - DNA, 35 bp, Artificial Sequence
  Synthetic oligonucleotide
gtgtagcatcccgagctgcatattcccccgcctct

SEQ ID NO: 130574 - DNA, 35 bp, Artificial Sequence
  Synthetic oligonucleotide
gtccaccttcaacgttgataacgttcgtaacttct

SEQ ID NO: 130575 - DNA, 35 bp, Artificial Sequence
  Synthetic oligonucleotide
acccccggtgtccttcgtttatgggcccctccaca

SEQ ID NO: 130576 - DNA, 35 bp, Artificial Sequence
  Synthetic oligonucleotide
tctggagcgtacacacattctttaagctccctcca

SEQ ID NO: 130577 - DNA, 35 bp, Artificial Sequence
  Synthetic oligonucleotide
taggggggggtggtcgtgggagccggataagcgca

SEQ ID NO: 130578 - DNA, 36 bp, Artificial Sequence
  Synthetic oligonucleotide
acagtggggagggtgtgttatgtgggtggggtcgca

SEQ ID NO: 130579 - DNA, 37 bp, Artificial Sequence
  Synthetic oligonucleotide
acactgagttggggaaggtggaggggtggagtaaaga

SEQ ID NO: 130580 - DNA, 36 bp, Artificial Sequence
  Synthetic oligonucleotide
actcccctcactcctgctcctgttccataacgacga

SEQ ID NO: 130581 - DNA, 37 bp, Artificial Sequence
  Synthetic oligonucleotide
gacgagagtggaaaagcgatgatggagcgggagggga

SEQ ID NO: 130582 - DNA, 38 bp, Artificial Sequence
  Synthetic oligonucleotide
gtatgccctcccgtcataagaccaccccttgccactga

SEQ ID NO: 130583 - DNA, 38 bp, Artificial Sequence
  Synthetic oligonucleotide
gatgacaccctccctctgaccttagacaggtgccctga

SEQ ID NO: 130584 - DNA, 38 bp, Artificial Sequence
  Synthetic oligonucleotide
gcttgtgcgtagacgctgccccccgtgcctttccctga

SEQ ID NO: 130585 - DNA, 38 bp, Artificial Sequence
  Synthetic oligonucleotide
gcgaagctaggaacagagggagggcgggggtttattga

SEQ ID NO: 130586 - DNA, 35 bp, Artificial Sequence
  Synthetic oligonucleotide
gttggcgttcgttcgttatgccccatttgtcgccc

SEQ ID NO: 130587 - DNA, 35 bp, Artificial Sequence
  Synthetic oligonucleotide
aacatcactgtgtctcacctgcccccgtaccgcgc

SEQ ID NO: 130588 - DNA, 35 bp, Artificial Sequence
  Synthetic oligonucleotide
tcacgcacccttgatatccgcccgcccttgtgcgc

SEQ ID NO: 130589 - DNA, 35 bp, Artificial Sequence
  Synthetic oligonucleotide
gtgagggaattgggggggagcagagggacaatcgc

SEQ ID NO: 130590 - DNA, 35 bp, Artificial Sequence
  Synthetic oligonucleotide
tgtactgcaagtgctttgcgattaatcctgtcctc

SEQ ID NO: 130591 - DNA, 35 bp, Artificial Sequence
  Synthetic oligonucleotide
acgcacggttacatcccatccggccccttacctag

SEQ ID NO: 130592 - DNA, 35 bp, Artificial Sequence
  Synthetic oligonucleotide
atccgccactgttcccctccctagacgtcctgtag

SEQ ID NO: 130593 - DNA, 35 bp, Artificial Sequence
  Synthetic oligonucleotide
taccccaccttttgcccctcgatgagcacctttag

SEQ ID NO: 130594 - DNA, 35 bp, Artificial Sequence
  Synthetic oligonucleotide
tcctgctccctccgcttttttggaatcgaaccacg

SEQ ID NO: 130595 - DNA, 35 bp, Artificial Sequence
  Synthetic oligonucleotide
ttgtgggacggggggatgaggagcggggtaagcat

SEQ ID NO: 130596 - DNA, 35 bp, Artificial Sequence
  Synthetic oligonucleotide
acgaatccccgcaagccgccgttcccacacacact

SEQ ID NO: 130597 - DNA, 34 bp, Artificial Sequence
  Synthetic oligonucleotide
gaccatcgccttcatacggccgattcgcccccct

SEQ ID NO: 130598 - DNA, 35 bp, Artificial Sequence
  Synthetic oligonucleotide
tgccgcactctgtccccgctttctagaaccccttt

SEQ ID NO: 130599 - DNA, 36 bp, Artificial Sequence
  Synthetic oligonucleotide
acggaaggaatggccggggtgggtggtggggggaaa

SEQ ID NO: 130600 - DNA, 35 bp, Artificial Sequence
  Synthetic oligonucleotide
gtcgcccagtccacctgcgccccggtcttcctcca

SEQ ID NO: 130601 - DNA, 37 bp, Artificial Sequence
  Synthetic oligonucleotide
accggagtgagaggcggggatggaggtggttggcaga

SEQ ID NO: 130602 - DNA, 38 bp, Artificial Sequence
  Synthetic oligonucleotide
tcactccctcctccgcgacaggcacccgctcccagtga

SEQ ID NO: 130603 - DNA, 36 bp, Artificial Sequence
  Synthetic oligonucleotide
tcccggttccatctctgtacccccgtatccctgata

SEQ ID NO: 130604 - DNA, 36 bp, Artificial Sequence
  Synthetic oligonucleotide
gatccacccccgttcgttacggaacagtaactgtta

SEQ ID NO: 130605 - DNA, 35 bp, Artificial Sequence
  Synthetic oligonucleotide
gtggccgttaacgatccgctctcgctccgttccac

SEQ ID NO: 130606 - DNA, 35 bp, Artificial Sequence
  Synthetic oligonucleotide
tgcacccatcttccagcgcatcctccggattcccc

SEQ ID NO: 130607 - DNA, 35 bp, Artificial Sequence
  Synthetic oligonucleotide
gtgcaccttctctattgttgcttaacattcccgcc

SEQ ID NO: 130608 - DNA, 35 bp, Artificial Sequence
  Synthetic oligonucleotide
taacaacctgcatttttcaccgagccattcgccgc

SEQ ID NO: 130609 - DNA, 35 bp, Artificial Sequence
  Synthetic oligonucleotide
aagcaggcactcaccttgctctggaccctttttgc

SEQ ID NO: 130610 - DNA, 35 bp, Artificial Sequence
  Synthetic oligonucleotide
aacccgcgtgttacgtactgccttgctccccgctc

SEQ ID NO: 130611 - DNA, 35 bp, Artificial Sequence
  Synthetic oligonucleotide
gacccccagagatcgcccgccctaaccgctgaccg

SEQ ID NO: 130612 - DNA, 35 bp, Artificial Sequence
  Synthetic oligonucleotide
accaaccaccctcagcctctacttcggattgacct

SEQ ID NO: 130613 - DNA, 33 bp, Artificial Sequence
  Synthetic oligonucleotide
tcccggttactaccccggcgcctcaccctccct

SEQ ID NO: 130614 - DNA, 35 bp, Artificial Sequence
  Synthetic oligonucleotide
atgctcctccgtgcggaactcatccattgccttgt

SEQ ID NO: 130615 - DNA, 35 bp, Artificial Sequence
  Synthetic oligonucleotide
atcctccgggcggccgactcgcactggctcccctt

SEQ ID NO: 130616 - DNA, 35 bp, Artificial Sequence
  Synthetic oligonucleotide
gaccaccccatctgctctagtcttaatcaggtaca

SEQ ID NO: 130617 - DNA, 35 bp, Artificial Sequence
  Synthetic oligonucleotide
gacgtatccgcccccaccgtttgttcccgacccca

SEQ ID NO: 130618 - DNA, 37 bp, Artificial Sequence
  Synthetic oligonucleotide
tttgctcctcacacccttttatgacgtacctgcccga

SEQ ID NO: 130619 - DNA, 36 bp, Artificial Sequence
  Synthetic oligonucleotide
gtccccacccgtccgagctttaaatcgtttctccga

SEQ ID NO: 130620 - DNA, 37 bp, Artificial Sequence
  Synthetic oligonucleotide
gggggggcagggatggggagggagggggttaaatcga

SEQ ID NO: 130621 - DNA, 37 bp, Artificial Sequence
  Synthetic oligonucleotide
tgttactgctccacctgccgtctctttgcccctatga

SEQ ID NO: 130622 - DNA, 38 bp, Artificial Sequence
  Synthetic oligonucleotide
gaggggatcgggaggaggggtggacgatcggggactga

SEQ ID NO: 130623 - DNA, 35 bp, Artificial Sequence
  Synthetic oligonucleotide
acacccaagtctcccgccgtgctgttccgtttcta

SEQ ID NO: 130624 - DNA, 35 bp, Artificial Sequence
  Synthetic oligonucleotide
tccatcccctcggtcgtacgctggttatcttatac

SEQ ID NO: 130625 - DNA, 35 bp, Artificial Sequence
  Synthetic oligonucleotide
acacaccatgtcctacaccgccaccagggacgacc

SEQ ID NO: 130626 - DNA, 33 bp, Artificial Sequence
  Synthetic oligonucleotide
accctctcctgctgacttcttccggccgtggcc

SEQ ID NO: 130627 - DNA, 35 bp, Artificial Sequence
  Synthetic oligonucleotide
tgccccgccactcatctcgtaaatagaaatccctc

SEQ ID NO: 130628 - DNA, 35 bp, Artificial Sequence
  Synthetic oligonucleotide
tgtacccccgcttccgtttcgtggtttcgtctctc

SEQ ID NO: 130629 - DNA, 35 bp, Artificial Sequence
  Synthetic oligonucleotide
gacccccccccgcaccccagagtggatcacttctc

SEQ ID NO: 130630 - DNA, 34 bp, Artificial Sequence
  Synthetic oligonucleotide
tcagacagggtgtaaggcgcggggtgcggggttc

SEQ ID NO: 130631 - DNA, 35 bp, Artificial Sequence
  Synthetic oligonucleotide
acccctccccgactaccgtatgcgcctcctttgag

SEQ ID NO: 130632 - DNA, 35 bp, Artificial Sequence
  Synthetic oligonucleotide
acgctacggggcaagggggtggggaaggtgttctg

SEQ ID NO: 130633 - DNA, 35 bp, Artificial Sequence
  Synthetic oligonucleotide
tgagtgagggagggcggtgatatggtgggcacttg

SEQ ID NO: 130634 - DNA, 36 bp, Artificial Sequence
  Synthetic oligonucleotide
acatacgttgcctcaccagacgtccctgcctttcct

SEQ ID NO: 130635 - DNA, 35 bp, Artificial Sequence
  Synthetic oligonucleotide
tctgtccccccctccgtactattctgtgtcaatct

SEQ ID NO: 130636 - DNA, 35 bp, Artificial Sequence
  Synthetic oligonucleotide
tacgatttgccacctgttcaagggtcctcttctct

SEQ ID NO: 130637 - DNA, 36 bp, Artificial Sequence
  Synthetic oligonucleotide
tccctagccccccgagccatattaagtacccctcaa

SEQ ID NO: 130638 - DNA, 35 bp, Artificial Sequence
  Synthetic oligonucleotide
gagcgctgggatgggaggggtaaggggttgaggca

SEQ ID NO: 130639 - DNA, 35 bp, Artificial Sequence
  Synthetic oligonucleotide
tcgacccgcgctcgacctggcactccccgacctca

SEQ ID NO: 130640 - DNA, 37 bp, Artificial Sequence
  Synthetic oligonucleotide
gagccatctgtccgcccttccccctggccctcgccga

SEQ ID NO: 130641 - DNA, 37 bp, Artificial Sequence
  Synthetic oligonucleotide
tgccaatccgttgttctgtaccccttcccacctagga

SEQ ID NO: 130642 - DNA, 36 bp, Artificial Sequence
  Synthetic oligonucleotide
gactcccacgctctgcccgcctttttgctcttcgta

SEQ ID NO: 130643 - DNA, 36 bp, Artificial Sequence
  Synthetic oligonucleotide
aagctcactccctgccgcccccgtccgctttctgta

SEQ ID NO: 130644 - DNA, 30 bp, Artificial Sequence
  Synthetic oligonucleotide
tagtcatccgtgcaagcccctcctgtttac

SEQ ID NO: 130645 - DNA, 35 bp, Artificial Sequence
  Synthetic oligonucleotide
ttcggacacccgcacctagctgctatcggcacacc

SEQ ID NO: 130646 - DNA, 35 bp, Artificial Sequence
  Synthetic oligonucleotide
aacccgaccaggtacgcccctcgttaatagccgcc

SEQ ID NO: 130647 - DNA, 35 bp, Artificial Sequence
  Synthetic oligonucleotide
taactaacgcagctcatccttcttccatcgccgtc

SEQ ID NO: 130648 - DNA, 35 bp, Artificial Sequence
  Synthetic oligonucleotide
tctccctgtccaacttctacgccttgctcgctacg

SEQ ID NO: 130649 - DNA, 35 bp, Artificial Sequence
  Synthetic oligonucleotide
tttgccactccttcaagttcgaatatccaccttcg

SEQ ID NO: 130650 - DNA, 35 bp, Artificial Sequence
  Synthetic oligonucleotide
tacgatcagcatggagtaggaggaggaagggaagg

SEQ ID NO: 130651 - DNA, 35 bp, Artificial Sequence
  Synthetic oligonucleotide
gaccccgtaacggctgtccttacttccatccctat

SEQ ID NO: 130652 - DNA, 35 bp, Artificial Sequence
  Synthetic oligonucleotide
tgcctacgccacccctgtatgccctagttcgccct

SEQ ID NO: 130653 - DNA, 35 bp, Artificial Sequence
  Synthetic oligonucleotide
aagaggggcctaggatgggcgggtacgggaggggt

SEQ ID NO: 130654 - DNA, 35 bp, Artificial Sequence
  Synthetic oligonucleotide
tccgacggtgacggggggggcaaagggcgggctaa

SEQ ID NO: 130655 - DNA, 37 bp, Artificial Sequence
  Synthetic oligonucleotide
tttgaggcggcaagggcgggggggaacagggtgcaga

SEQ ID NO: 130656 - DNA, 35 bp, Artificial Sequence
  Synthetic oligonucleotide
acagccctgcctgcccatttgcgactttgcttcga

SEQ ID NO: 130657 - DNA, 37 bp, Artificial Sequence
  Synthetic oligonucleotide
tcgaactgggggacgggaccgtgggaggggagaagga

SEQ ID NO: 130658 - DNA, 37 bp, Artificial Sequence
  Synthetic oligonucleotide
ggggaggggaacatatgtagatcacggtgggagggga

SEQ ID NO: 130659 - DNA, 26 bp, Artificial Sequence
  Synthetic oligonucleotide
actccatctaaacccgacttgcctga

SEQ ID NO: 130660 - DNA, 38 bp, Artificial Sequence
  Synthetic oligonucleotide
tctcatcccatctgtgcgcgccttgtcctcatccgtga

SEQ ID NO: 130661 - DNA, 36 bp, Artificial Sequence
  Synthetic oligonucleotide
ttgcgcgagctgtgccgtaactttgccttccctgta

SEQ ID NO: 130662 - DNA, 34 bp, Artificial Sequence
  Synthetic oligonucleotide
ttacgaactgccccccctcagttcgtgttctcac

SEQ ID NO: 130663 - DNA, 35 bp, Artificial Sequence
  Synthetic oligonucleotide
gagcacaccctccatccagcttaaaggccttcacc

SEQ ID NO: 130664 - DNA, 35 bp, Artificial Sequence
  Synthetic oligonucleotide
gatacccgcttccgcagtgaacaacccctccgtcc

SEQ ID NO: 130665 - DNA, 35 bp, Artificial Sequence
  Synthetic oligonucleotide
aacacctcgccttgtaattctccgtttcttatcgc

SEQ ID NO: 130666 - DNA, 35 bp, Artificial Sequence
  Synthetic oligonucleotide
tcagaatgccccggtttcaacataacgtacccctc

SEQ ID NO: 130667 - DNA, 35 bp, Artificial Sequence
  Synthetic oligonucleotide
atctgcactacgctgctcaatcacccttaccgttc

SEQ ID NO: 130668 - DNA, 35 bp, Artificial Sequence
  Synthetic oligonucleotide
gatgctccttgctcttgttttggttctacttaccg

SEQ ID NO: 130669 - DNA, 35 bp, Artificial Sequence
  Synthetic oligonucleotide
tccgatacatccgacccctgctcaagtgccactgt

SEQ ID NO: 130670 - DNA, 35 bp, Artificial Sequence
  Synthetic oligonucleotide
ttagagccaccgatcacatcttacgtcccttctgt

SEQ ID NO: 130671 - DNA, 35 bp, Artificial Sequence
  Synthetic oligonucleotide
tctcaccacagtccgccttcccgatgctagttcaa

SEQ ID NO: 130672 - DNA, 35 bp, Artificial Sequence
  Synthetic oligonucleotide
atcatcctcggtgtcctgccaccatgtcctttgaa

SEQ ID NO: 130673 - DNA, 36 bp, Artificial Sequence
  Synthetic oligonucleotide
aacgccgccgcgttctcagggtcactcgctcgccca

SEQ ID NO: 130674 - DNA, 37 bp, Artificial Sequence
  Synthetic oligonucleotide
gccccctgcccgcccctttgactgtcagtatactaga

SEQ ID NO: 130675 - DNA, 37 bp, Artificial Sequence
  Synthetic oligonucleotide
ccgcccctgaccatccctgagagacatgcggtaccga

SEQ ID NO: 130676 - DNA, 37 bp, Artificial Sequence
  Synthetic oligonucleotide
ggaggtggtggggtggaattatggcggtacctgttga

SEQ ID NO: 130677 - DNA, 35 bp, Artificial Sequence
  Synthetic oligonucleotide
agcccgcagatccctcacgacacttccctggccac

SEQ ID NO: 130678 - DNA, 35 bp, Artificial Sequence
  Synthetic oligonucleotide
ttccagccagaggcattcaaccacacgctctcacc

SEQ ID NO: 130679 - DNA, 35 bp, Artificial Sequence
  Synthetic oligonucleotide
tgatcgcccacctctaacctagcacggcatggccc

SEQ ID NO: 130680 - DNA, 35 bp, Artificial Sequence
  Synthetic oligonucleotide
acccccacgcgcttgcgagtctccgtttttccgcc

SEQ ID NO: 130681 - DNA, 35 bp, Artificial Sequence
  Synthetic oligonucleotide
gtcacgcataactgctttttgcgacctaccactgc

SEQ ID NO: 130682 - DNA, 35 bp, Artificial Sequence
  Synthetic oligonucleotide
accccgccgttttccccattgctttcttgacctgc

SEQ ID NO: 130683 - DNA, 35 bp, Artificial Sequence
  Synthetic oligonucleotide
gctcatccgcctcatagtccttggttccccggctc

SEQ ID NO: 130684 - DNA, 35 bp, Artificial Sequence
  Synthetic oligonucleotide
gcacgtcacccatcgggccactctccgctgctgtc

SEQ ID NO: 130685 - DNA, 35 bp, Artificial Sequence
  Synthetic oligonucleotide
tacccgttccacccgccattatgatggtctccccg

SEQ ID NO: 130686 - DNA, 36 bp, Artificial Sequence
  Synthetic oligonucleotide
agtgctaggcgggggagggggaaaagtgggatcgaa

SEQ ID NO: 130687 - DNA, 35 bp, Artificial Sequence
  Synthetic oligonucleotide
aacacctccgaccacgtttcgacatgagcccctca

SEQ ID NO: 130688 - DNA, 35 bp, Artificial Sequence
  Synthetic oligonucleotide
gagggtgggggggaatagggttaagtcaccagaga

SEQ ID NO: 130689 - DNA, 37 bp, Artificial Sequence
  Synthetic oligonucleotide
tctgacccagccatctctgtaccatcgtccctatcga

SEQ ID NO: 130690 - DNA, 36 bp, Artificial Sequence
  Synthetic oligonucleotide
gagccctccacctgcataatgtcgattcggtctcga

SEQ ID NO: 130691 - DNA, 36 bp, Artificial Sequence
  Synthetic oligonucleotide
tagtcgcgtggagctcggagggggaggggggatgga

SEQ ID NO: 130692 - DNA, 38 bp, Artificial Sequence
  Synthetic oligonucleotide
accgcgccgccccctccatccatctgcattgctcatga

SEQ ID NO: 130693 - DNA, 38 bp, Artificial Sequence
  Synthetic oligonucleotide
ttcgtgcaggccgttcaactcgttccgccattccctga

SEQ ID NO: 130694 - DNA, 38 bp, Artificial Sequence
  Synthetic oligonucleotide
ggtgaggtaggaggagggaggggaggccactgaggtga

SEQ ID NO: 130695 - DNA, 34 bp, Artificial Sequence
  Synthetic oligonucleotide
atcctcctgccgctgacaagtcgaaccctctcac

SEQ ID NO: 130696 - DNA, 34 bp, Artificial Sequence
  Synthetic oligonucleotide
acatctcaccgtacgcgtcgcccgccgcactatc

SEQ ID NO: 130697 - DNA, 35 bp, Artificial Sequence
  Synthetic oligonucleotide
gccgcatccgtggagcgcacccacaactgttcttc

SEQ ID NO: 130698 - DNA, 35 bp, Artificial Sequence
  Synthetic oligonucleotide
gtaggcacctcaccagtccaagtcgttctatctcg

SEQ ID NO: 130699 - DNA, 35 bp, Artificial Sequence
  Synthetic oligonucleotide
tacacgcttacctgttgcctatgctcctctctatt

SEQ ID NO: 130700 - DNA, 37 bp, Artificial Sequence
  Synthetic oligonucleotide
tgcgagctcacgtctaattgggtgggaagggaaggga

SEQ ID NO: 130701 - DNA, 38 bp, Artificial Sequence
  Synthetic oligonucleotide
acgacccctccgtttcaaaccccctgtcactccactga

SEQ ID NO: 130702 - DNA, 35 bp, Artificial Sequence
  Synthetic oligonucleotide
gatccagctgtcatgtcctccgtcccaatcgccta

SEQ ID NO: 130703 - DNA, 35 bp, Artificial Sequence
  Synthetic oligonucleotide
gcctcccgttggtttacccgctccctattctggta

SEQ ID NO: 130704 - DNA, 35 bp, Artificial Sequence
  Synthetic oligonucleotide
tcgaaggtgccgccctctatcccctgtacgcctta

SEQ ID NO: 130705 - DNA, 35 bp, Artificial Sequence
  Synthetic oligonucleotide
ggtcacacttggtcccgctcctccagtttccgcac

SEQ ID NO: 130706 - DNA, 35 bp, Artificial Sequence
  Synthetic oligonucleotide
tcagtacctgtcactacctccgttcctccgctacc

SEQ ID NO: 130707 - DNA, 35 bp, Artificial Sequence
  Synthetic oligonucleotide
tcatcaccccatgagcgcgagctaattcacgttcc

SEQ ID NO: 130708 - DNA, 35 bp, Artificial Sequence
  Synthetic oligonucleotide
gacccgccctattgattcttttgtccccctggtgc

SEQ ID NO: 130709 - DNA, 35 bp, Artificial Sequence
  Synthetic oligonucleotide
acagggagtcgcccgctttccctgtttgaatcatc

SEQ ID NO: 130710 - DNA, 35 bp, Artificial Sequence
  Synthetic oligonucleotide
gcccagccgtgattgtacacccctccgcttctatc

SEQ ID NO: 130711 - DNA, 35 bp, Artificial Sequence
  Synthetic oligonucleotide
ttgccaactccaattttctgtaccaaccgcacctc

SEQ ID NO: 130712 - DNA, 34 bp, Artificial Sequence
  Synthetic oligonucleotide
gggggtagggggaggatggtggtatttaaaaatg

SEQ ID NO: 130713 - DNA, 35 bp, Artificial Sequence
  Synthetic oligonucleotide
ttgcccctagagctgccctctcgcccggttttctt

SEQ ID NO: 130714 - DNA, 36 bp, Artificial Sequence
  Synthetic oligonucleotide
gctgggggggagagcatcgtaatgggacgggtgaaa

SEQ ID NO: 130715 - DNA, 36 bp, Artificial Sequence
  Synthetic oligonucleotide
gtaggacggaagggagggacacaggaggccgactaa

SEQ ID NO: 130716 - DNA, 36 bp, Artificial Sequence
  Synthetic oligonucleotide
agccgccgcccgtttggttcccttgctcaaagccca

SEQ ID NO: 130717 - DNA, 35 bp, Artificial Sequence
  Synthetic oligonucleotide
tgatcaccggccttcctcctatcgtcatttagcca

SEQ ID NO: 130718 - DNA, 36 bp, Artificial Sequence
  Synthetic oligonucleotide
tgagcccagtcgccatcaattgactccgccgctcca

SEQ ID NO: 130719 - DNA, 35 bp, Artificial Sequence
  Synthetic oligonucleotide
tcccgcctgacactgaccgttaaaacgcgccctca

SEQ ID NO: 130720 - DNA, 35 bp, Artificial Sequence
  Synthetic oligonucleotide
gtggaaacatgggtgggctctaagggcgggagaga

SEQ ID NO: 130721 - DNA, 37 bp, Artificial Sequence
  Synthetic oligonucleotide
acactcgcccgcacccttaccgtttactcagccacga

SEQ ID NO: 130722 - DNA, 37 bp, Artificial Sequence
  Synthetic oligonucleotide
gcaccatcgcccatttgttaattctatccccgcccga

SEQ ID NO: 130723 - DNA, 37 bp, Artificial Sequence
  Synthetic oligonucleotide
agcaggagaggggacggggtacgggaacgcgaggcga

SEQ ID NO: 130724 - DNA, 37 bp, Artificial Sequence
  Synthetic oligonucleotide
acttgtgggcgggtgggtgaaaatacgaacccaggga

SEQ ID NO: 130725 - DNA, 37 bp, Artificial Sequence
  Synthetic oligonucleotide
gcgatcacagggggtcgggggggaacggtcataggga

SEQ ID NO: 130726 - DNA, 36 bp, Artificial Sequence
  Synthetic oligonucleotide
ttccaccgcctccactgcatccgcgcactcctatga

SEQ ID NO: 130727 - DNA, 37 bp, Artificial Sequence
  Synthetic oligonucleotide
aacccccgcccttcattgcaccagccatccagtatga

SEQ ID NO: 130728 - DNA, 36 bp, Artificial Sequence
  Synthetic oligonucleotide
tcaaccgccgatcgctctgttcataccaactcttta

SEQ ID NO: 130729 - DNA, 35 bp, Artificial Sequence
  Synthetic oligonucleotide
atttccgcccgtggttattcacttggcctccccac

SEQ ID NO: 130730 - DNA, 35 bp, Artificial Sequence
  Synthetic oligonucleotide
gattaggataggtgggacgggcgggtggaggagac

SEQ ID NO: 130731 - DNA, 35 bp, Artificial Sequence
  Synthetic oligonucleotide
gtacgtgctcccaccccctgctcaggccaaacagc

SEQ ID NO: 130732 - DNA, 35 bp, Artificial Sequence
  Synthetic oligonucleotide
ttcgacacctgtggttctttcttctgctgccttgc

SEQ ID NO: 130733 - DNA, 35 bp, Artificial Sequence
  Synthetic oligonucleotide
tactgtccccctgccattcacgtttaaagctcgtt

SEQ ID NO: 130734 - DNA, 35 bp, Artificial Sequence
  Synthetic oligonucleotide
agcctccttccgcctctgttaacctgtcccagcaa

SEQ ID NO: 130735 - DNA, 33 bp, Artificial Sequence
  Synthetic oligonucleotide
aatcgccgaccttgcttacctccgacgcttaca

SEQ ID NO: 130736 - DNA, 36 bp, Artificial Sequence
  Synthetic oligonucleotide
tccgaatgaccctggtgctgcttgaccacccctcca

SEQ ID NO: 130737 - DNA, 37 bp, Artificial Sequence
  Synthetic oligonucleotide
atgcgggacgggggtagggagggtgtccgcacgacga

SEQ ID NO: 130738 - DNA, 37 bp, Artificial Sequence
  Synthetic oligonucleotide
gaaagagtaccaaaatgagaagggccggcgggaggga

SEQ ID NO: 130739 - DNA, 37 bp, Artificial Sequence
  Synthetic oligonucleotide
tgccggggtaagggttttggggatgatagggcgggga

SEQ ID NO: 130740 - DNA, 35 bp, Artificial Sequence
  Synthetic oligonucleotide
tgtcctctgccttcccgtgccccccctgttgggga

SEQ ID NO: 130741 - DNA, 37 bp, Artificial Sequence
  Synthetic oligonucleotide
tccgctcctctcgtgcttcaccattaatactccatga

SEQ ID NO: 130742 - DNA, 37 bp, Artificial Sequence
  Synthetic oligonucleotide
tacgagttgcgggaggtgggggagggttacactatga

SEQ ID NO: 130743 - DNA, 37 bp, Artificial Sequence
  Synthetic oligonucleotide
attctgcccccgactcttaccgaacttgcctccgtga

SEQ ID NO: 130744 - DNA, 35 bp, Artificial Sequence
  Synthetic oligonucleotide
gaccgccccgaccaccccatcgcctccgttgtaac

SEQ ID NO: 130745 - DNA, 35 bp, Artificial Sequence
  Synthetic oligonucleotide
actcgcctgacagccatagcgttccctcgttctcc

SEQ ID NO: 130746 - DNA, 33 bp, Artificial Sequence
  Synthetic oligonucleotide
gcaatcccaattgctccgatcctccgccttcgc

SEQ ID NO: 130747 - DNA, 35 bp, Artificial Sequence
  Synthetic oligonucleotide
gactcccctcatttctgtcctgcccgccctgtacg

SEQ ID NO: 130748 - DNA, 35 bp, Artificial Sequence
  Synthetic oligonucleotide
acccaccgatgctactctatttcgctctatctccg

SEQ ID NO: 130749 - DNA, 35 bp, Artificial Sequence
  Synthetic oligonucleotide
gcccccttcctgcacgaggcgccccgaccttctcg

SEQ ID NO: 130750 - DNA, 35 bp, Artificial Sequence
  Synthetic oligonucleotide
gacagggggcgggagggcggtggggaccccagtcg

SEQ ID NO: 130751 - DNA, 35 bp, Artificial Sequence
  Synthetic oligonucleotide
tgacccttcagcgttgccatgatccctccaccagt

SEQ ID NO: 130752 - DNA, 35 bp, Artificial Sequence
  Synthetic oligonucleotide
tcgccgcccccgcctgtgtagctttttcatgcctt

SEQ ID NO: 130753 - DNA, 35 bp, Artificial Sequence
  Synthetic oligonucleotide
tccacgctcctggctcgctcgctatggtccatttt

SEQ ID NO: 130754 - DNA, 29 bp, Artificial Sequence
  Synthetic oligonucleotide
tcttaacccccctgtccacgtcgagccca

SEQ ID NO: 130755 - DNA, 36 bp, Artificial Sequence
  Synthetic oligonucleotide
gacgagggaggagggtgcgggtgctagtggacgcca

SEQ ID NO: 130756 - DNA, 36 bp, Artificial Sequence
  Synthetic oligonucleotide
gtcgacctccacctccaagtccttgcccgcctgcca

SEQ ID NO: 130757 - DNA, 36 bp, Artificial Sequence
  Synthetic oligonucleotide
tacgcctccggattgccctcccgccactaccgcgca

SEQ ID NO: 130758 - DNA, 36 bp, Artificial Sequence
  Synthetic oligonucleotide
agacatgcaccccgccgaaccagccgccccccccga

SEQ ID NO: 130759 - DNA, 37 bp, Artificial Sequence
  Synthetic oligonucleotide
gttcacgcctcactcccctcgcgctacccaccgtgga

SEQ ID NO: 130760 - DNA, 38 bp, Artificial Sequence
  Synthetic oligonucleotide
agcgccccgtccatccgtctgtttcccgtactatctga

SEQ ID NO: 130761 - DNA, 35 bp, Artificial Sequence
  Synthetic oligonucleotide
ggaacgcgggggaggggggggttgagagaaggtga

SEQ ID NO: 130762 - DNA, 37 bp, Artificial Sequence
  Synthetic oligonucleotide
tctgtacccctgtagactctccccgacgacagcttga

SEQ ID NO: 130763 - DNA, 38 bp, Artificial Sequence
  Synthetic oligonucleotide
atgcccgctttctacgtcccctcgcccgtcccgcttga

SEQ ID NO: 130764 - DNA, 33 bp, Artificial Sequence
  Synthetic oligonucleotide
gggacctccactgtgccacccctgcatctttta

SEQ ID NO: 130765 - DNA, 35 bp, Artificial Sequence
  Synthetic oligonucleotide
tcctgtgggcagatctaacgggcccccccccaccc

SEQ ID NO: 130766 - DNA, 35 bp, Artificial Sequence
  Synthetic oligonucleotide
tccgccacccctgcgtttcgctcttgtcctgtccc

SEQ ID NO: 130767 - DNA, 35 bp, Artificial Sequence
  Synthetic oligonucleotide
tgatttgtccctgccatggaacgccctcccacgcc

SEQ ID NO: 130768 - DNA, 35 bp, Artificial Sequence
  Synthetic oligonucleotide
tcccgaccctcgcaccacggacacgtgcctgccgc

SEQ ID NO: 130769 - DNA, 35 bp, Artificial Sequence
  Synthetic oligonucleotide
tcgagtccagctctactgtcaactcacacccgctc

SEQ ID NO: 130770 - DNA, 35 bp, Artificial Sequence
  Synthetic oligonucleotide
gtgccagtatgtcccccgtctctttgactctgctc

SEQ ID NO: 130771 - DNA, 35 bp, Artificial Sequence
  Synthetic oligonucleotide
acaactcagccggctcgatcggtctagtccctctc

SEQ ID NO: 130772 - DNA, 35 bp, Artificial Sequence
  Synthetic oligonucleotide
agctgcctgaagtctataccctatcctgtccgttc

SEQ ID NO: 130773 - DNA, 35 bp, Artificial Sequence
  Synthetic oligonucleotide
gcactccgttccaccttctctactctgcttaaaag

SEQ ID NO: 130774 - DNA, 35 bp, Artificial Sequence
  Synthetic oligonucleotide
acgagagcagggaggcacaaagtgagggtgggtag

SEQ ID NO: 130775 - DNA, 34 bp, Artificial Sequence
  Synthetic oligonucleotide
acttccaccccctttacggtccaccctgccaagg

SEQ ID NO: 130776 - DNA, 35 bp, Artificial Sequence
  Synthetic oligonucleotide
gatgagcgggggggactgaggaattgaaaagcggg

SEQ ID NO: 130777 - DNA, 35 bp, Artificial Sequence
  Synthetic oligonucleotide
ttacttgtagcgcctcgccctctttcaccaccatg

SEQ ID NO: 130778 - DNA, 35 bp, Artificial Sequence
  Synthetic oligonucleotide
tggactctgccttctcgcccgcccgtttgaccttg

SEQ ID NO: 130779 - DNA, 35 bp, Artificial Sequence
  Synthetic oligonucleotide
gccacctgtcgcccgctataccaatatcgtcttct

SEQ ID NO: 130780 - DNA, 35 bp, Artificial Sequence
  Synthetic oligonucleotide
gtctccacctcccgtccatcatcgggccgatcctt

SEQ ID NO: 130781 - DNA, 35 bp, Artificial Sequence
  Synthetic oligonucleotide
tccccacaactgttccatcgagtttctgcccccga

SEQ ID NO: 130782 - DNA, 38 bp, Artificial Sequence
  Synthetic oligonucleotide
gcacctgctgcccccattgaatttgtcgttcccgctga

SEQ ID NO: 130783 - DNA, 37 bp, Artificial Sequence
  Synthetic oligonucleotide
taggagggtgggagaggagaacgtggtgggagggtga

SEQ ID NO: 130784 - DNA, 36 bp, Artificial Sequence
  Synthetic oligonucleotide
acgctcatccgtgccgccatgctgatacccttacta

SEQ ID NO: 130785 - DNA, 35 bp, Artificial Sequence
  Synthetic oligonucleotide
tagtaccccgccgacgttttccgaagtctaaccta

SEQ ID NO: 130786 - DNA, 36 bp, Artificial Sequence
  Synthetic oligonucleotide
gtcccgccgccttgaccactcgttattcggtgccta

SEQ ID NO: 130787 - DNA, 35 bp, Artificial Sequence
  Synthetic oligonucleotide
taccactatccatcgcctttgtgcacacgctccta

SEQ ID NO: 130788 - DNA, 36 bp, Artificial Sequence
  Synthetic oligonucleotide
gaccgccctacgcctgtcgcgcccccacgccttcta

SEQ ID NO: 130789 - DNA, 35 bp, Artificial Sequence
  Synthetic oligonucleotide
ttgaccgcatcccgcgtggtcacacttacactaac

SEQ ID NO: 130790 - DNA, 35 bp, Artificial Sequence
  Synthetic oligonucleotide
gacctcacacgacctgccgagccgcactcctggac

SEQ ID NO: 130791 - DNA, 35 bp, Artificial Sequence
  Synthetic oligonucleotide
tcaagccgcctctcatccctagttctgctgcccgc

SEQ ID NO: 130792 - DNA, 35 bp, Artificial Sequence
  Synthetic oligonucleotide
ggagccccttcccttgttcatctcgtttcctggtc

SEQ ID NO: 130793 - DNA, 35 bp, Artificial Sequence
  Synthetic oligonucleotide
gccgggtgaaggtgtttgagcggggggggtgggag

SEQ ID NO: 130794 - DNA, 35 bp, Artificial Sequence
  Synthetic oligonucleotide
tatgcaggactcgttcgtgttccctcccccctgtt

SEQ ID NO: 130795 - DNA, 36 bp, Artificial Sequence
  Synthetic oligonucleotide
gatcaaccgcaatgccactgccgatcctatttctca

SEQ ID NO: 130796 - DNA, 35 bp, Artificial Sequence
  Synthetic oligonucleotide
ggtaacccccgcctcccctgcagtcactatcgaac

SEQ ID NO: 130797 - DNA, 35 bp, Artificial Sequence
  Synthetic oligonucleotide
gcaccctcctggtatcccggtgaatgcctccgccc

SEQ ID NO: 130798 - DNA, 35 bp, Artificial Sequence
  Synthetic oligonucleotide
gccccgacccccctctcgacagcccctgcacttcc

SEQ ID NO: 130799 - DNA, 35 bp, Artificial Sequence
  Synthetic oligonucleotide
tcatccaaccgatcctttggccccaccttgttgtg

SEQ ID NO: 130800 - DNA, 35 bp, Artificial Sequence
  Synthetic oligonucleotide
gtcgcacctactgccccgccatgtatttttcacat

SEQ ID NO: 130801 - DNA, 35 bp, Artificial Sequence
  Synthetic oligonucleotide
gaaacgctgtgagttgtcatccgcctactgtccct

SEQ ID NO: 130802 - DNA, 35 bp, Artificial Sequence
  Synthetic oligonucleotide
gtgttgcccaccctggttctcgtgactccctcgct

SEQ ID NO: 130803 - DNA, 35 bp, Artificial Sequence
  Synthetic oligonucleotide
gccgaccccgggcattccttctgtctctcgtggct

SEQ ID NO: 130804 - DNA, 35 bp, Artificial Sequence
  Synthetic oligonucleotide
gactcgatcaatcaagtggagccggccccttttct

SEQ ID NO: 130805 - DNA, 35 bp, Artificial Sequence
  Synthetic oligonucleotide
atggcctgccgtcactaccgctctcgtccccggaa

SEQ ID NO: 130806 - DNA, 37 bp, Artificial Sequence
  Synthetic oligonucleotide
gagggacttcggaggaggggggcagaacaagggtaga

SEQ ID NO: 130807 - DNA, 37 bp, Artificial Sequence
  Synthetic oligonucleotide
tgcgtggggtggacacaggagagggacgggaagagga

SEQ ID NO: 130808 - DNA, 37 bp, Artificial Sequence
  Synthetic oligonucleotide
gtgcgtaacgggaagagaggtgcgagggtgggaggga

SEQ ID NO: 130809 - DNA, 37 bp, Artificial Sequence
  Synthetic oligonucleotide
tagcgggcattctcacgttccctggcctgttccctga

SEQ ID NO: 130810 - DNA, 36 bp, Artificial Sequence
  Synthetic oligonucleotide
tgtgacccgaccccttctgcttctactgttgcctta

SEQ ID NO: 130811 - DNA, 35 bp, Artificial Sequence
  Synthetic oligonucleotide
gatcgccgcaggctcatcgcgctaacaccactacc

SEQ ID NO: 130812 - DNA, 35 bp, Artificial Sequence
  Synthetic oligonucleotide
acatccatgcagtgccaccagcttaggctcccccc

SEQ ID NO: 130813 - DNA, 35 bp, Artificial Sequence
  Synthetic oligonucleotide
tctgatgtgttcttgctcgcccaaccggatctccc

SEQ ID NO: 130814 - DNA, 35 bp, Artificial Sequence
  Synthetic oligonucleotide
aaccctcagaggtaccgtgccccctcaaccgcgcc

SEQ ID NO: 130815 - DNA, 35 bp, Artificial Sequence
  Synthetic oligonucleotide
gcaagcgattcacgcctgccgtaacacacccctgc

SEQ ID NO: 130816 - DNA, 35 bp, Artificial Sequence
  Synthetic oligonucleotide
gtgggctcgccttctcccctgttggtcgtttacat

SEQ ID NO: 130817 - DNA, 35 bp, Artificial Sequence
  Synthetic oligonucleotide
tttcccacctccgccgccgacacatttatacttgt

SEQ ID NO: 130818 - DNA, 35 bp, Artificial Sequence
  Synthetic oligonucleotide
tatctgacgtcgcgctgatccgacccttccttgtt

SEQ ID NO: 130819 - DNA, 35 bp, Artificial Sequence
  Synthetic oligonucleotide
gtccacacgataccagctgcccttacgctaacaaa

SEQ ID NO: 130820 - DNA, 35 bp, Artificial Sequence
  Synthetic oligonucleotide
tgccccccttcttgcgcctgagctcactatatcca

SEQ ID NO: 130821 - DNA, 36 bp, Artificial Sequence
  Synthetic oligonucleotide
aactgccgcccgtttcccgctcactcaggtattgca

SEQ ID NO: 130822 - DNA, 36 bp, Artificial Sequence
  Synthetic oligonucleotide
gagtagtgaaatggtggatagaaggggcgtacaaga

SEQ ID NO: 130823 - DNA, 37 bp, Artificial Sequence
  Synthetic oligonucleotide
tcgcccctctctgttctcgcttcttcactgtcctaga

SEQ ID NO: 130824 - DNA, 37 bp, Artificial Sequence
  Synthetic oligonucleotide
gtcccttcgcagtcgtccttgtccgccctccgtctga

SEQ ID NO: 130825 - DNA, 35 bp, Artificial Sequence
  Synthetic oligonucleotide
tcccgtgccgccattgtcattcgtttcccgcttta

SEQ ID NO: 130826 - DNA, 35 bp, Artificial Sequence
  Synthetic oligonucleotide
tctatccgcctcacaggggtctgtcctaacccgcc

SEQ ID NO: 130827 - DNA, 35 bp, Artificial Sequence
  Synthetic oligonucleotide
tcatgaggcacttcgccgttgtaggccccctttcc

SEQ ID NO: 130828 - DNA, 35 bp, Artificial Sequence
  Synthetic oligonucleotide
tccatcccgcaatgaacgaacgtacatcttacatc

SEQ ID NO: 130829 - DNA, 35 bp, Artificial Sequence
  Synthetic oligonucleotide
tgcgatggtgccgacggccatacaccccccctttc

SEQ ID NO: 130830 - DNA, 35 bp, Artificial Sequence
  Synthetic oligonucleotide
gcgaacctcgtgtcgtccgccccttccgtttcact

SEQ ID NO: 130831 - DNA, 35 bp, Artificial Sequence
  Synthetic oligonucleotide
tgaaccggtcgtcccctatgcaggcccttctacct

SEQ ID NO: 130832 - DNA, 35 bp, Artificial Sequence
  Synthetic oligonucleotide
gccggtgcctttccatgtcacttctctgggttcct

SEQ ID NO: 130833 - DNA, 35 bp, Artificial Sequence
  Synthetic oligonucleotide
attgagcccccatctcgcattgtagccagtcctct

SEQ ID NO: 130834 - DNA, 35 bp, Artificial Sequence
  Synthetic oligonucleotide
gcgacgacactcggagcgctctcctatactgcctt

SEQ ID NO: 130835 - DNA, 36 bp, Artificial Sequence
  Synthetic oligonucleotide
tccgcctgactacgtagctcccttcgcaccatctaa

SEQ ID NO: 130836 - DNA, 36 bp, Artificial Sequence
  Synthetic oligonucleotide
aaacgacaaggatagggaggcggggggctataggca

SEQ ID NO: 130837 - DNA, 36 bp, Artificial Sequence
  Synthetic oligonucleotide
gtccaccgccaatctagaagtcgttattgcccttca

SEQ ID NO: 130838 - DNA, 36 bp, Artificial Sequence
  Synthetic oligonucleotide
acgtggaagagggagagcgggggatgggagggagga

SEQ ID NO: 130839 - DNA, 38 bp, Artificial Sequence
  Synthetic oligonucleotide
gtggggcacgatgggggtttgagaaggggaaggggtga

SEQ ID NO: 130840 - DNA, 35 bp, Artificial Sequence
  Synthetic oligonucleotide
aaccgatggaaaggagtgggaggggaagagtgaac

SEQ ID NO: 130841 - DNA, 35 bp, Artificial Sequence
  Synthetic oligonucleotide
aacaccgccatgctctttgttagccaccgcctacc

SEQ ID NO: 130842 - DNA, 35 bp, Artificial Sequence
  Synthetic oligonucleotide
gttgccctcgacgttattgttcttctgttgttacc

SEQ ID NO: 130843 - DNA, 35 bp, Artificial Sequence
  Synthetic oligonucleotide
catccactgcacccgtaccatccgccactgctgcc

SEQ ID NO: 130844 - DNA, 35 bp, Artificial Sequence
  Synthetic oligonucleotide
accacctccatacgtacgcaactgaaaactcgtcc

SEQ ID NO: 130845 - DNA, 34 bp, Artificial Sequence
  Synthetic oligonucleotide
agccgagacatattgccccttttccggctcttcc

SEQ ID NO: 130846 - DNA, 35 bp, Artificial Sequence
  Synthetic oligonucleotide
gttgacgcctctttattgttattgttttcctgcgc

SEQ ID NO: 130847 - DNA, 35 bp, Artificial Sequence
  Synthetic oligonucleotide
gtaccaactcagcaaacacttcgcacccctctggc

SEQ ID NO: 130848 - DNA, 32 bp, Artificial Sequence
  Synthetic oligonucleotide
ttgcggatgcccatagctactcgcgctccctc

SEQ ID NO: 130849 - DNA, 35 bp, Artificial Sequence
  Synthetic oligonucleotide
aggacgcagccgtccgtcttttgcttctcgctccg

SEQ ID NO: 130850 - DNA, 35 bp, Artificial Sequence
  Synthetic oligonucleotide
gcgaaacggcctgcgagccgccctcttacatcctg

SEQ ID NO: 130851 - DNA, 35 bp, Artificial Sequence
  Synthetic oligonucleotide
gatctacgccgggccacctgtgccttacacctcat

SEQ ID NO: 130852 - DNA, 35 bp, Artificial Sequence
  Synthetic oligonucleotide
tccccactcagcccaccagtctctgtgaccaccct

SEQ ID NO: 130853 - DNA, 35 bp, Artificial Sequence
  Synthetic oligonucleotide
agccggtacgcccgccgaccttccgtgttgcccct

SEQ ID NO: 130854 - DNA, 35 bp, Artificial Sequence
  Synthetic oligonucleotide
tgatccccctctggcctgaactgtcataccttcct

SEQ ID NO: 130855 - DNA, 35 bp, Artificial Sequence
  Synthetic oligonucleotide
attctgccatcgcccgttccaccgttcaccaggct

SEQ ID NO: 130856 - DNA, 35 bp, Artificial Sequence
  Synthetic oligonucleotide
gcaccccccaggcgttcagtgtacctctccgttgt

SEQ ID NO: 130857 - DNA, 35 bp, Artificial Sequence
  Synthetic oligonucleotide
gaccatctctcatcgaacctgtattttgccatctt

SEQ ID NO: 130858 - DNA, 37 bp, Artificial Sequence
  Synthetic oligonucleotide
aaccacccctccgctattactcaggagcgccctccga

SEQ ID NO: 130859 - DNA, 38 bp, Artificial Sequence
  Synthetic oligonucleotide
gacgaccacctctcttgctgcatgtgccttcaatctga

SEQ ID NO: 130860 - DNA, 36 bp, Artificial Sequence
  Synthetic oligonucleotide
ttccgtgtacccaccatgtgcatgcccatcccttta

SEQ ID NO: 130861 - DNA, 35 bp, Artificial Sequence
  Synthetic oligonucleotide
acatacgcacattcgctctaagctttctcgccacc

SEQ ID NO: 130862 - DNA, 35 bp, Artificial Sequence
  Synthetic oligonucleotide
actccctacaatcgctcccgcctgtgcccccgacc

SEQ ID NO: 130863 - DNA, 35 bp, Artificial Sequence
  Synthetic oligonucleotide
aaccccgcccctcagtcgcagctaccacgagtacc

SEQ ID NO: 130864 - DNA, 35 bp, Artificial Sequence
  Synthetic oligonucleotide
gaccttgctgtttgtactattgccactttcccgcc

SEQ ID NO: 130865 - DNA, 34 bp, Artificial Sequence
  Synthetic oligonucleotide
ttcgccgccccattgcttgttccatccttcttcc

SEQ ID NO: 130866 - DNA, 35 bp, Artificial Sequence
  Synthetic oligonucleotide
actcatcctcagccccggcgccgaaacccaactgc

SEQ ID NO: 130867 - DNA, 35 bp, Artificial Sequence
  Synthetic oligonucleotide
taagggcgggatgggtggatgaatgggggctccag

SEQ ID NO: 130868 - DNA, 35 bp, Artificial Sequence
  Synthetic oligonucleotide
ataccccccctcattggttccttcgagtgcttccg

SEQ ID NO: 130869 - DNA, 35 bp, Artificial Sequence
  Synthetic oligonucleotide
gttgacgataaaggtaggggcgaaggaatgggggg

SEQ ID NO: 130870 - DNA, 35 bp, Artificial Sequence
  Synthetic oligonucleotide
gccccacgcccccgtttccccttcaccacctggtg

SEQ ID NO: 130871 - DNA, 35 bp, Artificial Sequence
  Synthetic oligonucleotide
acgatccgccatcacccttatctatgcatcctcct

SEQ ID NO: 130872 - DNA, 35 bp, Artificial Sequence
  Synthetic oligonucleotide
ggaccacctggtctcgtgcctactatctgtccgct

SEQ ID NO: 130873 - DNA, 35 bp, Artificial Sequence
  Synthetic oligonucleotide
gtgtgccccccagatccctcgcgctaccttttgct

SEQ ID NO: 130874 - DNA, 35 bp, Artificial Sequence
  Synthetic oligonucleotide
gtcacgttcccacagctgaactcctcctcctccgt

SEQ ID NO: 130875 - DNA, 36 bp, Artificial Sequence
  Synthetic oligonucleotide
acaccagagaaggagttgacgggagggggggtagaa

SEQ ID NO: 130876 - DNA, 36 bp, Artificial Sequence
  Synthetic oligonucleotide
gttggcaccacctcccatgactctcggacacacaca

SEQ ID NO: 130877 - DNA, 36 bp, Artificial Sequence
  Synthetic oligonucleotide
tcgccgagatcgcccttccgttgtccatgcttgcca

SEQ ID NO: 130878 - DNA, 36 bp, Artificial Sequence
  Synthetic oligonucleotide
gcccactctgcttgcacgccgttccttctgattcca

SEQ ID NO: 130879 - DNA, 36 bp, Artificial Sequence
  Synthetic oligonucleotide
tcctgccgcaccaatctgctcctctcttctggacga

SEQ ID NO: 130880 - DNA, 36 bp, Artificial Sequence
  Synthetic oligonucleotide
gtcacattccgctgcccactcgcccctttacacgga

SEQ ID NO: 130881 - DNA, 37 bp, Artificial Sequence
  Synthetic oligonucleotide
catgggggcatccaagggggagggcttagactgggga

SEQ ID NO: 130882 - DNA, 37 bp, Artificial Sequence
  Synthetic oligonucleotide
atgccaacagaggaaagggagggaggaaggtgatgga

SEQ ID NO: 130883 - DNA, 37 bp, Artificial Sequence
  Synthetic oligonucleotide
tcacgacttcacgcctgacttatactaccgcctttga

SEQ ID NO: 130884 - DNA, 36 bp, Artificial Sequence
  Synthetic oligonucleotide
acaccccgtaatgggcatggttcgccccttttacta

SEQ ID NO: 130885 - DNA, 35 bp, Artificial Sequence
  Synthetic oligonucleotide
tgccccgccacgtttcccagtttatcgcccagccc

SEQ ID NO: 130886 - DNA, 35 bp, Artificial Sequence
  Synthetic oligonucleotide
ttgggtatacgtccgacttgcccttcacctctgcc

SEQ ID NO: 130887 - DNA, 36 bp, Artificial Sequence
  Synthetic oligonucleotide
tgtcgaggagggtggtttgaagggtgtgggggtacg

SEQ ID NO: 130888 - DNA, 35 bp, Artificial Sequence
  Synthetic oligonucleotide
agcccgacatcccgccgtattccacccatgtgccg

SEQ ID NO: 130889 - DNA, 35 bp, Artificial Sequence
  Synthetic oligonucleotide
tacctccgctgccccctggttcctgtctcatatcg

SEQ ID NO: 130890 - DNA, 35 bp, Artificial Sequence
  Synthetic oligonucleotide
gacccgctatgtcctgtcccccctccgagttatgg

SEQ ID NO: 130891 - DNA, 36 bp, Artificial Sequence
  Synthetic oligonucleotide
tgacggtggggttggttaatgggaaggtgtggggtg

SEQ ID NO: 130892 - DNA, 35 bp, Artificial Sequence
  Synthetic oligonucleotide
atccccaccgactgcccccgctacttggcgattaa

SEQ ID NO: 130893 - DNA, 36 bp, Artificial Sequence
  Synthetic oligonucleotide
gctgggggaccccgcgtacctcccacacctacccca

SEQ ID NO: 130894 - DNA, 36 bp, Artificial Sequence
  Synthetic oligonucleotide
gcatcgcacgtagcaaccgacctcctctgtccctca

SEQ ID NO: 130895 - DNA, 37 bp, Artificial Sequence
  Synthetic oligonucleotide
gactgcacctttggtaaccgcctgttttcacccccga

SEQ ID NO: 130896 - DNA, 37 bp, Artificial Sequence
  Synthetic oligonucleotide
taccctccgacgcctgccctagaccatacgttcccga

SEQ ID NO: 130897 - DNA, 35 bp, Artificial Sequence
  Synthetic oligonucleotide
tggggagatcggagggggctctagtggggcgggga

SEQ ID NO: 130898 - DNA, 37 bp, Artificial Sequence
  Synthetic oligonucleotide
tgaacgtgaaggagggcaagggggggagaggatatga

SEQ ID NO: 130899 - DNA, 37 bp, Artificial Sequence
  Synthetic oligonucleotide
tatacgccgcgttcagccccgccttgtccctctctga

SEQ ID NO: 130900 - DNA, 35 bp, Artificial Sequence
  Synthetic oligonucleotide
gttgtggcccagcagtgtcacgcgcctcttccgac

SEQ ID NO: 130901 - DNA, 35 bp, Artificial Sequence
  Synthetic oligonucleotide
gctgtgacgcacagcccctggattccccactagcc

SEQ ID NO: 130902 - DNA, 35 bp, Artificial Sequence
  Synthetic oligonucleotide
tgcgggctatacctcgtttaatgcgcctccctgcc

SEQ ID NO: 130903 - DNA, 35 bp, Artificial Sequence
  Synthetic oligonucleotide
tacgcagtgaagatgctcagctgcacctctactcc

SEQ ID NO: 130904 - DNA, 35 bp, Artificial Sequence
  Synthetic oligonucleotide
tgaagagcgcataccatgtgcttaaccgttcctcc

SEQ ID NO: 130905 - DNA, 35 bp, Artificial Sequence
  Synthetic oligonucleotide
gtggaacctctagaggttatgcctactcccgctcc

SEQ ID NO: 130906 - DNA, 35 bp, Artificial Sequence
  Synthetic oligonucleotide
gactccaggggaagctgtcagggcggggtgggatc

SEQ ID NO: 130907 - DNA, 35 bp, Artificial Sequence
  Synthetic oligonucleotide
tggaggagggtggggctggccggtggcaaacacag

SEQ ID NO: 130908 - DNA, 35 bp, Artificial Sequence
  Synthetic oligonucleotide
gagggtgggggcgtatggggaagggataacccggg

SEQ ID NO: 130909 - DNA, 35 bp, Artificial Sequence
  Synthetic oligonucleotide
gtctgcacccaatacgatgtccctttgtgccccct

SEQ ID NO: 130910 - DNA, 35 bp, Artificial Sequence
  Synthetic oligonucleotide
tacgccacaatcgcgagtcttcttccgccttcctt

SEQ ID NO: 130911 - DNA, 36 bp, Artificial Sequence
  Synthetic oligonucleotide
gaatccaggggcggtggtgggggggcagggacccaa

SEQ ID NO: 130912 - DNA, 36 bp, Artificial Sequence
  Synthetic oligonucleotide
tccggagcgccacatacataacatccccggccctca

SEQ ID NO: 130913 - DNA, 36 bp, Artificial Sequence
  Synthetic oligonucleotide
tttcaccctgcctcgagcgcatctagccggttctca

SEQ ID NO: 130914 - DNA, 37 bp, Artificial Sequence
  Synthetic oligonucleotide
actttcacccccccgctgatgacgctcccatctccga

SEQ ID NO: 130915 - DNA, 37 bp, Artificial Sequence
  Synthetic oligonucleotide
aggggacggagagaaggggtagaggagcttggcgcga

SEQ ID NO: 130916 - DNA, 37 bp, Artificial Sequence
  Synthetic oligonucleotide
atggaactgatcggaagaggggggaggggaagtagga

SEQ ID NO: 130917 - DNA, 37 bp, Artificial Sequence
  Synthetic oligonucleotide
tgcacttccgctgccccaccatcacttcgtcaccgga

SEQ ID NO: 130918 - DNA, 38 bp, Artificial Sequence
  Synthetic oligonucleotide
gtggggggagtagtggacggaggtgcggtaacgaatga

SEQ ID NO: 130919 - DNA, 35 bp, Artificial Sequence
  Synthetic oligonucleotide
aacccagcgcgcacctccatttgccccctccttga

SEQ ID NO: 130920 - DNA, 35 bp, Artificial Sequence
  Synthetic oligonucleotide
accccgtctccggtccctcgcaatccagtagcacc

SEQ ID NO: 130921 - DNA, 35 bp, Artificial Sequence
  Synthetic oligonucleotide
gtcatagcccccaggctgtaatctgttccccatcc

SEQ ID NO: 130922 - DNA, 35 bp, Artificial Sequence
  Synthetic oligonucleotide
gccgcaccctctgccagagcccacattatttgtcc

SEQ ID NO: 130923 - DNA, 35 bp, Artificial Sequence
  Synthetic oligonucleotide
atcctcgcagtgcatcacacgtttttttgctccgc

SEQ ID NO: 130924 - DNA, 35 bp, Artificial Sequence
  Synthetic oligonucleotide
ttactccaaccgctcgttttgaagccacctttcgc

SEQ ID NO: 130925 - DNA, 35 bp, Artificial Sequence
  Synthetic oligonucleotide
tttgcaccccctctgacgcagccctagaatctatc

SEQ ID NO: 130926 - DNA, 35 bp, Artificial Sequence
  Synthetic oligonucleotide
gttgagtacagatagccccccgctgccctactctc

SEQ ID NO: 130927 - DNA, 35 bp, Artificial Sequence
  Synthetic oligonucleotide
agttgccgccctccgtcgctcgctctaggacattc

SEQ ID NO: 130928 - DNA, 35 bp, Artificial Sequence
  Synthetic oligonucleotide
atgcgcccagtgacccgaactagttatgcccccct

SEQ ID NO: 130929 - DNA, 35 bp, Artificial Sequence
  Synthetic oligonucleotide
gttgcgtacctcgacggtctcataacacttgccct

SEQ ID NO: 130930 - DNA, 35 bp, Artificial Sequence
  Synthetic oligonucleotide
gcaacctctgacgcgaaactatgtccctcacgcct

SEQ ID NO: 130931 - DNA, 35 bp, Artificial Sequence
  Synthetic oligonucleotide
taccgcccgcctcgcccttgttgctctagtactct

SEQ ID NO: 130932 - DNA, 36 bp, Artificial Sequence
  Synthetic oligonucleotide
gcagtcctcgcgggtacgtccaagctttttccctct

SEQ ID NO: 130933 - DNA, 35 bp, Artificial Sequence
  Synthetic oligonucleotide
gttcacgcctgcccctgcgactgccaacccggttt

SEQ ID NO: 130934 - DNA, 36 bp, Artificial Sequence
  Synthetic oligonucleotide
gccctctcagatgacaccatcctgtccgctccgaaa

SEQ ID NO: 130935 - DNA, 36 bp, Artificial Sequence
  Synthetic oligonucleotide
gtaccatcccgccactgctactcctgtacggtgtaa

SEQ ID NO: 130936 - DNA, 35 bp, Artificial Sequence
  Synthetic oligonucleotide
accccccgtaccttcactccaatcgagactaggca

SEQ ID NO: 130937 - DNA, 37 bp, Artificial Sequence
  Synthetic oligonucleotide
gagaataagcgggggtgacaagggcgaggtgagggga

SEQ ID NO: 130938 - DNA, 38 bp, Artificial Sequence
  Synthetic oligonucleotide
gtgtgaaggtgggaaaaacggggacgggaacattgtga

SEQ ID NO: 130939 - DNA, 35 bp, Artificial Sequence
  Synthetic oligonucleotide
gctcatccacgtgtcatcaaagcgcctcctccgta

SEQ ID NO: 130940 - DNA, 35 bp, Artificial Sequence
  Synthetic oligonucleotide
acctgcgggagggaaaggaaagcgggaagaagtac

SEQ ID NO: 130941 - DNA, 35 bp, Artificial Sequence
  Synthetic oligonucleotide
gtacatcctgtgctcgaatccactgtggccatccc

SEQ ID NO: 130942 - DNA, 35 bp, Artificial Sequence
  Synthetic oligonucleotide
acgtgcacctgtgccatctaccgtagtttcgatcc

SEQ ID NO: 130943 - DNA, 35 bp, Artificial Sequence
  Synthetic oligonucleotide
gacgcatcaactgttctattgctcgctctaactcc

SEQ ID NO: 130944 - DNA, 35 bp, Artificial Sequence
  Synthetic oligonucleotide
aactcagtccttcttcgtcacttcaccgaccaagc

SEQ ID NO: 130945 - DNA, 35 bp, Artificial Sequence
  Synthetic oligonucleotide
acgattctcccgccggtcttggccgtttcactatc

SEQ ID NO: 130946 - DNA, 35 bp, Artificial Sequence
  Synthetic oligonucleotide
accccatgaccgacctccctgggatctaatccctc

SEQ ID NO: 130947 - DNA, 35 bp, Artificial Sequence
  Synthetic oligonucleotide
tcacatatcgcctgatccatccgccgatcactttc

SEQ ID NO: 130948 - DNA, 35 bp, Artificial Sequence
  Synthetic oligonucleotide
gacgatcatcgccgtttctcactcttacagtccct

SEQ ID NO: 130949 - DNA, 35 bp, Artificial Sequence
  Synthetic oligonucleotide
aggatggctcggcgtttggtcgtttctctcgtggt

SEQ ID NO: 130950 - DNA, 35 bp, Artificial Sequence
  Synthetic oligonucleotide
agaccacccagcctgtgttgtgtctccatgtcctt

SEQ ID NO: 130951 - DNA, 35 bp, Artificial Sequence
  Synthetic oligonucleotide
atttacacgccaccatgcgcgtcctcacttctctt

SEQ ID NO: 130952 - DNA, 36 bp, Artificial Sequence
  Synthetic oligonucleotide
actactgccctggcgtatagtccgcacttccccaca

SEQ ID NO: 130953 - DNA, 35 bp, Artificial Sequence
  Synthetic oligonucleotide
gcatctcgctcggccccgtatcaccaccaccatca

SEQ ID NO: 130954 - DNA, 35 bp, Artificial Sequence
  Synthetic oligonucleotide
gtaccgcgcaccctttgtcacattaccatccctca

SEQ ID NO: 130955 - DNA, 37 bp, Artificial Sequence
  Synthetic oligonucleotide
aaaacaagcgaggagggaaggggaggcgacagctaga

SEQ ID NO: 130956 - DNA, 37 bp, Artificial Sequence
  Synthetic oligonucleotide
gtcgcctgccagctccctttatcctgcactcacccga

SEQ ID NO: 130957 - DNA, 38 bp, Artificial Sequence
  Synthetic oligonucleotide
accgagcacgctgccttccccgcgccgtaccctcttga

SEQ ID NO: 130958 - DNA, 37 bp, Artificial Sequence
  Synthetic oligonucleotide
cgcggggtaagcgtatcggggtgggagggaaatttga

SEQ ID NO: 130959 - DNA, 36 bp, Artificial Sequence
  Synthetic oligonucleotide
tcacccctcataatgtcctttcgtgctatccgtata

SEQ ID NO: 130960 - DNA, 35 bp, Artificial Sequence
  Synthetic oligonucleotide
ttgccgaggcctcacccgtctttcacactccatac

SEQ ID NO: 130961 - DNA, 35 bp, Artificial Sequence
  Synthetic oligonucleotide
actgcccacaactcgactgcaacgttgcccacgcc

SEQ ID NO: 130962 - DNA, 35 bp, Artificial Sequence
  Synthetic oligonucleotide
tagcgctacgccccctttagctttgaattgccgcc

SEQ ID NO: 130963 - DNA, 35 bp, Artificial Sequence
  Synthetic oligonucleotide
gcattcccccgcgcatccatagatccatttatgcc

SEQ ID NO: 130964 - DNA, 35 bp, Artificial Sequence
  Synthetic oligonucleotide
tggagcccgtccgctactgagtctccctcttatcc

SEQ ID NO: 130965 - DNA, 35 bp, Artificial Sequence
  Synthetic oligonucleotide
gcaaagccaactgccgtccgtagctccgaccttcc

SEQ ID NO: 130966 - DNA, 35 bp, Artificial Sequence
  Synthetic oligonucleotide
atagcggcctcaccagtccatccccaacctcatgc

SEQ ID NO: 130967 - DNA, 35 bp, Artificial Sequence
  Synthetic oligonucleotide
gtccccccgccatccaagtgcgttcagcacagtgc

SEQ ID NO: 130968 - DNA, 35 bp, Artificial Sequence
  Synthetic oligonucleotide
gtattgtcgccgatcaatattggtactagcccctc

SEQ ID NO: 130969 - DNA, 35 bp, Artificial Sequence
  Synthetic oligonucleotide
tcgtgcctcgccgtactatattttgtgcctccttc

SEQ ID NO: 130970 - DNA, 35 bp, Artificial Sequence
  Synthetic oligonucleotide
tctgccacgccgctcgatcgttcctctcccttagg

SEQ ID NO: 130971 - DNA, 35 bp, Artificial Sequence
  Synthetic oligonucleotide
gcctgggagaaagggggaggcgggcacaggacttg

SEQ ID NO: 130972 - DNA, 35 bp, Artificial Sequence
  Synthetic oligonucleotide
gcctctccacacggattaacgactcgcacgcccct

SEQ ID NO: 130973 - DNA, 35 bp, Artificial Sequence
  Synthetic oligonucleotide
gaccaccaatctcagccttgacgtaattcccgcct

SEQ ID NO: 130974 - DNA, 35 bp, Artificial Sequence
  Synthetic oligonucleotide
gcccttcctgcaatgcctctacatagacctgcttt

SEQ ID NO: 130975 - DNA, 35 bp, Artificial Sequence
  Synthetic oligonucleotide
tgccaccgatgaaggttttcaagcccccctcttaa

SEQ ID NO: 130976 - DNA, 36 bp, Artificial Sequence
  Synthetic oligonucleotide
gcacctgcatactcgcgcccccgaccactgtcacca

SEQ ID NO: 130977 - DNA, 36 bp, Artificial Sequence
  Synthetic oligonucleotide
tcgacgccccgttatactgcccgcgcctgtcaccca

SEQ ID NO: 130978 - DNA, 36 bp, Artificial Sequence
  Synthetic oligonucleotide
gtacggtggggaggggtggtccaagggaacggggca

SEQ ID NO: 130979 - DNA, 36 bp, Artificial Sequence
  Synthetic oligonucleotide
gcaccccgcctcctcaggccgagatccatcttctca

SEQ ID NO: 130980 - DNA, 37 bp, Artificial Sequence
  Synthetic oligonucleotide
aggaagggtagcaagggggggaaggtcggacgctaga

SEQ ID NO: 130981 - DNA, 36 bp, Artificial Sequence
  Synthetic oligonucleotide
tcgcccaccctctgtaactccagcatccgaccacga

SEQ ID NO: 130982 - DNA, 37 bp, Artificial Sequence
  Synthetic oligonucleotide
gtgcccatccaggatgaatcgcctccgcccttaccga

SEQ ID NO: 130983 - DNA, 37 bp, Artificial Sequence
  Synthetic oligonucleotide
gtccacccctccccgagttatagcccccgccaccgga

SEQ ID NO: 130984 - DNA, 37 bp, Artificial Sequence
  Synthetic oligonucleotide
gaaaaagatggggcggaggttagttatggagggggga

SEQ ID NO: 130985 - DNA, 35 bp, Artificial Sequence
  Synthetic oligonucleotide
agtaccgccattaaccagcttgctcccctccctga

SEQ ID NO: 130986 - DNA, 37 bp, Artificial Sequence
  Synthetic oligonucleotide
gtccacaccgctccaatcgccgttaccgcccgggtga

SEQ ID NO: 130987 - DNA, 38 bp, Artificial Sequence
  Synthetic oligonucleotide
gaagcccatccttctgcttatgtgcctcctccccttga

SEQ ID NO: 130988 - DNA, 38 bp, Artificial Sequence
  Synthetic oligonucleotide
ggcggtgacggcggggtggcggtggataatcttcttga

SEQ ID NO: 130989 - DNA, 36 bp, Artificial Sequence
  Synthetic oligonucleotide
accacctccgcatgtactcccttttagccctggata

SEQ ID NO: 130990 - DNA, 36 bp, Artificial Sequence
  Synthetic oligonucleotide
gccgccacgccaccgatccttccatgcgtacatata

SEQ ID NO: 130991 - DNA, 36 bp, Artificial Sequence
  Synthetic oligonucleotide
tgccgcgattctgtacttcgccctgcccttgtccta

SEQ ID NO: 130992 - DNA, 35 bp, Artificial Sequence
  Synthetic oligonucleotide
gcactcacagtcagatcctgatcgctccatcgtta

SEQ ID NO: 130993 - DNA, 35 bp, Artificial Sequence
  Synthetic oligonucleotide
ggtggccctcccgtcccttgcctgttctgtcttac

SEQ ID NO: 130994 - DNA, 35 bp, Artificial Sequence
  Synthetic oligonucleotide
gaactccgcctccgcttttcgagatagaacccccc

SEQ ID NO: 130995 - DNA, 35 bp, Artificial Sequence
  Synthetic oligonucleotide
gcccccctcgacgcatatggtatcctgtcttgtcc

SEQ ID NO: 130996 - DNA, 35 bp, Artificial Sequence
  Synthetic oligonucleotide
gcgtagtcagtccgcgcgctgttcctccggtttcc

SEQ ID NO: 130997 - DNA, 33 bp, Artificial Sequence
  Synthetic oligonucleotide
acgacccccgctcttaccccattggttttaagc

SEQ ID NO: 130998 - DNA, 35 bp, Artificial Sequence
  Synthetic oligonucleotide
aatccccaccgcccgagtgccgaattcatgcccgc

SEQ ID NO: 130999 - DNA, 35 bp, Artificial Sequence
  Synthetic oligonucleotide
ggaacacccgtcatttttcgcacccctgcttaggc

SEQ ID NO: 131000 - DNA, 35 bp, Artificial Sequence
  Synthetic oligonucleotide
aatctgccctcccccggtattcattctgttgcatc

SEQ ID NO: 131001 - DNA, 35 bp, Artificial Sequence
  Synthetic oligonucleotide
accatccaccttagcatatacaagtactcgtgctc

SEQ ID NO: 131002 - DNA, 35 bp, Artificial Sequence
  Synthetic oligonucleotide
acatccacacgatcctttgtgctccttctactccg

SEQ ID NO: 131003 - DNA, 35 bp, Artificial Sequence
  Synthetic oligonucleotide
actcgtcgccacaatgaacctaccacctactcatg

SEQ ID NO: 131004 - DNA, 35 bp, Artificial Sequence
  Synthetic oligonucleotide
tgataggaaggggcgggcggaggggcattcgatat

SEQ ID NO: 131005 - DNA, 35 bp, Artificial Sequence
  Synthetic oligonucleotide
tcaccgtccaatctcacccgggtccgtattctact

SEQ ID NO: 131006 - DNA, 35 bp, Artificial Sequence
  Synthetic oligonucleotide
acccttgcatcacatctggtaattactcttgtcct

SEQ ID NO: 131007 - DNA, 35 bp, Artificial Sequence
  Synthetic oligonucleotide
tacagcaagccccacagtatttgcccgccctctct

SEQ ID NO: 131008 - DNA, 35 bp, Artificial Sequence
  Synthetic oligonucleotide
acaccactgccctttgacgtaaccagaccgcgctt

SEQ ID NO: 131009 - DNA, 36 bp, Artificial Sequence
  Synthetic oligonucleotide
gcgagggttagggagcacgaggagggtattgggcaa

SEQ ID NO: 131010 - DNA, 36 bp, Artificial Sequence
  Synthetic oligonucleotide
tagggggtgggaggggaaattgaacggttatgggaa

SEQ ID NO: 131011 - DNA, 35 bp, Artificial Sequence
  Synthetic oligonucleotide
gcgcactcctcgagtttctatctgcaacaccttaa

SEQ ID NO: 131012 - DNA, 36 bp, Artificial Sequence
  Synthetic oligonucleotide
gccccttgctaccaatgcgtggccttgtccatttaa

SEQ ID NO: 131013 - DNA, 35 bp, Artificial Sequence
  Synthetic oligonucleotide
tccgatctccattcctcaggcctctgtaacatcca

SEQ ID NO: 131014 - DNA, 36 bp, Artificial Sequence
  Synthetic oligonucleotide
gtgagggagggcgggctgggtatgataggggtgtca

SEQ ID NO: 131015 - DNA, 35 bp, Artificial Sequence
  Synthetic oligonucleotide
agcggtctcgccctgatcgcgccccacttatttca

SEQ ID NO: 131016 - DNA, 35 bp, Artificial Sequence
  Synthetic oligonucleotide
gtggagagggtggactgggaggcatgataaggcga

SEQ ID NO: 131017 - DNA, 37 bp, Artificial Sequence
  Synthetic oligonucleotide
gcagggcgaaggcatcgtgggggggggttagtactga

SEQ ID NO: 131018 - DNA, 38 bp, Artificial Sequence
  Synthetic oligonucleotide
gcagggacaagagtagagggacggaggagtgaaggtga

SEQ ID NO: 131019 - DNA, 35 bp, Artificial Sequence
  Synthetic oligonucleotide
gcgactagcctccccgctccctctgtattgcgcta

SEQ ID NO: 131020 - DNA, 35 bp, Artificial Sequence
  Synthetic oligonucleotide
ttcccgtcactgctgcactaccttcgctctgaacc

SEQ ID NO: 131021 - DNA, 35 bp, Artificial Sequence
  Synthetic oligonucleotide
gttcacccccaccgtttgaactatgtttcaaaccc

SEQ ID NO: 131022 - DNA, 35 bp, Artificial Sequence
  Synthetic oligonucleotide
gccgtttcgctgcattactttccgccgagccctcc

SEQ ID NO: 131023 - DNA, 35 bp, Artificial Sequence
  Synthetic oligonucleotide
tgcccactttccacttcctacaggctctggtttcc

SEQ ID NO: 131024 - DNA, 35 bp, Artificial Sequence
  Synthetic oligonucleotide
acatgtactgccccccgtgactttgccgactcccg

SEQ ID NO: 131025 - DNA, 35 bp, Artificial Sequence
  Synthetic oligonucleotide
gtatgcagaagggggggaccagaacggaatgtagg

SEQ ID NO: 131026 - DNA, 36 bp, Artificial Sequence
  Synthetic oligonucleotide
ggggcgatggcagaagggcgggaaggtatcgggggg

SEQ ID NO: 131027 - DNA, 35 bp, Artificial Sequence
  Synthetic oligonucleotide
acaccccgtgttcccccacttccgcacccgctctg

SEQ ID NO: 131028 - DNA, 35 bp, Artificial Sequence
  Synthetic oligonucleotide
gcaacctcagggtgccgtgccatttgcccttccct

SEQ ID NO: 131029 - DNA, 36 bp, Artificial Sequence
  Synthetic oligonucleotide
tccatcaatgccctcggatgcgcttgctccacctaa

SEQ ID NO: 131030 - DNA, 36 bp, Artificial Sequence
  Synthetic oligonucleotide
gcccgacgtagcctcattcgtttcctaagcccccca

SEQ ID NO: 131031 - DNA, 36 bp, Artificial Sequence
  Synthetic oligonucleotide
tgagagcgcactatcgtctctgaattcggtctccca

SEQ ID NO: 131032 - DNA, 36 bp, Artificial Sequence
  Synthetic oligonucleotide
gcagtgtaagatcacctacccgaccctgcgcctcca

SEQ ID NO: 131033 - DNA, 37 bp, Artificial Sequence
  Synthetic oligonucleotide
tgatcctcaccatcttcaccacagttgccttgatcga

SEQ ID NO: 131034 - DNA, 38 bp, Artificial Sequence
  Synthetic oligonucleotide
tagcggtggagggggataggcggggcaaaacgacatga

SEQ ID NO: 131035 - DNA, 38 bp, Artificial Sequence
  Synthetic oligonucleotide
gacgccgtaatactgcatttgttccctcgccctactga

SEQ ID NO: 131036 - DNA, 38 bp, Artificial Sequence
  Synthetic oligonucleotide
aacactgggagggccgggtgggtgagccttgcccgtga

SEQ ID NO: 131037 - DNA, 36 bp, Artificial Sequence
  Synthetic oligonucleotide
acaccaagcgctgtcctgccttcctcattttattga

SEQ ID NO: 131038 - DNA, 38 bp, Artificial Sequence
  Synthetic oligonucleotide
gagggggggtgggattgcgggtaggtgacgtacgttga

SEQ ID NO: 131039 - DNA, 36 bp, Artificial Sequence
  Synthetic oligonucleotide
gagccccctgccttcactccgctgccccggttccta

SEQ ID NO: 131040 - DNA, 35 bp, Artificial Sequence
  Synthetic oligonucleotide
gaaggggggctcaaaatcttggggcggggttcaac

SEQ ID NO: 131041 - DNA, 34 bp, Artificial Sequence
  Synthetic oligonucleotide
agacgccgcccccatgaagctagatcacttaccc

SEQ ID NO: 131042 - DNA, 35 bp, Artificial Sequence
  Synthetic oligonucleotide
tagccacacctcgcagagctcccataacgtccccc

SEQ ID NO: 131043 - DNA, 35 bp, Artificial Sequence
  Synthetic oligonucleotide
tagacaacgccctttctggttacccgtctatgctc

SEQ ID NO: 131044 - DNA, 35 bp, Artificial Sequence
  Synthetic oligonucleotide
gtgtcgcacccctcgtgtttttgcggttagccttc

SEQ ID NO: 131045 - DNA, 35 bp, Artificial Sequence
  Synthetic oligonucleotide
gcccgccgcccctcgctttaaagcaccctgttccg

SEQ ID NO: 131046 - DNA, 35 bp, Artificial Sequence
  Synthetic oligonucleotide
gtccatcactctccttgccgcctatcgcctacatg

SEQ ID NO: 131047 - DNA, 35 bp, Artificial Sequence
  Synthetic oligonucleotide
aacgcgacacattaactcctcccacgctcctgctg

SEQ ID NO: 131048 - DNA, 35 bp, Artificial Sequence
  Synthetic oligonucleotide
gcagtccccgtgttggttccctaagcctgtcccct

SEQ ID NO: 131049 - DNA, 35 bp, Artificial Sequence
  Synthetic oligonucleotide
ttaggcccacctcccacatgtctgtacctcgctct

SEQ ID NO: 131050 - DNA, 35 bp, Artificial Sequence
  Synthetic oligonucleotide
actgaccgcagctatgttgctcggctaccatctct

SEQ ID NO: 131051 - DNA, 35 bp, Artificial Sequence
  Synthetic oligonucleotide
gcgcatgacagtctactgctgcacctaccctgtct

SEQ ID NO: 131052 - DNA, 36 bp, Artificial Sequence
  Synthetic oligonucleotide
gatgaggtgggaggggtaaaggaccggcaccacaaa

SEQ ID NO: 131053 - DNA, 37 bp, Artificial Sequence
  Synthetic oligonucleotide
agagggtgaacatgggaagggcgaacggggtttgaga

SEQ ID NO: 131054 - DNA, 35 bp, Artificial Sequence
  Synthetic oligonucleotide
gtgtcccagcccttctattacgttaaactgcccga

SEQ ID NO: 131055 - DNA, 37 bp, Artificial Sequence
  Synthetic oligonucleotide
ggggttggtgcaatgggaagggggtggtgtggtggga

SEQ ID NO: 131056 - DNA, 32 bp, Artificial Sequence
  Synthetic oligonucleotide
actccccccctgcaatacctacgctccgtgta

SEQ ID NO: 131057 - DNA, 35 bp, Artificial Sequence
  Synthetic oligonucleotide
gttcgcccccgcccacctggcgtattttacatcac

SEQ ID NO: 131058 - DNA, 35 bp, Artificial Sequence
  Synthetic oligonucleotide
tgcattcgagcctgtacgcccctccgcttataccc

SEQ ID NO: 131059 - DNA, 35 bp, Artificial Sequence
  Synthetic oligonucleotide
ggggagaagcccaagtgttttagggaggggagggc

SEQ ID NO: 131060 - DNA, 35 bp, Artificial Sequence
  Synthetic oligonucleotide
atgctccccgggtccgcgcactacacagtcccctc

SEQ ID NO: 131061 - DNA, 35 bp, Artificial Sequence
  Synthetic oligonucleotide
ttccaccgcgcatgaatttgctaatgtcccttctg

SEQ ID NO: 131062 - DNA, 35 bp, Artificial Sequence
  Synthetic oligonucleotide
ggagagaagaggaactagtggcggggcaggatgat

SEQ ID NO: 131063 - DNA, 35 bp, Artificial Sequence
  Synthetic oligonucleotide
atcagccgcacctgcccccagaagcccatcgctat

SEQ ID NO: 131064 - DNA, 35 bp, Artificial Sequence
  Synthetic oligonucleotide
tacgaatgctcccctccaccgctcagtcgtttcct

SEQ ID NO: 131065 - DNA, 35 bp, Artificial Sequence
  Synthetic oligonucleotide
gtcacgcgtgcggtcccctgttcacccgcccgttt

SEQ ID NO: 131066 - DNA, 35 bp, Artificial Sequence
  Synthetic oligonucleotide
atccctccccgtccgcatgccggtccgctctgttt

SEQ ID NO: 131067 - DNA, 35 bp, Artificial Sequence
  Synthetic oligonucleotide
tcccatgtctgcccttcctgtacaaccggtctttt

SEQ ID NO: 131068 - DNA, 36 bp, Artificial Sequence
  Synthetic oligonucleotide
ttgcacgagggtagggggggaaatcaggtggtgaaa

SEQ ID NO: 131069 - DNA, 36 bp, Artificial Sequence
  Synthetic oligonucleotide
gaccttgcgcaattcgaatcccagtccttcctgcca

SEQ ID NO: 131070 - DNA, 35 bp, Artificial Sequence
  Synthetic oligonucleotide
aaggggctggaggaggaagggggggtgtaaacgga

SEQ ID NO: 131071 - DNA, 37 bp, Artificial Sequence
  Synthetic oligonucleotide
tacccccgcagctgtgcacacttctccgccggctgga

SEQ ID NO: 131072 - DNA, 38 bp, Artificial Sequence
  Synthetic oligonucleotide
ttcgcccaacaggcgtctagttcccatccttccgctga

SEQ ID NO: 131073 - DNA, 34 bp, Artificial Sequence
  Synthetic oligonucleotide
gcatcctgcccgtctacccgttactcgcttctga

SEQ ID NO: 131074 - DNA, 38 bp, Artificial Sequence
  Synthetic oligonucleotide
tcctcccatccgtgtccccctttagacagccgcattga

SEQ ID NO: 131075 - DNA, 35 bp, Artificial Sequence
  Synthetic oligonucleotide
tgaaggaggggggtgggggctggttggagggacac

SEQ ID NO: 131076 - DNA, 35 bp, Artificial Sequence
  Synthetic oligonucleotide
tgtgcatcccgccgcctattgatcgccgtctgcac

SEQ ID NO: 131077 - DNA, 35 bp, Artificial Sequence
  Synthetic oligonucleotide
tgctattgcacgttagctccttgcgctcccccacc

SEQ ID NO: 131078 - DNA, 35 bp, Artificial Sequence
  Synthetic oligonucleotide
tgcgggcgggacacgggagggtaaacatggtcagc

SEQ ID NO: 131079 - DNA, 35 bp, Artificial Sequence
  Synthetic oligonucleotide
gtacacctcgtccgcctttttcgtaacgtcttagc

SEQ ID NO: 131080 - DNA, 35 bp, Artificial Sequence
  Synthetic oligonucleotide
atgggcctctatatatgtcctctgccactccatgc

SEQ ID NO: 131081 - DNA, 35 bp, Artificial Sequence
  Synthetic oligonucleotide
gacagtgcgtcaccgtggtcccttactgcgccctc

SEQ ID NO: 131082 - DNA, 35 bp, Artificial Sequence
  Synthetic oligonucleotide
gcctccgcgcatgtttttccctgtttcactattcg

SEQ ID NO: 131083 - DNA, 35 bp, Artificial Sequence
  Synthetic oligonucleotide
gtgggtgcagtagggcgggaggaaggtcgacggtg

SEQ ID NO: 131084 - DNA, 35 bp, Artificial Sequence
  Synthetic oligonucleotide
gactcgccggcctgtcacagctcgactgttgccct

SEQ ID NO: 131085 - DNA, 35 bp, Artificial Sequence
  Synthetic oligonucleotide
tctcgcgtgagccgcccctggtatccactgtcttt

SEQ ID NO: 131086 - DNA, 36 bp, Artificial Sequence
  Synthetic oligonucleotide
gtcgccggccgttcgcttagtctcgttccccgtaaa

SEQ ID NO: 131087 - DNA, 36 bp, Artificial Sequence
  Synthetic oligonucleotide
gaaaagggcgggaaggtgaggggcctgattgtataa

SEQ ID NO: 131088 - DNA, 36 bp, Artificial Sequence
  Synthetic oligonucleotide
tccaccgttgatctatgctatgaccccccgccgtca

SEQ ID NO: 131089 - DNA, 37 bp, Artificial Sequence
  Synthetic oligonucleotide
ggactcgccgccacatttatgttcttcgcatctccga

SEQ ID NO: 131090 - DNA, 37 bp, Artificial Sequence
  Synthetic oligonucleotide
gcagtccctgttcctcgctgtacatcccgcttctcga

SEQ ID NO: 131091 - DNA, 38 bp, Artificial Sequence
  Synthetic oligonucleotide
gaaagggatagcaaggggcaaggtaggagggtgagtga

SEQ ID NO: 131092 - DNA, 37 bp, Artificial Sequence
  Synthetic oligonucleotide
aaccagagacatgagaggtcgagaggtgagggggtga

SEQ ID NO: 131093 - DNA, 37 bp, Artificial Sequence
  Synthetic oligonucleotide
accccgcctcaacctgtctcgccgtcccttttattga

SEQ ID NO: 131094 - DNA, 35 bp, Artificial Sequence
  Synthetic oligonucleotide
atccccatcccgtgatcggacactcacccccggta

SEQ ID NO: 131095 - DNA, 35 bp, Artificial Sequence
  Synthetic oligonucleotide
taaagccaacgcccctgtgactcggcctataccac

SEQ ID NO: 131096 - DNA, 35 bp, Artificial Sequence
  Synthetic oligonucleotide
accacgctgccctgtgctctccagttggctttccc

SEQ ID NO: 131097 - DNA, 35 bp, Artificial Sequence
  Synthetic oligonucleotide
acaccagcactagcgccaccagcccagtaccatcc

SEQ ID NO: 131098 - DNA, 35 bp, Artificial Sequence
  Synthetic oligonucleotide
tatcgcggagcccgtctcgccgtagttccatatcc

SEQ ID NO: 131099 - DNA, 35 bp, Artificial Sequence
  Synthetic oligonucleotide
tacccccgtaaccatcgagcccgcctaacctgtcc

SEQ ID NO: 131100 - DNA, 35 bp, Artificial Sequence
  Synthetic oligonucleotide
atccgtgccgggccactgtactctctgggctcctc

SEQ ID NO: 131101 - DNA, 35 bp, Artificial Sequence
  Synthetic oligonucleotide
cactgcgcgggcccccctatagttagctgctcctc

SEQ ID NO: 131102 - DNA, 35 bp, Artificial Sequence
  Synthetic oligonucleotide
tcgctcctgttcggtccttagttgcctcttcgttc

SEQ ID NO: 131103 - DNA, 35 bp, Artificial Sequence
  Synthetic oligonucleotide
ttgatgggtgggagggttacaggggacccagaacg

SEQ ID NO: 131104 - DNA, 35 bp, Artificial Sequence
  Synthetic oligonucleotide
ggaatggggcgagtggtaggtagcaaggggccgcg

SEQ ID NO: 131105 - DNA, 35 bp, Artificial Sequence
  Synthetic oligonucleotide
aaggggggaaggtgttacggggtctgggtgggcgg

SEQ ID NO: 131106 - DNA, 35 bp, Artificial Sequence
  Synthetic oligonucleotide
taaccccccccgacccgttttcgctatctcgcggg

SEQ ID NO: 131107 - DNA, 35 bp, Artificial Sequence
  Synthetic oligonucleotide
attgcaccttccgctgcctaggccctagtccctct

SEQ ID NO: 131108 - DNA, 35 bp, Artificial Sequence
  Synthetic oligonucleotide
gtgagcgccatcgcctttcgtttgtctgccctagt

SEQ ID NO: 131109 - DNA, 35 bp, Artificial Sequence
  Synthetic oligonucleotide
tgtgactacgaccacgctcgctccacctggttttt

SEQ ID NO: 131110 - DNA, 36 bp, Artificial Sequence
  Synthetic oligonucleotide
agaatggtcgagggaggaggagggattgcggaatga

SEQ ID NO: 131111 - DNA, 36 bp, Artificial Sequence
  Synthetic oligonucleotide
agtacccgctcacctatctgcctttctgctcctata

SEQ ID NO: 131112 - DNA, 36 bp, Artificial Sequence
  Synthetic oligonucleotide
tccctgctcccgctatgcctcgttgttgtctccgta

SEQ ID NO: 131113 - DNA, 36 bp, Artificial Sequence
  Synthetic oligonucleotide
atcactgcctccatattactttgatacacctcttta

SEQ ID NO: 131114 - DNA, 34 bp, Artificial Sequence
  Synthetic oligonucleotide
tggtccaccctcatgctactcccctctatggtac

SEQ ID NO: 131115 - DNA, 35 bp, Artificial Sequence
  Synthetic oligonucleotide
aaacacacgtccaactcgctgtatctaccgccccc

SEQ ID NO: 131116 - DNA, 34 bp, Artificial Sequence
  Synthetic oligonucleotide
tcacacgtttgcgtgactaccaccccttaatccc

SEQ ID NO: 131117 - DNA, 35 bp, Artificial Sequence
  Synthetic oligonucleotide
acttctaagccccaccccatccagccgcctgtggc

SEQ ID NO: 131118 - DNA, 35 bp, Artificial Sequence
  Synthetic oligonucleotide
acatcgccctatcgttaaaccatccttgctatgtc

SEQ ID NO: 131119 - DNA, 35 bp, Artificial Sequence
  Synthetic oligonucleotide
gatccgctcacccgatcagcttttccacaattgtc

SEQ ID NO: 131120 - DNA, 35 bp, Artificial Sequence
  Synthetic oligonucleotide
atagggacaacagtggatgaagggcgggggatgag

SEQ ID NO: 131121 - DNA, 35 bp, Artificial Sequence
  Synthetic oligonucleotide
aaccatgcgcaaattgtcgcccctgatcgctacct

SEQ ID NO: 131122 - DNA, 35 bp, Artificial Sequence
  Synthetic oligonucleotide
gtcactccacgtaattgtctggaaagctcccctct

SEQ ID NO: 131123 - DNA, 36 bp, Artificial Sequence
  Synthetic oligonucleotide
actcggtgccccaatcggtactccctgtctctacaa

SEQ ID NO: 131124 - DNA, 30 bp, Artificial Sequence
  Synthetic oligonucleotide
tacttcccccagacccgtcctccgtaataa

SEQ ID NO: 131125 - DNA, 36 bp, Artificial Sequence
  Synthetic oligonucleotide
aatctgcccggctccatctcgttcctagtgtcttca

SEQ ID NO: 131126 - DNA, 37 bp, Artificial Sequence
  Synthetic oligonucleotide
ttagtgagggggccgggacggaaatacggggacggga

SEQ ID NO: 131127 - DNA, 37 bp, Artificial Sequence
  Synthetic oligonucleotide
gagacagtgtggggtaggtgaatcaatgggtggggga

SEQ ID NO: 131128 - DNA, 38 bp, Artificial Sequence
  Synthetic oligonucleotide
accccagcccgctggcatactaatactcactcccttga

SEQ ID NO: 131129 - DNA, 35 bp, Artificial Sequence
  Synthetic oligonucleotide
acccacacaccccctgtttctgttgccccccagta

SEQ ID NO: 131130 - DNA, 35 bp, Artificial Sequence
  Synthetic oligonucleotide
tcaaccttcacatgcctccacttacacagctgtta

SEQ ID NO: 131131 - DNA, 36 bp, Artificial Sequence
  Synthetic oligonucleotide
attcgacctcccccgggttaccatgctgaccgttta

SEQ ID NO: 131132 - DNA, 35 bp, Artificial Sequence
  Synthetic oligonucleotide
gtctagctaaccttctgtcgtggccgccgatcccc

SEQ ID NO: 131133 - DNA, 35 bp, Artificial Sequence
  Synthetic oligonucleotide
tgccacttgcacactggagatgcccgttcctcccc

SEQ ID NO: 131134 - DNA, 35 bp, Artificial Sequence
  Synthetic oligonucleotide
agctcagtgcaatctcctgctcacgttgtccctcc

SEQ ID NO: 131135 - DNA, 35 bp, Artificial Sequence
  Synthetic oligonucleotide
acgtagtcgccgcatttctccccttctatcccggc

SEQ ID NO: 131136 - DNA, 35 bp, Artificial Sequence
  Synthetic oligonucleotide
gacctccccgcacacgactcatcgggccatattgc

SEQ ID NO: 131137 - DNA, 35 bp, Artificial Sequence
  Synthetic oligonucleotide
gccccggctgatcccgcgattcaccccgtacccct

SEQ ID NO: 131138 - DNA, 35 bp, Artificial Sequence
  Synthetic oligonucleotide
tggaccctgcatattgcgctgcacccccgcttgct

SEQ ID NO: 131139 - DNA, 32 bp, Artificial Sequence
  Synthetic oligonucleotide
ttgaggctcctccgctctctcagccttattct

SEQ ID NO: 131140 - DNA, 36 bp, Artificial Sequence
  Synthetic oligonucleotide
atccctgccgccgaatcacactgtccctcaccggaa

SEQ ID NO: 131141 - DNA, 36 bp, Artificial Sequence
  Synthetic oligonucleotide
aacagcccgcctcgttcttatccgagtcttgcacca

SEQ ID NO: 131142 - DNA, 36 bp, Artificial Sequence
  Synthetic oligonucleotide
agacgcaagtcgacgagtgccacccccccgccatca

SEQ ID NO: 131143 - DNA, 36 bp, Artificial Sequence
  Synthetic oligonucleotide
atccgcactggtcctgcggtatgacccctttcctca

SEQ ID NO: 131144 - DNA, 37 bp, Artificial Sequence
  Synthetic oligonucleotide
accccagtcgtaaccgatctccatttgccatgcccga

SEQ ID NO: 131145 - DNA, 35 bp, Artificial Sequence
  Synthetic oligonucleotide
tgaacgcatggccttggtctgtcttgttcttcccc

SEQ ID NO: 131146 - DNA, 35 bp, Artificial Sequence
  Synthetic oligonucleotide
accctggtccatgatcctgttgcctcgatctccgc

SEQ ID NO: 131147 - DNA, 35 bp, Artificial Sequence
  Synthetic oligonucleotide
ttcgcccgcctacccgtttcgagctagaaccactc

SEQ ID NO: 131148 - DNA, 35 bp, Artificial Sequence
  Synthetic oligonucleotide
gtgccatgtcgcctcctatttagttcctgcctctc

SEQ ID NO: 131149 - DNA, 35 bp, Artificial Sequence
  Synthetic oligonucleotide
tccggtgggacgggagaagggggggatgtccatcg

SEQ ID NO: 131150 - DNA, 34 bp, Artificial Sequence
  Synthetic oligonucleotide
tactggcgcacctcggctatcattcttccgcgct

SEQ ID NO: 131151 - DNA, 35 bp, Artificial Sequence
  Synthetic oligonucleotide
gccccacaggacgcggtgctcattgcctttccctt

SEQ ID NO: 131152 - DNA, 35 bp, Artificial Sequence
  Synthetic oligonucleotide
actttcgccgcctgttcaatgccctccttccgcaa

SEQ ID NO: 131153 - DNA, 36 bp, Artificial Sequence
  Synthetic oligonucleotide
acgcccactgggctgattctacgtgcaccccctcca

SEQ ID NO: 131154 - DNA, 36 bp, Artificial Sequence
  Synthetic oligonucleotide
tgacgcccccggtgaactctctcttatactcccgca

SEQ ID NO: 131155 - DNA, 37 bp, Artificial Sequence
  Synthetic oligonucleotide
acacccggagagatactgggaaggggggggagtagga

SEQ ID NO: 131156 - DNA, 37 bp, Artificial Sequence
  Synthetic oligonucleotide
gaaggggagtagactgggaggaggaggggagtaatga

SEQ ID NO: 131157 - DNA, 38 bp, Artificial Sequence
  Synthetic oligonucleotide
acgaccaaggggtgacgggaggggacgggctttactga

SEQ ID NO: 131158 - DNA, 38 bp, Artificial Sequence
  Synthetic oligonucleotide
accccactcgccgttgactaataccggaccctgcttga

SEQ ID NO: 131159 - DNA, 34 bp, Artificial Sequence
  Synthetic oligonucleotide
atgacacctgtgcggttgataacccggccctccc

SEQ ID NO: 131160 - DNA, 35 bp, Artificial Sequence
  Synthetic oligonucleotide
ggttagctcacgttcccttaacagatctgcctccc

SEQ ID NO: 131161 - DNA, 35 bp, Artificial Sequence
  Synthetic oligonucleotide
tcaccccgatgttccgcgccttctcagcgtctccc

SEQ ID NO: 131162 - DNA, 35 bp, Artificial Sequence
  Synthetic oligonucleotide
tcacacactccttgcgcaaactttgacgacgtccc

SEQ ID NO: 131163 - DNA, 35 bp, Artificial Sequence
  Synthetic oligonucleotide
atgttcccccgacagactccttcccctattctcgc

SEQ ID NO: 131164 - DNA, 35 bp, Artificial Sequence
  Synthetic oligonucleotide
attcaccgtgccacgtctgcacacgccggcccctc

SEQ ID NO: 131165 - DNA, 35 bp, Artificial Sequence
  Synthetic oligonucleotide
ggtgcggaccctgctgtcgcttttcgtctgtcctc

SEQ ID NO: 131166 - DNA, 34 bp, Artificial Sequence
  Synthetic oligonucleotide
accttgcctgcccttgcccgacttcttcctgccg

SEQ ID NO: 131167 - DNA, 35 bp, Artificial Sequence
  Synthetic oligonucleotide
acctcccgcccctcatagtcttaacgtacccactg

SEQ ID NO: 131168 - DNA, 35 bp, Artificial Sequence
  Synthetic oligonucleotide
ttagacaccggaccgcctgcttgacccatagccct

SEQ ID NO: 131169 - DNA, 37 bp, Artificial Sequence
  Synthetic oligonucleotide
gccatccccgatgaagtcagtcttcactaccctccga

SEQ ID NO: 131170 - DNA, 36 bp, Artificial Sequence
  Synthetic oligonucleotide
tcaacaacggaaggagaaatgagggggaggatagga

SEQ ID NO: 131171 - DNA, 38 bp, Artificial Sequence
  Synthetic oligonucleotide
aagtacgaggaaaatgggtgggggcgagagagggatga

SEQ ID NO: 131172 - DNA, 35 bp, Artificial Sequence
  Synthetic oligonucleotide
tgatgccctcacccgtggtcaatcctcttctacta

SEQ ID NO: 131173 - DNA, 36 bp, Artificial Sequence
  Synthetic oligonucleotide
tgacaacccaggtctgccaccccccattcttttcta

SEQ ID NO: 131174 - DNA, 35 bp, Artificial Sequence
  Synthetic oligonucleotide
gttgaggcgtgtcgatgtcattcttatcctgtccc

SEQ ID NO: 131175 - DNA, 29 bp, Artificial Sequence
  Synthetic oligonucleotide
atgtgacatctccgcctgttccttgctcc

SEQ ID NO: 131176 - DNA, 35 bp, Artificial Sequence
  Synthetic oligonucleotide
gcacgaccattacgcgtcatgttactgccccgtcc

SEQ ID NO: 131177 - DNA, 35 bp, Artificial Sequence
  Synthetic oligonucleotide
tcaaactgcgtgcatagcgtactcctcttctgctc

SEQ ID NO: 131178 - DNA, 33 bp, Artificial Sequence
  Synthetic oligonucleotide
tcttcccatcagtcgggaacccagtactatctc

SEQ ID NO: 131179 - DNA, 35 bp, Artificial Sequence
  Synthetic oligonucleotide
gaccacaggagtcccatggcctatctttttttctc

SEQ ID NO: 131180 - DNA, 35 bp, Artificial Sequence
  Synthetic oligonucleotide
atggtgctcgatctgtgcacgcccctttccttccg

SEQ ID NO: 131181 - DNA, 35 bp, Artificial Sequence
  Synthetic oligonucleotide
cacacggcatgtcctgcctcccactgtttcgttcg

SEQ ID NO: 131182 - DNA, 35 bp, Artificial Sequence
  Synthetic oligonucleotide
gaacactgacactgcccatcgagcctatccaatat

SEQ ID NO: 131183 - DNA, 35 bp, Artificial Sequence
  Synthetic oligonucleotide
acctgagcattgcgctacccatccgtccctgctat

SEQ ID NO: 131184 - DNA, 35 bp, Artificial Sequence
  Synthetic oligonucleotide
ggttcagaccgccgtcccctctcatcgccttgggt

SEQ ID NO: 131185 - DNA, 35 bp, Artificial Sequence
  Synthetic oligonucleotide
gatcgggacacgggagggaaagcgggtgaggtctt

SEQ ID NO: 131186 - DNA, 36 bp, Artificial Sequence
  Synthetic oligonucleotide
gcaacccccctgccggagcactcttgcgttcaccaa

SEQ ID NO: 131187 - DNA, 36 bp, Artificial Sequence
  Synthetic oligonucleotide
accagccctcctgcacgccatcatgcttcaacgcaa

SEQ ID NO: 131188 - DNA, 36 bp, Artificial Sequence
  Synthetic oligonucleotide
atgggagggaaacgattactgaggggggggagacga

SEQ ID NO: 131189 - DNA, 30 bp, Artificial Sequence
  Synthetic oligonucleotide
gatgttgtctggccttctcacgccccccga

SEQ ID NO: 131190 - DNA, 35 bp, Artificial Sequence
  Synthetic oligonucleotide
tccttcacccgaccacctccgagccttggactcga

SEQ ID NO: 131191 - DNA, 38 bp, Artificial Sequence
  Synthetic oligonucleotide
gcctgtgtgggggggcacaagggagtggggggttatga

SEQ ID NO: 131192 - DNA, 38 bp, Artificial Sequence
  Synthetic oligonucleotide
tgcccattgcctattgtcgccccccgagttccgcttga

SEQ ID NO: 131193 - DNA, 35 bp, Artificial Sequence
  Synthetic oligonucleotide
gagcgctcatctcgttcctcaccgcccttctaata

SEQ ID NO: 131194 - DNA, 35 bp, Artificial Sequence
  Synthetic oligonucleotide
gtcccgccgacccgttcccccccccgcggactata

SEQ ID NO: 131195 - DNA, 36 bp, Artificial Sequence
  Synthetic oligonucleotide
tatggcctccccctgatcccgctttgcctggtgcta

SEQ ID NO: 131196 - DNA, 35 bp, Artificial Sequence
  Synthetic oligonucleotide
atcgtttgcgccgccgctccactcccgcatttcta

SEQ ID NO: 131197 - DNA, 35 bp, Artificial Sequence
  Synthetic oligonucleotide
tcacccgcgctggttaaacgccgtattatcttcac

SEQ ID NO: 131198 - DNA, 35 bp, Artificial Sequence
  Synthetic oligonucleotide
tgtaccctcccgtctgttccctgtgcagcccagcc

SEQ ID NO: 131199 - DNA, 35 bp, Artificial Sequence
  Synthetic oligonucleotide
aactcaacctcaatctgctccaatggccaaacgcc

SEQ ID NO: 131200 - DNA, 34 bp, Artificial Sequence
  Synthetic oligonucleotide
gcgcaacgcctggcgcacgcttaccacccgttcc

SEQ ID NO: 131201 - DNA, 35 bp, Artificial Sequence
  Synthetic oligonucleotide
ttccacctcattgactgtatacctgtctcttctgc

SEQ ID NO: 131202 - DNA, 35 bp, Artificial Sequence
  Synthetic oligonucleotide
acccaagcctgacacctcccctcgtactgtacgtc

SEQ ID NO: 131203 - DNA, 35 bp, Artificial Sequence
  Synthetic oligonucleotide
tgccatctcacaatgtttctacccgtattctcgtc

SEQ ID NO: 131204 - DNA, 35 bp, Artificial Sequence
  Synthetic oligonucleotide
gcccaccccgcacttgaacgtagcaaactaacttc

SEQ ID NO: 131205 - DNA, 35 bp, Artificial Sequence
  Synthetic oligonucleotide
atggacgggttggagttgaagggaaaagggctgag

SEQ ID NO: 131206 - DNA, 35 bp, Artificial Sequence
  Synthetic oligonucleotide
tcgagtaccgacccctcccacgtctgccctcctat

SEQ ID NO: 131207 - DNA, 35 bp, Artificial Sequence
  Synthetic oligonucleotide
acccgcgcatttagtgctataccgtctctacccct

SEQ ID NO: 131208 - DNA, 35 bp, Artificial Sequence
  Synthetic oligonucleotide
agcccatcgcgcaccgccgcgcactcacgctccct

SEQ ID NO: 131209 - DNA, 35 bp, Artificial Sequence
  Synthetic oligonucleotide
gtgccgtacttccgctgctcgcctacatatcatgt

SEQ ID NO: 131210 - DNA, 36 bp, Artificial Sequence
  Synthetic oligonucleotide
tctcgtacccgcctcgttcgttgttacacatccaca

SEQ ID NO: 131211 - DNA, 36 bp, Artificial Sequence
  Synthetic oligonucleotide
tcctccaccatgcagtattatgcgccggcataccca

SEQ ID NO: 131212 - DNA, 35 bp, Artificial Sequence
  Synthetic oligonucleotide
tgcaacgcattaggggggggtagggtcgggacgca

SEQ ID NO: 131213 - DNA, 35 bp, Artificial Sequence
  Synthetic oligonucleotide
gagtgaccgtagggagggtggtatgggagggggca

SEQ ID NO: 131214 - DNA, 37 bp, Artificial Sequence
  Synthetic oligonucleotide
acgtgggccacccctccgctcccgttcgatctctcga

SEQ ID NO: 131215 - DNA, 37 bp, Artificial Sequence
  Synthetic oligonucleotide
tagggaagggcgggtgggatcactacgagaaggtcga

SEQ ID NO: 131216 - DNA, 37 bp, Artificial Sequence
  Synthetic oligonucleotide
ttgtcgcccagccttctgttatctcccccagcccgga

SEQ ID NO: 131217 - DNA, 36 bp, Artificial Sequence
  Synthetic oligonucleotide
tggtggatgacgggaaggaaccgaggagggagggga

SEQ ID NO: 131218 - DNA, 36 bp, Artificial Sequence
  Synthetic oligonucleotide
tgtgatccgcaccaactgaacgccctcgcccttgga

SEQ ID NO: 131219 - DNA, 37 bp, Artificial Sequence
  Synthetic oligonucleotide
aaccacccgcctgcctgatactttagtagcctcctga

SEQ ID NO: 131220 - DNA, 35 bp, Artificial Sequence
  Synthetic oligonucleotide
acacaccggtcatccaccatacgttgcattccgcc

SEQ ID NO: 131221 - DNA, 35 bp, Artificial Sequence
  Synthetic oligonucleotide
gctccggtccacgcgctagttcaaggcctttctcc

SEQ ID NO: 131222 - DNA, 35 bp, Artificial Sequence
  Synthetic oligonucleotide
atgtgtgagacggaggggggggagtgggttatagc

SEQ ID NO: 131223 - DNA, 35 bp, Artificial Sequence
  Synthetic oligonucleotide
tgtgcgaccctgttttctcgctcgctctcacccgc

SEQ ID NO: 131224 - DNA, 35 bp, Artificial Sequence
  Synthetic oligonucleotide
accaccgtaatgtgccgtcagactacctggtccct

SEQ ID NO: 131225 - DNA, 35 bp, Artificial Sequence
  Synthetic oligonucleotide
gtcgggtctatgtgcccttccctccgcggccctct

SEQ ID NO: 131226 - DNA, 35 bp, Artificial Sequence
  Synthetic oligonucleotide
gaggtgtaggggggaaataaatgggaagagcggca

SEQ ID NO: 131227 - DNA, 35 bp, Artificial Sequence
  Synthetic oligonucleotide
tactgtggaaagaaggagtggatgggaacgaggga

SEQ ID NO: 131228 - DNA, 37 bp, Artificial Sequence
  Synthetic oligonucleotide
tcacgccccattttccctgccgctgtggtccttggga

SEQ ID NO: 131229 - DNA, 37 bp, Artificial Sequence
  Synthetic oligonucleotide
gttcgctcaactcgcctgcatgccatccctaacctga

SEQ ID NO: 131230 - DNA, 37 bp, Artificial Sequence
  Synthetic oligonucleotide
aacatcacctctctgcccacataacagtccttgctga

SEQ ID NO: 131231 - DNA, 36 bp, Artificial Sequence
  Synthetic oligonucleotide
ggtgcgggcccggttgtcctatcgcctttccacgta

SEQ ID NO: 131232 - DNA, 35 bp, Artificial Sequence
  Synthetic oligonucleotide
tgtggacctaattgtatcgccctgttttgcccacc

SEQ ID NO: 131233 - DNA, 35 bp, Artificial Sequence
  Synthetic oligonucleotide
gtacctcgcccacaatcttaagcaacatttttacc

SEQ ID NO: 131234 - DNA, 35 bp, Artificial Sequence
  Synthetic oligonucleotide
gtcaccgtttgtgccacccaaatggtctcgccccc

SEQ ID NO: 131235 - DNA, 35 bp, Artificial Sequence
  Synthetic oligonucleotide
gtcgcatgctcttcaccgtacgctactttctggcc

SEQ ID NO: 131236 - DNA, 35 bp, Artificial Sequence
  Synthetic oligonucleotide
tgtggcccccgaactgttttctcgcccgtacctcc

SEQ ID NO: 131237 - DNA, 35 bp, Artificial Sequence
  Synthetic oligonucleotide
cccccctgccccttgcttactggcctctccttggc

SEQ ID NO: 131238 - DNA, 35 bp, Artificial Sequence
  Synthetic oligonucleotide
gtgcccatgtccccattgatccccaagtcaccatc

SEQ ID NO: 131239 - DNA, 35 bp, Artificial Sequence
  Synthetic oligonucleotide
ttcaatcggcgcagttaccctcgtcatgctccatc

SEQ ID NO: 131240 - DNA, 35 bp, Artificial Sequence
  Synthetic oligonucleotide
tgctactcccaaccgtgtcgggtctcgattcctcg

SEQ ID NO: 131241 - DNA, 35 bp, Artificial Sequence
  Synthetic oligonucleotide
acaccccagctcatcaccgtcctccgaaatccgtg

SEQ ID NO: 131242 - DNA, 35 bp, Artificial Sequence
  Synthetic oligonucleotide
attccatcccgccttcacacgaccttgagttccgt

SEQ ID NO: 131243 - DNA, 35 bp, Artificial Sequence
  Synthetic oligonucleotide
gccacgtacagaggtctcatcatcgcctgggtctt

SEQ ID NO: 131244 - DNA, 35 bp, Artificial Sequence
  Synthetic oligonucleotide
taccgcacacgtcgtacgctcccagatccttctca

SEQ ID NO: 131245 - DNA, 37 bp, Artificial Sequence
  Synthetic oligonucleotide
agttgaggaggtgggacagggagacggggggtacaga

SEQ ID NO: 131246 - DNA, 37 bp, Artificial Sequence
  Synthetic oligonucleotide
tctccaccctcatgtctcgtaatatccctcacctaga

SEQ ID NO: 131247 - DNA, 36 bp, Artificial Sequence
  Synthetic oligonucleotide
gtctcccccacatatagtttctgtccgtccagacga

SEQ ID NO: 131248 - DNA, 38 bp, Artificial Sequence
  Synthetic oligonucleotide
atagcaagggggcgggggaagggcggggaggcccgtga

SEQ ID NO: 131249 - DNA, 38 bp, Artificial Sequence
  Synthetic oligonucleotide
ttgtaacatgcgctaccatctagcacccaccttgttga

SEQ ID NO: 131250 - DNA, 35 bp, Artificial Sequence
  Synthetic oligonucleotide
gtcccgctctagattccctccatcctgttgcagcc

SEQ ID NO: 131251 - DNA, 35 bp, Artificial Sequence
  Synthetic oligonucleotide
cacgccaccactgttgcaaggtatccctctacgcc

SEQ ID NO: 131252 - DNA, 35 bp, Artificial Sequence
  Synthetic oligonucleotide
tcccatctcaccttgccttgagtaggctttcaatc

SEQ ID NO: 131253 - DNA, 35 bp, Artificial Sequence
  Synthetic oligonucleotide
tcatggtccctccgccggcaccaatctcgcttatc

SEQ ID NO: 131254 - DNA, 35 bp, Artificial Sequence
  Synthetic oligonucleotide
tcccacatccagctcggcctccggatcgttccccg

SEQ ID NO: 131255 - DNA, 35 bp, Artificial Sequence
  Synthetic oligonucleotide
gaggagtggaggggcggtggttggtgggcaatgct

SEQ ID NO: 131256 - DNA, 35 bp, Artificial Sequence
  Synthetic oligonucleotide
tttgccacgtacagacgggggggagggtagggcgt

SEQ ID NO: 131257 - DNA, 36 bp, Artificial Sequence
  Synthetic oligonucleotide
gaacacagccatttacctccccgcgacgacccgaca

SEQ ID NO: 131258 - DNA, 35 bp, Artificial Sequence
  Synthetic oligonucleotide
gcactttccccgcacgcctacattgcgttatacca

SEQ ID NO: 131259 - DNA, 35 bp, Artificial Sequence
  Synthetic oligonucleotide
gccctcacccctggatatcttcaagcccgacccca

SEQ ID NO: 131260 - DNA, 36 bp, Artificial Sequence
  Synthetic oligonucleotide
tctcagcaccgccctcccctcccacgctcgccgcca

SEQ ID NO: 131261 - DNA, 38 bp, Artificial Sequence
  Synthetic oligonucleotide
gtggacggcttttccatcatgtgatcctccccccgtga

SEQ ID NO: 131262 - DNA, 36 bp, Artificial Sequence
  Synthetic oligonucleotide
tgcaatagggaggggtgggtcgggaaattctgagta

SEQ ID NO: 131263 - DNA, 35 bp, Artificial Sequence
  Synthetic oligonucleotide
aaacccatcttgccatgccgtgcctccctttagcc

SEQ ID NO: 131264 - DNA, 36 bp, Artificial Sequence
  Synthetic oligonucleotide
atgcatacggtatgtatgtacaccgaccccgccgcc

SEQ ID NO: 131265 - DNA, 35 bp, Artificial Sequence
  Synthetic oligonucleotide
tacactgacccgcccagccgacccactcatctgcc

SEQ ID NO: 131266 - DNA, 36 bp, Artificial Sequence
  Synthetic oligonucleotide
ttcaacaccctcttgcctgcttagttaaggaaatcc

SEQ ID NO: 131267 - DNA, 35 bp, Artificial Sequence
  Synthetic oligonucleotide
gtccgcccgctccacactaatcactttatgcacgc

SEQ ID NO: 131268 - DNA, 35 bp, Artificial Sequence
  Synthetic oligonucleotide
gtgttgccgccgtcttttcgtctcctgtccgtcgc

SEQ ID NO: 131269 - DNA, 35 bp, Artificial Sequence
  Synthetic oligonucleotide
gataccctcactggtgttttcgttccctggccctt

SEQ ID NO: 131270 - DNA, 35 bp, Artificial Sequence
  Synthetic oligonucleotide
attttccgcccccgagttggtctctgtttccccca

SEQ ID NO: 131271 - DNA, 37 bp, Artificial Sequence
  Synthetic oligonucleotide
tgtcggagtggtcgggggggaggaggcggaagtacga

SEQ ID NO: 131272 - DNA, 36 bp, Artificial Sequence
  Synthetic oligonucleotide
tcgccaagtggcggaggaggggaaaggaagggggga

SEQ ID NO: 131273 - DNA, 37 bp, Artificial Sequence
  Synthetic oligonucleotide
ggggaggagggggaagtagagggggttaatgttggga

SEQ ID NO: 131274 - DNA, 37 bp, Artificial Sequence
  Synthetic oligonucleotide
tgcccagatcgcgccctcgtccctccgcacaccgtga

SEQ ID NO: 131275 - DNA, 38 bp, Artificial Sequence
  Synthetic oligonucleotide
gaccctgcccagttcggtccatccattcttcatcttga

SEQ ID NO: 131276 - DNA, 35 bp, Artificial Sequence
  Synthetic oligonucleotide
gtgtccacccgcaattgtggccctgctttacacta

SEQ ID NO: 131277 - DNA, 35 bp, Artificial Sequence
  Synthetic oligonucleotide
gcaacctatttgtcgatattccttcccgtgcccta

SEQ ID NO: 131278 - DNA, 35 bp, Artificial Sequence
  Synthetic oligonucleotide
ttacccgcgcgcttttaaggtctacaccctctcgc

SEQ ID NO: 131279 - DNA, 35 bp, Artificial Sequence
  Synthetic oligonucleotide
ttgggcgccttgccgccggacttcatcctccctgc

SEQ ID NO: 131280 - DNA, 35 bp, Artificial Sequence
  Synthetic oligonucleotide
gtgatagcgtatgttcacctgccccgcctgcttgc

SEQ ID NO: 131281 - DNA, 35 bp, Artificial Sequence
  Synthetic oligonucleotide
gtgtctccatccacgtcgtccgccactacctggtc

SEQ ID NO: 131282 - DNA, 35 bp, Artificial Sequence
  Synthetic oligonucleotide
gacatcggcacagtagccgcgcagccctccacttc

SEQ ID NO: 131283 - DNA, 35 bp, Artificial Sequence
  Synthetic oligonucleotide
tccctccacccgacggtcccatgctcctgcacaag

SEQ ID NO: 131284 - DNA, 35 bp, Artificial Sequence
  Synthetic oligonucleotide
tgcggttgccaccccggtccccagagccccccacg

SEQ ID NO: 131285 - DNA, 35 bp, Artificial Sequence
  Synthetic oligonucleotide
agggtcaggggggcgggctttggcagtacggggcg

SEQ ID NO: 131286 - DNA, 35 bp, Artificial Sequence
  Synthetic oligonucleotide
tgcgacccactcacgccgcccccatgtgtctttgt

SEQ ID NO: 131287 - DNA, 35 bp, Artificial Sequence
  Synthetic oligonucleotide
gtgacatacggagggagggaacgggttgtgggttt

SEQ ID NO: 131288 - DNA, 35 bp, Artificial Sequence
  Synthetic oligonucleotide
taccaccatcgataccgctttctgtgctcgcctaa

SEQ ID NO: 131289 - DNA, 34 bp, Artificial Sequence
  Synthetic oligonucleotide
gatacgccgctatcactcggtcccctttatgcca

SEQ ID NO: 131290 - DNA, 35 bp, Artificial Sequence
  Synthetic oligonucleotide
aagactaacggtcgggtagggggggaggagcaaga

SEQ ID NO: 131291 - DNA, 35 bp, Artificial Sequence
  Synthetic oligonucleotide
gcaacacgccctccgtaaccagcccttgtcgacga

SEQ ID NO: 131292 - DNA, 36 bp, Artificial Sequence
  Synthetic oligonucleotide
gacatgtccatccttccgtgggtccacctccgccga

SEQ ID NO: 131293 - DNA, 37 bp, Artificial Sequence
  Synthetic oligonucleotide
attagaggggaggggcgcacaacgagcagggcgggga

SEQ ID NO: 131294 - DNA, 36 bp, Artificial Sequence
  Synthetic oligonucleotide
ggataggaggggcaggatgggtgtgggggatgatga

SEQ ID NO: 131295 - DNA, 38 bp, Artificial Sequence
  Synthetic oligonucleotide
gggagacagtccgggacgggaaggaggggacgaagtga

SEQ ID NO: 131296 - DNA, 35 bp, Artificial Sequence
  Synthetic oligonucleotide
tcccccgtcacttgtgttgccccgctcccccacac

SEQ ID NO: 131297 - DNA, 35 bp, Artificial Sequence
  Synthetic oligonucleotide
tacagtgcaaacctgggctccagtgcttcatcccc

SEQ ID NO: 131298 - DNA, 35 bp, Artificial Sequence
  Synthetic oligonucleotide
ttgcaggccgttcctagtccattcaccatttgcgc

SEQ ID NO: 131299 - DNA, 35 bp, Artificial Sequence
  Synthetic oligonucleotide
gggcgatgcagcagtcgttacaaccgccccccctc

SEQ ID NO: 131300 - DNA, 35 bp, Artificial Sequence
  Synthetic oligonucleotide
acgcaacctatccgttcctatcaggccatgccacg

SEQ ID NO: 131301 - DNA, 35 bp, Artificial Sequence
  Synthetic oligonucleotide
gagcccccccccgtattgcaaagtagcaacgtgcg

SEQ ID NO: 131302 - DNA, 36 bp, Artificial Sequence
  Synthetic oligonucleotide
aacaccgcatccggctatgtgcttacgttcccctcg

SEQ ID NO: 131303 - DNA, 35 bp, Artificial Sequence
  Synthetic oligonucleotide
aacctccgccccgcataccattttaagacatctat

SEQ ID NO: 131304 - DNA, 35 bp, Artificial Sequence
  Synthetic oligonucleotide
tcatacagcgatccagtcgctccgctgcaccttct

SEQ ID NO: 131305 - DNA, 35 bp, Artificial Sequence
  Synthetic oligonucleotide
attagcaccgtgcagtctccgcccacacctgcctt

SEQ ID NO: 131306 - DNA, 36 bp, Artificial Sequence
  Synthetic oligonucleotide
aacgatcgacgggagggaagggcggtatggatgtaa

SEQ ID NO: 131307 - DNA, 36 bp, Artificial Sequence
  Synthetic oligonucleotide
gatgaccgccttcccgctactgtcaaggaacccaca

SEQ ID NO: 131308 - DNA, 37 bp, Artificial Sequence
  Synthetic oligonucleotide
gaagggtgagtcacgagggacgggtagcacgggggga

SEQ ID NO: 131309 - DNA, 36 bp, Artificial Sequence
  Synthetic oligonucleotide
tgtagggggatggagcgggagggccattgtggggga

SEQ ID NO: 131310 - DNA, 37 bp, Artificial Sequence
  Synthetic oligonucleotide
gccccccaccccagttgtacttgcgctaactcctgga

SEQ ID NO: 131311 - DNA, 38 bp, Artificial Sequence
  Synthetic oligonucleotide
gcccctcacatcgggtacgtactcctccatcttattga

SEQ ID NO: 131312 - DNA, 35 bp, Artificial Sequence
  Synthetic oligonucleotide
tcatccgacctgaatgctaccctacgcccacggta

SEQ ID NO: 131313 - DNA, 35 bp, Artificial Sequence
  Synthetic oligonucleotide
gtgcacaccgcatacggctctagtgcctgccccgc

SEQ ID NO: 131314 - DNA, 35 bp, Artificial Sequence
  Synthetic oligonucleotide
attgaccctgcccgagaacgcaagaaccatgcctc

SEQ ID NO: 131315 - DNA, 35 bp, Artificial Sequence
  Synthetic oligonucleotide
tagaacgtccgccctcgtaatgcccttccgcgttc

SEQ ID NO: 131316 - DNA, 35 bp, Artificial Sequence
  Synthetic oligonucleotide
aaccacccctcacccgtaggcatcccatgctgagg

SEQ ID NO: 131317 - DNA, 35 bp, Artificial Sequence
  Synthetic oligonucleotide
ttacacggcgcatatcccctcttggttccacctgg

SEQ ID NO: 131318 - DNA, 35 bp, Artificial Sequence
  Synthetic oligonucleotide
agtatgccagtgctgctcccttatgtacttcgcat

SEQ ID NO: 131319 - DNA, 35 bp, Artificial Sequence
  Synthetic oligonucleotide
gtcacgtctagtacctcctgccgcatccccctcat

SEQ ID NO: 131320 - DNA, 35 bp, Artificial Sequence
  Synthetic oligonucleotide
gacgaccccggcccgccttccctctgggcttctat

SEQ ID NO: 131321 - DNA, 35 bp, Artificial Sequence
  Synthetic oligonucleotide
gcaaggccacattggcgccccacccatcgatacct

SEQ ID NO: 131322 - DNA, 30 bp, Artificial Sequence
  Synthetic oligonucleotide
aaacaccccccccgccggacccatactcaa

SEQ ID NO: 131323 - DNA, 36 bp, Artificial Sequence
  Synthetic oligonucleotide
tgtccctcaacccctatgtcgtcccgccggtgccca

SEQ ID NO: 131324 - DNA, 37 bp, Artificial Sequence
  Synthetic oligonucleotide
gtctcgcacccatgataatctgtccacctttccccga

SEQ ID NO: 131325 - DNA, 37 bp, Artificial Sequence
  Synthetic oligonucleotide
tacactgtcgggggggaacgggcgggtgacaatgcga

SEQ ID NO: 131326 - DNA, 37 bp, Artificial Sequence
  Synthetic oligonucleotide
gttggggtgggagggcccttttcgtgagagccgggga

SEQ ID NO: 131327 - DNA, 35 bp, Artificial Sequence
  Synthetic oligonucleotide
gggggaaagaatcgtgggaaagggagggggactga

SEQ ID NO: 131328 - DNA, 38 bp, Artificial Sequence
  Synthetic oligonucleotide
gcacccctccccgccgctaaaagtacgcccccgcttga

SEQ ID NO: 131329 - DNA, 36 bp, Artificial Sequence
  Synthetic oligonucleotide
agtacgcacacatctgctcgccgccctcggccacta

SEQ ID NO: 131330 - DNA, 34 bp, Artificial Sequence
  Synthetic oligonucleotide
tagtcgccccacctacgagttaccaagctactac

SEQ ID NO: 131331 - DNA, 35 bp, Artificial Sequence
  Synthetic oligonucleotide
gtgcttccccgctctgccgcacgttggtaaccccc

SEQ ID NO: 131332 - DNA, 35 bp, Artificial Sequence
  Synthetic oligonucleotide
acttaccgaacgaaggttagccaactgccccctcc

SEQ ID NO: 131333 - DNA, 35 bp, Artificial Sequence
  Synthetic oligonucleotide
ggaacatgtctccttctccgtcactcctactaggc

SEQ ID NO: 131334 - DNA, 35 bp, Artificial Sequence
  Synthetic oligonucleotide
gcacttcacactgccttttccagccaactggcctc

SEQ ID NO: 131335 - DNA, 35 bp, Artificial Sequence
  Synthetic oligonucleotide
gccccccttccgtttggggtttgtaccgctatctc

SEQ ID NO: 131336 - DNA, 35 bp, Artificial Sequence
  Synthetic oligonucleotide
tccagagtgcgaattgcacggcactttaccttctc

SEQ ID NO: 131337 - DNA, 35 bp, Artificial Sequence
  Synthetic oligonucleotide
tgcccctgggtatctgcgtctttcccccgcacccg

SEQ ID NO: 131338 - DNA, 35 bp, Artificial Sequence
  Synthetic oligonucleotide
tgccacaacccatcttggtccttaccgccgcttgg

SEQ ID NO: 131339 - DNA, 35 bp, Artificial Sequence
  Synthetic oligonucleotide
acacacttgcatcatcgctctcctcctttagcttg

SEQ ID NO: 131340 - DNA, 35 bp, Artificial Sequence
  Synthetic oligonucleotide
gcgctctgtcccacgcatgctacctttgcctccat

SEQ ID NO: 131341 - DNA, 35 bp, Artificial Sequence
  Synthetic oligonucleotide
tcgcccctgtcgccataccgtacttctctcatcct

SEQ ID NO: 131342 - DNA, 38 bp, Artificial Sequence
  Synthetic oligonucleotide
gaacgacgcccgccacattattttgccatctttgttga

SEQ ID NO: 131343 - DNA, 35 bp, Artificial Sequence
  Synthetic oligonucleotide
gccccctgccggtcatttctacatgcttacaacac

SEQ ID NO: 131344 - DNA, 35 bp, Artificial Sequence
  Synthetic oligonucleotide
taagtccgacgccctgcacgctccattctttgccc

SEQ ID NO: 131345 - DNA, 35 bp, Artificial Sequence
  Synthetic oligonucleotide
gctatggcccggccccaccccaacattttggatcc

SEQ ID NO: 131346 - DNA, 35 bp, Artificial Sequence
  Synthetic oligonucleotide
acgtgcctggtctggtatctcccccgtgtcattcg

SEQ ID NO: 131347 - DNA, 36 bp, Artificial Sequence
  Synthetic oligonucleotide
acatgaatgcgagggagggtgggtaggatgagaggg

SEQ ID NO: 131348 - DNA, 35 bp, Artificial Sequence
  Synthetic oligonucleotide
gtgcaggggtagggcgggggtagaggtgaagcgtg

SEQ ID NO: 131349 - DNA, 35 bp, Artificial Sequence
  Synthetic oligonucleotide
gccatcacctgagtagtaaccacacccattcacct

SEQ ID NO: 131350 - DNA, 35 bp, Artificial Sequence
  Synthetic oligonucleotide
ttgtcatgaccgcctgaatctgcgatctttcccct

SEQ ID NO: 131351 - DNA, 35 bp, Artificial Sequence
  Synthetic oligonucleotide
gccgcaaccgcctaactgttccgggcccatctctt

SEQ ID NO: 131352 - DNA, 36 bp, Artificial Sequence
  Synthetic oligonucleotide
gggggtcgggaggaggggagagcggaccggcgataa

SEQ ID NO: 131353 - DNA, 36 bp, Artificial Sequence
  Synthetic oligonucleotide
tccacctactacctccctagcctgttcgcttgcaca

SEQ ID NO: 131354 - DNA, 35 bp, Artificial Sequence
  Synthetic oligonucleotide
agccaccctgttcttgtcttggtacgccatctaca

SEQ ID NO: 131355 - DNA, 36 bp, Artificial Sequence
  Synthetic oligonucleotide
ttcacccccgcgcactccacctttgcatatcggcca

SEQ ID NO: 131356 - DNA, 36 bp, Artificial Sequence
  Synthetic oligonucleotide
acccctcctccatccagcacagtcgctggcaacgca

SEQ ID NO: 131357 - DNA, 37 bp, Artificial Sequence
  Synthetic oligonucleotide
atgtgtgagacggtgggggcataaaggtggaacgaga

SEQ ID NO: 131358 - DNA, 37 bp, Artificial Sequence
  Synthetic oligonucleotide
gtcacacgctccaccgctcttggaaactgctcttcga

SEQ ID NO: 131359 - DNA, 36 bp, Artificial Sequence
  Synthetic oligonucleotide
ttgttccccgccactctattgtaacgtcactccgga

SEQ ID NO: 131360 - DNA, 38 bp, Artificial Sequence
  Synthetic oligonucleotide
gcaccctcctgctcgtaacaccatgcctcgttcaatga

SEQ ID NO: 131361 - DNA, 35 bp, Artificial Sequence
  Synthetic oligonucleotide
tgcgatccccgcacgggaccaccccccccatctga

SEQ ID NO: 131362 - DNA, 38 bp, Artificial Sequence
  Synthetic oligonucleotide
tggtcggggcggaggaggcaggggtggagcggaggtga

SEQ ID NO: 131363 - DNA, 38 bp, Artificial Sequence
  Synthetic oligonucleotide
gtgcagaaaggaggaccatggagaggtgagggcggtga

SEQ ID NO: 131364 - DNA, 35 bp, Artificial Sequence
  Synthetic oligonucleotide
aatgttcgcctttgcctttcgacgagtttacaccc

SEQ ID NO: 131365 - DNA, 35 bp, Artificial Sequence
  Synthetic oligonucleotide
gtgcccctccctcaatcattccccggtggtgcccc

SEQ ID NO: 131366 - DNA, 35 bp, Artificial Sequence
  Synthetic oligonucleotide
tgaagcgaatccgccctctgttttcccgtgtcctc

SEQ ID NO: 131367 - DNA, 35 bp, Artificial Sequence
  Synthetic oligonucleotide
gtccccagaggaatcccatctccgctcttcaattc

SEQ ID NO: 131368 - DNA, 35 bp, Artificial Sequence
  Synthetic oligonucleotide
tcccccctcgccacctgagacccccgcttttcggg

SEQ ID NO: 131369 - DNA, 35 bp, Artificial Sequence
  Synthetic oligonucleotide
taacgcccacccgtcccctcccatcgaactttatg

SEQ ID NO: 131370 - DNA, 35 bp, Artificial Sequence
  Synthetic oligonucleotide
tgcacccccgcttccttagagaaccttctcgcact

SEQ ID NO: 131371 - DNA, 35 bp, Artificial Sequence
  Synthetic oligonucleotide
gtgccactccgctcccctccgtgcaacgctgtgct

SEQ ID NO: 131372 - DNA, 35 bp, Artificial Sequence
  Synthetic oligonucleotide
atacgcccgtagcagttgctcatcctgcctcctgt

SEQ ID NO: 131373 - DNA, 34 bp, Artificial Sequence
  Synthetic oligonucleotide
ggacccgcctggcccctacacatagaccaacctt

SEQ ID NO: 131374 - DNA, 35 bp, Artificial Sequence
  Synthetic oligonucleotide
tgtgccaccgcccggttcgtccgccgcctttccca

SEQ ID NO: 131375 - DNA, 35 bp, Artificial Sequence
  Synthetic oligonucleotide
tccctcttgcaggctccccgtacccctctgtgcca

SEQ ID NO: 131376 - DNA, 35 bp, Artificial Sequence
  Synthetic oligonucleotide
acgcccttcctgtgcgactaaatcccgacccctca

SEQ ID NO: 131377 - DNA, 36 bp, Artificial Sequence
  Synthetic oligonucleotide
gttgacgctccccgacctgcttgggtacacctctca

SEQ ID NO: 131378 - DNA, 36 bp, Artificial Sequence
  Synthetic oligonucleotide
tactccccgcctccgttggtgccttaatgtcattca

SEQ ID NO: 131379 - DNA, 38 bp, Artificial Sequence
  Synthetic oligonucleotide
tgtgcccttcatgtatgtcagcccgcccccctcgtaga

SEQ ID NO: 131380 - DNA, 37 bp, Artificial Sequence
  Synthetic oligonucleotide
gtctccaccgcactggccctctcttccgttcacagga

SEQ ID NO: 131381 - DNA, 37 bp, Artificial Sequence
  Synthetic oligonucleotide
accgctcccacccaagctctgtctccgtactaacgga

SEQ ID NO: 131382 - DNA, 38 bp, Artificial Sequence
  Synthetic oligonucleotide
gggaggaagggatagaagggaatagggtacggagatga

SEQ ID NO: 131383 - DNA, 36 bp, Artificial Sequence
  Synthetic oligonucleotide
ggactggggggggtagggtgagggtgaacgtcctga

SEQ ID NO: 131384 - DNA, 37 bp, Artificial Sequence
  Synthetic oligonucleotide
gcctcgcccctccgaattatgcctgtcgctgttctga

SEQ ID NO: 131385 - DNA, 35 bp, Artificial Sequence
  Synthetic oligonucleotide
gtccatcgctgcagtctgtttccgcaccccaccta

SEQ ID NO: 131386 - DNA, 36 bp, Artificial Sequence
  Synthetic oligonucleotide
gactccgtcatggccgatccaccgccgttgcccgta

SEQ ID NO: 131387 - DNA, 35 bp, Artificial Sequence
  Synthetic oligonucleotide
gacaccgcggatactgcgccgccgctgcctcaccc

SEQ ID NO: 131388 - DNA, 35 bp, Artificial Sequence
  Synthetic oligonucleotide
gcgacctcgctgcacgcactctcttactggtggcc

SEQ ID NO: 131389 - DNA, 35 bp, Artificial Sequence
  Synthetic oligonucleotide
accgccccctcagtttttaaattgcccgtggatcc

SEQ ID NO: 131390 - DNA, 35 bp, Artificial Sequence
  Synthetic oligonucleotide
gccccgactccctcacctcttggctggtaacagtc

SEQ ID NO: 131391 - DNA, 35 bp, Artificial Sequence
  Synthetic oligonucleotide
gcgttaggtcccgcctgcctctcattgttactgcg

SEQ ID NO: 131392 - DNA, 35 bp, Artificial Sequence
  Synthetic oligonucleotide
aacccaccagtcagccataaaccttgcctccgttg

SEQ ID NO: 131393 - DNA, 35 bp, Artificial Sequence
  Synthetic oligonucleotide
gactgtccccgcactatgattccctaccttgtaca

SEQ ID NO: 131394 - DNA, 37 bp, Artificial Sequence
  Synthetic oligonucleotide
tcgacctacccctcttgattttcgtgtcaatctccga

SEQ ID NO: 131395 - DNA, 37 bp, Artificial Sequence
  Synthetic oligonucleotide
tgccccaaccgactacccatgctacccgtccctagga

SEQ ID NO: 131396 - DNA, 37 bp, Artificial Sequence
  Synthetic oligonucleotide
agagacgtatagagggggtggtggtggcgtgaaatga

SEQ ID NO: 131397 - DNA, 35 bp, Artificial Sequence
  Synthetic oligonucleotide
gacactccatgtttaatgcccgtaccctggtccac

SEQ ID NO: 131398 - DNA, 35 bp, Artificial Sequence
  Synthetic oligonucleotide
tgaccgtgcctttcctctacccttcgtcccgagcc

SEQ ID NO: 131399 - DNA, 35 bp, Artificial Sequence
  Synthetic oligonucleotide
gaccagacacagccattgttcgcctctcccgtgcc

SEQ ID NO: 131400 - DNA, 34 bp, Artificial Sequence
  Synthetic oligonucleotide
atctcatcacaggccccccgcgctagctctgcct

SEQ ID NO: 131401 - DNA, 35 bp, Artificial Sequence
  Synthetic oligonucleotide
aacaagcgcttggtgtccgccttactgcctctcct

SEQ ID NO: 131402 - DNA, 35 bp, Artificial Sequence
  Synthetic oligonucleotide
atcgtaggccgtcacgcaacaccgtccagccttct

SEQ ID NO: 131403 - DNA, 35 bp, Artificial Sequence
  Synthetic oligonucleotide
tagctgcctctatctgttcccgtttggtcatcctt

SEQ ID NO: 131404 - DNA, 36 bp, Artificial Sequence
  Synthetic oligonucleotide
tgacatcaggcctcgctgccccgtacatccgcccca

SEQ ID NO: 131405 - DNA, 35 bp, Artificial Sequence
  Synthetic oligonucleotide
gttcacctgccctaacgagttttttcgcctctcta

SEQ ID NO: 131406 - DNA, 35 bp, Artificial Sequence
  Synthetic oligonucleotide
agacatcgacaggtacatccccgtgaccgccgccc

SEQ ID NO: 131407 - DNA, 35 bp, Artificial Sequence
  Synthetic oligonucleotide
tatgccgatgtacattgtttatccgctgtcctgcc

SEQ ID NO: 131408 - DNA, 35 bp, Artificial Sequence
  Synthetic oligonucleotide
atgcacctcccatatccagtccacggtcccaacgc

SEQ ID NO: 131409 - DNA, 35 bp, Artificial Sequence
  Synthetic oligonucleotide
tttcacccatttcgtttagcctgcctgtgccacgc

SEQ ID NO: 131410 - DNA, 34 bp, Artificial Sequence
  Synthetic oligonucleotide
gaagcaaatgtgccgcccctctcctagtgtctgc

SEQ ID NO: 131411 - DNA, 35 bp, Artificial Sequence
  Synthetic oligonucleotide
gccggaaggacgactgctgactaccacctaccttc

SEQ ID NO: 131412 - DNA, 35 bp, Artificial Sequence
  Synthetic oligonucleotide
gcctctcgcactgaaagtaggcccccccactcccg

SEQ ID NO: 131413 - DNA, 35 bp, Artificial Sequence
  Synthetic oligonucleotide
tcacccaccccatcacgtccttaatgcacctaatg

SEQ ID NO: 131414 - DNA, 35 bp, Artificial Sequence
  Synthetic oligonucleotide
tcactcctccatgcgctattttaccattgttccat

SEQ ID NO: 131415 - DNA, 35 bp, Artificial Sequence
  Synthetic oligonucleotide
gccacacccctcccacagcatatcgactttagcat

SEQ ID NO: 131416 - DNA, 35 bp, Artificial Sequence
  Synthetic oligonucleotide
tgggctcccctcgatgtcaatggtcctcgttctct

SEQ ID NO: 131417 - DNA, 36 bp, Artificial Sequence
  Synthetic oligonucleotide
atggagaggggtaacatcatgcgggggactggggaa

SEQ ID NO: 131418 - DNA, 36 bp, Artificial Sequence
  Synthetic oligonucleotide
tgcggggtgggcgggaatagagctgccgcgggataa

SEQ ID NO: 131419 - DNA, 35 bp, Artificial Sequence
  Synthetic oligonucleotide
ttcgctcacctcaccttttattgcgtctccctgca

SEQ ID NO: 131420 - DNA, 36 bp, Artificial Sequence
  Synthetic oligonucleotide
gcctccatgtccagccctttattgatgcacctttca

SEQ ID NO: 131421 - DNA, 37 bp, Artificial Sequence
  Synthetic oligonucleotide
gaatcgcaatggagggacggggcgggggactgtgaga

SEQ ID NO: 131422 - DNA, 37 bp, Artificial Sequence
  Synthetic oligonucleotide
tcctccgccccgccgagctctttagttcactatccga

SEQ ID NO: 131423 - DNA, 36 bp, Artificial Sequence
  Synthetic oligonucleotide
ggatggacgagggagaaaaacgggaaagaagatcga

SEQ ID NO: 131424 - DNA, 37 bp, Artificial Sequence
  Synthetic oligonucleotide
ttacacggatcggaggaggggggcagttgtaggggga

SEQ ID NO: 131425 - DNA, 36 bp, Artificial Sequence
  Synthetic oligonucleotide
tccgcccgccaacgcctaacacctttactccctgga

SEQ ID NO: 131426 - DNA, 38 bp, Artificial Sequence
  Synthetic oligonucleotide
taacagccacagtgcctacgttccgaaccacctcttga

SEQ ID NO: 131427 - DNA, 38 bp, Artificial Sequence
  Synthetic oligonucleotide
tgagctcgtcaccctcttcatagcctgttctcgtttga

SEQ ID NO: 131428 - DNA, 35 bp, Artificial Sequence
  Synthetic oligonucleotide
accctgtgttcggccccatatgcccttccttcgta

SEQ ID NO: 131429 - DNA, 35 bp, Artificial Sequence
  Synthetic oligonucleotide
aactgcgcctccctctatgtttcgcctgcatccac

SEQ ID NO: 131430 - DNA, 35 bp, Artificial Sequence
  Synthetic oligonucleotide
aacgagcaagggggggcgggaaagacggcgtagcc

SEQ ID NO: 131431 - DNA, 35 bp, Artificial Sequence
  Synthetic oligonucleotide
gccctccgaccaactatgcaaatgggtcctgctcc

SEQ ID NO: 131432 - DNA, 35 bp, Artificial Sequence
  Synthetic oligonucleotide
gtcccaccagtgctgcgacacttatcacaccttgc

SEQ ID NO: 131433 - DNA, 35 bp, Artificial Sequence
  Synthetic oligonucleotide
acgatcccccagttgccttgccgcccttacaggtc

SEQ ID NO: 131434 - DNA, 35 bp, Artificial Sequence
  Synthetic oligonucleotide
acgctccctacagcagtcctcacactaccccgccg

SEQ ID NO: 131435 - DNA, 35 bp, Artificial Sequence
  Synthetic oligonucleotide
atcccaccctggtgcacatcaccgccggacccttt

SEQ ID NO: 131436 - DNA, 35 bp, Artificial Sequence
  Synthetic oligonucleotide
tcctccatccgtgcgttgctctctctcgcagcttt

SEQ ID NO: 131437 - DNA, 36 bp, Artificial Sequence
  Synthetic oligonucleotide
atacacccttccccactgtgttctatggtttgtgga

SEQ ID NO: 131438 - DNA, 33 bp, Artificial Sequence
  Synthetic oligonucleotide
gccgaccgcagttctactttcatggtcccacta

SEQ ID NO: 131439 - DNA, 36 bp, Artificial Sequence
  Synthetic oligonucleotide
aagtccccgccgctggcccacgccaatactgtccta

SEQ ID NO: 131440 - DNA, 35 bp, Artificial Sequence
  Synthetic oligonucleotide
tgcatgagtgcctcgttctgtcccttatcgccgta

SEQ ID NO: 131441 - DNA, 35 bp, Artificial Sequence
  Synthetic oligonucleotide
gttcgccccctcgcatccaaagacctggatcatta

SEQ ID NO: 131442 - DNA, 35 bp, Artificial Sequence
  Synthetic oligonucleotide
acgcctcaccgctcactctatcgggtttgttaccc

SEQ ID NO: 131443 - DNA, 35 bp, Artificial Sequence
  Synthetic oligonucleotide
tacccccaccgtactccagtctatcatggacatcc

SEQ ID NO: 131444 - DNA, 35 bp, Artificial Sequence
  Synthetic oligonucleotide
tgtgcttcactccttacgtgcatcttcctgcctcc

SEQ ID NO: 131445 - DNA, 35 bp, Artificial Sequence
  Synthetic oligonucleotide
gcgaagccccttagactcgctttgctcttgacctc

SEQ ID NO: 131446 - DNA, 35 bp, Artificial Sequence
  Synthetic oligonucleotide
gcgctcgaagcacggccggtaccttgatccccctc

SEQ ID NO: 131447 - DNA, 34 bp, Artificial Sequence
  Synthetic oligonucleotide
ggagggtagggtggttcgtacaggggggggggcg

SEQ ID NO: 131448 - DNA, 35 bp, Artificial Sequence
  Synthetic oligonucleotide
agtgacaacacgtgagggggcgggaaaaaagaggg

SEQ ID NO: 131449 - DNA, 35 bp, Artificial Sequence
  Synthetic oligonucleotide
atgctcatgccgccttcggtattaccatccttcct

SEQ ID NO: 131450 - DNA, 35 bp, Artificial Sequence
  Synthetic oligonucleotide
tgagacgtgcgttactgccatcacctctctatgtt

SEQ ID NO: 131451 - DNA, 35 bp, Artificial Sequence
  Synthetic oligonucleotide
gatcacatcagtgctgtcaccttcccatacgcttt

SEQ ID NO: 131452 - DNA, 35 bp, Artificial Sequence
  Synthetic oligonucleotide
acgggtcgaaggagaggggagggatgccgggaaaa

SEQ ID NO: 131453 - DNA, 36 bp, Artificial Sequence
  Synthetic oligonucleotide
tctgagcaccgccaccccggaccctcttaagcacca

SEQ ID NO: 131454 - DNA, 36 bp, Artificial Sequence
  Synthetic oligonucleotide
tccctccgcaatcctcgtaccttgtctgccagacga

SEQ ID NO: 131455 - DNA, 37 bp, Artificial Sequence
  Synthetic oligonucleotide
ataccgccagagcgttgtatgtccgccccccttacga

SEQ ID NO: 131456 - DNA, 35 bp, Artificial Sequence
  Synthetic oligonucleotide
gagctgggacgagagcaggatagcaagggggggga

SEQ ID NO: 131457 - DNA, 38 bp, Artificial Sequence
  Synthetic oligonucleotide
gcccccactggtgttcctgtcctctccttcgaacctga

SEQ ID NO: 131458 - DNA, 36 bp, Artificial Sequence
  Synthetic oligonucleotide
taccctcatctccgcctggcaccatttatcgtgcta

SEQ ID NO: 131459 - DNA, 35 bp, Artificial Sequence
  Synthetic oligonucleotide
acaacctcccctgacctaggtgcccatacattgcc

SEQ ID NO: 131460 - DNA, 35 bp, Artificial Sequence
  Synthetic oligonucleotide
tgccctgcctatcgtttggttggcttcgctcctcc

SEQ ID NO: 131461 - DNA, 35 bp, Artificial Sequence
  Synthetic oligonucleotide
atctgtccacgcctatgacaccctctataactcgc

SEQ ID NO: 131462 - DNA, 35 bp, Artificial Sequence
  Synthetic oligonucleotide
gtaaccgcaacccgcttagcccccccgaccgtctc

SEQ ID NO: 131463 - DNA, 35 bp, Artificial Sequence
  Synthetic oligonucleotide
acccttgccgccttcgattgccgtcctacaccacg

SEQ ID NO: 131464 - DNA, 35 bp, Artificial Sequence
  Synthetic oligonucleotide
ctcgtcctcgtagccccctagtcactctgtcgccg

SEQ ID NO: 131465 - DNA, 35 bp, Artificial Sequence
  Synthetic oligonucleotide
tagacgtcggccctgatatccccgttcccttgtgg

SEQ ID NO: 131466 - DNA, 35 bp, Artificial Sequence
  Synthetic oligonucleotide
ttccgccggcattctacagacaccttcccgtcctg

SEQ ID NO: 131467 - DNA, 35 bp, Artificial Sequence
  Synthetic oligonucleotide
ccgaacctaccccaggtgcgtaccctgccactcct

SEQ ID NO: 131468 - DNA, 35 bp, Artificial Sequence
  Synthetic oligonucleotide
tgcgatccgcacccagggctatgtcccgccactct

SEQ ID NO: 131469 - DNA, 35 bp, Artificial Sequence
  Synthetic oligonucleotide
tatccgcctcacctgctctgggccgcacctcgctt

SEQ ID NO: 131470 - DNA, 35 bp, Artificial Sequence
  Synthetic oligonucleotide
ttccggagccccctctttgccgccaaccctttgtt

SEQ ID NO: 131471 - DNA, 37 bp, Artificial Sequence
  Synthetic oligonucleotide
agtacaaggcagagagggacggcgggcggagtggaaa

SEQ ID NO: 131472 - DNA, 36 bp, Artificial Sequence
  Synthetic oligonucleotide
tggtggaggaaggcaaagaagggcactgggatcgaa

SEQ ID NO: 131473 - DNA, 36 bp, Artificial Sequence
  Synthetic oligonucleotide
gccccccccgctttgttctaccttcggcaagctcca

SEQ ID NO: 131474 - DNA, 37 bp, Artificial Sequence
  Synthetic oligonucleotide
atagagaccggaaggtggggcggacgtcggagaggga

SEQ ID NO: 131475 - DNA, 37 bp, Artificial Sequence
  Synthetic oligonucleotide
caggggttatcttgggtggggtatggtcagttgggga

SEQ ID NO: 131476 - DNA, 37 bp, Artificial Sequence
  Synthetic oligonucleotide
tactacgcctaatcttgttcaactggtccacccctga

SEQ ID NO: 131477 - DNA, 37 bp, Artificial Sequence
  Synthetic oligonucleotide
aacccaacgccccgttgctaggaagtcccgcccttga

SEQ ID NO: 131478 - DNA, 34 bp, Artificial Sequence
  Synthetic oligonucleotide
gtagcccctcccgttcgttaacagtcctttcata

SEQ ID NO: 131479 - DNA, 36 bp, Artificial Sequence
  Synthetic oligonucleotide
tacccacctgtccacgcttaataagccgatctcgta

SEQ ID NO: 131480 - DNA, 35 bp, Artificial Sequence
  Synthetic oligonucleotide
tctcgccacctatcgttgctttaccatagaccgac

SEQ ID NO: 131481 - DNA, 35 bp, Artificial Sequence
  Synthetic oligonucleotide
gcatgcccacttccccagtgacttgctttgacccc

SEQ ID NO: 131482 - DNA, 35 bp, Artificial Sequence
  Synthetic oligonucleotide
tcctcacccttcgcccatgacgtctttcagtgccc

SEQ ID NO: 131483 - DNA, 35 bp, Artificial Sequence
  Synthetic oligonucleotide
acgcccgaaattctgaacccgtccctcccttggcc

SEQ ID NO: 131484 - DNA, 35 bp, Artificial Sequence
  Synthetic oligonucleotide
gaggtgcgccgagtcatctacgtcctctccactcc

SEQ ID NO: 131485 - DNA, 35 bp, Artificial Sequence
  Synthetic oligonucleotide
tactgctaacgccctcccctggttgatcctctcgc

SEQ ID NO: 131486 - DNA, 35 bp, Artificial Sequence
  Synthetic oligonucleotide
acagcggtcgcgccaccgttccgcccgtccccgtc

SEQ ID NO: 131487 - DNA, 35 bp, Artificial Sequence
  Synthetic oligonucleotide
ttcaccactcgacgttctccacatttgcctgggtc

SEQ ID NO: 131488 - DNA, 35 bp, Artificial Sequence
  Synthetic oligonucleotide
acacctcccgtcatagcacactctcgatgctcccg

SEQ ID NO: 131489 - DNA, 35 bp, Artificial Sequence
  Synthetic oligonucleotide
tcaacaatgtccaccggcgccccgttccccccagg

SEQ ID NO: 131490 - DNA, 35 bp, Artificial Sequence
  Synthetic oligonucleotide
atcactcagagcttgagcgccttttcatctgccct

SEQ ID NO: 131491 - DNA, 35 bp, Artificial Sequence
  Synthetic oligonucleotide
agtatcgcagacgaactccgcctccgtccgacctt

SEQ ID NO: 131492 - DNA, 38 bp, Artificial Sequence
  Synthetic oligonucleotide
atagcgccctccgatcgccctgaattctgcctttttga

SEQ ID NO: 131493 - DNA, 35 bp, Artificial Sequence
  Synthetic oligonucleotide
gtgtctcacatcgctctttcgcccgcacttatgcc

SEQ ID NO: 131494 - DNA, 35 bp, Artificial Sequence
  Synthetic oligonucleotide
gtgtagtgccatggtcttgttcgccccaagcttcc

SEQ ID NO: 131495 - DNA, 35 bp, Artificial Sequence
  Synthetic oligonucleotide
gtccatccgttgggtagcactccattcattcccgc

SEQ ID NO: 131496 - DNA, 35 bp, Artificial Sequence
  Synthetic oligonucleotide
tccgctctggttatcgccgctggtttccctcttgc

SEQ ID NO: 131497 - DNA, 35 bp, Artificial Sequence
  Synthetic oligonucleotide
accaggacgttggtctgccagtttcctccgttatc

SEQ ID NO: 131498 - DNA, 35 bp, Artificial Sequence
  Synthetic oligonucleotide
gtctccacgtaggttcttgtgccggtgttactctc

SEQ ID NO: 131499 - DNA, 35 bp, Artificial Sequence
  Synthetic oligonucleotide
acgacctgacctccccgttctgacactcgaattcg

SEQ ID NO: 131500 - DNA, 35 bp, Artificial Sequence
  Synthetic oligonucleotide
acgccatccgtcctctttctccagtcttctctctg

SEQ ID NO: 131501 - DNA, 35 bp, Artificial Sequence
  Synthetic oligonucleotide
tgactcagtcgtcatcctctgctagttcatgtcct

SEQ ID NO: 131502 - DNA, 35 bp, Artificial Sequence
  Synthetic oligonucleotide
tagccagatcccgtccgtccgtgtccgcccctgct

SEQ ID NO: 131503 - DNA, 35 bp, Artificial Sequence
  Synthetic oligonucleotide
gcgccccccccgcttgtaacctaccccacgtccgt

SEQ ID NO: 131504 - DNA, 35 bp, Artificial Sequence
  Synthetic oligonucleotide
agagtggggagagaggaaggggaatgcgagtttgt

SEQ ID NO: 131505 - DNA, 36 bp, Artificial Sequence
  Synthetic oligonucleotide
accccactcgttcgagctcttgttctttgtacccaa

SEQ ID NO: 131506 - DNA, 36 bp, Artificial Sequence
  Synthetic oligonucleotide
ggtccacgtcagtccgcccctctgtacacgcttcca

SEQ ID NO: 131507 - DNA, 36 bp, Artificial Sequence
  Synthetic oligonucleotide
tgcaaaccccgccctaatgtaatgaccgcccgctca

SEQ ID NO: 131508 - DNA, 35 bp, Artificial Sequence
  Synthetic oligonucleotide
acaaggccgtctcgatccttccccctgcattttca

SEQ ID NO: 131509 - DNA, 35 bp, Artificial Sequence
  Synthetic oligonucleotide
ttgcattgccactcgtatcgtccgctcctttttca

SEQ ID NO: 131510 - DNA, 35 bp, Artificial Sequence
  Synthetic oligonucleotide
tgcacgagaggaagacacaagggggaacagagaga

SEQ ID NO: 131511 - DNA, 37 bp, Artificial Sequence
  Synthetic oligonucleotide
ggaacgatgacgggggagtaggaggagaaggcggaga

SEQ ID NO: 131512 - DNA, 37 bp, Artificial Sequence
  Synthetic oligonucleotide
gccactcgcgattcgtccgccccgcaccatacttcga

SEQ ID NO: 131513 - DNA, 36 bp, Artificial Sequence
  Synthetic oligonucleotide
attgcgagcgggaagtgggaagcgtgggggggagga

SEQ ID NO: 131514 - DNA, 37 bp, Artificial Sequence
  Synthetic oligonucleotide
gaggggggggtggtaggaggcgataccgggcgcggga

SEQ ID NO: 131515 - DNA, 38 bp, Artificial Sequence
  Synthetic oligonucleotide
gatctacctcccatgccattattgcatccataccatga

SEQ ID NO: 131516 - DNA, 37 bp, Artificial Sequence
  Synthetic oligonucleotide
aaaccagcacatctccacactgcttcatcgacactga

SEQ ID NO: 131517 - DNA, 38 bp, Artificial Sequence
  Synthetic oligonucleotide
tcgcgttgtcgtcatcccatgttccgctaccctcctga

SEQ ID NO: 131518 - DNA, 38 bp, Artificial Sequence
  Synthetic oligonucleotide
ggtgaaagccgaggaaaagggagtgagggcgcgggtga

SEQ ID NO: 131519 - DNA, 37 bp, Artificial Sequence
  Synthetic oligonucleotide
gacccaccacctgtacaatatgctccatacactttga

SEQ ID NO: 131520 - DNA, 35 bp, Artificial Sequence
  Synthetic oligonucleotide
gctacccccgcgcatgtagcatctcctacctcgta

SEQ ID NO: 131521 - DNA, 37 bp, Artificial Sequence
  Synthetic oligonucleotide
aaagcacaaggggtagaggaggaagaaaaaagaggta

SEQ ID NO: 131522 - DNA, 36 bp, Artificial Sequence
  Synthetic oligonucleotide
aacagagcgtgtgcccccctgcccctgattcttgta

SEQ ID NO: 131523 - DNA, 35 bp, Artificial Sequence
  Synthetic oligonucleotide
tatcacgtctgtccatgctggccgtcccctctcac

SEQ ID NO: 131524 - DNA, 35 bp, Artificial Sequence
  Synthetic oligonucleotide
atccgccctgcgcttcctgcccttcgaacgatacc

SEQ ID NO: 131525 - DNA, 35 bp, Artificial Sequence
  Synthetic oligonucleotide
ttttgcccctggccaatgacgctttaacacacccc

SEQ ID NO: 131526 - DNA, 35 bp, Artificial Sequence
  Synthetic oligonucleotide
tggacacgcaccaccatctaggctgagtccgcccc

SEQ ID NO: 131527 - DNA, 35 bp, Artificial Sequence
  Synthetic oligonucleotide
gccgccgccttttacatctgacttcgtgattcgcc

SEQ ID NO: 131528 - DNA, 35 bp, Artificial Sequence
  Synthetic oligonucleotide
atgtacgccatacctactcccagccttgttattcc

SEQ ID NO: 131529 - DNA, 35 bp, Artificial Sequence
  Synthetic oligonucleotide
gcgtaacctcctgccgacctccgctcccggcttcc

SEQ ID NO: 131530 - DNA, 35 bp, Artificial Sequence
  Synthetic oligonucleotide
ggggtcagtgcctcaatcgtgcccgcccacttctc

SEQ ID NO: 131531 - DNA, 35 bp, Artificial Sequence
  Synthetic oligonucleotide
aacccccagcacgccacgtacttcttcaccacttc

SEQ ID NO: 131532 - DNA, 35 bp, Artificial Sequence
  Synthetic oligonucleotide
gtccccggccaacactgtaacgaatccgtcccttc

SEQ ID NO: 131533 - DNA, 35 bp, Artificial Sequence
  Synthetic oligonucleotide
gtgcccgcccgctgctcccatcacccgcctcccag

SEQ ID NO: 131534 - DNA, 36 bp, Artificial Sequence
  Synthetic oligonucleotide
tgtgcccagcgtttgccctctgccttttgcccctag

SEQ ID NO: 131535 - DNA, 35 bp, Artificial Sequence
  Synthetic oligonucleotide
gtcgcgccacacctgtcctcacctccgggccctcg

SEQ ID NO: 131536 - DNA, 35 bp, Artificial Sequence
  Synthetic oligonucleotide
tatctgggtagggggggagaaaagtagagcagggg

SEQ ID NO: 131537 - DNA, 35 bp, Artificial Sequence
  Synthetic oligonucleotide
gcgtacaagtcgcacctgcattacctgccatcact

SEQ ID NO: 131538 - DNA, 35 bp, Artificial Sequence
  Synthetic oligonucleotide
agcatgccacacgctccgcctacatcccatgcgct

SEQ ID NO: 131539 - DNA, 35 bp, Artificial Sequence
  Synthetic oligonucleotide
atgcggggcatttatgctgtgcgtaccatctctct

SEQ ID NO: 131540 - DNA, 35 bp, Artificial Sequence
  Synthetic oligonucleotide
attgtccctcaggtttgttcacgctcccccaccgt

SEQ ID NO: 131541 - DNA, 35 bp, Artificial Sequence
  Synthetic oligonucleotide
tctggtgctggcgtcgtcactgccatctcgccctt

SEQ ID NO: 131542 - DNA, 37 bp, Artificial Sequence
  Synthetic oligonucleotide
ggacctgctcctaacgctcccgaccgctcccgcccga

SEQ ID NO: 131543 - DNA, 37 bp, Artificial Sequence
  Synthetic oligonucleotide
gaccgacggaggagggagttacgggttgtggtgggga

SEQ ID NO: 131544 - DNA, 37 bp, Artificial Sequence
  Synthetic oligonucleotide
attacgaaggggagggggtgcgagaggtagggctgga

SEQ ID NO: 131545 - DNA, 37 bp, Artificial Sequence
  Synthetic oligonucleotide
gcacagtgggtgggaggggcacgaactgagagggtga

SEQ ID NO: 131546 - DNA, 37 bp, Artificial Sequence
  Synthetic oligonucleotide
tcaaacaccatgtcgtttctattgcctgcccctttga

SEQ ID NO: 131547 - DNA, 36 bp, Artificial Sequence
  Synthetic oligonucleotide
atttcacccctgctgtgtgcctgcattcttcccata

SEQ ID NO: 131548 - DNA, 36 bp, Artificial Sequence
  Synthetic oligonucleotide
atcgcactcccgctcgacctaaattacagtaatgta

SEQ ID NO: 131549 - DNA, 35 bp, Artificial Sequence
  Synthetic oligonucleotide
gcgtacgcccctttaatgtccctgagttacaccac

SEQ ID NO: 131550 - DNA, 35 bp, Artificial Sequence
  Synthetic oligonucleotide
tccacgctcgcaagccttcaacgactccccctgac

SEQ ID NO: 131551 - DNA, 35 bp, Artificial Sequence
  Synthetic oligonucleotide
tttcccccgcccgtgaaggtgctctcctttccacc

SEQ ID NO: 131552 - DNA, 35 bp, Artificial Sequence
  Synthetic oligonucleotide
gaaccgctccgctgttacccctacactgtccaccc

SEQ ID NO: 131553 - DNA, 35 bp, Artificial Sequence
  Synthetic oligonucleotide
accaacaccccccctcgcgatgtgttctccactgc

SEQ ID NO: 131554 - DNA, 35 bp, Artificial Sequence
  Synthetic oligonucleotide
aacgcacgagattcttatgccggtcctcctttctc

SEQ ID NO: 131555 - DNA, 35 bp, Artificial Sequence
  Synthetic oligonucleotide
taccgaccgcccacgggttgaatctctccgacttc

SEQ ID NO: 131556 - DNA, 35 bp, Artificial Sequence
  Synthetic oligonucleotide
ttgcctaggcgctccatggcttcgttctatctttc

SEQ ID NO: 131557 - DNA, 35 bp, Artificial Sequence
  Synthetic oligonucleotide
gtgggcattgcccatgtgcccctcgtcccccctag

SEQ ID NO: 131558 - DNA, 35 bp, Artificial Sequence
  Synthetic oligonucleotide
tgcccatctcgcttttttttaaggccctctacgct

SEQ ID NO: 131559 - DNA, 35 bp, Artificial Sequence
  Synthetic oligonucleotide
accccccgatccgatttcgcgtttgtcactctcaa

SEQ ID NO: 131560 - DNA, 36 bp, Artificial Sequence
  Synthetic oligonucleotide
gtgtcagcagccccgtcgcctgccccttcatggcca

SEQ ID NO: 131561 - DNA, 36 bp, Artificial Sequence
  Synthetic oligonucleotide
tttaacgtctgacgccactcccccgcgcccttggca

SEQ ID NO: 131562 - DNA, 36 bp, Artificial Sequence
  Synthetic oligonucleotide
ttttaccatccgccgtgcctatcgtcctcaactgca

SEQ ID NO: 131563 - DNA, 36 bp, Artificial Sequence
  Synthetic oligonucleotide
tagtcgaaaggcctgggaaggagggagggtgggaga

SEQ ID NO: 131564 - DNA, 36 bp, Artificial Sequence
  Synthetic oligonucleotide
tgcttaccccgacgcttttgtctgctgaccccctga

SEQ ID NO: 131565 - DNA, 36 bp, Artificial Sequence
  Synthetic oligonucleotide
gttccacacccccagcccttcatcagtcggtcttga

SEQ ID NO: 131566 - DNA, 38 bp, Artificial Sequence
  Synthetic oligonucleotide
ggagatgggaagggggggcaagggcacatgcgagttga

SEQ ID NO: 131567 - DNA, 35 bp, Artificial Sequence
  Synthetic oligonucleotide
acatcagttcaccgccgcgctcctacgccgttacc

SEQ ID NO: 131568 - DNA, 35 bp, Artificial Sequence
  Synthetic oligonucleotide
tagtgatccggcaccattcaagtagctccaccccc

SEQ ID NO: 131569 - DNA, 35 bp, Artificial Sequence
  Synthetic oligonucleotide
gtcatccacagctttttgagcctacatatgccttc

SEQ ID NO: 131570 - DNA, 35 bp, Artificial Sequence
  Synthetic oligonucleotide
tcttacaccccgcctactcgaagaggccattcttc

SEQ ID NO: 131571 - DNA, 35 bp, Artificial Sequence
  Synthetic oligonucleotide
agccatacgtacacgaccattccaactctccgccg

SEQ ID NO: 131572 - DNA, 35 bp, Artificial Sequence
  Synthetic oligonucleotide
acccgcagtgcttctagtcgcccccaattctgtcg

SEQ ID NO: 131573 - DNA, 35 bp, Artificial Sequence
  Synthetic oligonucleotide
gtagggcggacgggaggcggggtttaaggcgccat

SEQ ID NO: 131574 - DNA, 35 bp, Artificial Sequence
  Synthetic oligonucleotide
atcgatccccaccactgtgcgcggacttcctttat

SEQ ID NO: 131575 - DNA, 35 bp, Artificial Sequence
  Synthetic oligonucleotide
atgcgcgctcgaagtaattcgtcttcctctctgct

SEQ ID NO: 131576 - DNA, 36 bp, Artificial Sequence
  Synthetic oligonucleotide
tgtcgcaggccctgcccccacattcgtacttgccaa

SEQ ID NO: 131577 - DNA, 35 bp, Artificial Sequence
  Synthetic oligonucleotide
tgaccctggggaccatctgtcgtactaccgcccca

SEQ ID NO: 131578 - DNA, 36 bp, Artificial Sequence
  Synthetic oligonucleotide
atgtcaaacgtccagtgctccaccatccctctctca

SEQ ID NO: 131579 - DNA, 37 bp, Artificial Sequence
  Synthetic oligonucleotide
gttcggggagggaggccaaatggtatgggtaggggga

SEQ ID NO: 131580 - DNA, 34 bp, Artificial Sequence
  Synthetic oligonucleotide
atagccagccgcgatcgccttttgtacctcccac

SEQ ID NO: 131581 - DNA, 35 bp, Artificial Sequence
  Synthetic oligonucleotide
tgcagacgccctgctcagccctatcgcccttagac

SEQ ID NO: 131582 - DNA, 35 bp, Artificial Sequence
  Synthetic oligonucleotide
acgggaacccgccgcctagccctctttgccccgac

SEQ ID NO: 131583 - DNA, 35 bp, Artificial Sequence
  Synthetic oligonucleotide
actccctccactacatgcgctatccgtggctcgac

SEQ ID NO: 131584 - DNA, 35 bp, Artificial Sequence
  Synthetic oligonucleotide
tcgccgttcgctgtctacccgtacttcgcacctac

SEQ ID NO: 131585 - DNA, 35 bp, Artificial Sequence
  Synthetic oligonucleotide
gttacgcgccacgccgtgtaactcgccttgacccc

SEQ ID NO: 131586 - DNA, 35 bp, Artificial Sequence
  Synthetic oligonucleotide
gttccgacccgcgcacttatccatcggcccccccc

SEQ ID NO: 131587 - DNA, 35 bp, Artificial Sequence
  Synthetic oligonucleotide
tacgcctccctctagaagatctgcgaacccgatcc

SEQ ID NO: 131588 - DNA, 35 bp, Artificial Sequence
  Synthetic oligonucleotide
tggagcctccctgctctcgttcgaccatctccttc

SEQ ID NO: 131589 - DNA, 35 bp, Artificial Sequence
  Synthetic oligonucleotide
gttaccctgctgattcgtttggtccttgtccttcg

SEQ ID NO: 131590 - DNA, 35 bp, Artificial Sequence
  Synthetic oligonucleotide
ggtaaccgcccacatgctcacaggtcccctcctat

SEQ ID NO: 131591 - DNA, 35 bp, Artificial Sequence
  Synthetic oligonucleotide
acctgcccaaaccagggatcattgcccactgccct

SEQ ID NO: 131592 - DNA, 35 bp, Artificial Sequence
  Synthetic oligonucleotide
tctgctccccgcactgtacacaaagcccgatactt

SEQ ID NO: 131593 - DNA, 37 bp, Artificial Sequence
  Synthetic oligonucleotide
ggtcaagacgagaggggaggggcaaagatggctcaga

SEQ ID NO: 131594 - DNA, 37 bp, Artificial Sequence
  Synthetic oligonucleotide
gcggatcagcaagaggagggttgggaggtgggaggga

SEQ ID NO: 131595 - DNA, 37 bp, Artificial Sequence
  Synthetic oligonucleotide
accccgctccccccccacagggtcaatcgcttttgga

SEQ ID NO: 131596 - DNA, 38 bp, Artificial Sequence
  Synthetic oligonucleotide
gggaagagggcacgaagggggcagggagcaggtgatga

SEQ ID NO: 131597 - DNA, 38 bp, Artificial Sequence
  Synthetic oligonucleotide
atgggtagggtgggtgcgaggaaggagaggaggtatga

SEQ ID NO: 131598 - DNA, 36 bp, Artificial Sequence
  Synthetic oligonucleotide
gacctcgcttccatgcttgactatccgttacgccta

SEQ ID NO: 131599 - DNA, 35 bp, Artificial Sequence
  Synthetic oligonucleotide
tgtgcatcccgccgcctattgatcgccttctgcac

SEQ ID NO: 131600 - DNA, 35 bp, Artificial Sequence
  Synthetic oligonucleotide
tcccacatagcttgggtcctgcccggaacatcccc

SEQ ID NO: 131601 - DNA, 35 bp, Artificial Sequence
  Synthetic oligonucleotide
gtagcggttccgaccgtcctgtctcattcgttgcc

SEQ ID NO: 131602 - DNA, 35 bp, Artificial Sequence
  Synthetic oligonucleotide
aacagccacacgttctctctcctgtcacttcgtcc

SEQ ID NO: 131603 - DNA, 35 bp, Artificial Sequence
  Synthetic oligonucleotide
taaccaacaatcctgatgcctatctgcaatcacgc

SEQ ID NO: 131604 - DNA, 35 bp, Artificial Sequence
  Synthetic oligonucleotide
ggttccgccccctttctgttactccgcatttgctc

SEQ ID NO: 131605 - DNA, 35 bp, Artificial Sequence
  Synthetic oligonucleotide
tagcgcccctgaactcgtgttcgtcctcctatctc

SEQ ID NO: 131606 - DNA, 35 bp, Artificial Sequence
  Synthetic oligonucleotide
tgccccccgatgccgcaccgcactattcaccgtat

SEQ ID NO: 131607 - DNA, 35 bp, Artificial Sequence
  Synthetic oligonucleotide
atccatctgcctcccccgctgcccgtacatagcct

SEQ ID NO: 131608 - DNA, 35 bp, Artificial Sequence
  Synthetic oligonucleotide
acccgcaatgcgcatgccgtcccccctgatcgtct

SEQ ID NO: 131609 - DNA, 34 bp, Artificial Sequence
  Synthetic oligonucleotide
tatggccactgctcgtattcttccgtcgttccaa

SEQ ID NO: 131610 - DNA, 35 bp, Artificial Sequence
  Synthetic oligonucleotide
gctgcactaagtagggaacgggtatggggggctaa

SEQ ID NO: 131611 - DNA, 36 bp, Artificial Sequence
  Synthetic oligonucleotide
gcgcaccccggcccttctagcttgtagccaccttca

SEQ ID NO: 131612 - DNA, 35 bp, Artificial Sequence
  Synthetic oligonucleotide
atttgcccgcacgtaccgtacatctgctcgtttca

SEQ ID NO: 131613 - DNA, 37 bp, Artificial Sequence
  Synthetic oligonucleotide
gagactgtggcgggacacaaaaggaggaggagaaaga

SEQ ID NO: 131614 - DNA, 35 bp, Artificial Sequence
  Synthetic oligonucleotide
acgtacacgaacaccacgattaccgacctccccga

SEQ ID NO: 131615 - DNA, 37 bp, Artificial Sequence
  Synthetic oligonucleotide
gaaccggagaggacgagggggagcgggggcggtccga

SEQ ID NO: 131616 - DNA, 37 bp, Artificial Sequence
  Synthetic oligonucleotide
tcacgccctcacgtagtcctagccctgtccgttgcga

SEQ ID NO: 131617 - DNA, 35 bp, Artificial Sequence
  Synthetic oligonucleotide
ttgtgtgcgtaccgcccctgttatacacctctcga

SEQ ID NO: 131618 - DNA, 35 bp, Artificial Sequence
  Synthetic oligonucleotide
gtccggtcagtgaacctccgcctcacacctctgga

SEQ ID NO: 131619 - DNA, 38 bp, Artificial Sequence
  Synthetic oligonucleotide
gggtaggaagtaggggaagggaaccgggatgggaatga

SEQ ID NO: 131620 - DNA, 38 bp, Artificial Sequence
  Synthetic oligonucleotide
gtaccgccatccgatcccatttgcctgcatttacatga

SEQ ID NO: 131621 - DNA, 34 bp, Artificial Sequence
  Synthetic oligonucleotide
gagcttgccacaagcttatagccccccaccctga

SEQ ID NO: 131622 - DNA, 38 bp, Artificial Sequence
  Synthetic oligonucleotide
taccccttccagcctgcttttgagccaccggttcctga

SEQ ID NO: 131623 - DNA, 36 bp, Artificial Sequence
  Synthetic oligonucleotide
gcaccctgcacagaccccgcctctctccccctccta

SEQ ID NO: 131624 - DNA, 35 bp, Artificial Sequence
  Synthetic oligonucleotide
tgagcggtcgccgacctatgcgcttacctctccta

SEQ ID NO: 131625 - DNA, 35 bp, Artificial Sequence
  Synthetic oligonucleotide
gatacaccgccatcgagtgcctcgcaccctctacc

SEQ ID NO: 131626 - DNA, 35 bp, Artificial Sequence
  Synthetic oligonucleotide
tagatcccacgtcgagcgtccgtcgcccggtgccc

SEQ ID NO: 131627 - DNA, 35 bp, Artificial Sequence
  Synthetic oligonucleotide
tgaccgcaaaccggaacggtatctgaactcctgcc

SEQ ID NO: 131628 - DNA, 35 bp, Artificial Sequence
  Synthetic oligonucleotide
gtcgtcctcacatcgttttggtcatctaattatcc

SEQ ID NO: 131629 - DNA, 35 bp, Artificial Sequence
  Synthetic oligonucleotide
ttccttccacccgtcccgatcatgcgaataccttc

SEQ ID NO: 131630 - DNA, 35 bp, Artificial Sequence
  Synthetic oligonucleotide
gtcctgctatctgttctccctgccatactagcttc

SEQ ID NO: 131631 - DNA, 35 bp, Artificial Sequence
  Synthetic oligonucleotide
gcctgccacccccctgccatacgtccctgccacag

SEQ ID NO: 131632 - DNA, 35 bp, Artificial Sequence
  Synthetic oligonucleotide
acacgcccgcccatcctctcgtacacaggggaacg

SEQ ID NO: 131633 - DNA, 35 bp, Artificial Sequence
  Synthetic oligonucleotide
gtcaccattgcatgggcccccctcttttctccccg

SEQ ID NO: 131634 - DNA, 35 bp, Artificial Sequence
  Synthetic oligonucleotide
tggatgtcgctcctgccgcgtccgcctactcctcg

SEQ ID NO: 131635 - DNA, 35 bp, Artificial Sequence
  Synthetic oligonucleotide
gtctaccgccccgttctctctccgagtacccttgg

SEQ ID NO: 131636 - DNA, 35 bp, Artificial Sequence
  Synthetic oligonucleotide
ttgcttccccctctgcgtacctcctgctggtaaca

SEQ ID NO: 131637 - DNA, 35 bp, Artificial Sequence
  Synthetic oligonucleotide
tcccctgctcggctcacctgcactaataccagcca

SEQ ID NO: 131638 - DNA, 36 bp, Artificial Sequence
  Synthetic oligonucleotide
gccccgatcctctgcttattgtcgtaccatgcttca

SEQ ID NO: 131639 - DNA, 37 bp, Artificial Sequence
  Synthetic oligonucleotide
atgtagtcgggggccgaggagggaaggtgggagtaga

SEQ ID NO: 131640 - DNA, 35 bp, Artificial Sequence
  Synthetic oligonucleotide
tggaacgaccatcctattttgccctttcgtgccga

SEQ ID NO: 131641 - DNA, 38 bp, Artificial Sequence
  Synthetic oligonucleotide
gagacgccgtgggagggattgggagggtatacggatga

SEQ ID NO: 131642 - DNA, 38 bp, Artificial Sequence
  Synthetic oligonucleotide
gccgcccccctcctgcgttggtttacccccagtcgtga

SEQ ID NO: 131643 - DNA, 37 bp, Artificial Sequence
  Synthetic oligonucleotide
gttgcggcctgcctgctaatgtcgcgcttccccttga

SEQ ID NO: 131644 - DNA, 37 bp, Artificial Sequence
  Synthetic oligonucleotide
accacccgtggcaatcctgttatcacgttccttttga

SEQ ID NO: 131645 - DNA, 36 bp, Artificial Sequence
  Synthetic oligonucleotide
gtgtcaccccgcctctcgcctccgcttactgtgtta

SEQ ID NO: 131646 - DNA, 35 bp, Artificial Sequence
  Synthetic oligonucleotide
gcaagccgtgacgcccccactcgtgctcgcccccc

SEQ ID NO: 131647 - DNA, 35 bp, Artificial Sequence
  Synthetic oligonucleotide
agtagggcgggaacatgcggagggcgggaatcccc

SEQ ID NO: 131648 - DNA, 35 bp, Artificial Sequence
  Synthetic oligonucleotide
acccttcccggtcccccgctatgctaatcttagcc

SEQ ID NO: 131649 - DNA, 35 bp, Artificial Sequence
  Synthetic oligonucleotide
accatcagcccatttctacggcccattatctcgcc

SEQ ID NO: 131650 - DNA, 35 bp, Artificial Sequence
  Synthetic oligonucleotide
gaccacgctttgctactccgaacttgtctttttgc

SEQ ID NO: 131651 - DNA, 35 bp, Artificial Sequence
  Synthetic oligonucleotide
gacctcacatttatcatgcctgctacccacgggtc

SEQ ID NO: 131652 - DNA, 35 bp, Artificial Sequence
  Synthetic oligonucleotide
tccactgtgttggcccgattatttagtctcctccg

SEQ ID NO: 131653 - DNA, 35 bp, Artificial Sequence
  Synthetic oligonucleotide
gacaggggaggtagagatagagggcataagtgggg

SEQ ID NO: 131654 - DNA, 35 bp, Artificial Sequence
  Synthetic oligonucleotide
gaatgctccccccccgctaagagcccaccgcactg

SEQ ID NO: 131655 - DNA, 35 bp, Artificial Sequence
  Synthetic oligonucleotide
cccacgcccccccttcctttcagctcagagtcact

SEQ ID NO: 131656 - DNA, 35 bp, Artificial Sequence
  Synthetic oligonucleotide
ataccccgcccccactggttatgacgttcgccctt

SEQ ID NO: 131657 - DNA, 35 bp, Artificial Sequence
  Synthetic oligonucleotide
tgccctcccctccctccagttttgcataaaagcaa

SEQ ID NO: 131658 - DNA, 36 bp, Artificial Sequence
  Synthetic oligonucleotide
acgaaaccccccgaccctgccaaaggacaggacaca

SEQ ID NO: 131659 - DNA, 35 bp, Artificial Sequence
  Synthetic oligonucleotide
ttcctgccacgtctctgcacacctatgttccacca

SEQ ID NO: 131660 - DNA, 36 bp, Artificial Sequence
  Synthetic oligonucleotide
tgcggggggagagagggaagagggtagcaggacgca

SEQ ID NO: 131661 - DNA, 37 bp, Artificial Sequence
  Synthetic oligonucleotide
tagggaggggcttgggggtgttataatcctttgggga

SEQ ID NO: 131662 - DNA, 37 bp, Artificial Sequence
  Synthetic oligonucleotide
gatcaggagggagaggggcctgagctaggggaatgga

SEQ ID NO: 131663 - DNA, 38 bp, Artificial Sequence
  Synthetic oligonucleotide
gactcaccgccgctgactatccctactattgtgcctga

SEQ ID NO: 131664 - DNA, 38 bp, Artificial Sequence
  Synthetic oligonucleotide
gtgataccgtggaggaggggggggacgagcgggggtga

SEQ ID NO: 131665 - DNA, 36 bp, Artificial Sequence
  Synthetic oligonucleotide
acgcccgaacgaagtacggtctacactcttctccta

SEQ ID NO: 131666 - DNA, 35 bp, Artificial Sequence
  Synthetic oligonucleotide
acgacctcttccaagtgtctcttctcctgcactac

SEQ ID NO: 131667 - DNA, 35 bp, Artificial Sequence
  Synthetic oligonucleotide
tgcaacgccgtaaaagtgtcccctccccatcgccc

SEQ ID NO: 131668 - DNA, 35 bp, Artificial Sequence
  Synthetic oligonucleotide
gtggtccgtcgaaccttctcccctatccggttggc

SEQ ID NO: 131669 - DNA, 35 bp, Artificial Sequence
  Synthetic oligonucleotide
gcgaagccgcccgtgtcacccgtcagcctaaatgc

SEQ ID NO: 131670 - DNA, 35 bp, Artificial Sequence
  Synthetic oligonucleotide
tcaggcgccagcccccgcgcccctcagttacctgc

SEQ ID NO: 131671 - DNA, 35 bp, Artificial Sequence
  Synthetic oligonucleotide
gcctgctgcattgtgccgcgcaatcattcaacctc

SEQ ID NO: 131672 - DNA, 35 bp, Artificial Sequence
  Synthetic oligonucleotide
cacgcgatcagctgcgctctcttcctgcctccgtc

SEQ ID NO: 131673 - DNA, 35 bp, Artificial Sequence
  Synthetic oligonucleotide
gacaaggagaggcgacggacgaggggatgaaacag

SEQ ID NO: 131674 - DNA, 35 bp, Artificial Sequence
  Synthetic oligonucleotide
tactccgacgcccggcatttccctgatttcgatcg

SEQ ID NO: 131675 - DNA, 35 bp, Artificial Sequence
  Synthetic oligonucleotide
gcacagcgcgcctgtgatttgttcccctgtccttg

SEQ ID NO: 131676 - DNA, 35 bp, Artificial Sequence
  Synthetic oligonucleotide
tcccgtcgtgtcgatctccatactatccctggcct

SEQ ID NO: 131677 - DNA, 35 bp, Artificial Sequence
  Synthetic oligonucleotide
ggactgcccgcccttgccccgatattacgtttctt

SEQ ID NO: 131678 - DNA, 35 bp, Artificial Sequence
  Synthetic oligonucleotide
gcaccacttcatccgcctctccgattcgcagccaa

SEQ ID NO: 131679 - DNA, 35 bp, Artificial Sequence
  Synthetic oligonucleotide
gccccactagctgccccggtactgaattccacaca

SEQ ID NO: 131680 - DNA, 35 bp, Artificial Sequence
  Synthetic oligonucleotide
ttccccctccccctgcaattagtgtgctagcagca

SEQ ID NO: 131681 - DNA, 37 bp, Artificial Sequence
  Synthetic oligonucleotide
tacaccaccgatgtctctcttctttgccctttgcaga

SEQ ID NO: 131682 - DNA, 35 bp, Artificial Sequence
  Synthetic oligonucleotide
tctgccctccgtgtgtttgcctgctcccgttccga

SEQ ID NO: 131683 - DNA, 37 bp, Artificial Sequence
  Synthetic oligonucleotide
gacgcagtccctctgttgttcgtctcccctccaagga

SEQ ID NO: 131684 - DNA, 36 bp, Artificial Sequence
  Synthetic oligonucleotide
gtccactccgcgcctgctttcccaatttccgttgga

SEQ ID NO: 131685 - DNA, 38 bp, Artificial Sequence
  Synthetic oligonucleotide
gctggcaccacccctgcacccgtgacccctcttgctga

SEQ ID NO: 131686 - DNA, 35 bp, Artificial Sequence
  Synthetic oligonucleotide
tccaccgcgcagtacgcacattgtcttacccaccc

SEQ ID NO: 131687 - DNA, 35 bp, Artificial Sequence
  Synthetic oligonucleotide
tgcaccgaatcgcacccgagcctgccgtaccttcc

SEQ ID NO: 131688 - DNA, 35 bp, Artificial Sequence
  Synthetic oligonucleotide
ccgctatgcccatccgttatgatcaccgacctttc

SEQ ID NO: 131689 - DNA, 34 bp, Artificial Sequence
  Synthetic oligonucleotide
gtcccgccccaccctttaatgacgccatcatccg

SEQ ID NO: 131690 - DNA, 35 bp, Artificial Sequence
  Synthetic oligonucleotide
ccctgtccccccgcgattgtctactggtctccatg

SEQ ID NO: 131691 - DNA, 35 bp, Artificial Sequence
  Synthetic oligonucleotide
tcccctcttcatgatcgtctgttcgtccatctctg

SEQ ID NO: 131692 - DNA, 35 bp, Artificial Sequence
  Synthetic oligonucleotide
actcggcctatcgtgcccctgtctgagctccctct

SEQ ID NO: 131693 - DNA, 35 bp, Artificial Sequence
  Synthetic oligonucleotide
gcatgtcgcatattccccttctctggccccctagt

SEQ ID NO: 131694 - DNA, 36 bp, Artificial Sequence
  Synthetic oligonucleotide
agatggggggaggggagtgcgatcgggtcgcagaaa

SEQ ID NO: 131695 - DNA, 35 bp, Artificial Sequence
  Synthetic oligonucleotide
ggggagggaagggggcaattagtcaaagggaacca

SEQ ID NO: 131696 - DNA, 36 bp, Artificial Sequence
  Synthetic oligonucleotide
tgtaccaccacccgagttcatgtcccgttgctccca

SEQ ID NO: 131697 - DNA, 35 bp, Artificial Sequence
  Synthetic oligonucleotide
tacgcctccgccataatgccacacctaactcagca

SEQ ID NO: 131698 - DNA, 36 bp, Artificial Sequence
  Synthetic oligonucleotide
gcatccgtcgccaccacccgaaccccccttacggca

SEQ ID NO: 131699 - DNA, 36 bp, Artificial Sequence
  Synthetic oligonucleotide
tcaccgtcattgtacctccatccgtacgcaccctca

SEQ ID NO: 131700 - DNA, 37 bp, Artificial Sequence
  Synthetic oligonucleotide
gatggagagggcccggggacgagggggacagtccaga

SEQ ID NO: 131701 - DNA, 37 bp, Artificial Sequence
  Synthetic oligonucleotide
aaatacgccgtacaggtgtatttcgcctccccccgga

SEQ ID NO: 131702 - DNA, 37 bp, Artificial Sequence
  Synthetic oligonucleotide
tcccaacctctctgttcctcacagtcctcatcatgga

SEQ ID NO: 131703 - DNA, 35 bp, Artificial Sequence
  Synthetic oligonucleotide
gcaccacgatggctggcacctccctcgaccaccta

SEQ ID NO: 131704 - DNA, 35 bp, Artificial Sequence
  Synthetic oligonucleotide
accgccaccttgatttcacgctgtcacacttcgac

SEQ ID NO: 131705 - DNA, 35 bp, Artificial Sequence
  Synthetic oligonucleotide
ttcccgcccgctttatgttcggccttaaatacacc

SEQ ID NO: 131706 - DNA, 35 bp, Artificial Sequence
  Synthetic oligonucleotide
tcagccactctgacctcgcatcccctacatttacc

SEQ ID NO: 131707 - DNA, 35 bp, Artificial Sequence
  Synthetic oligonucleotide
acagactgctttcatcccgccattgattaccgccc

SEQ ID NO: 131708 - DNA, 35 bp, Artificial Sequence
  Synthetic oligonucleotide
gccgtacggacaccgcccgctaatttcttcgctcc

SEQ ID NO: 131709 - DNA, 35 bp, Artificial Sequence
  Synthetic oligonucleotide
gccaatcccaatttatcatatgcaccggtaccatc

SEQ ID NO: 131710 - DNA, 35 bp, Artificial Sequence
  Synthetic oligonucleotide
tccatcccccgcttgttccggtgccctgtttactc

SEQ ID NO: 131711 - DNA, 35 bp, Artificial Sequence
  Synthetic oligonucleotide
gactattccgcatctcgttgtccgttcctcacctc

SEQ ID NO: 131712 - DNA, 35 bp, Artificial Sequence
  Synthetic oligonucleotide
tgaaccgcctcctgccgccacaaggtccttcgctc

SEQ ID NO: 131713 - DNA, 35 bp, Artificial Sequence
  Synthetic oligonucleotide
tactatgtcaggtcgcgttactgttcaccttcttc

SEQ ID NO: 131714 - DNA, 35 bp, Artificial Sequence
  Synthetic oligonucleotide
atgccatccaatggtcctctcgccgtttgcaaccg

SEQ ID NO: 131715 - DNA, 35 bp, Artificial Sequence
  Synthetic oligonucleotide
ttagctcaccccctccgtccatgcctttcctgcgg

SEQ ID NO: 131716 - DNA, 35 bp, Artificial Sequence
  Synthetic oligonucleotide
tgcgggcccgcccctctgttcgttactttgtcaat

SEQ ID NO: 131717 - DNA, 34 bp, Artificial Sequence
  Synthetic oligonucleotide
tcacctgtctagcctacactaagccatccgccct

SEQ ID NO: 131718 - DNA, 35 bp, Artificial Sequence
  Synthetic oligonucleotide
accgaccacagacatcgtgacacagccaccctctt

SEQ ID NO: 131719 - DNA, 36 bp, Artificial Sequence
  Synthetic oligonucleotide
gcaaacggggagggacataggcaaggggtgggctca

SEQ ID NO: 131720 - DNA, 35 bp, Artificial Sequence
  Synthetic oligonucleotide
ggatattcccacatctgtacccgactcgttcttca

SEQ ID NO: 131721 - DNA, 37 bp, Artificial Sequence
  Synthetic oligonucleotide
gccactccagtgtcttgcactgctgctctcctgccga

SEQ ID NO: 131722 - DNA, 37 bp, Artificial Sequence
  Synthetic oligonucleotide
gcaggagagtgagggtggccgggggggggaggttgga

SEQ ID NO: 131723 - DNA, 37 bp, Artificial Sequence
  Synthetic oligonucleotide
cacacggaagagggcgagttgggacggggggggatga

SEQ ID NO: 131724 - DNA, 38 bp, Artificial Sequence
  Synthetic oligonucleotide
gtgggggggaggggtcgtaaaagagattggggcgctga

SEQ ID NO: 131725 - DNA, 35 bp, Artificial Sequence
  Synthetic oligonucleotide
gttgaagagtcacgggcgggtacgggagggttcta

SEQ ID NO: 131726 - DNA, 35 bp, Artificial Sequence
  Synthetic oligonucleotide
tcgctatcctgcacgctgtttcccttgtcggtcac

SEQ ID NO: 131727 - DNA, 35 bp, Artificial Sequence
  Synthetic oligonucleotide
tcaggaagctccgtctgagtgccgtcctgtccgcc

SEQ ID NO: 131728 - DNA, 35 bp, Artificial Sequence
  Synthetic oligonucleotide
gcaccatcgggtcttcgatataatcacccctgctc

SEQ ID NO: 131729 - DNA, 34 bp, Artificial Sequence
  Synthetic oligonucleotide
tgtgtacagcccccctattgattctttgcgtttc

SEQ ID NO: 131730 - DNA, 35 bp, Artificial Sequence
  Synthetic oligonucleotide
gacggggggggatacacggaaagggataggttagg

SEQ ID NO: 131731 - DNA, 35 bp, Artificial Sequence
  Synthetic oligonucleotide
acgcgccatccattggtctcggtgcctctactatt

SEQ ID NO: 131732 - DNA, 36 bp, Artificial Sequence
  Synthetic oligonucleotide
tgggatggtaacgggtgtggagcaaaggggatggaa

SEQ ID NO: 131733 - DNA, 36 bp, Artificial Sequence
  Synthetic oligonucleotide
gatttgtgttggacacagcgttgccctcccacccca

SEQ ID NO: 131734 - DNA, 36 bp, Artificial Sequence
  Synthetic oligonucleotide
gaccgccatcctattcgttcttatctgtcacttgca

SEQ ID NO: 131735 - DNA, 35 bp, Artificial Sequence
  Synthetic oligonucleotide
gagacgccagaagcccgcataccccccgaccgtca

SEQ ID NO: 131736 - DNA, 35 bp, Artificial Sequence
  Synthetic oligonucleotide
gggccacacgctgtcttttacgctccctccttcga

SEQ ID NO: 131737 - DNA, 38 bp, Artificial Sequence
  Synthetic oligonucleotide
gcaacagggtggcgggggggtggacaacggagggttga

SEQ ID NO: 131738 - DNA, 35 bp, Artificial Sequence
  Synthetic oligonucleotide
gtcatactgctgttccgtttatcctggcatttacc

SEQ ID NO: 131739 - DNA, 35 bp, Artificial Sequence
  Synthetic oligonucleotide
acacattccgcaggccccatggccgttcccttccc

SEQ ID NO: 131740 - DNA, 35 bp, Artificial Sequence
  Synthetic oligonucleotide
gcgcccctgccagtgctcgcacaccttgtttcgcc

SEQ ID NO: 131741 - DNA, 35 bp, Artificial Sequence
  Synthetic oligonucleotide
ggacccaccatgtcggctgtacgtttcgcccttcc

SEQ ID NO: 131742 - DNA, 34 bp, Artificial Sequence
  Synthetic oligonucleotide
tttcccgcccaactccccttgcgatcctctgcgc

SEQ ID NO: 131743 - DNA, 35 bp, Artificial Sequence
  Synthetic oligonucleotide
tgcacccgtccaattaccagcgtgacgtatccctc

SEQ ID NO: 131744 - DNA, 35 bp, Artificial Sequence
  Synthetic oligonucleotide
tgcctcatcaccattcacccgacgtaagacccttc

SEQ ID NO: 131745 - DNA, 35 bp, Artificial Sequence
  Synthetic oligonucleotide
agccaccgcctcatcttgatcccccggccctttcg

SEQ ID NO: 131746 - DNA, 35 bp, Artificial Sequence
  Synthetic oligonucleotide
gacatgcaagaggaagggaacaatgagggatcggg

SEQ ID NO: 131747 - DNA, 35 bp, Artificial Sequence
  Synthetic oligonucleotide
accctccttcccgcgtaataaccgctactccattg

SEQ ID NO: 131748 - DNA, 35 bp, Artificial Sequence
  Synthetic oligonucleotide
gccatgacctggaccggcctgcctcctccgccact

SEQ ID NO: 131749 - DNA, 35 bp, Artificial Sequence
  Synthetic oligonucleotide
gggacatgcgtcgcatcgttcctgctgctcttctt

SEQ ID NO: 131750 - DNA, 35 bp, Artificial Sequence
  Synthetic oligonucleotide
gacactcttctgatctgccccgccgagttcccgtt

SEQ ID NO: 131751 - DNA, 35 bp, Artificial Sequence
  Synthetic oligonucleotide
tcatacctgcatgccaccgtcactccccccgtcaa

SEQ ID NO: 131752 - DNA, 37 bp, Artificial Sequence
  Synthetic oligonucleotide
gatacctgccctgccatctatacttgtgtgcccgcca

SEQ ID NO: 131753 - DNA, 36 bp, Artificial Sequence
  Synthetic oligonucleotide
gatgatagcgtcgcgctcccctgtcttttgccgcca

SEQ ID NO: 131754 - DNA, 36 bp, Artificial Sequence
  Synthetic oligonucleotide
gctcgtgctcccatccggcctgttctctttccagca

SEQ ID NO: 131755 - DNA, 37 bp, Artificial Sequence
  Synthetic oligonucleotide
gactcgcccaccatgtcttaccattctcaggtccgga

SEQ ID NO: 131756 - DNA, 38 bp, Artificial Sequence
  Synthetic oligonucleotide
gaaagagggggaaggaggggtaaggggagtgggcatga

SEQ ID NO: 131757 - DNA, 38 bp, Artificial Sequence
  Synthetic oligonucleotide
tacgcgccatgttaatcgtaccgccccctaccctctga

SEQ ID NO: 131758 - DNA, 35 bp, Artificial Sequence
  Synthetic oligonucleotide
tgcgagtggggggggtagtactggcgggaatgtga

SEQ ID NO: 131759 - DNA, 36 bp, Artificial Sequence
  Synthetic oligonucleotide
tcgatcgtcttaagctgccccatcgcctcgcccata

SEQ ID NO: 131760 - DNA, 34 bp, Artificial Sequence
  Synthetic oligonucleotide
ttcacagtaccaccatgtaacgcccctttttacc

SEQ ID NO: 131761 - DNA, 35 bp, Artificial Sequence
  Synthetic oligonucleotide
tccgtcatgtcgggtcctacgaatccatctgctcc

SEQ ID NO: 131762 - DNA, 35 bp, Artificial Sequence
  Synthetic oligonucleotide
aacgcctccctttaagcttgtttcgtgaacgttcc

SEQ ID NO: 131763 - DNA, 33 bp, Artificial Sequence
  Synthetic oligonucleotide
gttcaccctccttctctcagcctcgtgccgagc

SEQ ID NO: 131764 - DNA, 35 bp, Artificial Sequence
  Synthetic oligonucleotide
tcgacctaccatgcccgttcttagcccttggattc

SEQ ID NO: 131765 - DNA, 35 bp, Artificial Sequence
  Synthetic oligonucleotide
tcccatctcatcctgattcgtaacctgttctttag

SEQ ID NO: 131766 - DNA, 35 bp, Artificial Sequence
  Synthetic oligonucleotide
tagagaaggtggaacggaacggacaggaggcgtgg

SEQ ID NO: 131767 - DNA, 35 bp, Artificial Sequence
  Synthetic oligonucleotide
gaacatgcagtcgcctcctccctctcaccgcccct

SEQ ID NO: 131768 - DNA, 35 bp, Artificial Sequence
  Synthetic oligonucleotide
ttgggggaagccgttggggtgggcgtatgggggct

SEQ ID NO: 131769 - DNA, 35 bp, Artificial Sequence
  Synthetic oligonucleotide
agcactccatgtcgctgcccacgctcacccccatt

SEQ ID NO: 131770 - DNA, 36 bp, Artificial Sequence
  Synthetic oligonucleotide
gaccaagtagtgggagggagcctgggaggaggacaa

SEQ ID NO: 131771 - DNA, 35 bp, Artificial Sequence
  Synthetic oligonucleotide
gcacctcagacgcatgtactcggcccttcacctaa

SEQ ID NO: 131772 - DNA, 36 bp, Artificial Sequence
  Synthetic oligonucleotide
tactgccccttcattgtcgatatttacctctacgca

SEQ ID NO: 131773 - DNA, 36 bp, Artificial Sequence
  Synthetic oligonucleotide
gactcacgccctcctcgatagctttcgccgtatgca

SEQ ID NO: 131774 - DNA, 37 bp, Artificial Sequence
  Synthetic oligonucleotide
tgggatggggcgggtactttggggtaatcactgggga

SEQ ID NO: 131775 - DNA, 36 bp, Artificial Sequence
  Synthetic oligonucleotide
tccccctcctgcatgttttcacaccgatcagcctga

SEQ ID NO: 131776 - DNA, 38 bp, Artificial Sequence
  Synthetic oligonucleotide
acccctccctcctcgcgcattcatccgtcacgtagtga

SEQ ID NO: 131777 - DNA, 37 bp, Artificial Sequence
  Synthetic oligonucleotide
gagcgatgggcaaggacgaggaggggatcgctggtga

SEQ ID NO: 131778 - DNA, 35 bp, Artificial Sequence
  Synthetic oligonucleotide
tgttcctcctccggcctgtaatttccctcacgtta

SEQ ID NO: 131779 - DNA, 35 bp, Artificial Sequence
  Synthetic oligonucleotide
gtgcctggttacgttcgcttttcttccagacccgc

SEQ ID NO: 131780 - DNA, 35 bp, Artificial Sequence
  Synthetic oligonucleotide
tgcccactggttatatccgcgccttgcttcttggc

SEQ ID NO: 131781 - DNA, 35 bp, Artificial Sequence
  Synthetic oligonucleotide
gagcttgcccctcgacttgcctgctttctcgttgc

SEQ ID NO: 131782 - DNA, 35 bp, Artificial Sequence
  Synthetic oligonucleotide
ttcacggccacttcccccgttgcccttcatggttc

SEQ ID NO: 131783 - DNA, 35 bp, Artificial Sequence
  Synthetic oligonucleotide
acacctcggggttattgtgctctccttccgcttcg

SEQ ID NO: 131784 - DNA, 35 bp, Artificial Sequence
  Synthetic oligonucleotide
tgtcattccgtcgcagcacatcacctcctgccgat

SEQ ID NO: 131785 - DNA, 35 bp, Artificial Sequence
  Synthetic oligonucleotide
gtgcccaagcgccttcatcgaccctcctaggccct

SEQ ID NO: 131786 - DNA, 35 bp, Artificial Sequence
  Synthetic oligonucleotide
tcgcatctgctgacccatgaacacgctccactcct

SEQ ID NO: 131787 - DNA, 35 bp, Artificial Sequence
  Synthetic oligonucleotide
gccacccgccttgtacaggccctaccagcactcct

SEQ ID NO: 131788 - DNA, 35 bp, Artificial Sequence
  Synthetic oligonucleotide
tccgtttccctgatcctgttactagcccccagtct

SEQ ID NO: 131789 - DNA, 34 bp, Artificial Sequence
  Synthetic oligonucleotide
gactcaacgctgtaatttcgtttccgccccgttt

SEQ ID NO: 131790 - DNA, 36 bp, Artificial Sequence
  Synthetic oligonucleotide
gaggataggcggggaggtatgggggaggggtgtaaa

SEQ ID NO: 131791 - DNA, 35 bp, Artificial Sequence
  Synthetic oligonucleotide
tcacgctgacttcccgagctcgcataaatccgcca

SEQ ID NO: 131792 - DNA, 36 bp, Artificial Sequence
  Synthetic oligonucleotide
acacacaccattgctgcccctatggatccctgatca

SEQ ID NO: 131793 - DNA, 36 bp, Artificial Sequence
  Synthetic oligonucleotide
gtacgtcccgcaccctcacgcgtccttccggcctca

SEQ ID NO: 131794 - DNA, 36 bp, Artificial Sequence
  Synthetic oligonucleotide
aacccaccatccgctgtacgtgccccgtgaggttca

SEQ ID NO: 131795 - DNA, 36 bp, Artificial Sequence
  Synthetic oligonucleotide
agggccgggacgggggggactagagtgttaatcaga

SEQ ID NO: 131796 - DNA, 37 bp, Artificial Sequence
  Synthetic oligonucleotide
gcacgcctctcccccctgcatacctggacgtccacga

SEQ ID NO: 131797 - DNA, 37 bp, Artificial Sequence
  Synthetic oligonucleotide
gactcggacactgcatggataacccgccccccctcga

SEQ ID NO: 131798 - DNA, 36 bp, Artificial Sequence
  Synthetic oligonucleotide
agccccgtgcccattgtactttctatctagcctcga

SEQ ID NO: 131799 - DNA, 37 bp, Artificial Sequence
  Synthetic oligonucleotide
ggaggggaaggaacatagatcaacgagatggggcgga

SEQ ID NO: 131800 - DNA, 38 bp, Artificial Sequence
  Synthetic oligonucleotide
acctcccctcccccgtagttttcagtcacatttcatga

SEQ ID NO: 131801 - DNA, 38 bp, Artificial Sequence
  Synthetic oligonucleotide
gaggtcggtaagatgagacgggcggaggggggggatga

SEQ ID NO: 131802 - DNA, 37 bp, Artificial Sequence
  Synthetic oligonucleotide
gactccgtatccgttacgccaccctgtactttactga

SEQ ID NO: 131803 - DNA, 38 bp, Artificial Sequence
  Synthetic oligonucleotide
acgccccgagtcagatggcaaccccactcccgccctga

SEQ ID NO: 131804 - DNA, 38 bp, Artificial Sequence
  Synthetic oligonucleotide
acgtggtggttgggggtggggggcggaggaccttctga

SEQ ID NO: 131805 - DNA, 37 bp, Artificial Sequence
  Synthetic oligonucleotide
acgcacctatcccatccgactcgccctgttgctgtga

SEQ ID NO: 131806 - DNA, 35 bp, Artificial Sequence
  Synthetic oligonucleotide
tttgtggccagatcccacgctgttcctatccttgc

SEQ ID NO: 131807 - DNA, 35 bp, Artificial Sequence
  Synthetic oligonucleotide
ttcccacttagctgtatgccaccgaccgtctcatc

SEQ ID NO: 131808 - DNA, 35 bp, Artificial Sequence
  Synthetic oligonucleotide
acaccatcacattgcgacccttgtaccaaccgttc

SEQ ID NO: 131809 - DNA, 35 bp, Artificial Sequence
  Synthetic oligonucleotide
gagaggaacatggtaggggggtagccaggaaagag

SEQ ID NO: 131810 - DNA, 35 bp, Artificial Sequence
  Synthetic oligonucleotide
tgatccccccttgccctcgtgtaagcgtacgtacg

SEQ ID NO: 131811 - DNA, 35 bp, Artificial Sequence
  Synthetic oligonucleotide
aatcacccgcccagctcgctcattgaaccgccgtg

SEQ ID NO: 131812 - DNA, 35 bp, Artificial Sequence
  Synthetic oligonucleotide
aaagagggacgggtggaatacaggaaacgagcaat

SEQ ID NO: 131813 - DNA, 35 bp, Artificial Sequence
  Synthetic oligonucleotide
ttccacgctaccccgcctgcattcaacctttcgat

SEQ ID NO: 131814 - DNA, 35 bp, Artificial Sequence
  Synthetic oligonucleotide
tgcacccgggtcccattcgctacacctgaccttat

SEQ ID NO: 131815 - DNA, 35 bp, Artificial Sequence
  Synthetic oligonucleotide
ttacccccaccatggcattacgatactcacgtgct

SEQ ID NO: 131816 - DNA, 35 bp, Artificial Sequence
  Synthetic oligonucleotide
tcagaccgaccacatcctcttttcacatccctcgt

SEQ ID NO: 131817 - DNA, 34 bp, Artificial Sequence
  Synthetic oligonucleotide
actgcacagctgtcgccccacatacccgcttcgt

SEQ ID NO: 131818 - DNA, 35 bp, Artificial Sequence
  Synthetic oligonucleotide
tgcatccacattgctgggcccatactcctgtactt

SEQ ID NO: 131819 - DNA, 36 bp, Artificial Sequence
  Synthetic oligonucleotide
gatgagcggcctttagctattggtctccccgttcca

SEQ ID NO: 131820 - DNA, 36 bp, Artificial Sequence
  Synthetic oligonucleotide
taccgcacatcaagcttgaaaacccgctccctcgca

SEQ ID NO: 131821 - DNA, 35 bp, Artificial Sequence
  Synthetic oligonucleotide
agctaggccaattgctccacccacccatgtttgca

SEQ ID NO: 131822 - DNA, 37 bp, Artificial Sequence
  Synthetic oligonucleotide
aaatacggagggagtggacacgtggggaagggcagga

SEQ ID NO: 131823 - DNA, 37 bp, Artificial Sequence
  Synthetic oligonucleotide
gcagtaccgggaggatagggaagggtagtgcggagga

SEQ ID NO: 131824 - DNA, 38 bp, Artificial Sequence
  Synthetic oligonucleotide
atggagacagtagagcgcgggggggagacggtatatga

SEQ ID NO: 131825 - DNA, 38 bp, Artificial Sequence
  Synthetic oligonucleotide
agcgcccctcctggtattgctcttctcctcactggtga

SEQ ID NO: 131826 - DNA, 35 bp, Artificial Sequence
  Synthetic oligonucleotide
ggagacgtgaccctgtaatatccctgttttcccac

SEQ ID NO: 131827 - DNA, 35 bp, Artificial Sequence
  Synthetic oligonucleotide
agcatgggcgcttggtcccccgttatcccgcttac

SEQ ID NO: 131828 - DNA, 35 bp, Artificial Sequence
  Synthetic oligonucleotide
actaaaccttcggtgctggcaccttttctgccccc

SEQ ID NO: 131829 - DNA, 35 bp, Artificial Sequence
  Synthetic oligonucleotide
tctgtactgcccttagaaccctgccctcccgatcc

SEQ ID NO: 131830 - DNA, 35 bp, Artificial Sequence
  Synthetic oligonucleotide
ggacgatccattgcagtaatctcactgtgccctcc

SEQ ID NO: 131831 - DNA, 35 bp, Artificial Sequence
  Synthetic oligonucleotide
gtgtcaccctgtgccgtgtattgtgcccttgttcc

SEQ ID NO: 131832 - DNA, 35 bp, Artificial Sequence
  Synthetic oligonucleotide
atttggccaccccgcccacattttgatagccgatc

SEQ ID NO: 131833 - DNA, 35 bp, Artificial Sequence
  Synthetic oligonucleotide
ttgtcaccctccctagtctccccgtccaccggaat

SEQ ID NO: 131834 - DNA, 35 bp, Artificial Sequence
  Synthetic oligonucleotide
ttacccatctactccgctaccgtatctgcctgcct

SEQ ID NO: 131835 - DNA, 35 bp, Artificial Sequence
  Synthetic oligonucleotide
accgcaatccccggttggcgtgtcacaggccctct

SEQ ID NO: 131836 - DNA, 36 bp, Artificial Sequence
  Synthetic oligonucleotide
tgccgcccctgccataaagtcgtactaccgccgcaa

SEQ ID NO: 131837 - DNA, 35 bp, Artificial Sequence
  Synthetic oligonucleotide
tacgtcatggcattatcccgccgtgccttctccca

SEQ ID NO: 131838 - DNA, 36 bp, Artificial Sequence
  Synthetic oligonucleotide
tcccacgtcgtcccttgaatacatgttgccctctca

SEQ ID NO: 131839 - DNA, 37 bp, Artificial Sequence
  Synthetic oligonucleotide
tggggagtggcggtttccatcctagggctgtggggga

SEQ ID NO: 131840 - DNA, 37 bp, Artificial Sequence
  Synthetic oligonucleotide
tacccccgcctgccctgctctcggtacgtctccctga

SEQ ID NO: 131841 - DNA, 35 bp, Artificial Sequence
  Synthetic oligonucleotide
actctaccatgccctcgtttcgggacgcacaccta

SEQ ID NO: 131842 - DNA, 35 bp, Artificial Sequence
  Synthetic oligonucleotide
gcgccctcacctgaattggtcccacgcctgcatcc

SEQ ID NO: 131843 - DNA, 35 bp, Artificial Sequence
  Synthetic oligonucleotide
gcatcccgtccgcccttctagctacatccctctgc

SEQ ID NO: 131844 - DNA, 35 bp, Artificial Sequence
  Synthetic oligonucleotide
ttcggtgcagggtcctaattgctttaccactcctc

SEQ ID NO: 131845 - DNA, 35 bp, Artificial Sequence
  Synthetic oligonucleotide
gcgccgccttccatctggactataatcacgccttc

SEQ ID NO: 131846 - DNA, 34 bp, Artificial Sequence
  Synthetic oligonucleotide
gacttccctcccgcccggcattgtcccacctgag

SEQ ID NO: 131847 - DNA, 35 bp, Artificial Sequence
  Synthetic oligonucleotide
tgatgctcccgccgtattgtcctccttcgtatcat

SEQ ID NO: 131848 - DNA, 35 bp, Artificial Sequence
  Synthetic oligonucleotide
gccccgctcctcttgtcttaatcctggttgggcct

SEQ ID NO: 131849 - DNA, 33 bp, Artificial Sequence
  Synthetic oligonucleotide
agatctgcctcggtaccgccccattccatctgt

SEQ ID NO: 131850 - DNA, 36 bp, Artificial Sequence
  Synthetic oligonucleotide
tcatctccggcctgacaccctcctcgacacttctaa

SEQ ID NO: 131851 - DNA, 36 bp, Artificial Sequence
  Synthetic oligonucleotide
accaccccgccaccatatgctgcccacatgtcgcca

SEQ ID NO: 131852 - DNA, 37 bp, Artificial Sequence
  Synthetic oligonucleotide
tccgcaacacccgcccccctgccattgggcccctcga

SEQ ID NO: 131853 - DNA, 36 bp, Artificial Sequence
  Synthetic oligonucleotide
tctgactccatcgccctgacccagtctctcacagga

SEQ ID NO: 131854 - DNA, 35 bp, Artificial Sequence
  Synthetic oligonucleotide
ttggtccccccactcattgttgttgatcaccctga

SEQ ID NO: 131855 - DNA, 38 bp, Artificial Sequence
  Synthetic oligonucleotide
gccaccgcatacgtggacgccctgcactctcttcgtga

SEQ ID NO: 131856 - DNA, 35 bp, Artificial Sequence
  Synthetic oligonucleotide
tacatcaatcacctggttcccatcgtgccactcta

SEQ ID NO: 131857 - DNA, 35 bp, Artificial Sequence
  Synthetic oligonucleotide
accgttccctcgctctcgtgcctattggttgtcta

SEQ ID NO: 131858 - DNA, 36 bp, Artificial Sequence
  Synthetic oligonucleotide
attcgccgcacactctgctctatctgtttggttcta

SEQ ID NO: 131859 - DNA, 35 bp, Artificial Sequence
  Synthetic oligonucleotide
gaaggggggctcaaaatctgtgggcggggttcaac

SEQ ID NO: 131860 - DNA, 35 bp, Artificial Sequence
  Synthetic oligonucleotide
tccatggtaaccgaccgccttccccccaaggatcc

SEQ ID NO: 131861 - DNA, 35 bp, Artificial Sequence
  Synthetic oligonucleotide
gccctgtcgcgccgactctgaccccaccctagtcc

SEQ ID NO: 131862 - DNA, 34 bp, Artificial Sequence
  Synthetic oligonucleotide
actcactacgtactaaccgtccgcccaccgacgc

SEQ ID NO: 131863 - DNA, 35 bp, Artificial Sequence
  Synthetic oligonucleotide
tgtccgccctgccattacttgaccagtaactccgc

SEQ ID NO: 131864 - DNA, 35 bp, Artificial Sequence
  Synthetic oligonucleotide
acatcactccccttggccctatgctcgctgtagag

SEQ ID NO: 131865 - DNA, 35 bp, Artificial Sequence
  Synthetic oligonucleotide
tcacactccctgctgctaactgtactcgcctttcg

SEQ ID NO: 131866 - DNA, 35 bp, Artificial Sequence
  Synthetic oligonucleotide
ggggtgtggttggttcccattgggttgggcggggg

SEQ ID NO: 131867 - DNA, 35 bp, Artificial Sequence
  Synthetic oligonucleotide
ttcactaccgcctgatctccgccggccatctcatg

SEQ ID NO: 131868 - DNA, 35 bp, Artificial Sequence
  Synthetic oligonucleotide
gccgcaagacagggcttccgtttctcctcccgttg

SEQ ID NO: 131869 - DNA, 35 bp, Artificial Sequence
  Synthetic oligonucleotide
gactccgccatttgctccaagtcctcagttcctat

SEQ ID NO: 131870 - DNA, 35 bp, Artificial Sequence
  Synthetic oligonucleotide
taaccacccggccctcgtttcgtacctatcccact

SEQ ID NO: 131871 - DNA, 35 bp, Artificial Sequence
  Synthetic oligonucleotide
accgatccacatcccgctgacggttaatgctacct

SEQ ID NO: 131872 - DNA, 35 bp, Artificial Sequence
  Synthetic oligonucleotide
gacaggcggctgaacgtcttccgtccctctttgct

SEQ ID NO: 131873 - DNA, 35 bp, Artificial Sequence
  Synthetic oligonucleotide
tccgcccaccacccgatctagcttttctcgcatgt

SEQ ID NO: 131874 - DNA, 35 bp, Artificial Sequence
  Synthetic oligonucleotide
gctcgggcgcccttgccttaaccgttgtcctctgt

SEQ ID NO: 131875 - DNA, 35 bp, Artificial Sequence
  Synthetic oligonucleotide
ttcagcatacgggtgggtgagggggggacaagatt

SEQ ID NO: 131876 - DNA, 35 bp, Artificial Sequence
  Synthetic oligonucleotide
agcacactcaccggtctttacagctatcgcctttt

SEQ ID NO: 131877 - DNA, 36 bp, Artificial Sequence
  Synthetic oligonucleotide
taagccaaccggcacgttgcccttcgcccttttaaa

SEQ ID NO: 131878 - DNA, 36 bp, Artificial Sequence
  Synthetic oligonucleotide
gagatccccgccctgttctaccctcctgtccgccaa

SEQ ID NO: 131879 - DNA, 35 bp, Artificial Sequence
  Synthetic oligonucleotide
ttcacaagcctgccgctgacatcatccactcctca

SEQ ID NO: 131880 - DNA, 37 bp, Artificial Sequence
  Synthetic oligonucleotide
tccacctctgccctccactgtgtcgaactctgttcga

SEQ ID NO: 131881 - DNA, 37 bp, Artificial Sequence
  Synthetic oligonucleotide
aaaggacgggcatgaaggatcttggattgggggagga

SEQ ID NO: 131882 - DNA, 35 bp, Artificial Sequence
  Synthetic oligonucleotide
ataatggaggtggaggtgacggaggcaatggagga

SEQ ID NO: 131883 - DNA, 38 bp, Artificial Sequence
  Synthetic oligonucleotide
aagcggagggaggggcgcgaaggacaataggtgggtga

SEQ ID NO: 131884 - DNA, 35 bp, Artificial Sequence
  Synthetic oligonucleotide
aactgggtgggtggggccggacgtaggaggggata

SEQ ID NO: 131885 - DNA, 36 bp, Artificial Sequence
  Synthetic oligonucleotide
gtcgtccgtccgctctagtcttcttcaccgttttta

SEQ ID NO: 131886 - DNA, 35 bp, Artificial Sequence
  Synthetic oligonucleotide
gcccactcaccactctcgatcttcaggctaatgac

SEQ ID NO: 131887 - DNA, 35 bp, Artificial Sequence
  Synthetic oligonucleotide
gaaggagaggggggagggttccgagagcgctacgc

SEQ ID NO: 131888 - DNA, 35 bp, Artificial Sequence
  Synthetic oligonucleotide
gagcgctctgttcctcacattgctgtacgttccgc

SEQ ID NO: 131889 - DNA, 35 bp, Artificial Sequence
  Synthetic oligonucleotide
tgcctagcagcccttcgctccccctaaacgctcgc

SEQ ID NO: 131890 - DNA, 35 bp, Artificial Sequence
  Synthetic oligonucleotide
attcgcccaccgtaggtgccacccccgctttaggc

SEQ ID NO: 131891 - DNA, 35 bp, Artificial Sequence
  Synthetic oligonucleotide
acatccacctcgctggatccgtacaatttccgttc

SEQ ID NO: 131892 - DNA, 35 bp, Artificial Sequence
  Synthetic oligonucleotide
gagcgtaggggagactcgaagtggaggggggaaag

SEQ ID NO: 131893 - DNA, 36 bp, Artificial Sequence
  Synthetic oligonucleotide
gacgtggagcggagggagggggggatcttatgtacg

SEQ ID NO: 131894 - DNA, 35 bp, Artificial Sequence
  Synthetic oligonucleotide
tccacaacctagtcgggtctccttgtcacctaccg

SEQ ID NO: 131895 - DNA, 35 bp, Artificial Sequence
  Synthetic oligonucleotide
accacccggcctatgtcctccttacgggattcccg

SEQ ID NO: 131896 - DNA, 35 bp, Artificial Sequence
  Synthetic oligonucleotide
gagtcgcagtgtgtccgcccttgccctcactaatg

SEQ ID NO: 131897 - DNA, 35 bp, Artificial Sequence
  Synthetic oligonucleotide
gctcaggtaccacatgtttcatcccactccccatg

SEQ ID NO: 131898 - DNA, 35 bp, Artificial Sequence
  Synthetic oligonucleotide
tgacacgtcggtctactttgtcctccgcttatttg

SEQ ID NO: 131899 - DNA, 35 bp, Artificial Sequence
  Synthetic oligonucleotide
taggttcgccccgcctcccaccgtaggtcccccat

SEQ ID NO: 131900 - DNA, 35 bp, Artificial Sequence
  Synthetic oligonucleotide
gcgcctcctccgggttacgtcccagccctcccgat

SEQ ID NO: 131901 - DNA, 35 bp, Artificial Sequence
  Synthetic oligonucleotide
gcccggatcacgcccccgtcaattgccgaccacct

SEQ ID NO: 131902 - DNA, 35 bp, Artificial Sequence
  Synthetic oligonucleotide
gccgctccgcctttcgtgatctcactgtcccctct

SEQ ID NO: 131903 - DNA, 35 bp, Artificial Sequence
  Synthetic oligonucleotide
acgcaatcagctgctctaactcccccgcccttctt

SEQ ID NO: 131904 - DNA, 35 bp, Artificial Sequence
  Synthetic oligonucleotide
actgcctccgtacctcgatgatcactgtctccttt

SEQ ID NO: 131905 - DNA, 35 bp, Artificial Sequence
  Synthetic oligonucleotide
tatgcaccatgctgcattccctcccaccccgtgaa

SEQ ID NO: 131906 - DNA, 36 bp, Artificial Sequence
  Synthetic oligonucleotide
tcccagtcctcgttcgcttccccattgcttatcaca

SEQ ID NO: 131907 - DNA, 36 bp, Artificial Sequence
  Synthetic oligonucleotide
ttgcccacccccctcacagagcaccggacctcgcca

SEQ ID NO: 131908 - DNA, 37 bp, Artificial Sequence
  Synthetic oligonucleotide
tgctgcgccccttaccggttaagcccctcctccacga

SEQ ID NO: 131909 - DNA, 37 bp, Artificial Sequence
  Synthetic oligonucleotide
atcgccctccatcactatcagcacacatttcgatcga

SEQ ID NO: 131910 - DNA, 35 bp, Artificial Sequence
  Synthetic oligonucleotide
aacgcagggggggggagggctgcaggtcgaccgga

SEQ ID NO: 131911 - DNA, 35 bp, Artificial Sequence
  Synthetic oligonucleotide
tcatcgagccccagccgctactcgtgacccactga

SEQ ID NO: 131912 - DNA, 35 bp, Artificial Sequence
  Synthetic oligonucleotide
gagagaagggaagaacacaggcggggagggacgta

SEQ ID NO: 131913 - DNA, 36 bp, Artificial Sequence
  Synthetic oligonucleotide
acgcccccctccgacgaggaagtcgcctccatatta

SEQ ID NO: 131914 - DNA, 35 bp, Artificial Sequence
  Synthetic oligonucleotide
acgcaccccactgtcgcgcctacagaccctccgcc

SEQ ID NO: 131915 - DNA, 35 bp, Artificial Sequence
  Synthetic oligonucleotide
tcgagatgtgctttttatgtcgtcccatccatgcc

SEQ ID NO: 131916 - DNA, 35 bp, Artificial Sequence
  Synthetic oligonucleotide
tgaagcgcttgctggcccccgtcctccaatgctcc

SEQ ID NO: 131917 - DNA, 35 bp, Artificial Sequence
  Synthetic oligonucleotide
tgtgcttgcatctacgcgctcaacataccctccgc

SEQ ID NO: 131918 - DNA, 35 bp, Artificial Sequence
  Synthetic oligonucleotide
gactccgggccacccgtgttcaatctacctttcat

SEQ ID NO: 131919 - DNA, 35 bp, Artificial Sequence
  Synthetic oligonucleotide
tacctaccgcctcacggtggaatgatctttgccct

SEQ ID NO: 131920 - DNA, 35 bp, Artificial Sequence
  Synthetic oligonucleotide
tcatgcagtctgttcgcctctgtccgcactttcct

SEQ ID NO: 131921 - DNA, 35 bp, Artificial Sequence
  Synthetic oligonucleotide
tatgccctccccattgcctaagaacctatctacaa

SEQ ID NO: 131922 - DNA, 36 bp, Artificial Sequence
  Synthetic oligonucleotide
agggacgtacggcctgtcatctccccacgttttcca

SEQ ID NO: 131923 - DNA, 35 bp, Artificial Sequence
  Synthetic oligonucleotide
aaatgccgccaatgaccatcccgttccccgttgca

SEQ ID NO: 131924 - DNA, 36 bp, Artificial Sequence
  Synthetic oligonucleotide
tgcgaccttcatcgtgtaccctctgttcggccttca

SEQ ID NO: 131925 - DNA, 35 bp, Artificial Sequence
  Synthetic oligonucleotide
gaaacaggaaggacggcgagagggaagcggacaga

SEQ ID NO: 131926 - DNA, 37 bp, Artificial Sequence
  Synthetic oligonucleotide
gcacgcaaggcgggggggagtgagaccagggaaagga

SEQ ID NO: 131927 - DNA, 38 bp, Artificial Sequence
  Synthetic oligonucleotide
ttcggagtgaggtgggggtggaggaacacaagaggtga

SEQ ID NO: 131928 - DNA, 38 bp, Artificial Sequence
  Synthetic oligonucleotide
gtcacgtcggaaacgattagtacctcccctcctcttga

SEQ ID NO: 131929 - DNA, 35 bp, Artificial Sequence
  Synthetic oligonucleotide
gtgtcacatcaccccgctctcacagatctatctta

SEQ ID NO: 131930 - DNA, 35 bp, Artificial Sequence
  Synthetic oligonucleotide
tgtctccaccattctaaccgcgctcccctgggacc

SEQ ID NO: 131931 - DNA, 35 bp, Artificial Sequence
  Synthetic oligonucleotide
ggaacacggaccctgctaatgatccctccccaccc

SEQ ID NO: 131932 - DNA, 36 bp, Artificial Sequence
  Synthetic oligonucleotide
tacacctctgctgttaatcgccccaacttgccgccc

SEQ ID NO: 131933 - DNA, 33 bp, Artificial Sequence
  Synthetic oligonucleotide
tagacccgaccgccccaggtagcctacatgtcc

SEQ ID NO: 131934 - DNA, 35 bp, Artificial Sequence
  Synthetic oligonucleotide
gtcagacacgttgcatttattgcgcccccatctgc

SEQ ID NO: 131935 - DNA, 36 bp, Artificial Sequence
  Synthetic oligonucleotide
gtctgcgcacctctccattccaccgtagaccctgtc

SEQ ID NO: 131936 - DNA, 35 bp, Artificial Sequence
  Synthetic oligonucleotide
acgctcgctctacctgatttcgtcgaccctcccct

SEQ ID NO: 131937 - DNA, 35 bp, Artificial Sequence
  Synthetic oligonucleotide
actttccgccccctcccctggttagactggtatct

SEQ ID NO: 131938 - DNA, 35 bp, Artificial Sequence
  Synthetic oligonucleotide
aacagccgaagaagtgcgccttcacctcgtcctgt

SEQ ID NO: 131939 - DNA, 35 bp, Artificial Sequence
  Synthetic oligonucleotide
gcatgcccccaaccacggcgccgtttccctccgtt

SEQ ID NO: 131940 - DNA, 36 bp, Artificial Sequence
  Synthetic oligonucleotide
gctgtcccacgccgcaccgacccgctccagtacaaa

SEQ ID NO: 131941 - DNA, 36 bp, Artificial Sequence
  Synthetic oligonucleotide
tgttgccacccatccgtgtgttgtccgttccgcaca

SEQ ID NO: 131942 - DNA, 35 bp, Artificial Sequence
  Synthetic oligonucleotide
tctggatgcgcgcgttctcatttgcccactcacca

SEQ ID NO: 131943 - DNA, 36 bp, Artificial Sequence
  Synthetic oligonucleotide
acacgcccatcttctgccatttgaactatttcgcca

SEQ ID NO: 131944 - DNA, 35 bp, Artificial Sequence
  Synthetic oligonucleotide
ggacgccctcctcccccgttgcctctggtacatca

SEQ ID NO: 131945 - DNA, 37 bp, Artificial Sequence
  Synthetic oligonucleotide
actgtgggggggagtgggacggggatctgtgtcatga

SEQ ID NO: 131946 - DNA, 38 bp, Artificial Sequence
  Synthetic oligonucleotide
gtgtcacccgtccggttcgctcttccctcatctcttga

SEQ ID NO: 131947 - DNA, 37 bp, Artificial Sequence
  Synthetic oligonucleotide
tgcacccacctactgcgaccacctccacttttgttga

SEQ ID NO: 131948 - DNA, 35 bp, Artificial Sequence
  Synthetic oligonucleotide
gtaccccgtcaattactccgctccctcctccgtac

SEQ ID NO: 131949 - DNA, 35 bp, Artificial Sequence
  Synthetic oligonucleotide
ggtcccgacgcagcccccttcccattcggtcgtac

SEQ ID NO: 131950 - DNA, 35 bp, Artificial Sequence
  Synthetic oligonucleotide
gatcccgcctagaaatccatgtatcgcctccctcc

SEQ ID NO: 131951 - DNA, 35 bp, Artificial Sequence
  Synthetic oligonucleotide
tcatctgcatgcattacccgcctccttgcgcccgc

SEQ ID NO: 131952 - DNA, 35 bp, Artificial Sequence
  Synthetic oligonucleotide
gcacctgtcagatacaccttccatcttggccgccg

SEQ ID NO: 131953 - DNA, 35 bp, Artificial Sequence
  Synthetic oligonucleotide
tgcgcggccccgttcttgtactaccgcctccgtcg

SEQ ID NO: 131954 - DNA, 35 bp, Artificial Sequence
  Synthetic oligonucleotide
acagctgtacgtaacgggagggggggaaggatcgg

SEQ ID NO: 131955 - DNA, 35 bp, Artificial Sequence
  Synthetic oligonucleotide
agctccgcctcacgtttcttctactgtccatagct

SEQ ID NO: 131956 - DNA, 35 bp, Artificial Sequence
  Synthetic oligonucleotide
atgggctggtggggacttgaggtcgctcggggtct

SEQ ID NO: 131957 - DNA, 35 bp, Artificial Sequence
  Synthetic oligonucleotide
tagcacccctttcggcgccaccctgatccctgtct

SEQ ID NO: 131958 - DNA, 35 bp, Artificial Sequence
  Synthetic oligonucleotide
ggccccgcagctctgtcgtcattaccacgccttct

SEQ ID NO: 131959 - DNA, 35 bp, Artificial Sequence
  Synthetic oligonucleotide
acgtactgccttcccttgccatcttcgagccgagt

SEQ ID NO: 131960 - DNA, 36 bp, Artificial Sequence
  Synthetic oligonucleotide
gacgccgtgcaaacctgatctttcgctcctaccggt

SEQ ID NO: 131961 - DNA, 36 bp, Artificial Sequence
  Synthetic oligonucleotide
acctaccgatccgtgtctctgcaccttctcatgtaa

SEQ ID NO: 131962 - DNA, 35 bp, Artificial Sequence
  Synthetic oligonucleotide
gccgcttatgtgcatccgttgccctcccccgtaca

SEQ ID NO: 131963 - DNA, 36 bp, Artificial Sequence
  Synthetic oligonucleotide
ttgccctgcatcccatcctaaaactgtcccttccca

SEQ ID NO: 131964 - DNA, 35 bp, Artificial Sequence
  Synthetic oligonucleotide
gcgtacccgcgcgcccccactacggttgccttcca

SEQ ID NO: 131965 - DNA, 37 bp, Artificial Sequence
  Synthetic oligonucleotide
gtgcgcacacaatgctatcttgcacgcttcccaccga

SEQ ID NO: 131966 - DNA, 37 bp, Artificial Sequence
  Synthetic oligonucleotide
actaccccgcctgttggtatctaatttgcttccccga

SEQ ID NO: 131967 - DNA, 35 bp, Artificial Sequence
  Synthetic oligonucleotide
gcgtcaccagctcatccacgcatcccccgctccga

SEQ ID NO: 131968 - DNA, 38 bp, Artificial Sequence
  Synthetic oligonucleotide
tgatcggagggtgggggggaggttcgggagcacaatga

SEQ ID NO: 131969 - DNA, 38 bp, Artificial Sequence
  Synthetic oligonucleotide
gtccatgccctctcaccatttttacggtctgtccctga

SEQ ID NO: 131970 - DNA, 37 bp, Artificial Sequence
  Synthetic oligonucleotide
gcaggcggaggaaggcagggtgaagggcttagggtga

SEQ ID NO: 131971 - DNA, 37 bp, Artificial Sequence
  Synthetic oligonucleotide
acacgtgcgcattgttcctcggtgccaccttctttga

SEQ ID NO: 131972 - DNA, 38 bp, Artificial Sequence
  Synthetic oligonucleotide
tgtcacgggagggagggtggcgctatggggacttttga

SEQ ID NO: 131973 - DNA, 36 bp, Artificial Sequence
  Synthetic oligonucleotide
tacttgcgccgcctgaattccttcgtggtcccccta

SEQ ID NO: 131974 - DNA, 35 bp, Artificial Sequence
  Synthetic oligonucleotide
gcagtcggtcatctccgtttactttgccctccacc

SEQ ID NO: 131975 - DNA, 35 bp, Artificial Sequence
  Synthetic oligonucleotide
ttgtccccacagaccaaatagcctgccgtttaccc

SEQ ID NO: 131976 - DNA, 35 bp, Artificial Sequence
  Synthetic oligonucleotide
gggccatccagtttgcgcaccgaacccctgccccc

SEQ ID NO: 131977 - DNA, 35 bp, Artificial Sequence
  Synthetic oligonucleotide
ccaacccctgactctaataagcctcgtccctgccc

SEQ ID NO: 131978 - DNA, 35 bp, Artificial Sequence
  Synthetic oligonucleotide
tgcgctgccctcatccgcccaattgcaccgctgcc

SEQ ID NO: 131979 - DNA, 35 bp, Artificial Sequence
  Synthetic oligonucleotide
atgcgcgccccgcacttttgttgttctatcttggc

SEQ ID NO: 131980 - DNA, 35 bp, Artificial Sequence
  Synthetic oligonucleotide
tcctgtgagcctgttttcgcccttacttacgttgc

SEQ ID NO: 131981 - DNA, 35 bp, Artificial Sequence
  Synthetic oligonucleotide
gttagcaccgggtgctgcgttcggtacccttcctc

SEQ ID NO: 131982 - DNA, 35 bp, Artificial Sequence
  Synthetic oligonucleotide
gatacgccctcctgtcgaccctagtaaccggtgtc

SEQ ID NO: 131983 - DNA, 30 bp, Artificial Sequence
  Synthetic oligonucleotide
tgagccggaccacccacgcaccgctccttg

SEQ ID NO: 131984 - DNA, 35 bp, Artificial Sequence
  Synthetic oligonucleotide
tcacgatccctgcagatagttcaccctgctcacct

SEQ ID NO: 131985 - DNA, 35 bp, Artificial Sequence
  Synthetic oligonucleotide
tcctccgccgcttgcgttttctagccggtactttt

SEQ ID NO: 131986 - DNA, 36 bp, Artificial Sequence
  Synthetic oligonucleotide
gtgttacctcttgcttgtatcgctcccttctcccaa

SEQ ID NO: 131987 - DNA, 36 bp, Artificial Sequence
  Synthetic oligonucleotide
agtgcctcctcttcggttgttctatcgcacttctca

SEQ ID NO: 131988 - DNA, 37 bp, Artificial Sequence
  Synthetic oligonucleotide
atcagcaagggtcgcgtgggggggagtgagggttgga

SEQ ID NO: 131989 - DNA, 38 bp, Artificial Sequence
  Synthetic oligonucleotide
gctggaggggggtgggaggggacggatcaacggcatga

SEQ ID NO: 131990 - DNA, 35 bp, Artificial Sequence
  Synthetic oligonucleotide
atggtgccatcggctgccccttcccctgtttaaac

SEQ ID NO: 131991 - DNA, 35 bp, Artificial Sequence
  Synthetic oligonucleotide
gccaccttgcctgttcacacttatacggtattaac

SEQ ID NO: 131992 - DNA, 35 bp, Artificial Sequence
  Synthetic oligonucleotide
tgtccgcgatcagctcattccagcgcctcctttac

SEQ ID NO: 131993 - DNA, 35 bp, Artificial Sequence
  Synthetic oligonucleotide
acccgccttaagactgcccttcgagttcaattccc

SEQ ID NO: 131994 - DNA, 35 bp, Artificial Sequence
  Synthetic oligonucleotide
ttgggcccgcccccccgatacgtatgtccactggt

SEQ ID NO: 131995 - DNA, 35 bp, Artificial Sequence
  Synthetic oligonucleotide
tcatcgctgccctaatgcgactttcgtgaaccctt

SEQ ID NO: 131996 - DNA, 35 bp, Artificial Sequence
  Synthetic oligonucleotide
gcaccgcgatgcttcgtgggcacctaccttttcaa

SEQ ID NO: 131997 - DNA, 35 bp, Artificial Sequence
  Synthetic oligonucleotide
tcgagactcgccctccacatctcgaaccactacca

SEQ ID NO: 131998 - DNA, 36 bp, Artificial Sequence
  Synthetic oligonucleotide
tcatctccccgcatggtaatacctcccatcttccca

SEQ ID NO: 131999 - DNA, 36 bp, Artificial Sequence
  Synthetic oligonucleotide
ttctgcccgagctgttcctatttttcgcacccctca

SEQ ID NO: 132000 - DNA, 35 bp, Artificial Sequence
  Synthetic oligonucleotide
atcgagggaacaggggggtggggggcgtgttcaga

SEQ ID NO: 132001 - DNA, 37 bp, Artificial Sequence
  Synthetic oligonucleotide
atcatccactgatcagtttgccaccgccataccccga

SEQ ID NO: 132002 - DNA, 37 bp, Artificial Sequence
  Synthetic oligonucleotide
accccgcctgagcctccatgccattgtcttatctcga

SEQ ID NO: 132003 - DNA, 36 bp, Artificial Sequence
  Synthetic oligonucleotide
ttgacccccgtcccttttgtatttttaccccttcga

SEQ ID NO: 132004 - DNA, 37 bp, Artificial Sequence
  Synthetic oligonucleotide
gagttcggacgggggggggagggcaaacccttgggga

SEQ ID NO: 132005 - DNA, 37 bp, Artificial Sequence
  Synthetic oligonucleotide
agactccccgccctcctctagcaacaggtcagcttga

SEQ ID NO: 132006 - DNA, 35 bp, Artificial Sequence
  Synthetic oligonucleotide
tcccgtacatcccctggctattgccgttttgccta

SEQ ID NO: 132007 - DNA, 36 bp, Artificial Sequence
  Synthetic oligonucleotide
gtataccccgcactcgcccgaacgtcctgctttcta

SEQ ID NO: 132008 - DNA, 35 bp, Artificial Sequence
  Synthetic oligonucleotide
tctccctcccgtcttgcattacagctgcctgcgta

SEQ ID NO: 132009 - DNA, 35 bp, Artificial Sequence
  Synthetic oligonucleotide
gatgcgcgcttaagctgaactccccactcgtccac

SEQ ID NO: 132010 - DNA, 35 bp, Artificial Sequence
  Synthetic oligonucleotide
gtatgccgtcctattccatctctcggtctgttagc

SEQ ID NO: 132011 - DNA, 35 bp, Artificial Sequence
  Synthetic oligonucleotide
agcgccccattgccttttactccccgacggtcggc

SEQ ID NO: 132012 - DNA, 35 bp, Artificial Sequence
  Synthetic oligonucleotide
tccatccgcctttcaggggctacctccccaccctc

SEQ ID NO: 132013 - DNA, 35 bp, Artificial Sequence
  Synthetic oligonucleotide
tacgtcggtaccgcttctcctcctcagctactgtc

SEQ ID NO: 132014 - DNA, 35 bp, Artificial Sequence
  Synthetic oligonucleotide
aaaccggtcagttatcctggtatcattctcccccg

SEQ ID NO: 132015 - DNA, 35 bp, Artificial Sequence
  Synthetic oligonucleotide
tgcacccccctcacacgtgattgttccgcctatgg

SEQ ID NO: 132016 - DNA, 35 bp, Artificial Sequence
  Synthetic oligonucleotide
accccactacatctgtctatcctcacccacttgtg

SEQ ID NO: 132017 - DNA, 35 bp, Artificial Sequence
  Synthetic oligonucleotide
ttggcgacactgctacccccgctccagctcactat

SEQ ID NO: 132018 - DNA, 35 bp, Artificial Sequence
  Synthetic oligonucleotide
tgcatccgtggttcagctgtcgcactactccccct

SEQ ID NO: 132019 - DNA, 35 bp, Artificial Sequence
  Synthetic oligonucleotide
gactgccccacgcatttccccaagccgctccgcct

SEQ ID NO: 132020 - DNA, 37 bp, Artificial Sequence
  Synthetic oligonucleotide
ttctgccccctctgtagacccccgccacctgccatga

SEQ ID NO: 132021 - DNA, 38 bp, Artificial Sequence
  Synthetic oligonucleotide
ttccatgccgcctgccctatattacacgcccccattga

SEQ ID NO: 132022 - DNA, 38 bp, Artificial Sequence
  Synthetic oligonucleotide
aacgccttccgcatcctggtacgctcttgactcgttga

SEQ ID NO: 132023 - DNA, 35 bp, Artificial Sequence
  Synthetic oligonucleotide
atagctcgcatctcttcgtgtccttcactcccacc

SEQ ID NO: 132024 - DNA, 35 bp, Artificial Sequence
  Synthetic oligonucleotide
tcatctctgcccccctgaggccttaccgtgcaccc

SEQ ID NO: 132025 - DNA, 35 bp, Artificial Sequence
  Synthetic oligonucleotide
attcgcaaacgcttgcctctatttatgcaccctcc

SEQ ID NO: 132026 - DNA, 35 bp, Artificial Sequence
  Synthetic oligonucleotide
gccacatttcaatagtcccctggagcctgttttcc

SEQ ID NO: 132027 - DNA, 35 bp, Artificial Sequence
  Synthetic oligonucleotide
tcgcatgtcgaccaagtccgccgtccttcgttatc

SEQ ID NO: 132028 - DNA, 35 bp, Artificial Sequence
  Synthetic oligonucleotide
acacacgataggttccgttgctgcacgctttcctc

SEQ ID NO: 132029 - DNA, 35 bp, Artificial Sequence
  Synthetic oligonucleotide
gcccgcggcccgcacgtctcgttcacctcatgccg

SEQ ID NO: 132030 - DNA, 35 bp, Artificial Sequence
  Synthetic oligonucleotide
atgcggccctgccatttcccttcaacaccgctccg

SEQ ID NO: 132031 - DNA, 34 bp, Artificial Sequence
  Synthetic oligonucleotide
gcactaccctcaaaccccaccctctgtccacgtg

SEQ ID NO: 132032 - DNA, 35 bp, Artificial Sequence
  Synthetic oligonucleotide
tcgaaaaccctgttctgctactccacacatacgtg

SEQ ID NO: 132033 - DNA, 35 bp, Artificial Sequence
  Synthetic oligonucleotide
ggagatgacgggtgggggagcaatgggaaaagact

SEQ ID NO: 132034 - DNA, 35 bp, Artificial Sequence
  Synthetic oligonucleotide
gccatgttccgtgagccgcttgtcttcccacccct

SEQ ID NO: 132035 - DNA, 35 bp, Artificial Sequence
  Synthetic oligonucleotide
gatcgaaccatcacccggcatatccttcacctcgt

SEQ ID NO: 132036 - DNA, 36 bp, Artificial Sequence
  Synthetic oligonucleotide
ttcccgcccccacgccttctactgttcggttttgaa

SEQ ID NO: 132037 - DNA, 35 bp, Artificial Sequence
  Synthetic oligonucleotide
ggccccgaccgtcctgtcctcgcctcccccttcca

SEQ ID NO: 132038 - DNA, 37 bp, Artificial Sequence
  Synthetic oligonucleotide
ttctaggggaagtaggggggacggagatagaacggga

SEQ ID NO: 132039 - DNA, 36 bp, Artificial Sequence
  Synthetic oligonucleotide
tgaacggtgggaggggtgaggaaggttctccgggga

SEQ ID NO: 132040 - DNA, 37 bp, Artificial Sequence
  Synthetic oligonucleotide
agcacacggtcagctcttactcccctccctgtctgga

SEQ ID NO: 132041 - DNA, 38 bp, Artificial Sequence
  Synthetic oligonucleotide
tacatgagaccggaggaagggagcgagcgggacggtga

SEQ ID NO: 132042 - DNA, 35 bp, Artificial Sequence
  Synthetic oligonucleotide
gtatgtgcaccctctgcgctttccctccgctcgcc

SEQ ID NO: 132043 - DNA, 35 bp, Artificial Sequence
  Synthetic oligonucleotide
tgatcccaccccgctccgtccactaggccacttcc

SEQ ID NO: 132044 - DNA, 35 bp, Artificial Sequence
  Synthetic oligonucleotide
ccacaagcggatgcctctgatcctctgccccccgc

SEQ ID NO: 132045 - DNA, 35 bp, Artificial Sequence
  Synthetic oligonucleotide
gtgcacgtggcaagggaagggggaacggctgtgcg

SEQ ID NO: 132046 - DNA, 35 bp, Artificial Sequence
  Synthetic oligonucleotide
gatcacttcatccgcatgggcctttactaccctcg

SEQ ID NO: 132047 - DNA, 35 bp, Artificial Sequence
  Synthetic oligonucleotide
acctcaaccctccatgtattgcgctccgcttgctg

SEQ ID NO: 132048 - DNA, 35 bp, Artificial Sequence
  Synthetic oligonucleotide
gcccccgctcgcaacctagccttacactgcccact

SEQ ID NO: 132049 - DNA, 35 bp, Artificial Sequence
  Synthetic oligonucleotide
gtatgcccccgccactctgtttacgttttaaaagt

SEQ ID NO: 132050 - DNA, 36 bp, Artificial Sequence
  Synthetic oligonucleotide
tcgcctaaacgcctctgcatcgatcgcccttctgca

SEQ ID NO: 132051 - DNA, 36 bp, Artificial Sequence
  Synthetic oligonucleotide
gcccatgacggtgtccgtctcataaaccacctctca

SEQ ID NO: 132052 - DNA, 36 bp, Artificial Sequence
  Synthetic oligonucleotide
aacctagccccacccattgcgttcactctggcttca

SEQ ID NO: 132053 - DNA, 36 bp, Artificial Sequence
  Synthetic oligonucleotide
gtacccgatcctcttgactccccccgctaaagacga

SEQ ID NO: 132054 - DNA, 37 bp, Artificial Sequence
  Synthetic oligonucleotide
acctcgacacccatttacaagccttcaccgtgcccga

SEQ ID NO: 132055 - DNA, 37 bp, Artificial Sequence
  Synthetic oligonucleotide
agcctgtgcgcgacgtccccctccagcctcctcccga

SEQ ID NO: 132056 - DNA, 35 bp, Artificial Sequence
  Synthetic oligonucleotide
ttggtcctccccttctatgctacttggtactccga

SEQ ID NO: 132057 - DNA, 38 bp, Artificial Sequence
  Synthetic oligonucleotide
gtccatgacgctgtcttgttcttgcactcctttcctga

SEQ ID NO: 132058 - DNA, 35 bp, Artificial Sequence
  Synthetic oligonucleotide
ataccaccgcaagattctccgctccaactccgtac

SEQ ID NO: 132059 - DNA, 35 bp, Artificial Sequence
  Synthetic oligonucleotide
ggtaccgcagcaattgcttcaagcctgttcgcccc

SEQ ID NO: 132060 - DNA, 35 bp, Artificial Sequence
  Synthetic oligonucleotide
gctactcgcccggactgacccgcctatcgactccc

SEQ ID NO: 132061 - DNA, 35 bp, Artificial Sequence
  Synthetic oligonucleotide
tgatccacgtgaccgccgaccgccacatcccttcc

SEQ ID NO: 132062 - DNA, 34 bp, Artificial Sequence
  Synthetic oligonucleotide
ttcgcctccccattgcttgttccatccgtcttcc

SEQ ID NO: 132063 - DNA, 35 bp, Artificial Sequence
  Synthetic oligonucleotide
ttcaccgggcgttggtccatcctccccgcttacgc

SEQ ID NO: 132064 - DNA, 35 bp, Artificial Sequence
  Synthetic oligonucleotide
gtatgaccccgcctcttctctttaccgccgacggc

SEQ ID NO: 132065 - DNA, 35 bp, Artificial Sequence
  Synthetic oligonucleotide
taacacctcaacccctgtgccgcactgtttgcatc

SEQ ID NO: 132066 - DNA, 35 bp, Artificial Sequence
  Synthetic oligonucleotide
atccactggcgtgcccctgcgcaccactctctgtc

SEQ ID NO: 132067 - DNA, 35 bp, Artificial Sequence
  Synthetic oligonucleotide
gtgggtcacctcccatcctgattcacgtgattttc

SEQ ID NO: 132068 - DNA, 35 bp, Artificial Sequence
  Synthetic oligonucleotide
gtgtcaggggaaaggacatggaaagggggggaaag

SEQ ID NO: 132069 - DNA, 35 bp, Artificial Sequence
  Synthetic oligonucleotide
ggtagaataggaagggtgaaaggaagggcaggaag

SEQ ID NO: 132070 - DNA, 35 bp, Artificial Sequence
  Synthetic oligonucleotide
gaccatccccgcatgcactcttacagcacctaacg

SEQ ID NO: 132071 - DNA, 35 bp, Artificial Sequence
  Synthetic oligonucleotide
tgaggcctggtcactgcttctatgcttcttcttcg

SEQ ID NO: 132072 - DNA, 35 bp, Artificial Sequence
  Synthetic oligonucleotide
taacctctccgacctgctcaagcctctctcgctat

SEQ ID NO: 132073 - DNA, 35 bp, Artificial Sequence
  Synthetic oligonucleotide
aatgctcgcatacacacgacccgcttgtcccgact

SEQ ID NO: 132074 - DNA, 35 bp, Artificial Sequence
  Synthetic oligonucleotide
acgggtgcagggggtacgggtggggaggggcactt

SEQ ID NO: 132075 - DNA, 35 bp, Artificial Sequence
  Synthetic oligonucleotide
ggacgggcgggagtggggcgggatcgaattatgtt

SEQ ID NO: 132076 - DNA, 35 bp, Artificial Sequence
  Synthetic oligonucleotide
gcgctactcaatcctgtccctcagccccacacttt

SEQ ID NO: 132077 - DNA, 35 bp, Artificial Sequence
  Synthetic oligonucleotide
gctccgtacaactgactttcgtgtccaccgccttt

SEQ ID NO: 132078 - DNA, 36 bp, Artificial Sequence
  Synthetic oligonucleotide
ggggtcggtggaagggagacgggggaagaagcgcaa

SEQ ID NO: 132079 - DNA, 36 bp, Artificial Sequence
  Synthetic oligonucleotide
acgttccacgagctgtctcgtgcctgcctcccccca

SEQ ID NO: 132080 - DNA, 36 bp, Artificial Sequence
  Synthetic oligonucleotide
gtcccgaacagatctgcattcgtttccgtccgtcca

SEQ ID NO: 132081 - DNA, 36 bp, Artificial Sequence
  Synthetic oligonucleotide
aacacgcgcactaaccgttttccgattccgccccga

SEQ ID NO: 132082 - DNA, 37 bp, Artificial Sequence
  Synthetic oligonucleotide
tcacaaggccggggagggtgaggcgggcgaggatcga

SEQ ID NO: 132083 - DNA, 36 bp, Artificial Sequence
  Synthetic oligonucleotide
gtagaggtggacaggtggaaggggggcaaagcggga

SEQ ID NO: 132084 - DNA, 37 bp, Artificial Sequence
  Synthetic oligonucleotide
ttagccgcccccgagcgccctcttcacccttttggga

SEQ ID NO: 132085 - DNA, 37 bp, Artificial Sequence
  Synthetic oligonucleotide
gggggggaccaaatggggtggtgatcaaacggggtga

SEQ ID NO: 132086 - DNA, 35 bp, Artificial Sequence
  Synthetic oligonucleotide
tcctacctgccccgggtacctgtgcctgtccaacc

SEQ ID NO: 132087 - DNA, 35 bp, Artificial Sequence
  Synthetic oligonucleotide
taacgccatggtcctggcgaacattatgacctccc

SEQ ID NO: 132088 - DNA, 35 bp, Artificial Sequence
  Synthetic oligonucleotide
tcgataacgcctcattaagtccctctatagccgcc

SEQ ID NO: 132089 - DNA, 35 bp, Artificial Sequence
  Synthetic oligonucleotide
gtcaccccgcctgtactaccatcacggacagggcc

SEQ ID NO: 132090 - DNA, 35 bp, Artificial Sequence
  Synthetic oligonucleotide
atccacctcttcccgtgatcgcttatgctaatagc

SEQ ID NO: 132091 - DNA, 35 bp, Artificial Sequence
  Synthetic oligonucleotide
ttgtaccatcgggcaataacgttcctctacgcctc

SEQ ID NO: 132092 - DNA, 29 bp, Artificial Sequence
  Synthetic oligonucleotide
gaccatcgcggtattacttgtccattctc

SEQ ID NO: 132093 - DNA, 35 bp, Artificial Sequence
  Synthetic oligonucleotide
acaccgcccggcccatggttgaccacatgcttctc

SEQ ID NO: 132094 - DNA, 35 bp, Artificial Sequence
  Synthetic oligonucleotide
gtcaacgaacaccccgcgcccatcatgtccccttc

SEQ ID NO: 132095 - DNA, 34 bp, Artificial Sequence
  Synthetic oligonucleotide
acacgcacccccgaaacccgatccggacgcctcg

SEQ ID NO: 132096 - DNA, 35 bp, Artificial Sequence
  Synthetic oligonucleotide
ggtcatgtccaccgtaccaccttgctcccgcgcat

SEQ ID NO: 132097 - DNA, 35 bp, Artificial Sequence
  Synthetic oligonucleotide
tcacgtcctgcggcgtcttttactaccacccttca

SEQ ID NO: 132098 - DNA, 37 bp, Artificial Sequence
  Synthetic oligonucleotide
tgccccatcgcccgtagtttagccgccttgtcccaga

SEQ ID NO: 132099 - DNA, 36 bp, Artificial Sequence
  Synthetic oligonucleotide
agatgcgcccatctagcccggaccgcctgaccccga

SEQ ID NO: 132100 - DNA, 37 bp, Artificial Sequence
  Synthetic oligonucleotide
tacgggtgggggtcggggatctctgttgggggtccga

SEQ ID NO: 132101 - DNA, 37 bp, Artificial Sequence
  Synthetic oligonucleotide
accacccgtccgatcttcacttgctctttagcgtcga

SEQ ID NO: 132102 - DNA, 38 bp, Artificial Sequence
  Synthetic oligonucleotide
gcgatacgcgtgtgtcgtacacctctcttcctcgttga

SEQ ID NO: 132103 - DNA, 38 bp, Artificial Sequence
  Synthetic oligonucleotide
agggtgagacggatgggcgcaaaggtcgtacactttga

SEQ ID NO: 132104 - DNA, 35 bp, Artificial Sequence
  Synthetic oligonucleotide
tgacccctcctcatgcccaccacggtcactttgcc

SEQ ID NO: 132105 - DNA, 35 bp, Artificial Sequence
  Synthetic oligonucleotide
acactcgtcatcctataataccatgctcgccgtcc

SEQ ID NO: 132106 - DNA, 35 bp, Artificial Sequence
  Synthetic oligonucleotide
gtccactgccctcactccagcccacgctccacatc

SEQ ID NO: 132107 - DNA, 35 bp, Artificial Sequence
  Synthetic oligonucleotide
gaccaccccgtttcattacgatcacaggttacatc

SEQ ID NO: 132108 - DNA, 35 bp, Artificial Sequence
  Synthetic oligonucleotide
atggtcgatccccaggccgtcttcgcccgcccctc

SEQ ID NO: 132109 - DNA, 35 bp, Artificial Sequence
  Synthetic oligonucleotide
gagggggggtagggaatagaacgggcggaagttgg

SEQ ID NO: 132110 - DNA, 35 bp, Artificial Sequence
  Synthetic oligonucleotide
ggggccagtgtgtctcctcccgcctcccgtttctg

SEQ ID NO: 132111 - DNA, 35 bp, Artificial Sequence
  Synthetic oligonucleotide
acctcagcacgccgttgccgctacgaacccgttat

SEQ ID NO: 132112 - DNA, 35 bp, Artificial Sequence
  Synthetic oligonucleotide
gcaagggaggggaaaaaaaggggtcgaaatgggct

SEQ ID NO: 132113 - DNA, 35 bp, Artificial Sequence
  Synthetic oligonucleotide
tcccacaccaccttcgaccccgcgagtatcgatct

SEQ ID NO: 132114 - DNA, 35 bp, Artificial Sequence
  Synthetic oligonucleotide
tataggggtagggtgtggaaaaggggaagggccgt

SEQ ID NO: 132115 - DNA, 35 bp, Artificial Sequence
  Synthetic oligonucleotide
gactcatcagcgtggcgccctttaccgtccttggt

SEQ ID NO: 132116 - DNA, 36 bp, Artificial Sequence
  Synthetic oligonucleotide
tgaccctgcctccccgccgaccgagcaattgcttaa

SEQ ID NO: 132117 - DNA, 36 bp, Artificial Sequence
  Synthetic oligonucleotide
gatatccccgtcattagttctatctcatgtctatca

SEQ ID NO: 132118 - DNA, 37 bp, Artificial Sequence
  Synthetic oligonucleotide
agacacccccctccatccgtatttaaaacgccatcga

SEQ ID NO: 132119 - DNA, 37 bp, Artificial Sequence
  Synthetic oligonucleotide
tcaccccaccgcctaccaggtcatgcattccgcatga

SEQ ID NO: 132120 - DNA, 38 bp, Artificial Sequence
  Synthetic oligonucleotide
accgcccggtgcccttgccttatgtccccactttgtga

SEQ ID NO: 132121 - DNA, 36 bp, Artificial Sequence
  Synthetic oligonucleotide
acggaccgcccccacttgccccctcgtttaggtcta

SEQ ID NO: 132122 - DNA, 36 bp, Artificial Sequence
  Synthetic oligonucleotide
tacaagggtgggtgggggttgacttacagttgggta

SEQ ID NO: 132123 - DNA, 35 bp, Artificial Sequence
  Synthetic oligonucleotide
tatccagtcggaggtgctgccccaagtcccttacc

SEQ ID NO: 132124 - DNA, 35 bp, Artificial Sequence
  Synthetic oligonucleotide
gatgagatcccgtcgcacccccgtctgttcactcc

SEQ ID NO: 132125 - DNA, 35 bp, Artificial Sequence
  Synthetic oligonucleotide
gagacgtcatgtgacatttcattcgtctgcacctc

SEQ ID NO: 132126 - DNA, 35 bp, Artificial Sequence
  Synthetic oligonucleotide
tgcctccctgataattacgcgctaagctctgcctc

SEQ ID NO: 132127 - DNA, 35 bp, Artificial Sequence
  Synthetic oligonucleotide
gatcaacacgcggcggatccgttcttctctgtccg

SEQ ID NO: 132128 - DNA, 35 bp, Artificial Sequence
  Synthetic oligonucleotide
gactaggggagaggggaccaatcatagggggacgg

SEQ ID NO: 132129 - DNA, 35 bp, Artificial Sequence
  Synthetic oligonucleotide
gagggagatggcgaaggcgggtccggacgaggggg

SEQ ID NO: 132130 - DNA, 35 bp, Artificial Sequence
  Synthetic oligonucleotide
agcctaccccctcgcctcgcctcgcatccacgcat

SEQ ID NO: 132131 - DNA, 36 bp, Artificial Sequence
  Synthetic oligonucleotide
agaagggggtgcagggacgggagggcattcggtcaa

SEQ ID NO: 132132 - DNA, 36 bp, Artificial Sequence
  Synthetic oligonucleotide
tccagccccgtcctgtattcgctccgttgcctgaca

SEQ ID NO: 132133 - DNA, 36 bp, Artificial Sequence
  Synthetic oligonucleotide
gctccgtacgctcctccatggcccagcagtttccca

SEQ ID NO: 132134 - DNA, 35 bp, Artificial Sequence
  Synthetic oligonucleotide
ttcgctagccggagatgcccgtccgttcgccttca

SEQ ID NO: 132135 - DNA, 37 bp, Artificial Sequence
  Synthetic oligonucleotide
ttgtctgctcctggtttcccacccctcccctgccgga

SEQ ID NO: 132136 - DNA, 38 bp, Artificial Sequence
  Synthetic oligonucleotide
accccgccactctatcccggtaccatcaccttgagtga

SEQ ID NO: 132137 - DNA, 38 bp, Artificial Sequence
  Synthetic oligonucleotide
aactgcctgccgcccatcgcagtgttgcccatccttga

SEQ ID NO: 132138 - DNA, 35 bp, Artificial Sequence
  Synthetic oligonucleotide
tacgccccaacgaactttacggagtaactgacccc

SEQ ID NO: 132139 - DNA, 35 bp, Artificial Sequence
  Synthetic oligonucleotide
gccgtgcgccaaagcgtcccctcgacgtacccgcc

SEQ ID NO: 132140 - DNA, 35 bp, Artificial Sequence
  Synthetic oligonucleotide
gaccgcccacggttgccttgccatttggtcttgcc

SEQ ID NO: 132141 - DNA, 35 bp, Artificial Sequence
  Synthetic oligonucleotide
gcccccaccatggcgatatccactccttgcacagc

SEQ ID NO: 132142 - DNA, 35 bp, Artificial Sequence
  Synthetic oligonucleotide
tcgagctcggcaatttgcacctacgcccgcacctc

SEQ ID NO: 132143 - DNA, 35 bp, Artificial Sequence
  Synthetic oligonucleotide
acttgccccccggctggtctctagtcgctccctag

SEQ ID NO: 132144 - DNA, 35 bp, Artificial Sequence
  Synthetic oligonucleotide
tatccgctgcctacaacaccgcccgatgccccccg

SEQ ID NO: 132145 - DNA, 35 bp, Artificial Sequence
  Synthetic oligonucleotide
tgacatgctgttacagttccttatttcacctcctg

SEQ ID NO: 132146 - DNA, 35 bp, Artificial Sequence
  Synthetic oligonucleotide
gctgtccaccgcagtcggtcttgcccaccccacgt

SEQ ID NO: 132147 - DNA, 35 bp, Artificial Sequence
  Synthetic oligonucleotide
gtgcaccaccccgtttcccttcactgtctcgtcgt

SEQ ID NO: 132148 - DNA, 35 bp, Artificial Sequence
  Synthetic oligonucleotide
gaccgctgccaccacccagcgacgcctctcttcgt

SEQ ID NO: 132149 - DNA, 35 bp, Artificial Sequence
  Synthetic oligonucleotide
tgtacatcccggcccccgtgcagacgccctttctt

SEQ ID NO: 132150 - DNA, 35 bp, Artificial Sequence
  Synthetic oligonucleotide
atgtcccctcacatgcgcaacatcgggcctaccaa

SEQ ID NO: 132151 - DNA, 36 bp, Artificial Sequence
  Synthetic oligonucleotide
cgtagagcccctcacggttatatatcgcctaccgaa

SEQ ID NO: 132152 - DNA, 38 bp, Artificial Sequence
  Synthetic oligonucleotide
acctcacccgataggtctctacaccagctcccccctga

SEQ ID NO: 132153 - DNA, 37 bp, Artificial Sequence
  Synthetic oligonucleotide
tactgcacctgctgctgcctcccatatcgggccctga

SEQ ID NO: 132154 - DNA, 38 bp, Artificial Sequence
  Synthetic oligonucleotide
tccctgccagatcgcgcaacatcactgccctttcttga

SEQ ID NO: 132155 - DNA, 36 bp, Artificial Sequence
  Synthetic oligonucleotide
tgctgtctcctggttctgtccctgtcgctttaccta

SEQ ID NO: 132156 - DNA, 36 bp, Artificial Sequence
  Synthetic oligonucleotide
gcgagagcgaagcgtttttggccaccctgcacccta

SEQ ID NO: 132157 - DNA, 36 bp, Artificial Sequence
  Synthetic oligonucleotide
acgagcctcttccgccatgccaagttccctcccgta

SEQ ID NO: 132158 - DNA, 35 bp, Artificial Sequence
  Synthetic oligonucleotide
acctaccggcgccctgactcgccactctacgccac

SEQ ID NO: 132159 - DNA, 35 bp, Artificial Sequence
  Synthetic oligonucleotide
gctgctctcccgactcgtacctgacgccccttccc

SEQ ID NO: 132160 - DNA, 35 bp, Artificial Sequence
  Synthetic oligonucleotide
acccccgtatagcatatgcctccactgattctgcc

SEQ ID NO: 132161 - DNA, 35 bp, Artificial Sequence
  Synthetic oligonucleotide
atatcgctagcccttgccgccatccgccccagtcc

SEQ ID NO: 132162 - DNA, 35 bp, Artificial Sequence
  Synthetic oligonucleotide
tagtcccaacttctatgttcttgctccttatgtcc

SEQ ID NO: 132163 - DNA, 35 bp, Artificial Sequence
  Synthetic oligonucleotide
atcgcccgcctgcatcctgattcatcactcgcttc

SEQ ID NO: 132164 - DNA, 35 bp, Artificial Sequence
  Synthetic oligonucleotide
tccgccgtacaagcgccaccttccccaacctctag

SEQ ID NO: 132165 - DNA, 35 bp, Artificial Sequence
  Synthetic oligonucleotide
gaacatgcacctccctgtttagttatacgctcacg

SEQ ID NO: 132166 - DNA, 35 bp, Artificial Sequence
  Synthetic oligonucleotide
tccatcgaccccgactacccctccattcatgcagg

SEQ ID NO: 132167 - DNA, 35 bp, Artificial Sequence
  Synthetic oligonucleotide
tcgatgtgccattcatgcgttctacctgttaacct

SEQ ID NO: 132168 - DNA, 28 bp, Artificial Sequence
  Synthetic oligonucleotide
tagtgctccaccattgctttcggtccct

SEQ ID NO: 132169 - DNA, 35 bp, Artificial Sequence
  Synthetic oligonucleotide
gtgccttactgctttgaatatgtctggtccctcct

SEQ ID NO: 132170 - DNA, 35 bp, Artificial Sequence
  Synthetic oligonucleotide
acccagtgccccgactactggttgtcccctcctct

SEQ ID NO: 132171 - DNA, 35 bp, Artificial Sequence
  Synthetic oligonucleotide
tcgtacccgcgaacacgttatttaccacccatcgt

SEQ ID NO: 132172 - DNA, 35 bp, Artificial Sequence
  Synthetic oligonucleotide
gatagcgcggttcttgaattgctgccttcctctgt

SEQ ID NO: 132173 - DNA, 35 bp, Artificial Sequence
  Synthetic oligonucleotide
tatcccatcagttgctgcccgatcctctaatgctt

SEQ ID NO: 132174 - DNA, 36 bp, Artificial Sequence
  Synthetic oligonucleotide
gcacagggagggtgggcagtaacaccccggggtaaa

SEQ ID NO: 132175 - DNA, 37 bp, Artificial Sequence
  Synthetic oligonucleotide
tcacacccgccttccgcagatcatccttgttgcacga

SEQ ID NO: 132176 - DNA, 37 bp, Artificial Sequence
  Synthetic oligonucleotide
gtccagcactcccgtgcgatgattacacctctaccga

SEQ ID NO: 132177 - DNA, 38 bp, Artificial Sequence
  Synthetic oligonucleotide
tacccccgcccttggatcacacgttactgaaaagttga

SEQ ID NO: 132178 - DNA, 35 bp, Artificial Sequence
  Synthetic oligonucleotide
gcacacactcaccgtctcacggccaccatgctgac

SEQ ID NO: 132179 - DNA, 35 bp, Artificial Sequence
  Synthetic oligonucleotide
tcagcggctcgcactcgtccgtccgctcccgcgcc

SEQ ID NO: 132180 - DNA, 35 bp, Artificial Sequence
  Synthetic oligonucleotide
agatcgcagactggcaatctctggtccctttttcc

SEQ ID NO: 132181 - DNA, 35 bp, Artificial Sequence
  Synthetic oligonucleotide
agtggtggcggagggttgtggcatggaaggtaggc

SEQ ID NO: 132182 - DNA, 35 bp, Artificial Sequence
  Synthetic oligonucleotide
tgatgcctcgcactgatattgatcaccgtaccatc

SEQ ID NO: 132183 - DNA, 35 bp, Artificial Sequence
  Synthetic oligonucleotide
atggtacagggtcccgcctccttgcttcgtgcctc

SEQ ID NO: 132184 - DNA, 35 bp, Artificial Sequence
  Synthetic oligonucleotide
tacctcgctgctaattgcactatcgttcctgcttc

SEQ ID NO: 132185 - DNA, 35 bp, Artificial Sequence
  Synthetic oligonucleotide
ataggaaacgcgcacctgtccctcctcagtccccg

SEQ ID NO: 132186 - DNA, 35 bp, Artificial Sequence
  Synthetic oligonucleotide
tagcacgtggtggaccgagggggggaagggttgcg

SEQ ID NO: 132187 - DNA, 35 bp, Artificial Sequence
  Synthetic oligonucleotide
tggaaggggggggagtcgcggtgggagggacaggg

SEQ ID NO: 132188 - DNA, 35 bp, Artificial Sequence
  Synthetic oligonucleotide
tgatgtgtaacccgtcctcccgcgctaatcacctg

SEQ ID NO: 132189 - DNA, 35 bp, Artificial Sequence
  Synthetic oligonucleotide
aaagagcggcctcctgtccatccctcgtgctattg

SEQ ID NO: 132190 - DNA, 35 bp, Artificial Sequence
  Synthetic oligonucleotide
acagacccaggctcctaagcacaccaccttcgtat

SEQ ID NO: 132191 - DNA, 35 bp, Artificial Sequence
  Synthetic oligonucleotide
acaccctccagacccccttcggtgtttacccgact

SEQ ID NO: 132192 - DNA, 35 bp, Artificial Sequence
  Synthetic oligonucleotide
tctggtcaggtccgccaccctgccgtatctcaatt

SEQ ID NO: 132193 - DNA, 36 bp, Artificial Sequence
  Synthetic oligonucleotide
gttgtcgcaacatctagttattgctccactttcaca

SEQ ID NO: 132194 - DNA, 35 bp, Artificial Sequence
  Synthetic oligonucleotide
gacgagggttatagaatagggaagggggggatgca

SEQ ID NO: 132195 - DNA, 36 bp, Artificial Sequence
  Synthetic oligonucleotide
gacggggggtccgctgctctatcccttcacttctca

SEQ ID NO: 132196 - DNA, 37 bp, Artificial Sequence
  Synthetic oligonucleotide
cccacccaccgcttatgtattctctcgcaccccccga

SEQ ID NO: 132197 - DNA, 35 bp, Artificial Sequence
  Synthetic oligonucleotide
gtagcgaacaagagcaggggaacgggtgggggcga

SEQ ID NO: 132198 - DNA, 36 bp, Artificial Sequence
  Synthetic oligonucleotide
ggagccgagctttgggaaggagcgggagggggctga

SEQ ID NO: 132199 - DNA, 37 bp, Artificial Sequence
  Synthetic oligonucleotide
gtggggaaagggagggggagcagggtagccattttga

SEQ ID NO: 132200 - DNA, 36 bp, Artificial Sequence
  Synthetic oligonucleotide
gactacaccgatctgttctggctctctggttcccta

SEQ ID NO: 132201 - DNA, 36 bp, Artificial Sequence
  Synthetic oligonucleotide
gggtagaggcgggctgggggcagggcgaggaggtta

SEQ ID NO: 132202 - DNA, 35 bp, Artificial Sequence
  Synthetic oligonucleotide
gaacgtcgatgtaatttactcctgtccgccgcacc

SEQ ID NO: 132203 - DNA, 35 bp, Artificial Sequence
  Synthetic oligonucleotide
gcatgagccgccacccgccttgtgacatctgcacc

SEQ ID NO: 132204 - DNA, 35 bp, Artificial Sequence
  Synthetic oligonucleotide
ggatccgacaaaactgatagttgccccccctgccc

SEQ ID NO: 132205 - DNA, 35 bp, Artificial Sequence
  Synthetic oligonucleotide
gtacgtcccctgccccagtccacagacctctttgc

SEQ ID NO: 132206 - DNA, 35 bp, Artificial Sequence
  Synthetic oligonucleotide
ataccaccgccgattgcgtgaggaaacgcaacatc

SEQ ID NO: 132207 - DNA, 35 bp, Artificial Sequence
  Synthetic oligonucleotide
tcaggcgccctctcttcggtaatattgcggccctc

SEQ ID NO: 132208 - DNA, 35 bp, Artificial Sequence
  Synthetic oligonucleotide
tacccgtcgtccctgcctttgtcgtctcctgcctc

SEQ ID NO: 132209 - DNA, 35 bp, Artificial Sequence
  Synthetic oligonucleotide
tagcgacgtcgactcatcttcaccttcgacctctc

SEQ ID NO: 132210 - DNA, 35 bp, Artificial Sequence
  Synthetic oligonucleotide
atctctgcctccaccttcatagggtgcctgcattc

SEQ ID NO: 132211 - DNA, 35 bp, Artificial Sequence
  Synthetic oligonucleotide
tgcaaggggtccaggtgggaggggtgtggggttag

SEQ ID NO: 132212 - DNA, 35 bp, Artificial Sequence
  Synthetic oligonucleotide
gaggtgcaaacgggtgggggtagtggggtagtgct

SEQ ID NO: 132213 - DNA, 35 bp, Artificial Sequence
  Synthetic oligonucleotide
ttcgcgtttcacctcctgtccttcctgtcaccggt

SEQ ID NO: 132214 - DNA, 35 bp, Artificial Sequence
  Synthetic oligonucleotide
tccacaagcctgacctcgttctttgccctattcaa

SEQ ID NO: 132215 - DNA, 35 bp, Artificial Sequence
  Synthetic oligonucleotide
tgagaaggaaggtggagataaatggtgaggcgtaa

SEQ ID NO: 132216 - DNA, 36 bp, Artificial Sequence
  Synthetic oligonucleotide
acccctcccccgtattcatgtctgcctcgcctagca

SEQ ID NO: 132217 - DNA, 35 bp, Artificial Sequence
  Synthetic oligonucleotide
ccatacccccgccggaacgttcattggtcttctca

SEQ ID NO: 132218 - DNA, 37 bp, Artificial Sequence
  Synthetic oligonucleotide
ggaagggacgggcagggcatgagggtggggcaaccga

SEQ ID NO: 132219 - DNA, 37 bp, Artificial Sequence
  Synthetic oligonucleotide
acaccgacatggccctacccgtccacctctttagtga

SEQ ID NO: 132220 - DNA, 35 bp, Artificial Sequence
  Synthetic oligonucleotide
acagatgcgctgccttggtccatttccgcgtacta

SEQ ID NO: 132221 - DNA, 35 bp, Artificial Sequence
  Synthetic oligonucleotide
tccactagccgccccgagcgtattcaatcacccta

SEQ ID NO: 132222 - DNA, 35 bp, Artificial Sequence
  Synthetic oligonucleotide
tacccccgctgctgcactccatcaacatcgcccac

SEQ ID NO: 132223 - DNA, 35 bp, Artificial Sequence
  Synthetic oligonucleotide
tagcgcgttacatcctgcgtgcgtctcccattcac

SEQ ID NO: 132224 - DNA, 35 bp, Artificial Sequence
  Synthetic oligonucleotide
tccgtaagccccattcgcgtagaaaccatccttac

SEQ ID NO: 132225 - DNA, 35 bp, Artificial Sequence
  Synthetic oligonucleotide
gctggaccatttgcccgctgtctcccacgctttac

SEQ ID NO: 132226 - DNA, 35 bp, Artificial Sequence
  Synthetic oligonucleotide
gtgctgcctgccaccattctgctctccgctgcacc

SEQ ID NO: 132227 - DNA, 35 bp, Artificial Sequence
  Synthetic oligonucleotide
actgattgtgaggtcgcccgtcgttgcccgccccc

SEQ ID NO: 132228 - DNA, 35 bp, Artificial Sequence
  Synthetic oligonucleotide
atgcgtactcgcctaaatttgtttgtcaccgcgcc

SEQ ID NO: 132229 - DNA, 35 bp, Artificial Sequence
  Synthetic oligonucleotide
tcagggaagtgggggatggggcaggggtagcttcc

SEQ ID NO: 132230 - DNA, 35 bp, Artificial Sequence
  Synthetic oligonucleotide
gtgggccgacagcccgccccccatgtccctcaggc

SEQ ID NO: 132231 - DNA, 34 bp, Artificial Sequence
  Synthetic oligonucleotide
ttgaccccgtacgggcctcacatttctgaacatc

SEQ ID NO: 132232 - DNA, 35 bp, Artificial Sequence
  Synthetic oligonucleotide
gtgccgcgcactcgtaatcatctaggctctacctc

SEQ ID NO: 132233 - DNA, 35 bp, Artificial Sequence
  Synthetic oligonucleotide
tatacgtcaaactccgcctgtccttaggtcccccg

SEQ ID NO: 132234 - DNA, 35 bp, Artificial Sequence
  Synthetic oligonucleotide
aagaggacggggagggaggaaatgccagagtatgg

SEQ ID NO: 132235 - DNA, 35 bp, Artificial Sequence
  Synthetic oligonucleotide
aactcgcctcgagttacttagactccctatcacat

SEQ ID NO: 132236 - DNA, 35 bp, Artificial Sequence
  Synthetic oligonucleotide
ttgtggaccgccgttcaacattagttatcccccct

SEQ ID NO: 132237 - DNA, 36 bp, Artificial Sequence
  Synthetic oligonucleotide
gtcctccgccgctcaatgccgccgttctaatcccca

SEQ ID NO: 132238 - DNA, 36 bp, Artificial Sequence
  Synthetic oligonucleotide
tacaaccgcccggctgtgccactgctgcatctccca

SEQ ID NO: 132239 - DNA, 37 bp, Artificial Sequence
  Synthetic oligonucleotide
acgtgggcgagggggtggtaaacgtggggaggggcga

SEQ ID NO: 132240 - DNA, 37 bp, Artificial Sequence
  Synthetic oligonucleotide
gagagaggagaggaggcatgatacagggaagtgtgga

SEQ ID NO: 132241 - DNA, 38 bp, Artificial Sequence
  Synthetic oligonucleotide
aaagggaaggtgggagggcgtggaacatgaacaggtga

SEQ ID NO: 132242 - DNA, 36 bp, Artificial Sequence
  Synthetic oligonucleotide
ggacacccctccgtcatcatccaccgactcctgtga

SEQ ID NO: 132243 - DNA, 35 bp, Artificial Sequence
  Synthetic oligonucleotide
atcactccccctgctgccttacttgtttccgcgta

SEQ ID NO: 132244 - DNA, 35 bp, Artificial Sequence
  Synthetic oligonucleotide
gtctattgcacacctgcccgagcctcgcccttgta

SEQ ID NO: 132245 - DNA, 35 bp, Artificial Sequence
  Synthetic oligonucleotide
ttgcccccacgggcggtcctcttcattcttgccac

SEQ ID NO: 132246 - DNA, 35 bp, Artificial Sequence
  Synthetic oligonucleotide
tcctcccacgctcacccagctgcaatgcacctgac

SEQ ID NO: 132247 - DNA, 35 bp, Artificial Sequence
  Synthetic oligonucleotide
gacaacccgtaccagtcctttctgcacgccttacc

SEQ ID NO: 132248 - DNA, 35 bp, Artificial Sequence
  Synthetic oligonucleotide
gtttgatccgtcgcgtcgtccctcttccgccgccc

SEQ ID NO: 132249 - DNA, 35 bp, Artificial Sequence
  Synthetic oligonucleotide
tcactcttcacgccactttcatgtcctacagcctc

SEQ ID NO: 132250 - DNA, 35 bp, Artificial Sequence
  Synthetic oligonucleotide
tgccgaccagacacacctgttctactcccctctcg

SEQ ID NO: 132251 - DNA, 35 bp, Artificial Sequence
  Synthetic oligonucleotide
ggtccctgtcccacgtctgtcctggcttctttact

SEQ ID NO: 132252 - DNA, 35 bp, Artificial Sequence
  Synthetic oligonucleotide
tgaccaccccgtgcatccttgctccatggaacatt

SEQ ID NO: 132253 - DNA, 35 bp, Artificial Sequence
  Synthetic oligonucleotide
atcccgtcccttgtcctcaggtttagcaccccatt

SEQ ID NO: 132254 - DNA, 35 bp, Artificial Sequence
  Synthetic oligonucleotide
gactcagtatgtctattccgccagccccctgcctt

SEQ ID NO: 132255 - DNA, 35 bp, Artificial Sequence
  Synthetic oligonucleotide
gtggcggaggcgggggttggatggagggcaatcaa

SEQ ID NO: 132256 - DNA, 35 bp, Artificial Sequence
  Synthetic oligonucleotide
gtcccacgaagaacgaggatgaggaaggagggaca

SEQ ID NO: 132257 - DNA, 35 bp, Artificial Sequence
  Synthetic oligonucleotide
gactgcccccagtcctgacgaagtcttttggtcca

SEQ ID NO: 132258 - DNA, 36 bp, Artificial Sequence
  Synthetic oligonucleotide
tcccatcccatggtccactgcctgtccgcccgggca

SEQ ID NO: 132259 - DNA, 37 bp, Artificial Sequence
  Synthetic oligonucleotide
aacgtggcagggggtagcagggcgggatggacgacga

SEQ ID NO: 132260 - DNA, 36 bp, Artificial Sequence
  Synthetic oligonucleotide
gcacccccggttgcttaacccaccccttgttaccga

SEQ ID NO: 132261 - DNA, 37 bp, Artificial Sequence
  Synthetic oligonucleotide
taggggggagggggtcgggtaagaagaacgtgcagga

SEQ ID NO: 132262 - DNA, 37 bp, Artificial Sequence
  Synthetic oligonucleotide
ggggcgggatcaataggggtctctgaatagttgggga

SEQ ID NO: 132263 - DNA, 37 bp, Artificial Sequence
  Synthetic oligonucleotide
tggatgcaaagagggcgggattcgaagggagggtgga

SEQ ID NO: 132264 - DNA, 38 bp, Artificial Sequence
  Synthetic oligonucleotide
gacgggtccgggtgggagggaagctccgtgttacctga

SEQ ID NO: 132265 - DNA, 38 bp, Artificial Sequence
  Synthetic oligonucleotide
tagcgcctcgcctgtcttctctcttcgcctcatcctga

SEQ ID NO: 132266 - DNA, 38 bp, Artificial Sequence
  Synthetic oligonucleotide
tccacgcctcacgtatctttatcatctagtcgcattga

SEQ ID NO: 132267 - DNA, 38 bp, Artificial Sequence
  Synthetic oligonucleotide
tgagagggtaaggggtggcatgggaagggaacacttga

SEQ ID NO: 132268 - DNA, 36 bp, Artificial Sequence
  Synthetic oligonucleotide
tcaccccaccgattgttttgcccgggcgctccgtta

SEQ ID NO: 132269 - DNA, 35 bp, Artificial Sequence
  Synthetic oligonucleotide
gatcctcaccgcccacagctaggtacacctcgtac

SEQ ID NO: 132270 - DNA, 35 bp, Artificial Sequence
  Synthetic oligonucleotide
tgtgtcgacgtcgcccctgtctctggacttccacc

SEQ ID NO: 132271 - DNA, 35 bp, Artificial Sequence
  Synthetic oligonucleotide
gcatcaggcacattagcctatttttgttccacccc

SEQ ID NO: 132272 - DNA, 35 bp, Artificial Sequence
  Synthetic oligonucleotide
ttgcctccctgcgtctccagaacgttgcgcctccc

SEQ ID NO: 132273 - DNA, 35 bp, Artificial Sequence
  Synthetic oligonucleotide
atctcccccctctgcaggcctcgactgtaaaggcc

SEQ ID NO: 132274 - DNA, 35 bp, Artificial Sequence
  Synthetic oligonucleotide
tcccactcctgcactattcacgtcctgtccgtgcc

SEQ ID NO: 132275 - DNA, 35 bp, Artificial Sequence
  Synthetic oligonucleotide
gagccgcaatgggtttttacttgtcccacctttcc

SEQ ID NO: 132276 - DNA, 35 bp, Artificial Sequence
  Synthetic oligonucleotide
atccctccgagtcagtaccctagccgcccgccatc

SEQ ID NO: 132277 - DNA, 35 bp, Artificial Sequence
  Synthetic oligonucleotide
tgcagggggaactatgggcgggaaaatcaggggag

SEQ ID NO: 132278 - DNA, 33 bp, Artificial Sequence
  Synthetic oligonucleotide
accgcggactacacatatctcccctttcctgcg

SEQ ID NO: 132279 - DNA, 35 bp, Artificial Sequence
  Synthetic oligonucleotide
acacatcagctgtgcccccgttatcttttctctcg

SEQ ID NO: 132280 - DNA, 35 bp, Artificial Sequence
  Synthetic oligonucleotide
tgcaccaccctcctctacccgcttgttatcccagg

SEQ ID NO: 132281 - DNA, 35 bp, Artificial Sequence
  Synthetic oligonucleotide
gcacctttcgctgcccatctgatccatcaattcat

SEQ ID NO: 132282 - DNA, 35 bp, Artificial Sequence
  Synthetic oligonucleotide
gacctgcccgggccctctagttgcattcatgttct

SEQ ID NO: 132283 - DNA, 35 bp, Artificial Sequence
  Synthetic oligonucleotide
tgcaatgggcctctcacctgctgttgtttccgctt

SEQ ID NO: 132284 - DNA, 35 bp, Artificial Sequence
  Synthetic oligonucleotide
tgacttgtgcctcgcctgtccattttgttgccgtt

SEQ ID NO: 132285 - DNA, 35 bp, Artificial Sequence
  Synthetic oligonucleotide
tgaggaggagggactatgagaagggtagggcagaa

SEQ ID NO: 132286 - DNA, 36 bp, Artificial Sequence
  Synthetic oligonucleotide
acctggctcacctctcctgttcttatcaacgccaca

SEQ ID NO: 132287 - DNA, 36 bp, Artificial Sequence
  Synthetic oligonucleotide
tcccgagccaccccaggttcgccccttttggcccca

SEQ ID NO: 132288 - DNA, 36 bp, Artificial Sequence
  Synthetic oligonucleotide
gtaccggtcccatttgccatcacaacggttcctcca

SEQ ID NO: 132289 - DNA, 37 bp, Artificial Sequence
  Synthetic oligonucleotide
ttggtacagaggggggtggggccggaaagggcgcaga

SEQ ID NO: 132290 - DNA, 37 bp, Artificial Sequence
  Synthetic oligonucleotide
tgcctcgcaccgtgccacgatcgcctctctttataga

SEQ ID NO: 132291 - DNA, 37 bp, Artificial Sequence
  Synthetic oligonucleotide
gccaccttcccccctaattacacactcgtggtaccga

SEQ ID NO: 132292 - DNA, 35 bp, Artificial Sequence
  Synthetic oligonucleotide
tcacacatcacagcagtttatctgtttcccctcga

SEQ ID NO: 132293 - DNA, 37 bp, Artificial Sequence
  Synthetic oligonucleotide
tgctcctcaccgctacatcgggtaccctcccttagga

SEQ ID NO: 132294 - DNA, 37 bp, Artificial Sequence
  Synthetic oligonucleotide
ggttgggaggcgcggtggggtggaggtggccaccgga

SEQ ID NO: 132295 - DNA, 37 bp, Artificial Sequence
  Synthetic oligonucleotide
ggagggctaccgggtgggagggccacatacacactga

SEQ ID NO: 132296 - DNA, 38 bp, Artificial Sequence
  Synthetic oligonucleotide
acgcggagggcgatgggctggcagggagggaggggtga

SEQ ID NO: 132297 - DNA, 36 bp, Artificial Sequence
  Synthetic oligonucleotide
tacgcgcccctcattggcacaattatacgcctctta

SEQ ID NO: 132298 - DNA, 35 bp, Artificial Sequence
  Synthetic oligonucleotide
gacacattaaactgtaaccgaccgcctctctgcac

SEQ ID NO: 132299 - DNA, 35 bp, Artificial Sequence
  Synthetic oligonucleotide
acgcaccaccacgcgattctcccgctgccccgtac

SEQ ID NO: 132300 - DNA, 35 bp, Artificial Sequence
  Synthetic oligonucleotide
aagccatcccgcctcatcgttctctggtttacacc

SEQ ID NO: 132301 - DNA, 35 bp, Artificial Sequence
  Synthetic oligonucleotide
gaagcccgccgatagccttattccgcacaatcccc

SEQ ID NO: 132302 - DNA, 35 bp, Artificial Sequence
  Synthetic oligonucleotide
tctgcacatagtgccaccattgttcttagcccgcc

SEQ ID NO: 132303 - DNA, 35 bp, Artificial Sequence
  Synthetic oligonucleotide
ctattgatgcggccatcaaccccccttgttcacgc

SEQ ID NO: 132304 - DNA, 35 bp, Artificial Sequence
  Synthetic oligonucleotide
ggtacgacgcacaattcagcacgccctgtttccgc

SEQ ID NO: 132305 - DNA, 35 bp, Artificial Sequence
  Synthetic oligonucleotide
aactgcaaccgccccacacccgcacagcctactgg

SEQ ID NO: 132306 - DNA, 34 bp, Artificial Sequence
  Synthetic oligonucleotide
gactagactctgttccgccaccgaccctcccatg

SEQ ID NO: 132307 - DNA, 35 bp, Artificial Sequence
  Synthetic oligonucleotide
tctgcgcacttggtcttcctcattcgctccactat

SEQ ID NO: 132308 - DNA, 35 bp, Artificial Sequence
  Synthetic oligonucleotide
tgctgctcgccatcgacgctctctcttaccatgct

SEQ ID NO: 132309 - DNA, 35 bp, Artificial Sequence
  Synthetic oligonucleotide
gccagatctgttggtgaaccccaccgcctccccgt

SEQ ID NO: 132310 - DNA, 35 bp, Artificial Sequence
  Synthetic oligonucleotide
tctcactccggtcttcctgttccttcgccgagttt

SEQ ID NO: 132311 - DNA, 36 bp, Artificial Sequence
  Synthetic oligonucleotide
agacaccctctgcatattacgtccccttcactgcaa

SEQ ID NO: 132312 - DNA, 37 bp, Artificial Sequence
  Synthetic oligonucleotide
ttccaccgccgctacatccacctctcttgggccacga

SEQ ID NO: 132313 - DNA, 37 bp, Artificial Sequence
  Synthetic oligonucleotide
tgtgggtgggtgggacgggagatgtcgggttcaccga

SEQ ID NO: 132314 - DNA, 36 bp, Artificial Sequence
  Synthetic oligonucleotide
gaacgccacacataacaatacgcccctgtcctgcga

SEQ ID NO: 132315 - DNA, 37 bp, Artificial Sequence
  Synthetic oligonucleotide
tcaccgcctggaaggcactccagtcatcccacctcga

SEQ ID NO: 132316 - DNA, 37 bp, Artificial Sequence
  Synthetic oligonucleotide
atggtggggctgaggggaatgaacttattggggggga

SEQ ID NO: 132317 - DNA, 37 bp, Artificial Sequence
  Synthetic oligonucleotide
tccaacgtccgcccccccccaactgccgtcttgtgga

SEQ ID NO: 132318 - DNA, 38 bp, Artificial Sequence
  Synthetic oligonucleotide
taggagctcacgccctctggtccgccccatccacctga

SEQ ID NO: 132319 - DNA, 38 bp, Artificial Sequence
  Synthetic oligonucleotide
gcactcccaacgcacgcgactccgcacctactacctga

SEQ ID NO: 132320 - DNA, 38 bp, Artificial Sequence
  Synthetic oligonucleotide
agcggaggagcagggaagctgggcgggaatgggggtga

SEQ ID NO: 132321 - DNA, 38 bp, Artificial Sequence
  Synthetic oligonucleotide
ttcataccgcctttttgcatagctgccccacccattga

SEQ ID NO: 132322 - DNA, 34 bp, Artificial Sequence
  Synthetic oligonucleotide
ttcgttgcccacgactcccatccgtatgcactta

SEQ ID NO: 132323 - DNA, 35 bp, Artificial Sequence
  Synthetic oligonucleotide
tgcaccgtatcgcgtattccggcgctcatcaccac

SEQ ID NO: 132324 - DNA, 35 bp, Artificial Sequence
  Synthetic oligonucleotide
tgcatctcagcatccattctgcgcccactgcccac

SEQ ID NO: 132325 - DNA, 35 bp, Artificial Sequence
  Synthetic oligonucleotide
actgttccgcattgtgatcatttgtcccgctcacc

SEQ ID NO: 132326 - DNA, 35 bp, Artificial Sequence
  Synthetic oligonucleotide
agactcccgtcctccttgacttgccgtactttccc

SEQ ID NO: 132327 - DNA, 35 bp, Artificial Sequence
  Synthetic oligonucleotide
ttcccgccttgtgcggttctggttcactccctcgc

SEQ ID NO: 132328 - DNA, 35 bp, Artificial Sequence
  Synthetic oligonucleotide
tatgtgtccgcactgagtgctcgcccctcgcattc

SEQ ID NO: 132329 - DNA, 35 bp, Artificial Sequence
  Synthetic oligonucleotide
gacttcgcgggtgggaaagggctgggcagtagagg

SEQ ID NO: 132330 - DNA, 35 bp, Artificial Sequence
  Synthetic oligonucleotide
gcgcccaaccgcactgttgctagttcaatcacact

SEQ ID NO: 132331 - DNA, 35 bp, Artificial Sequence
  Synthetic oligonucleotide
ttacccatccggaccgtcgaggacccacccgcctt

SEQ ID NO: 132332 - DNA, 36 bp, Artificial Sequence
  Synthetic oligonucleotide
tgcatgtcacttctatccggccgtttgccctgctca

SEQ ID NO: 132333 - DNA, 35 bp, Artificial Sequence
  Synthetic oligonucleotide
tacgccggcggcattgttttcacctacctccccga

SEQ ID NO: 132334 - DNA, 37 bp, Artificial Sequence
  Synthetic oligonucleotide
tgacagtgctgatctattatatcttcctcctctgcga

SEQ ID NO: 132335 - DNA, 37 bp, Artificial Sequence
  Synthetic oligonucleotide
tagttccagcccctatgctctcccgacgccctatcga

SEQ ID NO: 132336 - DNA, 37 bp, Artificial Sequence
  Synthetic oligonucleotide
gatgcccgagtctggagtagggaggcgggggggcgga

SEQ ID NO: 132337 - DNA, 38 bp, Artificial Sequence
  Synthetic oligonucleotide
ttgctgggagggagggtgggacggacgaacctggatga

SEQ ID NO: 132338 - DNA, 38 bp, Artificial Sequence
  Synthetic oligonucleotide
acgtcccacccgacctgctcgtttactctccgacttga

SEQ ID NO: 132339 - DNA, 36 bp, Artificial Sequence
  Synthetic oligonucleotide
tacagccagctctgaatccttcccttctcctgcgta

SEQ ID NO: 132340 - DNA, 35 bp, Artificial Sequence
  Synthetic oligonucleotide
atcgtaagcccactattttgcatgatcacctcacc

SEQ ID NO: 132341 - DNA, 35 bp, Artificial Sequence
  Synthetic oligonucleotide
gacatccgtacgttctcttgcttgtttccttcacc

SEQ ID NO: 132342 - DNA, 35 bp, Artificial Sequence
  Synthetic oligonucleotide
gtccccctccgatacctttgaacgtccctgtagcc

SEQ ID NO: 132343 - DNA, 35 bp, Artificial Sequence
  Synthetic oligonucleotide
atgcaccaacatcgaccgctttccatgatacctcc

SEQ ID NO: 132344 - DNA, 35 bp, Artificial Sequence
  Synthetic oligonucleotide
ggtgcccccagttcgagcctccccttgcatgttcc

SEQ ID NO: 132345 - DNA, 35 bp, Artificial Sequence
  Synthetic oligonucleotide
tgccccctctcgctccttgtgctaatgttatccgc

SEQ ID NO: 132346 - DNA, 35 bp, Artificial Sequence
  Synthetic oligonucleotide
gccacctcgagccccgcaccactttccacccgggc

SEQ ID NO: 132347 - DNA, 35 bp, Artificial Sequence
  Synthetic oligonucleotide
gatccgcaggaacggaaaggggggaggaacatatc

SEQ ID NO: 132348 - DNA, 35 bp, Artificial Sequence
  Synthetic oligonucleotide
tccggtaccaccgaccaattgaccaatcaccactc

SEQ ID NO: 132349 - DNA, 34 bp, Artificial Sequence
  Synthetic oligonucleotide
gtagatgggcggggggactgagggaacgccgccg

SEQ ID NO: 132350 - DNA, 35 bp, Artificial Sequence
  Synthetic oligonucleotide
gcccaccaccaacaccatcattttgcacagagttt

SEQ ID NO: 132351 - DNA, 35 bp, Artificial Sequence
  Synthetic oligonucleotide
ttcactgccccatctgttcgttcgaatgccgcgca

SEQ ID NO: 132352 - DNA, 35 bp, Artificial Sequence
  Synthetic oligonucleotide
cccctgccccgccgcttcgtatttcctctcgcgca

SEQ ID NO: 132353 - DNA, 35 bp, Artificial Sequence
  Synthetic oligonucleotide
aatatcgcggaggaggtggggattggaggtaggca

SEQ ID NO: 132354 - DNA, 35 bp, Artificial Sequence
  Synthetic oligonucleotide
gcaaaccgccagcctaccgaacggccctatcctca

SEQ ID NO: 132355 - DNA, 35 bp, Artificial Sequence
  Synthetic oligonucleotide
gatccgttccagccgccctccccccccttaagtca

SEQ ID NO: 132356 - DNA, 37 bp, Artificial Sequence
  Synthetic oligonucleotide
gagctggaagagggagggagggacatgatagtagaga

SEQ ID NO: 132357 - DNA, 35 bp, Artificial Sequence
  Synthetic oligonucleotide
acactgctacatctccatggtccgccctatctcga

SEQ ID NO: 132358 - DNA, 37 bp, Artificial Sequence
  Synthetic oligonucleotide
gagtagggggcggacaagagcgggcatcgtggcagga

SEQ ID NO: 132359 - DNA, 37 bp, Artificial Sequence
  Synthetic oligonucleotide
tgaggggtgaagaatagatggagaggggtgaacggga

SEQ ID NO: 132360 - DNA, 36 bp, Artificial Sequence
  Synthetic oligonucleotide
taggacggacgtgggggggggcatcatggggactga

SEQ ID NO: 132361 - DNA, 36 bp, Artificial Sequence
  Synthetic oligonucleotide
ggatcggagatgcagtggaagggaggggggatgtga

SEQ ID NO: 132362 - DNA, 36 bp, Artificial Sequence
  Synthetic oligonucleotide
actcacgtatcgcttgtttggtctcactcgccttta

SEQ ID NO: 132363 - DNA, 35 bp, Artificial Sequence
  Synthetic oligonucleotide
cctgaccctcgcatgttcgtttctagtaccccgcc

SEQ ID NO: 132364 - DNA, 35 bp, Artificial Sequence
  Synthetic oligonucleotide
taaccgccccgattacgtacactcaccctcgcgcc

SEQ ID NO: 132365 - DNA, 34 bp, Artificial Sequence
  Synthetic oligonucleotide
ttcgccctatcccttcagcatgatccatctttcc

SEQ ID NO: 132366 - DNA, 35 bp, Artificial Sequence
  Synthetic oligonucleotide
tgaagctcgttctcagtcctaatcctctgtcctgc

SEQ ID NO: 132367 - DNA, 35 bp, Artificial Sequence
  Synthetic oligonucleotide
gtgggtcacagccggtattgttcctcgcctttgtc

SEQ ID NO: 132368 - DNA, 35 bp, Artificial Sequence
  Synthetic oligonucleotide
atgactgccttccccgcaatattactacccctgcg

SEQ ID NO: 132369 - DNA, 35 bp, Artificial Sequence
  Synthetic oligonucleotide
tacccgcctacatctcgttaatgggcttcacctcg

SEQ ID NO: 132370 - DNA, 35 bp, Artificial Sequence
  Synthetic oligonucleotide
gacacccttcctctgtacacgtacctggcctacgg

SEQ ID NO: 132371 - DNA, 35 bp, Artificial Sequence
  Synthetic oligonucleotide
tcagccctgccttccccgcagaccccgccgccttg

SEQ ID NO: 132372 - DNA, 35 bp, Artificial Sequence
  Synthetic oligonucleotide
tttcgctggccttagttgcttccacctgttttact

SEQ ID NO: 132373 - DNA, 35 bp, Artificial Sequence
  Synthetic oligonucleotide
ctctcagtggcacgtcctccgttgcctgtccctct

SEQ ID NO: 132374 - DNA, 35 bp, Artificial Sequence
  Synthetic oligonucleotide
atggtggggtacggggggagggacataagcgacgt

SEQ ID NO: 132375 - DNA, 35 bp, Artificial Sequence
  Synthetic oligonucleotide
gtggcacgatcccccttccgcgccgcctctattgt

SEQ ID NO: 132376 - DNA, 36 bp, Artificial Sequence
  Synthetic oligonucleotide
gcccatccctcgttcccccgttattgagtacgtcaa

SEQ ID NO: 132377 - DNA, 36 bp, Artificial Sequence
  Synthetic oligonucleotide
gaagggggtggacgggtaaggcatcgtacggattaa

SEQ ID NO: 132378 - DNA, 36 bp, Artificial Sequence
  Synthetic oligonucleotide
tgtgtttccgtccagctcctagtccttccctctgca

SEQ ID NO: 132379 - DNA, 37 bp, Artificial Sequence
  Synthetic oligonucleotide
gggatgggagggatgggggtcgaggcaccggtgtaga

SEQ ID NO: 132380 - DNA, 37 bp, Artificial Sequence
  Synthetic oligonucleotide
aatagggaagggagggaaagaggggggagtctgtcga

SEQ ID NO: 132381 - DNA, 35 bp, Artificial Sequence
  Synthetic oligonucleotide
tagacagggtaggatgatccgggggcggggaggga

SEQ ID NO: 132382 - DNA, 37 bp, Artificial Sequence
  Synthetic oligonucleotide
tgtctaaggtaagggaacgggggagaaggcaggggga

SEQ ID NO: 132383 - DNA, 37 bp, Artificial Sequence
  Synthetic oligonucleotide
acacaacccatccccgacgcatcgtacagtcccgtga

SEQ ID NO: 132384 - DNA, 37 bp, Artificial Sequence
  Synthetic oligonucleotide
tttcccaccgctgtttgcccgctcatatacttcgtga

SEQ ID NO: 132385 - DNA, 35 bp, Artificial Sequence
  Synthetic oligonucleotide
gcccccaccccgccccatgtacagcaagcatgcta

SEQ ID NO: 132386 - DNA, 35 bp, Artificial Sequence
  Synthetic oligonucleotide
ttgaacccccctgctgaatgactagtttactcacc

SEQ ID NO: 132387 - DNA, 35 bp, Artificial Sequence
  Synthetic oligonucleotide
gtgaaacgttccctcgtcacacccgtacctgttcc

SEQ ID NO: 132388 - DNA, 35 bp, Artificial Sequence
  Synthetic oligonucleotide
tacgcgagtccataacgccgttccatctgccacgc

SEQ ID NO: 132389 - DNA, 34 bp, Artificial Sequence
  Synthetic oligonucleotide
ttctcgcaatgccgcatacacgcccatctttcgc

SEQ ID NO: 132390 - DNA, 35 bp, Artificial Sequence
  Synthetic oligonucleotide
agtatccccgttccgtctctgtcccttgttcctgc

SEQ ID NO: 132391 - DNA, 35 bp, Artificial Sequence
  Synthetic oligonucleotide
gacccgcaccgctaacatcccccgggttaatcatc

SEQ ID NO: 132392 - DNA, 35 bp, Artificial Sequence
  Synthetic oligonucleotide
gtcgatgggctcccgttccgtgtacgcctctcctc

SEQ ID NO: 132393 - DNA, 35 bp, Artificial Sequence
  Synthetic oligonucleotide
gcacggtgccacgttagttcctgctttctgctctc

SEQ ID NO: 132394 - DNA, 35 bp, Artificial Sequence
  Synthetic oligonucleotide
attgccagacagtattctcctccatccctcatgtc

SEQ ID NO: 132395 - DNA, 35 bp, Artificial Sequence
  Synthetic oligonucleotide
tcctctcgcgctctactgtccgtctcacgcctccg

SEQ ID NO: 132396 - DNA, 34 bp, Artificial Sequence
  Synthetic oligonucleotide
gtggagtgggggggggagggtcaagcgggatgcg

SEQ ID NO: 132397 - DNA, 35 bp, Artificial Sequence
  Synthetic oligonucleotide
tctgctccgctttctcgtctccggttaatacatcg

SEQ ID NO: 132398 - DNA, 35 bp, Artificial Sequence
  Synthetic oligonucleotide
ggtgacgggaacagagcattgcagggagggtaggg

SEQ ID NO: 132399 - DNA, 35 bp, Artificial Sequence
  Synthetic oligonucleotide
gtggggccaggggcgggggggatattatggttgtg

SEQ ID NO: 132400 - DNA, 35 bp, Artificial Sequence
  Synthetic oligonucleotide
gccgcccccatctctggttagtttcaccgtcgtct

SEQ ID NO: 132401 - DNA, 35 bp, Artificial Sequence
  Synthetic oligonucleotide
attccacagcgtttcagtccgcacgccgcccccaa

SEQ ID NO: 132402 - DNA, 35 bp, Artificial Sequence
  Synthetic oligonucleotide
tagtgcccacccgccttttagagcccgcctatgaa

SEQ ID NO: 132403 - DNA, 36 bp, Artificial Sequence
  Synthetic oligonucleotide
atctctgcctcccccgcctattattgtatgttcaca

SEQ ID NO: 132404 - DNA, 35 bp, Artificial Sequence
  Synthetic oligonucleotide
gccgatgtatggcgcgagggggggtgggagctcca

SEQ ID NO: 132405 - DNA, 36 bp, Artificial Sequence
  Synthetic oligonucleotide
gggtgggtgggtcagggtttcataatgcgagccgca

SEQ ID NO: 132406 - DNA, 36 bp, Artificial Sequence
  Synthetic oligonucleotide
tatgcccgcccgcatacccatttcggtcctgttgca

SEQ ID NO: 132407 - DNA, 38 bp, Artificial Sequence
  Synthetic oligonucleotide
ttgcggtccagtgcgctttcgcctatctctcatcctga

SEQ ID NO: 132408 - DNA, 38 bp, Artificial Sequence
  Synthetic oligonucleotide
ggatgcggacgggaagggcggggaggggcgtctcctga

SEQ ID NO: 132409 - DNA, 35 bp, Artificial Sequence
  Synthetic oligonucleotide
tcacccgcctttagccgccttgtttgatctcttcc

SEQ ID NO: 132410 - DNA, 35 bp, Artificial Sequence
  Synthetic oligonucleotide
gcccacctccgcacctatattttgccagttgttcc

SEQ ID NO: 132411 - DNA, 35 bp, Artificial Sequence
  Synthetic oligonucleotide
tcgtgttcgccacactcgccattttcgttccggtc

SEQ ID NO: 132412 - DNA, 35 bp, Artificial Sequence
  Synthetic oligonucleotide
agtgatgagggaagcaggggggcggaacggaaaag

SEQ ID NO: 132413 - DNA, 35 bp, Artificial Sequence
  Synthetic oligonucleotide
ggactgtacaaaccatgaaacatgacctccgccct

SEQ ID NO: 132414 - DNA, 35 bp, Artificial Sequence
  Synthetic oligonucleotide
gtcccgcccatggcatgccacgaatctgctcatct

SEQ ID NO: 132415 - DNA, 36 bp, Artificial Sequence
  Synthetic oligonucleotide
atactagctcgcgtacataccgctataccgccccaa

SEQ ID NO: 132416 - DNA, 36 bp, Artificial Sequence
  Synthetic oligonucleotide
accatacccgtctcatgtctcgctcgctttcttcaa

SEQ ID NO: 132417 - DNA, 37 bp, Artificial Sequence
  Synthetic oligonucleotide
aagagcgggaggaggatagggcgcggattaacggaga

SEQ ID NO: 132418 - DNA, 37 bp, Artificial Sequence
  Synthetic oligonucleotide
acatcctcccgttatctttagacctgcctccactaga

SEQ ID NO: 132419 - DNA, 36 bp, Artificial Sequence
  Synthetic oligonucleotide
gacgaggaggaaaggtggtggccgaacggaattgga

SEQ ID NO: 132420 - DNA, 38 bp, Artificial Sequence
  Synthetic oligonucleotide
actgcgagaaggtctagaggggggagcgggaggaatga

SEQ ID NO: 132421 - DNA, 35 bp, Artificial Sequence
  Synthetic oligonucleotide
acccccgttgacaactccgccgtaccctttgctga

SEQ ID NO: 132422 - DNA, 38 bp, Artificial Sequence
  Synthetic oligonucleotide
acccgcgcattcgcctcccacatgctgacttcccttga

SEQ ID NO: 132423 - DNA, 35 bp, Artificial Sequence
  Synthetic oligonucleotide
tcccgaaccacccacgattatgttacgttactata

SEQ ID NO: 132424 - DNA, 36 bp, Artificial Sequence
  Synthetic oligonucleotide
tgctactacgccccatcgtgtcttgttgccttcgta

SEQ ID NO: 132425 - DNA, 36 bp, Artificial Sequence
  Synthetic oligonucleotide
acacccccatttcatgctgtttaccgcctcccttta

SEQ ID NO: 132426 - DNA, 35 bp, Artificial Sequence
  Synthetic oligonucleotide
gccgtctcgctcagcccgtcctcgctatccgacac

SEQ ID NO: 132427 - DNA, 35 bp, Artificial Sequence
  Synthetic oligonucleotide
tgcatccatccttgcgtaaatcttctccttactcc

SEQ ID NO: 132428 - DNA, 35 bp, Artificial Sequence
  Synthetic oligonucleotide
gtcaccgatacgctagctataactattcctgcctc

SEQ ID NO: 132429 - DNA, 35 bp, Artificial Sequence
  Synthetic oligonucleotide
atgaatggaaacgggggaggggataaaagtgagat

SEQ ID NO: 132430 - DNA, 35 bp, Artificial Sequence
  Synthetic oligonucleotide
tcaaatgcggacagccccacgctcctcctcgcact

SEQ ID NO: 132431 - DNA, 35 bp, Artificial Sequence
  Synthetic oligonucleotide
gttcgccgatctcctgtagccgccctttgcttact

SEQ ID NO: 132432 - DNA, 35 bp, Artificial Sequence
  Synthetic oligonucleotide
aacgccgccccacatccgacgcacccgccttaagt

SEQ ID NO: 132433 - DNA, 35 bp, Artificial Sequence
  Synthetic oligonucleotide
atcagcacggttttgccattttacccactgccctt

SEQ ID NO: 132434 - DNA, 35 bp, Artificial Sequence
  Synthetic oligonucleotide
atcccgatcgcccccatctgaaggtacgttcctca

SEQ ID NO: 132435 - DNA, 35 bp, Artificial Sequence
  Synthetic oligonucleotide
ttgcctcccacaagcacataacccacttgccccga

SEQ ID NO: 132436 - DNA, 37 bp, Artificial Sequence
  Synthetic oligonucleotide
aactacccgccacccgccaagcgcacgcattctccga

SEQ ID NO: 132437 - DNA, 37 bp, Artificial Sequence
  Synthetic oligonucleotide
taccccaatcgaccaatctgatacgaccctctctcga

SEQ ID NO: 132438 - DNA, 37 bp, Artificial Sequence
  Synthetic oligonucleotide
aagggatgggaggtggtactgtaggcaggggagggga

SEQ ID NO: 132439 - DNA, 35 bp, Artificial Sequence
  Synthetic oligonucleotide
actacacccgttgcttatatgctttgcccttctga

SEQ ID NO: 132440 - DNA, 38 bp, Artificial Sequence
  Synthetic oligonucleotide
tagcccgggtgggatgggggggagcttagtactattga

SEQ ID NO: 132441 - DNA, 36 bp, Artificial Sequence
  Synthetic oligonucleotide
acgacacgccggcgggtgggaggatgatggggtgta

SEQ ID NO: 132442 - DNA, 35 bp, Artificial Sequence
  Synthetic oligonucleotide
tttgctcccacagcctcgagcacgacccatacccc

SEQ ID NO: 132443 - DNA, 35 bp, Artificial Sequence
  Synthetic oligonucleotide
tgagcccggtgcgttattgcggcttttccactccc

SEQ ID NO: 132444 - DNA, 35 bp, Artificial Sequence
  Synthetic oligonucleotide
tccatacacgtgcccaggcttcaccacccgctgtc

SEQ ID NO: 132445 - DNA, 35 bp, Artificial Sequence
  Synthetic oligonucleotide
acgctacactggtcgcctgtaacatccatctgttc

SEQ ID NO: 132446 - DNA, 36 bp, Artificial Sequence
  Synthetic oligonucleotide
gaatgccccgttcaccttcgtccccgaggctcccat

SEQ ID NO: 132447 - DNA, 35 bp, Artificial Sequence
  Synthetic oligonucleotide
atgcgggggggattgattggggagggctattaact

SEQ ID NO: 132448 - DNA, 35 bp, Artificial Sequence
  Synthetic oligonucleotide
tacgcgctgtcattagttcgtacgccgcacaccct

SEQ ID NO: 132449 - DNA, 35 bp, Artificial Sequence
  Synthetic oligonucleotide
gatcagctgtcgatccccccctcctcttcgccaaa

SEQ ID NO: 132450 - DNA, 36 bp, Artificial Sequence
  Synthetic oligonucleotide
agatgcgcacgcagccgccgaccctttccgttctaa

SEQ ID NO: 132451 - DNA, 37 bp, Artificial Sequence
  Synthetic oligonucleotide
tgcccttccgtgctccctctgctgaagtccttttgga

SEQ ID NO: 132452 - DNA, 35 bp, Artificial Sequence
  Synthetic oligonucleotide
ttgtccacccaattgtctgactcctacagttctcc

SEQ ID NO: 132453 - DNA, 34 bp, Artificial Sequence
  Synthetic oligonucleotide
acgaaggaactcccgcctctgaactcgatcctgc

SEQ ID NO: 132454 - DNA, 35 bp, Artificial Sequence
  Synthetic oligonucleotide
gaacgcataggcgccccttgttatcattctcctgc

SEQ ID NO: 132455 - DNA, 35 bp, Artificial Sequence
  Synthetic oligonucleotide
gctccacctcacacttgactagcccgtcttccgtc

SEQ ID NO: 132456 - DNA, 35 bp, Artificial Sequence
  Synthetic oligonucleotide
ttggtaggcaaggagggggggagagcgggtacacg

SEQ ID NO: 132457 - DNA, 35 bp, Artificial Sequence
  Synthetic oligonucleotide
acacgaacgcccgaatccctactaacccaccgccg

SEQ ID NO: 132458 - DNA, 35 bp, Artificial Sequence
  Synthetic oligonucleotide
tatcatacccgacccctcccccatttttacgtggg

SEQ ID NO: 132459 - DNA, 35 bp, Artificial Sequence
  Synthetic oligonucleotide
gtcctctccacccttctgttgatccatacttgttg

SEQ ID NO: 132460 - DNA, 35 bp, Artificial Sequence
  Synthetic oligonucleotide
gtgccgcccacggaacatggtctcctccatcccct

SEQ ID NO: 132461 - DNA, 34 bp, Artificial Sequence
  Synthetic oligonucleotide
gtatccccccctgcctccgagtaagctatctcct

SEQ ID NO: 132462 - DNA, 33 bp, Artificial Sequence
  Synthetic oligonucleotide
tctcgttaccgccctctgcccggaccctgtatt

SEQ ID NO: 132463 - DNA, 35 bp, Artificial Sequence
  Synthetic oligonucleotide
gtgactgtgcgctgtgcttcctaaccggccccttt

SEQ ID NO: 132464 - DNA, 36 bp, Artificial Sequence
  Synthetic oligonucleotide
gccctcactcctcctgccctgcatacgacatgaaaa

SEQ ID NO: 132465 - DNA, 35 bp, Artificial Sequence
  Synthetic oligonucleotide
agagcacatccgctaggtacttctcatcaccacca

SEQ ID NO: 132466 - DNA, 37 bp, Artificial Sequence
  Synthetic oligonucleotide
agttggcccgctctgttctcgcccctgttttttccga

SEQ ID NO: 132467 - DNA, 37 bp, Artificial Sequence
  Synthetic oligonucleotide
acccacctgtccactactgcatgatcaccctattgga

SEQ ID NO: 132468 - DNA, 38 bp, Artificial Sequence
  Synthetic oligonucleotide
tacgccccgccccaaccgatcttcccccgttgccctga

SEQ ID NO: 132469 - DNA, 38 bp, Artificial Sequence
  Synthetic oligonucleotide
gtcacctctggtgcatttccccccgttttaccctctga

SEQ ID NO: 132470 - DNA, 36 bp, Artificial Sequence
  Synthetic oligonucleotide
aatagtgcgaggggtcgaggggaaggagtggggtta

SEQ ID NO: 132471 - DNA, 35 bp, Artificial Sequence
  Synthetic oligonucleotide
gtccacacccccgctgaaccaaatttcgccacaac

SEQ ID NO: 132472 - DNA, 35 bp, Artificial Sequence
  Synthetic oligonucleotide
ttacgcctccgacctttattcttccacgggacacc

SEQ ID NO: 132473 - DNA, 35 bp, Artificial Sequence
  Synthetic oligonucleotide
gccatcgaggccgtgctccctccgcctccagcccc

SEQ ID NO: 132474 - DNA, 35 bp, Artificial Sequence
  Synthetic oligonucleotide
tgacgtcgcaattgactacccttttcccatgttgc

SEQ ID NO: 132475 - DNA, 35 bp, Artificial Sequence
  Synthetic oligonucleotide
ttaggcccccacgctttgaatactgtctctgcatc

SEQ ID NO: 132476 - DNA, 35 bp, Artificial Sequence
  Synthetic oligonucleotide
attccccctgacccctgacgcctgctacgttactc

SEQ ID NO: 132477 - DNA, 35 bp, Artificial Sequence
  Synthetic oligonucleotide
agtgcgctcctgccctgcccttttctgtacccctc

SEQ ID NO: 132478 - DNA, 35 bp, Artificial Sequence
  Synthetic oligonucleotide
gcccccccgcccgctcctgtctagaaatagcggag

SEQ ID NO: 132479 - DNA, 35 bp, Artificial Sequence
  Synthetic oligonucleotide
gccttcgccccctaatcacgcccgcctaagccgcg

SEQ ID NO: 132480 - DNA, 35 bp, Artificial Sequence
  Synthetic oligonucleotide
gtccgccccttatcgccattcgttccgaaactctg

SEQ ID NO: 132481 - DNA, 35 bp, Artificial Sequence
  Synthetic oligonucleotide
tcataccacacggtgtcctgacacgctctccacct

SEQ ID NO: 132482 - DNA, 34 bp, Artificial Sequence
  Synthetic oligonucleotide
gtggtttgcctcggtctgtttacccgtcgcccct

SEQ ID NO: 132483 - DNA, 35 bp, Artificial Sequence
  Synthetic oligonucleotide
gagagctcccgccccaccatgatagccaactccgt

SEQ ID NO: 132484 - DNA, 35 bp, Artificial Sequence
  Synthetic oligonucleotide
tatcaccatcattgcccgggggttaacttatcctt

SEQ ID NO: 132485 - DNA, 37 bp, Artificial Sequence
  Synthetic oligonucleotide
ggggggtggggcaagaagggattcgcgggtagggaga

SEQ ID NO: 132486 - DNA, 37 bp, Artificial Sequence
  Synthetic oligonucleotide
gtacggggagggtgggtaaataggtcataggacggga

SEQ ID NO: 132487 - DNA, 35 bp, Artificial Sequence
  Synthetic oligonucleotide
gaccacgtcgcccgccgcctaatcccgattctgga

SEQ ID NO: 132488 - DNA, 36 bp, Artificial Sequence
  Synthetic oligonucleotide
tacaaccagggtgggatgggaatggggcactcatga

SEQ ID NO: 132489 - DNA, 38 bp, Artificial Sequence
  Synthetic oligonucleotide
gtagcgtgcagccttttgtacgccacgctcccccctga

SEQ ID NO: 132490 - DNA, 37 bp, Artificial Sequence
  Synthetic oligonucleotide
tgatcttgtgggtgagggggcgggcgggtactattga

SEQ ID NO: 132491 - DNA, 38 bp, Artificial Sequence
  Synthetic oligonucleotide
gcacggaacctgtccccactcgccagccccccgtttga

SEQ ID NO: 132492 - DNA, 36 bp, Artificial Sequence
  Synthetic oligonucleotide
tcccatcgagcgtgtcctgttcggccatcattccta

SEQ ID NO: 132493 - DNA, 35 bp, Artificial Sequence
  Synthetic oligonucleotide
atatcgccccgcaaccatttccagccccccgagcc

SEQ ID NO: 132494 - DNA, 35 bp, Artificial Sequence
  Synthetic oligonucleotide
atctagtgcccgttagtaataacgtccctccctcc

SEQ ID NO: 132495 - DNA, 35 bp, Artificial Sequence
  Synthetic oligonucleotide
gcaaactacacttgcgcggccgttcctgctcgtcc

SEQ ID NO: 132496 - DNA, 35 bp, Artificial Sequence
  Synthetic oligonucleotide
ctattacgcacccgctgaccgcccccttcccaccg

SEQ ID NO: 132497 - DNA, 35 bp, Artificial Sequence
  Synthetic oligonucleotide
ccctgcctccctgtgatcggccagttccctccact

SEQ ID NO: 132498 - DNA, 34 bp, Artificial Sequence
  Synthetic oligonucleotide
gaatgccctcgtcctccatcggttgtgctcctct

SEQ ID NO: 132499 - DNA, 35 bp, Artificial Sequence
  Synthetic oligonucleotide
gctccagtcccggactctcctggccctcatacctt

SEQ ID NO: 132500 - DNA, 35 bp, Artificial Sequence
  Synthetic oligonucleotide
tgtgccctcgcgaatcgccgtattcgtagcccctt

SEQ ID NO: 132501 - DNA, 35 bp, Artificial Sequence
  Synthetic oligonucleotide
actcacaccgccaatctgcgtgcctcatgggcctt

SEQ ID NO: 132502 - DNA, 35 bp, Artificial Sequence
  Synthetic oligonucleotide
tgactcctcgatctactttagtacccgcttccttt

SEQ ID NO: 132503 - DNA, 32 bp, Artificial Sequence
  Synthetic oligonucleotide
tgttacagacctggccaactccatcctcgttt

SEQ ID NO: 132504 - DNA, 36 bp, Artificial Sequence
  Synthetic oligonucleotide
accaccccaacgcctgccactgccacagcatgacaa

SEQ ID NO: 132505 - DNA, 37 bp, Artificial Sequence
  Synthetic oligonucleotide
gcaccctctgttcgctttttaggattacactctgcga

SEQ ID NO: 132506 - DNA, 36 bp, Artificial Sequence
  Synthetic oligonucleotide
taccccccctggtggccactaacacacctccctcga

SEQ ID NO: 132507 - DNA, 38 bp, Artificial Sequence
  Synthetic oligonucleotide
acgcgaccaagttgtccgttacgcttccttcctcctga

SEQ ID NO: 132508 - DNA, 38 bp, Artificial Sequence
  Synthetic oligonucleotide
gagccgacccactgcatagttgcctgtctccttcctga

SEQ ID NO: 132509 - DNA, 37 bp, Artificial Sequence
  Synthetic oligonucleotide
tcactcccgccaaagtggcccacgcactcccccttga

SEQ ID NO: 132510 - DNA, 37 bp, Artificial Sequence
  Synthetic oligonucleotide
gctcgtcgaacgcccgtatttccgctcccccgcttga

SEQ ID NO: 132511 - DNA, 35 bp, Artificial Sequence
  Synthetic oligonucleotide
acaccccacccccagccccccggagtagacccata

SEQ ID NO: 132512 - DNA, 35 bp, Artificial Sequence
  Synthetic oligonucleotide
gtaccaagagtcgaaggggcggggaggggagagta

SEQ ID NO: 132513 - DNA, 36 bp, Artificial Sequence
  Synthetic oligonucleotide
actctccgtgactcattgctacttccgctgacttta

SEQ ID NO: 132514 - DNA, 35 bp, Artificial Sequence
  Synthetic oligonucleotide
gcgacggactactcattgtgctctaccccctgtac

SEQ ID NO: 132515 - DNA, 35 bp, Artificial Sequence
  Synthetic oligonucleotide
gtactgtcgcctcgagcaccccctcccctgcaccc

SEQ ID NO: 132516 - DNA, 35 bp, Artificial Sequence
  Synthetic oligonucleotide
ccagtggtattatgccgcccctcgaacgtgccgcc

SEQ ID NO: 132517 - DNA, 35 bp, Artificial Sequence
  Synthetic oligonucleotide
atgagcacatcattactgattcccgcccaccacgc

SEQ ID NO: 132518 - DNA, 35 bp, Artificial Sequence
  Synthetic oligonucleotide
gactgcaccccggttggtccaacttttccctcatc

SEQ ID NO: 132519 - DNA, 35 bp, Artificial Sequence
  Synthetic oligonucleotide
ccgaggaggaggcgggatgagtgggtgggtatggg

SEQ ID NO: 132520 - DNA, 35 bp, Artificial Sequence
  Synthetic oligonucleotide
agccccaccaacagacagacccttgcccccgattg

SEQ ID NO: 132521 - DNA, 35 bp, Artificial Sequence
  Synthetic oligonucleotide
taagtatccgccacgccgtcccgtttacgcactat

SEQ ID NO: 132522 - DNA, 35 bp, Artificial Sequence
  Synthetic oligonucleotide
ttgcaccggcctgccctggcatggctctaccctct

SEQ ID NO: 132523 - DNA, 35 bp, Artificial Sequence
  Synthetic oligonucleotide
gacagggtctgaccgttcctccgcttaacctgtct

SEQ ID NO: 132524 - DNA, 35 bp, Artificial Sequence
  Synthetic oligonucleotide
tgaacgtacacacgcctctctctgtccccagttgt

SEQ ID NO: 132525 - DNA, 35 bp, Artificial Sequence
  Synthetic oligonucleotide
ggacccatctgcacccccccactacgcagtttcaa

SEQ ID NO: 132526 - DNA, 35 bp, Artificial Sequence
  Synthetic oligonucleotide
gacgtccaaaggcgacggggagggtgggtgcggaa

SEQ ID NO: 132527 - DNA, 36 bp, Artificial Sequence
  Synthetic oligonucleotide
gaagccggccgatcactagcgccacccttaccctaa

SEQ ID NO: 132528 - DNA, 35 bp, Artificial Sequence
  Synthetic oligonucleotide
atcaaacggggggaggttcacgtgggtgggggtaa

SEQ ID NO: 132529 - DNA, 36 bp, Artificial Sequence
  Synthetic oligonucleotide
attcccgccctgttccgatggatcgctcacctccca

SEQ ID NO: 132530 - DNA, 36 bp, Artificial Sequence
  Synthetic oligonucleotide
gcccctcttagctctggtcgactgcccctcttcgca

SEQ ID NO: 132531 - DNA, 37 bp, Artificial Sequence
  Synthetic oligonucleotide
tgtagtagggtgggggtggtatggggtgcatgggaga

SEQ ID NO: 132532 - DNA, 35 bp, Artificial Sequence
  Synthetic oligonucleotide
tagaaaccgccttccgtgcccccccgccctcacga

SEQ ID NO: 132533 - DNA, 37 bp, Artificial Sequence
  Synthetic oligonucleotide
gctacaacatcaccctgcccccctcgtcctcacagga

SEQ ID NO: 132534 - DNA, 36 bp, Artificial Sequence
  Synthetic oligonucleotide
tcaacggcggaattgcggggtggaggtagggcggga

SEQ ID NO: 132535 - DNA, 38 bp, Artificial Sequence
  Synthetic oligonucleotide
acgcggttcaacttctataatacgcctctctccgctga

SEQ ID NO: 132536 - DNA, 36 bp, Artificial Sequence
  Synthetic oligonucleotide
tcccttggcctgctccacacgttcatccggcccata

SEQ ID NO: 132537 - DNA, 35 bp, Artificial Sequence
  Synthetic oligonucleotide
tgaccgaacaggggacgggggggtgtgaggaggta

SEQ ID NO: 132538 - DNA, 35 bp, Artificial Sequence
  Synthetic oligonucleotide
aacacctccatccggcacatccatgcacctcctta

SEQ ID NO: 132539 - DNA, 35 bp, Artificial Sequence
  Synthetic oligonucleotide
tccccacgcgcaacttgactcgccgttgaccgacc

SEQ ID NO: 132540 - DNA, 35 bp, Artificial Sequence
  Synthetic oligonucleotide
tctcatcccggtgcgactctgcctcgcgtttaccc

SEQ ID NO: 132541 - DNA, 35 bp, Artificial Sequence
  Synthetic oligonucleotide
gttcccctgcccaatggtccttcgtacgctctccc

SEQ ID NO: 132542 - DNA, 35 bp, Artificial Sequence
  Synthetic oligonucleotide
ttgcgtctggcagtttcttctctggttctcgtccc

SEQ ID NO: 132543 - DNA, 35 bp, Artificial Sequence
  Synthetic oligonucleotide
gtgcctccttccgatcagtcctccgccgcctttcc

SEQ ID NO: 132544 - DNA, 35 bp, Artificial Sequence
  Synthetic oligonucleotide
gaacagctccctctgtccttcctcagtgttcctgc

SEQ ID NO: 132545 - DNA, 35 bp, Artificial Sequence
  Synthetic oligonucleotide
tcgcgatttggccaatgtatctgctgctcctcctc

SEQ ID NO: 132546 - DNA, 35 bp, Artificial Sequence
  Synthetic oligonucleotide
gtgcccctcgctcaagcctctggacccactccgtc

SEQ ID NO: 132547 - DNA, 35 bp, Artificial Sequence
  Synthetic oligonucleotide
gccaaggtgggctgggagggtggggcgccctttcg

SEQ ID NO: 132548 - DNA, 35 bp, Artificial Sequence
  Synthetic oligonucleotide
ttccccagcccggcgcaccatccacaacataaggg

SEQ ID NO: 132549 - DNA, 35 bp, Artificial Sequence
  Synthetic oligonucleotide
accctacgatcgctgccttttctttccgtcctact

SEQ ID NO: 132550 - DNA, 35 bp, Artificial Sequence
  Synthetic oligonucleotide
gttgggcgtatggggggtgggagggcgtgaacagt

SEQ ID NO: 132551 - DNA, 35 bp, Artificial Sequence
  Synthetic oligonucleotide
acgacgctgacaacttatctcatccccgtcctggt

SEQ ID NO: 132552 - DNA, 35 bp, Artificial Sequence
  Synthetic oligonucleotide
tgccgagagatgtattcgcccgccccactacactt

SEQ ID NO: 132553 - DNA, 35 bp, Artificial Sequence
  Synthetic oligonucleotide
tacggacctcagcacgtcctggcctccctcgcctt

SEQ ID NO: 132554 - DNA, 35 bp, Artificial Sequence
  Synthetic oligonucleotide
gtgcctccgccgccctttagctccacctgtcccaa

SEQ ID NO: 132555 - DNA, 36 bp, Artificial Sequence
  Synthetic oligonucleotide
ggggcgggccccacgagtcctttcctcactccacca

SEQ ID NO: 132556 - DNA, 35 bp, Artificial Sequence
  Synthetic oligonucleotide
agctcgcccgccatagcgcacgttctctccgccca

SEQ ID NO: 132557 - DNA, 36 bp, Artificial Sequence
  Synthetic oligonucleotide
gtacccccgactttgttgctatttaccaatctccca

SEQ ID NO: 132558 - DNA, 36 bp, Artificial Sequence
  Synthetic oligonucleotide
acgccgctgcccctcgtcagtcttggtttcgctcca

SEQ ID NO: 132559 - DNA, 36 bp, Artificial Sequence
  Synthetic oligonucleotide
ttgcctcccacgctctccaattgtcaagttccatca

SEQ ID NO: 132560 - DNA, 36 bp, Artificial Sequence
  Synthetic oligonucleotide
tggtccagtcataacgcgtcggccctctgtctctca

SEQ ID NO: 132561 - DNA, 37 bp, Artificial Sequence
  Synthetic oligonucleotide
agtgtgccgcaggggaaggggtgcgggaagtaaggga

SEQ ID NO: 132562 - DNA, 37 bp, Artificial Sequence
  Synthetic oligonucleotide
tgtatgacgtatggtgggtgttaacgggggggcggga

SEQ ID NO: 132563 - DNA, 37 bp, Artificial Sequence
  Synthetic oligonucleotide
gagccagctcggtcccttcaccttcgccgtccattga

SEQ ID NO: 132564 - DNA, 38 bp, Artificial Sequence
  Synthetic oligonucleotide
tgcctaccctctgctggttacgaccccatctgttttga

SEQ ID NO: 132565 - DNA, 35 bp, Artificial Sequence
  Synthetic oligonucleotide
gcggagagggggcgggaaaggcggagactgtggta

SEQ ID NO: 132566 - DNA, 35 bp, Artificial Sequence
  Synthetic oligonucleotide
gtaccactgccccactggcctatactacgtgtaac

SEQ ID NO: 132567 - DNA, 35 bp, Artificial Sequence
  Synthetic oligonucleotide
tcccgatcttgccccgttccgtcgctttaaccgac

SEQ ID NO: 132568 - DNA, 35 bp, Artificial Sequence
  Synthetic oligonucleotide
accagggctgcctcccgctgcagcagtacatctac

SEQ ID NO: 132569 - DNA, 35 bp, Artificial Sequence
  Synthetic oligonucleotide
gagacgaccttttgcccaacacgccgccagaaacc

SEQ ID NO: 132570 - DNA, 35 bp, Artificial Sequence
  Synthetic oligonucleotide
tgtcgcctccagttacgccttcaaacaagctcccc

SEQ ID NO: 132571 - DNA, 35 bp, Artificial Sequence
  Synthetic oligonucleotide
gcattacaatcaccgttttgcactccttatcacgc

SEQ ID NO: 132572 - DNA, 35 bp, Artificial Sequence
  Synthetic oligonucleotide
gccacttctactggcactgcctccgctactccctc

SEQ ID NO: 132573 - DNA, 35 bp, Artificial Sequence
  Synthetic oligonucleotide
tgacgtaccggtgggcggggggatgggagggcaag

SEQ ID NO: 132574 - DNA, 35 bp, Artificial Sequence
  Synthetic oligonucleotide
atggagggaggaccagaggctaggggtaggtaggg

SEQ ID NO: 132575 - DNA, 35 bp, Artificial Sequence
  Synthetic oligonucleotide
tgagcccagcccacgcaacgcagtcccccgctctg

SEQ ID NO: 132576 - DNA, 35 bp, Artificial Sequence
  Synthetic oligonucleotide
tcaacgccccccgcgtttgctcctatgcacattct

SEQ ID NO: 132577 - DNA, 35 bp, Artificial Sequence
  Synthetic oligonucleotide
gactacgactaattttgcaccatcctaccgttcgt

SEQ ID NO: 132578 - DNA, 36 bp, Artificial Sequence
  Synthetic oligonucleotide
gaaggcgaagggggagcaacatcggagatagggcaa

SEQ ID NO: 132579 - DNA, 35 bp, Artificial Sequence
  Synthetic oligonucleotide
ggaaggggatcaaggggaaagaagggtgtgaagaa

SEQ ID NO: 132580 - DNA, 35 bp, Artificial Sequence
  Synthetic oligonucleotide
actgaagcgatgcaccgtctgcccccgccttctaa

SEQ ID NO: 132581 - DNA, 33 bp, Artificial Sequence
  Synthetic oligonucleotide
gatcgcccatcaatctcttccgaccagtttaca

SEQ ID NO: 132582 - DNA, 37 bp, Artificial Sequence
  Synthetic oligonucleotide
ggagggaggcggaagggcaacgggcgaagcgcacaga

SEQ ID NO: 132583 - DNA, 35 bp, Artificial Sequence
  Synthetic oligonucleotide
gtgacgggagggccggggggggcgcggtactacga

SEQ ID NO: 132584 - DNA, 37 bp, Artificial Sequence
  Synthetic oligonucleotide
gtggagagggggttgaagactgaagcaggggaaggga

SEQ ID NO: 132585 - DNA, 37 bp, Artificial Sequence
  Synthetic oligonucleotide
gaagggtgggcaagagagaaggaggggaggcatggga

SEQ ID NO: 132586 - DNA, 38 bp, Artificial Sequence
  Synthetic oligonucleotide
actgccgcaccgcctgttttttgtcctttcctcactga

SEQ ID NO: 132587 - DNA, 38 bp, Artificial Sequence
  Synthetic oligonucleotide
acacacacgcctcagttcttcttcgccatgccctctga

SEQ ID NO: 132588 - DNA, 38 bp, Artificial Sequence
  Synthetic oligonucleotide
agtgtgcagtgggggaggagaggggaaacaaggtctga

SEQ ID NO: 132589 - DNA, 37 bp, Artificial Sequence
  Synthetic oligonucleotide
tgcgcacaggagagggggggggcctggtggaaggtga

SEQ ID NO: 132590 - DNA, 38 bp, Artificial Sequence
  Synthetic oligonucleotide
gtctcacccgtacgatctgcaccgaacttatcccttga

SEQ ID NO: 132591 - DNA, 36 bp, Artificial Sequence
  Synthetic oligonucleotide
gcgcctcgcatatctgtaccttcgctccggccttga

SEQ ID NO: 132592 - DNA, 36 bp, Artificial Sequence
  Synthetic oligonucleotide
tcctaccgccgtaatctgctcgtgctccccgaacta

SEQ ID NO: 132593 - DNA, 36 bp, Artificial Sequence
  Synthetic oligonucleotide
tcgtggggcgggagatacgaggggggtgtggggcta

SEQ ID NO: 132594 - DNA, 35 bp, Artificial Sequence
  Synthetic oligonucleotide
tgcgaacgccgctttagcttagcccaacctgccac

SEQ ID NO: 132595 - DNA, 35 bp, Artificial Sequence
  Synthetic oligonucleotide
tcattcccagatatcacatcctgttcgcccttggc

SEQ ID NO: 132596 - DNA, 35 bp, Artificial Sequence
  Synthetic oligonucleotide
tccccccccagctgtcttccgccaccgttttctgc

SEQ ID NO: 132597 - DNA, 35 bp, Artificial Sequence
  Synthetic oligonucleotide
aacagccgcactcgtagcgcgctttgcctatcctc

SEQ ID NO: 132598 - DNA, 35 bp, Artificial Sequence
  Synthetic oligonucleotide
acccgcaaccgccgcattattccattctctatacg

SEQ ID NO: 132599 - DNA, 35 bp, Artificial Sequence
  Synthetic oligonucleotide
ggagaggggtgagaaggtgcttgggtttgggtggg

SEQ ID NO: 132600 - DNA, 35 bp, Artificial Sequence
  Synthetic oligonucleotide
tgagccctcctcgcctcttgtcaacccggtcttgt

SEQ ID NO: 132601 - DNA, 36 bp, Artificial Sequence
  Synthetic oligonucleotide
actcccgtccccagctttcgtgcgatccaacctaca

SEQ ID NO: 132602 - DNA, 36 bp, Artificial Sequence
  Synthetic oligonucleotide
tgcaacgcagcggtcactgctcccccccacacgcca

SEQ ID NO: 132603 - DNA, 37 bp, Artificial Sequence
  Synthetic oligonucleotide
tctcacccgccatggtactcgtgtcatccctagtcga

SEQ ID NO: 132604 - DNA, 38 bp, Artificial Sequence
  Synthetic oligonucleotide
gccacatctcagtgtgcccgccacccccgccctcctga

SEQ ID NO: 132605 - DNA, 38 bp, Artificial Sequence
  Synthetic oligonucleotide
tactgcggctgccttcgctccctcccggttccccgtga

SEQ ID NO: 132606 - DNA, 34 bp, Artificial Sequence
  Synthetic oligonucleotide
tgttgccccacaggctttctacgccatcttttga

SEQ ID NO: 132607 - DNA, 35 bp, Artificial Sequence
  Synthetic oligonucleotide
gtcctccccccatttgtgctcgtgctttcattata

SEQ ID NO: 132608 - DNA, 36 bp, Artificial Sequence
  Synthetic oligonucleotide
gatcgcacaccagtctggcccgtcgtcccttccgta

SEQ ID NO: 132609 - DNA, 38 bp, Artificial Sequence
  Synthetic oligonucleotide
tggggggagggttaggggttacgtattgggggccctta

SEQ ID NO: 132610 - DNA, 36 bp, Artificial Sequence
  Synthetic oligonucleotide
gtagcccgcaatcctcgccattagaacttctcctta

SEQ ID NO: 132611 - DNA, 36 bp, Artificial Sequence
  Synthetic oligonucleotide
gtggtggcggggaggcctaaacggggtaggcggtta

SEQ ID NO: 132612 - DNA, 35 bp, Artificial Sequence
  Synthetic oligonucleotide
gtcgaagacagggtggaatatgagggggcgggaac

SEQ ID NO: 132613 - DNA, 35 bp, Artificial Sequence
  Synthetic oligonucleotide
ttgagcctgcgtcttcttcacctccgcctacgccc

SEQ ID NO: 132614 - DNA, 35 bp, Artificial Sequence
  Synthetic oligonucleotide
tcacacgtgtctgtccctgtcgtccgtcgtttccc

SEQ ID NO: 132615 - DNA, 35 bp, Artificial Sequence
  Synthetic oligonucleotide
ttcgaccgcgtgtacgtaatcggtcgctcccttcc

SEQ ID NO: 132616 - DNA, 35 bp, Artificial Sequence
  Synthetic oligonucleotide
gacgtccgacgcttccgtttaatacactttcctgt

SEQ ID NO: 132617 - DNA, 36 bp, Artificial Sequence
  Synthetic oligonucleotide
agaatatgagggcgggggggaagggacgggttgaaa

SEQ ID NO: 132618 - DNA, 36 bp, Artificial Sequence
  Synthetic oligonucleotide
gaaactccagccccattgcgtgctccacccgccaca

SEQ ID NO: 132619 - DNA, 36 bp, Artificial Sequence
  Synthetic oligonucleotide
tccgccaccgcccataagctttcttcatccccctca

SEQ ID NO: 132620 - DNA, 37 bp, Artificial Sequence
  Synthetic oligonucleotide
agccgcagaccccttggtgtaagctccacctccctga

SEQ ID NO: 132621 - DNA, 35 bp, Artificial Sequence
  Synthetic oligonucleotide
ttcgaagacgggtgggggggtcaggccgacgggta

SEQ ID NO: 132622 - DNA, 35 bp, Artificial Sequence
  Synthetic oligonucleotide
attgtgtcacagcctgccccccccgatcctgatcc

SEQ ID NO: 132623 - DNA, 35 bp, Artificial Sequence
  Synthetic oligonucleotide
attaacaatcgctcctgtccaagctcgccgcccgc

SEQ ID NO: 132624 - DNA, 35 bp, Artificial Sequence
  Synthetic oligonucleotide
gcgagctggtcccctccctgattaacggcttcctc

SEQ ID NO: 132625 - DNA, 35 bp, Artificial Sequence
  Synthetic oligonucleotide
gatccctggacacattggttaacgttatcaccttc

SEQ ID NO: 132626 - DNA, 35 bp, Artificial Sequence
  Synthetic oligonucleotide
gacatcgaccttctatatttctggctcccttgttc

SEQ ID NO: 132627 - DNA, 35 bp, Artificial Sequence
  Synthetic oligonucleotide
ggaccacccctcattagccgaataattgccgccat

SEQ ID NO: 132628 - DNA, 35 bp, Artificial Sequence
  Synthetic oligonucleotide
tccccgtgacgccacctgatctcttgatacgctat

SEQ ID NO: 132629 - DNA, 35 bp, Artificial Sequence
  Synthetic oligonucleotide
agtcatttcgcctgccgtgaactcccgcgccccct

SEQ ID NO: 132630 - DNA, 35 bp, Artificial Sequence
  Synthetic oligonucleotide
tgcgcggaatccacatggtactgcctgccctttct

SEQ ID NO: 132631 - DNA, 35 bp, Artificial Sequence
  Synthetic oligonucleotide
aagactaggggacggaatgggaaagtgcgaggagt

SEQ ID NO: 132632 - DNA, 35 bp, Artificial Sequence
  Synthetic oligonucleotide
gccgccaggcccaccaccgtgcgattcccacaatt

SEQ ID NO: 132633 - DNA, 35 bp, Artificial Sequence
  Synthetic oligonucleotide
gtcggtcattcctgatcgctcctctttgttgcctt

SEQ ID NO: 132634 - DNA, 35 bp, Artificial Sequence
  Synthetic oligonucleotide
tacacccccccatggcgatgcacgagtgctttaca

SEQ ID NO: 132635 - DNA, 36 bp, Artificial Sequence
  Synthetic oligonucleotide
gtgaccgtcgaaggtcccgggccccatcctctatca

SEQ ID NO: 132636 - DNA, 35 bp, Artificial Sequence
  Synthetic oligonucleotide
tgtccttcgcacagcctttcgttctgccttatcga

SEQ ID NO: 132637 - DNA, 36 bp, Artificial Sequence
  Synthetic oligonucleotide
gcagagggccggttacggaggaagggcgaaagggga

SEQ ID NO: 132638 - DNA, 38 bp, Artificial Sequence
  Synthetic oligonucleotide
taacccctcgcctcctcacccagccggtcctttcatga

SEQ ID NO: 132639 - DNA, 38 bp, Artificial Sequence
  Synthetic oligonucleotide
gttccaccggcgattaagtgtccccactttcacactga

SEQ ID NO: 132640 - DNA, 35 bp, Artificial Sequence
  Synthetic oligonucleotide
tgtcaccgccacatcctccagggtactatctttga

SEQ ID NO: 132641 - DNA, 38 bp, Artificial Sequence
  Synthetic oligonucleotide
tagacatcgctctggatctatccgtgccttttctttga

SEQ ID NO: 132642 - DNA, 35 bp, Artificial Sequence
  Synthetic oligonucleotide
attcgccccatcaagcctcactgtactatctagta

SEQ ID NO: 132643 - DNA, 36 bp, Artificial Sequence
  Synthetic oligonucleotide
attgggcgggccagggtgggtactacggaatgtgta

SEQ ID NO: 132644 - DNA, 33 bp, Artificial Sequence
  Synthetic oligonucleotide
acgccatacgccacccaatccacccgtagcaac

SEQ ID NO: 132645 - DNA, 35 bp, Artificial Sequence
  Synthetic oligonucleotide
gctgagccatcttatgatctgcattccccccgaac

SEQ ID NO: 132646 - DNA, 35 bp, Artificial Sequence
  Synthetic oligonucleotide
gcgcacctcaaggttgttgaacccgcctctacccc

SEQ ID NO: 132647 - DNA, 35 bp, Artificial Sequence
  Synthetic oligonucleotide
tgctccatcctctgcaaatatcccgtaacagctcc

SEQ ID NO: 132648 - DNA, 35 bp, Artificial Sequence
  Synthetic oligonucleotide
gcctccctgtcccttggtcctatacgggtgtactc

SEQ ID NO: 132649 - DNA, 35 bp, Artificial Sequence
  Synthetic oligonucleotide
gcatcgctgctttctcattgattcaccggtacctc

SEQ ID NO: 132650 - DNA, 35 bp, Artificial Sequence
  Synthetic oligonucleotide
acccccacccctcgagaaacgatgcagcatgcctc

SEQ ID NO: 132651 - DNA, 35 bp, Artificial Sequence
  Synthetic oligonucleotide
tctggaagcagaaggaggactggaggaagggcggg

SEQ ID NO: 132652 - DNA, 35 bp, Artificial Sequence
  Synthetic oligonucleotide
gtgggggggagcacggcaaaggagaagtccaggat

SEQ ID NO: 132653 - DNA, 35 bp, Artificial Sequence
  Synthetic oligonucleotide
ttacgcctctcttgcttattgaccccgggtgttct

SEQ ID NO: 132654 - DNA, 35 bp, Artificial Sequence
  Synthetic oligonucleotide
accacgaccgttctgccctacacgtagccatttgt

SEQ ID NO: 132655 - DNA, 35 bp, Artificial Sequence
  Synthetic oligonucleotide
gaaacgggggaaggcacacaggcggagtgagagga

SEQ ID NO: 132656 - DNA, 37 bp, Artificial Sequence
  Synthetic oligonucleotide
acacccccgcgctgttctttcttttaacgatccttga

SEQ ID NO: 132657 - DNA, 35 bp, Artificial Sequence
  Synthetic oligonucleotide
tctgatgcaggtctcgtactctccttttctggccc

SEQ ID NO: 132658 - DNA, 36 bp, Artificial Sequence
  Synthetic oligonucleotide
tcatccgactactatacatgccctggggtcacctcc

SEQ ID NO: 132659 - DNA, 35 bp, Artificial Sequence
  Synthetic oligonucleotide
tgccctcacattcggtacacccgcgcaagctctcc

SEQ ID NO: 132660 - DNA, 35 bp, Artificial Sequence
  Synthetic oligonucleotide
taccgcagggccataaggcgctcactcttccttcc

SEQ ID NO: 132661 - DNA, 35 bp, Artificial Sequence
  Synthetic oligonucleotide
tgtgcccttattgtgaacgccgtttcattctccgc

SEQ ID NO: 132662 - DNA, 35 bp, Artificial Sequence
  Synthetic oligonucleotide
tagtgcgccacatccagcccttcgttctcgcttgc

SEQ ID NO: 132663 - DNA, 35 bp, Artificial Sequence
  Synthetic oligonucleotide
actacctccacgccaggtggttactcttacccctc

SEQ ID NO: 132664 - DNA, 35 bp, Artificial Sequence
  Synthetic oligonucleotide
gtccccccaaagttgtccgctatcccttctcttcg

SEQ ID NO: 132665 - DNA, 36 bp, Artificial Sequence
  Synthetic oligonucleotide
gatcagcctgtcatcactttgatttggtctctcctg

SEQ ID NO: 132666 - DNA, 35 bp, Artificial Sequence
  Synthetic oligonucleotide
gacctctctccttctgttttgcgatagcgcaccct

SEQ ID NO: 132667 - DNA, 35 bp, Artificial Sequence
  Synthetic oligonucleotide
gtcaccatcattatatcgctttcagtctcccgcct

SEQ ID NO: 132668 - DNA, 35 bp, Artificial Sequence
  Synthetic oligonucleotide
gacacgtgtactagtccctatgctgccctccctct

SEQ ID NO: 132669 - DNA, 35 bp, Artificial Sequence
  Synthetic oligonucleotide
gaaggctcgctcgctccgtcaccttggtctcttct

SEQ ID NO: 132670 - DNA, 35 bp, Artificial Sequence
  Synthetic oligonucleotide
gtaacgcatcggcaagcctcgcccccccaacctgt

SEQ ID NO: 132671 - DNA, 35 bp, Artificial Sequence
  Synthetic oligonucleotide
gggatggcctcggaggagaaggggtaggttaggtt

SEQ ID NO: 132672 - DNA, 36 bp, Artificial Sequence
  Synthetic oligonucleotide
tcatccgccccttatatgctagtccccgtcctgaaa

SEQ ID NO: 132673 - DNA, 36 bp, Artificial Sequence
  Synthetic oligonucleotide
tcaccacccatgttatcctgttcgattttgccataa

SEQ ID NO: 132674 - DNA, 36 bp, Artificial Sequence
  Synthetic oligonucleotide
ggtaagcaccgccgggggggggacgggaaggggtaa

SEQ ID NO: 132675 - DNA, 36 bp, Artificial Sequence
  Synthetic oligonucleotide
atggccccctcgtgcgtcaaggaccctatccaccca

SEQ ID NO: 132676 - DNA, 36 bp, Artificial Sequence
  Synthetic oligonucleotide
tctatcgcgcccgccctgtcccacgctagcctgtca

SEQ ID NO: 132677 - DNA, 37 bp, Artificial Sequence
  Synthetic oligonucleotide
gcccccgaagctactcgacactcccgtccctccgcga

SEQ ID NO: 132678 - DNA, 37 bp, Artificial Sequence
  Synthetic oligonucleotide
tgcacattgtccgttctatcccacctggccccccgga

SEQ ID NO: 132679 - DNA, 37 bp, Artificial Sequence
  Synthetic oligonucleotide
tgcaccccccctggtctgcttgtttcttccttgtgga

SEQ ID NO: 132680 - DNA, 37 bp, Artificial Sequence
  Synthetic oligonucleotide
gcaacacttgccgacctgatctactcgccctccttga

SEQ ID NO: 132681 - DNA, 35 bp, Artificial Sequence
  Synthetic oligonucleotide
atagagcacgcgctttcgttaccgttccttcgccc

SEQ ID NO: 132682 - DNA, 35 bp, Artificial Sequence
  Synthetic oligonucleotide
tgctcgctgccgtctcatgctttactcgtacctcc

SEQ ID NO: 132683 - DNA, 35 bp, Artificial Sequence
  Synthetic oligonucleotide
accggccacgcttacctatggtttttcgccccttc

SEQ ID NO: 132684 - DNA, 35 bp, Artificial Sequence
  Synthetic oligonucleotide
aataccgtgctgagtcccgtgccttctgtacctat

SEQ ID NO: 132685 - DNA, 35 bp, Artificial Sequence
  Synthetic oligonucleotide
gcaaggcacatgctacttgccacatcccacacctt

SEQ ID NO: 132686 - DNA, 35 bp, Artificial Sequence
  Synthetic oligonucleotide
gtctgggggggaacggggtctggagggacgtggaa

SEQ ID NO: 132687 - DNA, 36 bp, Artificial Sequence
  Synthetic oligonucleotide
gacaccccatattggcttgctagctacggtctccca

SEQ ID NO: 132688 - DNA, 36 bp, Artificial Sequence
  Synthetic oligonucleotide
aaccgcacctatcacttgtatcagccccttctatca

SEQ ID NO: 132689 - DNA, 37 bp, Artificial Sequence
  Synthetic oligonucleotide
aacggggaaggaaggacgggggggccggggtaggaga

SEQ ID NO: 132690 - DNA, 38 bp, Artificial Sequence
  Synthetic oligonucleotide
ttggaagggaaaggtaaggtggggagaaggggtaatga

SEQ ID NO: 132691 - DNA, 37 bp, Artificial Sequence
  Synthetic oligonucleotide
ttgcaagagggaggggtgaggggtgagggcgcggtga

SEQ ID NO: 132692 - DNA, 38 bp, Artificial Sequence
  Synthetic oligonucleotide
ggaggggggaggtaggtggggtgaacagacacatgtga

SEQ ID NO: 132693 - DNA, 37 bp, Artificial Sequence
  Synthetic oligonucleotide
gatgcgcaacattttccccactgccgtccctccttga

SEQ ID NO: 132694 - DNA, 37 bp, Artificial Sequence
  Synthetic oligonucleotide
tcatcgctgcctgctccggccctcacttttatgttga

SEQ ID NO: 132695 - DNA, 35 bp, Artificial Sequence
  Synthetic oligonucleotide
tcacacgggtgccggccgtctattcgcactcccta

SEQ ID NO: 132696 - DNA, 36 bp, Artificial Sequence
  Synthetic oligonucleotide
acccgcactccgccttgcctctagcttgacatctta

SEQ ID NO: 132697 - DNA, 35 bp, Artificial Sequence
  Synthetic oligonucleotide
accgcgtcattacgtcgttgtcctgccgcctgcac

SEQ ID NO: 132698 - DNA, 35 bp, Artificial Sequence
  Synthetic oligonucleotide
taacgggtcagagcctctcacgtccttctgtctac

SEQ ID NO: 132699 - DNA, 35 bp, Artificial Sequence
  Synthetic oligonucleotide
gacacaagcctgggaacctccgcttctccttcacc

SEQ ID NO: 132700 - DNA, 35 bp, Artificial Sequence
  Synthetic oligonucleotide
tcgacgtcttcggctccccgcgcgcttccacttcc

SEQ ID NO: 132701 - DNA, 35 bp, Artificial Sequence
  Synthetic oligonucleotide
tctacacactgaggaacgaatccactcgcccctgc

SEQ ID NO: 132702 - DNA, 35 bp, Artificial Sequence
  Synthetic oligonucleotide
tgccatcccattatcttcatccgcgccgctaactg

SEQ ID NO: 132703 - DNA, 35 bp, Artificial Sequence
  Synthetic oligonucleotide
acgacgcactatctgccgtgcgccttccctcgtat

SEQ ID NO: 132704 - DNA, 35 bp, Artificial Sequence
  Synthetic oligonucleotide
accgccgccacctagcttattaaccatcgcttctt

SEQ ID NO: 132705 - DNA, 36 bp, Artificial Sequence
  Synthetic oligonucleotide
gagtgaggaacagggaggtgcggacgggcatgggaa

SEQ ID NO: 132706 - DNA, 35 bp, Artificial Sequence
  Synthetic oligonucleotide
ttacacacccgctcgcttccatctacgatgagaca

SEQ ID NO: 132707 - DNA, 35 bp, Artificial Sequence
  Synthetic oligonucleotide
tccccgtgctactctattcgctatgaccttgtcca

SEQ ID NO: 132708 - DNA, 36 bp, Artificial Sequence
  Synthetic oligonucleotide
acgatccactccatccgtttcatccatctattagca

SEQ ID NO: 132709 - DNA, 36 bp, Artificial Sequence
  Synthetic oligonucleotide
acgcaacatacggagtatgatcttgaactcctctca

SEQ ID NO: 132710 - DNA, 35 bp, Artificial Sequence
  Synthetic oligonucleotide
ggactcccccccacgttgtttgctgaacattgtca

SEQ ID NO: 132711 - DNA, 37 bp, Artificial Sequence
  Synthetic oligonucleotide
acgttgcggcacatctctcgcccctcttgtcccccga

SEQ ID NO: 132712 - DNA, 37 bp, Artificial Sequence
  Synthetic oligonucleotide
acgccacaccctgttgatcatttccgtccttgtagga

SEQ ID NO: 132713 - DNA, 36 bp, Artificial Sequence
  Synthetic oligonucleotide
gtcccatcccccgatcccagtataccgttcacgtga

SEQ ID NO: 132714 - DNA, 37 bp, Artificial Sequence
  Synthetic oligonucleotide
aacagtggagcgtagagggagggagggtaaagggtga

SEQ ID NO: 132715 - DNA, 35 bp, Artificial Sequence
  Synthetic oligonucleotide
gtaagccatcaccctgctacagacgagccccaccc

SEQ ID NO: 132716 - DNA, 35 bp, Artificial Sequence
  Synthetic oligonucleotide
atgacgccctgtctttgcgctactccggatttccc

SEQ ID NO: 132717 - DNA, 35 bp, Artificial Sequence
  Synthetic oligonucleotide
acagtgcgcgcctctgcgtccaccgcccttaacgc

SEQ ID NO: 132718 - DNA, 35 bp, Artificial Sequence
  Synthetic oligonucleotide
accaccctcgctaacatttgttccctaacgtgatc

SEQ ID NO: 132719 - DNA, 35 bp, Artificial Sequence
  Synthetic oligonucleotide
atggcaaagtactacccggccgccaccagtccccg

SEQ ID NO: 132720 - DNA, 35 bp, Artificial Sequence
  Synthetic oligonucleotide
gaggtgtcgcccgcattccgattcatcgtttcccg

SEQ ID NO: 132721 - DNA, 35 bp, Artificial Sequence
  Synthetic oligonucleotide
gccagtgctgcctctatcatttatgtgctccctcg

SEQ ID NO: 132722 - DNA, 35 bp, Artificial Sequence
  Synthetic oligonucleotide
gtggtggtgggggcagtaaggtagaactgggttgg

SEQ ID NO: 132723 - DNA, 35 bp, Artificial Sequence
  Synthetic oligonucleotide
tacaatccgccgcaccatctagcccctgttagcat

SEQ ID NO: 132724 - DNA, 35 bp, Artificial Sequence
  Synthetic oligonucleotide
ttcctgccgcagtctctctccgcacacatcccact

SEQ ID NO: 132725 - DNA, 35 bp, Artificial Sequence
  Synthetic oligonucleotide
atccactctgggttgttctcagccttatttaccct

SEQ ID NO: 132726 - DNA, 35 bp, Artificial Sequence
  Synthetic oligonucleotide
atctctcccgtcccttcgtaacagtaactcgccct

SEQ ID NO: 132727 - DNA, 36 bp, Artificial Sequence
  Synthetic oligonucleotide
accaacaccgccagagcttgccctgtctaccctgaa

SEQ ID NO: 132728 - DNA, 36 bp, Artificial Sequence
  Synthetic oligonucleotide
tcactctccgcgactcgactcccaccactgtctaca

SEQ ID NO: 132729 - DNA, 35 bp, Artificial Sequence
  Synthetic oligonucleotide
ttgctacgtactcgttacctcccacacctcttgga

SEQ ID NO: 132730 - DNA, 38 bp, Artificial Sequence
  Synthetic oligonucleotide
tccgcacacctgcctccccccggccataggccccgtga

SEQ ID NO: 132731 - DNA, 37 bp, Artificial Sequence
  Synthetic oligonucleotide
actacaccagcaggaggggggggggccattagggtga

SEQ ID NO: 132732 - DNA, 38 bp, Artificial Sequence
  Synthetic oligonucleotide
aacgacacaacgtgtgtctccgcccccctaccctttga

SEQ ID NO: 132733 - DNA, 35 bp, Artificial Sequence
  Synthetic oligonucleotide
tctcgctcccggcctacgacattattaccgttcac

SEQ ID NO: 132734 - DNA, 35 bp, Artificial Sequence
  Synthetic oligonucleotide
accacgcccctctggctatgatttggcttcactac

SEQ ID NO: 132735 - DNA, 35 bp, Artificial Sequence
  Synthetic oligonucleotide
tgtctaacgctcccgagtctctcgtattcgcctcc

SEQ ID NO: 132736 - DNA, 35 bp, Artificial Sequence
  Synthetic oligonucleotide
taccggcactcctcacgctcgtccaccactcgctc

SEQ ID NO: 132737 - DNA, 35 bp, Artificial Sequence
  Synthetic oligonucleotide
gatgcatcctaccgccattcgccccgatcccgctg

SEQ ID NO: 132738 - DNA, 34 bp, Artificial Sequence
  Synthetic oligonucleotide
gcaatacccgttatcctcgcgccacccgttacat

SEQ ID NO: 132739 - DNA, 35 bp, Artificial Sequence
  Synthetic oligonucleotide
gcctggctcccaattcgtttcagcccgaaccctat

SEQ ID NO: 132740 - DNA, 34 bp, Artificial Sequence
  Synthetic oligonucleotide
tatgtaattcgccgagtacgcccccgttgcccct

SEQ ID NO: 132741 - DNA, 35 bp, Artificial Sequence
  Synthetic oligonucleotide
atcagcacagatcagtccgtccttccctcccccgt

SEQ ID NO: 132742 - DNA, 35 bp, Artificial Sequence
  Synthetic oligonucleotide
gcagacgcacctcggccgctctgcccctctctttt

SEQ ID NO: 132743 - DNA, 36 bp, Artificial Sequence
  Synthetic oligonucleotide
tgatgtattgcctgtgcctttgccgcctcacctcca

SEQ ID NO: 132744 - DNA, 36 bp, Artificial Sequence
  Synthetic oligonucleotide
actgaaccccgttgcattatctgtactgctcttcca

SEQ ID NO: 132745 - DNA, 36 bp, Artificial Sequence
  Synthetic oligonucleotide
ggccaaccgtctgcttagtccctcctgccgtcttca

SEQ ID NO: 132746 - DNA, 37 bp, Artificial Sequence
  Synthetic oligonucleotide
tcgaaacgggacgtgttgtgtagggggggacgggaga

SEQ ID NO: 132747 - DNA, 37 bp, Artificial Sequence
  Synthetic oligonucleotide
ttgacgcccacactcgcgtatatcgccttttcctcga

SEQ ID NO: 132748 - DNA, 37 bp, Artificial Sequence
  Synthetic oligonucleotide
gaggggacacggggtgaatcgggggctgaaagtggga

SEQ ID NO: 132749 - DNA, 38 bp, Artificial Sequence
  Synthetic oligonucleotide
gatacgtggaagggtaaggacggcgggggagtacatga

SEQ ID NO: 132750 - DNA, 37 bp, Artificial Sequence
  Synthetic oligonucleotide
gtaccccgccagaatcctatgcatccaccttccttga

SEQ ID NO: 132751 - DNA, 38 bp, Artificial Sequence
  Synthetic oligonucleotide
agcggagacagggttggtggggaggcgatgggggttga

SEQ ID NO: 132752 - DNA, 35 bp, Artificial Sequence
  Synthetic oligonucleotide
gaccactaccagtgccctgctttctaccactttga

SEQ ID NO: 132753 - DNA, 35 bp, Artificial Sequence
  Synthetic oligonucleotide
acactgccacaactttcagggccaccgctacgcta

SEQ ID NO: 132754 - DNA, 35 bp, Artificial Sequence
  Synthetic oligonucleotide
gtcgcatcgcaattgccgctaccgatgcctcctta

SEQ ID NO: 132755 - DNA, 36 bp, Artificial Sequence
  Synthetic oligonucleotide
gtgtgccctcgaacgtacgcgctcccccttatttta

SEQ ID NO: 132756 - DNA, 35 bp, Artificial Sequence
  Synthetic oligonucleotide
aaggatagcctgcccctggtttcgctctattgtcc

SEQ ID NO: 132757 - DNA, 35 bp, Artificial Sequence
  Synthetic oligonucleotide
atcagcctatgtaatccgctccctgttccgctagc

SEQ ID NO: 132758 - DNA, 35 bp, Artificial Sequence
  Synthetic oligonucleotide
tcgcgttcctcagacttccaacactccttcttcgc

SEQ ID NO: 132759 - DNA, 35 bp, Artificial Sequence
  Synthetic oligonucleotide
gaaccgcgataggtgctctatttgtcctcccgctc

SEQ ID NO: 132760 - DNA, 35 bp, Artificial Sequence
  Synthetic oligonucleotide
atcagagcgcacctcctctcgtgtcgattgctctc

SEQ ID NO: 132761 - DNA, 35 bp, Artificial Sequence
  Synthetic oligonucleotide
tacagtcgcactggcatcattccctacgttttgtc

SEQ ID NO: 132762 - DNA, 35 bp, Artificial Sequence
  Synthetic oligonucleotide
ggtaccgcccaactgctactccccactgttaaacg

SEQ ID NO: 132763 - DNA, 35 bp, Artificial Sequence
  Synthetic oligonucleotide
tcacctcaccgccgctctagcgagtacccacatcg

SEQ ID NO: 132764 - DNA, 35 bp, Artificial Sequence
  Synthetic oligonucleotide
tcgctatgccctatgcattgacgcctgttccctcg

SEQ ID NO: 132765 - DNA, 35 bp, Artificial Sequence
  Synthetic oligonucleotide
tgtctcccgacaccagcttacatcccgcccgtttg

SEQ ID NO: 132766 - DNA, 36 bp, Artificial Sequence
  Synthetic oligonucleotide
tgccccaaacctgtgactcgcccatgtcgttctcca

SEQ ID NO: 132767 - DNA, 35 bp, Artificial Sequence
  Synthetic oligonucleotide
gataccgttccatagcctatcaactcccctgttca

SEQ ID NO: 132768 - DNA, 37 bp, Artificial Sequence
  Synthetic oligonucleotide
gcttactcgccgcctgtccgtctatactgcccatcga

SEQ ID NO: 132769 - DNA, 35 bp, Artificial Sequence
  Synthetic oligonucleotide
tgagggcgatgcgggcggaggaggatatgcaggga

SEQ ID NO: 132770 - DNA, 37 bp, Artificial Sequence
  Synthetic oligonucleotide
gacccacaacctgccagtactagcctgccttccatga

SEQ ID NO: 132771 - DNA, 36 bp, Artificial Sequence
  Synthetic oligonucleotide
gccccatgcctgaactgtactcgatccgctgaatta

SEQ ID NO: 132772 - DNA, 36 bp, Artificial Sequence
  Synthetic oligonucleotide
gacatcccgttacctctcctgtgcactgcggccacc

SEQ ID NO: 132773 - DNA, 35 bp, Artificial Sequence
  Synthetic oligonucleotide
gcactgtgtcattgtaaattgtgccgccccccccc

SEQ ID NO: 132774 - DNA, 35 bp, Artificial Sequence
  Synthetic oligonucleotide
gctgcctcgtcctcaagccacagcatgcccccgcc

SEQ ID NO: 132775 - DNA, 35 bp, Artificial Sequence
  Synthetic oligonucleotide
gcgccgaagtgcagctcgacccgccattcttttcc

SEQ ID NO: 132776 - DNA, 35 bp, Artificial Sequence
  Synthetic oligonucleotide
gacgatacacactgcctctgttatttaacaccctc

SEQ ID NO: 132777 - DNA, 35 bp, Artificial Sequence
  Synthetic oligonucleotide
tgtcacccgatatcacgtcggctctacctgtcctc

SEQ ID NO: 132778 - DNA, 35 bp, Artificial Sequence
  Synthetic oligonucleotide
agatcgcgaagcccggtcgtcttttctctgtcctc

SEQ ID NO: 132779 - DNA, 35 bp, Artificial Sequence
  Synthetic oligonucleotide
tagactgcccttcccttgtccccttcaccggtacg

SEQ ID NO: 132780 - DNA, 35 bp, Artificial Sequence
  Synthetic oligonucleotide
atctttcgtgccccatcctgcagtcacagcttacg

SEQ ID NO: 132781 - DNA, 35 bp, Artificial Sequence
  Synthetic oligonucleotide
gtccccctcatccgcatgtcttctaggcctgtgcg

SEQ ID NO: 132782 - DNA, 35 bp, Artificial Sequence
  Synthetic oligonucleotide
tgccggaggagggaggggggttcgaaaagaccgtg

SEQ ID NO: 132783 - DNA, 35 bp, Artificial Sequence
  Synthetic oligonucleotide
tgttctatcccaggccctctcagtgccacgcttat

SEQ ID NO: 132784 - DNA, 34 bp, Artificial Sequence
  Synthetic oligonucleotide
gactgagagcgttctcgccgtcaacatttcctct

SEQ ID NO: 132785 - DNA, 35 bp, Artificial Sequence
  Synthetic oligonucleotide
gacaggcgtagtcttcgttattccgccttacctgt

SEQ ID NO: 132786 - DNA, 35 bp, Artificial Sequence
  Synthetic oligonucleotide
gccatcgccctcctttccgctctcagaggcaactt

SEQ ID NO: 132787 - DNA, 35 bp, Artificial Sequence
  Synthetic oligonucleotide
gccggggggggtggggtatctcaaggaaggtggtt

SEQ ID NO: 132788 - DNA, 35 bp, Artificial Sequence
  Synthetic oligonucleotide
gatggatggggcacaggggtttggggaggagtgca

SEQ ID NO: 132789 - DNA, 37 bp, Artificial Sequence
  Synthetic oligonucleotide
aacctgagcgggaggtaggtatgggtgggggggtaga

SEQ ID NO: 132790 - DNA, 36 bp, Artificial Sequence
  Synthetic oligonucleotide
tccaggcactgattgcctggcctcccatttctccga

SEQ ID NO: 132791 - DNA, 38 bp, Artificial Sequence
  Synthetic oligonucleotide
agacgcaggcaggggtgggaggggggtgtagcggatga

SEQ ID NO: 132792 - DNA, 35 bp, Artificial Sequence
  Synthetic oligonucleotide
gtggggagcagaggggggacgaggtcgccagctga

SEQ ID NO: 132793 - DNA, 38 bp, Artificial Sequence
  Synthetic oligonucleotide
tgcacaccgtctacgttttcccgcacccgtttcgctga

SEQ ID NO: 132794 - DNA, 35 bp, Artificial Sequence
  Synthetic oligonucleotide
tcccgtaccatcattgcgcctgcctaagccgagta

SEQ ID NO: 132795 - DNA, 35 bp, Artificial Sequence
  Synthetic oligonucleotide
accccgctatctgttcccttatcctgtttctggac

SEQ ID NO: 132796 - DNA, 35 bp, Artificial Sequence
  Synthetic oligonucleotide
atccccgtacatcctgttgccaccaaatgactacc

SEQ ID NO: 132797 - DNA, 35 bp, Artificial Sequence
  Synthetic oligonucleotide
tctgacccgcctgtagacatcctgtcactccgtcc

SEQ ID NO: 132798 - DNA, 35 bp, Artificial Sequence
  Synthetic oligonucleotide
gcacagtgttcctgtccgttagccatttcgttagc

SEQ ID NO: 132799 - DNA, 35 bp, Artificial Sequence
  Synthetic oligonucleotide
tgcatatgtgactattgccccctctcgtgccctcg

SEQ ID NO: 132800 - DNA, 35 bp, Artificial Sequence
  Synthetic oligonucleotide
agtgaactgttaggggtgggtaggaatggagaagg

SEQ ID NO: 132801 - DNA, 35 bp, Artificial Sequence
  Synthetic oligonucleotide
gatgagtgggagggtggacatggaggcgcgatttg

SEQ ID NO: 132802 - DNA, 35 bp, Artificial Sequence
  Synthetic oligonucleotide
gcctcctcacatatccccggctactggtgccctct

SEQ ID NO: 132803 - DNA, 35 bp, Artificial Sequence
  Synthetic oligonucleotide
gcctccaccaagcgttcctcatcagtccgtccctt

SEQ ID NO: 132804 - DNA, 35 bp, Artificial Sequence
  Synthetic oligonucleotide
gatgatcgccctcccctgacaactgtgacatccaa

SEQ ID NO: 132805 - DNA, 35 bp, Artificial Sequence
  Synthetic oligonucleotide
acgcacgcctgccttccctttattcgcctatcgaa

SEQ ID NO: 132806 - DNA, 36 bp, Artificial Sequence
  Synthetic oligonucleotide
gtggagggaggacgggttagaacgtcgaggaaggca

SEQ ID NO: 132807 - DNA, 36 bp, Artificial Sequence
  Synthetic oligonucleotide
gtaccacgtccccgccgatctggtccacttatttca

SEQ ID NO: 132808 - DNA, 37 bp, Artificial Sequence
  Synthetic oligonucleotide
gaccccgcccatgtccatactcctcttttacgtgaga

SEQ ID NO: 132809 - DNA, 37 bp, Artificial Sequence
  Synthetic oligonucleotide
tgtgtgtagcgacaccttcgttgcccccctcgcccga

SEQ ID NO: 132810 - DNA, 37 bp, Artificial Sequence
  Synthetic oligonucleotide
gactcctcagctgaggatcgctctagccccccgccga

SEQ ID NO: 132811 - DNA, 37 bp, Artificial Sequence
  Synthetic oligonucleotide
gagggcggggttggggtattaatgctcgctcggggga

SEQ ID NO: 132812 - DNA, 37 bp, Artificial Sequence
  Synthetic oligonucleotide
acccgcccctccgctgccagggaccctcggacttgga

SEQ ID NO: 132813 - DNA, 35 bp, Artificial Sequence
  Synthetic oligonucleotide
tcgtcgtctccgttgcgccatcagccccgtttcta

SEQ ID NO: 132814 - DNA, 35 bp, Artificial Sequence
  Synthetic oligonucleotide
cgaacgcatccgtccgcttctctgctacgcccgac

SEQ ID NO: 132815 - DNA, 35 bp, Artificial Sequence
  Synthetic oligonucleotide
taccccctcgctccgtttgcccacgtaccccggac

SEQ ID NO: 132816 - DNA, 35 bp, Artificial Sequence
  Synthetic oligonucleotide
gatcgccgtccaatcttgatccctgaccactcgcc

SEQ ID NO: 132817 - DNA, 35 bp, Artificial Sequence
  Synthetic oligonucleotide
tccggcccttcacactattcgccacatcatgccgc

SEQ ID NO: 132818 - DNA, 35 bp, Artificial Sequence
  Synthetic oligonucleotide
atccgcctccaaaaggtgaaagcttcctcctccgc

SEQ ID NO: 132819 - DNA, 35 bp, Artificial Sequence
  Synthetic oligonucleotide
agtgttgtgcagggtcctgtttgctccgtcctcgc

SEQ ID NO: 132820 - DNA, 35 bp, Artificial Sequence
  Synthetic oligonucleotide
tgcgagttgcatccgttttgcgcttggtactcctc

SEQ ID NO: 132821 - DNA, 35 bp, Artificial Sequence
  Synthetic oligonucleotide
attcgggcccgccgaattataacacctactctttc

SEQ ID NO: 132822 - DNA, 35 bp, Artificial Sequence
  Synthetic oligonucleotide
gactcgcctatcccctttagtacgcccttgaccag

SEQ ID NO: 132823 - DNA, 35 bp, Artificial Sequence
  Synthetic oligonucleotide
gccctcgacagggtccctatcattgtcgctcccat

SEQ ID NO: 132824 - DNA, 35 bp, Artificial Sequence
  Synthetic oligonucleotide
ccccattgctgctctatactggcaaggtcccatct

SEQ ID NO: 132825 - DNA, 35 bp, Artificial Sequence
  Synthetic oligonucleotide
gccccctccgagattacattagtggtggtccctct

SEQ ID NO: 132826 - DNA, 35 bp, Artificial Sequence
  Synthetic oligonucleotide
accgtgcttctgtaacatcttgcctggctactatt

SEQ ID NO: 132827 - DNA, 37 bp, Artificial Sequence
  Synthetic oligonucleotide
aagacgggaagggggggactggtgcggtggaacgaga

SEQ ID NO: 132828 - DNA, 37 bp, Artificial Sequence
  Synthetic oligonucleotide
attcgcccccgcatcctctgcctattagaggccccga

SEQ ID NO: 132829 - DNA, 37 bp, Artificial Sequence
  Synthetic oligonucleotide
acacgcgttgacgggaaagggcagggtgggaccgcga

SEQ ID NO: 132830 - DNA, 38 bp, Artificial Sequence
  Synthetic oligonucleotide
tctctgccgctcgccccccataacggtacctgccctga

SEQ ID NO: 132831 - DNA, 37 bp, Artificial Sequence
  Synthetic oligonucleotide
accgcacgaacatcctgttccatcctgcctagcctga

SEQ ID NO: 132832 - DNA, 36 bp, Artificial Sequence
  Synthetic oligonucleotide
tgctcgccccatcctgtccgggccctcgtatccata

SEQ ID NO: 132833 - DNA, 35 bp, Artificial Sequence
  Synthetic oligonucleotide
gcacgccgacccatctgctttacgatccgctgcta

SEQ ID NO: 132834 - DNA, 36 bp, Artificial Sequence
  Synthetic oligonucleotide
tgcgggggagggggataggattgcagggggatggta

SEQ ID NO: 132835 - DNA, 35 bp, Artificial Sequence
  Synthetic oligonucleotide
tgacccaacctacgtgcctccgcgtaccccgcacc

SEQ ID NO: 132836 - DNA, 35 bp, Artificial Sequence
  Synthetic oligonucleotide
tccccctctgcccttgtcctgtttaatgttctacc

SEQ ID NO: 132837 - DNA, 35 bp, Artificial Sequence
  Synthetic oligonucleotide
gtgcgtgaacaatgtcctgcccctcccagccggcc

SEQ ID NO: 132838 - DNA, 35 bp, Artificial Sequence
  Synthetic oligonucleotide
gtcgcccccttcgtacctgagttacttcacatagc

SEQ ID NO: 132839 - DNA, 35 bp, Artificial Sequence
  Synthetic oligonucleotide
gtaacccggccaatctactacaaggtcctcctcgc

SEQ ID NO: 132840 - DNA, 36 bp, Artificial Sequence
  Synthetic oligonucleotide
gagtgggcgggagggttcatggctttcaaggggctc

SEQ ID NO: 132841 - DNA, 35 bp, Artificial Sequence
  Synthetic oligonucleotide
tatgtcactcatgcaccgcgtcactcatcctattc

SEQ ID NO: 132842 - DNA, 35 bp, Artificial Sequence
  Synthetic oligonucleotide
gtggaagcagatcccctctccagtgccgcctgttc

SEQ ID NO: 132843 - DNA, 35 bp, Artificial Sequence
  Synthetic oligonucleotide
tcgccccgggactcctccatctgtatctgcccttg

SEQ ID NO: 132844 - DNA, 35 bp, Artificial Sequence
  Synthetic oligonucleotide
atgaataccgcccgcctgtgccccttctactccct

SEQ ID NO: 132845 - DNA, 35 bp, Artificial Sequence
  Synthetic oligonucleotide
attgtgcacgcctgggtcctgtcgtaccgctctct

SEQ ID NO: 132846 - DNA, 35 bp, Artificial Sequence
  Synthetic oligonucleotide
tccgacgccaggcgtataaacccgctcccttacgt

SEQ ID NO: 132847 - DNA, 35 bp, Artificial Sequence
  Synthetic oligonucleotide
gcaacccacacgtaggtctcatggtcacttcactt

SEQ ID NO: 132848 - DNA, 35 bp, Artificial Sequence
  Synthetic oligonucleotide
gctgttcgccaaagctctacctccccactggcctt

SEQ ID NO: 132849 - DNA, 35 bp, Artificial Sequence
  Synthetic oligonucleotide
atgggggacgggtagcagggggttaggattacgaa

SEQ ID NO: 132850 - DNA, 35 bp, Artificial Sequence
  Synthetic oligonucleotide
atgttcagccttccctctgtctgccaccagtttaa

SEQ ID NO: 132851 - DNA, 34 bp, Artificial Sequence
  Synthetic oligonucleotide
tgacccgcccccctactcactccgattcttgcga

SEQ ID NO: 132852 - DNA, 34 bp, Artificial Sequence
  Synthetic oligonucleotide
tcagaagcccacgacgcatacttatcactctcga

SEQ ID NO: 132853 - DNA, 36 bp, Artificial Sequence
  Synthetic oligonucleotide
acacaccgccagctgactcttttaatcaacgttcga

SEQ ID NO: 132854 - DNA, 38 bp, Artificial Sequence
  Synthetic oligonucleotide
ggggggggtggcatggggagaacgggagtaagcgatga

SEQ ID NO: 132855 - DNA, 37 bp, Artificial Sequence
  Synthetic oligonucleotide
gaataggggtggtagaaagggagggccagggatgtga

SEQ ID NO: 132856 - DNA, 38 bp, Artificial Sequence
  Synthetic oligonucleotide
tatgcgatcggacgtgagcaccccccccttcctcttga

SEQ ID NO: 132857 - DNA, 38 bp, Artificial Sequence
  Synthetic oligonucleotide
tctcaccagatgtgcacccgccctacgtcctgctttga

SEQ ID NO: 132858 - DNA, 35 bp, Artificial Sequence
  Synthetic oligonucleotide
aaacccgcccggcccctttcgatcatccttccata

SEQ ID NO: 132859 - DNA, 35 bp, Artificial Sequence
  Synthetic oligonucleotide
acgcacctccctgtttggctttcggctttgaccta

SEQ ID NO: 132860 - DNA, 35 bp, Artificial Sequence
  Synthetic oligonucleotide
gtgccccatatgttatccagcccttaactacgcta

SEQ ID NO: 132861 - DNA, 35 bp, Artificial Sequence
  Synthetic oligonucleotide
gacatgcgcggtccgcatcgaagcccccattgccc

SEQ ID NO: 132862 - DNA, 35 bp, Artificial Sequence
  Synthetic oligonucleotide
tcactgtcctccgagcgcggctcgatacgcctccc

SEQ ID NO: 132863 - DNA, 35 bp, Artificial Sequence
  Synthetic oligonucleotide
ttcgaacatcacgcttgactcgtttatcatactcc

SEQ ID NO: 132864 - DNA, 35 bp, Artificial Sequence
  Synthetic oligonucleotide
gaaccggcaccattcaccgttccagtccctcttgc

SEQ ID NO: 132865 - DNA, 35 bp, Artificial Sequence
  Synthetic oligonucleotide
agtgaaccgcccctctcatcttcttgccagtcctc

SEQ ID NO: 132866 - DNA, 35 bp, Artificial Sequence
  Synthetic oligonucleotide
acgaccatccctgcccgtaacttgctaaatagctc

SEQ ID NO: 132867 - DNA, 35 bp, Artificial Sequence
  Synthetic oligonucleotide
taagccccctcacacacgtttgcccgcgctactcg

SEQ ID NO: 132868 - DNA, 35 bp, Artificial Sequence
  Synthetic oligonucleotide
gtcccaccccggcttcccttacatcttactttggg

SEQ ID NO: 132869 - DNA, 35 bp, Artificial Sequence
  Synthetic oligonucleotide
agctgacctatctgtccccgatccgccctttgctg

SEQ ID NO: 132870 - DNA, 35 bp, Artificial Sequence
  Synthetic oligonucleotide
ttgcgaatcactcacccagcgtaccggtccctcct

SEQ ID NO: 132871 - DNA, 35 bp, Artificial Sequence
  Synthetic oligonucleotide
tcccgaccccccgcacatgtgacttcctcttcgct

SEQ ID NO: 132872 - DNA, 35 bp, Artificial Sequence
  Synthetic oligonucleotide
atacccccgcaccgaccgcccaacccatgtggtct

SEQ ID NO: 132873 - DNA, 35 bp, Artificial Sequence
  Synthetic oligonucleotide
tgaacatccgcaccctctgtgaaagtcccgtcctt

SEQ ID NO: 132874 - DNA, 36 bp, Artificial Sequence
  Synthetic oligonucleotide
acttcccgcctgagtatttcgtctcctgtcccgaca

SEQ ID NO: 132875 - DNA, 35 bp, Artificial Sequence
  Synthetic oligonucleotide
acgttgcctcccgacggttgcctgttcttgtccca

SEQ ID NO: 132876 - DNA, 35 bp, Artificial Sequence
  Synthetic oligonucleotide
ctcgcccctcagtgcatctcgttatcatggtcgca

SEQ ID NO: 132877 - DNA, 35 bp, Artificial Sequence
  Synthetic oligonucleotide
tagggatggtggggagggttgggggggacgctaga

SEQ ID NO: 132878 - DNA, 35 bp, Artificial Sequence
  Synthetic oligonucleotide
acgttacccgctcctcatcccatgtcctgtctcga

SEQ ID NO: 132879 - DNA, 38 bp, Artificial Sequence
  Synthetic oligonucleotide
tctccactcgccgaatcctgaaaagctcctgcccatga

SEQ ID NO: 132880 - DNA, 37 bp, Artificial Sequence
  Synthetic oligonucleotide
gtcgccctcgacatttgacttatgcctatctacctga

SEQ ID NO: 132881 - DNA, 38 bp, Artificial Sequence
  Synthetic oligonucleotide
gtccagatcgggtggaaagggggcgggcggtatcttga

SEQ ID NO: 132882 - DNA, 37 bp, Artificial Sequence
  Synthetic oligonucleotide
gaagcgcccatgcgccctcctttacattgcctcttga

SEQ ID NO: 132883 - DNA, 35 bp, Artificial Sequence
  Synthetic oligonucleotide
ttcccaccccctccgtattatgatttcagacacta

SEQ ID NO: 132884 - DNA, 36 bp, Artificial Sequence
  Synthetic oligonucleotide
tgccccctgtgctgaacttcctttcctgtctacgta

SEQ ID NO: 132885 - DNA, 35 bp, Artificial Sequence
  Synthetic oligonucleotide
acgtcaatcgcccgctcgtacggattaccctctac

SEQ ID NO: 132886 - DNA, 34 bp, Artificial Sequence
  Synthetic oligonucleotide
tgactcttctccgttcttttgcgcttggctctac

SEQ ID NO: 132887 - DNA, 35 bp, Artificial Sequence
  Synthetic oligonucleotide
atgtgtatcgcacgctaccactcatgttccatccc

SEQ ID NO: 132888 - DNA, 35 bp, Artificial Sequence
  Synthetic oligonucleotide
ttctggtgctgttcgcctatttcgtcctggtctcc

SEQ ID NO: 132889 - DNA, 35 bp, Artificial Sequence
  Synthetic oligonucleotide
gaaatcgtcgcccaccacccccccagcccctaggc

SEQ ID NO: 132890 - DNA, 35 bp, Artificial Sequence
  Synthetic oligonucleotide
tgcatgccaaccccatcagtcgctggcccgccctc

SEQ ID NO: 132891 - DNA, 35 bp, Artificial Sequence
  Synthetic oligonucleotide
gtattggcctgccctgttcatctgtccatgtcctc

SEQ ID NO: 132892 - DNA, 35 bp, Artificial Sequence
  Synthetic oligonucleotide
cacctcccctgcctttccgtgtacgctactgtgtc

SEQ ID NO: 132893 - DNA, 35 bp, Artificial Sequence
  Synthetic oligonucleotide
acagtagagtgggagggtgaggtggtgatggttcg

SEQ ID NO: 132894 - DNA, 35 bp, Artificial Sequence
  Synthetic oligonucleotide
gtcccccccgtctcccgtcaggccctgcctctagg

SEQ ID NO: 132895 - DNA, 35 bp, Artificial Sequence
  Synthetic oligonucleotide
attcctcgccagtccctctatccctggtttgtcct

SEQ ID NO: 132896 - DNA, 35 bp, Artificial Sequence
  Synthetic oligonucleotide
acccctgtcctcgggtctgcctcaggctcccttct

SEQ ID NO: 132897 - DNA, 35 bp, Artificial Sequence
  Synthetic oligonucleotide
taccatgctgccatgctcgctactaccacattttt

SEQ ID NO: 132898 - DNA, 36 bp, Artificial Sequence
  Synthetic oligonucleotide
tagtaccaccgcattgacttggtcccttgtctacaa

SEQ ID NO: 132899 - DNA, 36 bp, Artificial Sequence
  Synthetic oligonucleotide
tcccgccccgcccaattactatcccatggtcctcca

SEQ ID NO: 132900 - DNA, 36 bp, Artificial Sequence
  Synthetic oligonucleotide
accccactcgtttgttccccgttgcccaagacggta

SEQ ID NO: 132901 - DNA, 35 bp, Artificial Sequence
  Synthetic oligonucleotide
aagcgagcacatgctgctctgtccgactttctcac

SEQ ID NO: 132902 - DNA, 35 bp, Artificial Sequence
  Synthetic oligonucleotide
gggaaccctaccgctgctctagttctccctggtac

SEQ ID NO: 132903 - DNA, 35 bp, Artificial Sequence
  Synthetic oligonucleotide
gatccacccgtgacgtccccggtcccgatcgtccc

SEQ ID NO: 132904 - DNA, 35 bp, Artificial Sequence
  Synthetic oligonucleotide
aacccaccgccacgcccttccaagccacagtcagc

SEQ ID NO: 132905 - DNA, 35 bp, Artificial Sequence
  Synthetic oligonucleotide
tagtcacgctcggcgcccatgtttttatccctctc

SEQ ID NO: 132906 - DNA, 35 bp, Artificial Sequence
  Synthetic oligonucleotide
agccgtgcctcccccgaatacgtcgctaattagtc

SEQ ID NO: 132907 - DNA, 35 bp, Artificial Sequence
  Synthetic oligonucleotide
acctttcgcactgccgcccggataccttctccgtc

SEQ ID NO: 132908 - DNA, 35 bp, Artificial Sequence
  Synthetic oligonucleotide
gaccaccacctcatgcttctcttcctgcccctaag

SEQ ID NO: 132909 - DNA, 35 bp, Artificial Sequence
  Synthetic oligonucleotide
taccctgcccgccgtggtcacctatcaagcccccg

SEQ ID NO: 132910 - DNA, 35 bp, Artificial Sequence
  Synthetic oligonucleotide
tcagactaccccctttgcttctcgcgccttaccat

SEQ ID NO: 132911 - DNA, 35 bp, Artificial Sequence
  Synthetic oligonucleotide
gaagccccatccgcccacccgatagcagcacgact

SEQ ID NO: 132912 - DNA, 35 bp, Artificial Sequence
  Synthetic oligonucleotide
gtgtggaatgaggtgataggcaagggggtggggtt

SEQ ID NO: 132913 - DNA, 35 bp, Artificial Sequence
  Synthetic oligonucleotide
aaccaaccgccggaccgagcccgtcctatccgcca

SEQ ID NO: 132914 - DNA, 35 bp, Artificial Sequence
  Synthetic oligonucleotide
tactgcgaggggggggctgggaatgttagggggca

SEQ ID NO: 132915 - DNA, 38 bp, Artificial Sequence
  Synthetic oligonucleotide
tcctcagccaccgttgttctccattacgtccgccctga

SEQ ID NO: 132916 - DNA, 36 bp, Artificial Sequence
  Synthetic oligonucleotide
atcccccggacgtttgtctcgttcttgtcttcctta

SEQ ID NO: 132917 - DNA, 36 bp, Artificial Sequence
  Synthetic oligonucleotide
gtcaccctcctatgtatttggttacaccctccgtta

SEQ ID NO: 132918 - DNA, 35 bp, Artificial Sequence
  Synthetic oligonucleotide
tgactcagttcacccctgttcccgtggcgcttacc

SEQ ID NO: 132919 - DNA, 35 bp, Artificial Sequence
  Synthetic oligonucleotide
tgatgctcaggtctccatgcccggttgcccccccc

SEQ ID NO: 132920 - DNA, 35 bp, Artificial Sequence
  Synthetic oligonucleotide
accgacacacagctccttctacatcagtttcgccc

SEQ ID NO: 132921 - DNA, 35 bp, Artificial Sequence
  Synthetic oligonucleotide
gccctgctcctatcctttgcgctacatgtcttccc

SEQ ID NO: 132922 - DNA, 35 bp, Artificial Sequence
  Synthetic oligonucleotide
agtgtgcgtgcccagcccggtccactctgtattcc

SEQ ID NO: 132923 - DNA, 35 bp, Artificial Sequence
  Synthetic oligonucleotide
ttgcttaccacccggtgctcgttatctagctttcc

SEQ ID NO: 132924 - DNA, 35 bp, Artificial Sequence
  Synthetic oligonucleotide
gatgtgtccccctcctcttcgtatttaggaactgc

SEQ ID NO: 132925 - DNA, 35 bp, Artificial Sequence
  Synthetic oligonucleotide
gtacatgccaccgaaaaatgcagtccttctcctgc

SEQ ID NO: 132926 - DNA, 35 bp, Artificial Sequence
  Synthetic oligonucleotide
gcattgcccgctgccttactccgacacttacttgc

SEQ ID NO: 132927 - DNA, 35 bp, Artificial Sequence
  Synthetic oligonucleotide
gtcccagcgcttctcgtcgcccacatctggctctc

SEQ ID NO: 132928 - DNA, 35 bp, Artificial Sequence
  Synthetic oligonucleotide
gtagcgacgcccactttgacctacacgctgttctc

SEQ ID NO: 132929 - DNA, 35 bp, Artificial Sequence
  Synthetic oligonucleotide
ttgaggggaagaccggtggaggagttagggagagt

SEQ ID NO: 132930 - DNA, 35 bp, Artificial Sequence
  Synthetic oligonucleotide
aacacctcactgcgtgactcaatctgccctttatt

SEQ ID NO: 132931 - DNA, 36 bp, Artificial Sequence
  Synthetic oligonucleotide
tatccacgtccacgcgccgaccgtccattttcacca

SEQ ID NO: 132932 - DNA, 35 bp, Artificial Sequence
  Synthetic oligonucleotide
attcccccgcgtcgagctagccactgtcacaccca

SEQ ID NO: 132933 - DNA, 35 bp, Artificial Sequence
  Synthetic oligonucleotide
tatcgcacctccgcttccggtcctcctcggatcca

SEQ ID NO: 132934 - DNA, 37 bp, Artificial Sequence
  Synthetic oligonucleotide
tgggaaggggaacggaaggggaggtaggaattataga

SEQ ID NO: 132935 - DNA, 38 bp, Artificial Sequence
  Synthetic oligonucleotide
ttacgccccccgtaccctcctgccctcgcgatctatga

SEQ ID NO: 132936 - DNA, 37 bp, Artificial Sequence
  Synthetic oligonucleotide
tgagacggagggggcaaggggccatgagggggagtga

SEQ ID NO: 132937 - DNA, 35 bp, Artificial Sequence
  Synthetic oligonucleotide
acaaccaagccctatgctggctaattacttccccc

SEQ ID NO: 132938 - DNA, 35 bp, Artificial Sequence
  Synthetic oligonucleotide
atcagccactgtacacccgtcccagttgctcctcc

SEQ ID NO: 132939 - DNA, 29 bp, Artificial Sequence
  Synthetic oligonucleotide
atgttacatctccgccggttccttgctcc

SEQ ID NO: 132940 - DNA, 35 bp, Artificial Sequence
  Synthetic oligonucleotide
taacgcagtgctcggcctgaactacgcgattctcc

SEQ ID NO: 132941 - DNA, 35 bp, Artificial Sequence
  Synthetic oligonucleotide
aacaacgcccccaagtttattgaccaccaacttcc

SEQ ID NO: 132942 - DNA, 35 bp, Artificial Sequence
  Synthetic oligonucleotide
gtcagaagcccgacacctccctgcaatccggttcc

SEQ ID NO: 132943 - DNA, 35 bp, Artificial Sequence
  Synthetic oligonucleotide
tctgccactccaggacagttcgcgccgccccttgc

SEQ ID NO: 132944 - DNA, 35 bp, Artificial Sequence
  Synthetic oligonucleotide
actctccatcctccgagctcccatgggatacactc

SEQ ID NO: 132945 - DNA, 35 bp, Artificial Sequence
  Synthetic oligonucleotide
atcccgccggcctacgtcttcctacgtgccctttc

SEQ ID NO: 132946 - DNA, 35 bp, Artificial Sequence
  Synthetic oligonucleotide
gacaacggtcaagctcatcgccgtccctttactat

SEQ ID NO: 132947 - DNA, 35 bp, Artificial Sequence
  Synthetic oligonucleotide
ggtggggtgggagcgggggtacgggttagatcact

SEQ ID NO: 132948 - DNA, 35 bp, Artificial Sequence
  Synthetic oligonucleotide
taacgtgcatcaccgccccgggtctgcccacctct

SEQ ID NO: 132949 - DNA, 35 bp, Artificial Sequence
  Synthetic oligonucleotide
tccagttgcgatctcggcttcccgtgcccttgatt

SEQ ID NO: 132950 - DNA, 30 bp, Artificial Sequence
  Synthetic oligonucleotide
tgctttgcccctgttacgccctatattcaa

SEQ ID NO: 132951 - DNA, 36 bp, Artificial Sequence
  Synthetic oligonucleotide
agagcgggataaaggaaaagggcacggggaaaagaa

SEQ ID NO: 132952 - DNA, 36 bp, Artificial Sequence
  Synthetic oligonucleotide
actcaccctccccggtatggtcaccagtttaccgca

SEQ ID NO: 132953 - DNA, 35 bp, Artificial Sequence
  Synthetic oligonucleotide
acaccaccttcccatgcaagattctgtttatttca

SEQ ID NO: 132954 - DNA, 37 bp, Artificial Sequence
  Synthetic oligonucleotide
taccccgcccccttcccccacatctagtcgtttcaga

SEQ ID NO: 132955 - DNA, 37 bp, Artificial Sequence
  Synthetic oligonucleotide
tgtgactgcggggaggggagaagggaacccgggagga

SEQ ID NO: 132956 - DNA, 38 bp, Artificial Sequence
  Synthetic oligonucleotide
atcgctcgccctctcacttgtaacagcccacctcctga

SEQ ID NO: 132957 - DNA, 38 bp, Artificial Sequence
  Synthetic oligonucleotide
gagacgggaggacgtgggagggctgataccgaacgtga

SEQ ID NO: 132958 - DNA, 38 bp, Artificial Sequence
  Synthetic oligonucleotide
accaccccgcactattgttttttctccagcaatcttga

SEQ ID NO: 132959 - DNA, 36 bp, Artificial Sequence
  Synthetic oligonucleotide
tgccaccacattgatttcgcacgacgcacccccgta

SEQ ID NO: 132960 - DNA, 36 bp, Artificial Sequence
  Synthetic oligonucleotide
tcacccctgcacctcgcccccggagactgtttcgta

SEQ ID NO: 132961 - DNA, 36 bp, Artificial Sequence
  Synthetic oligonucleotide
acctgtacacgcatgaccctgaattagcccacctta

SEQ ID NO: 132962 - DNA, 35 bp, Artificial Sequence
  Synthetic oligonucleotide
tacttccgccccgaatatcaacagcctgtgccaac

SEQ ID NO: 132963 - DNA, 35 bp, Artificial Sequence
  Synthetic oligonucleotide
atctctattcctgctcccgtgcccgtcctgcacac

SEQ ID NO: 132964 - DNA, 35 bp, Artificial Sequence
  Synthetic oligonucleotide
atcgcccacctgcccagtaatactactattgtcgc

SEQ ID NO: 132965 - DNA, 35 bp, Artificial Sequence
  Synthetic oligonucleotide
aaccgccactcttgccacgatactcaattacgatc

SEQ ID NO: 132966 - DNA, 35 bp, Artificial Sequence
  Synthetic oligonucleotide
ttgacgtggctcaccgcaattactgccagttcctc

SEQ ID NO: 132967 - DNA, 35 bp, Artificial Sequence
  Synthetic oligonucleotide
tactcccgccgtatctatttagccgccctaccttc

SEQ ID NO: 132968 - DNA, 35 bp, Artificial Sequence
  Synthetic oligonucleotide
tacctctcatcccgccgcctcacatacagtgcaag

SEQ ID NO: 132969 - DNA, 35 bp, Artificial Sequence
  Synthetic oligonucleotide
gacatcgtacctcgtcatctttcatcccacctccg

SEQ ID NO: 132970 - DNA, 35 bp, Artificial Sequence
  Synthetic oligonucleotide
gccgacacctgcaagggcaccacacctcctctccg

SEQ ID NO: 132971 - DNA, 35 bp, Artificial Sequence
  Synthetic oligonucleotide
gatgcacccgtgtctctcccctcctacattgtcat

SEQ ID NO: 132972 - DNA, 35 bp, Artificial Sequence
  Synthetic oligonucleotide
gtgctatagctgcaccttcatccttccgctcctgt

SEQ ID NO: 132973 - DNA, 35 bp, Artificial Sequence
  Synthetic oligonucleotide
gcctcagagcctcgcccccgacccgcccagttttt

SEQ ID NO: 132974 - DNA, 35 bp, Artificial Sequence
  Synthetic oligonucleotide
gccacgcacggacgaagggacgggtggaaggggaa

SEQ ID NO: 132975 - DNA, 36 bp, Artificial Sequence
  Synthetic oligonucleotide
gacttgcgaggagggggggtaaacatgagggtggca

SEQ ID NO: 132976 - DNA, 36 bp, Artificial Sequence
  Synthetic oligonucleotide
tctgcccgagcagaaccagccatttttctcgcctca

SEQ ID NO: 132977 - DNA, 38 bp, Artificial Sequence
  Synthetic oligonucleotide
gtcccctgcccctcactgttaaatgcagctccccatga

SEQ ID NO: 132978 - DNA, 36 bp, Artificial Sequence
  Synthetic oligonucleotide
acacgcagccccttatccccccccggtccaccgtga

SEQ ID NO: 132979 - DNA, 35 bp, Artificial Sequence
  Synthetic oligonucleotide
gtcgccctgctcccccttctatcgtgcaagccgta

SEQ ID NO: 132980 - DNA, 35 bp, Artificial Sequence
  Synthetic oligonucleotide
atgagagcagggcggtcgggcagggagcggagtta

SEQ ID NO: 132981 - DNA, 35 bp, Artificial Sequence
  Synthetic oligonucleotide
tgcacatcctgtccgcccgcatctgcatgcgaccc

SEQ ID NO: 132982 - DNA, 35 bp, Artificial Sequence
  Synthetic oligonucleotide
ttggtcggacgcgtatcgcaagctccccctggccc

SEQ ID NO: 132983 - DNA, 35 bp, Artificial Sequence
  Synthetic oligonucleotide
gtggacctcggtcccgctactacctcgctactccc

SEQ ID NO: 132984 - DNA, 35 bp, Artificial Sequence
  Synthetic oligonucleotide
tgttaccacccgccttgcctcagaacttgccttcc

SEQ ID NO: 132985 - DNA, 35 bp, Artificial Sequence
  Synthetic oligonucleotide
tgttcatcgcccctctgtacgcactcccaacacgc

SEQ ID NO: 132986 - DNA, 35 bp, Artificial Sequence
  Synthetic oligonucleotide
gcacatgcatgactgcccccccttgttagccaccg

SEQ ID NO: 132987 - DNA, 35 bp, Artificial Sequence
  Synthetic oligonucleotide
gacaatcctatctctcccgcacgcccagtcccgcg

SEQ ID NO: 132988 - DNA, 35 bp, Artificial Sequence
  Synthetic oligonucleotide
atgctgccggtacgagggatgggaggggaatcagg

SEQ ID NO: 132989 - DNA, 35 bp, Artificial Sequence
  Synthetic oligonucleotide
agaggactggagggaggggatgggggcgcttgggg

SEQ ID NO: 132990 - DNA, 35 bp, Artificial Sequence
  Synthetic oligonucleotide
gcccctaccgctttatgcgacacctttcatcactg

SEQ ID NO: 132991 - DNA, 35 bp, Artificial Sequence
  Synthetic oligonucleotide
accccgccttcctaccgacccctgctgttacggtg

SEQ ID NO: 132992 - DNA, 35 bp, Artificial Sequence
  Synthetic oligonucleotide
taacgccgccctgaattttttgcgtcaaccgccat

SEQ ID NO: 132993 - DNA, 35 bp, Artificial Sequence
  Synthetic oligonucleotide
tctcacccgccgcctccctcgtgattggtctagct

SEQ ID NO: 132994 - DNA, 35 bp, Artificial Sequence
  Synthetic oligonucleotide
gtgtccgttccatccactgagactatgctccctct

SEQ ID NO: 132995 - DNA, 35 bp, Artificial Sequence
  Synthetic oligonucleotide
tgtgactcgcggggggggaggttaatggaaggtgt

SEQ ID NO: 132996 - DNA, 36 bp, Artificial Sequence
  Synthetic oligonucleotide
gcccacctcttttcccttcggcagtgaacgagttca

SEQ ID NO: 132997 - DNA, 37 bp, Artificial Sequence
  Synthetic oligonucleotide
aatccgcccgcgctcccggcccctctctgttacccga

SEQ ID NO: 132998 - DNA, 36 bp, Artificial Sequence
  Synthetic oligonucleotide
gtcagccttaatgcccccccctcgccgctacatgga

SEQ ID NO: 132999 - DNA, 37 bp, Artificial Sequence
  Synthetic oligonucleotide
actggctcacgggctgacgggagggagggctagtgga

SEQ ID NO: 133000 - DNA, 38 bp, Artificial Sequence
  Synthetic oligonucleotide
tccgggtgggaacatgtgtattagggtgggatctctga

SEQ ID NO: 133001 - DNA, 35 bp, Artificial Sequence
  Synthetic oligonucleotide
gtgtggggaagacagagggtggaaggggcgccata

SEQ ID NO: 133002 - DNA, 34 bp, Artificial Sequence
  Synthetic oligonucleotide
tccgcccaatggctaatacttgctacttctccta

SEQ ID NO: 133003 - DNA, 35 bp, Artificial Sequence
  Synthetic oligonucleotide
ggtggtgccctcgttgtcttgttctatcacttaac

SEQ ID NO: 133004 - DNA, 35 bp, Artificial Sequence
  Synthetic oligonucleotide
gttccgacgtccttctgtaacacctttctacccac

SEQ ID NO: 133005 - DNA, 35 bp, Artificial Sequence
  Synthetic oligonucleotide
tcatcctgcggttcatatcgcccgagccaccctac

SEQ ID NO: 133006 - DNA, 35 bp, Artificial Sequence
  Synthetic oligonucleotide
aaatggcaatccgcctgagctcccgtttacccacc

SEQ ID NO: 133007 - DNA, 35 bp, Artificial Sequence
  Synthetic oligonucleotide
ggtcattcccacagcctttataagcttttcccgcc

SEQ ID NO: 133008 - DNA, 35 bp, Artificial Sequence
  Synthetic oligonucleotide
tcgcccacatccagctgctttatctcgacgtcgcc

SEQ ID NO: 133009 - DNA, 35 bp, Artificial Sequence
  Synthetic oligonucleotide
gcatggcccactagcttatctcgttcattcctgcc

SEQ ID NO: 133010 - DNA, 36 bp, Artificial Sequence
  Synthetic oligonucleotide
actcgcacgttctccacctgctccttgctctacagc

SEQ ID NO: 133011 - DNA, 35 bp, Artificial Sequence
  Synthetic oligonucleotide
gaacagagtgctctgttcgtcaatgacccctccgc

SEQ ID NO: 133012 - DNA, 35 bp, Artificial Sequence
  Synthetic oligonucleotide
tcatgggcgcctgttcgatatccaccacccgtcgc

SEQ ID NO: 133013 - DNA, 35 bp, Artificial Sequence
  Synthetic oligonucleotide
tccccactcccacgattctgtttgcttgttgcttc

SEQ ID NO: 133014 - DNA, 35 bp, Artificial Sequence
  Synthetic oligonucleotide
gacgcctcattgctgccccttccactgaacatcag

SEQ ID NO: 133015 - DNA, 35 bp, Artificial Sequence
  Synthetic oligonucleotide
gccgagagtccgctatctccccgtctcgtttaact

SEQ ID NO: 133016 - DNA, 35 bp, Artificial Sequence
  Synthetic oligonucleotide
ttcgccaccacgctaatctttagagcgccttttct

SEQ ID NO: 133017 - DNA, 35 bp, Artificial Sequence
  Synthetic oligonucleotide
acatcgtcgcacactgccttctcccgtacatatgt

SEQ ID NO: 133018 - DNA, 35 bp, Artificial Sequence
  Synthetic oligonucleotide
actctccacctgtcaccgcatcacgttgcaacctt

SEQ ID NO: 133019 - DNA, 35 bp, Artificial Sequence
  Synthetic oligonucleotide
tgtcccctgtgccgataccttactcccatggcctt

SEQ ID NO: 133020 - DNA, 35 bp, Artificial Sequence
  Synthetic oligonucleotide
gcaccggttgtcatccagccctcgaccttttgttt

SEQ ID NO: 133021 - DNA, 35 bp, Artificial Sequence
  Synthetic oligonucleotide
tcacgcaccgccctgagccctcccagtgtcgtaca

SEQ ID NO: 133022 - DNA, 35 bp, Artificial Sequence
  Synthetic oligonucleotide
tcacagtcccagatccgccacgtctcagctttgca

SEQ ID NO: 133023 - DNA, 35 bp, Artificial Sequence
  Synthetic oligonucleotide
attgttcaccatcgaggttttcgggcctcccctca

SEQ ID NO: 133024 - DNA, 37 bp, Artificial Sequence
  Synthetic oligonucleotide
atagggggggtggtgcgtgaggggggcccggcgaaga

SEQ ID NO: 133025 - DNA, 36 bp, Artificial Sequence
  Synthetic oligonucleotide
taccccacccgggcagtctcttgcgcctcccctaga

SEQ ID NO: 133026 - DNA, 37 bp, Artificial Sequence
  Synthetic oligonucleotide
gacccgccgccacattcctcctacccctccgagcgga

SEQ ID NO: 133027 - DNA, 37 bp, Artificial Sequence
  Synthetic oligonucleotide
taaggtggaggcggggtttgacggacagcatggtgga

SEQ ID NO: 133028 - DNA, 38 bp, Artificial Sequence
  Synthetic oligonucleotide
gcaggagagtgcacgggcgaggagaggaggacgggtga

SEQ ID NO: 133029 - DNA, 36 bp, Artificial Sequence
  Synthetic oligonucleotide
agtgcccccgtcccgttcctgctgtgcttagcccta

SEQ ID NO: 133030 - DNA, 36 bp, Artificial Sequence
  Synthetic oligonucleotide
gcccgaccgtcccgccgcgcataatgtcaacttcta

SEQ ID NO: 133031 - DNA, 35 bp, Artificial Sequence
  Synthetic oligonucleotide
aaacatggggtaggggtggtagaaaggggcacgta

SEQ ID NO: 133032 - DNA, 35 bp, Artificial Sequence
  Synthetic oligonucleotide
gtcctcataccctcgccgtgctcatacccgagtac

SEQ ID NO: 133033 - DNA, 35 bp, Artificial Sequence
  Synthetic oligonucleotide
tggacctcctccgcacttgtcttacgaaccttggc

SEQ ID NO: 133034 - DNA, 35 bp, Artificial Sequence
  Synthetic oligonucleotide
gtcatcctacggcgcatgtattacctctgcccatc

SEQ ID NO: 133035 - DNA, 35 bp, Artificial Sequence
  Synthetic oligonucleotide
tgcatcctccttttccttccggcctctcttgctag

SEQ ID NO: 133036 - DNA, 35 bp, Artificial Sequence
  Synthetic oligonucleotide
attccacctcgtttgtcccagctgtcaccccggcg

SEQ ID NO: 133037 - DNA, 35 bp, Artificial Sequence
  Synthetic oligonucleotide
ggagagggaacatacggatgacggatgggggcgat

SEQ ID NO: 133038 - DNA, 35 bp, Artificial Sequence
  Synthetic oligonucleotide
gtcgcctcccgaaacatcttttgaccccagccact

SEQ ID NO: 133039 - DNA, 35 bp, Artificial Sequence
  Synthetic oligonucleotide
gcgcatatcaggcacgtctttactcggatccctct

SEQ ID NO: 133040 - DNA, 35 bp, Artificial Sequence
  Synthetic oligonucleotide
ggttcacacacacccgtattatgggcacactttct

SEQ ID NO: 133041 - DNA, 35 bp, Artificial Sequence
  Synthetic oligonucleotide
gtgttccccccccgtcgtgcccttacttaacttgt

SEQ ID NO: 133042 - DNA, 35 bp, Artificial Sequence
  Synthetic oligonucleotide
tacgcccgcggcttgctccagtcttcgtccccttt

SEQ ID NO: 133043 - DNA, 35 bp, Artificial Sequence
  Synthetic oligonucleotide
ggacgagctcaggatcgccttccctcacccacgca

SEQ ID NO: 133044 - DNA, 36 bp, Artificial Sequence
  Synthetic oligonucleotide
gtcgtcctctgctatctcttttgtaactgcccatca

SEQ ID NO: 133045 - DNA, 35 bp, Artificial Sequence
  Synthetic oligonucleotide
tcctccccagccgtcccccccatctccaacacaga

SEQ ID NO: 133046 - DNA, 37 bp, Artificial Sequence
  Synthetic oligonucleotide
accactctgctggtcttattctatcgcccttatcgga

SEQ ID NO: 133047 - DNA, 37 bp, Artificial Sequence
  Synthetic oligonucleotide
tggggagtggcggtttccatcctaggtcggtggggga

SEQ ID NO: 133048 - DNA, 36 bp, Artificial Sequence
  Synthetic oligonucleotide
gaggacgatcggggaggaaaggttgcaagaatggga

SEQ ID NO: 133049 - DNA, 37 bp, Artificial Sequence
  Synthetic oligonucleotide
gacccgcgggagacggggaaacggggggtaagtatga

SEQ ID NO: 133050 - DNA, 38 bp, Artificial Sequence
  Synthetic oligonucleotide
tcgccgtttgctttcgcccctccaacctcgaggtctga

SEQ ID NO: 133051 - DNA, 36 bp, Artificial Sequence
  Synthetic oligonucleotide
gaacccgtcaccccgtaatagccctctgcaccgtga

SEQ ID NO: 133052 - DNA, 35 bp, Artificial Sequence
  Synthetic oligonucleotide
agtcgccgatgcccagcctcccgattctttgctac

SEQ ID NO: 133053 - DNA, 35 bp, Artificial Sequence
  Synthetic oligonucleotide
tgagagccctgcccttcctgacatcagttcctacc

SEQ ID NO: 133054 - DNA, 35 bp, Artificial Sequence
  Synthetic oligonucleotide
gctcgccacttttgccgtcctggatcatgctttcc

SEQ ID NO: 133055 - DNA, 35 bp, Artificial Sequence
  Synthetic oligonucleotide
tgtcggtgcgctgctttaccttcccgttcttgtgc

SEQ ID NO: 133056 - DNA, 35 bp, Artificial Sequence
  Synthetic oligonucleotide
gagcctctactcacccgcgcgcccccgccatgctc

SEQ ID NO: 133057 - DNA, 35 bp, Artificial Sequence
  Synthetic oligonucleotide
gttcaggccacggattctgcgttctccaccacccg

SEQ ID NO: 133058 - DNA, 35 bp, Artificial Sequence
  Synthetic oligonucleotide
gtggcaaagggaatatagggggtagggggcggggg

SEQ ID NO: 133059 - DNA, 35 bp, Artificial Sequence
  Synthetic oligonucleotide
ccacacttcctctccttacgggtcaggcctcccat

SEQ ID NO: 133060 - DNA, 33 bp, Artificial Sequence
  Synthetic oligonucleotide
gcaccctgtcacgcgaagcgcctgcccatcgtt

SEQ ID NO: 133061 - DNA, 36 bp, Artificial Sequence
  Synthetic oligonucleotide
gttgccgcccgcgtggcctcattttcgttcccacaa

SEQ ID NO: 133062 - DNA, 36 bp, Artificial Sequence
  Synthetic oligonucleotide
ctaggggccgaactgggtggggaagtctggggttaa

SEQ ID NO: 133063 - DNA, 36 bp, Artificial Sequence
  Synthetic oligonucleotide
ggacaccgtaccagttcaattattcgcacgctctca

SEQ ID NO: 133064 - DNA, 37 bp, Artificial Sequence
  Synthetic oligonucleotide
acttgcacctgcgtttgttcgcccgctcccccatcga

SEQ ID NO: 133065 - DNA, 37 bp, Artificial Sequence
  Synthetic oligonucleotide
tcagacccgtcgcttagctcctctcgccctcttagga

SEQ ID NO: 133066 - DNA, 38 bp, Artificial Sequence
  Synthetic oligonucleotide
gccacttccgcctataccgaccacccatctcgcaatga

SEQ ID NO: 133067 - DNA, 37 bp, Artificial Sequence
  Synthetic oligonucleotide
aaccccgcctgtaccgctctcttccagggaatcctga

SEQ ID NO: 133068 - DNA, 38 bp, Artificial Sequence
  Synthetic oligonucleotide
tcccacggtcagtgcgccccgataccctccttgtgtga

SEQ ID NO: 133069 - DNA, 36 bp, Artificial Sequence
  Synthetic oligonucleotide
gtatgggggggcgaaggtgacgcggcgctgatttga

SEQ ID NO: 133070 - DNA, 35 bp, Artificial Sequence
  Synthetic oligonucleotide
gtggacacatcgtttgtacacccacttcctctgta

SEQ ID NO: 133071 - DNA, 35 bp, Artificial Sequence
  Synthetic oligonucleotide
gccgtattaccgttccctgtttagcatgcccaccc

SEQ ID NO: 133072 - DNA, 35 bp, Artificial Sequence
  Synthetic oligonucleotide
gtcataatccggtgctacaaggccttgatcctccc

SEQ ID NO: 133073 - DNA, 35 bp, Artificial Sequence
  Synthetic oligonucleotide
tcagagggggagtgcggggagagggggtgcggcgc

SEQ ID NO: 133074 - DNA, 35 bp, Artificial Sequence
  Synthetic oligonucleotide
gataccaacgtggggcgcgtatactgccttccatc

SEQ ID NO: 133075 - DNA, 35 bp, Artificial Sequence
  Synthetic oligonucleotide
tcccttggctcccgatctaaatctcagtgcctctc

SEQ ID NO: 133076 - DNA, 35 bp, Artificial Sequence
  Synthetic oligonucleotide
ttccgccgaggtccgagatggtcctgtcccccgtc

SEQ ID NO: 133077 - DNA, 35 bp, Artificial Sequence
  Synthetic oligonucleotide
tgctacggaaagggaggatggggactgggtcggtg

SEQ ID NO: 133078 - DNA, 35 bp, Artificial Sequence
  Synthetic oligonucleotide
tacgtagtcgccaccttccatcgccattccagtct

SEQ ID NO: 133079 - DNA, 36 bp, Artificial Sequence
  Synthetic oligonucleotide
attcgccccacacgtggtaatgacctcgcatctctt

SEQ ID NO: 133080 - DNA, 35 bp, Artificial Sequence
  Synthetic oligonucleotide
tgaccgcactgaatcgcccgccatcccgacttgtt

SEQ ID NO: 133081 - DNA, 35 bp, Artificial Sequence
  Synthetic oligonucleotide
gtccccccccgacccaaccatgagcggttcaaaaa

SEQ ID NO: 133082 - DNA, 36 bp, Artificial Sequence
  Synthetic oligonucleotide
ggggagggatggagctgggcgggttaacagggtcaa

SEQ ID NO: 133083 - DNA, 35 bp, Artificial Sequence
  Synthetic oligonucleotide
ttgatgcccaggcctcgctccgccctttgtagcca

SEQ ID NO: 133084 - DNA, 35 bp, Artificial Sequence
  Synthetic oligonucleotide
atcatccacgtgtcccacgtgttccgttcctttca

SEQ ID NO: 133085 - DNA, 37 bp, Artificial Sequence
  Synthetic oligonucleotide
attgcgtccagctcgtctttgaaccatccaccatcga

SEQ ID NO: 133086 - DNA, 37 bp, Artificial Sequence
  Synthetic oligonucleotide
actcccatccgccacttatgcgacccgctacacggga

SEQ ID NO: 133087 - DNA, 38 bp, Artificial Sequence
  Synthetic oligonucleotide
ttgacgtagcaggtatggggggagggaggggcgcctga

SEQ ID NO: 133088 - DNA, 36 bp, Artificial Sequence
  Synthetic oligonucleotide
gcctgccgagcatcgcataatctgtcccttccatta

SEQ ID NO: 133089 - DNA, 35 bp, Artificial Sequence
  Synthetic oligonucleotide
gcccccgattcatacgcacgtttacacctgcctta

SEQ ID NO: 133090 - DNA, 35 bp, Artificial Sequence
  Synthetic oligonucleotide
ttacatcattccgttccaccgtggttccgcccgcc

SEQ ID NO: 133091 - DNA, 35 bp, Artificial Sequence
  Synthetic oligonucleotide
tccacttccgcagatggcgtctcgtcttccttagc

SEQ ID NO: 133092 - DNA, 35 bp, Artificial Sequence
  Synthetic oligonucleotide
gtccctccgtgttatttcgttccctcttaccttag

SEQ ID NO: 133093 - DNA, 35 bp, Artificial Sequence
  Synthetic oligonucleotide
tgaacctcaggttcgttttttttcactcactcccg

SEQ ID NO: 133094 - DNA, 35 bp, Artificial Sequence
  Synthetic oligonucleotide
tgtccgaccagaccccacataggttgctcccctcg

SEQ ID NO: 133095 - DNA, 35 bp, Artificial Sequence
  Synthetic oligonucleotide
acacccggtaacgcactccacactcgccccgccgg

SEQ ID NO: 133096 - DNA, 35 bp, Artificial Sequence
  Synthetic oligonucleotide
tcaatacggtccagggaggggggggcatgggtgct

SEQ ID NO: 133097 - DNA, 35 bp, Artificial Sequence
  Synthetic oligonucleotide
aatccctgcgcccattgatagtcacccgcccctgt

SEQ ID NO: 133098 - DNA, 35 bp, Artificial Sequence
  Synthetic oligonucleotide
ttgtcccccatggtccttcctcacacttccgtgtt

SEQ ID NO: 133099 - DNA, 36 bp, Artificial Sequence
  Synthetic oligonucleotide
gacgcagaatgagggggagtgggaggggattcgcaa

SEQ ID NO: 133100 - DNA, 35 bp, Artificial Sequence
  Synthetic oligonucleotide
tcgcgtcgcaccacctatgaaacgccctccacgca

SEQ ID NO: 133101 - DNA, 36 bp, Artificial Sequence
  Synthetic oligonucleotide
gatgccgcccccccttgtttctcctgtgtaagatca

SEQ ID NO: 133102 - DNA, 37 bp, Artificial Sequence
  Synthetic oligonucleotide
agactggaggaaaggtggaaggggtagttggagcaga

SEQ ID NO: 133103 - DNA, 38 bp, Artificial Sequence
  Synthetic oligonucleotide
gagggaaaggaggaggggctgaagagaggacctactga

SEQ ID NO: 133104 - DNA, 38 bp, Artificial Sequence
  Synthetic oligonucleotide
gatgagtgatgggtgggtggggatgggaagcccggtga

SEQ ID NO: 133105 - DNA, 36 bp, Artificial Sequence
  Synthetic oligonucleotide
acacccagccatccgtacttcaccgccagtcattta

SEQ ID NO: 133106 - DNA, 36 bp, Artificial Sequence
  Synthetic oligonucleotide
gttctcgcacatgttcacgcttacttaggcctccac

SEQ ID NO: 133107 - DNA, 34 bp, Artificial Sequence
  Synthetic oligonucleotide
tccccagtccctgcaaccagttcacgccatcacc

SEQ ID NO: 133108 - DNA, 36 bp, Artificial Sequence
  Synthetic oligonucleotide
gaatgcacatctccgcagtcgcccgtcacgacgccc

SEQ ID NO: 133109 - DNA, 35 bp, Artificial Sequence
  Synthetic oligonucleotide
aaccctggtcctggtatctccactgctgaattgcc

SEQ ID NO: 133110 - DNA, 35 bp, Artificial Sequence
  Synthetic oligonucleotide
ttggccaccccagctcacgtaaggcccacacttcc

SEQ ID NO: 133111 - DNA, 35 bp, Artificial Sequence
  Synthetic oligonucleotide
tcacgttagcgctgtgtccgtcagccattccttcc

SEQ ID NO: 133112 - DNA, 35 bp, Artificial Sequence
  Synthetic oligonucleotide
attccgccgtcgcctcgaactcgaacatctacctc

SEQ ID NO: 133113 - DNA, 35 bp, Artificial Sequence
  Synthetic oligonucleotide
ttacgaggtgcagattcatggccgccgttctcctc

SEQ ID NO: 133114 - DNA, 35 bp, Artificial Sequence
  Synthetic oligonucleotide
gaccgaggtatagacccccgcccccaatctccgtc

SEQ ID NO: 133115 - DNA, 35 bp, Artificial Sequence
  Synthetic oligonucleotide
tatgcgcaatgagcgagcccctgttctttttcgtc

SEQ ID NO: 133116 - DNA, 35 bp, Artificial Sequence
  Synthetic oligonucleotide
ttagtaccccgcatgaccgtcctgttccttgttcg

SEQ ID NO: 133117 - DNA, 35 bp, Artificial Sequence
  Synthetic oligonucleotide
gccacccacccccctccccaagagacgtagatatg

SEQ ID NO: 133118 - DNA, 35 bp, Artificial Sequence
  Synthetic oligonucleotide
aatacaccccgcgcccgttccctacgtgatcactg

SEQ ID NO: 133119 - DNA, 35 bp, Artificial Sequence
  Synthetic oligonucleotide
gcatcgccaccaatcctcgcctggtccggccccct

SEQ ID NO: 133120 - DNA, 35 bp, Artificial Sequence
  Synthetic oligonucleotide
tacgccgggtttgccgtgacgtccttgctccctct

SEQ ID NO: 133121 - DNA, 35 bp, Artificial Sequence
  Synthetic oligonucleotide
ttcagtcgcccccccgccgttgctgttccttgtct

SEQ ID NO: 133122 - DNA, 35 bp, Artificial Sequence
  Synthetic oligonucleotide
taaaggggccggaggtaagggaatatgggaggggt

SEQ ID NO: 133123 - DNA, 35 bp, Artificial Sequence
  Synthetic oligonucleotide
atatcgccactccctcgtcccatgtcccccaatgt

SEQ ID NO: 133124 - DNA, 35 bp, Artificial Sequence
  Synthetic oligonucleotide
gcccaatctgccgtactatcacgacgatgcccctt

SEQ ID NO: 133125 - DNA, 36 bp, Artificial Sequence
  Synthetic oligonucleotide
accccccctcgatgcaacaccagccgagtgctcaca

SEQ ID NO: 133126 - DNA, 36 bp, Artificial Sequence
  Synthetic oligonucleotide
acaccgcgcatatgttagcccagctgccacccccca

SEQ ID NO: 133127 - DNA, 35 bp, Artificial Sequence
  Synthetic oligonucleotide
gaagcggccggttgtctgtcttccatccttcccca

SEQ ID NO: 133128 - DNA, 36 bp, Artificial Sequence
  Synthetic oligonucleotide
gacactcttacagttgtccccagtcccttcccgcca

SEQ ID NO: 133129 - DNA, 38 bp, Artificial Sequence
  Synthetic oligonucleotide
ggccagagggagggggggaaaagggcgtgtcagagtga

SEQ ID NO: 133130 - DNA, 35 bp, Artificial Sequence
  Synthetic oligonucleotide
acacccgccttccacctgacttcttacgcgttcta

SEQ ID NO: 133131 - DNA, 35 bp, Artificial Sequence
  Synthetic oligonucleotide
accaaccatcctctgttttctagacgcgcgcatac

SEQ ID NO: 133132 - DNA, 35 bp, Artificial Sequence
  Synthetic oligonucleotide
taacgcatccgtagtggcgctcttacctcctcccc

SEQ ID NO: 133133 - DNA, 35 bp, Artificial Sequence
  Synthetic oligonucleotide
gtactcctcgttcgcgactcgcctatcactactgc

SEQ ID NO: 133134 - DNA, 35 bp, Artificial Sequence
  Synthetic oligonucleotide
tgttacacacaagtttctggcgccccaagccgctc

SEQ ID NO: 133135 - DNA, 35 bp, Artificial Sequence
  Synthetic oligonucleotide
ggatccttccacgcatcctgcaccttctcatgctc

SEQ ID NO: 133136 - DNA, 35 bp, Artificial Sequence
  Synthetic oligonucleotide
acaggacacctgcgcagttgcgaccccctctcttc

SEQ ID NO: 133137 - DNA, 35 bp, Artificial Sequence
  Synthetic oligonucleotide
atgaacacccgccccaatccgtccaatgtcattgg

SEQ ID NO: 133138 - DNA, 35 bp, Artificial Sequence
  Synthetic oligonucleotide
atcactactccgaccgtcgtatcttcgacccttat

SEQ ID NO: 133139 - DNA, 35 bp, Artificial Sequence
  Synthetic oligonucleotide
ccaccctcgccacggttcgcttttggcttctcctt

SEQ ID NO: 133140 - DNA, 35 bp, Artificial Sequence
  Synthetic oligonucleotide
ggtcgcacaccacgggagctttaatacacctcttt

SEQ ID NO: 133141 - DNA, 36 bp, Artificial Sequence
  Synthetic oligonucleotide
acgtgaggagtgggaattaaatggggcggtcgtaca

SEQ ID NO: 133142 - DNA, 36 bp, Artificial Sequence
  Synthetic oligonucleotide
tccatctcagcactgtattgcactctcgtcacccca

SEQ ID NO: 133143 - DNA, 36 bp, Artificial Sequence
  Synthetic oligonucleotide
gacgcgcccgacatgacgttaccttccacctccgca

SEQ ID NO: 133144 - DNA, 36 bp, Artificial Sequence
  Synthetic oligonucleotide
gaccactgccccgtgccctttaagcctccatatgca

SEQ ID NO: 133145 - DNA, 37 bp, Artificial Sequence
  Synthetic oligonucleotide
gtacacgcccgcccttccctatattgcttgtagacga

SEQ ID NO: 133146 - DNA, 38 bp, Artificial Sequence
  Synthetic oligonucleotide
atgcattgggtcgggtgggggggaggtgaactatctga

SEQ ID NO: 133147 - DNA, 38 bp, Artificial Sequence
  Synthetic oligonucleotide
gcgttcatcgccgttgtcccccgccctctccgctctga

SEQ ID NO: 133148 - DNA, 37 bp, Artificial Sequence
  Synthetic oligonucleotide
ggtaggaagggtgggagggggaagaccgccgcgttga

SEQ ID NO: 133149 - DNA, 36 bp, Artificial Sequence
  Synthetic oligonucleotide
gatccccagcgccctcccccccagtgcatagacgta

SEQ ID NO: 133150 - DNA, 35 bp, Artificial Sequence
  Synthetic oligonucleotide
gttgtccccctcacatacgttgctaacagtccgta

SEQ ID NO: 133151 - DNA, 35 bp, Artificial Sequence
  Synthetic oligonucleotide
gccgtgtgttgcgcgcctcgttacatctatccacc

SEQ ID NO: 133152 - DNA, 35 bp, Artificial Sequence
  Synthetic oligonucleotide
tggtgttgcgctgcctttttgtccgtggttccccc

SEQ ID NO: 133153 - DNA, 35 bp, Artificial Sequence
  Synthetic oligonucleotide
gacgtgtgctgtcgtcccggctcttctccccagcc

SEQ ID NO: 133154 - DNA, 35 bp, Artificial Sequence
  Synthetic oligonucleotide
ggacacaagaaaccaggaggagggctggggtgaag

SEQ ID NO: 133155 - DNA, 35 bp, Artificial Sequence
  Synthetic oligonucleotide
tatcgtcgccctccttggtaactcggatttcttct

SEQ ID NO: 133156 - DNA, 35 bp, Artificial Sequence
  Synthetic oligonucleotide
gcaaccctatcgccctatcactagcccctacgggt

SEQ ID NO: 133157 - DNA, 35 bp, Artificial Sequence
  Synthetic oligonucleotide
tacctcgatgtgtcgtctgttctgccgtcccttca

SEQ ID NO: 133158 - DNA, 37 bp, Artificial Sequence
  Synthetic oligonucleotide
agcgccccttctgctgatttacccccatccagttcga

SEQ ID NO: 133159 - DNA, 38 bp, Artificial Sequence
  Synthetic oligonucleotide
gaggtggaggaggtcgaattgggggagtggaggagtga

SEQ ID NO: 133160 - DNA, 38 bp, Artificial Sequence
  Synthetic oligonucleotide
aacaccgccccccggccatcagccactattttttgtga

SEQ ID NO: 133161 - DNA, 35 bp, Artificial Sequence
  Synthetic oligonucleotide
tctacgttaccacagtgcctccccgttgcccgacc

SEQ ID NO: 133162 - DNA, 35 bp, Artificial Sequence
  Synthetic oligonucleotide
gacaccgcaatagccccagtagcagccgctttacc

SEQ ID NO: 133163 - DNA, 35 bp, Artificial Sequence
  Synthetic oligonucleotide
tggatcttccgccctgagtcatcgtcccttctgcc

SEQ ID NO: 133164 - DNA, 35 bp, Artificial Sequence
  Synthetic oligonucleotide
tctacccccgcacgacgttctggcactgctgacgc

SEQ ID NO: 133165 - DNA, 35 bp, Artificial Sequence
  Synthetic oligonucleotide
ggggcgggtgtggtgggttcactgtcgtttctatt

SEQ ID NO: 133166 - DNA, 35 bp, Artificial Sequence
  Synthetic oligonucleotide
tccttcagatggcactatgttatcctgcccccctt

SEQ ID NO: 133167 - DNA, 35 bp, Artificial Sequence
  Synthetic oligonucleotide
tcctgacccatctctgatatttgtgtgcccccctt

SEQ ID NO: 133168 - DNA, 36 bp, Artificial Sequence
  Synthetic oligonucleotide
tgtcccgcctgacgcgttctagttccgcgcacccca

SEQ ID NO: 133169 - DNA, 36 bp, Artificial Sequence
  Synthetic oligonucleotide
cacgtcaacctcagtatgcccgccgccacatctcca

SEQ ID NO: 133170 - DNA, 37 bp, Artificial Sequence
  Synthetic oligonucleotide
gccacgtagccggccgcacctccccaccatacgccga

SEQ ID NO: 133171 - DNA, 37 bp, Artificial Sequence
  Synthetic oligonucleotide
atcgatggagcacgtcgggtctgaagggagggaggga

SEQ ID NO: 133172 - DNA, 36 bp, Artificial Sequence
  Synthetic oligonucleotide
tctcggagggaggggcggggatcgtttggtcgggga

SEQ ID NO: 133173 - DNA, 38 bp, Artificial Sequence
  Synthetic oligonucleotide
tctacgcctgaggacgtcctccgccccccgtaccctga

SEQ ID NO: 133174 - DNA, 37 bp, Artificial Sequence
  Synthetic oligonucleotide
gtagccccttctttgtcgttgctctcttcccctgtga

SEQ ID NO: 133175 - DNA, 38 bp, Artificial Sequence
  Synthetic oligonucleotide
atcctcccgcaactgtacaagatccctctctcgcttga

SEQ ID NO: 133176 - DNA, 35 bp, Artificial Sequence
  Synthetic oligonucleotide
tcaccatcacgatctgcaaccttcagacctaccta

SEQ ID NO: 133177 - DNA, 34 bp, Artificial Sequence
  Synthetic oligonucleotide
ggtcaggtgtccatcgccgccacagcacctccta

SEQ ID NO: 133178 - DNA, 35 bp, Artificial Sequence
  Synthetic oligonucleotide
ggggactgtgcacgggcggggttaagtgagggacc

SEQ ID NO: 133179 - DNA, 35 bp, Artificial Sequence
  Synthetic oligonucleotide
attcgcgcacctcaaatcatccggtagctccaccc

SEQ ID NO: 133180 - DNA, 35 bp, Artificial Sequence
  Synthetic oligonucleotide
attgaacgcggtctggtctccttttcacgcgcccc

SEQ ID NO: 133181 - DNA, 35 bp, Artificial Sequence
  Synthetic oligonucleotide
gttcccaatgtgccgatcggcctgtgctccctccc

SEQ ID NO: 133182 - DNA, 34 bp, Artificial Sequence
  Synthetic oligonucleotide
ataccacagatcccaactgttcccttgctcccgc

SEQ ID NO: 133183 - DNA, 35 bp, Artificial Sequence
  Synthetic oligonucleotide
attaacgacatctcgccgctgtcccgccccgccgc

SEQ ID NO: 133184 - DNA, 35 bp, Artificial Sequence
  Synthetic oligonucleotide
agcgtcaagcccccgccgcactcgcaccctacccg

SEQ ID NO: 133185 - DNA, 35 bp, Artificial Sequence
  Synthetic oligonucleotide
gaacgataccacggggaaggggggaagggttgggg

SEQ ID NO: 133186 - DNA, 35 bp, Artificial Sequence
  Synthetic oligonucleotide
gagccactggcaccccatgtctctcctcttcattg

SEQ ID NO: 133187 - DNA, 35 bp, Artificial Sequence
  Synthetic oligonucleotide
gcccccttcacacccggccgtgcccacaccactat

SEQ ID NO: 133188 - DNA, 35 bp, Artificial Sequence
  Synthetic oligonucleotide
actacccgttccatcgttttcattcgcgacgaatt

SEQ ID NO: 133189 - DNA, 35 bp, Artificial Sequence
  Synthetic oligonucleotide
accaccccggcacttgtcctaccacgcacctccca

SEQ ID NO: 133190 - DNA, 35 bp, Artificial Sequence
  Synthetic oligonucleotide
ttcatgccatccccagccttagcccccgttgtgca

SEQ ID NO: 133191 - DNA, 36 bp, Artificial Sequence
  Synthetic oligonucleotide
tcccctccacacccttcatacttggtcacgccatca

SEQ ID NO: 133192 - DNA, 36 bp, Artificial Sequence
  Synthetic oligonucleotide
gcgcccttcttccctgtcgtttatcggacccgctca

SEQ ID NO: 133193 - DNA, 37 bp, Artificial Sequence
  Synthetic oligonucleotide
tccgcaccgacacttccccctcgacccacacgctaga

SEQ ID NO: 133194 - DNA, 37 bp, Artificial Sequence
  Synthetic oligonucleotide
tccccctccttcctgttaggcgtagaccttacttcga

SEQ ID NO: 133195 - DNA, 37 bp, Artificial Sequence
  Synthetic oligonucleotide
acccccgcgtccacgccgttaaccttgcccaacctga

SEQ ID NO: 133196 - DNA, 35 bp, Artificial Sequence
  Synthetic oligonucleotide
tcacctacgcctgtaccgcttgaactcatccatta

SEQ ID NO: 133197 - DNA, 35 bp, Artificial Sequence
  Synthetic oligonucleotide
gccgccccccaggaataagcgcccgtcccccgtta

SEQ ID NO: 133198 - DNA, 35 bp, Artificial Sequence
  Synthetic oligonucleotide
gtccacagctccgtagcgtcccttttcccgatgcc

SEQ ID NO: 133199 - DNA, 35 bp, Artificial Sequence
  Synthetic oligonucleotide
ttcgcacacctcctcgtctcggcttcactcttgcc

SEQ ID NO: 133200 - DNA, 35 bp, Artificial Sequence
  Synthetic oligonucleotide
gctcggtgttagcgtagagtcgccccctcccatcc

SEQ ID NO: 133201 - DNA, 36 bp, Artificial Sequence
  Synthetic oligonucleotide
ttgacgccctctcgccccttatttagttgatccagc

SEQ ID NO: 133202 - DNA, 35 bp, Artificial Sequence
  Synthetic oligonucleotide
tgatgacgcgttctgccgattccccattcctgccg

SEQ ID NO: 133203 - DNA, 35 bp, Artificial Sequence
  Synthetic oligonucleotide
tatcattcgccccccgctgcccgcgatttcccgat

SEQ ID NO: 133204 - DNA, 35 bp, Artificial Sequence
  Synthetic oligonucleotide
agagggtgggtgagcgggttgggggaagataatgt

SEQ ID NO: 133205 - DNA, 35 bp, Artificial Sequence
  Synthetic oligonucleotide
gcatcgagctgccttcctttctcgcgacgccctgt

SEQ ID NO: 133206 - DNA, 36 bp, Artificial Sequence
  Synthetic oligonucleotide
agcactcccgcccttagtaaccgttccccatgcgca

SEQ ID NO: 133207 - DNA, 36 bp, Artificial Sequence
  Synthetic oligonucleotide
tgacgattcccacgtactgtcccccgtgttccttca

SEQ ID NO: 133208 - DNA, 37 bp, Artificial Sequence
  Synthetic oligonucleotide
ggatgagtgaggctgggaaaggaggattgaggggcga

SEQ ID NO: 133209 - DNA, 37 bp, Artificial Sequence
  Synthetic oligonucleotide
tgccccgctcgccccctcacatgagtccctggtagga

SEQ ID NO: 133210 - DNA, 37 bp, Artificial Sequence
  Synthetic oligonucleotide
gagaaggagaagactggcgtaaaggaggtagggcgga

SEQ ID NO: 133211 - DNA, 38 bp, Artificial Sequence
  Synthetic oligonucleotide
atttgcctgtgcaccttgttaccgttacgctcccctga

SEQ ID NO: 133212 - DNA, 38 bp, Artificial Sequence
  Synthetic oligonucleotide
tctccaccccgccatgttaccgcgcttcttcccattga

SEQ ID NO: 133213 - DNA, 36 bp, Artificial Sequence
  Synthetic oligonucleotide
gttcacccctgtgaggtccaccgacgattaccctta

SEQ ID NO: 133214 - DNA, 35 bp, Artificial Sequence
  Synthetic oligonucleotide
accacagatccattgccgttcactaccttcttgac

SEQ ID NO: 133215 - DNA, 35 bp, Artificial Sequence
  Synthetic oligonucleotide
acaacagtagtaccgcgccttgacttttccatccc

SEQ ID NO: 133216 - DNA, 34 bp, Artificial Sequence
  Synthetic oligonucleotide
tgatccctccgaccgacatctgtttagcccacgc

SEQ ID NO: 133217 - DNA, 35 bp, Artificial Sequence
  Synthetic oligonucleotide
tctacaccctctgcttaacagctcccctagagtgc

SEQ ID NO: 133218 - DNA, 35 bp, Artificial Sequence
  Synthetic oligonucleotide
aggtactcctgccccaccccctcgtgctactgtgc

SEQ ID NO: 133219 - DNA, 35 bp, Artificial Sequence
  Synthetic oligonucleotide
gtcccccagtactgctccaatgccccgacttggtc

SEQ ID NO: 133220 - DNA, 35 bp, Artificial Sequence
  Synthetic oligonucleotide
ggacgtatcgctcccgttcattcgtgcctttcttc

SEQ ID NO: 133221 - DNA, 35 bp, Artificial Sequence
  Synthetic oligonucleotide
acacccaccacgtttgaatattttgcttccttcag

SEQ ID NO: 133222 - DNA, 35 bp, Artificial Sequence
  Synthetic oligonucleotide
gataggtcgggagggggaggacaagaaggacttag

SEQ ID NO: 133223 - DNA, 35 bp, Artificial Sequence
  Synthetic oligonucleotide
tgatcgcccttctgcccgtcctgaccttggtcgcg

SEQ ID NO: 133224 - DNA, 35 bp, Artificial Sequence
  Synthetic oligonucleotide
gcccgcccggcacctttgtctaatccatccgactg

SEQ ID NO: 133225 - DNA, 35 bp, Artificial Sequence
  Synthetic oligonucleotide
actccaccgccgctttgagatcccttcggtacgtg

SEQ ID NO: 133226 - DNA, 35 bp, Artificial Sequence
  Synthetic oligonucleotide
ggagcacccttaccatgtaccctttgttctccttg

SEQ ID NO: 133227 - DNA, 35 bp, Artificial Sequence
  Synthetic oligonucleotide
gccctgcatgtatgtttttgcgtctccccacccat

SEQ ID NO: 133228 - DNA, 35 bp, Artificial Sequence
  Synthetic oligonucleotide
tccgccgacaactgatttccacctggcccttcgct

SEQ ID NO: 133229 - DNA, 35 bp, Artificial Sequence
  Synthetic oligonucleotide
gtcgccccctctcctaatgattctatgtaccaaca

SEQ ID NO: 133230 - DNA, 36 bp, Artificial Sequence
  Synthetic oligonucleotide
gctgcatgcgcgtattcgtagcctcccgccctccca

SEQ ID NO: 133231 - DNA, 35 bp, Artificial Sequence
  Synthetic oligonucleotide
gtgacggggtctgcatccatcgctcttcttatcca

SEQ ID NO: 133232 - DNA, 36 bp, Artificial Sequence
  Synthetic oligonucleotide
tcatcatcgggactcttgtttgctgccctcactcca

SEQ ID NO: 133233 - DNA, 35 bp, Artificial Sequence
  Synthetic oligonucleotide
gcccagttcgcctttctgccttaccacgctaccga

SEQ ID NO: 133234 - DNA, 37 bp, Artificial Sequence
  Synthetic oligonucleotide
aatccgccccctgttacatgtcttagtccttcgccga

SEQ ID NO: 133235 - DNA, 36 bp, Artificial Sequence
  Synthetic oligonucleotide
ataccaccgtctggtcgccacagaccacccctccga

SEQ ID NO: 133236 - DNA, 37 bp, Artificial Sequence
  Synthetic oligonucleotide
tagggaccgaggaggctgattcgcgggggagggggga

SEQ ID NO: 133237 - DNA, 38 bp, Artificial Sequence
  Synthetic oligonucleotide
agtgaaagcaaaggggcgggagggagtccagggtttga

SEQ ID NO: 133238 - DNA, 36 bp, Artificial Sequence
  Synthetic oligonucleotide
tgacgggcgcttcccattgtcctgcacgcttaccta

SEQ ID NO: 133239 - DNA, 36 bp, Artificial Sequence
  Synthetic oligonucleotide
ggacacagacagctgcttcgccacaccttcgctcta

SEQ ID NO: 133240 - DNA, 35 bp, Artificial Sequence
  Synthetic oligonucleotide
gacaacccctcccatccgtacgcttgggctactta

SEQ ID NO: 133241 - DNA, 35 bp, Artificial Sequence
  Synthetic oligonucleotide
gtgatcccccgacccactcgctcaaccctgcaggc

SEQ ID NO: 133242 - DNA, 35 bp, Artificial Sequence
  Synthetic oligonucleotide
agcggatgacccgcctcactttcccgccctactgc

SEQ ID NO: 133243 - DNA, 35 bp, Artificial Sequence
  Synthetic oligonucleotide
taacacccgcccctgccctattacccttcttggag

SEQ ID NO: 133244 - DNA, 35 bp, Artificial Sequence
  Synthetic oligonucleotide
atcccgtgtttgatccttgtctttgttccccccgg

SEQ ID NO: 133245 - DNA, 35 bp, Artificial Sequence
  Synthetic oligonucleotide
gtcccagcgcggagattctcctgttcggcctctct

SEQ ID NO: 133246 - DNA, 34 bp, Artificial Sequence
  Synthetic oligonucleotide
atgctagccaactcgttctgccttacttacccgt

SEQ ID NO: 133247 - DNA, 36 bp, Artificial Sequence
  Synthetic oligonucleotide
gaacaccctcccgctactgttgcccacggtctccaa

SEQ ID NO: 133248 - DNA, 35 bp, Artificial Sequence
  Synthetic oligonucleotide
acgcgccccgcccgcttcttggacctcacgaataa

SEQ ID NO: 133249 - DNA, 36 bp, Artificial Sequence
  Synthetic oligonucleotide
tcatcctcgcccttttgttcctatggcctctcctaa

SEQ ID NO: 133250 - DNA, 36 bp, Artificial Sequence
  Synthetic oligonucleotide
tttgcccgcccctttgatgaaggttatctccgccca

SEQ ID NO: 133251 - DNA, 35 bp, Artificial Sequence
  Synthetic oligonucleotide
gatgacacaccgaccgctctagtttacccacgcca

SEQ ID NO: 133252 - DNA, 36 bp, Artificial Sequence
  Synthetic oligonucleotide
tgtccgttgagcgtctactccgcctgcctatcgcca

SEQ ID NO: 133253 - DNA, 36 bp, Artificial Sequence
  Synthetic oligonucleotide
tccgcaccaactgccggtcaccgcctgtaaccctca

SEQ ID NO: 133254 - DNA, 37 bp, Artificial Sequence
  Synthetic oligonucleotide
aagctgaggagggtgggtggggaggatctaggttgga

SEQ ID NO: 133255 - DNA, 38 bp, Artificial Sequence
  Synthetic oligonucleotide
agcagagctcctgtccgtttcgatctctctcttcctga

SEQ ID NO: 133256 - DNA, 36 bp, Artificial Sequence
  Synthetic oligonucleotide
tgaagtcagtcacaatgagtttccttccgctcccta

SEQ ID NO: 133257 - DNA, 36 bp, Artificial Sequence
  Synthetic oligonucleotide
gcccagtccgccctgcaccctgcaattcctatggta

SEQ ID NO: 133258 - DNA, 35 bp, Artificial Sequence
  Synthetic oligonucleotide
gcgccccagcctcgccttttatagctccgctttac

SEQ ID NO: 133259 - DNA, 35 bp, Artificial Sequence
  Synthetic oligonucleotide
gtgatcccgccgatgactcatctacgttacgcacc

SEQ ID NO: 133260 - DNA, 35 bp, Artificial Sequence
  Synthetic oligonucleotide
taagcccagttcctactgctcatctgtttctgtcc

SEQ ID NO: 133261 - DNA, 35 bp, Artificial Sequence
  Synthetic oligonucleotide
tgatcgggggatgtcctatatcctgccgctccttc

SEQ ID NO: 133262 - DNA, 35 bp, Artificial Sequence
  Synthetic oligonucleotide
gactcagcaccgcccacagatttatcctccgcccg

SEQ ID NO: 133263 - DNA, 36 bp, Artificial Sequence
  Synthetic oligonucleotide
gcccccccgcccgcctcaatctatcccgcctcagcg

SEQ ID NO: 133264 - DNA, 35 bp, Artificial Sequence
  Synthetic oligonucleotide
gttcctgactcagagctcatttcccaccccctgcg

SEQ ID NO: 133265 - DNA, 35 bp, Artificial Sequence
  Synthetic oligonucleotide
gtgatccccccaaccgtcttgtccgcccatagtcg

SEQ ID NO: 133266 - DNA, 35 bp, Artificial Sequence
  Synthetic oligonucleotide
tcgcgtgcctcatatcacccctccttaacatcctg

SEQ ID NO: 133267 - DNA, 35 bp, Artificial Sequence
  Synthetic oligonucleotide
atgcccgctgcgtttatgctccgttcgccttcctg

SEQ ID NO: 133268 - DNA, 35 bp, Artificial Sequence
  Synthetic oligonucleotide
gatgtccagccttccacatagtatctttccatttg

SEQ ID NO: 133269 - DNA, 35 bp, Artificial Sequence
  Synthetic oligonucleotide
tgatctccatctggttttggtccgccacacctcct

SEQ ID NO: 133270 - DNA, 35 bp, Artificial Sequence
  Synthetic oligonucleotide
atgtgtcgggctcacggtccccttcgcctcccttt

SEQ ID NO: 133271 - DNA, 35 bp, Artificial Sequence
  Synthetic oligonucleotide
tggaggaaagagaggagcgggggggagacaggaaa

SEQ ID NO: 133272 - DNA, 36 bp, Artificial Sequence
  Synthetic oligonucleotide
atcgccctccatacttattgccgtgaccacgtaaca

SEQ ID NO: 133273 - DNA, 36 bp, Artificial Sequence
  Synthetic oligonucleotide
gctactcagttctgcaccagccccccttgccccgca

SEQ ID NO: 133274 - DNA, 35 bp, Artificial Sequence
  Synthetic oligonucleotide
gcgtacatccgccgccgaacctatgatcttcgtca

SEQ ID NO: 133275 - DNA, 37 bp, Artificial Sequence
  Synthetic oligonucleotide
tcccaccgccttccctctataacccactagagcacga

SEQ ID NO: 133276 - DNA, 37 bp, Artificial Sequence
  Synthetic oligonucleotide
agggtgggagggtgtgtgcgtgcgtgaggggcctgga

SEQ ID NO: 133277 - DNA, 38 bp, Artificial Sequence
  Synthetic oligonucleotide
gcacatccgccataccctgcactgcacctctgtcttga

SEQ ID NO: 133278 - DNA, 36 bp, Artificial Sequence
  Synthetic oligonucleotide
accgttcgcagttcgtctctccaaccccgtcgccta

SEQ ID NO: 133279 - DNA, 36 bp, Artificial Sequence
  Synthetic oligonucleotide
acctcctgttgccttccgtaattacacctttagtta

SEQ ID NO: 133280 - DNA, 35 bp, Artificial Sequence
  Synthetic oligonucleotide
tccgccaccctcctaatgttggttccattgctccc

SEQ ID NO: 133281 - DNA, 35 bp, Artificial Sequence
  Synthetic oligonucleotide
tgtgtgcatctatctgttttttacctacatgttcc

SEQ ID NO: 133282 - DNA, 35 bp, Artificial Sequence
  Synthetic oligonucleotide
gtgtgctggtactctcctgtttcgactccctgggc

SEQ ID NO: 133283 - DNA, 35 bp, Artificial Sequence
  Synthetic oligonucleotide
gatcaccccgactccgacccatttggaccaacctc

SEQ ID NO: 133284 - DNA, 35 bp, Artificial Sequence
  Synthetic oligonucleotide
gcattgcattgctctaccacccgaggtcatcgctc

SEQ ID NO: 133285 - DNA, 35 bp, Artificial Sequence
  Synthetic oligonucleotide
tacattgcctcacccattgccctcgcttctataag

SEQ ID NO: 133286 - DNA, 35 bp, Artificial Sequence
  Synthetic oligonucleotide
tcttgcgcccttcgctcgtccacacctgctatacg

SEQ ID NO: 133287 - DNA, 35 bp, Artificial Sequence
  Synthetic oligonucleotide
agtcacatcacgtccgctctaccccgcctgccgcg

SEQ ID NO: 133288 - DNA, 35 bp, Artificial Sequence
  Synthetic oligonucleotide
gaccccggcctcccgactgactccgcgtcctctcg

SEQ ID NO: 133289 - DNA, 35 bp, Artificial Sequence
  Synthetic oligonucleotide
aatgtgcagaggataaggtggggggagtggaagtg

SEQ ID NO: 133290 - DNA, 35 bp, Artificial Sequence
  Synthetic oligonucleotide
tgggtccaccccttcttctccccgcaaacgcatat

SEQ ID NO: 133291 - DNA, 35 bp, Artificial Sequence
  Synthetic oligonucleotide
tccgttggcacgatgggcccccgctattcacctct

SEQ ID NO: 133292 - DNA, 36 bp, Artificial Sequence
  Synthetic oligonucleotide
gagagccaacaagggcaggggggaagaatggaggaa

SEQ ID NO: 133293 - DNA, 33 bp, Artificial Sequence
  Synthetic oligonucleotide
tacgtacattcaccgccactttactccatgcca

SEQ ID NO: 133294 - DNA, 36 bp, Artificial Sequence
  Synthetic oligonucleotide
acattggtggggaggggtccggtgggggaggaagca

SEQ ID NO: 133295 - DNA, 37 bp, Artificial Sequence
  Synthetic oligonucleotide
tcgagcgaagggagagaacggaggggacggagtgaga

SEQ ID NO: 133296 - DNA, 37 bp, Artificial Sequence
  Synthetic oligonucleotide
caggggtgaacaggggagggaggggacgacaagacga

SEQ ID NO: 133297 - DNA, 36 bp, Artificial Sequence
  Synthetic oligonucleotide
acccgtgcccggctatatttcgctccgtttttccga

SEQ ID NO: 133298 - DNA, 36 bp, Artificial Sequence
  Synthetic oligonucleotide
gatacccgcccgttgtacccccagttcccgtaagga

SEQ ID NO: 133299 - DNA, 37 bp, Artificial Sequence
  Synthetic oligonucleotide
gcccgccccgatagtaccgtacctccccgccgaatga

SEQ ID NO: 133300 - DNA, 38 bp, Artificial Sequence
  Synthetic oligonucleotide
gtgatactgcctccgctgcccgttaactcctctcctga

SEQ ID NO: 133301 - DNA, 38 bp, Artificial Sequence
  Synthetic oligonucleotide
gactaggggggattagtgctttggggtggagggggtga

SEQ ID NO: 133302 - DNA, 36 bp, Artificial Sequence
  Synthetic oligonucleotide
aagttgcgcgcacttcccgagcccactcctccgcta

SEQ ID NO: 133303 - DNA, 36 bp, Artificial Sequence
  Synthetic oligonucleotide
gatggaaggagggaggtgaaaactgtggatggcgta

SEQ ID NO: 133304 - DNA, 35 bp, Artificial Sequence
  Synthetic oligonucleotide
gagccgacggtctttggtcacatcacgcccccaac

SEQ ID NO: 133305 - DNA, 35 bp, Artificial Sequence
  Synthetic oligonucleotide
tgccaccatcgattcatcccttccgcatgatccac

SEQ ID NO: 133306 - DNA, 35 bp, Artificial Sequence
  Synthetic oligonucleotide
atcgcaacctgttaattgtagccaatcgcctcccc

SEQ ID NO: 133307 - DNA, 35 bp, Artificial Sequence
  Synthetic oligonucleotide
atcccacctcccgtctagcggtctactacactgcc

SEQ ID NO: 133308 - DNA, 35 bp, Artificial Sequence
  Synthetic oligonucleotide
gccgcgcatgccactttatcggactaacaccttcc

SEQ ID NO: 133309 - DNA, 35 bp, Artificial Sequence
  Synthetic oligonucleotide
gataaatgtgggacggttggaggggagtgggaggc

SEQ ID NO: 133310 - DNA, 35 bp, Artificial Sequence
  Synthetic oligonucleotide
aacactcgcatacgtaacagtctgccccgctcctc

SEQ ID NO: 133311 - DNA, 35 bp, Artificial Sequence
  Synthetic oligonucleotide
ttgccaggctaatgcttacgggtcctgcttccttc

SEQ ID NO: 133312 - DNA, 35 bp, Artificial Sequence
  Synthetic oligonucleotide
gtggggccggtcccggggagggttgcgtgatgggg

SEQ ID NO: 133313 - DNA, 35 bp, Artificial Sequence
  Synthetic oligonucleotide
gatccaccacttcgactgcccttaaccgttcgact

SEQ ID NO: 133314 - DNA, 35 bp, Artificial Sequence
  Synthetic oligonucleotide
actccaacctctaatgctgtgcgttttcttcatct

SEQ ID NO: 133315 - DNA, 36 bp, Artificial Sequence
  Synthetic oligonucleotide
atcccgccctcttgcccgtggcactcaacattgcca

SEQ ID NO: 133316 - DNA, 29 bp, Artificial Sequence
  Synthetic oligonucleotide
gaaccccccacccactcaacatctcggca

SEQ ID NO: 133317 - DNA, 37 bp, Artificial Sequence
  Synthetic oligonucleotide
atcaaagcaaggggtggaacaaaaaagtggtgacaga

SEQ ID NO: 133318 - DNA, 35 bp, Artificial Sequence
  Synthetic oligonucleotide
actcccattgccccatgtacgggttccacacacga

SEQ ID NO: 133319 - DNA, 37 bp, Artificial Sequence
  Synthetic oligonucleotide
gcaacaccgcccttcccccgcgcccttcgtataagga

SEQ ID NO: 133320 - DNA, 37 bp, Artificial Sequence
  Synthetic oligonucleotide
aaaggataggggatggatggggccggagtgaggagga

SEQ ID NO: 133321 - DNA, 37 bp, Artificial Sequence
  Synthetic oligonucleotide
gaccatggagagcagggaggggaacaggaataacgga

SEQ ID NO: 133322 - DNA, 37 bp, Artificial Sequence
  Synthetic oligonucleotide
accaacggtcagaggcgggcggctcagcggcaaggga

SEQ ID NO: 133323 - DNA, 36 bp, Artificial Sequence
  Synthetic oligonucleotide
tacccactccgactgccctccacacccagttaatga

SEQ ID NO: 133324 - DNA, 36 bp, Artificial Sequence
  Synthetic oligonucleotide
tcagtagagaggaggggcgaagaggagagcgtccta

SEQ ID NO: 133325 - DNA, 36 bp, Artificial Sequence
  Synthetic oligonucleotide
aacgctcccagaccctgtggtatccccgctctctta

SEQ ID NO: 133326 - DNA, 36 bp, Artificial Sequence
  Synthetic oligonucleotide
gatcacccccccaattggttttagcgccatttctta

SEQ ID NO: 133327 - DNA, 35 bp, Artificial Sequence
  Synthetic oligonucleotide
gaatcacccccaccatgtcgtctcttaccgttacc

SEQ ID NO: 133328 - DNA, 35 bp, Artificial Sequence
  Synthetic oligonucleotide
gtctcgcccgatcgtagtcacatgcgcgtacctcc

SEQ ID NO: 133329 - DNA, 35 bp, Artificial Sequence
  Synthetic oligonucleotide
acccccgcagtcagcacgccaacctcctctccttc

SEQ ID NO: 133330 - DNA, 35 bp, Artificial Sequence
  Synthetic oligonucleotide
tatctatccgcccagcatccccctacctgtctgcg

SEQ ID NO: 133331 - DNA, 35 bp, Artificial Sequence
  Synthetic oligonucleotide
gacgcccggcccagttacgctacaacctgttacat

SEQ ID NO: 133332 - DNA, 35 bp, Artificial Sequence
  Synthetic oligonucleotide
tctcgcccttgatgcccctccgttagtcgtacttt

SEQ ID NO: 133333 - DNA, 35 bp, Artificial Sequence
  Synthetic oligonucleotide
tcccaaccccacgttcgctttattcgggtgactca

SEQ ID NO: 133334 - DNA, 37 bp, Artificial Sequence
  Synthetic oligonucleotide
gtcggagcataaagagggaaagggggcggggcgtaga

SEQ ID NO: 133335 - DNA, 37 bp, Artificial Sequence
  Synthetic oligonucleotide
agagaccaggggggtgagaggggatatgggctgacga

SEQ ID NO: 133336 - DNA, 36 bp, Artificial Sequence
  Synthetic oligonucleotide
gcgaatcgggtgggatgggaagggtatctgtgtcga

SEQ ID NO: 133337 - DNA, 37 bp, Artificial Sequence
  Synthetic oligonucleotide
ttccaccgtctccttgcccttcttatcgccctacgga

SEQ ID NO: 133338 - DNA, 38 bp, Artificial Sequence
  Synthetic oligonucleotide
gtgcaccggtcgttcgttcaccctgcacctgtacctga

SEQ ID NO: 133339 - DNA, 37 bp, Artificial Sequence
  Synthetic oligonucleotide
gtcccatccgccattattcccgcacgctaaccgttga

SEQ ID NO: 133340 - DNA, 36 bp, Artificial Sequence
  Synthetic oligonucleotide
gaaacccaccgcccctcctgcatccgtactaaagta

SEQ ID NO: 133341 - DNA, 35 bp, Artificial Sequence
  Synthetic oligonucleotide
accgcggtgttccactgtctacactggccgctccc

SEQ ID NO: 133342 - DNA, 35 bp, Artificial Sequence
  Synthetic oligonucleotide
gcgcgagttctgtagcgttcgcccttccttttgcc

SEQ ID NO: 133343 - DNA, 35 bp, Artificial Sequence
  Synthetic oligonucleotide
taggtggcccaagcttttagccgctacgactttcc

SEQ ID NO: 133344 - DNA, 35 bp, Artificial Sequence
  Synthetic oligonucleotide
gacacactacccgcgtaccactcgcttcccctagc

SEQ ID NO: 133345 - DNA, 35 bp, Artificial Sequence
  Synthetic oligonucleotide
gatcggtgcatacacgtctgccgctccaccgccgc

SEQ ID NO: 133346 - DNA, 35 bp, Artificial Sequence
  Synthetic oligonucleotide
gcacctcctatgtcatcccccattgcgctcgtcgc

SEQ ID NO: 133347 - DNA, 35 bp, Artificial Sequence
  Synthetic oligonucleotide
tgacactcatcgcaccccttatcacccagctttgc

SEQ ID NO: 133348 - DNA, 35 bp, Artificial Sequence
  Synthetic oligonucleotide
atcgatgctatctttggtccctatacctgttcctc

SEQ ID NO: 133349 - DNA, 35 bp, Artificial Sequence
  Synthetic oligonucleotide
atttccaccaccacgaacgcctccacccttacagg

SEQ ID NO: 133350 - DNA, 35 bp, Artificial Sequence
  Synthetic oligonucleotide
gtccaccgccgccttagaattgccgcgacctgtct

SEQ ID NO: 133351 - DNA, 36 bp, Artificial Sequence
  Synthetic oligonucleotide
gttccaccgtaccacccatcctcgatttcagggaca

SEQ ID NO: 133352 - DNA, 36 bp, Artificial Sequence
  Synthetic oligonucleotide
ccaggtcaccgccccactatcccgacgtcgccacca

SEQ ID NO: 133353 - DNA, 36 bp, Artificial Sequence
  Synthetic oligonucleotide
acagccacagccgccgcaccctcgcgaaattccgca

SEQ ID NO: 133354 - DNA, 35 bp, Artificial Sequence
  Synthetic oligonucleotide
tttgcacccctctgttctccgtcgacggttcctca

SEQ ID NO: 133355 - DNA, 37 bp, Artificial Sequence
  Synthetic oligonucleotide
taagacgggggaatgggggacggtgaatagggagcga

SEQ ID NO: 133356 - DNA, 36 bp, Artificial Sequence
  Synthetic oligonucleotide
tcacaactcccgccctggtgattccccctacgtgga

SEQ ID NO: 133357 - DNA, 38 bp, Artificial Sequence
  Synthetic oligonucleotide
tcgcccctccagccttggtcccccgccagaccacctga

SEQ ID NO: 133358 - DNA, 38 bp, Artificial Sequence
  Synthetic oligonucleotide
atggaagggtgcagaagggaggggaggggaggaattga

SEQ ID NO: 133359 - DNA, 38 bp, Artificial Sequence
  Synthetic oligonucleotide
tcaccccccgcctccgtagaacctcgtacattcattga

SEQ ID NO: 133360 - DNA, 35 bp, Artificial Sequence
  Synthetic oligonucleotide
tacgccccctcttccgttcaactgtaaacgtgcta

SEQ ID NO: 133361 - DNA, 35 bp, Artificial Sequence
  Synthetic oligonucleotide
agacctactcgcctagttgcgctccacccagaccc

SEQ ID NO: 133362 - DNA, 35 bp, Artificial Sequence
  Synthetic oligonucleotide
tctacatcaccgttcaccaaacgacggtaccgccc

SEQ ID NO: 133363 - DNA, 35 bp, Artificial Sequence
  Synthetic oligonucleotide
atccccgcatgcctacctgttacgctaagttttcc

SEQ ID NO: 133364 - DNA, 35 bp, Artificial Sequence
  Synthetic oligonucleotide
atggacgtcacggctacccccggctgttccatcgc

SEQ ID NO: 133365 - DNA, 35 bp, Artificial Sequence
  Synthetic oligonucleotide
acgctccgccaccacttcccgttatttgggtgctc

SEQ ID NO: 133366 - DNA, 35 bp, Artificial Sequence
  Synthetic oligonucleotide
aacatggctggccttctcatcgctcgaactctgtc

SEQ ID NO: 133367 - DNA, 35 bp, Artificial Sequence
  Synthetic oligonucleotide
gttgcggaaacacgtcctctgttctgtcttcgttc

SEQ ID NO: 133368 - DNA, 35 bp, Artificial Sequence
  Synthetic oligonucleotide
ttgtgccttccttcccgctctgcattctggtatcg

SEQ ID NO: 133369 - DNA, 35 bp, Artificial Sequence
  Synthetic oligonucleotide
tagtcacacctccccgcaatagcctcggtattaat

SEQ ID NO: 133370 - DNA, 35 bp, Artificial Sequence
  Synthetic oligonucleotide
accccccctcgatcccagcgtgacgacgcctacat

SEQ ID NO: 133371 - DNA, 35 bp, Artificial Sequence
  Synthetic oligonucleotide
gagagcagtcgctcgacccgcctcactattctcct

SEQ ID NO: 133372 - DNA, 33 bp, Artificial Sequence
  Synthetic oligonucleotide
gaggctccctcacccgttcatcacttaggtcct

SEQ ID NO: 133373 - DNA, 35 bp, Artificial Sequence
  Synthetic oligonucleotide
aatgctgtaagcatcggcccccgcccccctcttct

SEQ ID NO: 133374 - DNA, 35 bp, Artificial Sequence
  Synthetic oligonucleotide
acctagtgccaatcgctagccaaactcccgccctt

SEQ ID NO: 133375 - DNA, 35 bp, Artificial Sequence
  Synthetic oligonucleotide
tccacgccatgtacttcctctttcttccgcctgtt

SEQ ID NO: 133376 - DNA, 36 bp, Artificial Sequence
  Synthetic oligonucleotide
gcacaccgccacgcaaggctaaaaatcgccactcca

SEQ ID NO: 133377 - DNA, 36 bp, Artificial Sequence
  Synthetic oligonucleotide
aacgagggaccgaggtgggcgggaggtagctggaga

SEQ ID NO: 133378 - DNA, 36 bp, Artificial Sequence
  Synthetic oligonucleotide
gccctccagacgtaccttacggcgccctccacccga

SEQ ID NO: 133379 - DNA, 37 bp, Artificial Sequence
  Synthetic oligonucleotide
gtccccgctttccgtacatcgccatccgtttcatcga

SEQ ID NO: 133380 - DNA, 37 bp, Artificial Sequence
  Synthetic oligonucleotide
atgtgcgcagagggcgggcaagggcgagtttatggga

SEQ ID NO: 133381 - DNA, 36 bp, Artificial Sequence
  Synthetic oligonucleotide
aagaagtggggcaggggggaacgggcggactcagta

SEQ ID NO: 133382 - DNA, 36 bp, Artificial Sequence
  Synthetic oligonucleotide
tagccctctggacattgccaccttactacgtacgta

SEQ ID NO: 133383 - DNA, 35 bp, Artificial Sequence
  Synthetic oligonucleotide
gcaacaatctgcgccacccatctgcaatccgtaac

SEQ ID NO: 133384 - DNA, 35 bp, Artificial Sequence
  Synthetic oligonucleotide
ttgttcgctgtccacgtatctttcacgctccctcc

SEQ ID NO: 133385 - DNA, 35 bp, Artificial Sequence
  Synthetic oligonucleotide
atcgcaccatcaatcggtcgaatcgtgccaattcc

SEQ ID NO: 133386 - DNA, 35 bp, Artificial Sequence
  Synthetic oligonucleotide
tctacgtccccggctgcccacgcgctcgttatctc

SEQ ID NO: 133387 - DNA, 35 bp, Artificial Sequence
  Synthetic oligonucleotide
gatcggggaagtctcagtcgccgtcgctccctttc

SEQ ID NO: 133388 - DNA, 35 bp, Artificial Sequence
  Synthetic oligonucleotide
gccacccatcccataacctacgcggaacatcaccg

SEQ ID NO: 133389 - DNA, 35 bp, Artificial Sequence
  Synthetic oligonucleotide
tactgcctcttccctcttcgctcgacccactctgg

SEQ ID NO: 133390 - DNA, 35 bp, Artificial Sequence
  Synthetic oligonucleotide
ggtcaacaccttctcctggaatcgctgcctacctg

SEQ ID NO: 133391 - DNA, 35 bp, Artificial Sequence
  Synthetic oligonucleotide
accctcattcagccgcctgtctcgtctgccccgtt

SEQ ID NO: 133392 - DNA, 36 bp, Artificial Sequence
  Synthetic oligonucleotide
ccacccaccgaggtttcgtgcctgcccccctgtaaa

SEQ ID NO: 133393 - DNA, 36 bp, Artificial Sequence
  Synthetic oligonucleotide
tgcgagtggctcgacctctacttcccttgctttcaa

SEQ ID NO: 133394 - DNA, 36 bp, Artificial Sequence
  Synthetic oligonucleotide
ttgcccatcccgcccgtgcttgaatatgccccgcca

SEQ ID NO: 133395 - DNA, 36 bp, Artificial Sequence
  Synthetic oligonucleotide
gaaactccagtcctgcttatgtagccactcccgcca

SEQ ID NO: 133396 - DNA, 36 bp, Artificial Sequence
  Synthetic oligonucleotide
gcacgctcccatcgcacttagcctttgactccagca

SEQ ID NO: 133397 - DNA, 34 bp, Artificial Sequence
  Synthetic oligonucleotide
aatgaaggtggaagggaaatcggacgggcagaga

SEQ ID NO: 133398 - DNA, 37 bp, Artificial Sequence
  Synthetic oligonucleotide
ggagtgaccggaggggggcataatgcggtgagggcga

SEQ ID NO: 133399 - DNA, 37 bp, Artificial Sequence
  Synthetic oligonucleotide
tgctaaaacgaaggggggggaggagggacatttggga

SEQ ID NO: 133400 - DNA, 37 bp, Artificial Sequence
  Synthetic oligonucleotide
tcagcccgcctcggcccgctttaatctctcctttgga

SEQ ID NO: 133401 - DNA, 38 bp, Artificial Sequence
  Synthetic oligonucleotide
tcacacctatcctggtttccaacacatccctgtaatga

SEQ ID NO: 133402 - DNA, 38 bp, Artificial Sequence
  Synthetic oligonucleotide
ttcgatccacctctgcattgaaagatccctcttgttga

SEQ ID NO: 133403 - DNA, 36 bp, Artificial Sequence
  Synthetic oligonucleotide
gacgggcgagggggatacggggaactgggtgagcta

SEQ ID NO: 133404 - DNA, 36 bp, Artificial Sequence
  Synthetic oligonucleotide
acgaccgtgggtaagggtgggatgggcagtaccgta

SEQ ID NO: 133405 - DNA, 35 bp, Artificial Sequence
  Synthetic oligonucleotide
ttgcccgtcacttttctcgctccgcccgctgggac

SEQ ID NO: 133406 - DNA, 35 bp, Artificial Sequence
  Synthetic oligonucleotide
gtggcaccagtgctgtactcttcatcttcgcgccc

SEQ ID NO: 133407 - DNA, 35 bp, Artificial Sequence
  Synthetic oligonucleotide
ttcgctgcccagcaaaagtaaatgccaccgctccc

SEQ ID NO: 133408 - DNA, 35 bp, Artificial Sequence
  Synthetic oligonucleotide
atacccgcggtctgtaactactccttccgctgtgc

SEQ ID NO: 133409 - DNA, 35 bp, Artificial Sequence
  Synthetic oligonucleotide
ggtgcattacctgccctcccctccgtgccgggttc

SEQ ID NO: 133410 - DNA, 35 bp, Artificial Sequence
  Synthetic oligonucleotide
ttgaccccaccctcagccgtgaacccccgacgatg

SEQ ID NO: 133411 - DNA, 35 bp, Artificial Sequence
  Synthetic oligonucleotide
gtgctgcctccctgtgcatcggtacttcccatcgt

SEQ ID NO: 133412 - DNA, 35 bp, Artificial Sequence
  Synthetic oligonucleotide
actctgaccccatcattcactccgcctccgacggt

SEQ ID NO: 133413 - DNA, 36 bp, Artificial Sequence
  Synthetic oligonucleotide
acgaacgctgattcgcttttgcctctgctctctaca

SEQ ID NO: 133414 - DNA, 36 bp, Artificial Sequence
  Synthetic oligonucleotide
gtcgtcacccacagttctctatcggacgcctaccca

SEQ ID NO: 133415 - DNA, 37 bp, Artificial Sequence
  Synthetic oligonucleotide
tacaaggcaccgcatacttgccaacgtacccccccga

SEQ ID NO: 133416 - DNA, 37 bp, Artificial Sequence
  Synthetic oligonucleotide
ttagttccccaccgattgttgctgaccgccttttcga

SEQ ID NO: 133417 - DNA, 37 bp, Artificial Sequence
  Synthetic oligonucleotide
aatgggtggcgatcggagggcgggaggagggcgcgga

SEQ ID NO: 133418 - DNA, 38 bp, Artificial Sequence
  Synthetic oligonucleotide
tcacgccccgcctgtgcccgatatacaaaccctgctga

SEQ ID NO: 133419 - DNA, 38 bp, Artificial Sequence
  Synthetic oligonucleotide
tgcactgtcccctgcgcgttgaatttccccctcgttga

SEQ ID NO: 133420 - DNA, 38 bp, Artificial Sequence
  Synthetic oligonucleotide
tgtagccaggttggcggggcgagggggggacgggttga

SEQ ID NO: 133421 - DNA, 36 bp, Artificial Sequence
  Synthetic oligonucleotide
tgaccccgttccttccgccgtatcacagccacaata

SEQ ID NO: 133422 - DNA, 35 bp, Artificial Sequence
  Synthetic oligonucleotide
gagccaacctctcctcgtgcttttctctgttcacc

SEQ ID NO: 133423 - DNA, 35 bp, Artificial Sequence
  Synthetic oligonucleotide
gcctaggacctgctggttagctcctcccgtgcccc

SEQ ID NO: 133424 - DNA, 35 bp, Artificial Sequence
  Synthetic oligonucleotide
tcctcatcagagctacttacactgtctgttctccc

SEQ ID NO: 133425 - DNA, 35 bp, Artificial Sequence
  Synthetic oligonucleotide
acgaatccagccgtcccccggcacctgtttgatcc

SEQ ID NO: 133426 - DNA, 35 bp, Artificial Sequence
  Synthetic oligonucleotide
gcactgactcagccgctttcaccagaatccactcc

SEQ ID NO: 133427 - DNA, 35 bp, Artificial Sequence
  Synthetic oligonucleotide
agcgcgtgcagcagccccccttactctcaccttgc

SEQ ID NO: 133428 - DNA, 35 bp, Artificial Sequence
  Synthetic oligonucleotide
tgttccggcccccctcacttgcagtttaagctctc

SEQ ID NO: 133429 - DNA, 35 bp, Artificial Sequence
  Synthetic oligonucleotide
gttccatccgccgtacacgtgtgcgaagcacggtc

SEQ ID NO: 133430 - DNA, 35 bp, Artificial Sequence
  Synthetic oligonucleotide
gtgaaagagggaggggtggggaggtccgggtaacg

SEQ ID NO: 133431 - DNA, 35 bp, Artificial Sequence
  Synthetic oligonucleotide
tccaccggccaccgccatgcttcgttactatccgg

SEQ ID NO: 133432 - DNA, 35 bp, Artificial Sequence
  Synthetic oligonucleotide
acccactcctcgtccgactccccagtttgtccatg

SEQ ID NO: 133433 - DNA, 35 bp, Artificial Sequence
  Synthetic oligonucleotide
ggtcgctctcatctcgttcaaatcctgccatcctg

SEQ ID NO: 133434 - DNA, 35 bp, Artificial Sequence
  Synthetic oligonucleotide
tccccaccctaccctgctctacttagttaaagcct

SEQ ID NO: 133435 - DNA, 35 bp, Artificial Sequence
  Synthetic oligonucleotide
atggccacctcgctgaagctctgtccctctctagt

SEQ ID NO: 133436 - DNA, 35 bp, Artificial Sequence
  Synthetic oligonucleotide
ttggcactttccatccgttttcgcccccagacttt

SEQ ID NO: 133437 - DNA, 36 bp, Artificial Sequence
  Synthetic oligonucleotide
ggagtggggtgggagggtggtcgctggagcgtgcaa

SEQ ID NO: 133438 - DNA, 36 bp, Artificial Sequence
  Synthetic oligonucleotide
gacaccacccacttaccgcaccatgttgctattgaa

SEQ ID NO: 133439 - DNA, 35 bp, Artificial Sequence
  Synthetic oligonucleotide
tgttgacgtcacctatcggaccctctcctccccca

SEQ ID NO: 133440 - DNA, 37 bp, Artificial Sequence
  Synthetic oligonucleotide
aaacaagggcagggagggatagggcttggatggaaga

SEQ ID NO: 133441 - DNA, 37 bp, Artificial Sequence
  Synthetic oligonucleotide
tcgctccaacgcacagcgccccatcccccgctttcga

SEQ ID NO: 133442 - DNA, 37 bp, Artificial Sequence
  Synthetic oligonucleotide
tagagacggaatggggggagggccagctgccgaggga

SEQ ID NO: 133443 - DNA, 38 bp, Artificial Sequence
  Synthetic oligonucleotide
gaccatcactgtatgcttagtttccgcactttttatga

SEQ ID NO: 133444 - DNA, 36 bp, Artificial Sequence
  Synthetic oligonucleotide
gtcacacgccctccgctccgccagtccgacagttga

SEQ ID NO: 133445 - DNA, 34 bp, Artificial Sequence
  Synthetic oligonucleotide
tcatcatccattccccctcgcctgaagtactata

SEQ ID NO: 133446 - DNA, 35 bp, Artificial Sequence
  Synthetic oligonucleotide
tgtgtctgccagtgttttctgccctgttactccac

SEQ ID NO: 133447 - DNA, 35 bp, Artificial Sequence
  Synthetic oligonucleotide
aacgcccggttgctttgaattttgcaccgttccac

SEQ ID NO: 133448 - DNA, 35 bp, Artificial Sequence
  Synthetic oligonucleotide
tgcgtcccggcccgcttgttggttctgttcatcac

SEQ ID NO: 133449 - DNA, 35 bp, Artificial Sequence
  Synthetic oligonucleotide
tgccaacacgacggcgtcactgccccgttcattcc

SEQ ID NO: 133450 - DNA, 35 bp, Artificial Sequence
  Synthetic oligonucleotide
tttcgttgcccaggcccacccctactggtacttcc

SEQ ID NO: 133451 - DNA, 35 bp, Artificial Sequence
  Synthetic oligonucleotide
accacacctctcactcttggaagcaagcgaaccgc

SEQ ID NO: 133452 - DNA, 35 bp, Artificial Sequence
  Synthetic oligonucleotide
tgaagcgctaccgttccctagcctgttcttgtctc

SEQ ID NO: 133453 - DNA, 35 bp, Artificial Sequence
  Synthetic oligonucleotide
tcaaccctacgacacccctccctgcgtacctggtc

SEQ ID NO: 133454 - DNA, 35 bp, Artificial Sequence
  Synthetic oligonucleotide
ttgatggtccccacctgacatgccctgcgcccccg

SEQ ID NO: 133455 - DNA, 35 bp, Artificial Sequence
  Synthetic oligonucleotide
ttccaccctctaacccccgcctctctgcctgtgcg

SEQ ID NO: 133456 - DNA, 35 bp, Artificial Sequence
  Synthetic oligonucleotide
atgaccaccttcacacacgttagcctcttctgtcg

SEQ ID NO: 133457 - DNA, 34 bp, Artificial Sequence
  Synthetic oligonucleotide
atcccacccccgattcctgccgttgaactcaggg

SEQ ID NO: 133458 - DNA, 35 bp, Artificial Sequence
  Synthetic oligonucleotide
ggagcccagggagcgaggggggtggggcatgtgct

SEQ ID NO: 133459 - DNA, 35 bp, Artificial Sequence
  Synthetic oligonucleotide
atgcgccctggtcctactccgccctatcgccctaa

SEQ ID NO: 133460 - DNA, 35 bp, Artificial Sequence
  Synthetic oligonucleotide
gtgatccgcccctgaacgtgccatgattgccaaca

SEQ ID NO: 133461 - DNA, 35 bp, Artificial Sequence
  Synthetic oligonucleotide
tccccacccagacacctaactttgtgcgcatccca

SEQ ID NO: 133462 - DNA, 36 bp, Artificial Sequence
  Synthetic oligonucleotide
ttgaccacatactgtaacggcctcccgctccacgca

SEQ ID NO: 133463 - DNA, 35 bp, Artificial Sequence
  Synthetic oligonucleotide
tcagcgtgcactactggtcccttctcgtcccatca

SEQ ID NO: 133464 - DNA, 37 bp, Artificial Sequence
  Synthetic oligonucleotide
gacgggcgggagggaacgtgttaggatctcatcggga

SEQ ID NO: 133465 - DNA, 37 bp, Artificial Sequence
  Synthetic oligonucleotide
gagttgagaccagggggaagagtgggcgaggaatgga

SEQ ID NO: 133466 - DNA, 38 bp, Artificial Sequence
  Synthetic oligonucleotide
gtccgtatcgcctctcgtttggttccatctcttgttga

SEQ ID NO: 133467 - DNA, 36 bp, Artificial Sequence
  Synthetic oligonucleotide
acgcctcgcatcgctccacctcgtctttatgaccta

SEQ ID NO: 133468 - DNA, 35 bp, Artificial Sequence
  Synthetic oligonucleotide
gtggaagccctcctgtttgcgcaaacccctgccta

SEQ ID NO: 133469 - DNA, 35 bp, Artificial Sequence
  Synthetic oligonucleotide
acgcgtacactgctcccataagttcctcgctcaac

SEQ ID NO: 133470 - DNA, 35 bp, Artificial Sequence
  Synthetic oligonucleotide
tgcggtccaggtccctctgccaaatcccgcccccc

SEQ ID NO: 133471 - DNA, 35 bp, Artificial Sequence
  Synthetic oligonucleotide
aaacgtgctctagccccccactctgttatggcccc

SEQ ID NO: 133472 - DNA, 35 bp, Artificial Sequence
  Synthetic oligonucleotide
tcagcacagagtctctcatccgtctcactattgtc

SEQ ID NO: 133473 - DNA, 34 bp, Artificial Sequence
  Synthetic oligonucleotide
tccgcacctgctgccccctcgcctaactgagttc

SEQ ID NO: 133474 - DNA, 35 bp, Artificial Sequence
  Synthetic oligonucleotide
tctcctgccatccacgcttacatatcaactggttc

SEQ ID NO: 133475 - DNA, 35 bp, Artificial Sequence
  Synthetic oligonucleotide
gacccacacccacccggaacgccgactacgtcgag

SEQ ID NO: 133476 - DNA, 32 bp, Artificial Sequence
  Synthetic oligonucleotide
tcaccagtagactcatccccctgccgcccttg

SEQ ID NO: 133477 - DNA, 35 bp, Artificial Sequence
  Synthetic oligonucleotide
atgcacccggttgactctcctcacgttcttttgct

SEQ ID NO: 133478 - DNA, 35 bp, Artificial Sequence
  Synthetic oligonucleotide
tatcgcccccgtacttgaacttcgtccgctcctgt

SEQ ID NO: 133479 - DNA, 36 bp, Artificial Sequence
  Synthetic oligonucleotide
gcatggtgggatagggtacgggggtacggggataaa

SEQ ID NO: 133480 - DNA, 35 bp, Artificial Sequence
  Synthetic oligonucleotide
ttcggacacttgccgcttatatcttcgcccgcaca

SEQ ID NO: 133481 - DNA, 36 bp, Artificial Sequence
  Synthetic oligonucleotide
gtgcaaggtctatctcgccccatcgctcattttgca

SEQ ID NO: 133482 - DNA, 35 bp, Artificial Sequence
  Synthetic oligonucleotide
aacttgcccgtcccccatttgagtctttcccgtca

SEQ ID NO: 133483 - DNA, 38 bp, Artificial Sequence
  Synthetic oligonucleotide
agaccccagcctccgccgccgtactccgaaaacactga

SEQ ID NO: 133484 - DNA, 37 bp, Artificial Sequence
  Synthetic oligonucleotide
tgctctatcgccactgcccgccccacagcctgtttga

SEQ ID NO: 133485 - DNA, 36 bp, Artificial Sequence
  Synthetic oligonucleotide
agggaagggtgggccgggaccggggggagttatgta

SEQ ID NO: 133486 - DNA, 35 bp, Artificial Sequence
  Synthetic oligonucleotide
acacgacccccagcccccggcctacggacacacac

SEQ ID NO: 133487 - DNA, 35 bp, Artificial Sequence
  Synthetic oligonucleotide
ggatgacgcagccattcgttgctttcacacaccac

SEQ ID NO: 133488 - DNA, 35 bp, Artificial Sequence
  Synthetic oligonucleotide
atctcttgccccctcgtgtatacttctaccgcccc

SEQ ID NO: 133489 - DNA, 35 bp, Artificial Sequence
  Synthetic oligonucleotide
gcttgcctccgccctttaatgcgtaagttttcgcc

SEQ ID NO: 133490 - DNA, 35 bp, Artificial Sequence
  Synthetic oligonucleotide
tcaccctcccatgatcgcatagtctgccccttgcc

SEQ ID NO: 133491 - DNA, 35 bp, Artificial Sequence
  Synthetic oligonucleotide
gagacccctccgccgctaccaatcactgatccatc

SEQ ID NO: 133492 - DNA, 35 bp, Artificial Sequence
  Synthetic oligonucleotide
tatggtcctgcgcaccaacgttacccggtcctgtc

SEQ ID NO: 133493 - DNA, 35 bp, Artificial Sequence
  Synthetic oligonucleotide
atcatccgcccgcccttggcgcagcccgctacccg

SEQ ID NO: 133494 - DNA, 35 bp, Artificial Sequence
  Synthetic oligonucleotide
gaccgcctgccacacatcttccatactcccctccg

SEQ ID NO: 133495 - DNA, 35 bp, Artificial Sequence
  Synthetic oligonucleotide
ttgtccactcctcctggcaggttttccgcaccctg

SEQ ID NO: 133496 - DNA, 35 bp, Artificial Sequence
  Synthetic oligonucleotide
gtgtcacaacgtcccatttattactgtcgcctctg

SEQ ID NO: 133497 - DNA, 35 bp, Artificial Sequence
  Synthetic oligonucleotide
tgtgtctgtgactctctgttgccgccgtactatat

SEQ ID NO: 133498 - DNA, 35 bp, Artificial Sequence
  Synthetic oligonucleotide
agactaagcccgtcccgttgccttttttacaccct

SEQ ID NO: 133499 - DNA, 35 bp, Artificial Sequence
  Synthetic oligonucleotide
tcagtcatcagccggccctatacaattaccgtcct

SEQ ID NO: 133500 - DNA, 35 bp, Artificial Sequence
  Synthetic oligonucleotide
tgtacaccctccgctttaacatctctgattccagt

SEQ ID NO: 133501 - DNA, 35 bp, Artificial Sequence
  Synthetic oligonucleotide
ttccaccccgacagcgcaccacgatcctcttatgt

SEQ ID NO: 133502 - DNA, 35 bp, Artificial Sequence
  Synthetic oligonucleotide
gacctaaccgccacctcgcccaaactgggtcctgt

SEQ ID NO: 133503 - DNA, 35 bp, Artificial Sequence
  Synthetic oligonucleotide
gatgcggcctctcacgaacgccccttgacgctctt

SEQ ID NO: 133504 - DNA, 35 bp, Artificial Sequence
  Synthetic oligonucleotide
gagtccccggccctttatgcctacatggaaccttt

SEQ ID NO: 133505 - DNA, 35 bp, Artificial Sequence
  Synthetic oligonucleotide
ttcgcacctcggtatactgtccccggccccaacaa

SEQ ID NO: 133506 - DNA, 36 bp, Artificial Sequence
  Synthetic oligonucleotide
tcattccgcaccacccgctgcgttgcaattttgcaa

SEQ ID NO: 133507 - DNA, 36 bp, Artificial Sequence
  Synthetic oligonucleotide
gctgctacggcacctcgatttctgcaccatcttcaa

SEQ ID NO: 133508 - DNA, 36 bp, Artificial Sequence
  Synthetic oligonucleotide
tacctgcctggggggggtaaaatgctggggagggaa

SEQ ID NO: 133509 - DNA, 36 bp, Artificial Sequence
  Synthetic oligonucleotide
tgccaccatccactctatccagagacaactccctca

SEQ ID NO: 133510 - DNA, 36 bp, Artificial Sequence
  Synthetic oligonucleotide
gtgaccatcatccattctgctctcggaaccagttca

SEQ ID NO: 133511 - DNA, 37 bp, Artificial Sequence
  Synthetic oligonucleotide
ggggcatgggggaggcgaaacgggagggcgagcaaga

SEQ ID NO: 133512 - DNA, 36 bp, Artificial Sequence
  Synthetic oligonucleotide
gacaagccacttttgttactccacttcccgacccga

SEQ ID NO: 133513 - DNA, 37 bp, Artificial Sequence
  Synthetic oligonucleotide
gacagggtatgggagggaaggaatcataaagagggga

SEQ ID NO: 133514 - DNA, 38 bp, Artificial Sequence
  Synthetic oligonucleotide
tagggcagtacgaaagggcgggcgatagaagggggtga

SEQ ID NO: 133515 - DNA, 35 bp, Artificial Sequence
  Synthetic oligonucleotide
aatagacgcgggaagatcgggaaggagggaaggta

SEQ ID NO: 133516 - DNA, 35 bp, Artificial Sequence
  Synthetic oligonucleotide
tataccaccaactgttcgtgtccctgctcccctta

SEQ ID NO: 133517 - DNA, 36 bp, Artificial Sequence
  Synthetic oligonucleotide
tacgacttgctccaccctgtcatgtccatatcttta

SEQ ID NO: 133518 - DNA, 35 bp, Artificial Sequence
  Synthetic oligonucleotide
accagctgtacgccctgattctcgtgctactccac

SEQ ID NO: 133519 - DNA, 35 bp, Artificial Sequence
  Synthetic oligonucleotide
tagatacccccctgaatggctttttgtaacgctcc

SEQ ID NO: 133520 - DNA, 35 bp, Artificial Sequence
  Synthetic oligonucleotide
aatgtacgcgacgtttccgccgttttttgttctcc

SEQ ID NO: 133521 - DNA, 35 bp, Artificial Sequence
  Synthetic oligonucleotide
atgcctcccccccggatagactgtcccgattgtcc

SEQ ID NO: 133522 - DNA, 35 bp, Artificial Sequence
  Synthetic oligonucleotide
tgagattcatgccggtatccgtgtcaccctctcgc

SEQ ID NO: 133523 - DNA, 35 bp, Artificial Sequence
  Synthetic oligonucleotide
acaaggatgggcgggagggagagtgggcgtgcttg

SEQ ID NO: 133524 - DNA, 35 bp, Artificial Sequence
  Synthetic oligonucleotide
gtctcgccgcctcgtccccttccgcgcgatcaaat

SEQ ID NO: 133525 - DNA, 35 bp, Artificial Sequence
  Synthetic oligonucleotide
actacacgcccgctaagttcatttttggcccccct

SEQ ID NO: 133526 - DNA, 35 bp, Artificial Sequence
  Synthetic oligonucleotide
tgtggagcgcaacatcctatagtcactttccgcct

SEQ ID NO: 133527 - DNA, 35 bp, Artificial Sequence
  Synthetic oligonucleotide
tcaacgatcatcatggtttctctctccgacccgct

SEQ ID NO: 133528 - DNA, 35 bp, Artificial Sequence
  Synthetic oligonucleotide
tagctgccaccacccgactcgccccgtgtacttgt

SEQ ID NO: 133529 - DNA, 36 bp, Artificial Sequence
  Synthetic oligonucleotide
agtggggataggacaccagggaaataggggcgaaca

SEQ ID NO: 133530 - DNA, 35 bp, Artificial Sequence
  Synthetic oligonucleotide
tgccaactcgcattctggactcttccgccctacca

SEQ ID NO: 133531 - DNA, 35 bp, Artificial Sequence
  Synthetic oligonucleotide
gaggtgccaagggtggaaaaggcagggggaaagca

SEQ ID NO: 133532 - DNA, 36 bp, Artificial Sequence
  Synthetic oligonucleotide
aatccacctcacccgcgcaccaggtctcctaggtca

SEQ ID NO: 133533 - DNA, 36 bp, Artificial Sequence
  Synthetic oligonucleotide
gcatgggtaggagggcttcgagggggatgggccaga

SEQ ID NO: 133534 - DNA, 37 bp, Artificial Sequence
  Synthetic oligonucleotide
aacacccctcggtgtttcctgttccctcctgtaccga

SEQ ID NO: 133535 - DNA, 38 bp, Artificial Sequence
  Synthetic oligonucleotide
ttcgccgtctacagccgtgccctttgtgcctcctccga

SEQ ID NO: 133536 - DNA, 38 bp, Artificial Sequence
  Synthetic oligonucleotide
tgagggcggatggaggggggtggatttggacggtatga

SEQ ID NO: 133537 - DNA, 37 bp, Artificial Sequence
  Synthetic oligonucleotide
ttccgcccccccctcctgacagctcactagttgttga

SEQ ID NO: 133538 - DNA, 35 bp, Artificial Sequence
  Synthetic oligonucleotide
ttacgcccaacaacggtatccgcgcgattttcaac

SEQ ID NO: 133539 - DNA, 35 bp, Artificial Sequence
  Synthetic oligonucleotide
gctaagtgtcggcccgtactcacacgcccttgccc

SEQ ID NO: 133540 - DNA, 35 bp, Artificial Sequence
  Synthetic oligonucleotide
tgaatccgtaccagagagtgccatcccgcccttcc

SEQ ID NO: 133541 - DNA, 35 bp, Artificial Sequence
  Synthetic oligonucleotide
tgggaccgcccctcgtagtaaccccctcttcccgc

SEQ ID NO: 133542 - DNA, 35 bp, Artificial Sequence
  Synthetic oligonucleotide
accagtcgtgtgtcgtgcttgtccttccttttcgc

SEQ ID NO: 133543 - DNA, 35 bp, Artificial Sequence
  Synthetic oligonucleotide
tgacgcaagtatccggtaacgtttgtcctccctgc

SEQ ID NO: 133544 - DNA, 35 bp, Artificial Sequence
  Synthetic oligonucleotide
tctgaacgcggtggtctttgctgccgttttccctc

SEQ ID NO: 133545 - DNA, 35 bp, Artificial Sequence
  Synthetic oligonucleotide
acccggcctctctacagttgctcgccctctctctc

SEQ ID NO: 133546 - DNA, 35 bp, Artificial Sequence
  Synthetic oligonucleotide
gtgctagctttgcccccgatttgccctctgctgtc

SEQ ID NO: 133547 - DNA, 35 bp, Artificial Sequence
  Synthetic oligonucleotide
gccataccggtccactcttccacttgactgccttc

SEQ ID NO: 133548 - DNA, 35 bp, Artificial Sequence
  Synthetic oligonucleotide
acgagccactgatcttacccattttcaccatcccg

SEQ ID NO: 133549 - DNA, 35 bp, Artificial Sequence
  Synthetic oligonucleotide
aagtgacgggataggtgactcgagggaagtaacgg

SEQ ID NO: 133550 - DNA, 35 bp, Artificial Sequence
  Synthetic oligonucleotide
gttacccctcgagtgcaatcaccttcacccacatg

SEQ ID NO: 133551 - DNA, 35 bp, Artificial Sequence
  Synthetic oligonucleotide
ggtagacgcggttcgcatcctctcgctccttcctg

SEQ ID NO: 133552 - DNA, 35 bp, Artificial Sequence
  Synthetic oligonucleotide
gcaccggccccgctccctgtctctgtccctttctg

SEQ ID NO: 133553 - DNA, 35 bp, Artificial Sequence
  Synthetic oligonucleotide
acctgcgcacctgcccgctccagactgctaacaat

SEQ ID NO: 133554 - DNA, 35 bp, Artificial Sequence
  Synthetic oligonucleotide
gtcacgtaagtatagagggggggtgcggtgggaat

SEQ ID NO: 133555 - DNA, 35 bp, Artificial Sequence
  Synthetic oligonucleotide
atcgaagcggcaaaaccaccgttcctccgcccact

SEQ ID NO: 133556 - DNA, 35 bp, Artificial Sequence
  Synthetic oligonucleotide
tacatccccgcttgccaacaccgtgacggtgcaca

SEQ ID NO: 133557 - DNA, 36 bp, Artificial Sequence
  Synthetic oligonucleotide
gtgagcgcttgttcccccggtccagctttccttcca

SEQ ID NO: 133558 - DNA, 37 bp, Artificial Sequence
  Synthetic oligonucleotide
acagcctcgccctattcctacgcgcctcccgcctaga

SEQ ID NO: 133559 - DNA, 37 bp, Artificial Sequence
  Synthetic oligonucleotide
acgtgggagggggaggggggaaagcgccgggtgtaga

SEQ ID NO: 133560 - DNA, 36 bp, Artificial Sequence
  Synthetic oligonucleotide
aatgcccgcatacatctttcgccgccacatctcgta

SEQ ID NO: 133561 - DNA, 35 bp, Artificial Sequence
  Synthetic oligonucleotide
tccccatgccttccgcagcgatcgatactctcgta

SEQ ID NO: 133562 - DNA, 36 bp, Artificial Sequence
  Synthetic oligonucleotide
gacaatccacctgcgcactctcgcgtcccgccctta

SEQ ID NO: 133563 - DNA, 35 bp, Artificial Sequence
  Synthetic oligonucleotide
ttgttcacgatagtcgccgccgttactcgctcccc

SEQ ID NO: 133564 - DNA, 35 bp, Artificial Sequence
  Synthetic oligonucleotide
gcacacgatgtgtgtacccgttctcgtctctcgcc

SEQ ID NO: 133565 - DNA, 35 bp, Artificial Sequence
  Synthetic oligonucleotide
accagtcgcctcccgtcgggaaaccctcacctgcc

SEQ ID NO: 133566 - DNA, 35 bp, Artificial Sequence
  Synthetic oligonucleotide
gatacgcggcgctccgtcctccgcttaatggttcc

SEQ ID NO: 133567 - DNA, 35 bp, Artificial Sequence
  Synthetic oligonucleotide
tctacccctgtccagggctcactgcctattcccgc

SEQ ID NO: 133568 - DNA, 35 bp, Artificial Sequence
  Synthetic oligonucleotide
ggccccccgcgtgtaccagcgcacctcccttaatc

SEQ ID NO: 133569 - DNA, 35 bp, Artificial Sequence
  Synthetic oligonucleotide
tgctggccacatcccgctgactcgtgcactctatc

SEQ ID NO: 133570 - DNA, 35 bp, Artificial Sequence
  Synthetic oligonucleotide
tgtgactgtgatgctttgcgcccttatttgtcctc

SEQ ID NO: 133571 - DNA, 35 bp, Artificial Sequence
  Synthetic oligonucleotide
gtgtgtgcccaacccgctctcgtgctaccgctctc

SEQ ID NO: 133572 - DNA, 35 bp, Artificial Sequence
  Synthetic oligonucleotide
gagagcgtatcgggggaaggggaaggttatggtag

SEQ ID NO: 133573 - DNA, 35 bp, Artificial Sequence
  Synthetic oligonucleotide
gtctcgtccccagtcacccgccgtcacatataccg

SEQ ID NO: 133574 - DNA, 37 bp, Artificial Sequence
  Synthetic oligonucleotide
gggtggtgagggagggagcagaggtttgcggtgaatg

SEQ ID NO: 133575 - DNA, 35 bp, Artificial Sequence
  Synthetic oligonucleotide
tgactccgcggactagcgcctccgacccttacttg

SEQ ID NO: 133576 - DNA, 35 bp, Artificial Sequence
  Synthetic oligonucleotide
atccgtgtgccacccgcttgtcttgtccctaccat

SEQ ID NO: 133577 - DNA, 35 bp, Artificial Sequence
  Synthetic oligonucleotide
gccatctgcgtcttgcgccaccactctctcgccat

SEQ ID NO: 133578 - DNA, 35 bp, Artificial Sequence
  Synthetic oligonucleotide
tgaaaggccactctcctcagatcctgcttcgccct

SEQ ID NO: 133579 - DNA, 35 bp, Artificial Sequence
  Synthetic oligonucleotide
gcgcgccgtaatcgccgttgacccacttttgccct

SEQ ID NO: 133580 - DNA, 35 bp, Artificial Sequence
  Synthetic oligonucleotide
aacagacgcacctctccatgccctgaatcaagcct

SEQ ID NO: 133581 - DNA, 35 bp, Artificial Sequence
  Synthetic oligonucleotide
tcctgctcccgtgccatttgaattaaatccttcct

SEQ ID NO: 133582 - DNA, 35 bp, Artificial Sequence
  Synthetic oligonucleotide
gtaggcccaccacgcacgttatttcaccacactgt

SEQ ID NO: 133583 - DNA, 35 bp, Artificial Sequence
  Synthetic oligonucleotide
ataggggggtcggagggaggggggcaagtaggatt

SEQ ID NO: 133584 - DNA, 35 bp, Artificial Sequence
  Synthetic oligonucleotide
tcctcgtagaccgtcgtaccagtcgccttaccttt

SEQ ID NO: 133585 - DNA, 36 bp, Artificial Sequence
  Synthetic oligonucleotide
gtgatgcacgattgatgccgccgtccttgttcccca

SEQ ID NO: 133586 - DNA, 36 bp, Artificial Sequence
  Synthetic oligonucleotide
tgagcggacggccaaacatatcttctccactgctca

SEQ ID NO: 133587 - DNA, 36 bp, Artificial Sequence
  Synthetic oligonucleotide
gatcgcccgctccactgcgaattccgttattgttca

SEQ ID NO: 133588 - DNA, 37 bp, Artificial Sequence
  Synthetic oligonucleotide
gaaggagtggggagggattatgcatggaaaacgggga

SEQ ID NO: 133589 - DNA, 37 bp, Artificial Sequence
  Synthetic oligonucleotide
gaccgggggagaggagaaaaagggtggggattgggga

SEQ ID NO: 133590 - DNA, 38 bp, Artificial Sequence
  Synthetic oligonucleotide
tgaatggagggaggtgaagggaaaaggtggacttatga

SEQ ID NO: 133591 - DNA, 38 bp, Artificial Sequence
  Synthetic oligonucleotide
tcacccccgcttttcgcctgcttatgacacactagtga

SEQ ID NO: 133592 - DNA, 36 bp, Artificial Sequence
  Synthetic oligonucleotide
aagcatgcacccgtatcgttttttccctgcctagta

SEQ ID NO: 133593 - DNA, 36 bp, Artificial Sequence
  Synthetic oligonucleotide
ttggtccgcgcttgtttcggtcctcccacccttgta

SEQ ID NO: 133594 - DNA, 36 bp, Artificial Sequence
  Synthetic oligonucleotide
gttgcattcattccgtcctgtccatgcctccactta

SEQ ID NO: 133595 - DNA, 36 bp, Artificial Sequence
  Synthetic oligonucleotide
ttagccacaccacattgcgttacttgctagctttta

SEQ ID NO: 133596 - DNA, 35 bp, Artificial Sequence
  Synthetic oligonucleotide
tgcaacctcacctttcgtccctccgtctgggacac

SEQ ID NO: 133597 - DNA, 35 bp, Artificial Sequence
  Synthetic oligonucleotide
atgcgcttacacgctcccactgcctccgttgacac

SEQ ID NO: 133598 - DNA, 35 bp, Artificial Sequence
  Synthetic oligonucleotide
tcacgtgctaggttttcgttctcgccgctccctac

SEQ ID NO: 133599 - DNA, 35 bp, Artificial Sequence
  Synthetic oligonucleotide
atcgcccgccttacccttctatactgtttttgacc

SEQ ID NO: 133600 - DNA, 35 bp, Artificial Sequence
  Synthetic oligonucleotide
gtctggccgctgcatgccattttcacgtttcgccc

SEQ ID NO: 133601 - DNA, 34 bp, Artificial Sequence
  Synthetic oligonucleotide
aacacctcctcccgtatcctgggaccccaggccc

SEQ ID NO: 133602 - DNA, 35 bp, Artificial Sequence
  Synthetic oligonucleotide
taacacgtgtcttgcatctggatcccctcgctccc

SEQ ID NO: 133603 - DNA, 35 bp, Artificial Sequence
  Synthetic oligonucleotide
accaccgctctgcctgctgcattgttctccttccc

SEQ ID NO: 133604 - DNA, 35 bp, Artificial Sequence
  Synthetic oligonucleotide
gcatccatgcgcgacccacctctcaactcactgtc

SEQ ID NO: 133605 - DNA, 35 bp, Artificial Sequence
  Synthetic oligonucleotide
accgccccccacgtgggtccaccttattaatcaat

SEQ ID NO: 133606 - DNA, 35 bp, Artificial Sequence
  Synthetic oligonucleotide
tacgacgcctctacgcatgcacccaggcccatcct

SEQ ID NO: 133607 - DNA, 35 bp, Artificial Sequence
  Synthetic oligonucleotide
gacgatcgtttcacacgcctgacccacctcttgct

SEQ ID NO: 133608 - DNA, 35 bp, Artificial Sequence
  Synthetic oligonucleotide
gagcaacgctgcccccgtctcggtccaactgttct

SEQ ID NO: 133609 - DNA, 35 bp, Artificial Sequence
  Synthetic oligonucleotide
gagagcgagcgattgtcaaccctccatccccccgt

SEQ ID NO: 133610 - DNA, 35 bp, Artificial Sequence
  Synthetic oligonucleotide
tatccgccgactggctctatcttcatcgcactaca

SEQ ID NO: 133611 - DNA, 36 bp, Artificial Sequence
  Synthetic oligonucleotide
gtcacacgtcacaattaatcggcctgcctcctgcca

SEQ ID NO: 133612 - DNA, 35 bp, Artificial Sequence
  Synthetic oligonucleotide
gcaccctcttctgcgttaacgcgctgtcgcttcca

SEQ ID NO: 133613 - DNA, 36 bp, Artificial Sequence
  Synthetic oligonucleotide
tgatccacctgtgcaattgactataccacgccatca

SEQ ID NO: 133614 - DNA, 37 bp, Artificial Sequence
  Synthetic oligonucleotide
tgaccttccaccctctctgtaacgctctgcttcgcga

SEQ ID NO: 133615 - DNA, 37 bp, Artificial Sequence
  Synthetic oligonucleotide
ccagaccgccgctctataccatgtcaccccccctgga

SEQ ID NO: 133616 - DNA, 38 bp, Artificial Sequence
  Synthetic oligonucleotide
aacgacgctttccctggttttaacgtaccatcccctga

SEQ ID NO: 133617 - DNA, 38 bp, Artificial Sequence
  Synthetic oligonucleotide
accgcacctctgtccctcgtgatcgccccctgccctga

SEQ ID NO: 133618 - DNA, 36 bp, Artificial Sequence
  Synthetic oligonucleotide
acatagcccgctgccgtctcgacctctctatcctga

SEQ ID NO: 133619 - DNA, 38 bp, Artificial Sequence
  Synthetic oligonucleotide
ttcgcgtcctctaaagccctgtccttctccgccgttga

SEQ ID NO: 133620 - DNA, 35 bp, Artificial Sequence
  Synthetic oligonucleotide
gccaaacccccgttgtcaactttcctgggccctta

SEQ ID NO: 133621 - DNA, 36 bp, Artificial Sequence
  Synthetic oligonucleotide
gtgcggccctggctctacatcacctcgccctgttta

SEQ ID NO: 133622 - DNA, 35 bp, Artificial Sequence
  Synthetic oligonucleotide
acccgccgatccttcgcgctttagacgacgctaac

SEQ ID NO: 133623 - DNA, 35 bp, Artificial Sequence
  Synthetic oligonucleotide
tagcatcgggtccgtgccatgcccatcctgttcac

SEQ ID NO: 133624 - DNA, 35 bp, Artificial Sequence
  Synthetic oligonucleotide
gtccctctcacgtttgccttagagcccaccgcacc

SEQ ID NO: 133625 - DNA, 35 bp, Artificial Sequence
  Synthetic oligonucleotide
tacagcagccaccatccctgatccccccggcgccc

SEQ ID NO: 133626 - DNA, 35 bp, Artificial Sequence
  Synthetic oligonucleotide
atgagcctcaacttcatgtctaactccacctgccc

SEQ ID NO: 133627 - DNA, 35 bp, Artificial Sequence
  Synthetic oligonucleotide
tcacattgtgcatccatacgcctggctttaactcc

SEQ ID NO: 133628 - DNA, 35 bp, Artificial Sequence
  Synthetic oligonucleotide
gccactggctggcctctcctctgtcccgcatacgc

SEQ ID NO: 133629 - DNA, 35 bp, Artificial Sequence
  Synthetic oligonucleotide
gggatccccattgtcgttcgcgcccacctgcaatc

SEQ ID NO: 133630 - DNA, 35 bp, Artificial Sequence
  Synthetic oligonucleotide
tcgccctcggcccccgttctcctgagttcctactc

SEQ ID NO: 133631 - DNA, 35 bp, Artificial Sequence
  Synthetic oligonucleotide
tcccgctcgcagcacatgccccttcagctctagtc

SEQ ID NO: 133632 - DNA, 35 bp, Artificial Sequence
  Synthetic oligonucleotide
gacgctgggacgaggcgtggagggatgatgggggg

SEQ ID NO: 133633 - DNA, 35 bp, Artificial Sequence
  Synthetic oligonucleotide
aagaacgagggagagggagctggggtgggacgctg

SEQ ID NO: 133634 - DNA, 35 bp, Artificial Sequence
  Synthetic oligonucleotide
gagccccatcccaccccgtgcgttttcgccatgat

SEQ ID NO: 133635 - DNA, 34 bp, Artificial Sequence
  Synthetic oligonucleotide
ttcccatccgcgacccgggttttgccttcctgtt

SEQ ID NO: 133636 - DNA, 36 bp, Artificial Sequence
  Synthetic oligonucleotide
atcgcgcgttagctgctttcatcgcctctgccctaa

SEQ ID NO: 133637 - DNA, 36 bp, Artificial Sequence
  Synthetic oligonucleotide
gtccaacacctcatgctttcccaccgtgattgaaca

SEQ ID NO: 133638 - DNA, 36 bp, Artificial Sequence
  Synthetic oligonucleotide
gtcgctgtcccattagtacttctcgcttcacctcca

SEQ ID NO: 133639 - DNA, 36 bp, Artificial Sequence
  Synthetic oligonucleotide
gctaactcggcactgtaccatcccaggcattcctca

SEQ ID NO: 133640 - DNA, 37 bp, Artificial Sequence
  Synthetic oligonucleotide
ttcacccctctagatccgctacacctcgttcgtagga

SEQ ID NO: 133641 - DNA, 37 bp, Artificial Sequence
  Synthetic oligonucleotide
gtacccgccccccaattattgtttctcccagtaggga

SEQ ID NO: 133642 - DNA, 37 bp, Artificial Sequence
  Synthetic oligonucleotide
ggagtcacgacgagggggcgggttagtgcaaggggga

SEQ ID NO: 133643 - DNA, 37 bp, Artificial Sequence
  Synthetic oligonucleotide
tgggggtgcggtcggggagggggaggggtcagagtga

SEQ ID NO: 133644 - DNA, 36 bp, Artificial Sequence
  Synthetic oligonucleotide
gccccgctcccgcccggtactctaggccctacttga

SEQ ID NO: 133645 - DNA, 35 bp, Artificial Sequence
  Synthetic oligonucleotide
agaccacctttagcgcacttcccccgttcccttga

SEQ ID NO: 133646 - DNA, 36 bp, Artificial Sequence
  Synthetic oligonucleotide
tccgaagcaacgcgccgcccgctccttccgttacta

SEQ ID NO: 133647 - DNA, 35 bp, Artificial Sequence
  Synthetic oligonucleotide
aagatcggccccctctgactttctttgcacttcac

SEQ ID NO: 133648 - DNA, 35 bp, Artificial Sequence
  Synthetic oligonucleotide
tcatgggtgggcggggtaaagggcaccacgctacc

SEQ ID NO: 133649 - DNA, 35 bp, Artificial Sequence
  Synthetic oligonucleotide
acctcccctcgaattaaggcccgcgcgccctcccc

SEQ ID NO: 133650 - DNA, 35 bp, Artificial Sequence
  Synthetic oligonucleotide
tgcggtggatcgcccacgtgtgtgccttccttccc

SEQ ID NO: 133651 - DNA, 35 bp, Artificial Sequence
  Synthetic oligonucleotide
gcaccgtttcgtcacactctttgccatgaatagcc

SEQ ID NO: 133652 - DNA, 35 bp, Artificial Sequence
  Synthetic oligonucleotide
accataatccgcagctggtttttccccggtcttcc

SEQ ID NO: 133653 - DNA, 35 bp, Artificial Sequence
  Synthetic oligonucleotide
gtcacgtacctcgttatcacctccgttaccctggc

SEQ ID NO: 133654 - DNA, 35 bp, Artificial Sequence
  Synthetic oligonucleotide
gcaccattcgcgagccgttcattatattcctctgc

SEQ ID NO: 133655 - DNA, 35 bp, Artificial Sequence
  Synthetic oligonucleotide
tcatgccttcccgcctaacgccacacctgtcaatc

SEQ ID NO: 133656 - DNA, 35 bp, Artificial Sequence
  Synthetic oligonucleotide
tgtacctccgagtgctccctgccgcaaaaccactc

SEQ ID NO: 133657 - DNA, 35 bp, Artificial Sequence
  Synthetic oligonucleotide
gttccgtcctacatgccagccgttctatacatctc

SEQ ID NO: 133658 - DNA, 35 bp, Artificial Sequence
  Synthetic oligonucleotide
tgcgactcgccgcttacgatgtcgcgctacacttc

SEQ ID NO: 133659 - DNA, 35 bp, Artificial Sequence
  Synthetic oligonucleotide
atcaaactgcctctgcccgcataccaccctgtttg

SEQ ID NO: 133660 - DNA, 35 bp, Artificial Sequence
  Synthetic oligonucleotide
atcgcaacccgatcctgctcccctatcacattttg

SEQ ID NO: 133661 - DNA, 35 bp, Artificial Sequence
  Synthetic oligonucleotide
gatggccctctaatcatgtttagccaccatctcct

SEQ ID NO: 133662 - DNA, 35 bp, Artificial Sequence
  Synthetic oligonucleotide
aacccttgcctgcccctcgtctcgatcgaccccca

SEQ ID NO: 133663 - DNA, 36 bp, Artificial Sequence
  Synthetic oligonucleotide
ttaccccgttcgctcttttaccgtccgctttgccca

SEQ ID NO: 133664 - DNA, 36 bp, Artificial Sequence
  Synthetic oligonucleotide
ttgcgattcggtctctctttttcacctgctcctgca

SEQ ID NO: 133665 - DNA, 36 bp, Artificial Sequence
  Synthetic oligonucleotide
tgcctacgcctctcctcctttgctatcgatcgacga

SEQ ID NO: 133666 - DNA, 37 bp, Artificial Sequence
  Synthetic oligonucleotide
actgacaccgacatgggccctctccgccgccatccga

SEQ ID NO: 133667 - DNA, 37 bp, Artificial Sequence
  Synthetic oligonucleotide
gacttccgtcctcgtgttttctgccccacgcctccga

SEQ ID NO: 133668 - DNA, 37 bp, Artificial Sequence
  Synthetic oligonucleotide
tctccaccatcacccatgatcggacacctgttttcga

SEQ ID NO: 133669 - DNA, 38 bp, Artificial Sequence
  Synthetic oligonucleotide
tatgccacacctgcacccgttctcgtcccacgccctga

SEQ ID NO: 133670 - DNA, 38 bp, Artificial Sequence
  Synthetic oligonucleotide
gccatccgtccgcattttacttcgccctgtatcgctga

SEQ ID NO: 133671 - DNA, 38 bp, Artificial Sequence
  Synthetic oligonucleotide
gtttggtgaaaggatggaggtggggtggcggtgggtga

SEQ ID NO: 133672 - DNA, 35 bp, Artificial Sequence
  Synthetic oligonucleotide
gacactcgcgccgggtttggagagggagggcaata

SEQ ID NO: 133673 - DNA, 34 bp, Artificial Sequence
  Synthetic oligonucleotide
gatgcccgcctccccacacttgcttactatcata

SEQ ID NO: 133674 - DNA, 36 bp, Artificial Sequence
  Synthetic oligonucleotide
gacaacccaccccgtgtaatatgcccccctggcgta

SEQ ID NO: 133675 - DNA, 35 bp, Artificial Sequence
  Synthetic oligonucleotide
tacggactacctgcccttacgtcgtatcctcgtac

SEQ ID NO: 133676 - DNA, 35 bp, Artificial Sequence
  Synthetic oligonucleotide
tcccgccccgcctatcaacatttggaccttccacc

SEQ ID NO: 133677 - DNA, 35 bp, Artificial Sequence
  Synthetic oligonucleotide
agacactgcctgacttcccctagccatgacacgcc

SEQ ID NO: 133678 - DNA, 35 bp, Artificial Sequence
  Synthetic oligonucleotide
tacccttccgcattgcaataccacggtcacaccgc

SEQ ID NO: 133679 - DNA, 35 bp, Artificial Sequence
  Synthetic oligonucleotide
tccatgtccgcctggacattgacctcctggttatc

SEQ ID NO: 133680 - DNA, 35 bp, Artificial Sequence
  Synthetic oligonucleotide
gcatgcaacagcccagtctcccgcttcgtggcctc

SEQ ID NO: 133681 - DNA, 35 bp, Artificial Sequence
  Synthetic oligonucleotide
accttcagctctcccctggtcactcctcgtccgtc

SEQ ID NO: 133682 - DNA, 35 bp, Artificial Sequence
  Synthetic oligonucleotide
acactgcggcaaggcacagcggccctctctctttc

SEQ ID NO: 133683 - DNA, 35 bp, Artificial Sequence
  Synthetic oligonucleotide
tccagccccgcattggccgagattctccttcttcg

SEQ ID NO: 133684 - DNA, 35 bp, Artificial Sequence
  Synthetic oligonucleotide
tgctgggacgggaggaggcgaaaagggatttgggg

SEQ ID NO: 133685 - DNA, 35 bp, Artificial Sequence
  Synthetic oligonucleotide
ggggcacctccacctcttgcgctaggccttacact

SEQ ID NO: 133686 - DNA, 35 bp, Artificial Sequence
  Synthetic oligonucleotide
gcatacagcctaaccgcttcctgttcactgcccct

SEQ ID NO: 133687 - DNA, 34 bp, Artificial Sequence
  Synthetic oligonucleotide
tagccccacccccctccatccagaaccgtagcct

SEQ ID NO: 133688 - DNA, 35 bp, Artificial Sequence
  Synthetic oligonucleotide
tccaacggtccgtcgccggttgatcctcttgctct

SEQ ID NO: 133689 - DNA, 35 bp, Artificial Sequence
  Synthetic oligonucleotide
gtgttcgcatgcgtagattcctcagctccatctct

SEQ ID NO: 133690 - DNA, 35 bp, Artificial Sequence
  Synthetic oligonucleotide
gcacgataccataatgtgcacgtgtttctcctctt

SEQ ID NO: 133691 - DNA, 36 bp, Artificial Sequence
  Synthetic oligonucleotide
ccccggtcgccgtattctgttccctgtacccacgca

SEQ ID NO: 133692 - DNA, 36 bp, Artificial Sequence
  Synthetic oligonucleotide
ggttagcccaactgttcgcatctgtgccgtccctca

SEQ ID NO: 133693 - DNA, 35 bp, Artificial Sequence
  Synthetic oligonucleotide
accccgccccctacactgatccatgatgtatgtca

SEQ ID NO: 133694 - DNA, 37 bp, Artificial Sequence
  Synthetic oligonucleotide
acaccccaccgcctcgtatagtcctctcttagaacga

SEQ ID NO: 133695 - DNA, 37 bp, Artificial Sequence
  Synthetic oligonucleotide
tggaatggaggaggtaggggttacggatgaaggcgga

SEQ ID NO: 133696 - DNA, 38 bp, Artificial Sequence
  Synthetic oligonucleotide
gtgggacgcgctgtaggggacgggagggcggagactga

SEQ ID NO: 133697 - DNA, 38 bp, Artificial Sequence
  Synthetic oligonucleotide
gttggggaggggttataggggacgtggggatggtctga

SEQ ID NO: 133698 - DNA, 38 bp, Artificial Sequence
  Synthetic oligonucleotide
ttgatcgccctcatcatcgcctttgatgccgcccttga

SEQ ID NO: 133699 - DNA, 36 bp, Artificial Sequence
  Synthetic oligonucleotide
acacctccgctcgtatttattttagttgcctcttga

SEQ ID NO: 133700 - DNA, 35 bp, Artificial Sequence
  Synthetic oligonucleotide
ggggcgggaaaggggccggtcagctaatgggggac

SEQ ID NO: 133701 - DNA, 35 bp, Artificial Sequence
  Synthetic oligonucleotide
ttcccacacctccggccttttttcacaggcttgac

SEQ ID NO: 133702 - DNA, 35 bp, Artificial Sequence
  Synthetic oligonucleotide
gcccccatgcgcataattttcccgctaagcatccc

SEQ ID NO: 133703 - DNA, 35 bp, Artificial Sequence
  Synthetic oligonucleotide
gcctacgacgccacacatattcggccctatctgcc

SEQ ID NO: 133704 - DNA, 35 bp, Artificial Sequence
  Synthetic oligonucleotide
gtcccgtcgcctgtatcgcctttcccttcgccatc

SEQ ID NO: 133705 - DNA, 35 bp, Artificial Sequence
  Synthetic oligonucleotide
atatcacctcccgccgctacgtgcagtattccctc

SEQ ID NO: 133706 - DNA, 35 bp, Artificial Sequence
  Synthetic oligonucleotide
gtcccgcaggacgccgtctccctcgctcgcatctc

SEQ ID NO: 133707 - DNA, 35 bp, Artificial Sequence
  Synthetic oligonucleotide
atcgtacaccgctttttgtcgagctacctaccttc

SEQ ID NO: 133708 - DNA, 35 bp, Artificial Sequence
  Synthetic oligonucleotide
tgcactggcgttcgtctcgattctgcttccctttc

SEQ ID NO: 133709 - DNA, 35 bp, Artificial Sequence
  Synthetic oligonucleotide
gagtagaccccactcccggcctgacccacgacccg

SEQ ID NO: 133710 - DNA, 35 bp, Artificial Sequence
  Synthetic oligonucleotide
gaaggtgtgggtggggcgtgacggcgcgtaaaggg

SEQ ID NO: 133711 - DNA, 35 bp, Artificial Sequence
  Synthetic oligonucleotide
aagtacagcgagaaagggtggtaggatgggtgggg

SEQ ID NO: 133712 - DNA, 34 bp, Artificial Sequence
  Synthetic oligonucleotide
aatacagcccggcgcagcctttccaccgcccctg

SEQ ID NO: 133713 - DNA, 35 bp, Artificial Sequence
  Synthetic oligonucleotide
agggcacgagccacgtgcgccgccctatacactct

SEQ ID NO: 133714 - DNA, 34 bp, Artificial Sequence
  Synthetic oligonucleotide
atcgcctgtccctatgcggtggcctggttcctct

SEQ ID NO: 133715 - DNA, 35 bp, Artificial Sequence
  Synthetic oligonucleotide
tcccgactcttctcccgttcctaagtgcctttatt

SEQ ID NO: 133716 - DNA, 35 bp, Artificial Sequence
  Synthetic oligonucleotide
tgcgccatcggttcttcgtttccttgcatcacctt

SEQ ID NO: 133717 - DNA, 35 bp, Artificial Sequence
  Synthetic oligonucleotide
acatccaacctctccatgggcatcatcaaaccttt

SEQ ID NO: 133718 - DNA, 36 bp, Artificial Sequence
  Synthetic oligonucleotide
gccccctccacctgatactcctccttgtgtttggca

SEQ ID NO: 133719 - DNA, 35 bp, Artificial Sequence
  Synthetic oligonucleotide
tgtacgatcgatctagtcggtttcctattccatca

SEQ ID NO: 133720 - DNA, 36 bp, Artificial Sequence
  Synthetic oligonucleotide
gcccccccctgccctccgtgttaggcgacgatccga

SEQ ID NO: 133721 - DNA, 37 bp, Artificial Sequence
  Synthetic oligonucleotide
gaacgagggggagacaaggcaggcggaaagtaggcga

SEQ ID NO: 133722 - DNA, 36 bp, Artificial Sequence
  Synthetic oligonucleotide
gctgagccggtgagggtggagggagggatgcttcga

SEQ ID NO: 133723 - DNA, 36 bp, Artificial Sequence
  Synthetic oligonucleotide
ggactggggacggcatgggtcggtgaggggggggga

SEQ ID NO: 133724 - DNA, 38 bp, Artificial Sequence
  Synthetic oligonucleotide
gaggggacagggaggggatggggacgctgataagctga

SEQ ID NO: 133725 - DNA, 35 bp, Artificial Sequence
  Synthetic oligonucleotide
gaactgcccctcttgcactcccaagtcgcctgtac

SEQ ID NO: 133726 - DNA, 35 bp, Artificial Sequence
  Synthetic oligonucleotide
gctgcgagcgctctgctcttgttcctactccgccc

SEQ ID NO: 133727 - DNA, 35 bp, Artificial Sequence
  Synthetic oligonucleotide
tatgacgccgcgtgcctcccgcttaatcacctgcc

SEQ ID NO: 133728 - DNA, 35 bp, Artificial Sequence
  Synthetic oligonucleotide
tcagccgtgcaccctacttccttcccttggctgcc

SEQ ID NO: 133729 - DNA, 35 bp, Artificial Sequence
  Synthetic oligonucleotide
tcgtcctcggtcccaatctgttgcgccactgttcc

SEQ ID NO: 133730 - DNA, 35 bp, Artificial Sequence
  Synthetic oligonucleotide
ccatcctacgcccatcgactcggtcctccattggc

SEQ ID NO: 133731 - DNA, 35 bp, Artificial Sequence
  Synthetic oligonucleotide
gtgcttgcctttggataccttttcgccacccttgc

SEQ ID NO: 133732 - DNA, 35 bp, Artificial Sequence
  Synthetic oligonucleotide
gtgccatgccgcctctcattgttacttggttgctc

SEQ ID NO: 133733 - DNA, 35 bp, Artificial Sequence
  Synthetic oligonucleotide
gaaccacgccctacccgtttttatcccttcctgtg

SEQ ID NO: 133734 - DNA, 35 bp, Artificial Sequence
  Synthetic oligonucleotide
acgccccactagctgcattccgtctttccctgttg

SEQ ID NO: 133735 - DNA, 35 bp, Artificial Sequence
  Synthetic oligonucleotide
gcccccctgtaacgaccctgcttaggctatggcct

SEQ ID NO: 133736 - DNA, 35 bp, Artificial Sequence
  Synthetic oligonucleotide
acgttagcgcacgagtacccccccccgtctgccaa

SEQ ID NO: 133737 - DNA, 36 bp, Artificial Sequence
  Synthetic oligonucleotide
agcacctacagctgccatgctcccctccacgccgaa

SEQ ID NO: 133738 - DNA, 36 bp, Artificial Sequence
  Synthetic oligonucleotide
ttgacacccccacatcatgttctccatgctttcgaa

SEQ ID NO: 133739 - DNA, 35 bp, Artificial Sequence
  Synthetic oligonucleotide
tcccggtctcaactgttccgtctctggctttcaca

SEQ ID NO: 133740 - DNA, 37 bp, Artificial Sequence
  Synthetic oligonucleotide
agcaggaggggtcgctggggggacgggcgaggaaaga

SEQ ID NO: 133741 - DNA, 37 bp, Artificial Sequence
  Synthetic oligonucleotide
actccaccactcctgaccgtacacatagtcctagaga

SEQ ID NO: 133742 - DNA, 37 bp, Artificial Sequence
  Synthetic oligonucleotide
aaacagccgcccactcctgcccactactgcccgtaga

SEQ ID NO: 133743 - DNA, 35 bp, Artificial Sequence
  Synthetic oligonucleotide
ggagacatataaggggtgggtgaggagggaaacga

SEQ ID NO: 133744 - DNA, 37 bp, Artificial Sequence
  Synthetic oligonucleotide
atgtgcatccccagccggccttacaaaaccacctcga

SEQ ID NO: 133745 - DNA, 37 bp, Artificial Sequence
  Synthetic oligonucleotide
gggtgtgggggggagggtagtgacaggattaaacgga

SEQ ID NO: 133746 - DNA, 35 bp, Artificial Sequence
  Synthetic oligonucleotide
atgcaccctcaccccttttcacctatacagccgga

SEQ ID NO: 133747 - DNA, 37 bp, Artificial Sequence
  Synthetic oligonucleotide
acccggtggatgggggttgggacggatgagtcgggga

SEQ ID NO: 133748 - DNA, 38 bp, Artificial Sequence
  Synthetic oligonucleotide
gatgtgtgggggtagaataacgggaagcggtggactga

SEQ ID NO: 133749 - DNA, 38 bp, Artificial Sequence
  Synthetic oligonucleotide
accacaccctgaaacatctagagtcctgctccccttga

SEQ ID NO: 133750 - DNA, 36 bp, Artificial Sequence
  Synthetic oligonucleotide
taagggtgggcggggcgatgggtaattaggtcgtta

SEQ ID NO: 133751 - DNA, 35 bp, Artificial Sequence
  Synthetic oligonucleotide
gacaccgtacctttcagtttactcctggcctgccc

SEQ ID NO: 133752 - DNA, 35 bp, Artificial Sequence
  Synthetic oligonucleotide
gcacgcacgcttagctatgatctctcgcgcatccc

SEQ ID NO: 133753 - DNA, 35 bp, Artificial Sequence
  Synthetic oligonucleotide
gcttcagacccgctgtccttccgtagtgttccgcc

SEQ ID NO: 133754 - DNA, 35 bp, Artificial Sequence
  Synthetic oligonucleotide
gcccattgccttcatctggtgctacgccactcgcc

SEQ ID NO: 133755 - DNA, 35 bp, Artificial Sequence
  Synthetic oligonucleotide
tgtgcgtcctgttgctccttaagaccccctcctgc

SEQ ID NO: 133756 - DNA, 35 bp, Artificial Sequence
  Synthetic oligonucleotide
tccgcgctccctgccggcacaccgtaaaacacctc

SEQ ID NO: 133757 - DNA, 35 bp, Artificial Sequence
  Synthetic oligonucleotide
gatagtgggactggagggtgaggggggggtacgag

SEQ ID NO: 133758 - DNA, 35 bp, Artificial Sequence
  Synthetic oligonucleotide
tagagccgcgacttgctccctgactcatctcctcg

SEQ ID NO: 133759 - DNA, 35 bp, Artificial Sequence
  Synthetic oligonucleotide
tctacgatccctccttccgcgcacatcaagcctgg

SEQ ID NO: 133760 - DNA, 35 bp, Artificial Sequence
  Synthetic oligonucleotide
tcatttcccctgcccttagaacgctctggtcctgg

SEQ ID NO: 133761 - DNA, 35 bp, Artificial Sequence
  Synthetic oligonucleotide
tgctgcccccagtccttcgagcgttccaatcccat

SEQ ID NO: 133762 - DNA, 35 bp, Artificial Sequence
  Synthetic oligonucleotide
accaacgaccggcaacagtaattcgggcccttcct

SEQ ID NO: 133763 - DNA, 35 bp, Artificial Sequence
  Synthetic oligonucleotide
ttgtaccaccgcccattacccgcacccgtagcgct

SEQ ID NO: 133764 - DNA, 35 bp, Artificial Sequence
  Synthetic oligonucleotide
gtgttctgctccgtagtttcttgtcatgtctccgt

SEQ ID NO: 133765 - DNA, 34 bp, Artificial Sequence
  Synthetic oligonucleotide
acgatcgttccactcaccccatgcgcccctctgt

SEQ ID NO: 133766 - DNA, 36 bp, Artificial Sequence
  Synthetic oligonucleotide
gtccgccccggcttatcgtattttccctcgttaaca

SEQ ID NO: 133767 - DNA, 36 bp, Artificial Sequence
  Synthetic oligonucleotide
aacaccacacatgcacttcgatcggcatatcctcca

SEQ ID NO: 133768 - DNA, 37 bp, Artificial Sequence
  Synthetic oligonucleotide
tccacccctacgctgcctaccgaaattcagtcatcga

SEQ ID NO: 133769 - DNA, 37 bp, Artificial Sequence
  Synthetic oligonucleotide
ttccgtcccgccgcccccttcgttacactcttaagga

SEQ ID NO: 133770 - DNA, 37 bp, Artificial Sequence
  Synthetic oligonucleotide
gacgcgcggtccagtgcctgtccatcgcccttcctga

SEQ ID NO: 133771 - DNA, 38 bp, Artificial Sequence
  Synthetic oligonucleotide
tagggcgggagagagggtacgggcaagggatcggctga

SEQ ID NO: 133772 - DNA, 37 bp, Artificial Sequence
  Synthetic oligonucleotide
aggaaaggacggagaagaaggaaagggggtacggtga

SEQ ID NO: 133773 - DNA, 38 bp, Artificial Sequence
  Synthetic oligonucleotide
acggacacgacctctcctgtccttaacgtgccctttga

SEQ ID NO: 133774 - DNA, 36 bp, Artificial Sequence
  Synthetic oligonucleotide
gacccaaccgcctgccctactcacccttagtgcgta

SEQ ID NO: 133775 - DNA, 36 bp, Artificial Sequence
  Synthetic oligonucleotide
ttagtagacggaggtagcggggggaggctgagggta

SEQ ID NO: 133776 - DNA, 36 bp, Artificial Sequence
  Synthetic oligonucleotide
ggggtggggtacggggagggttagtcgtgcagctta

SEQ ID NO: 133777 - DNA, 35 bp, Artificial Sequence
  Synthetic oligonucleotide
ggacacgcgccgactccaccggcctcgccccctac

SEQ ID NO: 133778 - DNA, 35 bp, Artificial Sequence
  Synthetic oligonucleotide
accatcgagcattacttccgtgactggcccccccc

SEQ ID NO: 133779 - DNA, 35 bp, Artificial Sequence
  Synthetic oligonucleotide
tccacccgactattattcggcacctttatatgccc

SEQ ID NO: 133780 - DNA, 35 bp, Artificial Sequence
  Synthetic oligonucleotide
gtacgccccaccggtccttcctttataaaacgcgc

SEQ ID NO: 133781 - DNA, 35 bp, Artificial Sequence
  Synthetic oligonucleotide
tggaccccccttacttgcccgttgctcgccgcatc

SEQ ID NO: 133782 - DNA, 35 bp, Artificial Sequence
  Synthetic oligonucleotide
tcaacaccgctccttacgctgtttattaaccaccg

SEQ ID NO: 133783 - DNA, 34 bp, Artificial Sequence
  Synthetic oligonucleotide
gactggaggggggggaggtgagggaagtcaagcg

SEQ ID NO: 133784 - DNA, 35 bp, Artificial Sequence
  Synthetic oligonucleotide
tcgccctctcattgtactatatgtctcttctcgcg

SEQ ID NO: 133785 - DNA, 35 bp, Artificial Sequence
  Synthetic oligonucleotide
gacccacccggctttcgcatacctggctttcttct

SEQ ID NO: 133786 - DNA, 35 bp, Artificial Sequence
  Synthetic oligonucleotide
gctgcaagctgacgcgcccgaccccaccctggttt

SEQ ID NO: 133787 - DNA, 35 bp, Artificial Sequence
  Synthetic oligonucleotide
tatcccccgctcacggttcatcgctggtactcaca

SEQ ID NO: 133788 - DNA, 35 bp, Artificial Sequence
  Synthetic oligonucleotide
accccctcctgtctcgtgcgataccattccgtaca

SEQ ID NO: 133789 - DNA, 35 bp, Artificial Sequence
  Synthetic oligonucleotide
tagtcccgcgcgcgatactgccccatcctatccca

SEQ ID NO: 133790 - DNA, 36 bp, Artificial Sequence
  Synthetic oligonucleotide
tttgcctccccgcttatggtatagccatctaccgca

SEQ ID NO: 133791 - DNA, 37 bp, Artificial Sequence
  Synthetic oligonucleotide
ttacccgcccccctgttggttatctcgtggcccgaga

SEQ ID NO: 133792 - DNA, 35 bp, Artificial Sequence
  Synthetic oligonucleotide
atcaacccggtcaaatgaaaactccgcccccccga

SEQ ID NO: 133793 - DNA, 37 bp, Artificial Sequence
  Synthetic oligonucleotide
tcccctccgctttcacctttgctacctgtcactagga

SEQ ID NO: 133794 - DNA, 37 bp, Artificial Sequence
  Synthetic oligonucleotide
gagggggacgaaagaggaccatgatgggagaagggga

SEQ ID NO: 133795 - DNA, 38 bp, Artificial Sequence
  Synthetic oligonucleotide
tccatacgccctattggttcctacgatcccacccgtga

SEQ ID NO: 133796 - DNA, 38 bp, Artificial Sequence
  Synthetic oligonucleotide
tcctcccccgaccctgcatgagctgtgcactattgtga

SEQ ID NO: 133797 - DNA, 37 bp, Artificial Sequence
  Synthetic oligonucleotide
atccctgccctgccgcctgtttacaatgctaacttga

SEQ ID NO: 133798 - DNA, 37 bp, Artificial Sequence
  Synthetic oligonucleotide
atccctctgaccctgtatgcggtgccacccattttga

SEQ ID NO: 133799 - DNA, 35 bp, Artificial Sequence
  Synthetic oligonucleotide
ttgggcccccagcctggctgtcccgctcattaccc

SEQ ID NO: 133800 - DNA, 34 bp, Artificial Sequence
  Synthetic oligonucleotide
agcacattgtgcctgtccctctccgtacccgagc

SEQ ID NO: 133801 - DNA, 35 bp, Artificial Sequence
  Synthetic oligonucleotide
ggagccactgctcctgttttcgcctcttaattcgc

SEQ ID NO: 133802 - DNA, 35 bp, Artificial Sequence
  Synthetic oligonucleotide
actcccgtttggctgctgtcctacctcgtcctgtc

SEQ ID NO: 133803 - DNA, 35 bp, Artificial Sequence
  Synthetic oligonucleotide
gaagccctgttttactttatccctcgccctacccg

SEQ ID NO: 133804 - DNA, 35 bp, Artificial Sequence
  Synthetic oligonucleotide
agccacctgaacagtgtccgctccacccaacgccg

SEQ ID NO: 133805 - DNA, 35 bp, Artificial Sequence
  Synthetic oligonucleotide
gaactccgtacttatccttccgccgctcacctgcg

SEQ ID NO: 133806 - DNA, 35 bp, Artificial Sequence
  Synthetic oligonucleotide
gtggcccgggtggtggaggggaaagtccggggtgg

SEQ ID NO: 133807 - DNA, 35 bp, Artificial Sequence
  Synthetic oligonucleotide
ggtggagcaatgggccgggaaagggaaggtgactg

SEQ ID NO: 133808 - DNA, 35 bp, Artificial Sequence
  Synthetic oligonucleotide
acatcgccctctacgctggtccctacgacctccct

SEQ ID NO: 133809 - DNA, 35 bp, Artificial Sequence
  Synthetic oligonucleotide
tcacatcttcaagcgtgccactccatctcgatcct

SEQ ID NO: 133810 - DNA, 36 bp, Artificial Sequence
  Synthetic oligonucleotide
gccccatcccacacctttgttcattcgggcaatgaa

SEQ ID NO: 133811 - DNA, 35 bp, Artificial Sequence
  Synthetic oligonucleotide
gaccacccgcgatttgtgctgctcccgctccttaa

SEQ ID NO: 133812 - DNA, 35 bp, Artificial Sequence
  Synthetic oligonucleotide
acgcgtcggaaagtatgcgcgccctcccctctcca

SEQ ID NO: 133813 - DNA, 35 bp, Artificial Sequence
  Synthetic oligonucleotide
tgtgcccctgtccgtgtacgcccctccgattttca

SEQ ID NO: 133814 - DNA, 37 bp, Artificial Sequence
  Synthetic oligonucleotide
aatgccccccgcaaatatataatccctcgtccgacga

SEQ ID NO: 133815 - DNA, 37 bp, Artificial Sequence
  Synthetic oligonucleotide
gccgctaaccactcgcttgtcgtcacgacctctccga

SEQ ID NO: 133816 - DNA, 37 bp, Artificial Sequence
  Synthetic oligonucleotide
ttggtaccgtaccgctcactcgcccttctgctcgcga

SEQ ID NO: 133817 - DNA, 37 bp, Artificial Sequence
  Synthetic oligonucleotide
tgcacgccccctagcaggtaccgcattccctcctcga

SEQ ID NO: 133818 - DNA, 37 bp, Artificial Sequence
  Synthetic oligonucleotide
tcacaccgctagccggttcttaacgcctttatctcga

SEQ ID NO: 133819 - DNA, 37 bp, Artificial Sequence
  Synthetic oligonucleotide
gcctcgccacatgtccccctccactcctaagcttcga

SEQ ID NO: 133820 - DNA, 37 bp, Artificial Sequence
  Synthetic oligonucleotide
ttgaggggcgggaatcgaactgcaggagtgggaggga

SEQ ID NO: 133821 - DNA, 37 bp, Artificial Sequence
  Synthetic oligonucleotide
tgatcggtgagggatgggtagggagggtccatactga

SEQ ID NO: 133822 - DNA, 38 bp, Artificial Sequence
  Synthetic oligonucleotide
tacccgcctacgagctttcgggaccacaccttctttga

SEQ ID NO: 133823 - DNA, 36 bp, Artificial Sequence
  Synthetic oligonucleotide
gaacggagaggtgtcgggggaaggtgaggaacgcta

SEQ ID NO: 133824 - DNA, 36 bp, Artificial Sequence
  Synthetic oligonucleotide
tcaccccgtccggtcccgcctttcgatctatcagta

SEQ ID NO: 133825 - DNA, 36 bp, Artificial Sequence
  Synthetic oligonucleotide
tcccagccgccgatgctcccccgtccgtttttctta

SEQ ID NO: 133826 - DNA, 35 bp, Artificial Sequence
  Synthetic oligonucleotide
tgcaatgtgctccccccgtactacctacgttacac

SEQ ID NO: 133827 - DNA, 35 bp, Artificial Sequence
  Synthetic oligonucleotide
tcccttcggccggtgcaccgtttcccccatcgccc

SEQ ID NO: 133828 - DNA, 35 bp, Artificial Sequence
  Synthetic oligonucleotide
actcacacacagccgtcataacctttccccgtgtc

SEQ ID NO: 133829 - DNA, 35 bp, Artificial Sequence
  Synthetic oligonucleotide
tctataggcacatagtatcgttccctggctctttc

SEQ ID NO: 133830 - DNA, 35 bp, Artificial Sequence
  Synthetic oligonucleotide
tactcgcttcgatacatgcctcatcacgcccttcg

SEQ ID NO: 133831 - DNA, 35 bp, Artificial Sequence
  Synthetic oligonucleotide
tcgccatcacgtccctgtcgctgctcgccgccctg

SEQ ID NO: 133832 - DNA, 35 bp, Artificial Sequence
  Synthetic oligonucleotide
accggacaggtaccatgcctttcatcccgcccgct

SEQ ID NO: 133833 - DNA, 35 bp, Artificial Sequence
  Synthetic oligonucleotide
tgagggcacgcatccggccaccgactcccgtttct

SEQ ID NO: 133834 - DNA, 35 bp, Artificial Sequence
  Synthetic oligonucleotide
ttgttaccccctgatctttatttatagcattgcca

SEQ ID NO: 133835 - DNA, 36 bp, Artificial Sequence
  Synthetic oligonucleotide
agcgaagagagagctggttgggtgggaggaggggga

SEQ ID NO: 133836 - DNA, 36 bp, Artificial Sequence
  Synthetic oligonucleotide
ttcgcacaccacgaagttatcccgccccgacctgga

SEQ ID NO: 133837 - DNA, 37 bp, Artificial Sequence
  Synthetic oligonucleotide
gaacgtgagaaggggcggaagaggggcgcgtggtgga

SEQ ID NO: 133838 - DNA, 36 bp, Artificial Sequence
  Synthetic oligonucleotide
taggggggagatggcagtatgagggaggatgaatga

SEQ ID NO: 133839 - DNA, 38 bp, Artificial Sequence
  Synthetic oligonucleotide
tactcgcccccgggtttcttactacagtctacacctga

SEQ ID NO: 133840 - DNA, 35 bp, Artificial Sequence
  Synthetic oligonucleotide
gtcaaaagggaggaagacagagaggaaggggggac

SEQ ID NO: 133841 - DNA, 35 bp, Artificial Sequence
  Synthetic oligonucleotide
tcgacgtcgatggcaatctgtttatggcccctccc

SEQ ID NO: 133842 - DNA, 35 bp, Artificial Sequence
  Synthetic oligonucleotide
tgcttgacacgcctttttattgatcgactcctgcc

SEQ ID NO: 133843 - DNA, 35 bp, Artificial Sequence
  Synthetic oligonucleotide
gagccaccaaccgcaccatctttaatgggtcttcc

SEQ ID NO: 133844 - DNA, 35 bp, Artificial Sequence
  Synthetic oligonucleotide
gagccgcggagcctgcacatccccatcgtcgttcc

SEQ ID NO: 133845 - DNA, 35 bp, Artificial Sequence
  Synthetic oligonucleotide
gagccaccttgtggctacttagaacattcatcctc

SEQ ID NO: 133846 - DNA, 35 bp, Artificial Sequence
  Synthetic oligonucleotide
tgaagagaggggtggaaaacggagtggatgtgaag

SEQ ID NO: 133847 - DNA, 35 bp, Artificial Sequence
  Synthetic oligonucleotide
gtaccttcaccgcacctcatgttacaccccccggg

SEQ ID NO: 133848 - DNA, 35 bp, Artificial Sequence
  Synthetic oligonucleotide
tcaaaccccggcgtccgacattccccctccgtcat

SEQ ID NO: 133849 - DNA, 35 bp, Artificial Sequence
  Synthetic oligonucleotide
tcacacacgactcctctgcccacttcagacttcat

SEQ ID NO: 133850 - DNA, 35 bp, Artificial Sequence
  Synthetic oligonucleotide
tcgccaatctcgaggtcaccttgccatgttccctt

SEQ ID NO: 133851 - DNA, 35 bp, Artificial Sequence
  Synthetic oligonucleotide
gcccgccacttacagtgctgctctcatcaatcctt

SEQ ID NO: 133852 - DNA, 35 bp, Artificial Sequence
  Synthetic oligonucleotide
tagccacgttcatgtccgcgttgcttctcccgctt

SEQ ID NO: 133853 - DNA, 35 bp, Artificial Sequence
  Synthetic oligonucleotide
accgccgccgtcctcttccgttacttcgtgatttt

SEQ ID NO: 133854 - DNA, 36 bp, Artificial Sequence
  Synthetic oligonucleotide
tctagggagtgggtggggtgaagtagataacgggaa

SEQ ID NO: 133855 - DNA, 32 bp, Artificial Sequence
  Synthetic oligonucleotide
tagtccccggtccgcccctctagtttgcgcca

SEQ ID NO: 133856 - DNA, 35 bp, Artificial Sequence
  Synthetic oligonucleotide
ttaacgcacgccctttgccccagcctggtctgcca

SEQ ID NO: 133857 - DNA, 36 bp, Artificial Sequence
  Synthetic oligonucleotide
gccaaccgacccacccgcaccttctccgcgctccga

SEQ ID NO: 133858 - DNA, 37 bp, Artificial Sequence
  Synthetic oligonucleotide
tgccatccttcatcccggaaccagccccatccttcga

SEQ ID NO: 133859 - DNA, 37 bp, Artificial Sequence
  Synthetic oligonucleotide
aaagacagaagacgagggtgaggggaggccgggatga

SEQ ID NO: 133860 - DNA, 38 bp, Artificial Sequence
  Synthetic oligonucleotide
ggagcgggaggagattgaggggcgggggggataactga

SEQ ID NO: 133861 - DNA, 32 bp, Artificial Sequence
  Synthetic oligonucleotide
aatccacttcccctctgcctgtactactctga

SEQ ID NO: 133862 - DNA, 38 bp, Artificial Sequence
  Synthetic oligonucleotide
atctgggggaggagggaagagaggggcaaagttggtga

SEQ ID NO: 133863 - DNA, 36 bp, Artificial Sequence
  Synthetic oligonucleotide
acgtgtcggtggggtcggtggacggggggggattga

SEQ ID NO: 133864 - DNA, 35 bp, Artificial Sequence
  Synthetic oligonucleotide
ttgtgctcaccgttgcgcccgtatctgtgttcgta

SEQ ID NO: 133865 - DNA, 35 bp, Artificial Sequence
  Synthetic oligonucleotide
ttgcccatctacctgttcgtaacgtgtttccttac

SEQ ID NO: 133866 - DNA, 35 bp, Artificial Sequence
  Synthetic oligonucleotide
ttatgcccgttccaccgctgatactctttttggcc

SEQ ID NO: 133867 - DNA, 34 bp, Artificial Sequence
  Synthetic oligonucleotide
ataaccctccgccgctcttaggacaaccccctcc

SEQ ID NO: 133868 - DNA, 35 bp, Artificial Sequence
  Synthetic oligonucleotide
gtgcaggccgccgacccctgtactgctcaaattcc

SEQ ID NO: 133869 - DNA, 35 bp, Artificial Sequence
  Synthetic oligonucleotide
taccacctacggaagacctcgcccggcactctttc

SEQ ID NO: 133870 - DNA, 35 bp, Artificial Sequence
  Synthetic oligonucleotide
gaatgaaggggggggatgaggggaggggtatatct

SEQ ID NO: 133871 - DNA, 35 bp, Artificial Sequence
  Synthetic oligonucleotide
ttgcttcacccggccaagcataacacccaccttct

SEQ ID NO: 133872 - DNA, 35 bp, Artificial Sequence
  Synthetic oligonucleotide
gacgacctcgccgcacgaccccgttgtcaaacctt

SEQ ID NO: 133873 - DNA, 35 bp, Artificial Sequence
  Synthetic oligonucleotide
agctaacgcccgttcgcatacccttccttttgcca

SEQ ID NO: 133874 - DNA, 36 bp, Artificial Sequence
  Synthetic oligonucleotide
tgacaacgtatgcctaccaccagcacttcctcgtca

SEQ ID NO: 133875 - DNA, 36 bp, Artificial Sequence
  Synthetic oligonucleotide
gtccgtgtccacgatgctcccgttcccgccatgtca

SEQ ID NO: 133876 - DNA, 36 bp, Artificial Sequence
  Synthetic oligonucleotide
tagccatctccatctgtcgttcttcgtctttgttca

SEQ ID NO: 133877 - DNA, 37 bp, Artificial Sequence
  Synthetic oligonucleotide
agctggtgaatgggagggggaaggggggactgcgcga

SEQ ID NO: 133878 - DNA, 37 bp, Artificial Sequence
  Synthetic oligonucleotide
tcctccgccccacctcgtactaatgaaaaccattcga

SEQ ID NO: 133879 - DNA, 37 bp, Artificial Sequence
  Synthetic oligonucleotide
ggtcgaccccgctgcttgcttcacctgtctcgttcga

SEQ ID NO: 133880 - DNA, 38 bp, Artificial Sequence
  Synthetic oligonucleotide
tgagggctgagggaggggggtggatttggacggtatga

SEQ ID NO: 133881 - DNA, 36 bp, Artificial Sequence
  Synthetic oligonucleotide
tcacaacgtccacaatctttctatcgacctctctga

SEQ ID NO: 133882 - DNA, 37 bp, Artificial Sequence
  Synthetic oligonucleotide
ttcgccatcccctgtgcgtgttcaataccttctttga

SEQ ID NO: 133883 - DNA, 37 bp, Artificial Sequence
  Synthetic oligonucleotide
gatgcgacggtcggactcgcatctgcccttcttttga

SEQ ID NO: 133884 - DNA, 36 bp, Artificial Sequence
  Synthetic oligonucleotide
aaggaaggcccctcacctgcttattgtacatcttta

SEQ ID NO: 133885 - DNA, 35 bp, Artificial Sequence
  Synthetic oligonucleotide
tctcgacgcgcttttcatcccccctaggcctgaac

SEQ ID NO: 133886 - DNA, 35 bp, Artificial Sequence
  Synthetic oligonucleotide
gccgttaactgcctcttacctgcatcctgagccac

SEQ ID NO: 133887 - DNA, 35 bp, Artificial Sequence
  Synthetic oligonucleotide
gtcgaagccctcgcctcattagttttcatactccc

SEQ ID NO: 133888 - DNA, 35 bp, Artificial Sequence
  Synthetic oligonucleotide
taagcatcctgtgaaccgcccacccatacctgtcc

SEQ ID NO: 133889 - DNA, 35 bp, Artificial Sequence
  Synthetic oligonucleotide
tcttccgatcccccgctgatataagccctttccgc

SEQ ID NO: 133890 - DNA, 35 bp, Artificial Sequence
  Synthetic oligonucleotide
tgtctgccccgtccagcattctattcccttttctc

SEQ ID NO: 133891 - DNA, 35 bp, Artificial Sequence
  Synthetic oligonucleotide
gaagagcatcgccgcccccccttgtccccaccgtc

SEQ ID NO: 133892 - DNA, 35 bp, Artificial Sequence
  Synthetic oligonucleotide
agtctagcatctccgaacgttttgccccccctgtc

SEQ ID NO: 133893 - DNA, 35 bp, Artificial Sequence
  Synthetic oligonucleotide
tgagactcagccttggccccaccccccagcttgtg

SEQ ID NO: 133894 - DNA, 33 bp, Artificial Sequence
  Synthetic oligonucleotide
atcactccgccttgttcatctatcatccgtaat

SEQ ID NO: 133895 - DNA, 35 bp, Artificial Sequence
  Synthetic oligonucleotide
gtgggacggggggggaagttttagagaacgggtat

SEQ ID NO: 133896 - DNA, 36 bp, Artificial Sequence
  Synthetic oligonucleotide
gtgggggggtcggggcgggactcaggagtaaataca

SEQ ID NO: 133897 - DNA, 33 bp, Artificial Sequence
  Synthetic oligonucleotide
aacgccttctcgcctcctattgccactcgtaca

SEQ ID NO: 133898 - DNA, 36 bp, Artificial Sequence
  Synthetic oligonucleotide
tcacattaacgcagccctgtcttccctccacaccca

SEQ ID NO: 133899 - DNA, 36 bp, Artificial Sequence
  Synthetic oligonucleotide
gacgtcactgcctaagtttcgttttaatcgcctcca

SEQ ID NO: 133900 - DNA, 35 bp, Artificial Sequence
  Synthetic oligonucleotide
acctcacatcatcggtttagatttcatctgctcca

SEQ ID NO: 133901 - DNA, 36 bp, Artificial Sequence
  Synthetic oligonucleotide
tttccgccggtcacctatggtctgctctcacttcca

SEQ ID NO: 133902 - DNA, 37 bp, Artificial Sequence
  Synthetic oligonucleotide
agagccatagaggagtaaatggtgcgggggggtgaga

SEQ ID NO: 133903 - DNA, 36 bp, Artificial Sequence
  Synthetic oligonucleotide
gtgcctcatgttcgccacacaatgccaccccttaga

SEQ ID NO: 133904 - DNA, 38 bp, Artificial Sequence
  Synthetic oligonucleotide
gagggacggcaacaaaggtataggaagggaggggatga

SEQ ID NO: 133905 - DNA, 36 bp, Artificial Sequence
  Synthetic oligonucleotide
gccgccacatgcccccgatgtcccattccgcgctga

SEQ ID NO: 133906 - DNA, 36 bp, Artificial Sequence
  Synthetic oligonucleotide
gccctgccacaccgccccatttgtgcaacaatggta

SEQ ID NO: 133907 - DNA, 35 bp, Artificial Sequence
  Synthetic oligonucleotide
gcatgccacgccaccagccatttttcctctaacac

SEQ ID NO: 133908 - DNA, 35 bp, Artificial Sequence
  Synthetic oligonucleotide
acgccccccacgcagttttcccgtaagtatctacc

SEQ ID NO: 133909 - DNA, 35 bp, Artificial Sequence
  Synthetic oligonucleotide
tcccgttgcatccgcgagccatcccccccctgccc

SEQ ID NO: 133910 - DNA, 35 bp, Artificial Sequence
  Synthetic oligonucleotide
taacgcaccaccgcctcccaatgacagtgctcggc

SEQ ID NO: 133911 - DNA, 35 bp, Artificial Sequence
  Synthetic oligonucleotide
gtgctgcccaatgccatccctcgtcccctaaagtc

SEQ ID NO: 133912 - DNA, 35 bp, Artificial Sequence
  Synthetic oligonucleotide
tcgcccctctgcacaatcgcgtctctttcacggtc

SEQ ID NO: 133913 - DNA, 35 bp, Artificial Sequence
  Synthetic oligonucleotide
ttccccacatcggtgagcttagacatcactgcttc

SEQ ID NO: 133914 - DNA, 35 bp, Artificial Sequence
  Synthetic oligonucleotide
gtgtcaccatccatcatgctgcttggtcgcatttc

SEQ ID NO: 133915 - DNA, 35 bp, Artificial Sequence
  Synthetic oligonucleotide
tgagagggtagaccgcgggtagagagggaaagtag

SEQ ID NO: 133916 - DNA, 35 bp, Artificial Sequence
  Synthetic oligonucleotide
actcacaccctccaagtccgccttaccgcccgtag

SEQ ID NO: 133917 - DNA, 35 bp, Artificial Sequence
  Synthetic oligonucleotide
tacggtggggggaggtgctggcgggagggtgtacg

SEQ ID NO: 133918 - DNA, 35 bp, Artificial Sequence
  Synthetic oligonucleotide
tgcacatcgcatagggatcggaagggttgggaggg

SEQ ID NO: 133919 - DNA, 35 bp, Artificial Sequence
  Synthetic oligonucleotide
acacaagcagtacttggggtatggggtggaggggg

SEQ ID NO: 133920 - DNA, 35 bp, Artificial Sequence
  Synthetic oligonucleotide
ggacaacttccgtcgctactgtccaccaatttact

SEQ ID NO: 133921 - DNA, 35 bp, Artificial Sequence
  Synthetic oligonucleotide
acacccaccttacgcgcgatcatacaggccttctt

SEQ ID NO: 133922 - DNA, 36 bp, Artificial Sequence
  Synthetic oligonucleotide
tacccgcccagtgccggcccttctcatcggtttcaa

SEQ ID NO: 133923 - DNA, 33 bp, Artificial Sequence
  Synthetic oligonucleotide
ccccacttccgttggctccttcccgcttcctaa

SEQ ID NO: 133924 - DNA, 35 bp, Artificial Sequence
  Synthetic oligonucleotide
acccacaacacgcccctcagctgcccctcgttaca

SEQ ID NO: 133925 - DNA, 36 bp, Artificial Sequence
  Synthetic oligonucleotide
aactaccgcatgtgccgagcctccacccgttcacca

SEQ ID NO: 133926 - DNA, 36 bp, Artificial Sequence
  Synthetic oligonucleotide
tacgatcagcccctcgtcgctccctagatacccgca

SEQ ID NO: 133927 - DNA, 35 bp, Artificial Sequence
  Synthetic oligonucleotide
taacttggtgggggaaggtggaaggaggagtggca

SEQ ID NO: 133928 - DNA, 35 bp, Artificial Sequence
  Synthetic oligonucleotide
gcctcgatcgcccctccgttcaagctcatttttca

SEQ ID NO: 133929 - DNA, 37 bp, Artificial Sequence
  Synthetic oligonucleotide
gcacccacgcctctccgtcattcgtttcatttgccga

SEQ ID NO: 133930 - DNA, 37 bp, Artificial Sequence
  Synthetic oligonucleotide
aggagacaaatggaggcttgggggggtggtggtcgga

SEQ ID NO: 133931 - DNA, 38 bp, Artificial Sequence
  Synthetic oligonucleotide
accccccctcccccctcactgtaagtcgtctggcttga

SEQ ID NO: 133932 - DNA, 37 bp, Artificial Sequence
  Synthetic oligonucleotide
tcgctatcgcctcctgctctctactctcccctgttga

SEQ ID NO: 133933 - DNA, 35 bp, Artificial Sequence
  Synthetic oligonucleotide
tacacacatcactatgctgcccatctaggccacta

SEQ ID NO: 133934 - DNA, 35 bp, Artificial Sequence
  Synthetic oligonucleotide
tcccaacccaaacgccctcttgcgacttttatgcc

SEQ ID NO: 133935 - DNA, 35 bp, Artificial Sequence
  Synthetic oligonucleotide
accccatgcccactgtttagtaatacctttctgtc

SEQ ID NO: 133936 - DNA, 35 bp, Artificial Sequence
  Synthetic oligonucleotide
actgctccgcgcccctccatccgtcgacctttgtc

SEQ ID NO: 133937 - DNA, 35 bp, Artificial Sequence
  Synthetic oligonucleotide
ataccgtcctacgccgttagtgcacctctcttttc

SEQ ID NO: 133938 - DNA, 35 bp, Artificial Sequence
  Synthetic oligonucleotide
tttcaccccctgccattatcgtgcacaccctggag

SEQ ID NO: 133939 - DNA, 35 bp, Artificial Sequence
  Synthetic oligonucleotide
atccactgacacaagtacactaaggcccactccat

SEQ ID NO: 133940 - DNA, 35 bp, Artificial Sequence
  Synthetic oligonucleotide
tgtacctccgcccccgagctttagacgaggctcat

SEQ ID NO: 133941 - DNA, 35 bp, Artificial Sequence
  Synthetic oligonucleotide
tgtgccgattgcccgcctcagctctacactccgct

SEQ ID NO: 133942 - DNA, 35 bp, Artificial Sequence
  Synthetic oligonucleotide
tccctgtcgctcccatcccgtttttccaacgcctt

SEQ ID NO: 133943 - DNA, 35 bp, Artificial Sequence
  Synthetic oligonucleotide
gggaagggtgaggaagggggactatagtaggagtt

SEQ ID NO: 133944 - DNA, 35 bp, Artificial Sequence
  Synthetic oligonucleotide
tacgccatccatcgagtttttcacgtacgttcttt

SEQ ID NO: 133945 - DNA, 36 bp, Artificial Sequence
  Synthetic oligonucleotide
gaagaggactgggcggaacaggaggggctatggcaa

SEQ ID NO: 133946 - DNA, 36 bp, Artificial Sequence
  Synthetic oligonucleotide
gccactctgaacgtcacgcctgctaatcccgcccca

SEQ ID NO: 133947 - DNA, 35 bp, Artificial Sequence
  Synthetic oligonucleotide
tgccgttactgccttccccctatatgttcgttgca

SEQ ID NO: 133948 - DNA, 36 bp, Artificial Sequence
  Synthetic oligonucleotide
tccatcctcctatacccggttgacaagtctcctaga

SEQ ID NO: 133949 - DNA, 36 bp, Artificial Sequence
  Synthetic oligonucleotide
acatgcaagaggggggaggaaaaggcggcaattgga

SEQ ID NO: 133950 - DNA, 38 bp, Artificial Sequence
  Synthetic oligonucleotide
gcacgacaggtgctaaatcactccctcccccctgatga

SEQ ID NO: 133951 - DNA, 38 bp, Artificial Sequence
  Synthetic oligonucleotide
ggtgagaggagtgtggcaggggggaggagggggagtga

SEQ ID NO: 133952 - DNA, 36 bp, Artificial Sequence
  Synthetic oligonucleotide
acagaccccgccttggttccccatacagtatagcta

SEQ ID NO: 133953 - DNA, 35 bp, Artificial Sequence
  Synthetic oligonucleotide
acctcatgccttattgtgcgcttctttacatccac

SEQ ID NO: 133954 - DNA, 35 bp, Artificial Sequence
  Synthetic oligonucleotide
tacatacgcctggtttcctaaatgcccccgcgccc

SEQ ID NO: 133955 - DNA, 35 bp, Artificial Sequence
  Synthetic oligonucleotide
ttcgaagcgcccaaaggtaaccactctcgtctccc

SEQ ID NO: 133956 - DNA, 34 bp, Artificial Sequence
  Synthetic oligonucleotide
ccgtggtccctctgttcggcatattccctgctcc

SEQ ID NO: 133957 - DNA, 35 bp, Artificial Sequence
  Synthetic oligonucleotide
gagtccgcgtgacgcctatctttcactaccgttcc

SEQ ID NO: 133958 - DNA, 35 bp, Artificial Sequence
  Synthetic oligonucleotide
ttttgccccaacacagaggtctacttccaccgtgc

SEQ ID NO: 133959 - DNA, 35 bp, Artificial Sequence
  Synthetic oligonucleotide
gtaccatctccgtgcgtgctgtagctactcccgtc

SEQ ID NO: 133960 - DNA, 35 bp, Artificial Sequence
  Synthetic oligonucleotide
gacggggagggaggggaggtaacatcgaaaatacg

SEQ ID NO: 133961 - DNA, 35 bp, Artificial Sequence
  Synthetic oligonucleotide
gtccacctttcttctggtacaccgcctatactccg

SEQ ID NO: 133962 - DNA, 35 bp, Artificial Sequence
  Synthetic oligonucleotide
tcacgttgcactccgcgcggctccctgttatctcg

SEQ ID NO: 133963 - DNA, 35 bp, Artificial Sequence
  Synthetic oligonucleotide
agagcaacccgcgcgccctcctatctcctcctagg

SEQ ID NO: 133964 - DNA, 35 bp, Artificial Sequence
  Synthetic oligonucleotide
aacgcacatggttgcgtgggctcttaccttctcat

SEQ ID NO: 133965 - DNA, 33 bp, Artificial Sequence
  Synthetic oligonucleotide
tgcctgctgggctccggattcctcccacctcct

SEQ ID NO: 133966 - DNA, 35 bp, Artificial Sequence
  Synthetic oligonucleotide
acccaccgactggtaaggcccacctgttttttcct

SEQ ID NO: 133967 - DNA, 35 bp, Artificial Sequence
  Synthetic oligonucleotide
tctcccccgggtccatttgctttcccaccaggtct

SEQ ID NO: 133968 - DNA, 35 bp, Artificial Sequence
  Synthetic oligonucleotide
atgatcagcctctgtctgcgcttatattgttcctt

SEQ ID NO: 133969 - DNA, 36 bp, Artificial Sequence
  Synthetic oligonucleotide
gagatcagggaactgaggacggaaagggcaatgaaa

SEQ ID NO: 133970 - DNA, 36 bp, Artificial Sequence
  Synthetic oligonucleotide
attgtggcggtcactctctatatcttgcacctcaca

SEQ ID NO: 133971 - DNA, 36 bp, Artificial Sequence
  Synthetic oligonucleotide
actctccgcggtcggtccatcgtactgccctctaca

SEQ ID NO: 133972 - DNA, 35 bp, Artificial Sequence
  Synthetic oligonucleotide
tacacccccccccgacgatccattgctggagacca

SEQ ID NO: 133973 - DNA, 37 bp, Artificial Sequence
  Synthetic oligonucleotide
tagccctcatcgcatatatcatggcccactcccgaga

SEQ ID NO: 133974 - DNA, 37 bp, Artificial Sequence
  Synthetic oligonucleotide
accgccccttgagtggtcctcgctgatcgccccccga

SEQ ID NO: 133975 - DNA, 35 bp, Artificial Sequence
  Synthetic oligonucleotide
tcacatccgatctgccaggaaaccctttctcccga

SEQ ID NO: 133976 - DNA, 37 bp, Artificial Sequence
  Synthetic oligonucleotide
tgagtcgcccctctctgtcaccatcgtcacttccgga

SEQ ID NO: 133977 - DNA, 38 bp, Artificial Sequence
  Synthetic oligonucleotide
gactgtgtcgccgccatcctcgcccgctatgaacttga

SEQ ID NO: 133978 - DNA, 35 bp, Artificial Sequence
  Synthetic oligonucleotide
acgagagccttccccgataccttcccccgtcctta

SEQ ID NO: 133979 - DNA, 35 bp, Artificial Sequence
  Synthetic oligonucleotide
tcgtgaccctcatagttcgccttgctcttcacgcc

SEQ ID NO: 133980 - DNA, 35 bp, Artificial Sequence
  Synthetic oligonucleotide
gtgtccctcccccctggttcaccaccgcacttagc

SEQ ID NO: 133981 - DNA, 34 bp, Artificial Sequence
  Synthetic oligonucleotide
ttatccctcgattgccggtctattgcctcgcctc

SEQ ID NO: 133982 - DNA, 35 bp, Artificial Sequence
  Synthetic oligonucleotide
tccgctccgaatatggtccgctcatgtctcccgtc

SEQ ID NO: 133983 - DNA, 35 bp, Artificial Sequence
  Synthetic oligonucleotide
ttgcgtccgctccgtcccgtcaagtacaaccgttc

SEQ ID NO: 133984 - DNA, 35 bp, Artificial Sequence
  Synthetic oligonucleotide
gttgaagggagggaggaactgaagggcaaaaatcg

SEQ ID NO: 133985 - DNA, 35 bp, Artificial Sequence
  Synthetic oligonucleotide
ttgccctgccttgcacgacttgttttttctgccat

SEQ ID NO: 133986 - DNA, 35 bp, Artificial Sequence
  Synthetic oligonucleotide
actaacacacccccgtcctctgccgccattcgcct

SEQ ID NO: 133987 - DNA, 35 bp, Artificial Sequence
  Synthetic oligonucleotide
ttacgccccggttcccggttccaccatcttgttgt

SEQ ID NO: 133988 - DNA, 35 bp, Artificial Sequence
  Synthetic oligonucleotide
atcctgccgaaacatgacgctgcacaccccgcctt

SEQ ID NO: 133989 - DNA, 35 bp, Artificial Sequence
  Synthetic oligonucleotide
tcttctccgccgtatctcttctcctgacgactctt

SEQ ID NO: 133990 - DNA, 36 bp, Artificial Sequence
  Synthetic oligonucleotide
aatgcgacgcgcctccctccgccgattgcctttgaa

SEQ ID NO: 133991 - DNA, 36 bp, Artificial Sequence
  Synthetic oligonucleotide
agcacacgctgtctttctgcaccctcctttagctga

SEQ ID NO: 133992 - DNA, 38 bp, Artificial Sequence
  Synthetic oligonucleotide
atcaccccatctgcacctgccttatgagttctcgttga

SEQ ID NO: 133993 - DNA, 36 bp, Artificial Sequence
  Synthetic oligonucleotide
tgtgcattcgtccttcgtttcgcttcgttccccgta

SEQ ID NO: 133994 - DNA, 35 bp, Artificial Sequence
  Synthetic oligonucleotide
gtgagtgggcggtgggaagggaaccgcaggtcaac

SEQ ID NO: 133995 - DNA, 35 bp, Artificial Sequence
  Synthetic oligonucleotide
tagtgcctatgccgtttacatcacacacctgccac

SEQ ID NO: 133996 - DNA, 35 bp, Artificial Sequence
  Synthetic oligonucleotide
ggaccagaatggtccctatcctcactgtgccttcc

SEQ ID NO: 133997 - DNA, 35 bp, Artificial Sequence
  Synthetic oligonucleotide
gttgggggagggggaagatggacgtacgcttcagc

SEQ ID NO: 133998 - DNA, 35 bp, Artificial Sequence
  Synthetic oligonucleotide
ggtgcgatcgcaccctgatcttctacaccttctgc

SEQ ID NO: 133999 - DNA, 35 bp, Artificial Sequence
  Synthetic oligonucleotide
tcgccctctctcaatctttctcgtgagtcactctc

SEQ ID NO: 134000 - DNA, 35 bp, Artificial Sequence
  Synthetic oligonucleotide
ttggtaaccgtctttgcgccccttatgtccatgtc

SEQ ID NO: 134001 - DNA, 35 bp, Artificial Sequence
  Synthetic oligonucleotide
gatcgagggacacgggggggactaaggtagctgag

SEQ ID NO: 134002 - DNA, 35 bp, Artificial Sequence
  Synthetic oligonucleotide
gttcatccgcacctccaccagcagattctcttacg

SEQ ID NO: 134003 - DNA, 35 bp, Artificial Sequence
  Synthetic oligonucleotide
tgtcgccattgccccctaagttaacctccaccccg

SEQ ID NO: 134004 - DNA, 34 bp, Artificial Sequence
  Synthetic oligonucleotide
actcgtccacggctcacctatttccgccccttcg

SEQ ID NO: 134005 - DNA, 36 bp, Artificial Sequence
  Synthetic oligonucleotide
tttgacattcgcctatcgtgcttcgctccaccatat

SEQ ID NO: 134006 - DNA, 34 bp, Artificial Sequence
  Synthetic oligonucleotide
acctcatgcgagcctttgtgcagcgctgccctct

SEQ ID NO: 134007 - DNA, 35 bp, Artificial Sequence
  Synthetic oligonucleotide
gctcctcccgatcgcactttgacgcacgctccctt

SEQ ID NO: 134008 - DNA, 35 bp, Artificial Sequence
  Synthetic oligonucleotide
gtcaccaccgccgatgttcttccctagttattctt

SEQ ID NO: 134009 - DNA, 35 bp, Artificial Sequence
  Synthetic oligonucleotide
tcctccactccaccgcgtacaactggctgattttt

SEQ ID NO: 134010 - DNA, 36 bp, Artificial Sequence
  Synthetic oligonucleotide
ttgcaacgcccttatcgtccaggtagcccccacaca

SEQ ID NO: 134011 - DNA, 35 bp, Artificial Sequence
  Synthetic oligonucleotide
gccacctctcaccttgtcctggtttccctttatca

SEQ ID NO: 134012 - DNA, 36 bp, Artificial Sequence
  Synthetic oligonucleotide
gaaggtggagtgggggtttgggagcatgggtgttca

SEQ ID NO: 134013 - DNA, 37 bp, Artificial Sequence
  Synthetic oligonucleotide
gagcaaaaggggaagggtgggtgagtgaggaagtaga

SEQ ID NO: 134014 - DNA, 37 bp, Artificial Sequence
  Synthetic oligonucleotide
gacgcacttatctgacaaccgcaccgccgcccttcga

SEQ ID NO: 134015 - DNA, 37 bp, Artificial Sequence
  Synthetic oligonucleotide
tggtgagagaggggtaagtattgagggcggggaggga

SEQ ID NO: 134016 - DNA, 37 bp, Artificial Sequence
  Synthetic oligonucleotide
ttatgggggaacagtattgggaggggtgttacgggga

SEQ ID NO: 134017 - DNA, 37 bp, Artificial Sequence
  Synthetic oligonucleotide
agcttacggaggaggttgggggcaaggtgtgggtgga

SEQ ID NO: 134018 - DNA, 38 bp, Artificial Sequence
  Synthetic oligonucleotide
acggagaggaccaggggatagggagggggtacggatga

SEQ ID NO: 134019 - DNA, 38 bp, Artificial Sequence
  Synthetic oligonucleotide
ccagggtggggaaatggggtttaatgaagaggggatga

SEQ ID NO: 134020 - DNA, 37 bp, Artificial Sequence
  Synthetic oligonucleotide
gccccgcgcctgctcgacatactccgcgccctactga

SEQ ID NO: 134021 - DNA, 36 bp, Artificial Sequence
  Synthetic oligonucleotide
tcccccccctgccagatcttttgggccctctactga

SEQ ID NO: 134022 - DNA, 37 bp, Artificial Sequence
  Synthetic oligonucleotide
tatgtccccggtcgccgcccttattaatcgttcctga

SEQ ID NO: 134023 - DNA, 36 bp, Artificial Sequence
  Synthetic oligonucleotide
gcgaaggggagaggtagcatgaatggggacgggtga

SEQ ID NO: 134024 - DNA, 36 bp, Artificial Sequence
  Synthetic oligonucleotide
ttgggtcacccttcgttgcggacttccctcccttga

SEQ ID NO: 134025 - DNA, 38 bp, Artificial Sequence
  Synthetic oligonucleotide
gctcccgccccagccgaacgcgcatttctacctgttga

SEQ ID NO: 134026 - DNA, 36 bp, Artificial Sequence
  Synthetic oligonucleotide
gcgcactcgctgcaggtctaccacccccattcgcta

SEQ ID NO: 134027 - DNA, 36 bp, Artificial Sequence
  Synthetic oligonucleotide
gcaccgtactccctctgtcccccgccagtttgatta

SEQ ID NO: 134028 - DNA, 35 bp, Artificial Sequence
  Synthetic oligonucleotide
tcaacaacagcacggtccccactagtacgctccac

SEQ ID NO: 134029 - DNA, 35 bp, Artificial Sequence
  Synthetic oligonucleotide
tacgcacgaccctttaggcgtgctccatgttccac

SEQ ID NO: 134030 - DNA, 35 bp, Artificial Sequence
  Synthetic oligonucleotide
acatcacccgctcctttgtagaaccccgatggtac

SEQ ID NO: 134031 - DNA, 35 bp, Artificial Sequence
  Synthetic oligonucleotide
gttcgccctcctcgtcgcacttacgagctgtaccc

SEQ ID NO: 134032 - DNA, 35 bp, Artificial Sequence
  Synthetic oligonucleotide
tcctcgacatcctgccatcgagtatacgccacccc

SEQ ID NO: 134033 - DNA, 35 bp, Artificial Sequence
  Synthetic oligonucleotide
aacgtccctgtgttccgccgcggtctatcttctcc

SEQ ID NO: 134034 - DNA, 35 bp, Artificial Sequence
  Synthetic oligonucleotide
ttgatattgccttcacatcctgtcttccgtggtcc

SEQ ID NO: 134035 - DNA, 35 bp, Artificial Sequence
  Synthetic oligonucleotide
aacagatgtgtcatgccacttacttactaccgctc

SEQ ID NO: 134036 - DNA, 35 bp, Artificial Sequence
  Synthetic oligonucleotide
gccgctcgtatcgtctcgattagcctgtccccgtc

SEQ ID NO: 134037 - DNA, 35 bp, Artificial Sequence
  Synthetic oligonucleotide
acgaagggtacagcgttttaggccctcttctcctg

SEQ ID NO: 134038 - DNA, 35 bp, Artificial Sequence
  Synthetic oligonucleotide
ggctgaaccagggagggaagggaggggtcgagcat

SEQ ID NO: 134039 - DNA, 35 bp, Artificial Sequence
  Synthetic oligonucleotide
acgagtgccatcgcgatcacctacacactccatct

SEQ ID NO: 134040 - DNA, 28 bp, Artificial Sequence
  Synthetic oligonucleotide
gcgtatctcacgtttcttcagtccctct

SEQ ID NO: 134041 - DNA, 35 bp, Artificial Sequence
  Synthetic oligonucleotide
cacgttaccgtccttcgctgcccccccgacctggt

SEQ ID NO: 134042 - DNA, 35 bp, Artificial Sequence
  Synthetic oligonucleotide
gccaacctggccccctcagtcctattattgccgtt

SEQ ID NO: 134043 - DNA, 36 bp, Artificial Sequence
  Synthetic oligonucleotide
tgaacaggggggaagggcaaatgactggcaaccgaa

SEQ ID NO: 134044 - DNA, 35 bp, Artificial Sequence
  Synthetic oligonucleotide
gcgccccagccaccgtctcttgccctattgcctaa

SEQ ID NO: 134045 - DNA, 35 bp, Artificial Sequence
  Synthetic oligonucleotide
tgcaccgaccctccgaactgcgtcatcccccgaca

SEQ ID NO: 134046 - DNA, 37 bp, Artificial Sequence
  Synthetic oligonucleotide
tcccacccccatccgatgcccacccgctgtagaacga

SEQ ID NO: 134047 - DNA, 36 bp, Artificial Sequence
  Synthetic oligonucleotide
aatcccgcagtgcaatggcgcattcctgccttccga

SEQ ID NO: 134048 - DNA, 37 bp, Artificial Sequence
  Synthetic oligonucleotide
accccgctcccccgcctgtcgaaggaatctgccatga

SEQ ID NO: 134049 - DNA, 37 bp, Artificial Sequence
  Synthetic oligonucleotide
tccaccacgcgtcaaggtaccgcacccacctccatga

SEQ ID NO: 134050 - DNA, 36 bp, Artificial Sequence
  Synthetic oligonucleotide
gcccgctccgccattcgcaccactacctgctcccta

SEQ ID NO: 134051 - DNA, 36 bp, Artificial Sequence
  Synthetic oligonucleotide
ccgggggttgatctttcggggtatgggaggggagta

SEQ ID NO: 134052 - DNA, 35 bp, Artificial Sequence
  Synthetic oligonucleotide
tggacccgccctgtacgtcctaaccgttctcaacc

SEQ ID NO: 134053 - DNA, 35 bp, Artificial Sequence
  Synthetic oligonucleotide
tattcccccggccctttacgatagtagctcgtacc

SEQ ID NO: 134054 - DNA, 35 bp, Artificial Sequence
  Synthetic oligonucleotide
actagccccactgcctgttgttcaatccaattacc

SEQ ID NO: 134055 - DNA, 35 bp, Artificial Sequence
  Synthetic oligonucleotide
ggagctatccgcctgtccccaccgtcgctattacc

SEQ ID NO: 134056 - DNA, 35 bp, Artificial Sequence
  Synthetic oligonucleotide
tagcatgatagcccgtacgtctaccgccacccgcc

SEQ ID NO: 134057 - DNA, 35 bp, Artificial Sequence
  Synthetic oligonucleotide
tccgaactcgttcctatcaccacgccccccgaagc

SEQ ID NO: 134058 - DNA, 35 bp, Artificial Sequence
  Synthetic oligonucleotide
accctacatcatggcgtgacctgtacatcccccgc

SEQ ID NO: 134059 - DNA, 35 bp, Artificial Sequence
  Synthetic oligonucleotide
attgccccctctccggtccttaacgtcaaccctgc

SEQ ID NO: 134060 - DNA, 35 bp, Artificial Sequence
  Synthetic oligonucleotide
tcccgtgtggccaccccgcctgaatcgtatctttc

SEQ ID NO: 134061 - DNA, 35 bp, Artificial Sequence
  Synthetic oligonucleotide
gtacaccgccggtttctcgctatagttccattttc

SEQ ID NO: 134062 - DNA, 35 bp, Artificial Sequence
  Synthetic oligonucleotide
gcaagggtgggcgggcattgtaaagggattatgcg

SEQ ID NO: 134063 - DNA, 35 bp, Artificial Sequence
  Synthetic oligonucleotide
gtctacgccggccgtttcatcttttcgtatcttcg

SEQ ID NO: 134064 - DNA, 35 bp, Artificial Sequence
  Synthetic oligonucleotide
tcacccatcacccctcgacgagaccctgactcagg

SEQ ID NO: 134065 - DNA, 35 bp, Artificial Sequence
  Synthetic oligonucleotide
tacagcgctgcgacgtaacgggtggtgtgggcggg

SEQ ID NO: 134066 - DNA, 35 bp, Artificial Sequence
  Synthetic oligonucleotide
agccaacccctgtcctcgccatacctacgtcctgg

SEQ ID NO: 134067 - DNA, 35 bp, Artificial Sequence
  Synthetic oligonucleotide
gaacatcccccctcaagttatactgctgatcctct

SEQ ID NO: 134068 - DNA, 35 bp, Artificial Sequence
  Synthetic oligonucleotide
ttaacgcgctgttccatcatgcatccacttattgt

SEQ ID NO: 134069 - DNA, 36 bp, Artificial Sequence
  Synthetic oligonucleotide
ggagagccaggcggtgggtggtaaggggagcataaa

SEQ ID NO: 134070 - DNA, 36 bp, Artificial Sequence
  Synthetic oligonucleotide
tgggatacgcctcacattctactccgagctccccca

SEQ ID NO: 134071 - DNA, 33 bp, Artificial Sequence
  Synthetic oligonucleotide
gacccggtctctgtcgcaactcctggcttccca

SEQ ID NO: 134072 - DNA, 36 bp, Artificial Sequence
  Synthetic oligonucleotide
tagccaccctatctagcccgctgtcccgtagtgcca

SEQ ID NO: 134073 - DNA, 35 bp, Artificial Sequence
  Synthetic oligonucleotide
tgcccccactcgctgcttgcatcaatggccactca

SEQ ID NO: 134074 - DNA, 36 bp, Artificial Sequence
  Synthetic oligonucleotide
ggatccggcctccgtattttgtctcctggtctttca

SEQ ID NO: 134075 - DNA, 36 bp, Artificial Sequence
  Synthetic oligonucleotide
gtggatagaaaggggcgataggtgggggcagaagga

SEQ ID NO: 134076 - DNA, 38 bp, Artificial Sequence
  Synthetic oligonucleotide
acagagggagcagtagagcggggggcggggaggattga

SEQ ID NO: 134077 - DNA, 38 bp, Artificial Sequence
  Synthetic oligonucleotide
tcccactccctcccccgagtacagtacctaccccttga

SEQ ID NO: 134078 - DNA, 38 bp, Artificial Sequence
  Synthetic oligonucleotide
gtccgccctccatttgccccgctcagaacccacgttga

SEQ ID NO: 134079 - DNA, 35 bp, Artificial Sequence
  Synthetic oligonucleotide
aaacccacctcggtctctatatgtcgtacttccac

SEQ ID NO: 134080 - DNA, 35 bp, Artificial Sequence
  Synthetic oligonucleotide
gagtaaatgggagggggggtgacatggggatagcg

SEQ ID NO: 134081 - DNA, 36 bp, Artificial Sequence
  Synthetic oligonucleotide
gacatcgatctgtgggggcgggggggcggaacaagg

SEQ ID NO: 134082 - DNA, 35 bp, Artificial Sequence
  Synthetic oligonucleotide
gtagatgcgggggaaagtgggcacgggaggattgg

SEQ ID NO: 134083 - DNA, 35 bp, Artificial Sequence
  Synthetic oligonucleotide
tcctgtcccagtttgttgctcgccatcctactctg

SEQ ID NO: 134084 - DNA, 35 bp, Artificial Sequence
  Synthetic oligonucleotide
tgtaccatgatcgcacctgccgctggccccactct

SEQ ID NO: 134085 - DNA, 35 bp, Artificial Sequence
  Synthetic oligonucleotide
gggagaggtcagtcgcccgcccgccactcatctgt

SEQ ID NO: 134086 - DNA, 35 bp, Artificial Sequence
  Synthetic oligonucleotide
tccaccaacctatccgctaagccatgacctcggtt

SEQ ID NO: 134087 - DNA, 35 bp, Artificial Sequence
  Synthetic oligonucleotide
agcctgccgcaccccttacgtctgtctccctgcaa

SEQ ID NO: 134088 - DNA, 35 bp, Artificial Sequence
  Synthetic oligonucleotide
tacgcttacctgtctgttccgtccttcgccctcaa

SEQ ID NO: 134089 - DNA, 37 bp, Artificial Sequence
  Synthetic oligonucleotide
gctgaaagggtagggggtgcggggtgatacggtcaga

SEQ ID NO: 134090 - DNA, 37 bp, Artificial Sequence
  Synthetic oligonucleotide
gagagaggcgggtgggtgggcgctcgcatgaatgaga

SEQ ID NO: 134091 - DNA, 35 bp, Artificial Sequence
  Synthetic oligonucleotide
gaaccgcccccctcccgcatggtatcaatttgaga

SEQ ID NO: 134092 - DNA, 36 bp, Artificial Sequence
  Synthetic oligonucleotide
acccaccatggtaatcctccccgcccacccccggga

SEQ ID NO: 134093 - DNA, 37 bp, Artificial Sequence
  Synthetic oligonucleotide
gttccgtgcggggttgtttggggtgtcgctctgggga

SEQ ID NO: 134094 - DNA, 38 bp, Artificial Sequence
  Synthetic oligonucleotide
aagcgaacacaggtaagggtaggagggtggggggctga

SEQ ID NO: 134095 - DNA, 37 bp, Artificial Sequence
  Synthetic oligonucleotide
ggccctgcccattgtcctcctatgtctcacctcttga

SEQ ID NO: 134096 - DNA, 34 bp, Artificial Sequence
  Synthetic oligonucleotide
tagacatcctcactcttgaatctttgcaccctta

SEQ ID NO: 134097 - DNA, 35 bp, Artificial Sequence
  Synthetic oligonucleotide
gttcgccagatgactccttttgccttggtccagcc

SEQ ID NO: 134098 - DNA, 35 bp, Artificial Sequence
  Synthetic oligonucleotide
tctagctcagtatgcctataccgccacgtgtctcc

SEQ ID NO: 134099 - DNA, 35 bp, Artificial Sequence
  Synthetic oligonucleotide
tgcacgggcaccgactcggtaactatcgcacttcc

SEQ ID NO: 134100 - DNA, 35 bp, Artificial Sequence
  Synthetic oligonucleotide
gccaacatcctagaatccacgccgccgctataggc

SEQ ID NO: 134101 - DNA, 35 bp, Artificial Sequence
  Synthetic oligonucleotide
aacccgtccctgcgcctagatccactttctactgc

SEQ ID NO: 134102 - DNA, 34 bp, Artificial Sequence
  Synthetic oligonucleotide
ataggccgtccctgccctatgttttcccgctatc

SEQ ID NO: 134103 - DNA, 35 bp, Artificial Sequence
  Synthetic oligonucleotide
ttatcgctccacgcaccaccaggtatgcacccccg

SEQ ID NO: 134104 - DNA, 35 bp, Artificial Sequence
  Synthetic oligonucleotide
tacgccggcccgagactgtaccgcccctgaccctg

SEQ ID NO: 134105 - DNA, 35 bp, Artificial Sequence
  Synthetic oligonucleotide
tgtcctgaacctgtctcgtattcgccatacttcat

SEQ ID NO: 134106 - DNA, 35 bp, Artificial Sequence
  Synthetic oligonucleotide
tgaccgaggtcggctctctgtcactcaccctatct

SEQ ID NO: 134107 - DNA, 35 bp, Artificial Sequence
  Synthetic oligonucleotide
gcgccacccccgtatcctgtttgctaacgacttct

SEQ ID NO: 134108 - DNA, 35 bp, Artificial Sequence
  Synthetic oligonucleotide
ttgaccatcccatccatccgttacgacaaactagt

SEQ ID NO: 134109 - DNA, 35 bp, Artificial Sequence
  Synthetic oligonucleotide
gcaggaacgcctaaaagggggagcgggggggttaa

SEQ ID NO: 134110 - DNA, 36 bp, Artificial Sequence
  Synthetic oligonucleotide
gcaagagcgcagccgattccatgacctccgcccaca

SEQ ID NO: 134111 - DNA, 35 bp, Artificial Sequence
  Synthetic oligonucleotide
gagacagcctggtgcatccaagcctcctccaccca

SEQ ID NO: 134112 - DNA, 36 bp, Artificial Sequence
  Synthetic oligonucleotide
atgaccgcatcgccggctctcgccaattcttgccca

SEQ ID NO: 134113 - DNA, 34 bp, Artificial Sequence
  Synthetic oligonucleotide
aagcaccatcccaacgtctgccgacccaccatca

SEQ ID NO: 134114 - DNA, 37 bp, Artificial Sequence
  Synthetic oligonucleotide
gatgagtggggggagaatgcggacagtggtcggaaga

SEQ ID NO: 134115 - DNA, 36 bp, Artificial Sequence
  Synthetic oligonucleotide
ttaggtcgagggcaggggcgggagggggtagacaga

SEQ ID NO: 134116 - DNA, 36 bp, Artificial Sequence
  Synthetic oligonucleotide
gcagggacgggaggggaaagatagtgggtcatacga

SEQ ID NO: 134117 - DNA, 36 bp, Artificial Sequence
  Synthetic oligonucleotide
gacttggaggaggaaggagcgaggcaagggctagga

SEQ ID NO: 134118 - DNA, 37 bp, Artificial Sequence
  Synthetic oligonucleotide
ggatggtgggagggggtttgaagggtgtcggaacgga

SEQ ID NO: 134119 - DNA, 37 bp, Artificial Sequence
  Synthetic oligonucleotide
tgtctaggaggaaggggagaacgcgagggtgaaggga

SEQ ID NO: 134120 - DNA, 37 bp, Artificial Sequence
  Synthetic oligonucleotide
acaccacttgtccgaccggtactcgcctcattactga

SEQ ID NO: 134121 - DNA, 36 bp, Artificial Sequence
  Synthetic oligonucleotide
acgatacccgccactagttgcgtctagttccaccta

SEQ ID NO: 134122 - DNA, 35 bp, Artificial Sequence
  Synthetic oligonucleotide
tcgagaagcccgttgtcccgccctgtccctataac

SEQ ID NO: 134123 - DNA, 32 bp, Artificial Sequence
  Synthetic oligonucleotide
taacactgcccccgcacggactatgtagaccc

SEQ ID NO: 134124 - DNA, 35 bp, Artificial Sequence
  Synthetic oligonucleotide
ttgatctcccagcccatgcgactcgtacccgctcc

SEQ ID NO: 134125 - DNA, 35 bp, Artificial Sequence
  Synthetic oligonucleotide
gtactcgctagccttgactcccactgtagcctctc

SEQ ID NO: 134126 - DNA, 35 bp, Artificial Sequence
  Synthetic oligonucleotide
acccacgccgcatgttccgccgcaggttgcgcttc

SEQ ID NO: 134127 - DNA, 35 bp, Artificial Sequence
  Synthetic oligonucleotide
acgcccctagcctagcccttctcactgcctctctg

SEQ ID NO: 134128 - DNA, 35 bp, Artificial Sequence
  Synthetic oligonucleotide
acccccgcactatgcttgtttcgctcctgcgtatt

SEQ ID NO: 134129 - DNA, 35 bp, Artificial Sequence
  Synthetic oligonucleotide
tcactccgccataccgtccttcgccttggttcgtt

SEQ ID NO: 134130 - DNA, 36 bp, Artificial Sequence
  Synthetic oligonucleotide
gcaccgacccacctgtcaagatcttcccccgctgaa

SEQ ID NO: 134131 - DNA, 36 bp, Artificial Sequence
  Synthetic oligonucleotide
accacgcaggcctgacttcaatctatctcaccgcca

SEQ ID NO: 134132 - DNA, 36 bp, Artificial Sequence
  Synthetic oligonucleotide
tgacgcccctccagctgcttaacccagaatcacgca

SEQ ID NO: 134133 - DNA, 37 bp, Artificial Sequence
  Synthetic oligonucleotide
gtccgccccccgcattacaagtggcctgttctgccga

SEQ ID NO: 134134 - DNA, 37 bp, Artificial Sequence
  Synthetic oligonucleotide
atgcaagctcacgccgcccgtctctctgttcatccga

SEQ ID NO: 134135 - DNA, 37 bp, Artificial Sequence
  Synthetic oligonucleotide
gaagggtagggtgggtgcaaagcattggggaaacgga

SEQ ID NO: 134136 - DNA, 36 bp, Artificial Sequence
  Synthetic oligonucleotide
gatgtacgctcaagccttgtctctgcccacttccta

SEQ ID NO: 134137 - DNA, 35 bp, Artificial Sequence
  Synthetic oligonucleotide
gacgatgcgcggaactgggagggacgggaagggta

SEQ ID NO: 134138 - DNA, 35 bp, Artificial Sequence
  Synthetic oligonucleotide
tagtcacgacggccgtctatccacccgcttcatac

SEQ ID NO: 134139 - DNA, 35 bp, Artificial Sequence
  Synthetic oligonucleotide
ttcgcgtcctggttctccccgtctcgccgtcctac

SEQ ID NO: 134140 - DNA, 35 bp, Artificial Sequence
  Synthetic oligonucleotide
accgccgtagttcgtcacccttctcaccgagtccc

SEQ ID NO: 134141 - DNA, 35 bp, Artificial Sequence
  Synthetic oligonucleotide
tgaccacctctaagtcacaccgtgccccgtttgcc

SEQ ID NO: 134142 - DNA, 35 bp, Artificial Sequence
  Synthetic oligonucleotide
actgaccccggccccattgctcagggcccccttcc

SEQ ID NO: 134143 - DNA, 35 bp, Artificial Sequence
  Synthetic oligonucleotide
gtgcgcctctcgagcctcctctactgcggaacctc

SEQ ID NO: 134144 - DNA, 35 bp, Artificial Sequence
  Synthetic oligonucleotide
tcaaaagctaaggtcgcccgctgcccccccgattc

SEQ ID NO: 134145 - DNA, 35 bp, Artificial Sequence
  Synthetic oligonucleotide
gtatcatcgcccctgttcgtcgctggcctctcaat

SEQ ID NO: 134146 - DNA, 35 bp, Artificial Sequence
  Synthetic oligonucleotide
tcaactgggcgggtgggtctttccggtccggggat

SEQ ID NO: 134147 - DNA, 35 bp, Artificial Sequence
  Synthetic oligonucleotide
tcctccgccctatgaagtatgactttcactcgcct

SEQ ID NO: 134148 - DNA, 35 bp, Artificial Sequence
  Synthetic oligonucleotide
gcatgccgcattgtggcctctatctccttcttgct

SEQ ID NO: 134149 - DNA, 35 bp, Artificial Sequence
  Synthetic oligonucleotide
actgtgcgcagttccctccttatgcactcctttgt

SEQ ID NO: 134150 - DNA, 36 bp, Artificial Sequence
  Synthetic oligonucleotide
tagcttcagggcgggaggggcgggggaatgcgcgaa

SEQ ID NO: 134151 - DNA, 35 bp, Artificial Sequence
  Synthetic oligonucleotide
tgcgtacccacccgcttttgagctcactgaaccca

SEQ ID NO: 134152 - DNA, 33 bp, Artificial Sequence
  Synthetic oligonucleotide
attgcgatgcacttcgaaccgttccttccgtca

SEQ ID NO: 134153 - DNA, 37 bp, Artificial Sequence
  Synthetic oligonucleotide
ccacctctctgttctgttccgtcgcctgaatgttaga

SEQ ID NO: 134154 - DNA, 37 bp, Artificial Sequence
  Synthetic oligonucleotide
acgggccgccttgccatctgtttttcgccctcatcga

SEQ ID NO: 134155 - DNA, 35 bp, Artificial Sequence
  Synthetic oligonucleotide
ttcgccgctaccagccgatacaccctgcccccgga

SEQ ID NO: 134156 - DNA, 37 bp, Artificial Sequence
  Synthetic oligonucleotide
tagtggggcaggtaaggtctcgggcggggtttgggga

SEQ ID NO: 134157 - DNA, 38 bp, Artificial Sequence
  Synthetic oligonucleotide
gttgtcacgcgggggggtgggggagggagtaaacatga

SEQ ID NO: 134158 - DNA, 38 bp, Artificial Sequence
  Synthetic oligonucleotide
aagacagtggacgggtgagagctggggacgggaagtga

SEQ ID NO: 134159 - DNA, 35 bp, Artificial Sequence
  Synthetic oligonucleotide
gatcgcctgtttagccgccttatccgttccccata

SEQ ID NO: 134160 - DNA, 35 bp, Artificial Sequence
  Synthetic oligonucleotide
ttcgaccggtacccccccatttgtcctagctaccc

SEQ ID NO: 134161 - DNA, 35 bp, Artificial Sequence
  Synthetic oligonucleotide
ttgtctgtaccaccgcggtttgtcttcgttgctcc

SEQ ID NO: 134162 - DNA, 35 bp, Artificial Sequence
  Synthetic oligonucleotide
attcgcgcctcaacatctgggtcatctccgtctgc

SEQ ID NO: 134163 - DNA, 35 bp, Artificial Sequence
  Synthetic oligonucleotide
gtgagatcagttatcctcgtcaccccctagccctg

SEQ ID NO: 134164 - DNA, 35 bp, Artificial Sequence
  Synthetic oligonucleotide
gcgcacatccccgcgcctctgttagttctagtcat

SEQ ID NO: 134165 - DNA, 35 bp, Artificial Sequence
  Synthetic oligonucleotide
accacgacttcatgttactgcccactgtcttccct

SEQ ID NO: 134166 - DNA, 35 bp, Artificial Sequence
  Synthetic oligonucleotide
tccgcaagactgctactcgctcccctgcctacgct

SEQ ID NO: 134167 - DNA, 37 bp, Artificial Sequence
  Synthetic oligonucleotide
actcccgctcgatataccgtagccatccttcatccga

SEQ ID NO: 134168 - DNA, 36 bp, Artificial Sequence
  Synthetic oligonucleotide
gcgccccctttacgctgcaatgtcacctctctccga

SEQ ID NO: 134169 - DNA, 37 bp, Artificial Sequence
  Synthetic oligonucleotide
gatggatgtaagcaggtagtggggggaagataggcga

SEQ ID NO: 134170 - DNA, 37 bp, Artificial Sequence
  Synthetic oligonucleotide
tgcgtacgcacttgctcacccgtctacccctgttcga

SEQ ID NO: 134171 - DNA, 37 bp, Artificial Sequence
  Synthetic oligonucleotide
gagaggcgcagaaatgggggggtgaggagcgaaagga

SEQ ID NO: 134172 - DNA, 37 bp, Artificial Sequence
  Synthetic oligonucleotide
gcggagggggtggggctggcgataggcggttttcgga

SEQ ID NO: 134173 - DNA, 37 bp, Artificial Sequence
  Synthetic oligonucleotide
gtagggggtggaatagtagggtaacggggaatcggga

SEQ ID NO: 134174 - DNA, 37 bp, Artificial Sequence
  Synthetic oligonucleotide
tccaggaccagtcaggaggagggatgagggtggggga

SEQ ID NO: 134175 - DNA, 38 bp, Artificial Sequence
  Synthetic oligonucleotide
gccacctgcccccgatcctatggtcctcccagacatga

SEQ ID NO: 134176 - DNA, 35 bp, Artificial Sequence
  Synthetic oligonucleotide
tttgaccgctaaacggagctttgtaccatccctga

SEQ ID NO: 134177 - DNA, 37 bp, Artificial Sequence
  Synthetic oligonucleotide
atccagtgtacaggggaagaaggagggggaacggtga

SEQ ID NO: 134178 - DNA, 36 bp, Artificial Sequence
  Synthetic oligonucleotide
gactcccttcacatcttacatggccactgaccatta

SEQ ID NO: 134179 - DNA, 35 bp, Artificial Sequence
  Synthetic oligonucleotide
acatcaggtcgttctaccgcgtatccgtccaccgc

SEQ ID NO: 134180 - DNA, 36 bp, Artificial Sequence
  Synthetic oligonucleotide
gcactacgtgtttcgtccccacctggcctcccccgc

SEQ ID NO: 134181 - DNA, 35 bp, Artificial Sequence
  Synthetic oligonucleotide
tcacacacattctattacgccttgcacttggtcgc

SEQ ID NO: 134182 - DNA, 35 bp, Artificial Sequence
  Synthetic oligonucleotide
agtctaccgccccctagcagaccacgctttcctcg

SEQ ID NO: 134183 - DNA, 35 bp, Artificial Sequence
  Synthetic oligonucleotide
gcatatcctccgccacatgaatcatccagggttcg

SEQ ID NO: 134184 - DNA, 35 bp, Artificial Sequence
  Synthetic oligonucleotide
gcccggtcctccgaagggtcttctcctctcattgg

SEQ ID NO: 134185 - DNA, 35 bp, Artificial Sequence
  Synthetic oligonucleotide
atggtgctcgctccctaccagtattcaccttcctg

SEQ ID NO: 134186 - DNA, 35 bp, Artificial Sequence
  Synthetic oligonucleotide
aagtccgggatgtgcccctgcccgctttcgttcct

SEQ ID NO: 134187 - DNA, 35 bp, Artificial Sequence
  Synthetic oligonucleotide
gcggtgccttcaccctccgtaccccgtgaccccgt

SEQ ID NO: 134188 - DNA, 35 bp, Artificial Sequence
  Synthetic oligonucleotide
tccaaccgactccccatgctgcttttgtgaacttt

SEQ ID NO: 134189 - DNA, 36 bp, Artificial Sequence
  Synthetic oligonucleotide
gtactgcccgatgatcgctcctgctggcccctgtaa

SEQ ID NO: 134190 - DNA, 36 bp, Artificial Sequence
  Synthetic oligonucleotide
acattccacctgcccgcccctggtgtcagtaactca

SEQ ID NO: 134191 - DNA, 37 bp, Artificial Sequence
  Synthetic oligonucleotide
gcaacgcaccgtttcaccggactccgctactcttcga

SEQ ID NO: 134192 - DNA, 36 bp, Artificial Sequence
  Synthetic oligonucleotide
aagaggaggaggaagtgggttatacgggaaaagtga

SEQ ID NO: 134193 - DNA, 38 bp, Artificial Sequence
  Synthetic oligonucleotide
gatagggggatgtggcgggtggggcggaacgcgagtga

SEQ ID NO: 134194 - DNA, 38 bp, Artificial Sequence
  Synthetic oligonucleotide
actgactggcagatgcccttattgccccccgttcgtga

SEQ ID NO: 134195 - DNA, 36 bp, Artificial Sequence
  Synthetic oligonucleotide
tccggagcccttatgtctctctggtccactccttga

SEQ ID NO: 134196 - DNA, 36 bp, Artificial Sequence
  Synthetic oligonucleotide
aaacagggggggtagaaaaggggtcggaatggcata

SEQ ID NO: 134197 - DNA, 35 bp, Artificial Sequence
  Synthetic oligonucleotide
ttagtcagcctccctgcgctctggaccgaatcgac

SEQ ID NO: 134198 - DNA, 35 bp, Artificial Sequence
  Synthetic oligonucleotide
acccccgggatcttgcgcctgctctattcgccacc

SEQ ID NO: 134199 - DNA, 35 bp, Artificial Sequence
  Synthetic oligonucleotide
gatgtgcacgttatctggtggctctctactcttcc

SEQ ID NO: 134200 - DNA, 35 bp, Artificial Sequence
  Synthetic oligonucleotide
acgccccgccatagccagtccgtacctcattgctc

SEQ ID NO: 134201 - DNA, 35 bp, Artificial Sequence
  Synthetic oligonucleotide
agctacccactgctcgccccgtacccgcacccaag

SEQ ID NO: 134202 - DNA, 35 bp, Artificial Sequence
  Synthetic oligonucleotide
atccgactgagctcgactcctgattatttgtcctg

SEQ ID NO: 134203 - DNA, 35 bp, Artificial Sequence
  Synthetic oligonucleotide
tgagcaccgaccacctgccgtctagttcctgttgt

SEQ ID NO: 134204 - DNA, 36 bp, Artificial Sequence
  Synthetic oligonucleotide
tgatgggtaggacaaaggaggggggatcggtgtaaa

SEQ ID NO: 134205 - DNA, 36 bp, Artificial Sequence
  Synthetic oligonucleotide
tatgcggccacacccatatcgttgcccttgccctaa

SEQ ID NO: 134206 - DNA, 35 bp, Artificial Sequence
  Synthetic oligonucleotide
agtggggagggtgggtccgctgtatggggcttcca

SEQ ID NO: 134207 - DNA, 37 bp, Artificial Sequence
  Synthetic oligonucleotide
tacatcgcattgaaggggcaggaggggaggatgcaga

SEQ ID NO: 134208 - DNA, 37 bp, Artificial Sequence
  Synthetic oligonucleotide
tgggcctcccgccactccctatgtactcgtcgaacga

SEQ ID NO: 134209 - DNA, 37 bp, Artificial Sequence
  Synthetic oligonucleotide
tgacgcacttcactttgcccccctctcgttcggacga

SEQ ID NO: 134210 - DNA, 35 bp, Artificial Sequence
  Synthetic oligonucleotide
aacgcccgcctccctcgtaaacatagtctcactga

SEQ ID NO: 134211 - DNA, 38 bp, Artificial Sequence
  Synthetic oligonucleotide
gttacggagcatggggggaggaaggggagtaggggtga

SEQ ID NO: 134212 - DNA, 38 bp, Artificial Sequence
  Synthetic oligonucleotide
gccccctgctctggttcgattaccctcccccactgtga

SEQ ID NO: 134213 - DNA, 36 bp, Artificial Sequence
  Synthetic oligonucleotide
gttcgaacgcccccacacctgccctgaggactttta

SEQ ID NO: 134214 - DNA, 35 bp, Artificial Sequence
  Synthetic oligonucleotide
ggtaccgccacccattgaccttccactagtctcac

SEQ ID NO: 134215 - DNA, 35 bp, Artificial Sequence
  Synthetic oligonucleotide
atgcgtcgggccgtaacgtgcatcacccactcccc

SEQ ID NO: 134216 - DNA, 35 bp, Artificial Sequence
  Synthetic oligonucleotide
gattgccgcaaaacccgctgttcttgattacgccc

SEQ ID NO: 134217 - DNA, 35 bp, Artificial Sequence
  Synthetic oligonucleotide
tgcattcctcccacacgacgttgaattcctcgccc

SEQ ID NO: 134218 - DNA, 35 bp, Artificial Sequence
  Synthetic oligonucleotide
agcgccttcgaattgatcctgtcaccgctctgccc

SEQ ID NO: 134219 - DNA, 35 bp, Artificial Sequence
  Synthetic oligonucleotide
ggtgcgcccggatcgttgcttccgtgttccctgcc

SEQ ID NO: 134220 - DNA, 35 bp, Artificial Sequence
  Synthetic oligonucleotide
agctgctcatcaccgctccatcaggctaggcctcc

SEQ ID NO: 134221 - DNA, 35 bp, Artificial Sequence
  Synthetic oligonucleotide
gcatccccgcccccgtgttagaatctactcggtcc

SEQ ID NO: 134222 - DNA, 35 bp, Artificial Sequence
  Synthetic oligonucleotide
gtacaccctcatgtctcgtgagtctctcgggttcc

SEQ ID NO: 134223 - DNA, 35 bp, Artificial Sequence
  Synthetic oligonucleotide
agtatcctgccccggaccgttcctgccctatccgc

SEQ ID NO: 134224 - DNA, 35 bp, Artificial Sequence
  Synthetic oligonucleotide
ttgtgatcccccgttcctcccgttatggcgtatgc

SEQ ID NO: 134225 - DNA, 34 bp, Artificial Sequence
  Synthetic oligonucleotide
tagactctcgccggccttagccacatccccctgc

SEQ ID NO: 134226 - DNA, 35 bp, Artificial Sequence
  Synthetic oligonucleotide
ttcgccctgaaggcagtctgttcctgcatgccatc

SEQ ID NO: 134227 - DNA, 35 bp, Artificial Sequence
  Synthetic oligonucleotide
gaactcactccatatgggcctcgctgcctgccttc

SEQ ID NO: 134228 - DNA, 35 bp, Artificial Sequence
  Synthetic oligonucleotide
agggaaccagtagtaggaggaaacggggggacgag

SEQ ID NO: 134229 - DNA, 35 bp, Artificial Sequence
  Synthetic oligonucleotide
tccccgcccgcctccatacgcccaatctttcggcg

SEQ ID NO: 134230 - DNA, 35 bp, Artificial Sequence
  Synthetic oligonucleotide
tgatcctgtcctggctttgatcccccctgttatcg

SEQ ID NO: 134231 - DNA, 35 bp, Artificial Sequence
  Synthetic oligonucleotide
tgcccgaacgggtggagggggggagtagaagcagg

SEQ ID NO: 134232 - DNA, 35 bp, Artificial Sequence
  Synthetic oligonucleotide
acatgtcaccgccatgctcccgttccgctctgtgg

SEQ ID NO: 134233 - DNA, 36 bp, Artificial Sequence
  Synthetic oligonucleotide
ggaggggggagaagggggggtgggagtagggtgcaa

SEQ ID NO: 134234 - DNA, 36 bp, Artificial Sequence
  Synthetic oligonucleotide
tcccatcactcaatcttgcatctgggctctccaaca

SEQ ID NO: 134235 - DNA, 35 bp, Artificial Sequence
  Synthetic oligonucleotide
aactcgagggacacacggggaaggcggggggtaca

SEQ ID NO: 134236 - DNA, 36 bp, Artificial Sequence
  Synthetic oligonucleotide
gtgacgcctcggtatctcaagctatgccacctgcca

SEQ ID NO: 134237 - DNA, 36 bp, Artificial Sequence
  Synthetic oligonucleotide
aaccgtgcccgccccaggccattgatccaactcgca

SEQ ID NO: 134238 - DNA, 36 bp, Artificial Sequence
  Synthetic oligonucleotide
ttaccgcatatgggtgcgtgtcctgcctttcattca

SEQ ID NO: 134239 - DNA, 37 bp, Artificial Sequence
  Synthetic oligonucleotide
gatgtcggtcagtgggtgggtgggttaatcgttaaga

SEQ ID NO: 134240 - DNA, 37 bp, Artificial Sequence
  Synthetic oligonucleotide
gaggatgtgggaggaggctttcaggactggggttaga

SEQ ID NO: 134241 - DNA, 37 bp, Artificial Sequence
  Synthetic oligonucleotide
acgctgccgacgggggggagggttatggtagggagga

SEQ ID NO: 134242 - DNA, 37 bp, Artificial Sequence
  Synthetic oligonucleotide
tgcctccctcggaaatatctcctgatccacccctgga

SEQ ID NO: 134243 - DNA, 36 bp, Artificial Sequence
  Synthetic oligonucleotide
gagctcacctcccgccggttactatccttgtgctga

SEQ ID NO: 134244 - DNA, 38 bp, Artificial Sequence
  Synthetic oligonucleotide
gtctgcccccgtgctgccttcacctatctatcgtttga

SEQ ID NO: 134245 - DNA, 36 bp, Artificial Sequence
  Synthetic oligonucleotide
tctcactgtgccatcctaagcgcgtccaggtaacac

SEQ ID NO: 134246 - DNA, 35 bp, Artificial Sequence
  Synthetic oligonucleotide
gaccaccacattcttctttggacgctctcctccac

SEQ ID NO: 134247 - DNA, 35 bp, Artificial Sequence
  Synthetic oligonucleotide
gtcattccattgttgctattgctttccgcctgtac

SEQ ID NO: 134248 - DNA, 35 bp, Artificial Sequence
  Synthetic oligonucleotide
actccgccccagggagttcttgaacgccacacacc

SEQ ID NO: 134249 - DNA, 35 bp, Artificial Sequence
  Synthetic oligonucleotide
acattcccgtgcctgcattcggtctctcgaccacc

SEQ ID NO: 134250 - DNA, 34 bp, Artificial Sequence
  Synthetic oligonucleotide
gacattccccctgtgaggccagcacacccccccc

SEQ ID NO: 134251 - DNA, 35 bp, Artificial Sequence
  Synthetic oligonucleotide
accccaacggagtagacacttaacccagctgcccc

SEQ ID NO: 134252 - DNA, 35 bp, Artificial Sequence
  Synthetic oligonucleotide
tgccaccgaacgtcttttcttccccacccgctgcc

SEQ ID NO: 134253 - DNA, 35 bp, Artificial Sequence
  Synthetic oligonucleotide
gagaacgggcctgtgctgcttaccgactccactcc

SEQ ID NO: 134254 - DNA, 35 bp, Artificial Sequence
  Synthetic oligonucleotide
tcgatcaccccgctacggccttcttgctgatctcc

SEQ ID NO: 134255 - DNA, 35 bp, Artificial Sequence
  Synthetic oligonucleotide
gactgcccacattcgggcatacagtcctcaacctc

SEQ ID NO: 134256 - DNA, 35 bp, Artificial Sequence
  Synthetic oligonucleotide
gccccgagccacctccctgtccctctgcaccctgg

SEQ ID NO: 134257 - DNA, 35 bp, Artificial Sequence
  Synthetic oligonucleotide
gtcccgtgcccgtgatctatactacgccgttctct

SEQ ID NO: 134258 - DNA, 35 bp, Artificial Sequence
  Synthetic oligonucleotide
aatgtcccgggtgggtggggttgggttgcataaca

SEQ ID NO: 134259 - DNA, 35 bp, Artificial Sequence
  Synthetic oligonucleotide
tatacccgccgtccgtcaacaccaccactttcgca

SEQ ID NO: 134260 - DNA, 37 bp, Artificial Sequence
  Synthetic oligonucleotide
ggaggaggcgggaggttggcggagggacgcgagaaga

SEQ ID NO: 134261 - DNA, 37 bp, Artificial Sequence
  Synthetic oligonucleotide
atgcctccggcaggcaacacccgctcccgcccaccga

SEQ ID NO: 134262 - DNA, 37 bp, Artificial Sequence
  Synthetic oligonucleotide
gcaccacaatgccatctcatcccatccacgctatcga

SEQ ID NO: 134263 - DNA, 36 bp, Artificial Sequence
  Synthetic oligonucleotide
gtggggcaggatggggcgggaataaggtgggaggga

SEQ ID NO: 134264 - DNA, 38 bp, Artificial Sequence
  Synthetic oligonucleotide
gccgccaccccccacggtactatcgtagccaaccatga

SEQ ID NO: 134265 - DNA, 38 bp, Artificial Sequence
  Synthetic oligonucleotide
tcgatacgagagggggatgcggagggaactaagggtga

SEQ ID NO: 134266 - DNA, 38 bp, Artificial Sequence
  Synthetic oligonucleotide
gggggtgtgggagggtggggcgacgagtagaggggtga

SEQ ID NO: 134267 - DNA, 38 bp, Artificial Sequence
  Synthetic oligonucleotide
atgcgcgccagccttctgctccccatgtgccttcttga

SEQ ID NO: 134268 - DNA, 36 bp, Artificial Sequence
  Synthetic oligonucleotide
aagtgcgctcctacgtcctctgcccgcgcgccccta

SEQ ID NO: 134269 - DNA, 36 bp, Artificial Sequence
  Synthetic oligonucleotide
tcgcacctaaccccgcctctgatctgccatgctcta

SEQ ID NO: 134270 - DNA, 36 bp, Artificial Sequence
  Synthetic oligonucleotide
gaggctgacagggggggggaggctgggttgagcgta

SEQ ID NO: 134271 - DNA, 35 bp, Artificial Sequence
  Synthetic oligonucleotide
tcacacccttagcccgtttcttcatcgaaccatta

SEQ ID NO: 134272 - DNA, 35 bp, Artificial Sequence
  Synthetic oligonucleotide
ttcatccccctaaggattagcacggtcctaacaac

SEQ ID NO: 134273 - DNA, 35 bp, Artificial Sequence
  Synthetic oligonucleotide
gacccacccttccggcgtatatgactttacatcac

SEQ ID NO: 134274 - DNA, 35 bp, Artificial Sequence
  Synthetic oligonucleotide
ttggcgcccctggcttacctatatgtcaatcctcc

SEQ ID NO: 134275 - DNA, 35 bp, Artificial Sequence
  Synthetic oligonucleotide
gccggccccattggtgctaccgggccacatcctcc

SEQ ID NO: 134276 - DNA, 35 bp, Artificial Sequence
  Synthetic oligonucleotide
gacgtagtagatggtgatggggtgggggcggagag

SEQ ID NO: 134277 - DNA, 35 bp, Artificial Sequence
  Synthetic oligonucleotide
tgcgatcagccctcggtcgccctgactccctttag

SEQ ID NO: 134278 - DNA, 35 bp, Artificial Sequence
  Synthetic oligonucleotide
tgggacgttccgctacgttctatgtctcttctctg

SEQ ID NO: 134279 - DNA, 35 bp, Artificial Sequence
  Synthetic oligonucleotide
gtgtgtagcccgctccccgctgccgttttcccact

SEQ ID NO: 134280 - DNA, 35 bp, Artificial Sequence
  Synthetic oligonucleotide
gatgcatcctctttcgttaccttggtcttgtcact

SEQ ID NO: 134281 - DNA, 35 bp, Artificial Sequence
  Synthetic oligonucleotide
tccctccctcacattttcatattgccgaacgacct

SEQ ID NO: 134282 - DNA, 35 bp, Artificial Sequence
  Synthetic oligonucleotide
gggaatggtgaaggcggcggacggggcggggagtt

SEQ ID NO: 134283 - DNA, 35 bp, Artificial Sequence
  Synthetic oligonucleotide
gttccacccgcatgcttatgttctccttttggttt

SEQ ID NO: 134284 - DNA, 35 bp, Artificial Sequence
  Synthetic oligonucleotide
tccgccatcacctctgcgtcaccccagattgccca

SEQ ID NO: 134285 - DNA, 36 bp, Artificial Sequence
  Synthetic oligonucleotide
gtgacacccttcggagcgtcgccatcatgcccgcca

SEQ ID NO: 134286 - DNA, 35 bp, Artificial Sequence
  Synthetic oligonucleotide
gtggaggggaagacagggatgacgagtagggagca

SEQ ID NO: 134287 - DNA, 35 bp, Artificial Sequence
  Synthetic oligonucleotide
agaacacgacgtccgggggatggggcggggggaga

SEQ ID NO: 134288 - DNA, 37 bp, Artificial Sequence
  Synthetic oligonucleotide
gatccatcgccgcccagtatcccatcgttccccacga

SEQ ID NO: 134289 - DNA, 37 bp, Artificial Sequence
  Synthetic oligonucleotide
atcaccacgcctgcctttcggctgtttctccccccga

SEQ ID NO: 134290 - DNA, 37 bp, Artificial Sequence
  Synthetic oligonucleotide
atcgagcatcatccgtccgtccacctgtttccctcga

SEQ ID NO: 134291 - DNA, 37 bp, Artificial Sequence
  Synthetic oligonucleotide
accaccaacatcacaggcatatcgccttccccttgga

SEQ ID NO: 134292 - DNA, 38 bp, Artificial Sequence
  Synthetic oligonucleotide
acccatcacagaatggtcacgtgcctctcctccgctga

SEQ ID NO: 134293 - DNA, 37 bp, Artificial Sequence
  Synthetic oligonucleotide
gaagagcacgggaggaaaaggtaacgggaataagtga

SEQ ID NO: 134294 - DNA, 38 bp, Artificial Sequence
  Synthetic oligonucleotide
gggaacgtcacggaataggggcggtaggggatgggtga

SEQ ID NO: 134295 - DNA, 35 bp, Artificial Sequence
  Synthetic oligonucleotide
tcgcccccccccacgtccggtgttgtcccgcttta

SEQ ID NO: 134296 - DNA, 35 bp, Artificial Sequence
  Synthetic oligonucleotide
tcccacgagggaacagcgggccacctctcttcacc

SEQ ID NO: 134297 - DNA, 35 bp, Artificial Sequence
  Synthetic oligonucleotide
gtctgctcgctctctagcccaatgctcccttcgcc

SEQ ID NO: 134298 - DNA, 35 bp, Artificial Sequence
  Synthetic oligonucleotide
ttgactccccgtgcgtgccctatcgatttctggcc

SEQ ID NO: 134299 - DNA, 35 bp, Artificial Sequence
  Synthetic oligonucleotide
gtgagcattcccgccgactcgactatgaactatcc

SEQ ID NO: 134300 - DNA, 29 bp, Artificial Sequence
  Synthetic oligonucleotide
aaacccacactgctccaccgatcgtttcc

SEQ ID NO: 134301 - DNA, 35 bp, Artificial Sequence
  Synthetic oligonucleotide
acgcgctatcgaatgactcttctcaacgcctccgc

SEQ ID NO: 134302 - DNA, 35 bp, Artificial Sequence
  Synthetic oligonucleotide
tccgccatcccctgcattgatctccggttttccgc

SEQ ID NO: 134303 - DNA, 35 bp, Artificial Sequence
  Synthetic oligonucleotide
gccccgcccactaagtcgtaccattacgtcccggc

SEQ ID NO: 134304 - DNA, 35 bp, Artificial Sequence
  Synthetic oligonucleotide
gagagggggaggcgggggattgcgagtcatgtgtc

SEQ ID NO: 134305 - DNA, 35 bp, Artificial Sequence
  Synthetic oligonucleotide
atcgcacacgatgtaagccacccttccgtcaattc

SEQ ID NO: 134306 - DNA, 35 bp, Artificial Sequence
  Synthetic oligonucleotide
tcacctcagccgatctacccgcctatcatctagcg

SEQ ID NO: 134307 - DNA, 35 bp, Artificial Sequence
  Synthetic oligonucleotide
atcccacgcctatcgttcccaatggccctcccact

SEQ ID NO: 134308 - DNA, 35 bp, Artificial Sequence
  Synthetic oligonucleotide
gccgagcgcccccgtttaatctccgtcacttcact

SEQ ID NO: 134309 - DNA, 35 bp, Artificial Sequence
  Synthetic oligonucleotide
gtcgcattcttcgttcgttcctagattcaccctgt

SEQ ID NO: 134310 - DNA, 36 bp, Artificial Sequence
  Synthetic oligonucleotide
gcgggggggacaaggaagggaaagctaagggagcaa

SEQ ID NO: 134311 - DNA, 36 bp, Artificial Sequence
  Synthetic oligonucleotide
tcactacccagccatcccacgcggttttttgttcca

SEQ ID NO: 134312 - DNA, 36 bp, Artificial Sequence
  Synthetic oligonucleotide
gcgtaagccggggtgggaagaggggggcggtctaga

SEQ ID NO: 134313 - DNA, 36 bp, Artificial Sequence
  Synthetic oligonucleotide
gccaggagaggaaggggcggcattgggagtggtaga

SEQ ID NO: 134314 - DNA, 37 bp, Artificial Sequence
  Synthetic oligonucleotide
gttcggtcgatctgcccgacccccgcccctttaccga

SEQ ID NO: 134315 - DNA, 37 bp, Artificial Sequence
  Synthetic oligonucleotide
gacgtcagcagccgcccgctatactcccctgtcccga

SEQ ID NO: 134316 - DNA, 36 bp, Artificial Sequence
  Synthetic oligonucleotide
tgctccgctccctgccaatccccattcccgtttcga

SEQ ID NO: 134317 - DNA, 38 bp, Artificial Sequence
  Synthetic oligonucleotide
atttgcgccgctttgttttggcgcacccctcctcctga

SEQ ID NO: 134318 - DNA, 38 bp, Artificial Sequence
  Synthetic oligonucleotide
gcaggaaggaacatggcaaaataggtggggcacggtga

SEQ ID NO: 134319 - DNA, 37 bp, Artificial Sequence
  Synthetic oligonucleotide
tcaccacaccactgtttcattcgacccactctaggta

SEQ ID NO: 134320 - DNA, 36 bp, Artificial Sequence
  Synthetic oligonucleotide
ggatgcgggagagagggggggaagtttagacatgta

SEQ ID NO: 134321 - DNA, 36 bp, Artificial Sequence
  Synthetic oligonucleotide
accgccacactagacgggtcttcttgtccactttta

SEQ ID NO: 134322 - DNA, 35 bp, Artificial Sequence
  Synthetic oligonucleotide
cacgctccctgcacggatcctcgacttgctcttac

SEQ ID NO: 134323 - DNA, 35 bp, Artificial Sequence
  Synthetic oligonucleotide
gccaatgcgcgagctctaacacccacctccgctcc

SEQ ID NO: 134324 - DNA, 35 bp, Artificial Sequence
  Synthetic oligonucleotide
tccaccctgacttgtgttgtaatgccgcccttatc

SEQ ID NO: 134325 - DNA, 35 bp, Artificial Sequence
  Synthetic oligonucleotide
gcgctaagcacgtggcgcttgtcaactctcccttc

SEQ ID NO: 134326 - DNA, 35 bp, Artificial Sequence
  Synthetic oligonucleotide
tgttcccttcgcccccatacacaccaggagccctg

SEQ ID NO: 134327 - DNA, 35 bp, Artificial Sequence
  Synthetic oligonucleotide
gacgccttcattgtcttttccctgtgcatctggtt

SEQ ID NO: 134328 - DNA, 35 bp, Artificial Sequence
  Synthetic oligonucleotide
tccgatacgccgatttgcgtcttgcctcctgcaca

SEQ ID NO: 134329 - DNA, 36 bp, Artificial Sequence
  Synthetic oligonucleotide
acaccaccttctttcagtattgacccccgtttacca

SEQ ID NO: 134330 - DNA, 36 bp, Artificial Sequence
  Synthetic oligonucleotide
tccgtctaggccgccctatgcctgtaccttttgcca

SEQ ID NO: 134331 - DNA, 36 bp, Artificial Sequence
  Synthetic oligonucleotide
ccgcaaggctcacttttactcgtccatctccatgca

SEQ ID NO: 134332 - DNA, 36 bp, Artificial Sequence
  Synthetic oligonucleotide
aatcgggagggcgggcagggtgtgcgcatttgtgca

SEQ ID NO: 134333 - DNA, 36 bp, Artificial Sequence
  Synthetic oligonucleotide
ggtcgttgcccgccgttgtcattccccgtatcctca

SEQ ID NO: 134334 - DNA, 37 bp, Artificial Sequence
  Synthetic oligonucleotide
ttgtcgaccctaatgcgtgcccctcctgccctgccga

SEQ ID NO: 134335 - DNA, 37 bp, Artificial Sequence
  Synthetic oligonucleotide
tgttggagggtgggggatggggttggatgagacgcga

SEQ ID NO: 134336 - DNA, 38 bp, Artificial Sequence
  Synthetic oligonucleotide
gactgccagtgttctgctacctctcctgccctacgtga

SEQ ID NO: 134337 - DNA, 37 bp, Artificial Sequence
  Synthetic oligonucleotide
aacaccgccatccgtcttccccttcccgcaatgttga

SEQ ID NO: 134338 - DNA, 37 bp, Artificial Sequence
  Synthetic oligonucleotide
ggggcgagactggtgtgggggcggggcgggtgtttga

SEQ ID NO: 134339 - DNA, 35 bp, Artificial Sequence
  Synthetic oligonucleotide
agcaaagcgggaaaaagggagcggaggggttggta

SEQ ID NO: 134340 - DNA, 35 bp, Artificial Sequence
  Synthetic oligonucleotide
gtcgtgtcctctgtgtcttctacttccctcccccc

SEQ ID NO: 134341 - DNA, 35 bp, Artificial Sequence
  Synthetic oligonucleotide
tgcgaccacgaccacaagcttagcgcgcctgctcc

SEQ ID NO: 134342 - DNA, 35 bp, Artificial Sequence
  Synthetic oligonucleotide
tattgcacctcgtgttcgcctgccttcgccttttc

SEQ ID NO: 134343 - DNA, 35 bp, Artificial Sequence
  Synthetic oligonucleotide
ggagtatggatggcgggagtgacgggagaaaacag

SEQ ID NO: 134344 - DNA, 35 bp, Artificial Sequence
  Synthetic oligonucleotide
tgcaactccattaataccgccgcattgtcatctcg

SEQ ID NO: 134345 - DNA, 35 bp, Artificial Sequence
  Synthetic oligonucleotide
accagccccattttaatcgcccagtcgctccattg

SEQ ID NO: 134346 - DNA, 35 bp, Artificial Sequence
  Synthetic oligonucleotide
gcaatcgggcgggcttgggggggtaagttgccttg

SEQ ID NO: 134347 - DNA, 35 bp, Artificial Sequence
  Synthetic oligonucleotide
gttcaccccgttgtcaccgtgacacctactctcat

SEQ ID NO: 134348 - DNA, 35 bp, Artificial Sequence
  Synthetic oligonucleotide
ttcgtttgccacattttgtccccttcggtttcact

SEQ ID NO: 134349 - DNA, 35 bp, Artificial Sequence
  Synthetic oligonucleotide
tgctgccacacacacagttttaccgtactatctct

SEQ ID NO: 134350 - DNA, 36 bp, Artificial Sequence
  Synthetic oligonucleotide
attgggacagaggagaagcaggaggcgaagggaaaa

SEQ ID NO: 134351 - DNA, 36 bp, Artificial Sequence
  Synthetic oligonucleotide
tcccccgtcaccgcgttgccgatatcatttaattca

SEQ ID NO: 134352 - DNA, 37 bp, Artificial Sequence
  Synthetic oligonucleotide
tgccacagggaggagtggggggggagcgggtgggaga

SEQ ID NO: 134353 - DNA, 37 bp, Artificial Sequence
  Synthetic oligonucleotide
gtggagtagcggttgaaaggcgagggaggggggtgga

SEQ ID NO: 134354 - DNA, 35 bp, Artificial Sequence
  Synthetic oligonucleotide
ggggtggaaggaagggcactgggtcgggaaaatga

SEQ ID NO: 134355 - DNA, 36 bp, Artificial Sequence
  Synthetic oligonucleotide
ttccccacccgcccaacctaaactgtcacgtaatga

SEQ ID NO: 134356 - DNA, 37 bp, Artificial Sequence
  Synthetic oligonucleotide
gtgccccctactgttgttttattatccttttccctga

SEQ ID NO: 134357 - DNA, 36 bp, Artificial Sequence
  Synthetic oligonucleotide
tgatcctgccgcacaggccccgtcaccgctgtccta

SEQ ID NO: 134358 - DNA, 35 bp, Artificial Sequence
  Synthetic oligonucleotide
atgtcgtgcttcagctcctcctgctattctgcacc

SEQ ID NO: 134359 - DNA, 35 bp, Artificial Sequence
  Synthetic oligonucleotide
atccatgttgctcctgttccggtcgtcccgctacc

SEQ ID NO: 134360 - DNA, 35 bp, Artificial Sequence
  Synthetic oligonucleotide
tcacgcagtgcaccgtccccgtccgaccaatcccc

SEQ ID NO: 134361 - DNA, 35 bp, Artificial Sequence
  Synthetic oligonucleotide
acagatgggccggctcacgatccacttccctgccc

SEQ ID NO: 134362 - DNA, 35 bp, Artificial Sequence
  Synthetic oligonucleotide
ggacgtccgcaccacccgcatgttggcacaccgcc

SEQ ID NO: 134363 - DNA, 35 bp, Artificial Sequence
  Synthetic oligonucleotide
gtcggaggcttctgttctcgtctaccctgttcgcc

SEQ ID NO: 134364 - DNA, 35 bp, Artificial Sequence
  Synthetic oligonucleotide
acgtgtgagcggtcgctcgtcccttctttcgatcc

SEQ ID NO: 134365 - DNA, 35 bp, Artificial Sequence
  Synthetic oligonucleotide
tacgttgaccgcccaacttgatctgcccgtactcc

SEQ ID NO: 134366 - DNA, 35 bp, Artificial Sequence
  Synthetic oligonucleotide
tcaccaccgtcgtctaggcctcagtgactccccgc

SEQ ID NO: 134367 - DNA, 35 bp, Artificial Sequence
  Synthetic oligonucleotide
tgccgctgtcctgactctcttctatcgactactgc

SEQ ID NO: 134368 - DNA, 34 bp, Artificial Sequence
  Synthetic oligonucleotide
ggaccataccctgattccttccctccaccgttgc

SEQ ID NO: 134369 - DNA, 35 bp, Artificial Sequence
  Synthetic oligonucleotide
taagagccggcggggggaatgaggtaggctgctag

SEQ ID NO: 134370 - DNA, 35 bp, Artificial Sequence
  Synthetic oligonucleotide
ttaccgctgccgccgcctcctcattactgttccct

SEQ ID NO: 134371 - DNA, 35 bp, Artificial Sequence
  Synthetic oligonucleotide
tccatggtaacggccccttcagtttcatccacctt

SEQ ID NO: 134372 - DNA, 35 bp, Artificial Sequence
  Synthetic oligonucleotide
accacccacgctgcctcccagtactcaccgcacaa

SEQ ID NO: 134373 - DNA, 35 bp, Artificial Sequence
  Synthetic oligonucleotide
acgtctagccacacccgtgctatcccctctgtgaa

SEQ ID NO: 134374 - DNA, 35 bp, Artificial Sequence
  Synthetic oligonucleotide
ttgacaacatctaagcgttctgctacccgttccca

SEQ ID NO: 134375 - DNA, 36 bp, Artificial Sequence
  Synthetic oligonucleotide
acctgcgctgccacgaattgtcaccgccctcatcca

SEQ ID NO: 134376 - DNA, 35 bp, Artificial Sequence
  Synthetic oligonucleotide
gagtcagagctcccgccttgcccgctattcgctca

SEQ ID NO: 134377 - DNA, 38 bp, Artificial Sequence
  Synthetic oligonucleotide
ggggggtgagttgagagtagagggacacggcaggacga

SEQ ID NO: 134378 - DNA, 37 bp, Artificial Sequence
  Synthetic oligonucleotide
tccgatgcgcccggctaccattgcgcttgttccccga

SEQ ID NO: 134379 - DNA, 37 bp, Artificial Sequence
  Synthetic oligonucleotide
atgtagccgagaggggaagaaggagatggggtgatga

SEQ ID NO: 134380 - DNA, 38 bp, Artificial Sequence
  Synthetic oligonucleotide
gtagtaggagggggtgggaagtggtttggtggaactga

SEQ ID NO: 134381 - DNA, 38 bp, Artificial Sequence
  Synthetic oligonucleotide
agatggggccgggggggtaaaggggttgtggccggtga

SEQ ID NO: 134382 - DNA, 36 bp, Artificial Sequence
  Synthetic oligonucleotide
ggtgggggaacaggtaaaatcggcggaggtgggtga

SEQ ID NO: 134383 - DNA, 35 bp, Artificial Sequence
  Synthetic oligonucleotide
gccttaacgcacctgtcgttcccctctggatcacc

SEQ ID NO: 134384 - DNA, 35 bp, Artificial Sequence
  Synthetic oligonucleotide
gaccccacctgtgccataatccgatgccggcctcc

SEQ ID NO: 134385 - DNA, 35 bp, Artificial Sequence; identical to SEQ ID NO: 56463
  Synthetic oligonucleotide

SEQ ID NO: 134386 - DNA, 35 bp, Artificial Sequence
  Synthetic oligonucleotide
tgatgactcccccggcctcttgacgtttgacgctc

SEQ ID NO: 134387 - DNA, 35 bp, Artificial Sequence
  Synthetic oligonucleotide
gcaccgccgctaatgccgtcgccatcctaacagtc

SEQ ID NO: 134388 - DNA, 35 bp, Artificial Sequence
  Synthetic oligonucleotide
gcctcacactgctgcaaccccatatgggccctcct

SEQ ID NO: 134389 - DNA, 35 bp, Artificial Sequence
  Synthetic oligonucleotide
tttgggcctgccacctgtctatagttctctgtcct

SEQ ID NO: 134390 - DNA, 35 bp, Artificial Sequence
  Synthetic oligonucleotide
acgcaatcggccttactcccccttcctcccgtggt

SEQ ID NO: 134391 - DNA, 35 bp, Artificial Sequence
  Synthetic oligonucleotide
tccgaggcccactgatctaacccaagtctccctgt

SEQ ID NO: 134392 - DNA, 35 bp, Artificial Sequence
  Synthetic oligonucleotide
aaggatgtgccactcgacgcccactatatgccctt

SEQ ID NO: 134393 - DNA, 35 bp, Artificial Sequence
  Synthetic oligonucleotide
agctcccgtccaggctctcatctcctccctacgca

SEQ ID NO: 134394 - DNA, 36 bp, Artificial Sequence
  Synthetic oligonucleotide
tcagccctccggaatcatgctaccactcgtactcga

SEQ ID NO: 134395 - DNA, 37 bp, Artificial Sequence
  Synthetic oligonucleotide
tggaacgtcacacgattcatacacacccctgcctcga

SEQ ID NO: 134396 - DNA, 37 bp, Artificial Sequence
  Synthetic oligonucleotide
acccgcaccccagctggcccgttctatctcacgctga

SEQ ID NO: 134397 - DNA, 38 bp, Artificial Sequence
  Synthetic oligonucleotide
tccccgcacccgctattatttcgacgtgggtccattga

SEQ ID NO: 134398 - DNA, 37 bp, Artificial Sequence
  Synthetic oligonucleotide
atcgccaacgcccccatcggttaatcctccttcttga

SEQ ID NO: 134399 - DNA, 36 bp, Artificial Sequence
  Synthetic oligonucleotide
agccgcagtgttgtttcgtttccgccgcctacctta

SEQ ID NO: 134400 - DNA, 35 bp, Artificial Sequence
  Synthetic oligonucleotide
gactcctgcgctcaaaccggttctcgtcctttcac

SEQ ID NO: 134401 - DNA, 35 bp, Artificial Sequence
  Synthetic oligonucleotide
tatgacccccccgactgaccattgcacgtcgcacc

SEQ ID NO: 134402 - DNA, 35 bp, Artificial Sequence
  Synthetic oligonucleotide
atagccgcgcggtctcccatctggcattccaactc

SEQ ID NO: 134403 - DNA, 35 bp, Artificial Sequence
  Synthetic oligonucleotide
acgaatcggttccgccctgctaataactggccttc

SEQ ID NO: 134404 - DNA, 35 bp, Artificial Sequence
  Synthetic oligonucleotide
aagtgctgtccgtctgtcccctgtcccgccttttc

SEQ ID NO: 134405 - DNA, 35 bp, Artificial Sequence
  Synthetic oligonucleotide
gtgcaagctccatctcacgcggacccctgtgccat

SEQ ID NO: 134406 - DNA, 35 bp, Artificial Sequence
  Synthetic oligonucleotide
accacatacgggcactgtacaacctagcctcccct

SEQ ID NO: 134407 - DNA, 35 bp, Artificial Sequence
  Synthetic oligonucleotide
ggatccaccgacattagcgttttaaattcctccct

SEQ ID NO: 134408 - DNA, 35 bp, Artificial Sequence
  Synthetic oligonucleotide
gtacctggtcgcgtatcgagttcttccctccctgt

SEQ ID NO: 134409 - DNA, 35 bp, Artificial Sequence
  Synthetic oligonucleotide
gacgcctcctcccttctctaaggacttggcctatt

SEQ ID NO: 134410 - DNA, 35 bp, Artificial Sequence
  Synthetic oligonucleotide
tgtccactctccttttgccgatcgacacccccctt

SEQ ID NO: 134411 - DNA, 35 bp, Artificial Sequence
  Synthetic oligonucleotide
aaccgacgcagagctctcattctgcctttcccctt

SEQ ID NO: 134412 - DNA, 35 bp, Artificial Sequence
  Synthetic oligonucleotide
gctcgccagcccaagcccccgtccgcaagctcctt

SEQ ID NO: 134413 - DNA, 35 bp, Artificial Sequence
  Synthetic oligonucleotide
gccctcacctacccacttgtcacgcttgtctcgtt

SEQ ID NO: 134414 - DNA, 36 bp, Artificial Sequence
  Synthetic oligonucleotide
agacctggcgcccgcaccaccgttcctcttagtcaa

SEQ ID NO: 134415 - DNA, 36 bp, Artificial Sequence
  Synthetic oligonucleotide
tctgcctccattgtccaactgtcattcctagcctaa

SEQ ID NO: 134416 - DNA, 35 bp, Artificial Sequence
  Synthetic oligonucleotide
aaccccacacccgctcccgaaagaatgcctttgca

SEQ ID NO: 134417 - DNA, 37 bp, Artificial Sequence
  Synthetic oligonucleotide
acccccgcctcgcactacgcgcatttgaccacgccga

SEQ ID NO: 134418 - DNA, 37 bp, Artificial Sequence
  Synthetic oligonucleotide
acacccgcctgttgcgcatacgtcgctccttgccgga

SEQ ID NO: 134419 - DNA, 38 bp, Artificial Sequence
  Synthetic oligonucleotide
acccctcgcccctgtctgtgaaccttctctcttcctga

SEQ ID NO: 134420 - DNA, 35 bp, Artificial Sequence
  Synthetic oligonucleotide
gtggacgaccacccgctacccttcgccaattggcc

SEQ ID NO: 134421 - DNA, 35 bp, Artificial Sequence
  Synthetic oligonucleotide
gtggatgcgacacacacgacgcgcgccctaactcc

SEQ ID NO: 134422 - DNA, 35 bp, Artificial Sequence
  Synthetic oligonucleotide
tagccagatggtatgccccctcctgtagttcctcc

SEQ ID NO: 134423 - DNA, 35 bp, Artificial Sequence
  Synthetic oligonucleotide
gttgatcgcggtctcctccctgccacacgacttcc

SEQ ID NO: 134424 - DNA, 35 bp, Artificial Sequence
  Synthetic oligonucleotide
accgttcccgccacaccgttgtcattatgcctctc

SEQ ID NO: 134425 - DNA, 35 bp, Artificial Sequence
  Synthetic oligonucleotide
gactccggaatgccgcatgtcacagttcccttctc

SEQ ID NO: 134426 - DNA, 35 bp, Artificial Sequence
  Synthetic oligonucleotide
gagccgtcccgtctgctgcctccgctatcccctgg

SEQ ID NO: 134427 - DNA, 35 bp, Artificial Sequence
  Synthetic oligonucleotide
ttcgttccaactgccctgttcctagtcgctctgct

SEQ ID NO: 134428 - DNA, 35 bp, Artificial Sequence
  Synthetic oligonucleotide
ttcgttgcaccgcccaccctgaagatcgttcctgt

SEQ ID NO: 134429 - DNA, 36 bp, Artificial Sequence
  Synthetic oligonucleotide
acacgaccccgctccaacctctgcctctcaggacaa

SEQ ID NO: 134430 - DNA, 36 bp, Artificial Sequence
  Synthetic oligonucleotide
acactccccccccggactgtgcgacgaggcccccca

SEQ ID NO: 134431 - DNA, 37 bp, Artificial Sequence
  Synthetic oligonucleotide
tcttttggcggtggcgagtgcaggtggctggtgggga

SEQ ID NO: 134432 - DNA, 37 bp, Artificial Sequence
  Synthetic oligonucleotide
tgtctagtccgtccgtccccaagccctcgccccctga

SEQ ID NO: 134433 - DNA, 35 bp, Artificial Sequence
  Synthetic oligonucleotide
tacgcgcaatcacatacggtctcgccccgcccaac

SEQ ID NO: 134434 - DNA, 35 bp, Artificial Sequence
  Synthetic oligonucleotide
gtggtgtccggtccgtctttgatcccgcgttaacc

SEQ ID NO: 134435 - DNA, 35 bp, Artificial Sequence
  Synthetic oligonucleotide
gcctcaccgcatctcttgtggtcctaccacacccc

SEQ ID NO: 134436 - DNA, 35 bp, Artificial Sequence
  Synthetic oligonucleotide
tccagacatcacataacggccctcgtcctatcgcc

SEQ ID NO: 134437 - DNA, 35 bp, Artificial Sequence
  Synthetic oligonucleotide
gcaacctccctggcgaatcttgaccctatccctcc

SEQ ID NO: 134438 - DNA, 35 bp, Artificial Sequence
  Synthetic oligonucleotide
gaccggcccacaataatgctacgaatactgcctcc

SEQ ID NO: 134439 - DNA, 35 bp, Artificial Sequence
  Synthetic oligonucleotide
gcaagggggtaggatgccatgagggtggatggagg

SEQ ID NO: 134440 - DNA, 35 bp, Artificial Sequence
  Synthetic oligonucleotide
tgatgactcctcgtgctccacccctttggttccat

SEQ ID NO: 134441 - DNA, 35 bp, Artificial Sequence
  Synthetic oligonucleotide
gcagtcagcgggagggaggttcggggcgggaatat

SEQ ID NO: 134442 - DNA, 35 bp, Artificial Sequence
  Synthetic oligonucleotide
gcacccctgcgtattaatccaccgcgcaactacct

SEQ ID NO: 134443 - DNA, 35 bp, Artificial Sequence
  Synthetic oligonucleotide
gtgcgtgctcacccccttcgtatccctcgcgcgct

SEQ ID NO: 134444 - DNA, 35 bp, Artificial Sequence
  Synthetic oligonucleotide
tgttccactgtcttctccatatagccccgactcgt

SEQ ID NO: 134445 - DNA, 36 bp, Artificial Sequence
  Synthetic oligonucleotide
gtcaccacgcccttccaccatgtcttcaggtccatt

SEQ ID NO: 134446 - DNA, 35 bp, Artificial Sequence
  Synthetic oligonucleotide
atccttcgccactcgcctttgagccctgagccgtt

SEQ ID NO: 134447 - DNA, 35 bp, Artificial Sequence
  Synthetic oligonucleotide
atccctccccagtcctttagtagacgtgccaccca

SEQ ID NO: 134448 - DNA, 36 bp, Artificial Sequence
  Synthetic oligonucleotide
gccaccctgcattctccattgatttgactcgtccca

SEQ ID NO: 134449 - DNA, 36 bp, Artificial Sequence
  Synthetic oligonucleotide
acccgccccccgcatctgaagtcccacccgcgaaga

SEQ ID NO: 134450 - DNA, 36 bp, Artificial Sequence
  Synthetic oligonucleotide
tgtgcccaccccattgccacagtttcgtttctccga

SEQ ID NO: 134451 - DNA, 37 bp, Artificial Sequence
  Synthetic oligonucleotide
agattcgatggagggaagggagtgcggggtaggggga

SEQ ID NO: 134452 - DNA, 37 bp, Artificial Sequence
  Synthetic oligonucleotide
tcagactgccctcgctacataccctcgctgatcctga

SEQ ID NO: 134453 - DNA, 38 bp, Artificial Sequence
  Synthetic oligonucleotide
tagggaaacgcgccaacactcccctcctccggttgtga

SEQ ID NO: 134454 - DNA, 36 bp, Artificial Sequence
  Synthetic oligonucleotide
gcccatccctacgatcgcttttggactacctccata

SEQ ID NO: 134455 - DNA, 36 bp, Artificial Sequence
  Synthetic oligonucleotide
tgatctgcatccacggtctcgtaacttgctgcccta

SEQ ID NO: 134456 - DNA, 35 bp, Artificial Sequence
  Synthetic oligonucleotide
ttgatcacccacagtcccgcatcagccccatcgcc

SEQ ID NO: 134457 - DNA, 35 bp, Artificial Sequence
  Synthetic oligonucleotide
tgcttagcctgcccgaatgactccaactagctgcc

SEQ ID NO: 134458 - DNA, 35 bp, Artificial Sequence
  Synthetic oligonucleotide
ttatccctgtgaccgcctgttttgctcccgactcc

SEQ ID NO: 134459 - DNA, 35 bp, Artificial Sequence
  Synthetic oligonucleotide
gcaccatgaaattccgtctttgcgacctctcttcc

SEQ ID NO: 134460 - DNA, 35 bp, Artificial Sequence
  Synthetic oligonucleotide
tcttacagccccccttcctactgctcgtcacaccg

SEQ ID NO: 134461 - DNA, 35 bp, Artificial Sequence
  Synthetic oligonucleotide
tagtctacatcacgtccattcctccgttcacctcg

SEQ ID NO: 134462 - DNA, 35 bp, Artificial Sequence
  Synthetic oligonucleotide
tcaagccgggatgaggatgggacggggtggtcggg

SEQ ID NO: 134463 - DNA, 35 bp, Artificial Sequence
  Synthetic oligonucleotide
tcggcctgcctcagccacatcaccctcctgttctg

SEQ ID NO: 134464 - DNA, 35 bp, Artificial Sequence
  Synthetic oligonucleotide
acacaccacctaacatgttcgccgttacgctcttg

SEQ ID NO: 134465 - DNA, 35 bp, Artificial Sequence
  Synthetic oligonucleotide
tcctgatgtcacgcttgcctcgttccaactacact

SEQ ID NO: 134466 - DNA, 35 bp, Artificial Sequence
  Synthetic oligonucleotide
acactgcctcgtatatattttctcgtctccccgca

SEQ ID NO: 134467 - DNA, 36 bp, Artificial Sequence
  Synthetic oligonucleotide
acgtacctcctgccctgcaacaagacccgaagttca

SEQ ID NO: 134468 - DNA, 36 bp, Artificial Sequence
  Synthetic oligonucleotide
tgcctacccctccgcgccttttcgtaggttgtttca

SEQ ID NO: 134469 - DNA, 37 bp, Artificial Sequence
  Synthetic oligonucleotide
ggtgacgaagaggtagggattgtggaggggggaacga

SEQ ID NO: 134470 - DNA, 36 bp, Artificial Sequence
  Synthetic oligonucleotide
atccttccctgcctgtgcctccatgtgccattccga

SEQ ID NO: 134471 - DNA, 37 bp, Artificial Sequence
  Synthetic oligonucleotide
aagggggcggtggggatggtcacatattttggatgga

SEQ ID NO: 134472 - DNA, 35 bp, Artificial Sequence
  Synthetic oligonucleotide
aatccgcccccaacccccgctgtccacggcgtgga

SEQ ID NO: 134473 - DNA, 37 bp, Artificial Sequence
  Synthetic oligonucleotide
gccacctccgacttgctattcgaatatccttttatga

SEQ ID NO: 134474 - DNA, 36 bp, Artificial Sequence
  Synthetic oligonucleotide
accaccttccatctggtccgacgatacactgctata

SEQ ID NO: 134475 - DNA, 35 bp, Artificial Sequence
  Synthetic oligonucleotide
ggacacagctcagatcatcccgccctccctgtata

SEQ ID NO: 134476 - DNA, 35 bp, Artificial Sequence
  Synthetic oligonucleotide
gaccatagcctcctgcactgacctgtatgcttacc

SEQ ID NO: 134477 - DNA, 35 bp, Artificial Sequence
  Synthetic oligonucleotide
acccccggctcggattatcttggtttctcgtcccg

SEQ ID NO: 134478 - DNA, 35 bp, Artificial Sequence
  Synthetic oligonucleotide
atgatccaccctcgacacacgcattcctcactccg

SEQ ID NO: 134479 - DNA, 35 bp, Artificial Sequence
  Synthetic oligonucleotide
aagaatcgtgaaaggggggagggtaagggggcggg

SEQ ID NO: 134480 - DNA, 34 bp, Artificial Sequence
  Synthetic oligonucleotide
tggagtgcatcaccccatcttttccgcctccgtg

SEQ ID NO: 134481 - DNA, 35 bp, Artificial Sequence
  Synthetic oligonucleotide
tcaccctgacgccatgttcctcgatacgatctttg

SEQ ID NO: 134482 - DNA, 35 bp, Artificial Sequence
  Synthetic oligonucleotide
tgccaggccttgtgaccacatccctctccacttct

SEQ ID NO: 134483 - DNA, 35 bp, Artificial Sequence
  Synthetic oligonucleotide
ttgcccccgtgacccagtgccactcgcttgccctt

SEQ ID NO: 134484 - DNA, 35 bp, Artificial Sequence
  Synthetic oligonucleotide
gtggagaagggggggaaacaggaggacgtggcgtt

SEQ ID NO: 134485 - DNA, 35 bp, Artificial Sequence
  Synthetic oligonucleotide
gaccacaccgcctgcttcctggcatatcagttttt

SEQ ID NO: 134486 - DNA, 33 bp, Artificial Sequence
  Synthetic oligonucleotide
taactccccactctgacgcctgctttagacaaa

SEQ ID NO: 134487 - DNA, 36 bp, Artificial Sequence
  Synthetic oligonucleotide
tgccacctgtgcgtatatatccgctcgccatctaca

SEQ ID NO: 134488 - DNA, 35 bp, Artificial Sequence
  Synthetic oligonucleotide
gcacaccgctcagtggcgctgttcgtttctcctca

SEQ ID NO: 134489 - DNA, 36 bp, Artificial Sequence
  Synthetic oligonucleotide
gaccttccgggccgctgcatgccttgttcttaccga

SEQ ID NO: 134490 - DNA, 35 bp, Artificial Sequence
  Synthetic oligonucleotide
taggggcagaaggggaaggaggcatgtagcagcga

SEQ ID NO: 134491 - DNA, 32 bp, Artificial Sequence
  Synthetic oligonucleotide
acaccccgattgccccccactacttccgagga

SEQ ID NO: 134492 - DNA, 37 bp, Artificial Sequence
  Synthetic oligonucleotide
gtcccgccgcccacacaacactcccacgatccccgga

SEQ ID NO: 134493 - DNA, 38 bp, Artificial Sequence
  Synthetic oligonucleotide
gagggtgggtggacaggggagggattaagcaaggatga

SEQ ID NO: 134494 - DNA, 37 bp, Artificial Sequence
  Synthetic oligonucleotide
gttcaccgtcgcatcacatcacggacgccccacctga

SEQ ID NO: 134495 - DNA, 35 bp, Artificial Sequence
  Synthetic oligonucleotide
ggttgggaggtgtgggggagcgaggagggggctga

SEQ ID NO: 134496 - DNA, 37 bp, Artificial Sequence
  Synthetic oligonucleotide
tacggaccatcccccgccctccgcatcacccttctga

SEQ ID NO: 134497 - DNA, 35 bp, Artificial Sequence
  Synthetic oligonucleotide
tcattatggcgggggaagggtgggcggaggggtga

SEQ ID NO: 134498 - DNA, 38 bp, Artificial Sequence
  Synthetic oligonucleotide
accacccctcggcactcccgctggctccattctcttga

SEQ ID NO: 134499 - DNA, 37 bp, Artificial Sequence
  Synthetic oligonucleotide
tgaccctccgctgcttatgcccttaccgaagttttga

SEQ ID NO: 134500 - DNA, 35 bp, Artificial Sequence
  Synthetic oligonucleotide
tccgacccgacccttacctttgcacccgttgtcta

SEQ ID NO: 134501 - DNA, 36 bp, Artificial Sequence
  Synthetic oligonucleotide
gccgatcggtttgcagccataccaccacctcttgta

SEQ ID NO: 134502 - DNA, 36 bp, Artificial Sequence
  Synthetic oligonucleotide
tactcgccaacatgttgcaaacctccctttccgtta

SEQ ID NO: 134503 - DNA, 35 bp, Artificial Sequence
  Synthetic oligonucleotide
atccgagcaccgagacgctccacccctccattcac

SEQ ID NO: 134504 - DNA, 35 bp, Artificial Sequence
  Synthetic oligonucleotide
acccctcccccatcggcgtttgtcccatgaatacc

SEQ ID NO: 134505 - DNA, 35 bp, Artificial Sequence
  Synthetic oligonucleotide
tgtcgtgcaccaaatccgtacctccctcacgcgcc

SEQ ID NO: 134506 - DNA, 35 bp, Artificial Sequence
  Synthetic oligonucleotide
tccaaaccgcgcatgtttaattcgtcgcacccatc

SEQ ID NO: 134507 - DNA, 35 bp, Artificial Sequence
  Synthetic oligonucleotide
tgttagccagatctggtgctctactgcttctcctc

SEQ ID NO: 134508 - DNA, 35 bp, Artificial Sequence
  Synthetic oligonucleotide
taaagcccccggccctccacccagtccgtactctg

SEQ ID NO: 134509 - DNA, 36 bp, Artificial Sequence
  Synthetic oligonucleotide
tccgtcctcccctgacgtgttcagtgcccttccaat

SEQ ID NO: 134510 - DNA, 35 bp, Artificial Sequence
  Synthetic oligonucleotide
atcatggccacgtctgctaatattgtcaccctcct

SEQ ID NO: 134511 - DNA, 35 bp, Artificial Sequence
  Synthetic oligonucleotide
tgtcaccccgtcctacgtagtaccaccgctctgtt

SEQ ID NO: 134512 - DNA, 36 bp, Artificial Sequence
  Synthetic oligonucleotide
ttgtccgcccatccgtctcgccatccaagccccgaa

SEQ ID NO: 134513 - DNA, 36 bp, Artificial Sequence
  Synthetic oligonucleotide
gccggtggaggtggtggtgggggtggttttactgaa

SEQ ID NO: 134514 - DNA, 36 bp, Artificial Sequence
  Synthetic oligonucleotide
gaggttgtgcacctctgtctaccctgccctgcctaa

SEQ ID NO: 134515 - DNA, 36 bp, Artificial Sequence
  Synthetic oligonucleotide
acttcacccgcctcaccgagttcctttgcttgctaa

SEQ ID NO: 134516 - DNA, 36 bp, Artificial Sequence
  Synthetic oligonucleotide
gtgatccgcacactagttaatgctcccatccatcca

SEQ ID NO: 134517 - DNA, 36 bp, Artificial Sequence
  Synthetic oligonucleotide
acatcaccgccctgtccttcccaagctgaacagtca

SEQ ID NO: 134518 - DNA, 37 bp, Artificial Sequence
  Synthetic oligonucleotide
tgagtggggatagggggagcatgggtgaaagcggaga

SEQ ID NO: 134519 - DNA, 37 bp, Artificial Sequence
  Synthetic oligonucleotide
gcaggtcggtacaggtagggaggaattggaggggaga

SEQ ID NO: 134520 - DNA, 37 bp, Artificial Sequence
  Synthetic oligonucleotide
gcggggggcgggtaggattggggcccttagtagggga

SEQ ID NO: 134521 - DNA, 37 bp, Artificial Sequence
  Synthetic oligonucleotide
atcacagcctgagtgacgggttatgggacgggtggga

SEQ ID NO: 134522 - DNA, 36 bp, Artificial Sequence
  Synthetic oligonucleotide
gtcggaatagggtggaggaggggtcgggtggatgga

SEQ ID NO: 134523 - DNA, 38 bp, Artificial Sequence
  Synthetic oligonucleotide
gtagaatggaatgggcaaaggggtgggaggggacatga

SEQ ID NO: 134524 - DNA, 37 bp, Artificial Sequence
  Synthetic oligonucleotide
tcccaccctccggagttagcacctgttctacctatga

SEQ ID NO: 134525 - DNA, 36 bp, Artificial Sequence
  Synthetic oligonucleotide
ttgtccacgcttgttcctcgcaaccgcccctccgta

SEQ ID NO: 134526 - DNA, 35 bp, Artificial Sequence
  Synthetic oligonucleotide
gaacgctcagtcgcatcactttaggccctccctta

SEQ ID NO: 134527 - DNA, 35 bp, Artificial Sequence
  Synthetic oligonucleotide
attcgcctcacccgcatacgcttgacctatagccc

SEQ ID NO: 134528 - DNA, 35 bp, Artificial Sequence
  Synthetic oligonucleotide
tcagaacgtcctgcatttcaattcgcttaccgccc

SEQ ID NO: 134529 - DNA, 35 bp, Artificial Sequence
  Synthetic oligonucleotide
gcgctacctcctatcttatcgtgaatggctttccc

SEQ ID NO: 134530 - DNA, 35 bp, Artificial Sequence
  Synthetic oligonucleotide
tatatgccgcctggcgtaaaacatcacgtgcctcc

SEQ ID NO: 134531 - DNA, 35 bp, Artificial Sequence
  Synthetic oligonucleotide
agtcacaagcagtgtttccccatcgttcacgctcc

SEQ ID NO: 134532 - DNA, 35 bp, Artificial Sequence
  Synthetic oligonucleotide
tgtgccctcacccagtcatcactagccaactttgc

SEQ ID NO: 134533 - DNA, 35 bp, Artificial Sequence
  Synthetic oligonucleotide
tagcccgccccttccactcgagggtacaaactctc

SEQ ID NO: 134534 - DNA, 35 bp, Artificial Sequence
  Synthetic oligonucleotide
gacaccgtggtttgcgccccaacttatcacctctc

SEQ ID NO: 134535 - DNA, 35 bp, Artificial Sequence
  Synthetic oligonucleotide
atgaccctatgtcactccccctggcctccctggtc

SEQ ID NO: 134536 - DNA, 35 bp, Artificial Sequence
  Synthetic oligonucleotide
gtggtacctgcgatgtgctgtcctgtcctcgcttc

SEQ ID NO: 134537 - DNA, 35 bp, Artificial Sequence
  Synthetic oligonucleotide
tcccggaagaaggagaggagggacggacgagcacg

SEQ ID NO: 134538 - DNA, 35 bp, Artificial Sequence
  Synthetic oligonucleotide
acacgggcacgcccctgctccgtaaaaatcacccg

SEQ ID NO: 134539 - DNA, 35 bp, Artificial Sequence
  Synthetic oligonucleotide
gccgccttccccctgttgccgcgtggggccctccg

SEQ ID NO: 134540 - DNA, 35 bp, Artificial Sequence
  Synthetic oligonucleotide
attgggcgggtgtgggcgggaaagacttgccaaat

SEQ ID NO: 134541 - DNA, 35 bp, Artificial Sequence
  Synthetic oligonucleotide
gttccgccccgaacgtgagcattcgttcttttcct

SEQ ID NO: 134542 - DNA, 35 bp, Artificial Sequence
  Synthetic oligonucleotide
tctccccgcccccctgtataccgttgccattcggt

SEQ ID NO: 134543 - DNA, 35 bp, Artificial Sequence
  Synthetic oligonucleotide
tcaccctaccatccagcgtaatagtcctgtccgaa

SEQ ID NO: 134544 - DNA, 36 bp, Artificial Sequence
  Synthetic oligonucleotide
ttccacctcaccagaccctgtgtctctctcaccgca

SEQ ID NO: 134545 - DNA, 36 bp, Artificial Sequence
  Synthetic oligonucleotide
tcacctgccaatcctgtaaacctgacaccatcctca

SEQ ID NO: 134546 - DNA, 36 bp, Artificial Sequence
  Synthetic oligonucleotide
accccgctcatcgccacacggacacctcgatcttca

SEQ ID NO: 134547 - DNA, 37 bp, Artificial Sequence
  Synthetic oligonucleotide
ggaggtcgggagagggacggaagggggggtgacgcga

SEQ ID NO: 134548 - DNA, 36 bp, Artificial Sequence
  Synthetic oligonucleotide
actgaaggggaccagggagggggccagggggcggga

SEQ ID NO: 134549 - DNA, 37 bp, Artificial Sequence
  Synthetic oligonucleotide
acgaaagacgggaaggagggggaacaaaaggtactga

SEQ ID NO: 134550 - DNA, 36 bp, Artificial Sequence
  Synthetic oligonucleotide
ttccgcgcccctagctctttcctccacctctgctga

SEQ ID NO: 134551 - DNA, 37 bp, Artificial Sequence
  Synthetic oligonucleotide
atttcacccacactatgctctttatggccatctttga

SEQ ID NO: 134552 - DNA, 36 bp, Artificial Sequence
  Synthetic oligonucleotide
gtggaaagcctgttggggaaggtgaagggggggtta

SEQ ID NO: 134553 - DNA, 35 bp, Artificial Sequence
  Synthetic oligonucleotide
gtgccccttctggtggctacacataccttttcaac

SEQ ID NO: 134554 - DNA, 35 bp, Artificial Sequence
  Synthetic oligonucleotide
gataccgccacttgaccccctttgcattagtccac

SEQ ID NO: 134555 - DNA, 35 bp, Artificial Sequence
  Synthetic oligonucleotide
gccgccaccatcacgtcgaggtccgaccaccaccc

SEQ ID NO: 134556 - DNA, 35 bp, Artificial Sequence
  Synthetic oligonucleotide
ggcccatggccattgtgcaacaccaccacactccc

SEQ ID NO: 134557 - DNA, 35 bp, Artificial Sequence
  Synthetic oligonucleotide
gcaccctagacgccctttgcccgccgtaagccgcc

SEQ ID NO: 134558 - DNA, 35 bp, Artificial Sequence
  Synthetic oligonucleotide
tccgggaccgtcgtttgttctcctacaccccgcgc

SEQ ID NO: 134559 - DNA, 35 bp, Artificial Sequence
  Synthetic oligonucleotide
tctccatccaccatgctatgtgcgtatgccttcgc

SEQ ID NO: 134560 - DNA, 35 bp, Artificial Sequence
  Synthetic oligonucleotide
accacccacgcccccccctcatttcaatgggtctc

SEQ ID NO: 134561 - DNA, 35 bp, Artificial Sequence
  Synthetic oligonucleotide
gccgcccctattccggataaccgactcctcgtgcg

SEQ ID NO: 134562 - DNA, 35 bp, Artificial Sequence
  Synthetic oligonucleotide
tgtcccccacgccccttgccagcaacagctaacat

SEQ ID NO: 134563 - DNA, 35 bp, Artificial Sequence
  Synthetic oligonucleotide
agacccttcgattcgcgtacacccgtctggcccct

SEQ ID NO: 134564 - DNA, 35 bp, Artificial Sequence
  Synthetic oligonucleotide
tcccctactcgccgttcccgtcaacgctccttcgt

SEQ ID NO: 134565 - DNA, 35 bp, Artificial Sequence
  Synthetic oligonucleotide
tgtgatcccgcgatgctcttgttcttttgcccttt

SEQ ID NO: 134566 - DNA, 35 bp, Artificial Sequence
  Synthetic oligonucleotide
gaaggccgggctcccctccgccatccgttccccca

SEQ ID NO: 134567 - DNA, 35 bp, Artificial Sequence
  Synthetic oligonucleotide
ggtctcggcgcccgtcctacttagtcccgtgccca

SEQ ID NO: 134568 - DNA, 36 bp, Artificial Sequence
  Synthetic oligonucleotide
ggtgcgccacgtagtttcgccggttacgctcctcca

SEQ ID NO: 134569 - DNA, 35 bp, Artificial Sequence
  Synthetic oligonucleotide
gagtgccccgcccttctggattccctttctactca

SEQ ID NO: 134570 - DNA, 37 bp, Artificial Sequence
  Synthetic oligonucleotide
acgccatcctgaccgctttgtttcaccccctgtacga

SEQ ID NO: 134571 - DNA, 36 bp, Artificial Sequence
  Synthetic oligonucleotide
ttgcactcgcccccctgtttttagcattcgcacgga

SEQ ID NO: 134572 - DNA, 37 bp, Artificial Sequence
  Synthetic oligonucleotide
aagcaggggacaagggcggctagggggaactcacgga

SEQ ID NO: 134573 - DNA, 37 bp, Artificial Sequence
  Synthetic oligonucleotide
gtccacccgctcgtgccctgtttgctttactttctga

SEQ ID NO: 134574 - DNA, 38 bp, Artificial Sequence
  Synthetic oligonucleotide
gtgtcagggagggaggccggtaggaagtatgggggtga

SEQ ID NO: 134575 - DNA, 35 bp, Artificial Sequence
  Synthetic oligonucleotide
tactgcccatccttcccccgccgtttagcagttga

SEQ ID NO: 134576 - DNA, 35 bp, Artificial Sequence
  Synthetic oligonucleotide
gtagcgtgcactgtctgctgcccccgcccatttta

SEQ ID NO: 134577 - DNA, 35 bp, Artificial Sequence
  Synthetic oligonucleotide
gtacacgcatccggggctccatacctcacgctaac

SEQ ID NO: 134578 - DNA, 35 bp, Artificial Sequence
  Synthetic oligonucleotide
accccgtctcgctccacaagccaccgggttcatac

SEQ ID NO: 134579 - DNA, 35 bp, Artificial Sequence
  Synthetic oligonucleotide
tcgcccactagcatatgtggccccctgctttcacc

SEQ ID NO: 134580 - DNA, 33 bp, Artificial Sequence
  Synthetic oligonucleotide
agacatccatccttctcccggcgacttgccccc

SEQ ID NO: 134581 - DNA, 35 bp, Artificial Sequence
  Synthetic oligonucleotide
ttccaccctgatgcttaccggattctgcctgtgcc

SEQ ID NO: 134582 - DNA, 35 bp, Artificial Sequence
  Synthetic oligonucleotide
gacgcgggtacgatgggctcgggagggctcggtcc

SEQ ID NO: 134583 - DNA, 35 bp, Artificial Sequence
  Synthetic oligonucleotide
atccagcctatcccgtttgcccgccggtcgcccgc

SEQ ID NO: 134584 - DNA, 35 bp, Artificial Sequence
  Synthetic oligonucleotide
ttcgacgctttccatccacgttccaaccatgccgc

SEQ ID NO: 134585 - DNA, 35 bp, Artificial Sequence
  Synthetic oligonucleotide
acgtgtgcagtacgtgggtgggggaggggaagggc

SEQ ID NO: 134586 - DNA, 35 bp, Artificial Sequence
  Synthetic oligonucleotide
caacgctccgccacttctggattttgccgccctgc

SEQ ID NO: 134587 - DNA, 35 bp, Artificial Sequence
  Synthetic oligonucleotide
tcgatccaccccgctccgtaattctcgctttgtgc

SEQ ID NO: 134588 - DNA, 35 bp, Artificial Sequence
  Synthetic oligonucleotide
tcagctcaggacgtcaccgcccttaccacactttc

SEQ ID NO: 134589 - DNA, 35 bp, Artificial Sequence
  Synthetic oligonucleotide
gggcctccctccatccacactgccactgcttccag

SEQ ID NO: 134590 - DNA, 35 bp, Artificial Sequence
  Synthetic oligonucleotide
tccgcctcatatcccgtgctatgcctttccctcat

SEQ ID NO: 134591 - DNA, 35 bp, Artificial Sequence
  Synthetic oligonucleotide
aggggggagaacggagggcggatggacagaatgct

SEQ ID NO: 134592 - DNA, 36 bp, Artificial Sequence
  Synthetic oligonucleotide
tgtaaggtgaggggaaggggggtgtgaggatgcagt

SEQ ID NO: 134593 - DNA, 35 bp, Artificial Sequence
  Synthetic oligonucleotide
taaggacacgacaatttccacgtccccccgccgtt

SEQ ID NO: 134594 - DNA, 35 bp, Artificial Sequence
  Synthetic oligonucleotide
ttgcccacccccggatatcaccacactcgtatgtt

SEQ ID NO: 134595 - DNA, 36 bp, Artificial Sequence
  Synthetic oligonucleotide
taagggagaaggaggaacaaggatagggatcgaaaa

SEQ ID NO: 134596 - DNA, 36 bp, Artificial Sequence
  Synthetic oligonucleotide
atcatgccgccgctgcttaaatggtctcgcttccaa

SEQ ID NO: 134597 - DNA, 34 bp, Artificial Sequence
  Synthetic oligonucleotide
ttgccgcctcgcgtttattcatccccatgtcaca

SEQ ID NO: 134598 - DNA, 36 bp, Artificial Sequence
  Synthetic oligonucleotide
tcctgtgctatagtcgtttccccgtcgtccttccca

SEQ ID NO: 134599 - DNA, 36 bp, Artificial Sequence
  Synthetic oligonucleotide
accaccaccaacgcctgcgtgccttgcctttcgcca

SEQ ID NO: 134600 - DNA, 36 bp, Artificial Sequence
  Synthetic oligonucleotide
agtccccccccgagccaccctgatcctgcctaagca

SEQ ID NO: 134601 - DNA, 35 bp, Artificial Sequence
  Synthetic oligonucleotide
ggtgatcgcctcctgtaccctttaacccccctgca

SEQ ID NO: 134602 - DNA, 35 bp, Artificial Sequence
  Synthetic oligonucleotide
atgtcctccggcgcctcgttatcgaccacttatca

SEQ ID NO: 134603 - DNA, 37 bp, Artificial Sequence
  Synthetic oligonucleotide
ggatgcagtaggggggtggggtggtgtggtgggcaga

SEQ ID NO: 134604 - DNA, 36 bp, Artificial Sequence
  Synthetic oligonucleotide
gggtagggactggtggtggggctttagggacggaga

SEQ ID NO: 134605 - DNA, 36 bp, Artificial Sequence
  Synthetic oligonucleotide
gcactcaccacaccccccagcgccctcatgtcacga

SEQ ID NO: 134606 - DNA, 37 bp, Artificial Sequence
  Synthetic oligonucleotide
gtccagggacgggagggacgaaacagatagtgggcga

SEQ ID NO: 134607 - DNA, 37 bp, Artificial Sequence
  Synthetic oligonucleotide
gccgctgactcgccgtcgccctcgccccctcaccgga

SEQ ID NO: 134608 - DNA, 35 bp, Artificial Sequence
  Synthetic oligonucleotide
gtttccacctgggtgcctcactgtcctcatcttga

SEQ ID NO: 134609 - DNA, 35 bp, Artificial Sequence
  Synthetic oligonucleotide
tctcacctccattccaccgggttcaagtccttcac

SEQ ID NO: 134610 - DNA, 35 bp, Artificial Sequence
  Synthetic oligonucleotide
gttgtgcgcccgcttaccacatggttacccctacc

SEQ ID NO: 134611 - DNA, 35 bp, Artificial Sequence
  Synthetic oligonucleotide
gatcacgttccatctgttcctcagccgtcttttcc

SEQ ID NO: 134612 - DNA, 34 bp, Artificial Sequence
  Synthetic oligonucleotide
ttcgtcccagctccttcttctcccacaatccggc

SEQ ID NO: 134613 - DNA, 35 bp, Artificial Sequence
  Synthetic oligonucleotide
gaccactggcgccaaacctgcccctctctcttatc

SEQ ID NO: 134614 - DNA, 35 bp, Artificial Sequence
  Synthetic oligonucleotide
atggactcccactgctgaccccttgccgcattctc

SEQ ID NO: 134615 - DNA, 35 bp, Artificial Sequence
  Synthetic oligonucleotide
gacactcgccagccacgtttcaacacttagttctc

SEQ ID NO: 134616 - DNA, 35 bp, Artificial Sequence
  Synthetic oligonucleotide
tgcacccatcccactgcccaccttatgatgtgacg

SEQ ID NO: 134617 - DNA, 35 bp, Artificial Sequence
  Synthetic oligonucleotide
tctcctacgcccacccgtaaaagtcccacctccgg

SEQ ID NO: 134618 - DNA, 35 bp, Artificial Sequence
  Synthetic oligonucleotide
gagaacgtgagggtgaatcgatgagggtggggcgg

SEQ ID NO: 134619 - DNA, 35 bp, Artificial Sequence
  Synthetic oligonucleotide
tatgttgggacgggcgggttaagacaaggggcatg

SEQ ID NO: 134620 - DNA, 34 bp, Artificial Sequence
  Synthetic oligonucleotide
cccacccgccttgcgcacatcgcacttgcccctg

SEQ ID NO: 134621 - DNA, 35 bp, Artificial Sequence
  Synthetic oligonucleotide
gtttgccccgattttacctgttcccgatgatcctg

SEQ ID NO: 134622 - DNA, 34 bp, Artificial Sequence
  Synthetic oligonucleotide
gcaccccacctgtacctggtcttcccttgagtat

SEQ ID NO: 134623 - DNA, 35 bp, Artificial Sequence
  Synthetic oligonucleotide
tgctccccttgccttgtatgctccactgcttcggt

SEQ ID NO: 134624 - DNA, 35 bp, Artificial Sequence
  Synthetic oligonucleotide
tctcgttccgcctcaccggccctacttagacgttt

SEQ ID NO: 134625 - DNA, 36 bp, Artificial Sequence
  Synthetic oligonucleotide
tgatcccctccatcgcttttgcaacactgtctttaa

SEQ ID NO: 134626 - DNA, 35 bp, Artificial Sequence
  Synthetic oligonucleotide
tgatcacccgcgtggttttatctccgactccgcca

SEQ ID NO: 134627 - DNA, 36 bp, Artificial Sequence
  Synthetic oligonucleotide
atcacccggctgactggttcctaatagcctcctcca

SEQ ID NO: 134628 - DNA, 35 bp, Artificial Sequence
  Synthetic oligonucleotide
gctccacctggcgcccttctgaatctcagtcttca

SEQ ID NO: 134629 - DNA, 36 bp, Artificial Sequence
  Synthetic oligonucleotide
gtgtgaggcaggacggagaggggcatgggggataga

SEQ ID NO: 134630 - DNA, 35 bp, Artificial Sequence
  Synthetic oligonucleotide
gaccgccgcccttgctctcaactccgactatacga

SEQ ID NO: 134631 - DNA, 37 bp, Artificial Sequence
  Synthetic oligonucleotide
tcccgccccagttctctcttctcgtctatctgactga

SEQ ID NO: 134632 - DNA, 38 bp, Artificial Sequence
  Synthetic oligonucleotide
ggtgtggcgcagagttcatttacatacccccccgctga

SEQ ID NO: 134633 - DNA, 38 bp, Artificial Sequence
  Synthetic oligonucleotide
gccacccccgccacgagtgttcaacccccggcccgtga

SEQ ID NO: 134634 - DNA, 37 bp, Artificial Sequence
  Synthetic oligonucleotide
acaagcgcacccacttaccccagcccgccccgcttga

SEQ ID NO: 134635 - DNA, 36 bp, Artificial Sequence
  Synthetic oligonucleotide
tactcccgccgctggactttgccggtcatgccccta

SEQ ID NO: 134636 - DNA, 36 bp, Artificial Sequence
  Synthetic oligonucleotide
aatggtgggagggtgcgggggtggaaacgcctagta

SEQ ID NO: 134637 - DNA, 36 bp, Artificial Sequence
  Synthetic oligonucleotide
gtggagggttaagggggtaaaggggagggacatgta

SEQ ID NO: 134638 - DNA, 35 bp, Artificial Sequence
  Synthetic oligonucleotide
aggacacgccctcgctcccatcctagtctctctta

SEQ ID NO: 134639 - DNA, 36 bp, Artificial Sequence
  Synthetic oligonucleotide
gccggggagatagggtgggcatgaaggggttagtta

SEQ ID NO: 134640 - DNA, 35 bp, Artificial Sequence
  Synthetic oligonucleotide
acgagacgccggatcttttgtcgctccgcctccac

SEQ ID NO: 134641 - DNA, 35 bp, Artificial Sequence
  Synthetic oligonucleotide
tgctgttcgcaggagcgctcaatattactctccac

SEQ ID NO: 134642 - DNA, 35 bp, Artificial Sequence
  Synthetic oligonucleotide
atgccaccgttcgctctttcatctctcaagtcccc

SEQ ID NO: 134643 - DNA, 35 bp, Artificial Sequence
  Synthetic oligonucleotide
gcttgatcctgccgcctgcccgctgccctatggcc

SEQ ID NO: 134644 - DNA, 35 bp, Artificial Sequence
  Synthetic oligonucleotide
tcgatcgacttgctcgtactcgccatgtaacttcc

SEQ ID NO: 134645 - DNA, 35 bp, Artificial Sequence
  Synthetic oligonucleotide
gacgccctactacgcgcattacagttttggcttcc

SEQ ID NO: 134646 - DNA, 35 bp, Artificial Sequence
  Synthetic oligonucleotide
tgtgcatactctcagtctggcggccccgttccctc

SEQ ID NO: 134647 - DNA, 35 bp, Artificial Sequence
  Synthetic oligonucleotide
tgtgacgtatctcctagcgcggggccttccacttc

SEQ ID NO: 134648 - DNA, 35 bp, Artificial Sequence
  Synthetic oligonucleotide
tgcccctgcctatcgttcttgtacccgttccaccg

SEQ ID NO: 134649 - DNA, 35 bp, Artificial Sequence
  Synthetic oligonucleotide
gtggagatgcgcggagataggtcgggggagtgggg

SEQ ID NO: 134650 - DNA, 35 bp, Artificial Sequence
  Synthetic oligonucleotide
gccccagtccgcctgtcccctgctctcttgccgtg

SEQ ID NO: 134651 - DNA, 35 bp, Artificial Sequence
  Synthetic oligonucleotide
taaccaccgaccagctctccgttaccaggatccct

SEQ ID NO: 134652 - DNA, 35 bp, Artificial Sequence
  Synthetic oligonucleotide
acttccccgtcgagcagcccgttctcacatgtcct

SEQ ID NO: 134653 - DNA, 35 bp, Artificial Sequence
  Synthetic oligonucleotide
gcattacgcgtcccgccttgcaagttctccttcct

SEQ ID NO: 134654 - DNA, 35 bp, Artificial Sequence
  Synthetic oligonucleotide
ggatagcctttgctcgtaccatgccattcatctct

SEQ ID NO: 134655 - DNA, 35 bp, Artificial Sequence
  Synthetic oligonucleotide
agccctcgctaccccgctgttacttagggccttct

SEQ ID NO: 134656 - DNA, 35 bp, Artificial Sequence
  Synthetic oligonucleotide
acagccaaacgcgcatgtgctacctctcgcctcgt

SEQ ID NO: 134657 - DNA, 35 bp, Artificial Sequence
  Synthetic oligonucleotide
tcccacccaccatcgagattaaccgcgttaccatt

SEQ ID NO: 134658 - DNA, 34 bp, Artificial Sequence
  Synthetic oligonucleotide
gtactacgcgtggaagccctcctgccctttattt

SEQ ID NO: 134659 - DNA, 36 bp, Artificial Sequence
  Synthetic oligonucleotide
tgcagggctcaagtcactgtctgccacaccctctca

SEQ ID NO: 134660 - DNA, 37 bp, Artificial Sequence
  Synthetic oligonucleotide
atgcgacgacggtgggaacggaaggaggaatgccaga

SEQ ID NO: 134661 - DNA, 37 bp, Artificial Sequence
  Synthetic oligonucleotide
gaagggaaggggaggtggccaaagcgaggggttgaga

SEQ ID NO: 134662 - DNA, 37 bp, Artificial Sequence
  Synthetic oligonucleotide
agaaggggacgagagaggaaaggtaggtgctgggcga

SEQ ID NO: 134663 - DNA, 37 bp, Artificial Sequence
  Synthetic oligonucleotide
ggacatgggacaggggggggccgggtaaagttgtcga

SEQ ID NO: 134664 - DNA, 35 bp, Artificial Sequence
  Synthetic oligonucleotide
gacactgccccacgtttttgaacccttggttcacc

SEQ ID NO: 134665 - DNA, 35 bp, Artificial Sequence
  Synthetic oligonucleotide
ttatcccccgttcaaggacggtatcagtccttccc

SEQ ID NO: 134666 - DNA, 35 bp, Artificial Sequence
  Synthetic oligonucleotide
tcatggcaccagtgttcgttcctttgtacttcgcc

SEQ ID NO: 134667 - DNA, 35 bp, Artificial Sequence
  Synthetic oligonucleotide
taaacggtcagataccctgctgcaatatccgctcc

SEQ ID NO: 134668 - DNA, 35 bp, Artificial Sequence
  Synthetic oligonucleotide
gcctccacgcatgcccttaaatgttcccgggctcc

SEQ ID NO: 134669 - DNA, 35 bp, Artificial Sequence
  Synthetic oligonucleotide
tgacgcgatccattaagtccgcggctcctttctcc

SEQ ID NO: 134670 - DNA, 35 bp, Artificial Sequence
  Synthetic oligonucleotide
tcttgcactccgcctccacctgctgtttttgttcc

SEQ ID NO: 134671 - DNA, 35 bp, Artificial Sequence
  Synthetic oligonucleotide
gtgtaactcccccgtgcatactttctccccgtttg

SEQ ID NO: 134672 - DNA, 35 bp, Artificial Sequence
  Synthetic oligonucleotide
tgactcccccccatgcggccgctcgtagcctctat

SEQ ID NO: 134673 - DNA, 35 bp, Artificial Sequence
  Synthetic oligonucleotide
gacaaagcctgtggggggcgggaaggggtgataaa

SEQ ID NO: 134674 - DNA, 35 bp, Artificial Sequence
  Synthetic oligonucleotide
attcgcgccgcctatctatccgcttctccggccaa

SEQ ID NO: 134675 - DNA, 36 bp, Artificial Sequence
  Synthetic oligonucleotide
gcctgatctgcacctacgtgttaccgctcgccctaa

SEQ ID NO: 134676 - DNA, 35 bp, Artificial Sequence
  Synthetic oligonucleotide
actccgctcctgctctagccataccccctggcgca

SEQ ID NO: 134677 - DNA, 36 bp, Artificial Sequence
  Synthetic oligonucleotide
ggtccgtcccccgtatgctctcctggatttgcctca

SEQ ID NO: 134678 - DNA, 36 bp, Artificial Sequence
  Synthetic oligonucleotide
aagggggccgaggggaacgggggaggagagcgacga

SEQ ID NO: 134679 - DNA, 35 bp, Artificial Sequence
  Synthetic oligonucleotide
tatcaccgcacccttacccgtgtttttactctcga

SEQ ID NO: 134680 - DNA, 36 bp, Artificial Sequence
  Synthetic oligonucleotide
agaacgcagaggagcgatgaaaaagggggggcggga

SEQ ID NO: 134681 - DNA, 37 bp, Artificial Sequence
  Synthetic oligonucleotide
gggtggggtaggtggtgccggaaggagtatcggggga

SEQ ID NO: 134682 - DNA, 36 bp, Artificial Sequence
  Synthetic oligonucleotide
gttagccgccatctatctgctttccgtttgtcctga

SEQ ID NO: 134683 - DNA, 38 bp, Artificial Sequence
  Synthetic oligonucleotide
gaagggcggagggaagtagaactaacgggggcaattga

SEQ ID NO: 134684 - DNA, 38 bp, Artificial Sequence
  Synthetic oligonucleotide
aagcaacccagtcacccgccgtcctgttccaccattga

SEQ ID NO: 134685 - DNA, 38 bp, Artificial Sequence
  Synthetic oligonucleotide
ggaaaggtggggggggtggaataagttaagcgacttga

SEQ ID NO: 134686 - DNA, 38 bp, Artificial Sequence
  Synthetic oligonucleotide
tgctaccgcctccgctgactctaatcaactgttcttga

SEQ ID NO: 134687 - DNA, 36 bp, Artificial Sequence
  Synthetic oligonucleotide
ttggacagtcgatccctccgtctcccaagccaccta

SEQ ID NO: 134688 - DNA, 36 bp, Artificial Sequence
  Synthetic oligonucleotide
ttacgcccccctgcgtcacataaatagtgccctcta

SEQ ID NO: 134689 - DNA, 36 bp, Artificial Sequence
  Synthetic oligonucleotide
gactcacctcggccttgtattagttgcccgccgtta

SEQ ID NO: 134690 - DNA, 35 bp, Artificial Sequence
  Synthetic oligonucleotide
aagacattcgtcaccagcgcccgtcactctccacc

SEQ ID NO: 134691 - DNA, 35 bp, Artificial Sequence
  Synthetic oligonucleotide
gtgttgcgcagttaatacgcccacccctctctccc

SEQ ID NO: 134692 - DNA, 35 bp, Artificial Sequence
  Synthetic oligonucleotide
gccactcccccgacgttccttcaaggcggacaagc

SEQ ID NO: 134693 - DNA, 35 bp, Artificial Sequence
  Synthetic oligonucleotide
ttcgaccaattggcccctgttcaagtactacctgc

SEQ ID NO: 134694 - DNA, 34 bp, Artificial Sequence
  Synthetic oligonucleotide
gtgcgactgttcgcgctgtttcctttatgccctc

SEQ ID NO: 134695 - DNA, 35 bp, Artificial Sequence
  Synthetic oligonucleotide
gtccgggcaatcttgcaagcacccctctctcgctc

SEQ ID NO: 134696 - DNA, 35 bp, Artificial Sequence
  Synthetic oligonucleotide
tacacggggacgggtgggcaagggacgtacagtgg

SEQ ID NO: 134697 - DNA, 35 bp, Artificial Sequence
  Synthetic oligonucleotide
agtgcccctctattatctggactgtttcctcgcct

SEQ ID NO: 134698 - DNA, 35 bp, Artificial Sequence
  Synthetic oligonucleotide
accatggcctcaggactctttttcttctgcactct

SEQ ID NO: 134699 - DNA, 35 bp, Artificial Sequence
  Synthetic oligonucleotide
ttgacgcagaccattccctgccgccgttacttctt

SEQ ID NO: 134700 - DNA, 35 bp, Artificial Sequence
  Synthetic oligonucleotide
aagtccgcacgcacgctcgccacagttttcttctt

SEQ ID NO: 134701 - DNA, 36 bp, Artificial Sequence
  Synthetic oligonucleotide
aagtagagtagcgggggggggacgtgctggcggcaa

SEQ ID NO: 134702 - DNA, 35 bp, Artificial Sequence
  Synthetic oligonucleotide
gatgcgccaggagcgggaggaagggcaagtggcaa

SEQ ID NO: 134703 - DNA, 36 bp, Artificial Sequence
  Synthetic oligonucleotide
accacccctgtttgaacatctcccctgtgcttgcaa

SEQ ID NO: 134704 - DNA, 36 bp, Artificial Sequence
  Synthetic oligonucleotide
accgcgtctgccgcgtactcatccttttcttgctca

SEQ ID NO: 134705 - DNA, 37 bp, Artificial Sequence
  Synthetic oligonucleotide
gagggggacatttaggcgggcggaggacagggagaga

SEQ ID NO: 134706 - DNA, 37 bp, Artificial Sequence
  Synthetic oligonucleotide
acgcgcctcccgccgacccccgtgccctagtcgacga

SEQ ID NO: 134707 - DNA, 37 bp, Artificial Sequence
  Synthetic oligonucleotide
ggggtaggcctagttggggagggctagcatacgggga

SEQ ID NO: 134708 - DNA, 37 bp, Artificial Sequence
  Synthetic oligonucleotide
tctgtggggtcagagttcagatcagggtggggtggga

SEQ ID NO: 134709 - DNA, 38 bp, Artificial Sequence
  Synthetic oligonucleotide
gacgctgcgcgccgtgccctcgtttcactccttcttga

SEQ ID NO: 134710 - DNA, 38 bp, Artificial Sequence
  Synthetic oligonucleotide
ttggcgaagcggggggggtgggcaggggagtgagttga

SEQ ID NO: 134711 - DNA, 36 bp, Artificial Sequence
  Synthetic oligonucleotide
aatgggtggggtggggtgagggggcggtgatagcta

SEQ ID NO: 134712 - DNA, 35 bp, Artificial Sequence
  Synthetic oligonucleotide
gtaccagccccccacatcgtgagcctcctctcgta

SEQ ID NO: 134713 - DNA, 35 bp, Artificial Sequence
  Synthetic oligonucleotide
acccctcgccttcgcttacacgcactgggagaccc

SEQ ID NO: 134714 - DNA, 35 bp, Artificial Sequence
  Synthetic oligonucleotide
tagttcacggccacaggtgctttcctctctacccc

SEQ ID NO: 134715 - DNA, 35 bp, Artificial Sequence
  Synthetic oligonucleotide
gatcctcgatacttgctactctactgtgctctgcc

SEQ ID NO: 134716 - DNA, 35 bp, Artificial Sequence
  Synthetic oligonucleotide
accgcccccctgccctcatgcaatcctagtgctcc

SEQ ID NO: 134717 - DNA, 35 bp, Artificial Sequence
  Synthetic oligonucleotide
tcaacagggaccttggattgggcagggtgggtgtc

SEQ ID NO: 134718 - DNA, 35 bp, Artificial Sequence
  Synthetic oligonucleotide
aaccacacgggcgtcggctccttctaacacctttc

SEQ ID NO: 134719 - DNA, 35 bp, Artificial Sequence
  Synthetic oligonucleotide
tccgatgcaggtcaacctatctcgccggtgctttc

SEQ ID NO: 134720 - DNA, 35 bp, Artificial Sequence
  Synthetic oligonucleotide
ttgcggagggagtaaggagatgaggagcggtcaag

SEQ ID NO: 134721 - DNA, 35 bp, Artificial Sequence
  Synthetic oligonucleotide
tgaacctcccgccgtccattagaccactctttacg

SEQ ID NO: 134722 - DNA, 35 bp, Artificial Sequence
  Synthetic oligonucleotide
gccacgctacagcaaccctccgcctcgttcatact

SEQ ID NO: 134723 - DNA, 35 bp, Artificial Sequence
  Synthetic oligonucleotide
gcgttgtcccgtttgcccatgttcttccttcacct

SEQ ID NO: 134724 - DNA, 35 bp, Artificial Sequence
  Synthetic oligonucleotide
atgagggtggtggggcggaaggactttggcacatt

SEQ ID NO: 134725 - DNA, 35 bp, Artificial Sequence
  Synthetic oligonucleotide
gcttagccgcgcacgtcttccttcaccccacgatt

SEQ ID NO: 134726 - DNA, 35 bp, Artificial Sequence
  Synthetic oligonucleotide
accgacaccttcatcccttgtcaccttacagtttt

SEQ ID NO: 134727 - DNA, 35 bp, Artificial Sequence
  Synthetic oligonucleotide
taccccgctccccacatggcactgtaccgtgccaa

SEQ ID NO: 134728 - DNA, 37 bp, Artificial Sequence
  Synthetic oligonucleotide
ataaacgaagaacggggaaggggaacagaggaagcga

SEQ ID NO: 134729 - DNA, 37 bp, Artificial Sequence
  Synthetic oligonucleotide
gccgacaccacttgccactcccgttttccctacagga

SEQ ID NO: 134730 - DNA, 37 bp, Artificial Sequence
  Synthetic oligonucleotide
tgacagtatgcgggcggaattaaggtggcggggggga

SEQ ID NO: 134731 - DNA, 35 bp, Artificial Sequence
  Synthetic oligonucleotide
ggggaacggtgtggggggggaggccgtagccatga

SEQ ID NO: 134732 - DNA, 37 bp, Artificial Sequence
  Synthetic oligonucleotide
gaccaatcccctgcccctggtgcctgtacacacgtga

SEQ ID NO: 134733 - DNA, 38 bp, Artificial Sequence
  Synthetic oligonucleotide
acaccatcgcaggctccactggcccttctactacgtga

SEQ ID NO: 134734 - DNA, 34 bp, Artificial Sequence
  Synthetic oligonucleotide
gtctgttccacacccgcccctgtcctacgcgtga

SEQ ID NO: 134735 - DNA, 38 bp, Artificial Sequence
  Synthetic oligonucleotide
ggggacatccgtcacctttctattgcctcaccccttga

SEQ ID NO: 134736 - DNA, 36 bp, Artificial Sequence
  Synthetic oligonucleotide
gcccgaacctcgcccccgtagtttattgtgtgccta

SEQ ID NO: 134737 - DNA, 35 bp, Artificial Sequence
  Synthetic oligonucleotide
tagtcaacgcaggcccctccatgcgcccccacaac

SEQ ID NO: 134738 - DNA, 35 bp, Artificial Sequence
  Synthetic oligonucleotide
gtgctccatgacctatattgcccgaccgcttcgac

SEQ ID NO: 134739 - DNA, 35 bp, Artificial Sequence
  Synthetic oligonucleotide
tcccatctcgctacctgttctactcgggacttgac

SEQ ID NO: 134740 - DNA, 35 bp, Artificial Sequence
  Synthetic oligonucleotide
aatgagcccgcccagtcgtcgtcagtcaacacccc

SEQ ID NO: 134741 - DNA, 36 bp, Artificial Sequence
  Synthetic oligonucleotide
tacaccaacggtggtaccccatcctgactaacgccc

SEQ ID NO: 134742 - DNA, 35 bp, Artificial Sequence
  Synthetic oligonucleotide
tctcaattcgtactatctgcactagcccgtgctcc

SEQ ID NO: 134743 - DNA, 35 bp, Artificial Sequence
  Synthetic oligonucleotide
tgcgccagcccgattgcgccgctgtgcccgtttcc

SEQ ID NO: 134744 - DNA, 35 bp, Artificial Sequence
  Synthetic oligonucleotide
acccccggagcccttgtacggcgattatcttactc

SEQ ID NO: 134745 - DNA, 35 bp, Artificial Sequence
  Synthetic oligonucleotide
gtggaaccgttccggctgttgctcccaatctcttc

SEQ ID NO: 134746 - DNA, 35 bp, Artificial Sequence
  Synthetic oligonucleotide
gtctagctgccttcatctatgattcctgttcctcg

SEQ ID NO: 134747 - DNA, 35 bp, Artificial Sequence
  Synthetic oligonucleotide
tgggggggatagggctaggaaacgggggacattgg

SEQ ID NO: 134748 - DNA, 35 bp, Artificial Sequence
  Synthetic oligonucleotide
tgtctgcccacgctatttgcatctcataccctctg

SEQ ID NO: 134749 - DNA, 35 bp, Artificial Sequence
  Synthetic oligonucleotide
ggaacatcatccgtcgtaattctggtcgcctccat

SEQ ID NO: 134750 - DNA, 35 bp, Artificial Sequence
  Synthetic oligonucleotide
tgtcgtatgtgtccgtcctggcctcttcttcctat

SEQ ID NO: 134751 - DNA, 35 bp, Artificial Sequence
  Synthetic oligonucleotide
tacgccctggcctcctcagcactgccattgtccct

SEQ ID NO: 134752 - DNA, 35 bp, Artificial Sequence
  Synthetic oligonucleotide
tcccgacctcgaactcagcgagttgctctttccct

SEQ ID NO: 134753 - DNA, 35 bp, Artificial Sequence
  Synthetic oligonucleotide
ttcgccacccgcgtgctactgtttttgtccctcct

SEQ ID NO: 134754 - DNA, 35 bp, Artificial Sequence
  Synthetic oligonucleotide
gtcaagtgggtcccatggttcctcgcactgttcct

SEQ ID NO: 134755 - DNA, 35 bp, Artificial Sequence
  Synthetic oligonucleotide
tacgcgcccccggccctactaaaacgctgttaaca

SEQ ID NO: 134756 - DNA, 36 bp, Artificial Sequence
  Synthetic oligonucleotide
atcgccttcgctgccacactccctggatcgacccca

SEQ ID NO: 134757 - DNA, 35 bp, Artificial Sequence
  Synthetic oligonucleotide
gaccgacacttctcctccgccgtcgctcctcctca

SEQ ID NO: 134758 - DNA, 37 bp, Artificial Sequence
  Synthetic oligonucleotide
gtaagggggacggaggggccaggcggcgggacacgga

SEQ ID NO: 134759 - DNA, 37 bp, Artificial Sequence
  Synthetic oligonucleotide
atccccatcgccctagctgctacctactacatttgga

SEQ ID NO: 134760 - DNA, 38 bp, Artificial Sequence
  Synthetic oligonucleotide
gactgcctcctcgctgataacacacatccgcccgctga

SEQ ID NO: 134761 - DNA, 38 bp, Artificial Sequence
  Synthetic oligonucleotide
acggcgagggagggggggtataggggccgggagggtga

SEQ ID NO: 134762 - DNA, 38 bp, Artificial Sequence
  Synthetic oligonucleotide
gcccctccgtttaccgctccgccaccaccctttggtga

SEQ ID NO: 134763 - DNA, 38 bp, Artificial Sequence
  Synthetic oligonucleotide
gtgatggtgggacggggtacgggggtgcgagtggttga

SEQ ID NO: 134764 - DNA, 35 bp, Artificial Sequence
  Synthetic oligonucleotide
accctccgcccagtcgcgatcaaggctccccaata

SEQ ID NO: 134765 - DNA, 36 bp, Artificial Sequence
  Synthetic oligonucleotide
tccccgttcacactctctacatgtcaggcttcgcta

SEQ ID NO: 134766 - DNA, 36 bp, Artificial Sequence
  Synthetic oligonucleotide
acccccagcactgcctatcccaccatcactgtttta

SEQ ID NO: 134767 - DNA, 35 bp, Artificial Sequence
  Synthetic oligonucleotide
agcaaccagacagatacattccatcgcgccaccac

SEQ ID NO: 134768 - DNA, 35 bp, Artificial Sequence
  Synthetic oligonucleotide
aggatgcccgttagcgctgtccgtccccgtccacc

SEQ ID NO: 134769 - DNA, 35 bp, Artificial Sequence
  Synthetic oligonucleotide
tgtgcctcgtttcagtctgctttttctgttccacc

SEQ ID NO: 134770 - DNA, 35 bp, Artificial Sequence
  Synthetic oligonucleotide
gtctaccccctgtgttctgaacaccgcactgcacc

SEQ ID NO: 134771 - DNA, 35 bp, Artificial Sequence
  Synthetic oligonucleotide
gcccccatcatatgctagtgcttcgcccatacccc

SEQ ID NO: 134772 - DNA, 35 bp, Artificial Sequence
  Synthetic oligonucleotide
gtccccaaatctgtctgttagcgcctctatgcccc

SEQ ID NO: 134773 - DNA, 35 bp, Artificial Sequence
  Synthetic oligonucleotide
gacgcggccctgtcaccatgatttacttctctccc

SEQ ID NO: 134774 - DNA, 35 bp, Artificial Sequence
  Synthetic oligonucleotide
tccatcgtcgtcccctagccttggtcttgttatcc

SEQ ID NO: 134775 - DNA, 35 bp, Artificial Sequence
  Synthetic oligonucleotide
gacgattcgaccagacgctttatgctaccctccgc

SEQ ID NO: 134776 - DNA, 35 bp, Artificial Sequence
  Synthetic oligonucleotide
gccgtgccatcatttaccgactgtcccactatcgc

SEQ ID NO: 134777 - DNA, 34 bp, Artificial Sequence
  Synthetic oligonucleotide
tgacaacgactaacgcctccttcacctccttggc

SEQ ID NO: 134778 - DNA, 35 bp, Artificial Sequence
  Synthetic oligonucleotide
atccccatcacattagcacacgctacaatgcgtgc

SEQ ID NO: 134779 - DNA, 35 bp, Artificial Sequence
  Synthetic oligonucleotide
aaggtcatgaggggcgggatgggtagggcggttgc

SEQ ID NO: 134780 - DNA, 35 bp, Artificial Sequence
  Synthetic oligonucleotide
tgccggtcctccggaatgcctatgccatcaccttc

SEQ ID NO: 134781 - DNA, 35 bp, Artificial Sequence
  Synthetic oligonucleotide
gccccccctcgtccctcgtatacgccacgaagccg

SEQ ID NO: 134782 - DNA, 35 bp, Artificial Sequence
  Synthetic oligonucleotide
aacaacagccatatacgttacccgccaccctctcg

SEQ ID NO: 134783 - DNA, 35 bp, Artificial Sequence
  Synthetic oligonucleotide
gaccgggtccggcctgtcatctcatctgtccttcg

SEQ ID NO: 134784 - DNA, 35 bp, Artificial Sequence
  Synthetic oligonucleotide
tcccccctcgccacctgatccccccgcttttcggg

SEQ ID NO: 134785 - DNA, 35 bp, Artificial Sequence
  Synthetic oligonucleotide
tcacatcgccacaacgccgacctacctcccaccct

SEQ ID NO: 134786 - DNA, 35 bp, Artificial Sequence
  Synthetic oligonucleotide
gtcgcctccgcttcccataacctcctttcggagct

SEQ ID NO: 134787 - DNA, 36 bp, Artificial Sequence
  Synthetic oligonucleotide
agagacgatggtaggggggcgtaaagtggtggggaa

SEQ ID NO: 134788 - DNA, 36 bp, Artificial Sequence
  Synthetic oligonucleotide
gcgacccccacccgcatgatacccgcttgtcgccca

SEQ ID NO: 134789 - DNA, 37 bp, Artificial Sequence
  Synthetic oligonucleotide
aacgccaccgtaagacctgtccgccttcagccttcca

SEQ ID NO: 134790 - DNA, 35 bp, Artificial Sequence
  Synthetic oligonucleotide
tatgtcacccctcactcctcgttaaacgtagctca

SEQ ID NO: 134791 - DNA, 35 bp, Artificial Sequence
  Synthetic oligonucleotide
atgatgagcgggggggcaggaaacggggctgcaga

SEQ ID NO: 134792 - DNA, 38 bp, Artificial Sequence
  Synthetic oligonucleotide
gaggtgggactcggggagggagacaacggagggggtga

SEQ ID NO: 134793 - DNA, 36 bp, Artificial Sequence
  Synthetic oligonucleotide
acaacaccgatagccgtactgccgttatcttcccta

SEQ ID NO: 134794 - DNA, 36 bp, Artificial Sequence
  Synthetic oligonucleotide
tgggtccggctgttgcatgccccccactctctcgta

SEQ ID NO: 134795 - DNA, 36 bp, Artificial Sequence
  Synthetic oligonucleotide
tactaggcggtgaaacatggaggggtggaggcggta

SEQ ID NO: 134796 - DNA, 35 bp, Artificial Sequence
  Synthetic oligonucleotide
gtctaacgcattggccttccttcgtgcactttccc

SEQ ID NO: 134797 - DNA, 35 bp, Artificial Sequence
  Synthetic oligonucleotide
ggatacgccgcctgttttcccgagtcccgcttgcc

SEQ ID NO: 134798 - DNA, 35 bp, Artificial Sequence
  Synthetic oligonucleotide
tatgtgatcgatcgtgtgcctgtcgcctcctttcc

SEQ ID NO: 134799 - DNA, 35 bp, Artificial Sequence
  Synthetic oligonucleotide
tgcgccctgcgagtcgcgtgccaccttcccgccgc

SEQ ID NO: 134800 - DNA, 35 bp, Artificial Sequence
  Synthetic oligonucleotide
ttgaccactactgctcgctgacgaattatccctgc

SEQ ID NO: 134801 - DNA, 35 bp, Artificial Sequence
  Synthetic oligonucleotide
tggatcttgtcccctgtcattttgccgtgcttctc

SEQ ID NO: 134802 - DNA, 35 bp, Artificial Sequence
  Synthetic oligonucleotide
ggacggcccctcgcagctttttcactttcctggtc

SEQ ID NO: 134803 - DNA, 35 bp, Artificial Sequence
  Synthetic oligonucleotide
gtgaatgaggccgaagtagagggacggtatggggg

SEQ ID NO: 134804 - DNA, 35 bp, Artificial Sequence
  Synthetic oligonucleotide
gttgcccccgctctcgacgttagtttaaatcattg

SEQ ID NO: 134805 - DNA, 35 bp, Artificial Sequence
  Synthetic oligonucleotide
acagatcacgctctcccctttgtccttggttacct

SEQ ID NO: 134806 - DNA, 35 bp, Artificial Sequence
  Synthetic oligonucleotide
gatcaggccgccactcgcagataccccccacccct

SEQ ID NO: 134807 - DNA, 35 bp, Artificial Sequence
  Synthetic oligonucleotide
aacagtgcccctcgaatgtatctctgcgtccccct

SEQ ID NO: 134808 - DNA, 35 bp, Artificial Sequence
  Synthetic oligonucleotide
gtacctgcggtcgttccggcccacctttctctgtt

SEQ ID NO: 134809 - DNA, 35 bp, Artificial Sequence
  Synthetic oligonucleotide
tcagtaggtgctatcttattccccccctgtcgttt

SEQ ID NO: 134810 - DNA, 35 bp, Artificial Sequence
  Synthetic oligonucleotide
gccgccccggccacctgtatcctttgtgaagtttt

SEQ ID NO: 134811 - DNA, 36 bp, Artificial Sequence
  Synthetic oligonucleotide
gttgctggtccaggtcgttccgttcgcccccccaaa

SEQ ID NO: 134812 - DNA, 36 bp, Artificial Sequence
  Synthetic oligonucleotide
tccctaccgatccgttcgcctcctttggtcatcaca

SEQ ID NO: 134813 - DNA, 36 bp, Artificial Sequence
  Synthetic oligonucleotide
gacaccgatccgctttccatcaggccctggttccca

SEQ ID NO: 134814 - DNA, 36 bp, Artificial Sequence
  Synthetic oligonucleotide
aacactcacttgcctattaggcctgcgtttcacgca

SEQ ID NO: 134815 - DNA, 37 bp, Artificial Sequence
  Synthetic oligonucleotide
tggtgaaggggtgaagggggccactagggcggggaga

SEQ ID NO: 134816 - DNA, 37 bp, Artificial Sequence
  Synthetic oligonucleotide
tacgcccactctgcgtgccatcaccttacaaccggga

SEQ ID NO: 134817 - DNA, 37 bp, Artificial Sequence
  Synthetic oligonucleotide
tccatgcccgatccatatacgccgtgcctaaccctga

SEQ ID NO: 134818 - DNA, 36 bp, Artificial Sequence
  Synthetic oligonucleotide
tgaccccgattcggtcctatattgtccttgtctcta

SEQ ID NO: 134819 - DNA, 35 bp, Artificial Sequence
  Synthetic oligonucleotide
acgcccccacccaagccgtaatgcaacactagcac

SEQ ID NO: 134820 - DNA, 35 bp, Artificial Sequence
  Synthetic oligonucleotide
gccccagtgcaccctgtccaggttctgccacctac

SEQ ID NO: 134821 - DNA, 35 bp, Artificial Sequence
  Synthetic oligonucleotide
acatccccctacggttgacgagatcatcccgctcc

SEQ ID NO: 134822 - DNA, 35 bp, Artificial Sequence
  Synthetic oligonucleotide
aggacgcccccacatttgctatgccgcctcgttcc

SEQ ID NO: 134823 - DNA, 35 bp, Artificial Sequence
  Synthetic oligonucleotide
tgctgtacacgcgtgttcgtttcatgatctccctc

SEQ ID NO: 134824 - DNA, 35 bp, Artificial Sequence
  Synthetic oligonucleotide
acaggcatccatcacattattcttgctgcctcctc

SEQ ID NO: 134825 - DNA, 35 bp, Artificial Sequence
  Synthetic oligonucleotide
gagccggttcgattctcgcttctgttcttctgctc

SEQ ID NO: 134826 - DNA, 35 bp, Artificial Sequence
  Synthetic oligonucleotide
atgtggcaccccaccttgtaattcatgctgttttc

SEQ ID NO: 134827 - DNA, 35 bp, Artificial Sequence
  Synthetic oligonucleotide
tgtccgccctccctcgtctcataagctcacgcaag

SEQ ID NO: 134828 - DNA, 35 bp, Artificial Sequence
  Synthetic oligonucleotide
aagggccggggtgggggggaaatataaacaactcg

SEQ ID NO: 134829 - DNA, 35 bp, Artificial Sequence
  Synthetic oligonucleotide
ccaccgccgatcgccccgtacactccttctttgct

SEQ ID NO: 134830 - DNA, 34 bp, Artificial Sequence
  Synthetic oligonucleotide
aatcgtcgacgccgtagttcgctccctcttctgt

SEQ ID NO: 134831 - DNA, 35 bp, Artificial Sequence
  Synthetic oligonucleotide
gctgcaccctcattgtcatacctattttcccttgt

SEQ ID NO: 134832 - DNA, 35 bp, Artificial Sequence
  Synthetic oligonucleotide
gtgggaaggcggggggggaacaggcggaatcacaa

SEQ ID NO: 134833 - DNA, 36 bp, Artificial Sequence
  Synthetic oligonucleotide
gcgcctccctagctgcaacccttcccgctccctgaa

SEQ ID NO: 134834 - DNA, 36 bp, Artificial Sequence
  Synthetic oligonucleotide
acaagaggacggaggtgggcaaaaacggagggataa

SEQ ID NO: 134835 - DNA, 35 bp, Artificial Sequence
  Synthetic oligonucleotide
gaacctcgccctcttactcgacccagttttattaa

SEQ ID NO: 134836 - DNA, 36 bp, Artificial Sequence
  Synthetic oligonucleotide
gcctggccacaccctgttacctgtccccttgcacca

SEQ ID NO: 134837 - DNA, 37 bp, Artificial Sequence
  Synthetic oligonucleotide
tgaagcgtagttgcctacacccattcactgcccccga

SEQ ID NO: 134838 - DNA, 37 bp, Artificial Sequence
  Synthetic oligonucleotide
tgacaccctcccaggtttaccgtccacgcccctccga

SEQ ID NO: 134839 - DNA, 37 bp, Artificial Sequence
  Synthetic oligonucleotide
acaactggtgtaaagggcgggcaatgggggaggggga

SEQ ID NO: 134840 - DNA, 37 bp, Artificial Sequence
  Synthetic oligonucleotide
gaggggagtagctagtgggtgtgggggacagtgggga

SEQ ID NO: 134841 - DNA, 38 bp, Artificial Sequence
  Synthetic oligonucleotide
gcaggccagggtgtacgtcatgggggacagggtgttga

SEQ ID NO: 134842 - DNA, 36 bp, Artificial Sequence
  Synthetic oligonucleotide
acctgcccgtcctccatcgcccaggtccaatgaata

SEQ ID NO: 134843 - DNA, 36 bp, Artificial Sequence
  Synthetic oligonucleotide
tcccgttcgagcgtgctacttcactatctcccgtta

SEQ ID NO: 134844 - DNA, 35 bp, Artificial Sequence
  Synthetic oligonucleotide
tgagtggcataacccccgccgcactgcctttcgac

SEQ ID NO: 134845 - DNA, 35 bp, Artificial Sequence
  Synthetic oligonucleotide
tcacccacattgcgcataagccatttgtcgcctac

SEQ ID NO: 134846 - DNA, 35 bp, Artificial Sequence
  Synthetic oligonucleotide
gattcacacccccgtgtcccagcgcaactcgctac

SEQ ID NO: 134847 - DNA, 35 bp, Artificial Sequence
  Synthetic oligonucleotide
gctcgtggccgccttcatcccgtttcctaggcacc

SEQ ID NO: 134848 - DNA, 35 bp, Artificial Sequence
  Synthetic oligonucleotide
tgagccctccttgtttcctttgcattcaggttccc

SEQ ID NO: 134849 - DNA, 35 bp, Artificial Sequence
  Synthetic oligonucleotide
gcgagcctctattccctttcaactgccggtacgcc

SEQ ID NO: 134850 - DNA, 35 bp, Artificial Sequence
  Synthetic oligonucleotide
gtcgccctgcccccgccaccttaagttgaacccgc

SEQ ID NO: 134851 - DNA, 35 bp, Artificial Sequence
  Synthetic oligonucleotide
atccagcccttcaagccgcatcgcagaccttccgc

SEQ ID NO: 134852 - DNA, 35 bp, Artificial Sequence
  Synthetic oligonucleotide
gtgccccgcctcacccccctgataatccatagcgc

SEQ ID NO: 134853 - DNA, 34 bp, Artificial Sequence
  Synthetic oligonucleotide
tagatcagtcgggccatctaccgcctcccccttc

SEQ ID NO: 134854 - DNA, 36 bp, Artificial Sequence
  Synthetic oligonucleotide
cattaccgcgccacctcgccgcccgacggacaccat

SEQ ID NO: 134855 - DNA, 35 bp, Artificial Sequence
  Synthetic oligonucleotide
tccaccatcatcttgagtaccctcctccagagcat

SEQ ID NO: 134856 - DNA, 35 bp, Artificial Sequence
  Synthetic oligonucleotide
gtcacagtgcgctctagcccctcctccgtcgatct

SEQ ID NO: 134857 - DNA, 35 bp, Artificial Sequence
  Synthetic oligonucleotide
tcgctgtcaatttcgccgccccccgatccgctcgt

SEQ ID NO: 134858 - DNA, 35 bp, Artificial Sequence
  Synthetic oligonucleotide
atccgctgggcaggttctgtctttcgtctttcctt

SEQ ID NO: 134859 - DNA, 36 bp, Artificial Sequence
  Synthetic oligonucleotide
tacctggcgggggggggtaaaatgctggggagggaa

SEQ ID NO: 134860 - DNA, 36 bp, Artificial Sequence
  Synthetic oligonucleotide
tccgttccccgcttgctcctatctgattacttgcca

SEQ ID NO: 134861 - DNA, 35 bp, Artificial Sequence
  Synthetic oligonucleotide
gccccgccgggcgttgcctaatcttcctaccttca

SEQ ID NO: 134862 - DNA, 37 bp, Artificial Sequence
  Synthetic oligonucleotide
tgcacctgacaaattgctcccgaccgccacaccgaga

SEQ ID NO: 134863 - DNA, 37 bp, Artificial Sequence
  Synthetic oligonucleotide
ttccgtccagcccggaccgtgcactacgcccccccga

SEQ ID NO: 134864 - DNA, 37 bp, Artificial Sequence
  Synthetic oligonucleotide
gctgaagagagttgagaatgggggcggggtggtagga

SEQ ID NO: 134865 - DNA, 38 bp, Artificial Sequence
  Synthetic oligonucleotide
atcacgtcccctcacctgtactgccaccctcatcctga

SEQ ID NO: 134866 - DNA, 35 bp, Artificial Sequence
  Synthetic oligonucleotide
gtcaactcagacgattctagctcctcttcctccac

SEQ ID NO: 134867 - DNA, 35 bp, Artificial Sequence
  Synthetic oligonucleotide
gaccccacgcacatcggactttctctcgtggcacc

SEQ ID NO: 134868 - DNA, 35 bp, Artificial Sequence
  Synthetic oligonucleotide
tcttcaccctcttgtccttgcctggagctacgtcc

SEQ ID NO: 134869 - DNA, 35 bp, Artificial Sequence
  Synthetic oligonucleotide
tgcacacctgaaggcgccgcccccaaccacctcgc

SEQ ID NO: 134870 - DNA, 35 bp, Artificial Sequence
  Synthetic oligonucleotide
tgtgatcttgccgctcctgctctcgccctactggc

SEQ ID NO: 134871 - DNA, 35 bp, Artificial Sequence
  Synthetic oligonucleotide
gagttgggggccggggggggttggcggaaatatgc

SEQ ID NO: 134872 - DNA, 35 bp, Artificial Sequence
  Synthetic oligonucleotide
tccccatctcattgccgcatccaggttagtctatc

SEQ ID NO: 134873 - DNA, 35 bp, Artificial Sequence
  Synthetic oligonucleotide
gtccacgttccgccacggacccggttaccccactc

SEQ ID NO: 134874 - DNA, 35 bp, Artificial Sequence
  Synthetic oligonucleotide
tgcatacgctttggctttccagactctccggcctc

SEQ ID NO: 134875 - DNA, 35 bp, Artificial Sequence
  Synthetic oligonucleotide
ggagtgcacgccacatgcttcgtgctcccctattc

SEQ ID NO: 134876 - DNA, 35 bp, Artificial Sequence
  Synthetic oligonucleotide
ccacaccccaaccggatctaaggcctcgaacccct

SEQ ID NO: 134877 - DNA, 35 bp, Artificial Sequence
  Synthetic oligonucleotide
gccttcatcctctctcggtgccgtgccttgtctct

SEQ ID NO: 134878 - DNA, 34 bp, Artificial Sequence
  Synthetic oligonucleotide
gcaccagtacgcttgtttccactccccccacagt

SEQ ID NO: 134879 - DNA, 35 bp, Artificial Sequence
  Synthetic oligonucleotide
tgtgccggccttccgtccctgtcccttcccatagt

SEQ ID NO: 134880 - DNA, 35 bp, Artificial Sequence
  Synthetic oligonucleotide
gagggtggttagaagggagttggggaggcgtggtt

SEQ ID NO: 134881 - DNA, 35 bp, Artificial Sequence
  Synthetic oligonucleotide
gaccatccgccgctccccggaacttcgtccgcaca

SEQ ID NO: 134882 - DNA, 36 bp, Artificial Sequence
  Synthetic oligonucleotide
gtccacagccgcttatccatcacggtaccttgcaca

SEQ ID NO: 134883 - DNA, 36 bp, Artificial Sequence
  Synthetic oligonucleotide
gtgacgcacctattttttggatacaccttgctccca

SEQ ID NO: 134884 - DNA, 36 bp, Artificial Sequence
  Synthetic oligonucleotide
acactgtgcctgccctcgcgaattgattactgtcca

SEQ ID NO: 134885 - DNA, 36 bp, Artificial Sequence
  Synthetic oligonucleotide
ggtcgggggaagtgggtgggaggggcgtagaataga

SEQ ID NO: 134886 - DNA, 36 bp, Artificial Sequence
  Synthetic oligonucleotide
gcatgagggtgacgggaggggggttgtgaggaggga

SEQ ID NO: 134887 - DNA, 36 bp, Artificial Sequence
  Synthetic oligonucleotide
agtacccgccagccgtccccactcacccccacggga

SEQ ID NO: 134888 - DNA, 38 bp, Artificial Sequence
  Synthetic oligonucleotide
actcccaccccgccgtcgcatcatcactcaagcactga

SEQ ID NO: 134889 - DNA, 36 bp, Artificial Sequence
  Synthetic oligonucleotide
gcttacacccccagccccacggtacgccgcccttga

SEQ ID NO: 134890 - DNA, 37 bp, Artificial Sequence
  Synthetic oligonucleotide
aacctcgcccctttctccatggtatcacgccctttga

SEQ ID NO: 134891 - DNA, 36 bp, Artificial Sequence
  Synthetic oligonucleotide
agtccccgccctgtacggtcttccctgaatagttta

SEQ ID NO: 134892 - DNA, 34 bp, Artificial Sequence
  Synthetic oligonucleotide
gccccttgcctctgccctgaatacaagaatgccc

SEQ ID NO: 134893 - DNA, 35 bp, Artificial Sequence
  Synthetic oligonucleotide
gccatgccgggctcgcctcaacttcaccatgtccc

SEQ ID NO: 134894 - DNA, 34 bp, Artificial Sequence
  Synthetic oligonucleotide
gtagacaccctccgcctcctcgtcactcacatcc

SEQ ID NO: 134895 - DNA, 35 bp, Artificial Sequence
  Synthetic oligonucleotide
aaccgccctcatcaccccctttagtcagcgcgtgc

SEQ ID NO: 134896 - DNA, 35 bp, Artificial Sequence
  Synthetic oligonucleotide
acgtgccccttctgtatctgcctcatatttctctc

SEQ ID NO: 134897 - DNA, 35 bp, Artificial Sequence
  Synthetic oligonucleotide
gttttacccgcccgtgttccgcacacttccaccat

SEQ ID NO: 134898 - DNA, 35 bp, Artificial Sequence
  Synthetic oligonucleotide
ccatgtcgcacgggtgcattaacatcggcgcccct

SEQ ID NO: 134899 - DNA, 35 bp, Artificial Sequence
  Synthetic oligonucleotide
gaccgcgaacacccgcggatccgctccttggccct

SEQ ID NO: 134900 - DNA, 35 bp, Artificial Sequence
  Synthetic oligonucleotide
gtgtcgtgccacgtccctcatactcccctcgccgt

SEQ ID NO: 134901 - DNA, 35 bp, Artificial Sequence
  Synthetic oligonucleotide
gcaaggcgcccaccaatcctgtcgtacacctcggt

SEQ ID NO: 134902 - DNA, 35 bp, Artificial Sequence
  Synthetic oligonucleotide
gatgtttgcgctccatgctctggcttcatttcctt

SEQ ID NO: 134903 - DNA, 35 bp, Artificial Sequence
  Synthetic oligonucleotide
gagggggggatcttgggcgggaggagagattaaca

SEQ ID NO: 134904 - DNA, 36 bp, Artificial Sequence
  Synthetic oligonucleotide
gacctcttcccgccgccttagacccgtgtagccaca

SEQ ID NO: 134905 - DNA, 35 bp, Artificial Sequence
  Synthetic oligonucleotide
gttggccggccgacgttctgttcttttgctccaca

SEQ ID NO: 134906 - DNA, 36 bp, Artificial Sequence
  Synthetic oligonucleotide
tgaggaggagacggggggtgggagacgatgtgcaca

SEQ ID NO: 134907 - DNA, 36 bp, Artificial Sequence
  Synthetic oligonucleotide
ttccgcacccattcgggccctcgatcccactatcca

SEQ ID NO: 134908 - DNA, 36 bp, Artificial Sequence
  Synthetic oligonucleotide
agaccgtacttccctgtgaaccgctcccatcttcca

SEQ ID NO: 134909 - DNA, 35 bp, Artificial Sequence
  Synthetic oligonucleotide
tgtgacgcactataatctcctgtccccttcacgca

SEQ ID NO: 134910 - DNA, 36 bp, Artificial Sequence
  Synthetic oligonucleotide
tggaccacccgccccgctaccgacttacagtccata

SEQ ID NO: 134911 - DNA, 36 bp, Artificial Sequence
  Synthetic oligonucleotide
tctgcgtcaactcgtgccccgctggctcccccgtta

SEQ ID NO: 134912 - DNA, 35 bp, Artificial Sequence
  Synthetic oligonucleotide
ttcgccgtgcccttcgtagtcaacacgccttatac

SEQ ID NO: 134913 - DNA, 35 bp, Artificial Sequence
  Synthetic oligonucleotide
gagtagggcaggaggactccaccgccaatttcacc

SEQ ID NO: 134914 - DNA, 35 bp, Artificial Sequence
  Synthetic oligonucleotide
tcgttaccctgcattcacctatgttgcccgccgcc

SEQ ID NO: 134915 - DNA, 35 bp, Artificial Sequence
  Synthetic oligonucleotide
aaagcccgtgtcgcgctctcgtatgctgctcctcc

SEQ ID NO: 134916 - DNA, 35 bp, Artificial Sequence
  Synthetic oligonucleotide
tacaccacctatccccaccacgaccagcgtcccgc

SEQ ID NO: 134917 - DNA, 35 bp, Artificial Sequence
  Synthetic oligonucleotide
gagctcccgcatcccccatccacccgatcaatgtc

SEQ ID NO: 134918 - DNA, 35 bp, Artificial Sequence
  Synthetic oligonucleotide
tcaccatggtttaccccgattacgtacgtgccttc

SEQ ID NO: 134919 - DNA, 35 bp, Artificial Sequence
  Synthetic oligonucleotide
tcctcgtcccggcctatctttctgtactctacgcg

SEQ ID NO: 134920 - DNA, 35 bp, Artificial Sequence
  Synthetic oligonucleotide
aagggctgaggaaggaatagggaggggtaaggagg

SEQ ID NO: 134921 - DNA, 35 bp, Artificial Sequence
  Synthetic oligonucleotide
attgagagggtgtgaggaagtaaaaggggaagcat

SEQ ID NO: 134922 - DNA, 35 bp, Artificial Sequence
  Synthetic oligonucleotide
tccagccacccgcatggttgcccaataccccctct

SEQ ID NO: 134923 - DNA, 35 bp, Artificial Sequence
  Synthetic oligonucleotide
tcgcataacgcagtttacatggcctttccttcgtt

SEQ ID NO: 134924 - DNA, 36 bp, Artificial Sequence
  Synthetic oligonucleotide
tcagcacgccaatcgtcatccacccaatctgttcaa

SEQ ID NO: 134925 - DNA, 36 bp, Artificial Sequence
  Synthetic oligonucleotide
ggaccccccctccatccgctttatgcgtccaggtca

SEQ ID NO: 134926 - DNA, 35 bp, Artificial Sequence
  Synthetic oligonucleotide
atagcccagtcgctcccgttaccctctttcaccga

SEQ ID NO: 134927 - DNA, 37 bp, Artificial Sequence
  Synthetic oligonucleotide
acctccgcccgaatgccattatggtgcctgcctccga

SEQ ID NO: 134928 - DNA, 37 bp, Artificial Sequence
  Synthetic oligonucleotide
acttgtcgcatcacagcgcattcgtacccgtcctcga

SEQ ID NO: 134929 - DNA, 36 bp, Artificial Sequence
  Synthetic oligonucleotide
gccgccccttgctctcaacgcgtttacaccacctga

SEQ ID NO: 134930 - DNA, 37 bp, Artificial Sequence
  Synthetic oligonucleotide
gtacgccaccacctatcgcccacgaccactcccgtga

SEQ ID NO: 134931 - DNA, 37 bp, Artificial Sequence
  Synthetic oligonucleotide
ggtgaagggaggaggagctgggacggagcagtcgtga

SEQ ID NO: 134932 - DNA, 36 bp, Artificial Sequence
  Synthetic oligonucleotide
tctacagcccatccatctgcccgtctcgccgtagta

SEQ ID NO: 134933 - DNA, 35 bp, Artificial Sequence
  Synthetic oligonucleotide
ccctgcccacacccgtactttcgctcatgccgtcc

SEQ ID NO: 134934 - DNA, 35 bp, Artificial Sequence
  Synthetic oligonucleotide
gccgctatcggcccatctttcttccccctgcccgc

SEQ ID NO: 134935 - DNA, 35 bp, Artificial Sequence
  Synthetic oligonucleotide
tggtcaacaccgcttgactctattcttggaccatc

SEQ ID NO: 134936 - DNA, 35 bp, Artificial Sequence
  Synthetic oligonucleotide
aaggtcagcccaccatggctaatcttctcacgctc

SEQ ID NO: 134937 - DNA, 35 bp, Artificial Sequence
  Synthetic oligonucleotide
gtgcaccagcaaggtcacttgtactaccctttctc

SEQ ID NO: 134938 - DNA, 35 bp, Artificial Sequence
  Synthetic oligonucleotide
tgtacgatggggggtaagggggtgcgaggttggag

SEQ ID NO: 134939 - DNA, 35 bp, Artificial Sequence
  Synthetic oligonucleotide
taggcccattccccgctatcgttccacgcgcctcg

SEQ ID NO: 134940 - DNA, 35 bp, Artificial Sequence
  Synthetic oligonucleotide
tgtcaccttcgcacgtcgttttaattttctcttcg

SEQ ID NO: 134941 - DNA, 35 bp, Artificial Sequence
  Synthetic oligonucleotide
tacccgaactccagcctggcttaaagcattctcct

SEQ ID NO: 134942 - DNA, 35 bp, Artificial Sequence
  Synthetic oligonucleotide
aaggaccacccccctgccttttttatatgtgtcct

SEQ ID NO: 134943 - DNA, 35 bp, Artificial Sequence
  Synthetic oligonucleotide
tcgactacgccccctccggatctataactgctgct

SEQ ID NO: 134944 - DNA, 35 bp, Artificial Sequence
  Synthetic oligonucleotide
gcattgcctgcccccttacggcccccaccgcactt

SEQ ID NO: 134945 - DNA, 36 bp, Artificial Sequence
  Synthetic oligonucleotide
accatgaggcataaagtaaagggcgggaaggggaca

SEQ ID NO: 134946 - DNA, 35 bp, Artificial Sequence
  Synthetic oligonucleotide
gttgtccgccacgccctgctcaccaacttgtgcca

SEQ ID NO: 134947 - DNA, 38 bp, Artificial Sequence
  Synthetic oligonucleotide
tagtctccgcccgggttacaaggtccctcctctactga

SEQ ID NO: 134948 - DNA, 38 bp, Artificial Sequence
  Synthetic oligonucleotide
gcccagaccccgcttggtgtactacacctctttcctga

SEQ ID NO: 134949 - DNA, 38 bp, Artificial Sequence
  Synthetic oligonucleotide
gacaccactgcttcctcattctgtcccttcatccgtga

SEQ ID NO: 134950 - DNA, 36 bp, Artificial Sequence
  Synthetic oligonucleotide
tcatacccccattctgttattatgcgattcccttta

SEQ ID NO: 134951 - DNA, 35 bp, Artificial Sequence
  Synthetic oligonucleotide
tcgtactgatctcagcctggtccgcccttccttta

SEQ ID NO: 134952 - DNA, 35 bp, Artificial Sequence
  Synthetic oligonucleotide
ttgtcccacccgacccgacgcatgctacctggtac

SEQ ID NO: 134953 - DNA, 35 bp, Artificial Sequence
  Synthetic oligonucleotide
tgttgcactccgacggcccatacctctaatgcacc

SEQ ID NO: 134954 - DNA, 35 bp, Artificial Sequence
  Synthetic oligonucleotide
tgatgaccttgatgaaagctgccccgctccgcccc

SEQ ID NO: 134955 - DNA, 34 bp, Artificial Sequence
  Synthetic oligonucleotide
tccactcgagccatgaagcaaacgcgagcctccc

SEQ ID NO: 134956 - DNA, 35 bp, Artificial Sequence
  Synthetic oligonucleotide
tcccactcccctatgtgatgctctaccgttcagcc

SEQ ID NO: 134957 - DNA, 35 bp, Artificial Sequence
  Synthetic oligonucleotide
gttgcacccccattctatctgcgccccgtcgcgag

SEQ ID NO: 134958 - DNA, 35 bp, Artificial Sequence
  Synthetic oligonucleotide
atcagcagaaggcgaggggagggggctggcaaagg

SEQ ID NO: 134959 - DNA, 35 bp, Artificial Sequence
  Synthetic oligonucleotide
tcgccgaccccagccattttgcgctctctcgatct

SEQ ID NO: 134960 - DNA, 35 bp, Artificial Sequence
  Synthetic oligonucleotide
ttggactctgcgcacgcctccgcctctcctactct

SEQ ID NO: 134961 - DNA, 35 bp, Artificial Sequence
  Synthetic oligonucleotide
tcagtgcaccagttgatgttcttgtctcctcttgt

SEQ ID NO: 134962 - DNA, 35 bp, Artificial Sequence
  Synthetic oligonucleotide
tcgaccaaccacactgtccaccaagttctgcgctt

SEQ ID NO: 134963 - DNA, 35 bp, Artificial Sequence
  Synthetic oligonucleotide
tgcgatcttacgcgccattgctctactgcctccaa

SEQ ID NO: 134964 - DNA, 36 bp, Artificial Sequence
  Synthetic oligonucleotide
aacgtcccagccgctcgccagtccacaccctcgaca

SEQ ID NO: 134965 - DNA, 37 bp, Artificial Sequence
  Synthetic oligonucleotide
gccgatccaccccgacatgctacgtattacacctcga

SEQ ID NO: 134966 - DNA, 36 bp, Artificial Sequence
  Synthetic oligonucleotide
ggtcctcctgcctgttaccacaccccgattcctcga

SEQ ID NO: 134967 - DNA, 38 bp, Artificial Sequence
  Synthetic oligonucleotide
tagcagtgcctcggctgcatccacctcttcgtcgctga

SEQ ID NO: 134968 - DNA, 37 bp, Artificial Sequence
  Synthetic oligonucleotide
acgataagggggggtggaggggagagtgctgtgctga

SEQ ID NO: 134969 - DNA, 38 bp, Artificial Sequence
  Synthetic oligonucleotide
gaccagagcagctgttggtacactcccccgcttgttga

SEQ ID NO: 134970 - DNA, 37 bp, Artificial Sequence
  Synthetic oligonucleotide
tcacatccgccccacttgccctttggttgcactttga

SEQ ID NO: 134971 - DNA, 36 bp, Artificial Sequence
  Synthetic oligonucleotide
gttccccccctgctccacgcccgccgagtttagcta

SEQ ID NO: 134972 - DNA, 35 bp, Artificial Sequence
  Synthetic oligonucleotide
gtagcaaagggggggagcaagagtgggatcgcgta

SEQ ID NO: 134973 - DNA, 36 bp, Artificial Sequence
  Synthetic oligonucleotide
ttgggacgtccatgggagggagggtgtgtttactta

SEQ ID NO: 134974 - DNA, 36 bp, Artificial Sequence
  Synthetic oligonucleotide
gagagccccgtcctgtcccctaatgacctgccctta

SEQ ID NO: 134975 - DNA, 36 bp, Artificial Sequence
  Synthetic oligonucleotide
tccgcctctggatctgtcaccctgttacaccgctta

SEQ ID NO: 134976 - DNA, 35 bp, Artificial Sequence
  Synthetic oligonucleotide
gcaccataccgtgccggctattttctccttcctac

SEQ ID NO: 134977 - DNA, 35 bp, Artificial Sequence
  Synthetic oligonucleotide
gcggatcgcctcccgcatgacccacgccattttac

SEQ ID NO: 134978 - DNA, 35 bp, Artificial Sequence
  Synthetic oligonucleotide
gcgatccaccttcattcgtcgagaaacttggtccc

SEQ ID NO: 134979 - DNA, 35 bp, Artificial Sequence
  Synthetic oligonucleotide
gcagtgagacgcccacttctccacctcatcgcgcc

SEQ ID NO: 134980 - DNA, 35 bp, Artificial Sequence
  Synthetic oligonucleotide
ttcgctgcctccacttcgacgccgccccagctgcc

SEQ ID NO: 134981 - DNA, 35 bp, Artificial Sequence
  Synthetic oligonucleotide
tgacccgctctattttgaactcacacctctctgcc

SEQ ID NO: 134982 - DNA, 35 bp, Artificial Sequence
  Synthetic oligonucleotide
tgatacccgctgttctccctacttgaaacgtttcc

SEQ ID NO: 134983 - DNA, 35 bp, Artificial Sequence
  Synthetic oligonucleotide
tcgtgggcaccgttccccttacactgtccgtttcc

SEQ ID NO: 134984 - DNA, 35 bp, Artificial Sequence
  Synthetic oligonucleotide
tagacctccgtgtgtgccccctgtcaccttccggc

SEQ ID NO: 134985 - DNA, 35 bp, Artificial Sequence
  Synthetic oligonucleotide
acatcgccgcctcacgccgttcctgaactgtttgc

SEQ ID NO: 134986 - DNA, 35 bp, Artificial Sequence
  Synthetic oligonucleotide
gatacgtccacttgccgcgctccccgcactgaatc

SEQ ID NO: 134987 - DNA, 35 bp, Artificial Sequence
  Synthetic oligonucleotide
gtcctgaccgcatcacatagtctcttcttacactc

SEQ ID NO: 134988 - DNA, 35 bp, Artificial Sequence
  Synthetic oligonucleotide
tgtgagtcccgatctcttcgcctgttccgttattc

SEQ ID NO: 134989 - DNA, 35 bp, Artificial Sequence
  Synthetic oligonucleotide
acacgggatgggtagtgggtgggttttgcaatcgg

SEQ ID NO: 134990 - DNA, 35 bp, Artificial Sequence
  Synthetic oligonucleotide
cccgccatcccgcctgtccttgttctcttgtcatg

SEQ ID NO: 134991 - DNA, 35 bp, Artificial Sequence
  Synthetic oligonucleotide
tgaacttctccatcctccgctgaccgtatgacctg

SEQ ID NO: 134992 - DNA, 35 bp, Artificial Sequence
  Synthetic oligonucleotide
tcacctccattcggttatcgttactttgctactct

SEQ ID NO: 134993 - DNA, 35 bp, Artificial Sequence
  Synthetic oligonucleotide
acgaccgcactctattccgccacgccgctcttggt

SEQ ID NO: 134994 - DNA, 35 bp, Artificial Sequence
  Synthetic oligonucleotide
tgtacgttcgctctctttgtttcgccgtatttttt

SEQ ID NO: 134995 - DNA, 36 bp, Artificial Sequence
  Synthetic oligonucleotide
gcgtgccccggccccgctatctttggtcctattcca

SEQ ID NO: 134996 - DNA, 35 bp, Artificial Sequence
  Synthetic oligonucleotide
ttgtgacccgcggcccctttgtttcgcctcattca

SEQ ID NO: 134997 - DNA, 37 bp, Artificial Sequence
  Synthetic oligonucleotide
gagtttagggagggggggcatggaggtagaggggaga

SEQ ID NO: 134998 - DNA, 38 bp, Artificial Sequence
  Synthetic oligonucleotide
atgcccctccgatccatgcgttcatcggctctactcga

SEQ ID NO: 134999 - DNA, 37 bp, Artificial Sequence
  Synthetic oligonucleotide
tccaggcccactgctgtcatccttacgccatccagga

SEQ ID NO: 135000 - DNA, 36 bp, Artificial Sequence
  Synthetic oligonucleotide
tacctgccgcacttgtttgcccctatcgttaccgga

SEQ ID NO: 135001 - DNA, 37 bp, Artificial Sequence
  Synthetic oligonucleotide
aacggcgggaggcaaagtaatgggcggagggagcgga

SEQ ID NO: 135002 - DNA, 38 bp, Artificial Sequence
  Synthetic oligonucleotide
tgaccctcgccccattcttattacatctgcttcactga

SEQ ID NO: 135003 - DNA, 38 bp, Artificial Sequence
  Synthetic oligonucleotide
tgacccccccaatgtgacgcgcgcaccctcccagctga

SEQ ID NO: 135004 - DNA, 35 bp, Artificial Sequence
  Synthetic oligonucleotide
aatgttccgcgctgtactgcccttctcgtacttga

SEQ ID NO: 135005 - DNA, 38 bp, Artificial Sequence
  Synthetic oligonucleotide
ttgaccaccatatctgtttgcgggccaaccttccttga

SEQ ID NO: 135006 - DNA, 36 bp, Artificial Sequence
  Synthetic oligonucleotide
gccaccgtgcaggccacacccccgacctgtttgcta

SEQ ID NO: 135007 - DNA, 35 bp, Artificial Sequence
  Synthetic oligonucleotide
gtcgaaggcccgagggggggatggacggggcggac

SEQ ID NO: 135008 - DNA, 35 bp, Artificial Sequence
  Synthetic oligonucleotide
gttcacacgcttcgtgtaaatgcttactaccttcc

SEQ ID NO: 135009 - DNA, 31 bp, Artificial Sequence
  Synthetic oligonucleotide
aatcgtagctacccgccgtacactagcccgc

SEQ ID NO: 135010 - DNA, 35 bp, Artificial Sequence
  Synthetic oligonucleotide
tcatgatccacgtttaatcctttattgctgccatc

SEQ ID NO: 135011 - DNA, 35 bp, Artificial Sequence
  Synthetic oligonucleotide
ttgtcgcaaccggtctgacatctgccattgccttc

SEQ ID NO: 135012 - DNA, 35 bp, Artificial Sequence
  Synthetic oligonucleotide
tctcgcccgttgtcccgttgctcttgctcttgccg

SEQ ID NO: 135013 - DNA, 35 bp, Artificial Sequence
  Synthetic oligonucleotide
tccaacgcagaaccctgatccctcctttcccacat

SEQ ID NO: 135014 - DNA, 35 bp, Artificial Sequence
  Synthetic oligonucleotide
acggtaccttcccatgtccgctgacctacctccct

SEQ ID NO: 135015 - DNA, 35 bp, Artificial Sequence
  Synthetic oligonucleotide
acgtaccactgctcgctccttgtcactccgccgtt

SEQ ID NO: 135016 - DNA, 35 bp, Artificial Sequence
  Synthetic oligonucleotide
ggggatggatgggtcagggggtcgggtgggggcaa

SEQ ID NO: 135017 - DNA, 36 bp, Artificial Sequence
  Synthetic oligonucleotide
tatcgcacctcgcctcgcctgttttcacttattcaa

SEQ ID NO: 135018 - DNA, 36 bp, Artificial Sequence
  Synthetic oligonucleotide
ttggaggtggggggcgggcaagagggctaggttcaa

SEQ ID NO: 135019 - DNA, 35 bp, Artificial Sequence
  Synthetic oligonucleotide
aaagtccacgcactcgcttataccgccgttactaa

SEQ ID NO: 135020 - DNA, 35 bp, Artificial Sequence
  Synthetic oligonucleotide
accgtcgctctctgttgattcacctctgcgtacca

SEQ ID NO: 135021 - DNA, 35 bp, Artificial Sequence
  Synthetic oligonucleotide
ttaccgtacgccactcctccaccagacgcatccca

SEQ ID NO: 135022 - DNA, 36 bp, Artificial Sequence
  Synthetic oligonucleotide
tggtagactccgctgtctctaccgcctccacctgca

SEQ ID NO: 135023 - DNA, 35 bp, Artificial Sequence
  Synthetic oligonucleotide
tatctcccgcgtcgccgtgcccctgcccatccaga

SEQ ID NO: 135024 - DNA, 37 bp, Artificial Sequence
  Synthetic oligonucleotide
gagccgggcgaggcgggtgggaatgcgatgttcgaga

SEQ ID NO: 135025 - DNA, 35 bp, Artificial Sequence
  Synthetic oligonucleotide
gtaagggcgggtggagaggagagaagcgaggtaga

SEQ ID NO: 135026 - DNA, 36 bp, Artificial Sequence
  Synthetic oligonucleotide
tgaggggcgtttgattcgggcggggggcgacgggga

SEQ ID NO: 135027 - DNA, 37 bp, Artificial Sequence
  Synthetic oligonucleotide
taccatccccggtcgtcgactgacccttccccctgga

SEQ ID NO: 135028 - DNA, 38 bp, Artificial Sequence
  Synthetic oligonucleotide
ggggctagagtcagggaaggggatgatgggggtactga

SEQ ID NO: 135029 - DNA, 37 bp, Artificial Sequence
  Synthetic oligonucleotide
gggagtgggtggagggaggggacacggactgatctga

SEQ ID NO: 135030 - DNA, 38 bp, Artificial Sequence
  Synthetic oligonucleotide
gagactggacaatgaggggaagggcggctggaacgtga

SEQ ID NO: 135031 - DNA, 38 bp, Artificial Sequence
  Synthetic oligonucleotide
acgccttccacagcatattcctctgccatcctccgtga

SEQ ID NO: 135032 - DNA, 35 bp, Artificial Sequence
  Synthetic oligonucleotide
ttccgtgccaacgcagccgggaacacacaccttac

SEQ ID NO: 135033 - DNA, 35 bp, Artificial Sequence
  Synthetic oligonucleotide
atcgtactcctcacctctcgcgccatggctcctgc

SEQ ID NO: 135034 - DNA, 35 bp, Artificial Sequence
  Synthetic oligonucleotide
tcaacgtcacgagctgttcgtttgccccctcgtgc

SEQ ID NO: 135035 - DNA, 35 bp, Artificial Sequence
  Synthetic oligonucleotide
gatgtacctcgcccgcctatcacgtgtcgtttatc

SEQ ID NO: 135036 - DNA, 35 bp, Artificial Sequence
  Synthetic oligonucleotide
tctgtgcagaaccccaggcccgtactcgatccctc

SEQ ID NO: 135037 - DNA, 35 bp, Artificial Sequence
  Synthetic oligonucleotide
tcgtgactctattccacggccttttacagcccttc

SEQ ID NO: 135038 - DNA, 35 bp, Artificial Sequence
  Synthetic oligonucleotide
tacgcccattccctcctcccgttatgctactgttc

SEQ ID NO: 135039 - DNA, 35 bp, Artificial Sequence
  Synthetic oligonucleotide
tgagaataccgggtgaataaggggcgggcgggacg

SEQ ID NO: 135040 - DNA, 35 bp, Artificial Sequence
  Synthetic oligonucleotide
gtgcagtgaacaagggaggctgagaggtgggaagg

SEQ ID NO: 135041 - DNA, 35 bp, Artificial Sequence
  Synthetic oligonucleotide
tgacaattcccgtatccctccctggcccctgttgg

SEQ ID NO: 135042 - DNA, 35 bp, Artificial Sequence
  Synthetic oligonucleotide
acacctcgttgtaccatcccccgcggctttgttct

SEQ ID NO: 135043 - DNA, 35 bp, Artificial Sequence
  Synthetic oligonucleotide
aacccgcacctctatttctggctgacctgctactt

SEQ ID NO: 135044 - DNA, 35 bp, Artificial Sequence
  Synthetic oligonucleotide
acccgttctcaacgatgccgttccattttaccctt

SEQ ID NO: 135045 - DNA, 35 bp, Artificial Sequence
  Synthetic oligonucleotide
gcccccacggctatattgctttctccgttctcctt

SEQ ID NO: 135046 - DNA, 35 bp, Artificial Sequence
  Synthetic oligonucleotide
agccacacaaggctgtctctcacccccattcgttt

SEQ ID NO: 135047 - DNA, 35 bp, Artificial Sequence
  Synthetic oligonucleotide
tccactgcccttgtagctacgaccttattcaccca

SEQ ID NO: 135048 - DNA, 35 bp, Artificial Sequence
  Synthetic oligonucleotide
gtgtcgtcctctgcatcccgtcagctcgctcctca

SEQ ID NO: 135049 - DNA, 35 bp, Artificial Sequence
  Synthetic oligonucleotide
ctcttgcgccctgtcattgttccatctcctcacga

SEQ ID NO: 135050 - DNA, 37 bp, Artificial Sequence
  Synthetic oligonucleotide
aattcgccccgtcccatcgcctacaggtcccgcctga

SEQ ID NO: 135051 - DNA, 37 bp, Artificial Sequence
  Synthetic oligonucleotide
atgggcagaggtgggggaggacgagagaaaagcgtga

SEQ ID NO: 135052 - DNA, 37 bp, Artificial Sequence
  Synthetic oligonucleotide
tcaggaatgcagaggaggcatgggggggcgtgggtga

SEQ ID NO: 135053 - DNA, 35 bp, Artificial Sequence
  Synthetic oligonucleotide
gaatggtccaacgtcgtctatcgctccttccctac

SEQ ID NO: 135054 - DNA, 35 bp, Artificial Sequence
  Synthetic oligonucleotide
tacaccgaccacgactccccctacacacatgctac

SEQ ID NO: 135055 - DNA, 35 bp, Artificial Sequence
  Synthetic oligonucleotide
gatggctccttccgaccgtagtcacacgatccgcc

SEQ ID NO: 135056 - DNA, 35 bp, Artificial Sequence
  Synthetic oligonucleotide
aacactgtttccccagacgcccctctcaccgtgcc

SEQ ID NO: 135057 - DNA, 35 bp, Artificial Sequence
  Synthetic oligonucleotide
tcttcccacctggtcacctacacgcttgttctagc

SEQ ID NO: 135058 - DNA, 35 bp, Artificial Sequence
  Synthetic oligonucleotide
ggtgccttcatgtggttgttatctgctccatcctc

SEQ ID NO: 135059 - DNA, 35 bp, Artificial Sequence
  Synthetic oligonucleotide
tacagatgccacgtccactactccgccgacacttc

SEQ ID NO: 135060 - DNA, 33 bp, Artificial Sequence
  Synthetic oligonucleotide
gcacgcctagattattttcgttcccccgcttcg

SEQ ID NO: 135061 - DNA, 35 bp, Artificial Sequence
  Synthetic oligonucleotide
gatacgcttcagtccactatccacccactcgttcg

SEQ ID NO: 135062 - DNA, 35 bp, Artificial Sequence
  Synthetic oligonucleotide
tccatccccagtttctgcctagcccgccccgaatg

SEQ ID NO: 135063 - DNA, 35 bp, Artificial Sequence
  Synthetic oligonucleotide
ttgacgtccctggccatctgtatcctgccccccat

SEQ ID NO: 135064 - DNA, 35 bp, Artificial Sequence
  Synthetic oligonucleotide
gtctccccccctgtcttagctaagacagtatgcct

SEQ ID NO: 135065 - DNA, 35 bp, Artificial Sequence
  Synthetic oligonucleotide
gcacgcggaccgcctcgcccgaacttccctttagt

SEQ ID NO: 135066 - DNA, 35 bp, Artificial Sequence
  Synthetic oligonucleotide
tacgcacttagatgttcccgctccatgtcacccgt

SEQ ID NO: 135067 - DNA, 35 bp, Artificial Sequence
  Synthetic oligonucleotide
tccaccacttgagcgtttatctttcctgtctatgt

SEQ ID NO: 135068 - DNA, 35 bp, Artificial Sequence
  Synthetic oligonucleotide
ttggtagccgcccctccctcttaccttgatccctt

SEQ ID NO: 135069 - DNA, 35 bp, Artificial Sequence
  Synthetic oligonucleotide
ggaccgcaccctccgttcctgtggccctctgtctt

SEQ ID NO: 135070 - DNA, 36 bp, Artificial Sequence
  Synthetic oligonucleotide
ttaccgccacctgacccctccctgtgcttggaaaca

SEQ ID NO: 135071 - DNA, 36 bp, Artificial Sequence
  Synthetic oligonucleotide
tgtgcccgcccgtgcagcctgctatgcccattacca

SEQ ID NO: 135072 - DNA, 36 bp, Artificial Sequence
  Synthetic oligonucleotide
tgcccccccccgtacgcccgtctcaggacggtgtca

SEQ ID NO: 135073 - DNA, 37 bp, Artificial Sequence
  Synthetic oligonucleotide
gccccaacctccctgtaaacgtaacgtccctatgcga

SEQ ID NO: 135074 - DNA, 37 bp, Artificial Sequence
  Synthetic oligonucleotide
tacacagtggaggtggggggagggtttcgggaaagga

SEQ ID NO: 135075 - DNA, 37 bp, Artificial Sequence
  Synthetic oligonucleotide
gcagaacagggggtacagggtggggcgggattgagga

SEQ ID NO: 135076 - DNA, 38 bp, Artificial Sequence
  Synthetic oligonucleotide
tgcccctgcgcctcatctcttaccggcttactccctga

SEQ ID NO: 135077 - DNA, 38 bp, Artificial Sequence
  Synthetic oligonucleotide
tccccgaccctgttgtcctgttacgtcgtcctttctga

SEQ ID NO: 135078 - DNA, 38 bp, Artificial Sequence
  Synthetic oligonucleotide
actggaaaggggggataggatgggtggggaaggggtga

SEQ ID NO: 135079 - DNA, 35 bp, Artificial Sequence
  Synthetic oligonucleotide
gtgcgcacccggacctgctccatttcggtttccta

SEQ ID NO: 135080 - DNA, 36 bp, Artificial Sequence
  Synthetic oligonucleotide
ggactcagttgtccttcgttccctcccctgttcgta

SEQ ID NO: 135081 - DNA, 36 bp, Artificial Sequence
  Synthetic oligonucleotide
aggacgacgccgataaccccccgccgttgatcctta

SEQ ID NO: 135082 - DNA, 36 bp, Artificial Sequence
  Synthetic oligonucleotide
gtggcatcccccaccatctgccattaaaccgtttta

SEQ ID NO: 135083 - DNA, 35 bp, Artificial Sequence
  Synthetic oligonucleotide
tgaaccctcccgtctcacatgccctcatagccgac

SEQ ID NO: 135084 - DNA, 35 bp, Artificial Sequence
  Synthetic oligonucleotide
gccttgcccgttcccgctggagatattcatccccc

SEQ ID NO: 135085 - DNA, 35 bp, Artificial Sequence
  Synthetic oligonucleotide
atccgaatcagtacccactgtattcggccttcccc

SEQ ID NO: 135086 - DNA, 35 bp, Artificial Sequence
  Synthetic oligonucleotide
actgaccagattacctcgatgccgctatttcgtcc

SEQ ID NO: 135087 - DNA, 35 bp, Artificial Sequence
  Synthetic oligonucleotide
gagtcctccgcgtcttttcctgctgcctatctccg

SEQ ID NO: 135088 - DNA, 35 bp, Artificial Sequence
  Synthetic oligonucleotide
gtatcaaacagggacgtagagaagaggaggggggg

SEQ ID NO: 135089 - DNA, 35 bp, Artificial Sequence
  Synthetic oligonucleotide
gctcacagcagcgctgattcacgtccactcccctg

SEQ ID NO: 135090 - DNA, 35 bp, Artificial Sequence
  Synthetic oligonucleotide
tcccagcctcatagctctcgccctggcccttattg

SEQ ID NO: 135091 - DNA, 35 bp, Artificial Sequence
  Synthetic oligonucleotide
acgcaagcatgccctcgttcgttctccctttgttg

SEQ ID NO: 135092 - DNA, 35 bp, Artificial Sequence
  Synthetic oligonucleotide
ggagggttagggtgggtgggactgttagacgcgat

SEQ ID NO: 135093 - DNA, 35 bp, Artificial Sequence
  Synthetic oligonucleotide
gcggaacccagcagtatctctatcgccccgcacct

SEQ ID NO: 135094 - DNA, 35 bp, Artificial Sequence
  Synthetic oligonucleotide
actcgcaccctgcctctgtttcatctcgctgacct

SEQ ID NO: 135095 - DNA, 35 bp, Artificial Sequence
  Synthetic oligonucleotide
gctcacgcccgacgattgcttctgaacccttccgt

SEQ ID NO: 135096 - DNA, 35 bp, Artificial Sequence
  Synthetic oligonucleotide
gataagggtggggccggaagggagaaggcgccaaa

SEQ ID NO: 135097 - DNA, 36 bp, Artificial Sequence
  Synthetic oligonucleotide
gatcgacccgtgccgtaatgcgcccctactgtccaa

SEQ ID NO: 135098 - DNA, 36 bp, Artificial Sequence
  Synthetic oligonucleotide
gtggggagtgggacaacgaggggaggggtaacagca

SEQ ID NO: 135099 - DNA, 36 bp, Artificial Sequence
  Synthetic oligonucleotide
ggtcacagcccccaccccgttacgacgtttgccgca

SEQ ID NO: 135100 - DNA, 35 bp, Artificial Sequence
  Synthetic oligonucleotide
tccgctgctcggcccgctctcttcgctccattgca

SEQ ID NO: 135101 - DNA, 37 bp, Artificial Sequence
  Synthetic oligonucleotide
gcataagggtaggtgggaaggaaagtaggaaataaga

SEQ ID NO: 135102 - DNA, 37 bp, Artificial Sequence
  Synthetic oligonucleotide
tccacctgtacagcccgccctcgtttacgttatacga

SEQ ID NO: 135103 - DNA, 37 bp, Artificial Sequence
  Synthetic oligonucleotide
aacattcgggggtggggctaaaggagacagggaggga

SEQ ID NO: 135104 - DNA, 37 bp, Artificial Sequence
  Synthetic oligonucleotide
ggaccgagatggagctgaaggagggattaggtcggga

SEQ ID NO: 135105 - DNA, 36 bp, Artificial Sequence
  Synthetic oligonucleotide
atccaacagacgggttactagggagggcgggattga

SEQ ID NO: 135106 - DNA, 35 bp, Artificial Sequence
  Synthetic oligonucleotide
accgccccgcagtaccggcatcattgcacctccac

SEQ ID NO: 135107 - DNA, 35 bp, Artificial Sequence
  Synthetic oligonucleotide
gtcccagacactagcttatatgcttgcccccgtac

SEQ ID NO: 135108 - DNA, 35 bp, Artificial Sequence
  Synthetic oligonucleotide
acgactccttccgccaacctcgaggggctaccacc

SEQ ID NO: 135109 - DNA, 35 bp, Artificial Sequence
  Synthetic oligonucleotide
tcaacctccccatgcggtaagactagcatctgccc

SEQ ID NO: 135110 - DNA, 35 bp, Artificial Sequence
  Synthetic oligonucleotide
tagcatacacgctctgcttctcgtcccatcaatcc

SEQ ID NO: 135111 - DNA, 35 bp, Artificial Sequence
  Synthetic oligonucleotide
atgcacgccctgcgaatcgttacgaattaccctcc

SEQ ID NO: 135112 - DNA, 35 bp, Artificial Sequence
  Synthetic oligonucleotide
tctaccacccccacgctctcaacaacggaccgtcc

SEQ ID NO: 135113 - DNA, 35 bp, Artificial Sequence
  Synthetic oligonucleotide
tccgaccagcccatccctcttctttgtacgtgtcc

SEQ ID NO: 135114 - DNA, 35 bp, Artificial Sequence
  Synthetic oligonucleotide
gtcgagctcttttgccgcctaacgccactcgttcc

SEQ ID NO: 135115 - DNA, 35 bp, Artificial Sequence
  Synthetic oligonucleotide
gtcaactggtccgttgtccggcactattttccctc

SEQ ID NO: 135116 - DNA, 35 bp, Artificial Sequence
  Synthetic oligonucleotide
agaccccactccctctgaggccacttcctttgttc

SEQ ID NO: 135117 - DNA, 34 bp, Artificial Sequence
  Synthetic oligonucleotide
aacccgtgagccgccttccactctttttgacttg

SEQ ID NO: 135118 - DNA, 35 bp, Artificial Sequence
  Synthetic oligonucleotide
tgaatcgacctgtctatccttttctcctcttcttg

SEQ ID NO: 135119 - DNA, 35 bp, Artificial Sequence
  Synthetic oligonucleotide
tgcgccctacgaacatctggaaaccgccccttttg

SEQ ID NO: 135120 - DNA, 35 bp, Artificial Sequence
  Synthetic oligonucleotide
gagagactgggggggagggcaatgagcgatgagat

SEQ ID NO: 135121 - DNA, 35 bp, Artificial Sequence
  Synthetic oligonucleotide
tccaagcctagactttaccgttcataccccttcct

SEQ ID NO: 135122 - DNA, 35 bp, Artificial Sequence
  Synthetic oligonucleotide
ttgacgttcgcccccccctgacgtttcaacgatct

SEQ ID NO: 135123 - DNA, 35 bp, Artificial Sequence
  Synthetic oligonucleotide
ttgcactccgcatccactctgtccaaccccgttgt

SEQ ID NO: 135124 - DNA, 35 bp, Artificial Sequence
  Synthetic oligonucleotide
tcgctaagccatggtaacgctgcttcttcttcctt

SEQ ID NO: 135125 - DNA, 35 bp, Artificial Sequence
  Synthetic oligonucleotide
ggagagaaggaggggggggagcgacgggactcttt

SEQ ID NO: 135126 - DNA, 36 bp, Artificial Sequence
  Synthetic oligonucleotide
acgccccccccattcgtttttgaacagcttcccgaa

SEQ ID NO: 135127 - DNA, 35 bp, Artificial Sequence
  Synthetic oligonucleotide
tcgagaaggggaaccgggtataagcgggggggtaa

SEQ ID NO: 135128 - DNA, 37 bp, Artificial Sequence
  Synthetic oligonucleotide
acccacctactgaacagtaaaagccccctctatacga

SEQ ID NO: 135129 - DNA, 37 bp, Artificial Sequence
  Synthetic oligonucleotide
aacaacggggcaaggggggcggagcggtgacattcga

SEQ ID NO: 135130 - DNA, 38 bp, Artificial Sequence
  Synthetic oligonucleotide
ttccacagccctcttgtagtttcgccacccacatctga

SEQ ID NO: 135131 - DNA, 38 bp, Artificial Sequence
  Synthetic oligonucleotide
gaggagaggggtggcggttacaataggggcaagggtga

SEQ ID NO: 135132 - DNA, 35 bp, Artificial Sequence
  Synthetic oligonucleotide
tcctgtgcctgctcttgctattacttttccgctta

SEQ ID NO: 135133 - DNA, 35 bp, Artificial Sequence
  Synthetic oligonucleotide
gttccacgtgtgtcctgcatgcattcgttttccac

SEQ ID NO: 135134 - DNA, 35 bp, Artificial Sequence
  Synthetic oligonucleotide
ggatgcgccaccgcccctccgttcctgattactac

SEQ ID NO: 135135 - DNA, 35 bp, Artificial Sequence
  Synthetic oligonucleotide
gcttgcccgccgtaactcccaaatcgtcactgacc

SEQ ID NO: 135136 - DNA, 35 bp, Artificial Sequence
  Synthetic oligonucleotide
tcgtgtggccctcaagaactttattccgctcgccc

SEQ ID NO: 135137 - DNA, 35 bp, Artificial Sequence
  Synthetic oligonucleotide
tttaccaccccctccgctggaagccgactcgagcc

SEQ ID NO: 135138 - DNA, 35 bp, Artificial Sequence
  Synthetic oligonucleotide
gacctctccctatgggcatacagttctcgccctcc

SEQ ID NO: 135139 - DNA, 35 bp, Artificial Sequence
  Synthetic oligonucleotide
gccacggctgttgcttttcttagtaatcgccttcc

SEQ ID NO: 135140 - DNA, 35 bp, Artificial Sequence
  Synthetic oligonucleotide
tgccttactcatcgcgctttacctcactggaactc

SEQ ID NO: 135141 - DNA, 35 bp, Artificial Sequence
  Synthetic oligonucleotide
accgcactccatctggtcacgcatatcgttctacg

SEQ ID NO: 135142 - DNA, 36 bp, Artificial Sequence
  Synthetic oligonucleotide
gtgcgggaatgatgcggattatgggtggggggggcg

SEQ ID NO: 135143 - DNA, 35 bp, Artificial Sequence
  Synthetic oligonucleotide
tctagcgcataacttgtcctcttagctctgcccat

SEQ ID NO: 135144 - DNA, 35 bp, Artificial Sequence
  Synthetic oligonucleotide
gcagtggagggacgatagtgggagtaggggggcat

SEQ ID NO: 135145 - DNA, 35 bp, Artificial Sequence
  Synthetic oligonucleotide
acgatgccacaagggccctatcaatcgcatcctct

SEQ ID NO: 135146 - DNA, 35 bp, Artificial Sequence
  Synthetic oligonucleotide
actccgataccgcgcgcctcctgcccattacgatt

SEQ ID NO: 135147 - DNA, 35 bp, Artificial Sequence
  Synthetic oligonucleotide
gacactcctcgggcattctgttatcgtttcatttt

SEQ ID NO: 135148 - DNA, 35 bp, Artificial Sequence
  Synthetic oligonucleotide
gagaacctcggtcgcctatcacctttgcctgtttt

SEQ ID NO: 135149 - DNA, 35 bp, Artificial Sequence
  Synthetic oligonucleotide
gtgccgcccagccaacccctactgatccccgcgca

SEQ ID NO: 135150 - DNA, 36 bp, Artificial Sequence
  Synthetic oligonucleotide
cccgccctccgactcctctcgacatgtccttctgca

SEQ ID NO: 135151 - DNA, 37 bp, Artificial Sequence
  Synthetic oligonucleotide
gaggaacggaggaggataggaggtaccagactcaaga

SEQ ID NO: 135152 - DNA, 37 bp, Artificial Sequence
  Synthetic oligonucleotide
gcctgggagggtgggatcttgacagtgtggggataga

SEQ ID NO: 135153 - DNA, 35 bp, Artificial Sequence
  Synthetic oligonucleotide
gccctgtccgccctcacgatcttctagtcggtaga

SEQ ID NO: 135154 - DNA, 37 bp, Artificial Sequence
  Synthetic oligonucleotide
atccgctcccactgacctcccgactatagtccaacga

SEQ ID NO: 135155 - DNA, 38 bp, Artificial Sequence
  Synthetic oligonucleotide
ttgaggaggacggggtggaagcggggtccggaggatga

SEQ ID NO: 135156 - DNA, 35 bp, Artificial Sequence
  Synthetic oligonucleotide
gcaccccacctatttcacgccacaaccgcctctga

SEQ ID NO: 135157 - DNA, 38 bp, Artificial Sequence
  Synthetic oligonucleotide
ttggccgtcggaatgtatcacctcctgctcgcctctga

SEQ ID NO: 135158 - DNA, 38 bp, Artificial Sequence
  Synthetic oligonucleotide
tgccaagccccttcccgttgccgctatccatctcgtga

SEQ ID NO: 135159 - DNA, 38 bp, Artificial Sequence
  Synthetic oligonucleotide
gtgaaccaggggaaagggtggtacgacgggggagttga

SEQ ID NO: 135160 - DNA, 38 bp, Artificial Sequence
  Synthetic oligonucleotide
ggtggccccgccctgttactgcccctcactgcatttga

SEQ ID NO: 135161 - DNA, 36 bp, Artificial Sequence
  Synthetic oligonucleotide
tgactggcattcctggtctatcacctccagctccta

SEQ ID NO: 135162 - DNA, 36 bp, Artificial Sequence
  Synthetic oligonucleotide
gtgcattgccagtgtctatcccacccctacctgcta

SEQ ID NO: 135163 - DNA, 35 bp, Artificial Sequence
  Synthetic oligonucleotide
atgcgccgtctattgctaggccgcccacctttcta

SEQ ID NO: 135164 - DNA, 35 bp, Artificial Sequence
  Synthetic oligonucleotide
tgacccgccctcgctcacatcctatacctagctta

SEQ ID NO: 135165 - DNA, 36 bp, Artificial Sequence
  Synthetic oligonucleotide
tcccctgttccctgtcttccgtgctcgccccgctta

SEQ ID NO: 135166 - DNA, 35 bp, Artificial Sequence
  Synthetic oligonucleotide
taccatcaacccggcttggattttgcctcgttacc

SEQ ID NO: 135167 - DNA, 35 bp, Artificial Sequence
  Synthetic oligonucleotide
tagccctcctggagataatcgattcctgctgctcc

SEQ ID NO: 135168 - DNA, 35 bp, Artificial Sequence
  Synthetic oligonucleotide
atcgcgtggtagaagctatgtcgtcccgcccttcc

SEQ ID NO: 135169 - DNA, 35 bp, Artificial Sequence
  Synthetic oligonucleotide
tactcccgactgttctgttctgtccccgctcacgc

SEQ ID NO: 135170 - DNA, 35 bp, Artificial Sequence
  Synthetic oligonucleotide
acatggaccgtccttcctgagcttcgaccctccgc

SEQ ID NO: 135171 - DNA, 35 bp, Artificial Sequence
  Synthetic oligonucleotide
gactcccacccgttctacaagcgcggacccttacg

SEQ ID NO: 135172 - DNA, 35 bp, Artificial Sequence
  Synthetic oligonucleotide
acgatgggaagttctgggaagggctaggggtggcg

SEQ ID NO: 135173 - DNA, 35 bp, Artificial Sequence
  Synthetic oligonucleotide
tcgagcgggtgggcggcccggggtggtggaggaaa

SEQ ID NO: 135174 - DNA, 36 bp, Artificial Sequence
  Synthetic oligonucleotide
gcactccgccgccgcgcactagcatccacttagcaa

SEQ ID NO: 135175 - DNA, 36 bp, Artificial Sequence
  Synthetic oligonucleotide
gcctgagcctatgctctttactatgcccccgtttaa

SEQ ID NO: 135176 - DNA, 36 bp, Artificial Sequence
  Synthetic oligonucleotide
accatgggagagggagaaaggggcaggcaagaaaca

SEQ ID NO: 135177 - DNA, 34 bp, Artificial Sequence
  Synthetic oligonucleotide
taccagccgcgcagtgctacgccaccctgcccca

SEQ ID NO: 135178 - DNA, 37 bp, Artificial Sequence
  Synthetic oligonucleotide
gaccaagtgtgaaagggtggcgggggacagggatcga

SEQ ID NO: 135179 - DNA, 37 bp, Artificial Sequence
  Synthetic oligonucleotide
atcatccctcgcgccgcatgtaacaccacccctcgga

SEQ ID NO: 135180 - DNA, 37 bp, Artificial Sequence
  Synthetic oligonucleotide
gccccgcacccccccggttatgtcctccaacaagtga

SEQ ID NO: 135181 - DNA, 35 bp, Artificial Sequence
  Synthetic oligonucleotide
actcccccgaccgttacccgcgtagtgcttacata

SEQ ID NO: 135182 - DNA, 35 bp, Artificial Sequence
  Synthetic oligonucleotide
gcccgccgtacgcttctgttacttggccaattcta

SEQ ID NO: 135183 - DNA, 34 bp, Artificial Sequence
  Synthetic oligonucleotide
tagcccactcgttgtccataccgccccgcgctta

SEQ ID NO: 135184 - DNA, 36 bp, Artificial Sequence
  Synthetic oligonucleotide
tcctgtcctgcctcccaccatgattgccaatgccac

SEQ ID NO: 135185 - DNA, 35 bp, Artificial Sequence
  Synthetic oligonucleotide
aactgcatcgatccggccgcgcgctcccttggcac

SEQ ID NO: 135186 - DNA, 35 bp, Artificial Sequence
  Synthetic oligonucleotide
accgcgccaactgtttctatgcacgcgcctatcac

SEQ ID NO: 135187 - DNA, 35 bp, Artificial Sequence
  Synthetic oligonucleotide
gccactcaattgtctgcccctttcccatgtttgac

SEQ ID NO: 135188 - DNA, 35 bp, Artificial Sequence
  Synthetic oligonucleotide
gacctcacctatgtcgatttttcagcccagcttcc

SEQ ID NO: 135189 - DNA, 35 bp, Artificial Sequence
  Synthetic oligonucleotide
agcgccatcacatactccggccacccttgcaacgc

SEQ ID NO: 135190 - DNA, 35 bp, Artificial Sequence
  Synthetic oligonucleotide
atcatcccgccgaattgacatttctggcacctctc

SEQ ID NO: 135191 - DNA, 35 bp, Artificial Sequence
  Synthetic oligonucleotide
tcgaagggaaggttttagggggaggggggagcagg

SEQ ID NO: 135192 - DNA, 35 bp, Artificial Sequence
  Synthetic oligonucleotide
attgacctgcccccttatacgcccaaccttgacgg

SEQ ID NO: 135193 - DNA, 35 bp, Artificial Sequence
  Synthetic oligonucleotide
gaaggggggggtggttatttagaggaactataggg

SEQ ID NO: 135194 - DNA, 35 bp, Artificial Sequence
  Synthetic oligonucleotide
tccgcccacctactgcacggaccaccgcctgacat

SEQ ID NO: 135195 - DNA, 35 bp, Artificial Sequence
  Synthetic oligonucleotide
ttgatcgcgttcgatacctcccttctggtccgcct

SEQ ID NO: 135196 - DNA, 35 bp, Artificial Sequence
  Synthetic oligonucleotide
ggagtggggagggagtaatttatagctgggagggt

SEQ ID NO: 135197 - DNA, 35 bp, Artificial Sequence
  Synthetic oligonucleotide
actctacaccgccctcgttgtccgctgacctatgt

SEQ ID NO: 135198 - DNA, 35 bp, Artificial Sequence
  Synthetic oligonucleotide
agcgcctgacctgtttgccttccccgtgctttctt

SEQ ID NO: 135199 - DNA, 36 bp, Artificial Sequence
  Synthetic oligonucleotide
tgccactcctccgtacctttgcagaccgtcccccca

SEQ ID NO: 135200 - DNA, 35 bp, Artificial Sequence
  Synthetic oligonucleotide
gtccccctccccttctgttcaagccccgtggccca

SEQ ID NO: 135201 - DNA, 35 bp, Artificial Sequence
  Synthetic oligonucleotide
gcctcccgtcctgcgctagttcgagcccgactcca

SEQ ID NO: 135202 - DNA, 35 bp, Artificial Sequence
  Synthetic oligonucleotide
tatctgcctcctcactgtttctcgtctatggcgca

SEQ ID NO: 135203 - DNA, 37 bp, Artificial Sequence
  Synthetic oligonucleotide
attgacccgctcactcccccttatagatctgccatga

SEQ ID NO: 135204 - DNA, 35 bp, Artificial Sequence
  Synthetic oligonucleotide
gttccccgtattcctccgttttccgaccagtttta

SEQ ID NO: 135205 - DNA, 35 bp, Artificial Sequence
  Synthetic oligonucleotide
ttggtgcgcatacttctgcgtccctgctcctcaac

SEQ ID NO: 135206 - DNA, 35 bp, Artificial Sequence
  Synthetic oligonucleotide
gccgtcacacgaagtttcagccaccgccctactac

SEQ ID NO: 135207 - DNA, 35 bp, Artificial Sequence
  Synthetic oligonucleotide
tatcagcacggttctactcagtccggccctcctac

SEQ ID NO: 135208 - DNA, 35 bp, Artificial Sequence
  Synthetic oligonucleotide
gctgcatgctgtacctgcttttcttcattgccccc

SEQ ID NO: 135209 - DNA, 35 bp, Artificial Sequence
  Synthetic oligonucleotide
gctccagtctcctttaccagttcgtcccgccgccc

SEQ ID NO: 135210 - DNA, 35 bp, Artificial Sequence
  Synthetic oligonucleotide
gagcgtcgctagtttcccgtgcatgcccttccctc

SEQ ID NO: 135211 - DNA, 35 bp, Artificial Sequence
  Synthetic oligonucleotide
gttgtccgttaccgccccccctcattcagttgccg

SEQ ID NO: 135212 - DNA, 35 bp, Artificial Sequence
  Synthetic oligonucleotide
atcactcgaccctcgcagcattcaccattttcctg

SEQ ID NO: 135213 - DNA, 35 bp, Artificial Sequence
  Synthetic oligonucleotide
agccggactggagggtggtggaaggttggggggtg

SEQ ID NO: 135214 - DNA, 35 bp, Artificial Sequence
  Synthetic oligonucleotide
tgccggtaacgctcgcactctcaccagtcttccct

SEQ ID NO: 135215 - DNA, 35 bp, Artificial Sequence
  Synthetic oligonucleotide
gctgcctagagctttcatttgccccactcttcggt

SEQ ID NO: 135216 - DNA, 36 bp, Artificial Sequence
  Synthetic oligonucleotide
tccgcttagccccctcccgtcctcgcgcttcgttaa

SEQ ID NO: 135217 - DNA, 36 bp, Artificial Sequence
  Synthetic oligonucleotide
tccacccagccactatcgtcttgggctgtaccacca

SEQ ID NO: 135218 - DNA, 36 bp, Artificial Sequence
  Synthetic oligonucleotide
acatcgccactgagttttgtttttttcgccatccca

SEQ ID NO: 135219 - DNA, 37 bp, Artificial Sequence
  Synthetic oligonucleotide
gccgccttcacctgttgttctctgtgccctcttgcga

SEQ ID NO: 135220 - DNA, 38 bp, Artificial Sequence
  Synthetic oligonucleotide
aattccgcgccactctcgctccccaccctgcttggtga

SEQ ID NO: 135221 - DNA, 37 bp, Artificial Sequence
  Synthetic oligonucleotide
gggtggtggcgggggtatcggaggcggcaccaatcta

SEQ ID NO: 135222 - DNA, 35 bp, Artificial Sequence
  Synthetic oligonucleotide
tgctgggccactccctgtctgcctcatcctctcta

SEQ ID NO: 135223 - DNA, 36 bp, Artificial Sequence
  Synthetic oligonucleotide
tatccaccctgtatgccccgcctcggattccgagta

SEQ ID NO: 135224 - DNA, 35 bp, Artificial Sequence
  Synthetic oligonucleotide
tagtaccatacgtcagctccacctccgccgcaaac

SEQ ID NO: 135225 - DNA, 35 bp, Artificial Sequence
  Synthetic oligonucleotide
gaccccgtcggtcgcgcctatatatcgcctgctac

SEQ ID NO: 135226 - DNA, 35 bp, Artificial Sequence
  Synthetic oligonucleotide
gccaccattggtgttcgatgccatgttgctcgccc

SEQ ID NO: 135227 - DNA, 35 bp, Artificial Sequence
  Synthetic oligonucleotide
accgacccggtcgtgcggtggtccgcccccgtccc

SEQ ID NO: 135228 - DNA, 35 bp, Artificial Sequence
  Synthetic oligonucleotide
accgttctggtcgccccattggctcttgttgctcc

SEQ ID NO: 135229 - DNA, 35 bp, Artificial Sequence
  Synthetic oligonucleotide
gactccacgcgcccactacctcgtcactcccgcgc

SEQ ID NO: 135230 - DNA, 35 bp, Artificial Sequence
  Synthetic oligonucleotide
tcagtgccagccccccccctattcggccgaaatgc

SEQ ID NO: 135231 - DNA, 35 bp, Artificial Sequence
  Synthetic oligonucleotide
gacactgcactccgctagttaaattgccattcctc

SEQ ID NO: 135232 - DNA, 35 bp, Artificial Sequence
  Synthetic oligonucleotide
tgtgtcattcgcaatttgtcttccccactgttctc

SEQ ID NO: 135233 - DNA, 35 bp, Artificial Sequence
  Synthetic oligonucleotide
attcccgccgaaccgtggccctcgccttttttgtc

SEQ ID NO: 135234 - DNA, 35 bp, Artificial Sequence
  Synthetic oligonucleotide
ggataggagatgggtggggtagggggatgaagaag

SEQ ID NO: 135235 - DNA, 35 bp, Artificial Sequence
  Synthetic oligonucleotide
gctccacgctacctacgatctcctgctaattaccg

SEQ ID NO: 135236 - DNA, 35 bp, Artificial Sequence
  Synthetic oligonucleotide
ttgagggagggtcacttagggcggggggaaggggg

SEQ ID NO: 135237 - DNA, 35 bp, Artificial Sequence
  Synthetic oligonucleotide
acacaccacctaccatgttcgccgttccgctcttg

SEQ ID NO: 135238 - DNA, 35 bp, Artificial Sequence
  Synthetic oligonucleotide
tgaccaagcaactgcctgttcgccctgctcccact

SEQ ID NO: 135239 - DNA, 35 bp, Artificial Sequence
  Synthetic oligonucleotide
gacaacgcgctctccatctatcgaatatgccccct

SEQ ID NO: 135240 - DNA, 35 bp, Artificial Sequence
  Synthetic oligonucleotide
ccacggcctccgccatgttcatacccaccctttgt

SEQ ID NO: 135241 - DNA, 35 bp, Artificial Sequence
  Synthetic oligonucleotide
tgcctcctctcatggttttttatgttgttcgcctt

SEQ ID NO: 135242 - DNA, 36 bp, Artificial Sequence
  Synthetic oligonucleotide
acgatcgggacacaagacacggggggggagggagaa

SEQ ID NO: 135243 - DNA, 35 bp, Artificial Sequence
  Synthetic oligonucleotide
acctatgccctggattcgtgatccctcccgtgcca

SEQ ID NO: 135244 - DNA, 35 bp, Artificial Sequence
  Synthetic oligonucleotide
tgtgagggggggggtaaggacggaatggagggtca

SEQ ID NO: 135245 - DNA, 37 bp, Artificial Sequence
  Synthetic oligonucleotide
atcgcagagctgtggagtggggaggggagtgaggaga

SEQ ID NO: 135246 - DNA, 37 bp, Artificial Sequence
  Synthetic oligonucleotide
gttccccgccgccacctccggacacgtacgcccccga

SEQ ID NO: 135247 - DNA, 37 bp, Artificial Sequence
  Synthetic oligonucleotide
tgtgcctcttgctgcggttatgacgcccccctgccga

SEQ ID NO: 135248 - DNA, 37 bp, Artificial Sequence
  Synthetic oligonucleotide
gtgagggtagacgaccgcggtgggggaggagggagga

SEQ ID NO: 135249 - DNA, 37 bp, Artificial Sequence
  Synthetic oligonucleotide
acgctggggagtaaaaagggcggggtggaagatggga

SEQ ID NO: 135250 - DNA, 38 bp, Artificial Sequence
  Synthetic oligonucleotide
gacggagtcgggagaaggggaagctgggggtcgaatga

SEQ ID NO: 135251 - DNA, 37 bp, Artificial Sequence
  Synthetic oligonucleotide
aagggaccgggacaagtgagctgggggcgggcggtga

SEQ ID NO: 135252 - DNA, 36 bp, Artificial Sequence
  Synthetic oligonucleotide
gcgccgtgtactgatggtttcgcccccgccctttga

SEQ ID NO: 135253 - DNA, 35 bp, Artificial Sequence
  Synthetic oligonucleotide
gtggcgccccatcatctctcttctccagccgttta

SEQ ID NO: 135254 - DNA, 35 bp, Artificial Sequence
  Synthetic oligonucleotide
tacgcgccgcctcattccacacaccttcataccac

SEQ ID NO: 135255 - DNA, 35 bp, Artificial Sequence
  Synthetic oligonucleotide
tgcccacccgtccggtatcccgtcccgtccgtgac

SEQ ID NO: 135256 - DNA, 35 bp, Artificial Sequence
  Synthetic oligonucleotide
gcaccatgaacgtgcctgtgcgctgaacccatccc

SEQ ID NO: 135257 - DNA, 35 bp, Artificial Sequence
  Synthetic oligonucleotide
aaacgggtcagggagggaagggtactaggaagagc

SEQ ID NO: 135258 - DNA, 35 bp, Artificial Sequence
  Synthetic oligonucleotide
tcccacctcggagctgattggccgccggacacctc

SEQ ID NO: 135259 - DNA, 35 bp, Artificial Sequence
  Synthetic oligonucleotide
gactataatccgccccccttgcatgagcctgtctc

SEQ ID NO: 135260 - DNA, 35 bp, Artificial Sequence
  Synthetic oligonucleotide
gcccccgcccctcatgtgcgccgtactcacttctc

SEQ ID NO: 135261 - DNA, 35 bp, Artificial Sequence
  Synthetic oligonucleotide
aggacccggctcaccccaccgcccataccactgcg

SEQ ID NO: 135262 - DNA, 35 bp, Artificial Sequence
  Synthetic oligonucleotide
gattacgcccgacctagccctgttgtcacgctact

SEQ ID NO: 135263 - DNA, 36 bp, Artificial Sequence
  Synthetic oligonucleotide
tcccccttgcctcgcattattcgtgttctacgcaca

SEQ ID NO: 135264 - DNA, 35 bp, Artificial Sequence
  Synthetic oligonucleotide
tcagcacccagccacgatttccgattgccccgcca

SEQ ID NO: 135265 - DNA, 37 bp, Artificial Sequence
  Synthetic oligonucleotide
attgccccactttcgtgctctgacgtttgccccccga

SEQ ID NO: 135266 - DNA, 37 bp, Artificial Sequence
  Synthetic oligonucleotide
acgagcggggggtgagggaagtatggagcggaatgga

SEQ ID NO: 135267 - DNA, 35 bp, Artificial Sequence
  Synthetic oligonucleotide
gtgccctcattcagatcggccgccttcccctccta

SEQ ID NO: 135268 - DNA, 35 bp, Artificial Sequence
  Synthetic oligonucleotide
tttggccgccgctactgtctccgactccacccaac

SEQ ID NO: 135269 - DNA, 35 bp, Artificial Sequence
  Synthetic oligonucleotide
gcgatcgcctgcatcgctcaaattattcgctccac

SEQ ID NO: 135270 - DNA, 35 bp, Artificial Sequence
  Synthetic oligonucleotide
acctacctcgtagcccgatccatgcttcttctcac

SEQ ID NO: 135271 - DNA, 35 bp, Artificial Sequence
  Synthetic oligonucleotide
gagccctggctagtgtaatcccccccgtctcctac

SEQ ID NO: 135272 - DNA, 35 bp, Artificial Sequence
  Synthetic oligonucleotide
atccacaaaccaccgtccgccgtcgcctaccgccc

SEQ ID NO: 135273 - DNA, 35 bp, Artificial Sequence
  Synthetic oligonucleotide
acccacagcctccccttttaggaattatccgtgcc

SEQ ID NO: 135274 - DNA, 35 bp, Artificial Sequence
  Synthetic oligonucleotide
gcgcaactcagagtcgccgccgaactggcccttcc

SEQ ID NO: 135275 - DNA, 35 bp, Artificial Sequence
  Synthetic oligonucleotide
tccagactgtgacgtcgcgcctcctgcacatcttc

SEQ ID NO: 135276 - DNA, 35 bp, Artificial Sequence
  Synthetic oligonucleotide
tccctcaatccacccaatgtctgcgcccctcaccg

SEQ ID NO: 135277 - DNA, 35 bp, Artificial Sequence
  Synthetic oligonucleotide
agccaccctcgctacccttcagctgtatttgtccg

SEQ ID NO: 135278 - DNA, 35 bp, Artificial Sequence
  Synthetic oligonucleotide
tccccgcccgcctccatccgcccaatctttcggct

SEQ ID NO: 135279 - DNA, 35 bp, Artificial Sequence
  Synthetic oligonucleotide
attcgctctgccctctttcgatcccgggttaatct

SEQ ID NO: 135280 - DNA, 35 bp, Artificial Sequence
  Synthetic oligonucleotide
tacgatccgcctcttcgctaagcctagtttacatt

SEQ ID NO: 135281 - DNA, 36 bp, Artificial Sequence
  Synthetic oligonucleotide
acccccttgtactgcctcgcctcataagccacttaa

SEQ ID NO: 135282 - DNA, 36 bp, Artificial Sequence
  Synthetic oligonucleotide
gtggagggggagtatgataggggatctcgggctaga

SEQ ID NO: 135283 - DNA, 37 bp, Artificial Sequence
  Synthetic oligonucleotide
taacggggcgggcgggcagggatccgtgtcccttcga

SEQ ID NO: 135284 - DNA, 37 bp, Artificial Sequence
  Synthetic oligonucleotide
atggtgggcggatggggggagggcgctaagaagatga

SEQ ID NO: 135285 - DNA, 38 bp, Artificial Sequence
  Synthetic oligonucleotide
ggacaaccctcaacatgctttacctagatcttcactga

SEQ ID NO: 135286 - DNA, 38 bp, Artificial Sequence
  Synthetic oligonucleotide
tcacgcagtgcccgattttccgtctctcgctcccttga

SEQ ID NO: 135287 - DNA, 36 bp, Artificial Sequence
  Synthetic oligonucleotide
tgctccccttccgtttggcggtcagtgacacaccac

SEQ ID NO: 135288 - DNA, 35 bp, Artificial Sequence
  Synthetic oligonucleotide
acaggagccgctttccctcctgcctgttagcctac

SEQ ID NO: 135289 - DNA, 35 bp, Artificial Sequence
  Synthetic oligonucleotide
tacacccgaacttggtgctgtgctgttttatctcc

SEQ ID NO: 135290 - DNA, 35 bp, Artificial Sequence
  Synthetic oligonucleotide
gtacaacgttcattcctattctgcaaccatctcgc

SEQ ID NO: 135291 - DNA, 35 bp, Artificial Sequence
  Synthetic oligonucleotide
tagtcctgcccgttgtcctgtccgaaagctcgatc

SEQ ID NO: 135292 - DNA, 35 bp, Artificial Sequence
  Synthetic oligonucleotide
ttgcacgtgttgcgctgatatacctgtcccacctc

SEQ ID NO: 135293 - DNA, 35 bp, Artificial Sequence
  Synthetic oligonucleotide
gccgttcgcggacccccgtcgaccattgccctctc

SEQ ID NO: 135294 - DNA, 35 bp, Artificial Sequence
  Synthetic oligonucleotide
accaggccttttcctggtcgtattttccccacttc

SEQ ID NO: 135295 - DNA, 35 bp, Artificial Sequence
  Synthetic oligonucleotide
acgcctcaactccaccctcggactctgtactgttc

SEQ ID NO: 135296 - DNA, 35 bp, Artificial Sequence
  Synthetic oligonucleotide
acgcaagccgaggaagggtgggagtttgtgagggg

SEQ ID NO: 135297 - DNA, 35 bp, Artificial Sequence
  Synthetic oligonucleotide
aatgtgcgcccctggtcccctttcactatatagtg

SEQ ID NO: 135298 - DNA, 35 bp, Artificial Sequence
  Synthetic oligonucleotide
aacgcgccgctgccgcgaaactccaccccctattg

SEQ ID NO: 135299 - DNA, 35 bp, Artificial Sequence
  Synthetic oligonucleotide
agtcctccatccgccgttgtcacgaattcccgttg

SEQ ID NO: 135300 - DNA, 35 bp, Artificial Sequence
  Synthetic oligonucleotide
agtgggcgggagggtttgttagggactaatgcaat

SEQ ID NO: 135301 - DNA, 35 bp, Artificial Sequence
  Synthetic oligonucleotide
tgtcattgggtcgcgggggggttagggagggatat

SEQ ID NO: 135302 - DNA, 35 bp, Artificial Sequence
  Synthetic oligonucleotide
accgagcccacccgttgcatacgccccgattcctt

SEQ ID NO: 135303 - DNA, 35 bp, Artificial Sequence
  Synthetic oligonucleotide
tttaccacctgcgagcgcgcacacaagcccctctt

SEQ ID NO: 135304 - DNA, 36 bp, Artificial Sequence
  Synthetic oligonucleotide
ggatggtggaagtggggagtgaggggtaagagcgaa

SEQ ID NO: 135305 - DNA, 36 bp, Artificial Sequence
  Synthetic oligonucleotide
gagagtacagaggatgagggtgatagggcggaggaa

SEQ ID NO: 135306 - DNA, 36 bp, Artificial Sequence
  Synthetic oligonucleotide
gccctacgtcacccgggccaccaccgtccactccca

SEQ ID NO: 135307 - DNA, 36 bp, Artificial Sequence
  Synthetic oligonucleotide
aagcactcccgtcgtaatcatttcgctacacctcca

SEQ ID NO: 135308 - DNA, 37 bp, Artificial Sequence
  Synthetic oligonucleotide
cattgtctctgagctggggagtggtggggagggccga

SEQ ID NO: 135309 - DNA, 37 bp, Artificial Sequence
  Synthetic oligonucleotide
accacgggcggggttgtgtttttttggggagagggga

SEQ ID NO: 135310 - DNA, 37 bp, Artificial Sequence
  Synthetic oligonucleotide
tccgcaaaaaggaaggcaaataacatgagcgggggga

SEQ ID NO: 135311 - DNA, 37 bp, Artificial Sequence
  Synthetic oligonucleotide
tgagaccctcaaacgttctacccccgagccccctgga

SEQ ID NO: 135312 - DNA, 37 bp, Artificial Sequence
  Synthetic oligonucleotide
acaggaggggaatttgtgggggcaaggggcggttgga

SEQ ID NO: 135313 - DNA, 37 bp, Artificial Sequence
  Synthetic oligonucleotide
ggtgggaaggggaggcggaagtaggtagccacgatga

SEQ ID NO: 135314 - DNA, 38 bp, Artificial Sequence
  Synthetic oligonucleotide
gaccacgcggtttccgattagccccccgtccccactga

SEQ ID NO: 135315 - DNA, 37 bp, Artificial Sequence
  Synthetic oligonucleotide
tacccccaccgcctccttccccgtgtcagagttgtga

SEQ ID NO: 135316 - DNA, 38 bp, Artificial Sequence
  Synthetic oligonucleotide
ggacctccgcctcacgacgccacagcccctacccttga

SEQ ID NO: 135317 - DNA, 37 bp, Artificial Sequence
  Synthetic oligonucleotide
tgcgggaagggacgagaatcagggggatgcaggttga

SEQ ID NO: 135318 - DNA, 36 bp, Artificial Sequence
  Synthetic oligonucleotide
attgcgcccccccttgcgttgcgagaatttcctcta

SEQ ID NO: 135319 - DNA, 35 bp, Artificial Sequence
  Synthetic oligonucleotide
taacgtagccctgcactgcacattattcgatccac

SEQ ID NO: 135320 - DNA, 35 bp, Artificial Sequence
  Synthetic oligonucleotide
atgcccgctccgacacggttactctgcggttcccc

SEQ ID NO: 135321 - DNA, 35 bp, Artificial Sequence
  Synthetic oligonucleotide
gcccgcttctgacgcgccccgtaattcctttgccc

SEQ ID NO: 135322 - DNA, 35 bp, Artificial Sequence
  Synthetic oligonucleotide
atcctgttcacgacggtcaccttccctgttccgcc

SEQ ID NO: 135323 - DNA, 35 bp, Artificial Sequence
  Synthetic oligonucleotide
ttgtatacaacggcccgtgcctcgcttcttactcc

SEQ ID NO: 135324 - DNA, 34 bp, Artificial Sequence
  Synthetic oligonucleotide
gccacgtaacacccggtacttcgcaatacgctcc

SEQ ID NO: 135325 - DNA, 35 bp, Artificial Sequence
  Synthetic oligonucleotide
gcccgccagtccctgcccccactacgctagaccgc

SEQ ID NO: 135326 - DNA, 35 bp, Artificial Sequence
  Synthetic oligonucleotide
tagcactttgctgatataacttcgtctcctcctgc

SEQ ID NO: 135327 - DNA, 35 bp, Artificial Sequence
  Synthetic oligonucleotide
tgcacatcaccgtgtctgcttctaccggttcctgc

SEQ ID NO: 135328 - DNA, 35 bp, Artificial Sequence
  Synthetic oligonucleotide
accgccagaacacccctgcattatcgatctgcatc

SEQ ID NO: 135329 - DNA, 35 bp, Artificial Sequence
  Synthetic oligonucleotide
attgccgcccctgccccatgtcgctgataactatc

SEQ ID NO: 135330 - DNA, 35 bp, Artificial Sequence
  Synthetic oligonucleotide
aacaccgctcttccgccgaacaccgtggtttcctc

SEQ ID NO: 135331 - DNA, 35 bp, Artificial Sequence
  Synthetic oligonucleotide
gtccgccccccgcccatgatcgtattgttgcaagg

SEQ ID NO: 135332 - DNA, 35 bp, Artificial Sequence
  Synthetic oligonucleotide
cacacctcaccgtactatgccttctcacccgctgg

SEQ ID NO: 135333 - DNA, 34 bp, Artificial Sequence
  Synthetic oligonucleotide
gtcatcccaccacttcgcccaacctcttcgggtg

SEQ ID NO: 135334 - DNA, 35 bp, Artificial Sequence
  Synthetic oligonucleotide
tagtccccctcagcattgatccatatccccgcact

SEQ ID NO: 135335 - DNA, 35 bp, Artificial Sequence
  Synthetic oligonucleotide
actgcccgcccttgccactaccttctctacgggct

SEQ ID NO: 135336 - DNA, 35 bp, Artificial Sequence
  Synthetic oligonucleotide
tccgaccccccgcgcgcgcttcttcatgtttccgt

SEQ ID NO: 135337 - DNA, 36 bp, Artificial Sequence
  Synthetic oligonucleotide
gataccccgccgccccctattactgtacgtcgctaa

SEQ ID NO: 135338 - DNA, 37 bp, Artificial Sequence
  Synthetic oligonucleotide
atgccacccatcaccgtctcaccttccccgttgcaga

SEQ ID NO: 135339 - DNA, 37 bp, Artificial Sequence
  Synthetic oligonucleotide
tacgcatcccgacttgcagcctgtaccatctcctaga

SEQ ID NO: 135340 - DNA, 36 bp, Artificial Sequence
  Synthetic oligonucleotide
tcgccccgcctgtaatagtcttctgatccctctcga

SEQ ID NO: 135341 - DNA, 36 bp, Artificial Sequence
  Synthetic oligonucleotide
tacggtgggagggcaagagaagggagtaggcgtcga

SEQ ID NO: 135342 - DNA, 36 bp, Artificial Sequence
  Synthetic oligonucleotide
gaggagcgacccgtcctcccgctgacttcccttcga

SEQ ID NO: 135343 - DNA, 37 bp, Artificial Sequence
  Synthetic oligonucleotide
atggggcacaacgaggggagggaggccgatgtaggga

SEQ ID NO: 135344 - DNA, 37 bp, Artificial Sequence
  Synthetic oligonucleotide
ttgtgaggagggtggggggtaaagggggttgatggga

SEQ ID NO: 135345 - DNA, 37 bp, Artificial Sequence
  Synthetic oligonucleotide
ggatcacccttctctgcccccaacgtccacttatgga

SEQ ID NO: 135346 - DNA, 38 bp, Artificial Sequence
  Synthetic oligonucleotide
gggtggggtgtattggggatattaacgatagggggtga

SEQ ID NO: 135347 - DNA, 38 bp, Artificial Sequence
  Synthetic oligonucleotide
tccccctaccgcaccctaatctggctttgagcctttga

SEQ ID NO: 135348 - DNA, 35 bp, Artificial Sequence
  Synthetic oligonucleotide
gttgctacgcccacatctgatttcccctcttcata

SEQ ID NO: 135349 - DNA, 36 bp, Artificial Sequence
  Synthetic oligonucleotide
ttgagacgggcgggttgtattgcgggtgggggacta

SEQ ID NO: 135350 - DNA, 36 bp, Artificial Sequence
  Synthetic oligonucleotide
taacgtcatcagcctcatttcgccagccccttacta

SEQ ID NO: 135351 - DNA, 36 bp, Artificial Sequence
  Synthetic oligonucleotide
tgcactcatccagtctccgcccgttaccatttgcta

SEQ ID NO: 135352 - DNA, 35 bp, Artificial Sequence
  Synthetic oligonucleotide
tgttacccctgttcgtgcatggccccaccctttta

SEQ ID NO: 135353 - DNA, 36 bp, Artificial Sequence
  Synthetic oligonucleotide
tgtgttccgccccactcctgtttagtcgccttttta

SEQ ID NO: 135354 - DNA, 35 bp, Artificial Sequence
  Synthetic oligonucleotide
tcgagcatcagcaggtgttacctcttctcctccac

SEQ ID NO: 135355 - DNA, 35 bp, Artificial Sequence
  Synthetic oligonucleotide
gcactcccgaatgctcatgtggtgccgcctcgtac

SEQ ID NO: 135356 - DNA, 35 bp, Artificial Sequence
  Synthetic oligonucleotide
aagagccccgcactatgccccgcccctgcacaccc

SEQ ID NO: 135357 - DNA, 35 bp, Artificial Sequence
  Synthetic oligonucleotide
tttggccccctgtcgttagccgatgcgccgttccc

SEQ ID NO: 135358 - DNA, 35 bp, Artificial Sequence
  Synthetic oligonucleotide
atgcctacaaggcagacccgatcctgtcctcttcc

SEQ ID NO: 135359 - DNA, 35 bp, Artificial Sequence
  Synthetic oligonucleotide
tcagcctgttcgccatcaacaaaccccgacttcgc

SEQ ID NO: 135360 - DNA, 35 bp, Artificial Sequence
  Synthetic oligonucleotide
gtcttctgccacttagcctccgtgctaccccaccg

SEQ ID NO: 135361 - DNA, 35 bp, Artificial Sequence
  Synthetic oligonucleotide
tctctcggacagtactgttacccattgctccccct

SEQ ID NO: 135362 - DNA, 35 bp, Artificial Sequence
  Synthetic oligonucleotide
gcgtcgccgtacagatcgcgcgctcctgccttcct

SEQ ID NO: 135363 - DNA, 35 bp, Artificial Sequence
  Synthetic oligonucleotide
tcaacccaagccgttcagcagtaccctccgccgct

SEQ ID NO: 135364 - DNA, 35 bp, Artificial Sequence
  Synthetic oligonucleotide
gtgaccacctccattgcgcgcttatttttgtcgct

SEQ ID NO: 135365 - DNA, 35 bp, Artificial Sequence
  Synthetic oligonucleotide
tccgctcttgtccagacccatgctccatctaccgt

SEQ ID NO: 135366 - DNA, 35 bp, Artificial Sequence
  Synthetic oligonucleotide
tgagtggggcgacggaggggggctgagaatgcatt

SEQ ID NO: 135367 - DNA, 35 bp, Artificial Sequence
  Synthetic oligonucleotide
aatgtgtacgctccttcgctggtcgactccccgtt

SEQ ID NO: 135368 - DNA, 36 bp, Artificial Sequence
  Synthetic oligonucleotide
gttccctccacccatacctgagcaaggacagttcaa

SEQ ID NO: 135369 - DNA, 35 bp, Artificial Sequence
  Synthetic oligonucleotide
tccacctcccccgcagaccatgtggtgggacacca

SEQ ID NO: 135370 - DNA, 36 bp, Artificial Sequence
  Synthetic oligonucleotide
gtcccccgccctttctcactgaagaccgcctgtcca

SEQ ID NO: 135371 - DNA, 37 bp, Artificial Sequence
  Synthetic oligonucleotide
ggagacgggcggaggcatgagacagggggggaggaga

SEQ ID NO: 135372 - DNA, 35 bp, Artificial Sequence
  Synthetic oligonucleotide
ccctcccgtgccacctatccgttgttttgcaccga

SEQ ID NO: 135373 - DNA, 34 bp, Artificial Sequence
  Synthetic oligonucleotide
gctgaaggcgcaatatctcccccggttccctcga

SEQ ID NO: 135374 - DNA, 37 bp, Artificial Sequence
  Synthetic oligonucleotide
aatgtagcgccgcctggttcacttttacgcccttcga

SEQ ID NO: 135375 - DNA, 37 bp, Artificial Sequence
  Synthetic oligonucleotide
actacgtgggatggtggggttgaggggcatatcggga

SEQ ID NO: 135376 - DNA, 38 bp, Artificial Sequence
  Synthetic oligonucleotide
gaggggaggtggccgataaaggaaaggagggtgtatga

SEQ ID NO: 135377 - DNA, 37 bp, Artificial Sequence
  Synthetic oligonucleotide
gccgccaactccgcctgtcctgtgttttactccctga

SEQ ID NO: 135378 - DNA, 36 bp, Artificial Sequence
  Synthetic oligonucleotide
tgaatccaccgccagcccagtccccatgccatctga

SEQ ID NO: 135379 - DNA, 37 bp, Artificial Sequence
  Synthetic oligonucleotide
gtgccatctttcgcggatcttgcccaggtctttctga

SEQ ID NO: 135380 - DNA, 38 bp, Artificial Sequence
  Synthetic oligonucleotide
tgtggccgagggaacaggaggggaagggaaattagtga

SEQ ID NO: 135381 - DNA, 38 bp, Artificial Sequence
  Synthetic oligonucleotide
acgacgcatggggtggtcaaagggggaggagggggtga

SEQ ID NO: 135382 - DNA, 37 bp, Artificial Sequence
  Synthetic oligonucleotide
taatgggagggggggtgcggttctaccgggacattga

SEQ ID NO: 135383 - DNA, 38 bp, Artificial Sequence
  Synthetic oligonucleotide
gacaccccagcgtgctactgccccgtgatccgttttga

SEQ ID NO: 135384 - DNA, 36 bp, Artificial Sequence
  Synthetic oligonucleotide
gacggggaaggcgggaggggcccgaagtcggtggta

SEQ ID NO: 135385 - DNA, 35 bp, Artificial Sequence
  Synthetic oligonucleotide
tctacgttacacccgtgctttcacccgtgaccacc

SEQ ID NO: 135386 - DNA, 35 bp, Artificial Sequence
  Synthetic oligonucleotide
gcctttggtccgccattactagcgaccgttcctcc

SEQ ID NO: 135387 - DNA, 33 bp, Artificial Sequence
  Synthetic oligonucleotide
tcagacgctcttcgcttgttcctacacccccgc

SEQ ID NO: 135388 - DNA, 35 bp, Artificial Sequence
  Synthetic oligonucleotide
gcagactcacactcactcccaagtcccaccgttgc

SEQ ID NO: 135389 - DNA, 34 bp, Artificial Sequence
  Synthetic oligonucleotide
gccactacccgcgagatcgcgttcgtcccacctc

SEQ ID NO: 135390 - DNA, 35 bp, Artificial Sequence
  Synthetic oligonucleotide
ttggggctgccacgtattagtttagctccctcctc

SEQ ID NO: 135391 - DNA, 35 bp, Artificial Sequence
  Synthetic oligonucleotide
tacttgggaaccgtacctctgcctgtcctccgctc

SEQ ID NO: 135392 - DNA, 35 bp, Artificial Sequence
  Synthetic oligonucleotide
ggaccgactactccagttccccgcctcgcctgctc

SEQ ID NO: 135393 - DNA, 35 bp, Artificial Sequence
  Synthetic oligonucleotide
tagtgcgagtgcacgcttgtttcccccagtctttc

SEQ ID NO: 135394 - DNA, 36 bp, Artificial Sequence
  Synthetic oligonucleotide
gcccacgcgcttcctcacatgcgctatctcctcccg

SEQ ID NO: 135395 - DNA, 35 bp, Artificial Sequence
  Synthetic oligonucleotide
gcctaccgttcctttctgttccggacctatcgccg

SEQ ID NO: 135396 - DNA, 35 bp, Artificial Sequence
  Synthetic oligonucleotide
ttggccggcaccgcccccgtatcccttacctctcg

SEQ ID NO: 135397 - DNA, 35 bp, Artificial Sequence
  Synthetic oligonucleotide
gtgggggggtggtgcgtggaggtgagcaaccgatg

SEQ ID NO: 135398 - DNA, 35 bp, Artificial Sequence
  Synthetic oligonucleotide
acttgcccagacctcgtctgcctgacaccctccct

SEQ ID NO: 135399 - DNA, 36 bp, Artificial Sequence
  Synthetic oligonucleotide
ttcagtgcaccgtcactattactctccgcccccaca

SEQ ID NO: 135400 - DNA, 35 bp, Artificial Sequence
  Synthetic oligonucleotide
gtaccgttccctccgctccgctccctgccgaccca

SEQ ID NO: 135401 - DNA, 35 bp, Artificial Sequence
  Synthetic oligonucleotide
tccctgtccaagccggcacgctacacctcgctcca

SEQ ID NO: 135402 - DNA, 37 bp, Artificial Sequence
  Synthetic oligonucleotide
gagtagggagggcgggaagttgggtggtgcgcctaga

SEQ ID NO: 135403 - DNA, 37 bp, Artificial Sequence
  Synthetic oligonucleotide
gcaggaaggggaacggggagatggtgcgatggtgcga

SEQ ID NO: 135404 - DNA, 36 bp, Artificial Sequence
  Synthetic oligonucleotide
gaagaggagaaaggtgtcttagcgggggagggtgga

SEQ ID NO: 135405 - DNA, 37 bp, Artificial Sequence
  Synthetic oligonucleotide
tcctgcctcctacctgcttacaacgctcgaccttgga

SEQ ID NO: 135406 - DNA, 38 bp, Artificial Sequence
  Synthetic oligonucleotide
aaccccccccgacctgtgctgtgatccaccgtccctga

SEQ ID NO: 135407 - DNA, 35 bp, Artificial Sequence
  Synthetic oligonucleotide
tctcccccgtagtgacctatctccactcttcctga

SEQ ID NO: 135408 - DNA, 37 bp, Artificial Sequence
  Synthetic oligonucleotide
tgggggagagatggacatggagggaaagggaaagtga

SEQ ID NO: 135409 - DNA, 36 bp, Artificial Sequence
  Synthetic oligonucleotide
gacgtcacgtaccgtatccatgcctgccttcactta

SEQ ID NO: 135410 - DNA, 35 bp, Artificial Sequence
  Synthetic oligonucleotide
accttagccgatccacctgttacatccagatctac

SEQ ID NO: 135411 - DNA, 35 bp, Artificial Sequence
  Synthetic oligonucleotide
tgacatcacctacgtttatcttggcccgccacgcc

SEQ ID NO: 135412 - DNA, 35 bp, Artificial Sequence
  Synthetic oligonucleotide
acatccaatccgttgcttcattccgcactcgcgcc

SEQ ID NO: 135413 - DNA, 35 bp, Artificial Sequence
  Synthetic oligonucleotide
actcgctgtatccgtgctctatcacatctccctcc

SEQ ID NO: 135414 - DNA, 35 bp, Artificial Sequence
  Synthetic oligonucleotide
acttcgggaaccctcatcgctgtccatcattgtcc

SEQ ID NO: 135415 - DNA, 35 bp, Artificial Sequence
  Synthetic oligonucleotide
tcaccgtactcttgtacgaccttttagcctccagc

SEQ ID NO: 135416 - DNA, 35 bp, Artificial Sequence
  Synthetic oligonucleotide
gcctggcctccccactccttgatcatgacaaccgc

SEQ ID NO: 135417 - DNA, 35 bp, Artificial Sequence
  Synthetic oligonucleotide
gcacacgtccagccgcttccagcctcccataccgc

SEQ ID NO: 135418 - DNA, 35 bp, Artificial Sequence
  Synthetic oligonucleotide
gtcgccctcgtcatatctctgccctatccttctgc

SEQ ID NO: 135419 - DNA, 35 bp, Artificial Sequence
  Synthetic oligonucleotide
gcctgtccccagaaccatgcctgctccgtaccgtc

SEQ ID NO: 135420 - DNA, 35 bp, Artificial Sequence
  Synthetic oligonucleotide
ggaagacgaaaggtaagggggcgtggaggaaggat

SEQ ID NO: 135421 - DNA, 35 bp, Artificial Sequence
  Synthetic oligonucleotide
gaaggcggtcgatctgctcggtctctttccccact

SEQ ID NO: 135422 - DNA, 35 bp, Artificial Sequence
  Synthetic oligonucleotide
acgcaacgaaggacgagctaccctttcccccccct

SEQ ID NO: 135423 - DNA, 35 bp, Artificial Sequence
  Synthetic oligonucleotide
tcacccatcattgtccttttaaagtgtcttcgcct

SEQ ID NO: 135424 - DNA, 35 bp, Artificial Sequence
  Synthetic oligonucleotide
atcccgcgccgtattctgtccgtcctgtcctgcct

SEQ ID NO: 135425 - DNA, 35 bp, Artificial Sequence
  Synthetic oligonucleotide
agaacgcagccccaccgaaaggcccccctcttcct

SEQ ID NO: 135426 - DNA, 35 bp, Artificial Sequence
  Synthetic oligonucleotide
tgcctttgccccatttgcccaaccccccaatcggt

SEQ ID NO: 135427 - DNA, 35 bp, Artificial Sequence
  Synthetic oligonucleotide
tgccgggtgggtcgggtggggtgtcgcccgcctgt

SEQ ID NO: 135428 - DNA, 36 bp, Artificial Sequence
  Synthetic oligonucleotide
ttccgctcccatcacctccgtgttcactctggatca

SEQ ID NO: 135429 - DNA, 35 bp, Artificial Sequence
  Synthetic oligonucleotide
gctatcacgtcaacccgttccttccgcgaccttca

SEQ ID NO: 135430 - DNA, 36 bp, Artificial Sequence
  Synthetic oligonucleotide
gacacgccttcgtacaatggcatctcactcccttca

SEQ ID NO: 135431 - DNA, 37 bp, Artificial Sequence
  Synthetic oligonucleotide
gagcaccaccgcgactccgtgccatccattatcccga

SEQ ID NO: 135432 - DNA, 36 bp, Artificial Sequence
  Synthetic oligonucleotide
gaaggaggaaatgggccgggaaagaagttaagggga

SEQ ID NO: 135433 - DNA, 38 bp, Artificial Sequence
  Synthetic oligonucleotide
tcaaccccccgcacctgcgcatctggacctacacttga

SEQ ID NO: 135434 - DNA, 36 bp, Artificial Sequence
  Synthetic oligonucleotide
gcgccttcgccctgctgtgccccccctcttttcata

SEQ ID NO: 135435 - DNA, 35 bp, Artificial Sequence
  Synthetic oligonucleotide
gatgcgtagatccgttacttctgacccctgccgta

SEQ ID NO: 135436 - DNA, 36 bp, Artificial Sequence
  Synthetic oligonucleotide
gtaccccacctgtccgttcccacactgtaacgcgta

SEQ ID NO: 135437 - DNA, 35 bp, Artificial Sequence
  Synthetic oligonucleotide
gacaagctttgatccgcgcctaaccacccctctta

SEQ ID NO: 135438 - DNA, 35 bp, Artificial Sequence
  Synthetic oligonucleotide
tccatgtacagccattgccatccgtcccgcattta

SEQ ID NO: 135439 - DNA, 35 bp, Artificial Sequence
  Synthetic oligonucleotide
tcagtcccacacagctgtctaccggtctgtcacac

SEQ ID NO: 135440 - DNA, 35 bp, Artificial Sequence
  Synthetic oligonucleotide
acgacgtgcagatccctgcgccatacttgtctcac

SEQ ID NO: 135441 - DNA, 35 bp, Artificial Sequence
  Synthetic oligonucleotide
tagtccgtcgcctcgcttattctatcggcctaacc

SEQ ID NO: 135442 - DNA, 35 bp, Artificial Sequence
  Synthetic oligonucleotide
tcccagctcccccgtctgtcattgttctttgttcc

SEQ ID NO: 135443 - DNA, 35 bp, Artificial Sequence
  Synthetic oligonucleotide
accgtgtcatcgtttcccccgtcgattatgtccgc

SEQ ID NO: 135444 - DNA, 35 bp, Artificial Sequence
  Synthetic oligonucleotide
gacatcccacatgccttaactgataaagtcctcgc

SEQ ID NO: 135445 - DNA, 35 bp, Artificial Sequence
  Synthetic oligonucleotide
tccgacgggcgacctttctccccaccgacccgtgc

SEQ ID NO: 135446 - DNA, 35 bp, Artificial Sequence
  Synthetic oligonucleotide
tacgctatatgtccatcgcagcccatccgccttgc

SEQ ID NO: 135447 - DNA, 35 bp, Artificial Sequence
  Synthetic oligonucleotide
atactcgcgctatttagtgcgttttctattccatc

SEQ ID NO: 135448 - DNA, 35 bp, Artificial Sequence
  Synthetic oligonucleotide
aactcgtgagtcccgcccgctgatcttacatcctc

SEQ ID NO: 135449 - DNA, 35 bp, Artificial Sequence
  Synthetic oligonucleotide
gtgactgccccggacccgcatgagcgtctcctttc

SEQ ID NO: 135450 - DNA, 35 bp, Artificial Sequence
  Synthetic oligonucleotide
tcacactcagtcctcgagtgtacagattcccacct

SEQ ID NO: 135451 - DNA, 35 bp, Artificial Sequence
  Synthetic oligonucleotide
ttgccccatctcttagcgttttgctcccccctggt

SEQ ID NO: 135452 - DNA, 35 bp, Artificial Sequence
  Synthetic oligonucleotide
tgcccctccattgacttcgctcgcgcccgcttctt

SEQ ID NO: 135453 - DNA, 36 bp, Artificial Sequence
  Synthetic oligonucleotide
tccccacctcacacaaccgctataatgcctcaacaa

SEQ ID NO: 135454 - DNA, 36 bp, Artificial Sequence
  Synthetic oligonucleotide
gagcaccacctggtctttcttcccccgccgttcaca

SEQ ID NO: 135455 - DNA, 36 bp, Artificial Sequence
  Synthetic oligonucleotide
ggggggatccagaaagagggaagggaaaggcgtaca

SEQ ID NO: 135456 - DNA, 36 bp, Artificial Sequence
  Synthetic oligonucleotide
tcaacgcttacccagccggtgccctcttgctcccca

SEQ ID NO: 135457 - DNA, 36 bp, Artificial Sequence
  Synthetic oligonucleotide
gggggctcgccctatgtctgctactcgatccctcca

SEQ ID NO: 135458 - DNA, 36 bp, Artificial Sequence
  Synthetic oligonucleotide
accaccgcgtgtttttgttcagccccccctttttca

SEQ ID NO: 135459 - DNA, 35 bp, Artificial Sequence
  Synthetic oligonucleotide
tgttccccgccgctatctacaatcctcgttaacga

SEQ ID NO: 135460 - DNA, 37 bp, Artificial Sequence
  Synthetic oligonucleotide
tacatccatccaggagtctacctgatccatcccccga

SEQ ID NO: 135461 - DNA, 37 bp, Artificial Sequence
  Synthetic oligonucleotide
tgctgaggggaaaaaaagtggggcgggcttatgggga

SEQ ID NO: 135462 - DNA, 37 bp, Artificial Sequence
  Synthetic oligonucleotide
tccgcactctcttaccgtgttgccccctctctgttga

SEQ ID NO: 135463 - DNA, 35 bp, Artificial Sequence
  Synthetic oligonucleotide
gctctgtcgcggcgttcggctccggtcctccccac

SEQ ID NO: 135464 - DNA, 35 bp, Artificial Sequence
  Synthetic oligonucleotide
gccgcattcactctcgcctgtttgctcgcttccac

SEQ ID NO: 135465 - DNA, 35 bp, Artificial Sequence
  Synthetic oligonucleotide
tgaagcacgcaatactgcgtttcacctctttccac

SEQ ID NO: 135466 - DNA, 35 bp, Artificial Sequence
  Synthetic oligonucleotide
acacgaccgtatctcgtgtgtacaccttagccccc

SEQ ID NO: 135467 - DNA, 35 bp, Artificial Sequence
  Synthetic oligonucleotide
ttcgtcgagcaatgtgcccttgccgtaccattccc

SEQ ID NO: 135468 - DNA, 35 bp, Artificial Sequence
  Synthetic oligonucleotide
taaccaccatcgacgccattcttgcctcatgctcc

SEQ ID NO: 135469 - DNA, 35 bp, Artificial Sequence
  Synthetic oligonucleotide
cccgatcatcatgtaccctcccgtaccgcccctgc

SEQ ID NO: 135470 - DNA, 35 bp, Artificial Sequence
  Synthetic oligonucleotide
atccttggcctcaagctgcaattgcccctcgcctc

SEQ ID NO: 135471 - DNA, 33 bp, Artificial Sequence
  Synthetic oligonucleotide
ggagcgccactcaccccgatgatccctctgctc

SEQ ID NO: 135472 - DNA, 35 bp, Artificial Sequence
  Synthetic oligonucleotide
gccatcacgccggtactcgcgtgttcactcatctc

SEQ ID NO: 135473 - DNA, 35 bp, Artificial Sequence
  Synthetic oligonucleotide
gcagacgtattatgtccgccgtctcacccgtcttc

SEQ ID NO: 135474 - DNA, 35 bp, Artificial Sequence
  Synthetic oligonucleotide
aactgcatgtccccctcctgcgatccaccaaactg

SEQ ID NO: 135475 - DNA, 35 bp, Artificial Sequence
  Synthetic oligonucleotide
tcaaacgccagtctcctccgttgctcagttacact

SEQ ID NO: 135476 - DNA, 35 bp, Artificial Sequence
  Synthetic oligonucleotide
atccgacgcacccacgttatcgcgtgccgccccct

SEQ ID NO: 135477 - DNA, 35 bp, Artificial Sequence
  Synthetic oligonucleotide
tgcggatgacaacgcttttagggcccatctctcct

SEQ ID NO: 135478 - DNA, 36 bp, Artificial Sequence
  Synthetic oligonucleotide
tccgcctcctccctgaccgcgtgcccgacaccgtaa

SEQ ID NO: 135479 - DNA, 36 bp, Artificial Sequence
  Synthetic oligonucleotide
accaggggcctttcgctgtttccttcccgcctccga

SEQ ID NO: 135480 - DNA, 37 bp, Artificial Sequence
  Synthetic oligonucleotide
gaatggggacggggggagccaagtgaaagtcgcggga

SEQ ID NO: 135481 - DNA, 37 bp, Artificial Sequence
  Synthetic oligonucleotide
tgctccctcatatcctctcctacgtactgtactttga

SEQ ID NO: 135482 - DNA, 36 bp, Artificial Sequence
  Synthetic oligonucleotide
atcgcccacctgttatcgtgccctatggtttccata

SEQ ID NO: 135483 - DNA, 36 bp, Artificial Sequence
  Synthetic oligonucleotide
gttagcacggtcactgcccctcgtttccgtattcta

SEQ ID NO: 135484 - DNA, 35 bp, Artificial Sequence
  Synthetic oligonucleotide
tgcccctatcctgaatgcatgttctgcccccacac

SEQ ID NO: 135485 - DNA, 35 bp, Artificial Sequence
  Synthetic oligonucleotide
gctccaacgtaggtgcgctgttacccattcccacc

SEQ ID NO: 135486 - DNA, 35 bp, Artificial Sequence
  Synthetic oligonucleotide
tcctcctcgcgcctgtcttcagcacccacccagcc

SEQ ID NO: 135487 - DNA, 35 bp, Artificial Sequence
  Synthetic oligonucleotide
atccgaacgtaccaccccgccaccctctggacgcc

SEQ ID NO: 135488 - DNA, 35 bp, Artificial Sequence
  Synthetic oligonucleotide
gacctccgtgcaacgacgcccccctgccgcgcgcc

SEQ ID NO: 135489 - DNA, 35 bp, Artificial Sequence
  Synthetic oligonucleotide
attctcccgccctgtgaacttgtcgccgacgtgcc

SEQ ID NO: 135490 - DNA, 35 bp, Artificial Sequence
  Synthetic oligonucleotide
gagtgctcccttgtactcgtggttttctggtctcc

SEQ ID NO: 135491 - DNA, 35 bp, Artificial Sequence
  Synthetic oligonucleotide
acacacgcccgcgcatatttctcgtccttccaggc

SEQ ID NO: 135492 - DNA, 35 bp, Artificial Sequence
  Synthetic oligonucleotide
tccgactccgcacttcccgcccgatcccgcctggc

SEQ ID NO: 135493 - DNA, 35 bp, Artificial Sequence
  Synthetic oligonucleotide
gccactcgcgtggtgtcatctctcccctccgcctc

SEQ ID NO: 135494 - DNA, 35 bp, Artificial Sequence
  Synthetic oligonucleotide
gacctgacccctgccatctgtttcatctgtccttc

SEQ ID NO: 135495 - DNA, 35 bp, Artificial Sequence
  Synthetic oligonucleotide
tctcgcccttctcggtacatcacgctcgttccccg

SEQ ID NO: 135496 - DNA, 35 bp, Artificial Sequence
  Synthetic oligonucleotide
tcccacagatgtctttaaccgttgccatccattcg

SEQ ID NO: 135497 - DNA, 35 bp, Artificial Sequence
  Synthetic oligonucleotide
gaacgaagggagggagtggaagggatggaacgtat

SEQ ID NO: 135498 - DNA, 35 bp, Artificial Sequence
  Synthetic oligonucleotide
tgccttctgccgtttactcgaggcctaccactcct

SEQ ID NO: 135499 - DNA, 35 bp, Artificial Sequence
  Synthetic oligonucleotide
acctctgccgccgttcttacgccttcctcaggtct

SEQ ID NO: 135500 - DNA, 33 bp, Artificial Sequence
  Synthetic oligonucleotide
gcgatgcggcattcttttccggctctacacctt

SEQ ID NO: 135501 - DNA, 35 bp, Artificial Sequence
  Synthetic oligonucleotide
gtcgccgacccctgttccctaggccctatagtttt

SEQ ID NO: 135502 - DNA, 35 bp, Artificial Sequence
  Synthetic oligonucleotide
ttctgctctgtcagtggcccccgcccctctccgaa

SEQ ID NO: 135503 - DNA, 36 bp, Artificial Sequence
  Synthetic oligonucleotide
gcgtgagccccctgatacgccatcccggacctttaa

SEQ ID NO: 135504 - DNA, 36 bp, Artificial Sequence
  Synthetic oligonucleotide
tgtgacgccacgtgtcaatcccccagcccggcccca

SEQ ID NO: 135505 - DNA, 36 bp, Artificial Sequence
  Synthetic oligonucleotide
gcccatgcccctactgcctcccctttgcgccatgca

SEQ ID NO: 135506 - DNA, 37 bp, Artificial Sequence
  Synthetic oligonucleotide
gcactgcccctactactgccccccttgtgtcccacga

SEQ ID NO: 135507 - DNA, 37 bp, Artificial Sequence
  Synthetic oligonucleotide
gccgcccggaaactgctgcttatttctacgccttcga

SEQ ID NO: 135508 - DNA, 37 bp, Artificial Sequence
  Synthetic oligonucleotide
tgagtcccaggagtgatggggctgggggagtggggga

SEQ ID NO: 135509 - DNA, 37 bp, Artificial Sequence
  Synthetic oligonucleotide
accccgctccctccttggtaagacccgttgaccttga

SEQ ID NO: 135510 - DNA, 38 bp, Artificial Sequence
  Synthetic oligonucleotide
cccatccgccacatagctttagcgcgccccgcccttga

SEQ ID NO: 135511 - DNA, 36 bp, Artificial Sequence
  Synthetic oligonucleotide
tgctacgcccggaatctgtccaatcctctactcgta

SEQ ID NO: 135512 - DNA, 35 bp, Artificial Sequence
  Synthetic oligonucleotide
tacccactggtctgtcctgctttacttcgatatta

SEQ ID NO: 135513 - DNA, 31 bp, Artificial Sequence
  Synthetic oligonucleotide
gtctactccgaacctcgcccttgttagctta

SEQ ID NO: 135514 - DNA, 35 bp, Artificial Sequence
  Synthetic oligonucleotide
tccaacactgccttcgcgtttctgtcccaccgtac

SEQ ID NO: 135515 - DNA, 35 bp, Artificial Sequence
  Synthetic oligonucleotide
gcagatgtgtgcatcatgatgccttcctgcttacc

SEQ ID NO: 135516 - DNA, 35 bp, Artificial Sequence
  Synthetic oligonucleotide
gccatacacccgcatcccgagactcgacagagccc

SEQ ID NO: 135517 - DNA, 35 bp, Artificial Sequence
  Synthetic oligonucleotide
accacctgctggctaccattagtgccaaaccgccc

SEQ ID NO: 135518 - DNA, 35 bp, Artificial Sequence
  Synthetic oligonucleotide
atcgggtcgcgatttgcttacgttcccttcttccc

SEQ ID NO: 135519 - DNA, 34 bp, Artificial Sequence
  Synthetic oligonucleotide
tttaccacgcccagacatactaatgcactgttcc

SEQ ID NO: 135520 - DNA, 35 bp, Artificial Sequence
  Synthetic oligonucleotide
atcctccatcagtctggcgtccgtaacctgcctgc

SEQ ID NO: 135521 - DNA, 35 bp, Artificial Sequence
  Synthetic oligonucleotide
aacgccacacctgcctattttcctcgttcgcgttc

SEQ ID NO: 135522 - DNA, 35 bp, Artificial Sequence
  Synthetic oligonucleotide
ttactcccgcttgctcgtgcccacctcgttctccg

SEQ ID NO: 135523 - DNA, 35 bp, Artificial Sequence
  Synthetic oligonucleotide
atctagccacaacattagttctatcgccccgctcg

SEQ ID NO: 135524 - DNA, 35 bp, Artificial Sequence
  Synthetic oligonucleotide
gcaacttgcacgtcttcccatgttttcgttctctg

SEQ ID NO: 135525 - DNA, 35 bp, Artificial Sequence
  Synthetic oligonucleotide
atcttccccgaccctgcatcacagtactctgagtg

SEQ ID NO: 135526 - DNA, 35 bp, Artificial Sequence
  Synthetic oligonucleotide
acaccattgcctcaccttcgcccgcacgactacat

SEQ ID NO: 135527 - DNA, 36 bp, Artificial Sequence
  Synthetic oligonucleotide
atactgcccccctttgtcgctcgagccttattaaca

SEQ ID NO: 135528 - DNA, 36 bp, Artificial Sequence
  Synthetic oligonucleotide
tcacccactcacgtgcctccttgtgtgctacttaca

SEQ ID NO: 135529 - DNA, 36 bp, Artificial Sequence
  Synthetic oligonucleotide
ccacacataccgccattgctgccactaagcccacca

SEQ ID NO: 135530 - DNA, 35 bp, Artificial Sequence
  Synthetic oligonucleotide
atgtgagcttccctggctgtaccatcaccttccca

SEQ ID NO: 135531 - DNA, 36 bp, Artificial Sequence
  Synthetic oligonucleotide
actggtgcccccgcccgcgtctagcactcttctcca

SEQ ID NO: 135532 - DNA, 36 bp, Artificial Sequence
  Synthetic oligonucleotide
aactaggtgacaggggtgacgggggggcgaggtgca

SEQ ID NO: 135533 - DNA, 36 bp, Artificial Sequence
  Synthetic oligonucleotide
accagcatatggtgtcaccccctgtcgccccttgca

SEQ ID NO: 135534 - DNA, 36 bp, Artificial Sequence
  Synthetic oligonucleotide
atcctccagcgccgtccgtagctatctcacccctca

SEQ ID NO: 135535 - DNA, 35 bp, Artificial Sequence
  Synthetic oligonucleotide
gcccactcttcctatgccgaccggagggcccctca

SEQ ID NO: 135536 - DNA, 36 bp, Artificial Sequence
  Synthetic oligonucleotide
gccgcctccctctcctagctacacgttacggtctca

SEQ ID NO: 135537 - DNA, 36 bp, Artificial Sequence
  Synthetic oligonucleotide
ttcaccgtcgctcccccgttatcggccctcgtttca

SEQ ID NO: 135538 - DNA, 37 bp, Artificial Sequence
  Synthetic oligonucleotide
gccccctccgcctgctttaactacagagacctcgaga

SEQ ID NO: 135539 - DNA, 36 bp, Artificial Sequence
  Synthetic oligonucleotide
agtgagaaggggggtaggcgaatggggaaggcacga

SEQ ID NO: 135540 - DNA, 37 bp, Artificial Sequence
  Synthetic oligonucleotide
tatcactgggggcggttggaaggcggagggaggagga

SEQ ID NO: 135541 - DNA, 37 bp, Artificial Sequence
  Synthetic oligonucleotide
gagacaaggcgtgaaaggaggaaagattgcggcggga

SEQ ID NO: 135542 - DNA, 38 bp, Artificial Sequence
  Synthetic oligonucleotide
gtgcgtacgcagcagagtacacgcttgtccctccctga

SEQ ID NO: 135543 - DNA, 38 bp, Artificial Sequence
  Synthetic oligonucleotide
agtcgacgccaagtatctgctccatttctgccctctga

SEQ ID NO: 135544 - DNA, 35 bp, Artificial Sequence
  Synthetic oligonucleotide
tccacatcccgctttcctatgctactgagcacata

SEQ ID NO: 135545 - DNA, 36 bp, Artificial Sequence
  Synthetic oligonucleotide
ggaggaggggtgacggggggtcggacgctactggta

SEQ ID NO: 135546 - DNA, 35 bp, Artificial Sequence
  Synthetic oligonucleotide
gcgatgccccacttgacgcgctcctgcctccacac

SEQ ID NO: 135547 - DNA, 35 bp, Artificial Sequence
  Synthetic oligonucleotide
aatgccgctccccacttgcacccacgacacgtacc

SEQ ID NO: 135548 - DNA, 35 bp, Artificial Sequence
  Synthetic oligonucleotide
tatccgtccctcgccgccatgttgttgttctaccc

SEQ ID NO: 135549 - DNA, 35 bp, Artificial Sequence
  Synthetic oligonucleotide
taaatcccacgcccgcccaccgaggtactgttccc

SEQ ID NO: 135550 - DNA, 35 bp, Artificial Sequence
  Synthetic oligonucleotide
tccgcacaacagacactgaacttaccgtgcctctc

SEQ ID NO: 135551 - DNA, 35 bp, Artificial Sequence
  Synthetic oligonucleotide
gcaaacgccttcctgctgtcaccctctattttgtc

SEQ ID NO: 135552 - DNA, 35 bp, Artificial Sequence
  Synthetic oligonucleotide
ggtacggacgggggtgggggaaaaatctgcagtgg

SEQ ID NO: 135553 - DNA, 35 bp, Artificial Sequence
  Synthetic oligonucleotide
tgtagccccacctcgtttttgtttcctgcaatggt

SEQ ID NO: 135554 - DNA, 35 bp, Artificial Sequence
  Synthetic oligonucleotide
tcccgactcaccgttaggactttccccactcatgt

SEQ ID NO: 135555 - DNA, 35 bp, Artificial Sequence
  Synthetic oligonucleotide
gcgtcaacgcagccgcttcctgactaccccgcttt

SEQ ID NO: 135556 - DNA, 36 bp, Artificial Sequence
  Synthetic oligonucleotide
gaccaagggagccggaaaaaggaagatggggttgaa

SEQ ID NO: 135557 - DNA, 35 bp, Artificial Sequence
  Synthetic oligonucleotide
gcgtaccggtcaccatcgctccctgattcttcaca

SEQ ID NO: 135558 - DNA, 36 bp, Artificial Sequence
  Synthetic oligonucleotide
tccgccgcctttcatctggcgtcctagttggcccca

SEQ ID NO: 135559 - DNA, 36 bp, Artificial Sequence
  Synthetic oligonucleotide
ttagccccagctcggccatttcaacgccctggccca

SEQ ID NO: 135560 - DNA, 35 bp, Artificial Sequence
  Synthetic oligonucleotide
ttcatccaacgggagggtgggagagagggtccgca

SEQ ID NO: 135561 - DNA, 36 bp, Artificial Sequence
  Synthetic oligonucleotide
tgctacaccgccggacggtcctcccccacccgccga

SEQ ID NO: 135562 - DNA, 36 bp, Artificial Sequence
  Synthetic oligonucleotide
acgaaccatcaactcccttgcgctcctgtctcgcga

SEQ ID NO: 135563 - DNA, 37 bp, Artificial Sequence
  Synthetic oligonucleotide
ggtggcatcaccacgccgccacaatattgcccctcga

SEQ ID NO: 135564 - DNA, 37 bp, Artificial Sequence
  Synthetic oligonucleotide
accccgtcttggcgctgttcaatcacctctctacgga

SEQ ID NO: 135565 - DNA, 34 bp, Artificial Sequence
  Synthetic oligonucleotide
tgagcgccctcttcccatgttgcccctcaccgga

SEQ ID NO: 135566 - DNA, 35 bp, Artificial Sequence
  Synthetic oligonucleotide
cgccctttgtctctcccgcccagtccgcgcctgga

SEQ ID NO: 135567 - DNA, 38 bp, Artificial Sequence
  Synthetic oligonucleotide
gagttcgggggtgggggagtggaggaggcggagagtga

SEQ ID NO: 135568 - DNA, 37 bp, Artificial Sequence
  Synthetic oligonucleotide
gtggagggcggagagggagctcaggggactcaggtga

SEQ ID NO: 135569 - DNA, 38 bp, Artificial Sequence
  Synthetic oligonucleotide
aaggggaagggggaggaatggcggggaccgaaggttga

SEQ ID NO: 135570 - DNA, 38 bp, Artificial Sequence
  Synthetic oligonucleotide
ttggcccccctctctgcccatcagtgacatcctgttga

SEQ ID NO: 135571 - DNA, 36 bp, Artificial Sequence
  Synthetic oligonucleotide
gcgccccttcatcctgctcgttccagtatgtaaata

SEQ ID NO: 135572 - DNA, 36 bp, Artificial Sequence
  Synthetic oligonucleotide
tccgacccacgtctccgtctattttcgtggccatta

SEQ ID NO: 135573 - DNA, 35 bp, Artificial Sequence
  Synthetic oligonucleotide
gttacgtgcgggtgatcattagctcctccttcccc

SEQ ID NO: 135574 - DNA, 35 bp, Artificial Sequence
  Synthetic oligonucleotide
gccacatcaggtaagcaaatcacctcggcccttcc

SEQ ID NO: 135575 - DNA, 35 bp, Artificial Sequence
  Synthetic oligonucleotide
acgaccgcattacttctacgacgtctgccccttgc

SEQ ID NO: 135576 - DNA, 35 bp, Artificial Sequence
  Synthetic oligonucleotide
gcgcagtctcaccacgacgttaagctcaccccctc

SEQ ID NO: 135577 - DNA, 35 bp, Artificial Sequence
  Synthetic oligonucleotide
tccatgaggcctatgccgctcttgttcaccttgtc

SEQ ID NO: 135578 - DNA, 35 bp, Artificial Sequence
  Synthetic oligonucleotide
gtgacgctcgccctggatcccactctttaatttag

SEQ ID NO: 135579 - DNA, 35 bp, Artificial Sequence
  Synthetic oligonucleotide
tagtgatggcggaagtagaactgggggagaggggg

SEQ ID NO: 135580 - DNA, 35 bp, Artificial Sequence
  Synthetic oligonucleotide
taccacgtccctttgcttagtcaccccccgcccat

SEQ ID NO: 135581 - DNA, 35 bp, Artificial Sequence
  Synthetic oligonucleotide
gcagacccacacccgcccaagcccaagcagccttt

SEQ ID NO: 135582 - DNA, 36 bp, Artificial Sequence
  Synthetic oligonucleotide
tcgaacgggaaggatggggcggggcaggtgaggcaa

SEQ ID NO: 135583 - DNA, 37 bp, Artificial Sequence
  Synthetic oligonucleotide
gtgggatgcaagagggagggagagtacattagggaga

SEQ ID NO: 135584 - DNA, 36 bp, Artificial Sequence
  Synthetic oligonucleotide
gaaccccccatggctgtttcttcgttccctttacga

SEQ ID NO: 135585 - DNA, 37 bp, Artificial Sequence
  Synthetic oligonucleotide
taccaaccgcctgccttattgacgcgtcctcttgcga

SEQ ID NO: 135586 - DNA, 35 bp, Artificial Sequence
  Synthetic oligonucleotide
gcgccttctcgcctcatctccgcactcgcgccgta

SEQ ID NO: 135587 - DNA, 36 bp, Artificial Sequence
  Synthetic oligonucleotide
tgagcacacgcctctacttaacgctccccccggtta

SEQ ID NO: 135588 - DNA, 35 bp, Artificial Sequence
  Synthetic oligonucleotide
tccagcatagtgcctccctgttttcggcttatcac

SEQ ID NO: 135589 - DNA, 35 bp, Artificial Sequence
  Synthetic oligonucleotide
gccctccgtcaccttacgttatcactcacactcac

SEQ ID NO: 135590 - DNA, 36 bp, Artificial Sequence
  Synthetic oligonucleotide
tgtcccttcgctccatgttgttcttcgccatctgac

SEQ ID NO: 135591 - DNA, 35 bp, Artificial Sequence
  Synthetic oligonucleotide
gaacgagcggcacattatatccttccgtctgtacc

SEQ ID NO: 135592 - DNA, 35 bp, Artificial Sequence
  Synthetic oligonucleotide
gagccgcatgatccacctaccaactgctgcacccc

SEQ ID NO: 135593 - DNA, 35 bp, Artificial Sequence
  Synthetic oligonucleotide
tcccattctagcccactcgccatgccgtaaatgcc

SEQ ID NO: 135594 - DNA, 35 bp, Artificial Sequence
  Synthetic oligonucleotide
gtggtccgaaccatcactaccattcctgctctgcc

SEQ ID NO: 135595 - DNA, 35 bp, Artificial Sequence
  Synthetic oligonucleotide
acgcgctgtgagcttctttcacccctgctgttgcc

SEQ ID NO: 135596 - DNA, 35 bp, Artificial Sequence
  Synthetic oligonucleotide
atatagccacggccctgtaccctagtctgtcttcc

SEQ ID NO: 135597 - DNA, 35 bp, Artificial Sequence
  Synthetic oligonucleotide
tgccttccgccatggactgtccaccgcgctgttcc

SEQ ID NO: 135598 - DNA, 35 bp, Artificial Sequence
  Synthetic oligonucleotide
gatccttgcccgcatctccttgcgttacgctttcc

SEQ ID NO: 135599 - DNA, 35 bp, Artificial Sequence
  Synthetic oligonucleotide
aagaccgatacactatgtccgccgttttaccccgc

SEQ ID NO: 135600 - DNA, 35 bp, Artificial Sequence
  Synthetic oligonucleotide
tcccgctgcattacctcgttctgaaatcgccccgc

SEQ ID NO: 135601 - DNA, 35 bp, Artificial Sequence
  Synthetic oligonucleotide
tcgcggtcgtctctccgtcgtcattacaccgccgc

SEQ ID NO: 135602 - DNA, 35 bp, Artificial Sequence
  Synthetic oligonucleotide
gtgaagggattagggagggaaatcgggtaggacgg

SEQ ID NO: 135603 - DNA, 35 bp, Artificial Sequence
  Synthetic oligonucleotide
gaaggacagggaactgggggggtcaagaagacggg

SEQ ID NO: 135604 - DNA, 35 bp, Artificial Sequence
  Synthetic oligonucleotide
tccccgttccctttatgtgctatcgccataccctg

SEQ ID NO: 135605 - DNA, 35 bp, Artificial Sequence
  Synthetic oligonucleotide
acagcatcccgccacccctccaacgtttaatgttg

SEQ ID NO: 135606 - DNA, 35 bp, Artificial Sequence
  Synthetic oligonucleotide
tgcccccacgctcaagcccggcccaactccttcct

SEQ ID NO: 135607 - DNA, 35 bp, Artificial Sequence
  Synthetic oligonucleotide
gctgacccctccctctttccccgcctcgcttcgct

SEQ ID NO: 135608 - DNA, 35 bp, Artificial Sequence
  Synthetic oligonucleotide
tcccactcccgactctatgactcccaaaatgtgct

SEQ ID NO: 135609 - DNA, 35 bp, Artificial Sequence
  Synthetic oligonucleotide
tcccaccagcgcaattgagcgtctcattccactct

SEQ ID NO: 135610 - DNA, 35 bp, Artificial Sequence
  Synthetic oligonucleotide
ttgctgacatctgacccgcgcaccccccacttagt

SEQ ID NO: 135611 - DNA, 35 bp, Artificial Sequence
  Synthetic oligonucleotide
accatcccagccactgcccctcgaagacccgctgt

SEQ ID NO: 135612 - DNA, 35 bp, Artificial Sequence
  Synthetic oligonucleotide
atcgtcgcactcgccctttaaccctgatctcgctt

SEQ ID NO: 135613 - DNA, 36 bp, Artificial Sequence
  Synthetic oligonucleotide
acaccgcgaacgagcggttgtagtacacttatccca

SEQ ID NO: 135614 - DNA, 37 bp, Artificial Sequence
  Synthetic oligonucleotide
tccaccgaatgttcttggtaaacgcctcctacctcga

SEQ ID NO: 135615 - DNA, 36 bp, Artificial Sequence
  Synthetic oligonucleotide
gatgccccctcactggtattgctaacaccgaactga

SEQ ID NO: 135616 - DNA, 38 bp, Artificial Sequence
  Synthetic oligonucleotide
ggagacagcagtaaggaggatgaggggaatgggtgtga

SEQ ID NO: 135617 - DNA, 36 bp, Artificial Sequence
  Synthetic oligonucleotide
gccccgccgctgtccctgctctattctgactccata

SEQ ID NO: 135618 - DNA, 35 bp, Artificial Sequence
  Synthetic oligonucleotide
acaccccttcaccacgtacgaccgaaggttgctta

SEQ ID NO: 135619 - DNA, 35 bp, Artificial Sequence
  Synthetic oligonucleotide
gctgatacgaccgtgctcgctccctgttactttta

SEQ ID NO: 135620 - DNA, 35 bp, Artificial Sequence
  Synthetic oligonucleotide
tgccatacctgcttttacaccagccccagctgacc

SEQ ID NO: 135621 - DNA, 35 bp, Artificial Sequence
  Synthetic oligonucleotide
gcacgccaataatgaattcggctccctgacccccc

SEQ ID NO: 135622 - DNA, 35 bp, Artificial Sequence
  Synthetic oligonucleotide
gcgccgccgtgcccgaatcggtcgctccacctccc

SEQ ID NO: 135623 - DNA, 35 bp, Artificial Sequence
  Synthetic oligonucleotide
gaaactgctaccatctcgccccgcttgagccatcc

SEQ ID NO: 135624 - DNA, 35 bp, Artificial Sequence
  Synthetic oligonucleotide
gctccgccctgttgctctatccgtgctgcgcaatc

SEQ ID NO: 135625 - DNA, 35 bp, Artificial Sequence
  Synthetic oligonucleotide
tcccgattccgtttcccccgtgcaccagattcatc

SEQ ID NO: 135626 - DNA, 35 bp, Artificial Sequence
  Synthetic oligonucleotide
agtcgactacctccgcttgcattgataccttggtc

SEQ ID NO: 135627 - DNA, 35 bp, Artificial Sequence
  Synthetic oligonucleotide
tgttaacctgtggaccacccgccgtgcttttcccg

SEQ ID NO: 135628 - DNA, 35 bp, Artificial Sequence
  Synthetic oligonucleotide
aacgtgcacgggtaggaataggggggagtagaatg

SEQ ID NO: 135629 - DNA, 35 bp, Artificial Sequence
  Synthetic oligonucleotide
gcggatgaaggaaaggtagggcgggcgggacaaat

SEQ ID NO: 135630 - DNA, 35 bp, Artificial Sequence
  Synthetic oligonucleotide
tccaggtctagtcgctctcttacggccccttctct

SEQ ID NO: 135631 - DNA, 35 bp, Artificial Sequence
  Synthetic oligonucleotide
tcggggtcgctgccgtgccctgtcatccctattct

SEQ ID NO: 135632 - DNA, 35 bp, Artificial Sequence
  Synthetic oligonucleotide
gcatggaggtggaaaaaaggggtagacggcgagtt

SEQ ID NO: 135633 - DNA, 36 bp, Artificial Sequence
  Synthetic oligonucleotide
agccacccctcaggtccacgattcccgctgcctcca

SEQ ID NO: 135634 - DNA, 35 bp, Artificial Sequence
  Synthetic oligonucleotide
ggatgctcacccccgtgccgagcccctcatctcca

SEQ ID NO: 135635 - DNA, 37 bp, Artificial Sequence
  Synthetic oligonucleotide
gatcgggatgggaacgggtgggagacccaggagaaga

SEQ ID NO: 135636 - DNA, 37 bp, Artificial Sequence
  Synthetic oligonucleotide
gagagggaaagtaagggatcattgggcgggccgggga

SEQ ID NO: 135637 - DNA, 35 bp, Artificial Sequence
  Synthetic oligonucleotide
ccagttgcacctgttttctcctctccgccccgtga

SEQ ID NO: 135638 - DNA, 38 bp, Artificial Sequence
  Synthetic oligonucleotide
ggggcggggacatctggggttcaaggtacagggggtga

SEQ ID NO: 135639 - DNA, 38 bp, Artificial Sequence
  Synthetic oligonucleotide
gtgcgccctccacatgtactgattgccttaccctttga

SEQ ID NO: 135640 - DNA, 36 bp, Artificial Sequence
  Synthetic oligonucleotide
tcccccggcaaccatgtggtttccctccatccgcta

SEQ ID NO: 135641 - DNA, 36 bp, Artificial Sequence
  Synthetic oligonucleotide
gcaatcgccaatcaccgtcctgcacttccctgagta

SEQ ID NO: 135642 - DNA, 35 bp, Artificial Sequence
  Synthetic oligonucleotide
gccactcagttaccgccgcacatatgacctcctac

SEQ ID NO: 135643 - DNA, 35 bp, Artificial Sequence
  Synthetic oligonucleotide
tagtccacaggccgccccctacacgacccttcccc

SEQ ID NO: 135644 - DNA, 35 bp, Artificial Sequence
  Synthetic oligonucleotide
tcaccgcccccttctgcttagtgccggttacgccc

SEQ ID NO: 135645 - DNA, 35 bp, Artificial Sequence
  Synthetic oligonucleotide
gggacgtaccatcatgtaaattggcgccccttccc

SEQ ID NO: 135646 - DNA, 35 bp, Artificial Sequence
  Synthetic oligonucleotide
gtgatcattccgttgtccagcccgttctagccatc

SEQ ID NO: 135647 - DNA, 35 bp, Artificial Sequence
  Synthetic oligonucleotide
aatgacaaggaagagaggggaaggtcatgcaggag

SEQ ID NO: 135648 - DNA, 35 bp, Artificial Sequence
  Synthetic oligonucleotide
tccgcccagccctgtttgacaaattatatcgcctg

SEQ ID NO: 135649 - DNA, 35 bp, Artificial Sequence
  Synthetic oligonucleotide
tccagacgcactaatacgtaccacccccaaaagtg

SEQ ID NO: 135650 - DNA, 35 bp, Artificial Sequence
  Synthetic oligonucleotide
tccacttgtcaaccgcctatcctcacccctcattg

SEQ ID NO: 135651 - DNA, 35 bp, Artificial Sequence
  Synthetic oligonucleotide
tagtacgcgcaaccttctttcagtgtcatactcct

SEQ ID NO: 135652 - DNA, 35 bp, Artificial Sequence
  Synthetic oligonucleotide
tatccctcccaccggtctacgggaatatgcctcct

SEQ ID NO: 135653 - DNA, 35 bp, Artificial Sequence
  Synthetic oligonucleotide
ttccaccgccagtcgacattatgccgggccccctt

SEQ ID NO: 135654 - DNA, 35 bp, Artificial Sequence
  Synthetic oligonucleotide
atgtactaccaccgccactttgttcttttcgtgtt

SEQ ID NO: 135655 - DNA, 35 bp, Artificial Sequence
  Synthetic oligonucleotide
tgccgtcaatctcacttagcccgaccgcccttgaa

SEQ ID NO: 135656 - DNA, 35 bp, Artificial Sequence
  Synthetic oligonucleotide
atccaactacatcgcttgcctgtcctcgtttcaca

SEQ ID NO: 135657 - DNA, 34 bp, Artificial Sequence
  Synthetic oligonucleotide
atgtacacccggagctttgtgccccttccaacca

SEQ ID NO: 135658 - DNA, 35 bp, Artificial Sequence
  Synthetic oligonucleotide
gtccaccccgttgaccggtttacctagccctccca

SEQ ID NO: 135659 - DNA, 37 bp, Artificial Sequence
  Synthetic oligonucleotide
gaggagtaggctgaaggaaggcggggcgggatgcaga

SEQ ID NO: 135660 - DNA, 37 bp, Artificial Sequence
  Synthetic oligonucleotide
gtccccccccacgtggttctatgtctctcccaaacga

SEQ ID NO: 135661 - DNA, 37 bp, Artificial Sequence
  Synthetic oligonucleotide
tcccccctccagctccatgcaaccgtctgctcgacga

SEQ ID NO: 135662 - DNA, 37 bp, Artificial Sequence
  Synthetic oligonucleotide
tcgagggggagggcatagaaagggtgggctacatcga

SEQ ID NO: 135663 - DNA, 36 bp, Artificial Sequence
  Synthetic oligonucleotide
tgtgatgcgccttgactatgcttcctccccaccgga

SEQ ID NO: 135664 - DNA, 37 bp, Artificial Sequence
  Synthetic oligonucleotide
gggattaggtggaggtaagggagcaacggggagggga

SEQ ID NO: 135665 - DNA, 36 bp, Artificial Sequence
  Synthetic oligonucleotide
aagcgcacatggggactggggtgcgggatgagggga

SEQ ID NO: 135666 - DNA, 37 bp, Artificial Sequence
  Synthetic oligonucleotide
aacgcgccccgtttttccatcttatctgtgaccctga

SEQ ID NO: 135667 - DNA, 37 bp, Artificial Sequence
  Synthetic oligonucleotide
tccactcctcgcccatattgagccgtccccatgctga

SEQ ID NO: 135668 - DNA, 38 bp, Artificial Sequence
  Synthetic oligonucleotide
aagacggcgagggggggggaagggctggcggggtctga

SEQ ID NO: 135669 - DNA, 35 bp, Artificial Sequence
  Synthetic oligonucleotide
tgaccacacttgatagactagcgccaccttcccac

SEQ ID NO: 135670 - DNA, 35 bp, Artificial Sequence
  Synthetic oligonucleotide
tctatccaccacctgcccaatgacttagtagttac

SEQ ID NO: 135671 - DNA, 35 bp, Artificial Sequence
  Synthetic oligonucleotide
tcgttccaccaccgaggctatcgctcatctacacc

SEQ ID NO: 135672 - DNA, 35 bp, Artificial Sequence
  Synthetic oligonucleotide
gttccccccgtttgactgctctatggcgaaacccc

SEQ ID NO: 135673 - DNA, 35 bp, Artificial Sequence
  Synthetic oligonucleotide
cccggcccgccggggttcagttttcgttttgcccc

SEQ ID NO: 135674 - DNA, 35 bp, Artificial Sequence
  Synthetic oligonucleotide
aacgggctgtgcacatgccgcccactcgcactccc

SEQ ID NO: 135675 - DNA, 35 bp, Artificial Sequence
  Synthetic oligonucleotide
gcacgaccgtcccacggcgtatgtcaccttccgcc

SEQ ID NO: 135676 - DNA, 35 bp, Artificial Sequence
  Synthetic oligonucleotide
tcatcaagccttcaccattcatcaacgcgattgcc

SEQ ID NO: 135677 - DNA, 35 bp, Artificial Sequence
  Synthetic oligonucleotide
tgactcgacccgatagcagcgtatcactccactcc

SEQ ID NO: 135678 - DNA, 35 bp, Artificial Sequence
  Synthetic oligonucleotide
accaaccccggcgtacagggcgccctatttcctcc

SEQ ID NO: 135679 - DNA, 35 bp, Artificial Sequence
  Synthetic oligonucleotide
gacgtcccttataccgccctgcatagctccgctgc

SEQ ID NO: 135680 - DNA, 35 bp, Artificial Sequence
  Synthetic oligonucleotide
gttcactcatcaccatatcactcactgtcaccatc

SEQ ID NO: 135681 - DNA, 35 bp, Artificial Sequence
  Synthetic oligonucleotide
tcctggcatacaatgtacttacgcgctgcaccttc

SEQ ID NO: 135682 - DNA, 35 bp, Artificial Sequence
  Synthetic oligonucleotide
gcctgacacatgccgcccattcgtactgccttccg

SEQ ID NO: 135683 - DNA, 35 bp, Artificial Sequence
  Synthetic oligonucleotide
tagatccgtccccgttttcatatgccttcgtgtcg

SEQ ID NO: 135684 - DNA, 35 bp, Artificial Sequence
  Synthetic oligonucleotide
acgcggggaatccgggagaggagggggatagtggg

SEQ ID NO: 135685 - DNA, 35 bp, Artificial Sequence
  Synthetic oligonucleotide
ttaccgcccggccttcgactcctctacactttgat

SEQ ID NO: 135686 - DNA, 35 bp, Artificial Sequence
  Synthetic oligonucleotide
tacgacgcctgcctccgattatagtcaccacccct

SEQ ID NO: 135687 - DNA, 36 bp, Artificial Sequence
  Synthetic oligonucleotide
gtgatgcgcacactattccgcccgcccttcgtttaa

SEQ ID NO: 135688 - DNA, 36 bp, Artificial Sequence
  Synthetic oligonucleotide
tgcgaggacggaaggggagtaaggtaagacggcaca

SEQ ID NO: 135689 - DNA, 36 bp, Artificial Sequence
  Synthetic oligonucleotide
tcaccgtctgctgctccgcttagcgttccgccccga

SEQ ID NO: 135690 - DNA, 37 bp, Artificial Sequence
  Synthetic oligonucleotide
aagagacacggactggtaaggaggtaggaaaggatga

SEQ ID NO: 135691 - DNA, 37 bp, Artificial Sequence
  Synthetic oligonucleotide
gccacccgtcacccctcccttagcccgtactaactga

SEQ ID NO: 135692 - DNA, 38 bp, Artificial Sequence
  Synthetic oligonucleotide
gatcatcgcgttttgtgcacgtaccatccctcccctga

SEQ ID NO: 135693 - DNA, 38 bp, Artificial Sequence
  Synthetic oligonucleotide
gagacagtggggagcgacaagtgagagggattaggtga

SEQ ID NO: 135694 - DNA, 38 bp, Artificial Sequence
  Synthetic oligonucleotide
gcatccccctcccgcttcccgtctgccgtggcccttga

SEQ ID NO: 135695 - DNA, 38 bp, Artificial Sequence
  Synthetic oligonucleotide
tgtgtaccgtccccccgccccttaccttgtccggttga

SEQ ID NO: 135696 - DNA, 35 bp, Artificial Sequence
  Synthetic oligonucleotide
agtcgcccgccccacatgctcatcactgcggtaac

SEQ ID NO: 135697 - DNA, 35 bp, Artificial Sequence
  Synthetic oligonucleotide
actcgctctcctgaactttggcccatcgctttgac

SEQ ID NO: 135698 - DNA, 35 bp, Artificial Sequence
  Synthetic oligonucleotide
accaccgccatgtgcatccgcaccgtagtatcacc

SEQ ID NO: 135699 - DNA, 35 bp, Artificial Sequence
  Synthetic oligonucleotide
ttgtgcgacgtcgtttacttttgttgtccccgccc

SEQ ID NO: 135700 - DNA, 35 bp, Artificial Sequence
  Synthetic oligonucleotide
taagtctatcgcacggttacccccacagtcccgcc

SEQ ID NO: 135701 - DNA, 35 bp, Artificial Sequence
  Synthetic oligonucleotide
actcaaccgcatttccattacgtcgaactggctcc

SEQ ID NO: 135702 - DNA, 35 bp, Artificial Sequence
  Synthetic oligonucleotide
ggtcacaccgcccagcatacgggtttgccttccgc

SEQ ID NO: 135703 - DNA, 35 bp, Artificial Sequence
  Synthetic oligonucleotide
gagacatcccgctcatacgccgctttccaacactc

SEQ ID NO: 135704 - DNA, 35 bp, Artificial Sequence
  Synthetic oligonucleotide
gtctgcccctgcccataactcggtttcaccttttc

SEQ ID NO: 135705 - DNA, 35 bp, Artificial Sequence
  Synthetic oligonucleotide
tccgtatgcctccatcctagtttctaatcgcctag

SEQ ID NO: 135706 - DNA, 35 bp, Artificial Sequence
  Synthetic oligonucleotide
gtcgcccctaccttccatcagacgtcgcctaatcg

SEQ ID NO: 135707 - DNA, 35 bp, Artificial Sequence
  Synthetic oligonucleotide
tccaccctcttgtctttcttttcgaccccgcttcg

SEQ ID NO: 135708 - DNA, 35 bp, Artificial Sequence
  Synthetic oligonucleotide
gagacacccgcccgttgcaccccctctacttacat

SEQ ID NO: 135709 - DNA, 36 bp, Artificial Sequence
  Synthetic oligonucleotide
aagggaggagggtaaagggtcggggacaaaggttat

SEQ ID NO: 135710 - DNA, 35 bp, Artificial Sequence
  Synthetic oligonucleotide
acgtacgcgtgccttgtgcacgttacactccccct

SEQ ID NO: 135711 - DNA, 35 bp, Artificial Sequence
  Synthetic oligonucleotide
acgtaagctcatctctatcctgcctttccctgggt

SEQ ID NO: 135712 - DNA, 35 bp, Artificial Sequence
  Synthetic oligonucleotide
tccccgcctaagggtaaaacctccctgcatatctt

SEQ ID NO: 135713 - DNA, 35 bp, Artificial Sequence
  Synthetic oligonucleotide
tctccacttccgtccaccgtcagtatctgccatca

SEQ ID NO: 135714 - DNA, 36 bp, Artificial Sequence
  Synthetic oligonucleotide
accaacttcactgctcttcgcgcccggcgcccttca

SEQ ID NO: 135715 - DNA, 35 bp, Artificial Sequence
  Synthetic oligonucleotide
ttcgaccaccccccatacggtacctgtatatccga

SEQ ID NO: 135716 - DNA, 37 bp, Artificial Sequence
  Synthetic oligonucleotide
gtggggcactgtgccgggcgggaggtttgtaagggga

SEQ ID NO: 135717 - DNA, 37 bp, Artificial Sequence
  Synthetic oligonucleotide
gtagacggacggaggtgcaggaaagcacggaggggga

SEQ ID NO: 135718 - DNA, 37 bp, Artificial Sequence
  Synthetic oligonucleotide
tgtaccacccccgccgattggcaacactcacaactga

SEQ ID NO: 135719 - DNA, 37 bp, Artificial Sequence
  Synthetic oligonucleotide
atcccaccccgctgacgacatgctcgccgattcttga

SEQ ID NO: 135720 - DNA, 35 bp, Artificial Sequence
  Synthetic oligonucleotide
tccagagtgcaaatgttccgtaccccattgccccc

SEQ ID NO: 135721 - DNA, 35 bp, Artificial Sequence
  Synthetic oligonucleotide
gcccacccgctttatcactgctccagcaacgagcc

SEQ ID NO: 135722 - DNA, 35 bp, Artificial Sequence
  Synthetic oligonucleotide
tgttgccctacacgccctcgccccccggaattagc

SEQ ID NO: 135723 - DNA, 35 bp, Artificial Sequence
  Synthetic oligonucleotide
ggggggctggggcgaaggaggaattatggaaggtg

SEQ ID NO: 135724 - DNA, 35 bp, Artificial Sequence
  Synthetic oligonucleotide
tacgcgccgtctttgaaggctctactcttacctct

SEQ ID NO: 135725 - DNA, 35 bp, Artificial Sequence
  Synthetic oligonucleotide
tgttagctgccggcctgattcgtcgctgtccctct

SEQ ID NO: 135726 - DNA, 35 bp, Artificial Sequence
  Synthetic oligonucleotide
tttgtcgccatcatctcggttttcctcggtacatt

SEQ ID NO: 135727 - DNA, 35 bp, Artificial Sequence
  Synthetic oligonucleotide
gaccacgtaatatctcgtcccacaccccgcaggtt

SEQ ID NO: 135728 - DNA, 36 bp, Artificial Sequence
  Synthetic oligonucleotide
acatcccgaccccccgccccgagacacgggtttgaa

SEQ ID NO: 135729 - DNA, 37 bp, Artificial Sequence
  Synthetic oligonucleotide
agcgcccagcaggagggaactgggagggaacacggga

SEQ ID NO: 135730 - DNA, 37 bp, Artificial Sequence
  Synthetic oligonucleotide
gtgaacagaagggggtggaaagagagacgggagtgga

SEQ ID NO: 135731 - DNA, 37 bp, Artificial Sequence
  Synthetic oligonucleotide
tccaccgccgctgcttgacaccccctctatttgatga

SEQ ID NO: 135732 - DNA, 37 bp, Artificial Sequence
  Synthetic oligonucleotide
tagccactgtcctcgccctccgcctaatcaccgctga

SEQ ID NO: 135733 - DNA, 38 bp, Artificial Sequence
  Synthetic oligonucleotide
gcgtttggcgcacgtgttttctgctccctcccttgtga

SEQ ID NO: 135734 - DNA, 36 bp, Artificial Sequence
  Synthetic oligonucleotide
aaccgccatcccgctgtgatcactcccccttgttga

SEQ ID NO: 135735 - DNA, 36 bp, Artificial Sequence
  Synthetic oligonucleotide
ttaccgctactgcgcacatcgccttgcaacacctta

SEQ ID NO: 135736 - DNA, 35 bp, Artificial Sequence
  Synthetic oligonucleotide
acgttcacaccatcgctttttggccccccgcgcac

SEQ ID NO: 135737 - DNA, 35 bp, Artificial Sequence
  Synthetic oligonucleotide
tcacagacgagaatcgttcattccctgcctttcac

SEQ ID NO: 135738 - DNA, 35 bp, Artificial Sequence
  Synthetic oligonucleotide
gttacacgtcaccacacgcccagtgctcgtttcac

SEQ ID NO: 135739 - DNA, 35 bp, Artificial Sequence
  Synthetic oligonucleotide
tcaggcggaaggatggggaccttggtggtggatac

SEQ ID NO: 135740 - DNA, 35 bp, Artificial Sequence
  Synthetic oligonucleotide
gccacctgttcgtgcccgtttacattggcgctccc

SEQ ID NO: 135741 - DNA, 35 bp, Artificial Sequence
  Synthetic oligonucleotide
gcacgcacccccctggttctcctggtctccaggcc

SEQ ID NO: 135742 - DNA, 35 bp, Artificial Sequence
  Synthetic oligonucleotide
gagaccacgtgctgctctcttccgctcactatctc

SEQ ID NO: 135743 - DNA, 35 bp, Artificial Sequence
  Synthetic oligonucleotide
tcctctctccggcctaatctgtactcacctatttc

SEQ ID NO: 135744 - DNA, 35 bp, Artificial Sequence
  Synthetic oligonucleotide
tgcattcctcggttcgtttcatcgttgggcttttc

SEQ ID NO: 135745 - DNA, 35 bp, Artificial Sequence
  Synthetic oligonucleotide
ttagcgtagcatatccaaccatggaccccccctcg

SEQ ID NO: 135746 - DNA, 35 bp, Artificial Sequence
  Synthetic oligonucleotide
tcaatgctctcagcatgtctctactcatcccttct

SEQ ID NO: 135747 - DNA, 35 bp, Artificial Sequence
  Synthetic oligonucleotide
taacctcactcggtttgtctcattatgcccttcca

SEQ ID NO: 135748 - DNA, 36 bp, Artificial Sequence
  Synthetic oligonucleotide
acccgccttgtcgacctgcttttaacctgtaactca

SEQ ID NO: 135749 - DNA, 38 bp, Artificial Sequence
  Synthetic oligonucleotide
tgagaggggtggatctttggggggacgggtaaggggga

SEQ ID NO: 135750 - DNA, 36 bp, Artificial Sequence
  Synthetic oligonucleotide
ggaacgaggaggacgagggcgatgggcaaggatgga

SEQ ID NO: 135751 - DNA, 37 bp, Artificial Sequence
  Synthetic oligonucleotide
agaggatggatgagggatggagggaagatggatgtga

SEQ ID NO: 135752 - DNA, 38 bp, Artificial Sequence
  Synthetic oligonucleotide
gagcgaagggagggggggtaccgtacgcaggggattga

SEQ ID NO: 135753 - DNA, 38 bp, Artificial Sequence
  Synthetic oligonucleotide
tgtccgccccgccaaatgcactccccggtacgccttga

SEQ ID NO: 135754 - DNA, 35 bp, Artificial Sequence
  Synthetic oligonucleotide
tgcacccgttctgcagcgcactctctgcttcacta

SEQ ID NO: 135755 - DNA, 35 bp, Artificial Sequence
  Synthetic oligonucleotide
agatgtgccgtcaacctcctgctgttccgccaaac

SEQ ID NO: 135756 - DNA, 35 bp, Artificial Sequence
  Synthetic oligonucleotide
ttgacactgccgtcaacattaacacacgccgccac

SEQ ID NO: 135757 - DNA, 35 bp, Artificial Sequence
  Synthetic oligonucleotide
tctgccacatatccggtaattatgttacgttccac

SEQ ID NO: 135758 - DNA, 35 bp, Artificial Sequence
  Synthetic oligonucleotide
gagaggccaaggagacagtagggacggggaaggac

SEQ ID NO: 135759 - DNA, 34 bp, Artificial Sequence
  Synthetic oligonucleotide
acccatccctgttcgcccccgtgcctaccgcacc

SEQ ID NO: 135760 - DNA, 35 bp, Artificial Sequence
  Synthetic oligonucleotide
ggacgcccccccttcgatggctattcgtccatccc

SEQ ID NO: 135761 - DNA, 35 bp, Artificial Sequence
  Synthetic oligonucleotide
ccaccacactggccttcaatgacggcgccactccc

SEQ ID NO: 135762 - DNA, 35 bp, Artificial Sequence
  Synthetic oligonucleotide
gccatacagcactgccagacgcctttcactgttcc

SEQ ID NO: 135763 - DNA, 35 bp, Artificial Sequence
  Synthetic oligonucleotide
attggagagcgattgccccccgttccattctatgc

SEQ ID NO: 135764 - DNA, 35 bp, Artificial Sequence
  Synthetic oligonucleotide
gagggaccctcccgtattggttctactttcacctc

SEQ ID NO: 135765 - DNA, 35 bp, Artificial Sequence
  Synthetic oligonucleotide
gctgaacctgacgtccgtattaacatccgccgctc

SEQ ID NO: 135766 - DNA, 35 bp, Artificial Sequence
  Synthetic oligonucleotide
tcccctcgcatacatcctccttacgctcgctcgag

SEQ ID NO: 135767 - DNA, 35 bp, Artificial Sequence
  Synthetic oligonucleotide
tagtacgccggagcaagttaccacccccctgcccg

SEQ ID NO: 135768 - DNA, 34 bp, Artificial Sequence
  Synthetic oligonucleotide
gcccattgccctgcagttctaatactgctttcat

SEQ ID NO: 135769 - DNA, 36 bp, Artificial Sequence
  Synthetic oligonucleotide
acacctcgcactgccgatatatctcacccttccact

SEQ ID NO: 135770 - DNA, 35 bp, Artificial Sequence
  Synthetic oligonucleotide
acgtcgcctcatcgttcttcctagctcccagttct

SEQ ID NO: 135771 - DNA, 35 bp, Artificial Sequence
  Synthetic oligonucleotide
tctgtcccaccgtttcagtaccgctttgtgcctgt

SEQ ID NO: 135772 - DNA, 35 bp, Artificial Sequence
  Synthetic oligonucleotide
acccccccgaatcctccgaacagtacacggagtgt

SEQ ID NO: 135773 - DNA, 35 bp, Artificial Sequence
  Synthetic oligonucleotide
attgccggttggcgagccctcctcccgcccctgtt

SEQ ID NO: 135774 - DNA, 35 bp, Artificial Sequence
  Synthetic oligonucleotide
gtccacttcggtgcccgaacctcctgcctcccgaa

SEQ ID NO: 135775 - DNA, 36 bp, Artificial Sequence
  Synthetic oligonucleotide
atgggactgtaaggtggggtcggggtacggtgggaa

SEQ ID NO: 135776 - DNA, 33 bp, Artificial Sequence
  Synthetic oligonucleotide
gtgctccacagccccttcccttcagtttaaaca

SEQ ID NO: 135777 - DNA, 36 bp, Artificial Sequence
  Synthetic oligonucleotide
tactgccattgtcttaacagcaccgagcccccccca

SEQ ID NO: 135778 - DNA, 37 bp, Artificial Sequence
  Synthetic oligonucleotide
tatgccccccccctgtcattgttaactgcccccgaga

SEQ ID NO: 135779 - DNA, 37 bp, Artificial Sequence
  Synthetic oligonucleotide
tatgtcaaggggcacacgggggttggaggggggtaga

SEQ ID NO: 135780 - DNA, 37 bp, Artificial Sequence
  Synthetic oligonucleotide
acccagccccagcctccctccagctcggtcataccga

SEQ ID NO: 135781 - DNA, 37 bp, Artificial Sequence
  Synthetic oligonucleotide
ggacactcctccgtatttcgacttcctcaccgcgcga

SEQ ID NO: 135782 - DNA, 37 bp, Artificial Sequence
  Synthetic oligonucleotide
acgcacgtgggtggggcccagggggggtgcaattgga

SEQ ID NO: 135783 - DNA, 38 bp, Artificial Sequence
  Synthetic oligonucleotide
gtgaccgcctgcccctgcctcttgaccgcttgcaatga

SEQ ID NO: 135784 - DNA, 37 bp, Artificial Sequence
  Synthetic oligonucleotide
tgacgctccacttcgccatctctatgtctgttcctga

SEQ ID NO: 135785 - DNA, 38 bp, Artificial Sequence
  Synthetic oligonucleotide
tccgacccccctccgtcttatcagtagcataggtctga

SEQ ID NO: 135786 - DNA, 38 bp, Artificial Sequence
  Synthetic oligonucleotide
tgcgtcctctgccgccccacctccagcctccccggtga

SEQ ID NO: 135787 - DNA, 35 bp, Artificial Sequence
  Synthetic oligonucleotide
gagtgtacagccctctgcccctcacaacgacccta

SEQ ID NO: 135788 - DNA, 35 bp, Artificial Sequence
  Synthetic oligonucleotide
acgaacagcctcgttatcgctcaccgtttctgtac

SEQ ID NO: 135789 - DNA, 35 bp, Artificial Sequence
  Synthetic oligonucleotide
tagaccctcaatgaattgccgttccgtactgcccc

SEQ ID NO: 135790 - DNA, 35 bp, Artificial Sequence
  Synthetic oligonucleotide
gccgccgaaagcactgcgcgcctcgcactatcccc

SEQ ID NO: 135791 - DNA, 35 bp, Artificial Sequence
  Synthetic oligonucleotide
gatggacgaaccacctgctttgcgatacacttccc

SEQ ID NO: 135792 - DNA, 35 bp, Artificial Sequence
  Synthetic oligonucleotide
acgatgctcctgttcctcagtggtctcgtctctcc

SEQ ID NO: 135793 - DNA, 35 bp, Artificial Sequence
  Synthetic oligonucleotide
gtgcgtatcacgtctgtcaacaagcccccccccgc

SEQ ID NO: 135794 - DNA, 35 bp, Artificial Sequence
  Synthetic oligonucleotide
tctcccatccgcctatgtactaaaccgccttccgc

SEQ ID NO: 135795 - DNA, 35 bp, Artificial Sequence
  Synthetic oligonucleotide
tctccccctacgattggttgtaagctttccacctc

SEQ ID NO: 135796 - DNA, 35 bp, Artificial Sequence
  Synthetic oligonucleotide
gtccatcgcccctacggccttagcatttcctattc

SEQ ID NO: 135797 - DNA, 35 bp, Artificial Sequence
  Synthetic oligonucleotide
gcctaccacacatgttccgaagtacatgtcttttc

SEQ ID NO: 135798 - DNA, 35 bp, Artificial Sequence
  Synthetic oligonucleotide
gtggccaatgccccacgatctgtctttcccaactg

SEQ ID NO: 135799 - DNA, 35 bp, Artificial Sequence
  Synthetic oligonucleotide
aggttggcacaccatctgcatcttgatcctcgcct

SEQ ID NO: 135800 - DNA, 30 bp, Artificial Sequence
  Synthetic oligonucleotide
tgcctctaccgctgtaatttccgtgcatct

SEQ ID NO: 135801 - DNA, 35 bp, Artificial Sequence
  Synthetic oligonucleotide
ttcgcctgactcgcgcgatatggccctccgcttct

SEQ ID NO: 135802 - DNA, 35 bp, Artificial Sequence
  Synthetic oligonucleotide
accacaaacaccgtcgcgtcacgccttccttttgt

SEQ ID NO: 135803 - DNA, 35 bp, Artificial Sequence
  Synthetic oligonucleotide
acgaccgtccgctccatacgccccatctgcctcga

SEQ ID NO: 135804 - DNA, 36 bp, Artificial Sequence
  Synthetic oligonucleotide
tagagcgaggtgggggggtggtggtggctgagtcga

SEQ ID NO: 135805 - DNA, 37 bp, Artificial Sequence
  Synthetic oligonucleotide
ttgagaggcctccccgctgtaccatacactccttcga

SEQ ID NO: 135806 - DNA, 38 bp, Artificial Sequence
  Synthetic oligonucleotide
tccacctcggtacccccccgcattaatcagtccaatga

SEQ ID NO: 135807 - DNA, 38 bp, Artificial Sequence
  Synthetic oligonucleotide
aaagagcagggagggtgactgggaagggcgtaacgtga

SEQ ID NO: 135808 - DNA, 36 bp, Artificial Sequence
  Synthetic oligonucleotide
gcacaaagtcagggaaggccgggataggggaggtga

SEQ ID NO: 135809 - DNA, 38 bp, Artificial Sequence
  Synthetic oligonucleotide
gggaacaggcatgagagggcatggtgggcggggtgtga

SEQ ID NO: 135810 - DNA, 37 bp, Artificial Sequence
  Synthetic oligonucleotide
tccacacaccagatgactccccgctgcctatcgttga

SEQ ID NO: 135811 - DNA, 35 bp, Artificial Sequence
  Synthetic oligonucleotide
gcacccatccgttgtcatgcccttactattagtac

SEQ ID NO: 135812 - DNA, 35 bp, Artificial Sequence
  Synthetic oligonucleotide
aactccctctccatgcgtctcccagcccctctgcc

SEQ ID NO: 135813 - DNA, 35 bp, Artificial Sequence
  Synthetic oligonucleotide
tcgcttcctcggcgcttgtaattcttcccggctcc

SEQ ID NO: 135814 - DNA, 35 bp, Artificial Sequence
  Synthetic oligonucleotide
atccggacctcctctgtctcatatcttgcggttcc

SEQ ID NO: 135815 - DNA, 35 bp, Artificial Sequence
  Synthetic oligonucleotide
tgcacataacttgtccacagtctttccctccgcgc

SEQ ID NO: 135816 - DNA, 35 bp, Artificial Sequence
  Synthetic oligonucleotide
atccctcatgcccgtccctgctacgttcttttggc

SEQ ID NO: 135817 - DNA, 35 bp, Artificial Sequence
  Synthetic oligonucleotide
gccatcgctgcttacattgtttaccgtcactcatc

SEQ ID NO: 135818 - DNA, 35 bp, Artificial Sequence
  Synthetic oligonucleotide
atacactcaacttgcctatgcccccacgtttcatc

SEQ ID NO: 135819 - DNA, 35 bp, Artificial Sequence
  Synthetic oligonucleotide
gtgaaagccccacctcatatagtcacttgccactc

SEQ ID NO: 135820 - DNA, 35 bp, Artificial Sequence
  Synthetic oligonucleotide
aacacctgcgcaacctttctgcgaagtccctcctc

SEQ ID NO: 135821 - DNA, 35 bp, Artificial Sequence
  Synthetic oligonucleotide
atatccactcgccaccccagcgtatcattttgctc

SEQ ID NO: 135822 - DNA, 35 bp, Artificial Sequence
  Synthetic oligonucleotide
acgagagccccctcatgccacatttgccgaccgtc

SEQ ID NO: 135823 - DNA, 35 bp, Artificial Sequence
  Synthetic oligonucleotide
atccgatccttgccgccccagtcctcccgccatag

SEQ ID NO: 135824 - DNA, 35 bp, Artificial Sequence
  Synthetic oligonucleotide
tcgccatctgctatcgttgctgtccttccactccg

SEQ ID NO: 135825 - DNA, 35 bp, Artificial Sequence
  Synthetic oligonucleotide
aagactccgcaacattggtccatccgcatcactcg

SEQ ID NO: 135826 - DNA, 35 bp, Artificial Sequence
  Synthetic oligonucleotide
gtcactgccgccacagttttttcttcacctactgg

SEQ ID NO: 135827 - DNA, 35 bp, Artificial Sequence
  Synthetic oligonucleotide
acgctccacgcgccctttctcttctctagccattg

SEQ ID NO: 135828 - DNA, 35 bp, Artificial Sequence
  Synthetic oligonucleotide
gcacccgaacacatcatccaccgcatccgacttgt

SEQ ID NO: 135829 - DNA, 35 bp, Artificial Sequence
  Synthetic oligonucleotide
gtgcccccgccaagccttcccagaatgtgcgcatt

SEQ ID NO: 135830 - DNA, 35 bp, Artificial Sequence
  Synthetic oligonucleotide
gatgcgtgttcgtttcgttgtcgcccaaacccttt

SEQ ID NO: 135831 - DNA, 36 bp, Artificial Sequence
  Synthetic oligonucleotide
tgccacctgcttcccccgccttgcgtatccgtgcaa

SEQ ID NO: 135832 - DNA, 35 bp, Artificial Sequence
  Synthetic oligonucleotide
tgcaccgctcgcatcctgtgcctccgttcctataa

SEQ ID NO: 135833 - DNA, 35 bp, Artificial Sequence
  Synthetic oligonucleotide
gaaccgtccgccctgtcgcaacctacccggtctca

SEQ ID NO: 135834 - DNA, 36 bp, Artificial Sequence
  Synthetic oligonucleotide
gcccacgcccgcattttaccctacgtttcaaggtca

SEQ ID NO: 135835 - DNA, 37 bp, Artificial Sequence
  Synthetic oligonucleotide
gtcagagggaggagaagagggggaggtggtgaacaga

SEQ ID NO: 135836 - DNA, 36 bp, Artificial Sequence
  Synthetic oligonucleotide
gcccccgcacggtttatgcccttaccggccatagga

SEQ ID NO: 135837 - DNA, 37 bp, Artificial Sequence
  Synthetic oligonucleotide
ataacgcgggggaatggacaactgggactgggaggga

SEQ ID NO: 135838 - DNA, 38 bp, Artificial Sequence
  Synthetic oligonucleotide
gtcgcgatgttgtcgccccctgccccctgattgcatga

SEQ ID NO: 135839 - DNA, 38 bp, Artificial Sequence
  Synthetic oligonucleotide
actgacacccctatatgtccacatcgccttctacctga

SEQ ID NO: 135840 - DNA, 38 bp, Artificial Sequence
  Synthetic oligonucleotide
tcagctagcactgtcgtacattgtttctcccccgctga

SEQ ID NO: 135841 - DNA, 36 bp, Artificial Sequence
  Synthetic oligonucleotide
atgggcgaggctttgggaggaaagggtgaggggata

SEQ ID NO: 135842 - DNA, 36 bp, Artificial Sequence
  Synthetic oligonucleotide
gatcgcccttgccctatattgtctgccgatttccta

SEQ ID NO: 135843 - DNA, 35 bp, Artificial Sequence
  Synthetic oligonucleotide
tcgtcccgcctttgttcccagccgagccccttcac

SEQ ID NO: 135844 - DNA, 35 bp, Artificial Sequence
  Synthetic oligonucleotide
atccgccgtcggtaaagtccctgctaccagccccc

SEQ ID NO: 135845 - DNA, 35 bp, Artificial Sequence
  Synthetic oligonucleotide
tgcactccgccatcctctgtatcactctatgcccc

SEQ ID NO: 135846 - DNA, 35 bp, Artificial Sequence
  Synthetic oligonucleotide
acgactctcagtgcctctgtcatctacgccggtcc

SEQ ID NO: 135847 - DNA, 35 bp, Artificial Sequence
  Synthetic oligonucleotide
gccggacaccattaggctgttaccatctccggtcc

SEQ ID NO: 135848 - DNA, 35 bp, Artificial Sequence
  Synthetic oligonucleotide
ggaatgcccacctccatacggccttgcccccttcc

SEQ ID NO: 135849 - DNA, 35 bp, Artificial Sequence
  Synthetic oligonucleotide
tgtagcgacactgtcgtcgctagtttcctcgttcc

SEQ ID NO: 135850 - DNA, 35 bp, Artificial Sequence
  Synthetic oligonucleotide
gtcaatcgccgggcacgtattggttactcctccgc

SEQ ID NO: 135851 - DNA, 35 bp, Artificial Sequence
  Synthetic oligonucleotide
gccggtgtcggcaagtacccctttcttctctggtc

SEQ ID NO: 135852 - DNA, 35 bp, Artificial Sequence
  Synthetic oligonucleotide
tctggagccctccatcacccactcccataccgatg

SEQ ID NO: 135853 - DNA, 35 bp, Artificial Sequence
  Synthetic oligonucleotide
gttcgccctccgattcttttacaacctgccccttg

SEQ ID NO: 135854 - DNA, 35 bp, Artificial Sequence
  Synthetic oligonucleotide
taacacgcaactgcatgcgcttcccacaccttgct

SEQ ID NO: 135855 - DNA, 35 bp, Artificial Sequence
  Synthetic oligonucleotide
gaatcgcacctcctatcaaagtcttcccacccggt

SEQ ID NO: 135856 - DNA, 35 bp, Artificial Sequence
  Synthetic oligonucleotide
tacctggtatgttgcgctatactcgtcccaccctt

SEQ ID NO: 135857 - DNA, 35 bp, Artificial Sequence
  Synthetic oligonucleotide
acttcgctcccgacttgtccgtagtccaacctttt

SEQ ID NO: 135858 - DNA, 36 bp, Artificial Sequence
  Synthetic oligonucleotide
tcccccacgcctccaggcctaacgcctcgtacacca

SEQ ID NO: 135859 - DNA, 36 bp, Artificial Sequence
  Synthetic oligonucleotide
gtaacaggtccgcacgtccagctcttcccgtctcca

SEQ ID NO: 135860 - DNA, 37 bp, Artificial Sequence
  Synthetic oligonucleotide
tctacacacccgagtttagacgccccatccttgccga

SEQ ID NO: 135861 - DNA, 37 bp, Artificial Sequence
  Synthetic oligonucleotide
acccatgccctggtgctcctttctgtttcgcttgcga

SEQ ID NO: 135862 - DNA, 37 bp, Artificial Sequence
  Synthetic oligonucleotide
tagaacgccctcgcctgcactccacgtccctatagga

SEQ ID NO: 135863 - DNA, 37 bp, Artificial Sequence
  Synthetic oligonucleotide
gacctgccaccctgccccgtctcgccattataccgga

SEQ ID NO: 135864 - DNA, 37 bp, Artificial Sequence
  Synthetic oligonucleotide
tacccctccatgccctcaaccgctcccttaaggcgga

SEQ ID NO: 135865 - DNA, 36 bp, Artificial Sequence
  Synthetic oligonucleotide
gtgtgaagaaaggcggaaaagagacacgggcaggga

SEQ ID NO: 135866 - DNA, 37 bp, Artificial Sequence
  Synthetic oligonucleotide
atgcacacgaccaccgccaccaatgccgcccctttga

SEQ ID NO: 135867 - DNA, 36 bp, Artificial Sequence
  Synthetic oligonucleotide
gtgccctgcccgcctgtggtagtcaccgccccgcta

SEQ ID NO: 135868 - DNA, 36 bp, Artificial Sequence
  Synthetic oligonucleotide
tgcaacctccccgttcatggattcatcacgccgcta

SEQ ID NO: 135869 - DNA, 36 bp, Artificial Sequence
  Synthetic oligonucleotide
tcgacccccacccccgcgatttatacacgcccggta

SEQ ID NO: 135870 - DNA, 35 bp, Artificial Sequence
  Synthetic oligonucleotide
gaaggggtgctcaaaatctgggggcggggttcaac

SEQ ID NO: 135871 - DNA, 35 bp, Artificial Sequence
  Synthetic oligonucleotide
agatctgggcagggcgggagggttcagtatagtac

SEQ ID NO: 135872 - DNA, 35 bp, Artificial Sequence
  Synthetic oligonucleotide
gagagcctccgctgctagaaacacgttgttccccc

SEQ ID NO: 135873 - DNA, 35 bp, Artificial Sequence
  Synthetic oligonucleotide
gctcgccatgagctaacagcccagcttatctcccc

SEQ ID NO: 135874 - DNA, 35 bp, Artificial Sequence
  Synthetic oligonucleotide
gcctgtcccgtcgcgtcgtccaaagcccatacgcc

SEQ ID NO: 135875 - DNA, 35 bp, Artificial Sequence
  Synthetic oligonucleotide
gtactcagccgccctcattatgcaatgccacttcc

SEQ ID NO: 135876 - DNA, 35 bp, Artificial Sequence
  Synthetic oligonucleotide
gctcagccggtcctgtctattcctttgccgcacgc

SEQ ID NO: 135877 - DNA, 35 bp, Artificial Sequence
  Synthetic oligonucleotide
tgtggctcactcccgcggtattcacgttcacactc

SEQ ID NO: 135878 - DNA, 35 bp, Artificial Sequence
  Synthetic oligonucleotide
gtgttacctacctgtgtatgcggtcctctccactc

SEQ ID NO: 135879 - DNA, 35 bp, Artificial Sequence
  Synthetic oligonucleotide
atctgccaacgcgttagcgatgagccttacacctc

SEQ ID NO: 135880 - DNA, 35 bp, Artificial Sequence
  Synthetic oligonucleotide
tagccccgattcatctgcagtacgcccgggccctc

SEQ ID NO: 135881 - DNA, 35 bp, Artificial Sequence
  Synthetic oligonucleotide
gcaacccgcccagttacatggccgtacctcctctc

SEQ ID NO: 135882 - DNA, 35 bp, Artificial Sequence
  Synthetic oligonucleotide
tgtcccgcgctcttgctattatccgctaccttgtc

SEQ ID NO: 135883 - DNA, 35 bp, Artificial Sequence
  Synthetic oligonucleotide
tgatgcgtacttgtagcaccttctccttcgttacg

SEQ ID NO: 135884 - DNA, 35 bp, Artificial Sequence
  Synthetic oligonucleotide
tgcaggagaggaggggggatagttgaatggaactg

SEQ ID NO: 135885 - DNA, 35 bp, Artificial Sequence
  Synthetic oligonucleotide
gaacgcatatctgcacgcataccccacgctcgtat

SEQ ID NO: 135886 - DNA, 35 bp, Artificial Sequence
  Synthetic oligonucleotide
gcggaaccgcccatgcccttccctgctccagaact

SEQ ID NO: 135887 - DNA, 35 bp, Artificial Sequence
  Synthetic oligonucleotide
tccccaccgttattattacacagtacaacctttct

SEQ ID NO: 135888 - DNA, 35 bp, Artificial Sequence
  Synthetic oligonucleotide
gatcaccccgcctgtataaaccaccttgtggcgtt

SEQ ID NO: 135889 - DNA, 35 bp, Artificial Sequence
  Synthetic oligonucleotide
tcaccctgggctggtgccttcgccgctccctcttt

SEQ ID NO: 135890 - DNA, 35 bp, Artificial Sequence
  Synthetic oligonucleotide
acccgccaccccggtattcgcttaatttggtcttt

SEQ ID NO: 135891 - DNA, 36 bp, Artificial Sequence
  Synthetic oligonucleotide
acccctccgccccatgacatgcttctattataacca

SEQ ID NO: 135892 - DNA, 35 bp, Artificial Sequence
  Synthetic oligonucleotide
atccgctgctctgccttccttcttggggccatcca

SEQ ID NO: 135893 - DNA, 35 bp, Artificial Sequence
  Synthetic oligonucleotide
acatccgcccccgctatagtcgaaaccttcatcca

SEQ ID NO: 135894 - DNA, 36 bp, Artificial Sequence
  Synthetic oligonucleotide
tgccacctcaacatccgcgtccgaaaccgtcgtcca

SEQ ID NO: 135895 - DNA, 37 bp, Artificial Sequence
  Synthetic oligonucleotide
gatgtgcgctgtattccttctccccccggtttaacga

SEQ ID NO: 135896 - DNA, 37 bp, Artificial Sequence
  Synthetic oligonucleotide
tgcaacatgtcttccgcacgccctgtcactcctcgga

SEQ ID NO: 135897 - DNA, 37 bp, Artificial Sequence
  Synthetic oligonucleotide
gaccaatgaagagcggtgggaggatgggggggatgga

SEQ ID NO: 135898 - DNA, 38 bp, Artificial Sequence
  Synthetic oligonucleotide
gcatgtgtagggaggggctggggcgtacgtggggatga

SEQ ID NO: 135899 - DNA, 35 bp, Artificial Sequence
  Synthetic oligonucleotide
gttaccgcaccatctctgaggatcctttcttgtga

SEQ ID NO: 135900 - DNA, 36 bp, Artificial Sequence
  Synthetic oligonucleotide
tgagacacggtgacggggagttggggggaagtgata

SEQ ID NO: 135901 - DNA, 35 bp, Artificial Sequence
  Synthetic oligonucleotide
attcgcagtcagcctgtcacgtcctatcccctgta

SEQ ID NO: 135902 - DNA, 35 bp, Artificial Sequence
  Synthetic oligonucleotide
gggagtggggggtagggtgctgagaggggatatta

SEQ ID NO: 135903 - DNA, 35 bp, Artificial Sequence
  Synthetic oligonucleotide
ttctcgtacctgaggccggccctcgcttcctcccc

SEQ ID NO: 135904 - DNA, 35 bp, Artificial Sequence
  Synthetic oligonucleotide
acgatgtctgtcccgcttctcgaccacgctttccc

SEQ ID NO: 135905 - DNA, 35 bp, Artificial Sequence
  Synthetic oligonucleotide
acttagcaccaccaatgcttgcacatacgttccgc

SEQ ID NO: 135906 - DNA, 35 bp, Artificial Sequence
  Synthetic oligonucleotide
tccgcaatcattgtagccctgccgtgcaccacctc

SEQ ID NO: 135907 - DNA, 35 bp, Artificial Sequence
  Synthetic oligonucleotide
gcgcccccccggtgcggattccgccaaaacatctc

SEQ ID NO: 135908 - DNA, 35 bp, Artificial Sequence
  Synthetic oligonucleotide
gactccgactttctggctgctaattgacccttctc

SEQ ID NO: 135909 - DNA, 35 bp, Artificial Sequence
  Synthetic oligonucleotide
tacccgccccggcctcaccatgtaggcggtatttc

SEQ ID NO: 135910 - DNA, 35 bp, Artificial Sequence
  Synthetic oligonucleotide
aacaatggggaggtggaaaacttgagggatcgggg

SEQ ID NO: 135911 - DNA, 35 bp, Artificial Sequence
  Synthetic oligonucleotide
gtgttcggcccctccgccctttttgtgatctcctg

SEQ ID NO: 135912 - DNA, 35 bp, Artificial Sequence
  Synthetic oligonucleotide
gatttccctccccctgtcgatgccacgctccgcat

SEQ ID NO: 135913 - DNA, 35 bp, Artificial Sequence
  Synthetic oligonucleotide
aggggacgggtgctggtgggggtgggctggggtgt

SEQ ID NO: 135914 - DNA, 35 bp, Artificial Sequence
  Synthetic oligonucleotide
tacgtatcccaccgttccaccccgtcgccgtaaca

SEQ ID NO: 135915 - DNA, 35 bp, Artificial Sequence
  Synthetic oligonucleotide
tatggctgtgtgccgccacgggtctcgtcctctca

SEQ ID NO: 135916 - DNA, 37 bp, Artificial Sequence
  Synthetic oligonucleotide
tcaggaatgaatagtcgggtgggcaagggagggacga

SEQ ID NO: 135917 - DNA, 35 bp, Artificial Sequence
  Synthetic oligonucleotide
tacgtcttcgctctatcccgtttgtgcccttccga

SEQ ID NO: 135918 - DNA, 34 bp, Artificial Sequence
  Synthetic oligonucleotide
tgttgacctgccccgaccacgcatacctcctcga

SEQ ID NO: 135919 - DNA, 37 bp, Artificial Sequence
  Synthetic oligonucleotide
tacacccgtcgcctttatcacctcgcccatcgactga

SEQ ID NO: 135920 - DNA, 37 bp, Artificial Sequence
  Synthetic oligonucleotide
agacagttgccatggggtggaagcgggtgggaggtga

SEQ ID NO: 135921 - DNA, 36 bp, Artificial Sequence
  Synthetic oligonucleotide
gatccgcggatcagagtttaccccctccccctgtga

SEQ ID NO: 135922 - DNA, 37 bp, Artificial Sequence
  Synthetic oligonucleotide
aacatcgggtcaagagggtgggggtgcggggaattga

SEQ ID NO: 135923 - DNA, 34 bp, Artificial Sequence
  Synthetic oligonucleotide
tactgcgccaccttgcgaaacaccccttcacgta

SEQ ID NO: 135924 - DNA, 36 bp, Artificial Sequence
  Synthetic oligonucleotide
ttgggcgcctcccgtctactactatacacccgcgta

SEQ ID NO: 135925 - DNA, 36 bp, Artificial Sequence
  Synthetic oligonucleotide
gtgaggggtggacggggggaatcgcgcgcgagggta

SEQ ID NO: 135926 - DNA, 34 bp, Artificial Sequence
  Synthetic oligonucleotide
ggtgtggggtgggtgggtgaatagtgggcaatta

SEQ ID NO: 135927 - DNA, 36 bp, Artificial Sequence
  Synthetic oligonucleotide
gccatacgccctcttgtccgttttaaaaatgcttta

SEQ ID NO: 135928 - DNA, 35 bp, Artificial Sequence
  Synthetic oligonucleotide
acacgtacactgtcgtttttattacacattccacc

SEQ ID NO: 135929 - DNA, 35 bp, Artificial Sequence
  Synthetic oligonucleotide
gcgcaaaccatcctgtttttgtttttcgctatacc

SEQ ID NO: 135930 - DNA, 35 bp, Artificial Sequence
  Synthetic oligonucleotide
acttgggtccggtacctcctcatgccattgccccc

SEQ ID NO: 135931 - DNA, 35 bp, Artificial Sequence
  Synthetic oligonucleotide
gtcaatctgacgcggtgctgggtctcttatccccc

SEQ ID NO: 135932 - DNA, 35 bp, Artificial Sequence
  Synthetic oligonucleotide
acctccgctcctttttcgccccgcttcttgagccc

SEQ ID NO: 135933 - DNA, 35 bp, Artificial Sequence
  Synthetic oligonucleotide
atcgaccgtcgtgttatgtgcctttcgttcttccc

SEQ ID NO: 135934 - DNA, 35 bp, Artificial Sequence
  Synthetic oligonucleotide
ggtgggacgtcgcagttggcttccatccccgctcc

SEQ ID NO: 135935 - DNA, 35 bp, Artificial Sequence
  Synthetic oligonucleotide
aaatgcgccaccacgtctaaaaaatccacccgtcc

SEQ ID NO: 135936 - DNA, 35 bp, Artificial Sequence
  Synthetic oligonucleotide
gcccggtctacgctctggttcaccctcgcttttcc

SEQ ID NO: 135937 - DNA, 35 bp, Artificial Sequence
  Synthetic oligonucleotide
tctccaccctcccgtctgcatcatctaacatcatc

SEQ ID NO: 135938 - DNA, 35 bp, Artificial Sequence
  Synthetic oligonucleotide
gcgaggagccattcctcgttgttaccccatgtatc

SEQ ID NO: 135939 - DNA, 25 bp, Artificial Sequence
  Synthetic oligonucleotide
tcccttgatccattagacccctctc

SEQ ID NO: 135940 - DNA, 35 bp, Artificial Sequence
  Synthetic oligonucleotide
accaacaacacactgtattgttacgttctccattc

SEQ ID NO: 135941 - DNA, 35 bp, Artificial Sequence
  Synthetic oligonucleotide
actgccctcacgctccactcgacgtacgccatccg

SEQ ID NO: 135942 - DNA, 35 bp, Artificial Sequence
  Synthetic oligonucleotide
tgttactcccaggcccgccccctccccacagctgg

SEQ ID NO: 135943 - DNA, 35 bp, Artificial Sequence
  Synthetic oligonucleotide
gtcatacgatcggtcgttacaattgcctccatctg

SEQ ID NO: 135944 - DNA, 35 bp, Artificial Sequence
  Synthetic oligonucleotide
gtttcgcccgccatccttcaagtaccttcgaccct

SEQ ID NO: 135945 - DNA, 35 bp, Artificial Sequence
  Synthetic oligonucleotide
atccagcactcgaccctgcttatgccgcgtgccct

SEQ ID NO: 135946 - DNA, 35 bp, Artificial Sequence
  Synthetic oligonucleotide
acgcctaccccagtcgcatcctcgctatgaccgct

SEQ ID NO: 135947 - DNA, 35 bp, Artificial Sequence
  Synthetic oligonucleotide
gtcaccctgttcgaccgcgcacacacgccaatctt

SEQ ID NO: 135948 - DNA, 35 bp, Artificial Sequence
  Synthetic oligonucleotide
tagtcgccgaccattccttcagaccctgtcctctt

SEQ ID NO: 135949 - DNA, 35 bp, Artificial Sequence
  Synthetic oligonucleotide
ggccatgcccggaaactggttgtccctgcccccca

SEQ ID NO: 135950 - DNA, 35 bp, Artificial Sequence
  Synthetic oligonucleotide
tatggcgttcgcactgacgattattaccacctcca

SEQ ID NO: 135951 - DNA, 36 bp, Artificial Sequence
  Synthetic oligonucleotide
agatccccctccatcttgcctggcgtccctgttcca

SEQ ID NO: 135952 - DNA, 35 bp, Artificial Sequence
  Synthetic oligonucleotide
tccctcccccacatgtggcgaacgcctccaatgca

SEQ ID NO: 135953 - DNA, 35 bp, Artificial Sequence
  Synthetic oligonucleotide
taaggggagggcgggaacgtagggaaatagactca

SEQ ID NO: 135954 - DNA, 36 bp, Artificial Sequence
  Synthetic oligonucleotide
ttaaccccgccccgttatcctgaggttctattttca

SEQ ID NO: 135955 - DNA, 37 bp, Artificial Sequence
  Synthetic oligonucleotide
tgcaaccgacacccgcccctccatcccatcatgccga

SEQ ID NO: 135956 - DNA, 37 bp, Artificial Sequence
  Synthetic oligonucleotide
gcgcaccatcaaatccatcgcagccctcaccattcga

SEQ ID NO: 135957 - DNA, 36 bp, Artificial Sequence
  Synthetic oligonucleotide
tcccacctcatcttcgcgaatgtacttcctgcggga

SEQ ID NO: 135958 - DNA, 38 bp, Artificial Sequence
  Synthetic oligonucleotide
ggtcggggtggaggatgaaggggcgatggcagatctga

SEQ ID NO: 135959 - DNA, 37 bp, Artificial Sequence
  Synthetic oligonucleotide
gacatccacccgtgaacatctgccttcaatcctttga

SEQ ID NO: 135960 - DNA, 36 bp, Artificial Sequence
  Synthetic oligonucleotide
gccacaccctgctgggacctaccctactccattcta

SEQ ID NO: 135961 - DNA, 35 bp, Artificial Sequence
  Synthetic oligonucleotide
agcccctcacgaccatcgctaccgcccgcccgaac

SEQ ID NO: 135962 - DNA, 35 bp, Artificial Sequence
  Synthetic oligonucleotide
actcgcacggtcacaatctcttgcttcacttaccc

SEQ ID NO: 135963 - DNA, 35 bp, Artificial Sequence
  Synthetic oligonucleotide
agaccctcgtagcagctatttccagcgcggccccc

SEQ ID NO: 135964 - DNA, 35 bp, Artificial Sequence
  Synthetic oligonucleotide
atctcgacccgatgcctgcttctcccctgtacgcc

SEQ ID NO: 135965 - DNA, 35 bp, Artificial Sequence
  Synthetic oligonucleotide
attgccccgacacctcgtttgccatcactttgtcc

SEQ ID NO: 135966 - DNA, 35 bp, Artificial Sequence
  Synthetic oligonucleotide
agagcgggtggagcgggtgggaacagcaactgcgc

SEQ ID NO: 135967 - DNA, 35 bp, Artificial Sequence
  Synthetic oligonucleotide
agctccccctccccctgctccctctcttgacaggc

SEQ ID NO: 135968 - DNA, 35 bp, Artificial Sequence
  Synthetic oligonucleotide
tgtccacccacaactaaaggtacatgcccgttttc

SEQ ID NO: 135969 - DNA, 35 bp, Artificial Sequence
  Synthetic oligonucleotide
ttcgccccatccgtcccctagcttccaccttcgcg

SEQ ID NO: 135970 - DNA, 35 bp, Artificial Sequence
  Synthetic oligonucleotide
gaggcccgcttacatcgctttatcatctcgcttcg

SEQ ID NO: 135971 - DNA, 35 bp, Artificial Sequence
  Synthetic oligonucleotide
gccggacgccggttccttcattgccattatgttcg

SEQ ID NO: 135972 - DNA, 35 bp, Artificial Sequence
  Synthetic oligonucleotide
gtgccgagaggggtgggggaaagaaggagaaggtg

SEQ ID NO: 135973 - DNA, 35 bp, Artificial Sequence
  Synthetic oligonucleotide
ggaccccccccgtgcgtttctcaagtacctgtaat

SEQ ID NO: 135974 - DNA, 35 bp, Artificial Sequence
  Synthetic oligonucleotide
ggatcgaccggaccgcttcatcgcccttcatcact

SEQ ID NO: 135975 - DNA, 35 bp, Artificial Sequence
  Synthetic oligonucleotide
tagtccatccgtacgcgtcaatattcacctggcct

SEQ ID NO: 135976 - DNA, 35 bp, Artificial Sequence
  Synthetic oligonucleotide
ttcggtcgcctctcgtctgctacacttcttctggt

SEQ ID NO: 135977 - DNA, 35 bp, Artificial Sequence
  Synthetic oligonucleotide
gcgctgggccgctcgtgcttgtacctcctatctgt

SEQ ID NO: 135978 - DNA, 35 bp, Artificial Sequence
  Synthetic oligonucleotide
gacctcatcgcctctcatcacaggccttccgttgt

SEQ ID NO: 135979 - DNA, 35 bp, Artificial Sequence
  Synthetic oligonucleotide
tcatcagtcgcagtatcttatcccctatgcctaca

SEQ ID NO: 135980 - DNA, 36 bp, Artificial Sequence
  Synthetic oligonucleotide
gcagacgcaggtcttcctcggccctctgcctttcca

SEQ ID NO: 135981 - DNA, 36 bp, Artificial Sequence
  Synthetic oligonucleotide
tgtgacgaccccctgcacacacacgcctttcccgca

SEQ ID NO: 135982 - DNA, 36 bp, Artificial Sequence
  Synthetic oligonucleotide
tgcgggggggctcgggtgggattgttatagcttgca

SEQ ID NO: 135983 - DNA, 36 bp, Artificial Sequence
  Synthetic oligonucleotide
gtgcacgtacgctcagcgtttccttctcccgctcga

SEQ ID NO: 135984 - DNA, 37 bp, Artificial Sequence
  Synthetic oligonucleotide
tcctgcgcctcaacgtatcaatcctgccctcattcga

SEQ ID NO: 135985 - DNA, 37 bp, Artificial Sequence
  Synthetic oligonucleotide
agttccgcctgttcgctcccccctgtcccagtacgga

SEQ ID NO: 135986 - DNA, 37 bp, Artificial Sequence
  Synthetic oligonucleotide
tggggagtggcggtttccatactagggcggtggggga

SEQ ID NO: 135987 - DNA, 36 bp, Artificial Sequence
  Synthetic oligonucleotide
tcaatcgcatttcccccgcacgaacgtacttagtta

SEQ ID NO: 135988 - DNA, 35 bp, Artificial Sequence
  Synthetic oligonucleotide
atctccccgcccgactttgccccgagccactccac

SEQ ID NO: 135989 - DNA, 35 bp, Artificial Sequence
  Synthetic oligonucleotide
ttgccaggactcgtttatgctcgccttgtttcgac

SEQ ID NO: 135990 - DNA, 35 bp, Artificial Sequence
  Synthetic oligonucleotide
agtccgcatgccagtgcccccgttcttatccaccc

SEQ ID NO: 135991 - DNA, 35 bp, Artificial Sequence
  Synthetic oligonucleotide
gcatttcgcatgactgtcacacccgcccactgccc

SEQ ID NO: 135992 - DNA, 35 bp, Artificial Sequence
  Synthetic oligonucleotide
ttcgcctccgccccgctcgtttttggaaccctccc

SEQ ID NO: 135993 - DNA, 35 bp, Artificial Sequence
  Synthetic oligonucleotide
gctgcaagagcgacagtcctttccccggtgctccc

SEQ ID NO: 135994 - DNA, 35 bp, Artificial Sequence
  Synthetic oligonucleotide
tgtcacctgcctccctgactcgttatcctgccgcc

SEQ ID NO: 135995 - DNA, 35 bp, Artificial Sequence
  Synthetic oligonucleotide
gttcgccttccatgtcccaccacgttccccgtgcc

SEQ ID NO: 135996 - DNA, 35 bp, Artificial Sequence
  Synthetic oligonucleotide
agtccagtgccctcccgattataggtcgtgcctcc

SEQ ID NO: 135997 - DNA, 35 bp, Artificial Sequence
  Synthetic oligonucleotide
tatgcccaattatcgtactcgaactgcctgtttcc

SEQ ID NO: 135998 - DNA, 35 bp, Artificial Sequence
  Synthetic oligonucleotide
gtccccggccaatccatgcaacgttccacattctc

SEQ ID NO: 135999 - DNA, 35 bp, Artificial Sequence
  Synthetic oligonucleotide
ttcacgcgagcttttattatttcctggttgttctc

SEQ ID NO: 136000 - DNA, 35 bp, Artificial Sequence
  Synthetic oligonucleotide
gcccccaatccaactacgatgcccaccgatcctcg

SEQ ID NO: 136001 - DNA, 35 bp, Artificial Sequence
  Synthetic oligonucleotide
aatgctcacaccatcgcgtaaccagttttccctct

SEQ ID NO: 136002 - DNA, 35 bp, Artificial Sequence
  Synthetic oligonucleotide
tccaccgcccgacgagtttaccctgcctccgccgt

SEQ ID NO: 136003 - DNA, 35 bp, Artificial Sequence
  Synthetic oligonucleotide
gcctctgcctgcccacgttacaccacatctctcgt

SEQ ID NO: 136004 - DNA, 34 bp, Artificial Sequence
  Synthetic oligonucleotide
tcatccgcccacgctgtatatccttgcattactt

SEQ ID NO: 136005 - DNA, 35 bp, Artificial Sequence
  Synthetic oligonucleotide
gtgcacagagtcccaccgttttctcagggtccttt

SEQ ID NO: 136006 - DNA, 35 bp, Artificial Sequence
  Synthetic oligonucleotide
tgcctgcgctggtcacgtattcgccgtccccgttt

SEQ ID NO: 136007 - DNA, 36 bp, Artificial Sequence
  Synthetic oligonucleotide
tcccctgtccgtcacccgctattcagccgatcccaa

SEQ ID NO: 136008 - DNA, 34 bp, Artificial Sequence
  Synthetic oligonucleotide
tacgcacccggcccccccccgcgcgctgtcccaa

SEQ ID NO: 136009 - DNA, 36 bp, Artificial Sequence
  Synthetic oligonucleotide
gaacacggcatggagggtgggtggggagaaaacgca

SEQ ID NO: 136010 - DNA, 37 bp, Artificial Sequence
  Synthetic oligonucleotide
gggggaggggatggcggttgcgacctggccggtacga

SEQ ID NO: 136011 - DNA, 37 bp, Artificial Sequence
  Synthetic oligonucleotide
ttcgacaacccttagccatgattacgccctcactcga

SEQ ID NO: 136012 - DNA, 36 bp, Artificial Sequence
  Synthetic oligonucleotide
tccggagcacgaaacctcgtgtcagccacttctcga

SEQ ID NO: 136013 - DNA, 37 bp, Artificial Sequence
  Synthetic oligonucleotide
tgtgcggggaagggaatgaaagggggagacgcgggga

SEQ ID NO: 136014 - DNA, 37 bp, Artificial Sequence
  Synthetic oligonucleotide
aagatgagagggtgacaaagggaggtgcgagaagtga

SEQ ID NO: 136015 - DNA, 35 bp, Artificial Sequence
  Synthetic oligonucleotide
aagtggggggaaggggggtaagtggcaaaagatac

SEQ ID NO: 136016 - DNA, 35 bp, Artificial Sequence
  Synthetic oligonucleotide
atctgaccaccgccatatattgttagcgccgcacc

SEQ ID NO: 136017 - DNA, 35 bp, Artificial Sequence
  Synthetic oligonucleotide
tgagacactcgcaagtgacctaattgttccgcccc

SEQ ID NO: 136018 - DNA, 35 bp, Artificial Sequence
  Synthetic oligonucleotide
accgaaccgcacggctaaggccactattgctcccc

SEQ ID NO: 136019 - DNA, 35 bp, Artificial Sequence
  Synthetic oligonucleotide
tcatacgcccatcttggacatcccgtgtacacctc

SEQ ID NO: 136020 - DNA, 35 bp, Artificial Sequence
  Synthetic oligonucleotide
gcatgctcatcgcgctcgtaccgggtctacttccg

SEQ ID NO: 136021 - DNA, 35 bp, Artificial Sequence
  Synthetic oligonucleotide
gttgggtggaaggcggaaggacgaggagggacatg

SEQ ID NO: 136022 - DNA, 35 bp, Artificial Sequence
  Synthetic oligonucleotide
ttgcggtccgcccgtttcaattgccttcccaacat

SEQ ID NO: 136023 - DNA, 35 bp, Artificial Sequence
  Synthetic oligonucleotide
gatgaatatcccgccttaatgcacgcccctgccat

SEQ ID NO: 136024 - DNA, 35 bp, Artificial Sequence
  Synthetic oligonucleotide
taatcgtgcatcaatgcacccgtgttttcgcccct

SEQ ID NO: 136025 - DNA, 35 bp, Artificial Sequence
  Synthetic oligonucleotide
ttcgttccgttttcttccgtccagtgccctgccct

SEQ ID NO: 136026 - DNA, 36 bp, Artificial Sequence
  Synthetic oligonucleotide
aacgcatcccagacgacccacccccctcgccagcaa

SEQ ID NO: 136027 - DNA, 35 bp, Artificial Sequence
  Synthetic oligonucleotide
tctccgccccgctttttttccgaccgaccgagcca

SEQ ID NO: 136028 - DNA, 36 bp, Artificial Sequence
  Synthetic oligonucleotide
acctaccccccccgatagtgaggggccctgttttca

SEQ ID NO: 136029 - DNA, 37 bp, Artificial Sequence
  Synthetic oligonucleotide
agtcaggagggcgggcttaggtgaggggaagggtcga

SEQ ID NO: 136030 - DNA, 36 bp, Artificial Sequence
  Synthetic oligonucleotide
aacgggatgggacactggggtgggaatgaggaatga

SEQ ID NO: 136031 - DNA, 37 bp, Artificial Sequence
  Synthetic oligonucleotide
gatgtccttccgcccgcgttccacctccgtctactga

SEQ ID NO: 136032 - DNA, 36 bp, Artificial Sequence
  Synthetic oligonucleotide
tctgcgctactgccctgctacttccctcgcacctga

SEQ ID NO: 136033 - DNA, 38 bp, Artificial Sequence
  Synthetic oligonucleotide
acaccgtcctgccattttccgcctactcttctcgttga

SEQ ID NO: 136034 - DNA, 36 bp, Artificial Sequence
  Synthetic oligonucleotide
tcccctgcacccgtatggtgcattactacccactta

SEQ ID NO: 136035 - DNA, 35 bp, Artificial Sequence
  Synthetic oligonucleotide
gtccaccatcgtgataacgccgcccttcctgtaac

SEQ ID NO: 136036 - DNA, 35 bp, Artificial Sequence
  Synthetic oligonucleotide
tccggccgtccttgccaatcgtgccccgcctcacc

SEQ ID NO: 136037 - DNA, 35 bp, Artificial Sequence
  Synthetic oligonucleotide
gtagccgcactcactattctaccatgggcatcccc

SEQ ID NO: 136038 - DNA, 35 bp, Artificial Sequence
  Synthetic oligonucleotide
tcctcacccatcgacgatcactccgtggtcccgcc

SEQ ID NO: 136039 - DNA, 35 bp, Artificial Sequence
  Synthetic oligonucleotide
gtccgccggcccgaaaccccccgccacgtatatcc

SEQ ID NO: 136040 - DNA, 35 bp, Artificial Sequence
  Synthetic oligonucleotide
agtcccatcctgctcttttgtcatgttcacctggc

SEQ ID NO: 136041 - DNA, 35 bp, Artificial Sequence
  Synthetic oligonucleotide
gtgacctcgccctgcattatcttatcaaaacctgc

SEQ ID NO: 136042 - DNA, 35 bp, Artificial Sequence
  Synthetic oligonucleotide
aaactgcccccatcttgacatgcctgtcgactctc

SEQ ID NO: 136043 - DNA, 35 bp, Artificial Sequence
  Synthetic oligonucleotide
gcgcagtatcggcctgctaaagtccatcttctctc

SEQ ID NO: 136044 - DNA, 35 bp, Artificial Sequence
  Synthetic oligonucleotide
acgagtactgtccccgtcattctccgtccacattc

SEQ ID NO: 136045 - DNA, 35 bp, Artificial Sequence
  Synthetic oligonucleotide
tgtcacccctcccaacagcggtgttcactctattc

SEQ ID NO: 136046 - DNA, 35 bp, Artificial Sequence
  Synthetic oligonucleotide
tcacctcgcctcactctccaaactacgctgtaagg

SEQ ID NO: 136047 - DNA, 35 bp, Artificial Sequence
  Synthetic oligonucleotide
gctgggtgtgggatattggaatgaggggggtgagt

SEQ ID NO: 136048 - DNA, 35 bp, Artificial Sequence
  Synthetic oligonucleotide
gacctctccgctcggatccactccttccatattgt

SEQ ID NO: 136049 - DNA, 35 bp, Artificial Sequence
  Synthetic oligonucleotide
taagttcgccccacatgctacctgctctccgagtt

SEQ ID NO: 136050 - DNA, 35 bp, Artificial Sequence
  Synthetic oligonucleotide
agccctcccgccatgtatcccgcgcgatcttacaa

SEQ ID NO: 136051 - DNA, 35 bp, Artificial Sequence
  Synthetic oligonucleotide
ttgccccgctgctcctcttcatccatggcccggaa

SEQ ID NO: 136052 - DNA, 36 bp, Artificial Sequence
  Synthetic oligonucleotide
tccatccgctaccttctcagcacagtagatctacca

SEQ ID NO: 136053 - DNA, 35 bp, Artificial Sequence
  Synthetic oligonucleotide
gagttgcccccgcaataagacacccctgttaccca

SEQ ID NO: 136054 - DNA, 36 bp, Artificial Sequence
  Synthetic oligonucleotide
agttccgccgcccgctatatccactgttcgcatgca

SEQ ID NO: 136055 - DNA, 36 bp, Artificial Sequence
  Synthetic oligonucleotide
acacggccccttcctgcactttggctacctgactca

SEQ ID NO: 136056 - DNA, 37 bp, Artificial Sequence
  Synthetic oligonucleotide
tgcacactacaccttcgtattcataagccaccaccga

SEQ ID NO: 136057 - DNA, 37 bp, Artificial Sequence
  Synthetic oligonucleotide
gagaacgacgggtaggggccgggttgacaaggtggga

SEQ ID NO: 136058 - DNA, 36 bp, Artificial Sequence
  Synthetic oligonucleotide
ggggagaggaacaagcgggaagagaccaggaagtga

SEQ ID NO: 136059 - DNA, 38 bp, Artificial Sequence
  Synthetic oligonucleotide
gcacccaccacctgtatccgccgtcccaccggtgttga

SEQ ID NO: 136060 - DNA, 36 bp, Artificial Sequence
  Synthetic oligonucleotide
atcccccccagacgtatttccacgacccccctgata

SEQ ID NO: 136061 - DNA, 36 bp, Artificial Sequence
  Synthetic oligonucleotide
taccgacgaactcgcgccctctccaatgtacaggta

SEQ ID NO: 136062 - DNA, 35 bp, Artificial Sequence
  Synthetic oligonucleotide
tctccacctccactccgcgcagagcacgtgtcaac

SEQ ID NO: 136063 - DNA, 35 bp, Artificial Sequence
  Synthetic oligonucleotide
ttggaccaggggaagggggtgtaagggggcacgac

SEQ ID NO: 136064 - DNA, 35 bp, Artificial Sequence
  Synthetic oligonucleotide
ggactacctctgcatcagggcccctacaccccccc

SEQ ID NO: 136065 - DNA, 35 bp, Artificial Sequence
  Synthetic oligonucleotide
gcccgtgccatctgtagccgcccatctgaagctcc

SEQ ID NO: 136066 - DNA, 35 bp, Artificial Sequence
  Synthetic oligonucleotide
gtcgataggtcgcaatgtaatgtctccgcccccgc

SEQ ID NO: 136067 - DNA, 35 bp, Artificial Sequence
  Synthetic oligonucleotide
taacgcccggtgtgcttctgcgcctacatcacttc

SEQ ID NO: 136068 - DNA, 35 bp, Artificial Sequence
  Synthetic oligonucleotide
gactgcatcaatactcgcgtcacatccttgctttc

SEQ ID NO: 136069 - DNA, 35 bp, Artificial Sequence
  Synthetic oligonucleotide
tcattgttcgcaattggcgatatagcccctctttc

SEQ ID NO: 136070 - DNA, 35 bp, Artificial Sequence
  Synthetic oligonucleotide
actccaccaccacgtatcaccatccatgctgtgag

SEQ ID NO: 136071 - DNA, 35 bp, Artificial Sequence
  Synthetic oligonucleotide
gctacgttgccgatccctcctcctccgctgcttag

SEQ ID NO: 136072 - DNA, 35 bp, Artificial Sequence
  Synthetic oligonucleotide
gcgatccgtcccattttgctgcgttactcccatcg

SEQ ID NO: 136073 - DNA, 35 bp, Artificial Sequence
  Synthetic oligonucleotide
gtggtcccgtgcccctgtcccgaatgcaatacctg

SEQ ID NO: 136074 - DNA, 35 bp, Artificial Sequence
  Synthetic oligonucleotide
ttgactgcctgcccacgccactggatctcttattg

SEQ ID NO: 136075 - DNA, 35 bp, Artificial Sequence
  Synthetic oligonucleotide
gttgcccctcgcccctacttgtgcgcgccacaact

SEQ ID NO: 136076 - DNA, 35 bp, Artificial Sequence
  Synthetic oligonucleotide
ggtaccgcaacggccaccccgacccggctactact

SEQ ID NO: 136077 - DNA, 35 bp, Artificial Sequence
  Synthetic oligonucleotide
acaccaactgtctcgttccacactttcccaagcct

SEQ ID NO: 136078 - DNA, 35 bp, Artificial Sequence
  Synthetic oligonucleotide
gtactgcgcgttcacatctccccgtcctgtttagt

SEQ ID NO: 136079 - DNA, 35 bp, Artificial Sequence
  Synthetic oligonucleotide
gtcgctccgccaactttccagcagctgtgcccctt

SEQ ID NO: 136080 - DNA, 36 bp, Artificial Sequence
  Synthetic oligonucleotide
tacgtagccgccatcctgtcacccttccccgcttaa

SEQ ID NO: 136081 - DNA, 36 bp, Artificial Sequence
  Synthetic oligonucleotide
gcaggggggaatgcgcggctggaaggagggggcaca

SEQ ID NO: 136082 - DNA, 36 bp, Artificial Sequence
  Synthetic oligonucleotide
gagaccacttccgcaatgatcctaccgtgtcctcca

SEQ ID NO: 136083 - DNA, 36 bp, Artificial Sequence
  Synthetic oligonucleotide
tgattgccccgctcgagccgccccacaccattgaga

SEQ ID NO: 136084 - DNA, 37 bp, Artificial Sequence
  Synthetic oligonucleotide
aggtgccacgtatcgccccatccgacccccgttccga

SEQ ID NO: 136085 - DNA, 37 bp, Artificial Sequence
  Synthetic oligonucleotide
tgcgacccccgccacttctatcttcaccgtctaggga

SEQ ID NO: 136086 - DNA, 37 bp, Artificial Sequence
  Synthetic oligonucleotide
tcacaaagagcggaaggagggaggacggaagttggga

SEQ ID NO: 136087 - DNA, 36 bp, Artificial Sequence
  Synthetic oligonucleotide
ggggggaacgggagggcgcggggttagccaatatga

SEQ ID NO: 136088 - DNA, 37 bp, Artificial Sequence
  Synthetic oligonucleotide
tccacccccgcttcagctctctcgtcttggctcctga

SEQ ID NO: 136089 - DNA, 38 bp, Artificial Sequence
  Synthetic oligonucleotide
gacaagggggggggaaaaaggcgagtaagccatggtga

SEQ ID NO: 136090 - DNA, 38 bp, Artificial Sequence
  Synthetic oligonucleotide
accacgtccgcatgtctccccgcgaaagcccccgttga

SEQ ID NO: 136091 - DNA, 35 bp, Artificial Sequence
  Synthetic oligonucleotide
gttgccaggcctcaatcttttttagctgcacctta

SEQ ID NO: 136092 - DNA, 35 bp, Artificial Sequence
  Synthetic oligonucleotide
tccaacagctcgtaagtactacccggtcctccccc

SEQ ID NO: 136093 - DNA, 35 bp, Artificial Sequence
  Synthetic oligonucleotide
taggacactctccttaccgtccccgtccgccgccc

SEQ ID NO: 136094 - DNA, 35 bp, Artificial Sequence
  Synthetic oligonucleotide
gttgtcagtcgcattaaccggcccctcatacgtcc

SEQ ID NO: 136095 - DNA, 35 bp, Artificial Sequence
  Synthetic oligonucleotide
actagtgtcactgcgccccccccaatcaccacatc

SEQ ID NO: 136096 - DNA, 34 bp, Artificial Sequence
  Synthetic oligonucleotide
atccacctctcgctccagccattattggtcattc

SEQ ID NO: 136097 - DNA, 35 bp, Artificial Sequence
  Synthetic oligonucleotide
tgtcaccttagccggtacttccgctcgacaccttc

SEQ ID NO: 136098 - DNA, 35 bp, Artificial Sequence
  Synthetic oligonucleotide
ttgaccccctacactccgtctgtgtcatttcgttc

SEQ ID NO: 136099 - DNA, 35 bp, Artificial Sequence
  Synthetic oligonucleotide
acctccatcactgctctctctgcccgatcaactag

SEQ ID NO: 136100 - DNA, 34 bp, Artificial Sequence
  Synthetic oligonucleotide
tccgacgtcgtgatcttgcaccctttcaccgcct

SEQ ID NO: 136101 - DNA, 35 bp, Artificial Sequence
  Synthetic oligonucleotide
aatggggagggaagggcgggaacggcgcggagggt

SEQ ID NO: 136102 - DNA, 35 bp, Artificial Sequence
  Synthetic oligonucleotide
gatgacgatcacgtcctaactgtaccttctcctgt

SEQ ID NO: 136103 - DNA, 35 bp, Artificial Sequence
  Synthetic oligonucleotide
gtgtcagtgcgcttgatctcctccttggctgcctt

SEQ ID NO: 136104 - DNA, 35 bp, Artificial Sequence
  Synthetic oligonucleotide
tgtttccccgttcaccatgccgatcgacttcacaa

SEQ ID NO: 136105 - DNA, 36 bp, Artificial Sequence
  Synthetic oligonucleotide
acccacttccctcgtgtgctatcttactgcttacaa

SEQ ID NO: 136106 - DNA, 36 bp, Artificial Sequence
  Synthetic oligonucleotide
gccaccccgaggtttacacgttcctgtccagtgcca

SEQ ID NO: 136107 - DNA, 36 bp, Artificial Sequence
  Synthetic oligonucleotide
tctcatgccctccagctatcttctgtcattctccga

SEQ ID NO: 136108 - DNA, 37 bp, Artificial Sequence
  Synthetic oligonucleotide
agacggggggagagtttggggagacagaggcggagga

SEQ ID NO: 136109 - DNA, 38 bp, Artificial Sequence
  Synthetic oligonucleotide
gtggtgggacgggtttggggggggagcgaggggtatga

SEQ ID NO: 136110 - DNA, 38 bp, Artificial Sequence
  Synthetic oligonucleotide
gctcgcaaagtcgtttctgcgtcaccgtttcctcctga

SEQ ID NO: 136111 - DNA, 38 bp, Artificial Sequence
  Synthetic oligonucleotide
ggacgaggggggagagcagggcgggggaacggtattga

SEQ ID NO: 136112 - DNA, 37 bp, Artificial Sequence
  Synthetic oligonucleotide
gtgctgcctccgccttcggttcgttgcctctttttga

SEQ ID NO: 136113 - DNA, 36 bp, Artificial Sequence
  Synthetic oligonucleotide
tgccccgcccccccgcatcgaatctgataccactta

SEQ ID NO: 136114 - DNA, 35 bp, Artificial Sequence
  Synthetic oligonucleotide
gtcccgcctagatcctacgcactgcacggctccac

SEQ ID NO: 136115 - DNA, 35 bp, Artificial Sequence
  Synthetic oligonucleotide
tgacgcccgctcgctccctgctctataccagttcc

SEQ ID NO: 136116 - DNA, 35 bp, Artificial Sequence
  Synthetic oligonucleotide
gctccatcagcattatctgtcatcttttgggcctc

SEQ ID NO: 136117 - DNA, 35 bp, Artificial Sequence
  Synthetic oligonucleotide
agagcaacacctgatcctcgcgtcggccctccttc

SEQ ID NO: 136118 - DNA, 35 bp, Artificial Sequence
  Synthetic oligonucleotide
gacgtgaggtaggggaaaggacacggggtggacag

SEQ ID NO: 136119 - DNA, 35 bp, Artificial Sequence
  Synthetic oligonucleotide
tgcgccgcctcaccacgtccctctagcagtctact

SEQ ID NO: 136120 - DNA, 35 bp, Artificial Sequence
  Synthetic oligonucleotide
acaccccctttcgtattggcttcttgaccctggct

SEQ ID NO: 136121 - DNA, 35 bp, Artificial Sequence
  Synthetic oligonucleotide
gaaggggggcatgggacaaggggatgatgggttaa

SEQ ID NO: 136122 - DNA, 35 bp, Artificial Sequence
  Synthetic oligonucleotide
gtcgaggtaggggggcgggcgacgaacgagaatca

SEQ ID NO: 136123 - DNA, 37 bp, Artificial Sequence
  Synthetic oligonucleotide
acccgtcccatcccgggttttgttcatgttctatcga

SEQ ID NO: 136124 - DNA, 36 bp, Artificial Sequence
  Synthetic oligonucleotide
tgccctctgccgtaacacctcatgtctttatgtcga

SEQ ID NO: 136125 - DNA, 37 bp, Artificial Sequence
  Synthetic oligonucleotide
acgacagttggggggggtctgaggaggaggcggagga

SEQ ID NO: 136126 - DNA, 35 bp, Artificial Sequence
  Synthetic oligonucleotide
ggatcgacggggcggcgggtgagggcttgaaggga

SEQ ID NO: 136127 - DNA, 37 bp, Artificial Sequence
  Synthetic oligonucleotide
gacacctccgacctcgtgtgcctacgctacaccctga

SEQ ID NO: 136128 - DNA, 38 bp, Artificial Sequence
  Synthetic oligonucleotide
agtgagggagtgcgagtacggaaaaggggtggtggtga

SEQ ID NO: 136129 - DNA, 36 bp, Artificial Sequence
  Synthetic oligonucleotide
tcaagcgagggggtctgggagggtgaagggtattga

SEQ ID NO: 136130 - DNA, 36 bp, Artificial Sequence
  Synthetic oligonucleotide
tagttcgccccagctgccctctttaacctactttga

SEQ ID NO: 136131 - DNA, 36 bp, Artificial Sequence
  Synthetic oligonucleotide
gatgtcacgcccggcctggtccgtttacctccacta

SEQ ID NO: 136132 - DNA, 35 bp, Artificial Sequence
  Synthetic oligonucleotide
tttcaggcccccctacctgcctgagtactacccta

SEQ ID NO: 136133 - DNA, 35 bp, Artificial Sequence
  Synthetic oligonucleotide
ggacacctcgcccaccttttgaatagtcacctgta

SEQ ID NO: 136134 - DNA, 35 bp, Artificial Sequence
  Synthetic oligonucleotide
gcacgactctcccagatcccccgccgcatgcaacc

SEQ ID NO: 136135 - DNA, 35 bp, Artificial Sequence
  Synthetic oligonucleotide
acccaccttgtcgcagctggtcttccatctacacc

SEQ ID NO: 136136 - DNA, 35 bp, Artificial Sequence
  Synthetic oligonucleotide
aagaccctaccctactgccatctgactaacgaccc

SEQ ID NO: 136137 - DNA, 34 bp, Artificial Sequence
  Synthetic oligonucleotide
tcaaggccaccatgcataccatccccgtggtccc

SEQ ID NO: 136138 - DNA, 35 bp, Artificial Sequence
  Synthetic oligonucleotide
gcccgaggtccacaggcatatatccgttctcctcc

SEQ ID NO: 136139 - DNA, 35 bp, Artificial Sequence
  Synthetic oligonucleotide
gtgagggaaaagtgggtggattatggatagggtgc

SEQ ID NO: 136140 - DNA, 35 bp, Artificial Sequence
  Synthetic oligonucleotide
tcacaccttccggcaatctggacctaacgcaattc

SEQ ID NO: 136141 - DNA, 35 bp, Artificial Sequence
  Synthetic oligonucleotide
gaccatcaccacgggctcccaaaacagacgctttc

SEQ ID NO: 136142 - DNA, 35 bp, Artificial Sequence
  Synthetic oligonucleotide
aatgctgttacgggggggtgggttgaaaggggacg

SEQ ID NO: 136143 - DNA, 35 bp, Artificial Sequence
  Synthetic oligonucleotide
actgctcccccacaggctctcccttccattccggg

SEQ ID NO: 136144 - DNA, 35 bp, Artificial Sequence
  Synthetic oligonucleotide
accccgcaatctccagctatctccacgctcttttg

SEQ ID NO: 136145 - DNA, 35 bp, Artificial Sequence
  Synthetic oligonucleotide
gtgtgatggagggacggggagtgggagcggtttgt

SEQ ID NO: 136146 - DNA, 35 bp, Artificial Sequence
  Synthetic oligonucleotide
tagtacctccccgtctgcccctgttctcccttctt

SEQ ID NO: 136147 - DNA, 35 bp, Artificial Sequence
  Synthetic oligonucleotide
tttggcgggctcgactctacttgcctctcttcgtt

SEQ ID NO: 136148 - DNA, 35 bp, Artificial Sequence
  Synthetic oligonucleotide
agcatgggaacggtaggaaggagggatgggtcgaa

SEQ ID NO: 136149 - DNA, 36 bp, Artificial Sequence
  Synthetic oligonucleotide
gcacgtggggagagggggaaatgggagaaacggaca

SEQ ID NO: 136150 - DNA, 35 bp, Artificial Sequence
  Synthetic oligonucleotide
tacgcctacatccatgatgtccccatcgattctca

SEQ ID NO: 136151 - DNA, 36 bp, Artificial Sequence
  Synthetic oligonucleotide
tacgctgcctcgacttctttgctcccgctgccttca

SEQ ID NO: 136152 - DNA, 36 bp, Artificial Sequence
  Synthetic oligonucleotide
gtgacgcacccttgctcccccaccatgttcgcccga

SEQ ID NO: 136153 - DNA, 37 bp, Artificial Sequence
  Synthetic oligonucleotide
ttaccctccactggtcgtatgctcgcccacctcccga

SEQ ID NO: 136154 - DNA, 37 bp, Artificial Sequence
  Synthetic oligonucleotide
acttgcctgcctcgcctctctaccaccggtcttatga

SEQ ID NO: 136155 - DNA, 37 bp, Artificial Sequence
  Synthetic oligonucleotide
gtgtgcgctccagttctcttccgctgcctaattctga

SEQ ID NO: 136156 - DNA, 36 bp, Artificial Sequence
  Synthetic oligonucleotide
gaagggccgggatgggcgggatggagagttcaagta

SEQ ID NO: 136157 - DNA, 35 bp, Artificial Sequence
  Synthetic oligonucleotide
atccaccaacccctcatgtgacaaccgaaaaggta

SEQ ID NO: 136158 - DNA, 35 bp, Artificial Sequence
  Synthetic oligonucleotide
tcgaatcaccgccgggccattgttcacccctgtac

SEQ ID NO: 136159 - DNA, 35 bp, Artificial Sequence
  Synthetic oligonucleotide
acgagacgcgcaccgttctggtccgccctatcacc

SEQ ID NO: 136160 - DNA, 35 bp, Artificial Sequence
  Synthetic oligonucleotide
tgagcgtctgtgcccctgtcatacccgcgcgttcc

SEQ ID NO: 136161 - DNA, 35 bp, Artificial Sequence
  Synthetic oligonucleotide
tccctgcttcctggtttacgctccattcccgacgc

SEQ ID NO: 136162 - DNA, 35 bp, Artificial Sequence
  Synthetic oligonucleotide
ggggtgggggggcggctaaagggaaagaaagtggc

SEQ ID NO: 136163 - DNA, 35 bp, Artificial Sequence
  Synthetic oligonucleotide
tgacgcacactcactatcgcttggcccgcccgtgc

SEQ ID NO: 136164 - DNA, 35 bp, Artificial Sequence
  Synthetic oligonucleotide
tgtagccccgaattcctttattcagtacctgcctc

SEQ ID NO: 136165 - DNA, 35 bp, Artificial Sequence
  Synthetic oligonucleotide
ccccaaacgcaatgccccgtccatgaaccctcccg

SEQ ID NO: 136166 - DNA, 35 bp, Artificial Sequence
  Synthetic oligonucleotide
gtggggcgggggggtggaaggtactttttacgtcg

SEQ ID NO: 136167 - DNA, 35 bp, Artificial Sequence
  Synthetic oligonucleotide
ggaacgggggcgagtaactgggggatggggcgctg

SEQ ID NO: 136168 - DNA, 35 bp, Artificial Sequence
  Synthetic oligonucleotide
tgacggggaggggggaagggcactgtccgggcgtg

SEQ ID NO: 136169 - DNA, 35 bp, Artificial Sequence
  Synthetic oligonucleotide
atgcatacgcgctatgattccttgctcactccctt

SEQ ID NO: 136170 - DNA, 36 bp, Artificial Sequence
  Synthetic oligonucleotide
agaggagaaggcacggcggaaaataggggcgaggaa

SEQ ID NO: 136171 - DNA, 36 bp, Artificial Sequence
  Synthetic oligonucleotide
gtgcaggtcttctgccctccggatcctgctttgcca

SEQ ID NO: 136172 - DNA, 37 bp, Artificial Sequence
  Synthetic oligonucleotide
aaccacggtgggtgaggtgggcgggataactcataga

SEQ ID NO: 136173 - DNA, 37 bp, Artificial Sequence
  Synthetic oligonucleotide
tcacccgtcatgacgctgccacaccactgctcccgga

SEQ ID NO: 136174 - DNA, 37 bp, Artificial Sequence
  Synthetic oligonucleotide
tgtgacgcacaggaggggggcgcgggtggctttggga

SEQ ID NO: 136175 - DNA, 37 bp, Artificial Sequence
  Synthetic oligonucleotide
ttgagcaatggagcagggggggggacgggtggaatga

SEQ ID NO: 136176 - DNA, 37 bp, Artificial Sequence
  Synthetic oligonucleotide
tcctccgccccaattacgtgtgaactaccgatcctga

SEQ ID NO: 136177 - DNA, 38 bp, Artificial Sequence
  Synthetic oligonucleotide
ggtcacgccctcgccctcgttttttagtgctccattga

SEQ ID NO: 136178 - DNA, 35 bp, Artificial Sequence
  Synthetic oligonucleotide
tgcccttgcccgcattaagccgctgtactctgccc

SEQ ID NO: 136179 - DNA, 35 bp, Artificial Sequence
  Synthetic oligonucleotide
gccatctgatctccgtcttcctgtcctcttgtgcc

SEQ ID NO: 136180 - DNA, 35 bp, Artificial Sequence
  Synthetic oligonucleotide
gcacccgtgccttgtctgcctatctactaacgtcc

SEQ ID NO: 136181 - DNA, 35 bp, Artificial Sequence
  Synthetic oligonucleotide
gccccctcatcatgcacctgcgcccttccttgtcc

SEQ ID NO: 136182 - DNA, 35 bp, Artificial Sequence
  Synthetic oligonucleotide
tgatgccgtagagcgcgcccgtttactgtcttctc

SEQ ID NO: 136183 - DNA, 35 bp, Artificial Sequence
  Synthetic oligonucleotide
agggaggggcgggttagggcgggctcatatatagg

SEQ ID NO: 136184 - DNA, 35 bp, Artificial Sequence
  Synthetic oligonucleotide
attgtgcctttcgccccgcccgtggttccttcctg

SEQ ID NO: 136185 - DNA, 35 bp, Artificial Sequence
  Synthetic oligonucleotide
acatgctctcatccccgtcccatcatcggcatttg

SEQ ID NO: 136186 - DNA, 35 bp, Artificial Sequence
  Synthetic oligonucleotide
gtatggggcggggactagggtgggtttatcgccat

SEQ ID NO: 136187 - DNA, 35 bp, Artificial Sequence
  Synthetic oligonucleotide
tgcgacgatcgacaccccccccggcccacctgact

SEQ ID NO: 136188 - DNA, 35 bp, Artificial Sequence
  Synthetic oligonucleotide
gggtgcccgctgcccccgtccatattattcgccct

SEQ ID NO: 136189 - DNA, 34 bp, Artificial Sequence
  Synthetic oligonucleotide
atttccgcaccctcaagccttctgttgacccgct

SEQ ID NO: 136190 - DNA, 35 bp, Artificial Sequence
  Synthetic oligonucleotide
gacaaccgatcacgtcctgctttcgaccccccgct

SEQ ID NO: 136191 - DNA, 35 bp, Artificial Sequence
  Synthetic oligonucleotide
tctgaggtggtgctaaggaaggggggtagaggcgt

SEQ ID NO: 136192 - DNA, 36 bp, Artificial Sequence
  Synthetic oligonucleotide
ttgtccccactccacgttgttgcctcctgccgtaaa

SEQ ID NO: 136193 - DNA, 33 bp, Artificial Sequence
  Synthetic oligonucleotide
actgccctgccgccccgtgccgttatggcccca

SEQ ID NO: 136194 - DNA, 36 bp, Artificial Sequence
  Synthetic oligonucleotide
tccccactctcatgtccaggctcgcacatacgctca

SEQ ID NO: 136195 - DNA, 35 bp, Artificial Sequence
  Synthetic oligonucleotide
gggaggacccagctctgccatcccctgtcttttca

SEQ ID NO: 136196 - DNA, 37 bp, Artificial Sequence
  Synthetic oligonucleotide
gtggtagggaggagcgggtaaaaggcaacttaacaga

SEQ ID NO: 136197 - DNA, 37 bp, Artificial Sequence
  Synthetic oligonucleotide
gtcatcctcatcgcctcgaacgcctccgctctcccga

SEQ ID NO: 136198 - DNA, 37 bp, Artificial Sequence
  Synthetic oligonucleotide
ttcgaccccgaccgcctctcctatccttccggtagga

SEQ ID NO: 136199 - DNA, 38 bp, Artificial Sequence
  Synthetic oligonucleotide
taccctcgctcctgtatggtccacacactaccccctga

SEQ ID NO: 136200 - DNA, 38 bp, Artificial Sequence
  Synthetic oligonucleotide
gccatccctccgcccggtaacgccacccgtacttgtga

SEQ ID NO: 136201 - DNA, 38 bp, Artificial Sequence
  Synthetic oligonucleotide
gcaggccccctctgtctcctccttcccaggctgcttga

SEQ ID NO: 136202 - DNA, 38 bp, Artificial Sequence
  Synthetic oligonucleotide
gatgtgtcgtgggggggaggagggcatgtaatcgttga

SEQ ID NO: 136203 - DNA, 35 bp, Artificial Sequence
  Synthetic oligonucleotide
tacgcacctcgtagccactgtatttattacgcccc

SEQ ID NO: 136204 - DNA, 35 bp, Artificial Sequence
  Synthetic oligonucleotide
gttcgctcgcctcatccgttacaccctccctggcc

SEQ ID NO: 136205 - DNA, 36 bp, Artificial Sequence
  Synthetic oligonucleotide
acggagcacgattagtggctccccccgacccttgcc

SEQ ID NO: 136206 - DNA, 35 bp, Artificial Sequence
  Synthetic oligonucleotide
gtctcactcctcttgccgtattcaccccgccttcc

SEQ ID NO: 136207 - DNA, 35 bp, Artificial Sequence
  Synthetic oligonucleotide
aagcgctcccccgagtatcgcccgttcgcctttcc

SEQ ID NO: 136208 - DNA, 35 bp, Artificial Sequence
  Synthetic oligonucleotide
gacatacggtacttgtaccaaagcaacatctccgc

SEQ ID NO: 136209 - DNA, 35 bp, Artificial Sequence
  Synthetic oligonucleotide
tcccctactacagttcgtcccgccacttttgtcgc

SEQ ID NO: 136210 - DNA, 35 bp, Artificial Sequence
  Synthetic oligonucleotide
gccgtccgccctcgccgcaagcactccctttgacg

SEQ ID NO: 136211 - DNA, 35 bp, Artificial Sequence
  Synthetic oligonucleotide
gctgacccctacgttccacgattcccgctctaccg

SEQ ID NO: 136212 - DNA, 35 bp, Artificial Sequence
  Synthetic oligonucleotide
tagtcgccccagtatcgtttggcccttcgacctcg

SEQ ID NO: 136213 - DNA, 35 bp, Artificial Sequence
  Synthetic oligonucleotide
acaccccgtttgcccccacttccgcacccgctctg

SEQ ID NO: 136214 - DNA, 35 bp, Artificial Sequence
  Synthetic oligonucleotide
agcccaactgctccaggtcatcaccgctatcctat

SEQ ID NO: 136215 - DNA, 35 bp, Artificial Sequence
  Synthetic oligonucleotide
tgactccatcggaacttcccgcccccgaactcttt

SEQ ID NO: 136216 - DNA, 36 bp, Artificial Sequence
  Synthetic oligonucleotide
gccttgtccttgtctcgttctgtagccatccctcaa

SEQ ID NO: 136217 - DNA, 35 bp, Artificial Sequence
  Synthetic oligonucleotide
ggggcgggtagccaaagaagggggggggaaacgaa

SEQ ID NO: 136218 - DNA, 36 bp, Artificial Sequence
  Synthetic oligonucleotide
tcacaggctaccattggtgaccgctcccatcctaca

SEQ ID NO: 136219 - DNA, 35 bp, Artificial Sequence
  Synthetic oligonucleotide
tccgcctcaccggggtccgtaactgttcattcgca

SEQ ID NO: 136220 - DNA, 36 bp, Artificial Sequence
  Synthetic oligonucleotide
ggtgccaaaagacgaggtgaggggcggaggagggca

SEQ ID NO: 136221 - DNA, 37 bp, Artificial Sequence
  Synthetic oligonucleotide
gaggagggagcaggagggaagtaaaaacgacgagaga

SEQ ID NO: 136222 - DNA, 37 bp, Artificial Sequence
  Synthetic oligonucleotide
ggatagggggaggcgaaggggaaaaggacacgctaga

SEQ ID NO: 136223 - DNA, 36 bp, Artificial Sequence
  Synthetic oligonucleotide
aactcgcctcgaacaaattatggtacttccccccga

SEQ ID NO: 136224 - DNA, 35 bp, Artificial Sequence
  Synthetic oligonucleotide
tctcattcccccctgtgctcacccaccctcctgga

SEQ ID NO: 136225 - DNA, 37 bp, Artificial Sequence
  Synthetic oligonucleotide
gtcgacgggaggagtgggggggcaagaatgctcctga

SEQ ID NO: 136226 - DNA, 38 bp, Artificial Sequence
  Synthetic oligonucleotide
gtgtcaggggggtgggaaaggctcttgctgagggctga

SEQ ID NO: 136227 - DNA, 38 bp, Artificial Sequence
  Synthetic oligonucleotide
tccgacgcccctcctgttcacgtgctccttaacattga

SEQ ID NO: 136228 - DNA, 35 bp, Artificial Sequence
  Synthetic oligonucleotide
ttccgtgccatcgccccgttgcctgtcagccatac

SEQ ID NO: 136229 - DNA, 35 bp, Artificial Sequence
  Synthetic oligonucleotide
ggtcgctgagcccgtcacaccgtttccatgtcccc

SEQ ID NO: 136230 - DNA, 35 bp, Artificial Sequence
  Synthetic oligonucleotide
accgttggtcggtcccctgtaacggtcctttcccc

SEQ ID NO: 136231 - DNA, 35 bp, Artificial Sequence
  Synthetic oligonucleotide
tgtacacaccgcttgactcgttcacctggcctccc

SEQ ID NO: 136232 - DNA, 35 bp, Artificial Sequence
  Synthetic oligonucleotide
accgctgtcccagcctgttctattcctccgatgcc

SEQ ID NO: 136233 - DNA, 35 bp, Artificial Sequence
  Synthetic oligonucleotide
atgcgcccatcattcctagttggtgtcttctatcc

SEQ ID NO: 136234 - DNA, 35 bp, Artificial Sequence
  Synthetic oligonucleotide
agtgcgctcctgacctgcccgtttctgtacccctc

SEQ ID NO: 136235 - DNA, 34 bp, Artificial Sequence
  Synthetic oligonucleotide
tgtaggaccaacgctccgccctttcgattccctc

SEQ ID NO: 136236 - DNA, 35 bp, Artificial Sequence
  Synthetic oligonucleotide
ttccacctctagcgataattcgcaagtcctcgttc

SEQ ID NO: 136237 - DNA, 35 bp, Artificial Sequence
  Synthetic oligonucleotide
tgaccccgaccgccacactccgctccccgctcgcg

SEQ ID NO: 136238 - DNA, 35 bp, Artificial Sequence
  Synthetic oligonucleotide
agagtgtgtggacggtggggggacaaagtagaggg

SEQ ID NO: 136239 - DNA, 35 bp, Artificial Sequence
  Synthetic oligonucleotide
tcacaatgaccgccacaactgttcaaccatccttg

SEQ ID NO: 136240 - DNA, 35 bp, Artificial Sequence
  Synthetic oligonucleotide
accctcacctcatacgttgcgccgcgctaactcct

SEQ ID NO: 136241 - DNA, 35 bp, Artificial Sequence
  Synthetic oligonucleotide
tcatgactcgccctaatcctgacacccatctttgt

SEQ ID NO: 136242 - DNA, 36 bp, Artificial Sequence
  Synthetic oligonucleotide
actagctcgccctgacttgcacggcctcccatccaa

SEQ ID NO: 136243 - DNA, 36 bp, Artificial Sequence
  Synthetic oligonucleotide
tacctgccgggggggggtaaaatgctggggaggtaa

SEQ ID NO: 136244 - DNA, 35 bp, Artificial Sequence
  Synthetic oligonucleotide
actgggcgggggtgtagagggaggggcaaactaca

SEQ ID NO: 136245 - DNA, 36 bp, Artificial Sequence
  Synthetic oligonucleotide
gcgacaactgcactacggcttcatctaccgcgccca

SEQ ID NO: 136246 - DNA, 37 bp, Artificial Sequence
  Synthetic oligonucleotide
gctcgccaagagctctcctcccccgtcacactgacga

SEQ ID NO: 136247 - DNA, 37 bp, Artificial Sequence
  Synthetic oligonucleotide
tagaaccggtggggtggggcgccggggaggaatacga

SEQ ID NO: 136248 - DNA, 37 bp, Artificial Sequence
  Synthetic oligonucleotide
tgcaaccccggcccgcctcccatcgtttatgtttcga

SEQ ID NO: 136249 - DNA, 38 bp, Artificial Sequence
  Synthetic oligonucleotide
actatgtgggaggggatgagggatgggtgtgggaatga

SEQ ID NO: 136250 - DNA, 35 bp, Artificial Sequence
  Synthetic oligonucleotide
tccccttcagtcctgtcccagccataccccactga

SEQ ID NO: 136251 - DNA, 38 bp, Artificial Sequence
  Synthetic oligonucleotide
tccaccgccacccttgttacgttcaatctttgccctga

SEQ ID NO: 136252 - DNA, 37 bp, Artificial Sequence
  Synthetic oligonucleotide
gtggccactgtccctgcctacgacctcctcctgctga

SEQ ID NO: 136253 - DNA, 38 bp, Artificial Sequence
  Synthetic oligonucleotide
tccaccgcaaacttgcctgctccccttcgactacgtga

SEQ ID NO: 136254 - DNA, 38 bp, Artificial Sequence
  Synthetic oligonucleotide
gtgatcgcacccgttctttgattaacgcccccccgtga

SEQ ID NO: 136255 - DNA, 35 bp, Artificial Sequence
  Synthetic oligonucleotide
acaaggtgcgaaggcgggggggtggaagatcggta

SEQ ID NO: 136256 - DNA, 36 bp, Artificial Sequence
  Synthetic oligonucleotide
tcgccactcgtagtcagccgccccttcccgcctgta

SEQ ID NO: 136257 - DNA, 36 bp, Artificial Sequence
  Synthetic oligonucleotide
agcacccaaccctgtccctgtgcgcccccgctatta

SEQ ID NO: 136258 - DNA, 35 bp, Artificial Sequence
  Synthetic oligonucleotide
gttcagtcccccacacttgcgtttgaacatactac

SEQ ID NO: 136259 - DNA, 35 bp, Artificial Sequence
  Synthetic oligonucleotide
tcgtaggcccctctgcacatccggaccctcgaacc

SEQ ID NO: 136260 - DNA, 35 bp, Artificial Sequence
  Synthetic oligonucleotide
atgtgtgcctctgttccttatcgacctcctggccc

SEQ ID NO: 136261 - DNA, 35 bp, Artificial Sequence
  Synthetic oligonucleotide
accttagcagtgctcacgttgctaacgtgccctcc

SEQ ID NO: 136262 - DNA, 35 bp, Artificial Sequence
  Synthetic oligonucleotide
gtcggtccggtatttatgatcactcgccccctcgc

SEQ ID NO: 136263 - DNA, 35 bp, Artificial Sequence
  Synthetic oligonucleotide
acacgccgcatgtgcacgcccccacgatccagctc

SEQ ID NO: 136264 - DNA, 35 bp, Artificial Sequence
  Synthetic oligonucleotide
atgtcccacccatatggccgtctcgcccccctaag

SEQ ID NO: 136265 - DNA, 35 bp, Artificial Sequence
  Synthetic oligonucleotide
ccacacacccactccgcccaccgtcattgcacgcg

SEQ ID NO: 136266 - DNA, 35 bp, Artificial Sequence
  Synthetic oligonucleotide
gtacctccgcggaaagcccttccactccctccgcg

SEQ ID NO: 136267 - DNA, 35 bp, Artificial Sequence
  Synthetic oligonucleotide
actaggcaacagcagtctcttttatgtcgccccct

SEQ ID NO: 136268 - DNA, 35 bp, Artificial Sequence
  Synthetic oligonucleotide
aatccggcctcaatgagtcatcttccatccgtcct

SEQ ID NO: 136269 - DNA, 35 bp, Artificial Sequence
  Synthetic oligonucleotide
ggaaccgtgctccccgtctctatgcaagctgttct

SEQ ID NO: 136270 - DNA, 35 bp, Artificial Sequence
  Synthetic oligonucleotide
gtgccaccctcccatcaccgccctaagtttgtggt

SEQ ID NO: 136271 - DNA, 35 bp, Artificial Sequence
  Synthetic oligonucleotide
gtcgagtcccctgtctaacgctgccgcatctcctt

SEQ ID NO: 136272 - DNA, 35 bp, Artificial Sequence
  Synthetic oligonucleotide
tgggcctccccctgccacgccgcacggttctcctt

SEQ ID NO: 136273 - DNA, 35 bp, Artificial Sequence
  Synthetic oligonucleotide
tgcaccctttaagacgcccgcccccgagcctgttt

SEQ ID NO: 136274 - DNA, 36 bp, Artificial Sequence
  Synthetic oligonucleotide
gcccctccccggaacccttctcgacgtttgtaggaa

SEQ ID NO: 136275 - DNA, 36 bp, Artificial Sequence
  Synthetic oligonucleotide
gtggtcgggtcaggggaggaagggggaaaggcgaca

SEQ ID NO: 136276 - DNA, 36 bp, Artificial Sequence
  Synthetic oligonucleotide
ttgaacctgcctcccatttgacatccagtgaggaca

SEQ ID NO: 136277 - DNA, 36 bp, Artificial Sequence
  Synthetic oligonucleotide
tagcaccctccgcactcccactagcttttggccgca

SEQ ID NO: 136278 - DNA, 36 bp, Artificial Sequence
  Synthetic oligonucleotide
atcccctcgcacccggttcctcgctaacactccgca

SEQ ID NO: 136279 - DNA, 36 bp, Artificial Sequence
  Synthetic oligonucleotide
gtatgcctgcgttgcagctgcccactttgcccctca

SEQ ID NO: 136280 - DNA, 36 bp, Artificial Sequence
  Synthetic oligonucleotide
gtccatcctctgcctgcactgaacgtctaccgttca

SEQ ID NO: 136281 - DNA, 36 bp, Artificial Sequence
  Synthetic oligonucleotide
tcgtcccatcctgtacaacttccctcgccgtgacga

SEQ ID NO: 136282 - DNA, 37 bp, Artificial Sequence
  Synthetic oligonucleotide
gacacccactatgcaccatgccccaacggtcatccga

SEQ ID NO: 136283 - DNA, 35 bp, Artificial Sequence
  Synthetic oligonucleotide
ggggctccgttcgggtggggtgcgcatgaggggga

SEQ ID NO: 136284 - DNA, 37 bp, Artificial Sequence
  Synthetic oligonucleotide
gtaggtggcggtgtacgtggggagggttgggggggga

SEQ ID NO: 136285 - DNA, 37 bp, Artificial Sequence
  Synthetic oligonucleotide
taagagcgcaggagaggaggagtgagggggctttgga

SEQ ID NO: 136286 - DNA, 36 bp, Artificial Sequence
  Synthetic oligonucleotide
ccgaacgccacattatcgttatcccgccctccgcta

SEQ ID NO: 136287 - DNA, 35 bp, Artificial Sequence
  Synthetic oligonucleotide
acgccctgtgccagccgcaacctcacacgacccac

SEQ ID NO: 136288 - DNA, 35 bp, Artificial Sequence
  Synthetic oligonucleotide
agcacaccatcatgctctccctttcggctctccac

SEQ ID NO: 136289 - DNA, 35 bp, Artificial Sequence
  Synthetic oligonucleotide
gcacggcctgcctcgatcctccatcgttccgaccc

SEQ ID NO: 136290 - DNA, 35 bp, Artificial Sequence
  Synthetic oligonucleotide
gtgcatggtcaccggcttttcccccctttttcccc

SEQ ID NO: 136291 - DNA, 35 bp, Artificial Sequence
  Synthetic oligonucleotide
gacttgcgtcggtggttcacctgtccggccgtccc

SEQ ID NO: 136292 - DNA, 35 bp, Artificial Sequence
  Synthetic oligonucleotide
gacgatttcacccccgtccgccctacacatcagcc

SEQ ID NO: 136293 - DNA, 35 bp, Artificial Sequence
  Synthetic oligonucleotide
gagtcccgactcgcctcacctggaaccccctagcc

SEQ ID NO: 136294 - DNA, 35 bp, Artificial Sequence
  Synthetic oligonucleotide
gataggcacaccgtacgccacccccttgattcgcc

SEQ ID NO: 136295 - DNA, 35 bp, Artificial Sequence
  Synthetic oligonucleotide
gcgtcgtctttgcgctcccgactacccttcgttcc

SEQ ID NO: 136296 - DNA, 35 bp, Artificial Sequence
  Synthetic oligonucleotide
tcattcccagtgcgcgcggactccttccctcctgc

SEQ ID NO: 136297 - DNA, 35 bp, Artificial Sequence
  Synthetic oligonucleotide
ttccctgccacccgcctaatgtgcgctttcaaatc

SEQ ID NO: 136298 - DNA, 35 bp, Artificial Sequence
  Synthetic oligonucleotide
acaacagtgctgcaggccataatatcctctccatc

SEQ ID NO: 136299 - DNA, 35 bp, Artificial Sequence
  Synthetic oligonucleotide
acatcattccgacgatcgtgagttcggtctacctc

SEQ ID NO: 136300 - DNA, 35 bp, Artificial Sequence
  Synthetic oligonucleotide
ttgggtgggtatgaggggtaacactgtaaggcctc

SEQ ID NO: 136301 - DNA, 35 bp, Artificial Sequence
  Synthetic oligonucleotide
gacacctcacgacatgtttttctgctgccttcctc

SEQ ID NO: 136302 - DNA, 35 bp, Artificial Sequence
  Synthetic oligonucleotide
atgctgtagccctgtccacccgccgtgattcgctc

SEQ ID NO: 136303 - DNA, 35 bp, Artificial Sequence
  Synthetic oligonucleotide
agataacccccatacatgctgatactcgacccttc

SEQ ID NO: 136304 - DNA, 35 bp, Artificial Sequence
  Synthetic oligonucleotide
gctcgccccaccatctcgtacgtcccctggggccg

SEQ ID NO: 136305 - DNA, 35 bp, Artificial Sequence
  Synthetic oligonucleotide
gacgactacacttttatgcctgccctgacctagcg

SEQ ID NO: 136306 - DNA, 35 bp, Artificial Sequence
  Synthetic oligonucleotide
tccccctcctcttgcaacacagtacatccaacggg

SEQ ID NO: 136307 - DNA, 35 bp, Artificial Sequence
  Synthetic oligonucleotide
tccgcgccttctcgtgtccctctcgttgctcactg

SEQ ID NO: 136308 - DNA, 35 bp, Artificial Sequence
  Synthetic oligonucleotide
gcccctattcgcccgcaatgcataccatgttccat

SEQ ID NO: 136309 - DNA, 35 bp, Artificial Sequence
  Synthetic oligonucleotide
gaccacccccgacgaaagcccccccagctgcttat

SEQ ID NO: 136310 - DNA, 35 bp, Artificial Sequence
  Synthetic oligonucleotide
atgccgcctgtaatgcccttcgttgttccgtttat

SEQ ID NO: 136311 - DNA, 35 bp, Artificial Sequence
  Synthetic oligonucleotide
gccccacgtacatgcgaccacccccgcattatact

SEQ ID NO: 136312 - DNA, 35 bp, Artificial Sequence
  Synthetic oligonucleotide
gagggggacgagtgctggggtttggggacattact

SEQ ID NO: 136313 - DNA, 35 bp, Artificial Sequence
  Synthetic oligonucleotide
tgtcgatccaccttcgtattttggaatgtcctcct

SEQ ID NO: 136314 - DNA, 35 bp, Artificial Sequence
  Synthetic oligonucleotide
tccgcccaatgcgcgttctagctcacccttttgct

SEQ ID NO: 136315 - DNA, 35 bp, Artificial Sequence
  Synthetic oligonucleotide
tccgacgacttagtgcaccatcccctggtcgtttt

SEQ ID NO: 136316 - DNA, 35 bp, Artificial Sequence
  Synthetic oligonucleotide
agccctggcccacgagaccttatacgcacccccca

SEQ ID NO: 136317 - DNA, 37 bp, Artificial Sequence
  Synthetic oligonucleotide
ggattaggaagagaggagcatgaggtgggcgggaaga

SEQ ID NO: 136318 - DNA, 37 bp, Artificial Sequence
  Synthetic oligonucleotide
atagcctgtccaatcgcgcccccacccgtcctgacga

SEQ ID NO: 136319 - DNA, 36 bp, Artificial Sequence
  Synthetic oligonucleotide
gctcacgtagttgagctaatatccttcctgtaccga

SEQ ID NO: 136320 - DNA, 35 bp, Artificial Sequence
  Synthetic oligonucleotide
gccacataccctcaccgactcacagcgcttgccga

SEQ ID NO: 136321 - DNA, 36 bp, Artificial Sequence
  Synthetic oligonucleotide
gtacactcctaccgctcgtttttgactcctgttcga

SEQ ID NO: 136322 - DNA, 35 bp, Artificial Sequence
  Synthetic oligonucleotide
gcgttgccacgctttagtaacccaccctccccgga

SEQ ID NO: 136323 - DNA, 37 bp, Artificial Sequence
  Synthetic oligonucleotide
agtgtcggggtgagggtgggtgatagtggagatggga

SEQ ID NO: 136324 - DNA, 37 bp, Artificial Sequence
  Synthetic oligonucleotide
gatccatccgctccccgtcccctatcggtgatgtgga

SEQ ID NO: 136325 - DNA, 38 bp, Artificial Sequence
  Synthetic oligonucleotide
gtgcaagcctcgccgtcgccacccatctgcctctatga

SEQ ID NO: 136326 - DNA, 37 bp, Artificial Sequence
  Synthetic oligonucleotide
tgccattctcagtcgtcaccttcctacctccgcctga

SEQ ID NO: 136327 - DNA, 36 bp, Artificial Sequence
  Synthetic oligonucleotide
tactcgcccctcgcaatttgatctgctcaccgctga

SEQ ID NO: 136328 - DNA, 38 bp, Artificial Sequence
  Synthetic oligonucleotide
tcgcacaccgcgttggaaagctcctcccccctctgtga

SEQ ID NO: 136329 - DNA, 38 bp, Artificial Sequence
  Synthetic oligonucleotide
tctgaggaggaggtgtggggcggggcatgcgagtgtga

SEQ ID NO: 136330 - DNA, 38 bp, Artificial Sequence
  Synthetic oligonucleotide
tgccccccccctacgcaccagatctggcccactcttga

SEQ ID NO: 136331 - DNA, 35 bp, Artificial Sequence
  Synthetic oligonucleotide
tccacttgccccagttgctttcctctaacctaaac

SEQ ID NO: 136332 - DNA, 35 bp, Artificial Sequence
  Synthetic oligonucleotide
gttggtgcattgacctgtatatccccgtttaccac

SEQ ID NO: 136333 - DNA, 35 bp, Artificial Sequence
  Synthetic oligonucleotide
actatggccaccctgttcgtaagtccacctatcac

SEQ ID NO: 136334 - DNA, 35 bp, Artificial Sequence
  Synthetic oligonucleotide
agcctgacgacgcgaagcttaattgcctgccctac

SEQ ID NO: 136335 - DNA, 35 bp, Artificial Sequence
  Synthetic oligonucleotide
atccgtacaactgtatgccagttcgttttccaccc

SEQ ID NO: 136336 - DNA, 35 bp, Artificial Sequence
  Synthetic oligonucleotide
tacgctctccgcccccggtttgattggcttgcccc

SEQ ID NO: 136337 - DNA, 35 bp, Artificial Sequence
  Synthetic oligonucleotide
tcacaacacccctccgccgctttgctggtccgccc

SEQ ID NO: 136338 - DNA, 35 bp, Artificial Sequence
  Synthetic oligonucleotide
attgacaatctccgcctgtttaccatccggttccc

SEQ ID NO: 136339 - DNA, 35 bp, Artificial Sequence
  Synthetic oligonucleotide
gtttgtgtgcgtatcctgtctccatgtttacctcc

SEQ ID NO: 136340 - DNA, 35 bp, Artificial Sequence
  Synthetic oligonucleotide
tcgttacgcccccagtacctcagctcactgcaatc

SEQ ID NO: 136341 - DNA, 35 bp, Artificial Sequence
  Synthetic oligonucleotide
gtcctgggccccccttctttcatttgagaccactc

SEQ ID NO: 136342 - DNA, 35 bp, Artificial Sequence
  Synthetic oligonucleotide
agtcgacctactgccagtcgcttacatccgccctc

SEQ ID NO: 136343 - DNA, 35 bp, Artificial Sequence
  Synthetic oligonucleotide
gcgcttcggccttccccgtatttgatcgttgcctc

SEQ ID NO: 136344 - DNA, 35 bp, Artificial Sequence
  Synthetic oligonucleotide
gctgttctatgcactgtcgctaccattcgttcctc

SEQ ID NO: 136345 - DNA, 35 bp, Artificial Sequence
  Synthetic oligonucleotide
agtacacgtagcaccacccggccaccttacttgtc

SEQ ID NO: 136346 - DNA, 35 bp, Artificial Sequence
  Synthetic oligonucleotide
tgagggatgggggcggtaaggtagtgcggcaatcg

SEQ ID NO: 136347 - DNA, 35 bp, Artificial Sequence
  Synthetic oligonucleotide
aacttcgcctgcccccgacgcacatatagccatcg

SEQ ID NO: 136348 - DNA, 32 bp, Artificial Sequence
  Synthetic oligonucleotide
tcgtaccatcctgtcaaagcccttcttcgact

SEQ ID NO: 136349 - DNA, 35 bp, Artificial Sequence
  Synthetic oligonucleotide
ttcagtaagctccaccccccgtctgctgccttcct

SEQ ID NO: 136350 - DNA, 35 bp, Artificial Sequence
  Synthetic oligonucleotide
tttacccgccgcaaacacatctgttgctatttcct

SEQ ID NO: 136351 - DNA, 35 bp, Artificial Sequence
  Synthetic oligonucleotide
gcgagaggcgcacttgtcctaccctcaacttctgt

SEQ ID NO: 136352 - DNA, 35 bp, Artificial Sequence
  Synthetic oligonucleotide
tgcatgttgggcggggcgcgtatttatggtggctt

SEQ ID NO: 136353 - DNA, 35 bp, Artificial Sequence
  Synthetic oligonucleotide
gtgggcgccgtcaagtgcattcgtccctcactttt

SEQ ID NO: 136354 - DNA, 35 bp, Artificial Sequence
  Synthetic oligonucleotide
tgtactactctgccgtgcctacttacctccttttt

SEQ ID NO: 136355 - DNA, 36 bp, Artificial Sequence
  Synthetic oligonucleotide
cccaccgccactgacttgtaactgtttgccctccca

SEQ ID NO: 136356 - DNA, 36 bp, Artificial Sequence
  Synthetic oligonucleotide
acatccccgttcccacttttatttggccaagttgca

SEQ ID NO: 136357 - DNA, 37 bp, Artificial Sequence
  Synthetic oligonucleotide
taccgcccccgcccttgtgttttcgatccgaacacga

SEQ ID NO: 136358 - DNA, 37 bp, Artificial Sequence
  Synthetic oligonucleotide
ttcctgtccaccccatctgctatgtctcccagttcga

SEQ ID NO: 136359 - DNA, 37 bp, Artificial Sequence
  Synthetic oligonucleotide
gtgagggaaaggatgcggccaaggcgggggtggtgga

SEQ ID NO: 136360 - DNA, 37 bp, Artificial Sequence
  Synthetic oligonucleotide
tgctgcccagtccttgttcgttcctccctggtttgga

SEQ ID NO: 136361 - DNA, 38 bp, Artificial Sequence
  Synthetic oligonucleotide
ggggatagccagagggatgcggagggtaggcgggatga

SEQ ID NO: 136362 - DNA, 37 bp, Artificial Sequence
  Synthetic oligonucleotide
tgcgccgccgtccagtttgcccctctctcgtcactga

SEQ ID NO: 136363 - DNA, 36 bp, Artificial Sequence
  Synthetic oligonucleotide
tccccagcaccgatccacctccaccgccgtgattga

SEQ ID NO: 136364 - DNA, 36 bp, Artificial Sequence
  Synthetic oligonucleotide
gaaccgggccccccccccgtgttgttaaccttccta

SEQ ID NO: 136365 - DNA, 36 bp, Artificial Sequence
  Synthetic oligonucleotide
ggacgggggggtgggggaatacgacggcttacatta

SEQ ID NO: 136366 - DNA, 35 bp, Artificial Sequence
  Synthetic oligonucleotide
acgatcgcaccctccgccccaccataacccggtta

SEQ ID NO: 136367 - DNA, 35 bp, Artificial Sequence
  Synthetic oligonucleotide
gagcgccggcgtacagttcacctccccgcccgtac

SEQ ID NO: 136368 - DNA, 35 bp, Artificial Sequence
  Synthetic oligonucleotide
ggactccccgtccgtatacacccatgtcttacccc

SEQ ID NO: 136369 - DNA, 35 bp, Artificial Sequence
  Synthetic oligonucleotide
actggccttcgctttcacctgcccgaatcttgtcc

SEQ ID NO: 136370 - DNA, 35 bp, Artificial Sequence
  Synthetic oligonucleotide
gctcatgaccgttaggtatgtaccgatcctcctgc

SEQ ID NO: 136371 - DNA, 35 bp, Artificial Sequence
  Synthetic oligonucleotide
gcacatcattcctggccctctatcgcccaccttgc

SEQ ID NO: 136372 - DNA, 35 bp, Artificial Sequence
  Synthetic oligonucleotide
ttcgcacgcattattcagccacagtccgttacatc

SEQ ID NO: 136373 - DNA, 35 bp, Artificial Sequence
  Synthetic oligonucleotide
gccccctccaactaagcgctgcctccatgactatc

SEQ ID NO: 136374 - DNA, 35 bp, Artificial Sequence
  Synthetic oligonucleotide
gaggcaccctcctgcttcattgtcacactcctatc

SEQ ID NO: 136375 - DNA, 35 bp, Artificial Sequence
  Synthetic oligonucleotide
ttcacatgccacacccggtctggggttcgaccctc

SEQ ID NO: 136376 - DNA, 35 bp, Artificial Sequence
  Synthetic oligonucleotide
acactcccccgctgtataaccgcttcaagacgctc

SEQ ID NO: 136377 - DNA, 35 bp, Artificial Sequence
  Synthetic oligonucleotide
gaatccccagtcatcctctctgcccgttcatggtc

SEQ ID NO: 136378 - DNA, 35 bp, Artificial Sequence
  Synthetic oligonucleotide
gtggaccttaaccgggacgccgccctgcaccccct

SEQ ID NO: 136379 - DNA, 36 bp, Artificial Sequence
  Synthetic oligonucleotide
ggaacgtggagagtgggtatgtgggcgggttatcaa

SEQ ID NO: 136380 - DNA, 35 bp, Artificial Sequence
  Synthetic oligonucleotide
gaacatcctggatcgcctccccacccgtgctgcca

SEQ ID NO: 136381 - DNA, 35 bp, Artificial Sequence
  Synthetic oligonucleotide
gtcacgcccgcttttcccttgccgttcccgcggca

SEQ ID NO: 136382 - DNA, 35 bp, Artificial Sequence
  Synthetic oligonucleotide
aagaccccgcccgttcgctcgccaatgcccttgca

SEQ ID NO: 136383 - DNA, 35 bp, Artificial Sequence
  Synthetic oligonucleotide
ggtcacttcgactcactcaccgccgccgttattca

SEQ ID NO: 136384 - DNA, 36 bp, Artificial Sequence
  Synthetic oligonucleotide
atcaccgcctcacttttgtcctagcctgttgaccga

SEQ ID NO: 136385 - DNA, 37 bp, Artificial Sequence
  Synthetic oligonucleotide
ttcaaggtgggaggtgggaggaagggaacaatggcga

SEQ ID NO: 136386 - DNA, 37 bp, Artificial Sequence
  Synthetic oligonucleotide
tggagaggggctcgcggtggggtgggggctggcagga

SEQ ID NO: 136387 - DNA, 37 bp, Artificial Sequence
  Synthetic oligonucleotide
ttgccttccgcagccctaccctccgccgccgtaatga

SEQ ID NO: 136388 - DNA, 36 bp, Artificial Sequence
  Synthetic oligonucleotide
atcgacgcctcctatctcaccaagattgcaccgtga

SEQ ID NO: 136389 - DNA, 38 bp, Artificial Sequence
  Synthetic oligonucleotide
acaccctgcccccttttcgataaacagctcaccgttga

SEQ ID NO: 136390 - DNA, 37 bp, Artificial Sequence
  Synthetic oligonucleotide
gacaccactgctgccctgacccttatctgtcgtttga

SEQ ID NO: 136391 - DNA, 35 bp, Artificial Sequence
  Synthetic oligonucleotide
acacaccactttaacgtgcatgttctttcctccta

SEQ ID NO: 136392 - DNA, 36 bp, Artificial Sequence
  Synthetic oligonucleotide
gccccaccgtgccctaaccgcttctacagaccgtta

SEQ ID NO: 136393 - DNA, 35 bp, Artificial Sequence
  Synthetic oligonucleotide
aatccacttgccactggagtatcaccgcccgcacc

SEQ ID NO: 136394 - DNA, 35 bp, Artificial Sequence
  Synthetic oligonucleotide
ccccgccccatggtcaaagccttcaccgcacaccc

SEQ ID NO: 136395 - DNA, 36 bp, Artificial Sequence
  Synthetic oligonucleotide
tgctacctcccaagcgctgtcctgtgctttcagccc

SEQ ID NO: 136396 - DNA, 35 bp, Artificial Sequence
  Synthetic oligonucleotide
gtccctcacgaagtattcactaggttcacctcctc

SEQ ID NO: 136397 - DNA, 35 bp, Artificial Sequence
  Synthetic oligonucleotide
gtcgtttccccgactgactattccccgtgcctctc

SEQ ID NO: 136398 - DNA, 35 bp, Artificial Sequence
  Synthetic oligonucleotide
tgtacccctcccgaaaccgtaacaccgttcacttc

SEQ ID NO: 136399 - DNA, 35 bp, Artificial Sequence
  Synthetic oligonucleotide
tccactaacacccttgcttatgttgacgaaccttc

SEQ ID NO: 136400 - DNA, 35 bp, Artificial Sequence
  Synthetic oligonucleotide
actcacccgcccacagcccgctatattagtggccg

SEQ ID NO: 136401 - DNA, 35 bp, Artificial Sequence
  Synthetic oligonucleotide
ttaggatggtggagcggggaggggtcggctagctg

SEQ ID NO: 136402 - DNA, 35 bp, Artificial Sequence
  Synthetic oligonucleotide
gcccaccgtcccccttccctcacggctgtccggtg

SEQ ID NO: 136403 - DNA, 35 bp, Artificial Sequence
  Synthetic oligonucleotide
tcaacacacgtcctcgtccccgcgccgcctaccat

SEQ ID NO: 136404 - DNA, 35 bp, Artificial Sequence
  Synthetic oligonucleotide
gtcccacttgtccccccggttttggttgcacctct

SEQ ID NO: 136405 - DNA, 33 bp, Artificial Sequence
  Synthetic oligonucleotide
tagctcccctgcccgttcgacatcggtaacttt

SEQ ID NO: 136406 - DNA, 35 bp, Artificial Sequence
  Synthetic oligonucleotide
gacacgtcgatgccagtatttcgccttcccgccca

SEQ ID NO: 136407 - DNA, 36 bp, Artificial Sequence
  Synthetic oligonucleotide
atgtaactcctctccgtaatgaccctgtccttgcca

SEQ ID NO: 136408 - DNA, 36 bp, Artificial Sequence
  Synthetic oligonucleotide
gtaccctcgccgctaatccatctgctacccaccaga

SEQ ID NO: 136409 - DNA, 37 bp, Artificial Sequence
  Synthetic oligonucleotide
ggacacagggaggagtggggggggagcgggtgggaga

SEQ ID NO: 136410 - DNA, 37 bp, Artificial Sequence
  Synthetic oligonucleotide
tcaccatcacgatctgcttcttctcgactaattcgga

SEQ ID NO: 136411 - DNA, 37 bp, Artificial Sequence
  Synthetic oligonucleotide
ttacgaacgggcggggggcaaaggaaagcatagggga

SEQ ID NO: 136412 - DNA, 35 bp, Artificial Sequence
  Synthetic oligonucleotide
tgagagaggagggtagcctggtgacgggcggggga

SEQ ID NO: 136413 - DNA, 36 bp, Artificial Sequence
  Synthetic oligonucleotide
ttccaccgacccatcctttgcaaccgttctgcctga

SEQ ID NO: 136414 - DNA, 38 bp, Artificial Sequence
  Synthetic oligonucleotide
tcaacgccaccctgtaaggcaccttttctcctccttga

SEQ ID NO: 136415 - DNA, 36 bp, Artificial Sequence
  Synthetic oligonucleotide
gctcaatccgtttgcccttgtgttcgtcctccgtta

SEQ ID NO: 136416 - DNA, 36 bp, Artificial Sequence
  Synthetic oligonucleotide
acctccacgtgcacctgctactcgactcagtcttta

SEQ ID NO: 136417 - DNA, 35 bp, Artificial Sequence
  Synthetic oligonucleotide
atgctccccaccgcggttacgctgccttctaaacc

SEQ ID NO: 136418 - DNA, 35 bp, Artificial Sequence
  Synthetic oligonucleotide
accccgttgcgatggtcatcagcccctaccgatcc

SEQ ID NO: 136419 - DNA, 35 bp, Artificial Sequence
  Synthetic oligonucleotide
ggacatgtccgcacatctgtcctacctttcgcatc

SEQ ID NO: 136420 - DNA, 35 bp, Artificial Sequence
  Synthetic oligonucleotide
gccacacccgttgtaatcagggggtgcccttcttc

SEQ ID NO: 136421 - DNA, 35 bp, Artificial Sequence
  Synthetic oligonucleotide
tatggctgggttcctgcttaatgttccccctcccg

SEQ ID NO: 136422 - DNA, 35 bp, Artificial Sequence
  Synthetic oligonucleotide
aggtcaaccctagatctcgccccccaccatggcct

SEQ ID NO: 136423 - DNA, 35 bp, Artificial Sequence
  Synthetic oligonucleotide
acgagagcgcgggctggtctcccttttccctcatt

SEQ ID NO: 136424 - DNA, 36 bp, Artificial Sequence
  Synthetic oligonucleotide
tccaccgtatccacccccatagagctcctgcgtaaa

SEQ ID NO: 136425 - DNA, 35 bp, Artificial Sequence
  Synthetic oligonucleotide
gcctagggggaataggggtgggagggccggccgaa

SEQ ID NO: 136426 - DNA, 35 bp, Artificial Sequence
  Synthetic oligonucleotide
tcttcaccgctccgaacctcgtgtaaccctcccca

SEQ ID NO: 136427 - DNA, 36 bp, Artificial Sequence
  Synthetic oligonucleotide
gccattctgccggttggtttcatcacgctctgccca

SEQ ID NO: 136428 - DNA, 36 bp, Artificial Sequence
  Synthetic oligonucleotide
tgtgcctacgccctgtctccactctgcttcgaatca

SEQ ID NO: 136429 - DNA, 35 bp, Artificial Sequence
  Synthetic oligonucleotide
gacccactccctccccggacagcccgctcacgtca

SEQ ID NO: 136430 - DNA, 37 bp, Artificial Sequence
  Synthetic oligonucleotide
acaccgcgatggtggatgggggtgaagggtggaaaga

SEQ ID NO: 136431 - DNA, 37 bp, Artificial Sequence
  Synthetic oligonucleotide
tcaagggtgagggactaggactaggggggggaaacga

SEQ ID NO: 136432 - DNA, 37 bp, Artificial Sequence
  Synthetic oligonucleotide
aacccaccgcgcctccccctgcctgattggtctacga

SEQ ID NO: 136433 - DNA, 36 bp, Artificial Sequence
  Synthetic oligonucleotide
tgacatccactcccatccgccactactatgtagcga

SEQ ID NO: 136434 - DNA, 37 bp, Artificial Sequence
  Synthetic oligonucleotide
gtctagcacgggggggcatagggtaagggagttgcga

SEQ ID NO: 136435 - DNA, 37 bp, Artificial Sequence
  Synthetic oligonucleotide
accggatgagatcaggggatgggccgggggggaagga

SEQ ID NO: 136436 - DNA, 37 bp, Artificial Sequence
  Synthetic oligonucleotide
ttcccccccgcaatattccatcagccaggcttaagga

SEQ ID NO: 136437 - DNA, 36 bp, Artificial Sequence
  Synthetic oligonucleotide
accctccgccaaggtctgtctcatcctcgtcacgga

SEQ ID NO: 136438 - DNA, 37 bp, Artificial Sequence
  Synthetic oligonucleotide
tcccaacccgacttgtgccatcgccgcccttccatga

SEQ ID NO: 136439 - DNA, 37 bp, Artificial Sequence
  Synthetic oligonucleotide
gagaaggggggaggtagataagacaaggtggcgctga

SEQ ID NO: 136440 - DNA, 38 bp, Artificial Sequence
  Synthetic oligonucleotide
tgttcctgccctctgctactgttcatggctctctctga

SEQ ID NO: 136441 - DNA, 38 bp, Artificial Sequence
  Synthetic oligonucleotide
tacgacggggtgggatggggttggttgggcgattctga

SEQ ID NO: 136442 - DNA, 38 bp, Artificial Sequence
  Synthetic oligonucleotide
gaacgcaggtgaaggtggtggtggtgggggtgctgtga

SEQ ID NO: 136443 - DNA, 35 bp, Artificial Sequence
  Synthetic oligonucleotide
tgctagcccacgtttaatgctttctctcctcgcta

SEQ ID NO: 136444 - DNA, 36 bp, Artificial Sequence
  Synthetic oligonucleotide
tgtgcggagggcggagggggggtcatggcggatcta

SEQ ID NO: 136445 - DNA, 35 bp, Artificial Sequence
  Synthetic oligonucleotide
ttgagccccgcacattcctgttctcctttgccgta

SEQ ID NO: 136446 - DNA, 35 bp, Artificial Sequence
  Synthetic oligonucleotide
tacgtggtccgtggcgtctttacgcattccttccc

SEQ ID NO: 136447 - DNA, 35 bp, Artificial Sequence
  Synthetic oligonucleotide
tgatgccatccgccctcccctgcaagtttctggcc

SEQ ID NO: 136448 - DNA, 35 bp, Artificial Sequence
  Synthetic oligonucleotide
tgaacctattctcgccagtcccgctccaacgccgc

SEQ ID NO: 136449 - DNA, 35 bp, Artificial Sequence
  Synthetic oligonucleotide
gcccacccccgagttcacctagcttactgttaacg

SEQ ID NO: 136450 - DNA, 35 bp, Artificial Sequence
  Synthetic oligonucleotide
tggaaacactcgccgaccacacccagcctgccacg

SEQ ID NO: 136451 - DNA, 35 bp, Artificial Sequence
  Synthetic oligonucleotide
gccgatccggctgtctacaccgtttctccgtaccg

SEQ ID NO: 136452 - DNA, 35 bp, Artificial Sequence
  Synthetic oligonucleotide
gatgtccgattccttctgcccctactcttttgtcg

SEQ ID NO: 136453 - DNA, 35 bp, Artificial Sequence
  Synthetic oligonucleotide
tcaatagccgtcatcgcgcgcctgaaactcctctg

SEQ ID NO: 136454 - DNA, 35 bp, Artificial Sequence
  Synthetic oligonucleotide
tgcatagcaccgccattctactctatcgactccct

SEQ ID NO: 136455 - DNA, 35 bp, Artificial Sequence
  Synthetic oligonucleotide
tctgcattatcctgctgcttccacgccaccgtttt

SEQ ID NO: 136456 - DNA, 35 bp, Artificial Sequence
  Synthetic oligonucleotide
aacgcatggccatgcgtgcccgcctctttacacca

SEQ ID NO: 136457 - DNA, 36 bp, Artificial Sequence
  Synthetic oligonucleotide
gtccgcaccactatggtctcgtgcttctcgtatcca

SEQ ID NO: 136458 - DNA, 36 bp, Artificial Sequence
  Synthetic oligonucleotide
gtccgctccgcatccaccatcgccttcaccgctcca

SEQ ID NO: 136459 - DNA, 36 bp, Artificial Sequence
  Synthetic oligonucleotide
tcacgtccgttgtcgaccctccaccccttattgtca

SEQ ID NO: 136460 - DNA, 37 bp, Artificial Sequence
  Synthetic oligonucleotide
gaagtgggagtggagggtgcaagcaggcacgtgacga

SEQ ID NO: 136461 - DNA, 37 bp, Artificial Sequence
  Synthetic oligonucleotide
gtgatccgggagtgggaatggaggggcataataggga

SEQ ID NO: 136462 - DNA, 37 bp, Artificial Sequence
  Synthetic oligonucleotide
gtcgggctcattcatgggggggttgcgaccaagggga

SEQ ID NO: 136463 - DNA, 37 bp, Artificial Sequence
  Synthetic oligonucleotide
tacgtgaccccgctcccttcagtcatgaattgactga

SEQ ID NO: 136464 - DNA, 37 bp, Artificial Sequence
  Synthetic oligonucleotide
gccgtcccttggtcaactgctgcatctcctcgcctga

SEQ ID NO: 136465 - DNA, 35 bp, Artificial Sequence
  Synthetic oligonucleotide
tccgccttgcagatcggccgttctttgcccactac

SEQ ID NO: 136466 - DNA, 35 bp, Artificial Sequence
  Synthetic oligonucleotide
tcgccggttccattatttattgcgctccatcctac

SEQ ID NO: 136467 - DNA, 35 bp, Artificial Sequence
  Synthetic oligonucleotide
acgacccgcccctgcacacttggacgatcttaacc

SEQ ID NO: 136468 - DNA, 35 bp, Artificial Sequence
  Synthetic oligonucleotide
gtatcctcgccgtatcaggcccttcgcctattccc

SEQ ID NO: 136469 - DNA, 35 bp, Artificial Sequence
  Synthetic oligonucleotide
tcacatcgtgctccacatctaccacaccgcaccgc

SEQ ID NO: 136470 - DNA, 35 bp, Artificial Sequence
  Synthetic oligonucleotide
acgtggctctatgcgccccaactctctggtccctc

SEQ ID NO: 136471 - DNA, 35 bp, Artificial Sequence
  Synthetic oligonucleotide
gatggcccattcgcatattcattatgtcaccgctc

SEQ ID NO: 136472 - DNA, 35 bp, Artificial Sequence
  Synthetic oligonucleotide
gtcaaatcaccacgactgccctctgtcccccgctc

SEQ ID NO: 136473 - DNA, 35 bp, Artificial Sequence
  Synthetic oligonucleotide
cacccctccgaccaccttgcagccgtacctccgtc

SEQ ID NO: 136474 - DNA, 35 bp, Artificial Sequence
  Synthetic oligonucleotide
gatgcccaacacctcagcggcatatcccgcccttc

SEQ ID NO: 136475 - DNA, 35 bp, Artificial Sequence
  Synthetic oligonucleotide
accctgccctcccattgagggagccattggccttc

SEQ ID NO: 136476 - DNA, 35 bp, Artificial Sequence
  Synthetic oligonucleotide
gcgattcacccctccgcacggtctgcccctatttc

SEQ ID NO: 136477 - DNA, 35 bp, Artificial Sequence
  Synthetic oligonucleotide
tgtatgcgccacatttgcgtcctccttgccctccg

SEQ ID NO: 136478 - DNA, 34 bp, Artificial Sequence
  Synthetic oligonucleotide
gctgcccctaacatgttgcccctcgctcgcctcg

SEQ ID NO: 136479 - DNA, 35 bp, Artificial Sequence
  Synthetic oligonucleotide
tcaccccttcattccccgagccgtcctagtcgagg

SEQ ID NO: 136480 - DNA, 35 bp, Artificial Sequence
  Synthetic oligonucleotide
tccgccccttttcaacgccggccccccgaatattg

SEQ ID NO: 136481 - DNA, 35 bp, Artificial Sequence
  Synthetic oligonucleotide
gtccgcccctccctcttcctcatgagctctatttg

SEQ ID NO: 136482 - DNA, 35 bp, Artificial Sequence
  Synthetic oligonucleotide
tgcgaccgctccacccctgcatttagggccatcct

SEQ ID NO: 136483 - DNA, 35 bp, Artificial Sequence
  Synthetic oligonucleotide
aatttgcccggacaatgcatatttgcccctcctct

SEQ ID NO: 136484 - DNA, 35 bp, Artificial Sequence
  Synthetic oligonucleotide
accatccagtctctgcccttcttcgtcgtccacgt

SEQ ID NO: 136485 - DNA, 35 bp, Artificial Sequence
  Synthetic oligonucleotide
ggacggggtgggattgagagggggtcgggccgtgt

SEQ ID NO: 136486 - DNA, 35 bp, Artificial Sequence
  Synthetic oligonucleotide
tgcctcgccggccctgaatacgccgtcacctcatt

SEQ ID NO: 136487 - DNA, 33 bp, Artificial Sequence
  Synthetic oligonucleotide
gtgcctccgacgcccgcccgagtctctttagtt

SEQ ID NO: 136488 - DNA, 36 bp, Artificial Sequence
  Synthetic oligonucleotide
gttcacatggccttggtttaaccgacctccgctaca

SEQ ID NO: 136489 - DNA, 35 bp, Artificial Sequence
  Synthetic oligonucleotide
tgagcctgcctcatgcgcactatagttccatccca

SEQ ID NO: 136490 - DNA, 35 bp, Artificial Sequence
  Synthetic oligonucleotide
atagcctcccgacgccattacaggatccactccca

SEQ ID NO: 136491 - DNA, 36 bp, Artificial Sequence
  Synthetic oligonucleotide
aactcatggcggaggagggggtcctgggttgtggca

SEQ ID NO: 136492 - DNA, 37 bp, Artificial Sequence
  Synthetic oligonucleotide
gaaagggacagaacggaaaagaaggggggtgtagaga

SEQ ID NO: 136493 - DNA, 35 bp, Artificial Sequence
  Synthetic oligonucleotide
gatagtgccgggtagaacggggtggatcggggaga

SEQ ID NO: 136494 - DNA, 37 bp, Artificial Sequence
  Synthetic oligonucleotide
gcgcctcatcacaccggatcgcacacactcctttaga

SEQ ID NO: 136495 - DNA, 37 bp, Artificial Sequence
  Synthetic oligonucleotide
gcacctccatcttgaatcctccttccggcgatgccga

SEQ ID NO: 136496 - DNA, 37 bp, Artificial Sequence
  Synthetic oligonucleotide
gggaaacaggccgggagggaatgggggggtacatcga

SEQ ID NO: 136497 - DNA, 38 bp, Artificial Sequence
  Synthetic oligonucleotide
gagggtagggcgggaggagcgagggagacaatggctga

SEQ ID NO: 136498 - DNA, 38 bp, Artificial Sequence
  Synthetic oligonucleotide
tgcacccttgctgatccttgtcctatatgcctctttga

SEQ ID NO: 136499 - DNA, 36 bp, Artificial Sequence
  Synthetic oligonucleotide
gcgaggtggaggaggagggtctaggggcatagtcta

SEQ ID NO: 136500 - DNA, 35 bp, Artificial Sequence
  Synthetic oligonucleotide
tccaggagcgcccagtaattgtcgccccccccgta

SEQ ID NO: 136501 - DNA, 35 bp, Artificial Sequence
  Synthetic oligonucleotide
attgaccggccgatttgctcatacttcttctccac

SEQ ID NO: 136502 - DNA, 35 bp, Artificial Sequence
  Synthetic oligonucleotide
gccggccatcccgcctgttacctttccattcatac

SEQ ID NO: 136503 - DNA, 35 bp, Artificial Sequence
  Synthetic oligonucleotide
tccgcatcatcgccttcaagcgcctccggccaccc

SEQ ID NO: 136504 - DNA, 35 bp, Artificial Sequence
  Synthetic oligonucleotide
taacaccgacaacttcctgtaaaaccgctctgccc

SEQ ID NO: 136505 - DNA, 35 bp, Artificial Sequence
  Synthetic oligonucleotide
tactgtcgtgcaagatattgcacacgatccctttc

SEQ ID NO: 136506 - DNA, 35 bp, Artificial Sequence
  Synthetic oligonucleotide
aggacgcccgccatatatctccgctgttttgccct

SEQ ID NO: 136507 - DNA, 35 bp, Artificial Sequence
  Synthetic oligonucleotide
gctgcattcccctcgttcatagtcttagttccgct

SEQ ID NO: 136508 - DNA, 36 bp, Artificial Sequence
  Synthetic oligonucleotide
gcacatccgcttttcgtttttaactgtttcttgcca

SEQ ID NO: 136509 - DNA, 37 bp, Artificial Sequence
  Synthetic oligonucleotide
gaccactctgaccattgttttgtcccctccctttaga

SEQ ID NO: 136510 - DNA, 37 bp, Artificial Sequence
  Synthetic oligonucleotide
gtcgaccgcccgccctggaatagtgccatgcacccga

SEQ ID NO: 136511 - DNA, 35 bp, Artificial Sequence
  Synthetic oligonucleotide
tcgatcctgccgcctatgttccaaccaacgcccga

SEQ ID NO: 136512 - DNA, 37 bp, Artificial Sequence
  Synthetic oligonucleotide
gcaacctgcagtttccaacactccgccttttatccga

SEQ ID NO: 136513 - DNA, 37 bp, Artificial Sequence
  Synthetic oligonucleotide
gtctgcacaccgtttgcatctagccacctaccttcga

SEQ ID NO: 136514 - DNA, 36 bp, Artificial Sequence
  Synthetic oligonucleotide
gtggtccaacggggagaaggggtgagggcgggagga

SEQ ID NO: 136515 - DNA, 37 bp, Artificial Sequence
  Synthetic oligonucleotide
gacgcattttaggtgaggggaggggcatgggcgggga

SEQ ID NO: 136516 - DNA, 36 bp, Artificial Sequence
  Synthetic oligonucleotide
gggaggtttggtggcggggaataggacgggggtgga

SEQ ID NO: 136517 - DNA, 36 bp, Artificial Sequence
  Synthetic oligonucleotide
tctgtcctcgggtacttctctgtcttccatgcctga

SEQ ID NO: 136518 - DNA, 36 bp, Artificial Sequence
  Synthetic oligonucleotide
taacactgtggggggaaaaaggcgaaggggggctga

SEQ ID NO: 136519 - DNA, 36 bp, Artificial Sequence
  Synthetic oligonucleotide
acagtgccccgcctcccctgtacgttaacagtcgta

SEQ ID NO: 136520 - DNA, 36 bp, Artificial Sequence
  Synthetic oligonucleotide
gacgccctgccctcttggtctttaattaaccttgta

SEQ ID NO: 136521 - DNA, 36 bp, Artificial Sequence
  Synthetic oligonucleotide
gcaaccgccttcatcccgtgctgtagcttactctta

SEQ ID NO: 136522 - DNA, 36 bp, Artificial Sequence
  Synthetic oligonucleotide
tcatacgtgcgctgctttattgacccaccctgttta

SEQ ID NO: 136523 - DNA, 35 bp, Artificial Sequence
  Synthetic oligonucleotide
atgaccacaccccgagttgatcttctccgtgaacc

SEQ ID NO: 136524 - DNA, 35 bp, Artificial Sequence
  Synthetic oligonucleotide
tcacctccccccgactgtacatttgttgggatacc

SEQ ID NO: 136525 - DNA, 35 bp, Artificial Sequence
  Synthetic oligonucleotide
tccttactgccccgtcgttaacacccaccattgcc

SEQ ID NO: 136526 - DNA, 35 bp, Artificial Sequence
  Synthetic oligonucleotide
tccacctatcatgttccccctgtcccaagacaggc

SEQ ID NO: 136527 - DNA, 35 bp, Artificial Sequence
  Synthetic oligonucleotide
tcagtccactctgttgacattcactccttgccatc

SEQ ID NO: 136528 - DNA, 35 bp, Artificial Sequence
  Synthetic oligonucleotide
acgagcacaccgcggtattggaactcccctccctc

SEQ ID NO: 136529 - DNA, 35 bp, Artificial Sequence
  Synthetic oligonucleotide
tcccgttgattatccgccgccattgtaccactgtc

SEQ ID NO: 136530 - DNA, 35 bp, Artificial Sequence
  Synthetic oligonucleotide
tgtccagcctgccctccctgttttcgacttagtag

SEQ ID NO: 136531 - DNA, 35 bp, Artificial Sequence
  Synthetic oligonucleotide
accgtcgtggctttccctggttccccctgctgccg

SEQ ID NO: 136532 - DNA, 35 bp, Artificial Sequence
  Synthetic oligonucleotide
taagagggaagggtggcggggatgatctgcaaggg

SEQ ID NO: 136533 - DNA, 35 bp, Artificial Sequence
  Synthetic oligonucleotide
ggtggagtgggggggaaagtaggtaatccgcggtg

SEQ ID NO: 136534 - DNA, 35 bp, Artificial Sequence
  Synthetic oligonucleotide
tacatcccctgttggcttcatgctgatctcccgat

SEQ ID NO: 136535 - DNA, 35 bp, Artificial Sequence
  Synthetic oligonucleotide
gataaccccgacatgccctcatcttggagccccct

SEQ ID NO: 136536 - DNA, 35 bp, Artificial Sequence
  Synthetic oligonucleotide
gacgttccaccactctacgcgtttttcggacttct

SEQ ID NO: 136537 - DNA, 35 bp, Artificial Sequence
  Synthetic oligonucleotide
acgggtgctcacatgtcgctaccttcgcctcctgt

SEQ ID NO: 136538 - DNA, 35 bp, Artificial Sequence
  Synthetic oligonucleotide
gagtgtgagccgaggcaaaggggaggtggaggaaa

SEQ ID NO: 136539 - DNA, 36 bp, Artificial Sequence
  Synthetic oligonucleotide
gctccacccccttctggttagtgccaatactgtaca

SEQ ID NO: 136540 - DNA, 35 bp, Artificial Sequence
  Synthetic oligonucleotide
aactactgccactgaacatctgaccctacacgcca

SEQ ID NO: 136541 - DNA, 36 bp, Artificial Sequence
  Synthetic oligonucleotide
accgcccttccccttcacgtgcagatccgttcctca

SEQ ID NO: 136542 - DNA, 36 bp, Artificial Sequence
  Synthetic oligonucleotide
gaagtgcgcaggccccctcttagtctccagctctca

SEQ ID NO: 136543 - DNA, 35 bp, Artificial Sequence
  Synthetic oligonucleotide
ttcccgccaagtgctcgtactcggtcaccccttca

SEQ ID NO: 136544 - DNA, 37 bp, Artificial Sequence
  Synthetic oligonucleotide
gtcccccgccttcttgcctcgcttgccctttacgaga

SEQ ID NO: 136545 - DNA, 37 bp, Artificial Sequence
  Synthetic oligonucleotide
tgtcgagggtaggagcaaggggggcgaggtgtgcgga

SEQ ID NO: 136546 - DNA, 37 bp, Artificial Sequence
  Synthetic oligonucleotide
gaccctcggtgcatccgactcatcccctcccctgtga

SEQ ID NO: 136547 - DNA, 36 bp, Artificial Sequence
  Synthetic oligonucleotide
gcaacactgagtgttcccggcacttctcctcaccta

SEQ ID NO: 136548 - DNA, 35 bp, Artificial Sequence
  Synthetic oligonucleotide
tccctcacaccccatgccgagatcgtgaccctgta

SEQ ID NO: 136549 - DNA, 35 bp, Artificial Sequence
  Synthetic oligonucleotide
cccgacgtcctgtcgcttatgtcttttcgatccac

SEQ ID NO: 136550 - DNA, 35 bp, Artificial Sequence
  Synthetic oligonucleotide
gcacgccccctcgcagagcacacatccacccttac

SEQ ID NO: 136551 - DNA, 35 bp, Artificial Sequence
  Synthetic oligonucleotide
gaacgcaaaaggctgacctgctacccatctccgcc

SEQ ID NO: 136552 - DNA, 35 bp, Artificial Sequence
  Synthetic oligonucleotide
gccatcacgtagtgctgaccctcatgggacccctc

SEQ ID NO: 136553 - DNA, 35 bp, Artificial Sequence
  Synthetic oligonucleotide
gacgacggatgtctccactcgtatttttcctggtc

SEQ ID NO: 136554 - DNA, 35 bp, Artificial Sequence
  Synthetic oligonucleotide
gccaactcatcatcctgtcagcctccataccgttc

SEQ ID NO: 136555 - DNA, 35 bp, Artificial Sequence
  Synthetic oligonucleotide
agaagaagccaggacgagggtagggcgggcgaaag

SEQ ID NO: 136556 - DNA, 35 bp, Artificial Sequence
  Synthetic oligonucleotide
accccacacatgactcgttacctccggccatctcg

SEQ ID NO: 136557 - DNA, 35 bp, Artificial Sequence
  Synthetic oligonucleotide
gtgtcgcttactatctgcctccacagctgccctgg

SEQ ID NO: 136558 - DNA, 35 bp, Artificial Sequence
  Synthetic oligonucleotide
gcacccagacccatagccgccttcgagtccctact

SEQ ID NO: 136559 - DNA, 35 bp, Artificial Sequence
  Synthetic oligonucleotide
acaccgcgcctcgttatgcgtccgtttcggccctt

SEQ ID NO: 136560 - DNA, 36 bp, Artificial Sequence
  Synthetic oligonucleotide
gatccgccccttgtgtgttaccctcgtcagtatgca

SEQ ID NO: 136561 - DNA, 35 bp, Artificial Sequence
  Synthetic oligonucleotide
taccttcctctgttgctttcccaggtcaccattca

SEQ ID NO: 136562 - DNA, 37 bp, Artificial Sequence
  Synthetic oligonucleotide
ttcacctttctgcacccgtattatacctgccctacga

SEQ ID NO: 136563 - DNA, 37 bp, Artificial Sequence
  Synthetic oligonucleotide
ggggagagatcgggaggggacaataagcacgacggga

SEQ ID NO: 136564 - DNA, 37 bp, Artificial Sequence
  Synthetic oligonucleotide
gtctccgccctcgggtgccacacctcacatttttgga

SEQ ID NO: 136565 - DNA, 38 bp, Artificial Sequence
  Synthetic oligonucleotide
taaggtggggggggggagatttaggccggacggcctga

SEQ ID NO: 136566 - DNA, 35 bp, Artificial Sequence
  Synthetic oligonucleotide
gtgctcgacgcatcctactacagccgttccaccta

SEQ ID NO: 136567 - DNA, 36 bp, Artificial Sequence
  Synthetic oligonucleotide
gccactgcaccagcctccacgatacccgacccccta

SEQ ID NO: 136568 - DNA, 36 bp, Artificial Sequence
  Synthetic oligonucleotide
tcccctcaccactgtgcccactaccccccgttccta

SEQ ID NO: 136569 - DNA, 35 bp, Artificial Sequence
  Synthetic oligonucleotide
gtgaagccaccgttcgtgccatccacattccagta

SEQ ID NO: 136570 - DNA, 36 bp, Artificial Sequence
  Synthetic oligonucleotide
gtgagccactgatccctccctgtttccattcatgta

SEQ ID NO: 136571 - DNA, 35 bp, Artificial Sequence
  Synthetic oligonucleotide
acctccatcattctcgtgtgaacgccatacattac

SEQ ID NO: 136572 - DNA, 35 bp, Artificial Sequence
  Synthetic oligonucleotide
tgcaggttcacacatcgctttagtcgcgcgccacc

SEQ ID NO: 136573 - DNA, 35 bp, Artificial Sequence
  Synthetic oligonucleotide
actgcatacaccatatcctgctgctcgtccatcgc

SEQ ID NO: 136574 - DNA, 35 bp, Artificial Sequence
  Synthetic oligonucleotide
tacatcccatccggtgcttttttctcactcttcgc

SEQ ID NO: 136575 - DNA, 35 bp, Artificial Sequence
  Synthetic oligonucleotide
tctgtgcatcatcccgtctcctcgccccagactgc

SEQ ID NO: 136576 - DNA, 34 bp, Artificial Sequence
  Synthetic oligonucleotide
aacacccccagttgtcccacagcccactcctatc

SEQ ID NO: 136577 - DNA, 35 bp, Artificial Sequence
  Synthetic oligonucleotide
atcttgtcccgtcaggctgcaccacaacccgtctc

SEQ ID NO: 136578 - DNA, 35 bp, Artificial Sequence
  Synthetic oligonucleotide
ttgtggcccccgccctgacggctcgcccccccgtc

SEQ ID NO: 136579 - DNA, 35 bp, Artificial Sequence
  Synthetic oligonucleotide
tttgtgctgagcagactcgcctttccccccttgtc

SEQ ID NO: 136580 - DNA, 35 bp, Artificial Sequence
  Synthetic oligonucleotide
gatccgtacaatctcaccgtcacgctagtaatccg

SEQ ID NO: 136581 - DNA, 34 bp, Artificial Sequence
  Synthetic oligonucleotide
tttgcctgacctcctaccccgcgccctttaccgg

SEQ ID NO: 136582 - DNA, 35 bp, Artificial Sequence
  Synthetic oligonucleotide
gcctcgcgtcctccctgtcccgcccaatttccttg

SEQ ID NO: 136583 - DNA, 35 bp, Artificial Sequence
  Synthetic oligonucleotide
acacccgcccctcggatgctacccatttaactttg

SEQ ID NO: 136584 - DNA, 35 bp, Artificial Sequence
  Synthetic oligonucleotide
tggagcctccaatgcgcaggcaccaccactcttat

SEQ ID NO: 136585 - DNA, 35 bp, Artificial Sequence
  Synthetic oligonucleotide
actgtggccacgacggtaggacacagcctcttact

SEQ ID NO: 136586 - DNA, 35 bp, Artificial Sequence
  Synthetic oligonucleotide
tcaaccgacctcatattgaagcactgcatgcccct

SEQ ID NO: 136587 - DNA, 35 bp, Artificial Sequence
  Synthetic oligonucleotide
gtttgccacacctgctcccccccgtttggggctct

SEQ ID NO: 136588 - DNA, 35 bp, Artificial Sequence
  Synthetic oligonucleotide
gcgatctcccctccgctcccatccttaagacttct

SEQ ID NO: 136589 - DNA, 35 bp, Artificial Sequence
  Synthetic oligonucleotide
tatgccctgccctcgtcctgttcgccaccacgttt

SEQ ID NO: 136590 - DNA, 35 bp, Artificial Sequence
  Synthetic oligonucleotide
gcgaggtagctcggtcttgtcctgtcctctcgttt

SEQ ID NO: 136591 - DNA, 36 bp, Artificial Sequence
  Synthetic oligonucleotide
gtttggagccggggacgagggggggagtacaccaaa

SEQ ID NO: 136592 - DNA, 36 bp, Artificial Sequence
  Synthetic oligonucleotide
gcatcccgccctgactcgcacccacctaccgtggaa

SEQ ID NO: 136593 - DNA, 36 bp, Artificial Sequence
  Synthetic oligonucleotide
gctgagggagagaaggatggggcgacgtattatgaa

SEQ ID NO: 136594 - DNA, 36 bp, Artificial Sequence
  Synthetic oligonucleotide
gaccgccacaagcccccgacaaccctccagtgaaca

SEQ ID NO: 136595 - DNA, 36 bp, Artificial Sequence
  Synthetic oligonucleotide
gtgactcgcggatagtaacggttaccgcccctccca

SEQ ID NO: 136596 - DNA, 36 bp, Artificial Sequence
  Synthetic oligonucleotide
tatgaacccccgctgttgtacttccctaatttgcca

SEQ ID NO: 136597 - DNA, 36 bp, Artificial Sequence
  Synthetic oligonucleotide
acattcattgccagatcgtccgtccacctccctgca

SEQ ID NO: 136598 - DNA, 36 bp, Artificial Sequence
  Synthetic oligonucleotide
gacgctccatgtgccgcctacccctgatctatctca

SEQ ID NO: 136599 - DNA, 36 bp, Artificial Sequence
  Synthetic oligonucleotide
ttccccttgtgctcctgttccatatgtccactttca

SEQ ID NO: 136600 - DNA, 37 bp, Artificial Sequence
  Synthetic oligonucleotide
agacggggagggaggggggtggaggaccccaaggaga

SEQ ID NO: 136601 - DNA, 35 bp, Artificial Sequence
  Synthetic oligonucleotide
accatggggaggaggggaagcaagggggggaagga

SEQ ID NO: 136602 - DNA, 36 bp, Artificial Sequence
  Synthetic oligonucleotide
tagtcagccgagaccatacaggtgggaggggcggga

SEQ ID NO: 136603 - DNA, 36 bp, Artificial Sequence
  Synthetic oligonucleotide
agcaagggaggaggggtgctatatgaaaatggggga

SEQ ID NO: 136604 - DNA, 38 bp, Artificial Sequence
  Synthetic oligonucleotide
accgttccgcctcccccttgtacctatgccacatatga

SEQ ID NO: 136605 - DNA, 37 bp, Artificial Sequence
  Synthetic oligonucleotide
tacctctgtctggtcctgtttccttagccctctctga

SEQ ID NO: 136606 - DNA, 38 bp, Artificial Sequence
  Synthetic oligonucleotide
aaccgaggaggagggaatgaggaaagggatactattga

SEQ ID NO: 136607 - DNA, 35 bp, Artificial Sequence
  Synthetic oligonucleotide
tactgccgaatagggagggaaggacggggtggata

SEQ ID NO: 136608 - DNA, 36 bp, Artificial Sequence
  Synthetic oligonucleotide
tcacacaagggagggcgggcttgaagagggagagta

SEQ ID NO: 136609 - DNA, 35 bp, Artificial Sequence
  Synthetic oligonucleotide
ttcacccttacgaatgctggaggcccccatactac

SEQ ID NO: 136610 - DNA, 35 bp, Artificial Sequence
  Synthetic oligonucleotide
gggggcagtagaatgggcggggctcggggtctacc

SEQ ID NO: 136611 - DNA, 35 bp, Artificial Sequence
  Synthetic oligonucleotide
gcctgaacttccgtcgcgaactgagctcctatccc

SEQ ID NO: 136612 - DNA, 35 bp, Artificial Sequence
  Synthetic oligonucleotide
gatcccgccctcactaggtcagccttggccctccc

SEQ ID NO: 136613 - DNA, 35 bp, Artificial Sequence
  Synthetic oligonucleotide
ggatcatcgccctacacgtcgtccgtgacccgctc

SEQ ID NO: 136614 - DNA, 35 bp, Artificial Sequence
  Synthetic oligonucleotide
gagaggtgggatgcaagtgaaggggtggagaatcg

SEQ ID NO: 136615 - DNA, 35 bp, Artificial Sequence
  Synthetic oligonucleotide
tcgacgtccgctgattaccttttacctcccgtctg

SEQ ID NO: 136616 - DNA, 35 bp, Artificial Sequence
  Synthetic oligonucleotide
actcactcgccctgttttatgtttcacggtcccct

SEQ ID NO: 136617 - DNA, 35 bp, Artificial Sequence
  Synthetic oligonucleotide
gtgggtccgtaccgccctcttcaagtgtccatcct

SEQ ID NO: 136618 - DNA, 35 bp, Artificial Sequence
  Synthetic oligonucleotide
acttggcccgccgatccatcttttgcttcacacgt

SEQ ID NO: 136619 - DNA, 35 bp, Artificial Sequence
  Synthetic oligonucleotide
tagccccaaccctttgatgcctccttcgttccggt

SEQ ID NO: 136620 - DNA, 35 bp, Artificial Sequence
  Synthetic oligonucleotide
agacctgcctgtgctcacctgcctcctcgaattgt

SEQ ID NO: 136621 - DNA, 35 bp, Artificial Sequence
  Synthetic oligonucleotide
gtgacgtccgccccccatccttccaacggcgcctt

SEQ ID NO: 136622 - DNA, 35 bp, Artificial Sequence
  Synthetic oligonucleotide
gtcttgcaacctgtgcccctccccgttccctggtt

SEQ ID NO: 136623 - DNA, 36 bp, Artificial Sequence
  Synthetic oligonucleotide
gaggaggggaaggataatacaatatacggtcggcaa

SEQ ID NO: 136624 - DNA, 34 bp, Artificial Sequence
  Synthetic oligonucleotide
gagaccgggcagggtaacacagggatgaagggaa

SEQ ID NO: 136625 - DNA, 36 bp, Artificial Sequence
  Synthetic oligonucleotide
tggtaacgcgcatgtcttccctcggtcacgctccca

SEQ ID NO: 136626 - DNA, 36 bp, Artificial Sequence
  Synthetic oligonucleotide
ccatgcaccggtttcacttgtctagcttggcctcca

SEQ ID NO: 136627 - DNA, 36 bp, Artificial Sequence
  Synthetic oligonucleotide
tacttcccccgtgctcgacagtcccccgccccgtca

SEQ ID NO: 136628 - DNA, 35 bp, Artificial Sequence
  Synthetic oligonucleotide
gactccgccatatgccaccctccggctgaacttca

SEQ ID NO: 136629 - DNA, 36 bp, Artificial Sequence
  Synthetic oligonucleotide
atcagtccgacaccgccgttaccgcgactcctttca

SEQ ID NO: 136630 - DNA, 37 bp, Artificial Sequence
  Synthetic oligonucleotide
tcaggccatctcgctctcatccgtcatttcaattcga

SEQ ID NO: 136631 - DNA, 37 bp, Artificial Sequence
  Synthetic oligonucleotide
tcgagtggggagtcgactaggaaaagggaggaacgga

SEQ ID NO: 136632 - DNA, 37 bp, Artificial Sequence
  Synthetic oligonucleotide
ttagcgtctgtgcgcaacttaccacccctgccccgga

SEQ ID NO: 136633 - DNA, 37 bp, Artificial Sequence
  Synthetic oligonucleotide
tctaacccatccgcctttacacccgtctcctccggga

SEQ ID NO: 136634 - DNA, 35 bp, Artificial Sequence
  Synthetic oligonucleotide
tcacacgctcggctcgccgccacccccacaactga

SEQ ID NO: 136635 - DNA, 38 bp, Artificial Sequence
  Synthetic oligonucleotide
gccccccgatccctcctgccgcagtccctctgagctga

SEQ ID NO: 136636 - DNA, 38 bp, Artificial Sequence
  Synthetic oligonucleotide
gcccccccccacaggtgtaattgcacctactcttctga

SEQ ID NO: 136637 - DNA, 37 bp, Artificial Sequence
  Synthetic oligonucleotide
tccgacaacccagccgccgcgttaaacccatccttga

SEQ ID NO: 136638 - DNA, 38 bp, Artificial Sequence
  Synthetic oligonucleotide
gtgccacgtctcgtccgcctatgcttcgccgcctttga

SEQ ID NO: 136639 - DNA, 36 bp, Artificial Sequence
  Synthetic oligonucleotide
gaatgatgggcaggggctcgggcgggataccattta

SEQ ID NO: 136640 - DNA, 35 bp, Artificial Sequence
  Synthetic oligonucleotide
gctcgccctccgctcttagagcaatcgtgccatcc

SEQ ID NO: 136641 - DNA, 35 bp, Artificial Sequence
  Synthetic oligonucleotide
gatgggcgactcgactgcttttttggcgatcctcc

SEQ ID NO: 136642 - DNA, 35 bp, Artificial Sequence
  Synthetic oligonucleotide
tcaacccagcgctcactctccgcccccgcccccgc

SEQ ID NO: 136643 - DNA, 35 bp, Artificial Sequence
  Synthetic oligonucleotide
gacgagactttcgaacgccgccaccctatgcccgc

SEQ ID NO: 136644 - DNA, 35 bp, Artificial Sequence
  Synthetic oligonucleotide
agtcccatctgtttcctgcgctccagtccagccgc

SEQ ID NO: 136645 - DNA, 35 bp, Artificial Sequence
  Synthetic oligonucleotide
acgagcagactgcctctaccgtgactcccttgcgc

SEQ ID NO: 136646 - DNA, 35 bp, Artificial Sequence
  Synthetic oligonucleotide
gactcagtatgatgggtacccccctcgcccttcgc

SEQ ID NO: 136647 - DNA, 35 bp, Artificial Sequence
  Synthetic oligonucleotide
aaccattgcccggtcttgccttcgttcaacacctc

SEQ ID NO: 136648 - DNA, 35 bp, Artificial Sequence
  Synthetic oligonucleotide
tgactgccagcgtataattcacccccatgtcgccg

SEQ ID NO: 136649 - DNA, 35 bp, Artificial Sequence
  Synthetic oligonucleotide
tagtgatcagctggtcgttcttcaatgcttctcct

SEQ ID NO: 136650 - DNA, 35 bp, Artificial Sequence
  Synthetic oligonucleotide
gtgtcaacggtccttggtactttcgcattcaccca

SEQ ID NO: 136651 - DNA, 35 bp, Artificial Sequence
  Synthetic oligonucleotide
gcgacactcctgcccgtacggttcatacttgtcca

SEQ ID NO: 136652 - DNA, 36 bp, Artificial Sequence
  Synthetic oligonucleotide
tgcacctacgtgcgtgccccatcactacttccctca

SEQ ID NO: 136653 - DNA, 37 bp, Artificial Sequence
  Synthetic oligonucleotide
gatactagaccggaggagggtggggagggacgtgaga

SEQ ID NO: 136654 - DNA, 37 bp, Artificial Sequence
  Synthetic oligonucleotide
ttaccatcgcgcgtcgtttcccatgtttctgctccga

SEQ ID NO: 136655 - DNA, 36 bp, Artificial Sequence
  Synthetic oligonucleotide
gtccccgcatcccctgtcctttccctgagcccccta

SEQ ID NO: 136656 - DNA, 36 bp, Artificial Sequence
  Synthetic oligonucleotide
gatgggcgggttcgggcttatgtattttgggtccta

SEQ ID NO: 136657 - DNA, 36 bp, Artificial Sequence
  Synthetic oligonucleotide
tcggagggggggggcaaaggggcatgggaaaggcta

SEQ ID NO: 136658 - DNA, 35 bp, Artificial Sequence
  Synthetic oligonucleotide
atgacgaaccggcctcctgctctcagtacacacac

SEQ ID NO: 136659 - DNA, 35 bp, Artificial Sequence
  Synthetic oligonucleotide
tacgcccgcaattgcagatttcctctccgcgccac

SEQ ID NO: 136660 - DNA, 35 bp, Artificial Sequence
  Synthetic oligonucleotide
actgaccaccacccctggctttgcttaaagtagac

SEQ ID NO: 136661 - DNA, 34 bp, Artificial Sequence
  Synthetic oligonucleotide
tggtccacccgcattctactcccctctatggtac

SEQ ID NO: 136662 - DNA, 35 bp, Artificial Sequence
  Synthetic oligonucleotide
gcctgccacgattgctgcacgttctcgcttgcccc

SEQ ID NO: 136663 - DNA, 35 bp, Artificial Sequence
  Synthetic oligonucleotide
tcactggtatcattccggccctgtttttcctgccc

SEQ ID NO: 136664 - DNA, 35 bp, Artificial Sequence
  Synthetic oligonucleotide
tgtaatccgatagctggcctgttcacctgtctccc

SEQ ID NO: 136665 - DNA, 35 bp, Artificial Sequence
  Synthetic oligonucleotide
gttcaaccgttccctgcccgatctagtccattatc

SEQ ID NO: 136666 - DNA, 35 bp, Artificial Sequence
  Synthetic oligonucleotide
gcccccaagatgtaccggccattcctccccccctc

SEQ ID NO: 136667 - DNA, 35 bp, Artificial Sequence
  Synthetic oligonucleotide
aatgatggtaggagagggtagggcgacggttgggg

SEQ ID NO: 136668 - DNA, 35 bp, Artificial Sequence
  Synthetic oligonucleotide
acacaacctgccctccctcgcttgtttcgtgacct

SEQ ID NO: 136669 - DNA, 35 bp, Artificial Sequence
  Synthetic oligonucleotide
tctgcctgccaggcttctcgattcgtactccccct

SEQ ID NO: 136670 - DNA, 35 bp, Artificial Sequence
  Synthetic oligonucleotide
gtgctcccgcgcacgctccctcgctttctgttgct

SEQ ID NO: 136671 - DNA, 35 bp, Artificial Sequence
  Synthetic oligonucleotide
atggctggtacatgtcctttcgatcctgctcctgt

SEQ ID NO: 136672 - DNA, 35 bp, Artificial Sequence
  Synthetic oligonucleotide
aaggggaagatacgggtggggcaaattcggggtgt

SEQ ID NO: 136673 - DNA, 35 bp, Artificial Sequence
  Synthetic oligonucleotide
accccacgtaccatctagcatccgggccgcccaaa

SEQ ID NO: 136674 - DNA, 36 bp, Artificial Sequence
  Synthetic oligonucleotide
tctgttccaccgtccccgtcctatgccacccggcaa

SEQ ID NO: 136675 - DNA, 35 bp, Artificial Sequence
  Synthetic oligonucleotide
gccccccacacgcttcgcatatgatcgccccttaa

SEQ ID NO: 136676 - DNA, 35 bp, Artificial Sequence
  Synthetic oligonucleotide
atcgagctaagcctccctctgttcctaacgcacca

SEQ ID NO: 136677 - DNA, 36 bp, Artificial Sequence
  Synthetic oligonucleotide
gatgcgcccctctatctccgctgtctatgggtccca

SEQ ID NO: 136678 - DNA, 36 bp, Artificial Sequence
  Synthetic oligonucleotide
acaggtcgtggtcatctgtatccccccccgcctcca

SEQ ID NO: 136679 - DNA, 36 bp, Artificial Sequence
  Synthetic oligonucleotide
tcaaccagccgttattcctaccattctgccgttcca

SEQ ID NO: 136680 - DNA, 35 bp, Artificial Sequence
  Synthetic oligonucleotide
tgacattgcgggcggtgggggtgggacttcgcgca

SEQ ID NO: 136681 - DNA, 35 bp, Artificial Sequence
  Synthetic oligonucleotide
ggggtgaacgggggtgcggagcagggttaggcaga

SEQ ID NO: 136682 - DNA, 37 bp, Artificial Sequence
  Synthetic oligonucleotide
taaccccctccgcatgacccgccaagaacaggcacga

SEQ ID NO: 136683 - DNA, 37 bp, Artificial Sequence
  Synthetic oligonucleotide
tcccaccacacagcatctggccatgcaatccccccga

SEQ ID NO: 136684 - DNA, 36 bp, Artificial Sequence
  Synthetic oligonucleotide
agccccatagtgaccccgcctccgctgcctctccga

SEQ ID NO: 136685 - DNA, 37 bp, Artificial Sequence
  Synthetic oligonucleotide
gcaacccctggctatctgttttctgcgctccgtgcga

SEQ ID NO: 136686 - DNA, 35 bp, Artificial Sequence
  Synthetic oligonucleotide
gaaagaagggggcaggggtgaaagaaggaggcgga

SEQ ID NO: 136687 - DNA, 36 bp, Artificial Sequence
  Synthetic oligonucleotide
acttgggccaagggggtggtggggttgatgggcgga

SEQ ID NO: 136688 - DNA, 36 bp, Artificial Sequence
  Synthetic oligonucleotide
gtccaccccacgccttctcaatgttcaccacaggga

SEQ ID NO: 136689 - DNA, 38 bp, Artificial Sequence
  Synthetic oligonucleotide
ggtcctcctccagttgtcatcttgctccttccgcctga

SEQ ID NO: 136690 - DNA, 38 bp, Artificial Sequence
  Synthetic oligonucleotide
taagggaaggagggaaggcggaggagaaagacaggtga

SEQ ID NO: 136691 - DNA, 36 bp, Artificial Sequence
  Synthetic oligonucleotide
tccgtgccctcttccgctcgatctctaaagatccta

SEQ ID NO: 136692 - DNA, 35 bp, Artificial Sequence
  Synthetic oligonucleotide
cttaccaccgttactgaagctacctttgttctcta

SEQ ID NO: 136693 - DNA, 34 bp, Artificial Sequence
  Synthetic oligonucleotide
tcccccgcccgtaatttctgttcacgaatagcac

SEQ ID NO: 136694 - DNA, 35 bp, Artificial Sequence
  Synthetic oligonucleotide
atgcctgctacacgtgtcccttactatccaccacc

SEQ ID NO: 136695 - DNA, 35 bp, Artificial Sequence
  Synthetic oligonucleotide
actcccgccataaccgatctggtctttcctgaccc

SEQ ID NO: 136696 - DNA, 35 bp, Artificial Sequence
  Synthetic oligonucleotide
tccacatcctcactgcacagacctcagccccgtcc

SEQ ID NO: 136697 - DNA, 35 bp, Artificial Sequence
  Synthetic oligonucleotide
tccaccgctcggcctgtccataccgtacttcgtcc

SEQ ID NO: 136698 - DNA, 35 bp, Artificial Sequence
  Synthetic oligonucleotide
tacctcacctttacgtgctcgcttgccttctcatc

SEQ ID NO: 136699 - DNA, 35 bp, Artificial Sequence
  Synthetic oligonucleotide
tataccccgcagccattttgcccgattcgcctatc

SEQ ID NO: 136700 - DNA, 34 bp, Artificial Sequence
  Synthetic oligonucleotide
taaccccccgtagctgccccacatctgtcctttc

SEQ ID NO: 136701 - DNA, 35 bp, Artificial Sequence
  Synthetic oligonucleotide
tgttgcaggcgtcattgccctgcgccccgtccccg

SEQ ID NO: 136702 - DNA, 35 bp, Artificial Sequence
  Synthetic oligonucleotide
ggcccctcaccaagccaacacgacccctctccgcg

SEQ ID NO: 136703 - DNA, 35 bp, Artificial Sequence
  Synthetic oligonucleotide
ggtgcgctagtgccctcatttccaccctcgttgcg

SEQ ID NO: 136704 - DNA, 36 bp, Artificial Sequence
  Synthetic oligonucleotide
gagcggaaagcgggaggggagggatgctagcgcagg

SEQ ID NO: 136705 - DNA, 35 bp, Artificial Sequence
  Synthetic oligonucleotide
gtaggtggaggtgccggggggagagaagggcgagg

SEQ ID NO: 136706 - DNA, 35 bp, Artificial Sequence
  Synthetic oligonucleotide
gtaacccatcgcccccgttagcagagcaacttctg

SEQ ID NO: 136707 - DNA, 35 bp, Artificial Sequence
  Synthetic oligonucleotide
gaccaccccccattatcggttagaccatcgaacct

SEQ ID NO: 136708 - DNA, 35 bp, Artificial Sequence
  Synthetic oligonucleotide
attgccgacctggtcttccttctttgcctttgcct

SEQ ID NO: 136709 - DNA, 35 bp, Artificial Sequence
  Synthetic oligonucleotide
ttgccggactcgactttcttcagccagttacctct

SEQ ID NO: 136710 - DNA, 35 bp, Artificial Sequence
  Synthetic oligonucleotide
gggacacggctttcggtcccgctctgtccctctct

SEQ ID NO: 136711 - DNA, 35 bp, Artificial Sequence
  Synthetic oligonucleotide
gcccctccaggccggtctcggacgctatcttcctt

SEQ ID NO: 136712 - DNA, 35 bp, Artificial Sequence
  Synthetic oligonucleotide
ttagccacccttggctcttagattcctgttctaca

SEQ ID NO: 136713 - DNA, 37 bp, Artificial Sequence
  Synthetic oligonucleotide
tgacatcccgcctcttcttttttgctacacactacga

SEQ ID NO: 136714 - DNA, 35 bp, Artificial Sequence
  Synthetic oligonucleotide
tgcggaatcctagcctgttcatccctctccatcga

SEQ ID NO: 136715 - DNA, 38 bp, Artificial Sequence
  Synthetic oligonucleotide
ggatgagggtaagggggaacaggaggcgggctgagtga

SEQ ID NO: 136716 - DNA, 38 bp, Artificial Sequence
  Synthetic oligonucleotide
gtcaccacatccctgcctcagttgctacgctgccttga

SEQ ID NO: 136717 - DNA, 35 bp, Artificial Sequence
  Synthetic oligonucleotide
gaaagtaggagtgggggtagggagtgcgggagata

SEQ ID NO: 136718 - DNA, 36 bp, Artificial Sequence
  Synthetic oligonucleotide
atgggagggaaggggtgtggctagaggagggggata

SEQ ID NO: 136719 - DNA, 35 bp, Artificial Sequence
  Synthetic oligonucleotide
actcacccccatgtcgacatctgttggcttatcac

SEQ ID NO: 136720 - DNA, 35 bp, Artificial Sequence
  Synthetic oligonucleotide
gagccttgacccctgtgcgacgctattctgttcac

SEQ ID NO: 136721 - DNA, 35 bp, Artificial Sequence
  Synthetic oligonucleotide
ggtcacggaggggaaacgggggaccggaaggcgac

SEQ ID NO: 136722 - DNA, 35 bp, Artificial Sequence
  Synthetic oligonucleotide
ccctggcccccctccctgtctggactgatccatac

SEQ ID NO: 136723 - DNA, 35 bp, Artificial Sequence
  Synthetic oligonucleotide
tactccttgccacccattctttctcgggactgtgc

SEQ ID NO: 136724 - DNA, 35 bp, Artificial Sequence
  Synthetic oligonucleotide
acgacatccctaggtacccccccatccccgtactg

SEQ ID NO: 136725 - DNA, 35 bp, Artificial Sequence
  Synthetic oligonucleotide
acaaccggcctgaatcccatccgcattgccccttg

SEQ ID NO: 136726 - DNA, 35 bp, Artificial Sequence
  Synthetic oligonucleotide
ggggtgaagggggtagcagtcgggaggggagttat

SEQ ID NO: 136727 - DNA, 35 bp, Artificial Sequence
  Synthetic oligonucleotide
attgatccgcccccttgctgagcgcactgttccct

SEQ ID NO: 136728 - DNA, 35 bp, Artificial Sequence
  Synthetic oligonucleotide
accgtcctcgtcccgtgccgcttagcccccgctct

SEQ ID NO: 136729 - DNA, 36 bp, Artificial Sequence
  Synthetic oligonucleotide
gcaccatccttccaccttgcataacgcctgccggaa

SEQ ID NO: 136730 - DNA, 36 bp, Artificial Sequence
  Synthetic oligonucleotide
gtccactcttctcctgttctaatgtgtcctcgcaca

SEQ ID NO: 136731 - DNA, 36 bp, Artificial Sequence
  Synthetic oligonucleotide
tccctgcctccttccattagctgatttcgtttcaca

SEQ ID NO: 136732 - DNA, 35 bp, Artificial Sequence
  Synthetic oligonucleotide
actgctccgcccatcttggttcaaagtcgccttca

SEQ ID NO: 136733 - DNA, 37 bp, Artificial Sequence
  Synthetic oligonucleotide
gacatctaccgctcgcctcgccctgtcaccatttaga

SEQ ID NO: 136734 - DNA, 37 bp, Artificial Sequence
  Synthetic oligonucleotide
tatcgcagtcgatggactatcaccaccccgctctcga

SEQ ID NO: 136735 - DNA, 35 bp, Artificial Sequence
  Synthetic oligonucleotide
gcccccatgccttcctgcttttaccgttattcgga

SEQ ID NO: 136736 - DNA, 37 bp, Artificial Sequence
  Synthetic oligonucleotide
atccgtcatagcgcccccatcccatgctctcttcgga

SEQ ID NO: 136737 - DNA, 37 bp, Artificial Sequence
  Synthetic oligonucleotide
acgacggtcgtccttcgtccttcgtgccacaccctga

SEQ ID NO: 136738 - DNA, 38 bp, Artificial Sequence
  Synthetic oligonucleotide
gtcatctctgcattcccccgtctgtcatgcctccctga

SEQ ID NO: 136739 - DNA, 37 bp, Artificial Sequence
  Synthetic oligonucleotide
gcgtttctgcgccctcctgctacgtgccacttcctga

SEQ ID NO: 136740 - DNA, 37 bp, Artificial Sequence
  Synthetic oligonucleotide
tccgccagatgtccgcggcgctctctccaccatctga

SEQ ID NO: 136741 - DNA, 37 bp, Artificial Sequence
  Synthetic oligonucleotide
gcgccgttcgcccagcttatactttctgcctctttga

SEQ ID NO: 136742 - DNA, 36 bp, Artificial Sequence
  Synthetic oligonucleotide
gcacaggccgggcagggagggtagcgctgggacata

SEQ ID NO: 136743 - DNA, 35 bp, Artificial Sequence
  Synthetic oligonucleotide
tttgagccccgcggtcgtttgtcggtcttctccac

SEQ ID NO: 136744 - DNA, 35 bp, Artificial Sequence
  Synthetic oligonucleotide
acattcattcgcttgatcttctagtgccacttacc

SEQ ID NO: 136745 - DNA, 35 bp, Artificial Sequence
  Synthetic oligonucleotide
gtaccaacgccggtaccatcccactccctgcctcc

SEQ ID NO: 136746 - DNA, 35 bp, Artificial Sequence
  Synthetic oligonucleotide
gagcggggttggtaccacggccgttcactctttcc

SEQ ID NO: 136747 - DNA, 35 bp, Artificial Sequence
  Synthetic oligonucleotide
tactccggcaatatgtacactgctcccccgtccgc

SEQ ID NO: 136748 - DNA, 35 bp, Artificial Sequence
  Synthetic oligonucleotide
tacatcggagcgatacttcctgcgcccttagcctc

SEQ ID NO: 136749 - DNA, 35 bp, Artificial Sequence
  Synthetic oligonucleotide
ggatccttccctgtcgcataaaaatggtctcgctc

SEQ ID NO: 136750 - DNA, 35 bp, Artificial Sequence
  Synthetic oligonucleotide
tgagcagatgggatgtcgggagggggggctcttgg

SEQ ID NO: 136751 - DNA, 35 bp, Artificial Sequence
  Synthetic oligonucleotide
tgctcccacaacgcaccaacttcgccatccccctg

SEQ ID NO: 136752 - DNA, 35 bp, Artificial Sequence
  Synthetic oligonucleotide
attcccggccaatgttgtcctctttctgtccccat

SEQ ID NO: 136753 - DNA, 35 bp, Artificial Sequence
  Synthetic oligonucleotide
gccttcccgcccatctgccttccactagcctggat

SEQ ID NO: 136754 - DNA, 35 bp, Artificial Sequence
  Synthetic oligonucleotide
tcttcatcaccgcctcgacttcgcgaatatactat

SEQ ID NO: 136755 - DNA, 35 bp, Artificial Sequence
  Synthetic oligonucleotide
gacgtggtcgtctttgtcccctgtaccaaccatct

SEQ ID NO: 136756 - DNA, 35 bp, Artificial Sequence
  Synthetic oligonucleotide
atgccgcagtgcgcactccacgatctgctttactt

SEQ ID NO: 136757 - DNA, 35 bp, Artificial Sequence
  Synthetic oligonucleotide
aacgcgcgctatgcactctcatacctggctccctt

SEQ ID NO: 136758 - DNA, 36 bp, Artificial Sequence
  Synthetic oligonucleotide
tactatcctcctcgtgcgtatgcatttcctggtcca

SEQ ID NO: 136759 - DNA, 36 bp, Artificial Sequence
  Synthetic oligonucleotide
gagcatgtcacgcgtattgctcttcatcctccgtca

SEQ ID NO: 136760 - DNA, 36 bp, Artificial Sequence
  Synthetic oligonucleotide
tgctaaccctgtgttcgtgtccgtctcgccttttca

SEQ ID NO: 136761 - DNA, 37 bp, Artificial Sequence
  Synthetic oligonucleotide
gaggggagagggacgcaaggggaagcgagagtcaaga

SEQ ID NO: 136762 - DNA, 35 bp, Artificial Sequence
  Synthetic oligonucleotide
tagagggaggtggattagggggccgttgtggtgga

SEQ ID NO: 136763 - DNA, 36 bp, Artificial Sequence
  Synthetic oligonucleotide
tcactccccagatcgcagtacctgttccttctatga

SEQ ID NO: 136764 - DNA, 35 bp, Artificial Sequence
  Synthetic oligonucleotide
acgacttagcccatgcacctccgttttttcgctga

SEQ ID NO: 136765 - DNA, 38 bp, Artificial Sequence
  Synthetic oligonucleotide
gcatgcgcgtaggagggagtaggggggggaacggctga

SEQ ID NO: 136766 - DNA, 35 bp, Artificial Sequence
  Synthetic oligonucleotide
taacgcccggtgccgccttctattccctttgctga

SEQ ID NO: 136767 - DNA, 38 bp, Artificial Sequence
  Synthetic oligonucleotide
gaactcacctcctggcctgtactttgacactcttgtga

SEQ ID NO: 136768 - DNA, 37 bp, Artificial Sequence
  Synthetic oligonucleotide
tgccgccgccccctccgcagtacttagtacccattga

SEQ ID NO: 136769 - DNA, 35 bp, Artificial Sequence
  Synthetic oligonucleotide
gtcgccccccgtttcgctttttccagattgcacta

SEQ ID NO: 136770 - DNA, 36 bp, Artificial Sequence
  Synthetic oligonucleotide
tgtcgtccgactccgtttttcgctcacctgtaccta

SEQ ID NO: 136771 - DNA, 36 bp, Artificial Sequence
  Synthetic oligonucleotide
ttacggtaccacccgtgctttcttctccaccctgta

SEQ ID NO: 136772 - DNA, 35 bp, Artificial Sequence
  Synthetic oligonucleotide
tgtcacgccctccccagcgttcccgataccttaac

SEQ ID NO: 136773 - DNA, 35 bp, Artificial Sequence
  Synthetic oligonucleotide
tccctacgactcacatcactatattctggatccac

SEQ ID NO: 136774 - DNA, 35 bp, Artificial Sequence
  Synthetic oligonucleotide
gactcgggttgggtggggcagggctactccactac

SEQ ID NO: 136775 - DNA, 35 bp, Artificial Sequence
  Synthetic oligonucleotide
gtcatcacctgccgatactccacttttggttcacc

SEQ ID NO: 136776 - DNA, 35 bp, Artificial Sequence
  Synthetic oligonucleotide
tcaagcccatacgtacacggcccttccgttctgcc

SEQ ID NO: 136777 - DNA, 35 bp, Artificial Sequence
  Synthetic oligonucleotide
acctagccgcacctatccgttcaacccggccctcc

SEQ ID NO: 136778 - DNA, 35 bp, Artificial Sequence
  Synthetic oligonucleotide
gtgcccctacggacgctcatgcactatcactacgc

SEQ ID NO: 136779 - DNA, 35 bp, Artificial Sequence
  Synthetic oligonucleotide
gtgccttccctgtttacctcgccctctgcggtcgc

SEQ ID NO: 136780 - DNA, 35 bp, Artificial Sequence
  Synthetic oligonucleotide
ggtcaaaccaatggtacccgtcccttctgttcctc

SEQ ID NO: 136781 - DNA, 35 bp, Artificial Sequence
  Synthetic oligonucleotide
gcccatgtgggcgggcttatattccatctttcctc

SEQ ID NO: 136782 - DNA, 35 bp, Artificial Sequence
  Synthetic oligonucleotide
ggacgagtgcgagtgcatgcctttctgtccctgtc

SEQ ID NO: 136783 - DNA, 35 bp, Artificial Sequence
  Synthetic oligonucleotide
tccctcccgacgtatatggcactccttcttacacg

SEQ ID NO: 136784 - DNA, 35 bp, Artificial Sequence
  Synthetic oligonucleotide
acgtcaacatgatgccgttctttcctccctacccg

SEQ ID NO: 136785 - DNA, 35 bp, Artificial Sequence
  Synthetic oligonucleotide
aacaagcattgcgctccctctgtcttacatcctcg

SEQ ID NO: 136786 - DNA, 35 bp, Artificial Sequence
  Synthetic oligonucleotide
aacaccgacatccgacctctcgttcttgcacttcg

SEQ ID NO: 136787 - DNA, 35 bp, Artificial Sequence
  Synthetic oligonucleotide
tgccaccgcactgttaccggctccctcctatactg

SEQ ID NO: 136788 - DNA, 35 bp, Artificial Sequence
  Synthetic oligonucleotide
acgccctcactaatatcgtcttcgcccgcctcttg

SEQ ID NO: 136789 - DNA, 35 bp, Artificial Sequence
  Synthetic oligonucleotide
tctcatctcgcatcccgcctcgacccgttattact

SEQ ID NO: 136790 - DNA, 35 bp, Artificial Sequence
  Synthetic oligonucleotide
atgctacggggtccttggtgggaggggggggagtt

SEQ ID NO: 136791 - DNA, 36 bp, Artificial Sequence
  Synthetic oligonucleotide
tcccccagccgtcctttgcttatcttgtcactcgaa

SEQ ID NO: 136792 - DNA, 36 bp, Artificial Sequence
  Synthetic oligonucleotide
tccagggcggggcggagaggggaccaagggtatgaa

SEQ ID NO: 136793 - DNA, 36 bp, Artificial Sequence
  Synthetic oligonucleotide
gatccgagcgcctgtacctctcctcctgtttacgca

SEQ ID NO: 136794 - DNA, 36 bp, Artificial Sequence
  Synthetic oligonucleotide
atgaccgcctcttctgcccccagcgctgctccatca

SEQ ID NO: 136795 - DNA, 36 bp, Artificial Sequence
  Synthetic oligonucleotide
gacatgacttccgcacaccgttccatccgttactca

SEQ ID NO: 136796 - DNA, 36 bp, Artificial Sequence
  Synthetic oligonucleotide
acgctctccctccactgttacatgcccaccgcctca

SEQ ID NO: 136797 - DNA, 37 bp, Artificial Sequence
  Synthetic oligonucleotide
ccctgccctcttcgtgtccctgtccgctcaacaaaga

SEQ ID NO: 136798 - DNA, 37 bp, Artificial Sequence
  Synthetic oligonucleotide
gatgcactgcctttgatcctgctccgcctttccacga

SEQ ID NO: 136799 - DNA, 37 bp, Artificial Sequence
  Synthetic oligonucleotide
tagcgcgcggggccgagggagggtggggcttgtgcga

SEQ ID NO: 136800 - DNA, 37 bp, Artificial Sequence
  Synthetic oligonucleotide
gacggggagggcgggtgagggttttgcagctattcga

SEQ ID NO: 136801 - DNA, 37 bp, Artificial Sequence
  Synthetic oligonucleotide
aacgcgggtagatcgggcattggggcggtgggcggga

SEQ ID NO: 136802 - DNA, 37 bp, Artificial Sequence
  Synthetic oligonucleotide
gggatcatcgcatgggaggggcgaaacgttcctggga

SEQ ID NO: 136803 - DNA, 37 bp, Artificial Sequence
  Synthetic oligonucleotide
ggtgtggaggagggatatacaagtggtggagctggga

SEQ ID NO: 136804 - DNA, 38 bp, Artificial Sequence
  Synthetic oligonucleotide
agccaacctcgccatgtcacagctccatcacgtactga

SEQ ID NO: 136805 - DNA, 38 bp, Artificial Sequence
  Synthetic oligonucleotide
acaatcggggtgggaggggtaataacgggcgttgctga

SEQ ID NO: 136806 - DNA, 36 bp, Artificial Sequence
  Synthetic oligonucleotide
acatcatccgccgtccccccaaccgctcaactctga

SEQ ID NO: 136807 - DNA, 35 bp, Artificial Sequence
  Synthetic oligonucleotide
atccgacgccggtccaccctcgtactgtttccaac

SEQ ID NO: 136808 - DNA, 35 bp, Artificial Sequence
  Synthetic oligonucleotide
tctgctctgctgttctcgttgcttaatccgccacc

SEQ ID NO: 136809 - DNA, 35 bp, Artificial Sequence
  Synthetic oligonucleotide
actattccccgtccatccccgtgctacattgtggc

SEQ ID NO: 136810 - DNA, 34 bp, Artificial Sequence
  Synthetic oligonucleotide
agcatactaagggaggcgggaagggagggaatgc

SEQ ID NO: 136811 - DNA, 35 bp, Artificial Sequence
  Synthetic oligonucleotide
ttcgtgcagtgccgacccggcgttctatcccctgc

SEQ ID NO: 136812 - DNA, 35 bp, Artificial Sequence
  Synthetic oligonucleotide
tcccagttccgcccgcttatcccacatgccattgc

SEQ ID NO: 136813 - DNA, 35 bp, Artificial Sequence
  Synthetic oligonucleotide
tgtacctcgcgtgctctgctcattctcccccactc

SEQ ID NO: 136814 - DNA, 35 bp, Artificial Sequence
  Synthetic oligonucleotide
ccagagcgccgtctggtttccccctcgccccggtc

SEQ ID NO: 136815 - DNA, 35 bp, Artificial Sequence
  Synthetic oligonucleotide
gcacacctcgattacttttgatccagctcaacttc

SEQ ID NO: 136816 - DNA, 35 bp, Artificial Sequence
  Synthetic oligonucleotide
tagtcagtctgcacctatagcccttcccgcaccat

SEQ ID NO: 136817 - DNA, 35 bp, Artificial Sequence
  Synthetic oligonucleotide
gctgcccaggatctgcttgccctcgccctcatact

SEQ ID NO: 136818 - DNA, 35 bp, Artificial Sequence
  Synthetic oligonucleotide
gacacacctacaccgctctcgaggccttatgtact

SEQ ID NO: 136819 - DNA, 35 bp, Artificial Sequence
  Synthetic oligonucleotide
ttcaccgccgcaaccttaccgcccgtcctgccgct

SEQ ID NO: 136820 - DNA, 35 bp, Artificial Sequence
  Synthetic oligonucleotide
tgccactcgcctcaataaaacgggtcggtttcgct

SEQ ID NO: 136821 - DNA, 35 bp, Artificial Sequence
  Synthetic oligonucleotide
gacctgcccccatcctgtattcgtgccgcctcctt

SEQ ID NO: 136822 - DNA, 36 bp, Artificial Sequence
  Synthetic oligonucleotide
atcgaccctaagaccccccgcccgaaccgcgcgcaa

SEQ ID NO: 136823 - DNA, 36 bp, Artificial Sequence
  Synthetic oligonucleotide
acgtcactacactatggctcatcttgcactacccca

SEQ ID NO: 136824 - DNA, 35 bp, Artificial Sequence
  Synthetic oligonucleotide
tgcctctcgcagactcttttagccccccagctgca

SEQ ID NO: 136825 - DNA, 36 bp, Artificial Sequence
  Synthetic oligonucleotide
tccgtccatgtccatttctgcccccacgcgtgctca

SEQ ID NO: 136826 - DNA, 37 bp, Artificial Sequence
  Synthetic oligonucleotide
gactgccgccccctgcgtagcgcttcctcaccgccga

SEQ ID NO: 136827 - DNA, 36 bp, Artificial Sequence
  Synthetic oligonucleotide
atggtgagggcgctaggggcggggggtctgcaggga

SEQ ID NO: 136828 - DNA, 37 bp, Artificial Sequence
  Synthetic oligonucleotide
tgtccggggcgggcggggtaatcttgtcggtacggga

SEQ ID NO: 136829 - DNA, 37 bp, Artificial Sequence
  Synthetic oligonucleotide
ttggggaacagggggatgggggggaggaaaattatga

SEQ ID NO: 136830 - DNA, 38 bp, Artificial Sequence
  Synthetic oligonucleotide
ttgtcccgcctgcattgccccatatacctctttcctga

SEQ ID NO: 136831 - DNA, 37 bp, Artificial Sequence
  Synthetic oligonucleotide
tgccgatcttcttcgttctagccaccatccctcgtga

SEQ ID NO: 136832 - DNA, 36 bp, Artificial Sequence
  Synthetic oligonucleotide
acacccgtagccccatcatgctcagcccgacttcta

SEQ ID NO: 136833 - DNA, 36 bp, Artificial Sequence
  Synthetic oligonucleotide
gtgctcctggcaccatctatccgctccttgttcgta

SEQ ID NO: 136834 - DNA, 35 bp, Artificial Sequence
  Synthetic oligonucleotide
agcgcatcacccgttctatcgcagacctccctaac

SEQ ID NO: 136835 - DNA, 35 bp, Artificial Sequence
  Synthetic oligonucleotide
accccttgccggatgcaatcttggctgttccttac

SEQ ID NO: 136836 - DNA, 35 bp, Artificial Sequence
  Synthetic oligonucleotide
gctccgacgttatgccgcccaatacccgtccaccc

SEQ ID NO: 136837 - DNA, 35 bp, Artificial Sequence
  Synthetic oligonucleotide
gcctctaaagcccgccgcctctgtcgctcgtatcc

SEQ ID NO: 136838 - DNA, 35 bp, Artificial Sequence
  Synthetic oligonucleotide
tcgatatgcaagaagccgcccgcctccctcccggc

SEQ ID NO: 136839 - DNA, 35 bp, Artificial Sequence
  Synthetic oligonucleotide
gtcgaagggggagatggtgaaaggcatggtctgag

SEQ ID NO: 136840 - DNA, 35 bp, Artificial Sequence
  Synthetic oligonucleotide
gcctagccctgagcgtcaaggccttcctctatcat

SEQ ID NO: 136841 - DNA, 35 bp, Artificial Sequence
  Synthetic oligonucleotide
tcctcctgtccgctcttgcccattagcaccattat

SEQ ID NO: 136842 - DNA, 35 bp, Artificial Sequence
  Synthetic oligonucleotide
tcccgtaagggtcgttatttggctcgctcccgcct

SEQ ID NO: 136843 - DNA, 35 bp, Artificial Sequence
  Synthetic oligonucleotide
tcagaacgcgtacaccttagctccgccccgcatct

SEQ ID NO: 136844 - DNA, 35 bp, Artificial Sequence
  Synthetic oligonucleotide
tgcctcccgcccgtggctcccatagtacgctcgtt

SEQ ID NO: 136845 - DNA, 35 bp, Artificial Sequence
  Synthetic oligonucleotide
gccttcaccgccaagatccccgtcactctaacttt

SEQ ID NO: 136846 - DNA, 36 bp, Artificial Sequence
  Synthetic oligonucleotide
tgttgacatccagcgtgctcttcgttccgtcaaaca

SEQ ID NO: 136847 - DNA, 36 bp, Artificial Sequence
  Synthetic oligonucleotide
gtaaccccgctgtcctcccaccactaggtttgcaca

SEQ ID NO: 136848 - DNA, 35 bp, Artificial Sequence
  Synthetic oligonucleotide
atcgtcctccgcctgtacgcctgtccggctttgca

SEQ ID NO: 136849 - DNA, 36 bp, Artificial Sequence
  Synthetic oligonucleotide
accccggtcccccaccccgtgtctccgtttggatca

SEQ ID NO: 136850 - DNA, 35 bp, Artificial Sequence
  Synthetic oligonucleotide
actaccgtaccatcagcaccgcaccctgcgcttca

SEQ ID NO: 136851 - DNA, 36 bp, Artificial Sequence
  Synthetic oligonucleotide
tagggaggggctcggggcctcgttcacacgggggga

SEQ ID NO: 136852 - DNA, 37 bp, Artificial Sequence
  Synthetic oligonucleotide
tgagggggtggggcagggggggagatcaggatgtgga

SEQ ID NO: 136853 - DNA, 37 bp, Artificial Sequence
  Synthetic oligonucleotide
tcccaccccggtgcctattttcgcgtttattccttga

SEQ ID NO: 136854 - DNA, 35 bp, Artificial Sequence
  Synthetic oligonucleotide
tcaaagcctatcgtccccggtgctgtgctctccac

SEQ ID NO: 136855 - DNA, 37 bp, Artificial Sequence
  Synthetic oligonucleotide
ttcgcacgcctagcggacattttttttggcgcccccc

SEQ ID NO: 136856 - DNA, 35 bp, Artificial Sequence
  Synthetic oligonucleotide
gtcaccacctcagtttcccattctccgttcgtgcc

SEQ ID NO: 136857 - DNA, 35 bp, Artificial Sequence
  Synthetic oligonucleotide
gcccaagcgcaactcaagcatctgccctactgtcc

SEQ ID NO: 136858 - DNA, 35 bp, Artificial Sequence
  Synthetic oligonucleotide
accaccatccccgtagccaacacctggccctccgc

SEQ ID NO: 136859 - DNA, 35 bp, Artificial Sequence
  Synthetic oligonucleotide
tccgaccaggccggcccacgagttttcgcctgctc

SEQ ID NO: 136860 - DNA, 35 bp, Artificial Sequence
  Synthetic oligonucleotide
acgctccacatgtccatccctaggtctgttccttc

SEQ ID NO: 136861 - DNA, 35 bp, Artificial Sequence
  Synthetic oligonucleotide
gttgaccccccattgccacgcgtttcgttcgtacg

SEQ ID NO: 136862 - DNA, 35 bp, Artificial Sequence
  Synthetic oligonucleotide
agtatgctcccatagtacgattcccacgccctccg

SEQ ID NO: 136863 - DNA, 35 bp, Artificial Sequence
  Synthetic oligonucleotide
tccaagcaccctccctggtccacgggcccctcgcg

SEQ ID NO: 136864 - DNA, 35 bp, Artificial Sequence
  Synthetic oligonucleotide
gcactaaccccgcccgctctgaaatcacctctcgg

SEQ ID NO: 136865 - DNA, 35 bp, Artificial Sequence
  Synthetic oligonucleotide
gacccgaccctgctgcctcgctctgcgccctattg

SEQ ID NO: 136866 - DNA, 35 bp, Artificial Sequence
  Synthetic oligonucleotide
aagcaccgccgcctttctcccgaatcttgccgcat

SEQ ID NO: 136867 - DNA, 35 bp, Artificial Sequence
  Synthetic oligonucleotide
gcacgtcgccctatcctatgatgtgcccgttccct

SEQ ID NO: 136868 - DNA, 35 bp, Artificial Sequence
  Synthetic oligonucleotide
gtccatcccttagttacgtactcttccatccgggt

SEQ ID NO: 136869 - DNA, 35 bp, Artificial Sequence
  Synthetic oligonucleotide
acacgctcacagtctaaccgacccagcctcccttt

SEQ ID NO: 136870 - DNA, 35 bp, Artificial Sequence
  Synthetic oligonucleotide
tacctcccgcactactgctcttgtcttgtctgttt

SEQ ID NO: 136871 - DNA, 36 bp, Artificial Sequence
  Synthetic oligonucleotide
tgagcccagatatcccttcaacccgctccccttgaa

SEQ ID NO: 136872 - DNA, 37 bp, Artificial Sequence
  Synthetic oligonucleotide
gtcacgaataggggctaaagggcgtaggggggagcga

SEQ ID NO: 136873 - DNA, 36 bp, Artificial Sequence
  Synthetic oligonucleotide
tgcaagggagaccgaacgggcgaaggaggaagagga

SEQ ID NO: 136874 - DNA, 37 bp, Artificial Sequence
  Synthetic oligonucleotide
acacaaacgcgtaaactgggtgggatgggcgatggga

SEQ ID NO: 136875 - DNA, 37 bp, Artificial Sequence
  Synthetic oligonucleotide
ggatcacgctagccgccccgccttctcctgtccctga

SEQ ID NO: 136876 - DNA, 38 bp, Artificial Sequence
  Synthetic oligonucleotide
gagacaagggggggctagagtggaaaggggtaaggtga

SEQ ID NO: 136877 - DNA, 36 bp, Artificial Sequence
  Synthetic oligonucleotide
tgacaccctccctgcctgtccttggggtgcccttga

SEQ ID NO: 136878 - DNA, 35 bp, Artificial Sequence
  Synthetic oligonucleotide
atccatcgaccaccgcgctcaagcgacgaccaccc

SEQ ID NO: 136879 - DNA, 35 bp, Artificial Sequence
  Synthetic oligonucleotide
tttccgcaccctccgcaatctttggccttataccc

SEQ ID NO: 136880 - DNA, 35 bp, Artificial Sequence
  Synthetic oligonucleotide
gcgccccttccaagtgttgactcttggtgcactcc

SEQ ID NO: 136881 - DNA, 35 bp, Artificial Sequence
  Synthetic oligonucleotide
acatcctcccgactatgttagtcctcttactatgc

SEQ ID NO: 136882 - DNA, 35 bp, Artificial Sequence
  Synthetic oligonucleotide
atcggacagtctcacccaccccgccctgtggtctc

SEQ ID NO: 136883 - DNA, 35 bp, Artificial Sequence
  Synthetic oligonucleotide
tcgtccaacctctgctctctagtcctaagttcttc

SEQ ID NO: 136884 - DNA, 32 bp, Artificial Sequence
  Synthetic oligonucleotide
tactccgaaatccccccagccgtgcctcccag

SEQ ID NO: 136885 - DNA, 35 bp, Artificial Sequence
  Synthetic oligonucleotide
gttcacatccatgtacgatgacgccgccttccccg

SEQ ID NO: 136886 - DNA, 35 bp, Artificial Sequence
  Synthetic oligonucleotide
gactacctcgagttctggcccataaactgcctccg

SEQ ID NO: 136887 - DNA, 35 bp, Artificial Sequence
  Synthetic oligonucleotide
tcccaacccctgccccacatcgattctactcctgg

SEQ ID NO: 136888 - DNA, 35 bp, Artificial Sequence
  Synthetic oligonucleotide
gcaactgccccaccatcaacccgtcccgatgcctg

SEQ ID NO: 136889 - DNA, 35 bp, Artificial Sequence
  Synthetic oligonucleotide
acgttccgccagtttggttcatccagcccgcacct

SEQ ID NO: 136890 - DNA, 35 bp, Artificial Sequence
  Synthetic oligonucleotide
tgccaacgccacgcattttatgattctgcactcct

SEQ ID NO: 136891 - DNA, 35 bp, Artificial Sequence
  Synthetic oligonucleotide
accctcgtccctgtcgatcttccattacactcgct

SEQ ID NO: 136892 - DNA, 35 bp, Artificial Sequence
  Synthetic oligonucleotide
tcctccggcatctgaccccgctcgcacccgcctgt

SEQ ID NO: 136893 - DNA, 33 bp, Artificial Sequence
  Synthetic oligonucleotide
gcagactcccggcccgtacccacttggtccatt

SEQ ID NO: 136894 - DNA, 35 bp, Artificial Sequence
  Synthetic oligonucleotide
agcgagtgactcgcggctcccttttgatacccctt

SEQ ID NO: 136895 - DNA, 35 bp, Artificial Sequence
  Synthetic oligonucleotide
ttgcccgccctccatcatgtccgttagtccaggaa

SEQ ID NO: 136896 - DNA, 36 bp, Artificial Sequence
  Synthetic oligonucleotide
gtcaaccccacttcgtgcctcacagttttagcttca

SEQ ID NO: 136897 - DNA, 37 bp, Artificial Sequence
  Synthetic oligonucleotide
gtgtagtcgtcacatcttcccttccgttctatgccga

SEQ ID NO: 136898 - DNA, 37 bp, Artificial Sequence
  Synthetic oligonucleotide
acttcccgcacagtgtttctgtgcacgcccttctcga

SEQ ID NO: 136899 - DNA, 37 bp, Artificial Sequence
  Synthetic oligonucleotide
acccaccgccatctgtaagcagctatatcttcccgga

SEQ ID NO: 136900 - DNA, 37 bp, Artificial Sequence
  Synthetic oligonucleotide
ggggtgggctcaataatggccggtgacaccctgggga

SEQ ID NO: 136901 - DNA, 37 bp, Artificial Sequence
  Synthetic oligonucleotide
ggtggagatggagcggggtaagggatcacggagtgga

SEQ ID NO: 136902 - DNA, 38 bp, Artificial Sequence
  Synthetic oligonucleotide
gaagggtgcggagggggaatgaccatacgggcgagtga

SEQ ID NO: 136903 - DNA, 38 bp, Artificial Sequence
  Synthetic oligonucleotide
tgcccctgcccagacgtactgctttccaccgcatgtga

SEQ ID NO: 136904 - DNA, 38 bp, Artificial Sequence
  Synthetic oligonucleotide
tccactcccccctaatgcgtacctgtcaagtttcttga

SEQ ID NO: 136905 - DNA, 35 bp, Artificial Sequence
  Synthetic oligonucleotide
acagccttagccgcaccttgatactgacttcacac

SEQ ID NO: 136906 - DNA, 35 bp, Artificial Sequence
  Synthetic oligonucleotide
gtcaaccattatgcctggggccacttctttaccac

SEQ ID NO: 136907 - DNA, 35 bp, Artificial Sequence
  Synthetic oligonucleotide
gatcggcctcccaccatgcaatagcctacttttac

SEQ ID NO: 136908 - DNA, 35 bp, Artificial Sequence
  Synthetic oligonucleotide
tacttgcccgaacgaattctgagccctcccatacc

SEQ ID NO: 136909 - DNA, 35 bp, Artificial Sequence
  Synthetic oligonucleotide
gtccgcccgcttctcattatcgcaaagattccccc

SEQ ID NO: 136910 - DNA, 35 bp, Artificial Sequence
  Synthetic oligonucleotide
ggtgggcactgtctccgttggttctgcttctatcc

SEQ ID NO: 136911 - DNA, 35 bp, Artificial Sequence
  Synthetic oligonucleotide
gcacccatcccgtccccctgcccgtggtaagtagc

SEQ ID NO: 136912 - DNA, 35 bp, Artificial Sequence
  Synthetic oligonucleotide
gatcaacggggaccgcttactcgccacatgctctc

SEQ ID NO: 136913 - DNA, 35 bp, Artificial Sequence
  Synthetic oligonucleotide
gtggggggtgggaagctgggacggcaggcaggtag

SEQ ID NO: 136914 - DNA, 35 bp, Artificial Sequence
  Synthetic oligonucleotide
tgagcgctcatggcccaggccacgcaatcctcccg

SEQ ID NO: 136915 - DNA, 35 bp, Artificial Sequence
  Synthetic oligonucleotide
ggccctcgcacatctcaacccttgcccctgccgcg

SEQ ID NO: 136916 - DNA, 35 bp, Artificial Sequence
  Synthetic oligonucleotide
gtcgccatctttcctgttcaagtttcgcctcctcg

SEQ ID NO: 136917 - DNA, 35 bp, Artificial Sequence
  Synthetic oligonucleotide
gacgagaggacacggggcggtaacataatgagggg

SEQ ID NO: 136918 - DNA, 35 bp, Artificial Sequence
  Synthetic oligonucleotide
agacgctcgccgcccgttacatgaataccgctact

SEQ ID NO: 136919 - DNA, 35 bp, Artificial Sequence
  Synthetic oligonucleotide
gttacatcccgattatgcgtaggtcccccctgcct

SEQ ID NO: 136920 - DNA, 35 bp, Artificial Sequence
  Synthetic oligonucleotide
tacgcaagtccgtcatccctgtcaacgccaccagt

SEQ ID NO: 136921 - DNA, 35 bp, Artificial Sequence
  Synthetic oligonucleotide
gttgccattcacagttgtcaattcttctcctttgt

SEQ ID NO: 136922 - DNA, 35 bp, Artificial Sequence
  Synthetic oligonucleotide
ccgaggtcgcccgcccacgcctataagcccgcctt

SEQ ID NO: 136923 - DNA, 35 bp, Artificial Sequence
  Synthetic oligonucleotide
tcctgccttcgccgcacttgaattaagctcccgtt

SEQ ID NO: 136924 - DNA, 35 bp, Artificial Sequence
  Synthetic oligonucleotide
tcccacccacccgcctgtaagctttgactattgaa

SEQ ID NO: 136925 - DNA, 36 bp, Artificial Sequence
  Synthetic oligonucleotide
gcctgaacccctgtgatcccgcccctgttccagcca

SEQ ID NO: 136926 - DNA, 36 bp, Artificial Sequence
  Synthetic oligonucleotide
atgcatgctcccagctcctccttatagcacatgcca

SEQ ID NO: 136927 - DNA, 36 bp, Artificial Sequence
  Synthetic oligonucleotide
tcacgcccgaatcccgcatatacttaactgctgcca

SEQ ID NO: 136928 - DNA, 36 bp, Artificial Sequence
  Synthetic oligonucleotide
tcagatagccgtcgcacatcgacttacaccgctcca

SEQ ID NO: 136929 - DNA, 36 bp, Artificial Sequence
  Synthetic oligonucleotide
ttacgcccgcatctgcccgtaagcctctgctcctca

SEQ ID NO: 136930 - DNA, 35 bp, Artificial Sequence
  Synthetic oligonucleotide
aaagggccggatggggaggagagtaggcatgcaga

SEQ ID NO: 136931 - DNA, 37 bp, Artificial Sequence
  Synthetic oligonucleotide
acctggcgcccgctacataactgaccctctttgccga

SEQ ID NO: 136932 - DNA, 37 bp, Artificial Sequence
  Synthetic oligonucleotide
tgacgcctccacaccgccccccgccagtgcctggcga

SEQ ID NO: 136933 - DNA, 37 bp, Artificial Sequence
  Synthetic oligonucleotide
actcaccccccgtccagctacctctcgctaacctcga

SEQ ID NO: 136934 - DNA, 36 bp, Artificial Sequence
  Synthetic oligonucleotide
acgactccgccattttcaagaacgctcctccctcga

SEQ ID NO: 136935 - DNA, 37 bp, Artificial Sequence
  Synthetic oligonucleotide
gaatcccgcgtgcaggattgggaggagtggggaggga

SEQ ID NO: 136936 - DNA, 37 bp, Artificial Sequence
  Synthetic oligonucleotide
gatgcatccctacgccgcgctctcctacactggggga

SEQ ID NO: 136937 - DNA, 37 bp, Artificial Sequence
  Synthetic oligonucleotide
ggaggagggtgggtagacttgggggagggtactggga

SEQ ID NO: 136938 - DNA, 37 bp, Artificial Sequence
  Synthetic oligonucleotide
aacgagaggggccgtgggagaaaagagggggtatgga

SEQ ID NO: 136939 - DNA, 37 bp, Artificial Sequence
  Synthetic oligonucleotide
tgtatgccacctgactcacgcactcaccccatttgga

SEQ ID NO: 136940 - DNA, 37 bp, Artificial Sequence
  Synthetic oligonucleotide
gccacccgtttgcccctttgtacttcgactccaatga

SEQ ID NO: 136941 - DNA, 38 bp, Artificial Sequence
  Synthetic oligonucleotide
gaataagcaacaggatgggggagcggagtggtggatga

SEQ ID NO: 136942 - DNA, 36 bp, Artificial Sequence
  Synthetic oligonucleotide
gctgtcctgccccctcattgtagttcttcgctgtga

SEQ ID NO: 136943 - DNA, 36 bp, Artificial Sequence
  Synthetic oligonucleotide
tgaccggacccacgcttcccgcatttcgagctatac

SEQ ID NO: 136944 - DNA, 35 bp, Artificial Sequence
  Synthetic oligonucleotide
gtctgacactcgttgtggcttcccttactgccacc

SEQ ID NO: 136945 - DNA, 35 bp, Artificial Sequence
  Synthetic oligonucleotide
agcctgtcagtatgtatttctagcccccacccgcc

SEQ ID NO: 136946 - DNA, 35 bp, Artificial Sequence
  Synthetic oligonucleotide
gacactaatgcgctttagccccccgctccttcgcc

SEQ ID NO: 136947 - DNA, 35 bp, Artificial Sequence
  Synthetic oligonucleotide
gaccatctatgtccacgctagcctcctcttaacgc

SEQ ID NO: 136948 - DNA, 35 bp, Artificial Sequence
  Synthetic oligonucleotide
tcctggcactcgacatctacaccacctctacgcgc

SEQ ID NO: 136949 - DNA, 35 bp, Artificial Sequence
  Synthetic oligonucleotide
ggtgtgactgtgtgctctatccgttccccctctgc

SEQ ID NO: 136950 - DNA, 35 bp, Artificial Sequence
  Synthetic oligonucleotide
agtggtcgctacaatggcccgcaccagcccttctc

SEQ ID NO: 136951 - DNA, 35 bp, Artificial Sequence
  Synthetic oligonucleotide
tcgctgttccgcccggcttggtaattcaactcttc

SEQ ID NO: 136952 - DNA, 35 bp, Artificial Sequence
  Synthetic oligonucleotide
tcccagcctggcctaacgtcacccggcctcacccg

SEQ ID NO: 136953 - DNA, 35 bp, Artificial Sequence
  Synthetic oligonucleotide
taccccgtgataacccgctccccgccctgcattcg

SEQ ID NO: 136954 - DNA, 35 bp, Artificial Sequence
  Synthetic oligonucleotide
gatccaccaagcctctgcccttctccaacaagttg

SEQ ID NO: 136955 - DNA, 35 bp, Artificial Sequence
  Synthetic oligonucleotide
tttcggtgccatccccgtctagactcctgtttcct

SEQ ID NO: 136956 - DNA, 35 bp, Artificial Sequence
  Synthetic oligonucleotide
tactacagtccctgcgcgccgcccgaacctccgct

SEQ ID NO: 136957 - DNA, 35 bp, Artificial Sequence
  Synthetic oligonucleotide
accctgagccttccgatgcctctgtcgccccttct

SEQ ID NO: 136958 - DNA, 35 bp, Artificial Sequence
  Synthetic oligonucleotide
ggccaccctccgccggcactacggtctccccttct

SEQ ID NO: 136959 - DNA, 35 bp, Artificial Sequence
  Synthetic oligonucleotide
gcacgcttgctccggttccctcttatgactcctgt

SEQ ID NO: 136960 - DNA, 35 bp, Artificial Sequence
  Synthetic oligonucleotide
tgcacacatcaacgctttggcccagcccttcccaa

SEQ ID NO: 136961 - DNA, 35 bp, Artificial Sequence
  Synthetic oligonucleotide
tcggggccccccattgtcgtccttatttccagcca

SEQ ID NO: 136962 - DNA, 35 bp, Artificial Sequence
  Synthetic oligonucleotide
tcttgccccattggccacccctcaactgcctcgca

SEQ ID NO: 136963 - DNA, 36 bp, Artificial Sequence
  Synthetic oligonucleotide
ttgtcaccgttccatccttgatctcgctcgctggca

SEQ ID NO: 136964 - DNA, 35 bp, Artificial Sequence
  Synthetic oligonucleotide
gtgccctttgccgtacctgccggttatccctccga

SEQ ID NO: 136965 - DNA, 36 bp, Artificial Sequence
  Synthetic oligonucleotide
tcgaacgcccagacggcttcactcctacctcatcga

SEQ ID NO: 136966 - DNA, 35 bp, Artificial Sequence
  Synthetic oligonucleotide
gaggactcggggtggatgggcggggggaagctcga

SEQ ID NO: 136967 - DNA, 38 bp, Artificial Sequence
  Synthetic oligonucleotide
gcccaccctactgttgttctatcctgggcattctatga

SEQ ID NO: 136968 - DNA, 38 bp, Artificial Sequence
  Synthetic oligonucleotide
atgggaaagggagggggaagaggcgcatcgggtggtga

SEQ ID NO: 136969 - DNA, 37 bp, Artificial Sequence
  Synthetic oligonucleotide
gccatccccgtccgccgaggccaccattcatccttga

SEQ ID NO: 136970 - DNA, 38 bp, Artificial Sequence
  Synthetic oligonucleotide
atcgacccctcctcggtaaatgttcacttgcctcttga

SEQ ID NO: 136971 - DNA, 36 bp, Artificial Sequence
  Synthetic oligonucleotide
gagccacattaagcgctgcccgttaccctcgcccta

SEQ ID NO: 136972 - DNA, 35 bp, Artificial Sequence
  Synthetic oligonucleotide
gacacgccaaggctatatcaaccagcccccgccta

SEQ ID NO: 136973 - DNA, 36 bp, Artificial Sequence
  Synthetic oligonucleotide
gctcaccccccaattgctcgtattatagttccttta

SEQ ID NO: 136974 - DNA, 35 bp, Artificial Sequence
  Synthetic oligonucleotide
tagaaccccgcaccaatcctgccgccataacggac

SEQ ID NO: 136975 - DNA, 35 bp, Artificial Sequence
  Synthetic oligonucleotide
gtaccatccaccacactgcatgacctagctattac

SEQ ID NO: 136976 - DNA, 35 bp, Artificial Sequence
  Synthetic oligonucleotide
tcaccaccccagaccgtagctcaccatatattacc

SEQ ID NO: 136977 - DNA, 35 bp, Artificial Sequence
  Synthetic oligonucleotide
gcccacttagagttttcgtcacacacctctttccc

SEQ ID NO: 136978 - DNA, 35 bp, Artificial Sequence
  Synthetic oligonucleotide
aactcccgctccatgcgtctctcagcccctctgcc

SEQ ID NO: 136979 - DNA, 35 bp, Artificial Sequence
  Synthetic oligonucleotide
gggatgctgccttgcccgagccgtttcgccttgcc

SEQ ID NO: 136980 - DNA, 35 bp, Artificial Sequence
  Synthetic oligonucleotide
gctcggcgtcactgtctccttgcttagtgtcctcc

SEQ ID NO: 136981 - DNA, 35 bp, Artificial Sequence
  Synthetic oligonucleotide
gccacttgtccttccacagccccttttgccactgc

SEQ ID NO: 136982 - DNA, 35 bp, Artificial Sequence
  Synthetic oligonucleotide
ttgtcacctcccacgcctcttaccatgagcggctc

SEQ ID NO: 136983 - DNA, 35 bp, Artificial Sequence
  Synthetic oligonucleotide
tctaagcccccgctagttacctggttacatccttc

SEQ ID NO: 136984 - DNA, 35 bp, Artificial Sequence
  Synthetic oligonucleotide
atcgccgtgcctcccagtcaattagtcgccaatcg

SEQ ID NO: 136985 - DNA, 35 bp, Artificial Sequence
  Synthetic oligonucleotide
ttagcgcacctgacacctacctgcttatcatctcg

SEQ ID NO: 136986 - DNA, 35 bp, Artificial Sequence
  Synthetic oligonucleotide
gtattccctaaactgctatccccccgcatgattgg

SEQ ID NO: 136987 - DNA, 35 bp, Artificial Sequence
  Synthetic oligonucleotide
tgaaccgtccccaagagtatgcgccccctcccctg

SEQ ID NO: 136988 - DNA, 34 bp, Artificial Sequence
  Synthetic oligonucleotide
atgcccgccgcccgcgcagcactcgtttcacaat

SEQ ID NO: 136989 - DNA, 35 bp, Artificial Sequence
  Synthetic oligonucleotide
tgaatcatacgcccgcctggtacgacccattctgt

SEQ ID NO: 136990 - DNA, 35 bp, Artificial Sequence
  Synthetic oligonucleotide
gctgcaacatcggagtcctcctcgtacacgccctt

SEQ ID NO: 136991 - DNA, 36 bp, Artificial Sequence
  Synthetic oligonucleotide
tcgtgcccaccattcgttcggacgcctttgttccca

SEQ ID NO: 136992 - DNA, 35 bp, Artificial Sequence
  Synthetic oligonucleotide
gaactccgcccctactactgctatttgctcttgca

SEQ ID NO: 136993 - DNA, 38 bp, Artificial Sequence
  Synthetic oligonucleotide
ggggcggtggacgcgtttatggtaggcggggctgcaga

SEQ ID NO: 136994 - DNA, 37 bp, Artificial Sequence
  Synthetic oligonucleotide
ggggagttggttacacgggtgaggaagggcaaaggga

SEQ ID NO: 136995 - DNA, 37 bp, Artificial Sequence
  Synthetic oligonucleotide
atgcaggggggagggctaccggggactcacgacggga

SEQ ID NO: 136996 - DNA, 38 bp, Artificial Sequence
  Synthetic oligonucleotide
ttcgcctcccgcaggatctgctttccgcccttttctga

SEQ ID NO: 136997 - DNA, 37 bp, Artificial Sequence
  Synthetic oligonucleotide
gagggggacggggtggaatgtgtgggcaggggcgtga

SEQ ID NO: 136998 - DNA, 38 bp, Artificial Sequence
  Synthetic oligonucleotide
tcgcgaatcgcctgccgttggggcccctctcactttga

SEQ ID NO: 136999 - DNA, 36 bp, Artificial Sequence
  Synthetic oligonucleotide
gtcccgccatcccgccactcattgacgccttgaata

SEQ ID NO: 137000 - DNA, 36 bp, Artificial Sequence
  Synthetic oligonucleotide
tccgtcacctctgcccatcattgtttcacgtccata

SEQ ID NO: 137001 - DNA, 35 bp, Artificial Sequence
  Synthetic oligonucleotide
tcctgccccgattcgtgagccagtcgccgccccac

SEQ ID NO: 137002 - DNA, 35 bp, Artificial Sequence
  Synthetic oligonucleotide
gcacacgtgagcgagcattgcccctgatcctttac

SEQ ID NO: 137003 - DNA, 35 bp, Artificial Sequence
  Synthetic oligonucleotide
atagccacgctttgtatgcgccccccacgtgaacc

SEQ ID NO: 137004 - DNA, 35 bp, Artificial Sequence
  Synthetic oligonucleotide
tgggcctcccacccgttgtaccttcgtgcctgtcc

SEQ ID NO: 137005 - DNA, 35 bp, Artificial Sequence
  Synthetic oligonucleotide
tacacgtctgcgccccctcctgattactttcacgc

SEQ ID NO: 137006 - DNA, 35 bp, Artificial Sequence
  Synthetic oligonucleotide
ttcctccgccctccgttataacctgcagttgaggc

SEQ ID NO: 137007 - DNA, 34 bp, Artificial Sequence
  Synthetic oligonucleotide
tctgaccccctctcattttaaggttctttccctc

SEQ ID NO: 137008 - DNA, 35 bp, Artificial Sequence
  Synthetic oligonucleotide
gatgcccccccatatataccagtgtccatagcctc

SEQ ID NO: 137009 - DNA, 35 bp, Artificial Sequence
  Synthetic oligonucleotide
ttggaagacccactgcatgctctgtctccactctc

SEQ ID NO: 137010 - DNA, 35 bp, Artificial Sequence
  Synthetic oligonucleotide
gttaagcctcgatgacccgctacctgccccccgtc

SEQ ID NO: 137011 - DNA, 35 bp, Artificial Sequence
  Synthetic oligonucleotide
gccgcacaatagtgttttccccgtccgtgtcctag

SEQ ID NO: 137012 - DNA, 35 bp, Artificial Sequence
  Synthetic oligonucleotide
tctcacccccaggctacaccatccgatcggctccg

SEQ ID NO: 137013 - DNA, 35 bp, Artificial Sequence
  Synthetic oligonucleotide
tacaccgcctgctatacttggtgttcgctcccgcg

SEQ ID NO: 137014 - DNA, 35 bp, Artificial Sequence
  Synthetic oligonucleotide
ggtaggagggagaccggggagagcggggcggtgtg

SEQ ID NO: 137015 - DNA, 36 bp, Artificial Sequence
  Synthetic oligonucleotide
ttatccgccgcccatccgttagttctttacacttat

SEQ ID NO: 137016 - DNA, 35 bp, Artificial Sequence
  Synthetic oligonucleotide
gcatagcatcccagatacatcccgtcctctcatgt

SEQ ID NO: 137017 - DNA, 35 bp, Artificial Sequence
  Synthetic oligonucleotide
tagtctcgtacgacttccttcttgctccaccctgt

SEQ ID NO: 137018 - DNA, 36 bp, Artificial Sequence
  Synthetic oligonucleotide
tcagatgggcctctcgtgtaattttccgttctgcaa

SEQ ID NO: 137019 - DNA, 36 bp, Artificial Sequence
  Synthetic oligonucleotide
tccctgtgcccatttgcgtccatccgcgctccttaa

SEQ ID NO: 137020 - DNA, 35 bp, Artificial Sequence
  Synthetic oligonucleotide
gccttcctgacctcctacagaccgcctgtgcccca

SEQ ID NO: 137021 - DNA, 36 bp, Artificial Sequence
  Synthetic oligonucleotide
acccaccacgaaacacactgccgccaacttgcgcca

SEQ ID NO: 137022 - DNA, 36 bp, Artificial Sequence
  Synthetic oligonucleotide
tcgcccccaaagcccccagaccactgttttgctcca

SEQ ID NO: 137023 - DNA, 36 bp, Artificial Sequence
  Synthetic oligonucleotide
agtgcggcgcacttgacctccacgtactcctccgca

SEQ ID NO: 137024 - DNA, 36 bp, Artificial Sequence
  Synthetic oligonucleotide
gtcaaggccgtcatttctcccctcccgtgcttatca

SEQ ID NO: 137025 - DNA, 36 bp, Artificial Sequence
  Synthetic oligonucleotide
gtccgaccctgtaccattccacctctccgttaggga

SEQ ID NO: 137026 - DNA, 38 bp, Artificial Sequence
  Synthetic oligonucleotide
tcccctcgaacgtggttctatctctcgtcactctgtga

SEQ ID NO: 137027 - DNA, 38 bp, Artificial Sequence
  Synthetic oligonucleotide
tcacagcatccatttgtccatcacccggccttcattga

SEQ ID NO: 137028 - DNA, 38 bp, Artificial Sequence
  Synthetic oligonucleotide
acatcacctcggctaacatgcgtacacctccgccttga

SEQ ID NO: 137029 - DNA, 35 bp, Artificial Sequence
  Synthetic oligonucleotide
gccatactcagccccccgattctgacacctgtcac

SEQ ID NO: 137030 - DNA, 35 bp, Artificial Sequence
  Synthetic oligonucleotide
aacttgtccgccccaccctacccgtttgtcctgac

SEQ ID NO: 137031 - DNA, 35 bp, Artificial Sequence
  Synthetic oligonucleotide
aagtctccacaggctcgtattcccgcctggccccc

SEQ ID NO: 137032 - DNA, 35 bp, Artificial Sequence
  Synthetic oligonucleotide
acaccacctcactcacgctacatgacggactcccc

SEQ ID NO: 137033 - DNA, 35 bp, Artificial Sequence
  Synthetic oligonucleotide
ttgcccctccgccgtgcattttcggtgccctgccc

SEQ ID NO: 137034 - DNA, 35 bp, Artificial Sequence
  Synthetic oligonucleotide
gtacgcccctgcttggttttttaacgtcttttccc

SEQ ID NO: 137035 - DNA, 35 bp, Artificial Sequence
  Synthetic oligonucleotide
aatcatcgaccatgtcttttcgccttgtcctttcc

SEQ ID NO: 137036 - DNA, 35 bp, Artificial Sequence
  Synthetic oligonucleotide
ttcctgctcgtgcagtccgcccgcccttcaatcgc

SEQ ID NO: 137037 - DNA, 35 bp, Artificial Sequence
  Synthetic oligonucleotide
gcccatttccgcccgcttatcccacatgccattgc

SEQ ID NO: 137038 - DNA, 35 bp, Artificial Sequence
  Synthetic oligonucleotide
gtgacgcgcttgcctgaactcttaacacgccattc

SEQ ID NO: 137039 - DNA, 35 bp, Artificial Sequence
  Synthetic oligonucleotide
actatgccgctgcccctcccgacgcttagaccttc

SEQ ID NO: 137040 - DNA, 35 bp, Artificial Sequence
  Synthetic oligonucleotide
gtcacagtacccattgtattcacccccccactttc

SEQ ID NO: 137041 - DNA, 35 bp, Artificial Sequence
  Synthetic oligonucleotide
tcgccacctgttccctgttaccttttgctgatact

SEQ ID NO: 137042 - DNA, 35 bp, Artificial Sequence
  Synthetic oligonucleotide
gcaaaacgctgtgtttgcctgtacctattgccctt

SEQ ID NO: 137043 - DNA, 35 bp, Artificial Sequence
  Synthetic oligonucleotide
gcccatcacctggatgcgctttcttatgatccctt

SEQ ID NO: 137044 - DNA, 36 bp, Artificial Sequence
  Synthetic oligonucleotide
tagtctccgccagccgctatgtcctacacttctcaa

SEQ ID NO: 137045 - DNA, 36 bp, Artificial Sequence
  Synthetic oligonucleotide
gagtgggggcatgggagtgggaggatttatggggaa

SEQ ID NO: 137046 - DNA, 35 bp, Artificial Sequence
  Synthetic oligonucleotide
actgctctgcccttactgaagtctcgctcccgcca

SEQ ID NO: 137047 - DNA, 36 bp, Artificial Sequence
  Synthetic oligonucleotide
ttactgccacaggttgccactcactccccgtatgca

SEQ ID NO: 137048 - DNA, 36 bp, Artificial Sequence
  Synthetic oligonucleotide
tactgtgaccccgttgtgctcacgcctctgttttca

SEQ ID NO: 137049 - DNA, 37 bp, Artificial Sequence
  Synthetic oligonucleotide
tcttagccccgcttagatctgcttatctgcccaccga

SEQ ID NO: 137050 - DNA, 37 bp, Artificial Sequence
  Synthetic oligonucleotide
tggacccacgtctttctcaccctcgcgccccacccga

SEQ ID NO: 137051 - DNA, 37 bp, Artificial Sequence
  Synthetic oligonucleotide
ttgacacccagctttcgccctccgccccgtctcgcga

SEQ ID NO: 137052 - DNA, 38 bp, Artificial Sequence
  Synthetic oligonucleotide
tcctgcggcacgaatgtcctcacacttgctccacctga

SEQ ID NO: 137053 - DNA, 38 bp, Artificial Sequence
  Synthetic oligonucleotide
tcttcctcgcccgtgcctttaccgccatgcctccctga

SEQ ID NO: 137054 - DNA, 37 bp, Artificial Sequence
  Synthetic oligonucleotide
gagagttagggaggggcgtgaatggagtggggagtga

SEQ ID NO: 137055 - DNA, 37 bp, Artificial Sequence
  Synthetic oligonucleotide
gctccagcgaggcataggggagggagggcggacgtga

SEQ ID NO: 137056 - DNA, 38 bp, Artificial Sequence
  Synthetic oligonucleotide
gagagtgccgacgtgagtgggggggatgggagtggtga

SEQ ID NO: 137057 - DNA, 37 bp, Artificial Sequence
  Synthetic oligonucleotide
agtggggaggactaaggagggcgggaggggagattga

SEQ ID NO: 137058 - DNA, 38 bp, Artificial Sequence
  Synthetic oligonucleotide
tcccattcgcctccatacccgacgccagccttccttga

SEQ ID NO: 137059 - DNA, 35 bp, Artificial Sequence
  Synthetic oligonucleotide
tacccgccgtcgacgaccttcacctcacgacccac

SEQ ID NO: 137060 - DNA, 35 bp, Artificial Sequence
  Synthetic oligonucleotide
gcaacccatcccgcgcgggccgctcgccttccgac

SEQ ID NO: 137061 - DNA, 35 bp, Artificial Sequence
  Synthetic oligonucleotide
ttggccaacgatcgcatgcgctcccgatctgttcc

SEQ ID NO: 137062 - DNA, 35 bp, Artificial Sequence
  Synthetic oligonucleotide
tactgctccttgccgttttcctgcacctttcacgc

SEQ ID NO: 137063 - DNA, 35 bp, Artificial Sequence
  Synthetic oligonucleotide
cccctcaccgccaccgcatggcatctcccatccgc

SEQ ID NO: 137064 - DNA, 35 bp, Artificial Sequence
  Synthetic oligonucleotide
agtaacaccgcaaatcatcctgtccagtcccgggc

SEQ ID NO: 137065 - DNA, 35 bp, Artificial Sequence
  Synthetic oligonucleotide
gagagccacaaaaccagccaccagttaccacctgc

SEQ ID NO: 137066 - DNA, 35 bp, Artificial Sequence
  Synthetic oligonucleotide
accgcccccatgctaacacagagtacactgctttc

SEQ ID NO: 137067 - DNA, 35 bp, Artificial Sequence
  Synthetic oligonucleotide
ggtctacccgtgccgtattggttcattttcccccg

SEQ ID NO: 137068 - DNA, 35 bp, Artificial Sequence
  Synthetic oligonucleotide
gtcgtccccctcgctacctctgtgcactatgtact

SEQ ID NO: 137069 - DNA, 35 bp, Artificial Sequence
  Synthetic oligonucleotide
gtccaccgcatccgagaaccgccatagccgcccct

SEQ ID NO: 137070 - DNA, 34 bp, Artificial Sequence
  Synthetic oligonucleotide
gccatgatcgggtcgccgctactaaacttatcct

SEQ ID NO: 137071 - DNA, 35 bp, Artificial Sequence
  Synthetic oligonucleotide
aagccaaccgccctagtcttgcctcttctatagct

SEQ ID NO: 137072 - DNA, 35 bp, Artificial Sequence
  Synthetic oligonucleotide
gaaccagcagtcactcctatacccgtgcgcttgct

SEQ ID NO: 137073 - DNA, 35 bp, Artificial Sequence
  Synthetic oligonucleotide
aaggcgggagggggggaggaagggtactgctcgtt

SEQ ID NO: 137074 - DNA, 36 bp, Artificial Sequence
  Synthetic oligonucleotide
tcccgtcaccttggtgcctcgtaacatcttttcaca

SEQ ID NO: 137075 - DNA, 35 bp, Artificial Sequence
  Synthetic oligonucleotide
ttaccccctccgcaactggatcctgcccatagaca

SEQ ID NO: 137076 - DNA, 36 bp, Artificial Sequence
  Synthetic oligonucleotide
gccacctccgcatgttctacattctgaccgtcccca

SEQ ID NO: 137077 - DNA, 36 bp, Artificial Sequence
  Synthetic oligonucleotide
ttgtccccccgtacctatgaaaagatcccgcgccca

SEQ ID NO: 137078 - DNA, 36 bp, Artificial Sequence
  Synthetic oligonucleotide
gccaacctcgctgtacgctgccaaccctcgacgcca

SEQ ID NO: 137079 - DNA, 36 bp, Artificial Sequence
  Synthetic oligonucleotide
acacaccgttttgacctgaccctctccgctgctcca

SEQ ID NO: 137080 - DNA, 36 bp, Artificial Sequence
  Synthetic oligonucleotide
agggtggtagcgggtgggttttagccatttggcgca

SEQ ID NO: 137081 - DNA, 37 bp, Artificial Sequence
  Synthetic oligonucleotide
tagagggggcaagaggtcgggggtagaacggctcaga

SEQ ID NO: 137082 - DNA, 36 bp, Artificial Sequence
  Synthetic oligonucleotide
atcccccgctccattgacaccacagcattgacccga

SEQ ID NO: 137083 - DNA, 37 bp, Artificial Sequence
  Synthetic oligonucleotide
gggaggtggtaggtaggggatgcggaggaggacggga

SEQ ID NO: 137084 - DNA, 37 bp, Artificial Sequence
  Synthetic oligonucleotide
gtgaatacgagggtgacgggggggagtagtcatggga

SEQ ID NO: 137085 - DNA, 38 bp, Artificial Sequence
  Synthetic oligonucleotide
tcgcgcactgttctgcttaccacccgtcgaccttctga

SEQ ID NO: 137086 - DNA, 38 bp, Artificial Sequence
  Synthetic oligonucleotide
tgccaacatcatcacttccttatcgctcgtccccgtga

SEQ ID NO: 137087 - DNA, 38 bp, Artificial Sequence
  Synthetic oligonucleotide
gtagcccccatttcccgcctgtacctagcactttgtga

SEQ ID NO: 137088 - DNA, 37 bp, Artificial Sequence
  Synthetic oligonucleotide
tacagcacctttctgcccccgtacgatccactcttga

SEQ ID NO: 137089 - DNA, 38 bp, Artificial Sequence
  Synthetic oligonucleotide
ttaaccaccgcctaatgcgttcctctatctctgtttga

SEQ ID NO: 137090 - DNA, 36 bp, Artificial Sequence
  Synthetic oligonucleotide
tgaggtgcccgtgtgggagggagggggggaccaata

SEQ ID NO: 137091 - DNA, 35 bp, Artificial Sequence
  Synthetic oligonucleotide
atcccctccgtatggtctcgaacttgtttccccta

SEQ ID NO: 137092 - DNA, 35 bp, Artificial Sequence
  Synthetic oligonucleotide
ttttgccccccgtcaccatacgcgtcccgcctcac

SEQ ID NO: 137093 - DNA, 35 bp, Artificial Sequence
  Synthetic oligonucleotide
tgatggggtgggtggtagggcgggtgaggaaaccc

SEQ ID NO: 137094 - DNA, 35 bp, Artificial Sequence
  Synthetic oligonucleotide
tggtcgccctttgtttgataaactcccgcccgccc

SEQ ID NO: 137095 - DNA, 35 bp, Artificial Sequence
  Synthetic oligonucleotide
acttggcccacccatgcccgttggacggaattccc

SEQ ID NO: 137096 - DNA, 35 bp, Artificial Sequence
  Synthetic oligonucleotide
tcagatgcatcgcctgccccccgttcgtactgctc

SEQ ID NO: 137097 - DNA, 35 bp, Artificial Sequence
  Synthetic oligonucleotide
aaccacaatgccctccgtacgctagaccagtgctc

SEQ ID NO: 137098 - DNA, 35 bp, Artificial Sequence
  Synthetic oligonucleotide
taaatatcgcgtccttgttgccttgccgttctctc

SEQ ID NO: 137099 - DNA, 35 bp, Artificial Sequence
  Synthetic oligonucleotide
tcgcaattcccacccagcccgctcaccccgtcctg

SEQ ID NO: 137100 - DNA, 35 bp, Artificial Sequence
  Synthetic oligonucleotide
tccgccccttgtcaacgcaggccccccgaatattg

SEQ ID NO: 137101 - DNA, 35 bp, Artificial Sequence
  Synthetic oligonucleotide
gggaattccgccatccgtccaccgcctctttgcat

SEQ ID NO: 137102 - DNA, 35 bp, Artificial Sequence
  Synthetic oligonucleotide
tcctgtcgtaaatctgcccttagtcgttgcgccct

SEQ ID NO: 137103 - DNA, 35 bp, Artificial Sequence
  Synthetic oligonucleotide
tgtgtaaccggctcctggctctccatcccgttcct

SEQ ID NO: 137104 - DNA, 35 bp, Artificial Sequence
  Synthetic oligonucleotide
tagaagggaggggagtacggggggggtaatacggt

SEQ ID NO: 137105 - DNA, 36 bp, Artificial Sequence
  Synthetic oligonucleotide
gcccaaccgcttgtggtcccgttctccttgttcttt

SEQ ID NO: 137106 - DNA, 35 bp, Artificial Sequence
  Synthetic oligonucleotide
gcccacctgcattccgacacttctgccatctcaca

SEQ ID NO: 137107 - DNA, 36 bp, Artificial Sequence
  Synthetic oligonucleotide
gcctccgcctaccccatgttctgcgtctctgtcaca

SEQ ID NO: 137108 - DNA, 36 bp, Artificial Sequence
  Synthetic oligonucleotide
actcactccaccgcgcctacagagccccgcactaca

SEQ ID NO: 137109 - DNA, 36 bp, Artificial Sequence
  Synthetic oligonucleotide
gttaggactataggggccgacggggagaaggggaga

SEQ ID NO: 137110 - DNA, 37 bp, Artificial Sequence
  Synthetic oligonucleotide
ggggagaacatgggcgggcaacgatacgggaactcga

SEQ ID NO: 137111 - DNA, 36 bp, Artificial Sequence
  Synthetic oligonucleotide
ttcgctgccaagtgcacctcccccccctcacctcga

SEQ ID NO: 137112 - DNA, 37 bp, Artificial Sequence
  Synthetic oligonucleotide
tcatgatgagacggcatacgggggaaagggggcggga

SEQ ID NO: 137113 - DNA, 37 bp, Artificial Sequence
  Synthetic oligonucleotide
tcatgggggggagtgagagggggctgattgaagggga

SEQ ID NO: 137114 - DNA, 37 bp, Artificial Sequence
  Synthetic oligonucleotide
atggtacggagggggtgaggggtaagaccgaggggga

SEQ ID NO: 137115 - DNA, 35 bp, Artificial Sequence
  Synthetic oligonucleotide
tgatcccctccgttcatgtctcctcgggaaccaac

SEQ ID NO: 137116 - DNA, 35 bp, Artificial Sequence
  Synthetic oligonucleotide
acactccaccgatatccccaagtctgccctggtac

SEQ ID NO: 137117 - DNA, 35 bp, Artificial Sequence
  Synthetic oligonucleotide
ttgtcccccatgagcccatcgattcctttgtgacc

SEQ ID NO: 137118 - DNA, 35 bp, Artificial Sequence
  Synthetic oligonucleotide
tcagcgctaccctgtcaccgcggcacaatgccccc

SEQ ID NO: 137119 - DNA, 35 bp, Artificial Sequence
  Synthetic oligonucleotide
tccaaccatccggccgtggctgtcaggccgctccc

SEQ ID NO: 137120 - DNA, 35 bp, Artificial Sequence
  Synthetic oligonucleotide
gcgactgccttacttcatgtatagctcccatctcc

SEQ ID NO: 137121 - DNA, 35 bp, Artificial Sequence
  Synthetic oligonucleotide
atatcccgccccctctttgagtttaccgttctcgc

SEQ ID NO: 137122 - DNA, 35 bp, Artificial Sequence
  Synthetic oligonucleotide
ttagtgtatcccgcccgtgtcctccttttgcctgc

SEQ ID NO: 137123 - DNA, 35 bp, Artificial Sequence
  Synthetic oligonucleotide
gaagggagggcgggagggattatgtatcggcgtgc

SEQ ID NO: 137124 - DNA, 35 bp, Artificial Sequence
  Synthetic oligonucleotide
ttaccgctctcatcatttgccgcccctgaactgtc

SEQ ID NO: 137125 - DNA, 35 bp, Artificial Sequence
  Synthetic oligonucleotide
tatcccaccgccccccagtatctgaccccaccgag

SEQ ID NO: 137126 - DNA, 36 bp, Artificial Sequence
  Synthetic oligonucleotide
gtgctgctgcagcttattgcccacgcctcctccacg

SEQ ID NO: 137127 - DNA, 35 bp, Artificial Sequence
  Synthetic oligonucleotide
atcgacccttcaccgccacttatgaccaattgtcg

SEQ ID NO: 137128 - DNA, 35 bp, Artificial Sequence
  Synthetic oligonucleotide
acgccccactagctgcattccttcgttccctgttg

SEQ ID NO: 137129 - DNA, 35 bp, Artificial Sequence
  Synthetic oligonucleotide
gctggctgtcaggtgcttgcttacgtctcccccct

SEQ ID NO: 137130 - DNA, 35 bp, Artificial Sequence
  Synthetic oligonucleotide
gagcaccttgacatccctgtgtttttgcccccgct

SEQ ID NO: 137131 - DNA, 35 bp, Artificial Sequence
  Synthetic oligonucleotide
gacttgcccggcctggtactcacacatcctcatgt

SEQ ID NO: 137132 - DNA, 35 bp, Artificial Sequence
  Synthetic oligonucleotide
aggggcgggggaccagggtggggaagggaagcttt

SEQ ID NO: 137133 - DNA, 35 bp, Artificial Sequence
  Synthetic oligonucleotide
gtgcgccgacaggccccgcgcccctaccaatgcca

SEQ ID NO: 137134 - DNA, 35 bp, Artificial Sequence
  Synthetic oligonucleotide
ttagctcccgcacccgtccagctctctccgtagca

SEQ ID NO: 137135 - DNA, 36 bp, Artificial Sequence
  Synthetic oligonucleotide
gtacatccccgtcgctgcaattgccccttaagcgca

SEQ ID NO: 137136 - DNA, 36 bp, Artificial Sequence
  Synthetic oligonucleotide
tcacctcgccaccattcatgagaaacacccgactca

SEQ ID NO: 137137 - DNA, 36 bp, Artificial Sequence
  Synthetic oligonucleotide
gccacccattctgctcgcctcctaacacgacggtca

SEQ ID NO: 137138 - DNA, 37 bp, Artificial Sequence
  Synthetic oligonucleotide
ttgggggggaatggggtgggtagccacggggagaaga

SEQ ID NO: 137139 - DNA, 37 bp, Artificial Sequence
  Synthetic oligonucleotide
gatcacaccctgttcaccacgcaccctctcagtgcga

SEQ ID NO: 137140 - DNA, 37 bp, Artificial Sequence
  Synthetic oligonucleotide
aacgcctcacattgtcacacccggcgcccccccagga

SEQ ID NO: 137141 - DNA, 37 bp, Artificial Sequence
  Synthetic oligonucleotide
gggggtccgtaggaaacgttttttggggtggcgggga

SEQ ID NO: 137142 - DNA, 36 bp, Artificial Sequence
  Synthetic oligonucleotide
atgacgaccctcgttcgtttactatctcatccctga

SEQ ID NO: 137143 - DNA, 38 bp, Artificial Sequence
  Synthetic oligonucleotide
aagtgccggggggggcggacaaggagaagaagttgtga

SEQ ID NO: 137144 - DNA, 37 bp, Artificial Sequence
  Synthetic oligonucleotide
accctgcccctcttctcacatcactggcagtcattga

SEQ ID NO: 137145 - DNA, 35 bp, Artificial Sequence
  Synthetic oligonucleotide
tcaccactggtttggtttgagctcccacgccctta

SEQ ID NO: 137146 - DNA, 35 bp, Artificial Sequence
  Synthetic oligonucleotide
gactccaccgccgggctcaaccttgggcatgttac

SEQ ID NO: 137147 - DNA, 35 bp, Artificial Sequence
  Synthetic oligonucleotide
tctcatgcctgctcctcgtaatttctgaactcgcc

SEQ ID NO: 137148 - DNA, 35 bp, Artificial Sequence
  Synthetic oligonucleotide
aatgtcacggccttactgctaaacctcgccctgcc

SEQ ID NO: 137149 - DNA, 35 bp, Artificial Sequence
  Synthetic oligonucleotide
gcacgctgtggcactttggcccacgtcgttcctcc

SEQ ID NO: 137150 - DNA, 35 bp, Artificial Sequence
  Synthetic oligonucleotide
tgttcacctgtccccgctgagtcccctatccaagc

SEQ ID NO: 137151 - DNA, 35 bp, Artificial Sequence
  Synthetic oligonucleotide
tgtacgacatcgagtcatcacttactcctcctggc

SEQ ID NO: 137152 - DNA, 35 bp, Artificial Sequence
  Synthetic oligonucleotide
tagtacacccgttcgctctcaaatcccgctctggc

SEQ ID NO: 137153 - DNA, 35 bp, Artificial Sequence
  Synthetic oligonucleotide
ggagtctcagcccctagccaccatagtaccgcctc

SEQ ID NO: 137154 - DNA, 35 bp, Artificial Sequence
  Synthetic oligonucleotide
gacatgtctgagttccttaccaccatcttacactg

SEQ ID NO: 137155 - DNA, 35 bp, Artificial Sequence
  Synthetic oligonucleotide
tacgcgctcgagccccactttgccaccactctgtg

SEQ ID NO: 137156 - DNA, 35 bp, Artificial Sequence
  Synthetic oligonucleotide
ttgggagcccagacgcccgtcctacactgccgcct

SEQ ID NO: 137157 - DNA, 34 bp, Artificial Sequence
  Synthetic oligonucleotide
taacctcgaccatccttgaacccggccctcttgt

SEQ ID NO: 137158 - DNA, 36 bp, Artificial Sequence
  Synthetic oligonucleotide
tccccaccacccaatgtcctacaagattatatcaaa

SEQ ID NO: 137159 - DNA, 36 bp, Artificial Sequence
  Synthetic oligonucleotide
gccggtcagtctgtccgcaacgcccccccgttcaca

SEQ ID NO: 137160 - DNA, 36 bp, Artificial Sequence
  Synthetic oligonucleotide
aagggaggtagggaggggaagggccgttaaatagca

SEQ ID NO: 137161 - DNA, 37 bp, Artificial Sequence
  Synthetic oligonucleotide
tcctgggcgtagcctgtgtcccttcccgttcctccga

SEQ ID NO: 137162 - DNA, 37 bp, Artificial Sequence
  Synthetic oligonucleotide
aagggggggagtggtggcggacgacatgctgggggga

SEQ ID NO: 137163 - DNA, 37 bp, Artificial Sequence
  Synthetic oligonucleotide
agccaaggggtacgtacggggaagaaggaggcggtga

SEQ ID NO: 137164 - DNA, 36 bp, Artificial Sequence
  Synthetic oligonucleotide
ttgacctctcgccatctttgtcctaccctcgaccta

SEQ ID NO: 137165 - DNA, 36 bp, Artificial Sequence
  Synthetic oligonucleotide
ggggaaggggtgggagcgggtgcgagtaggggccta

SEQ ID NO: 137166 - DNA, 35 bp, Artificial Sequence
  Synthetic oligonucleotide
tgccaccgtaaagactctctacgtccctgcttaac

SEQ ID NO: 137167 - DNA, 35 bp, Artificial Sequence
  Synthetic oligonucleotide
gcactgtcactgtatgaccgtagtccgttccaccc

SEQ ID NO: 137168 - DNA, 35 bp, Artificial Sequence
  Synthetic oligonucleotide
tgttcatcgccttcccgacgcctttctacctcgcc

SEQ ID NO: 137169 - DNA, 35 bp, Artificial Sequence
  Synthetic oligonucleotide
tctcccctcactcaggtcgataaatccctcgtgcc

SEQ ID NO: 137170 - DNA, 35 bp, Artificial Sequence
  Synthetic oligonucleotide
gctctgtagccttccccattatgttttgcccgtcc

SEQ ID NO: 137171 - DNA, 35 bp, Artificial Sequence
  Synthetic oligonucleotide
gccatcccgcactaggttctccccttctttcatgc

SEQ ID NO: 137172 - DNA, 35 bp, Artificial Sequence
  Synthetic oligonucleotide
gactcatccgctatccgtaatcgcgcccaggtatc

SEQ ID NO: 137173 - DNA, 34 bp, Artificial Sequence
  Synthetic oligonucleotide
agtatacaccccgctctgccactcatgccggttc

SEQ ID NO: 137174 - DNA, 35 bp, Artificial Sequence
  Synthetic oligonucleotide
gaacgccgcctggcaccgaactcattgcacttttc

SEQ ID NO: 137175 - DNA, 35 bp, Artificial Sequence
  Synthetic oligonucleotide
gggaggataacgggaggggttggaagtgggtgcgg

SEQ ID NO: 137176 - DNA, 35 bp, Artificial Sequence
  Synthetic oligonucleotide
tgcctgtgcactcgtgtgcccccgcacccttcctg

SEQ ID NO: 137177 - DNA, 35 bp, Artificial Sequence
  Synthetic oligonucleotide
gcacttgccccatgaccatacccgagcatccacct

SEQ ID NO: 137178 - DNA, 35 bp, Artificial Sequence
  Synthetic oligonucleotide
agacgccgtactcgccgactgtctgttatccccct

SEQ ID NO: 137179 - DNA, 35 bp, Artificial Sequence
  Synthetic oligonucleotide
caaggcccaccctccctgaccgctgcttctctgct

SEQ ID NO: 137180 - DNA, 35 bp, Artificial Sequence
  Synthetic oligonucleotide
tccacacctaggtctgtcccatgcctgatcgctct

SEQ ID NO: 137181 - DNA, 35 bp, Artificial Sequence
  Synthetic oligonucleotide
ggtggacgggggataatggggaatggtgagcacgt

SEQ ID NO: 137182 - DNA, 35 bp, Artificial Sequence
  Synthetic oligonucleotide
accaccacccccagcgtttcgcgcacagtaacgtt

SEQ ID NO: 137183 - DNA, 35 bp, Artificial Sequence
  Synthetic oligonucleotide
gttcctcacatccgtgaattggtcgcccccacttt

SEQ ID NO: 137184 - DNA, 36 bp, Artificial Sequence
  Synthetic oligonucleotide
taccctacgtcccctacgccctgcccttgtcgcaca

SEQ ID NO: 137185 - DNA, 36 bp, Artificial Sequence
  Synthetic oligonucleotide
gtacactccgttgcacccgccctgaagccccctcca

SEQ ID NO: 137186 - DNA, 35 bp, Artificial Sequence
  Synthetic oligonucleotide
taggccactcgtacaactgctgacaccccccctca

SEQ ID NO: 137187 - DNA, 36 bp, Artificial Sequence
  Synthetic oligonucleotide
ttgagcaacccactcctcacatgcgatatgtcctca

SEQ ID NO: 137188 - DNA, 36 bp, Artificial Sequence
  Synthetic oligonucleotide
tgcctatcctctatgtgtagtccactctctccgtca

SEQ ID NO: 137189 - DNA, 36 bp, Artificial Sequence
  Synthetic oligonucleotide
gtctgcgcatgttacgttaacttcccccgttcttca

SEQ ID NO: 137190 - DNA, 35 bp, Artificial Sequence
  Synthetic oligonucleotide
gttcgcccccgtgtctccatcaccccagaccacga

SEQ ID NO: 137191 - DNA, 37 bp, Artificial Sequence
  Synthetic oligonucleotide
ccgtgtgccagcctatccgaacgcccatgcccgccga

SEQ ID NO: 137192 - DNA, 37 bp, Artificial Sequence
  Synthetic oligonucleotide
tgtcgacctcacgcattcccaccaccctccccggcga

SEQ ID NO: 137193 - DNA, 37 bp, Artificial Sequence
  Synthetic oligonucleotide
atcgagggggatggagtagggatgggggaggcttcga

SEQ ID NO: 137194 - DNA, 36 bp, Artificial Sequence
  Synthetic oligonucleotide
gtgctcacttctcacctgcccgtctcctccatcgga

SEQ ID NO: 137195 - DNA, 37 bp, Artificial Sequence
  Synthetic oligonucleotide
tttggggtcgagaggggtatcttaagggggttgggga

SEQ ID NO: 137196 - DNA, 37 bp, Artificial Sequence
  Synthetic oligonucleotide
gcagtgggggaggaggggggtgtacactggcggtgga

SEQ ID NO: 137197 - DNA, 35 bp, Artificial Sequence
  Synthetic oligonucleotide
acaatgatgtcggcgggtggggccggggaattgga

SEQ ID NO: 137198 - DNA, 38 bp, Artificial Sequence
  Synthetic oligonucleotide
ggacccgcccttgatccatccatccgtcactcttatga

SEQ ID NO: 137199 - DNA, 36 bp, Artificial Sequence
  Synthetic oligonucleotide
actcacgaagggggaaaaagcagggagagccaacta

SEQ ID NO: 137200 - DNA, 35 bp, Artificial Sequence
  Synthetic oligonucleotide
gatccactatcaatgtcccgtacgcactttcacac

SEQ ID NO: 137201 - DNA, 35 bp, Artificial Sequence
  Synthetic oligonucleotide
tacacctcagccgtatcgccaccactctccagtcc

SEQ ID NO: 137202 - DNA, 35 bp, Artificial Sequence
  Synthetic oligonucleotide
tcctcaccggaacctgtagcctgcccctatttagc

SEQ ID NO: 137203 - DNA, 34 bp, Artificial Sequence
  Synthetic oligonucleotide
atcattcgcccccaccacccgttctcagtcacgc

SEQ ID NO: 137204 - DNA, 35 bp, Artificial Sequence
  Synthetic oligonucleotide
tcccatctcctgtgtcttttcgcatgatcctccgc

SEQ ID NO: 137205 - DNA, 35 bp, Artificial Sequence
  Synthetic oligonucleotide
tgcaccatcatgcctgctccatgcctcgctgctgc

SEQ ID NO: 137206 - DNA, 35 bp, Artificial Sequence
  Synthetic oligonucleotide
acacccactgagcccttccgaatgcatcctacatc

SEQ ID NO: 137207 - DNA, 35 bp, Artificial Sequence
  Synthetic oligonucleotide
gcctgccccttgttctgtatcccttcctggctctc

SEQ ID NO: 137208 - DNA, 35 bp, Artificial Sequence
  Synthetic oligonucleotide
gcataccctctggtccacatccagtccaccttccg

SEQ ID NO: 137209 - DNA, 35 bp, Artificial Sequence
  Synthetic oligonucleotide
gtggggactctgcggaaggaaacgggtgggtgggg

SEQ ID NO: 137210 - DNA, 35 bp, Artificial Sequence
  Synthetic oligonucleotide
gagctgattctcctcgcctccctcacccgtacctg

SEQ ID NO: 137211 - DNA, 35 bp, Artificial Sequence
  Synthetic oligonucleotide
tgtgtactcccgaaccttgccctcccgccgggact

SEQ ID NO: 137212 - DNA, 35 bp, Artificial Sequence
  Synthetic oligonucleotide
atgccactgctttcggtctataggtttctccgcct

SEQ ID NO: 137213 - DNA, 35 bp, Artificial Sequence
  Synthetic oligonucleotide
acacgcctccgttacgtttcgtacgcccttcattt

SEQ ID NO: 137214 - DNA, 29 bp, Artificial Sequence
  Synthetic oligonucleotide
tccgcactgccaccttgatcaccatcttt

SEQ ID NO: 137215 - DNA, 35 bp, Artificial Sequence
  Synthetic oligonucleotide
gccaccggtccataagcccgccacccctcccgttt

SEQ ID NO: 137216 - DNA, 36 bp, Artificial Sequence
  Synthetic oligonucleotide
tactgtcgggagggtgggcgaaaggggctggttaaa

SEQ ID NO: 137217 - DNA, 35 bp, Artificial Sequence
  Synthetic oligonucleotide
tgagagtcgccccatacttccctgttgtccgtgaa

SEQ ID NO: 137218 - DNA, 36 bp, Artificial Sequence
  Synthetic oligonucleotide
gtcgccctgccctgttgaccgcgaagcatccttaca

SEQ ID NO: 137219 - DNA, 35 bp, Artificial Sequence
  Synthetic oligonucleotide
agccaccgcccgctgcgaggctagcccaattccca

SEQ ID NO: 137220 - DNA, 35 bp, Artificial Sequence
  Synthetic oligonucleotide
gacgacccgacgtactacttttgcatttctcgcca

SEQ ID NO: 137221 - DNA, 37 bp, Artificial Sequence
  Synthetic oligonucleotide
acctcccaccgcccggaaaccctcctctggacagaga

SEQ ID NO: 137222 - DNA, 35 bp, Artificial Sequence
  Synthetic oligonucleotide
gtgtaggggaggggcggggtgcggtatgaaataga

SEQ ID NO: 137223 - DNA, 36 bp, Artificial Sequence
  Synthetic oligonucleotide
gtggggggacgggaagggatgtaacaagagtggcga

SEQ ID NO: 137224 - DNA, 37 bp, Artificial Sequence
  Synthetic oligonucleotide
gaaggggatcaaggagagcgggagcgaggaagaagga

SEQ ID NO: 137225 - DNA, 37 bp, Artificial Sequence
  Synthetic oligonucleotide
gtgcggtgggggggtgggttaggctttaaactacgga

SEQ ID NO: 137226 - DNA, 36 bp, Artificial Sequence
  Synthetic oligonucleotide
acgctcaagcgctagtcgcccgccctttactcctga

SEQ ID NO: 137227 - DNA, 38 bp, Artificial Sequence
  Synthetic oligonucleotide
tgtgacagaaggggggtgaaggggaggaaggttggtga

SEQ ID NO: 137228 - DNA, 36 bp, Artificial Sequence
  Synthetic oligonucleotide
ggagccgggaaggagggaaggggtcaggggttaata

SEQ ID NO: 137229 - DNA, 36 bp, Artificial Sequence
  Synthetic oligonucleotide
atccgaccaccgcccactgtttctccccggctccta

SEQ ID NO: 137230 - DNA, 36 bp, Artificial Sequence
  Synthetic oligonucleotide
agacgaccccgccggtggatcgcctcccctctctta

SEQ ID NO: 137231 - DNA, 35 bp, Artificial Sequence
  Synthetic oligonucleotide
ggatctagcacctctcgccgccccgacccgcttta

SEQ ID NO: 137232 - DNA, 35 bp, Artificial Sequence
  Synthetic oligonucleotide
accacgccaaggcggtatcatctagcctcatacac

SEQ ID NO: 137233 - DNA, 30 bp, Artificial Sequence
  Synthetic oligonucleotide
acgtggttcctccgcccctctgaatccccc

SEQ ID NO: 137234 - DNA, 35 bp, Artificial Sequence
  Synthetic oligonucleotide
acagtcgatggttattgctccgtgccctttgcccc

SEQ ID NO: 137235 - DNA, 35 bp, Artificial Sequence
  Synthetic oligonucleotide
taccggaccgcacgtgacgtcgctgcctcctcccc

SEQ ID NO: 137236 - DNA, 35 bp, Artificial Sequence
  Synthetic oligonucleotide
gtgtggtcgccccaatcgtattttagctcctcccc

SEQ ID NO: 137237 - DNA, 35 bp, Artificial Sequence
  Synthetic oligonucleotide
gctgcacgatccctggcccttgtgtcgctcacgcc

SEQ ID NO: 137238 - DNA, 35 bp, Artificial Sequence
  Synthetic oligonucleotide
tgatcccctatcgtgttcgtgcctggcacgtttcc

SEQ ID NO: 137239 - DNA, 35 bp, Artificial Sequence
  Synthetic oligonucleotide
actgcaacacctgaatcgtccattaccccggttgc

SEQ ID NO: 137240 - DNA, 35 bp, Artificial Sequence
  Synthetic oligonucleotide
tactgctgcgtaccttgcttagtatctccgtcctc

SEQ ID NO: 137241 - DNA, 35 bp, Artificial Sequence
  Synthetic oligonucleotide
gactcagtgactggtacctgccttccctcgttctc

SEQ ID NO: 137242 - DNA, 35 bp, Artificial Sequence
  Synthetic oligonucleotide
gccctcccatccgtggcaccggatttcatttcccg

SEQ ID NO: 137243 - DNA, 35 bp, Artificial Sequence
  Synthetic oligonucleotide
gtccacaccggcccgctttgcgacacccatctgcg

SEQ ID NO: 137244 - DNA, 35 bp, Artificial Sequence
  Synthetic oligonucleotide
gacccccactacgcgaatttaaacatgccctcctg

SEQ ID NO: 137245 - DNA, 35 bp, Artificial Sequence
  Synthetic oligonucleotide
gacacctctccagtgttgtacactgactcgcacct

SEQ ID NO: 137246 - DNA, 36 bp, Artificial Sequence
  Synthetic oligonucleotide
gattgcaggagaggacacagggagggggggatcaaa

SEQ ID NO: 137247 - DNA, 36 bp, Artificial Sequence
  Synthetic oligonucleotide
atccatccgcaccccgtactgttctcgacgctcaca

SEQ ID NO: 137248 - DNA, 36 bp, Artificial Sequence
  Synthetic oligonucleotide
tcgactcctcctgttaacgtttaaagcccccttaca

SEQ ID NO: 137249 - DNA, 36 bp, Artificial Sequence
  Synthetic oligonucleotide
gatgtgcgccttgccttcttctgcccagactcctca

SEQ ID NO: 137250 - DNA, 36 bp, Artificial Sequence
  Synthetic oligonucleotide
ttgcacttcgcgtatcgcttataaccgtcctcctca

SEQ ID NO: 137251 - DNA, 36 bp, Artificial Sequence
  Synthetic oligonucleotide
gaccgggaaagggataaggatagggtgcagagttca

SEQ ID NO: 137252 - DNA, 36 bp, Artificial Sequence
  Synthetic oligonucleotide
tacactcctcacctgtcaaatatagccacctcaaga

SEQ ID NO: 137253 - DNA, 37 bp, Artificial Sequence
  Synthetic oligonucleotide
gggggaaggggaggcggtagggtagagacaatataga

SEQ ID NO: 137254 - DNA, 36 bp, Artificial Sequence
  Synthetic oligonucleotide
ttagcactgctcgcgtcagcattccctcctacccga

SEQ ID NO: 137255 - DNA, 37 bp, Artificial Sequence
  Synthetic oligonucleotide
tagagttcggaggaagggagttggagtgggtgtggga

SEQ ID NO: 137256 - DNA, 37 bp, Artificial Sequence
  Synthetic oligonucleotide
acaccacccccacacgctttcctctcctgtcagtgga

SEQ ID NO: 137257 - DNA, 38 bp, Artificial Sequence
  Synthetic oligonucleotide
gcctctccgcccccctataagcgtcccgttacgcatga

SEQ ID NO: 137258 - DNA, 38 bp, Artificial Sequence
  Synthetic oligonucleotide
tccgtccaccgccagccactccccgcccgttcggatga

SEQ ID NO: 137259 - DNA, 38 bp, Artificial Sequence
  Synthetic oligonucleotide
tgtggtcctccgtaacatgccataaccacctctcctga

SEQ ID NO: 137260 - DNA, 36 bp, Artificial Sequence
  Synthetic oligonucleotide
tccccactggcccccactgatctactctctctgtga

SEQ ID NO: 137261 - DNA, 35 bp, Artificial Sequence
  Synthetic oligonucleotide
gcccgcattgcctcctgtattcatcctggccgcac

SEQ ID NO: 137262 - DNA, 35 bp, Artificial Sequence
  Synthetic oligonucleotide
atcgaccgatcacccgttgacttacactgttgcac

SEQ ID NO: 137263 - DNA, 35 bp, Artificial Sequence
  Synthetic oligonucleotide
accttaccccgcctggcccctttggttagtactac

SEQ ID NO: 137264 - DNA, 35 bp, Artificial Sequence
  Synthetic oligonucleotide
gtactgcaggcccctctgaattgccagttctctac

SEQ ID NO: 137265 - DNA, 35 bp, Artificial Sequence
  Synthetic oligonucleotide
gacacccctcctgcctgtggacgccatcatacacc

SEQ ID NO: 137266 - DNA, 35 bp, Artificial Sequence
  Synthetic oligonucleotide
accccccgcaggtgctgtcttgcctgcccctcacc

SEQ ID NO: 137267 - DNA, 35 bp, Artificial Sequence
  Synthetic oligonucleotide
tgcaaacgcaccatgttgttatcctctatcgtccc

SEQ ID NO: 137268 - DNA, 35 bp, Artificial Sequence
  Synthetic oligonucleotide
tcgatccaccacctccatcttagctggccgaagcc

SEQ ID NO: 137269 - DNA, 35 bp, Artificial Sequence
  Synthetic oligonucleotide
tgacaccctcttgtccgttgttccgctccttccgc

SEQ ID NO: 137270 - DNA, 35 bp, Artificial Sequence
  Synthetic oligonucleotide
tgtggctcacttccattgctatcgaaacctctggc

SEQ ID NO: 137271 - DNA, 35 bp, Artificial Sequence
  Synthetic oligonucleotide
tccgacacttcggaccaatcttgccctgctcttgc

SEQ ID NO: 137272 - DNA, 35 bp, Artificial Sequence
  Synthetic oligonucleotide
atcgcacctcaaaggtctactctctctgtactctc

SEQ ID NO: 137273 - DNA, 35 bp, Artificial Sequence
  Synthetic oligonucleotide
gtacgccacccctcattgttacccagtgatcaacg

SEQ ID NO: 137274 - DNA, 35 bp, Artificial Sequence
  Synthetic oligonucleotide
gttaacccgcactttgtcagccaccaccctgcccg

SEQ ID NO: 137275 - DNA, 35 bp, Artificial Sequence
  Synthetic oligonucleotide
ttcgtcctggcctctttacatcttcacctgttcgg

SEQ ID NO: 137276 - DNA, 35 bp, Artificial Sequence
  Synthetic oligonucleotide
agcggggtgggctgggggcgggacgagcttacatg

SEQ ID NO: 137277 - DNA, 35 bp, Artificial Sequence
  Synthetic oligonucleotide
acatgcggtgccctccttgtcatactgattccatg

SEQ ID NO: 137278 - DNA, 35 bp, Artificial Sequence
  Synthetic oligonucleotide
taagatgtgtcccgtcgtcccgcccacctcatcat

SEQ ID NO: 137279 - DNA, 35 bp, Artificial Sequence
  Synthetic oligonucleotide
gtcgccaccggagtcctaagcgcatcgctccatct

SEQ ID NO: 137280 - DNA, 35 bp, Artificial Sequence
  Synthetic oligonucleotide
tgtctatgcccgaccgcgattacacgcacacctct

SEQ ID NO: 137281 - DNA, 35 bp, Artificial Sequence
  Synthetic oligonucleotide
ttactcacccgccgtcttcgcccatcctagtgtct

SEQ ID NO: 137282 - DNA, 35 bp, Artificial Sequence
  Synthetic oligonucleotide
tgctccccctgttcgctatccattcctacttctgt

SEQ ID NO: 137283 - DNA, 35 bp, Artificial Sequence
  Synthetic oligonucleotide
gatgaaggcccctgcctacctgtacatatgccctt

SEQ ID NO: 137284 - DNA, 35 bp, Artificial Sequence
  Synthetic oligonucleotide
gcgaacaccatcgatcgacgttccgtttttccttt

SEQ ID NO: 137285 - DNA, 36 bp, Artificial Sequence
  Synthetic oligonucleotide
accaatcccgcccacctgctccacgacagtttgcaa

SEQ ID NO: 137286 - DNA, 36 bp, Artificial Sequence
  Synthetic oligonucleotide
tacctgccggtggggggtaaaatgctggggagggaa

SEQ ID NO: 137287 - DNA, 35 bp, Artificial Sequence
  Synthetic oligonucleotide
gagtcccccccgcatatcgcccgcctccttgctca

SEQ ID NO: 137288 - DNA, 36 bp, Artificial Sequence
  Synthetic oligonucleotide
agagtgggaacgggggatgcgggaatgatgggcgga

SEQ ID NO: 137289 - DNA, 36 bp, Artificial Sequence
  Synthetic oligonucleotide
agacggtcggccgtcacctgcaacccccctccctga

SEQ ID NO: 137290 - DNA, 37 bp, Artificial Sequence
  Synthetic oligonucleotide
agccaccatctggtacaccactacacccactttgtga

SEQ ID NO: 137291 - DNA, 38 bp, Artificial Sequence
  Synthetic oligonucleotide
tccacgcccttgtctcttcagcgcacatcagccattga

SEQ ID NO: 137292 - DNA, 38 bp, Artificial Sequence
  Synthetic oligonucleotide
gacatgggagcaggaggcatgtttggggcgggggttga

SEQ ID NO: 137293 - DNA, 38 bp, Artificial Sequence
  Synthetic oligonucleotide
agcgccgccgctatgccttccgttgcttttcactttga

SEQ ID NO: 137294 - DNA, 36 bp, Artificial Sequence
  Synthetic oligonucleotide
acacccccgactcgctctgcgttagcccaattcata

SEQ ID NO: 137295 - DNA, 36 bp, Artificial Sequence
  Synthetic oligonucleotide
aaacacgggcgagagggggggggctgaggagattta

SEQ ID NO: 137296 - DNA, 35 bp, Artificial Sequence
  Synthetic oligonucleotide
tccctcgcccggacttagaattcgatcccctcaac

SEQ ID NO: 137297 - DNA, 35 bp, Artificial Sequence
  Synthetic oligonucleotide
gccaacgctttgccacggtttttgatacaccaccc

SEQ ID NO: 137298 - DNA, 35 bp, Artificial Sequence
  Synthetic oligonucleotide
gcctggccatttcttgagttttcgcgccccgcccc

SEQ ID NO: 137299 - DNA, 35 bp, Artificial Sequence
  Synthetic oligonucleotide
gtgatcggctcactggtaccccctattttcgcccc

SEQ ID NO: 137300 - DNA, 35 bp, Artificial Sequence
  Synthetic oligonucleotide
accgatgtcccaccccgaactttatatcgtgcccc

SEQ ID NO: 137301 - DNA, 35 bp, Artificial Sequence
  Synthetic oligonucleotide
gatcactcacatacgttgcccggcctcttggtgcc

SEQ ID NO: 137302 - DNA, 35 bp, Artificial Sequence
  Synthetic oligonucleotide
tagcgggccccccaagtaccttctctccgttgagc

SEQ ID NO: 137303 - DNA, 35 bp, Artificial Sequence
  Synthetic oligonucleotide
taacatcacaccttcctgcgcgcccgggcacccgc

SEQ ID NO: 137304 - DNA, 35 bp, Artificial Sequence
  Synthetic oligonucleotide
gggaccacatcccgcctgttcattgcgcatcgctc

SEQ ID NO: 137305 - DNA, 35 bp, Artificial Sequence
  Synthetic oligonucleotide
gcccacttatccgccgtgtgtcgcccgttaaattc

SEQ ID NO: 137306 - DNA, 35 bp, Artificial Sequence
  Synthetic oligonucleotide
actccccactagttgtggcactaccacgcaccccg

SEQ ID NO: 137307 - DNA, 35 bp, Artificial Sequence
  Synthetic oligonucleotide
tcaggcccgcccccgttggctaacaaaccgttttt

SEQ ID NO: 137308 - DNA, 35 bp, Artificial Sequence
  Synthetic oligonucleotide
gcaaacgccgatccttgcctcattcttattcgcca

SEQ ID NO: 137309 - DNA, 35 bp, Artificial Sequence
  Synthetic oligonucleotide
tgccacggtctctccatatcatttgcccgcctcca

SEQ ID NO: 137310 - DNA, 35 bp, Artificial Sequence
  Synthetic oligonucleotide
acgccctctccacactgtcatcttggtaggttcca

SEQ ID NO: 137311 - DNA, 36 bp, Artificial Sequence
  Synthetic oligonucleotide
gagacaactccacctgctactaatgcccccgcagca

SEQ ID NO: 137312 - DNA, 36 bp, Artificial Sequence
  Synthetic oligonucleotide
gagaatgaagcaggggggagatagggaaccttagga

SEQ ID NO: 137313 - DNA, 37 bp, Artificial Sequence
  Synthetic oligonucleotide
gccctatcgccccgctcatccctcactctccgcgtga

SEQ ID NO: 137314 - DNA, 38 bp, Artificial Sequence
  Synthetic oligonucleotide
gcaacacgggcggggaataatgggtggggtatcggtga

SEQ ID NO: 137315 - DNA, 38 bp, Artificial Sequence
  Synthetic oligonucleotide
atgccctatccagcttggtaatgccccatcccacttga

SEQ ID NO: 137316 - DNA, 35 bp, Artificial Sequence
  Synthetic oligonucleotide
tcaacccgatccgaaacttgcgcgcctgcccccta

SEQ ID NO: 137317 - DNA, 35 bp, Artificial Sequence
  Synthetic oligonucleotide
gttactgccgtcacccccgtcaatttttccaccac

SEQ ID NO: 137318 - DNA, 35 bp, Artificial Sequence
  Synthetic oligonucleotide
tccaattgccccgtttcgttatgtaccgttccccc

SEQ ID NO: 137319 - DNA, 35 bp, Artificial Sequence
  Synthetic oligonucleotide
tccccctagcagaaggaccatgactccccgccgcc

SEQ ID NO: 137320 - DNA, 35 bp, Artificial Sequence
  Synthetic oligonucleotide
ttcagccctgcagcgcgtacgttcccgtgttgtcc

SEQ ID NO: 137321 - DNA, 35 bp, Artificial Sequence
  Synthetic oligonucleotide
gcatgtggtcctgtcattgtcacccttgtttgtcc

SEQ ID NO: 137322 - DNA, 35 bp, Artificial Sequence
  Synthetic oligonucleotide
gcgcccactttggtgcctataaccagttccgttcc

SEQ ID NO: 137323 - DNA, 35 bp, Artificial Sequence
  Synthetic oligonucleotide
acgaacacaccacacgaaccgtagcattaccactc

SEQ ID NO: 137324 - DNA, 35 bp, Artificial Sequence
  Synthetic oligonucleotide
ggaggtgacctggaaagaatgggaaggatggggag

SEQ ID NO: 137325 - DNA, 35 bp, Artificial Sequence
  Synthetic oligonucleotide
gcacatctggccctttgcatgtcctctctcttact

SEQ ID NO: 137326 - DNA, 35 bp, Artificial Sequence
  Synthetic oligonucleotide
gatcccccctctacctcgccttctggcattgtgct

SEQ ID NO: 137327 - DNA, 35 bp, Artificial Sequence
  Synthetic oligonucleotide
gcccacccgtactatcctgggagatttacttttct

SEQ ID NO: 137328 - DNA, 35 bp, Artificial Sequence
  Synthetic oligonucleotide
agatacacgagaggagctagagggaggggcatggt

SEQ ID NO: 137329 - DNA, 35 bp, Artificial Sequence
  Synthetic oligonucleotide
tcctacgccgttcacatcttcaccctttgcgcttt

SEQ ID NO: 137330 - DNA, 36 bp, Artificial Sequence
  Synthetic oligonucleotide
tgctgcccgcccctcagaaccgtactgctccgtcca

SEQ ID NO: 137331 - DNA, 36 bp, Artificial Sequence
  Synthetic oligonucleotide
tcgcttgcccgtacggccatcgcctgctcccccgca

SEQ ID NO: 137332 - DNA, 36 bp, Artificial Sequence
  Synthetic oligonucleotide
gcaggtgcagggggggagtaggcgggggcgcgggca

SEQ ID NO: 137333 - DNA, 36 bp, Artificial Sequence
  Synthetic oligonucleotide
gtttgccagccttgtattccgtctgcgctcacctca

SEQ ID NO: 137334 - DNA, 36 bp, Artificial Sequence
  Synthetic oligonucleotide
acccgccgtgtgctctgttgtcgcagctttccctca

SEQ ID NO: 137335 - DNA, 34 bp, Artificial Sequence
  Synthetic oligonucleotide
ttccccggggcggtgctctcttccacgcgcttca

SEQ ID NO: 137336 - DNA, 37 bp, Artificial Sequence
  Synthetic oligonucleotide
ggggaggggtgagggttgcagaaacggaaggcacaga

SEQ ID NO: 137337 - DNA, 37 bp, Artificial Sequence
  Synthetic oligonucleotide
tcagcccctaatgcttgcctggctcgaccctccacga

SEQ ID NO: 137338 - DNA, 37 bp, Artificial Sequence
  Synthetic oligonucleotide
cacgacactcgctccgttgccaatggcccctctccga

SEQ ID NO: 137339 - DNA, 37 bp, Artificial Sequence
  Synthetic oligonucleotide
tacagggaggagtggtgggtaacgtatgggggaagga

SEQ ID NO: 137340 - DNA, 37 bp, Artificial Sequence
  Synthetic oligonucleotide
gttgactcatcccggcccatcgacccccgccttcgga

SEQ ID NO: 137341 - DNA, 37 bp, Artificial Sequence
  Synthetic oligonucleotide
gaaaggggaaaggacgtcaggggaacggcgggatgga

SEQ ID NO: 137342 - DNA, 37 bp, Artificial Sequence
  Synthetic oligonucleotide
acagatgtgggaggtgggtaacgctgggggaaaatga

SEQ ID NO: 137343 - DNA, 38 bp, Artificial Sequence
  Synthetic oligonucleotide
tgcaccctcttaatgtaccatttcctgccggcccctga

SEQ ID NO: 137344 - DNA, 38 bp, Artificial Sequence
  Synthetic oligonucleotide
ttgaccgttctttgcgctcatcgatccacctatcctga

SEQ ID NO: 137345 - DNA, 37 bp, Artificial Sequence
  Synthetic oligonucleotide
acgcaatccagatccagtgccccgctcctccctctga

SEQ ID NO: 137346 - DNA, 35 bp, Artificial Sequence
  Synthetic oligonucleotide
gcccagccgtcctctgttcactttggcctctctga

SEQ ID NO: 137347 - DNA, 38 bp, Artificial Sequence
  Synthetic oligonucleotide
aagtagactgggaagacgaatagggtgggagggcgtga

SEQ ID NO: 137348 - DNA, 36 bp, Artificial Sequence
  Synthetic oligonucleotide
tgtatcgccgcccgctgtatcttcctcatcttacta

SEQ ID NO: 137349 - DNA, 36 bp, Artificial Sequence
  Synthetic oligonucleotide
tcgagtcgccattgcccatactccaaactcgttcta

SEQ ID NO: 137350 - DNA, 35 bp, Artificial Sequence
  Synthetic oligonucleotide
agacagacatctgcatttgctcggcgcccccacac

SEQ ID NO: 137351 - DNA, 35 bp, Artificial Sequence
  Synthetic oligonucleotide
gaaccaccctcgccgtgcgagcgtattatgaccac

SEQ ID NO: 137352 - DNA, 35 bp, Artificial Sequence
  Synthetic oligonucleotide
acgatcgccctgacggttcccatccgagtacccac

SEQ ID NO: 137353 - DNA, 35 bp, Artificial Sequence
  Synthetic oligonucleotide
gtgccgttgctatcccctggcgtacctccgttcac

SEQ ID NO: 137354 - DNA, 35 bp, Artificial Sequence
  Synthetic oligonucleotide
gcgaccacgccaccctggctgttccacctcatgac

SEQ ID NO: 137355 - DNA, 35 bp, Artificial Sequence
  Synthetic oligonucleotide
ttcgcccgcctcacgacatgattgggcctctctac

SEQ ID NO: 137356 - DNA, 35 bp, Artificial Sequence
  Synthetic oligonucleotide
tgagtgtcctatcttgccttaactgcagctccacc

SEQ ID NO: 137357 - DNA, 35 bp, Artificial Sequence
  Synthetic oligonucleotide
gttgcccttccctgttggtcacttgctatataccc

SEQ ID NO: 137358 - DNA, 33 bp, Artificial Sequence
  Synthetic oligonucleotide
gttcgggccgggtttctcacgcgccacctcccc

SEQ ID NO: 137359 - DNA, 35 bp, Artificial Sequence
  Synthetic oligonucleotide
tatgcaccacaatttggccgtacctttgttacctc

SEQ ID NO: 137360 - DNA, 35 bp, Artificial Sequence
  Synthetic oligonucleotide
tatgtggcgacaatgctatttttcgcgtccctttc

SEQ ID NO: 137361 - DNA, 35 bp, Artificial Sequence
  Synthetic oligonucleotide
acgccagggcccggcgtaactccatcttagctttc

SEQ ID NO: 137362 - DNA, 35 bp, Artificial Sequence
  Synthetic oligonucleotide
ttgacaagcgttatcccgtgccttttctccactcg

SEQ ID NO: 137363 - DNA, 35 bp, Artificial Sequence
  Synthetic oligonucleotide
atatccttcgcacatcctcgttgagccacctctcg

SEQ ID NO: 137364 - DNA, 35 bp, Artificial Sequence
  Synthetic oligonucleotide
gtcacccgcccccccgctttagaaccgatatgtcg

SEQ ID NO: 137365 - DNA, 35 bp, Artificial Sequence
  Synthetic oligonucleotide
gacgtcacttctagacacactggtgccccccctct

SEQ ID NO: 137366 - DNA, 35 bp, Artificial Sequence
  Synthetic oligonucleotide
accctcccgcagcccccgacgtctcccccggtgaa

SEQ ID NO: 137367 - DNA, 35 bp, Artificial Sequence
  Synthetic oligonucleotide
gcgaatgtgtagagggggagaaatagggggagtaa

SEQ ID NO: 137368 - DNA, 35 bp, Artificial Sequence
  Synthetic oligonucleotide
actatcgcctcacacagtgtacgccgtccttgcca

SEQ ID NO: 137369 - DNA, 36 bp, Artificial Sequence
  Synthetic oligonucleotide
atctgcgcgggcggaacggggagaaggggagtcgca

SEQ ID NO: 137370 - DNA, 36 bp, Artificial Sequence
  Synthetic oligonucleotide
tctcccacgcccaaatgtccctgtacccgccacaga

SEQ ID NO: 137371 - DNA, 37 bp, Artificial Sequence
  Synthetic oligonucleotide
aacaggtggggagggggatggtgttgtcggaggtcga

SEQ ID NO: 137372 - DNA, 37 bp, Artificial Sequence
  Synthetic oligonucleotide
aaccctccgccactattattacaacacctcgcccgga

SEQ ID NO: 137373 - DNA, 37 bp, Artificial Sequence
  Synthetic oligonucleotide
gtgaggtgaaggagggagggctgttgaggatagggga

SEQ ID NO: 137374 - DNA, 37 bp, Artificial Sequence
  Synthetic oligonucleotide
gtcccgccatcactgctttcttcccatgcactcctga

SEQ ID NO: 137375 - DNA, 38 bp, Artificial Sequence
  Synthetic oligonucleotide
gcggggaagacaggctagtaaagggggaggcggtgtga

SEQ ID NO: 137376 - DNA, 38 bp, Artificial Sequence
  Synthetic oligonucleotide
gaggtagggaaggataggggggggaggtctgacattga

SEQ ID NO: 137377 - DNA, 37 bp, Artificial Sequence
  Synthetic oligonucleotide
tccgcagagggggtgggaggtaggaggcgaagattga

SEQ ID NO: 137378 - DNA, 35 bp, Artificial Sequence
  Synthetic oligonucleotide
gtcatggtgccatccccgtctcgttccgcttgata

SEQ ID NO: 137379 - DNA, 35 bp, Artificial Sequence
  Synthetic oligonucleotide
gtgagctcccgtatggtgggggggagtggcgggta

SEQ ID NO: 137380 - DNA, 34 bp, Artificial Sequence
  Synthetic oligonucleotide
attcgcctcaccgccccgtttgtcgtgcccttta

SEQ ID NO: 137381 - DNA, 35 bp, Artificial Sequence
  Synthetic oligonucleotide
acgtacgttctcccgtctacaccaccactgtttta

SEQ ID NO: 137382 - DNA, 35 bp, Artificial Sequence
  Synthetic oligonucleotide
acgaagcacgcaccgttatacccccattccgtcac

SEQ ID NO: 137383 - DNA, 35 bp, Artificial Sequence
  Synthetic oligonucleotide
ttcgaacgcgccgcacgtacttccagttggccacc

SEQ ID NO: 137384 - DNA, 35 bp, Artificial Sequence
  Synthetic oligonucleotide
tccgcagaccctccgctattttagtcacttctacc

SEQ ID NO: 137385 - DNA, 35 bp, Artificial Sequence
  Synthetic oligonucleotide
ttccggagccccgatagcccacgctcgcctgaccc

SEQ ID NO: 137386 - DNA, 35 bp, Artificial Sequence
  Synthetic oligonucleotide
gaggacgccgtccatagcgtgcccctatactcccc

SEQ ID NO: 137387 - DNA, 36 bp, Artificial Sequence
  Synthetic oligonucleotide
accaccatcctgctgtttatcctctgtgccggtgcc

SEQ ID NO: 137388 - DNA, 35 bp, Artificial Sequence
  Synthetic oligonucleotide
agccatacatgctgacccccacacgccgctttagc

SEQ ID NO: 137389 - DNA, 36 bp, Artificial Sequence
  Synthetic oligonucleotide
gtcgccgataactgcgccttataactgtttgccctc

SEQ ID NO: 137390 - DNA, 35 bp, Artificial Sequence
  Synthetic oligonucleotide
tcaacccatcgcgcctcattggtctaccaggcctc

SEQ ID NO: 137391 - DNA, 35 bp, Artificial Sequence
  Synthetic oligonucleotide
acgcacgggtcagcccctctatgcgcgtcctcctc

SEQ ID NO: 137392 - DNA, 35 bp, Artificial Sequence
  Synthetic oligonucleotide
tcttagcctgccgcacgtactcctgctcgttcccg

SEQ ID NO: 137393 - DNA, 35 bp, Artificial Sequence
  Synthetic oligonucleotide
accaccgccctctgaggccatctgactgtgcgccg

SEQ ID NO: 137394 - DNA, 35 bp, Artificial Sequence
  Synthetic oligonucleotide
tctgtgtcccacctcaaagtctatctggcttcttg

SEQ ID NO: 137395 - DNA, 35 bp, Artificial Sequence
  Synthetic oligonucleotide
cccatcccagtgcttctgttctctcgctgttcttg

SEQ ID NO: 137396 - DNA, 35 bp, Artificial Sequence
  Synthetic oligonucleotide
gccccacatcagccggtcgtacatccctgccgtat

SEQ ID NO: 137397 - DNA, 35 bp, Artificial Sequence
  Synthetic oligonucleotide
tgcccgtatggttgtcagttatttgctccccccct

SEQ ID NO: 137398 - DNA, 35 bp, Artificial Sequence
  Synthetic oligonucleotide
aaccacgcactggttacgcacatcctttttttatt

SEQ ID NO: 137399 - DNA, 35 bp, Artificial Sequence
  Synthetic oligonucleotide
ttcgatccccctgtggtgtggtgctccattttttt

SEQ ID NO: 137400 - DNA, 36 bp, Artificial Sequence
  Synthetic oligonucleotide
acctgacacctgctctggcttctggacctccttaaa

SEQ ID NO: 137401 - DNA, 36 bp, Artificial Sequence
  Synthetic oligonucleotide
agtgcggagggggggattgaggggacacgggtttaa

SEQ ID NO: 137402 - DNA, 36 bp, Artificial Sequence
  Synthetic oligonucleotide
gacccgcccccattttatgttttccatcgctagaca

SEQ ID NO: 137403 - DNA, 36 bp, Artificial Sequence
  Synthetic oligonucleotide
tcctccccctcaccctgcgtgggaatctgtcctaca

SEQ ID NO: 137404 - DNA, 35 bp, Artificial Sequence
  Synthetic oligonucleotide
cacgcccctacccgacgcatttttgacacacgcca

SEQ ID NO: 137405 - DNA, 37 bp, Artificial Sequence
  Synthetic oligonucleotide
actaagagacgagaggaacaggcaggaccgggggaga

SEQ ID NO: 137406 - DNA, 37 bp, Artificial Sequence
  Synthetic oligonucleotide
ttactaccgcccagacaagcactgcacgcccccacga

SEQ ID NO: 137407 - DNA, 37 bp, Artificial Sequence
  Synthetic oligonucleotide
tacgcccccccaatggtttttctggcccataagacga

SEQ ID NO: 137408 - DNA, 36 bp, Artificial Sequence
  Synthetic oligonucleotide
tacctcctcaggtccggaccttcccctgtcatccga

SEQ ID NO: 137409 - DNA, 37 bp, Artificial Sequence
  Synthetic oligonucleotide
tatcgggagggagggggcgccggtgtacaatagggga

SEQ ID NO: 137410 - DNA, 36 bp, Artificial Sequence
  Synthetic oligonucleotide
ggtggagaagcagtatggaggaaggtggaatgggga

SEQ ID NO: 137411 - DNA, 37 bp, Artificial Sequence
  Synthetic oligonucleotide
gtacgaagcggggcggggaacggaagttgcggtggga

SEQ ID NO: 137412 - DNA, 38 bp, Artificial Sequence
  Synthetic oligonucleotide
gagagggcggcaggggggcgggtgaatagggggaatga

SEQ ID NO: 137413 - DNA, 38 bp, Artificial Sequence
  Synthetic oligonucleotide
taggataggcatgggtgggtatcgggggggatgactga

SEQ ID NO: 137414 - DNA, 38 bp, Artificial Sequence
  Synthetic oligonucleotide
aaacgtgggggaaaatggggtagctatgggtggggtga

SEQ ID NO: 137415 - DNA, 36 bp, Artificial Sequence
  Synthetic oligonucleotide
tccctccggcatgccctcccccccttgtgccgggta

SEQ ID NO: 137416 - DNA, 36 bp, Artificial Sequence
  Synthetic oligonucleotide
tgacgtcactcttgccttcgaagcccccctcgttta

SEQ ID NO: 137417 - DNA, 35 bp, Artificial Sequence
  Synthetic oligonucleotide
ttacccctcgcctataacacacgttacatcgcaac

SEQ ID NO: 137418 - DNA, 35 bp, Artificial Sequence
  Synthetic oligonucleotide
gatcgggggtgggcgggaagacttttatggggcac

SEQ ID NO: 137419 - DNA, 35 bp, Artificial Sequence
  Synthetic oligonucleotide
caatagccgcccgcacctcccgcgtactttgcacc

SEQ ID NO: 137420 - DNA, 35 bp, Artificial Sequence
  Synthetic oligonucleotide
gccgtccctgcgcaccctaactaccttctacgccc

SEQ ID NO: 137421 - DNA, 35 bp, Artificial Sequence
  Synthetic oligonucleotide
gactgagaaatgcagctgcccctaccgccccgccc

SEQ ID NO: 137422 - DNA, 35 bp, Artificial Sequence
  Synthetic oligonucleotide
actaactgctgcagtgtcattcggaaacccccgcc

SEQ ID NO: 137423 - DNA, 35 bp, Artificial Sequence
  Synthetic oligonucleotide
aggagctcgctgccgcccgctgtcccccctgcgcc

SEQ ID NO: 137424 - DNA, 35 bp, Artificial Sequence
  Synthetic oligonucleotide
acacgccccgacgtaggaggcctcccatcccggcc

SEQ ID NO: 137425 - DNA, 35 bp, Artificial Sequence
  Synthetic oligonucleotide
tccgccttcccctgttgatatcttcccgacctgcc

SEQ ID NO: 137426 - DNA, 35 bp, Artificial Sequence
  Synthetic oligonucleotide
ttcacactgtctgcactctctcttattcgtagtcc

SEQ ID NO: 137427 - DNA, 35 bp, Artificial Sequence
  Synthetic oligonucleotide
attcctctatcagttgctcacccgttccccaacgc

SEQ ID NO: 137428 - DNA, 35 bp, Artificial Sequence
  Synthetic oligonucleotide
gaccgcacccgcgcacactatggtcacaacccgtc

SEQ ID NO: 137429 - DNA, 35 bp, Artificial Sequence
  Synthetic oligonucleotide
tgcccatcccaccttactcccagtcggtacatgtc

SEQ ID NO: 137430 - DNA, 35 bp, Artificial Sequence
  Synthetic oligonucleotide
gaggagcgtgctctccttggccccactaccatgtc

SEQ ID NO: 137431 - DNA, 35 bp, Artificial Sequence
  Synthetic oligonucleotide
gcggggggagaagcaggaggataggggccgctggg

SEQ ID NO: 137432 - DNA, 34 bp, Artificial Sequence
  Synthetic oligonucleotide
gaccacgccatctgaatcaaattctccatcttgg

SEQ ID NO: 137433 - DNA, 35 bp, Artificial Sequence
  Synthetic oligonucleotide
gcacagcccggtttttttcgctatctcgaccccct

SEQ ID NO: 137434 - DNA, 35 bp, Artificial Sequence
  Synthetic oligonucleotide
gccgcttccactcatcattctatcgtcaggcccct

SEQ ID NO: 137435 - DNA, 35 bp, Artificial Sequence
  Synthetic oligonucleotide
gtcgtacgacttgtcgtcctagaaacccttgccct

SEQ ID NO: 137436 - DNA, 35 bp, Artificial Sequence
  Synthetic oligonucleotide
gctcgtcgcagatccggccttacatctacctccct

SEQ ID NO: 137437 - DNA, 36 bp, Artificial Sequence
  Synthetic oligonucleotide
gtcggggtggagcgggtagacagggtgagtgaggca

SEQ ID NO: 137438 - DNA, 36 bp, Artificial Sequence
  Synthetic oligonucleotide
gtgacgacgcacctgccaatctcttgctcccgttca

SEQ ID NO: 137439 - DNA, 37 bp, Artificial Sequence
  Synthetic oligonucleotide
gacggggcgggacgggtgggtaccatggaacgtacga

SEQ ID NO: 137440 - DNA, 37 bp, Artificial Sequence
  Synthetic oligonucleotide
tatgccccccatatcgataactcgtccacctgctcga

SEQ ID NO: 137441 - DNA, 37 bp, Artificial Sequence
  Synthetic oligonucleotide
tccggatggggtgacgggtggttgcggtgaggaggga

SEQ ID NO: 137442 - DNA, 36 bp, Artificial Sequence
  Synthetic oligonucleotide
gcgggctagggcgtgagggggcggtggaacggggga

SEQ ID NO: 137443 - DNA, 37 bp, Artificial Sequence
  Synthetic oligonucleotide
actcaccgacacagctctttgcctttccctcccgtga

SEQ ID NO: 137444 - DNA, 38 bp, Artificial Sequence
  Synthetic oligonucleotide
gatgtggggagccgtgggaagggaccggggaattgtga

SEQ ID NO: 137445 - DNA, 37 bp, Artificial Sequence
  Synthetic oligonucleotide
gccggggtgaaatggggtcagggaggggggcttttga

SEQ ID NO: 137446 - DNA, 35 bp, Artificial Sequence
  Synthetic oligonucleotide
gctaccctccgaccatcgtttcatcacgttcccta

SEQ ID NO: 137447 - DNA, 36 bp, Artificial Sequence
  Synthetic oligonucleotide
tccatcgccatcttttatgtctttggccttctctta

SEQ ID NO: 137448 - DNA, 35 bp, Artificial Sequence
  Synthetic oligonucleotide
gccgcgcaccgccacgcgtctttagtctcacctcc

SEQ ID NO: 137449 - DNA, 35 bp, Artificial Sequence
  Synthetic oligonucleotide
gatcagatgcatttgttggttcttccgtttcttcc

SEQ ID NO: 137450 - DNA, 35 bp, Artificial Sequence
  Synthetic oligonucleotide
gtgtccgtctccttgtcagcctcatttcctccagc

SEQ ID NO: 137451 - DNA, 34 bp, Artificial Sequence
  Synthetic oligonucleotide
gcctcccacctgaggtgccacctgtctttccagc

SEQ ID NO: 137452 - DNA, 34 bp, Artificial Sequence
  Synthetic oligonucleotide
tcacactccccgcagctcgccgaccctcctacgc

SEQ ID NO: 137453 - DNA, 35 bp, Artificial Sequence
  Synthetic oligonucleotide
tccttacacgcaatactgttcttgccttaactatc

SEQ ID NO: 137454 - DNA, 35 bp, Artificial Sequence
  Synthetic oligonucleotide
tgctcgacgtacgacggcgagctggtttccttatc

SEQ ID NO: 137455 - DNA, 35 bp, Artificial Sequence
  Synthetic oligonucleotide
tcaccactccgccacccgaatcaccaggctttgtc

SEQ ID NO: 137456 - DNA, 35 bp, Artificial Sequence
  Synthetic oligonucleotide
actcacccgcctcccctgtccgggcctcactcttc

SEQ ID NO: 137457 - DNA, 35 bp, Artificial Sequence
  Synthetic oligonucleotide
gtttgtccccagttgccgcttctcacacttctgag

SEQ ID NO: 137458 - DNA, 35 bp, Artificial Sequence
  Synthetic oligonucleotide
tgcatttgcaccccccccgattcgccgtcagcgcg

SEQ ID NO: 137459 - DNA, 35 bp, Artificial Sequence
  Synthetic oligonucleotide
acattgtgggtaggggaagggaagggaccatgtcg

SEQ ID NO: 137460 - DNA, 35 bp, Artificial Sequence
  Synthetic oligonucleotide
gtcgcccaaatgtctgcttcggttattcactcctg

SEQ ID NO: 137461 - DNA, 35 bp, Artificial Sequence
  Synthetic oligonucleotide
atgttctcctatcacatgcgctggccttcctgcct

SEQ ID NO: 137462 - DNA, 35 bp, Artificial Sequence
  Synthetic oligonucleotide
tctctcagtccaccgccacataccatctcctgatt

SEQ ID NO: 137463 - DNA, 35 bp, Artificial Sequence
  Synthetic oligonucleotide
ggttcatacatcagcctgccctgcttactgccctt

SEQ ID NO: 137464 - DNA, 35 bp, Artificial Sequence
  Synthetic oligonucleotide
tatcgggtcaggttcctccatgctgcccctctgtt

SEQ ID NO: 137465 - DNA, 35 bp, Artificial Sequence
  Synthetic oligonucleotide
atcacgccaggacctgactcgcatcccccccccaa

SEQ ID NO: 137466 - DNA, 35 bp, Artificial Sequence
  Synthetic oligonucleotide
tcagtaagaggctgggaatggggggggcgggtaca

SEQ ID NO: 137467 - DNA, 35 bp, Artificial Sequence
  Synthetic oligonucleotide
gaacgggagggagggccgggcgaagttaggtccca

SEQ ID NO: 137468 - DNA, 36 bp, Artificial Sequence
  Synthetic oligonucleotide
gcacacgtacttcaccccccttgaccctggttgcca

SEQ ID NO: 137469 - DNA, 36 bp, Artificial Sequence
  Synthetic oligonucleotide
gaagctcatccctgccccctccgccagaagctttca

SEQ ID NO: 137470 - DNA, 37 bp, Artificial Sequence
  Synthetic oligonucleotide
ggtgggcggggcggggggggccaagacaaaacacaga

SEQ ID NO: 137471 - DNA, 37 bp, Artificial Sequence
  Synthetic oligonucleotide
gggaccagtagtcatggggggacgggggattgggaga

SEQ ID NO: 137472 - DNA, 38 bp, Artificial Sequence
  Synthetic oligonucleotide
tcagggacagagggcgggtggggctaagtggcttgtga

SEQ ID NO: 137473 - DNA, 38 bp, Artificial Sequence
  Synthetic oligonucleotide
agccagccacaaacttgtctgccctgttcccctattga

SEQ ID NO: 137474 - DNA, 36 bp, Artificial Sequence
  Synthetic oligonucleotide
gtctacaccgactgatccctctgtgctccctcccta

SEQ ID NO: 137475 - DNA, 36 bp, Artificial Sequence
  Synthetic oligonucleotide
tgccacaccttgagctctatggatcccttctgccta

SEQ ID NO: 137476 - DNA, 35 bp, Artificial Sequence
  Synthetic oligonucleotide
acacagtcggcttctgctatgcccgcttccaaccc

SEQ ID NO: 137477 - DNA, 35 bp, Artificial Sequence
  Synthetic oligonucleotide
tgcacaaccccgtgggtgtcgaattttcatcctcc

SEQ ID NO: 137478 - DNA, 35 bp, Artificial Sequence
  Synthetic oligonucleotide
agggcggggcatatgggggggggtgttatcggtcc

SEQ ID NO: 137479 - DNA, 35 bp, Artificial Sequence
  Synthetic oligonucleotide
gccaatcctctcgtcgttatctatcctcgtaccgc

SEQ ID NO: 137480 - DNA, 35 bp, Artificial Sequence
  Synthetic oligonucleotide
atgatcgacccaactgtagcaaccccccctcttgc

SEQ ID NO: 137481 - DNA, 34 bp, Artificial Sequence
  Synthetic oligonucleotide
acgactccacccgcccctactccacccgagaatc

SEQ ID NO: 137482 - DNA, 35 bp, Artificial Sequence
  Synthetic oligonucleotide
tgccccctctcatcatacgcattgttgcacgactc

SEQ ID NO: 137483 - DNA, 35 bp, Artificial Sequence
  Synthetic oligonucleotide
gactccaccctgtcaatgcttctcgcgccacgctc

SEQ ID NO: 137484 - DNA, 35 bp, Artificial Sequence
  Synthetic oligonucleotide
tcctcaccccgttctctatcaataaggtctttcat

SEQ ID NO: 137485 - DNA, 35 bp, Artificial Sequence
  Synthetic oligonucleotide
tccgaaccgtaccaccgccgggctacactctcact

SEQ ID NO: 137486 - DNA, 35 bp, Artificial Sequence
  Synthetic oligonucleotide
ttgatgtgggggcgactagggaggagggtgggagt

SEQ ID NO: 137487 - DNA, 35 bp, Artificial Sequence
  Synthetic oligonucleotide
aaaaggggcgggtaggggaggttgcgggtggactt

SEQ ID NO: 137488 - DNA, 35 bp, Artificial Sequence
  Synthetic oligonucleotide
gccgaaagcctgtccagtctccttcgtcctctgtt

SEQ ID NO: 137489 - DNA, 35 bp, Artificial Sequence
  Synthetic oligonucleotide
gtccgagcccagtatagtgggtccccctgcccttt

SEQ ID NO: 137490 - DNA, 36 bp, Artificial Sequence
  Synthetic oligonucleotide
atcgtggggggagggatcgagggaggtgtgtgaaca

SEQ ID NO: 137491 - DNA, 36 bp, Artificial Sequence
  Synthetic oligonucleotide
tgcgcatccgccctgaatcgctttgtccttttccca

SEQ ID NO: 137492 - DNA, 37 bp, Artificial Sequence
  Synthetic oligonucleotide
tgcactcgcgtcatttgtctcctcttggccctctcga

SEQ ID NO: 137493 - DNA, 37 bp, Artificial Sequence
  Synthetic oligonucleotide
gaataccgggaccacacagcagggtagggggggagga

SEQ ID NO: 137494 - DNA, 35 bp, Artificial Sequence
  Synthetic oligonucleotide
gatcagggcgagggaaggaaaagggcgtgggagga

SEQ ID NO: 137495 - DNA, 36 bp, Artificial Sequence
  Synthetic oligonucleotide
gttcagggagagagaggggatggggggccgctggga

SEQ ID NO: 137496 - DNA, 37 bp, Artificial Sequence
  Synthetic oligonucleotide
gcaccgatcaccccgcccgaccacccgactcattgga

SEQ ID NO: 137497 - DNA, 37 bp, Artificial Sequence
  Synthetic oligonucleotide
gcacatcatcactccgggtttcgtccacctctcctga

SEQ ID NO: 137498 - DNA, 36 bp, Artificial Sequence
  Synthetic oligonucleotide
tcgctacgccccgcatctgctccacgcctgtcgtga

SEQ ID NO: 137499 - DNA, 38 bp, Artificial Sequence
  Synthetic oligonucleotide
tcgccctccctcctctgttctagttcaggcccatgtga

SEQ ID NO: 137500 - DNA, 36 bp, Artificial Sequence
  Synthetic oligonucleotide
tccccgcccccccgtcctacttttcactaggaacta

SEQ ID NO: 137501 - DNA, 35 bp, Artificial Sequence
  Synthetic oligonucleotide
taaatgcggagagggagggcagaggatggggggac

SEQ ID NO: 137502 - DNA, 35 bp, Artificial Sequence
  Synthetic oligonucleotide
tcaaggcctaccgcattgagaaattcgccctcccc

SEQ ID NO: 137503 - DNA, 35 bp, Artificial Sequence
  Synthetic oligonucleotide
attgctccctaccagtccatgctgcccgcctctgc

SEQ ID NO: 137504 - DNA, 35 bp, Artificial Sequence
  Synthetic oligonucleotide
tccagctgcccttccaaatctgtctgtttccagtc

SEQ ID NO: 137505 - DNA, 35 bp, Artificial Sequence
  Synthetic oligonucleotide
aaccgcttcgtcgccctgtcacaccacactccacg

SEQ ID NO: 137506 - DNA, 35 bp, Artificial Sequence
  Synthetic oligonucleotide
agtcaagaccgtcacccgtttcacccctttagccg

SEQ ID NO: 137507 - DNA, 36 bp, Artificial Sequence
  Synthetic oligonucleotide
tgtgaggggatagggggtgagtagtaggtaggatat

SEQ ID NO: 137508 - DNA, 35 bp, Artificial Sequence
  Synthetic oligonucleotide
ggaccccacctcctgagattgcctttgccgtccct

SEQ ID NO: 137509 - DNA, 35 bp, Artificial Sequence
  Synthetic oligonucleotide
attaccgcgcacgagctcttctcaccactcctcgt

SEQ ID NO: 137510 - DNA, 35 bp, Artificial Sequence
  Synthetic oligonucleotide
aagtaccaccgcagccagggagggacggggcgggt

SEQ ID NO: 137511 - DNA, 35 bp, Artificial Sequence
  Synthetic oligonucleotide
taccactgcaccctctttgctactgtgccccgatt

SEQ ID NO: 137512 - DNA, 36 bp, Artificial Sequence
  Synthetic oligonucleotide
attctccaccgctgacccgatcctttcccacgagaa

SEQ ID NO: 137513 - DNA, 36 bp, Artificial Sequence
  Synthetic oligonucleotide
gccacctccgctcattgatccgtacgctatttttca

SEQ ID NO: 137514 - DNA, 37 bp, Artificial Sequence
  Synthetic oligonucleotide
acctcacccctagacctcacagcgcctttcttagcga

SEQ ID NO: 137515 - DNA, 36 bp, Artificial Sequence
  Synthetic oligonucleotide
tgctaccgccacccgggtgatcctccattttctcga

SEQ ID NO: 137516 - DNA, 35 bp, Artificial Sequence
  Synthetic oligonucleotide
gggtgggccgggggtagggaagtttgaacgtagga

SEQ ID NO: 137517 - DNA, 35 bp, Artificial Sequence
  Synthetic oligonucleotide
gccgggaggtggggtatacagaggtctcatgggga

SEQ ID NO: 137518 - DNA, 38 bp, Artificial Sequence
  Synthetic oligonucleotide
tgagcgaccggagcagggggggaggggctcagaaatga

SEQ ID NO: 137519 - DNA, 38 bp, Artificial Sequence
  Synthetic oligonucleotide
tccctagccccgttccctaacggtataccgtaccctga

SEQ ID NO: 137520 - DNA, 37 bp, Artificial Sequence
  Synthetic oligonucleotide
gtacgaccgggggtaggtggaggggcgacggggttga

SEQ ID NO: 137521 - DNA, 35 bp, Artificial Sequence
  Synthetic oligonucleotide
gtcccaaccgaccctctcaatttgacagagttaac

SEQ ID NO: 137522 - DNA, 35 bp, Artificial Sequence
  Synthetic oligonucleotide
atctctaacgcagatgtcgttccatcttacctcac

SEQ ID NO: 137523 - DNA, 35 bp, Artificial Sequence
  Synthetic oligonucleotide
accactgtagaatccgccaagggcctccatccgac

SEQ ID NO: 137524 - DNA, 35 bp, Artificial Sequence
  Synthetic oligonucleotide
atactccccgccattgaagtgtacgaccccacccc

SEQ ID NO: 137525 - DNA, 35 bp, Artificial Sequence
  Synthetic oligonucleotide
ttactggccctctctgcttatttcagaccgccgcc

SEQ ID NO: 137526 - DNA, 35 bp, Artificial Sequence
  Synthetic oligonucleotide
ttgtattgccccccatgtttcgctgttatttggcc

SEQ ID NO: 137527 - DNA, 35 bp, Artificial Sequence
  Synthetic oligonucleotide
attccgtgtaacaccatgtcccggcctaacttgcc

SEQ ID NO: 137528 - DNA, 35 bp, Artificial Sequence
  Synthetic oligonucleotide
gcgaattgacgccccgcccgacccctacgtcgtcc

SEQ ID NO: 137529 - DNA, 35 bp, Artificial Sequence
  Synthetic oligonucleotide
aatcgcgaatcccgacatgatgagcgaccttttcc

SEQ ID NO: 137530 - DNA, 35 bp, Artificial Sequence
  Synthetic oligonucleotide
gttgggcgcaaccggagtgtccacccgccgctatc

SEQ ID NO: 137531 - DNA, 35 bp, Artificial Sequence
  Synthetic oligonucleotide
tgatcttcccctcggtgctatccgtacgctttatc

SEQ ID NO: 137532 - DNA, 34 bp, Artificial Sequence
  Synthetic oligonucleotide
gtctagcccgcaattgtcacgtactctctctcag

SEQ ID NO: 137533 - DNA, 35 bp, Artificial Sequence
  Synthetic oligonucleotide
tgcccctaccgtcatttcctattctacattgcctg

SEQ ID NO: 137534 - DNA, 35 bp, Artificial Sequence
  Synthetic oligonucleotide
tttccccgtcgcataccacacccttcactcttgtg

SEQ ID NO: 137535 - DNA, 35 bp, Artificial Sequence
  Synthetic oligonucleotide
tgtacgcctgccattctatcaccgggttgcctgct

SEQ ID NO: 137536 - DNA, 35 bp, Artificial Sequence
  Synthetic oligonucleotide
tacgtgtgggggtgggagggaccgtgtgggaatct

SEQ ID NO: 137537 - DNA, 35 bp, Artificial Sequence
  Synthetic oligonucleotide
tgggccggtgctgctccctaagacccttcctcgtt

SEQ ID NO: 137538 - DNA, 36 bp, Artificial Sequence
  Synthetic oligonucleotide
tgccctccaccactggatatctagccccagctctaa

SEQ ID NO: 137539 - DNA, 35 bp, Artificial Sequence
  Synthetic oligonucleotide
tccgtcaggccgtccggttcttttcccactgccca

SEQ ID NO: 137540 - DNA, 35 bp, Artificial Sequence
  Synthetic oligonucleotide
gacacccaccgcttctggcttctcagcaactccca

SEQ ID NO: 137541 - DNA, 36 bp, Artificial Sequence
  Synthetic oligonucleotide
gacgtgccatagaaaagggtgagatatagggggaga

SEQ ID NO: 137542 - DNA, 37 bp, Artificial Sequence
  Synthetic oligonucleotide
tcagatgcccccatcgaatcttccccgtcgcgaacga

SEQ ID NO: 137543 - DNA, 36 bp, Artificial Sequence
  Synthetic oligonucleotide
tgccacctccacctatgacacttctggcccacacga

SEQ ID NO: 137544 - DNA, 36 bp, Artificial Sequence
  Synthetic oligonucleotide
tacgaccagccggccgtccccttcatctccgctcga

SEQ ID NO: 137545 - DNA, 37 bp, Artificial Sequence
  Synthetic oligonucleotide
gtgaacactggtgaggggctgggaaggacggggatga

SEQ ID NO: 137546 - DNA, 38 bp, Artificial Sequence
  Synthetic oligonucleotide
tgtctaccacgatctttcaagctccaccttcctgctga

SEQ ID NO: 137547 - DNA, 38 bp, Artificial Sequence
  Synthetic oligonucleotide
gcctggtcaccctatctgttccggccactattccttga

SEQ ID NO: 137548 - DNA, 38 bp, Artificial Sequence
  Synthetic oligonucleotide
ggaacgggctgggtggggtagggggcttcgtccgttga

SEQ ID NO: 137549 - DNA, 35 bp, Artificial Sequence
  Synthetic oligonucleotide
tgtttcgccaccatggtcttatcctgtaccgcata

SEQ ID NO: 137550 - DNA, 35 bp, Artificial Sequence
  Synthetic oligonucleotide
agttatcctccatctgtcttcacctgtttttcgta

SEQ ID NO: 137551 - DNA, 35 bp, Artificial Sequence
  Synthetic oligonucleotide
gccgatagcgcccacagtaccgacgcccatcctac

SEQ ID NO: 137552 - DNA, 34 bp, Artificial Sequence
  Synthetic oligonucleotide
acgtcgttcaccacccactgtcgttcttgacccc

SEQ ID NO: 137553 - DNA, 35 bp, Artificial Sequence
  Synthetic oligonucleotide
ttaggccaccagtatcgttacatgtctcgtttccc

SEQ ID NO: 137554 - DNA, 35 bp, Artificial Sequence
  Synthetic oligonucleotide
atgccgctgcattattcgattacgacactcccgcc

SEQ ID NO: 137555 - DNA, 35 bp, Artificial Sequence
  Synthetic oligonucleotide
tgtcgcctactcctctcctgttttcaaagtccgcc

SEQ ID NO: 137556 - DNA, 35 bp, Artificial Sequence
  Synthetic oligonucleotide
gaccgccccttgctcccgtgccataagttgcgtcc

SEQ ID NO: 137557 - DNA, 36 bp, Artificial Sequence
  Synthetic oligonucleotide
ttgcacagcaacttccctctatacacacactcttgc

SEQ ID NO: 137558 - DNA, 35 bp, Artificial Sequence
  Synthetic oligonucleotide
aatgcaggctgtccccttgtctcattgtcattgtc

SEQ ID NO: 137559 - DNA, 35 bp, Artificial Sequence
  Synthetic oligonucleotide
gccccctgacctgagtgctttaatctcgccttttc

SEQ ID NO: 137560 - DNA, 35 bp, Artificial Sequence
  Synthetic oligonucleotide
tgcggtcaattgcctcctatagtcactccccatcg

SEQ ID NO: 137561 - DNA, 35 bp, Artificial Sequence
  Synthetic oligonucleotide
ataggagggcgggggggagttgatactggaggttg

SEQ ID NO: 137562 - DNA, 33 bp, Artificial Sequence
  Synthetic oligonucleotide
tctcactcgttcaccatctgctcccgttccaat

SEQ ID NO: 137563 - DNA, 35 bp, Artificial Sequence
  Synthetic oligonucleotide
agaacaggaggcatggggatacggatggggctggt

SEQ ID NO: 137564 - DNA, 35 bp, Artificial Sequence
  Synthetic oligonucleotide
acactactctggtgcttgccaatccacaccctgtt

SEQ ID NO: 137565 - DNA, 35 bp, Artificial Sequence
  Synthetic oligonucleotide
ggtacatagacgggggggttgtaggggaagggaaa

SEQ ID NO: 137566 - DNA, 36 bp, Artificial Sequence
  Synthetic oligonucleotide
gtgccgttgcgctatcacgacccactcccctgccca

SEQ ID NO: 137567 - DNA, 35 bp, Artificial Sequence
  Synthetic oligonucleotide
acactcgcattctggtcggaatcttcgccccttca

SEQ ID NO: 137568 - DNA, 36 bp, Artificial Sequence
  Synthetic oligonucleotide
aactcctgtctccatgctttcacgcctctggtttca

SEQ ID NO: 137569 - DNA, 37 bp, Artificial Sequence
  Synthetic oligonucleotide
tgcacccctttctggaacctcgtccccgcttcgacga

SEQ ID NO: 137570 - DNA, 37 bp, Artificial Sequence
  Synthetic oligonucleotide
gccccccatcgctcgccctgtgacagttacctcgtga

SEQ ID NO: 137571 - DNA, 35 bp, Artificial Sequence
  Synthetic oligonucleotide
tcaccgccctccgtctctgtttaccggccttcaac

SEQ ID NO: 137572 - DNA, 35 bp, Artificial Sequence
  Synthetic oligonucleotide
gacccctccacgcgcacagccaacactcgccgtac

SEQ ID NO: 137573 - DNA, 34 bp, Artificial Sequence
  Synthetic oligonucleotide
aggtgccgctaatgtccttgcacgctacaccacc

SEQ ID NO: 137574 - DNA, 35 bp, Artificial Sequence
  Synthetic oligonucleotide
tactttcgccccaatgacaccctatggccagtacc

SEQ ID NO: 137575 - DNA, 35 bp, Artificial Sequence
  Synthetic oligonucleotide
gacgatccaccacgtttccgtaagttacttagccc

SEQ ID NO: 137576 - DNA, 34 bp, Artificial Sequence
  Synthetic oligonucleotide
ttgctcgtactatgccccgtccttttgcgtcgcc

SEQ ID NO: 137577 - DNA, 35 bp, Artificial Sequence
  Synthetic oligonucleotide
agctgacgtacctaagaccctgtccccttgctgtc

SEQ ID NO: 137578 - DNA, 35 bp, Artificial Sequence
  Synthetic oligonucleotide
gtgtgcgcctgcttattccagttctttgctgcttc

SEQ ID NO: 137579 - DNA, 35 bp, Artificial Sequence
  Synthetic oligonucleotide
tcacgctactgatcccgctcctcgcttcctttcag

SEQ ID NO: 137580 - DNA, 35 bp, Artificial Sequence
  Synthetic oligonucleotide
gcgcatccctcgctatcgttcataccgctattacg

SEQ ID NO: 137581 - DNA, 35 bp, Artificial Sequence
  Synthetic oligonucleotide
tcacgaccacttgtcgtatgttctatttgccgccg

SEQ ID NO: 137582 - DNA, 35 bp, Artificial Sequence
  Synthetic oligonucleotide
gccctgcacatgttgtttgccgtcctttttgctcg

SEQ ID NO: 137583 - DNA, 35 bp, Artificial Sequence
  Synthetic oligonucleotide
tgtacgcctccacccgccgtataaacgcttatcct

SEQ ID NO: 137584 - DNA, 35 bp, Artificial Sequence
  Synthetic oligonucleotide
tccatggccactggtaacactttgctattccttct

SEQ ID NO: 137585 - DNA, 35 bp, Artificial Sequence
  Synthetic oligonucleotide
gttagcgctcgtcctgatgctttcctgctcctcgt

SEQ ID NO: 137586 - DNA, 35 bp, Artificial Sequence
  Synthetic oligonucleotide
ggtgacgccccattgcatttagccacttccctatt

SEQ ID NO: 137587 - DNA, 35 bp, Artificial Sequence
  Synthetic oligonucleotide
tgcctccgcctctctgtcttaaaatagtccttaca

SEQ ID NO: 137588 - DNA, 36 bp, Artificial Sequence
  Synthetic oligonucleotide
gctcattgccccccgtgttccagcttgcccaaccca

SEQ ID NO: 137589 - DNA, 36 bp, Artificial Sequence
  Synthetic oligonucleotide
aacctccccgtcgctcgtaactagtcagtccctcca

SEQ ID NO: 137590 - DNA, 35 bp, Artificial Sequence
  Synthetic oligonucleotide
gagacaggagcgggagagcgagggttagggccaga

SEQ ID NO: 137591 - DNA, 37 bp, Artificial Sequence
  Synthetic oligonucleotide
tatctccgccacctgcaagcatgcactgttctcctga

SEQ ID NO: 137592 - DNA, 37 bp, Artificial Sequence
  Synthetic oligonucleotide
aaccccctctcatgattctgtctgtgcgcccccttga

SEQ ID NO: 137593 - DNA, 38 bp, Artificial Sequence
  Synthetic oligonucleotide
gtgtactccgccctacttgtgtccgttcctaccgttga

SEQ ID NO: 137594 - DNA, 35 bp, Artificial Sequence
  Synthetic oligonucleotide
gagcgccatgcctccctatgcccaggtccatcgta

SEQ ID NO: 137595 - DNA, 36 bp, Artificial Sequence
  Synthetic oligonucleotide
gacacccagaagccgcactacctcctggactttgta

SEQ ID NO: 137596 - DNA, 35 bp, Artificial Sequence
  Synthetic oligonucleotide
gccccatcgcccggaaccaaactcgctgtgcgacc

SEQ ID NO: 137597 - DNA, 35 bp, Artificial Sequence
  Synthetic oligonucleotide
atgccggtacttgttggcattcggtgattccttcc

SEQ ID NO: 137598 - DNA, 35 bp, Artificial Sequence
  Synthetic oligonucleotide
gttgtccgtcgcatcccatacctcccccaaaaggc

SEQ ID NO: 137599 - DNA, 35 bp, Artificial Sequence
  Synthetic oligonucleotide
gcactcctccatgctctgataaccgtgcgccatgc

SEQ ID NO: 137600 - DNA, 35 bp, Artificial Sequence
  Synthetic oligonucleotide
tagccactcgccctgacagccatcttgtgccctgc

SEQ ID NO: 137601 - DNA, 35 bp, Artificial Sequence
  Synthetic oligonucleotide
atcgacacgagctctgccccttcttcgtgacactc

SEQ ID NO: 137602 - DNA, 35 bp, Artificial Sequence
  Synthetic oligonucleotide
gtgccacgcccctaatgagcgcgttatcgaccctc

SEQ ID NO: 137603 - DNA, 35 bp, Artificial Sequence
  Synthetic oligonucleotide
ttgacgccgtaaaagtttcctcgcctaccctggtc

SEQ ID NO: 137604 - DNA, 35 bp, Artificial Sequence
  Synthetic oligonucleotide
tgatccgcccgtacattacatcctccccgaacgtg

SEQ ID NO: 137605 - DNA, 35 bp, Artificial Sequence
  Synthetic oligonucleotide
acgccccactatctgcattccgtcgttccctgttg

SEQ ID NO: 137606 - DNA, 35 bp, Artificial Sequence
  Synthetic oligonucleotide
aaccgcggtcgtctttctgttgcccacccaccact

SEQ ID NO: 137607 - DNA, 36 bp, Artificial Sequence
  Synthetic oligonucleotide
gaggatgtaggaggagcatagagggggcaagttcaa

SEQ ID NO: 137608 - DNA, 36 bp, Artificial Sequence
  Synthetic oligonucleotide
actgcgccccccgttcgtaaatgtccccttccccca

SEQ ID NO: 137609 - DNA, 35 bp, Artificial Sequence
  Synthetic oligonucleotide
tgcatcagtcttgccatgtcaccatcaccctccca

SEQ ID NO: 137610 - DNA, 35 bp, Artificial Sequence
  Synthetic oligonucleotide
tgctcgacccgtgtccattaccacgcctcgttcca

SEQ ID NO: 137611 - DNA, 35 bp, Artificial Sequence
  Synthetic oligonucleotide
gaaccccaccgttactgccactggttaggccctca

SEQ ID NO: 137612 - DNA, 38 bp, Artificial Sequence
  Synthetic oligonucleotide
gtcgctgactcctgcccctccgctcatcaattcattga

SEQ ID NO: 137613 - DNA, 37 bp, Artificial Sequence
  Synthetic oligonucleotide
gacacgtcccagctttgccacatccggtttcccttga

SEQ ID NO: 137614 - DNA, 37 bp, Artificial Sequence
  Synthetic oligonucleotide
ggacggacgacactgcattgacctgcctccctcttga

SEQ ID NO: 137615 - DNA, 38 bp, Artificial Sequence
  Synthetic oligonucleotide
gttcaccttctgacctcctattcgacacctctgtttga

SEQ ID NO: 137616 - DNA, 35 bp, Artificial Sequence
  Synthetic oligonucleotide
tcccacagagccgtagtccaccatccgtttgtcac

SEQ ID NO: 137617 - DNA, 35 bp, Artificial Sequence
  Synthetic oligonucleotide
gacatccatcacccatcgtgtctagtttcttcccc

SEQ ID NO: 137618 - DNA, 35 bp, Artificial Sequence
  Synthetic oligonucleotide
tgattcgaccgactatccgctatcaggtccctccc

SEQ ID NO: 137619 - DNA, 35 bp, Artificial Sequence
  Synthetic oligonucleotide
tcatccccactctgatagtctcccgtcacttcagc

SEQ ID NO: 137620 - DNA, 35 bp, Artificial Sequence
  Synthetic oligonucleotide
gaaacaccgtccaggcctgcatcctctccggaatc

SEQ ID NO: 137621 - DNA, 35 bp, Artificial Sequence
  Synthetic oligonucleotide
agacccccgccagttgaggatcactagcctccctc

SEQ ID NO: 137622 - DNA, 35 bp, Artificial Sequence
  Synthetic oligonucleotide
atatggccaacgcacatcacctggacctgtccctc

SEQ ID NO: 137623 - DNA, 35 bp, Artificial Sequence
  Synthetic oligonucleotide
gacttgctcgttcgtcctggttatccgtcgttctc

SEQ ID NO: 137624 - DNA, 31 bp, Artificial Sequence
  Synthetic oligonucleotide
gttatgcccccgggagctctgctttccgttc

SEQ ID NO: 137625 - DNA, 35 bp, Artificial Sequence
  Synthetic oligonucleotide
agacttcacgcactgctgcccgatcacacattttc

SEQ ID NO: 137626 - DNA, 35 bp, Artificial Sequence
  Synthetic oligonucleotide
acactcggtcaacttgccttttgtcgctatccccg

SEQ ID NO: 137627 - DNA, 35 bp, Artificial Sequence
  Synthetic oligonucleotide
tgcgggaggtgagggcggttattgaggtagggggg

SEQ ID NO: 137628 - DNA, 35 bp, Artificial Sequence
  Synthetic oligonucleotide
tcaaggagtgccggcctgccccccgttccaccaat

SEQ ID NO: 137629 - DNA, 35 bp, Artificial Sequence
  Synthetic oligonucleotide
acacccttacgatgtctgctgatcccgttttatct

SEQ ID NO: 137630 - DNA, 35 bp, Artificial Sequence
  Synthetic oligonucleotide
tactgccctctttcatgttccgttatgcgctgtct

SEQ ID NO: 137631 - DNA, 35 bp, Artificial Sequence
  Synthetic oligonucleotide
acttgccagtccacctttctatcaacatccgccgt

SEQ ID NO: 137632 - DNA, 35 bp, Artificial Sequence
  Synthetic oligonucleotide
ataggagggggaggggctaggggaatgttacaggt

SEQ ID NO: 137633 - DNA, 36 bp, Artificial Sequence
  Synthetic oligonucleotide
ttctcatccgccgccctccgtcccgctccttccgaa

SEQ ID NO: 137634 - DNA, 36 bp, Artificial Sequence
  Synthetic oligonucleotide
tcccccactccctgcatgaactagttgtctgccaca

SEQ ID NO: 137635 - DNA, 35 bp, Artificial Sequence
  Synthetic oligonucleotide
tcccgtaacgccgccgtttttttgttagcccacca

SEQ ID NO: 137636 - DNA, 36 bp, Artificial Sequence
  Synthetic oligonucleotide
gttcccttccgccactggtctactacgttgtgccca

SEQ ID NO: 137637 - DNA, 36 bp, Artificial Sequence
  Synthetic oligonucleotide
gctggctcccgctcgttgcccttccgctccatgcga

SEQ ID NO: 137638 - DNA, 37 bp, Artificial Sequence
  Synthetic oligonucleotide
tccctgtcagactccgatctacccctcgcccactcga

SEQ ID NO: 137639 - DNA, 38 bp, Artificial Sequence
  Synthetic oligonucleotide
tgaatgagggacgggggggaatggagagtacggggtga

SEQ ID NO: 137640 - DNA, 35 bp, Artificial Sequence
  Synthetic oligonucleotide
tctgccccatctgcactcgcgttctcaccgtttga

SEQ ID NO: 137641 - DNA, 35 bp, Artificial Sequence
  Synthetic oligonucleotide
gccgttgccaagctgcacctttctcgaacatgccc

SEQ ID NO: 137642 - DNA, 35 bp, Artificial Sequence
  Synthetic oligonucleotide
gtgcatcgtagccccgtatattctcccgccttccc

SEQ ID NO: 137643 - DNA, 35 bp, Artificial Sequence
  Synthetic oligonucleotide
tcaccctcccattctcgcatagtctgccccttgcc

SEQ ID NO: 137644 - DNA, 35 bp, Artificial Sequence
  Synthetic oligonucleotide
tccacgccctgcctgcggtaaccgaatctctatcc

SEQ ID NO: 137645 - DNA, 35 bp, Artificial Sequence
  Synthetic oligonucleotide
gaagccaccgggccacccctttcccgacatgctcc

SEQ ID NO: 137646 - DNA, 35 bp, Artificial Sequence
  Synthetic oligonucleotide
tccgaccactcgtttcccccttcgatttcctcagc

SEQ ID NO: 137647 - DNA, 35 bp, Artificial Sequence
  Synthetic oligonucleotide
gcccctccgcgcgaagtctgcatccctcgcccctc

SEQ ID NO: 137648 - DNA, 35 bp, Artificial Sequence
  Synthetic oligonucleotide
acagccgaggccgcctttccatccttcaagttgtc

SEQ ID NO: 137649 - DNA, 35 bp, Artificial Sequence
  Synthetic oligonucleotide
gcttacctctgtcgttttcctttccatgaccgttc

SEQ ID NO: 137650 - DNA, 35 bp, Artificial Sequence
  Synthetic oligonucleotide
aaacaccgacccgatccgctctaccaacatgctcg

SEQ ID NO: 137651 - DNA, 35 bp, Artificial Sequence
  Synthetic oligonucleotide
tagtaggtggaaagaagatagaggggaaggctagg

SEQ ID NO: 137652 - DNA, 35 bp, Artificial Sequence
  Synthetic oligonucleotide
gtaggcttcccccagatcttatcctcgctccactg

SEQ ID NO: 137653 - DNA, 35 bp, Artificial Sequence
  Synthetic oligonucleotide
agctggggaaggggggatcgcaagtagggaaacat

SEQ ID NO: 137654 - DNA, 35 bp, Artificial Sequence
  Synthetic oligonucleotide
ttcgatagcccctccgatgcttccgcaccccatct

SEQ ID NO: 137655 - DNA, 35 bp, Artificial Sequence
  Synthetic oligonucleotide
accggtagggtgggtggaggggtcggtgagggcgt

SEQ ID NO: 137656 - DNA, 35 bp, Artificial Sequence
  Synthetic oligonucleotide
gcgcaccctttccttgttaccatctgccacggggt

SEQ ID NO: 137657 - DNA, 35 bp, Artificial Sequence
  Synthetic oligonucleotide
actcgtactggcctgtaccgctccttacctctctt

SEQ ID NO: 137658 - DNA, 36 bp, Artificial Sequence
  Synthetic oligonucleotide
tctgaccccgtactctagtgcccttccgccgggaca

SEQ ID NO: 137659 - DNA, 35 bp, Artificial Sequence
  Synthetic oligonucleotide
acaccacaccccgcccactttgtcaagctcctaca

SEQ ID NO: 137660 - DNA, 35 bp, Artificial Sequence
  Synthetic oligonucleotide
gcgcacagacgcccgatcgcggctcaaccacccca

SEQ ID NO: 137661 - DNA, 36 bp, Artificial Sequence
  Synthetic oligonucleotide
taggtgggggggagggggggggaactaagggcagca

SEQ ID NO: 137662 - DNA, 37 bp, Artificial Sequence
  Synthetic oligonucleotide
tgccacccgaccgccatgcctccactttcaacgcaga

SEQ ID NO: 137663 - DNA, 37 bp, Artificial Sequence
  Synthetic oligonucleotide
acgtgaccgtctcagcccgacgccccatccatgccga

SEQ ID NO: 137664 - DNA, 35 bp, Artificial Sequence
  Synthetic oligonucleotide
gaccccagtcactccctacgccaatactcctccga

SEQ ID NO: 137665 - DNA, 37 bp, Artificial Sequence
  Synthetic oligonucleotide
acccctcgggtatcggcctccccttggtactcctcga

SEQ ID NO: 137666 - DNA, 37 bp, Artificial Sequence
  Synthetic oligonucleotide
ggatcaccacgagctcataagccctcacccatttcga

SEQ ID NO: 137667 - DNA, 37 bp, Artificial Sequence
  Synthetic oligonucleotide
atgcggatggaaggggagggccgagggagaagaagga

SEQ ID NO: 137668 - DNA, 36 bp, Artificial Sequence
  Synthetic oligonucleotide
gggacgggcgggactggggggcggaggattcatgga

SEQ ID NO: 137669 - DNA, 38 bp, Artificial Sequence
  Synthetic oligonucleotide
tcataccctgttcacccctgtacattgacgtttgctga

SEQ ID NO: 137670 - DNA, 36 bp, Artificial Sequence
  Synthetic oligonucleotide
ggggtggagtagaggggcgaggcatagccagcgtga

SEQ ID NO: 137671 - DNA, 37 bp, Artificial Sequence
  Synthetic oligonucleotide
gaactcggggccggatgaggacgggggcgggcggtga

SEQ ID NO: 137672 - DNA, 37 bp, Artificial Sequence
  Synthetic oligonucleotide
ttatcgcaatccagctgccccacccctggcctcttga

SEQ ID NO: 137673 - DNA, 36 bp, Artificial Sequence
  Synthetic oligonucleotide
tactagggaacgtgggtgagggaggggggggtccta

SEQ ID NO: 137674 - DNA, 36 bp, Artificial Sequence
  Synthetic oligonucleotide
tccgacccgcctgcaaaagctcaccacccgaccgta

SEQ ID NO: 137675 - DNA, 36 bp, Artificial Sequence
  Synthetic oligonucleotide
gggagggacgggggggacgtgcgcgcgcatatctta

SEQ ID NO: 137676 - DNA, 35 bp, Artificial Sequence
  Synthetic oligonucleotide
cccccccgccgcagttattattattgccctacccc

SEQ ID NO: 137677 - DNA, 34 bp, Artificial Sequence
  Synthetic oligonucleotide
agtgctgtcccatctccacccgtcctggttcccc

SEQ ID NO: 137678 - DNA, 35 bp, Artificial Sequence
  Synthetic oligonucleotide
aatccgcgatccagcagccttgaccaacgccactc

SEQ ID NO: 137679 - DNA, 35 bp, Artificial Sequence
  Synthetic oligonucleotide
tgacctcgctccatcaccatccagtcctaccgctc

SEQ ID NO: 137680 - DNA, 35 bp, Artificial Sequence
  Synthetic oligonucleotide
acgacacgccgccgcccggccccaattttcccttc

SEQ ID NO: 137681 - DNA, 35 bp, Artificial Sequence
  Synthetic oligonucleotide
acatccccctgtcccactagcaacgttactgctag

SEQ ID NO: 137682 - DNA, 35 bp, Artificial Sequence
  Synthetic oligonucleotide
tctccccatccgccgcctagtttgataaacgttcg

SEQ ID NO: 137683 - DNA, 35 bp, Artificial Sequence
  Synthetic oligonucleotide
aagggggtgggcaggggtcggcactcttttcgggg

SEQ ID NO: 137684 - DNA, 35 bp, Artificial Sequence
  Synthetic oligonucleotide
gattgggagggtgggctgggtgttccgtaccacat

SEQ ID NO: 137685 - DNA, 35 bp, Artificial Sequence
  Synthetic oligonucleotide
gatcacacgtggtagcagcagggaggaaagcacat

SEQ ID NO: 137686 - DNA, 35 bp, Artificial Sequence
  Synthetic oligonucleotide
accgggtccccatgatcgcagccctcttcacccat

SEQ ID NO: 137687 - DNA, 30 bp, Artificial Sequence
  Synthetic oligonucleotide
acccggcttgactgcctccgacttgcccct

SEQ ID NO: 137688 - DNA, 34 bp, Artificial Sequence
  Synthetic oligonucleotide
gcccccagccatcattatacttactccctggttt

SEQ ID NO: 137689 - DNA, 36 bp, Artificial Sequence
  Synthetic oligonucleotide
actccgcaccaccgcatatctatccggctactgtaa

SEQ ID NO: 137690 - DNA, 35 bp, Artificial Sequence
  Synthetic oligonucleotide
gacgacgccgccctggttcattgttaccctcccca

SEQ ID NO: 137691 - DNA, 36 bp, Artificial Sequence
  Synthetic oligonucleotide
tttgccactgccctttatttcttgcgccaattctca

SEQ ID NO: 137692 - DNA, 37 bp, Artificial Sequence
  Synthetic oligonucleotide
tgaccgcctggtactcagctccgccctatgccttcga

SEQ ID NO: 137693 - DNA, 37 bp, Artificial Sequence
  Synthetic oligonucleotide
gcccccctctccgtccccttcccgaacgtccctagga

SEQ ID NO: 137694 - DNA, 36 bp, Artificial Sequence
  Synthetic oligonucleotide
gtgatgacatagggaggagagggtgggggctaaata

SEQ ID NO: 137695 - DNA, 36 bp, Artificial Sequence
  Synthetic oligonucleotide
atgttcccccgccccattgaacgcactgccacgcta

SEQ ID NO: 137696 - DNA, 35 bp, Artificial Sequence
  Synthetic oligonucleotide
gttacccccgcctcccgactcgtgctagtggtcta

SEQ ID NO: 137697 - DNA, 36 bp, Artificial Sequence
  Synthetic oligonucleotide
gcccccccgatcatgtcctgctgaccgcctctagta

SEQ ID NO: 137698 - DNA, 35 bp, Artificial Sequence
  Synthetic oligonucleotide
ggaggaccggggggaaaggaatagggatagcgaac

SEQ ID NO: 137699 - DNA, 35 bp, Artificial Sequence
  Synthetic oligonucleotide
gcattccgtcatcgtttttggcctctcgatcccac

SEQ ID NO: 137700 - DNA, 35 bp, Artificial Sequence
  Synthetic oligonucleotide
atgttgcgcacttgcagccctcgtcccgccgcacc

SEQ ID NO: 137701 - DNA, 35 bp, Artificial Sequence
  Synthetic oligonucleotide
actatcgccgtgcccgaaatttgctgttccacccc

SEQ ID NO: 137702 - DNA, 35 bp, Artificial Sequence
  Synthetic oligonucleotide
accgccctgtaggctttttgaacgctatctttgcc

SEQ ID NO: 137703 - DNA, 35 bp, Artificial Sequence
  Synthetic oligonucleotide
gcagacggcacaccagctactcccccgctttaagc

SEQ ID NO: 137704 - DNA, 35 bp, Artificial Sequence
  Synthetic oligonucleotide
atgagaggtgaggtacgggttaacaatggggaggg

SEQ ID NO: 137705 - DNA, 35 bp, Artificial Sequence
  Synthetic oligonucleotide
gcctcccatacgcatcataacaggccacacccttg

SEQ ID NO: 137706 - DNA, 35 bp, Artificial Sequence
  Synthetic oligonucleotide
agcacccaatgcttttttcgtacctgacccttttg

SEQ ID NO: 137707 - DNA, 35 bp, Artificial Sequence
  Synthetic oligonucleotide
acccacgatgcctgcatctgtacttttccgacact

SEQ ID NO: 137708 - DNA, 35 bp, Artificial Sequence
  Synthetic oligonucleotide
tccatgccaatccaccttgttgctgctaacaccct

SEQ ID NO: 137709 - DNA, 35 bp, Artificial Sequence
  Synthetic oligonucleotide
ccagccctgtccccacctgtctttagactccgcct

SEQ ID NO: 137710 - DNA, 35 bp, Artificial Sequence
  Synthetic oligonucleotide
gttcgctcgccgcttcattttgcccctgtcgtgct

SEQ ID NO: 137711 - DNA, 35 bp, Artificial Sequence
  Synthetic oligonucleotide
gccgggggttgacggaaagaggcgaggggggcagt

SEQ ID NO: 137712 - DNA, 34 bp, Artificial Sequence
  Synthetic oligonucleotide
gccccgtcccccgcccattattaggcttcctcaa

SEQ ID NO: 137713 - DNA, 35 bp, Artificial Sequence
  Synthetic oligonucleotide
gattggtgtggggtgtgagggggaagataggggaa

SEQ ID NO: 137714 - DNA, 37 bp, Artificial Sequence
  Synthetic oligonucleotide
tgcccgtcgttagcgtcgccccccagcccttcaccga

SEQ ID NO: 137715 - DNA, 37 bp, Artificial Sequence
  Synthetic oligonucleotide
acactcctcgacctgctcttgacccgcccccagagga

SEQ ID NO: 137716 - DNA, 37 bp, Artificial Sequence
  Synthetic oligonucleotide
ggaggtggtggggctcgttgagggtccgcgggaggga

SEQ ID NO: 137717 - DNA, 37 bp, Artificial Sequence
  Synthetic oligonucleotide
tgctacgcgacctgccgtccaagcacctatcccctga

SEQ ID NO: 137718 - DNA, 38 bp, Artificial Sequence
  Synthetic oligonucleotide
gaccgttgatctgcccggcctaccccgtcccttcgtga

SEQ ID NO: 137719 - DNA, 35 bp, Artificial Sequence
  Synthetic oligonucleotide
tctccctccgaccgcccacacccgtaggatcacac

SEQ ID NO: 137720 - DNA, 35 bp, Artificial Sequence
  Synthetic oligonucleotide
tgtgtaccgccaccattgcccacagctttctcgcc

SEQ ID NO: 137721 - DNA, 35 bp, Artificial Sequence
  Synthetic oligonucleotide
tactcagcaacgccccccacccatgtggagcctcc

SEQ ID NO: 137722 - DNA, 35 bp, Artificial Sequence
  Synthetic oligonucleotide
gtctcgctgcagtacattcctgcttgagtcccatc

SEQ ID NO: 137723 - DNA, 35 bp, Artificial Sequence
  Synthetic oligonucleotide
tcacacgcgtgctcgtccacttttcacggcctctc

SEQ ID NO: 137724 - DNA, 35 bp, Artificial Sequence
  Synthetic oligonucleotide
gacctccatcacctgtttaggggtctacttctttc

SEQ ID NO: 137725 - DNA, 35 bp, Artificial Sequence
  Synthetic oligonucleotide
gacctccggggtgcgggagtaagggtgaggagggg

SEQ ID NO: 137726 - DNA, 35 bp, Artificial Sequence
  Synthetic oligonucleotide
ggtgccaccgccgctctatccgttccgcccatatg

SEQ ID NO: 137727 - DNA, 35 bp, Artificial Sequence
  Synthetic oligonucleotide
tgcagacactccggctctcactccccctctacgtg

SEQ ID NO: 137728 - DNA, 35 bp, Artificial Sequence
  Synthetic oligonucleotide
acctcctgcactatctgtcattcctggtttatttg

SEQ ID NO: 137729 - DNA, 35 bp, Artificial Sequence
  Synthetic oligonucleotide
tacgtgaacccgctacctatcctgtcaaggtcatt

SEQ ID NO: 137730 - DNA, 36 bp, Artificial Sequence
  Synthetic oligonucleotide
aagaaaggaacggtggagaggggacatgtgggccaa

SEQ ID NO: 137731 - DNA, 36 bp, Artificial Sequence
  Synthetic oligonucleotide
tgagcgccgctgcgtctccccatccctaccccctca

SEQ ID NO: 137732 - DNA, 37 bp, Artificial Sequence
  Synthetic oligonucleotide
ggagtgagagcagggggggagtaggaggatacacaga

SEQ ID NO: 137733 - DNA, 36 bp, Artificial Sequence
  Synthetic oligonucleotide
tgctatcctccacagcctgttctaccccctcggaga

SEQ ID NO: 137734 - DNA, 36 bp, Artificial Sequence
  Synthetic oligonucleotide
aacgaaggcgggccgggggaaagggagcttcataga

SEQ ID NO: 137735 - DNA, 36 bp, Artificial Sequence
  Synthetic oligonucleotide
actgccccttcctctcgtgaatgccaatccacccga

SEQ ID NO: 137736 - DNA, 35 bp, Artificial Sequence
  Synthetic oligonucleotide
acgctcaccaccgatatgcttccccctatgtgcga

SEQ ID NO: 137737 - DNA, 36 bp, Artificial Sequence
  Synthetic oligonucleotide
tctgactgcctcttacatttatacccacctgctcga

SEQ ID NO: 137738 - DNA, 35 bp, Artificial Sequence
  Synthetic oligonucleotide
tcccgccgtaacgaaggcctgacacactctctcga

SEQ ID NO: 137739 - DNA, 38 bp, Artificial Sequence
  Synthetic oligonucleotide
agcactgctacagccgggtggagggggagggcaactga

SEQ ID NO: 137740 - DNA, 37 bp, Artificial Sequence
  Synthetic oligonucleotide
tacgccgccgcccgacgtcgtctctcgcctgacctga

SEQ ID NO: 137741 - DNA, 37 bp, Artificial Sequence
  Synthetic oligonucleotide
tacgccgccaaatctgtttgctcccatctacgcccta

SEQ ID NO: 137742 - DNA, 35 bp, Artificial Sequence
  Synthetic oligonucleotide
accgccaacgctagactactcgcccgttacttgac

SEQ ID NO: 137743 - DNA, 35 bp, Artificial Sequence
  Synthetic oligonucleotide
ttcgtcccccgctcctgggtaaatcgctgtacacc

SEQ ID NO: 137744 - DNA, 35 bp, Artificial Sequence
  Synthetic oligonucleotide
aaaccactgccaataggtccactgatacacccccc

SEQ ID NO: 137745 - DNA, 35 bp, Artificial Sequence
  Synthetic oligonucleotide
gttaggcacctcgtttcccgcgctttataccgccc

SEQ ID NO: 137746 - DNA, 35 bp, Artificial Sequence
  Synthetic oligonucleotide
acccgtatggccacttgttcacccccccttggcgc

SEQ ID NO: 137747 - DNA, 35 bp, Artificial Sequence
  Synthetic oligonucleotide
tggacacgcccctttttggaacgcacgccccatgc

SEQ ID NO: 137748 - DNA, 35 bp, Artificial Sequence
  Synthetic oligonucleotide
tgcaccactgcaggtccctctccagcagcccatgc

SEQ ID NO: 137749 - DNA, 35 bp, Artificial Sequence
  Synthetic oligonucleotide
gttccatccggcctatctatccgtttcttttgtgc

SEQ ID NO: 137750 - DNA, 35 bp, Artificial Sequence
  Synthetic oligonucleotide
actctgacgacacttgaccctgcactagctccatc

SEQ ID NO: 137751 - DNA, 35 bp, Artificial Sequence
  Synthetic oligonucleotide
agcacgccccatacctcagtagccccacgtccatc

SEQ ID NO: 137752 - DNA, 35 bp, Artificial Sequence
  Synthetic oligonucleotide
taacacgtctgcccgggcgcgcttcccccgtactc

SEQ ID NO: 137753 - DNA, 35 bp, Artificial Sequence
  Synthetic oligonucleotide
tagacaggggtggggcgggataccgggttacaaag

SEQ ID NO: 137754 - DNA, 35 bp, Artificial Sequence
  Synthetic oligonucleotide
ggagggcatagggaagggaggtcggcgggacacgg

SEQ ID NO: 137755 - DNA, 35 bp, Artificial Sequence
  Synthetic oligonucleotide
gtgcatgcgggaataatcgtaaagggagggacggg

SEQ ID NO: 137756 - DNA, 35 bp, Artificial Sequence
  Synthetic oligonucleotide
gcggggggggtatgcggggtaaaaagggaatcgat

SEQ ID NO: 137757 - DNA, 35 bp, Artificial Sequence
  Synthetic oligonucleotide
acctcctcctccgcaatgtactcagctcacttatt

SEQ ID NO: 137758 - DNA, 35 bp, Artificial Sequence
  Synthetic oligonucleotide
attacaccgcccaacccatcgccacatagtgcgtt

SEQ ID NO: 137759 - DNA, 36 bp, Artificial Sequence
  Synthetic oligonucleotide
accacacctccgttccgtcactctgtgatcgctcaa

SEQ ID NO: 137760 - DNA, 35 bp, Artificial Sequence
  Synthetic oligonucleotide
gcatccccgagttgtattgttctcatcctgcccca

SEQ ID NO: 137761 - DNA, 35 bp, Artificial Sequence
  Synthetic oligonucleotide
cctgctccacacgcctgttgctgccatcacttcca

SEQ ID NO: 137762 - DNA, 35 bp, Artificial Sequence
  Synthetic oligonucleotide
atgacatccccggccacccgatttgcgtactcgca

SEQ ID NO: 137763 - DNA, 35 bp, Artificial Sequence
  Synthetic oligonucleotide
attaccgccccccttctatgtccgtggacaagtca

SEQ ID NO: 137764 - DNA, 37 bp, Artificial Sequence
  Synthetic oligonucleotide
tcgagagggacgaggcggaggggacggagcaccgaga

SEQ ID NO: 137765 - DNA, 35 bp, Artificial Sequence
  Synthetic oligonucleotide
gagcccctccgtcgccgtgatgtattcccctccga

SEQ ID NO: 137766 - DNA, 37 bp, Artificial Sequence
  Synthetic oligonucleotide
tcacctccaccctggctttgacatctgctcttcggga

SEQ ID NO: 137767 - DNA, 37 bp, Artificial Sequence
  Synthetic oligonucleotide
accacgtgcggggttgtgttttgttggggagagggga

SEQ ID NO: 137768 - DNA, 36 bp, Artificial Sequence
  Synthetic oligonucleotide
accagatgcgacctatacatatccgccgctccctga

SEQ ID NO: 137769 - DNA, 35 bp, Artificial Sequence
  Synthetic oligonucleotide
gctgtcctcccgtcctattcgaatccgttttcata

SEQ ID NO: 137770 - DNA, 35 bp, Artificial Sequence
  Synthetic oligonucleotide
gcgttgcccccccgacgtctgtaattcaacccgta

SEQ ID NO: 137771 - DNA, 35 bp, Artificial Sequence
  Synthetic oligonucleotide
gtcaggacacaagttcatactcaccgcaccaccac

SEQ ID NO: 137772 - DNA, 35 bp, Artificial Sequence
  Synthetic oligonucleotide
gcatcagacgcgaatgcatacgtctcttcatccac

SEQ ID NO: 137773 - DNA, 35 bp, Artificial Sequence
  Synthetic oligonucleotide
tccggagcatccctatcctcgttaagtccctaccc

SEQ ID NO: 137774 - DNA, 35 bp, Artificial Sequence
  Synthetic oligonucleotide
tgtcgacgcaacatacccacgcccttagctctgcc

SEQ ID NO: 137775 - DNA, 35 bp, Artificial Sequence
  Synthetic oligonucleotide
tacggagctacgtatcgctcaagccgccatgttcc

SEQ ID NO: 137776 - DNA, 35 bp, Artificial Sequence
  Synthetic oligonucleotide
acctctgttgcatcttcgccgacacctcgtcccgc

SEQ ID NO: 137777 - DNA, 35 bp, Artificial Sequence
  Synthetic oligonucleotide
gaacgctgactctgacgttccgatccctccctggc

SEQ ID NO: 137778 - DNA, 35 bp, Artificial Sequence
  Synthetic oligonucleotide
cgcgatcatgtgccggctccctacaacatcacctc

SEQ ID NO: 137779 - DNA, 35 bp, Artificial Sequence
  Synthetic oligonucleotide
acacgcccccctcatctataccaacgcaagggctc

SEQ ID NO: 137780 - DNA, 35 bp, Artificial Sequence
  Synthetic oligonucleotide
acacccgccatatgcgtgatacagcacgccttctc

SEQ ID NO: 137781 - DNA, 35 bp, Artificial Sequence
  Synthetic oligonucleotide
acgacaacctcctgtttctatttccgcctcgtgtc

SEQ ID NO: 137782 - DNA, 35 bp, Artificial Sequence
  Synthetic oligonucleotide
tcccctctgctccattatttttagcccttgccatg

SEQ ID NO: 137783 - DNA, 35 bp, Artificial Sequence
  Synthetic oligonucleotide
gcagatgagcaggaggagggggcgggtaacggcat

SEQ ID NO: 137784 - DNA, 36 bp, Artificial Sequence
  Synthetic oligonucleotide
gggtggcggtgacggggagggagggacgagagtcat

SEQ ID NO: 137785 - DNA, 35 bp, Artificial Sequence
  Synthetic oligonucleotide
gtcgactctgtgctcccgacccgccctttgtcact

SEQ ID NO: 137786 - DNA, 35 bp, Artificial Sequence
  Synthetic oligonucleotide
tcgacctgactgcccctcgataacgttgttcacct

SEQ ID NO: 137787 - DNA, 35 bp, Artificial Sequence
  Synthetic oligonucleotide
gcgccatgcctccgcgtacgaccggcacaaccctt

SEQ ID NO: 137788 - DNA, 36 bp, Artificial Sequence
  Synthetic oligonucleotide
ttgtcaccgcccatgatcggtccctttcgctacaaa

SEQ ID NO: 137789 - DNA, 36 bp, Artificial Sequence
  Synthetic oligonucleotide
accgcgtacgccgccggtaatccccctccttggaaa

SEQ ID NO: 137790 - DNA, 36 bp, Artificial Sequence
  Synthetic oligonucleotide
gtacacgaactccgtgtagtttcttctttccctgaa

SEQ ID NO: 137791 - DNA, 37 bp, Artificial Sequence
  Synthetic oligonucleotide
atggggtgggtagtgtaggggcggtcaccagcgggga

SEQ ID NO: 137792 - DNA, 37 bp, Artificial Sequence
  Synthetic oligonucleotide
gctcgggagggcgggatagggttaggacccaacatga

SEQ ID NO: 137793 - DNA, 38 bp, Artificial Sequence
  Synthetic oligonucleotide
gtgtacgcgcacacgcatagccaccgtatccccgctga

SEQ ID NO: 137794 - DNA, 38 bp, Artificial Sequence
  Synthetic oligonucleotide
ttgttgcgctcctgcttacccgacactgcaccccttga

SEQ ID NO: 137795 - DNA, 38 bp, Artificial Sequence
  Synthetic oligonucleotide
acccgactccactccgacgttatgtcacggtcatttga

SEQ ID NO: 137796 - DNA, 38 bp, Artificial Sequence
  Synthetic oligonucleotide
atcgccccccaggtggacctctagccttccttatttga

SEQ ID NO: 137797 - DNA, 36 bp, Artificial Sequence
  Synthetic oligonucleotide
atacgtgctcccctcccaatggtttcttcgctagta

SEQ ID NO: 137798 - DNA, 35 bp, Artificial Sequence
  Synthetic oligonucleotide
gcataccgatgcttatgttcgcgcgcttctccccc

SEQ ID NO: 137799 - DNA, 35 bp, Artificial Sequence
  Synthetic oligonucleotide
acacacctgtcaccctttttcaattagccgtccgc

SEQ ID NO: 137800 - DNA, 35 bp, Artificial Sequence
  Synthetic oligonucleotide
gaccctcctttgctctagccgctgttaacgctcgc

SEQ ID NO: 137801 - DNA, 35 bp, Artificial Sequence
  Synthetic oligonucleotide
tcatctgccccataccaaccaggtctacacctggc

SEQ ID NO: 137802 - DNA, 35 bp, Artificial Sequence
  Synthetic oligonucleotide
tccccccgcccaaatttctcaccgtgttgtttctc

SEQ ID NO: 137803 - DNA, 35 bp, Artificial Sequence
  Synthetic oligonucleotide
ttcgctccgccactcttcatgactcttctcctgcg

SEQ ID NO: 137804 - DNA, 35 bp, Artificial Sequence
  Synthetic oligonucleotide
tcaggtggtgcggggcgcaagggagttcggggtgg

SEQ ID NO: 137805 - DNA, 35 bp, Artificial Sequence
  Synthetic oligonucleotide
gggacccctaccacctgtgctcatactccctttct

SEQ ID NO: 137806 - DNA, 36 bp, Artificial Sequence
  Synthetic oligonucleotide
tcgagtgtaaggggcgggtgggaaggcaagaacaca

SEQ ID NO: 137807 - DNA, 35 bp, Artificial Sequence
  Synthetic oligonucleotide
aaagaggggggaccgacggtggggggatatggaca

SEQ ID NO: 137808 - DNA, 36 bp, Artificial Sequence
  Synthetic oligonucleotide
acgcatgccacccgttgcttcattgcgattccgcca

SEQ ID NO: 137809 - DNA, 36 bp, Artificial Sequence
  Synthetic oligonucleotide
gccttccatcagtcggtaccccatccctcgatcgca

SEQ ID NO: 137810 - DNA, 36 bp, Artificial Sequence
  Synthetic oligonucleotide
acagcctgccctttcaacccccattcgccgttgtca

SEQ ID NO: 137811 - DNA, 37 bp, Artificial Sequence
  Synthetic oligonucleotide
aacccccgcgctaccggtccctcttccccccgtcaga

SEQ ID NO: 137812 - DNA, 37 bp, Artificial Sequence
  Synthetic oligonucleotide
agacacccccctcggttaacatggaacctgcctacga

SEQ ID NO: 137813 - DNA, 37 bp, Artificial Sequence
  Synthetic oligonucleotide
gcactacctgctggcctcaacaccattacgccctcga

SEQ ID NO: 137814 - DNA, 36 bp, Artificial Sequence
  Synthetic oligonucleotide
gtccgcccccagtggcttgctccctttttccacgga

SEQ ID NO: 137815 - DNA, 37 bp, Artificial Sequence
  Synthetic oligonucleotide
tgcaccgccgctgcccgcctctgatattcccactgga

SEQ ID NO: 137816 - DNA, 36 bp, Artificial Sequence
  Synthetic oligonucleotide
gttccacaccgcgtcgttctcctcctgtctgcctga

SEQ ID NO: 137817 - DNA, 38 bp, Artificial Sequence
  Synthetic oligonucleotide
gctggactcgccagcattgcaccactcatcctcgctga

SEQ ID NO: 137818 - DNA, 37 bp, Artificial Sequence
  Synthetic oligonucleotide
gatgggacgggggaaggtggtcgtaagcatgatgtga

SEQ ID NO: 137819 - DNA, 38 bp, Artificial Sequence
  Synthetic oligonucleotide
tgtaggatggatgggggcgggagggaatagcgctgtga

SEQ ID NO: 137820 - DNA, 38 bp, Artificial Sequence
  Synthetic oligonucleotide
gacaccctctggatcctcatactgccccccatacttga

SEQ ID NO: 137821 - DNA, 38 bp, Artificial Sequence
  Synthetic oligonucleotide
gccatccctcgtgctacttctgtctttctgtcctttga

SEQ ID NO: 137822 - DNA, 35 bp, Artificial Sequence
  Synthetic oligonucleotide
agtgacgccgccgctgcctaactccgcgccaccta

SEQ ID NO: 137823 - DNA, 35 bp, Artificial Sequence
  Synthetic oligonucleotide
gtcctgccaccatcccggcgttctgtaccttggta

SEQ ID NO: 137824 - DNA, 35 bp, Artificial Sequence
  Synthetic oligonucleotide
tccgctcgggcgggagggagaatggggctgctgta

SEQ ID NO: 137825 - DNA, 36 bp, Artificial Sequence
  Synthetic oligonucleotide
ggatgccccatcggcccatcatgagttccgccctta

SEQ ID NO: 137826 - DNA, 35 bp, Artificial Sequence
  Synthetic oligonucleotide
gatatccctcattctgtacgactcgctgacttcac

SEQ ID NO: 137827 - DNA, 35 bp, Artificial Sequence
  Synthetic oligonucleotide
gaactcacccggcatggtcccctcgccccgacacc

SEQ ID NO: 137828 - DNA, 35 bp, Artificial Sequence
  Synthetic oligonucleotide
acacacgcacatctacttcacggccggcacccccc

SEQ ID NO: 137829 - DNA, 35 bp, Artificial Sequence
  Synthetic oligonucleotide
agacgcaactacgcctcttctccgtgtcacgcccc

SEQ ID NO: 137830 - DNA, 35 bp, Artificial Sequence
  Synthetic oligonucleotide
ttgccccatccccgagaggccgttggtcatgcccc

SEQ ID NO: 137831 - DNA, 35 bp, Artificial Sequence
  Synthetic oligonucleotide
aaccaccgtacgaaaccaccacccatgccgagccc

SEQ ID NO: 137832 - DNA, 35 bp, Artificial Sequence
  Synthetic oligonucleotide
tccggtgcctgagcttggtacctcgccgccccgcc

SEQ ID NO: 137833 - DNA, 35 bp, Artificial Sequence
  Synthetic oligonucleotide
tgccctcccggtgtccctcgctatctccgatcgcc

SEQ ID NO: 137834 - DNA, 35 bp, Artificial Sequence
  Synthetic oligonucleotide
gatacacccccttgaaactgtcagagtgcctgtcc

SEQ ID NO: 137835 - DNA, 35 bp, Artificial Sequence
  Synthetic oligonucleotide
gctcccccaccgctcacactctgcgcttcgtaggc

SEQ ID NO: 137836 - DNA, 35 bp, Artificial Sequence
  Synthetic oligonucleotide
ttgccacggggtcctgttcttacctacatgctgtc

SEQ ID NO: 137837 - DNA, 34 bp, Artificial Sequence
  Synthetic oligonucleotide
gttcaccccacttggcccctaaacccgtgctttc

SEQ ID NO: 137838 - DNA, 35 bp, Artificial Sequence
  Synthetic oligonucleotide
gtgagcatcgccgttcgacacgttccccgtttttc

SEQ ID NO: 137839 - DNA, 35 bp, Artificial Sequence
  Synthetic oligonucleotide
gtggtcccgcacacctcctttcttacacatttacg

SEQ ID NO: 137840 - DNA, 35 bp, Artificial Sequence
  Synthetic oligonucleotide
tgtgtgaaagggtgggaagaggacggggaaaaggg

SEQ ID NO: 137841 - DNA, 35 bp, Artificial Sequence
  Synthetic oligonucleotide
gatagtctgctggtcctctcccaccccccctgtgg

SEQ ID NO: 137842 - DNA, 35 bp, Artificial Sequence
  Synthetic oligonucleotide
tcttacgacgcccctcctccgtgatgcacttcatt

SEQ ID NO: 137843 - DNA, 35 bp, Artificial Sequence
  Synthetic oligonucleotide
gagacgcctcctcgcccctcgtcgttagtacattt

SEQ ID NO: 137844 - DNA, 35 bp, Artificial Sequence
  Synthetic oligonucleotide
tgttccctcggtcgccgctactactagttcccaca

SEQ ID NO: 137845 - DNA, 35 bp, Artificial Sequence
  Synthetic oligonucleotide
tacatcccacatcccggtgaccattgcctcacgca

SEQ ID NO: 137846 - DNA, 35 bp, Artificial Sequence
  Synthetic oligonucleotide
tcgcgcccaatgttctcaccggccactatcattca

SEQ ID NO: 137847 - DNA, 36 bp, Artificial Sequence
  Synthetic oligonucleotide
tatgcaccccagtgcttatgcactcttccatgttca

SEQ ID NO: 137848 - DNA, 37 bp, Artificial Sequence
  Synthetic oligonucleotide
gtgatgggaggtggtagtttagggcactggggagaga

SEQ ID NO: 137849 - DNA, 37 bp, Artificial Sequence
  Synthetic oligonucleotide
gagccgcattggttcgaccacgccccttctctgacga

SEQ ID NO: 137850 - DNA, 37 bp, Artificial Sequence
  Synthetic oligonucleotide
aagtgaggcaaaaagcgggaagaatcgggggaacgga

SEQ ID NO: 137851 - DNA, 37 bp, Artificial Sequence
  Synthetic oligonucleotide
ccaaggaggggaagggtatcggtaatgtaggtgggga

SEQ ID NO: 137852 - DNA, 37 bp, Artificial Sequence
  Synthetic oligonucleotide
tatccctctcctgttcctacatggcccgtcccctgga

SEQ ID NO: 137853 - DNA, 37 bp, Artificial Sequence
  Synthetic oligonucleotide
tccccagtccatgtgtggttcgtgttctccgccctga

SEQ ID NO: 137854 - DNA, 38 bp, Artificial Sequence
  Synthetic oligonucleotide
ggggggcggttcggggagaatggtggtggctggcctga

SEQ ID NO: 137855 - DNA, 37 bp, Artificial Sequence
  Synthetic oligonucleotide
gccccagtcgccaccccgccccaccctctgttgctga

SEQ ID NO: 137856 - DNA, 37 bp, Artificial Sequence
  Synthetic oligonucleotide
tgtcccgtcctccgtcgtttcccaatgcgctctctga

SEQ ID NO: 137857 - DNA, 38 bp, Artificial Sequence
  Synthetic oligonucleotide
ggtcctgcccggccttccttattaagcccctgccttga

SEQ ID NO: 137858 - DNA, 37 bp, Artificial Sequence
  Synthetic oligonucleotide
ttgctcacatctgctgcgcctctaccccgccctttga

SEQ ID NO: 137859 - DNA, 36 bp, Artificial Sequence
  Synthetic oligonucleotide
attcagtctcgccatcgccatgcccctatctgagta

SEQ ID NO: 137860 - DNA, 35 bp, Artificial Sequence
  Synthetic oligonucleotide
gccgtcatatgtccctaccgtgtgcattacctccc

SEQ ID NO: 137861 - DNA, 35 bp, Artificial Sequence
  Synthetic oligonucleotide
tgaggccacaggtgcgcagttttctcttttcctcc

SEQ ID NO: 137862 - DNA, 34 bp, Artificial Sequence
  Synthetic oligonucleotide
tccccttgccccgctaagtcctggacccctgtcc

SEQ ID NO: 137863 - DNA, 35 bp, Artificial Sequence
  Synthetic oligonucleotide
gtcgtaacctcactggcccttggaagcccgtttcc

SEQ ID NO: 137864 - DNA, 35 bp, Artificial Sequence
  Synthetic oligonucleotide
acccgtctctcgcccgacagtgtcttatccctcgc

SEQ ID NO: 137865 - DNA, 35 bp, Artificial Sequence
  Synthetic oligonucleotide
gtgcgccccccggtagccttttctctttccgaatc

SEQ ID NO: 137866 - DNA, 35 bp, Artificial Sequence
  Synthetic oligonucleotide
ggcgcccacactgcttccgtcacgttactcccgtc

SEQ ID NO: 137867 - DNA, 35 bp, Artificial Sequence
  Synthetic oligonucleotide
gtgacgcctcgccatgtctccccctcgcctctgtc

SEQ ID NO: 137868 - DNA, 35 bp, Artificial Sequence
  Synthetic oligonucleotide
acgtaccacccccgacacttgatgctgtcttcccg

SEQ ID NO: 137869 - DNA, 35 bp, Artificial Sequence
  Synthetic oligonucleotide
tcacgcccttgaatctagcatctttggacccttcg

SEQ ID NO: 137870 - DNA, 35 bp, Artificial Sequence
  Synthetic oligonucleotide
acgaacaacccccaccacaggcgtattatcccctg

SEQ ID NO: 137871 - DNA, 36 bp, Artificial Sequence
  Synthetic oligonucleotide
tcccacaggccccgctggaaaacgttctcccccgct

SEQ ID NO: 137872 - DNA, 35 bp, Artificial Sequence
  Synthetic oligonucleotide
tcatcatcccctctattgtgtttgtttcgttatgt

SEQ ID NO: 137873 - DNA, 35 bp, Artificial Sequence
  Synthetic oligonucleotide
gaaccccacgagcccgcgccccttcgcgacccgtt

SEQ ID NO: 137874 - DNA, 35 bp, Artificial Sequence
  Synthetic oligonucleotide
agcccaccaccagcacgggagtctttctgttcttt

SEQ ID NO: 137875 - DNA, 36 bp, Artificial Sequence
  Synthetic oligonucleotide
tctctcccacacatgaattctaccagtccaccgaca

SEQ ID NO: 137876 - DNA, 36 bp, Artificial Sequence
  Synthetic oligonucleotide
tgctgtatcctgccccatgtaccaccaaccgttaca

SEQ ID NO: 137877 - DNA, 36 bp, Artificial Sequence
  Synthetic oligonucleotide
tccgcgcggcacgtaagtcgtcctccgtctgcccca

SEQ ID NO: 137878 - DNA, 36 bp, Artificial Sequence
  Synthetic oligonucleotide
tgagcaccgcttcccctacaaccctgccatgtccca

SEQ ID NO: 137879 - DNA, 36 bp, Artificial Sequence
  Synthetic oligonucleotide
tcttggccctcctccctgctgtatcatactcaatca

SEQ ID NO: 137880 - DNA, 37 bp, Artificial Sequence
  Synthetic oligonucleotide
tctcactccgccccactcctaagaggaatcctcccga

SEQ ID NO: 137881 - DNA, 36 bp, Artificial Sequence
  Synthetic oligonucleotide
atgcgggcaaggtggtggtgcggttggggggtgcga

SEQ ID NO: 137882 - DNA, 33 bp, Artificial Sequence
  Synthetic oligonucleotide
accgtacacccgccctcctgctagaacgacgga

SEQ ID NO: 137883 - DNA, 37 bp, Artificial Sequence
  Synthetic oligonucleotide
gcccccggcctctttctgtcatcactcgttttccgga

SEQ ID NO: 137884 - DNA, 37 bp, Artificial Sequence
  Synthetic oligonucleotide
aaaagggtgggggcacatggggggtagaattcgggga

SEQ ID NO: 137885 - DNA, 37 bp, Artificial Sequence
  Synthetic oligonucleotide
ttgggagtggcggtttccatcctagggcggtggggga

SEQ ID NO: 137886 - DNA, 38 bp, Artificial Sequence
  Synthetic oligonucleotide
taccaccaccgcctctggctccgaccaggtcaccctga

SEQ ID NO: 137887 - DNA, 36 bp, Artificial Sequence
  Synthetic oligonucleotide
tacaccgccggcctgtccttttgcgaacctccctta

SEQ ID NO: 137888 - DNA, 36 bp, Artificial Sequence
  Synthetic oligonucleotide
tccacgggtaccgagcgtccaggggggggagggtta

SEQ ID NO: 137889 - DNA, 35 bp, Artificial Sequence
  Synthetic oligonucleotide
ggacctcctgtctcagctcgttacgttccatccac

SEQ ID NO: 137890 - DNA, 35 bp, Artificial Sequence
  Synthetic oligonucleotide
atccaccactggcgtagctgcctttgtcgctccac

SEQ ID NO: 137891 - DNA, 35 bp, Artificial Sequence
  Synthetic oligonucleotide
tcgccaatcctcatgcttatactttccggcgaacc

SEQ ID NO: 137892 - DNA, 35 bp, Artificial Sequence
  Synthetic oligonucleotide
gaatgcgttgcccgacggccgtctcgttcccgccc

SEQ ID NO: 137893 - DNA, 35 bp, Artificial Sequence
  Synthetic oligonucleotide
gcgcaacacgtcatgcttacttacgtgcctttccc

SEQ ID NO: 137894 - DNA, 35 bp, Artificial Sequence
  Synthetic oligonucleotide
atgcggagtagttccctttgattgcccggcccgcc

SEQ ID NO: 137895 - DNA, 35 bp, Artificial Sequence
  Synthetic oligonucleotide
tctctcgccctgatctatctcggttagtcttcgcc

SEQ ID NO: 137896 - DNA, 35 bp, Artificial Sequence
  Synthetic oligonucleotide
atagcaccatcctgtagatttcccgtcacccggcc

SEQ ID NO: 137897 - DNA, 35 bp, Artificial Sequence
  Synthetic oligonucleotide
agcgtgcgacatttccatgcatctgctttcgctcc

SEQ ID NO: 137898 - DNA, 35 bp, Artificial Sequence
  Synthetic oligonucleotide
tcacctcgatgcctgggtcactctcgccgctactc

SEQ ID NO: 137899 - DNA, 35 bp, Artificial Sequence
  Synthetic oligonucleotide
tgactggccacttctgcttctgagcatagcccctc

SEQ ID NO: 137900 - DNA, 35 bp, Artificial Sequence
  Synthetic oligonucleotide
ttgtctcacgcgcaaagctgctccccatgcccctc

SEQ ID NO: 137901 - DNA, 35 bp, Artificial Sequence
  Synthetic oligonucleotide
tttgcgaagctggcagtccccactgtcttgccctc

SEQ ID NO: 137902 - DNA, 35 bp, Artificial Sequence
  Synthetic oligonucleotide
gaagcccacccaccgtactcgctgccgttgtagtc

SEQ ID NO: 137903 - DNA, 35 bp, Artificial Sequence
  Synthetic oligonucleotide
tgacattcgtgccgtctttcattgcgcttctgttc

SEQ ID NO: 137904 - DNA, 35 bp, Artificial Sequence
  Synthetic oligonucleotide
gatacgtggcagaagggtggaaatcagggccgcag

SEQ ID NO: 137905 - DNA, 35 bp, Artificial Sequence
  Synthetic oligonucleotide
ccattcgcccccgctccgtgccggcccttctaccg

SEQ ID NO: 137906 - DNA, 35 bp, Artificial Sequence
  Synthetic oligonucleotide
gatcagtcttctcctgtctttctgcccctagcccg

SEQ ID NO: 137907 - DNA, 35 bp, Artificial Sequence
  Synthetic oligonucleotide
gttaaggcaaatagggggaggaggggagtacgcgg

SEQ ID NO: 137908 - DNA, 34 bp, Artificial Sequence
  Synthetic oligonucleotide
taggttgctcacccttttccttcccttgatgcgg

SEQ ID NO: 137909 - DNA, 35 bp, Artificial Sequence
  Synthetic oligonucleotide
gccctaccccgtagcgatgacctcctcttgtttct

SEQ ID NO: 137910 - DNA, 35 bp, Artificial Sequence
  Synthetic oligonucleotide
tcatcgcccaccggaatttggcgtcattggccctt

SEQ ID NO: 137911 - DNA, 35 bp, Artificial Sequence
  Synthetic oligonucleotide
tacgctacgccgccttctgcactcctcgatacgtt

SEQ ID NO: 137912 - DNA, 36 bp, Artificial Sequence
  Synthetic oligonucleotide
gccggtgcctgcctattctggttttccctgttacaa

SEQ ID NO: 137913 - DNA, 36 bp, Artificial Sequence
  Synthetic oligonucleotide
tacccgcctcttcccgttgtctctagggcttgtaca

SEQ ID NO: 137914 - DNA, 35 bp, Artificial Sequence
  Synthetic oligonucleotide
gtcgcatccctgcctagccatttgttcctcaccca

SEQ ID NO: 137915 - DNA, 36 bp, Artificial Sequence
  Synthetic oligonucleotide
gccccgcacgctgtccaccacgtccgcacaaccgca

SEQ ID NO: 137916 - DNA, 36 bp, Artificial Sequence
  Synthetic oligonucleotide
atgtccctacacccgacagcccgtagttccacctca

SEQ ID NO: 137917 - DNA, 37 bp, Artificial Sequence
  Synthetic oligonucleotide
ttacacacctcctgtttcgttacatctcgtccttaga

SEQ ID NO: 137918 - DNA, 37 bp, Artificial Sequence
  Synthetic oligonucleotide
gcccccgtccagtacgcattcttatcgtctcctccga

SEQ ID NO: 137919 - DNA, 37 bp, Artificial Sequence
  Synthetic oligonucleotide
tcagtggggtgggtagagtgatgggcaaatacgggga

SEQ ID NO: 137920 - DNA, 37 bp, Artificial Sequence
  Synthetic oligonucleotide
aatggcgggagggggtaagggcaggatagcgaatgga

SEQ ID NO: 137921 - DNA, 37 bp, Artificial Sequence
  Synthetic oligonucleotide
tcaccgaaacctctgcatactaccacccaaacgtgga

SEQ ID NO: 137922 - DNA, 38 bp, Artificial Sequence
  Synthetic oligonucleotide
tagtgcatgtggagcgggtgcgggggagagggaaatga

SEQ ID NO: 137923 - DNA, 38 bp, Artificial Sequence
  Synthetic oligonucleotide
tccgatcagacgtgcccgcctatctccgctttccctga

SEQ ID NO: 137924 - DNA, 36 bp, Artificial Sequence
  Synthetic oligonucleotide
ttccccacttccacctgtactttagaaccaccgtga

SEQ ID NO: 137925 - DNA, 38 bp, Artificial Sequence
  Synthetic oligonucleotide
gcatgtaagcggaggaagggggggggacggaccggtga

SEQ ID NO: 137926 - DNA, 37 bp, Artificial Sequence
  Synthetic oligonucleotide
gtccgcccgcacatctctcgtccttttaagcacttga

SEQ ID NO: 137927 - DNA, 38 bp, Artificial Sequence
  Synthetic oligonucleotide
ttccccagtcccacgcttgttgcccctcactgacttga

SEQ ID NO: 137928 - DNA, 38 bp, Artificial Sequence
  Synthetic oligonucleotide
gacgaataaggacaggggtggaatgagggggaggttga

SEQ ID NO: 137929 - DNA, 36 bp, Artificial Sequence
  Synthetic oligonucleotide
acgctcgccctaccgtttaccactgacgccgcacta

SEQ ID NO: 137930 - DNA, 35 bp, Artificial Sequence
  Synthetic oligonucleotide
atgccccactcttttggtctccacagctataccta

SEQ ID NO: 137931 - DNA, 35 bp, Artificial Sequence
  Synthetic oligonucleotide
acgaaccgctggccccaggatatcgcccctaccta

SEQ ID NO: 137932 - DNA, 35 bp, Artificial Sequence
  Synthetic oligonucleotide
tcgatacactccgacggacgtcctcatctccaccc

SEQ ID NO: 137933 - DNA, 35 bp, Artificial Sequence
  Synthetic oligonucleotide
tcaccctccggcatctcgccccactccagtccccc

SEQ ID NO: 137934 - DNA, 35 bp, Artificial Sequence
  Synthetic oligonucleotide
ggtttgcccccacgaattatacagttacccctgcc

SEQ ID NO: 137935 - DNA, 35 bp, Artificial Sequence
  Synthetic oligonucleotide
gactgcgtataggtctatccctgctttccatgtcc

SEQ ID NO: 137936 - DNA, 35 bp, Artificial Sequence
  Synthetic oligonucleotide
gtcgccgtccattcgcccaaaatgcccagtattcc

SEQ ID NO: 137937 - DNA, 35 bp, Artificial Sequence
  Synthetic oligonucleotide
agctcactcattgccgcttatcccatggacgttcc

SEQ ID NO: 137938 - DNA, 35 bp, Artificial Sequence
  Synthetic oligonucleotide
aattcccgtgtagcccgccgtaaatgcccccctgc

SEQ ID NO: 137939 - DNA, 35 bp, Artificial Sequence
  Synthetic oligonucleotide
acgctggcaactccgccccgtcgcttatacccctc

SEQ ID NO: 137940 - DNA, 35 bp, Artificial Sequence
  Synthetic oligonucleotide
tcagtctgggtgaggagggttatggtgatgggagg

SEQ ID NO: 137941 - DNA, 34 bp, Artificial Sequence
  Synthetic oligonucleotide
aacaccggcccatccatggtcttaccttatcact

SEQ ID NO: 137942 - DNA, 35 bp, Artificial Sequence
  Synthetic oligonucleotide
tgaaacacggcgttccctgggctcaatccgtttct

SEQ ID NO: 137943 - DNA, 35 bp, Artificial Sequence
  Synthetic oligonucleotide
gagcccactgttcctgccgtgttctgtctacttgt

SEQ ID NO: 137944 - DNA, 35 bp, Artificial Sequence
  Synthetic oligonucleotide
tccgccgccgctctcggcaatcttgttttaccctt

SEQ ID NO: 137945 - DNA, 35 bp, Artificial Sequence
  Synthetic oligonucleotide
ttggtgcacaacttattatggcgatctcccctgtt

SEQ ID NO: 137946 - DNA, 30 bp, Artificial Sequence
  Synthetic oligonucleotide
gctcccatgctgtacccctttactcctcaa

SEQ ID NO: 137947 - DNA, 36 bp, Artificial Sequence
  Synthetic oligonucleotide
ggaaccgcctcatagtactggtcgccgccctattaa

SEQ ID NO: 137948 - DNA, 36 bp, Artificial Sequence
  Synthetic oligonucleotide
gaggtgggtagggtagggaaggtatgaaaggtttaa

SEQ ID NO: 137949 - DNA, 36 bp, Artificial Sequence
  Synthetic oligonucleotide
tcactacctgccccgatctgttttagccccgcgaca

SEQ ID NO: 137950 - DNA, 35 bp, Artificial Sequence
  Synthetic oligonucleotide
tccgcgcccctatgccgtaccgctctcaatatgca

SEQ ID NO: 137951 - DNA, 35 bp, Artificial Sequence
  Synthetic oligonucleotide
gccacatcctcccgctgtctattgccggaactgca

SEQ ID NO: 137952 - DNA, 37 bp, Artificial Sequence
  Synthetic oligonucleotide
tgagagcggagggtaatgggggaggagcaagatcaga

SEQ ID NO: 137953 - DNA, 37 bp, Artificial Sequence
  Synthetic oligonucleotide
tactccgatccagtacatgtacaaccctgcccctcga

SEQ ID NO: 137954 - DNA, 36 bp, Artificial Sequence
  Synthetic oligonucleotide
ggacgccctccgatctcattatcctcgcccatcgga

SEQ ID NO: 137955 - DNA, 36 bp, Artificial Sequence
  Synthetic oligonucleotide
tcaccaccgttcgcgcctctagccactggaccatga

SEQ ID NO: 137956 - DNA, 38 bp, Artificial Sequence
  Synthetic oligonucleotide
ggtggtgggtgggaatcgtggggtggacgggatagtga

SEQ ID NO: 137957 - DNA, 35 bp, Artificial Sequence
  Synthetic oligonucleotide
tgtgcgcacatcacgccgccctcgaatactcgcta

SEQ ID NO: 137958 - DNA, 36 bp, Artificial Sequence
  Synthetic oligonucleotide
gtccgcaagcctgccttgtcctcagctccaccctta

SEQ ID NO: 137959 - DNA, 36 bp, Artificial Sequence
  Synthetic oligonucleotide
gcctcaacgtatccgttctgtacgcctccccattta

SEQ ID NO: 137960 - DNA, 35 bp, Artificial Sequence
  Synthetic oligonucleotide
agttgtgcctgttgcccgatactacccttgttcac

SEQ ID NO: 137961 - DNA, 35 bp, Artificial Sequence
  Synthetic oligonucleotide
gtgtcgaccacccagatggtttgcttccatctccc

SEQ ID NO: 137962 - DNA, 35 bp, Artificial Sequence
  Synthetic oligonucleotide
actcaacttagttgtctctagcctgccctttcgcc

SEQ ID NO: 137963 - DNA, 35 bp, Artificial Sequence
  Synthetic oligonucleotide
tatgcgcttcggtctcccatccttgtgatcgttcc

SEQ ID NO: 137964 - DNA, 35 bp, Artificial Sequence
  Synthetic oligonucleotide
tcagcatacaattcgttgttcgaccctgcccacgc

SEQ ID NO: 137965 - DNA, 35 bp, Artificial Sequence
  Synthetic oligonucleotide
gcaaagtcgcaatgccgcctatccatgctgcccgc

SEQ ID NO: 137966 - DNA, 35 bp, Artificial Sequence
  Synthetic oligonucleotide
tgcatcctcacatacgcctcatcattcgctgtcgc

SEQ ID NO: 137967 - DNA, 35 bp, Artificial Sequence
  Synthetic oligonucleotide
atcgccgatgcgtactctcctgtctgcctcacctc

SEQ ID NO: 137968 - DNA, 35 bp, Artificial Sequence
  Synthetic oligonucleotide
ttatgcgatcccattgttcccgtgctcgtctcctc

SEQ ID NO: 137969 - DNA, 35 bp, Artificial Sequence
  Synthetic oligonucleotide
atctgcccgattgcccatgcgctcctaggttgctc

SEQ ID NO: 137970 - DNA, 35 bp, Artificial Sequence
  Synthetic oligonucleotide
tacaacccctgtgcccttatactgacatgtatctc

SEQ ID NO: 137971 - DNA, 35 bp, Artificial Sequence
  Synthetic oligonucleotide
tacacccggcccgaaccctcgcgcaccttaatgtc

SEQ ID NO: 137972 - DNA, 35 bp, Artificial Sequence
  Synthetic oligonucleotide
tgggcactgattcgccgcgtgctccctcctacccg

SEQ ID NO: 137973 - DNA, 35 bp, Artificial Sequence
  Synthetic oligonucleotide
tttcgccatgccgctccctcctttggtcccatccg

SEQ ID NO: 137974 - DNA, 35 bp, Artificial Sequence
  Synthetic oligonucleotide
gcacctcccatccatgtgcgcatatcgctcctccg

SEQ ID NO: 137975 - DNA, 35 bp, Artificial Sequence
  Synthetic oligonucleotide
tccgccaaagcggttaaggggggaaggaactgggg

SEQ ID NO: 137976 - DNA, 35 bp, Artificial Sequence
  Synthetic oligonucleotide
gcgaatgggggggcgggggaggaacgagggtacgt

SEQ ID NO: 137977 - DNA, 35 bp, Artificial Sequence
  Synthetic oligonucleotide
tcaccgcttcacagccgctcccccaagctactttt

SEQ ID NO: 137978 - DNA, 35 bp, Artificial Sequence
  Synthetic oligonucleotide
ggaggagctgcgtaggataggggggggtggggcaa

SEQ ID NO: 137979 - DNA, 36 bp, Artificial Sequence
  Synthetic oligonucleotide
gtgtgagtgcggggggtggtgggcgtggtggcggaa

SEQ ID NO: 137980 - DNA, 36 bp, Artificial Sequence
  Synthetic oligonucleotide
tacctgccgggtgggggtaaaatgctggggagggaa

SEQ ID NO: 137981 - DNA, 35 bp, Artificial Sequence
  Synthetic oligonucleotide
tcgcacgcccgggggagggagggtcctgggataca

SEQ ID NO: 137982 - DNA, 36 bp, Artificial Sequence
  Synthetic oligonucleotide
atgctccactagtgttttcagccgctctacccacca

SEQ ID NO: 137983 - DNA, 35 bp, Artificial Sequence
  Synthetic oligonucleotide
ggacgccctcagccccaggcattctaccaccgcca

SEQ ID NO: 137984 - DNA, 36 bp, Artificial Sequence
  Synthetic oligonucleotide
atggcacagtccgtctctttgcagccacccccagca

SEQ ID NO: 137985 - DNA, 37 bp, Artificial Sequence
  Synthetic oligonucleotide
tgccatccattgccctctccacacgccaggcttgaga

SEQ ID NO: 137986 - DNA, 37 bp, Artificial Sequence
  Synthetic oligonucleotide
gcaccgatccggtgcattttaacttttgctcctccga

SEQ ID NO: 137987 - DNA, 37 bp, Artificial Sequence
  Synthetic oligonucleotide
gtcgaccaccgcccatactggagattacacccctcga

SEQ ID NO: 137988 - DNA, 37 bp, Artificial Sequence
  Synthetic oligonucleotide
gggggaggatagggaggaggtgggaccgtagtaagga

SEQ ID NO: 137989 - DNA, 37 bp, Artificial Sequence
  Synthetic oligonucleotide
acacctccatctccatttccgcatcccgtcatgcgga

SEQ ID NO: 137990 - DNA, 37 bp, Artificial Sequence
  Synthetic oligonucleotide
aactgggggcacatgtggacaaactatcgggagggga

SEQ ID NO: 137991 - DNA, 37 bp, Artificial Sequence
  Synthetic oligonucleotide
atgcgggggcgggtggggtccaaccatgaatagggga

SEQ ID NO: 137992 - DNA, 37 bp, Artificial Sequence
  Synthetic oligonucleotide
gggtggagtgggggggagcaaagaccgagtttgtgga

SEQ ID NO: 137993 - DNA, 38 bp, Artificial Sequence
  Synthetic oligonucleotide
tcgctctctccgcctgttaagtccccgtcccactatga

SEQ ID NO: 137994 - DNA, 37 bp, Artificial Sequence
  Synthetic oligonucleotide
tctgcccattgtactgctgtttctgcccttttgctga

SEQ ID NO: 137995 - DNA, 36 bp, Artificial Sequence
  Synthetic oligonucleotide
tgtgcgcacacaccctgttcggccattctctcgtga

SEQ ID NO: 137996 - DNA, 38 bp, Artificial Sequence
  Synthetic oligonucleotide
tgcctggcgctccctcgattgccgcatccactccttga

SEQ ID NO: 137997 - DNA, 36 bp, Artificial Sequence
  Synthetic oligonucleotide
agacgggaggaaggtgaggggtgattggggtctata

SEQ ID NO: 137998 - DNA, 36 bp, Artificial Sequence
  Synthetic oligonucleotide
ttccgcctgcccgtagcctttccggtaatccccgta

SEQ ID NO: 137999 - DNA, 35 bp, Artificial Sequence
  Synthetic oligonucleotide
tgcgcccgctgttactgtactttgtcatgcctccc

SEQ ID NO: 138000 - DNA, 35 bp, Artificial Sequence
  Synthetic oligonucleotide
cccactatacagtggggcaccttacgccttccgcc

SEQ ID NO: 138001 - DNA, 35 bp, Artificial Sequence
  Synthetic oligonucleotide
acaccagtcattgcttgcattaacccgccttttcc

SEQ ID NO: 138002 - DNA, 35 bp, Artificial Sequence
  Synthetic oligonucleotide
gccctcttcagtgtacgcgcctatccaccccggtc

SEQ ID NO: 138003 - DNA, 35 bp, Artificial Sequence
  Synthetic oligonucleotide
ttaccaaacgcctgtatggtcgttatcacctcttc

SEQ ID NO: 138004 - DNA, 35 bp, Artificial Sequence
  Synthetic oligonucleotide
gccagtcccgctccacctggtggctgaagcctttc

SEQ ID NO: 138005 - DNA, 35 bp, Artificial Sequence
  Synthetic oligonucleotide
gccgctcccggcaattaactgctctcacgccaccg

SEQ ID NO: 138006 - DNA, 35 bp, Artificial Sequence
  Synthetic oligonucleotide
tgcccatcacgtgttccggcctcccaatatactcg

SEQ ID NO: 138007 - DNA, 35 bp, Artificial Sequence
  Synthetic oligonucleotide
ggacgggttggggaggagcacacacagtggaaggg

SEQ ID NO: 138008 - DNA, 35 bp, Artificial Sequence
  Synthetic oligonucleotide
gcaagggcagggggaggccgggggaatgcagcggg

SEQ ID NO: 138009 - DNA, 35 bp, Artificial Sequence
  Synthetic oligonucleotide
gtctgttggccttccgaccctgctctaacctcctg

SEQ ID NO: 138010 - DNA, 35 bp, Artificial Sequence
  Synthetic oligonucleotide
acccctccgttgacgcccatgggcgagccctccct

SEQ ID NO: 138011 - DNA, 35 bp, Artificial Sequence
  Synthetic oligonucleotide
gacgggcgggggggagccggaccagtaaatagggt

SEQ ID NO: 138012 - DNA, 35 bp, Artificial Sequence
  Synthetic oligonucleotide
tctgcaccaccctccgctatatgtttgactgctgt

SEQ ID NO: 138013 - DNA, 35 bp, Artificial Sequence
  Synthetic oligonucleotide
actcgctcccccccggatccctttagaacgtcgca

SEQ ID NO: 138014 - DNA, 37 bp, Artificial Sequence
  Synthetic oligonucleotide
ggaagagggacaaaagtgaagggcgggcgggaaaaga

SEQ ID NO: 138015 - DNA, 37 bp, Artificial Sequence
  Synthetic oligonucleotide
tggggtcggctcagtgagggggggggcaatgggagga

SEQ ID NO: 138016 - DNA, 36 bp, Artificial Sequence
  Synthetic oligonucleotide
tcacgtagtcgcgtccaatacatctccccacccgga

SEQ ID NO: 138017 - DNA, 37 bp, Artificial Sequence
  Synthetic oligonucleotide
gcgggggaaatgggaatacgtgcaaagggggagggga

SEQ ID NO: 138018 - DNA, 37 bp, Artificial Sequence
  Synthetic oligonucleotide
gtaacactcggcccctattaccgccactcatccatga

SEQ ID NO: 138019 - DNA, 37 bp, Artificial Sequence
  Synthetic oligonucleotide
gacgacgtgaccgaggagggagggatagtgggcatga

SEQ ID NO: 138020 - DNA, 38 bp, Artificial Sequence
  Synthetic oligonucleotide
gtcacccccagcatgcccgttcgtcgttgctccactga

SEQ ID NO: 138021 - DNA, 38 bp, Artificial Sequence
  Synthetic oligonucleotide
actgggacggggaagggaagggacaagtcgggcgttga

SEQ ID NO: 138022 - DNA, 37 bp, Artificial Sequence
  Synthetic oligonucleotide
gattccgccccatgactgccccgatacgaaactttga

SEQ ID NO: 138023 - DNA, 36 bp, Artificial Sequence
  Synthetic oligonucleotide
acatgcgtagacgtccctcaccctccgttgtttgta

SEQ ID NO: 138024 - DNA, 35 bp, Artificial Sequence
  Synthetic oligonucleotide
tctgaccatgccttccgtttcgcgctgaacacaac

SEQ ID NO: 138025 - DNA, 35 bp, Artificial Sequence
  Synthetic oligonucleotide
gagccactctgctcccctggttccgttccaccgac

SEQ ID NO: 138026 - DNA, 35 bp, Artificial Sequence
  Synthetic oligonucleotide
aatcaccgctgtccctttgtcgcttgtgggccccc

SEQ ID NO: 138027 - DNA, 35 bp, Artificial Sequence
  Synthetic oligonucleotide
aactcccgctccattcgtctcccagcccctctgcc

SEQ ID NO: 138028 - DNA, 35 bp, Artificial Sequence
  Synthetic oligonucleotide
ttcacgacatgtcttccccgactagctccgacctc

SEQ ID NO: 138029 - DNA, 35 bp, Artificial Sequence
  Synthetic oligonucleotide
gtggtgcccgctcgccgacttgccgcctccgccct

SEQ ID NO: 138030 - DNA, 35 bp, Artificial Sequence
  Synthetic oligonucleotide
tctgcccgtccattgctcttcgtccctcgtactct

SEQ ID NO: 138031 - DNA, 35 bp, Artificial Sequence
  Synthetic oligonucleotide
gtcttccgggccccagttgccgccgccctgcctct

SEQ ID NO: 138032 - DNA, 35 bp, Artificial Sequence
  Synthetic oligonucleotide
actgggggggggtggaaggaagggatcaagcccgt

SEQ ID NO: 138033 - DNA, 36 bp, Artificial Sequence
  Synthetic oligonucleotide
gttgatacgtaggagggagtagggaggggtcggaaa

SEQ ID NO: 138034 - DNA, 36 bp, Artificial Sequence
  Synthetic oligonucleotide
atctcgtgtaacaccttcgagccaccgtatcttgca

SEQ ID NO: 138035 - DNA, 29 bp, Artificial Sequence
  Synthetic oligonucleotide
tctgcccccacctcttaacagttgtttca

SEQ ID NO: 138036 - DNA, 37 bp, Artificial Sequence
  Synthetic oligonucleotide
gcgactctcagccgcgatactacccacgaccacccga

SEQ ID NO: 138037 - DNA, 36 bp, Artificial Sequence
  Synthetic oligonucleotide
gtacgcgcgccttactctggtgtcctctctccctga

SEQ ID NO: 138038 - DNA, 38 bp, Artificial Sequence
  Synthetic oligonucleotide
gacgcggccatgtcgttccacccccccgcaacacgtga

SEQ ID NO: 138039 - DNA, 36 bp, Artificial Sequence
  Synthetic oligonucleotide
aagcaatgcatgggggagcgggcggaggcacggtga

SEQ ID NO: 138040 - DNA, 36 bp, Artificial Sequence
  Synthetic oligonucleotide
gattgaggataggtgggaacgggcgggggcgacata

SEQ ID NO: 138041 - DNA, 35 bp, Artificial Sequence
  Synthetic oligonucleotide
gcgtccatcgttcctcccgttcgccgtcgttacta

SEQ ID NO: 138042 - DNA, 36 bp, Artificial Sequence
  Synthetic oligonucleotide
gattcctccgatcatgatctactagccctgttccta

SEQ ID NO: 138043 - DNA, 35 bp, Artificial Sequence
  Synthetic oligonucleotide
ttggtcgtcatagtctctctttccctctactcgta

SEQ ID NO: 138044 - DNA, 36 bp, Artificial Sequence
  Synthetic oligonucleotide
tccagggagggaggcgtggtgccgggggtaagggta

SEQ ID NO: 138045 - DNA, 36 bp, Artificial Sequence
  Synthetic oligonucleotide
gggtgggatgggagcaatttgaggaggggacggtta

SEQ ID NO: 138046 - DNA, 36 bp, Artificial Sequence
  Synthetic oligonucleotide
tctacccctcccgctccgagttgctccctagtttta

SEQ ID NO: 138047 - DNA, 35 bp, Artificial Sequence
  Synthetic oligonucleotide
gcccccctgtagggatgcctcaccgccccgtgacc

SEQ ID NO: 138048 - DNA, 35 bp, Artificial Sequence
  Synthetic oligonucleotide
gaacaccgcacttctgcctgcctcgatagcatacc

SEQ ID NO: 138049 - DNA, 35 bp, Artificial Sequence
  Synthetic oligonucleotide
tccgcgttcgaagtaccatcctaccgcccgtaccc

SEQ ID NO: 138050 - DNA, 35 bp, Artificial Sequence
  Synthetic oligonucleotide
tcagccgctcgtatgtgcctcactcgcgctcatcc

SEQ ID NO: 138051 - DNA, 35 bp, Artificial Sequence
  Synthetic oligonucleotide
gttacgtccgatgtttgttcacctgttatcccctc

SEQ ID NO: 138052 - DNA, 35 bp, Artificial Sequence
  Synthetic oligonucleotide
gaacccgcctcatagctgaatctgaaaacctcgtc

SEQ ID NO: 138053 - DNA, 35 bp, Artificial Sequence
  Synthetic oligonucleotide
ggacactcgccctatacccccatcattaatgttag

SEQ ID NO: 138054 - DNA, 35 bp, Artificial Sequence
  Synthetic oligonucleotide
aggaaacgctcgccttgtctttcgatactcccccg

SEQ ID NO: 138055 - DNA, 35 bp, Artificial Sequence
  Synthetic oligonucleotide
tctgtccggtcggttagcgtatactccatcccgcg

SEQ ID NO: 138056 - DNA, 35 bp, Artificial Sequence
  Synthetic oligonucleotide
attgcaagtcacactgctcactctcgtttccgtcg

SEQ ID NO: 138057 - DNA, 35 bp, Artificial Sequence
  Synthetic oligonucleotide
gtgctccctgccagtcccctacccggtgtctttcg

SEQ ID NO: 138058 - DNA, 35 bp, Artificial Sequence
  Synthetic oligonucleotide
accacaccacgctgtactttcgccctccgtcgtgg

SEQ ID NO: 138059 - DNA, 35 bp, Artificial Sequence
  Synthetic oligonucleotide
tgacatccccgggttaccctcttgctccttgcgtg

SEQ ID NO: 138060 - DNA, 35 bp, Artificial Sequence
  Synthetic oligonucleotide
tctccacatcgcaaatcctcgctctcagttcccat

SEQ ID NO: 138061 - DNA, 35 bp, Artificial Sequence
  Synthetic oligonucleotide
actcggatgcccctacctgtttcttgctctttgct

SEQ ID NO: 138062 - DNA, 35 bp, Artificial Sequence
  Synthetic oligonucleotide
ttggccgcagcttcatcacaccgcccccaccccgt

SEQ ID NO: 138063 - DNA, 35 bp, Artificial Sequence
  Synthetic oligonucleotide
tcccaccctttactgatagtttacaccatacctgt

SEQ ID NO: 138064 - DNA, 35 bp, Artificial Sequence
  Synthetic oligonucleotide
tcaccgccgtgcgtgcagtggaattcccccctgtt

SEQ ID NO: 138065 - DNA, 35 bp, Artificial Sequence
  Synthetic oligonucleotide
acccgcgtgtcttgccgccgcccctataacacttt

SEQ ID NO: 138066 - DNA, 35 bp, Artificial Sequence
  Synthetic oligonucleotide
tcttgtgccgtcgccccgccgcgtatcattccttt

SEQ ID NO: 138067 - DNA, 35 bp, Artificial Sequence
  Synthetic oligonucleotide
tctccggccactctcgttttatctgcgcacgcttt

SEQ ID NO: 138068 - DNA, 35 bp, Artificial Sequence
  Synthetic oligonucleotide
ggaccccctgcatgctgtacgtcgtccccaaccaa

SEQ ID NO: 138069 - DNA, 36 bp, Artificial Sequence
  Synthetic oligonucleotide
acgagggaggggggtctggtaaagggagggtcttaa

SEQ ID NO: 138070 - DNA, 36 bp, Artificial Sequence
  Synthetic oligonucleotide
tgatctgcgcacggatttaccttccccgttccacca

SEQ ID NO: 138071 - DNA, 34 bp, Artificial Sequence
  Synthetic oligonucleotide
tgacacctcatgcatcccgtctcttgactcacca

SEQ ID NO: 138072 - DNA, 36 bp, Artificial Sequence
  Synthetic oligonucleotide
ggtcaacccatggttctactcctgctcaccttagca

SEQ ID NO: 138073 - DNA, 36 bp, Artificial Sequence
  Synthetic oligonucleotide
aactgggggattagggttgggggtggagctcgggca

SEQ ID NO: 138074 - DNA, 36 bp, Artificial Sequence
  Synthetic oligonucleotide
ttggagcctgaccgcccgtttaataccacatcctca

SEQ ID NO: 138075 - DNA, 37 bp, Artificial Sequence
  Synthetic oligonucleotide
tagggagcacggaatggagggagggaataggagaaga

SEQ ID NO: 138076 - DNA, 37 bp, Artificial Sequence
  Synthetic oligonucleotide
ttggacggtacgggaaggaaggtaagtggggcggaga

SEQ ID NO: 138077 - DNA, 37 bp, Artificial Sequence
  Synthetic oligonucleotide
tcgcccacacgcaccccgcccacttcgctccgctaga

SEQ ID NO: 138078 - DNA, 36 bp, Artificial Sequence
  Synthetic oligonucleotide
gctgcacgcccggccctcccctgtatttacccccga

SEQ ID NO: 138079 - DNA, 37 bp, Artificial Sequence
  Synthetic oligonucleotide
tccgttgcacccggccaacgttatacatccatctcga

SEQ ID NO: 138080 - DNA, 37 bp, Artificial Sequence
  Synthetic oligonucleotide
tgcaacacagccgtttttgttccgtcttccatgtcga

SEQ ID NO: 138081 - DNA, 37 bp, Artificial Sequence
  Synthetic oligonucleotide
ttcgattccggcggaaggtgggggctggatggccgga

SEQ ID NO: 138082 - DNA, 37 bp, Artificial Sequence
  Synthetic oligonucleotide
gacaaagggggagtagggactacggaaagatagtgga

SEQ ID NO: 138083 - DNA, 38 bp, Artificial Sequence
  Synthetic oligonucleotide
gtgctcagccctcctgttgtttatctcgccgcttatga

SEQ ID NO: 138084 - DNA, 38 bp, Artificial Sequence
  Synthetic oligonucleotide
ggagcgcccgtcctgtttcactcctctccgcgtgctga

SEQ ID NO: 138085 - DNA, 38 bp, Artificial Sequence
  Synthetic oligonucleotide
gtgacacgcggggaaggggagggggttaaaagtggtga

SEQ ID NO: 138086 - DNA, 36 bp, Artificial Sequence
  Synthetic oligonucleotide
acccctccgccatgcccagtccactgcgctgcttga

SEQ ID NO: 138087 - DNA, 35 bp, Artificial Sequence
  Synthetic oligonucleotide
atatcatacgccctgtgcgcatttgcctctccata

SEQ ID NO: 138088 - DNA, 35 bp, Artificial Sequence
  Synthetic oligonucleotide
tcaatagcccctttcactgtatgctgtcccgttac

SEQ ID NO: 138089 - DNA, 35 bp, Artificial Sequence
  Synthetic oligonucleotide
acgatatctccgagccctgcacctcgcgtaccacc

SEQ ID NO: 138090 - DNA, 35 bp, Artificial Sequence
  Synthetic oligonucleotide
aatctaccgcaatgcgatttccgccacaccgcacc

SEQ ID NO: 138091 - DNA, 35 bp, Artificial Sequence
  Synthetic oligonucleotide
accgacacagggcacaaacccgtacccctcccccc

SEQ ID NO: 138092 - DNA, 35 bp, Artificial Sequence
  Synthetic oligonucleotide
gttcgccccacgtttgtcccgcccggtctgggccc

SEQ ID NO: 138093 - DNA, 35 bp, Artificial Sequence
  Synthetic oligonucleotide
gagtgggggggttgaagggtgggatatatgcagcc

SEQ ID NO: 138094 - DNA, 35 bp, Artificial Sequence
  Synthetic oligonucleotide
gtatgcgccgacttctcatgtcgtaacctcccgcc

SEQ ID NO: 138095 - DNA, 35 bp, Artificial Sequence
  Synthetic oligonucleotide
gtccattccgcccctacacgtttgcccgtatgtcc

SEQ ID NO: 138096 - DNA, 35 bp, Artificial Sequence
  Synthetic oligonucleotide
atcgatcgccctgcccgtatgcaccgccaagccgc

SEQ ID NO: 138097 - DNA, 35 bp, Artificial Sequence
  Synthetic oligonucleotide
acccccggtatggacccctcagccgccgccacccg

SEQ ID NO: 138098 - DNA, 35 bp, Artificial Sequence
  Synthetic oligonucleotide
gccatcgccgcacccctgcttaaaaccgtaccctg

SEQ ID NO: 138099 - DNA, 35 bp, Artificial Sequence
  Synthetic oligonucleotide
accgctcgcccaatctgtttctctcaagttatagt

SEQ ID NO: 138100 - DNA, 35 bp, Artificial Sequence
  Synthetic oligonucleotide
tcaccccatctctccgatcccgaaggaccctaggt

SEQ ID NO: 138101 - DNA, 35 bp, Artificial Sequence
  Synthetic oligonucleotide
aatatccgcccctcgtcccctgttcctcgtcttgt

SEQ ID NO: 138102 - DNA, 35 bp, Artificial Sequence
  Synthetic oligonucleotide
tcccgacagtgcgcggcgggggggatagggaacaa

SEQ ID NO: 138103 - DNA, 35 bp, Artificial Sequence
  Synthetic oligonucleotide
ttcaccggccagcgcttccttcgccaccgctccga

SEQ ID NO: 138104 - DNA, 37 bp, Artificial Sequence
  Synthetic oligonucleotide
aagcactgcctcccgtcctgccccatgaatatcgcga

SEQ ID NO: 138105 - DNA, 37 bp, Artificial Sequence
  Synthetic oligonucleotide
tctcacctcctggtatcgacacctttccttccatcga

SEQ ID NO: 138106 - DNA, 36 bp, Artificial Sequence
  Synthetic oligonucleotide
gagtgaagttggaggggaaatggggaccaggcagga

SEQ ID NO: 138107 - DNA, 36 bp, Artificial Sequence
  Synthetic oligonucleotide
tgtgtgggtgggtgggattgagcaggagtacgcgga

SEQ ID NO: 138108 - DNA, 37 bp, Artificial Sequence
  Synthetic oligonucleotide
tccacaccgcctacgccgccacttccgtaattactga

SEQ ID NO: 138109 - DNA, 36 bp, Artificial Sequence
  Synthetic oligonucleotide
ttgtgccatccatcccattgtctgttactcggttta

SEQ ID NO: 138110 - DNA, 35 bp, Artificial Sequence
  Synthetic oligonucleotide
gtggcacctcatcttactgctaccgtttctgtcac

SEQ ID NO: 138111 - DNA, 35 bp, Artificial Sequence
  Synthetic oligonucleotide
atgtgcacccgccgccgccttgccgaatcttagcc

SEQ ID NO: 138112 - DNA, 35 bp, Artificial Sequence
  Synthetic oligonucleotide
aatccgtccatccctttccgttcaatgccgtatcc

SEQ ID NO: 138113 - DNA, 35 bp, Artificial Sequence
  Synthetic oligonucleotide
gcacgcccatatctttttcggtatgtctgcgctcc

SEQ ID NO: 138114 - DNA, 35 bp, Artificial Sequence
  Synthetic oligonucleotide
gacctcctgtacagaccctatccaaggcacacttc

SEQ ID NO: 138115 - DNA, 35 bp, Artificial Sequence
  Synthetic oligonucleotide
gtctgccgttccccccagttgcttcccgcctctag

SEQ ID NO: 138116 - DNA, 35 bp, Artificial Sequence
  Synthetic oligonucleotide
accctgcgagaataactatatgcccccactccgcg

SEQ ID NO: 138117 - DNA, 35 bp, Artificial Sequence
  Synthetic oligonucleotide
tgcgagacgaccccctatctaccccgccttcattg

SEQ ID NO: 138118 - DNA, 35 bp, Artificial Sequence
  Synthetic oligonucleotide
tgactcccccccatgctgccgcgcgtagcctctat

SEQ ID NO: 138119 - DNA, 35 bp, Artificial Sequence
  Synthetic oligonucleotide
aacccagtaccattgcctagcgacacacgccgcct

SEQ ID NO: 138120 - DNA, 35 bp, Artificial Sequence
  Synthetic oligonucleotide
acttcccctcagggtttattcgtctcacatctcct

SEQ ID NO: 138121 - DNA, 35 bp, Artificial Sequence
  Synthetic oligonucleotide
agatcggcactctgcttccttaggtcaccccctgt

SEQ ID NO: 138122 - DNA, 35 bp, Artificial Sequence
  Synthetic oligonucleotide
gccaaacgcccccctggttatctagtctaactatt

SEQ ID NO: 138123 - DNA, 35 bp, Artificial Sequence
  Synthetic oligonucleotide
tctacgcctcaccggtccggtgccctattgtttca

SEQ ID NO: 138124 - DNA, 37 bp, Artificial Sequence
  Synthetic oligonucleotide
gaggggggattgggtgggaggctgacggggtgggaga

SEQ ID NO: 138125 - DNA, 36 bp, Artificial Sequence
  Synthetic oligonucleotide
ggtgccgatggtggacgggagggggagtaaagtcga

SEQ ID NO: 138126 - DNA, 35 bp, Artificial Sequence
  Synthetic oligonucleotide
ggtcaaccgctgctgcctacccactctacttcgga

SEQ ID NO: 138127 - DNA, 37 bp, Artificial Sequence
  Synthetic oligonucleotide
gagattagggtggggggagaaggttcacagggaggga

SEQ ID NO: 138128 - DNA, 37 bp, Artificial Sequence
  Synthetic oligonucleotide
aagaaaacgacggaggggagcggtgggattggaggga

SEQ ID NO: 138129 - DNA, 38 bp, Artificial Sequence
  Synthetic oligonucleotide
agagagagggaggggtgggatgagcaaggtggagatga

SEQ ID NO: 138130 - DNA, 38 bp, Artificial Sequence
  Synthetic oligonucleotide
gtccctgcccgataggcatcacaatactgttcccctga

SEQ ID NO: 138131 - DNA, 36 bp, Artificial Sequence
  Synthetic oligonucleotide
atccgcccagcccgactctcaatcttgcccccgtga

SEQ ID NO: 138132 - DNA, 38 bp, Artificial Sequence
  Synthetic oligonucleotide
ttcatcccagacgccccatcgtccgttcccttgcttga

SEQ ID NO: 138133 - DNA, 38 bp, Artificial Sequence
  Synthetic oligonucleotide
tgctgacatctttgcttagctgccattccccccgttga

SEQ ID NO: 138134 - DNA, 35 bp, Artificial Sequence
  Synthetic oligonucleotide
tccccgccaccgccccactgtcacctcggtcttta

SEQ ID NO: 138135 - DNA, 35 bp, Artificial Sequence
  Synthetic oligonucleotide
tgttcacctacgacttgctgctgctgcccactcac

SEQ ID NO: 138136 - DNA, 35 bp, Artificial Sequence
  Synthetic oligonucleotide
ttcactcccctgtcctgctacatagtatgctctac

SEQ ID NO: 138137 - DNA, 34 bp, Artificial Sequence
  Synthetic oligonucleotide
tctcccccccgccgatgccctatctccgcgaccc

SEQ ID NO: 138138 - DNA, 35 bp, Artificial Sequence
  Synthetic oligonucleotide
tgccccgccctggtatcccttctacggcgctttcc

SEQ ID NO: 138139 - DNA, 35 bp, Artificial Sequence
  Synthetic oligonucleotide
ggtggccctccccaccactgccctcaagctactgc

SEQ ID NO: 138140 - DNA, 35 bp, Artificial Sequence
  Synthetic oligonucleotide
gagaccacctccgacgccatatagcgctttgcctc

SEQ ID NO: 138141 - DNA, 34 bp, Artificial Sequence
  Synthetic oligonucleotide
gggacttccccacgtgtttcgcactgcctctttc

SEQ ID NO: 138142 - DNA, 35 bp, Artificial Sequence
  Synthetic oligonucleotide
tcccccccgcctgttatgccttgccaatacctgcg

SEQ ID NO: 138143 - DNA, 35 bp, Artificial Sequence
  Synthetic oligonucleotide
gtcagagccacatccgtaccaaccaccactcgtcg

SEQ ID NO: 138144 - DNA, 35 bp, Artificial Sequence
  Synthetic oligonucleotide
ggacctgcgcttaccgtccacccgtccttggtact

SEQ ID NO: 138145 - DNA, 35 bp, Artificial Sequence
  Synthetic oligonucleotide
tttaacatcgcaccgtatgttccatcactcacctt

SEQ ID NO: 138146 - DNA, 36 bp, Artificial Sequence
  Synthetic oligonucleotide
acacgccgttgtctgccagcccccgcccccaaaaca

SEQ ID NO: 138147 - DNA, 35 bp, Artificial Sequence
  Synthetic oligonucleotide
atgtccctcccccttgtattgtctactgtagacca

SEQ ID NO: 138148 - DNA, 36 bp, Artificial Sequence
  Synthetic oligonucleotide
taagccgcccaccactcttccagagtacgcccccca

SEQ ID NO: 138149 - DNA, 36 bp, Artificial Sequence
  Synthetic oligonucleotide
acctcggctccagctgtcatcttgccgcgtttccca

SEQ ID NO: 138150 - DNA, 36 bp, Artificial Sequence
  Synthetic oligonucleotide
gcccgggccacgtgcctcaactgttctccctacgca

SEQ ID NO: 138151 - DNA, 35 bp, Artificial Sequence
  Synthetic oligonucleotide
gagtgagacgtcacacatttccgccttgcccctca

SEQ ID NO: 138152 - DNA, 35 bp, Artificial Sequence
  Synthetic oligonucleotide
agtcccacctgctgcggtcctccccgccttatcga

SEQ ID NO: 138153 - DNA, 37 bp, Artificial Sequence
  Synthetic oligonucleotide
ggggggtgggagggctggggaggctgaactgcgggga

SEQ ID NO: 138154 - DNA, 38 bp, Artificial Sequence
  Synthetic oligonucleotide
gtccacgtcagacgttcactttggcctgcccctcctga

SEQ ID NO: 138155 - DNA, 35 bp, Artificial Sequence
  Synthetic oligonucleotide
acccccttcggccatctgcgtaccccccccttata

SEQ ID NO: 138156 - DNA, 36 bp, Artificial Sequence
  Synthetic oligonucleotide
acacgccgcccgccgcttacctatgtttctcgttta

SEQ ID NO: 138157 - DNA, 35 bp, Artificial Sequence
  Synthetic oligonucleotide
tcccttccgttcatgtcccgctttcagttgcccac

SEQ ID NO: 138158 - DNA, 35 bp, Artificial Sequence
  Synthetic oligonucleotide
gcattcatgacccgcccctgcctggtgcctacacc

SEQ ID NO: 138159 - DNA, 35 bp, Artificial Sequence
  Synthetic oligonucleotide
acgatgtccgtccacggttatggcttctattcccc

SEQ ID NO: 138160 - DNA, 35 bp, Artificial Sequence
  Synthetic oligonucleotide
gcaccaccggtacaaaaatcacgggctcttctccc

SEQ ID NO: 138161 - DNA, 35 bp, Artificial Sequence
  Synthetic oligonucleotide
tgttgcccccgaactgttttctcgcccgtaccgcc

SEQ ID NO: 138162 - DNA, 35 bp, Artificial Sequence
  Synthetic oligonucleotide
gccccctcacctgttctcctgtattataccccgcc

SEQ ID NO: 138163 - DNA, 35 bp, Artificial Sequence
  Synthetic oligonucleotide
gcccaatgcccaccgtacgatcaaggtctagttcc

SEQ ID NO: 138164 - DNA, 35 bp, Artificial Sequence
  Synthetic oligonucleotide
attgccctaccgctggccttcacgtgctctccagc

SEQ ID NO: 138165 - DNA, 35 bp, Artificial Sequence
  Synthetic oligonucleotide
tagtccctcccccgatttatgacccgccatcttgc

SEQ ID NO: 138166 - DNA, 35 bp, Artificial Sequence
  Synthetic oligonucleotide
tgcgtttcacgccacatgtccactcctcccctatc

SEQ ID NO: 138167 - DNA, 35 bp, Artificial Sequence
  Synthetic oligonucleotide
gttgcctcctcctcccgccgagtcttctcgaagag

SEQ ID NO: 138168 - DNA, 35 bp, Artificial Sequence
  Synthetic oligonucleotide
acgccccgttcctacatgccagcccttgcaagccg

SEQ ID NO: 138169 - DNA, 35 bp, Artificial Sequence
  Synthetic oligonucleotide
gatatcctgtgcatatgctatttcgtcgcctctcg

SEQ ID NO: 138170 - DNA, 35 bp, Artificial Sequence
  Synthetic oligonucleotide
ttgaggtagtgggaggaggacgctggtaggggatg

SEQ ID NO: 138171 - DNA, 35 bp, Artificial Sequence
  Synthetic oligonucleotide
atccgcccaacctgcctccaagttatattcttact

SEQ ID NO: 138172 - DNA, 35 bp, Artificial Sequence
  Synthetic oligonucleotide
gccgtataccgcaattgtagccctccctagtccct

SEQ ID NO: 138173 - DNA, 35 bp, Artificial Sequence
  Synthetic oligonucleotide
ttctgcactacccggttggtttttcggtctttcct

SEQ ID NO: 138174 - DNA, 35 bp, Artificial Sequence
  Synthetic oligonucleotide
ggtggcatggtggggtgcggggggtggagaactct

SEQ ID NO: 138175 - DNA, 32 bp, Artificial Sequence
  Synthetic oligonucleotide
gcatggttacgccttctgccgcctcaaccctt

SEQ ID NO: 138176 - DNA, 36 bp, Artificial Sequence
  Synthetic oligonucleotide
gccacctcagcatcctttctatcgcttgggctacca

SEQ ID NO: 138177 - DNA, 36 bp, Artificial Sequence
  Synthetic oligonucleotide
atctgccctaacttgtatgaacgccgccctctacca

SEQ ID NO: 138178 - DNA, 35 bp, Artificial Sequence
  Synthetic oligonucleotide
tgtgcgtgcccgcctctccgtgttcttacacatca

SEQ ID NO: 138179 - DNA, 36 bp, Artificial Sequence
  Synthetic oligonucleotide
acacccgcgacgacccgcaactcctgtgacctctca

SEQ ID NO: 138180 - DNA, 35 bp, Artificial Sequence
  Synthetic oligonucleotide
tcccatacgccgcacatctctgttcccctgagtca

SEQ ID NO: 138181 - DNA, 37 bp, Artificial Sequence
  Synthetic oligonucleotide
ggaaggagcgtaggaaaaaacggggcggagaggaaga

SEQ ID NO: 138182 - DNA, 35 bp, Artificial Sequence
  Synthetic oligonucleotide
gactggagccgtgtgatccgccccccgccctgcga

SEQ ID NO: 138183 - DNA, 37 bp, Artificial Sequence
  Synthetic oligonucleotide
tgcactgcacccagacttaccgccgcccaccgctcga

SEQ ID NO: 138184 - DNA, 36 bp, Artificial Sequence
  Synthetic oligonucleotide
tcacgacagatgagtgacgggggggagggcccggga

SEQ ID NO: 138185 - DNA, 38 bp, Artificial Sequence
  Synthetic oligonucleotide
tagcccccgccgccctgtgatgccaacccgtcgcatga

SEQ ID NO: 138186 - DNA, 38 bp, Artificial Sequence
  Synthetic oligonucleotide
tgctagccccgtcctgcgtctatccccccagtcgatga

SEQ ID NO: 138187 - DNA, 38 bp, Artificial Sequence
  Synthetic oligonucleotide
ttcccgcctccctcccatgatatagggcgtgaccctga

SEQ ID NO: 138188 - DNA, 37 bp, Artificial Sequence
  Synthetic oligonucleotide
tcccccgcaatgcctctccccaggtactgttccctga

SEQ ID NO: 138189 - DNA, 38 bp, Artificial Sequence
  Synthetic oligonucleotide
atcgcacccccagagctaccgtacttcacaccttctga

SEQ ID NO: 138190 - DNA, 38 bp, Artificial Sequence
  Synthetic oligonucleotide
gagcacgcctcacccctcctaggtcccatcccacgtga

SEQ ID NO: 138191 - DNA, 38 bp, Artificial Sequence
  Synthetic oligonucleotide
gcccgctactgctgatctccgctctacctctttcgtga

SEQ ID NO: 138192 - DNA, 35 bp, Artificial Sequence
  Synthetic oligonucleotide
tagccgccatacaagcctagctctgtcctcccgta

SEQ ID NO: 138193 - DNA, 36 bp, Artificial Sequence
  Synthetic oligonucleotide
gtccctgccccctaaagtcttagtgacccccactta

SEQ ID NO: 138194 - DNA, 35 bp, Artificial Sequence
  Synthetic oligonucleotide
gccacagtcgccccttgccgtgtgaccgtcttcac

SEQ ID NO: 138195 - DNA, 35 bp, Artificial Sequence
  Synthetic oligonucleotide
gtacctgcccgactgcactcgcggaatgcctaccc

SEQ ID NO: 138196 - DNA, 35 bp, Artificial Sequence
  Synthetic oligonucleotide
tccgttccgcccccgggccacgcttgtacaccgcc

SEQ ID NO: 138197 - DNA, 35 bp, Artificial Sequence
  Synthetic oligonucleotide
tcaaacactcctcattgcgctggcttggtccctcc

SEQ ID NO: 138198 - DNA, 36 bp, Artificial Sequence
  Synthetic oligonucleotide
tcagcgccaaagcttgaaacctcctgccctttgtcc

SEQ ID NO: 138199 - DNA, 35 bp, Artificial Sequence
  Synthetic oligonucleotide
tgaacaccgcccctgtagggtctttcgccgcccgc

SEQ ID NO: 138200 - DNA, 35 bp, Artificial Sequence
  Synthetic oligonucleotide
gtcccgaaccgaccccccatatggagtactgtctc

SEQ ID NO: 138201 - DNA, 35 bp, Artificial Sequence
  Synthetic oligonucleotide
gcacacgcaatttgctcctctcgctctgtcctgtc

SEQ ID NO: 138202 - DNA, 34 bp, Artificial Sequence
  Synthetic oligonucleotide
gtgcttgcctctcctgtagcgccgcactccattc

SEQ ID NO: 138203 - DNA, 35 bp, Artificial Sequence
  Synthetic oligonucleotide
gtcgacttccgtgcgcctggtctatctctagcttc

SEQ ID NO: 138204 - DNA, 35 bp, Artificial Sequence
  Synthetic oligonucleotide
cacgaaagcccccacccctgtaattgcccatcccg

SEQ ID NO: 138205 - DNA, 35 bp, Artificial Sequence
  Synthetic oligonucleotide
gtcatcctcgtaaagctcgcccgcatcacccatcg

SEQ ID NO: 138206 - DNA, 35 bp, Artificial Sequence
  Synthetic oligonucleotide
aatgcaggcccagctgcttatttcccatcacctcg

SEQ ID NO: 138207 - DNA, 35 bp, Artificial Sequence
  Synthetic oligonucleotide
gttcagccccgaacattcccccgcccacgccttcg

SEQ ID NO: 138208 - DNA, 35 bp, Artificial Sequence
  Synthetic oligonucleotide
tcaactgtcggatgcttctacctctcttgcgttat

SEQ ID NO: 138209 - DNA, 35 bp, Artificial Sequence
  Synthetic oligonucleotide
gctgcacgatagatagtcacctgcgcccctctcct

SEQ ID NO: 138210 - DNA, 35 bp, Artificial Sequence
  Synthetic oligonucleotide
tgctaccgacgcttcctacaaactgccgacctgct

SEQ ID NO: 138211 - DNA, 35 bp, Artificial Sequence
  Synthetic oligonucleotide
gtcgcaaagcctcctcaatcgccctgggtccttct

SEQ ID NO: 138212 - DNA, 35 bp, Artificial Sequence
  Synthetic oligonucleotide
tccacaccgcgcgttacagccgcccgattccttct

SEQ ID NO: 138213 - DNA, 35 bp, Artificial Sequence
  Synthetic oligonucleotide
tcgatcaccccattctctcgtcggttttctaccgt

SEQ ID NO: 138214 - DNA, 35 bp, Artificial Sequence
  Synthetic oligonucleotide
accatcccccgcaatcgactaccaacctccgaggt

SEQ ID NO: 138215 - DNA, 35 bp, Artificial Sequence
  Synthetic oligonucleotide
gctgggcgggaggggtctattgtggggaactgggt

SEQ ID NO: 138216 - DNA, 35 bp, Artificial Sequence
  Synthetic oligonucleotide
ttgtcccgatcgtcagctctcactaccatccatgt

SEQ ID NO: 138217 - DNA, 35 bp, Artificial Sequence
  Synthetic oligonucleotide
acacctactcccgctgggccccttatgtctcttgt

SEQ ID NO: 138218 - DNA, 35 bp, Artificial Sequence
  Synthetic oligonucleotide
gcccacacatactccctctgctgccctcccgggtt

SEQ ID NO: 138219 - DNA, 36 bp, Artificial Sequence
  Synthetic oligonucleotide
gtgcaccctcgctcgtagaagttccccgcctgcaca

SEQ ID NO: 138220 - DNA, 36 bp, Artificial Sequence
  Synthetic oligonucleotide
ggaccctcacaccatacgcctcgcacattctgcgca

SEQ ID NO: 138221 - DNA, 36 bp, Artificial Sequence
  Synthetic oligonucleotide
acatcccgcccttcctccgtacttaatgcgcattca

SEQ ID NO: 138222 - DNA, 36 bp, Artificial Sequence
  Synthetic oligonucleotide
tcacgccccattgtcgcactatacggattaccttca

SEQ ID NO: 138223 - DNA, 37 bp, Artificial Sequence
  Synthetic oligonucleotide
gaggagggggtagtactagtttggtgctggggggaga

SEQ ID NO: 138224 - DNA, 37 bp, Artificial Sequence
  Synthetic oligonucleotide
atgacaaaggcgggggggcaaggggacattatcgcga

SEQ ID NO: 138225 - DNA, 35 bp, Artificial Sequence
  Synthetic oligonucleotide
tcgaacgccctttgccccgtctcacatacgctcga

SEQ ID NO: 138226 - DNA, 37 bp, Artificial Sequence
  Synthetic oligonucleotide
tcccacgctttccctgtttcgtctccttggccttcga

SEQ ID NO: 138227 - DNA, 37 bp, Artificial Sequence
  Synthetic oligonucleotide
gtggggccacatagcggtacggggggggatggaagga

SEQ ID NO: 138228 - DNA, 37 bp, Artificial Sequence
  Synthetic oligonucleotide
tcactccctctccgtttcatgcggcagtcacaattga

SEQ ID NO: 138229 - DNA, 36 bp, Artificial Sequence
  Synthetic oligonucleotide
tatcgtggcgcctgtctcggtaccctcccttcacta

SEQ ID NO: 138230 - DNA, 35 bp, Artificial Sequence
  Synthetic oligonucleotide
agccaaccggtctcgcttttggttttctttgccta

SEQ ID NO: 138231 - DNA, 36 bp, Artificial Sequence
  Synthetic oligonucleotide
aacgcccatcgcttttcacagtctgcaccatcctta

SEQ ID NO: 138232 - DNA, 35 bp, Artificial Sequence
  Synthetic oligonucleotide
ggaactagcctccacctgctcattactagcttgac

SEQ ID NO: 138233 - DNA, 35 bp, Artificial Sequence
  Synthetic oligonucleotide
gcacggtgccacttctgtcttgcctcgaccgatac

SEQ ID NO: 138234 - DNA, 35 bp, Artificial Sequence
  Synthetic oligonucleotide
tttatccatcccccggtgtgcatatctcgcctacc

SEQ ID NO: 138235 - DNA, 35 bp, Artificial Sequence
  Synthetic oligonucleotide
gactagcgaccactgcacaccccgccacaaagccc

SEQ ID NO: 138236 - DNA, 35 bp, Artificial Sequence
  Synthetic oligonucleotide
acaccgatgccgctctccttgccttcaatctgtcc

SEQ ID NO: 138237 - DNA, 35 bp, Artificial Sequence
  Synthetic oligonucleotide
gttgcggaggacctgttttcacctttcgccgccgc

SEQ ID NO: 138238 - DNA, 35 bp, Artificial Sequence
  Synthetic oligonucleotide
tactaggccgtcgtctcgcctcactgcctcctcgc

SEQ ID NO: 138239 - DNA, 35 bp, Artificial Sequence
  Synthetic oligonucleotide
tgcgaacgccgtgttgtcatctaactcccacttgc

SEQ ID NO: 138240 - DNA, 32 bp, Artificial Sequence
  Synthetic oligonucleotide
tcaacctcgctctgtcccaaccacaccttgtc

SEQ ID NO: 138241 - DNA, 35 bp, Artificial Sequence
  Synthetic oligonucleotide
tgtcatctccccctgtatgttacaacacgtccttc

SEQ ID NO: 138242 - DNA, 35 bp, Artificial Sequence
  Synthetic oligonucleotide
accctccactggctgacctattgacggtgcctttc

SEQ ID NO: 138243 - DNA, 35 bp, Artificial Sequence
  Synthetic oligonucleotide
gagggagggaggggctggttgggctcgtttttgcg

SEQ ID NO: 138244 - DNA, 35 bp, Artificial Sequence
  Synthetic oligonucleotide
gcacgccacttgctgttctcgatttccctgcaact

SEQ ID NO: 138245 - DNA, 35 bp, Artificial Sequence
  Synthetic oligonucleotide
aaccccgctccatacgcattatttttgtacatcct

SEQ ID NO: 138246 - DNA, 35 bp, Artificial Sequence
  Synthetic oligonucleotide
tcaccatcacttgatctggccttcaattcagtcct

SEQ ID NO: 138247 - DNA, 35 bp, Artificial Sequence
  Synthetic oligonucleotide
atgttcagtgcaggttggcccttctgctcttttct

SEQ ID NO: 138248 - DNA, 35 bp, Artificial Sequence
  Synthetic oligonucleotide
gggaatgcatttgggtgaggggaacggagggggaa

SEQ ID NO: 138249 - DNA, 35 bp, Artificial Sequence
  Synthetic oligonucleotide
atcggtcacctgcattgctccgtttccccttgaca

SEQ ID NO: 138250 - DNA, 35 bp, Artificial Sequence
  Synthetic oligonucleotide
gtgtgtctgtgccgccgctttcatctctcgttaca

SEQ ID NO: 138251 - DNA, 35 bp, Artificial Sequence
  Synthetic oligonucleotide
gccatctgcgaagctctattattatgtcccaccca

SEQ ID NO: 138252 - DNA, 35 bp, Artificial Sequence
  Synthetic oligonucleotide
gctcatgctgcagaaaccggtcggccctcccccca

SEQ ID NO: 138253 - DNA, 36 bp, Artificial Sequence
  Synthetic oligonucleotide
actaaggggggtgagagggaagcgtgcgacgggcca

SEQ ID NO: 138254 - DNA, 36 bp, Artificial Sequence
  Synthetic oligonucleotide
tcacccccctctgtatctgcacgtttgtcctctcca

SEQ ID NO: 138255 - DNA, 35 bp, Artificial Sequence
  Synthetic oligonucleotide
aagatgggggggggatggacggaagggcaacagca

SEQ ID NO: 138256 - DNA, 35 bp, Artificial Sequence
  Synthetic oligonucleotide
gcgtagccgagctcttttcctccgtcactgtctca

SEQ ID NO: 138257 - DNA, 36 bp, Artificial Sequence
  Synthetic oligonucleotide
gccagtggcagtgacacttctcgctgcgtttcttca

SEQ ID NO: 138258 - DNA, 37 bp, Artificial Sequence
  Synthetic oligonucleotide
atgggaggggcttaaagagggaaggggttagtaaaga

SEQ ID NO: 138259 - DNA, 37 bp, Artificial Sequence
  Synthetic oligonucleotide
attggggcgtgggtgaaatggggtgctagagggagga

SEQ ID NO: 138260 - DNA, 36 bp, Artificial Sequence
  Synthetic oligonucleotide
tccagtcctgttcctgtgtacctcgccccctctgga

SEQ ID NO: 138261 - DNA, 38 bp, Artificial Sequence
  Synthetic oligonucleotide
atggccatggtctcttcactgctccccccagtccatga

SEQ ID NO: 138262 - DNA, 35 bp, Artificial Sequence
  Synthetic oligonucleotide
gtcgcgggggaggggggaggaaccaacgacactga

SEQ ID NO: 138263 - DNA, 37 bp, Artificial Sequence
  Synthetic oligonucleotide
gctccccgccgatcggttccttcatcgtttccactga

SEQ ID NO: 138264 - DNA, 37 bp, Artificial Sequence
  Synthetic oligonucleotide
atcgcaccgccttccatccatcccacatctgcgctga

SEQ ID NO: 138265 - DNA, 38 bp, Artificial Sequence
  Synthetic oligonucleotide
gccaccatgatctgagccctttgcaaccgcctccttga

SEQ ID NO: 138266 - DNA, 37 bp, Artificial Sequence
  Synthetic oligonucleotide
ttcgcactccgctgacgttcctccattgtcgtcttga

SEQ ID NO: 138267 - DNA, 38 bp, Artificial Sequence
  Synthetic oligonucleotide
gttgccgcaacctcagcctctgcatcccgtccttttga

SEQ ID NO: 138268 - DNA, 35 bp, Artificial Sequence
  Synthetic oligonucleotide
gtgaaccgcaactagacatctccgccccctcgtac

SEQ ID NO: 138269 - DNA, 35 bp, Artificial Sequence
  Synthetic oligonucleotide
tcccacctcgcgtgtgtcgtcctcgccccgttacc

SEQ ID NO: 138270 - DNA, 35 bp, Artificial Sequence
  Synthetic oligonucleotide
gtcaagcacattcccgggtccctgctctccgcccc

SEQ ID NO: 138271 - DNA, 36 bp, Artificial Sequence
  Synthetic oligonucleotide
ggtgtgagtgccccgtttttgtctagccatgtcccc

SEQ ID NO: 138272 - DNA, 35 bp, Artificial Sequence
  Synthetic oligonucleotide
tcccgcgggaccattgtcaattgcacacttcctcc

SEQ ID NO: 138273 - DNA, 35 bp, Artificial Sequence
  Synthetic oligonucleotide
tacgacgcacaacctattgttaccgtttgccaatc

SEQ ID NO: 138274 - DNA, 35 bp, Artificial Sequence
  Synthetic oligonucleotide
gcctcctccatccgcgagtttgccactgccccatc

SEQ ID NO: 138275 - DNA, 35 bp, Artificial Sequence
  Synthetic oligonucleotide
acatcccgggcgcttgttgagccgccacatacctc

SEQ ID NO: 138276 - DNA, 35 bp, Artificial Sequence
  Synthetic oligonucleotide
gcaatacattggccacgaccgtagttccttccctc

SEQ ID NO: 138277 - DNA, 35 bp, Artificial Sequence
  Synthetic oligonucleotide
tcgttccccccgcctagaggcactggcatcctctc

SEQ ID NO: 138278 - DNA, 35 bp, Artificial Sequence
  Synthetic oligonucleotide
agatcctcgacgagcgaaccaccccgcccccaacg

SEQ ID NO: 138279 - DNA, 35 bp, Artificial Sequence
  Synthetic oligonucleotide
agccatacccctgctaccggtgacttaccatctcg

SEQ ID NO: 138280 - DNA, 35 bp, Artificial Sequence
  Synthetic oligonucleotide
gtctccacccgtcgctttagcctcgttggcctact

SEQ ID NO: 138281 - DNA, 35 bp, Artificial Sequence
  Synthetic oligonucleotide
tgcctctgtacgctccccccttgcttgtagcctct

SEQ ID NO: 138282 - DNA, 34 bp, Artificial Sequence
  Synthetic oligonucleotide
gaccatcacgcccatcgtttgcgatctaacattt

SEQ ID NO: 138283 - DNA, 35 bp, Artificial Sequence
  Synthetic oligonucleotide
gacttccccccgcccgccgggtacgccaccctgaa

SEQ ID NO: 138284 - DNA, 35 bp, Artificial Sequence
  Synthetic oligonucleotide
gccgtgctgagcctccttggtcttctgtaacacca

SEQ ID NO: 138285 - DNA, 36 bp, Artificial Sequence
  Synthetic oligonucleotide
tactttccgcccaccatgtcaacccgagccattcca

SEQ ID NO: 138286 - DNA, 37 bp, Artificial Sequence
  Synthetic oligonucleotide
gaaaggtggagggtgtagggaattcggggaaaggaga

SEQ ID NO: 138287 - DNA, 36 bp, Artificial Sequence
  Synthetic oligonucleotide
acacactcaggggaaaagataggggtggagggacga

SEQ ID NO: 138288 - DNA, 37 bp, Artificial Sequence
  Synthetic oligonucleotide
gatgataggggggcacgggtggacggagaggatagga

SEQ ID NO: 138289 - DNA, 37 bp, Artificial Sequence
  Synthetic oligonucleotide
tattagagggaagggtaaggggcgggggtataacgga

SEQ ID NO: 138290 - DNA, 37 bp, Artificial Sequence
  Synthetic oligonucleotide
ttagccggcgggggggaaaagtgcttcgggtgggtga

SEQ ID NO: 138291 - DNA, 38 bp, Artificial Sequence
  Synthetic oligonucleotide
gagaccgacgggggaggaggcgggtgggagctttgtga

SEQ ID NO: 138292 - DNA, 38 bp, Artificial Sequence
  Synthetic oligonucleotide
tgttgtggagggggaatacaggacgggggcaacattga

SEQ ID NO: 138293 - DNA, 37 bp, Artificial Sequence
  Synthetic oligonucleotide
ttacgccccctacccttaccgtgcagttcaaccttga

SEQ ID NO: 138294 - DNA, 35 bp, Artificial Sequence
  Synthetic oligonucleotide
acgacctaccctttccatcgcacctggtttccaac

SEQ ID NO: 138295 - DNA, 35 bp, Artificial Sequence
  Synthetic oligonucleotide
atacctccaatgcgtctcagaacaccccggcccac

SEQ ID NO: 138296 - DNA, 35 bp, Artificial Sequence
  Synthetic oligonucleotide
actccgggccccacttgcacgtaagtccaatccac

SEQ ID NO: 138297 - DNA, 35 bp, Artificial Sequence
  Synthetic oligonucleotide
accgccccctccggtttcgatccgtcaacaagcac

SEQ ID NO: 138298 - DNA, 36 bp, Artificial Sequence
  Synthetic oligonucleotide
atcgcccctccagcattttacttcgagccgtccccc

SEQ ID NO: 138299 - DNA, 35 bp, Artificial Sequence
  Synthetic oligonucleotide
cactggcatcagcgctccatgccttacttgtcccc

SEQ ID NO: 138300 - DNA, 35 bp, Artificial Sequence
  Synthetic oligonucleotide
cccgctccagctgccgtactcccatcagccttctc

SEQ ID NO: 138301 - DNA, 35 bp, Artificial Sequence
  Synthetic oligonucleotide
acaaacatccctcaccacgtgccaccattcatgcg

SEQ ID NO: 138302 - DNA, 35 bp, Artificial Sequence
  Synthetic oligonucleotide
gttgcgcccctcgtttcaccatgctctaacctgcg

SEQ ID NO: 138303 - DNA, 35 bp, Artificial Sequence
  Synthetic oligonucleotide
agtggtgcgtccctctgttttgtctccctcgtcat

SEQ ID NO: 138304 - DNA, 35 bp, Artificial Sequence
  Synthetic oligonucleotide
acatcgatccggaggggggtgggaagcgggatact

SEQ ID NO: 138305 - DNA, 35 bp, Artificial Sequence
  Synthetic oligonucleotide
gccgcaagcagcccgcttctccatatactcggcct

SEQ ID NO: 138306 - DNA, 35 bp, Artificial Sequence
  Synthetic oligonucleotide
agcacccccaatttgatccgcactacaccttagct

SEQ ID NO: 138307 - DNA, 35 bp, Artificial Sequence
  Synthetic oligonucleotide
agcgcattctctttagtcccttccacatggccggt

SEQ ID NO: 138308 - DNA, 35 bp, Artificial Sequence
  Synthetic oligonucleotide
ggacaccctgccgtgatcgcctatttctccccatt

SEQ ID NO: 138309 - DNA, 35 bp, Artificial Sequence
  Synthetic oligonucleotide
acaatgccagcctggaccgccgttccctgctcctt

SEQ ID NO: 138310 - DNA, 35 bp, Artificial Sequence
  Synthetic oligonucleotide
tgcccccatcacattctctgccggtggatttcctt

SEQ ID NO: 138311 - DNA, 35 bp, Artificial Sequence
  Synthetic oligonucleotide
gtcgacgcccggtcgccccatactatactggcttt

SEQ ID NO: 138312 - DNA, 37 bp, Artificial Sequence
  Synthetic oligonucleotide
acgcccccctccttttgcagctgcttcccctgcgcga

SEQ ID NO: 138313 - DNA, 37 bp, Artificial Sequence
  Synthetic oligonucleotide
gagggggggcgaccaaggagaaaaaatatagggtgga

SEQ ID NO: 138314 - DNA, 38 bp, Artificial Sequence
  Synthetic oligonucleotide
gatgcgggggggaagggttcagtagagccgggtagtga

SEQ ID NO: 138315 - DNA, 38 bp, Artificial Sequence
  Synthetic oligonucleotide
accctgccccactgcgcccacccccacgctcaaggtga

SEQ ID NO: 138316 - DNA, 35 bp, Artificial Sequence
  Synthetic oligonucleotide
tcatcacccgctccttggcttaaacgagtgccccc

SEQ ID NO: 138317 - DNA, 35 bp, Artificial Sequence
  Synthetic oligonucleotide
gtgatccctgctggttacctttcactatgccttcc

SEQ ID NO: 138318 - DNA, 35 bp, Artificial Sequence
  Synthetic oligonucleotide
taccacctccgattctcccctgcggtttccctcgc

SEQ ID NO: 138319 - DNA, 35 bp, Artificial Sequence
  Synthetic oligonucleotide
aactccgttccaccgcttgcattgtgcatcccatc

SEQ ID NO: 138320 - DNA, 35 bp, Artificial Sequence
  Synthetic oligonucleotide
agcacttggcgttgggcccccttttttgttccatc

SEQ ID NO: 138321 - DNA, 35 bp, Artificial Sequence
  Synthetic oligonucleotide
taccgcgttacatgcgcactcccactgcactactc

SEQ ID NO: 138322 - DNA, 35 bp, Artificial Sequence
  Synthetic oligonucleotide
aagacgcacgctatgcacttcccgtcccctcggtc

SEQ ID NO: 138323 - DNA, 35 bp, Artificial Sequence
  Synthetic oligonucleotide
gacgcacggatctggccgcactctctttctattcg

SEQ ID NO: 138324 - DNA, 35 bp, Artificial Sequence
  Synthetic oligonucleotide
gtcgggggacggggggggaggctatcaacggcatg

SEQ ID NO: 138325 - DNA, 35 bp, Artificial Sequence
  Synthetic oligonucleotide
tacccacaccgccccatgatgcacctcgccacctg

SEQ ID NO: 138326 - DNA, 35 bp, Artificial Sequence
  Synthetic oligonucleotide
tcagagtcgtcgcgccgcttcttactccctccgat

SEQ ID NO: 138327 - DNA, 35 bp, Artificial Sequence
  Synthetic oligonucleotide
gagtgccacctcgtgtttacaatctgtttcctcct

SEQ ID NO: 138328 - DNA, 35 bp, Artificial Sequence
  Synthetic oligonucleotide
tttgccgccggccgatcctgcccttccgtgttcct

SEQ ID NO: 138329 - DNA, 35 bp, Artificial Sequence
  Synthetic oligonucleotide
ttcgctccagtggttccccccgctctatctaagct

SEQ ID NO: 138330 - DNA, 35 bp, Artificial Sequence
  Synthetic oligonucleotide
gatgtaagaaagggggtggagggggatgcaggagt

SEQ ID NO: 138331 - DNA, 35 bp, Artificial Sequence
  Synthetic oligonucleotide
actcccgcccctacatggtctcattcagtcccctt

SEQ ID NO: 138332 - DNA, 35 bp, Artificial Sequence
  Synthetic oligonucleotide
tacgcgatgacctgctgatctgttgcctcgttctt

SEQ ID NO: 138333 - DNA, 35 bp, Artificial Sequence
  Synthetic oligonucleotide
tctagcgggaaggggggtaaatggggatataacaa

SEQ ID NO: 138334 - DNA, 30 bp, Artificial Sequence
  Synthetic oligonucleotide
taacacaaccccagccaagcacccgtacca

SEQ ID NO: 138335 - DNA, 37 bp, Artificial Sequence
  Synthetic oligonucleotide
gttcacgaagatggtaggggaccgggggggagggaga

SEQ ID NO: 138336 - DNA, 37 bp, Artificial Sequence
  Synthetic oligonucleotide
gagacagtcacgcgtatcgtcctgccccattttccga

SEQ ID NO: 138337 - DNA, 37 bp, Artificial Sequence
  Synthetic oligonucleotide
tcttgtcctccatgtcgtccccgccgccccgtttcga

SEQ ID NO: 138338 - DNA, 37 bp, Artificial Sequence
  Synthetic oligonucleotide
gtcaatacacgatctatctgcaatcccgccccccgga

SEQ ID NO: 138339 - DNA, 38 bp, Artificial Sequence
  Synthetic oligonucleotide
cacaacgattcctgccgccccccgctcgctgtccctga

SEQ ID NO: 138340 - DNA, 36 bp, Artificial Sequence
  Synthetic oligonucleotide
ttgtccacccctccactccacgactgcccatcttga

SEQ ID NO: 138341 - DNA, 38 bp, Artificial Sequence
  Synthetic oligonucleotide
gtgcaaccactgaccctgcgctgttcgccccccgttga

SEQ ID NO: 138342 - DNA, 36 bp, Artificial Sequence
  Synthetic oligonucleotide
tggggggggaacaaatcgggtgggaggtcaagcgta

SEQ ID NO: 138343 - DNA, 35 bp, Artificial Sequence
  Synthetic oligonucleotide
tcaatgggtgggagggccgaatcctctggggggta

SEQ ID NO: 138344 - DNA, 35 bp, Artificial Sequence
  Synthetic oligonucleotide
atgagcgctggctcttgcccctcctgctccttgac

SEQ ID NO: 138345 - DNA, 35 bp, Artificial Sequence
  Synthetic oligonucleotide
acgcctcggtcgcctcgcccctcatcttcccgtac

SEQ ID NO: 138346 - DNA, 35 bp, Artificial Sequence
  Synthetic oligonucleotide
tcgagtccgccccctttcccaccgttcttttgtac

SEQ ID NO: 138347 - DNA, 35 bp, Artificial Sequence
  Synthetic oligonucleotide
attgcccagccgcccttctagcttaggtccattac

SEQ ID NO: 138348 - DNA, 35 bp, Artificial Sequence
  Synthetic oligonucleotide
ttgacttcccatcttattacggatcctgctacgcc

SEQ ID NO: 138349 - DNA, 35 bp, Artificial Sequence
  Synthetic oligonucleotide
tgtggcccccgaactgttttctctcccgtaccgcc

SEQ ID NO: 138350 - DNA, 35 bp, Artificial Sequence
  Synthetic oligonucleotide
tcgatccagcccgttgttcacgcgttccatctgcc

SEQ ID NO: 138351 - DNA, 35 bp, Artificial Sequence
  Synthetic oligonucleotide
gttgtccagccttgactctgtcccgccttctaagc

SEQ ID NO: 138352 - DNA, 35 bp, Artificial Sequence
  Synthetic oligonucleotide
atcgcccacccccccttggattgcatccaattggc

SEQ ID NO: 138353 - DNA, 35 bp, Artificial Sequence
  Synthetic oligonucleotide
gccgctacatcatccgcagcctaacactacactgc

SEQ ID NO: 138354 - DNA, 34 bp, Artificial Sequence
  Synthetic oligonucleotide
ttgttgctggctcgtttccggtaattgtcgcctc

SEQ ID NO: 138355 - DNA, 35 bp, Artificial Sequence
  Synthetic oligonucleotide
accgccacgtgcacccattttaggtattcctgttc

SEQ ID NO: 138356 - DNA, 35 bp, Artificial Sequence
  Synthetic oligonucleotide
gcccccctgtgtccgtatcctgatcaaccctgtcg

SEQ ID NO: 138357 - DNA, 35 bp, Artificial Sequence
  Synthetic oligonucleotide
atctgcccccgttcggtatcactttcttcctcctg

SEQ ID NO: 138358 - DNA, 35 bp, Artificial Sequence
  Synthetic oligonucleotide
gggagagcgtgctccctgtcctaccgttcatgcct

SEQ ID NO: 138359 - DNA, 35 bp, Artificial Sequence
  Synthetic oligonucleotide
ttccccacactgtctgttcctctactgcctccggt

SEQ ID NO: 138360 - DNA, 35 bp, Artificial Sequence
  Synthetic oligonucleotide
ggagcacacgttagccgcccactcccccattccaa

SEQ ID NO: 138361 - DNA, 35 bp, Artificial Sequence
  Synthetic oligonucleotide
aactccacctaccgatcgtgcctgtaccgtagtaa

SEQ ID NO: 138362 - DNA, 36 bp, Artificial Sequence
  Synthetic oligonucleotide
tgccaccacctccagtccgtaacttggtgtctccca

SEQ ID NO: 138363 - DNA, 36 bp, Artificial Sequence
  Synthetic oligonucleotide
tgcaatgtcaagtgctcgtccttcctttctccttca

SEQ ID NO: 138364 - DNA, 37 bp, Artificial Sequence
  Synthetic oligonucleotide
atcgacgacaggtaggcggagggaaacgggagagcga

SEQ ID NO: 138365 - DNA, 37 bp, Artificial Sequence
  Synthetic oligonucleotide
tccagggggagaacattgtaggagggcggggtcggga

SEQ ID NO: 138366 - DNA, 37 bp, Artificial Sequence
  Synthetic oligonucleotide
attgcaccccagctcctcgtctactctggcaccatga

SEQ ID NO: 138367 - DNA, 36 bp, Artificial Sequence
  Synthetic oligonucleotide
tccctccatcctctgcttctttgcatatgtccacta

SEQ ID NO: 138368 - DNA, 36 bp, Artificial Sequence
  Synthetic oligonucleotide
atgtcgtgaaaggggggggtaggtgaagcagtagta

SEQ ID NO: 138369 - DNA, 35 bp, Artificial Sequence
  Synthetic oligonucleotide
aaggcgggagcgagtgggggcttcggggggaggta

SEQ ID NO: 138370 - DNA, 36 bp, Artificial Sequence
  Synthetic oligonucleotide
tagcacccatcttgtagatccctcgttcccactgta

SEQ ID NO: 138371 - DNA, 35 bp, Artificial Sequence
  Synthetic oligonucleotide
tcctccctgcacggaaggtcctactcacgccttac

SEQ ID NO: 138372 - DNA, 35 bp, Artificial Sequence
  Synthetic oligonucleotide
gctgactagctcaccattggaccaccttgtcaccc

SEQ ID NO: 138373 - DNA, 35 bp, Artificial Sequence
  Synthetic oligonucleotide
ttcccatcgctacgcctgccctttcggccacccgc

SEQ ID NO: 138374 - DNA, 35 bp, Artificial Sequence
  Synthetic oligonucleotide
gggaccgtacgaccctgtctcctttgctcattcgc

SEQ ID NO: 138375 - DNA, 35 bp, Artificial Sequence
  Synthetic oligonucleotide
gactgctcctttacatgctagctccgtgcctcatc

SEQ ID NO: 138376 - DNA, 35 bp, Artificial Sequence
  Synthetic oligonucleotide
atcgaacgatcactggcaatcttgcacttccgctc

SEQ ID NO: 138377 - DNA, 35 bp, Artificial Sequence
  Synthetic oligonucleotide
gctcactcctgctcctggttccgaagttagccttc

SEQ ID NO: 138378 - DNA, 35 bp, Artificial Sequence
  Synthetic oligonucleotide
tatgtgtacggggtgaggggggccgggcggtagag

SEQ ID NO: 138379 - DNA, 35 bp, Artificial Sequence
  Synthetic oligonucleotide
gtcccctctgtgttttacgcctcccacgctactag

SEQ ID NO: 138380 - DNA, 35 bp, Artificial Sequence
  Synthetic oligonucleotide
acccaccctatctgcctcgaatcattgattcatcg

SEQ ID NO: 138381 - DNA, 35 bp, Artificial Sequence
  Synthetic oligonucleotide
gcatacgccggtggagggtggtagaggtgggcggg

SEQ ID NO: 138382 - DNA, 35 bp, Artificial Sequence
  Synthetic oligonucleotide
actgactgcctcccgaagctccccctttgttcttg

SEQ ID NO: 138383 - DNA, 35 bp, Artificial Sequence
  Synthetic oligonucleotide
gccgaaccagctcgcgattgtgattttcccgccct

SEQ ID NO: 138384 - DNA, 35 bp, Artificial Sequence
  Synthetic oligonucleotide
aaccctgcccatatcttttttgacgtgcactgcct

SEQ ID NO: 138385 - DNA, 35 bp, Artificial Sequence
  Synthetic oligonucleotide
tacccctcctcgcatttgtccattacgggtctatt

SEQ ID NO: 138386 - DNA, 35 bp, Artificial Sequence
  Synthetic oligonucleotide
gttcaaagcgcagactctccagttccgttcccttt

SEQ ID NO: 138387 - DNA, 36 bp, Artificial Sequence
  Synthetic oligonucleotide
aaatggaacaagggggaggggttatagggcatgaaa

SEQ ID NO: 138388 - DNA, 36 bp, Artificial Sequence
  Synthetic oligonucleotide
acgtgttcgctccatcgctttaacttccgcttttaa

SEQ ID NO: 138389 - DNA, 35 bp, Artificial Sequence
  Synthetic oligonucleotide
ttgggtccgctatccggccgttgtcctttcctcca

SEQ ID NO: 138390 - DNA, 36 bp, Artificial Sequence
  Synthetic oligonucleotide
ttgaccattgttagcgctgtctccgtccccattgca

SEQ ID NO: 138391 - DNA, 36 bp, Artificial Sequence
  Synthetic oligonucleotide
gcatgccccccgtgcgttatctggtcccctatatca

SEQ ID NO: 138392 - DNA, 34 bp, Artificial Sequence
  Synthetic oligonucleotide
gtcgacctccctgtttccatatatcgctcgacga

SEQ ID NO: 138393 - DNA, 37 bp, Artificial Sequence
  Synthetic oligonucleotide
tacgatgcgcccgttctatctccccagacactctcga

SEQ ID NO: 138394 - DNA, 37 bp, Artificial Sequence
  Synthetic oligonucleotide
tgcgggggaggatagaggggtttgggacacgaaagga

SEQ ID NO: 138395 - DNA, 37 bp, Artificial Sequence
  Synthetic oligonucleotide
tcagcccctcccatcgcgcatacacttgattcacgga

SEQ ID NO: 138396 - DNA, 35 bp, Artificial Sequence
  Synthetic oligonucleotide
atgctgcaaacaacgggggagagtggggagtggga

SEQ ID NO: 138397 - DNA, 36 bp, Artificial Sequence
  Synthetic oligonucleotide
acgagtgcgcagttaagattcctcccgcccccctga

SEQ ID NO: 138398 - DNA, 38 bp, Artificial Sequence
  Synthetic oligonucleotide
tcgccattcgcagcccgcccccttgtcacatcccctga

SEQ ID NO: 138399 - DNA, 38 bp, Artificial Sequence
  Synthetic oligonucleotide
ggccactcgcccgaactgcatcatccgccgcaacttga

SEQ ID NO: 138400 - DNA, 37 bp, Artificial Sequence
  Synthetic oligonucleotide
ttcgcaccacgtcataccaccggctgccaccccttga

SEQ ID NO: 138401 - DNA, 36 bp, Artificial Sequence
  Synthetic oligonucleotide
atgtgccgccttcttctgttaaccccgtctttcata

SEQ ID NO: 138402 - DNA, 36 bp, Artificial Sequence
  Synthetic oligonucleotide
tccacagtctacagtcccgccttagccccttcgcta

SEQ ID NO: 138403 - DNA, 35 bp, Artificial Sequence
  Synthetic oligonucleotide
tccaacaacacatgtccgcatcacagtccgttgac

SEQ ID NO: 138404 - DNA, 35 bp, Artificial Sequence
  Synthetic oligonucleotide
gcgacctcccatgatcgcctgaccgcctttaatcc

SEQ ID NO: 138405 - DNA, 35 bp, Artificial Sequence
  Synthetic oligonucleotide
tcaaccgattggcggagtgcaatcgactaccatcc

SEQ ID NO: 138406 - DNA, 35 bp, Artificial Sequence
  Synthetic oligonucleotide
gtagcaccacccgcccatagcataaaggctactcc

SEQ ID NO: 138407 - DNA, 35 bp, Artificial Sequence
  Synthetic oligonucleotide
acccactcgttcacttcgggcatcatccactacgc

SEQ ID NO: 138408 - DNA, 35 bp, Artificial Sequence
  Synthetic oligonucleotide
acaccccagcttggcccatttcgttgcatcttatc

SEQ ID NO: 138409 - DNA, 35 bp, Artificial Sequence
  Synthetic oligonucleotide
gacgaccctcatttctgtcctgcccgccctgtacg

SEQ ID NO: 138410 - DNA, 35 bp, Artificial Sequence
  Synthetic oligonucleotide
gtggtcccgcacacatccttgcttacacatttacg

SEQ ID NO: 138411 - DNA, 35 bp, Artificial Sequence
  Synthetic oligonucleotide
gtcccaaccactctccacgtgttcttccagcttcg

SEQ ID NO: 138412 - DNA, 35 bp, Artificial Sequence
  Synthetic oligonucleotide
gtgtgagcgggtaagggccaaaggtcgggtggggg

SEQ ID NO: 138413 - DNA, 35 bp, Artificial Sequence
  Synthetic oligonucleotide
gcccccgctctcaccatctcatatacttaggctat

SEQ ID NO: 138414 - DNA, 35 bp, Artificial Sequence
  Synthetic oligonucleotide
ttcatggcgtcattcagctgctagtctcgttccct

SEQ ID NO: 138415 - DNA, 36 bp, Artificial Sequence
  Synthetic oligonucleotide
aacgatgcagagacagggagggtagagggaagataa

SEQ ID NO: 138416 - DNA, 36 bp, Artificial Sequence
  Synthetic oligonucleotide
agtcacccgcaccctttgtcttgtgccccggtatca

SEQ ID NO: 138417 - DNA, 35 bp, Artificial Sequence
  Synthetic oligonucleotide
tacgacactctgctcgcctatattattccccttca

SEQ ID NO: 138418 - DNA, 36 bp, Artificial Sequence
  Synthetic oligonucleotide
taggtcaggccctatgccgcgccctgtcctccttca

SEQ ID NO: 138419 - DNA, 35 bp, Artificial Sequence
  Synthetic oligonucleotide
gtggacccctccgtagttgctcacacacctgttca

SEQ ID NO: 138420 - DNA, 37 bp, Artificial Sequence
  Synthetic oligonucleotide
ggggaggggccatcagtagggaaagcaggaggagaga

SEQ ID NO: 138421 - DNA, 37 bp, Artificial Sequence
  Synthetic oligonucleotide
gcttgggcgccagggggcatacgggggatagtaggga

SEQ ID NO: 138422 - DNA, 35 bp, Artificial Sequence
  Synthetic oligonucleotide
aatggaggaaggtacgtgggggttggagcggtgga

SEQ ID NO: 138423 - DNA, 37 bp, Artificial Sequence
  Synthetic oligonucleotide
taagtgggggccaaggggaagtaaagggcgatgtgga

SEQ ID NO: 138424 - DNA, 37 bp, Artificial Sequence
  Synthetic oligonucleotide
taagtggggaagggggaggtatatggtcggggactga

SEQ ID NO: 138425 - DNA, 36 bp, Artificial Sequence
  Synthetic oligonucleotide
gcccccccacctgttgattaccagtttcacgcctga

SEQ ID NO: 138426 - DNA, 38 bp, Artificial Sequence
  Synthetic oligonucleotide
tgataccgaggcagagggagtggggggaaggctagtga

SEQ ID NO: 138427 - DNA, 38 bp, Artificial Sequence
  Synthetic oligonucleotide
acatcaacgccgccattagctaatccacctcgcattga

SEQ ID NO: 138428 - DNA, 36 bp, Artificial Sequence
  Synthetic oligonucleotide
atcaaccgcctcatgcccccctactccattgtacta

SEQ ID NO: 138429 - DNA, 35 bp, Artificial Sequence
  Synthetic oligonucleotide
ttaccgccatgtgcaacctcccacgccctgccgta

SEQ ID NO: 138430 - DNA, 36 bp, Artificial Sequence
  Synthetic oligonucleotide
tgtgccgtaggatcccgccgttttccatgtccttta

SEQ ID NO: 138431 - DNA, 35 bp, Artificial Sequence
  Synthetic oligonucleotide
tgaacgtagcccccagccggtccaacgaattccac

SEQ ID NO: 138432 - DNA, 34 bp, Artificial Sequence
  Synthetic oligonucleotide
tccttgtcagtgccacccgcgcatcttcccaacc

SEQ ID NO: 138433 - DNA, 35 bp, Artificial Sequence
  Synthetic oligonucleotide
tgcaattacactccgcttgaccgcactgggccccc

SEQ ID NO: 138434 - DNA, 35 bp, Artificial Sequence
  Synthetic oligonucleotide
gtgctccctgccgttcaagccgcatggcccctccc

SEQ ID NO: 138435 - DNA, 35 bp, Artificial Sequence
  Synthetic oligonucleotide
gacgcccgacacatagccccaccctcgggcccgcc

SEQ ID NO: 138436 - DNA, 35 bp, Artificial Sequence
  Synthetic oligonucleotide
gaaacgctaccccctgttcgacccacgtgtttgcc

SEQ ID NO: 138437 - DNA, 35 bp, Artificial Sequence
  Synthetic oligonucleotide
gtgtactcccctgcgtgttaccatccggactatcc

SEQ ID NO: 138438 - DNA, 35 bp, Artificial Sequence
  Synthetic oligonucleotide
tcccatctgccaccggtatgcccctggacacctcc

SEQ ID NO: 138439 - DNA, 35 bp, Artificial Sequence
  Synthetic oligonucleotide
gcctcctgcatttgccatataagctcgtgccttcc

SEQ ID NO: 138440 - DNA, 35 bp, Artificial Sequence
  Synthetic oligonucleotide
tacacccgtgtaacgtcgcgtagagcaccctcctc

SEQ ID NO: 138441 - DNA, 35 bp, Artificial Sequence
  Synthetic oligonucleotide
ttacacttccgaccgcataggcaccatccgcattc

SEQ ID NO: 138442 - DNA, 35 bp, Artificial Sequence
  Synthetic oligonucleotide
atgacacgtccgaatcgcccatcgcctccttcacg

SEQ ID NO: 138443 - DNA, 35 bp, Artificial Sequence
  Synthetic oligonucleotide
atgccacttcacccccaccccgtgtccctatcatg

SEQ ID NO: 138444 - DNA, 35 bp, Artificial Sequence
  Synthetic oligonucleotide
accacgccatgtgtaccacccgcttcgtgctattg

SEQ ID NO: 138445 - DNA, 35 bp, Artificial Sequence
  Synthetic oligonucleotide
tctccaccttcgctactagggccactcactgcact

SEQ ID NO: 138446 - DNA, 35 bp, Artificial Sequence
  Synthetic oligonucleotide
gattgggggggagaaggaaggtagaaaacatgcgt

SEQ ID NO: 138447 - DNA, 35 bp, Artificial Sequence
  Synthetic oligonucleotide
gtaccattccgcctcgcataagcacctctcccgtt

SEQ ID NO: 138448 - DNA, 35 bp, Artificial Sequence
  Synthetic oligonucleotide
agttccaccccactcctccacgtgaccgaaggtaa

SEQ ID NO: 138449 - DNA, 36 bp, Artificial Sequence
  Synthetic oligonucleotide
gcccgaactgccgcataaccacacgcctgtctaaca

SEQ ID NO: 138450 - DNA, 35 bp, Artificial Sequence
  Synthetic oligonucleotide
gccttgtgtccccccgttcgtgctcctggtcccca

SEQ ID NO: 138451 - DNA, 35 bp, Artificial Sequence
  Synthetic oligonucleotide
ttggccgctagatgccgtccgcccaccgtctgcca

SEQ ID NO: 138452 - DNA, 36 bp, Artificial Sequence
  Synthetic oligonucleotide
acgagcaccagcgggggggtggggcgaaagagggca

SEQ ID NO: 138453 - DNA, 36 bp, Artificial Sequence
  Synthetic oligonucleotide
acctcccacggtcctgctataattcatgcttactca

SEQ ID NO: 138454 - DNA, 37 bp, Artificial Sequence
  Synthetic oligonucleotide
cagtacgaggggggtgggtaaggaggggcggtcgaga

SEQ ID NO: 138455 - DNA, 37 bp, Artificial Sequence
  Synthetic oligonucleotide
tcattcacgccgcctgcatccagccactgcttcacga

SEQ ID NO: 138456 - DNA, 37 bp, Artificial Sequence
  Synthetic oligonucleotide
ttaggaggagggaggggctaaaggtggggcaacagga

SEQ ID NO: 138457 - DNA, 35 bp, Artificial Sequence
  Synthetic oligonucleotide
gaaaggaggggaaatagttcgtagggagtgaggga

SEQ ID NO: 138458 - DNA, 38 bp, Artificial Sequence
  Synthetic oligonucleotide
gtcaccccagacctgttttcgctgcggccctccactga

SEQ ID NO: 138459 - DNA, 36 bp, Artificial Sequence
  Synthetic oligonucleotide
tgcccgcggaagaacccccctccgcctttcccgtga

SEQ ID NO: 138460 - DNA, 38 bp, Artificial Sequence
  Synthetic oligonucleotide
tcacgtccaccacgttgtaaactatccgcctctcgtga

SEQ ID NO: 138461 - DNA, 37 bp, Artificial Sequence
  Synthetic oligonucleotide
gacaccctcctgcgtacaccggccctccatgtcttga

SEQ ID NO: 138462 - DNA, 37 bp, Artificial Sequence
  Synthetic oligonucleotide
tactccgcctgacgagccccattctcccccgtgttga

SEQ ID NO: 138463 - DNA, 35 bp, Artificial Sequence
  Synthetic oligonucleotide
tactgggtcgctatcgggtgggtgggttctatgta

SEQ ID NO: 138464 - DNA, 35 bp, Artificial Sequence
  Synthetic oligonucleotide
tatggcgcaagctctgttgtctttcctcccctgta

SEQ ID NO: 138465 - DNA, 35 bp, Artificial Sequence
  Synthetic oligonucleotide
gacatcacgccgctccctcgcccttaagctctgta

SEQ ID NO: 138466 - DNA, 35 bp, Artificial Sequence
  Synthetic oligonucleotide
gcacaacccactatgtcgttgcacacgcccctacc

SEQ ID NO: 138467 - DNA, 35 bp, Artificial Sequence
  Synthetic oligonucleotide
tccgcacaatgcacctcctcatctggctaggtacc

SEQ ID NO: 138468 - DNA, 35 bp, Artificial Sequence
  Synthetic oligonucleotide
gatccaagcctgtcacctactcactgccagccccc

SEQ ID NO: 138469 - DNA, 35 bp, Artificial Sequence
  Synthetic oligonucleotide
atgtcccgccacccgcgtcctctttctttgaacgc

SEQ ID NO: 138470 - DNA, 35 bp, Artificial Sequence
  Synthetic oligonucleotide
acaccacctccgagcttttttgcctctctacatgc

SEQ ID NO: 138471 - DNA, 35 bp, Artificial Sequence
  Synthetic oligonucleotide
acatcccccccaaaattgggttatgacacttcatc

SEQ ID NO: 138472 - DNA, 35 bp, Artificial Sequence
  Synthetic oligonucleotide
aacgctcgcccattgcttcggcgccttaccattcg

SEQ ID NO: 138473 - DNA, 35 bp, Artificial Sequence
  Synthetic oligonucleotide
gcgaccctaccgccaactccatgtctctaccttcg

SEQ ID NO: 138474 - DNA, 35 bp, Artificial Sequence
  Synthetic oligonucleotide
tcgaccttccagggcgtcctgtcccatctcgcaat

SEQ ID NO: 138475 - DNA, 35 bp, Artificial Sequence
  Synthetic oligonucleotide
tgacaacgcattgtctcccccgacccctcaataat

SEQ ID NO: 138476 - DNA, 35 bp, Artificial Sequence
  Synthetic oligonucleotide
gcctagccaccgacaccgcactatttggtcacctt

SEQ ID NO: 138477 - DNA, 35 bp, Artificial Sequence
  Synthetic oligonucleotide
ttaggaacgaaagggcacggaagggggagggagtt

SEQ ID NO: 138478 - DNA, 35 bp, Artificial Sequence
  Synthetic oligonucleotide
gtgcgccgatatatcgcgccatctgctcccgcttt

SEQ ID NO: 138479 - DNA, 36 bp, Artificial Sequence
  Synthetic oligonucleotide
gagccgaaccgccgccttgtacccccgcactgccca

SEQ ID NO: 138480 - DNA, 35 bp, Artificial Sequence
  Synthetic oligonucleotide
gtgctccttcactcgcccttacaggaacaggctca

SEQ ID NO: 138481 - DNA, 36 bp, Artificial Sequence
  Synthetic oligonucleotide
tatcccgccttggtttctgtccaccgcaccatttca

SEQ ID NO: 138482 - DNA, 36 bp, Artificial Sequence
  Synthetic oligonucleotide
acccacccgtttcgccgatatacctctgttgccaga

SEQ ID NO: 138483 - DNA, 35 bp, Artificial Sequence
  Synthetic oligonucleotide
tccgatagcggcattcgagtacgcaccccccccga

SEQ ID NO: 138484 - DNA, 35 bp, Artificial Sequence
  Synthetic oligonucleotide
gctggggggcttagggtggggctagattccgggga

SEQ ID NO: 138485 - DNA, 38 bp, Artificial Sequence
  Synthetic oligonucleotide
ggtcgccctcgctgaaccttctacatccctcctagtga

SEQ ID NO: 138486 - DNA, 36 bp, Artificial Sequence
  Synthetic oligonucleotide
ttccaacgacacacgttactcacttcttccctgcta

SEQ ID NO: 138487 - DNA, 36 bp, Artificial Sequence
  Synthetic oligonucleotide
atgtgatctgctactgcactgtgctcccttccttta

SEQ ID NO: 138488 - DNA, 35 bp, Artificial Sequence
  Synthetic oligonucleotide
gccacatatctccaatcggttcctgggcccacccc

SEQ ID NO: 138489 - DNA, 35 bp, Artificial Sequence
  Synthetic oligonucleotide
gcgcgcgcccttccgtttccgcagcaatgcccgcc

SEQ ID NO: 138490 - DNA, 35 bp, Artificial Sequence
  Synthetic oligonucleotide
gagcactccaagtatcccccctcagtcaccccggc

SEQ ID NO: 138491 - DNA, 35 bp, Artificial Sequence
  Synthetic oligonucleotide
gcgccccgccgctcgtctttcaccgttttttgggc

SEQ ID NO: 138492 - DNA, 35 bp, Artificial Sequence
  Synthetic oligonucleotide
gcaccaacgccaatccccattcagatcccgctggc

SEQ ID NO: 138493 - DNA, 35 bp, Artificial Sequence
  Synthetic oligonucleotide
ttgcaccccgcccacgccgaaccattgatccatgc

SEQ ID NO: 138494 - DNA, 35 bp, Artificial Sequence
  Synthetic oligonucleotide
tccaccggtcccttgctccagaatcctcccagtgc

SEQ ID NO: 138495 - DNA, 35 bp, Artificial Sequence
  Synthetic oligonucleotide
gccgatcttgcagttatacacctccgctgcccatc

SEQ ID NO: 138496 - DNA, 35 bp, Artificial Sequence
  Synthetic oligonucleotide
gactcgcatcacgcagctgcttacgcctccctttc

SEQ ID NO: 138497 - DNA, 35 bp, Artificial Sequence
  Synthetic oligonucleotide
taacgctccgcctctttaccctcgtgtttcctacg

SEQ ID NO: 138498 - DNA, 35 bp, Artificial Sequence
  Synthetic oligonucleotide
gcaaagagaggaaaaacggggggaacggcattgcg

SEQ ID NO: 138499 - DNA, 35 bp, Artificial Sequence
  Synthetic oligonucleotide
tacacgctgctggcccttccggtctcattctatcg

SEQ ID NO: 138500 - DNA, 35 bp, Artificial Sequence
  Synthetic oligonucleotide
ggtcagggcgatcggttatgggggggaggggtggg

SEQ ID NO: 138501 - DNA, 35 bp, Artificial Sequence
  Synthetic oligonucleotide
gcccactctccgctgtctacgggataccacgctat

SEQ ID NO: 138502 - DNA, 35 bp, Artificial Sequence
  Synthetic oligonucleotide
tgtagccagccttgcctcttacgtcgcacacatct

SEQ ID NO: 138503 - DNA, 36 bp, Artificial Sequence
  Synthetic oligonucleotide
gtgacgcgcattttctccgttccagccccggttaca

SEQ ID NO: 138504 - DNA, 35 bp, Artificial Sequence
  Synthetic oligonucleotide
tcatagacgcacatcttcgtaacatcactttacca

SEQ ID NO: 138505 - DNA, 36 bp, Artificial Sequence
  Synthetic oligonucleotide
actgcccctcgcgcaattgtcggccattccctccca

SEQ ID NO: 138506 - DNA, 36 bp, Artificial Sequence
  Synthetic oligonucleotide
atcgtgtcacgccatacctgcccttcctcagttgca

SEQ ID NO: 138507 - DNA, 36 bp, Artificial Sequence
  Synthetic oligonucleotide
ttgaggggtggagggtggttggccgagggagagtca

SEQ ID NO: 138508 - DNA, 37 bp, Artificial Sequence
  Synthetic oligonucleotide
accccctcgaatagtagtgccacctcgtctccaccga

SEQ ID NO: 138509 - DNA, 37 bp, Artificial Sequence
  Synthetic oligonucleotide
acgcatcctccgcccctgtagtaaatcaactccgcga

SEQ ID NO: 138510 - DNA, 35 bp, Artificial Sequence
  Synthetic oligonucleotide
acccccgcatacctccgttccagcccacgcctcga

SEQ ID NO: 138511 - DNA, 36 bp, Artificial Sequence
  Synthetic oligonucleotide
agcaatggagttgaaacgggggcacgggtataggga

SEQ ID NO: 138512 - DNA, 37 bp, Artificial Sequence
  Synthetic oligonucleotide
tactgcggaggggctcggggaaaagaagggctaggga

SEQ ID NO: 138513 - DNA, 37 bp, Artificial Sequence
  Synthetic oligonucleotide
gacattaaacacgggggggagcaaggaggaagatgga

SEQ ID NO: 138514 - DNA, 37 bp, Artificial Sequence
  Synthetic oligonucleotide
atgggatcgggagggggggtcaaatagaactttgtga

SEQ ID NO: 138515 - DNA, 36 bp, Artificial Sequence
  Synthetic oligonucleotide
tacgtgccacctccgttctgtacgtatccaccccta

SEQ ID NO: 138516 - DNA, 36 bp, Artificial Sequence
  Synthetic oligonucleotide
agcacagcccatctccgcaccgactgtcccgcgcta

SEQ ID NO: 138517 - DNA, 36 bp, Artificial Sequence
  Synthetic oligonucleotide
tcaccagtgcacatacttgccttatacgcctcgtta

SEQ ID NO: 138518 - DNA, 35 bp, Artificial Sequence
  Synthetic oligonucleotide
acatcccgccggtcgctcctacgacatttcgacac

SEQ ID NO: 138519 - DNA, 36 bp, Artificial Sequence
  Synthetic oligonucleotide
gttgcaatgccagtatcttactttgcgttctttcac

SEQ ID NO: 138520 - DNA, 35 bp, Artificial Sequence
  Synthetic oligonucleotide
atgtatgccacccttccgactgtcgtgccccctac

SEQ ID NO: 138521 - DNA, 35 bp, Artificial Sequence
  Synthetic oligonucleotide
tactgcgccttcgactctgttcttttgcctgttac

SEQ ID NO: 138522 - DNA, 35 bp, Artificial Sequence
  Synthetic oligonucleotide
tccgctgacgttgtcttgctgacccgattcccacc

SEQ ID NO: 138523 - DNA, 35 bp, Artificial Sequence
  Synthetic oligonucleotide
tccagggatgccgcctcccttgtttacatagtccc

SEQ ID NO: 138524 - DNA, 35 bp, Artificial Sequence
  Synthetic oligonucleotide
gagcaccacatggcactcaatttgtcgaccttccc

SEQ ID NO: 138525 - DNA, 35 bp, Artificial Sequence
  Synthetic oligonucleotide
gcccccgcatcattcacctgcgcccttccttgtcc

SEQ ID NO: 138526 - DNA, 35 bp, Artificial Sequence
  Synthetic oligonucleotide
gtgcccacactgatctgcatccaccttccggttgc

SEQ ID NO: 138527 - DNA, 35 bp, Artificial Sequence
  Synthetic oligonucleotide
gtaccccgccctgtccgcacttttgaatgattgtc

SEQ ID NO: 138528 - DNA, 35 bp, Artificial Sequence
  Synthetic oligonucleotide
tctaacatgccgttggtatcgcgccctcatctccg

SEQ ID NO: 138529 - DNA, 35 bp, Artificial Sequence
  Synthetic oligonucleotide
ttcgaaccccgtgccacctgtcttgcggaccttcg

SEQ ID NO: 138530 - DNA, 35 bp, Artificial Sequence
  Synthetic oligonucleotide
gtaccccccaccttgccagtctagcactctcgctg

SEQ ID NO: 138531 - DNA, 35 bp, Artificial Sequence
  Synthetic oligonucleotide
gtcgccgtccctttgccaacacctcgcggtctctg

SEQ ID NO: 138532 - DNA, 35 bp, Artificial Sequence
  Synthetic oligonucleotide
gacgttgtcaccggtgcctgtatcggtccccccct

SEQ ID NO: 138533 - DNA, 35 bp, Artificial Sequence
  Synthetic oligonucleotide
tagttgcagcatactcccggtaccctcgtctttct

SEQ ID NO: 138534 - DNA, 35 bp, Artificial Sequence
  Synthetic oligonucleotide
agctctcccaacatgctgtctcactcgctccacca

SEQ ID NO: 138535 - DNA, 35 bp, Artificial Sequence
  Synthetic oligonucleotide
aactggatgggaggaggtaggggggcctaagggca

SEQ ID NO: 138536 - DNA, 35 bp, Artificial Sequence
  Synthetic oligonucleotide
gcacccgtaatttacgcacatttgccactgtctca

SEQ ID NO: 138537 - DNA, 36 bp, Artificial Sequence
  Synthetic oligonucleotide
gacagggacctatgggggggagggcttatgatgtca

SEQ ID NO: 138538 - DNA, 37 bp, Artificial Sequence
  Synthetic oligonucleotide
gaggagagactgggggggagcgcggccagggaaaaga

SEQ ID NO: 138539 - DNA, 37 bp, Artificial Sequence
  Synthetic oligonucleotide
cgtcaccgtaccatcaaccctccgccccgactgcgga

SEQ ID NO: 138540 - DNA, 37 bp, Artificial Sequence
  Synthetic oligonucleotide
agagatggggttcagaacggggaagggtggatgggga

SEQ ID NO: 138541 - DNA, 36 bp, Artificial Sequence
  Synthetic oligonucleotide
acgcctctccatccgcattgctattgatcctttgga

SEQ ID NO: 138542 - DNA, 38 bp, Artificial Sequence
  Synthetic oligonucleotide
ggatagagggaggggaccgggtgggtgggtagacatga

SEQ ID NO: 138543 - DNA, 38 bp, Artificial Sequence
  Synthetic oligonucleotide
gcaggtggaaggggaaggatcaaagaatgcggggatga

SEQ ID NO: 138544 - DNA, 38 bp, Artificial Sequence
  Synthetic oligonucleotide
tcgtggccctgctgcccttcctgtacactgtaacctga

SEQ ID NO: 138545 - DNA, 37 bp, Artificial Sequence
  Synthetic oligonucleotide
tccctaccttcctcagatcttgtccgccctgccctga

SEQ ID NO: 138546 - DNA, 37 bp, Artificial Sequence
  Synthetic oligonucleotide
tacgccctcctcgcttaaatttagcagtcttccctga

SEQ ID NO: 138547 - DNA, 38 bp, Artificial Sequence
  Synthetic oligonucleotide
agcccctcccgcctcccagacatcacctaggctcgtga

SEQ ID NO: 138548 - DNA, 36 bp, Artificial Sequence; identical to SEQ ID NO: 27775
  Synthetic oligonucleotide

SEQ ID NO: 138549 - DNA, 36 bp, Artificial Sequence
  Synthetic oligonucleotide
gaaggtgagtaccggtagagggggtagggcgggata

SEQ ID NO: 138550 - DNA, 35 bp, Artificial Sequence
  Synthetic oligonucleotide
tgtggcccctcgtttgcgtgaacaatctccaccta

SEQ ID NO: 138551 - DNA, 36 bp, Artificial Sequence
  Synthetic oligonucleotide
gttaaccgcttcacctgtaacgtgtctctgtcccta

SEQ ID NO: 138552 - DNA, 36 bp, Artificial Sequence
  Synthetic oligonucleotide
tgtagcggccacgttcggccccgttcactccgctta

SEQ ID NO: 138553 - DNA, 36 bp, Artificial Sequence
  Synthetic oligonucleotide
gaaggccattgcacgttgcaccaccaccaccgttta

SEQ ID NO: 138554 - DNA, 35 bp, Artificial Sequence
  Synthetic oligonucleotide
aaggggacggggtaggtaggaggttgtggcatcgc

SEQ ID NO: 138555 - DNA, 35 bp, Artificial Sequence
  Synthetic oligonucleotide
tccacgtactcatcacgacattcgcgcactacctc

SEQ ID NO: 138556 - DNA, 35 bp, Artificial Sequence
  Synthetic oligonucleotide
aaccgctgtgtctttctgcgctattatcgttcctc

SEQ ID NO: 138557 - DNA, 35 bp, Artificial Sequence
  Synthetic oligonucleotide
ttcctcccccgctatgttccctacaccagttatag

SEQ ID NO: 138558 - DNA, 35 bp, Artificial Sequence
  Synthetic oligonucleotide
acaacgctcgactcccatatctttgtacatcctcg

SEQ ID NO: 138559 - DNA, 35 bp, Artificial Sequence
  Synthetic oligonucleotide
aggagcaaccgccttgccttctccacctaccttcg

SEQ ID NO: 138560 - DNA, 35 bp, Artificial Sequence
  Synthetic oligonucleotide
tgcccatccgcctatcccggtcacaaattttattg

SEQ ID NO: 138561 - DNA, 35 bp, Artificial Sequence
  Synthetic oligonucleotide
gccagggctccgtttcttgtactgcactcatacct

SEQ ID NO: 138562 - DNA, 35 bp, Artificial Sequence
  Synthetic oligonucleotide
acatttctgcgttaccgcccgccttgtcccacgct

SEQ ID NO: 138563 - DNA, 35 bp, Artificial Sequence
  Synthetic oligonucleotide
actcccccgcctattgaatattgatcatgtcttct

SEQ ID NO: 138564 - DNA, 35 bp, Artificial Sequence
  Synthetic oligonucleotide
gtgcctccagactactggcttagacctccatcctt

SEQ ID NO: 138565 - DNA, 35 bp, Artificial Sequence
  Synthetic oligonucleotide
gtgacacgcgcttggccatccgccgccgcttcctt

SEQ ID NO: 138566 - DNA, 36 bp, Artificial Sequence
  Synthetic oligonucleotide
tatgcctcatcctgtcgccgttctctgtccttgaaa

SEQ ID NO: 138567 - DNA, 36 bp, Artificial Sequence
  Synthetic oligonucleotide
ttcccgccccctatttgctggagccaaacccactaa

SEQ ID NO: 138568 - DNA, 36 bp, Artificial Sequence
  Synthetic oligonucleotide
tcaggggtgggtcgggtagggaagccatagtaccca

SEQ ID NO: 138569 - DNA, 36 bp, Artificial Sequence
  Synthetic oligonucleotide
cccccccgcctatattgtcacacatgtcctctgcca

SEQ ID NO: 138570 - DNA, 36 bp, Artificial Sequence
  Synthetic oligonucleotide
tacgcgaccacatattttatcgcacactctcatcca

SEQ ID NO: 138571 - DNA, 35 bp, Artificial Sequence
  Synthetic oligonucleotide
ggatgagggaacgggtactgggaggctggccggca

SEQ ID NO: 138572 - DNA, 36 bp, Artificial Sequence
  Synthetic oligonucleotide
gttcactcgccgctctatttctagtccttcactgca

SEQ ID NO: 138573 - DNA, 35 bp, Artificial Sequence
  Synthetic oligonucleotide
tcacgacaagtgaccaattcttccctgtcctctca

SEQ ID NO: 138574 - DNA, 36 bp, Artificial Sequence
  Synthetic oligonucleotide
tcccaccgcctcctaatcgtcagtcatggtccttca

SEQ ID NO: 138575 - DNA, 37 bp, Artificial Sequence
  Synthetic oligonucleotide
actgcagaagaaagggtaggggcgggatcggcgagga

SEQ ID NO: 138576 - DNA, 37 bp, Artificial Sequence
  Synthetic oligonucleotide
gcatgacgggggaggtcggaggcgacggcggtaggga

SEQ ID NO: 138577 - DNA, 36 bp, Artificial Sequence
  Synthetic oligonucleotide
ggatagccagcgacaatgccgtttcctctccgctga

SEQ ID NO: 138578 - DNA, 38 bp, Artificial Sequence
  Synthetic oligonucleotide
acctcccgcctcacactgcgtatagtttccctatctga

SEQ ID NO: 138579 - DNA, 37 bp, Artificial Sequence
  Synthetic oligonucleotide
tagggtcgctgggggagcgggggacagagggtgttga

SEQ ID NO: 138580 - DNA, 36 bp, Artificial Sequence
  Synthetic oligonucleotide
acatgcagttccttctgccttcacgcccttgctgta

SEQ ID NO: 138581 - DNA, 36 bp, Artificial Sequence
  Synthetic oligonucleotide
ttcgccgtctgagcttctgccgtccccttatttgcc

SEQ ID NO: 138582 - DNA, 35 bp, Artificial Sequence
  Synthetic oligonucleotide
gtgcatccccccgtaccgctggtaatcgcgaatcc

SEQ ID NO: 138583 - DNA, 35 bp, Artificial Sequence
  Synthetic oligonucleotide
tgacatcccctgggcgtgtcttcttctattactcc

SEQ ID NO: 138584 - DNA, 35 bp, Artificial Sequence
  Synthetic oligonucleotide
ttcgtcacgcgcatccattgtactacactacctcc

SEQ ID NO: 138585 - DNA, 35 bp, Artificial Sequence
  Synthetic oligonucleotide
gtggttccctcccatgctctccagcaccatttcgc

SEQ ID NO: 138586 - DNA, 35 bp, Artificial Sequence
  Synthetic oligonucleotide
gaaccacctccgacaacatcatggacagttctatc

SEQ ID NO: 138587 - DNA, 35 bp, Artificial Sequence
  Synthetic oligonucleotide
tgcgtgcctcatcccgtcctacggaacccgcgctc

SEQ ID NO: 138588 - DNA, 35 bp, Artificial Sequence
  Synthetic oligonucleotide
gccagaaaagagggaaagaagagggatggaagaag

SEQ ID NO: 138589 - DNA, 35 bp, Artificial Sequence
  Synthetic oligonucleotide
gctctcgcgccctgctcttactaatttgcccgacg

SEQ ID NO: 138590 - DNA, 35 bp, Artificial Sequence
  Synthetic oligonucleotide
gcccacctctctgctcagcacatttcgtgtctctg

SEQ ID NO: 138591 - DNA, 35 bp, Artificial Sequence
  Synthetic oligonucleotide
gaacgcggcgcatttccctgcggtattctgcccct

SEQ ID NO: 138592 - DNA, 35 bp, Artificial Sequence
  Synthetic oligonucleotide
ttacagctccggccttcattgatcgatctccccgt

SEQ ID NO: 138593 - DNA, 35 bp, Artificial Sequence
  Synthetic oligonucleotide
agccagtcctcggagctttctgtccctgcccatgt

SEQ ID NO: 138594 - DNA, 35 bp, Artificial Sequence
  Synthetic oligonucleotide
tcatgactaacgcctcgtggccctcctatctccca

SEQ ID NO: 138595 - DNA, 36 bp, Artificial Sequence
  Synthetic oligonucleotide
tccaagtccccgtggtgcacgcccagtccccccgca

SEQ ID NO: 138596 - DNA, 36 bp, Artificial Sequence
  Synthetic oligonucleotide
gtgggcgggagggttgcgatattagccgggtcatca

SEQ ID NO: 138597 - DNA, 37 bp, Artificial Sequence
  Synthetic oligonucleotide
cctgccctccccacctcagcgctgtcttggatgacga

SEQ ID NO: 138598 - DNA, 37 bp, Artificial Sequence
  Synthetic oligonucleotide
tttgcgcgggtcctcgtttctccctcttgcgtttcga

SEQ ID NO: 138599 - DNA, 37 bp, Artificial Sequence
  Synthetic oligonucleotide
gtccccgggaggaggagggggtcggataaggtgggga

SEQ ID NO: 138600 - DNA, 37 bp, Artificial Sequence
  Synthetic oligonucleotide
aaggacacgggggtggggtttcgggggtaagttggga

SEQ ID NO: 138601 - DNA, 36 bp, Artificial Sequence
  Synthetic oligonucleotide
tcgagtgctgtcaccttctccctcgtgacctaccta

SEQ ID NO: 138602 - DNA, 36 bp, Artificial Sequence
  Synthetic oligonucleotide
tcttcgcaccgtgtggccacgtcctcgctccctcta

SEQ ID NO: 138603 - DNA, 35 bp, Artificial Sequence
  Synthetic oligonucleotide
agtgcccacatggtctttgaacctccaatccctta

SEQ ID NO: 138604 - DNA, 35 bp, Artificial Sequence
  Synthetic oligonucleotide
taggcccccccactctgtcgcactcaatcccgcac

SEQ ID NO: 138605 - DNA, 35 bp, Artificial Sequence
  Synthetic oligonucleotide
atcatgatcgcacgttactctcacacgtccccgcc

SEQ ID NO: 138606 - DNA, 35 bp, Artificial Sequence
  Synthetic oligonucleotide
atctcccagtccctgccacccgcattgcgttcgcc

SEQ ID NO: 138607 - DNA, 35 bp, Artificial Sequence
  Synthetic oligonucleotide
gccaactgcggtgccctattgaccctctccttcgc

SEQ ID NO: 138608 - DNA, 35 bp, Artificial Sequence
  Synthetic oligonucleotide
cactcctggacatacgatcgcaccagcccctttgc

SEQ ID NO: 138609 - DNA, 35 bp, Artificial Sequence
  Synthetic oligonucleotide
agcccatgcctccattattctctgttacctgcctc

SEQ ID NO: 138610 - DNA, 34 bp, Artificial Sequence
  Synthetic oligonucleotide
gagacggcgagaggggggggggtgctagacgttc

SEQ ID NO: 138611 - DNA, 35 bp, Artificial Sequence
  Synthetic oligonucleotide
ggttcgtcctgatccccattagccttcacccgttc

SEQ ID NO: 138612 - DNA, 35 bp, Artificial Sequence
  Synthetic oligonucleotide
tgaccacctgtactccgcccccagctatcgcacag

SEQ ID NO: 138613 - DNA, 35 bp, Artificial Sequence
  Synthetic oligonucleotide
gacttagcgaccttctgttgtctcccctgttaccg

SEQ ID NO: 138614 - DNA, 35 bp, Artificial Sequence
  Synthetic oligonucleotide
tgactagggcgggtaggggtaatgtcgaaatgggg

SEQ ID NO: 138615 - DNA, 35 bp, Artificial Sequence
  Synthetic oligonucleotide
tccgtaggacccctttgctttaattcgcctttttg

SEQ ID NO: 138616 - DNA, 35 bp, Artificial Sequence
  Synthetic oligonucleotide
acagctggtaagctggttgcctcgcccgtgcctct

SEQ ID NO: 138617 - DNA, 35 bp, Artificial Sequence
  Synthetic oligonucleotide
tccagatgctcccacagcctgttgatttcgtttct

SEQ ID NO: 138618 - DNA, 35 bp, Artificial Sequence
  Synthetic oligonucleotide
gtttccaccgcgtaatccccggccacttctatttt

SEQ ID NO: 138619 - DNA, 36 bp, Artificial Sequence
  Synthetic oligonucleotide
tcccccctccatgttccggcccaaaaggttcaccaa

SEQ ID NO: 138620 - DNA, 36 bp, Artificial Sequence
  Synthetic oligonucleotide
gcacctgcccaacatgctttaacacatgcccctcaa

SEQ ID NO: 138621 - DNA, 36 bp, Artificial Sequence
  Synthetic oligonucleotide
gccgacacttaccatctgaggctcataacatcccca

SEQ ID NO: 138622 - DNA, 36 bp, Artificial Sequence
  Synthetic oligonucleotide
tggttggcctccttattcgtaaccttcctcgtcgca

SEQ ID NO: 138623 - DNA, 36 bp, Artificial Sequence
  Synthetic oligonucleotide
gtcccactaccctatgtgttccaccccagcttatca

SEQ ID NO: 138624 - DNA, 37 bp, Artificial Sequence
  Synthetic oligonucleotide
tccccagcccctgtctttccccatcctagtccttaga

SEQ ID NO: 138625 - DNA, 37 bp, Artificial Sequence
  Synthetic oligonucleotide
tgaccacgttgcattcatcgttttgtgcctctctcga

SEQ ID NO: 138626 - DNA, 36 bp, Artificial Sequence
  Synthetic oligonucleotide
acgtggtggggccggggggggacagggaactgtcga

SEQ ID NO: 138627 - DNA, 36 bp, Artificial Sequence
  Synthetic oligonucleotide
gtgtccctcccgcctgtctgttcgtaagtcccacta

SEQ ID NO: 138628 - DNA, 36 bp, Artificial Sequence
  Synthetic oligonucleotide
tcccccccgtcgtccagcaagcgagcactactccta

SEQ ID NO: 138629 - DNA, 33 bp, Artificial Sequence
  Synthetic oligonucleotide
tcatcacctcctgactaaaggtacgcccgcccc

SEQ ID NO: 138630 - DNA, 35 bp, Artificial Sequence
  Synthetic oligonucleotide
agtccccgcccattctttcagctagtactgctccc

SEQ ID NO: 138631 - DNA, 35 bp, Artificial Sequence
  Synthetic oligonucleotide
gaagcccgtccttgcacaccaacccacccctttcc

SEQ ID NO: 138632 - DNA, 35 bp, Artificial Sequence
  Synthetic oligonucleotide
aacgcccatctctgctcccggtatcgctattccgc

SEQ ID NO: 138633 - DNA, 34 bp, Artificial Sequence
  Synthetic oligonucleotide
tcgctcgggaggggaagggcaaggggcaacgggc

SEQ ID NO: 138634 - DNA, 35 bp, Artificial Sequence
  Synthetic oligonucleotide
tcacgcctcaaagccccaatcgcacccatctgctc

SEQ ID NO: 138635 - DNA, 35 bp, Artificial Sequence
  Synthetic oligonucleotide
gtcccggcgacttagtagtcctgttccaccttgtc

SEQ ID NO: 138636 - DNA, 35 bp, Artificial Sequence
  Synthetic oligonucleotide
gtttggtcctgtccatgcgctttttgcagcccttc

SEQ ID NO: 138637 - DNA, 35 bp, Artificial Sequence
  Synthetic oligonucleotide
gcacctgccggcaagtgcattgctcctaatcgttc

SEQ ID NO: 138638 - DNA, 35 bp, Artificial Sequence
  Synthetic oligonucleotide
atattgaggcgggattgtgggaggggactacgcag

SEQ ID NO: 138639 - DNA, 35 bp, Artificial Sequence
  Synthetic oligonucleotide
gtcgccttcagtctcattctatggtccccccttgg

SEQ ID NO: 138640 - DNA, 35 bp, Artificial Sequence
  Synthetic oligonucleotide
tacgcatatcgcgtacctgctaatcccactacctg

SEQ ID NO: 138641 - DNA, 35 bp, Artificial Sequence
  Synthetic oligonucleotide
aaaccccgctgtctcctcgttctagccacccaagt

SEQ ID NO: 138642 - DNA, 35 bp, Artificial Sequence
  Synthetic oligonucleotide
tgcctccatcgcgctacatcgcctcctagccatgt

SEQ ID NO: 138643 - DNA, 35 bp, Artificial Sequence
  Synthetic oligonucleotide
accgaacagctcccagtccttcgtacttgctcttt

SEQ ID NO: 138644 - DNA, 36 bp, Artificial Sequence
  Synthetic oligonucleotide
accacccaaccaccgacgctgtattggttcctcaca

SEQ ID NO: 138645 - DNA, 36 bp, Artificial Sequence
  Synthetic oligonucleotide
ttacgctcgtggtgcaatatccccgtccacccccca

SEQ ID NO: 138646 - DNA, 36 bp, Artificial Sequence
  Synthetic oligonucleotide
gtccctcaggacctgtttgaacgttcccctggccca

SEQ ID NO: 138647 - DNA, 36 bp, Artificial Sequence
  Synthetic oligonucleotide
tcgaggagagaggggggggtaaggtcgctaatggca

SEQ ID NO: 138648 - DNA, 37 bp, Artificial Sequence
  Synthetic oligonucleotide
gagatggtgggtagaggggcgatgggcggaatgaaga

SEQ ID NO: 138649 - DNA, 36 bp, Artificial Sequence
  Synthetic oligonucleotide
tgcggaccgctcgcactgttacgtcttctgccccga

SEQ ID NO: 138650 - DNA, 37 bp, Artificial Sequence
  Synthetic oligonucleotide
tgcgtcgcacctttcgatcgatcgtcctgttccccga

SEQ ID NO: 138651 - DNA, 37 bp, Artificial Sequence
  Synthetic oligonucleotide
agtgagtcaccctgccgattacccgtccgtcttccga

SEQ ID NO: 138652 - DNA, 34 bp, Artificial Sequence
  Synthetic oligonucleotide
ggtaagggggagaagggaggctatgggctggcga

SEQ ID NO: 138653 - DNA, 37 bp, Artificial Sequence
  Synthetic oligonucleotide
gcatgtctgtatccgcgttcctccccgcccattgcga

SEQ ID NO: 138654 - DNA, 35 bp, Artificial Sequence
  Synthetic oligonucleotide
agtcacctccctcacaccccgtccggttacctcga

SEQ ID NO: 138655 - DNA, 37 bp, Artificial Sequence
  Synthetic oligonucleotide
aagggggagggacggggaaggggtttggcgagaagga

SEQ ID NO: 138656 - DNA, 37 bp, Artificial Sequence
  Synthetic oligonucleotide
acgcaaatgaaggggggtagatggagtaggggctgga

SEQ ID NO: 138657 - DNA, 38 bp, Artificial Sequence
  Synthetic oligonucleotide
atgcccagcgcacgcctaaataccagcctccaccctga

SEQ ID NO: 138658 - DNA, 37 bp, Artificial Sequence
  Synthetic oligonucleotide
gacacctgccgacgcgtgtgttcgccgcccctcctga

SEQ ID NO: 138659 - DNA, 37 bp, Artificial Sequence
  Synthetic oligonucleotide
tcatctcccttcgctggtatctgactcctccagctga

SEQ ID NO: 138660 - DNA, 37 bp, Artificial Sequence
  Synthetic oligonucleotide
acgtgagccattattgtccactcctcgctcctgctga

SEQ ID NO: 138661 - DNA, 36 bp, Artificial Sequence
  Synthetic oligonucleotide
gtctacgccctccgcattactagagtatccctctga

SEQ ID NO: 138662 - DNA, 35 bp, Artificial Sequence
  Synthetic oligonucleotide
acatcttccctgcctggtcccacgccaccgtatta

SEQ ID NO: 138663 - DNA, 36 bp, Artificial Sequence
  Synthetic oligonucleotide
acgcgacctctgctccgacaactgtacgttccttta

SEQ ID NO: 138664 - DNA, 35 bp, Artificial Sequence
  Synthetic oligonucleotide
acgaccactaccgaccctgtcccaatttagtacac

SEQ ID NO: 138665 - DNA, 35 bp, Artificial Sequence
  Synthetic oligonucleotide
aagagcacgcttccccgccctctcacgctggccac

SEQ ID NO: 138666 - DNA, 35 bp, Artificial Sequence
  Synthetic oligonucleotide
gaaccgcgctcccgatcttaaaccgtcaccgttac

SEQ ID NO: 138667 - DNA, 34 bp, Artificial Sequence
  Synthetic oligonucleotide
tgggcatcccccccccccgctgattgcgtaaccc

SEQ ID NO: 138668 - DNA, 35 bp, Artificial Sequence
  Synthetic oligonucleotide
gtagcatccgcagccatcctactcgtatcaatccc

SEQ ID NO: 138669 - DNA, 35 bp, Artificial Sequence
  Synthetic oligonucleotide
acctctcctccttgttcccgaccgctcccaaggcc

SEQ ID NO: 138670 - DNA, 35 bp, Artificial Sequence
  Synthetic oligonucleotide
attccccctcgaaactgttctgtatcactcatcgc

SEQ ID NO: 138671 - DNA, 34 bp, Artificial Sequence
  Synthetic oligonucleotide
gcgcccgttcccaggctcgtcgcagttgcacctc

SEQ ID NO: 138672 - DNA, 35 bp, Artificial Sequence
  Synthetic oligonucleotide
tcactcacccgccgcctgactaatcagctccgctc

SEQ ID NO: 138673 - DNA, 36 bp, Artificial Sequence
  Synthetic oligonucleotide
accaccccgccgacactggacagttacacccacttc

SEQ ID NO: 138674 - DNA, 35 bp, Artificial Sequence
  Synthetic oligonucleotide
ataccccagcccatgttaattccgccctcaccttc

SEQ ID NO: 138675 - DNA, 35 bp, Artificial Sequence
  Synthetic oligonucleotide
gacgcggactcatacgttctttcctcccccagttc

SEQ ID NO: 138676 - DNA, 35 bp, Artificial Sequence
  Synthetic oligonucleotide
tccgccgccctgcccgccgctttccatcactcaag

SEQ ID NO: 138677 - DNA, 35 bp, Artificial Sequence
  Synthetic oligonucleotide
gtaagtgaggtagtggggaacacaggatgggggag

SEQ ID NO: 138678 - DNA, 35 bp, Artificial Sequence
  Synthetic oligonucleotide
atacagcgctatgctgtatcgtcctccgcccaccg

SEQ ID NO: 138679 - DNA, 35 bp, Artificial Sequence
  Synthetic oligonucleotide
aaccacccgctcaccgtaccttcaaacgccattgg

SEQ ID NO: 138680 - DNA, 35 bp, Artificial Sequence
  Synthetic oligonucleotide
acacctcaccgtcgttcatccgtcaaaccgtcact

SEQ ID NO: 138681 - DNA, 35 bp, Artificial Sequence
  Synthetic oligonucleotide
taccaacaccatcgcgtggcaacatccaggtccct

SEQ ID NO: 138682 - DNA, 35 bp, Artificial Sequence
  Synthetic oligonucleotide
atctgcagccctcgccgctctttgctactcttgct

SEQ ID NO: 138683 - DNA, 35 bp, Artificial Sequence
  Synthetic oligonucleotide
taagcaaccgctgcccgcctattgccacaccatct

SEQ ID NO: 138684 - DNA, 35 bp, Artificial Sequence
  Synthetic oligonucleotide
gtcatacccgcccttgtccccctgttttgttatct

SEQ ID NO: 138685 - DNA, 35 bp, Artificial Sequence
  Synthetic oligonucleotide
gcaacgcatcccactcgtctcctagacaccgccgt

SEQ ID NO: 138686 - DNA, 34 bp, Artificial Sequence
  Synthetic oligonucleotide
ttccatcctcatcgctgacttattcccatcttgt

SEQ ID NO: 138687 - DNA, 35 bp, Artificial Sequence
  Synthetic oligonucleotide
atgcccacccccgcctcgggacgagcctctccatt

SEQ ID NO: 138688 - DNA, 34 bp, Artificial Sequence
  Synthetic oligonucleotide
tttcatccccggcgttcaggtccgccccgcactt

SEQ ID NO: 138689 - DNA, 35 bp, Artificial Sequence
  Synthetic oligonucleotide
gaagggaggggcggggggttgtgagcgtggatctt

SEQ ID NO: 138690 - DNA, 35 bp, Artificial Sequence
  Synthetic oligonucleotide
gacaccctcccttgaaaagctccagcgctcttctt

SEQ ID NO: 138691 - DNA, 36 bp, Artificial Sequence
  Synthetic oligonucleotide
ttacccgccttgggtccagcccacttcctcctcgaa

SEQ ID NO: 138692 - DNA, 36 bp, Artificial Sequence
  Synthetic oligonucleotide
gccaacttggtgcaaatttgagtcccccccgctaca

SEQ ID NO: 138693 - DNA, 36 bp, Artificial Sequence
  Synthetic oligonucleotide
acgttacccccgcgccctactcgattaggttctaca

SEQ ID NO: 138694 - DNA, 35 bp, Artificial Sequence
  Synthetic oligonucleotide
gcctcacccttcgatcctatttaaacaccggtaca

SEQ ID NO: 138695 - DNA, 35 bp, Artificial Sequence
  Synthetic oligonucleotide
tccaccgccgcctgggcaccacctgattgccatca

SEQ ID NO: 138696 - DNA, 35 bp, Artificial Sequence
  Synthetic oligonucleotide
gccaacctccatgtccaatttatgcttgttaccga

SEQ ID NO: 138697 - DNA, 37 bp, Artificial Sequence
  Synthetic oligonucleotide
gagagtggtgggtggtggggacggtcggaggatcgga

SEQ ID NO: 138698 - DNA, 37 bp, Artificial Sequence
  Synthetic oligonucleotide
gacaggggaggggtaggactgcagtggggcggaatga

SEQ ID NO: 138699 - DNA, 38 bp, Artificial Sequence
  Synthetic oligonucleotide
tcgcacatcatcgttttatccatccattccacgtatga

SEQ ID NO: 138700 - DNA, 36 bp, Artificial Sequence
  Synthetic oligonucleotide
aatgtcaagtggtggaggataggaggggaacgggta

SEQ ID NO: 138701 - DNA, 35 bp, Artificial Sequence
  Synthetic oligonucleotide
gtgccctcaccgccgactcgttaggctaacacacc

SEQ ID NO: 138702 - DNA, 35 bp, Artificial Sequence
  Synthetic oligonucleotide
gccccttgacgaccgcccgcccgttctatcagccc

SEQ ID NO: 138703 - DNA, 35 bp, Artificial Sequence
  Synthetic oligonucleotide
tcacattgaccgtgaggttccgacgctacatctcc

SEQ ID NO: 138704 - DNA, 35 bp, Artificial Sequence
  Synthetic oligonucleotide
acaacgtcccgccgccctcacatgtcctgtggtcc

SEQ ID NO: 138705 - DNA, 35 bp, Artificial Sequence
  Synthetic oligonucleotide
atgctcggctgtaaccgctccttctgctatgccgc

SEQ ID NO: 138706 - DNA, 34 bp, Artificial Sequence
  Synthetic oligonucleotide
gtgacaccaggaggctggcggggggggaggaggc

SEQ ID NO: 138707 - DNA, 35 bp, Artificial Sequence
  Synthetic oligonucleotide
cacacccgttgctttataggttttcgctcccctgc

SEQ ID NO: 138708 - DNA, 35 bp, Artificial Sequence
  Synthetic oligonucleotide
gcatgcgcgcttcaccaattgttcaccgctacatc

SEQ ID NO: 138709 - DNA, 35 bp, Artificial Sequence
  Synthetic oligonucleotide
gccacgccagtggctgtttactcctgatcccactc

SEQ ID NO: 138710 - DNA, 35 bp, Artificial Sequence
  Synthetic oligonucleotide
tgccctaccctgtctccacttcccagcctggtgtc

SEQ ID NO: 138711 - DNA, 35 bp, Artificial Sequence
  Synthetic oligonucleotide
tcaacactgagatctcacccacgcgtcctctttcg

SEQ ID NO: 138712 - DNA, 35 bp, Artificial Sequence
  Synthetic oligonucleotide
aaatcggggtgggacgggagggcaataactcgatg

SEQ ID NO: 138713 - DNA, 35 bp, Artificial Sequence
  Synthetic oligonucleotide
gacgcacctcatgcccttttagtttgccattactg

SEQ ID NO: 138714 - DNA, 35 bp, Artificial Sequence
  Synthetic oligonucleotide
ttgtcaccggtcctgggtagcttctcttcctcctg

SEQ ID NO: 138715 - DNA, 35 bp, Artificial Sequence
  Synthetic oligonucleotide
gttccatcggtcccatgtttggctcttgctccttg

SEQ ID NO: 138716 - DNA, 35 bp, Artificial Sequence
  Synthetic oligonucleotide
tcccgccccgtgaatcgtaccagctacgactacat

SEQ ID NO: 138717 - DNA, 35 bp, Artificial Sequence
  Synthetic oligonucleotide
tccccatcgcaacactggtctatcttgttctaact

SEQ ID NO: 138718 - DNA, 35 bp, Artificial Sequence
  Synthetic oligonucleotide
gccaccggaatatgcagcacggcttccgctcccct

SEQ ID NO: 138719 - DNA, 35 bp, Artificial Sequence
  Synthetic oligonucleotide
gcccctgaggcacacctgctaaagctgccactcct

SEQ ID NO: 138720 - DNA, 35 bp, Artificial Sequence
  Synthetic oligonucleotide
gcgcacatacgattttactgttcgccgtttctcct

SEQ ID NO: 138721 - DNA, 35 bp, Artificial Sequence
  Synthetic oligonucleotide
ttgcagacgctggtctcaccgctccccaccttgct

SEQ ID NO: 138722 - DNA, 35 bp, Artificial Sequence
  Synthetic oligonucleotide
ttggtacgccatttgttgcttccgccctcgttgtt

SEQ ID NO: 138723 - DNA, 35 bp, Artificial Sequence
  Synthetic oligonucleotide
tcagagtctgcatcttacccccgccatgcctgttt

SEQ ID NO: 138724 - DNA, 36 bp, Artificial Sequence
  Synthetic oligonucleotide
gagcgggagggggagaggtggggatccgacgtcaaa

SEQ ID NO: 138725 - DNA, 36 bp, Artificial Sequence
  Synthetic oligonucleotide
acacgccctcttgccgatcctgttttgcacatccaa

SEQ ID NO: 138726 - DNA, 36 bp, Artificial Sequence
  Synthetic oligonucleotide
tcctgccctctcttgtgccatcgggaacccttgcaa

SEQ ID NO: 138727 - DNA, 36 bp, Artificial Sequence
  Synthetic oligonucleotide
tcccaccacctgcttaaaccctcggacgtattcgaa

SEQ ID NO: 138728 - DNA, 36 bp, Artificial Sequence
  Synthetic oligonucleotide
tattgcgagcgccgctgcagccctccacgcccctaa

SEQ ID NO: 138729 - DNA, 36 bp, Artificial Sequence
  Synthetic oligonucleotide
tactacgcctcactttaacagcctgcttgccaccca

SEQ ID NO: 138730 - DNA, 36 bp, Artificial Sequence
  Synthetic oligonucleotide
tgctgccccatacgtcctctatatggcccctgttca

SEQ ID NO: 138731 - DNA, 37 bp, Artificial Sequence
  Synthetic oligonucleotide
taacaccgtacacgtgatctcgccctcccgccaccga

SEQ ID NO: 138732 - DNA, 35 bp, Artificial Sequence
  Synthetic oligonucleotide
taagtcgcccccgctcagcgtatagcaccccccga

SEQ ID NO: 138733 - DNA, 37 bp, Artificial Sequence
  Synthetic oligonucleotide
gccacctgtcacattatgctctcgaattcacctgcga

SEQ ID NO: 138734 - DNA, 37 bp, Artificial Sequence
  Synthetic oligonucleotide
taggaggtggggcggattaggggcgtaaaagcgtcga

SEQ ID NO: 138735 - DNA, 35 bp, Artificial Sequence
  Synthetic oligonucleotide
taggggggaggtaccgggaggggtagggcaactga

SEQ ID NO: 138736 - DNA, 37 bp, Artificial Sequence
  Synthetic oligonucleotide
tagccatccacaacacccaccgccgtctctcgactga

SEQ ID NO: 138737 - DNA, 37 bp, Artificial Sequence
  Synthetic oligonucleotide
acgtagccccgcgtgtcttttcggaccccctccctga

SEQ ID NO: 138738 - DNA, 38 bp, Artificial Sequence
  Synthetic oligonucleotide
gtgtcctcagcaattcaccgcgcctgttccattcctga

SEQ ID NO: 138739 - DNA, 38 bp, Artificial Sequence
  Synthetic oligonucleotide
gccatcctctccgttcgtttttgcctgcttgctcgtga

SEQ ID NO: 138740 - DNA, 38 bp, Artificial Sequence
  Synthetic oligonucleotide
tacccacccttagtccgtttacgctgcaactcccttga

SEQ ID NO: 138741 - DNA, 36 bp, Artificial Sequence
  Synthetic oligonucleotide
gactcccctccgttcatattaagcatgcgcgaccta

SEQ ID NO: 138742 - DNA, 35 bp, Artificial Sequence
  Synthetic oligonucleotide
cattccgctacccgccactgtcttagcagtctacc

SEQ ID NO: 138743 - DNA, 35 bp, Artificial Sequence
  Synthetic oligonucleotide
gcctccttgcagcatgttgccctgattcgtcttcc

SEQ ID NO: 138744 - DNA, 36 bp, Artificial Sequence
  Synthetic oligonucleotide
attccctcgacgcgattggcactccactccacggtc

SEQ ID NO: 138745 - DNA, 35 bp, Artificial Sequence
  Synthetic oligonucleotide
agcccctgccactcctttatacctctacggtggtc

SEQ ID NO: 138746 - DNA, 35 bp, Artificial Sequence
  Synthetic oligonucleotide
gaccccatcggtctgatctccgcctcccagttgtc

SEQ ID NO: 138747 - DNA, 35 bp, Artificial Sequence
  Synthetic oligonucleotide
tctagcccctgttgatcacttactaccccccatcg

SEQ ID NO: 138748 - DNA, 35 bp, Artificial Sequence
  Synthetic oligonucleotide
tcctcccgcatcggacgttcgtcttggcccgcctt

SEQ ID NO: 138749 - DNA, 36 bp, Artificial Sequence
  Synthetic oligonucleotide
gctcctgcccactccaccatgtacacggttgcacaa

SEQ ID NO: 138750 - DNA, 35 bp, Artificial Sequence
  Synthetic oligonucleotide
gtcccccgccccttctgttcaagccccgttgccca

SEQ ID NO: 138751 - DNA, 36 bp, Artificial Sequence
  Synthetic oligonucleotide
gtcagggtcctgctaccattcgcgctcctcctgtca

SEQ ID NO: 138752 - DNA, 36 bp, Artificial Sequence
  Synthetic oligonucleotide
gtcgctccccaatgccaactatcagtgatccaccga

SEQ ID NO: 138753 - DNA, 29 bp, Artificial Sequence
  Synthetic oligonucleotide
gctgtacgcccgcccgaaaccctatccga

SEQ ID NO: 138754 - DNA, 37 bp, Artificial Sequence
  Synthetic oligonucleotide
gttgagccactattccatttgtactatcgccttccga

SEQ ID NO: 138755 - DNA, 35 bp, Artificial Sequence
  Synthetic oligonucleotide
gttcgaactgggtaaggggtagggagctggggcga

SEQ ID NO: 138756 - DNA, 37 bp, Artificial Sequence
  Synthetic oligonucleotide
aaacggggacggagaagcgggtagggcaaggtcatga

SEQ ID NO: 138757 - DNA, 38 bp, Artificial Sequence
  Synthetic oligonucleotide
gtggggtggggtgtatgccggggtcctgaggggactga

SEQ ID NO: 138758 - DNA, 38 bp, Artificial Sequence
  Synthetic oligonucleotide
ggaggagggaactgactagtagggatggagggcggtga

SEQ ID NO: 138759 - DNA, 37 bp, Artificial Sequence
  Synthetic oligonucleotide
tggggagtggcggtttccatcctagggcggtgggtga

SEQ ID NO: 138760 - DNA, 38 bp, Artificial Sequence
  Synthetic oligonucleotide
ttccggggcgttcatgggggcgggcgggaaaaaattga

SEQ ID NO: 138761 - DNA, 36 bp, Artificial Sequence
  Synthetic oligonucleotide
accaccgctgtacttctccctgctccgtgcccccta

SEQ ID NO: 138762 - DNA, 36 bp, Artificial Sequence
  Synthetic oligonucleotide
gccattccactttgctgtctgtactcctgtcccgta

SEQ ID NO: 138763 - DNA, 35 bp, Artificial Sequence
  Synthetic oligonucleotide
tcccatctcgtagtgaaaacaatccgctgttccac

SEQ ID NO: 138764 - DNA, 35 bp, Artificial Sequence
  Synthetic oligonucleotide
ttggctccgttccttcgatccgtctacaccccacc

SEQ ID NO: 138765 - DNA, 35 bp, Artificial Sequence
  Synthetic oligonucleotide
ttcgccacgccacctctcggacaatattgccgccc

SEQ ID NO: 138766 - DNA, 35 bp, Artificial Sequence
  Synthetic oligonucleotide
tgtggtcgagcgtctacatttttcgtccctgtccc

SEQ ID NO: 138767 - DNA, 35 bp, Artificial Sequence
  Synthetic oligonucleotide
tagcgcgacactctatgccatccggacccctgcgc

SEQ ID NO: 138768 - DNA, 35 bp, Artificial Sequence
  Synthetic oligonucleotide
acgtgtgctctgaccaccaatgccgcttacgcctc

SEQ ID NO: 138769 - DNA, 35 bp, Artificial Sequence
  Synthetic oligonucleotide
ttcgccaacaccttagacacatcctggcacacttc

SEQ ID NO: 138770 - DNA, 35 bp, Artificial Sequence
  Synthetic oligonucleotide
tgctccttccgcatccatgtcccaatatctgtttc

SEQ ID NO: 138771 - DNA, 35 bp, Artificial Sequence
  Synthetic oligonucleotide
tcaacgccccccctgtcatccctcctccgtgcgcg

SEQ ID NO: 138772 - DNA, 35 bp, Artificial Sequence
  Synthetic oligonucleotide
ttgcgccgtgtgtcgtcgttggtccgcctccctcg

SEQ ID NO: 138773 - DNA, 35 bp, Artificial Sequence
  Synthetic oligonucleotide
gccagggctttatctgtactttcctgcctacttcg

SEQ ID NO: 138774 - DNA, 35 bp, Artificial Sequence
  Synthetic oligonucleotide
acaccaacccgcccagcctcctaccgttactttcg

SEQ ID NO: 138775 - DNA, 35 bp, Artificial Sequence
  Synthetic oligonucleotide
tgtcccgcccgttccccctttgcctttctagcgtg

SEQ ID NO: 138776 - DNA, 35 bp, Artificial Sequence
  Synthetic oligonucleotide
tatagccccgctcgcactattgccgccttaccttg

SEQ ID NO: 138777 - DNA, 35 bp, Artificial Sequence
  Synthetic oligonucleotide
gcgccctgcacttatcgccctgcctgttttgtttg

SEQ ID NO: 138778 - DNA, 35 bp, Artificial Sequence
  Synthetic oligonucleotide
ttcgcctgcattgcccggtccgtctccgctccgct

SEQ ID NO: 138779 - DNA, 35 bp, Artificial Sequence
  Synthetic oligonucleotide
actcgccaagggtgggagtgactaagggtagggct

SEQ ID NO: 138780 - DNA, 35 bp, Artificial Sequence
  Synthetic oligonucleotide
tactgtggctcccttggtctcctgttgcactatct

SEQ ID NO: 138781 - DNA, 35 bp, Artificial Sequence
  Synthetic oligonucleotide
ttccgccccagcttgtccctccgtaaattatcctt

SEQ ID NO: 138782 - DNA, 36 bp, Artificial Sequence
  Synthetic oligonucleotide
tgtggtgacgatagggtaagggtggggctggtggaa

SEQ ID NO: 138783 - DNA, 36 bp, Artificial Sequence
  Synthetic oligonucleotide
ttggcccgctcccgtcgcgtttcccctgttcgtgaa

SEQ ID NO: 138784 - DNA, 34 bp, Artificial Sequence
  Synthetic oligonucleotide
ggaggtccctgccctatgatcggtcctttccaca

SEQ ID NO: 138785 - DNA, 35 bp, Artificial Sequence
  Synthetic oligonucleotide
atcaccctcactttaggattcctgagcactgcaca

SEQ ID NO: 138786 - DNA, 36 bp, Artificial Sequence
  Synthetic oligonucleotide
gccatgcctcccctcccggtcacatgccaacttaca

SEQ ID NO: 138787 - DNA, 35 bp, Artificial Sequence
  Synthetic oligonucleotide
ttgcaccaccatccgtcaataggactttacatcca

SEQ ID NO: 138788 - DNA, 36 bp, Artificial Sequence
  Synthetic oligonucleotide
aacctacgcctttcctgcctgttcagtcttccagca

SEQ ID NO: 138789 - DNA, 36 bp, Artificial Sequence
  Synthetic oligonucleotide
gaacggccaccccgctcccctgtccaaacgtacgca

SEQ ID NO: 138790 - DNA, 36 bp, Artificial Sequence
  Synthetic oligonucleotide
cccaatgcccccgcgttaacgccgaccatgccctca

SEQ ID NO: 138791 - DNA, 37 bp, Artificial Sequence
  Synthetic oligonucleotide
accctccgcagttctgcttttttacctctttcgcgga

SEQ ID NO: 138792 - DNA, 38 bp, Artificial Sequence
  Synthetic oligonucleotide
gagtgggcgattagacagggtgatgggagggtgggtga

SEQ ID NO: 138793 - DNA, 38 bp, Artificial Sequence
  Synthetic oligonucleotide
gttgctcattgccgtatcgaccccatcacttcccttga

SEQ ID NO: 138794 - DNA, 38 bp, Artificial Sequence
  Synthetic oligonucleotide
gtcctccccacccgctgcatgattcagccacgccttga

SEQ ID NO: 138795 - DNA, 36 bp, Artificial Sequence
  Synthetic oligonucleotide
gcccatcacagtatttacctctcgacgaccctccta

SEQ ID NO: 138796 - DNA, 36 bp, Artificial Sequence
  Synthetic oligonucleotide
tcgagacacctccgctatctgggaagggccctccta

SEQ ID NO: 138797 - DNA, 36 bp, Artificial Sequence
  Synthetic oligonucleotide
accccatctcgcgttcctcaccgccccgacacagta

SEQ ID NO: 138798 - DNA, 35 bp, Artificial Sequence
  Synthetic oligonucleotide
aatcgccctcatgtttcacgctggtccttcctgta

SEQ ID NO: 138799 - DNA, 35 bp, Artificial Sequence
  Synthetic oligonucleotide
tgtacaccacctatcctgcatcatgcctggctacc

SEQ ID NO: 138800 - DNA, 35 bp, Artificial Sequence
  Synthetic oligonucleotide
gtccctggaccggccctttgtctctcacgtttacc

SEQ ID NO: 138801 - DNA, 35 bp, Artificial Sequence
  Synthetic oligonucleotide
accaaccgctgtgcatagtccgaaacttcgccccc

SEQ ID NO: 138802 - DNA, 35 bp, Artificial Sequence
  Synthetic oligonucleotide
ttcgctgcctccacttcgccgcctccccagctgcc

SEQ ID NO: 138803 - DNA, 36 bp, Artificial Sequence
  Synthetic oligonucleotide
tgaggaggattggggggggaaagatacggtgtacag

SEQ ID NO: 138804 - DNA, 35 bp, Artificial Sequence
  Synthetic oligonucleotide
gttgggccctccgaacgcatctgacctacatcttt

SEQ ID NO: 138805 - DNA, 36 bp, Artificial Sequence
  Synthetic oligonucleotide
tgtcccccacttgcctagtactcatacggtctccaa

SEQ ID NO: 138806 - DNA, 35 bp, Artificial Sequence
  Synthetic oligonucleotide
gcaaagccgggaatagcgggagggatcaatgggca

SEQ ID NO: 138807 - DNA, 37 bp, Artificial Sequence
  Synthetic oligonucleotide
agcatcgctacgggaagggggggggcgcactgaaaga

SEQ ID NO: 138808 - DNA, 37 bp, Artificial Sequence
  Synthetic oligonucleotide
aactggaggggccggatgagaagcggaagggggtcga

SEQ ID NO: 138809 - DNA, 37 bp, Artificial Sequence
  Synthetic oligonucleotide
gtggggtcagtacagggggtggggcctcagttcggga

SEQ ID NO: 138810 - DNA, 38 bp, Artificial Sequence
  Synthetic oligonucleotide
tacaccgcccacgccgctatttggcccctctgtcttga

SEQ ID NO: 138811 - DNA, 35 bp, Artificial Sequence
  Synthetic oligonucleotide
atctcccatccgctggtcgcccacatgcatgttga

SEQ ID NO: 138812 - DNA, 35 bp, Artificial Sequence
  Synthetic oligonucleotide
actctccgccttagcttgtgatctcccccacacta

SEQ ID NO: 138813 - DNA, 35 bp, Artificial Sequence
  Synthetic oligonucleotide
tccgcccagcttgccatctcgccgtgttttcgcta

SEQ ID NO: 138814 - DNA, 35 bp, Artificial Sequence
  Synthetic oligonucleotide
acccgtaccatccatgttagttcccataacccgac

SEQ ID NO: 138815 - DNA, 35 bp, Artificial Sequence
  Synthetic oligonucleotide
ttgcgccgccccctgctgcattcgatcttccttac

SEQ ID NO: 138816 - DNA, 34 bp, Artificial Sequence
  Synthetic oligonucleotide
tgatgctcaggtcgccatgcccggttgccccccc

SEQ ID NO: 138817 - DNA, 35 bp, Artificial Sequence
  Synthetic oligonucleotide
tccgaccatgcccgcatctatttggcaatcatctc

SEQ ID NO: 138818 - DNA, 35 bp, Artificial Sequence
  Synthetic oligonucleotide
ggagcgaagccgcctcacctattgaccacgatctc

SEQ ID NO: 138819 - DNA, 35 bp, Artificial Sequence
  Synthetic oligonucleotide
tactccgccaaaccacgtgtccttcctactctgtc

SEQ ID NO: 138820 - DNA, 35 bp, Artificial Sequence
  Synthetic oligonucleotide
tgacggtccgctgctaggtacttctccttcgtgtc

SEQ ID NO: 138821 - DNA, 35 bp, Artificial Sequence
  Synthetic oligonucleotide
tacgcccccggctaagtctgtctggtcgccggttc

SEQ ID NO: 138822 - DNA, 35 bp, Artificial Sequence
  Synthetic oligonucleotide
actatcaccttctgctgtcagtaccagctcctttc

SEQ ID NO: 138823 - DNA, 35 bp, Artificial Sequence
  Synthetic oligonucleotide
gcaaacgcggggaaggaacgggaggaggggaagag

SEQ ID NO: 138824 - DNA, 35 bp, Artificial Sequence
  Synthetic oligonucleotide
gttaacccgctctttgttcatttgattacctttag

SEQ ID NO: 138825 - DNA, 35 bp, Artificial Sequence
  Synthetic oligonucleotide
ttgccgacccggtccctgcgcctcgccgtctcccg

SEQ ID NO: 138826 - DNA, 35 bp, Artificial Sequence
  Synthetic oligonucleotide
gtccaccggcccttccctggttctgcaagcctttg

SEQ ID NO: 138827 - DNA, 35 bp, Artificial Sequence
  Synthetic oligonucleotide
gctgccacatgtctcgtgctcagcccccttcccat

SEQ ID NO: 138828 - DNA, 35 bp, Artificial Sequence
  Synthetic oligonucleotide
tgtgcactgggggggaaagggatgggtccgtttat

SEQ ID NO: 138829 - DNA, 35 bp, Artificial Sequence
  Synthetic oligonucleotide
tcgcccagggtcacgcgatcttttcttgctccact

SEQ ID NO: 138830 - DNA, 34 bp, Artificial Sequence
  Synthetic oligonucleotide
ttgcaacctgacttcctcatgctctatcatgcct

SEQ ID NO: 138831 - DNA, 35 bp, Artificial Sequence
  Synthetic oligonucleotide
tcacgaacgcatgctaccccgtcgccacttacgct

SEQ ID NO: 138832 - DNA, 36 bp, Artificial Sequence
  Synthetic oligonucleotide
tagtgcaggaaagggcatgggctagtgggggcaaaa

SEQ ID NO: 138833 - DNA, 35 bp, Artificial Sequence
  Synthetic oligonucleotide
tccagccactatcacattgccactgccccttcgaa

SEQ ID NO: 138834 - DNA, 36 bp, Artificial Sequence
  Synthetic oligonucleotide
tgcatcgcacgatcctgcccgcctcttcaacgtgaa

SEQ ID NO: 138835 - DNA, 36 bp, Artificial Sequence
  Synthetic oligonucleotide
ttgatccgcttgccggtctgctccacttccctacca

SEQ ID NO: 138836 - DNA, 35 bp, Artificial Sequence
  Synthetic oligonucleotide
ttcgcacgcaactcagtaccactcctgacctccca

SEQ ID NO: 138837 - DNA, 35 bp, Artificial Sequence
  Synthetic oligonucleotide
tcagggtgtccccttgtaacgcttcccgctcttca

SEQ ID NO: 138838 - DNA, 37 bp, Artificial Sequence
  Synthetic oligonucleotide
aatggaaaatgaagtggtggaagggggcggtacaaga

SEQ ID NO: 138839 - DNA, 37 bp, Artificial Sequence
  Synthetic oligonucleotide
ttcgtgcaacctcgcccgtgctgttacgcctttccga

SEQ ID NO: 138840 - DNA, 36 bp, Artificial Sequence
  Synthetic oligonucleotide
tccatctccgtccacatgcttcgaatccaccttgga

SEQ ID NO: 138841 - DNA, 37 bp, Artificial Sequence
  Synthetic oligonucleotide
tattgcccccctgccggttatacagacttttcactga

SEQ ID NO: 138842 - DNA, 37 bp, Artificial Sequence
  Synthetic oligonucleotide
agtccgccccatcgtcctaacgcaccctctcgattga

SEQ ID NO: 138843 - DNA, 38 bp, Artificial Sequence
  Synthetic oligonucleotide
tgtcccccctgtaggcatacccctgtcctctcgtttga

SEQ ID NO: 138844 - DNA, 35 bp, Artificial Sequence
  Synthetic oligonucleotide
gccgccctcgcctgcttctatctcagcgatacata

SEQ ID NO: 138845 - DNA, 35 bp, Artificial Sequence
  Synthetic oligonucleotide
ggacaaccgttcatcatcccgccacattgacccac

SEQ ID NO: 138846 - DNA, 35 bp, Artificial Sequence
  Synthetic oligonucleotide
tcagttccgccccacatcatatactgtctacaacc

SEQ ID NO: 138847 - DNA, 35 bp, Artificial Sequence
  Synthetic oligonucleotide
acccccgttcgccgaaccagggaaactgtaccacc

SEQ ID NO: 138848 - DNA, 35 bp, Artificial Sequence
  Synthetic oligonucleotide
tcaccactcccgatgtcctctcgaacctgcccccc

SEQ ID NO: 138849 - DNA, 35 bp, Artificial Sequence
  Synthetic oligonucleotide
aataccgcactgtgtcaatccagcccgccaatgcc

SEQ ID NO: 138850 - DNA, 35 bp, Artificial Sequence
  Synthetic oligonucleotide
cccgacggccggtttttcttggtcgcctactttcc

SEQ ID NO: 138851 - DNA, 35 bp, Artificial Sequence
  Synthetic oligonucleotide
ttcgtgccctccgaccttaatccccttgtagccgc

SEQ ID NO: 138852 - DNA, 35 bp, Artificial Sequence
  Synthetic oligonucleotide
gttcgaccatctctccgtccttggccattttgcgc

SEQ ID NO: 138853 - DNA, 35 bp, Artificial Sequence
  Synthetic oligonucleotide
acctctgccccacctacgttttcgggatctctcgc

SEQ ID NO: 138854 - DNA, 35 bp, Artificial Sequence
  Synthetic oligonucleotide
gaggatagggggtgggggggaggctggcactaggc

SEQ ID NO: 138855 - DNA, 35 bp, Artificial Sequence
  Synthetic oligonucleotide
gtcacgcgttacttgtcccttttaatcgttctatc

SEQ ID NO: 138856 - DNA, 35 bp, Artificial Sequence
  Synthetic oligonucleotide
atgatcgcgtcgtcatcccccacaatacccccgtc

SEQ ID NO: 138857 - DNA, 35 bp, Artificial Sequence
  Synthetic oligonucleotide
ttcagggagctgtaccggccgtttcttcgtacttc

SEQ ID NO: 138858 - DNA, 35 bp, Artificial Sequence
  Synthetic oligonucleotide
gccgagggccacttgtaacatcctattctttcacg

SEQ ID NO: 138859 - DNA, 35 bp, Artificial Sequence
  Synthetic oligonucleotide
gtcaagtcctttgccgtcgcttctttccctgcccg

SEQ ID NO: 138860 - DNA, 35 bp, Artificial Sequence
  Synthetic oligonucleotide
aggggggtggtgtgcggtgggggcggtttcgggcg

SEQ ID NO: 138861 - DNA, 35 bp, Artificial Sequence
  Synthetic oligonucleotide
gaccagggacagcagggggggaggtggcaaaacgg

SEQ ID NO: 138862 - DNA, 35 bp, Artificial Sequence
  Synthetic oligonucleotide
tgagccggaggaagtggtggaggagagtgaaaggg

SEQ ID NO: 138863 - DNA, 35 bp, Artificial Sequence
  Synthetic oligonucleotide
gaacggggcgggagtatcggttatggtgggacggg

SEQ ID NO: 138864 - DNA, 35 bp, Artificial Sequence
  Synthetic oligonucleotide
gcctcccgcctgcccccgacacgaacaaacatctg

SEQ ID NO: 138865 - DNA, 35 bp, Artificial Sequence
  Synthetic oligonucleotide
gacgcaggcacgatccttgggccgccctttatcct

SEQ ID NO: 138866 - DNA, 35 bp, Artificial Sequence
  Synthetic oligonucleotide
tcgcgaggcgtgggagggaggggaagtttgggtgt

SEQ ID NO: 138867 - DNA, 36 bp, Artificial Sequence
  Synthetic oligonucleotide
ttcggaaatccgcccccattgcgctacctagatcca

SEQ ID NO: 138868 - DNA, 36 bp, Artificial Sequence
  Synthetic oligonucleotide
gtcacctggcgctatttcccgacccttcgtcccgca

SEQ ID NO: 138869 - DNA, 35 bp, Artificial Sequence
  Synthetic oligonucleotide
ttctagcccccctacatcccgccattgcctccgca

SEQ ID NO: 138870 - DNA, 37 bp, Artificial Sequence
  Synthetic oligonucleotide
tgtgttcccgccattccctgctacgccctgctaccga

SEQ ID NO: 138871 - DNA, 37 bp, Artificial Sequence
  Synthetic oligonucleotide
agaccccgaccaccgaccctccgatcatttcatccga

SEQ ID NO: 138872 - DNA, 36 bp, Artificial Sequence
  Synthetic oligonucleotide
tctctctcgccctctcttgtgcaacgtacccctcga

SEQ ID NO: 138873 - DNA, 37 bp, Artificial Sequence
  Synthetic oligonucleotide
gggtgcatggagggtggggcaacagggaggataagga

SEQ ID NO: 138874 - DNA, 37 bp, Artificial Sequence
  Synthetic oligonucleotide
tagacgtccgggagtgggcggggacgggaccaacgga

SEQ ID NO: 138875 - DNA, 37 bp, Artificial Sequence
  Synthetic oligonucleotide
aggagggggaacaagggaggccggtggcgggagggga

SEQ ID NO: 138876 - DNA, 37 bp, Artificial Sequence
  Synthetic oligonucleotide
tagtcggtgggggcgggaggggtgaaggtgatgggga

SEQ ID NO: 138877 - DNA, 37 bp, Artificial Sequence
  Synthetic oligonucleotide
gaggaaggaggcgggctagggatagaaggggttggga

SEQ ID NO: 138878 - DNA, 37 bp, Artificial Sequence
  Synthetic oligonucleotide
agaccaccacctctgcttatctcacgccgatcactga

SEQ ID NO: 138879 - DNA, 38 bp, Artificial Sequence
  Synthetic oligonucleotide
gactgtgccgtgtgtaccatcaccctctactcctttga

SEQ ID NO: 138880 - DNA, 36 bp, Artificial Sequence
  Synthetic oligonucleotide
gtgcaaacggggacggggggaaacgggacaacggta

SEQ ID NO: 138881 - DNA, 35 bp, Artificial Sequence
  Synthetic oligonucleotide
gaccaaccctcactgcctgccgtatacaactggta

SEQ ID NO: 138882 - DNA, 37 bp, Artificial Sequence
  Synthetic oligonucleotide
gccgtcatcacggtatcctcgttctgccctctcctta

SEQ ID NO: 138883 - DNA, 36 bp, Artificial Sequence
  Synthetic oligonucleotide
taggggccaggggggagacggtcgggaggggattta

SEQ ID NO: 138884 - DNA, 35 bp, Artificial Sequence
  Synthetic oligonucleotide
gacaagccccagctcttctgttcacgttcaataac

SEQ ID NO: 138885 - DNA, 35 bp, Artificial Sequence
  Synthetic oligonucleotide
acgcgctctacctgttccgccctttgactcccgac

SEQ ID NO: 138886 - DNA, 35 bp, Artificial Sequence
  Synthetic oligonucleotide
gcctaacgtccggtccaagccttcctcgttttacc

SEQ ID NO: 138887 - DNA, 35 bp, Artificial Sequence
  Synthetic oligonucleotide
gccctgtctcaaggttgctcatatcgaccctcccc

SEQ ID NO: 138888 - DNA, 35 bp, Artificial Sequence
  Synthetic oligonucleotide
tcgcaactcaacagtgcacattacttccatctccc

SEQ ID NO: 138889 - DNA, 35 bp, Artificial Sequence
  Synthetic oligonucleotide
gtggacgcagctcctcgccactataccgttgtccc

SEQ ID NO: 138890 - DNA, 35 bp, Artificial Sequence
  Synthetic oligonucleotide
tctgttccatctgatctggccatatatatccgtcc

SEQ ID NO: 138891 - DNA, 35 bp, Artificial Sequence
  Synthetic oligonucleotide
gcatcccccgtcccccagcgtttgcatcgtggtcc

SEQ ID NO: 138892 - DNA, 35 bp, Artificial Sequence
  Synthetic oligonucleotide
tcaccgcagtcaccgccaatgtatctcactcttcc

SEQ ID NO: 138893 - DNA, 35 bp, Artificial Sequence
  Synthetic oligonucleotide
tcactccgcgcgccccacatcatgtctcccaaagc

SEQ ID NO: 138894 - DNA, 35 bp, Artificial Sequence
  Synthetic oligonucleotide
aaccaaagattaccaacgctcgtccccctgcccgc

SEQ ID NO: 138895 - DNA, 35 bp, Artificial Sequence
  Synthetic oligonucleotide
tctcgccggttgcacccttgaatggacccccctgc

SEQ ID NO: 138896 - DNA, 35 bp, Artificial Sequence
  Synthetic oligonucleotide
tccgcccttttcgtcgaccatcgcctgctatttgc

SEQ ID NO: 138897 - DNA, 35 bp, Artificial Sequence
  Synthetic oligonucleotide
acagggaagaagagggtggagtcggagtacatgag

SEQ ID NO: 138898 - DNA, 35 bp, Artificial Sequence
  Synthetic oligonucleotide
gctccccccgtaactcccgctagccctcagacccg

SEQ ID NO: 138899 - DNA, 35 bp, Artificial Sequence
  Synthetic oligonucleotide
gtgaggcatacatctttgtctattgttactccccg

SEQ ID NO: 138900 - DNA, 35 bp, Artificial Sequence
  Synthetic oligonucleotide
tcgaccctttcctcttgtgtgcgcttttttttccg

SEQ ID NO: 138901 - DNA, 35 bp, Artificial Sequence
  Synthetic oligonucleotide
accctaccccggccccgcccacggtcgtaccatcg

SEQ ID NO: 138902 - DNA, 35 bp, Artificial Sequence
  Synthetic oligonucleotide
gccgatcagccctcccctgtcctgtttcttgaatg

SEQ ID NO: 138903 - DNA, 35 bp, Artificial Sequence
  Synthetic oligonucleotide
gcctatctccaccacgtatgttagccgcctttcct

SEQ ID NO: 138904 - DNA, 35 bp, Artificial Sequence
  Synthetic oligonucleotide
acagtccgctcgtgattttgccctcgttctcatct

SEQ ID NO: 138905 - DNA, 35 bp, Artificial Sequence
  Synthetic oligonucleotide
accgcctgtgtagttctttcgcctgtctccctggt

SEQ ID NO: 138906 - DNA, 35 bp, Artificial Sequence
  Synthetic oligonucleotide
ttccgaccctgacctctcgcacttgctccaagcaa

SEQ ID NO: 138907 - DNA, 36 bp, Artificial Sequence
  Synthetic oligonucleotide
attcagggccgagggagggaagggcttcgacaggaa

SEQ ID NO: 138908 - DNA, 36 bp, Artificial Sequence
  Synthetic oligonucleotide
acaccttgtcccgcctggtaagctatctctgttcca

SEQ ID NO: 138909 - DNA, 37 bp, Artificial Sequence
  Synthetic oligonucleotide
tatcacccatctatggcataactccatctcttaccga

SEQ ID NO: 138910 - DNA, 37 bp, Artificial Sequence
  Synthetic oligonucleotide
ttaagccccgctactcccgcctgtactatcgcttcga

SEQ ID NO: 138911 - DNA, 37 bp, Artificial Sequence
  Synthetic oligonucleotide
ggggtcagaaagctgggtgtaggggggacattgagga

SEQ ID NO: 138912 - DNA, 37 bp, Artificial Sequence
  Synthetic oligonucleotide
actccgggggcaattctgggggagggaaccaggggga

SEQ ID NO: 138913 - DNA, 37 bp, Artificial Sequence
  Synthetic oligonucleotide
catgtggagaaaacggggctaaaggggggcggtggga

SEQ ID NO: 138914 - DNA, 36 bp, Artificial Sequence
  Synthetic oligonucleotide
tcctgcgcctcgacctctccgacacccgcaatctga

SEQ ID NO: 138915 - DNA, 38 bp, Artificial Sequence
  Synthetic oligonucleotide
acatcctgcccgtatcttgccgcacccgttttccgtga

SEQ ID NO: 138916 - DNA, 38 bp, Artificial Sequence
  Synthetic oligonucleotide
tctcacagtcagcacattgccccgacacccttcgttga

SEQ ID NO: 138917 - DNA, 35 bp, Artificial Sequence
  Synthetic oligonucleotide
gacgtctcccctctgttcgcattgcttacgcttta

SEQ ID NO: 138918 - DNA, 35 bp, Artificial Sequence
  Synthetic oligonucleotide
tagctcacaggtccgtcttagcaccttccttgaac

SEQ ID NO: 138919 - DNA, 35 bp, Artificial Sequence
  Synthetic oligonucleotide
ggacgccccctcgtcgtattctttggcctcacgac

SEQ ID NO: 138920 - DNA, 35 bp, Artificial Sequence
  Synthetic oligonucleotide
atgcgccacgtttagagctcccccttgccgttccc

SEQ ID NO: 138921 - DNA, 35 bp, Artificial Sequence
  Synthetic oligonucleotide
accccgatcgcccatgctccccgttacgcatggcc

SEQ ID NO: 138922 - DNA, 35 bp, Artificial Sequence
  Synthetic oligonucleotide
aatacccctctgtcctgctatggacagtttgttcc

SEQ ID NO: 138923 - DNA, 35 bp, Artificial Sequence
  Synthetic oligonucleotide
tcccaaccctctccctctgagccgagctaccacgc

SEQ ID NO: 138924 - DNA, 35 bp, Artificial Sequence
  Synthetic oligonucleotide
tgacagagacggttagtcgcactttccctttccgc

SEQ ID NO: 138925 - DNA, 34 bp, Artificial Sequence
  Synthetic oligonucleotide
gcctccgactcgcgcgcttattaaccccctcgtc

SEQ ID NO: 138926 - DNA, 35 bp, Artificial Sequence
  Synthetic oligonucleotide
tatccaccaacatgcgctgctaatggccctggttc

SEQ ID NO: 138927 - DNA, 35 bp, Artificial Sequence
  Synthetic oligonucleotide
gtgtcgcggggtgtgtaagctacgggggggaaggg

SEQ ID NO: 138928 - DNA, 35 bp, Artificial Sequence
  Synthetic oligonucleotide
gatgggagtgtgggagggcgggtaccctgtggtgg

SEQ ID NO: 138929 - DNA, 36 bp, Artificial Sequence
  Synthetic oligonucleotide
actgctacaaccggtctgtcttgccgtactcccctg

SEQ ID NO: 138930 - DNA, 35 bp, Artificial Sequence
  Synthetic oligonucleotide
acgcggtgcctgtaagcctattcctgaaccctctg

SEQ ID NO: 138931 - DNA, 35 bp, Artificial Sequence
  Synthetic oligonucleotide
gatggcccggacaccgcctgctgcacccctatcat

SEQ ID NO: 138932 - DNA, 35 bp, Artificial Sequence
  Synthetic oligonucleotide
tccacctccaaccgcgttcatcgacccttttctat

SEQ ID NO: 138933 - DNA, 35 bp, Artificial Sequence
  Synthetic oligonucleotide
aatcccgccacgccatctcgatctgtcgatcttct

SEQ ID NO: 138934 - DNA, 35 bp, Artificial Sequence
  Synthetic oligonucleotide
ggtgccgtactcgctcgctccctttcgacttcatt

SEQ ID NO: 138935 - DNA, 36 bp, Artificial Sequence
  Synthetic oligonucleotide
gtttgcaccgctgcccacaactctcctttctgtgca

SEQ ID NO: 138936 - DNA, 36 bp, Artificial Sequence
  Synthetic oligonucleotide
acccgtggctcgactcgtagttttgccctctctcga

SEQ ID NO: 138937 - DNA, 35 bp, Artificial Sequence
  Synthetic oligonucleotide
gattaggggcgagggtagggggaagcacgacagga

SEQ ID NO: 138938 - DNA, 37 bp, Artificial Sequence
  Synthetic oligonucleotide
acaccctccgccatttccggctgaactgcccatagga

SEQ ID NO: 138939 - DNA, 35 bp, Artificial Sequence
  Synthetic oligonucleotide
ggaaaggtcgggtacgggctagggtgggcgaggga

SEQ ID NO: 138940 - DNA, 38 bp, Artificial Sequence
  Synthetic oligonucleotide
gccatccatctttatctagtgcctcccctgtttactga

SEQ ID NO: 138941 - DNA, 36 bp, Artificial Sequence
  Synthetic oligonucleotide
agctccacccccccgccgtcgtccttcaggcgctga

SEQ ID NO: 138942 - DNA, 38 bp, Artificial Sequence
  Synthetic oligonucleotide
gtcctcacccgcctttgtttgtctcgcctcttgagtga

SEQ ID NO: 138943 - DNA, 38 bp, Artificial Sequence
  Synthetic oligonucleotide
gaacggggggtggggctcgggacaagtatagggggtga

SEQ ID NO: 138944 - DNA, 36 bp, Artificial Sequence
  Synthetic oligonucleotide
ttgcgccgattgtagcatttcgccccccgctcacta

SEQ ID NO: 138945 - DNA, 35 bp, Artificial Sequence
  Synthetic oligonucleotide
gtgtgcatcgattgccccactggcctcaccgctac

SEQ ID NO: 138946 - DNA, 36 bp, Artificial Sequence
  Synthetic oligonucleotide
acctgaaccacgctccacccctgttgctattccacc

SEQ ID NO: 138947 - DNA, 35 bp, Artificial Sequence
  Synthetic oligonucleotide
gacccgggtcaccatcccgcttccacatagttccc

SEQ ID NO: 138948 - DNA, 35 bp, Artificial Sequence
  Synthetic oligonucleotide
gatgaaccgcgggttccgtatttatctcctatgcc

SEQ ID NO: 138949 - DNA, 35 bp, Artificial Sequence
  Synthetic oligonucleotide
gttgccctctgttccagccgaccttagatctgtcc

SEQ ID NO: 138950 - DNA, 35 bp, Artificial Sequence
  Synthetic oligonucleotide
ttaggcacccgcccccttgcgtcactggcccttcc

SEQ ID NO: 138951 - DNA, 35 bp, Artificial Sequence
  Synthetic oligonucleotide
gcttccgcctccctctgccccgcatctactctagc

SEQ ID NO: 138952 - DNA, 35 bp, Artificial Sequence
  Synthetic oligonucleotide
aactcctctgccttctggaacaccaccgcatacgc

SEQ ID NO: 138953 - DNA, 35 bp, Artificial Sequence
  Synthetic oligonucleotide
accccctctgtcatcttctactgccgcgttgccgc

SEQ ID NO: 138954 - DNA, 35 bp, Artificial Sequence
  Synthetic oligonucleotide
tgccccatggctttccgatcctctgtctctcgcgc

SEQ ID NO: 138955 - DNA, 35 bp, Artificial Sequence
  Synthetic oligonucleotide
gtcccgccattctggtcttgaaccctcttgttcgc

SEQ ID NO: 138956 - DNA, 35 bp, Artificial Sequence
  Synthetic oligonucleotide
gtcgcctcagtacgtttcactctccatctgccggc

SEQ ID NO: 138957 - DNA, 35 bp, Artificial Sequence
  Synthetic oligonucleotide
tcgatcggccgtaccgtttgctgaaccgttgcctc

SEQ ID NO: 138958 - DNA, 35 bp, Artificial Sequence
  Synthetic oligonucleotide
acacctccccgaattgcccgagcttggtctccttc

SEQ ID NO: 138959 - DNA, 35 bp, Artificial Sequence
  Synthetic oligonucleotide
gatggaaggatagagagggggtggacaagtattag

SEQ ID NO: 138960 - DNA, 35 bp, Artificial Sequence
  Synthetic oligonucleotide
gtccactcctttgtcttccgcgccgcctcgccccg

SEQ ID NO: 138961 - DNA, 35 bp, Artificial Sequence
  Synthetic oligonucleotide
atgcggagaacggaaggggaacgggaaatttagcg

SEQ ID NO: 138962 - DNA, 35 bp, Artificial Sequence
  Synthetic oligonucleotide
gtacagtagagggggggaggggcagaggccatggg

SEQ ID NO: 138963 - DNA, 35 bp, Artificial Sequence
  Synthetic oligonucleotide
gggtaaggaaacggaggaggaggggcgtgacactg

SEQ ID NO: 138964 - DNA, 35 bp, Artificial Sequence
  Synthetic oligonucleotide
ggacatcaacatgcatgtcatacttttagccctct

SEQ ID NO: 138965 - DNA, 35 bp, Artificial Sequence
  Synthetic oligonucleotide
tactcccccgctcagcccataacacgtgttatctt

SEQ ID NO: 138966 - DNA, 35 bp, Artificial Sequence
  Synthetic oligonucleotide
gaccatctcccttaatgtagtttttgtacctcgtt

SEQ ID NO: 138967 - DNA, 35 bp, Artificial Sequence
  Synthetic oligonucleotide
atactccaccgtgctgcccacatcttttccgtttt

SEQ ID NO: 138968 - DNA, 35 bp, Artificial Sequence
  Synthetic oligonucleotide
aacccctccgcctgtcccgtactctacgttcctaa

SEQ ID NO: 138969 - DNA, 35 bp, Artificial Sequence
  Synthetic oligonucleotide
acctccacatcgggggacataacctcgccattaca

SEQ ID NO: 138970 - DNA, 36 bp, Artificial Sequence
  Synthetic oligonucleotide
tccctccgcatttgacaaacatatcagtcccgccca

SEQ ID NO: 138971 - DNA, 36 bp, Artificial Sequence
  Synthetic oligonucleotide
tcaccgtcgcctcctcatcccgtactgctttggcca

SEQ ID NO: 138972 - DNA, 35 bp, Artificial Sequence
  Synthetic oligonucleotide
tttcacgcccctacatcccgaccctgaccttgcca

SEQ ID NO: 138973 - DNA, 36 bp, Artificial Sequence
  Synthetic oligonucleotide
gcgaacttcccttcctcagcgcacatcacttccgca

SEQ ID NO: 138974 - DNA, 36 bp, Artificial Sequence
  Synthetic oligonucleotide
actgaggcctcactattgcaactcgctggtccctca

SEQ ID NO: 138975 - DNA, 37 bp, Artificial Sequence
  Synthetic oligonucleotide
tacatgtgtgggagggtgtggggtaggggatggcaga

SEQ ID NO: 138976 - DNA, 36 bp, Artificial Sequence
  Synthetic oligonucleotide
gaggtgggggacggaacgagggggcttgtacataga

SEQ ID NO: 138977 - DNA, 35 bp, Artificial Sequence
  Synthetic oligonucleotide
gacgcactgattccgccttacctgctcctgaccga

SEQ ID NO: 138978 - DNA, 37 bp, Artificial Sequence
  Synthetic oligonucleotide
gggtggggtcttcgtacgggggtgtaaaaactgggga

SEQ ID NO: 138979 - DNA, 37 bp, Artificial Sequence
  Synthetic oligonucleotide
gggggcaaagcatgcggaggggagttggaggtgggga

SEQ ID NO: 138980 - DNA, 37 bp, Artificial Sequence
  Synthetic oligonucleotide
tcatacgtgaggacgatgggagggagggaatgtggga

SEQ ID NO: 138981 - DNA, 37 bp, Artificial Sequence
  Synthetic oligonucleotide
tttcgactcccgcccttcctgtccgcgatttccgtga

SEQ ID NO: 138982 - DNA, 38 bp, Artificial Sequence
  Synthetic oligonucleotide
aacgaccccgccacacctgtttctcatattctttgtga

SEQ ID NO: 138983 - DNA, 36 bp, Artificial Sequence
  Synthetic oligonucleotide
atccctccgcttacctcgctgggactttgtacccta

SEQ ID NO: 138984 - DNA, 36 bp, Artificial Sequence
  Synthetic oligonucleotide
tctaccctcatcgctcaaggtcctgtccgtcgccta

SEQ ID NO: 138985 - DNA, 35 bp, Artificial Sequence
  Synthetic oligonucleotide
gttgcatcccccttgggagttccccgtcctacccc

SEQ ID NO: 138986 - DNA, 35 bp, Artificial Sequence
  Synthetic oligonucleotide
tgctgccgtacccatcgctttgatagttaccgccc

SEQ ID NO: 138987 - DNA, 35 bp, Artificial Sequence
  Synthetic oligonucleotide
aacgacctctctctggccccacgttggtctatgcc

SEQ ID NO: 138988 - DNA, 35 bp, Artificial Sequence
  Synthetic oligonucleotide
acacgcagcaatactgtctgggtccctcgccctcc

SEQ ID NO: 138989 - DNA, 35 bp, Artificial Sequence
  Synthetic oligonucleotide
gacatagcggctgcggtaagccccatagcccttcc

SEQ ID NO: 138990 - DNA, 35 bp, Artificial Sequence
  Synthetic oligonucleotide
agcaccggagatcctacccgctcattccgccccgc

SEQ ID NO: 138991 - DNA, 35 bp, Artificial Sequence
  Synthetic oligonucleotide
gaatgcccctcctgccgtcgataacaacgtcactc

SEQ ID NO: 138992 - DNA, 35 bp, Artificial Sequence
  Synthetic oligonucleotide
gcgctccgccatttccatccccgtttggcccattc

SEQ ID NO: 138993 - DNA, 35 bp, Artificial Sequence
  Synthetic oligonucleotide
ttgtgacaccccccgtcgaccattcatccttcacg

SEQ ID NO: 138994 - DNA, 35 bp, Artificial Sequence
  Synthetic oligonucleotide
tacacggcccgttctctagccactccgttgacccg

SEQ ID NO: 138995 - DNA, 34 bp, Artificial Sequence
  Synthetic oligonucleotide
tgttgccgcacgtgcctcccgttctatttgcttg

SEQ ID NO: 138996 - DNA, 35 bp, Artificial Sequence
  Synthetic oligonucleotide
gtaccgccgtggttctttgtttgttgcctcgctct

SEQ ID NO: 138997 - DNA, 35 bp, Artificial Sequence
  Synthetic oligonucleotide
gaaggaggaggaggggggggtggctcaatcacagt

SEQ ID NO: 138998 - DNA, 29 bp, Artificial Sequence
  Synthetic oligonucleotide
tagtcgttgacccccccccgtcctgcctt

SEQ ID NO: 138999 - DNA, 36 bp, Artificial Sequence
  Synthetic oligonucleotide
acgggcccccccacattcgatatcttggaccctcaa

SEQ ID NO: 139000 - DNA, 35 bp, Artificial Sequence
  Synthetic oligonucleotide
aaggggggggtgtcgcagaaaggatagggagggaa

SEQ ID NO: 139001 - DNA, 35 bp, Artificial Sequence
  Synthetic oligonucleotide
gcctgttccgtgtcttccgctgtctgctccgtaca

SEQ ID NO: 139002 - DNA, 36 bp, Artificial Sequence
  Synthetic oligonucleotide
tatgcctcacaggtttccatgattctgctcctcgca

SEQ ID NO: 139003 - DNA, 36 bp, Artificial Sequence
  Synthetic oligonucleotide
tgggtcacctatccgttttggtcctgttttccctca

SEQ ID NO: 139004 - DNA, 37 bp, Artificial Sequence
  Synthetic oligonucleotide
aggggtcatgggggtgtcgacttggtagtggagggga

SEQ ID NO: 139005 - DNA, 37 bp, Artificial Sequence
  Synthetic oligonucleotide
ggggtgggttgttagggggatgagtaaaatgggggga

SEQ ID NO: 139006 - DNA, 37 bp, Artificial Sequence
  Synthetic oligonucleotide
gttgcaaccgtcgaatccgctgcacctcccactctga

SEQ ID NO: 139007 - DNA, 38 bp, Artificial Sequence
  Synthetic oligonucleotide
atccccgtggcgcccatctgtttctactccactcttga

SEQ ID NO: 139008 - DNA, 36 bp, Artificial Sequence
  Synthetic oligonucleotide
taccaccgtcgcccctccagccccagttcacccgta

SEQ ID NO: 139009 - DNA, 35 bp, Artificial Sequence
  Synthetic oligonucleotide
gcaagggaagaaaggggtggacgattggaggtgta

SEQ ID NO: 139010 - DNA, 36 bp, Artificial Sequence
  Synthetic oligonucleotide
gccccaccccctattagtccatagactccccttgta

SEQ ID NO: 139011 - DNA, 35 bp, Artificial Sequence
  Synthetic oligonucleotide
acccatctccgtgttctcgttcctggccaaaatta

SEQ ID NO: 139012 - DNA, 35 bp, Artificial Sequence
  Synthetic oligonucleotide
agctccggcccttcgtttcacagaccttttctacc

SEQ ID NO: 139013 - DNA, 35 bp, Artificial Sequence
  Synthetic oligonucleotide
atgcactcccgcttctccatacagaaacccgcccc

SEQ ID NO: 139014 - DNA, 35 bp, Artificial Sequence
  Synthetic oligonucleotide
tcgtcccagacacatcgtgtttcactgttacctcc

SEQ ID NO: 139015 - DNA, 35 bp, Artificial Sequence
  Synthetic oligonucleotide
tccaacaaacgtacacctgtgcaatttagtcctcc

SEQ ID NO: 139016 - DNA, 35 bp, Artificial Sequence
  Synthetic oligonucleotide
gacctgcctcaaatcattgacgcgccctccactgc

SEQ ID NO: 139017 - DNA, 35 bp, Artificial Sequence
  Synthetic oligonucleotide
accgcttgcgaccccggtaccctttcatcctgctc

SEQ ID NO: 139018 - DNA, 35 bp, Artificial Sequence
  Synthetic oligonucleotide
gcctatcacgttcgccgccaacaccccgtaaaccg

SEQ ID NO: 139019 - DNA, 35 bp, Artificial Sequence
  Synthetic oligonucleotide
tccccgcgctcacctcgaggtcaccacctactccg

SEQ ID NO: 139020 - DNA, 35 bp, Artificial Sequence
  Synthetic oligonucleotide
tctgaacaagggagggtgcgaggggaagactgtgg

SEQ ID NO: 139021 - DNA, 35 bp, Artificial Sequence
  Synthetic oligonucleotide
tgtgccatcccgatactttggtctttccttgcctg

SEQ ID NO: 139022 - DNA, 35 bp, Artificial Sequence
  Synthetic oligonucleotide
gcatagggtagacggggagccggaggagtggggtg

SEQ ID NO: 139023 - DNA, 35 bp, Artificial Sequence
  Synthetic oligonucleotide
tcagctagaccgcctggctcccctctctgctaact

SEQ ID NO: 139024 - DNA, 35 bp, Artificial Sequence
  Synthetic oligonucleotide
gctcccatccgatatgcacctgctcgaaccatgct

SEQ ID NO: 139025 - DNA, 35 bp, Artificial Sequence
  Synthetic oligonucleotide
tccaccctgcgacgcgctttttcgacgccgccctt

SEQ ID NO: 139026 - DNA, 36 bp, Artificial Sequence
  Synthetic oligonucleotide
tgaacgccccctgtgcgtacgaccgcccctttgaaa

SEQ ID NO: 139027 - DNA, 36 bp, Artificial Sequence
  Synthetic oligonucleotide
ggagagggaggtgcgtgcggaagtcggaggggcgaa

SEQ ID NO: 139028 - DNA, 36 bp, Artificial Sequence
  Synthetic oligonucleotide
tccagcctcctatatgtcagcgccccttccttgaca

SEQ ID NO: 139029 - DNA, 35 bp, Artificial Sequence
  Synthetic oligonucleotide
ttgacccgactgttgtccacgtaactgccgcccca

SEQ ID NO: 139030 - DNA, 35 bp, Artificial Sequence
  Synthetic oligonucleotide
acttccaccctccgcagcatgtcgcttccgcgcca

SEQ ID NO: 139031 - DNA, 35 bp, Artificial Sequence
  Synthetic oligonucleotide
tgtgacccactgtaatggaatgcccgcactctcca

SEQ ID NO: 139032 - DNA, 35 bp, Artificial Sequence
  Synthetic oligonucleotide
agactcgcgatagccgtttccttctcactgttgca

SEQ ID NO: 139033 - DNA, 37 bp, Artificial Sequence
  Synthetic oligonucleotide
tcaggagtgcccgcttcgtattattatccgccctcga

SEQ ID NO: 139034 - DNA, 36 bp, Artificial Sequence
  Synthetic oligonucleotide
tccaccacctcacttgttctccattggacgttagga

SEQ ID NO: 139035 - DNA, 37 bp, Artificial Sequence
  Synthetic oligonucleotide
gaggagaggccaaacatggtgcgggggcgggctggga

SEQ ID NO: 139036 - DNA, 36 bp, Artificial Sequence
  Synthetic oligonucleotide
atgcctcgaggaggacggaggggatggataggtgga

SEQ ID NO: 139037 - DNA, 38 bp, Artificial Sequence
  Synthetic oligonucleotide
ggagggcggagggaggggggtggatttggacggtatga

SEQ ID NO: 139038 - DNA, 38 bp, Artificial Sequence
  Synthetic oligonucleotide
atggtccagcccgttcttctgcttctctgtccacctga

SEQ ID NO: 139039 - DNA, 37 bp, Artificial Sequence
  Synthetic oligonucleotide
tcccgagccatcagctccactcaattgccccccttga

SEQ ID NO: 139040 - DNA, 37 bp, Artificial Sequence
  Synthetic oligonucleotide
tgccccgcacatctcgttctcaactccctctccttga

SEQ ID NO: 139041 - DNA, 37 bp, Artificial Sequence
  Synthetic oligonucleotide
gagccgccatccacctgctgaacacgtttactcttga

SEQ ID NO: 139042 - DNA, 35 bp, Artificial Sequence
  Synthetic oligonucleotide
ttggtcactcactgccttcattgccatcggtcacc

SEQ ID NO: 139043 - DNA, 35 bp, Artificial Sequence
  Synthetic oligonucleotide
tcagcaccccgtaacccggtttcaaacacaccccc

SEQ ID NO: 139044 - DNA, 35 bp, Artificial Sequence
  Synthetic oligonucleotide
gcaaggtaagttctggttcgcccgtgtctccgccc

SEQ ID NO: 139045 - DNA, 35 bp, Artificial Sequence
  Synthetic oligonucleotide
gttccgcacacttaacacctgcctcgctaaaagcc

SEQ ID NO: 139046 - DNA, 35 bp, Artificial Sequence
  Synthetic oligonucleotide
tagacgccgactatcgacgtgcctcctcgcctatc

SEQ ID NO: 139047 - DNA, 34 bp, Artificial Sequence
  Synthetic oligonucleotide
attcaacactgacccaccatcgcttaggacactc

SEQ ID NO: 139048 - DNA, 35 bp, Artificial Sequence
  Synthetic oligonucleotide
gaagggcgggcccatagtaagtgggtccccgagtc

SEQ ID NO: 139049 - DNA, 35 bp, Artificial Sequence
  Synthetic oligonucleotide
gctgccccgcctaccgaatgtctgccctgtcaccg

SEQ ID NO: 139050 - DNA, 35 bp, Artificial Sequence
  Synthetic oligonucleotide
tcgaaccagctcccacccgccagatccccccagcg

SEQ ID NO: 139051 - DNA, 35 bp, Artificial Sequence
  Synthetic oligonucleotide
attgcccactctgcataatttagcccaccggccct

SEQ ID NO: 139052 - DNA, 35 bp, Artificial Sequence
  Synthetic oligonucleotide
ttagtccatcccccgattccctagcactgggccct

SEQ ID NO: 139053 - DNA, 34 bp, Artificial Sequence
  Synthetic oligonucleotide
acgatccaccgctaaccagcgctttcatgagcct

SEQ ID NO: 139054 - DNA, 36 bp, Artificial Sequence
  Synthetic oligonucleotide
agtgaccgccacccctgccctaacatacccgtcaca

SEQ ID NO: 139055 - DNA, 35 bp, Artificial Sequence
  Synthetic oligonucleotide
acgcactgccacatcactcatcagtcaagttgcca

SEQ ID NO: 139056 - DNA, 36 bp, Artificial Sequence
  Synthetic oligonucleotide
tcccatacacgcgatctgcgccgactacccgctcca

SEQ ID NO: 139057 - DNA, 37 bp, Artificial Sequence
  Synthetic oligonucleotide
gccccttcccgctggtgactcatccgttttgtaccga

SEQ ID NO: 139058 - DNA, 37 bp, Artificial Sequence
  Synthetic oligonucleotide
attgtacggagggggggagtagaggaagggccgccga

SEQ ID NO: 139059 - DNA, 37 bp, Artificial Sequence
  Synthetic oligonucleotide
tccctccgagtgtacttgttccgttcttcctatccga

SEQ ID NO: 139060 - DNA, 37 bp, Artificial Sequence
  Synthetic oligonucleotide
acccaccttccttccactggcccctgcgccttggcga

SEQ ID NO: 139061 - DNA, 37 bp, Artificial Sequence
  Synthetic oligonucleotide
tgggaggggcctcggtatcttcttggggtcctgggga

SEQ ID NO: 139062 - DNA, 37 bp, Artificial Sequence
  Synthetic oligonucleotide
aagggcgggatgggatgggacgatgtactattgtgga

SEQ ID NO: 139063 - DNA, 37 bp, Artificial Sequence
  Synthetic oligonucleotide
agacacgcaatggagacatggggggggacgaggatga

SEQ ID NO: 139064 - DNA, 37 bp, Artificial Sequence
  Synthetic oligonucleotide
tgctcatcccggttcttggtcgtctctccgctcctga

SEQ ID NO: 139065 - DNA, 38 bp, Artificial Sequence
  Synthetic oligonucleotide
ggagaacgggacaggggggcgtagggggaaacaagtga

SEQ ID NO: 139066 - DNA, 38 bp, Artificial Sequence
  Synthetic oligonucleotide
gatgaaagtgggtgggctatgggagggccgcctggtga

SEQ ID NO: 139067 - DNA, 36 bp, Artificial Sequence
  Synthetic oligonucleotide
ggagcgagctcgcctccgtgcccttccgttccttga

SEQ ID NO: 139068 - DNA, 37 bp, Artificial Sequence
  Synthetic oligonucleotide
tcaccgcccgggcccgcctgctccaaacccactttga

SEQ ID NO: 139069 - DNA, 34 bp, Artificial Sequence
  Synthetic oligonucleotide
gggtgggggggggaaagggtatagcagggagtac

SEQ ID NO: 139070 - DNA, 35 bp, Artificial Sequence
  Synthetic oligonucleotide
atgttcacatcgcctgcacatccgagccctcaacc

SEQ ID NO: 139071 - DNA, 35 bp, Artificial Sequence
  Synthetic oligonucleotide
gtcatagcctatatgcctgtcgccttacccgcacc

SEQ ID NO: 139072 - DNA, 35 bp, Artificial Sequence
  Synthetic oligonucleotide
gtgcggtcgccgagcggagctgaatacatcctacc

SEQ ID NO: 139073 - DNA, 35 bp, Artificial Sequence
  Synthetic oligonucleotide
tccacccacgaacgatcgctccaagtcacgccccc

SEQ ID NO: 139074 - DNA, 35 bp, Artificial Sequence
  Synthetic oligonucleotide
acccgccctctcacccacattttacgacgtgcccc

SEQ ID NO: 139075 - DNA, 35 bp, Artificial Sequence
  Synthetic oligonucleotide
taacaatcgccacctctgtacgcatgtcaatcccc

SEQ ID NO: 139076 - DNA, 35 bp, Artificial Sequence
  Synthetic oligonucleotide
accggtacgtgcagatcctgaatttgtacctcccc

SEQ ID NO: 139077 - DNA, 35 bp, Artificial Sequence
  Synthetic oligonucleotide
ttccgtcccctgcccctacgcgttgatatggcgcc

SEQ ID NO: 139078 - DNA, 35 bp, Artificial Sequence
  Synthetic oligonucleotide
ttggtcaactctttcggtctctcgccatacgtgcc

SEQ ID NO: 139079 - DNA, 35 bp, Artificial Sequence
  Synthetic oligonucleotide
tcctcctgcacctgccgcccgccatactagggagc

SEQ ID NO: 139080 - DNA, 35 bp, Artificial Sequence
  Synthetic oligonucleotide
tccctccctccgaccattcgatacttagactgagc

SEQ ID NO: 139081 - DNA, 35 bp, Artificial Sequence
  Synthetic oligonucleotide
actaacaccaccttccctgccgtatacagacatgc

SEQ ID NO: 139082 - DNA, 35 bp, Artificial Sequence
  Synthetic oligonucleotide
tctctgccacacctcacccgcgttcgtctctagtc

SEQ ID NO: 139083 - DNA, 35 bp, Artificial Sequence
  Synthetic oligonucleotide
tctcaactcccttggtaaggcccctattctctccg

SEQ ID NO: 139084 - DNA, 35 bp, Artificial Sequence
  Synthetic oligonucleotide
aacgagggacgggagggagggtcaagaggggacgg

SEQ ID NO: 139085 - DNA, 35 bp, Artificial Sequence
  Synthetic oligonucleotide
tcagattcgtccgccattgatgccctgcccgtttg

SEQ ID NO: 139086 - DNA, 35 bp, Artificial Sequence
  Synthetic oligonucleotide
acccctcttcgcccgctatcgacattagccacgct

SEQ ID NO: 139087 - DNA, 35 bp, Artificial Sequence
  Synthetic oligonucleotide
gtgcgtagcccgttcgctataccttcagccccgct

SEQ ID NO: 139088 - DNA, 35 bp, Artificial Sequence
  Synthetic oligonucleotide
tgacaggttgggaggggagatatagggcgggcgct

SEQ ID NO: 139089 - DNA, 35 bp, Artificial Sequence
  Synthetic oligonucleotide
aatgcacccgtttcccagccaacccgtctatcgct

SEQ ID NO: 139090 - DNA, 35 bp, Artificial Sequence
  Synthetic oligonucleotide
acgcgcccgcgtgctgttagcacctccccaactct

SEQ ID NO: 139091 - DNA, 36 bp, Artificial Sequence
  Synthetic oligonucleotide
tgttcactgcggtgttactcttcatccgtgctactt

SEQ ID NO: 139092 - DNA, 35 bp, Artificial Sequence
  Synthetic oligonucleotide
ttccaccgttctatctgctgcaactcttgttccaa

SEQ ID NO: 139093 - DNA, 35 bp, Artificial Sequence
  Synthetic oligonucleotide
ggaaaggggagggcgggagtaggtgcagtctgcaa

SEQ ID NO: 139094 - DNA, 35 bp, Artificial Sequence
  Synthetic oligonucleotide
aagcacatccgacaccttctgattacattcgccca

SEQ ID NO: 139095 - DNA, 36 bp, Artificial Sequence
  Synthetic oligonucleotide
accaccccccagccggctacattgttccgctgatca

SEQ ID NO: 139096 - DNA, 37 bp, Artificial Sequence
  Synthetic oligonucleotide
tcgcgtgagaggaagaagcaagggagggggatggaga

SEQ ID NO: 139097 - DNA, 35 bp, Artificial Sequence
  Synthetic oligonucleotide
acccggacaccgcctctctttcatcctccagtgga

SEQ ID NO: 139098 - DNA, 37 bp, Artificial Sequence
  Synthetic oligonucleotide
gcagggggagcggggggggcggggggaccgctgtgga

SEQ ID NO: 139099 - DNA, 38 bp, Artificial Sequence
  Synthetic oligonucleotide
gtgttgcgcgaatctctgcctgttccttgccaccctga

SEQ ID NO: 139100 - DNA, 38 bp, Artificial Sequence
  Synthetic oligonucleotide
tcatccacttcgccccgtatttaaccgtccgcccctga

SEQ ID NO: 139101 - DNA, 38 bp, Artificial Sequence
  Synthetic oligonucleotide
gcaccgccgtgccatttggactgtaccttcttccctga

SEQ ID NO: 139102 - DNA, 37 bp, Artificial Sequence
  Synthetic oligonucleotide
gccacgcccgccttactgcttctcatagctctgctga

SEQ ID NO: 139103 - DNA, 37 bp, Artificial Sequence
  Synthetic oligonucleotide
gccccatctgaccgaatacgtccccctctcttcgtga

SEQ ID NO: 139104 - DNA, 36 bp, Artificial Sequence
  Synthetic oligonucleotide
ggatgccctgctctattgtacccgtttccccttcta

SEQ ID NO: 139105 - DNA, 35 bp, Artificial Sequence
  Synthetic oligonucleotide
agcacgacgtagcccacggtcctcatcctccgcac

SEQ ID NO: 139106 - DNA, 35 bp, Artificial Sequence
  Synthetic oligonucleotide
aggccatgctactggttcccgcgccctccctttac

SEQ ID NO: 139107 - DNA, 35 bp, Artificial Sequence
  Synthetic oligonucleotide
tgtcactctttggtccaagtctatccccgctgccc

SEQ ID NO: 139108 - DNA, 35 bp, Artificial Sequence
  Synthetic oligonucleotide
acctggtcactgggtttctcccgccaattgcctcc

SEQ ID NO: 139109 - DNA, 35 bp, Artificial Sequence
  Synthetic oligonucleotide
tcaaccctttcgcctgtctagtagtcttagccctc

SEQ ID NO: 139110 - DNA, 35 bp, Artificial Sequence
  Synthetic oligonucleotide
gaccccacctcctctacatagcgcgcccatggctc

SEQ ID NO: 139111 - DNA, 35 bp, Artificial Sequence
  Synthetic oligonucleotide
ggtgtcgatccacaccgtgaatgtcaccacctctc

SEQ ID NO: 139112 - DNA, 35 bp, Artificial Sequence
  Synthetic oligonucleotide
tcctggcgaccccataccagcaccccctccctgtc

SEQ ID NO: 139113 - DNA, 35 bp, Artificial Sequence
  Synthetic oligonucleotide
agcccggcgtaagttttccatttgccccccattcg

SEQ ID NO: 139114 - DNA, 35 bp, Artificial Sequence
  Synthetic oligonucleotide
ttacgcccgtacctgttaattccctgttccgtact

SEQ ID NO: 139115 - DNA, 35 bp, Artificial Sequence
  Synthetic oligonucleotide
gttgccggacctcatctgttccttcatgaatacct

SEQ ID NO: 139116 - DNA, 35 bp, Artificial Sequence
  Synthetic oligonucleotide
gactccctctctgtcccaacccttcttagggtggt

SEQ ID NO: 139117 - DNA, 35 bp, Artificial Sequence
  Synthetic oligonucleotide
gcgtattgcgccgtctattccttccttccttcgtt

SEQ ID NO: 139118 - DNA, 35 bp, Artificial Sequence
  Synthetic oligonucleotide
ttccgatcctcacctgcttcctagacatgtaccaa

SEQ ID NO: 139119 - DNA, 36 bp, Artificial Sequence
  Synthetic oligonucleotide
tccagccttcggtgcttccgtcttgctcgttctcca

SEQ ID NO: 139120 - DNA, 34 bp, Artificial Sequence
  Synthetic oligonucleotide
tcccagatccatcctcgcccagagttttccatca

SEQ ID NO: 139121 - DNA, 36 bp, Artificial Sequence
  Synthetic oligonucleotide
tcagaacgagtggggaagggcggaggagacgtttca

SEQ ID NO: 139122 - DNA, 36 bp, Artificial Sequence
  Synthetic oligonucleotide
tccgctcgagaccttgctgccttctgacctttttca

SEQ ID NO: 139123 - DNA, 36 bp, Artificial Sequence
  Synthetic oligonucleotide
gaccacccccaactcgcaggcctcctccctttgaga

SEQ ID NO: 139124 - DNA, 37 bp, Artificial Sequence
  Synthetic oligonucleotide
tctgccccgccttcgcctcgttctgtcgcagacccga

SEQ ID NO: 139125 - DNA, 36 bp, Artificial Sequence
  Synthetic oligonucleotide
tacgatgataggcaggggggagaagaaggggtccga

SEQ ID NO: 139126 - DNA, 37 bp, Artificial Sequence
  Synthetic oligonucleotide
aacgacgggggataagcaagaggcggaaagaagggga

SEQ ID NO: 139127 - DNA, 36 bp, Artificial Sequence
  Synthetic oligonucleotide
tcacgactcgcccgcttacgccctactcactgctga

SEQ ID NO: 139128 - DNA, 38 bp, Artificial Sequence
  Synthetic oligonucleotide
gcctgccgtcgctgccactgcctctatcacattgctga

SEQ ID NO: 139129 - DNA, 35 bp, Artificial Sequence
  Synthetic oligonucleotide
tctgactcagcccctctacctcctcagccccttga

SEQ ID NO: 139130 - DNA, 38 bp, Artificial Sequence
  Synthetic oligonucleotide
gacccttccgcatgggaattctctacactcctccttga

SEQ ID NO: 139131 - DNA, 38 bp, Artificial Sequence
  Synthetic oligonucleotide
tcaaaggcctcgcccccgcactcgctactgttccttga

SEQ ID NO: 139132 - DNA, 38 bp, Artificial Sequence
  Synthetic oligonucleotide
atggccgggtatgacgggaggggacggtctgtggttga

SEQ ID NO: 139133 - DNA, 38 bp, Artificial Sequence
  Synthetic oligonucleotide
tacgcacctcccatgacctatccatcaaaccctgttga

SEQ ID NO: 139134 - DNA, 36 bp, Artificial Sequence
  Synthetic oligonucleotide
accgcctcacgccgacttcggagaacggacctccta

SEQ ID NO: 139135 - DNA, 36 bp, Artificial Sequence
  Synthetic oligonucleotide
gggtgggaggaggcctggggaaaagaaaatgacgta

SEQ ID NO: 139136 - DNA, 35 bp, Artificial Sequence
  Synthetic oligonucleotide
gccgtagcccctgcgtccttcagcacgttgtccac

SEQ ID NO: 139137 - DNA, 35 bp, Artificial Sequence
  Synthetic oligonucleotide
aacgcgccgacaattgcccatacagcttcgccgcc

SEQ ID NO: 139138 - DNA, 35 bp, Artificial Sequence
  Synthetic oligonucleotide
atccgatgccgtagtacactccctcagctcttgcc

SEQ ID NO: 139139 - DNA, 35 bp, Artificial Sequence
  Synthetic oligonucleotide
actacgactctgacgcctcccccctcgagggttcc

SEQ ID NO: 139140 - DNA, 35 bp, Artificial Sequence
  Synthetic oligonucleotide
tctgtgcgatgcttcatccctacgttgccccttgc

SEQ ID NO: 139141 - DNA, 35 bp, Artificial Sequence
  Synthetic oligonucleotide
tagccctccccacatctttttaagctacgccttgc

SEQ ID NO: 139142 - DNA, 35 bp, Artificial Sequence
  Synthetic oligonucleotide
ggattgccaccgagtgctactgtccaccctgtatc

SEQ ID NO: 139143 - DNA, 35 bp, Artificial Sequence
  Synthetic oligonucleotide
tccacggccatgaatattttctttcgttacacctc

SEQ ID NO: 139144 - DNA, 35 bp, Artificial Sequence
  Synthetic oligonucleotide
aacacaagggcgtaggggtgagggcagggggaagg

SEQ ID NO: 139145 - DNA, 35 bp, Artificial Sequence
  Synthetic oligonucleotide
ttccccctaccgttggccccccacttccatcgatg

SEQ ID NO: 139146 - DNA, 35 bp, Artificial Sequence
  Synthetic oligonucleotide
atccgcacatttgccctgccgactaaacgcacgat

SEQ ID NO: 139147 - DNA, 35 bp, Artificial Sequence
  Synthetic oligonucleotide
gcccccgctacctgaccctctgtccaccgctatat

SEQ ID NO: 139148 - DNA, 35 bp, Artificial Sequence
  Synthetic oligonucleotide
tctccaccccgaatcctattgcactccgaggaact

SEQ ID NO: 139149 - DNA, 35 bp, Artificial Sequence
  Synthetic oligonucleotide
ggcccaccctctggatcttattgactgctgcctct

SEQ ID NO: 139150 - DNA, 35 bp, Artificial Sequence
  Synthetic oligonucleotide
tcccgcactgggaccgccgtacccctctcgtttct

SEQ ID NO: 139151 - DNA, 35 bp, Artificial Sequence
  Synthetic oligonucleotide
agtcgccgctctgcctccttcaccgtcctctgctt

SEQ ID NO: 139152 - DNA, 36 bp, Artificial Sequence
  Synthetic oligonucleotide
gccgccccacgcaccatttactccgacagtcccaaa

SEQ ID NO: 139153 - DNA, 36 bp, Artificial Sequence
  Synthetic oligonucleotide
tccgtacccgagccatcctatctgccgccctgtaaa

SEQ ID NO: 139154 - DNA, 35 bp, Artificial Sequence
  Synthetic oligonucleotide
tccccaccatccacagtgttgaattcaggttcgaa

SEQ ID NO: 139155 - DNA, 36 bp, Artificial Sequence
  Synthetic oligonucleotide
gtgaggaaggggaggtggagaaggaagggctgggaa

SEQ ID NO: 139156 - DNA, 36 bp, Artificial Sequence
  Synthetic oligonucleotide
ggatggaaagggcacggctaggggcggaattgggaa

SEQ ID NO: 139157 - DNA, 35 bp, Artificial Sequence
  Synthetic oligonucleotide
gtcaaggggggctggaaactaggaaggggggataa

SEQ ID NO: 139158 - DNA, 35 bp, Artificial Sequence
  Synthetic oligonucleotide
agcccccatccacacgctcctataggtcaatcaca

SEQ ID NO: 139159 - DNA, 35 bp, Artificial Sequence
  Synthetic oligonucleotide
atttgccccgtacgaccttagttggacccccccca

SEQ ID NO: 139160 - DNA, 35 bp, Artificial Sequence
  Synthetic oligonucleotide
gccccactgtttgttcccgctccatgacgacgcca

SEQ ID NO: 139161 - DNA, 36 bp, Artificial Sequence
  Synthetic oligonucleotide
acctcaatcgcttacatccatctgttcaacgtgcca

SEQ ID NO: 139162 - DNA, 36 bp, Artificial Sequence
  Synthetic oligonucleotide
gccgcagtctcacaattattggtttcgcttcctgca

SEQ ID NO: 139163 - DNA, 33 bp, Artificial Sequence
  Synthetic oligonucleotide
tcgcttagcccaatgccaccctactttacctca

SEQ ID NO: 139164 - DNA, 37 bp, Artificial Sequence
  Synthetic oligonucleotide
agttagaacgaggcgggtgggaacaacgggggggaga

SEQ ID NO: 139165 - DNA, 37 bp, Artificial Sequence
  Synthetic oligonucleotide
gagacacgcgatgtatccgcccttccctccccgccga

SEQ ID NO: 139166 - DNA, 37 bp, Artificial Sequence
  Synthetic oligonucleotide
gccgtcgcccctgcctctctagccacacaatcgtcga

SEQ ID NO: 139167 - DNA, 37 bp, Artificial Sequence
  Synthetic oligonucleotide
gcatgcccgtacagccgccgtcacttttcccttcgga

SEQ ID NO: 139168 - DNA, 36 bp, Artificial Sequence
  Synthetic oligonucleotide
gcctgccacctgctcttcattacatagtcgatatga

SEQ ID NO: 139169 - DNA, 38 bp, Artificial Sequence
  Synthetic oligonucleotide
gaaagaaagacgaggagagggatgggacaggtaactga

SEQ ID NO: 139170 - DNA, 37 bp, Artificial Sequence
  Synthetic oligonucleotide
tctacctcccagcccctggttccgactctcttcctga

SEQ ID NO: 139171 - DNA, 38 bp, Artificial Sequence
  Synthetic oligonucleotide
ttgcgctcctctctgcgtttaatctcttcccgccgtga

SEQ ID NO: 139172 - DNA, 38 bp, Artificial Sequence
  Synthetic oligonucleotide
tagttcgtcagcacctgtccttcgcccccgtcatttga

SEQ ID NO: 139173 - DNA, 37 bp, Artificial Sequence
  Synthetic oligonucleotide
gaccactactgaggcgatcaacaccccctcgctttga

SEQ ID NO: 139174 - DNA, 38 bp, Artificial Sequence
  Synthetic oligonucleotide
gaggacatcctctcagtgctctgccttccctgctttga

SEQ ID NO: 139175 - DNA, 36 bp, Artificial Sequence
  Synthetic oligonucleotide
tccctcatccgttgcctgttctaaccttagattcta

SEQ ID NO: 139176 - DNA, 35 bp, Artificial Sequence
  Synthetic oligonucleotide
atcccccgagagtgagccccaatcccgccttggac

SEQ ID NO: 139177 - DNA, 35 bp, Artificial Sequence
  Synthetic oligonucleotide
gttgcccgacgccatcatgccttcgcctcgcctac

SEQ ID NO: 139178 - DNA, 35 bp, Artificial Sequence
  Synthetic oligonucleotide
taacgcctcttacgtcgcataatgcacacccgccc

SEQ ID NO: 139179 - DNA, 35 bp, Artificial Sequence
  Synthetic oligonucleotide
ttgcgtgcacttgtactattcacctcctgtggccc

SEQ ID NO: 139180 - DNA, 35 bp, Artificial Sequence
  Synthetic oligonucleotide
actcgcaagccacgcatcatcatctaaagctcgcc

SEQ ID NO: 139181 - DNA, 35 bp, Artificial Sequence
  Synthetic oligonucleotide
tcagcggtggctaacctacctgccgtttcatgtcc

SEQ ID NO: 139182 - DNA, 36 bp, Artificial Sequence
  Synthetic oligonucleotide
aggacgtgctccttctcattgttcttcgaccgccgc

SEQ ID NO: 139183 - DNA, 35 bp, Artificial Sequence
  Synthetic oligonucleotide
atgcgcctcagaacctccgtattgttatcctccgc

SEQ ID NO: 139184 - DNA, 35 bp, Artificial Sequence
  Synthetic oligonucleotide
tgcggtccccccggccactaaattacccgttccgc

SEQ ID NO: 139185 - DNA, 35 bp, Artificial Sequence
  Synthetic oligonucleotide
tgcatacgtacccctgactccgcactccgactatc

SEQ ID NO: 139186 - DNA, 35 bp, Artificial Sequence
  Synthetic oligonucleotide
gcgtgctcaccctccccttaggtattgcatccctc

SEQ ID NO: 139187 - DNA, 35 bp, Artificial Sequence
  Synthetic oligonucleotide
gcacacatgagtcccgatccgtcccgctccagctc

SEQ ID NO: 139188 - DNA, 35 bp, Artificial Sequence
  Synthetic oligonucleotide
atcccgaggctcagaacacccccctcccgcccggg

SEQ ID NO: 139189 - DNA, 35 bp, Artificial Sequence
  Synthetic oligonucleotide
acacgcatcattcgctctcgtctacttcctcggat

SEQ ID NO: 139190 - DNA, 35 bp, Artificial Sequence
  Synthetic oligonucleotide
gccatcgggtggattaggtgggtgggttggaatat

SEQ ID NO: 139191 - DNA, 35 bp, Artificial Sequence
  Synthetic oligonucleotide
gtagccgccacctgattctgtagtccctgccccct

SEQ ID NO: 139192 - DNA, 35 bp, Artificial Sequence
  Synthetic oligonucleotide
tagtatcccatcccatgctcttagagcgcagccct

SEQ ID NO: 139193 - DNA, 35 bp, Artificial Sequence
  Synthetic oligonucleotide
tggttcagccggatcgccttccttcgcttctctct

SEQ ID NO: 139194 - DNA, 35 bp, Artificial Sequence
  Synthetic oligonucleotide
tgatgctcgcctctcctttacattcatgctcctgt

SEQ ID NO: 139195 - DNA, 35 bp, Artificial Sequence
  Synthetic oligonucleotide
gacacgactcctggataccagcacgtcctgccttt

SEQ ID NO: 139196 - DNA, 36 bp, Artificial Sequence
  Synthetic oligonucleotide
atggtggggcgagaggggtcagggggcggatgtaaa

SEQ ID NO: 139197 - DNA, 36 bp, Artificial Sequence
  Synthetic oligonucleotide
actgcaccctcaagacgctcctgccctccgcccaca

SEQ ID NO: 139198 - DNA, 36 bp, Artificial Sequence
  Synthetic oligonucleotide
tccatcgacaccgctcgctccacgtaccctcgcaca

SEQ ID NO: 139199 - DNA, 34 bp, Artificial Sequence
  Synthetic oligonucleotide
gcacaggtctacctagcatgttgctccaccccca

SEQ ID NO: 139200 - DNA, 35 bp, Artificial Sequence
  Synthetic oligonucleotide
tatgtcctcacacactccttcgctccgtggcctca

SEQ ID NO: 139201 - DNA, 36 bp, Artificial Sequence
  Synthetic oligonucleotide
gtagagggagggaatggggagtaaacgacgaagtca

SEQ ID NO: 139202 - DNA, 37 bp, Artificial Sequence
  Synthetic oligonucleotide
aacgccgcatcttccgtcttgcatcacgctctatcga

SEQ ID NO: 139203 - DNA, 34 bp, Artificial Sequence
  Synthetic oligonucleotide
atccccctccgatcctgcttacccgttgattcga

SEQ ID NO: 139204 - DNA, 37 bp, Artificial Sequence
  Synthetic oligonucleotide
ggtcacgggggtggggatcatagggtgggttcacgga

SEQ ID NO: 139205 - DNA, 37 bp, Artificial Sequence
  Synthetic oligonucleotide
gcacccacaacatctcgccgctacggtcactcaatga

SEQ ID NO: 139206 - DNA, 37 bp, Artificial Sequence
  Synthetic oligonucleotide
gtgggaagtggggcatgaggggtaggagagcgagtga

SEQ ID NO: 139207 - DNA, 38 bp, Artificial Sequence
  Synthetic oligonucleotide
ttgtcacctcaccccgctcttacgtccgtccatattga

SEQ ID NO: 139208 - DNA, 38 bp, Artificial Sequence
  Synthetic oligonucleotide
gtggggcaactacacaacaggggaagggaagggcttga

SEQ ID NO: 139209 - DNA, 36 bp, Artificial Sequence
  Synthetic oligonucleotide
gttcgcaggcacaatatcggtctgtctccttcgcta

SEQ ID NO: 139210 - DNA, 36 bp, Artificial Sequence
  Synthetic oligonucleotide
agcggtggaggtagggggggaacggttgaatggtta

SEQ ID NO: 139211 - DNA, 35 bp, Artificial Sequence
  Synthetic oligonucleotide
acctcccttccgttgtaataccggccctaggttta

SEQ ID NO: 139212 - DNA, 35 bp, Artificial Sequence
  Synthetic oligonucleotide
tgctgtggcgtgactcggcgctctccttctatcac

SEQ ID NO: 139213 - DNA, 35 bp, Artificial Sequence
  Synthetic oligonucleotide
ttgcggttcacctgtattttagccttcccgctcac

SEQ ID NO: 139214 - DNA, 35 bp, Artificial Sequence
  Synthetic oligonucleotide
acctcgccacccgttctcgacagcgtcttcccgac

SEQ ID NO: 139215 - DNA, 35 bp, Artificial Sequence
  Synthetic oligonucleotide
tacaccgcgaacagcgtccccgtccgacttccgac

SEQ ID NO: 139216 - DNA, 35 bp, Artificial Sequence
  Synthetic oligonucleotide
atccatgcgcgtactgccgctcacccgtagaatcc

SEQ ID NO: 139217 - DNA, 35 bp, Artificial Sequence
  Synthetic oligonucleotide
tggagatccgaccagcccatgtacctctctcgtcc

SEQ ID NO: 139218 - DNA, 35 bp, Artificial Sequence
  Synthetic oligonucleotide
acatccgacgctcctcgccacctgcgtacgcccgc

SEQ ID NO: 139219 - DNA, 35 bp, Artificial Sequence
  Synthetic oligonucleotide
tagcaaagcatctggttacattcgtgcccccctgc

SEQ ID NO: 139220 - DNA, 35 bp, Artificial Sequence
  Synthetic oligonucleotide
gtggcacgccgccacttggcttagctgtacccctc

SEQ ID NO: 139221 - DNA, 35 bp, Artificial Sequence
  Synthetic oligonucleotide
tgtcccacctgtagtgccggttccctcacttgctc

SEQ ID NO: 139222 - DNA, 35 bp, Artificial Sequence
  Synthetic oligonucleotide
aattaccctgtccccgtaccacaccctgccttccg

SEQ ID NO: 139223 - DNA, 35 bp, Artificial Sequence
  Synthetic oligonucleotide
gtgctgtccgggtgggtgggttttcagtctatggg

SEQ ID NO: 139224 - DNA, 35 bp, Artificial Sequence
  Synthetic oligonucleotide
gaaggcgagcctgccagttctttccccactgtcct

SEQ ID NO: 139225 - DNA, 35 bp, Artificial Sequence
  Synthetic oligonucleotide
agctcgcgcattcccttcgactcctgttcttccgt

SEQ ID NO: 139226 - DNA, 35 bp, Artificial Sequence
  Synthetic oligonucleotide
tcacgtcgcacccgcctatctctgttcgatttggt

SEQ ID NO: 139227 - DNA, 35 bp, Artificial Sequence
  Synthetic oligonucleotide
acgccacactacgctgtgccgttgcccctagcttt

SEQ ID NO: 139228 - DNA, 35 bp, Artificial Sequence
  Synthetic oligonucleotide
ggaacgagcgggaaaagggaggggtgcttcggtaa

SEQ ID NO: 139229 - DNA, 36 bp, Artificial Sequence
  Synthetic oligonucleotide
ttcgcgcaaagtcgttcgcttccgtccatccgtaca

SEQ ID NO: 139230 - DNA, 36 bp, Artificial Sequence
  Synthetic oligonucleotide
tgcactccccacggatttaggccccctgctagacca

SEQ ID NO: 139231 - DNA, 36 bp, Artificial Sequence
  Synthetic oligonucleotide
gttacccatgcctcactgcgcactctggtttatcca

SEQ ID NO: 139232 - DNA, 37 bp, Artificial Sequence
  Synthetic oligonucleotide
gaatgggcgcgcgaacagggggggaagggtcactaga

SEQ ID NO: 139233 - DNA, 37 bp, Artificial Sequence
  Synthetic oligonucleotide
tcagtgtcgtaggcgggagggcggggaaggctttaga

SEQ ID NO: 139234 - DNA, 36 bp, Artificial Sequence
  Synthetic oligonucleotide
tgttgccgtcagcatcatctgctcccccactaccga

SEQ ID NO: 139235 - DNA, 36 bp, Artificial Sequence
  Synthetic oligonucleotide
gagaggagggtgtcagggaggggaagtaatgctgga

SEQ ID NO: 139236 - DNA, 36 bp, Artificial Sequence
  Synthetic oligonucleotide
gtccccgcccctacatgtttcccccgcgtattgtga

SEQ ID NO: 139237 - DNA, 36 bp, Artificial Sequence
  Synthetic oligonucleotide
gcaccctcctgtaatattcgcgctcgttccatcata

SEQ ID NO: 139238 - DNA, 35 bp, Artificial Sequence
  Synthetic oligonucleotide
tccccctccgtccctgcctacgatcatcgccgata

SEQ ID NO: 139239 - DNA, 36 bp, Artificial Sequence
  Synthetic oligonucleotide
gatctaccaccgctgcctacgtaggccccacgccta

SEQ ID NO: 139240 - DNA, 35 bp, Artificial Sequence
  Synthetic oligonucleotide
atgaccccgccactgtctcttgttaatctcgtcta

SEQ ID NO: 139241 - DNA, 35 bp, Artificial Sequence
  Synthetic oligonucleotide
actccgggcgtgcccctgcctttctcttgccacac

SEQ ID NO: 139242 - DNA, 35 bp, Artificial Sequence
  Synthetic oligonucleotide
aacgccccgcgccgaggttctcgggttctgctccc

SEQ ID NO: 139243 - DNA, 35 bp, Artificial Sequence
  Synthetic oligonucleotide
tctggctcggcacagctccccgcccgttacactcc

SEQ ID NO: 139244 - DNA, 35 bp, Artificial Sequence
  Synthetic oligonucleotide
gtctccaccatggcttgcgatatcgcactttgtcc

SEQ ID NO: 139245 - DNA, 35 bp, Artificial Sequence
  Synthetic oligonucleotide
ttgctgcacatgtgtccaccctacaaccccgccgc

SEQ ID NO: 139246 - DNA, 35 bp, Artificial Sequence
  Synthetic oligonucleotide
gcgctctacgccttccgtatttttttcacctgtgc

SEQ ID NO: 139247 - DNA, 35 bp, Artificial Sequence
  Synthetic oligonucleotide
tgtttctgccacccaatcaacgactgtctccgctc

SEQ ID NO: 139248 - DNA, 35 bp, Artificial Sequence
  Synthetic oligonucleotide
gtaccgtcttggttccatacattgtcgcccgtttc

SEQ ID NO: 139249 - DNA, 35 bp, Artificial Sequence
  Synthetic oligonucleotide
gccggtcgcattcccgtgcataactttcctactag

SEQ ID NO: 139250 - DNA, 35 bp, Artificial Sequence
  Synthetic oligonucleotide
tacccacacactctctgttcgtctagactgctacg

SEQ ID NO: 139251 - DNA, 34 bp, Artificial Sequence
  Synthetic oligonucleotide
gcacccatcacccccctgcgcacttaagtaaatg

SEQ ID NO: 139252 - DNA, 35 bp, Artificial Sequence
  Synthetic oligonucleotide
tgccccgcaagccattcgcctttcttcccggctat

SEQ ID NO: 139253 - DNA, 35 bp, Artificial Sequence
  Synthetic oligonucleotide
tccaccagcactgctatacctcactccacacgcct

SEQ ID NO: 139254 - DNA, 35 bp, Artificial Sequence
  Synthetic oligonucleotide
tccatgtggaggccggatcgatctacttcctcctt

SEQ ID NO: 139255 - DNA, 35 bp, Artificial Sequence
  Synthetic oligonucleotide
tgtacccccccgtgcgaacgttcttgcgctatttt

SEQ ID NO: 139256 - DNA, 35 bp, Artificial Sequence
  Synthetic oligonucleotide
gtcgcctcatacgttacctgccttcgctttcccaa

SEQ ID NO: 139257 - DNA, 35 bp, Artificial Sequence
  Synthetic oligonucleotide
gatccaccccacacgtaaccgctgctgtccaccca

SEQ ID NO: 139258 - DNA, 36 bp, Artificial Sequence
  Synthetic oligonucleotide
taagcctcattccgcctcgatggttacgccacccca

SEQ ID NO: 139259 - DNA, 34 bp, Artificial Sequence
  Synthetic oligonucleotide
ggtaccgcatcctttgagtttctgccttcgccca

SEQ ID NO: 139260 - DNA, 35 bp, Artificial Sequence
  Synthetic oligonucleotide
tcctcttgccacacgagttctgtcctgagttccca

SEQ ID NO: 139261 - DNA, 35 bp, Artificial Sequence
  Synthetic oligonucleotide
attccctgcggtcgtaaagttccccccccgccgca

SEQ ID NO: 139262 - DNA, 35 bp, Artificial Sequence
  Synthetic oligonucleotide
attcccgcgcccaagcctttccacaccggccttca

SEQ ID NO: 139263 - DNA, 37 bp, Artificial Sequence
  Synthetic oligonucleotide
attgggcgggtgggagcaggaacggaagggccgcaga

SEQ ID NO: 139264 - DNA, 37 bp, Artificial Sequence
  Synthetic oligonucleotide
gttcgccccactgatagcgtcgcgctcttatcaccga

SEQ ID NO: 139265 - DNA, 37 bp, Artificial Sequence
  Synthetic oligonucleotide
tgtctgtggacggggcgaggagcaaggaaggaggcga

SEQ ID NO: 139266 - DNA, 38 bp, Artificial Sequence
  Synthetic oligonucleotide
tctatcccctcctgtacttagtcgtcctcacctggtga

SEQ ID NO: 139267 - DNA, 36 bp, Artificial Sequence
  Synthetic oligonucleotide
ttgcacctcaaaggtttcccccggcctcattccata

SEQ ID NO: 139268 - DNA, 36 bp, Artificial Sequence
  Synthetic oligonucleotide
atcccctcgctctcgccccggccacgtactttagta

SEQ ID NO: 139269 - DNA, 36 bp, Artificial Sequence
  Synthetic oligonucleotide
gacggatgcaggggggtaacagggtgggattaggta

SEQ ID NO: 139270 - DNA, 36 bp, Artificial Sequence
  Synthetic oligonucleotide
tcgccctcacttgtcattatcgctacactatcttta

SEQ ID NO: 139271 - DNA, 35 bp, Artificial Sequence
  Synthetic oligonucleotide
gcataagacggaacatacatgggggaggggggcac

SEQ ID NO: 139272 - DNA, 35 bp, Artificial Sequence
  Synthetic oligonucleotide
acactcccatttgtcaatcctgttacttcgcttac

SEQ ID NO: 139273 - DNA, 35 bp, Artificial Sequence
  Synthetic oligonucleotide
tcccacgcatttacactattgaaccaccgcctacc

SEQ ID NO: 139274 - DNA, 35 bp, Artificial Sequence
  Synthetic oligonucleotide
gcacatcgcgggcccgtttctcttgctgttctacc

SEQ ID NO: 139275 - DNA, 35 bp, Artificial Sequence
  Synthetic oligonucleotide
tacaccttgcacctgatcgggtcgcgctatcaccc

SEQ ID NO: 139276 - DNA, 35 bp, Artificial Sequence
  Synthetic oligonucleotide
ttgtatccgacatagcatgtatccctgtcgccccc

SEQ ID NO: 139277 - DNA, 35 bp, Artificial Sequence
  Synthetic oligonucleotide
acgccccggtgccactggtgtcgtcccgaacttcc

SEQ ID NO: 139278 - DNA, 35 bp, Artificial Sequence
  Synthetic oligonucleotide
tcaccatcgacttgcgttcccttgctttccacatc

SEQ ID NO: 139279 - DNA, 35 bp, Artificial Sequence
  Synthetic oligonucleotide
actccgcacgcccttcgccacatctgtcccgcctc

SEQ ID NO: 139280 - DNA, 35 bp, Artificial Sequence
  Synthetic oligonucleotide
agcctgacccatgtcatccgaccgcctgctagctc

SEQ ID NO: 139281 - DNA, 35 bp, Artificial Sequence
  Synthetic oligonucleotide
taaccgggcgggaagggtgggaaaatcacagcggg

SEQ ID NO: 139282 - DNA, 35 bp, Artificial Sequence
  Synthetic oligonucleotide
ttccactgcatccactacctctacttggctcactg

SEQ ID NO: 139283 - DNA, 35 bp, Artificial Sequence
  Synthetic oligonucleotide
acaccttcaactgccccgctcacgcaaaatgcttg

SEQ ID NO: 139284 - DNA, 34 bp, Artificial Sequence
  Synthetic oligonucleotide
gaccgcgaacgtgctttactcctgtgtctgccct

SEQ ID NO: 139285 - DNA, 35 bp, Artificial Sequence
  Synthetic oligonucleotide
gatacatccgatatccttccgtccctgccgtgcct

SEQ ID NO: 139286 - DNA, 35 bp, Artificial Sequence
  Synthetic oligonucleotide
tgtagccacttgtcgaccaccatcctttagtctct

SEQ ID NO: 139287 - DNA, 35 bp, Artificial Sequence
  Synthetic oligonucleotide
accgcggcctatgtcgcaattcgggtactctttct

SEQ ID NO: 139288 - DNA, 35 bp, Artificial Sequence
  Synthetic oligonucleotide
tgcttccgccccctgttcattaattcgtagtcatt

SEQ ID NO: 139289 - DNA, 35 bp, Artificial Sequence
  Synthetic oligonucleotide
tccccgtcccccagtgttgcatcccgtacgcactt

SEQ ID NO: 139290 - DNA, 36 bp, Artificial Sequence
  Synthetic oligonucleotide
accacacatatcatcgccgctctgctccccttggaa

SEQ ID NO: 139291 - DNA, 36 bp, Artificial Sequence
  Synthetic oligonucleotide
gccaccaactctatgtttcttgcgatacctgcccga

SEQ ID NO: 139292 - DNA, 37 bp, Artificial Sequence
  Synthetic oligonucleotide
actccgccgttcacgtttttgctacccctaccccgga

SEQ ID NO: 139293 - DNA, 38 bp, Artificial Sequence
  Synthetic oligonucleotide
tttgacacgggtgggggggcatagggccaattaactga

SEQ ID NO: 139294 - DNA, 36 bp, Artificial Sequence
  Synthetic oligonucleotide
tccccctccgtcggtcacaccgttgtctacttcata

SEQ ID NO: 139295 - DNA, 36 bp, Artificial Sequence
  Synthetic oligonucleotide
gccgtcgccgaagtctcttgtagcaccccgccgtta

SEQ ID NO: 139296 - DNA, 35 bp, Artificial Sequence
  Synthetic oligonucleotide
ggtggtccagacgcgcaatgccactctttttccac

SEQ ID NO: 139297 - DNA, 35 bp, Artificial Sequence
  Synthetic oligonucleotide
acccgttgcctcattcatcataaccctcctgcccc

SEQ ID NO: 139298 - DNA, 35 bp, Artificial Sequence
  Synthetic oligonucleotide
gcgtcccgcaatcctgctgtaaactgccgctgccc

SEQ ID NO: 139299 - DNA, 35 bp, Artificial Sequence
  Synthetic oligonucleotide
cccaccgccgagattgactcacccaccgccttccc

SEQ ID NO: 139300 - DNA, 35 bp, Artificial Sequence
  Synthetic oligonucleotide
tgtacgcccttgggtagtctctccatggcacctcc

SEQ ID NO: 139301 - DNA, 35 bp, Artificial Sequence
  Synthetic oligonucleotide
atggcccagccgacacttcgcacctattcccctcc

SEQ ID NO: 139302 - DNA, 35 bp, Artificial Sequence
  Synthetic oligonucleotide
aacgtactgtacgacgcgtttacgctttgccttcc

SEQ ID NO: 139303 - DNA, 35 bp, Artificial Sequence
  Synthetic oligonucleotide
acgcaccgcccccccattgccgcctaggttcaagc

SEQ ID NO: 139304 - DNA, 36 bp, Artificial Sequence
  Synthetic oligonucleotide
tcactacacccgaattgtcctatagccaatccccgc

SEQ ID NO: 139305 - DNA, 35 bp, Artificial Sequence
  Synthetic oligonucleotide
gcactcagaaggaaatgctgtcgctcgcccccatc

SEQ ID NO: 139306 - DNA, 35 bp, Artificial Sequence
  Synthetic oligonucleotide
tacaagtaccacctcccacgaagccgctccctccg

SEQ ID NO: 139307 - DNA, 35 bp, Artificial Sequence
  Synthetic oligonucleotide
actcgatctgtctctgcaccctataacctgctccg

SEQ ID NO: 139308 - DNA, 35 bp, Artificial Sequence
  Synthetic oligonucleotide
gatggggcggttgaggtgggttggtggaacactgg

SEQ ID NO: 139309 - DNA, 33 bp, Artificial Sequence
  Synthetic oligonucleotide
attccacccccccgccactcagtagaattgtgg

SEQ ID NO: 139310 - DNA, 35 bp, Artificial Sequence
  Synthetic oligonucleotide
aacgcgcgcccgccccgccgtttctactaattctg

SEQ ID NO: 139311 - DNA, 35 bp, Artificial Sequence
  Synthetic oligonucleotide
tcaggagggcgaaagaaggggagggctgacgggat

SEQ ID NO: 139312 - DNA, 35 bp, Artificial Sequence
  Synthetic oligonucleotide
gccccgacgccttctgttcaccgcgacgcaccttt

SEQ ID NO: 139313 - DNA, 36 bp, Artificial Sequence
  Synthetic oligonucleotide
gccacatcccctcggtacttggtctcacattaacaa

SEQ ID NO: 139314 - DNA, 35 bp, Artificial Sequence
  Synthetic oligonucleotide
gcccggtcccttaccagccgtgcgttacgcactaa

SEQ ID NO: 139315 - DNA, 36 bp, Artificial Sequence
  Synthetic oligonucleotide
tccgctccccttgcgcgttttcacatagctttccca

SEQ ID NO: 139316 - DNA, 36 bp, Artificial Sequence
  Synthetic oligonucleotide
gacgcacctcttgactagcccgacacatatacgcca

SEQ ID NO: 139317 - DNA, 35 bp, Artificial Sequence
  Synthetic oligonucleotide
taccgtccccgctctcaatcacgtagtctctcgca

SEQ ID NO: 139318 - DNA, 35 bp, Artificial Sequence
  Synthetic oligonucleotide
gtccccgcgactgtccccatattcttgcccggtca

SEQ ID NO: 139319 - DNA, 36 bp, Artificial Sequence
  Synthetic oligonucleotide
gtgccatccgtacttgccgaccttcctatggtttca

SEQ ID NO: 139320 - DNA, 36 bp, Artificial Sequence
  Synthetic oligonucleotide
gagcacgccactccgtcaatccgtccgcccttccga

SEQ ID NO: 139321 - DNA, 36 bp, Artificial Sequence
  Synthetic oligonucleotide
gtgggggagcacggggggaggtcggctaagtggcga

SEQ ID NO: 139322 - DNA, 38 bp, Artificial Sequence
  Synthetic oligonucleotide
ggaagacgggcacgggcataggggcgctgggggaatga

SEQ ID NO: 139323 - DNA, 38 bp, Artificial Sequence
  Synthetic oligonucleotide
atccattggtctcgctcgattccgccgtttttgcctga

SEQ ID NO: 139324 - DNA, 36 bp, Artificial Sequence
  Synthetic oligonucleotide
tctagcccatccgtgtactgcttcatatcctcctga

SEQ ID NO: 139325 - DNA, 38 bp, Artificial Sequence
  Synthetic oligonucleotide
atggcccgcacgcactgtcccacccacgcttcctttga

SEQ ID NO: 139326 - DNA, 36 bp, Artificial Sequence
  Synthetic oligonucleotide
gagtaggggaagaaagggggggcggacattgtagta

SEQ ID NO: 139327 - DNA, 36 bp, Artificial Sequence
  Synthetic oligonucleotide
tgccctgtccatcctcgatttttgggcccattatta

SEQ ID NO: 139328 - DNA, 35 bp, Artificial Sequence
  Synthetic oligonucleotide
acctgcgaacattatgtggcacctcccgtccgcac

SEQ ID NO: 139329 - DNA, 35 bp, Artificial Sequence
  Synthetic oligonucleotide
accccttccatcatccgtcccgtgcctcgggggac

SEQ ID NO: 139330 - DNA, 35 bp, Artificial Sequence
  Synthetic oligonucleotide
gcgtaccgtaccttcaccgaccgtttttgcctacc

SEQ ID NO: 139331 - DNA, 34 bp, Artificial Sequence
  Synthetic oligonucleotide
tctaccaacctccggtcctcgtcgcccgctcccc

SEQ ID NO: 139332 - DNA, 35 bp, Artificial Sequence
  Synthetic oligonucleotide
tgcccctccagttcgtcttttcagccatcgccgcc

SEQ ID NO: 139333 - DNA, 35 bp, Artificial Sequence
  Synthetic oligonucleotide
acgcccctccgaaccgcaattagtgactatcgcgc

SEQ ID NO: 139334 - DNA, 35 bp, Artificial Sequence
  Synthetic oligonucleotide
tcgcgcaactaaccgcccccctctgtttcagctgc

SEQ ID NO: 139335 - DNA, 35 bp, Artificial Sequence
  Synthetic oligonucleotide
tgtgtgaccgctctccactccgtcttgtctacgtc

SEQ ID NO: 139336 - DNA, 34 bp, Artificial Sequence
  Synthetic oligonucleotide
tgccaagccatatcactactgtactgtccatgtc

SEQ ID NO: 139337 - DNA, 35 bp, Artificial Sequence
  Synthetic oligonucleotide
accagctagccgttcacaatattccgtgccctttc

SEQ ID NO: 139338 - DNA, 35 bp, Artificial Sequence
  Synthetic oligonucleotide
agtgatggaggaggaggttacggaggggttttgag

SEQ ID NO: 139339 - DNA, 35 bp, Artificial Sequence
  Synthetic oligonucleotide
taagaccccgttcgaaccacccctccctgactagg

SEQ ID NO: 139340 - DNA, 35 bp, Artificial Sequence
  Synthetic oligonucleotide
gataggtcagggaagcaagggcgggcaggtggggg

SEQ ID NO: 139341 - DNA, 35 bp, Artificial Sequence
  Synthetic oligonucleotide
gtttcacgtcctcaacccaccgtcctaccgttttg

SEQ ID NO: 139342 - DNA, 35 bp, Artificial Sequence
  Synthetic oligonucleotide
tcaactcgggcaaatgccgcccctcccgagccact

SEQ ID NO: 139343 - DNA, 35 bp, Artificial Sequence
  Synthetic oligonucleotide
tcaccccgagctcgcgagctgtttcacccgtttct

SEQ ID NO: 139344 - DNA, 35 bp, Artificial Sequence
  Synthetic oligonucleotide
cctcacccgccccgacctccaccttcgagactcgt

SEQ ID NO: 139345 - DNA, 36 bp, Artificial Sequence
  Synthetic oligonucleotide
atgccaccccctctaacgcctcaggccctccgtaca

SEQ ID NO: 139346 - DNA, 32 bp, Artificial Sequence
  Synthetic oligonucleotide
gatcgcgctttcggtctcgttttcccatatca

SEQ ID NO: 139347 - DNA, 37 bp, Artificial Sequence
  Synthetic oligonucleotide
tgagagtgcgatttcggggggcgggagtgggcggaga

SEQ ID NO: 139348 - DNA, 37 bp, Artificial Sequence
  Synthetic oligonucleotide
gggttgagggggcggaggcgaaaaggtgaagggtaga

SEQ ID NO: 139349 - DNA, 37 bp, Artificial Sequence
  Synthetic oligonucleotide
acgcggggaggggggaaagggaattgaattaccggga

SEQ ID NO: 139350 - DNA, 37 bp, Artificial Sequence
  Synthetic oligonucleotide
ggaacgacgcacggagaggcacgggggaggctgggga

SEQ ID NO: 139351 - DNA, 35 bp, Artificial Sequence
  Synthetic oligonucleotide
acgtgatgcctttccggttctgtttcttgccctga

SEQ ID NO: 139352 - DNA, 38 bp, Artificial Sequence
  Synthetic oligonucleotide
gagcccccccctgacgcgcgtacccatcacttacttga

SEQ ID NO: 139353 - DNA, 35 bp, Artificial Sequence
  Synthetic oligonucleotide
tccgttcgtacccgctatcttgttacatccttgac

SEQ ID NO: 139354 - DNA, 35 bp, Artificial Sequence
  Synthetic oligonucleotide
gctcacccactccatgcgtgcttcacccgtttacc

SEQ ID NO: 139355 - DNA, 35 bp, Artificial Sequence
  Synthetic oligonucleotide
cccgacgacggtccagtcgcctttgttgcccaccc

SEQ ID NO: 139356 - DNA, 35 bp, Artificial Sequence
  Synthetic oligonucleotide
tgaagcgtccgcatattaccctgccaccccctgcc

SEQ ID NO: 139357 - DNA, 35 bp, Artificial Sequence
  Synthetic oligonucleotide
actcccatgtcgcagcatttccgcattagtgctcc

SEQ ID NO: 139358 - DNA, 35 bp, Artificial Sequence
  Synthetic oligonucleotide
aaccccacgcccgccctgttgctgaatggctctcc

SEQ ID NO: 139359 - DNA, 36 bp, Artificial Sequence
  Synthetic oligonucleotide
gcccgcccgccaaatttgatctttaaccagcattcc

SEQ ID NO: 139360 - DNA, 35 bp, Artificial Sequence
  Synthetic oligonucleotide
tcctcctcacgttttccccctatacacgctctagc

SEQ ID NO: 139361 - DNA, 35 bp, Artificial Sequence
  Synthetic oligonucleotide
tgtcgcccccgctacaacctatgaccataccccgc

SEQ ID NO: 139362 - DNA, 35 bp, Artificial Sequence
  Synthetic oligonucleotide
gcgatgtgtcaccgttttacgtgcccccttaaatc

SEQ ID NO: 139363 - DNA, 35 bp, Artificial Sequence
  Synthetic oligonucleotide
gccggtcccattggtttgtaactgtcgcgcctatc

SEQ ID NO: 139364 - DNA, 35 bp, Artificial Sequence
  Synthetic oligonucleotide
aaccccacctgccctcgacgatctgcaacgcgttc

SEQ ID NO: 139365 - DNA, 35 bp, Artificial Sequence
  Synthetic oligonucleotide
ggagccaaggaggggaatgggggcggaatctcaag

SEQ ID NO: 139366 - DNA, 35 bp, Artificial Sequence
  Synthetic oligonucleotide
gccaccttcattgcgatttccagctccatcgctgg

SEQ ID NO: 139367 - DNA, 35 bp, Artificial Sequence
  Synthetic oligonucleotide
ggtattgggacaggggggtaggagcaagaggggtg

SEQ ID NO: 139368 - DNA, 35 bp, Artificial Sequence
  Synthetic oligonucleotide
gatgtacgcccatgcctgcaatgctttactgtcct

SEQ ID NO: 139369 - DNA, 35 bp, Artificial Sequence
  Synthetic oligonucleotide
gcctccaggtcaataatggcgccttcctgtccctt

SEQ ID NO: 139370 - DNA, 35 bp, Artificial Sequence
  Synthetic oligonucleotide
tccaggcacgcagaccccctcctcttgtgccggtt

SEQ ID NO: 139371 - DNA, 35 bp, Artificial Sequence
  Synthetic oligonucleotide
tacgctccactggcccctacaacccgcgagttgtt

SEQ ID NO: 139372 - DNA, 35 bp, Artificial Sequence
  Synthetic oligonucleotide
tccgagaatcggatgccccctcgcctggctccttt

SEQ ID NO: 139373 - DNA, 34 bp, Artificial Sequence
  Synthetic oligonucleotide
gaagccaccccccttgtactgcagctcccattaa

SEQ ID NO: 139374 - DNA, 35 bp, Artificial Sequence
  Synthetic oligonucleotide
attctggagggggagggggagtaggacgaatgaca

SEQ ID NO: 139375 - DNA, 36 bp, Artificial Sequence
  Synthetic oligonucleotide
acctgtctcgacaagtcgctccctcagcccctccca

SEQ ID NO: 139376 - DNA, 36 bp, Artificial Sequence
  Synthetic oligonucleotide
acaccatcacgagtcagcgtttaaatccgccctcca

SEQ ID NO: 139377 - DNA, 35 bp, Artificial Sequence
  Synthetic oligonucleotide
gtctagccctcaatcgacttttcgtacctcctcca

SEQ ID NO: 139378 - DNA, 35 bp, Artificial Sequence
  Synthetic oligonucleotide
atcatccccccgatccgcattttgccctgtggaga

SEQ ID NO: 139379 - DNA, 37 bp, Artificial Sequence
  Synthetic oligonucleotide
aagctggtccgccctattacgttcaccctctccacga

SEQ ID NO: 139380 - DNA, 36 bp, Artificial Sequence
  Synthetic oligonucleotide
tccgaagggtcgacgctaaccaactctgcctcccga

SEQ ID NO: 139381 - DNA, 36 bp, Artificial Sequence
  Synthetic oligonucleotide
tgtgcctgcctccggtaccatctcgctctactagga

SEQ ID NO: 139382 - DNA, 38 bp, Artificial Sequence
  Synthetic oligonucleotide
gatgtccaccgtttatgcctaactgccctactccctga

SEQ ID NO: 139383 - DNA, 38 bp, Artificial Sequence
  Synthetic oligonucleotide
atgaccatcacacctggtacgccctagtccttccctga

SEQ ID NO: 139384 - DNA, 38 bp, Artificial Sequence
  Synthetic oligonucleotide
accgccctcccatctagtggcactatactccaccttga

SEQ ID NO: 139385 - DNA, 38 bp, Artificial Sequence
  Synthetic oligonucleotide
agacaccgcccctgggttcccgatcacgcaccttttga

SEQ ID NO: 139386 - DNA, 35 bp, Artificial Sequence
  Synthetic oligonucleotide
accagggtgggtgggtgtggagtttgtcattacta

SEQ ID NO: 139387 - DNA, 35 bp, Artificial Sequence
  Synthetic oligonucleotide
tcagatccaatgccgtttttttcgcctatgcccta

SEQ ID NO: 139388 - DNA, 36 bp, Artificial Sequence
  Synthetic oligonucleotide
tgcaaccctggtcgccactttgaaccccacctcgta

SEQ ID NO: 139389 - DNA, 35 bp, Artificial Sequence
  Synthetic oligonucleotide
gtgtggtcgctggccctcccattagctggctatac

SEQ ID NO: 139390 - DNA, 35 bp, Artificial Sequence
  Synthetic oligonucleotide
acgcgtcacgcgcacagcctggcctcccactgtac

SEQ ID NO: 139391 - DNA, 34 bp, Artificial Sequence
  Synthetic oligonucleotide
atttccctctcaccgttgtcgcacgtgctactgc

SEQ ID NO: 139392 - DNA, 35 bp, Artificial Sequence
  Synthetic oligonucleotide
tttacccccgcttgaactctccaggtgcctttgtc

SEQ ID NO: 139393 - DNA, 35 bp, Artificial Sequence
  Synthetic oligonucleotide
tccacttgccccaggtctctctgtctaggccgttc

SEQ ID NO: 139394 - DNA, 35 bp, Artificial Sequence
  Synthetic oligonucleotide
accgccacctctaatttatacaccttcgctgaaag

SEQ ID NO: 139395 - DNA, 35 bp, Artificial Sequence
  Synthetic oligonucleotide
gacccgccttactgatgcccctatccgcgttcgag

SEQ ID NO: 139396 - DNA, 35 bp, Artificial Sequence
  Synthetic oligonucleotide
tcatggtgtggttgaggcaaaaggggcggggtgag

SEQ ID NO: 139397 - DNA, 35 bp, Artificial Sequence
  Synthetic oligonucleotide
gtccccactacaccacccgcccgccatggataccg

SEQ ID NO: 139398 - DNA, 35 bp, Artificial Sequence
  Synthetic oligonucleotide
tgcccagtgccacccgcctaagaactttcactccg

SEQ ID NO: 139399 - DNA, 35 bp, Artificial Sequence
  Synthetic oligonucleotide
gcaccagtgcccatcttgctttacccccgtaccgg

SEQ ID NO: 139400 - DNA, 35 bp, Artificial Sequence
  Synthetic oligonucleotide
ttacctgcccggtttgttgcttatcttgtccgttt

SEQ ID NO: 139401 - DNA, 35 bp, Artificial Sequence
  Synthetic oligonucleotide
atgtgtccccttcccgccctggggttcttcaccca

SEQ ID NO: 139402 - DNA, 36 bp, Artificial Sequence
  Synthetic oligonucleotide
tgtacgtcgaatccagctttattgcccgctccccca

SEQ ID NO: 139403 - DNA, 36 bp, Artificial Sequence
  Synthetic oligonucleotide
gcacaccctcccatcgcccgtggctaattgttgcca

SEQ ID NO: 139404 - DNA, 36 bp, Artificial Sequence
  Synthetic oligonucleotide
gcccccggcgtccctacgctgcctatccccacttca

SEQ ID NO: 139405 - DNA, 36 bp, Artificial Sequence
  Synthetic oligonucleotide
actccgcgcttcttcattgttgctgtccgcccttca

SEQ ID NO: 139406 - DNA, 37 bp, Artificial Sequence
  Synthetic oligonucleotide
aaagggggaggtggagggggctctgcgcactaaggga

SEQ ID NO: 139407 - DNA, 37 bp, Artificial Sequence
  Synthetic oligonucleotide
atgggggagggagggtcgctcttcggataacggggga

SEQ ID NO: 139408 - DNA, 38 bp, Artificial Sequence
  Synthetic oligonucleotide
gctaccctcccgctggttatcaggtactccacacctga

SEQ ID NO: 139409 - DNA, 37 bp, Artificial Sequence
  Synthetic oligonucleotide
agtacaacgtgctctgttaacctcgccctccccctga

SEQ ID NO: 139410 - DNA, 35 bp, Artificial Sequence
  Synthetic oligonucleotide
gccgatcgagcgtgcgccttccgtctacttaccta

SEQ ID NO: 139411 - DNA, 36 bp, Artificial Sequence
  Synthetic oligonucleotide
gagtgggtgagggtgaggggatggtggtagtggcta

SEQ ID NO: 139412 - DNA, 36 bp, Artificial Sequence
  Synthetic oligonucleotide
accattgcccctcatgtcgtcccaatggactatcta

SEQ ID NO: 139413 - DNA, 36 bp, Artificial Sequence
  Synthetic oligonucleotide
gcacatccgtctgtctttccgcggggtcctttcgta

SEQ ID NO: 139414 - DNA, 34 bp, Artificial Sequence
  Synthetic oligonucleotide
tccccatcacgcgtagcagctacacccttcttta

SEQ ID NO: 139415 - DNA, 35 bp, Artificial Sequence
  Synthetic oligonucleotide
tgccccctggtaattctgattgacacgcctcccac

SEQ ID NO: 139416 - DNA, 35 bp, Artificial Sequence
  Synthetic oligonucleotide
tagtcgccgtgtgtctcccccccgcatacaactac

SEQ ID NO: 139417 - DNA, 35 bp, Artificial Sequence
  Synthetic oligonucleotide
acccgcctcgcttactccgcggtgttcttttctcc

SEQ ID NO: 139418 - DNA, 35 bp, Artificial Sequence
  Synthetic oligonucleotide
tgttacacatctgacgagccgccccctccatttcc

SEQ ID NO: 139419 - DNA, 35 bp, Artificial Sequence
  Synthetic oligonucleotide
tacatcgcctgctcccgtatggtccacccttttcc

SEQ ID NO: 139420 - DNA, 35 bp, Artificial Sequence
  Synthetic oligonucleotide
tcgaaccgcgcaacggacctcgccaatctgtcatc

SEQ ID NO: 139421 - DNA, 35 bp, Artificial Sequence
  Synthetic oligonucleotide
gacactcgccatagatctacttttcccttaccgtc

SEQ ID NO: 139422 - DNA, 35 bp, Artificial Sequence
  Synthetic oligonucleotide
gtgacggtcatccattcatgcgccccgcccggttc

SEQ ID NO: 139423 - DNA, 35 bp, Artificial Sequence
  Synthetic oligonucleotide
actctgccccttccacgttatgctgttccccgacg

SEQ ID NO: 139424 - DNA, 35 bp, Artificial Sequence
  Synthetic oligonucleotide
atactgcaccctccgttacctcgctctctattacg

SEQ ID NO: 139425 - DNA, 35 bp, Artificial Sequence
  Synthetic oligonucleotide
tcctaagcgtcgctcctatgccgctccactccatg

SEQ ID NO: 139426 - DNA, 36 bp, Artificial Sequence
  Synthetic oligonucleotide
atctcgatcaactgttcgtccgccctcccgcttatg

SEQ ID NO: 139427 - DNA, 35 bp, Artificial Sequence
  Synthetic oligonucleotide
gcctctgccctacccagttattatttgtcacccat

SEQ ID NO: 139428 - DNA, 35 bp, Artificial Sequence
  Synthetic oligonucleotide
tccgcatcatgtcctattctcgtttggtctccgct

SEQ ID NO: 139429 - DNA, 35 bp, Artificial Sequence
  Synthetic oligonucleotide
aagttgcactcgccgccccattaaccctgcgctct

SEQ ID NO: 139430 - DNA, 35 bp, Artificial Sequence
  Synthetic oligonucleotide
tgatgcgcatgtaaccccccgccgcctcctggttt

SEQ ID NO: 139431 - DNA, 35 bp, Artificial Sequence
  Synthetic oligonucleotide
tgaccaccccagttctcatacgtccgcttaactaa

SEQ ID NO: 139432 - DNA, 35 bp, Artificial Sequence
  Synthetic oligonucleotide
gactggaaccgccgccttccgcctcgccaatgcca

SEQ ID NO: 139433 - DNA, 36 bp, Artificial Sequence
  Synthetic oligonucleotide
gatgacgccaccattgctatcttattctttcttcca

SEQ ID NO: 139434 - DNA, 35 bp, Artificial Sequence
  Synthetic oligonucleotide
ggatccgggagggggggtatacgtagggatacgca

SEQ ID NO: 139435 - DNA, 35 bp, Artificial Sequence
  Synthetic oligonucleotide
tcatctgccgtaattatcagcctcctccgctcgca

SEQ ID NO: 139436 - DNA, 35 bp, Artificial Sequence
  Synthetic oligonucleotide
agcccacctcgattccgtttgtcaactactggtca

SEQ ID NO: 139437 - DNA, 37 bp, Artificial Sequence
  Synthetic oligonucleotide
gcgacagagagggagggccaaggagcaaaaggggaga

SEQ ID NO: 139438 - DNA, 37 bp, Artificial Sequence
  Synthetic oligonucleotide
gcacctccctgccgccctctagtaccccctttgacga

SEQ ID NO: 139439 - DNA, 37 bp, Artificial Sequence
  Synthetic oligonucleotide
gcgatcctcctccgctcgcaccctacagcccacccga

SEQ ID NO: 139440 - DNA, 37 bp, Artificial Sequence
  Synthetic oligonucleotide
tgtcccctccgcttacttgtcttgtccaaccttccga

SEQ ID NO: 139441 - DNA, 35 bp, Artificial Sequence
  Synthetic oligonucleotide
accagtcctgcaccatacaagccacctccttccga

SEQ ID NO: 139442 - DNA, 37 bp, Artificial Sequence
  Synthetic oligonucleotide
gcatagctgggagggtggggaagggagtttggatgga

SEQ ID NO: 139443 - DNA, 37 bp, Artificial Sequence
  Synthetic oligonucleotide
atggggaatgggtggtatgtacgtctagggcggtgga

SEQ ID NO: 139444 - DNA, 37 bp, Artificial Sequence
  Synthetic oligonucleotide
gccaccctctaatgagttgcttttcccttccattgga

SEQ ID NO: 139445 - DNA, 38 bp, Artificial Sequence
  Synthetic oligonucleotide
tcacgacgtccatttcccgatccattgctctccgttga

SEQ ID NO: 139446 - DNA, 37 bp, Artificial Sequence
  Synthetic oligonucleotide
gaccgcccttctgctcttggcccttagatccctttga

SEQ ID NO: 139447 - DNA, 38 bp, Artificial Sequence
  Synthetic oligonucleotide
gcgttcgtcgttccacctgcttgtactcactcctttga

SEQ ID NO: 139448 - DNA, 36 bp, Artificial Sequence
  Synthetic oligonucleotide
gttcccatcacccgcattgcctcccgaagtcgacta

SEQ ID NO: 139449 - DNA, 35 bp, Artificial Sequence
  Synthetic oligonucleotide
ttcgctccgtgatcatgtttgcctttccgcccgta

SEQ ID NO: 139450 - DNA, 35 bp, Artificial Sequence
  Synthetic oligonucleotide
ttaagtcggaagtttcctatctgctcctgttccac

SEQ ID NO: 139451 - DNA, 35 bp, Artificial Sequence
  Synthetic oligonucleotide
gtacacttcacccgccactatccagtctgccgtcc

SEQ ID NO: 139452 - DNA, 35 bp, Artificial Sequence
  Synthetic oligonucleotide
tgacctactcccttgtgccccggcctagtgcttcc

SEQ ID NO: 139453 - DNA, 35 bp, Artificial Sequence
  Synthetic oligonucleotide
accgctgttcgatcacgcacggaaaccgacccctc

SEQ ID NO: 139454 - DNA, 35 bp, Artificial Sequence
  Synthetic oligonucleotide
acatgtcacggttataccatcgccaccactccttc

SEQ ID NO: 139455 - DNA, 35 bp, Artificial Sequence
  Synthetic oligonucleotide
ttcatacgcacaacgcctgtagctttagttccttc

SEQ ID NO: 139456 - DNA, 35 bp, Artificial Sequence
  Synthetic oligonucleotide
tgatcgccccaagcacatctaccaatgaccgtttc

SEQ ID NO: 139457 - DNA, 35 bp, Artificial Sequence
  Synthetic oligonucleotide
taggtcgcagccctcattcttggtgccacttcccg

SEQ ID NO: 139458 - DNA, 35 bp, Artificial Sequence
  Synthetic oligonucleotide
atcaaccacgttgcctcgttcgtcccatctctcgg

SEQ ID NO: 139459 - DNA, 35 bp, Artificial Sequence
  Synthetic oligonucleotide
gcctgatccccgcgttcgcccctgtctctaaccat

SEQ ID NO: 139460 - DNA, 35 bp, Artificial Sequence
  Synthetic oligonucleotide
gtggtgctcgaggggcaaaaagggtagggagggat

SEQ ID NO: 139461 - DNA, 35 bp, Artificial Sequence
  Synthetic oligonucleotide
ttactacccgcccgcgcgtctctctcgacccttat

SEQ ID NO: 139462 - DNA, 35 bp, Artificial Sequence
  Synthetic oligonucleotide
gacgccgcttgatgtgctagcctccgtctccatct

SEQ ID NO: 139463 - DNA, 35 bp, Artificial Sequence
  Synthetic oligonucleotide
agcgacagcaactcacagccccccccattcactgt

SEQ ID NO: 139464 - DNA, 35 bp, Artificial Sequence
  Synthetic oligonucleotide
atttcccacccacgttatcgtagcccggtccctgt

SEQ ID NO: 139465 - DNA, 35 bp, Artificial Sequence
  Synthetic oligonucleotide
taacagtatcgccccccttgtcaccgctacattgt

SEQ ID NO: 139466 - DNA, 35 bp, Artificial Sequence
  Synthetic oligonucleotide
aatccgccgcagacgtccttatcccgtcacatttt

SEQ ID NO: 139467 - DNA, 34 bp, Artificial Sequence
  Synthetic oligonucleotide
gccactcgccggtttggcttatactttggctttt

SEQ ID NO: 139468 - DNA, 35 bp, Artificial Sequence
  Synthetic oligonucleotide
agtggatgagaggcggacggaaacggtaggggcaa

SEQ ID NO: 139469 - DNA, 36 bp, Artificial Sequence
  Synthetic oligonucleotide
acccgtccccgtgcactgtctaacctgtctactcaa

SEQ ID NO: 139470 - DNA, 35 bp, Artificial Sequence
  Synthetic oligonucleotide
acaccccccgtccttgaactcttgtcgttggacca

SEQ ID NO: 139471 - DNA, 35 bp, Artificial Sequence
  Synthetic oligonucleotide
gtacactctccaacctgttcactcctgtcctgaga

SEQ ID NO: 139472 - DNA, 37 bp, Artificial Sequence
  Synthetic oligonucleotide
gggaggagggaggggaggtcacgagagtgaggataga

SEQ ID NO: 139473 - DNA, 37 bp, Artificial Sequence
  Synthetic oligonucleotide
aacccgccccccgcgccaatagttaccaccacctaga

SEQ ID NO: 139474 - DNA, 36 bp, Artificial Sequence
  Synthetic oligonucleotide
atgttggccgcagttctccccgttactctcctcgga

SEQ ID NO: 139475 - DNA, 37 bp, Artificial Sequence
  Synthetic oligonucleotide
gaacgagctgtaagagagggaaggagtgggataggga

SEQ ID NO: 139476 - DNA, 37 bp, Artificial Sequence
  Synthetic oligonucleotide
gtggtgtcgagagggaacattgggtacgggaggggga

SEQ ID NO: 139477 - DNA, 37 bp, Artificial Sequence
  Synthetic oligonucleotide
aacgcccgcccccagctaccttctgccatagtttgga

SEQ ID NO: 139478 - DNA, 38 bp, Artificial Sequence
  Synthetic oligonucleotide
tcacgagatgggccagtgggtgggggggaacgggctga

SEQ ID NO: 139479 - DNA, 37 bp, Artificial Sequence
  Synthetic oligonucleotide
acactccccgattaatacaccgtcgctcctcttctga

SEQ ID NO: 139480 - DNA, 36 bp, Artificial Sequence
  Synthetic oligonucleotide
gatgaagaccggaagagggggggaaccagaagcata

SEQ ID NO: 139481 - DNA, 35 bp, Artificial Sequence
  Synthetic oligonucleotide
tggtaactgcccgcctccccctacgttcctgtata

SEQ ID NO: 139482 - DNA, 35 bp, Artificial Sequence
  Synthetic oligonucleotide
tcccggtgctcctggcatacaagcctgcctcacac

SEQ ID NO: 139483 - DNA, 35 bp, Artificial Sequence
  Synthetic oligonucleotide
agcaccctctcctgcacatgaccgcctgtggcacc

SEQ ID NO: 139484 - DNA, 35 bp, Artificial Sequence
  Synthetic oligonucleotide
gttcatcaggctcccatagtttttagccgtgcccc

SEQ ID NO: 139485 - DNA, 35 bp, Artificial Sequence
  Synthetic oligonucleotide
tctcggttcaaccgttcccatccgccattatgtcc

SEQ ID NO: 139486 - DNA, 35 bp, Artificial Sequence
  Synthetic oligonucleotide
aatcactgccacattcctaatctggactttcctgc

SEQ ID NO: 139487 - DNA, 35 bp, Artificial Sequence
  Synthetic oligonucleotide
aagccccctcgttccctattggactcgcctccatc

SEQ ID NO: 139488 - DNA, 35 bp, Artificial Sequence
  Synthetic oligonucleotide
ttcgttgccgtgctctgctaccactcactgctatc

SEQ ID NO: 139489 - DNA, 35 bp, Artificial Sequence
  Synthetic oligonucleotide
gatgaggttaagcctgggggggaggggggaacgag

SEQ ID NO: 139490 - DNA, 35 bp, Artificial Sequence
  Synthetic oligonucleotide
ggattaagcatggagggagtggggcggggattcgg

SEQ ID NO: 139491 - DNA, 35 bp, Artificial Sequence
  Synthetic oligonucleotide
aaccccgcaccctcacacccacagccccaagtggg

SEQ ID NO: 139492 - DNA, 35 bp, Artificial Sequence
  Synthetic oligonucleotide
atcaaagggagtggtaggggcataaggtagggcat

SEQ ID NO: 139493 - DNA, 35 bp, Artificial Sequence
  Synthetic oligonucleotide
tccgggtggggtggggccgttggtgacagggatat

SEQ ID NO: 139494 - DNA, 35 bp, Artificial Sequence
  Synthetic oligonucleotide
ttgcattgccgctcctgtcgtttcggatccaccct

SEQ ID NO: 139495 - DNA, 35 bp, Artificial Sequence
  Synthetic oligonucleotide
aaacttgttgcgcccccctccgtatgccgctccct

SEQ ID NO: 139496 - DNA, 35 bp, Artificial Sequence
  Synthetic oligonucleotide
taccccggtcctttcgccttgaactgtatccttgt

SEQ ID NO: 139497 - DNA, 35 bp, Artificial Sequence
  Synthetic oligonucleotide
gtagccaatcctgcattatgcgtttctcacacctt

SEQ ID NO: 139498 - DNA, 35 bp, Artificial Sequence
  Synthetic oligonucleotide
tgagcgccgtgcaccagttccggctctaccctgtt

SEQ ID NO: 139499 - DNA, 36 bp, Artificial Sequence
  Synthetic oligonucleotide
gtaacacccgactccgcccttggcatcacagtcaca

SEQ ID NO: 139500 - DNA, 36 bp, Artificial Sequence
  Synthetic oligonucleotide
tatcgatgcactcggacgtcgcttcactcgccccca

SEQ ID NO: 139501 - DNA, 36 bp, Artificial Sequence
  Synthetic oligonucleotide
tgcaaacgctgatgctctctgtctctcactggccca

SEQ ID NO: 139502 - DNA, 36 bp, Artificial Sequence
  Synthetic oligonucleotide
tgcctgaacgcccacgttgtttgattcccaccgcca

SEQ ID NO: 139503 - DNA, 35 bp, Artificial Sequence
  Synthetic oligonucleotide
gtccgacgcccgagtcagcacagctccctctatca

SEQ ID NO: 139504 - DNA, 36 bp, Artificial Sequence
  Synthetic oligonucleotide
acccagctgccatcgtccactctcaccaactgtaga

SEQ ID NO: 139505 - DNA, 36 bp, Artificial Sequence
  Synthetic oligonucleotide
gtatcgccccccattctttgaagccttgtctttaga

SEQ ID NO: 139506 - DNA, 37 bp, Artificial Sequence
  Synthetic oligonucleotide
tgacccctctgcactttcattccacactgtcacacga

SEQ ID NO: 139507 - DNA, 37 bp, Artificial Sequence
  Synthetic oligonucleotide
tcgcgccgggtgggagggatcgggtaaggttttccga

SEQ ID NO: 139508 - DNA, 35 bp, Artificial Sequence
  Synthetic oligonucleotide
atcgcgtttctgtcactctgtccactcgccctcga

SEQ ID NO: 139509 - DNA, 37 bp, Artificial Sequence
  Synthetic oligonucleotide
aatgcaagggaggtttgtcgggggacgaaaggaggga

SEQ ID NO: 139510 - DNA, 37 bp, Artificial Sequence
  Synthetic oligonucleotide
aagggcggatgacggcgcggtgagtgggcgggtggga

SEQ ID NO: 139511 - DNA, 37 bp, Artificial Sequence
  Synthetic oligonucleotide
tttccagctcagctacccctgttccctcgcctttgga

SEQ ID NO: 139512 - DNA, 38 bp, Artificial Sequence
  Synthetic oligonucleotide
tggagggggaggggaaaataggctgaggtggaacatga

SEQ ID NO: 139513 - DNA, 37 bp, Artificial Sequence
  Synthetic oligonucleotide
gatcccatcagttgaccatattgccgcctccttctga

SEQ ID NO: 139514 - DNA, 36 bp, Artificial Sequence
  Synthetic oligonucleotide
agggtggggcgaatagggtggggatgattcaattga

SEQ ID NO: 139515 - DNA, 37 bp, Artificial Sequence
  Synthetic oligonucleotide
tttcccacctcagcaatatctttgcctgccctcttga

SEQ ID NO: 139516 - DNA, 36 bp, Artificial Sequence
  Synthetic oligonucleotide
tacgccacttgcccgcccgctccctttcaacctgta

SEQ ID NO: 139517 - DNA, 36 bp, Artificial Sequence
  Synthetic oligonucleotide
accccaccgcccatgctatatcgattatttaattta

SEQ ID NO: 139518 - DNA, 35 bp, Artificial Sequence
  Synthetic oligonucleotide
tactccttccagcgcattagggtccgccgccgccc

SEQ ID NO: 139519 - DNA, 35 bp, Artificial Sequence
  Synthetic oligonucleotide
tgctcgctagtctgctacaccctccgtgtcccgcc

SEQ ID NO: 139520 - DNA, 35 bp, Artificial Sequence
  Synthetic oligonucleotide
gttcacctgcctccctgactcgttatcctgccgcc

SEQ ID NO: 139521 - DNA, 34 bp, Artificial Sequence
  Synthetic oligonucleotide
gcctgcccgcctgtcgtagttcgtcgccccccgc

SEQ ID NO: 139522 - DNA, 35 bp, Artificial Sequence
  Synthetic oligonucleotide
taagcactaccatctgcttttccagtctacttggc

SEQ ID NO: 139523 - DNA, 35 bp, Artificial Sequence
  Synthetic oligonucleotide
tgcgacgcagtacccttcacatcgcgttatccctc

SEQ ID NO: 139524 - DNA, 35 bp, Artificial Sequence
  Synthetic oligonucleotide
ataccatcgcccgaaggataccttcctgaactctc

SEQ ID NO: 139525 - DNA, 35 bp, Artificial Sequence
  Synthetic oligonucleotide
tcatttcactaccctatcagttttccaccgccgag

SEQ ID NO: 139526 - DNA, 35 bp, Artificial Sequence
  Synthetic oligonucleotide
tttccacgccccttgtcctcattacctagcccccg

SEQ ID NO: 139527 - DNA, 35 bp, Artificial Sequence
  Synthetic oligonucleotide
acttcacccccgcatatgctacctaggcaaccatg

SEQ ID NO: 139528 - DNA, 34 bp, Artificial Sequence
  Synthetic oligonucleotide
ggagagaccgaggggtggatgggggtctgtgttg

SEQ ID NO: 139529 - DNA, 35 bp, Artificial Sequence
  Synthetic oligonucleotide
ttgtccaccctactgccctgccatggaatgttcat

SEQ ID NO: 139530 - DNA, 35 bp, Artificial Sequence
  Synthetic oligonucleotide
tccattcccgtccgcccttttagtcacaactcgat

SEQ ID NO: 139531 - DNA, 35 bp, Artificial Sequence
  Synthetic oligonucleotide
ggggtacaatcgggcgaggggggtacagagggtat

SEQ ID NO: 139532 - DNA, 35 bp, Artificial Sequence
  Synthetic oligonucleotide
tccagaccacccgcgttaagttccagaacgcccct

SEQ ID NO: 139533 - DNA, 35 bp, Artificial Sequence
  Synthetic oligonucleotide
actcgccaatccttgcatacctacgcttctcgcct

SEQ ID NO: 139534 - DNA, 35 bp, Artificial Sequence
  Synthetic oligonucleotide
tagtccatccggtagcccgtccccagccaccagct

SEQ ID NO: 139535 - DNA, 35 bp, Artificial Sequence
  Synthetic oligonucleotide
ttgacacctgcccgcctccccatcgctgcccagct

SEQ ID NO: 139536 - DNA, 35 bp, Artificial Sequence
  Synthetic oligonucleotide
aaagagcacgtagagggaacaggtgaggggcaggt

SEQ ID NO: 139537 - DNA, 35 bp, Artificial Sequence
  Synthetic oligonucleotide
gtactgcccgctgatccgctatcagcctcctctaa

SEQ ID NO: 139538 - DNA, 36 bp, Artificial Sequence
  Synthetic oligonucleotide
accccctgatcctcatccgttcgccacaggccccca

SEQ ID NO: 139539 - DNA, 36 bp, Artificial Sequence
  Synthetic oligonucleotide
gcaccgcactatacttctttccgcagtgcgctccca

SEQ ID NO: 139540 - DNA, 36 bp, Artificial Sequence
  Synthetic oligonucleotide
atcaccgtcgcccgggcctcatattgtacttttcca

SEQ ID NO: 139541 - DNA, 36 bp, Artificial Sequence
  Synthetic oligonucleotide
tctgacatgctctgcgtgtcccattttagcccttca

SEQ ID NO: 139542 - DNA, 37 bp, Artificial Sequence
  Synthetic oligonucleotide
acccacgctcgcagccaataatgccttcctaacccga

SEQ ID NO: 139543 - DNA, 37 bp, Artificial Sequence
  Synthetic oligonucleotide
gaccgtgcgctgcagctctaagcccctccccgcccga

SEQ ID NO: 139544 - DNA, 37 bp, Artificial Sequence
  Synthetic oligonucleotide
gaggacaaagggcgggcaagggcagtttgcgggagga

SEQ ID NO: 139545 - DNA, 37 bp, Artificial Sequence
  Synthetic oligonucleotide
acacaccgccttcttacttcctccttatccggtagga

SEQ ID NO: 139546 - DNA, 38 bp, Artificial Sequence
  Synthetic oligonucleotide
tcctccgccccgttagactatgcgccgcctccgcctga

SEQ ID NO: 139547 - DNA, 38 bp, Artificial Sequence
  Synthetic oligonucleotide
tcacacccctgactagctgttcccatgttcccttgtga

SEQ ID NO: 139548 - DNA, 36 bp, Artificial Sequence
  Synthetic oligonucleotide
ttgccgggctggtgtccccttcctgtttatcgttga

SEQ ID NO: 139549 - DNA, 36 bp, Artificial Sequence
  Synthetic oligonucleotide
tgaccccccttgttgtccttatgcaacctgcttcta

SEQ ID NO: 139550 - DNA, 35 bp, Artificial Sequence
  Synthetic oligonucleotide
gtgggtcccttccctgtgtgtctactcttccttta

SEQ ID NO: 139551 - DNA, 35 bp, Artificial Sequence
  Synthetic oligonucleotide
ggggtggaggggcaagagtccgggggaagggaaac

SEQ ID NO: 139552 - DNA, 35 bp, Artificial Sequence
  Synthetic oligonucleotide
tatcaccggcgccgccccatggcctggcctcatcc

SEQ ID NO: 139553 - DNA, 35 bp, Artificial Sequence
  Synthetic oligonucleotide
gccagcaaggtcctcagcctaagaccccccgccgc

SEQ ID NO: 139554 - DNA, 35 bp, Artificial Sequence
  Synthetic oligonucleotide
tctgtaccctgctgttgataattcccacatctcgc

SEQ ID NO: 139555 - DNA, 35 bp, Artificial Sequence
  Synthetic oligonucleotide
accgcagccagctttccgtcttggcccatcctatc

SEQ ID NO: 139556 - DNA, 35 bp, Artificial Sequence
  Synthetic oligonucleotide
ggaggaggtcgcgggggaaggggcggcatatactc

SEQ ID NO: 139557 - DNA, 35 bp, Artificial Sequence
  Synthetic oligonucleotide
gcacctctatctggcttttccttacttctccgtag

SEQ ID NO: 139558 - DNA, 35 bp, Artificial Sequence
  Synthetic oligonucleotide
tggatcgtcaccgattccttcactctccgtccacg

SEQ ID NO: 139559 - DNA, 34 bp, Artificial Sequence
  Synthetic oligonucleotide
ttcgcacgaatccatgcgatacatgcccccccat

SEQ ID NO: 139560 - DNA, 35 bp, Artificial Sequence
  Synthetic oligonucleotide
gtgcgtcacccccgtccagtagtttcacatcccgt

SEQ ID NO: 139561 - DNA, 35 bp, Artificial Sequence
  Synthetic oligonucleotide
accttctcagcacacgcccgcctctccgttacggt

SEQ ID NO: 139562 - DNA, 36 bp, Artificial Sequence
  Synthetic oligonucleotide
gaggcggaaggtggagggcggcggaggcacagcgaa

SEQ ID NO: 139563 - DNA, 35 bp, Artificial Sequence
  Synthetic oligonucleotide
tcgatacccttcacttggccctataactgcttgca

SEQ ID NO: 139564 - DNA, 36 bp, Artificial Sequence
  Synthetic oligonucleotide
tcccgcctcttatcagctatcttcgccccgagctca

SEQ ID NO: 139565 - DNA, 37 bp, Artificial Sequence
  Synthetic oligonucleotide
atacgcctccgacttactgcaaccacctcgctaccga

SEQ ID NO: 139566 - DNA, 36 bp, Artificial Sequence
  Synthetic oligonucleotide
gtgcttgcactgtgacgctgacccaccctccgccga

SEQ ID NO: 139567 - DNA, 37 bp, Artificial Sequence
  Synthetic oligonucleotide
atccacgtcaaacaccgttctgcttccatccatccga

SEQ ID NO: 139568 - DNA, 35 bp, Artificial Sequence
  Synthetic oligonucleotide
gatcagaggggggtacgaggctaggagggcaagga

SEQ ID NO: 139569 - DNA, 38 bp, Artificial Sequence
  Synthetic oligonucleotide
tgtcctcccacattactccgagacgcccttccgccgga

SEQ ID NO: 139570 - DNA, 36 bp, Artificial Sequence
  Synthetic oligonucleotide
ggggacgggcaagggcataacgggggaaaggttgga

SEQ ID NO: 139571 - DNA, 37 bp, Artificial Sequence
  Synthetic oligonucleotide
acgatttgatgccgggtatagctccctccgccactga

SEQ ID NO: 139572 - DNA, 37 bp, Artificial Sequence
  Synthetic oligonucleotide
tccgccgcccatacattcttccgtctactcgtcctga

SEQ ID NO: 139573 - DNA, 37 bp, Artificial Sequence
  Synthetic oligonucleotide
acgcgggggaggggggaaggggatgaaagtatggtga

SEQ ID NO: 139574 - DNA, 38 bp, Artificial Sequence
  Synthetic oligonucleotide
gggaaagagggcgggaacgggatataggtcgggcttga

SEQ ID NO: 139575 - DNA, 35 bp, Artificial Sequence
  Synthetic oligonucleotide
acttgatcctccctgccgccgagaggctagccacc

SEQ ID NO: 139576 - DNA, 35 bp, Artificial Sequence
  Synthetic oligonucleotide
tgcccacgccctgcgcgtccggaacccatcctccc

SEQ ID NO: 139577 - DNA, 29 bp, Artificial Sequence
  Synthetic oligonucleotide
atgtgacatctccgccgtttccttgctcc

SEQ ID NO: 139578 - DNA, 35 bp, Artificial Sequence
  Synthetic oligonucleotide
gtcccccctcctgcccacttcgagaagttttctcc

SEQ ID NO: 139579 - DNA, 35 bp, Artificial Sequence
  Synthetic oligonucleotide
actcaccaacacccttcttgtatgcaagcagttcc

SEQ ID NO: 139580 - DNA, 35 bp, Artificial Sequence
  Synthetic oligonucleotide
tgttggtttgcacgtccgcctcgctcgttccccgc

SEQ ID NO: 139581 - DNA, 35 bp, Artificial Sequence
  Synthetic oligonucleotide
tagtcagggcgggtgggtcagggtggagtactatc

SEQ ID NO: 139582 - DNA, 35 bp, Artificial Sequence
  Synthetic oligonucleotide
aaccactcgctttctattcgctctctgtttagctc

SEQ ID NO: 139583 - DNA, 35 bp, Artificial Sequence
  Synthetic oligonucleotide
cctgccgtccagagccacccgcccttattgtcccg

SEQ ID NO: 139584 - DNA, 35 bp, Artificial Sequence
  Synthetic oligonucleotide
tccaccccctctcatgcacgggtcgcccgccgtgg

SEQ ID NO: 139585 - DNA, 35 bp, Artificial Sequence
  Synthetic oligonucleotide
gccccaagtcaccctgctctactttctcactgctg

SEQ ID NO: 139586 - DNA, 35 bp, Artificial Sequence
  Synthetic oligonucleotide
ttcacgtcaatggtactgtgccccctacatcctat

SEQ ID NO: 139587 - DNA, 35 bp, Artificial Sequence
  Synthetic oligonucleotide
ggctccccgtcccgcagcttttgtgcaacttctct

SEQ ID NO: 139588 - DNA, 35 bp, Artificial Sequence
  Synthetic oligonucleotide
accacctctgattcaatcaaccccgccccttctgt

SEQ ID NO: 139589 - DNA, 35 bp, Artificial Sequence
  Synthetic oligonucleotide
atccacccgttgtcgttactacaagcttaaccatt

SEQ ID NO: 139590 - DNA, 37 bp, Artificial Sequence
  Synthetic oligonucleotide
actctcgcccgttattgttcctcccgtcttgcaagga

SEQ ID NO: 139591 - DNA, 38 bp, Artificial Sequence
  Synthetic oligonucleotide
gtgcaacgcctgtctcttaacgccctgtcctcctatga

SEQ ID NO: 139592 - DNA, 37 bp, Artificial Sequence
  Synthetic oligonucleotide
aaccgcgaccaccgggtcctagaatcacctcccctga

SEQ ID NO: 139593 - DNA, 38 bp, Artificial Sequence
  Synthetic oligonucleotide
gacgtgaggcgctgttcgttctttcccctccctgttga

SEQ ID NO: 139594 - DNA, 36 bp, Artificial Sequence
  Synthetic oligonucleotide
acatccgcggatcatccgttctttccctgcccgcta

SEQ ID NO: 139595 - DNA, 35 bp, Artificial Sequence
  Synthetic oligonucleotide
tactcactgctgggataccgtgtcaccttcccccc

SEQ ID NO: 139596 - DNA, 35 bp, Artificial Sequence
  Synthetic oligonucleotide
gtccactacacctgctccacggattttttttagcc

SEQ ID NO: 139597 - DNA, 35 bp, Artificial Sequence
  Synthetic oligonucleotide
taccggtcctgccaaactgtctgcatctttcgtcc

SEQ ID NO: 139598 - DNA, 33 bp, Artificial Sequence
  Synthetic oligonucleotide
tcagacgctctgcgctttttcctacacccccgc

SEQ ID NO: 139599 - DNA, 35 bp, Artificial Sequence
  Synthetic oligonucleotide
gtgcgaccctgccccttcctagccaatcttctggc

SEQ ID NO: 139600 - DNA, 35 bp, Artificial Sequence
  Synthetic oligonucleotide
acgttaacccagtcgcacatgcttcctattccatc

SEQ ID NO: 139601 - DNA, 35 bp, Artificial Sequence
  Synthetic oligonucleotide
tctgttccaccgatcgcctatgttttcttgttttg

SEQ ID NO: 139602 - DNA, 35 bp, Artificial Sequence
  Synthetic oligonucleotide
gaacaccgctgccttggtccatcacaaatactcat

SEQ ID NO: 139603 - DNA, 35 bp, Artificial Sequence
  Synthetic oligonucleotide
atcgccgccgcccctccaatacaacaatcggcact

SEQ ID NO: 139604 - DNA, 35 bp, Artificial Sequence
  Synthetic oligonucleotide
gacccgaactcgtggtacattgtccgcccccacct

SEQ ID NO: 139605 - DNA, 35 bp, Artificial Sequence
  Synthetic oligonucleotide
agcatcaccctctcatggccatgtctctttatgct

SEQ ID NO: 139606 - DNA, 35 bp, Artificial Sequence
  Synthetic oligonucleotide
tagcgacggtgcgctcatccccccaaccttgttct

SEQ ID NO: 139607 - DNA, 34 bp, Artificial Sequence
  Synthetic oligonucleotide
gaaggggaggaacactatggaggctgaggacagt

SEQ ID NO: 139608 - DNA, 35 bp, Artificial Sequence
  Synthetic oligonucleotide
ttcaaccgcccgccccagacctacaccatccaggt

SEQ ID NO: 139609 - DNA, 35 bp, Artificial Sequence
  Synthetic oligonucleotide
gtccatcctactcattgtccagccacttatctggt

SEQ ID NO: 139610 - DNA, 35 bp, Artificial Sequence
  Synthetic oligonucleotide
accacttcccttccgcttacgtacgccgacacgtt

SEQ ID NO: 139611 - DNA, 36 bp, Artificial Sequence
  Synthetic oligonucleotide
ggttgacatgcggttacggggggaaggtgggtggaa

SEQ ID NO: 139612 - DNA, 36 bp, Artificial Sequence
  Synthetic oligonucleotide
aacgccattcctctcgctgtctcaacttggtgccca

SEQ ID NO: 139613 - DNA, 36 bp, Artificial Sequence
  Synthetic oligonucleotide
gccaattgccatgtgtccttcatctccatcccgcca

SEQ ID NO: 139614 - DNA, 35 bp, Artificial Sequence
  Synthetic oligonucleotide
acttgatgacgcctgacctagttctttcacctcca

SEQ ID NO: 139615 - DNA, 36 bp, Artificial Sequence
  Synthetic oligonucleotide
agaacaacgccgcctcgtactctcagcctttatgca

SEQ ID NO: 139616 - DNA, 36 bp, Artificial Sequence
  Synthetic oligonucleotide
tcaaggggggttaggggaggaagaagctggggtgca

SEQ ID NO: 139617 - DNA, 37 bp, Artificial Sequence
  Synthetic oligonucleotide
tgtggggagggttcgggagggaggccatgaagcaaga

SEQ ID NO: 139618 - DNA, 37 bp, Artificial Sequence
  Synthetic oligonucleotide
agtgtgggagttagggtgggaggggcagagaaaacga

SEQ ID NO: 139619 - DNA, 37 bp, Artificial Sequence
  Synthetic oligonucleotide
actccgccgtacgttgccgctcctctcgcagtcacga

SEQ ID NO: 139620 - DNA, 37 bp, Artificial Sequence
  Synthetic oligonucleotide
tcccgctcaccacacgcctcattacgctgtccacgga

SEQ ID NO: 139621 - DNA, 37 bp, Artificial Sequence
  Synthetic oligonucleotide
gacacataggcacagggttggagggggggtgtaggga

SEQ ID NO: 139622 - DNA, 37 bp, Artificial Sequence
  Synthetic oligonucleotide
atggggtagatagacgggatgggcacagggggaatga

SEQ ID NO: 139623 - DNA, 38 bp, Artificial Sequence
  Synthetic oligonucleotide
aagggaggataagggggggtgagtgcggggagtagtga

SEQ ID NO: 139624 - DNA, 38 bp, Artificial Sequence
  Synthetic oligonucleotide
gcagtctggggcatggtggggtagaacgggaacggtga

SEQ ID NO: 139625 - DNA, 38 bp, Artificial Sequence
  Synthetic oligonucleotide
accaccgccacatctcatgcgactgttttctctcttga

SEQ ID NO: 139626 - DNA, 36 bp, Artificial Sequence
  Synthetic oligonucleotide
taaacgaggtggaggagggggatgtcacggttgata

SEQ ID NO: 139627 - DNA, 35 bp, Artificial Sequence
  Synthetic oligonucleotide
tgttcgtcccacctagcaccgtgtccagccgccta

SEQ ID NO: 139628 - DNA, 36 bp, Artificial Sequence
  Synthetic oligonucleotide
tgcaaagccgccgcccccgttttgttcaatggccta

SEQ ID NO: 139629 - DNA, 36 bp, Artificial Sequence
  Synthetic oligonucleotide
actgcacctcccgggctagcaacaacatctctccta

SEQ ID NO: 139630 - DNA, 35 bp, Artificial Sequence
  Synthetic oligonucleotide
catcccccgtactgtatcattaaggctaccgtgac

SEQ ID NO: 139631 - DNA, 35 bp, Artificial Sequence
  Synthetic oligonucleotide
gttgtgttccctgcacgtcatttttatcgccctac

SEQ ID NO: 139632 - DNA, 35 bp, Artificial Sequence
  Synthetic oligonucleotide
tacacccctccctggttgctcaaagcccttcaacc

SEQ ID NO: 139633 - DNA, 35 bp, Artificial Sequence
  Synthetic oligonucleotide
tctaacgcgagtccgcttctcgttctttgctcacc

SEQ ID NO: 139634 - DNA, 35 bp, Artificial Sequence
  Synthetic oligonucleotide
tccaccagcaatatgcgttcccaagtcctatctcc

SEQ ID NO: 139635 - DNA, 35 bp, Artificial Sequence
  Synthetic oligonucleotide
tgtgcccctcactatgcttttgttgctcctgcggc

SEQ ID NO: 139636 - DNA, 33 bp, Artificial Sequence
  Synthetic oligonucleotide
tgagctcagatacccgcttcattcctgctgctc

SEQ ID NO: 139637 - DNA, 35 bp, Artificial Sequence
  Synthetic oligonucleotide
tcaccccggccccattgacgttgtactttcccttc

SEQ ID NO: 139638 - DNA, 35 bp, Artificial Sequence
  Synthetic oligonucleotide
ttcagcgcctcgttcagtcgcgtgccgtttccttc

SEQ ID NO: 139639 - DNA, 35 bp, Artificial Sequence
  Synthetic oligonucleotide
gacacctacacgtattccctccaatagcctgcttc

SEQ ID NO: 139640 - DNA, 35 bp, Artificial Sequence
  Synthetic oligonucleotide
ggacccatccgccctattgagccttgcccatgttc

SEQ ID NO: 139641 - DNA, 35 bp, Artificial Sequence
  Synthetic oligonucleotide
tggagccttccgccgatctagctccatcctacact

SEQ ID NO: 139642 - DNA, 35 bp, Artificial Sequence
  Synthetic oligonucleotide
atcctatgcatcaacgggttgtatgcgtgcttact

SEQ ID NO: 139643 - DNA, 35 bp, Artificial Sequence
  Synthetic oligonucleotide
actcacctttttgtgtctggtccgacttccaccct

SEQ ID NO: 139644 - DNA, 35 bp, Artificial Sequence
  Synthetic oligonucleotide
tctaactccgccctcacgtgtgcctcctcaactct

SEQ ID NO: 139645 - DNA, 35 bp, Artificial Sequence
  Synthetic oligonucleotide
gcccacccccatgcagtgctttgatcgcatcacaa

SEQ ID NO: 139646 - DNA, 36 bp, Artificial Sequence
  Synthetic oligonucleotide
tcccgcgcaccatcttttaaatcgttaggcaaccaa

SEQ ID NO: 139647 - DNA, 36 bp, Artificial Sequence
  Synthetic oligonucleotide
gacctgccgggggggggtaaaatgctggggagggaa

SEQ ID NO: 139648 - DNA, 36 bp, Artificial Sequence
  Synthetic oligonucleotide
agcaccccctgatttcttcgtccctccggtttggaa

SEQ ID NO: 139649 - DNA, 35 bp, Artificial Sequence
  Synthetic oligonucleotide
actgccctgcctggcccgtgtcaccggtctctaca

SEQ ID NO: 139650 - DNA, 36 bp, Artificial Sequence
  Synthetic oligonucleotide
gacccacaccgattgtcttaagccgccgtccgccca

SEQ ID NO: 139651 - DNA, 36 bp, Artificial Sequence
  Synthetic oligonucleotide
atgtgacaccgttcatgcattcgccatctacctcca

SEQ ID NO: 139652 - DNA, 37 bp, Artificial Sequence
  Synthetic oligonucleotide
gaggacgatcggagaaggggaggggatttggcagaga

SEQ ID NO: 139653 - DNA, 37 bp, Artificial Sequence
  Synthetic oligonucleotide
cccaggggctccaatgtgggtgtatagggcggggaga

SEQ ID NO: 139654 - DNA, 36 bp, Artificial Sequence
  Synthetic oligonucleotide
gagaggaagaattgaaagggtgaactggggaaggga

SEQ ID NO: 139655 - DNA, 37 bp, Artificial Sequence
  Synthetic oligonucleotide
gccggaacagggaattgggacgggtgagggtttggga

SEQ ID NO: 139656 - DNA, 37 bp, Artificial Sequence
  Synthetic oligonucleotide
tgcaaccagtctgttcccgttcgtttgttccccatga

SEQ ID NO: 139657 - DNA, 36 bp, Artificial Sequence
  Synthetic oligonucleotide
gtccatcacatcacgccgttacaaatacctccctga

SEQ ID NO: 139658 - DNA, 36 bp, Artificial Sequence
  Synthetic oligonucleotide
gcctattccgccactgttgcctgcacatcccacata

SEQ ID NO: 139659 - DNA, 36 bp, Artificial Sequence
  Synthetic oligonucleotide
tccacctccggctccggcctactccatccctgccta

SEQ ID NO: 139660 - DNA, 36 bp, Artificial Sequence
  Synthetic oligonucleotide
gacacgcggcgcaaagtgagggcggggaggggcgta

SEQ ID NO: 139661 - DNA, 36 bp, Artificial Sequence
  Synthetic oligonucleotide
tccccacctcgtctcccggtgcactatatcgcatta

SEQ ID NO: 139662 - DNA, 35 bp, Artificial Sequence
  Synthetic oligonucleotide
ttggttgggcgggagggggcattctgtgggtaaac

SEQ ID NO: 139663 - DNA, 35 bp, Artificial Sequence
  Synthetic oligonucleotide
gaaggcaccgtttagtactccgcacttccgccgcc

SEQ ID NO: 139664 - DNA, 35 bp, Artificial Sequence
  Synthetic oligonucleotide
gtcgtatggcatccgtttcgcccgcgctcctcgcc

SEQ ID NO: 139665 - DNA, 35 bp, Artificial Sequence
  Synthetic oligonucleotide
atcgacgccgatcgtacaaacctatgcctttatcc

SEQ ID NO: 139666 - DNA, 35 bp, Artificial Sequence
  Synthetic oligonucleotide
ggtcgcatggcctccttcaccctggtcttgtttcc

SEQ ID NO: 139667 - DNA, 35 bp, Artificial Sequence
  Synthetic oligonucleotide
ttgactgcaggccaaccgcacgcttccccacacgc

SEQ ID NO: 139668 - DNA, 35 bp, Artificial Sequence
  Synthetic oligonucleotide
gtctccccgcacacttttctcccttcaggcgtatc

SEQ ID NO: 139669 - DNA, 35 bp, Artificial Sequence
  Synthetic oligonucleotide
gttcgcacggtgcacgaactatattaccatcctag

SEQ ID NO: 139670 - DNA, 35 bp, Artificial Sequence
  Synthetic oligonucleotide
gcgacaaccctactcactgtaaccgcccccacacg

SEQ ID NO: 139671 - DNA, 35 bp, Artificial Sequence
  Synthetic oligonucleotide
gacgctcgccccctgtgccctatgtatatccccgg

SEQ ID NO: 139672 - DNA, 35 bp, Artificial Sequence
  Synthetic oligonucleotide
tattccacccgctccacacttacgccttccacatg

SEQ ID NO: 139673 - DNA, 35 bp, Artificial Sequence
  Synthetic oligonucleotide
accaccacctgttaacacacccatgtacgctcatg

SEQ ID NO: 139674 - DNA, 35 bp, Artificial Sequence
  Synthetic oligonucleotide
tgcggccctcgctccatcacaccccctgctcattg

SEQ ID NO: 139675 - DNA, 35 bp, Artificial Sequence
  Synthetic oligonucleotide
gtatgctacctcgatcgccctgttcccctctcttg

SEQ ID NO: 139676 - DNA, 35 bp, Artificial Sequence
  Synthetic oligonucleotide
tcctcctgcttacacctggcccctatccgttccat

SEQ ID NO: 139677 - DNA, 35 bp, Artificial Sequence
  Synthetic oligonucleotide
gttgcaaccagattcagcccgctccacgaccccgt

SEQ ID NO: 139678 - DNA, 35 bp, Artificial Sequence
  Synthetic oligonucleotide
atctacacgccaatgacttcgccggcccccatctt

SEQ ID NO: 139679 - DNA, 36 bp, Artificial Sequence
  Synthetic oligonucleotide
atcgcttcaccagccttctacccgtccgcttgccaa

SEQ ID NO: 139680 - DNA, 35 bp, Artificial Sequence
  Synthetic oligonucleotide
tagtcccgcccgcatacgatcactgctaccttcaa

SEQ ID NO: 139681 - DNA, 33 bp, Artificial Sequence
  Synthetic oligonucleotide
aacgccctaacccctcccgtcaccgtttggtaa

SEQ ID NO: 139682 - DNA, 36 bp, Artificial Sequence
  Synthetic oligonucleotide
atggacatgcccgtcactagctctttcgttctctca

SEQ ID NO: 139683 - DNA, 35 bp, Artificial Sequence
  Synthetic oligonucleotide
tcgacggaagcgagaaaggggagggggggacgaga

SEQ ID NO: 139684 - DNA, 35 bp, Artificial Sequence
  Synthetic oligonucleotide
atcacctcccatccagctaggtgcttagctcccga

SEQ ID NO: 139685 - DNA, 37 bp, Artificial Sequence
  Synthetic oligonucleotide
gacccacccctggttgcccccgccttctatgttgcga

SEQ ID NO: 139686 - DNA, 37 bp, Artificial Sequence
  Synthetic oligonucleotide
tactccgcctcactgctcttaacgattagtctctcga

SEQ ID NO: 139687 - DNA, 36 bp, Artificial Sequence
  Synthetic oligonucleotide
gtgggagccgagttaggggagtaggggctgagcgga

SEQ ID NO: 139688 - DNA, 36 bp, Artificial Sequence
  Synthetic oligonucleotide
gactaggcggggacaagggggaccagcgggaaggga

SEQ ID NO: 139689 - DNA, 36 bp, Artificial Sequence
  Synthetic oligonucleotide
ttggtcgcgatccctgccctgtactttctctctgga

SEQ ID NO: 139690 - DNA, 38 bp, Artificial Sequence
  Synthetic oligonucleotide
aagaaagggcgggggaggcggaggggactagcgcatga

SEQ ID NO: 139691 - DNA, 38 bp, Artificial Sequence
  Synthetic oligonucleotide
tacgttgtgcctcgcgatttgcttcatcacacccctga

SEQ ID NO: 139692 - DNA, 37 bp, Artificial Sequence
  Synthetic oligonucleotide
tcagaagcgacacccccgtaccattcccccggcctga

SEQ ID NO: 139693 - DNA, 37 bp, Artificial Sequence
  Synthetic oligonucleotide
atccagccacacgttgattccttgttctccctgctga

SEQ ID NO: 139694 - DNA, 37 bp, Artificial Sequence
  Synthetic oligonucleotide
attggtgaggggggagggggggaggcaggggatgtga

SEQ ID NO: 139695 - DNA, 35 bp, Artificial Sequence
  Synthetic oligonucleotide
atgcggtactcctccggttcctgtttgccccccta

SEQ ID NO: 139696 - DNA, 36 bp, Artificial Sequence
  Synthetic oligonucleotide
ttgagggtgggatgcatgggggggaggataaccgta

SEQ ID NO: 139697 - DNA, 35 bp, Artificial Sequence
  Synthetic oligonucleotide
tgtgcccgcacctcgtactctgcatctcgttgtta

SEQ ID NO: 139698 - DNA, 35 bp, Artificial Sequence
  Synthetic oligonucleotide
tcatttcgccgcccggcaccgcccctatgacaccc

SEQ ID NO: 139699 - DNA, 35 bp, Artificial Sequence
  Synthetic oligonucleotide
tcccagcactcgccccgtcggtaatggctctaccc

SEQ ID NO: 139700 - DNA, 35 bp, Artificial Sequence
  Synthetic oligonucleotide
tgccctcctcgtgtaacgatattcgattccctccc

SEQ ID NO: 139701 - DNA, 35 bp, Artificial Sequence
  Synthetic oligonucleotide
gctaccacttcagccttgactcgttacttccagcc

SEQ ID NO: 139702 - DNA, 35 bp, Artificial Sequence
  Synthetic oligonucleotide
tcacctaccccctttttgtttcttacggccatcgc

SEQ ID NO: 139703 - DNA, 35 bp, Artificial Sequence
  Synthetic oligonucleotide
gcagagaccgtgtgtcaccctccccccttcggatc

SEQ ID NO: 139704 - DNA, 35 bp, Artificial Sequence
  Synthetic oligonucleotide
acaagccgccgcccctgggaccctagactgcactc

SEQ ID NO: 139705 - DNA, 35 bp, Artificial Sequence
  Synthetic oligonucleotide
tgcagggagattttgcgctccccttcccctcggtc

SEQ ID NO: 139706 - DNA, 35 bp, Artificial Sequence
  Synthetic oligonucleotide
atgtgcagtgagggcgtgggttgagggtgagggag

SEQ ID NO: 139707 - DNA, 35 bp, Artificial Sequence
  Synthetic oligonucleotide
tatgtaccccctgataccgtacgccgccccaaccg

SEQ ID NO: 139708 - DNA, 35 bp, Artificial Sequence
  Synthetic oligonucleotide
tacccctccgctctcctgccatctacgacgcaccg

SEQ ID NO: 139709 - DNA, 35 bp, Artificial Sequence
  Synthetic oligonucleotide
tatgactagcctcacccaggatactggcccctccg

SEQ ID NO: 139710 - DNA, 35 bp, Artificial Sequence
  Synthetic oligonucleotide
gacaccaccgcgagtttcatcctgttccttcttgg

SEQ ID NO: 139711 - DNA, 35 bp, Artificial Sequence
  Synthetic oligonucleotide
tccggaccccgtcctgtggttcctttcgtactctg

SEQ ID NO: 139712 - DNA, 35 bp, Artificial Sequence
  Synthetic oligonucleotide
gatacatccgatagccttccttccctgccgtgcct

SEQ ID NO: 139713 - DNA, 35 bp, Artificial Sequence
  Synthetic oligonucleotide
accgtccgcacttcaacacgccttctccaagccgt

SEQ ID NO: 139714 - DNA, 35 bp, Artificial Sequence
  Synthetic oligonucleotide
tcagcactgcaccacatccaagacctctcacgctt

SEQ ID NO: 139715 - DNA, 35 bp, Artificial Sequence
  Synthetic oligonucleotide
aacgagtcacccgcgttcttcccctggccgtgctt

SEQ ID NO: 139716 - DNA, 35 bp, Artificial Sequence
  Synthetic oligonucleotide
gttgcgacacggggttccaccatcctgttcctctt

SEQ ID NO: 139717 - DNA, 30 bp, Artificial Sequence
  Synthetic oligonucleotide
atcaccgcccttcgattacgctccatccaa

SEQ ID NO: 139718 - DNA, 35 bp, Artificial Sequence
  Synthetic oligonucleotide
tgcacacccctcaggtagtcatcttcctccgttaa

SEQ ID NO: 139719 - DNA, 36 bp, Artificial Sequence
  Synthetic oligonucleotide
tcagcccgcattgctacatcctccgtgccccccaca

SEQ ID NO: 139720 - DNA, 36 bp, Artificial Sequence
  Synthetic oligonucleotide
accgcaacaggggggagttgggggggaatggtgaca

SEQ ID NO: 139721 - DNA, 36 bp, Artificial Sequence
  Synthetic oligonucleotide
gccttcgcctcgcatggaccatcgctttctacctca

SEQ ID NO: 139722 - DNA, 35 bp, Artificial Sequence
  Synthetic oligonucleotide
gcttggcccctccgcaacgtgcccgctgactctca

SEQ ID NO: 139723 - DNA, 37 bp, Artificial Sequence
  Synthetic oligonucleotide
tttccgacccgccttccgacttcccagacaggtacga

SEQ ID NO: 139724 - DNA, 37 bp, Artificial Sequence
  Synthetic oligonucleotide
atcccgtaccgctcacattggccccccatttactcga

SEQ ID NO: 139725 - DNA, 36 bp, Artificial Sequence
  Synthetic oligonucleotide
tgctgagtcaactttcacgccactccatccctcgga

SEQ ID NO: 139726 - DNA, 37 bp, Artificial Sequence
  Synthetic oligonucleotide
gaaggtgagggcaggaaagggaccggggtatgcggga

SEQ ID NO: 139727 - DNA, 37 bp, Artificial Sequence
  Synthetic oligonucleotide
agccgggggccttagaagggtaggggctgagggggga

SEQ ID NO: 139728 - DNA, 37 bp, Artificial Sequence
  Synthetic oligonucleotide
acgatgggagggcggtgcgggggcgataagcgtatga

SEQ ID NO: 139729 - DNA, 36 bp, Artificial Sequence
  Synthetic oligonucleotide
tccatcctccccggatgtcatctacacccctctcta

SEQ ID NO: 139730 - DNA, 36 bp, Artificial Sequence
  Synthetic oligonucleotide
agtttgcccagctttccgttatgcctgatttctcta

SEQ ID NO: 139731 - DNA, 35 bp, Artificial Sequence
  Synthetic oligonucleotide
tacccgccccgaatgtctttttctggaccgcctta

SEQ ID NO: 139732 - DNA, 35 bp, Artificial Sequence
  Synthetic oligonucleotide
gtacccattcccacctggccaagaggcttgttcac

SEQ ID NO: 139733 - DNA, 35 bp, Artificial Sequence
  Synthetic oligonucleotide
acccaacgccctgtttcccgagaacagcgtctccc

SEQ ID NO: 139734 - DNA, 35 bp, Artificial Sequence
  Synthetic oligonucleotide
gcactctcgtcctccgggccgtaacctcccaccgc

SEQ ID NO: 139735 - DNA, 34 bp, Artificial Sequence
  Synthetic oligonucleotide
gatcaccactctgacgtccccgccacactttcgc

SEQ ID NO: 139736 - DNA, 35 bp, Artificial Sequence
  Synthetic oligonucleotide
accaccgatcctatacgcaacttccccccacatgc

SEQ ID NO: 139737 - DNA, 35 bp, Artificial Sequence
  Synthetic oligonucleotide
aacacaatgccaccgtacgcaccacaagcacctgc

SEQ ID NO: 139738 - DNA, 35 bp, Artificial Sequence
  Synthetic oligonucleotide
tcacttgactcaatgccccctccgccgctcacccg

SEQ ID NO: 139739 - DNA, 35 bp, Artificial Sequence
  Synthetic oligonucleotide
gtgtgtcctgaccctgccctttgtatgcacccccg

SEQ ID NO: 139740 - DNA, 35 bp, Artificial Sequence
  Synthetic oligonucleotide
taacgccacccactttcgattatcaataccccccg

SEQ ID NO: 139741 - DNA, 35 bp, Artificial Sequence
  Synthetic oligonucleotide
accctactacctccgctgtggatcctccgcatccg

SEQ ID NO: 139742 - DNA, 35 bp, Artificial Sequence
  Synthetic oligonucleotide
tcacccaccatcgtgcctgcccgcttccctcttcg

SEQ ID NO: 139743 - DNA, 35 bp, Artificial Sequence
  Synthetic oligonucleotide
acgtccactcctgttgttggtccctgttcttggtg

SEQ ID NO: 139744 - DNA, 35 bp, Artificial Sequence
  Synthetic oligonucleotide
gccaacctcacgacttcttcagtaccaggctccat

SEQ ID NO: 139745 - DNA, 35 bp, Artificial Sequence
  Synthetic oligonucleotide
ttgatcggccgatactagtcgcctggttgccccct

SEQ ID NO: 139746 - DNA, 35 bp, Artificial Sequence
  Synthetic oligonucleotide
gcccatcgcctgcaaccgtcttactttttcgccct

SEQ ID NO: 139747 - DNA, 35 bp, Artificial Sequence
  Synthetic oligonucleotide
tcctcgcacacgtactatctccccctcttttaggt

SEQ ID NO: 139748 - DNA, 35 bp, Artificial Sequence
  Synthetic oligonucleotide
gcctgtcctaactgctctatgcctgctccttctgt

SEQ ID NO: 139749 - DNA, 35 bp, Artificial Sequence
  Synthetic oligonucleotide
tccctgtcacctgcacatgcttttaactatcactt

SEQ ID NO: 139750 - DNA, 35 bp, Artificial Sequence
  Synthetic oligonucleotide
acgccatgcggttcatcgccgccgccctacgtgtt

SEQ ID NO: 139751 - DNA, 36 bp, Artificial Sequence
  Synthetic oligonucleotide
gcaccactcacctgagttattctcgttcgttctaaa

SEQ ID NO: 139752 - DNA, 36 bp, Artificial Sequence
  Synthetic oligonucleotide
acttggagggagggggggtagagagctatgggccaa

SEQ ID NO: 139753 - DNA, 35 bp, Artificial Sequence
  Synthetic oligonucleotide
ttgacaccgcttatccgccttagacctcctcataa

SEQ ID NO: 139754 - DNA, 36 bp, Artificial Sequence
  Synthetic oligonucleotide
gtagggtgcaagggagggcgggcggtaaggtgatga

SEQ ID NO: 139755 - DNA, 36 bp, Artificial Sequence
  Synthetic oligonucleotide
attaccccacccgtctcccgttgtttacctcgctga

SEQ ID NO: 139756 - DNA, 38 bp, Artificial Sequence
  Synthetic oligonucleotide
aatagccgctgcacttcgccccttcacatggaatctga

SEQ ID NO: 139757 - DNA, 36 bp, Artificial Sequence
  Synthetic oligonucleotide
tacccatcgcactgcccttcctactaaacactgtga

SEQ ID NO: 139758 - DNA, 36 bp, Artificial Sequence
  Synthetic oligonucleotide
ttcaactcccctcccgtcacagggacagccccccta

SEQ ID NO: 139759 - DNA, 36 bp, Artificial Sequence
  Synthetic oligonucleotide
ttgactcccctccacacgtgcacttccatgggctta

SEQ ID NO: 139760 - DNA, 35 bp, Artificial Sequence
  Synthetic oligonucleotide
accgccccgcaatcaccttcatgtgccccgttaac

SEQ ID NO: 139761 - DNA, 35 bp, Artificial Sequence
  Synthetic oligonucleotide
gacccatgccgcctcactttcataaaccgggtcac

SEQ ID NO: 139762 - DNA, 35 bp, Artificial Sequence
  Synthetic oligonucleotide
agcccacccctgcgattcttatgcttctggcaacc

SEQ ID NO: 139763 - DNA, 35 bp, Artificial Sequence
  Synthetic oligonucleotide
atacctgccgtcctgagtgctctttcaactcgccc

SEQ ID NO: 139764 - DNA, 35 bp, Artificial Sequence
  Synthetic oligonucleotide
acctccacggtccctttcatggacacgccttgccc

SEQ ID NO: 139765 - DNA, 35 bp, Artificial Sequence
  Synthetic oligonucleotide
atcgtaccagtcccacccgcgagagcctgagttcc

SEQ ID NO: 139766 - DNA, 35 bp, Artificial Sequence
  Synthetic oligonucleotide
acgaagcgctgggtagggggggcaatgaacgggct

SEQ ID NO: 139767 - DNA, 35 bp, Artificial Sequence
  Synthetic oligonucleotide
acagatcgccgtctcttaccccctctccgacttgt

SEQ ID NO: 139768 - DNA, 35 bp, Artificial Sequence
  Synthetic oligonucleotide
gacgactgctcacaacgccctcacgtctctgcttt

SEQ ID NO: 139769 - DNA, 36 bp, Artificial Sequence
  Synthetic oligonucleotide
acgcccatccccgcctgatagaaccccgcactctaa

SEQ ID NO: 139770 - DNA, 36 bp, Artificial Sequence
  Synthetic oligonucleotide
ttgatgtccgcgcagattagccctctcctccgttaa

SEQ ID NO: 139771 - DNA, 36 bp, Artificial Sequence
  Synthetic oligonucleotide
gcaaagcaccaacctgtctcatccgttctgccgcca

SEQ ID NO: 139772 - DNA, 36 bp, Artificial Sequence
  Synthetic oligonucleotide
gcgatcaactgatgtgctctctcctcctcaccctca

SEQ ID NO: 139773 - DNA, 36 bp, Artificial Sequence
  Synthetic oligonucleotide
gcgctgactgccacggttatgcccccagtcccttca

SEQ ID NO: 139774 - DNA, 37 bp, Artificial Sequence
  Synthetic oligonucleotide
gacaccgctcgccccatccagagcccccctgtttaga

SEQ ID NO: 139775 - DNA, 38 bp, Artificial Sequence
  Synthetic oligonucleotide
gcaccagacaggtgatcgccgccaccctttttgaccga

SEQ ID NO: 139776 - DNA, 37 bp, Artificial Sequence
  Synthetic oligonucleotide
ggacgggaagtaaggtggatggtaaggtggtgggcga

SEQ ID NO: 139777 - DNA, 37 bp, Artificial Sequence
  Synthetic oligonucleotide
gctccacctctcgactgtatcccttctgcatattcga

SEQ ID NO: 139778 - DNA, 38 bp, Artificial Sequence
  Synthetic oligonucleotide
ttccgcccgctcgcatggcgttcttgttccctctatga

SEQ ID NO: 139779 - DNA, 37 bp, Artificial Sequence
  Synthetic oligonucleotide
tgctgccacgctccgttgtttgatttcttctccgtga

SEQ ID NO: 139780 - DNA, 38 bp, Artificial Sequence
  Synthetic oligonucleotide
ttcaaccaggggagggtgggaaagggggttataattga

SEQ ID NO: 139781 - DNA, 35 bp, Artificial Sequence
  Synthetic oligonucleotide
tcgacgaacccctccgttgtcgccaactgccacta

SEQ ID NO: 139782 - DNA, 34 bp, Artificial Sequence
  Synthetic oligonucleotide
accacctcggtgttctacaattgtacccacccta

SEQ ID NO: 139783 - DNA, 35 bp, Artificial Sequence
  Synthetic oligonucleotide
tgccctgcaaccccctcctgcttactacctagacc

SEQ ID NO: 139784 - DNA, 35 bp, Artificial Sequence
  Synthetic oligonucleotide
gacaaaccctgcccttcggttacatgcctacgacc

SEQ ID NO: 139785 - DNA, 34 bp, Artificial Sequence
  Synthetic oligonucleotide
gtcaccctcgacctcctgctaatctgccccgccc

SEQ ID NO: 139786 - DNA, 35 bp, Artificial Sequence
  Synthetic oligonucleotide
tatgccacccatgcagtgcaggcctaccctgctcc

SEQ ID NO: 139787 - DNA, 34 bp, Artificial Sequence
  Synthetic oligonucleotide
gcctgcccgcctgtctgagttcgtcgccccccgc

SEQ ID NO: 139788 - DNA, 34 bp, Artificial Sequence
  Synthetic oligonucleotide
gacaactgcccaggctcagaacgtccacctctgc

SEQ ID NO: 139789 - DNA, 35 bp, Artificial Sequence
  Synthetic oligonucleotide
gtgtggctttcgatctgccgcgttctcccgcactc

SEQ ID NO: 139790 - DNA, 35 bp, Artificial Sequence
  Synthetic oligonucleotide
gccccactcgccttttgtgacgttttaatctactc

SEQ ID NO: 139791 - DNA, 35 bp, Artificial Sequence
  Synthetic oligonucleotide
taaagtgggcgaggggggggaaaagtagcaacgtc

SEQ ID NO: 139792 - DNA, 35 bp, Artificial Sequence
  Synthetic oligonucleotide
tatccacgaactttgtccttacaccgcccccgacg

SEQ ID NO: 139793 - DNA, 35 bp, Artificial Sequence
  Synthetic oligonucleotide
ttcgtaccattccgcacctgatttttcccccaccg

SEQ ID NO: 139794 - DNA, 33 bp, Artificial Sequence
  Synthetic oligonucleotide
gcatcacctcaatctcaggcccactttatttcg

SEQ ID NO: 139795 - DNA, 35 bp, Artificial Sequence
  Synthetic oligonucleotide
tgccgtgtaccaacctcattgcgcccccttgttgg

SEQ ID NO: 139796 - DNA, 35 bp, Artificial Sequence
  Synthetic oligonucleotide
acccgccgaccataccgacgctatattctgcccat

SEQ ID NO: 139797 - DNA, 35 bp, Artificial Sequence
  Synthetic oligonucleotide
acaaccgcatcgtgctcattccacccgtccggcat

SEQ ID NO: 139798 - DNA, 35 bp, Artificial Sequence
  Synthetic oligonucleotide
gagggatgagtacgggagtaggggtggtggggcat

SEQ ID NO: 139799 - DNA, 35 bp, Artificial Sequence
  Synthetic oligonucleotide
gtaccaccgcctcctcacactacttcgggctacct

SEQ ID NO: 139800 - DNA, 35 bp, Artificial Sequence
  Synthetic oligonucleotide
acacgtgccacctacacgctagcctccacgaccct

SEQ ID NO: 139801 - DNA, 35 bp, Artificial Sequence
  Synthetic oligonucleotide
gcccgcttccgtactatgcgtcaggacttcatcct

SEQ ID NO: 139802 - DNA, 35 bp, Artificial Sequence
  Synthetic oligonucleotide
acaacgtcgatcggcacttctgcccccgccccggt

SEQ ID NO: 139803 - DNA, 35 bp, Artificial Sequence
  Synthetic oligonucleotide
tcacaatgctctctcccacgttgtcctggatcctt

SEQ ID NO: 139804 - DNA, 36 bp, Artificial Sequence
  Synthetic oligonucleotide
tcccacccacatgcataccgatattctagctttgaa

SEQ ID NO: 139805 - DNA, 35 bp, Artificial Sequence
  Synthetic oligonucleotide
atccgtagccccgacccgattattgtcacccttaa

SEQ ID NO: 139806 - DNA, 35 bp, Artificial Sequence
  Synthetic oligonucleotide
acacgacctctgcttagctcctgcctttctcacca

SEQ ID NO: 139807 - DNA, 36 bp, Artificial Sequence
  Synthetic oligonucleotide
ttttgcgcgctagttcgatactcgctgccctcccca

SEQ ID NO: 139808 - DNA, 36 bp, Artificial Sequence
  Synthetic oligonucleotide
aagacgccgtcaatactgtctgctacctgttcccca

SEQ ID NO: 139809 - DNA, 36 bp, Artificial Sequence
  Synthetic oligonucleotide
accaacagtgcgaggaaggcaggggggggttgaaga

SEQ ID NO: 139810 - DNA, 36 bp, Artificial Sequence
  Synthetic oligonucleotide
agacactatcgggacgcgattgccccctttctccga

SEQ ID NO: 139811 - DNA, 37 bp, Artificial Sequence
  Synthetic oligonucleotide
gtgtacgggcggggttgttgtgggtggggttgtgcga

SEQ ID NO: 139812 - DNA, 37 bp, Artificial Sequence
  Synthetic oligonucleotide
gtgtcaggggtgtgcgaacgggaaaggggggggcgga

SEQ ID NO: 139813 - DNA, 35 bp, Artificial Sequence
  Synthetic oligonucleotide
aggtgggagttggggaaaggggggacaagagggga

SEQ ID NO: 139814 - DNA, 38 bp, Artificial Sequence
  Synthetic oligonucleotide
acgccgccccccgacgtttatcaccgttccctcagtga

SEQ ID NO: 139815 - DNA, 38 bp, Artificial Sequence
  Synthetic oligonucleotide
gaggggggaaggggagtcgaacgccgacagtactttga

SEQ ID NO: 139816 - DNA, 36 bp, Artificial Sequence
  Synthetic oligonucleotide
tcctcaccgcgtcccgtcgatctcgtgccatcacta

SEQ ID NO: 139817 - DNA, 36 bp, Artificial Sequence
  Synthetic oligonucleotide
tccgacctaccacaaggataatgtctgccttcccta

SEQ ID NO: 139818 - DNA, 36 bp, Artificial Sequence
  Synthetic oligonucleotide
gtggacggtgagggcggagggagaatttgagaggta

SEQ ID NO: 139819 - DNA, 35 bp, Artificial Sequence
  Synthetic oligonucleotide
ttattccggaggtggagggggtcgagggggcggta

SEQ ID NO: 139820 - DNA, 36 bp, Artificial Sequence
  Synthetic oligonucleotide
tcatccactctcaccatggccaaacgcacaactgta

SEQ ID NO: 139821 - DNA, 35 bp, Artificial Sequence
  Synthetic oligonucleotide
gctgaccgctactagctccctccgcgaccatacac

SEQ ID NO: 139822 - DNA, 35 bp, Artificial Sequence
  Synthetic oligonucleotide
tcctaacccgctccgtgcctaacagcccaacatac

SEQ ID NO: 139823 - DNA, 35 bp, Artificial Sequence
  Synthetic oligonucleotide
gcacccatccacatgtcattttttgttcggtttac

SEQ ID NO: 139824 - DNA, 35 bp, Artificial Sequence
  Synthetic oligonucleotide
tcccgccgtgtcaacttctatactctgtccgcacc

SEQ ID NO: 139825 - DNA, 35 bp, Artificial Sequence
  Synthetic oligonucleotide
tccgccctctctcgggacgaatccaaggaactccc

SEQ ID NO: 139826 - DNA, 35 bp, Artificial Sequence
  Synthetic oligonucleotide
gcaccaccctttgaataatcccgttctggccttcc

SEQ ID NO: 139827 - DNA, 35 bp, Artificial Sequence
  Synthetic oligonucleotide
gacctgtcgcttttcgttatcgggtcaccgtttcc

SEQ ID NO: 139828 - DNA, 33 bp, Artificial Sequence
  Synthetic oligonucleotide
tcagactggtttttcgcccgctccgccacatgc

SEQ ID NO: 139829 - DNA, 35 bp, Artificial Sequence
  Synthetic oligonucleotide
gggtcatgatcagcgagttccgtcccacccactgc

SEQ ID NO: 139830 - DNA, 35 bp, Artificial Sequence
  Synthetic oligonucleotide
tgcaacattgcctccgtgaaatcaccccccgcctc

SEQ ID NO: 139831 - DNA, 35 bp, Artificial Sequence
  Synthetic oligonucleotide
tcccgtctctcccctcatggtgcttctatcacgtc

SEQ ID NO: 139832 - DNA, 35 bp, Artificial Sequence
  Synthetic oligonucleotide
ttcgtcgtactgacgcctccacccgatactgattc

SEQ ID NO: 139833 - DNA, 35 bp, Artificial Sequence
  Synthetic oligonucleotide
acatgactgcctgctcgtgagtaattgcctcgttc

SEQ ID NO: 139834 - DNA, 35 bp, Artificial Sequence
  Synthetic oligonucleotide
atcccttcgcccgccaatcacctatccattggttc

SEQ ID NO: 139835 - DNA, 35 bp, Artificial Sequence
  Synthetic oligonucleotide
attggggagggaaaaaagggcgttggcaaaggggg

SEQ ID NO: 139836 - DNA, 35 bp, Artificial Sequence
  Synthetic oligonucleotide
gggaggagggccaaggagaagaggcgaacagtggg

SEQ ID NO: 139837 - DNA, 35 bp, Artificial Sequence
  Synthetic oligonucleotide
atgtgacggtgtggcggtgggttgggggggatatg

SEQ ID NO: 139838 - DNA, 33 bp, Artificial Sequence
  Synthetic oligonucleotide
accctcggccggtacctgctcatctctctcctg

SEQ ID NO: 139839 - DNA, 35 bp, Artificial Sequence
  Synthetic oligonucleotide
gcacgcaatttgattcaccccagccggcatcacct

SEQ ID NO: 139840 - DNA, 35 bp, Artificial Sequence
  Synthetic oligonucleotide
gaccctgccgcactccggaccctacatacttagct

SEQ ID NO: 139841 - DNA, 35 bp, Artificial Sequence
  Synthetic oligonucleotide
ggacacgtgccccacaccgcgctgaagcccgctct

SEQ ID NO: 139842 - DNA, 35 bp, Artificial Sequence
  Synthetic oligonucleotide
tgtgccctcgtaacttcctctccatccagcccggt

SEQ ID NO: 139843 - DNA, 35 bp, Artificial Sequence
  Synthetic oligonucleotide
ttcgaggggtggcaaaagtgggggcggatggggtt

SEQ ID NO: 139844 - DNA, 35 bp, Artificial Sequence
  Synthetic oligonucleotide
atgccaccccaccctgttctccatgattaactgtt

SEQ ID NO: 139845 - DNA, 35 bp, Artificial Sequence
  Synthetic oligonucleotide
actaccacccccgtccctctggaacaattgctgtt

SEQ ID NO: 139846 - DNA, 36 bp, Artificial Sequence
  Synthetic oligonucleotide
ttagccgtgccctacctgcgcccctcttgtctctaa

SEQ ID NO: 139847 - DNA, 36 bp, Artificial Sequence
  Synthetic oligonucleotide
tgctgatcgcacatcttatcaacgcccttggaacca

SEQ ID NO: 139848 - DNA, 36 bp, Artificial Sequence
  Synthetic oligonucleotide
gtcactgcccacttgctgccccgtcgcgtgccgcca

SEQ ID NO: 139849 - DNA, 36 bp, Artificial Sequence
  Synthetic oligonucleotide
gcattcagccatcacattcgagtttttccgttgcca

SEQ ID NO: 139850 - DNA, 36 bp, Artificial Sequence
  Synthetic oligonucleotide
acgtgagggccattgcttttactatcccgtgctcca

SEQ ID NO: 139851 - DNA, 36 bp, Artificial Sequence
  Synthetic oligonucleotide
ttcactcagattgactaccacctctcgccccacgca

SEQ ID NO: 139852 - DNA, 35 bp, Artificial Sequence
  Synthetic oligonucleotide
gtgccgtttgctttctccgccctgctcgttctgca

SEQ ID NO: 139853 - DNA, 31 bp, Artificial Sequence
  Synthetic oligonucleotide
tacttgcatccggcgctctcgtcctttttca

SEQ ID NO: 139854 - DNA, 37 bp, Artificial Sequence
  Synthetic oligonucleotide
tagtgtgcgggagggaaagagcagggtgggcggaaga

SEQ ID NO: 139855 - DNA, 37 bp, Artificial Sequence
  Synthetic oligonucleotide
taccatcggcccccattgtttcgtatcctcctaccga

SEQ ID NO: 139856 - DNA, 37 bp, Artificial Sequence
  Synthetic oligonucleotide
accccccgcgctccgcctccagtctatcgtatcccga

SEQ ID NO: 139857 - DNA, 36 bp, Artificial Sequence
  Synthetic oligonucleotide
ccacagggtgatcaggggagggagggctcgcaggga

SEQ ID NO: 139858 - DNA, 37 bp, Artificial Sequence
  Synthetic oligonucleotide
gacacgaaggagggaggacgggaagtggtgacctgga

SEQ ID NO: 139859 - DNA, 32 bp, Artificial Sequence
  Synthetic oligonucleotide
tgactcaggctgtatcctggttcccctcttga

SEQ ID NO: 139860 - DNA, 36 bp, Artificial Sequence
  Synthetic oligonucleotide
tgcggtccctcagccgaatcccgctcgcattccata

SEQ ID NO: 139861 - DNA, 36 bp, Artificial Sequence
  Synthetic oligonucleotide
tagcacctgcagccccttctccttacaccctgtcta

SEQ ID NO: 139862 - DNA, 36 bp, Artificial Sequence
  Synthetic oligonucleotide
tgccccttccacccattccatgcgagacgctcgtta

SEQ ID NO: 139863 - DNA, 35 bp, Artificial Sequence
  Synthetic oligonucleotide
gccgccccccccgcgatgccctttgagtcctgaac

SEQ ID NO: 139864 - DNA, 35 bp, Artificial Sequence
  Synthetic oligonucleotide
taccgccaccttcacgtcacgcccccaggcaccac

SEQ ID NO: 139865 - DNA, 35 bp, Artificial Sequence
  Synthetic oligonucleotide
accgttcttgccgccgctctgtcccgcgttgcccc

SEQ ID NO: 139866 - DNA, 34 bp, Artificial Sequence
  Synthetic oligonucleotide
gtccagaggacgtcgataatgcaccccccgcgcc

SEQ ID NO: 139867 - DNA, 35 bp, Artificial Sequence
  Synthetic oligonucleotide
tgttttcccccgcctcctacatgacgcttagtgcc

SEQ ID NO: 139868 - DNA, 35 bp, Artificial Sequence
  Synthetic oligonucleotide
gtaccatcatcgtgagtcgtttaccgtgattttcc

SEQ ID NO: 139869 - DNA, 35 bp, Artificial Sequence
  Synthetic oligonucleotide
gcatccgtccgactttacttttcccacctctacgc

SEQ ID NO: 139870 - DNA, 35 bp, Artificial Sequence
  Synthetic oligonucleotide
gctgtcgatctgtgcacctacaccgcttacccttc

SEQ ID NO: 139871 - DNA, 35 bp, Artificial Sequence
  Synthetic oligonucleotide
gtacccagcctccactacccgccggctccatcccg

SEQ ID NO: 139872 - DNA, 35 bp, Artificial Sequence
  Synthetic oligonucleotide
ggggggagacgggcataaaggtggggcacagggat

SEQ ID NO: 139873 - DNA, 35 bp, Artificial Sequence
  Synthetic oligonucleotide
ttgcaagcaacccacgccccccatgaccccgtgat

SEQ ID NO: 139874 - DNA, 35 bp, Artificial Sequence
  Synthetic oligonucleotide
gacaccctccccttaacacgaatagacggccctct

SEQ ID NO: 139875 - DNA, 35 bp, Artificial Sequence
  Synthetic oligonucleotide
acttgctcaccccagccgttatgtagcttcgctct

SEQ ID NO: 139876 - DNA, 35 bp, Artificial Sequence
  Synthetic oligonucleotide
gtagtccaacccgcccgagtccaccctgccacatt

SEQ ID NO: 139877 - DNA, 35 bp, Artificial Sequence
  Synthetic oligonucleotide
tccacggcttgaccttcgcgcgtacttagttcctt

SEQ ID NO: 139878 - DNA, 35 bp, Artificial Sequence
  Synthetic oligonucleotide
aagtcaccgccacgctactacaaattctccgcttt

SEQ ID NO: 139879 - DNA, 36 bp, Artificial Sequence
  Synthetic oligonucleotide
gaaaaacagcagggaaagacaggggggagcgtgcaa

SEQ ID NO: 139880 - DNA, 36 bp, Artificial Sequence
  Synthetic oligonucleotide
gagctcctgttacgcaccgccgtccaattccacgaa

SEQ ID NO: 139881 - DNA, 36 bp, Artificial Sequence
  Synthetic oligonucleotide
tgccctgctctggtctgcttcctctccttccggaca

SEQ ID NO: 139882 - DNA, 36 bp, Artificial Sequence
  Synthetic oligonucleotide
acgaagtgccaagcgtacgttttcttccggcctcca

SEQ ID NO: 139883 - DNA, 35 bp, Artificial Sequence
  Synthetic oligonucleotide
gtcagaacgccgccaccttaagcaaccccggtcca

SEQ ID NO: 139884 - DNA, 37 bp, Artificial Sequence
  Synthetic oligonucleotide
tgacacagggaggaggggggggggagcgggtgggaga

SEQ ID NO: 139885 - DNA, 36 bp, Artificial Sequence
  Synthetic oligonucleotide
gacggggcactggggagggagctctggggaatgaga

SEQ ID NO: 139886 - DNA, 37 bp, Artificial Sequence
  Synthetic oligonucleotide
tgtgaggcggagtagggggaggaacaattgcctgcga

SEQ ID NO: 139887 - DNA, 37 bp, Artificial Sequence
  Synthetic oligonucleotide
agggggaggggggtgaaaggcaagcggatgggcggga

SEQ ID NO: 139888 - DNA, 37 bp, Artificial Sequence
  Synthetic oligonucleotide
tactacgccaaccattttgatccactctctgccgtga

SEQ ID NO: 139889 - DNA, 36 bp, Artificial Sequence
  Synthetic oligonucleotide
gaggggggggggcaagcaaggacaacaggagggtga

SEQ ID NO: 139890 - DNA, 37 bp, Artificial Sequence
  Synthetic oligonucleotide
cccggggaggggacagcgattggggcctggggattga

SEQ ID NO: 139891 - DNA, 38 bp, Artificial Sequence
  Synthetic oligonucleotide
gcaccacccggcgattttaactgctccctccgatttga

SEQ ID NO: 139892 - DNA, 35 bp, Artificial Sequence
  Synthetic oligonucleotide
gtggaaagtactcgggtggggtgggaagggtcata

SEQ ID NO: 139893 - DNA, 35 bp, Artificial Sequence
  Synthetic oligonucleotide
gccgaactcggctggtactaactacccttaccaac

SEQ ID NO: 139894 - DNA, 34 bp, Artificial Sequence
  Synthetic oligonucleotide
tagcatcactcgcccgtatccaagccacccggac

SEQ ID NO: 139895 - DNA, 35 bp, Artificial Sequence
  Synthetic oligonucleotide
tacgatgtgttcgttgccctatggccctcttctac

SEQ ID NO: 139896 - DNA, 35 bp, Artificial Sequence
  Synthetic oligonucleotide
gacccccgcccatccgtatcccccgcattggcacc

SEQ ID NO: 139897 - DNA, 35 bp, Artificial Sequence
  Synthetic oligonucleotide
gacctgccctgtcttatatcccgtcctaccccccc

SEQ ID NO: 139898 - DNA, 35 bp, Artificial Sequence
  Synthetic oligonucleotide
gttcacacccccctattgccagagaagcccgcccc

SEQ ID NO: 139899 - DNA, 35 bp, Artificial Sequence
  Synthetic oligonucleotide
acataccatcccgcgccccggaattcgttattccc

SEQ ID NO: 139900 - DNA, 35 bp, Artificial Sequence
  Synthetic oligonucleotide
acggaactgccgcccgacgcgtcaccgaccctgcc

SEQ ID NO: 139901 - DNA, 35 bp, Artificial Sequence
  Synthetic oligonucleotide
ttccaggcacgtcaccccttccgtctatggcctcc

SEQ ID NO: 139902 - DNA, 35 bp, Artificial Sequence
  Synthetic oligonucleotide
gcgacaccactggcccccgctgcgccacattctcc

SEQ ID NO: 139903 - DNA, 35 bp, Artificial Sequence
  Synthetic oligonucleotide
gtactccccatacttaaccgatcaaaccgacacgc

SEQ ID NO: 139904 - DNA, 35 bp, Artificial Sequence
  Synthetic oligonucleotide
gtgaaccaacatgcccctgccctctctcggaccgc

SEQ ID NO: 139905 - DNA, 35 bp, Artificial Sequence
  Synthetic oligonucleotide
acacctcctccgctgattaaacgatttggtcgtgc

SEQ ID NO: 139906 - DNA, 35 bp, Artificial Sequence
  Synthetic oligonucleotide
tcatgccattcgtcggctctcggtatctcactctc

SEQ ID NO: 139907 - DNA, 35 bp, Artificial Sequence
  Synthetic oligonucleotide
gccctaccgactgctcttgcgtttcgttcgttctc

SEQ ID NO: 139908 - DNA, 35 bp, Artificial Sequence
  Synthetic oligonucleotide
gagcctccaccactatggttaactcaccatcacct

SEQ ID NO: 139909 - DNA, 35 bp, Artificial Sequence
  Synthetic oligonucleotide
acctctctccggctttgtactctggtccttccctt

SEQ ID NO: 139910 - DNA, 36 bp, Artificial Sequence
  Synthetic oligonucleotide
gacacatgccatcctgctcatctatccagacctcca

SEQ ID NO: 139911 - DNA, 36 bp, Artificial Sequence
  Synthetic oligonucleotide
aaccaccgtacccccatgctgtccgtagccgccgca

SEQ ID NO: 139912 - DNA, 36 bp, Artificial Sequence
  Synthetic oligonucleotide
gtgacatcgggatgggaaccgcaagaggggagggca

SEQ ID NO: 139913 - DNA, 36 bp, Artificial Sequence
  Synthetic oligonucleotide
atgctcaccgtctcgtcgttccttggttgttcatca

SEQ ID NO: 139914 - DNA, 35 bp, Artificial Sequence
  Synthetic oligonucleotide
atacctagcgcgaactgcgtggtgccttcccttca

SEQ ID NO: 139915 - DNA, 36 bp, Artificial Sequence
  Synthetic oligonucleotide
tgcccgcctccgaattattttagttctcccttttca

SEQ ID NO: 139916 - DNA, 36 bp, Artificial Sequence
  Synthetic oligonucleotide
gatgcccacctcgcctgctgaatacatcttttgaga

SEQ ID NO: 139917 - DNA, 37 bp, Artificial Sequence
  Synthetic oligonucleotide
cacgtcacacacgtctttcagtcctcccatgccacga

SEQ ID NO: 139918 - DNA, 37 bp, Artificial Sequence
  Synthetic oligonucleotide
aactgcccgcctcatctatcgcatcatccaggtacga

SEQ ID NO: 139919 - DNA, 37 bp, Artificial Sequence
  Synthetic oligonucleotide
agcagaaccagctctgttcctcctgccccctgtacga

SEQ ID NO: 139920 - DNA, 37 bp, Artificial Sequence
  Synthetic oligonucleotide
actgcgtcagccatgcgtcccaccccgccctccccga

SEQ ID NO: 139921 - DNA, 36 bp, Artificial Sequence
  Synthetic oligonucleotide
tcccacatcacaccaccgaagcctcggtcccttcga

SEQ ID NO: 139922 - DNA, 37 bp, Artificial Sequence
  Synthetic oligonucleotide
ttgcccttcacaatggcttcgatcccccatccctgga

SEQ ID NO: 139923 - DNA, 38 bp, Artificial Sequence
  Synthetic oligonucleotide
tctcgaccaccgcctccacccgtctgccaagaacctga

SEQ ID NO: 139924 - DNA, 38 bp, Artificial Sequence
  Synthetic oligonucleotide
aagccaaagccccctgcgtctcgttcacttccgcctga

SEQ ID NO: 139925 - DNA, 38 bp, Artificial Sequence
  Synthetic oligonucleotide
acccccgtcctgtgccaacgttccaagccctcccgtga

SEQ ID NO: 139926 - DNA, 38 bp, Artificial Sequence
  Synthetic oligonucleotide
agttaggcgacgggaaggggaagggggggctccgttga

SEQ ID NO: 139927 - DNA, 37 bp, Artificial Sequence
  Synthetic oligonucleotide
aatcccgcctccgcccccctcatgaccgttagccgta

SEQ ID NO: 139928 - DNA, 35 bp, Artificial Sequence
  Synthetic oligonucleotide
tatgacccgccatgttgcgttttctcctatcctta

SEQ ID NO: 139929 - DNA, 36 bp, Artificial Sequence
  Synthetic oligonucleotide
gtctgccacgccagactttgtcccccacttatctta

SEQ ID NO: 139930 - DNA, 35 bp, Artificial Sequence
  Synthetic oligonucleotide
gtctccgcctccactgtttcctcgggccctgttta

SEQ ID NO: 139931 - DNA, 35 bp, Artificial Sequence
  Synthetic oligonucleotide
tcaacctccgtcgcccgggttcagtcccgcctcac

SEQ ID NO: 139932 - DNA, 35 bp, Artificial Sequence
  Synthetic oligonucleotide
taccccccgtgtgatacactttgcttcccgttacc

SEQ ID NO: 139933 - DNA, 35 bp, Artificial Sequence
  Synthetic oligonucleotide
gcccccctttagaccgtttagcctcttgttttacc

SEQ ID NO: 139934 - DNA, 35 bp, Artificial Sequence
  Synthetic oligonucleotide
gtgcttccatgagcctattccgaccgctccacccc

SEQ ID NO: 139935 - DNA, 35 bp, Artificial Sequence
  Synthetic oligonucleotide
gaactgtcccatcgcgttctaatacataacctccc

SEQ ID NO: 139936 - DNA, 35 bp, Artificial Sequence
  Synthetic oligonucleotide
tttgtcctgcccctcttggttactgtgccgattcc

SEQ ID NO: 139937 - DNA, 35 bp, Artificial Sequence
  Synthetic oligonucleotide
ttccgccttggcacttggcttcagcccctcttcgc

SEQ ID NO: 139938 - DNA, 35 bp, Artificial Sequence
  Synthetic oligonucleotide
gacaacactcctgcttgtctttacacgctcctatc

SEQ ID NO: 139939 - DNA, 35 bp, Artificial Sequence
  Synthetic oligonucleotide
aacgtttgccgccgacgcgagcctttgacgccctc

SEQ ID NO: 139940 - DNA, 35 bp, Artificial Sequence
  Synthetic oligonucleotide
tccaccccagtatctgctagttttggtacctggtc

SEQ ID NO: 139941 - DNA, 35 bp, Artificial Sequence
  Synthetic oligonucleotide
acgccgccccgcgaggttcctcccagtggcccttc

SEQ ID NO: 139942 - DNA, 35 bp, Artificial Sequence
  Synthetic oligonucleotide
gaccaatgcctgtccagccaccagcctgttccacg

SEQ ID NO: 139943 - DNA, 35 bp, Artificial Sequence
  Synthetic oligonucleotide
gtcttccaccctcttgttttcgtcacgacctcccg

SEQ ID NO: 139944 - DNA, 35 bp, Artificial Sequence
  Synthetic oligonucleotide
gcgccgacccacctaggtcaccctgtcccccgccg

SEQ ID NO: 139945 - DNA, 35 bp, Artificial Sequence
  Synthetic oligonucleotide
gccctgagctgatctggccctggtttctcccctcg

SEQ ID NO: 139946 - DNA, 35 bp, Artificial Sequence
  Synthetic oligonucleotide
acagtgaaggtcggaaggaggcggggagttacggg

SEQ ID NO: 139947 - DNA, 35 bp, Artificial Sequence
  Synthetic oligonucleotide
ggtgcactgcccaccgcggacatcctctacacctg

SEQ ID NO: 139948 - DNA, 35 bp, Artificial Sequence
  Synthetic oligonucleotide
taccgtcacacttcgataactattgcccctgtctg

SEQ ID NO: 139949 - DNA, 35 bp, Artificial Sequence
  Synthetic oligonucleotide
tctcgccgtcccgcaattattcctgctccgcccct

SEQ ID NO: 139950 - DNA, 35 bp, Artificial Sequence
  Synthetic oligonucleotide
tcatccaatggcctcactccctgtcttccgttgct

SEQ ID NO: 139951 - DNA, 35 bp, Artificial Sequence
  Synthetic oligonucleotide
tccgccccacacgaatgtcgcaccttgaaatatct

SEQ ID NO: 139952 - DNA, 35 bp, Artificial Sequence
  Synthetic oligonucleotide
tgacgttgcccttcgccttgttcactatcacgctt

SEQ ID NO: 139953 - DNA, 36 bp, Artificial Sequence
  Synthetic oligonucleotide
gacacgctagcagaagcccacactcgcctctaccca

SEQ ID NO: 139954 - DNA, 35 bp, Artificial Sequence
  Synthetic oligonucleotide
aacaactcccagtcgcggactgacacctgccttca

SEQ ID NO: 139955 - DNA, 37 bp, Artificial Sequence
  Synthetic oligonucleotide
gccggaaaaggtggtaaatgggagcgagggtataaga

SEQ ID NO: 139956 - DNA, 37 bp, Artificial Sequence
  Synthetic oligonucleotide
tcccacgcccctctgaataagtttcctctcatctaga

SEQ ID NO: 139957 - DNA, 36 bp, Artificial Sequence
  Synthetic oligonucleotide
cacgcccccccgtttccgctcccatgaacagtacga

SEQ ID NO: 139958 - DNA, 37 bp, Artificial Sequence
  Synthetic oligonucleotide
tccaccgccctcgatttctgctggttatgtttccgga

SEQ ID NO: 139959 - DNA, 37 bp, Artificial Sequence
  Synthetic oligonucleotide
ttcactcgcctccttgtcctaagtatccgtttcatga

SEQ ID NO: 139960 - DNA, 37 bp, Artificial Sequence
  Synthetic oligonucleotide
caccacccctacctcccactgtgtgcccgtaccctga

SEQ ID NO: 139961 - DNA, 38 bp, Artificial Sequence
  Synthetic oligonucleotide
ttagacctcaaggcgatatcccactcaccctccgctga

SEQ ID NO: 139962 - DNA, 37 bp, Artificial Sequence
  Synthetic oligonucleotide
ggatgaggtgggagggaaagggaaatggtccgggtga

SEQ ID NO: 139963 - DNA, 37 bp, Artificial Sequence
  Synthetic oligonucleotide
tggatcacgccgtcgtctaattggccctccctcttga

SEQ ID NO: 139964 - DNA, 35 bp, Artificial Sequence
  Synthetic oligonucleotide
gtttgccgtcgagcgtacttcccacccttgtttga

SEQ ID NO: 139965 - DNA, 38 bp, Artificial Sequence
  Synthetic oligonucleotide
gacgggggggggtggaacggggaaaggagggcttttga

SEQ ID NO: 139966 - DNA, 35 bp, Artificial Sequence
  Synthetic oligonucleotide
atttgcacagccatcacaccccgcttttgtaccta

SEQ ID NO: 139967 - DNA, 35 bp, Artificial Sequence
  Synthetic oligonucleotide
acgccctcataccgggtttctcgcctgttgctcta

SEQ ID NO: 139968 - DNA, 35 bp, Artificial Sequence
  Synthetic oligonucleotide
ccacccggggctccgacctatactgtaccgcctac

SEQ ID NO: 139969 - DNA, 35 bp, Artificial Sequence
  Synthetic oligonucleotide
atcgtagccgtgccccggtatttgccttttcgacc

SEQ ID NO: 139970 - DNA, 35 bp, Artificial Sequence
  Synthetic oligonucleotide
gccaccccgcctatggtccgttctcaagactttcc

SEQ ID NO: 139971 - DNA, 35 bp, Artificial Sequence
  Synthetic oligonucleotide
atcacctctgactccgacgttgccaccttctatgc

SEQ ID NO: 139972 - DNA, 35 bp, Artificial Sequence
  Synthetic oligonucleotide
gttcctgtccggcattcatggtcttcaccgccatc

SEQ ID NO: 139973 - DNA, 35 bp, Artificial Sequence
  Synthetic oligonucleotide
tagccccacatatgccgatatcactattcctcatc

SEQ ID NO: 139974 - DNA, 35 bp, Artificial Sequence
  Synthetic oligonucleotide
gatgcggtcggatatccgttcgctctatgcctttc

SEQ ID NO: 139975 - DNA, 35 bp, Artificial Sequence
  Synthetic oligonucleotide
gtgtatcccacgctatctcgtcgcccccctgctcg

SEQ ID NO: 139976 - DNA, 35 bp, Artificial Sequence
  Synthetic oligonucleotide
gcccacctccgatatttgtttctagtccagttact

SEQ ID NO: 139977 - DNA, 35 bp, Artificial Sequence
  Synthetic oligonucleotide
gtgccccattcgctcctcccgtgccggattatgct

SEQ ID NO: 139978 - DNA, 35 bp, Artificial Sequence
  Synthetic oligonucleotide
tctcgtccccttcctgtcattgcccccctgcgatt

SEQ ID NO: 139979 - DNA, 36 bp, Artificial Sequence
  Synthetic oligonucleotide
gtgccgcaccacccgtgtctctcctacctccttcaa

SEQ ID NO: 139980 - DNA, 35 bp, Artificial Sequence
  Synthetic oligonucleotide
taccccaccctccagggagcctattcctctgccca

SEQ ID NO: 139981 - DNA, 36 bp, Artificial Sequence
  Synthetic oligonucleotide
gatcccactcccatgcctgtttcgcgcactaatcca

SEQ ID NO: 139982 - DNA, 34 bp, Artificial Sequence
  Synthetic oligonucleotide
gacaccgtgtttccccaggtaatttcacccgtca

SEQ ID NO: 139983 - DNA, 37 bp, Artificial Sequence
  Synthetic oligonucleotide
gctcagactaacagcacggagggggggaagggaaaga

SEQ ID NO: 139984 - DNA, 37 bp, Artificial Sequence
  Synthetic oligonucleotide
gtgacgccacccgtgctgggccctatccttctgtaga

SEQ ID NO: 139985 - DNA, 37 bp, Artificial Sequence
  Synthetic oligonucleotide
atcaccctccatgtcccccgaagttgctgaaaaccga

SEQ ID NO: 139986 - DNA, 37 bp, Artificial Sequence
  Synthetic oligonucleotide
tgactacgatagttgtccgcccccctttctttcccga

SEQ ID NO: 139987 - DNA, 37 bp, Artificial Sequence
  Synthetic oligonucleotide
gcatagtaaggggaggagtaacgggagggggggccga

SEQ ID NO: 139988 - DNA, 38 bp, Artificial Sequence
  Synthetic oligonucleotide
ttgacgggccgtcactgcctccgcctactccgccctga

SEQ ID NO: 139989 - DNA, 36 bp, Artificial Sequence
  Synthetic oligonucleotide
gtacctcgacctgatccgttgttctctgtccgccta

SEQ ID NO: 139990 - DNA, 36 bp, Artificial Sequence
  Synthetic oligonucleotide
gcaagcggaacctgtagtcctcgcccgttctctcta

SEQ ID NO: 139991 - DNA, 35 bp, Artificial Sequence
  Synthetic oligonucleotide
ttgttgccaccagcgaacgctccctctccggttta

SEQ ID NO: 139992 - DNA, 35 bp, Artificial Sequence
  Synthetic oligonucleotide
agtgcctactcccccccggctcaagtttgcctcac

SEQ ID NO: 139993 - DNA, 35 bp, Artificial Sequence
  Synthetic oligonucleotide
gctgcgcagtctgttccctgtatccgcgcccgtac

SEQ ID NO: 139994 - DNA, 35 bp, Artificial Sequence
  Synthetic oligonucleotide
accctccgcgcaccggtgcacctccgctcccttac

SEQ ID NO: 139995 - DNA, 35 bp, Artificial Sequence
  Synthetic oligonucleotide
attgtgcgtagtgcaatactttccgcctctcaacc

SEQ ID NO: 139996 - DNA, 35 bp, Artificial Sequence
  Synthetic oligonucleotide
tcacctacgcctatctgtttcgtcggaccgccccc

SEQ ID NO: 139997 - DNA, 35 bp, Artificial Sequence
  Synthetic oligonucleotide
tcctcacttcgcctccccacaattgagtctgcccc

SEQ ID NO: 139998 - DNA, 35 bp, Artificial Sequence
  Synthetic oligonucleotide
gcccttatccggtcgcccgtcctgcatattcgccc

SEQ ID NO: 139999 - DNA, 35 bp, Artificial Sequence
  Synthetic oligonucleotide
tgcatagcgcctcctgtgcccctccgccgcatccc

SEQ ID NO: 140000 - DNA, 35 bp, Artificial Sequence
  Synthetic oligonucleotide
gtactctcctatccgataacagcctccgttcttcc

SEQ ID NO: 140001 - DNA, 35 bp, Artificial Sequence
  Synthetic oligonucleotide
tcagctccctctccatggctttagttttcgtccgc

SEQ ID NO: 140002 - DNA, 35 bp, Artificial Sequence
  Synthetic oligonucleotide
gcccagcattgttcgctcggtcactctcccctggc

SEQ ID NO: 140003 - DNA, 35 bp, Artificial Sequence
  Synthetic oligonucleotide
ttcggacgcccgtatcctccgtcccgtttccatgc

SEQ ID NO: 140004 - DNA, 35 bp, Artificial Sequence
  Synthetic oligonucleotide
tcttgggcctcccgatatctctgtcctctacgtgc

SEQ ID NO: 140005 - DNA, 35 bp, Artificial Sequence
  Synthetic oligonucleotide
ttcctcccccacatggtaccgacctatctcccatc

SEQ ID NO: 140006 - DNA, 35 bp, Artificial Sequence
  Synthetic oligonucleotide
tacaccgtcgtccttatcgagcctcgtttgcactc

SEQ ID NO: 140007 - DNA, 35 bp, Artificial Sequence
  Synthetic oligonucleotide
taccaacgaacgacgcttttacatgcaaccccttc

SEQ ID NO: 140008 - DNA, 35 bp, Artificial Sequence
  Synthetic oligonucleotide
atgtgtggggtgaagggggatcgcaggggtggtag

SEQ ID NO: 140009 - DNA, 33 bp, Artificial Sequence
  Synthetic oligonucleotide
gccgcttaccctgcccccctcgccggaggtccg

SEQ ID NO: 140010 - DNA, 35 bp, Artificial Sequence
  Synthetic oligonucleotide
gcctacgacagtcccactggctttccctgtcctcg

SEQ ID NO: 140011 - DNA, 35 bp, Artificial Sequence
  Synthetic oligonucleotide
tcatgcacgttcgcccccttctgcgcaaattgttg

SEQ ID NO: 140012 - DNA, 35 bp, Artificial Sequence
  Synthetic oligonucleotide
tagtcgtcaggtaaccatttgtccggccttcacct

SEQ ID NO: 140013 - DNA, 35 bp, Artificial Sequence
  Synthetic oligonucleotide
tcagcctccagctttcgccttactacgctccccct

SEQ ID NO: 140014 - DNA, 35 bp, Artificial Sequence
  Synthetic oligonucleotide
ttggtcgtcacatctgatcgctgcgctgcctctgt

SEQ ID NO: 140015 - DNA, 35 bp, Artificial Sequence
  Synthetic oligonucleotide
atactccgcagctgcctccagctccgccatttatt

SEQ ID NO: 140016 - DNA, 35 bp, Artificial Sequence
  Synthetic oligonucleotide
atgacccccctcccgtatgttacaagggaaccctt

SEQ ID NO: 140017 - DNA, 35 bp, Artificial Sequence
  Synthetic oligonucleotide
gtcccacgcgctccttgtcctgtagcccgggtttt

SEQ ID NO: 140018 - DNA, 36 bp, Artificial Sequence
  Synthetic oligonucleotide
tgccatctagccccatcccgtcatcgcacccggaaa

SEQ ID NO: 140019 - DNA, 35 bp, Artificial Sequence
  Synthetic oligonucleotide
gtccgcacccgcctctggaagacgtccctcataca

SEQ ID NO: 140020 - DNA, 36 bp, Artificial Sequence
  Synthetic oligonucleotide
tcctcgccgaggctctgtccatacactccccgccca

SEQ ID NO: 140021 - DNA, 36 bp, Artificial Sequence
  Synthetic oligonucleotide
atgttcccaacgcccgcacccactggatctccctca

SEQ ID NO: 140022 - DNA, 37 bp, Artificial Sequence
  Synthetic oligonucleotide
ttcgtagcctcagagaacagggatggggaggtggaga

SEQ ID NO: 140023 - DNA, 37 bp, Artificial Sequence
  Synthetic oligonucleotide
tgaccactctcccctgatgatctacgttaccctccga

SEQ ID NO: 140024 - DNA, 37 bp, Artificial Sequence
  Synthetic oligonucleotide
acgctggggcataggggcggaggtgggggagtggcga

SEQ ID NO: 140025 - DNA, 37 bp, Artificial Sequence
  Synthetic oligonucleotide
tagcatgccggccccttccccccgccaatacgatcga

SEQ ID NO: 140026 - DNA, 37 bp, Artificial Sequence
  Synthetic oligonucleotide
ttcgccttgagcctccattcctctcgcctgaccatga

SEQ ID NO: 140027 - DNA, 38 bp, Artificial Sequence
  Synthetic oligonucleotide
agaggacgggcggtagagagaccaagggcggagggtga

SEQ ID NO: 140028 - DNA, 34 bp, Artificial Sequence
  Synthetic oligonucleotide
gcgaggggagggcgatagggcttgacatgggtga

SEQ ID NO: 140029 - DNA, 38 bp, Artificial Sequence
  Synthetic oligonucleotide
tcgcatccgtgtcctgccgctcgtctcattccacttga

SEQ ID NO: 140030 - DNA, 36 bp, Artificial Sequence
  Synthetic oligonucleotide
aaagcaccgctagcctggttcgctcctctattcata

SEQ ID NO: 140031 - DNA, 36 bp, Artificial Sequence
  Synthetic oligonucleotide
acatcacgtcagaccgttcactgcctctcatacgta

SEQ ID NO: 140032 - DNA, 35 bp, Artificial Sequence
  Synthetic oligonucleotide
tccacctccctctgaattaggacctagaattcgta

SEQ ID NO: 140033 - DNA, 35 bp, Artificial Sequence
  Synthetic oligonucleotide
aagacccccccctcctgcctccctgcggttgcaac

SEQ ID NO: 140034 - DNA, 35 bp, Artificial Sequence
  Synthetic oligonucleotide
gatgcccccagtgggagtcacctttcccgtaacac

SEQ ID NO: 140035 - DNA, 35 bp, Artificial Sequence
  Synthetic oligonucleotide
tccgagcccctgccccgttcatcatcttccgatac

SEQ ID NO: 140036 - DNA, 35 bp, Artificial Sequence
  Synthetic oligonucleotide
ttgtacctgccgatacggaatttgtcctcttgccc

SEQ ID NO: 140037 - DNA, 35 bp, Artificial Sequence
  Synthetic oligonucleotide
gtgctcgcaccctgactcggcattcccttcctccc

SEQ ID NO: 140038 - DNA, 35 bp, Artificial Sequence
  Synthetic oligonucleotide
agtgaggtgtccgtgctttcttctccatctgtccc

SEQ ID NO: 140039 - DNA, 35 bp, Artificial Sequence
  Synthetic oligonucleotide
acaaaaggtcagccggccgccccgaactcgtctcc

SEQ ID NO: 140040 - DNA, 34 bp, Artificial Sequence
  Synthetic oligonucleotide
accttaggtcaccgctatcccagcccctcattcc

SEQ ID NO: 140041 - DNA, 35 bp, Artificial Sequence
  Synthetic oligonucleotide
tgccgagcctcctgtctgcctactcatattgctgc

SEQ ID NO: 140042 - DNA, 35 bp, Artificial Sequence
  Synthetic oligonucleotide
gaccatgtatctcgttatcagtcgccccacacatc

SEQ ID NO: 140043 - DNA, 35 bp, Artificial Sequence
  Synthetic oligonucleotide
tttcgcgcatccgccacatagcctgtacccgattc

SEQ ID NO: 140044 - DNA, 35 bp, Artificial Sequence
  Synthetic oligonucleotide
ttgtacactcgcccgctgactctatcggtgtcttc

SEQ ID NO: 140045 - DNA, 35 bp, Artificial Sequence
  Synthetic oligonucleotide
tacctcagttgatcaattcgcctccgtcctcaccg

SEQ ID NO: 140046 - DNA, 35 bp, Artificial Sequence
  Synthetic oligonucleotide
ttagtagcatcctcaaagtcctgcctccccttccg

SEQ ID NO: 140047 - DNA, 35 bp, Artificial Sequence
  Synthetic oligonucleotide
gggtggcgggggggttttgaggatggcacatcgcg

SEQ ID NO: 140048 - DNA, 35 bp, Artificial Sequence
  Synthetic oligonucleotide
gtctcgcgcggaagaataatccccgtcccctatcg

SEQ ID NO: 140049 - DNA, 35 bp, Artificial Sequence
  Synthetic oligonucleotide
ttgtctacctcccactgtatccgctcctatagctg

SEQ ID NO: 140050 - DNA, 35 bp, Artificial Sequence
  Synthetic oligonucleotide
tactccaccccccgttgttgttcctcctcgctgat

SEQ ID NO: 140051 - DNA, 35 bp, Artificial Sequence
  Synthetic oligonucleotide
gacacttacccgccttagtgccgtggactcaccct

SEQ ID NO: 140052 - DNA, 35 bp, Artificial Sequence
  Synthetic oligonucleotide
tgcgaccgacacaagcttttcaccccggtcctcct

SEQ ID NO: 140053 - DNA, 35 bp, Artificial Sequence
  Synthetic oligonucleotide
tgtgaccccgcaccttcttcggcgtatgcccatct

SEQ ID NO: 140054 - DNA, 35 bp, Artificial Sequence
  Synthetic oligonucleotide
ccctggacctcacatcatgttttcgccatccctct

SEQ ID NO: 140055 - DNA, 35 bp, Artificial Sequence
  Synthetic oligonucleotide
ggaccgataccacgtgtgctctgttcctttcttct

SEQ ID NO: 140056 - DNA, 35 bp, Artificial Sequence
  Synthetic oligonucleotide
taccgccattgctcttgtttctgttccgattacgt

SEQ ID NO: 140057 - DNA, 35 bp, Artificial Sequence
  Synthetic oligonucleotide
tcgagtccgtccttagtgattgttctcctgtccgt

SEQ ID NO: 140058 - DNA, 35 bp, Artificial Sequence
  Synthetic oligonucleotide
gcaggtgggggaaaggcaactaaaacggggagggt

SEQ ID NO: 140059 - DNA, 35 bp, Artificial Sequence
  Synthetic oligonucleotide
ttcatcccgtgctaccgctgcgcccctcttacttt

SEQ ID NO: 140060 - DNA, 35 bp, Artificial Sequence
  Synthetic oligonucleotide
tgcgtgcaacgcctgtctcccggcccttccagttt

SEQ ID NO: 140061 - DNA, 35 bp, Artificial Sequence
  Synthetic oligonucleotide
acactccaggtcgagttctttgcgcccctccgttt

SEQ ID NO: 140062 - DNA, 35 bp, Artificial Sequence
  Synthetic oligonucleotide
agttcacccctcctcgatcctgcttacgagcctaa

SEQ ID NO: 140063 - DNA, 35 bp, Artificial Sequence
  Synthetic oligonucleotide
gacgaagggggggtggaaagggggctagatcaaca

SEQ ID NO: 140064 - DNA, 35 bp, Artificial Sequence
  Synthetic oligonucleotide
gcgccagtccatctgacgtaattgccctttctcca

SEQ ID NO: 140065 - DNA, 36 bp, Artificial Sequence
  Synthetic oligonucleotide
gctgatgtgtgcactgtaccggccccctctttttca

SEQ ID NO: 140066 - DNA, 37 bp, Artificial Sequence
  Synthetic oligonucleotide
gtagggagcagggggaacgtgggtaggggtctgcaga

SEQ ID NO: 140067 - DNA, 37 bp, Artificial Sequence
  Synthetic oligonucleotide
tccaccctccgactgcacattccgggacctaactaga

SEQ ID NO: 140068 - DNA, 37 bp, Artificial Sequence
  Synthetic oligonucleotide
ggggagggtggagcaaggggaatggttacggcaccga

SEQ ID NO: 140069 - DNA, 36 bp, Artificial Sequence
  Synthetic oligonucleotide
gcgtagacgcaggatcagcaggagggaggggcggga

SEQ ID NO: 140070 - DNA, 37 bp, Artificial Sequence
  Synthetic oligonucleotide
tttgcttcggatgtctctccgccactcctcacactga

SEQ ID NO: 140071 - DNA, 38 bp, Artificial Sequence
  Synthetic oligonucleotide
tgtaccttcaccctggtttggtctgcctccctccgtga

SEQ ID NO: 140072 - DNA, 38 bp, Artificial Sequence
  Synthetic oligonucleotide
atagagacgagacggggggtgggccaggacggtggtga

SEQ ID NO: 140073 - DNA, 38 bp, Artificial Sequence
  Synthetic oligonucleotide
gagggacgggaaagtgagggtatcggatggggcattga

SEQ ID NO: 140074 - DNA, 36 bp, Artificial Sequence
  Synthetic oligonucleotide
gcctgcctctcgccgccttcttagcactgcccttga

SEQ ID NO: 140075 - DNA, 36 bp, Artificial Sequence
  Synthetic oligonucleotide
accgactcgatcctctgcgcgcccccactcgcttga

SEQ ID NO: 140076 - DNA, 36 bp, Artificial Sequence
  Synthetic oligonucleotide
tcattgctgccttttgcccgtaacatcgccctaata

SEQ ID NO: 140077 - DNA, 36 bp, Artificial Sequence
  Synthetic oligonucleotide
acacccacccgtttacgtcacgacctctcctcgata

SEQ ID NO: 140078 - DNA, 36 bp, Artificial Sequence
  Synthetic oligonucleotide
tgtctccccgtccgctcaccctcgctattgggccta

SEQ ID NO: 140079 - DNA, 36 bp, Artificial Sequence
  Synthetic oligonucleotide
acgccctctgcatcccccgtgctatctcttttggta

SEQ ID NO: 140080 - DNA, 35 bp, Artificial Sequence
  Synthetic oligonucleotide
agatcgcccccgcttgctttttgctgtcccgctta

SEQ ID NO: 140081 - DNA, 35 bp, Artificial Sequence
  Synthetic oligonucleotide
tctatcacatcacgctctggcttagcctatcaccc

SEQ ID NO: 140082 - DNA, 35 bp, Artificial Sequence
  Synthetic oligonucleotide
tgccgtgtcgattgctagtttacgtgccctccccc

SEQ ID NO: 140083 - DNA, 35 bp, Artificial Sequence
  Synthetic oligonucleotide
tcccatgcccacgatcctgtttttgccacacttcc

SEQ ID NO: 140084 - DNA, 35 bp, Artificial Sequence
  Synthetic oligonucleotide
tcaatccgccgacccgccttccattctgagtccgc

SEQ ID NO: 140085 - DNA, 35 bp, Artificial Sequence
  Synthetic oligonucleotide
actcatctatgcgccggtccccgttccctctatcg

SEQ ID NO: 140086 - DNA, 35 bp, Artificial Sequence
  Synthetic oligonucleotide
ggagagaggcaaaaggcggaggcacagttggcagg

SEQ ID NO: 140087 - DNA, 35 bp, Artificial Sequence
  Synthetic oligonucleotide
tatcacgggggggaatgggttagggagggaagggg

SEQ ID NO: 140088 - DNA, 35 bp, Artificial Sequence
  Synthetic oligonucleotide
ttccgccccccagtgtcaaaaaacccctccaacat

SEQ ID NO: 140089 - DNA, 35 bp, Artificial Sequence
  Synthetic oligonucleotide
actctgtccacttgttcgttcccgggcccatccat

SEQ ID NO: 140090 - DNA, 35 bp, Artificial Sequence
  Synthetic oligonucleotide
actgacaacctctgcataccttctacctgtaacct

SEQ ID NO: 140091 - DNA, 35 bp, Artificial Sequence
  Synthetic oligonucleotide
gcattgtgtcccccgatccggtccacgctatccct

SEQ ID NO: 140092 - DNA, 35 bp, Artificial Sequence
  Synthetic oligonucleotide
tatccgctttagctcccccgttccatctgtaggct

SEQ ID NO: 140093 - DNA, 35 bp, Artificial Sequence
  Synthetic oligonucleotide
aagtcgacgcctcgccccccaataattgtccttgt

SEQ ID NO: 140094 - DNA, 35 bp, Artificial Sequence
  Synthetic oligonucleotide
gtcataccgctagcccgcccgccccgtgtgcactt

SEQ ID NO: 140095 - DNA, 35 bp, Artificial Sequence
  Synthetic oligonucleotide
tccatcttcaagccgtcttttttcgccactctgtt

SEQ ID NO: 140096 - DNA, 35 bp, Artificial Sequence
  Synthetic oligonucleotide
acgttcaccatcacctactctccaggcggaccttt

SEQ ID NO: 140097 - DNA, 35 bp, Artificial Sequence
  Synthetic oligonucleotide
acaccaccaatgtcgtttcctggccatccctacaa

SEQ ID NO: 140098 - DNA, 36 bp, Artificial Sequence
  Synthetic oligonucleotide
aaacccgacggatgtctacccccccgtctcctccaa

SEQ ID NO: 140099 - DNA, 36 bp, Artificial Sequence
  Synthetic oligonucleotide
gcatgtctcctgcttctgtttacgccttgtcctcca

SEQ ID NO: 140100 - DNA, 36 bp, Artificial Sequence
  Synthetic oligonucleotide
acacctcacgctacgcacaatgcctttgcctctcca

SEQ ID NO: 140101 - DNA, 35 bp, Artificial Sequence
  Synthetic oligonucleotide
gccacaccctgggttttttctgttcgtattctcca

SEQ ID NO: 140102 - DNA, 36 bp, Artificial Sequence
  Synthetic oligonucleotide
tgccccctcccggcaccctgctagctcctgttagca

SEQ ID NO: 140103 - DNA, 35 bp, Artificial Sequence
  Synthetic oligonucleotide
actgatccatcccgccggagcccattcgctcatca

SEQ ID NO: 140104 - DNA, 36 bp, Artificial Sequence
  Synthetic oligonucleotide
atacaccccccgatgctacatgcctagttatgctca

SEQ ID NO: 140105 - DNA, 37 bp, Artificial Sequence
  Synthetic oligonucleotide
gatcgcccctatctgcacttcaggactctgttcccga

SEQ ID NO: 140106 - DNA, 35 bp, Artificial Sequence
  Synthetic oligonucleotide
gccaccccgctgcccttggacgtcaattaccatga

SEQ ID NO: 140107 - DNA, 37 bp, Artificial Sequence
  Synthetic oligonucleotide
ggtgggggcgagggggtggagggttctggttgagtga

SEQ ID NO: 140108 - DNA, 37 bp, Artificial Sequence
  Synthetic oligonucleotide
agactgggctgggtgggtatgggagttcgtgtggtga

SEQ ID NO: 140109 - DNA, 35 bp, Artificial Sequence
  Synthetic oligonucleotide
gtgacatcgcccagcttgatacccgctctccgcta

SEQ ID NO: 140110 - DNA, 35 bp, Artificial Sequence
  Synthetic oligonucleotide
gccacttgccccagtttctttcctctaacctaaac

SEQ ID NO: 140111 - DNA, 35 bp, Artificial Sequence
  Synthetic oligonucleotide
attccccgacaccaggtcctgcccttgttacgacc

SEQ ID NO: 140112 - DNA, 35 bp, Artificial Sequence
  Synthetic oligonucleotide
accgaggcaagcgcccgtccgtcgttgctgccgcc

SEQ ID NO: 140113 - DNA, 35 bp, Artificial Sequence
  Synthetic oligonucleotide
atatgccactgccatacccctctgcctacattgcc

SEQ ID NO: 140114 - DNA, 35 bp, Artificial Sequence
  Synthetic oligonucleotide
tgcaacgcatctccacatacgctaggtatccttcc

SEQ ID NO: 140115 - DNA, 35 bp, Artificial Sequence
  Synthetic oligonucleotide
tccttcacccgcaattgctctgccgagtactttcc

SEQ ID NO: 140116 - DNA, 35 bp, Artificial Sequence
  Synthetic oligonucleotide
tccactcgcacttcccccaccgtgccatagtttcc

SEQ ID NO: 140117 - DNA, 35 bp, Artificial Sequence
  Synthetic oligonucleotide
tgcccgtacccttccctgctgctctactctgctgc

SEQ ID NO: 140118 - DNA, 35 bp, Artificial Sequence
  Synthetic oligonucleotide
gcaccccgccggacttgtgcaccggtcctattatc

SEQ ID NO: 140119 - DNA, 35 bp, Artificial Sequence
  Synthetic oligonucleotide
ttgtgcggtcgggggccttttactgctcgtacctc

SEQ ID NO: 140120 - DNA, 35 bp, Artificial Sequence
  Synthetic oligonucleotide
gctccccacacgtagccatcgtgtactatctattc

SEQ ID NO: 140121 - DNA, 35 bp, Artificial Sequence
  Synthetic oligonucleotide
ggacatcccgcacatgaacccgtttcctgctctcg

SEQ ID NO: 140122 - DNA, 35 bp, Artificial Sequence
  Synthetic oligonucleotide
tgcaccttccttttacgatccccgcctcccacagg

SEQ ID NO: 140123 - DNA, 35 bp, Artificial Sequence
  Synthetic oligonucleotide
agccagacgggaacggggagcaggtaggcgatggg

SEQ ID NO: 140124 - DNA, 35 bp, Artificial Sequence
  Synthetic oligonucleotide
atctgacgcctgtggtccctaccgcccctacccct

SEQ ID NO: 140125 - DNA, 35 bp, Artificial Sequence
  Synthetic oligonucleotide
aactcgtactccgctatgtgtatcctgtcccccct

SEQ ID NO: 140126 - DNA, 35 bp, Artificial Sequence
  Synthetic oligonucleotide
tttacccagcgccagttcgtccattccatcgtcct

SEQ ID NO: 140127 - DNA, 35 bp, Artificial Sequence
  Synthetic oligonucleotide
gtatcttatcactacgcccgttcccatgctaatct

SEQ ID NO: 140128 - DNA, 35 bp, Artificial Sequence
  Synthetic oligonucleotide
gtgcgaatcctctcaccctgctgcccccccgctgt

SEQ ID NO: 140129 - DNA, 35 bp, Artificial Sequence
  Synthetic oligonucleotide
acggggaggggccgtgagcatgggaggggggtatt

SEQ ID NO: 140130 - DNA, 35 bp, Artificial Sequence
  Synthetic oligonucleotide
tagcaatcggcccgctaccagcccagttacacctt

SEQ ID NO: 140131 - DNA, 35 bp, Artificial Sequence
  Synthetic oligonucleotide
ggggccattcctcggttgttcattctcgatccttt

SEQ ID NO: 140132 - DNA, 35 bp, Artificial Sequence
  Synthetic oligonucleotide
gtcccggtcgtacgcatccctccatctggtcgttt

SEQ ID NO: 140133 - DNA, 36 bp, Artificial Sequence
  Synthetic oligonucleotide
tcaccatctacctgttatctctgttctccatgtaaa

SEQ ID NO: 140134 - DNA, 35 bp, Artificial Sequence
  Synthetic oligonucleotide
actcctcccgccgaaattgcctcacctggttacaa

SEQ ID NO: 140135 - DNA, 36 bp, Artificial Sequence
  Synthetic oligonucleotide
gcacgacgccaatccccggtatttcccatctttcaa

SEQ ID NO: 140136 - DNA, 35 bp, Artificial Sequence
  Synthetic oligonucleotide
actcgctccccccgcattcccccgccagagggaca

SEQ ID NO: 140137 - DNA, 35 bp, Artificial Sequence
  Synthetic oligonucleotide
ggacggggggggaggcgcacaagtaggctgggaca

SEQ ID NO: 140138 - DNA, 36 bp, Artificial Sequence
  Synthetic oligonucleotide
tcacacatcagcgtgttcgttcgccagctgccccca

SEQ ID NO: 140139 - DNA, 36 bp, Artificial Sequence
  Synthetic oligonucleotide
gcgaaccccatgccacggatcgtactccttcgccca

SEQ ID NO: 140140 - DNA, 35 bp, Artificial Sequence
  Synthetic oligonucleotide
tacgcaccacaatgtaccatccattttattctcca

SEQ ID NO: 140141 - DNA, 37 bp, Artificial Sequence
  Synthetic oligonucleotide
agagagatgcgggctcgagggggggagggacaacaga

SEQ ID NO: 140142 - DNA, 37 bp, Artificial Sequence
  Synthetic oligonucleotide
gatgctgggaaagagcggtggggccgggggttgagga

SEQ ID NO: 140143 - DNA, 36 bp, Artificial Sequence
  Synthetic oligonucleotide
ttgatccacggtcgttctctgttcgctccatcacta

SEQ ID NO: 140144 - DNA, 36 bp, Artificial Sequence
  Synthetic oligonucleotide
gtgcatacgttgtccgcctatgcccgcactccctta

SEQ ID NO: 140145 - DNA, 35 bp, Artificial Sequence
  Synthetic oligonucleotide
aatgccgcccccgtcttcgcgccctgcgccgctta

SEQ ID NO: 140146 - DNA, 35 bp, Artificial Sequence
  Synthetic oligonucleotide
tgagtgccactccgcctgtgccgacgcccaccaac

SEQ ID NO: 140147 - DNA, 35 bp, Artificial Sequence
  Synthetic oligonucleotide
gagatccccgtctggcaataccttggtcgctcccc

SEQ ID NO: 140148 - DNA, 35 bp, Artificial Sequence
  Synthetic oligonucleotide
cccgccccccctccggcatggtttgcggttcctcc

SEQ ID NO: 140149 - DNA, 35 bp, Artificial Sequence
  Synthetic oligonucleotide
tccgctccaccatgcgctcagtgcgtccgttctgc

SEQ ID NO: 140150 - DNA, 35 bp, Artificial Sequence
  Synthetic oligonucleotide
tgatcgccaccatcgcttaacgaccctgacctctc

SEQ ID NO: 140151 - DNA, 35 bp, Artificial Sequence
  Synthetic oligonucleotide
gttactcgccctgttgtccatcggatgctacgttc

SEQ ID NO: 140152 - DNA, 35 bp, Artificial Sequence
  Synthetic oligonucleotide
tccagcccgacgcgctgcgttcaaccctctctcat

SEQ ID NO: 140153 - DNA, 35 bp, Artificial Sequence
  Synthetic oligonucleotide
accatgtgcccacttcgttgagtttacggacccct

SEQ ID NO: 140154 - DNA, 35 bp, Artificial Sequence
  Synthetic oligonucleotide
gtggggcatcacgctggttcgcgtaacccttccct

SEQ ID NO: 140155 - DNA, 35 bp, Artificial Sequence
  Synthetic oligonucleotide
tgcccacagaatccgctttggtacgcgcactcgct

SEQ ID NO: 140156 - DNA, 35 bp, Artificial Sequence
  Synthetic oligonucleotide
gtcttgccccaagtctgccttatttgcaaccatct

SEQ ID NO: 140157 - DNA, 35 bp, Artificial Sequence
  Synthetic oligonucleotide
gaacaccctctcttgcttacctttaagaactttgt

SEQ ID NO: 140158 - DNA, 36 bp, Artificial Sequence
  Synthetic oligonucleotide
tgggggaggaggggctaggaaagggtcgtcgggcaa

SEQ ID NO: 140159 - DNA, 36 bp, Artificial Sequence
  Synthetic oligonucleotide
tgctagcagaccccgtcgtttcgcctgtcccaccca

SEQ ID NO: 140160 - DNA, 36 bp, Artificial Sequence
  Synthetic oligonucleotide
gtggcgaacgccgcccccctacatctgtgacacgca

SEQ ID NO: 140161 - DNA, 37 bp, Artificial Sequence
  Synthetic oligonucleotide
agatcatcttccgacactcccctcgcctgtccaccga

SEQ ID NO: 140162 - DNA, 36 bp, Artificial Sequence
  Synthetic oligonucleotide
gacgcggtaagcggggggacggacgtatggggagga

SEQ ID NO: 140163 - DNA, 37 bp, Artificial Sequence
  Synthetic oligonucleotide
tttgccatccatcctcttggtgtttactctccttgga

SEQ ID NO: 140164 - DNA, 37 bp, Artificial Sequence
  Synthetic oligonucleotide
tgcgaggatgggatgggcgtgggggggcacaaaatga

SEQ ID NO: 140165 - DNA, 38 bp, Artificial Sequence
  Synthetic oligonucleotide
tgaacaagcaagggggtgaagccggggcggggtaatga

SEQ ID NO: 140166 - DNA, 37 bp, Artificial Sequence
  Synthetic oligonucleotide
atgaccacccgctagactctaactgctcagtctatga

SEQ ID NO: 140167 - DNA, 38 bp, Artificial Sequence
  Synthetic oligonucleotide
ttcccgctcacagccctataaagcccccccctcattga

SEQ ID NO: 140168 - DNA, 38 bp, Artificial Sequence
  Synthetic oligonucleotide
tccaggtccgcaattcgcccataacacactcccgttga

SEQ ID NO: 140169 - DNA, 36 bp, Artificial Sequence
  Synthetic oligonucleotide
tattgccctgctcccatgcctcttatgccccgtata

SEQ ID NO: 140170 - DNA, 36 bp, Artificial Sequence
  Synthetic oligonucleotide
gacgccgtcgctggctctcccgtatctttttgccta

SEQ ID NO: 140171 - DNA, 35 bp, Artificial Sequence
  Synthetic oligonucleotide
aacacccactgtccttgggttcatgcaccccctta

SEQ ID NO: 140172 - DNA, 35 bp, Artificial Sequence
  Synthetic oligonucleotide
gaaggggggctcaaaatctggtggcggggttcaac

SEQ ID NO: 140173 - DNA, 35 bp, Artificial Sequence
  Synthetic oligonucleotide
gaccaccacattcttagttggacgctctcctccac

SEQ ID NO: 140174 - DNA, 34 bp, Artificial Sequence
  Synthetic oligonucleotide
tgttccacccgcatgctactcccctctatggtac

SEQ ID NO: 140175 - DNA, 35 bp, Artificial Sequence
  Synthetic oligonucleotide
tgactcctgcgctatgatccgatcgccccatgtac

SEQ ID NO: 140176 - DNA, 35 bp, Artificial Sequence
  Synthetic oligonucleotide
tgttgagccaatccggtctaatgcgcccctcaccc

SEQ ID NO: 140177 - DNA, 35 bp, Artificial Sequence
  Synthetic oligonucleotide
tgtcccgtacgctcgttatcttagttaccgttccc

SEQ ID NO: 140178 - DNA, 35 bp, Artificial Sequence
  Synthetic oligonucleotide
aatttatgcccccgtcaagctgcctatcgtcttcc

SEQ ID NO: 140179 - DNA, 35 bp, Artificial Sequence
  Synthetic oligonucleotide
tgacacgtactgttcatagtccgtcctctgccttc

SEQ ID NO: 140180 - DNA, 35 bp, Artificial Sequence
  Synthetic oligonucleotide
ccatcccccgttcctgcatagtgcattattccacg

SEQ ID NO: 140181 - DNA, 35 bp, Artificial Sequence
  Synthetic oligonucleotide
atggtaccgtggcggggagggggctgacgggagtg

SEQ ID NO: 140182 - DNA, 35 bp, Artificial Sequence
  Synthetic oligonucleotide
tccacccattcccatcatcaactgtgagtgctact

SEQ ID NO: 140183 - DNA, 35 bp, Artificial Sequence
  Synthetic oligonucleotide
tctcgctcccttcccgatcctaggtcagttagcct

SEQ ID NO: 140184 - DNA, 35 bp, Artificial Sequence
  Synthetic oligonucleotide
acagatgcacctgtacactctcccgccaatggcct

SEQ ID NO: 140185 - DNA, 35 bp, Artificial Sequence
  Synthetic oligonucleotide
aatctccgtcccgctctgtcaaagccgtacttcct

SEQ ID NO: 140186 - DNA, 34 bp, Artificial Sequence
  Synthetic oligonucleotide
gcccttgccgccaatggtgcttgttctctgttct

SEQ ID NO: 140187 - DNA, 35 bp, Artificial Sequence
  Synthetic oligonucleotide
gacaccccaaggtatactgggtgccccctcctctt

SEQ ID NO: 140188 - DNA, 36 bp, Artificial Sequence
  Synthetic oligonucleotide
gccagagcccgccacgttttttctaccacatgtaca

SEQ ID NO: 140189 - DNA, 36 bp, Artificial Sequence
  Synthetic oligonucleotide
tacccgcccctcaatccgttagcacgaacgcaatca

SEQ ID NO: 140190 - DNA, 36 bp, Artificial Sequence
  Synthetic oligonucleotide
acatgggagcgggggggggaggtaggagcgagggga

SEQ ID NO: 140191 - DNA, 38 bp, Artificial Sequence
  Synthetic oligonucleotide
atgggggtgtgggatggggaaaggcggggtggtgatga

SEQ ID NO: 140192 - DNA, 38 bp, Artificial Sequence
  Synthetic oligonucleotide
tgacctcagggtggcgtgggagggccccatatttctga

SEQ ID NO: 140193 - DNA, 38 bp, Artificial Sequence
  Synthetic oligonucleotide
atcgaccgggtgggtaggggaagacgggatccaggtga

SEQ ID NO: 140194 - DNA, 35 bp, Artificial Sequence
  Synthetic oligonucleotide
gacgggagggaaaggaggggggggttaagtaacta

SEQ ID NO: 140195 - DNA, 36 bp, Artificial Sequence
  Synthetic oligonucleotide
tagttcgcccctgccacatcgcttaacttgactgta

SEQ ID NO: 140196 - DNA, 35 bp, Artificial Sequence
  Synthetic oligonucleotide
gatgactcccgtagatccatcgttatttcccgtta

SEQ ID NO: 140197 - DNA, 35 bp, Artificial Sequence
  Synthetic oligonucleotide
tccatcctccgccatgtacacccgtgcgtttccac

SEQ ID NO: 140198 - DNA, 35 bp, Artificial Sequence
  Synthetic oligonucleotide
atcgctcggtccccctgctctttttgcggtattac

SEQ ID NO: 140199 - DNA, 35 bp, Artificial Sequence
  Synthetic oligonucleotide
tcgacctcgtatttgtccgcttctcgtccgccacc

SEQ ID NO: 140200 - DNA, 35 bp, Artificial Sequence
  Synthetic oligonucleotide
actagacacgcctccgaaagcgagccatcctgccc

SEQ ID NO: 140201 - DNA, 35 bp, Artificial Sequence
  Synthetic oligonucleotide
accgctctcccgttccttcgattagcgcaaccgcc

SEQ ID NO: 140202 - DNA, 35 bp, Artificial Sequence
  Synthetic oligonucleotide
agccgaggccggaattttatgccccctgtcttgcc

SEQ ID NO: 140203 - DNA, 35 bp, Artificial Sequence
  Synthetic oligonucleotide
acgttcccacttgtgttgtacatactcacccctcc

SEQ ID NO: 140204 - DNA, 35 bp, Artificial Sequence
  Synthetic oligonucleotide
gacgcaagcagtagcgcacttctgaccaccccagc

SEQ ID NO: 140205 - DNA, 35 bp, Artificial Sequence
  Synthetic oligonucleotide
tgacgcccctgctgctagaccgccaaactctcagc

SEQ ID NO: 140206 - DNA, 35 bp, Artificial Sequence
  Synthetic oligonucleotide
acgcgatgacatatagtcgttctccaccacttcgc

SEQ ID NO: 140207 - DNA, 35 bp, Artificial Sequence
  Synthetic oligonucleotide
tgccacgcacacctggcgtcacgcatctattctgc

SEQ ID NO: 140208 - DNA, 35 bp, Artificial Sequence
  Synthetic oligonucleotide
tgagcaccactgacgcctccactaaacccggttgc

SEQ ID NO: 140209 - DNA, 35 bp, Artificial Sequence
  Synthetic oligonucleotide
acccgtccagccattactcccatttccgtctttgc

SEQ ID NO: 140210 - DNA, 35 bp, Artificial Sequence
  Synthetic oligonucleotide
tgccggctagccatcacgtcgtcccacttcttctc

SEQ ID NO: 140211 - DNA, 35 bp, Artificial Sequence
  Synthetic oligonucleotide
tgcggaccaatcatgtcgtccggcccattcctgtc

SEQ ID NO: 140212 - DNA, 35 bp, Artificial Sequence
  Synthetic oligonucleotide
tccgtctcccgcgtcctagtaattgccgctccttc

SEQ ID NO: 140213 - DNA, 35 bp, Artificial Sequence
  Synthetic oligonucleotide
agggaaccgtgctgtgattcccctcttcgcctacg

SEQ ID NO: 140214 - DNA, 35 bp, Artificial Sequence
  Synthetic oligonucleotide
gctatccaaccctgccactgatcgacctcgccccg

SEQ ID NO: 140215 - DNA, 35 bp, Artificial Sequence
  Synthetic oligonucleotide
gatgcaaggcacgcggggggaagggctgatgggcg

SEQ ID NO: 140216 - DNA, 35 bp, Artificial Sequence
  Synthetic oligonucleotide
tacgaagtgaaggtgttggttcgtggaaggagggg

SEQ ID NO: 140217 - DNA, 35 bp, Artificial Sequence
  Synthetic oligonucleotide
tcccaccgttcccttctccggtgccagctcccctt

SEQ ID NO: 140218 - DNA, 35 bp, Artificial Sequence
  Synthetic oligonucleotide
agagacgccgaaccgcgccgcatcgcccttccctt

SEQ ID NO: 140219 - DNA, 35 bp, Artificial Sequence
  Synthetic oligonucleotide
gcccacacctcataatctgtatgtaatacccgctt

SEQ ID NO: 140220 - DNA, 35 bp, Artificial Sequence
  Synthetic oligonucleotide
ggagggtggagagggattgggtaccagttcccttt

SEQ ID NO: 140221 - DNA, 36 bp, Artificial Sequence
  Synthetic oligonucleotide
tccaccactcgccgcgctataatgcccattcgtcaa

SEQ ID NO: 140222 - DNA, 37 bp, Artificial Sequence
  Synthetic oligonucleotide
gatgcggggataggcgggtggggggcagaaggaaaga

SEQ ID NO: 140223 - DNA, 37 bp, Artificial Sequence
  Synthetic oligonucleotide
ttccactgcctttactcgtgcctccagaccactacga

SEQ ID NO: 140224 - DNA, 37 bp, Artificial Sequence
  Synthetic oligonucleotide
ggtcccgcttggctttgtcttctcgccgtttccccga

SEQ ID NO: 140225 - DNA, 37 bp, Artificial Sequence
  Synthetic oligonucleotide
gtgcccctcccgcttagaccgtttttagtactgccga

SEQ ID NO: 140226 - DNA, 37 bp, Artificial Sequence
  Synthetic oligonucleotide
gtcacgggggggtggtggcaacacgtagcagggggga

SEQ ID NO: 140227 - DNA, 37 bp, Artificial Sequence
  Synthetic oligonucleotide
gaacgcacgagggaggcatgagggggtgttaatggga

SEQ ID NO: 140228 - DNA, 37 bp, Artificial Sequence
  Synthetic oligonucleotide
acgaaaagcctgaaaaagggtgggaacggggctggga

SEQ ID NO: 140229 - DNA, 37 bp, Artificial Sequence
  Synthetic oligonucleotide
atgccggagaagaaggaggagccggggggacaatgga

SEQ ID NO: 140230 - DNA, 37 bp, Artificial Sequence
  Synthetic oligonucleotide
ttagtgccagcgatcgcctcatacccctccgccctga

SEQ ID NO: 140231 - DNA, 37 bp, Artificial Sequence
  Synthetic oligonucleotide
tgtcgccgtccccttccgtcactcagaactgccctga

SEQ ID NO: 140232 - DNA, 37 bp, Artificial Sequence
  Synthetic oligonucleotide
agccgccccatctactattgatccctgttcccggtga

SEQ ID NO: 140233 - DNA, 35 bp, Artificial Sequence
  Synthetic oligonucleotide
agccacgtggacctgctgatcactcctgttcctta

SEQ ID NO: 140234 - DNA, 35 bp, Artificial Sequence
  Synthetic oligonucleotide
tcgattcgcctctgacatccaccagttattcacac

SEQ ID NO: 140235 - DNA, 35 bp, Artificial Sequence
  Synthetic oligonucleotide
ttgtgatcgacctccccccgtgttactcggtaacc

SEQ ID NO: 140236 - DNA, 35 bp, Artificial Sequence
  Synthetic oligonucleotide
taagtccgccacggttgtcgcgctaacctcgcccc

SEQ ID NO: 140237 - DNA, 36 bp, Artificial Sequence
  Synthetic oligonucleotide
ggagccccccacgtcctcgtagcgatattccggccc

SEQ ID NO: 140238 - DNA, 35 bp, Artificial Sequence
  Synthetic oligonucleotide
acccgttagaaccgaccccgcctgcatgcccttcc

SEQ ID NO: 140239 - DNA, 35 bp, Artificial Sequence
  Synthetic oligonucleotide
tcggggtgtcagccccctccacgcccatcccttcc

SEQ ID NO: 140240 - DNA, 35 bp, Artificial Sequence
  Synthetic oligonucleotide
cagtactgctggtcgcctctttccgtcacctttcc

SEQ ID NO: 140241 - DNA, 35 bp, Artificial Sequence
  Synthetic oligonucleotide
gcaccctgcgccaactgattgccatcctataccgc

SEQ ID NO: 140242 - DNA, 35 bp, Artificial Sequence
  Synthetic oligonucleotide
gacccaccctccatcgtgtttgtgacttgacccgc

SEQ ID NO: 140243 - DNA, 35 bp, Artificial Sequence
  Synthetic oligonucleotide
tcagacagcgcatgccccatggtcgctcctctcgc

SEQ ID NO: 140244 - DNA, 35 bp, Artificial Sequence
  Synthetic oligonucleotide
gtacgctcccgcctccccctaaggacttagggatc

SEQ ID NO: 140245 - DNA, 35 bp, Artificial Sequence
  Synthetic oligonucleotide
ggtcaccagtgccgcacactcctcgtctcctcgtc

SEQ ID NO: 140246 - DNA, 35 bp, Artificial Sequence
  Synthetic oligonucleotide
gcgtatgcctgcagtccgttcttgccgccccatag

SEQ ID NO: 140247 - DNA, 35 bp, Artificial Sequence
  Synthetic oligonucleotide
gttgccgcctcacttgtcatcatgtaacattcgcg

SEQ ID NO: 140248 - DNA, 35 bp, Artificial Sequence
  Synthetic oligonucleotide
gcagtccacttctccttccccttacccgtactggg

SEQ ID NO: 140249 - DNA, 35 bp, Artificial Sequence
  Synthetic oligonucleotide
tttaggccccaccctgcctcgtcccccactattgg

SEQ ID NO: 140250 - DNA, 35 bp, Artificial Sequence
  Synthetic oligonucleotide
ggacactctctccgaccgtgcgaaaccctctttgg

SEQ ID NO: 140251 - DNA, 35 bp, Artificial Sequence
  Synthetic oligonucleotide
gtccacccgctcacttatccctgtgccttctgtat

SEQ ID NO: 140252 - DNA, 35 bp, Artificial Sequence
  Synthetic oligonucleotide
gttacgctgttcacattggccctctctccacttat

SEQ ID NO: 140253 - DNA, 35 bp, Artificial Sequence
  Synthetic oligonucleotide
taggccccactgaacctattgagctcgattcccct

SEQ ID NO: 140254 - DNA, 35 bp, Artificial Sequence
  Synthetic oligonucleotide
atgccatagcccttctgtagttccggttagttcct

SEQ ID NO: 140255 - DNA, 35 bp, Artificial Sequence
  Synthetic oligonucleotide
tcgccccgcccggctgtttcgctccccccaagatt

SEQ ID NO: 140256 - DNA, 35 bp, Artificial Sequence
  Synthetic oligonucleotide
tcaatgcgctacttggactccatgctcccgccctt

SEQ ID NO: 140257 - DNA, 35 bp, Artificial Sequence
  Synthetic oligonucleotide
gtctgcccaccgcgcgtatttcacgctacattgtt

SEQ ID NO: 140258 - DNA, 35 bp, Artificial Sequence
  Synthetic oligonucleotide
tcttgcccgttcccgccagcgcccgttttacttca

SEQ ID NO: 140259 - DNA, 37 bp, Artificial Sequence
  Synthetic oligonucleotide
ggtaagctatgggcatgggggggaggggtcgggcaga

SEQ ID NO: 140260 - DNA, 37 bp, Artificial Sequence
  Synthetic oligonucleotide
tgacgtaccgccccccacgatagagtttctgccacga

SEQ ID NO: 140261 - DNA, 37 bp, Artificial Sequence
  Synthetic oligonucleotide
gtgagggggacgaggggtttggaaggagcatatacga

SEQ ID NO: 140262 - DNA, 37 bp, Artificial Sequence
  Synthetic oligonucleotide
accacgccttatccagttctatctactgcctccccga

SEQ ID NO: 140263 - DNA, 37 bp, Artificial Sequence
  Synthetic oligonucleotide
acatgccgaggaggggaagaaagaggggcgcggccga

SEQ ID NO: 140264 - DNA, 37 bp, Artificial Sequence
  Synthetic oligonucleotide
tgaccccactcccaccgttactcgttaccagtttcga

SEQ ID NO: 140265 - DNA, 36 bp, Artificial Sequence
  Synthetic oligonucleotide
accccccgcccatctcacgagccactcctgtttcga

SEQ ID NO: 140266 - DNA, 37 bp, Artificial Sequence
  Synthetic oligonucleotide
tcccggtcgcctctctaccacctcttgccctctcgga

SEQ ID NO: 140267 - DNA, 38 bp, Artificial Sequence
  Synthetic oligonucleotide
aggaagggggaagggcctaaacggggacttgggaatga

SEQ ID NO: 140268 - DNA, 38 bp, Artificial Sequence
  Synthetic oligonucleotide
gcacactcctgaattgcattgcaccatacctccactga

SEQ ID NO: 140269 - DNA, 37 bp, Artificial Sequence
  Synthetic oligonucleotide
gcacacttgatcgtcgttagttcttctccttccgtga

SEQ ID NO: 140270 - DNA, 35 bp, Artificial Sequence
  Synthetic oligonucleotide
tccagcactacacttccgtccgtttccgccaccta

SEQ ID NO: 140271 - DNA, 35 bp, Artificial Sequence
  Synthetic oligonucleotide
tgcctccgccctttgtccgggctcatttcataacc

SEQ ID NO: 140272 - DNA, 35 bp, Artificial Sequence
  Synthetic oligonucleotide
tgggctcaccggtcgctccctgtcgctatcccccc

SEQ ID NO: 140273 - DNA, 35 bp, Artificial Sequence
  Synthetic oligonucleotide
acttctcctgcttcacctggttatctctccttgcc

SEQ ID NO: 140274 - DNA, 35 bp, Artificial Sequence
  Synthetic oligonucleotide
atatgctgtcggcacctcctcgctttatacgttcc

SEQ ID NO: 140275 - DNA, 35 bp, Artificial Sequence
  Synthetic oligonucleotide
actcgcccgcgctccacgcctccaccatcacccgc

SEQ ID NO: 140276 - DNA, 35 bp, Artificial Sequence
  Synthetic oligonucleotide
acacgctcaactgattgtgccctctacccatccgc

SEQ ID NO: 140277 - DNA, 35 bp, Artificial Sequence
  Synthetic oligonucleotide
aagtgcaccctttctgtagttcgtttcgctatatc

SEQ ID NO: 140278 - DNA, 35 bp, Artificial Sequence
  Synthetic oligonucleotide
gaaacgtccagactgttcctgtcgctagcttcctc

SEQ ID NO: 140279 - DNA, 35 bp, Artificial Sequence
  Synthetic oligonucleotide
gcctgccatcatatgcactccctggtatcctcgtc

SEQ ID NO: 140280 - DNA, 35 bp, Artificial Sequence
  Synthetic oligonucleotide
ggacacaccctctcgcggtattaagccctttgttc

SEQ ID NO: 140281 - DNA, 35 bp, Artificial Sequence
  Synthetic oligonucleotide
tagcgccaacccacttgcccccgattttcagtccg

SEQ ID NO: 140282 - DNA, 35 bp, Artificial Sequence
  Synthetic oligonucleotide
ccataccttcccacagcttcgtctccgcctgtccg

SEQ ID NO: 140283 - DNA, 35 bp, Artificial Sequence
  Synthetic oligonucleotide
attgggcgggcacggagggggattagggataggcg

SEQ ID NO: 140284 - DNA, 35 bp, Artificial Sequence
  Synthetic oligonucleotide
gtcgctcagccactcttcatgactcttctcctgcg

SEQ ID NO: 140285 - DNA, 35 bp, Artificial Sequence
  Synthetic oligonucleotide
gcctgacctcgctccgctccatgaatgcccactcg

SEQ ID NO: 140286 - DNA, 35 bp, Artificial Sequence
  Synthetic oligonucleotide
gatgccccccacggcctattatctccattctgtcg

SEQ ID NO: 140287 - DNA, 35 bp, Artificial Sequence
  Synthetic oligonucleotide
tcccattcagctatcatgtcttctatcgtctcctg

SEQ ID NO: 140288 - DNA, 35 bp, Artificial Sequence
  Synthetic oligonucleotide
ttgcttcagtgcatctcatgtcgcccttccccgtg

SEQ ID NO: 140289 - DNA, 35 bp, Artificial Sequence
  Synthetic oligonucleotide
tgcatggactcctgcctttgatatattcctccgtg

SEQ ID NO: 140290 - DNA, 36 bp, Artificial Sequence
  Synthetic oligonucleotide
tctgcccctgaacgagtaattcgaaccctctgccat

SEQ ID NO: 140291 - DNA, 35 bp, Artificial Sequence
  Synthetic oligonucleotide
tcacgctccctctcgactctcttacctagttatgt

SEQ ID NO: 140292 - DNA, 35 bp, Artificial Sequence
  Synthetic oligonucleotide
acgacaggccccttttgcttccacgagttaccgtt

SEQ ID NO: 140293 - DNA, 35 bp, Artificial Sequence
  Synthetic oligonucleotide
gttggtcacacgcccctccccgtattggaatcgtt

SEQ ID NO: 140294 - DNA, 35 bp, Artificial Sequence
  Synthetic oligonucleotide
tccccgctcgccactatcccgctcgacattagcaa

SEQ ID NO: 140295 - DNA, 35 bp, Artificial Sequence
  Synthetic oligonucleotide
acccgccccgaaccacctcgcgccataccccgcaa

SEQ ID NO: 140296 - DNA, 35 bp, Artificial Sequence
  Synthetic oligonucleotide
tatcacgcgtgtctttgccggtagcccctgtttca

SEQ ID NO: 140297 - DNA, 37 bp, Artificial Sequence
  Synthetic oligonucleotide
atgggacacagatgtcggggggtgggtaaggggaaga

SEQ ID NO: 140298 - DNA, 36 bp, Artificial Sequence
  Synthetic oligonucleotide
gcccctcacatccactgccaatcgcctcctacgaga

SEQ ID NO: 140299 - DNA, 36 bp, Artificial Sequence
  Synthetic oligonucleotide
tggacgaggggtgcgaggagagagagaggtgcagga

SEQ ID NO: 140300 - DNA, 36 bp, Artificial Sequence
  Synthetic oligonucleotide
agatagtgacggctgataggaaggggaaggatggga

SEQ ID NO: 140301 - DNA, 38 bp, Artificial Sequence
  Synthetic oligonucleotide
atgactgctagacctccgacctccgcccccgttgctga

SEQ ID NO: 140302 - DNA, 36 bp, Artificial Sequence
  Synthetic oligonucleotide
gattggaggagggggggataagaacgagtcacgtga

SEQ ID NO: 140303 - DNA, 38 bp, Artificial Sequence
  Synthetic oligonucleotide
attgcggtcacccaccgtcccctccgttcgacccgtga

SEQ ID NO: 140304 - DNA, 35 bp, Artificial Sequence
  Synthetic oligonucleotide
ggaccaagggatggagcgttggagagagggggtga

SEQ ID NO: 140305 - DNA, 35 bp, Artificial Sequence
  Synthetic oligonucleotide
atctaccctccgcagtcttttcgagcacaatcgac

SEQ ID NO: 140306 - DNA, 35 bp, Artificial Sequence
  Synthetic oligonucleotide
ttcggaacatcctcgcctcctattcagttagcccc

SEQ ID NO: 140307 - DNA, 35 bp, Artificial Sequence
  Synthetic oligonucleotide
tcttctgccccagtatcggccgccccgaccttccc

SEQ ID NO: 140308 - DNA, 35 bp, Artificial Sequence
  Synthetic oligonucleotide
agtacacccgccgttgaatttcaacgatccacgcc

SEQ ID NO: 140309 - DNA, 35 bp, Artificial Sequence
  Synthetic oligonucleotide
gctccccgtcggtacacgtcggcttatgaccttcc

SEQ ID NO: 140310 - DNA, 35 bp, Artificial Sequence
  Synthetic oligonucleotide
tcccacgtcgtctggcccgccctcacccttaccgc

SEQ ID NO: 140311 - DNA, 35 bp, Artificial Sequence
  Synthetic oligonucleotide
acatcgttcggtccaccacgtctcgtttctttcgc

SEQ ID NO: 140312 - DNA, 35 bp, Artificial Sequence
  Synthetic oligonucleotide
atgctccaacctctaggtcgcctgtcaccacctgc

SEQ ID NO: 140313 - DNA, 31 bp, Artificial Sequence
  Synthetic oligonucleotide
tcccaatagctacctccgccctatttgcctc

SEQ ID NO: 140314 - DNA, 35 bp, Artificial Sequence
  Synthetic oligonucleotide
gtgaggggggaggggaagtgggtgtggcttaggtc

SEQ ID NO: 140315 - DNA, 35 bp, Artificial Sequence
  Synthetic oligonucleotide
gacgatcctccccgtgtgtttcatttctacatgcg

SEQ ID NO: 140316 - DNA, 35 bp, Artificial Sequence
  Synthetic oligonucleotide
gcctgtggaggctggggattttaaggggggggtgg

SEQ ID NO: 140317 - DNA, 35 bp, Artificial Sequence
  Synthetic oligonucleotide
gtcgcatgtccacaatacactgcctgcccaccgat

SEQ ID NO: 140318 - DNA, 35 bp, Artificial Sequence
  Synthetic oligonucleotide
tgcaaccctgagttccattaagtccaacaccgcct

SEQ ID NO: 140319 - DNA, 35 bp, Artificial Sequence
  Synthetic oligonucleotide
acaccccatccattggtagcatcaaaggccttcct

SEQ ID NO: 140320 - DNA, 35 bp, Artificial Sequence
  Synthetic oligonucleotide
gcaacgccccccctgtcatccctcctccgtgcgct

SEQ ID NO: 140321 - DNA, 35 bp, Artificial Sequence
  Synthetic oligonucleotide
agtcccaaccggctcatggccctgctttccactgt

SEQ ID NO: 140322 - DNA, 35 bp, Artificial Sequence
  Synthetic oligonucleotide
aaccctgccctctcgattgaacttcttgttcctgt

SEQ ID NO: 140323 - DNA, 35 bp, Artificial Sequence
  Synthetic oligonucleotide
acgagccggaggggtagttagtgtgggtgggagtt

SEQ ID NO: 140324 - DNA, 35 bp, Artificial Sequence
  Synthetic oligonucleotide
ggactcctcacacccctgtgcagtattacaccttt

SEQ ID NO: 140325 - DNA, 36 bp, Artificial Sequence
  Synthetic oligonucleotide
tatggggggagcgagagggactaagaacgcgcagaa

SEQ ID NO: 140326 - DNA, 36 bp, Artificial Sequence
  Synthetic oligonucleotide
ttcagccggatcacgcgtttcattccatccttccca

SEQ ID NO: 140327 - DNA, 35 bp, Artificial Sequence
  Synthetic oligonucleotide
tactgctccaccatggtccatcttcaccgacgaga

SEQ ID NO: 140328 - DNA, 37 bp, Artificial Sequence
  Synthetic oligonucleotide
atccgtgacaggggggtggagcgggtaagtagttaga

SEQ ID NO: 140329 - DNA, 37 bp, Artificial Sequence
  Synthetic oligonucleotide
acatgaccgccccgttccgcccgatgcaatgcatcga

SEQ ID NO: 140330 - DNA, 36 bp, Artificial Sequence
  Synthetic oligonucleotide
gccaacgctccggcctcctacgtagcctcccctcga

SEQ ID NO: 140331 - DNA, 37 bp, Artificial Sequence
  Synthetic oligonucleotide
gtcgtccgccgctgcctactatacatctccttgtcga

SEQ ID NO: 140332 - DNA, 37 bp, Artificial Sequence
  Synthetic oligonucleotide
gccacccccttctgtctcccatggccgagataacgga

SEQ ID NO: 140333 - DNA, 37 bp, Artificial Sequence
  Synthetic oligonucleotide
atccccgactccgcctatgacctcgccatcacttgga

SEQ ID NO: 140334 - DNA, 35 bp, Artificial Sequence
  Synthetic oligonucleotide
tttcgcccccccgttcccctttatggtcagactga

SEQ ID NO: 140335 - DNA, 36 bp, Artificial Sequence
  Synthetic oligonucleotide
ggaccagtcaggtaggggaggaggagcggtaggtga

SEQ ID NO: 140336 - DNA, 37 bp, Artificial Sequence
  Synthetic oligonucleotide
aacagggtggtgacgtgggtggggcttaacagcttga

SEQ ID NO: 140337 - DNA, 36 bp, Artificial Sequence
  Synthetic oligonucleotide
ttaccactagacgtattctagcctgttcttccctta

SEQ ID NO: 140338 - DNA, 35 bp, Artificial Sequence
  Synthetic oligonucleotide
actgctgacgacgccgatacttcgtcccgctcccc

SEQ ID NO: 140339 - DNA, 35 bp, Artificial Sequence
  Synthetic oligonucleotide
gcacgcctccacaacacgtcacccgttattccgcc

SEQ ID NO: 140340 - DNA, 35 bp, Artificial Sequence
  Synthetic oligonucleotide
gggcggggagggtgggacccgagttacaacttgcc

SEQ ID NO: 140341 - DNA, 35 bp, Artificial Sequence
  Synthetic oligonucleotide
acgatagggccccctctgtactttctcaggcatcc

SEQ ID NO: 140342 - DNA, 35 bp, Artificial Sequence
  Synthetic oligonucleotide
ggacggccatcccggatattacttgtgctccctcc

SEQ ID NO: 140343 - DNA, 35 bp, Artificial Sequence
  Synthetic oligonucleotide
tctgacccatcccctctgatattgccttaggttcc

SEQ ID NO: 140344 - DNA, 35 bp, Artificial Sequence
  Synthetic oligonucleotide
gcatggctccacctcaatccgtcttttatacacgc

SEQ ID NO: 140345 - DNA, 35 bp, Artificial Sequence
  Synthetic oligonucleotide
tgccacattttgcatctttcaccctgctatttcgc

SEQ ID NO: 140346 - DNA, 35 bp, Artificial Sequence
  Synthetic oligonucleotide
ggagacttcactagctatacccgcccccatccggc

SEQ ID NO: 140347 - DNA, 35 bp, Artificial Sequence
  Synthetic oligonucleotide
agttccggcccccaatgccctcactattgaacctc

SEQ ID NO: 140348 - DNA, 35 bp, Artificial Sequence
  Synthetic oligonucleotide
ggagatgggtcgggtggggaatggtgagagatcag

SEQ ID NO: 140349 - DNA, 35 bp, Artificial Sequence
  Synthetic oligonucleotide
gctcacctccgttcgtccatacggctacacttgcg

SEQ ID NO: 140350 - DNA, 35 bp, Artificial Sequence
  Synthetic oligonucleotide
gtggttaccggaacagggggaaaaaaggtggaatg

SEQ ID NO: 140351 - DNA, 35 bp, Artificial Sequence
  Synthetic oligonucleotide
gcacctaccatctggctccacactccctccagact

SEQ ID NO: 140352 - DNA, 35 bp, Artificial Sequence
  Synthetic oligonucleotide
tgtcaacagcacgcatcgccactcaggctacctct

SEQ ID NO: 140353 - DNA, 35 bp, Artificial Sequence
  Synthetic oligonucleotide
atcaatccgcccgtgatatctggtttttgtccctt

SEQ ID NO: 140354 - DNA, 35 bp, Artificial Sequence
  Synthetic oligonucleotide
ggacaccgccttacactcgtttagtacttcctttt

SEQ ID NO: 140355 - DNA, 35 bp, Artificial Sequence
  Synthetic oligonucleotide
ttgggggcgaacttgaaaaggggggaagcggggaa

SEQ ID NO: 140356 - DNA, 36 bp, Artificial Sequence
  Synthetic oligonucleotide
agtgtcacacgtccccgctggtctatctgttcgcca

SEQ ID NO: 140357 - DNA, 35 bp, Artificial Sequence
  Synthetic oligonucleotide
tacagtgcctcttgcgcaaagcggtctcccctcca

SEQ ID NO: 140358 - DNA, 37 bp, Artificial Sequence
  Synthetic oligonucleotide
gtgaagcaggggatcggtgaagggagcggatgggaga

SEQ ID NO: 140359 - DNA, 37 bp, Artificial Sequence
  Synthetic oligonucleotide
atacccgatcgatccgtacacctccactcgtcgccga

SEQ ID NO: 140360 - DNA, 37 bp, Artificial Sequence
  Synthetic oligonucleotide
tcctaatgcctcgatctgttctcgttatgcccttcga

SEQ ID NO: 140361 - DNA, 35 bp, Artificial Sequence
  Synthetic oligonucleotide
aaccccatcgcacacattggattacgctccttcga

SEQ ID NO: 140362 - DNA, 37 bp, Artificial Sequence
  Synthetic oligonucleotide
gagtaagaggggggacagaagaggggggataacagga

SEQ ID NO: 140363 - DNA, 37 bp, Artificial Sequence
  Synthetic oligonucleotide
tcgaaggggcaacggtgtagggagggatcactgggga

SEQ ID NO: 140364 - DNA, 38 bp, Artificial Sequence
  Synthetic oligonucleotide
tcaccgtcgttcagctctttcttccatccgtttactga

SEQ ID NO: 140365 - DNA, 36 bp, Artificial Sequence
  Synthetic oligonucleotide
gagccccctccccgccgcctgctgtagcctatctga

SEQ ID NO: 140366 - DNA, 38 bp, Artificial Sequence
  Synthetic oligonucleotide
aagaggtggcacagggaggaacaggagcagggggttga

SEQ ID NO: 140367 - DNA, 35 bp, Artificial Sequence
  Synthetic oligonucleotide
gcctgcccagcagttaatgctggcttggattcccc

SEQ ID NO: 140368 - DNA, 35 bp, Artificial Sequence
  Synthetic oligonucleotide
gccaccaccctcgtccaatgggacgtccgttcccc

SEQ ID NO: 140369 - DNA, 35 bp, Artificial Sequence
  Synthetic oligonucleotide
tcgatcccgcgcgcgcacccttctcgtggtttccc

SEQ ID NO: 140370 - DNA, 35 bp, Artificial Sequence
  Synthetic oligonucleotide
acgacccacccaacctcggtatcccttgtacatcc

SEQ ID NO: 140371 - DNA, 35 bp, Artificial Sequence
  Synthetic oligonucleotide
gccaagctgccgcatgacgcgctctaccctagtcc

SEQ ID NO: 140372 - DNA, 35 bp, Artificial Sequence
  Synthetic oligonucleotide
aaaatcaccgtgctcatgagtctccttttctgtcc

SEQ ID NO: 140373 - DNA, 35 bp, Artificial Sequence
  Synthetic oligonucleotide
attgcttcccacacctgccccgaccgggtactatc

SEQ ID NO: 140374 - DNA, 35 bp, Artificial Sequence
  Synthetic oligonucleotide
actgcccaaccagggtaccatgccatgctcccctc

SEQ ID NO: 140375 - DNA, 35 bp, Artificial Sequence
  Synthetic oligonucleotide
aattccgccacccctccctcttgtattaacactag

SEQ ID NO: 140376 - DNA, 35 bp, Artificial Sequence
  Synthetic oligonucleotide
tccgacgaactgcctcacatccaccgctccacacg

SEQ ID NO: 140377 - DNA, 35 bp, Artificial Sequence
  Synthetic oligonucleotide
tgaccactcccctatgttaacacacgtcgccaccg

SEQ ID NO: 140378 - DNA, 35 bp, Artificial Sequence
  Synthetic oligonucleotide
gacaggcgttctttccgtctctcgttcccgcgccg

SEQ ID NO: 140379 - DNA, 35 bp, Artificial Sequence
  Synthetic oligonucleotide
gcacaccccgccgcattcataacctttggacgtcg

SEQ ID NO: 140380 - DNA, 35 bp, Artificial Sequence
  Synthetic oligonucleotide
gatcacgtcgtcattgtcattttattgccccttcg

SEQ ID NO: 140381 - DNA, 34 bp, Artificial Sequence
  Synthetic oligonucleotide
tacatcctacgcccactgacccgtggtcccccct

SEQ ID NO: 140382 - DNA, 35 bp, Artificial Sequence
  Synthetic oligonucleotide
gcacgcctgtgccgcgaccacccttcgttgcccct

SEQ ID NO: 140383 - DNA, 35 bp, Artificial Sequence
  Synthetic oligonucleotide
acctaacgccactccttcgcctgcataatattgct

SEQ ID NO: 140384 - DNA, 35 bp, Artificial Sequence
  Synthetic oligonucleotide
tccacccaacgcctcgatctatgcccggttactct

SEQ ID NO: 140385 - DNA, 35 bp, Artificial Sequence
  Synthetic oligonucleotide
ttggaagagagagggtggaacagttggggtgaggt

SEQ ID NO: 140386 - DNA, 35 bp, Artificial Sequence
  Synthetic oligonucleotide
gagtgcaaccacctctattttcgttcccctggggt

SEQ ID NO: 140387 - DNA, 35 bp, Artificial Sequence
  Synthetic oligonucleotide
ccacccccacgaccgtttcgctccctgacatatgt

SEQ ID NO: 140388 - DNA, 35 bp, Artificial Sequence
  Synthetic oligonucleotide
gtctccacagatctgcctcccatacacctttcctt

SEQ ID NO: 140389 - DNA, 35 bp, Artificial Sequence
  Synthetic oligonucleotide
tgccattgccgtggtgcccgggccccctcaccgtt

SEQ ID NO: 140390 - DNA, 35 bp, Artificial Sequence
  Synthetic oligonucleotide
ggtaacgccgcccccgctcataagcacatcacttt

SEQ ID NO: 140391 - DNA, 35 bp, Artificial Sequence
  Synthetic oligonucleotide
tccgtccgccaccccatctgtgctcctcgccgcca

SEQ ID NO: 140392 - DNA, 35 bp, Artificial Sequence
  Synthetic oligonucleotide
tgttaccgtcccctgtctagctggttatcgctcca

SEQ ID NO: 140393 - DNA, 36 bp, Artificial Sequence
  Synthetic oligonucleotide
acacgggccggaaagggtcgggagggaaagggctca

SEQ ID NO: 140394 - DNA, 36 bp, Artificial Sequence
  Synthetic oligonucleotide
ttcgcgcaactgcactacgtcgcctcccacatttca

SEQ ID NO: 140395 - DNA, 37 bp, Artificial Sequence
  Synthetic oligonucleotide
tgacacagggaggagtggagggggagcgggtgggaga

SEQ ID NO: 140396 - DNA, 37 bp, Artificial Sequence
  Synthetic oligonucleotide
aaacgagggaagttgggacgggggacgaggcaataga

SEQ ID NO: 140397 - DNA, 37 bp, Artificial Sequence
  Synthetic oligonucleotide
tgtgcgggggcgggtgaggggctagggcgtgcgacga

SEQ ID NO: 140398 - DNA, 37 bp, Artificial Sequence
  Synthetic oligonucleotide
gaggggaaaggtggaggtaatggtgcgatcaaaggga

SEQ ID NO: 140399 - DNA, 37 bp, Artificial Sequence
  Synthetic oligonucleotide
gtgggccaacgtgcgggtggggtggaagtaaggggga

SEQ ID NO: 140400 - DNA, 38 bp, Artificial Sequence
  Synthetic oligonucleotide
aacgcggttaggggcggtggaggcgggaaggatgctga

SEQ ID NO: 140401 - DNA, 37 bp, Artificial Sequence
  Synthetic oligonucleotide
acgcactccggacccttgcccccacgccttgctgtga

SEQ ID NO: 140402 - DNA, 36 bp, Artificial Sequence
  Synthetic oligonucleotide
tcctaggccaccttccccgcttgtcgctctgcccta

SEQ ID NO: 140403 - DNA, 36 bp, Artificial Sequence
  Synthetic oligonucleotide
gcctgctcagtagcctccacggccgcccccatgcta

SEQ ID NO: 140404 - DNA, 35 bp, Artificial Sequence
  Synthetic oligonucleotide
accgccctggcctgaccgtgcgcgcgagcccttac

SEQ ID NO: 140405 - DNA, 35 bp, Artificial Sequence
  Synthetic oligonucleotide
tatgacacgtcaatctgcctccgtcctgtgccacc

SEQ ID NO: 140406 - DNA, 35 bp, Artificial Sequence
  Synthetic oligonucleotide
gcgtgcacggttcatcgctcctgtctttttcaccc

SEQ ID NO: 140407 - DNA, 33 bp, Artificial Sequence
  Synthetic oligonucleotide
gtccactcccggccgttatcgagccctcacccc

SEQ ID NO: 140408 - DNA, 35 bp, Artificial Sequence
  Synthetic oligonucleotide
gtaccaggtcgatctcccatcaagccacaccttcc

SEQ ID NO: 140409 - DNA, 35 bp, Artificial Sequence
  Synthetic oligonucleotide
tcactgccaccgggcttatatataccattggtttc

SEQ ID NO: 140410 - DNA, 35 bp, Artificial Sequence
  Synthetic oligonucleotide
gaacaccttcctcgattttagcagtcccttacctg

SEQ ID NO: 140411 - DNA, 35 bp, Artificial Sequence
  Synthetic oligonucleotide
gaccctctgtctcgttgagtgcatcacgccccctg

SEQ ID NO: 140412 - DNA, 35 bp, Artificial Sequence
  Synthetic oligonucleotide
gtacatgccgatgtgggtcctgtctcgttcttttg

SEQ ID NO: 140413 - DNA, 35 bp, Artificial Sequence
  Synthetic oligonucleotide
accgccctaccagccacatcgtcattcatcttcat

SEQ ID NO: 140414 - DNA, 35 bp, Artificial Sequence
  Synthetic oligonucleotide
gatctggccagcccatgtcctcgccccgcttttat

SEQ ID NO: 140415 - DNA, 35 bp, Artificial Sequence
  Synthetic oligonucleotide
gccacaactgatccccccggtcataactgtttcct

SEQ ID NO: 140416 - DNA, 35 bp, Artificial Sequence
  Synthetic oligonucleotide
agcaccgctgtcggtttaacttatatcctcctgct

SEQ ID NO: 140417 - DNA, 33 bp, Artificial Sequence
  Synthetic oligonucleotide
agacaagtgaacgccgaccgtctttaccactct

SEQ ID NO: 140418 - DNA, 35 bp, Artificial Sequence
  Synthetic oligonucleotide
gccaacgacccgccatccaccatgcgtccgcacgt

SEQ ID NO: 140419 - DNA, 35 bp, Artificial Sequence
  Synthetic oligonucleotide
gacccgcccccactgacactagtcaacctgcccgt

SEQ ID NO: 140420 - DNA, 35 bp, Artificial Sequence
  Synthetic oligonucleotide
agtgcgccacacactactatccccacagtctttgt

SEQ ID NO: 140421 - DNA, 35 bp, Artificial Sequence
  Synthetic oligonucleotide
tgcctcgcctcattccgtttctctttgtgcccctt

SEQ ID NO: 140422 - DNA, 35 bp, Artificial Sequence
  Synthetic oligonucleotide
gtcatcaccgttcctgtccacttgcctattttttt

SEQ ID NO: 140423 - DNA, 35 bp, Artificial Sequence
  Synthetic oligonucleotide
tcagacccgccgccgatctgaggcctctgctcaca

SEQ ID NO: 140424 - DNA, 35 bp, Artificial Sequence
  Synthetic oligonucleotide
gcccacgcattgacgcctggaacacttacctacca

SEQ ID NO: 140425 - DNA, 35 bp, Artificial Sequence
  Synthetic oligonucleotide
ccctccctcggttgatccacctgcaccaccatgca

SEQ ID NO: 140426 - DNA, 37 bp, Artificial Sequence
  Synthetic oligonucleotide
acgccgccccccggctacgtgatatgctctacaccga

SEQ ID NO: 140427 - DNA, 37 bp, Artificial Sequence
  Synthetic oligonucleotide
ggtgggtgtgaatggggggcgacggaagtggagcgga

SEQ ID NO: 140428 - DNA, 37 bp, Artificial Sequence
  Synthetic oligonucleotide
gcaccctgaccgtacactgtttaccccgcccttggga

SEQ ID NO: 140429 - DNA, 37 bp, Artificial Sequence
  Synthetic oligonucleotide
ggaagtcgggcaattgggagtaacggggggtggtgga

SEQ ID NO: 140430 - DNA, 35 bp, Artificial Sequence
  Synthetic oligonucleotide
agaggaggagaggagagttctgggaggaggttgga

SEQ ID NO: 140431 - DNA, 38 bp, Artificial Sequence
  Synthetic oligonucleotide
gccaccctcgtgccttattcaccagctcacatcactga

SEQ ID NO: 140432 - DNA, 31 bp, Artificial Sequence
  Synthetic oligonucleotide
tctgctagtcgccttatagccccctccctga

SEQ ID NO: 140433 - DNA, 36 bp, Artificial Sequence
  Synthetic oligonucleotide
gacctccgctcccgtccttcccctcacaacgcctga

SEQ ID NO: 140434 - DNA, 35 bp, Artificial Sequence
  Synthetic oligonucleotide
tgatcgccagtgctgtggccctctccacccattga

SEQ ID NO: 140435 - DNA, 38 bp, Artificial Sequence
  Synthetic oligonucleotide
tgtctacgccattcgtgccccactccaccccctattga

SEQ ID NO: 140436 - DNA, 36 bp, Artificial Sequence
  Synthetic oligonucleotide
gcccatgttcccgttgtcttggccccctgctttcta

SEQ ID NO: 140437 - DNA, 36 bp, Artificial Sequence
  Synthetic oligonucleotide
attccacaaccgccattggattcccccactcgttta

SEQ ID NO: 140438 - DNA, 35 bp, Artificial Sequence
  Synthetic oligonucleotide
acactctcgatccgcacacctgtgatggcctacac

SEQ ID NO: 140439 - DNA, 35 bp, Artificial Sequence
  Synthetic oligonucleotide
gggggaaggggaggctggggatttcgggatgatac

SEQ ID NO: 140440 - DNA, 35 bp, Artificial Sequence
  Synthetic oligonucleotide
ggacgacaccatgcccgccggtccaaatgcccccc

SEQ ID NO: 140441 - DNA, 35 bp, Artificial Sequence
  Synthetic oligonucleotide
agttaggcacgctgaccattgtctctgggctcccc

SEQ ID NO: 140442 - DNA, 35 bp, Artificial Sequence
  Synthetic oligonucleotide
gttccccttgctcaccctatggcgtttataccgcc

SEQ ID NO: 140443 - DNA, 35 bp, Artificial Sequence
  Synthetic oligonucleotide
gaaggtgccccccgtgccatatctcgctatacatc

SEQ ID NO: 140444 - DNA, 34 bp, Artificial Sequence
  Synthetic oligonucleotide
atgccgttcgttcatcccttgtagtatgcccctc

SEQ ID NO: 140445 - DNA, 35 bp, Artificial Sequence
  Synthetic oligonucleotide
tgcgccttacgttataccagtctcagttccgcctc

SEQ ID NO: 140446 - DNA, 35 bp, Artificial Sequence
  Synthetic oligonucleotide
tgagtatgcaggccgtcgaatctttcttgctcctc

SEQ ID NO: 140447 - DNA, 35 bp, Artificial Sequence
  Synthetic oligonucleotide
agtgaagcaatgccatacccccgccgtgcctcgtc

SEQ ID NO: 140448 - DNA, 35 bp, Artificial Sequence
  Synthetic oligonucleotide
ttcgatcccgctacccccccaccgcttttcgcggg

SEQ ID NO: 140449 - DNA, 35 bp, Artificial Sequence
  Synthetic oligonucleotide
aacattcgtcccacaccaggcactcctcgctccct

SEQ ID NO: 140450 - DNA, 35 bp, Artificial Sequence
  Synthetic oligonucleotide
agccccatcagcctcgaaccactcctcgctatagt

SEQ ID NO: 140451 - DNA, 35 bp, Artificial Sequence
  Synthetic oligonucleotide
gtaggtaccgaggagggagggagggctggtcgcgt

SEQ ID NO: 140452 - DNA, 35 bp, Artificial Sequence
  Synthetic oligonucleotide
actctgctacctagccgcccattacgtaaacctgt

SEQ ID NO: 140453 - DNA, 35 bp, Artificial Sequence
  Synthetic oligonucleotide
tctcaccctctccactgggattctgagtgatcctt

SEQ ID NO: 140454 - DNA, 36 bp, Artificial Sequence
  Synthetic oligonucleotide
accaccacctcaactctatcgtaagcaatgccctca

SEQ ID NO: 140455 - DNA, 36 bp, Artificial Sequence
  Synthetic oligonucleotide
ggtaaggaccagagagcaggaagggatgggtgaaga

SEQ ID NO: 140456 - DNA, 36 bp, Artificial Sequence
  Synthetic oligonucleotide
ggtgccgcctccatgcgcaaccattcccttcctaga

SEQ ID NO: 140457 - DNA, 37 bp, Artificial Sequence
  Synthetic oligonucleotide
tccactctcctgaatgcgatacatgcattgcccccga

SEQ ID NO: 140458 - DNA, 37 bp, Artificial Sequence
  Synthetic oligonucleotide
tagaatggggggaggaaggaaagagggaggaagtcga

SEQ ID NO: 140459 - DNA, 36 bp, Artificial Sequence
  Synthetic oligonucleotide
gcgcaatgtaagagggggtggaagggggtaagagga

SEQ ID NO: 140460 - DNA, 36 bp, Artificial Sequence
  Synthetic oligonucleotide
tagcgggagtagcaggaggggcgtaggagtgaggga

SEQ ID NO: 140461 - DNA, 37 bp, Artificial Sequence
  Synthetic oligonucleotide
gtgggagggggtggttatgcttctgttcgggtgggga

SEQ ID NO: 140462 - DNA, 38 bp, Artificial Sequence
  Synthetic oligonucleotide
gatgggaggcgtgaaggccgtagtgggaaggggaatga

SEQ ID NO: 140463 - DNA, 38 bp, Artificial Sequence
  Synthetic oligonucleotide
ggactgagggacggggagatcggcgaagaagcgcgtga

SEQ ID NO: 140464 - DNA, 38 bp, Artificial Sequence
  Synthetic oligonucleotide
gcacgggggagtaccggggattgagatgggacgggtga

SEQ ID NO: 140465 - DNA, 35 bp, Artificial Sequence
  Synthetic oligonucleotide
tctcaggcgccaactggctggctccctctgtatta

SEQ ID NO: 140466 - DNA, 35 bp, Artificial Sequence
  Synthetic oligonucleotide
gtcctgccggctttaggcgacccgtccctccctta

SEQ ID NO: 140467 - DNA, 35 bp, Artificial Sequence
  Synthetic oligonucleotide
ttcgtactcccccgccttaggttctgtgcccacac

SEQ ID NO: 140468 - DNA, 35 bp, Artificial Sequence
  Synthetic oligonucleotide
tgatgctcggatcgaattgcacctgcctcttcacc

SEQ ID NO: 140469 - DNA, 35 bp, Artificial Sequence
  Synthetic oligonucleotide
gtcactgcttcggacgtcctttcaacatacgcccc

SEQ ID NO: 140470 - DNA, 33 bp, Artificial Sequence
  Synthetic oligonucleotide
aagactgctgactccgctcgtgctacttgcccc

SEQ ID NO: 140471 - DNA, 35 bp, Artificial Sequence
  Synthetic oligonucleotide
actttcccgccaattgtagcttcacggttcctccc

SEQ ID NO: 140472 - DNA, 35 bp, Artificial Sequence
  Synthetic oligonucleotide
atgacctcagttccgctttcttccgtggttggtcc

SEQ ID NO: 140473 - DNA, 35 bp, Artificial Sequence
  Synthetic oligonucleotide
tcctactccggacacaatggtcaagcactcaccgc

SEQ ID NO: 140474 - DNA, 35 bp, Artificial Sequence
  Synthetic oligonucleotide
gactcctcccgttcgacgctctgctacatccgatc

SEQ ID NO: 140475 - DNA, 35 bp, Artificial Sequence
  Synthetic oligonucleotide
gcccctggtccgtccctcgcgtatgcatttagctc

SEQ ID NO: 140476 - DNA, 35 bp, Artificial Sequence
  Synthetic oligonucleotide
tcctacaactgtacgcgtgtctttcccagcctttc

SEQ ID NO: 140477 - DNA, 35 bp, Artificial Sequence
  Synthetic oligonucleotide
tccccagcgaggcccagccgccccccactgctttc

SEQ ID NO: 140478 - DNA, 35 bp, Artificial Sequence
  Synthetic oligonucleotide
tcttccaccccctcgtatagtaaaactgtgatttg

SEQ ID NO: 140479 - DNA, 35 bp, Artificial Sequence
  Synthetic oligonucleotide
tgtgatcgtcccgcccccgttcccattgctgcaat

SEQ ID NO: 140480 - DNA, 35 bp, Artificial Sequence
  Synthetic oligonucleotide
tcacgcattgccttatgagctccatttcccgtact

SEQ ID NO: 140481 - DNA, 35 bp, Artificial Sequence
  Synthetic oligonucleotide
tgtcccacccgttgtctacccatcgcggctcccct

SEQ ID NO: 140482 - DNA, 35 bp, Artificial Sequence
  Synthetic oligonucleotide
gtgtactcccctgtgcattgacgtccgtttcatct

SEQ ID NO: 140483 - DNA, 35 bp, Artificial Sequence
  Synthetic oligonucleotide
tgacaaccgattccagccccattgtcttacgcctt

SEQ ID NO: 140484 - DNA, 35 bp, Artificial Sequence
  Synthetic oligonucleotide
gcgccagactcctgattcttatgtcccccctcctt

SEQ ID NO: 140485 - DNA, 35 bp, Artificial Sequence
  Synthetic oligonucleotide
gacacgtcacgcttcgttagccgtcctttttgttt

SEQ ID NO: 140486 - DNA, 36 bp, Artificial Sequence
  Synthetic oligonucleotide
gtggggtggagcaggaaaaagggttgcgctggacaa

SEQ ID NO: 140487 - DNA, 36 bp, Artificial Sequence
  Synthetic oligonucleotide
tacgcctcatgccaattgttattccgtcctcctgaa

SEQ ID NO: 140488 - DNA, 36 bp, Artificial Sequence
  Synthetic oligonucleotide
atgtaccctctcgttgctaattttctggaccaccca

SEQ ID NO: 140489 - DNA, 36 bp, Artificial Sequence
  Synthetic oligonucleotide
gcccatgcaaagggcatggaattcctacctccgcca

SEQ ID NO: 140490 - DNA, 36 bp, Artificial Sequence
  Synthetic oligonucleotide
gatagggagtaacggtagggcgggcacgggaaacga

SEQ ID NO: 140491 - DNA, 35 bp, Artificial Sequence
  Synthetic oligonucleotide
tatgaaggggagggcgggaaatgcaacagtggcga

SEQ ID NO: 140492 - DNA, 37 bp, Artificial Sequence
  Synthetic oligonucleotide
ggggtgagggatggcggggaggaagggctgaactcga

SEQ ID NO: 140493 - DNA, 36 bp, Artificial Sequence
  Synthetic oligonucleotide
gccccccccaaccccgccaagagagccaacgaagga

SEQ ID NO: 140494 - DNA, 37 bp, Artificial Sequence
  Synthetic oligonucleotide
tcgtaacgcccaccttttgctccccctgatcccagga

SEQ ID NO: 140495 - DNA, 36 bp, Artificial Sequence
  Synthetic oligonucleotide
ttgcacctcccacccgtcccacaccccggttccgga

SEQ ID NO: 140496 - DNA, 37 bp, Artificial Sequence
  Synthetic oligonucleotide
gaggggggcggtaacatgagcgtaaacggggagcgga

SEQ ID NO: 140497 - DNA, 37 bp, Artificial Sequence
  Synthetic oligonucleotide
atccgcggtcgaggcggaggggggggcggacttcgga

SEQ ID NO: 140498 - DNA, 36 bp, Artificial Sequence
  Synthetic oligonucleotide
gtattcagggaggggggcggagggggagatccatga

SEQ ID NO: 140499 - DNA, 37 bp, Artificial Sequence
  Synthetic oligonucleotide
gtcgacgttacctggtcaagttccctcccatccctga

SEQ ID NO: 140500 - DNA, 38 bp, Artificial Sequence
  Synthetic oligonucleotide
gtcccctccaccgcttgctacaagggctccacttgtga

SEQ ID NO: 140501 - DNA, 38 bp, Artificial Sequence
  Synthetic oligonucleotide
gtgtgacatccgtccctctttgctcactgttcccttga

SEQ ID NO: 140502 - DNA, 36 bp, Artificial Sequence
  Synthetic oligonucleotide
accaacgcggatcccataccctccccacggccttga

SEQ ID NO: 140503 - DNA, 38 bp, Artificial Sequence
  Synthetic oligonucleotide
aagatagggcggggggggcatgtatgggacgtctttga

SEQ ID NO: 140504 - DNA, 36 bp, Artificial Sequence
  Synthetic oligonucleotide
tccgtctcccccttagatttgctaccccggccacta

SEQ ID NO: 140505 - DNA, 35 bp, Artificial Sequence
  Synthetic oligonucleotide
acgcgaccctttatgctccctggggtacttcccac

SEQ ID NO: 140506 - DNA, 35 bp, Artificial Sequence
  Synthetic oligonucleotide
acgccgtctgtgccgtactgcctgcctctgtcccc

SEQ ID NO: 140507 - DNA, 35 bp, Artificial Sequence
  Synthetic oligonucleotide
aatctccctgacgtcgcgcgcccagccacctcgcc

SEQ ID NO: 140508 - DNA, 35 bp, Artificial Sequence
  Synthetic oligonucleotide
taacgcactccggctcttccctgctgtaattcgcc

SEQ ID NO: 140509 - DNA, 35 bp, Artificial Sequence
  Synthetic oligonucleotide
gagccgcactggccctcgctattcttccgctccgc

SEQ ID NO: 140510 - DNA, 35 bp, Artificial Sequence
  Synthetic oligonucleotide
tcttgcgcgatctgttctcttccccatcctccggc

SEQ ID NO: 140511 - DNA, 35 bp, Artificial Sequence
  Synthetic oligonucleotide
gccgatatactcacgtccgctccacctttgcttgc

SEQ ID NO: 140512 - DNA, 35 bp, Artificial Sequence
  Synthetic oligonucleotide
agcaccccgccagccggaatattcaccgaccactc

SEQ ID NO: 140513 - DNA, 35 bp, Artificial Sequence
  Synthetic oligonucleotide
tctgactccgcgaaacggtcgcatactctctactc

SEQ ID NO: 140514 - DNA, 35 bp, Artificial Sequence
  Synthetic oligonucleotide
atcccaaaccttagttgcatagggcctccttcctc

SEQ ID NO: 140515 - DNA, 35 bp, Artificial Sequence
  Synthetic oligonucleotide
gcaccgcctatgagcccctgtccctcgccccgccg

SEQ ID NO: 140516 - DNA, 35 bp, Artificial Sequence
  Synthetic oligonucleotide
gaaggatcgccgtgggtgatgggcgggtgggttcg

SEQ ID NO: 140517 - DNA, 35 bp, Artificial Sequence
  Synthetic oligonucleotide
attccatcccggatgtcccaccatttctgttcatg

SEQ ID NO: 140518 - DNA, 35 bp, Artificial Sequence
  Synthetic oligonucleotide
atgttccagcacttcacacgttggcctactccctg

SEQ ID NO: 140519 - DNA, 28 bp, Artificial Sequence
  Synthetic oligonucleotide
atccctcttgtcacactttttggtacat

SEQ ID NO: 140520 - DNA, 34 bp, Artificial Sequence
  Synthetic oligonucleotide
gccacccgcttgttcgttcactactgttgtccgt

SEQ ID NO: 140521 - DNA, 35 bp, Artificial Sequence
  Synthetic oligonucleotide
atcattgcatctccacctggccccgtttagcgttt

SEQ ID NO: 140522 - DNA, 36 bp, Artificial Sequence
  Synthetic oligonucleotide
ggaccaccctcgcattatttatctgttccgtattaa

SEQ ID NO: 140523 - DNA, 36 bp, Artificial Sequence
  Synthetic oligonucleotide
acgcctactgtcgccgcgtattgtcctatcatccca

SEQ ID NO: 140524 - DNA, 35 bp, Artificial Sequence
  Synthetic oligonucleotide
gccatccctgtttgtacgctgaattattgtctcca

SEQ ID NO: 140525 - DNA, 37 bp, Artificial Sequence
  Synthetic oligonucleotide
gaaacggaggtatgcacaaagaggagggggaggaaga

SEQ ID NO: 140526 - DNA, 35 bp, Artificial Sequence
  Synthetic oligonucleotide
ttcgctccatcccatcgcagtatcgactgtccaga

SEQ ID NO: 140527 - DNA, 37 bp, Artificial Sequence
  Synthetic oligonucleotide
acacgatcacctcctgattccctcgcctgtatgccga

SEQ ID NO: 140528 - DNA, 37 bp, Artificial Sequence
  Synthetic oligonucleotide
accgtcgcagcacggtactcctactgaccccctccga

SEQ ID NO: 140529 - DNA, 37 bp, Artificial Sequence
  Synthetic oligonucleotide
gtgggtgggcgggggagacaaaaagttgaggtaggga

SEQ ID NO: 140530 - DNA, 37 bp, Artificial Sequence
  Synthetic oligonucleotide
gtagagtggactgtgggtgttcagggcgggacgggga

SEQ ID NO: 140531 - DNA, 37 bp, Artificial Sequence
  Synthetic oligonucleotide
gattccgccctaatgtccacggcagcctgcccctgga

SEQ ID NO: 140532 - DNA, 35 bp, Artificial Sequence
  Synthetic oligonucleotide
gtaccgatctccacccgttcatgcgcactcactga

SEQ ID NO: 140533 - DNA, 37 bp, Artificial Sequence
  Synthetic oligonucleotide
gatgccgcagaccgcccccaaccagtccctctactga

SEQ ID NO: 140534 - DNA, 38 bp, Artificial Sequence
  Synthetic oligonucleotide
gatatccgctgtgataagcctgtctgatcacctcctga

SEQ ID NO: 140535 - DNA, 38 bp, Artificial Sequence
  Synthetic oligonucleotide
tccacatccctcggacccttatctgacgaatgtcttga

SEQ ID NO: 140536 - DNA, 36 bp, Artificial Sequence
  Synthetic oligonucleotide
accctccgttcctcgtttatggaccccatgccacta

SEQ ID NO: 140537 - DNA, 35 bp, Artificial Sequence
  Synthetic oligonucleotide
tccccgctatccccctggcgacagttctacaccta

SEQ ID NO: 140538 - DNA, 36 bp, Artificial Sequence
  Synthetic oligonucleotide
gttcagctaagagctgccccttgcctcccatccgta

SEQ ID NO: 140539 - DNA, 36 bp, Artificial Sequence
  Synthetic oligonucleotide
tccccatcccaccgattaacagcgcagtatccctta

SEQ ID NO: 140540 - DNA, 36 bp, Artificial Sequence
  Synthetic oligonucleotide
gtcaccaggcctatgcccagtacgaaccatccttta

SEQ ID NO: 140541 - DNA, 36 bp, Artificial Sequence
  Synthetic oligonucleotide
acacgacatcatcgtggtgcccttcttccgctttta

SEQ ID NO: 140542 - DNA, 35 bp, Artificial Sequence
  Synthetic oligonucleotide
tgaacgtcgcctgcgcccggccaatcattgtccac

SEQ ID NO: 140543 - DNA, 35 bp, Artificial Sequence
  Synthetic oligonucleotide
tgtaacaccgctgggactccccttcgctttcgacc

SEQ ID NO: 140544 - DNA, 36 bp, Artificial Sequence
  Synthetic oligonucleotide
gaccgcctgagcctgtttttaggtgatcccccgccc

SEQ ID NO: 140545 - DNA, 35 bp, Artificial Sequence
  Synthetic oligonucleotide
tactccatgcgcacttagctgaatctgactcctcc

SEQ ID NO: 140546 - DNA, 35 bp, Artificial Sequence
  Synthetic oligonucleotide
gatccacccctccgtttttgccttggtacggttcc

SEQ ID NO: 140547 - DNA, 35 bp, Artificial Sequence
  Synthetic oligonucleotide
tctagcggccccgcccctccccacgccaatacagc

SEQ ID NO: 140548 - DNA, 35 bp, Artificial Sequence
  Synthetic oligonucleotide
gtgttacgtcatttggtagcctgcccgccccccgc

SEQ ID NO: 140549 - DNA, 35 bp, Artificial Sequence
  Synthetic oligonucleotide
tcatccccagaagcgtgcttagtactgctccccgc

SEQ ID NO: 140550 - DNA, 35 bp, Artificial Sequence
  Synthetic oligonucleotide
gtgacattcctccatgctatgtttcgcgacccatc

SEQ ID NO: 140551 - DNA, 34 bp, Artificial Sequence
  Synthetic oligonucleotide
ggatcctgccttccctgcttgacagcttgccatc

SEQ ID NO: 140552 - DNA, 35 bp, Artificial Sequence
  Synthetic oligonucleotide
gacgagggtcttatgttcgccccatccctgtactc

SEQ ID NO: 140553 - DNA, 35 bp, Artificial Sequence
  Synthetic oligonucleotide
tgccccgccccgaccattgtgccatcattcgtgtc

SEQ ID NO: 140554 - DNA, 35 bp, Artificial Sequence
  Synthetic oligonucleotide
atattcgcgaagcctacctttcccgcccaccgttc

SEQ ID NO: 140555 - DNA, 35 bp, Artificial Sequence
  Synthetic oligonucleotide
aatgcatggggcgggggtggagtggtactgctaag

SEQ ID NO: 140556 - DNA, 35 bp, Artificial Sequence
  Synthetic oligonucleotide
gtctcatccgtcaacgtcgcttccccttactctcg

SEQ ID NO: 140557 - DNA, 35 bp, Artificial Sequence
  Synthetic oligonucleotide
atccgttgccgttctgactccccctttttccgtcg

SEQ ID NO: 140558 - DNA, 35 bp, Artificial Sequence
  Synthetic oligonucleotide
atgtgctcctgcctattaattagttccgccattcg

SEQ ID NO: 140559 - DNA, 35 bp, Artificial Sequence
  Synthetic oligonucleotide
gccgcccctccttgtacacttctcttgcaatcctg

SEQ ID NO: 140560 - DNA, 35 bp, Artificial Sequence
  Synthetic oligonucleotide
ggttaccgcccccacgtgtttttttggttgttctg

SEQ ID NO: 140561 - DNA, 32 bp, Artificial Sequence
  Synthetic oligonucleotide
aacgccttagcgatcacctcactattccccct

SEQ ID NO: 140562 - DNA, 35 bp, Artificial Sequence
  Synthetic oligonucleotide
gtggaccatccgccgcgtttccctaatatcagcct

SEQ ID NO: 140563 - DNA, 35 bp, Artificial Sequence
  Synthetic oligonucleotide
acgtccatccacccccgtcaagacgctcgtgttct

SEQ ID NO: 140564 - DNA, 35 bp, Artificial Sequence
  Synthetic oligonucleotide
ggtgcattccgcttctgtatctctcctcttcctgt

SEQ ID NO: 140565 - DNA, 35 bp, Artificial Sequence
  Synthetic oligonucleotide
gtggggcgtgagtcgcttccatcctatcgtgcctt

SEQ ID NO: 140566 - DNA, 35 bp, Artificial Sequence
  Synthetic oligonucleotide
tcccgccactcactcctcggtatatactccgtctt

SEQ ID NO: 140567 - DNA, 36 bp, Artificial Sequence
  Synthetic oligonucleotide
atcgcccactttaccctgcattgatccctgtgtgca

SEQ ID NO: 140568 - DNA, 37 bp, Artificial Sequence
  Synthetic oligonucleotide
acacctccgtgttcaatgtacggccccccccccacga

SEQ ID NO: 140569 - DNA, 35 bp, Artificial Sequence
  Synthetic oligonucleotide
ttgagcgcccgtttcttggttgtccctatccccga

SEQ ID NO: 140570 - DNA, 37 bp, Artificial Sequence
  Synthetic oligonucleotide
atgtccccacgcgggtctttgctcctgtttcccctga

SEQ ID NO: 140571 - DNA, 38 bp, Artificial Sequence
  Synthetic oligonucleotide
gtacgacgggtgctgggtcggggaaagggggcaagtga

SEQ ID NO: 140572 - DNA, 38 bp, Artificial Sequence
  Synthetic oligonucleotide
atccgccctgccctagtgaccgtacctcctcatcttga

SEQ ID NO: 140573 - DNA, 36 bp, Artificial Sequence
  Synthetic oligonucleotide
gctggagggcgggaaggcgggcggtaaactaggata

SEQ ID NO: 140574 - DNA, 35 bp, Artificial Sequence
  Synthetic oligonucleotide
gacaagggaatgggggactgaggggggtcgggtta

SEQ ID NO: 140575 - DNA, 35 bp, Artificial Sequence
  Synthetic oligonucleotide
atgccctgccgcaggataagcgctgcctcctccac

SEQ ID NO: 140576 - DNA, 35 bp, Artificial Sequence
  Synthetic oligonucleotide
gttgacctaaatgtgcgtactcatccttccgttac

SEQ ID NO: 140577 - DNA, 36 bp, Artificial Sequence
  Synthetic oligonucleotide
tgtcgccggcctgtccatttgcactaccgcttggcc

SEQ ID NO: 140578 - DNA, 35 bp, Artificial Sequence
  Synthetic oligonucleotide
tacgaaggtgcccgccggtcgttctcttatttgcc

SEQ ID NO: 140579 - DNA, 35 bp, Artificial Sequence
  Synthetic oligonucleotide
tccgaaagcgcgctgttgcccttccccgataatcc

SEQ ID NO: 140580 - DNA, 35 bp, Artificial Sequence
  Synthetic oligonucleotide
gcccccgtccaggcaaccttgcacggctcttatcc

SEQ ID NO: 140581 - DNA, 35 bp, Artificial Sequence
  Synthetic oligonucleotide
tatcgtcatctgcgcacgtcggatcccgcacctcc

SEQ ID NO: 140582 - DNA, 35 bp, Artificial Sequence
  Synthetic oligonucleotide
gcctcccttgctcaagttctcgccttgcactccgc

SEQ ID NO: 140583 - DNA, 35 bp, Artificial Sequence
  Synthetic oligonucleotide
ttccacccgttttctcgtactgaattgtgcttcgc

SEQ ID NO: 140584 - DNA, 35 bp, Artificial Sequence
  Synthetic oligonucleotide
ttagccactatctcaaggtatcgatcgtctcctgc

SEQ ID NO: 140585 - DNA, 35 bp, Artificial Sequence
  Synthetic oligonucleotide
agtcgggtgagggaacgggggggcgttgaaggtgc

SEQ ID NO: 140586 - DNA, 35 bp, Artificial Sequence
  Synthetic oligonucleotide
tctgcctctgatccgtttcgtgcgctactcccgtc

SEQ ID NO: 140587 - DNA, 35 bp, Artificial Sequence
  Synthetic oligonucleotide
accacacagtcgcggtttcaccatctatcatctcg

SEQ ID NO: 140588 - DNA, 35 bp, Artificial Sequence
  Synthetic oligonucleotide
ggacgcagcccatgttgccacctctttcctcttcg

SEQ ID NO: 140589 - DNA, 35 bp, Artificial Sequence
  Synthetic oligonucleotide
atcgacgtaccatctgcctgtgcgcattgcgatat

SEQ ID NO: 140590 - DNA, 35 bp, Artificial Sequence
  Synthetic oligonucleotide
ttcgcacgtgctgttaccttgtattttgctcccct

SEQ ID NO: 140591 - DNA, 35 bp, Artificial Sequence
  Synthetic oligonucleotide
gcctgattcacttttgcccgactgccctattgcct

SEQ ID NO: 140592 - DNA, 35 bp, Artificial Sequence
  Synthetic oligonucleotide
gccacagccctcatccgctccttccaccactatct

SEQ ID NO: 140593 - DNA, 35 bp, Artificial Sequence
  Synthetic oligonucleotide
gacccgcctgacagcccgatccatcaccccgtcgt

SEQ ID NO: 140594 - DNA, 35 bp, Artificial Sequence
  Synthetic oligonucleotide
gaccgctgatagcgccttgcttcacccccaccgtt

SEQ ID NO: 140595 - DNA, 35 bp, Artificial Sequence
  Synthetic oligonucleotide
gcccccgcccccaccatgcgcatgccgcatcgttt

SEQ ID NO: 140596 - DNA, 36 bp, Artificial Sequence
  Synthetic oligonucleotide
gcctggtgcgtgaatagcccgtcctcccccttgaca

SEQ ID NO: 140597 - DNA, 35 bp, Artificial Sequence
  Synthetic oligonucleotide
taccgatcgtctgtcgccgtttcatccgtcaccca

SEQ ID NO: 140598 - DNA, 36 bp, Artificial Sequence
  Synthetic oligonucleotide
acgtgacccctctttgctcatgcgccgctccgccca

SEQ ID NO: 140599 - DNA, 35 bp, Artificial Sequence
  Synthetic oligonucleotide
gcactgaggctgaagagggggcagggagggcgaga

SEQ ID NO: 140600 - DNA, 36 bp, Artificial Sequence
  Synthetic oligonucleotide
agccgaaaggatgggaagtgggtggggtgagggcga

SEQ ID NO: 140601 - DNA, 37 bp, Artificial Sequence
  Synthetic oligonucleotide
ggaggggacggggtggaggaggcccagcagtgttcga

SEQ ID NO: 140602 - DNA, 35 bp, Artificial Sequence
  Synthetic oligonucleotide
aagggcaaggggaataggagcaagcaagggcagga

SEQ ID NO: 140603 - DNA, 37 bp, Artificial Sequence
  Synthetic oligonucleotide
ttcacctcacctgtctatccgggccaccctttttgga

SEQ ID NO: 140604 - DNA, 38 bp, Artificial Sequence
  Synthetic oligonucleotide
gttgcccccccatttgctttgcgctcactgtttactga

SEQ ID NO: 140605 - DNA, 37 bp, Artificial Sequence
  Synthetic oligonucleotide
tacccccctcctccgacctgttacagtcgtcctctga

SEQ ID NO: 140606 - DNA, 35 bp, Artificial Sequence
  Synthetic oligonucleotide
acacggcccgcacctgagtaccggctccttcccta

SEQ ID NO: 140607 - DNA, 31 bp, Artificial Sequence
  Synthetic oligonucleotide
acccccccgattgcacctagtaacgctgtta

SEQ ID NO: 140608 - DNA, 35 bp, Artificial Sequence
  Synthetic oligonucleotide
agttaactccgaaagtgcccatccagccccccgac

SEQ ID NO: 140609 - DNA, 35 bp, Artificial Sequence
  Synthetic oligonucleotide
ggggaacggatcttggggtcgactaggggggggac

SEQ ID NO: 140610 - DNA, 35 bp, Artificial Sequence
  Synthetic oligonucleotide
ttgtactgcgctcacatattaatatcgttgccacc

SEQ ID NO: 140611 - DNA, 35 bp, Artificial Sequence
  Synthetic oligonucleotide
tgccgacagtacgatccgtttacttttccggcccc

SEQ ID NO: 140612 - DNA, 35 bp, Artificial Sequence
  Synthetic oligonucleotide
atgcccacattatggttgggtcatgccttcctccc

SEQ ID NO: 140613 - DNA, 35 bp, Artificial Sequence
  Synthetic oligonucleotide
actgcccttcatttctccggtccggtccacacgcc

SEQ ID NO: 140614 - DNA, 28 bp, Artificial Sequence
  Synthetic oligonucleotide
tccaccgcctccgtctcgcccaatctcc

SEQ ID NO: 140615 - DNA, 35 bp, Artificial Sequence
  Synthetic oligonucleotide
gcccgccttcaccgtctcatatctccctccggtcc

SEQ ID NO: 140616 - DNA, 35 bp, Artificial Sequence
  Synthetic oligonucleotide
tctccgccctttcgtgtcccagtatcacaatccgc

SEQ ID NO: 140617 - DNA, 35 bp, Artificial Sequence
  Synthetic oligonucleotide
tggtccctgacactattctatactgcacatctcgc

SEQ ID NO: 140618 - DNA, 35 bp, Artificial Sequence
  Synthetic oligonucleotide
tggtcgccgggttcttcatcgccactttttttcgc

SEQ ID NO: 140619 - DNA, 35 bp, Artificial Sequence
  Synthetic oligonucleotide
tgcattacatcgccacggtacctaaacgcccactc

SEQ ID NO: 140620 - DNA, 36 bp, Artificial Sequence
  Synthetic oligonucleotide
tagtccgcctcccaatttactccactctggcttctc

SEQ ID NO: 140621 - DNA, 35 bp, Artificial Sequence
  Synthetic oligonucleotide
atagctcgcccttccattctgctccttgcctgtag

SEQ ID NO: 140622 - DNA, 35 bp, Artificial Sequence
  Synthetic oligonucleotide
aaggtcccctcccccgcaatagctagcagttatcg

SEQ ID NO: 140623 - DNA, 35 bp, Artificial Sequence
  Synthetic oligonucleotide
gaccgccgtgctggtcactcattctgctatccctg

SEQ ID NO: 140624 - DNA, 35 bp, Artificial Sequence
  Synthetic oligonucleotide
gtccaccacaatgctcttccgtatacgccgcacct

SEQ ID NO: 140625 - DNA, 35 bp, Artificial Sequence
  Synthetic oligonucleotide
gtgattgtctcctgttggaacgtgcccccgcccct

SEQ ID NO: 140626 - DNA, 35 bp, Artificial Sequence
  Synthetic oligonucleotide
tagcagactacacgcttagtcatacggccccttct

SEQ ID NO: 140627 - DNA, 35 bp, Artificial Sequence
  Synthetic oligonucleotide
gacacgaatacttctcaggcactccccctgctggt

SEQ ID NO: 140628 - DNA, 36 bp, Artificial Sequence
  Synthetic oligonucleotide
gctgtcgccgctgccgtactataccatcgttttcaa

SEQ ID NO: 140629 - DNA, 35 bp, Artificial Sequence
  Synthetic oligonucleotide
gaagagcacggaggctagggtaggtgggtatggaa

SEQ ID NO: 140630 - DNA, 35 bp, Artificial Sequence
  Synthetic oligonucleotide
tccctacgtaccactggtctatccgtgcatcttaa

SEQ ID NO: 140631 - DNA, 36 bp, Artificial Sequence
  Synthetic oligonucleotide
agagagggccctcctgcgtatcacctcctttgtcca

SEQ ID NO: 140632 - DNA, 36 bp, Artificial Sequence
  Synthetic oligonucleotide
agccaccactggttagcatccgccgagccctccgca

SEQ ID NO: 140633 - DNA, 37 bp, Artificial Sequence
  Synthetic oligonucleotide
acatgggtgggcggggggatgagatagtcagggtaga

SEQ ID NO: 140634 - DNA, 37 bp, Artificial Sequence
  Synthetic oligonucleotide
acgccgcccttatggatatccctctgcctttcctcga

SEQ ID NO: 140635 - DNA, 35 bp, Artificial Sequence
  Synthetic oligonucleotide
ccacgctccgcccgtcccctgcctctacgtgtcga

SEQ ID NO: 140636 - DNA, 37 bp, Artificial Sequence
  Synthetic oligonucleotide
gatcgagaagggacgggggtggatgcgctagtgggga

SEQ ID NO: 140637 - DNA, 38 bp, Artificial Sequence
  Synthetic oligonucleotide
taggggagggaggtgtgggcgaatagtggcatctatga

SEQ ID NO: 140638 - DNA, 37 bp, Artificial Sequence
  Synthetic oligonucleotide
gtccgtgtcactgcggcccttcaccactttgctttga

SEQ ID NO: 140639 - DNA, 36 bp, Artificial Sequence
  Synthetic oligonucleotide
gagggatcgcgggggtaataaaaaagggcgggggta

SEQ ID NO: 140640 - DNA, 36 bp, Artificial Sequence
  Synthetic oligonucleotide
gaggggcaatagggcggtggggaaagatgtggctta

SEQ ID NO: 140641 - DNA, 35 bp, Artificial Sequence
  Synthetic oligonucleotide
tctgcccacgccgcacatgatcggtactctgccac

SEQ ID NO: 140642 - DNA, 36 bp, Artificial Sequence
  Synthetic oligonucleotide
tgtgaccgccgcctgaaaagctgcccctttcttgac

SEQ ID NO: 140643 - DNA, 35 bp, Artificial Sequence
  Synthetic oligonucleotide
tccacattgacaatgtgtgtcacctgccctcctac

SEQ ID NO: 140644 - DNA, 35 bp, Artificial Sequence
  Synthetic oligonucleotide
gtgcactccccatcgtcgcgcgcctcttccatacc

SEQ ID NO: 140645 - DNA, 35 bp, Artificial Sequence
  Synthetic oligonucleotide
gttgcctgctgcttcgtacaccccgtcataacccc

SEQ ID NO: 140646 - DNA, 35 bp, Artificial Sequence
  Synthetic oligonucleotide
tagcacccccctatggacgcaaagacttatccccc

SEQ ID NO: 140647 - DNA, 35 bp, Artificial Sequence
  Synthetic oligonucleotide
ttcgatccccctctgctgttttttcttgcgcctcc

SEQ ID NO: 140648 - DNA, 35 bp, Artificial Sequence
  Synthetic oligonucleotide
tacgcccgccattattcttgctttctgcgttgtcc

SEQ ID NO: 140649 - DNA, 35 bp, Artificial Sequence
  Synthetic oligonucleotide
gcctgctagagcgccgactcccgttaccacctatc

SEQ ID NO: 140650 - DNA, 35 bp, Artificial Sequence
  Synthetic oligonucleotide
gcgcctcagttgcttcgttatcccctgcgtgtctc

SEQ ID NO: 140651 - DNA, 35 bp, Artificial Sequence
  Synthetic oligonucleotide
tgcgcaacgcacccatctttcctctgttctccagg

SEQ ID NO: 140652 - DNA, 35 bp, Artificial Sequence
  Synthetic oligonucleotide
ttcctcccaccgccctcctcatgtaagacgattgg

SEQ ID NO: 140653 - DNA, 34 bp, Artificial Sequence
  Synthetic oligonucleotide
tccgccgcctgcgtattgccttccgtctgccctg

SEQ ID NO: 140654 - DNA, 34 bp, Artificial Sequence
  Synthetic oligonucleotide
tccccatccccgctaccggtttactacggttctg

SEQ ID NO: 140655 - DNA, 35 bp, Artificial Sequence
  Synthetic oligonucleotide
tttgacccctacaccaccttgtacagagttccact

SEQ ID NO: 140656 - DNA, 35 bp, Artificial Sequence
  Synthetic oligonucleotide
atccgtgtcccgcccaccatccgaccgtgattcct

SEQ ID NO: 140657 - DNA, 35 bp, Artificial Sequence
  Synthetic oligonucleotide
gaccaccgcccgcttttttcacccatacactctct

SEQ ID NO: 140658 - DNA, 36 bp, Artificial Sequence
  Synthetic oligonucleotide
ttccgcccctccccgtccgagcctcttccgccgcaa

SEQ ID NO: 140659 - DNA, 35 bp, Artificial Sequence
  Synthetic oligonucleotide
gttgtagaagggtgtcgggggggagcaacgggtaa

SEQ ID NO: 140660 - DNA, 36 bp, Artificial Sequence
  Synthetic oligonucleotide
tcacaaactccatttagggcgggtggtgagggttaa

SEQ ID NO: 140661 - DNA, 36 bp, Artificial Sequence
  Synthetic oligonucleotide
gacgcactaccaccacgaatcaagcggacgcttaca

SEQ ID NO: 140662 - DNA, 34 bp, Artificial Sequence
  Synthetic oligonucleotide
ttcccagtgcatatacgcgccgcacccctgttca

SEQ ID NO: 140663 - DNA, 37 bp, Artificial Sequence
  Synthetic oligonucleotide
ttctgccccactcgaatagtgcacttccctaccaaga

SEQ ID NO: 140664 - DNA, 37 bp, Artificial Sequence
  Synthetic oligonucleotide
acaccacccttgcatgatgatccgtccccgcccgaga

SEQ ID NO: 140665 - DNA, 37 bp, Artificial Sequence
  Synthetic oligonucleotide
gcctgaggtgggagtggaggaagggggaggcaataga

SEQ ID NO: 140666 - DNA, 37 bp, Artificial Sequence
  Synthetic oligonucleotide
gtcgaaagggaagagaggaggcacaagcgggaataga

SEQ ID NO: 140667 - DNA, 37 bp, Artificial Sequence
  Synthetic oligonucleotide
attgagggacggcatcaggtaatggggtggtggggga

SEQ ID NO: 140668 - DNA, 38 bp, Artificial Sequence
  Synthetic oligonucleotide
atgagggagggagtagggggagcatctgagccaggtga

SEQ ID NO: 140669 - DNA, 38 bp, Artificial Sequence
  Synthetic oligonucleotide
tagtaggtcgacaggggaggaataggcggggatggtga

SEQ ID NO: 140670 - DNA, 36 bp, Artificial Sequence
  Synthetic oligonucleotide
acaggaggggtggggtcttggggaggaggtgttcta

SEQ ID NO: 140671 - DNA, 36 bp, Artificial Sequence
  Synthetic oligonucleotide
tgtcattgcgggggagcgagtgggaagggtggagta

SEQ ID NO: 140672 - DNA, 35 bp, Artificial Sequence
  Synthetic oligonucleotide
ttagttgcaccgcacacgtattccccgattcctac

SEQ ID NO: 140673 - DNA, 35 bp, Artificial Sequence
  Synthetic oligonucleotide
gcagacacagtcctgctctttaccggcttacgccc

SEQ ID NO: 140674 - DNA, 35 bp, Artificial Sequence
  Synthetic oligonucleotide
tgtcgcattgcctcactccgtgtccctaatatccc

SEQ ID NO: 140675 - DNA, 35 bp, Artificial Sequence
  Synthetic oligonucleotide
aaccaggtcgcacaatcgatcgttccagtcctccc

SEQ ID NO: 140676 - DNA, 35 bp, Artificial Sequence
  Synthetic oligonucleotide
tctcccttccgacgaatcgcgacctgccgtttccc

SEQ ID NO: 140677 - DNA, 35 bp, Artificial Sequence
  Synthetic oligonucleotide
tcacatgccccctcgcgctttaagcccattgacgc

SEQ ID NO: 140678 - DNA, 35 bp, Artificial Sequence
  Synthetic oligonucleotide
gtctcgcgtctagcatagccacccacctcgcccgc

SEQ ID NO: 140679 - DNA, 35 bp, Artificial Sequence
  Synthetic oligonucleotide
tgtaccactcatatctcgttttcctccgatcccgc

SEQ ID NO: 140680 - DNA, 35 bp, Artificial Sequence
  Synthetic oligonucleotide
gtacgtagacgccgccgagccctctaactgtcctc

SEQ ID NO: 140681 - DNA, 33 bp, Artificial Sequence
  Synthetic oligonucleotide
gtcttagcgcttacatcttccatcgtcacgctc

SEQ ID NO: 140682 - DNA, 35 bp, Artificial Sequence
  Synthetic oligonucleotide
acgcctgtcgccgaacctccagtctatgcgctctc

SEQ ID NO: 140683 - DNA, 34 bp, Artificial Sequence
  Synthetic oligonucleotide
ggaggacgaaggagggttagggtgtggggtggtc

SEQ ID NO: 140684 - DNA, 35 bp, Artificial Sequence
  Synthetic oligonucleotide
ggaccgttacgccgttgtccctgtcgttttacttc

SEQ ID NO: 140685 - DNA, 35 bp, Artificial Sequence
  Synthetic oligonucleotide
gaccactcttagtactatctcccgcctgggtaccg

SEQ ID NO: 140686 - DNA, 35 bp, Artificial Sequence
  Synthetic oligonucleotide
ggatccctgctctacacctgtcccctgcctcatcg

SEQ ID NO: 140687 - DNA, 35 bp, Artificial Sequence
  Synthetic oligonucleotide
atctcccggcaatgcgctgcccgtttcgccaccct

SEQ ID NO: 140688 - DNA, 35 bp, Artificial Sequence
  Synthetic oligonucleotide
aattaccgccacaaccgctccggaactgtacccct

SEQ ID NO: 140689 - DNA, 35 bp, Artificial Sequence
  Synthetic oligonucleotide
tctcccccctctgttgtcgcagtctacgcccgcct

SEQ ID NO: 140690 - DNA, 36 bp, Artificial Sequence
  Synthetic oligonucleotide
aaccggccacttgcctgtgcgctcccctctcgatct

SEQ ID NO: 140691 - DNA, 35 bp, Artificial Sequence
  Synthetic oligonucleotide
actacccagcccacatactacttttctgcccttgt

SEQ ID NO: 140692 - DNA, 35 bp, Artificial Sequence
  Synthetic oligonucleotide
atggtccctccgcccttgtctgtatttgtcacctt

SEQ ID NO: 140693 - DNA, 36 bp, Artificial Sequence
  Synthetic oligonucleotide
tctacgtcctcccggcgtattatccctttcccttaa

SEQ ID NO: 140694 - DNA, 36 bp, Artificial Sequence
  Synthetic oligonucleotide
tgccgtgccgctggtctcacttgcctatcctgttaa

SEQ ID NO: 140695 - DNA, 36 bp, Artificial Sequence
  Synthetic oligonucleotide
aggtgaaaaacgtgggggggcacaggggaagggaca

SEQ ID NO: 140696 - DNA, 36 bp, Artificial Sequence
  Synthetic oligonucleotide
aaccgatcacatgccgacctttctgaccgccctaca

SEQ ID NO: 140697 - DNA, 36 bp, Artificial Sequence
  Synthetic oligonucleotide
gctgcctctacgtactcatctgtctaacgtccccca

SEQ ID NO: 140698 - DNA, 36 bp, Artificial Sequence
  Synthetic oligonucleotide
gattcacaccgctgttagtttatctctcgttgccca

SEQ ID NO: 140699 - DNA, 36 bp, Artificial Sequence
  Synthetic oligonucleotide
tacgaacctcagccgcctcgtctccccattccaaga

SEQ ID NO: 140700 - DNA, 36 bp, Artificial Sequence
  Synthetic oligonucleotide
gacagttgggagggggggagacgatttgggacacga

SEQ ID NO: 140701 - DNA, 36 bp, Artificial Sequence
  Synthetic oligonucleotide
gaaaggagtgaagggggtgcggtacgaggaaaagga

SEQ ID NO: 140702 - DNA, 38 bp, Artificial Sequence
  Synthetic oligonucleotide
gccaagggacgaggggatcagggttgcacgggcgggga

SEQ ID NO: 140703 - DNA, 37 bp, Artificial Sequence
  Synthetic oligonucleotide
ttagagggcgcaagggaaaaggcggtggggcgtggga

SEQ ID NO: 140704 - DNA, 36 bp, Artificial Sequence
  Synthetic oligonucleotide
gtgtgcaccgagttgcttctctcctccctcttggga

SEQ ID NO: 140705 - DNA, 38 bp, Artificial Sequence
  Synthetic oligonucleotide
aatgcgcatgaacgggggagggcacaggggaagtatga

SEQ ID NO: 140706 - DNA, 36 bp, Artificial Sequence
  Synthetic oligonucleotide
tcaacgcaggttttcccgttctccaccccgctctga

SEQ ID NO: 140707 - DNA, 38 bp, Artificial Sequence
  Synthetic oligonucleotide
gttgaggggtgcataacggcgggaggggagggacgtga

SEQ ID NO: 140708 - DNA, 38 bp, Artificial Sequence
  Synthetic oligonucleotide
atcacatccgcctaccctgcacgagtcacttaccgtga

SEQ ID NO: 140709 - DNA, 37 bp, Artificial Sequence
  Synthetic oligonucleotide
tgcgcctctccgtctctctttaatagccctgccgtga

SEQ ID NO: 140710 - DNA, 36 bp, Artificial Sequence
  Synthetic oligonucleotide
gaccccgtccactgtcatttaaccgtcgattcccta

SEQ ID NO: 140711 - DNA, 35 bp, Artificial Sequence
  Synthetic oligonucleotide
gccccgccacatctctcgttgccgatcatgagcta

SEQ ID NO: 140712 - DNA, 36 bp, Artificial Sequence
  Synthetic oligonucleotide
ggatccagtcgcccatggttcgcttccctgttgtta

SEQ ID NO: 140713 - DNA, 36 bp, Artificial Sequence
  Synthetic oligonucleotide
ttccgccgcccctatgctttcttaagccctcgttta

SEQ ID NO: 140714 - DNA, 35 bp, Artificial Sequence
  Synthetic oligonucleotide
tgtccactgccctgcccacttgagcccccgtgcac

SEQ ID NO: 140715 - DNA, 35 bp, Artificial Sequence
  Synthetic oligonucleotide
ttgcccgccctcaccggcttcgtagccagacaccc

SEQ ID NO: 140716 - DNA, 35 bp, Artificial Sequence
  Synthetic oligonucleotide
accgatcttccataccggccttaggtccacctgcc

SEQ ID NO: 140717 - DNA, 34 bp, Artificial Sequence
  Synthetic oligonucleotide
tgattacccacgcgccgttttccacataccctcc

SEQ ID NO: 140718 - DNA, 35 bp, Artificial Sequence
  Synthetic oligonucleotide
atctgccgacggccgccgcccttgaacaatgctcc

SEQ ID NO: 140719 - DNA, 35 bp, Artificial Sequence
  Synthetic oligonucleotide
gactatcctctgtttgcatgtcgaaccacttgtcc

SEQ ID NO: 140720 - DNA, 35 bp, Artificial Sequence
  Synthetic oligonucleotide
gacggatctcgatgtaccgtccgcctccctgtcgc

SEQ ID NO: 140721 - DNA, 35 bp, Artificial Sequence
  Synthetic oligonucleotide
taaaccaccggaggtaatactgctcccctctttgc

SEQ ID NO: 140722 - DNA, 35 bp, Artificial Sequence
  Synthetic oligonucleotide
gctccaccgcctgtcgtttggctgaaaggccattc

SEQ ID NO: 140723 - DNA, 35 bp, Artificial Sequence
  Synthetic oligonucleotide
acgtgcggccacggctctgcttcttagccctgttc

SEQ ID NO: 140724 - DNA, 35 bp, Artificial Sequence
  Synthetic oligonucleotide
gtcccatgccctccaaccgtttagttttgccgacg

SEQ ID NO: 140725 - DNA, 35 bp, Artificial Sequence
  Synthetic oligonucleotide
tgcgtgcaggtcacacgctctaccacaccaccatg

SEQ ID NO: 140726 - DNA, 35 bp, Artificial Sequence
  Synthetic oligonucleotide
gcacaccctctagctttttatcccgatctcccttg

SEQ ID NO: 140727 - DNA, 35 bp, Artificial Sequence
  Synthetic oligonucleotide
tattccaccacgccttcgtacctgtgcctgtaaat

SEQ ID NO: 140728 - DNA, 35 bp, Artificial Sequence
  Synthetic oligonucleotide
gaactgcctgcctgggaccttcttatacctcgact

SEQ ID NO: 140729 - DNA, 35 bp, Artificial Sequence
  Synthetic oligonucleotide
gtcatgacaccgccccttgtactgtctcctttact

SEQ ID NO: 140730 - DNA, 35 bp, Artificial Sequence
  Synthetic oligonucleotide
gtccatccgacctggctgagctggccaccacacct

SEQ ID NO: 140731 - DNA, 35 bp, Artificial Sequence
  Synthetic oligonucleotide
ggagcctgatcgggcgggagggccagggaaaatct

SEQ ID NO: 140732 - DNA, 35 bp, Artificial Sequence
  Synthetic oligonucleotide
gctccaccggcatgtacccctttcgctcttattct

SEQ ID NO: 140733 - DNA, 35 bp, Artificial Sequence
  Synthetic oligonucleotide
gcctaccgcgcccactccttacgcctctctgttgt

SEQ ID NO: 140734 - DNA, 35 bp, Artificial Sequence
  Synthetic oligonucleotide
gcccaccgcccgttgagctcataccactagccttt

SEQ ID NO: 140735 - DNA, 35 bp, Artificial Sequence
  Synthetic oligonucleotide
gatccacgcctagagcttccctgtctgcccttttt

SEQ ID NO: 140736 - DNA, 35 bp, Artificial Sequence
  Synthetic oligonucleotide
gccctcaccgctccaacaactgccatttcccgaca

SEQ ID NO: 140737 - DNA, 37 bp, Artificial Sequence
  Synthetic oligonucleotide
aagatgcgaatgcggaggagaaaagggtaggtacaga

SEQ ID NO: 140738 - DNA, 37 bp, Artificial Sequence
  Synthetic oligonucleotide
accctcatcgccacccttcctattgttattgcctcga

SEQ ID NO: 140739 - DNA, 37 bp, Artificial Sequence
  Synthetic oligonucleotide
gcccctccctgctttatggtctgttgccctgattcga

SEQ ID NO: 140740 - DNA, 37 bp, Artificial Sequence
  Synthetic oligonucleotide
tagatacgacaggagggcgagggggaggtcgcgggga

SEQ ID NO: 140741 - DNA, 36 bp, Artificial Sequence
  Synthetic oligonucleotide
gcacaggagtcactgggggagggaggtttgggggga

SEQ ID NO: 140742 - DNA, 37 bp, Artificial Sequence
  Synthetic oligonucleotide
ttcgtgggggaaggattgtcgaagggtgggttgggga

SEQ ID NO: 140743 - DNA, 38 bp, Artificial Sequence
  Synthetic oligonucleotide
agggagaggcggacgggggagggtgcccgggggaatga

SEQ ID NO: 140744 - DNA, 38 bp, Artificial Sequence
  Synthetic oligonucleotide
accgtcctgccccaaaccctgtgttaatctccgcctga

SEQ ID NO: 140745 - DNA, 38 bp, Artificial Sequence
  Synthetic oligonucleotide
gaccaggagaggaaactgtagggagggacggaagctga

SEQ ID NO: 140746 - DNA, 37 bp, Artificial Sequence
  Synthetic oligonucleotide
tcctcaaccccgttgccatatgtgattcgccctctga

SEQ ID NO: 140747 - DNA, 35 bp, Artificial Sequence
  Synthetic oligonucleotide
aaacagcacgccaccacctgactctacccctgcta

SEQ ID NO: 140748 - DNA, 35 bp, Artificial Sequence
  Synthetic oligonucleotide
tgccgggcctcccgagagatacatctccgctccac

SEQ ID NO: 140749 - DNA, 35 bp, Artificial Sequence
  Synthetic oligonucleotide
acccaaggcacttgtggcatgtcacttctatcacc

SEQ ID NO: 140750 - DNA, 35 bp, Artificial Sequence
  Synthetic oligonucleotide
ttcgactgcccgcccggtttgtcttaattcccgcc

SEQ ID NO: 140751 - DNA, 35 bp, Artificial Sequence
  Synthetic oligonucleotide
tccctagcccacctcataccttccttgtttgcgcc

SEQ ID NO: 140752 - DNA, 35 bp, Artificial Sequence
  Synthetic oligonucleotide
tgcaacccgctgtggtccgcctaccgattcttgcc

SEQ ID NO: 140753 - DNA, 35 bp, Artificial Sequence
  Synthetic oligonucleotide
agttccgccccgctctgcaaccccgtaatctatcc

SEQ ID NO: 140754 - DNA, 35 bp, Artificial Sequence
  Synthetic oligonucleotide
tgcgcaaacaccctgctggttggtgccaattttcc

SEQ ID NO: 140755 - DNA, 35 bp, Artificial Sequence
  Synthetic oligonucleotide
ttaccgttcccaccgccgcattgccctatgaaagc

SEQ ID NO: 140756 - DNA, 35 bp, Artificial Sequence
  Synthetic oligonucleotide
gcaaccctcttctcaccatcttgctgtttttccgc

SEQ ID NO: 140757 - DNA, 35 bp, Artificial Sequence
  Synthetic oligonucleotide
ataccgccgctacctatttgactaatcaccttcgc

SEQ ID NO: 140758 - DNA, 35 bp, Artificial Sequence
  Synthetic oligonucleotide
ttccaaacgctcctgccttaccagcccacccctgc

SEQ ID NO: 140759 - DNA, 35 bp, Artificial Sequence
  Synthetic oligonucleotide
acctgcgagtccactccgccgccagtcctcacctc

SEQ ID NO: 140760 - DNA, 35 bp, Artificial Sequence
  Synthetic oligonucleotide
ttgctgtccggtctggctaactacctgatttcctc

SEQ ID NO: 140761 - DNA, 35 bp, Artificial Sequence
  Synthetic oligonucleotide
tatgggggagtctctgggtggggttggggatggag

SEQ ID NO: 140762 - DNA, 35 bp, Artificial Sequence
  Synthetic oligonucleotide
acatgggcgggagggatgaccgggtaccatgtacg

SEQ ID NO: 140763 - DNA, 35 bp, Artificial Sequence
  Synthetic oligonucleotide
gaggagggggagcaagttacgaggctagatgcggg

SEQ ID NO: 140764 - DNA, 35 bp, Artificial Sequence
  Synthetic oligonucleotide
atctctgcccgcccatccctaaatagacctactgg

SEQ ID NO: 140765 - DNA, 35 bp, Artificial Sequence
  Synthetic oligonucleotide
gtatggccccgatcccccttgaatcctttccttgg

SEQ ID NO: 140766 - DNA, 35 bp, Artificial Sequence
  Synthetic oligonucleotide
gtgttgctcgccaaaataatctcccctcacgaatg

SEQ ID NO: 140767 - DNA, 35 bp, Artificial Sequence
  Synthetic oligonucleotide
acacaccactccctgctccctatccagcttacatg

SEQ ID NO: 140768 - DNA, 35 bp, Artificial Sequence
  Synthetic oligonucleotide
tcacaccgcaaatcgttcctcgccacccttttctg

SEQ ID NO: 140769 - DNA, 35 bp, Artificial Sequence
  Synthetic oligonucleotide
ttcgactccaccacgtgcccccctcagaactaaca

SEQ ID NO: 140770 - DNA, 36 bp, Artificial Sequence
  Synthetic oligonucleotide
gccctccgcggtcaaacgcccatctgtccgccccca

SEQ ID NO: 140771 - DNA, 35 bp, Artificial Sequence
  Synthetic oligonucleotide
tacacgactgtcttgcccgcggatctcttgcccca

SEQ ID NO: 140772 - DNA, 35 bp, Artificial Sequence
  Synthetic oligonucleotide
gattaccgtgatcttagtccgccctgcattacgca

SEQ ID NO: 140773 - DNA, 37 bp, Artificial Sequence
  Synthetic oligonucleotide
atgcggagggaaaggattctaagtagcgggggggaga

SEQ ID NO: 140774 - DNA, 37 bp, Artificial Sequence
  Synthetic oligonucleotide
accgccccccctgaccagccagtccttgtaccctaga

SEQ ID NO: 140775 - DNA, 37 bp, Artificial Sequence
  Synthetic oligonucleotide
atcataggggcgggagggaaaccaacgggtgaggcga

SEQ ID NO: 140776 - DNA, 37 bp, Artificial Sequence
  Synthetic oligonucleotide
gacagggggggtaagggagggctattggccaagatga

SEQ ID NO: 140777 - DNA, 35 bp, Artificial Sequence
  Synthetic oligonucleotide
accttacctcgactatgcgcttaattgccgcccta

SEQ ID NO: 140778 - DNA, 36 bp, Artificial Sequence
  Synthetic oligonucleotide
gcacaccggcgtctcgtactaaccccctgattccta

SEQ ID NO: 140779 - DNA, 35 bp, Artificial Sequence
  Synthetic oligonucleotide
agcaatgggaggggaagggcgaaatggggagtcta

SEQ ID NO: 140780 - DNA, 35 bp, Artificial Sequence
  Synthetic oligonucleotide
acccaccttctccatcatctctgtaggaacaacac

SEQ ID NO: 140781 - DNA, 35 bp, Artificial Sequence
  Synthetic oligonucleotide
tgctcctctgtgcaccggttaccttcgatccccac

SEQ ID NO: 140782 - DNA, 35 bp, Artificial Sequence
  Synthetic oligonucleotide
acaccacctcaccatctgtgcttcttaccctggac

SEQ ID NO: 140783 - DNA, 35 bp, Artificial Sequence
  Synthetic oligonucleotide
accctgggccccccgctgttacgcgcccctgtacc

SEQ ID NO: 140784 - DNA, 35 bp, Artificial Sequence
  Synthetic oligonucleotide
accaacccagactcccgccccatggagcgaaagcc

SEQ ID NO: 140785 - DNA, 35 bp, Artificial Sequence
  Synthetic oligonucleotide
atcgacccgctctacagccccgccaaacaaacgcc

SEQ ID NO: 140786 - DNA, 35 bp, Artificial Sequence
  Synthetic oligonucleotide
tgtatctccactgccctcgcgccgccggactgtcc

SEQ ID NO: 140787 - DNA, 35 bp, Artificial Sequence
  Synthetic oligonucleotide
agtcccggcggtggatggggaggtggaagggtctc

SEQ ID NO: 140788 - DNA, 35 bp, Artificial Sequence
  Synthetic oligonucleotide
tgattcaccgcctccgttctgagcttcatttcttc

SEQ ID NO: 140789 - DNA, 35 bp, Artificial Sequence
  Synthetic oligonucleotide
agccccgcacccacctggtaaacacctcatgtacg

SEQ ID NO: 140790 - DNA, 35 bp, Artificial Sequence
  Synthetic oligonucleotide
agccacgagcgtctcaatgtccctcccccttggcg

SEQ ID NO: 140791 - DNA, 35 bp, Artificial Sequence
  Synthetic oligonucleotide
tgatgtcatcctgccccttatacgttcgccatgcg

SEQ ID NO: 140792 - DNA, 35 bp, Artificial Sequence
  Synthetic oligonucleotide
gtccctccatgtattctgtcgcccaccttattatg

SEQ ID NO: 140793 - DNA, 35 bp, Artificial Sequence
  Synthetic oligonucleotide
gcgatagccttagcccgtatttgcccatgtaccct

SEQ ID NO: 140794 - DNA, 35 bp, Artificial Sequence
  Synthetic oligonucleotide
gaccaccacatccctggctatacggaaaacattct

SEQ ID NO: 140795 - DNA, 35 bp, Artificial Sequence
  Synthetic oligonucleotide
tacacacgggtagggaagggtgggaggaggtatgt

SEQ ID NO: 140796 - DNA, 35 bp, Artificial Sequence
  Synthetic oligonucleotide
gcacagttctacacctgcttcttgcccagtaactt

SEQ ID NO: 140797 - DNA, 36 bp, Artificial Sequence
  Synthetic oligonucleotide
gccccgcacccactccaccgaggacgtacgctacca

SEQ ID NO: 140798 - DNA, 35 bp, Artificial Sequence
  Synthetic oligonucleotide
gtacgacaccggtgcagcaatgccccccccaccca

SEQ ID NO: 140799 - DNA, 36 bp, Artificial Sequence
  Synthetic oligonucleotide
accgcctcgccttgtctatccgttgtctctactcca

SEQ ID NO: 140800 - DNA, 36 bp, Artificial Sequence
  Synthetic oligonucleotide
taggaaggggagggtggctcgatcggggagggggca

SEQ ID NO: 140801 - DNA, 35 bp, Artificial Sequence
  Synthetic oligonucleotide
tgtccattcttacctgttggctttctccccgttca

SEQ ID NO: 140802 - DNA, 37 bp, Artificial Sequence
  Synthetic oligonucleotide
attcacgtacgcctgtactgcctcatccgctccccga

SEQ ID NO: 140803 - DNA, 37 bp, Artificial Sequence
  Synthetic oligonucleotide
ttagagagggggaggggatactgcggagtgagaggga

SEQ ID NO: 140804 - DNA, 36 bp, Artificial Sequence
  Synthetic oligonucleotide
tacgtaggcagggcgggacacgttaggggaggggga

SEQ ID NO: 140805 - DNA, 37 bp, Artificial Sequence
  Synthetic oligonucleotide
acgaaggcgaagggctggagtaggggggctgagtgga

SEQ ID NO: 140806 - DNA, 38 bp, Artificial Sequence
  Synthetic oligonucleotide
gccgctccacttctgtcctagtccccgtcctgttctga

SEQ ID NO: 140807 - DNA, 38 bp, Artificial Sequence
  Synthetic oligonucleotide
gggaccatgagagggggagggagggggccacatggtga

SEQ ID NO: 140808 - DNA, 37 bp, Artificial Sequence
  Synthetic oligonucleotide
tcaccgctgtgccgccgatgtatcttccgcctcttga

SEQ ID NO: 140809 - DNA, 38 bp, Artificial Sequence
  Synthetic oligonucleotide
gccggactgccatcgagtctttcgccgcccctgtttga

SEQ ID NO: 140810 - DNA, 36 bp, Artificial Sequence
  Synthetic oligonucleotide
atgaccgcaagccacccctccgcccccacgttcgta

SEQ ID NO: 140811 - DNA, 35 bp, Artificial Sequence
  Synthetic oligonucleotide
tttgtccagccctccttgcttcctagttcatgtac

SEQ ID NO: 140812 - DNA, 35 bp, Artificial Sequence
  Synthetic oligonucleotide
acatccatttgcccctgaccactgtgtccaaaccc

SEQ ID NO: 140813 - DNA, 35 bp, Artificial Sequence
  Synthetic oligonucleotide
tctatgtccctgctccgtgctctacctactgaccc

SEQ ID NO: 140814 - DNA, 35 bp, Artificial Sequence
  Synthetic oligonucleotide
gattaccccaccgtatacggcactgtttttggccc

SEQ ID NO: 140815 - DNA, 35 bp, Artificial Sequence
  Synthetic oligonucleotide
taccaaccctctgccgccctctcccgagaatgccc

SEQ ID NO: 140816 - DNA, 35 bp, Artificial Sequence
  Synthetic oligonucleotide
ttgcaatacagccgttgttaccctttcttctcgcc

SEQ ID NO: 140817 - DNA, 35 bp, Artificial Sequence
  Synthetic oligonucleotide
tcgcaagtgttcgttgtcgcgctcttctccatgcc

SEQ ID NO: 140818 - DNA, 35 bp, Artificial Sequence
  Synthetic oligonucleotide
cccggtcccagcgcacacccaggccttcccgctcc

SEQ ID NO: 140819 - DNA, 35 bp, Artificial Sequence
  Synthetic oligonucleotide
tgatacgccttccgcactagttgcccgcctgtcgc

SEQ ID NO: 140820 - DNA, 35 bp, Artificial Sequence
  Synthetic oligonucleotide
gtggtcgtcaacgacgctcctccctgttcacatgc

SEQ ID NO: 140821 - DNA, 35 bp, Artificial Sequence
  Synthetic oligonucleotide
gtccatcccttccgtgatgctgagttcctactatc

SEQ ID NO: 140822 - DNA, 35 bp, Artificial Sequence
  Synthetic oligonucleotide
tttgggccaccgcgcacctttcatttgcaaacctc

SEQ ID NO: 140823 - DNA, 35 bp, Artificial Sequence
  Synthetic oligonucleotide
cctgacgtcacgattcacatgccccctcctgtccg

SEQ ID NO: 140824 - DNA, 35 bp, Artificial Sequence
  Synthetic oligonucleotide
tactgcttgccaatcgccttcctccgcttagagcg

SEQ ID NO: 140825 - DNA, 35 bp, Artificial Sequence
  Synthetic oligonucleotide
agtggtggaggagcgaaaaagcttaggcgaggtgg

SEQ ID NO: 140826 - DNA, 35 bp, Artificial Sequence
  Synthetic oligonucleotide
gcggacaccaccttccactttcgacggaccccctg

SEQ ID NO: 140827 - DNA, 35 bp, Artificial Sequence
  Synthetic oligonucleotide
tcgcgtcctcttgttcctccggccccccgcctttg

SEQ ID NO: 140828 - DNA, 35 bp, Artificial Sequence
  Synthetic oligonucleotide
agtcgaggagaagggggggggaggtcaatcggtat

SEQ ID NO: 140829 - DNA, 35 bp, Artificial Sequence
  Synthetic oligonucleotide
gtgtacatgctgtccgtttcgtcccctgcaatgct

SEQ ID NO: 140830 - DNA, 35 bp, Artificial Sequence
  Synthetic oligonucleotide
tgcgaccatcccgctcttatgctattccgactgct

SEQ ID NO: 140831 - DNA, 35 bp, Artificial Sequence
  Synthetic oligonucleotide
gtgtgctgctcccttgtttttgcaccccccacagt

SEQ ID NO: 140832 - DNA, 35 bp, Artificial Sequence
  Synthetic oligonucleotide
tgcacgttgcctatgtgatcctcggttcggccctt

SEQ ID NO: 140833 - DNA, 35 bp, Artificial Sequence
  Synthetic oligonucleotide
atgcccgtacacggttgccctcgattcctgtcctt

SEQ ID NO: 140834 - DNA, 35 bp, Artificial Sequence
  Synthetic oligonucleotide
gctgcatgccgcaacgcttgtcttttagccctctt

SEQ ID NO: 140835 - DNA, 36 bp, Artificial Sequence
  Synthetic oligonucleotide
agactgggaaccagggggagggggcgaaaaaaggca

SEQ ID NO: 140836 - DNA, 29 bp, Artificial Sequence
  Synthetic oligonucleotide
atcccccgtcctggtctcgcgccgtttca

SEQ ID NO: 140837 - DNA, 37 bp, Artificial Sequence
  Synthetic oligonucleotide
acaggcaacgcacttgttttctctccgcctccccaga

SEQ ID NO: 140838 - DNA, 35 bp, Artificial Sequence
  Synthetic oligonucleotide
gcgctcaagggggaaagcaaaagggagggagccga

SEQ ID NO: 140839 - DNA, 37 bp, Artificial Sequence
  Synthetic oligonucleotide
tcatcaggcctgctgttcccccaatatccgccgccga

SEQ ID NO: 140840 - DNA, 37 bp, Artificial Sequence
  Synthetic oligonucleotide
ggtggagctgggcagtgggggtgggggtgcggggcga

SEQ ID NO: 140841 - DNA, 37 bp, Artificial Sequence
  Synthetic oligonucleotide
gacagaatggacgggtgggggactgttgggggacgga

SEQ ID NO: 140842 - DNA, 37 bp, Artificial Sequence
  Synthetic oligonucleotide
gcgaacgttcgcggggggggtaagcggagggtacgga

SEQ ID NO: 140843 - DNA, 35 bp, Artificial Sequence
  Synthetic oligonucleotide
attgtcacacggaggggctgggggggacctaggga

SEQ ID NO: 140844 - DNA, 38 bp, Artificial Sequence
  Synthetic oligonucleotide
gcctccctcgctcctccgctcatgttcttacaacatga

SEQ ID NO: 140845 - DNA, 38 bp, Artificial Sequence
  Synthetic oligonucleotide
gctgccactcgctccctcatgtggtcattcccccctga

SEQ ID NO: 140846 - DNA, 38 bp, Artificial Sequence
  Synthetic oligonucleotide
gccacccagtggcacatgctccttcacagcctctctga

SEQ ID NO: 140847 - DNA, 38 bp, Artificial Sequence
  Synthetic oligonucleotide
acgtacctttcccctgccgccctaacagcacgacgtga

SEQ ID NO: 140848 - DNA, 38 bp, Artificial Sequence
  Synthetic oligonucleotide
ggggaggggacagctggggttcaaggtacagggggtga

SEQ ID NO: 140849 - DNA, 38 bp, Artificial Sequence
  Synthetic oligonucleotide
atggggcgtaggggaaggcgaggggggctatgtggtga

SEQ ID NO: 140850 - DNA, 37 bp, Artificial Sequence
  Synthetic oligonucleotide
tgtttaacgtcacatcgtcccggccctcttaacttga

SEQ ID NO: 140851 - DNA, 37 bp, Artificial Sequence
  Synthetic oligonucleotide
tcatccacgcccccatgttacctcactcgccacttga

SEQ ID NO: 140852 - DNA, 38 bp, Artificial Sequence
  Synthetic oligonucleotide
aacgacgcgggggaggagaggagggctggatacgttga

SEQ ID NO: 140853 - DNA, 35 bp, Artificial Sequence
  Synthetic oligonucleotide
tagcctccccaggtcattctccctgtttcttcata

SEQ ID NO: 140854 - DNA, 35 bp, Artificial Sequence
  Synthetic oligonucleotide
gcccatcctgatgctcatctctcgttgccttgata

SEQ ID NO: 140855 - DNA, 35 bp, Artificial Sequence
  Synthetic oligonucleotide
acgccccttccatctgtattttttttttccttgta

SEQ ID NO: 140856 - DNA, 35 bp, Artificial Sequence
  Synthetic oligonucleotide
gcttagaagccacactccgccatatgccagtacac

SEQ ID NO: 140857 - DNA, 35 bp, Artificial Sequence
  Synthetic oligonucleotide
accacccctgaagggaatttgcccagtaatcctac

SEQ ID NO: 140858 - DNA, 35 bp, Artificial Sequence
  Synthetic oligonucleotide
gactactaactgactgcccctccgactccaggacc

SEQ ID NO: 140859 - DNA, 35 bp, Artificial Sequence
  Synthetic oligonucleotide
gctcaggcaccctgctccccgcccctcgacacccc

SEQ ID NO: 140860 - DNA, 34 bp, Artificial Sequence
  Synthetic oligonucleotide
taacatagcccctgttccccggacacatcatgcc

SEQ ID NO: 140861 - DNA, 35 bp, Artificial Sequence
  Synthetic oligonucleotide
gggtgccgcctgttgtccacgcccttttgtaccgc

SEQ ID NO: 140862 - DNA, 35 bp, Artificial Sequence
  Synthetic oligonucleotide
ggacacttcctgccttaggcatttccgcccctgtc

SEQ ID NO: 140863 - DNA, 35 bp, Artificial Sequence
  Synthetic oligonucleotide
tccgtcgttacttcctccgtcaccaggcttgccct

SEQ ID NO: 140864 - DNA, 35 bp, Artificial Sequence
  Synthetic oligonucleotide
gttacacctcccgacgcacgtggtccaagttccct

SEQ ID NO: 140865 - DNA, 36 bp, Artificial Sequence
  Synthetic oligonucleotide
tcatgcaccccaccgtacctgcttccgctgacccaa

SEQ ID NO: 140866 - DNA, 36 bp, Artificial Sequence
  Synthetic oligonucleotide
gatctacgcgtccatcctgtcttgcctaccgcctaa

SEQ ID NO: 140867 - DNA, 36 bp, Artificial Sequence
  Synthetic oligonucleotide
actcaagccaccaaccgtattcgtcgaccccctcca

SEQ ID NO: 140868 - DNA, 36 bp, Artificial Sequence
  Synthetic oligonucleotide
gtaccatcaggcactgcgtctgccgcctctatcgca

SEQ ID NO: 140869 - DNA, 37 bp, Artificial Sequence
  Synthetic oligonucleotide
ggggagggagaaaacgggaatcacggaacaggctaga

SEQ ID NO: 140870 - DNA, 37 bp, Artificial Sequence
  Synthetic oligonucleotide
accgacgctgttgccggtactccatagttcttcccga

SEQ ID NO: 140871 - DNA, 37 bp, Artificial Sequence
  Synthetic oligonucleotide
atcacccccgcgccctagttttatttgcccttgtcga

SEQ ID NO: 140872 - DNA, 37 bp, Artificial Sequence
  Synthetic oligonucleotide
tttgcaagggaggggggacagggaaggagaagccgga

SEQ ID NO: 140873 - DNA, 35 bp, Artificial Sequence
  Synthetic oligonucleotide
tcttccaccacggtccatgcaacactccacgtgga

SEQ ID NO: 140874 - DNA, 37 bp, Artificial Sequence
  Synthetic oligonucleotide
accaccgctgattccctctacatgctccctccactga

SEQ ID NO: 140875 - DNA, 37 bp, Artificial Sequence
  Synthetic oligonucleotide
accacccggccccctgtacgccgagccccccatctga

SEQ ID NO: 140876 - DNA, 37 bp, Artificial Sequence
  Synthetic oligonucleotide
tctcccacgccacgaggcccattacccagtactctga

SEQ ID NO: 140877 - DNA, 35 bp, Artificial Sequence
  Synthetic oligonucleotide
agataggggagggcgaattgggggagttcgacgta

SEQ ID NO: 140878 - DNA, 35 bp, Artificial Sequence
  Synthetic oligonucleotide
agacacatccctctccatctgcgcacattatcgta

SEQ ID NO: 140879 - DNA, 35 bp, Artificial Sequence
  Synthetic oligonucleotide
gcagtgccgcatcatctccaccctgctacatggac

SEQ ID NO: 140880 - DNA, 35 bp, Artificial Sequence
  Synthetic oligonucleotide
tccacgaggaggagaaaaggaatgaaggggtggac

SEQ ID NO: 140881 - DNA, 34 bp, Artificial Sequence
  Synthetic oligonucleotide
tcaagcactcgaacccgatcggtctccccgcacc

SEQ ID NO: 140882 - DNA, 35 bp, Artificial Sequence
  Synthetic oligonucleotide
ggacgccactttgattttccagccctagtagcccc

SEQ ID NO: 140883 - DNA, 35 bp, Artificial Sequence
  Synthetic oligonucleotide
agagcccctccccgggttatattcttgcgctcgcc

SEQ ID NO: 140884 - DNA, 35 bp, Artificial Sequence
  Synthetic oligonucleotide
tatcgtcctacctgttcgtgcaagttgtctcctgc

SEQ ID NO: 140885 - DNA, 35 bp, Artificial Sequence
  Synthetic oligonucleotide
tcactctgaagcctgctgtacactccgaccccatc

SEQ ID NO: 140886 - DNA, 35 bp, Artificial Sequence
  Synthetic oligonucleotide
tcggaccccgcacacagtgccgatctacctccatc

SEQ ID NO: 140887 - DNA, 35 bp, Artificial Sequence
  Synthetic oligonucleotide
aacccgcccgaaccaccaggactccgtcgaacctc

SEQ ID NO: 140888 - DNA, 35 bp, Artificial Sequence
  Synthetic oligonucleotide
gaacccttagaactgtccaatttagcctgcccctc

SEQ ID NO: 140889 - DNA, 35 bp, Artificial Sequence
  Synthetic oligonucleotide
atcccgttcctccgtcgcattgaaatcaaccggtc

SEQ ID NO: 140890 - DNA, 35 bp, Artificial Sequence
  Synthetic oligonucleotide
gccgaagtaagagggaagggtacggggaacagacg

SEQ ID NO: 140891 - DNA, 35 bp, Artificial Sequence
  Synthetic oligonucleotide
acccgcccatggttggcactttcctactactcccg

SEQ ID NO: 140892 - DNA, 35 bp, Artificial Sequence
  Synthetic oligonucleotide
tgctcaatctatgccatatgtccacctctgcccat

SEQ ID NO: 140893 - DNA, 35 bp, Artificial Sequence
  Synthetic oligonucleotide
taccgccgcttgcacctcccattctgttaggctat

SEQ ID NO: 140894 - DNA, 35 bp, Artificial Sequence
  Synthetic oligonucleotide
ggggggagcactggggagggcgggcgagtgcgtat

SEQ ID NO: 140895 - DNA, 35 bp, Artificial Sequence
  Synthetic oligonucleotide
tgatccaaacgcagtcccacttgtacagcccccct

SEQ ID NO: 140896 - DNA, 35 bp, Artificial Sequence
  Synthetic oligonucleotide
actcctgaccgtccagtccctttcgctatcgatct

SEQ ID NO: 140897 - DNA, 35 bp, Artificial Sequence
  Synthetic oligonucleotide
gccgcttcagctttcgttccaccgggctcttctct

SEQ ID NO: 140898 - DNA, 36 bp, Artificial Sequence
  Synthetic oligonucleotide
ttaggaaaagggggaagggaaagggcgggtagcgaa

SEQ ID NO: 140899 - DNA, 35 bp, Artificial Sequence
  Synthetic oligonucleotide
tacggggccaaaagggcgaggggggaccgcgggaa

SEQ ID NO: 140900 - DNA, 36 bp, Artificial Sequence
  Synthetic oligonucleotide
gcgccccctcgctccgtccttggaaggtcttccgca

SEQ ID NO: 140901 - DNA, 35 bp, Artificial Sequence
  Synthetic oligonucleotide
ggggtgggcaactgaggggacaatccaggggatca

SEQ ID NO: 140902 - DNA, 36 bp, Artificial Sequence
  Synthetic oligonucleotide
gcgtactcgaccgtttcgtccacgactcccgcttca

SEQ ID NO: 140903 - DNA, 37 bp, Artificial Sequence
  Synthetic oligonucleotide
tgcgaacgacggatgacggaggagcgggggaatgaga

SEQ ID NO: 140904 - DNA, 37 bp, Artificial Sequence
  Synthetic oligonucleotide
tgtgcggggcgggaggattggcggggggttttaacga

SEQ ID NO: 140905 - DNA, 37 bp, Artificial Sequence
  Synthetic oligonucleotide
ttaaggcctccgccactgtttgaccctccgccgccga

SEQ ID NO: 140906 - DNA, 37 bp, Artificial Sequence
  Synthetic oligonucleotide
atccatcgccggacatgttccccacgctgctcctcga

SEQ ID NO: 140907 - DNA, 37 bp, Artificial Sequence
  Synthetic oligonucleotide
tgtttgagggagatgtaggcggggatagcgggacgga

SEQ ID NO: 140908 - DNA, 36 bp, Artificial Sequence
  Synthetic oligonucleotide
acctcgctccacctgtaattgcccgtcatgagcgga

SEQ ID NO: 140909 - DNA, 37 bp, Artificial Sequence
  Synthetic oligonucleotide
tcctacaccctgtccttactttaggcacccccttgga

SEQ ID NO: 140910 - DNA, 37 bp, Artificial Sequence
  Synthetic oligonucleotide
gtgacccccgcttccgactcctgcccgttacccttga

SEQ ID NO: 140911 - DNA, 37 bp, Artificial Sequence
  Synthetic oligonucleotide
gccgccgttaccgacacttattcctgccctgccttga

SEQ ID NO: 140912 - DNA, 38 bp, Artificial Sequence
  Synthetic oligonucleotide
actccatcacaccctgccctgtcgaggccactctttga

SEQ ID NO: 140913 - DNA, 35 bp, Artificial Sequence
  Synthetic oligonucleotide
gcaccgctcgcccgtcgtcctaatacatgccaata

SEQ ID NO: 140914 - DNA, 36 bp, Artificial Sequence
  Synthetic oligonucleotide
gccgccccatcgctactgctgaaattaatccactta

SEQ ID NO: 140915 - DNA, 35 bp, Artificial Sequence
  Synthetic oligonucleotide
gaggcccatcgttcgccagtacccgcctcacctac

SEQ ID NO: 140916 - DNA, 35 bp, Artificial Sequence
  Synthetic oligonucleotide
cacccgtacactcgtcctcaccgacctattcgacc

SEQ ID NO: 140917 - DNA, 35 bp, Artificial Sequence
  Synthetic oligonucleotide
atcccccgctgtcagccgcccccgtgaaccctacc

SEQ ID NO: 140918 - DNA, 35 bp, Artificial Sequence
  Synthetic oligonucleotide
gcaaccactgcatctatcctcgctcgcaggctacc

SEQ ID NO: 140919 - DNA, 35 bp, Artificial Sequence
  Synthetic oligonucleotide
gtgcggtttggttcgttctctgctgcttttctacc

SEQ ID NO: 140920 - DNA, 35 bp, Artificial Sequence
  Synthetic oligonucleotide
tctggctggcacacttccctccgtataccgtcgcc

SEQ ID NO: 140921 - DNA, 35 bp, Artificial Sequence
  Synthetic oligonucleotide
taccctgcctgctcgccggacttgctgaatcatcc

SEQ ID NO: 140922 - DNA, 35 bp, Artificial Sequence
  Synthetic oligonucleotide
gccacgccactccttctagccctgctatcctttcc

SEQ ID NO: 140923 - DNA, 35 bp, Artificial Sequence
  Synthetic oligonucleotide
gatcgggccggggggggagggtcttgttctgcatc

SEQ ID NO: 140924 - DNA, 35 bp, Artificial Sequence
  Synthetic oligonucleotide
tgacctgcactcccgcccgctggaccaccagactc

SEQ ID NO: 140925 - DNA, 35 bp, Artificial Sequence
  Synthetic oligonucleotide
tccgaacccgtcccatccccgtcaagtcctcgctc

SEQ ID NO: 140926 - DNA, 35 bp, Artificial Sequence
  Synthetic oligonucleotide
tgccaccccggagtcttccctgtcgcttccctgtc

SEQ ID NO: 140927 - DNA, 35 bp, Artificial Sequence
  Synthetic oligonucleotide
tgctcgcaacgctcatgacaacgccaccactcttc

SEQ ID NO: 140928 - DNA, 35 bp, Artificial Sequence
  Synthetic oligonucleotide
tccccgactcgtagtttgccgtgtcctttcctttc

SEQ ID NO: 140929 - DNA, 35 bp, Artificial Sequence
  Synthetic oligonucleotide
gaggtgggaacggttgagggccattagtgggggag

SEQ ID NO: 140930 - DNA, 35 bp, Artificial Sequence
  Synthetic oligonucleotide
ttcgctctctcggtaaaccgcccgctccccatacg

SEQ ID NO: 140931 - DNA, 35 bp, Artificial Sequence
  Synthetic oligonucleotide
gaagcccgaccaattgcccctggtcccccgtaccg

SEQ ID NO: 140932 - DNA, 35 bp, Artificial Sequence
  Synthetic oligonucleotide
ttgggaggggggaggcgggataaatcgagatcgcg

SEQ ID NO: 140933 - DNA, 35 bp, Artificial Sequence
  Synthetic oligonucleotide
ggtatcactggccccctatgttcctcccctgtggg

SEQ ID NO: 140934 - DNA, 35 bp, Artificial Sequence
  Synthetic oligonucleotide
taaggctacccacccctcatgtctttgaatgcctg

SEQ ID NO: 140935 - DNA, 35 bp, Artificial Sequence
  Synthetic oligonucleotide
tacccgccatcccttggtctttgcattgcttcctg

SEQ ID NO: 140936 - DNA, 35 bp, Artificial Sequence
  Synthetic oligonucleotide
ggtccaggtcgcccgcctcattttgctttccacct

SEQ ID NO: 140937 - DNA, 35 bp, Artificial Sequence
  Synthetic oligonucleotide
tcttgccccttcgcttcgtaccctcgacacaatct

SEQ ID NO: 140938 - DNA, 35 bp, Artificial Sequence
  Synthetic oligonucleotide
gcttatggcacgcagccgttgcaatcctccgctct

SEQ ID NO: 140939 - DNA, 35 bp, Artificial Sequence
  Synthetic oligonucleotide
gattcacattgcgctacccgccttcccactctggt

SEQ ID NO: 140940 - DNA, 35 bp, Artificial Sequence
  Synthetic oligonucleotide
gtgctccctcaaccttctgcttggctatgacttgt

SEQ ID NO: 140941 - DNA, 36 bp, Artificial Sequence
  Synthetic oligonucleotide
ttcgcacacactcggttcaaccacagtctcccctca

SEQ ID NO: 140942 - DNA, 36 bp, Artificial Sequence
  Synthetic oligonucleotide
tgcccgcctgcctcgcctgaaacccggtgttcctca

SEQ ID NO: 140943 - DNA, 37 bp, Artificial Sequence
  Synthetic oligonucleotide
gaccctctcgtatgcccttcctccaccagtcagacga

SEQ ID NO: 140944 - DNA, 37 bp, Artificial Sequence
  Synthetic oligonucleotide
actcgcccaaatggcttaaatcgtaatcacctcccga

SEQ ID NO: 140945 - DNA, 37 bp, Artificial Sequence
  Synthetic oligonucleotide
gacagggcccgacgctgccccctccattgattctcga

SEQ ID NO: 140946 - DNA, 37 bp, Artificial Sequence
  Synthetic oligonucleotide
ggacgccctgcacacccttcttcccgctccaccggga

SEQ ID NO: 140947 - DNA, 37 bp, Artificial Sequence
  Synthetic oligonucleotide
ggtggaggagaggtagtagggcgcggggtggtgtgga

SEQ ID NO: 140948 - DNA, 37 bp, Artificial Sequence
  Synthetic oligonucleotide
gacgcctccttttgcttacaatgctgccctcccatga

SEQ ID NO: 140949 - DNA, 37 bp, Artificial Sequence
  Synthetic oligonucleotide
gcaaggggatgggggtgtgggtacgtgtgctgggtga

SEQ ID NO: 140950 - DNA, 38 bp, Artificial Sequence
  Synthetic oligonucleotide
gaagtaagtggcggaacggggcagggagtggtgggtga

SEQ ID NO: 140951 - DNA, 38 bp, Artificial Sequence
  Synthetic oligonucleotide
taacgccccgacttcctgttgctcaatccccgtggtga

SEQ ID NO: 140952 - DNA, 37 bp, Artificial Sequence
  Synthetic oligonucleotide
gcgagaacgtacggaggggactctgggggcgggttga

SEQ ID NO: 140953 - DNA, 38 bp, Artificial Sequence
  Synthetic oligonucleotide
gtccccctcatgttccagacttcgtgccatccctttga

SEQ ID NO: 140954 - DNA, 35 bp, Artificial Sequence
  Synthetic oligonucleotide
gccagccgcctcgaagctactgcccacttcccata

SEQ ID NO: 140955 - DNA, 36 bp, Artificial Sequence
  Synthetic oligonucleotide
agggaggggcggagagagaggaagggctaaagttta

SEQ ID NO: 140956 - DNA, 35 bp, Artificial Sequence
  Synthetic oligonucleotide
tccgctcttacccccaagctagcctacggtcttac

SEQ ID NO: 140957 - DNA, 35 bp, Artificial Sequence
  Synthetic oligonucleotide
gttgcatcaataagtccccccccgccctgagcacc

SEQ ID NO: 140958 - DNA, 35 bp, Artificial Sequence
  Synthetic oligonucleotide
ggtatttgccgcctacgtctcatctcccgagcccc

SEQ ID NO: 140959 - DNA, 35 bp, Artificial Sequence
  Synthetic oligonucleotide
tctccaaccacgatactggtccctacgcttcgccc

SEQ ID NO: 140960 - DNA, 35 bp, Artificial Sequence
  Synthetic oligonucleotide
ttacgattcaccccgcaccatgcccttgtgttgcc

SEQ ID NO: 140961 - DNA, 35 bp, Artificial Sequence
  Synthetic oligonucleotide
atagcacctactcggtgtcctccttcgttgccctc

SEQ ID NO: 140962 - DNA, 35 bp, Artificial Sequence
  Synthetic oligonucleotide
tcgctagcacaattgcgtactgctcacaccccgtc

SEQ ID NO: 140963 - DNA, 36 bp, Artificial Sequence
  Synthetic oligonucleotide
acccgcgccccctgcatacgtaacccctcctttgcg

SEQ ID NO: 140964 - DNA, 35 bp, Artificial Sequence
  Synthetic oligonucleotide
acatttgcttccaccagttcccccccgccccgtgg

SEQ ID NO: 140965 - DNA, 35 bp, Artificial Sequence
  Synthetic oligonucleotide
gaagggagcgttacaggacgggagggaagggcgct

SEQ ID NO: 140966 - DNA, 35 bp, Artificial Sequence
  Synthetic oligonucleotide
tgctcggatcatcatgctactcgtaccaccaccgt

SEQ ID NO: 140967 - DNA, 36 bp, Artificial Sequence
  Synthetic oligonucleotide
atgcaaatcatgggtggggtgggagggatgaagaaa

SEQ ID NO: 140968 - DNA, 36 bp, Artificial Sequence
  Synthetic oligonucleotide
tttgcacgtcagccgagtcgacccttaccaccccca

SEQ ID NO: 140969 - DNA, 36 bp, Artificial Sequence
  Synthetic oligonucleotide
acacccactcttcatggtaacttcaactgccattca

SEQ ID NO: 140970 - DNA, 37 bp, Artificial Sequence
  Synthetic oligonucleotide
tgggtggacaggaagggtggtgggtgcagggggaaga

SEQ ID NO: 140971 - DNA, 37 bp, Artificial Sequence
  Synthetic oligonucleotide
gaagtgtggtgggggggttggggcggacgtactgaga

SEQ ID NO: 140972 - DNA, 37 bp, Artificial Sequence
  Synthetic oligonucleotide
gaccgtcacaccattttaggccgcttgttacacccga

SEQ ID NO: 140973 - DNA, 37 bp, Artificial Sequence
  Synthetic oligonucleotide
gggaacccgcctccaccgtgaccctctcatactggga

SEQ ID NO: 140974 - DNA, 37 bp, Artificial Sequence
  Synthetic oligonucleotide
tacctgcccgcttgacttgatccgccgccacctatga

SEQ ID NO: 140975 - DNA, 38 bp, Artificial Sequence
  Synthetic oligonucleotide
tgggagagtgggggggtgggtgctccatgccctcctga

SEQ ID NO: 140976 - DNA, 38 bp, Artificial Sequence
  Synthetic oligonucleotide
gtccgcccgtaccatgattcatttcgccctctctttga

SEQ ID NO: 140977 - DNA, 35 bp, Artificial Sequence
  Synthetic oligonucleotide
gtgggcacccctcacgctgaacatccatctttata

SEQ ID NO: 140978 - DNA, 36 bp, Artificial Sequence
  Synthetic oligonucleotide
tcgagcgctatcgcctacgccctgtgccctgtttta

SEQ ID NO: 140979 - DNA, 35 bp, Artificial Sequence
  Synthetic oligonucleotide
acgtgcacctgttactctgattcccggcctaccac

SEQ ID NO: 140980 - DNA, 35 bp, Artificial Sequence
  Synthetic oligonucleotide
tactgactgccgcccgtttaagctccggccactac

SEQ ID NO: 140981 - DNA, 35 bp, Artificial Sequence
  Synthetic oligonucleotide
tgaccatcgtgcttagtccaactgctctcttctac

SEQ ID NO: 140982 - DNA, 35 bp, Artificial Sequence
  Synthetic oligonucleotide
tcaccccctcatgcctggactttcagacttttacc

SEQ ID NO: 140983 - DNA, 35 bp, Artificial Sequence
  Synthetic oligonucleotide
tgccaccgctgcctcgacgaagttttctgcccctc

SEQ ID NO: 140984 - DNA, 35 bp, Artificial Sequence
  Synthetic oligonucleotide
tggggtcgttgtgtccgtcttagcgccccttcctc

SEQ ID NO: 140985 - DNA, 35 bp, Artificial Sequence
  Synthetic oligonucleotide
gccaaaagtcagccgcttttccccccacaatgctc

SEQ ID NO: 140986 - DNA, 35 bp, Artificial Sequence
  Synthetic oligonucleotide
aaccagcgcaccctgttcatgtcttgtcaccgttc

SEQ ID NO: 140987 - DNA, 35 bp, Artificial Sequence
  Synthetic oligonucleotide
gacgaccctcactttatacctacgccgcattttcg

SEQ ID NO: 140988 - DNA, 35 bp, Artificial Sequence
  Synthetic oligonucleotide
acagaacggaccatcaccccgccatctccgccggg

SEQ ID NO: 140989 - DNA, 35 bp, Artificial Sequence
  Synthetic oligonucleotide
tccttgcacactgttgtctttcctcaccaccgaat

SEQ ID NO: 140990 - DNA, 35 bp, Artificial Sequence
  Synthetic oligonucleotide
atcactcgtgcgccatgtcccaccccgattcacat

SEQ ID NO: 140991 - DNA, 35 bp, Artificial Sequence
  Synthetic oligonucleotide
tagtacgaagggggcggagggggtccgggtcgcat

SEQ ID NO: 140992 - DNA, 35 bp, Artificial Sequence
  Synthetic oligonucleotide
agcgctatcgctgctttttgtctctggtccctact

SEQ ID NO: 140993 - DNA, 35 bp, Artificial Sequence
  Synthetic oligonucleotide
gcaagaccgtccgcctttgctttaacttaacccct

SEQ ID NO: 140994 - DNA, 35 bp, Artificial Sequence
  Synthetic oligonucleotide
tgccgtcccggtgctcctcacgaactgcccgccct

SEQ ID NO: 140995 - DNA, 35 bp, Artificial Sequence
  Synthetic oligonucleotide
gttcgcccctccgcttcttccgcttttacgtggct

SEQ ID NO: 140996 - DNA, 35 bp, Artificial Sequence
  Synthetic oligonucleotide
tccccgacgccgtttttcttgtttgtacccatcgt

SEQ ID NO: 140997 - DNA, 35 bp, Artificial Sequence
  Synthetic oligonucleotide
actgctgtcacaccttatcacccccccgtgtcctt

SEQ ID NO: 140998 - DNA, 35 bp, Artificial Sequence
  Synthetic oligonucleotide
accgcctcggctccgtttttttgcactcctactaa

SEQ ID NO: 140999 - DNA, 36 bp, Artificial Sequence
  Synthetic oligonucleotide
tccctaccgcagtttcccttcagccctcctgcttaa

SEQ ID NO: 141000 - DNA, 35 bp, Artificial Sequence
  Synthetic oligonucleotide
atcaccacctcgctacgtttctaaatgtctgtaca

SEQ ID NO: 141001 - DNA, 35 bp, Artificial Sequence
  Synthetic oligonucleotide
gcggtcccctgcgctaaccgtacctgtccctgcca

SEQ ID NO: 141002 - DNA, 35 bp, Artificial Sequence
  Synthetic oligonucleotide
gggtgccgctacatgctcaccgtatctcgctctca

SEQ ID NO: 141003 - DNA, 37 bp, Artificial Sequence
  Synthetic oligonucleotide
gactacgcacatccacctgcgacctcatattcataga

SEQ ID NO: 141004 - DNA, 37 bp, Artificial Sequence
  Synthetic oligonucleotide
acgaacagggaggggggggtgaggtctgttatcacga

SEQ ID NO: 141005 - DNA, 36 bp, Artificial Sequence
  Synthetic oligonucleotide
gccctgaccctgctcatcacattctcctctggacga

SEQ ID NO: 141006 - DNA, 37 bp, Artificial Sequence
  Synthetic oligonucleotide
tagtagcgcgcctcgtcctatccaccctatgtaccga

SEQ ID NO: 141007 - DNA, 37 bp, Artificial Sequence
  Synthetic oligonucleotide
aaaccgtgtggggaaggagggttagaaaggggacgga

SEQ ID NO: 141008 - DNA, 37 bp, Artificial Sequence
  Synthetic oligonucleotide
tgcccccacctttccacaccgcgcccccacataggga

SEQ ID NO: 141009 - DNA, 36 bp, Artificial Sequence
  Synthetic oligonucleotide
atcactcaccatcgtctatatgcccccttctgccta

SEQ ID NO: 141010 - DNA, 36 bp, Artificial Sequence
  Synthetic oligonucleotide
ggagtgccttggggggaaggactagggggaggggta

SEQ ID NO: 141011 - DNA, 36 bp, Artificial Sequence
  Synthetic oligonucleotide
tgcggggccaatgtgtggggtgggcacccagggtta

SEQ ID NO: 141012 - DNA, 35 bp, Artificial Sequence
  Synthetic oligonucleotide
tgtccgcccctcgtttgttgcctactccgtgcccc

SEQ ID NO: 141013 - DNA, 35 bp, Artificial Sequence
  Synthetic oligonucleotide
gcagtatgtcctcccgcctgccctttgatcacgcc

SEQ ID NO: 141014 - DNA, 35 bp, Artificial Sequence
  Synthetic oligonucleotide
acgtcactgccctgactttagctccgcacccgtcc

SEQ ID NO: 141015 - DNA, 34 bp, Artificial Sequence
  Synthetic oligonucleotide
caccctgccctccgccggctttagctaattgtcc

SEQ ID NO: 141016 - DNA, 35 bp, Artificial Sequence
  Synthetic oligonucleotide
ttgccactcgcctcggtttaactttttgtggcctc

SEQ ID NO: 141017 - DNA, 35 bp, Artificial Sequence
  Synthetic oligonucleotide
gtacaccgtacagccgtggtcgctcacttatcttc

SEQ ID NO: 141018 - DNA, 35 bp, Artificial Sequence
  Synthetic oligonucleotide
acagaccgcttggctatgcagtcccgcccctgttc

SEQ ID NO: 141019 - DNA, 35 bp, Artificial Sequence
  Synthetic oligonucleotide
gtcgccctggttatatcgcctcgcgctacttgttc

SEQ ID NO: 141020 - DNA, 35 bp, Artificial Sequence
  Synthetic oligonucleotide
gatcctgaagaggaggtgaatggaggggagaagcg

SEQ ID NO: 141021 - DNA, 35 bp, Artificial Sequence
  Synthetic oligonucleotide
agcactcgccttccgtttaggttacatcattctcg

SEQ ID NO: 141022 - DNA, 36 bp, Artificial Sequence
  Synthetic oligonucleotide
acccccgcgccttcaactgctctgtgcgcctctttg

SEQ ID NO: 141023 - DNA, 35 bp, Artificial Sequence
  Synthetic oligonucleotide
ttgtgccctttcgacgtctctttgaactctctact

SEQ ID NO: 141024 - DNA, 35 bp, Artificial Sequence
  Synthetic oligonucleotide
aacttggagcgcgtaccatcctggtcatttgccct

SEQ ID NO: 141025 - DNA, 35 bp, Artificial Sequence
  Synthetic oligonucleotide
ttcctccccggagttgtagtcccctccatttgcct

SEQ ID NO: 141026 - DNA, 35 bp, Artificial Sequence
  Synthetic oligonucleotide
aatgcgcgtacccatcatactcagtggtcacctct

SEQ ID NO: 141027 - DNA, 35 bp, Artificial Sequence
  Synthetic oligonucleotide
gctctccgcccgatctcacagtccctccttgctgt

SEQ ID NO: 141028 - DNA, 35 bp, Artificial Sequence
  Synthetic oligonucleotide
gctccctcgtccttctccgtcttccgctcgcttgt

SEQ ID NO: 141029 - DNA, 36 bp, Artificial Sequence
  Synthetic oligonucleotide
tccatcccctcctgcgccctagccaacgataacgaa

SEQ ID NO: 141030 - DNA, 36 bp, Artificial Sequence
  Synthetic oligonucleotide
atgccccctccgagcacccgcccatttcgagtttaa

SEQ ID NO: 141031 - DNA, 36 bp, Artificial Sequence
  Synthetic oligonucleotide
ttcacccccgctacctggcatatgccaatcgctaca

SEQ ID NO: 141032 - DNA, 35 bp, Artificial Sequence
  Synthetic oligonucleotide
accatcgcacaacacgacgaatatgcactccccca

SEQ ID NO: 141033 - DNA, 36 bp, Artificial Sequence
  Synthetic oligonucleotide
gagcgccgtggttttagctaccatcctcccgccgca

SEQ ID NO: 141034 - DNA, 36 bp, Artificial Sequence
  Synthetic oligonucleotide
gacccactccatcccatccgcgcccccgcattgtca

SEQ ID NO: 141035 - DNA, 35 bp, Artificial Sequence
  Synthetic oligonucleotide
gccccggtggttgtatttttcccgcgccctcccga

SEQ ID NO: 141036 - DNA, 36 bp, Artificial Sequence
  Synthetic oligonucleotide
gcagtcgtgccgggaaggggggagcaaggacatcga

SEQ ID NO: 141037 - DNA, 37 bp, Artificial Sequence
  Synthetic oligonucleotide
tgcggagcctcgcccattaacacgctgtacccctcga

SEQ ID NO: 141038 - DNA, 37 bp, Artificial Sequence
  Synthetic oligonucleotide
acgcacctccgatcacggcctgtactatagtgacgga

SEQ ID NO: 141039 - DNA, 37 bp, Artificial Sequence
  Synthetic oligonucleotide
gcaccctcgcctgcccgtttcgccgacgccatgcgga

SEQ ID NO: 141040 - DNA, 38 bp, Artificial Sequence
  Synthetic oligonucleotide
taaagaagggtggagagtgtgggggcgggttcaattga

SEQ ID NO: 141041 - DNA, 37 bp, Artificial Sequence
  Synthetic oligonucleotide
atccgcccatccgttattccatgccatcttaccttga

SEQ ID NO: 141042 - DNA, 36 bp, Artificial Sequence
  Synthetic oligonucleotide
gcccacctttccgtccggtctgcccacttcccttga

SEQ ID NO: 141043 - DNA, 36 bp, Artificial Sequence
  Synthetic oligonucleotide
tcatccccgcaaccaacccgcccgagcctgtgcata

SEQ ID NO: 141044 - DNA, 36 bp, Artificial Sequence
  Synthetic oligonucleotide
tactcggtcgcccctggcttagcacacaccctgcta

SEQ ID NO: 141045 - DNA, 36 bp, Artificial Sequence
  Synthetic oligonucleotide
tcacgtagccacctgatccccccgtcggaccttcta

SEQ ID NO: 141046 - DNA, 36 bp, Artificial Sequence
  Synthetic oligonucleotide
tactaccggcaatctcgtatctcacctcccgttcta

SEQ ID NO: 141047 - DNA, 34 bp, Artificial Sequence
  Synthetic oligonucleotide
cccgcactacgccccgtcccgcccgcattcgaac

SEQ ID NO: 141048 - DNA, 35 bp, Artificial Sequence
  Synthetic oligonucleotide
gaggccaccctctttgtcccttgcacctcgttgac

SEQ ID NO: 141049 - DNA, 34 bp, Artificial Sequence
  Synthetic oligonucleotide
tgagggcggcctgacgaacgcgctcccattcccc

SEQ ID NO: 141050 - DNA, 35 bp, Artificial Sequence
  Synthetic oligonucleotide
acagcccacacgctctcaaagtcggccccgagccc

SEQ ID NO: 141051 - DNA, 35 bp, Artificial Sequence
  Synthetic oligonucleotide
ttgccccgctacctacgggtaacttccatcatggc

SEQ ID NO: 141052 - DNA, 35 bp, Artificial Sequence
  Synthetic oligonucleotide
agcacgggcaggcaccatcgcgtttgttttccctc

SEQ ID NO: 141053 - DNA, 35 bp, Artificial Sequence
  Synthetic oligonucleotide
aacccactcgcttacagacgtttccctctcttgtc

SEQ ID NO: 141054 - DNA, 35 bp, Artificial Sequence
  Synthetic oligonucleotide
tttggcaaccctccgtgcccaaggccgttcccttc

SEQ ID NO: 141055 - DNA, 35 bp, Artificial Sequence
  Synthetic oligonucleotide
ggggaaggtgagaaggaggttacagaagtcagcag

SEQ ID NO: 141056 - DNA, 32 bp, Artificial Sequence
  Synthetic oligonucleotide
gtgtgtggagtggggggcgagtagagagaccg

SEQ ID NO: 141057 - DNA, 35 bp, Artificial Sequence
  Synthetic oligonucleotide
gaaccaccccccgtaaaaaaccgatccttgtatcg

SEQ ID NO: 141058 - DNA, 35 bp, Artificial Sequence
  Synthetic oligonucleotide
tgtatcggggggggtgggggagcggtgggcgaggg

SEQ ID NO: 141059 - DNA, 35 bp, Artificial Sequence
  Synthetic oligonucleotide
ttccgctctagtatctgcatttgattgtcctcctg

SEQ ID NO: 141060 - DNA, 35 bp, Artificial Sequence
  Synthetic oligonucleotide
tgcacccactcggttcctcgcgctaggccccctat

SEQ ID NO: 141061 - DNA, 35 bp, Artificial Sequence
  Synthetic oligonucleotide
tgagtacccgcttgatagaccatagcccgcctcct

SEQ ID NO: 141062 - DNA, 35 bp, Artificial Sequence
  Synthetic oligonucleotide
agtcaagttccgcagtagtgccctccgtcgttcct

SEQ ID NO: 141063 - DNA, 36 bp, Artificial Sequence
  Synthetic oligonucleotide
gcccaccgtctcagccctcacccgtcgctcacgaaa

SEQ ID NO: 141064 - DNA, 35 bp, Artificial Sequence
  Synthetic oligonucleotide
tgtcgcattcagcggcacatcgattctaccaccaa

SEQ ID NO: 141065 - DNA, 36 bp, Artificial Sequence
  Synthetic oligonucleotide
gcgcactacatttgcctctcgttttcttcccgccga

SEQ ID NO: 141066 - DNA, 35 bp, Artificial Sequence
  Synthetic oligonucleotide
atcgatacacccttgcatggttccctgttctccga

SEQ ID NO: 141067 - DNA, 37 bp, Artificial Sequence
  Synthetic oligonucleotide
ttacgcccacccgcataggcccttccaatcacctcga

SEQ ID NO: 141068 - DNA, 37 bp, Artificial Sequence
  Synthetic oligonucleotide
cacacctccacactcgtatattccctcaggttaggga

SEQ ID NO: 141069 - DNA, 37 bp, Artificial Sequence
  Synthetic oligonucleotide
tcgcttcccaccagttggccttcgtacctcctctgga

SEQ ID NO: 141070 - DNA, 36 bp, Artificial Sequence
  Synthetic oligonucleotide
acctccccgccccctccgccttgaatagtgtagtga

SEQ ID NO: 141071 - DNA, 36 bp, Artificial Sequence
  Synthetic oligonucleotide
actaccgctctctgcgtaacaatccgccccccgtga

SEQ ID NO: 141072 - DNA, 38 bp, Artificial Sequence
  Synthetic oligonucleotide
gcatgggcggggtgatgatggggaatgccgtggggtga

SEQ ID NO: 141073 - DNA, 36 bp, Artificial Sequence
  Synthetic oligonucleotide
gcgggacagacaggagggtgggccggggtgaaggta

SEQ ID NO: 141074 - DNA, 35 bp, Artificial Sequence
  Synthetic oligonucleotide
tctgaaccaccctcgcaatgagctttgctcctgta

SEQ ID NO: 141075 - DNA, 36 bp, Artificial Sequence
  Synthetic oligonucleotide
tctatccaccgctggtaacttttgcccgttcttgta

SEQ ID NO: 141076 - DNA, 36 bp, Artificial Sequence
  Synthetic oligonucleotide
acacccttcgatggattcgcgttaccgttcctctta

SEQ ID NO: 141077 - DNA, 35 bp, Artificial Sequence
  Synthetic oligonucleotide
gacgcccgcaggctccttcgctatccaacccgcac

SEQ ID NO: 141078 - DNA, 35 bp, Artificial Sequence
  Synthetic oligonucleotide
tagcaccgcgtttgtctttggccttcccgctcgac

SEQ ID NO: 141079 - DNA, 35 bp, Artificial Sequence
  Synthetic oligonucleotide
gactccctcccgcggaaacgttacagtctccctac

SEQ ID NO: 141080 - DNA, 35 bp, Artificial Sequence
  Synthetic oligonucleotide
gtgaccccccccgaatggggaattcagaccacccc

SEQ ID NO: 141081 - DNA, 35 bp, Artificial Sequence
  Synthetic oligonucleotide
tcagctacatcacatgcttcaatactcttctgccc

SEQ ID NO: 141082 - DNA, 35 bp, Artificial Sequence
  Synthetic oligonucleotide
acgacggctaccaactgtcctccgtttccacagcc

SEQ ID NO: 141083 - DNA, 35 bp, Artificial Sequence
  Synthetic oligonucleotide
acactgtcaacggtaagtcagcttctcccctttcc

SEQ ID NO: 141084 - DNA, 35 bp, Artificial Sequence
  Synthetic oligonucleotide
tcagtagcggcctcacatccgcgcccagtacctgc

SEQ ID NO: 141085 - DNA, 35 bp, Artificial Sequence
  Synthetic oligonucleotide
gccagtgccatttcaattgctcatgacgttccatc

SEQ ID NO: 141086 - DNA, 35 bp, Artificial Sequence
  Synthetic oligonucleotide
ataccaccccttccggctataagttccaacccctc

SEQ ID NO: 141087 - DNA, 35 bp, Artificial Sequence
  Synthetic oligonucleotide
attgtcgcacgattgcgtactacctgtcattgctc

SEQ ID NO: 141088 - DNA, 35 bp, Artificial Sequence
  Synthetic oligonucleotide
ttggcaaccacatcttgtctcccggcccggtaccg

SEQ ID NO: 141089 - DNA, 35 bp, Artificial Sequence
  Synthetic oligonucleotide
acatagcgcggagtcgtttccctagttgtcccccg

SEQ ID NO: 141090 - DNA, 35 bp, Artificial Sequence
  Synthetic oligonucleotide
gccaaagagaggggagggggatgcggccttcgtcg

SEQ ID NO: 141091 - DNA, 35 bp, Artificial Sequence
  Synthetic oligonucleotide
tacgagcgtctccatctgcctgcccgtaccgttcg

SEQ ID NO: 141092 - DNA, 35 bp, Artificial Sequence
  Synthetic oligonucleotide
ggtccggagtcggtaggagggcgggcaaaggaggg

SEQ ID NO: 141093 - DNA, 35 bp, Artificial Sequence
  Synthetic oligonucleotide
acacaccacctagcatgttcgccgttccgctcttg

SEQ ID NO: 141094 - DNA, 35 bp, Artificial Sequence
  Synthetic oligonucleotide
ggtctagctcaggttattactccgcccgttcgcct

SEQ ID NO: 141095 - DNA, 35 bp, Artificial Sequence
  Synthetic oligonucleotide
gttgtcaccattgtcttttataggccgttgctcct

SEQ ID NO: 141096 - DNA, 35 bp, Artificial Sequence
  Synthetic oligonucleotide
tccgttccgtcacgtcgccttgatcccgtttgttt

SEQ ID NO: 141097 - DNA, 35 bp, Artificial Sequence
  Synthetic oligonucleotide
tcatcccactgtatctatgtttgcctggccatttt

SEQ ID NO: 141098 - DNA, 36 bp, Artificial Sequence
  Synthetic oligonucleotide
gcacctacacaggctctatcctcatacagctccaca

SEQ ID NO: 141099 - DNA, 36 bp, Artificial Sequence
  Synthetic oligonucleotide
atccgccacaccatctactaacttgtgaccccccca

SEQ ID NO: 141100 - DNA, 36 bp, Artificial Sequence
  Synthetic oligonucleotide
gtcacatcaccactcgattagcacgtattcattcca

SEQ ID NO: 141101 - DNA, 36 bp, Artificial Sequence
  Synthetic oligonucleotide
ggactccatctgctaactctcgtgacccgtctctca

SEQ ID NO: 141102 - DNA, 37 bp, Artificial Sequence
  Synthetic oligonucleotide
ggggggcaatagggtttaggaaggaaggggtaggaga

SEQ ID NO: 141103 - DNA, 37 bp, Artificial Sequence
  Synthetic oligonucleotide
acacttcccgccgacaccgtccctgctccctccccga

SEQ ID NO: 141104 - DNA, 37 bp, Artificial Sequence
  Synthetic oligonucleotide
gttgttccgttcgatgctctatccacctcgccgccga

SEQ ID NO: 141105 - DNA, 37 bp, Artificial Sequence
  Synthetic oligonucleotide
gtggaacctcgggaacggatagggcacggtgggagga

SEQ ID NO: 141106 - DNA, 37 bp, Artificial Sequence
  Synthetic oligonucleotide
gatgagcaatgggggaatgaggcggtggggtttagga

SEQ ID NO: 141107 - DNA, 37 bp, Artificial Sequence
  Synthetic oligonucleotide
acatgggaacgggggcaggaggagagcgtccgacgga

SEQ ID NO: 141108 - DNA, 37 bp, Artificial Sequence
  Synthetic oligonucleotide
ggaccacacgggtgcgggaaatggttcggggggggga

SEQ ID NO: 141109 - DNA, 36 bp, Artificial Sequence
  Synthetic oligonucleotide
gtagtgataggaaggctgggatcaggggcgggtgga

SEQ ID NO: 141110 - DNA, 38 bp, Artificial Sequence
  Synthetic oligonucleotide
atgacaccgcagtgacttttgcacacctcaccaactga

SEQ ID NO: 141111 - DNA, 38 bp, Artificial Sequence
  Synthetic oligonucleotide
tgatgcacgcacctgttacccatcgctctcggacctga

SEQ ID NO: 141112 - DNA, 37 bp, Artificial Sequence
  Synthetic oligonucleotide
tcataccacccagagtcgccctccacccacacagtga

SEQ ID NO: 141113 - DNA, 38 bp, Artificial Sequence
  Synthetic oligonucleotide
ttgggctctctgtcccctgccactcccctttgccgtga

SEQ ID NO: 141114 - DNA, 38 bp, Artificial Sequence
  Synthetic oligonucleotide
gccgattccatgcgtactcttcgcgtagtcactcttga

SEQ ID NO: 141115 - DNA, 35 bp, Artificial Sequence
  Synthetic oligonucleotide
tagtcaccttccggtcggccctctgtactaccata

SEQ ID NO: 141116 - DNA, 36 bp, Artificial Sequence
  Synthetic oligonucleotide
tgagggtacgggtcgggccggaaagggaagtgggta

SEQ ID NO: 141117 - DNA, 36 bp, Artificial Sequence
  Synthetic oligonucleotide
tgtccgaccctcctgcgtggcacctttaccgggtta

SEQ ID NO: 141118 - DNA, 35 bp, Artificial Sequence
  Synthetic oligonucleotide
gccgagtctggttgtcggtatccccgccactcccc

SEQ ID NO: 141119 - DNA, 35 bp, Artificial Sequence
  Synthetic oligonucleotide
gcgctgccatgatgaaatggccctcacctgctccc

SEQ ID NO: 141120 - DNA, 35 bp, Artificial Sequence
  Synthetic oligonucleotide
gtcggtcaaccctttctgtcctcttgattatcgcc

SEQ ID NO: 141121 - DNA, 35 bp, Artificial Sequence
  Synthetic oligonucleotide
accccagcccatcccctgtgcgttgtagtgttgcc

SEQ ID NO: 141122 - DNA, 34 bp, Artificial Sequence
  Synthetic oligonucleotide
acgccaaatccggtcccacctcatcgctctgtcc

SEQ ID NO: 141123 - DNA, 35 bp, Artificial Sequence
  Synthetic oligonucleotide
tcatcacctttcgccccgtacaaggctctataagc

SEQ ID NO: 141124 - DNA, 35 bp, Artificial Sequence
  Synthetic oligonucleotide
tcccccacatacgcctgcgagttactgcgctccgc

SEQ ID NO: 141125 - DNA, 35 bp, Artificial Sequence
  Synthetic oligonucleotide
tgaagcatccctgattccctcggttcatgccctgc

SEQ ID NO: 141126 - DNA, 35 bp, Artificial Sequence
  Synthetic oligonucleotide
taagccattctgcacagccatgtccgctcccaatc

SEQ ID NO: 141127 - DNA, 35 bp, Artificial Sequence
  Synthetic oligonucleotide
taactcagcctcgttggcactgaaccgttgtcctc

SEQ ID NO: 141128 - DNA, 34 bp, Artificial Sequence
  Synthetic oligonucleotide
tatgccaactgtcccatgaaactcccccgaccag

SEQ ID NO: 141129 - DNA, 35 bp, Artificial Sequence
  Synthetic oligonucleotide
gtggggatgctcaagcggggtaagtagtgggaatg

SEQ ID NO: 141130 - DNA, 35 bp, Artificial Sequence
  Synthetic oligonucleotide
acatgctgtaccgcggtctgtctttattatccctg

SEQ ID NO: 141131 - DNA, 35 bp, Artificial Sequence
  Synthetic oligonucleotide
tgacattccgacccgacttcacagtaccattcctg

SEQ ID NO: 141132 - DNA, 35 bp, Artificial Sequence
  Synthetic oligonucleotide
tcaaatcatcgtgcagcgctgccctacttcccttg

SEQ ID NO: 141133 - DNA, 35 bp, Artificial Sequence
  Synthetic oligonucleotide
tacaccccgctttccagggaattatactgtttcat

SEQ ID NO: 141134 - DNA, 35 bp, Artificial Sequence
  Synthetic oligonucleotide
gcccagttcgctcctagcctgcgctttgttcttct

SEQ ID NO: 141135 - DNA, 35 bp, Artificial Sequence
  Synthetic oligonucleotide
gtggtctgtctcccgttgtccttagcatcccttgt

SEQ ID NO: 141136 - DNA, 35 bp, Artificial Sequence
  Synthetic oligonucleotide
catacccccggcccctgcgtgtcactcaacacctt

SEQ ID NO: 141137 - DNA, 35 bp, Artificial Sequence
  Synthetic oligonucleotide
gatgactccgtcctggtataccacgccctttgctt

SEQ ID NO: 141138 - DNA, 35 bp, Artificial Sequence
  Synthetic oligonucleotide
acacgatccctgttgccgacctcaagcctgatttt

SEQ ID NO: 141139 - DNA, 35 bp, Artificial Sequence
  Synthetic oligonucleotide
gagagacgggtgggaaagggcgactcggcgaataa

SEQ ID NO: 141140 - DNA, 36 bp, Artificial Sequence
  Synthetic oligonucleotide
gcgcaagcctaatatttgacctgccgtcccgcccca

SEQ ID NO: 141141 - DNA, 36 bp, Artificial Sequence
  Synthetic oligonucleotide
gtgccaagactgatacatatgctccctccctcgcca

SEQ ID NO: 141142 - DNA, 36 bp, Artificial Sequence
  Synthetic oligonucleotide
gtgaagccacgactcaccctgccccatttcgacgca

SEQ ID NO: 141143 - DNA, 36 bp, Artificial Sequence
  Synthetic oligonucleotide
gcctcccgccctgtattagtctctcgggccaccgca

SEQ ID NO: 141144 - DNA, 36 bp, Artificial Sequence
  Synthetic oligonucleotide
tgtgaggggggggggtaaggacggaatggagggtca

SEQ ID NO: 141145 - DNA, 36 bp, Artificial Sequence
  Synthetic oligonucleotide
tcaccccttcaccctggtcagttctgccctagttca

SEQ ID NO: 141146 - DNA, 36 bp, Artificial Sequence
  Synthetic oligonucleotide
gactccccttgttccctgccttagaagacgctttca

SEQ ID NO: 141147 - DNA, 37 bp, Artificial Sequence
  Synthetic oligonucleotide
gagccggaggggtgaggggcgcaagcggaggagtaga

SEQ ID NO: 141148 - DNA, 37 bp, Artificial Sequence
  Synthetic oligonucleotide
gtcggacaagtggagaagagggcgaggagggagggga

SEQ ID NO: 141149 - DNA, 36 bp, Artificial Sequence
  Synthetic oligonucleotide
tttcacaggtgacgacattgggaagggaggggggga

SEQ ID NO: 141150 - DNA, 36 bp, Artificial Sequence
  Synthetic oligonucleotide
ttcggaggacggggtcatgcaaagggggaggctgga

SEQ ID NO: 141151 - DNA, 36 bp, Artificial Sequence
  Synthetic oligonucleotide
accccatctgcatccacaccgccttcctgtagttga

SEQ ID NO: 141152 - DNA, 36 bp, Artificial Sequence
  Synthetic oligonucleotide
gccgaggggggggagacgtggagtgagggagggata

SEQ ID NO: 141153 - DNA, 36 bp, Artificial Sequence
  Synthetic oligonucleotide
acctccacgcctgcttttcccgaactctctgctata

SEQ ID NO: 141154 - DNA, 36 bp, Artificial Sequence
  Synthetic oligonucleotide
tgtatgtgttccgttcgtcgtcccgtgtcgccccta

SEQ ID NO: 141155 - DNA, 35 bp, Artificial Sequence
  Synthetic oligonucleotide
atcacccacctctcgctgtctgtgacctgtacgta

SEQ ID NO: 141156 - DNA, 36 bp, Artificial Sequence
  Synthetic oligonucleotide
atgacgtcgcaccaccctaccgtattcccgttcgta

SEQ ID NO: 141157 - DNA, 36 bp, Artificial Sequence
  Synthetic oligonucleotide
tctcatcccgctccatgctttcccataaacacttta

SEQ ID NO: 141158 - DNA, 35 bp, Artificial Sequence
  Synthetic oligonucleotide
tgcgatcagccccttcccgtcttcgtgtctccgac

SEQ ID NO: 141159 - DNA, 35 bp, Artificial Sequence
  Synthetic oligonucleotide
tccccctctttggtacacgacttgccgcatctccc

SEQ ID NO: 141160 - DNA, 33 bp, Artificial Sequence
  Synthetic oligonucleotide
tattgccgcccggatcctggttcactttttgcc

SEQ ID NO: 141161 - DNA, 35 bp, Artificial Sequence
  Synthetic oligonucleotide
tccactacaccctcctgaccggcggaccgccctcc

SEQ ID NO: 141162 - DNA, 35 bp, Artificial Sequence
  Synthetic oligonucleotide
acgcccccccccggttatcaactcgtcaggttcgc

SEQ ID NO: 141163 - DNA, 35 bp, Artificial Sequence
  Synthetic oligonucleotide
gcatccctgtcttcccacctctacgtgcgtgctgc

SEQ ID NO: 141164 - DNA, 35 bp, Artificial Sequence
  Synthetic oligonucleotide
gcgttgcactgggctgccctctccgctttcttgtc

SEQ ID NO: 141165 - DNA, 35 bp, Artificial Sequence
  Synthetic oligonucleotide
ttgacagatgcccttaatgtcacgcctctaccttc

SEQ ID NO: 141166 - DNA, 35 bp, Artificial Sequence
  Synthetic oligonucleotide
gccgcccgtagcgctcgggtcctttgccttatttc

SEQ ID NO: 141167 - DNA, 36 bp, Artificial Sequence
  Synthetic oligonucleotide
atcgcgcagggatcgtcaagccctgtcctccttacg

SEQ ID NO: 141168 - DNA, 35 bp, Artificial Sequence
  Synthetic oligonucleotide
gcggaccggggaggcagtaaaggggggaagatgcg

SEQ ID NO: 141169 - DNA, 35 bp, Artificial Sequence
  Synthetic oligonucleotide
acagacagcagctcttggtccgctatcacctcact

SEQ ID NO: 141170 - DNA, 35 bp, Artificial Sequence
  Synthetic oligonucleotide
agtcgttcctcaggtcgcagttcacatatccacct

SEQ ID NO: 141171 - DNA, 35 bp, Artificial Sequence
  Synthetic oligonucleotide
gatacatccgatagctttccgtccctgccgtgcct

SEQ ID NO: 141172 - DNA, 36 bp, Artificial Sequence
  Synthetic oligonucleotide
tctcctctgccggttctctacagctatctgtatcct

SEQ ID NO: 141173 - DNA, 36 bp, Artificial Sequence
  Synthetic oligonucleotide
gattagggtggggatgggaggggtttgtcggagcaa

SEQ ID NO: 141174 - DNA, 36 bp, Artificial Sequence
  Synthetic oligonucleotide
gatccgggaaagggcgtgaagggcggcaaaaggcaa

SEQ ID NO: 141175 - DNA, 36 bp, Artificial Sequence
  Synthetic oligonucleotide
gaacctacgcccgcttgtattcgctccctgcccgaa

SEQ ID NO: 141176 - DNA, 36 bp, Artificial Sequence
  Synthetic oligonucleotide
gtgactccacccaccgcctgccctgccgtccattaa

SEQ ID NO: 141177 - DNA, 32 bp, Artificial Sequence
  Synthetic oligonucleotide
gttcctgccccgattatccatcctgatcgcca

SEQ ID NO: 141178 - DNA, 36 bp, Artificial Sequence
  Synthetic oligonucleotide
tagccctgaacgcccctatgactacattgacctcca

SEQ ID NO: 141179 - DNA, 36 bp, Artificial Sequence
  Synthetic oligonucleotide
tgtcgtcgcccatccacccgctagccttactgtcca

SEQ ID NO: 141180 - DNA, 36 bp, Artificial Sequence
  Synthetic oligonucleotide
tagttccaccccgctcctatcagcgatcctagttca

SEQ ID NO: 141181 - DNA, 37 bp, Artificial Sequence
  Synthetic oligonucleotide
ttgagagaagggtggtggtgggggggaagaaaggaga

SEQ ID NO: 141182 - DNA, 36 bp, Artificial Sequence
  Synthetic oligonucleotide
tgcaaccgccacgttctcgcgcctatttaataccga

SEQ ID NO: 141183 - DNA, 36 bp, Artificial Sequence
  Synthetic oligonucleotide
actgtacgccccccgattagattgccctcctgtcga

SEQ ID NO: 141184 - DNA, 37 bp, Artificial Sequence
  Synthetic oligonucleotide
acaccctcgctgaatgctctgtcgtccctgccttcga

SEQ ID NO: 141185 - DNA, 37 bp, Artificial Sequence
  Synthetic oligonucleotide
gggggggcggtaagtagggacgggaggcttgggggga

SEQ ID NO: 141186 - DNA, 36 bp, Artificial Sequence
  Synthetic oligonucleotide
atccgacccactcatgcctcaacgttgacagctgga

SEQ ID NO: 141187 - DNA, 36 bp, Artificial Sequence
  Synthetic oligonucleotide
gacttcctcgccgcacggttctcgccatttcactga

SEQ ID NO: 141188 - DNA, 38 bp, Artificial Sequence
  Synthetic oligonucleotide
ggtcgcccttctcctctgttgtccacctgcctgcctga

SEQ ID NO: 141189 - DNA, 38 bp, Artificial Sequence
  Synthetic oligonucleotide
agagcaaacggggcaaaaaggtggaggtgcgggggtga

SEQ ID NO: 141190 - DNA, 36 bp, Artificial Sequence
  Synthetic oligonucleotide
acccccccgatcccgtatgcccctagaggcctgtga

SEQ ID NO: 141191 - DNA, 36 bp, Artificial Sequence
  Synthetic oligonucleotide
tgcatccttgcacacgtatagccccactcccgttga

SEQ ID NO: 141192 - DNA, 36 bp, Artificial Sequence
  Synthetic oligonucleotide
ttcgggacccccgcaccccccgcatgatatcgccta

SEQ ID NO: 141193 - DNA, 35 bp, Artificial Sequence
  Synthetic oligonucleotide
accggagaccccctgtgctacatcttccaggccta

SEQ ID NO: 141194 - DNA, 36 bp, Artificial Sequence
  Synthetic oligonucleotide
agtcacccgtcccacgcctggaactctacctccgta

SEQ ID NO: 141195 - DNA, 36 bp, Artificial Sequence
  Synthetic oligonucleotide
tattccgccaccttggtcctgcactcgaacccctta

SEQ ID NO: 141196 - DNA, 36 bp, Artificial Sequence
  Synthetic oligonucleotide
gatcaggccacatcgtacatctctagttcctcctta

SEQ ID NO: 141197 - DNA, 36 bp, Artificial Sequence
  Synthetic oligonucleotide
tctgccgacagctgattatccacccgccccacgtta

SEQ ID NO: 141198 - DNA, 35 bp, Artificial Sequence
  Synthetic oligonucleotide
gactgcgctgcgtacgttacgtccatatccaccac

SEQ ID NO: 141199 - DNA, 35 bp, Artificial Sequence
  Synthetic oligonucleotide
tctcaccatctgcgttcccgcgggactctctgcac

SEQ ID NO: 141200 - DNA, 35 bp, Artificial Sequence
  Synthetic oligonucleotide
aactcgcaccactaatgcgcacttactcgtatcac

SEQ ID NO: 141201 - DNA, 35 bp, Artificial Sequence
  Synthetic oligonucleotide
tcactccgctccatcctcgtactatcggacacgac

SEQ ID NO: 141202 - DNA, 35 bp, Artificial Sequence
  Synthetic oligonucleotide
aaagatgggggaaggggggagtgagcgcaggcgac

SEQ ID NO: 141203 - DNA, 35 bp, Artificial Sequence
  Synthetic oligonucleotide
gtgatctgctgcctccttcgggccatcgtaatacc

SEQ ID NO: 141204 - DNA, 35 bp, Artificial Sequence
  Synthetic oligonucleotide
tactggcgccttccatatggactctatttgccccc

SEQ ID NO: 141205 - DNA, 35 bp, Artificial Sequence
  Synthetic oligonucleotide
attaaccgcctccacatagttcgagaatctttgcc

SEQ ID NO: 141206 - DNA, 35 bp, Artificial Sequence
  Synthetic oligonucleotide
gcgctgttgtctcctgtagctcccgcccgccccgc

SEQ ID NO: 141207 - DNA, 35 bp, Artificial Sequence
  Synthetic oligonucleotide
gcccaccccgacgattcttgtccttcctctcgcgc

SEQ ID NO: 141208 - DNA, 35 bp, Artificial Sequence
  Synthetic oligonucleotide
tcacgacgtcacccatttcgccctgattcccaatc

SEQ ID NO: 141209 - DNA, 35 bp, Artificial Sequence
  Synthetic oligonucleotide
tctgccacagctcgaaccctcaacgcctgtcaatc

SEQ ID NO: 141210 - DNA, 35 bp, Artificial Sequence
  Synthetic oligonucleotide
gatccaccaatgatgcgcctgccatttctagtttc

SEQ ID NO: 141211 - DNA, 35 bp, Artificial Sequence
  Synthetic oligonucleotide
gcgcgtgcgcccactgctaccccccctagatctcg

SEQ ID NO: 141212 - DNA, 35 bp, Artificial Sequence
  Synthetic oligonucleotide
agtccccccactcctatctccccaggtccgccatg

SEQ ID NO: 141213 - DNA, 35 bp, Artificial Sequence
  Synthetic oligonucleotide
gcatttacaccccccgacccgccaccgaaactgtg

SEQ ID NO: 141214 - DNA, 35 bp, Artificial Sequence
  Synthetic oligonucleotide
gccacccttcactgcatcccaacgtacccatgcat

SEQ ID NO: 141215 - DNA, 35 bp, Artificial Sequence
  Synthetic oligonucleotide
actgctccgcacacctggttagactgtccatctct

SEQ ID NO: 141216 - DNA, 35 bp, Artificial Sequence
  Synthetic oligonucleotide
attccccgccccgcttataccataagtttcccggt

SEQ ID NO: 141217 - DNA, 35 bp, Artificial Sequence
  Synthetic oligonucleotide
ggggtgggctgttgaggggaagactcattgggggt

SEQ ID NO: 141218 - DNA, 35 bp, Artificial Sequence
  Synthetic oligonucleotide
gtcccaaccccctacgtgctaatgatcgacgcctt

SEQ ID NO: 141219 - DNA, 35 bp, Artificial Sequence
  Synthetic oligonucleotide
tgccctcctcggtttgccctcatcacagtcgacaa

SEQ ID NO: 141220 - DNA, 36 bp, Artificial Sequence
  Synthetic oligonucleotide
gatccacctagaatgctcctgaacaccctcgctgaa

SEQ ID NO: 141221 - DNA, 36 bp, Artificial Sequence
  Synthetic oligonucleotide
tgaaaagggggaggaaaaaggcagtcgaggaagaca

SEQ ID NO: 141222 - DNA, 36 bp, Artificial Sequence
  Synthetic oligonucleotide
ttatgcgtaagccctcagtccctcgtcgtccactca

SEQ ID NO: 141223 - DNA, 36 bp, Artificial Sequence
  Synthetic oligonucleotide
tcccgcccccctaaatgactagcctagatacgctca

SEQ ID NO: 141224 - DNA, 35 bp, Artificial Sequence
  Synthetic oligonucleotide
tcgccggtgacctgtaccctcccctccgttattca

SEQ ID NO: 141225 - DNA, 35 bp, Artificial Sequence
  Synthetic oligonucleotide
tgatacagcccgccttccttctccacgactcttca

SEQ ID NO: 141226 - DNA, 36 bp, Artificial Sequence
  Synthetic oligonucleotide
atcataccccttcaattgcgatatgcacctctttca

SEQ ID NO: 141227 - DNA, 36 bp, Artificial Sequence
  Synthetic oligonucleotide
tatccgcgccatccgatagcatgcctgtttctttca

SEQ ID NO: 141228 - DNA, 36 bp, Artificial Sequence
  Synthetic oligonucleotide
taccgcaaccgggaaagggagggtgggggtgtgaga

SEQ ID NO: 141229 - DNA, 37 bp, Artificial Sequence
  Synthetic oligonucleotide
gaaggtaggagtgggacggggcatgtgggtctgacga

SEQ ID NO: 141230 - DNA, 37 bp, Artificial Sequence
  Synthetic oligonucleotide
agacaaggagcggggaaaacaggttggaggggggcga

SEQ ID NO: 141231 - DNA, 36 bp, Artificial Sequence
  Synthetic oligonucleotide
aaccgggagggagggtgtgcctggggagtgtggcga

SEQ ID NO: 141232 - DNA, 37 bp, Artificial Sequence
  Synthetic oligonucleotide
tgtccctctcggcctgtttctagctccctattctcga

SEQ ID NO: 141233 - DNA, 37 bp, Artificial Sequence
  Synthetic oligonucleotide
atcgcctcattccgccgtgaacccagtctctcttcga

SEQ ID NO: 141234 - DNA, 37 bp, Artificial Sequence
  Synthetic oligonucleotide
gttggcataggggacaattggggttcaaggggaggga

SEQ ID NO: 141235 - DNA, 37 bp, Artificial Sequence
  Synthetic oligonucleotide
ggggaggggtatcagtaaggcttagggaggggaggga

SEQ ID NO: 141236 - DNA, 36 bp, Artificial Sequence
  Synthetic oligonucleotide
ggggcaacataagcgggagggcgcgcctgttaggga

SEQ ID NO: 141237 - DNA, 37 bp, Artificial Sequence
  Synthetic oligonucleotide
tacagggaggttcaaggggggaggaaatagtgcggga

SEQ ID NO: 141238 - DNA, 37 bp, Artificial Sequence
  Synthetic oligonucleotide
ggaaaaggaaggggcggggaaacgaaagatagtggga

SEQ ID NO: 141239 - DNA, 37 bp, Artificial Sequence
  Synthetic oligonucleotide
gacgtccatccttcagcgcgtggcacccccatttgga

SEQ ID NO: 141240 - DNA, 38 bp, Artificial Sequence
  Synthetic oligonucleotide
gactcgactccagctatcagcgcacacaccctccatga

SEQ ID NO: 141241 - DNA, 38 bp, Artificial Sequence
  Synthetic oligonucleotide
gaggggggtggatcgggtacgggaacgcgccaaactga

SEQ ID NO: 141242 - DNA, 37 bp, Artificial Sequence
  Synthetic oligonucleotide
attcggtccgggggggagagaagggcgggaagattga

SEQ ID NO: 141243 - DNA, 36 bp, Artificial Sequence
  Synthetic oligonucleotide
ttggagagcgggtgggtgggtctaacatgccaaata

SEQ ID NO: 141244 - DNA, 35 bp, Artificial Sequence
  Synthetic oligonucleotide
gtcagaacacatgtgcttctatccctacgccccta

SEQ ID NO: 141245 - DNA, 36 bp, Artificial Sequence
  Synthetic oligonucleotide
acctaatgtgccagttgccgtcgcgcctccctccta

SEQ ID NO: 141246 - DNA, 36 bp, Artificial Sequence
  Synthetic oligonucleotide
gtatcacacgtccctgcccttcccgccagtgaggta

SEQ ID NO: 141247 - DNA, 36 bp, Artificial Sequence
  Synthetic oligonucleotide
ttgccatcgatactgccgccttccctgacgttttta

SEQ ID NO: 141248 - DNA, 35 bp, Artificial Sequence
  Synthetic oligonucleotide
gcgactaccgatctgcttaccgcctcaccatggac

SEQ ID NO: 141249 - DNA, 35 bp, Artificial Sequence
  Synthetic oligonucleotide
atgtccgacctccccgcctgctgaaccttgcatac

SEQ ID NO: 141250 - DNA, 35 bp, Artificial Sequence
  Synthetic oligonucleotide
gatggcgctacagctccgttctcagtcataccacc

SEQ ID NO: 141251 - DNA, 35 bp, Artificial Sequence
  Synthetic oligonucleotide
acgcgcactcactccatcccatttcgtatccggcc

SEQ ID NO: 141252 - DNA, 35 bp, Artificial Sequence
  Synthetic oligonucleotide
gcagacgcgatacccacacgctcccctggtttgcc

SEQ ID NO: 141253 - DNA, 35 bp, Artificial Sequence
  Synthetic oligonucleotide
gttggagttcagatcccaccgcccctcatttctcc

SEQ ID NO: 141254 - DNA, 29 bp, Artificial Sequence
  Synthetic oligonucleotide
gatgtaaaccctgacgccctctatatcgc

SEQ ID NO: 141255 - DNA, 35 bp, Artificial Sequence
  Synthetic oligonucleotide
gcgcatacgccgtcccgccacagcttgtaccctgc

SEQ ID NO: 141256 - DNA, 34 bp, Artificial Sequence
  Synthetic oligonucleotide
tcacatgtgtccaatctatcgcactaccagcctc

SEQ ID NO: 141257 - DNA, 35 bp, Artificial Sequence
  Synthetic oligonucleotide
gcgtacctgagatctgccctttacttgcgctcctc

SEQ ID NO: 141258 - DNA, 35 bp, Artificial Sequence
  Synthetic oligonucleotide
gcctgcccgcgccgcctaccccgaacttctagctc

SEQ ID NO: 141259 - DNA, 35 bp, Artificial Sequence
  Synthetic oligonucleotide
gaggtgcaacctgggcctcgttctttctgcctctc

SEQ ID NO: 141260 - DNA, 35 bp, Artificial Sequence
  Synthetic oligonucleotide
gactccatccccggccttgcacaatttttaacccg

SEQ ID NO: 141261 - DNA, 35 bp, Artificial Sequence
  Synthetic oligonucleotide
aagggggagggtacgagccgaaggagggcgagagg

SEQ ID NO: 141262 - DNA, 35 bp, Artificial Sequence
  Synthetic oligonucleotide
tagagggggtgtcggggtcaagcggggggtagtgg

SEQ ID NO: 141263 - DNA, 35 bp, Artificial Sequence
  Synthetic oligonucleotide
ttgatgtggcctgcatccttctcctccctgccgtg

SEQ ID NO: 141264 - DNA, 35 bp, Artificial Sequence
  Synthetic oligonucleotide
tgtgcccccgcttactgcccgacccgaccgtattg

SEQ ID NO: 141265 - DNA, 35 bp, Artificial Sequence
  Synthetic oligonucleotide
gcttacccttgcagtgcgtggctttccatcccttg

SEQ ID NO: 141266 - DNA, 35 bp, Artificial Sequence
  Synthetic oligonucleotide
atcgatacctccgcttttcaaaatctgctctcttg

SEQ ID NO: 141267 - DNA, 35 bp, Artificial Sequence
  Synthetic oligonucleotide
ggtctcactcctggtccacattggcaatcaccaat

SEQ ID NO: 141268 - DNA, 35 bp, Artificial Sequence
  Synthetic oligonucleotide
gacacctcggtttgtacggctctacctcaccccat

SEQ ID NO: 141269 - DNA, 35 bp, Artificial Sequence
  Synthetic oligonucleotide
acgatccaactgcactatgggctaccaagctccct

SEQ ID NO: 141270 - DNA, 35 bp, Artificial Sequence
  Synthetic oligonucleotide
gcactgcccgcatcccgtcccggaacgaattccct

SEQ ID NO: 141271 - DNA, 35 bp, Artificial Sequence
  Synthetic oligonucleotide
tttgccccctcttgatccatagttaacatgctgct

SEQ ID NO: 141272 - DNA, 35 bp, Artificial Sequence
  Synthetic oligonucleotide
tcgcctgccggactgcgctttaccaccttcaccgt

SEQ ID NO: 141273 - DNA, 35 bp, Artificial Sequence
  Synthetic oligonucleotide
ggttcgagtcacttagcatgcaccactcctcctgt

SEQ ID NO: 141274 - DNA, 35 bp, Artificial Sequence
  Synthetic oligonucleotide
gtcacccctcagataccttatgcgtccatgccctt

SEQ ID NO: 141275 - DNA, 35 bp, Artificial Sequence
  Synthetic oligonucleotide
atccagccgctgacgttccccactgcccatccgtt

SEQ ID NO: 141276 - DNA, 36 bp, Artificial Sequence
  Synthetic oligonucleotide
aacggggggtgggcaaggggaatgcaaaggggataa

SEQ ID NO: 141277 - DNA, 36 bp, Artificial Sequence
  Synthetic oligonucleotide
taggatgacgccgccgcaccaactgccctgctttaa

SEQ ID NO: 141278 - DNA, 36 bp, Artificial Sequence
  Synthetic oligonucleotide
tcgcaccctcctacttttgctatttgcccatgcaca

SEQ ID NO: 141279 - DNA, 36 bp, Artificial Sequence
  Synthetic oligonucleotide
gctgcctccgccattagttgtccctatcagctcaca

SEQ ID NO: 141280 - DNA, 35 bp, Artificial Sequence
  Synthetic oligonucleotide
tgtggccgagcctctgttccgtcaacatcccgcca

SEQ ID NO: 141281 - DNA, 35 bp, Artificial Sequence
  Synthetic oligonucleotide
gccgcacccctctgacgaaccgttccagctatgca

SEQ ID NO: 141282 - DNA, 36 bp, Artificial Sequence
  Synthetic oligonucleotide
gactcgcactgaccttgcattggccaacatccatca

SEQ ID NO: 141283 - DNA, 36 bp, Artificial Sequence
  Synthetic oligonucleotide
acatcccacccgcccacttgttatgcccatctacga

SEQ ID NO: 141284 - DNA, 37 bp, Artificial Sequence
  Synthetic oligonucleotide
gtatgccctcgccctgacaagaattcgctccacccga

SEQ ID NO: 141285 - DNA, 36 bp, Artificial Sequence
  Synthetic oligonucleotide
tagcgcaggttaggaagggcggaggagttgagcgga

SEQ ID NO: 141286 - DNA, 37 bp, Artificial Sequence
  Synthetic oligonucleotide
ggataggggtaatggacaagggtggacggacggggga

SEQ ID NO: 141287 - DNA, 37 bp, Artificial Sequence
  Synthetic oligonucleotide
tgtgaacgaggagagggacagtgggagacggtatgga

SEQ ID NO: 141288 - DNA, 37 bp, Artificial Sequence
  Synthetic oligonucleotide
tgccgggcgtacacatgtccattcaccgccaccctga

SEQ ID NO: 141289 - DNA, 37 bp, Artificial Sequence
  Synthetic oligonucleotide
gccccgctcacctccgtattgtttatccaccgcgtga

SEQ ID NO: 141290 - DNA, 37 bp, Artificial Sequence
  Synthetic oligonucleotide
atccataccaccgccaccgttattgccactgacttga

SEQ ID NO: 141291 - DNA, 37 bp, Artificial Sequence
  Synthetic oligonucleotide
agccgcccgcgcaccatctctagggcacactgcttga

SEQ ID NO: 141292 - DNA, 37 bp, Artificial Sequence
  Synthetic oligonucleotide
tccactgtcagctgctcggactccctccttctcttga

SEQ ID NO: 141293 - DNA, 37 bp, Artificial Sequence
  Synthetic oligonucleotide
tcatccatcgtgggtggggtggggcacgggaatttga

SEQ ID NO: 141294 - DNA, 36 bp, Artificial Sequence
  Synthetic oligonucleotide
gatcaaacggagaggcgggcgggaacgtgggtgata

SEQ ID NO: 141295 - DNA, 36 bp, Artificial Sequence
  Synthetic oligonucleotide
gacttaccgccccgccttcatccgcacttgtacgta

SEQ ID NO: 141296 - DNA, 36 bp, Artificial Sequence
  Synthetic oligonucleotide
gcctactgttcacctttctgcgcctgtgccccggta

SEQ ID NO: 141297 - DNA, 35 bp, Artificial Sequence
  Synthetic oligonucleotide
agccaccatgatccggacgtgacgctaccttcccc

SEQ ID NO: 141298 - DNA, 35 bp, Artificial Sequence
  Synthetic oligonucleotide
atatccccaaccagcgcctcccctcacgctttgcc

SEQ ID NO: 141299 - DNA, 35 bp, Artificial Sequence
  Synthetic oligonucleotide
gagcatgctatgcgaacgtcctaccatccccgtcc

SEQ ID NO: 141300 - DNA, 35 bp, Artificial Sequence
  Synthetic oligonucleotide
tagctccaccatgcttccacgatagcccccatagc

SEQ ID NO: 141301 - DNA, 35 bp, Artificial Sequence
  Synthetic oligonucleotide
tcctacacaccaccatatgcccaccgccttatagc

SEQ ID NO: 141302 - DNA, 34 bp, Artificial Sequence
  Synthetic oligonucleotide
ttacctccacagttgactactactctggttccgc

SEQ ID NO: 141303 - DNA, 35 bp, Artificial Sequence
  Synthetic oligonucleotide
gcttcccacaattacctcccagcgtttcttctcgc

SEQ ID NO: 141304 - DNA, 35 bp, Artificial Sequence
  Synthetic oligonucleotide
gtcgaccccatccaatcaaagcagtcttgccttgc

SEQ ID NO: 141305 - DNA, 35 bp, Artificial Sequence
  Synthetic oligonucleotide
tccaggtcgatacctgtacctccccgtgtcttatc

SEQ ID NO: 141306 - DNA, 35 bp, Artificial Sequence
  Synthetic oligonucleotide
gctcaaccccagctggttcatttaagttctacctc

SEQ ID NO: 141307 - DNA, 35 bp, Artificial Sequence
  Synthetic oligonucleotide
acggacaccgacaacctctgctactatactcgccg

SEQ ID NO: 141308 - DNA, 35 bp, Artificial Sequence
  Synthetic oligonucleotide
tcacgtgcggatcctgcctcgtctttgtttctccg

SEQ ID NO: 141309 - DNA, 35 bp, Artificial Sequence
  Synthetic oligonucleotide
gtccacgacaggaccatggccaccctctacgttcg

SEQ ID NO: 141310 - DNA, 35 bp, Artificial Sequence
  Synthetic oligonucleotide
gaccaacgtcggtttggacacgtgggaggggaggg

SEQ ID NO: 141311 - DNA, 35 bp, Artificial Sequence
  Synthetic oligonucleotide
taccggcccttctcccccatgccaatcgcaccttg

SEQ ID NO: 141312 - DNA, 35 bp, Artificial Sequence
  Synthetic oligonucleotide
tcccctgacctccctgactcaagaagcttacccat

SEQ ID NO: 141313 - DNA, 35 bp, Artificial Sequence
  Synthetic oligonucleotide
tgtgtgcgagggtggtgtgggtgcgggaatgtgat

SEQ ID NO: 141314 - DNA, 35 bp, Artificial Sequence
  Synthetic oligonucleotide
gtggtgcaccctcctcgcgtacgaagcctgcacct

SEQ ID NO: 141315 - DNA, 35 bp, Artificial Sequence
  Synthetic oligonucleotide
tgaccccgtagcgttagttatctgtcacctttcct

SEQ ID NO: 141316 - DNA, 35 bp, Artificial Sequence
  Synthetic oligonucleotide
aacagctgatgtggcattcccgccccctgttttct

SEQ ID NO: 141317 - DNA, 35 bp, Artificial Sequence
  Synthetic oligonucleotide
ccacgcccgtagccgttgaccacctcccatcatgt

SEQ ID NO: 141318 - DNA, 35 bp, Artificial Sequence
  Synthetic oligonucleotide
gagccactcgccccatcacctttcccagagcactt

SEQ ID NO: 141319 - DNA, 35 bp, Artificial Sequence
  Synthetic oligonucleotide
ggggggccgacacacgccgcttgttgaccttcctt

SEQ ID NO: 141320 - DNA, 36 bp, Artificial Sequence
  Synthetic oligonucleotide
gcccgccgctagctgctcctatcttgccgcacccaa

SEQ ID NO: 141321 - DNA, 36 bp, Artificial Sequence
  Synthetic oligonucleotide
gcgatccgtcgcacccctccacctttgcctgacgaa

SEQ ID NO: 141322 - DNA, 35 bp, Artificial Sequence
  Synthetic oligonucleotide
agtcaaccacaaagcccctcccctcgccgctccca

SEQ ID NO: 141323 - DNA, 36 bp, Artificial Sequence
  Synthetic oligonucleotide
tgagtgaggcgggagctggtggagagggaacgggca

SEQ ID NO: 141324 - DNA, 36 bp, Artificial Sequence
  Synthetic oligonucleotide
tacgagggaagatcaggggggtttgcgggggtggca

SEQ ID NO: 141325 - DNA, 35 bp, Artificial Sequence
  Synthetic oligonucleotide
agactgcccccggtgacaccgtaactgacctctca

SEQ ID NO: 141326 - DNA, 36 bp, Artificial Sequence
  Synthetic oligonucleotide
tcaggtcctgtatcgttacccccgttcctttcgtca

SEQ ID NO: 141327 - DNA, 35 bp, Artificial Sequence
  Synthetic oligonucleotide
atcgtataccgcctgccccaatgagtcccctttca

SEQ ID NO: 141328 - DNA, 37 bp, Artificial Sequence
  Synthetic oligonucleotide
atgcgctaccatctgtttgctttccctccccgcgaga

SEQ ID NO: 141329 - DNA, 33 bp, Artificial Sequence
  Synthetic oligonucleotide
gaccccctctatcttgtacgccctctcacacga

SEQ ID NO: 141330 - DNA, 37 bp, Artificial Sequence
  Synthetic oligonucleotide
ttggtcctcatcactgccgcatattatctgctcccga

SEQ ID NO: 141331 - DNA, 37 bp, Artificial Sequence
  Synthetic oligonucleotide
ggtgcatacgcccgacctctctccgtaccgtcgccga

SEQ ID NO: 141332 - DNA, 35 bp, Artificial Sequence
  Synthetic oligonucleotide
tccacggtctcgccctacccttacgtatattccga

SEQ ID NO: 141333 - DNA, 37 bp, Artificial Sequence
  Synthetic oligonucleotide
tgcggggtagggaggtggggggaggaaactcaggcga

SEQ ID NO: 141334 - DNA, 38 bp, Artificial Sequence
  Synthetic oligonucleotide
acacgggcccatcgttgctcgcctccaccctgacttga

SEQ ID NO: 141335 - DNA, 37 bp, Artificial Sequence
  Synthetic oligonucleotide
tgccaccctcatggcgcgtactcttctctttacttga

SEQ ID NO: 141336 - DNA, 36 bp, Artificial Sequence
  Synthetic oligonucleotide
gtgggcgggtgggaaattaaaggtcatcggggacta

SEQ ID NO: 141337 - DNA, 36 bp, Artificial Sequence
  Synthetic oligonucleotide
tagtcccaccccacaccctgtacgggagcccactta

SEQ ID NO: 141338 - DNA, 35 bp, Artificial Sequence
  Synthetic oligonucleotide
gtacccggccgcatctggtcctccgcgctctccac

SEQ ID NO: 141339 - DNA, 35 bp, Artificial Sequence
  Synthetic oligonucleotide
tttcgcccctctgtccagctgtagctccattatac

SEQ ID NO: 141340 - DNA, 35 bp, Artificial Sequence
  Synthetic oligonucleotide
gcaccaccctgccatttaatacagtttccatttac

SEQ ID NO: 141341 - DNA, 35 bp, Artificial Sequence
  Synthetic oligonucleotide
tgcccatgccgattgggccacctcttgttcgaacc

SEQ ID NO: 141342 - DNA, 35 bp, Artificial Sequence
  Synthetic oligonucleotide
tgccatgacaacaggctactgctgacaccgccccc

SEQ ID NO: 141343 - DNA, 35 bp, Artificial Sequence
  Synthetic oligonucleotide
acgcgcctccgcaagcgggttatctccgtgccccc

SEQ ID NO: 141344 - DNA, 35 bp, Artificial Sequence
  Synthetic oligonucleotide
atggtcaccactccgacgggcagactttgctcccc

SEQ ID NO: 141345 - DNA, 35 bp, Artificial Sequence
  Synthetic oligonucleotide
gaaacccccgtcgttctatcgctgaattgtcgccc

SEQ ID NO: 141346 - DNA, 35 bp, Artificial Sequence
  Synthetic oligonucleotide
gtggggaaggggggcagtaatcaagcgagggacgc

SEQ ID NO: 141347 - DNA, 35 bp, Artificial Sequence
  Synthetic oligonucleotide
aaacgaggggcaaagtggtagtatgggggatgggc

SEQ ID NO: 141348 - DNA, 35 bp, Artificial Sequence
  Synthetic oligonucleotide
tcagatggtcagtcgatccttatacgtacccctgc

SEQ ID NO: 141349 - DNA, 35 bp, Artificial Sequence
  Synthetic oligonucleotide
tgcaatcgcgggcctcgtcaaaccgtccacctatc

SEQ ID NO: 141350 - DNA, 35 bp, Artificial Sequence
  Synthetic oligonucleotide
gtagcggcccgcaatggtatcctttctccccactc

SEQ ID NO: 141351 - DNA, 35 bp, Artificial Sequence
  Synthetic oligonucleotide
attcaccctccattatatgaccatgggttcttctc

SEQ ID NO: 141352 - DNA, 35 bp, Artificial Sequence
  Synthetic oligonucleotide
tgacgaacggtcgcttgaacctgcccattatcttc

SEQ ID NO: 141353 - DNA, 35 bp, Artificial Sequence
  Synthetic oligonucleotide
gctctacctcagtgagcaccgcttatgcccctttc

SEQ ID NO: 141354 - DNA, 34 bp, Artificial Sequence
  Synthetic oligonucleotide
actctcacctccccacccgacaatagtcgccgag

SEQ ID NO: 141355 - DNA, 35 bp, Artificial Sequence
  Synthetic oligonucleotide
accacaccgttaaatatcttccgtccctctcctgg

SEQ ID NO: 141356 - DNA, 35 bp, Artificial Sequence
  Synthetic oligonucleotide
gttccaccgccctcacagtcccgaagacgggatat

SEQ ID NO: 141357 - DNA, 35 bp, Artificial Sequence
  Synthetic oligonucleotide
acctcctgagattgtgatcccttgcactcccttat

SEQ ID NO: 141358 - DNA, 35 bp, Artificial Sequence
  Synthetic oligonucleotide
acacgttcgtatgtaccttgcgccgttaactccct

SEQ ID NO: 141359 - DNA, 35 bp, Artificial Sequence
  Synthetic oligonucleotide
gtgtcggacgtttcatcgttttatattcgttccct

SEQ ID NO: 141360 - DNA, 35 bp, Artificial Sequence
  Synthetic oligonucleotide
gaagcaggtgcctgccatgcaaataacccccctct

SEQ ID NO: 141361 - DNA, 35 bp, Artificial Sequence
  Synthetic oligonucleotide
tacgcgtacctgccactcgccatgacttccgctct

SEQ ID NO: 141362 - DNA, 36 bp, Artificial Sequence
  Synthetic oligonucleotide
gatccctcgtatcgttgtagacccaccctcacccaa

SEQ ID NO: 141363 - DNA, 35 bp, Artificial Sequence
  Synthetic oligonucleotide
gcgcgcacacatgtctcggaccgccccacccgcaa

SEQ ID NO: 141364 - DNA, 36 bp, Artificial Sequence
  Synthetic oligonucleotide
tcatccctcttctggccacctatactatggcgccca

SEQ ID NO: 141365 - DNA, 36 bp, Artificial Sequence
  Synthetic oligonucleotide
acgtgagcctatccccgtcgtctgaatctcgctcca

SEQ ID NO: 141366 - DNA, 35 bp, Artificial Sequence
  Synthetic oligonucleotide
tgaactgcccccaatccgaatggaccttctttgca

SEQ ID NO: 141367 - DNA, 36 bp, Artificial Sequence
  Synthetic oligonucleotide
acccccaccctctgccgcgggactcttccagtctca

SEQ ID NO: 141368 - DNA, 36 bp, Artificial Sequence
  Synthetic oligonucleotide
accacctcgtactcgaagcccatttgatcctggtca

SEQ ID NO: 141369 - DNA, 37 bp, Artificial Sequence
  Synthetic oligonucleotide
atggctcagctgcctttgccgtccatccttaccccga

SEQ ID NO: 141370 - DNA, 37 bp, Artificial Sequence
  Synthetic oligonucleotide
aaatcccacccccagtcgtatcgtatgtcacccccga

SEQ ID NO: 141371 - DNA, 37 bp, Artificial Sequence
  Synthetic oligonucleotide
gggggtgaaggttcggtacgaaagcggaggggcggga

SEQ ID NO: 141372 - DNA, 35 bp, Artificial Sequence
  Synthetic oligonucleotide
tgcgccctcgagcccctcctccgtactcacactga

SEQ ID NO: 141373 - DNA, 36 bp, Artificial Sequence
  Synthetic oligonucleotide
gagccgcacacacccggtccgactcccaacccctga

SEQ ID NO: 141374 - DNA, 35 bp, Artificial Sequence
  Synthetic oligonucleotide
accgcaatcaccatctacattagcaccactcctga

SEQ ID NO: 141375 - DNA, 36 bp, Artificial Sequence
  Synthetic oligonucleotide
cacgtaccaccgtggcgtcgagacctctgccttcta

SEQ ID NO: 141376 - DNA, 35 bp, Artificial Sequence
  Synthetic oligonucleotide
tccaccctccgagtccctgttcttaggctgaagta

SEQ ID NO: 141377 - DNA, 35 bp, Artificial Sequence
  Synthetic oligonucleotide
gctcaggcccctgactctccgtacttgataacaac

SEQ ID NO: 141378 - DNA, 35 bp, Artificial Sequence
  Synthetic oligonucleotide
agcaaatcatcgcgtacagctccctatccatctac

SEQ ID NO: 141379 - DNA, 35 bp, Artificial Sequence
  Synthetic oligonucleotide
gctacaccgcgtagtcaggtggtccttctgccccc

SEQ ID NO: 141380 - DNA, 35 bp, Artificial Sequence
  Synthetic oligonucleotide
gtgcgatacgttgccctctcggtttttgccttgcc

SEQ ID NO: 141381 - DNA, 35 bp, Artificial Sequence
  Synthetic oligonucleotide
tcccaccacgccccgatcgtcacacctccatagtc

SEQ ID NO: 141382 - DNA, 35 bp, Artificial Sequence
  Synthetic oligonucleotide
acaatgcacgcctccctctagttttccttaatgtc

SEQ ID NO: 141383 - DNA, 35 bp, Artificial Sequence
  Synthetic oligonucleotide
gatgcacgcccgttatccacctctccgttacctgg

SEQ ID NO: 141384 - DNA, 35 bp, Artificial Sequence
  Synthetic oligonucleotide
tcctagcctgcccaccagtccacggatccctcctg

SEQ ID NO: 141385 - DNA, 35 bp, Artificial Sequence
  Synthetic oligonucleotide
accctcccggaccagtctctgcatccgtcctcact

SEQ ID NO: 141386 - DNA, 35 bp, Artificial Sequence
  Synthetic oligonucleotide
tctgatcctcctacccgtaccgacaggctgactct

SEQ ID NO: 141387 - DNA, 35 bp, Artificial Sequence
  Synthetic oligonucleotide
gatgcccctcctgtatgtctttcgtcacctgttct

SEQ ID NO: 141388 - DNA, 35 bp, Artificial Sequence
  Synthetic oligonucleotide
tttgcgactgtagctgctttcgttacttctctcgt

SEQ ID NO: 141389 - DNA, 35 bp, Artificial Sequence
  Synthetic oligonucleotide
tgcacctcctgtacgcctaccacttgccctagatt

SEQ ID NO: 141390 - DNA, 36 bp, Artificial Sequence
  Synthetic oligonucleotide
tcgaatggtcatctgtgtgctcccctcctcgcccca

SEQ ID NO: 141391 - DNA, 36 bp, Artificial Sequence
  Synthetic oligonucleotide
tagatgggcggggaccgaagcggagggatgggggca

SEQ ID NO: 141392 - DNA, 36 bp, Artificial Sequence
  Synthetic oligonucleotide
tgcaccccacccctgccctccgttttagcaatttca

SEQ ID NO: 141393 - DNA, 37 bp, Artificial Sequence
  Synthetic oligonucleotide
tcgccgccaccgctgctcccctacgtcctagaccaga

SEQ ID NO: 141394 - DNA, 36 bp, Artificial Sequence
  Synthetic oligonucleotide
tccgtcgttcccgccgccctgttcgtattctttaga

SEQ ID NO: 141395 - DNA, 37 bp, Artificial Sequence
  Synthetic oligonucleotide
tgtcgcggcgccccatctccgctctgtcccgtgccga

SEQ ID NO: 141396 - DNA, 37 bp, Artificial Sequence
  Synthetic oligonucleotide
tcgtacctcccgacactctattgtttttggccctcga

SEQ ID NO: 141397 - DNA, 36 bp, Artificial Sequence
  Synthetic oligonucleotide
tccacggcggaggtggggcggcattttcaggacgga

SEQ ID NO: 141398 - DNA, 35 bp, Artificial Sequence
  Synthetic oligonucleotide
gttggtctcccctccgcctttacgcattctgcgga

SEQ ID NO: 141399 - DNA, 37 bp, Artificial Sequence
  Synthetic oligonucleotide
agactgggggaaggggtaacgtggagcgggcgcggga

SEQ ID NO: 141400 - DNA, 37 bp, Artificial Sequence
  Synthetic oligonucleotide
gactgaggaggagagcggtttgaaggggtcaagggga

SEQ ID NO: 141401 - DNA, 37 bp, Artificial Sequence
  Synthetic oligonucleotide
attatgaggcgaaggtgggcggagtaggcggagggga

SEQ ID NO: 141402 - DNA, 38 bp, Artificial Sequence
  Synthetic oligonucleotide
tgtcgcacgcgctatgtttaccacttccaccttcctga

SEQ ID NO: 141403 - DNA, 37 bp, Artificial Sequence
  Synthetic oligonucleotide
tgatcgggggggccgagggggaaagaatgcggggtga

SEQ ID NO: 141404 - DNA, 38 bp, Artificial Sequence
  Synthetic oligonucleotide
gccttacgctcggtaggtcgttccatccgccttgttga

SEQ ID NO: 141405 - DNA, 38 bp, Artificial Sequence
  Synthetic oligonucleotide
tatccatctgccactgttccccgttaacacgcctttga

SEQ ID NO: 141406 - DNA, 36 bp, Artificial Sequence
  Synthetic oligonucleotide
gcacacagcgccgcccgatccctctcgtattacgta

SEQ ID NO: 141407 - DNA, 36 bp, Artificial Sequence
  Synthetic oligonucleotide
gtggaccctccccactgtgcgtaatttctcctcgta

SEQ ID NO: 141408 - DNA, 35 bp, Artificial Sequence
  Synthetic oligonucleotide
ttcgagccgcacacccgaggcgtaacccgtaccac

SEQ ID NO: 141409 - DNA, 35 bp, Artificial Sequence
  Synthetic oligonucleotide
agacaacaagctgtcgacccctgcgcgcactcccc

SEQ ID NO: 141410 - DNA, 35 bp, Artificial Sequence
  Synthetic oligonucleotide
tgcaccaatccaacacttctctcgcctgcccagcc

SEQ ID NO: 141411 - DNA, 35 bp, Artificial Sequence
  Synthetic oligonucleotide
tcaccctccctctgtctttagctgcgcgctttgcc

SEQ ID NO: 141412 - DNA, 35 bp, Artificial Sequence
  Synthetic oligonucleotide
tccacgatcagatccgctccacacttctcctcagc

SEQ ID NO: 141413 - DNA, 35 bp, Artificial Sequence
  Synthetic oligonucleotide
gggggccacgagtctttctgcttcacgttcttcgc

SEQ ID NO: 141414 - DNA, 35 bp, Artificial Sequence
  Synthetic oligonucleotide
gactcccgctgctgagtccctatccctgtttttgc

SEQ ID NO: 141415 - DNA, 35 bp, Artificial Sequence
  Synthetic oligonucleotide
taggcaatcagttcggtccttgctccccccgcatc

SEQ ID NO: 141416 - DNA, 35 bp, Artificial Sequence
  Synthetic oligonucleotide
gacaacatatcttgcccgtgtttgcctccaccttc

SEQ ID NO: 141417 - DNA, 35 bp, Artificial Sequence
  Synthetic oligonucleotide
tgcggctcacaaacctgttcactgccactaccccg

SEQ ID NO: 141418 - DNA, 35 bp, Artificial Sequence
  Synthetic oligonucleotide
gccccccttgcacccacgtctacaccttgttctgg

SEQ ID NO: 141419 - DNA, 35 bp, Artificial Sequence
  Synthetic oligonucleotide
aatccctgcccgccccatattgcatagtatgcatg

SEQ ID NO: 141420 - DNA, 35 bp, Artificial Sequence
  Synthetic oligonucleotide
ttgcacacgccataggtcactcgccactttccctg

SEQ ID NO: 141421 - DNA, 35 bp, Artificial Sequence
  Synthetic oligonucleotide
agccccctcccctccgtcccacactgtatccgctg

SEQ ID NO: 141422 - DNA, 35 bp, Artificial Sequence
  Synthetic oligonucleotide
ggggccgttcatttgccagcgccttcccttacact

SEQ ID NO: 141423 - DNA, 34 bp, Artificial Sequence
  Synthetic oligonucleotide
aattcgccttcccatgtatgcttagttcgccact

SEQ ID NO: 141424 - DNA, 35 bp, Artificial Sequence
  Synthetic oligonucleotide
tctaagcgccgcggttcgagcgcccacatccccct

SEQ ID NO: 141425 - DNA, 35 bp, Artificial Sequence
  Synthetic oligonucleotide
gtcatggacaccgcccgccttaacattatcgccct

SEQ ID NO: 141426 - DNA, 35 bp, Artificial Sequence
  Synthetic oligonucleotide
tgtacctacctcttccgtgctggccttagttccct

SEQ ID NO: 141427 - DNA, 35 bp, Artificial Sequence
  Synthetic oligonucleotide
gccaccttcgacgcctgctgccatgtccccgtgtt

SEQ ID NO: 141428 - DNA, 36 bp, Artificial Sequence
  Synthetic oligonucleotide
gttgcacaaatcgtgcggttctatctgtcgctccca

SEQ ID NO: 141429 - DNA, 36 bp, Artificial Sequence
  Synthetic oligonucleotide
gctgtacgtctgaactaccctctgcctgtctttcca

SEQ ID NO: 141430 - DNA, 36 bp, Artificial Sequence
  Synthetic oligonucleotide
gttgccccgcccctggaaactcacacagtatttgca

SEQ ID NO: 141431 - DNA, 35 bp, Artificial Sequence
  Synthetic oligonucleotide
tgcatcccactcgactggacgtccgcttaccctca

SEQ ID NO: 141432 - DNA, 35 bp, Artificial Sequence
  Synthetic oligonucleotide
gacgagaagaaaagtggaagatggggggctgatga

SEQ ID NO: 141433 - DNA, 38 bp, Artificial Sequence
  Synthetic oligonucleotide
ttacccgcccgctccctcttacgtgacgtccaacctga

SEQ ID NO: 141434 - DNA, 35 bp, Artificial Sequence
  Synthetic oligonucleotide
gatgggcgtggaagggtgggggattaattaggtga

SEQ ID NO: 141435 - DNA, 37 bp, Artificial Sequence
  Synthetic oligonucleotide
tcccgccgccgtatcatcctctccgttagtcgcttga

SEQ ID NO: 141436 - DNA, 36 bp, Artificial Sequence
  Synthetic oligonucleotide
gttgcagcccccgctctgtgcttttacctgctacta

SEQ ID NO: 141437 - DNA, 36 bp, Artificial Sequence
  Synthetic oligonucleotide
tccaccaaccgattcctcccgccagtccgcttggta

SEQ ID NO: 141438 - DNA, 35 bp, Artificial Sequence
  Synthetic oligonucleotide
tcaccgtcgctcgactcaatgcctccatctcctta

SEQ ID NO: 141439 - DNA, 35 bp, Artificial Sequence
  Synthetic oligonucleotide
gcctgcatacccagttctaagtctcccttgtccac

SEQ ID NO: 141440 - DNA, 35 bp, Artificial Sequence
  Synthetic oligonucleotide
tcgccgccgagccattgcgtcacatacctacctac

SEQ ID NO: 141441 - DNA, 35 bp, Artificial Sequence
  Synthetic oligonucleotide
gtgctcctcctccgatggaacatcataattgcccc

SEQ ID NO: 141442 - DNA, 35 bp, Artificial Sequence
  Synthetic oligonucleotide
ttcgctgcctccacttctccgccgccccagctgcc

SEQ ID NO: 141443 - DNA, 35 bp, Artificial Sequence
  Synthetic oligonucleotide
gatgcaacttacatctttctctctggtctattgcc

SEQ ID NO: 141444 - DNA, 35 bp, Artificial Sequence
  Synthetic oligonucleotide
attgccctatgcccttcgacttggacctccgctcc

SEQ ID NO: 141445 - DNA, 35 bp, Artificial Sequence
  Synthetic oligonucleotide
acgcccgataccctgcctggccatagaccctctcc

SEQ ID NO: 141446 - DNA, 35 bp, Artificial Sequence
  Synthetic oligonucleotide
accacgtatgcctcttgccgaccggtactctctcc

SEQ ID NO: 141447 - DNA, 32 bp, Artificial Sequence
  Synthetic oligonucleotide
accagtccatttgctctgtcaccatttccgtc

SEQ ID NO: 141448 - DNA, 35 bp, Artificial Sequence
  Synthetic oligonucleotide
tccacccgtacctttttcctccagtctttggggtc

SEQ ID NO: 141449 - DNA, 35 bp, Artificial Sequence
  Synthetic oligonucleotide
ttgagatggcctcatcgtgtgctcccgctatcttc

SEQ ID NO: 141450 - DNA, 35 bp, Artificial Sequence
  Synthetic oligonucleotide
tggtactgcatctcccttcttcccagcctctgttc

SEQ ID NO: 141451 - DNA, 35 bp, Artificial Sequence
  Synthetic oligonucleotide
gacgacatccgccatgtacccgtctcttgtctttc

SEQ ID NO: 141452 - DNA, 35 bp, Artificial Sequence
  Synthetic oligonucleotide
ggagccctcacgttgaccaattcgccatcactccg

SEQ ID NO: 141453 - DNA, 35 bp, Artificial Sequence
  Synthetic oligonucleotide
tcccgacccggtgccgggctattgagccttcccat

SEQ ID NO: 141454 - DNA, 35 bp, Artificial Sequence
  Synthetic oligonucleotide
tacaccgtcctttgcttactccatttggcacctat

SEQ ID NO: 141455 - DNA, 35 bp, Artificial Sequence
  Synthetic oligonucleotide
tgctgccccccgcctggctaagttgccgtatctat

SEQ ID NO: 141456 - DNA, 35 bp, Artificial Sequence
  Synthetic oligonucleotide
gagatcacccatcgtgtgccatagtttacacccct

SEQ ID NO: 141457 - DNA, 35 bp, Artificial Sequence
  Synthetic oligonucleotide
tgctgccttcgctctccctcagaacggccgcccct

SEQ ID NO: 141458 - DNA, 35 bp, Artificial Sequence
  Synthetic oligonucleotide
gagggtccgctgattcccgtaatgttcaccgccct

SEQ ID NO: 141459 - DNA, 35 bp, Artificial Sequence
  Synthetic oligonucleotide
gcacacacaccccgacttggccgcattccgcttct

SEQ ID NO: 141460 - DNA, 35 bp, Artificial Sequence
  Synthetic oligonucleotide
gcccgcccccctgggccgcgtcctgtctcgcttct

SEQ ID NO: 141461 - DNA, 35 bp, Artificial Sequence
  Synthetic oligonucleotide
gtagggggatcggagaagggaagggggaaccgcgt

SEQ ID NO: 141462 - DNA, 35 bp, Artificial Sequence
  Synthetic oligonucleotide
tgccatcctgtggagttccctagccccccttatgt

SEQ ID NO: 141463 - DNA, 34 bp, Artificial Sequence
  Synthetic oligonucleotide
actgccgtaccctcgaccgttacgtaccccttgt

SEQ ID NO: 141464 - DNA, 35 bp, Artificial Sequence
  Synthetic oligonucleotide
tagcagtgctcactcgtcttttcaatgtcttcctt

SEQ ID NO: 141465 - DNA, 36 bp, Artificial Sequence
  Synthetic oligonucleotide
ttccacggcggatggtggggtcggacggtggagaaa

SEQ ID NO: 141466 - DNA, 35 bp, Artificial Sequence
  Synthetic oligonucleotide
tgcttactcgccctgccttccgccactactgagaa

SEQ ID NO: 141467 - DNA, 36 bp, Artificial Sequence
  Synthetic oligonucleotide
gtgggtgccccccatgctgtctaccaccttatcgaa

SEQ ID NO: 141468 - DNA, 35 bp, Artificial Sequence
  Synthetic oligonucleotide
gacttccgctcctccgccaattagggccgcataca

SEQ ID NO: 141469 - DNA, 35 bp, Artificial Sequence
  Synthetic oligonucleotide
gcaccccctggttgccgccgttgtatcatctccca

SEQ ID NO: 141470 - DNA, 36 bp, Artificial Sequence
  Synthetic oligonucleotide
tccagcgtacgctctgaacctaggccacttcttcca

SEQ ID NO: 141471 - DNA, 36 bp, Artificial Sequence
  Synthetic oligonucleotide
gagtactagcgccccagttgctctgttcctccttca

SEQ ID NO: 141472 - DNA, 37 bp, Artificial Sequence
  Synthetic oligonucleotide
gtaggaaagagggagtgggggggacggctacgaagga

SEQ ID NO: 141473 - DNA, 37 bp, Artificial Sequence
  Synthetic oligonucleotide
gatgtgaacggggggatgcagacagggaggggcagga

SEQ ID NO: 141474 - DNA, 37 bp, Artificial Sequence
  Synthetic oligonucleotide
gtagcaagacgaggagggggggcaagcggaaaatgga

SEQ ID NO: 141475 - DNA, 38 bp, Artificial Sequence
  Synthetic oligonucleotide
gtggaggcgagcagtagaacgaggggggaagcgaatga

SEQ ID NO: 141476 - DNA, 38 bp, Artificial Sequence
  Synthetic oligonucleotide
gcccccccgtcaccaaattaccgagcaccccgccctga

SEQ ID NO: 141477 - DNA, 38 bp, Artificial Sequence
  Synthetic oligonucleotide
tacaggactaggtggagggcaacgggcggaaggggtga

SEQ ID NO: 141478 - DNA, 36 bp, Artificial Sequence
  Synthetic oligonucleotide
acgaaccgcctcctcgggtgaagcctcaccttccta

SEQ ID NO: 141479 - DNA, 37 bp, Artificial Sequence
  Synthetic oligonucleotide
ttgtcaccgccgccgcatagccgatcttaggttccta

SEQ ID NO: 141480 - DNA, 35 bp, Artificial Sequence
  Synthetic oligonucleotide
gttgagcgattgccccttctgttcgtgctccgcac

SEQ ID NO: 141481 - DNA, 35 bp, Artificial Sequence
  Synthetic oligonucleotide
atgccacaatcacactatccagacccgcctctcac

SEQ ID NO: 141482 - DNA, 35 bp, Artificial Sequence
  Synthetic oligonucleotide
accctccgctcaccggtgcacctccgctcccgtac

SEQ ID NO: 141483 - DNA, 35 bp, Artificial Sequence
  Synthetic oligonucleotide
atccattcgagcaagtgtaacacgcccgtcgcccc

SEQ ID NO: 141484 - DNA, 35 bp, Artificial Sequence
  Synthetic oligonucleotide
gccgttcgggctcgttcttcaagttctgtcatccc

SEQ ID NO: 141485 - DNA, 35 bp, Artificial Sequence
  Synthetic oligonucleotide
gcctgcccactctaagttccttgtactcttctccc

SEQ ID NO: 141486 - DNA, 35 bp, Artificial Sequence
  Synthetic oligonucleotide
tacactgtcgtattccgaacgcccgcccctgctcc

SEQ ID NO: 141487 - DNA, 35 bp, Artificial Sequence
  Synthetic oligonucleotide
acacatctacctccgcccggatggtcgttccttcc

SEQ ID NO: 141488 - DNA, 35 bp, Artificial Sequence
  Synthetic oligonucleotide
tcttcatccccagatcaccgttcccttgcgctagc

SEQ ID NO: 141489 - DNA, 35 bp, Artificial Sequence
  Synthetic oligonucleotide
ttacacacacgttcgagtggtcatccctgttccgc

SEQ ID NO: 141490 - DNA, 35 bp, Artificial Sequence
  Synthetic oligonucleotide
tctgtcgttccaacctatcttactgcccaccctgc

SEQ ID NO: 141491 - DNA, 35 bp, Artificial Sequence
  Synthetic oligonucleotide
gtgccggatcccgcctcctaccaattcgcttcccg

SEQ ID NO: 141492 - DNA, 35 bp, Artificial Sequence
  Synthetic oligonucleotide
tttgaaggggggcggttgcggatcctggagggagg

SEQ ID NO: 141493 - DNA, 35 bp, Artificial Sequence
  Synthetic oligonucleotide
aactaaagtggaggggtaagcaggagggtgtaggg

SEQ ID NO: 141494 - DNA, 35 bp, Artificial Sequence
  Synthetic oligonucleotide
atcaatggggaggaggcgaaggggggacggatggg

SEQ ID NO: 141495 - DNA, 35 bp, Artificial Sequence
  Synthetic oligonucleotide
gcatccgctcctgacgctctatccctccctcatgg

SEQ ID NO: 141496 - DNA, 34 bp, Artificial Sequence
  Synthetic oligonucleotide
gtgacaccctctgtgttgccctgtcctccctatg

SEQ ID NO: 141497 - DNA, 35 bp, Artificial Sequence
  Synthetic oligonucleotide
acacccagtgtgcccccacttccgcacccgctctg

SEQ ID NO: 141498 - DNA, 35 bp, Artificial Sequence
  Synthetic oligonucleotide
acgccctctccatttgtctctccgggtctccgaat

SEQ ID NO: 141499 - DNA, 35 bp, Artificial Sequence
  Synthetic oligonucleotide
tagggctgagcgagggaggcaatgggggggcgaat

SEQ ID NO: 141500 - DNA, 35 bp, Artificial Sequence
  Synthetic oligonucleotide
actccctccgaagccgccttgagtttgccaccgct

SEQ ID NO: 141501 - DNA, 35 bp, Artificial Sequence
  Synthetic oligonucleotide
gtcggggtgggggtctatgggggactagatggggt

SEQ ID NO: 141502 - DNA, 35 bp, Artificial Sequence
  Synthetic oligonucleotide
tactcatgtcctacctcgccaggctttactcctgt

SEQ ID NO: 141503 - DNA, 35 bp, Artificial Sequence
  Synthetic oligonucleotide
atgtctcccctccgagttcccaatgaccgatctgt

SEQ ID NO: 141504 - DNA, 35 bp, Artificial Sequence
  Synthetic oligonucleotide
acgtaactcctgcttgatatttcactctcctctgt

SEQ ID NO: 141505 - DNA, 35 bp, Artificial Sequence
  Synthetic oligonucleotide
tcttccacctatctggctggttccaattccgtatt

SEQ ID NO: 141506 - DNA, 35 bp, Artificial Sequence
  Synthetic oligonucleotide
ttatctccggcgccggtcgccatacgctccacctt

SEQ ID NO: 141507 - DNA, 35 bp, Artificial Sequence
  Synthetic oligonucleotide
gatcccgcggccggcataacctctaagtcgccctt

SEQ ID NO: 141508 - DNA, 35 bp, Artificial Sequence
  Synthetic oligonucleotide
gccccccgccgtttcgtagtactgcttgccctctt

SEQ ID NO: 141509 - DNA, 35 bp, Artificial Sequence
  Synthetic oligonucleotide
gacaacgacgttcgttgcattgcgcctctatcttt

SEQ ID NO: 141510 - DNA, 36 bp, Artificial Sequence
  Synthetic oligonucleotide
gccacctgtcctgcatttatcctcacgctctctaaa

SEQ ID NO: 141511 - DNA, 36 bp, Artificial Sequence
  Synthetic oligonucleotide
gcaccccgcctgtccgctttacaggactttaacaca

SEQ ID NO: 141512 - DNA, 36 bp, Artificial Sequence
  Synthetic oligonucleotide
tgcatcgtttcgctgtctcgttacttctccatccca

SEQ ID NO: 141513 - DNA, 35 bp, Artificial Sequence
  Synthetic oligonucleotide
tacgccgtcccatgtaactcgcttgccatttctca

SEQ ID NO: 141514 - DNA, 35 bp, Artificial Sequence
  Synthetic oligonucleotide
agtatccgccccactcgtccattctgtcactgtca

SEQ ID NO: 141515 - DNA, 37 bp, Artificial Sequence
  Synthetic oligonucleotide
acacacaccctcgttctcccgcgccgtctccagcaga

SEQ ID NO: 141516 - DNA, 37 bp, Artificial Sequence
  Synthetic oligonucleotide
gttatgcgccataggttacgatccccctcccccgcga

SEQ ID NO: 141517 - DNA, 36 bp, Artificial Sequence
  Synthetic oligonucleotide
gagggatgtgcaccgggtgggggagaatagcaggga

SEQ ID NO: 141518 - DNA, 37 bp, Artificial Sequence
  Synthetic oligonucleotide
gacaacatacccgcttcccgcgccccctccgcactga

SEQ ID NO: 141519 - DNA, 38 bp, Artificial Sequence
  Synthetic oligonucleotide
taaccatcacctcctgttcagggtactgccctccgtga

SEQ ID NO: 141520 - DNA, 38 bp, Artificial Sequence
  Synthetic oligonucleotide
aagtgctggcagtccgggagggaagtcagggagggtga

SEQ ID NO: 141521 - DNA, 37 bp, Artificial Sequence
  Synthetic oligonucleotide
tgaaaggggaaaggtggtgtggggggttagtcgttga

SEQ ID NO: 141522 - DNA, 35 bp, Artificial Sequence
  Synthetic oligonucleotide
gatgtgcgccattgctgtccctctatacacacgta

SEQ ID NO: 141523 - DNA, 35 bp, Artificial Sequence
  Synthetic oligonucleotide
ttccgttgccgcgccttgtctcgtctttaccgcac

SEQ ID NO: 141524 - DNA, 35 bp, Artificial Sequence
  Synthetic oligonucleotide
tgctccacctccatctgtgatggcacttgtgaccc

SEQ ID NO: 141525 - DNA, 35 bp, Artificial Sequence
  Synthetic oligonucleotide
accagtgtccggctcacccctcccggttccatccc

SEQ ID NO: 141526 - DNA, 35 bp, Artificial Sequence
  Synthetic oligonucleotide
gcccaggtcaaccttcgtgaaccgcctaccctccc

SEQ ID NO: 141527 - DNA, 35 bp, Artificial Sequence
  Synthetic oligonucleotide
tcgcccccgtatcctgcacccgcgtatcgttagcc

SEQ ID NO: 141528 - DNA, 35 bp, Artificial Sequence
  Synthetic oligonucleotide
gtgaacacagttgctaatcctcgagtgcccccgcc

SEQ ID NO: 141529 - DNA, 35 bp, Artificial Sequence
  Synthetic oligonucleotide
atcaccaccgtttacttcagcgcaccggccgggcc

SEQ ID NO: 141530 - DNA, 35 bp, Artificial Sequence
  Synthetic oligonucleotide
tccgtcctccgccgtacaccgcgctcgcgtatgcc

SEQ ID NO: 141531 - DNA, 35 bp, Artificial Sequence
  Synthetic oligonucleotide
ttgtctcacagtagtttccctgccccagtttttcc

SEQ ID NO: 141532 - DNA, 35 bp, Artificial Sequence
  Synthetic oligonucleotide
tcaaagcctccttcccacgcgccctgggtcaccgc

SEQ ID NO: 141533 - DNA, 35 bp, Artificial Sequence
  Synthetic oligonucleotide
atgcgagcactccgtgcgttgtttgaccccccctc

SEQ ID NO: 141534 - DNA, 35 bp, Artificial Sequence
  Synthetic oligonucleotide
gcgtggcttccccctggattttacgttggcctctc

SEQ ID NO: 141535 - DNA, 35 bp, Artificial Sequence
  Synthetic oligonucleotide
accacccctgttggatcatatctgatctttaattc

SEQ ID NO: 141536 - DNA, 35 bp, Artificial Sequence
  Synthetic oligonucleotide
acactgcgagggggggggtaggggtcgagtgggag

SEQ ID NO: 141537 - DNA, 35 bp, Artificial Sequence
  Synthetic oligonucleotide
tgatcccgcttcggacgtcaactatcgccctctcg

SEQ ID NO: 141538 - DNA, 35 bp, Artificial Sequence
  Synthetic oligonucleotide
gcgtaagagacgagagggtagggtggggtgtgggg

SEQ ID NO: 141539 - DNA, 35 bp, Artificial Sequence
  Synthetic oligonucleotide
ttgtctccccggtcgttgtgcggctcttactccct

SEQ ID NO: 141540 - DNA, 35 bp, Artificial Sequence
  Synthetic oligonucleotide
accaatgcgcctcggttattgattttgttgccctt

SEQ ID NO: 141541 - DNA, 35 bp, Artificial Sequence
  Synthetic oligonucleotide
gacctacacactgcaagtgacacctgactttcttt

SEQ ID NO: 141542 - DNA, 36 bp, Artificial Sequence
  Synthetic oligonucleotide
gaacgaatgggtaaacgggccgggaggggtagcgaa

SEQ ID NO: 141543 - DNA, 35 bp, Artificial Sequence
  Synthetic oligonucleotide
acccatcatcattactgttatcccctccgcatgaa

SEQ ID NO: 141544 - DNA, 35 bp, Artificial Sequence
  Synthetic oligonucleotide
tcagttgccccccccgttaatgagtgcctgtataa

SEQ ID NO: 141545 - DNA, 31 bp, Artificial Sequence
  Synthetic oligonucleotide
actgggcaacccatacccctgtaactctcca

SEQ ID NO: 141546 - DNA, 36 bp, Artificial Sequence
  Synthetic oligonucleotide
gaacatccgcactgctgttcatttggaaccccatca

SEQ ID NO: 141547 - DNA, 37 bp, Artificial Sequence
  Synthetic oligonucleotide
tccgcacccggtactttagcctgttatccttctccga

SEQ ID NO: 141548 - DNA, 34 bp, Artificial Sequence
  Synthetic oligonucleotide
taaacacgtgggggggggaacaaaggacaaggga

SEQ ID NO: 141549 - DNA, 35 bp, Artificial Sequence
  Synthetic oligonucleotide
tcaccttacgtgccatgccttttccttcacctgga

SEQ ID NO: 141550 - DNA, 37 bp, Artificial Sequence
  Synthetic oligonucleotide
tcagtccgccatccttgcctgcctacgatatccctga

SEQ ID NO: 141551 - DNA, 35 bp, Artificial Sequence
  Synthetic oligonucleotide
gcctgccacacttgcgttcctatccgtttccctta

SEQ ID NO: 141552 - DNA, 36 bp, Artificial Sequence
  Synthetic oligonucleotide
tccccaaccgcttatgctccgcgccgacactgttta

SEQ ID NO: 141553 - DNA, 35 bp, Artificial Sequence
  Synthetic oligonucleotide
tatcccccgcccgagccggttagccaaactgccac

SEQ ID NO: 141554 - DNA, 35 bp, Artificial Sequence
  Synthetic oligonucleotide
tcatcccatctcgccgaatgccatgctaatggacc

SEQ ID NO: 141555 - DNA, 35 bp, Artificial Sequence
  Synthetic oligonucleotide
gaccgcgcctccatctgttgcgctctctctaagcc

SEQ ID NO: 141556 - DNA, 35 bp, Artificial Sequence
  Synthetic oligonucleotide
gcacttgcacactcgatcatgacccccttggcgcc

SEQ ID NO: 141557 - DNA, 35 bp, Artificial Sequence
  Synthetic oligonucleotide
aacagcacacgggtacctgcgcatccatctattcc

SEQ ID NO: 141558 - DNA, 35 bp, Artificial Sequence
  Synthetic oligonucleotide
ggggaagtacgaaggggtgagtacgcgggtggggc

SEQ ID NO: 141559 - DNA, 35 bp, Artificial Sequence
  Synthetic oligonucleotide
ttccatgccctgccgcctgagggttttcgcctctc

SEQ ID NO: 141560 - DNA, 35 bp, Artificial Sequence
  Synthetic oligonucleotide
acatgcgcgctggtcatgccgctccgacccctgtc

SEQ ID NO: 141561 - DNA, 35 bp, Artificial Sequence
  Synthetic oligonucleotide
tctgtcagtctctcgcccgctggtccctgtctccg

SEQ ID NO: 141562 - DNA, 35 bp, Artificial Sequence
  Synthetic oligonucleotide
acacctccgtgcttccccattcttcagccttagcg

SEQ ID NO: 141563 - DNA, 35 bp, Artificial Sequence
  Synthetic oligonucleotide
atggtgcgatgcttattcgttcgttctctgtcctg

SEQ ID NO: 141564 - DNA, 35 bp, Artificial Sequence
  Synthetic oligonucleotide
tccagtctttcaccacttcacttcgcccgctcttg

SEQ ID NO: 141565 - DNA, 35 bp, Artificial Sequence
  Synthetic oligonucleotide
actcgacctccgcctgtttctcccccatatggcct

SEQ ID NO: 141566 - DNA, 35 bp, Artificial Sequence
  Synthetic oligonucleotide
gcccgcgtatgtcttccgctcctggttgttttcct

SEQ ID NO: 141567 - DNA, 35 bp, Artificial Sequence
  Synthetic oligonucleotide
gccatccgcccacttgataacaatcaactctgtct

SEQ ID NO: 141568 - DNA, 35 bp, Artificial Sequence
  Synthetic oligonucleotide
gccccacacctcagttttccattctttacgtgtct

SEQ ID NO: 141569 - DNA, 35 bp, Artificial Sequence
  Synthetic oligonucleotide
tcagcgacgtcccaggtcgctccctgccacttctt

SEQ ID NO: 141570 - DNA, 35 bp, Artificial Sequence
  Synthetic oligonucleotide
gtggaccgtgcagtccccataaagttcccctcgtt

SEQ ID NO: 141571 - DNA, 35 bp, Artificial Sequence
  Synthetic oligonucleotide
gtgctccacaccatgttattcctatgctgattaca

SEQ ID NO: 141572 - DNA, 36 bp, Artificial Sequence
  Synthetic oligonucleotide
gacgatgggggagggagggcggcaaacgtgcgggca

SEQ ID NO: 141573 - DNA, 35 bp, Artificial Sequence
  Synthetic oligonucleotide
ggacggtccgtcgctctatctggtctcccattgca

SEQ ID NO: 141574 - DNA, 35 bp, Artificial Sequence
  Synthetic oligonucleotide
acccgcccgcacaccgtatgctttctacaggctca

SEQ ID NO: 141575 - DNA, 37 bp, Artificial Sequence
  Synthetic oligonucleotide
ggaagggaggggtgtaggtacgttatggtgaaaaaga

SEQ ID NO: 141576 - DNA, 37 bp, Artificial Sequence
  Synthetic oligonucleotide
acgaaccgcacccccctgtctattggccgtcaccaga

SEQ ID NO: 141577 - DNA, 37 bp, Artificial Sequence
  Synthetic oligonucleotide
gtagataaacagggaggggacgggcgaggggcgtaga

SEQ ID NO: 141578 - DNA, 36 bp, Artificial Sequence
  Synthetic oligonucleotide
gtcccgcgtcgcgcttcatgtcatctccccgtccga

SEQ ID NO: 141579 - DNA, 37 bp, Artificial Sequence
  Synthetic oligonucleotide
aggggggacaagggtgggcggaatggggagagttcga

SEQ ID NO: 141580 - DNA, 37 bp, Artificial Sequence
  Synthetic oligonucleotide
acgccactgcctcccttctgacgaagatccctacgga

SEQ ID NO: 141581 - DNA, 37 bp, Artificial Sequence
  Synthetic oligonucleotide
atggaaacatcggtatgatgggcggagtgggtaggga

SEQ ID NO: 141582 - DNA, 37 bp, Artificial Sequence
  Synthetic oligonucleotide
taagttccagacggaggggaggacgagggcatgggga

SEQ ID NO: 141583 - DNA, 38 bp, Artificial Sequence
  Synthetic oligonucleotide
gggggacagtaggggacggagatagctcggggtgggga

SEQ ID NO: 141584 - DNA, 38 bp, Artificial Sequence
  Synthetic oligonucleotide
tgccacccacgagccccctctgcgcacatcatccatga

SEQ ID NO: 141585 - DNA, 37 bp, Artificial Sequence
  Synthetic oligonucleotide
gacacgagcgggatgggacaagcgggcggggcgatga

SEQ ID NO: 141586 - DNA, 38 bp, Artificial Sequence
  Synthetic oligonucleotide
gatgaggtgtggaggtatggggggacgagggagtatga

SEQ ID NO: 141587 - DNA, 36 bp, Artificial Sequence
  Synthetic oligonucleotide
tcttgctccgctcgccccatgtcttactttcctcta

SEQ ID NO: 141588 - DNA, 35 bp, Artificial Sequence
  Synthetic oligonucleotide
atgtaccgtgccgctggtccattgccttatttcac

SEQ ID NO: 141589 - DNA, 35 bp, Artificial Sequence
  Synthetic oligonucleotide
acttcgccccggtgatcatactgattcttgccacc

SEQ ID NO: 141590 - DNA, 35 bp, Artificial Sequence
  Synthetic oligonucleotide
atcgccactgcgccctgccctcggaactgcccccc

SEQ ID NO: 141591 - DNA, 35 bp, Artificial Sequence
  Synthetic oligonucleotide
tcgatcattcgcggtcacgtcactcgcccagtccc

SEQ ID NO: 141592 - DNA, 35 bp, Artificial Sequence
  Synthetic oligonucleotide
ggggtgccatcacatcggtcacgtacattcccgcc

SEQ ID NO: 141593 - DNA, 35 bp, Artificial Sequence
  Synthetic oligonucleotide
taccgtcctccgtccacaccgctgcattaatgtcc

SEQ ID NO: 141594 - DNA, 35 bp, Artificial Sequence
  Synthetic oligonucleotide
tgccccaccatcccgggacccttgccgctatgcgc

SEQ ID NO: 141595 - DNA, 35 bp, Artificial Sequence
  Synthetic oligonucleotide
gcaagagtagcgtgaaacttccgccggccctcctc

SEQ ID NO: 141596 - DNA, 35 bp, Artificial Sequence
  Synthetic oligonucleotide
tcaagtacgcggatccgtaacgctgtcgcctcctc

SEQ ID NO: 141597 - DNA, 35 bp, Artificial Sequence
  Synthetic oligonucleotide
tcatcaacgaatccggcggtattcttcctcccttc

SEQ ID NO: 141598 - DNA, 35 bp, Artificial Sequence
  Synthetic oligonucleotide
accaccgccaatttctgctcaggatcttacgttcg

SEQ ID NO: 141599 - DNA, 35 bp, Artificial Sequence
  Synthetic oligonucleotide
acctggttcactcccctccgctttgtcttcgttcg

SEQ ID NO: 141600 - DNA, 35 bp, Artificial Sequence
  Synthetic oligonucleotide
gtgggaggcgggacaagcggtaggtaagggtaagg

SEQ ID NO: 141601 - DNA, 35 bp, Artificial Sequence
  Synthetic oligonucleotide
gcggtgggaggggggggaggcatgatgatgcatgg

SEQ ID NO: 141602 - DNA, 35 bp, Artificial Sequence
  Synthetic oligonucleotide
tacgctcgccctgtcactttgcctaccccttcatg

SEQ ID NO: 141603 - DNA, 35 bp, Artificial Sequence
  Synthetic oligonucleotide
atgagccaacacagggtggagtagggggggacctg

SEQ ID NO: 141604 - DNA, 35 bp, Artificial Sequence
  Synthetic oligonucleotide
atcacccccacgtgcttactgccattgatcaacct

SEQ ID NO: 141605 - DNA, 35 bp, Artificial Sequence
  Synthetic oligonucleotide
gttcatcgccgccatcctgtcttactttagccgct

SEQ ID NO: 141606 - DNA, 35 bp, Artificial Sequence
  Synthetic oligonucleotide
actcagcacgtcgtgatctctcttcccccaccgtt

SEQ ID NO: 141607 - DNA, 36 bp, Artificial Sequence
  Synthetic oligonucleotide
tgtcacctccgccacccagcacccgaccagttcaaa

SEQ ID NO: 141608 - DNA, 35 bp, Artificial Sequence
  Synthetic oligonucleotide
acacggaggggggacgacggggacggacggagcaa

SEQ ID NO: 141609 - DNA, 36 bp, Artificial Sequence
  Synthetic oligonucleotide
tcaacttccgctctgtaacttgctgctactcgccca

SEQ ID NO: 141610 - DNA, 37 bp, Artificial Sequence
  Synthetic oligonucleotide
accagctgccccttcgtaccggccattctccccgcga

SEQ ID NO: 141611 - DNA, 37 bp, Artificial Sequence
  Synthetic oligonucleotide
ggtacacgaacgggctggggaagggggagggaaggga

SEQ ID NO: 141612 - DNA, 37 bp, Artificial Sequence
  Synthetic oligonucleotide
ggaggggggacaatggggctggtgcaaaggcgaggga

SEQ ID NO: 141613 - DNA, 37 bp, Artificial Sequence
  Synthetic oligonucleotide
acactatcgtcggggcaggagaggacggagggcggga

SEQ ID NO: 141614 - DNA, 38 bp, Artificial Sequence
  Synthetic oligonucleotide
tgggagggtggagtagaaaaggggggaattaggaatga

SEQ ID NO: 141615 - DNA, 37 bp, Artificial Sequence
  Synthetic oligonucleotide
tagccacagtgaagggggggggagtagggctgtatga

SEQ ID NO: 141616 - DNA, 38 bp, Artificial Sequence
  Synthetic oligonucleotide
gacagtgctcagcctccgcgatccggtaccccccctga

SEQ ID NO: 141617 - DNA, 35 bp, Artificial Sequence
  Synthetic oligonucleotide
ttcgagtggcgggggaatgggctgggggtgggata

SEQ ID NO: 141618 - DNA, 36 bp, Artificial Sequence
  Synthetic oligonucleotide
acgcccacgcactcattcgccgctctgcccccgtta

SEQ ID NO: 141619 - DNA, 35 bp, Artificial Sequence
  Synthetic oligonucleotide
atgatcaacctcgccaccatgttttgttcgcctac

SEQ ID NO: 141620 - DNA, 35 bp, Artificial Sequence
  Synthetic oligonucleotide
gcagtaaggtgcttcagacccggcccccccccctc

SEQ ID NO: 141621 - DNA, 35 bp, Artificial Sequence
  Synthetic oligonucleotide
gtagggaaggggaccaggggggacaacactgatag

SEQ ID NO: 141622 - DNA, 35 bp, Artificial Sequence
  Synthetic oligonucleotide
gagccggccgaacggtacccgcgccccacttcccg

SEQ ID NO: 141623 - DNA, 35 bp, Artificial Sequence
  Synthetic oligonucleotide
gagtgaagactggaggggggatgaacgtgggatgg

SEQ ID NO: 141624 - DNA, 35 bp, Artificial Sequence
  Synthetic oligonucleotide
gctccaacctcctgaaaggatccaatccgatacct

SEQ ID NO: 141625 - DNA, 35 bp, Artificial Sequence
  Synthetic oligonucleotide
tggtcattacgccagatcccctcccctcgcactct

SEQ ID NO: 141626 - DNA, 35 bp, Artificial Sequence
  Synthetic oligonucleotide
acctcaccccggtgccaatgcctaagcacgcctct

SEQ ID NO: 141627 - DNA, 35 bp, Artificial Sequence
  Synthetic oligonucleotide
gactgggtgtaaggtggatggtgggcgggaatggt

SEQ ID NO: 141628 - DNA, 35 bp, Artificial Sequence
  Synthetic oligonucleotide
ttagccactcccgacaccggcctatcaccgaactt

SEQ ID NO: 141629 - DNA, 35 bp, Artificial Sequence
  Synthetic oligonucleotide
gtggaacacgccgtctaccttgtcagctatccctt

SEQ ID NO: 141630 - DNA, 36 bp, Artificial Sequence
  Synthetic oligonucleotide
tcaaccaccccacccggccgtacacgacttatcgaa

SEQ ID NO: 141631 - DNA, 36 bp, Artificial Sequence
  Synthetic oligonucleotide
taacccgccctcgccgttcttttattgacttcggaa

SEQ ID NO: 141632 - DNA, 36 bp, Artificial Sequence
  Synthetic oligonucleotide
accgcctgagcgactgcattcctgtcctgtcatcca

SEQ ID NO: 141633 - DNA, 35 bp, Artificial Sequence
  Synthetic oligonucleotide
gcaaactctccgcgccgtctttctacttacgtcga

SEQ ID NO: 141634 - DNA, 37 bp, Artificial Sequence
  Synthetic oligonucleotide
gcgtgaaggaaacagcgggaggagggcgggaggagga

SEQ ID NO: 141635 - DNA, 37 bp, Artificial Sequence
  Synthetic oligonucleotide
gattggccggacgggtgggaagggggtcgaaaaggga

SEQ ID NO: 141636 - DNA, 37 bp, Artificial Sequence
  Synthetic oligonucleotide
accaagggcggggttgtgttttgttggggagagggga

SEQ ID NO: 141637 - DNA, 37 bp, Artificial Sequence
  Synthetic oligonucleotide
gttccgcctcaccgacctctctctacgttcctatgga

SEQ ID NO: 141638 - DNA, 38 bp, Artificial Sequence
  Synthetic oligonucleotide
tgtcaaggggatcggggggttaagggaggggcaaatga

SEQ ID NO: 141639 - DNA, 38 bp, Artificial Sequence
  Synthetic oligonucleotide
tatgccccggtctccgctgctcccttcgttcctactga

SEQ ID NO: 141640 - DNA, 38 bp, Artificial Sequence
  Synthetic oligonucleotide
tgcccacccccatcttagcttgcgcgcacactgcgtga

SEQ ID NO: 141641 - DNA, 37 bp, Artificial Sequence
  Synthetic oligonucleotide
gctccacgccccctagcgtacgtacctcaacctttga

SEQ ID NO: 141642 - DNA, 38 bp, Artificial Sequence
  Synthetic oligonucleotide
gtacgcgctcgatttccctccctctgcctgtgctttga

SEQ ID NO: 141643 - DNA, 35 bp, Artificial Sequence
  Synthetic oligonucleotide
gcggaccgcctcctcggtacagctcacgctccccc

SEQ ID NO: 141644 - DNA, 35 bp, Artificial Sequence
  Synthetic oligonucleotide
agacacacaatcgtctttcatacctgagctcgccc

SEQ ID NO: 141645 - DNA, 35 bp, Artificial Sequence
  Synthetic oligonucleotide
ttcggtccacgttacactgaaagcgcccccttccc

SEQ ID NO: 141646 - DNA, 35 bp, Artificial Sequence
  Synthetic oligonucleotide
actgctgctccagtcgtaggtctcttcttcctgcc

SEQ ID NO: 141647 - DNA, 35 bp, Artificial Sequence
  Synthetic oligonucleotide
taccagcttgcatgcaccgccaggcacccgcctcc

SEQ ID NO: 141648 - DNA, 35 bp, Artificial Sequence
  Synthetic oligonucleotide
tagcacgtggcgtgtcgctccattcctatctcttc

SEQ ID NO: 141649 - DNA, 35 bp, Artificial Sequence
  Synthetic oligonucleotide
gacgcctccagccttctgtgcctattccggatttc

SEQ ID NO: 141650 - DNA, 35 bp, Artificial Sequence
  Synthetic oligonucleotide
acctcgggtctgggggggagggcggttggaacaag

SEQ ID NO: 141651 - DNA, 35 bp, Artificial Sequence
  Synthetic oligonucleotide
ggggggtggagggatgggccggccgggaattagag

SEQ ID NO: 141652 - DNA, 35 bp, Artificial Sequence
  Synthetic oligonucleotide
gatggggtgacggtgggttagggggaggtagggag

SEQ ID NO: 141653 - DNA, 35 bp, Artificial Sequence
  Synthetic oligonucleotide
tagcaccggcccagatcttcacccgttaacccgcg

SEQ ID NO: 141654 - DNA, 35 bp, Artificial Sequence
  Synthetic oligonucleotide
ccacgccgaggccccttcccttgtttgttaccctg

SEQ ID NO: 141655 - DNA, 35 bp, Artificial Sequence
  Synthetic oligonucleotide
gtcacccatgtcttccgtcctctttacgccgcact

SEQ ID NO: 141656 - DNA, 35 bp, Artificial Sequence
  Synthetic oligonucleotide
atattcccacctgtccattcgcatcagtacgctct

SEQ ID NO: 141657 - DNA, 35 bp, Artificial Sequence
  Synthetic oligonucleotide
aggacccccgcctccttgttcttaccccgtgctct

SEQ ID NO: 141658 - DNA, 35 bp, Artificial Sequence
  Synthetic oligonucleotide
actgcccccaccagagtaagatctcctcacgcctt

SEQ ID NO: 141659 - DNA, 35 bp, Artificial Sequence
  Synthetic oligonucleotide
tttgttcccccaattgtatagcatctctcttcgtt

SEQ ID NO: 141660 - DNA, 35 bp, Artificial Sequence
  Synthetic oligonucleotide
atcaagctgtgttcagtgctcctccgccacctttt

SEQ ID NO: 141661 - DNA, 35 bp, Artificial Sequence
  Synthetic oligonucleotide
gtagggggtgtggtcgaaggggggaaggagtaaaa

SEQ ID NO: 141662 - DNA, 36 bp, Artificial Sequence
  Synthetic oligonucleotide
gattgggaggatgacgggagcgtaaaggggagggaa

SEQ ID NO: 141663 - DNA, 35 bp, Artificial Sequence
  Synthetic oligonucleotide
tcacacaccttcgtttgcattatcctcctggtgaa

SEQ ID NO: 141664 - DNA, 35 bp, Artificial Sequence
  Synthetic oligonucleotide
tcccggcaaaggcacatccggttttttctctctca

SEQ ID NO: 141665 - DNA, 35 bp, Artificial Sequence
  Synthetic oligonucleotide
actccgtcagccaatcaccccccgcccgccataga

SEQ ID NO: 141666 - DNA, 36 bp, Artificial Sequence
  Synthetic oligonucleotide
tcagcgcagctttgcacaactcctccgatttcccga

SEQ ID NO: 141667 - DNA, 37 bp, Artificial Sequence
  Synthetic oligonucleotide
accgcacctcaacgggtccttagttcttttcatccga

SEQ ID NO: 141668 - DNA, 37 bp, Artificial Sequence
  Synthetic oligonucleotide
atcagggtcagagggagggtgggaaagcgggaggcga

SEQ ID NO: 141669 - DNA, 37 bp, Artificial Sequence
  Synthetic oligonucleotide
gactcccgccaccgatcctccacgtactttccaggga

SEQ ID NO: 141670 - DNA, 38 bp, Artificial Sequence
  Synthetic oligonucleotide
gcgatctcaccgggtccgtaacatctcctgtaccttga

SEQ ID NO: 141671 - DNA, 36 bp, Artificial Sequence
  Synthetic oligonucleotide
gtcgctccgcccgcgccctaactatcccgctcttga

SEQ ID NO: 141672 - DNA, 36 bp, Artificial Sequence
  Synthetic oligonucleotide
atgcccctgtcaccgcctcctatggacctcggccta

SEQ ID NO: 141673 - DNA, 35 bp, Artificial Sequence
  Synthetic oligonucleotide
gcatcgcgcttttacggtctcctgccttccttgta

SEQ ID NO: 141674 - DNA, 35 bp, Artificial Sequence
  Synthetic oligonucleotide
gatcaccggacccatgcccgcttccctgctcctta

SEQ ID NO: 141675 - DNA, 36 bp, Artificial Sequence
  Synthetic oligonucleotide
tcgacctgccgcagctcaatcgtccctttcgtctta

SEQ ID NO: 141676 - DNA, 36 bp, Artificial Sequence
  Synthetic oligonucleotide
gttcagccattgtgcttcgttcgcttcccccagtta

SEQ ID NO: 141677 - DNA, 35 bp, Artificial Sequence
  Synthetic oligonucleotide
tcccgcgcacatccacgtcgtcatccctccaatac

SEQ ID NO: 141678 - DNA, 35 bp, Artificial Sequence
  Synthetic oligonucleotide
gtgtcgcaccatcaacccgcaccgtttccttatac

SEQ ID NO: 141679 - DNA, 35 bp, Artificial Sequence
  Synthetic oligonucleotide
agctgtcgccatctggttcgcttctcgttgtcccc

SEQ ID NO: 141680 - DNA, 35 bp, Artificial Sequence
  Synthetic oligonucleotide
taactaccccagtgatgcacatatcgcgccctccc

SEQ ID NO: 141681 - DNA, 35 bp, Artificial Sequence
  Synthetic oligonucleotide
gatgcgacttacacgcgttacattatgaccccgcc

SEQ ID NO: 141682 - DNA, 35 bp, Artificial Sequence
  Synthetic oligonucleotide
gctgtcaatgcctggcatgtgtcttctcccgctcc

SEQ ID NO: 141683 - DNA, 35 bp, Artificial Sequence
  Synthetic oligonucleotide
gtacctccccatccttgacttgccgtccgcccagc

SEQ ID NO: 141684 - DNA, 35 bp, Artificial Sequence
  Synthetic oligonucleotide
tcactatccgatacttcgttcacacgccgacctgc

SEQ ID NO: 141685 - DNA, 35 bp, Artificial Sequence
  Synthetic oligonucleotide
gcactagctcgctcgcctaacatgaccctatctgc

SEQ ID NO: 141686 - DNA, 35 bp, Artificial Sequence
  Synthetic oligonucleotide
gacgccgtgcttcctgaagttcgccttccttcatc

SEQ ID NO: 141687 - DNA, 35 bp, Artificial Sequence
  Synthetic oligonucleotide
tcacaggacggccagctcgcccaatcctgtctatc

SEQ ID NO: 141688 - DNA, 35 bp, Artificial Sequence
  Synthetic oligonucleotide
gcctccatgccgttctggttagtccctctccgttc

SEQ ID NO: 141689 - DNA, 35 bp, Artificial Sequence
  Synthetic oligonucleotide
gcgggtgtgttcccccgccgtgccactcgcctttc

SEQ ID NO: 141690 - DNA, 35 bp, Artificial Sequence
  Synthetic oligonucleotide
ttcaccctcgttcggcttacgagcgcgaccttttc

SEQ ID NO: 141691 - DNA, 35 bp, Artificial Sequence
  Synthetic oligonucleotide
agcccccaccatacctctgagttaccgttcttacg

SEQ ID NO: 141692 - DNA, 35 bp, Artificial Sequence
  Synthetic oligonucleotide
atgggagaaggtgggggtggactatggtgtgcggg

SEQ ID NO: 141693 - DNA, 35 bp, Artificial Sequence
  Synthetic oligonucleotide
gcattaccctgcacccgttactattttgagctatg

SEQ ID NO: 141694 - DNA, 35 bp, Artificial Sequence
  Synthetic oligonucleotide
tcacgcatggttcgtgcgatccgtcttgccccctg

SEQ ID NO: 141695 - DNA, 35 bp, Artificial Sequence
  Synthetic oligonucleotide
gccggagcgcagtggtggcccgttccgtctttctg

SEQ ID NO: 141696 - DNA, 35 bp, Artificial Sequence
  Synthetic oligonucleotide
tccacccgcggtacatacactccatcttgctcgat

SEQ ID NO: 141697 - DNA, 35 bp, Artificial Sequence
  Synthetic oligonucleotide
tctgtcacccaactcatcgtacttctccggcgact

SEQ ID NO: 141698 - DNA, 35 bp, Artificial Sequence
  Synthetic oligonucleotide
tttcggcgcagtactgtcttccctgtctttctcct

SEQ ID NO: 141699 - DNA, 35 bp, Artificial Sequence
  Synthetic oligonucleotide
tccgcgtatccgcttgttctttcgttcctattcct

SEQ ID NO: 141700 - DNA, 35 bp, Artificial Sequence
  Synthetic oligonucleotide
accgcgcttctgacggtcccggccctgacctctct

SEQ ID NO: 141701 - DNA, 35 bp, Artificial Sequence
  Synthetic oligonucleotide
aagcgcatttgcgttcccccgtttcctgtccatgt

SEQ ID NO: 141702 - DNA, 35 bp, Artificial Sequence
  Synthetic oligonucleotide
tcccggggcactttctcgctggagccttcaccctt

SEQ ID NO: 141703 - DNA, 35 bp, Artificial Sequence
  Synthetic oligonucleotide
aattgcacccccaccatgcggccttcaggacacca

SEQ ID NO: 141704 - DNA, 35 bp, Artificial Sequence
  Synthetic oligonucleotide
tgacagatcagctccctcttgagtttcctgcacca

SEQ ID NO: 141705 - DNA, 36 bp, Artificial Sequence
  Synthetic oligonucleotide
gcccgtgcatagccgcctctgctttcgtttttccca

SEQ ID NO: 141706 - DNA, 36 bp, Artificial Sequence
  Synthetic oligonucleotide
gctcccccgtcggacatcgtacccatctgtcgtcca

SEQ ID NO: 141707 - DNA, 36 bp, Artificial Sequence
  Synthetic oligonucleotide
tgatggtgagataacgggtgggaaggggataggaga

SEQ ID NO: 141708 - DNA, 36 bp, Artificial Sequence
  Synthetic oligonucleotide
tcctacggtcctcgggcacatctccactccactcga

SEQ ID NO: 141709 - DNA, 37 bp, Artificial Sequence
  Synthetic oligonucleotide
gagattggagagggaggtatcgaggatggaggatgga

SEQ ID NO: 141710 - DNA, 35 bp, Artificial Sequence
  Synthetic oligonucleotide
tgcattgcctggtccctttcacacccgccttatga

SEQ ID NO: 141711 - DNA, 37 bp, Artificial Sequence
  Synthetic oligonucleotide
tccgcccatctgagcgcgttccccggtccttatctga

SEQ ID NO: 141712 - DNA, 37 bp, Artificial Sequence
  Synthetic oligonucleotide
tcacaccttcccagcccgcctggcctcctgcctgtga

SEQ ID NO: 141713 - DNA, 38 bp, Artificial Sequence
  Synthetic oligonucleotide
gaccccctcacctcgttccacagtcggtacaacattga

SEQ ID NO: 141714 - DNA, 38 bp, Artificial Sequence
  Synthetic oligonucleotide
gggaaccatggggggaggagggcgagaacaggcattga

SEQ ID NO: 141715 - DNA, 36 bp, Artificial Sequence
  Synthetic oligonucleotide
tctccaccccaccatctaggaacgctaccatgagta

SEQ ID NO: 141716 - DNA, 36 bp, Artificial Sequence
  Synthetic oligonucleotide
gtccacccaaccgttgttataacccatcttccggta

SEQ ID NO: 141717 - DNA, 36 bp, Artificial Sequence
  Synthetic oligonucleotide
atcaccatcgccgtggttcgcccacacttccatgta

SEQ ID NO: 141718 - DNA, 35 bp, Artificial Sequence
  Synthetic oligonucleotide
tacagccaccctcggactcgcatcatggcttatac

SEQ ID NO: 141719 - DNA, 35 bp, Artificial Sequence
  Synthetic oligonucleotide
tagacctcacccccgtactccctggttatagttac

SEQ ID NO: 141720 - DNA, 35 bp, Artificial Sequence
  Synthetic oligonucleotide
tcagaccgttagcccccactcttccaccagtttac

SEQ ID NO: 141721 - DNA, 36 bp, Artificial Sequence
  Synthetic oligonucleotide
aaatggttgagggggccaagggaaaggggggagacc

SEQ ID NO: 141722 - DNA, 35 bp, Artificial Sequence
  Synthetic oligonucleotide
gacaacgcgaaaagtgcccttccgcccttgatacc

SEQ ID NO: 141723 - DNA, 35 bp, Artificial Sequence
  Synthetic oligonucleotide
tcacgttccctgtcagtcactcgtcatacttgtcc

SEQ ID NO: 141724 - DNA, 35 bp, Artificial Sequence
  Synthetic oligonucleotide
gcaccgcttccaccaccctctatggacgtcccatc

SEQ ID NO: 141725 - DNA, 35 bp, Artificial Sequence
  Synthetic oligonucleotide
tccccctccactcaggcttcgctacgtttcgcctc

SEQ ID NO: 141726 - DNA, 35 bp, Artificial Sequence
  Synthetic oligonucleotide
tcacaccgccccatctttgcatatgccctgccacg

SEQ ID NO: 141727 - DNA, 35 bp, Artificial Sequence
  Synthetic oligonucleotide
gactcccctgctttctacccgactcgcatcttccg

SEQ ID NO: 141728 - DNA, 35 bp, Artificial Sequence
  Synthetic oligonucleotide
tatcagctgcccccattgtcctccttacttatgcg

SEQ ID NO: 141729 - DNA, 35 bp, Artificial Sequence
  Synthetic oligonucleotide
gtacaggggtgcgataaaggcgggggaaaaggggg

SEQ ID NO: 141730 - DNA, 35 bp, Artificial Sequence
  Synthetic oligonucleotide
ccgagcaccatcttgacctgatctttccacccctg

SEQ ID NO: 141731 - DNA, 35 bp, Artificial Sequence
  Synthetic oligonucleotide
tgagggcggggttaaaggttgggcgggttgataat

SEQ ID NO: 141732 - DNA, 35 bp, Artificial Sequence
  Synthetic oligonucleotide
aacgacactctcgcgatatccatcatttagttcct

SEQ ID NO: 141733 - DNA, 35 bp, Artificial Sequence
  Synthetic oligonucleotide
tgcgaatgttcccccgctgcccgctcgtgacctgt

SEQ ID NO: 141734 - DNA, 35 bp, Artificial Sequence
  Synthetic oligonucleotide
tacccatcgcggaaaattatcctgctccccatgtt

SEQ ID NO: 141735 - DNA, 35 bp, Artificial Sequence
  Synthetic oligonucleotide
gttacgcactgtcccttctgcgcttgctctgtttt

SEQ ID NO: 141736 - DNA, 35 bp, Artificial Sequence
  Synthetic oligonucleotide
ttgacagggccggcggtgggtgggtgatgatgaaa

SEQ ID NO: 141737 - DNA, 35 bp, Artificial Sequence
  Synthetic oligonucleotide
ggatgccgcccagccttcacgttatcttttgccaa

SEQ ID NO: 141738 - DNA, 36 bp, Artificial Sequence
  Synthetic oligonucleotide
accaaggggcggggcgggtaagggaatattaatcaa

SEQ ID NO: 141739 - DNA, 36 bp, Artificial Sequence
  Synthetic oligonucleotide
aacacgcctgacgcgaattgccccgccgtccctcaa

SEQ ID NO: 141740 - DNA, 36 bp, Artificial Sequence
  Synthetic oligonucleotide
tacctgccgtgggggggtaaaatgctggggagggaa

SEQ ID NO: 141741 - DNA, 35 bp, Artificial Sequence
  Synthetic oligonucleotide
gcccctaccccgctgtgctcgcattgaggtcccca

SEQ ID NO: 141742 - DNA, 35 bp, Artificial Sequence
  Synthetic oligonucleotide
agctacgtcatcaacgtcctactcacacctgccca

SEQ ID NO: 141743 - DNA, 36 bp, Artificial Sequence
  Synthetic oligonucleotide
gatcttcccgcccgctccggccaccttgtctgccca

SEQ ID NO: 141744 - DNA, 36 bp, Artificial Sequence
  Synthetic oligonucleotide
gtatgctgccttcctactgtcgttgctcgctggcca

SEQ ID NO: 141745 - DNA, 36 bp, Artificial Sequence
  Synthetic oligonucleotide
gagtgcgggagggcaatcggggagggggatgcatca

SEQ ID NO: 141746 - DNA, 35 bp, Artificial Sequence
  Synthetic oligonucleotide
tgtccccactgtgcttttccatctatgtacgctca

SEQ ID NO: 141747 - DNA, 37 bp, Artificial Sequence
  Synthetic oligonucleotide
atggcgcccgccaggctcccgttcatgccgcttttca

SEQ ID NO: 141748 - DNA, 37 bp, Artificial Sequence
  Synthetic oligonucleotide
tcgcggaggggaggggatagggaagaaatcggtcaga

SEQ ID NO: 141749 - DNA, 37 bp, Artificial Sequence
  Synthetic oligonucleotide
ttccgccggcctagcgcattgccccccgttccataga

SEQ ID NO: 141750 - DNA, 36 bp, Artificial Sequence
  Synthetic oligonucleotide
tcccaccgcccccaacagcatggtcttcgctatcga

SEQ ID NO: 141751 - DNA, 35 bp, Artificial Sequence
  Synthetic oligonucleotide
gtcatccttcgctgccccgccggtccttcccagga

SEQ ID NO: 141752 - DNA, 37 bp, Artificial Sequence
  Synthetic oligonucleotide
gacccgccgccacatgactcctacccctccgagcgga

SEQ ID NO: 141753 - DNA, 38 bp, Artificial Sequence
  Synthetic oligonucleotide
acgagggacggggcggcttggcaacgacggggggatga

SEQ ID NO: 141754 - DNA, 37 bp, Artificial Sequence
  Synthetic oligonucleotide
gctgccccgaatagtgcctcgcccttctcccttatga

SEQ ID NO: 141755 - DNA, 37 bp, Artificial Sequence
  Synthetic oligonucleotide
gagcaaacgtaggggggcgggtgacttggggaggtga

SEQ ID NO: 141756 - DNA, 37 bp, Artificial Sequence
  Synthetic oligonucleotide
gatacccatcgccactcgtcctcgcttacatctttga

SEQ ID NO: 141757 - DNA, 36 bp, Artificial Sequence
  Synthetic oligonucleotide
atcctcccgctccctcccctatacgagggaatccta

SEQ ID NO: 141758 - DNA, 36 bp, Artificial Sequence
  Synthetic oligonucleotide
gaaccgcccgttcagtcgcctttcatacctccgcta

SEQ ID NO: 141759 - DNA, 36 bp, Artificial Sequence
  Synthetic oligonucleotide
gccacccgacctgctgatcgcatactgattatctta

SEQ ID NO: 141760 - DNA, 36 bp, Artificial Sequence
  Synthetic oligonucleotide
gttgacgtcccatatgttaaccctggttccctctta

SEQ ID NO: 141761 - DNA, 35 bp, Artificial Sequence
  Synthetic oligonucleotide
gtcaaccccagaaagccactcccccgcgcaaccac

SEQ ID NO: 141762 - DNA, 35 bp, Artificial Sequence
  Synthetic oligonucleotide
tgtgctccacaactctgacttatctcgccgcttac

SEQ ID NO: 141763 - DNA, 35 bp, Artificial Sequence
  Synthetic oligonucleotide
gccggtacacctgtatcgaatcccaccccaccacc

SEQ ID NO: 141764 - DNA, 35 bp, Artificial Sequence
  Synthetic oligonucleotide
gatgctcctttcactgttagcgccctggccccacc

SEQ ID NO: 141765 - DNA, 35 bp, Artificial Sequence
  Synthetic oligonucleotide
tcacgtccggtcgatttgccttccaccgcctcgcc

SEQ ID NO: 141766 - DNA, 35 bp, Artificial Sequence
  Synthetic oligonucleotide
attgctcccacacagatcgatgtcccgctctctcc

SEQ ID NO: 141767 - DNA, 35 bp, Artificial Sequence
  Synthetic oligonucleotide
gctgatcgccgttccgtttcctggcgccttcttcc

SEQ ID NO: 141768 - DNA, 35 bp, Artificial Sequence
  Synthetic oligonucleotide
gaagcgtcctcgctgccctctcgttgtttcgtcgc

SEQ ID NO: 141769 - DNA, 35 bp, Artificial Sequence
  Synthetic oligonucleotide
gcgatgcgtcagccccgccttccctttcccttggc

SEQ ID NO: 141770 - DNA, 35 bp, Artificial Sequence
  Synthetic oligonucleotide
tttgcgccttcacacctgttcttacgctgcttatc

SEQ ID NO: 141771 - DNA, 35 bp, Artificial Sequence
  Synthetic oligonucleotide
tgaccacccccctctgtgccggtgccccgttcttc

SEQ ID NO: 141772 - DNA, 35 bp, Artificial Sequence
  Synthetic oligonucleotide
acgtacctcaccgctccaaaatcattgcctctacg

SEQ ID NO: 141773 - DNA, 35 bp, Artificial Sequence
  Synthetic oligonucleotide
gccaagcgcaccgacctgggacccccgccgctccg

SEQ ID NO: 141774 - DNA, 35 bp, Artificial Sequence
  Synthetic oligonucleotide
tacccccttacgttcgtaatatgcgcccgcccgcg

SEQ ID NO: 141775 - DNA, 35 bp, Artificial Sequence
  Synthetic oligonucleotide
gtgagcgggaacaggggctcgaaaggcaagggggg

SEQ ID NO: 141776 - DNA, 35 bp, Artificial Sequence
  Synthetic oligonucleotide
taacgcactccccagcctcacctctattccgctgg

SEQ ID NO: 141777 - DNA, 35 bp, Artificial Sequence
  Synthetic oligonucleotide
gacgagcgccccccttgcctggcatgctctaccat

SEQ ID NO: 141778 - DNA, 35 bp, Artificial Sequence
  Synthetic oligonucleotide
gtccccctcacgttcttttcctcgtaccagctgct

SEQ ID NO: 141779 - DNA, 35 bp, Artificial Sequence
  Synthetic oligonucleotide
acccgccacgtcgattcttcctactgtttagctct

SEQ ID NO: 141780 - DNA, 35 bp, Artificial Sequence
  Synthetic oligonucleotide
acagtcgccagatcactgttgtcttcctggtctct

SEQ ID NO: 141781 - DNA, 35 bp, Artificial Sequence
  Synthetic oligonucleotide
gacgaagggggagagaagggaaaggataaaactgt

SEQ ID NO: 141782 - DNA, 36 bp, Artificial Sequence
  Synthetic oligonucleotide
atgccctgcgcaggcaccagcttacgccccccccaa

SEQ ID NO: 141783 - DNA, 35 bp, Artificial Sequence
  Synthetic oligonucleotide
aaaccaccgcactgaaggcccccccctgacatcaa

SEQ ID NO: 141784 - DNA, 36 bp, Artificial Sequence
  Synthetic oligonucleotide
gctatcataccgccctttaccttcgcctgcagtgaa

SEQ ID NO: 141785 - DNA, 35 bp, Artificial Sequence
  Synthetic oligonucleotide
acccccttccgcccccgttcgtctttaacacttaa

SEQ ID NO: 141786 - DNA, 35 bp, Artificial Sequence
  Synthetic oligonucleotide
tacccactcctgatttggtcattctcctttcgcca

SEQ ID NO: 141787 - DNA, 36 bp, Artificial Sequence
  Synthetic oligonucleotide
tctccactccgtcctagttcccgttgctgggcctca

SEQ ID NO: 141788 - DNA, 37 bp, Artificial Sequence
  Synthetic oligonucleotide
tgtcgcaactgttgccccttgtacgcctacgccccga

SEQ ID NO: 141789 - DNA, 35 bp, Artificial Sequence
  Synthetic oligonucleotide
cccacggccttcctgcccatcgcctcttgccccga

SEQ ID NO: 141790 - DNA, 35 bp, Artificial Sequence
  Synthetic oligonucleotide
gtgatcgggaggggtgctgaggggagaacggccga

SEQ ID NO: 141791 - DNA, 35 bp, Artificial Sequence
  Synthetic oligonucleotide
ttctcgcccgcccctccatcagtgatgagctccga

SEQ ID NO: 141792 - DNA, 37 bp, Artificial Sequence
  Synthetic oligonucleotide
gacagtcggacggaaaggagggcggggatagattcga

SEQ ID NO: 141793 - DNA, 36 bp, Artificial Sequence
  Synthetic oligonucleotide
tagtcagggggctaaaagggagaagagcggggagga

SEQ ID NO: 141794 - DNA, 37 bp, Artificial Sequence
  Synthetic oligonucleotide
gccaggcgccacccaacgtttttcgcccatccccgga

SEQ ID NO: 141795 - DNA, 36 bp, Artificial Sequence
  Synthetic oligonucleotide
tgtgaggggtgtgtacgggggacggaaggcggggga

SEQ ID NO: 141796 - DNA, 37 bp, Artificial Sequence
  Synthetic oligonucleotide
gatcacacccaatgtaatttcgatggcccacccctga

SEQ ID NO: 141797 - DNA, 38 bp, Artificial Sequence
  Synthetic oligonucleotide
gtcgacgctagtcatttcacctcctgctcccttcgtga

SEQ ID NO: 141798 - DNA, 37 bp, Artificial Sequence
  Synthetic oligonucleotide
accacaggtcagcgggacacgggggaaggggaggtga

SEQ ID NO: 141799 - DNA, 38 bp, Artificial Sequence
  Synthetic oligonucleotide
tccacgtagtggtgtcatttcgccccgtccctggttga

SEQ ID NO: 141800 - DNA, 36 bp, Artificial Sequence
  Synthetic oligonucleotide
gtggaagggtagaacgggggacaaagacgaaaggta

SEQ ID NO: 141801 - DNA, 35 bp, Artificial Sequence
  Synthetic oligonucleotide
tgatcggagcctctagtgatccgccctctatccac

SEQ ID NO: 141802 - DNA, 35 bp, Artificial Sequence
  Synthetic oligonucleotide
ttccgtgtgccctgctgatttccacgatacttcac

SEQ ID NO: 141803 - DNA, 35 bp, Artificial Sequence
  Synthetic oligonucleotide
tcacaaccctctgcgttccgccccggacttggtac

SEQ ID NO: 141804 - DNA, 35 bp, Artificial Sequence
  Synthetic oligonucleotide
tctatcgcacacgaatcgttttgacccactcaacc

SEQ ID NO: 141805 - DNA, 35 bp, Artificial Sequence
  Synthetic oligonucleotide
actccgcacacagcctgcccccccaccggcttacc

SEQ ID NO: 141806 - DNA, 34 bp, Artificial Sequence
  Synthetic oligonucleotide
atcaccatacagtaggttcctgcatatttactcc

SEQ ID NO: 141807 - DNA, 35 bp, Artificial Sequence
  Synthetic oligonucleotide
actcttcgcagtgccgtcattacacctacggctcc

SEQ ID NO: 141808 - DNA, 35 bp, Artificial Sequence
  Synthetic oligonucleotide
tgtcgcgccattctcttcacctttccttcagtgtc

SEQ ID NO: 141809 - DNA, 35 bp, Artificial Sequence
  Synthetic oligonucleotide
tgcctccgacagttccaccgcgacttcctcacccg

SEQ ID NO: 141810 - DNA, 35 bp, Artificial Sequence
  Synthetic oligonucleotide
actccgtcggagtcggtgcaggccccccccctccg

SEQ ID NO: 141811 - DNA, 35 bp, Artificial Sequence
  Synthetic oligonucleotide
aagccgtgggggagggactgggcaggattgacggg

SEQ ID NO: 141812 - DNA, 35 bp, Artificial Sequence
  Synthetic oligonucleotide
ttacttgcagcaccaccctttggtcacctttgcct

SEQ ID NO: 141813 - DNA, 35 bp, Artificial Sequence
  Synthetic oligonucleotide
aacccacccacgtgccgtgccctccctagtactct

SEQ ID NO: 141814 - DNA, 35 bp, Artificial Sequence
  Synthetic oligonucleotide
ttcccgctgcctgttttatgcataccacctctagt

SEQ ID NO: 141815 - DNA, 34 bp, Artificial Sequence
  Synthetic oligonucleotide
gtcgccccctccctgcattgttatctttcacctt

SEQ ID NO: 141816 - DNA, 35 bp, Artificial Sequence
  Synthetic oligonucleotide
tttactcacgcactcgcccacactgtttagccctt

SEQ ID NO: 141817 - DNA, 36 bp, Artificial Sequence
  Synthetic oligonucleotide
agtgacagcccttccgtgctccccgcttcactcttt

SEQ ID NO: 141818 - DNA, 36 bp, Artificial Sequence
  Synthetic oligonucleotide
gcaaacagcccactgttcgtcgcccctccctggcaa

SEQ ID NO: 141819 - DNA, 35 bp, Artificial Sequence
  Synthetic oligonucleotide
acgccacttctgtccctgtcttttgtcgtgttcaa

SEQ ID NO: 141820 - DNA, 35 bp, Artificial Sequence
  Synthetic oligonucleotide
agggaccaaacaagtcgggggggagggttcttgaa

SEQ ID NO: 141821 - DNA, 36 bp, Artificial Sequence
  Synthetic oligonucleotide
tgccactcagatctccttcccccgctggcatcctaa

SEQ ID NO: 141822 - DNA, 35 bp, Artificial Sequence
  Synthetic oligonucleotide
gagacctgcccgccgcaccaaaaactgtccgcaca

SEQ ID NO: 141823 - DNA, 36 bp, Artificial Sequence
  Synthetic oligonucleotide
ggtgccgccgcacgacgccataaccgccaccgtaca

SEQ ID NO: 141824 - DNA, 36 bp, Artificial Sequence
  Synthetic oligonucleotide
aatggcacagcatgtgaccagctcctaccctcccca

SEQ ID NO: 141825 - DNA, 36 bp, Artificial Sequence
  Synthetic oligonucleotide
acaactgcgccgccatcatgcgctcgttcatctcca

SEQ ID NO: 141826 - DNA, 34 bp, Artificial Sequence
  Synthetic oligonucleotide
tttacatcagtccgcacctgttaccttgccatca

SEQ ID NO: 141827 - DNA, 36 bp, Artificial Sequence
  Synthetic oligonucleotide
tggaccccttctccgttgccgtgactggctatctca

SEQ ID NO: 141828 - DNA, 36 bp, Artificial Sequence
  Synthetic oligonucleotide
agtgtaggtgacggaggagcgagggagggcacgtca

SEQ ID NO: 141829 - DNA, 36 bp, Artificial Sequence
  Synthetic oligonucleotide
gcctctacccagctggtttgttcgtttcctgtttca

SEQ ID NO: 141830 - DNA, 37 bp, Artificial Sequence
  Synthetic oligonucleotide
tgcaacctcagccgtccccgcgccccctcactaccga

SEQ ID NO: 141831 - DNA, 37 bp, Artificial Sequence
  Synthetic oligonucleotide
actcgctaccccgtcctgctccccccgcccataagga

SEQ ID NO: 141832 - DNA, 36 bp, Artificial Sequence
  Synthetic oligonucleotide
ttgccccctcgttctccttgcgcaactcactccgga

SEQ ID NO: 141833 - DNA, 38 bp, Artificial Sequence
  Synthetic oligonucleotide
gatcctccgtcagctcgcccctcttcgctgcctaatga

SEQ ID NO: 141834 - DNA, 38 bp, Artificial Sequence
  Synthetic oligonucleotide
aacgtgcacggcgaagtgggcggggggggacgtaatga

SEQ ID NO: 141835 - DNA, 35 bp, Artificial Sequence
  Synthetic oligonucleotide
attgggggggggcaagggaaacgtatggtggctga

SEQ ID NO: 141836 - DNA, 38 bp, Artificial Sequence
  Synthetic oligonucleotide
taacgcgctgggcagagagtggggggggagggacgtga

SEQ ID NO: 141837 - DNA, 38 bp, Artificial Sequence
  Synthetic oligonucleotide
gacccgcacaactttaactgcatacactccccctgtga

SEQ ID NO: 141838 - DNA, 37 bp, Artificial Sequence
  Synthetic oligonucleotide
atggagggaacgggcgagaaagaacagtcttaattga

SEQ ID NO: 141839 - DNA, 37 bp, Artificial Sequence
  Synthetic oligonucleotide
tacggggcgggagggatggggttactccacaccttga

SEQ ID NO: 141840 - DNA, 35 bp, Artificial Sequence
  Synthetic oligonucleotide
ttgcaacaccacgttctttccctccgccggctata

SEQ ID NO: 141841 - DNA, 36 bp, Artificial Sequence
  Synthetic oligonucleotide
gccccagtgtccagggccctctactccttccgccta

SEQ ID NO: 141842 - DNA, 35 bp, Artificial Sequence
  Synthetic oligonucleotide
tccaccatcctctcggtcagattagcccccagtac

SEQ ID NO: 141843 - DNA, 35 bp, Artificial Sequence
  Synthetic oligonucleotide
tgcaaactcccgcgcgctatgctgcctgccgttac

SEQ ID NO: 141844 - DNA, 35 bp, Artificial Sequence
  Synthetic oligonucleotide
agtttgccgccagctagtcccgtcgttcactctcc

SEQ ID NO: 141845 - DNA, 35 bp, Artificial Sequence
  Synthetic oligonucleotide
gtcgccactcactctcatatacgaccttcaccacg

SEQ ID NO: 141846 - DNA, 35 bp, Artificial Sequence
  Synthetic oligonucleotide
gtaacgtccttagcattacctgtgttcctcctccg

SEQ ID NO: 141847 - DNA, 35 bp, Artificial Sequence
  Synthetic oligonucleotide
ggagagtgtggtgaggatggtgaggtgttgggcgg

SEQ ID NO: 141848 - DNA, 35 bp, Artificial Sequence
  Synthetic oligonucleotide
gatgtaagggggggcgtgagagaccagatggcggg

SEQ ID NO: 141849 - DNA, 35 bp, Artificial Sequence
  Synthetic oligonucleotide
gttccacctcccccgtcttctgattagcttgttgg

SEQ ID NO: 141850 - DNA, 35 bp, Artificial Sequence
  Synthetic oligonucleotide
acacccgtgctttctctgttcctcgctgagctatg

SEQ ID NO: 141851 - DNA, 35 bp, Artificial Sequence
  Synthetic oligonucleotide
gcacaccccccaggcctccggttagtaacttcctg

SEQ ID NO: 141852 - DNA, 35 bp, Artificial Sequence
  Synthetic oligonucleotide
tacctcccagttgtcccccagtacccgctcccact

SEQ ID NO: 141853 - DNA, 35 bp, Artificial Sequence
  Synthetic oligonucleotide
taaacccgtcatgtcatccctggtctcccgccact

SEQ ID NO: 141854 - DNA, 35 bp, Artificial Sequence
  Synthetic oligonucleotide
tggaccggggtcgttacctaggggagggtgggcct

SEQ ID NO: 141855 - DNA, 35 bp, Artificial Sequence
  Synthetic oligonucleotide
gcacccacgcctctcaaccgtaaccacagtgcaaa

SEQ ID NO: 141856 - DNA, 36 bp, Artificial Sequence
  Synthetic oligonucleotide
tgcgacctctccatatgcctcacatgtaccccgcaa

SEQ ID NO: 141857 - DNA, 35 bp, Artificial Sequence
  Synthetic oligonucleotide
ggtcatccccacatggaacaccgcctctcatagaa

SEQ ID NO: 141858 - DNA, 36 bp, Artificial Sequence
  Synthetic oligonucleotide
ttgtagggataagtcggggggggtagaagggaggaa

SEQ ID NO: 141859 - DNA, 35 bp, Artificial Sequence
  Synthetic oligonucleotide
ggacacggttattgtgggcgggggaagggtgggaa

SEQ ID NO: 141860 - DNA, 36 bp, Artificial Sequence
  Synthetic oligonucleotide
gcgtttgcgaacgggtcatgggggggaggggaaaca

SEQ ID NO: 141861 - DNA, 36 bp, Artificial Sequence
  Synthetic oligonucleotide
gtgggtgtcacaatcgggtgggtgagttgtagggca

SEQ ID NO: 141862 - DNA, 36 bp, Artificial Sequence
  Synthetic oligonucleotide
ttgccgcttctgaggtctgtctgctccatcctctca

SEQ ID NO: 141863 - DNA, 37 bp, Artificial Sequence
  Synthetic oligonucleotide
aaaggaggaacggggggtatgaatgcataggaggaga

SEQ ID NO: 141864 - DNA, 37 bp, Artificial Sequence
  Synthetic oligonucleotide
acccaccatccttaggtcctgggccagttcctctgga

SEQ ID NO: 141865 - DNA, 38 bp, Artificial Sequence
  Synthetic oligonucleotide
gtgtgggcggtgagagggaagagggagtatgtgtatga

SEQ ID NO: 141866 - DNA, 38 bp, Artificial Sequence
  Synthetic oligonucleotide
tcgatcaggcattcaccgtgtcattttcctcctcctga

SEQ ID NO: 141867 - DNA, 37 bp, Artificial Sequence
  Synthetic oligonucleotide
tctgtatcgtgtggtggcgtagggcgggggggagtga

SEQ ID NO: 141868 - DNA, 36 bp, Artificial Sequence
  Synthetic oligonucleotide
accacgcccggcattgcatttttacgctcccttata

SEQ ID NO: 141869 - DNA, 36 bp, Artificial Sequence
  Synthetic oligonucleotide
tgctagcatccgctgtcctgcttctcttctctccta

SEQ ID NO: 141870 - DNA, 36 bp, Artificial Sequence
  Synthetic oligonucleotide
tgtgccgatccgctaatatctggtgtctgccctcta

SEQ ID NO: 141871 - DNA, 35 bp, Artificial Sequence
  Synthetic oligonucleotide
agtgcccgatgcgggtagcacgcccctattaccac

SEQ ID NO: 141872 - DNA, 35 bp, Artificial Sequence
  Synthetic oligonucleotide
ttgcgacacgtctcactgttgctgcaatcccctac

SEQ ID NO: 141873 - DNA, 35 bp, Artificial Sequence
  Synthetic oligonucleotide
tgcctccccgtacacctgtgctttctactgggccc

SEQ ID NO: 141874 - DNA, 35 bp, Artificial Sequence
  Synthetic oligonucleotide
gtctcatcgctccacttgctctaagggtatctccc

SEQ ID NO: 141875 - DNA, 35 bp, Artificial Sequence
  Synthetic oligonucleotide
acatgcctttctattcgttccgctggacttttgcc

SEQ ID NO: 141876 - DNA, 35 bp, Artificial Sequence
  Synthetic oligonucleotide
tatcccaccgccctgacgttaccgtagattactcc

SEQ ID NO: 141877 - DNA, 35 bp, Artificial Sequence
  Synthetic oligonucleotide
tcctcgccccccacgtagctccaactgcaactagc

SEQ ID NO: 141878 - DNA, 35 bp, Artificial Sequence
  Synthetic oligonucleotide
attcccctcccctggttgtttagggtgccttaatc

SEQ ID NO: 141879 - DNA, 35 bp, Artificial Sequence
  Synthetic oligonucleotide
ggtgtaccttccgttctgtctaactgtttttcgtc

SEQ ID NO: 141880 - DNA, 35 bp, Artificial Sequence
  Synthetic oligonucleotide
ggccgtctcgaactgccatcacctccagctccttc

SEQ ID NO: 141881 - DNA, 35 bp, Artificial Sequence
  Synthetic oligonucleotide
gagggatgggacggggggggagtgaggcatacaag

SEQ ID NO: 141882 - DNA, 35 bp, Artificial Sequence
  Synthetic oligonucleotide
tgaagcgcctgtcaactccttgtgctgccttcccg

SEQ ID NO: 141883 - DNA, 35 bp, Artificial Sequence
  Synthetic oligonucleotide
gtacagccatcgcccgcaccctgcgcgccccgccg

SEQ ID NO: 141884 - DNA, 35 bp, Artificial Sequence
  Synthetic oligonucleotide
aataccgcgcaaccctgtcccattcaacctctccg

SEQ ID NO: 141885 - DNA, 35 bp, Artificial Sequence
  Synthetic oligonucleotide
aacaggcaggaggctgggtggggaaggtcggatgg

SEQ ID NO: 141886 - DNA, 35 bp, Artificial Sequence
  Synthetic oligonucleotide
tgtcgccctcaccgtctcccccatgccagttcctg

SEQ ID NO: 141887 - DNA, 35 bp, Artificial Sequence
  Synthetic oligonucleotide
gtgtgatctgccccctcacgtccttggtgacacct

SEQ ID NO: 141888 - DNA, 35 bp, Artificial Sequence
  Synthetic oligonucleotide
gtccgctagtgcgaatgtccgccccacttgctcct

SEQ ID NO: 141889 - DNA, 35 bp, Artificial Sequence
  Synthetic oligonucleotide
gcattgacgcctcaatcaacacttcccgcttcgct

SEQ ID NO: 141890 - DNA, 35 bp, Artificial Sequence
  Synthetic oligonucleotide
gatgccttccgcgcccggtgttcatgccaccccgt

SEQ ID NO: 141891 - DNA, 35 bp, Artificial Sequence
  Synthetic oligonucleotide
agaagacgcggactcgcactgctccacccctttgt

SEQ ID NO: 141892 - DNA, 36 bp, Artificial Sequence
  Synthetic oligonucleotide
attcgagaggggggaacaataaaggagcgggtgaaa

SEQ ID NO: 141893 - DNA, 35 bp, Artificial Sequence
  Synthetic oligonucleotide
gccatccgccctgttttaaccattgttgtcagcaa

SEQ ID NO: 141894 - DNA, 35 bp, Artificial Sequence
  Synthetic oligonucleotide
agatagggcatgggtgggcaccggcggagggggca

SEQ ID NO: 141895 - DNA, 37 bp, Artificial Sequence
  Synthetic oligonucleotide
aatgcgagggggtgggcaggcaggtacggagggaaga

SEQ ID NO: 141896 - DNA, 37 bp, Artificial Sequence
  Synthetic oligonucleotide
gaagtcagggagggggggcaagattagggctttgaga

SEQ ID NO: 141897 - DNA, 37 bp, Artificial Sequence
  Synthetic oligonucleotide
gatgcgcagccttgtcggcacatgtcactccccccga

SEQ ID NO: 141898 - DNA, 37 bp, Artificial Sequence
  Synthetic oligonucleotide
gtacgtctcgcgtttatggtctccccgtcctgcccga

SEQ ID NO: 141899 - DNA, 37 bp, Artificial Sequence
  Synthetic oligonucleotide
ggatcccgccgatacccacactgcattccatcctcga

SEQ ID NO: 141900 - DNA, 38 bp, Artificial Sequence
  Synthetic oligonucleotide
gatcaccgcccacctcatttcatagctttcccccgtga

SEQ ID NO: 141901 - DNA, 35 bp, Artificial Sequence
  Synthetic oligonucleotide
acacgcccccccttggcctgttctcttactcgtga

SEQ ID NO: 141902 - DNA, 36 bp, Artificial Sequence
  Synthetic oligonucleotide
gtcggagaaaagtcgggggtaggaggggaggggtga

SEQ ID NO: 141903 - DNA, 38 bp, Artificial Sequence
  Synthetic oligonucleotide
tagaactccgccacctggtctcatagccactgacttga

SEQ ID NO: 141904 - DNA, 36 bp, Artificial Sequence
  Synthetic oligonucleotide
gtgtacgcgcactggttaccgccaccctctgtcgta

SEQ ID NO: 141905 - DNA, 36 bp, Artificial Sequence
  Synthetic oligonucleotide
tacatccgccgccaagcttcaatcagcttactatta

SEQ ID NO: 141906 - DNA, 36 bp, Artificial Sequence
  Synthetic oligonucleotide
gatgggtaggtgggaggggagaagagtccaatgtta

SEQ ID NO: 141907 - DNA, 35 bp, Artificial Sequence
  Synthetic oligonucleotide
gaccggtgccccaccatgtctcccgatctttttta

SEQ ID NO: 141908 - DNA, 35 bp, Artificial Sequence
  Synthetic oligonucleotide
tccacccccagatgtcacctagctgccgattccac

SEQ ID NO: 141909 - DNA, 35 bp, Artificial Sequence
  Synthetic oligonucleotide
gctacctcctcccggtttatcgtgttgctgttcac

SEQ ID NO: 141910 - DNA, 35 bp, Artificial Sequence
  Synthetic oligonucleotide
attgctcccttccggtggtttcgaatctacctacc

SEQ ID NO: 141911 - DNA, 35 bp, Artificial Sequence
  Synthetic oligonucleotide
gcggagctgcccccctgttgccaaaaggtccgccc

SEQ ID NO: 141912 - DNA, 35 bp, Artificial Sequence
  Synthetic oligonucleotide
gccgcatatcaacgtactctcctgtgccatcgccc

SEQ ID NO: 141913 - DNA, 35 bp, Artificial Sequence
  Synthetic oligonucleotide
gaacacccccctccccggcgctataacccgtggcc

SEQ ID NO: 141914 - DNA, 35 bp, Artificial Sequence
  Synthetic oligonucleotide
ttccctccgctacccgacttaccattgtgcgttcc

SEQ ID NO: 141915 - DNA, 35 bp, Artificial Sequence
  Synthetic oligonucleotide
tacactcgcccagtccgtttctagccgtattttcc

SEQ ID NO: 141916 - DNA, 35 bp, Artificial Sequence
  Synthetic oligonucleotide
atcaaccgactgcccgccttccacttggcatccgc

SEQ ID NO: 141917 - DNA, 35 bp, Artificial Sequence
  Synthetic oligonucleotide
gatgcataccatcgattgtgtgccatcccttcttc

SEQ ID NO: 141918 - DNA, 35 bp, Artificial Sequence
  Synthetic oligonucleotide
gcaccacccggactggccgactcaacatactaccg

SEQ ID NO: 141919 - DNA, 35 bp, Artificial Sequence
  Synthetic oligonucleotide
gcccaaccctgcacctcttactgatgttactttcg

SEQ ID NO: 141920 - DNA, 35 bp, Artificial Sequence
  Synthetic oligonucleotide
atgacctccactcacgaccgactaggtgcaccttg

SEQ ID NO: 141921 - DNA, 35 bp, Artificial Sequence
  Synthetic oligonucleotide
gtcgaccaccccctttaaatgcgcgctcgctccat

SEQ ID NO: 141922 - DNA, 35 bp, Artificial Sequence
  Synthetic oligonucleotide
gacacgggagggagaactaaggagggatgggagat

SEQ ID NO: 141923 - DNA, 35 bp, Artificial Sequence
  Synthetic oligonucleotide
gaaaccccaatgcattgaacggccccctggaccct

SEQ ID NO: 141924 - DNA, 35 bp, Artificial Sequence
  Synthetic oligonucleotide
tctatcgctcacaacatgtctcacaccgcccggct

SEQ ID NO: 141925 - DNA, 35 bp, Artificial Sequence
  Synthetic oligonucleotide
tatgccttcacactgctgagttcgctgatccatct

SEQ ID NO: 141926 - DNA, 35 bp, Artificial Sequence
  Synthetic oligonucleotide
atactgccgcacactgaccccactccacgaatcgt

SEQ ID NO: 141927 - DNA, 35 bp, Artificial Sequence
  Synthetic oligonucleotide
tgtgtccgtatgccgtcgcttctcccccgtgccaa

SEQ ID NO: 141928 - DNA, 36 bp, Artificial Sequence
  Synthetic oligonucleotide
tgcgccctcccttccgcccatttcggtctaagccca

SEQ ID NO: 141929 - DNA, 36 bp, Artificial Sequence
  Synthetic oligonucleotide
tccccacctcattttctatcttctgctcccgtgcca

SEQ ID NO: 141930 - DNA, 36 bp, Artificial Sequence
  Synthetic oligonucleotide
cctgcccccctctgctccgtccagtcttcacgctca

SEQ ID NO: 141931 - DNA, 35 bp, Artificial Sequence
  Synthetic oligonucleotide
gcctcctcgttgttcggtccttgcccacccggtca

SEQ ID NO: 141932 - DNA, 35 bp, Artificial Sequence
  Synthetic oligonucleotide
atgccctccctgctgaccaatgcgccctcatgtca

SEQ ID NO: 141933 - DNA, 36 bp, Artificial Sequence
  Synthetic oligonucleotide
ttaggacgggggaaggaggggccgaataaagcaaga

SEQ ID NO: 141934 - DNA, 36 bp, Artificial Sequence
  Synthetic oligonucleotide
tctttcaccgcagtcgccctcttgaacctcctccga

SEQ ID NO: 141935 - DNA, 35 bp, Artificial Sequence
  Synthetic oligonucleotide
gatcccgcattattacccctgccgaccctcttcga

SEQ ID NO: 141936 - DNA, 37 bp, Artificial Sequence
  Synthetic oligonucleotide
aaagacagggtggaagcaggggggaagaggaatggga

SEQ ID NO: 141937 - DNA, 38 bp, Artificial Sequence
  Synthetic oligonucleotide
gttcgccaccctcccgactgctttatctgcatgcatga

SEQ ID NO: 141938 - DNA, 38 bp, Artificial Sequence
  Synthetic oligonucleotide
ttcgccgccgcactctttatgccgcccttcgcctatga

SEQ ID NO: 141939 - DNA, 37 bp, Artificial Sequence
  Synthetic oligonucleotide
gcgcccccccacactgccatactctgcaccttgttga

SEQ ID NO: 141940 - DNA, 35 bp, Artificial Sequence
  Synthetic oligonucleotide
atcacaccgtgtccacaactgtcgttctataccac

SEQ ID NO: 141941 - DNA, 35 bp, Artificial Sequence
  Synthetic oligonucleotide
gcgcctgcctcgtagaaacctcccccctctggcac

SEQ ID NO: 141942 - DNA, 35 bp, Artificial Sequence
  Synthetic oligonucleotide
gtggtcagtgatgtcttacacactccctcccctac

SEQ ID NO: 141943 - DNA, 35 bp, Artificial Sequence
  Synthetic oligonucleotide
tgacatgacgcatatctttccctgtaggcctgtac

SEQ ID NO: 141944 - DNA, 35 bp, Artificial Sequence
  Synthetic oligonucleotide
atacaacgccatgggtccatccttctcctgcttac

SEQ ID NO: 141945 - DNA, 35 bp, Artificial Sequence
  Synthetic oligonucleotide
agtatccaccgctgtttgataatgccttcactacc

SEQ ID NO: 141946 - DNA, 35 bp, Artificial Sequence
  Synthetic oligonucleotide
tgtacctctgttatggttttgctcccaccttatcc

SEQ ID NO: 141947 - DNA, 35 bp, Artificial Sequence
  Synthetic oligonucleotide
tgcaactactccggggctcgccgttaagtccttcc

SEQ ID NO: 141948 - DNA, 35 bp, Artificial Sequence
  Synthetic oligonucleotide
gactcacccccccgattgcttccgtaccgccacgc

SEQ ID NO: 141949 - DNA, 35 bp, Artificial Sequence
  Synthetic oligonucleotide
tacgcgcttccgtccagtgccttcataccacctgc

SEQ ID NO: 141950 - DNA, 35 bp, Artificial Sequence
  Synthetic oligonucleotide
ttccgccaccgggcattagcatacactgctacctc

SEQ ID NO: 141951 - DNA, 35 bp, Artificial Sequence
  Synthetic oligonucleotide
acagtgccgaccccttgacttgacccgtctccctc

SEQ ID NO: 141952 - DNA, 35 bp, Artificial Sequence
  Synthetic oligonucleotide
gacgaagcgcatcctctctgttctatcttagcctc

SEQ ID NO: 141953 - DNA, 35 bp, Artificial Sequence
  Synthetic oligonucleotide
tgcccgcccccttacactcgttttgcctgcagtag

SEQ ID NO: 141954 - DNA, 35 bp, Artificial Sequence
  Synthetic oligonucleotide
actcttccaccctcccgagtgacgtcgtcccgacg

SEQ ID NO: 141955 - DNA, 35 bp, Artificial Sequence
  Synthetic oligonucleotide
tgcccaagcccaccccccacagccgtaccaaggcg

SEQ ID NO: 141956 - DNA, 35 bp, Artificial Sequence
  Synthetic oligonucleotide
gtagcccaccgtcaccatgccgcgctgccatcact

SEQ ID NO: 141957 - DNA, 35 bp, Artificial Sequence
  Synthetic oligonucleotide
gcacacacgacctgtttgggcctaaaccctttcct

SEQ ID NO: 141958 - DNA, 35 bp, Artificial Sequence
  Synthetic oligonucleotide
gtatcccacctgtgcacttcgctttatacttgtct

SEQ ID NO: 141959 - DNA, 35 bp, Artificial Sequence
  Synthetic oligonucleotide
tagccccactcctcatcacctttaagggcttgttt

SEQ ID NO: 141960 - DNA, 35 bp, Artificial Sequence
  Synthetic oligonucleotide
atgtcggtggccagcttcattattcccatcgccca

SEQ ID NO: 141961 - DNA, 36 bp, Artificial Sequence
  Synthetic oligonucleotide
caccatcccccggaccatgagcacccctggcctcca

SEQ ID NO: 141962 - DNA, 35 bp, Artificial Sequence
  Synthetic oligonucleotide
tatcatgccccgccacactggtactccctcgggca

SEQ ID NO: 141963 - DNA, 37 bp, Artificial Sequence
  Synthetic oligonucleotide
agtgggggagaggtgaaggaggaaacacatgggcaga

SEQ ID NO: 141964 - DNA, 37 bp, Artificial Sequence
  Synthetic oligonucleotide
agggacggaccggggggagggatcgtcagcctgggga

SEQ ID NO: 141965 - DNA, 37 bp, Artificial Sequence
  Synthetic oligonucleotide
tatccgccacccatccgcgccctgcccttatcaatga

SEQ ID NO: 141966 - DNA, 36 bp, Artificial Sequence
  Synthetic oligonucleotide
ataacgggcgggggtggtgggcacagcttctcatga

SEQ ID NO: 141967 - DNA, 38 bp, Artificial Sequence
  Synthetic oligonucleotide
atggtggtggaggcggagtgaaacggcgggattgatga

SEQ ID NO: 141968 - DNA, 38 bp, Artificial Sequence
  Synthetic oligonucleotide
atgcaccatcggctagccggtccctttccatcacttga

SEQ ID NO: 141969 - DNA, 37 bp, Artificial Sequence
  Synthetic oligonucleotide
acccctgcatgtacaggacctgcccctgcccccttga

SEQ ID NO: 141970 - DNA, 38 bp, Artificial Sequence
  Synthetic oligonucleotide
gacctccggcctcccgctgccttcctggtcctccttga

SEQ ID NO: 141971 - DNA, 36 bp, Artificial Sequence
  Synthetic oligonucleotide
gcgttctcagcccatactgcgctattccactcttga

SEQ ID NO: 141972 - DNA, 35 bp, Artificial Sequence
  Synthetic oligonucleotide
gtgactccccctcagcccttgatcatcaagcaata

SEQ ID NO: 141973 - DNA, 36 bp, Artificial Sequence
  Synthetic oligonucleotide
gtccccatcccgttgatatagaccgccctctaatta

SEQ ID NO: 141974 - DNA, 36 bp, Artificial Sequence
  Synthetic oligonucleotide
gccacgctggactgccggatatatgccctctttcac

SEQ ID NO: 141975 - DNA, 35 bp, Artificial Sequence
  Synthetic oligonucleotide
tttccctgccccattctttcacgtgctacgccacc

SEQ ID NO: 141976 - DNA, 35 bp, Artificial Sequence
  Synthetic oligonucleotide
atctcccgtcgcctgtattattctgtgtgtcatcc

SEQ ID NO: 141977 - DNA, 35 bp, Artificial Sequence
  Synthetic oligonucleotide
atccgccccctgttcgcttgttcctgcttaaatgc

SEQ ID NO: 141978 - DNA, 35 bp, Artificial Sequence
  Synthetic oligonucleotide
atgccttcctccacgtagtaacccgggcctaactc

SEQ ID NO: 141979 - DNA, 35 bp, Artificial Sequence
  Synthetic oligonucleotide
gtgctacgtgcgacggtaccacctgcccctttgtc

SEQ ID NO: 141980 - DNA, 35 bp, Artificial Sequence
  Synthetic oligonucleotide
accgcggcttcctcaccggtgctcccccccctttc

SEQ ID NO: 141981 - DNA, 35 bp, Artificial Sequence
  Synthetic oligonucleotide
gctgggtcggggggggagatatgatgagcgtgcag

SEQ ID NO: 141982 - DNA, 35 bp, Artificial Sequence
  Synthetic oligonucleotide
gcagtccggagggtagggggggggccaggacggag

SEQ ID NO: 141983 - DNA, 35 bp, Artificial Sequence
  Synthetic oligonucleotide
tctgtacgctccgacccatttagtatctccgcccg

SEQ ID NO: 141984 - DNA, 35 bp, Artificial Sequence
  Synthetic oligonucleotide
acatgcccgttccccgtcacacctcgagtgcatcg

SEQ ID NO: 141985 - DNA, 35 bp, Artificial Sequence
  Synthetic oligonucleotide
gggacatgcggagggaggagaaggaatagtggtgg

SEQ ID NO: 141986 - DNA, 35 bp, Artificial Sequence
  Synthetic oligonucleotide
gcaacattttgcaccatgtccgccttccctaccct

SEQ ID NO: 141987 - DNA, 35 bp, Artificial Sequence
  Synthetic oligonucleotide
gcccacaccccggaactgaatgcgcactccatgct

SEQ ID NO: 141988 - DNA, 36 bp, Artificial Sequence
  Synthetic oligonucleotide
gatacagagacgggggggtaggtagtgtggtggaaa

SEQ ID NO: 141989 - DNA, 35 bp, Artificial Sequence
  Synthetic oligonucleotide
gcacgcattttgccgctcctctttgcccgttgaaa

SEQ ID NO: 141990 - DNA, 36 bp, Artificial Sequence
  Synthetic oligonucleotide
gctgccgagcgcacttggcaccatcttgttccccaa

SEQ ID NO: 141991 - DNA, 36 bp, Artificial Sequence
  Synthetic oligonucleotide
gtacgccccgcatttggtgcaccttttccgctgtaa

SEQ ID NO: 141992 - DNA, 36 bp, Artificial Sequence
  Synthetic oligonucleotide
tcgacgcacctcgtacatcatcgcccgggtccaaca

SEQ ID NO: 141993 - DNA, 35 bp, Artificial Sequence
  Synthetic oligonucleotide
atgaccaccttagaatgcgctatatttttacccca

SEQ ID NO: 141994 - DNA, 36 bp, Artificial Sequence
  Synthetic oligonucleotide
tccaggcacccgccctatctatcctgggttgtccca

SEQ ID NO: 141995 - DNA, 36 bp, Artificial Sequence
  Synthetic oligonucleotide
tatgcttcagtatcctgttctatctccttctcctca

SEQ ID NO: 141996 - DNA, 36 bp, Artificial Sequence
  Synthetic oligonucleotide
gtccgcctacctacatggtttactcgcgccccttca

SEQ ID NO: 141997 - DNA, 37 bp, Artificial Sequence
  Synthetic oligonucleotide
aacggggccaggtagcggggagggcaatcggggacga

SEQ ID NO: 141998 - DNA, 37 bp, Artificial Sequence
  Synthetic oligonucleotide
cccacccgcgcagaacctgctcctcgccccgacccga

SEQ ID NO: 141999 - DNA, 37 bp, Artificial Sequence
  Synthetic oligonucleotide
gcacgcaagcccgttctccacacgtatcacctctcga

SEQ ID NO: 142000 - DNA, 36 bp, Artificial Sequence
  Synthetic oligonucleotide
tgagccctccattttccacgcccgctgtccttagga

SEQ ID NO: 142001 - DNA, 37 bp, Artificial Sequence
  Synthetic oligonucleotide
gttccgagggagggggggaggaaagattgggccggga

SEQ ID NO: 142002 - DNA, 37 bp, Artificial Sequence
  Synthetic oligonucleotide
tatggtgcgccctgccttccacgttccccattttgga

SEQ ID NO: 142003 - DNA, 38 bp, Artificial Sequence
  Synthetic oligonucleotide
tgagggcggagggaggtgggtggatttggacggtatga

SEQ ID NO: 142004 - DNA, 38 bp, Artificial Sequence
  Synthetic oligonucleotide
tcaccaaccttcctgccttacagtcatcacgtcagtga

SEQ ID NO: 142005 - DNA, 38 bp, Artificial Sequence
  Synthetic oligonucleotide
gccatcctgccagtgattacgttcgcctggtccattga

SEQ ID NO: 142006 - DNA, 36 bp, Artificial Sequence
  Synthetic oligonucleotide
gtgtgccgcagtaaccgctctctaccgtccccttga

SEQ ID NO: 142007 - DNA, 38 bp, Artificial Sequence
  Synthetic oligonucleotide
agagagggagggccgggtaaatggggggaacgtcttga

SEQ ID NO: 142008 - DNA, 35 bp, Artificial Sequence
  Synthetic oligonucleotide
gcccgcggctagctttgattcgccccgtctttcac

SEQ ID NO: 142009 - DNA, 35 bp, Artificial Sequence
  Synthetic oligonucleotide
ttatcgggtccctgcctcactctgtcctagcaacc

SEQ ID NO: 142010 - DNA, 35 bp, Artificial Sequence
  Synthetic oligonucleotide
ggacagcccgcgccactcccctgttattaacagcc

SEQ ID NO: 142011 - DNA, 35 bp, Artificial Sequence
  Synthetic oligonucleotide
gagacaccggctctaacgtgcacacccgcttcgcc

SEQ ID NO: 142012 - DNA, 35 bp, Artificial Sequence
  Synthetic oligonucleotide
attcccatccttcgccttggttttttgtgactgcc

SEQ ID NO: 142013 - DNA, 35 bp, Artificial Sequence
  Synthetic oligonucleotide
gttccatgccgtagcgctgttagtcgtccccgtcc

SEQ ID NO: 142014 - DNA, 35 bp, Artificial Sequence
  Synthetic oligonucleotide
tcacacccatggccccgttaaacccggtcacctgc

SEQ ID NO: 142015 - DNA, 35 bp, Artificial Sequence
  Synthetic oligonucleotide
tctgagtccaggaacgctgccctcgcccccacatc

SEQ ID NO: 142016 - DNA, 35 bp, Artificial Sequence
  Synthetic oligonucleotide
tatccagtgggaaagggagggtgagagcttgggcg

SEQ ID NO: 142017 - DNA, 35 bp, Artificial Sequence
  Synthetic oligonucleotide
tccaagcccccaatcgtctccctcggttctactgg

SEQ ID NO: 142018 - DNA, 35 bp, Artificial Sequence
  Synthetic oligonucleotide
accttccactgggcacctcgctatgctttcttcct

SEQ ID NO: 142019 - DNA, 35 bp, Artificial Sequence
  Synthetic oligonucleotide
gccccctcatccccgccggtgctcgccctgacagt

SEQ ID NO: 142020 - DNA, 36 bp, Artificial Sequence
  Synthetic oligonucleotide
tctcgtgggtgggtgggaacgggtagtgcgcggaaa

SEQ ID NO: 142021 - DNA, 35 bp, Artificial Sequence
  Synthetic oligonucleotide
atcacccgcgttacccctaggtcctgttcttccaa

SEQ ID NO: 142022 - DNA, 36 bp, Artificial Sequence
  Synthetic oligonucleotide
gccggtgtccgcggaggggggtggggggattagcaa

SEQ ID NO: 142023 - DNA, 36 bp, Artificial Sequence
  Synthetic oligonucleotide
tctcatgcacccatcctgcctttctctaccgagaca

SEQ ID NO: 142024 - DNA, 37 bp, Artificial Sequence
  Synthetic oligonucleotide
ggatgaggaggacgggttgggaaaggtgaggccgaga

SEQ ID NO: 142025 - DNA, 37 bp, Artificial Sequence
  Synthetic oligonucleotide
gtccgaagaaccaatgggatatgggggggtgggtaga

SEQ ID NO: 142026 - DNA, 36 bp, Artificial Sequence
  Synthetic oligonucleotide
gcccttcctccgtggtgcccacttgctttcccccga

SEQ ID NO: 142027 - DNA, 37 bp, Artificial Sequence
  Synthetic oligonucleotide
tgttaccccccactgtcacaagacctcacgttatcga

SEQ ID NO: 142028 - DNA, 37 bp, Artificial Sequence
  Synthetic oligonucleotide
tgattacgccgatctcttccccacgcccacactcgga

SEQ ID NO: 142029 - DNA, 37 bp, Artificial Sequence
  Synthetic oligonucleotide
ggaggaggcggggtgtggcgggaggccaccttctgga

SEQ ID NO: 142030 - DNA, 38 bp, Artificial Sequence
  Synthetic oligonucleotide
gatgggcgaggaacggtggcgcgagaacgggacgatga

SEQ ID NO: 142031 - DNA, 38 bp, Artificial Sequence
  Synthetic oligonucleotide
ccaccccctcccagtcttgtactacccgattgccctga

SEQ ID NO: 142032 - DNA, 38 bp, Artificial Sequence
  Synthetic oligonucleotide
gactcgtacacatctgcccttcggttccgtactcctga

SEQ ID NO: 142033 - DNA, 38 bp, Artificial Sequence
  Synthetic oligonucleotide
atccgcccgtttgttcggacctttgccactcttcctga

SEQ ID NO: 142034 - DNA, 38 bp, Artificial Sequence
  Synthetic oligonucleotide
atcgccacgccctcgttaacttctctgcatcctagtga

SEQ ID NO: 142035 - DNA, 38 bp, Artificial Sequence
  Synthetic oligonucleotide
gacactcgccgtccatccctctccgaccccagtagtga

SEQ ID NO: 142036 - DNA, 37 bp, Artificial Sequence
  Synthetic oligonucleotide
atgcaccccactagtcgtttcgtaccaccctaattga

SEQ ID NO: 142037 - DNA, 38 bp, Artificial Sequence
  Synthetic oligonucleotide
tctgcgccctcattcgtttcccttgtctgcgcccttga

SEQ ID NO: 142038 - DNA, 36 bp, Artificial Sequence
  Synthetic oligonucleotide
tgacaaccgccaccatcggcttgaactcgctcccta

SEQ ID NO: 142039 - DNA, 36 bp, Artificial Sequence
  Synthetic oligonucleotide
gccacttcgcgtagcataacctcgtatcacctcgta

SEQ ID NO: 142040 - DNA, 35 bp, Artificial Sequence
  Synthetic oligonucleotide
gtcctacccacggacgcgttgcactagctcatcac

SEQ ID NO: 142041 - DNA, 35 bp, Artificial Sequence
  Synthetic oligonucleotide
tcaccgagagcattccccaagtgatccgttctacc

SEQ ID NO: 142042 - DNA, 35 bp, Artificial Sequence
  Synthetic oligonucleotide
acactagcgggctaccgttactctggcttctcccc

SEQ ID NO: 142043 - DNA, 35 bp, Artificial Sequence
  Synthetic oligonucleotide
acaacagacttccattgtccacatcggacccgccc

SEQ ID NO: 142044 - DNA, 35 bp, Artificial Sequence
  Synthetic oligonucleotide
gtgactgtcggcgccattcataggtccattctccc

SEQ ID NO: 142045 - DNA, 35 bp, Artificial Sequence
  Synthetic oligonucleotide
ttctcacccgcgccccgtttcgttatacgcaatcc

SEQ ID NO: 142046 - DNA, 35 bp, Artificial Sequence
  Synthetic oligonucleotide
tccaccttccccatgtcttttttcggaccttctcc

SEQ ID NO: 142047 - DNA, 35 bp, Artificial Sequence
  Synthetic oligonucleotide
tcccccctgctgccttccgtttaaactcggtacgc

SEQ ID NO: 142048 - DNA, 35 bp, Artificial Sequence
  Synthetic oligonucleotide
atcttgaggccccctgatccccaccacgctattgc

SEQ ID NO: 142049 - DNA, 35 bp, Artificial Sequence
  Synthetic oligonucleotide
tccttcatcccgcgcattcacatattggtcacttc

SEQ ID NO: 142050 - DNA, 35 bp, Artificial Sequence
  Synthetic oligonucleotide
gacccgtacatggccgagccatcctgaccaccccg

SEQ ID NO: 142051 - DNA, 35 bp, Artificial Sequence
  Synthetic oligonucleotide
ggtgggggggtagggcaatgggtgttcaaagcggg

SEQ ID NO: 142052 - DNA, 35 bp, Artificial Sequence
  Synthetic oligonucleotide
taccgcgctagcccgcatttgttccccgaacctct

SEQ ID NO: 142053 - DNA, 35 bp, Artificial Sequence
  Synthetic oligonucleotide
gttccagcccagcctatgccccatctgccgaccgt

SEQ ID NO: 142054 - DNA, 35 bp, Artificial Sequence
  Synthetic oligonucleotide
gcacaccatccgcatgacaaccgtccagctttatt

SEQ ID NO: 142055 - DNA, 35 bp, Artificial Sequence
  Synthetic oligonucleotide
cacgcctcccaaccatccatcgagcctcgactctt

SEQ ID NO: 142056 - DNA, 35 bp, Artificial Sequence
  Synthetic oligonucleotide
tctagccccacagcttccgcgcccgtattgccttt

SEQ ID NO: 142057 - DNA, 36 bp, Artificial Sequence
  Synthetic oligonucleotide
gtgaccgccccatcttgcgccgcctctccttgacaa

SEQ ID NO: 142058 - DNA, 35 bp, Artificial Sequence
  Synthetic oligonucleotide
gtcatccagctgactatatctgcccatcttacgaa

SEQ ID NO: 142059 - DNA, 36 bp, Artificial Sequence
  Synthetic oligonucleotide
agcccctctcgactcgctatgtaaggcccccacaca

SEQ ID NO: 142060 - DNA, 35 bp, Artificial Sequence
  Synthetic oligonucleotide
gccccctccagattgcctacgctcgatcataccca

SEQ ID NO: 142061 - DNA, 36 bp, Artificial Sequence
  Synthetic oligonucleotide
gattaccgacgccctgtcaagccctcgttcctctca

SEQ ID NO: 142062 - DNA, 37 bp, Artificial Sequence
  Synthetic oligonucleotide
ggagacaggcattagggcagggaagggtaaggggaga

SEQ ID NO: 142063 - DNA, 37 bp, Artificial Sequence
  Synthetic oligonucleotide
tagggtgctctcagtgtgaggtggggggggagggcga

SEQ ID NO: 142064 - DNA, 37 bp, Artificial Sequence
  Synthetic oligonucleotide
aacacgtccccgatccctatggtgctatccctttcga

SEQ ID NO: 142065 - DNA, 35 bp, Artificial Sequence
  Synthetic oligonucleotide
aagagggaggagggagaattgacgcaatcggtgga

SEQ ID NO: 142066 - DNA, 37 bp, Artificial Sequence
  Synthetic oligonucleotide
atgggcgggagggatcggggacgtaccaacactctga

SEQ ID NO: 142067 - DNA, 36 bp, Artificial Sequence
  Synthetic oligonucleotide
taacatcctcagcggcacttagctcccccgttagta

SEQ ID NO: 142068 - DNA, 35 bp, Artificial Sequence
  Synthetic oligonucleotide
gttaccgcccccccaaccccacgtttcgagaacac

SEQ ID NO: 142069 - DNA, 35 bp, Artificial Sequence
  Synthetic oligonucleotide
tcagccacccccgccttgccctcgttcgtatcgac

SEQ ID NO: 142070 - DNA, 35 bp, Artificial Sequence
  Synthetic oligonucleotide
gttcgagagcggggggcgggtcgggttaagggtac

SEQ ID NO: 142071 - DNA, 35 bp, Artificial Sequence
  Synthetic oligonucleotide
tccgcccccataccgccccttgagtagtcatgtac

SEQ ID NO: 142072 - DNA, 35 bp, Artificial Sequence
  Synthetic oligonucleotide
tgtgcaatatactgagcatgtcagccgcccccccc

SEQ ID NO: 142073 - DNA, 35 bp, Artificial Sequence
  Synthetic oligonucleotide
tccgtccctcagcgaataaatccatctgtctcccc

SEQ ID NO: 142074 - DNA, 35 bp, Artificial Sequence
  Synthetic oligonucleotide
tgccacgctggccatccgtatgatccccccacgcc

SEQ ID NO: 142075 - DNA, 35 bp, Artificial Sequence
  Synthetic oligonucleotide
tcccgcaccgaaatgccttgttttgtatgctctcc

SEQ ID NO: 142076 - DNA, 35 bp, Artificial Sequence
  Synthetic oligonucleotide
tagtcactccactaaatgcatctgcaccatcttgc

SEQ ID NO: 142077 - DNA, 35 bp, Artificial Sequence
  Synthetic oligonucleotide
gacatccagctctgcactttgcggctaccttactc

SEQ ID NO: 142078 - DNA, 35 bp, Artificial Sequence
  Synthetic oligonucleotide
acctcacgccgaacctagcagtgtcccacctcctc

SEQ ID NO: 142079 - DNA, 34 bp, Artificial Sequence
  Synthetic oligonucleotide
gggaccgcccgtgcaccacgttagtcccgtcctc

SEQ ID NO: 142080 - DNA, 35 bp, Artificial Sequence
  Synthetic oligonucleotide
agccaaccgacatcatgcagtccttcgcaccattc

SEQ ID NO: 142081 - DNA, 35 bp, Artificial Sequence
  Synthetic oligonucleotide
tacgcccattccctccgccctttatgctactgttc

SEQ ID NO: 142082 - DNA, 35 bp, Artificial Sequence
  Synthetic oligonucleotide
acgtcgcgaaatatcgcctaccaccgcccccgccg

SEQ ID NO: 142083 - DNA, 35 bp, Artificial Sequence
  Synthetic oligonucleotide
ttgccttcctcctgagctgatcgccattacttccg

SEQ ID NO: 142084 - DNA, 35 bp, Artificial Sequence
  Synthetic oligonucleotide
gggacaaatcgcatgggtgggctcattttgctggg

SEQ ID NO: 142085 - DNA, 35 bp, Artificial Sequence
  Synthetic oligonucleotide
ggtcgcaagggagggactaagggggggcgttctgg

SEQ ID NO: 142086 - DNA, 35 bp, Artificial Sequence
  Synthetic oligonucleotide
gacgcaagtccacggccgccattcccccccagctg

SEQ ID NO: 142087 - DNA, 35 bp, Artificial Sequence
  Synthetic oligonucleotide
gccacctcccggtttgatactcccccatttaacat

SEQ ID NO: 142088 - DNA, 35 bp, Artificial Sequence
  Synthetic oligonucleotide
tttcatccgccgttctttctgatatccgtgccact

SEQ ID NO: 142089 - DNA, 35 bp, Artificial Sequence
  Synthetic oligonucleotide
tgtccccctgccccccaatctttatcccgggacct

SEQ ID NO: 142090 - DNA, 35 bp, Artificial Sequence
  Synthetic oligonucleotide
tccccattcactcgcctattcgatctcgggtacct

SEQ ID NO: 142091 - DNA, 35 bp, Artificial Sequence
  Synthetic oligonucleotide
gactacacccgggtcgataatcagatcctcctcct

SEQ ID NO: 142092 - DNA, 35 bp, Artificial Sequence
  Synthetic oligonucleotide
gtaccagccgcgcttgcctatttgcgctcgtttct

SEQ ID NO: 142093 - DNA, 36 bp, Artificial Sequence
  Synthetic oligonucleotide
gagcaatgccctagccgctgttcccttacccgcaaa

SEQ ID NO: 142094 - DNA, 36 bp, Artificial Sequence
  Synthetic oligonucleotide
atagccgccctcttcgtctcacctcgtgcatgtgca

SEQ ID NO: 142095 - DNA, 36 bp, Artificial Sequence
  Synthetic oligonucleotide
tgcctgcccgtccaatcccccgccccccgatgaaga

SEQ ID NO: 142096 - DNA, 37 bp, Artificial Sequence
  Synthetic oligonucleotide
tgtgcaaggggagggggaggatagagaagcgacccga

SEQ ID NO: 142097 - DNA, 37 bp, Artificial Sequence
  Synthetic oligonucleotide
tcaacgaaagcagggggcgacaacgggagggcaagga

SEQ ID NO: 142098 - DNA, 36 bp, Artificial Sequence
  Synthetic oligonucleotide
actcgcgggggtggtgtcgaggggatgggaggagga

SEQ ID NO: 142099 - DNA, 36 bp, Artificial Sequence
  Synthetic oligonucleotide
tcaggaggaggggaggtggaggaggtggctttagga

SEQ ID NO: 142100 - DNA, 37 bp, Artificial Sequence
  Synthetic oligonucleotide
aggtcaaagcagggggagggaagggaactaacgcgga

SEQ ID NO: 142101 - DNA, 37 bp, Artificial Sequence
  Synthetic oligonucleotide
agtggatggaaggtgggaaaagggctaagacggatga

SEQ ID NO: 142102 - DNA, 38 bp, Artificial Sequence
  Synthetic oligonucleotide
gccctctcctccgccgtgatccgcgtgacccttcgtga

SEQ ID NO: 142103 - DNA, 36 bp, Artificial Sequence
  Synthetic oligonucleotide
tgccgctgatggcgtactcccgcaacccccctctta

SEQ ID NO: 142104 - DNA, 34 bp, Artificial Sequence
  Synthetic oligonucleotide
gtagcaacacttccggattccgtgacccgccacc

SEQ ID NO: 142105 - DNA, 35 bp, Artificial Sequence
  Synthetic oligonucleotide
agtgggcctccacctgtctattcgctctctgtacc

SEQ ID NO: 142106 - DNA, 35 bp, Artificial Sequence
  Synthetic oligonucleotide
accaacgtcgtcatcggtactccctcttgtttacc

SEQ ID NO: 142107 - DNA, 35 bp, Artificial Sequence
  Synthetic oligonucleotide
tcccgtcacagtttatccccctttagtaggccccc

SEQ ID NO: 142108 - DNA, 35 bp, Artificial Sequence
  Synthetic oligonucleotide
acctcagccatccgaaactagctccccacggtccc

SEQ ID NO: 142109 - DNA, 35 bp, Artificial Sequence
  Synthetic oligonucleotide
agttcatcacctcaaatggctgaccgccccccgcc

SEQ ID NO: 142110 - DNA, 33 bp, Artificial Sequence
  Synthetic oligonucleotide
tagcctcgaaccctatcactccacggtgcctcc

SEQ ID NO: 142111 - DNA, 35 bp, Artificial Sequence
  Synthetic oligonucleotide
gcccaccatcaacttgacacattgtgctgttctcc

SEQ ID NO: 142112 - DNA, 35 bp, Artificial Sequence
  Synthetic oligonucleotide
tgcacgctcatagcgcccccgctttctatcctggc

SEQ ID NO: 142113 - DNA, 35 bp, Artificial Sequence
  Synthetic oligonucleotide
tgtgccctagcctcacttgtatcacgttcttcctc

SEQ ID NO: 142114 - DNA, 35 bp, Artificial Sequence
  Synthetic oligonucleotide
ccctcgcaccatcgttacactcgcccgggcctctc

SEQ ID NO: 142115 - DNA, 35 bp, Artificial Sequence
  Synthetic oligonucleotide
tctggtaggcggggcgtgtttggggtagggtggtc

SEQ ID NO: 142116 - DNA, 35 bp, Artificial Sequence
  Synthetic oligonucleotide
aaccccgtccctgcaacccacttagtacaccgttc

SEQ ID NO: 142117 - DNA, 32 bp, Artificial Sequence
  Synthetic oligonucleotide
atccccatgtgatgtccttagcctctctttag

SEQ ID NO: 142118 - DNA, 35 bp, Artificial Sequence
  Synthetic oligonucleotide
gaccacgcgcactcaccgtcaatttcccacgtacg

SEQ ID NO: 142119 - DNA, 35 bp, Artificial Sequence
  Synthetic oligonucleotide
ttcagatccaatcgttacttccgcctgctaattcg

SEQ ID NO: 142120 - DNA, 35 bp, Artificial Sequence
  Synthetic oligonucleotide
gtcgaggggtagggagttggtggagcattgaacgg

SEQ ID NO: 142121 - DNA, 35 bp, Artificial Sequence
  Synthetic oligonucleotide
gagttgtgcgttcccttctgtcgccgtggttacct

SEQ ID NO: 142122 - DNA, 35 bp, Artificial Sequence
  Synthetic oligonucleotide
gttgcgaatcgtactgttgtttcctgcctacccct

SEQ ID NO: 142123 - DNA, 35 bp, Artificial Sequence
  Synthetic oligonucleotide
gccatcctgtaggtcctctggtcaagcctagccct

SEQ ID NO: 142124 - DNA, 35 bp, Artificial Sequence
  Synthetic oligonucleotide
agttggggaggggtgggtagggagttgttcccagt

SEQ ID NO: 142125 - DNA, 35 bp, Artificial Sequence
  Synthetic oligonucleotide
gtcccgcttccccctcgtagtccttggtcctactt

SEQ ID NO: 142126 - DNA, 35 bp, Artificial Sequence
  Synthetic oligonucleotide
tcaaccgcctcctctccatgccggctaccatcttt

SEQ ID NO: 142127 - DNA, 35 bp, Artificial Sequence
  Synthetic oligonucleotide
gcccatgccagctactactgcgtcatcactcgttt

SEQ ID NO: 142128 - DNA, 35 bp, Artificial Sequence
  Synthetic oligonucleotide
gtccctcccgccccgtgcgtacctaactaacgcaa

SEQ ID NO: 142129 - DNA, 36 bp, Artificial Sequence
  Synthetic oligonucleotide
tcccgcccatgtctactccctttgaccaccgataca

SEQ ID NO: 142130 - DNA, 36 bp, Artificial Sequence
  Synthetic oligonucleotide
gagtacgacaaacgaggtacgagggagggggggcca

SEQ ID NO: 142131 - DNA, 35 bp, Artificial Sequence
  Synthetic oligonucleotide
ttactcccccctccattgtggcgagccctgatcca

SEQ ID NO: 142132 - DNA, 35 bp, Artificial Sequence
  Synthetic oligonucleotide
agtgcgccacccgtcttcaacatagctgctatcca

SEQ ID NO: 142133 - DNA, 35 bp, Artificial Sequence
  Synthetic oligonucleotide
tactatgccctccactgctgctatatgctactcca

SEQ ID NO: 142134 - DNA, 37 bp, Artificial Sequence
  Synthetic oligonucleotide
ttctccgccccatttgcgcctcattagccctgctaga

SEQ ID NO: 142135 - DNA, 37 bp, Artificial Sequence
  Synthetic oligonucleotide
acccccatctcatttcgcgaatacacacgtcgcccga

SEQ ID NO: 142136 - DNA, 37 bp, Artificial Sequence
  Synthetic oligonucleotide
tgctacctacatcgtgcctataccagcctgcctccga

SEQ ID NO: 142137 - DNA, 36 bp, Artificial Sequence
  Synthetic oligonucleotide
acagtagccgccctctattccgagtaccccttccga

SEQ ID NO: 142138 - DNA, 37 bp, Artificial Sequence
  Synthetic oligonucleotide
gttgctccatctacagttagcccccgccgtttctcga

SEQ ID NO: 142139 - DNA, 36 bp, Artificial Sequence
  Synthetic oligonucleotide
tgtcagacccgatccatgtttgtcctcctccttcga

SEQ ID NO: 142140 - DNA, 37 bp, Artificial Sequence
  Synthetic oligonucleotide
agagggagcctagaacgggtgggagaatacaacggga

SEQ ID NO: 142141 - DNA, 38 bp, Artificial Sequence
  Synthetic oligonucleotide
taagccccccgctgctgcttctatcgaaacacctatga

SEQ ID NO: 142142 - DNA, 38 bp, Artificial Sequence
  Synthetic oligonucleotide
gctgactatggggtgggggggaagggcaagacacctga

SEQ ID NO: 142143 - DNA, 37 bp, Artificial Sequence
  Synthetic oligonucleotide
gccagtcttcaagcgtttagcctccttgccttcctga

SEQ ID NO: 142144 - DNA, 38 bp, Artificial Sequence
  Synthetic oligonucleotide
atcacccacgcctccatcccgacgagacacatcagtga

SEQ ID NO: 142145 - DNA, 37 bp, Artificial Sequence
  Synthetic oligonucleotide
gtgaagggtggtggagcaacagggagcgctgtggtga

SEQ ID NO: 142146 - DNA, 37 bp, Artificial Sequence
  Synthetic oligonucleotide
ccgatccgtaccgctcctgacctgcccttcaatttga

SEQ ID NO: 142147 - DNA, 35 bp, Artificial Sequence
  Synthetic oligonucleotide
ttcgcccccttttgatccgttacccgtgggactta

SEQ ID NO: 142148 - DNA, 35 bp, Artificial Sequence
  Synthetic oligonucleotide
tcgcactaccactcgcaattagttccatcgctacc

SEQ ID NO: 142149 - DNA, 35 bp, Artificial Sequence
  Synthetic oligonucleotide
gaactcgccctctcaccgacttgttcgtacgaccc

SEQ ID NO: 142150 - DNA, 35 bp, Artificial Sequence
  Synthetic oligonucleotide
atccgatgcccacgggtctgttgccaccccatccc

SEQ ID NO: 142151 - DNA, 35 bp, Artificial Sequence
  Synthetic oligonucleotide
agacacgctttagtctgctctgcgccgcacctccc

SEQ ID NO: 142152 - DNA, 35 bp, Artificial Sequence
  Synthetic oligonucleotide
gatccccccacattggttatccataatgcgtagcc

SEQ ID NO: 142153 - DNA, 35 bp, Artificial Sequence
  Synthetic oligonucleotide
tctacccgcctaagggttgtccctcacgctacgcc

SEQ ID NO: 142154 - DNA, 35 bp, Artificial Sequence
  Synthetic oligonucleotide
taccaccctccgctagtcttactatgttcctatcc

SEQ ID NO: 142155 - DNA, 35 bp, Artificial Sequence
  Synthetic oligonucleotide
ggagcatcgctctgcttctcgtattcgccttttcc

SEQ ID NO: 142156 - DNA, 35 bp, Artificial Sequence
  Synthetic oligonucleotide
gcctaggccgccccccgccctgtagagcctcacgc

SEQ ID NO: 142157 - DNA, 34 bp, Artificial Sequence
  Synthetic oligonucleotide
actagccgatctgtaacgatcacacttcctctgc

SEQ ID NO: 142158 - DNA, 35 bp, Artificial Sequence
  Synthetic oligonucleotide
tcctcggtcctgcctcgtaccggttaccttttatc

SEQ ID NO: 142159 - DNA, 35 bp, Artificial Sequence
  Synthetic oligonucleotide
acgcccgtgtggtcactttacgccacatgcccctc

SEQ ID NO: 142160 - DNA, 35 bp, Artificial Sequence
  Synthetic oligonucleotide
gtggggccggcttgcattatacccgtacctccctc

SEQ ID NO: 142161 - DNA, 35 bp, Artificial Sequence
  Synthetic oligonucleotide
gacccctgatcgccccctggtatgccagcttaacg

SEQ ID NO: 142162 - DNA, 35 bp, Artificial Sequence
  Synthetic oligonucleotide
tctgccccccgagcccctctgttagtccttggccg

SEQ ID NO: 142163 - DNA, 35 bp, Artificial Sequence
  Synthetic oligonucleotide
attcgtacccgtgctgcattagtccttccactccg

SEQ ID NO: 142164 - DNA, 35 bp, Artificial Sequence
  Synthetic oligonucleotide
aacgcccttccctgttcacccagatgacctgcgcg

SEQ ID NO: 142165 - DNA, 35 bp, Artificial Sequence
  Synthetic oligonucleotide
accgcccggccgaccctcgctacgaacttccacgg

SEQ ID NO: 142166 - DNA, 35 bp, Artificial Sequence
  Synthetic oligonucleotide
tcattgcaactcgcatcctgtcaaccagtcccctg

SEQ ID NO: 142167 - DNA, 35 bp, Artificial Sequence
  Synthetic oligonucleotide
tctcgttctgccagctcctaacttgttctgccctg

SEQ ID NO: 142168 - DNA, 35 bp, Artificial Sequence
  Synthetic oligonucleotide
acctcccgccccaatcgtagttgcattttagcctg

SEQ ID NO: 142169 - DNA, 35 bp, Artificial Sequence
  Synthetic oligonucleotide
gtgtcacttgcccatgtcgcctaattaccactctg

SEQ ID NO: 142170 - DNA, 35 bp, Artificial Sequence
  Synthetic oligonucleotide
aacgagggtggaggggtgatagcggcatctttttg

SEQ ID NO: 142171 - DNA, 35 bp, Artificial Sequence
  Synthetic oligonucleotide
tagcactgatctgttaactcctccttcgccttcct

SEQ ID NO: 142172 - DNA, 35 bp, Artificial Sequence
  Synthetic oligonucleotide
acccttcatcgtacgcttgttgctctatttccctt

SEQ ID NO: 142173 - DNA, 35 bp, Artificial Sequence
  Synthetic oligonucleotide
accccccgtgtcgtacactatcctcacgttgcctt

SEQ ID NO: 142174 - DNA, 35 bp, Artificial Sequence
  Synthetic oligonucleotide
gcactccgctgctcggccggcctgacgcctctctt

SEQ ID NO: 142175 - DNA, 35 bp, Artificial Sequence
  Synthetic oligonucleotide
atggtctgccatccccgtgggccctgccttccttt

SEQ ID NO: 142176 - DNA, 36 bp, Artificial Sequence
  Synthetic oligonucleotide
tcccatcctgcacattgccgcgcgccaccctgcaaa

SEQ ID NO: 142177 - DNA, 36 bp, Artificial Sequence
  Synthetic oligonucleotide
gtaactcgcctccacgtgtctaccatctgtacctaa

SEQ ID NO: 142178 - DNA, 35 bp, Artificial Sequence
  Synthetic oligonucleotide
acaccggctccgcacattgctccaaccccatctaa

SEQ ID NO: 142179 - DNA, 36 bp, Artificial Sequence
  Synthetic oligonucleotide
ataccaacgctgaattgcctcgtaccatccctaaca

SEQ ID NO: 142180 - DNA, 36 bp, Artificial Sequence
  Synthetic oligonucleotide
accgcacccgactcaaatgtaccttccggccgcaca

SEQ ID NO: 142181 - DNA, 36 bp, Artificial Sequence
  Synthetic oligonucleotide
atgtagggaggaacgaacggggaaggtgtgtggaca

SEQ ID NO: 142182 - DNA, 35 bp, Artificial Sequence
  Synthetic oligonucleotide
gccccctatcctgcgcttgcctaaccagccttaca

SEQ ID NO: 142183 - DNA, 36 bp, Artificial Sequence
  Synthetic oligonucleotide
accgacgatgcgcgtagcctataccccccgtgccca

SEQ ID NO: 142184 - DNA, 35 bp, Artificial Sequence
  Synthetic oligonucleotide
tcccaaccccccaagttccttaagtcacccggcca

SEQ ID NO: 142185 - DNA, 35 bp, Artificial Sequence
  Synthetic oligonucleotide
tcatctgccggtccacgtatctccccgtcgattca

SEQ ID NO: 142186 - DNA, 37 bp, Artificial Sequence
  Synthetic oligonucleotide
aggggcggatggagcacggaggggcgggggtgtacga

SEQ ID NO: 142187 - DNA, 37 bp, Artificial Sequence
  Synthetic oligonucleotide
tcccacgggccgtactgttatcatcccgttctaccga

SEQ ID NO: 142188 - DNA, 37 bp, Artificial Sequence
  Synthetic oligonucleotide
gggaagggtgacaaagacatgggggagggagggcgga

SEQ ID NO: 142189 - DNA, 35 bp, Artificial Sequence
  Synthetic oligonucleotide
gctcaaggggtgggtagagggttgaggaaaaggga

SEQ ID NO: 142190 - DNA, 37 bp, Artificial Sequence
  Synthetic oligonucleotide
acaggagttgggggggagaaggaggagtataacggga

SEQ ID NO: 142191 - DNA, 37 bp, Artificial Sequence
  Synthetic oligonucleotide
atcaccaccaccatgcctatgtacgttcgcctgggga

SEQ ID NO: 142192 - DNA, 37 bp, Artificial Sequence
  Synthetic oligonucleotide
atccgaagggtgggtgggttgatgacgaaccctggga

SEQ ID NO: 142193 - DNA, 36 bp, Artificial Sequence
  Synthetic oligonucleotide
tggtcatactcccttcgtcatcgcacctcctctgga

SEQ ID NO: 142194 - DNA, 38 bp, Artificial Sequence
  Synthetic oligonucleotide
atcgcacgcactatggttcattgaatcgcctctcctga

SEQ ID NO: 142195 - DNA, 38 bp, Artificial Sequence
  Synthetic oligonucleotide
gagaaaggtggggaggtggacgggtgaggacttagtga

SEQ ID NO: 142196 - DNA, 38 bp, Artificial Sequence
  Synthetic oligonucleotide
tccatcatcccttgcctattgcactagtgaccccgtga

SEQ ID NO: 142197 - DNA, 38 bp, Artificial Sequence
  Synthetic oligonucleotide
tgaacacccgcctggtccgactaccctcttcccgttga

SEQ ID NO: 142198 - DNA, 38 bp, Artificial Sequence
  Synthetic oligonucleotide
tccgaccggtttctgcctcctcacgctcccgccgttga

SEQ ID NO: 142199 - DNA, 36 bp, Artificial Sequence
  Synthetic oligonucleotide
gctgccaagcccgtgcgcccagtgccccgtccccta

SEQ ID NO: 142200 - DNA, 36 bp, Artificial Sequence
  Synthetic oligonucleotide
acaggtcagttcgcgcccggtcctgtttcgctccta

SEQ ID NO: 142201 - DNA, 36 bp, Artificial Sequence
  Synthetic oligonucleotide
taaggggagaaggaggaaggagtacagtgaaagcta

SEQ ID NO: 142202 - DNA, 35 bp, Artificial Sequence
  Synthetic oligonucleotide
tgtcgtccgccgcccccttatctctgagtaatgac

SEQ ID NO: 142203 - DNA, 34 bp, Artificial Sequence
  Synthetic oligonucleotide
tcctgcgcccccgctcttcgcgctccacggtgac

SEQ ID NO: 142204 - DNA, 35 bp, Artificial Sequence
  Synthetic oligonucleotide
gtgcttccttgcacctatcctgtttgaaaccgtac

SEQ ID NO: 142205 - DNA, 35 bp, Artificial Sequence
  Synthetic oligonucleotide
gactaagccgacccgcaacatccgccgtctatacc

SEQ ID NO: 142206 - DNA, 35 bp, Artificial Sequence
  Synthetic oligonucleotide
attcctagcgcacaaccccaccacagacgttgccc

SEQ ID NO: 142207 - DNA, 35 bp, Artificial Sequence
  Synthetic oligonucleotide
ttgtccggtaccctgcatccttcattcgcctgtcc

SEQ ID NO: 142208 - DNA, 35 bp, Artificial Sequence
  Synthetic oligonucleotide
gaatcgaccccatcttagttttcactgcctttagc

SEQ ID NO: 142209 - DNA, 35 bp, Artificial Sequence
  Synthetic oligonucleotide
attcccgcgcgcgtggtctcgtcgcctaaccccgc

SEQ ID NO: 142210 - DNA, 35 bp, Artificial Sequence
  Synthetic oligonucleotide
gtcaagggtagggggccgggaatgggaatgggatc

SEQ ID NO: 142211 - DNA, 35 bp, Artificial Sequence
  Synthetic oligonucleotide
accaaccatggcctcgtttttagcaccgactcctc

SEQ ID NO: 142212 - DNA, 35 bp, Artificial Sequence
  Synthetic oligonucleotide
gccgccaccatctaacctcccggtctggctaattc

SEQ ID NO: 142213 - DNA, 35 bp, Artificial Sequence
  Synthetic oligonucleotide
tactacccgtcctgcctcgcccttccctttcattc

SEQ ID NO: 142214 - DNA, 35 bp, Artificial Sequence
  Synthetic oligonucleotide
gaccgccctccccacgcacatcttagaaggtgttc

SEQ ID NO: 142215 - DNA, 35 bp, Artificial Sequence
  Synthetic oligonucleotide
atcgctatgggcacagggcgggagggtagggaacg

SEQ ID NO: 142216 - DNA, 35 bp, Artificial Sequence
  Synthetic oligonucleotide
agctatccgcttagccctctgtttctgtccgcccg

SEQ ID NO: 142217 - DNA, 35 bp, Artificial Sequence
  Synthetic oligonucleotide
atacgcccgctacatcccgccagcctcactgttcg

SEQ ID NO: 142218 - DNA, 35 bp, Artificial Sequence
  Synthetic oligonucleotide
ttgcacgcctcatggctccgtagtccccgcccatg

SEQ ID NO: 142219 - DNA, 33 bp, Artificial Sequence
  Synthetic oligonucleotide
gtaaccacccaggtacatctgcctcttacacct

SEQ ID NO: 142220 - DNA, 35 bp, Artificial Sequence
  Synthetic oligonucleotide
acctcgcgtaacatcgcgacatacactcgaattct

SEQ ID NO: 142221 - DNA, 35 bp, Artificial Sequence
  Synthetic oligonucleotide
tgtcaggcgccggaagcccaccttctttcccttct

SEQ ID NO: 142222 - DNA, 35 bp, Artificial Sequence
  Synthetic oligonucleotide
tgcctccccctttcgtgagtccctcccatgccggt

SEQ ID NO: 142223 - DNA, 35 bp, Artificial Sequence
  Synthetic oligonucleotide
tcagccgtagatcgccgcactatgcccctccattt

SEQ ID NO: 142224 - DNA, 36 bp, Artificial Sequence
  Synthetic oligonucleotide
acccccgccatgcttatccgccttcatagtagccaa

SEQ ID NO: 142225 - DNA, 35 bp, Artificial Sequence
  Synthetic oligonucleotide
tgccccttctcgccggtccttctcttaggtgccaa

SEQ ID NO: 142226 - DNA, 36 bp, Artificial Sequence
  Synthetic oligonucleotide
tcccaccatcacaatctaatgcgagttatacgccca

SEQ ID NO: 142227 - DNA, 37 bp, Artificial Sequence
  Synthetic oligonucleotide
gcccccctcctgttggtgctctactcttggtcgaaga

SEQ ID NO: 142228 - DNA, 37 bp, Artificial Sequence
  Synthetic oligonucleotide
gggagggagggtgggaataatgtagcttccccggaga

SEQ ID NO: 142229 - DNA, 37 bp, Artificial Sequence
  Synthetic oligonucleotide
ggataacagcaggaaggggagcggtgggacatataga

SEQ ID NO: 142230 - DNA, 36 bp, Artificial Sequence
  Synthetic oligonucleotide
acggtcacgcccttggccccattgtaccatcaccga

SEQ ID NO: 142231 - DNA, 37 bp, Artificial Sequence
  Synthetic oligonucleotide
tcccctgacggacagacatctattaccatcctctcga

SEQ ID NO: 142232 - DNA, 35 bp, Artificial Sequence
  Synthetic oligonucleotide
agacattgaccttgttctacgccctgccttctcga

SEQ ID NO: 142233 - DNA, 37 bp, Artificial Sequence
  Synthetic oligonucleotide
actcatccctccctggcattgcactggaccctaggga

SEQ ID NO: 142234 - DNA, 38 bp, Artificial Sequence
  Synthetic oligonucleotide
agttcccgccccacctgcgcattggcccagccccatga

SEQ ID NO: 142235 - DNA, 37 bp, Artificial Sequence
  Synthetic oligonucleotide
gcagggaggggcgggggggaggatcatcgggaactga

SEQ ID NO: 142236 - DNA, 36 bp, Artificial Sequence
  Synthetic oligonucleotide
gacttaccgccacatgctagtaccgttttcccctga

SEQ ID NO: 142237 - DNA, 37 bp, Artificial Sequence
  Synthetic oligonucleotide
gccatgccctgtcgctgctatacccctattctcttga

SEQ ID NO: 142238 - DNA, 37 bp, Artificial Sequence
  Synthetic oligonucleotide
gcatgccgcctcgaaccgcccactctactctgtttga

SEQ ID NO: 142239 - DNA, 36 bp, Artificial Sequence
  Synthetic oligonucleotide
tccccatacgaccgttcccgaatttattgtacctta

SEQ ID NO: 142240 - DNA, 35 bp, Artificial Sequence
  Synthetic oligonucleotide
acatccgctccacgtatcttttgaccctttcacac

SEQ ID NO: 142241 - DNA, 35 bp, Artificial Sequence
  Synthetic oligonucleotide
ccactgcgcccctagccacccaagacttcctgcac

SEQ ID NO: 142242 - DNA, 35 bp, Artificial Sequence
  Synthetic oligonucleotide
ttggacaccccgagagccgctcgttcactgttacc

SEQ ID NO: 142243 - DNA, 35 bp, Artificial Sequence
  Synthetic oligonucleotide
gcccatcacctatgccgttacctgacacttcgccc

SEQ ID NO: 142244 - DNA, 35 bp, Artificial Sequence
  Synthetic oligonucleotide
taatgggagccgtctaccaccgccatgtctgtccc

SEQ ID NO: 142245 - DNA, 35 bp, Artificial Sequence
  Synthetic oligonucleotide
tcaagcgagagtctacgtcctgtttcattcttccc

SEQ ID NO: 142246 - DNA, 35 bp, Artificial Sequence
  Synthetic oligonucleotide
tactcgccaactctgcctccctgtactcattcgcc

SEQ ID NO: 142247 - DNA, 35 bp, Artificial Sequence
  Synthetic oligonucleotide
gacctctggctgtcataaggcccccctcgctttcc

SEQ ID NO: 142248 - DNA, 35 bp, Artificial Sequence
  Synthetic oligonucleotide
tgtgcaaacgcataatgcatttgtcgctccctcgc

SEQ ID NO: 142249 - DNA, 35 bp, Artificial Sequence
  Synthetic oligonucleotide
gtccctcgtccgcactgagttccaatattccctgc

SEQ ID NO: 142250 - DNA, 35 bp, Artificial Sequence
  Synthetic oligonucleotide
tgtcatgcttagcccgctgcacggatccctttctc

SEQ ID NO: 142251 - DNA, 35 bp, Artificial Sequence
  Synthetic oligonucleotide
gccctgccccgtccctctagctgtgccttgctgtc

SEQ ID NO: 142252 - DNA, 35 bp, Artificial Sequence
  Synthetic oligonucleotide
tccaatccgcccggctttctatcgatcctggaacg

SEQ ID NO: 142253 - DNA, 35 bp, Artificial Sequence
  Synthetic oligonucleotide
gttacatcggctctctgttccatcgcatcacctcg

SEQ ID NO: 142254 - DNA, 35 bp, Artificial Sequence
  Synthetic oligonucleotide
gttccaccgtccggtccatcttcgatactatctcg

SEQ ID NO: 142255 - DNA, 35 bp, Artificial Sequence
  Synthetic oligonucleotide
tgaagtcgtgctcggggcaaagggagggattgggg

SEQ ID NO: 142256 - DNA, 35 bp, Artificial Sequence
  Synthetic oligonucleotide
agactgctgggtggggatctagtgtggggggtggg

SEQ ID NO: 142257 - DNA, 35 bp, Artificial Sequence
  Synthetic oligonucleotide
tgctacctcctgctgtccgtaattcaccattgatg

SEQ ID NO: 142258 - DNA, 35 bp, Artificial Sequence
  Synthetic oligonucleotide
gttgcccccccagtcctcgtgaatgttttcttact

SEQ ID NO: 142259 - DNA, 35 bp, Artificial Sequence
  Synthetic oligonucleotide
agttgccgcccagcctacctcctaccgtgtcacct

SEQ ID NO: 142260 - DNA, 35 bp, Artificial Sequence
  Synthetic oligonucleotide
tgatcccctccgcacggccacaacacctccaggct

SEQ ID NO: 142261 - DNA, 35 bp, Artificial Sequence
  Synthetic oligonucleotide
aaccaatggagggcagtaaaggcggaggggtggtt

SEQ ID NO: 142262 - DNA, 36 bp, Artificial Sequence
  Synthetic oligonucleotide
ttggatggtgtggtggacggtgggggggtgcgggaa

SEQ ID NO: 142263 - DNA, 36 bp, Artificial Sequence
  Synthetic oligonucleotide
gtgacagggaagggcgaggggagggcgggcacgtaa

SEQ ID NO: 142264 - DNA, 36 bp, Artificial Sequence
  Synthetic oligonucleotide
tacgatccatccgttgggtttttccgcctggtttaa

SEQ ID NO: 142265 - DNA, 35 bp, Artificial Sequence
  Synthetic oligonucleotide
taccctgccttatgtccatctgcggacgccttcca

SEQ ID NO: 142266 - DNA, 36 bp, Artificial Sequence
  Synthetic oligonucleotide
acgctcgccctccactgttacatgcccacctcctca

SEQ ID NO: 142267 - DNA, 36 bp, Artificial Sequence
  Synthetic oligonucleotide
gtctacaccgtcgacccctacccacgccccaccaga

SEQ ID NO: 142268 - DNA, 37 bp, Artificial Sequence
  Synthetic oligonucleotide
gtcacgcctccatcacgttcctgcacctcgcgcgaga

SEQ ID NO: 142269 - DNA, 37 bp, Artificial Sequence
  Synthetic oligonucleotide
agtatgcgccgggaggtggtgggggtgggcgcaacga

SEQ ID NO: 142270 - DNA, 37 bp, Artificial Sequence
  Synthetic oligonucleotide
agtggggagggcgggaatggagaatgcaaatggtcga

SEQ ID NO: 142271 - DNA, 37 bp, Artificial Sequence
  Synthetic oligonucleotide
actgcgccactagccgcctcccttccattcgcacgga

SEQ ID NO: 142272 - DNA, 38 bp, Artificial Sequence
  Synthetic oligonucleotide
gaggggaatgctgggggttgaagaggaggggaaactga

SEQ ID NO: 142273 - DNA, 38 bp, Artificial Sequence
  Synthetic oligonucleotide
acacgtcgggcgggtgggcatgatagggaccaatctga

SEQ ID NO: 142274 - DNA, 37 bp, Artificial Sequence
  Synthetic oligonucleotide
acgaaccgccttattctatcctcgcaactcaccttga

SEQ ID NO: 142275 - DNA, 36 bp, Artificial Sequence
  Synthetic oligonucleotide
tacagataccgccccagcccgccccgcgctccttga

SEQ ID NO: 142276 - DNA, 38 bp, Artificial Sequence
  Synthetic oligonucleotide
ggagctcgccctcgtttcgtctgcctctcattatttga

SEQ ID NO: 142277 - DNA, 35 bp, Artificial Sequence
  Synthetic oligonucleotide
tcatcgcccttccgtcgtcacgtttcttgccttac

SEQ ID NO: 142278 - DNA, 35 bp, Artificial Sequence
  Synthetic oligonucleotide
gccccatcctgtcgcctccatagtcttgcttcacc

SEQ ID NO: 142279 - DNA, 35 bp, Artificial Sequence
  Synthetic oligonucleotide
atgcgagcccatcttggcatacaacgcctcttacc

SEQ ID NO: 142280 - DNA, 35 bp, Artificial Sequence
  Synthetic oligonucleotide
acgtcccctgcctgaacgttattacacctcgaccc

SEQ ID NO: 142281 - DNA, 35 bp, Artificial Sequence
  Synthetic oligonucleotide
tgtcaccatctcgcatacgacttttaccacgcccc

SEQ ID NO: 142282 - DNA, 35 bp, Artificial Sequence
  Synthetic oligonucleotide
gtagccgacggtctctgttatcctttccctgcccc

SEQ ID NO: 142283 - DNA, 35 bp, Artificial Sequence
  Synthetic oligonucleotide
atcatgatcgctacgttcaccactttcctgttgcc

SEQ ID NO: 142284 - DNA, 35 bp, Artificial Sequence
  Synthetic oligonucleotide
gcccacgctatccctggtttttagttctctgtagc

SEQ ID NO: 142285 - DNA, 35 bp, Artificial Sequence
  Synthetic oligonucleotide
gatgacgggggagatggggaggaaatggttagggc

SEQ ID NO: 142286 - DNA, 35 bp, Artificial Sequence
  Synthetic oligonucleotide
ttgacgcatacccctccagcttcctatagccctgc

SEQ ID NO: 142287 - DNA, 35 bp, Artificial Sequence
  Synthetic oligonucleotide
acacgcgttcgacggccccccgcagcctgcacatc

SEQ ID NO: 142288 - DNA, 35 bp, Artificial Sequence
  Synthetic oligonucleotide
atagccacccgtcccgccaaggtcctccccacgtc

SEQ ID NO: 142289 - DNA, 36 bp, Artificial Sequence
  Synthetic oligonucleotide
gtgctaatggcgccccgtttcacccgctttgagttc

SEQ ID NO: 142290 - DNA, 35 bp, Artificial Sequence
  Synthetic oligonucleotide
attgcgcgtacacatccttctcatttctgatccat

SEQ ID NO: 142291 - DNA, 35 bp, Artificial Sequence
  Synthetic oligonucleotide
tagcccctgctgaggcctttcttgtagttccacct

SEQ ID NO: 142292 - DNA, 35 bp, Artificial Sequence
  Synthetic oligonucleotide
accagtcccccgccttcacgtgataacaaattcct

SEQ ID NO: 142293 - DNA, 35 bp, Artificial Sequence
  Synthetic oligonucleotide
gtacgcttggtcggttcctgccccgtttagttcct

SEQ ID NO: 142294 - DNA, 35 bp, Artificial Sequence
  Synthetic oligonucleotide
acaacatggaggaggggggtaggtgctatggtgct

SEQ ID NO: 142295 - DNA, 35 bp, Artificial Sequence
  Synthetic oligonucleotide
acttccccggcctcatgtctcgacctcatatttct

SEQ ID NO: 142296 - DNA, 35 bp, Artificial Sequence
  Synthetic oligonucleotide
gtatgcccgaactgcaagctctcccccccatgggt

SEQ ID NO: 142297 - DNA, 34 bp, Artificial Sequence
  Synthetic oligonucleotide
agccaacaatctgccctcttatccgaccttgcaa

SEQ ID NO: 142298 - DNA, 36 bp, Artificial Sequence
  Synthetic oligonucleotide
tacctgccggggggggttaaaatgctggggagggaa

SEQ ID NO: 142299 - DNA, 36 bp, Artificial Sequence
  Synthetic oligonucleotide
ttcgtactccctcagaccttcacaggtgtcccccca

SEQ ID NO: 142300 - DNA, 36 bp, Artificial Sequence
  Synthetic oligonucleotide
ttcccccccctgtgcctgtaacaacttccgaccgca

SEQ ID NO: 142301 - DNA, 36 bp, Artificial Sequence
  Synthetic oligonucleotide
atgccccctctcttggctgctgactatcacacatca

SEQ ID NO: 142302 - DNA, 35 bp, Artificial Sequence
  Synthetic oligonucleotide
actacgtagcaggtctcacatcaccgcccctctca

SEQ ID NO: 142303 - DNA, 37 bp, Artificial Sequence
  Synthetic oligonucleotide
gagacaacagtactaaaggagcgggaagggggggaga

SEQ ID NO: 142304 - DNA, 37 bp, Artificial Sequence
  Synthetic oligonucleotide
ggagggtcaatagccttgggcgggcggggaaacacga

SEQ ID NO: 142305 - DNA, 37 bp, Artificial Sequence
  Synthetic oligonucleotide
agttggagggggatgggggggagaggggtgaggagga

SEQ ID NO: 142306 - DNA, 37 bp, Artificial Sequence
  Synthetic oligonucleotide
ccgatacccgccattgtacaccgctcctcgccccgga

SEQ ID NO: 142307 - DNA, 37 bp, Artificial Sequence
  Synthetic oligonucleotide
agggccaggaggataggagggaggatataggatggga

SEQ ID NO: 142308 - DNA, 38 bp, Artificial Sequence
  Synthetic oligonucleotide
gcccttccccatctgtgcgtgactcatcttccccctga

SEQ ID NO: 142309 - DNA, 37 bp, Artificial Sequence
  Synthetic oligonucleotide
tgttcacttagccctgtccatcctgctcattcgctga

SEQ ID NO: 142310 - DNA, 38 bp, Artificial Sequence
  Synthetic oligonucleotide
gacccctgccctctgactctgtaccaagcacttgctga

SEQ ID NO: 142311 - DNA, 37 bp, Artificial Sequence
  Synthetic oligonucleotide
atggtgcagtgggaactttgtcgggagggaagggtga

SEQ ID NO: 142312 - DNA, 37 bp, Artificial Sequence
  Synthetic oligonucleotide
cccgcacctagcacgtgcctcgtaccatcccctgtga

SEQ ID NO: 142313 - DNA, 38 bp, Artificial Sequence
  Synthetic oligonucleotide
gttcgccggcccgatgcttttcgctacttcccttgtga

SEQ ID NO: 142314 - DNA, 38 bp, Artificial Sequence
  Synthetic oligonucleotide
atggctcgctcgccccgtccccccagcacgtaccttga

SEQ ID NO: 142315 - DNA, 37 bp, Artificial Sequence
  Synthetic oligonucleotide
gcacattctctgccggtacataaacaccctcgcttga

SEQ ID NO: 142316 - DNA, 37 bp, Artificial Sequence
  Synthetic oligonucleotide
agccgccacgaatcttcgtgtactatcgccctcttga

SEQ ID NO: 142317 - DNA, 35 bp, Artificial Sequence
  Synthetic oligonucleotide
ttagacaagggaaggaggagtcaggggcgggttga

SEQ ID NO: 142318 - DNA, 34 bp, Artificial Sequence
  Synthetic oligonucleotide
aatcacaacctcccgcttaacagcttgcccgcta

SEQ ID NO: 142319 - DNA, 36 bp, Artificial Sequence
  Synthetic oligonucleotide
acatttccgccgatcctgccccatcgcttacagtta

SEQ ID NO: 142320 - DNA, 35 bp, Artificial Sequence
  Synthetic oligonucleotide
gcctcccgtccgaccactgtttcttcttcgtgtta

SEQ ID NO: 142321 - DNA, 35 bp, Artificial Sequence
  Synthetic oligonucleotide
gcgcacctgtgccctatgtcattattcccggcccc

SEQ ID NO: 142322 - DNA, 35 bp, Artificial Sequence
  Synthetic oligonucleotide
cacaccatccattcttgcccagcgaaccacggtcc

SEQ ID NO: 142323 - DNA, 35 bp, Artificial Sequence
  Synthetic oligonucleotide
atcacccacccctccgtttggtatggcccatttcc

SEQ ID NO: 142324 - DNA, 34 bp, Artificial Sequence
  Synthetic oligonucleotide
ttgcataccgctgttttggcctgtacctttccgc

SEQ ID NO: 142325 - DNA, 35 bp, Artificial Sequence
  Synthetic oligonucleotide
acataccctctccaattgcacacctggctacaggc

SEQ ID NO: 142326 - DNA, 35 bp, Artificial Sequence
  Synthetic oligonucleotide
ttccgaccgtcgcctttatagcctcttgatcatgc

SEQ ID NO: 142327 - DNA, 35 bp, Artificial Sequence
  Synthetic oligonucleotide
gagagcagaagggccagggaaaaagataggtgatc

SEQ ID NO: 142328 - DNA, 35 bp, Artificial Sequence
  Synthetic oligonucleotide
accgtttcccgcccttgtatctcattagtcccctc

SEQ ID NO: 142329 - DNA, 35 bp, Artificial Sequence
  Synthetic oligonucleotide
tagctcctgtccctctgcgctacgcgtttcgcctc

SEQ ID NO: 142330 - DNA, 35 bp, Artificial Sequence
  Synthetic oligonucleotide
gtggggcgaagggagacataggggcgattagggag

SEQ ID NO: 142331 - DNA, 35 bp, Artificial Sequence
  Synthetic oligonucleotide
actcaccgtctggctctctcccgtgcacaacaccg

SEQ ID NO: 142332 - DNA, 36 bp, Artificial Sequence
  Synthetic oligonucleotide
gaggggggtagaggggcgggagtggttcgggaggcg

SEQ ID NO: 142333 - DNA, 35 bp, Artificial Sequence
  Synthetic oligonucleotide
gccgagggaagggggattgacacacggagaatgcg

SEQ ID NO: 142334 - DNA, 35 bp, Artificial Sequence
  Synthetic oligonucleotide
gtatcccgcttgatctggcatcccctactacttcg

SEQ ID NO: 142335 - DNA, 35 bp, Artificial Sequence
  Synthetic oligonucleotide
tcagcctccctgctttggtcctgagctattctcat

SEQ ID NO: 142336 - DNA, 35 bp, Artificial Sequence
  Synthetic oligonucleotide
attcccgagccacttgccgaggcaccctgacccct

SEQ ID NO: 142337 - DNA, 35 bp, Artificial Sequence
  Synthetic oligonucleotide
tctctccccggcacctgacctttatggcctcatct

SEQ ID NO: 142338 - DNA, 35 bp, Artificial Sequence
  Synthetic oligonucleotide
tcacgttcgcgtgctgcacggttccgttctactct

SEQ ID NO: 142339 - DNA, 35 bp, Artificial Sequence
  Synthetic oligonucleotide
tcacgattctgccgccgctgtgctcccggcccatt

SEQ ID NO: 142340 - DNA, 35 bp, Artificial Sequence
  Synthetic oligonucleotide
gcgaggacagccctcggtcgtcgcataataccctt

SEQ ID NO: 142341 - DNA, 36 bp, Artificial Sequence
  Synthetic oligonucleotide
ggatcgcgcagaaacctgttcccgtgcccctccaaa

SEQ ID NO: 142342 - DNA, 35 bp, Artificial Sequence
  Synthetic oligonucleotide
acgcgggctaggagaggggaaggtacggggggaaa

SEQ ID NO: 142343 - DNA, 36 bp, Artificial Sequence
  Synthetic oligonucleotide
ggatctgtcgccacgtcgcccgcatctggtccccca

SEQ ID NO: 142344 - DNA, 35 bp, Artificial Sequence
  Synthetic oligonucleotide
cgggcatagccaatgccgtgccatacctcttccca

SEQ ID NO: 142345 - DNA, 36 bp, Artificial Sequence
  Synthetic oligonucleotide
gctagccccaagtagcgtgtcctgcccatcgtttca

SEQ ID NO: 142346 - DNA, 37 bp, Artificial Sequence
  Synthetic oligonucleotide
gccatgggttggggtgggagggctgtccccggagaga

SEQ ID NO: 142347 - DNA, 37 bp, Artificial Sequence
  Synthetic oligonucleotide
gtggggagacagtggggggatgatagagcgccggaga

SEQ ID NO: 142348 - DNA, 36 bp, Artificial Sequence
  Synthetic oligonucleotide
gagggaggggctagaaacggtgagggaaatcagcga

SEQ ID NO: 142349 - DNA, 36 bp, Artificial Sequence
  Synthetic oligonucleotide
gagctccatcacggcactcctccagcgctttagcga

SEQ ID NO: 142350 - DNA, 36 bp, Artificial Sequence
  Synthetic oligonucleotide
attcaccccccccgcacccaccgaccactgatcgga

SEQ ID NO: 142351 - DNA, 37 bp, Artificial Sequence
  Synthetic oligonucleotide
tctccctcctagcacctcttcccatcctgtaatggga

SEQ ID NO: 142352 - DNA, 37 bp, Artificial Sequence
  Synthetic oligonucleotide
gaactcgggagggaggggttacgagctgacagtggga

SEQ ID NO: 142353 - DNA, 37 bp, Artificial Sequence
  Synthetic oligonucleotide
acgcccctagctcagctttatcgcacgctctccctga

SEQ ID NO: 142354 - DNA, 37 bp, Artificial Sequence
  Synthetic oligonucleotide
gtacctcacagtatctcaccaccactcccccgcgtga

SEQ ID NO: 142355 - DNA, 37 bp, Artificial Sequence
  Synthetic oligonucleotide
gtcactcccgtgagcactctgccttttcgacccttga

SEQ ID NO: 142356 - DNA, 37 bp, Artificial Sequence
  Synthetic oligonucleotide
acccgccttcacaccttcgtgcatcgaccccatttga

SEQ ID NO: 142357 - DNA, 36 bp, Artificial Sequence
  Synthetic oligonucleotide
tccgcaccatcttgtccagctttcgtgtgctcgtta

SEQ ID NO: 142358 - DNA, 35 bp, Artificial Sequence
  Synthetic oligonucleotide
gatgacaatgttgcgccccgctatgccacccttta

SEQ ID NO: 142359 - DNA, 35 bp, Artificial Sequence
  Synthetic oligonucleotide
gagagggttggagggtactcattgctccgggggac

SEQ ID NO: 142360 - DNA, 35 bp, Artificial Sequence
  Synthetic oligonucleotide
tagcgcactcgcccctccgcctgcagagctggtac

SEQ ID NO: 142361 - DNA, 35 bp, Artificial Sequence
  Synthetic oligonucleotide
taggctacgttcccctgtgccatgcgttcctcacc

SEQ ID NO: 142362 - DNA, 35 bp, Artificial Sequence
  Synthetic oligonucleotide
gtgaccccgtttgctgtcattggctatccattccc

SEQ ID NO: 142363 - DNA, 35 bp, Artificial Sequence
  Synthetic oligonucleotide
ggtcaaaggcccgttcctcgttgaattgcccatcc

SEQ ID NO: 142364 - DNA, 35 bp, Artificial Sequence
  Synthetic oligonucleotide
ttcaccccctgtccttggctgtcactcccattggc

SEQ ID NO: 142365 - DNA, 35 bp, Artificial Sequence
  Synthetic oligonucleotide
gtcccgtttctgttcgttgtacgcttcccttattc

SEQ ID NO: 142366 - DNA, 35 bp, Artificial Sequence
  Synthetic oligonucleotide
gactccaccgttcacaccatcccgatcgccatgag

SEQ ID NO: 142367 - DNA, 35 bp, Artificial Sequence
  Synthetic oligonucleotide
ggtaccgtcgcggcctgcttgttcctcgttctcat

SEQ ID NO: 142368 - DNA, 35 bp, Artificial Sequence
  Synthetic oligonucleotide
tccgtgactctcgcagcacttatatagtttccctt

SEQ ID NO: 142369 - DNA, 35 bp, Artificial Sequence
  Synthetic oligonucleotide
tccactccacgatttgggatccccagccacccgtt

SEQ ID NO: 142370 - DNA, 35 bp, Artificial Sequence
  Synthetic oligonucleotide
gatgaccgccacgatattctccagttacggccttt

SEQ ID NO: 142371 - DNA, 36 bp, Artificial Sequence
  Synthetic oligonucleotide
ggcccttccgccgcgatcctgttctgttttcctaca

SEQ ID NO: 142372 - DNA, 36 bp, Artificial Sequence
  Synthetic oligonucleotide
actggcctccttcaaccgctgcccctgttctgtaca

SEQ ID NO: 142373 - DNA, 35 bp, Artificial Sequence
  Synthetic oligonucleotide
ggactagctgattgttggtcattcgccgcccccca

SEQ ID NO: 142374 - DNA, 36 bp, Artificial Sequence
  Synthetic oligonucleotide
atgggggggagggaagggctagtaggtcgacagtca

SEQ ID NO: 142375 - DNA, 36 bp, Artificial Sequence
  Synthetic oligonucleotide
atcgacgcctatccaactctcgtgttcacctcttca

SEQ ID NO: 142376 - DNA, 37 bp, Artificial Sequence
  Synthetic oligonucleotide
actaccccgcacccaccagctagtcgacgtaaggaga

SEQ ID NO: 142377 - DNA, 35 bp, Artificial Sequence
  Synthetic oligonucleotide
tgccctgggacgaactggtgagggggagggataga

SEQ ID NO: 142378 - DNA, 37 bp, Artificial Sequence
  Synthetic oligonucleotide
acgcaatcccgtcactgttcgttcctgtgcgccccga

SEQ ID NO: 142379 - DNA, 36 bp, Artificial Sequence
  Synthetic oligonucleotide
gaagtagggtgggggggaggaggttcgtaacgcgga

SEQ ID NO: 142380 - DNA, 36 bp, Artificial Sequence
  Synthetic oligonucleotide
aggggatgactggggaagtacaggggcaagtgggga

SEQ ID NO: 142381 - DNA, 37 bp, Artificial Sequence
  Synthetic oligonucleotide
gatcagtgggggggcgtgggcggggcggggaattgga

SEQ ID NO: 142382 - DNA, 38 bp, Artificial Sequence
  Synthetic oligonucleotide
gcgaggccaggtgggggggggaggtcgggaagcactga

SEQ ID NO: 142383 - DNA, 37 bp, Artificial Sequence
  Synthetic oligonucleotide
atccgttcccgtccatctgccgtcatctcccatctga

SEQ ID NO: 142384 - DNA, 38 bp, Artificial Sequence
  Synthetic oligonucleotide
tgccctctaccgctccgtcctgtgatgccctctcttga

SEQ ID NO: 142385 - DNA, 35 bp, Artificial Sequence
  Synthetic oligonucleotide
acagccctgctccttccctgaccaattcggcccac

SEQ ID NO: 142386 - DNA, 35 bp, Artificial Sequence
  Synthetic oligonucleotide
tgcctcgcgcaaccgcttaaagtttcccgcatcac

SEQ ID NO: 142387 - DNA, 35 bp, Artificial Sequence
  Synthetic oligonucleotide
actcccgatgccattccacgccgcttgcccatgac

SEQ ID NO: 142388 - DNA, 35 bp, Artificial Sequence
  Synthetic oligonucleotide
accgaaccgtgctttttatcgttgtgcaaaccacc

SEQ ID NO: 142389 - DNA, 35 bp, Artificial Sequence
  Synthetic oligonucleotide
aaaccctgtcgcagacgctcccccgttcacgcacc

SEQ ID NO: 142390 - DNA, 35 bp, Artificial Sequence
  Synthetic oligonucleotide
ggaacacccactttggtacctggtctatcgtaccc

SEQ ID NO: 142391 - DNA, 35 bp, Artificial Sequence
  Synthetic oligonucleotide
agcaacctccatctccccgcggttaagacaccgcc

SEQ ID NO: 142392 - DNA, 35 bp, Artificial Sequence
  Synthetic oligonucleotide
tacaggtctccattccgcgtccctcctgccgggcc

SEQ ID NO: 142393 - DNA, 35 bp, Artificial Sequence
  Synthetic oligonucleotide
gttacgccggtattgccctcttgcgtcacgctcgc

SEQ ID NO: 142394 - DNA, 35 bp, Artificial Sequence
  Synthetic oligonucleotide
atgacctcctagctcgttaaaccgacccaacctgc

SEQ ID NO: 142395 - DNA, 35 bp, Artificial Sequence
  Synthetic oligonucleotide
acccgggcacatgtaccacccacaaattgtctgtc

SEQ ID NO: 142396 - DNA, 35 bp, Artificial Sequence
  Synthetic oligonucleotide
gtcactgactactgttgagcctctcccgccgtttc

SEQ ID NO: 142397 - DNA, 35 bp, Artificial Sequence
  Synthetic oligonucleotide
ttcgatcctcgctcctgggtttccactgccacacg

SEQ ID NO: 142398 - DNA, 35 bp, Artificial Sequence
  Synthetic oligonucleotide
ttggcgcaactcgttgtctctgcttaccccctccg

SEQ ID NO: 142399 - DNA, 35 bp, Artificial Sequence
  Synthetic oligonucleotide
gcagaaccaaggcggagggaaaacaggattggatg

SEQ ID NO: 142400 - DNA, 35 bp, Artificial Sequence
  Synthetic oligonucleotide
ttgtcggtccattttcgtgcatgccgcctctccat

SEQ ID NO: 142401 - DNA, 35 bp, Artificial Sequence
  Synthetic oligonucleotide
acagctgatcctcgccgacgctctatctgttcact

SEQ ID NO: 142402 - DNA, 36 bp, Artificial Sequence
  Synthetic oligonucleotide
gtcgctcaacagtcggagctctccccacttgcctaa

SEQ ID NO: 142403 - DNA, 36 bp, Artificial Sequence
  Synthetic oligonucleotide
tttgatgtgccacacccccgccctgcttgtacacca

SEQ ID NO: 142404 - DNA, 35 bp, Artificial Sequence
  Synthetic oligonucleotide
ggctccactccgtgttttttgccgccacaccacca

SEQ ID NO: 142405 - DNA, 36 bp, Artificial Sequence
  Synthetic oligonucleotide
gtgcacgactgagcggccagctcccctctgccccca

SEQ ID NO: 142406 - DNA, 36 bp, Artificial Sequence
  Synthetic oligonucleotide
accgacaccatccgttttaacaaacccgcttcccca

SEQ ID NO: 142407 - DNA, 36 bp, Artificial Sequence
  Synthetic oligonucleotide
gtgtcatcgcatcgagttctcttcctcttacctgca

SEQ ID NO: 142408 - DNA, 37 bp, Artificial Sequence
  Synthetic oligonucleotide
acccctccccctcgtgaacagtcccgtcctgattgca

SEQ ID NO: 142409 - DNA, 35 bp, Artificial Sequence
  Synthetic oligonucleotide
tgcaacgaatgctctggacccccgccctacgctca

SEQ ID NO: 142410 - DNA, 37 bp, Artificial Sequence
  Synthetic oligonucleotide
gtcaaaccggagggcgggacgggggggttgggaaaga

SEQ ID NO: 142411 - DNA, 37 bp, Artificial Sequence
  Synthetic oligonucleotide
atcacctcgcactgccgttcttatcgctcccccaaga

SEQ ID NO: 142412 - DNA, 37 bp, Artificial Sequence
  Synthetic oligonucleotide
atgttagggtagggtacggggaagggcgatgagacga

SEQ ID NO: 142413 - DNA, 36 bp, Artificial Sequence
  Synthetic oligonucleotide
accccgtcaagcccacccctgtcatcaagtacccga

SEQ ID NO: 142414 - DNA, 36 bp, Artificial Sequence
  Synthetic oligonucleotide
tcccggccctatttgataaccccgccgcttacctga

SEQ ID NO: 142415 - DNA, 38 bp, Artificial Sequence
  Synthetic oligonucleotide
gccagcccgccccacttgtatggttcctttcgccctga

SEQ ID NO: 142416 - DNA, 37 bp, Artificial Sequence
  Synthetic oligonucleotide
taatgccagagaggtgggcgggaggggaggtttgtga

SEQ ID NO: 142417 - DNA, 35 bp, Artificial Sequence
  Synthetic oligonucleotide
aaccaccgccgattccctttccgtttggcgtttta

SEQ ID NO: 142418 - DNA, 35 bp, Artificial Sequence
  Synthetic oligonucleotide
atgtctagcagaaccgcgcaccgccccgcctttac

SEQ ID NO: 142419 - DNA, 35 bp, Artificial Sequence
  Synthetic oligonucleotide
ttgttccacccattgcaagtgcgtccttttgcacc

SEQ ID NO: 142420 - DNA, 35 bp, Artificial Sequence
  Synthetic oligonucleotide
gaattgcctgcgaaaactgcccttgactgcgcccc

SEQ ID NO: 142421 - DNA, 36 bp, Artificial Sequence
  Synthetic oligonucleotide
tacccatcgtagttcatccgctgatccccgctcgcc

SEQ ID NO: 142422 - DNA, 35 bp, Artificial Sequence
  Synthetic oligonucleotide
gaccctgctctcatccttttctgtccgcaatggcc

SEQ ID NO: 142423 - DNA, 35 bp, Artificial Sequence
  Synthetic oligonucleotide
gctcttgcgacgcctggtcttacacgccccactcc

SEQ ID NO: 142424 - DNA, 36 bp, Artificial Sequence
  Synthetic oligonucleotide
tggaccgcccgcccgataccgtagcccgtttgttcc

SEQ ID NO: 142425 - DNA, 35 bp, Artificial Sequence
  Synthetic oligonucleotide
gagtactgctcccccccttcaggataactaaacgc

SEQ ID NO: 142426 - DNA, 35 bp, Artificial Sequence; identical to SEQ ID NO: 3034
  Synthetic oligonucleotide

SEQ ID NO: 142427 - DNA, 35 bp, Artificial Sequence
  Synthetic oligonucleotide
agctccccctctgcttttgttccgtctgctccatc

SEQ ID NO: 142428 - DNA, 35 bp, Artificial Sequence
  Synthetic oligonucleotide
ttgaggcacctgctgcccattcattacgttctatc

SEQ ID NO: 142429 - DNA, 35 bp, Artificial Sequence
  Synthetic oligonucleotide
ggatggcccagcccgttttctcattgcccatactc

SEQ ID NO: 142430 - DNA, 35 bp, Artificial Sequence
  Synthetic oligonucleotide
gtacgcctgatgcccctccgcctaaccaagttgtc

SEQ ID NO: 142431 - DNA, 35 bp, Artificial Sequence
  Synthetic oligonucleotide
ggacccgcccgctttgccctccctaaacgcacgag

SEQ ID NO: 142432 - DNA, 35 bp, Artificial Sequence
  Synthetic oligonucleotide
taaccacctgtcccatctttttgcctgtaagctag

SEQ ID NO: 142433 - DNA, 35 bp, Artificial Sequence
  Synthetic oligonucleotide
tactgcaaacgccgcttttctttccatcgcttacg

SEQ ID NO: 142434 - DNA, 35 bp, Artificial Sequence
  Synthetic oligonucleotide
gatatatgtggggggtggagggcgtggtacgggcg

SEQ ID NO: 142435 - DNA, 35 bp, Artificial Sequence
  Synthetic oligonucleotide
gccccgtctctgcaccgcgatgccgcccagcccct

SEQ ID NO: 142436 - DNA, 35 bp, Artificial Sequence
  Synthetic oligonucleotide
accacaggtctcgccttcttccgttatgcttctct

SEQ ID NO: 142437 - DNA, 35 bp, Artificial Sequence
  Synthetic oligonucleotide
gatgtgtctgcaattatacctcacgatccctgctt

SEQ ID NO: 142438 - DNA, 36 bp, Artificial Sequence
  Synthetic oligonucleotide
ttgacgcactcctgcgcctcccttcttgttcagaaa

SEQ ID NO: 142439 - DNA, 36 bp, Artificial Sequence
  Synthetic oligonucleotide
gaacagaggagcggtggacagggggttggtgaggaa

SEQ ID NO: 142440 - DNA, 30 bp, Artificial Sequence
  Synthetic oligonucleotide
gcccccccggacgccgcatccctgtagaca

SEQ ID NO: 142441 - DNA, 36 bp, Artificial Sequence
  Synthetic oligonucleotide
tccacccgatcgtgtcgttcctttcgcttcaccgca

SEQ ID NO: 142442 - DNA, 36 bp, Artificial Sequence
  Synthetic oligonucleotide
aggggggtggtaccaagggggcggaggagcggtgca

SEQ ID NO: 142443 - DNA, 37 bp, Artificial Sequence
  Synthetic oligonucleotide
tgacgtcacacctgctgtatttccctcgctcccaaga

SEQ ID NO: 142444 - DNA, 35 bp, Artificial Sequence
  Synthetic oligonucleotide
attgcaccctcccctggtccatgactgtctcaaga

SEQ ID NO: 142445 - DNA, 36 bp, Artificial Sequence
  Synthetic oligonucleotide
aatggaggggggcggtacgggtggagcgttggagga

SEQ ID NO: 142446 - DNA, 37 bp, Artificial Sequence
  Synthetic oligonucleotide
tgtatcatccggctcttacccccctgcccctacatga

SEQ ID NO: 142447 - DNA, 38 bp, Artificial Sequence
  Synthetic oligonucleotide
aaccgggggtcgagggaggggaagattggtgcagatga

SEQ ID NO: 142448 - DNA, 38 bp, Artificial Sequence
  Synthetic oligonucleotide
gagggggggcagaaagtagacgggaatggggtggatga

SEQ ID NO: 142449 - DNA, 38 bp, Artificial Sequence
  Synthetic oligonucleotide
gcacgagctaactgcaattgacgccccctctctcctga

SEQ ID NO: 142450 - DNA, 38 bp, Artificial Sequence
  Synthetic oligonucleotide
gcacggatcatctgtacctttgtcctcccttgtcctga

SEQ ID NO: 142451 - DNA, 37 bp, Artificial Sequence
  Synthetic oligonucleotide
aaagagaggcggagtaggcggggaaagcggtaagtga

SEQ ID NO: 142452 - DNA, 38 bp, Artificial Sequence
  Synthetic oligonucleotide
tcacaagagagggggggtgaggcggggttcgtacgtga

SEQ ID NO: 142453 - DNA, 38 bp, Artificial Sequence
  Synthetic oligonucleotide
tttgcacccctatgttcaacgcccctccgcgcccgtga

SEQ ID NO: 142454 - DNA, 38 bp, Artificial Sequence
  Synthetic oligonucleotide
tgacaagctcctccgcacttgcaaccgcccctccgtga

SEQ ID NO: 142455 - DNA, 38 bp, Artificial Sequence
  Synthetic oligonucleotide
tctacccccgcccccgtgccagctcacacggcccttga

SEQ ID NO: 142456 - DNA, 35 bp, Artificial Sequence
  Synthetic oligonucleotide
atgatgcttgcctccttgccctcgccaccttgtta

SEQ ID NO: 142457 - DNA, 35 bp, Artificial Sequence
  Synthetic oligonucleotide
gtccacgcaggtgccaacttacggaatactccccc

SEQ ID NO: 142458 - DNA, 36 bp, Artificial Sequence
  Synthetic oligonucleotide
gtccgccagcctattctccgctgggccttcgttccc

SEQ ID NO: 142459 - DNA, 35 bp, Artificial Sequence
  Synthetic oligonucleotide
acaccacccgccgagcaaggcccataccgccagcc

SEQ ID NO: 142460 - DNA, 35 bp, Artificial Sequence
  Synthetic oligonucleotide
acccagctacggtatggtcaccctaactcgccgcc

SEQ ID NO: 142461 - DNA, 35 bp, Artificial Sequence
  Synthetic oligonucleotide
gcacccctttcatactgctgctgaggcctcgctcc

SEQ ID NO: 142462 - DNA, 35 bp, Artificial Sequence
  Synthetic oligonucleotide
atgccccccctgtaccgtgttacgttcaaccttcc

SEQ ID NO: 142463 - DNA, 35 bp, Artificial Sequence
  Synthetic oligonucleotide
atcctgctcctggtccgtttctattatgccccggc

SEQ ID NO: 142464 - DNA, 35 bp, Artificial Sequence
  Synthetic oligonucleotide
tcgatcaccgccctgtcatttccctggtccttctc

SEQ ID NO: 142465 - DNA, 35 bp, Artificial Sequence
  Synthetic oligonucleotide
gaaacgggcgggcattcagggaagggacgcgagcg

SEQ ID NO: 142466 - DNA, 35 bp, Artificial Sequence
  Synthetic oligonucleotide
gccaccgccgcctgttaacaccttcgtgtttgtcg

SEQ ID NO: 142467 - DNA, 35 bp, Artificial Sequence
  Synthetic oligonucleotide
gccccttcatccagtaagctccacccccgccccgg

SEQ ID NO: 142468 - DNA, 35 bp, Artificial Sequence
  Synthetic oligonucleotide
tcaacccccaactgcgcccccctccctgatttatg

SEQ ID NO: 142469 - DNA, 35 bp, Artificial Sequence
  Synthetic oligonucleotide
tcttgaccgcccccctccgacagctaatcacgctg

SEQ ID NO: 142470 - DNA, 35 bp, Artificial Sequence
  Synthetic oligonucleotide
gacccacctggggctattatgttgatcctttccat

SEQ ID NO: 142471 - DNA, 35 bp, Artificial Sequence
  Synthetic oligonucleotide
gattgcccgacgtcttggtgtccgtctttccacct

SEQ ID NO: 142472 - DNA, 35 bp, Artificial Sequence
  Synthetic oligonucleotide
acacccgccggccctccatttcatcaattgttgct

SEQ ID NO: 142473 - DNA, 35 bp, Artificial Sequence
  Synthetic oligonucleotide
tccgtactccacttggctctcgtccccattcctgt

SEQ ID NO: 142474 - DNA, 35 bp, Artificial Sequence
  Synthetic oligonucleotide
gtgtcgcgccacgctgccctctacgcccggccaaa

SEQ ID NO: 142475 - DNA, 36 bp, Artificial Sequence
  Synthetic oligonucleotide
acgtacctcccctccatttgtaagcactccctttaa

SEQ ID NO: 142476 - DNA, 36 bp, Artificial Sequence
  Synthetic oligonucleotide
gtgccggtcggacttctgtattccgctccttctaca

SEQ ID NO: 142477 - DNA, 36 bp, Artificial Sequence
  Synthetic oligonucleotide
tctcgctgtcgattgtggctcccctgtccttctgca

SEQ ID NO: 142478 - DNA, 35 bp, Artificial Sequence
  Synthetic oligonucleotide
gagatggcatggtcaccctctaccgttcgccctca

SEQ ID NO: 142479 - DNA, 36 bp, Artificial Sequence
  Synthetic oligonucleotide
actacccccgccacctgtttacaacggaactcttca

SEQ ID NO: 142480 - DNA, 33 bp, Artificial Sequence
  Synthetic oligonucleotide
atctgctgttacacattgcccctcttacgccga

SEQ ID NO: 142481 - DNA, 37 bp, Artificial Sequence
  Synthetic oligonucleotide
gatgggaggtaacaggaagatggcaggggggtcagga

SEQ ID NO: 142482 - DNA, 37 bp, Artificial Sequence
  Synthetic oligonucleotide
gaccgccgcacctccgcatttatctctaccgaccgga

SEQ ID NO: 142483 - DNA, 34 bp, Artificial Sequence
  Synthetic oligonucleotide
aagtggggagggagttatacgtagggagttggga

SEQ ID NO: 142484 - DNA, 37 bp, Artificial Sequence
  Synthetic oligonucleotide
tgaaggacccgggggagaagggattaccaggggtgga

SEQ ID NO: 142485 - DNA, 37 bp, Artificial Sequence
  Synthetic oligonucleotide
gcgccctagcaggcggacagttttaccacctccctga

SEQ ID NO: 142486 - DNA, 37 bp, Artificial Sequence
  Synthetic oligonucleotide
tgtaggggggatgggagggtctaaggggagggagtga

SEQ ID NO: 142487 - DNA, 38 bp, Artificial Sequence
  Synthetic oligonucleotide
acacaccgccctatagccatcttcgtcctggactttga

SEQ ID NO: 142488 - DNA, 35 bp, Artificial Sequence
  Synthetic oligonucleotide
ggatcctccgccgtacgcaaaacgcacccgaccta

SEQ ID NO: 142489 - DNA, 36 bp, Artificial Sequence
  Synthetic oligonucleotide
tcccgatcccgttccctatgacgctttaacctgcta

SEQ ID NO: 142490 - DNA, 36 bp, Artificial Sequence
  Synthetic oligonucleotide
tcaccgcccactgctttcccatcgatcagggttcta

SEQ ID NO: 142491 - DNA, 35 bp, Artificial Sequence
  Synthetic oligonucleotide
gcttaccgcctatcgcctctaatgtcccgtttgac

SEQ ID NO: 142492 - DNA, 35 bp, Artificial Sequence
  Synthetic oligonucleotide
tgcgatgtcatcgtagtcttgtaatatcctccccc

SEQ ID NO: 142493 - DNA, 35 bp, Artificial Sequence
  Synthetic oligonucleotide
actctgcttcgagcatccaccttcgtcgaccgccc

SEQ ID NO: 142494 - DNA, 35 bp, Artificial Sequence
  Synthetic oligonucleotide
aaagtgcgacaaagctgtttactcaccgccctccc

SEQ ID NO: 142495 - DNA, 35 bp, Artificial Sequence
  Synthetic oligonucleotide
agcatcgccaacgtcccccctcgcatctgcgcgcc

SEQ ID NO: 142496 - DNA, 35 bp, Artificial Sequence
  Synthetic oligonucleotide
ttcgccgcgttgggccgtcactatgccaccgctcc

SEQ ID NO: 142497 - DNA, 35 bp, Artificial Sequence
  Synthetic oligonucleotide
tgtgcaccttatttccatctatatgactgtgctcc

SEQ ID NO: 142498 - DNA, 35 bp, Artificial Sequence
  Synthetic oligonucleotide
tcgccagagccctcgcctgcttcgttatctcttcc

SEQ ID NO: 142499 - DNA, 35 bp, Artificial Sequence
  Synthetic oligonucleotide
gtgctcgacaactgccaccaagtacctcctgtcgc

SEQ ID NO: 142500 - DNA, 35 bp, Artificial Sequence
  Synthetic oligonucleotide
tgcacccccaatgactcgctcctttcctctccggc

SEQ ID NO: 142501 - DNA, 35 bp, Artificial Sequence
  Synthetic oligonucleotide
gaaccacgtccttccatgcttgttagttttacctc

SEQ ID NO: 142502 - DNA, 35 bp, Artificial Sequence
  Synthetic oligonucleotide
actgctgaggaacaccctctgcgccccccgccctc

SEQ ID NO: 142503 - DNA, 35 bp, Artificial Sequence
  Synthetic oligonucleotide
gccactgtcacacgtcccctcagatggtcctggtc

SEQ ID NO: 142504 - DNA, 35 bp, Artificial Sequence
  Synthetic oligonucleotide
taacgcaccacccatgcattttcggagcttttttc

SEQ ID NO: 142505 - DNA, 35 bp, Artificial Sequence
  Synthetic oligonucleotide
tgaccttcgcccacccatgcctcgcacttcggacg

SEQ ID NO: 142506 - DNA, 35 bp, Artificial Sequence
  Synthetic oligonucleotide
tacgctcccgtggttcaaatctggtctcgttcccg

SEQ ID NO: 142507 - DNA, 36 bp, Artificial Sequence
  Synthetic oligonucleotide
tagagagggaggtaatcggggataggggggaggccg

SEQ ID NO: 142508 - DNA, 35 bp, Artificial Sequence
  Synthetic oligonucleotide
gacgccactgcctcccataatgttcacaccgcggg

SEQ ID NO: 142509 - DNA, 35 bp, Artificial Sequence
  Synthetic oligonucleotide
gtcggggagtgggggggtgtaggggagagatgatg

SEQ ID NO: 142510 - DNA, 35 bp, Artificial Sequence
  Synthetic oligonucleotide
tccacacgcacggtttctgctgccgtgtcctaact

SEQ ID NO: 142511 - DNA, 35 bp, Artificial Sequence
  Synthetic oligonucleotide
tttcatcgccacattgctccagtgctccgcctact

SEQ ID NO: 142512 - DNA, 35 bp, Artificial Sequence
  Synthetic oligonucleotide
acctcattccctccgcgccgtataggtttctatct

SEQ ID NO: 142513 - DNA, 35 bp, Artificial Sequence
  Synthetic oligonucleotide
gccccacctagatatgttcgttttcccgtttgtct

SEQ ID NO: 142514 - DNA, 35 bp, Artificial Sequence
  Synthetic oligonucleotide
atctgccatgccatcacttgcccgccccctccggt

SEQ ID NO: 142515 - DNA, 35 bp, Artificial Sequence
  Synthetic oligonucleotide
gtgccacacactccaccaccattccgcgaatcgtt

SEQ ID NO: 142516 - DNA, 35 bp, Artificial Sequence
  Synthetic oligonucleotide
ggacccgctgtgcctgctctccttaccgttgtttt

SEQ ID NO: 142517 - DNA, 36 bp, Artificial Sequence
  Synthetic oligonucleotide
aatgggtgcacgagggggccggtgaaggtggggtaa

SEQ ID NO: 142518 - DNA, 36 bp, Artificial Sequence
  Synthetic oligonucleotide
agctcctgccaccccttgttacttagccaggccaca

SEQ ID NO: 142519 - DNA, 36 bp, Artificial Sequence
  Synthetic oligonucleotide
tccatcatacattgtagtaattgtaccgcccgccca

SEQ ID NO: 142520 - DNA, 35 bp, Artificial Sequence
  Synthetic oligonucleotide
tagccatgccctccataagtccccacgcacagcca

SEQ ID NO: 142521 - DNA, 36 bp, Artificial Sequence
  Synthetic oligonucleotide
agcacttcgggctggccatcagtacccttctcctca

SEQ ID NO: 142522 - DNA, 37 bp, Artificial Sequence
  Synthetic oligonucleotide
aacgcgtgcccgttgcccttcgccgttcaatatacga

SEQ ID NO: 142523 - DNA, 37 bp, Artificial Sequence
  Synthetic oligonucleotide
tacgttcaccacgtgtttttaccgcctgccccaccga

SEQ ID NO: 142524 - DNA, 37 bp, Artificial Sequence
  Synthetic oligonucleotide
tcagcatcaatcactctagttccgcccttccgcccga

SEQ ID NO: 142525 - DNA, 37 bp, Artificial Sequence
  Synthetic oligonucleotide
tcttagtccgcctgccatgtcctagtgccccccgcga

SEQ ID NO: 142526 - DNA, 37 bp, Artificial Sequence
  Synthetic oligonucleotide
gggagagcaaggggctccaaggggggaaggtgaagga

SEQ ID NO: 142527 - DNA, 37 bp, Artificial Sequence
  Synthetic oligonucleotide
gtgcaataaggaggggggggggtggtacctgggagga

SEQ ID NO: 142528 - DNA, 36 bp, Artificial Sequence
  Synthetic oligonucleotide
gaggaggggaatgaagcaaaaggattaagaagggga

SEQ ID NO: 142529 - DNA, 37 bp, Artificial Sequence
  Synthetic oligonucleotide
ggtgaagagggcgggtcagaggacggggttgggggga

SEQ ID NO: 142530 - DNA, 35 bp, Artificial Sequence
  Synthetic oligonucleotide
tcgcatgggagaggagggcgggaaatcgattatga

SEQ ID NO: 142531 - DNA, 37 bp, Artificial Sequence
  Synthetic oligonucleotide
gtctcatccgcagtgcaaactgccaaccttcccctga

SEQ ID NO: 142532 - DNA, 38 bp, Artificial Sequence
  Synthetic oligonucleotide
gttcccagccgcctcgatgcgatttcccttccgcctga

SEQ ID NO: 142533 - DNA, 38 bp, Artificial Sequence
  Synthetic oligonucleotide
tgtccactcgccctctttaccccgtcagtattcgctga

SEQ ID NO: 142534 - DNA, 38 bp, Artificial Sequence
  Synthetic oligonucleotide
gcgcgatgtgtacatggcccttccctgctttcctctga

SEQ ID NO: 142535 - DNA, 36 bp, Artificial Sequence
  Synthetic oligonucleotide
ggacgtcgccttcgtttctagtccttgtccgcctta

SEQ ID NO: 142536 - DNA, 35 bp, Artificial Sequence
  Synthetic oligonucleotide
aacgccccgcgccaacacgcatcatcgcactgacc

SEQ ID NO: 142537 - DNA, 35 bp, Artificial Sequence
  Synthetic oligonucleotide
gtcacgcccccccggtgaccgacgttcgtccaccc

SEQ ID NO: 142538 - DNA, 35 bp, Artificial Sequence
  Synthetic oligonucleotide
aactgtagctgacgttgcgcccctccgatgctccc

SEQ ID NO: 142539 - DNA, 35 bp, Artificial Sequence
  Synthetic oligonucleotide
accgcacgcatgactttagcatgctgtgattctcc

SEQ ID NO: 142540 - DNA, 35 bp, Artificial Sequence
  Synthetic oligonucleotide
ttgtcatctgaggtgctcctgcgatttccccttcc

SEQ ID NO: 142541 - DNA, 35 bp, Artificial Sequence
  Synthetic oligonucleotide
acccacacctctctgtatccctgatttcatggggc

SEQ ID NO: 142542 - DNA, 35 bp, Artificial Sequence
  Synthetic oligonucleotide
tacttgctccgccaccaatgcttccattcattatc

SEQ ID NO: 142543 - DNA, 35 bp, Artificial Sequence
  Synthetic oligonucleotide
gcccgccgatcccccttatctgcccggcgattatc

SEQ ID NO: 142544 - DNA, 35 bp, Artificial Sequence
  Synthetic oligonucleotide
gcctccttcctctgttgcatagttgcctcgagctc

SEQ ID NO: 142545 - DNA, 35 bp, Artificial Sequence
  Synthetic oligonucleotide
actgccccccccccgatggtctcactagccctttc

SEQ ID NO: 142546 - DNA, 35 bp, Artificial Sequence
  Synthetic oligonucleotide
gtccgccatccgatcatctcattcatccatgctag

SEQ ID NO: 142547 - DNA, 35 bp, Artificial Sequence
  Synthetic oligonucleotide
gactaacttctgtctgttttgatcccttccacccg

SEQ ID NO: 142548 - DNA, 35 bp, Artificial Sequence
  Synthetic oligonucleotide
gtctccgcccacttcgaacaccacatgtacccccg

SEQ ID NO: 142549 - DNA, 35 bp, Artificial Sequence
  Synthetic oligonucleotide
accccatggtcgtccctggttccaacgcccttccg

SEQ ID NO: 142550 - DNA, 35 bp, Artificial Sequence
  Synthetic oligonucleotide
gaacacgctcccatgttacctacctggcctattcg

SEQ ID NO: 142551 - DNA, 35 bp, Artificial Sequence
  Synthetic oligonucleotide
accctgttcccatgcctattcctgcctgccctatg

SEQ ID NO: 142552 - DNA, 35 bp, Artificial Sequence
  Synthetic oligonucleotide
tccattaccatcacgcgcttgcctcaccgctattg

SEQ ID NO: 142553 - DNA, 35 bp, Artificial Sequence
  Synthetic oligonucleotide
acgaaccatgcccccctcgaccgactctgatgact

SEQ ID NO: 142554 - DNA, 35 bp, Artificial Sequence
  Synthetic oligonucleotide
tcaccgcacgccagtattccccccccagtgcccct

SEQ ID NO: 142555 - DNA, 35 bp, Artificial Sequence
  Synthetic oligonucleotide
atctggtctcgtcccatcccgcagccccacccgct

SEQ ID NO: 142556 - DNA, 35 bp, Artificial Sequence
  Synthetic oligonucleotide
aatccttgctgcctatcgtgccccccccattctgt

SEQ ID NO: 142557 - DNA, 36 bp, Artificial Sequence
  Synthetic oligonucleotide
gacggacttccactgactcgccgctgttttccactt

SEQ ID NO: 142558 - DNA, 35 bp, Artificial Sequence
  Synthetic oligonucleotide
tgcaactcacgccgccgtttacacaaccctttgtt

SEQ ID NO: 142559 - DNA, 36 bp, Artificial Sequence
  Synthetic oligonucleotide
gggagactttcacctgctgccgtactcgtcccttca

SEQ ID NO: 142560 - DNA, 37 bp, Artificial Sequence
  Synthetic oligonucleotide
ttaggctgcccctgctccgagccctacccccccgcga

SEQ ID NO: 142561 - DNA, 37 bp, Artificial Sequence
  Synthetic oligonucleotide
tgctgcacgtttgagtacttgttccacccgctctcga

SEQ ID NO: 142562 - DNA, 36 bp, Artificial Sequence
  Synthetic oligonucleotide
ggggtgtgcgcatgccataatatagtgaaagaggga

SEQ ID NO: 142563 - DNA, 37 bp, Artificial Sequence
  Synthetic oligonucleotide
gtccaaccgcactcctatataccccacaccccttgga

SEQ ID NO: 142564 - DNA, 37 bp, Artificial Sequence
  Synthetic oligonucleotide
ttcgttgccctagactgttaccgctacacccacctga

SEQ ID NO: 142565 - DNA, 38 bp, Artificial Sequence
  Synthetic oligonucleotide
ttgtgcgttaagccgcgttccccgccgccctgccctga

SEQ ID NO: 142566 - DNA, 36 bp, Artificial Sequence
  Synthetic oligonucleotide
atgccccgccgccccaccgatatctccaggttctga

SEQ ID NO: 142567 - DNA, 38 bp, Artificial Sequence
  Synthetic oligonucleotide
gctgtgcatggtgaaatgggagggaagcgagggggtga

SEQ ID NO: 142568 - DNA, 38 bp, Artificial Sequence
  Synthetic oligonucleotide
gctgtcactccccccgtattgtttcgcctgtacattga

SEQ ID NO: 142569 - DNA, 36 bp, Artificial Sequence
  Synthetic oligonucleotide
gtgcttgagggtgggtgggttcttcaggggcccata

SEQ ID NO: 142570 - DNA, 35 bp, Artificial Sequence
  Synthetic oligonucleotide
ggaccgcattgggcgttgttcccgtgccttcccta

SEQ ID NO: 142571 - DNA, 33 bp, Artificial Sequence
  Synthetic oligonucleotide
tatcgcgttgcctgggctccatcatttccgtac

SEQ ID NO: 142572 - DNA, 35 bp, Artificial Sequence
  Synthetic oligonucleotide
gatgccggcgccatacttgttctttgaatcccccc

SEQ ID NO: 142573 - DNA, 35 bp, Artificial Sequence
  Synthetic oligonucleotide
gaccgtatgtgcgtcggtcgttctgtctctcgccc

SEQ ID NO: 142574 - DNA, 35 bp, Artificial Sequence
  Synthetic oligonucleotide
gcaccgcaatgatgttgatgttatgccgccttccc

SEQ ID NO: 142575 - DNA, 35 bp, Artificial Sequence
  Synthetic oligonucleotide
acacataggcgactgttaccctgttttgtccttcc

SEQ ID NO: 142576 - DNA, 35 bp, Artificial Sequence
  Synthetic oligonucleotide
tagcccaagcccttcaccctcccttccacctagtc

SEQ ID NO: 142577 - DNA, 35 bp, Artificial Sequence
  Synthetic oligonucleotide
atccgcgtccagccacgctacttactttctccgtc

SEQ ID NO: 142578 - DNA, 35 bp, Artificial Sequence
  Synthetic oligonucleotide
acactccaccctcccatcgttaacgtgcccccacg

SEQ ID NO: 142579 - DNA, 35 bp, Artificial Sequence
  Synthetic oligonucleotide
gcattacccccgcagaaacttcactacgctccacg

SEQ ID NO: 142580 - DNA, 35 bp, Artificial Sequence
  Synthetic oligonucleotide
tgagcaaccttgcccccgccgtttcgtagacatcg

SEQ ID NO: 142581 - DNA, 35 bp, Artificial Sequence
  Synthetic oligonucleotide
taatgaagtgggggtggagggctcaggaaggccgg

SEQ ID NO: 142582 - DNA, 35 bp, Artificial Sequence
  Synthetic oligonucleotide
gactaacgccactacttgcccagacccttggcctg

SEQ ID NO: 142583 - DNA, 35 bp, Artificial Sequence
  Synthetic oligonucleotide
agcgtagagccgcgcccccgtacctccctttattg

SEQ ID NO: 142584 - DNA, 35 bp, Artificial Sequence
  Synthetic oligonucleotide
gaccctacgccgtaactgttacttcacccgtccat

SEQ ID NO: 142585 - DNA, 35 bp, Artificial Sequence
  Synthetic oligonucleotide
gtgagcccctcgtccctctgcccgtttgtttccct

SEQ ID NO: 142586 - DNA, 35 bp, Artificial Sequence
  Synthetic oligonucleotide
accccgacactggcgcaacagccagcggtacctct

SEQ ID NO: 142587 - DNA, 35 bp, Artificial Sequence
  Synthetic oligonucleotide
tccccgactctcgcccctggtagttccacctaatt

SEQ ID NO: 142588 - DNA, 35 bp, Artificial Sequence
  Synthetic oligonucleotide
gtgccccttccgcctgcgtttatctggttaacatt

SEQ ID NO: 142589 - DNA, 35 bp, Artificial Sequence
  Synthetic oligonucleotide
tcgtggctcccctcatcgcttccatatcgtacctt

SEQ ID NO: 142590 - DNA, 35 bp, Artificial Sequence
  Synthetic oligonucleotide
agagcacgggggaattaaaggggcggaggtgggtt

SEQ ID NO: 142591 - DNA, 35 bp, Artificial Sequence
  Synthetic oligonucleotide
gtcgcctgggaggggtgggtaggggtttgacattt

SEQ ID NO: 142592 - DNA, 35 bp, Artificial Sequence
  Synthetic oligonucleotide
agggtgcaggggaagaacgggcggattgggggtaa

SEQ ID NO: 142593 - DNA, 36 bp, Artificial Sequence
  Synthetic oligonucleotide
tagcgcaccccttctggtcctcactccgatcgcaca

SEQ ID NO: 142594 - DNA, 36 bp, Artificial Sequence
  Synthetic oligonucleotide
tccctgcccgcccccagaagcccatcccgagcatca

SEQ ID NO: 142595 - DNA, 36 bp, Artificial Sequence
  Synthetic oligonucleotide
ttccagccctaccctgtactgatctactcgctttca

SEQ ID NO: 142596 - DNA, 36 bp, Artificial Sequence
  Synthetic oligonucleotide
atgctcacgcccaccatctagcaccaaactgtttca

SEQ ID NO: 142597 - DNA, 37 bp, Artificial Sequence
  Synthetic oligonucleotide
gacgcaggggaggtgggggggaagcggaccggagaga

SEQ ID NO: 142598 - DNA, 37 bp, Artificial Sequence
  Synthetic oligonucleotide
ttggccgacagtcgtctccatctgccttccgtttaga

SEQ ID NO: 142599 - DNA, 36 bp, Artificial Sequence
  Synthetic oligonucleotide
aacgttgtgggcaggggacgggaagggcgcagtcga

SEQ ID NO: 142600 - DNA, 38 bp, Artificial Sequence
  Synthetic oligonucleotide
tgacgccattcttgcccgtgcttgccccactccactga

SEQ ID NO: 142601 - DNA, 36 bp, Artificial Sequence
  Synthetic oligonucleotide
ggtttgcgcccgtgtacccttctccccctcctctga

SEQ ID NO: 142602 - DNA, 37 bp, Artificial Sequence
  Synthetic oligonucleotide
acatccaccacatacgtactcttcttcagtccgttga

SEQ ID NO: 142603 - DNA, 36 bp, Artificial Sequence
  Synthetic oligonucleotide
tcccctaccgcccggattgacctcgcctcgtaccta

SEQ ID NO: 142604 - DNA, 35 bp, Artificial Sequence
  Synthetic oligonucleotide
tcagtcctgcctccacttcacttcaaacggacgta

SEQ ID NO: 142605 - DNA, 36 bp, Artificial Sequence
  Synthetic oligonucleotide
gtctgtgcctcttgccccctgttcgtccaccatgta

SEQ ID NO: 142606 - DNA, 35 bp, Artificial Sequence
  Synthetic oligonucleotide
gcccgccagtctccccctataggcacgttatttac

SEQ ID NO: 142607 - DNA, 35 bp, Artificial Sequence
  Synthetic oligonucleotide
gagcgccatctcttgcctagccccgttcactgacc

SEQ ID NO: 142608 - DNA, 35 bp, Artificial Sequence
  Synthetic oligonucleotide
gccaccccttattctggtcctataaccagacctcc

SEQ ID NO: 142609 - DNA, 35 bp, Artificial Sequence
  Synthetic oligonucleotide
acacctctgtcaatccagcgctggcgtttcgctcc

SEQ ID NO: 142610 - DNA, 35 bp, Artificial Sequence
  Synthetic oligonucleotide
acgacactgccagtcgcatcgttttgtctccttcc

SEQ ID NO: 142611 - DNA, 35 bp, Artificial Sequence
  Synthetic oligonucleotide
tcccgcctccgcatacagacagtatcccccatcgc

SEQ ID NO: 142612 - DNA, 35 bp, Artificial Sequence
  Synthetic oligonucleotide
attccgcaagggatccaagcactacatacgccatc

SEQ ID NO: 142613 - DNA, 35 bp, Artificial Sequence
  Synthetic oligonucleotide
tcgcctcatcacatctgctatgcaatgtacctatc

SEQ ID NO: 142614 - DNA, 35 bp, Artificial Sequence
  Synthetic oligonucleotide
gcgcgcggtccatcctgcgactcccccttcccttc

SEQ ID NO: 142615 - DNA, 35 bp, Artificial Sequence
  Synthetic oligonucleotide
gataagctcaccatccgttgccctgtacccccacg

SEQ ID NO: 142616 - DNA, 35 bp, Artificial Sequence
  Synthetic oligonucleotide
accgctgttcacataattcgcgatctcctccaccg

SEQ ID NO: 142617 - DNA, 35 bp, Artificial Sequence
  Synthetic oligonucleotide
gacttccccagacctatgaaccgcacctcacatcg

SEQ ID NO: 142618 - DNA, 35 bp, Artificial Sequence
  Synthetic oligonucleotide
tccacccaggacatgttcgctacacctgcctatcg

SEQ ID NO: 142619 - DNA, 35 bp, Artificial Sequence
  Synthetic oligonucleotide
tcgcgccatcccacaatgcaatacccgctcacctg

SEQ ID NO: 142620 - DNA, 35 bp, Artificial Sequence
  Synthetic oligonucleotide
gcatccccgccacctgtctgttctccgtttctact

SEQ ID NO: 142621 - DNA, 35 bp, Artificial Sequence
  Synthetic oligonucleotide
acccaattcgtgtgttgtatcgcgcgccccttcct

SEQ ID NO: 142622 - DNA, 35 bp, Artificial Sequence
  Synthetic oligonucleotide
tccgaggcatcaggatcttatctgacgccctctct

SEQ ID NO: 142623 - DNA, 34 bp, Artificial Sequence
  Synthetic oligonucleotide
gcaggtgacccactgcctattgtttaccttctct

SEQ ID NO: 142624 - DNA, 35 bp, Artificial Sequence
  Synthetic oligonucleotide
acgcaaccccttgtactctacccctcccatccggt

SEQ ID NO: 142625 - DNA, 35 bp, Artificial Sequence
  Synthetic oligonucleotide
ttgaagacgtcacacgccccctagccgcccattgt

SEQ ID NO: 142626 - DNA, 35 bp, Artificial Sequence
  Synthetic oligonucleotide
gacgactccgccgaaaccgttcgggactccccctt

SEQ ID NO: 142627 - DNA, 35 bp, Artificial Sequence
  Synthetic oligonucleotide
ggactcccccgtgcacaaaactgccggcttccctt

SEQ ID NO: 142628 - DNA, 36 bp, Artificial Sequence
  Synthetic oligonucleotide
acccccccacggagccacgaactgcctgaccacgaa

SEQ ID NO: 142629 - DNA, 36 bp, Artificial Sequence
  Synthetic oligonucleotide
atttgcccatcttgacttgcctccacaggtgaccca

SEQ ID NO: 142630 - DNA, 35 bp, Artificial Sequence
  Synthetic oligonucleotide
gtccaaatctcctgaatgtctcgttcccatgccca

SEQ ID NO: 142631 - DNA, 35 bp, Artificial Sequence
  Synthetic oligonucleotide
tgtcacacgcccatgtcccttgttgtcaccatgca

SEQ ID NO: 142632 - DNA, 34 bp, Artificial Sequence
  Synthetic oligonucleotide
accagcccaaatcctcgccacctgcgactctgca

SEQ ID NO: 142633 - DNA, 36 bp, Artificial Sequence
  Synthetic oligonucleotide
ggacccactctaccgtgcacttcctggccttgttca

SEQ ID NO: 142634 - DNA, 35 bp, Artificial Sequence
  Synthetic oligonucleotide
actcacaggtgtgcctcccactgtctgccttttca

SEQ ID NO: 142635 - DNA, 37 bp, Artificial Sequence
  Synthetic oligonucleotide
atcgcattgggtggggagggaaggcggggggataaga

SEQ ID NO: 142636 - DNA, 36 bp, Artificial Sequence
  Synthetic oligonucleotide
gaggaagtgagggaaaggaacggcggggtagtacga

SEQ ID NO: 142637 - DNA, 36 bp, Artificial Sequence
  Synthetic oligonucleotide
tgcggggagacggtggaggaaacggaggagggtcga

SEQ ID NO: 142638 - DNA, 37 bp, Artificial Sequence
  Synthetic oligonucleotide
tgcactctgcctccgatcatttttccgccgccacgga

SEQ ID NO: 142639 - DNA, 37 bp, Artificial Sequence
  Synthetic oligonucleotide
gagaggagggagggcgtactttgggggctgttaggga

SEQ ID NO: 142640 - DNA, 37 bp, Artificial Sequence
  Synthetic oligonucleotide
taggcgaagggcaggacctgggaagggagggcttgga

SEQ ID NO: 142641 - DNA, 37 bp, Artificial Sequence
  Synthetic oligonucleotide
gatcgtcgatgctccgcccgtccacgtcccttcctga

SEQ ID NO: 142642 - DNA, 37 bp, Artificial Sequence
  Synthetic oligonucleotide
ttgaccggcaccttcacgtttcgcccttctttgctga

SEQ ID NO: 142643 - DNA, 38 bp, Artificial Sequence
  Synthetic oligonucleotide
gcctgtcgtagccccgttatctcccactcgtcttctga

SEQ ID NO: 142644 - DNA, 37 bp, Artificial Sequence
  Synthetic oligonucleotide
accccgacctcctcctccctgagtcactgtcaattga

SEQ ID NO: 142645 - DNA, 35 bp, Artificial Sequence
  Synthetic oligonucleotide
ttcccatccgttagctcctcctcctgtgcgcttga

SEQ ID NO: 142646 - DNA, 34 bp, Artificial Sequence
  Synthetic oligonucleotide
gtaccccctctgccccttctcgattataggttga

SEQ ID NO: 142647 - DNA, 36 bp, Artificial Sequence
  Synthetic oligonucleotide
tttgactcctcgattcgcccttattcacagtccgta

SEQ ID NO: 142648 - DNA, 35 bp, Artificial Sequence
  Synthetic oligonucleotide
gtgacgcacagtggccgccactgtacaccttccac

SEQ ID NO: 142649 - DNA, 35 bp, Artificial Sequence
  Synthetic oligonucleotide
caataccccgccccgttgagtaccctgctccgacc

SEQ ID NO: 142650 - DNA, 35 bp, Artificial Sequence
  Synthetic oligonucleotide
atcgaccctttacttatgttcacatgtccgtgccc

SEQ ID NO: 142651 - DNA, 35 bp, Artificial Sequence
  Synthetic oligonucleotide
aacctttgccctccggtagtgctattccccatccc

SEQ ID NO: 142652 - DNA, 35 bp, Artificial Sequence
  Synthetic oligonucleotide
gaccctttccgagatgcatacccgctccgctagcc

SEQ ID NO: 142653 - DNA, 35 bp, Artificial Sequence
  Synthetic oligonucleotide
tgaggcctgcgaccgtcgccgtctctactttgtcc

SEQ ID NO: 142654 - DNA, 35 bp, Artificial Sequence
  Synthetic oligonucleotide
tcgcggggaggtcatttattcgtgcgccctgttcc

SEQ ID NO: 142655 - DNA, 35 bp, Artificial Sequence
  Synthetic oligonucleotide
acattcctcgcctcataattgcctttctgacgggc

SEQ ID NO: 142656 - DNA, 35 bp, Artificial Sequence
  Synthetic oligonucleotide
gtcatcccctggctttcccgcaggctcctattggc

SEQ ID NO: 142657 - DNA, 35 bp, Artificial Sequence
  Synthetic oligonucleotide
gtgataacaacacctcttcccgcgtgccttctccg

SEQ ID NO: 142658 - DNA, 35 bp, Artificial Sequence
  Synthetic oligonucleotide
gagcgctgccccttctaccacctttttgtcgctgg

SEQ ID NO: 142659 - DNA, 35 bp, Artificial Sequence
  Synthetic oligonucleotide
tctcggccccgaccggtcgacgttactgccctcct

SEQ ID NO: 142660 - DNA, 35 bp, Artificial Sequence
  Synthetic oligonucleotide
gccccacccgcgctacacgatccatctcttgtgct

SEQ ID NO: 142661 - DNA, 35 bp, Artificial Sequence
  Synthetic oligonucleotide
tccacctcacactactccgtactgcctcggtatct

SEQ ID NO: 142662 - DNA, 35 bp, Artificial Sequence
  Synthetic oligonucleotide
tctggcacccctgtgatttaggtttcggtccctct

SEQ ID NO: 142663 - DNA, 35 bp, Artificial Sequence
  Synthetic oligonucleotide
agcaaagctcctgccccggcgaaccacactgctct

SEQ ID NO: 142664 - DNA, 35 bp, Artificial Sequence
  Synthetic oligonucleotide
gacctagccaactgccctgtacctcatcgttctct

SEQ ID NO: 142665 - DNA, 35 bp, Artificial Sequence
  Synthetic oligonucleotide
tgaccccgaccctgtacctgcacccataggttatt

SEQ ID NO: 142666 - DNA, 35 bp, Artificial Sequence
  Synthetic oligonucleotide
tgttccacctaacctgactatacaatgacaccctt

SEQ ID NO: 142667 - DNA, 35 bp, Artificial Sequence
  Synthetic oligonucleotide
ggtacgggaaagagggaggttgagggggtgacgaa

SEQ ID NO: 142668 - DNA, 36 bp, Artificial Sequence
  Synthetic oligonucleotide
gttgggtcgtggcgagacgggtgcgggggggtggaa

SEQ ID NO: 142669 - DNA, 35 bp, Artificial Sequence
  Synthetic oligonucleotide
tgcacatcccacccctcccgtcacagtgtgcacca

SEQ ID NO: 142670 - DNA, 35 bp, Artificial Sequence
  Synthetic oligonucleotide
atttacatcctccatgcctactagaagcctggcca

SEQ ID NO: 142671 - DNA, 35 bp, Artificial Sequence
  Synthetic oligonucleotide
accagtgccctgtcacctcgatcatctcccatgca

SEQ ID NO: 142672 - DNA, 36 bp, Artificial Sequence
  Synthetic oligonucleotide
agatgggcccgctgtacctcctgctcacacacttca

SEQ ID NO: 142673 - DNA, 37 bp, Artificial Sequence
  Synthetic oligonucleotide
gccaacgtacgcatgtatgtagctatcccgctcccga

SEQ ID NO: 142674 - DNA, 37 bp, Artificial Sequence
  Synthetic oligonucleotide
tctccaccgtcctcggtcccttgcctcgtttacgcga

SEQ ID NO: 142675 - DNA, 35 bp, Artificial Sequence
  Synthetic oligonucleotide
tgcgattaccctcaccgtcgcccccgttccatcga

SEQ ID NO: 142676 - DNA, 35 bp, Artificial Sequence
  Synthetic oligonucleotide
tctccccgttgttcgcactgcccacagttcctcga

SEQ ID NO: 142677 - DNA, 36 bp, Artificial Sequence
  Synthetic oligonucleotide
gaggtgatgaatgggtgggtaggcggagggctagga

SEQ ID NO: 142678 - DNA, 35 bp, Artificial Sequence
  Synthetic oligonucleotide
ggtaacgagatggggtgggggggggctgctaggga

SEQ ID NO: 142679 - DNA, 37 bp, Artificial Sequence
  Synthetic oligonucleotide
tgagggaacggctgggggagaagggcatggtacggga

SEQ ID NO: 142680 - DNA, 37 bp, Artificial Sequence
  Synthetic oligonucleotide
tccgaccaactctcctcgtgttgccttccctactgga

SEQ ID NO: 142681 - DNA, 38 bp, Artificial Sequence
  Synthetic oligonucleotide
ttgcctaccttgcttttacacccagccttccgtgctga

SEQ ID NO: 142682 - DNA, 38 bp, Artificial Sequence
  Synthetic oligonucleotide
gcctaaccggcaaaaggagggagtaggagagggattga

SEQ ID NO: 142683 - DNA, 38 bp, Artificial Sequence
  Synthetic oligonucleotide
tgcgataccgccccgtgaacactgtaccaactccttga

SEQ ID NO: 142684 - DNA, 38 bp, Artificial Sequence
  Synthetic oligonucleotide
gccccggcctgaggcgtgcccctcctcctccatcttga

SEQ ID NO: 142685 - DNA, 36 bp, Artificial Sequence
  Synthetic oligonucleotide
gagcacacccgaccctgccgcttttcgccataacta

SEQ ID NO: 142686 - DNA, 35 bp, Artificial Sequence
  Synthetic oligonucleotide
ttgtacacgcgctgtccccgacccttctttctgac

SEQ ID NO: 142687 - DNA, 35 bp, Artificial Sequence
  Synthetic oligonucleotide
tacgcactactagactttccccgtggccgttatac

SEQ ID NO: 142688 - DNA, 35 bp, Artificial Sequence
  Synthetic oligonucleotide
actccatgtgcccacgccgccgacaggccctaacc

SEQ ID NO: 142689 - DNA, 35 bp, Artificial Sequence
  Synthetic oligonucleotide
gccaacatccggtccacccttaggctaccaccacc

SEQ ID NO: 142690 - DNA, 35 bp, Artificial Sequence
  Synthetic oligonucleotide
tacccacgcggctcgttcattttcaatagtccccc

SEQ ID NO: 142691 - DNA, 35 bp, Artificial Sequence
  Synthetic oligonucleotide
tccggccccattggtactcactccagcgccttgcc

SEQ ID NO: 142692 - DNA, 34 bp, Artificial Sequence
  Synthetic oligonucleotide
actcacgcctccagggtcaagtgcgccccttatc

SEQ ID NO: 142693 - DNA, 35 bp, Artificial Sequence
  Synthetic oligonucleotide
tcccaattccgctagtagaagctctcgcctctgtc

SEQ ID NO: 142694 - DNA, 35 bp, Artificial Sequence
  Synthetic oligonucleotide
tcggtaccccgttgttcttcgtgcccgtctccttc

SEQ ID NO: 142695 - DNA, 35 bp, Artificial Sequence
  Synthetic oligonucleotide
gtgccggcctccgagagcactcgcacacctttttc

SEQ ID NO: 142696 - DNA, 35 bp, Artificial Sequence
  Synthetic oligonucleotide
gctgttctcaatacccgacctccttccgcctctgg

SEQ ID NO: 142697 - DNA, 35 bp, Artificial Sequence
  Synthetic oligonucleotide
ggtacagtcagagtctaacgtctcactccatcctg

SEQ ID NO: 142698 - DNA, 35 bp, Artificial Sequence
  Synthetic oligonucleotide
gccgagcccctcccctttatgtgttcccctaattg

SEQ ID NO: 142699 - DNA, 35 bp, Artificial Sequence
  Synthetic oligonucleotide
ttcccccattccagagtgttccagtccccgtccgt

SEQ ID NO: 142700 - DNA, 35 bp, Artificial Sequence
  Synthetic oligonucleotide
gcgtcccccctgtagtcccggcgtcaccaaccctt

SEQ ID NO: 142701 - DNA, 35 bp, Artificial Sequence
  Synthetic oligonucleotide
agccaccctgagcacattcgttcgactgccccttt

SEQ ID NO: 142702 - DNA, 29 bp, Artificial Sequence
  Synthetic oligonucleotide
atcctccgccaatctcgtagtccttcttt

SEQ ID NO: 142703 - DNA, 36 bp, Artificial Sequence
  Synthetic oligonucleotide
gtgtcctgccttgtccacatctagtacactgtccca

SEQ ID NO: 142704 - DNA, 35 bp, Artificial Sequence
  Synthetic oligonucleotide
ttgcccacgccggtctggtttccctatgttcgcca

SEQ ID NO: 142705 - DNA, 35 bp, Artificial Sequence
  Synthetic oligonucleotide
atcctccgtcgtaccgttccgcccagccattcgca

SEQ ID NO: 142706 - DNA, 37 bp, Artificial Sequence
  Synthetic oligonucleotide
atgggcgggcgggacatggggttaatcagggtagaga

SEQ ID NO: 142707 - DNA, 37 bp, Artificial Sequence
  Synthetic oligonucleotide
gtgttcgccccaactcttatgctctcttaccgcatga

SEQ ID NO: 142708 - DNA, 38 bp, Artificial Sequence
  Synthetic oligonucleotide
gaccccccgtacctcgtttgaacgctgaccttcactga

SEQ ID NO: 142709 - DNA, 38 bp, Artificial Sequence
  Synthetic oligonucleotide
atgggagggagggcgggatctgcaactgtgtattctga

SEQ ID NO: 142710 - DNA, 38 bp, Artificial Sequence
  Synthetic oligonucleotide
acccactaccccagctgcaccttacatccccgcggtga

SEQ ID NO: 142711 - DNA, 35 bp, Artificial Sequence
  Synthetic oligonucleotide
gagaggactccgtgtcgatcgcccctcttgccgta

SEQ ID NO: 142712 - DNA, 35 bp, Artificial Sequence
  Synthetic oligonucleotide
acaaggggggggagggggggctggataggtggaac

SEQ ID NO: 142713 - DNA, 35 bp, Artificial Sequence
  Synthetic oligonucleotide
ttcgccgatgttctcatgtcgttatttcgtcccac

SEQ ID NO: 142714 - DNA, 35 bp, Artificial Sequence
  Synthetic oligonucleotide
aactgtatcactcgctcccacgccgtgccataacc

SEQ ID NO: 142715 - DNA, 35 bp, Artificial Sequence
  Synthetic oligonucleotide
tcaaccacactccgccgctgcggtcgctccatacc

SEQ ID NO: 142716 - DNA, 35 bp, Artificial Sequence
  Synthetic oligonucleotide
gtctcgccaccttgcctgttgaacccatccttgcc

SEQ ID NO: 142717 - DNA, 35 bp, Artificial Sequence
  Synthetic oligonucleotide
actccctgctcggactttatgccggatttttctcc

SEQ ID NO: 142718 - DNA, 34 bp, Artificial Sequence
  Synthetic oligonucleotide
gcccacgtagatgattcccgccttttcctgttgc

SEQ ID NO: 142719 - DNA, 35 bp, Artificial Sequence
  Synthetic oligonucleotide
aatgcccactggttcgcctcacaggggcccccctc

SEQ ID NO: 142720 - DNA, 35 bp, Artificial Sequence
  Synthetic oligonucleotide
tccgccacggctgcttgtcccgccccttgtccctc

SEQ ID NO: 142721 - DNA, 35 bp, Artificial Sequence
  Synthetic oligonucleotide
gttgtcacgtactctgaatgatttccacccgtctc

SEQ ID NO: 142722 - DNA, 35 bp, Artificial Sequence
  Synthetic oligonucleotide
tgtacatcacggcccattagtcgacgtcccccgtc

SEQ ID NO: 142723 - DNA, 34 bp, Artificial Sequence
  Synthetic oligonucleotide
acattactcgcaccccgtcacctgcattctcacg

SEQ ID NO: 142724 - DNA, 35 bp, Artificial Sequence
  Synthetic oligonucleotide
agcgccagctaggggggagggcaaaggtagagggg

SEQ ID NO: 142725 - DNA, 35 bp, Artificial Sequence
  Synthetic oligonucleotide
gaatggggaggaggggcagtaaaagggaaatttgg

SEQ ID NO: 142726 - DNA, 35 bp, Artificial Sequence
  Synthetic oligonucleotide
tagacacctccaccgttcgctaccgcccttacatg

SEQ ID NO: 142727 - DNA, 35 bp, Artificial Sequence
  Synthetic oligonucleotide
gtttgtccccaccatgtgtatccgccctccccctg

SEQ ID NO: 142728 - DNA, 36 bp, Artificial Sequence
  Synthetic oligonucleotide
actagcaccatcgcatcctttttagtaacatcgctg

SEQ ID NO: 142729 - DNA, 35 bp, Artificial Sequence
  Synthetic oligonucleotide
gaaggttggcgggggggttgcggagagtccggcat

SEQ ID NO: 142730 - DNA, 35 bp, Artificial Sequence
  Synthetic oligonucleotide
tcctggtactgtcgttatggccgcctttcctccct

SEQ ID NO: 142731 - DNA, 35 bp, Artificial Sequence
  Synthetic oligonucleotide
tcctcatcctccgagaatcgatttcaagaccgcct

SEQ ID NO: 142732 - DNA, 35 bp, Artificial Sequence
  Synthetic oligonucleotide
gctcagctcgccgagcgccttcgcccttgcactct

SEQ ID NO: 142733 - DNA, 35 bp, Artificial Sequence
  Synthetic oligonucleotide
aattcgccccgcaattaccgccctcgcctttcttt

SEQ ID NO: 142734 - DNA, 35 bp, Artificial Sequence
  Synthetic oligonucleotide
gccaggtcatcttcgctcccgctcggctctggttt

SEQ ID NO: 142735 - DNA, 35 bp, Artificial Sequence
  Synthetic oligonucleotide
gctgaccctccccatgtgtcgaacccccgatgtca

SEQ ID NO: 142736 - DNA, 36 bp, Artificial Sequence
  Synthetic oligonucleotide
agatggcccagctagcgttaccgccactcttcttca

SEQ ID NO: 142737 - DNA, 36 bp, Artificial Sequence
  Synthetic oligonucleotide
tcacatgcccgccgctattgatcctgtggttcttca

SEQ ID NO: 142738 - DNA, 36 bp, Artificial Sequence
  Synthetic oligonucleotide
gcacgtgccgccagattccgaattgcccactctcga

SEQ ID NO: 142739 - DNA, 37 bp, Artificial Sequence
  Synthetic oligonucleotide
gacgggaaccggggtcaattagggcggagtgggcgga

SEQ ID NO: 142740 - DNA, 38 bp, Artificial Sequence
  Synthetic oligonucleotide
agcccccgccctacatcagacatcgtccgaccccctga

SEQ ID NO: 142741 - DNA, 38 bp, Artificial Sequence
  Synthetic oligonucleotide
acagactccgccctgtgcccatgttgacctatccctga

SEQ ID NO: 142742 - DNA, 38 bp, Artificial Sequence
  Synthetic oligonucleotide
tgacagttcgccttgtagccattcgccgcccttcctga

SEQ ID NO: 142743 - DNA, 37 bp, Artificial Sequence
  Synthetic oligonucleotide
gcaccactgccgccccttctaagacttgatcatctga

SEQ ID NO: 142744 - DNA, 38 bp, Artificial Sequence
  Synthetic oligonucleotide
gtagaggaggagagggtaacgacgtacggggcaggtga

SEQ ID NO: 142745 - DNA, 38 bp, Artificial Sequence
  Synthetic oligonucleotide
tatggggaaggaggacgggggggattgcagttcggtga

SEQ ID NO: 142746 - DNA, 37 bp, Artificial Sequence
  Synthetic oligonucleotide
ttggccgccccctctgtttcccaggtgtctctcttga

SEQ ID NO: 142747 - DNA, 36 bp, Artificial Sequence
  Synthetic oligonucleotide
gtcgtccatcctcttgccgctcaccaactctcacta

SEQ ID NO: 142748 - DNA, 36 bp, Artificial Sequence
  Synthetic oligonucleotide
acgcgtgcgggtatgcgtctattcctccctctcgta

SEQ ID NO: 142749 - DNA, 36 bp, Artificial Sequence
  Synthetic oligonucleotide
tctgacaacccccaaccggctttgagccacacctta

SEQ ID NO: 142750 - DNA, 35 bp, Artificial Sequence
  Synthetic oligonucleotide
acacgaccggcccttctgttgactaccgctattac

SEQ ID NO: 142751 - DNA, 35 bp, Artificial Sequence
  Synthetic oligonucleotide
agcacactcactgcgttttcgcggtgctctcgccc

SEQ ID NO: 142752 - DNA, 35 bp, Artificial Sequence
  Synthetic oligonucleotide
gccaggacgccgcctccacccctgttcactggccc

SEQ ID NO: 142753 - DNA, 35 bp, Artificial Sequence
  Synthetic oligonucleotide
tttcgacgcgcatgcacctgtctgcacatcttccc

SEQ ID NO: 142754 - DNA, 35 bp, Artificial Sequence
  Synthetic oligonucleotide
ggccagacggcccagcgctgctcattatcccctcc

SEQ ID NO: 142755 - DNA, 35 bp, Artificial Sequence
  Synthetic oligonucleotide
gcatagctgtgcgcataattgttgttcccgtttcc

SEQ ID NO: 142756 - DNA, 35 bp, Artificial Sequence
  Synthetic oligonucleotide
tggggagaagggcgggtggcttggggacgggaagc

SEQ ID NO: 142757 - DNA, 35 bp, Artificial Sequence
  Synthetic oligonucleotide
gtgccccccatcagagccgatcccgccgtcatagc

SEQ ID NO: 142758 - DNA, 35 bp, Artificial Sequence
  Synthetic oligonucleotide
gcagactcacctactgttcaacttcctcgtttcgc

SEQ ID NO: 142759 - DNA, 35 bp, Artificial Sequence
  Synthetic oligonucleotide
gccgagggtcactcttcaacatcctgggcccactc

SEQ ID NO: 142760 - DNA, 35 bp, Artificial Sequence
  Synthetic oligonucleotide
acttgtcccgccggccgtctagcgctcatcccctc

SEQ ID NO: 142761 - DNA, 35 bp, Artificial Sequence
  Synthetic oligonucleotide
accaccacttatgttgcttcttgcgcctgctcctc

SEQ ID NO: 142762 - DNA, 35 bp, Artificial Sequence
  Synthetic oligonucleotide
taatccatcggtctcactgtacctgtgtccccccg

SEQ ID NO: 142763 - DNA, 35 bp, Artificial Sequence
  Synthetic oligonucleotide
gttactgccgatcgctgcccctctacgctcccgcg

SEQ ID NO: 142764 - DNA, 35 bp, Artificial Sequence
  Synthetic oligonucleotide
tcagacactgcccaccgtccataactcgagcctat

SEQ ID NO: 142765 - DNA, 35 bp, Artificial Sequence
  Synthetic oligonucleotide
tactgacgccggacccttcaaattccactttctat

SEQ ID NO: 142766 - DNA, 35 bp, Artificial Sequence
  Synthetic oligonucleotide
atgcccactctctcaccatgttgcccgaactaact

SEQ ID NO: 142767 - DNA, 36 bp, Artificial Sequence
  Synthetic oligonucleotide
atcgctcccgatcggatcttgtgccttccccagtct

SEQ ID NO: 142768 - DNA, 35 bp, Artificial Sequence
  Synthetic oligonucleotide
attcacgtgtccatcgtaccgtccatcctatctgt

SEQ ID NO: 142769 - DNA, 36 bp, Artificial Sequence
  Synthetic oligonucleotide
atgtggccaccacacctccgccatgccgcccctcaa

SEQ ID NO: 142770 - DNA, 36 bp, Artificial Sequence
  Synthetic oligonucleotide
gctgacatcccagcactttcgaccccgtgcctacca

SEQ ID NO: 142771 - DNA, 35 bp, Artificial Sequence
  Synthetic oligonucleotide
atcctgtccgccgctattgttacgtgtcccggcca

SEQ ID NO: 142772 - DNA, 37 bp, Artificial Sequence
  Synthetic oligonucleotide
gcaacagtcctcgctcgcatagtagcccgcccccaga

SEQ ID NO: 142773 - DNA, 37 bp, Artificial Sequence
  Synthetic oligonucleotide
agccgggggtggacggtaggagcgggtattaggcaga

SEQ ID NO: 142774 - DNA, 37 bp, Artificial Sequence
  Synthetic oligonucleotide
tcactcgcccccatcgtttgcgaagtcttttcgacga

SEQ ID NO: 142775 - DNA, 37 bp, Artificial Sequence
  Synthetic oligonucleotide
aaccgcagattgcttccacgaccacctccgctcccga

SEQ ID NO: 142776 - DNA, 37 bp, Artificial Sequence
  Synthetic oligonucleotide
gcacctccccacgccatgcgattccgctcttgtccga

SEQ ID NO: 142777 - DNA, 37 bp, Artificial Sequence
  Synthetic oligonucleotide
gtgacagtccttcacatgaccactatcccgctctcga

SEQ ID NO: 142778 - DNA, 37 bp, Artificial Sequence
  Synthetic oligonucleotide
ggtggatcgaagggctaggggaaactagaggggagga

SEQ ID NO: 142779 - DNA, 37 bp, Artificial Sequence
  Synthetic oligonucleotide
agcaccacgcacacacatattagccacctgacccgga

SEQ ID NO: 142780 - DNA, 37 bp, Artificial Sequence
  Synthetic oligonucleotide
taccaccccgctatttagtgccgcccacctcgtatga

SEQ ID NO: 142781 - DNA, 38 bp, Artificial Sequence
  Synthetic oligonucleotide
gaagagggaggggtctgacgaaaagggcgggtaattga

SEQ ID NO: 142782 - DNA, 38 bp, Artificial Sequence
  Synthetic oligonucleotide
gcacgacggtctcgtaagccgttccctgtcctccttga

SEQ ID NO: 142783 - DNA, 35 bp, Artificial Sequence
  Synthetic oligonucleotide
tttggcctttctcgcagcctgcccattgaccgtac

SEQ ID NO: 142784 - DNA, 35 bp, Artificial Sequence
  Synthetic oligonucleotide
gaactccccctttctgtgtgcctcgatattgctgc

SEQ ID NO: 142785 - DNA, 35 bp, Artificial Sequence
  Synthetic oligonucleotide
gctctgccaggcctccaaacgcaccgggccccttc

SEQ ID NO: 142786 - DNA, 35 bp, Artificial Sequence
  Synthetic oligonucleotide
aaacagcacctctcacccctgcctgtctcgacccg

SEQ ID NO: 142787 - DNA, 35 bp, Artificial Sequence
  Synthetic oligonucleotide
agaaggagaagggggcaagaatagggatacatcgg

SEQ ID NO: 142788 - DNA, 35 bp, Artificial Sequence
  Synthetic oligonucleotide
atatggcgggtggaggcgggaggggagttcgtggg

SEQ ID NO: 142789 - DNA, 35 bp, Artificial Sequence
  Synthetic oligonucleotide
attgacgcgggcacatgaaccgcgctacactctct

SEQ ID NO: 142790 - DNA, 35 bp, Artificial Sequence
  Synthetic oligonucleotide
gtgcactccccggcctccactcatcagtgccccgt

SEQ ID NO: 142791 - DNA, 35 bp, Artificial Sequence
  Synthetic oligonucleotide
gagccgcagctgttgccgtctgtcatagcctcctt

SEQ ID NO: 142792 - DNA, 36 bp, Artificial Sequence
  Synthetic oligonucleotide
aagggggagcgccggggagggataattcggggagca

SEQ ID NO: 142793 - DNA, 36 bp, Artificial Sequence
  Synthetic oligonucleotide
ttccgtcacccgacccgcccttcgacctgatctgca

SEQ ID NO: 142794 - DNA, 36 bp, Artificial Sequence
  Synthetic oligonucleotide
gaccgcccagccacggctattaacttacctcgctca

SEQ ID NO: 142795 - DNA, 34 bp, Artificial Sequence
  Synthetic oligonucleotide
gtgtgactcacatctgattgacttacacctctca

SEQ ID NO: 142796 - DNA, 36 bp, Artificial Sequence
  Synthetic oligonucleotide
agcacaaccaatgtgccctgtacttccccgttgtca

SEQ ID NO: 142797 - DNA, 35 bp, Artificial Sequence
  Synthetic oligonucleotide
acgtgggctgaaacgggggggtgggttgtaataga

SEQ ID NO: 142798 - DNA, 37 bp, Artificial Sequence
  Synthetic oligonucleotide
tatgggtaggggggtacggggacgagggggaatccga

SEQ ID NO: 142799 - DNA, 35 bp, Artificial Sequence
  Synthetic oligonucleotide
ggtgtagcacaaggggggagggagcgttgaggcga

SEQ ID NO: 142800 - DNA, 36 bp, Artificial Sequence
  Synthetic oligonucleotide
atgggacattcggggtgaaggggggggcatgaggga

SEQ ID NO: 142801 - DNA, 37 bp, Artificial Sequence
  Synthetic oligonucleotide
gtgggctacagggagccgttatagggggtggagggga

SEQ ID NO: 142802 - DNA, 38 bp, Artificial Sequence
  Synthetic oligonucleotide
actgccgttcccgtctgcctaccaaagcacctctctga

SEQ ID NO: 142803 - DNA, 37 bp, Artificial Sequence
  Synthetic oligonucleotide
atagccccgtacctcgattgccacttagccaccttga

SEQ ID NO: 142804 - DNA, 38 bp, Artificial Sequence
  Synthetic oligonucleotide
gtcggagggtgggtacgggaggggcgccgcttgtttga

SEQ ID NO: 142805 - DNA, 38 bp, Artificial Sequence
  Synthetic oligonucleotide
gacccccccgcagtcgtatcatcgtttcacctttttga

SEQ ID NO: 142806 - DNA, 36 bp, Artificial Sequence
  Synthetic oligonucleotide
gtcaacacccgcccgacctcgtttcaattcatcata

SEQ ID NO: 142807 - DNA, 36 bp, Artificial Sequence
  Synthetic oligonucleotide
ggacactccgccacttcgttctctagcttatactta

SEQ ID NO: 142808 - DNA, 35 bp, Artificial Sequence
  Synthetic oligonucleotide
ttgtgcacgccccgtacttcatcaacgtttgcaac

SEQ ID NO: 142809 - DNA, 35 bp, Artificial Sequence
  Synthetic oligonucleotide
tcaccgcctttcctgccacgtgtgttcatttacac

SEQ ID NO: 142810 - DNA, 35 bp, Artificial Sequence
  Synthetic oligonucleotide
atccctgatcggcgcccgactccgagtctcctcac

SEQ ID NO: 142811 - DNA, 35 bp, Artificial Sequence
  Synthetic oligonucleotide
atctgcactgccctttgtctacacctgttcacgcc

SEQ ID NO: 142812 - DNA, 35 bp, Artificial Sequence
  Synthetic oligonucleotide
ttcccactgcgctacaagtgcaacactcttcatcc

SEQ ID NO: 142813 - DNA, 35 bp, Artificial Sequence
  Synthetic oligonucleotide
gcctgcatgccgggaaccccccactgcgatcctcc

SEQ ID NO: 142814 - DNA, 35 bp, Artificial Sequence
  Synthetic oligonucleotide
agtccactccctgctgcaccttgagccgaaagtcc

SEQ ID NO: 142815 - DNA, 35 bp, Artificial Sequence
  Synthetic oligonucleotide
atgcctgacgtccgatacgcggatcgtctccttcc

SEQ ID NO: 142816 - DNA, 35 bp, Artificial Sequence
  Synthetic oligonucleotide
accctgcgcttcacattttgggtccccactcttcc

SEQ ID NO: 142817 - DNA, 36 bp, Artificial Sequence
  Synthetic oligonucleotide
tccctccgtcctgtcccttcaatgccacagactagc

SEQ ID NO: 142818 - DNA, 35 bp, Artificial Sequence
  Synthetic oligonucleotide
gtcctcatccgcttgcagctagttccgcccttagc

SEQ ID NO: 142819 - DNA, 35 bp, Artificial Sequence
  Synthetic oligonucleotide
gccgcggtacgccacacgcttgacctgcctatatc

SEQ ID NO: 142820 - DNA, 35 bp, Artificial Sequence
  Synthetic oligonucleotide
atcaccgccgcgatttcgaataccgtccactagtc

SEQ ID NO: 142821 - DNA, 35 bp, Artificial Sequence
  Synthetic oligonucleotide
gtcccccccgttttccgtggtcctctcaagaggtc

SEQ ID NO: 142822 - DNA, 35 bp, Artificial Sequence
  Synthetic oligonucleotide
tccaccgcactggccttaagtttagatcttctgtc

SEQ ID NO: 142823 - DNA, 35 bp, Artificial Sequence
  Synthetic oligonucleotide
ctatccctgtagcatctcgtcgcctgttccgcttc

SEQ ID NO: 142824 - DNA, 35 bp, Artificial Sequence
  Synthetic oligonucleotide
gtggaggaggaatcggggggggtgggtcgacctag

SEQ ID NO: 142825 - DNA, 35 bp, Artificial Sequence
  Synthetic oligonucleotide
tgtcgggtgaggggggagaaaggagagctttggtg

SEQ ID NO: 142826 - DNA, 35 bp, Artificial Sequence
  Synthetic oligonucleotide
tgtccatccaaatgaccctactttgaccatccttg

SEQ ID NO: 142827 - DNA, 35 bp, Artificial Sequence
  Synthetic oligonucleotide
gcgcaacaacacttgatcttatgggcccgccttct

SEQ ID NO: 142828 - DNA, 35 bp, Artificial Sequence
  Synthetic oligonucleotide
gccctctccattatctgttttatcgccagagcttt

SEQ ID NO: 142829 - DNA, 35 bp, Artificial Sequence
  Synthetic oligonucleotide
gatgcagcccatgctccactaatgcggtttctttt

SEQ ID NO: 142830 - DNA, 36 bp, Artificial Sequence
  Synthetic oligonucleotide
gtgcccacccgtagcctctgacctcctcctgttcaa

SEQ ID NO: 142831 - DNA, 35 bp, Artificial Sequence
  Synthetic oligonucleotide
accccatccccaggctccaacatgttgtcttcgaa

SEQ ID NO: 142832 - DNA, 36 bp, Artificial Sequence
  Synthetic oligonucleotide
atcccgcgccggccacgtcgctgtcctcccaccaca

SEQ ID NO: 142833 - DNA, 36 bp, Artificial Sequence
  Synthetic oligonucleotide
gtccctgcaggttggtcatcgctcccctatacgcca

SEQ ID NO: 142834 - DNA, 35 bp, Artificial Sequence
  Synthetic oligonucleotide
agcacgcctcccgcagttcccccgccgacaccgca

SEQ ID NO: 142835 - DNA, 26 bp, Artificial Sequence
  Synthetic oligonucleotide
tcctgtagtgttggcccccccctgca

SEQ ID NO: 142836 - DNA, 35 bp, Artificial Sequence
  Synthetic oligonucleotide
gggtccagtccgcctctctattaccctgcccctca

SEQ ID NO: 142837 - DNA, 37 bp, Artificial Sequence
  Synthetic oligonucleotide
atcaccgtaaattcagctccccctcgcccgtggacga

SEQ ID NO: 142838 - DNA, 37 bp, Artificial Sequence
  Synthetic oligonucleotide
cacacatgccgccacactgagtccttccgcccaccga

SEQ ID NO: 142839 - DNA, 37 bp, Artificial Sequence
  Synthetic oligonucleotide
gattaacagggtggggggacacggagtaagagggcga

SEQ ID NO: 142840 - DNA, 37 bp, Artificial Sequence
  Synthetic oligonucleotide
agggacatgggaagggaaggaggtgaacggagctcga

SEQ ID NO: 142841 - DNA, 36 bp, Artificial Sequence
  Synthetic oligonucleotide
gacgcccacatctcgtacccgcctcaactgtttcga

SEQ ID NO: 142842 - DNA, 37 bp, Artificial Sequence
  Synthetic oligonucleotide
agaggagggacaagcagagtagggggtggtgcaggga

SEQ ID NO: 142843 - DNA, 36 bp, Artificial Sequence
  Synthetic oligonucleotide
aagggaagttgtgggagggccggagtgagggaggga

SEQ ID NO: 142844 - DNA, 37 bp, Artificial Sequence
  Synthetic oligonucleotide
gtcccacatctcgttcatttgcacctgcctttaggga

SEQ ID NO: 142845 - DNA, 36 bp, Artificial Sequence
  Synthetic oligonucleotide
gatgggacgaggtcgacaataggaggcgagggtgga

SEQ ID NO: 142846 - DNA, 36 bp, Artificial Sequence
  Synthetic oligonucleotide
agctccgacctccgcaccccatcgccctgcacatga

SEQ ID NO: 142847 - DNA, 38 bp, Artificial Sequence
  Synthetic oligonucleotide
atcaccaccgccgttcttcgcctttgctatcgccctga

SEQ ID NO: 142848 - DNA, 36 bp, Artificial Sequence
  Synthetic oligonucleotide
ttgaccccctgagccctttagacccgcattatctga

SEQ ID NO: 142849 - DNA, 35 bp, Artificial Sequence
  Synthetic oligonucleotide
aactcccgcacctgccctacttgtacagatcgcta

SEQ ID NO: 142850 - DNA, 36 bp, Artificial Sequence
  Synthetic oligonucleotide
accccaccgccacattgcccaaccgacgcgggtcta

SEQ ID NO: 142851 - DNA, 36 bp, Artificial Sequence
  Synthetic oligonucleotide
acacgccactccgatctacctaacgacgctccggta

SEQ ID NO: 142852 - DNA, 36 bp, Artificial Sequence
  Synthetic oligonucleotide
tcacacttacgagccgctgctcctctcgctccatta

SEQ ID NO: 142853 - DNA, 35 bp, Artificial Sequence
  Synthetic oligonucleotide
tcccgcacgtggacagcaccccatctgcctccaac

SEQ ID NO: 142854 - DNA, 35 bp, Artificial Sequence
  Synthetic oligonucleotide
gcccaccacttgctaccctgcctagtatacgctac

SEQ ID NO: 142855 - DNA, 35 bp, Artificial Sequence
  Synthetic oligonucleotide
gcccgtcgctcgcgttcactcccgcccgtttcacc

SEQ ID NO: 142856 - DNA, 35 bp, Artificial Sequence
  Synthetic oligonucleotide
gccccgccgctcgtagagaatacgccctggttacc

SEQ ID NO: 142857 - DNA, 35 bp, Artificial Sequence
  Synthetic oligonucleotide
gaccgaccctgaatagttgctctgtactcccgccc

SEQ ID NO: 142858 - DNA, 35 bp, Artificial Sequence
  Synthetic oligonucleotide
tcgcactcccagcccccgttttatttgcccctgcc

SEQ ID NO: 142859 - DNA, 35 bp, Artificial Sequence
  Synthetic oligonucleotide
gcttacatcatcacccagcgcgatacactccgtcc

SEQ ID NO: 142860 - DNA, 35 bp, Artificial Sequence
  Synthetic oligonucleotide
ttgccgggcttcctcttgtcggccgaacccattcc

SEQ ID NO: 142861 - DNA, 30 bp, Artificial Sequence
  Synthetic oligonucleotide
gcctcaccggctcatactgctccccctggc

SEQ ID NO: 142862 - DNA, 35 bp, Artificial Sequence
  Synthetic oligonucleotide
gatggaccgcactcagccctgccgctcttagaatc

SEQ ID NO: 142863 - DNA, 35 bp, Artificial Sequence
  Synthetic oligonucleotide
ttgggaccgacgtgcaccgtttcttgcttccgctc

SEQ ID NO: 142864 - DNA, 35 bp, Artificial Sequence
  Synthetic oligonucleotide
gcccgcatcgtgcgcacccgttatttctccggctc

SEQ ID NO: 142865 - DNA, 35 bp, Artificial Sequence
  Synthetic oligonucleotide
acgacgagtgtccgctagctcctttcgtccccgtc

SEQ ID NO: 142866 - DNA, 35 bp, Artificial Sequence
  Synthetic oligonucleotide
accgctcagcacctctctacccgcactatcaagcg

SEQ ID NO: 142867 - DNA, 35 bp, Artificial Sequence
  Synthetic oligonucleotide
ttcccgggagggggtcgaaaggggatagtcggggg

SEQ ID NO: 142868 - DNA, 35 bp, Artificial Sequence
  Synthetic oligonucleotide
agcgagctctcacctgtctacgccttcctggaact

SEQ ID NO: 142869 - DNA, 35 bp, Artificial Sequence
  Synthetic oligonucleotide
gtaccggcgatgtacgtacttctctctcttccgct

SEQ ID NO: 142870 - DNA, 35 bp, Artificial Sequence
  Synthetic oligonucleotide
acccgccacccactgtatttgtcctaccacctgct

SEQ ID NO: 142871 - DNA, 35 bp, Artificial Sequence
  Synthetic oligonucleotide
tagcacatccggatctatcgaaccccttcccatgt

SEQ ID NO: 142872 - DNA, 35 bp, Artificial Sequence
  Synthetic oligonucleotide
gattgccaccgttattcggttaccgggcccacctt

SEQ ID NO: 142873 - DNA, 35 bp, Artificial Sequence
  Synthetic oligonucleotide
tgatcacctcacgccctgtgctacagtaccatctt

SEQ ID NO: 142874 - DNA, 36 bp, Artificial Sequence
  Synthetic oligonucleotide
gaatggaggatggggagtgggaaaggatgccgtaca

SEQ ID NO: 142875 - DNA, 35 bp, Artificial Sequence
  Synthetic oligonucleotide
caccaactgcccgccgtgtcggtccgacctcccca

SEQ ID NO: 142876 - DNA, 35 bp, Artificial Sequence
  Synthetic oligonucleotide
taagtacgccagcccaccgatctgtacctcctcca

SEQ ID NO: 142877 - DNA, 36 bp, Artificial Sequence
  Synthetic oligonucleotide
gtaccgcaccgcccctccttgcatatgcccgctcca

SEQ ID NO: 142878 - DNA, 36 bp, Artificial Sequence
  Synthetic oligonucleotide
tgctacctcacccccagtttaacgcccttgcaagca

SEQ ID NO: 142879 - DNA, 36 bp, Artificial Sequence
  Synthetic oligonucleotide
gggacgtgcgaaggggtagtaggggttcgcggggca

SEQ ID NO: 142880 - DNA, 36 bp, Artificial Sequence
  Synthetic oligonucleotide
actcaccgtgccagcctcgcggtccctcctcactca

SEQ ID NO: 142881 - DNA, 36 bp, Artificial Sequence
  Synthetic oligonucleotide
gactatccatctgtgaactactgttcgtgcccttca

SEQ ID NO: 142882 - DNA, 35 bp, Artificial Sequence
  Synthetic oligonucleotide
tcactttccgcttgccctcccctggtaatgtttca

SEQ ID NO: 142883 - DNA, 36 bp, Artificial Sequence
  Synthetic oligonucleotide
ttcaccctgccttagaacgctactaggccgttttca

SEQ ID NO: 142884 - DNA, 37 bp, Artificial Sequence
  Synthetic oligonucleotide
gatcacgcgatctcacgtcctaaatgctgccttccga

SEQ ID NO: 142885 - DNA, 36 bp, Artificial Sequence
  Synthetic oligonucleotide
tgcacggacccatggctttattcaacctctgctcga

SEQ ID NO: 142886 - DNA, 37 bp, Artificial Sequence
  Synthetic oligonucleotide
tagtatcaaagggaggggagggaaccagctcagggga

SEQ ID NO: 142887 - DNA, 37 bp, Artificial Sequence
  Synthetic oligonucleotide
tggggagtggaggtttccatcctagggcggtggggga

SEQ ID NO: 142888 - DNA, 38 bp, Artificial Sequence
  Synthetic oligonucleotide
tctcccgcgctgcccctgacttagacctccccccctga

SEQ ID NO: 142889 - DNA, 38 bp, Artificial Sequence
  Synthetic oligonucleotide
gggtaaacctgcccgtgatacgcctgctcgccccctga

SEQ ID NO: 142890 - DNA, 37 bp, Artificial Sequence
  Synthetic oligonucleotide
gattcgctccactgtcgccccgccgctacctgcctga

SEQ ID NO: 142891 - DNA, 38 bp, Artificial Sequence
  Synthetic oligonucleotide
gtggcaaaaggaccgagggcaaggggaagagggggtga

SEQ ID NO: 142892 - DNA, 38 bp, Artificial Sequence
  Synthetic oligonucleotide
atcagcaccgtgcgatccttcctgttcaccagccttga

SEQ ID NO: 142893 - DNA, 38 bp, Artificial Sequence
  Synthetic oligonucleotide
tcaccactcctggccgatattatacaccgttctcttga

SEQ ID NO: 142894 - DNA, 36 bp, Artificial Sequence
  Synthetic oligonucleotide
tatcgaaccgcatcctgtcctcactgcctgcttcta

SEQ ID NO: 142895 - DNA, 34 bp, Artificial Sequence
  Synthetic oligonucleotide
gccatcacccccgggactctgatctcaattttac

SEQ ID NO: 142896 - DNA, 35 bp, Artificial Sequence
  Synthetic oligonucleotide
aacgccactgtcctcgcctttggcacacggtaccc

SEQ ID NO: 142897 - DNA, 35 bp, Artificial Sequence
  Synthetic oligonucleotide
gtcctacactcccgcgtgttctcgtactagccccc

SEQ ID NO: 142898 - DNA, 35 bp, Artificial Sequence
  Synthetic oligonucleotide
tgtccacgcctctttcgaccttattgccaacctcc

SEQ ID NO: 142899 - DNA, 35 bp, Artificial Sequence
  Synthetic oligonucleotide
tcccgctcactggctcgttatggtaaccccctcgc

SEQ ID NO: 142900 - DNA, 35 bp, Artificial Sequence
  Synthetic oligonucleotide
acctcctccatgaaggcttcttacgcgcccccggc

SEQ ID NO: 142901 - DNA, 35 bp, Artificial Sequence
  Synthetic oligonucleotide
ggttgccgtccttaagtcactccatgtcctcgctc

SEQ ID NO: 142902 - DNA, 35 bp, Artificial Sequence
  Synthetic oligonucleotide
gagaaccgccaatcacatgaccctgaatcctgctc

SEQ ID NO: 142903 - DNA, 35 bp, Artificial Sequence
  Synthetic oligonucleotide
gtgcgccgccccccactgactatcaagtgtgcacg

SEQ ID NO: 142904 - DNA, 35 bp, Artificial Sequence
  Synthetic oligonucleotide
acggaaagtggagcagggggggtgaatgaatacgg

SEQ ID NO: 142905 - DNA, 35 bp, Artificial Sequence
  Synthetic oligonucleotide
gacaccatcgttcctgtcttctagtccctatatat

SEQ ID NO: 142906 - DNA, 35 bp, Artificial Sequence
  Synthetic oligonucleotide
tcccgctttcactgccatacgaaaaccaccctgct

SEQ ID NO: 142907 - DNA, 34 bp, Artificial Sequence
  Synthetic oligonucleotide
atcctccccgtcagtgctttttcttgcctcgagt

SEQ ID NO: 142908 - DNA, 35 bp, Artificial Sequence
  Synthetic oligonucleotide
gttacaccacgcaccctcccgtttaggacttaggt

SEQ ID NO: 142909 - DNA, 35 bp, Artificial Sequence
  Synthetic oligonucleotide
accctgcaccctgcccctccttgattcccgggatt

SEQ ID NO: 142910 - DNA, 35 bp, Artificial Sequence
  Synthetic oligonucleotide
ttccccactgtcaaacgtactgcctaactccactt

SEQ ID NO: 142911 - DNA, 35 bp, Artificial Sequence
  Synthetic oligonucleotide
acgtaacagtcgttgaccgccccccatccaatctt

SEQ ID NO: 142912 - DNA, 35 bp, Artificial Sequence
  Synthetic oligonucleotide
atgccattcgccttgcggtttgtaatctccttctt

SEQ ID NO: 142913 - DNA, 36 bp, Artificial Sequence
  Synthetic oligonucleotide
atcatcgccccgtattctgtccttccctgttttaaa

SEQ ID NO: 142914 - DNA, 36 bp, Artificial Sequence
  Synthetic oligonucleotide
tgctccgcccccgacttgtagatccgctactcataa

SEQ ID NO: 142915 - DNA, 35 bp, Artificial Sequence
  Synthetic oligonucleotide
gccgcaccgactaccctctggctccctggtgaaca

SEQ ID NO: 142916 - DNA, 36 bp, Artificial Sequence
  Synthetic oligonucleotide
gacgcgaccaaggcgcttatccaccgctccccgaca

SEQ ID NO: 142917 - DNA, 36 bp, Artificial Sequence
  Synthetic oligonucleotide
ttgcacccgtcctctgcaggatccgacgcgccccca

SEQ ID NO: 142918 - DNA, 36 bp, Artificial Sequence
  Synthetic oligonucleotide
tcctacacctcgccgaatcaccacaggtcatgccca

SEQ ID NO: 142919 - DNA, 30 bp, Artificial Sequence
  Synthetic oligonucleotide
actcccgacccctccacgtatccactgcca

SEQ ID NO: 142920 - DNA, 34 bp, Artificial Sequence
  Synthetic oligonucleotide
gcgcccggccatctccaccgtgtcctactgtcca

SEQ ID NO: 142921 - DNA, 35 bp, Artificial Sequence
  Synthetic oligonucleotide
tacctctccgcctgtgttgttccctcccgcgtgca

SEQ ID NO: 142922 - DNA, 35 bp, Artificial Sequence
  Synthetic oligonucleotide
gtgacttgccccttccgtgcgtttgatagcactca

SEQ ID NO: 142923 - DNA, 36 bp, Artificial Sequence
  Synthetic oligonucleotide
gtcccgccctcgccgccgtatcctgatccggactca

SEQ ID NO: 142924 - DNA, 37 bp, Artificial Sequence
  Synthetic oligonucleotide
tcgataccagaggagaaacgaggaggggaggagacga

SEQ ID NO: 142925 - DNA, 35 bp, Artificial Sequence
  Synthetic oligonucleotide
gggaacgggggtggcaagggaggtcataagacgga

SEQ ID NO: 142926 - DNA, 38 bp, Artificial Sequence
  Synthetic oligonucleotide
gttagtgggcgatgaggcaagggggcggggcggaatga

SEQ ID NO: 142927 - DNA, 36 bp, Artificial Sequence
  Synthetic oligonucleotide
gagggacatagaagcaggtggttaaaggggggctga

SEQ ID NO: 142928 - DNA, 38 bp, Artificial Sequence
  Synthetic oligonucleotide
atccgctggcgacgggcgggaaagggttgggtggctga

SEQ ID NO: 142929 - DNA, 37 bp, Artificial Sequence
  Synthetic oligonucleotide
tgccaccctcggctatcccttccacttgagacattga

SEQ ID NO: 142930 - DNA, 37 bp, Artificial Sequence
  Synthetic oligonucleotide
gaggagggaccgggggggactacgaaaagccgtttga

SEQ ID NO: 142931 - DNA, 36 bp, Artificial Sequence
  Synthetic oligonucleotide
tgtacgtaccagataacccgccgctccatgccccta

SEQ ID NO: 142932 - DNA, 35 bp, Artificial Sequence
  Synthetic oligonucleotide
gtattgccaccctgtcattgcccgccactttcgta

SEQ ID NO: 142933 - DNA, 36 bp, Artificial Sequence
  Synthetic oligonucleotide
acttccgcaccggagcgccttttgcaccagccctta

SEQ ID NO: 142934 - DNA, 35 bp, Artificial Sequence
  Synthetic oligonucleotide
gcccatctgtattgcgtcccccttcgtcgattcac

SEQ ID NO: 142935 - DNA, 35 bp, Artificial Sequence
  Synthetic oligonucleotide
tcgcgcgctcgatcattccgccttggttccttcac

SEQ ID NO: 142936 - DNA, 35 bp, Artificial Sequence
  Synthetic oligonucleotide
gtaccacaccgccccaacacacgttcgtatcatac

SEQ ID NO: 142937 - DNA, 35 bp, Artificial Sequence
  Synthetic oligonucleotide
gtcgaactcgtctccccctcccctcccgctcgccc

SEQ ID NO: 142938 - DNA, 35 bp, Artificial Sequence
  Synthetic oligonucleotide
gttcgcaccctccccatggtccattgccccgtccc

SEQ ID NO: 142939 - DNA, 35 bp, Artificial Sequence
  Synthetic oligonucleotide
gagggaggggagggagtagtgttgtgccgggggcc

SEQ ID NO: 142940 - DNA, 35 bp, Artificial Sequence
  Synthetic oligonucleotide
gtttcctgctctcatgtctcgcacggttccgctcc

SEQ ID NO: 142941 - DNA, 35 bp, Artificial Sequence
  Synthetic oligonucleotide
gctcgacgttgcacgcgctccctgaactcccctgc

SEQ ID NO: 142942 - DNA, 35 bp, Artificial Sequence
  Synthetic oligonucleotide
tgcctacgccccacctattatgggcaagactcctc

SEQ ID NO: 142943 - DNA, 35 bp, Artificial Sequence
  Synthetic oligonucleotide
atgcccttcctatccgcggttatgcgatacctctc

SEQ ID NO: 142944 - DNA, 35 bp, Artificial Sequence
  Synthetic oligonucleotide
gcaaccatatcgttcatctatcactgcctccgacg

SEQ ID NO: 142945 - DNA, 35 bp, Artificial Sequence
  Synthetic oligonucleotide
tacctgccaagttgtcctgtctcctcacttcccgg

SEQ ID NO: 142946 - DNA, 35 bp, Artificial Sequence
  Synthetic oligonucleotide
cctcacctcgaccctgcacgttaagcttaccccct

SEQ ID NO: 142947 - DNA, 34 bp, Artificial Sequence
  Synthetic oligonucleotide
acacgaacacacttggattgatctttgctccctt

SEQ ID NO: 142948 - DNA, 35 bp, Artificial Sequence
  Synthetic oligonucleotide
tgacacccaggacatgggcgcccaactttcctctt

SEQ ID NO: 142949 - DNA, 35 bp, Artificial Sequence
  Synthetic oligonucleotide
tgcattccccgttctggcctttgatctactctctt

SEQ ID NO: 142950 - DNA, 35 bp, Artificial Sequence
  Synthetic oligonucleotide
gtacacgtcactggcccctgagctgtcctcgtctt

SEQ ID NO: 142951 - DNA, 35 bp, Artificial Sequence
  Synthetic oligonucleotide
gcagggagggaggcggacaataggagaaatgtcaa

SEQ ID NO: 142952 - DNA, 35 bp, Artificial Sequence
  Synthetic oligonucleotide
atccatcctctgacaggcgatcctccccagtacca

SEQ ID NO: 142953 - DNA, 35 bp, Artificial Sequence
  Synthetic oligonucleotide
tgtcgtccgtcgagccacctacgcctccgccatca

SEQ ID NO: 142954 - DNA, 37 bp, Artificial Sequence
  Synthetic oligonucleotide
tcccatacctcaattgataaccacccccttctcgaga

SEQ ID NO: 142955 - DNA, 35 bp, Artificial Sequence
  Synthetic oligonucleotide
gcccgcctccctttgtaccccagcctacctctcga

SEQ ID NO: 142956 - DNA, 37 bp, Artificial Sequence
  Synthetic oligonucleotide
tgatccccctcttgatatgccaccacccgtaggcgga

SEQ ID NO: 142957 - DNA, 36 bp, Artificial Sequence
  Synthetic oligonucleotide
tctcagatgactaccgccccccccgcgtcctcggga

SEQ ID NO: 142958 - DNA, 37 bp, Artificial Sequence
  Synthetic oligonucleotide
ggagaaacgggggtggggaggccgtcggggaagtgga

SEQ ID NO: 142959 - DNA, 37 bp, Artificial Sequence
  Synthetic oligonucleotide
gatgagggagaaacgcgcgaaacagggggagggtgga

SEQ ID NO: 142960 - DNA, 38 bp, Artificial Sequence
  Synthetic oligonucleotide
gcacagggcgggggggagatcgcgtaccagggcgatga

SEQ ID NO: 142961 - DNA, 38 bp, Artificial Sequence
  Synthetic oligonucleotide
tgagggcggagggagggggttggatttggacggtatga

SEQ ID NO: 142962 - DNA, 38 bp, Artificial Sequence
  Synthetic oligonucleotide
acctcccacacgagtattttgtcgccctgcctacctga

SEQ ID NO: 142963 - DNA, 37 bp, Artificial Sequence
  Synthetic oligonucleotide
gatcgcggtaagactgggaagggcacgggtggggtga

SEQ ID NO: 142964 - DNA, 37 bp, Artificial Sequence
  Synthetic oligonucleotide
gtcccatgccttcacccctggtccagttcactattga

SEQ ID NO: 142965 - DNA, 36 bp, Artificial Sequence
  Synthetic oligonucleotide
tgaacgggtgggtgtggtactagggtgggaagttta

SEQ ID NO: 142966 - DNA, 35 bp, Artificial Sequence
  Synthetic oligonucleotide
tcccgccccttacgtagtttttgcacagtactaac

SEQ ID NO: 142967 - DNA, 35 bp, Artificial Sequence
  Synthetic oligonucleotide
accggggtcattccgcctacacgaccgctgcccac

SEQ ID NO: 142968 - DNA, 35 bp, Artificial Sequence
  Synthetic oligonucleotide
tgagcgcggctatatctgtttggccctccttccac

SEQ ID NO: 142969 - DNA, 35 bp, Artificial Sequence
  Synthetic oligonucleotide
gcacaccgtgcttgaccccgcaccatttttagcac

SEQ ID NO: 142970 - DNA, 35 bp, Artificial Sequence
  Synthetic oligonucleotide
gacaccactgtattaattgcccagcatgccacacc

SEQ ID NO: 142971 - DNA, 35 bp, Artificial Sequence
  Synthetic oligonucleotide
gtgcatatcaaccttccgcgctcatggtccccccc

SEQ ID NO: 142972 - DNA, 35 bp, Artificial Sequence
  Synthetic oligonucleotide
gatgtcctcatttcgtaaacgcgccgcctatcgcc

SEQ ID NO: 142973 - DNA, 35 bp, Artificial Sequence
  Synthetic oligonucleotide
tgatcctctcttgcgtgctctccaccctatactgc

SEQ ID NO: 142974 - DNA, 35 bp, Artificial Sequence
  Synthetic oligonucleotide
atctatcctgcccgttgtgcctgcaccttttgatc

SEQ ID NO: 142975 - DNA, 35 bp, Artificial Sequence
  Synthetic oligonucleotide
ataccaccgccgagcagttttaattcgccattctc

SEQ ID NO: 142976 - DNA, 35 bp, Artificial Sequence
  Synthetic oligonucleotide
gtgtgtgcatcacctgggtgccgtaccctttcttc

SEQ ID NO: 142977 - DNA, 35 bp, Artificial Sequence
  Synthetic oligonucleotide
gaccgaccgccccactttgtttgctcctcttttag

SEQ ID NO: 142978 - DNA, 35 bp, Artificial Sequence
  Synthetic oligonucleotide
gtgccgcagcaatccactcgttcctgtcttgcccg

SEQ ID NO: 142979 - DNA, 35 bp, Artificial Sequence
  Synthetic oligonucleotide
ttccgtcccggatcgacattccgcctcccacctcg

SEQ ID NO: 142980 - DNA, 35 bp, Artificial Sequence
  Synthetic oligonucleotide
aggggcggggggggttcttgtgggcatgctacgct

SEQ ID NO: 142981 - DNA, 35 bp, Artificial Sequence
  Synthetic oligonucleotide
gtgacagtccaactccgtgaaccaacttgccctct

SEQ ID NO: 142982 - DNA, 35 bp, Artificial Sequence
  Synthetic oligonucleotide
tcaccaagccaaggtgcacccacacgacctcctct

SEQ ID NO: 142983 - DNA, 35 bp, Artificial Sequence
  Synthetic oligonucleotide
tgatggaggtgaaaggggctgggggaatagcgagt

SEQ ID NO: 142984 - DNA, 35 bp, Artificial Sequence
  Synthetic oligonucleotide
ccagccccaccacgttaccgccgcgaccacctagt

SEQ ID NO: 142985 - DNA, 35 bp, Artificial Sequence
  Synthetic oligonucleotide
tctgccccctcccgcccgtatcttgctctttcggt

SEQ ID NO: 142986 - DNA, 35 bp, Artificial Sequence
  Synthetic oligonucleotide
gtcacccatcactgacggtccctatagccatcttt

SEQ ID NO: 142987 - DNA, 36 bp, Artificial Sequence
  Synthetic oligonucleotide
acactagcgcaatttgcaccctcccccccgtagcaa

SEQ ID NO: 142988 - DNA, 35 bp, Artificial Sequence
  Synthetic oligonucleotide
taggaggagaagggtgagggtaaagtataaagtaa

SEQ ID NO: 142989 - DNA, 36 bp, Artificial Sequence
  Synthetic oligonucleotide
gatagggggttggttggaggggacggggaagttaga

SEQ ID NO: 142990 - DNA, 37 bp, Artificial Sequence
  Synthetic oligonucleotide
tccgaccccttcgacgcgacccacatccacctgacga

SEQ ID NO: 142991 - DNA, 37 bp, Artificial Sequence
  Synthetic oligonucleotide
tgaccggtcgcctattcatccctcacgccattgccga

SEQ ID NO: 142992 - DNA, 37 bp, Artificial Sequence
  Synthetic oligonucleotide
acaggaacgcgggggggcggggaagcaatacctagga

SEQ ID NO: 142993 - DNA, 36 bp, Artificial Sequence
  Synthetic oligonucleotide
gcgaggtgaaggggggccgcagattgggggcgggga

SEQ ID NO: 142994 - DNA, 37 bp, Artificial Sequence
  Synthetic oligonucleotide
gacgatggcgggttcttgggtgggatggagcggggga

SEQ ID NO: 142995 - DNA, 37 bp, Artificial Sequence
  Synthetic oligonucleotide
tctggtgggggtcggtgggcgggaggaaattatggga

SEQ ID NO: 142996 - DNA, 33 bp, Artificial Sequence
  Synthetic oligonucleotide
cccaccgccgtggcccatacacgcaccccctga

SEQ ID NO: 142997 - DNA, 38 bp, Artificial Sequence
  Synthetic oligonucleotide
gcagggaggaggtgcgagggacgggataattaggctga

SEQ ID NO: 142998 - DNA, 38 bp, Artificial Sequence
  Synthetic oligonucleotide
tcatccgtcccttccctattctacgctcgccctgctga

SEQ ID NO: 142999 - DNA, 37 bp, Artificial Sequence
  Synthetic oligonucleotide
ggaacgaacatgatcgcgggcgggcaagggggggtga

SEQ ID NO: 143000 - DNA, 38 bp, Artificial Sequence
  Synthetic oligonucleotide
tatgcgcacgcacattccgccctgttactgtccattga

SEQ ID NO: 143001 - DNA, 36 bp, Artificial Sequence
  Synthetic oligonucleotide
acccgacgttcagtctgcctgccttttatcgccata

SEQ ID NO: 143002 - DNA, 35 bp, Artificial Sequence
  Synthetic oligonucleotide
acgcgccaggcctaacgttttgcgcccttccccta

SEQ ID NO: 143003 - DNA, 35 bp, Artificial Sequence
  Synthetic oligonucleotide
agtcgccccgccacaagctcgcctccgttcgctta

SEQ ID NO: 143004 - DNA, 35 bp, Artificial Sequence
  Synthetic oligonucleotide
taggtacccccgcctgtacctcgtgattctttaac

SEQ ID NO: 143005 - DNA, 35 bp, Artificial Sequence
  Synthetic oligonucleotide
tccacctgcctcgtttagctttcatctgcctccac

SEQ ID NO: 143006 - DNA, 35 bp, Artificial Sequence
  Synthetic oligonucleotide
acacccataccgatcaattgcgattactgattcac

SEQ ID NO: 143007 - DNA, 35 bp, Artificial Sequence
  Synthetic oligonucleotide
ttcgacgtccttcctgtccgtccccagccgccgac

SEQ ID NO: 143008 - DNA, 35 bp, Artificial Sequence
  Synthetic oligonucleotide
tcagccagccattaccgtatcgaatcgctgccccc

SEQ ID NO: 143009 - DNA, 35 bp, Artificial Sequence
  Synthetic oligonucleotide
ttcaatcagccagcgtgacctcgcctcgtactccc

SEQ ID NO: 143010 - DNA, 35 bp, Artificial Sequence
  Synthetic oligonucleotide
attctgtgcacgcccgccatctcactttgctcgcc

SEQ ID NO: 143011 - DNA, 35 bp, Artificial Sequence
  Synthetic oligonucleotide
acactgctcgcgtgtgctgcgatacatccctctcc

SEQ ID NO: 143012 - DNA, 35 bp, Artificial Sequence
  Synthetic oligonucleotide
tgtttccaccgactttaaagcccgccggcctcctc

SEQ ID NO: 143013 - DNA, 35 bp, Artificial Sequence
  Synthetic oligonucleotide
tacgacgtcgctaattgtcttcacacgcactgctc

SEQ ID NO: 143014 - DNA, 35 bp, Artificial Sequence
  Synthetic oligonucleotide
gcatgccgccccccctccgtataccgcctcgctcg

SEQ ID NO: 143015 - DNA, 35 bp, Artificial Sequence
  Synthetic oligonucleotide
tcacacgccctgcttctaactgtactcgcctttcg

SEQ ID NO: 143016 - DNA, 35 bp, Artificial Sequence
  Synthetic oligonucleotide
atagcaaagtgcaggggatgatggaacttgaaatg

SEQ ID NO: 143017 - DNA, 35 bp, Artificial Sequence
  Synthetic oligonucleotide
aacccccgcctccatacattcattacaggtattat

SEQ ID NO: 143018 - DNA, 35 bp, Artificial Sequence
  Synthetic oligonucleotide
gctgataccgacctattagtagcctccccgccact

SEQ ID NO: 143019 - DNA, 34 bp, Artificial Sequence
  Synthetic oligonucleotide
atctaccctgccgcctcccgttcgtatccgatct

SEQ ID NO: 143020 - DNA, 35 bp, Artificial Sequence
  Synthetic oligonucleotide
acagtcccgcgcgtgatgccaggccgccttactct

SEQ ID NO: 143021 - DNA, 35 bp, Artificial Sequence
  Synthetic oligonucleotide
tcttgtcagaaccctgtagcgcccttgtcacctct

SEQ ID NO: 143022 - DNA, 35 bp, Artificial Sequence
  Synthetic oligonucleotide
gacgcacccctcgcccgctaccgtaactccgttct

SEQ ID NO: 143023 - DNA, 35 bp, Artificial Sequence
  Synthetic oligonucleotide
gaagccccagcccacactgccatttacgcctatgt

SEQ ID NO: 143024 - DNA, 35 bp, Artificial Sequence
  Synthetic oligonucleotide
tccccccgccctgttctaggtagttcgccccccaa

SEQ ID NO: 143025 - DNA, 36 bp, Artificial Sequence
  Synthetic oligonucleotide
gtacagggacgggaggggacgagggtcggtaaataa

SEQ ID NO: 143026 - DNA, 35 bp, Artificial Sequence
  Synthetic oligonucleotide
agcgcaccacccgcagagcccgtacgtccttacca

SEQ ID NO: 143027 - DNA, 35 bp, Artificial Sequence
  Synthetic oligonucleotide
tgccccccccatcggctaacacatccaggacccca

SEQ ID NO: 143028 - DNA, 36 bp, Artificial Sequence
  Synthetic oligonucleotide
tgcgccccctcgccttacgctctgtctcccaggtca

SEQ ID NO: 143029 - DNA, 36 bp, Artificial Sequence
  Synthetic oligonucleotide
taactcgtactgaactgcccctcgaccccagtttca

SEQ ID NO: 143030 - DNA, 35 bp, Artificial Sequence
  Synthetic oligonucleotide
tgccactcacgccgcctacacatccggttcgccga

SEQ ID NO: 143031 - DNA, 33 bp, Artificial Sequence
  Synthetic oligonucleotide
tccgcttctgcctccgcccagtttccgtatcga

SEQ ID NO: 143032 - DNA, 37 bp, Artificial Sequence
  Synthetic oligonucleotide
accacggtcggggttgtgttttgttggggagagggga

SEQ ID NO: 143033 - DNA, 37 bp, Artificial Sequence
  Synthetic oligonucleotide
ggtacagggacggtggagcgctgggaaggaggatgga

SEQ ID NO: 143034 - DNA, 38 bp, Artificial Sequence
  Synthetic oligonucleotide
tgaacgcaccgccgcgcccgcccttaactttgccatga

SEQ ID NO: 143035 - DNA, 37 bp, Artificial Sequence
  Synthetic oligonucleotide
aatcaggggaaggggagaagggagacggaataagtga

SEQ ID NO: 143036 - DNA, 37 bp, Artificial Sequence
  Synthetic oligonucleotide
agacagtcgcaaagagccccccccctgccctcggtga

SEQ ID NO: 143037 - DNA, 35 bp, Artificial Sequence
  Synthetic oligonucleotide
gacgagttccgaagtagggtggggggagtgggata

SEQ ID NO: 143038 - DNA, 36 bp, Artificial Sequence
  Synthetic oligonucleotide
gcatgccgcccgacgttagtccgatatccacgccta

SEQ ID NO: 143039 - DNA, 35 bp, Artificial Sequence
  Synthetic oligonucleotide
tgacacttcctcggccaccttcaccgttttgggta

SEQ ID NO: 143040 - DNA, 36 bp, Artificial Sequence
  Synthetic oligonucleotide
gacccgccgccccttcgtgcaaatcccaacattgta

SEQ ID NO: 143041 - DNA, 36 bp, Artificial Sequence
  Synthetic oligonucleotide
tgaagacgccgttccgttatcctctgctattttgta

SEQ ID NO: 143042 - DNA, 35 bp, Artificial Sequence
  Synthetic oligonucleotide
gttcacccgcaataccctgggttcgactactccac

SEQ ID NO: 143043 - DNA, 35 bp, Artificial Sequence
  Synthetic oligonucleotide
gtaacccgccagacctggctcatgctatatccacc

SEQ ID NO: 143044 - DNA, 35 bp, Artificial Sequence
  Synthetic oligonucleotide
acagacgcactgcttttattcggcgttcttcaccc

SEQ ID NO: 143045 - DNA, 35 bp, Artificial Sequence
  Synthetic oligonucleotide
ttgtccccgccgtacgcacttttttatctgatccc

SEQ ID NO: 143046 - DNA, 35 bp, Artificial Sequence
  Synthetic oligonucleotide
atccgtcctactccgctgtccagtcatacagtccc

SEQ ID NO: 143047 - DNA, 35 bp, Artificial Sequence
  Synthetic oligonucleotide
ggggccccctctactggaattatcgcaacttgtcc

SEQ ID NO: 143048 - DNA, 35 bp, Artificial Sequence
  Synthetic oligonucleotide
agtccacctttccccgtattttgtcggtctctatc

SEQ ID NO: 143049 - DNA, 35 bp, Artificial Sequence
  Synthetic oligonucleotide
tccaccccacactgacttatatccggtccggactc

SEQ ID NO: 143050 - DNA, 35 bp, Artificial Sequence
  Synthetic oligonucleotide
tcatacccctattcgcctgcccacctgaggtgctc

SEQ ID NO: 143051 - DNA, 35 bp, Artificial Sequence
  Synthetic oligonucleotide
gtgttggtcggtcgcggttaattccatctcgtctc

SEQ ID NO: 143052 - DNA, 35 bp, Artificial Sequence
  Synthetic oligonucleotide
tacacgcataaccccccgttccctcctgaagggtc

SEQ ID NO: 143053 - DNA, 35 bp, Artificial Sequence
  Synthetic oligonucleotide
atctccccagcattcgcgcgctcgactcgttcttc

SEQ ID NO: 143054 - DNA, 35 bp, Artificial Sequence
  Synthetic oligonucleotide
gatctgagtacgctcgcctgtaatagcctcctccg

SEQ ID NO: 143055 - DNA, 35 bp, Artificial Sequence
  Synthetic oligonucleotide
gactcacgccctcttccattcctgtgctatttccg

SEQ ID NO: 143056 - DNA, 35 bp, Artificial Sequence
  Synthetic oligonucleotide
cacaacctccctgcgtgcaaatactcccttcccgg

SEQ ID NO: 143057 - DNA, 35 bp, Artificial Sequence
  Synthetic oligonucleotide
gcaactcggctcacactcccccacctgtttcctgg

SEQ ID NO: 143058 - DNA, 35 bp, Artificial Sequence
  Synthetic oligonucleotide
acgaggtgggtcgtacggggggagggtctgcgtgg

SEQ ID NO: 143059 - DNA, 35 bp, Artificial Sequence
  Synthetic oligonucleotide
tgatcccccaccctgagcatctctatccacacatg

SEQ ID NO: 143060 - DNA, 35 bp, Artificial Sequence
  Synthetic oligonucleotide
gaaccgccaagcatacgcctcgacccttcttcctg

SEQ ID NO: 143061 - DNA, 35 bp, Artificial Sequence
  Synthetic oligonucleotide
tgacatgggaggtaaggcaatgtgggggggggaat

SEQ ID NO: 143062 - DNA, 35 bp, Artificial Sequence
  Synthetic oligonucleotide
gcatccctttacccgccgtgctgtcttaacccgct

SEQ ID NO: 143063 - DNA, 35 bp, Artificial Sequence
  Synthetic oligonucleotide
gccccgcctatcctgtccgaagcaggcattcatct

SEQ ID NO: 143064 - DNA, 35 bp, Artificial Sequence
  Synthetic oligonucleotide
ttagccccccctctgttgatgtattacccggttct

SEQ ID NO: 143065 - DNA, 35 bp, Artificial Sequence
  Synthetic oligonucleotide
acttgcctccccatgttatcttccctttgtgtggt

SEQ ID NO: 143066 - DNA, 35 bp, Artificial Sequence
  Synthetic oligonucleotide
acgtgtgccgggatgcatagggatagggagggtgt

SEQ ID NO: 143067 - DNA, 35 bp, Artificial Sequence
  Synthetic oligonucleotide
tcttgactccgccctgtacctacactattaccgtt

SEQ ID NO: 143068 - DNA, 36 bp, Artificial Sequence
  Synthetic oligonucleotide
gtaggggtggggggcggtgacggggaattatcaaaa

SEQ ID NO: 143069 - DNA, 36 bp, Artificial Sequence
  Synthetic oligonucleotide
ttgtgatggtcgccgcctgttcttgtttctttccaa

SEQ ID NO: 143070 - DNA, 35 bp, Artificial Sequence
  Synthetic oligonucleotide
acacctccaacgctcccttctccgaccacggggaa

SEQ ID NO: 143071 - DNA, 36 bp, Artificial Sequence
  Synthetic oligonucleotide
gtcccgccccccgctggatagttattgccacgttaa

SEQ ID NO: 143072 - DNA, 36 bp, Artificial Sequence
  Synthetic oligonucleotide
atgaaccgccagagcctccgcaaccgccctccgaca

SEQ ID NO: 143073 - DNA, 36 bp, Artificial Sequence
  Synthetic oligonucleotide
tggaaggcacatgttacaagccctctcctcctctca

SEQ ID NO: 143074 - DNA, 37 bp, Artificial Sequence
  Synthetic oligonucleotide
acgtccacctcgaccgctgcattgatcactcccgcga

SEQ ID NO: 143075 - DNA, 37 bp, Artificial Sequence
  Synthetic oligonucleotide
accgcacctctccctatgttatgctcgtttctccgga

SEQ ID NO: 143076 - DNA, 36 bp, Artificial Sequence
  Synthetic oligonucleotide
atgtggggggcggggatatggcgataatggggcgga

SEQ ID NO: 143077 - DNA, 36 bp, Artificial Sequence
  Synthetic oligonucleotide
tagaggagggcggtgggggtctcaggtgacgtggga

SEQ ID NO: 143078 - DNA, 36 bp, Artificial Sequence
  Synthetic oligonucleotide
accacccggtctctcttattttgctcactgcctgga

SEQ ID NO: 143079 - DNA, 36 bp, Artificial Sequence
  Synthetic oligonucleotide
gtgccaggtcccattgcgtacccccccgtgcctgga

SEQ ID NO: 143080 - DNA, 37 bp, Artificial Sequence
  Synthetic oligonucleotide
tgtgcggcccagccctctgttgttccttcctcttgga

SEQ ID NO: 143081 - DNA, 37 bp, Artificial Sequence
  Synthetic oligonucleotide
ttgctgcccctgtaccgcataccccccctgccactga

SEQ ID NO: 143082 - DNA, 35 bp, Artificial Sequence
  Synthetic oligonucleotide
tccccacgtacctatgcgctgccctgtccgcctga

SEQ ID NO: 143083 - DNA, 38 bp, Artificial Sequence
  Synthetic oligonucleotide
atccaggccagacgggtgtctgttcttctcctccgtga

SEQ ID NO: 143084 - DNA, 38 bp, Artificial Sequence
  Synthetic oligonucleotide
gacgcaagtgatgtgtggggtgtaaggtggaggggtga

SEQ ID NO: 143085 - DNA, 38 bp, Artificial Sequence
  Synthetic oligonucleotide
gcctcgggagggcaggggagggactcactacaatgtga

SEQ ID NO: 143086 - DNA, 37 bp, Artificial Sequence
  Synthetic oligonucleotide
atcatccacacatgtgcgtcttcacacccattcttga

SEQ ID NO: 143087 - DNA, 36 bp, Artificial Sequence
  Synthetic oligonucleotide
gtgttcgcgcacgagcgacacttcaccctctccgta

SEQ ID NO: 143088 - DNA, 36 bp, Artificial Sequence
  Synthetic oligonucleotide
tgtccctgggggctccattcgacactgtctccctta

SEQ ID NO: 143089 - DNA, 36 bp, Artificial Sequence
  Synthetic oligonucleotide
acgtcgaaggtagggtgggaagctggtggcgggtta

SEQ ID NO: 143090 - DNA, 35 bp, Artificial Sequence
  Synthetic oligonucleotide
gcacccatgacgatctgcccacccaggtgcccgac

SEQ ID NO: 143091 - DNA, 35 bp, Artificial Sequence
  Synthetic oligonucleotide
tgccctgtctccctgtccatacatgttacttctac

SEQ ID NO: 143092 - DNA, 35 bp, Artificial Sequence
  Synthetic oligonucleotide
tcctccaacgatgccgcccgggcctctcatccacc

SEQ ID NO: 143093 - DNA, 35 bp, Artificial Sequence
  Synthetic oligonucleotide
tcgcgtcgaactccgccgtggctcgctgcactacc

SEQ ID NO: 143094 - DNA, 35 bp, Artificial Sequence
  Synthetic oligonucleotide
tacactcttcccagcccgcgctactacgtgcaccc

SEQ ID NO: 143095 - DNA, 35 bp, Artificial Sequence
  Synthetic oligonucleotide
tcgctccctcccgcccgatgacccgtagtgccgcc

SEQ ID NO: 143096 - DNA, 35 bp, Artificial Sequence
  Synthetic oligonucleotide
ttcgatcgcctcgcctttactcgtatttcctacgc

SEQ ID NO: 143097 - DNA, 35 bp, Artificial Sequence
  Synthetic oligonucleotide
ttgcatccgcaccgttccgcgcgtaccattacatc

SEQ ID NO: 143098 - DNA, 35 bp, Artificial Sequence
  Synthetic oligonucleotide
tcagcccgtcccctgttaccagttcttttctcatc

SEQ ID NO: 143099 - DNA, 35 bp, Artificial Sequence
  Synthetic oligonucleotide
tcccctaccgctctggtggtgttctacctaacctc

SEQ ID NO: 143100 - DNA, 35 bp, Artificial Sequence
  Synthetic oligonucleotide
tacacaggtgatgcccgaaccgccgccttgccctc

SEQ ID NO: 143101 - DNA, 35 bp, Artificial Sequence
  Synthetic oligonucleotide
gacaagggaggggagcttggggagacaaaacggtc

SEQ ID NO: 143102 - DNA, 35 bp, Artificial Sequence
  Synthetic oligonucleotide
gtttaccgccgatcttttcgcccctgggacacttc

SEQ ID NO: 143103 - DNA, 35 bp, Artificial Sequence
  Synthetic oligonucleotide
acacctccgatccttattaagctactgtactcttc

SEQ ID NO: 143104 - DNA, 35 bp, Artificial Sequence
  Synthetic oligonucleotide
gaatagtcgaggtgggggcggttggtatactgtag

SEQ ID NO: 143105 - DNA, 35 bp, Artificial Sequence
  Synthetic oligonucleotide
accatgacccgattatctcgtttttctgcctcccg

SEQ ID NO: 143106 - DNA, 34 bp, Artificial Sequence
  Synthetic oligonucleotide
gccactcattacgcccccctttagcaacctgccg

SEQ ID NO: 143107 - DNA, 35 bp, Artificial Sequence
  Synthetic oligonucleotide
ttgtcgccctcgctaatctatacgccctctattgg

SEQ ID NO: 143108 - DNA, 35 bp, Artificial Sequence
  Synthetic oligonucleotide
tcccctgtccaccacctattctcgtacaccccatg

SEQ ID NO: 143109 - DNA, 35 bp, Artificial Sequence
  Synthetic oligonucleotide
atgccacacatcatgcctcgcagtccggtccccct

SEQ ID NO: 143110 - DNA, 35 bp, Artificial Sequence
  Synthetic oligonucleotide
gcgcgccccctcgtatcgcctgttaaactcctgct

SEQ ID NO: 143111 - DNA, 35 bp, Artificial Sequence
  Synthetic oligonucleotide
tgtgagggaagaggtaggcttgggaggggcggatt

SEQ ID NO: 143112 - DNA, 35 bp, Artificial Sequence
  Synthetic oligonucleotide
ataccaccgcctgcttacgcaaatttggactcgtt

SEQ ID NO: 143113 - DNA, 35 bp, Artificial Sequence
  Synthetic oligonucleotide
tccctgtccgcgatcattaccgccatgctcccttt

SEQ ID NO: 143114 - DNA, 35 bp, Artificial Sequence
  Synthetic oligonucleotide
gacagagggggggcgtgggagaattgagtgggaaa

SEQ ID NO: 143115 - DNA, 36 bp, Artificial Sequence
  Synthetic oligonucleotide
gatgacacccgttgacgcgcccccttttacccggaa

SEQ ID NO: 143116 - DNA, 36 bp, Artificial Sequence
  Synthetic oligonucleotide
gccccgcccgccatgaccgaatacatgcatctttaa

SEQ ID NO: 143117 - DNA, 35 bp, Artificial Sequence
  Synthetic oligonucleotide
atcacccgttgcctctgcagatactggcccaccca

SEQ ID NO: 143118 - DNA, 36 bp, Artificial Sequence
  Synthetic oligonucleotide
tcatccaccggtgtcatcggcctcattcgcttccca

SEQ ID NO: 143119 - DNA, 35 bp, Artificial Sequence
  Synthetic oligonucleotide
taccacctggctccgtatttcatctgccctcggca

SEQ ID NO: 143120 - DNA, 37 bp, Artificial Sequence
  Synthetic oligonucleotide
taaggcgtacaggcgtgggggatgaacgggagggaga

SEQ ID NO: 143121 - DNA, 37 bp, Artificial Sequence
  Synthetic oligonucleotide
gtagcggagggcagagagggttggggagatggagcga

SEQ ID NO: 143122 - DNA, 37 bp, Artificial Sequence
  Synthetic oligonucleotide
tgccatgccctgcccctgttccgctctcgctcttcga

SEQ ID NO: 143123 - DNA, 35 bp, Artificial Sequence
  Synthetic oligonucleotide
gtgatgcggaagggaacctggagtgaggggtagga

SEQ ID NO: 143124 - DNA, 36 bp, Artificial Sequence
  Synthetic oligonucleotide
aagcacaccacctgcatcgcccaagcctctcccgga

SEQ ID NO: 143125 - DNA, 36 bp, Artificial Sequence
  Synthetic oligonucleotide
gtggacgaggggggtgggcttagggttgttcgggga

SEQ ID NO: 143126 - DNA, 37 bp, Artificial Sequence
  Synthetic oligonucleotide
ggaagggttgggagagggaagggaggccgaggtggga

SEQ ID NO: 143127 - DNA, 37 bp, Artificial Sequence
  Synthetic oligonucleotide
atcgctctacccagccgttctcccacagtcttttgga

SEQ ID NO: 143128 - DNA, 38 bp, Artificial Sequence
  Synthetic oligonucleotide
gggaagggggggaggggggtggtgtgttagggacgtga

SEQ ID NO: 143129 - DNA, 36 bp, Artificial Sequence
  Synthetic oligonucleotide
gaaccacgccacacgagccgccattcacaaccttga

SEQ ID NO: 143130 - DNA, 36 bp, Artificial Sequence
  Synthetic oligonucleotide
gagccacccaatgccgctgagccttcgtatcttcta

SEQ ID NO: 143131 - DNA, 36 bp, Artificial Sequence
  Synthetic oligonucleotide
tgtctccatccgttgctgggcgcccatttctccgta

SEQ ID NO: 143132 - DNA, 36 bp, Artificial Sequence
  Synthetic oligonucleotide
acgtccgtcccacacctcgtcattgcccaccagtta

SEQ ID NO: 143133 - DNA, 35 bp, Artificial Sequence
  Synthetic oligonucleotide
gaagaacacaaaggaggaagtgcgtgcgggggtta

SEQ ID NO: 143134 - DNA, 35 bp, Artificial Sequence
  Synthetic oligonucleotide
gactcgcctccatattgctttctggctgagcaccc

SEQ ID NO: 143135 - DNA, 35 bp, Artificial Sequence
  Synthetic oligonucleotide
atctgccgcgacattcctacctcctagttcccgcc

SEQ ID NO: 143136 - DNA, 35 bp, Artificial Sequence
  Synthetic oligonucleotide
ttacgcacccaccacacccgactcatgatacttcc

SEQ ID NO: 143137 - DNA, 35 bp, Artificial Sequence
  Synthetic oligonucleotide
atgcgcgcgatcgtaaccactttacacgcccttcc

SEQ ID NO: 143138 - DNA, 35 bp, Artificial Sequence
  Synthetic oligonucleotide
gacgagacattgccctgtgcgtcccccccatacgc

SEQ ID NO: 143139 - DNA, 35 bp, Artificial Sequence
  Synthetic oligonucleotide
tctgccaaccgctacccactgattgccccctacgc

SEQ ID NO: 143140 - DNA, 35 bp, Artificial Sequence
  Synthetic oligonucleotide
accgtcaacttcttgtcgctccaatctcctcgtgc

SEQ ID NO: 143141 - DNA, 35 bp, Artificial Sequence
  Synthetic oligonucleotide
tcccgactgactgattacgcgtgtcatctatcctc

SEQ ID NO: 143142 - DNA, 35 bp, Artificial Sequence
  Synthetic oligonucleotide
gcacctttccgcgctaccatccctcagtaccgctc

SEQ ID NO: 143143 - DNA, 35 bp, Artificial Sequence
  Synthetic oligonucleotide
tgctgctcgccgccgccttgacttgtccctttctc

SEQ ID NO: 143144 - DNA, 35 bp, Artificial Sequence
  Synthetic oligonucleotide
tagcctctcctgcctccactctcctccatggtgtc

SEQ ID NO: 143145 - DNA, 35 bp, Artificial Sequence
  Synthetic oligonucleotide
agaacagcccgcccattatccctttgtgctccttg

SEQ ID NO: 143146 - DNA, 35 bp, Artificial Sequence
  Synthetic oligonucleotide
gcccacacccatcggtataatgtctttccgcatat

SEQ ID NO: 143147 - DNA, 35 bp, Artificial Sequence
  Synthetic oligonucleotide
gctcaccctacacatgcaatttctgctacgcttct

SEQ ID NO: 143148 - DNA, 36 bp, Artificial Sequence
  Synthetic oligonucleotide
gacagggatgtcattggaacgggcggggatggggaa

SEQ ID NO: 143149 - DNA, 36 bp, Artificial Sequence
  Synthetic oligonucleotide
tgcccccgcccgctgtagggtccacacaattacaca

SEQ ID NO: 143150 - DNA, 35 bp, Artificial Sequence
  Synthetic oligonucleotide
ccccccaccccgcaatgtaccctcggcgcccacca

SEQ ID NO: 143151 - DNA, 35 bp, Artificial Sequence
  Synthetic oligonucleotide
attgcgcccgtgccacctgcccttagttaacatca

SEQ ID NO: 143152 - DNA, 35 bp, Artificial Sequence
  Synthetic oligonucleotide
tccggaggggaagggcgagggagcactttgggaga

SEQ ID NO: 143153 - DNA, 37 bp, Artificial Sequence
  Synthetic oligonucleotide
atgtgaaagcacgtgggtggggagcgggcgggtgaga

SEQ ID NO: 143154 - DNA, 37 bp, Artificial Sequence
  Synthetic oligonucleotide
aaggggcgagacgggatgggtgtagtgtgggggtaga

SEQ ID NO: 143155 - DNA, 37 bp, Artificial Sequence
  Synthetic oligonucleotide
tcgacgcccttccctgtttcatcctgtctccatgcga

SEQ ID NO: 143156 - DNA, 37 bp, Artificial Sequence
  Synthetic oligonucleotide
gtgagacggccgcagtggggggtggagctggaaagga

SEQ ID NO: 143157 - DNA, 37 bp, Artificial Sequence
  Synthetic oligonucleotide
gcgatgcgccacggtgggcgggggaaattggggcgga

SEQ ID NO: 143158 - DNA, 36 bp, Artificial Sequence
  Synthetic oligonucleotide
acctcgccactatcctcgttacccgtctgcccggga

SEQ ID NO: 143159 - DNA, 37 bp, Artificial Sequence
  Synthetic oligonucleotide
gcgcaggcccctgcgcccccctcctgatagagcctga

SEQ ID NO: 143160 - DNA, 38 bp, Artificial Sequence
  Synthetic oligonucleotide
gacccgatggagggaggttacgagaagggaaggcgtga

SEQ ID NO: 143161 - DNA, 36 bp, Artificial Sequence
  Synthetic oligonucleotide
gttcacctcacccctccgcccgttagcctatcgtga

SEQ ID NO: 143162 - DNA, 36 bp, Artificial Sequence
  Synthetic oligonucleotide
tgtgaacgggggcaaaggtaaagggggcggttgtga

SEQ ID NO: 143163 - DNA, 37 bp, Artificial Sequence
  Synthetic oligonucleotide
tcccccttgtcctgcgagttacgacgcaccctattga

SEQ ID NO: 143164 - DNA, 38 bp, Artificial Sequence
  Synthetic oligonucleotide
gcgtgcactcctccgcacttcgcgaccttccatcttga

SEQ ID NO: 143165 - DNA, 36 bp, Artificial Sequence
  Synthetic oligonucleotide
gtgatcaccttgttctatcgccgttatgccacgcta

SEQ ID NO: 143166 - DNA, 35 bp, Artificial Sequence
  Synthetic oligonucleotide
tgtgctcatcatcactgggccatcatctcgcttta

SEQ ID NO: 143167 - DNA, 35 bp, Artificial Sequence
  Synthetic oligonucleotide
agctacatactgccgtgtcccgccccccggcccac

SEQ ID NO: 143168 - DNA, 34 bp, Artificial Sequence
  Synthetic oligonucleotide
actgttctgcccctccagcgccttctacctggac

SEQ ID NO: 143169 - DNA, 35 bp, Artificial Sequence
  Synthetic oligonucleotide
acccattgctcacgttcggtcagttcccgggctac

SEQ ID NO: 143170 - DNA, 35 bp, Artificial Sequence
  Synthetic oligonucleotide
tgaacccccgttaccgcctaggcctatcgtacacc

SEQ ID NO: 143171 - DNA, 35 bp, Artificial Sequence
  Synthetic oligonucleotide
aagcacacacaggatttacctccccccctctgccc

SEQ ID NO: 143172 - DNA, 35 bp, Artificial Sequence
  Synthetic oligonucleotide
tgttcgccaaacatccgtggtgcgctgccctcgcc

SEQ ID NO: 143173 - DNA, 35 bp, Artificial Sequence
  Synthetic oligonucleotide
acaccacctcaccatctgttcttcttaccctggcc

SEQ ID NO: 143174 - DNA, 35 bp, Artificial Sequence
  Synthetic oligonucleotide
tccgcaatccgctagttccccatttacatcctgcc

SEQ ID NO: 143175 - DNA, 35 bp, Artificial Sequence
  Synthetic oligonucleotide
gaatcgccgatgccctcttatgtccagtttttgcc

SEQ ID NO: 143176 - DNA, 35 bp, Artificial Sequence
  Synthetic oligonucleotide
ttcttccccccgatagtttgcctggctgggcctcc

SEQ ID NO: 143177 - DNA, 35 bp, Artificial Sequence
  Synthetic oligonucleotide
tcatggccgtgcacacgggtcgccataatatctcc

SEQ ID NO: 143178 - DNA, 35 bp, Artificial Sequence
  Synthetic oligonucleotide
tgctccccacacattaaggccagtgcactccttcc

SEQ ID NO: 143179 - DNA, 35 bp, Artificial Sequence
  Synthetic oligonucleotide
gcatgccacttgagttctcgtttggttttagttcc

SEQ ID NO: 143180 - DNA, 35 bp, Artificial Sequence
  Synthetic oligonucleotide
acacctccgtctcccctagggcatatcctcgccgc

SEQ ID NO: 143181 - DNA, 36 bp, Artificial Sequence
  Synthetic oligonucleotide
tctcgagcccctcctgttcgaccgtgaccccttggc

SEQ ID NO: 143182 - DNA, 35 bp, Artificial Sequence
  Synthetic oligonucleotide
cattccgccacaccatcgacgcatccagtaacatc

SEQ ID NO: 143183 - DNA, 35 bp, Artificial Sequence
  Synthetic oligonucleotide
actccctccagcccttgtacgcgcacctcctcatc

SEQ ID NO: 143184 - DNA, 35 bp, Artificial Sequence
  Synthetic oligonucleotide
ttcggtcccagcctcgcgctcctgtccgtgccctc

SEQ ID NO: 143185 - DNA, 35 bp, Artificial Sequence
  Synthetic oligonucleotide
ttgacgggagggagaggggggaagtaccggccgag

SEQ ID NO: 143186 - DNA, 35 bp, Artificial Sequence
  Synthetic oligonucleotide
tgctacgcagatcgcccccacatagaatcatcctg

SEQ ID NO: 143187 - DNA, 35 bp, Artificial Sequence
  Synthetic oligonucleotide
tagtcccatcattggtagcctgtttgccccgcttg

SEQ ID NO: 143188 - DNA, 35 bp, Artificial Sequence
  Synthetic oligonucleotide
tgagcctgtcttcagtgcctacccacctcactgct

SEQ ID NO: 143189 - DNA, 35 bp, Artificial Sequence
  Synthetic oligonucleotide
tccggtcaatcgcaatattcgtactttctcctggt

SEQ ID NO: 143190 - DNA, 35 bp, Artificial Sequence
  Synthetic oligonucleotide
taagactagagggaggatgagggaaatgagtggaa

SEQ ID NO: 143191 - DNA, 33 bp, Artificial Sequence
  Synthetic oligonucleotide
atagccggtcgtccaacgttcccccttccttaa

SEQ ID NO: 143192 - DNA, 35 bp, Artificial Sequence
  Synthetic oligonucleotide
atggtggagggggaggtagggacgggctagagaca

SEQ ID NO: 143193 - DNA, 35 bp, Artificial Sequence
  Synthetic oligonucleotide
ggccttcccagccccccgctacactgccctcaaga

SEQ ID NO: 143194 - DNA, 37 bp, Artificial Sequence
  Synthetic oligonucleotide
aagacaggagggaagttgagtgaggagggcacggaga

SEQ ID NO: 143195 - DNA, 37 bp, Artificial Sequence
  Synthetic oligonucleotide
tccgccccagatctcgaagcccccgtccacttttaga

SEQ ID NO: 143196 - DNA, 37 bp, Artificial Sequence
  Synthetic oligonucleotide
gtcaccatacagtttattcccatcctcgttcttacga

SEQ ID NO: 143197 - DNA, 37 bp, Artificial Sequence
  Synthetic oligonucleotide
ttacgccccgcccctagtgagatgtctacacctccga

SEQ ID NO: 143198 - DNA, 37 bp, Artificial Sequence
  Synthetic oligonucleotide
ttcatcctcgccccacgttcctccaacgctagttcga

SEQ ID NO: 143199 - DNA, 37 bp, Artificial Sequence
  Synthetic oligonucleotide
gaatgagggagggagggttgggtgcaggatgctagga

SEQ ID NO: 143200 - DNA, 35 bp, Artificial Sequence
  Synthetic oligonucleotide
gaagccaccctgcctggcaccctcaatcctctgga

SEQ ID NO: 143201 - DNA, 37 bp, Artificial Sequence
  Synthetic oligonucleotide
ggattggccctctactgcgcccccccactcccttgga

SEQ ID NO: 143202 - DNA, 37 bp, Artificial Sequence
  Synthetic oligonucleotide
accaccccccgccgtacttggtactgcattctttgga

SEQ ID NO: 143203 - DNA, 36 bp, Artificial Sequence
  Synthetic oligonucleotide
acgtccagttgcccatgcctccgtgttcgcccctga

SEQ ID NO: 143204 - DNA, 35 bp, Artificial Sequence
  Synthetic oligonucleotide
acaaccaacgcgccctgctattcgtcttctacata

SEQ ID NO: 143205 - DNA, 25 bp, Artificial Sequence
  Synthetic oligonucleotide
gtaaccatcatcatcctacatacta

SEQ ID NO: 143206 - DNA, 36 bp, Artificial Sequence
  Synthetic oligonucleotide
taccggacccagtgcgaactgccccaccctattcta

SEQ ID NO: 143207 - DNA, 35 bp, Artificial Sequence
  Synthetic oligonucleotide
gtacaactccattcgcaccctagcccagtgcctta

SEQ ID NO: 143208 - DNA, 36 bp, Artificial Sequence
  Synthetic oligonucleotide
agtggggctgcaacagggggggacgggctgcattta

SEQ ID NO: 143209 - DNA, 35 bp, Artificial Sequence
  Synthetic oligonucleotide
tctcgtacccagacgccgctttaatacctccttac

SEQ ID NO: 143210 - DNA, 35 bp, Artificial Sequence
  Synthetic oligonucleotide
gccttcagaccgctatcttgctcgaccgccacacc

SEQ ID NO: 143211 - DNA, 35 bp, Artificial Sequence
  Synthetic oligonucleotide
gtgccagcccccaatccggcattattgcgcacgcc

SEQ ID NO: 143212 - DNA, 35 bp, Artificial Sequence
  Synthetic oligonucleotide
tcagcctgtttacactttcgctcaggcccctcgcc

SEQ ID NO: 143213 - DNA, 35 bp, Artificial Sequence
  Synthetic oligonucleotide
attccccccccgctatccctggcctccagcctgcc

SEQ ID NO: 143214 - DNA, 35 bp, Artificial Sequence
  Synthetic oligonucleotide
atcgtcgcccgtccgcgaacaatgcccttctcagc

SEQ ID NO: 143215 - DNA, 35 bp, Artificial Sequence
  Synthetic oligonucleotide
accgcccacgcacgaaactccctacctatgctctc

SEQ ID NO: 143216 - DNA, 35 bp, Artificial Sequence
  Synthetic oligonucleotide
aaacgtaagtaggaggaagggggaggggcacggtc

SEQ ID NO: 143217 - DNA, 35 bp, Artificial Sequence
  Synthetic oligonucleotide
ggacacctgccagccattttacggtccattcattc

SEQ ID NO: 143218 - DNA, 35 bp, Artificial Sequence
  Synthetic oligonucleotide
ggatcccgccgtaacgcgtagagttcctacccttc

SEQ ID NO: 143219 - DNA, 35 bp, Artificial Sequence
  Synthetic oligonucleotide
accatccggccacatggcattatccatatatcttc

SEQ ID NO: 143220 - DNA, 35 bp, Artificial Sequence
  Synthetic oligonucleotide
gtcgtcgaggcacggtgggggtagggatggggtag

SEQ ID NO: 143221 - DNA, 35 bp, Artificial Sequence
  Synthetic oligonucleotide
gtcacgccgcctctctgtacccgccatatgcactg

SEQ ID NO: 143222 - DNA, 35 bp, Artificial Sequence
  Synthetic oligonucleotide
aacaccgtgcccatgtccgtactgttcatcctctg

SEQ ID NO: 143223 - DNA, 35 bp, Artificial Sequence
  Synthetic oligonucleotide
tgctgcccccctggtggccatagaattccctccat

SEQ ID NO: 143224 - DNA, 35 bp, Artificial Sequence
  Synthetic oligonucleotide
atcctccagtagtacgcacggcactttgtgcgcct

SEQ ID NO: 143225 - DNA, 35 bp, Artificial Sequence
  Synthetic oligonucleotide
gaataccacccggcccgatagttctgctatctcct

SEQ ID NO: 143226 - DNA, 35 bp, Artificial Sequence
  Synthetic oligonucleotide
ttgcccctccctcgctgggaccttccgtatgtcct

SEQ ID NO: 143227 - DNA, 35 bp, Artificial Sequence
  Synthetic oligonucleotide
tgttcgatccaggcgctaatatccggctcattcct

SEQ ID NO: 143228 - DNA, 35 bp, Artificial Sequence
  Synthetic oligonucleotide
actgtcaagttcgtccgcctttctccacgcactgt

SEQ ID NO: 143229 - DNA, 35 bp, Artificial Sequence
  Synthetic oligonucleotide
gtttccaccctcatgtcccacctcccctgttgtgt

SEQ ID NO: 143230 - DNA, 33 bp, Artificial Sequence
  Synthetic oligonucleotide
gatgcccccccccgctgtaccaccccgataatt

SEQ ID NO: 143231 - DNA, 34 bp, Artificial Sequence
  Synthetic oligonucleotide
gcccattcactgtccacgcccagaagcacggctt

SEQ ID NO: 143232 - DNA, 35 bp, Artificial Sequence
  Synthetic oligonucleotide
tcacccccctgtagttactatgccactcttgtgtt

SEQ ID NO: 143233 - DNA, 38 bp, Artificial Sequence
  Synthetic oligonucleotide
tcaggcacccgtcctcttgtctgcttaccactgcctaa

SEQ ID NO: 143234 - DNA, 36 bp, Artificial Sequence
  Synthetic oligonucleotide
tatatcgtcgatgccccattagccgccgccttgtaa

SEQ ID NO: 143235 - DNA, 36 bp, Artificial Sequence
  Synthetic oligonucleotide
taccagcacccattgcgctatccttcacttgttaca

SEQ ID NO: 143236 - DNA, 35 bp, Artificial Sequence
  Synthetic oligonucleotide
acatcccccctccgtcgtaagacatggttaaacca

SEQ ID NO: 143237 - DNA, 37 bp, Artificial Sequence
  Synthetic oligonucleotide
aagggcgggcaaaaaaggggaacgggcatacgctaga

SEQ ID NO: 143238 - DNA, 37 bp, Artificial Sequence
  Synthetic oligonucleotide
tatggaggaggagggtaggggaaacataacaggacga

SEQ ID NO: 143239 - DNA, 37 bp, Artificial Sequence
  Synthetic oligonucleotide
tacgcgctccttcccccattggccacttcgcactcga

SEQ ID NO: 143240 - DNA, 37 bp, Artificial Sequence
  Synthetic oligonucleotide
agcgggggaggtaagggtaagtgggaagaagagcgga

SEQ ID NO: 143241 - DNA, 37 bp, Artificial Sequence
  Synthetic oligonucleotide
tgacagtattgggtgggacaacgcggaggggaaggga

SEQ ID NO: 143242 - DNA, 38 bp, Artificial Sequence
  Synthetic oligonucleotide
gacatgggggggcgagcgaggcggggtaggtggaatga

SEQ ID NO: 143243 - DNA, 38 bp, Artificial Sequence
  Synthetic oligonucleotide
attccacccccatgggccaccagtcactgttaacatga

SEQ ID NO: 143244 - DNA, 37 bp, Artificial Sequence
  Synthetic oligonucleotide
accgtcatctgcctctctctacttggtactgccctga

SEQ ID NO: 143245 - DNA, 37 bp, Artificial Sequence
  Synthetic oligonucleotide
acgccggccctgaccacggtatcgtaccatctcctga

SEQ ID NO: 143246 - DNA, 37 bp, Artificial Sequence
  Synthetic oligonucleotide
atgggaggggctagggtgggaaaggatatgtcggtga

SEQ ID NO: 143247 - DNA, 35 bp, Artificial Sequence
  Synthetic oligonucleotide
cccgacaccgccatggtctcgccgcttttctctta

SEQ ID NO: 143248 - DNA, 35 bp, Artificial Sequence
  Synthetic oligonucleotide
gtcttgaccgactaatttattgaccttgccctcac

SEQ ID NO: 143249 - DNA, 35 bp, Artificial Sequence
  Synthetic oligonucleotide
aatcctgcccacgacgggtccacccgaaactaccc

SEQ ID NO: 143250 - DNA, 35 bp, Artificial Sequence
  Synthetic oligonucleotide
ggagcccgctttcatatacgacggctcgccccccc

SEQ ID NO: 143251 - DNA, 35 bp, Artificial Sequence
  Synthetic oligonucleotide
tgaatcgtgttcctgtcccattagcctgcctcccc

SEQ ID NO: 143252 - DNA, 35 bp, Artificial Sequence
  Synthetic oligonucleotide
tcgcactccatccattcaagatcaccccccggccc

SEQ ID NO: 143253 - DNA, 35 bp, Artificial Sequence
  Synthetic oligonucleotide
tgtcccatcctagggcccttaccatccacgctccc

SEQ ID NO: 143254 - DNA, 35 bp, Artificial Sequence
  Synthetic oligonucleotide
ttagtgctcgtgcctccgttctttgttggtttccc

SEQ ID NO: 143255 - DNA, 35 bp, Artificial Sequence
  Synthetic oligonucleotide
acaccctatggacgtgccattctgagtttacttcc

SEQ ID NO: 143256 - DNA, 35 bp, Artificial Sequence
  Synthetic oligonucleotide
atcggttccacccttcaccctttcgccggagttcc

SEQ ID NO: 143257 - DNA, 35 bp, Artificial Sequence
  Synthetic oligonucleotide
accctgccgcatctgttttccgctaccgcctccag

SEQ ID NO: 143258 - DNA, 35 bp, Artificial Sequence
  Synthetic oligonucleotide
tggacagtgtgcattccttcgttccccgcatcccg

SEQ ID NO: 143259 - DNA, 35 bp, Artificial Sequence
  Synthetic oligonucleotide
tcaaggcaccctccgacccattcctctaatcccgg

SEQ ID NO: 143260 - DNA, 35 bp, Artificial Sequence
  Synthetic oligonucleotide
taactccccccgcacatgcacgatgcttcacttgg

SEQ ID NO: 143261 - DNA, 35 bp, Artificial Sequence
  Synthetic oligonucleotide
acgacacgagtcgtccatcccatcgcccttgcctg

SEQ ID NO: 143262 - DNA, 35 bp, Artificial Sequence
  Synthetic oligonucleotide
acatccaccctcatccgacaagaggcacggagtct

SEQ ID NO: 143263 - DNA, 35 bp, Artificial Sequence
  Synthetic oligonucleotide
gcacccgtgattattcgctgcctgtctttccaatt

SEQ ID NO: 143264 - DNA, 35 bp, Artificial Sequence
  Synthetic oligonucleotide
gcccctccggaagttaatgccactcaccccccttt

SEQ ID NO: 143265 - DNA, 35 bp, Artificial Sequence
  Synthetic oligonucleotide
gcccgctcgccgtacctgcacctgcccagcttttt

SEQ ID NO: 143266 - DNA, 35 bp, Artificial Sequence
  Synthetic oligonucleotide
gtggcggaggcggggggtggatggaggtcaatcaa

SEQ ID NO: 143267 - DNA, 36 bp, Artificial Sequence
  Synthetic oligonucleotide
agccggggggcgggaggggagatgcaatacggggaa

SEQ ID NO: 143268 - DNA, 36 bp, Artificial Sequence
  Synthetic oligonucleotide
taaagcgcaccgttgtcacgcctcacctcgacccca

SEQ ID NO: 143269 - DNA, 35 bp, Artificial Sequence
  Synthetic oligonucleotide
tagaacccaccacatccgatccgagtcgcattcca

SEQ ID NO: 143270 - DNA, 35 bp, Artificial Sequence
  Synthetic oligonucleotide
accctgacctacagttccctcgtgcttcttttcca

SEQ ID NO: 143271 - DNA, 36 bp, Artificial Sequence
  Synthetic oligonucleotide
gaaaggtggggcggtggagcaatcggggcagaacga

SEQ ID NO: 143272 - DNA, 36 bp, Artificial Sequence
  Synthetic oligonucleotide
gcccccaccgcacccccctttgacagtactggacga

SEQ ID NO: 143273 - DNA, 37 bp, Artificial Sequence
  Synthetic oligonucleotide
gagcacacccttgatctgcttttcaccattctgcgga

SEQ ID NO: 143274 - DNA, 37 bp, Artificial Sequence
  Synthetic oligonucleotide
gagaacggggggtggcctgatagggaagaaggaggga

SEQ ID NO: 143275 - DNA, 37 bp, Artificial Sequence
  Synthetic oligonucleotide
ttcccccgccctcacgaaccgtttctcgagaaatgga

SEQ ID NO: 143276 - DNA, 37 bp, Artificial Sequence
  Synthetic oligonucleotide
attgcaccgccggcaccttcccacctttcccgctgga

SEQ ID NO: 143277 - DNA, 38 bp, Artificial Sequence
  Synthetic oligonucleotide
ggacccgccctactctcccgattccctcgcttcgctga

SEQ ID NO: 143278 - DNA, 38 bp, Artificial Sequence
  Synthetic oligonucleotide
tcatgcacccatgtgcctacccgctcctaacctgctga

SEQ ID NO: 143279 - DNA, 38 bp, Artificial Sequence
  Synthetic oligonucleotide
tgaaacgtgggggggaggggattgggtaacgtcagtga

SEQ ID NO: 143280 - DNA, 38 bp, Artificial Sequence
  Synthetic oligonucleotide
acgctccacccactgcaggaccgcctcacccacggtga

SEQ ID NO: 143281 - DNA, 38 bp, Artificial Sequence
  Synthetic oligonucleotide
gcatcactaccgccgcctgtctcccgagctcatcttga

SEQ ID NO: 143282 - DNA, 37 bp, Artificial Sequence
  Synthetic oligonucleotide
tcgcaactcgcactctaccttaggacccgcctcttga

SEQ ID NO: 143283 - DNA, 35 bp, Artificial Sequence
  Synthetic oligonucleotide
gagagaatggccatgggggtgaaggggggtgcgta

SEQ ID NO: 143284 - DNA, 35 bp, Artificial Sequence
  Synthetic oligonucleotide
tgcaccccaattgctttttcagtatctaggctcac

SEQ ID NO: 143285 - DNA, 35 bp, Artificial Sequence
  Synthetic oligonucleotide
accacactccaacgccctggttttctcgacatgac

SEQ ID NO: 143286 - DNA, 35 bp, Artificial Sequence
  Synthetic oligonucleotide
ttggacgtctgtccaacgccgactgacacctcccc

SEQ ID NO: 143287 - DNA, 35 bp, Artificial Sequence
  Synthetic oligonucleotide
atggcactcgctccacacgtccatttctcgagccc

SEQ ID NO: 143288 - DNA, 35 bp, Artificial Sequence
  Synthetic oligonucleotide
tgcacgcatttgtctcgtttcggctcggtgctcgc

SEQ ID NO: 143289 - DNA, 35 bp, Artificial Sequence
  Synthetic oligonucleotide
agcactcgacactgccttccgcttgcacgacctgc

SEQ ID NO: 143290 - DNA, 35 bp, Artificial Sequence
  Synthetic oligonucleotide
agatatttacaccccgtccgacccaccctgcctgc

SEQ ID NO: 143291 - DNA, 35 bp, Artificial Sequence
  Synthetic oligonucleotide
gaggagtctcctgcctatatcgcctctcaatctgc

SEQ ID NO: 143292 - DNA, 35 bp, Artificial Sequence
  Synthetic oligonucleotide
tacgccccgaccaccggaccacatctcgcgccatc

SEQ ID NO: 143293 - DNA, 35 bp, Artificial Sequence
  Synthetic oligonucleotide
gccatcgataatgctccccggagttccccaccctc

SEQ ID NO: 143294 - DNA, 35 bp, Artificial Sequence
  Synthetic oligonucleotide
ttctccaccgcacccttgtatttggccctccgctc

SEQ ID NO: 143295 - DNA, 35 bp, Artificial Sequence
  Synthetic oligonucleotide
agatcgtcaattgtcccctcatgcttcgctctgtc

SEQ ID NO: 143296 - DNA, 35 bp, Artificial Sequence
  Synthetic oligonucleotide
atccacccgtacaccatggatactggggcccattc

SEQ ID NO: 143297 - DNA, 35 bp, Artificial Sequence
  Synthetic oligonucleotide
gtgacccccaatgctcccacgaagtccctgtaacg

SEQ ID NO: 143298 - DNA, 35 bp, Artificial Sequence
  Synthetic oligonucleotide
tccaccttccacgaatccccgcgttctctccgacg

SEQ ID NO: 143299 - DNA, 35 bp, Artificial Sequence
  Synthetic oligonucleotide
tcccagcacattgcccgccgccaccccttaatccg

SEQ ID NO: 143300 - DNA, 33 bp, Artificial Sequence
  Synthetic oligonucleotide
agcgggggtgggaagggtggggtccctatgggg

SEQ ID NO: 143301 - DNA, 35 bp, Artificial Sequence
  Synthetic oligonucleotide
gtccacgtacgccctccgtctgtcttgcaacactg

SEQ ID NO: 143302 - DNA, 35 bp, Artificial Sequence
  Synthetic oligonucleotide
gtccaccctgccatcctgtaccctaccctctcgtg

SEQ ID NO: 143303 - DNA, 35 bp, Artificial Sequence
  Synthetic oligonucleotide
gatctcgccgttctgcattagttccggtcccacat

SEQ ID NO: 143304 - DNA, 35 bp, Artificial Sequence
  Synthetic oligonucleotide
gagcggagctggggcctgttcttcctccctctcat

SEQ ID NO: 143305 - DNA, 35 bp, Artificial Sequence
  Synthetic oligonucleotide
aaccgccacacctctgcaagtttgaacgagcccct

SEQ ID NO: 143306 - DNA, 35 bp, Artificial Sequence
  Synthetic oligonucleotide
gactgggctcccttgcgctacggactcttctttct

SEQ ID NO: 143307 - DNA, 35 bp, Artificial Sequence
  Synthetic oligonucleotide
ttggcctcttcatctctcattgcgcatccacctgt

SEQ ID NO: 143308 - DNA, 35 bp, Artificial Sequence
  Synthetic oligonucleotide
tcacggtcgaacgaacaaacctccaccgcccctgt

SEQ ID NO: 143309 - DNA, 35 bp, Artificial Sequence
  Synthetic oligonucleotide
gcaactggcccccggttcctgtccctctccagaca

SEQ ID NO: 143310 - DNA, 36 bp, Artificial Sequence
  Synthetic oligonucleotide
agggtgggcgccataatgcgggcaagtcttgggaca

SEQ ID NO: 143311 - DNA, 36 bp, Artificial Sequence
  Synthetic oligonucleotide
tacctgtccggaccccgccccatcttcgccggtaca

SEQ ID NO: 143312 - DNA, 36 bp, Artificial Sequence
  Synthetic oligonucleotide
gtgccctccgaccggacccatccctgctgctctcca

SEQ ID NO: 143313 - DNA, 35 bp, Artificial Sequence
  Synthetic oligonucleotide
gcaacccccccgcaaccgctataactgcttgtcca

SEQ ID NO: 143314 - DNA, 36 bp, Artificial Sequence
  Synthetic oligonucleotide
tctgacgccacaccagcggcggccctcccccgctca

SEQ ID NO: 143315 - DNA, 36 bp, Artificial Sequence
  Synthetic oligonucleotide
tgacctacgttcgtcctagcttaccccgtcttctca

SEQ ID NO: 143316 - DNA, 36 bp, Artificial Sequence
  Synthetic oligonucleotide
gctcgccctgtctgtcggttcctgcctgctctttca

SEQ ID NO: 143317 - DNA, 36 bp, Artificial Sequence
  Synthetic oligonucleotide
tccacgctcccttctgaccggtgtcagggcccccga

SEQ ID NO: 143318 - DNA, 36 bp, Artificial Sequence
  Synthetic oligonucleotide
tccatccccgcttttgtcattctgccaacctcgcga

SEQ ID NO: 143319 - DNA, 36 bp, Artificial Sequence
  Synthetic oligonucleotide
acggggaggaagggcacgtaggggaaaccggaagga

SEQ ID NO: 143320 - DNA, 37 bp, Artificial Sequence
  Synthetic oligonucleotide
ttgccacccgccccccgtaactccctgtactgtcgga

SEQ ID NO: 143321 - DNA, 37 bp, Artificial Sequence
  Synthetic oligonucleotide
atgtgggcgaacatgggagggtgggtaacaagcctga

SEQ ID NO: 143322 - DNA, 35 bp, Artificial Sequence
  Synthetic oligonucleotide
attgcgcaatcgcataggacacaccacccccccta

SEQ ID NO: 143323 - DNA, 36 bp, Artificial Sequence
  Synthetic oligonucleotide
tctcaccgtcgctctgtctcgattcctcccaatgta

SEQ ID NO: 143324 - DNA, 35 bp, Artificial Sequence
  Synthetic oligonucleotide
agctcgccgtcgtccgctacaaccatcgtaccacc

SEQ ID NO: 143325 - DNA, 35 bp, Artificial Sequence
  Synthetic oligonucleotide
ttacaactcgccgccttgaaacacaccactggccc

SEQ ID NO: 143326 - DNA, 35 bp, Artificial Sequence
  Synthetic oligonucleotide
tgacctatgcacatgcccggcgggctgctccctcc

SEQ ID NO: 143327 - DNA, 35 bp, Artificial Sequence
  Synthetic oligonucleotide
tccaccccccattggttccttacggcccttcatgc

SEQ ID NO: 143328 - DNA, 35 bp, Artificial Sequence
  Synthetic oligonucleotide
attgcccccgatccctagtccaggccgccttaatc

SEQ ID NO: 143329 - DNA, 35 bp, Artificial Sequence
  Synthetic oligonucleotide
atattcgcccctccgttgtccgtggaaccctcgtc

SEQ ID NO: 143330 - DNA, 35 bp, Artificial Sequence
  Synthetic oligonucleotide
gacggggatgaacagaaggagggtagggggtgatg

SEQ ID NO: 143331 - DNA, 35 bp, Artificial Sequence
  Synthetic oligonucleotide
acgccgctcaccccgtcgacctccacaatcttctg

SEQ ID NO: 143332 - DNA, 35 bp, Artificial Sequence
  Synthetic oligonucleotide
gccgacgcttcccctgagcctccgcctctactaat

SEQ ID NO: 143333 - DNA, 35 bp, Artificial Sequence
  Synthetic oligonucleotide
ggagccttccgccctgttaacgtctatccgtacat

SEQ ID NO: 143334 - DNA, 35 bp, Artificial Sequence
  Synthetic oligonucleotide
tacacccgccccacgagcacgccgacgacgacgct

SEQ ID NO: 143335 - DNA, 35 bp, Artificial Sequence
  Synthetic oligonucleotide
aggaccgatgtcgggaggggacgggcgggaaaagt

SEQ ID NO: 143336 - DNA, 35 bp, Artificial Sequence
  Synthetic oligonucleotide
tgcgctactcctcgtgtctttctactgtcgttctt

SEQ ID NO: 143337 - DNA, 36 bp, Artificial Sequence
  Synthetic oligonucleotide
gactggggggggaggagggcacttaaaccatgagaa

SEQ ID NO: 143338 - DNA, 36 bp, Artificial Sequence
  Synthetic oligonucleotide
gagccacgcccgccgctccttgcactttctaccgaa

SEQ ID NO: 143339 - DNA, 36 bp, Artificial Sequence
  Synthetic oligonucleotide
gtggtggagggggagggcaatagaggttcgaacaca

SEQ ID NO: 143340 - DNA, 36 bp, Artificial Sequence
  Synthetic oligonucleotide
acctgccgccctccaccgtgaacaggcgttctcaca

SEQ ID NO: 143341 - DNA, 36 bp, Artificial Sequence
  Synthetic oligonucleotide
tgacgccagagtgcccttctcccccgtggcccgaca

SEQ ID NO: 143342 - DNA, 36 bp, Artificial Sequence
  Synthetic oligonucleotide
gtgcctcccgctgcctcgtattgcttatcccgacca

SEQ ID NO: 143343 - DNA, 35 bp, Artificial Sequence
  Synthetic oligonucleotide
ttcgctgccccgccgtgcctaatgctctcttgcca

SEQ ID NO: 143344 - DNA, 36 bp, Artificial Sequence
  Synthetic oligonucleotide
gatgtgactgcgactcgaactgttcctccctgtcca

SEQ ID NO: 143345 - DNA, 35 bp, Artificial Sequence
  Synthetic oligonucleotide
gccaccgagttctgtccatccccccagccggagca

SEQ ID NO: 143346 - DNA, 37 bp, Artificial Sequence
  Synthetic oligonucleotide
gtggggacatagaaggggcaggggagacaggcggcga

SEQ ID NO: 143347 - DNA, 37 bp, Artificial Sequence
  Synthetic oligonucleotide
gatacacggagaagagggggtcaagaggggtggagga

SEQ ID NO: 143348 - DNA, 36 bp, Artificial Sequence
  Synthetic oligonucleotide
tgagggcgatataagcaagggagtggggcgagggga

SEQ ID NO: 143349 - DNA, 37 bp, Artificial Sequence
  Synthetic oligonucleotide
gaaccgggaaaccaggaaaggtgaggtagggatggga

SEQ ID NO: 143350 - DNA, 37 bp, Artificial Sequence
  Synthetic oligonucleotide
ggagatggagcagaagggggggatacggtatgtggga

SEQ ID NO: 143351 - DNA, 35 bp, Artificial Sequence
  Synthetic oligonucleotide
aacgggaaggatacgagggggggaggatgagtgga

SEQ ID NO: 143352 - DNA, 37 bp, Artificial Sequence
  Synthetic oligonucleotide
tatgggagccagagagggagtggatgggaagtgtgga

SEQ ID NO: 143353 - DNA, 38 bp, Artificial Sequence
  Synthetic oligonucleotide
gtcgccctccatggtactccgcatctattgacttatga

SEQ ID NO: 143354 - DNA, 36 bp, Artificial Sequence
  Synthetic oligonucleotide
gttgctgccgatacaggggaagggggaggggactga

SEQ ID NO: 143355 - DNA, 38 bp, Artificial Sequence
  Synthetic oligonucleotide
ttacgctaccgcacagcccgtcccatatacgctcctga

SEQ ID NO: 143356 - DNA, 36 bp, Artificial Sequence
  Synthetic oligonucleotide
gtcacccaggtctgctctgatcatcgcctctcctga

SEQ ID NO: 143357 - DNA, 38 bp, Artificial Sequence
  Synthetic oligonucleotide
aaccatgcgcttcacatctgctcgctcctccgttctga

SEQ ID NO: 143358 - DNA, 38 bp, Artificial Sequence
  Synthetic oligonucleotide
tccacgtccgattgctccctcccgctccccataggtga

SEQ ID NO: 143359 - DNA, 38 bp, Artificial Sequence
  Synthetic oligonucleotide
gacatgtcatgggcgggtaggggcatcgggaaccttga

SEQ ID NO: 143360 - DNA, 31 bp, Artificial Sequence
  Synthetic oligonucleotide
ttaccgtgcgccacccaaccgtcctgcttta

SEQ ID NO: 143361 - DNA, 35 bp, Artificial Sequence
  Synthetic oligonucleotide
gtggaggaagtacgggtttgggggcttggggggac

SEQ ID NO: 143362 - DNA, 35 bp, Artificial Sequence
  Synthetic oligonucleotide
aattgtgccccccccgcccgaatccactttgtgac

SEQ ID NO: 143363 - DNA, 35 bp, Artificial Sequence
  Synthetic oligonucleotide
atccaccctccgcgcccatcagtaaatgtcattac

SEQ ID NO: 143364 - DNA, 35 bp, Artificial Sequence
  Synthetic oligonucleotide
gaatgcagacaaggagggggggtgggctggccgcc

SEQ ID NO: 143365 - DNA, 35 bp, Artificial Sequence
  Synthetic oligonucleotide
atcgctccctcaaacactgccaccctgctaagagc

SEQ ID NO: 143366 - DNA, 35 bp, Artificial Sequence
  Synthetic oligonucleotide
ggaaatgggaggaattggaggtaacaagggaaggc

SEQ ID NO: 143367 - DNA, 35 bp, Artificial Sequence
  Synthetic oligonucleotide
ttcgccagggggttgggggggatggctcaggtggc

SEQ ID NO: 143368 - DNA, 35 bp, Artificial Sequence
  Synthetic oligonucleotide
acgcggcccacgtgacccaccgcctcccgccctgc

SEQ ID NO: 143369 - DNA, 35 bp, Artificial Sequence
  Synthetic oligonucleotide
gacccccagcctcctacccatgatcctggttagtc

SEQ ID NO: 143370 - DNA, 35 bp, Artificial Sequence
  Synthetic oligonucleotide
gcacacccgccacctatctatcagcgttatccttc

SEQ ID NO: 143371 - DNA, 35 bp, Artificial Sequence
  Synthetic oligonucleotide
agtacgggagcggggggcggagaggattgaatcag

SEQ ID NO: 143372 - DNA, 35 bp, Artificial Sequence
  Synthetic oligonucleotide
gggttatgcggggggtggagggtggaggcgagctg

SEQ ID NO: 143373 - DNA, 35 bp, Artificial Sequence
  Synthetic oligonucleotide
taggtgggtgggcaggagagcggaggtgaggtgat

SEQ ID NO: 143374 - DNA, 35 bp, Artificial Sequence
  Synthetic oligonucleotide
gtgcctgcaccggtgtgatccacgttcgccatcct

SEQ ID NO: 143375 - DNA, 35 bp, Artificial Sequence
  Synthetic oligonucleotide
tcagagcccggtccactttcgagctatccaactct

SEQ ID NO: 143376 - DNA, 35 bp, Artificial Sequence
  Synthetic oligonucleotide
atcaccgtacccgatttctaatgcaccaccaacgt

SEQ ID NO: 143377 - DNA, 35 bp, Artificial Sequence
  Synthetic oligonucleotide
tcatctaccgcagttttcgtttcatccttacacgt

SEQ ID NO: 143378 - DNA, 35 bp, Artificial Sequence
  Synthetic oligonucleotide
tccactgactccttggctcctactcactgctactt

SEQ ID NO: 143379 - DNA, 35 bp, Artificial Sequence
  Synthetic oligonucleotide
gtcccgctccacattatgttttcttgccctgcctt

SEQ ID NO: 143380 - DNA, 35 bp, Artificial Sequence
  Synthetic oligonucleotide
aacatgcctgatggtaccgtggtctgctcctcttt

SEQ ID NO: 143381 - DNA, 35 bp, Artificial Sequence
  Synthetic oligonucleotide
gcacaaagcggggtgaagggaggatgggtaggaaa

SEQ ID NO: 143382 - DNA, 35 bp, Artificial Sequence
  Synthetic oligonucleotide
accgcctccccaccatcggacgtctttgggccaca

SEQ ID NO: 143383 - DNA, 36 bp, Artificial Sequence
  Synthetic oligonucleotide
tatgtcggagtcaatcgtgccgcccgcccgtctaca

SEQ ID NO: 143384 - DNA, 36 bp, Artificial Sequence
  Synthetic oligonucleotide
aagcacgacccccgcagctcgtacacacacctgtca

SEQ ID NO: 143385 - DNA, 37 bp, Artificial Sequence
  Synthetic oligonucleotide
gactcgtgaaggagtaagaaagggaggagggtgtaga

SEQ ID NO: 143386 - DNA, 36 bp, Artificial Sequence
  Synthetic oligonucleotide
ttacgcgccccgtcctctcgcgaaacaattccccga

SEQ ID NO: 143387 - DNA, 37 bp, Artificial Sequence
  Synthetic oligonucleotide
tgtcctcgcccgccttttgaaacgtgaccctcgccga

SEQ ID NO: 143388 - DNA, 37 bp, Artificial Sequence
  Synthetic oligonucleotide
gagaggggagtgaagggacatggaaacttgacggcga

SEQ ID NO: 143389 - DNA, 37 bp, Artificial Sequence
  Synthetic oligonucleotide
gcactcagaacgctcatcactccgcaccctccttcga

SEQ ID NO: 143390 - DNA, 37 bp, Artificial Sequence
  Synthetic oligonucleotide
aagctggtgaagcatggggtgggagggatggtaggga

SEQ ID NO: 143391 - DNA, 38 bp, Artificial Sequence
  Synthetic oligonucleotide
ggtccactcgatctgccggtacattctctcgaccctga

SEQ ID NO: 143392 - DNA, 38 bp, Artificial Sequence
  Synthetic oligonucleotide
atgggcgggcgcgggaaggggcatggtggggttcttga

SEQ ID NO: 143393 - DNA, 35 bp, Artificial Sequence
  Synthetic oligonucleotide
gatccccttcagtctggcttacctcccctagttga

SEQ ID NO: 143394 - DNA, 36 bp, Artificial Sequence
  Synthetic oligonucleotide
actcagtcagattaccctcgcgtggctccatcccta

SEQ ID NO: 143395 - DNA, 36 bp, Artificial Sequence
  Synthetic oligonucleotide
taaccccccaggagcttgtcctgccactcgttccta

SEQ ID NO: 143396 - DNA, 35 bp, Artificial Sequence
  Synthetic oligonucleotide
ttcaccacctacgcttccagttcgctgagctcacc

SEQ ID NO: 143397 - DNA, 35 bp, Artificial Sequence
  Synthetic oligonucleotide
agtccccgcaaacaccccaaggctcacccaccgcc

SEQ ID NO: 143398 - DNA, 35 bp, Artificial Sequence
  Synthetic oligonucleotide
atcgacagacctccactcacctcggcacgtttgcc

SEQ ID NO: 143399 - DNA, 35 bp, Artificial Sequence
  Synthetic oligonucleotide
atatgcccccgctcccaccttagaggaccgcatcc

SEQ ID NO: 143400 - DNA, 35 bp, Artificial Sequence
  Synthetic oligonucleotide
tcagaggtccatgcgaccgacccccctcccgctcc

SEQ ID NO: 143401 - DNA, 27 bp, Artificial Sequence
  Synthetic oligonucleotide
atgcatcaacgttcgccttcctccctc

SEQ ID NO: 143402 - DNA, 35 bp, Artificial Sequence
  Synthetic oligonucleotide
ttgagcctcgagggctcgctatagtattcctcctc

SEQ ID NO: 143403 - DNA, 35 bp, Artificial Sequence
  Synthetic oligonucleotide
ggacaggtgtgcactaccccgcctcgctgccgctc

SEQ ID NO: 143404 - DNA, 35 bp, Artificial Sequence
  Synthetic oligonucleotide
tcctccttcccctcagctcacgtgctggccatttc

SEQ ID NO: 143405 - DNA, 35 bp, Artificial Sequence
  Synthetic oligonucleotide
aaacgcacccatcctagattttccacgccctcccg

SEQ ID NO: 143406 - DNA, 35 bp, Artificial Sequence
  Synthetic oligonucleotide
acttctcacccgcgccttcctgacgactacgtcct

SEQ ID NO: 143407 - DNA, 35 bp, Artificial Sequence
  Synthetic oligonucleotide
ggagggggctagggatcaaaatgggagggggttct

SEQ ID NO: 143408 - DNA, 35 bp, Artificial Sequence
  Synthetic oligonucleotide
gcagagtagtctgcgcccccgcctcccgtccttgt

SEQ ID NO: 143409 - DNA, 35 bp, Artificial Sequence
  Synthetic oligonucleotide
ccgactctactcgggaggggtgtgggaggggggaa

SEQ ID NO: 143410 - DNA, 35 bp, Artificial Sequence
  Synthetic oligonucleotide
tgagcgcaacctgctgctacttgctttatctttaa

SEQ ID NO: 143411 - DNA, 36 bp, Artificial Sequence
  Synthetic oligonucleotide
tcctccgccacccttgtgcactataatgcacttcca

SEQ ID NO: 143412 - DNA, 36 bp, Artificial Sequence
  Synthetic oligonucleotide
acccccggtactgatccctgtgccaccacgccttca

SEQ ID NO: 143413 - DNA, 36 bp, Artificial Sequence
  Synthetic oligonucleotide
gccccgcccctccgccgaatatagacaaccccgaga

SEQ ID NO: 143414 - DNA, 35 bp, Artificial Sequence
  Synthetic oligonucleotide
acagatgccccccattcgtgccatcgacccataga

SEQ ID NO: 143415 - DNA, 36 bp, Artificial Sequence
  Synthetic oligonucleotide
actcgcgcccgcctcacgttctcttgctcagctaga

SEQ ID NO: 143416 - DNA, 37 bp, Artificial Sequence
  Synthetic oligonucleotide
tgccacaccgccccctgttcctgacggccaggcagga

SEQ ID NO: 143417 - DNA, 37 bp, Artificial Sequence
  Synthetic oligonucleotide
gggaagaggggatatacgagagatggagcagggagga

SEQ ID NO: 143418 - DNA, 37 bp, Artificial Sequence
  Synthetic oligonucleotide
tatgcggttggcgctgcctacctacttcccttacgga

SEQ ID NO: 143419 - DNA, 36 bp, Artificial Sequence
  Synthetic oligonucleotide
ggaggccggcggggcggacaggagggaggtaccgga

SEQ ID NO: 143420 - DNA, 37 bp, Artificial Sequence
  Synthetic oligonucleotide
acgcatggtggagacgggggggacaaatgcgagcgga

SEQ ID NO: 143421 - DNA, 38 bp, Artificial Sequence
  Synthetic oligonucleotide
aagagcgagggggggggtgcagaagacgggagggctga

SEQ ID NO: 143422 - DNA, 38 bp, Artificial Sequence
  Synthetic oligonucleotide
tcctcccgccgccaaatttgccccgaactagcccttga

SEQ ID NO: 143423 - DNA, 37 bp, Artificial Sequence
  Synthetic oligonucleotide
ggtgacaaaagggcggaggcggatggaggcggtttga

SEQ ID NO: 143424 - DNA, 35 bp, Artificial Sequence
  Synthetic oligonucleotide
atctgtacccgatcgttacgttgcccacccatgta

SEQ ID NO: 143425 - DNA, 35 bp, Artificial Sequence
  Synthetic oligonucleotide
tttgctcccgtcctacatgtcccctcggcttcgac

SEQ ID NO: 143426 - DNA, 35 bp, Artificial Sequence
  Synthetic oligonucleotide
gcattagcaattcatgccccagttcactcgcttac

SEQ ID NO: 143427 - DNA, 35 bp, Artificial Sequence
  Synthetic oligonucleotide
tgtacgcacgctggcatacgccccttccgttcacc

SEQ ID NO: 143428 - DNA, 36 bp, Artificial Sequence
  Synthetic oligonucleotide
acacccacgggatacgtaatagtcctcatgcccccc

SEQ ID NO: 143429 - DNA, 35 bp, Artificial Sequence
  Synthetic oligonucleotide
gacaatgcccccaatttactagctgttcccacgcc

SEQ ID NO: 143430 - DNA, 34 bp, Artificial Sequence
  Synthetic oligonucleotide
ttatgcgtacgcagccccctccgcttggccggcc

SEQ ID NO: 143431 - DNA, 35 bp, Artificial Sequence
  Synthetic oligonucleotide
atgcatcaccgcttctcatacttctcgctcgggcc

SEQ ID NO: 143432 - DNA, 35 bp, Artificial Sequence
  Synthetic oligonucleotide
tttcaacccactacccgtcctgtcccattgctgcc

SEQ ID NO: 143433 - DNA, 35 bp, Artificial Sequence
  Synthetic oligonucleotide
tcgacgacacctgcgcgccttagatccctctcagc

SEQ ID NO: 143434 - DNA, 35 bp, Artificial Sequence
  Synthetic oligonucleotide
tcaccgtacttcatctggatcctgacccctgtcgc

SEQ ID NO: 143435 - DNA, 35 bp, Artificial Sequence
  Synthetic oligonucleotide
acgagcccccacgctcggacctaaccactcttcgc

SEQ ID NO: 143436 - DNA, 35 bp, Artificial Sequence
  Synthetic oligonucleotide
attcagacatcagcgcggacaccccgcccatcctc

SEQ ID NO: 143437 - DNA, 35 bp, Artificial Sequence
  Synthetic oligonucleotide
tggttgccacacccttgccaccgccataactgctc

SEQ ID NO: 143438 - DNA, 35 bp, Artificial Sequence
  Synthetic oligonucleotide
agcccctccccgccccggtcttcacgaacaacttc

SEQ ID NO: 143439 - DNA, 35 bp, Artificial Sequence
  Synthetic oligonucleotide
gcaacacacccctcgcacttgtgctctccttcctg

SEQ ID NO: 143440 - DNA, 35 bp, Artificial Sequence
  Synthetic oligonucleotide
gtgggtcggtaacaggggaggaaggtcaggaggtg

SEQ ID NO: 143441 - DNA, 35 bp, Artificial Sequence
  Synthetic oligonucleotide
ttgtaactgccctgctcccctacgtcccaccggtg

SEQ ID NO: 143442 - DNA, 35 bp, Artificial Sequence
  Synthetic oligonucleotide
ttgcccccgtgtgcttgttttcgcgctcccataat

SEQ ID NO: 143443 - DNA, 35 bp, Artificial Sequence
  Synthetic oligonucleotide
tcacgctacccagtcacacgatagacccgccccat

SEQ ID NO: 143444 - DNA, 35 bp, Artificial Sequence
  Synthetic oligonucleotide
atatccaccgccctgttgtccacagcccactaact

SEQ ID NO: 143445 - DNA, 35 bp, Artificial Sequence
  Synthetic oligonucleotide
tctagcaccgcaaaacgtttacgcccccgctcact

SEQ ID NO: 143446 - DNA, 34 bp, Artificial Sequence
  Synthetic oligonucleotide
tatccacgcactaccgccacctgcccattatact

SEQ ID NO: 143447 - DNA, 35 bp, Artificial Sequence
  Synthetic oligonucleotide
tgccacccgcccttttgtttcatcgccgtatagct

SEQ ID NO: 143448 - DNA, 34 bp, Artificial Sequence
  Synthetic oligonucleotide
tacataacccaccgctccagccgtagcaatctct

SEQ ID NO: 143449 - DNA, 35 bp, Artificial Sequence
  Synthetic oligonucleotide
gtcccagctgccgttatctccttggcctctgttct

SEQ ID NO: 143450 - DNA, 35 bp, Artificial Sequence
  Synthetic oligonucleotide
ttctgccccgagacccccccgcttcccattgttgt

SEQ ID NO: 143451 - DNA, 35 bp, Artificial Sequence
  Synthetic oligonucleotide
gatacccctgccaccgcgagtgcaccacgtgactt

SEQ ID NO: 143452 - DNA, 35 bp, Artificial Sequence
  Synthetic oligonucleotide
ggacgacaattgctccgttatcccttcactgcctt

SEQ ID NO: 143453 - DNA, 35 bp, Artificial Sequence
  Synthetic oligonucleotide
tccccgtacacacaccacgcacaaaccttctggtt

SEQ ID NO: 143454 - DNA, 37 bp, Artificial Sequence
  Synthetic oligonucleotide
gccgatctcccgctcctcccacagccttgcgttgcga

SEQ ID NO: 143455 - DNA, 36 bp, Artificial Sequence
  Synthetic oligonucleotide
gctcccgccacaccgattagccttgcctgacctgga

SEQ ID NO: 143456 - DNA, 38 bp, Artificial Sequence
  Synthetic oligonucleotide
gccactaccgcctgcccctactgctgagcttgctctga

SEQ ID NO: 143457 - DNA, 38 bp, Artificial Sequence
  Synthetic oligonucleotide
gtgcccctgattcgtacccacatcctatattctcgtga

SEQ ID NO: 143458 - DNA, 37 bp, Artificial Sequence
  Synthetic oligonucleotide
accaggcccgccccgcctcgcttatgagcgcctttga

SEQ ID NO: 143459 - DNA, 36 bp, Artificial Sequence
  Synthetic oligonucleotide
tagcacctcccaatgccctctgccactacggtaata

SEQ ID NO: 143460 - DNA, 36 bp, Artificial Sequence
  Synthetic oligonucleotide
tgtccccaccgatcctctcatgtactctcaagcata

SEQ ID NO: 143461 - DNA, 36 bp, Artificial Sequence
  Synthetic oligonucleotide
gatgaagggccgggatgagcagctggggagggtata

SEQ ID NO: 143462 - DNA, 35 bp, Artificial Sequence
  Synthetic oligonucleotide
tctagccgaccccgcccgactgcccttggattata

SEQ ID NO: 143463 - DNA, 35 bp, Artificial Sequence
  Synthetic oligonucleotide
accaacccatctgagctatgagttaccctccacta

SEQ ID NO: 143464 - DNA, 36 bp, Artificial Sequence
  Synthetic oligonucleotide
tgagtgcatgccatctggtctggacctcccacccta

SEQ ID NO: 143465 - DNA, 36 bp, Artificial Sequence
  Synthetic oligonucleotide
tctgtccctccaattgcctgcgcggtcctaccagta

SEQ ID NO: 143466 - DNA, 36 bp, Artificial Sequence
  Synthetic oligonucleotide
agcacaccagttgactctttccaccctgcccgttta

SEQ ID NO: 143467 - DNA, 35 bp, Artificial Sequence
  Synthetic oligonucleotide
tgcctcatccttgtcccgtgttacctagcgtacac

SEQ ID NO: 143468 - DNA, 35 bp, Artificial Sequence
  Synthetic oligonucleotide
gaaacactggccggcaccaccctcccgtgcaccac

SEQ ID NO: 143469 - DNA, 35 bp, Artificial Sequence
  Synthetic oligonucleotide
tcatccgtcatattcttgtcttcctcggctgccac

SEQ ID NO: 143470 - DNA, 35 bp, Artificial Sequence
  Synthetic oligonucleotide
acaccacccgatctctcccagtctttgggtttcac

SEQ ID NO: 143471 - DNA, 35 bp, Artificial Sequence
  Synthetic oligonucleotide
actgacgcaccatcccatatctcgctttgctcgac

SEQ ID NO: 143472 - DNA, 36 bp, Artificial Sequence
  Synthetic oligonucleotide
gcccggtcctacatcgctattcccagcaccccgacc

SEQ ID NO: 143473 - DNA, 35 bp, Artificial Sequence
  Synthetic oligonucleotide
gccgcaggtctggtgtctcctttacctcattgccc

SEQ ID NO: 143474 - DNA, 35 bp, Artificial Sequence
  Synthetic oligonucleotide
gcatacgcacctcatactgccgcaactttccttcc

SEQ ID NO: 143475 - DNA, 35 bp, Artificial Sequence
  Synthetic oligonucleotide
gataatgtaggggggagtggcgagcgggacagggc

SEQ ID NO: 143476 - DNA, 35 bp, Artificial Sequence
  Synthetic oligonucleotide
tatcagagctgctgtccaccccccctcgctactgc

SEQ ID NO: 143477 - DNA, 35 bp, Artificial Sequence
  Synthetic oligonucleotide
tgtcgttaccgcagagaaaccgcccccctttgctc

SEQ ID NO: 143478 - DNA, 35 bp, Artificial Sequence
  Synthetic oligonucleotide
attcccgtaccaccatcgctggcagacctccccag

SEQ ID NO: 143479 - DNA, 35 bp, Artificial Sequence
  Synthetic oligonucleotide
gacgtgagctgggctgagggtgggttgggtgctag

SEQ ID NO: 143480 - DNA, 35 bp, Artificial Sequence
  Synthetic oligonucleotide
ggtggggtggggaaaagcaaggggccgggttggcg

SEQ ID NO: 143481 - DNA, 35 bp, Artificial Sequence
  Synthetic oligonucleotide
tcctgtgccgttcaggtcctaacgtccctctcctg

SEQ ID NO: 143482 - DNA, 35 bp, Artificial Sequence
  Synthetic oligonucleotide
gagctgcaccctcacttccgccttaggtccaccat

SEQ ID NO: 143483 - DNA, 35 bp, Artificial Sequence
  Synthetic oligonucleotide
atccgcgagctcccacttgttcatcataggcccct

SEQ ID NO: 143484 - DNA, 35 bp, Artificial Sequence
  Synthetic oligonucleotide
tccgccactcatacatcattttgacatccccttct

SEQ ID NO: 143485 - DNA, 36 bp, Artificial Sequence
  Synthetic oligonucleotide
ttgcgacccctcctgcttttaatcgttcactcacca

SEQ ID NO: 143486 - DNA, 35 bp, Artificial Sequence
  Synthetic oligonucleotide
atccgatcgccgccaccccgtaacgcacagggcca

SEQ ID NO: 143487 - DNA, 36 bp, Artificial Sequence
  Synthetic oligonucleotide
aacgcagtgagctccgcactccgccccccttgtcca

SEQ ID NO: 143488 - DNA, 36 bp, Artificial Sequence
  Synthetic oligonucleotide
ggacggagggctcggtaaatcggggaacggagggca

SEQ ID NO: 143489 - DNA, 35 bp, Artificial Sequence
  Synthetic oligonucleotide
acgcgtcaacgctatttgtaccaccacctgctgca

SEQ ID NO: 143490 - DNA, 36 bp, Artificial Sequence
  Synthetic oligonucleotide
tccctaccaccccgcgaatctctgcctgcagttgca

SEQ ID NO: 143491 - DNA, 37 bp, Artificial Sequence
  Synthetic oligonucleotide
tttggggggggtgggaggacgaaaggatgggaggaga

SEQ ID NO: 143492 - DNA, 36 bp, Artificial Sequence
  Synthetic oligonucleotide
agcaccaccacatgacaacccctgctacttcgacga

SEQ ID NO: 143493 - DNA, 37 bp, Artificial Sequence
  Synthetic oligonucleotide
gttgacggggagggagggaggatcttcggaagacgga

SEQ ID NO: 143494 - DNA, 36 bp, Artificial Sequence
  Synthetic oligonucleotide
tcgctcccgtctctagccgcactccatcaccccgga

SEQ ID NO: 143495 - DNA, 37 bp, Artificial Sequence
  Synthetic oligonucleotide
tgccccccccgtccaattctcacatccccatctcgga

SEQ ID NO: 143496 - DNA, 37 bp, Artificial Sequence
  Synthetic oligonucleotide
acgaatcgggtaagcagggagggagggtttacaggga

SEQ ID NO: 143497 - DNA, 36 bp, Artificial Sequence
  Synthetic oligonucleotide
gatggaggtggtgggggcaggcaggccggcaaatga

SEQ ID NO: 143498 - DNA, 36 bp, Artificial Sequence
  Synthetic oligonucleotide
actaccgccccctctctgccatgaccctggacctga

SEQ ID NO: 143499 - DNA, 38 bp, Artificial Sequence
  Synthetic oligonucleotide
gcacgggggggtggtgtgggacatcagcatgtctgtga

SEQ ID NO: 143500 - DNA, 38 bp, Artificial Sequence
  Synthetic oligonucleotide
acgagggacgggggggtagccaaaggacgtatgtgtga

SEQ ID NO: 143501 - DNA, 35 bp, Artificial Sequence
  Synthetic oligonucleotide
tcagtgtacgtccgtcttttcccctttatgcccta

SEQ ID NO: 143502 - DNA, 35 bp, Artificial Sequence
  Synthetic oligonucleotide
acgcgaccatcccttgttttacctcgtcagagccc

SEQ ID NO: 143503 - DNA, 35 bp, Artificial Sequence
  Synthetic oligonucleotide
atttgtgtgccacctgttccattgccgtagttgcc

SEQ ID NO: 143504 - DNA, 35 bp, Artificial Sequence
  Synthetic oligonucleotide
tcacatcagccctccacgtttctacactcaccagc

SEQ ID NO: 143505 - DNA, 35 bp, Artificial Sequence
  Synthetic oligonucleotide
gactacctcccatgtttcaccttggtagcacactc

SEQ ID NO: 143506 - DNA, 35 bp, Artificial Sequence
  Synthetic oligonucleotide
atcgccacctcccctctcggtctggggtcaacctc

SEQ ID NO: 143507 - DNA, 35 bp, Artificial Sequence
  Synthetic oligonucleotide
tatgccaccccccatgccccggggacaatgacctc

SEQ ID NO: 143508 - DNA, 36 bp, Artificial Sequence
  Synthetic oligonucleotide
gatacatcgcgtggcctttttccgatacatacgttc

SEQ ID NO: 143509 - DNA, 35 bp, Artificial Sequence
  Synthetic oligonucleotide
aacatacggtaggagggggtggggcacaatattag

SEQ ID NO: 143510 - DNA, 35 bp, Artificial Sequence
  Synthetic oligonucleotide
aatggcgacaactgtcgatctgttcttcccccccg

SEQ ID NO: 143511 - DNA, 35 bp, Artificial Sequence
  Synthetic oligonucleotide
ttacgccaccaatttttgactagttagtcgccccg

SEQ ID NO: 143512 - DNA, 35 bp, Artificial Sequence
  Synthetic oligonucleotide
agtccttgcagcccaccatgaccctgttcacgccg

SEQ ID NO: 143513 - DNA, 35 bp, Artificial Sequence
  Synthetic oligonucleotide
gtcggtgcatcccgtatcctttccccgttgtcgcg

SEQ ID NO: 143514 - DNA, 35 bp, Artificial Sequence
  Synthetic oligonucleotide
aaccgccccgattttcgcagtactcctcttgctcg

SEQ ID NO: 143515 - DNA, 35 bp, Artificial Sequence
  Synthetic oligonucleotide
ttgtacgcctcaacttttgctttctccagccgact

SEQ ID NO: 143516 - DNA, 35 bp, Artificial Sequence
  Synthetic oligonucleotide
ttgtaagcgcagcccccactatacgcaacccccct

SEQ ID NO: 143517 - DNA, 35 bp, Artificial Sequence
  Synthetic oligonucleotide
gatcctatcgcccttgaaccttgcttgccccgcct

SEQ ID NO: 143518 - DNA, 35 bp, Artificial Sequence
  Synthetic oligonucleotide
ggaccatctcgcaatagtcttttggtcatcctcct

SEQ ID NO: 143519 - DNA, 35 bp, Artificial Sequence
  Synthetic oligonucleotide
tactgccgctagcccccggacgccctttatttgct

SEQ ID NO: 143520 - DNA, 35 bp, Artificial Sequence
  Synthetic oligonucleotide
taaccaccccactttagttagttcacaacctgtct

SEQ ID NO: 143521 - DNA, 35 bp, Artificial Sequence
  Synthetic oligonucleotide
cctgtcatagcttacctgactctacttggaaatgt

SEQ ID NO: 143522 - DNA, 36 bp, Artificial Sequence
  Synthetic oligonucleotide
tacacccctgcttgatctcccgttgggctagcccaa

SEQ ID NO: 143523 - DNA, 36 bp, Artificial Sequence
  Synthetic oligonucleotide
tcaccagttggatgggtgggtgaggagggtaagcaa

SEQ ID NO: 143524 - DNA, 36 bp, Artificial Sequence
  Synthetic oligonucleotide
tgccgcctcatatactgccggctaactgttcaccca

SEQ ID NO: 143525 - DNA, 35 bp, Artificial Sequence
  Synthetic oligonucleotide
taccagtgtcgctgtaaccattcgccgtcacccca

SEQ ID NO: 143526 - DNA, 33 bp, Artificial Sequence
  Synthetic oligonucleotide
attccagcatgccccgctatttccatcattcca

SEQ ID NO: 143527 - DNA, 35 bp, Artificial Sequence
  Synthetic oligonucleotide
tgcccacctcagcccctcgttgagtctcaacttca

SEQ ID NO: 143528 - DNA, 37 bp, Artificial Sequence
  Synthetic oligonucleotide
gtctaaggggggaggggaaagaaatgcacagtggaga

SEQ ID NO: 143529 - DNA, 36 bp, Artificial Sequence
  Synthetic oligonucleotide
tccacccgtacgcccttccctgcctgagctgaacga

SEQ ID NO: 143530 - DNA, 37 bp, Artificial Sequence
  Synthetic oligonucleotide
ggtgcccgcctctatagctctgtccgccactcgacga

SEQ ID NO: 143531 - DNA, 37 bp, Artificial Sequence
  Synthetic oligonucleotide
gcacgcctgtgatcgctacctcccttcctataccgga

SEQ ID NO: 143532 - DNA, 35 bp, Artificial Sequence
  Synthetic oligonucleotide
actccaccccccatgtttgtctaatttccagtgga

SEQ ID NO: 143533 - DNA, 35 bp, Artificial Sequence
  Synthetic oligonucleotide
gtgggtgggaaaaggcgggggggatcgtaggtgga

SEQ ID NO: 143534 - DNA, 37 bp, Artificial Sequence
  Synthetic oligonucleotide
gtgggtgggcgggggatatacttggggcacttaatga

SEQ ID NO: 143535 - DNA, 36 bp, Artificial Sequence
  Synthetic oligonucleotide
gcccattgcgcctgttcgatccacccaaccatctga

SEQ ID NO: 143536 - DNA, 38 bp, Artificial Sequence
  Synthetic oligonucleotide
tgaccccattgccccgtcccccgctgacaagcccgtga

SEQ ID NO: 143537 - DNA, 38 bp, Artificial Sequence
  Synthetic oligonucleotide
attgggagggaggggggggaagtgtactcgcagcttga

SEQ ID NO: 143538 - DNA, 38 bp, Artificial Sequence
  Synthetic oligonucleotide
gaaacgagttgggggcaagggtggggaacgggcgttga

SEQ ID NO: 143539 - DNA, 37 bp, Artificial Sequence
  Synthetic oligonucleotide
atggggggaaaatggtgggaagcctgggaggggttga

SEQ ID NO: 143540 - DNA, 38 bp, Artificial Sequence
  Synthetic oligonucleotide
tcatcggtgtcacgcatctactatcgcccctgttttga

SEQ ID NO: 143541 - DNA, 36 bp, Artificial Sequence
  Synthetic oligonucleotide
tgtatacgtccctctctcatcccgttgtcgtgccta

SEQ ID NO: 143542 - DNA, 35 bp, Artificial Sequence
  Synthetic oligonucleotide
gactgcccgcctcggacccataccgactatgcaac

SEQ ID NO: 143543 - DNA, 35 bp, Artificial Sequence
  Synthetic oligonucleotide
ttagcccctccgctcccgtgacttacggctcacac

SEQ ID NO: 143544 - DNA, 35 bp, Artificial Sequence
  Synthetic oligonucleotide
actctcgcatcattccgtgccccctcgccaaggac

SEQ ID NO: 143545 - DNA, 36 bp, Artificial Sequence
  Synthetic oligonucleotide
gcgagcaacacctccacatggctctcgacgctgacc

SEQ ID NO: 143546 - DNA, 35 bp, Artificial Sequence
  Synthetic oligonucleotide
aaacagcagcaacccgcttcccgatatggctaccc

SEQ ID NO: 143547 - DNA, 35 bp, Artificial Sequence
  Synthetic oligonucleotide
ttgtgcctgttgtgcacaacagcccaatcctcccc

SEQ ID NO: 143548 - DNA, 35 bp, Artificial Sequence
  Synthetic oligonucleotide
gtctagtgcgcctcatctatgcagtcttttcctcc

SEQ ID NO: 143549 - DNA, 35 bp, Artificial Sequence
  Synthetic oligonucleotide
aacggagcgctggccgttccatagttcgttattcc

SEQ ID NO: 143550 - DNA, 35 bp, Artificial Sequence
  Synthetic oligonucleotide
gagtgggacgatacgggcgggacggggattgacgc

SEQ ID NO: 143551 - DNA, 35 bp, Artificial Sequence
  Synthetic oligonucleotide
gatcaccttcacctttaaatgatgcaccacgttgc

SEQ ID NO: 143552 - DNA, 35 bp, Artificial Sequence
  Synthetic oligonucleotide
tctcgtcagggtccaactgttccctcccccatatc

SEQ ID NO: 143553 - DNA, 35 bp, Artificial Sequence
  Synthetic oligonucleotide
tcctaccacgctttgatctccctgccacgaccctc

SEQ ID NO: 143554 - DNA, 35 bp, Artificial Sequence
  Synthetic oligonucleotide
gccacaatcggaacccgtaagccgacccgccgctc

SEQ ID NO: 143555 - DNA, 35 bp, Artificial Sequence
  Synthetic oligonucleotide
gatccgccacttatatcatcgcaaagctttgcttc

SEQ ID NO: 143556 - DNA, 35 bp, Artificial Sequence
  Synthetic oligonucleotide
gtgggggaagggggatcaagtagttgcaggaaccg

SEQ ID NO: 143557 - DNA, 35 bp, Artificial Sequence
  Synthetic oligonucleotide
ttcgccccatagaatgtacgcatgtattacccccg

SEQ ID NO: 143558 - DNA, 35 bp, Artificial Sequence
  Synthetic oligonucleotide
gctacagacctcttgcttatagcactccccttccg

SEQ ID NO: 143559 - DNA, 35 bp, Artificial Sequence
  Synthetic oligonucleotide
gtgaacgccgttgaacactcacctcccagctcgcg

SEQ ID NO: 143560 - DNA, 35 bp, Artificial Sequence
  Synthetic oligonucleotide
atggggggatcaatgcggaggggccgggagcatcg

SEQ ID NO: 143561 - DNA, 35 bp, Artificial Sequence
  Synthetic oligonucleotide
ttggtgggagggccgggcgtggttgagtgtactcg

SEQ ID NO: 143562 - DNA, 35 bp, Artificial Sequence
  Synthetic oligonucleotide
ttggagagtgggtgggagggttctgtcaccactgg

SEQ ID NO: 143563 - DNA, 35 bp, Artificial Sequence
  Synthetic oligonucleotide
gatacgcgtactatgcaccggggtctattcacatg

SEQ ID NO: 143564 - DNA, 35 bp, Artificial Sequence
  Synthetic oligonucleotide
acacatacccaccgatgactcctccaggcaacctg

SEQ ID NO: 143565 - DNA, 35 bp, Artificial Sequence
  Synthetic oligonucleotide
ttgcacccctgctggcttacccgagacatctctct

SEQ ID NO: 143566 - DNA, 35 bp, Artificial Sequence
  Synthetic oligonucleotide
tccatcacgcgctccagaacatcctcctccttcgt

SEQ ID NO: 143567 - DNA, 34 bp, Artificial Sequence
  Synthetic oligonucleotide
gtccatcctccacacctcctgtagtgaatcaatt

SEQ ID NO: 143568 - DNA, 35 bp, Artificial Sequence
  Synthetic oligonucleotide
gaagggggggggacagggagtgacggaaaacgctt

SEQ ID NO: 143569 - DNA, 35 bp, Artificial Sequence
  Synthetic oligonucleotide
gcacgacgccccattccctatgcactgtccccgtt

SEQ ID NO: 143570 - DNA, 35 bp, Artificial Sequence
  Synthetic oligonucleotide
tcatctcgccgctgtttgccttcttatactatttt

SEQ ID NO: 143571 - DNA, 35 bp, Artificial Sequence
  Synthetic oligonucleotide
ttattccgagggtgggcgggttcaaatgggtaaca

SEQ ID NO: 143572 - DNA, 36 bp, Artificial Sequence
  Synthetic oligonucleotide
tacagcactgcccgataccgcctccttctacgccca

SEQ ID NO: 143573 - DNA, 36 bp, Artificial Sequence
  Synthetic oligonucleotide
tccgccacgcttatgcctgctgcctacatcactcca

SEQ ID NO: 143574 - DNA, 36 bp, Artificial Sequence
  Synthetic oligonucleotide
taggggggaggcttaacaacggaggaatcggaggca

SEQ ID NO: 143575 - DNA, 37 bp, Artificial Sequence
  Synthetic oligonucleotide
aaaggggggggagggtgatgagcagagaccagcgaga

SEQ ID NO: 143576 - DNA, 37 bp, Artificial Sequence
  Synthetic oligonucleotide
tgacaccttcctcattacacggccgccttgtccacga

SEQ ID NO: 143577 - DNA, 37 bp, Artificial Sequence
  Synthetic oligonucleotide
tgaaagcgccaacatgaatacctcctgcttcacccga

SEQ ID NO: 143578 - DNA, 37 bp, Artificial Sequence
  Synthetic oligonucleotide
gactggtaacggggggtggaataacggcacagcgcga

SEQ ID NO: 143579 - DNA, 36 bp, Artificial Sequence
  Synthetic oligonucleotide
gcaacagaccctgccctcatacctagcccttctgga

SEQ ID NO: 143580 - DNA, 38 bp, Artificial Sequence
  Synthetic oligonucleotide
tcacgcgggtccaccactcacccagcccgttcccctga

SEQ ID NO: 143581 - DNA, 38 bp, Artificial Sequence
  Synthetic oligonucleotide
atgacattcgccggtgcatcgcctatccatcctcctga

SEQ ID NO: 143582 - DNA, 36 bp, Artificial Sequence
  Synthetic oligonucleotide
aatccgctagcgcctcctccctcattgttgctctga

SEQ ID NO: 143583 - DNA, 38 bp, Artificial Sequence
  Synthetic oligonucleotide
gacacgcccctcacgtcgtacaatccaacccccagtga

SEQ ID NO: 143584 - DNA, 38 bp, Artificial Sequence
  Synthetic oligonucleotide
gccaccttgagccgtggccgtgcattcataccccttga

SEQ ID NO: 143585 - DNA, 38 bp, Artificial Sequence
  Synthetic oligonucleotide
acgttacctccgcccgcaatctaccctatgctgtttga

SEQ ID NO: 143586 - DNA, 35 bp, Artificial Sequence
  Synthetic oligonucleotide
gcattaccctgtattgttctatattggccaccccc

SEQ ID NO: 143587 - DNA, 35 bp, Artificial Sequence
  Synthetic oligonucleotide
atgaccccagtgccgctttcgcttttggactcccc

SEQ ID NO: 143588 - DNA, 35 bp, Artificial Sequence
  Synthetic oligonucleotide
gaaccgccctccattataacgtacggctctgtccc

SEQ ID NO: 143589 - DNA, 35 bp, Artificial Sequence
  Synthetic oligonucleotide
gagcggccctgctatctgcgtacattgttacttcc

SEQ ID NO: 143590 - DNA, 35 bp, Artificial Sequence
  Synthetic oligonucleotide
tcgtgcttccgtacaattacggttcattcccttcc

SEQ ID NO: 143591 - DNA, 35 bp, Artificial Sequence
  Synthetic oligonucleotide
gatctacccaccgagctgtctaaagtaattcttcc

SEQ ID NO: 143592 - DNA, 35 bp, Artificial Sequence
  Synthetic oligonucleotide
tctcaaccgtttcgcaccgaccctccgccgtttcc

SEQ ID NO: 143593 - DNA, 35 bp, Artificial Sequence
  Synthetic oligonucleotide
tgccccacggacaccgccgcatggactaccctcgc

SEQ ID NO: 143594 - DNA, 35 bp, Artificial Sequence
  Synthetic oligonucleotide
tcccacctgaaaccaccctccatgcctgctaatgc

SEQ ID NO: 143595 - DNA, 35 bp, Artificial Sequence
  Synthetic oligonucleotide
gactagcgtcccggtccttctacgctgccctcctc

SEQ ID NO: 143596 - DNA, 35 bp, Artificial Sequence
  Synthetic oligonucleotide
gaacagctcttctggtgcccccacgcccatccgtc

SEQ ID NO: 143597 - DNA, 35 bp, Artificial Sequence
  Synthetic oligonucleotide
tccagccccatgacctccctacactgagcaagccg

SEQ ID NO: 143598 - DNA, 35 bp, Artificial Sequence
  Synthetic oligonucleotide
tcaatggcgcgctcgtatctctcatcttctctccg

SEQ ID NO: 143599 - DNA, 35 bp, Artificial Sequence
  Synthetic oligonucleotide
tcacttgccctctccatatactcgcgattcagtcg

SEQ ID NO: 143600 - DNA, 35 bp, Artificial Sequence
  Synthetic oligonucleotide
tcgatcgacccgcacgtatggccctccaccccttg

SEQ ID NO: 143601 - DNA, 35 bp, Artificial Sequence
  Synthetic oligonucleotide
ggtacagcgatcaagcctgcttctcctccacccat

SEQ ID NO: 143602 - DNA, 35 bp, Artificial Sequence
  Synthetic oligonucleotide
gttctcccgccgcttccttggttctccctctcgat

SEQ ID NO: 143603 - DNA, 35 bp, Artificial Sequence
  Synthetic oligonucleotide
gaagcgtcgtagcgtcatacccgccctccgcctat

SEQ ID NO: 143604 - DNA, 35 bp, Artificial Sequence
  Synthetic oligonucleotide
acacagctagcgtccacgagtcccgtttcccacct

SEQ ID NO: 143605 - DNA, 35 bp, Artificial Sequence
  Synthetic oligonucleotide
agttacctgttgtcgcccaccgtaggtccttgcct

SEQ ID NO: 143606 - DNA, 35 bp, Artificial Sequence
  Synthetic oligonucleotide
gcaccgacgcccacctcgtttcttcatccccgggt

SEQ ID NO: 143607 - DNA, 35 bp, Artificial Sequence
  Synthetic oligonucleotide
gcccggcgattgctaaaagccccgttcccaccctt

SEQ ID NO: 143608 - DNA, 35 bp, Artificial Sequence
  Synthetic oligonucleotide
acgccacgatggcccgctcctcgactgtcctgctt

SEQ ID NO: 143609 - DNA, 35 bp, Artificial Sequence
  Synthetic oligonucleotide
accgccacaacgcaaatggccgtttctccccacaa

SEQ ID NO: 143610 - DNA, 35 bp, Artificial Sequence
  Synthetic oligonucleotide
acccccgacctctctcatactttgcctgtccgcca

SEQ ID NO: 143611 - DNA, 36 bp, Artificial Sequence
  Synthetic oligonucleotide
ggttcaccggcaagtgtccgtttcgccctcattcca

SEQ ID NO: 143612 - DNA, 35 bp, Artificial Sequence
  Synthetic oligonucleotide
ggtgctaccgctttttgtttcttccgtgcctttca

SEQ ID NO: 143613 - DNA, 35 bp, Artificial Sequence
  Synthetic oligonucleotide
ggacggaatagggggggaggggaagctgatgccga

SEQ ID NO: 143614 - DNA, 38 bp, Artificial Sequence
  Synthetic oligonucleotide
tatggaagcggtctacctgctgctgctccttcccctga

SEQ ID NO: 143615 - DNA, 38 bp, Artificial Sequence
  Synthetic oligonucleotide
atccgctgcagacgagccctccccccatcacccgctga

SEQ ID NO: 143616 - DNA, 38 bp, Artificial Sequence
  Synthetic oligonucleotide
acttaccccgactttgcctcccttggacggtctgttga

SEQ ID NO: 143617 - DNA, 36 bp, Artificial Sequence
  Synthetic oligonucleotide
agacgcgtactgctcccttcgcctccgtagccccta

SEQ ID NO: 143618 - DNA, 36 bp, Artificial Sequence
  Synthetic oligonucleotide
tatgtcacccggctcgttctacagaccactcttcta

SEQ ID NO: 143619 - DNA, 36 bp, Artificial Sequence
  Synthetic oligonucleotide
accaccctacgtgatttccatcccaccatcctggta

SEQ ID NO: 143620 - DNA, 35 bp, Artificial Sequence
  Synthetic oligonucleotide
gtacatttccatgctattagccgccgcccttcaac

SEQ ID NO: 143621 - DNA, 35 bp, Artificial Sequence
  Synthetic oligonucleotide
acccgagccggcccgcagccttaatcaccgctcac

SEQ ID NO: 143622 - DNA, 35 bp, Artificial Sequence
  Synthetic oligonucleotide
gtacagctcgccgcctttaatctccatgcccgtac

SEQ ID NO: 143623 - DNA, 35 bp, Artificial Sequence
  Synthetic oligonucleotide
acgagtcacgcgtactgtctccgtaatgcccttac

SEQ ID NO: 143624 - DNA, 35 bp, Artificial Sequence
  Synthetic oligonucleotide
gccttcgcgcgtagtgtattagtttcttctcctcc

SEQ ID NO: 143625 - DNA, 35 bp, Artificial Sequence
  Synthetic oligonucleotide
ttgcccaaccattcattcgcctcattagccaccgc

SEQ ID NO: 143626 - DNA, 35 bp, Artificial Sequence
  Synthetic oligonucleotide
ttacgctccccctccgacgcatatccattatttgc

SEQ ID NO: 143627 - DNA, 35 bp, Artificial Sequence
  Synthetic oligonucleotide
gaaccttacccgctgattatttgcgccgaactctc

SEQ ID NO: 143628 - DNA, 35 bp, Artificial Sequence
  Synthetic oligonucleotide
tacgtacgccctcccaggtatgctgtcattttttc

SEQ ID NO: 143629 - DNA, 35 bp, Artificial Sequence
  Synthetic oligonucleotide
tgtccctgtcccactataggatgcatcccccctcg

SEQ ID NO: 143630 - DNA, 34 bp, Artificial Sequence
  Synthetic oligonucleotide
ggagcagtagtgaggggtcatggaggggagaagg

SEQ ID NO: 143631 - DNA, 35 bp, Artificial Sequence
  Synthetic oligonucleotide
tcacatcctcatgcgcatatccctaagtccctctg

SEQ ID NO: 143632 - DNA, 35 bp, Artificial Sequence
  Synthetic oligonucleotide
gattcgccttcttgtaacacgttcttctgtaccat

SEQ ID NO: 143633 - DNA, 35 bp, Artificial Sequence
  Synthetic oligonucleotide
tgagatggggagggaggaaaatgcatgagatagat

SEQ ID NO: 143634 - DNA, 35 bp, Artificial Sequence
  Synthetic oligonucleotide
actaccctccgtcgttcttgggatttccgccccct

SEQ ID NO: 143635 - DNA, 35 bp, Artificial Sequence
  Synthetic oligonucleotide
gaactagccgtacatgcctttccgcccgaacatct

SEQ ID NO: 143636 - DNA, 35 bp, Artificial Sequence
  Synthetic oligonucleotide
gactgcctcaagcatcgggcgtacccactccatct

SEQ ID NO: 143637 - DNA, 35 bp, Artificial Sequence
  Synthetic oligonucleotide
acccccgccccttctgcgtgaagttagccctctct

SEQ ID NO: 143638 - DNA, 35 bp, Artificial Sequence
  Synthetic oligonucleotide
tatcccccgctgttccttctcggcttttctgcctt

SEQ ID NO: 143639 - DNA, 35 bp, Artificial Sequence
  Synthetic oligonucleotide
tagcctcagcagcattttttccggcaccttttgtt

SEQ ID NO: 143640 - DNA, 36 bp, Artificial Sequence
  Synthetic oligonucleotide
agtgagaggaggtgaggggtgcagggcatcggataa

SEQ ID NO: 143641 - DNA, 35 bp, Artificial Sequence
  Synthetic oligonucleotide
tacgcacagcagttggattctaacccgccccacca

SEQ ID NO: 143642 - DNA, 35 bp, Artificial Sequence
  Synthetic oligonucleotide
accgacccgcattcttcctatcgatccctcccgca

SEQ ID NO: 143643 - DNA, 35 bp, Artificial Sequence
  Synthetic oligonucleotide
acatgcccgtgtccactagtactgctccgtcctca

SEQ ID NO: 143644 - DNA, 36 bp, Artificial Sequence
  Synthetic oligonucleotide
atccctctcacgccgttgcataatgccgaatcttca

SEQ ID NO: 143645 - DNA, 37 bp, Artificial Sequence
  Synthetic oligonucleotide
gcacccgttctagttctttcggcctactcgctcccga

SEQ ID NO: 143646 - DNA, 37 bp, Artificial Sequence
  Synthetic oligonucleotide
tcctacccgtcctgcaattctgcatgttcatatgcga

SEQ ID NO: 143647 - DNA, 37 bp, Artificial Sequence
  Synthetic oligonucleotide
acaccttgccctcgtacactcccttcgccctagagga

SEQ ID NO: 143648 - DNA, 35 bp, Artificial Sequence
  Synthetic oligonucleotide
tccaacccagttttcatcgcccgagtcccttcgga

SEQ ID NO: 143649 - DNA, 38 bp, Artificial Sequence
  Synthetic oligonucleotide
gtgaggaggggagggcttaaggaccgaggggcacatga

SEQ ID NO: 143650 - DNA, 36 bp, Artificial Sequence
  Synthetic oligonucleotide
tagctcaccccgaatgcccgcccatccttcccttga

SEQ ID NO: 143651 - DNA, 36 bp, Artificial Sequence
  Synthetic oligonucleotide
aatccacctctagatctgcaacaacatcattcccta

SEQ ID NO: 143652 - DNA, 35 bp, Artificial Sequence
  Synthetic oligonucleotide
atcccgccccgacgccccctgtctcgcttcacgta

SEQ ID NO: 143653 - DNA, 36 bp, Artificial Sequence
  Synthetic oligonucleotide
tgaccccgctccccttgggctatcccagatccgtta

SEQ ID NO: 143654 - DNA, 35 bp, Artificial Sequence
  Synthetic oligonucleotide
gactcgtccctgtttggcctccccgtttgcacaac

SEQ ID NO: 143655 - DNA, 35 bp, Artificial Sequence
  Synthetic oligonucleotide
tcaccatcgggaaggtcatacacactgccattcac

SEQ ID NO: 143656 - DNA, 35 bp, Artificial Sequence
  Synthetic oligonucleotide
gttcgccttagccctcgatacgactatctgttacc

SEQ ID NO: 143657 - DNA, 35 bp, Artificial Sequence
  Synthetic oligonucleotide
gtcccgcccctctttggacaagttttctagccccc

SEQ ID NO: 143658 - DNA, 35 bp, Artificial Sequence
  Synthetic oligonucleotide
gccgccgcattaggccctcgcaagtttacctcgcc

SEQ ID NO: 143659 - DNA, 35 bp, Artificial Sequence
  Synthetic oligonucleotide
gtcccatcctcctgatccagagcgctgccagctcc

SEQ ID NO: 143660 - DNA, 35 bp, Artificial Sequence
  Synthetic oligonucleotide
aagcaccccatgatacctcgttcctatatgtctcc

SEQ ID NO: 143661 - DNA, 35 bp, Artificial Sequence
  Synthetic oligonucleotide
gtggtcaacgtcattgagttactgcaccatcttcc

SEQ ID NO: 143662 - DNA, 35 bp, Artificial Sequence
  Synthetic oligonucleotide
gtgcctctcctcaccgctctcagcaggactctagc

SEQ ID NO: 143663 - DNA, 35 bp, Artificial Sequence
  Synthetic oligonucleotide
gttggggaggggaaattaatagatggggtgtgggc

SEQ ID NO: 143664 - DNA, 35 bp, Artificial Sequence
  Synthetic oligonucleotide
gtgactgcgacctttccccctctgtccgttctatc

SEQ ID NO: 143665 - DNA, 35 bp, Artificial Sequence
  Synthetic oligonucleotide
ttcagcacttagctgttccctcgcatcttggcctc

SEQ ID NO: 143666 - DNA, 35 bp, Artificial Sequence
  Synthetic oligonucleotide
gtctcgccccacactgctatacacgctgaactaag

SEQ ID NO: 143667 - DNA, 35 bp, Artificial Sequence
  Synthetic oligonucleotide
ttacgaggggggcgggaaaggaaggaacagtacag

SEQ ID NO: 143668 - DNA, 35 bp, Artificial Sequence
  Synthetic oligonucleotide
tccacttcctagccgttgctccgtttcccccgtag

SEQ ID NO: 143669 - DNA, 35 bp, Artificial Sequence
  Synthetic oligonucleotide
gacttccgctcccacttcgccgcagccattttacg

SEQ ID NO: 143670 - DNA, 35 bp, Artificial Sequence
  Synthetic oligonucleotide
tgcaccgccctcaccccattctcctcacccgctcg

SEQ ID NO: 143671 - DNA, 35 bp, Artificial Sequence
  Synthetic oligonucleotide
gcccaacgccattatctgtatccctctacctcctg

SEQ ID NO: 143672 - DNA, 35 bp, Artificial Sequence
  Synthetic oligonucleotide
gctccaccggtctagttgctcacaacgttccccct

SEQ ID NO: 143673 - DNA, 35 bp, Artificial Sequence
  Synthetic oligonucleotide
gtggggccgccttagctctggattaccttacgcct

SEQ ID NO: 143674 - DNA, 35 bp, Artificial Sequence
  Synthetic oligonucleotide
tcccgccggcggtctcgggtccctgttcctctagt

SEQ ID NO: 143675 - DNA, 35 bp, Artificial Sequence
  Synthetic oligonucleotide
agcaccatcgatgggtgggaatccgggtgggcctt

SEQ ID NO: 143676 - DNA, 35 bp, Artificial Sequence
  Synthetic oligonucleotide
tgcctcgacgccctccttgccttattagcgatgtt

SEQ ID NO: 143677 - DNA, 36 bp, Artificial Sequence
  Synthetic oligonucleotide
aggggaggaagggggtggtggcgagcgggtgcaaaa

SEQ ID NO: 143678 - DNA, 36 bp, Artificial Sequence
  Synthetic oligonucleotide
gaatgcgcatctgtcgccttaattacgcccctcgaa

SEQ ID NO: 143679 - DNA, 26 bp, Artificial Sequence
  Synthetic oligonucleotide
tatgttccccatccacctcgtgctaa

SEQ ID NO: 143680 - DNA, 36 bp, Artificial Sequence
  Synthetic oligonucleotide
gcatgcatgtcgtcgccgccctccccgttctgaaca

SEQ ID NO: 143681 - DNA, 35 bp, Artificial Sequence
  Synthetic oligonucleotide
tcgctctcctccgtgtgcaccacgatttgccacca

SEQ ID NO: 143682 - DNA, 35 bp, Artificial Sequence
  Synthetic oligonucleotide
ttcgcctctccggcttgaggtctggttccccccca

SEQ ID NO: 143683 - DNA, 36 bp, Artificial Sequence
  Synthetic oligonucleotide
atcccacccctatctcaggacagtactttcagtgca

SEQ ID NO: 143684 - DNA, 37 bp, Artificial Sequence
  Synthetic oligonucleotide
gcccagctctgtccacccatgtgaatcccaccgccga

SEQ ID NO: 143685 - DNA, 37 bp, Artificial Sequence
  Synthetic oligonucleotide
attgtgcgcagttgttcttttttgctgcaccttccga

SEQ ID NO: 143686 - DNA, 38 bp, Artificial Sequence
  Synthetic oligonucleotide
atgtgcgatccggccattttgcgtgctcccatccatga

SEQ ID NO: 143687 - DNA, 38 bp, Artificial Sequence
  Synthetic oligonucleotide
ggggcaagaatggggtggagcgggagtgccatggatga

SEQ ID NO: 143688 - DNA, 38 bp, Artificial Sequence
  Synthetic oligonucleotide
taccggggtgccagtgcgatggggcgggtggggtatga

SEQ ID NO: 143689 - DNA, 38 bp, Artificial Sequence
  Synthetic oligonucleotide
gcagatgggggagggtgggggagtagggagttaactga

SEQ ID NO: 143690 - DNA, 37 bp, Artificial Sequence
  Synthetic oligonucleotide
aacgaacgggaaagggagggcaggagccaaggactga

SEQ ID NO: 143691 - DNA, 38 bp, Artificial Sequence
  Synthetic oligonucleotide
ggtgtcgctattgctgctcgttctcgcccactccctga

SEQ ID NO: 143692 - DNA, 38 bp, Artificial Sequence
  Synthetic oligonucleotide
gggacacgtctcgctttcattccttcgccacctcgtga

SEQ ID NO: 143693 - DNA, 37 bp, Artificial Sequence
  Synthetic oligonucleotide
agtgggtgtagagggggggaaggacagtggccggtga

SEQ ID NO: 143694 - DNA, 38 bp, Artificial Sequence
  Synthetic oligonucleotide
acccccccaccgcacccccagtcatagtgttgccttga

SEQ ID NO: 143695 - DNA, 37 bp, Artificial Sequence
  Synthetic oligonucleotide
ggaacgctcatgtctccaaccgccgaccccagcttga

SEQ ID NO: 143696 - DNA, 37 bp, Artificial Sequence
  Synthetic oligonucleotide
tctgctgaccccatgttctgtttccgcccgtctttga

SEQ ID NO: 143697 - DNA, 36 bp, Artificial Sequence
  Synthetic oligonucleotide
tatgcccctgttcgtacccggccgtaccatttccta

SEQ ID NO: 143698 - DNA, 36 bp, Artificial Sequence
  Synthetic oligonucleotide
gaccgggtcgcctccatactgtccttacctccgcta

SEQ ID NO: 143699 - DNA, 36 bp, Artificial Sequence
  Synthetic oligonucleotide
acgccacgcctaagatctccttttgttccttccgta

SEQ ID NO: 143700 - DNA, 36 bp, Artificial Sequence
  Synthetic oligonucleotide
agcctaggaaggacggggactaaggggctggaggta

SEQ ID NO: 143701 - DNA, 36 bp, Artificial Sequence
  Synthetic oligonucleotide
gacgctctgcgcaccggctcctctctgctcctctta

SEQ ID NO: 143702 - DNA, 35 bp, Artificial Sequence
  Synthetic oligonucleotide
tccggctcctcaggactgccccgcccccgcctaac

SEQ ID NO: 143703 - DNA, 35 bp, Artificial Sequence
  Synthetic oligonucleotide
tacagatgtcggatcgcaccccccgtcgaccatac

SEQ ID NO: 143704 - DNA, 35 bp, Artificial Sequence
  Synthetic oligonucleotide
gccgacctaccgctatttgtccttgttcattttac

SEQ ID NO: 143705 - DNA, 35 bp, Artificial Sequence
  Synthetic oligonucleotide
acagagacatgtatcggtcctccgccctccccacc

SEQ ID NO: 143706 - DNA, 35 bp, Artificial Sequence
  Synthetic oligonucleotide
agatcccactactgctggtcgcctgagccccaccc

SEQ ID NO: 143707 - DNA, 35 bp, Artificial Sequence
  Synthetic oligonucleotide
tcctcacatcggtctcgaatcactatagtatcccc

SEQ ID NO: 143708 - DNA, 35 bp, Artificial Sequence
  Synthetic oligonucleotide
tccgccacccctgcgtttcgctcttggactgtccc

SEQ ID NO: 143709 - DNA, 35 bp, Artificial Sequence
  Synthetic oligonucleotide
tgtccttctccctcctgttgtcttgttcaaaggcc

SEQ ID NO: 143710 - DNA, 35 bp, Artificial Sequence
  Synthetic oligonucleotide
tcctgggactatccgctggcctctacacatctgcc

SEQ ID NO: 143711 - DNA, 35 bp, Artificial Sequence
  Synthetic oligonucleotide
agtctacctgccacaactcgcccatggcttcacgc

SEQ ID NO: 143712 - DNA, 34 bp, Artificial Sequence
  Synthetic oligonucleotide
tattcgcctcctttgcgcattcaggatacctcgc

SEQ ID NO: 143713 - DNA, 35 bp, Artificial Sequence
  Synthetic oligonucleotide
tcaatgcccctctaatctgccgtttatacattgtc

SEQ ID NO: 143714 - DNA, 35 bp, Artificial Sequence
  Synthetic oligonucleotide
ttgcctccccgggcctatgggctgtaccattcttc

SEQ ID NO: 143715 - DNA, 35 bp, Artificial Sequence
  Synthetic oligonucleotide
tacaccaccccatcctgctgcgtcgcacctcgttc

SEQ ID NO: 143716 - DNA, 35 bp, Artificial Sequence
  Synthetic oligonucleotide
gcctgccacccccctgccatacttcccggccacag

SEQ ID NO: 143717 - DNA, 35 bp, Artificial Sequence
  Synthetic oligonucleotide
tgctggcccaagtgtccctcctttacgcactcccg

SEQ ID NO: 143718 - DNA, 35 bp, Artificial Sequence
  Synthetic oligonucleotide
tcacggctgtccttcatggcctctagattcccctg

SEQ ID NO: 143719 - DNA, 35 bp, Artificial Sequence
  Synthetic oligonucleotide
gggaggggcgggagggcacagcaagtgtgatcact

SEQ ID NO: 143720 - DNA, 35 bp, Artificial Sequence
  Synthetic oligonucleotide
tgctcctcaggtctgatcgtccgcccgctccacct

SEQ ID NO: 143721 - DNA, 35 bp, Artificial Sequence
  Synthetic oligonucleotide
aagtcacgcccgccattagcagtgcctagctccct

SEQ ID NO: 143722 - DNA, 35 bp, Artificial Sequence
  Synthetic oligonucleotide
tatcacccctcgacttgccgcgccgttcttcaagt

SEQ ID NO: 143723 - DNA, 35 bp, Artificial Sequence
  Synthetic oligonucleotide
acccccacctccctactcgatactaacgagatctt

SEQ ID NO: 143724 - DNA, 36 bp, Artificial Sequence
  Synthetic oligonucleotide
gccttggcaccccaccgtttatgatcgtcctctcaa

SEQ ID NO: 143725 - DNA, 35 bp, Artificial Sequence
  Synthetic oligonucleotide
gaaacatcccaccgccgtgataaccagctcaccca

SEQ ID NO: 143726 - DNA, 36 bp, Artificial Sequence
  Synthetic oligonucleotide
tgatcgctgctgctgaaatctgtagcccctccccca

SEQ ID NO: 143727 - DNA, 35 bp, Artificial Sequence
  Synthetic oligonucleotide
tgatcccgccaaccgaatggtctatgttcatctca

SEQ ID NO: 143728 - DNA, 36 bp, Artificial Sequence
  Synthetic oligonucleotide
tccgccgccctgctgcatgtcctccactcacgttca

SEQ ID NO: 143729 - DNA, 37 bp, Artificial Sequence
  Synthetic oligonucleotide
acaagccggtgggggaatagggaacgagagagaggga

SEQ ID NO: 143730 - DNA, 37 bp, Artificial Sequence
  Synthetic oligonucleotide
gttaccgcccatattgcttacccttcggccctttgga

SEQ ID NO: 143731 - DNA, 38 bp, Artificial Sequence
  Synthetic oligonucleotide
atccccgtcctccattgttcggaccgccccccacatga

SEQ ID NO: 143732 - DNA, 38 bp, Artificial Sequence
  Synthetic oligonucleotide
acaaaacgcactgttgctccccccgtctccccgcatga

SEQ ID NO: 143733 - DNA, 38 bp, Artificial Sequence
  Synthetic oligonucleotide
gcccaccgggctgtgattctcaagtgccctgcccctga

SEQ ID NO: 143734 - DNA, 37 bp, Artificial Sequence
  Synthetic oligonucleotide
gagaagggaagggccgggatatagattgggaggctga

SEQ ID NO: 143735 - DNA, 38 bp, Artificial Sequence
  Synthetic oligonucleotide
gtcacgacgggaggggtaatacgcatgggtgggagtga

SEQ ID NO: 143736 - DNA, 38 bp, Artificial Sequence
  Synthetic oligonucleotide
gcccaaaccgcgtcctgctctgacccccccagccgtga

SEQ ID NO: 143737 - DNA, 36 bp, Artificial Sequence
  Synthetic oligonucleotide
agtaggaggggggggcgaaagcagctgagcttgtga

SEQ ID NO: 143738 - DNA, 38 bp, Artificial Sequence
  Synthetic oligonucleotide
atatcgccgcccacccatgtcatctcgaggcgtcttga

SEQ ID NO: 143739 - DNA, 36 bp, Artificial Sequence
  Synthetic oligonucleotide
gcctacagaactccatctgccgtatcctccgaccta

SEQ ID NO: 143740 - DNA, 36 bp, Artificial Sequence
  Synthetic oligonucleotide
tatcgcgtacgtcgctccccggctcccgccccgcta

SEQ ID NO: 143741 - DNA, 36 bp, Artificial Sequence
  Synthetic oligonucleotide
tcgtgggagcatgaaggcgggggggcaattagggta

SEQ ID NO: 143742 - DNA, 35 bp, Artificial Sequence
  Synthetic oligonucleotide
tgttgatggaggtcccgttgtctttcctgtgcccc

SEQ ID NO: 143743 - DNA, 35 bp, Artificial Sequence
  Synthetic oligonucleotide
gtgctaggccgctgttacaccccctcttgccgccc

SEQ ID NO: 143744 - DNA, 35 bp, Artificial Sequence
  Synthetic oligonucleotide
tcatctcagccgtccacgattcattgccggcttcc

SEQ ID NO: 143745 - DNA, 34 bp, Artificial Sequence
  Synthetic oligonucleotide
gttaccgcacatttatttacgatcctgaactagc

SEQ ID NO: 143746 - DNA, 35 bp, Artificial Sequence
  Synthetic oligonucleotide
tgctcaacaacctcgtctcgtctcgccccctacgc

SEQ ID NO: 143747 - DNA, 35 bp, Artificial Sequence
  Synthetic oligonucleotide
tccgtacctgtccccctaatatgtcagatcttatc

SEQ ID NO: 143748 - DNA, 35 bp, Artificial Sequence
  Synthetic oligonucleotide
gtctacatccgcgaattagcgcctggcccctcctc

SEQ ID NO: 143749 - DNA, 35 bp, Artificial Sequence
  Synthetic oligonucleotide
acatcgccggaccattccacccctctgcgtctctc

SEQ ID NO: 143750 - DNA, 35 bp, Artificial Sequence
  Synthetic oligonucleotide
gcacgctcgtatccagacgcgcccctctacccttc

SEQ ID NO: 143751 - DNA, 35 bp, Artificial Sequence
  Synthetic oligonucleotide
tagccctcgcaccgcccgttacccgccccaccacg

SEQ ID NO: 143752 - DNA, 35 bp, Artificial Sequence
  Synthetic oligonucleotide
acccttccgcatatctgtgatctcctggtgccccg

SEQ ID NO: 143753 - DNA, 35 bp, Artificial Sequence
  Synthetic oligonucleotide
agactagccccatttgcctccctgctattactgcg

SEQ ID NO: 143754 - DNA, 35 bp, Artificial Sequence
  Synthetic oligonucleotide
gttaaccgccgccacttccatcattctctgcctcg

SEQ ID NO: 143755 - DNA, 35 bp, Artificial Sequence
  Synthetic oligonucleotide
gtgatcttccatgtccctttgttctgcttttcggg

SEQ ID NO: 143756 - DNA, 35 bp, Artificial Sequence
  Synthetic oligonucleotide
aagtgcaagcagtcgtcccgttccattctccgttg

SEQ ID NO: 143757 - DNA, 35 bp, Artificial Sequence
  Synthetic oligonucleotide
acccgcacgactcgcctgctaaccccacgtatact

SEQ ID NO: 143758 - DNA, 35 bp, Artificial Sequence
  Synthetic oligonucleotide
tacagcctcgcgcgtgcgccctcttcacatcgcct

SEQ ID NO: 143759 - DNA, 35 bp, Artificial Sequence
  Synthetic oligonucleotide
tgccacatcagactatcgcactactcaccatgtct

SEQ ID NO: 143760 - DNA, 35 bp, Artificial Sequence
  Synthetic oligonucleotide
accgtagcccgttcacccgattcgtcccttcacgt

SEQ ID NO: 143761 - DNA, 35 bp, Artificial Sequence
  Synthetic oligonucleotide
tccaccacactttgcaattagggaattgccacgaa

SEQ ID NO: 143762 - DNA, 36 bp, Artificial Sequence
  Synthetic oligonucleotide
taccacatcgctgcttaccgctaccgttttctctaa

SEQ ID NO: 143763 - DNA, 35 bp, Artificial Sequence
  Synthetic oligonucleotide
atcccattgccctgagctatctcgtgcttcaagca

SEQ ID NO: 143764 - DNA, 35 bp, Artificial Sequence
  Synthetic oligonucleotide
atgtgccacctcaccgagcttccgccatgccccga

SEQ ID NO: 143765 - DNA, 35 bp, Artificial Sequence
  Synthetic oligonucleotide
atgccaaaccgacatacggtatacgcccctcccga

SEQ ID NO: 143766 - DNA, 35 bp, Artificial Sequence
  Synthetic oligonucleotide
tgaacccatccgcattgactcaccgccagttccga

SEQ ID NO: 143767 - DNA, 38 bp, Artificial Sequence
  Synthetic oligonucleotide
gcaggtctgtcctgctatagcctcctgccttttcctga

SEQ ID NO: 143768 - DNA, 36 bp, Artificial Sequence
  Synthetic oligonucleotide
tacgagcccatgaccgttaatgccgcaaccccccta

SEQ ID NO: 143769 - DNA, 35 bp, Artificial Sequence
  Synthetic oligonucleotide
atgcgggcattttggcgcatctcctgtccttccta

SEQ ID NO: 143770 - DNA, 36 bp, Artificial Sequence
  Synthetic oligonucleotide
gtccgcctccgctgcttacccgggacttatcaatta

SEQ ID NO: 143771 - DNA, 36 bp, Artificial Sequence
  Synthetic oligonucleotide
gccgctccgtccatcccgcggttgcgttccccctta

SEQ ID NO: 143772 - DNA, 36 bp, Artificial Sequence
  Synthetic oligonucleotide
tcacccgccattagaagtcctcgcaccccatggtta

SEQ ID NO: 143773 - DNA, 36 bp, Artificial Sequence
  Synthetic oligonucleotide
tacaccacccgacgctccccagtcagctctggttta

SEQ ID NO: 143774 - DNA, 35 bp, Artificial Sequence
  Synthetic oligonucleotide
agtacacctctccgtccctccactgcgtggctaac

SEQ ID NO: 143775 - DNA, 35 bp, Artificial Sequence
  Synthetic oligonucleotide
ttatagccgcgcgccctgttacttagtttcctcac

SEQ ID NO: 143776 - DNA, 35 bp, Artificial Sequence
  Synthetic oligonucleotide
gcaatggtcacaccgttagggccctcgttactccc

SEQ ID NO: 143777 - DNA, 35 bp, Artificial Sequence
  Synthetic oligonucleotide
gttaaacgaggggagggggggacagagggatcgcc

SEQ ID NO: 143778 - DNA, 35 bp, Artificial Sequence
  Synthetic oligonucleotide
gtcgcccccgctgagagcacctccactttgttgcc

SEQ ID NO: 143779 - DNA, 35 bp, Artificial Sequence
  Synthetic oligonucleotide
gtctggtacacgtgccggccaattcctttctatcc

SEQ ID NO: 143780 - DNA, 35 bp, Artificial Sequence
  Synthetic oligonucleotide
tcaacgtcctggtgcttttgtccggcgccctctcc

SEQ ID NO: 143781 - DNA, 35 bp, Artificial Sequence
  Synthetic oligonucleotide
gaaaccccctgtcatactcctgtgcgagcttctcc

SEQ ID NO: 143782 - DNA, 35 bp, Artificial Sequence
  Synthetic oligonucleotide
tagtccttccatctcgtccgcgtgaccgaccttcc

SEQ ID NO: 143783 - DNA, 35 bp, Artificial Sequence
  Synthetic oligonucleotide
agacaggctcggagggcggggaggtggtaatacgc

SEQ ID NO: 143784 - DNA, 35 bp, Artificial Sequence
  Synthetic oligonucleotide
gccccgctcgcttccggaacttcgtaacgcctctc

SEQ ID NO: 143785 - DNA, 34 bp, Artificial Sequence
  Synthetic oligonucleotide
accgcctgcccacctctggatcacgtccggtctc

SEQ ID NO: 143786 - DNA, 35 bp, Artificial Sequence
  Synthetic oligonucleotide
ggatgaggaaagaatggagggagcgggtggatcag

SEQ ID NO: 143787 - DNA, 35 bp, Artificial Sequence
  Synthetic oligonucleotide
acgcctccctgcatccccaaaagctacctgccacg

SEQ ID NO: 143788 - DNA, 35 bp, Artificial Sequence
  Synthetic oligonucleotide
ttacccacaggtgtggctgcctccctatcgttccg

SEQ ID NO: 143789 - DNA, 37 bp, Artificial Sequence
  Synthetic oligonucleotide
atcaccgcttttcccctgtacaccccccctttgggtg

SEQ ID NO: 143790 - DNA, 35 bp, Artificial Sequence
  Synthetic oligonucleotide
ggtcaacgtcccgccgtacccacatcgtctccttg

SEQ ID NO: 143791 - DNA, 35 bp, Artificial Sequence
  Synthetic oligonucleotide
tgcgaacgacccgccctctcgtgagatttttcact

SEQ ID NO: 143792 - DNA, 35 bp, Artificial Sequence
  Synthetic oligonucleotide
tacaaagaggggtgtcaggaaagggggtatggggt

SEQ ID NO: 143793 - DNA, 34 bp, Artificial Sequence
  Synthetic oligonucleotide
acttctccacccgtgctgctcataataccgcctt

SEQ ID NO: 143794 - DNA, 35 bp, Artificial Sequence
  Synthetic oligonucleotide
tccgcccacgcaattagctatccactgccctggtt

SEQ ID NO: 143795 - DNA, 35 bp, Artificial Sequence
  Synthetic oligonucleotide
tgccctcaacacttgtgcggtctcatctatccttt

SEQ ID NO: 143796 - DNA, 36 bp, Artificial Sequence
  Synthetic oligonucleotide
acaggcggtcccaggcccttcacccgtttgtcccaa

SEQ ID NO: 143797 - DNA, 35 bp, Artificial Sequence
  Synthetic oligonucleotide
gactgacttccctgcgtaaccgttcttgtacacca

SEQ ID NO: 143798 - DNA, 36 bp, Artificial Sequence
  Synthetic oligonucleotide
ttgccgctgcccctttggtattcctgttcatgccca

SEQ ID NO: 143799 - DNA, 36 bp, Artificial Sequence
  Synthetic oligonucleotide
acatcaccacccgggttttgcgcatcttgcttccca

SEQ ID NO: 143800 - DNA, 35 bp, Artificial Sequence
  Synthetic oligonucleotide
atactccccgtccgtcctggaggagcttcctttca

SEQ ID NO: 143801 - DNA, 37 bp, Artificial Sequence
  Synthetic oligonucleotide
gtgcgagataaagggaatgggtgggagtgggcacaga

SEQ ID NO: 143802 - DNA, 37 bp, Artificial Sequence
  Synthetic oligonucleotide
acacccatgtcttttttgaccctctgtcctccgccga

SEQ ID NO: 143803 - DNA, 37 bp, Artificial Sequence
  Synthetic oligonucleotide
cacgacaggtaggaaagtggagggagggcgggcagga

SEQ ID NO: 143804 - DNA, 37 bp, Artificial Sequence
  Synthetic oligonucleotide
gatacgcgaagtgggggaaggcgggagagaaagcgga

SEQ ID NO: 143805 - DNA, 37 bp, Artificial Sequence
  Synthetic oligonucleotide
gaagaactcacggggggggaatggggaggtgtaggga

SEQ ID NO: 143806 - DNA, 37 bp, Artificial Sequence
  Synthetic oligonucleotide
ttgcgctgtaagctctcatcgcgcctcctctcctgga

SEQ ID NO: 143807 - DNA, 38 bp, Artificial Sequence
  Synthetic oligonucleotide
gcaggggcacgtggcggatagggggtaggggagtatga

SEQ ID NO: 143808 - DNA, 38 bp, Artificial Sequence
  Synthetic oligonucleotide
tcagtgttcggagggggtggagtagggaggtgatctga

SEQ ID NO: 143809 - DNA, 38 bp, Artificial Sequence
  Synthetic oligonucleotide
aaggggggtacggggggactagtggggcaggcaagtga

SEQ ID NO: 143810 - DNA, 33 bp, Artificial Sequence
  Synthetic oligonucleotide
acccgcccacctactcctgaagtcgactaccta

SEQ ID NO: 143811 - DNA, 38 bp, Artificial Sequence
  Synthetic oligonucleotide
gacacatccaagtgaatgccgccgctccccttgtttta

SEQ ID NO: 143812 - DNA, 35 bp, Artificial Sequence
  Synthetic oligonucleotide
atacccaccgctacgtgcgcgcttgagctatctac

SEQ ID NO: 143813 - DNA, 36 bp, Artificial Sequence
  Synthetic oligonucleotide
gctcgccccacctctgagttgatttcagtgtctacc

SEQ ID NO: 143814 - DNA, 35 bp, Artificial Sequence
  Synthetic oligonucleotide
gcttcagcacagtactcttcaccacagcttctacc

SEQ ID NO: 143815 - DNA, 33 bp, Artificial Sequence
  Synthetic oligonucleotide
tgggcatccccccccccgctgattgcgtaaccc

SEQ ID NO: 143816 - DNA, 35 bp, Artificial Sequence
  Synthetic oligonucleotide
gtccagctcatcccggcttctggctcgaccgtccc

SEQ ID NO: 143817 - DNA, 35 bp, Artificial Sequence
  Synthetic oligonucleotide
cacattccctctctgtgctttttgtgatctcccgc

SEQ ID NO: 143818 - DNA, 35 bp, Artificial Sequence
  Synthetic oligonucleotide
gagcggggtaaacttggggtatgtttgggtggggc

SEQ ID NO: 143819 - DNA, 35 bp, Artificial Sequence
  Synthetic oligonucleotide
gttcctccgcccttaagtgactctttccctgcatc

SEQ ID NO: 143820 - DNA, 35 bp, Artificial Sequence
  Synthetic oligonucleotide
tagtgtcgctcgatggcacgtttgtccttctcctc

SEQ ID NO: 143821 - DNA, 35 bp, Artificial Sequence
  Synthetic oligonucleotide
aggacacgccccctccatccatcgttctcacgctc

SEQ ID NO: 143822 - DNA, 35 bp, Artificial Sequence
  Synthetic oligonucleotide
aactgcgcacggttatttacaccgcactcactctc

SEQ ID NO: 143823 - DNA, 35 bp, Artificial Sequence
  Synthetic oligonucleotide
gcgaagcatcgttgacatcttggctactctttctc

SEQ ID NO: 143824 - DNA, 36 bp, Artificial Sequence
  Synthetic oligonucleotide
tgactggtcacaatttgatcacctcgcctccttgtc

SEQ ID NO: 143825 - DNA, 35 bp, Artificial Sequence
  Synthetic oligonucleotide
acttccaccatcactaatgccctttaggagatttc

SEQ ID NO: 143826 - DNA, 35 bp, Artificial Sequence
  Synthetic oligonucleotide
gccacgtctcggcgtccacttacggcccttttttc

SEQ ID NO: 143827 - DNA, 35 bp, Artificial Sequence
  Synthetic oligonucleotide
gcggggggagggggggagaaggagatgaacaaggg

SEQ ID NO: 143828 - DNA, 35 bp, Artificial Sequence
  Synthetic oligonucleotide
aatgaacccggcacccatcgttcctctatagccct

SEQ ID NO: 143829 - DNA, 35 bp, Artificial Sequence
  Synthetic oligonucleotide
tgcccgttgccttgtaacacccatttgtccactct

SEQ ID NO: 143830 - DNA, 35 bp, Artificial Sequence
  Synthetic oligonucleotide
atcggtgcactgccctgttttcccgagtcccctct

SEQ ID NO: 143831 - DNA, 35 bp, Artificial Sequence
  Synthetic oligonucleotide
ttcatcctcggtgtcgccggacgcgctggccttct

SEQ ID NO: 143832 - DNA, 35 bp, Artificial Sequence
  Synthetic oligonucleotide
atgcggccgaaccaccctctatacgcgtgctcctt

SEQ ID NO: 143833 - DNA, 35 bp, Artificial Sequence
  Synthetic oligonucleotide
tcatgtcctccacctgttaccgccgcctcgctgtt

SEQ ID NO: 143834 - DNA, 35 bp, Artificial Sequence
  Synthetic oligonucleotide
atctacatcccagtccaccgcgcccggtcttgttt

SEQ ID NO: 143835 - DNA, 35 bp, Artificial Sequence
  Synthetic oligonucleotide
ttgaccaccacaaattgcttccattggacgttttt

SEQ ID NO: 143836 - DNA, 36 bp, Artificial Sequence
  Synthetic oligonucleotide
gtcggagccctcacaccgcgtatgcccttccagcaa

SEQ ID NO: 143837 - DNA, 36 bp, Artificial Sequence
  Synthetic oligonucleotide
gaagacgggaggagcgaggagggaggagaagtgcaa

SEQ ID NO: 143838 - DNA, 35 bp, Artificial Sequence
  Synthetic oligonucleotide
gttggtgggagggcggagaggacctagatcgagaa

SEQ ID NO: 143839 - DNA, 36 bp, Artificial Sequence
  Synthetic oligonucleotide
tcgttcactcctcctaactgttatcgcccgtggaca

SEQ ID NO: 143840 - DNA, 35 bp, Artificial Sequence
  Synthetic oligonucleotide
gtcgcttctagcctgttcctgcgctttccctgcca

SEQ ID NO: 143841 - DNA, 35 bp, Artificial Sequence
  Synthetic oligonucleotide
gatcgatgagaaggaaggcgggaaggttggcggca

SEQ ID NO: 143842 - DNA, 35 bp, Artificial Sequence
  Synthetic oligonucleotide
tcagcacaccgttggtccgaccgctctttggctca

SEQ ID NO: 143843 - DNA, 35 bp, Artificial Sequence
  Synthetic oligonucleotide
gacaaaacagttgctgcacccttcgccccatttca

SEQ ID NO: 143844 - DNA, 37 bp, Artificial Sequence
  Synthetic oligonucleotide
tagtcccccctctatgtgatgttccccgcgtccacga

SEQ ID NO: 143845 - DNA, 37 bp, Artificial Sequence
  Synthetic oligonucleotide
attcgatccgcctcctctgccgcatcagtcctaccga

SEQ ID NO: 143846 - DNA, 37 bp, Artificial Sequence
  Synthetic oligonucleotide
gagtggggaatggaggggtgggtggtgggtcaagcga

SEQ ID NO: 143847 - DNA, 36 bp, Artificial Sequence
  Synthetic oligonucleotide
gtcccacccctcactatccttcaccgcagttagcga

SEQ ID NO: 143848 - DNA, 37 bp, Artificial Sequence
  Synthetic oligonucleotide
gtgaccgactgtactgttcattccctcccccgttcga

SEQ ID NO: 143849 - DNA, 37 bp, Artificial Sequence
  Synthetic oligonucleotide
ggtggaggggagggacgggactagagatgtcgaagga

SEQ ID NO: 143850 - DNA, 37 bp, Artificial Sequence
  Synthetic oligonucleotide
gtgtggaaaaggtggtgtacgggggaggccggcagga

SEQ ID NO: 143851 - DNA, 37 bp, Artificial Sequence
  Synthetic oligonucleotide
ggtcgatgaggagggttaaataggtggtagggcggga

SEQ ID NO: 143852 - DNA, 38 bp, Artificial Sequence
  Synthetic oligonucleotide
attgccgccagcctggttaatttctacccttctcctga

SEQ ID NO: 143853 - DNA, 38 bp, Artificial Sequence
  Synthetic oligonucleotide
taagggcgagggagggcaagggagaatgcggagattga

SEQ ID NO: 143854 - DNA, 37 bp, Artificial Sequence
  Synthetic oligonucleotide
gcattacacccatcatgtcttatcctaccgtccttga

SEQ ID NO: 143855 - DNA, 35 bp, Artificial Sequence
  Synthetic oligonucleotide
tccgatccattcccagtctgtggcccgtttttcac

SEQ ID NO: 143856 - DNA, 35 bp, Artificial Sequence
  Synthetic oligonucleotide
tcctgctgtcgttccttattccggcccttactgcc

SEQ ID NO: 143857 - DNA, 35 bp, Artificial Sequence
  Synthetic oligonucleotide
aatgtaggccgctgtgtcttaaacctcccccctcc

SEQ ID NO: 143858 - DNA, 35 bp, Artificial Sequence
  Synthetic oligonucleotide
atggccgcttccctctcttacaccgcacgccccgc

SEQ ID NO: 143859 - DNA, 35 bp, Artificial Sequence
  Synthetic oligonucleotide
gccgtccccactgattccatttgccgccctttcgc

SEQ ID NO: 143860 - DNA, 35 bp, Artificial Sequence
  Synthetic oligonucleotide
tgaccgctgcctgactaatgctcgcccaccaaatc

SEQ ID NO: 143861 - DNA, 35 bp, Artificial Sequence
  Synthetic oligonucleotide
gttgctgactcccttacgctgactagcccctgctc

SEQ ID NO: 143862 - DNA, 35 bp, Artificial Sequence
  Synthetic oligonucleotide
tattgtcgcaattgttccatcgttggtcacctttc

SEQ ID NO: 143863 - DNA, 35 bp, Artificial Sequence
  Synthetic oligonucleotide
tgttgtcctacgcacgatccaccgacccttctacg

SEQ ID NO: 143864 - DNA, 35 bp, Artificial Sequence
  Synthetic oligonucleotide
acccccatcccatactcgccctgtctctatgtgcg

SEQ ID NO: 143865 - DNA, 35 bp, Artificial Sequence
  Synthetic oligonucleotide
gggtgggctcggtaggagggaagtgggggggctcg

SEQ ID NO: 143866 - DNA, 35 bp, Artificial Sequence
  Synthetic oligonucleotide
gcacactccatctgcgtcaaagcgagctccccgtg

SEQ ID NO: 143867 - DNA, 35 bp, Artificial Sequence
  Synthetic oligonucleotide
gtctatccgaccgcccgctgtccgcccttaaattg

SEQ ID NO: 143868 - DNA, 30 bp, Artificial Sequence
  Synthetic oligonucleotide
tccggaccgttcaccccctgttccctccat

SEQ ID NO: 143869 - DNA, 35 bp, Artificial Sequence
  Synthetic oligonucleotide
tcaagcgggtaggggagggaaatgggaccttgcat

SEQ ID NO: 143870 - DNA, 35 bp, Artificial Sequence
  Synthetic oligonucleotide
tcagagccgcccatccctgctaatggtagttcact

SEQ ID NO: 143871 - DNA, 35 bp, Artificial Sequence
  Synthetic oligonucleotide
taactgcgggtcgccgtgctcttcactgcctctct

SEQ ID NO: 143872 - DNA, 35 bp, Artificial Sequence
  Synthetic oligonucleotide
ttccgccccggcttgtcccgccgtaaattatcctt

SEQ ID NO: 143873 - DNA, 35 bp, Artificial Sequence
  Synthetic oligonucleotide
acggatgtacgccccgttttgaggattcgcccttt

SEQ ID NO: 143874 - DNA, 33 bp, Artificial Sequence
  Synthetic oligonucleotide
ggggatatccaggggagcaaagggaacggggca

SEQ ID NO: 143875 - DNA, 36 bp, Artificial Sequence
  Synthetic oligonucleotide
gacggtggggggggggaagaatggatggtggtctca

SEQ ID NO: 143876 - DNA, 36 bp, Artificial Sequence
  Synthetic oligonucleotide
ttcggggtaagggggagcaaatatagtggggaacga

SEQ ID NO: 143877 - DNA, 37 bp, Artificial Sequence
  Synthetic oligonucleotide
gatcacgccatcggtgcgccgcctagtaccatcccga

SEQ ID NO: 143878 - DNA, 37 bp, Artificial Sequence
  Synthetic oligonucleotide
aggggaggggtcagactaaggggagtcgctgagggga

SEQ ID NO: 143879 - DNA, 38 bp, Artificial Sequence
  Synthetic oligonucleotide
gtgcccccgccccactgctttagactcgctcgacatga

SEQ ID NO: 143880 - DNA, 38 bp, Artificial Sequence
  Synthetic oligonucleotide
acacatcctcagatagtgtaccctactccccttgctga

SEQ ID NO: 143881 - DNA, 38 bp, Artificial Sequence
  Synthetic oligonucleotide
atccgcccacctgcctaccgccgtcattatccggttga

SEQ ID NO: 143882 - DNA, 38 bp, Artificial Sequence
  Synthetic oligonucleotide
gatgccccactcacatgccctgtttagtttccggttga

SEQ ID NO: 143883 - DNA, 38 bp, Artificial Sequence
  Synthetic oligonucleotide
ttcgcacctcgatgcctctgcccgcatcccccttttga

SEQ ID NO: 143884 - DNA, 36 bp, Artificial Sequence
  Synthetic oligonucleotide
tcgcacaggtccgcatctctgccctcgtccctcata

SEQ ID NO: 143885 - DNA, 35 bp, Artificial Sequence
  Synthetic oligonucleotide
tgtcctccgcaatttggttcttaacttccagccac

SEQ ID NO: 143886 - DNA, 35 bp, Artificial Sequence
  Synthetic oligonucleotide
ttgtagccgctgttcactcatataacccacttcac

SEQ ID NO: 143887 - DNA, 35 bp, Artificial Sequence
  Synthetic oligonucleotide
attacctggtccgtttgtcgtctgtcatcccttac

SEQ ID NO: 143888 - DNA, 35 bp, Artificial Sequence
  Synthetic oligonucleotide
agcccaccctgtaggactgcgtttcccgactgccc

SEQ ID NO: 143889 - DNA, 35 bp, Artificial Sequence
  Synthetic oligonucleotide
gcaccaccacccagtgcattgaagcagttcccgcc

SEQ ID NO: 143890 - DNA, 35 bp, Artificial Sequence
  Synthetic oligonucleotide
ggtacggcccctggctactttccctctcttgtgcc

SEQ ID NO: 143891 - DNA, 35 bp, Artificial Sequence
  Synthetic oligonucleotide
tgacgcgcaccctctactatcccaagcgcattgcc

SEQ ID NO: 143892 - DNA, 35 bp, Artificial Sequence
  Synthetic oligonucleotide
agttcgcccgcacgttatcccttcgatgcctcatc

SEQ ID NO: 143893 - DNA, 35 bp, Artificial Sequence
  Synthetic oligonucleotide
gagcacgtaggtcaccctgattcgccactattgtc

SEQ ID NO: 143894 - DNA, 35 bp, Artificial Sequence
  Synthetic oligonucleotide
agttggcgaaaaggggagcaaggggcatgatagag

SEQ ID NO: 143895 - DNA, 35 bp, Artificial Sequence
  Synthetic oligonucleotide
gaaagaaagtgggcgggtaaacacggggaggaacg

SEQ ID NO: 143896 - DNA, 35 bp, Artificial Sequence
  Synthetic oligonucleotide
gctatccgccatggttctacgtgttgttccccccg

SEQ ID NO: 143897 - DNA, 35 bp, Artificial Sequence
  Synthetic oligonucleotide
tcacgtcgcgacacccgcgaactacgtccctcccg

SEQ ID NO: 143898 - DNA, 35 bp, Artificial Sequence
  Synthetic oligonucleotide
tacgcccgctgcccttccgtctacgcttcggcagg

SEQ ID NO: 143899 - DNA, 35 bp, Artificial Sequence
  Synthetic oligonucleotide
gtgagcctggtttaggcccccgttttgtaccatct

SEQ ID NO: 143900 - DNA, 34 bp, Artificial Sequence
  Synthetic oligonucleotide
tgagctcgactctcagtgtcttacgcccctctgt

SEQ ID NO: 143901 - DNA, 34 bp, Artificial Sequence
  Synthetic oligonucleotide
tcacgctgccacaatgcgtcgcctctccccgtgt

SEQ ID NO: 143902 - DNA, 35 bp, Artificial Sequence
  Synthetic oligonucleotide
tgcccccgctgataattcgctccccctggtggctt

SEQ ID NO: 143903 - DNA, 35 bp, Artificial Sequence
  Synthetic oligonucleotide
gtgttgtcactgcgcatagcatgacgttccatctt

SEQ ID NO: 143904 - DNA, 35 bp, Artificial Sequence
  Synthetic oligonucleotide
gtctcagccgtttccatcacgccatcccgtccgtt

SEQ ID NO: 143905 - DNA, 36 bp, Artificial Sequence
  Synthetic oligonucleotide
tgcatgtaggggaaggccatggagaggtggtgcaaa

SEQ ID NO: 143906 - DNA, 35 bp, Artificial Sequence
  Synthetic oligonucleotide
ttgattaccccgccactgattgtcctccttgccaa

SEQ ID NO: 143907 - DNA, 36 bp, Artificial Sequence
  Synthetic oligonucleotide
gccattccctgctggacttgtgccatctctactgaa

SEQ ID NO: 143908 - DNA, 36 bp, Artificial Sequence
  Synthetic oligonucleotide
tccacctccagtcgctccacgtaccttaatcgctca

SEQ ID NO: 143909 - DNA, 36 bp, Artificial Sequence
  Synthetic oligonucleotide
tcagccggcccgttttgcgttaccctcatcatttca

SEQ ID NO: 143910 - DNA, 36 bp, Artificial Sequence
  Synthetic oligonucleotide
taccgataggaggggggtgggaaggatctcgaaaga

SEQ ID NO: 143911 - DNA, 37 bp, Artificial Sequence
  Synthetic oligonucleotide
gttagcgccgaaggctcccttgcaccatcctgtacga

SEQ ID NO: 143912 - DNA, 35 bp, Artificial Sequence
  Synthetic oligonucleotide
tcgagcgactatccgccgaccttccgcaccaccga

SEQ ID NO: 143913 - DNA, 37 bp, Artificial Sequence
  Synthetic oligonucleotide
gcgtggtcgcaggaccctttacacacctcttctcgga

SEQ ID NO: 143914 - DNA, 37 bp, Artificial Sequence
  Synthetic oligonucleotide
taggggccggagggggggagataagctccgacaggga

SEQ ID NO: 143915 - DNA, 37 bp, Artificial Sequence
  Synthetic oligonucleotide
ttggacctgcccactctatcatccgcctactgctgga

SEQ ID NO: 143916 - DNA, 37 bp, Artificial Sequence
  Synthetic oligonucleotide
gaggggggaatgcggagtgggttaggggaagcgtgga

SEQ ID NO: 143917 - DNA, 37 bp, Artificial Sequence
  Synthetic oligonucleotide
tgacgaagggaggaggcaagagggtgaggcaccgtga

SEQ ID NO: 143918 - DNA, 38 bp, Artificial Sequence
  Synthetic oligonucleotide
atccaccgcgtccaattctcccccgtcccatgcggtga

SEQ ID NO: 143919 - DNA, 37 bp, Artificial Sequence
  Synthetic oligonucleotide
tggtcccccaccatcttgtaattacgcgcacctttga

SEQ ID NO: 143920 - DNA, 36 bp, Artificial Sequence
  Synthetic oligonucleotide
acgcacctccgcattagcctctcgggacttttccta

SEQ ID NO: 143921 - DNA, 36 bp, Artificial Sequence
  Synthetic oligonucleotide
gcgcgaggggaactggggtgacggcggaggtgggta

SEQ ID NO: 143922 - DNA, 35 bp, Artificial Sequence
  Synthetic oligonucleotide
tacactcactttcgataacccgactttgccgccgc

SEQ ID NO: 143923 - DNA, 35 bp, Artificial Sequence
  Synthetic oligonucleotide
acccaccctcaatcctcggttaccttaacgaaacg

SEQ ID NO: 143924 - DNA, 35 bp, Artificial Sequence
  Synthetic oligonucleotide
tagttagcgagtccgtcgttcccccgcaccacccg

SEQ ID NO: 143925 - DNA, 35 bp, Artificial Sequence
  Synthetic oligonucleotide
atgggcgccgatttgccacctgcttccccttgccg

SEQ ID NO: 143926 - DNA, 35 bp, Artificial Sequence
  Synthetic oligonucleotide
tccaccgtgtcgctcgccttcgagtttcccgccat

SEQ ID NO: 143927 - DNA, 35 bp, Artificial Sequence
  Synthetic oligonucleotide
actacgcgtcctcgcccctgttaccatgttccact

SEQ ID NO: 143928 - DNA, 35 bp, Artificial Sequence
  Synthetic oligonucleotide
tcatccccacaaatgttgtacgtttcccttggcct

SEQ ID NO: 143929 - DNA, 35 bp, Artificial Sequence
  Synthetic oligonucleotide
gacgcccgacggttcatgcacggccacctttcgct

SEQ ID NO: 143930 - DNA, 35 bp, Artificial Sequence
  Synthetic oligonucleotide
tattgtccgccccccgttgctcctatcgtcgaatt

SEQ ID NO: 143931 - DNA, 35 bp, Artificial Sequence
  Synthetic oligonucleotide
tcacaatgctatcacatcgcgcactgtacgccctt

SEQ ID NO: 143932 - DNA, 35 bp, Artificial Sequence
  Synthetic oligonucleotide
gcccgccccggggtgatatccgtcttatctttctt

SEQ ID NO: 143933 - DNA, 35 bp, Artificial Sequence
  Synthetic oligonucleotide
accgccacaccacgactgctcgccccattgaaaaa

SEQ ID NO: 143934 - DNA, 36 bp, Artificial Sequence
  Synthetic oligonucleotide
tcccactccatccccatgtgcgtatggccttagcaa

SEQ ID NO: 143935 - DNA, 36 bp, Artificial Sequence
  Synthetic oligonucleotide
ggtgaagcaaaaggggcgggcgggaattacaaataa

SEQ ID NO: 143936 - DNA, 36 bp, Artificial Sequence
  Synthetic oligonucleotide
gcagaaccccagctgcccccggtccctcgcttttaa

SEQ ID NO: 143937 - DNA, 35 bp, Artificial Sequence
  Synthetic oligonucleotide
ttatgtcccgagaccccatgcccctacccgccgca

SEQ ID NO: 143938 - DNA, 35 bp, Artificial Sequence
  Synthetic oligonucleotide
acatctcgattagcatctgccgctccgtacctgca

SEQ ID NO: 143939 - DNA, 36 bp, Artificial Sequence
  Synthetic oligonucleotide
taggatcagctcacacgtttccctcctatgccacga

SEQ ID NO: 143940 - DNA, 37 bp, Artificial Sequence
  Synthetic oligonucleotide
gaagcacgaaaatgtatgggcgggtagggggggacga

SEQ ID NO: 143941 - DNA, 37 bp, Artificial Sequence
  Synthetic oligonucleotide
gaagtaagggagagcaaaggggcgaggagacatgcga

SEQ ID NO: 143942 - DNA, 37 bp, Artificial Sequence
  Synthetic oligonucleotide
atccccgccctctaccgacaccatgcatgccctgcga

SEQ ID NO: 143943 - DNA, 37 bp, Artificial Sequence
  Synthetic oligonucleotide
tgcgaacgagggaggggagggcatgggggcgatcgga

SEQ ID NO: 143944 - DNA, 36 bp, Artificial Sequence
  Synthetic oligonucleotide
gagaagacgccaggggggggaacgggcacattggga

SEQ ID NO: 143945 - DNA, 38 bp, Artificial Sequence
  Synthetic oligonucleotide
taactgccttccttgttcctcctgctggtcctccttga

SEQ ID NO: 143946 - DNA, 38 bp, Artificial Sequence
  Synthetic oligonucleotide
acgttctgcgcacctgtacctgctccctttctccttga

SEQ ID NO: 143947 - DNA, 38 bp, Artificial Sequence
  Synthetic oligonucleotide
gacgtagccgcctcccgttattttggaacctctcttga

SEQ ID NO: 143948 - DNA, 38 bp, Artificial Sequence
  Synthetic oligonucleotide
tacatccgcccctgtttatggtgcttccatttcgttga

SEQ ID NO: 143949 - DNA, 36 bp, Artificial Sequence
  Synthetic oligonucleotide
cttcccgccacaacacggtatttgttaccactgcta

SEQ ID NO: 143950 - DNA, 36 bp, Artificial Sequence
  Synthetic oligonucleotide
tgcacatcctccgctcttgtactttgtaacgggtta

SEQ ID NO: 143951 - DNA, 35 bp, Artificial Sequence
  Synthetic oligonucleotide
gctccaccctccaatggtatacctaatcctccaac

SEQ ID NO: 143952 - DNA, 35 bp, Artificial Sequence
  Synthetic oligonucleotide
tccacccttccagagttaaactgcccccgacatac

SEQ ID NO: 143953 - DNA, 35 bp, Artificial Sequence
  Synthetic oligonucleotide
tcgaccgtatcggtcccttattgccttaccagacc

SEQ ID NO: 143954 - DNA, 35 bp, Artificial Sequence
  Synthetic oligonucleotide
gcacgcacccacgttctacctactcaagtctgacc

SEQ ID NO: 143955 - DNA, 35 bp, Artificial Sequence
  Synthetic oligonucleotide
tccccatctattgggtactcctgtgcgcttcgccc

SEQ ID NO: 143956 - DNA, 35 bp, Artificial Sequence
  Synthetic oligonucleotide
tgatcccatccatcgcccgctctgttcccgctgcc

SEQ ID NO: 143957 - DNA, 35 bp, Artificial Sequence
  Synthetic oligonucleotide
tcccatgtgcgttttcgttacccagccaacaccgc

SEQ ID NO: 143958 - DNA, 35 bp, Artificial Sequence
  Synthetic oligonucleotide
tcagacgcgaaacacttgtaactatcccactccgc

SEQ ID NO: 143959 - DNA, 35 bp, Artificial Sequence
  Synthetic oligonucleotide
gtacgagcgtccgcttctggcctccctctgttcgc

SEQ ID NO: 143960 - DNA, 35 bp, Artificial Sequence
  Synthetic oligonucleotide
tggatgtcctcctccccaccgaccactcctccggc

SEQ ID NO: 143961 - DNA, 35 bp, Artificial Sequence
  Synthetic oligonucleotide
ttcgggatgcatggggtgggggggcattggtggtc

SEQ ID NO: 143962 - DNA, 35 bp, Artificial Sequence
  Synthetic oligonucleotide
actgcggtgtcgcgctgccttccagttgatcgttc

SEQ ID NO: 143963 - DNA, 35 bp, Artificial Sequence
  Synthetic oligonucleotide
tgaaatagtcgagaggggaaacaggggggagtcag

SEQ ID NO: 143964 - DNA, 35 bp, Artificial Sequence
  Synthetic oligonucleotide
gctgtccccgtcaggacaacccgctccccttaccg

SEQ ID NO: 143965 - DNA, 35 bp, Artificial Sequence
  Synthetic oligonucleotide
atgcgtagcaccctcattaggcaaacacacccccg

SEQ ID NO: 143966 - DNA, 35 bp, Artificial Sequence
  Synthetic oligonucleotide
accccgcctctgttgatccaccgccacagctaggg

SEQ ID NO: 143967 - DNA, 35 bp, Artificial Sequence
  Synthetic oligonucleotide
tcttcacgtcgcaccctcgagtctcttcttgcctg

SEQ ID NO: 143968 - DNA, 35 bp, Artificial Sequence
  Synthetic oligonucleotide
gtccatgcacatgggcctgattttgcaccacccat

SEQ ID NO: 143969 - DNA, 35 bp, Artificial Sequence
  Synthetic oligonucleotide
atggggggaacgggggggagggaacgaatgctcat

SEQ ID NO: 143970 - DNA, 35 bp, Artificial Sequence
  Synthetic oligonucleotide
accgtcaccgcctaagtccaatgtccatcttccct

SEQ ID NO: 143971 - DNA, 35 bp, Artificial Sequence
  Synthetic oligonucleotide
tcaggccctaaccctgcattgtccacgagttcctt

SEQ ID NO: 143972 - DNA, 36 bp, Artificial Sequence
  Synthetic oligonucleotide
accggaaggaacggggggaattcggaggggaaataa

SEQ ID NO: 143973 - DNA, 36 bp, Artificial Sequence
  Synthetic oligonucleotide
tccccaccctacgcctcgcctcggtacccgctcaca

SEQ ID NO: 143974 - DNA, 36 bp, Artificial Sequence
  Synthetic oligonucleotide
tcacccccaacacacactcgtgctccttaagaccca

SEQ ID NO: 143975 - DNA, 36 bp, Artificial Sequence
  Synthetic oligonucleotide
tcaacgcattgcgctcgaagccaccccattctccca

SEQ ID NO: 143976 - DNA, 35 bp, Artificial Sequence
  Synthetic oligonucleotide
atccgacgctcccactgttttctctgattccgcca

SEQ ID NO: 143977 - DNA, 35 bp, Artificial Sequence
  Synthetic oligonucleotide
gacaccctatgtgttatactcttatctgcccctca

SEQ ID NO: 143978 - DNA, 36 bp, Artificial Sequence
  Synthetic oligonucleotide
tcagatggacggcggggtggtaaaagggggatgtca

SEQ ID NO: 143979 - DNA, 37 bp, Artificial Sequence
  Synthetic oligonucleotide
tgcctcctcccattcctttatgacagttcgggcaaga

SEQ ID NO: 143980 - DNA, 37 bp, Artificial Sequence
  Synthetic oligonucleotide
actaccccctcatgccaaaagctccctctttggcaga

SEQ ID NO: 143981 - DNA, 37 bp, Artificial Sequence
  Synthetic oligonucleotide
gtcgggtgggaaggcggtattagggcgggtaatccga

SEQ ID NO: 143982 - DNA, 37 bp, Artificial Sequence
  Synthetic oligonucleotide
gtctattccggcggaaggtgggggctggatggccgga

SEQ ID NO: 143983 - DNA, 36 bp, Artificial Sequence
  Synthetic oligonucleotide
gtccgggggtggtggggttcgatacaggcggtcgga

SEQ ID NO: 143984 - DNA, 37 bp, Artificial Sequence
  Synthetic oligonucleotide
gaggagggggggaacgaagctggattcagggctggga

SEQ ID NO: 143985 - DNA, 37 bp, Artificial Sequence
  Synthetic oligonucleotide
aacaggccccatctgccgcctcctcgatccaaatgga

SEQ ID NO: 143986 - DNA, 37 bp, Artificial Sequence
  Synthetic oligonucleotide
tataggtgggacgggtggaagggttctggggggtgga

SEQ ID NO: 143987 - DNA, 38 bp, Artificial Sequence
  Synthetic oligonucleotide
agatcaacgtggagggggggcgggataaggcaagatga

SEQ ID NO: 143988 - DNA, 37 bp, Artificial Sequence
  Synthetic oligonucleotide
gacaggtcgggaagggtgtgaggcgggagggtgatga

SEQ ID NO: 143989 - DNA, 37 bp, Artificial Sequence
  Synthetic oligonucleotide
tgatcggtcacatcgttatcacccgcccgacccgtga

SEQ ID NO: 143990 - DNA, 37 bp, Artificial Sequence
  Synthetic oligonucleotide
gcaccgcccgtcgtgcaccttgcttacctccccgtga

SEQ ID NO: 143991 - DNA, 38 bp, Artificial Sequence
  Synthetic oligonucleotide
acgttacccgccccattgttcaatcgactatctcgtga

SEQ ID NO: 143992 - DNA, 36 bp, Artificial Sequence
  Synthetic oligonucleotide
tgttggtgccctgccttgtcgacttccagttctcta

SEQ ID NO: 143993 - DNA, 35 bp, Artificial Sequence
  Synthetic oligonucleotide
atgctccacggcctacttgttcatccttgcctgta

SEQ ID NO: 143994 - DNA, 35 bp, Artificial Sequence
  Synthetic oligonucleotide
atatcccgctatgcttcccaggtagcctcctccac

SEQ ID NO: 143995 - DNA, 35 bp, Artificial Sequence
  Synthetic oligonucleotide
gtcgacgccccctatgcctcagttacgcccttccc

SEQ ID NO: 143996 - DNA, 35 bp, Artificial Sequence
  Synthetic oligonucleotide
gtcgcgcctttttatgcccgtcaggaccaccatcc

SEQ ID NO: 143997 - DNA, 35 bp, Artificial Sequence
  Synthetic oligonucleotide
agcgaagcgcgcacccgtacacttattaggcctcc

SEQ ID NO: 143998 - DNA, 35 bp, Artificial Sequence
  Synthetic oligonucleotide
ttgccaatccccaccatcgtgtcataggttgctcc

SEQ ID NO: 143999 - DNA, 35 bp, Artificial Sequence
  Synthetic oligonucleotide
tccgttcctctcgtccaattctgataccgtcctgc

SEQ ID NO: 144000 - DNA, 35 bp, Artificial Sequence
  Synthetic oligonucleotide
agtactcgctcctcgccaccatcccaggttgactc

SEQ ID NO: 144001 - DNA, 35 bp, Artificial Sequence
  Synthetic oligonucleotide
gtcccaggcccatctatcccaatctctcagtgctc

SEQ ID NO: 144002 - DNA, 35 bp, Artificial Sequence
  Synthetic oligonucleotide
gactgctccatcttgctgccacgacttatctattc

SEQ ID NO: 144003 - DNA, 35 bp, Artificial Sequence
  Synthetic oligonucleotide
gagagctccgactttcgttccttgtcccggtattc

SEQ ID NO: 144004 - DNA, 35 bp, Artificial Sequence
  Synthetic oligonucleotide
tcgcacttccctatggtcattcatctctctaccgg

SEQ ID NO: 144005 - DNA, 35 bp, Artificial Sequence
  Synthetic oligonucleotide
acacccctcccgctttcttttcgagactaacccgg

SEQ ID NO: 144006 - DNA, 35 bp, Artificial Sequence
  Synthetic oligonucleotide
acgaggagggggatcgcgtaagagggatgggtggg

SEQ ID NO: 144007 - DNA, 35 bp, Artificial Sequence
  Synthetic oligonucleotide
tcctgccccgcccgctgtagcccctaactcttttg

SEQ ID NO: 144008 - DNA, 35 bp, Artificial Sequence
  Synthetic oligonucleotide
tgacgtcccccttcagaacgttatctgcttttcct

SEQ ID NO: 144009 - DNA, 35 bp, Artificial Sequence
  Synthetic oligonucleotide
gttggatggtggataacactggaggaggtggggct

SEQ ID NO: 144010 - DNA, 35 bp, Artificial Sequence
  Synthetic oligonucleotide
tttcacccccccgacccaaggttagcccacgtgct

SEQ ID NO: 144011 - DNA, 35 bp, Artificial Sequence
  Synthetic oligonucleotide
ttcgaatcccctgccacatgagcctattaaactct

SEQ ID NO: 144012 - DNA, 35 bp, Artificial Sequence
  Synthetic oligonucleotide
acgcaacgcccatacctgctcccgttccgatccgt

SEQ ID NO: 144013 - DNA, 35 bp, Artificial Sequence
  Synthetic oligonucleotide
actgcgtcatctcgctcccccccttggtccgcctt

SEQ ID NO: 144014 - DNA, 35 bp, Artificial Sequence
  Synthetic oligonucleotide
tcctgcggaacgacgtctcccataccccgcgccca

SEQ ID NO: 144015 - DNA, 36 bp, Artificial Sequence
  Synthetic oligonucleotide
agcaccccacgctgcgtcccagttctgctcaatcca

SEQ ID NO: 144016 - DNA, 35 bp, Artificial Sequence
  Synthetic oligonucleotide
ggatccccgcacgtgtaccaccgatcccacctcca

SEQ ID NO: 144017 - DNA, 35 bp, Artificial Sequence
  Synthetic oligonucleotide
cggcctgccgcgtccgcgttctccctcgttctgca

SEQ ID NO: 144018 - DNA, 36 bp, Artificial Sequence
  Synthetic oligonucleotide
tcaaaccctgctccggccctcggtacttcgacttca

SEQ ID NO: 144019 - DNA, 36 bp, Artificial Sequence
  Synthetic oligonucleotide
gctccaaccgtctgcactctataccgatctccgcga

SEQ ID NO: 144020 - DNA, 37 bp, Artificial Sequence
  Synthetic oligonucleotide
tggggagtggcggtttccatcctagggcgttggggga

SEQ ID NO: 144021 - DNA, 38 bp, Artificial Sequence
  Synthetic oligonucleotide
gactgcctccaccgaacgtacgaccatcccattcatga

SEQ ID NO: 144022 - DNA, 38 bp, Artificial Sequence
  Synthetic oligonucleotide
gacgcactgcaagggtaggtgaggggagtgggagctga

SEQ ID NO: 144023 - DNA, 38 bp, Artificial Sequence
  Synthetic oligonucleotide
taacgagggtggaggggaagggcctaggaacgctgtga

SEQ ID NO: 144024 - DNA, 38 bp, Artificial Sequence
  Synthetic oligonucleotide
gccgcccgtgtgcgcacccctgttctccgtgcccttga

SEQ ID NO: 144025 - DNA, 37 bp, Artificial Sequence
  Synthetic oligonucleotide
accatacctcagtgccttttttgccaccctatcttga

SEQ ID NO: 144026 - DNA, 36 bp, Artificial Sequence
  Synthetic oligonucleotide
gatggggcgggaggggtcgggatggctaactcttga

SEQ ID NO: 144027 - DNA, 36 bp, Artificial Sequence
  Synthetic oligonucleotide
gcgacaccgcctttatcgtctatcctcagctccata

SEQ ID NO: 144028 - DNA, 36 bp, Artificial Sequence
  Synthetic oligonucleotide
gcgaagagagagaaggtaggcgcgatggggtaagta

SEQ ID NO: 144029 - DNA, 36 bp, Artificial Sequence
  Synthetic oligonucleotide
accccccgcccggcgtgagccctccgacccaaggta

SEQ ID NO: 144030 - DNA, 35 bp, Artificial Sequence
  Synthetic oligonucleotide
ttgccccgcaagctcccttctatccctcactggta

SEQ ID NO: 144031 - DNA, 35 bp, Artificial Sequence
  Synthetic oligonucleotide
gaatcaccatccacgaagggtctgctccccctcac

SEQ ID NO: 144032 - DNA, 35 bp, Artificial Sequence
  Synthetic oligonucleotide
gattgccgcccttctattcgatgcacagcccgccc

SEQ ID NO: 144033 - DNA, 35 bp, Artificial Sequence
  Synthetic oligonucleotide
ttgcgatgctcccgactcaagcgaccacacctccc

SEQ ID NO: 144034 - DNA, 35 bp, Artificial Sequence
  Synthetic oligonucleotide
acgcactgccccggccatagtacctgaacctaatc

SEQ ID NO: 144035 - DNA, 35 bp, Artificial Sequence
  Synthetic oligonucleotide
ttcactctcccgcaattgcatcctgggaccctctc

SEQ ID NO: 144036 - DNA, 35 bp, Artificial Sequence
  Synthetic oligonucleotide
gcttgcactccgattagtctcgttctcatgctctc

SEQ ID NO: 144037 - DNA, 35 bp, Artificial Sequence
  Synthetic oligonucleotide
tatgtcccggctattccccgcttagcgtgcctttc

SEQ ID NO: 144038 - DNA, 35 bp, Artificial Sequence
  Synthetic oligonucleotide
gagatgtgaagttgggtatgtggggcgggttaagg

SEQ ID NO: 144039 - DNA, 35 bp, Artificial Sequence
  Synthetic oligonucleotide
gtttcccgtccactctttttctttgcctgtccatg

SEQ ID NO: 144040 - DNA, 35 bp, Artificial Sequence
  Synthetic oligonucleotide
tgtgggaggggctcgggaaaaaagagatggggcat

SEQ ID NO: 144041 - DNA, 35 bp, Artificial Sequence
  Synthetic oligonucleotide
cccgccaaccgcctcccttatttatgccagtacct

SEQ ID NO: 144042 - DNA, 34 bp, Artificial Sequence
  Synthetic oligonucleotide
tttgcccctacggttcatacggtatctccgccct

SEQ ID NO: 144043 - DNA, 35 bp, Artificial Sequence
  Synthetic oligonucleotide
tgtacggtcctcgctcccgtgcacttgttcccgtt

SEQ ID NO: 144044 - DNA, 35 bp, Artificial Sequence
  Synthetic oligonucleotide
agacggggggtaggggggggaagatgcgtagagaa

SEQ ID NO: 144045 - DNA, 36 bp, Artificial Sequence
  Synthetic oligonucleotide
tccaccttcccttgactctgagtgcgcgatctccca

SEQ ID NO: 144046 - DNA, 35 bp, Artificial Sequence
  Synthetic oligonucleotide
accatcacaggtgctcccgcctcgaacctgctcca

SEQ ID NO: 144047 - DNA, 35 bp, Artificial Sequence
  Synthetic oligonucleotide
aactgatctcccgcctggctatacgccccgttgca

SEQ ID NO: 144048 - DNA, 35 bp, Artificial Sequence
  Synthetic oligonucleotide
gcacttctcagcggtgtcgggcccttctctattca

SEQ ID NO: 144049 - DNA, 37 bp, Artificial Sequence
  Synthetic oligonucleotide
ttccaaccgctgccccttcacgccaatctgcctacga

SEQ ID NO: 144050 - DNA, 37 bp, Artificial Sequence
  Synthetic oligonucleotide
gcgcacgttctcatcgccgcccgaatacgttccccga

SEQ ID NO: 144051 - DNA, 37 bp, Artificial Sequence
  Synthetic oligonucleotide
agaagtacaggaggggggcgagggaatcatgcgagga

SEQ ID NO: 144052 - DNA, 37 bp, Artificial Sequence
  Synthetic oligonucleotide
gatacagtgaaaatacggggacggggggcagttagga

SEQ ID NO: 144053 - DNA, 37 bp, Artificial Sequence
  Synthetic oligonucleotide
aaggtaggagggtagatatcggggaagggctcgggga

SEQ ID NO: 144054 - DNA, 38 bp, Artificial Sequence
  Synthetic oligonucleotide
aatgcggggaaaacggggcggaggacaggtcttagtga

SEQ ID NO: 144055 - DNA, 36 bp, Artificial Sequence
  Synthetic oligonucleotide
gcactccaactctgcccgtatctctcactaccgtga

SEQ ID NO: 144056 - DNA, 38 bp, Artificial Sequence
  Synthetic oligonucleotide
tactcgcttcctggcgcacatgccgaccccctccgtga

SEQ ID NO: 144057 - DNA, 38 bp, Artificial Sequence
  Synthetic oligonucleotide
agtggaggggcggttagaggaccgagggagggttgtga

SEQ ID NO: 144058 - DNA, 36 bp, Artificial Sequence
  Synthetic oligonucleotide
tgtctaccccagcgctggctcctatctaccgtttta

SEQ ID NO: 144059 - DNA, 36 bp, Artificial Sequence
  Synthetic oligonucleotide
atcaccttcgcgctgagctaatattcgcccttttta

SEQ ID NO: 144060 - DNA, 35 bp, Artificial Sequence
  Synthetic oligonucleotide
acacccgccgtcattaatcacttagtcctgtgcac

SEQ ID NO: 144061 - DNA, 35 bp, Artificial Sequence
  Synthetic oligonucleotide
gagcccgcccgctatggtactcgtttcgccagccc

SEQ ID NO: 144062 - DNA, 35 bp, Artificial Sequence
  Synthetic oligonucleotide
tcgcatagtgcatgcgccgcggcctcaccctcgcc

SEQ ID NO: 144063 - DNA, 35 bp, Artificial Sequence
  Synthetic oligonucleotide
gtccccctccactccgcgcccgagatgcctgtgcc

SEQ ID NO: 144064 - DNA, 35 bp, Artificial Sequence
  Synthetic oligonucleotide
tggacacgagccttcatactgcctcccacgattcc

SEQ ID NO: 144065 - DNA, 35 bp, Artificial Sequence
  Synthetic oligonucleotide
atgcagccaccggtcgcctctacttcctcttacgc

SEQ ID NO: 144066 - DNA, 35 bp, Artificial Sequence
  Synthetic oligonucleotide
tactcggttcaattgcgctgcacccttctcctcgc

SEQ ID NO: 144067 - DNA, 35 bp, Artificial Sequence
  Synthetic oligonucleotide
gccgtccgggtacgccatgcactacgctcttcatc

SEQ ID NO: 144068 - DNA, 35 bp, Artificial Sequence
  Synthetic oligonucleotide
aagcaccccgtcctcattctcctccgcgtctactc

SEQ ID NO: 144069 - DNA, 35 bp, Artificial Sequence
  Synthetic oligonucleotide
tgcaccgtagcatcatccgtccccgtctgaccctc

SEQ ID NO: 144070 - DNA, 35 bp, Artificial Sequence
  Synthetic oligonucleotide
accaaccaactgcccgcgggccttgcctttgcctc

SEQ ID NO: 144071 - DNA, 35 bp, Artificial Sequence
  Synthetic oligonucleotide
aatgcctcggctgtcgctatcgcccctttatcttc

SEQ ID NO: 144072 - DNA, 35 bp, Artificial Sequence
  Synthetic oligonucleotide
gtactccccgcccatctaactcggctaatgagacg

SEQ ID NO: 144073 - DNA, 35 bp, Artificial Sequence
  Synthetic oligonucleotide
gcacacccaatcctttgtgcaaccccgtttatccg

SEQ ID NO: 144074 - DNA, 35 bp, Artificial Sequence
  Synthetic oligonucleotide
gtccaacgccgaaattctcacctccgtactctgcg

SEQ ID NO: 144075 - DNA, 35 bp, Artificial Sequence
  Synthetic oligonucleotide
tccgccccagtatcgcgagtaaccctacccctcgg

SEQ ID NO: 144076 - DNA, 35 bp, Artificial Sequence
  Synthetic oligonucleotide
gtctccctgaccatgcatacggcccatcctacctg

SEQ ID NO: 144077 - DNA, 35 bp, Artificial Sequence
  Synthetic oligonucleotide
cccgacatccgccattccagtctccgtcgttcact

SEQ ID NO: 144078 - DNA, 35 bp, Artificial Sequence
  Synthetic oligonucleotide
gggatcctgccccgtactgccctttccacccttct

SEQ ID NO: 144079 - DNA, 35 bp, Artificial Sequence
  Synthetic oligonucleotide
tttccgatccccgacgtcccttgtcataccgttct

SEQ ID NO: 144080 - DNA, 35 bp, Artificial Sequence
  Synthetic oligonucleotide
tacgacgcctgcttcctcctcccgcattcagcagt

SEQ ID NO: 144081 - DNA, 34 bp, Artificial Sequence
  Synthetic oligonucleotide
actagcccaggccctctcgcgagtggtcaccctt

SEQ ID NO: 144082 - DNA, 36 bp, Artificial Sequence
  Synthetic oligonucleotide
aagccgggggggtgggctgggatagggatttatgaa

SEQ ID NO: 144083 - DNA, 36 bp, Artificial Sequence
  Synthetic oligonucleotide
atgacgaagggaggaaggcagggacaggcaaggtaa

SEQ ID NO: 144084 - DNA, 35 bp, Artificial Sequence
  Synthetic oligonucleotide
actcctcccccatgtgagatctgcttcccggccca

SEQ ID NO: 144085 - DNA, 36 bp, Artificial Sequence
  Synthetic oligonucleotide
gcaacgagttgcatagcgatcgttttccttggtcca

SEQ ID NO: 144086 - DNA, 36 bp, Artificial Sequence
  Synthetic oligonucleotide
tgcgccacgtaccgtcctgtgctggcccctcactca

SEQ ID NO: 144087 - DNA, 36 bp, Artificial Sequence
  Synthetic oligonucleotide
tatgcccatgctagtcatgcatccttcctcccttca

SEQ ID NO: 144088 - DNA, 37 bp, Artificial Sequence
  Synthetic oligonucleotide
gagtgagggacgaggggtaaggctggaggagtgtaga

SEQ ID NO: 144089 - DNA, 37 bp, Artificial Sequence
  Synthetic oligonucleotide
tcatgcacccctgttctgtactttgtgaaccacccga

SEQ ID NO: 144090 - DNA, 37 bp, Artificial Sequence
  Synthetic oligonucleotide
gcccagccactgctttactcccccactctatctgcga

SEQ ID NO: 144091 - DNA, 35 bp, Artificial Sequence
  Synthetic oligonucleotide
tacagaggcgtgggggaaaggtgaagggagtgcga

SEQ ID NO: 144092 - DNA, 36 bp, Artificial Sequence
  Synthetic oligonucleotide
ttacgcacctttcacctttcgtttccatacagtcga

SEQ ID NO: 144093 - DNA, 35 bp, Artificial Sequence
  Synthetic oligonucleotide
agaccgccccacccttttcagcgacgtattactga

SEQ ID NO: 144094 - DNA, 37 bp, Artificial Sequence
  Synthetic oligonucleotide
gacgtggctgttggccctctatagtacttcctcctga

SEQ ID NO: 144095 - DNA, 36 bp, Artificial Sequence
  Synthetic oligonucleotide
gagggtgagggtagtgggaggaaggcgaatgtgtga

SEQ ID NO: 144096 - DNA, 37 bp, Artificial Sequence
  Synthetic oligonucleotide
tccacctttcctcacttggataccgatcggttcttga

SEQ ID NO: 144097 - DNA, 37 bp, Artificial Sequence
  Synthetic oligonucleotide
tccctcctccgcgccccatcacggtcatgcaagttga

SEQ ID NO: 144098 - DNA, 36 bp, Artificial Sequence
  Synthetic oligonucleotide
tttccccctcccgccttgtatccaggttcggttata

SEQ ID NO: 144099 - DNA, 35 bp, Artificial Sequence
  Synthetic oligonucleotide
gttccgtcggacaccacacacccctgcccaccgta

SEQ ID NO: 144100 - DNA, 36 bp, Artificial Sequence
  Synthetic oligonucleotide
attatgtccacctgtctatcctgtccgttattggta

SEQ ID NO: 144101 - DNA, 36 bp, Artificial Sequence
  Synthetic oligonucleotide
gctgactatcccagcacgtctgagcccccacgtgta

SEQ ID NO: 144102 - DNA, 35 bp, Artificial Sequence
  Synthetic oligonucleotide
atagaccgtccgctgagcttcgtttccctcgccac

SEQ ID NO: 144103 - DNA, 35 bp, Artificial Sequence
  Synthetic oligonucleotide
gctgtagcacatactagtgatttcccgccgccacc

SEQ ID NO: 144104 - DNA, 35 bp, Artificial Sequence
  Synthetic oligonucleotide
ttcacccgcattggcttccaccccgacttaatccc

SEQ ID NO: 144105 - DNA, 35 bp, Artificial Sequence
  Synthetic oligonucleotide
gtcctccgcccgcacggtcctcttccccttgtgcc

SEQ ID NO: 144106 - DNA, 35 bp, Artificial Sequence
  Synthetic oligonucleotide
agttcacctccggcccctgtcttcaagctctatcc

SEQ ID NO: 144107 - DNA, 35 bp, Artificial Sequence
  Synthetic oligonucleotide
gtgttatcgccattgcagttgctcccccttgtcgc

SEQ ID NO: 144108 - DNA, 35 bp, Artificial Sequence
  Synthetic oligonucleotide
tgtcctcgggccgttgtcctcttccatgctgaatc

SEQ ID NO: 144109 - DNA, 35 bp, Artificial Sequence
  Synthetic oligonucleotide
gtgaccctatagctcgactagcccaccgtttcctc

SEQ ID NO: 144110 - DNA, 35 bp, Artificial Sequence
  Synthetic oligonucleotide
gcatcaacatgcacccttcgctctcgacacccttc

SEQ ID NO: 144111 - DNA, 35 bp, Artificial Sequence
  Synthetic oligonucleotide
aattccgcccctacctattctttgtactgcctacg

SEQ ID NO: 144112 - DNA, 35 bp, Artificial Sequence
  Synthetic oligonucleotide
tctacgggtggaaggtggtgggtgggtggtttacg

SEQ ID NO: 144113 - DNA, 35 bp, Artificial Sequence
  Synthetic oligonucleotide
tgcgcctgccttaactgtcattgcttcatagtccg

SEQ ID NO: 144114 - DNA, 35 bp, Artificial Sequence
  Synthetic oligonucleotide
aactgccccgtccggttgtcctgttccgtggttcg

SEQ ID NO: 144115 - DNA, 35 bp, Artificial Sequence
  Synthetic oligonucleotide
gcgagcgcgagttaggcggaaaagggtggggaagg

SEQ ID NO: 144116 - DNA, 35 bp, Artificial Sequence
  Synthetic oligonucleotide
tgtacagagcgaggggaaggtggggcaggagaggg

SEQ ID NO: 144117 - DNA, 35 bp, Artificial Sequence
  Synthetic oligonucleotide
ggggggaggggtatggttcggggtctagtttgggg

SEQ ID NO: 144118 - DNA, 35 bp, Artificial Sequence
  Synthetic oligonucleotide
gctacgcaccactgtacccctccgttcatcctctg

SEQ ID NO: 144119 - DNA, 35 bp, Artificial Sequence
  Synthetic oligonucleotide
gtcgcctcgttcccagcttcccacaccccgtacct

SEQ ID NO: 144120 - DNA, 35 bp, Artificial Sequence
  Synthetic oligonucleotide
tgtgtatccgtccccttacgcacgatccctgtcct

SEQ ID NO: 144121 - DNA, 35 bp, Artificial Sequence
  Synthetic oligonucleotide
gttcgccacccagcctgccatattcctcgcacagt

SEQ ID NO: 144122 - DNA, 35 bp, Artificial Sequence
  Synthetic oligonucleotide
gcaggcccgccgggagtgcgcacttccttctcctt

SEQ ID NO: 144123 - DNA, 35 bp, Artificial Sequence
  Synthetic oligonucleotide
gtcacttccagcctgcctttggtcgcctatttctt

SEQ ID NO: 144124 - DNA, 35 bp, Artificial Sequence
  Synthetic oligonucleotide
actcacagccccaccagtttcacggcgtgcccttt

SEQ ID NO: 144125 - DNA, 35 bp, Artificial Sequence
  Synthetic oligonucleotide
gatcgtaccgtatcgtgttccatgtgccttccttt

SEQ ID NO: 144126 - DNA, 36 bp, Artificial Sequence
  Synthetic oligonucleotide
tcactcttccgcccatgtaacgcattgttaccataa

SEQ ID NO: 144127 - DNA, 36 bp, Artificial Sequence
  Synthetic oligonucleotide
agccccaccaatcctgccctactagctgttaactaa

SEQ ID NO: 144128 - DNA, 36 bp, Artificial Sequence
  Synthetic oligonucleotide
tgttgcaagccgtctacctgcataccccggccctaa

SEQ ID NO: 144129 - DNA, 36 bp, Artificial Sequence
  Synthetic oligonucleotide
caccgccgccacgttcgtctaccacattcaccggca

SEQ ID NO: 144130 - DNA, 35 bp, Artificial Sequence
  Synthetic oligonucleotide
accaccgccccatgctgtctcctttgcatccttca

SEQ ID NO: 144131 - DNA, 37 bp, Artificial Sequence
  Synthetic oligonucleotide
actatcccgccctctgttgttcgtaggtgctccacga

SEQ ID NO: 144132 - DNA, 36 bp, Artificial Sequence
  Synthetic oligonucleotide
cttgccccgccccggcactacatcccatcctgagga

SEQ ID NO: 144133 - DNA, 36 bp, Artificial Sequence
  Synthetic oligonucleotide
ttgacatgccttccacctgttctccgccttcccgga

SEQ ID NO: 144134 - DNA, 35 bp, Artificial Sequence
  Synthetic oligonucleotide
tagaagcagttatgggtgaggaggggggggaggga

SEQ ID NO: 144135 - DNA, 36 bp, Artificial Sequence
  Synthetic oligonucleotide
tactacacatgggagggtggggagactaggtcggga

SEQ ID NO: 144136 - DNA, 37 bp, Artificial Sequence
  Synthetic oligonucleotide
gtgtaggagtcgggcgggttgaagggggccgggtgga

SEQ ID NO: 144137 - DNA, 37 bp, Artificial Sequence
  Synthetic oligonucleotide
gtgcactccgttgcattacgcaccttccatcgcatga

SEQ ID NO: 144138 - DNA, 38 bp, Artificial Sequence
  Synthetic oligonucleotide
ggtggtcgtgggggggggtagaagggcaggcgcactga

SEQ ID NO: 144139 - DNA, 37 bp, Artificial Sequence
  Synthetic oligonucleotide
gtccacgcccgcgctaccctcaacgtttcctgcctga

SEQ ID NO: 144140 - DNA, 38 bp, Artificial Sequence
  Synthetic oligonucleotide
gccgcccctactgctaatttacccgtacaccatcgtga

SEQ ID NO: 144141 - DNA, 38 bp, Artificial Sequence
  Synthetic oligonucleotide
ttgtgagggggagtggtggcggggagaatacgatgtga

SEQ ID NO: 144142 - DNA, 37 bp, Artificial Sequence
  Synthetic oligonucleotide
gcgctggggtggggtgctccttataggggtagattga

SEQ ID NO: 144143 - DNA, 38 bp, Artificial Sequence
  Synthetic oligonucleotide
agcgggagaggtacgggggcatagtacggggaagttga

SEQ ID NO: 144144 - DNA, 35 bp, Artificial Sequence
  Synthetic oligonucleotide
gacaaccaccctggtcctcatccattaccttggta

SEQ ID NO: 144145 - DNA, 35 bp, Artificial Sequence
  Synthetic oligonucleotide
ttcccgccgaatggcctttatcccacactgctgta

SEQ ID NO: 144146 - DNA, 35 bp, Artificial Sequence
  Synthetic oligonucleotide
gcctgcccgtaccggcgcataacaagccaacccac

SEQ ID NO: 144147 - DNA, 35 bp, Artificial Sequence
  Synthetic oligonucleotide
gatacaccttctggggctggaccgaccactcccac

SEQ ID NO: 144148 - DNA, 35 bp, Artificial Sequence
  Synthetic oligonucleotide
tcaagccggttgccgttgtctcgtctagccctcac

SEQ ID NO: 144149 - DNA, 35 bp, Artificial Sequence
  Synthetic oligonucleotide
tccacgttatagcgcgcgtaactccacccattcac

SEQ ID NO: 144150 - DNA, 35 bp, Artificial Sequence
  Synthetic oligonucleotide
gcaccctctcctactcggtgccggtatcccttcac

SEQ ID NO: 144151 - DNA, 35 bp, Artificial Sequence
  Synthetic oligonucleotide
tagcggacgtcgccaccatcgtagtcccgcccacc

SEQ ID NO: 144152 - DNA, 35 bp, Artificial Sequence
  Synthetic oligonucleotide
gtacaacgggtgggcgggatgctgggcggtccccc

SEQ ID NO: 144153 - DNA, 35 bp, Artificial Sequence
  Synthetic oligonucleotide
aaatactcgcctggttgccccttggttgttctccc

SEQ ID NO: 144154 - DNA, 35 bp, Artificial Sequence
  Synthetic oligonucleotide
gtagagccaccgcacgtgcttacgcccccacttcc

SEQ ID NO: 144155 - DNA, 35 bp, Artificial Sequence
  Synthetic oligonucleotide
gctttaagctgcctcctccgtgctccctgtccagc

SEQ ID NO: 144156 - DNA, 35 bp, Artificial Sequence
  Synthetic oligonucleotide
acacccgaatatgtccttgcacacgttctctccgc

SEQ ID NO: 144157 - DNA, 35 bp, Artificial Sequence
  Synthetic oligonucleotide
gtactcctccgaccccaggctctttaacgccgtgc

SEQ ID NO: 144158 - DNA, 35 bp, Artificial Sequence
  Synthetic oligonucleotide
ggatacacaccaccactgctgttaatcatgccatc

SEQ ID NO: 144159 - DNA, 35 bp, Artificial Sequence
  Synthetic oligonucleotide
acaccctctacaacctggcatacgatctgcatctc

SEQ ID NO: 144160 - DNA, 35 bp, Artificial Sequence
  Synthetic oligonucleotide
cacccccaccaccagtggtgttcgatctacttctc

SEQ ID NO: 144161 - DNA, 35 bp, Artificial Sequence
  Synthetic oligonucleotide
taaacctccgcctgatcgtaccgtcgtcatgtttc

SEQ ID NO: 144162 - DNA, 35 bp, Artificial Sequence
  Synthetic oligonucleotide
attgcccccccacactgttgtctcccaaacgctag

SEQ ID NO: 144163 - DNA, 35 bp, Artificial Sequence
  Synthetic oligonucleotide
acagcatgcatccctcctgatccttacctcatgcg

SEQ ID NO: 144164 - DNA, 35 bp, Artificial Sequence
  Synthetic oligonucleotide
aacccccctctacctacgtgcagtgaacttcttcg

SEQ ID NO: 144165 - DNA, 35 bp, Artificial Sequence
  Synthetic oligonucleotide
ggagacggactagaaagagtagggagggcgaaggg

SEQ ID NO: 144166 - DNA, 35 bp, Artificial Sequence
  Synthetic oligonucleotide
agacatactgccatctgccaccttttgggcccact

SEQ ID NO: 144167 - DNA, 35 bp, Artificial Sequence
  Synthetic oligonucleotide
gcctaccgttttctgctgctggttcacgacctcct

SEQ ID NO: 144168 - DNA, 35 bp, Artificial Sequence
  Synthetic oligonucleotide
taccctccctccgtccgccagtcttttccaaagct

SEQ ID NO: 144169 - DNA, 35 bp, Artificial Sequence
  Synthetic oligonucleotide
aggaccggggtgggggaatgggcgaggtggggcgt

SEQ ID NO: 144170 - DNA, 35 bp, Artificial Sequence
  Synthetic oligonucleotide
gaccccatccgctttgtagattaatctccgcacaa

SEQ ID NO: 144171 - DNA, 36 bp, Artificial Sequence
  Synthetic oligonucleotide
tagatgcaacggggcgaggcgggtgggtcaggacaa

SEQ ID NO: 144172 - DNA, 35 bp, Artificial Sequence
  Synthetic oligonucleotide
tggatgcatgcatccagcgtatcccccatctgcca

SEQ ID NO: 144173 - DNA, 36 bp, Artificial Sequence
  Synthetic oligonucleotide
atcgccggagaccattgtcatacgctccctaatcca

SEQ ID NO: 144174 - DNA, 36 bp, Artificial Sequence
  Synthetic oligonucleotide
agtactgccccgactagttcgcgcccctttattgca

SEQ ID NO: 144175 - DNA, 36 bp, Artificial Sequence
  Synthetic oligonucleotide
tacgtaacgctagatcctggttgcacgccgccctca

SEQ ID NO: 144176 - DNA, 35 bp, Artificial Sequence
  Synthetic oligonucleotide
tgatcacaccgtgccgccacaactgcattcattca

SEQ ID NO: 144177 - DNA, 35 bp, Artificial Sequence
  Synthetic oligonucleotide
atgggagggggcggttgggaatcgaacagcggaga

SEQ ID NO: 144178 - DNA, 37 bp, Artificial Sequence
  Synthetic oligonucleotide
agagagtatcgaggggcgaggggaacaatgggaggga

SEQ ID NO: 144179 - DNA, 37 bp, Artificial Sequence
  Synthetic oligonucleotide
acaccagggacacggggtggtgggggttgcaagggga

SEQ ID NO: 144180 - DNA, 36 bp, Artificial Sequence
  Synthetic oligonucleotide
tagggaacggactctaatgacaacgggaggggggga

SEQ ID NO: 144181 - DNA, 37 bp, Artificial Sequence
  Synthetic oligonucleotide
ggggttggcggccttcagtcgttaaggaggaggtgga

SEQ ID NO: 144182 - DNA, 38 bp, Artificial Sequence
  Synthetic oligonucleotide
gtctgctggccacccgtgcttacgccctccgctactga

SEQ ID NO: 144183 - DNA, 36 bp, Artificial Sequence
  Synthetic oligonucleotide
gattacgtcgaccacctccctgagcccctctcctga

SEQ ID NO: 144184 - DNA, 37 bp, Artificial Sequence
  Synthetic oligonucleotide
ttccgctcccgcctcgttttattggttctccagctga

SEQ ID NO: 144185 - DNA, 38 bp, Artificial Sequence
  Synthetic oligonucleotide
aatgaatgggaacgtgcggggaggggataaaggggtga

SEQ ID NO: 144186 - DNA, 37 bp, Artificial Sequence
  Synthetic oligonucleotide
ttccccccccgccgttcgtcagtaatcccatcgttga

SEQ ID NO: 144187 - DNA, 36 bp, Artificial Sequence
  Synthetic oligonucleotide
tttagcctgccccgctgcatgccattcgcccatata

SEQ ID NO: 144188 - DNA, 35 bp, Artificial Sequence
  Synthetic oligonucleotide
gccccccacatcgccccctgaactcgtaggcttta

SEQ ID NO: 144189 - DNA, 35 bp, Artificial Sequence
  Synthetic oligonucleotide
acccccatcattggtctgtctggtttttggtccac

SEQ ID NO: 144190 - DNA, 35 bp, Artificial Sequence
  Synthetic oligonucleotide
gagctctcccacccattccggtttagggccctcac

SEQ ID NO: 144191 - DNA, 35 bp, Artificial Sequence
  Synthetic oligonucleotide
gccaggtagcctgtattgtgctgccatcatcttcc

SEQ ID NO: 144192 - DNA, 35 bp, Artificial Sequence
  Synthetic oligonucleotide
gtgccaccgtgatccgtcccatcatccggctcttc

SEQ ID NO: 144193 - DNA, 33 bp, Artificial Sequence
  Synthetic oligonucleotide
acacgccggccccatccgttatccacttctctg

SEQ ID NO: 144194 - DNA, 35 bp, Artificial Sequence
  Synthetic oligonucleotide
gggtgactcgcctgcttaattgccgtacttctcct

SEQ ID NO: 144195 - DNA, 35 bp, Artificial Sequence
  Synthetic oligonucleotide
tccccatcacagatctcaccgttaccgccgcataa

SEQ ID NO: 144196 - DNA, 35 bp, Artificial Sequence
  Synthetic oligonucleotide
tctgacctcccactccctgtccacgccatccgaca

SEQ ID NO: 144197 - DNA, 36 bp, Artificial Sequence
  Synthetic oligonucleotide
gtcccgcccagcattggtctagtgccttcacctaca

SEQ ID NO: 144198 - DNA, 36 bp, Artificial Sequence
  Synthetic oligonucleotide
tgggtgggcgggtaggggacatccaccaagagtaca

SEQ ID NO: 144199 - DNA, 35 bp, Artificial Sequence
  Synthetic oligonucleotide
tgatacggtccgcccatcatcggctcataccatca

SEQ ID NO: 144200 - DNA, 35 bp, Artificial Sequence
  Synthetic oligonucleotide
tgctcgtaagcccggctgtaactgtcaccacctca

SEQ ID NO: 144201 - DNA, 36 bp, Artificial Sequence
  Synthetic oligonucleotide
gtccatcctctgcctgacctgaacgtctaccgttca

SEQ ID NO: 144202 - DNA, 37 bp, Artificial Sequence
  Synthetic oligonucleotide
tgggggggtagcaggggaggggtgatggaactcgcga

SEQ ID NO: 144203 - DNA, 35 bp, Artificial Sequence
  Synthetic oligonucleotide
aaggtgaaggagctgggaaagggggacatgggcga

SEQ ID NO: 144204 - DNA, 37 bp, Artificial Sequence
  Synthetic oligonucleotide
gatgcgtgcagggggagggaagtggcgagggtatcga

SEQ ID NO: 144205 - DNA, 33 bp, Artificial Sequence
  Synthetic oligonucleotide
atcccatcgccctcggtatatccgctacacgga

SEQ ID NO: 144206 - DNA, 37 bp, Artificial Sequence
  Synthetic oligonucleotide
acatgtgcgaagggcggggtgggtaggagctatggga

SEQ ID NO: 144207 - DNA, 37 bp, Artificial Sequence
  Synthetic oligonucleotide
acaatctgcgccgcctcgttcgttccttatagcctga

SEQ ID NO: 144208 - DNA, 38 bp, Artificial Sequence
  Synthetic oligonucleotide
gggtggaggaagggacggaaggaggatcagtgtcgtga

SEQ ID NO: 144209 - DNA, 36 bp, Artificial Sequence
  Synthetic oligonucleotide
aatagtgcggggtggggggatactggtaagggagta

SEQ ID NO: 144210 - DNA, 35 bp, Artificial Sequence
  Synthetic oligonucleotide
ttaccttccctgtccgctggtcattaccgccttta

SEQ ID NO: 144211 - DNA, 35 bp, Artificial Sequence
  Synthetic oligonucleotide
gacgctacacaatccatcacaggctgaacgccccc

SEQ ID NO: 144212 - DNA, 35 bp, Artificial Sequence
  Synthetic oligonucleotide
gttattcccggccccaccttcttatggcgctgccc

SEQ ID NO: 144213 - DNA, 35 bp, Artificial Sequence
  Synthetic oligonucleotide
tacacgacccgtatccttatatccgttggcttgcc

SEQ ID NO: 144214 - DNA, 35 bp, Artificial Sequence
  Synthetic oligonucleotide
acgcatcccgatcccgtggagtttgtcacctgtcc

SEQ ID NO: 144215 - DNA, 35 bp, Artificial Sequence
  Synthetic oligonucleotide
tgttactctgcgcaaaggccgcccccgaaccttcc

SEQ ID NO: 144216 - DNA, 35 bp, Artificial Sequence
  Synthetic oligonucleotide
gacctcgcccacaaagcccaccgaccccgccttcc

SEQ ID NO: 144217 - DNA, 35 bp, Artificial Sequence
  Synthetic oligonucleotide
atgccctcggtttgtcgccctttgttcttgtttcc

SEQ ID NO: 144218 - DNA, 35 bp, Artificial Sequence
  Synthetic oligonucleotide
gaataggcgcaccccagcctcacatccactcacgc

SEQ ID NO: 144219 - DNA, 35 bp, Artificial Sequence
  Synthetic oligonucleotide
tcaccctaacctctgccccactccgtgcgacccgc

SEQ ID NO: 144220 - DNA, 35 bp, Artificial Sequence
  Synthetic oligonucleotide
tctgactgacctttcgctatgctattatttcccgc

SEQ ID NO: 144221 - DNA, 35 bp, Artificial Sequence
  Synthetic oligonucleotide
tgatagggccatcagtacttcccgttctccgccgc

SEQ ID NO: 144222 - DNA, 35 bp, Artificial Sequence
  Synthetic oligonucleotide
acccccgcaacgcccctcatttgaaccgtacgtgc

SEQ ID NO: 144223 - DNA, 35 bp, Artificial Sequence
  Synthetic oligonucleotide
tagcgcccaatttcgttagtcgtccgtctcgcatc

SEQ ID NO: 144224 - DNA, 35 bp, Artificial Sequence
  Synthetic oligonucleotide
atccttgccctcaatccccaccgctcctgcgagtc

SEQ ID NO: 144225 - DNA, 35 bp, Artificial Sequence
  Synthetic oligonucleotide
actcaccctcagggtcttcccagccaccttgagtc

SEQ ID NO: 144226 - DNA, 35 bp, Artificial Sequence
  Synthetic oligonucleotide
tttgcgttatcatgctctcccgtcctcctgtcacg

SEQ ID NO: 144227 - DNA, 35 bp, Artificial Sequence
  Synthetic oligonucleotide
tacacagtcgccccttccgacgcccacatcccccg

SEQ ID NO: 144228 - DNA, 35 bp, Artificial Sequence
  Synthetic oligonucleotide
atgcgtgtacccctgcccgatccgccctgtccccg

SEQ ID NO: 144229 - DNA, 35 bp, Artificial Sequence
  Synthetic oligonucleotide
gccacctttgtaatgttcggttactacgccctccg

SEQ ID NO: 144230 - DNA, 35 bp, Artificial Sequence
  Synthetic oligonucleotide
gcaggtgttgaggggggctagagggtaggacgatg

SEQ ID NO: 144231 - DNA, 35 bp, Artificial Sequence
  Synthetic oligonucleotide
ggcgggcctcgctcgtcctatactcacgcttccat

SEQ ID NO: 144232 - DNA, 35 bp, Artificial Sequence
  Synthetic oligonucleotide
accgcgcgaacaggttccctaccccgcccgcttat

SEQ ID NO: 144233 - DNA, 35 bp, Artificial Sequence
  Synthetic oligonucleotide
gtcgagatacctgtgcatgtgccgcctaccaccct

SEQ ID NO: 144234 - DNA, 35 bp, Artificial Sequence
  Synthetic oligonucleotide
agcccccgaccttgtctactgttcgcgcataccct

SEQ ID NO: 144235 - DNA, 35 bp, Artificial Sequence
  Synthetic oligonucleotide
gattccgccattgcgactatatgctacttccccct

SEQ ID NO: 144236 - DNA, 35 bp, Artificial Sequence
  Synthetic oligonucleotide
aggtcacgttcgttcttctgtccttggtcccatct

SEQ ID NO: 144237 - DNA, 35 bp, Artificial Sequence
  Synthetic oligonucleotide
gaccaccccggtaatagttcctgtctctcacaagt

SEQ ID NO: 144238 - DNA, 35 bp, Artificial Sequence
  Synthetic oligonucleotide
ggtcacttaccgccacccgcaccacttacgttcgt

SEQ ID NO: 144239 - DNA, 36 bp, Artificial Sequence
  Synthetic oligonucleotide
ttagtgtgccatccgggagcgtgcccttaccacctt

SEQ ID NO: 144240 - DNA, 29 bp, Artificial Sequence
  Synthetic oligonucleotide
agctgccgttgttctgtaccccccctctt

SEQ ID NO: 144241 - DNA, 35 bp, Artificial Sequence
  Synthetic oligonucleotide
actcccatccttcttgattcgctttatctgacgtt

SEQ ID NO: 144242 - DNA, 36 bp, Artificial Sequence
  Synthetic oligonucleotide
agtacaccgccccattttatacccgtctttttcaaa

SEQ ID NO: 144243 - DNA, 36 bp, Artificial Sequence
  Synthetic oligonucleotide
gcatccgcccgctcactaacaacctgcacccttgaa

SEQ ID NO: 144244 - DNA, 36 bp, Artificial Sequence
  Synthetic oligonucleotide
tatgcgttgtagtcccccgctctgttttttgccaca

SEQ ID NO: 144245 - DNA, 36 bp, Artificial Sequence
  Synthetic oligonucleotide
gtaacacctcaccgctccccgcagtggcccctccca

SEQ ID NO: 144246 - DNA, 35 bp, Artificial Sequence
  Synthetic oligonucleotide
gaactccaccctgagatgcgcacctgaacgctcca

SEQ ID NO: 144247 - DNA, 35 bp, Artificial Sequence
  Synthetic oligonucleotide
acctctccatgtgctcgcaggctcccctcgcccga

SEQ ID NO: 144248 - DNA, 37 bp, Artificial Sequence
  Synthetic oligonucleotide
actgagggtcagctccgccattgtctcccctcttcga

SEQ ID NO: 144249 - DNA, 36 bp, Artificial Sequence
  Synthetic oligonucleotide
gagtgccagggtagggtggggagggcccgcgtagga

SEQ ID NO: 144250 - DNA, 37 bp, Artificial Sequence
  Synthetic oligonucleotide
gccacgggcggggttgtgttttgttggggagagggga

SEQ ID NO: 144251 - DNA, 37 bp, Artificial Sequence
  Synthetic oligonucleotide
atcgacctcgcccctcgggtctcccccccctcctgga

SEQ ID NO: 144252 - DNA, 35 bp, Artificial Sequence
  Synthetic oligonucleotide
gcgcccatccacatgccgtccgccgccaccaatga

SEQ ID NO: 144253 - DNA, 38 bp, Artificial Sequence
  Synthetic oligonucleotide
gaggggttggaggtggtgatggggtgggagtgggatga

SEQ ID NO: 144254 - DNA, 37 bp, Artificial Sequence
  Synthetic oligonucleotide
gcctcgagcgcacataacgccccccgtcgcccactga

SEQ ID NO: 144255 - DNA, 37 bp, Artificial Sequence
  Synthetic oligonucleotide
gactctgttgccctgatccccttcaccccctccgtga

SEQ ID NO: 144256 - DNA, 35 bp, Artificial Sequence
  Synthetic oligonucleotide
tcgcactgctcctcgattcgctctacccctgctac

SEQ ID NO: 144257 - DNA, 35 bp, Artificial Sequence
  Synthetic oligonucleotide
gccgcctgtacattccgcccgttgctacctcaacc

SEQ ID NO: 144258 - DNA, 35 bp, Artificial Sequence
  Synthetic oligonucleotide
aacgatgccgccttatgacgaagtacgcccgcccc

SEQ ID NO: 144259 - DNA, 36 bp, Artificial Sequence
  Synthetic oligonucleotide
tccaccgtcgtttttgtcagctgtactcgcttgccc

SEQ ID NO: 144260 - DNA, 35 bp, Artificial Sequence
  Synthetic oligonucleotide
gaccgcacttctctcaccctatcgtgactctcgcc

SEQ ID NO: 144261 - DNA, 35 bp, Artificial Sequence
  Synthetic oligonucleotide
gcaccgctcccgtggtttcactgttcactgcctcc

SEQ ID NO: 144262 - DNA, 35 bp, Artificial Sequence
  Synthetic oligonucleotide
taaccgaagggcgggaagggtcgggtagttatcgc

SEQ ID NO: 144263 - DNA, 35 bp, Artificial Sequence
  Synthetic oligonucleotide
tcagtgcctgcccaggtttaacgtgccccctactc

SEQ ID NO: 144264 - DNA, 35 bp, Artificial Sequence
  Synthetic oligonucleotide
atgcccactgccacgttctctgacactcgtttttc

SEQ ID NO: 144265 - DNA, 35 bp, Artificial Sequence
  Synthetic oligonucleotide
gttgttggagggagggcgggaggcctaagacatag

SEQ ID NO: 144266 - DNA, 35 bp, Artificial Sequence
  Synthetic oligonucleotide
taccgcccgcctagcccttgttgctctagtactcg

SEQ ID NO: 144267 - DNA, 35 bp, Artificial Sequence
  Synthetic oligonucleotide
taagagagaagaaaacggctggaggagacaggggg

SEQ ID NO: 144268 - DNA, 35 bp, Artificial Sequence
  Synthetic oligonucleotide
tgggttagggaagcaggagggggacgcaagtgggg

SEQ ID NO: 144269 - DNA, 35 bp, Artificial Sequence
  Synthetic oligonucleotide
aatgggggaggtagaggagtgctggggggtggatg

SEQ ID NO: 144270 - DNA, 34 bp, Artificial Sequence
  Synthetic oligonucleotide
tctctcccctggctgaccctgctcacatcctttg

SEQ ID NO: 144271 - DNA, 35 bp, Artificial Sequence
  Synthetic oligonucleotide
ttccatcggtctgaattctatccttcgttcgccct

SEQ ID NO: 144272 - DNA, 35 bp, Artificial Sequence
  Synthetic oligonucleotide
tttccgcatccccctgtcccacccgagtcgcaagt

SEQ ID NO: 144273 - DNA, 35 bp, Artificial Sequence
  Synthetic oligonucleotide
cacccaagccagctcatgccctgttcccactccgt

SEQ ID NO: 144274 - DNA, 35 bp, Artificial Sequence
  Synthetic oligonucleotide
gcgcagggacccatctgcgtcaccccccacgtggt

SEQ ID NO: 144275 - DNA, 35 bp, Artificial Sequence
  Synthetic oligonucleotide
acaatcctgccggtcgcctgttcccttgtacgatt

SEQ ID NO: 144276 - DNA, 35 bp, Artificial Sequence
  Synthetic oligonucleotide
gcaaacgacggtacggggatgaaggggatgaggaa

SEQ ID NO: 144277 - DNA, 36 bp, Artificial Sequence
  Synthetic oligonucleotide
taagagtccggcgcgcattcctgaaccccgacccca

SEQ ID NO: 144278 - DNA, 36 bp, Artificial Sequence
  Synthetic oligonucleotide
tgacgtcctgcccgctactcgcctgtcggtttttca

SEQ ID NO: 144279 - DNA, 37 bp, Artificial Sequence
  Synthetic oligonucleotide
tcaatggagcgttacaccgggggggcggggagggcga

SEQ ID NO: 144280 - DNA, 36 bp, Artificial Sequence
  Synthetic oligonucleotide
tgcccctcgcccccctcttcagtctcactctggcga

SEQ ID NO: 144281 - DNA, 37 bp, Artificial Sequence
  Synthetic oligonucleotide
atcccgcctcttttgctacgattcttccctacaagga

SEQ ID NO: 144282 - DNA, 37 bp, Artificial Sequence
  Synthetic oligonucleotide
acgggccatgtgagttaggggatggggaggggaggga

SEQ ID NO: 144283 - DNA, 37 bp, Artificial Sequence
  Synthetic oligonucleotide
ggggcgggccggaagccaatagaggggtttttgggga

SEQ ID NO: 144284 - DNA, 34 bp, Artificial Sequence
  Synthetic oligonucleotide
gaaacatggaagagtacgggggagataacatgga

SEQ ID NO: 144285 - DNA, 38 bp, Artificial Sequence
  Synthetic oligonucleotide
tcagaacgcgtgcgtctacgcccatccacctcgcctga

SEQ ID NO: 144286 - DNA, 38 bp, Artificial Sequence
  Synthetic oligonucleotide
gctgggtgcggaaaagggtcgagggagggtggtggtga

SEQ ID NO: 144287 - DNA, 38 bp, Artificial Sequence
  Synthetic oligonucleotide
tacgccgaccgctgccccttgtgtcaccttttcattga

SEQ ID NO: 144288 - DNA, 36 bp, Artificial Sequence
  Synthetic oligonucleotide
gccatcacctccgatctagtcttcccacagcctata

SEQ ID NO: 144289 - DNA, 35 bp, Artificial Sequence
  Synthetic oligonucleotide
gtctacggcctggtctaacgtcacccttcgcccta

SEQ ID NO: 144290 - DNA, 36 bp, Artificial Sequence
  Synthetic oligonucleotide
tgcaccccccccgaccctctgccatcgttacggtta

SEQ ID NO: 144291 - DNA, 35 bp, Artificial Sequence
  Synthetic oligonucleotide
gaacacgtccgttgtctacaccccgcctttaccac

SEQ ID NO: 144292 - DNA, 35 bp, Artificial Sequence
  Synthetic oligonucleotide
accgtccgccgctaccgccaactaacgccatgtac

SEQ ID NO: 144293 - DNA, 35 bp, Artificial Sequence
  Synthetic oligonucleotide
tgtaggtccgccgttgtttttgcttattttccacc

SEQ ID NO: 144294 - DNA, 35 bp, Artificial Sequence
  Synthetic oligonucleotide
gtgcgttaccgccctgaattcgccatactttcccc

SEQ ID NO: 144295 - DNA, 35 bp, Artificial Sequence
  Synthetic oligonucleotide
gctccctcacccactctatgcctcaggtgtccgcc

SEQ ID NO: 144296 - DNA, 35 bp, Artificial Sequence
  Synthetic oligonucleotide
gatgcgagcgattcccccgtttatctacactcgcc

SEQ ID NO: 144297 - DNA, 35 bp, Artificial Sequence
  Synthetic oligonucleotide
tcatcgctgcccatttccgttctacgaaactctcc

SEQ ID NO: 144298 - DNA, 34 bp, Artificial Sequence
  Synthetic oligonucleotide
taaaggtccgccctttcttccgccatagccctgc

SEQ ID NO: 144299 - DNA, 35 bp, Artificial Sequence
  Synthetic oligonucleotide
gatgcgaagatgatttctctattgcccccctgtgc

SEQ ID NO: 144300 - DNA, 35 bp, Artificial Sequence
  Synthetic oligonucleotide
tcgaccccacttgttagaacctctcggtcctgctc

SEQ ID NO: 144301 - DNA, 35 bp, Artificial Sequence
  Synthetic oligonucleotide
tctgcgtccatctcctcactttagtcctggccgtc

SEQ ID NO: 144302 - DNA, 34 bp, Artificial Sequence
  Synthetic oligonucleotide
ttcgtactcacactcccggcttgttgccccattc

SEQ ID NO: 144303 - DNA, 35 bp, Artificial Sequence
  Synthetic oligonucleotide
tgtggcccatcccaccgccgcccaccttgcccacg

SEQ ID NO: 144304 - DNA, 36 bp, Artificial Sequence
  Synthetic oligonucleotide
atgatgcacagtagagggggggaccgaggtgaaagg

SEQ ID NO: 144305 - DNA, 35 bp, Artificial Sequence
  Synthetic oligonucleotide
aaggaggaggggcgggtggatagtgctctggttgg

SEQ ID NO: 144306 - DNA, 35 bp, Artificial Sequence
  Synthetic oligonucleotide
gagggggcaaggaactgggcgggtggtagctgatg

SEQ ID NO: 144307 - DNA, 35 bp, Artificial Sequence
  Synthetic oligonucleotide
ttcacccgaggttattttatgcaccgcctcccact

SEQ ID NO: 144308 - DNA, 35 bp, Artificial Sequence
  Synthetic oligonucleotide
gtgcaaacccgctttatacagtgctattgccacct

SEQ ID NO: 144309 - DNA, 35 bp, Artificial Sequence
  Synthetic oligonucleotide
atggtcagcccgcgatcacctgtcattctccccct

SEQ ID NO: 144310 - DNA, 35 bp, Artificial Sequence
  Synthetic oligonucleotide
gccatgaggtgttgtgtccgccgcccttcgtccgt

SEQ ID NO: 144311 - DNA, 35 bp, Artificial Sequence
  Synthetic oligonucleotide
tgagggggggaactgagcgggaagtctgggagggt

SEQ ID NO: 144312 - DNA, 35 bp, Artificial Sequence
  Synthetic oligonucleotide
acttcaccgcgggcgggagggatagcaagttgggt

SEQ ID NO: 144313 - DNA, 36 bp, Artificial Sequence
  Synthetic oligonucleotide
gtcctgccccattttgtcgcctactgatttatccaa

SEQ ID NO: 144314 - DNA, 36 bp, Artificial Sequence
  Synthetic oligonucleotide
tgccaagtgacatggacgggcgaaaggggaagggaa

SEQ ID NO: 144315 - DNA, 29 bp, Artificial Sequence
  Synthetic oligonucleotide
ccatcgactctgacacctcgccgccctca

SEQ ID NO: 144316 - DNA, 36 bp, Artificial Sequence
  Synthetic oligonucleotide
atctccctccgatgagcttctgccatcagcctctca

SEQ ID NO: 144317 - DNA, 36 bp, Artificial Sequence
  Synthetic oligonucleotide
tgcaacccagcccatccctggcccaacgtacgttca

SEQ ID NO: 144318 - DNA, 36 bp, Artificial Sequence
  Synthetic oligonucleotide
tgcacgcattattgcctgagttctgccttcatttca

SEQ ID NO: 144319 - DNA, 37 bp, Artificial Sequence
  Synthetic oligonucleotide
gtcatgtgtggaaggcgagggaggaggggaagaacga

SEQ ID NO: 144320 - DNA, 37 bp, Artificial Sequence
  Synthetic oligonucleotide
tctgctccctcacactgccgcttacgttaacagccga

SEQ ID NO: 144321 - DNA, 37 bp, Artificial Sequence
  Synthetic oligonucleotide
tgcctcctccctgttgttttattggccatcactccga

SEQ ID NO: 144322 - DNA, 37 bp, Artificial Sequence
  Synthetic oligonucleotide
tgtaaggccggaggggtgggaagcgggtaggtaagga

SEQ ID NO: 144323 - DNA, 37 bp, Artificial Sequence
  Synthetic oligonucleotide
gtaccgatcgctcccttctaatatcctgtccctcgga

SEQ ID NO: 144324 - DNA, 38 bp, Artificial Sequence
  Synthetic oligonucleotide
gttaacccccgcttatcccacccccacagacgacctga

SEQ ID NO: 144325 - DNA, 37 bp, Artificial Sequence
  Synthetic oligonucleotide
tctgccccactctccttttacgggaccgctcccctga

SEQ ID NO: 144326 - DNA, 37 bp, Artificial Sequence
  Synthetic oligonucleotide
tgtcacgcaaaggggaggggcctgaatgagggggtga

SEQ ID NO: 144327 - DNA, 37 bp, Artificial Sequence
  Synthetic oligonucleotide
tgtgttcgcccacatgcactaccctgcaacccattga

SEQ ID NO: 144328 - DNA, 38 bp, Artificial Sequence
  Synthetic oligonucleotide
tccaacgccctgtgcctagcgatccccggctcccttga

SEQ ID NO: 144329 - DNA, 37 bp, Artificial Sequence
  Synthetic oligonucleotide
tggatccggctccattgtttcttttcctccgctttga

SEQ ID NO: 144330 - DNA, 35 bp, Artificial Sequence
  Synthetic oligonucleotide
attcccccccgagcacctgtgtatcccgcttagta

SEQ ID NO: 144331 - DNA, 36 bp, Artificial Sequence
  Synthetic oligonucleotide
gaccccacctctcatgtcggactccagactgcttta

SEQ ID NO: 144332 - DNA, 35 bp, Artificial Sequence
  Synthetic oligonucleotide
tataccgcacttggccccctcgttgtcatcgtaac

SEQ ID NO: 144333 - DNA, 35 bp, Artificial Sequence
  Synthetic oligonucleotide
accgacccgaccggaaattcacgtaacggcccacc

SEQ ID NO: 144334 - DNA, 35 bp, Artificial Sequence
  Synthetic oligonucleotide
gcaacccgttagtgtctcgttcctcctatcacccc

SEQ ID NO: 144335 - DNA, 35 bp, Artificial Sequence
  Synthetic oligonucleotide
aaccaccacctactccggtttctggccttaaggcc

SEQ ID NO: 144336 - DNA, 35 bp, Artificial Sequence
  Synthetic oligonucleotide
gaacgccaagcagcctttctgcttaagcccactcc

SEQ ID NO: 144337 - DNA, 35 bp, Artificial Sequence
  Synthetic oligonucleotide
tcagtggcctctgcttgaaccctgtacagtcctcc

SEQ ID NO: 144338 - DNA, 35 bp, Artificial Sequence
  Synthetic oligonucleotide
gcctccccacagtcctccttgagcctggctccagc

SEQ ID NO: 144339 - DNA, 35 bp, Artificial Sequence
  Synthetic oligonucleotide
gtgtggtcgcctgttctatcctccgggtcccctgc

SEQ ID NO: 144340 - DNA, 35 bp, Artificial Sequence
  Synthetic oligonucleotide
tttggctcctgccccacgcccgcagtttattcctc

SEQ ID NO: 144341 - DNA, 35 bp, Artificial Sequence
  Synthetic oligonucleotide
cattcagaatccgtgcgcatatactcccgccgctc

SEQ ID NO: 144342 - DNA, 35 bp, Artificial Sequence
  Synthetic oligonucleotide
gatgaggcctgcccactgccgttcactcatttctc

SEQ ID NO: 144343 - DNA, 35 bp, Artificial Sequence
  Synthetic oligonucleotide
tcctcaccctgtgatcttaatgtccccctctagtc

SEQ ID NO: 144344 - DNA, 35 bp, Artificial Sequence
  Synthetic oligonucleotide
gtcgcgcgatacttcttctgcatctggtctctttc

SEQ ID NO: 144345 - DNA, 35 bp, Artificial Sequence
  Synthetic oligonucleotide
tcttgccccatcagtcccgtaatttagcccgtccg

SEQ ID NO: 144346 - DNA, 35 bp, Artificial Sequence
  Synthetic oligonucleotide
gaggacaagttggcaggtggggagggcgggatcgg

SEQ ID NO: 144347 - DNA, 34 bp, Artificial Sequence
  Synthetic oligonucleotide
tgccctccgccgtttcctctcctgtactccctgt

SEQ ID NO: 144348 - DNA, 35 bp, Artificial Sequence
  Synthetic oligonucleotide
atgcccttcacgtggttgcctactttctttcttgt

SEQ ID NO: 144349 - DNA, 34 bp, Artificial Sequence
  Synthetic oligonucleotide
tttaccatcatgtctgtcacatcccttcccggaa

SEQ ID NO: 144350 - DNA, 36 bp, Artificial Sequence
  Synthetic oligonucleotide
gttgacctccgctcctgttccgggttatacctttaa

SEQ ID NO: 144351 - DNA, 31 bp, Artificial Sequence
  Synthetic oligonucleotide
gctcccgcccggtcttgcaaggcccaccaca

SEQ ID NO: 144352 - DNA, 36 bp, Artificial Sequence
  Synthetic oligonucleotide
ccccctctccgattgggtgataaacaccacactcca

SEQ ID NO: 144353 - DNA, 37 bp, Artificial Sequence
  Synthetic oligonucleotide
gcggggagggggttgggcggaacggggagcaggtaga

SEQ ID NO: 144354 - DNA, 37 bp, Artificial Sequence
  Synthetic oligonucleotide
aagtcgggcggaagggaacattggggggggagcagga

SEQ ID NO: 144355 - DNA, 35 bp, Artificial Sequence
  Synthetic oligonucleotide
agtaaccaccctctcgctctgtgccgttccacgga

SEQ ID NO: 144356 - DNA, 37 bp, Artificial Sequence
  Synthetic oligonucleotide
ggggggtaatacggggaggaggctggcacccggcgga

SEQ ID NO: 144357 - DNA, 38 bp, Artificial Sequence
  Synthetic oligonucleotide
acgcgcccaccttgcgcttacaccccgcctctttatga

SEQ ID NO: 144358 - DNA, 38 bp, Artificial Sequence
  Synthetic oligonucleotide
tttcgtccagatgtcttcccccattgcgttccacctga

SEQ ID NO: 144359 - DNA, 38 bp, Artificial Sequence
  Synthetic oligonucleotide
accaccctcccgcctcgcacgagaggtcttccccctga

SEQ ID NO: 144360 - DNA, 38 bp, Artificial Sequence
  Synthetic oligonucleotide
gtgccctcgctgaaatatggcatgccctcctcccctga

SEQ ID NO: 144361 - DNA, 36 bp, Artificial Sequence
  Synthetic oligonucleotide
acaatgcgcctcttcgttatgttatcgcccttctga

SEQ ID NO: 144362 - DNA, 30 bp, Artificial Sequence
  Synthetic oligonucleotide
gcctgaggtcgacctacaagcccccccgta

SEQ ID NO: 144363 - DNA, 38 bp, Artificial Sequence
  Synthetic oligonucleotide
gacaaagggcgaggggaggagcaagtttgtcgggtgta

SEQ ID NO: 144364 - DNA, 35 bp, Artificial Sequence
  Synthetic oligonucleotide
tcgactaccatcagcgggtaccatcactgtcctac

SEQ ID NO: 144365 - DNA, 35 bp, Artificial Sequence
  Synthetic oligonucleotide
gcgccacccctgctccctgttcttgacgtcgctac

SEQ ID NO: 144366 - DNA, 35 bp, Artificial Sequence
  Synthetic oligonucleotide
tgtcctcccacggtttacggtttccgatttcgccc

SEQ ID NO: 144367 - DNA, 35 bp, Artificial Sequence
  Synthetic oligonucleotide
ggacgtacaccacgtcgttcacttactttcctccc

SEQ ID NO: 144368 - DNA, 35 bp, Artificial Sequence
  Synthetic oligonucleotide
gccccgataccgggtactgctatacatctctcgcc

SEQ ID NO: 144369 - DNA, 29 bp, Artificial Sequence
  Synthetic oligonucleotide
atgtgacatctcctccggttccttgctcc

SEQ ID NO: 144370 - DNA, 35 bp, Artificial Sequence
  Synthetic oligonucleotide
taccgccctatggtgacttttgcccgctttcttcc

SEQ ID NO: 144371 - DNA, 35 bp, Artificial Sequence
  Synthetic oligonucleotide
tgaaggcggaggggggcgggggagcagtactgagc

SEQ ID NO: 144372 - DNA, 35 bp, Artificial Sequence
  Synthetic oligonucleotide
accgacacgccccatatcgcctggcctgttctagc

SEQ ID NO: 144373 - DNA, 35 bp, Artificial Sequence
  Synthetic oligonucleotide
tgctgaccccatacctggtgtaaccgcttccttgc

SEQ ID NO: 144374 - DNA, 34 bp, Artificial Sequence
  Synthetic oligonucleotide
gtagtacccaccgtccgagccctctacacgcatc

SEQ ID NO: 144375 - DNA, 35 bp, Artificial Sequence
  Synthetic oligonucleotide
tgagccggaactatgctctcctcctttttaacctc

SEQ ID NO: 144376 - DNA, 35 bp, Artificial Sequence
  Synthetic oligonucleotide
gcccacctgcctcagggccgcagtgcatgcccctc

SEQ ID NO: 144377 - DNA, 35 bp, Artificial Sequence
  Synthetic oligonucleotide
gggggcatcccctgcctgcaccttccatggctctc

SEQ ID NO: 144378 - DNA, 35 bp, Artificial Sequence
  Synthetic oligonucleotide
tccaacgcggtcacacctgactgagttccgccttc

SEQ ID NO: 144379 - DNA, 35 bp, Artificial Sequence
  Synthetic oligonucleotide
gagatcccgccccatcgacactcacctgcagtgag

SEQ ID NO: 144380 - DNA, 35 bp, Artificial Sequence
  Synthetic oligonucleotide
gcgaaaccggagggagtggggaggggatgttttag

SEQ ID NO: 144381 - DNA, 35 bp, Artificial Sequence
  Synthetic oligonucleotide
aagccaccacggcacacccttcccttggacccccg

SEQ ID NO: 144382 - DNA, 35 bp, Artificial Sequence
  Synthetic oligonucleotide
acaaatggaggcgatggacggaaggtggtgggcgg

SEQ ID NO: 144383 - DNA, 35 bp, Artificial Sequence
  Synthetic oligonucleotide
gtggtcctagcaatgttatcgatcctccactactg

SEQ ID NO: 144384 - DNA, 35 bp, Artificial Sequence
  Synthetic oligonucleotide
ttacccgcggccctcgtcctacttcccccctgctg

SEQ ID NO: 144385 - DNA, 32 bp, Artificial Sequence
  Synthetic oligonucleotide
gtgcgacgtgtcaatgttttcctgcgttccat

SEQ ID NO: 144386 - DNA, 35 bp, Artificial Sequence
  Synthetic oligonucleotide
tgtccacctcaccctttatcgtattcgttctcgat

SEQ ID NO: 144387 - DNA, 35 bp, Artificial Sequence
  Synthetic oligonucleotide
atcccggccgcctctcccctggttggctccttact

SEQ ID NO: 144388 - DNA, 35 bp, Artificial Sequence
  Synthetic oligonucleotide
ttcactcacctatgcgccacccgacccagacccct

SEQ ID NO: 144389 - DNA, 35 bp, Artificial Sequence
  Synthetic oligonucleotide
agccgactcttcctggtacactggccatccgccct

SEQ ID NO: 144390 - DNA, 35 bp, Artificial Sequence
  Synthetic oligonucleotide
agcagacgcccgcacatgcctccacgcaatccctt

SEQ ID NO: 144391 - DNA, 35 bp, Artificial Sequence
  Synthetic oligonucleotide
agtggggggtggggtagtagtgttgggcactgaaa

SEQ ID NO: 144392 - DNA, 36 bp, Artificial Sequence
  Synthetic oligonucleotide
tggatctgcctccacatatgcattccgtacctacaa

SEQ ID NO: 144393 - DNA, 36 bp, Artificial Sequence
  Synthetic oligonucleotide
gtctacgccgggctccttctccatgtccatgctcaa

SEQ ID NO: 144394 - DNA, 35 bp, Artificial Sequence
  Synthetic oligonucleotide
gcacgagccctctgccggtctcaggtcctgttcaa

SEQ ID NO: 144395 - DNA, 36 bp, Artificial Sequence
  Synthetic oligonucleotide
gcctccggcctcgatcgctgcactacccttcatcca

SEQ ID NO: 144396 - DNA, 36 bp, Artificial Sequence
  Synthetic oligonucleotide
tactgccccccgtccttcgaacgtctcctagatcca

SEQ ID NO: 144397 - DNA, 36 bp, Artificial Sequence
  Synthetic oligonucleotide
gatccaacccgccccacgacttgtcaatacactgca

SEQ ID NO: 144398 - DNA, 35 bp, Artificial Sequence
  Synthetic oligonucleotide
tcaaaagcgctgtacccttgctccatgtccttgca

SEQ ID NO: 144399 - DNA, 35 bp, Artificial Sequence
  Synthetic oligonucleotide
gtaccgtccgaatccgtcggcccacattcccatca

SEQ ID NO: 144400 - DNA, 37 bp, Artificial Sequence
  Synthetic oligonucleotide
acgccaacctcacctctaggcccactgtaatctccga

SEQ ID NO: 144401 - DNA, 37 bp, Artificial Sequence
  Synthetic oligonucleotide
gcagtccggaggaggggaaggaacggaggggttgcga

SEQ ID NO: 144402 - DNA, 38 bp, Artificial Sequence
  Synthetic oligonucleotide
tttggggccagtcacgggtggggaactgttcgtgggga

SEQ ID NO: 144403 - DNA, 38 bp, Artificial Sequence
  Synthetic oligonucleotide
gcgaccccgcatgtgtacgccacacccctcgcttatga

SEQ ID NO: 144404 - DNA, 36 bp, Artificial Sequence
  Synthetic oligonucleotide
tctgtcgactcgaatagttacccgcctcctccttga

SEQ ID NO: 144405 - DNA, 36 bp, Artificial Sequence
  Synthetic oligonucleotide
atgcccccttcacttgggtcctctatctgatcttga

SEQ ID NO: 144406 - DNA, 38 bp, Artificial Sequence
  Synthetic oligonucleotide
ttcccccctcaggccgaatgagccgctgtttttcttga

SEQ ID NO: 144407 - DNA, 38 bp, Artificial Sequence
  Synthetic oligonucleotide
gaaagagggcgtaacaggttgggggcggggatggttga

SEQ ID NO: 144408 - DNA, 35 bp, Artificial Sequence
  Synthetic oligonucleotide
gttctcacccctggcccacccacgatgccgtgcta

SEQ ID NO: 144409 - DNA, 35 bp, Artificial Sequence
  Synthetic oligonucleotide
tacgccaccgccatcatacataggcaccatgacac

SEQ ID NO: 144410 - DNA, 35 bp, Artificial Sequence
  Synthetic oligonucleotide
tacgttcccgtacgctgcaacaaggcctttccacc

SEQ ID NO: 144411 - DNA, 35 bp, Artificial Sequence
  Synthetic oligonucleotide
gtggggacggctgctgttcgccccgtttacttacc

SEQ ID NO: 144412 - DNA, 35 bp, Artificial Sequence
  Synthetic oligonucleotide
ttccgcaaccaacgcaagttatcaccgaacacccc

SEQ ID NO: 144413 - DNA, 35 bp, Artificial Sequence
  Synthetic oligonucleotide
acgccagtgtatccgttcccgtccactatagcccc

SEQ ID NO: 144414 - DNA, 35 bp, Artificial Sequence
  Synthetic oligonucleotide
gcacgtccgagtatgaatgttcgcgccgcctcccc

SEQ ID NO: 144415 - DNA, 35 bp, Artificial Sequence
  Synthetic oligonucleotide
gctatcctgaaagcgcatcccctgccgtactgccc

SEQ ID NO: 144416 - DNA, 35 bp, Artificial Sequence
  Synthetic oligonucleotide
tgtaaacatcccccagcgtgctatgcgcaccggcc

SEQ ID NO: 144417 - DNA, 35 bp, Artificial Sequence
  Synthetic oligonucleotide
tggtaccctccgtattgttgcattctcatcactcc

SEQ ID NO: 144418 - DNA, 35 bp, Artificial Sequence
  Synthetic oligonucleotide
tccccccccggacttgattcacaggacctgaccgc

SEQ ID NO: 144419 - DNA, 35 bp, Artificial Sequence
  Synthetic oligonucleotide
tgactacactgccttggtcttttaatcgctctcgc

SEQ ID NO: 144420 - DNA, 35 bp, Artificial Sequence
  Synthetic oligonucleotide
taccccccgacatttctgccgcaaaaggcttctgc

SEQ ID NO: 144421 - DNA, 35 bp, Artificial Sequence
  Synthetic oligonucleotide
tgcgggtcgccacatcttgcatttcgactatcatc

SEQ ID NO: 144422 - DNA, 35 bp, Artificial Sequence
  Synthetic oligonucleotide
tccgatttcatcgcctcatgcctaacttgctcatc

SEQ ID NO: 144423 - DNA, 35 bp, Artificial Sequence
  Synthetic oligonucleotide
tgaccgtgtctaaccgtccatgctatccctgtatc

SEQ ID NO: 144424 - DNA, 35 bp, Artificial Sequence
  Synthetic oligonucleotide
gtcgcatacccttctgtccaccgttcctgttattc

SEQ ID NO: 144425 - DNA, 35 bp, Artificial Sequence
  Synthetic oligonucleotide
ggaaaccgcttgaccgtccgcctcccgctccctag

SEQ ID NO: 144426 - DNA, 35 bp, Artificial Sequence
  Synthetic oligonucleotide
gtgcgaaaggcaccaccacagctcccgtccccccg

SEQ ID NO: 144427 - DNA, 35 bp, Artificial Sequence
  Synthetic oligonucleotide
gtcacccgtcatatatggcctaccacactcgcccg

SEQ ID NO: 144428 - DNA, 35 bp, Artificial Sequence
  Synthetic oligonucleotide
accactcctcgtttcgccagcaccgctattttccg

SEQ ID NO: 144429 - DNA, 35 bp, Artificial Sequence
  Synthetic oligonucleotide
ttgacccccccgcgcccgcgttcgccgcaccatgg

SEQ ID NO: 144430 - DNA, 35 bp, Artificial Sequence
  Synthetic oligonucleotide
gtcgtcgcccgctcgtctttcgacgattaccacct

SEQ ID NO: 144431 - DNA, 35 bp, Artificial Sequence
  Synthetic oligonucleotide
gctcactggactggctatcttcttgcggtttctct

SEQ ID NO: 144432 - DNA, 35 bp, Artificial Sequence
  Synthetic oligonucleotide
tgagttgcctcgccgccgtattttcaatcccgtct

SEQ ID NO: 144433 - DNA, 35 bp, Artificial Sequence
  Synthetic oligonucleotide
gagttccaccgcttcctctcgcccgcctgatgcgt

SEQ ID NO: 144434 - DNA, 35 bp, Artificial Sequence
  Synthetic oligonucleotide
acccacgcactatttaatacggtcgtgcccccctt

SEQ ID NO: 144435 - DNA, 34 bp, Artificial Sequence
  Synthetic oligonucleotide
tgcacactacaccctttccgctcgcagacaagtt

SEQ ID NO: 144436 - DNA, 35 bp, Artificial Sequence
  Synthetic oligonucleotide
ttgcaaagggcacgccgctctcgccctcccccgtt

SEQ ID NO: 144437 - DNA, 36 bp, Artificial Sequence
  Synthetic oligonucleotide
tcccactcgcccctacatgatacgtgacaacggaaa

SEQ ID NO: 144438 - DNA, 36 bp, Artificial Sequence
  Synthetic oligonucleotide
aaggatacggaagggggggggtagaggggagggaaa

SEQ ID NO: 144439 - DNA, 36 bp, Artificial Sequence
  Synthetic oligonucleotide
tcctgtcctcacttatccgtattccttgcatgcaca

SEQ ID NO: 144440 - DNA, 36 bp, Artificial Sequence
  Synthetic oligonucleotide
acgtgcgcacttatcacctgtcatgacccatacgca

SEQ ID NO: 144441 - DNA, 36 bp, Artificial Sequence
  Synthetic oligonucleotide
tcacgtccctcacccccagtcttcgctgttcgctca

SEQ ID NO: 144442 - DNA, 35 bp, Artificial Sequence
  Synthetic oligonucleotide
agccaccgcacagtacgtctgcccccgttctgtca

SEQ ID NO: 144443 - DNA, 37 bp, Artificial Sequence
  Synthetic oligonucleotide
tatgcggggaaggggtatgggaggagggtagtaaaga

SEQ ID NO: 144444 - DNA, 36 bp, Artificial Sequence
  Synthetic oligonucleotide
tcccaacacgaggttaccgtactgccttatcttcga

SEQ ID NO: 144445 - DNA, 37 bp, Artificial Sequence
  Synthetic oligonucleotide
gatgaaggccgatagtggagcggacggggacgaggga

SEQ ID NO: 144446 - DNA, 38 bp, Artificial Sequence
  Synthetic oligonucleotide
ttcgggcgggtgagggggggtatgaagcccagaagtga

SEQ ID NO: 144447 - DNA, 38 bp, Artificial Sequence
  Synthetic oligonucleotide
aagagaggggggatacggaaggagcgcggaggggttga

SEQ ID NO: 144448 - DNA, 38 bp, Artificial Sequence
  Synthetic oligonucleotide
gctgccgaaatggcgtgggagggagggaattttgttga

SEQ ID NO: 144449 - DNA, 37 bp, Artificial Sequence
  Synthetic oligonucleotide
tgtgttggtgagagggtgggggggaccttatatttga

SEQ ID NO: 144450 - DNA, 35 bp, Artificial Sequence
  Synthetic oligonucleotide
gctccatctcggtcgtaattgcccccatacagcac

SEQ ID NO: 144451 - DNA, 35 bp, Artificial Sequence
  Synthetic oligonucleotide
aacgccccgagcccttctcgctctctcctagtgac

SEQ ID NO: 144452 - DNA, 35 bp, Artificial Sequence
  Synthetic oligonucleotide
gctcgtgacatacttcttcctgcctggctacaccc

SEQ ID NO: 144453 - DNA, 35 bp, Artificial Sequence
  Synthetic oligonucleotide
acgcatcattatgcaaagcaccacccgcatcgccc

SEQ ID NO: 144454 - DNA, 35 bp, Artificial Sequence
  Synthetic oligonucleotide
acccaccctctgaggcctactctatttgctgagcc

SEQ ID NO: 144455 - DNA, 35 bp, Artificial Sequence
  Synthetic oligonucleotide
aaccccgcctgcattcgcacattggaagtcttcgc

SEQ ID NO: 144456 - DNA, 35 bp, Artificial Sequence
  Synthetic oligonucleotide
tacagccccgcacctcttcccccgcctgtgttcgc

SEQ ID NO: 144457 - DNA, 35 bp, Artificial Sequence
  Synthetic oligonucleotide
tgatcgcacacgtcatcgccgtcttccctattggc

SEQ ID NO: 144458 - DNA, 35 bp, Artificial Sequence
  Synthetic oligonucleotide
acacatccgggtaggatattggcccttctactctc

SEQ ID NO: 144459 - DNA, 35 bp, Artificial Sequence
  Synthetic oligonucleotide
aacccccaccggtcccttcccgccgcacattcttc

SEQ ID NO: 144460 - DNA, 35 bp, Artificial Sequence
  Synthetic oligonucleotide
aggaccctcctcacctgcgtgactgtgaccccacg

SEQ ID NO: 144461 - DNA, 35 bp, Artificial Sequence
  Synthetic oligonucleotide
tctcgcgcacttatctcatttgtctcccgtccacg

SEQ ID NO: 144462 - DNA, 35 bp, Artificial Sequence
  Synthetic oligonucleotide
tccctactcgcttttcccacctcgttattgagacg

SEQ ID NO: 144463 - DNA, 35 bp, Artificial Sequence
  Synthetic oligonucleotide
cccttgccccatcagtctctaccccccctttagcg

SEQ ID NO: 144464 - DNA, 35 bp, Artificial Sequence
  Synthetic oligonucleotide
tcctgtcatccgtctacactctgcccctctcttcg

SEQ ID NO: 144465 - DNA, 35 bp, Artificial Sequence
  Synthetic oligonucleotide
gtacggggagggggggtggtagtggactgaggagg

SEQ ID NO: 144466 - DNA, 35 bp, Artificial Sequence
  Synthetic oligonucleotide
gacggtgacacccgccttctctttcgctcttttgg

SEQ ID NO: 144467 - DNA, 35 bp, Artificial Sequence
  Synthetic oligonucleotide
actaacgacgggagggtgctggggtgggaccatct

SEQ ID NO: 144468 - DNA, 36 bp, Artificial Sequence
  Synthetic oligonucleotide
ttcgtcacaccagccccctattatgcgcccttccca

SEQ ID NO: 144469 - DNA, 36 bp, Artificial Sequence
  Synthetic oligonucleotide
tgtcaccccatatgcgcgttattcactctctagcca

SEQ ID NO: 144470 - DNA, 30 bp, Artificial Sequence
  Synthetic oligonucleotide
tacatcccccctgcatgcccgtatctagca

SEQ ID NO: 144471 - DNA, 33 bp, Artificial Sequence
  Synthetic oligonucleotide
tctaggcggatcccccctcgctcgccgccatca

SEQ ID NO: 144472 - DNA, 37 bp, Artificial Sequence
  Synthetic oligonucleotide
acttacgccctcctgtatccgctccatcctcgaaaga

SEQ ID NO: 144473 - DNA, 37 bp, Artificial Sequence
  Synthetic oligonucleotide
ttgaacgaggcgaagggggtaggagggctaaggaaga

SEQ ID NO: 144474 - DNA, 37 bp, Artificial Sequence
  Synthetic oligonucleotide
tgccccaccagagttacttttgtcccttccttcccga

SEQ ID NO: 144475 - DNA, 37 bp, Artificial Sequence
  Synthetic oligonucleotide
aacgggcgggggacaagggtgggggcctgggaccgga

SEQ ID NO: 144476 - DNA, 35 bp, Artificial Sequence
  Synthetic oligonucleotide
tgcctgacttgtcttccgcgcttccaccccccgga

SEQ ID NO: 144477 - DNA, 37 bp, Artificial Sequence
  Synthetic oligonucleotide
aagaacgggcagggggttttggggagggtgggtcgga

SEQ ID NO: 144478 - DNA, 37 bp, Artificial Sequence
  Synthetic oligonucleotide
ggtctgcgaagagagggaggcaaataggggcgaggga

SEQ ID NO: 144479 - DNA, 36 bp, Artificial Sequence
  Synthetic oligonucleotide
ataggaggggggagggttggcggatttaaggcggga

SEQ ID NO: 144480 - DNA, 37 bp, Artificial Sequence
  Synthetic oligonucleotide
gatgaagctcggcagagtacataggggcgggggggga

SEQ ID NO: 144481 - DNA, 36 bp, Artificial Sequence
  Synthetic oligonucleotide
tcccttcccgcgactttgtctgtcctgctctcctga

SEQ ID NO: 144482 - DNA, 37 bp, Artificial Sequence
  Synthetic oligonucleotide
aagggaggcatgggggcgaaaggggcaaagtccgtga

SEQ ID NO: 144483 - DNA, 37 bp, Artificial Sequence
  Synthetic oligonucleotide
actccccccacttggcttagaacccaggaacatgtga

SEQ ID NO: 144484 - DNA, 38 bp, Artificial Sequence
  Synthetic oligonucleotide
gtggccgtactttcaggatccgtaccttcttcacttga

SEQ ID NO: 144485 - DNA, 36 bp, Artificial Sequence
  Synthetic oligonucleotide
atcgccggtcgtcgaccttttgccacgtttgctcta

SEQ ID NO: 144486 - DNA, 35 bp, Artificial Sequence
  Synthetic oligonucleotide
actctcgcccacatccgggctaatgtcttttctac

SEQ ID NO: 144487 - DNA, 35 bp, Artificial Sequence
  Synthetic oligonucleotide
gacacgcgtgtcggtatgacgcgctatctaccacc

SEQ ID NO: 144488 - DNA, 35 bp, Artificial Sequence
  Synthetic oligonucleotide
gccgcccatcgttcgtcacatccccgcttaggccc

SEQ ID NO: 144489 - DNA, 35 bp, Artificial Sequence
  Synthetic oligonucleotide
gtcggggcatcgtcccgttgcatctctccttgtcc

SEQ ID NO: 144490 - DNA, 35 bp, Artificial Sequence
  Synthetic oligonucleotide
acgtgtcccgtcgtccttcttcctctgcctcgcgc

SEQ ID NO: 144491 - DNA, 35 bp, Artificial Sequence
  Synthetic oligonucleotide
gccagccctcaatcgctattgtccaccgttttcgc

SEQ ID NO: 144492 - DNA, 34 bp, Artificial Sequence
  Synthetic oligonucleotide
tgatatcccgcccagggaggtaccactttctatc

SEQ ID NO: 144493 - DNA, 35 bp, Artificial Sequence
  Synthetic oligonucleotide
gccaacctaggctctccgtgcacccctccgccgtc

SEQ ID NO: 144494 - DNA, 35 bp, Artificial Sequence
  Synthetic oligonucleotide
tcaacaccccacactttccccgtttcaggaagttc

SEQ ID NO: 144495 - DNA, 35 bp, Artificial Sequence
  Synthetic oligonucleotide
tctggacacccgctagcttcctcgtaattctcacg

SEQ ID NO: 144496 - DNA, 35 bp, Artificial Sequence
  Synthetic oligonucleotide
accgaccccgcccctttcttgattctgccaccgcg

SEQ ID NO: 144497 - DNA, 34 bp, Artificial Sequence
  Synthetic oligonucleotide
aatggtgctgtcgtactgccttctcccccacctg

SEQ ID NO: 144498 - DNA, 35 bp, Artificial Sequence
  Synthetic oligonucleotide
tcccgcctctgtatccatcaccgtgttccgacttg

SEQ ID NO: 144499 - DNA, 35 bp, Artificial Sequence
  Synthetic oligonucleotide
aactacgggagggagggtcgggtgaacgagtaaat

SEQ ID NO: 144500 - DNA, 35 bp, Artificial Sequence
  Synthetic oligonucleotide
gccattcgccgggtctctctctcttcattggttat

SEQ ID NO: 144501 - DNA, 35 bp, Artificial Sequence
  Synthetic oligonucleotide
tgcccacgcaaaagtaaccagcgcagaccccccct

SEQ ID NO: 144502 - DNA, 35 bp, Artificial Sequence
  Synthetic oligonucleotide
gtgttggaccctgcccctggataccccccccgtct

SEQ ID NO: 144503 - DNA, 35 bp, Artificial Sequence
  Synthetic oligonucleotide
aaagagactgtagggggggagtcgaagcggggagt

SEQ ID NO: 144504 - DNA, 35 bp, Artificial Sequence
  Synthetic oligonucleotide
gaatgggggggattgggtagggagagtcctgtggt

SEQ ID NO: 144505 - DNA, 35 bp, Artificial Sequence
  Synthetic oligonucleotide
acttcccgccgcatccgacgttttgaatccgcctt

SEQ ID NO: 144506 - DNA, 35 bp, Artificial Sequence
  Synthetic oligonucleotide
tatctcacgcgtcgtcattcgtcctccttggcctt

SEQ ID NO: 144507 - DNA, 35 bp, Artificial Sequence
  Synthetic oligonucleotide
acacgcctcaatgcaattgcacccgagttctcgtt

SEQ ID NO: 144508 - DNA, 36 bp, Artificial Sequence
  Synthetic oligonucleotide
tggagcacgagggcgggttacgaaggggcgggcaaa

SEQ ID NO: 144509 - DNA, 35 bp, Artificial Sequence
  Synthetic oligonucleotide
ttacccatcgctcccctgcctgcggttcctgacaa

SEQ ID NO: 144510 - DNA, 35 bp, Artificial Sequence
  Synthetic oligonucleotide
atgagcagggatggggggggaaacaagggacgcaa

SEQ ID NO: 144511 - DNA, 36 bp, Artificial Sequence
  Synthetic oligonucleotide
gagggaatgataggggtgcgagggaagagagactaa

SEQ ID NO: 144512 - DNA, 36 bp, Artificial Sequence
  Synthetic oligonucleotide
tcactctgtgcccttcgcggtttcctgtccccgtaa

SEQ ID NO: 144513 - DNA, 35 bp, Artificial Sequence
  Synthetic oligonucleotide
atggtggagggggagggagggaagggctagagaca

SEQ ID NO: 144514 - DNA, 36 bp, Artificial Sequence
  Synthetic oligonucleotide
acacgcgacatatttctccttcaaccctgcccgcca

SEQ ID NO: 144515 - DNA, 36 bp, Artificial Sequence
  Synthetic oligonucleotide
tgcacactcaccgttacgaggcgctcctgtcctcca

SEQ ID NO: 144516 - DNA, 36 bp, Artificial Sequence
  Synthetic oligonucleotide
tgcccgactagtccttcacgtgcttcttgtcttcca

SEQ ID NO: 144517 - DNA, 36 bp, Artificial Sequence
  Synthetic oligonucleotide
atgaccgctccccctccaatgccccataactggtca

SEQ ID NO: 144518 - DNA, 35 bp, Artificial Sequence
  Synthetic oligonucleotide
ggagcgagtcgccagacccttatcttcctcgttca

SEQ ID NO: 144519 - DNA, 37 bp, Artificial Sequence
  Synthetic oligonucleotide
atatccccgccctcaccatgagtcgttgccaccacga

SEQ ID NO: 144520 - DNA, 36 bp, Artificial Sequence
  Synthetic oligonucleotide
tatcgctcccccccgtccgactctcttctgggacga

SEQ ID NO: 144521 - DNA, 37 bp, Artificial Sequence
  Synthetic oligonucleotide
gtgccgtcgcctcgctcattaacacgcttaccaccga

SEQ ID NO: 144522 - DNA, 35 bp, Artificial Sequence
  Synthetic oligonucleotide
tcatccccatcctgtctcatcagccgcgtacgcga

SEQ ID NO: 144523 - DNA, 36 bp, Artificial Sequence
  Synthetic oligonucleotide
tctcaccaccgatcgcattaccttccgcccatagga

SEQ ID NO: 144524 - DNA, 37 bp, Artificial Sequence
  Synthetic oligonucleotide
gaggggcagacccggggtatgagggggcctagaggga

SEQ ID NO: 144525 - DNA, 38 bp, Artificial Sequence
  Synthetic oligonucleotide
gcgccgccgctcatcctgctgcctattctgacccatga

SEQ ID NO: 144526 - DNA, 38 bp, Artificial Sequence
  Synthetic oligonucleotide
tcctgccccaggtgtcaccgcaccccctcctgacctga

SEQ ID NO: 144527 - DNA, 38 bp, Artificial Sequence
  Synthetic oligonucleotide
tcgcggtgtcctccatcctgtccgttctatgcctctga

SEQ ID NO: 144528 - DNA, 38 bp, Artificial Sequence
  Synthetic oligonucleotide
gctaaagaacgatggagggggagtagggagggtggtga

SEQ ID NO: 144529 - DNA, 37 bp, Artificial Sequence
  Synthetic oligonucleotide
gttcccctcacttgtatcatcattgccccttgattga

SEQ ID NO: 144530 - DNA, 36 bp, Artificial Sequence
  Synthetic oligonucleotide
gccattcaccgccaccctgaccaaatagggccccta

SEQ ID NO: 144531 - DNA, 36 bp, Artificial Sequence
  Synthetic oligonucleotide
accctcatcgcacctttgagcctaccgtaccgccta

SEQ ID NO: 144532 - DNA, 36 bp, Artificial Sequence
  Synthetic oligonucleotide
acttgtgcggacggaagggagctaggtggcgcagta

SEQ ID NO: 144533 - DNA, 35 bp, Artificial Sequence
  Synthetic oligonucleotide
ttacacccctgtgggcttaattaactagtatccac

SEQ ID NO: 144534 - DNA, 35 bp, Artificial Sequence
  Synthetic oligonucleotide
gaaccgtaccatgacgcccctgttttcctcacacc

SEQ ID NO: 144535 - DNA, 35 bp, Artificial Sequence
  Synthetic oligonucleotide
gtgcgctacactgattccgccactggctgtgcccc

SEQ ID NO: 144536 - DNA, 34 bp, Artificial Sequence
  Synthetic oligonucleotide
atcgctcctccgccggggtcccgttactgtgccc

SEQ ID NO: 144537 - DNA, 35 bp, Artificial Sequence
  Synthetic oligonucleotide
tgggccgcctgcgcatggccccgtactattctccc

SEQ ID NO: 144538 - DNA, 35 bp, Artificial Sequence
  Synthetic oligonucleotide
tgtgcccgccgcataaccattgcccggccattgcc

SEQ ID NO: 144539 - DNA, 35 bp, Artificial Sequence
  Synthetic oligonucleotide
gtcccgtgcctcgcttgtcctgcttttttcttgcc

SEQ ID NO: 144540 - DNA, 35 bp, Artificial Sequence
  Synthetic oligonucleotide
aaccgaccgccacaacagcccagagtccaccccgc

SEQ ID NO: 144541 - DNA, 35 bp, Artificial Sequence
  Synthetic oligonucleotide
tgcactacgtactgcgcctattcagtctttctgtc

SEQ ID NO: 144542 - DNA, 35 bp, Artificial Sequence
  Synthetic oligonucleotide
tgccactttactgatccctgtctcttctctagttc

SEQ ID NO: 144543 - DNA, 35 bp, Artificial Sequence
  Synthetic oligonucleotide
ggaccccgcaagctgcctccgacacgctctctttc

SEQ ID NO: 144544 - DNA, 35 bp, Artificial Sequence
  Synthetic oligonucleotide
tgagcaacaggttcgtcctctccaccacctcacgg

SEQ ID NO: 144545 - DNA, 35 bp, Artificial Sequence
  Synthetic oligonucleotide
tgagacggctctacacccgcccctccgtatcctgg

SEQ ID NO: 144546 - DNA, 35 bp, Artificial Sequence
  Synthetic oligonucleotide
acccccacgccacacctcgcgctatactcagactg

SEQ ID NO: 144547 - DNA, 35 bp, Artificial Sequence
  Synthetic oligonucleotide
aacccagggaccatcatgcagcgcgacattctact

SEQ ID NO: 144548 - DNA, 35 bp, Artificial Sequence
  Synthetic oligonucleotide
gatatcgcacgagtcccccccctccctagcacgct

SEQ ID NO: 144549 - DNA, 35 bp, Artificial Sequence
  Synthetic oligonucleotide
acttgccacgccgactaacatcacctgccatcgct

SEQ ID NO: 144550 - DNA, 35 bp, Artificial Sequence
  Synthetic oligonucleotide
atcgttcgccgcctgtcacttggcttgttgtctct

SEQ ID NO: 144551 - DNA, 35 bp, Artificial Sequence
  Synthetic oligonucleotide
gatcgctccctgcctctgagtaataacgtttttct

SEQ ID NO: 144552 - DNA, 35 bp, Artificial Sequence
  Synthetic oligonucleotide
tgttgccggagtaggcgttcatgttccatccctgt

SEQ ID NO: 144553 - DNA, 35 bp, Artificial Sequence
  Synthetic oligonucleotide
tcgcagacagtctcgtctggctcccccgatttctt

SEQ ID NO: 144554 - DNA, 35 bp, Artificial Sequence
  Synthetic oligonucleotide
tctactcgcccactaggtcttaagttctgttcgtt

SEQ ID NO: 144555 - DNA, 36 bp, Artificial Sequence
  Synthetic oligonucleotide
atgggggggccgaaaaaaggggcaaaggttcgtaaa

SEQ ID NO: 144556 - DNA, 35 bp, Artificial Sequence
  Synthetic oligonucleotide
tccgtatcctcatgggctataaccgcttaccacaa

SEQ ID NO: 144557 - DNA, 35 bp, Artificial Sequence
  Synthetic oligonucleotide
gagcgccggccatggttcgtcccatctgctcaaca

SEQ ID NO: 144558 - DNA, 36 bp, Artificial Sequence
  Synthetic oligonucleotide
gtcccttgtctgccctgtgcttgctcctatcctaca

SEQ ID NO: 144559 - DNA, 36 bp, Artificial Sequence
  Synthetic oligonucleotide
gttacaccatcccctagtgcttcgtgcttgttagca

SEQ ID NO: 144560 - DNA, 36 bp, Artificial Sequence
  Synthetic oligonucleotide
ggggagctcacttgccaacatcccaccctgcctgca

SEQ ID NO: 144561 - DNA, 35 bp, Artificial Sequence
  Synthetic oligonucleotide
accgtcccaccatctatgtcgcgcctcaattttca

SEQ ID NO: 144562 - DNA, 37 bp, Artificial Sequence
  Synthetic oligonucleotide
tctccccgcctccacgtaattccttcgcttgatgcga

SEQ ID NO: 144563 - DNA, 37 bp, Artificial Sequence
  Synthetic oligonucleotide
tcacgcgttcttgcaaatcccagctgcccccactcga

SEQ ID NO: 144564 - DNA, 37 bp, Artificial Sequence
  Synthetic oligonucleotide
aagagaacggcggggtggacgggggttgcgtggtgga

SEQ ID NO: 144565 - DNA, 37 bp, Artificial Sequence
  Synthetic oligonucleotide
acgccatctgccgctgaacctcttgcatccctcctga

SEQ ID NO: 144566 - DNA, 37 bp, Artificial Sequence
  Synthetic oligonucleotide
gagagaaccgggctaacgggagggtgtggaggggtga

SEQ ID NO: 144567 - DNA, 38 bp, Artificial Sequence
  Synthetic oligonucleotide
tcatcctcccatggatgtctagacctgcccttctttga

SEQ ID NO: 144568 - DNA, 38 bp, Artificial Sequence
  Synthetic oligonucleotide
tacgcgcgttaggcgccgtttctccactccctgtttga

SEQ ID NO: 144569 - DNA, 36 bp, Artificial Sequence
  Synthetic oligonucleotide
atgctggggggagaatggaaaccaggagaaagacta

SEQ ID NO: 144570 - DNA, 35 bp, Artificial Sequence
  Synthetic oligonucleotide
tcgatcacacactgttgcgccacgagcgccctcac

SEQ ID NO: 144571 - DNA, 35 bp, Artificial Sequence
  Synthetic oligonucleotide
tctggcgtgcactgtactactccccctggcctacc

SEQ ID NO: 144572 - DNA, 35 bp, Artificial Sequence
  Synthetic oligonucleotide
tgccttgcccccgtagtgacgcgcaacgatccccc

SEQ ID NO: 144573 - DNA, 35 bp, Artificial Sequence
  Synthetic oligonucleotide
gtgccttcacctgacgtttaaatctttgcctcccc

SEQ ID NO: 144574 - DNA, 35 bp, Artificial Sequence
  Synthetic oligonucleotide
actccagactacacatcggtgtacactcctagccc

SEQ ID NO: 144575 - DNA, 35 bp, Artificial Sequence
  Synthetic oligonucleotide
gttacgccctggtttcagttacgacctcctagccc

SEQ ID NO: 144576 - DNA, 35 bp, Artificial Sequence
  Synthetic oligonucleotide
aagcaacacattctagccgtccgcctgccgccgcc

SEQ ID NO: 144577 - DNA, 35 bp, Artificial Sequence
  Synthetic oligonucleotide
gtccatctcgaactgcgattgtccagttttcatcc

SEQ ID NO: 144578 - DNA, 35 bp, Artificial Sequence
  Synthetic oligonucleotide
tgaccattgacccacacttcgcatgttctgtatcc

SEQ ID NO: 144579 - DNA, 35 bp, Artificial Sequence
  Synthetic oligonucleotide
ttgacggcccctgtcgctccacgccattctggtcc

SEQ ID NO: 144580 - DNA, 35 bp, Artificial Sequence
  Synthetic oligonucleotide
tccccccccggacgcacgcctggctgctctttagc

SEQ ID NO: 144581 - DNA, 35 bp, Artificial Sequence
  Synthetic oligonucleotide
gatatgtcgctgtctgttcactcccgcccttccgc

SEQ ID NO: 144582 - DNA, 35 bp, Artificial Sequence
  Synthetic oligonucleotide
ttaccgccgtactttggctctttaacgcattcatc

SEQ ID NO: 144583 - DNA, 35 bp, Artificial Sequence
  Synthetic oligonucleotide
gtccctccttccatgttgtcatcattaactacctc

SEQ ID NO: 144584 - DNA, 33 bp, Artificial Sequence
  Synthetic oligonucleotide
tttcagccgccacgctttgtccttcgcccgctc

SEQ ID NO: 144585 - DNA, 36 bp, Artificial Sequence
  Synthetic oligonucleotide
ttccgccccgctccacaattcgatagatagtctgtc

SEQ ID NO: 144586 - DNA, 35 bp, Artificial Sequence
  Synthetic oligonucleotide
tcattgcccggtatctgttcgccggatctccattc

SEQ ID NO: 144587 - DNA, 35 bp, Artificial Sequence
  Synthetic oligonucleotide
tcatacattgtcagctcctcgttactcggcctttc

SEQ ID NO: 144588 - DNA, 35 bp, Artificial Sequence
  Synthetic oligonucleotide
tgtgctccctccccctactcgcgtcgctttagtcg

SEQ ID NO: 144589 - DNA, 35 bp, Artificial Sequence
  Synthetic oligonucleotide
tcctcacccccccgcatgtatagctggtcccaggg

SEQ ID NO: 144590 - DNA, 35 bp, Artificial Sequence
  Synthetic oligonucleotide
gacgtcgggaagggtgggtagtcctcaatggtggg

SEQ ID NO: 144591 - DNA, 35 bp, Artificial Sequence
  Synthetic oligonucleotide
gacccctccgctctcctgccatctacgacgcactg

SEQ ID NO: 144592 - DNA, 35 bp, Artificial Sequence
  Synthetic oligonucleotide
gaaatgtggaaagggaggagaggtgggggggcgtg

SEQ ID NO: 144593 - DNA, 35 bp, Artificial Sequence
  Synthetic oligonucleotide
tccgcactacctacagcggcttctttctctctcat

SEQ ID NO: 144594 - DNA, 35 bp, Artificial Sequence
  Synthetic oligonucleotide
ttgatccactcccgccctgtatatcggaggttcct

SEQ ID NO: 144595 - DNA, 35 bp, Artificial Sequence
  Synthetic oligonucleotide
gcaccccacaccgatattatcacgcgagagcctct

SEQ ID NO: 144596 - DNA, 35 bp, Artificial Sequence
  Synthetic oligonucleotide
gaacgtccagtgcccctgtcgttgctcctctttct

SEQ ID NO: 144597 - DNA, 35 bp, Artificial Sequence
  Synthetic oligonucleotide
acccctcagtatgccgcctattcccctaccatcgt

SEQ ID NO: 144598 - DNA, 35 bp, Artificial Sequence
  Synthetic oligonucleotide
tgcatcgatcattttgcctcccacacgcgccttgt

SEQ ID NO: 144599 - DNA, 35 bp, Artificial Sequence
  Synthetic oligonucleotide
acctgacctgtcagtcatctgcccgtgctccactt

SEQ ID NO: 144600 - DNA, 36 bp, Artificial Sequence
  Synthetic oligonucleotide
cagtagggtgagtgggagggagggtcgagacgattt

SEQ ID NO: 144601 - DNA, 35 bp, Artificial Sequence
  Synthetic oligonucleotide
ttaccatgccaccgccctctgcgatacacctattt

SEQ ID NO: 144602 - DNA, 35 bp, Artificial Sequence
  Synthetic oligonucleotide
taccgccccagacggccgagcctccaccctgcttt

SEQ ID NO: 144603 - DNA, 35 bp, Artificial Sequence
  Synthetic oligonucleotide
tccacccgcataggtagttcccctgaccgtctttt

SEQ ID NO: 144604 - DNA, 36 bp, Artificial Sequence
  Synthetic oligonucleotide
aattgcgcatcttcgcccttgtccgttgtccccgaa

SEQ ID NO: 144605 - DNA, 36 bp, Artificial Sequence
  Synthetic oligonucleotide
tccgacaacccacctattatttgtacactctcttaa

SEQ ID NO: 144606 - DNA, 35 bp, Artificial Sequence
  Synthetic oligonucleotide
taatccccgccgccacggcccgtgtctctttcaca

SEQ ID NO: 144607 - DNA, 36 bp, Artificial Sequence
  Synthetic oligonucleotide
ttcgatcgcccgacccccctcatgctgattacacca

SEQ ID NO: 144608 - DNA, 35 bp, Artificial Sequence
  Synthetic oligonucleotide
tccgacctacccctgtcttcttacggtgcttccca

SEQ ID NO: 144609 - DNA, 36 bp, Artificial Sequence
  Synthetic oligonucleotide
aacctgccactgcccccgatcccgtaccgcaatcca

SEQ ID NO: 144610 - DNA, 36 bp, Artificial Sequence
  Synthetic oligonucleotide
tctcttccccgcctcatgctacgatcatggcctcca

SEQ ID NO: 144611 - DNA, 37 bp, Artificial Sequence
  Synthetic oligonucleotide
tgttagggggggatcggggacgggaacagctgggaga

SEQ ID NO: 144612 - DNA, 35 bp, Artificial Sequence
  Synthetic oligonucleotide
atgactcacagtgctgccacatctctacctgccga

SEQ ID NO: 144613 - DNA, 37 bp, Artificial Sequence
  Synthetic oligonucleotide
tatggcggaaacgggcagggagggctgggcgagtcga

SEQ ID NO: 144614 - DNA, 38 bp, Artificial Sequence
  Synthetic oligonucleotide
tccacccccaatcctgtctccggagtcacttggactga

SEQ ID NO: 144615 - DNA, 38 bp, Artificial Sequence
  Synthetic oligonucleotide
atgggacgggagaggagattatggagcagggggtgtga

SEQ ID NO: 144616 - DNA, 36 bp, Artificial Sequence
  Synthetic oligonucleotide
tagggtggcgatccggggactggtggggggcggtta

SEQ ID NO: 144617 - DNA, 36 bp, Artificial Sequence
  Synthetic oligonucleotide
ggacctcgccgtgctacctccccctaccgcatgtta

SEQ ID NO: 144618 - DNA, 35 bp, Artificial Sequence
  Synthetic oligonucleotide
tccgaccgagatcacagctctgcctaattctacac

SEQ ID NO: 144619 - DNA, 35 bp, Artificial Sequence
  Synthetic oligonucleotide
tatcgatccaccttccacctggtccgtgagaccac

SEQ ID NO: 144620 - DNA, 36 bp, Artificial Sequence
  Synthetic oligonucleotide
acaccgcctcagctttttgttccatcgttatcggac

SEQ ID NO: 144621 - DNA, 35 bp, Artificial Sequence
  Synthetic oligonucleotide
tcaactccttccccgacgctctatgcgatttaacc

SEQ ID NO: 144622 - DNA, 35 bp, Artificial Sequence
  Synthetic oligonucleotide
tttaaggccaccatgtccgtcttttgccgcctacc

SEQ ID NO: 144623 - DNA, 35 bp, Artificial Sequence
  Synthetic oligonucleotide
gtccacatcacaccggctccccgcttccaagtacc

SEQ ID NO: 144624 - DNA, 35 bp, Artificial Sequence
  Synthetic oligonucleotide
tgcccaggtcatgtgctccttccgctctactcccc

SEQ ID NO: 144625 - DNA, 35 bp, Artificial Sequence
  Synthetic oligonucleotide
accacggggccacgatctgaaatttcacccacgcc

SEQ ID NO: 144626 - DNA, 35 bp, Artificial Sequence
  Synthetic oligonucleotide
gaagcctgccgtaacccaacgttgtacttgccgcc

SEQ ID NO: 144627 - DNA, 35 bp, Artificial Sequence
  Synthetic oligonucleotide
tccgcgggaccccggattaacctgtgcctcttgcc

SEQ ID NO: 144628 - DNA, 35 bp, Artificial Sequence
  Synthetic oligonucleotide
tatcccacctgctccctatgatggatctgccatcc

SEQ ID NO: 144629 - DNA, 35 bp, Artificial Sequence
  Synthetic oligonucleotide
tcgtgactcatgccccaagtgccaatctcacctcc

SEQ ID NO: 144630 - DNA, 35 bp, Artificial Sequence
  Synthetic oligonucleotide
gcatgagtacagggcgggggcacggggggaggggc

SEQ ID NO: 144631 - DNA, 35 bp, Artificial Sequence
  Synthetic oligonucleotide
atcatcgcacctctggaatcctgtttctcgcaatc

SEQ ID NO: 144632 - DNA, 35 bp, Artificial Sequence
  Synthetic oligonucleotide
gccgttgacgccgctcgcccaactattcttgcctc

SEQ ID NO: 144633 - DNA, 35 bp, Artificial Sequence
  Synthetic oligonucleotide
tgtgggtgggcgtgggggagggagaagtacatttc

SEQ ID NO: 144634 - DNA, 35 bp, Artificial Sequence
  Synthetic oligonucleotide
actgccggtgattcccgtgtcttgttcctcccccg

SEQ ID NO: 144635 - DNA, 35 bp, Artificial Sequence
  Synthetic oligonucleotide
tgtgctggcgattacgcgctgcccgacctttccct

SEQ ID NO: 144636 - DNA, 34 bp, Artificial Sequence
  Synthetic oligonucleotide
tacacatccggtactgcccctcttttggtcatct

SEQ ID NO: 144637 - DNA, 35 bp, Artificial Sequence
  Synthetic oligonucleotide
gcccatgcctccattactcacgcaccctgatatct

SEQ ID NO: 144638 - DNA, 35 bp, Artificial Sequence
  Synthetic oligonucleotide
tgttgccccgtacgataattcctcgtccgtcttct

SEQ ID NO: 144639 - DNA, 35 bp, Artificial Sequence
  Synthetic oligonucleotide
gcatccagcaacgggagggaccgggaacgggttgt

SEQ ID NO: 144640 - DNA, 35 bp, Artificial Sequence
  Synthetic oligonucleotide
gtaccaactcatgtcatccttacgcgcctacgctt

SEQ ID NO: 144641 - DNA, 35 bp, Artificial Sequence
  Synthetic oligonucleotide
tcaccgtctgcgtccgacacctccctctgcccaca

SEQ ID NO: 144642 - DNA, 35 bp, Artificial Sequence
  Synthetic oligonucleotide
taccctccctatccctggtgccttatgacatgaca

SEQ ID NO: 144643 - DNA, 36 bp, Artificial Sequence
  Synthetic oligonucleotide
actcctgccccggttttgactatatgtctgtggcca

SEQ ID NO: 144644 - DNA, 35 bp, Artificial Sequence
  Synthetic oligonucleotide
tgcattgccacggccgggatctgcctaccccttca

SEQ ID NO: 144645 - DNA, 36 bp, Artificial Sequence
  Synthetic oligonucleotide
ccactgcaccactgtctattccttccctaccgccga

SEQ ID NO: 144646 - DNA, 37 bp, Artificial Sequence
  Synthetic oligonucleotide
ttcaccccttcaccgtagtccagcacatgttcgccga

SEQ ID NO: 144647 - DNA, 36 bp, Artificial Sequence
  Synthetic oligonucleotide
agatcccatcccgccagccccgtccacccactcgga

SEQ ID NO: 144648 - DNA, 37 bp, Artificial Sequence
  Synthetic oligonucleotide
tcctatacagggggtgggtggggtcaaagaaagggga

SEQ ID NO: 144649 - DNA, 37 bp, Artificial Sequence
  Synthetic oligonucleotide
tgaacgccgaccggaggcggtggggcctgggggtgga

SEQ ID NO: 144650 - DNA, 38 bp, Artificial Sequence
  Synthetic oligonucleotide
acggaaacagtacgggggtggggagagggcggaaatga

SEQ ID NO: 144651 - DNA, 38 bp, Artificial Sequence
  Synthetic oligonucleotide
accccccgattccgacctactagctcgcctgtccatga

SEQ ID NO: 144652 - DNA, 37 bp, Artificial Sequence
  Synthetic oligonucleotide
accgatgctcagctagctacgcccgcccccatcgtga

SEQ ID NO: 144653 - DNA, 36 bp, Artificial Sequence
  Synthetic oligonucleotide
gcccctcggagtccctacaccctgctccttcggtga

SEQ ID NO: 144654 - DNA, 37 bp, Artificial Sequence
  Synthetic oligonucleotide
accccgactcttaacgtgcccacgtgacacctcttga

SEQ ID NO: 144655 - DNA, 36 bp, Artificial Sequence
  Synthetic oligonucleotide
acccgtgctccttccgacgttctatcatatggcata

SEQ ID NO: 144656 - DNA, 35 bp, Artificial Sequence
  Synthetic oligonucleotide
gccaccccgccactcgcgccctcgacgccatacac

SEQ ID NO: 144657 - DNA, 35 bp, Artificial Sequence
  Synthetic oligonucleotide
acatgctaccgtgacgtcgtaccatgctttttcac

SEQ ID NO: 144658 - DNA, 35 bp, Artificial Sequence
  Synthetic oligonucleotide
tgccccacccccgagtctgtgccttgtcttgcccc

SEQ ID NO: 144659 - DNA, 35 bp, Artificial Sequence
  Synthetic oligonucleotide
gacgaacgtcccgtctgtctcgatatcacgcatcc

SEQ ID NO: 144660 - DNA, 35 bp, Artificial Sequence
  Synthetic oligonucleotide
gcccacgtaggcatcacgcgctcgaactcacctcc

SEQ ID NO: 144661 - DNA, 35 bp, Artificial Sequence
  Synthetic oligonucleotide
gccaacgccccccggtccgactcctatgacgctcc

SEQ ID NO: 144662 - DNA, 35 bp, Artificial Sequence
  Synthetic oligonucleotide
gcccagttccgcccgcttatcccacattccattgc

SEQ ID NO: 144663 - DNA, 35 bp, Artificial Sequence
  Synthetic oligonucleotide
gtatgcacgtcgctccaggttgttctcggtccctc

SEQ ID NO: 144664 - DNA, 35 bp, Artificial Sequence
  Synthetic oligonucleotide
tcaacattctcccgttcaacgtgctcaattgcctc

SEQ ID NO: 144665 - DNA, 35 bp, Artificial Sequence
  Synthetic oligonucleotide
tcctctcctgcgccccctagtcaccatttgccgtc

SEQ ID NO: 144666 - DNA, 35 bp, Artificial Sequence
  Synthetic oligonucleotide
tgtagcgctccctcctctcgtctgagcccgccacg

SEQ ID NO: 144667 - DNA, 30 bp, Artificial Sequence
  Synthetic oligonucleotide
gtgcccaccttccgtcccgtgatcttcccg

SEQ ID NO: 144668 - DNA, 35 bp, Artificial Sequence
  Synthetic oligonucleotide
gcccgccgcccctctcttgaaagcaccctgttccg

SEQ ID NO: 144669 - DNA, 35 bp, Artificial Sequence
  Synthetic oligonucleotide
tctcacccctccttgacattaaggactctcattcg

SEQ ID NO: 144670 - DNA, 35 bp, Artificial Sequence
  Synthetic oligonucleotide
ggtacagactccctcgcgccttccctatatccttg

SEQ ID NO: 144671 - DNA, 33 bp, Artificial Sequence
  Synthetic oligonucleotide
atccaccatcgcgtgagccccgacatttgccct

SEQ ID NO: 144672 - DNA, 35 bp, Artificial Sequence
  Synthetic oligonucleotide
acgatcctccgttcttcctgtgcacccgtggcgct

SEQ ID NO: 144673 - DNA, 35 bp, Artificial Sequence
  Synthetic oligonucleotide
tccttctctcgtgtgcatcatccacggtttcctct

SEQ ID NO: 144674 - DNA, 35 bp, Artificial Sequence
  Synthetic oligonucleotide
tgcaaggaacgagtcatcgccccacaatatccctt

SEQ ID NO: 144675 - DNA, 35 bp, Artificial Sequence
  Synthetic oligonucleotide
tgccatccagagtctttttaacgtcactaatcctt

SEQ ID NO: 144676 - DNA, 35 bp, Artificial Sequence
  Synthetic oligonucleotide
gagggggcggggggaggatggcaatggtccgcttt

SEQ ID NO: 144677 - DNA, 35 bp, Artificial Sequence
  Synthetic oligonucleotide
aatgaagtgagggtgaataggggagggctcgaaaa

SEQ ID NO: 144678 - DNA, 35 bp, Artificial Sequence
  Synthetic oligonucleotide
gtgggtgtctgggggggtgggtaaaagagtgagca

SEQ ID NO: 144679 - DNA, 36 bp, Artificial Sequence
  Synthetic oligonucleotide
ggatccccgcccagtgtctgccgcatcttttacgca

SEQ ID NO: 144680 - DNA, 36 bp, Artificial Sequence
  Synthetic oligonucleotide
tcttggggggggatgggagggagggcatagttaaga

SEQ ID NO: 144681 - DNA, 36 bp, Artificial Sequence
  Synthetic oligonucleotide
gccgcataccccacatcttgtaccgtctctggccga

SEQ ID NO: 144682 - DNA, 37 bp, Artificial Sequence
  Synthetic oligonucleotide
gggtggtggctggggtatcggaggcggcaccaatcga

SEQ ID NO: 144683 - DNA, 36 bp, Artificial Sequence
  Synthetic oligonucleotide
gagcccaccggacagacgttactctaccctcccgga

SEQ ID NO: 144684 - DNA, 37 bp, Artificial Sequence
  Synthetic oligonucleotide
atcgaacccatgtgccatcgaaccctcacctctcgga

SEQ ID NO: 144685 - DNA, 37 bp, Artificial Sequence
  Synthetic oligonucleotide
aaggataggacgaggaaaaagcaggcggagaagggga

SEQ ID NO: 144686 - DNA, 37 bp, Artificial Sequence
  Synthetic oligonucleotide
gcggagaaaagaaggatgataggggcgggagagtgga

SEQ ID NO: 144687 - DNA, 37 bp, Artificial Sequence
  Synthetic oligonucleotide
gttagcgtgcccaccctctgtcgccctgccctttgga

SEQ ID NO: 144688 - DNA, 37 bp, Artificial Sequence
  Synthetic oligonucleotide
ttcggacgcctccaccttctccaatgccgctcactga

SEQ ID NO: 144689 - DNA, 38 bp, Artificial Sequence
  Synthetic oligonucleotide
gcccaacagtactatgtcgttccgtgcccgctccctga

SEQ ID NO: 144690 - DNA, 38 bp, Artificial Sequence
  Synthetic oligonucleotide
tgcacttgcagatcgtttttacgccacttctcctctga

SEQ ID NO: 144691 - DNA, 38 bp, Artificial Sequence
  Synthetic oligonucleotide
tacgccacttgtacctgttgttccggcccacttcgtga

SEQ ID NO: 144692 - DNA, 38 bp, Artificial Sequence
  Synthetic oligonucleotide
acaggaggaggatgggacgtggtgtgggcggatcttga

SEQ ID NO: 144693 - DNA, 35 bp, Artificial Sequence
  Synthetic oligonucleotide
gaattggtgggagggagcgggacatgacgggaata

SEQ ID NO: 144694 - DNA, 35 bp, Artificial Sequence
  Synthetic oligonucleotide
gccaccgtgccccaccgccttgctccccattagta

SEQ ID NO: 144695 - DNA, 36 bp, Artificial Sequence
  Synthetic oligonucleotide
gcctccgccataccctcccaggctgtttcgcactta

SEQ ID NO: 144696 - DNA, 35 bp, Artificial Sequence
  Synthetic oligonucleotide
tttcgagcgtgtagctcgtccattgatctttccac

SEQ ID NO: 144697 - DNA, 35 bp, Artificial Sequence
  Synthetic oligonucleotide
gtgccggaccgggagggctaattgccgggtgggac

SEQ ID NO: 144698 - DNA, 35 bp, Artificial Sequence
  Synthetic oligonucleotide
ggtccacctcttcacccctccaggcttcttcgtac

SEQ ID NO: 144699 - DNA, 35 bp, Artificial Sequence
  Synthetic oligonucleotide
tgatccacccacttgtctaccccaacacggccccc

SEQ ID NO: 144700 - DNA, 35 bp, Artificial Sequence
  Synthetic oligonucleotide
aatccatgttcaactgcccgctgggacacgcctcc

SEQ ID NO: 144701 - DNA, 35 bp, Artificial Sequence
  Synthetic oligonucleotide
tccgtcgcggtcgagcctgtcaccaccacttttcc

SEQ ID NO: 144702 - DNA, 35 bp, Artificial Sequence
  Synthetic oligonucleotide
acctggcccatgcgatttacgcccgttctcaccgc

SEQ ID NO: 144703 - DNA, 35 bp, Artificial Sequence
  Synthetic oligonucleotide
tgcggatcattgcactgccttccgtttgaccatgc

SEQ ID NO: 144704 - DNA, 35 bp, Artificial Sequence
  Synthetic oligonucleotide
gcactctctgctcggatccgctgtcaacccttctc

SEQ ID NO: 144705 - DNA, 35 bp, Artificial Sequence
  Synthetic oligonucleotide
tccggggaacgaagggcgggtgtagggtatgcaag

SEQ ID NO: 144706 - DNA, 35 bp, Artificial Sequence
  Synthetic oligonucleotide
ggtcacttgtccgctcagccctccctcctcatccg

SEQ ID NO: 144707 - DNA, 35 bp, Artificial Sequence
  Synthetic oligonucleotide
ataccctcgccctcatctgtcaccgaccactttcg

SEQ ID NO: 144708 - DNA, 35 bp, Artificial Sequence
  Synthetic oligonucleotide
gttcaggggacggtggggagggaaatggtttaggg

SEQ ID NO: 144709 - DNA, 32 bp, Artificial Sequence
  Synthetic oligonucleotide
accgcccccagatttccttgttatctctactg

SEQ ID NO: 144710 - DNA, 34 bp, Artificial Sequence
  Synthetic oligonucleotide
agccccaggctctcgcactaccgtttccgcccat

SEQ ID NO: 144711 - DNA, 35 bp, Artificial Sequence
  Synthetic oligonucleotide
tcacacatacacgttattgtcgacttttcacccct

SEQ ID NO: 144712 - DNA, 35 bp, Artificial Sequence
  Synthetic oligonucleotide
gttacacgtttgtcctcctgctgttggggccccct

SEQ ID NO: 144713 - DNA, 35 bp, Artificial Sequence
  Synthetic oligonucleotide
atgggacgatcggacgcgacatacccctcgcccct

SEQ ID NO: 144714 - DNA, 35 bp, Artificial Sequence
  Synthetic oligonucleotide
acaggtggggccaggggttattggaggatggtcct

SEQ ID NO: 144715 - DNA, 35 bp, Artificial Sequence
  Synthetic oligonucleotide
tgcacccaatgggtatccaacttgcttcctgtcct

SEQ ID NO: 144716 - DNA, 35 bp, Artificial Sequence
  Synthetic oligonucleotide
gccttgacacgaagctgttgcgacccatccactct

SEQ ID NO: 144717 - DNA, 35 bp, Artificial Sequence
  Synthetic oligonucleotide
acccctagcagcatatgcccgcccaatccggctct

SEQ ID NO: 144718 - DNA, 35 bp, Artificial Sequence
  Synthetic oligonucleotide
gtgggggaagatggagaatgggagctacatgtggt

SEQ ID NO: 144719 - DNA, 35 bp, Artificial Sequence
  Synthetic oligonucleotide
atggtcacccgacgcgcttttaccacgcctacatt

SEQ ID NO: 144720 - DNA, 35 bp, Artificial Sequence
  Synthetic oligonucleotide
tcccacctcgttctttggcccatctgtcagttctt

SEQ ID NO: 144721 - DNA, 35 bp, Artificial Sequence
  Synthetic oligonucleotide
agagatcaggggaaagcgggtaaggggagcacgtt

SEQ ID NO: 144722 - DNA, 36 bp, Artificial Sequence
  Synthetic oligonucleotide
tagcggggaggggagggggtgtcttgtgggcgaaaa

SEQ ID NO: 144723 - DNA, 36 bp, Artificial Sequence
  Synthetic oligonucleotide
atgtgaccgggacgatgggcgggtgcgggattacaa

SEQ ID NO: 144724 - DNA, 36 bp, Artificial Sequence
  Synthetic oligonucleotide
agtcgcctcccatccgatcggtacgcaaccactcca

SEQ ID NO: 144725 - DNA, 36 bp, Artificial Sequence
  Synthetic oligonucleotide
gagcgatcgttcgttgccttctactctggtcctcca

SEQ ID NO: 144726 - DNA, 35 bp, Artificial Sequence
  Synthetic oligonucleotide
tggaccaccgacctaatgggtctacccccgctcca

SEQ ID NO: 144727 - DNA, 35 bp, Artificial Sequence
  Synthetic oligonucleotide
tcgtatgtgggggggacgcaggaaggggggaggca

SEQ ID NO: 144728 - DNA, 36 bp, Artificial Sequence
  Synthetic oligonucleotide
gagcgaccccccatatggttttccggcctttctgca

SEQ ID NO: 144729 - DNA, 36 bp, Artificial Sequence
  Synthetic oligonucleotide
atgggccgacgccactcgtatcgtttcctgctatca

SEQ ID NO: 144730 - DNA, 36 bp, Artificial Sequence
  Synthetic oligonucleotide
tcatgccctctggattctgttcctctggcccattca

SEQ ID NO: 144731 - DNA, 37 bp, Artificial Sequence
  Synthetic oligonucleotide
atcgccgactttgccccttgtgttttccctgttccga

SEQ ID NO: 144732 - DNA, 35 bp, Artificial Sequence
  Synthetic oligonucleotide
gcacgcgatatgataaccggcctcttcttcctcga

SEQ ID NO: 144733 - DNA, 36 bp, Artificial Sequence
  Synthetic oligonucleotide
gtgctggggagagttaacgggagtggaggcggggga

SEQ ID NO: 144734 - DNA, 36 bp, Artificial Sequence
  Synthetic oligonucleotide
tcctctccgctccctccattctcgcccacgctggga

SEQ ID NO: 144735 - DNA, 37 bp, Artificial Sequence
  Synthetic oligonucleotide
atgagaggggagggcgggtggagatcgcccggatgga

SEQ ID NO: 144736 - DNA, 38 bp, Artificial Sequence
  Synthetic oligonucleotide
attccccactgctacctgacgttcgccccagtcactga

SEQ ID NO: 144737 - DNA, 36 bp, Artificial Sequence
  Synthetic oligonucleotide
gttatcctcacacattgtttttgtagccactcctga

SEQ ID NO: 144738 - DNA, 38 bp, Artificial Sequence
  Synthetic oligonucleotide
gaccagcccacccccatccttgttagcacatcctctga

SEQ ID NO: 144739 - DNA, 37 bp, Artificial Sequence
  Synthetic oligonucleotide
gtaggcctccctctgccttttgcccaccctgtcgtga

SEQ ID NO: 144740 - DNA, 37 bp, Artificial Sequence
  Synthetic oligonucleotide
agcgggtgaaaggggttttaagcaaggggaaaggtga

SEQ ID NO: 144741 - DNA, 35 bp, Artificial Sequence
  Synthetic oligonucleotide
acacaaccctcattgctacccggccctaccattga

SEQ ID NO: 144742 - DNA, 35 bp, Artificial Sequence
  Synthetic oligonucleotide
accacacctccaattaccctgttaaggctttgcta

SEQ ID NO: 144743 - DNA, 36 bp, Artificial Sequence
  Synthetic oligonucleotide
gagaaaatcgggaagggtgggaaaacaggcggtgta

SEQ ID NO: 144744 - DNA, 35 bp, Artificial Sequence
  Synthetic oligonucleotide
ggagcccctactccctcggttttggcgccctatta

SEQ ID NO: 144745 - DNA, 35 bp, Artificial Sequence
  Synthetic oligonucleotide
aagcctcctcgttgtccgtcccatatacgctatac

SEQ ID NO: 144746 - DNA, 35 bp, Artificial Sequence
  Synthetic oligonucleotide
gtgaccccgccggacgttctccactatgcctttac

SEQ ID NO: 144747 - DNA, 35 bp, Artificial Sequence
  Synthetic oligonucleotide
acccccgacgcgcccttaagtttcacctggtagcc

SEQ ID NO: 144748 - DNA, 35 bp, Artificial Sequence
  Synthetic oligonucleotide
acctcgccccagcgctctcatctgtacacggcgcc

SEQ ID NO: 144749 - DNA, 35 bp, Artificial Sequence
  Synthetic oligonucleotide
ttgggggggtcagcttttttttcgcgtctcctgcc

SEQ ID NO: 144750 - DNA, 35 bp, Artificial Sequence
  Synthetic oligonucleotide
acgaatcccatgcccacctcaagcccattattgcc

SEQ ID NO: 144751 - DNA, 35 bp, Artificial Sequence
  Synthetic oligonucleotide
actcatccgctatcctgttcaaatagtttcgctcc

SEQ ID NO: 144752 - DNA, 32 bp, Artificial Sequence
  Synthetic oligonucleotide
ttctccgataccgacccacctgtaaaggctcc

SEQ ID NO: 144753 - DNA, 35 bp, Artificial Sequence
  Synthetic oligonucleotide
tgctcccctcagtcctcctttgatgcccgttctcc

SEQ ID NO: 144754 - DNA, 35 bp, Artificial Sequence
  Synthetic oligonucleotide
gacttccccccaccttgctctatgtagggcactgc

SEQ ID NO: 144755 - DNA, 35 bp, Artificial Sequence
  Synthetic oligonucleotide
gatgacgtttgtgaccttcatttgtgcccccctgc

SEQ ID NO: 144756 - DNA, 35 bp, Artificial Sequence
  Synthetic oligonucleotide
gcccgcccctcccgtcgttcacccgttactcttgc

SEQ ID NO: 144757 - DNA, 35 bp, Artificial Sequence
  Synthetic oligonucleotide
gaccgccacactcacataacccaccacacttggtg

SEQ ID NO: 144758 - DNA, 35 bp, Artificial Sequence
  Synthetic oligonucleotide
acactggccccacatccgacttcctcgaacccgat

SEQ ID NO: 144759 - DNA, 35 bp, Artificial Sequence
  Synthetic oligonucleotide
acgcctcaacctgactatgctccctcggactacct

SEQ ID NO: 144760 - DNA, 35 bp, Artificial Sequence
  Synthetic oligonucleotide
agacacgtcggtttttcccataccgcatccgccct

SEQ ID NO: 144761 - DNA, 35 bp, Artificial Sequence
  Synthetic oligonucleotide
tcccatcttcccaggtcttgcgcgttgtcctgcct

SEQ ID NO: 144762 - DNA, 35 bp, Artificial Sequence
  Synthetic oligonucleotide
tcaccctcgcccgtgccatgacgcaatttccgcgt

SEQ ID NO: 144763 - DNA, 35 bp, Artificial Sequence
  Synthetic oligonucleotide
gtgtcccgcctccgaccttgcaaggccccaccctt

SEQ ID NO: 144764 - DNA, 36 bp, Artificial Sequence
  Synthetic oligonucleotide
gtcgaacggaacgggcggaaaagggggatgtgggaa

SEQ ID NO: 144765 - DNA, 32 bp, Artificial Sequence
  Synthetic oligonucleotide
tgtagcgtactcccccgaatcccaggccgcca

SEQ ID NO: 144766 - DNA, 35 bp, Artificial Sequence
  Synthetic oligonucleotide
agcccccctctaatgatcacatacgcatctggcca

SEQ ID NO: 144767 - DNA, 35 bp, Artificial Sequence
  Synthetic oligonucleotide
acgatcgggccactgctgcaacatacgttcttcca

SEQ ID NO: 144768 - DNA, 36 bp, Artificial Sequence
  Synthetic oligonucleotide
acaccaccactttcccttgccacagcacgttgcgca

SEQ ID NO: 144769 - DNA, 37 bp, Artificial Sequence
  Synthetic oligonucleotide
acactcgcccactgaactgtttttgtcctcctgtaga

SEQ ID NO: 144770 - DNA, 37 bp, Artificial Sequence
  Synthetic oligonucleotide
tgtatccctcccactggtgttttagtcaccccttcga

SEQ ID NO: 144771 - DNA, 37 bp, Artificial Sequence
  Synthetic oligonucleotide
acctccccacccacagtccagtactcccttggaagga

SEQ ID NO: 144772 - DNA, 37 bp, Artificial Sequence
  Synthetic oligonucleotide
gtaccaccgcccgagacccttcctacgagaacaggga

SEQ ID NO: 144773 - DNA, 35 bp, Artificial Sequence
  Synthetic oligonucleotide
gtagggcgggtgggccagaagataaggaacgggga

SEQ ID NO: 144774 - DNA, 38 bp, Artificial Sequence
  Synthetic oligonucleotide
tcgacccttacatatgtctgcctccccgccccatggga

SEQ ID NO: 144775 - DNA, 37 bp, Artificial Sequence
  Synthetic oligonucleotide
ttccaacaaccgcccgaccctgcctccgcaccatgga

SEQ ID NO: 144776 - DNA, 37 bp, Artificial Sequence
  Synthetic oligonucleotide
ggacattgggagtacggctaagggcgggggggactga

SEQ ID NO: 144777 - DNA, 38 bp, Artificial Sequence
  Synthetic oligonucleotide
tgtgcctgttccttggctctcattgacaccctccctga

SEQ ID NO: 144778 - DNA, 38 bp, Artificial Sequence
  Synthetic oligonucleotide
gtcccatctccactgctctcaaacgcctgttactttga

SEQ ID NO: 144779 - DNA, 38 bp, Artificial Sequence
  Synthetic oligonucleotide
atgacacccgcactgtcaccacactcgttcttctttga

SEQ ID NO: 144780 - DNA, 35 bp, Artificial Sequence
  Synthetic oligonucleotide
aacgagccgcctatcgcgcccctttttcgttccta

SEQ ID NO: 144781 - DNA, 36 bp, Artificial Sequence
  Synthetic oligonucleotide
tctggagggcaaatagggcgggacggggcttgcgta

SEQ ID NO: 144782 - DNA, 36 bp, Artificial Sequence
  Synthetic oligonucleotide
gttcactgtctatctggcctctcagttcgcccctta

SEQ ID NO: 144783 - DNA, 35 bp, Artificial Sequence
  Synthetic oligonucleotide
tctacgcccctcccagtaatgacccggtgaatacc

SEQ ID NO: 144784 - DNA, 35 bp, Artificial Sequence
  Synthetic oligonucleotide
tccacccacgaacgatctctcccagtcacgccccc

SEQ ID NO: 144785 - DNA, 35 bp, Artificial Sequence
  Synthetic oligonucleotide
tgcaagccgctcaacccatcgtccttacaccgccc

SEQ ID NO: 144786 - DNA, 35 bp, Artificial Sequence
  Synthetic oligonucleotide
ggccggtcgccgcccgtgtttatgccgccactccc

SEQ ID NO: 144787 - DNA, 35 bp, Artificial Sequence
  Synthetic oligonucleotide
gttgtacgccaccgcttgagccttgtactctcgcc

SEQ ID NO: 144788 - DNA, 35 bp, Artificial Sequence
  Synthetic oligonucleotide
acaccacctcaccatctgtgattcttaccctggcc

SEQ ID NO: 144789 - DNA, 35 bp, Artificial Sequence
  Synthetic oligonucleotide
tgtgaccaacacatcggttcttaggctccccctcc

SEQ ID NO: 144790 - DNA, 35 bp, Artificial Sequence
  Synthetic oligonucleotide
ttgactgctgccggggcaagtcgcctaatccctcc

SEQ ID NO: 144791 - DNA, 35 bp, Artificial Sequence
  Synthetic oligonucleotide
accgagcctcacaagctacctgaccttgtctctcc

SEQ ID NO: 144792 - DNA, 35 bp, Artificial Sequence
  Synthetic oligonucleotide
tccatagtgccgcgttatcccacatcgtcctccgc

SEQ ID NO: 144793 - DNA, 34 bp, Artificial Sequence
  Synthetic oligonucleotide
gaggtccctaccccgcccttccatgctggtttgc

SEQ ID NO: 144794 - DNA, 35 bp, Artificial Sequence
  Synthetic oligonucleotide
tacacagcccagtgctccaaccgaccacgcaactc

SEQ ID NO: 144795 - DNA, 35 bp, Artificial Sequence
  Synthetic oligonucleotide
acaccgtcagaaacctccacggccgctgcatcctc

SEQ ID NO: 144796 - DNA, 35 bp, Artificial Sequence
  Synthetic oligonucleotide
tgccgatgcctatggcccactcctaccttacgctc

SEQ ID NO: 144797 - DNA, 35 bp, Artificial Sequence
  Synthetic oligonucleotide
gtctcgcccgcccccctgcgctagctcccaattgg

SEQ ID NO: 144798 - DNA, 35 bp, Artificial Sequence
  Synthetic oligonucleotide
gccccctcgcccggcccgcgcgtgccgcatatcct

SEQ ID NO: 144799 - DNA, 35 bp, Artificial Sequence
  Synthetic oligonucleotide
atcgtcccttcaccgccgttgtccttggggccgct

SEQ ID NO: 144800 - DNA, 35 bp, Artificial Sequence
  Synthetic oligonucleotide
ttgtcgcccatgtttcgcctgactactgaccatct

SEQ ID NO: 144801 - DNA, 35 bp, Artificial Sequence
  Synthetic oligonucleotide
accccgcaagtctgtttcatctccaccgctgttct

SEQ ID NO: 144802 - DNA, 35 bp, Artificial Sequence
  Synthetic oligonucleotide
actcagacagaggcaagggggaaagggtaacaatt

SEQ ID NO: 144803 - DNA, 35 bp, Artificial Sequence
  Synthetic oligonucleotide
ttattaccccgctcctgattgcgctggcccctttt

SEQ ID NO: 144804 - DNA, 36 bp, Artificial Sequence
  Synthetic oligonucleotide
acagagcaggggggagggaggcgccgcaaaatataa

SEQ ID NO: 144805 - DNA, 36 bp, Artificial Sequence
  Synthetic oligonucleotide
accatcgtgacctctgcccatctcgtccgccgcaca

SEQ ID NO: 144806 - DNA, 36 bp, Artificial Sequence
  Synthetic oligonucleotide
atctgacaccctcgtgcactggccccttccattcca

SEQ ID NO: 144807 - DNA, 35 bp, Artificial Sequence
  Synthetic oligonucleotide
gcaatgcccttactcgtcttaatgccgcccttcca

SEQ ID NO: 144808 - DNA, 36 bp, Artificial Sequence
  Synthetic oligonucleotide
gcccacgcacgaagtagccgtgctcgccctcttcca

SEQ ID NO: 144809 - DNA, 36 bp, Artificial Sequence
  Synthetic oligonucleotide
ggggacctgcccccgttctctatttcgtttgttgca

SEQ ID NO: 144810 - DNA, 36 bp, Artificial Sequence
  Synthetic oligonucleotide
agcccccgctggtccttcgtcttaaagcctggctca

SEQ ID NO: 144811 - DNA, 37 bp, Artificial Sequence
  Synthetic oligonucleotide
ggaacaagaggtaatgggcagggggggaggatgcaga

SEQ ID NO: 144812 - DNA, 37 bp, Artificial Sequence
  Synthetic oligonucleotide
tgccaacccctctcatctgttttacgctccctctcga

SEQ ID NO: 144813 - DNA, 37 bp, Artificial Sequence
  Synthetic oligonucleotide
ggggaacaggatggcgggtagggggggtgttggagga

SEQ ID NO: 144814 - DNA, 36 bp, Artificial Sequence
  Synthetic oligonucleotide
tccatcgtccagaaagggggggaaattggggaggga

SEQ ID NO: 144815 - DNA, 36 bp, Artificial Sequence
  Synthetic oligonucleotide
attgcaccgggcgggcgagggattgggttctcctga

SEQ ID NO: 144816 - DNA, 38 bp, Artificial Sequence
  Synthetic oligonucleotide
atccacatccgtacgttctgtcctgctgcactcgctga

SEQ ID NO: 144817 - DNA, 37 bp, Artificial Sequence
  Synthetic oligonucleotide
tcagccgtgcctccctgtggtcgccccgcactcttga

SEQ ID NO: 144818 - DNA, 36 bp, Artificial Sequence
  Synthetic oligonucleotide
tgtaaacccactgcccctcaactgctgtacacagta

SEQ ID NO: 144819 - DNA, 35 bp, Artificial Sequence
  Synthetic oligonucleotide
ggtacccacactttgtctatctggtcactccctta

SEQ ID NO: 144820 - DNA, 36 bp, Artificial Sequence
  Synthetic oligonucleotide
tgctgatccatcctgcggtaccttagttcattctta

SEQ ID NO: 144821 - DNA, 35 bp, Artificial Sequence
  Synthetic oligonucleotide
gcgactcctgtcctcctccgtggcgcctccctgac

SEQ ID NO: 144822 - DNA, 35 bp, Artificial Sequence
  Synthetic oligonucleotide
tacttagcgcccacacacttcagcgacattccccc

SEQ ID NO: 144823 - DNA, 35 bp, Artificial Sequence
  Synthetic oligonucleotide
gagcgctctcctttttgctttaagccccgttcccc

SEQ ID NO: 144824 - DNA, 35 bp, Artificial Sequence
  Synthetic oligonucleotide
atggcctgacggacgtctacgctgcaccccctgcc

SEQ ID NO: 144825 - DNA, 35 bp, Artificial Sequence
  Synthetic oligonucleotide
tagattcactgcctggccggacggtccacacctcc

SEQ ID NO: 144826 - DNA, 35 bp, Artificial Sequence
  Synthetic oligonucleotide
tgcccaaccccgccgctccagttacaggtccctcc

SEQ ID NO: 144827 - DNA, 35 bp, Artificial Sequence
  Synthetic oligonucleotide
gcaggatgttcgagcgcgcctgtctcccttcttcc

SEQ ID NO: 144828 - DNA, 35 bp, Artificial Sequence
  Synthetic oligonucleotide
tccgccactcaccctggaaacaccgcctcctttcc

SEQ ID NO: 144829 - DNA, 35 bp, Artificial Sequence
  Synthetic oligonucleotide
gatgcacgtgccttctttagtcccatctcacaagc

SEQ ID NO: 144830 - DNA, 34 bp, Artificial Sequence
  Synthetic oligonucleotide
gacccgccacgttacctgttctaccatcccgagc

SEQ ID NO: 144831 - DNA, 35 bp, Artificial Sequence
  Synthetic oligonucleotide
gtgcttgtccctgttgtcctcgccgaagctgccgc

SEQ ID NO: 144832 - DNA, 35 bp, Artificial Sequence
  Synthetic oligonucleotide
ttgatcacttaccggttctgtttattctgcctatc

SEQ ID NO: 144833 - DNA, 35 bp, Artificial Sequence
  Synthetic oligonucleotide
gtgaggtcgacccgccgtggaccaatcgccccctc

SEQ ID NO: 144834 - DNA, 35 bp, Artificial Sequence
  Synthetic oligonucleotide
gtcccccctcctatacttgtcggagaccacacccg

SEQ ID NO: 144835 - DNA, 35 bp, Artificial Sequence
  Synthetic oligonucleotide
tgagcacgtatgccgtgaatccctccgttactccg

SEQ ID NO: 144836 - DNA, 35 bp, Artificial Sequence
  Synthetic oligonucleotide
atcaccccccgctatagcgctccagttcccgttgg

SEQ ID NO: 144837 - DNA, 35 bp, Artificial Sequence
  Synthetic oligonucleotide
cctaccagcccgtagtccgctttgccccatccctg

SEQ ID NO: 144838 - DNA, 35 bp, Artificial Sequence
  Synthetic oligonucleotide
gcgaagcgaggagggggggcaagatgagtgagaat

SEQ ID NO: 144839 - DNA, 35 bp, Artificial Sequence
  Synthetic oligonucleotide
accgctcgctctccctggtcatattaagttcccat

SEQ ID NO: 144840 - DNA, 35 bp, Artificial Sequence
  Synthetic oligonucleotide
gcctaccccgcagcccattcgccgagtaccgccat

SEQ ID NO: 144841 - DNA, 35 bp, Artificial Sequence
  Synthetic oligonucleotide
tacctcgcgtgctttcctgccttcatcctccgggt

SEQ ID NO: 144842 - DNA, 35 bp, Artificial Sequence
  Synthetic oligonucleotide
ttcactgtcctggcgtcccgtccctatcttctgtt

SEQ ID NO: 144843 - DNA, 35 bp, Artificial Sequence
  Synthetic oligonucleotide
gaggggggttgggtaagggaaagaggtcgatgttt

SEQ ID NO: 144844 - DNA, 35 bp, Artificial Sequence
  Synthetic oligonucleotide
acttgtacaccctcgtttgagccccgatatctgaa

SEQ ID NO: 144845 - DNA, 36 bp, Artificial Sequence
  Synthetic oligonucleotide
tcctccctccatgttcaacgcggcctgccctcctaa

SEQ ID NO: 144846 - DNA, 35 bp, Artificial Sequence
  Synthetic oligonucleotide
atccatcacctgcccgtttcgttgggctcttaaca

SEQ ID NO: 144847 - DNA, 35 bp, Artificial Sequence
  Synthetic oligonucleotide
cacaccccagaaggtctgtctcactccatcgcgca

SEQ ID NO: 144848 - DNA, 36 bp, Artificial Sequence
  Synthetic oligonucleotide
gacgctccgcatctgttccatttctacgccgcctca

SEQ ID NO: 144849 - DNA, 35 bp, Artificial Sequence
  Synthetic oligonucleotide
gtactgacgcctttcgctttgtaaactgttcctca

SEQ ID NO: 144850 - DNA, 37 bp, Artificial Sequence
  Synthetic oligonucleotide
tcgccccccacgagcgtcaacttccctccgttaacga

SEQ ID NO: 144851 - DNA, 35 bp, Artificial Sequence
  Synthetic oligonucleotide
tctacaccgccgccttacgtccctagtcagtagga

SEQ ID NO: 144852 - DNA, 38 bp, Artificial Sequence
  Synthetic oligonucleotide
aacgcttgaccatcctgctgtgcccgcccctatcctga

SEQ ID NO: 144853 - DNA, 38 bp, Artificial Sequence
  Synthetic oligonucleotide
attcgtcgcgccgtgcctcctttcccccctgagcgtga

SEQ ID NO: 144854 - DNA, 38 bp, Artificial Sequence
  Synthetic oligonucleotide
gaccatgaaggggggattatgagggacgtggagggtga

SEQ ID NO: 144855 - DNA, 36 bp, Artificial Sequence
  Synthetic oligonucleotide
atgccgccctccttagccacctttaccccatgttga

SEQ ID NO: 144856 - DNA, 35 bp, Artificial Sequence
  Synthetic oligonucleotide
gcctgccgaacccgccttcgtatgacacctctgta

SEQ ID NO: 144857 - DNA, 35 bp, Artificial Sequence
  Synthetic oligonucleotide
gtggccagccgctctcatttttacgacttctccac

SEQ ID NO: 144858 - DNA, 35 bp, Artificial Sequence
  Synthetic oligonucleotide
gttatcctgtccgcccgccctctcggtttactacc

SEQ ID NO: 144859 - DNA, 35 bp, Artificial Sequence
  Synthetic oligonucleotide
tacatggcgtcccgaatggctccatctttccatcc

SEQ ID NO: 144860 - DNA, 35 bp, Artificial Sequence
  Synthetic oligonucleotide
tgtgcgtaccgcctgctcacacttccaacgactcc

SEQ ID NO: 144861 - DNA, 35 bp, Artificial Sequence
  Synthetic oligonucleotide
tgcacagttcacccgctagacaccccacccgacgc

SEQ ID NO: 144862 - DNA, 35 bp, Artificial Sequence
  Synthetic oligonucleotide
tatgagcaggcctcgctatctgacacatcccccgc

SEQ ID NO: 144863 - DNA, 35 bp, Artificial Sequence
  Synthetic oligonucleotide
acctgccacaacaacgcaaactcccactggccctc

SEQ ID NO: 144864 - DNA, 35 bp, Artificial Sequence
  Synthetic oligonucleotide
tgcatcgggcgccactgcccagaactcactgcctc

SEQ ID NO: 144865 - DNA, 35 bp, Artificial Sequence
  Synthetic oligonucleotide
gcccccacgttgagttttcctgatatcgtcctctc

SEQ ID NO: 144866 - DNA, 35 bp, Artificial Sequence
  Synthetic oligonucleotide
gccggtgtgtctccatctgtttctttatgtcattc

SEQ ID NO: 144867 - DNA, 33 bp, Artificial Sequence
  Synthetic oligonucleotide
gtctccatgcctgcccgttacgtaggtcctttc

SEQ ID NO: 144868 - DNA, 35 bp, Artificial Sequence
  Synthetic oligonucleotide
gacgagtgttgctcgctatcaatcccccgcttttc

SEQ ID NO: 144869 - DNA, 35 bp, Artificial Sequence
  Synthetic oligonucleotide
tgcccacctactctaacagcgcactcatctctccg

SEQ ID NO: 144870 - DNA, 35 bp, Artificial Sequence
  Synthetic oligonucleotide
gcgctacgccatttgccactttaacatctttctcg

SEQ ID NO: 144871 - DNA, 35 bp, Artificial Sequence
  Synthetic oligonucleotide
ttcctccgccactcggccatgagacccctatcatg

SEQ ID NO: 144872 - DNA, 35 bp, Artificial Sequence
  Synthetic oligonucleotide
gaagaggagaggtgacgttgagtaaggggttgatg

SEQ ID NO: 144873 - DNA, 35 bp, Artificial Sequence
  Synthetic oligonucleotide
aaaggatgggcgaggtgggctacaggggggatgtg

SEQ ID NO: 144874 - DNA, 35 bp, Artificial Sequence
  Synthetic oligonucleotide
tgccgcacccgcctacttaccccagtgaacctact

SEQ ID NO: 144875 - DNA, 35 bp, Artificial Sequence
  Synthetic oligonucleotide
tcgccgctcattcgttctgaccgccccaatcgcct

SEQ ID NO: 144876 - DNA, 35 bp, Artificial Sequence
  Synthetic oligonucleotide
ttgagtgcgccctgctatgcattgccctcttgcct

SEQ ID NO: 144877 - DNA, 35 bp, Artificial Sequence
  Synthetic oligonucleotide
atccacatcaatcacgctcggccgttttacctgct

SEQ ID NO: 144878 - DNA, 35 bp, Artificial Sequence
  Synthetic oligonucleotide
gtgctacctcacgcgtaccgctgctgcatccatct

SEQ ID NO: 144879 - DNA, 35 bp, Artificial Sequence
  Synthetic oligonucleotide
tgacgatgcccacccgcgcagcaccgtttccttct

SEQ ID NO: 144880 - DNA, 35 bp, Artificial Sequence
  Synthetic oligonucleotide
gaatcaccctcgcgggtctcactatcccctgttct

SEQ ID NO: 144881 - DNA, 35 bp, Artificial Sequence
  Synthetic oligonucleotide
gcccgtcatgtacgcaaccccgctcgctgctttct

SEQ ID NO: 144882 - DNA, 35 bp, Artificial Sequence
  Synthetic oligonucleotide
tccgtccggtgccaatctgctcctcccacctccgt

SEQ ID NO: 144883 - DNA, 36 bp, Artificial Sequence
  Synthetic oligonucleotide
gaaccgatctgttaccctggtcattcacgttaccaa

SEQ ID NO: 144884 - DNA, 35 bp, Artificial Sequence
  Synthetic oligonucleotide
gtcctcgtacaccgctagcactcctcctcgcgcca

SEQ ID NO: 144885 - DNA, 37 bp, Artificial Sequence
  Synthetic oligonucleotide
gtagagagggtggtgggcggacagcagacagaacaga

SEQ ID NO: 144886 - DNA, 37 bp, Artificial Sequence
  Synthetic oligonucleotide
atcccccgcgactcgtcctgccccacccgttgctaga

SEQ ID NO: 144887 - DNA, 37 bp, Artificial Sequence
  Synthetic oligonucleotide
gttgcccctatccccaccaccgccgtcgtttgaacga

SEQ ID NO: 144888 - DNA, 37 bp, Artificial Sequence
  Synthetic oligonucleotide
tcactgggcccatcccgcataacgctacacataccga

SEQ ID NO: 144889 - DNA, 37 bp, Artificial Sequence
  Synthetic oligonucleotide
ggggtggggacgaaatggggcggggatgtctcgtcga

SEQ ID NO: 144890 - DNA, 35 bp, Artificial Sequence
  Synthetic oligonucleotide
tgatcgacgcgctccttgctccctttacacttcga

SEQ ID NO: 144891 - DNA, 37 bp, Artificial Sequence
  Synthetic oligonucleotide
gccgccaccaatatccacctgcccttagttcctcgga

SEQ ID NO: 144892 - DNA, 37 bp, Artificial Sequence
  Synthetic oligonucleotide
tccgaatcacctcgctcctgttttgtcttctctggga

SEQ ID NO: 144893 - DNA, 37 bp, Artificial Sequence
  Synthetic oligonucleotide
tagggcgggcgggggaaaaaacgtaggaacggtggga

SEQ ID NO: 144894 - DNA, 37 bp, Artificial Sequence
  Synthetic oligonucleotide
tcactggccctcaatcgttaccccgactccccctgga

SEQ ID NO: 144895 - DNA, 38 bp, Artificial Sequence
  Synthetic oligonucleotide
atcgggccccacactgttctgccatcacctgccaatga

SEQ ID NO: 144896 - DNA, 38 bp, Artificial Sequence
  Synthetic oligonucleotide
gccaacgcgagacaggggtatgaaggggggcgggttga

SEQ ID NO: 144897 - DNA, 37 bp, Artificial Sequence
  Synthetic oligonucleotide
tgatcagcccccggtctgtcggccaccctccctttga

SEQ ID NO: 144898 - DNA, 36 bp, Artificial Sequence
  Synthetic oligonucleotide
accgctgtgttgcgtgcttttcccgtgccatcccta

SEQ ID NO: 144899 - DNA, 36 bp, Artificial Sequence
  Synthetic oligonucleotide
gccgtcacccgcctccaatgatgaacgccttccgta

SEQ ID NO: 144900 - DNA, 35 bp, Artificial Sequence
  Synthetic oligonucleotide
tgccccgtgaatcgcgccgtcgaacgacctcccac

SEQ ID NO: 144901 - DNA, 35 bp, Artificial Sequence
  Synthetic oligonucleotide
gacgccccaggggctgcgaaccgtcctctatccac

SEQ ID NO: 144902 - DNA, 35 bp, Artificial Sequence
  Synthetic oligonucleotide
atgttcgccccacctgaatagctccattaaatgac

SEQ ID NO: 144903 - DNA, 35 bp, Artificial Sequence
  Synthetic oligonucleotide
gaccacaactgcctttaacctgcctggaatgcacc

SEQ ID NO: 144904 - DNA, 35 bp, Artificial Sequence
  Synthetic oligonucleotide
gacccccgtgcctcactcgttcatccagtgcgacc

SEQ ID NO: 144905 - DNA, 35 bp, Artificial Sequence
  Synthetic oligonucleotide
ttacatcctcaggcacgttacaggataccgccccc

SEQ ID NO: 144906 - DNA, 35 bp, Artificial Sequence
  Synthetic oligonucleotide
aacccatccccgttggagagccccaatttgcgccc

SEQ ID NO: 144907 - DNA, 35 bp, Artificial Sequence
  Synthetic oligonucleotide
aaaatgcgcggccccggattgcgctcctctctccc

SEQ ID NO: 144908 - DNA, 35 bp, Artificial Sequence
  Synthetic oligonucleotide
acgtgctccaccaggaccgactcccttatttcgcc

SEQ ID NO: 144909 - DNA, 35 bp, Artificial Sequence
  Synthetic oligonucleotide
tacgctagtatcaggtatcgtgcccccttcgctcc

SEQ ID NO: 144910 - DNA, 35 bp, Artificial Sequence
  Synthetic oligonucleotide
tctccatctacgctggccacgccatgtacttctcc

SEQ ID NO: 144911 - DNA, 35 bp, Artificial Sequence
  Synthetic oligonucleotide
ataccccgcggcgcagttaaccgtcttagccccgc

SEQ ID NO: 144912 - DNA, 35 bp, Artificial Sequence
  Synthetic oligonucleotide
ttggtcacctcccccctgcgccaaactaaatgcgc

SEQ ID NO: 144913 - DNA, 35 bp, Artificial Sequence
  Synthetic oligonucleotide
tccatattgacgcactcactccgtcgccctcctgc

SEQ ID NO: 144914 - DNA, 35 bp, Artificial Sequence
  Synthetic oligonucleotide
tccagctcacgtgtggcttgtccacgtcacccatc

SEQ ID NO: 144915 - DNA, 35 bp, Artificial Sequence
  Synthetic oligonucleotide
tgtccctcctagccggtgtaggatactcacccctc

SEQ ID NO: 144916 - DNA, 35 bp, Artificial Sequence
  Synthetic oligonucleotide
gcctcattcatccagttagtcgctacaccaaagtc

SEQ ID NO: 144917 - DNA, 35 bp, Artificial Sequence
  Synthetic oligonucleotide
gggaaaacgggtggacggaggggagttatggttag

SEQ ID NO: 144918 - DNA, 35 bp, Artificial Sequence
  Synthetic oligonucleotide
tcgctatctccgtctccgcccgttcgtacccaccg

SEQ ID NO: 144919 - DNA, 35 bp, Artificial Sequence
  Synthetic oligonucleotide
tcattgcggtgtcatgtccttcccgtcccgactcg

SEQ ID NO: 144920 - DNA, 35 bp, Artificial Sequence
  Synthetic oligonucleotide
agttgtacacatcagcgcattacgttccatcttcg

SEQ ID NO: 144921 - DNA, 35 bp, Artificial Sequence
  Synthetic oligonucleotide
tgtcggtccctgctcctcctttgggcttgtccact

SEQ ID NO: 144922 - DNA, 35 bp, Artificial Sequence
  Synthetic oligonucleotide
tcgccctattgctcccagcgttactacacggccct

SEQ ID NO: 144923 - DNA, 35 bp, Artificial Sequence
  Synthetic oligonucleotide
gtggcggaggcggggggtggatggatggcaatcaa

SEQ ID NO: 144924 - DNA, 36 bp, Artificial Sequence
  Synthetic oligonucleotide
tgctccccttcccgtgtagcacagccacacttccca

SEQ ID NO: 144925 - DNA, 35 bp, Artificial Sequence
  Synthetic oligonucleotide
tcagtgccaccacctgggcccgctcattccctcca

SEQ ID NO: 144926 - DNA, 36 bp, Artificial Sequence
  Synthetic oligonucleotide
gtggcacctctccacacccctaatgcacgcccccga

SEQ ID NO: 144927 - DNA, 36 bp, Artificial Sequence
  Synthetic oligonucleotide
gcaaccttagctcaactgccatcctgctcccctcga

SEQ ID NO: 144928 - DNA, 37 bp, Artificial Sequence
  Synthetic oligonucleotide
gtctgtctcagccacctgccccgctacctcccgtcga

SEQ ID NO: 144929 - DNA, 37 bp, Artificial Sequence
  Synthetic oligonucleotide
tacccaccactgggccctttcacacccgtcccaagga

SEQ ID NO: 144930 - DNA, 36 bp, Artificial Sequence
  Synthetic oligonucleotide
ggtgggaggattagcgggggcaggctaccgggagga

SEQ ID NO: 144931 - DNA, 35 bp, Artificial Sequence
  Synthetic oligonucleotide
gttccgtcggtgtcctccctgtttaccatctcgga

SEQ ID NO: 144932 - DNA, 37 bp, Artificial Sequence
  Synthetic oligonucleotide
tcacaaggggccgtaaaagggtggggacgcatgggga

SEQ ID NO: 144933 - DNA, 37 bp, Artificial Sequence
  Synthetic oligonucleotide
gactcgccccacgactccctcattgccctgtactgga

SEQ ID NO: 144934 - DNA, 38 bp, Artificial Sequence
  Synthetic oligonucleotide
tatgcggggagtaagtggtcgggggagggcgaaaatga

SEQ ID NO: 144935 - DNA, 38 bp, Artificial Sequence
  Synthetic oligonucleotide
ggcgcctccgctggctgcctgaccaccctctctcctga

SEQ ID NO: 144936 - DNA, 38 bp, Artificial Sequence
  Synthetic oligonucleotide
tgcacgcccctgctcctacaataacatcccgcgagtga

SEQ ID NO: 144937 - DNA, 36 bp, Artificial Sequence
  Synthetic oligonucleotide
gggaacgcaggacaggagctgagggtgagggggtga

SEQ ID NO: 144938 - DNA, 36 bp, Artificial Sequence
  Synthetic oligonucleotide
tacgggtagtaggggggtgggagcagaacgcgaata

SEQ ID NO: 144939 - DNA, 36 bp, Artificial Sequence
  Synthetic oligonucleotide
atttgcctcgcagactccttggccttttctttcgta

SEQ ID NO: 144940 - DNA, 35 bp, Artificial Sequence
  Synthetic oligonucleotide
gaatgcctaggccgcaccgcatgcgccccctgaac

SEQ ID NO: 144941 - DNA, 35 bp, Artificial Sequence
  Synthetic oligonucleotide
gtcacccgcagtggtctacacacttctcaattcac

SEQ ID NO: 144942 - DNA, 35 bp, Artificial Sequence
  Synthetic oligonucleotide
tctcccagcaactactgtcattcacgtttccttac

SEQ ID NO: 144943 - DNA, 35 bp, Artificial Sequence
  Synthetic oligonucleotide
gtgtgcggaaatctgtctcccactcgcccagtacc

SEQ ID NO: 144944 - DNA, 35 bp, Artificial Sequence
  Synthetic oligonucleotide
tgcgcacttgcgtactgccgtacttgcttatcccc

SEQ ID NO: 144945 - DNA, 35 bp, Artificial Sequence
  Synthetic oligonucleotide
ggtttgtcagacgtcgcctaccattctgtcttccc

SEQ ID NO: 144946 - DNA, 35 bp, Artificial Sequence
  Synthetic oligonucleotide
atctcctgccttagattctgccccatccgatcgcc

SEQ ID NO: 144947 - DNA, 35 bp, Artificial Sequence
  Synthetic oligonucleotide
taggacattcgctgcattaacatcccttcttggcc

SEQ ID NO: 144948 - DNA, 35 bp, Artificial Sequence
  Synthetic oligonucleotide
acgacccctgatttacgccgggttaccttttctcc

SEQ ID NO: 144949 - DNA, 35 bp, Artificial Sequence
  Synthetic oligonucleotide
gtgctccgcgagcgtgcatttttctcataccctgc

SEQ ID NO: 144950 - DNA, 35 bp, Artificial Sequence
  Synthetic oligonucleotide
gttgcgtccattcagtccatccccggttcgcgtgc

SEQ ID NO: 144951 - DNA, 35 bp, Artificial Sequence
  Synthetic oligonucleotide
atccactcccgcttggtttattgttgggccgttgc

SEQ ID NO: 144952 - DNA, 35 bp, Artificial Sequence
  Synthetic oligonucleotide
atgtccacccacacgtgctaactgccacagctttc

SEQ ID NO: 144953 - DNA, 35 bp, Artificial Sequence
  Synthetic oligonucleotide
gatattcagccgcccagttgccgcccttcctcacg

SEQ ID NO: 144954 - DNA, 35 bp, Artificial Sequence
  Synthetic oligonucleotide
gtcctagcccaggctctcccttttagttacttccg

SEQ ID NO: 144955 - DNA, 35 bp, Artificial Sequence
  Synthetic oligonucleotide
tgccttccacccgtcctgacctctcatcgatttcg

SEQ ID NO: 144956 - DNA, 35 bp, Artificial Sequence
  Synthetic oligonucleotide
gttcacccctcacactggccaaatcaattttttcg

SEQ ID NO: 144957 - DNA, 36 bp, Artificial Sequence
  Synthetic oligonucleotide
gggcgaatgcagggggacggggaagaatggtgaagg

SEQ ID NO: 144958 - DNA, 34 bp, Artificial Sequence
  Synthetic oligonucleotide
tctacctctgcaaagcccgacccgatcctacatg

SEQ ID NO: 144959 - DNA, 35 bp, Artificial Sequence
  Synthetic oligonucleotide
tacagagcgcgaatgacgtctatcgcccgcctcct

SEQ ID NO: 144960 - DNA, 35 bp, Artificial Sequence
  Synthetic oligonucleotide
gcacagtcccctcgagtgccccatctgtagctcct

SEQ ID NO: 144961 - DNA, 35 bp, Artificial Sequence
  Synthetic oligonucleotide
gccgttagacttaccacccgtgcctgttcacttct

SEQ ID NO: 144962 - DNA, 36 bp, Artificial Sequence
  Synthetic oligonucleotide
gggagggccgggagggtgtaccgacggctatcctaa

SEQ ID NO: 144963 - DNA, 36 bp, Artificial Sequence
  Synthetic oligonucleotide
tcacttgccccccgcgcgccgacgctcctggtaaca

SEQ ID NO: 144964 - DNA, 36 bp, Artificial Sequence
  Synthetic oligonucleotide
acccgccacggtcaaacatagccctcccccagtaca

SEQ ID NO: 144965 - DNA, 35 bp, Artificial Sequence
  Synthetic oligonucleotide
ggtacatgccaacccttatccactagcccgggcca

SEQ ID NO: 144966 - DNA, 36 bp, Artificial Sequence
  Synthetic oligonucleotide
tcctgatccaccgatgattaccttgttacgattcca

SEQ ID NO: 144967 - DNA, 36 bp, Artificial Sequence
  Synthetic oligonucleotide
tagtcgcagtccgaacttggtttcctcaccccttca

SEQ ID NO: 144968 - DNA, 37 bp, Artificial Sequence
  Synthetic oligonucleotide
acatcccgcatagctacgtttccagcccaatccccga

SEQ ID NO: 144969 - DNA, 36 bp, Artificial Sequence
  Synthetic oligonucleotide
gtgacatccaccggcccctgcgtttagccaatccga

SEQ ID NO: 144970 - DNA, 37 bp, Artificial Sequence
  Synthetic oligonucleotide
gtgggtgaggcataagggcgagggggaccggcaagga

SEQ ID NO: 144971 - DNA, 37 bp, Artificial Sequence
  Synthetic oligonucleotide
gacacctctcgcaggagaacccaacaccacccccgga

SEQ ID NO: 144972 - DNA, 37 bp, Artificial Sequence
  Synthetic oligonucleotide
tgtgtaggacgggaaaggtggaacgtagattaaggga

SEQ ID NO: 144973 - DNA, 36 bp, Artificial Sequence
  Synthetic oligonucleotide
tgcccgccgccactgacacatcacaccgcctatgga

SEQ ID NO: 144974 - DNA, 37 bp, Artificial Sequence
  Synthetic oligonucleotide
gaggggggatagggtggggtgatgcagtctttatgga

SEQ ID NO: 144975 - DNA, 37 bp, Artificial Sequence
  Synthetic oligonucleotide
tgccgtccatctacatttcgcctgaccgtgcccctga

SEQ ID NO: 144976 - DNA, 35 bp, Artificial Sequence
  Synthetic oligonucleotide
gggtcgggtgcgggggaaagcgggggggactctga

SEQ ID NO: 144977 - DNA, 38 bp, Artificial Sequence
  Synthetic oligonucleotide
gcgagtggagcgaagggggggcaagcatagggtggtga

SEQ ID NO: 144978 - DNA, 37 bp, Artificial Sequence
  Synthetic oligonucleotide
gtaccccacacactcccccgatgctgtataagcttga

SEQ ID NO: 144979 - DNA, 36 bp, Artificial Sequence
  Synthetic oligonucleotide
gtcacctcagctctaaggcgccttgttcacctccta

SEQ ID NO: 144980 - DNA, 35 bp, Artificial Sequence
  Synthetic oligonucleotide
ccactgccatcgcccccgtttactccaccgttcta

SEQ ID NO: 144981 - DNA, 35 bp, Artificial Sequence
  Synthetic oligonucleotide
gttcgccccttgccttcgccccattggccgctgac

SEQ ID NO: 144982 - DNA, 35 bp, Artificial Sequence
  Synthetic oligonucleotide
tccgggcccgcccacatgattgctcctacttctac

SEQ ID NO: 144983 - DNA, 35 bp, Artificial Sequence
  Synthetic oligonucleotide
gatcgattccgtgcaggctttctcctgtcgccccc

SEQ ID NO: 144984 - DNA, 35 bp, Artificial Sequence
  Synthetic oligonucleotide
gccatcctgtcgaaatccactgtaaccgctgcccc

SEQ ID NO: 144985 - DNA, 35 bp, Artificial Sequence
  Synthetic oligonucleotide
agctgtgccccggcaccctgtccaacatttccgcc

SEQ ID NO: 144986 - DNA, 35 bp, Artificial Sequence
  Synthetic oligonucleotide
ggaatgccgcccccgttttacgacctaacctgtcc

SEQ ID NO: 144987 - DNA, 35 bp, Artificial Sequence
  Synthetic oligonucleotide
ttgccacagggtgttatgctccccgctcatgttcc

SEQ ID NO: 144988 - DNA, 35 bp, Artificial Sequence
  Synthetic oligonucleotide
ggttcgccacctgttttacttcccctacgttttgc

SEQ ID NO: 144989 - DNA, 35 bp, Artificial Sequence
  Synthetic oligonucleotide
gtaacccacatctgcatcaatccaccgcctcgctc

SEQ ID NO: 144990 - DNA, 35 bp, Artificial Sequence
  Synthetic oligonucleotide
gcacgtgcctctgcaatcccctcgagtcttatctc

SEQ ID NO: 144991 - DNA, 35 bp, Artificial Sequence
  Synthetic oligonucleotide
gcaatccgcctctgtaaattgtcaccttccctgtc

SEQ ID NO: 144992 - DNA, 35 bp, Artificial Sequence
  Synthetic oligonucleotide
tactcgacctccctagtgcagcctgtagtaccttc

SEQ ID NO: 144993 - DNA, 35 bp, Artificial Sequence
  Synthetic oligonucleotide
tgacactcccagattccctccacgcacgaccgttc

SEQ ID NO: 144994 - DNA, 35 bp, Artificial Sequence
  Synthetic oligonucleotide
aatcccctccgcagaccataacgacctcattgttc

SEQ ID NO: 144995 - DNA, 35 bp, Artificial Sequence
  Synthetic oligonucleotide
acagcccaatctgttttcgtcattacttatcctag

SEQ ID NO: 144996 - DNA, 35 bp, Artificial Sequence
  Synthetic oligonucleotide
agccaccacaccaggatgatatccaaccttcaccg

SEQ ID NO: 144997 - DNA, 35 bp, Artificial Sequence
  Synthetic oligonucleotide
gtggacctcaggatctccatgcttcttctcctccg

SEQ ID NO: 144998 - DNA, 35 bp, Artificial Sequence
  Synthetic oligonucleotide
tccagttcacccttggccctccgtcttgcttagcg

SEQ ID NO: 144999 - DNA, 35 bp, Artificial Sequence
  Synthetic oligonucleotide
tagcctgtgcagtcctagtccccttggtcctcctg

SEQ ID NO: 145000 - DNA, 35 bp, Artificial Sequence
  Synthetic oligonucleotide
gcgtaccgccgctctacccgcgaccaatccttaat

SEQ ID NO: 145001 - DNA, 35 bp, Artificial Sequence
  Synthetic oligonucleotide
gtctccctcaccagttatgcacctagccacggtat

SEQ ID NO: 145002 - DNA, 35 bp, Artificial Sequence
  Synthetic oligonucleotide
aattccccgcctagcccgtacattcctctgtgcct

SEQ ID NO: 145003 - DNA, 35 bp, Artificial Sequence
  Synthetic oligonucleotide
taagcctgctgccactcctggatacatctgttcgt

SEQ ID NO: 145004 - DNA, 35 bp, Artificial Sequence
  Synthetic oligonucleotide
ttctgccgccgcctattcattggaagacctttggt

SEQ ID NO: 145005 - DNA, 35 bp, Artificial Sequence
  Synthetic oligonucleotide
gcatgtaaccgggccagcctcttcagcgaagctgt

SEQ ID NO: 145006 - DNA, 36 bp, Artificial Sequence
  Synthetic oligonucleotide
aaccctgcctccgaccgtctattcaacttaagctaa

SEQ ID NO: 145007 - DNA, 35 bp, Artificial Sequence
  Synthetic oligonucleotide
tccaccgctgtcacacccgtaatcaaacacccaca

SEQ ID NO: 145008 - DNA, 36 bp, Artificial Sequence
  Synthetic oligonucleotide
ttccgccgcaccgccgtatgcccatcactgtcacca

SEQ ID NO: 145009 - DNA, 35 bp, Artificial Sequence
  Synthetic oligonucleotide
gacctgccagaaccgtcgtacccctaccgccccca

SEQ ID NO: 145010 - DNA, 36 bp, Artificial Sequence
  Synthetic oligonucleotide
acgaccctcttattgttcaacccgccagactcgcca

SEQ ID NO: 145011 - DNA, 36 bp, Artificial Sequence
  Synthetic oligonucleotide
accgcctgggctcccttctgtcactctcgctatcca

SEQ ID NO: 145012 - DNA, 35 bp, Artificial Sequence
  Synthetic oligonucleotide
tgtccacccagcccattgtaatcgccccctctgca

SEQ ID NO: 145013 - DNA, 37 bp, Artificial Sequence
  Synthetic oligonucleotide
tccgcccctaacatgcacgccgctcccctattctcga

SEQ ID NO: 145014 - DNA, 38 bp, Artificial Sequence
  Synthetic oligonucleotide
acgctccccttcctgtgcttcattgcctagccgcatga

SEQ ID NO: 145015 - DNA, 38 bp, Artificial Sequence
  Synthetic oligonucleotide
gatgagaggcaggaggggaaacagggtcagtggtatga

SEQ ID NO: 145016 - DNA, 35 bp, Artificial Sequence
  Synthetic oligonucleotide
gaggaagaagggggtggggatgagagtttgggtga

SEQ ID NO: 145017 - DNA, 38 bp, Artificial Sequence
  Synthetic oligonucleotide
atagccaccccgccctgtctttcgtgattgcaacttga

SEQ ID NO: 145018 - DNA, 38 bp, Artificial Sequence
  Synthetic oligonucleotide
tcatccaagctcttgctgtctcctcccatccctcttga

SEQ ID NO: 145019 - DNA, 35 bp, Artificial Sequence
  Synthetic oligonucleotide
gacgccagtcgcgtttacatccctccggcctctta

SEQ ID NO: 145020 - DNA, 35 bp, Artificial Sequence
  Synthetic oligonucleotide
gacccgtatcggcttgatcgctccaccccgcttta

SEQ ID NO: 145021 - DNA, 35 bp, Artificial Sequence
  Synthetic oligonucleotide
gaaggggggctcaaaagctgggggcggggttcaac

SEQ ID NO: 145022 - DNA, 34 bp, Artificial Sequence
  Synthetic oligonucleotide
tcaggtgctgcttcttccgcgcgcccccccctac

SEQ ID NO: 145023 - DNA, 35 bp, Artificial Sequence
  Synthetic oligonucleotide
acacatcagaagtagccctgtcccccggtcttacc

SEQ ID NO: 145024 - DNA, 35 bp, Artificial Sequence
  Synthetic oligonucleotide
cccaccctttcagtctgttcccctctaggccgccc

SEQ ID NO: 145025 - DNA, 35 bp, Artificial Sequence
  Synthetic oligonucleotide
acgtgacccgccctcttgtttttgaacccgttccc

SEQ ID NO: 145026 - DNA, 35 bp, Artificial Sequence
  Synthetic oligonucleotide
tcatcatgtcccatcctttcctgtgtgccggatcc

SEQ ID NO: 145027 - DNA, 35 bp, Artificial Sequence
  Synthetic oligonucleotide
gtgtgcgccgccgcgaccaataaaggtcctactcc

SEQ ID NO: 145028 - DNA, 35 bp, Artificial Sequence
  Synthetic oligonucleotide
taaccgccacgactgacccctccttttcgtgttcc

SEQ ID NO: 145029 - DNA, 35 bp, Artificial Sequence
  Synthetic oligonucleotide
ggtctgcctcgttcgcccacaccgtatttgtcatc

SEQ ID NO: 145030 - DNA, 35 bp, Artificial Sequence
  Synthetic oligonucleotide
aaacacatcccgattgcatgctggccaccttcttc

SEQ ID NO: 145031 - DNA, 35 bp, Artificial Sequence
  Synthetic oligonucleotide
gggaaggggactagtcggaggtaatagggggaaag

SEQ ID NO: 145032 - DNA, 35 bp, Artificial Sequence
  Synthetic oligonucleotide
tcaccgccgttggtgctgtgttttcccgctccccg

SEQ ID NO: 145033 - DNA, 35 bp, Artificial Sequence
  Synthetic oligonucleotide
acctccccctacccgaatccgcctcgctcctgccg

SEQ ID NO: 145034 - DNA, 35 bp, Artificial Sequence
  Synthetic oligonucleotide
acacccccgaccactcgagccctatggtagacatg

SEQ ID NO: 145035 - DNA, 35 bp, Artificial Sequence
  Synthetic oligonucleotide
agaacatcacctcactcagtcatacgctcaccctg

SEQ ID NO: 145036 - DNA, 35 bp, Artificial Sequence
  Synthetic oligonucleotide
gtccgccaccatccacccatagctcccgccgcttg

SEQ ID NO: 145037 - DNA, 35 bp, Artificial Sequence
  Synthetic oligonucleotide
tccacccttacctccctcgtccgtatctggcggat

SEQ ID NO: 145038 - DNA, 35 bp, Artificial Sequence
  Synthetic oligonucleotide
acgagggcccactcctctgtatgtttccctgctat

SEQ ID NO: 145039 - DNA, 34 bp, Artificial Sequence
  Synthetic oligonucleotide
actctcctccgctttggtgcgtagcacagtgcct

SEQ ID NO: 145040 - DNA, 34 bp, Artificial Sequence
  Synthetic oligonucleotide
gcctagcggtgcttcttctcctccatctccccgt

SEQ ID NO: 145041 - DNA, 36 bp, Artificial Sequence
  Synthetic oligonucleotide
gaaggacaagaaggtaggtggtggttgagggggaaa

SEQ ID NO: 145042 - DNA, 36 bp, Artificial Sequence
  Synthetic oligonucleotide
tccaccccatgtgttctcctatcccccttcaataca

SEQ ID NO: 145043 - DNA, 36 bp, Artificial Sequence
  Synthetic oligonucleotide
tcgtactcacccttggctgtccatcattcggtttca

SEQ ID NO: 145044 - DNA, 37 bp, Artificial Sequence
  Synthetic oligonucleotide
aacggggtagggtagggagggttagagagctgacaga

SEQ ID NO: 145045 - DNA, 37 bp, Artificial Sequence
  Synthetic oligonucleotide
gaggggagggggtagcggtagggcggaaccagaagga

SEQ ID NO: 145046 - DNA, 37 bp, Artificial Sequence
  Synthetic oligonucleotide
gtgacgggtacaaaggagttgcggagggagtagcgga

SEQ ID NO: 145047 - DNA, 37 bp, Artificial Sequence
  Synthetic oligonucleotide
gggaggagtggtggagggggtaggctggtttagggga

SEQ ID NO: 145048 - DNA, 38 bp, Artificial Sequence
  Synthetic oligonucleotide
tgagacagaaactgggtgggaaaaaggagaggcgatga

SEQ ID NO: 145049 - DNA, 38 bp, Artificial Sequence
  Synthetic oligonucleotide
tcggggttggtggtaggaggccggataggaggggatga

SEQ ID NO: 145050 - DNA, 36 bp, Artificial Sequence
  Synthetic oligonucleotide
aatgggagggtggcgtggggactgagaaccttatga

SEQ ID NO: 145051 - DNA, 38 bp, Artificial Sequence
  Synthetic oligonucleotide
gtcccccctctttatgtgtaacacctcgtatcacctga

SEQ ID NO: 145052 - DNA, 38 bp, Artificial Sequence
  Synthetic oligonucleotide
gttaccccctgactgttttcgtcatcatagttccctga

SEQ ID NO: 145053 - DNA, 35 bp, Artificial Sequence
  Synthetic oligonucleotide
atggggaggggcgttgggcggccaaaggggtgtga

SEQ ID NO: 145054 - DNA, 38 bp, Artificial Sequence
  Synthetic oligonucleotide
tctagcaaccctcaccttgtttcctgtgccgcccttga

SEQ ID NO: 145055 - DNA, 36 bp, Artificial Sequence
  Synthetic oligonucleotide
tccacgactacgtgccctactgtcctgcaccttcta

SEQ ID NO: 145056 - DNA, 36 bp, Artificial Sequence
  Synthetic oligonucleotide
gccgccctccacgctctcgacggacattagcccgta

SEQ ID NO: 145057 - DNA, 35 bp, Artificial Sequence
  Synthetic oligonucleotide
ataccggagggttcaactcgctgcttaccgcctta

SEQ ID NO: 145058 - DNA, 35 bp, Artificial Sequence
  Synthetic oligonucleotide
gattcctcgcaccgcggctccaccttgcgccccac

SEQ ID NO: 145059 - DNA, 35 bp, Artificial Sequence
  Synthetic oligonucleotide
acgcagatcctaccgcctggccgtatgctcccacc

SEQ ID NO: 145060 - DNA, 35 bp, Artificial Sequence
  Synthetic oligonucleotide
gtaccgacctggtaacgtatttgtctctttgcccc

SEQ ID NO: 145061 - DNA, 35 bp, Artificial Sequence
  Synthetic oligonucleotide
gcagtcccatccagcgtatctagtaacaacgtccc

SEQ ID NO: 145062 - DNA, 35 bp, Artificial Sequence
  Synthetic oligonucleotide
tgtgcatgacctcaaattctactatcactgcttcc

SEQ ID NO: 145063 - DNA, 35 bp, Artificial Sequence
  Synthetic oligonucleotide
acttgcccctggatccagtcttttgctgtcaccgc

SEQ ID NO: 145064 - DNA, 35 bp, Artificial Sequence
  Synthetic oligonucleotide
tgactatcctagcgattgctctcaccgacccttgc

SEQ ID NO: 145065 - DNA, 35 bp, Artificial Sequence
  Synthetic oligonucleotide
atacatggttccggtgtagtagcgtgcgctccctc

SEQ ID NO: 145066 - DNA, 35 bp, Artificial Sequence
  Synthetic oligonucleotide
tccccattcgctttgctaccgtttaaggtctgctc

SEQ ID NO: 145067 - DNA, 35 bp, Artificial Sequence
  Synthetic oligonucleotide
tccaaccttgctcttgatcctctgtgcaccccccg

SEQ ID NO: 145068 - DNA, 35 bp, Artificial Sequence
  Synthetic oligonucleotide
gcgatgccctttcccatgtaaactgtctctccgcg

SEQ ID NO: 145069 - DNA, 35 bp, Artificial Sequence
  Synthetic oligonucleotide
gacgcaatggagtggagggtgttgaacgtgggggg

SEQ ID NO: 145070 - DNA, 35 bp, Artificial Sequence
  Synthetic oligonucleotide
tacgtaccacctgtttgtagcacttattttccctg

SEQ ID NO: 145071 - DNA, 35 bp, Artificial Sequence
  Synthetic oligonucleotide
acatccacctaccgcctgtctatcaattaccgctg

SEQ ID NO: 145072 - DNA, 35 bp, Artificial Sequence
  Synthetic oligonucleotide
gtccatgccctacgaccgttgtcggaacacccttg

SEQ ID NO: 145073 - DNA, 35 bp, Artificial Sequence
  Synthetic oligonucleotide
tgcagtggtagtgggcggggggcaaggagagtcat

SEQ ID NO: 145074 - DNA, 35 bp, Artificial Sequence
  Synthetic oligonucleotide
gtgaacccccattatttcgcatagagccctttcat

SEQ ID NO: 145075 - DNA, 35 bp, Artificial Sequence
  Synthetic oligonucleotide
tgtcaaaccgtttccccagcgtatcattcactcct

SEQ ID NO: 145076 - DNA, 35 bp, Artificial Sequence
  Synthetic oligonucleotide
tcaccatagcgactgttccccctcgcccctgtcct

SEQ ID NO: 145077 - DNA, 35 bp, Artificial Sequence
  Synthetic oligonucleotide
acctgccccgcatattccatctcatgtccattcct

SEQ ID NO: 145078 - DNA, 35 bp, Artificial Sequence
  Synthetic oligonucleotide
gtgcacggcccccggacctgatgcgcgttccctct

SEQ ID NO: 145079 - DNA, 35 bp, Artificial Sequence
  Synthetic oligonucleotide
gagcatgcaacactggttcggttctacactcttct

SEQ ID NO: 145080 - DNA, 35 bp, Artificial Sequence
  Synthetic oligonucleotide
tccaaccgacatacacccgcatgcgcccctcccgt

SEQ ID NO: 145081 - DNA, 35 bp, Artificial Sequence
  Synthetic oligonucleotide
gcctatgcgtgtgcaccctcgcccccgtttgttgt

SEQ ID NO: 145082 - DNA, 35 bp, Artificial Sequence
  Synthetic oligonucleotide
gagcaccatgctgctacccattgccctccggattt

SEQ ID NO: 145083 - DNA, 35 bp, Artificial Sequence
  Synthetic oligonucleotide
gtgcggctcggatcgcgctccccactcccatcttt

SEQ ID NO: 145084 - DNA, 36 bp, Artificial Sequence
  Synthetic oligonucleotide
acccaccccctctccataatgtctgttacagatgaa

SEQ ID NO: 145085 - DNA, 35 bp, Artificial Sequence
  Synthetic oligonucleotide
gtggggtgacttgggataggggcgcgttggggaca

SEQ ID NO: 145086 - DNA, 36 bp, Artificial Sequence
  Synthetic oligonucleotide
gtgacacatgtcccatgtgacataggacccccttca

SEQ ID NO: 145087 - DNA, 37 bp, Artificial Sequence
  Synthetic oligonucleotide
tgcccacccgctcctgctcgttcaaacacctctccga

SEQ ID NO: 145088 - DNA, 37 bp, Artificial Sequence
  Synthetic oligonucleotide
gcctcactcgttctccctgccgtttccgaagactcga

SEQ ID NO: 145089 - DNA, 37 bp, Artificial Sequence
  Synthetic oligonucleotide
gcatggccgttgtccacctgtcccccgagttcctcga

SEQ ID NO: 145090 - DNA, 37 bp, Artificial Sequence
  Synthetic oligonucleotide
gtcctgacaccgtgtcagcatctccacctctctcgga

SEQ ID NO: 145091 - DNA, 37 bp, Artificial Sequence
  Synthetic oligonucleotide
accttcgggtagaggggcaattgacgggcgggaggga

SEQ ID NO: 145092 - DNA, 37 bp, Artificial Sequence
  Synthetic oligonucleotide
tgagaagagggttaggggggcagagggcaacacggga

SEQ ID NO: 145093 - DNA, 37 bp, Artificial Sequence
  Synthetic oligonucleotide
acgagagggggggtgattcgtcgcaggaggggcggga

SEQ ID NO: 145094 - DNA, 37 bp, Artificial Sequence
  Synthetic oligonucleotide
tcaagggcggggacctgtgtggggcttatgatgggga

SEQ ID NO: 145095 - DNA, 37 bp, Artificial Sequence
  Synthetic oligonucleotide
tagcgcagggaccgtaggagcggagggggggctggga

SEQ ID NO: 145096 - DNA, 37 bp, Artificial Sequence
  Synthetic oligonucleotide
atcacccctgcccgctgttcggtttaatcctcatgga

SEQ ID NO: 145097 - DNA, 38 bp, Artificial Sequence
  Synthetic oligonucleotide
acagtcgaggaaggggggatgctgagggggaaatatga

SEQ ID NO: 145098 - DNA, 37 bp, Artificial Sequence
  Synthetic oligonucleotide
atacaccccgcccgcttgttgctatgacgcaacctga

SEQ ID NO: 145099 - DNA, 37 bp, Artificial Sequence
  Synthetic oligonucleotide
gcattacgccatcagttcccttcgctcctcgtcctga

SEQ ID NO: 145100 - DNA, 38 bp, Artificial Sequence
  Synthetic oligonucleotide
gtcctgtaggtgtcctatccctgccccgccttagctga

SEQ ID NO: 145101 - DNA, 38 bp, Artificial Sequence
  Synthetic oligonucleotide
accctccaccctttcagatcgcgcctcggctcccttga

SEQ ID NO: 145102 - DNA, 38 bp, Artificial Sequence
  Synthetic oligonucleotide
tcctctcgcacacgggtcatctcgccactcctgtttga

SEQ ID NO: 145103 - DNA, 35 bp, Artificial Sequence
  Synthetic oligonucleotide
acaccaccctcgccccgaccctggagactcgcata

SEQ ID NO: 145104 - DNA, 35 bp, Artificial Sequence
  Synthetic oligonucleotide
ttaccacgccctcgttcccgcagtctatcttggac

SEQ ID NO: 145105 - DNA, 35 bp, Artificial Sequence
  Synthetic oligonucleotide
taacgcgctatcaccccagccgtaccgcccttgac

SEQ ID NO: 145106 - DNA, 33 bp, Artificial Sequence
  Synthetic oligonucleotide
tttagcacggacccagcccgcttcatgtcgccc

SEQ ID NO: 145107 - DNA, 35 bp, Artificial Sequence
  Synthetic oligonucleotide
gacctcctcggagttttaaacgcgccccattgccc

SEQ ID NO: 145108 - DNA, 35 bp, Artificial Sequence
  Synthetic oligonucleotide
ttgtccatcccctcacatcacatgtcagacacgcc

SEQ ID NO: 145109 - DNA, 35 bp, Artificial Sequence
  Synthetic oligonucleotide
acctacaccccacagtcacgaaccgccagcactcc

SEQ ID NO: 145110 - DNA, 34 bp, Artificial Sequence
  Synthetic oligonucleotide
gcccgtacgggtttcttacgtggtttgcccttcc

SEQ ID NO: 145111 - DNA, 35 bp, Artificial Sequence
  Synthetic oligonucleotide
ttacaacctcccgtgcgaccattggctgccatcgc

SEQ ID NO: 145112 - DNA, 35 bp, Artificial Sequence
  Synthetic oligonucleotide
tccgctcagggtttcgtccatcgccccattccgtc

SEQ ID NO: 145113 - DNA, 35 bp, Artificial Sequence
  Synthetic oligonucleotide
tgagacgcctcttcccctacccgcatggaatgttc

SEQ ID NO: 145114 - DNA, 35 bp, Artificial Sequence
  Synthetic oligonucleotide
tctcgccacctatacgttcccctgagttcttcacg

SEQ ID NO: 145115 - DNA, 35 bp, Artificial Sequence
  Synthetic oligonucleotide
gcgattaactccgcctcacgtacgccccctcaccg

SEQ ID NO: 145116 - DNA, 35 bp, Artificial Sequence
  Synthetic oligonucleotide
accttcccggacctgtattcacgccctgatccccg

SEQ ID NO: 145117 - DNA, 37 bp, Artificial Sequence
  Synthetic oligonucleotide
tagtggccgtgtggtacggagggaggggtaggggatg

SEQ ID NO: 145118 - DNA, 35 bp, Artificial Sequence
  Synthetic oligonucleotide
tgcacgggccctgcacctaccacgctatattccat

SEQ ID NO: 145119 - DNA, 34 bp, Artificial Sequence
  Synthetic oligonucleotide
agccacccgccgactctccagcccgagcccgact

SEQ ID NO: 145120 - DNA, 35 bp, Artificial Sequence
  Synthetic oligonucleotide
gacgagcctgctacgttacggcccctccttaacct

SEQ ID NO: 145121 - DNA, 35 bp, Artificial Sequence
  Synthetic oligonucleotide
tcatgttccccgcaccgtctcaggccccactacgt

SEQ ID NO: 145122 - DNA, 35 bp, Artificial Sequence
  Synthetic oligonucleotide
gacatgtccgactcatctccgcttagttccctcgt

SEQ ID NO: 145123 - DNA, 35 bp, Artificial Sequence
  Synthetic oligonucleotide
ttattcacgcccgtgctatcgctcctgaacctggt

SEQ ID NO: 145124 - DNA, 35 bp, Artificial Sequence
  Synthetic oligonucleotide
ttagcccccccgcccgctgttattcacgcaaagtt

SEQ ID NO: 145125 - DNA, 35 bp, Artificial Sequence
  Synthetic oligonucleotide
gtggccctgcatcacagttggccctctttctcttt

SEQ ID NO: 145126 - DNA, 35 bp, Artificial Sequence
  Synthetic oligonucleotide
ttgcaccgcgcctcgtcttggtcgtttgcccccaa

SEQ ID NO: 145127 - DNA, 35 bp, Artificial Sequence
  Synthetic oligonucleotide
gccaaaatcgccctgcccgtggtttatttcgccca

SEQ ID NO: 145128 - DNA, 36 bp, Artificial Sequence
  Synthetic oligonucleotide
tgccgacgccgtctttccgtgaataccatctcgcca

SEQ ID NO: 145129 - DNA, 35 bp, Artificial Sequence
  Synthetic oligonucleotide
ctgatgcctcctcctcttgtttcttcgtgctagca

SEQ ID NO: 145130 - DNA, 36 bp, Artificial Sequence
  Synthetic oligonucleotide
atgtccagtcgttcgctcccctacccgaccctttca

SEQ ID NO: 145131 - DNA, 37 bp, Artificial Sequence
  Synthetic oligonucleotide
agtccccgaccgggcgtatattgggtgggctgggaga

SEQ ID NO: 145132 - DNA, 37 bp, Artificial Sequence
  Synthetic oligonucleotide
ttgcatacgtccattgccttgttgccgcccttttaga

SEQ ID NO: 145133 - DNA, 37 bp, Artificial Sequence
  Synthetic oligonucleotide
atcccactcgggatccgtgcgccccgccatcccccga

SEQ ID NO: 145134 - DNA, 36 bp, Artificial Sequence
  Synthetic oligonucleotide
ggggggaggcgggaaggcgaacgggtgcgacgtcga

SEQ ID NO: 145135 - DNA, 37 bp, Artificial Sequence
  Synthetic oligonucleotide
atgtacagtgcggattgggggaggagagggaccagga

SEQ ID NO: 145136 - DNA, 36 bp, Artificial Sequence
  Synthetic oligonucleotide
atcccacctccagacgctacattggttcaacacgga

SEQ ID NO: 145137 - DNA, 37 bp, Artificial Sequence
  Synthetic oligonucleotide
accacgggaggggttgtgttttgttggggagagggga

SEQ ID NO: 145138 - DNA, 37 bp, Artificial Sequence
  Synthetic oligonucleotide
atcgaggcgggtgggaaaaagggcggggtctatggga

SEQ ID NO: 145139 - DNA, 37 bp, Artificial Sequence
  Synthetic oligonucleotide
ttggggtgtacctgggggcgggtgtacattcttggga

SEQ ID NO: 145140 - DNA, 38 bp, Artificial Sequence
  Synthetic oligonucleotide
gtgcatcggtagggggggatacgggcggcggttagtga

SEQ ID NO: 145141 - DNA, 38 bp, Artificial Sequence
  Synthetic oligonucleotide
ttgcacgcctccgcttccacccactattactgccgtga

SEQ ID NO: 145142 - DNA, 38 bp, Artificial Sequence
  Synthetic oligonucleotide
tacccccgctccgcatttgttcccatccatcgttgtga

SEQ ID NO: 145143 - DNA, 38 bp, Artificial Sequence
  Synthetic oligonucleotide
tcgtcccaccgccccatccgtcgtcagactagcattga

SEQ ID NO: 145144 - DNA, 38 bp, Artificial Sequence
  Synthetic oligonucleotide
tgatgcccctatttgatcgtgcccaccctcctgcttga

SEQ ID NO: 145145 - DNA, 35 bp, Artificial Sequence
  Synthetic oligonucleotide
atccagcctctcatcgttcttcctagtctccagta

SEQ ID NO: 145146 - DNA, 35 bp, Artificial Sequence
  Synthetic oligonucleotide
ttgccatgccgccctgtttgactctcttcttttta

SEQ ID NO: 145147 - DNA, 35 bp, Artificial Sequence
  Synthetic oligonucleotide
acccgttctgcccctttagtgattattcggtccac

SEQ ID NO: 145148 - DNA, 35 bp, Artificial Sequence
  Synthetic oligonucleotide
aatggggtgaggagggggaagaggggctgcatcac

SEQ ID NO: 145149 - DNA, 35 bp, Artificial Sequence
  Synthetic oligonucleotide
gagtcatcagcccgccgccgcatcatgggaaaccc

SEQ ID NO: 145150 - DNA, 35 bp, Artificial Sequence
  Synthetic oligonucleotide
gtccggcgcaccatcctgtcttccactgccgggcc

SEQ ID NO: 145151 - DNA, 35 bp, Artificial Sequence
  Synthetic oligonucleotide
actggacttctgccacctggtctctatgctatgcc

SEQ ID NO: 145152 - DNA, 35 bp, Artificial Sequence
  Synthetic oligonucleotide
tgagcatccacctatctggatttcgaacaacttcc

SEQ ID NO: 145153 - DNA, 35 bp, Artificial Sequence
  Synthetic oligonucleotide
gcgcaagggaaggtggtggggggcgagtgattagc

SEQ ID NO: 145154 - DNA, 35 bp, Artificial Sequence
  Synthetic oligonucleotide
atgaagcacccgtccacttcttcactctatccatc

SEQ ID NO: 145155 - DNA, 34 bp, Artificial Sequence
  Synthetic oligonucleotide
aatcccccgccaagacgcttatcttgactaactc

SEQ ID NO: 145156 - DNA, 35 bp, Artificial Sequence
  Synthetic oligonucleotide
tgtccctgtacggtcggtcgttgctagcacttttc

SEQ ID NO: 145157 - DNA, 35 bp, Artificial Sequence
  Synthetic oligonucleotide
tgaccaccttttatgcgaatatccaccacttattg

SEQ ID NO: 145158 - DNA, 35 bp, Artificial Sequence
  Synthetic oligonucleotide
tccgccatcaccccgcccctgtctgtagatccttg

SEQ ID NO: 145159 - DNA, 35 bp, Artificial Sequence
  Synthetic oligonucleotide
acccatcacccccattggcgcactatggacaatat

SEQ ID NO: 145160 - DNA, 35 bp, Artificial Sequence
  Synthetic oligonucleotide
tccgattgcacacatcccagccgtattctacgcct

SEQ ID NO: 145161 - DNA, 35 bp, Artificial Sequence
  Synthetic oligonucleotide
atcccccctgctacaatctgtggttcgttttgcct

SEQ ID NO: 145162 - DNA, 35 bp, Artificial Sequence
  Synthetic oligonucleotide
gacgggggggatagggaaaaagattttgggaagct

SEQ ID NO: 145163 - DNA, 35 bp, Artificial Sequence
  Synthetic oligonucleotide
ttcacccgccccgttgcacaattcgactccttgct

SEQ ID NO: 145164 - DNA, 35 bp, Artificial Sequence
  Synthetic oligonucleotide
gcaggaaaggcggaagggagggcatatgaggtagt

SEQ ID NO: 145165 - DNA, 35 bp, Artificial Sequence
  Synthetic oligonucleotide
tttggccctcctgctgtctcaatcgtgaaccctgt

SEQ ID NO: 145166 - DNA, 36 bp, Artificial Sequence
  Synthetic oligonucleotide
atcatagtgaggggggccgggagaaacagacagcaa

SEQ ID NO: 145167 - DNA, 35 bp, Artificial Sequence
  Synthetic oligonucleotide
aacccacacgcgttcacggcaccacgctcctcaca

SEQ ID NO: 145168 - DNA, 36 bp, Artificial Sequence
  Synthetic oligonucleotide
tcactcgccatcatgctcctgaagggccatccccca

SEQ ID NO: 145169 - DNA, 36 bp, Artificial Sequence
  Synthetic oligonucleotide
gccccgactctccgaggttctatactcacccgccca

SEQ ID NO: 145170 - DNA, 35 bp, Artificial Sequence
  Synthetic oligonucleotide
atcgtcaccctccgcttcttcgatgtcacatcgca

SEQ ID NO: 145171 - DNA, 36 bp, Artificial Sequence
  Synthetic oligonucleotide
tccccggatccgtcctgcagttcgcctctctattca

SEQ ID NO: 145172 - DNA, 35 bp, Artificial Sequence
  Synthetic oligonucleotide
ggtcccatcctaccgagggcctacagccgctttca

SEQ ID NO: 145173 - DNA, 37 bp, Artificial Sequence
  Synthetic oligonucleotide
tgatggtaagttgggggaaagggggtgttagcagaga

SEQ ID NO: 145174 - DNA, 36 bp, Artificial Sequence
  Synthetic oligonucleotide
ggagtgggggggtggagagacgtggtagtggataga

SEQ ID NO: 145175 - DNA, 37 bp, Artificial Sequence
  Synthetic oligonucleotide
gccaattcggggtgggtgggaaacgtgggggactaga

SEQ ID NO: 145176 - DNA, 35 bp, Artificial Sequence
  Synthetic oligonucleotide
tccagggagcacaagggaagcagggaagaggtaga

SEQ ID NO: 145177 - DNA, 36 bp, Artificial Sequence
  Synthetic oligonucleotide
atcccccccctgcttccacatgttaatcttccacga

SEQ ID NO: 145178 - DNA, 37 bp, Artificial Sequence
  Synthetic oligonucleotide
accctgctgtcgtcctacgctggcccctccttcacga

SEQ ID NO: 145179 - DNA, 37 bp, Artificial Sequence
  Synthetic oligonucleotide
tacgcccgccgaacattgccctcccgttttgtcccga

SEQ ID NO: 145180 - DNA, 35 bp, Artificial Sequence
  Synthetic oligonucleotide
tacccactcagtccgttatcgtcctcgtcttgcga

SEQ ID NO: 145181 - DNA, 37 bp, Artificial Sequence
  Synthetic oligonucleotide
tggtcgtcgccgccacatttgtaatctgctccatcga

SEQ ID NO: 145182 - DNA, 37 bp, Artificial Sequence
  Synthetic oligonucleotide
tctagaaacggactgcggggaaggacggggaatggga

SEQ ID NO: 145183 - DNA, 37 bp, Artificial Sequence
  Synthetic oligonucleotide
tgtgagtcgccgagtcctgcacccctgttccccatga

SEQ ID NO: 145184 - DNA, 38 bp, Artificial Sequence
  Synthetic oligonucleotide
acatcctctgctcgctatcccactcaccttcggcctga

SEQ ID NO: 145185 - DNA, 38 bp, Artificial Sequence
  Synthetic oligonucleotide
tgtgacgcccctccgtcgttgacacaactctttcttga

SEQ ID NO: 145186 - DNA, 33 bp, Artificial Sequence
  Synthetic oligonucleotide
tgtaccatcagctcgggcactatccaccaacta

SEQ ID NO: 145187 - DNA, 35 bp, Artificial Sequence
  Synthetic oligonucleotide
tccggtgctgctctcctccacgctaaccacaccta

SEQ ID NO: 145188 - DNA, 35 bp, Artificial Sequence
  Synthetic oligonucleotide
tccgaacgcgtttgccgaacgtctctttccaccta

SEQ ID NO: 145189 - DNA, 35 bp, Artificial Sequence
  Synthetic oligonucleotide
tgcgtgacctctgtcacctgttttactattctcac

SEQ ID NO: 145190 - DNA, 35 bp, Artificial Sequence
  Synthetic oligonucleotide
tcccggcctacgctatcctgttaatacgctttcac

SEQ ID NO: 145191 - DNA, 31 bp, Artificial Sequence
  Synthetic oligonucleotide
aaccgccccatccaatctgagccgctactac

SEQ ID NO: 145192 - DNA, 35 bp, Artificial Sequence
  Synthetic oligonucleotide
attcaaccatgccaccagccctataagccgcctac

SEQ ID NO: 145193 - DNA, 35 bp, Artificial Sequence
  Synthetic oligonucleotide
gactacgctcacctcaccacctgaagggcactccc

SEQ ID NO: 145194 - DNA, 35 bp, Artificial Sequence
  Synthetic oligonucleotide
gaaaccatcccttcgacacttcgtccagtcccgcc

SEQ ID NO: 145195 - DNA, 35 bp, Artificial Sequence
  Synthetic oligonucleotide
atcgccagcccgtcctggaattataccctgctgcc

SEQ ID NO: 145196 - DNA, 35 bp, Artificial Sequence
  Synthetic oligonucleotide
acggacgctgcgtagcccccgttgaccctcgctcc

SEQ ID NO: 145197 - DNA, 35 bp, Artificial Sequence
  Synthetic oligonucleotide
gtgagctcccttgtcttatctgtcctcgtcattgc

SEQ ID NO: 145198 - DNA, 35 bp, Artificial Sequence
  Synthetic oligonucleotide
gtagtcccccagcgtacatcgcatattcccctctc

SEQ ID NO: 145199 - DNA, 35 bp, Artificial Sequence
  Synthetic oligonucleotide
gtgtccctcgacatcccgccccatccatcgcattc

SEQ ID NO: 145200 - DNA, 35 bp, Artificial Sequence
  Synthetic oligonucleotide
acgcgctctgtcgagatcacgcctgccctaccttc

SEQ ID NO: 145201 - DNA, 35 bp, Artificial Sequence
  Synthetic oligonucleotide
tcacccgctcaggctcccaccatacactgaagttc

SEQ ID NO: 145202 - DNA, 35 bp, Artificial Sequence
  Synthetic oligonucleotide
gcctgccctgttcctcctagcaatgtgcgtaacct

SEQ ID NO: 145203 - DNA, 34 bp, Artificial Sequence
  Synthetic oligonucleotide
tgttgcggccggccccgacggcgtctccccccct

SEQ ID NO: 145204 - DNA, 35 bp, Artificial Sequence
  Synthetic oligonucleotide
accgcgcacaatccgggctgtcggttaccatccct

SEQ ID NO: 145205 - DNA, 35 bp, Artificial Sequence
  Synthetic oligonucleotide
agtggagctaagcccatcgttctgtcccatcgcct

SEQ ID NO: 145206 - DNA, 35 bp, Artificial Sequence
  Synthetic oligonucleotide
acatcaccacgaggttgatttctcccacacttcct

SEQ ID NO: 145207 - DNA, 35 bp, Artificial Sequence
  Synthetic oligonucleotide
gtaacaccagccgcctaacatcctgaacgctgtct

SEQ ID NO: 145208 - DNA, 35 bp, Artificial Sequence
  Synthetic oligonucleotide
gcacgagagcgtgaacccgcccgtctccatctctt

SEQ ID NO: 145209 - DNA, 35 bp, Artificial Sequence
  Synthetic oligonucleotide
gcccccgcctacattactatactgccatcctcttt

SEQ ID NO: 145210 - DNA, 35 bp, Artificial Sequence
  Synthetic oligonucleotide
tgacctcgcctgttccctccccgctctgagttttt

SEQ ID NO: 145211 - DNA, 35 bp, Artificial Sequence
  Synthetic oligonucleotide
atcagtcgaggagggggtggtgaggaccgggggaa

SEQ ID NO: 145212 - DNA, 35 bp, Artificial Sequence
  Synthetic oligonucleotide
acactcccactccgctagctctacgccacgtttaa

SEQ ID NO: 145213 - DNA, 37 bp, Artificial Sequence
  Synthetic oligonucleotide
gcccgtcccccgtcacccacgtagtatgccttaccga

SEQ ID NO: 145214 - DNA, 37 bp, Artificial Sequence
  Synthetic oligonucleotide
ttgacccccctgccctctcatcagcgatgtttttcga

SEQ ID NO: 145215 - DNA, 37 bp, Artificial Sequence
  Synthetic oligonucleotide
actagcaggaaacgggagggtgcgggttggagaggga

SEQ ID NO: 145216 - DNA, 36 bp, Artificial Sequence
  Synthetic oligonucleotide
ttcggaggagggagcggggtaaggccgaggcgggga

SEQ ID NO: 145217 - DNA, 37 bp, Artificial Sequence
  Synthetic oligonucleotide
gacgctagcacgggtgggagttggggctggctgggga

SEQ ID NO: 145218 - DNA, 37 bp, Artificial Sequence
  Synthetic oligonucleotide
gtcgcaccgctggtattccatctctaccctctcatga

SEQ ID NO: 145219 - DNA, 36 bp, Artificial Sequence
  Synthetic oligonucleotide
aatcaaccacccgacgttacccagttcccttcctga

SEQ ID NO: 145220 - DNA, 38 bp, Artificial Sequence
  Synthetic oligonucleotide
atggacgctcgggagagaggggataggggggccggtga

SEQ ID NO: 145221 - DNA, 38 bp, Artificial Sequence
  Synthetic oligonucleotide
atcagcaaggcggggtggggagggaagctacggggtga

SEQ ID NO: 145222 - DNA, 38 bp, Artificial Sequence
  Synthetic oligonucleotide
tatgtaccccccgcctcctgagtatattgcccccttga

SEQ ID NO: 145223 - DNA, 36 bp, Artificial Sequence
  Synthetic oligonucleotide
gcacctcacctgcatcccagtgcccgtaatctttga

SEQ ID NO: 145224 - DNA, 36 bp, Artificial Sequence
  Synthetic oligonucleotide
ttggagagcgggtgggtgggtcgaacattccaaata

SEQ ID NO: 145225 - DNA, 35 bp, Artificial Sequence
  Synthetic oligonucleotide
gccgacgtagtcacctggactccacttgcctgtac

SEQ ID NO: 145226 - DNA, 35 bp, Artificial Sequence
  Synthetic oligonucleotide
gtcccccgccaaccggactgccttgagccacgacc

SEQ ID NO: 145227 - DNA, 35 bp, Artificial Sequence
  Synthetic oligonucleotide
tgttccacacccgttagttcacagctttactcccc

SEQ ID NO: 145228 - DNA, 35 bp, Artificial Sequence
  Synthetic oligonucleotide
gtcgagtctcgggccacccatgtactttcaccatc

SEQ ID NO: 145229 - DNA, 35 bp, Artificial Sequence
  Synthetic oligonucleotide
gacggtcctgtctaagttattctgtccttcccatc

SEQ ID NO: 145230 - DNA, 35 bp, Artificial Sequence
  Synthetic oligonucleotide
ccctactccgggcgatacacagctattcacacttc

SEQ ID NO: 145231 - DNA, 35 bp, Artificial Sequence
  Synthetic oligonucleotide
acgcaccccaccacactcgtagtcggtatactttc

SEQ ID NO: 145232 - DNA, 35 bp, Artificial Sequence
  Synthetic oligonucleotide
tggatgctccccgtgccaccgaccaaactcctccg

SEQ ID NO: 145233 - DNA, 35 bp, Artificial Sequence
  Synthetic oligonucleotide
gagacgccctgatacctgacgaacccctcttctcg

SEQ ID NO: 145234 - DNA, 35 bp, Artificial Sequence
  Synthetic oligonucleotide
gatcgacggtgggggcgtatagaagggaggaaggg

SEQ ID NO: 145235 - DNA, 35 bp, Artificial Sequence
  Synthetic oligonucleotide
aggtcatgtctacggaatagggtcgggaggggggg

SEQ ID NO: 145236 - DNA, 35 bp, Artificial Sequence
  Synthetic oligonucleotide
aagtcccccgaccgatattggaattccccaccctg

SEQ ID NO: 145237 - DNA, 35 bp, Artificial Sequence
  Synthetic oligonucleotide
tgtgtgctccctatatgtccctgtccgagtctctg

SEQ ID NO: 145238 - DNA, 35 bp, Artificial Sequence
  Synthetic oligonucleotide
aaccgatcctcagccgctcccgctcctcgcaattg

SEQ ID NO: 145239 - DNA, 35 bp, Artificial Sequence
  Synthetic oligonucleotide
taccccccgtggtatgttactttgtcccgccgaat

SEQ ID NO: 145240 - DNA, 35 bp, Artificial Sequence
  Synthetic oligonucleotide
atacaccgcaccgctttacctttcggactcacact

SEQ ID NO: 145241 - DNA, 35 bp, Artificial Sequence
  Synthetic oligonucleotide
tccaaccctcgtgcacgcgcactttccgttgcact

SEQ ID NO: 145242 - DNA, 35 bp, Artificial Sequence
  Synthetic oligonucleotide
tagcgttcagcatatacaggccccccgcttcacct

SEQ ID NO: 145243 - DNA, 35 bp, Artificial Sequence
  Synthetic oligonucleotide
gttccgctcctccgcacctcgactctccagagcct

SEQ ID NO: 145244 - DNA, 35 bp, Artificial Sequence
  Synthetic oligonucleotide
tcaccataacgcctcgtcgagttcatcttacctct

SEQ ID NO: 145245 - DNA, 35 bp, Artificial Sequence
  Synthetic oligonucleotide
agagttcgggttagggtggcggagggggcgggagt

SEQ ID NO: 145246 - DNA, 35 bp, Artificial Sequence
  Synthetic oligonucleotide
taccgacgctcgcaccactgttccatcccatctgt

SEQ ID NO: 145247 - DNA, 35 bp, Artificial Sequence
  Synthetic oligonucleotide
taccctgcatacccacgcgctcctggccctctttt

SEQ ID NO: 145248 - DNA, 35 bp, Artificial Sequence
  Synthetic oligonucleotide
tcctccatcgcttcgacgctctcgcccgtgttttt

SEQ ID NO: 145249 - DNA, 35 bp, Artificial Sequence
  Synthetic oligonucleotide
agagcggagatcttggtgggaggggaggggaggaa

SEQ ID NO: 145250 - DNA, 35 bp, Artificial Sequence
  Synthetic oligonucleotide
tccctcgccctctagtaaccccttatagtgctaca

SEQ ID NO: 145251 - DNA, 36 bp, Artificial Sequence
  Synthetic oligonucleotide
gcgagctcccaccattctgcatttgcccactcccca

SEQ ID NO: 145252 - DNA, 35 bp, Artificial Sequence
  Synthetic oligonucleotide
gttgtgcgcaatgccgtttttcccgtgctgatcca

SEQ ID NO: 145253 - DNA, 35 bp, Artificial Sequence
  Synthetic oligonucleotide
gatcagtacgtcaccaatatgcccagccttctcca

SEQ ID NO: 145254 - DNA, 36 bp, Artificial Sequence
  Synthetic oligonucleotide
gcgactgtccgcacacacctgtttttaattcctgca

SEQ ID NO: 145255 - DNA, 35 bp, Artificial Sequence
  Synthetic oligonucleotide
gcattcactctcgatgactcttttgctccctctca

SEQ ID NO: 145256 - DNA, 36 bp, Artificial Sequence
  Synthetic oligonucleotide
gagaccgccggtaccttctgaataacacgcccttca

SEQ ID NO: 145257 - DNA, 37 bp, Artificial Sequence
  Synthetic oligonucleotide
ggacaacataagcacgggaaattgggggcgggataga

SEQ ID NO: 145258 - DNA, 37 bp, Artificial Sequence
  Synthetic oligonucleotide
tgaacacaccgccaccatttgctccctactccgacga

SEQ ID NO: 145259 - DNA, 37 bp, Artificial Sequence
  Synthetic oligonucleotide
ggtgagtaggggtaagggtagggcaagaggggtccga

SEQ ID NO: 145260 - DNA, 35 bp, Artificial Sequence
  Synthetic oligonucleotide
tatgcgatagcagtcctgtccgcccacccgttcga

SEQ ID NO: 145261 - DNA, 37 bp, Artificial Sequence
  Synthetic oligonucleotide
ttggggcagaagggggcgggagtataggggtgttcga

SEQ ID NO: 145262 - DNA, 37 bp, Artificial Sequence
  Synthetic oligonucleotide
tgctacacactcctcgtcatccgtctccctgtccgga

SEQ ID NO: 145263 - DNA, 37 bp, Artificial Sequence
  Synthetic oligonucleotide
tctactgccgcagctgctacacctcctttcccaggga

SEQ ID NO: 145264 - DNA, 38 bp, Artificial Sequence
  Synthetic oligonucleotide
gaaaagggaagggcgggtgggagctccaggtaccatga

SEQ ID NO: 145265 - DNA, 35 bp, Artificial Sequence
  Synthetic oligonucleotide
tcacttgcccattgattagcgcaccgcccctgtga

SEQ ID NO: 145266 - DNA, 37 bp, Artificial Sequence
  Synthetic oligonucleotide
gtggtacgccgcgcctgcctttctttgccgtttttga

SEQ ID NO: 145267 - DNA, 35 bp, Artificial Sequence
  Synthetic oligonucleotide
tgaacccctccgcctctgtggctccattcgtaata

SEQ ID NO: 145268 - DNA, 35 bp, Artificial Sequence
  Synthetic oligonucleotide
gaaagacaagggaaatgggaaggacaatggcgtta

SEQ ID NO: 145269 - DNA, 36 bp, Artificial Sequence
  Synthetic oligonucleotide
tccgcctccaaccagagtcgtccctttcctgattta

SEQ ID NO: 145270 - DNA, 35 bp, Artificial Sequence
  Synthetic oligonucleotide
gtccccctgccgtcgagtaccccccaatcgttaac

SEQ ID NO: 145271 - DNA, 35 bp, Artificial Sequence
  Synthetic oligonucleotide
gggtggggggaggtgggggaggtccaatggttcac

SEQ ID NO: 145272 - DNA, 35 bp, Artificial Sequence
  Synthetic oligonucleotide
tccgcacggtgtcgtcttcacctttgttcccatac

SEQ ID NO: 145273 - DNA, 35 bp, Artificial Sequence
  Synthetic oligonucleotide
accgtatgcccccatctgtttcccgttcgccttac

SEQ ID NO: 145274 - DNA, 35 bp, Artificial Sequence
  Synthetic oligonucleotide
acagtacgattgttggcccccgtcctgcctccacc

SEQ ID NO: 145275 - DNA, 35 bp, Artificial Sequence
  Synthetic oligonucleotide
ttaccgcctccactcccgaaatttgtgcccgtacc

SEQ ID NO: 145276 - DNA, 35 bp, Artificial Sequence
  Synthetic oligonucleotide
ttcgtgcacgattagctatgtcacttcctttgtcc

SEQ ID NO: 145277 - DNA, 35 bp, Artificial Sequence
  Synthetic oligonucleotide
tagggctcatgactgctgcaatccaccctccacgc

SEQ ID NO: 145278 - DNA, 35 bp, Artificial Sequence
  Synthetic oligonucleotide
taccccctgtcccgtccgccaaagtaagttcccgc

SEQ ID NO: 145279 - DNA, 35 bp, Artificial Sequence
  Synthetic oligonucleotide
tcgtatgcttacggtagtcacgcctctccactcgc

SEQ ID NO: 145280 - DNA, 35 bp, Artificial Sequence
  Synthetic oligonucleotide
ggactcgtgcatttcgccttcacttacgactcttc

SEQ ID NO: 145281 - DNA, 35 bp, Artificial Sequence
  Synthetic oligonucleotide
acatctcacctgtcgggcctttctgcacattcttc

SEQ ID NO: 145282 - DNA, 35 bp, Artificial Sequence
  Synthetic oligonucleotide
taccgtcccccgcgcaccctattatgtctgacacg

SEQ ID NO: 145283 - DNA, 35 bp, Artificial Sequence
  Synthetic oligonucleotide
tcaaccgtctcaatgatcccccactccccttaccg

SEQ ID NO: 145284 - DNA, 35 bp, Artificial Sequence
  Synthetic oligonucleotide
ttcccaccttcaagagcgaagcgacccaccccccg

SEQ ID NO: 145285 - DNA, 35 bp, Artificial Sequence
  Synthetic oligonucleotide
tttggcttggccactggttacctttgactcctccg

SEQ ID NO: 145286 - DNA, 35 bp, Artificial Sequence
  Synthetic oligonucleotide
agccgatacaagtggggaagggcacggtggtaagg

SEQ ID NO: 145287 - DNA, 35 bp, Artificial Sequence
  Synthetic oligonucleotide
ggccccatccgtacacccgtttgtcctcacacctg

SEQ ID NO: 145288 - DNA, 35 bp, Artificial Sequence
  Synthetic oligonucleotide
acgactgttctgccgtccccccatttgctaacttg

SEQ ID NO: 145289 - DNA, 35 bp, Artificial Sequence
  Synthetic oligonucleotide
gctatgcgaagtgttttgccctccctcttatagat

SEQ ID NO: 145290 - DNA, 35 bp, Artificial Sequence
  Synthetic oligonucleotide
tcttgacaccccttttgatcgtttatggcctttat

SEQ ID NO: 145291 - DNA, 35 bp, Artificial Sequence
  Synthetic oligonucleotide
tgtaccccccagccagtacagatctcccccgcact

SEQ ID NO: 145292 - DNA, 35 bp, Artificial Sequence
  Synthetic oligonucleotide
gtgtcccctctgcttggcctctcaattccggacct

SEQ ID NO: 145293 - DNA, 35 bp, Artificial Sequence
  Synthetic oligonucleotide
ttgaccctgccctaatcgacgagtcggtacaccct

SEQ ID NO: 145294 - DNA, 35 bp, Artificial Sequence
  Synthetic oligonucleotide
tgcgtctccgttccccatgttttgattaccgttct

SEQ ID NO: 145295 - DNA, 35 bp, Artificial Sequence
  Synthetic oligonucleotide
ttgacagcacctgcacatgcatcaccctcacttgt

SEQ ID NO: 145296 - DNA, 35 bp, Artificial Sequence
  Synthetic oligonucleotide
acacaggccctctggccccgctcctgcccgacctt

SEQ ID NO: 145297 - DNA, 34 bp, Artificial Sequence
  Synthetic oligonucleotide
acgcacgacagaactcacctccgctgccccgttt

SEQ ID NO: 145298 - DNA, 33 bp, Artificial Sequence
  Synthetic oligonucleotide
agccccgcccacgctaatggaccactgaaccaa

SEQ ID NO: 145299 - DNA, 36 bp, Artificial Sequence
  Synthetic oligonucleotide
aacgggggagagagggctgggaggtggaggcgtcaa

SEQ ID NO: 145300 - DNA, 36 bp, Artificial Sequence
  Synthetic oligonucleotide
tacaccgacaatggttatcgaaccaccccccttaca

SEQ ID NO: 145301 - DNA, 36 bp, Artificial Sequence
  Synthetic oligonucleotide
acgcgcaacacgcctccactgtttccttggctccca

SEQ ID NO: 145302 - DNA, 35 bp, Artificial Sequence
  Synthetic oligonucleotide
ccacccccccccaggtcttattccatggcttgcca

SEQ ID NO: 145303 - DNA, 37 bp, Artificial Sequence
  Synthetic oligonucleotide
tagggggggaacgggcattttgagcaagaggggcgga

SEQ ID NO: 145304 - DNA, 35 bp, Artificial Sequence
  Synthetic oligonucleotide
accaacgggtacgggagatatatgtggggcgggga

SEQ ID NO: 145305 - DNA, 37 bp, Artificial Sequence
  Synthetic oligonucleotide
gtcgggcgggtgagcaggtgggcgcggggatggggga

SEQ ID NO: 145306 - DNA, 37 bp, Artificial Sequence
  Synthetic oligonucleotide
acatggtggggggaagtgaggaggggcgaggaactga

SEQ ID NO: 145307 - DNA, 38 bp, Artificial Sequence
  Synthetic oligonucleotide
acgcaaaggagggagaacgaaacggggaggcatactga

SEQ ID NO: 145308 - DNA, 37 bp, Artificial Sequence
  Synthetic oligonucleotide
agtgggccccaaattgtcgtacccgcatcccccctga

SEQ ID NO: 145309 - DNA, 38 bp, Artificial Sequence
  Synthetic oligonucleotide
tgcaacatctccccggcaagctcacgctcatttcctga

SEQ ID NO: 145310 - DNA, 37 bp, Artificial Sequence
  Synthetic oligonucleotide
attcatgcgtatcgggggggagggaatgggtgagtga

SEQ ID NO: 145311 - DNA, 37 bp, Artificial Sequence
  Synthetic oligonucleotide
atgccatcgcttgtaccggccccattatttcttgtga

SEQ ID NO: 145312 - DNA, 35 bp, Artificial Sequence
  Synthetic oligonucleotide
tcccacccctccatcggtctatcaatgtgcgttga

SEQ ID NO: 145313 - DNA, 35 bp, Artificial Sequence
  Synthetic oligonucleotide
gccattccctgggtttgtttgcttcctcgttcata

SEQ ID NO: 145314 - DNA, 36 bp, Artificial Sequence
  Synthetic oligonucleotide
ttggagacgtccaatctgccatatcgtccccttata

SEQ ID NO: 145315 - DNA, 35 bp, Artificial Sequence
  Synthetic oligonucleotide
agagagcaggccggggttgggttcgggagggtcta

SEQ ID NO: 145316 - DNA, 35 bp, Artificial Sequence
  Synthetic oligonucleotide
tccgccgacagtcattacgctatgccttcccttta

SEQ ID NO: 145317 - DNA, 35 bp, Artificial Sequence
  Synthetic oligonucleotide
tctcgccgcctgtcctaccgcccagcctttaaccc

SEQ ID NO: 145318 - DNA, 35 bp, Artificial Sequence
  Synthetic oligonucleotide
tgtaaggccccatcacctgtcttctaacgccgccc

SEQ ID NO: 145319 - DNA, 35 bp, Artificial Sequence
  Synthetic oligonucleotide
acccgccccgtcgccatccaggtccatcctcgccc

SEQ ID NO: 145320 - DNA, 35 bp, Artificial Sequence
  Synthetic oligonucleotide
tacggtgctatctctggtctactcacccctgtccc

SEQ ID NO: 145321 - DNA, 35 bp, Artificial Sequence
  Synthetic oligonucleotide
tactgcttccgccactacatcgccgcgctatagcc

SEQ ID NO: 145322 - DNA, 35 bp, Artificial Sequence
  Synthetic oligonucleotide
ttcagccctgacatccgcaacaccccagtccctcc

SEQ ID NO: 145323 - DNA, 35 bp, Artificial Sequence
  Synthetic oligonucleotide
tacactgccataatccagcgacccccgcattgtcc

SEQ ID NO: 145324 - DNA, 35 bp, Artificial Sequence
  Synthetic oligonucleotide
gagtagcgccaacctcgtcccgccgccccattagc

SEQ ID NO: 145325 - DNA, 35 bp, Artificial Sequence
  Synthetic oligonucleotide
tgccaagggagggggtggtgcaaggtagggatggc

SEQ ID NO: 145326 - DNA, 35 bp, Artificial Sequence
  Synthetic oligonucleotide
tacacatctccgcccctgtttgtcatgacccttgc

SEQ ID NO: 145327 - DNA, 35 bp, Artificial Sequence
  Synthetic oligonucleotide
agacctatcaccgtggtccctgtcccccccacatc

SEQ ID NO: 145328 - DNA, 35 bp, Artificial Sequence
  Synthetic oligonucleotide
taccgtcgtcgttcttgcatttccggctctgtttc

SEQ ID NO: 145329 - DNA, 35 bp, Artificial Sequence
  Synthetic oligonucleotide
acgcaagtgcctctgcccgcctttcaaatccctag

SEQ ID NO: 145330 - DNA, 35 bp, Artificial Sequence
  Synthetic oligonucleotide
ggaaagggatgagtaggcatgtaggtcggggaacg

SEQ ID NO: 145331 - DNA, 35 bp, Artificial Sequence
  Synthetic oligonucleotide
tacgccaccccaaccaggtcttaacgtctctttcg

SEQ ID NO: 145332 - DNA, 35 bp, Artificial Sequence
  Synthetic oligonucleotide
atcggacaaaagggtgggggtaacttaaagaaggg

SEQ ID NO: 145333 - DNA, 35 bp, Artificial Sequence
  Synthetic oligonucleotide
gagggagggaggccggtggaaattcaggggggtgg

SEQ ID NO: 145334 - DNA, 35 bp, Artificial Sequence
  Synthetic oligonucleotide
tgaaacgtactcgctctttatggtccttcctactg

SEQ ID NO: 145335 - DNA, 35 bp, Artificial Sequence
  Synthetic oligonucleotide
acatctcctcagttccgcactccgccgctaaccat

SEQ ID NO: 145336 - DNA, 30 bp, Artificial Sequence
  Synthetic oligonucleotide
ttatgcgcgccgtcctccctgcttccgcct

SEQ ID NO: 145337 - DNA, 35 bp, Artificial Sequence
  Synthetic oligonucleotide
tacctgtccttccagttatgcatactccctgatct

SEQ ID NO: 145338 - DNA, 35 bp, Artificial Sequence
  Synthetic oligonucleotide
gtactgccacattttaagcgtatccccattcctgt

SEQ ID NO: 145339 - DNA, 35 bp, Artificial Sequence
  Synthetic oligonucleotide
gcactgtagacgctccttctccacgaacgtgcatt

SEQ ID NO: 145340 - DNA, 35 bp, Artificial Sequence
  Synthetic oligonucleotide
ggatccacgccccatggcccctcttatgacccctt

SEQ ID NO: 145341 - DNA, 35 bp, Artificial Sequence
  Synthetic oligonucleotide
actcctcgatccccgtgtgcgattccgttaacttt

SEQ ID NO: 145342 - DNA, 36 bp, Artificial Sequence
  Synthetic oligonucleotide
gcattcccgttcgagcatatgcctcgtgcccaccca

SEQ ID NO: 145343 - DNA, 36 bp, Artificial Sequence
  Synthetic oligonucleotide
acccccctccctcgctatacatgactttatgatcca

SEQ ID NO: 145344 - DNA, 36 bp, Artificial Sequence
  Synthetic oligonucleotide
tagagtgcgcacatcggttccatcctcatcttagca

SEQ ID NO: 145345 - DNA, 36 bp, Artificial Sequence
  Synthetic oligonucleotide
tgcaccgtttcgttgctcgctctccatcaccaggca

SEQ ID NO: 145346 - DNA, 36 bp, Artificial Sequence
  Synthetic oligonucleotide
gaacgggatcgggtggtgagggtactgcatttggca

SEQ ID NO: 145347 - DNA, 36 bp, Artificial Sequence
  Synthetic oligonucleotide
tgagtgccctctctctatctatgtccggtgaaatca

SEQ ID NO: 145348 - DNA, 36 bp, Artificial Sequence
  Synthetic oligonucleotide
ttagcaagggggtgggtgggtggcacagagtgttca

SEQ ID NO: 145349 - DNA, 37 bp, Artificial Sequence
  Synthetic oligonucleotide
gggaccgaggtagaggggggggatagaggtcggaaga

SEQ ID NO: 145350 - DNA, 37 bp, Artificial Sequence
  Synthetic oligonucleotide
gggggagtggcggtttccatcctagggcggtggggga

SEQ ID NO: 145351 - DNA, 37 bp, Artificial Sequence
  Synthetic oligonucleotide
aaaacagggcgggggggaatggtggtaactgcgatga

SEQ ID NO: 145352 - DNA, 38 bp, Artificial Sequence
  Synthetic oligonucleotide
agccccatcgtctgccagcgtccatacgccctctctga

SEQ ID NO: 145353 - DNA, 38 bp, Artificial Sequence
  Synthetic oligonucleotide
gactcgcgccctgctctagaccccgcccctctgagtga

SEQ ID NO: 145354 - DNA, 38 bp, Artificial Sequence
  Synthetic oligonucleotide
tgttgcccgataccgcgccacttgctccttggccttga

SEQ ID NO: 145355 - DNA, 38 bp, Artificial Sequence
  Synthetic oligonucleotide
cgagaccgtagttggtccacgcacacacccctctttga

SEQ ID NO: 145356 - DNA, 36 bp, Artificial Sequence
  Synthetic oligonucleotide
accctggcccccctcgttgattcagccctactcata

SEQ ID NO: 145357 - DNA, 35 bp, Artificial Sequence
  Synthetic oligonucleotide
agcctcacactcctgcatgtctcccgccccgcgta

SEQ ID NO: 145358 - DNA, 36 bp, Artificial Sequence
  Synthetic oligonucleotide
tatgggagatcagagaataagggcgggagggaggta

SEQ ID NO: 145359 - DNA, 36 bp, Artificial Sequence
  Synthetic oligonucleotide
tagtgcccctccggttccccagccgtacactttgta

SEQ ID NO: 145360 - DNA, 36 bp, Artificial Sequence
  Synthetic oligonucleotide
ggtccaactcctgcctcctgcctcacggactcctta

SEQ ID NO: 145361 - DNA, 35 bp, Artificial Sequence
  Synthetic oligonucleotide
ggtccacccgcgcaagttcccgcttcgtaactcac

SEQ ID NO: 145362 - DNA, 35 bp, Artificial Sequence
  Synthetic oligonucleotide
ttcgccggccgcacgcgcgcttcccagtacttgac

SEQ ID NO: 145363 - DNA, 35 bp, Artificial Sequence
  Synthetic oligonucleotide
tcgcacgagctctgtagggatgggagggagggacc

SEQ ID NO: 145364 - DNA, 35 bp, Artificial Sequence
  Synthetic oligonucleotide
actcggtctgctgtaacgttctctgccgcccaccc

SEQ ID NO: 145365 - DNA, 35 bp, Artificial Sequence
  Synthetic oligonucleotide
atgcgaggcctcatactgctccgttcgacccgccc

SEQ ID NO: 145366 - DNA, 35 bp, Artificial Sequence
  Synthetic oligonucleotide
gccctccaccactggttttgcgtacagaacgctcc

SEQ ID NO: 145367 - DNA, 35 bp, Artificial Sequence
  Synthetic oligonucleotide
gtggggtcgccccccccttggttttaccctgctcc

SEQ ID NO: 145368 - DNA, 35 bp, Artificial Sequence
  Synthetic oligonucleotide
gataacgtgcccccgttacttgtcctacgatctcc

SEQ ID NO: 145369 - DNA, 35 bp, Artificial Sequence
  Synthetic oligonucleotide
tgaccactttcggttgcttgctactcttcctgtcc

SEQ ID NO: 145370 - DNA, 35 bp, Artificial Sequence
  Synthetic oligonucleotide
ttcccaccctttcgttacagtaacaccctctcagc

SEQ ID NO: 145371 - DNA, 35 bp, Artificial Sequence
  Synthetic oligonucleotide
caccgcggaacctggttttcgccttcgccccccgc

SEQ ID NO: 145372 - DNA, 35 bp, Artificial Sequence
  Synthetic oligonucleotide
atcccgtctccggcctctcgctggcgcccctcccg

SEQ ID NO: 145373 - DNA, 35 bp, Artificial Sequence
  Synthetic oligonucleotide
taatgccccgtccctttgcgcgttctccccgattg

SEQ ID NO: 145374 - DNA, 35 bp, Artificial Sequence
  Synthetic oligonucleotide
tgcaaacactttcgctggtttatttgcccccccct

SEQ ID NO: 145375 - DNA, 35 bp, Artificial Sequence
  Synthetic oligonucleotide
ggacatcctccccgccatggacctgctcacctcct

SEQ ID NO: 145376 - DNA, 35 bp, Artificial Sequence
  Synthetic oligonucleotide
gacccttctcatgcaaatgacccaagatcacctct

SEQ ID NO: 145377 - DNA, 35 bp, Artificial Sequence
  Synthetic oligonucleotide
gtggccactggacgcagataaccccgcccctctct

SEQ ID NO: 145378 - DNA, 35 bp, Artificial Sequence
  Synthetic oligonucleotide
gacttgctccatccacgctcgatatattgttccgt

SEQ ID NO: 145379 - DNA, 35 bp, Artificial Sequence
  Synthetic oligonucleotide
tccgttgcccttacctgttttaagccctcacttgt

SEQ ID NO: 145380 - DNA, 35 bp, Artificial Sequence
  Synthetic oligonucleotide
gtagtacgccatctgcctaaagctctccagccctt

SEQ ID NO: 145381 - DNA, 35 bp, Artificial Sequence
  Synthetic oligonucleotide
tcgacctcccatgaagctcttttctactgtccctt

SEQ ID NO: 145382 - DNA, 35 bp, Artificial Sequence
  Synthetic oligonucleotide
tacctgcacgagcccccagtccaagctctatcctt

SEQ ID NO: 145383 - DNA, 35 bp, Artificial Sequence
  Synthetic oligonucleotide
aacccaccacacgcgtgagcacacatccacccgtt

SEQ ID NO: 145384 - DNA, 35 bp, Artificial Sequence
  Synthetic oligonucleotide
tcatgtcctccagtgcttttttccttggcccattt

SEQ ID NO: 145385 - DNA, 36 bp, Artificial Sequence
  Synthetic oligonucleotide
ttgcccctgcccctctcgatctcacgtgcatgccaa

SEQ ID NO: 145386 - DNA, 35 bp, Artificial Sequence
  Synthetic oligonucleotide
acccccatcttagatggcctaactttcgttcctaa

SEQ ID NO: 145387 - DNA, 36 bp, Artificial Sequence
  Synthetic oligonucleotide
acctggtcctcctgccactgttccggttttctccca

SEQ ID NO: 145388 - DNA, 35 bp, Artificial Sequence
  Synthetic oligonucleotide
tcacgcctcacgccaacagagtcccttcttgcgca

SEQ ID NO: 145389 - DNA, 36 bp, Artificial Sequence
  Synthetic oligonucleotide
attgtgccaccctgtgtctttcgacgtctaccatca

SEQ ID NO: 145390 - DNA, 37 bp, Artificial Sequence
  Synthetic oligonucleotide
gtaaagagcacgacggttgggaggtggagggaagaga

SEQ ID NO: 145391 - DNA, 37 bp, Artificial Sequence
  Synthetic oligonucleotide
agttgtgggggcggtaagcgaagggggctagcaagga

SEQ ID NO: 145392 - DNA, 36 bp, Artificial Sequence
  Synthetic oligonucleotide
gcaaagcaagggcggaaaagaggggagttgacagga

SEQ ID NO: 145393 - DNA, 37 bp, Artificial Sequence
  Synthetic oligonucleotide
aggaagggacgggcattgtaggggtgagggggaggga

SEQ ID NO: 145394 - DNA, 37 bp, Artificial Sequence
  Synthetic oligonucleotide
tgacagggagggctcgaatggggacggagggtatgga

SEQ ID NO: 145395 - DNA, 38 bp, Artificial Sequence
  Synthetic oligonucleotide
acgaacggcgggagacggggggaaaaaggcgcgaatga

SEQ ID NO: 145396 - DNA, 38 bp, Artificial Sequence
  Synthetic oligonucleotide
accaggggtgggccagggggggtaaatgcctggtatga

SEQ ID NO: 145397 - DNA, 36 bp, Artificial Sequence
  Synthetic oligonucleotide
taatccagccctgccccatgcccgcaacttacgtga

SEQ ID NO: 145398 - DNA, 36 bp, Artificial Sequence
  Synthetic oligonucleotide
tacaccgcagtgtttctcctcctcatgttagcttga

SEQ ID NO: 145399 - DNA, 37 bp, Artificial Sequence
  Synthetic oligonucleotide
tccatcccacctgagttgtctgaattcactgttttga

SEQ ID NO: 145400 - DNA, 36 bp, Artificial Sequence
  Synthetic oligonucleotide
gcctcgctatccgtgcttctacccatccccctcgta

SEQ ID NO: 145401 - DNA, 36 bp, Artificial Sequence
  Synthetic oligonucleotide
tgggcccctgctgacgttatcccactaccatctgta

SEQ ID NO: 145402 - DNA, 35 bp, Artificial Sequence
  Synthetic oligonucleotide
gaactgtccgttccgctcctgttctcgatttacac

SEQ ID NO: 145403 - DNA, 35 bp, Artificial Sequence
  Synthetic oligonucleotide
ggaacatcaggccggccatctgcgcccctcccacc

SEQ ID NO: 145404 - DNA, 35 bp, Artificial Sequence
  Synthetic oligonucleotide
agacctcatgtatatcatagcctcgccgccctacc

SEQ ID NO: 145405 - DNA, 35 bp, Artificial Sequence
  Synthetic oligonucleotide
atctgcaaatcggcgcctctcgctttccccagtcc

SEQ ID NO: 145406 - DNA, 35 bp, Artificial Sequence
  Synthetic oligonucleotide
tccgacctgcctccctgcgtgatactgacacatgc

SEQ ID NO: 145407 - DNA, 35 bp, Artificial Sequence
  Synthetic oligonucleotide
gacgggcgccctagcgcgtccccgccttctccatc

SEQ ID NO: 145408 - DNA, 35 bp, Artificial Sequence
  Synthetic oligonucleotide
aaagggggaggtgggggggctgaaataacgaacag

SEQ ID NO: 145409 - DNA, 35 bp, Artificial Sequence
  Synthetic oligonucleotide
gtgctgcaccgtctcccggtaccaccttcatcccg

SEQ ID NO: 145410 - DNA, 35 bp, Artificial Sequence
  Synthetic oligonucleotide
tcaccatgttagtctctttcacaacgtcccctccg

SEQ ID NO: 145411 - DNA, 35 bp, Artificial Sequence
  Synthetic oligonucleotide
gggtgagcgacggatcggaagggaggggaacggcg

SEQ ID NO: 145412 - DNA, 35 bp, Artificial Sequence
  Synthetic oligonucleotide
taagtggtgagcggggtggggcggaagtaaggtgg

SEQ ID NO: 145413 - DNA, 35 bp, Artificial Sequence
  Synthetic oligonucleotide
tccacccttactcgataagcttccccgccttttgg

SEQ ID NO: 145414 - DNA, 35 bp, Artificial Sequence
  Synthetic oligonucleotide
tgtgccccccgttgcccgcgcagactccttcattg

SEQ ID NO: 145415 - DNA, 35 bp, Artificial Sequence
  Synthetic oligonucleotide
gattcacgcattgcccgccgaccttatcctgtttg

SEQ ID NO: 145416 - DNA, 35 bp, Artificial Sequence
  Synthetic oligonucleotide
tcatgtgtgggcgggtggagtgggtgtctgataat

SEQ ID NO: 145417 - DNA, 35 bp, Artificial Sequence
  Synthetic oligonucleotide
agcacctccccgcccccacgtcgatctaggctcat

SEQ ID NO: 145418 - DNA, 35 bp, Artificial Sequence
  Synthetic oligonucleotide
tgatcatcctcctctgcttctggaatcttggtact

SEQ ID NO: 145419 - DNA, 35 bp, Artificial Sequence
  Synthetic oligonucleotide
gactcttccgccgccaacgcctcctaggagccttt

SEQ ID NO: 145420 - DNA, 35 bp, Artificial Sequence
  Synthetic oligonucleotide
actcatcgcctcgctagtcatcccacaccttcttt

SEQ ID NO: 145421 - DNA, 36 bp, Artificial Sequence
  Synthetic oligonucleotide
tatatccccggccccccggcattctggaatgttcca

SEQ ID NO: 145422 - DNA, 35 bp, Artificial Sequence
  Synthetic oligonucleotide
tcccctttcgcctctgcatcccacatcgcatcgca

SEQ ID NO: 145423 - DNA, 36 bp, Artificial Sequence
  Synthetic oligonucleotide
gctcacgaccctgtcccctcacaccactcagttgca

SEQ ID NO: 145424 - DNA, 36 bp, Artificial Sequence
  Synthetic oligonucleotide
atcacccacggcccacatgcacccgccaaccgatca

SEQ ID NO: 145425 - DNA, 35 bp, Artificial Sequence
  Synthetic oligonucleotide
tacgacctctttccatgccgcctgctcgaccctca

SEQ ID NO: 145426 - DNA, 36 bp, Artificial Sequence
  Synthetic oligonucleotide
gtcattcctcccgtatcgttattcaacggtctctca

SEQ ID NO: 145427 - DNA, 36 bp, Artificial Sequence
  Synthetic oligonucleotide
aacgaggtggaggcggagagaatcgaagggcaaaga

SEQ ID NO: 145428 - DNA, 37 bp, Artificial Sequence
  Synthetic oligonucleotide
atgtcctcctccgttccttgttgtctctcgatcacga

SEQ ID NO: 145429 - DNA, 37 bp, Artificial Sequence
  Synthetic oligonucleotide
ggacggagggacgggaaggggtgatgatcgaaccgga

SEQ ID NO: 145430 - DNA, 37 bp, Artificial Sequence
  Synthetic oligonucleotide
agaagggtggggcggggtaactgcgttgcaaacggga

SEQ ID NO: 145431 - DNA, 37 bp, Artificial Sequence
  Synthetic oligonucleotide
gagagagtgggtgaatgggctgaggaacgaaggggga

SEQ ID NO: 145432 - DNA, 37 bp, Artificial Sequence
  Synthetic oligonucleotide
tggtgagtggcggtttccatcctagggcggtggggga

SEQ ID NO: 145433 - DNA, 37 bp, Artificial Sequence
  Synthetic oligonucleotide
atgagggggggcggggtggtcggggagaggtggtgga

SEQ ID NO: 145434 - DNA, 38 bp, Artificial Sequence
  Synthetic oligonucleotide
aaccgccgtccatcgcgaagaccccttctcccacatga

SEQ ID NO: 145435 - DNA, 35 bp, Artificial Sequence
  Synthetic oligonucleotide
gcgtgctcccacgtcccgcctgcccatatccatga

SEQ ID NO: 145436 - DNA, 35 bp, Artificial Sequence
  Synthetic oligonucleotide
gaaaccgtctcctcttgctgcgtctcgctccctga

SEQ ID NO: 145437 - DNA, 35 bp, Artificial Sequence
  Synthetic oligonucleotide
tatcactactgcctttccgtgcctgccctcgctga

SEQ ID NO: 145438 - DNA, 38 bp, Artificial Sequence
  Synthetic oligonucleotide
gcccgtctcgccggggctacttccatcacttccattga

SEQ ID NO: 145439 - DNA, 36 bp, Artificial Sequence
  Synthetic oligonucleotide
tccccccccgcttttgtgacaacacactgggacata

SEQ ID NO: 145440 - DNA, 36 bp, Artificial Sequence
  Synthetic oligonucleotide
gctgacagagtaaaagggggctaggaggcggaggta

SEQ ID NO: 145441 - DNA, 35 bp, Artificial Sequence
  Synthetic oligonucleotide
atcaccatgcccaattcgtctcaaccggcccatta

SEQ ID NO: 145442 - DNA, 32 bp, Artificial Sequence
  Synthetic oligonucleotide
ggtaaccggcccccgccatctacgacacccac

SEQ ID NO: 145443 - DNA, 35 bp, Artificial Sequence
  Synthetic oligonucleotide
tccacctctcgataactgttgcatcaaacgaaacc

SEQ ID NO: 145444 - DNA, 35 bp, Artificial Sequence
  Synthetic oligonucleotide
tcgatccgctcgcgctcacttgtcccgtgcccacc

SEQ ID NO: 145445 - DNA, 35 bp, Artificial Sequence
  Synthetic oligonucleotide
acccatgcggtccccagccttatcaacacgtcacc

SEQ ID NO: 145446 - DNA, 35 bp, Artificial Sequence
  Synthetic oligonucleotide
tcaaccccgcgtgttcgcccttcagcgtgccaccc

SEQ ID NO: 145447 - DNA, 35 bp, Artificial Sequence
  Synthetic oligonucleotide
tgcgacccctttctgtaatacgtttttggcctccc

SEQ ID NO: 145448 - DNA, 35 bp, Artificial Sequence
  Synthetic oligonucleotide
atgctccggtcgtgtacgcttcccccctcgtgtcc

SEQ ID NO: 145449 - DNA, 35 bp, Artificial Sequence
  Synthetic oligonucleotide
gatgcggctgtcaaccggcgccctccattcattcc

SEQ ID NO: 145450 - DNA, 35 bp, Artificial Sequence
  Synthetic oligonucleotide
tccaaaagccacgcctgcttttctgaaccctttcc

SEQ ID NO: 145451 - DNA, 35 bp, Artificial Sequence
  Synthetic oligonucleotide
acttcccaccgtaaggctccgagtcgctcccattc

SEQ ID NO: 145452 - DNA, 35 bp, Artificial Sequence
  Synthetic oligonucleotide
gtgatgcaccgccatcatatacataccttaccttc

SEQ ID NO: 145453 - DNA, 35 bp, Artificial Sequence
  Synthetic oligonucleotide
tcttcggccctgcccctagtccgactccctgtacg

SEQ ID NO: 145454 - DNA, 35 bp, Artificial Sequence
  Synthetic oligonucleotide
gacttcatgagctgctgcatcctcccgccttctcg

SEQ ID NO: 145455 - DNA, 35 bp, Artificial Sequence
  Synthetic oligonucleotide
gggaaagggggaggtgcgaggtaggattcgcaggg

SEQ ID NO: 145456 - DNA, 35 bp, Artificial Sequence
  Synthetic oligonucleotide
tgctccgccgcttgcaccatcttcctgtcccctgg

SEQ ID NO: 145457 - DNA, 35 bp, Artificial Sequence
  Synthetic oligonucleotide
actcttccctcctgtgtattccccccgtgatctgg

SEQ ID NO: 145458 - DNA, 32 bp, Artificial Sequence
  Synthetic oligonucleotide
tacaacccgccccactaacatcatccgttgtg

SEQ ID NO: 145459 - DNA, 35 bp, Artificial Sequence
  Synthetic oligonucleotide
acatgccaccttacaactgtgatcttacctccaat

SEQ ID NO: 145460 - DNA, 35 bp, Artificial Sequence
  Synthetic oligonucleotide
acaccaccgttctcgctcggcctgctgcctatcat

SEQ ID NO: 145461 - DNA, 35 bp, Artificial Sequence
  Synthetic oligonucleotide
tgtaccacggaccgtaccgccgccatttaatttat

SEQ ID NO: 145462 - DNA, 35 bp, Artificial Sequence
  Synthetic oligonucleotide
ttcgttcctcttacgccctgttgtccctttaccct

SEQ ID NO: 145463 - DNA, 35 bp, Artificial Sequence
  Synthetic oligonucleotide
gacccggcggtaccccctctggacgcccctcgcct

SEQ ID NO: 145464 - DNA, 35 bp, Artificial Sequence
  Synthetic oligonucleotide
acacccttccgtccgacgtttctcccgcgtttcct

SEQ ID NO: 145465 - DNA, 35 bp, Artificial Sequence
  Synthetic oligonucleotide
gaccttacccctctcctcgatacgactgtccccgt

SEQ ID NO: 145466 - DNA, 35 bp, Artificial Sequence
  Synthetic oligonucleotide
atcagtccgcaccgcctcccgccactagcactgtt

SEQ ID NO: 145467 - DNA, 35 bp, Artificial Sequence
  Synthetic oligonucleotide
tagacgcagaagggtgtggtgggtgaaggcgggaa

SEQ ID NO: 145468 - DNA, 36 bp, Artificial Sequence
  Synthetic oligonucleotide
tttggggagaaatggggagaaggggggcgggcaaca

SEQ ID NO: 145469 - DNA, 35 bp, Artificial Sequence
  Synthetic oligonucleotide
caagcaccaccgcactgtccgcccgtccgcataca

SEQ ID NO: 145470 - DNA, 35 bp, Artificial Sequence
  Synthetic oligonucleotide
gactcccatccgccgtagataccagtttcgcgcca

SEQ ID NO: 145471 - DNA, 35 bp, Artificial Sequence
  Synthetic oligonucleotide
agcccagcgcctcgttcctaacgctacctcctcca

SEQ ID NO: 145472 - DNA, 36 bp, Artificial Sequence
  Synthetic oligonucleotide
gtcacctcgcgtcgaacttcgctcccgtgcattcca

SEQ ID NO: 145473 - DNA, 36 bp, Artificial Sequence
  Synthetic oligonucleotide
tccccacaccatatgccggtatccgtatcacctgca

SEQ ID NO: 145474 - DNA, 36 bp, Artificial Sequence
  Synthetic oligonucleotide
ttgcatgtcgacacctctcctcaagtccgccgctca

SEQ ID NO: 145475 - DNA, 36 bp, Artificial Sequence
  Synthetic oligonucleotide
atgtccactccctcgccctcgcagctattgcgttca

SEQ ID NO: 145476 - DNA, 37 bp, Artificial Sequence
  Synthetic oligonucleotide
tccagcacgccctctccgtttgcgcatcacttcaaga

SEQ ID NO: 145477 - DNA, 37 bp, Artificial Sequence
  Synthetic oligonucleotide
gccgtatccctcctctcgtgttcctgaccctcacaga

SEQ ID NO: 145478 - DNA, 37 bp, Artificial Sequence
  Synthetic oligonucleotide
atcgcctcatccgtcccaagctataccaactcctcga

SEQ ID NO: 145479 - DNA, 37 bp, Artificial Sequence
  Synthetic oligonucleotide
tcctacctccgttcgcacattatcatcctgaatagga

SEQ ID NO: 145480 - DNA, 37 bp, Artificial Sequence
  Synthetic oligonucleotide
gagtggtaatggggaaataacgggagggggtaaggga

SEQ ID NO: 145481 - DNA, 37 bp, Artificial Sequence
  Synthetic oligonucleotide
gcaggggagagggtggggacgggcgcggaccgaggga

SEQ ID NO: 145482 - DNA, 37 bp, Artificial Sequence
  Synthetic oligonucleotide
aactggggtcacatggggacaaactatcgggagggga

SEQ ID NO: 145483 - DNA, 36 bp, Artificial Sequence
  Synthetic oligonucleotide
tggggaagtacggaacgggggggagcaaacggggga

SEQ ID NO: 145484 - DNA, 37 bp, Artificial Sequence
  Synthetic oligonucleotide
taccacgtcgctcctattcgactcgctactccttgga

SEQ ID NO: 145485 - DNA, 36 bp, Artificial Sequence
  Synthetic oligonucleotide
tagtgggaaggggagggaaaaattagggaccaatga

SEQ ID NO: 145486 - DNA, 38 bp, Artificial Sequence
  Synthetic oligonucleotide
gaagagggtgggtgttgtaatgggggcaagtgggatga

SEQ ID NO: 145487 - DNA, 37 bp, Artificial Sequence
  Synthetic oligonucleotide
actcacactatgtacccctgcccgcttgacccgctga

SEQ ID NO: 145488 - DNA, 36 bp, Artificial Sequence
  Synthetic oligonucleotide
gcacgcagaaccctgtccactcgaatcactctctga

SEQ ID NO: 145489 - DNA, 37 bp, Artificial Sequence
  Synthetic oligonucleotide
gatgggtgagggtgggctgggacctgtttactagtga

SEQ ID NO: 145490 - DNA, 37 bp, Artificial Sequence
  Synthetic oligonucleotide
ttccgcccacgctctaccccgttcctatcctgtgtga

SEQ ID NO: 145491 - DNA, 37 bp, Artificial Sequence
  Synthetic oligonucleotide
tgccccatcatgcattatcatcccacgctgtctttga

SEQ ID NO: 145492 - DNA, 36 bp, Artificial Sequence
  Synthetic oligonucleotide
aatcacgcccgtatcccatctcgttttgtcgcacta

SEQ ID NO: 145493 - DNA, 35 bp, Artificial Sequence
  Synthetic oligonucleotide
tccagtgcccaccactctgcccgatgacttcccta

SEQ ID NO: 145494 - DNA, 35 bp, Artificial Sequence
  Synthetic oligonucleotide
agctagcaggggtcgtagggccgggagggaaggta

SEQ ID NO: 145495 - DNA, 36 bp, Artificial Sequence
  Synthetic oligonucleotide
tgaagtgtcgcctatttccaccgtgcctgttgttta

SEQ ID NO: 145496 - DNA, 35 bp, Artificial Sequence
  Synthetic oligonucleotide
tcaggtcgctctgcaccactccatagtttgcctcc

SEQ ID NO: 145497 - DNA, 35 bp, Artificial Sequence
  Synthetic oligonucleotide
tcacggatgtcccccgcgccgtttcgacctctcgc

SEQ ID NO: 145498 - DNA, 35 bp, Artificial Sequence
  Synthetic oligonucleotide
tcatccccacgccgatatgccctcttgagccctgc

SEQ ID NO: 145499 - DNA, 35 bp, Artificial Sequence
  Synthetic oligonucleotide
tattcgacgtcctctcagctgcgccgtcaccactc

SEQ ID NO: 145500 - DNA, 35 bp, Artificial Sequence
  Synthetic oligonucleotide
ttcaccgtcacactccgttacgctaaacatccctc

SEQ ID NO: 145501 - DNA, 35 bp, Artificial Sequence
  Synthetic oligonucleotide
tctccgaccccttccagaatgctaatacatcgttc

SEQ ID NO: 145502 - DNA, 35 bp, Artificial Sequence
  Synthetic oligonucleotide
ttggacgaacctcttctttcttatttaccgccccg

SEQ ID NO: 145503 - DNA, 35 bp, Artificial Sequence
  Synthetic oligonucleotide
tgtgcatacctcctgtgccgccttttcattcctcg

SEQ ID NO: 145504 - DNA, 35 bp, Artificial Sequence
  Synthetic oligonucleotide
atcctgtaccaccgccgcgttcctgaactttctcg

SEQ ID NO: 145505 - DNA, 35 bp, Artificial Sequence
  Synthetic oligonucleotide
agctgcggggacaaggggggaccgaggaacggggg

SEQ ID NO: 145506 - DNA, 35 bp, Artificial Sequence
  Synthetic oligonucleotide
gctttcggccgtacaccttctttcgcgcctgcact

SEQ ID NO: 145507 - DNA, 35 bp, Artificial Sequence
  Synthetic oligonucleotide
gtggtcgatcacactgctagctcgccaaactccct

SEQ ID NO: 145508 - DNA, 35 bp, Artificial Sequence
  Synthetic oligonucleotide
gcatacacacttgtgtttcggcctttacattctct

SEQ ID NO: 145509 - DNA, 35 bp, Artificial Sequence
  Synthetic oligonucleotide
tcacgcccctttgccagattctcctgttttgccgt

SEQ ID NO: 145510 - DNA, 35 bp, Artificial Sequence
  Synthetic oligonucleotide
tctgccccctcacgcccgtatcttgctctttcggt

SEQ ID NO: 145511 - DNA, 35 bp, Artificial Sequence
  Synthetic oligonucleotide
gggattcgcgcatcacccccttcaccaccgatctt

SEQ ID NO: 145512 - DNA, 35 bp, Artificial Sequence
  Synthetic oligonucleotide
acctccctgctgatggcccactctacgctatcgtt

SEQ ID NO: 145513 - DNA, 35 bp, Artificial Sequence
  Synthetic oligonucleotide
gacccggtggtgggaaagccggaggaggaggggtt

SEQ ID NO: 145514 - DNA, 35 bp, Artificial Sequence
  Synthetic oligonucleotide
gcatcccgccgttcgccagtctcatccgccggttt

SEQ ID NO: 145515 - DNA, 35 bp, Artificial Sequence
  Synthetic oligonucleotide
tagtcagacaccatcgtctccccgcttcggcctaa

SEQ ID NO: 145516 - DNA, 36 bp, Artificial Sequence
  Synthetic oligonucleotide
tccccaccttaactgttaccacccgcactgtagaca

SEQ ID NO: 145517 - DNA, 36 bp, Artificial Sequence
  Synthetic oligonucleotide
gcgatggtcaccctcctgctataacagccctgtaca

SEQ ID NO: 145518 - DNA, 36 bp, Artificial Sequence
  Synthetic oligonucleotide
gtccgtcattcatgacctgtctcctcccagccccca

SEQ ID NO: 145519 - DNA, 36 bp, Artificial Sequence
  Synthetic oligonucleotide
aacgctcacgtcgctcctatctgcgcacccttccca

SEQ ID NO: 145520 - DNA, 37 bp, Artificial Sequence
  Synthetic oligonucleotide
tatgcgtaggggggggcggaggggcgtctcagacgga

SEQ ID NO: 145521 - DNA, 37 bp, Artificial Sequence
  Synthetic oligonucleotide
taggggcgtgggggaggaggagctaggtgaaagcgga

SEQ ID NO: 145522 - DNA, 38 bp, Artificial Sequence
  Synthetic oligonucleotide
acgggggggagggctgggcaggaacgcactagtaatga

SEQ ID NO: 145523 - DNA, 37 bp, Artificial Sequence
  Synthetic oligonucleotide
tgtagtgcaataaggaggagagagggggagagactga

SEQ ID NO: 145524 - DNA, 38 bp, Artificial Sequence
  Synthetic oligonucleotide
gcatgcaacggcacatttgcacgcctaccacaccctga

SEQ ID NO: 145525 - DNA, 27 bp, Artificial Sequence
  Synthetic oligonucleotide
gagatgcccccccttgtttccccgtga

SEQ ID NO: 145526 - DNA, 37 bp, Artificial Sequence
  Synthetic oligonucleotide
gcatcacgctccttttactaccctcgcccgtcggtga

SEQ ID NO: 145527 - DNA, 38 bp, Artificial Sequence
  Synthetic oligonucleotide
gttgcccatcatgctctatcttaccaccgccagggtga

SEQ ID NO: 145528 - DNA, 37 bp, Artificial Sequence
  Synthetic oligonucleotide
acctgtcctccccccgctgtttggagtcttctcttga

SEQ ID NO: 145529 - DNA, 36 bp, Artificial Sequence
  Synthetic oligonucleotide
tcctcctccctcgatgcccgttgcgccaacactata

SEQ ID NO: 145530 - DNA, 36 bp, Artificial Sequence
  Synthetic oligonucleotide
gtcctcaccatcgagctgacggttttccttccctta

SEQ ID NO: 145531 - DNA, 35 bp, Artificial Sequence
  Synthetic oligonucleotide
gacccctcctacatgaaccgttgcgagcacccaac

SEQ ID NO: 145532 - DNA, 35 bp, Artificial Sequence
  Synthetic oligonucleotide
tctcgcctcccggatgccgtgctgttccttctaac

SEQ ID NO: 145533 - DNA, 35 bp, Artificial Sequence
  Synthetic oligonucleotide
attgtcatgccacctgccttgatcgttcctcccac

SEQ ID NO: 145534 - DNA, 35 bp, Artificial Sequence
  Synthetic oligonucleotide
gatgtcttaccgctgcccttatgttcacgtactac

SEQ ID NO: 145535 - DNA, 35 bp, Artificial Sequence
  Synthetic oligonucleotide
gtccatgcccgccccccctgctggtactcactacc

SEQ ID NO: 145536 - DNA, 35 bp, Artificial Sequence
  Synthetic oligonucleotide
gcatcagcccggctcccagcaccaaacatcacgcc

SEQ ID NO: 145537 - DNA, 35 bp, Artificial Sequence
  Synthetic oligonucleotide
agaccccatccctagtgtccacaagcatgctcgcc

SEQ ID NO: 145538 - DNA, 35 bp, Artificial Sequence
  Synthetic oligonucleotide
gcctcccccctcgaatgtcctgccaaagttcatcc

SEQ ID NO: 145539 - DNA, 35 bp, Artificial Sequence
  Synthetic oligonucleotide
ttggtagccaactcagtctttgcgtttcctcctcc

SEQ ID NO: 145540 - DNA, 35 bp, Artificial Sequence
  Synthetic oligonucleotide
aatcgccacaatccctgcctactgtaggcacttcc

SEQ ID NO: 145541 - DNA, 35 bp, Artificial Sequence
  Synthetic oligonucleotide
tcgtacgagctcgttgtacgcccccggcctcttcc

SEQ ID NO: 145542 - DNA, 35 bp, Artificial Sequence
  Synthetic oligonucleotide
ttcatggtggacgggggatcggggaaagaggcggc

SEQ ID NO: 145543 - DNA, 35 bp, Artificial Sequence
  Synthetic oligonucleotide
gaacgagcacttctttctccaaacgcctgccctgc

SEQ ID NO: 145544 - DNA, 35 bp, Artificial Sequence
  Synthetic oligonucleotide
agtagcccaccctcccgttgccctagctgttttgc

SEQ ID NO: 145545 - DNA, 35 bp, Artificial Sequence
  Synthetic oligonucleotide
ggatcgcacgcacttagcctcgagccgactccctc

SEQ ID NO: 145546 - DNA, 35 bp, Artificial Sequence
  Synthetic oligonucleotide
cccaccttactcagtccccgcggtccgtccccgtc

SEQ ID NO: 145547 - DNA, 35 bp, Artificial Sequence
  Synthetic oligonucleotide
tgcctatgtcacacccgagcccttctttacagcag

SEQ ID NO: 145548 - DNA, 35 bp, Artificial Sequence
  Synthetic oligonucleotide
gctccgccacacccaactcgtgtttcccttaactg

SEQ ID NO: 145549 - DNA, 35 bp, Artificial Sequence
  Synthetic oligonucleotide
agtgtctgccccctcgtaaactcttccaccgcctg

SEQ ID NO: 145550 - DNA, 35 bp, Artificial Sequence
  Synthetic oligonucleotide
acacctcccgtttcgtttgtctatccaacgctgct

SEQ ID NO: 145551 - DNA, 35 bp, Artificial Sequence
  Synthetic oligonucleotide
agcgccatcacagcgctccgccctctcttacctgt

SEQ ID NO: 145552 - DNA, 35 bp, Artificial Sequence
  Synthetic oligonucleotide
gcaacctcccaatgtctgccccccacgtgttttgt

SEQ ID NO: 145553 - DNA, 35 bp, Artificial Sequence
  Synthetic oligonucleotide
tctgacagctcaccgaccctcgcgccaagcccctt

SEQ ID NO: 145554 - DNA, 35 bp, Artificial Sequence
  Synthetic oligonucleotide
acccctcaaggcatactgaccaccgctcctacgtt

SEQ ID NO: 145555 - DNA, 36 bp, Artificial Sequence
  Synthetic oligonucleotide
atgggaggggggggagacgcggatggagtggggtca

SEQ ID NO: 145556 - DNA, 36 bp, Artificial Sequence
  Synthetic oligonucleotide
acctccacgtacagggcgcacccttccacgctttca

SEQ ID NO: 145557 - DNA, 36 bp, Artificial Sequence
  Synthetic oligonucleotide
tacacgcgccgacctgctacctctcgcaatcccaga

SEQ ID NO: 145558 - DNA, 36 bp, Artificial Sequence
  Synthetic oligonucleotide
acgcgacgtcgccccacttattgccagctactacga

SEQ ID NO: 145559 - DNA, 36 bp, Artificial Sequence
  Synthetic oligonucleotide
agcccatctgcgtgcctttggccaatctcgccccga

SEQ ID NO: 145560 - DNA, 36 bp, Artificial Sequence
  Synthetic oligonucleotide
gctcgccgcattgctgcctcctgccccagtccccga

SEQ ID NO: 145561 - DNA, 37 bp, Artificial Sequence
  Synthetic oligonucleotide
gtgtccacccacaagtatttatgcctgctgttcccga

SEQ ID NO: 145562 - DNA, 35 bp, Artificial Sequence
  Synthetic oligonucleotide
attgctcagcatacacgcaccctctctccactcga

SEQ ID NO: 145563 - DNA, 37 bp, Artificial Sequence
  Synthetic oligonucleotide
aaaggagaggggtggtgggaggtgaaatggtggagga

SEQ ID NO: 145564 - DNA, 37 bp, Artificial Sequence
  Synthetic oligonucleotide
gaagcgggggacgggacaagcgggggtggggatagga

SEQ ID NO: 145565 - DNA, 37 bp, Artificial Sequence
  Synthetic oligonucleotide
tagtcgcgtacccctgcgccccacgatccatgccgga

SEQ ID NO: 145566 - DNA, 37 bp, Artificial Sequence
  Synthetic oligonucleotide
caattggtcgcgcttatctatcctgcccttcatcgga

SEQ ID NO: 145567 - DNA, 37 bp, Artificial Sequence
  Synthetic oligonucleotide
gcaagctccagggtcccaccgttcatccctccgctga

SEQ ID NO: 145568 - DNA, 36 bp, Artificial Sequence
  Synthetic oligonucleotide
tatgggagggtcgggggtagttatggggtaacgtga

SEQ ID NO: 145569 - DNA, 35 bp, Artificial Sequence
  Synthetic oligonucleotide
ggatgggataactgggtagggagggcttctgtata

SEQ ID NO: 145570 - DNA, 36 bp, Artificial Sequence
  Synthetic oligonucleotide
ttacccacccctgtgatctcaagcctcccagtacta

SEQ ID NO: 145571 - DNA, 36 bp, Artificial Sequence
  Synthetic oligonucleotide
gaagagcaggtacaagggcatggagggaggagtgta

SEQ ID NO: 145572 - DNA, 35 bp, Artificial Sequence
  Synthetic oligonucleotide
gcgcatgcccgtgtaatgcctctgatcaccgccac

SEQ ID NO: 145573 - DNA, 35 bp, Artificial Sequence
  Synthetic oligonucleotide
tcaccatgtcctcgcagctgatccccgccagtgcc

SEQ ID NO: 145574 - DNA, 35 bp, Artificial Sequence
  Synthetic oligonucleotide
tcacgacctcctgacaatgcagctactcggtttcc

SEQ ID NO: 145575 - DNA, 35 bp, Artificial Sequence
  Synthetic oligonucleotide
tacgcgctcatctgctcaactccctgtgcccttgc

SEQ ID NO: 145576 - DNA, 35 bp, Artificial Sequence
  Synthetic oligonucleotide
gaaggccacctccgaggtcctgtcccatactaatc

SEQ ID NO: 145577 - DNA, 35 bp, Artificial Sequence
  Synthetic oligonucleotide
agacgcgcccaggcaccatcttgttttacaccatc

SEQ ID NO: 145578 - DNA, 35 bp, Artificial Sequence
  Synthetic oligonucleotide
ttgcatggcgatcacataccatcaaaccaccgctc

SEQ ID NO: 145579 - DNA, 35 bp, Artificial Sequence
  Synthetic oligonucleotide
ccctgcacccgtcccgctgcccttcgtgatggttc

SEQ ID NO: 145580 - DNA, 35 bp, Artificial Sequence
  Synthetic oligonucleotide
ggacatcctcactccttccgcccagagcaaacccg

SEQ ID NO: 145581 - DNA, 35 bp, Artificial Sequence
  Synthetic oligonucleotide
gggaggggagggccgagggaggttgaagatcttat

SEQ ID NO: 145582 - DNA, 35 bp, Artificial Sequence
  Synthetic oligonucleotide
aatagcatcagcctcgctcccgttcgctcgatcct

SEQ ID NO: 145583 - DNA, 35 bp, Artificial Sequence
  Synthetic oligonucleotide
tccgcctcctccgtacgatctaggtatctcccgct

SEQ ID NO: 145584 - DNA, 35 bp, Artificial Sequence
  Synthetic oligonucleotide
gatcccgctcgcccgacgattcgtcctttattgct

SEQ ID NO: 145585 - DNA, 35 bp, Artificial Sequence
  Synthetic oligonucleotide
gaagcgaagcactcctcccagtcacccgatcctgt

SEQ ID NO: 145586 - DNA, 35 bp, Artificial Sequence
  Synthetic oligonucleotide
gcccacccgccgaccttttgttcactctacgttgt

SEQ ID NO: 145587 - DNA, 35 bp, Artificial Sequence
  Synthetic oligonucleotide
gttccacccgtgtgcttcgataacttgcgcctctt

SEQ ID NO: 145588 - DNA, 35 bp, Artificial Sequence
  Synthetic oligonucleotide
gtgtgacgagcacacgtcgcatcatccttcttgtt

SEQ ID NO: 145589 - DNA, 35 bp, Artificial Sequence
  Synthetic oligonucleotide
gcccctatcacatactggtatggactcactccttt

SEQ ID NO: 145590 - DNA, 34 bp, Artificial Sequence
  Synthetic oligonucleotide
aacggtagagaagcaaggacgggggagcatgaaa

SEQ ID NO: 145591 - DNA, 36 bp, Artificial Sequence
  Synthetic oligonucleotide
acgctcatgcaccactatgttgctcaacgccttcca

SEQ ID NO: 145592 - DNA, 36 bp, Artificial Sequence
  Synthetic oligonucleotide
atcagtgccagcaggcgccttctctctctccttgca

SEQ ID NO: 145593 - DNA, 35 bp, Artificial Sequence
  Synthetic oligonucleotide
actgatgccgcatgcctttgccaagttgcccttca

SEQ ID NO: 145594 - DNA, 37 bp, Artificial Sequence
  Synthetic oligonucleotide
aacatccccccttatgatcttgagccctcgttgacga

SEQ ID NO: 145595 - DNA, 37 bp, Artificial Sequence
  Synthetic oligonucleotide
tgtcgccacctgccctcacattggtcgtcgcctacga

SEQ ID NO: 145596 - DNA, 37 bp, Artificial Sequence
  Synthetic oligonucleotide
gttgctatcagctctggtttcgcccccccccaaccga

SEQ ID NO: 145597 - DNA, 36 bp, Artificial Sequence
  Synthetic oligonucleotide
tatcgcgtgggtgagcggcatgggcggagggaggga

SEQ ID NO: 145598 - DNA, 37 bp, Artificial Sequence
  Synthetic oligonucleotide
accacgggctgggttgtgttttgttggggagagggga

SEQ ID NO: 145599 - DNA, 37 bp, Artificial Sequence
  Synthetic oligonucleotide
gaactgggcggcggaggcacggggagtaatggtggga

SEQ ID NO: 145600 - DNA, 37 bp, Artificial Sequence
  Synthetic oligonucleotide
acttcggccctctcactgcgcaccacaccatccatga

SEQ ID NO: 145601 - DNA, 37 bp, Artificial Sequence
  Synthetic oligonucleotide
ttacgcgtaggcacctcgtcactcctcttctccctga

SEQ ID NO: 145602 - DNA, 36 bp, Artificial Sequence
  Synthetic oligonucleotide
agacagggagggacgacgggttggggtactgcctga

SEQ ID NO: 145603 - DNA, 38 bp, Artificial Sequence
  Synthetic oligonucleotide
gacggggtgaggggtagttcggaattggagagggctga

SEQ ID NO: 145604 - DNA, 38 bp, Artificial Sequence
  Synthetic oligonucleotide
tggtcgaggaaagcaggggtgaagggtgggcatagtga

SEQ ID NO: 145605 - DNA, 38 bp, Artificial Sequence
  Synthetic oligonucleotide
ggacagatacaatgggctagggtgggaaggggaattga

SEQ ID NO: 145606 - DNA, 38 bp, Artificial Sequence
  Synthetic oligonucleotide
gcctactgccctcattacttcatctgctgcctgcttga

SEQ ID NO: 145607 - DNA, 36 bp, Artificial Sequence
  Synthetic oligonucleotide
gctcgacatgcaggcctccccgcccgtacttccata

SEQ ID NO: 145608 - DNA, 36 bp, Artificial Sequence
  Synthetic oligonucleotide
tgacgtcgccatgtcctatccccgcttttccaggta

SEQ ID NO: 145609 - DNA, 35 bp, Artificial Sequence
  Synthetic oligonucleotide
gacgccccttcccgcgcacccttggcttatctgta

SEQ ID NO: 145610 - DNA, 35 bp, Artificial Sequence
  Synthetic oligonucleotide
ttggggggcgggggggtagcacgagttggggccac

SEQ ID NO: 145611 - DNA, 35 bp, Artificial Sequence
  Synthetic oligonucleotide
tcgtgcatcgggtagttccgttttcgtccgccccc

SEQ ID NO: 145612 - DNA, 35 bp, Artificial Sequence
  Synthetic oligonucleotide
tcgcctggctcctcatgtccttgtcttcgttcccc

SEQ ID NO: 145613 - DNA, 35 bp, Artificial Sequence
  Synthetic oligonucleotide
acccgatctccgaatcgcttagccccctgttcccc

SEQ ID NO: 145614 - DNA, 35 bp, Artificial Sequence
  Synthetic oligonucleotide
gaagcacaactacttggtcccgactccttggctcc

SEQ ID NO: 145615 - DNA, 35 bp, Artificial Sequence
  Synthetic oligonucleotide
ttcgttgtgccgcactcctgccctacagactttcc

SEQ ID NO: 145616 - DNA, 35 bp, Artificial Sequence
  Synthetic oligonucleotide
accgcaaccactgaatactccgtgcgcccgaccgc

SEQ ID NO: 145617 - DNA, 35 bp, Artificial Sequence
  Synthetic oligonucleotide
gcgtgtcctcgctcccatccctgtcctatacaatc

SEQ ID NO: 145618 - DNA, 35 bp, Artificial Sequence
  Synthetic oligonucleotide
gttgcaccatcgacccctgatcccaggctttactc

SEQ ID NO: 145619 - DNA, 35 bp, Artificial Sequence
  Synthetic oligonucleotide
tgggcacttacacctgcgctgcattccatccggtc

SEQ ID NO: 145620 - DNA, 35 bp, Artificial Sequence
  Synthetic oligonucleotide
gatggcttgaccccgctgcgttgtttcgtcctgtc

SEQ ID NO: 145621 - DNA, 35 bp, Artificial Sequence
  Synthetic oligonucleotide
gccccgactcgcctgctccgaacgaggtaccattc

SEQ ID NO: 145622 - DNA, 35 bp, Artificial Sequence
  Synthetic oligonucleotide
tctcgactccgcctggtgctccagtcctcgttttc

SEQ ID NO: 145623 - DNA, 35 bp, Artificial Sequence
  Synthetic oligonucleotide
ttcgctctgcacgctctttctgccgccatcaatcg

SEQ ID NO: 145624 - DNA, 35 bp, Artificial Sequence
  Synthetic oligonucleotide
ggtaacgctaagtgtgcttctccctgcccccgtcg

SEQ ID NO: 145625 - DNA, 35 bp, Artificial Sequence
  Synthetic oligonucleotide
tgatcgatctggtcaccctgcttactacccattcg

SEQ ID NO: 145626 - DNA, 35 bp, Artificial Sequence
  Synthetic oligonucleotide
tctccgcccgatattatcgtcattatccctgttcg

SEQ ID NO: 145627 - DNA, 35 bp, Artificial Sequence
  Synthetic oligonucleotide
ggggtggagcaagtgctggaaggtcggggaatatg

SEQ ID NO: 145628 - DNA, 35 bp, Artificial Sequence
  Synthetic oligonucleotide
gcctgggtcggggggggttacgggtgcattgcctg

SEQ ID NO: 145629 - DNA, 35 bp, Artificial Sequence
  Synthetic oligonucleotide
ttctggatcctggtgcagtgccggaccgcccccct

SEQ ID NO: 145630 - DNA, 35 bp, Artificial Sequence
  Synthetic oligonucleotide
gtgtcatcgcctcatcttgggatatcccgcgccct

SEQ ID NO: 145631 - DNA, 35 bp, Artificial Sequence
  Synthetic oligonucleotide
tccgagggaaaacctcccaacgcctccgttacctt

SEQ ID NO: 145632 - DNA, 28 bp, Artificial Sequence
  Synthetic oligonucleotide
atacacctaccgtgcacaccgccttcaa

SEQ ID NO: 145633 - DNA, 36 bp, Artificial Sequence
  Synthetic oligonucleotide
gcaaggagaggaattgcgggagggggttggggtaca

SEQ ID NO: 145634 - DNA, 35 bp, Artificial Sequence
  Synthetic oligonucleotide
tctatcgcgcgcaacctgcccatgatccctaccca

SEQ ID NO: 145635 - DNA, 36 bp, Artificial Sequence
  Synthetic oligonucleotide
tatccgcgcagtcgcgtcacctacgcctgtttccca

SEQ ID NO: 145636 - DNA, 36 bp, Artificial Sequence
  Synthetic oligonucleotide
gtgtgatggcgggtgcggaggaggggggaggttgca

SEQ ID NO: 145637 - DNA, 35 bp, Artificial Sequence
  Synthetic oligonucleotide
tcttcaccggccacctctcggttatctgccaatca

SEQ ID NO: 145638 - DNA, 36 bp, Artificial Sequence
  Synthetic oligonucleotide
gaccccacgaccatcacgcctattgcacgtgtttca

SEQ ID NO: 145639 - DNA, 37 bp, Artificial Sequence
  Synthetic oligonucleotide
ttcggggtgaggcgggtatgaaggggagaacgccaga

SEQ ID NO: 145640 - DNA, 35 bp, Artificial Sequence
  Synthetic oligonucleotide
actgttccgctttgtggtttacccgctttccccga

SEQ ID NO: 145641 - DNA, 37 bp, Artificial Sequence
  Synthetic oligonucleotide
taccaccctcggaatatctagctagccacatcgccga

SEQ ID NO: 145642 - DNA, 36 bp, Artificial Sequence
  Synthetic oligonucleotide
tccgcggatccgcctttgccgttgctatttcctcga

SEQ ID NO: 145643 - DNA, 37 bp, Artificial Sequence
  Synthetic oligonucleotide
accggggtataggggcgggcgggaagagaccgaagga

SEQ ID NO: 145644 - DNA, 37 bp, Artificial Sequence
  Synthetic oligonucleotide
ggactgggggatggagagaggagagggtgacgcagga

SEQ ID NO: 145645 - DNA, 37 bp, Artificial Sequence
  Synthetic oligonucleotide
gaggggaagggagggggttggaaaggggcacgctgga

SEQ ID NO: 145646 - DNA, 36 bp, Artificial Sequence
  Synthetic oligonucleotide
aaggggtgggcaacgggtaagaatggggggagtgga

SEQ ID NO: 145647 - DNA, 35 bp, Artificial Sequence
  Synthetic oligonucleotide
gccatgtcaacgcacaccgacctcttccctttgga

SEQ ID NO: 145648 - DNA, 38 bp, Artificial Sequence
  Synthetic oligonucleotide
tgagggtgggatggggagggtcgctaaacggcaagtga

SEQ ID NO: 145649 - DNA, 38 bp, Artificial Sequence
  Synthetic oligonucleotide
accgctcgcctccgggtttctatcgggtctccccttga

SEQ ID NO: 145650 - DNA, 36 bp, Artificial Sequence
  Synthetic oligonucleotide
gcccacagtcgtctcaccgcgcctgcttatcccgta

SEQ ID NO: 145651 - DNA, 36 bp, Artificial Sequence
  Synthetic oligonucleotide
gatggtcgggatgggaacagggggcaggtcaaggta

SEQ ID NO: 145652 - DNA, 35 bp, Artificial Sequence
  Synthetic oligonucleotide
atttgccccccctgcttatgccgcgcatctcatac

SEQ ID NO: 145653 - DNA, 35 bp, Artificial Sequence
  Synthetic oligonucleotide
atccctgcacacctacgccctccctagctcggtac

SEQ ID NO: 145654 - DNA, 35 bp, Artificial Sequence
  Synthetic oligonucleotide
gtctcaccgccatcgattggcatattgcttccacc

SEQ ID NO: 145655 - DNA, 35 bp, Artificial Sequence
  Synthetic oligonucleotide
tgcacaatcttcctcctttcttcggtcctggtccc

SEQ ID NO: 145656 - DNA, 35 bp, Artificial Sequence
  Synthetic oligonucleotide
tgcggcccagatagctgcccgtgcctttctgtccc

SEQ ID NO: 145657 - DNA, 35 bp, Artificial Sequence
  Synthetic oligonucleotide
atccctagatctgttgccgtgcgtcccctttcgcc

SEQ ID NO: 145658 - DNA, 35 bp, Artificial Sequence
  Synthetic oligonucleotide
gtgaccgcagaaggttaccctctcagtcctcgtcc

SEQ ID NO: 145659 - DNA, 35 bp, Artificial Sequence
  Synthetic oligonucleotide
gtgctccgctcccacgtacccattgcgcactgtcc

SEQ ID NO: 145660 - DNA, 34 bp, Artificial Sequence
  Synthetic oligonucleotide
tgaacccgacgagcccctacattccatcgaccgc

SEQ ID NO: 145661 - DNA, 35 bp, Artificial Sequence
  Synthetic oligonucleotide
tgcattcatccactgccctagctcctgcccccatc

SEQ ID NO: 145662 - DNA, 35 bp, Artificial Sequence
  Synthetic oligonucleotide
tcccacgcatgttgttgttccaaaccctctccatc

SEQ ID NO: 145663 - DNA, 35 bp, Artificial Sequence
  Synthetic oligonucleotide
ttctgctcagccgaaccgcactgtcccctctgatc

SEQ ID NO: 145664 - DNA, 35 bp, Artificial Sequence
  Synthetic oligonucleotide
gtcacttcctcttcggttcaagtactgccccactc

SEQ ID NO: 145665 - DNA, 35 bp, Artificial Sequence
  Synthetic oligonucleotide
accgtagtagccccagttactgtccccacaccctc

SEQ ID NO: 145666 - DNA, 35 bp, Artificial Sequence
  Synthetic oligonucleotide
gccatctggctcctataaatcactgatcatgcctc

SEQ ID NO: 145667 - DNA, 35 bp, Artificial Sequence
  Synthetic oligonucleotide
cataccgcaacactcaaaggcagtcgctgctcctc

SEQ ID NO: 145668 - DNA, 35 bp, Artificial Sequence
  Synthetic oligonucleotide
acaccgttttgtccgcctatcgttccctggtcgtc

SEQ ID NO: 145669 - DNA, 36 bp, Artificial Sequence
  Synthetic oligonucleotide
tccccatgccgctcgctcctaattcgacgcttcgtc

SEQ ID NO: 145670 - DNA, 35 bp, Artificial Sequence
  Synthetic oligonucleotide
gacgcgccactctctcagctcagtccccgcgtgtc

SEQ ID NO: 145671 - DNA, 35 bp, Artificial Sequence
  Synthetic oligonucleotide
tccacgccagcctttggtccgcctattactttttc

SEQ ID NO: 145672 - DNA, 35 bp, Artificial Sequence
  Synthetic oligonucleotide
ggtatgagggtgtcggggaaggagtaggaatgcag

SEQ ID NO: 145673 - DNA, 35 bp, Artificial Sequence
  Synthetic oligonucleotide
ggtagtggcgggggaacaaagagcggttggtggag

SEQ ID NO: 145674 - DNA, 35 bp, Artificial Sequence
  Synthetic oligonucleotide
atttatcatagccgtttgtcagtcgtccccgcccg

SEQ ID NO: 145675 - DNA, 35 bp, Artificial Sequence
  Synthetic oligonucleotide
gcacgcctcacccacccccatgtcaaacccggccg

SEQ ID NO: 145676 - DNA, 35 bp, Artificial Sequence
  Synthetic oligonucleotide
acgtctgcctcagccctaagcgcccccccccgttg

SEQ ID NO: 145677 - DNA, 35 bp, Artificial Sequence
  Synthetic oligonucleotide
tgccaccgttacatccctcgcctattggactgcat

SEQ ID NO: 145678 - DNA, 35 bp, Artificial Sequence
  Synthetic oligonucleotide
gtgggggggcgcccgggtgggacgaacggtctcat

SEQ ID NO: 145679 - DNA, 35 bp, Artificial Sequence
  Synthetic oligonucleotide
gcccttgagtacacgaagtctcgttcctgccctct

SEQ ID NO: 145680 - DNA, 35 bp, Artificial Sequence
  Synthetic oligonucleotide
tcatctccgttcgtccctatccgtgcacatttagt

SEQ ID NO: 145681 - DNA, 35 bp, Artificial Sequence
  Synthetic oligonucleotide
gaggaggagggtagaggggggcagatccaatgggt

SEQ ID NO: 145682 - DNA, 35 bp, Artificial Sequence
  Synthetic oligonucleotide
gctcgcctacatctaccgttctgcccctcgtgctt

SEQ ID NO: 145683 - DNA, 36 bp, Artificial Sequence
  Synthetic oligonucleotide
ttagcctccctcccaattgtcgtagacccgctcaaa

SEQ ID NO: 145684 - DNA, 36 bp, Artificial Sequence
  Synthetic oligonucleotide
gacgaccccctcccttcttgtcctgggtcaggacaa

SEQ ID NO: 145685 - DNA, 36 bp, Artificial Sequence
  Synthetic oligonucleotide
taactgccgggggggggtaaaatgctggggagggaa

SEQ ID NO: 145686 - DNA, 36 bp, Artificial Sequence
  Synthetic oligonucleotide
tatgaggaggtacggtgagagagggagggtagtgaa

SEQ ID NO: 145687 - DNA, 36 bp, Artificial Sequence
  Synthetic oligonucleotide
aaaggggagtggagggcggtgggcaatgagctctaa

SEQ ID NO: 145688 - DNA, 36 bp, Artificial Sequence
  Synthetic oligonucleotide
actgtccactccccccccatgctacctccgtgagca

SEQ ID NO: 145689 - DNA, 36 bp, Artificial Sequence
  Synthetic oligonucleotide
acgcattacacagcatgccactcgcctgaccctgca

SEQ ID NO: 145690 - DNA, 36 bp, Artificial Sequence
  Synthetic oligonucleotide
aacgttaccctcatgcccgtggtttttacactctca

SEQ ID NO: 145691 - DNA, 36 bp, Artificial Sequence
  Synthetic oligonucleotide
gatgcggacgtttccagctcataacctgccctttca

SEQ ID NO: 145692 - DNA, 37 bp, Artificial Sequence
  Synthetic oligonucleotide
gcccctgcctcagagtctcacatagttcctcctcaga

SEQ ID NO: 145693 - DNA, 37 bp, Artificial Sequence
  Synthetic oligonucleotide
gtgagacggatagagtggggtgcggtagggggataga

SEQ ID NO: 145694 - DNA, 37 bp, Artificial Sequence
  Synthetic oligonucleotide
ggagtaggggggaggggggtatgcgagcttgggccga

SEQ ID NO: 145695 - DNA, 37 bp, Artificial Sequence
  Synthetic oligonucleotide
gtcgcccccctcatcttgtctcccccggttgacgcga

SEQ ID NO: 145696 - DNA, 37 bp, Artificial Sequence
  Synthetic oligonucleotide
atgccctccgatatatccccgctccatgacgccgcga

SEQ ID NO: 145697 - DNA, 37 bp, Artificial Sequence
  Synthetic oligonucleotide
gggtcgaaggagtggtgggtacgtggggcagggggga

SEQ ID NO: 145698 - DNA, 37 bp, Artificial Sequence
  Synthetic oligonucleotide
tgctgggggtcgagaagagggagggtgcatttgggga

SEQ ID NO: 145699 - DNA, 38 bp, Artificial Sequence
  Synthetic oligonucleotide
tgcctgctccctttcgtcgtcttccgcgcactgcctga

SEQ ID NO: 145700 - DNA, 38 bp, Artificial Sequence
  Synthetic oligonucleotide
tccgattatcctcggttcgttgttttccgccttcctga

SEQ ID NO: 145701 - DNA, 38 bp, Artificial Sequence
  Synthetic oligonucleotide
atcgccacacgcctatccttacttacatcagttcctga

SEQ ID NO: 145702 - DNA, 35 bp, Artificial Sequence
  Synthetic oligonucleotide
gactgaaataagggtggggaggggcagggtgaata

SEQ ID NO: 145703 - DNA, 36 bp, Artificial Sequence
  Synthetic oligonucleotide
tgatcaggtcactgcctattccatcctcgctgagta

SEQ ID NO: 145704 - DNA, 35 bp, Artificial Sequence
  Synthetic oligonucleotide
gactcaggctaaaacgtttgcgccactcctccgta

SEQ ID NO: 145705 - DNA, 35 bp, Artificial Sequence
  Synthetic oligonucleotide
ttcggtgagaggggccggttagtgggtgggtggta

SEQ ID NO: 145706 - DNA, 35 bp, Artificial Sequence
  Synthetic oligonucleotide
ggaccctgccgaagcccctagatctgctcttctac

SEQ ID NO: 145707 - DNA, 35 bp, Artificial Sequence
  Synthetic oligonucleotide
gggactccgcggccgacctgttcaacgccccgccc

SEQ ID NO: 145708 - DNA, 35 bp, Artificial Sequence
  Synthetic oligonucleotide
gaccgatgcgcttgaatcctggtgtcccatccgcc

SEQ ID NO: 145709 - DNA, 35 bp, Artificial Sequence
  Synthetic oligonucleotide
gcacagacctttactgttcaccccctataggctcc

SEQ ID NO: 145710 - DNA, 35 bp, Artificial Sequence
  Synthetic oligonucleotide
gatcccacctgtcccgcttcgacgtgctaaattcc

SEQ ID NO: 145711 - DNA, 35 bp, Artificial Sequence
  Synthetic oligonucleotide
tgtggagagtgggggggagggttcttggtcacagc

SEQ ID NO: 145712 - DNA, 35 bp, Artificial Sequence
  Synthetic oligonucleotide
tttgacgtcaacacgcaacacctgtcccttctagc

SEQ ID NO: 145713 - DNA, 35 bp, Artificial Sequence
  Synthetic oligonucleotide
tccagtccccggtgtcccgttccattgtcacatgc

SEQ ID NO: 145714 - DNA, 35 bp, Artificial Sequence
  Synthetic oligonucleotide
gtcagactaccgagcgtctcccggatccatcttgc

SEQ ID NO: 145715 - DNA, 35 bp, Artificial Sequence
  Synthetic oligonucleotide
tccatcagggcaggtcggtacttcacccatcaatc

SEQ ID NO: 145716 - DNA, 35 bp, Artificial Sequence
  Synthetic oligonucleotide
tgtccctccgatttccagcatgggcccgtttactc

SEQ ID NO: 145717 - DNA, 35 bp, Artificial Sequence
  Synthetic oligonucleotide
accctactccaccaactgctccgcctgacatagtc

SEQ ID NO: 145718 - DNA, 35 bp, Artificial Sequence
  Synthetic oligonucleotide
tgactttgtctcgcccctgtacgtcctcctcggtc

SEQ ID NO: 145719 - DNA, 35 bp, Artificial Sequence
  Synthetic oligonucleotide
gtcccacgtcctcttgggcccatttacacctgttc

SEQ ID NO: 145720 - DNA, 34 bp, Artificial Sequence
  Synthetic oligonucleotide
tcctactccaccatctgcgtcccgccttgccccg

SEQ ID NO: 145721 - DNA, 34 bp, Artificial Sequence
  Synthetic oligonucleotide
ttcaccgcctctacgagtactgccacgcctatcg

SEQ ID NO: 145722 - DNA, 35 bp, Artificial Sequence
  Synthetic oligonucleotide
acgaccacctccccacctacaggtcatccatgtcg

SEQ ID NO: 145723 - DNA, 35 bp, Artificial Sequence
  Synthetic oligonucleotide
atctccacctgggattatgttccattcatttttcg

SEQ ID NO: 145724 - DNA, 35 bp, Artificial Sequence
  Synthetic oligonucleotide
gccacacactcgcgatgcctgccctactccacgat

SEQ ID NO: 145725 - DNA, 36 bp, Artificial Sequence
  Synthetic oligonucleotide
gcctcgcgcctagcttatgtaccttccgatccgcca

SEQ ID NO: 145726 - DNA, 36 bp, Artificial Sequence
  Synthetic oligonucleotide
atcccacctcaattagtattcccaacttgcctggca

SEQ ID NO: 145727 - DNA, 37 bp, Artificial Sequence
  Synthetic oligonucleotide
gccggggaggagtagggatgaagggaggattgcaaga

SEQ ID NO: 145728 - DNA, 37 bp, Artificial Sequence
  Synthetic oligonucleotide
tagcatcacccgctctgccatggcatccccctaacga

SEQ ID NO: 145729 - DNA, 36 bp, Artificial Sequence
  Synthetic oligonucleotide
tagggcgggcgaggctctggggggaaaagggggcga

SEQ ID NO: 145730 - DNA, 37 bp, Artificial Sequence
  Synthetic oligonucleotide
tgcgggggagggataacggaggggggaggtaaatcga

SEQ ID NO: 145731 - DNA, 37 bp, Artificial Sequence
  Synthetic oligonucleotide
acaccgttcctcacccctctccgccagtctcaaagga

SEQ ID NO: 145732 - DNA, 37 bp, Artificial Sequence
  Synthetic oligonucleotide
gcatggtggtgaaacgggggaacttacggggaacgga

SEQ ID NO: 145733 - DNA, 36 bp, Artificial Sequence
  Synthetic oligonucleotide
aacccgcctcctctatcgtttgtccaccccttggga

SEQ ID NO: 145734 - DNA, 38 bp, Artificial Sequence
  Synthetic oligonucleotide
acatttgccacctgcttgcctcgaccccggtctactga

SEQ ID NO: 145735 - DNA, 38 bp, Artificial Sequence
  Synthetic oligonucleotide
tccactgctagtgctcgtattgccccacgcccttctga

SEQ ID NO: 145736 - DNA, 38 bp, Artificial Sequence
  Synthetic oligonucleotide
gtgtgccccgcacacgctatgacccttctctttagtga

SEQ ID NO: 145737 - DNA, 38 bp, Artificial Sequence
  Synthetic oligonucleotide
gactagatggaaggtggggggggcgggctacacggtga

SEQ ID NO: 145738 - DNA, 37 bp, Artificial Sequence
  Synthetic oligonucleotide
tcacgcgattcacgtttgccttcaccgccccacttga

SEQ ID NO: 145739 - DNA, 36 bp, Artificial Sequence
  Synthetic oligonucleotide
accgagttgggtgggaagggtaatgggtcgggttga

SEQ ID NO: 145740 - DNA, 35 bp, Artificial Sequence
  Synthetic oligonucleotide
tagccacatgcattcgcgccgcctcgccacttcta

SEQ ID NO: 145741 - DNA, 35 bp, Artificial Sequence
  Synthetic oligonucleotide
tcctccactgccctggacttataaaatcccatcac

SEQ ID NO: 145742 - DNA, 35 bp, Artificial Sequence
  Synthetic oligonucleotide
tagcagatcgccacctcccttgatatgcccgctac

SEQ ID NO: 145743 - DNA, 35 bp, Artificial Sequence
  Synthetic oligonucleotide
gtagccccatgttcttgttgtccgccacctttgcc

SEQ ID NO: 145744 - DNA, 35 bp, Artificial Sequence
  Synthetic oligonucleotide
agacagtccgtccgccgaccgccacattgccatcc

SEQ ID NO: 145745 - DNA, 35 bp, Artificial Sequence
  Synthetic oligonucleotide
tattgtgcgtcgcgccgctgtcctccaattcctcc

SEQ ID NO: 145746 - DNA, 35 bp, Artificial Sequence
  Synthetic oligonucleotide
ccactccactcatgctgcaaatccgtgccactcgc

SEQ ID NO: 145747 - DNA, 35 bp, Artificial Sequence
  Synthetic oligonucleotide
taccccctcatcaatatcgacctgtcacgccgggc

SEQ ID NO: 145748 - DNA, 35 bp, Artificial Sequence
  Synthetic oligonucleotide
gacggaaagcacctcgccccatggacacacacctc

SEQ ID NO: 145749 - DNA, 35 bp, Artificial Sequence
  Synthetic oligonucleotide
tgtgatcagtccatcttacttagccccatcgcctc

SEQ ID NO: 145750 - DNA, 35 bp, Artificial Sequence
  Synthetic oligonucleotide
acctcccgctctccgcctggtcgtaatccccggtc

SEQ ID NO: 145751 - DNA, 33 bp, Artificial Sequence
  Synthetic oligonucleotide
gagtacgctcagtccgcctgctcatccgtcttc

SEQ ID NO: 145752 - DNA, 35 bp, Artificial Sequence
  Synthetic oligonucleotide
gggaacagtgtcccgcccgcctcccttacttcgcg

SEQ ID NO: 145753 - DNA, 35 bp, Artificial Sequence
  Synthetic oligonucleotide
atccaacccgctatgaactaacttctcacacctcg

SEQ ID NO: 145754 - DNA, 35 bp, Artificial Sequence
  Synthetic oligonucleotide
ggttacccccctgccctggtacagcgagcacttcg

SEQ ID NO: 145755 - DNA, 35 bp, Artificial Sequence
  Synthetic oligonucleotide
tttgcgcgtagtcccttcttgatcggcccctttcg

SEQ ID NO: 145756 - DNA, 35 bp, Artificial Sequence
  Synthetic oligonucleotide
ggaacctcccttccgctcccagccgcctcacatgg

SEQ ID NO: 145757 - DNA, 35 bp, Artificial Sequence
  Synthetic oligonucleotide
atgttacccccatgtgacgctccctacgctcccat

SEQ ID NO: 145758 - DNA, 35 bp, Artificial Sequence
  Synthetic oligonucleotide
taacgtagagccctccccaggtaccgccccatgat

SEQ ID NO: 145759 - DNA, 35 bp, Artificial Sequence
  Synthetic oligonucleotide
gttgccggcaccacgcatgacccctgcctgcctat

SEQ ID NO: 145760 - DNA, 35 bp, Artificial Sequence
  Synthetic oligonucleotide
tattacccccctgatgaccttaagccgcgggccct

SEQ ID NO: 145761 - DNA, 35 bp, Artificial Sequence
  Synthetic oligonucleotide
tgctcccccccccgacctttactatagactagcgt

SEQ ID NO: 145762 - DNA, 35 bp, Artificial Sequence
  Synthetic oligonucleotide
aacttcaccctcggctccgatagctaccacttcgt

SEQ ID NO: 145763 - DNA, 35 bp, Artificial Sequence
  Synthetic oligonucleotide
aaagtggctacacaggggcgggggggcggaattgt

SEQ ID NO: 145764 - DNA, 34 bp, Artificial Sequence
  Synthetic oligonucleotide
gcctctcacccgctattcatgaattagattcctt

SEQ ID NO: 145765 - DNA, 35 bp, Artificial Sequence
  Synthetic oligonucleotide
tcgcccgagagggactccgccatgccttataccca

SEQ ID NO: 145766 - DNA, 36 bp, Artificial Sequence
  Synthetic oligonucleotide
tcatcctaggcctctgaccgtcgttccttctaccca

SEQ ID NO: 145767 - DNA, 36 bp, Artificial Sequence
  Synthetic oligonucleotide
actgacaccatcctcccgataagcagtgatcgccca

SEQ ID NO: 145768 - DNA, 36 bp, Artificial Sequence
  Synthetic oligonucleotide
tcctctctaccggctttgttttcgctctctgctcca

SEQ ID NO: 145769 - DNA, 37 bp, Artificial Sequence
  Synthetic oligonucleotide
acaacggggaggtagtgaaagggaggtaagcagaaga

SEQ ID NO: 145770 - DNA, 37 bp, Artificial Sequence
  Synthetic oligonucleotide
gaatacgaggcagagggcgaggagcaaggaagatgga

SEQ ID NO: 145771 - DNA, 37 bp, Artificial Sequence
  Synthetic oligonucleotide
tgtattcccgccgaggccgcccgcccagacctatgga

SEQ ID NO: 145772 - DNA, 37 bp, Artificial Sequence
  Synthetic oligonucleotide
acccccaccctgtacccgcttccagtcgatatcatga

SEQ ID NO: 145773 - DNA, 36 bp, Artificial Sequence
  Synthetic oligonucleotide
agtccacccacctcacgccggtctacccgcttatga

SEQ ID NO: 145774 - DNA, 36 bp, Artificial Sequence
  Synthetic oligonucleotide
tctcgcgcccagtacaccagcctctcgatcccctga

SEQ ID NO: 145775 - DNA, 37 bp, Artificial Sequence
  Synthetic oligonucleotide
tttaccacccgaccatgctaaaatgaactctctctga

SEQ ID NO: 145776 - DNA, 38 bp, Artificial Sequence
  Synthetic oligonucleotide
gtcccacctcgcagttttcacactagtccatcctgtga

SEQ ID NO: 145777 - DNA, 37 bp, Artificial Sequence
  Synthetic oligonucleotide
tcctccgcacctcgcttttggcactcacaacctttga

SEQ ID NO: 145778 - DNA, 35 bp, Artificial Sequence
  Synthetic oligonucleotide
atggggggggacatgaggggaaggcctagagtata

SEQ ID NO: 145779 - DNA, 36 bp, Artificial Sequence
  Synthetic oligonucleotide
tgcaccgcagatctccaggccatttcccccctgcta

SEQ ID NO: 145780 - DNA, 36 bp, Artificial Sequence
  Synthetic oligonucleotide
gcttacatccctgagttatccgcctctaccctgtta

SEQ ID NO: 145781 - DNA, 35 bp, Artificial Sequence
  Synthetic oligonucleotide
gtcacgcgatttatgcttctcgcaccccggcccac

SEQ ID NO: 145782 - DNA, 35 bp, Artificial Sequence
  Synthetic oligonucleotide
gagcgcattccatgcgtgcatgtccacccccgtac

SEQ ID NO: 145783 - DNA, 35 bp, Artificial Sequence
  Synthetic oligonucleotide
ttgcttccactgccttgccttatggtccatacacc

SEQ ID NO: 145784 - DNA, 35 bp, Artificial Sequence
  Synthetic oligonucleotide
gtgcaaaccgccgcgtgcgcattccgatttctccc

SEQ ID NO: 145785 - DNA, 35 bp, Artificial Sequence
  Synthetic oligonucleotide
tggaatgcacattggtgcggcaccccccgtttccc

SEQ ID NO: 145786 - DNA, 35 bp, Artificial Sequence
  Synthetic oligonucleotide
taggtgtcgtgactgttcttgttcctccgtctctc

SEQ ID NO: 145787 - DNA, 35 bp, Artificial Sequence
  Synthetic oligonucleotide
ttcgtcgcacagacctcctttccttggcaaccttc

SEQ ID NO: 145788 - DNA, 35 bp, Artificial Sequence
  Synthetic oligonucleotide
ggggaaggtgaggtgggcggagagggggctttttc

SEQ ID NO: 145789 - DNA, 35 bp, Artificial Sequence
  Synthetic oligonucleotide
gggggaagaaaagagggcggaggtagcgcgcgaag

SEQ ID NO: 145790 - DNA, 35 bp, Artificial Sequence
  Synthetic oligonucleotide
tgcaccacctgcagccatttgttttgcgttgcccg

SEQ ID NO: 145791 - DNA, 35 bp, Artificial Sequence
  Synthetic oligonucleotide
acattcccccccggccacttgtcacgtgtgcctcg

SEQ ID NO: 145792 - DNA, 35 bp, Artificial Sequence
  Synthetic oligonucleotide
gttctctgcccgcactgaccccccccctttctctg

SEQ ID NO: 145793 - DNA, 35 bp, Artificial Sequence
  Synthetic oligonucleotide
gccggactcagcggttttttcccggctcctttctg

SEQ ID NO: 145794 - DNA, 35 bp, Artificial Sequence
  Synthetic oligonucleotide
gtagaccaccccttcgccccactttgacgtgtact

SEQ ID NO: 145795 - DNA, 35 bp, Artificial Sequence
  Synthetic oligonucleotide
agttgtgccgccgcaatctccctgtcgtagtccct

SEQ ID NO: 145796 - DNA, 35 bp, Artificial Sequence
  Synthetic oligonucleotide
tatccagatacactcccagccatgcgctccccgct

SEQ ID NO: 145797 - DNA, 35 bp, Artificial Sequence
  Synthetic oligonucleotide
atgcccccactcgagagtaactccgctgctctgct

SEQ ID NO: 145798 - DNA, 35 bp, Artificial Sequence
  Synthetic oligonucleotide
gcacactggttgggggtagggcgtagggagggagt

SEQ ID NO: 145799 - DNA, 35 bp, Artificial Sequence
  Synthetic oligonucleotide
ttaccgcacctcgaaccctttctatctcgctctgt

SEQ ID NO: 145800 - DNA, 35 bp, Artificial Sequence
  Synthetic oligonucleotide
acgtcccccaaccgactgggcctccccgacaccaa

SEQ ID NO: 145801 - DNA, 36 bp, Artificial Sequence
  Synthetic oligonucleotide
gtagcatgggatcagggggggtcggggatatgttaa

SEQ ID NO: 145802 - DNA, 35 bp, Artificial Sequence
  Synthetic oligonucleotide
tgataggctccatccctctctgtttttcgtgttaa

SEQ ID NO: 145803 - DNA, 36 bp, Artificial Sequence
  Synthetic oligonucleotide
gtcgcccgctctcctatgataacccgcccgcataca

SEQ ID NO: 145804 - DNA, 36 bp, Artificial Sequence
  Synthetic oligonucleotide
aaccagccctcgcaagccacctgtcactatcttcca

SEQ ID NO: 145805 - DNA, 37 bp, Artificial Sequence
  Synthetic oligonucleotide
acgaggcggagcaatacgataggggaagggcaacaga

SEQ ID NO: 145806 - DNA, 37 bp, Artificial Sequence
  Synthetic oligonucleotide
accacatcacgttcactcctcgttatagccttcccga

SEQ ID NO: 145807 - DNA, 37 bp, Artificial Sequence
  Synthetic oligonucleotide
tgcacctaatgccatccgccaggcgcccctctctcga

SEQ ID NO: 145808 - DNA, 37 bp, Artificial Sequence
  Synthetic oligonucleotide
tcgacccgcccatttcctcgtatctcacccttacgga

SEQ ID NO: 145809 - DNA, 37 bp, Artificial Sequence
  Synthetic oligonucleotide
gaccaagtgaaggactgggcaggatagggaaggggga

SEQ ID NO: 145810 - DNA, 36 bp, Artificial Sequence
  Synthetic oligonucleotide
agtgggagggtgtatccgcaattacggggagctgga

SEQ ID NO: 145811 - DNA, 38 bp, Artificial Sequence
  Synthetic oligonucleotide
atggtcggtccgtgctctctccgcgccccttcctctga

SEQ ID NO: 145812 - DNA, 38 bp, Artificial Sequence
  Synthetic oligonucleotide
gccgcctccccgttcattagattacttccccggcgtga

SEQ ID NO: 145813 - DNA, 38 bp, Artificial Sequence
  Synthetic oligonucleotide
gccccgccccgtgtaatcgtaactacccttccttttga

SEQ ID NO: 145814 - DNA, 36 bp, Artificial Sequence
  Synthetic oligonucleotide
tccgccctccccaagatccgtcaactaagccatata

SEQ ID NO: 145815 - DNA, 36 bp, Artificial Sequence
  Synthetic oligonucleotide
tgtacgtcaatcactggtcccttccctttgccccta

SEQ ID NO: 145816 - DNA, 36 bp, Artificial Sequence
  Synthetic oligonucleotide
tctcgcgtgccccctgttcacattgtttttccccta

SEQ ID NO: 145817 - DNA, 36 bp, Artificial Sequence
  Synthetic oligonucleotide
tcacctgcggctatagtacatcccctccacccgcta

SEQ ID NO: 145818 - DNA, 36 bp, Artificial Sequence
  Synthetic oligonucleotide
aactcgcccccctgttggtattctgctcattcatta

SEQ ID NO: 145819 - DNA, 35 bp, Artificial Sequence
  Synthetic oligonucleotide
gaggtccgtccgtcctgctcctttcattttcgtta

SEQ ID NO: 145820 - DNA, 35 bp, Artificial Sequence
  Synthetic oligonucleotide
gagagggtgggagggtactcattgatccgggggac

SEQ ID NO: 145821 - DNA, 35 bp, Artificial Sequence
  Synthetic oligonucleotide
taaccgacgcctcctctgccgggatttgactgtac

SEQ ID NO: 145822 - DNA, 35 bp, Artificial Sequence
  Synthetic oligonucleotide
gcgctctgcactctttcctccggtggttcgtaacc

SEQ ID NO: 145823 - DNA, 35 bp, Artificial Sequence
  Synthetic oligonucleotide
gccaccgtgcccgccccatcgaggcctcccacacc

SEQ ID NO: 145824 - DNA, 35 bp, Artificial Sequence
  Synthetic oligonucleotide
acatctccgcccatgtactttgctgaatccctgcc

SEQ ID NO: 145825 - DNA, 35 bp, Artificial Sequence
  Synthetic oligonucleotide
tgtagagtgctcccctttcctgcgatcccggctcc

SEQ ID NO: 145826 - DNA, 35 bp, Artificial Sequence
  Synthetic oligonucleotide
ttccgacccccctgccctgtgatcaatttgtttcc

SEQ ID NO: 145827 - DNA, 35 bp, Artificial Sequence
  Synthetic oligonucleotide
gtgcccccctctgctgaacctggacacacctcagc

SEQ ID NO: 145828 - DNA, 35 bp, Artificial Sequence
  Synthetic oligonucleotide
tgagtcgcatgtcgcatcactgtacttcaccccgc

SEQ ID NO: 145829 - DNA, 35 bp, Artificial Sequence
  Synthetic oligonucleotide
tgcaccctgtcgctctcctcgccatttcatgaggc

SEQ ID NO: 145830 - DNA, 35 bp, Artificial Sequence
  Synthetic oligonucleotide
ttcgcggtccccctgtttgccttttatttctatgc

SEQ ID NO: 145831 - DNA, 35 bp, Artificial Sequence
  Synthetic oligonucleotide
tccgccacatttccgtttcatctttcgggtctatc

SEQ ID NO: 145832 - DNA, 35 bp, Artificial Sequence
  Synthetic oligonucleotide
tcacatgcactctcgcacatcctgaagatcacctc

SEQ ID NO: 145833 - DNA, 35 bp, Artificial Sequence
  Synthetic oligonucleotide
gctcgtggcgcacatggcctttcacactctcgctc

SEQ ID NO: 145834 - DNA, 32 bp, Artificial Sequence
  Synthetic oligonucleotide
gtgatgccttcgttccagtacaccacattctc

SEQ ID NO: 145835 - DNA, 35 bp, Artificial Sequence
  Synthetic oligonucleotide
tgctgtcccaccgcagtgactattcccgtctttcg

SEQ ID NO: 145836 - DNA, 35 bp, Artificial Sequence
  Synthetic oligonucleotide
gtataacgtgagagggaaaaggaagggaattgcgg

SEQ ID NO: 145837 - DNA, 35 bp, Artificial Sequence
  Synthetic oligonucleotide
gtttcgggaggggtcgataggggcacgacttgggg

SEQ ID NO: 145838 - DNA, 35 bp, Artificial Sequence
  Synthetic oligonucleotide
tctcacccaccgcccattgattccattgatacgtg

SEQ ID NO: 145839 - DNA, 35 bp, Artificial Sequence
  Synthetic oligonucleotide
tttccaccatccggctttggtccactttcaggcct

SEQ ID NO: 145840 - DNA, 35 bp, Artificial Sequence
  Synthetic oligonucleotide
ttgccgaaaccctcctgatcttgcgctcttgtcct

SEQ ID NO: 145841 - DNA, 35 bp, Artificial Sequence
  Synthetic oligonucleotide
tctaacagcatgtgctcagtcccgccgatcctgct

SEQ ID NO: 145842 - DNA, 35 bp, Artificial Sequence
  Synthetic oligonucleotide
tagccccgcccacatgtagatcctggttatttgct

SEQ ID NO: 145843 - DNA, 35 bp, Artificial Sequence
  Synthetic oligonucleotide
acgctcaccccgctgaaccgagtattctgcactct

SEQ ID NO: 145844 - DNA, 35 bp, Artificial Sequence
  Synthetic oligonucleotide
tcaccatgcgcctcgacgcaatccgaaactcttct

SEQ ID NO: 145845 - DNA, 35 bp, Artificial Sequence
  Synthetic oligonucleotide
tgacgcgccgtagctccccccgccccgtgagttct

SEQ ID NO: 145846 - DNA, 35 bp, Artificial Sequence
  Synthetic oligonucleotide
accagtggggttgggggcgtgggaaggcactggtt

SEQ ID NO: 145847 - DNA, 36 bp, Artificial Sequence
  Synthetic oligonucleotide
tctggcgctctgccagccccaccctcacggcccgca

SEQ ID NO: 145848 - DNA, 36 bp, Artificial Sequence
  Synthetic oligonucleotide
gactcctggccccatcgttgaagaatcctccttgca

SEQ ID NO: 145849 - DNA, 36 bp, Artificial Sequence
  Synthetic oligonucleotide
gccgttgcctcctccacatgttggcccgcgacctca

SEQ ID NO: 145850 - DNA, 36 bp, Artificial Sequence
  Synthetic oligonucleotide
ttggcactgttacctcgtactactctgcccgtttca

SEQ ID NO: 145851 - DNA, 36 bp, Artificial Sequence
  Synthetic oligonucleotide
ttcgcatcctcatgttcccactatccgccaccgaga

SEQ ID NO: 145852 - DNA, 37 bp, Artificial Sequence
  Synthetic oligonucleotide
gtccgcactgcatcacctatactgcgccccatcacga

SEQ ID NO: 145853 - DNA, 36 bp, Artificial Sequence
  Synthetic oligonucleotide
aaacagacgccggactgctcctcccgtttttcgcga

SEQ ID NO: 145854 - DNA, 36 bp, Artificial Sequence
  Synthetic oligonucleotide
tatgccgtctgccccccccagagtttcttcctgcga

SEQ ID NO: 145855 - DNA, 35 bp, Artificial Sequence
  Synthetic oligonucleotide
gcccacaccccactatggtccggaccccatgagga

SEQ ID NO: 145856 - DNA, 37 bp, Artificial Sequence
  Synthetic oligonucleotide
accacgcccgaagggatagggcgggccgagggaggga

SEQ ID NO: 145857 - DNA, 37 bp, Artificial Sequence
  Synthetic oligonucleotide
aacaccctcgccataccgtaccttatcccacctggga

SEQ ID NO: 145858 - DNA, 38 bp, Artificial Sequence
  Synthetic oligonucleotide
tccagccagttcccttgccgtgccacgcccttctatga

SEQ ID NO: 145859 - DNA, 37 bp, Artificial Sequence
  Synthetic oligonucleotide
agtgggtgggagggtttgggttgagagcttcacctga

SEQ ID NO: 145860 - DNA, 38 bp, Artificial Sequence
  Synthetic oligonucleotide
gcgatgacgatcgcgccttttcttcgcccatcccctga

SEQ ID NO: 145861 - DNA, 37 bp, Artificial Sequence
  Synthetic oligonucleotide
tcccaccgcatctggcttcctcggtcaccatccctga

SEQ ID NO: 145862 - DNA, 36 bp, Artificial Sequence
  Synthetic oligonucleotide
gttgcccactacgcctccccttgtcatgggacttga

SEQ ID NO: 145863 - DNA, 38 bp, Artificial Sequence
  Synthetic oligonucleotide
gaccacccccaatgaccccctgtagtcgcaatacttga

SEQ ID NO: 145864 - DNA, 38 bp, Artificial Sequence
  Synthetic oligonucleotide
tcacacacgcctcctttccgtaaagtaccgttccttga

SEQ ID NO: 145865 - DNA, 35 bp, Artificial Sequence
  Synthetic oligonucleotide
gagcaggagcggtgggtgggagggcggaccatata

SEQ ID NO: 145866 - DNA, 36 bp, Artificial Sequence
  Synthetic oligonucleotide
tgacccccgtggttgcgctggtaccgctctctccta

SEQ ID NO: 145867 - DNA, 35 bp, Artificial Sequence
  Synthetic oligonucleotide
tagcagtgcgacatagctccatcccccgtccctta

SEQ ID NO: 145868 - DNA, 36 bp, Artificial Sequence
  Synthetic oligonucleotide
gtgcgtcgcccggttggtcatttcacttccctttta

SEQ ID NO: 145869 - DNA, 35 bp, Artificial Sequence
  Synthetic oligonucleotide
tcactgctacacagtgcaaactccccttataacac

SEQ ID NO: 145870 - DNA, 35 bp, Artificial Sequence
  Synthetic oligonucleotide
ggtcacgcaacagcacgttaccacttttcctccac

SEQ ID NO: 145871 - DNA, 35 bp, Artificial Sequence
  Synthetic oligonucleotide
aaacaccgcgggtttcttccacctgtctatctcac

SEQ ID NO: 145872 - DNA, 35 bp, Artificial Sequence
  Synthetic oligonucleotide
tgcggataccatcaccattgttagccccacattac

SEQ ID NO: 145873 - DNA, 36 bp, Artificial Sequence
  Synthetic oligonucleotide
tcaacgactgcaccccgacgtgaccttccgctgacc

SEQ ID NO: 145874 - DNA, 35 bp, Artificial Sequence
  Synthetic oligonucleotide
tcatccagcacagcatcggcccgagcacgcacccc

SEQ ID NO: 145875 - DNA, 35 bp, Artificial Sequence
  Synthetic oligonucleotide
acccccgcaatccctttcagttactatacgtgccc

SEQ ID NO: 145876 - DNA, 35 bp, Artificial Sequence
  Synthetic oligonucleotide
gtcccatccgttccatcccgcttaagttcagtccc

SEQ ID NO: 145877 - DNA, 35 bp, Artificial Sequence
  Synthetic oligonucleotide
gtggctatcacgcaatgttccattatctgccttcc

SEQ ID NO: 145878 - DNA, 35 bp, Artificial Sequence
  Synthetic oligonucleotide
gagcgggagggaacggggtaagcggtgtgcagggc

SEQ ID NO: 145879 - DNA, 35 bp, Artificial Sequence
  Synthetic oligonucleotide
gttggatgtttcgtcctcctgttgttacgtccctc

SEQ ID NO: 145880 - DNA, 35 bp, Artificial Sequence
  Synthetic oligonucleotide
gctccccaacaccgctgcctgacccgacggcattc

SEQ ID NO: 145881 - DNA, 35 bp, Artificial Sequence
  Synthetic oligonucleotide
tgcgtgatatccaccccctgcttctgtgcacgttc

SEQ ID NO: 145882 - DNA, 35 bp, Artificial Sequence
  Synthetic oligonucleotide
aaccattacggtctgtcccgtcacacccgccgttc

SEQ ID NO: 145883 - DNA, 35 bp, Artificial Sequence
  Synthetic oligonucleotide
acgcgtctctcacgtactacctgcctcacttcacg

SEQ ID NO: 145884 - DNA, 35 bp, Artificial Sequence
  Synthetic oligonucleotide
gtggagtcagaggtcggccctttacttcctcctcg

SEQ ID NO: 145885 - DNA, 35 bp, Artificial Sequence
  Synthetic oligonucleotide
atcgcctctgccactatattatcaacttttgcctg

SEQ ID NO: 145886 - DNA, 35 bp, Artificial Sequence
  Synthetic oligonucleotide
tgtgctatcgctccgttttctttccgcccccagtg

SEQ ID NO: 145887 - DNA, 35 bp, Artificial Sequence
  Synthetic oligonucleotide
gcctctccacccggtcatatcaccatcattaattg

SEQ ID NO: 145888 - DNA, 35 bp, Artificial Sequence
  Synthetic oligonucleotide
ccgactcatacgcggtacccactggtcaaacccct

SEQ ID NO: 145889 - DNA, 35 bp, Artificial Sequence
  Synthetic oligonucleotide
atatcaacaccgccgccgccactgctccccaagct

SEQ ID NO: 145890 - DNA, 35 bp, Artificial Sequence
  Synthetic oligonucleotide
ttgacgccatccaccgttgaagccccgtacattct

SEQ ID NO: 145891 - DNA, 35 bp, Artificial Sequence
  Synthetic oligonucleotide
ttccagcctcattcgttgccccgcttattacctgt

SEQ ID NO: 145892 - DNA, 35 bp, Artificial Sequence
  Synthetic oligonucleotide
gccacttcctcctactactgcgaccgcactgcatt

SEQ ID NO: 145893 - DNA, 36 bp, Artificial Sequence
  Synthetic oligonucleotide
tacattgtgtagggggagcaggggagagagacgaaa

SEQ ID NO: 145894 - DNA, 36 bp, Artificial Sequence
  Synthetic oligonucleotide
gacgccgcgacccgtcgccctgcctccatctccgaa

SEQ ID NO: 145895 - DNA, 36 bp, Artificial Sequence
  Synthetic oligonucleotide
ttccacccgctttcactcacgattcgtctgttcaca

SEQ ID NO: 145896 - DNA, 36 bp, Artificial Sequence
  Synthetic oligonucleotide
gttgccatcccaccccatctagtctcaggttcacca

SEQ ID NO: 145897 - DNA, 35 bp, Artificial Sequence
  Synthetic oligonucleotide
tacccaccctcgcccagcccgtaggcatgcatcca

SEQ ID NO: 145898 - DNA, 36 bp, Artificial Sequence
  Synthetic oligonucleotide
atgacccctccaatgtaccgcgcctacaacatagca

SEQ ID NO: 145899 - DNA, 35 bp, Artificial Sequence
  Synthetic oligonucleotide
atagctcccccccggccggcggtccctgtcccgca

SEQ ID NO: 145900 - DNA, 36 bp, Artificial Sequence
  Synthetic oligonucleotide
gatgcacaacgtgccccgttttttagccccgattca

SEQ ID NO: 145901 - DNA, 35 bp, Artificial Sequence
  Synthetic oligonucleotide
gcccgtatcttgtatcgcacgccccccccctgaga

SEQ ID NO: 145902 - DNA, 37 bp, Artificial Sequence
  Synthetic oligonucleotide
cagggggggagggagggtgatgcactgctgaaaacga

SEQ ID NO: 145903 - DNA, 37 bp, Artificial Sequence
  Synthetic oligonucleotide
gtgctccacgcctgatctgccccatttgcgtcaacga

SEQ ID NO: 145904 - DNA, 37 bp, Artificial Sequence
  Synthetic oligonucleotide
acgtccctacgaccgactccctcccaccctcagtgga

SEQ ID NO: 145905 - DNA, 37 bp, Artificial Sequence
  Synthetic oligonucleotide
tcacacctcctggtggtttgttccatcatttcttgga

SEQ ID NO: 145906 - DNA, 37 bp, Artificial Sequence
  Synthetic oligonucleotide
tacgacgcctacccatgattctgcactctttcgctga

SEQ ID NO: 145907 - DNA, 36 bp, Artificial Sequence
  Synthetic oligonucleotide
aacgcctccgaccccgcaccgcacaggcccctgtga

SEQ ID NO: 145908 - DNA, 37 bp, Artificial Sequence
  Synthetic oligonucleotide
gcctcgcatccttctgttcggttttccaccttcttga

SEQ ID NO: 145909 - DNA, 36 bp, Artificial Sequence
  Synthetic oligonucleotide
atgggagggttgggagggtaaattcagagtttcgta

SEQ ID NO: 145910 - DNA, 36 bp, Artificial Sequence
  Synthetic oligonucleotide
taaccgagggaggggggcaagaacattgggtaggta

SEQ ID NO: 145911 - DNA, 36 bp, Artificial Sequence
  Synthetic oligonucleotide
gcccccctccctgagccgttctattccggacgatta

SEQ ID NO: 145912 - DNA, 35 bp, Artificial Sequence
  Synthetic oligonucleotide
actcttgtacgcacatgctcgccttcttccgccac

SEQ ID NO: 145913 - DNA, 35 bp, Artificial Sequence
  Synthetic oligonucleotide
tttgaccaccttcacatcgtcttagcgcaaatacc

SEQ ID NO: 145914 - DNA, 35 bp, Artificial Sequence
  Synthetic oligonucleotide
atcaaccgcgagtacatttagcccgcagtccaccc

SEQ ID NO: 145915 - DNA, 35 bp, Artificial Sequence
  Synthetic oligonucleotide
tacgatgacacaggttatcggacctgtcccacccc

SEQ ID NO: 145916 - DNA, 35 bp, Artificial Sequence
  Synthetic oligonucleotide
acaccctgcctccgatccgcaaattagctccgccc

SEQ ID NO: 145917 - DNA, 35 bp, Artificial Sequence
  Synthetic oligonucleotide
gatatcccggtcgcgcgttccccgttttcttgccc

SEQ ID NO: 145918 - DNA, 34 bp, Artificial Sequence
  Synthetic oligonucleotide
gacccgcttcgatctattgcactgtggctctccc

SEQ ID NO: 145919 - DNA, 35 bp, Artificial Sequence
  Synthetic oligonucleotide
gtcgctcacgggtttgcgaacctcaccctcctgcc

SEQ ID NO: 145920 - DNA, 35 bp, Artificial Sequence
  Synthetic oligonucleotide
gttgcaccttaggacctgtctctcttctaacatcc

SEQ ID NO: 145921 - DNA, 35 bp, Artificial Sequence
  Synthetic oligonucleotide
tgtccaccctcgtgcgttatagactactgctgtcc

SEQ ID NO: 145922 - DNA, 35 bp, Artificial Sequence
  Synthetic oligonucleotide
gtcataccgctgccatgccacttgatttccttcgc

SEQ ID NO: 145923 - DNA, 35 bp, Artificial Sequence
  Synthetic oligonucleotide
tgccaccccgtctcatagcctacccgccccctggc

SEQ ID NO: 145924 - DNA, 35 bp, Artificial Sequence
  Synthetic oligonucleotide
gtcgcattttccacacagctatgtctttctacctc

SEQ ID NO: 145925 - DNA, 35 bp, Artificial Sequence
  Synthetic oligonucleotide
atcaccaccattcagcgcgttaacctccgaccctc

SEQ ID NO: 145926 - DNA, 35 bp, Artificial Sequence
  Synthetic oligonucleotide
ataccgcatttcccgcgcctggtcactgccccctc

SEQ ID NO: 145927 - DNA, 35 bp, Artificial Sequence
  Synthetic oligonucleotide
gactttgcccctttcgtatatatcctccacgggtc

SEQ ID NO: 145928 - DNA, 35 bp, Artificial Sequence
  Synthetic oligonucleotide
tcgcatgttacatcccctcgcttagtgttcctgtc

SEQ ID NO: 145929 - DNA, 35 bp, Artificial Sequence
  Synthetic oligonucleotide
tcctttgcactcactccgtgtcgcctgcccttttc

SEQ ID NO: 145930 - DNA, 35 bp, Artificial Sequence
  Synthetic oligonucleotide
gcccccgctcgttcgtgacccttctgcccttaaag

SEQ ID NO: 145931 - DNA, 35 bp, Artificial Sequence
  Synthetic oligonucleotide
ataacgtgggaggtcgggagggtggagcagggatg

SEQ ID NO: 145932 - DNA, 35 bp, Artificial Sequence
  Synthetic oligonucleotide
tgagtatcccccccgtctgccttctattattcctg

SEQ ID NO: 145933 - DNA, 35 bp, Artificial Sequence
  Synthetic oligonucleotide
tgcaacctacactgcgatcatctattctgttcctg

SEQ ID NO: 145934 - DNA, 35 bp, Artificial Sequence
  Synthetic oligonucleotide
gacgcggccatcacttcttgttttaccaacctctg

SEQ ID NO: 145935 - DNA, 35 bp, Artificial Sequence
  Synthetic oligonucleotide
tctacccgccatgatctggcctcctcttattcttg

SEQ ID NO: 145936 - DNA, 35 bp, Artificial Sequence
  Synthetic oligonucleotide
aggacaacctagattacgcccacccgacccgcgct

SEQ ID NO: 145937 - DNA, 35 bp, Artificial Sequence
  Synthetic oligonucleotide
aagacacagcccgtgtcccacccccgttgccatct

SEQ ID NO: 145938 - DNA, 35 bp, Artificial Sequence
  Synthetic oligonucleotide
gaacagccaaccgtgctacccgccgccctcgttct

SEQ ID NO: 145939 - DNA, 35 bp, Artificial Sequence
  Synthetic oligonucleotide
gtccgctggagtctctgtccctctcttctcgccgt

SEQ ID NO: 145940 - DNA, 36 bp, Artificial Sequence
  Synthetic oligonucleotide
taccccgccctccgttgacgatctcgcattataaaa

SEQ ID NO: 145941 - DNA, 35 bp, Artificial Sequence
  Synthetic oligonucleotide
ggggaagataggggtggaccgggaagagatgacaa

SEQ ID NO: 145942 - DNA, 34 bp, Artificial Sequence
  Synthetic oligonucleotide
gatggggaggggtagggtagacgccgatgaagaa

SEQ ID NO: 145943 - DNA, 36 bp, Artificial Sequence
  Synthetic oligonucleotide
aaggaggccgggtgataggggggcggcaatagggaa

SEQ ID NO: 145944 - DNA, 36 bp, Artificial Sequence
  Synthetic oligonucleotide
gagatgggaggggtgggcaaagaagagctgagcaca

SEQ ID NO: 145945 - DNA, 36 bp, Artificial Sequence
  Synthetic oligonucleotide
ttagcccgccacccccgctaacacctcttagatgca

SEQ ID NO: 145946 - DNA, 37 bp, Artificial Sequence
  Synthetic oligonucleotide
gaaggacggcttaagagaaggggggataggaggaaga

SEQ ID NO: 145947 - DNA, 35 bp, Artificial Sequence
  Synthetic oligonucleotide
agggcccccccgctcccctcgactccgagactaga

SEQ ID NO: 145948 - DNA, 36 bp, Artificial Sequence
  Synthetic oligonucleotide
tgatgagcgctgccctcgtccttcctccctgctaga

SEQ ID NO: 145949 - DNA, 36 bp, Artificial Sequence
  Synthetic oligonucleotide
actccgcagcccgaattttctgttcgcccccctcga

SEQ ID NO: 145950 - DNA, 37 bp, Artificial Sequence
  Synthetic oligonucleotide
atgcctgtcgagatgtcgcttagccctccgccctcga

SEQ ID NO: 145951 - DNA, 37 bp, Artificial Sequence
  Synthetic oligonucleotide
atggtgggatagagggatatcatgggaagggggagga

SEQ ID NO: 145952 - DNA, 37 bp, Artificial Sequence
  Synthetic oligonucleotide
gggtggtggtgggcggagaaagagagtaaggcaggga

SEQ ID NO: 145953 - DNA, 37 bp, Artificial Sequence
  Synthetic oligonucleotide
acaacgggcggggttgtgttttgttggggagagggga

SEQ ID NO: 145954 - DNA, 36 bp, Artificial Sequence
  Synthetic oligonucleotide
tggggggagtaagtttgggtgggaagatgtcgggga

SEQ ID NO: 145955 - DNA, 38 bp, Artificial Sequence
  Synthetic oligonucleotide
gagaaccggagtcggataggaggaaagggatgatggga

SEQ ID NO: 145956 - DNA, 37 bp, Artificial Sequence
  Synthetic oligonucleotide
aagtctcgggggggggaggggagggcacaatctggga

SEQ ID NO: 145957 - DNA, 38 bp, Artificial Sequence
  Synthetic oligonucleotide
tccacgtcctgcggttgtccgttccgccactctcatga

SEQ ID NO: 145958 - DNA, 37 bp, Artificial Sequence
  Synthetic oligonucleotide
gatgggagccgggtgaggagggctgattgccagatga

SEQ ID NO: 145959 - DNA, 38 bp, Artificial Sequence
  Synthetic oligonucleotide
gctgtggccggccgccctcatgttcctccctagtctga

SEQ ID NO: 145960 - DNA, 37 bp, Artificial Sequence
  Synthetic oligonucleotide
tcccaccagtctctatctcgtttgcccccagtcgtga

SEQ ID NO: 145961 - DNA, 38 bp, Artificial Sequence
  Synthetic oligonucleotide
gacccccccactaggtacagcctgacccttcccggtga

SEQ ID NO: 145962 - DNA, 38 bp, Artificial Sequence
  Synthetic oligonucleotide
gctgcatgctgggagggaggcgacggggggggcggtga

SEQ ID NO: 145963 - DNA, 35 bp, Artificial Sequence
  Synthetic oligonucleotide
gatcccactctgcccagcgtctcctaatctgccac

SEQ ID NO: 145964 - DNA, 35 bp, Artificial Sequence
  Synthetic oligonucleotide
gacttgctcgcctaattgctacccgccatgatcac

SEQ ID NO: 145965 - DNA, 35 bp, Artificial Sequence
  Synthetic oligonucleotide
tccctccatcaccatgaccgttaagtataggtcac

SEQ ID NO: 145966 - DNA, 35 bp, Artificial Sequence
  Synthetic oligonucleotide
tgaccctcgcctgaactcccgttagttttccatac

SEQ ID NO: 145967 - DNA, 35 bp, Artificial Sequence
  Synthetic oligonucleotide
tacatacgcctggtttcctaaatgcccccgctccc

SEQ ID NO: 145968 - DNA, 35 bp, Artificial Sequence
  Synthetic oligonucleotide
tcccaacatcctgtccgcaataagccactacctcc

SEQ ID NO: 145969 - DNA, 35 bp, Artificial Sequence
  Synthetic oligonucleotide
gccaatccccggacgctccccctgcgtctcgctcc

SEQ ID NO: 145970 - DNA, 35 bp, Artificial Sequence
  Synthetic oligonucleotide
gctacgtcgcccagctgcacgaccccgttttactc

SEQ ID NO: 145971 - DNA, 35 bp, Artificial Sequence
  Synthetic oligonucleotide
ggtacgcactcgagtaaatcatgtccgccgccctc

SEQ ID NO: 145972 - DNA, 35 bp, Artificial Sequence
  Synthetic oligonucleotide
gcgactctcgcgcatcgtatgtctcgttcctcctc

SEQ ID NO: 145973 - DNA, 35 bp, Artificial Sequence
  Synthetic oligonucleotide
tactccctgcacgccccgggtttcccgcttacccg

SEQ ID NO: 145974 - DNA, 35 bp, Artificial Sequence
  Synthetic oligonucleotide
ttcggtcacaccactacgctgcccacctccgcccg

SEQ ID NO: 145975 - DNA, 35 bp, Artificial Sequence
  Synthetic oligonucleotide
tctgtgtacccccatcgccccacttcgttgccgcg

SEQ ID NO: 145976 - DNA, 35 bp, Artificial Sequence
  Synthetic oligonucleotide
agttgcaggcccacagtcccattcccccttgctcg

SEQ ID NO: 145977 - DNA, 35 bp, Artificial Sequence
  Synthetic oligonucleotide
gaaccgatagggggggggatgacggctccagaggg

SEQ ID NO: 145978 - DNA, 35 bp, Artificial Sequence
  Synthetic oligonucleotide
gcattgcctgtctacctcttcgtcctgtcccactg

SEQ ID NO: 145979 - DNA, 35 bp, Artificial Sequence
  Synthetic oligonucleotide
ggacactctggacgcgtaacctacctacatgccct

SEQ ID NO: 145980 - DNA, 35 bp, Artificial Sequence
  Synthetic oligonucleotide
gaaaggcacgcacactacctcgattcgcgcactct

SEQ ID NO: 145981 - DNA, 35 bp, Artificial Sequence
  Synthetic oligonucleotide
ggtccgatcgccacactgtctgtcctctctggatt

SEQ ID NO: 145982 - DNA, 35 bp, Artificial Sequence
  Synthetic oligonucleotide
tcgtacgttcccccgttcgtattgcattcctcttt

SEQ ID NO: 145983 - DNA, 36 bp, Artificial Sequence
  Synthetic oligonucleotide
aacgcgcctcgggtctacatctctttcgttcacgca

SEQ ID NO: 145984 - DNA, 36 bp, Artificial Sequence
  Synthetic oligonucleotide
tgttctcacctccgactcgccgaactgtctgcaaga

SEQ ID NO: 145985 - DNA, 37 bp, Artificial Sequence
  Synthetic oligonucleotide
tgtgcgggtagagaaggggttggggagtgcgaggaga

SEQ ID NO: 145986 - DNA, 37 bp, Artificial Sequence
  Synthetic oligonucleotide
acgcacgttatgcgttccgtactccgccacacaccga

SEQ ID NO: 145987 - DNA, 36 bp, Artificial Sequence
  Synthetic oligonucleotide
gggtcacgtctcgtttcgctgcgttctctcctccga

SEQ ID NO: 145988 - DNA, 37 bp, Artificial Sequence
  Synthetic oligonucleotide
tgtgccgggggggttgggatgggtgccatatagagga

SEQ ID NO: 145989 - DNA, 37 bp, Artificial Sequence
  Synthetic oligonucleotide
gtcccgtagtggagagggggggcggatatcgggagga

SEQ ID NO: 145990 - DNA, 37 bp, Artificial Sequence
  Synthetic oligonucleotide
gtcctaccgcgcccccatgctcccgacagttacggga

SEQ ID NO: 145991 - DNA, 36 bp, Artificial Sequence
  Synthetic oligonucleotide
attacacccgaatgccccacctcgtcccctagtgga

SEQ ID NO: 145992 - DNA, 35 bp, Artificial Sequence
  Synthetic oligonucleotide
tgctcgccctgccgctttacaacgatcctgactga

SEQ ID NO: 145993 - DNA, 38 bp, Artificial Sequence
  Synthetic oligonucleotide
gttgcgccccgctcatcatttgttccctatagccctga

SEQ ID NO: 145994 - DNA, 37 bp, Artificial Sequence
  Synthetic oligonucleotide
gatcccatgcctctctcgcttatccctcagtccttga

SEQ ID NO: 145995 - DNA, 35 bp, Artificial Sequence
  Synthetic oligonucleotide
acatcacctgtgccctgatttcctgcccgaacgta

SEQ ID NO: 145996 - DNA, 36 bp, Artificial Sequence
  Synthetic oligonucleotide
gagcagttcatcctcgcttatttggtccaccccgta

SEQ ID NO: 145997 - DNA, 36 bp, Artificial Sequence
  Synthetic oligonucleotide
gaacgaaggggggcggagaccggaggcacaggatta

SEQ ID NO: 145998 - DNA, 35 bp, Artificial Sequence
  Synthetic oligonucleotide
agttaccacctgatagttgtcgcctccctattcac

SEQ ID NO: 145999 - DNA, 35 bp, Artificial Sequence
  Synthetic oligonucleotide
gacgtctcccaccacccgctcgcaatgcgttctac

SEQ ID NO: 146000 - DNA, 35 bp, Artificial Sequence
  Synthetic oligonucleotide
tctgatccgctccagggctgcagtgccttttctac

SEQ ID NO: 146001 - DNA, 35 bp, Artificial Sequence
  Synthetic oligonucleotide
agggtgcccggagatctgcccagccgtacccaccc

SEQ ID NO: 146002 - DNA, 35 bp, Artificial Sequence
  Synthetic oligonucleotide
gcgtcggtcatctgccttaggtccgttttcacccc

SEQ ID NO: 146003 - DNA, 35 bp, Artificial Sequence
  Synthetic oligonucleotide
gtgcgcctcaccctcgtcctgtcgaaggaatcgcc

SEQ ID NO: 146004 - DNA, 35 bp, Artificial Sequence
  Synthetic oligonucleotide
tgacgatcctacgcattagctgttacgcccgttcc

SEQ ID NO: 146005 - DNA, 35 bp, Artificial Sequence
  Synthetic oligonucleotide
tgtgttccatcgacccaacccccatgccctcacgc

SEQ ID NO: 146006 - DNA, 35 bp, Artificial Sequence
  Synthetic oligonucleotide
gcaaaccgtcgcagccccgaccatcgcccccttgc

SEQ ID NO: 146007 - DNA, 35 bp, Artificial Sequence
  Synthetic oligonucleotide
gtgttctgcgcacaacgtacgccctgtccaatctc

SEQ ID NO: 146008 - DNA, 35 bp, Artificial Sequence
  Synthetic oligonucleotide
gcttcacccccctcaatcggtcctttgtttgtgtc

SEQ ID NO: 146009 - DNA, 35 bp, Artificial Sequence
  Synthetic oligonucleotide
attgcctccctcccgccgtgtaattcttggaaaag

SEQ ID NO: 146010 - DNA, 35 bp, Artificial Sequence
  Synthetic oligonucleotide
tgaggggggtgggagggctttatatgcggcggacg

SEQ ID NO: 146011 - DNA, 35 bp, Artificial Sequence
  Synthetic oligonucleotide
atctacctgtgtgcgccgccctccatactcatacg

SEQ ID NO: 146012 - DNA, 35 bp, Artificial Sequence
  Synthetic oligonucleotide
tgtcacccctccccacttactggcctcttacggcg

SEQ ID NO: 146013 - DNA, 35 bp, Artificial Sequence
  Synthetic oligonucleotide
agaccgtacggacgtatcacaccgccctctcatcg

SEQ ID NO: 146014 - DNA, 35 bp, Artificial Sequence
  Synthetic oligonucleotide
tccagctcctgctgcctctatcccacattaccatg

SEQ ID NO: 146015 - DNA, 35 bp, Artificial Sequence
  Synthetic oligonucleotide
tccatggccgcctctggaaacgtgctctctctctg

SEQ ID NO: 146016 - DNA, 35 bp, Artificial Sequence
  Synthetic oligonucleotide
ttgcccacctatttgctcactgccagccagccttg

SEQ ID NO: 146017 - DNA, 35 bp, Artificial Sequence
  Synthetic oligonucleotide
accgccccacttttcgatcccaccctgatactgat

SEQ ID NO: 146018 - DNA, 35 bp, Artificial Sequence
  Synthetic oligonucleotide
agcccagcgcccggccttgtctctctactctgtct

SEQ ID NO: 146019 - DNA, 35 bp, Artificial Sequence
  Synthetic oligonucleotide
gatcggggcgggtgggtcgtacagggtagccctaa

SEQ ID NO: 146020 - DNA, 36 bp, Artificial Sequence
  Synthetic oligonucleotide
gacaggggaggcgagtagcgcgggggggggcattaa

SEQ ID NO: 146021 - DNA, 35 bp, Artificial Sequence
  Synthetic oligonucleotide
ttccacccctccggaagcgaggccacggtcttcca

SEQ ID NO: 146022 - DNA, 35 bp, Artificial Sequence
  Synthetic oligonucleotide
taacatgcacctgcttaacatccccgctacacgca

SEQ ID NO: 146023 - DNA, 36 bp, Artificial Sequence
  Synthetic oligonucleotide
gtccctcgctgcaccgtatttggtcctttctactca

SEQ ID NO: 146024 - DNA, 35 bp, Artificial Sequence
  Synthetic oligonucleotide
ggagtaacgggggggtggatatggtggcatgaaga

SEQ ID NO: 146025 - DNA, 37 bp, Artificial Sequence
  Synthetic oligonucleotide
gcacggtcatcgccccgctgttcctgttccccataga

SEQ ID NO: 146026 - DNA, 35 bp, Artificial Sequence
  Synthetic oligonucleotide
atgtccgccccataaacttctcgtcgcttgcacga

SEQ ID NO: 146027 - DNA, 37 bp, Artificial Sequence
  Synthetic oligonucleotide
atggtccaccgcaggcacagtcctcgcactcctccga

SEQ ID NO: 146028 - DNA, 37 bp, Artificial Sequence
  Synthetic oligonucleotide
gtcaaaggagggagaaaacagggagaagcgcatgcga

SEQ ID NO: 146029 - DNA, 35 bp, Artificial Sequence
  Synthetic oligonucleotide
gtcacgactctggtccttctcttagctcctgtcga

SEQ ID NO: 146030 - DNA, 37 bp, Artificial Sequence
  Synthetic oligonucleotide
ggggacagggggacaaggagctgaatgggagagggga

SEQ ID NO: 146031 - DNA, 37 bp, Artificial Sequence
  Synthetic oligonucleotide
gagtgaacgtgggagcaggggaagggggctgtgggga

SEQ ID NO: 146032 - DNA, 38 bp, Artificial Sequence
  Synthetic oligonucleotide
actatcgcacgctgccctcccgcccctcctcgagatga

SEQ ID NO: 146033 - DNA, 37 bp, Artificial Sequence
  Synthetic oligonucleotide
gagccgttccagcgcagaactccgccgccctacctga

SEQ ID NO: 146034 - DNA, 37 bp, Artificial Sequence
  Synthetic oligonucleotide
ggaacgcgagcactgaatcctccgcctctccttctga

SEQ ID NO: 146035 - DNA, 38 bp, Artificial Sequence
  Synthetic oligonucleotide
gacgggcgggggggatagggtctatcggatttcagtga

SEQ ID NO: 146036 - DNA, 35 bp, Artificial Sequence
  Synthetic oligonucleotide
gacaacgtcccagtactttgcacctccccatgtga

SEQ ID NO: 146037 - DNA, 35 bp, Artificial Sequence
  Synthetic oligonucleotide
gtctaccacgccggccccttcctcttgttcttgta

SEQ ID NO: 146038 - DNA, 35 bp, Artificial Sequence
  Synthetic oligonucleotide
ggtgcccctctcgatcccaagtagtgcgcccctta

SEQ ID NO: 146039 - DNA, 35 bp, Artificial Sequence
  Synthetic oligonucleotide
ttcacctccgcctagtacaagggcctatatcctta

SEQ ID NO: 146040 - DNA, 35 bp, Artificial Sequence
  Synthetic oligonucleotide
tatccgcgactatcctacatcctggcgtactccac

SEQ ID NO: 146041 - DNA, 35 bp, Artificial Sequence
  Synthetic oligonucleotide
acacgcagcaacctttctgctccgggccattctac

SEQ ID NO: 146042 - DNA, 35 bp, Artificial Sequence
  Synthetic oligonucleotide
tccacgccgttagcggtgctggttttttccttccc

SEQ ID NO: 146043 - DNA, 35 bp, Artificial Sequence
  Synthetic oligonucleotide
tcgcggagctcctcctgcacagcctttcttgttcc

SEQ ID NO: 146044 - DNA, 35 bp, Artificial Sequence
  Synthetic oligonucleotide
tgccccacatcccccaggttcgtactgtaatttcc

SEQ ID NO: 146045 - DNA, 35 bp, Artificial Sequence
  Synthetic oligonucleotide
ttgatccccggcctctatgcaattttatactttcc

SEQ ID NO: 146046 - DNA, 34 bp, Artificial Sequence
  Synthetic oligonucleotide
tcagctccctccgtttctagttagccgccacagc

SEQ ID NO: 146047 - DNA, 35 bp, Artificial Sequence
  Synthetic oligonucleotide
gatgcattcgtcggtcctcgtgccacccattgcgc

SEQ ID NO: 146048 - DNA, 35 bp, Artificial Sequence
  Synthetic oligonucleotide
tcttcgactgtccccttccgttctatcactgttgc

SEQ ID NO: 146049 - DNA, 35 bp, Artificial Sequence
  Synthetic oligonucleotide
tccatacacgtgcttaatgctcgtattacgccctc

SEQ ID NO: 146050 - DNA, 35 bp, Artificial Sequence
  Synthetic oligonucleotide
ttcgtgacatcctgctgagcgtcaatagcgccctc

SEQ ID NO: 146051 - DNA, 34 bp, Artificial Sequence
  Synthetic oligonucleotide
agcttaacgcctgcatacactagcgccccccttc

SEQ ID NO: 146052 - DNA, 35 bp, Artificial Sequence
  Synthetic oligonucleotide
tccctcgcacctgaatccgtgtgattccatccttc

SEQ ID NO: 146053 - DNA, 35 bp, Artificial Sequence
  Synthetic oligonucleotide
atcgtcgctcctaaagtggccttctcaactccccg

SEQ ID NO: 146054 - DNA, 35 bp, Artificial Sequence
  Synthetic oligonucleotide
ttgcgtcggtctgatgtcttcgtccttctctcccg

SEQ ID NO: 146055 - DNA, 35 bp, Artificial Sequence
  Synthetic oligonucleotide
taatggagaacgggagggcgggtattagggtccgg

SEQ ID NO: 146056 - DNA, 35 bp, Artificial Sequence
  Synthetic oligonucleotide
gtaccgaccttctacgaaccgccatgccttccggg

SEQ ID NO: 146057 - DNA, 35 bp, Artificial Sequence
  Synthetic oligonucleotide
tcacgcccacttgtttgtgtccctttggttatctg

SEQ ID NO: 146058 - DNA, 35 bp, Artificial Sequence
  Synthetic oligonucleotide
atcaatgtatctgcgcacctccgcgccctggccct

SEQ ID NO: 146059 - DNA, 35 bp, Artificial Sequence
  Synthetic oligonucleotide
tgcgcgcaacttcatatcacgctggtacacctcct

SEQ ID NO: 146060 - DNA, 35 bp, Artificial Sequence
  Synthetic oligonucleotide
gagcgagacggggggtggttcaaggcggagtagaa

SEQ ID NO: 146061 - DNA, 35 bp, Artificial Sequence
  Synthetic oligonucleotide
tcagggggcgggcgggggtggcttgttgtccaaca

SEQ ID NO: 146062 - DNA, 35 bp, Artificial Sequence
  Synthetic oligonucleotide
tcacccagcccggccttctatcacgttcatgaaca

SEQ ID NO: 146063 - DNA, 36 bp, Artificial Sequence
  Synthetic oligonucleotide
gcccctgtccctctgtgactctttccgtcttgccca

SEQ ID NO: 146064 - DNA, 35 bp, Artificial Sequence
  Synthetic oligonucleotide
aacatacatcccagctcatcatctgccatgtccca

SEQ ID NO: 146065 - DNA, 36 bp, Artificial Sequence
  Synthetic oligonucleotide
tcgcctacctaccaccacgggttatcgttcactcca

SEQ ID NO: 146066 - DNA, 35 bp, Artificial Sequence
  Synthetic oligonucleotide
tgaagcctaccaatccgttttatgttcccctcgca

SEQ ID NO: 146067 - DNA, 37 bp, Artificial Sequence
  Synthetic oligonucleotide
acgaggcggaggggggaaggtaacttgtggcagcaga

SEQ ID NO: 146068 - DNA, 37 bp, Artificial Sequence
  Synthetic oligonucleotide
gggactttgcccaccttgttctatcacttcgctccga

SEQ ID NO: 146069 - DNA, 36 bp, Artificial Sequence
  Synthetic oligonucleotide
accgagaccacgcccagttccattcgccctcatcga

SEQ ID NO: 146070 - DNA, 36 bp, Artificial Sequence
  Synthetic oligonucleotide
tacctcatcgcccgggaattatctcgtccacctcga

SEQ ID NO: 146071 - DNA, 37 bp, Artificial Sequence
  Synthetic oligonucleotide
ggtcacgatatgggtgggagggctcggggtgattcga

SEQ ID NO: 146072 - DNA, 37 bp, Artificial Sequence
  Synthetic oligonucleotide
gatgggggagtgatattaggggtataagggcggggga

SEQ ID NO: 146073 - DNA, 33 bp, Artificial Sequence
  Synthetic oligonucleotide
gatcggagtaaggagggggatagaacgctggga

SEQ ID NO: 146074 - DNA, 37 bp, Artificial Sequence
  Synthetic oligonucleotide
tcgagtggggggaacggaggttaacggtgggttggga

SEQ ID NO: 146075 - DNA, 37 bp, Artificial Sequence
  Synthetic oligonucleotide
acacccgctatagtagccaacttctcgcccttctgga

SEQ ID NO: 146076 - DNA, 37 bp, Artificial Sequence
  Synthetic oligonucleotide
atctgccacatcattcaccgcaccgtacattccatga

SEQ ID NO: 146077 - DNA, 38 bp, Artificial Sequence
  Synthetic oligonucleotide
tcgccctggcccccattgttttggtcgtttccatctga

SEQ ID NO: 146078 - DNA, 38 bp, Artificial Sequence
  Synthetic oligonucleotide
gaagacgaggggagaaggagatgaggggtcggatctga

SEQ ID NO: 146079 - DNA, 38 bp, Artificial Sequence
  Synthetic oligonucleotide
acgtggagaagggaacgggattggaagaggagtggtga

SEQ ID NO: 146080 - DNA, 38 bp, Artificial Sequence
  Synthetic oligonucleotide
gggtggaggtgggggtcggctaaggctggcctaattga

SEQ ID NO: 146081 - DNA, 38 bp, Artificial Sequence
  Synthetic oligonucleotide
atgtaccctgcttccgacgcctaggcccgctcccttga

SEQ ID NO: 146082 - DNA, 38 bp, Artificial Sequence
  Synthetic oligonucleotide
tacaccaccaggtacctcgatcccacgtcccccgttga

SEQ ID NO: 146083 - DNA, 38 bp, Artificial Sequence
  Synthetic oligonucleotide
tgccaccgcctgaacagctatacttctctccgctttga

SEQ ID NO: 146084 - DNA, 38 bp, Artificial Sequence
  Synthetic oligonucleotide
tccccgctagcctgtgttccgccgccgcccgattttga

SEQ ID NO: 146085 - DNA, 36 bp, Artificial Sequence
  Synthetic oligonucleotide
attgctcgctggccgttttctcactccgttccacta

SEQ ID NO: 146086 - DNA, 36 bp, Artificial Sequence
  Synthetic oligonucleotide
tatgaaccccacccccgccccacgatccggagacta

SEQ ID NO: 146087 - DNA, 37 bp, Artificial Sequence
  Synthetic oligonucleotide
tccgccccagacacccgctctataaccgccaatcgta

SEQ ID NO: 146088 - DNA, 35 bp, Artificial Sequence
  Synthetic oligonucleotide
atccgccctctttttgcctggttgaggccattcac

SEQ ID NO: 146089 - DNA, 35 bp, Artificial Sequence
  Synthetic oligonucleotide
ttgcacccccctcacgatcctctcactgaatttac

SEQ ID NO: 146090 - DNA, 35 bp, Artificial Sequence
  Synthetic oligonucleotide
ttcaccgcctgcctttgaatactggtcgcccatcc

SEQ ID NO: 146091 - DNA, 35 bp, Artificial Sequence
  Synthetic oligonucleotide
gcccccctatgttctaatacgccgaaccatgatcc

SEQ ID NO: 146092 - DNA, 35 bp, Artificial Sequence
  Synthetic oligonucleotide
tcgcccggttacctccgcgctttcgctttccatgc

SEQ ID NO: 146093 - DNA, 35 bp, Artificial Sequence
  Synthetic oligonucleotide
gtcgccgtttcatcgccgccttccggacaccaatc

SEQ ID NO: 146094 - DNA, 35 bp, Artificial Sequence
  Synthetic oligonucleotide
acgttacctcccccgctcaggcaattagtccactc

SEQ ID NO: 146095 - DNA, 35 bp, Artificial Sequence
  Synthetic oligonucleotide
gcattgcctacgtgtcaccttgtcttcgcccgctc

SEQ ID NO: 146096 - DNA, 35 bp, Artificial Sequence
  Synthetic oligonucleotide
tacctcccactctgtagacagctcgtctatcgctc

SEQ ID NO: 146097 - DNA, 35 bp, Artificial Sequence
  Synthetic oligonucleotide
gtgcccaacacgccctatgctacctcgccatcaag

SEQ ID NO: 146098 - DNA, 35 bp, Artificial Sequence
  Synthetic oligonucleotide
ttggaacgagggggggggagaaacgtaggtgccag

SEQ ID NO: 146099 - DNA, 35 bp, Artificial Sequence
  Synthetic oligonucleotide
atatcccccgtgtgcatctttgtcatcgcactccg

SEQ ID NO: 146100 - DNA, 35 bp, Artificial Sequence
  Synthetic oligonucleotide
gctccatcaggcacatcctccaaccttgtacttcg

SEQ ID NO: 146101 - DNA, 35 bp, Artificial Sequence
  Synthetic oligonucleotide
aaccaccgggaggggatagaaagggtgtagttggg

SEQ ID NO: 146102 - DNA, 35 bp, Artificial Sequence
  Synthetic oligonucleotide
atgccgtcgccgccgggctgtcaatcctaactctg

SEQ ID NO: 146103 - DNA, 35 bp, Artificial Sequence
  Synthetic oligonucleotide
tgagaggccgcctttgcctatttggtctttttcct

SEQ ID NO: 146104 - DNA, 34 bp, Artificial Sequence
  Synthetic oligonucleotide
tgacaccccccaatctgcaggccatcctctcgct

SEQ ID NO: 146105 - DNA, 35 bp, Artificial Sequence
  Synthetic oligonucleotide
actccgcgggccccactggaacgacaccctgctct

SEQ ID NO: 146106 - DNA, 35 bp, Artificial Sequence
  Synthetic oligonucleotide
agtcccgcactgacttgctgttctgttcgttctct

SEQ ID NO: 146107 - DNA, 35 bp, Artificial Sequence
  Synthetic oligonucleotide
tccacctgtcggctccttacaagacacaacctctt

SEQ ID NO: 146108 - DNA, 35 bp, Artificial Sequence
  Synthetic oligonucleotide
gatatcatccggcgctattgttcctcttctccgtt

SEQ ID NO: 146109 - DNA, 36 bp, Artificial Sequence
  Synthetic oligonucleotide
gtaccatcccgccgcgacgttgaccttttagctcaa

SEQ ID NO: 146110 - DNA, 36 bp, Artificial Sequence
  Synthetic oligonucleotide
tcacaccaccccgctcgtaaaggtcctttgaatgaa

SEQ ID NO: 146111 - DNA, 35 bp, Artificial Sequence
  Synthetic oligonucleotide
ttcggacctcctccccgatgctgttctccacgtaa

SEQ ID NO: 146112 - DNA, 36 bp, Artificial Sequence
  Synthetic oligonucleotide
ttgccaccccacatctcaacctgaggccctgtaaca

SEQ ID NO: 146113 - DNA, 35 bp, Artificial Sequence
  Synthetic oligonucleotide
gccgactcgccgattatttcaaccgctcccccgca

SEQ ID NO: 146114 - DNA, 37 bp, Artificial Sequence
  Synthetic oligonucleotide
gcatgcccccgccccaccatgcatatgtacttgacga

SEQ ID NO: 146115 - DNA, 35 bp, Artificial Sequence
  Synthetic oligonucleotide
gctccccacccggctcatggttcgactctgcccga

SEQ ID NO: 146116 - DNA, 37 bp, Artificial Sequence
  Synthetic oligonucleotide
gacacaaatgggggttagtacgagagggagggcagga

SEQ ID NO: 146117 - DNA, 35 bp, Artificial Sequence
  Synthetic oligonucleotide
ggcgtgtggtggggggggaggaggatcggagggga

SEQ ID NO: 146118 - DNA, 38 bp, Artificial Sequence
  Synthetic oligonucleotide
agccaacggccactacgatgtacccctgcctattatga

SEQ ID NO: 146119 - DNA, 38 bp, Artificial Sequence
  Synthetic oligonucleotide
tagatgcaggtgcgaggaacagggggaggaacgagtga

SEQ ID NO: 146120 - DNA, 37 bp, Artificial Sequence
  Synthetic oligonucleotide
tcatccacattgtctccctccgcccatctgttcgtga

SEQ ID NO: 146121 - DNA, 35 bp, Artificial Sequence
  Synthetic oligonucleotide
tacgcaccccgattcgcctatttgtcattttcaac

SEQ ID NO: 146122 - DNA, 35 bp, Artificial Sequence
  Synthetic oligonucleotide
gtgcacgcccacacgatccctctccccgggctaac

SEQ ID NO: 146123 - DNA, 35 bp, Artificial Sequence
  Synthetic oligonucleotide
atttccacctcggtctctgccatcgctacgcacac

SEQ ID NO: 146124 - DNA, 35 bp, Artificial Sequence
  Synthetic oligonucleotide
gagaggggtgagggtctggggacaattgcgggcac

SEQ ID NO: 146125 - DNA, 35 bp, Artificial Sequence
  Synthetic oligonucleotide
tgtccacgccgacgtactctgggtccaactactac

SEQ ID NO: 146126 - DNA, 35 bp, Artificial Sequence
  Synthetic oligonucleotide
accgagcttcctacggtgcccacgcccctcccacc

SEQ ID NO: 146127 - DNA, 35 bp, Artificial Sequence
  Synthetic oligonucleotide
aacccgtcccccatttgaccttcacaggcccaccc

SEQ ID NO: 146128 - DNA, 35 bp, Artificial Sequence
  Synthetic oligonucleotide
gttgcgccgggattgggtgttctgccgccgtcccc

SEQ ID NO: 146129 - DNA, 35 bp, Artificial Sequence
  Synthetic oligonucleotide
ggacacggcgccgctattggttcctattcatgccc

SEQ ID NO: 146130 - DNA, 35 bp, Artificial Sequence
  Synthetic oligonucleotide
aaaccaacccccttcagttgtcgccactccaccgc

SEQ ID NO: 146131 - DNA, 35 bp, Artificial Sequence
  Synthetic oligonucleotide
tgttacacgcccggtcctcatccatcccaccctgc

SEQ ID NO: 146132 - DNA, 35 bp, Artificial Sequence
  Synthetic oligonucleotide
tcgcttcacatcccgcgcttcgaccaccgacttgc

SEQ ID NO: 146133 - DNA, 35 bp, Artificial Sequence
  Synthetic oligonucleotide
ttacccgctcgctctttacatgcttgacgttttgc

SEQ ID NO: 146134 - DNA, 35 bp, Artificial Sequence
  Synthetic oligonucleotide
gagatcgtgtgtgtcttccgtctttcgttcaaatc

SEQ ID NO: 146135 - DNA, 35 bp, Artificial Sequence
  Synthetic oligonucleotide
atgccgccactacatagttacacattcctctcctc

SEQ ID NO: 146136 - DNA, 35 bp, Artificial Sequence
  Synthetic oligonucleotide
gacctgacagctttccgtttacctccggccttttc

SEQ ID NO: 146137 - DNA, 35 bp, Artificial Sequence
  Synthetic oligonucleotide
acctctgcccccatagttaccccgccctgcttttc

SEQ ID NO: 146138 - DNA, 35 bp, Artificial Sequence
  Synthetic oligonucleotide
atccgcctggacttatgcactaccatcctttcacg

SEQ ID NO: 146139 - DNA, 35 bp, Artificial Sequence
  Synthetic oligonucleotide
gaccatcgcaataggaaaacacctgtccccacccg

SEQ ID NO: 146140 - DNA, 35 bp, Artificial Sequence
  Synthetic oligonucleotide
tgacaacaggcggatagaggaggtggaggtatggg

SEQ ID NO: 146141 - DNA, 35 bp, Artificial Sequence
  Synthetic oligonucleotide
acggggagagtggaagtggaagggtcggggggatg

SEQ ID NO: 146142 - DNA, 36 bp, Artificial Sequence
  Synthetic oligonucleotide
aactcggccgggtacatcgccttgcctctccacctg

SEQ ID NO: 146143 - DNA, 35 bp, Artificial Sequence
  Synthetic oligonucleotide
tctgtcattgcgattcccgcctaccgtttcctctg

SEQ ID NO: 146144 - DNA, 35 bp, Artificial Sequence
  Synthetic oligonucleotide
tcgctgctcatcgcccctgggtccacctctcattg

SEQ ID NO: 146145 - DNA, 35 bp, Artificial Sequence
  Synthetic oligonucleotide
tctgcactttgctgtttctaatgtcccgtctccat

SEQ ID NO: 146146 - DNA, 35 bp, Artificial Sequence
  Synthetic oligonucleotide
tcctcgccagaccttcatttacctgccggaaccct

SEQ ID NO: 146147 - DNA, 35 bp, Artificial Sequence
  Synthetic oligonucleotide
tgcggaccgtcacatcttactcgcattctgatcct

SEQ ID NO: 146148 - DNA, 35 bp, Artificial Sequence
  Synthetic oligonucleotide
gtcgctggcgaccgtgacctccagcctgatctcct

SEQ ID NO: 146149 - DNA, 35 bp, Artificial Sequence
  Synthetic oligonucleotide
aatgacattgtcacgtctacttaacccgcccttgt

SEQ ID NO: 146150 - DNA, 35 bp, Artificial Sequence
  Synthetic oligonucleotide
gcacctcctgccttgcacattgagtcgttttcatt

SEQ ID NO: 146151 - DNA, 35 bp, Artificial Sequence
  Synthetic oligonucleotide
ccagccctccgtacgatcattttctccgccgtatt

SEQ ID NO: 146152 - DNA, 35 bp, Artificial Sequence
  Synthetic oligonucleotide
gtggggagggaaagcagacggtggggagaacggaa

SEQ ID NO: 146153 - DNA, 36 bp, Artificial Sequence
  Synthetic oligonucleotide
agcctccaccagaattgccatcgccccggttaataa

SEQ ID NO: 146154 - DNA, 35 bp, Artificial Sequence
  Synthetic oligonucleotide
aagatgggggggacttgggcaaagtgggacgataa

SEQ ID NO: 146155 - DNA, 36 bp, Artificial Sequence
  Synthetic oligonucleotide
gcggggcgagggggggcgggtggtgacggataaaca

SEQ ID NO: 146156 - DNA, 35 bp, Artificial Sequence
  Synthetic oligonucleotide
atccgagccggatcactatttgcattaccatcaca

SEQ ID NO: 146157 - DNA, 35 bp, Artificial Sequence
  Synthetic oligonucleotide
accagccacacgcaacgatcccgcaaacgccttca

SEQ ID NO: 146158 - DNA, 37 bp, Artificial Sequence
  Synthetic oligonucleotide
gagacgaggccgggggtttggacaggggtaaggaaga

SEQ ID NO: 146159 - DNA, 36 bp, Artificial Sequence
  Synthetic oligonucleotide
atcccatccccgccgtcttcaacccgcgcacttaga

SEQ ID NO: 146160 - DNA, 37 bp, Artificial Sequence
  Synthetic oligonucleotide
aatgcatagcggcctgtgcgcgcctgaaccccctcga

SEQ ID NO: 146161 - DNA, 37 bp, Artificial Sequence
  Synthetic oligonucleotide
agagcgggtgaggcaacctgaaaacgggagggcggga

SEQ ID NO: 146162 - DNA, 37 bp, Artificial Sequence
  Synthetic oligonucleotide
gtcgacctcttcatccccgtgtgcccctcccattgga

SEQ ID NO: 146163 - DNA, 38 bp, Artificial Sequence
  Synthetic oligonucleotide
gcctgtagccccaccacgtctaaatgatcctctcctga

SEQ ID NO: 146164 - DNA, 38 bp, Artificial Sequence
  Synthetic oligonucleotide
gttaagatcgaaggggggaggcggaccaacgaaggtga

SEQ ID NO: 146165 - DNA, 37 bp, Artificial Sequence
  Synthetic oligonucleotide
tgcggtgtaggggggggagcggaaattgagactgtga

SEQ ID NO: 146166 - DNA, 38 bp, Artificial Sequence
  Synthetic oligonucleotide
gcgcacgcttgcgtctatcgccactcactacaccttga

SEQ ID NO: 146167 - DNA, 37 bp, Artificial Sequence
  Synthetic oligonucleotide
tctacctcacgcgcgcatttctcgacctccctgttga

SEQ ID NO: 146168 - DNA, 35 bp, Artificial Sequence
  Synthetic oligonucleotide
ccacccaccctcgatacgctgttctcacgccccta

SEQ ID NO: 146169 - DNA, 35 bp, Artificial Sequence
  Synthetic oligonucleotide
ttgatccccccccacgagtccgttgacagtgtcta

SEQ ID NO: 146170 - DNA, 35 bp, Artificial Sequence
  Synthetic oligonucleotide
acgtccctcctctcgaacgcaatgacccgcctacc

SEQ ID NO: 146171 - DNA, 35 bp, Artificial Sequence
  Synthetic oligonucleotide
gccgacgtaccggatcgtcccaatatagcctcgcc

SEQ ID NO: 146172 - DNA, 35 bp, Artificial Sequence
  Synthetic oligonucleotide
accacatcttgttgtaacaccttcccaccagtgcc

SEQ ID NO: 146173 - DNA, 35 bp, Artificial Sequence
  Synthetic oligonucleotide
tccgaggcgattagtcttcctctccgattcgctcc

SEQ ID NO: 146174 - DNA, 35 bp, Artificial Sequence
  Synthetic oligonucleotide
gcccatggccttcacgttcctcaccagttcgacgc

SEQ ID NO: 146175 - DNA, 35 bp, Artificial Sequence
  Synthetic oligonucleotide
agcgagtcaccgagttcgcctccatctgcctacgc

SEQ ID NO: 146176 - DNA, 35 bp, Artificial Sequence
  Synthetic oligonucleotide
tgcgatttgtgctgctctccatacctgctcccggc

SEQ ID NO: 146177 - DNA, 35 bp, Artificial Sequence
  Synthetic oligonucleotide
actctgcccccgaaggtttgcttccgtttaacatc

SEQ ID NO: 146178 - DNA, 35 bp, Artificial Sequence
  Synthetic oligonucleotide
tccgccatcaccattagcctttctgtcaatcgctc

SEQ ID NO: 146179 - DNA, 35 bp, Artificial Sequence
  Synthetic oligonucleotide
gaacgaggggttaaggggagagggatagggcgaag

SEQ ID NO: 146180 - DNA, 35 bp, Artificial Sequence
  Synthetic oligonucleotide
tgcaacctagccgcccactctcccacgaatgtacg

SEQ ID NO: 146181 - DNA, 35 bp, Artificial Sequence
  Synthetic oligonucleotide
tcccactgagttttttcttgcctgttccttccggg

SEQ ID NO: 146182 - DNA, 35 bp, Artificial Sequence
  Synthetic oligonucleotide
tcccggtgccgtacccgatgctctactcttgcctg

SEQ ID NO: 146183 - DNA, 35 bp, Artificial Sequence
  Synthetic oligonucleotide
aaacctcgccacccctctccaggccaactgccaat

SEQ ID NO: 146184 - DNA, 35 bp, Artificial Sequence
  Synthetic oligonucleotide
gaccagtaccactgcactcgccctcccccttgaat

SEQ ID NO: 146185 - DNA, 35 bp, Artificial Sequence
  Synthetic oligonucleotide
tgaacgaccccgtcccccaggccccacctagccat

SEQ ID NO: 146186 - DNA, 35 bp, Artificial Sequence
  Synthetic oligonucleotide
accgttgctcccggaacacctctgcctttagacct

SEQ ID NO: 146187 - DNA, 35 bp, Artificial Sequence
  Synthetic oligonucleotide
acgcattccgccggtctatctcccgatattcttct

SEQ ID NO: 146188 - DNA, 35 bp, Artificial Sequence
  Synthetic oligonucleotide
tgctcgctacggtcaatctctttagccgctccctt

SEQ ID NO: 146189 - DNA, 35 bp, Artificial Sequence
  Synthetic oligonucleotide
aaacccgccctgttacttgcttcccgataccgctt

SEQ ID NO: 146190 - DNA, 35 bp, Artificial Sequence
  Synthetic oligonucleotide
tctcgccttctcgtttgtctcttacttagcccgtt

SEQ ID NO: 146191 - DNA, 35 bp, Artificial Sequence
  Synthetic oligonucleotide
aactgctccatctattcatgcctggtaacccccca

SEQ ID NO: 146192 - DNA, 36 bp, Artificial Sequence
  Synthetic oligonucleotide
accagccgcccctcttgccgtatatccaccccgcca

SEQ ID NO: 146193 - DNA, 36 bp, Artificial Sequence
  Synthetic oligonucleotide
gccaattggccccctccgtgcacattacatctgcca

SEQ ID NO: 146194 - DNA, 36 bp, Artificial Sequence
  Synthetic oligonucleotide
tgaccaaccctgagctcaccccacccgtacttagca

SEQ ID NO: 146195 - DNA, 36 bp, Artificial Sequence
  Synthetic oligonucleotide
atccgcagccaggtgcgtttcgcctcatctctctca

SEQ ID NO: 146196 - DNA, 37 bp, Artificial Sequence
  Synthetic oligonucleotide
atcatcgtcccgttctgcccttctccctccgagcgga

SEQ ID NO: 146197 - DNA, 37 bp, Artificial Sequence
  Synthetic oligonucleotide
tggggagtggcggtttccatcctagggcggttgggga

SEQ ID NO: 146198 - DNA, 37 bp, Artificial Sequence
  Synthetic oligonucleotide
tgtgcagtgtactgcgttcctccgcccactccctgga

SEQ ID NO: 146199 - DNA, 37 bp, Artificial Sequence
  Synthetic oligonucleotide
gttgggcgggagtggatgggtgtcactttgcccatga

SEQ ID NO: 146200 - DNA, 38 bp, Artificial Sequence
  Synthetic oligonucleotide
gaggccactgctggtgtcatccgtctcactcctcctga

SEQ ID NO: 146201 - DNA, 38 bp, Artificial Sequence
  Synthetic oligonucleotide
tccctaccccgtccatctgcctctgtgtccagtcctga

SEQ ID NO: 146202 - DNA, 36 bp, Artificial Sequence
  Synthetic oligonucleotide
ggacaccctcgcccccaccccaagatacaatggtga

SEQ ID NO: 146203 - DNA, 34 bp, Artificial Sequence
  Synthetic oligonucleotide
gtccctcaccgcctacctgtctaacctacattga

SEQ ID NO: 146204 - DNA, 38 bp, Artificial Sequence
  Synthetic oligonucleotide
tctgacacctctgctatttcatttgctcccaccattga

SEQ ID NO: 146205 - DNA, 38 bp, Artificial Sequence
  Synthetic oligonucleotide
agtccacacctctgaatccttctagtgccacccattga

SEQ ID NO: 146206 - DNA, 38 bp, Artificial Sequence
  Synthetic oligonucleotide
tctatccgtcgcatgccgatccctcgttccatcgttga

SEQ ID NO: 146207 - DNA, 36 bp, Artificial Sequence
  Synthetic oligonucleotide
tttgagcgtccaggtctcttacggtctccccatcta

SEQ ID NO: 146208 - DNA, 36 bp, Artificial Sequence
  Synthetic oligonucleotide
tctaccgactggggaatgtgggtgggtggggactta

SEQ ID NO: 146209 - DNA, 36 bp, Artificial Sequence
  Synthetic oligonucleotide
tgcaccatcgcatccggcattacgtagctatcctta

SEQ ID NO: 146210 - DNA, 35 bp, Artificial Sequence
  Synthetic oligonucleotide
gcccctcgacgcctttgatccttccgctccagtta

SEQ ID NO: 146211 - DNA, 36 bp, Artificial Sequence
  Synthetic oligonucleotide
tacacgccacaatctctgcgagactttcccccttta

SEQ ID NO: 146212 - DNA, 35 bp, Artificial Sequence
  Synthetic oligonucleotide
atgcgcaccgactggttcccccccacgtgctgcac

SEQ ID NO: 146213 - DNA, 35 bp, Artificial Sequence
  Synthetic oligonucleotide
gcctctcacccgcggatacgggcttctacacttac

SEQ ID NO: 146214 - DNA, 35 bp, Artificial Sequence
  Synthetic oligonucleotide
aacacccgaagcccccgctcgttatcatatcgacc

SEQ ID NO: 146215 - DNA, 34 bp, Artificial Sequence
  Synthetic oligonucleotide
aacgacattgtagttttgtcttccctcccccccc

SEQ ID NO: 146216 - DNA, 35 bp, Artificial Sequence
  Synthetic oligonucleotide
gtgtcccactcggccttcatcgctatacgtttccc

SEQ ID NO: 146217 - DNA, 35 bp, Artificial Sequence
  Synthetic oligonucleotide
tccgcatgcccgccattctttcccactgtacggcc

SEQ ID NO: 146218 - DNA, 35 bp, Artificial Sequence
  Synthetic oligonucleotide
ttgccccctacctattgtctagcacatgacttcgc

SEQ ID NO: 146219 - DNA, 35 bp, Artificial Sequence
  Synthetic oligonucleotide
tgatccactccgccctcagtagaagcgaacctctc

SEQ ID NO: 146220 - DNA, 35 bp, Artificial Sequence
  Synthetic oligonucleotide
gttgtcgcaccatgcctcgaatcgtcctcccgttc

SEQ ID NO: 146221 - DNA, 35 bp, Artificial Sequence
  Synthetic oligonucleotide
acttccgtggctgcccggtccgtctattcgttttc

SEQ ID NO: 146222 - DNA, 35 bp, Artificial Sequence
  Synthetic oligonucleotide
tgcctcgcgcaatagcctttcagataccccgcccg

SEQ ID NO: 146223 - DNA, 35 bp, Artificial Sequence
  Synthetic oligonucleotide
gctaagggcggggggggaaaagtaaggagcctccg

SEQ ID NO: 146224 - DNA, 35 bp, Artificial Sequence
  Synthetic oligonucleotide
tccatgccgctcttcacacgtgtcaacttccttgg

SEQ ID NO: 146225 - DNA, 35 bp, Artificial Sequence
  Synthetic oligonucleotide
gcgtacgctccatggccctcccacgatcactatat

SEQ ID NO: 146226 - DNA, 35 bp, Artificial Sequence
  Synthetic oligonucleotide
gatcagtgcgcacgccttggctaaccacaacctct

SEQ ID NO: 146227 - DNA, 35 bp, Artificial Sequence
  Synthetic oligonucleotide
atcatctccgccgctctctccaccatgggtaacgt

SEQ ID NO: 146228 - DNA, 35 bp, Artificial Sequence
  Synthetic oligonucleotide
gtcccacccgcccttctaagcctgagccgccttaa

SEQ ID NO: 146229 - DNA, 35 bp, Artificial Sequence
  Synthetic oligonucleotide
gaacatccggtgggaaaggggggggtaccggaaca

SEQ ID NO: 146230 - DNA, 36 bp, Artificial Sequence
  Synthetic oligonucleotide
ttgttgcccttacgtttaccgggtcctgtctccaca

SEQ ID NO: 146231 - DNA, 36 bp, Artificial Sequence
  Synthetic oligonucleotide
gggagctcgcaccatggatcacctgtcccaccgcca

SEQ ID NO: 146232 - DNA, 36 bp, Artificial Sequence
  Synthetic oligonucleotide
agtcggggaggagtgggcggggcttgagggaatgca

SEQ ID NO: 146233 - DNA, 36 bp, Artificial Sequence
  Synthetic oligonucleotide
tacgtgccgtcacgttttggtctgctccaccattca

SEQ ID NO: 146234 - DNA, 37 bp, Artificial Sequence
  Synthetic oligonucleotide
tgactccatctctcgttgtccccgctccattctgaga

SEQ ID NO: 146235 - DNA, 36 bp, Artificial Sequence
  Synthetic oligonucleotide
tcaccaaccgctccatgttctctgctcttgtcccga

SEQ ID NO: 146236 - DNA, 36 bp, Artificial Sequence
  Synthetic oligonucleotide
tttcactgcggccccttagccaccaatcttcatcga

SEQ ID NO: 146237 - DNA, 35 bp, Artificial Sequence
  Synthetic oligonucleotide
tccgagctcccgtcctttctgcatattccattcga

SEQ ID NO: 146238 - DNA, 37 bp, Artificial Sequence
  Synthetic oligonucleotide
acgggaggaggggggaaagtcgaagaattacggggga

SEQ ID NO: 146239 - DNA, 37 bp, Artificial Sequence
  Synthetic oligonucleotide
ggggtggggagggagccggctgagacaccattctgga

SEQ ID NO: 146240 - DNA, 37 bp, Artificial Sequence
  Synthetic oligonucleotide
gtcaccccctcctatttctgttgtcagtccaggtgga

SEQ ID NO: 146241 - DNA, 36 bp, Artificial Sequence
  Synthetic oligonucleotide
taatgggaggaaggaggttaggggaagaattgtgga

SEQ ID NO: 146242 - DNA, 38 bp, Artificial Sequence
  Synthetic oligonucleotide
gcgtataggggggggacgtagaggagagagggaaatga

SEQ ID NO: 146243 - DNA, 38 bp, Artificial Sequence
  Synthetic oligonucleotide
aaccaccgtctgccctctacccacacaccccagcctga

SEQ ID NO: 146244 - DNA, 37 bp, Artificial Sequence
  Synthetic oligonucleotide
gacacactaccgttggcgtatgaccccccttctctga

SEQ ID NO: 146245 - DNA, 38 bp, Artificial Sequence
  Synthetic oligonucleotide
gcaccattccgaagactcaagcctacttccctccgtga

SEQ ID NO: 146246 - DNA, 38 bp, Artificial Sequence
  Synthetic oligonucleotide
gagaaggggggacgggacaaaaggatgcgcgctggtga

SEQ ID NO: 146247 - DNA, 36 bp, Artificial Sequence
  Synthetic oligonucleotide
gctatccacatcctgtttgcttttagttccacacta

SEQ ID NO: 146248 - DNA, 36 bp, Artificial Sequence
  Synthetic oligonucleotide
tgtgatggttctccgctggtcttcgttcctccgcta

SEQ ID NO: 146249 - DNA, 36 bp, Artificial Sequence
  Synthetic oligonucleotide
accgaccgtggcggacgtcctccccttctttcctta

SEQ ID NO: 146250 - DNA, 35 bp, Artificial Sequence
  Synthetic oligonucleotide
atccgccgccccttatcatatattccagcttccac

SEQ ID NO: 146251 - DNA, 35 bp, Artificial Sequence
  Synthetic oligonucleotide
taccatccgcactccctaatctggcccggagttac

SEQ ID NO: 146252 - DNA, 35 bp, Artificial Sequence
  Synthetic oligonucleotide
gacgcgctgcacgcccatcccgtcgcctctcaccc

SEQ ID NO: 146253 - DNA, 35 bp, Artificial Sequence
  Synthetic oligonucleotide
gactcatcaggcctcgcccttctagtgccacgccc

SEQ ID NO: 146254 - DNA, 35 bp, Artificial Sequence
  Synthetic oligonucleotide
gaacccaccgcaacccctgaagaaacgcccgtgcc

SEQ ID NO: 146255 - DNA, 35 bp, Artificial Sequence
  Synthetic oligonucleotide
ttgacccaccctcgctaagcaggtagctatttgcc

SEQ ID NO: 146256 - DNA, 35 bp, Artificial Sequence
  Synthetic oligonucleotide
attgcatgtttgtgtcgcctcctcgttctgtctcc

SEQ ID NO: 146257 - DNA, 35 bp, Artificial Sequence
  Synthetic oligonucleotide
gaccatttccccgttaccgccttcgacgaggttcc

SEQ ID NO: 146258 - DNA, 35 bp, Artificial Sequence
  Synthetic oligonucleotide
ttccccccctcgccgatagccagtttgactcgtgc

SEQ ID NO: 146259 - DNA, 35 bp, Artificial Sequence
  Synthetic oligonucleotide
tgacatgtggacctacactcggcccgcctcccatc

SEQ ID NO: 146260 - DNA, 35 bp, Artificial Sequence
  Synthetic oligonucleotide
gacggaccccagaaccgtccacccatggttatatc

SEQ ID NO: 146261 - DNA, 35 bp, Artificial Sequence
  Synthetic oligonucleotide
tgcttaccatcctgagtggtcttctcttatacctc

SEQ ID NO: 146262 - DNA, 35 bp, Artificial Sequence
  Synthetic oligonucleotide
acagcccgtgttgtctgccgcatccgaccgtcctc

SEQ ID NO: 146263 - DNA, 35 bp, Artificial Sequence
  Synthetic oligonucleotide
tatgacatacgttctgccccattgatctttcgctc

SEQ ID NO: 146264 - DNA, 35 bp, Artificial Sequence
  Synthetic oligonucleotide
tccgcccctactgcggatttctcatcatatccttc

SEQ ID NO: 146265 - DNA, 35 bp, Artificial Sequence
  Synthetic oligonucleotide
gtgtgtcaggaccgctcgcccgttcccccccctag

SEQ ID NO: 146266 - DNA, 35 bp, Artificial Sequence
  Synthetic oligonucleotide
tgacggactcctgccattgttctcacccccctccg

SEQ ID NO: 146267 - DNA, 35 bp, Artificial Sequence
  Synthetic oligonucleotide
actgccccggtcccagtttcgatcctagtgctccg

SEQ ID NO: 146268 - DNA, 35 bp, Artificial Sequence
  Synthetic oligonucleotide
tgcgcctcggaccacaacccccaccttattgcgcg

SEQ ID NO: 146269 - DNA, 35 bp, Artificial Sequence
  Synthetic oligonucleotide
gcaccatgcatcgcgtgacttgtaatccatcctcg

SEQ ID NO: 146270 - DNA, 34 bp, Artificial Sequence
  Synthetic oligonucleotide
gggagtaccggggtggacagggatgagcgaaggg

SEQ ID NO: 146271 - DNA, 35 bp, Artificial Sequence
  Synthetic oligonucleotide
gtgaggttggaggggaggatcgaagtggggaaggg

SEQ ID NO: 146272 - DNA, 35 bp, Artificial Sequence
  Synthetic oligonucleotide
gaacacgcaagcgcccttccctccagatcatcctg

SEQ ID NO: 146273 - DNA, 35 bp, Artificial Sequence
  Synthetic oligonucleotide
atgccccatcacgtatagttctcaccatggtctat

SEQ ID NO: 146274 - DNA, 35 bp, Artificial Sequence
  Synthetic oligonucleotide
gtgcgcccgccgtatctaccgttaactggaatcct

SEQ ID NO: 146275 - DNA, 35 bp, Artificial Sequence
  Synthetic oligonucleotide
gcgagacgaggaggatcggagaagaaaggtggatt

SEQ ID NO: 146276 - DNA, 35 bp, Artificial Sequence
  Synthetic oligonucleotide
tccctcgcacccggatttatttagccgcttaactt

SEQ ID NO: 146277 - DNA, 35 bp, Artificial Sequence
  Synthetic oligonucleotide
cccggggagggcgggtgggttataatttggtaaca

SEQ ID NO: 146278 - DNA, 35 bp, Artificial Sequence
  Synthetic oligonucleotide
gtaacacgtagccccatggttctcgctcctctaca

SEQ ID NO: 146279 - DNA, 35 bp, Artificial Sequence
  Synthetic oligonucleotide
tggatcgccactagctctctcatcgcacactacca

SEQ ID NO: 146280 - DNA, 35 bp, Artificial Sequence
  Synthetic oligonucleotide
tttgcaccgcagtcataccaccctcaaccgctgca

SEQ ID NO: 146281 - DNA, 35 bp, Artificial Sequence
  Synthetic oligonucleotide
acacaatgacgtcagtcccccccccggccgtttca

SEQ ID NO: 146282 - DNA, 37 bp, Artificial Sequence
  Synthetic oligonucleotide
gcccccctcgctccgacgtacatatcccctgtaacga

SEQ ID NO: 146283 - DNA, 37 bp, Artificial Sequence
  Synthetic oligonucleotide
ccaccccccttgtaattgtacccctccgacttgacga

SEQ ID NO: 146284 - DNA, 37 bp, Artificial Sequence
  Synthetic oligonucleotide
tcctcccgttccgcgtatgaccttcccacgtttccga

SEQ ID NO: 146285 - DNA, 37 bp, Artificial Sequence
  Synthetic oligonucleotide
taagaagggcatggacggggaacccagggggagagga

SEQ ID NO: 146286 - DNA, 36 bp, Artificial Sequence
  Synthetic oligonucleotide
tccccccgaccacctctcatgtcttgtctctacgga

SEQ ID NO: 146287 - DNA, 37 bp, Artificial Sequence
  Synthetic oligonucleotide
tcccactccaccaaaccctactgaactgtccgccgga

SEQ ID NO: 146288 - DNA, 37 bp, Artificial Sequence
  Synthetic oligonucleotide
tccgccttcaacgccgccacgcatctctcctcatgga

SEQ ID NO: 146289 - DNA, 37 bp, Artificial Sequence
  Synthetic oligonucleotide
tgcacccgcacctttttatttgggatacccatcctga

SEQ ID NO: 146290 - DNA, 37 bp, Artificial Sequence
  Synthetic oligonucleotide
gattcgattcggcaggctttgtcccgttccctcttga

SEQ ID NO: 146291 - DNA, 36 bp, Artificial Sequence
  Synthetic oligonucleotide
acaccgcctccacacgctataacctctatgataata

SEQ ID NO: 146292 - DNA, 36 bp, Artificial Sequence
  Synthetic oligonucleotide
tgctgtgcaacatccaccatgcgcccaccatcccta

SEQ ID NO: 146293 - DNA, 36 bp, Artificial Sequence
  Synthetic oligonucleotide
gacacccaccgcctccttggggaccaattctatgta

SEQ ID NO: 146294 - DNA, 36 bp, Artificial Sequence
  Synthetic oligonucleotide
taactcctgccctgccttcttttacacacagcctta

SEQ ID NO: 146295 - DNA, 37 bp, Artificial Sequence
  Synthetic oligonucleotide
ttgccgccttcgcctatttcccgggcctagcttgtta

SEQ ID NO: 146296 - DNA, 35 bp, Artificial Sequence
  Synthetic oligonucleotide
ttcacctctcatcgtacaccgtcgtgcgataccac

SEQ ID NO: 146297 - DNA, 35 bp, Artificial Sequence
  Synthetic oligonucleotide
tccattccaggtctgtgcgtcacactcccgcaccc

SEQ ID NO: 146298 - DNA, 35 bp, Artificial Sequence
  Synthetic oligonucleotide
actcgaaccgacgtgacgagcgcattttccccgcc

SEQ ID NO: 146299 - DNA, 35 bp, Artificial Sequence
  Synthetic oligonucleotide
aaccacgccatcgcggtgtccagttccttcctgcc

SEQ ID NO: 146300 - DNA, 35 bp, Artificial Sequence
  Synthetic oligonucleotide
tcaccgtactccctcttaaatgcctggcttcatcc

SEQ ID NO: 146301 - DNA, 35 bp, Artificial Sequence
  Synthetic oligonucleotide
acagccacgcctcggacgcatagctgccgccctcc

SEQ ID NO: 146302 - DNA, 35 bp, Artificial Sequence
  Synthetic oligonucleotide
tcctccccgctggtctctatacgtggaccgcctcc

SEQ ID NO: 146303 - DNA, 35 bp, Artificial Sequence
  Synthetic oligonucleotide
atggccacaagcgccagttccatcatttcgcctcc

SEQ ID NO: 146304 - DNA, 35 bp, Artificial Sequence
  Synthetic oligonucleotide
gcgtgtccagcgtgctttactgtaatccatcctcc

SEQ ID NO: 146305 - DNA, 35 bp, Artificial Sequence
  Synthetic oligonucleotide
tccgggagagctccatcccccttgacctcctgtcc

SEQ ID NO: 146306 - DNA, 35 bp, Artificial Sequence
  Synthetic oligonucleotide
tttcagcccgcgcgaccccgtcacccgcttctcgc

SEQ ID NO: 146307 - DNA, 35 bp, Artificial Sequence
  Synthetic oligonucleotide
acttctcctctgccggccactccccgattttcggc

SEQ ID NO: 146308 - DNA, 35 bp, Artificial Sequence
  Synthetic oligonucleotide
tcgcctgtccctgccttgcctttcctatctcgggc

SEQ ID NO: 146309 - DNA, 35 bp, Artificial Sequence
  Synthetic oligonucleotide
gaggccatcccgccttgttcctctcaccctgctgc

SEQ ID NO: 146310 - DNA, 36 bp, Artificial Sequence
  Synthetic oligonucleotide
attaccccagctgcccgttgcttcccttttagtatc

SEQ ID NO: 146311 - DNA, 35 bp, Artificial Sequence
  Synthetic oligonucleotide
tccgacacacattcacatccgttctatcactgctc

SEQ ID NO: 146312 - DNA, 35 bp, Artificial Sequence
  Synthetic oligonucleotide
gtccagcccccaccccacttcgcacagactgagtc

SEQ ID NO: 146313 - DNA, 35 bp, Artificial Sequence
  Synthetic oligonucleotide
tctgcccgctcttcgcagcctattgttatgccttc

SEQ ID NO: 146314 - DNA, 35 bp, Artificial Sequence
  Synthetic oligonucleotide
tcctatccgccggcccctgatcgcctaaatttacg

SEQ ID NO: 146315 - DNA, 35 bp, Artificial Sequence
  Synthetic oligonucleotide
gtcgctggcccccgctgatcccacaccatacttcg

SEQ ID NO: 146316 - DNA, 35 bp, Artificial Sequence
  Synthetic oligonucleotide
acctacgccccatattcatccgattcccgtccggg

SEQ ID NO: 146317 - DNA, 35 bp, Artificial Sequence
  Synthetic oligonucleotide
tgaccggagggtcccatgattcgtactcatccctg

SEQ ID NO: 146318 - DNA, 35 bp, Artificial Sequence
  Synthetic oligonucleotide
tcgactacacaggccttttccatcacccgatcctg

SEQ ID NO: 146319 - DNA, 35 bp, Artificial Sequence
  Synthetic oligonucleotide
tgcttccctcgaccctgccccacaatgttattgtg

SEQ ID NO: 146320 - DNA, 35 bp, Artificial Sequence
  Synthetic oligonucleotide
gtggccagtctgactggttcacaccgtctccctct

SEQ ID NO: 146321 - DNA, 35 bp, Artificial Sequence
  Synthetic oligonucleotide
tgctcccatgttggctccatcttacactcgattct

SEQ ID NO: 146322 - DNA, 35 bp, Artificial Sequence
  Synthetic oligonucleotide
gcgcagatgtagatcctccattccccctccgctgt

SEQ ID NO: 146323 - DNA, 35 bp, Artificial Sequence
  Synthetic oligonucleotide
gacggaggaggatctctgggaggggagcagggtgt

SEQ ID NO: 146324 - DNA, 35 bp, Artificial Sequence
  Synthetic oligonucleotide
gtcgacgggacagggagggcatgacaggcgggatt

SEQ ID NO: 146325 - DNA, 36 bp, Artificial Sequence
  Synthetic oligonucleotide
tgccatctgcccctcatctacatttccctgtggtaa

SEQ ID NO: 146326 - DNA, 35 bp, Artificial Sequence
  Synthetic oligonucleotide
ttacgtgtaccgcccctcctcgccgtgatagtcca

SEQ ID NO: 146327 - DNA, 37 bp, Artificial Sequence
  Synthetic oligonucleotide
gtggtgagggcgggggggaatttttcaatttaagaga

SEQ ID NO: 146328 - DNA, 36 bp, Artificial Sequence
  Synthetic oligonucleotide
acgacaaacaggtaggggaggaggacggagcggaga

SEQ ID NO: 146329 - DNA, 37 bp, Artificial Sequence
  Synthetic oligonucleotide
gcactttcgccgccacagtaacatcctcccccgccga

SEQ ID NO: 146330 - DNA, 37 bp, Artificial Sequence
  Synthetic oligonucleotide
tgccgcccaccgctttattctcccgtctttcctgcga

SEQ ID NO: 146331 - DNA, 37 bp, Artificial Sequence
  Synthetic oligonucleotide
agcaacctctacctggcccatctaagctgttcctcga

SEQ ID NO: 146332 - DNA, 37 bp, Artificial Sequence
  Synthetic oligonucleotide
gcgtggagggccaaggggggcacgggcaaataaagga

SEQ ID NO: 146333 - DNA, 35 bp, Artificial Sequence
  Synthetic oligonucleotide
ttggtggtgaagggtggagggtaatgtccaaggga

SEQ ID NO: 146334 - DNA, 37 bp, Artificial Sequence
  Synthetic oligonucleotide
gaacacggggggagggattccgggagatacctaggga

SEQ ID NO: 146335 - DNA, 37 bp, Artificial Sequence
  Synthetic oligonucleotide
atgggaggggactggagacattgattaggggtgggga

SEQ ID NO: 146336 - DNA, 37 bp, Artificial Sequence
  Synthetic oligonucleotide
atggggagacattcgggaaggggatggtacacatgga

SEQ ID NO: 146337 - DNA, 36 bp, Artificial Sequence
  Synthetic oligonucleotide
gaccaagctctacatcgcccagccttctcccttgga

SEQ ID NO: 146338 - DNA, 38 bp, Artificial Sequence
  Synthetic oligonucleotide
tccctctgactcagccgtttataccgcccccttcatga

SEQ ID NO: 146339 - DNA, 38 bp, Artificial Sequence
  Synthetic oligonucleotide
tagccggccatcactcttgaacctgtaccgtaccctga

SEQ ID NO: 146340 - DNA, 38 bp, Artificial Sequence
  Synthetic oligonucleotide
ggtgacgtaggtagggggtggttagggcggggtgttga

SEQ ID NO: 146341 - DNA, 36 bp, Artificial Sequence
  Synthetic oligonucleotide
gcacatcgcctcccacgtgactatatatgccttcta

SEQ ID NO: 146342 - DNA, 35 bp, Artificial Sequence
  Synthetic oligonucleotide
ttcaatccagcctctgtgaccacccccttcccgta

SEQ ID NO: 146343 - DNA, 35 bp, Artificial Sequence
  Synthetic oligonucleotide
accccgttcgcccatctgccctacctaattgcgta

SEQ ID NO: 146344 - DNA, 35 bp, Artificial Sequence
  Synthetic oligonucleotide
gactagctcgcggtctcgcccactctgcatcccac

SEQ ID NO: 146345 - DNA, 35 bp, Artificial Sequence
  Synthetic oligonucleotide
ttgcgccagccgccttcgaatcccaagccatcacc

SEQ ID NO: 146346 - DNA, 35 bp, Artificial Sequence
  Synthetic oligonucleotide
gtgcccctcgggagatttaacttgccttcgtcccc

SEQ ID NO: 146347 - DNA, 35 bp, Artificial Sequence
  Synthetic oligonucleotide
atgtgcaccccgctttccacccataactcagtccc

SEQ ID NO: 146348 - DNA, 35 bp, Artificial Sequence
  Synthetic oligonucleotide
gccacccgacttggccagttaaggcccgtccctcc

SEQ ID NO: 146349 - DNA, 35 bp, Artificial Sequence
  Synthetic oligonucleotide
agctcacccgcctgtgcatcgagccccgagcctcc

SEQ ID NO: 146350 - DNA, 35 bp, Artificial Sequence
  Synthetic oligonucleotide
tcgcctgtcagccctgttcccgtttacgtacccgc

SEQ ID NO: 146351 - DNA, 35 bp, Artificial Sequence
  Synthetic oligonucleotide
agacaacatgcctggccttaatatgccacccccgc

SEQ ID NO: 146352 - DNA, 35 bp, Artificial Sequence
  Synthetic oligonucleotide
ttccgatcaatgcccgtcggttccacgctctctgc

SEQ ID NO: 146353 - DNA, 35 bp, Artificial Sequence
  Synthetic oligonucleotide
gtacaccgtgctatccttccggactcgatctttgc

SEQ ID NO: 146354 - DNA, 35 bp, Artificial Sequence
  Synthetic oligonucleotide
gttcactgtacctgtgcttacgtcgtccatacctc

SEQ ID NO: 146355 - DNA, 35 bp, Artificial Sequence
  Synthetic oligonucleotide
gagcagacatgaccgcgcactaagctccatccctc

SEQ ID NO: 146356 - DNA, 36 bp, Artificial Sequence
  Synthetic oligonucleotide
gataggcgctgttgctgatcaagttctccctctgtc

SEQ ID NO: 146357 - DNA, 35 bp, Artificial Sequence
  Synthetic oligonucleotide
tagcctaccgacccgcgatctccaggcgacttttc

SEQ ID NO: 146358 - DNA, 35 bp, Artificial Sequence
  Synthetic oligonucleotide
gactccggtctctgtgttcattttacccttcccag

SEQ ID NO: 146359 - DNA, 35 bp, Artificial Sequence
  Synthetic oligonucleotide
gcaccccgctgaccgacccaactatctatgtttag

SEQ ID NO: 146360 - DNA, 35 bp, Artificial Sequence
  Synthetic oligonucleotide
gatgatcagcctcctattttccacacactctcacg

SEQ ID NO: 146361 - DNA, 35 bp, Artificial Sequence
  Synthetic oligonucleotide
gggaggcgcagagaactccactacccgctccaccg

SEQ ID NO: 146362 - DNA, 35 bp, Artificial Sequence
  Synthetic oligonucleotide
ttataggccccctgtcgcgttgtcttttcttcccg

SEQ ID NO: 146363 - DNA, 35 bp, Artificial Sequence
  Synthetic oligonucleotide
ggagtggggcacgagaaacaggatggttgggagcg

SEQ ID NO: 146364 - DNA, 35 bp, Artificial Sequence
  Synthetic oligonucleotide
gtggggacgggggtgaagtaactgataaacacggg

SEQ ID NO: 146365 - DNA, 35 bp, Artificial Sequence
  Synthetic oligonucleotide
tctcgcctcactattcccggcccctttgctgcctg

SEQ ID NO: 146366 - DNA, 36 bp, Artificial Sequence
  Synthetic oligonucleotide
ttgcccacccaactgaccgccccaactgctagcact

SEQ ID NO: 146367 - DNA, 35 bp, Artificial Sequence
  Synthetic oligonucleotide
tcccgtgacgcccccccgaatcccaccgccagtct

SEQ ID NO: 146368 - DNA, 35 bp, Artificial Sequence
  Synthetic oligonucleotide
gtccttcatcccgccccatctaacagtgcaactgt

SEQ ID NO: 146369 - DNA, 35 bp, Artificial Sequence
  Synthetic oligonucleotide
gctatgttccatagcacccaacatctgccactttt

SEQ ID NO: 146370 - DNA, 36 bp, Artificial Sequence
  Synthetic oligonucleotide
ccaaccagcctcaccgatcctctaggctgacctaaa

SEQ ID NO: 146371 - DNA, 36 bp, Artificial Sequence
  Synthetic oligonucleotide
tacctgccgggggggggtaaaatgatggggagggaa

SEQ ID NO: 146372 - DNA, 36 bp, Artificial Sequence
  Synthetic oligonucleotide
tatgccacccgtccttctattcctgccgtaaacgca

SEQ ID NO: 146373 - DNA, 37 bp, Artificial Sequence
  Synthetic oligonucleotide
gacaccgggggggtgaccttggggaaggggaagtaga

SEQ ID NO: 146374 - DNA, 36 bp, Artificial Sequence
  Synthetic oligonucleotide
gacgctgtacctgcccatcctcaccccgttgcccga

SEQ ID NO: 146375 - DNA, 37 bp, Artificial Sequence
  Synthetic oligonucleotide
gaccactcgcccccctttttgtgattgccgaaatcga

SEQ ID NO: 146376 - DNA, 37 bp, Artificial Sequence
  Synthetic oligonucleotide
gaagagccgcagggagggatcgtgggcgggacatcga

SEQ ID NO: 146377 - DNA, 37 bp, Artificial Sequence
  Synthetic oligonucleotide
gtagctcatgggggaacgggagggccgggtatgtcga

SEQ ID NO: 146378 - DNA, 36 bp, Artificial Sequence
  Synthetic oligonucleotide
gggttcggggcatctgggggagggagggggaaggga

SEQ ID NO: 146379 - DNA, 37 bp, Artificial Sequence
  Synthetic oligonucleotide
gcctgtacattgccgcctaacccctccattacttgga

SEQ ID NO: 146380 - DNA, 38 bp, Artificial Sequence
  Synthetic oligonucleotide
tccccggtcgctggtttgatcagcctttctcttcctga

SEQ ID NO: 146381 - DNA, 37 bp, Artificial Sequence
  Synthetic oligonucleotide
ggagtggcggagcgaatggtgggtcggggggctctga

SEQ ID NO: 146382 - DNA, 38 bp, Artificial Sequence
  Synthetic oligonucleotide
ggtggtggaggggctggaaggcggaattctagtagtga

SEQ ID NO: 146383 - DNA, 38 bp, Artificial Sequence
  Synthetic oligonucleotide
taagggtgggggagaagggagtggcgaagttgacgtga

SEQ ID NO: 146384 - DNA, 34 bp, Artificial Sequence
  Synthetic oligonucleotide
tagggatgggggggggataatgagtggacggtga

SEQ ID NO: 146385 - DNA, 38 bp, Artificial Sequence
  Synthetic oligonucleotide
atcaccatctatccccctcgcacctgtcaagagcttga

SEQ ID NO: 146386 - DNA, 36 bp, Artificial Sequence
  Synthetic oligonucleotide
tcgcgccgttgctctgttggaccctcttcacccgta

SEQ ID NO: 146387 - DNA, 36 bp, Artificial Sequence
  Synthetic oligonucleotide
tgttccccaatcctgtctaactcacgttgccttgta

SEQ ID NO: 146388 - DNA, 36 bp, Artificial Sequence
  Synthetic oligonucleotide
acccgcccccaacactcccgtccggacgaagtatta

SEQ ID NO: 146389 - DNA, 35 bp, Artificial Sequence
  Synthetic oligonucleotide
atcccacctcaatcgtgtggcagaggtctgcccac

SEQ ID NO: 146390 - DNA, 35 bp, Artificial Sequence
  Synthetic oligonucleotide
tgctgaccgcctagcatatggaatatccacctccc

SEQ ID NO: 146391 - DNA, 35 bp, Artificial Sequence
  Synthetic oligonucleotide
acacgctgcccatcttctctgttgctggatttccc

SEQ ID NO: 146392 - DNA, 35 bp, Artificial Sequence
  Synthetic oligonucleotide
gttcaacatctgtaggcgcatatttacgacccgcc

SEQ ID NO: 146393 - DNA, 35 bp, Artificial Sequence
  Synthetic oligonucleotide
gtcgcccctacgcccaactcccacgcatgtgctcc

SEQ ID NO: 146394 - DNA, 35 bp, Artificial Sequence
  Synthetic oligonucleotide
ttcagccccgattcgtgatgtaccgtccctccagc

SEQ ID NO: 146395 - DNA, 35 bp, Artificial Sequence
  Synthetic oligonucleotide
agctcgcacacgcgttccataccccatttatccgc

SEQ ID NO: 146396 - DNA, 35 bp, Artificial Sequence
  Synthetic oligonucleotide
gagcagcaccatcctgcccccacggccccactcgc

SEQ ID NO: 146397 - DNA, 35 bp, Artificial Sequence
  Synthetic oligonucleotide
tcagcccacgcctcaacccagtaccatcgcaaatc

SEQ ID NO: 146398 - DNA, 35 bp, Artificial Sequence
  Synthetic oligonucleotide
gctagctgccttttgcatgccacacccgctccctc

SEQ ID NO: 146399 - DNA, 35 bp, Artificial Sequence
  Synthetic oligonucleotide
aacgacaccccgcgaccccataggcgccccttctc

SEQ ID NO: 146400 - DNA, 35 bp, Artificial Sequence
  Synthetic oligonucleotide
tacaccctctgactcccgttttccgatttcctgtc

SEQ ID NO: 146401 - DNA, 35 bp, Artificial Sequence
  Synthetic oligonucleotide
taggggagcagggaagcgagggtgtgtgggacgag

SEQ ID NO: 146402 - DNA, 35 bp, Artificial Sequence
  Synthetic oligonucleotide
gtcccgtcctccgctaaataaacatacgccccccg

SEQ ID NO: 146403 - DNA, 35 bp, Artificial Sequence
  Synthetic oligonucleotide
tagtcctcaggccacttatcatgtctatcgccccg

SEQ ID NO: 146404 - DNA, 35 bp, Artificial Sequence
  Synthetic oligonucleotide
tgaccgccacagcctaccctggctccactcatgcg

SEQ ID NO: 146405 - DNA, 35 bp, Artificial Sequence
  Synthetic oligonucleotide
agtaccaccgccccgcctacttttgacacgcctcg

SEQ ID NO: 146406 - DNA, 35 bp, Artificial Sequence
  Synthetic oligonucleotide
gccgtcccatagttcctgtttattcgctgttctat

SEQ ID NO: 146407 - DNA, 35 bp, Artificial Sequence
  Synthetic oligonucleotide
acctgcccaactgcataggccaccccgaaagggct

SEQ ID NO: 146408 - DNA, 35 bp, Artificial Sequence
  Synthetic oligonucleotide
gctggggatcgaccagccgcctctcgcacaactct

SEQ ID NO: 146409 - DNA, 35 bp, Artificial Sequence
  Synthetic oligonucleotide
gcccgcccccctgtgccgcgtcctgtctcgcttct

SEQ ID NO: 146410 - DNA, 35 bp, Artificial Sequence
  Synthetic oligonucleotide
gacgccgtgcgcccgtgaacccgctgctccctggt

SEQ ID NO: 146411 - DNA, 35 bp, Artificial Sequence
  Synthetic oligonucleotide
cctacgaacaggttctcactcatgtgaatggcctt

SEQ ID NO: 146412 - DNA, 35 bp, Artificial Sequence
  Synthetic oligonucleotide
tcgccacatcctcaccgtgccgtgtcaggcctctt

SEQ ID NO: 146413 - DNA, 36 bp, Artificial Sequence
  Synthetic oligonucleotide
gcaccgaggcgctagtgttcaatgctccccccgtaa

SEQ ID NO: 146414 - DNA, 35 bp, Artificial Sequence
  Synthetic oligonucleotide
gacccgtgtacggtgtggcggagaggggggggtaa

SEQ ID NO: 146415 - DNA, 35 bp, Artificial Sequence
  Synthetic oligonucleotide
agcccagggctgtcctgcgttcactgtccttcaca

SEQ ID NO: 146416 - DNA, 36 bp, Artificial Sequence
  Synthetic oligonucleotide
atctacgtagggtgccttgctttcctccatttccca

SEQ ID NO: 146417 - DNA, 36 bp, Artificial Sequence
  Synthetic oligonucleotide
gttccccacagtggtttttatcgctcactacctgca

SEQ ID NO: 146418 - DNA, 36 bp, Artificial Sequence
  Synthetic oligonucleotide
gtgggctccgagagcgcatacctccctgtctcctca

SEQ ID NO: 146419 - DNA, 35 bp, Artificial Sequence
  Synthetic oligonucleotide
gttgggggtggttaggggggaacggggtggagtca

SEQ ID NO: 146420 - DNA, 35 bp, Artificial Sequence
  Synthetic oligonucleotide
aacaactgccgctctctattcttgccccagcttca

SEQ ID NO: 146421 - DNA, 35 bp, Artificial Sequence
  Synthetic oligonucleotide
gggggtgaggtgattggcaaggaggaggaggacga

SEQ ID NO: 146422 - DNA, 37 bp, Artificial Sequence
  Synthetic oligonucleotide
tgccacctcttgccctgttttgtttcttaggctacga

SEQ ID NO: 146423 - DNA, 35 bp, Artificial Sequence
  Synthetic oligonucleotide
gtaccccctgtgattgagtaaccacaccctctcga

SEQ ID NO: 146424 - DNA, 37 bp, Artificial Sequence
  Synthetic oligonucleotide
ggggaggatacgtggtgaggatggaaaggggtgtcga

SEQ ID NO: 146425 - DNA, 37 bp, Artificial Sequence
  Synthetic oligonucleotide
attggtgggaggggtacggggtggacacgtaagcgga

SEQ ID NO: 146426 - DNA, 37 bp, Artificial Sequence
  Synthetic oligonucleotide
gcccgggaggggtgtcctaggggcgcgtattagggga

SEQ ID NO: 146427 - DNA, 37 bp, Artificial Sequence
  Synthetic oligonucleotide
gatgggtggaagatggggagtggcggtcgcgggggga

SEQ ID NO: 146428 - DNA, 37 bp, Artificial Sequence
  Synthetic oligonucleotide
gtccggtaacggaatgaaggggaatgcgggtggggga

SEQ ID NO: 146429 - DNA, 37 bp, Artificial Sequence
  Synthetic oligonucleotide
gagttagccgcctccgccttgcgcccccgaccctgga

SEQ ID NO: 146430 - DNA, 37 bp, Artificial Sequence
  Synthetic oligonucleotide
agttgggggcgggttaataggggtgggatggaactga

SEQ ID NO: 146431 - DNA, 38 bp, Artificial Sequence
  Synthetic oligonucleotide
gcctctccaccatttgccccggacgaccctttgggtga

SEQ ID NO: 146432 - DNA, 38 bp, Artificial Sequence
  Synthetic oligonucleotide
acccgtcagacccctcagcccgcaccaccaccagttga

SEQ ID NO: 146433 - DNA, 36 bp, Artificial Sequence
  Synthetic oligonucleotide
gcattcagtcctgcagtaccgtacgccgctccccta

SEQ ID NO: 146434 - DNA, 35 bp, Artificial Sequence
  Synthetic oligonucleotide
tgtcgctcacgcacagggaatgggggggccgggta

SEQ ID NO: 146435 - DNA, 36 bp, Artificial Sequence
  Synthetic oligonucleotide
gccctctcggtttgctccgaaggaaccctactttta

SEQ ID NO: 146436 - DNA, 35 bp, Artificial Sequence
  Synthetic oligonucleotide
tccccgccgtccaccataacacttcctcttggcac

SEQ ID NO: 146437 - DNA, 35 bp, Artificial Sequence
  Synthetic oligonucleotide
tgtcgatctccgtggaaacctccgcctccctctac

SEQ ID NO: 146438 - DNA, 35 bp, Artificial Sequence
  Synthetic oligonucleotide
tgcgcggccgcctgtcttgtcctgcttcactcgcc

SEQ ID NO: 146439 - DNA, 35 bp, Artificial Sequence
  Synthetic oligonucleotide
gcaccccacccagcgatcagcgacgccactatgcc

SEQ ID NO: 146440 - DNA, 35 bp, Artificial Sequence
  Synthetic oligonucleotide
acacgcccgtcccctgcgatttggagtagccctcc

SEQ ID NO: 146441 - DNA, 35 bp, Artificial Sequence
  Synthetic oligonucleotide
gcccatgtccgctttgaacgcccatcgcctgtagc

SEQ ID NO: 146442 - DNA, 35 bp, Artificial Sequence
  Synthetic oligonucleotide
gtcgccgtctctgcccgtgccgtacccgacgcctc

SEQ ID NO: 146443 - DNA, 35 bp, Artificial Sequence
  Synthetic oligonucleotide
tgcaaccgcacgttaggcccatcagtcccgttgtc

SEQ ID NO: 146444 - DNA, 35 bp, Artificial Sequence
  Synthetic oligonucleotide
gaatcaggaggattgggaagagcaagaaggggagg

SEQ ID NO: 146445 - DNA, 35 bp, Artificial Sequence
  Synthetic oligonucleotide
gacatcacgcctcacacacgcattatcccatttgg

SEQ ID NO: 146446 - DNA, 35 bp, Artificial Sequence
  Synthetic oligonucleotide
acctcgcttccatccgcacgtcagcttggcaactg

SEQ ID NO: 146447 - DNA, 35 bp, Artificial Sequence
  Synthetic oligonucleotide
acccgtaccacctgcccgcctttcacggttccgtg

SEQ ID NO: 146448 - DNA, 35 bp, Artificial Sequence
  Synthetic oligonucleotide
acgaagaattaacgggagggcggaagggaggggtg

SEQ ID NO: 146449 - DNA, 35 bp, Artificial Sequence
  Synthetic oligonucleotide
tccgaccacactcccccgacagatccgcagtcttg

SEQ ID NO: 146450 - DNA, 36 bp, Artificial Sequence
  Synthetic oligonucleotide
taagtgccaggaacggaaaagggggatcagaggaaa

SEQ ID NO: 146451 - DNA, 36 bp, Artificial Sequence
  Synthetic oligonucleotide
gggggggaggggtatcaagtcgggataatggggcaa

SEQ ID NO: 146452 - DNA, 37 bp, Artificial Sequence
  Synthetic oligonucleotide
tacctgcgggggggggggtaaaatgctggggagggaa

SEQ ID NO: 146453 - DNA, 35 bp, Artificial Sequence
  Synthetic oligonucleotide
gcgagtatcggtgggtaaggggttgggagggctaa

SEQ ID NO: 146454 - DNA, 36 bp, Artificial Sequence
  Synthetic oligonucleotide
ggtcacttccgccggtcctgacactattgcctctaa

SEQ ID NO: 146455 - DNA, 36 bp, Artificial Sequence
  Synthetic oligonucleotide
tgtgagggtggtagggcgggggaaatgtgtggcaca

SEQ ID NO: 146456 - DNA, 36 bp, Artificial Sequence
  Synthetic oligonucleotide
acctaaccggccgtggtttcttccctcatgttcaca

SEQ ID NO: 146457 - DNA, 36 bp, Artificial Sequence
  Synthetic oligonucleotide
ttgcgtcaatgtgctcctgcggtctcccctcctaca

SEQ ID NO: 146458 - DNA, 36 bp, Artificial Sequence
  Synthetic oligonucleotide
gttcgcgtaccacatatggtaatcctgccctctcca

SEQ ID NO: 146459 - DNA, 36 bp, Artificial Sequence
  Synthetic oligonucleotide
gtgccaccgactttcgcccaacagacttcccgtcca

SEQ ID NO: 146460 - DNA, 36 bp, Artificial Sequence
  Synthetic oligonucleotide
gcgggccccgatcgcacctgtccttcccatccctca

SEQ ID NO: 146461 - DNA, 37 bp, Artificial Sequence
  Synthetic oligonucleotide
agacgctccctcatgttttcatccgccgcctaaacga

SEQ ID NO: 146462 - DNA, 37 bp, Artificial Sequence
  Synthetic oligonucleotide
ggtcaagccgctatctgcgaacatcctcacccaccga

SEQ ID NO: 146463 - DNA, 37 bp, Artificial Sequence
  Synthetic oligonucleotide
tctgccctggcccgccgctgatattactaccccccga

SEQ ID NO: 146464 - DNA, 36 bp, Artificial Sequence
  Synthetic oligonucleotide
tcgactccttggtctgcttttgatccgatcgcccga

SEQ ID NO: 146465 - DNA, 37 bp, Artificial Sequence
  Synthetic oligonucleotide
tgacgcttccctccgtatggtaatcacccgttcccga

SEQ ID NO: 146466 - DNA, 36 bp, Artificial Sequence
  Synthetic oligonucleotide
tccactgccatcatttcagttctcgccacacccgga

SEQ ID NO: 146467 - DNA, 37 bp, Artificial Sequence
  Synthetic oligonucleotide
accacacacctccgtacatgcctgtttcttctgggga

SEQ ID NO: 146468 - DNA, 38 bp, Artificial Sequence
  Synthetic oligonucleotide
atcgtcccgcccacgcttgctcgccgcactacacctga

SEQ ID NO: 146469 - DNA, 38 bp, Artificial Sequence
  Synthetic oligonucleotide
gacacgccttccattgctttaatccggttctcgcctga

SEQ ID NO: 146470 - DNA, 38 bp, Artificial Sequence
  Synthetic oligonucleotide
gaggtaactccgcagcctctcctgtccgccattcctga

SEQ ID NO: 146471 - DNA, 38 bp, Artificial Sequence
  Synthetic oligonucleotide
gactggggaaggagtcgggttgatggaggcgatggtga

SEQ ID NO: 146472 - DNA, 36 bp, Artificial Sequence
  Synthetic oligonucleotide
gaggagggagtggcggggttagagctgcacgggata

SEQ ID NO: 146473 - DNA, 36 bp, Artificial Sequence
  Synthetic oligonucleotide
ttccaccgacgacatctggtctccttgttttcccta

SEQ ID NO: 146474 - DNA, 35 bp, Artificial Sequence
  Synthetic oligonucleotide
tgacctttcaccgtcaccatccgttttgtcgcgta

SEQ ID NO: 146475 - DNA, 36 bp, Artificial Sequence
  Synthetic oligonucleotide
gtggagtggggcgggaggggaaaagaaagtggatta

SEQ ID NO: 146476 - DNA, 35 bp, Artificial Sequence
  Synthetic oligonucleotide
tgtgcgtgtagactgtacccctatgcccccttgac

SEQ ID NO: 146477 - DNA, 35 bp, Artificial Sequence
  Synthetic oligonucleotide
ccgaccccctcgagttctattcacctgcctattac

SEQ ID NO: 146478 - DNA, 35 bp, Artificial Sequence
  Synthetic oligonucleotide
tgctcctgctctatttggtgatttctgtcccgccc

SEQ ID NO: 146479 - DNA, 35 bp, Artificial Sequence
  Synthetic oligonucleotide
gcgtgtcgcggccatgtcttcttcctagttccgcc

SEQ ID NO: 146480 - DNA, 35 bp, Artificial Sequence
  Synthetic oligonucleotide
gcgtaactccgttatcatctgttctcccattgtcc

SEQ ID NO: 146481 - DNA, 35 bp, Artificial Sequence
  Synthetic oligonucleotide
tgtccttatccgctacctggttctatctgacttcc

SEQ ID NO: 146482 - DNA, 35 bp, Artificial Sequence
  Synthetic oligonucleotide
aacgcgctccctgaatgacttcctcttccatccgc

SEQ ID NO: 146483 - DNA, 35 bp, Artificial Sequence
  Synthetic oligonucleotide
gatgcacacttcgcccgcttttgatcgacccctgc

SEQ ID NO: 146484 - DNA, 35 bp, Artificial Sequence
  Synthetic oligonucleotide
attcacgtcagttttacctcagtccgcccgcttgc

SEQ ID NO: 146485 - DNA, 35 bp, Artificial Sequence
  Synthetic oligonucleotide
atccccgatcctgttgggcccttgcctgtgcgctc

SEQ ID NO: 146486 - DNA, 35 bp, Artificial Sequence
  Synthetic oligonucleotide
tagatccgctcacatcggaacacgtactttcgctc

SEQ ID NO: 146487 - DNA, 35 bp, Artificial Sequence
  Synthetic oligonucleotide
attggccctcgaatgggacatacttacccgccttc

SEQ ID NO: 146488 - DNA, 35 bp, Artificial Sequence
  Synthetic oligonucleotide
tccgtcatggtaccagtccgccactcacttctttc

SEQ ID NO: 146489 - DNA, 35 bp, Artificial Sequence
  Synthetic oligonucleotide
gaagagatgaggggggagtgatgtcagagagtgag

SEQ ID NO: 146490 - DNA, 35 bp, Artificial Sequence
  Synthetic oligonucleotide
ggaacgatgggccgggggggagcgaacgggcctag

SEQ ID NO: 146491 - DNA, 35 bp, Artificial Sequence
  Synthetic oligonucleotide
acctcccttaccacccctgcacgcgatgactaccg

SEQ ID NO: 146492 - DNA, 35 bp, Artificial Sequence
  Synthetic oligonucleotide
tccaccactgcgctcccaccccacttacattaccg

SEQ ID NO: 146493 - DNA, 35 bp, Artificial Sequence
  Synthetic oligonucleotide
tctgcgcagtgaacatcccaccagtttccccgccg

SEQ ID NO: 146494 - DNA, 35 bp, Artificial Sequence
  Synthetic oligonucleotide
acgctatcgccgccgctaccccctcgattcatctg

SEQ ID NO: 146495 - DNA, 35 bp, Artificial Sequence
  Synthetic oligonucleotide
ggacgatctggccttctccaccgcctcatcctcat

SEQ ID NO: 146496 - DNA, 35 bp, Artificial Sequence
  Synthetic oligonucleotide
acgctgggtaccagcaagttcttacaagccctcct

SEQ ID NO: 146497 - DNA, 35 bp, Artificial Sequence
  Synthetic oligonucleotide
tgacactaaggcgtccaccgtcctccctccgtcct

SEQ ID NO: 146498 - DNA, 35 bp, Artificial Sequence
  Synthetic oligonucleotide
atactgcgttggcctcgcttttgaccctctcttgt

SEQ ID NO: 146499 - DNA, 35 bp, Artificial Sequence
  Synthetic oligonucleotide
accgctgttgcccgtaccgtaccactccttgcatt

SEQ ID NO: 146500 - DNA, 35 bp, Artificial Sequence
  Synthetic oligonucleotide
gccgtcgattgccaattccccagtcggtccccctt

SEQ ID NO: 146501 - DNA, 36 bp, Artificial Sequence
  Synthetic oligonucleotide
agtaccctgccatcctctgctcccgacacttatcaa

SEQ ID NO: 146502 - DNA, 36 bp, Artificial Sequence
  Synthetic oligonucleotide
gttcaccatccagctatatttcgcggtctgtttcaa

SEQ ID NO: 146503 - DNA, 36 bp, Artificial Sequence
  Synthetic oligonucleotide
ttcctcacgccgagtgagtccattccttgcctaaca

SEQ ID NO: 146504 - DNA, 35 bp, Artificial Sequence
  Synthetic oligonucleotide
gaagccctggctatagtacccgccccaccgcgcca

SEQ ID NO: 146505 - DNA, 35 bp, Artificial Sequence
  Synthetic oligonucleotide
tgtccctgccgcctgtcttatcccattattgtcca

SEQ ID NO: 146506 - DNA, 37 bp, Artificial Sequence
  Synthetic oligonucleotide
gagctgtgagcggaggggggaaggtagaaatcaaaga

SEQ ID NO: 146507 - DNA, 35 bp, Artificial Sequence
  Synthetic oligonucleotide
gtagatgggatgggagggcatgagggtcaggtaga

SEQ ID NO: 146508 - DNA, 36 bp, Artificial Sequence
  Synthetic oligonucleotide
tggttgccctgttctcccgctccctgtgtgccccga

SEQ ID NO: 146509 - DNA, 33 bp, Artificial Sequence
  Synthetic oligonucleotide
gcatactccacccctacgtcgcccccccttcga

SEQ ID NO: 146510 - DNA, 37 bp, Artificial Sequence
  Synthetic oligonucleotide
gccatcccctccgtattcgctgcccccgatgacatga

SEQ ID NO: 146511 - DNA, 37 bp, Artificial Sequence
  Synthetic oligonucleotide
tccgccctctcttcctttgccgtactgggcaccatga

SEQ ID NO: 146512 - DNA, 37 bp, Artificial Sequence
  Synthetic oligonucleotide
gattggcgcccaatgtaccccgcccccagtgccctga

SEQ ID NO: 146513 - DNA, 37 bp, Artificial Sequence
  Synthetic oligonucleotide
gccccacccatcttttgtgccctctttctccgggtga

SEQ ID NO: 146514 - DNA, 35 bp, Artificial Sequence
  Synthetic oligonucleotide
tcccgcccctgtcggacttcccttctgtacatata

SEQ ID NO: 146515 - DNA, 36 bp, Artificial Sequence
  Synthetic oligonucleotide
aagggaagggttcggtgggggaagtggcatgtagta

SEQ ID NO: 146516 - DNA, 35 bp, Artificial Sequence
  Synthetic oligonucleotide
tacccaccgcttcggtcctcggtaccgcccttcac

SEQ ID NO: 146517 - DNA, 35 bp, Artificial Sequence
  Synthetic oligonucleotide
agcatccccgtacccctaggtgacacttacgcccc

SEQ ID NO: 146518 - DNA, 35 bp, Artificial Sequence
  Synthetic oligonucleotide
accactctggaggtattagccctactatctcgccc

SEQ ID NO: 146519 - DNA, 35 bp, Artificial Sequence
  Synthetic oligonucleotide
tgtacccgccccgtagagcttgaacgcgtattccc

SEQ ID NO: 146520 - DNA, 35 bp, Artificial Sequence
  Synthetic oligonucleotide
ggagtccgctgccctgccaaaatacagccctgtcc

SEQ ID NO: 146521 - DNA, 35 bp, Artificial Sequence
  Synthetic oligonucleotide
tcttgtagacgctgtatctcttaccgttgcctctc

SEQ ID NO: 146522 - DNA, 35 bp, Artificial Sequence
  Synthetic oligonucleotide
tccagcgcccttcgttgcttcacttatgcctaccg

SEQ ID NO: 146523 - DNA, 35 bp, Artificial Sequence
  Synthetic oligonucleotide
gaagggccaagaagaacgaagggggcagacaagtg

SEQ ID NO: 146524 - DNA, 35 bp, Artificial Sequence
  Synthetic oligonucleotide
gacaagagggggagaggagatagaatcggagtgtg

SEQ ID NO: 146525 - DNA, 35 bp, Artificial Sequence
  Synthetic oligonucleotide
aactagcgtgggatcctgttcgcgtccgttactat

SEQ ID NO: 146526 - DNA, 35 bp, Artificial Sequence
  Synthetic oligonucleotide
gagtcagggagtagggcgggtcggggattgtcact

SEQ ID NO: 146527 - DNA, 34 bp, Artificial Sequence
  Synthetic oligonucleotide
tgtgaagtccgtcgacgctcccgctattacgcct

SEQ ID NO: 146528 - DNA, 35 bp, Artificial Sequence
  Synthetic oligonucleotide
gctggggctcccgaactctgccgctgaactttcct

SEQ ID NO: 146529 - DNA, 35 bp, Artificial Sequence
  Synthetic oligonucleotide
tacatctcgctcggtattggctccattctcttgct

SEQ ID NO: 146530 - DNA, 35 bp, Artificial Sequence
  Synthetic oligonucleotide
tatgtgccatctctagcagcgtgcttacgcactct

SEQ ID NO: 146531 - DNA, 35 bp, Artificial Sequence
  Synthetic oligonucleotide
gtggcctcacactgctaatctcaccgtttctcggt

SEQ ID NO: 146532 - DNA, 35 bp, Artificial Sequence
  Synthetic oligonucleotide
ggattcgcgccacccacctcacccatccagtcttt

SEQ ID NO: 146533 - DNA, 35 bp, Artificial Sequence
  Synthetic oligonucleotide
ttgagcgacgctcgtgctacccgccaacttcccaa

SEQ ID NO: 146534 - DNA, 36 bp, Artificial Sequence
  Synthetic oligonucleotide
gcatccaccgcccgtaccgccacttaacgctttcaa

SEQ ID NO: 146535 - DNA, 35 bp, Artificial Sequence
  Synthetic oligonucleotide
tgctatgtccatctacacctcgccgcccttgggaa

SEQ ID NO: 146536 - DNA, 35 bp, Artificial Sequence
  Synthetic oligonucleotide
tgtacggaactgtgccctacccccgtttcccacca

SEQ ID NO: 146537 - DNA, 36 bp, Artificial Sequence
  Synthetic oligonucleotide
aacgcgctcacaccctcgcctatgcccaccgcacca

SEQ ID NO: 146538 - DNA, 35 bp, Artificial Sequence
  Synthetic oligonucleotide
tgtgtacgttcggcgtccctttccgcgcactctca

SEQ ID NO: 146539 - DNA, 35 bp, Artificial Sequence
  Synthetic oligonucleotide
gtgcgccttcttgtttttgcccctcgttatattca

SEQ ID NO: 146540 - DNA, 37 bp, Artificial Sequence
  Synthetic oligonucleotide
ttggactccagcgcgttcttcccagcttccttgccga

SEQ ID NO: 146541 - DNA, 37 bp, Artificial Sequence
  Synthetic oligonucleotide
aggatagggaaggaggacttgagagggcaaagaagga

SEQ ID NO: 146542 - DNA, 37 bp, Artificial Sequence
  Synthetic oligonucleotide
tagaccacggggcgggtgggaacgacggtgggtagga

SEQ ID NO: 146543 - DNA, 37 bp, Artificial Sequence
  Synthetic oligonucleotide
aatggggtcacggggggaaaagggttggcggtatgga

SEQ ID NO: 146544 - DNA, 38 bp, Artificial Sequence
  Synthetic oligonucleotide
attcccccgcccacgtgcccccgctcccaggagactga

SEQ ID NO: 146545 - DNA, 37 bp, Artificial Sequence
  Synthetic oligonucleotide
acactccgccggtcacctaccctcgtgctattcctga

SEQ ID NO: 146546 - DNA, 38 bp, Artificial Sequence
  Synthetic oligonucleotide
accaaccccaacgtgcccactgacctccagtaatctga

SEQ ID NO: 146547 - DNA, 37 bp, Artificial Sequence
  Synthetic oligonucleotide
gtcctccgcaccactgagctccacaccccgaccgtga

SEQ ID NO: 146548 - DNA, 38 bp, Artificial Sequence
  Synthetic oligonucleotide
aatgccgccgccgccttagcgttttgatcttccgttga

SEQ ID NO: 146549 - DNA, 37 bp, Artificial Sequence
  Synthetic oligonucleotide
taaagtgcaagggcgggggggagtccggaagggttga

SEQ ID NO: 146550 - DNA, 38 bp, Artificial Sequence
  Synthetic oligonucleotide
gccgaccttcgccggtttggtctcccctttcctgttga

SEQ ID NO: 146551 - DNA, 35 bp, Artificial Sequence
  Synthetic oligonucleotide
gttacatccacgcagcgtatattccccgggtgcac

SEQ ID NO: 146552 - DNA, 35 bp, Artificial Sequence
  Synthetic oligonucleotide
atgtcccaccgcatagacttcgttagcccctcacc

SEQ ID NO: 146553 - DNA, 35 bp, Artificial Sequence
  Synthetic oligonucleotide
gaaacagtactgccctgcctaccataacgccgacc

SEQ ID NO: 146554 - DNA, 35 bp, Artificial Sequence
  Synthetic oligonucleotide
gaagccctgcacctctcctccgcactcactgtacc

SEQ ID NO: 146555 - DNA, 35 bp, Artificial Sequence
  Synthetic oligonucleotide
gtcacaccttcttgcgaggaccggctttctttacc

SEQ ID NO: 146556 - DNA, 35 bp, Artificial Sequence
  Synthetic oligonucleotide
gacgacgttgacccgttctcccgccttatttgccc

SEQ ID NO: 146557 - DNA, 35 bp, Artificial Sequence
  Synthetic oligonucleotide
gatacctctctgcccgtaaaacggttctgtttccc

SEQ ID NO: 146558 - DNA, 35 bp, Artificial Sequence
  Synthetic oligonucleotide
gtaccacgaccgtctatccctcgccacaggtcgcc

SEQ ID NO: 146559 - DNA, 35 bp, Artificial Sequence
  Synthetic oligonucleotide
gcgccccccggttttagtatctttctccgattgcc

SEQ ID NO: 146560 - DNA, 35 bp, Artificial Sequence
  Synthetic oligonucleotide
gccccaccggatgcctcttgcaacgattcctatcc

SEQ ID NO: 146561 - DNA, 35 bp, Artificial Sequence
  Synthetic oligonucleotide
tctgccggttgtcctcttaacggttctggctttcc

SEQ ID NO: 146562 - DNA, 35 bp, Artificial Sequence
  Synthetic oligonucleotide
gacacggttgcgtgcgagacctccccacccgccgc

SEQ ID NO: 146563 - DNA, 35 bp, Artificial Sequence
  Synthetic oligonucleotide
ttcgacactacctcccactttagacagctgccctc

SEQ ID NO: 146564 - DNA, 35 bp, Artificial Sequence
  Synthetic oligonucleotide
agacgccgtagggccccatggtagttccctccctc

SEQ ID NO: 146565 - DNA, 35 bp, Artificial Sequence
  Synthetic oligonucleotide
gtttgtaccatccgcctggccaccaacagatcctc

SEQ ID NO: 146566 - DNA, 35 bp, Artificial Sequence
  Synthetic oligonucleotide
ttcgggcctactaacctgctataaccgattccttc

SEQ ID NO: 146567 - DNA, 35 bp, Artificial Sequence
  Synthetic oligonucleotide
atcgcaagctgttatttgtcccacccctctgatcg

SEQ ID NO: 146568 - DNA, 35 bp, Artificial Sequence
  Synthetic oligonucleotide
gagagcttaacagccgctatacccgccccttttcg

SEQ ID NO: 146569 - DNA, 35 bp, Artificial Sequence
  Synthetic oligonucleotide
gtggattgcccgtctgtctctctccttccccaggg

SEQ ID NO: 146570 - DNA, 37 bp, Artificial Sequence
  Synthetic oligonucleotide
gccccgcctcgtcttccgtctacccccacgttctttg

SEQ ID NO: 146571 - DNA, 35 bp, Artificial Sequence
  Synthetic oligonucleotide
gggtaagcctctcgttacatccgccgtcccgcact

SEQ ID NO: 146572 - DNA, 35 bp, Artificial Sequence
  Synthetic oligonucleotide
gctgatcgccgccgtgagaagtccttgtctcctct

SEQ ID NO: 146573 - DNA, 35 bp, Artificial Sequence
  Synthetic oligonucleotide
agaccccacctcaccgaacaggaccctccctctct

SEQ ID NO: 146574 - DNA, 35 bp, Artificial Sequence
  Synthetic oligonucleotide
gagccgtcactcacgccgtatctgttcccctgagt

SEQ ID NO: 146575 - DNA, 35 bp, Artificial Sequence
  Synthetic oligonucleotide
gcgaaagttacgggggggaagagcggacaagtatt

SEQ ID NO: 146576 - DNA, 35 bp, Artificial Sequence
  Synthetic oligonucleotide
gtgtcccgcctggtctcctgtaactgctactcctt

SEQ ID NO: 146577 - DNA, 35 bp, Artificial Sequence
  Synthetic oligonucleotide
gttcccccatcgatccgtatactgtctattgtctt

SEQ ID NO: 146578 - DNA, 35 bp, Artificial Sequence
  Synthetic oligonucleotide
ggtccaccccccatgttgagccctttctcattttt

SEQ ID NO: 146579 - DNA, 36 bp, Artificial Sequence
  Synthetic oligonucleotide
accacacttctcccgttcctgtctcagttctgagaa

SEQ ID NO: 146580 - DNA, 36 bp, Artificial Sequence
  Synthetic oligonucleotide
acatcccctgcctggcccctttataaatcgccgcca

SEQ ID NO: 146581 - DNA, 35 bp, Artificial Sequence
  Synthetic oligonucleotide
tcgatcgctgtccctcctttgattatctccgtcca

SEQ ID NO: 146582 - DNA, 35 bp, Artificial Sequence
  Synthetic oligonucleotide
aatccatcccagcgtgacgcccccactgctactca

SEQ ID NO: 146583 - DNA, 37 bp, Artificial Sequence
  Synthetic oligonucleotide
gccgccacgctgccctccgtgattatcatcattacga

SEQ ID NO: 146584 - DNA, 35 bp, Artificial Sequence
  Synthetic oligonucleotide
gttgcgtactcagggctatcgtccaacctccccga

SEQ ID NO: 146585 - DNA, 37 bp, Artificial Sequence
  Synthetic oligonucleotide
tgccaccacccgcttgtacacttatgtcattgctcga

SEQ ID NO: 146586 - DNA, 37 bp, Artificial Sequence
  Synthetic oligonucleotide
tgcatggcgccccttcgtctaccataccgtccttcga

SEQ ID NO: 146587 - DNA, 35 bp, Artificial Sequence
  Synthetic oligonucleotide
gcccacccgccttcactgatcttgccacctacgga

SEQ ID NO: 146588 - DNA, 37 bp, Artificial Sequence
  Synthetic oligonucleotide
gactccccttctgtccactctagcatatcccctggga

SEQ ID NO: 146589 - DNA, 37 bp, Artificial Sequence
  Synthetic oligonucleotide
atgctcccccaggctcctaccgtgacagccgcatgga

SEQ ID NO: 146590 - DNA, 36 bp, Artificial Sequence
  Synthetic oligonucleotide
atagccctgcctccccgacgtcgctaggcccttgga

SEQ ID NO: 146591 - DNA, 35 bp, Artificial Sequence
  Synthetic oligonucleotide
accacctaccaatgggctacctactatctccatga

SEQ ID NO: 146592 - DNA, 36 bp, Artificial Sequence
  Synthetic oligonucleotide
gatgccatcatgctaccgggcccaatctttccctga

SEQ ID NO: 146593 - DNA, 37 bp, Artificial Sequence
  Synthetic oligonucleotide
tccacctccgactaacgaacagagttctctttcctga

SEQ ID NO: 146594 - DNA, 38 bp, Artificial Sequence
  Synthetic oligonucleotide
gagacgtagggctgagggaagggccgggagagacgtga

SEQ ID NO: 146595 - DNA, 38 bp, Artificial Sequence
  Synthetic oligonucleotide
tcaacccgccgcctaggtccgaccctatccacttgtga

SEQ ID NO: 146596 - DNA, 35 bp, Artificial Sequence
  Synthetic oligonucleotide
aatgcccaactgcttacccgatccatctgctggta

SEQ ID NO: 146597 - DNA, 35 bp, Artificial Sequence
  Synthetic oligonucleotide
gctgccccataccggtttgctccttagtttgttta

SEQ ID NO: 146598 - DNA, 35 bp, Artificial Sequence
  Synthetic oligonucleotide
gccactgcctccaatgcttccgcgtaaaccagcac

SEQ ID NO: 146599 - DNA, 35 bp, Artificial Sequence
  Synthetic oligonucleotide
tcgctgccccggttggcctccctccatatttgcac

SEQ ID NO: 146600 - DNA, 35 bp, Artificial Sequence
  Synthetic oligonucleotide
gcgaacgacgcattccttagacctgagtacccccc

SEQ ID NO: 146601 - DNA, 35 bp, Artificial Sequence
  Synthetic oligonucleotide
tgtttcgcgccttccactggtcctacgcgccgccc

SEQ ID NO: 146602 - DNA, 35 bp, Artificial Sequence
  Synthetic oligonucleotide
ttgagcgaagctcgacctctactcagccctatccc

SEQ ID NO: 146603 - DNA, 35 bp, Artificial Sequence
  Synthetic oligonucleotide
tggagccccttgaccgctcaccacgtcctgtcgcc

SEQ ID NO: 146604 - DNA, 35 bp, Artificial Sequence
  Synthetic oligonucleotide
tcccaggcatccacttcacatatcacgcgccctcc

SEQ ID NO: 146605 - DNA, 35 bp, Artificial Sequence
  Synthetic oligonucleotide
tcaaccacatttgactcgcatactacgactgctcc

SEQ ID NO: 146606 - DNA, 35 bp, Artificial Sequence
  Synthetic oligonucleotide
tcatcgcctgttttctgcagttacctgtactttcc

SEQ ID NO: 146607 - DNA, 35 bp, Artificial Sequence
  Synthetic oligonucleotide
gcctcgccccgggatcccttctccccctagattgc

SEQ ID NO: 146608 - DNA, 35 bp, Artificial Sequence
  Synthetic oligonucleotide
atccctccacttccgttctgtgtcaacacttttgc

SEQ ID NO: 146609 - DNA, 35 bp, Artificial Sequence
  Synthetic oligonucleotide
tccaaggccctcccgactcacacattatgcacctc

SEQ ID NO: 146610 - DNA, 35 bp, Artificial Sequence
  Synthetic oligonucleotide
tacgttcgcctcatctcggaaatgctcgtactctc

SEQ ID NO: 146611 - DNA, 35 bp, Artificial Sequence
  Synthetic oligonucleotide
gttcactggtagcgcatagccaccgtcgctctctc

SEQ ID NO: 146612 - DNA, 35 bp, Artificial Sequence
  Synthetic oligonucleotide
acctgatcgctacgtatagtttcctccccccagtc

SEQ ID NO: 146613 - DNA, 35 bp, Artificial Sequence
  Synthetic oligonucleotide
tttgccctgataaccgtcactccctgcttaccgtc

SEQ ID NO: 146614 - DNA, 35 bp, Artificial Sequence
  Synthetic oligonucleotide
gacacgaggggcgggggagagtacgtcgatggaag

SEQ ID NO: 146615 - DNA, 35 bp, Artificial Sequence
  Synthetic oligonucleotide
gggtcatgaagagaggggagaaggcgaagaaatgg

SEQ ID NO: 146616 - DNA, 35 bp, Artificial Sequence
  Synthetic oligonucleotide
tcactcgcgcattcttttttggttccctactgtgg

SEQ ID NO: 146617 - DNA, 35 bp, Artificial Sequence
  Synthetic oligonucleotide
acgcactgcgcgtaactgttattcctccgtacctg

SEQ ID NO: 146618 - DNA, 35 bp, Artificial Sequence
  Synthetic oligonucleotide
acattcccgcctgttcgccgcggagacaggatact

SEQ ID NO: 146619 - DNA, 35 bp, Artificial Sequence
  Synthetic oligonucleotide
aacattccccgggtgcattcacgcagtctttacct

SEQ ID NO: 146620 - DNA, 35 bp, Artificial Sequence
  Synthetic oligonucleotide
aacaaccgacagtgcagccgatgcgacccctccct

SEQ ID NO: 146621 - DNA, 35 bp, Artificial Sequence
  Synthetic oligonucleotide
tacgccctccctatgttttttctagaatctactct

SEQ ID NO: 146622 - DNA, 35 bp, Artificial Sequence
  Synthetic oligonucleotide
gtccaatcactgctctcactgcctgaatcctggtt

SEQ ID NO: 146623 - DNA, 35 bp, Artificial Sequence
  Synthetic oligonucleotide
gatgcgctgtggctctttgaacaccttctcttttt

SEQ ID NO: 146624 - DNA, 36 bp, Artificial Sequence
  Synthetic oligonucleotide
tacctgccgggggggtgtaaaatgctggggagggaa

SEQ ID NO: 146625 - DNA, 36 bp, Artificial Sequence
  Synthetic oligonucleotide
tgaccatgctgcagaccgagcccccccactgcgaca

SEQ ID NO: 146626 - DNA, 36 bp, Artificial Sequence
  Synthetic oligonucleotide
gcttccacccagacgttacggtcttgtctctctgca

SEQ ID NO: 146627 - DNA, 36 bp, Artificial Sequence
  Synthetic oligonucleotide
aacgctcttgctgccccgttgttactcgtcctttca

SEQ ID NO: 146628 - DNA, 37 bp, Artificial Sequence
  Synthetic oligonucleotide
aagagtggggagaatagggaggggcgaggggtgcaga

SEQ ID NO: 146629 - DNA, 37 bp, Artificial Sequence
  Synthetic oligonucleotide
atcccaccgcccatggaatttccctacgtcgttacga

SEQ ID NO: 146630 - DNA, 34 bp, Artificial Sequence
  Synthetic oligonucleotide
ggacccacaccttccatgtcgctagcccccccga

SEQ ID NO: 146631 - DNA, 37 bp, Artificial Sequence
  Synthetic oligonucleotide
ggggcatgctccgtgccgtccctctcgcccttctcga

SEQ ID NO: 146632 - DNA, 37 bp, Artificial Sequence
  Synthetic oligonucleotide
aactggatgcagggaggaggatggatggtggtgggga

SEQ ID NO: 146633 - DNA, 37 bp, Artificial Sequence
  Synthetic oligonucleotide
gagtaagttcggggcggaaaacggggggagggatgga

SEQ ID NO: 146634 - DNA, 37 bp, Artificial Sequence
  Synthetic oligonucleotide
gcggaagggacgggaaggccagggaagtggggatgga

SEQ ID NO: 146635 - DNA, 37 bp, Artificial Sequence
  Synthetic oligonucleotide
tcaccattcgccatctgctagctggcctctccctgga

SEQ ID NO: 146636 - DNA, 38 bp, Artificial Sequence
  Synthetic oligonucleotide
agccccaccctccgctttgaataccctgttatcactga

SEQ ID NO: 146637 - DNA, 38 bp, Artificial Sequence
  Synthetic oligonucleotide
ggtcgacgggaggagaagcatcaggaaagggcgggtga

SEQ ID NO: 146638 - DNA, 37 bp, Artificial Sequence
  Synthetic oligonucleotide
atgcccttccgcctggcttaccctttgtctctcttga

SEQ ID NO: 146639 - DNA, 37 bp, Artificial Sequence
  Synthetic oligonucleotide
gccgccgcaccagcaccctattctgtacaccctttga

SEQ ID NO: 146640 - DNA, 38 bp, Artificial Sequence
  Synthetic oligonucleotide
tacgcacccggccgtcctattgcgccattcctttttga

SEQ ID NO: 146641 - DNA, 35 bp, Artificial Sequence
  Synthetic oligonucleotide
gcctcaccatccgctcgtagaccgaaccggttata

SEQ ID NO: 146642 - DNA, 35 bp, Artificial Sequence
  Synthetic oligonucleotide
gacaacttcgctgcccccgcaccccattagccgta

SEQ ID NO: 146643 - DNA, 36 bp, Artificial Sequence
  Synthetic oligonucleotide
aagtgcaaggggcggggtaaaggggtagcgggcgta

SEQ ID NO: 146644 - DNA, 36 bp, Artificial Sequence
  Synthetic oligonucleotide
tgcactactgatcccgccggccatgcttaccttgta

SEQ ID NO: 146645 - DNA, 35 bp, Artificial Sequence
  Synthetic oligonucleotide
tcatcatcgccccagcggtttttcccacgtagtac

SEQ ID NO: 146646 - DNA, 35 bp, Artificial Sequence
  Synthetic oligonucleotide
ttgggttccgcaccgatggcctcccccctctttac

SEQ ID NO: 146647 - DNA, 35 bp, Artificial Sequence
  Synthetic oligonucleotide
gacacctgtattggccgagccctacccctaagccc

SEQ ID NO: 146648 - DNA, 35 bp, Artificial Sequence
  Synthetic oligonucleotide
tcagctcgtactgattccatatcgcctgtcccgcc

SEQ ID NO: 146649 - DNA, 35 bp, Artificial Sequence
  Synthetic oligonucleotide
tgttgctactacttactaatgcccactgcgccgcc

SEQ ID NO: 146650 - DNA, 31 bp, Artificial Sequence
  Synthetic oligonucleotide
gcaacgtctagctactttggccttcatctcc

SEQ ID NO: 146651 - DNA, 34 bp, Artificial Sequence
  Synthetic oligonucleotide
ttagccgccccattgcttgttccatccgtcttcc

SEQ ID NO: 146652 - DNA, 35 bp, Artificial Sequence
  Synthetic oligonucleotide
ggggggcaaggggggaagggagtgccaaatatcgc

SEQ ID NO: 146653 - DNA, 35 bp, Artificial Sequence
  Synthetic oligonucleotide
acaccgccccgttccctatacgtctgcctactcgc

SEQ ID NO: 146654 - DNA, 35 bp, Artificial Sequence
  Synthetic oligonucleotide
tttgcgcgctggattgccactaccgttccaccctc

SEQ ID NO: 146655 - DNA, 35 bp, Artificial Sequence
  Synthetic oligonucleotide
gggggagggcgggggtgatagggcttccgttggtc

SEQ ID NO: 146656 - DNA, 35 bp, Artificial Sequence
  Synthetic oligonucleotide
gatcgagcccctgtgcgtttagcgggcctgctttc

SEQ ID NO: 146657 - DNA, 35 bp, Artificial Sequence
  Synthetic oligonucleotide
acgtggtgtgacgttgccgtttttagcctcttttc

SEQ ID NO: 146658 - DNA, 35 bp, Artificial Sequence
  Synthetic oligonucleotide
aacaccccccatgcctaattgaccttacgaatacg

SEQ ID NO: 146659 - DNA, 35 bp, Artificial Sequence
  Synthetic oligonucleotide
ttgcgcccatccgcgcaccttcttccctactcccg

SEQ ID NO: 146660 - DNA, 35 bp, Artificial Sequence
  Synthetic oligonucleotide
gttcctcgaatcccccgcatcccctgttaatgccg

SEQ ID NO: 146661 - DNA, 35 bp, Artificial Sequence
  Synthetic oligonucleotide
gcccggccacgcctcccctccgtttgtcccttccg

SEQ ID NO: 146662 - DNA, 35 bp, Artificial Sequence
  Synthetic oligonucleotide
ttacgcaacgcaatccctctccccgcccgttagcg

SEQ ID NO: 146663 - DNA, 35 bp, Artificial Sequence
  Synthetic oligonucleotide
gcccgccaggaagccacgttaccctccacctcgcg

SEQ ID NO: 146664 - DNA, 35 bp, Artificial Sequence
  Synthetic oligonucleotide
gagtacgtcggccgttcacatcgcctgtccatctg

SEQ ID NO: 146665 - DNA, 35 bp, Artificial Sequence
  Synthetic oligonucleotide
ttgagctctgcccgccctcccccattgcttacgtg

SEQ ID NO: 146666 - DNA, 35 bp, Artificial Sequence
  Synthetic oligonucleotide
gagggaacagggtaaggtagcggggaaggagtttg

SEQ ID NO: 146667 - DNA, 34 bp, Artificial Sequence
  Synthetic oligonucleotide
atagggcgggagggggatggaggtaggatcaaat

SEQ ID NO: 146668 - DNA, 35 bp, Artificial Sequence
  Synthetic oligonucleotide
atccgccgcactgtccaccttcagcaccaggttat

SEQ ID NO: 146669 - DNA, 35 bp, Artificial Sequence
  Synthetic oligonucleotide
tccgcgccacgttcaaccgcttgccctcctaacct

SEQ ID NO: 146670 - DNA, 34 bp, Artificial Sequence
  Synthetic oligonucleotide
gccgccgacgtactagtccctgaccctggtccct

SEQ ID NO: 146671 - DNA, 35 bp, Artificial Sequence
  Synthetic oligonucleotide
aacaactctgcctggccctattaagtcgttatcct

SEQ ID NO: 146672 - DNA, 35 bp, Artificial Sequence
  Synthetic oligonucleotide
tgtgtacgccgagatcgtcttcccccactgtgtct

SEQ ID NO: 146673 - DNA, 35 bp, Artificial Sequence
  Synthetic oligonucleotide
tgaacactctcctatccctgtatcgcgccctaatt

SEQ ID NO: 146674 - DNA, 35 bp, Artificial Sequence
  Synthetic oligonucleotide
atcccatctcgccgtcccccatggctcattacctt

SEQ ID NO: 146675 - DNA, 36 bp, Artificial Sequence
  Synthetic oligonucleotide
gaaccgacctttgctgcttttgggcccctatatcaa

SEQ ID NO: 146676 - DNA, 36 bp, Artificial Sequence
  Synthetic oligonucleotide
ggaggaggtggcgggaggtattcaggagggcaacca

SEQ ID NO: 146677 - DNA, 36 bp, Artificial Sequence
  Synthetic oligonucleotide
taacccgccggtattccccgtagccctcctggagca

SEQ ID NO: 146678 - DNA, 35 bp, Artificial Sequence
  Synthetic oligonucleotide
accaccccctgtagtgtggattcttcgccttatca

SEQ ID NO: 146679 - DNA, 36 bp, Artificial Sequence
  Synthetic oligonucleotide
gcaacctctccatggtcccatctctctacacggtca

SEQ ID NO: 146680 - DNA, 38 bp, Artificial Sequence
  Synthetic oligonucleotide
atgagacgcggaggggtgggggggctagataatcaaga

SEQ ID NO: 146681 - DNA, 37 bp, Artificial Sequence
  Synthetic oligonucleotide
aaccgcctcccccatcgccaatgcctccctttcgaga

SEQ ID NO: 146682 - DNA, 37 bp, Artificial Sequence
  Synthetic oligonucleotide
aagagggtagactgaggagggggtgcggggagttaga

SEQ ID NO: 146683 - DNA, 37 bp, Artificial Sequence
  Synthetic oligonucleotide
gtctcacctcatgttcattctgttacgtgccccccga

SEQ ID NO: 146684 - DNA, 36 bp, Artificial Sequence
  Synthetic oligonucleotide
aacgcctgtgttccatcctgggtctcccttccccga

SEQ ID NO: 146685 - DNA, 37 bp, Artificial Sequence
  Synthetic oligonucleotide
gagccctccacccgggtagttccatttcgattctcga

SEQ ID NO: 146686 - DNA, 37 bp, Artificial Sequence
  Synthetic oligonucleotide
taagaagagatagcaggggaacggtgacagggtggga

SEQ ID NO: 146687 - DNA, 37 bp, Artificial Sequence
  Synthetic oligonucleotide
gtgggcggatgtaggggggtgatgggaaaatgatgga

SEQ ID NO: 146688 - DNA, 37 bp, Artificial Sequence
  Synthetic oligonucleotide
tatccctccgcccactcggcattagaagcctccctga

SEQ ID NO: 146689 - DNA, 38 bp, Artificial Sequence
  Synthetic oligonucleotide
ttgaccatcatgcctgttaagctccacctctgcattga

SEQ ID NO: 146690 - DNA, 36 bp, Artificial Sequence
  Synthetic oligonucleotide
gtccaaccgtcccacagcttttccgcatagtgccta

SEQ ID NO: 146691 - DNA, 35 bp, Artificial Sequence
  Synthetic oligonucleotide
aacatctcgctcccattcggtttcctgaccgctta

SEQ ID NO: 146692 - DNA, 36 bp, Artificial Sequence
  Synthetic oligonucleotide
gtacccaacacacggtagaggcgtgcccctctctta

SEQ ID NO: 146693 - DNA, 35 bp, Artificial Sequence
  Synthetic oligonucleotide
gttgcccagacctgcttgtttcggacgctttccac

SEQ ID NO: 146694 - DNA, 35 bp, Artificial Sequence
  Synthetic oligonucleotide
accgatagacgtttgctcccctgattctagccacc

SEQ ID NO: 146695 - DNA, 34 bp, Artificial Sequence
  Synthetic oligonucleotide
gcctcgctagcccgcatcttgatacccgtgcacc

SEQ ID NO: 146696 - DNA, 35 bp, Artificial Sequence
  Synthetic oligonucleotide
acacggaagttcctgcccatctcttgctgtcgccc

SEQ ID NO: 146697 - DNA, 35 bp, Artificial Sequence
  Synthetic oligonucleotide
acgcgcgccaaaaaatcccgccactcctgtccgcc

SEQ ID NO: 146698 - DNA, 35 bp, Artificial Sequence
  Synthetic oligonucleotide
agatcccactcactgcactataagtcctgcgatcc

SEQ ID NO: 146699 - DNA, 35 bp, Artificial Sequence
  Synthetic oligonucleotide
ggagccgccggtcttaacgaatgccacccatgtcc

SEQ ID NO: 146700 - DNA, 35 bp, Artificial Sequence
  Synthetic oligonucleotide
ttcagcgcagctgcttaccatatttccttgtgtcc

SEQ ID NO: 146701 - DNA, 35 bp, Artificial Sequence
  Synthetic oligonucleotide
gttcaacacccgcccgctaacgctactctcgttcc

SEQ ID NO: 146702 - DNA, 35 bp, Artificial Sequence
  Synthetic oligonucleotide
gaccctcccttcctcgctataatagccgccatcgc

SEQ ID NO: 146703 - DNA, 35 bp, Artificial Sequence
  Synthetic oligonucleotide
gaggacatcccgccttgttccgctcaccctgctgc

SEQ ID NO: 146704 - DNA, 35 bp, Artificial Sequence
  Synthetic oligonucleotide
gacatcggcatgttttcttttagttcggcgccctc

SEQ ID NO: 146705 - DNA, 35 bp, Artificial Sequence
  Synthetic oligonucleotide
gcccgcccacacctgtccgacagctcttaatgctc

SEQ ID NO: 146706 - DNA, 35 bp, Artificial Sequence
  Synthetic oligonucleotide
tcttcatccaccgccatcatgcgttaccttttttc

SEQ ID NO: 146707 - DNA, 35 bp, Artificial Sequence
  Synthetic oligonucleotide
gcgccggggcggggggaatcttgaagggtgtgggg

SEQ ID NO: 146708 - DNA, 35 bp, Artificial Sequence
  Synthetic oligonucleotide
ttgcctggttcaccatctctcgctcccacaccctg

SEQ ID NO: 146709 - DNA, 35 bp, Artificial Sequence
  Synthetic oligonucleotide
tgcccttcgccctcttccaacccgttcggttgctg

SEQ ID NO: 146710 - DNA, 35 bp, Artificial Sequence
  Synthetic oligonucleotide
tatgctgcatcgctcgtccgctcctctctccgttg

SEQ ID NO: 146711 - DNA, 35 bp, Artificial Sequence
  Synthetic oligonucleotide
gccggaccgatgtgcccagtcctgctccatcacat

SEQ ID NO: 146712 - DNA, 35 bp, Artificial Sequence
  Synthetic oligonucleotide
tcttacggacggggggtgggatagggaaaccagat

SEQ ID NO: 146713 - DNA, 35 bp, Artificial Sequence
  Synthetic oligonucleotide
atcgccgatgttgtgcgtccgtctcccattcttat

SEQ ID NO: 146714 - DNA, 34 bp, Artificial Sequence
  Synthetic oligonucleotide
tcaggaccggtacagtctgcacctcagccctcct

SEQ ID NO: 146715 - DNA, 35 bp, Artificial Sequence
  Synthetic oligonucleotide
gcatggaagatgctgcttgctaccgccgccgtcct

SEQ ID NO: 146716 - DNA, 35 bp, Artificial Sequence
  Synthetic oligonucleotide
tctaagcgctgcacctttgccgctgtccacttcct

SEQ ID NO: 146717 - DNA, 35 bp, Artificial Sequence
  Synthetic oligonucleotide
ggaagacttgccctcgccgtgaaaatgcccttcct

SEQ ID NO: 146718 - DNA, 35 bp, Artificial Sequence
  Synthetic oligonucleotide
ggtggcagggcgggggggtgacgggaatggatcgt

SEQ ID NO: 146719 - DNA, 35 bp, Artificial Sequence
  Synthetic oligonucleotide
ggagggtgtcgggggggggtaagggggtttatggt

SEQ ID NO: 146720 - DNA, 35 bp, Artificial Sequence
  Synthetic oligonucleotide
tccatctcgcattgatagatccctgccctgttaca

SEQ ID NO: 146721 - DNA, 35 bp, Artificial Sequence
  Synthetic oligonucleotide
gcgccttctggccacatcgcccttctgcctcacca

SEQ ID NO: 146722 - DNA, 35 bp, Artificial Sequence
  Synthetic oligonucleotide
ggataggcgggggaggggagcgggtgggtttagca

SEQ ID NO: 146723 - DNA, 36 bp, Artificial Sequence
  Synthetic oligonucleotide
ttacgcgctatcaaccacctccgcctttacgccgca

SEQ ID NO: 146724 - DNA, 36 bp, Artificial Sequence
  Synthetic oligonucleotide
tatccccagacaccacctttcctattacgagactca

SEQ ID NO: 146725 - DNA, 37 bp, Artificial Sequence
  Synthetic oligonucleotide
ggaaaggaagttggggcgagaggggaagggggttaga

SEQ ID NO: 146726 - DNA, 36 bp, Artificial Sequence
  Synthetic oligonucleotide
atgtggccagtggggtgggtgaggtgggccatgcga

SEQ ID NO: 146727 - DNA, 36 bp, Artificial Sequence
  Synthetic oligonucleotide
ttgggaagggaaaagggaatatgaaatgggctggga

SEQ ID NO: 146728 - DNA, 37 bp, Artificial Sequence
  Synthetic oligonucleotide
gccgccccacgcgtaacctccgcattctccgtttgga

SEQ ID NO: 146729 - DNA, 38 bp, Artificial Sequence
  Synthetic oligonucleotide
agcccggcgtcccagtccgtccctgccctccccgctga

SEQ ID NO: 146730 - DNA, 38 bp, Artificial Sequence
  Synthetic oligonucleotide
tatacacgcccagatataacgttcttccatcccgctga

SEQ ID NO: 146731 - DNA, 35 bp, Artificial Sequence
  Synthetic oligonucleotide
tttccctccgttgacctatatacccggccccttga

SEQ ID NO: 146732 - DNA, 38 bp, Artificial Sequence
  Synthetic oligonucleotide
gcaagagagtgggggcggaaggacggtggcacatttga

SEQ ID NO: 146733 - DNA, 37 bp, Artificial Sequence
  Synthetic oligonucleotide
ttcgacgacgaccgggggggtgggtgaggatgtttga

SEQ ID NO: 146734 - DNA, 35 bp, Artificial Sequence
  Synthetic oligonucleotide
acagatccatgtcccgttgacgccgccctatccta

SEQ ID NO: 146735 - DNA, 35 bp, Artificial Sequence
  Synthetic oligonucleotide
atccagcagaatgtccgactccgcctgtcctccta

SEQ ID NO: 146736 - DNA, 36 bp, Artificial Sequence
  Synthetic oligonucleotide
gccctagtccgtccactctgagtaacgccacctcta

SEQ ID NO: 146737 - DNA, 35 bp, Artificial Sequence
  Synthetic oligonucleotide
acgaccgttgcgtgcaacgtttacaccaccccgta

SEQ ID NO: 146738 - DNA, 35 bp, Artificial Sequence
  Synthetic oligonucleotide
gccccctcccttcggtaataccggttcatactgta

SEQ ID NO: 146739 - DNA, 35 bp, Artificial Sequence
  Synthetic oligonucleotide
ggtgaagagaggggggagataggataactgttgta

SEQ ID NO: 146740 - DNA, 36 bp, Artificial Sequence
  Synthetic oligonucleotide
gaaggacgggggtgggaattggggcgccgtagatta

SEQ ID NO: 146741 - DNA, 35 bp, Artificial Sequence
  Synthetic oligonucleotide
tgacgcgcactgctctaatcattgtcatcgtacac

SEQ ID NO: 146742 - DNA, 35 bp, Artificial Sequence
  Synthetic oligonucleotide
atgccgggcttgggagggcgggttttgacacccac

SEQ ID NO: 146743 - DNA, 35 bp, Artificial Sequence
  Synthetic oligonucleotide
tcgttgtgcccacggtccatgatccccagtacccc

SEQ ID NO: 146744 - DNA, 35 bp, Artificial Sequence
  Synthetic oligonucleotide
atcccccctggtatgacttggaattgaccctgccc

SEQ ID NO: 146745 - DNA, 35 bp, Artificial Sequence
  Synthetic oligonucleotide
gatgcccactttctgagtgcaatggtcgccttccc

SEQ ID NO: 146746 - DNA, 35 bp, Artificial Sequence
  Synthetic oligonucleotide
acatgtcgtcacggcctatgccccccgtacaatcc

SEQ ID NO: 146747 - DNA, 35 bp, Artificial Sequence
  Synthetic oligonucleotide
agccccccaaccaggccctgtttgctctgccctcc

SEQ ID NO: 146748 - DNA, 35 bp, Artificial Sequence
  Synthetic oligonucleotide
actcctcacgataattaccactcacgcaccctggc

SEQ ID NO: 146749 - DNA, 35 bp, Artificial Sequence
  Synthetic oligonucleotide
gcccccctctatggcaccgtgacgttccacaaatc

SEQ ID NO: 146750 - DNA, 35 bp, Artificial Sequence
  Synthetic oligonucleotide
accccggcccgatttttcagccggccattatcctc

SEQ ID NO: 146751 - DNA, 35 bp, Artificial Sequence
  Synthetic oligonucleotide
ttgacgccattccagcgcttcgaacgttcccgctc

SEQ ID NO: 146752 - DNA, 35 bp, Artificial Sequence
  Synthetic oligonucleotide
ttagtctcgtcccatctgtctgttcgctactcgtc

SEQ ID NO: 146753 - DNA, 35 bp, Artificial Sequence
  Synthetic oligonucleotide
tctgtcccttccgtttggctctgtgtctttaccag

SEQ ID NO: 146754 - DNA, 35 bp, Artificial Sequence
  Synthetic oligonucleotide
ttacttagccgcctgcccttcgttgcgtctctgcg

SEQ ID NO: 146755 - DNA, 35 bp, Artificial Sequence
  Synthetic oligonucleotide
gtctgccccgtccatcgcccggtctacattcttcg

SEQ ID NO: 146756 - DNA, 35 bp, Artificial Sequence
  Synthetic oligonucleotide
gcacctctccgtccctgatatccattatttgcatg

SEQ ID NO: 146757 - DNA, 35 bp, Artificial Sequence
  Synthetic oligonucleotide
tcgctgccccgttcggacccttttgtactttcctg

SEQ ID NO: 146758 - DNA, 35 bp, Artificial Sequence
  Synthetic oligonucleotide
gccccgctccctgttgcaaactgtaccaatacttg

SEQ ID NO: 146759 - DNA, 34 bp, Artificial Sequence
  Synthetic oligonucleotide
tcacgtcagagaaagcctgcattacacttcccct

SEQ ID NO: 146760 - DNA, 35 bp, Artificial Sequence
  Synthetic oligonucleotide
tgcgtgcgttcacgcgcccctttgtccatttccct

SEQ ID NO: 146761 - DNA, 35 bp, Artificial Sequence
  Synthetic oligonucleotide
acaccgcctccgcccgtcagctcacgtcacacctt

SEQ ID NO: 146762 - DNA, 35 bp, Artificial Sequence
  Synthetic oligonucleotide
tgacagtctcagggcgctacctctatcgttctctt

SEQ ID NO: 146763 - DNA, 36 bp, Artificial Sequence
  Synthetic oligonucleotide
gctggggagtaaatggaagggggaagtgggtagcaa

SEQ ID NO: 146764 - DNA, 34 bp, Artificial Sequence
  Synthetic oligonucleotide
aaacggggggggggcgagtgctacagggtcatca

SEQ ID NO: 146765 - DNA, 37 bp, Artificial Sequence
  Synthetic oligonucleotide
gtccacggaggaggggggatgggagggaggttcacga

SEQ ID NO: 146766 - DNA, 36 bp, Artificial Sequence
  Synthetic oligonucleotide
gtgagccgcccgcccttacgttatttgcctctccga

SEQ ID NO: 146767 - DNA, 37 bp, Artificial Sequence
  Synthetic oligonucleotide
ggaacagactgttgggtgggtagggaatgggttgtga

SEQ ID NO: 146768 - DNA, 38 bp, Artificial Sequence
  Synthetic oligonucleotide
gaccacgagacagggggttgtgggggaagagggtttga

SEQ ID NO: 146769 - DNA, 35 bp, Artificial Sequence
  Synthetic oligonucleotide
gcaggtactagggaagggctgggcgggaccatata

SEQ ID NO: 146770 - DNA, 36 bp, Artificial Sequence
  Synthetic oligonucleotide
gactcccgccgtgcacatcttttcccactcacccta

SEQ ID NO: 146771 - DNA, 36 bp, Artificial Sequence
  Synthetic oligonucleotide
cccccctgcccgatagcctttgcccttaggtatcta

SEQ ID NO: 146772 - DNA, 35 bp, Artificial Sequence
  Synthetic oligonucleotide
tcctgccacacttgcgttcctatccgtttcccgta

SEQ ID NO: 146773 - DNA, 35 bp, Artificial Sequence
  Synthetic oligonucleotide
tcacgcccctccacacccgttttaccgcaccgcac

SEQ ID NO: 146774 - DNA, 35 bp, Artificial Sequence
  Synthetic oligonucleotide
tccatcatccccggttgcgactctggaacacctac

SEQ ID NO: 146775 - DNA, 35 bp, Artificial Sequence
  Synthetic oligonucleotide
tctacgctctcgcccaattccataatgccatcccc

SEQ ID NO: 146776 - DNA, 35 bp, Artificial Sequence
  Synthetic oligonucleotide
gtgcacctctcgtttgcgcagggtaccaccctccc

SEQ ID NO: 146777 - DNA, 35 bp, Artificial Sequence
  Synthetic oligonucleotide
tggaacctcctctgaagaccccgcttcttaccgcc

SEQ ID NO: 146778 - DNA, 35 bp, Artificial Sequence
  Synthetic oligonucleotide
tcccttcccgggcccccgactggctccagacctgc

SEQ ID NO: 146779 - DNA, 35 bp, Artificial Sequence
  Synthetic oligonucleotide
atctgctgtatgccttagtactcgcctacccctgc

SEQ ID NO: 146780 - DNA, 35 bp, Artificial Sequence
  Synthetic oligonucleotide
tcatgtcgtaagacacgaatcctggttcccccatc

SEQ ID NO: 146781 - DNA, 35 bp, Artificial Sequence
  Synthetic oligonucleotide
acctgcgtctattccggccctgcaccgtttgcctc

SEQ ID NO: 146782 - DNA, 35 bp, Artificial Sequence
  Synthetic oligonucleotide
gttgtcaactgacgcattatgttgctcgcctcctc

SEQ ID NO: 146783 - DNA, 35 bp, Artificial Sequence
  Synthetic oligonucleotide
ttgcgtaggctacccaccctgttcggtcctctctc

SEQ ID NO: 146784 - DNA, 35 bp, Artificial Sequence
  Synthetic oligonucleotide
gcccccctcctgtaacgcaagcagactctgccgag

SEQ ID NO: 146785 - DNA, 35 bp, Artificial Sequence
  Synthetic oligonucleotide
gacaaaggggagtgggatggggggcccagagctag

SEQ ID NO: 146786 - DNA, 35 bp, Artificial Sequence
  Synthetic oligonucleotide
gtcctgcccgtccccccttgccgctttacatcacg

SEQ ID NO: 146787 - DNA, 35 bp, Artificial Sequence
  Synthetic oligonucleotide
gccgccaccttatcccgccaccaacagccgattcg

SEQ ID NO: 146788 - DNA, 35 bp, Artificial Sequence
  Synthetic oligonucleotide
tcgccacgcccggtcctgattggctctctcgttcg

SEQ ID NO: 146789 - DNA, 35 bp, Artificial Sequence
  Synthetic oligonucleotide
gtctggacaaggtcgatagaagggggcggaggggg

SEQ ID NO: 146790 - DNA, 35 bp, Artificial Sequence
  Synthetic oligonucleotide
ggggagacagtggcgtattgaggagagggagggat

SEQ ID NO: 146791 - DNA, 35 bp, Artificial Sequence
  Synthetic oligonucleotide
aatggggggggtaggagtaggcaaatgagaaaact

SEQ ID NO: 146792 - DNA, 34 bp, Artificial Sequence
  Synthetic oligonucleotide
gtaggtaaagcaggtcgtccctgttgctcctcct

SEQ ID NO: 146793 - DNA, 35 bp, Artificial Sequence
  Synthetic oligonucleotide
tcatgcctctcactcgtaagacttccttcgttcct

SEQ ID NO: 146794 - DNA, 35 bp, Artificial Sequence
  Synthetic oligonucleotide
aggggggggaaggaaggtagatagtgcggcgcgct

SEQ ID NO: 146795 - DNA, 35 bp, Artificial Sequence
  Synthetic oligonucleotide
gcgtgcacttagtgtaccctcacctgccctccgtt

SEQ ID NO: 146796 - DNA, 36 bp, Artificial Sequence
  Synthetic oligonucleotide
gctcaccccactcctgtgcaatatcttgggcaccaa

SEQ ID NO: 146797 - DNA, 36 bp, Artificial Sequence
  Synthetic oligonucleotide
gcaaccacacccgccgagccgcccgtaacgttttaa

SEQ ID NO: 146798 - DNA, 36 bp, Artificial Sequence
  Synthetic oligonucleotide
ttccgtccgccgccgctctgcacatcgctcacccca

SEQ ID NO: 146799 - DNA, 36 bp, Artificial Sequence
  Synthetic oligonucleotide
gacggtcgagcgcgtaccgtttgtgcccccccgcca

SEQ ID NO: 146800 - DNA, 36 bp, Artificial Sequence
  Synthetic oligonucleotide
attgaccctcccatgcgcatctgacgccccctgcca

SEQ ID NO: 146801 - DNA, 36 bp, Artificial Sequence
  Synthetic oligonucleotide
tcccacgctactcactcgtttcccatccagtttaga

SEQ ID NO: 146802 - DNA, 37 bp, Artificial Sequence
  Synthetic oligonucleotide
acccgcccctcacctgtctgcctggccatcacaccga

SEQ ID NO: 146803 - DNA, 37 bp, Artificial Sequence
  Synthetic oligonucleotide
actcagctcgttatcgttatactcgctccccctccga

SEQ ID NO: 146804 - DNA, 37 bp, Artificial Sequence
  Synthetic oligonucleotide
tcagccgatcaggccatccagctcttgtttccctcga

SEQ ID NO: 146805 - DNA, 37 bp, Artificial Sequence
  Synthetic oligonucleotide
tcattggaggtgaggggaaggaaggaaggtggttcga

SEQ ID NO: 146806 - DNA, 37 bp, Artificial Sequence
  Synthetic oligonucleotide
tgatcccacaccatgccatcctgttcaactccacgga

SEQ ID NO: 146807 - DNA, 36 bp, Artificial Sequence
  Synthetic oligonucleotide
tgccctgtcatatcttctttgtttcgcccctccgga

SEQ ID NO: 146808 - DNA, 37 bp, Artificial Sequence
  Synthetic oligonucleotide
taaaacgcagggtatcaaggagccagggagggaggga

SEQ ID NO: 146809 - DNA, 35 bp, Artificial Sequence
  Synthetic oligonucleotide
ggggacgggggaagactaacacggggcgcacggga

SEQ ID NO: 146810 - DNA, 37 bp, Artificial Sequence
  Synthetic oligonucleotide
gcaggggtgggagggggcatggagtaccatcatggga

SEQ ID NO: 146811 - DNA, 37 bp, Artificial Sequence
  Synthetic oligonucleotide
ggagggaggggcgggcggggagtcaagaggaactgga

SEQ ID NO: 146812 - DNA, 36 bp, Artificial Sequence
  Synthetic oligonucleotide
tacatccgccgccctgatatcctcgttacccttgga

SEQ ID NO: 146813 - DNA, 38 bp, Artificial Sequence
  Synthetic oligonucleotide
ggggagggttgaagcaagggagcacgggcgaggaatga

SEQ ID NO: 146814 - DNA, 38 bp, Artificial Sequence
  Synthetic oligonucleotide
ggagcggtgcggtggggggacgggtgtggcggggatga

SEQ ID NO: 146815 - DNA, 37 bp, Artificial Sequence
  Synthetic oligonucleotide
gcgccagtccacgcccgttacatcgcctctttcctga

SEQ ID NO: 146816 - DNA, 38 bp, Artificial Sequence
  Synthetic oligonucleotide
tgtagtgcgaggcgaacggggcggggagggggcggtga

SEQ ID NO: 146817 - DNA, 38 bp, Artificial Sequence
  Synthetic oligonucleotide
atagcaacgggagggatgggtaagacgggggcaattga

SEQ ID NO: 146818 - DNA, 38 bp, Artificial Sequence
  Synthetic oligonucleotide
acccatccctcacaccgctaaggcgcctcaggccttga

SEQ ID NO: 146819 - DNA, 36 bp, Artificial Sequence
  Synthetic oligonucleotide
ttgttgcccctgctcccgtggccctgccatgctcta

SEQ ID NO: 146820 - DNA, 35 bp, Artificial Sequence
  Synthetic oligonucleotide
cccgaccgtccatcccagcccgtcagctcctctta

SEQ ID NO: 146821 - DNA, 35 bp, Artificial Sequence
  Synthetic oligonucleotide
acatgtcaaccgcgctgccattttgtcccatcaac

SEQ ID NO: 146822 - DNA, 35 bp, Artificial Sequence
  Synthetic oligonucleotide
gtgttaccgctccatctcgacacacagaatatcac

SEQ ID NO: 146823 - DNA, 35 bp, Artificial Sequence
  Synthetic oligonucleotide
acacccgacggtttccggacccgaaaagttgcccc

SEQ ID NO: 146824 - DNA, 35 bp, Artificial Sequence
  Synthetic oligonucleotide
gcggaacgccacacccgccgctacatttcatcgcc

SEQ ID NO: 146825 - DNA, 35 bp, Artificial Sequence
  Synthetic oligonucleotide
gcccatcttcccacctccccgcggaactcgttcgc

SEQ ID NO: 146826 - DNA, 33 bp, Artificial Sequence
  Synthetic oligonucleotide
tgtagccaccaatgatcccccccccgacctctc

SEQ ID NO: 146827 - DNA, 35 bp, Artificial Sequence
  Synthetic oligonucleotide
aaacgcaacgcccccccccgccatatggttcagtc

SEQ ID NO: 146828 - DNA, 35 bp, Artificial Sequence
  Synthetic oligonucleotide
tgttccacctcggtcatatgcccccttgcgtattc

SEQ ID NO: 146829 - DNA, 35 bp, Artificial Sequence
  Synthetic oligonucleotide
gcccacgttccccgactataccgtcatcttctaag

SEQ ID NO: 146830 - DNA, 35 bp, Artificial Sequence
  Synthetic oligonucleotide
ttgggtgagaccgatcgggagggggggacacggag

SEQ ID NO: 146831 - DNA, 36 bp, Artificial Sequence
  Synthetic oligonucleotide
acggggaaggtggaagtcggggggtgaatcagggag

SEQ ID NO: 146832 - DNA, 35 bp, Artificial Sequence
  Synthetic oligonucleotide
atggggggagggagccgagacgatgggcaagttag

SEQ ID NO: 146833 - DNA, 35 bp, Artificial Sequence
  Synthetic oligonucleotide
tcgtggccctcgctgcgttttagtcttcttgcccg

SEQ ID NO: 146834 - DNA, 33 bp, Artificial Sequence
  Synthetic oligonucleotide
gccacgtggcatacaactccatcactctctgcg

SEQ ID NO: 146835 - DNA, 35 bp, Artificial Sequence
  Synthetic oligonucleotide
tatccgtaacttcgcagccgcctacgcccctttcg

SEQ ID NO: 146836 - DNA, 35 bp, Artificial Sequence
  Synthetic oligonucleotide
gaaacaggggagggcgggcataactgtgaaacagg

SEQ ID NO: 146837 - DNA, 35 bp, Artificial Sequence
  Synthetic oligonucleotide
gaaactgggggttgggtgtgggaacaggagggggg

SEQ ID NO: 146838 - DNA, 35 bp, Artificial Sequence
  Synthetic oligonucleotide
gcgagattctcggacgggagggacgggtcgggggg

SEQ ID NO: 146839 - DNA, 35 bp, Artificial Sequence
  Synthetic oligonucleotide
agggtgggtagtaggtggcacgggtgcgggtgggg

SEQ ID NO: 146840 - DNA, 34 bp, Artificial Sequence
  Synthetic oligonucleotide
tatggtgggaggtaagggcattgggagggcatgg

SEQ ID NO: 146841 - DNA, 27 bp, Artificial Sequence
  Synthetic oligonucleotide
tcatgtgctttcctgtcctcaccctgg

SEQ ID NO: 146842 - DNA, 35 bp, Artificial Sequence
  Synthetic oligonucleotide
aaccgcccaatctgctactccagacattctccgat

SEQ ID NO: 146843 - DNA, 35 bp, Artificial Sequence
  Synthetic oligonucleotide
tcttccacccgctctcattagttctcgggagcact

SEQ ID NO: 146844 - DNA, 35 bp, Artificial Sequence
  Synthetic oligonucleotide
gatcatgtcagtccgcgttccccctctctacccct

SEQ ID NO: 146845 - DNA, 35 bp, Artificial Sequence
  Synthetic oligonucleotide
ttctgcaccccacacatacctcacgcgataagcct

SEQ ID NO: 146846 - DNA, 35 bp, Artificial Sequence
  Synthetic oligonucleotide
tagaccaccgacagtgctgcgcccccttccctcct

SEQ ID NO: 146847 - DNA, 35 bp, Artificial Sequence
  Synthetic oligonucleotide
aacctgtcctacgtcccccagctcatccatccggt

SEQ ID NO: 146848 - DNA, 35 bp, Artificial Sequence
  Synthetic oligonucleotide
atccaacaccctcctttgtcatagtccacttactt

SEQ ID NO: 146849 - DNA, 34 bp, Artificial Sequence
  Synthetic oligonucleotide
gtgaacgcaaccgtatcatgagtctctccccctt

SEQ ID NO: 146850 - DNA, 35 bp, Artificial Sequence
  Synthetic oligonucleotide
gactcccgcccctggtcgtaggagaactttacgtt

SEQ ID NO: 146851 - DNA, 35 bp, Artificial Sequence
  Synthetic oligonucleotide
tgcctgctcgggctcgcttctcctgccttccggtt

SEQ ID NO: 146852 - DNA, 35 bp, Artificial Sequence
  Synthetic oligonucleotide
tgacagtgaggcacgagggaaggggggtgtgggtt

SEQ ID NO: 146853 - DNA, 36 bp, Artificial Sequence
  Synthetic oligonucleotide
tccatacccgtcccctggtacatcttacggccccaa

SEQ ID NO: 146854 - DNA, 36 bp, Artificial Sequence
  Synthetic oligonucleotide
gccacgctatgtctccgccccctgtacgccctcgaa

SEQ ID NO: 146855 - DNA, 35 bp, Artificial Sequence
  Synthetic oligonucleotide
gcgagtggagaggggcaagcatggggtaggtcgaa

SEQ ID NO: 146856 - DNA, 36 bp, Artificial Sequence
  Synthetic oligonucleotide
tgccacgtaatatgcgtccctcccggccgatcccca

SEQ ID NO: 146857 - DNA, 36 bp, Artificial Sequence
  Synthetic oligonucleotide
tgacacggggccagctccctggttagttccttttca

SEQ ID NO: 146858 - DNA, 37 bp, Artificial Sequence
  Synthetic oligonucleotide
tgccatcccccgctatgtacactcgtttgttcgaaga

SEQ ID NO: 146859 - DNA, 37 bp, Artificial Sequence
  Synthetic oligonucleotide
tgacaccacatacctgccctgccatacggtcctacga

SEQ ID NO: 146860 - DNA, 35 bp, Artificial Sequence
  Synthetic oligonucleotide
atcaacctcgatcctgagatctttgcccaccccga

SEQ ID NO: 146861 - DNA, 37 bp, Artificial Sequence
  Synthetic oligonucleotide
gctcaccctgccggtttctttacgggtacatccccga

SEQ ID NO: 146862 - DNA, 37 bp, Artificial Sequence
  Synthetic oligonucleotide
agccctccccgtgcccacctgtgctttaacctgccga

SEQ ID NO: 146863 - DNA, 37 bp, Artificial Sequence
  Synthetic oligonucleotide
gtgcaatgccagtcttggcctcctatactatctccga

SEQ ID NO: 146864 - DNA, 32 bp, Artificial Sequence
  Synthetic oligonucleotide
tccgcgctgcctgttcatcccactcacatcga

SEQ ID NO: 146865 - DNA, 34 bp, Artificial Sequence
  Synthetic oligonucleotide
attacagggcgggggggacacggactctgaggga

SEQ ID NO: 146866 - DNA, 36 bp, Artificial Sequence
  Synthetic oligonucleotide
aagggaggggatcggggtacatgtggatagcgggga

SEQ ID NO: 146867 - DNA, 37 bp, Artificial Sequence
  Synthetic oligonucleotide
tgtgaagccaaggaagggatttcggggaaagggggga

SEQ ID NO: 146868 - DNA, 38 bp, Artificial Sequence
  Synthetic oligonucleotide
tcgcacccttctcaactcccgcgctcccggtcccctga

SEQ ID NO: 146869 - DNA, 37 bp, Artificial Sequence
  Synthetic oligonucleotide
gcactcccctgctgcttgcaaacagtatttcccctga

SEQ ID NO: 146870 - DNA, 38 bp, Artificial Sequence
  Synthetic oligonucleotide
tgtgccgtagacgccatattcctccgccgcgctcctga

SEQ ID NO: 146871 - DNA, 35 bp, Artificial Sequence
  Synthetic oligonucleotide
gaggggatccgtgcggagggaaggaatgcgggtga

SEQ ID NO: 146872 - DNA, 38 bp, Artificial Sequence
  Synthetic oligonucleotide
tggacaccctccgacgcttataccctgtccacatgtga

SEQ ID NO: 146873 - DNA, 35 bp, Artificial Sequence
  Synthetic oligonucleotide
gtatacaccctcgttcatgttctgctcctcctata

SEQ ID NO: 146874 - DNA, 36 bp, Artificial Sequence
  Synthetic oligonucleotide
gctccgttcccgccatgcctatgatcgctcctcgta

SEQ ID NO: 146875 - DNA, 36 bp, Artificial Sequence
  Synthetic oligonucleotide
gcacacaccccgcacatgggacgcccccacccatta

SEQ ID NO: 146876 - DNA, 36 bp, Artificial Sequence
  Synthetic oligonucleotide
acgtcctccgcacaggtgcgccctcctgacctgtta

SEQ ID NO: 146877 - DNA, 35 bp, Artificial Sequence
  Synthetic oligonucleotide
actccacccttgacctcctacgtgtactctcgcac

SEQ ID NO: 146878 - DNA, 35 bp, Artificial Sequence
  Synthetic oligonucleotide
acgcggaggaaggggggaagtcagtacagggtgac

SEQ ID NO: 146879 - DNA, 35 bp, Artificial Sequence
  Synthetic oligonucleotide
tccgacgcacacacatcagccgctctatcggaccc

SEQ ID NO: 146880 - DNA, 35 bp, Artificial Sequence
  Synthetic oligonucleotide
gccagggttctcgcacgctatcatacgcccacgcc

SEQ ID NO: 146881 - DNA, 35 bp, Artificial Sequence
  Synthetic oligonucleotide
accgagctctccctctgtacgtctgtaagcctgcc

SEQ ID NO: 146882 - DNA, 35 bp, Artificial Sequence
  Synthetic oligonucleotide
gcacgtattcggccacgtaaagtccttctgcctcc

SEQ ID NO: 146883 - DNA, 35 bp, Artificial Sequence
  Synthetic oligonucleotide
accccatctccacaccgtctgccgattcctgctcc

SEQ ID NO: 146884 - DNA, 33 bp, Artificial Sequence
  Synthetic oligonucleotide
tcagactctctgcgcttgttcctacacccccgc

SEQ ID NO: 146885 - DNA, 35 bp, Artificial Sequence
  Synthetic oligonucleotide
tcatggtgaccgccatggcactccctttccgccgc

SEQ ID NO: 146886 - DNA, 35 bp, Artificial Sequence
  Synthetic oligonucleotide
agccgtcggccccccatttcgttcctgcggtctgc

SEQ ID NO: 146887 - DNA, 35 bp, Artificial Sequence
  Synthetic oligonucleotide
tgagcccctcgccgccttgacgccgtgcctcgtgc

SEQ ID NO: 146888 - DNA, 35 bp, Artificial Sequence
  Synthetic oligonucleotide
tactccatctgcccgcccatagctattatccgctc

SEQ ID NO: 146889 - DNA, 33 bp, Artificial Sequence
  Synthetic oligonucleotide
tgctggattctggccctcccgcattatttgctc

SEQ ID NO: 146890 - DNA, 35 bp, Artificial Sequence
  Synthetic oligonucleotide
acatagcctcactgacgtttacccgcgattatctc

SEQ ID NO: 146891 - DNA, 35 bp, Artificial Sequence
  Synthetic oligonucleotide
tctgtccagagtctgcaatcttgtctccctgtctc

SEQ ID NO: 146892 - DNA, 35 bp, Artificial Sequence
  Synthetic oligonucleotide
tgcctcaccttccactataccgatcagccgccttc

SEQ ID NO: 146893 - DNA, 35 bp, Artificial Sequence
  Synthetic oligonucleotide
tttcgatgcctgctctacttccgttattcgccttc

SEQ ID NO: 146894 - DNA, 35 bp, Artificial Sequence
  Synthetic oligonucleotide
tagcgcccgcctttggctttctaatactccctttc

SEQ ID NO: 146895 - DNA, 35 bp, Artificial Sequence
  Synthetic oligonucleotide
tccaccccccaagactgcatcatcaccgcaatacg

SEQ ID NO: 146896 - DNA, 35 bp, Artificial Sequence
  Synthetic oligonucleotide
tgtagtccctccctcgctcactcgcgtataccccg

SEQ ID NO: 146897 - DNA, 35 bp, Artificial Sequence
  Synthetic oligonucleotide
accgcgtttaccacgccctgcacatgctccccccg

SEQ ID NO: 146898 - DNA, 35 bp, Artificial Sequence
  Synthetic oligonucleotide
actggccactgtacttgcctcttctccccgcgccg

SEQ ID NO: 146899 - DNA, 35 bp, Artificial Sequence
  Synthetic oligonucleotide
atccgcgacgcactacctccgatcgtctccatccg

SEQ ID NO: 146900 - DNA, 35 bp, Artificial Sequence
  Synthetic oligonucleotide
aggacacagcctcaccctagcatatgtcccccctg

SEQ ID NO: 146901 - DNA, 35 bp, Artificial Sequence
  Synthetic oligonucleotide
taatcaccctgcgccacctctctcctgccaatttg

SEQ ID NO: 146902 - DNA, 34 bp, Artificial Sequence
  Synthetic oligonucleotide
tggtcatggcggggggggggcggaggtaacctat

SEQ ID NO: 146903 - DNA, 35 bp, Artificial Sequence
  Synthetic oligonucleotide
tgccccgcattcgcttagccacccttttagcacct

SEQ ID NO: 146904 - DNA, 35 bp, Artificial Sequence
  Synthetic oligonucleotide
agtagggtgggaacggtaaatgggggggttagcct

SEQ ID NO: 146905 - DNA, 35 bp, Artificial Sequence
  Synthetic oligonucleotide
gcgcaagccgcccaggctgtacgtctctccctctt

SEQ ID NO: 146906 - DNA, 35 bp, Artificial Sequence
  Synthetic oligonucleotide
gccccatcgcagtgcctcccgcatagaccctggtt

SEQ ID NO: 146907 - DNA, 36 bp, Artificial Sequence
  Synthetic oligonucleotide
tcgctgataggaggcgaggggggctgggggtgggaa

SEQ ID NO: 146908 - DNA, 36 bp, Artificial Sequence
  Synthetic oligonucleotide
tcgcaccgctctggtccgcctagcctcgtccttgaa

SEQ ID NO: 146909 - DNA, 35 bp, Artificial Sequence
  Synthetic oligonucleotide
agtgtgtcgagccatctcgcgttgcccctcttgaa

SEQ ID NO: 146910 - DNA, 36 bp, Artificial Sequence
  Synthetic oligonucleotide
atcgcgcggtctaggttattatcgctcctcctcaca

SEQ ID NO: 146911 - DNA, 36 bp, Artificial Sequence
  Synthetic oligonucleotide
tccgccccccatcttgtgcctgcggcgtacgtttca

SEQ ID NO: 146912 - DNA, 36 bp, Artificial Sequence
  Synthetic oligonucleotide
gagtgcaaggggggcggatttgacgaacaggccaga

SEQ ID NO: 146913 - DNA, 37 bp, Artificial Sequence
  Synthetic oligonucleotide
acgatcattgccccattgtttacattacgccctacga

SEQ ID NO: 146914 - DNA, 37 bp, Artificial Sequence
  Synthetic oligonucleotide
atcctcctcacatgtccattgggtcaattccacccga

SEQ ID NO: 146915 - DNA, 37 bp, Artificial Sequence
  Synthetic oligonucleotide
ttagggcgggagggggtgagacttaagggacccgcga

SEQ ID NO: 146916 - DNA, 37 bp, Artificial Sequence
  Synthetic oligonucleotide
gaacccctgaccctatatgttgcctactgccccagga

SEQ ID NO: 146917 - DNA, 37 bp, Artificial Sequence
  Synthetic oligonucleotide
gcttaggtaggaggggaggaaggaagcgacaaaggga

SEQ ID NO: 146918 - DNA, 37 bp, Artificial Sequence
  Synthetic oligonucleotide
gaaagggggagggttaatgcggagcggtgctgaggga

SEQ ID NO: 146919 - DNA, 37 bp, Artificial Sequence
  Synthetic oligonucleotide
gtttggggccagtcgggcaagggggaagtgtggggga

SEQ ID NO: 146920 - DNA, 37 bp, Artificial Sequence
  Synthetic oligonucleotide
gtttcgccgcctgagttatcgttccttccagcgtgga

SEQ ID NO: 146921 - DNA, 38 bp, Artificial Sequence
  Synthetic oligonucleotide
atcccccctcgcccctctgctaatcagtccttgcatga

SEQ ID NO: 146922 - DNA, 38 bp, Artificial Sequence
  Synthetic oligonucleotide
ggagacaagcaggtaggggtagacggaagggcgtgtga

SEQ ID NO: 146923 - DNA, 38 bp, Artificial Sequence
  Synthetic oligonucleotide
acacactcccccacgttacctatatgccccggccttga

SEQ ID NO: 146924 - DNA, 37 bp, Artificial Sequence
  Synthetic oligonucleotide
gcgtaccacctgccgagcattcgaccgtcccttttga

SEQ ID NO: 146925 - DNA, 35 bp, Artificial Sequence
  Synthetic oligonucleotide
gactggccggaaggggggggggcggtttagaacta

SEQ ID NO: 146926 - DNA, 35 bp, Artificial Sequence
  Synthetic oligonucleotide
tccccccgacctccgcgacaaggccttctaaacac

SEQ ID NO: 146927 - DNA, 35 bp, Artificial Sequence
  Synthetic oligonucleotide
gcgagagggatggctgcaagcacgggggggaggac

SEQ ID NO: 146928 - DNA, 35 bp, Artificial Sequence
  Synthetic oligonucleotide
gccccgcccatctcgtagtgttcggaaacacgacc

SEQ ID NO: 146929 - DNA, 35 bp, Artificial Sequence
  Synthetic oligonucleotide
tctcatctccccctccacggtcgtatccaagtccc

SEQ ID NO: 146930 - DNA, 35 bp, Artificial Sequence
  Synthetic oligonucleotide
accatagagggagggggggtagggcggcttgtgcc

SEQ ID NO: 146931 - DNA, 35 bp, Artificial Sequence
  Synthetic oligonucleotide
tccctgcacacgcatcccgtttttgtctcgagtcc

SEQ ID NO: 146932 - DNA, 35 bp, Artificial Sequence
  Synthetic oligonucleotide
acgacccgaccatcgttgccattgtatcgctccgc

SEQ ID NO: 146933 - DNA, 35 bp, Artificial Sequence
  Synthetic oligonucleotide
ccacttggcacatcctccgcccgctctgttcgcgc

SEQ ID NO: 146934 - DNA, 35 bp, Artificial Sequence
  Synthetic oligonucleotide
gagcatgtcgttggttcgcgcgccctctagtactc

SEQ ID NO: 146935 - DNA, 35 bp, Artificial Sequence
  Synthetic oligonucleotide
gtcctcgctccgttatgtccctctgtcacatcctc

SEQ ID NO: 146936 - DNA, 28 bp, Artificial Sequence
  Synthetic oligonucleotide
gttcgccttcatttaaattgccaccttc

SEQ ID NO: 146937 - DNA, 35 bp, Artificial Sequence
  Synthetic oligonucleotide
ttctgccccactcgcggtctccgttacttcccccg

SEQ ID NO: 146938 - DNA, 35 bp, Artificial Sequence
  Synthetic oligonucleotide
ggaagacgccgttctttcatctgtacacctctgcg

SEQ ID NO: 146939 - DNA, 35 bp, Artificial Sequence
  Synthetic oligonucleotide
tcagcctactcacattgttctacccttactgctcg

SEQ ID NO: 146940 - DNA, 35 bp, Artificial Sequence
  Synthetic oligonucleotide
atgcggaatgagctggagggggggcaattaggagg

SEQ ID NO: 146941 - DNA, 35 bp, Artificial Sequence
  Synthetic oligonucleotide
ggaaagcaacggggtgcgcgcgaagggaggagggg

SEQ ID NO: 146942 - DNA, 35 bp, Artificial Sequence
  Synthetic oligonucleotide
tgcccccccgcttgatacacgccagcatactactg

SEQ ID NO: 146943 - DNA, 34 bp, Artificial Sequence
  Synthetic oligonucleotide
aaccccgcccccctctccagacgcctttgagttg

SEQ ID NO: 146944 - DNA, 35 bp, Artificial Sequence
  Synthetic oligonucleotide
gccccatggctctcccctttccgaccaccaatttg

SEQ ID NO: 146945 - DNA, 35 bp, Artificial Sequence
  Synthetic oligonucleotide
acattgcccctggttacccgtctctacacattggt

SEQ ID NO: 146946 - DNA, 35 bp, Artificial Sequence
  Synthetic oligonucleotide
tctccgccatctgcgcccagttagacccgccactt

SEQ ID NO: 146947 - DNA, 35 bp, Artificial Sequence
  Synthetic oligonucleotide
actgacaccccgacggttcctttgtcccggtactt

SEQ ID NO: 146948 - DNA, 35 bp, Artificial Sequence
  Synthetic oligonucleotide
tttggcccaggccatcgcatcacactcttcgcctt

SEQ ID NO: 146949 - DNA, 35 bp, Artificial Sequence
  Synthetic oligonucleotide
acccccctctccactgtgctactaggtcgttcctt

SEQ ID NO: 146950 - DNA, 35 bp, Artificial Sequence
  Synthetic oligonucleotide
gccccccctgtccgcagcactaacgcgccttttaa

SEQ ID NO: 146951 - DNA, 35 bp, Artificial Sequence
  Synthetic oligonucleotide
gtagggggcggtgggaaatggcggaggacggccca

SEQ ID NO: 146952 - DNA, 35 bp, Artificial Sequence
  Synthetic oligonucleotide
attcgcgcactcattttgcttgggtccttcttcca

SEQ ID NO: 146953 - DNA, 35 bp, Artificial Sequence
  Synthetic oligonucleotide
gcctacccccctctgattcaatgttcaattgtgca

SEQ ID NO: 146954 - DNA, 36 bp, Artificial Sequence
  Synthetic oligonucleotide
acatcccccgaaccagtacgtcctcgccgcctatca

SEQ ID NO: 146955 - DNA, 35 bp, Artificial Sequence
  Synthetic oligonucleotide
acccctgcactgcttctgcacaacctctcatgtca

SEQ ID NO: 146956 - DNA, 36 bp, Artificial Sequence
  Synthetic oligonucleotide
acccttgccgcccgccactaaccctcgtagtattca

SEQ ID NO: 146957 - DNA, 36 bp, Artificial Sequence
  Synthetic oligonucleotide
cctgcccctccccctattttgtcgtgcccgttttca

SEQ ID NO: 146958 - DNA, 37 bp, Artificial Sequence
  Synthetic oligonucleotide
tcaacgggaggggagggccgggctaggacgttaacga

SEQ ID NO: 146959 - DNA, 37 bp, Artificial Sequence
  Synthetic oligonucleotide
tcccgccgccactccctcggtgcatctcaaaatacga

SEQ ID NO: 146960 - DNA, 35 bp, Artificial Sequence
  Synthetic oligonucleotide
tgagaaggtcatagcagcccgtccacccccttcga

SEQ ID NO: 146961 - DNA, 36 bp, Artificial Sequence
  Synthetic oligonucleotide
gttcagcggggggggaggctagaagcggagtgcgga

SEQ ID NO: 146962 - DNA, 37 bp, Artificial Sequence
  Synthetic oligonucleotide
tctgtactgcctgtttattgttccaccctgtttcgga

SEQ ID NO: 146963 - DNA, 36 bp, Artificial Sequence
  Synthetic oligonucleotide
gccccaccctcataccgtatgccctcactaaaatga

SEQ ID NO: 146964 - DNA, 38 bp, Artificial Sequence
  Synthetic oligonucleotide
gtgacgcctccgcggttctctactagccttacctatga

SEQ ID NO: 146965 - DNA, 38 bp, Artificial Sequence
  Synthetic oligonucleotide
tccacagagccacctgttcatgctccaatcctcactga

SEQ ID NO: 146966 - DNA, 38 bp, Artificial Sequence
  Synthetic oligonucleotide
tgctaccgcctctggtaagccaccccatccctcgctga

SEQ ID NO: 146967 - DNA, 37 bp, Artificial Sequence
  Synthetic oligonucleotide
accgaaggtacccgcactgacgcatcccgacccttga

SEQ ID NO: 146968 - DNA, 36 bp, Artificial Sequence
  Synthetic oligonucleotide
gcgccacatcatgcctgtttcccgccgcacctgcta

SEQ ID NO: 146969 - DNA, 36 bp, Artificial Sequence
  Synthetic oligonucleotide
tcccacccccgatatcagttacttcgatagtaagta

SEQ ID NO: 146970 - DNA, 36 bp, Artificial Sequence
  Synthetic oligonucleotide
tcagaccaaccgccactagcaacactattgttttta

SEQ ID NO: 146971 - DNA, 35 bp, Artificial Sequence
  Synthetic oligonucleotide
agacaccccatttgccgccaatcccgctcttgaac

SEQ ID NO: 146972 - DNA, 35 bp, Artificial Sequence
  Synthetic oligonucleotide
gcccgccggacccccgtttgactcttagccgtaac

SEQ ID NO: 146973 - DNA, 35 bp, Artificial Sequence
  Synthetic oligonucleotide
accgctgcacgctctggttctgcatgctttcttac

SEQ ID NO: 146974 - DNA, 35 bp, Artificial Sequence
  Synthetic oligonucleotide
acgcctcgacacctagccggacagtgtcgcccccc

SEQ ID NO: 146975 - DNA, 35 bp, Artificial Sequence
  Synthetic oligonucleotide
gcccaacccttatggtagttgacgtttactcgccc

SEQ ID NO: 146976 - DNA, 34 bp, Artificial Sequence
  Synthetic oligonucleotide
tacgtcagggcctcgttcttgccagacccccgcc

SEQ ID NO: 146977 - DNA, 35 bp, Artificial Sequence
  Synthetic oligonucleotide
gtcccccattggccctcacgcacggtcgattccgc

SEQ ID NO: 146978 - DNA, 35 bp, Artificial Sequence
  Synthetic oligonucleotide
gccggcctgccccaccaacactagtaccgacctgc

SEQ ID NO: 146979 - DNA, 35 bp, Artificial Sequence
  Synthetic oligonucleotide
tgtgtccatgcgcaacaagcgatatcactccactc

SEQ ID NO: 146980 - DNA, 35 bp, Artificial Sequence
  Synthetic oligonucleotide
tcacaacgtccaacacccctccctcggacaacgcg

SEQ ID NO: 146981 - DNA, 35 bp, Artificial Sequence
  Synthetic oligonucleotide
aagagggtgcaatgtaggggcgggtcgagaatggg

SEQ ID NO: 146982 - DNA, 36 bp, Artificial Sequence
  Synthetic oligonucleotide
acagccggagcatgttatcatgtattctaccccctg

SEQ ID NO: 146983 - DNA, 35 bp, Artificial Sequence
  Synthetic oligonucleotide
gttcgagcacttcgtcccgttttaacccctccctg

SEQ ID NO: 146984 - DNA, 35 bp, Artificial Sequence
  Synthetic oligonucleotide
tgtgacggatcggcggtcggattattcttctcctg

SEQ ID NO: 146985 - DNA, 35 bp, Artificial Sequence
  Synthetic oligonucleotide
tccacactctccgccgggactcgcaaagtatcttg

SEQ ID NO: 146986 - DNA, 35 bp, Artificial Sequence
  Synthetic oligonucleotide
ccacaccacctaacatgttcgccgttccgctcttg

SEQ ID NO: 146987 - DNA, 35 bp, Artificial Sequence
  Synthetic oligonucleotide
tcccggtccctctcctgatctaccgttcgacctat

SEQ ID NO: 146988 - DNA, 35 bp, Artificial Sequence
  Synthetic oligonucleotide
tcggtaccacggtttgcttatgccgcctcgcccct

SEQ ID NO: 146989 - DNA, 34 bp, Artificial Sequence
  Synthetic oligonucleotide
gacacccccgaacaccctacgagcaagttggcct

SEQ ID NO: 146990 - DNA, 35 bp, Artificial Sequence
  Synthetic oligonucleotide
acatctgggaggggggagtggagggcgatcgcgct

SEQ ID NO: 146991 - DNA, 35 bp, Artificial Sequence
  Synthetic oligonucleotide
gtggttacgtcacatactttcctgcatcttcgtct

SEQ ID NO: 146992 - DNA, 35 bp, Artificial Sequence
  Synthetic oligonucleotide
tgttcgttccccctttgccgtatagtttactccgt

SEQ ID NO: 146993 - DNA, 36 bp, Artificial Sequence
  Synthetic oligonucleotide
gaagccgctcacttatggccgacccttctgttccaa

SEQ ID NO: 146994 - DNA, 36 bp, Artificial Sequence
  Synthetic oligonucleotide
gtgcgaacgggacaagggaggatagagggtagggaa

SEQ ID NO: 146995 - DNA, 36 bp, Artificial Sequence
  Synthetic oligonucleotide
gtgagctggtcaccgacgccccccttctctctggaa

SEQ ID NO: 146996 - DNA, 36 bp, Artificial Sequence
  Synthetic oligonucleotide
accaccctccgcattcgcctttgtttacacattgaa

SEQ ID NO: 146997 - DNA, 36 bp, Artificial Sequence
  Synthetic oligonucleotide
gttgcggacacccgacctgctccctaactgccgcca

SEQ ID NO: 146998 - DNA, 36 bp, Artificial Sequence
  Synthetic oligonucleotide
tagcccggcgcaccgtatagcacctttccccatcca

SEQ ID NO: 146999 - DNA, 36 bp, Artificial Sequence
  Synthetic oligonucleotide
tattcatgccctccgctcctggtcgccattggtgca

SEQ ID NO: 147000 - DNA, 37 bp, Artificial Sequence
  Synthetic oligonucleotide
acgcgcaccccacctattgcctggcctatcacctcga

SEQ ID NO: 147001 - DNA, 37 bp, Artificial Sequence
  Synthetic oligonucleotide
gacctctcctgtgtgcctcttgccttgtgtccctcga

SEQ ID NO: 147002 - DNA, 36 bp, Artificial Sequence
  Synthetic oligonucleotide
tgagcgcctgttgattccttttcacgccgccttcga

SEQ ID NO: 147003 - DNA, 37 bp, Artificial Sequence
  Synthetic oligonucleotide
gaccgcccggccctccaaatgtctttcaccgtttcga

SEQ ID NO: 147004 - DNA, 37 bp, Artificial Sequence
  Synthetic oligonucleotide
gagcgtatagcgagcggggtgggagggcaagtacgga

SEQ ID NO: 147005 - DNA, 37 bp, Artificial Sequence
  Synthetic oligonucleotide
accctgtgtcgctgctcatttaccccacgccatcgga

SEQ ID NO: 147006 - DNA, 37 bp, Artificial Sequence
  Synthetic oligonucleotide
gagggacatgtcgaagggggtatgtgggttgagggga

SEQ ID NO: 147007 - DNA, 37 bp, Artificial Sequence
  Synthetic oligonucleotide
gaaagagacaagtggttcaggcaacagggggcgggga

SEQ ID NO: 147008 - DNA, 36 bp, Artificial Sequence
  Synthetic oligonucleotide
acatcactcgcctcgacgcactgacctccgaaatga

SEQ ID NO: 147009 - DNA, 37 bp, Artificial Sequence
  Synthetic oligonucleotide
ggaaaggggaagagggggggtggagccaaattaatga

SEQ ID NO: 147010 - DNA, 37 bp, Artificial Sequence
  Synthetic oligonucleotide
ggatggggtgaggggaaggaggttcgggataagctga

SEQ ID NO: 147011 - DNA, 38 bp, Artificial Sequence
  Synthetic oligonucleotide
aacaaggaggggggaaggtaaggccaagagatgggtga

SEQ ID NO: 147012 - DNA, 36 bp, Artificial Sequence
  Synthetic oligonucleotide
tctgccaggcgctattgccacccgtaccctgctata

SEQ ID NO: 147013 - DNA, 35 bp, Artificial Sequence
  Synthetic oligonucleotide
tgacgatgactttcccgtgtcggtcttgtttccac

SEQ ID NO: 147014 - DNA, 35 bp, Artificial Sequence
  Synthetic oligonucleotide
attcatacgccgatccctccacacgccaacatgac

SEQ ID NO: 147015 - DNA, 35 bp, Artificial Sequence
  Synthetic oligonucleotide
gtaccctgccagccccgctttcctccttctgttac

SEQ ID NO: 147016 - DNA, 35 bp, Artificial Sequence
  Synthetic oligonucleotide
gctcctgccaccaagacctctcgcttagaacgccc

SEQ ID NO: 147017 - DNA, 35 bp, Artificial Sequence
  Synthetic oligonucleotide
gccgttcatccgcacgtcttgtcgtccatcctccc

SEQ ID NO: 147018 - DNA, 35 bp, Artificial Sequence
  Synthetic oligonucleotide
gaccccgacggcccggagctccactcttcatatcc

SEQ ID NO: 147019 - DNA, 35 bp, Artificial Sequence
  Synthetic oligonucleotide
tcccatctgtccctcttaaccggggagtagtttcc

SEQ ID NO: 147020 - DNA, 35 bp, Artificial Sequence
  Synthetic oligonucleotide
actcgccacacacctgtgtccccccctcctcccgc

SEQ ID NO: 147021 - DNA, 35 bp, Artificial Sequence
  Synthetic oligonucleotide
acacctctcgcttatcgggcacacacctgctatgc

SEQ ID NO: 147022 - DNA, 35 bp, Artificial Sequence
  Synthetic oligonucleotide
ttgaagccgaacgcgctcacggcctttgctccatc

SEQ ID NO: 147023 - DNA, 35 bp, Artificial Sequence
  Synthetic oligonucleotide
gtctaacccgccataactttgtactctctgtcatc

SEQ ID NO: 147024 - DNA, 35 bp, Artificial Sequence
  Synthetic oligonucleotide
gtcgtagggcacgccccccgtttcatttgatcctc

SEQ ID NO: 147025 - DNA, 35 bp, Artificial Sequence
  Synthetic oligonucleotide
ttacgagcccgacgaattctatcatccccccggtc

SEQ ID NO: 147026 - DNA, 35 bp, Artificial Sequence
  Synthetic oligonucleotide
gtcccgtcctcgtactcccttttggccgttatttc

SEQ ID NO: 147027 - DNA, 35 bp, Artificial Sequence
  Synthetic oligonucleotide
tccgttcagagatgggtgggtgggacctgggaccg

SEQ ID NO: 147028 - DNA, 35 bp, Artificial Sequence
  Synthetic oligonucleotide
tgcgaccgtatagcctcccccagttttgccctccg

SEQ ID NO: 147029 - DNA, 35 bp, Artificial Sequence
  Synthetic oligonucleotide
gaccctgctctcccccaccagggtactatgcttcg

SEQ ID NO: 147030 - DNA, 33 bp, Artificial Sequence
  Synthetic oligonucleotide
gactcgccaaatggggggggtgctggggtgagg

SEQ ID NO: 147031 - DNA, 35 bp, Artificial Sequence
  Synthetic oligonucleotide
agacagcacatacgtctcaccatccatgcctcttg

SEQ ID NO: 147032 - DNA, 35 bp, Artificial Sequence
  Synthetic oligonucleotide
ggaagagggggggggcgaaatagtacacaggagat

SEQ ID NO: 147033 - DNA, 33 bp, Artificial Sequence
  Synthetic oligonucleotide
taccccccgccctcgtcttggccgaactcatat

SEQ ID NO: 147034 - DNA, 35 bp, Artificial Sequence
  Synthetic oligonucleotide
ccaccgcccctcgcagtgtaggctaattccaccct

SEQ ID NO: 147035 - DNA, 35 bp, Artificial Sequence
  Synthetic oligonucleotide
tgtgtacctccgttttgcccttgtgcggtcaccct

SEQ ID NO: 147036 - DNA, 35 bp, Artificial Sequence
  Synthetic oligonucleotide
acccaccgaacccgtcgcatcatgtttcggcccct

SEQ ID NO: 147037 - DNA, 35 bp, Artificial Sequence
  Synthetic oligonucleotide
acatccccgtgcccacttcccacctacagtactgt

SEQ ID NO: 147038 - DNA, 35 bp, Artificial Sequence
  Synthetic oligonucleotide
tgttacagtgccaatctatggtctcccttccctgt

SEQ ID NO: 147039 - DNA, 35 bp, Artificial Sequence
  Synthetic oligonucleotide
gccgggattgggagggcagggaaaacccgcttctt

SEQ ID NO: 147040 - DNA, 36 bp, Artificial Sequence
  Synthetic oligonucleotide
ggggggggtaggcatgtaggatggagcggtgggaaa

SEQ ID NO: 147041 - DNA, 35 bp, Artificial Sequence
  Synthetic oligonucleotide
atcgacaccgcaccctcgtcacttcaaccgaccaa

SEQ ID NO: 147042 - DNA, 36 bp, Artificial Sequence
  Synthetic oligonucleotide
taccgccttctacaccatcatgtccgtttgtgccaa

SEQ ID NO: 147043 - DNA, 36 bp, Artificial Sequence
  Synthetic oligonucleotide
gatgtatgtagtgggagggagggggagggtagggaa

SEQ ID NO: 147044 - DNA, 36 bp, Artificial Sequence
  Synthetic oligonucleotide
gccgacgcactttcgcctgccctaatacccggttaa

SEQ ID NO: 147045 - DNA, 36 bp, Artificial Sequence
  Synthetic oligonucleotide
tttcacccacgattcgcagtacgctgtccttgtcca

SEQ ID NO: 147046 - DNA, 35 bp, Artificial Sequence
  Synthetic oligonucleotide
tagctcccccctctagtccgccgtaaatcaccgca

SEQ ID NO: 147047 - DNA, 35 bp, Artificial Sequence
  Synthetic oligonucleotide
atggcgctcccaagcctaccctcttcggtacatca

SEQ ID NO: 147048 - DNA, 37 bp, Artificial Sequence
  Synthetic oligonucleotide
gagcagagtaccgggtctgtagggtgggggggcacga

SEQ ID NO: 147049 - DNA, 35 bp, Artificial Sequence
  Synthetic oligonucleotide
accgccctcctcacccatttcatgtaatacgacga

SEQ ID NO: 147050 - DNA, 37 bp, Artificial Sequence
  Synthetic oligonucleotide
ttggcgccccgcccccatgaaggattctgccacccga

SEQ ID NO: 147051 - DNA, 37 bp, Artificial Sequence
  Synthetic oligonucleotide
aacgtggagaggggcaagggagtgagtgggtctccga

SEQ ID NO: 147052 - DNA, 34 bp, Artificial Sequence
  Synthetic oligonucleotide
acttgcaccggcctctaacgttattgcccccgga

SEQ ID NO: 147053 - DNA, 37 bp, Artificial Sequence
  Synthetic oligonucleotide
accgcccccctcatccctcaagcggatcccatccgga

SEQ ID NO: 147054 - DNA, 38 bp, Artificial Sequence
  Synthetic oligonucleotide
aaccgcacccggcctactgccattccacttccacctga

SEQ ID NO: 147055 - DNA, 35 bp, Artificial Sequence
  Synthetic oligonucleotide
ttgctatcgccccttccccttctctcgcacggtga

SEQ ID NO: 147056 - DNA, 36 bp, Artificial Sequence
  Synthetic oligonucleotide
agcccagggtgggaagggtttagggggatatcttga

SEQ ID NO: 147057 - DNA, 34 bp, Artificial Sequence
  Synthetic oligonucleotide
tcaagccctccgacgcccccgaatgttacagcta

SEQ ID NO: 147058 - DNA, 35 bp, Artificial Sequence
  Synthetic oligonucleotide
taactcgcagtcggggtctacagttctatcgcccc

SEQ ID NO: 147059 - DNA, 35 bp, Artificial Sequence
  Synthetic oligonucleotide
tagcccccatgcccccgtgtcctcggttcgtcgcc

SEQ ID NO: 147060 - DNA, 35 bp, Artificial Sequence
  Synthetic oligonucleotide
gtgctagctgcattgctctgacttccatcttatcc

SEQ ID NO: 147061 - DNA, 35 bp, Artificial Sequence
  Synthetic oligonucleotide
atgtgcgtgctatatacctcacctgttggccctcc

SEQ ID NO: 147062 - DNA, 35 bp, Artificial Sequence
  Synthetic oligonucleotide
ccctgctccacccgtagtgtcccgttctgggctcc

SEQ ID NO: 147063 - DNA, 35 bp, Artificial Sequence
  Synthetic oligonucleotide
taagcccgcaccctaccgttccaatgctcgtgtcc

SEQ ID NO: 147064 - DNA, 35 bp, Artificial Sequence
  Synthetic oligonucleotide
gacgcccttcttactcttattttgccgccccacgc

SEQ ID NO: 147065 - DNA, 35 bp, Artificial Sequence
  Synthetic oligonucleotide
ttcccactggccccgcaatcgcatacccgtccctc

SEQ ID NO: 147066 - DNA, 35 bp, Artificial Sequence
  Synthetic oligonucleotide
aactcgttcacgcctggttgtcccccttcttcctc

SEQ ID NO: 147067 - DNA, 35 bp, Artificial Sequence
  Synthetic oligonucleotide
ttagccctactccgccagccggccatactcctctc

SEQ ID NO: 147068 - DNA, 35 bp, Artificial Sequence
  Synthetic oligonucleotide
tcgatgcctacaccatactcgtacactccccatag

SEQ ID NO: 147069 - DNA, 35 bp, Artificial Sequence
  Synthetic oligonucleotide
gacccccatccccccgttcaatgagaatgcaaacg

SEQ ID NO: 147070 - DNA, 35 bp, Artificial Sequence
  Synthetic oligonucleotide
ttcgactcccaggccccttgctttgctctgcctcg

SEQ ID NO: 147071 - DNA, 35 bp, Artificial Sequence
  Synthetic oligonucleotide
tgacgcctaccgctcactttgtctgttgtccctgg

SEQ ID NO: 147072 - DNA, 35 bp, Artificial Sequence
  Synthetic oligonucleotide
gcctcacagactgccttccccaattcagcgaattg

SEQ ID NO: 147073 - DNA, 35 bp, Artificial Sequence
  Synthetic oligonucleotide
tgcaagaacccagcgctccatccccccgtgactct

SEQ ID NO: 147074 - DNA, 35 bp, Artificial Sequence
  Synthetic oligonucleotide
tatgaacagggtaaacagggtgagtgggatggggt

SEQ ID NO: 147075 - DNA, 35 bp, Artificial Sequence
  Synthetic oligonucleotide
aacacgcttgtggtcctgcaacttcccttcattgt

SEQ ID NO: 147076 - DNA, 36 bp, Artificial Sequence
  Synthetic oligonucleotide
tcccacctctcttcgtgcatcactaccgggcataaa

SEQ ID NO: 147077 - DNA, 36 bp, Artificial Sequence
  Synthetic oligonucleotide
atacccgccctcacacgttactctcatttctttgaa

SEQ ID NO: 147078 - DNA, 36 bp, Artificial Sequence
  Synthetic oligonucleotide
aacccctgtcgcgtagctgcttgaccactcccccca

SEQ ID NO: 147079 - DNA, 36 bp, Artificial Sequence
  Synthetic oligonucleotide
tccccctcacgccaatctgccttcgcccgtctccca

SEQ ID NO: 147080 - DNA, 36 bp, Artificial Sequence
  Synthetic oligonucleotide
attccaccatcgggttcccttctgactctggttcca

SEQ ID NO: 147081 - DNA, 36 bp, Artificial Sequence
  Synthetic oligonucleotide
agccgcctcctccgcctcttgctacgctttcgtgca

SEQ ID NO: 147082 - DNA, 36 bp, Artificial Sequence
  Synthetic oligonucleotide
gcgagcgccgcaccttggtatctttcgtttgcctca

SEQ ID NO: 147083 - DNA, 35 bp, Artificial Sequence
  Synthetic oligonucleotide
tccatcatcggcctatagtgcttccctccctttca

SEQ ID NO: 147084 - DNA, 35 bp, Artificial Sequence
  Synthetic oligonucleotide
cacgccacgttgcgcgacgtgcctcccccgtttca

SEQ ID NO: 147085 - DNA, 34 bp, Artificial Sequence
  Synthetic oligonucleotide
acgactccatcatccggccacattcgtaacccga

SEQ ID NO: 147086 - DNA, 37 bp, Artificial Sequence
  Synthetic oligonucleotide
tagcgcagctctcaatctgctaagctcccccgcccga

SEQ ID NO: 147087 - DNA, 37 bp, Artificial Sequence
  Synthetic oligonucleotide
gatgatgcaggggaatacggaagaaagggacggccga

SEQ ID NO: 147088 - DNA, 37 bp, Artificial Sequence
  Synthetic oligonucleotide
aacgtcacctccgcttctggttttgcgccactgccga

SEQ ID NO: 147089 - DNA, 37 bp, Artificial Sequence
  Synthetic oligonucleotide
tcaaacgcagggtgggtatcgactcgggggggtagga

SEQ ID NO: 147090 - DNA, 37 bp, Artificial Sequence
  Synthetic oligonucleotide
atcgtgataggggagctggttgggagggctgggggga

SEQ ID NO: 147091 - DNA, 37 bp, Artificial Sequence
  Synthetic oligonucleotide
agtgtgagggttggttggggaagtggtggctggggga

SEQ ID NO: 147092 - DNA, 38 bp, Artificial Sequence
  Synthetic oligonucleotide
acaccaccacagccgctggcctaccacatctcgaatga

SEQ ID NO: 147093 - DNA, 37 bp, Artificial Sequence
  Synthetic oligonucleotide
tccccgcccagtatgcctacccttagcttcccactga

SEQ ID NO: 147094 - DNA, 37 bp, Artificial Sequence
  Synthetic oligonucleotide
acacgtcgcacaaccgtttcgccacgagcccccctga

SEQ ID NO: 147095 - DNA, 35 bp, Artificial Sequence
  Synthetic oligonucleotide
gctctggccccctccgtttatcctgttttctcata

SEQ ID NO: 147096 - DNA, 35 bp, Artificial Sequence
  Synthetic oligonucleotide
tacaagaaggggggagagagatggtgagcgcgata

SEQ ID NO: 147097 - DNA, 36 bp, Artificial Sequence
  Synthetic oligonucleotide
gcctccacactgatccctgcatacttagggccacta

SEQ ID NO: 147098 - DNA, 36 bp, Artificial Sequence
  Synthetic oligonucleotide
ggttcgccggccgtccgttcgtttccacacctgcta

SEQ ID NO: 147099 - DNA, 36 bp, Artificial Sequence
  Synthetic oligonucleotide
tccccgccactctataatccctcgcctcatggcgta

SEQ ID NO: 147100 - DNA, 36 bp, Artificial Sequence
  Synthetic oligonucleotide
gtgtccgcacatcgttgaagccctctttcccaggta

SEQ ID NO: 147101 - DNA, 35 bp, Artificial Sequence
  Synthetic oligonucleotide
ttaggagtgcggacataagcaaggggcgggtggta

SEQ ID NO: 147102 - DNA, 34 bp, Artificial Sequence
  Synthetic oligonucleotide
accacccagctcggtctaccttattctgcctgta

SEQ ID NO: 147103 - DNA, 35 bp, Artificial Sequence
  Synthetic oligonucleotide
atgtccacctctattgtcgtctccggttccaatta

SEQ ID NO: 147104 - DNA, 35 bp, Artificial Sequence
  Synthetic oligonucleotide
gccgcatgagatctcgctaaacggtccgccgcccc

SEQ ID NO: 147105 - DNA, 35 bp, Artificial Sequence
  Synthetic oligonucleotide
gcctcggtcggtacttcatcgcctctccatttccc

SEQ ID NO: 147106 - DNA, 35 bp, Artificial Sequence
  Synthetic oligonucleotide
acatgccgagctcccgggtctggccgccttacgcc

SEQ ID NO: 147107 - DNA, 35 bp, Artificial Sequence
  Synthetic oligonucleotide
tcccccgctcacgaactgctcgtttggtcacatcc

SEQ ID NO: 147108 - DNA, 35 bp, Artificial Sequence
  Synthetic oligonucleotide
tcccgcccctgttgttgcctcactctcggtcatcc

SEQ ID NO: 147109 - DNA, 35 bp, Artificial Sequence
  Synthetic oligonucleotide
gggagcccctggtctctacgcctgcttttttgtcc

SEQ ID NO: 147110 - DNA, 35 bp, Artificial Sequence
  Synthetic oligonucleotide
gatcctccctgtgcaaaccgcctacctctcctagc

SEQ ID NO: 147111 - DNA, 35 bp, Artificial Sequence
  Synthetic oligonucleotide
tccccaactcggttcatatagtaccaccactctgc

SEQ ID NO: 147112 - DNA, 35 bp, Artificial Sequence
  Synthetic oligonucleotide
gcacagccatttcatccgctccagtgcctaatgtc

SEQ ID NO: 147113 - DNA, 35 bp, Artificial Sequence
  Synthetic oligonucleotide
tcatggccatttcctcaagtgtctgccgccctgtc

SEQ ID NO: 147114 - DNA, 35 bp, Artificial Sequence
  Synthetic oligonucleotide
gtgctccacccctccgcttaacgcaatccttgttc

SEQ ID NO: 147115 - DNA, 35 bp, Artificial Sequence
  Synthetic oligonucleotide
ttgtccgcacccactcgttcctcgcatcttaaaag

SEQ ID NO: 147116 - DNA, 35 bp, Artificial Sequence
  Synthetic oligonucleotide
aacgaggatggctggggaggtagagcagagtaaag

SEQ ID NO: 147117 - DNA, 35 bp, Artificial Sequence
  Synthetic oligonucleotide
tccgcccggtctccctatcttttctgcacagcgag

SEQ ID NO: 147118 - DNA, 35 bp, Artificial Sequence
  Synthetic oligonucleotide
tcccaccatgctccctcgtgccccgaattagaccg

SEQ ID NO: 147119 - DNA, 35 bp, Artificial Sequence
  Synthetic oligonucleotide
aaccccgccatatctcgctcagcaggccatccccg

SEQ ID NO: 147120 - DNA, 35 bp, Artificial Sequence
  Synthetic oligonucleotide
actgcccccctctcgaacgtgttcagcatgctgcg

SEQ ID NO: 147121 - DNA, 35 bp, Artificial Sequence
  Synthetic oligonucleotide
aaacactgagaagggatgggagtttggatggaagg

SEQ ID NO: 147122 - DNA, 35 bp, Artificial Sequence
  Synthetic oligonucleotide
tcttgtcctccgcctgtaaaacccccagtactggg

SEQ ID NO: 147123 - DNA, 35 bp, Artificial Sequence
  Synthetic oligonucleotide
cacaccctctctgaactccctctcgccctgtagtg

SEQ ID NO: 147124 - DNA, 35 bp, Artificial Sequence
  Synthetic oligonucleotide
tgaacctccttgccctgaatgttacaccatggcct

SEQ ID NO: 147125 - DNA, 35 bp, Artificial Sequence
  Synthetic oligonucleotide
tgtgagccctggatcgttgcgagccggttcctcct

SEQ ID NO: 147126 - DNA, 35 bp, Artificial Sequence
  Synthetic oligonucleotide
gcctctgcgccctgcattcaaatcacaccttgtct

SEQ ID NO: 147127 - DNA, 35 bp, Artificial Sequence
  Synthetic oligonucleotide
actcccccctgtcgatgatttgtgatcccccactt

SEQ ID NO: 147128 - DNA, 35 bp, Artificial Sequence
  Synthetic oligonucleotide
gtgcgatcgcctgccggataggtccattattcctt

SEQ ID NO: 147129 - DNA, 36 bp, Artificial Sequence
  Synthetic oligonucleotide
gacaggggtacaggacacggtgggggggttaggaaa

SEQ ID NO: 147130 - DNA, 36 bp, Artificial Sequence
  Synthetic oligonucleotide
gcgtggccctcccttgccgtttattcgtccaacgaa

SEQ ID NO: 147131 - DNA, 35 bp, Artificial Sequence
  Synthetic oligonucleotide
gcctgttcgcgtaaaactcatatgcacttcccaca

SEQ ID NO: 147132 - DNA, 36 bp, Artificial Sequence
  Synthetic oligonucleotide
tagtcccccctgagttatacgtgctaacccatccca

SEQ ID NO: 147133 - DNA, 35 bp, Artificial Sequence
  Synthetic oligonucleotide
tcctcgaaccacctcattatctggaccatgctcca

SEQ ID NO: 147134 - DNA, 36 bp, Artificial Sequence
  Synthetic oligonucleotide
gccaacgttgggcatacctccctactgcatccatca

SEQ ID NO: 147135 - DNA, 36 bp, Artificial Sequence
  Synthetic oligonucleotide
gtccccagcccgccgccaccaagccatactagatca

SEQ ID NO: 147136 - DNA, 36 bp, Artificial Sequence
  Synthetic oligonucleotide
gtgttcccaccgttcagcgtgattcattctccctca

SEQ ID NO: 147137 - DNA, 35 bp, Artificial Sequence
  Synthetic oligonucleotide
tcccatcccaaacacacgcccgcgcctcctggtca

SEQ ID NO: 147138 - DNA, 35 bp, Artificial Sequence
  Synthetic oligonucleotide
tttgacatccctcctccccttctgcgcgcctgtca

SEQ ID NO: 147139 - DNA, 35 bp, Artificial Sequence
  Synthetic oligonucleotide
atttaccgcagtagtaacgcttttgctcgccttca

SEQ ID NO: 147140 - DNA, 35 bp, Artificial Sequence
  Synthetic oligonucleotide
tcgcacttccatcccttctatccttcgcctgttca

SEQ ID NO: 147141 - DNA, 37 bp, Artificial Sequence
  Synthetic oligonucleotide
gcgacgctccatcttgcatactaccgaactcccccga

SEQ ID NO: 147142 - DNA, 37 bp, Artificial Sequence
  Synthetic oligonucleotide
agaccgtgggggggagggtcgggttgctatgaacgga

SEQ ID NO: 147143 - DNA, 37 bp, Artificial Sequence
  Synthetic oligonucleotide
acggtgggggaggtaaagtgaatgtggagggatggga

SEQ ID NO: 147144 - DNA, 38 bp, Artificial Sequence
  Synthetic oligonucleotide
tcccaccccggactatttgagtcgtcccgtgcccatga

SEQ ID NO: 147145 - DNA, 37 bp, Artificial Sequence
  Synthetic oligonucleotide
atccgaggagtggaagaggaggggggaggatgactga

SEQ ID NO: 147146 - DNA, 38 bp, Artificial Sequence
  Synthetic oligonucleotide
gtacgcccccgcactcctctatctatgccaggtactga

SEQ ID NO: 147147 - DNA, 38 bp, Artificial Sequence
  Synthetic oligonucleotide
tgcgactgccctttacgccgtgcattttccattcctga

SEQ ID NO: 147148 - DNA, 37 bp, Artificial Sequence
  Synthetic oligonucleotide
acagtcgcccgtacccccccagcttcgccctaggtga

SEQ ID NO: 147149 - DNA, 38 bp, Artificial Sequence
  Synthetic oligonucleotide
tccacgcttccgactatgtccctctccatctgcattga

SEQ ID NO: 147150 - DNA, 36 bp, Artificial Sequence
  Synthetic oligonucleotide
gtctgccccactatgccaagccctccgttacgagta

SEQ ID NO: 147151 - DNA, 35 bp, Artificial Sequence
  Synthetic oligonucleotide
gaggacgtagagggggtggggaagcggggagtgta

SEQ ID NO: 147152 - DNA, 36 bp, Artificial Sequence
  Synthetic oligonucleotide
tcatgcacccgctgtagtcgcccatggtctcgctta

SEQ ID NO: 147153 - DNA, 35 bp, Artificial Sequence
  Synthetic oligonucleotide
tccactagccagactcgtatccacctccacacgcc

SEQ ID NO: 147154 - DNA, 35 bp, Artificial Sequence
  Synthetic oligonucleotide
ggagtgttccgccgttgccagcacttttccgatcc

SEQ ID NO: 147155 - DNA, 35 bp, Artificial Sequence
  Synthetic oligonucleotide
accacgcaaacatcctggggtttcctgtgccactc

SEQ ID NO: 147156 - DNA, 35 bp, Artificial Sequence
  Synthetic oligonucleotide
tctggactcgcgtacacgctccacgtttgccactc

SEQ ID NO: 147157 - DNA, 35 bp, Artificial Sequence
  Synthetic oligonucleotide
atctccgccaggctcaccacctagatctcccggtc

SEQ ID NO: 147158 - DNA, 35 bp, Artificial Sequence
  Synthetic oligonucleotide
gttcacgggggaggaaacgggggacaatatagcag

SEQ ID NO: 147159 - DNA, 35 bp, Artificial Sequence
  Synthetic oligonucleotide
gttacccgtactgtaattatcgctcccttgctacg

SEQ ID NO: 147160 - DNA, 35 bp, Artificial Sequence
  Synthetic oligonucleotide
ttgacgccccctcccgttgcatcgccctcgccact

SEQ ID NO: 147161 - DNA, 35 bp, Artificial Sequence
  Synthetic oligonucleotide
tgacatcccactcttgtttctcacccctgtttact

SEQ ID NO: 147162 - DNA, 35 bp, Artificial Sequence
  Synthetic oligonucleotide
gtacacacgatgccgactcgctccgccttcctgct

SEQ ID NO: 147163 - DNA, 35 bp, Artificial Sequence
  Synthetic oligonucleotide
gtgattacagatggtgttgccgcccttgcccctct

SEQ ID NO: 147164 - DNA, 35 bp, Artificial Sequence
  Synthetic oligonucleotide
aaagggtgagggcggggcgggcgtagcgtacattt

SEQ ID NO: 147165 - DNA, 35 bp, Artificial Sequence
  Synthetic oligonucleotide
tggaggggcttagggggggggcgggacgaacgaaa

SEQ ID NO: 147166 - DNA, 36 bp, Artificial Sequence
  Synthetic oligonucleotide
gcccacgggcggggggtgtgggtataagcaagataa

SEQ ID NO: 147167 - DNA, 36 bp, Artificial Sequence
  Synthetic oligonucleotide
gcacgccgcgtctgctatccaccgtcccctcccaca

SEQ ID NO: 147168 - DNA, 36 bp, Artificial Sequence
  Synthetic oligonucleotide
ttattcaccgcccggttatgtcaacccttccatcca

SEQ ID NO: 147169 - DNA, 36 bp, Artificial Sequence
  Synthetic oligonucleotide
gagacagtggcgagaagagaagtggggtggggtgca

SEQ ID NO: 147170 - DNA, 36 bp, Artificial Sequence
  Synthetic oligonucleotide
atgtgcgagcgctagcccccctttcgcaacccatca

SEQ ID NO: 147171 - DNA, 36 bp, Artificial Sequence
  Synthetic oligonucleotide
taaacccaccaccaccctgcgcgactgtcctgccga

SEQ ID NO: 147172 - DNA, 36 bp, Artificial Sequence
  Synthetic oligonucleotide
tccaccactccccaccggctattacacacgtgccga

SEQ ID NO: 147173 - DNA, 36 bp, Artificial Sequence
  Synthetic oligonucleotide
ttgatgtggtacgagcggtgaagggaagggaggcga

SEQ ID NO: 147174 - DNA, 37 bp, Artificial Sequence
  Synthetic oligonucleotide
accacgggcggggttgtgttttgttggggatagggga

SEQ ID NO: 147175 - DNA, 37 bp, Artificial Sequence
  Synthetic oligonucleotide
tataccgccgccgctgccacttactactgctcctgga

SEQ ID NO: 147176 - DNA, 37 bp, Artificial Sequence
  Synthetic oligonucleotide
gaaggaggaggcggacagggctctgaaggagggatga

SEQ ID NO: 147177 - DNA, 37 bp, Artificial Sequence
  Synthetic oligonucleotide
gtcgtctggtggagggggggacggttggacggactga

SEQ ID NO: 147178 - DNA, 37 bp, Artificial Sequence
  Synthetic oligonucleotide
tccacccgtgcgccaccctatcagacactcgttctga

SEQ ID NO: 147179 - DNA, 38 bp, Artificial Sequence
  Synthetic oligonucleotide
gctccaccccctgagaacttccgagccctccctagtga

SEQ ID NO: 147180 - DNA, 35 bp, Artificial Sequence
  Synthetic oligonucleotide
acagcataagggggcacggtggagggggaatgtga

SEQ ID NO: 147181 - DNA, 36 bp, Artificial Sequence
  Synthetic oligonucleotide
acatagacggaatagggaaagactaggtgggtgtga

SEQ ID NO: 147182 - DNA, 37 bp, Artificial Sequence
  Synthetic oligonucleotide
tgcgcgcaaacgggagggaaactgggagggcgattga

SEQ ID NO: 147183 - DNA, 37 bp, Artificial Sequence
  Synthetic oligonucleotide
gttcgccccccttggcctcaatatcacatacagttga

SEQ ID NO: 147184 - DNA, 38 bp, Artificial Sequence
  Synthetic oligonucleotide
aagaccacctcccgtgctcaacatccatacctgtttga

SEQ ID NO: 147185 - DNA, 35 bp, Artificial Sequence
  Synthetic oligonucleotide
tttcagtcgcccctcggttctttgcatcaccccta

SEQ ID NO: 147186 - DNA, 36 bp, Artificial Sequence
  Synthetic oligonucleotide
tgcgcccgtcatcggtcaaacgtactatctgcccta

SEQ ID NO: 147187 - DNA, 36 bp, Artificial Sequence
  Synthetic oligonucleotide
gattcagccggtctcgctgttcattctaccttctta

SEQ ID NO: 147188 - DNA, 35 bp, Artificial Sequence
  Synthetic oligonucleotide
actcacccatcgcccataccatgttatgctgtcac

SEQ ID NO: 147189 - DNA, 35 bp, Artificial Sequence
  Synthetic oligonucleotide
gcgtatcccgtcacattcgttgcttcccccggtac

SEQ ID NO: 147190 - DNA, 35 bp, Artificial Sequence
  Synthetic oligonucleotide
tttacacgcactgggagggtgtgggaggggggtac

SEQ ID NO: 147191 - DNA, 35 bp, Artificial Sequence
  Synthetic oligonucleotide
atctgacccccgcttcacatccttagaactacgcc

SEQ ID NO: 147192 - DNA, 35 bp, Artificial Sequence
  Synthetic oligonucleotide
tcagacgcgcaactgtccaccttacgtccccctcc

SEQ ID NO: 147193 - DNA, 35 bp, Artificial Sequence
  Synthetic oligonucleotide
ttacgccaagtcccgcatgtacctctccttcctcc

SEQ ID NO: 147194 - DNA, 35 bp, Artificial Sequence
  Synthetic oligonucleotide
atccgcccctcgttcgcccaccggtacacttgtcc

SEQ ID NO: 147195 - DNA, 35 bp, Artificial Sequence
  Synthetic oligonucleotide
acactgttcgcctctccggttcaagtcttgaccgc

SEQ ID NO: 147196 - DNA, 34 bp, Artificial Sequence
  Synthetic oligonucleotide
gccaaagccaattcgttcatccctgcttatatgc

SEQ ID NO: 147197 - DNA, 35 bp, Artificial Sequence
  Synthetic oligonucleotide
tgccgcactgtgccgcctattgaatctctttgctc

SEQ ID NO: 147198 - DNA, 35 bp, Artificial Sequence
  Synthetic oligonucleotide
agcgcaccgcatgtccacgttcacgccatctcttc

SEQ ID NO: 147199 - DNA, 35 bp, Artificial Sequence
  Synthetic oligonucleotide
agccaagctgcccgctggcctgatctcgccatttc

SEQ ID NO: 147200 - DNA, 35 bp, Artificial Sequence
  Synthetic oligonucleotide
atgcctctcgttcgtccacccacctccacccgtag

SEQ ID NO: 147201 - DNA, 35 bp, Artificial Sequence
  Synthetic oligonucleotide
atgcgttccgtcccgcccatgttcaacctttctgg

SEQ ID NO: 147202 - DNA, 35 bp, Artificial Sequence
  Synthetic oligonucleotide
accccattgacccgcccggatctcgcacccccctg

SEQ ID NO: 147203 - DNA, 35 bp, Artificial Sequence
  Synthetic oligonucleotide
gacctcccccgccgtgacctatggttgtacattat

SEQ ID NO: 147204 - DNA, 35 bp, Artificial Sequence
  Synthetic oligonucleotide
gtcctgccctcacactcggatagatcaccttacgt

SEQ ID NO: 147205 - DNA, 35 bp, Artificial Sequence
  Synthetic oligonucleotide
tagtgcctccgttggtcacccctgccgccattggt

SEQ ID NO: 147206 - DNA, 35 bp, Artificial Sequence
  Synthetic oligonucleotide
ggaggttaggagggcgggtttgaggggggtgcatt

SEQ ID NO: 147207 - DNA, 35 bp, Artificial Sequence
  Synthetic oligonucleotide
accgatccggtccaaggctattatatgcctgcctt

SEQ ID NO: 147208 - DNA, 35 bp, Artificial Sequence
  Synthetic oligonucleotide
gtgtgcgctagcgactccatcgaccctggttcctt

SEQ ID NO: 147209 - DNA, 35 bp, Artificial Sequence
  Synthetic oligonucleotide
acttcgcctttccgccgtgccccctttgttcggtt

SEQ ID NO: 147210 - DNA, 36 bp, Artificial Sequence
  Synthetic oligonucleotide
agcccctccgccacatccggctcgatcgttacacaa

SEQ ID NO: 147211 - DNA, 36 bp, Artificial Sequence
  Synthetic oligonucleotide
gacaagggggcaatgaggggggacaaggcagaggaa

SEQ ID NO: 147212 - DNA, 36 bp, Artificial Sequence
  Synthetic oligonucleotide
tttgggtggggtatgcaccagagacaggggggggaa

SEQ ID NO: 147213 - DNA, 36 bp, Artificial Sequence
  Synthetic oligonucleotide
atggggggtgaccgataaaggggcgggtaagaaaca

SEQ ID NO: 147214 - DNA, 36 bp, Artificial Sequence
  Synthetic oligonucleotide
aacgggaagggtcggtttacatcaggggcgggaaca

SEQ ID NO: 147215 - DNA, 35 bp, Artificial Sequence
  Synthetic oligonucleotide
ccccgacccattgcgtgttttaccgtccttgccca

SEQ ID NO: 147216 - DNA, 35 bp, Artificial Sequence
  Synthetic oligonucleotide
actcatcctctccgcccttcaatatgcctatggca

SEQ ID NO: 147217 - DNA, 36 bp, Artificial Sequence
  Synthetic oligonucleotide
gtgcgccgccccgagccttattgatatcatcttgca

SEQ ID NO: 147218 - DNA, 36 bp, Artificial Sequence
  Synthetic oligonucleotide
tacgttccccgctgatgaacaaacgtctcgctctca

SEQ ID NO: 147219 - DNA, 36 bp, Artificial Sequence
  Synthetic oligonucleotide
tgagccttcaaccgttcaactgcctgattttcttca

SEQ ID NO: 147220 - DNA, 36 bp, Artificial Sequence
  Synthetic oligonucleotide
ttagcctccgcctattttgcctcgtgtttactttca

SEQ ID NO: 147221 - DNA, 36 bp, Artificial Sequence
  Synthetic oligonucleotide
ttaccccccgacctcacttgaggtatgcccgtttca

SEQ ID NO: 147222 - DNA, 36 bp, Artificial Sequence
  Synthetic oligonucleotide
ttatccccgcccagccaccgaagttacccggtttca

SEQ ID NO: 147223 - DNA, 37 bp, Artificial Sequence
  Synthetic oligonucleotide
acagtgccgccattcctagtttctgccctttcaacga

SEQ ID NO: 147224 - DNA, 37 bp, Artificial Sequence
  Synthetic oligonucleotide
gtccgcccgacctgctagcccctagtattatttacga

SEQ ID NO: 147225 - DNA, 36 bp, Artificial Sequence
  Synthetic oligonucleotide
gcataccgccgttctgcccgacctaccatcagccga

SEQ ID NO: 147226 - DNA, 37 bp, Artificial Sequence
  Synthetic oligonucleotide
tctacccacgcacatccctgttgagtcatcctctcga

SEQ ID NO: 147227 - DNA, 37 bp, Artificial Sequence
  Synthetic oligonucleotide
gaggagacgttgggtgacaagggatgcggagggagga

SEQ ID NO: 147228 - DNA, 37 bp, Artificial Sequence
  Synthetic oligonucleotide
agcagggtgggagcggttacggggggagtatggcgga

SEQ ID NO: 147229 - DNA, 37 bp, Artificial Sequence
  Synthetic oligonucleotide
gacctgggcgggcggggtgcagactacgaacagggga

SEQ ID NO: 147230 - DNA, 36 bp, Artificial Sequence
  Synthetic oligonucleotide
gcacccgacccttcgtccgtacaatgcttccctgga

SEQ ID NO: 147231 - DNA, 38 bp, Artificial Sequence
  Synthetic oligonucleotide
gaccccacaccccattatgccattggacacccacctga

SEQ ID NO: 147232 - DNA, 35 bp, Artificial Sequence
  Synthetic oligonucleotide
aggtccactcgcggtctattcgcctctccacctga

SEQ ID NO: 147233 - DNA, 37 bp, Artificial Sequence
  Synthetic oligonucleotide
acatcacggtctcgtttcagcatccgccccatcctga

SEQ ID NO: 147234 - DNA, 36 bp, Artificial Sequence
  Synthetic oligonucleotide
agacggatggggaaggatgaaggggagtatggctga

SEQ ID NO: 147235 - DNA, 38 bp, Artificial Sequence
  Synthetic oligonucleotide
gtgaggagggaagaaggggagggtaagggaactcgtga

SEQ ID NO: 147236 - DNA, 37 bp, Artificial Sequence
  Synthetic oligonucleotide
tcccgccgcccccgttcccttagtacgagacaattga

SEQ ID NO: 147237 - DNA, 38 bp, Artificial Sequence
  Synthetic oligonucleotide
tcctcaccccggtacatccccgagatcttagtccttga

SEQ ID NO: 147238 - DNA, 38 bp, Artificial Sequence
  Synthetic oligonucleotide
gccctgccccatccgcgcggtcccagtcacgtcgttga

SEQ ID NO: 147239 - DNA, 37 bp, Artificial Sequence
  Synthetic oligonucleotide
tcaatgccccgccagccgaacatctgccctcttttga

SEQ ID NO: 147240 - DNA, 35 bp, Artificial Sequence
  Synthetic oligonucleotide
tcccgagccgaccgcagcgagtactatcccccata

SEQ ID NO: 147241 - DNA, 36 bp, Artificial Sequence
  Synthetic oligonucleotide
gtgggctggagagggaggatcgggtgggatgtgata

SEQ ID NO: 147242 - DNA, 36 bp, Artificial Sequence
  Synthetic oligonucleotide
tccgacactccctggccgaggtcctactttccacta

SEQ ID NO: 147243 - DNA, 35 bp, Artificial Sequence
  Synthetic oligonucleotide
gactcaccgcccaggtgtaccgtgctttcaaacac

SEQ ID NO: 147244 - DNA, 35 bp, Artificial Sequence
  Synthetic oligonucleotide
tctgaccgcactcgagcgaagaacgcctctcatac

SEQ ID NO: 147245 - DNA, 35 bp, Artificial Sequence
  Synthetic oligonucleotide
acaccgactcgctatttattgtacggcatccttac

SEQ ID NO: 147246 - DNA, 35 bp, Artificial Sequence
  Synthetic oligonucleotide
gcatcatccttttccgttggctgcccttgtcttac

SEQ ID NO: 147247 - DNA, 35 bp, Artificial Sequence
  Synthetic oligonucleotide
ttctgagcgcccggtctgcgactcttatctgcccc

SEQ ID NO: 147248 - DNA, 35 bp, Artificial Sequence
  Synthetic oligonucleotide
taggtaccgcacctgggcattccatcgttctcccc

SEQ ID NO: 147249 - DNA, 35 bp, Artificial Sequence
  Synthetic oligonucleotide
gcctacccgtgcgattgttgcctccgccggctccc

SEQ ID NO: 147250 - DNA, 35 bp, Artificial Sequence
  Synthetic oligonucleotide
ttcccgcctcctttgttcccttcaagtactccgcc

SEQ ID NO: 147251 - DNA, 35 bp, Artificial Sequence
  Synthetic oligonucleotide
attcgcgagcctcctcatccgatccccctggtgcc

SEQ ID NO: 147252 - DNA, 35 bp, Artificial Sequence
  Synthetic oligonucleotide
tagacccccgtaccactactataattagcctatcc

SEQ ID NO: 147253 - DNA, 35 bp, Artificial Sequence
  Synthetic oligonucleotide
tacgtccccgtcgcctagttgcttatctcctgtcc

SEQ ID NO: 147254 - DNA, 35 bp, Artificial Sequence
  Synthetic oligonucleotide
ttgactgccctagcattacatgattagcctcttcc

SEQ ID NO: 147255 - DNA, 35 bp, Artificial Sequence
  Synthetic oligonucleotide
gggtcaacccatttgcctacgactccaccaattgc

SEQ ID NO: 147256 - DNA, 35 bp, Artificial Sequence
  Synthetic oligonucleotide
ttgccccctcccttgtgcctagtatcccggtaatc

SEQ ID NO: 147257 - DNA, 35 bp, Artificial Sequence
  Synthetic oligonucleotide
gtgcgtctcgcactggcactgctcctgccccgatc

SEQ ID NO: 147258 - DNA, 35 bp, Artificial Sequence
  Synthetic oligonucleotide
ccacgtagcctcatccctccgctcgccgctttgtc

SEQ ID NO: 147259 - DNA, 35 bp, Artificial Sequence
  Synthetic oligonucleotide
gtccggtccctcgagtgccgtatgctcacttcttc

SEQ ID NO: 147260 - DNA, 35 bp, Artificial Sequence
  Synthetic oligonucleotide
tgacagtgtcagtccccccgcgaccgccgttgttc

SEQ ID NO: 147261 - DNA, 35 bp, Artificial Sequence
  Synthetic oligonucleotide
gagcatcccaaccatcccccttcgcctcctgatag

SEQ ID NO: 147262 - DNA, 35 bp, Artificial Sequence
  Synthetic oligonucleotide
gtgggcccctgacgtacaatccttccagttcctag

SEQ ID NO: 147263 - DNA, 35 bp, Artificial Sequence
  Synthetic oligonucleotide
tgacgtcccctcctccgcattcttccatgcgttcg

SEQ ID NO: 147264 - DNA, 35 bp, Artificial Sequence
  Synthetic oligonucleotide
gccgcaactgattcacctcccccccacggtcttgg

SEQ ID NO: 147265 - DNA, 35 bp, Artificial Sequence
  Synthetic oligonucleotide
aacgcccatcggtcccgggcccattcgccccacat

SEQ ID NO: 147266 - DNA, 35 bp, Artificial Sequence
  Synthetic oligonucleotide
tttgcgggactgttgcccttgttgccttccctcat

SEQ ID NO: 147267 - DNA, 35 bp, Artificial Sequence
  Synthetic oligonucleotide
gcctacaactgaccgtttctaggactatctcccct

SEQ ID NO: 147268 - DNA, 35 bp, Artificial Sequence
  Synthetic oligonucleotide
tgccactccccgcggggatcctgtgccatatccct

SEQ ID NO: 147269 - DNA, 35 bp, Artificial Sequence
  Synthetic oligonucleotide
gtgtctgctcattcgtcacaacaccttcttcgcct

SEQ ID NO: 147270 - DNA, 35 bp, Artificial Sequence
  Synthetic oligonucleotide
tgcgcagaacagctccgtctatcccgtgttcctct

SEQ ID NO: 147271 - DNA, 35 bp, Artificial Sequence
  Synthetic oligonucleotide
tctcgcccactgtgccttaactcgtaattcgctct

SEQ ID NO: 147272 - DNA, 35 bp, Artificial Sequence
  Synthetic oligonucleotide
tgcgcctacgcactccctactcactctcgatcggt

SEQ ID NO: 147273 - DNA, 35 bp, Artificial Sequence
  Synthetic oligonucleotide
gcgtctccgcctacccccatccgagccctccgtgt

SEQ ID NO: 147274 - DNA, 35 bp, Artificial Sequence
  Synthetic oligonucleotide
tgtcccaccgctgtctccggtaggacgctactttt

SEQ ID NO: 147275 - DNA, 35 bp, Artificial Sequence
  Synthetic oligonucleotide
tagtcccgccccccgtgcttggagtctgtactttt

SEQ ID NO: 147276 - DNA, 35 bp, Artificial Sequence
  Synthetic oligonucleotide
agagggggggcagggataaggggcaccgagcgaaa

SEQ ID NO: 147277 - DNA, 31 bp, Artificial Sequence
  Synthetic oligonucleotide
tccgccctgttttccagctcttttccgacaa

SEQ ID NO: 147278 - DNA, 35 bp, Artificial Sequence
  Synthetic oligonucleotide
ggttgggaggggggaatgaaggtagggtatattaa

SEQ ID NO: 147279 - DNA, 36 bp, Artificial Sequence
  Synthetic oligonucleotide
tctggacaccgggagttccgtcataccgcccctaca

SEQ ID NO: 147280 - DNA, 36 bp, Artificial Sequence
  Synthetic oligonucleotide
gctgttcccaggtagttcgccaccgctgcccaccca

SEQ ID NO: 147281 - DNA, 34 bp, Artificial Sequence
  Synthetic oligonucleotide
tgtccacccatctccgccggcactaagtggccca

SEQ ID NO: 147282 - DNA, 35 bp, Artificial Sequence
  Synthetic oligonucleotide
actcgcatccgatgctccacacgtcactcacgcca

SEQ ID NO: 147283 - DNA, 35 bp, Artificial Sequence
  Synthetic oligonucleotide
ttcgtccagccttaattgttactttaccatctcca

SEQ ID NO: 147284 - DNA, 36 bp, Artificial Sequence
  Synthetic oligonucleotide
ttgtgcccaccatctagtactcgtcccatgctatca

SEQ ID NO: 147285 - DNA, 36 bp, Artificial Sequence
  Synthetic oligonucleotide
ggaggactggggaaagggggaggtggaaaggtacga

SEQ ID NO: 147286 - DNA, 36 bp, Artificial Sequence
  Synthetic oligonucleotide
gttgcaccctccggggcttctaagatctccctccga

SEQ ID NO: 147287 - DNA, 37 bp, Artificial Sequence
  Synthetic oligonucleotide
gagctgccccacgtattcctatccccgtctccctcga

SEQ ID NO: 147288 - DNA, 37 bp, Artificial Sequence
  Synthetic oligonucleotide
taggggggaggtagggggccacagggtcaacagggga

SEQ ID NO: 147289 - DNA, 37 bp, Artificial Sequence
  Synthetic oligonucleotide
tgaggtcggtggaggggggaggaaattggtctgggga

SEQ ID NO: 147290 - DNA, 38 bp, Artificial Sequence
  Synthetic oligonucleotide
tgaccaggcgcccatttgccctgccaccatagttttga

SEQ ID NO: 147291 - DNA, 36 bp, Artificial Sequence
  Synthetic oligonucleotide
tgccattcccctctgctagtacgcattctatccata

SEQ ID NO: 147292 - DNA, 35 bp, Artificial Sequence
  Synthetic oligonucleotide
actcgccccgatccccagctgacttttcgcaggta

SEQ ID NO: 147293 - DNA, 35 bp, Artificial Sequence
  Synthetic oligonucleotide
ggggaaaggggggggatagccaagggccagtggta

SEQ ID NO: 147294 - DNA, 34 bp, Artificial Sequence
  Synthetic oligonucleotide
tacgactacccattctgctcccgggcggtcctta

SEQ ID NO: 147295 - DNA, 35 bp, Artificial Sequence
  Synthetic oligonucleotide
gccggagggccaaacgcaccattctacgcccccac

SEQ ID NO: 147296 - DNA, 35 bp, Artificial Sequence
  Synthetic oligonucleotide
gcccaccccctcatcccgcagaaggcacggggacc

SEQ ID NO: 147297 - DNA, 35 bp, Artificial Sequence
  Synthetic oligonucleotide
ttcgacatccggtctgatctgtcgaaccactcccc

SEQ ID NO: 147298 - DNA, 35 bp, Artificial Sequence
  Synthetic oligonucleotide
gaattgccccccggtgtgtgcaactctccccctcc

SEQ ID NO: 147299 - DNA, 35 bp, Artificial Sequence
  Synthetic oligonucleotide
actcagacgatccgcattacgtgcttcattcttcc

SEQ ID NO: 147300 - DNA, 33 bp, Artificial Sequence
  Synthetic oligonucleotide
tccaaagacacatgctacctcgcttcaactcgc

SEQ ID NO: 147301 - DNA, 35 bp, Artificial Sequence
  Synthetic oligonucleotide
acgttactccgccggacggtctgccctccccgatc

SEQ ID NO: 147302 - DNA, 35 bp, Artificial Sequence
  Synthetic oligonucleotide
ttacccgcccgtcccaccatcaatgacctcacctc

SEQ ID NO: 147303 - DNA, 35 bp, Artificial Sequence
  Synthetic oligonucleotide
atcagaccgcatcacctccattattagcctttgtc

SEQ ID NO: 147304 - DNA, 35 bp, Artificial Sequence
  Synthetic oligonucleotide
gtaccgccccctgcctctgatatgcctttgcattc

SEQ ID NO: 147305 - DNA, 35 bp, Artificial Sequence
  Synthetic oligonucleotide
gtcccactcctatatctgttctacgtggtatcttc

SEQ ID NO: 147306 - DNA, 35 bp, Artificial Sequence
  Synthetic oligonucleotide
gcatgccccgtgccttttcgatctccggtcatttc

SEQ ID NO: 147307 - DNA, 35 bp, Artificial Sequence
  Synthetic oligonucleotide
gcaggacctccctctgctgttctatacccgttgag

SEQ ID NO: 147308 - DNA, 35 bp, Artificial Sequence
  Synthetic oligonucleotide
gtaccctactgctcccctctcgcgcttcccttgat

SEQ ID NO: 147309 - DNA, 35 bp, Artificial Sequence
  Synthetic oligonucleotide
atcgcccgcttccctcgcggttctatcctttcact

SEQ ID NO: 147310 - DNA, 35 bp, Artificial Sequence
  Synthetic oligonucleotide
tgtcccatccatcccggagccagcgcgcccctgct

SEQ ID NO: 147311 - DNA, 35 bp, Artificial Sequence
  Synthetic oligonucleotide
cattgtaccgccggccgtccttagctcttctccgt

SEQ ID NO: 147312 - DNA, 35 bp, Artificial Sequence
  Synthetic oligonucleotide
tagtcgcacctgcttctgcacctttagtccttttt

SEQ ID NO: 147313 - DNA, 36 bp, Artificial Sequence
  Synthetic oligonucleotide
aatgggagggtttcaaaggtggggcggttagggaaa

SEQ ID NO: 147314 - DNA, 35 bp, Artificial Sequence
  Synthetic oligonucleotide
gtgggtggtgggagggggacttaacatcattgaaa

SEQ ID NO: 147315 - DNA, 36 bp, Artificial Sequence
  Synthetic oligonucleotide
actgcctcccatcccattcttatgcgcaccatgcaa

SEQ ID NO: 147316 - DNA, 36 bp, Artificial Sequence
  Synthetic oligonucleotide
tccgccagacccgcctctatgtctaggtcacccaca

SEQ ID NO: 147317 - DNA, 36 bp, Artificial Sequence
  Synthetic oligonucleotide
accacctgcctctcattatttcagcgagacccgaca

SEQ ID NO: 147318 - DNA, 35 bp, Artificial Sequence
  Synthetic oligonucleotide
gccacgacctgagtcctacgcatttaccctgccca

SEQ ID NO: 147319 - DNA, 36 bp, Artificial Sequence
  Synthetic oligonucleotide
ttgccggccaattgattcacactgtttcccgtccca

SEQ ID NO: 147320 - DNA, 35 bp, Artificial Sequence
  Synthetic oligonucleotide
ggacgccctcagtcccacattgtccattctcgcca

SEQ ID NO: 147321 - DNA, 35 bp, Artificial Sequence
  Synthetic oligonucleotide
tcatccgcagagccgctccctttaatgttcgtcca

SEQ ID NO: 147322 - DNA, 36 bp, Artificial Sequence
  Synthetic oligonucleotide
tatccgctcccatcgtaccctcgtcacgcacaggca

SEQ ID NO: 147323 - DNA, 36 bp, Artificial Sequence
  Synthetic oligonucleotide
gcatccgcaccaccctttgctgacaacacgcattca

SEQ ID NO: 147324 - DNA, 37 bp, Artificial Sequence
  Synthetic oligonucleotide
tcacccccactttgcttcccagcgccggtccccacga

SEQ ID NO: 147325 - DNA, 37 bp, Artificial Sequence
  Synthetic oligonucleotide
gttgggtcgatatcgttgcagggagggtgggtgccga

SEQ ID NO: 147326 - DNA, 37 bp, Artificial Sequence
  Synthetic oligonucleotide
tcgacccgcctccccccatggtatcgtacgcaatcga

SEQ ID NO: 147327 - DNA, 37 bp, Artificial Sequence
  Synthetic oligonucleotide
acacgtttaggtgtgtcgcctgccccttccgcctcga

SEQ ID NO: 147328 - DNA, 36 bp, Artificial Sequence
  Synthetic oligonucleotide
gggtgcctctctgggctttttcctgtcccttctcga

SEQ ID NO: 147329 - DNA, 37 bp, Artificial Sequence
  Synthetic oligonucleotide
acacacccgctcgacccttcgtacgactcccattcga

SEQ ID NO: 147330 - DNA, 35 bp, Artificial Sequence
  Synthetic oligonucleotide
gatgcggagggaaggacgacaacgatagtgaggga

SEQ ID NO: 147331 - DNA, 37 bp, Artificial Sequence
  Synthetic oligonucleotide
ttgtgggcgggagggcatgagaagcatttgtccggga

SEQ ID NO: 147332 - DNA, 35 bp, Artificial Sequence
  Synthetic oligonucleotide
gacaggggggggtgaaaggtggaagtgacggggga

SEQ ID NO: 147333 - DNA, 37 bp, Artificial Sequence
  Synthetic oligonucleotide
gataagtgcatagggcgggtaggagggagaggtggga

SEQ ID NO: 147334 - DNA, 37 bp, Artificial Sequence
  Synthetic oligonucleotide
tcacggaaagggggaggaccagaagcaaggggagtga

SEQ ID NO: 147335 - DNA, 38 bp, Artificial Sequence
  Synthetic oligonucleotide
aaaccgggtaggtggggtggagcaatgcggggcggtga

SEQ ID NO: 147336 - DNA, 37 bp, Artificial Sequence
  Synthetic oligonucleotide
tcgagagcaggtgtaatcgcccgcccctattcattga

SEQ ID NO: 147337 - DNA, 38 bp, Artificial Sequence
  Synthetic oligonucleotide
gcaagcccgattcggaacgcgcctgcctactaccttga

SEQ ID NO: 147338 - DNA, 38 bp, Artificial Sequence
  Synthetic oligonucleotide
gtcgaggttcaccatgttttcccgcctctcattcttga

SEQ ID NO: 147339 - DNA, 37 bp, Artificial Sequence
  Synthetic oligonucleotide
gacggacgggcgagtcgggggaaatggtggaggttga

SEQ ID NO: 147340 - DNA, 36 bp, Artificial Sequence
  Synthetic oligonucleotide
tctccgctcccgcctagttggtcatcctttttccta

SEQ ID NO: 147341 - DNA, 34 bp, Artificial Sequence
  Synthetic oligonucleotide
gccgccatactatctcgtccgagcttctcccgta

SEQ ID NO: 147342 - DNA, 35 bp, Artificial Sequence
  Synthetic oligonucleotide
acccagtacgcccctctgccgatacgcttccatta

SEQ ID NO: 147343 - DNA, 35 bp, Artificial Sequence
  Synthetic oligonucleotide
tttggcacgtagcaagtctgtcatcccgcccgtta

SEQ ID NO: 147344 - DNA, 36 bp, Artificial Sequence
  Synthetic oligonucleotide
acagaccctcaacctgtttacttgtcccttgtttta

SEQ ID NO: 147345 - DNA, 35 bp, Artificial Sequence
  Synthetic oligonucleotide
ttggatgcgcggttccactgttgtctgccacccac

SEQ ID NO: 147346 - DNA, 35 bp, Artificial Sequence
  Synthetic oligonucleotide
acgtgccacatgtctatcgcgtttgggcccactac

SEQ ID NO: 147347 - DNA, 36 bp, Artificial Sequence
  Synthetic oligonucleotide
gcttacgtctcgcgtgcggctgtcccctcccatgcc

SEQ ID NO: 147348 - DNA, 35 bp, Artificial Sequence
  Synthetic oligonucleotide
ttgccagatgccgtgaccatccctgtattccctcc

SEQ ID NO: 147349 - DNA, 35 bp, Artificial Sequence
  Synthetic oligonucleotide
gcctcgccccctacgggaattgctgactgtcctcc

SEQ ID NO: 147350 - DNA, 35 bp, Artificial Sequence
  Synthetic oligonucleotide
accccgctcgaccacactccaaagatctccgctcc

SEQ ID NO: 147351 - DNA, 35 bp, Artificial Sequence
  Synthetic oligonucleotide
tacgcactgtctacaaacgttctagtgcttgctcc

SEQ ID NO: 147352 - DNA, 35 bp, Artificial Sequence
  Synthetic oligonucleotide
actctccaccaggtccttaacgttatgtcccccgc

SEQ ID NO: 147353 - DNA, 35 bp, Artificial Sequence
  Synthetic oligonucleotide
atctgcgtcactcagtcgatcatttgtccgtcctc

SEQ ID NO: 147354 - DNA, 35 bp, Artificial Sequence
  Synthetic oligonucleotide
gtacatgccccgtcctgccttcgcggctattgctc

SEQ ID NO: 147355 - DNA, 35 bp, Artificial Sequence
  Synthetic oligonucleotide
ccacgatcagatcgcgaaccacccctccgccagtc

SEQ ID NO: 147356 - DNA, 35 bp, Artificial Sequence
  Synthetic oligonucleotide
gcaagggtgaagcaagatcgggtggacgggtgaag

SEQ ID NO: 147357 - DNA, 35 bp, Artificial Sequence
  Synthetic oligonucleotide
tcatggctcccgactcaccttgcattacaacatcg

SEQ ID NO: 147358 - DNA, 35 bp, Artificial Sequence
  Synthetic oligonucleotide
ttcgatctccgccgcgtactaccccatcttcatcg

SEQ ID NO: 147359 - DNA, 35 bp, Artificial Sequence
  Synthetic oligonucleotide
tacgccactcgaccggcgtcactaccttccctagg

SEQ ID NO: 147360 - DNA, 35 bp, Artificial Sequence
  Synthetic oligonucleotide
gtttgagactagggggtgggagtcggacggggcgg

SEQ ID NO: 147361 - DNA, 35 bp, Artificial Sequence
  Synthetic oligonucleotide
gtccgagccgaccttgaagcccatccgttgccatg

SEQ ID NO: 147362 - DNA, 35 bp, Artificial Sequence
  Synthetic oligonucleotide
ttcatcccgagcgtattacggctctggctctacct

SEQ ID NO: 147363 - DNA, 35 bp, Artificial Sequence
  Synthetic oligonucleotide
gttcacccccgtggttctgtctcttgaactaccct

SEQ ID NO: 147364 - DNA, 35 bp, Artificial Sequence
  Synthetic oligonucleotide
ttggttgtgcctccagtctatcctgttcaccatgt

SEQ ID NO: 147365 - DNA, 35 bp, Artificial Sequence
  Synthetic oligonucleotide
ttgaaacatcgatggctctgctccgcctcctttgt

SEQ ID NO: 147366 - DNA, 35 bp, Artificial Sequence
  Synthetic oligonucleotide
aaccattccctcttgacatctgttcctgtgacctt

SEQ ID NO: 147367 - DNA, 35 bp, Artificial Sequence
  Synthetic oligonucleotide
gcgcacaatcgcctgcccaggtgcctccccccctt

SEQ ID NO: 147368 - DNA, 35 bp, Artificial Sequence
  Synthetic oligonucleotide
ttcgcccccgccgcatacaagtgcgagaagccctt

SEQ ID NO: 147369 - DNA, 35 bp, Artificial Sequence
  Synthetic oligonucleotide
agctaacccaccaccctcggcgccagtttcgcctt

SEQ ID NO: 147370 - DNA, 36 bp, Artificial Sequence
  Synthetic oligonucleotide
ttcacccttccctaagtgcagctccaccccccgcca

SEQ ID NO: 147371 - DNA, 36 bp, Artificial Sequence
  Synthetic oligonucleotide
ttctccctccccgttctgccgtctagcagtctcgca

SEQ ID NO: 147372 - DNA, 36 bp, Artificial Sequence
  Synthetic oligonucleotide
accgacggcaacctgttatgccactcacaccttgca

SEQ ID NO: 147373 - DNA, 35 bp, Artificial Sequence
  Synthetic oligonucleotide
ttagaaccaccccagaggccgtccctttaccatca

SEQ ID NO: 147374 - DNA, 36 bp, Artificial Sequence
  Synthetic oligonucleotide
gtactccgcagtgtgacgggcccctttatcatctca

SEQ ID NO: 147375 - DNA, 37 bp, Artificial Sequence
  Synthetic oligonucleotide
gtacatggggaggtaatggggtggcaaaggcaagaga

SEQ ID NO: 147376 - DNA, 37 bp, Artificial Sequence
  Synthetic oligonucleotide
gcctcgccctctatcgtttgctctctcgcccttgaga

SEQ ID NO: 147377 - DNA, 35 bp, Artificial Sequence
  Synthetic oligonucleotide
gttaaacgcgtccgtttctgtccttccgtttccga

SEQ ID NO: 147378 - DNA, 37 bp, Artificial Sequence
  Synthetic oligonucleotide
ttgggggggtggaagcctggtaatgggcgggaggcga

SEQ ID NO: 147379 - DNA, 37 bp, Artificial Sequence
  Synthetic oligonucleotide
aactaggggaaagtgcggataagcagagggacggcga

SEQ ID NO: 147380 - DNA, 37 bp, Artificial Sequence
  Synthetic oligonucleotide
ttgccgggcaatatacagtaagggggggagggggcga

SEQ ID NO: 147381 - DNA, 37 bp, Artificial Sequence
  Synthetic oligonucleotide
gacccacatctttgtaccagtgcctcccaccttagga

SEQ ID NO: 147382 - DNA, 37 bp, Artificial Sequence
  Synthetic oligonucleotide
tagccacgccacaccgtgccattttttcctttaggga

SEQ ID NO: 147383 - DNA, 38 bp, Artificial Sequence
  Synthetic oligonucleotide
actccccagccgccacctgccaacacggcctgtcctga

SEQ ID NO: 147384 - DNA, 36 bp, Artificial Sequence
  Synthetic oligonucleotide
atcgactgcgcttgccggtcgaaatatgccccccta

SEQ ID NO: 147385 - DNA, 36 bp, Artificial Sequence
  Synthetic oligonucleotide
gtgtgccccccccatgtcaccgccagtaaccgatta

SEQ ID NO: 147386 - DNA, 36 bp, Artificial Sequence
  Synthetic oligonucleotide
gggccgtttgcctgtctcttcgtcgacccctcctta

SEQ ID NO: 147387 - DNA, 35 bp, Artificial Sequence
  Synthetic oligonucleotide
tgattgtccatttcgtcgacactgttctatcccac

SEQ ID NO: 147388 - DNA, 35 bp, Artificial Sequence
  Synthetic oligonucleotide
tcgcccccgacgctagtaaggccaaccccccggac

SEQ ID NO: 147389 - DNA, 35 bp, Artificial Sequence
  Synthetic oligonucleotide
gacgaaatgcaggtaggggggggtggattgttgac

SEQ ID NO: 147390 - DNA, 35 bp, Artificial Sequence
  Synthetic oligonucleotide
ttgcccccgttcaattataccgcacgtgcttctac

SEQ ID NO: 147391 - DNA, 35 bp, Artificial Sequence
  Synthetic oligonucleotide
gacccactcaccgccatctattcttcgtagagccc

SEQ ID NO: 147392 - DNA, 35 bp, Artificial Sequence
  Synthetic oligonucleotide
atagaccacctcattctgcctgtcttctaattgcc

SEQ ID NO: 147393 - DNA, 35 bp, Artificial Sequence
  Synthetic oligonucleotide
ggtgcttcccggactgcttattcatctcgtcttcc

SEQ ID NO: 147394 - DNA, 35 bp, Artificial Sequence
  Synthetic oligonucleotide
tcgcacccccccgcgcgctcttcaatgtaacccgc

SEQ ID NO: 147395 - DNA, 34 bp, Artificial Sequence
  Synthetic oligonucleotide
ttaccgcctcactctgctccttcccatgtcttgc

SEQ ID NO: 147396 - DNA, 35 bp, Artificial Sequence
  Synthetic oligonucleotide
acatgaaccatcgccctcgtaccatgcagttttgc

SEQ ID NO: 147397 - DNA, 35 bp, Artificial Sequence
  Synthetic oligonucleotide
acttcatccctgttggttttatgatttacaccatc

SEQ ID NO: 147398 - DNA, 35 bp, Artificial Sequence
  Synthetic oligonucleotide
tcccacgcatcttagctcaacgtcaccgcactatc

SEQ ID NO: 147399 - DNA, 35 bp, Artificial Sequence
  Synthetic oligonucleotide
accggatccgttctcgttttttatgtccctctgtc

SEQ ID NO: 147400 - DNA, 35 bp, Artificial Sequence
  Synthetic oligonucleotide
tagccacggtatgatccctaagtcccctctcgttc

SEQ ID NO: 147401 - DNA, 35 bp, Artificial Sequence
  Synthetic oligonucleotide
gggacacactctcgctaccttccaaccacgcctcg

SEQ ID NO: 147402 - DNA, 35 bp, Artificial Sequence
  Synthetic oligonucleotide
aacccgcccccccacggccccagcaggaaaacatg

SEQ ID NO: 147403 - DNA, 35 bp, Artificial Sequence
  Synthetic oligonucleotide
gaatgatgcacgtgctgtgtggttactccctcctg

SEQ ID NO: 147404 - DNA, 35 bp, Artificial Sequence
  Synthetic oligonucleotide
ttccgggagggagatggggtggacggggcgtgctg

SEQ ID NO: 147405 - DNA, 35 bp, Artificial Sequence
  Synthetic oligonucleotide
acacatcccggtcgtagctgtgcgatccttccttg

SEQ ID NO: 147406 - DNA, 35 bp, Artificial Sequence
  Synthetic oligonucleotide
ggtcctgctctcatgtcctatgcctcccttgccat

SEQ ID NO: 147407 - DNA, 35 bp, Artificial Sequence
  Synthetic oligonucleotide
accggggagggtaaaagccggggataaggggagat

SEQ ID NO: 147408 - DNA, 35 bp, Artificial Sequence
  Synthetic oligonucleotide
gcccattgtgtccctgcccagccccgctatgtcct

SEQ ID NO: 147409 - DNA, 35 bp, Artificial Sequence
  Synthetic oligonucleotide
tcacaccgcatagtcagaggaccccctccgcttct

SEQ ID NO: 147410 - DNA, 35 bp, Artificial Sequence
  Synthetic oligonucleotide
gcacccgcctcaaccctatgcatcacttcaggcgt

SEQ ID NO: 147411 - DNA, 35 bp, Artificial Sequence
  Synthetic oligonucleotide
gtcctaccgctgtcgtttcttaccctcctgtgcgt

SEQ ID NO: 147412 - DNA, 35 bp, Artificial Sequence
  Synthetic oligonucleotide
acataagggggccggggtgagaagcgggttagggt

SEQ ID NO: 147413 - DNA, 35 bp, Artificial Sequence
  Synthetic oligonucleotide
gactgaggagagggtggaaaagcggagtatagtgt

SEQ ID NO: 147414 - DNA, 36 bp, Artificial Sequence
  Synthetic oligonucleotide
actgacacacccctgtactcgccctcccgtggggaa

SEQ ID NO: 147415 - DNA, 36 bp, Artificial Sequence
  Synthetic oligonucleotide
acaccgcaattttatcgctcgccctggtctctaaca

SEQ ID NO: 147416 - DNA, 36 bp, Artificial Sequence
  Synthetic oligonucleotide
gagtgcgtccccgccgccctacctcctccgtccaca

SEQ ID NO: 147417 - DNA, 36 bp, Artificial Sequence
  Synthetic oligonucleotide
taccgccccctttggctgtgcgaaagcacacataca

SEQ ID NO: 147418 - DNA, 35 bp, Artificial Sequence
  Synthetic oligonucleotide
gtgatgcctcaacctctttcgaaactgtttcccca

SEQ ID NO: 147419 - DNA, 35 bp, Artificial Sequence
  Synthetic oligonucleotide
tgggacacacccccgcgcccgtgctctaccatcca

SEQ ID NO: 147420 - DNA, 35 bp, Artificial Sequence
  Synthetic oligonucleotide
tcaggaatcaaccgggtgcgggtgggggggaatca

SEQ ID NO: 147421 - DNA, 36 bp, Artificial Sequence
  Synthetic oligonucleotide
aacgcgctcttgccaataacactcgccacaccctca

SEQ ID NO: 147422 - DNA, 37 bp, Artificial Sequence
  Synthetic oligonucleotide
gaccagatggtggggtgggtcggagggggcaagtaga

SEQ ID NO: 147423 - DNA, 37 bp, Artificial Sequence
  Synthetic oligonucleotide
gtgggagggggggtatggcggttacacgacagttaga

SEQ ID NO: 147424 - DNA, 37 bp, Artificial Sequence
  Synthetic oligonucleotide
gccactccgctgatctatcggttccccttaccaccga

SEQ ID NO: 147425 - DNA, 35 bp, Artificial Sequence
  Synthetic oligonucleotide
gggaccggcgaagggaaccggtggcggggggggga

SEQ ID NO: 147426 - DNA, 36 bp, Artificial Sequence
  Synthetic oligonucleotide
tgaaagccggtgcccttcgcctgccctttttctgga

SEQ ID NO: 147427 - DNA, 37 bp, Artificial Sequence
  Synthetic oligonucleotide
gtgtagggttgggtggggactgaggcatgggagtgga

SEQ ID NO: 147428 - DNA, 36 bp, Artificial Sequence
  Synthetic oligonucleotide
tggaccctccatgccctcgctgcctcccaccgtgga

SEQ ID NO: 147429 - DNA, 38 bp, Artificial Sequence
  Synthetic oligonucleotide
ggatgagggtgaggggggaggaatgattaacggaatga

SEQ ID NO: 147430 - DNA, 37 bp, Artificial Sequence
  Synthetic oligonucleotide
gaagggcgggtgggttggaggacggcgcaagccatga

SEQ ID NO: 147431 - DNA, 38 bp, Artificial Sequence
  Synthetic oligonucleotide
ttgcccccctagaacctgctcccgtgagacccctatga

SEQ ID NO: 147432 - DNA, 37 bp, Artificial Sequence
  Synthetic oligonucleotide
agaccacccgaccgtgcaatacggcctcctcttatga

SEQ ID NO: 147433 - DNA, 35 bp, Artificial Sequence
  Synthetic oligonucleotide
gccacgcatccatccacgcttcaaaccctgcctga

SEQ ID NO: 147434 - DNA, 37 bp, Artificial Sequence
  Synthetic oligonucleotide
aaagaggggggggtgggtgggcaccagaaggaggtga

SEQ ID NO: 147435 - DNA, 35 bp, Artificial Sequence
  Synthetic oligonucleotide
atccgcaccttggcaccgttggttttcgctcttga

SEQ ID NO: 147436 - DNA, 34 bp, Artificial Sequence
  Synthetic oligonucleotide
tactcgtcgcccttgccttcctctgctgcagcta

SEQ ID NO: 147437 - DNA, 35 bp, Artificial Sequence
  Synthetic oligonucleotide
tcccatcccgttaccctctgacgcgtttaggccac

SEQ ID NO: 147438 - DNA, 35 bp, Artificial Sequence
  Synthetic oligonucleotide
aatcctgtctcgttcccgtcgcgccactgttccac

SEQ ID NO: 147439 - DNA, 35 bp, Artificial Sequence
  Synthetic oligonucleotide
acagacaccgcacgaaagcgcgtaacgtacttcac

SEQ ID NO: 147440 - DNA, 26 bp, Artificial Sequence
  Synthetic oligonucleotide
cccttgtgccgccccgtttctatacc

SEQ ID NO: 147441 - DNA, 35 bp, Artificial Sequence
  Synthetic oligonucleotide
taccccacaattcaatgacgttgccactgtacccc

SEQ ID NO: 147442 - DNA, 35 bp, Artificial Sequence
  Synthetic oligonucleotide
tctcagctatccagccgccacccgcaatcctgccc

SEQ ID NO: 147443 - DNA, 35 bp, Artificial Sequence
  Synthetic oligonucleotide
ttcaaacccgctggtggccttaaatacatcctgcc

SEQ ID NO: 147444 - DNA, 35 bp, Artificial Sequence
  Synthetic oligonucleotide
atgcccatcgggttttcgaccgccccttgatacgc

SEQ ID NO: 147445 - DNA, 35 bp, Artificial Sequence
  Synthetic oligonucleotide
tacacccgcccttttatatccctgggctatgcctc

SEQ ID NO: 147446 - DNA, 35 bp, Artificial Sequence
  Synthetic oligonucleotide
acaccctctcactggtataaccaccgttacacacg

SEQ ID NO: 147447 - DNA, 35 bp, Artificial Sequence
  Synthetic oligonucleotide
gccgcttgccatttgactttcttattgtccgcccg

SEQ ID NO: 147448 - DNA, 35 bp, Artificial Sequence
  Synthetic oligonucleotide
tcaggggtggggacggtggtgacgaggggaatccg

SEQ ID NO: 147449 - DNA, 35 bp, Artificial Sequence
  Synthetic oligonucleotide
actcagccctgttttgcccttacccttctgcgctg

SEQ ID NO: 147450 - DNA, 36 bp, Artificial Sequence
  Synthetic oligonucleotide
atggagcaagccatcccctccttccactctgccgtg

SEQ ID NO: 147451 - DNA, 36 bp, Artificial Sequence
  Synthetic oligonucleotide
gccctgtccttcaatgtcatctttcgcacgtatcat

SEQ ID NO: 147452 - DNA, 35 bp, Artificial Sequence
  Synthetic oligonucleotide
gtgccatctgccgcacctattttatccaacatcct

SEQ ID NO: 147453 - DNA, 35 bp, Artificial Sequence
  Synthetic oligonucleotide
acgacgccacgcctcctttggattcaacacatgct

SEQ ID NO: 147454 - DNA, 35 bp, Artificial Sequence
  Synthetic oligonucleotide
tacccgccatcgccccgctgcctttttctgccatt

SEQ ID NO: 147455 - DNA, 35 bp, Artificial Sequence
  Synthetic oligonucleotide
gtgccacctacctcagagccacttgtttgtacctt

SEQ ID NO: 147456 - DNA, 35 bp, Artificial Sequence
  Synthetic oligonucleotide
atgcactctaccgctgccgtttatgttacattctt

SEQ ID NO: 147457 - DNA, 35 bp, Artificial Sequence
  Synthetic oligonucleotide
tccgcatccctgttgtcgccgggacccccgattca

SEQ ID NO: 147458 - DNA, 36 bp, Artificial Sequence
  Synthetic oligonucleotide
gccacacattatcgataagccctgccccttacaaga

SEQ ID NO: 147459 - DNA, 36 bp, Artificial Sequence
  Synthetic oligonucleotide
gatgggggataggatgtcggggctgggtggggacga

SEQ ID NO: 147460 - DNA, 38 bp, Artificial Sequence
  Synthetic oligonucleotide
gaagacaatggtggggggaacggatgacagccaaggga

SEQ ID NO: 147461 - DNA, 37 bp, Artificial Sequence
  Synthetic oligonucleotide
gaggataccggggtgcaaaggtgggaacgggcgggga

SEQ ID NO: 147462 - DNA, 36 bp, Artificial Sequence
  Synthetic oligonucleotide
ttagacgtggcaggaggaggggcggcttggtatgga

SEQ ID NO: 147463 - DNA, 38 bp, Artificial Sequence
  Synthetic oligonucleotide
gcccgtcgccctgttatcttgttctagcctcctactga

SEQ ID NO: 147464 - DNA, 38 bp, Artificial Sequence
  Synthetic oligonucleotide
gtccaatcctcctcgcgccgggccattctagtccgtga

SEQ ID NO: 147465 - DNA, 35 bp, Artificial Sequence
  Synthetic oligonucleotide
gcctacgttctgctttccgtgatcttccttccata

SEQ ID NO: 147466 - DNA, 36 bp, Artificial Sequence
  Synthetic oligonucleotide
tctgttgcccgtgcccgccccctgtcccgttcgata

SEQ ID NO: 147467 - DNA, 36 bp, Artificial Sequence
  Synthetic oligonucleotide
aacaccaggctgatgcgtctaccacctcactatcta

SEQ ID NO: 147468 - DNA, 35 bp, Artificial Sequence
  Synthetic oligonucleotide
ttaactcaccgccccctgcctctttggtttccgta

SEQ ID NO: 147469 - DNA, 36 bp, Artificial Sequence
  Synthetic oligonucleotide
acgtacatgccggttgccctgccctatagaccctta

SEQ ID NO: 147470 - DNA, 35 bp, Artificial Sequence
  Synthetic oligonucleotide
gacccatcgccgtgtgacgacccgtccttcgctac

SEQ ID NO: 147471 - DNA, 35 bp, Artificial Sequence
  Synthetic oligonucleotide
gggaacgccggatactatgcctcgctcccttttac

SEQ ID NO: 147472 - DNA, 35 bp, Artificial Sequence
  Synthetic oligonucleotide
tagacgtagccactcgcctgttaacccttacaacc

SEQ ID NO: 147473 - DNA, 35 bp, Artificial Sequence
  Synthetic oligonucleotide
gacgccccttccgtttcatgagtctagtttacacc

SEQ ID NO: 147474 - DNA, 35 bp, Artificial Sequence
  Synthetic oligonucleotide
agcgggtcgagtctctcggttcccttctgtcctcc

SEQ ID NO: 147475 - DNA, 35 bp, Artificial Sequence
  Synthetic oligonucleotide
acacaacagtccctgtggtcccgccctgtctgtcc

SEQ ID NO: 147476 - DNA, 35 bp, Artificial Sequence
  Synthetic oligonucleotide
taccacctgcccccagcgcgcatctgagcgttcgc

SEQ ID NO: 147477 - DNA, 35 bp, Artificial Sequence
  Synthetic oligonucleotide
tccacacctgcaccatcccgttcctagtgatactc

SEQ ID NO: 147478 - DNA, 35 bp, Artificial Sequence
  Synthetic oligonucleotide
tcaccatccgctgactatgtagatccacccccgtc

SEQ ID NO: 147479 - DNA, 35 bp, Artificial Sequence
  Synthetic oligonucleotide
gtttgccctcccagcccatccggttttgcatcccg

SEQ ID NO: 147480 - DNA, 35 bp, Artificial Sequence
  Synthetic oligonucleotide
agtatcctcgcgcattatgttatgccccccctccg

SEQ ID NO: 147481 - DNA, 35 bp, Artificial Sequence
  Synthetic oligonucleotide
tatgtatctctccgcccgccagccgcccactagcg

SEQ ID NO: 147482 - DNA, 35 bp, Artificial Sequence
  Synthetic oligonucleotide
agctcacctcttcccgtatcatggtctcctacgcg

SEQ ID NO: 147483 - DNA, 35 bp, Artificial Sequence
  Synthetic oligonucleotide
gccatgttctagctggttcacatctatccttcgct

SEQ ID NO: 147484 - DNA, 35 bp, Artificial Sequence
  Synthetic oligonucleotide
agaccactcatcacctcttgttactcgctgaccaa

SEQ ID NO: 147485 - DNA, 36 bp, Artificial Sequence
  Synthetic oligonucleotide
gtcccccccgcccgtacctaatttttataacgccaa

SEQ ID NO: 147486 - DNA, 35 bp, Artificial Sequence
  Synthetic oligonucleotide
gtgtccgcctcatgccgcatttccattatgtccaa

SEQ ID NO: 147487 - DNA, 36 bp, Artificial Sequence
  Synthetic oligonucleotide
tcagccctggtctcccgttgcttcacaccgttcaca

SEQ ID NO: 147488 - DNA, 36 bp, Artificial Sequence
  Synthetic oligonucleotide
tagcgccccgcatgccatgttcttcgcaccacacca

SEQ ID NO: 147489 - DNA, 36 bp, Artificial Sequence
  Synthetic oligonucleotide
accgcgccagcccctctatctgaatgtccgcctgca

SEQ ID NO: 147490 - DNA, 36 bp, Artificial Sequence
  Synthetic oligonucleotide
accacaactctaggtatcatctgtttcgctccatca

SEQ ID NO: 147491 - DNA, 35 bp, Artificial Sequence
  Synthetic oligonucleotide
agcccatcacgcactgcgttaccgctatccactca

SEQ ID NO: 147492 - DNA, 36 bp, Artificial Sequence
  Synthetic oligonucleotide
acctcctgactcaagcacccagtataccttgcctca

SEQ ID NO: 147493 - DNA, 36 bp, Artificial Sequence
  Synthetic oligonucleotide
ccctgcccccatcgtgtacgcttgcttctccgctca

SEQ ID NO: 147494 - DNA, 36 bp, Artificial Sequence
  Synthetic oligonucleotide
aagcgccgtttgcagctgtcatcgccattctcttca

SEQ ID NO: 147495 - DNA, 37 bp, Artificial Sequence
  Synthetic oligonucleotide
gtcggacgggtagtgggggaggctggggcggctaaga

SEQ ID NO: 147496 - DNA, 35 bp, Artificial Sequence
  Synthetic oligonucleotide
ggaccactcgcccccgccacacctgtgtcccacga

SEQ ID NO: 147497 - DNA, 29 bp, Artificial Sequence
  Synthetic oligonucleotide
tgtccctagccgtagccaattacctccga

SEQ ID NO: 147498 - DNA, 37 bp, Artificial Sequence
  Synthetic oligonucleotide
atccgcccggccccgccatctactgccactatcgcga

SEQ ID NO: 147499 - DNA, 38 bp, Artificial Sequence
  Synthetic oligonucleotide
aatggaggaggaggtggaaaggtgaatgtgcggtatga

SEQ ID NO: 147500 - DNA, 38 bp, Artificial Sequence
  Synthetic oligonucleotide
gggtcacggagggcggatacaggcggaacaaagggtga

SEQ ID NO: 147501 - DNA, 36 bp, Artificial Sequence
  Synthetic oligonucleotide
tcatccccgctgattcatcgccttgctccgccacta

SEQ ID NO: 147502 - DNA, 36 bp, Artificial Sequence
  Synthetic oligonucleotide
tccaatcccagcctcctgacgccacaatttagccta

SEQ ID NO: 147503 - DNA, 34 bp, Artificial Sequence
  Synthetic oligonucleotide
tgcaggagtgggcaaggggtggtggggtcgggta

SEQ ID NO: 147504 - DNA, 36 bp, Artificial Sequence
  Synthetic oligonucleotide
acccacctacgatgcgaacccatacactgcccatta

SEQ ID NO: 147505 - DNA, 38 bp, Artificial Sequence
  Synthetic oligonucleotide
gccctccttccgccgtctattgacacttcctatactta

SEQ ID NO: 147506 - DNA, 36 bp, Artificial Sequence
  Synthetic oligonucleotide
acttccaccgtccatttgccgctctgcttaccctta

SEQ ID NO: 147507 - DNA, 35 bp, Artificial Sequence
  Synthetic oligonucleotide
agtcccagtgtgacaccgcaccactcttcgcccac

SEQ ID NO: 147508 - DNA, 35 bp, Artificial Sequence
  Synthetic oligonucleotide
gcactcgcccggccgcccgccatcagacgtcccac

SEQ ID NO: 147509 - DNA, 35 bp, Artificial Sequence
  Synthetic oligonucleotide
tccacagcccacccagctccgtgggcctattccac

SEQ ID NO: 147510 - DNA, 35 bp, Artificial Sequence
  Synthetic oligonucleotide
ttctcgcaccgtccgcttcccgccccaaccacacc

SEQ ID NO: 147511 - DNA, 35 bp, Artificial Sequence
  Synthetic oligonucleotide
accctcacctgggcactattctacagtctcttacc

SEQ ID NO: 147512 - DNA, 35 bp, Artificial Sequence
  Synthetic oligonucleotide
tgcgcaatcacctaccgcaccgccctttatggccc

SEQ ID NO: 147513 - DNA, 35 bp, Artificial Sequence
  Synthetic oligonucleotide
tcgcactcccagaccccgttttatttgccccggcc

SEQ ID NO: 147514 - DNA, 35 bp, Artificial Sequence
  Synthetic oligonucleotide
atcagccccccgctttgcagccagcgttctcgtcc

SEQ ID NO: 147515 - DNA, 35 bp, Artificial Sequence
  Synthetic oligonucleotide
ttgaggccgtcgtattcatactccctgcttcttcc

SEQ ID NO: 147516 - DNA, 35 bp, Artificial Sequence
  Synthetic oligonucleotide
attgtgcctcctgctatgccgccatttatcttagc

SEQ ID NO: 147517 - DNA, 35 bp, Artificial Sequence
  Synthetic oligonucleotide
gatcatctcacgttctccgataacttagcgctcgc

SEQ ID NO: 147518 - DNA, 35 bp, Artificial Sequence
  Synthetic oligonucleotide
aatcaccttcggacccccgtgcactgcactccctc

SEQ ID NO: 147519 - DNA, 35 bp, Artificial Sequence
  Synthetic oligonucleotide
atagcgccaattttcgagcctccccccattgtctc

SEQ ID NO: 147520 - DNA, 35 bp, Artificial Sequence
  Synthetic oligonucleotide
tgaccgcccaccgtgcatccattctcgttctcccg

SEQ ID NO: 147521 - DNA, 35 bp, Artificial Sequence
  Synthetic oligonucleotide
tacgggttgagcattcgggtgggtgttaggtaggg

SEQ ID NO: 147522 - DNA, 35 bp, Artificial Sequence
  Synthetic oligonucleotide
ttgggctgcccccgacctacacctctgaacccctg

SEQ ID NO: 147523 - DNA, 35 bp, Artificial Sequence
  Synthetic oligonucleotide
ttggggcgaagggtccagggggtagggggcgtgat

SEQ ID NO: 147524 - DNA, 35 bp, Artificial Sequence
  Synthetic oligonucleotide
taactgcacgccacctctttcatcatggttcgcct

SEQ ID NO: 147525 - DNA, 35 bp, Artificial Sequence
  Synthetic oligonucleotide
gatacatcctatagccttccgtccctgccgtgcct

SEQ ID NO: 147526 - DNA, 35 bp, Artificial Sequence
  Synthetic oligonucleotide
aatgctcgcccgaatagctctgcccctttagccgt

SEQ ID NO: 147527 - DNA, 35 bp, Artificial Sequence
  Synthetic oligonucleotide
aacggtcagcccagcctccttggtccttcaaatgt

SEQ ID NO: 147528 - DNA, 35 bp, Artificial Sequence
  Synthetic oligonucleotide
atcccctcgccgctgttcacatacccagctgatgt

SEQ ID NO: 147529 - DNA, 36 bp, Artificial Sequence
  Synthetic oligonucleotide
tgacggaggtgggtaggggtacggaggaagagccaa

SEQ ID NO: 147530 - DNA, 36 bp, Artificial Sequence
  Synthetic oligonucleotide
gcgaacccacagcagctgtggccttcaccctgtaca

SEQ ID NO: 147531 - DNA, 36 bp, Artificial Sequence
  Synthetic oligonucleotide
gaggggatcgccccctgctttttcttctgccgccca

SEQ ID NO: 147532 - DNA, 35 bp, Artificial Sequence
  Synthetic oligonucleotide
gcctgctccccgcccgccgttacagcacatgccca

SEQ ID NO: 147533 - DNA, 36 bp, Artificial Sequence
  Synthetic oligonucleotide
tacgttctgcccctgccctctatcccagttacggca

SEQ ID NO: 147534 - DNA, 36 bp, Artificial Sequence
  Synthetic oligonucleotide
tacacccttgcctcgttggcctttcacccttgctca

SEQ ID NO: 147535 - DNA, 35 bp, Artificial Sequence
  Synthetic oligonucleotide
gcctcctgcatagagtccccgcttattccacccga

SEQ ID NO: 147536 - DNA, 37 bp, Artificial Sequence
  Synthetic oligonucleotide
gtctgccttggctcctgtcctctcgttctttagccga

SEQ ID NO: 147537 - DNA, 37 bp, Artificial Sequence
  Synthetic oligonucleotide
gaaggtgagggcgaaatcaagggattggatgggggga

SEQ ID NO: 147538 - DNA, 37 bp, Artificial Sequence
  Synthetic oligonucleotide
atgagcgaggggaaggagaggcgggaaaccaatatga

SEQ ID NO: 147539 - DNA, 37 bp, Artificial Sequence
  Synthetic oligonucleotide
atccccgcctccaaatacccgtcgtactacagtatga

SEQ ID NO: 147540 - DNA, 38 bp, Artificial Sequence
  Synthetic oligonucleotide
acccgtcccgcctccagctggttctatacctcttgtga

SEQ ID NO: 147541 - DNA, 36 bp, Artificial Sequence
  Synthetic oligonucleotide
tgtggccccctatcacgcgtcacgcctaccccgcta

SEQ ID NO: 147542 - DNA, 35 bp, Artificial Sequence
  Synthetic oligonucleotide
acaaacgcctggctgtcttagtctttgcccttcta

SEQ ID NO: 147543 - DNA, 35 bp, Artificial Sequence
  Synthetic oligonucleotide
gactgtgtgcccgtcggtatccaatgcacctaccc

SEQ ID NO: 147544 - DNA, 35 bp, Artificial Sequence
  Synthetic oligonucleotide
agtgcactcacatggctccctaccgagattccccc

SEQ ID NO: 147545 - DNA, 35 bp, Artificial Sequence
  Synthetic oligonucleotide
atgcccggccacccgtctctcttgatccttgtccc

SEQ ID NO: 147546 - DNA, 35 bp, Artificial Sequence
  Synthetic oligonucleotide
gcactgcaatgctgtttttgctggcgttcccttcc

SEQ ID NO: 147547 - DNA, 35 bp, Artificial Sequence
  Synthetic oligonucleotide
ggtgccccaccccgcccctgactcagttcgcatgc

SEQ ID NO: 147548 - DNA, 35 bp, Artificial Sequence
  Synthetic oligonucleotide
tgtccctacccgcctggtcgtacattgctccaatc

SEQ ID NO: 147549 - DNA, 35 bp, Artificial Sequence
  Synthetic oligonucleotide
tcacgcctgggagggcgggcctacagggttacctc

SEQ ID NO: 147550 - DNA, 35 bp, Artificial Sequence
  Synthetic oligonucleotide
tagccacaaagatcgcattgtctgtctacaccctc

SEQ ID NO: 147551 - DNA, 35 bp, Artificial Sequence
  Synthetic oligonucleotide
gactcagacgctccggccccaaacgaaccctgctc

SEQ ID NO: 147552 - DNA, 35 bp, Artificial Sequence
  Synthetic oligonucleotide
ttcgctcgctgtgagcctcatgaagctgccctctc

SEQ ID NO: 147553 - DNA, 35 bp, Artificial Sequence
  Synthetic oligonucleotide
gcccactacaccggtatgtcccctcttcgagagtc

SEQ ID NO: 147554 - DNA, 35 bp, Artificial Sequence
  Synthetic oligonucleotide
gttacgctatcacctcgttcgcatctgcacccttc

SEQ ID NO: 147555 - DNA, 35 bp, Artificial Sequence
  Synthetic oligonucleotide
gaccgatcaccccccggtacccaattgacacctag

SEQ ID NO: 147556 - DNA, 35 bp, Artificial Sequence
  Synthetic oligonucleotide
acgctgggaggaaacaagaggggagggacgtgacg

SEQ ID NO: 147557 - DNA, 35 bp, Artificial Sequence
  Synthetic oligonucleotide
gactacgtaccaccgacctcacagactcatttacg

SEQ ID NO: 147558 - DNA, 35 bp, Artificial Sequence
  Synthetic oligonucleotide
ggatacgtgcagccgcgtcttaccttgccaccccg

SEQ ID NO: 147559 - DNA, 35 bp, Artificial Sequence
  Synthetic oligonucleotide
atgacccgctcgcccccctactcagtttacatagg

SEQ ID NO: 147560 - DNA, 34 bp, Artificial Sequence
  Synthetic oligonucleotide
atgtagacagagggggtggaggggcacgtttagg

SEQ ID NO: 147561 - DNA, 35 bp, Artificial Sequence
  Synthetic oligonucleotide
gaattgagagcaaggagatgaaaccaaagggcggg

SEQ ID NO: 147562 - DNA, 35 bp, Artificial Sequence
  Synthetic oligonucleotide
gttactgccacatatcgctccacctcccagagggg

SEQ ID NO: 147563 - DNA, 35 bp, Artificial Sequence
  Synthetic oligonucleotide
gactacccaacctgtgacgtgatcctatcctactg

SEQ ID NO: 147564 - DNA, 35 bp, Artificial Sequence
  Synthetic oligonucleotide
atgtccaccctctccaaacttcctagtgtagtttg

SEQ ID NO: 147565 - DNA, 35 bp, Artificial Sequence
  Synthetic oligonucleotide
ggacgcggggcaaagcatgaaggggtgaggggaat

SEQ ID NO: 147566 - DNA, 35 bp, Artificial Sequence
  Synthetic oligonucleotide
agtcaccccggacctatacaactgcacccttgatt

SEQ ID NO: 147567 - DNA, 35 bp, Artificial Sequence
  Synthetic oligonucleotide
gcatcaccctcacctctgctctacagtctagcctt

SEQ ID NO: 147568 - DNA, 35 bp, Artificial Sequence
  Synthetic oligonucleotide
gaaccgtgctcctgtggccttatcctcacctcctt

SEQ ID NO: 147569 - DNA, 36 bp, Artificial Sequence
  Synthetic oligonucleotide
gtgtaggggcggttacgggggcggagaatataggca

SEQ ID NO: 147570 - DNA, 37 bp, Artificial Sequence
  Synthetic oligonucleotide
ttcaccgcctaatctcgtcgcactatcttcaggcaga

SEQ ID NO: 147571 - DNA, 37 bp, Artificial Sequence
  Synthetic oligonucleotide
aagacgggactgttgtagtggacgtgagggagggaga

SEQ ID NO: 147572 - DNA, 37 bp, Artificial Sequence
  Synthetic oligonucleotide
gtcccttgtccgtttgtttgcgctcctatgcccccga

SEQ ID NO: 147573 - DNA, 37 bp, Artificial Sequence
  Synthetic oligonucleotide
ggcccatgcacacctgcgttatccccctccttgccga

SEQ ID NO: 147574 - DNA, 36 bp, Artificial Sequence
  Synthetic oligonucleotide
gcctacgcccgctagttactggttttcgccctccga

SEQ ID NO: 147575 - DNA, 38 bp, Artificial Sequence
  Synthetic oligonucleotide
gataaggagcacacaagggataaggggcgaggggagga

SEQ ID NO: 147576 - DNA, 28 bp, Artificial Sequence
  Synthetic oligonucleotide
acaccccaccgcactatcacgccacgga

SEQ ID NO: 147577 - DNA, 37 bp, Artificial Sequence
  Synthetic oligonucleotide
accgcggcggggtaggggaagtagaagtagaggggga

SEQ ID NO: 147578 - DNA, 36 bp, Artificial Sequence
  Synthetic oligonucleotide
aatgccaggggacgaaatagcggaaggggcatggga

SEQ ID NO: 147579 - DNA, 37 bp, Artificial Sequence
  Synthetic oligonucleotide
accccctggctccatccattcagtaccagtacttgga

SEQ ID NO: 147580 - DNA, 36 bp, Artificial Sequence
  Synthetic oligonucleotide
gacgggctgagacgggtgggagggaccagggcatga

SEQ ID NO: 147581 - DNA, 36 bp, Artificial Sequence
  Synthetic oligonucleotide
gacgtttccagcctgctactagctgcctcttcctga

SEQ ID NO: 147582 - DNA, 38 bp, Artificial Sequence
  Synthetic oligonucleotide
tctggagcgggtggggcgggcatgggagattagtctga

SEQ ID NO: 147583 - DNA, 37 bp, Artificial Sequence
  Synthetic oligonucleotide
atcagcctggttatttctgtgccttcgcctcccttga

SEQ ID NO: 147584 - DNA, 37 bp, Artificial Sequence
  Synthetic oligonucleotide
gcccacatcccctttcctgagccgacagtctagttga

SEQ ID NO: 147585 - DNA, 33 bp, Artificial Sequence
  Synthetic oligonucleotide
gcaatggcactgctttcttatcctgctcccata

SEQ ID NO: 147586 - DNA, 36 bp, Artificial Sequence
  Synthetic oligonucleotide
atcgtaacctccgccttccacctgtagagtctccta

SEQ ID NO: 147587 - DNA, 35 bp, Artificial Sequence
  Synthetic oligonucleotide
acaaagaggggggcggaatcggactgcagcatgta

SEQ ID NO: 147588 - DNA, 35 bp, Artificial Sequence
  Synthetic oligonucleotide
acatgcgggaagggggagggcgggcaacgcttgta

SEQ ID NO: 147589 - DNA, 35 bp, Artificial Sequence
  Synthetic oligonucleotide
aaggcactccgctctggcaatcctgctcccctccc

SEQ ID NO: 147590 - DNA, 35 bp, Artificial Sequence
  Synthetic oligonucleotide
gtccgtccccagaggtcaatcctatatcttccgcc

SEQ ID NO: 147591 - DNA, 35 bp, Artificial Sequence
  Synthetic oligonucleotide
acccccgcatcagcccgttcccatgcctccgatcc

SEQ ID NO: 147592 - DNA, 35 bp, Artificial Sequence
  Synthetic oligonucleotide
tggagccactgggcactctgtcttttgctcgctcc

SEQ ID NO: 147593 - DNA, 35 bp, Artificial Sequence
  Synthetic oligonucleotide
tgcaaccgccacggcccgctgtctgctcatgctcc

SEQ ID NO: 147594 - DNA, 35 bp, Artificial Sequence
  Synthetic oligonucleotide
tccgcgctgttaccatattgcttccttctttgtcc

SEQ ID NO: 147595 - DNA, 35 bp, Artificial Sequence
  Synthetic oligonucleotide
gctagcgacttggtgcatcctccccgttccgttcc

SEQ ID NO: 147596 - DNA, 35 bp, Artificial Sequence
  Synthetic oligonucleotide
actccattccgctgtaaacaactctcgccgcacgc

SEQ ID NO: 147597 - DNA, 35 bp, Artificial Sequence
  Synthetic oligonucleotide
atccagacgttcgccactctgttctctcccgtcgc

SEQ ID NO: 147598 - DNA, 35 bp, Artificial Sequence
  Synthetic oligonucleotide
ttgccgcaacactcggtacatctctcacacttggc

SEQ ID NO: 147599 - DNA, 35 bp, Artificial Sequence
  Synthetic oligonucleotide
gactcctgcctcgcccatatttatctcatggactc

SEQ ID NO: 147600 - DNA, 35 bp, Artificial Sequence
  Synthetic oligonucleotide
gctcaccgatagccactgaatgactcgccctgttc

SEQ ID NO: 147601 - DNA, 35 bp, Artificial Sequence
  Synthetic oligonucleotide
gacgtgctcctccccattcaataacgtaacctttc

SEQ ID NO: 147602 - DNA, 35 bp, Artificial Sequence
  Synthetic oligonucleotide
gcgactcatcctccacctgcctcctcaatcatcag

SEQ ID NO: 147603 - DNA, 33 bp, Artificial Sequence
  Synthetic oligonucleotide
atgaatgtaggggcggggggcaagaagcgtgag

SEQ ID NO: 147604 - DNA, 35 bp, Artificial Sequence
  Synthetic oligonucleotide
gcgtgggacggggggtggggtgatgctttgggtag

SEQ ID NO: 147605 - DNA, 35 bp, Artificial Sequence
  Synthetic oligonucleotide
gctacctgtcgctctcctctcatcctccgtacacg

SEQ ID NO: 147606 - DNA, 35 bp, Artificial Sequence
  Synthetic oligonucleotide
gccaacacgggtacttgccctgcccttatcctccg

SEQ ID NO: 147607 - DNA, 35 bp, Artificial Sequence
  Synthetic oligonucleotide
gacagtgcatatccgatctttacaccatctactcg

SEQ ID NO: 147608 - DNA, 35 bp, Artificial Sequence
  Synthetic oligonucleotide
acacgacactacccatccatcccacccccggctgg

SEQ ID NO: 147609 - DNA, 35 bp, Artificial Sequence
  Synthetic oligonucleotide
gtgaagcgccttatcactgtcgtcctctcgtcctg

SEQ ID NO: 147610 - DNA, 35 bp, Artificial Sequence
  Synthetic oligonucleotide
gaactggtccattggctctaaaacctccgcccgtg

SEQ ID NO: 147611 - DNA, 35 bp, Artificial Sequence
  Synthetic oligonucleotide
gccactcaatcctcatgctacccagaccctgcgtg

SEQ ID NO: 147612 - DNA, 35 bp, Artificial Sequence
  Synthetic oligonucleotide
acacaacacctaacatgttcgccgttccgctcttg

SEQ ID NO: 147613 - DNA, 35 bp, Artificial Sequence
  Synthetic oligonucleotide
atctctccgaacctgatgacttagctccatccact

SEQ ID NO: 147614 - DNA, 35 bp, Artificial Sequence
  Synthetic oligonucleotide
gaccgtcagccatgcccatgttatgtcccctgcct

SEQ ID NO: 147615 - DNA, 35 bp, Artificial Sequence
  Synthetic oligonucleotide
tctgctctgtcccaatgagcccccgccttcctcct

SEQ ID NO: 147616 - DNA, 35 bp, Artificial Sequence
  Synthetic oligonucleotide
gtcgccatcctcaaaggggaccatgcccttctcct

SEQ ID NO: 147617 - DNA, 35 bp, Artificial Sequence
  Synthetic oligonucleotide
tgcgtgacagtatcgccacccacacgtccttctct

SEQ ID NO: 147618 - DNA, 35 bp, Artificial Sequence
  Synthetic oligonucleotide
acgcacctcttacagtgcatttgtcctttccacgt

SEQ ID NO: 147619 - DNA, 35 bp, Artificial Sequence
  Synthetic oligonucleotide
accctccctcgcattcacatgattcagtgcgcctt

SEQ ID NO: 147620 - DNA, 36 bp, Artificial Sequence
  Synthetic oligonucleotide
gggatcccggaagggtggaggaagcaggaagaaaaa

SEQ ID NO: 147621 - DNA, 36 bp, Artificial Sequence
  Synthetic oligonucleotide
agatgaaggaggggcattagaggagggaaaatgaaa

SEQ ID NO: 147622 - DNA, 35 bp, Artificial Sequence
  Synthetic oligonucleotide
atccccggctccctgccccgaatgcccgttgccca

SEQ ID NO: 147623 - DNA, 36 bp, Artificial Sequence
  Synthetic oligonucleotide
tcacctcccgcccagggacgaacattcccgcttcca

SEQ ID NO: 147624 - DNA, 36 bp, Artificial Sequence
  Synthetic oligonucleotide
tcatcaccgccgcttgtatcacaccattaattctca

SEQ ID NO: 147625 - DNA, 37 bp, Artificial Sequence
  Synthetic oligonucleotide
tagaggacaaggcggagaggcgggggagagggtaaga

SEQ ID NO: 147626 - DNA, 37 bp, Artificial Sequence
  Synthetic oligonucleotide
ttgccacaccgacgatgccgcgcaccactctccacga

SEQ ID NO: 147627 - DNA, 37 bp, Artificial Sequence
  Synthetic oligonucleotide
aaaccccgacacatcgccctcaacatcgctctgacga

SEQ ID NO: 147628 - DNA, 37 bp, Artificial Sequence
  Synthetic oligonucleotide
agggagggtgggagaggggaagggcatggatgagcga

SEQ ID NO: 147629 - DNA, 35 bp, Artificial Sequence
  Synthetic oligonucleotide
tacacgacaaccgtcctacaaggccctctacctga

SEQ ID NO: 147630 - DNA, 37 bp, Artificial Sequence
  Synthetic oligonucleotide
accgccacagtaagtccgttagcatccaccctcctga

SEQ ID NO: 147631 - DNA, 38 bp, Artificial Sequence
  Synthetic oligonucleotide
gtcgccctgccctgagcgcgccctccatatcccgttga

SEQ ID NO: 147632 - DNA, 38 bp, Artificial Sequence
  Synthetic oligonucleotide
ttggaaaggagcggggggtaggggtcggggccggttga

SEQ ID NO: 147633 - DNA, 35 bp, Artificial Sequence
  Synthetic oligonucleotide
accccctccttcgggttgcattcttgcccttgtta

SEQ ID NO: 147634 - DNA, 35 bp, Artificial Sequence
  Synthetic oligonucleotide
acccctgcccctgacgcgatgaccaggcccaccac

SEQ ID NO: 147635 - DNA, 35 bp, Artificial Sequence
  Synthetic oligonucleotide
gcaacctgtgcgctcgtaccaccctaaccatttac

SEQ ID NO: 147636 - DNA, 35 bp, Artificial Sequence
  Synthetic oligonucleotide
acgctacacccaccgtcttggacccggctcgtacc

SEQ ID NO: 147637 - DNA, 35 bp, Artificial Sequence
  Synthetic oligonucleotide
tacatgatctgcgggcctcatttaccgctacgccc

SEQ ID NO: 147638 - DNA, 35 bp, Artificial Sequence
  Synthetic oligonucleotide
gcctcccccatcattgtttacttcgcgccctagcc

SEQ ID NO: 147639 - DNA, 35 bp, Artificial Sequence
  Synthetic oligonucleotide
tttaatcagccaacagttcccgttccaccgccgcc

SEQ ID NO: 147640 - DNA, 35 bp, Artificial Sequence
  Synthetic oligonucleotide
tgacggaccccattgccctgttacgctggcgtgcc

SEQ ID NO: 147641 - DNA, 35 bp, Artificial Sequence
  Synthetic oligonucleotide
aacacgcatgtgctgacgttccagccttctcgtcc

SEQ ID NO: 147642 - DNA, 35 bp, Artificial Sequence
  Synthetic oligonucleotide
ttcgcttcgcagtgtccttactatcccccaccatc

SEQ ID NO: 147643 - DNA, 35 bp, Artificial Sequence
  Synthetic oligonucleotide
ataccaccctgagctggggactcacatctgccctc

SEQ ID NO: 147644 - DNA, 35 bp, Artificial Sequence
  Synthetic oligonucleotide
gtacccacccacccgttctgaaaagctttcgtttc

SEQ ID NO: 147645 - DNA, 35 bp, Artificial Sequence
  Synthetic oligonucleotide
gatgggcatcgaggggcggaaggatagggcactag

SEQ ID NO: 147646 - DNA, 35 bp, Artificial Sequence
  Synthetic oligonucleotide
tgtccatccctccccggattctataatgactcccg

SEQ ID NO: 147647 - DNA, 35 bp, Artificial Sequence
  Synthetic oligonucleotide
gtgccgcatattgccctattctatcacccccgccg

SEQ ID NO: 147648 - DNA, 35 bp, Artificial Sequence
  Synthetic oligonucleotide
catcaaccgcccatctcttaaccgtgtacacctcg

SEQ ID NO: 147649 - DNA, 35 bp, Artificial Sequence
  Synthetic oligonucleotide
acagctcactcccaccctcgtcgcgcatcctacgg

SEQ ID NO: 147650 - DNA, 36 bp, Artificial Sequence
  Synthetic oligonucleotide
gactagctgcggtcacgcgcgggtaggggagggtgg

SEQ ID NO: 147651 - DNA, 35 bp, Artificial Sequence
  Synthetic oligonucleotide
actgactgcactcttctctccgcactgtgcctctg

SEQ ID NO: 147652 - DNA, 35 bp, Artificial Sequence
  Synthetic oligonucleotide
tacattgcttgccccgccgaacggacacacttcct

SEQ ID NO: 147653 - DNA, 35 bp, Artificial Sequence
  Synthetic oligonucleotide
ggtcacgccgtccactccagttcagccagcttcct

SEQ ID NO: 147654 - DNA, 32 bp, Artificial Sequence
  Synthetic oligonucleotide
agttctcgacgccgcccttctccttgcccttt

SEQ ID NO: 147655 - DNA, 35 bp, Artificial Sequence
  Synthetic oligonucleotide
tatccgcacaccttctcagccagtgcccccccaaa

SEQ ID NO: 147656 - DNA, 36 bp, Artificial Sequence
  Synthetic oligonucleotide
acccaccccagtccgtttcatctggtttacgaccaa

SEQ ID NO: 147657 - DNA, 36 bp, Artificial Sequence
  Synthetic oligonucleotide
gcctcccgcaccacttatgtttccagtacgttccaa

SEQ ID NO: 147658 - DNA, 36 bp, Artificial Sequence
  Synthetic oligonucleotide
acagtggtgcgggcgggagggcattatatactggaa

SEQ ID NO: 147659 - DNA, 36 bp, Artificial Sequence
  Synthetic oligonucleotide
cgaaccccgccctctcgtttctggttgaggaaccca

SEQ ID NO: 147660 - DNA, 36 bp, Artificial Sequence
  Synthetic oligonucleotide
acccgaaccttccgaggcgaatcatccagtctccca

SEQ ID NO: 147661 - DNA, 36 bp, Artificial Sequence
  Synthetic oligonucleotide
tacaccgcattgcatatccgccgttcatttggctca

SEQ ID NO: 147662 - DNA, 36 bp, Artificial Sequence
  Synthetic oligonucleotide
tgccacgcgattctaacctgctatccgcttctttca

SEQ ID NO: 147663 - DNA, 34 bp, Artificial Sequence
  Synthetic oligonucleotide
acagacgctaccgcacgtgcctccgcttactcga

SEQ ID NO: 147664 - DNA, 37 bp, Artificial Sequence
  Synthetic oligonucleotide
aacatcgagaagggaatgggtggagtgagggtaagga

SEQ ID NO: 147665 - DNA, 36 bp, Artificial Sequence
  Synthetic oligonucleotide
gacgggggggtgtaggatagggaatgtcgacaggga

SEQ ID NO: 147666 - DNA, 37 bp, Artificial Sequence
  Synthetic oligonucleotide
ggagggtgggggtacggttaatcggggtggacactga

SEQ ID NO: 147667 - DNA, 38 bp, Artificial Sequence
  Synthetic oligonucleotide
tgtcgccccaccattgcaccggccttgttcgaccctga

SEQ ID NO: 147668 - DNA, 37 bp, Artificial Sequence
  Synthetic oligonucleotide
accaacctgtagtgtccgtttactctcccctccgtga

SEQ ID NO: 147669 - DNA, 38 bp, Artificial Sequence
  Synthetic oligonucleotide
ggggggagcaccggggggaagggacctaaagaaggtga

SEQ ID NO: 147670 - DNA, 37 bp, Artificial Sequence
  Synthetic oligonucleotide
gatgatgcaacgagggtaggagggtggggggatgtga

SEQ ID NO: 147671 - DNA, 37 bp, Artificial Sequence
  Synthetic oligonucleotide
ttgaggggctgtagggaatagggggtgggaattgtga

SEQ ID NO: 147672 - DNA, 36 bp, Artificial Sequence
  Synthetic oligonucleotide
taacgcgcgcgcatttcgccttgttagccactccta

SEQ ID NO: 147673 - DNA, 36 bp, Artificial Sequence
  Synthetic oligonucleotide
gtcaacgcctgtattctcggccgtccgcctcctcta

SEQ ID NO: 147674 - DNA, 36 bp, Artificial Sequence
  Synthetic oligonucleotide
aacccctcgcccatatactgccctttggtctctgta

SEQ ID NO: 147675 - DNA, 36 bp, Artificial Sequence
  Synthetic oligonucleotide
tgccacggcccgtactacagcaccacccctccatta

SEQ ID NO: 147676 - DNA, 35 bp, Artificial Sequence
  Synthetic oligonucleotide
aaggaccctcccgtttaagcccctcgtttcgtaac

SEQ ID NO: 147677 - DNA, 35 bp, Artificial Sequence
  Synthetic oligonucleotide
tcatggcaagaactgttcacgtcacgcccccaacc

SEQ ID NO: 147678 - DNA, 35 bp, Artificial Sequence
  Synthetic oligonucleotide
gtgacccaaatcttcgagcccacgtggtcccaccc

SEQ ID NO: 147679 - DNA, 35 bp, Artificial Sequence
  Synthetic oligonucleotide
aagtcagccttgtcacatctttccgcctacacccc

SEQ ID NO: 147680 - DNA, 35 bp, Artificial Sequence
  Synthetic oligonucleotide
gtcacacgcgggatttcacgccattgccaccgccc

SEQ ID NO: 147681 - DNA, 35 bp, Artificial Sequence
  Synthetic oligonucleotide
acgtgcttccatgttgttccgcgtaccatcatccc

SEQ ID NO: 147682 - DNA, 35 bp, Artificial Sequence
  Synthetic oligonucleotide
gccactcggcaataaactgacatccgctctactcc

SEQ ID NO: 147683 - DNA, 35 bp, Artificial Sequence
  Synthetic oligonucleotide
tatggctgtgatacttctgccctagttcctgctcc

SEQ ID NO: 147684 - DNA, 35 bp, Artificial Sequence
  Synthetic oligonucleotide
gcgccgcccaacgcgttccactgctttccgattcc

SEQ ID NO: 147685 - DNA, 35 bp, Artificial Sequence
  Synthetic oligonucleotide
tgtcaagctgaccgccacctgtcctcggcatttcc

SEQ ID NO: 147686 - DNA, 35 bp, Artificial Sequence
  Synthetic oligonucleotide
atcccatcgctacgttaactggttccacccccagc

SEQ ID NO: 147687 - DNA, 35 bp, Artificial Sequence
  Synthetic oligonucleotide
gttgcgcgagagcaatactccctcatcccgttcgc

SEQ ID NO: 147688 - DNA, 35 bp, Artificial Sequence
  Synthetic oligonucleotide
taatgcacgcctcttagtcttatctgctactcatc

SEQ ID NO: 147689 - DNA, 35 bp, Artificial Sequence
  Synthetic oligonucleotide
gcagggctgttgccgtttcgcgtgtttcgttcctc

SEQ ID NO: 147690 - DNA, 35 bp, Artificial Sequence
  Synthetic oligonucleotide
tggggacggggtgaaggctggtggtggggtgtaag

SEQ ID NO: 147691 - DNA, 35 bp, Artificial Sequence
  Synthetic oligonucleotide
acgaaacggggaaggcaaataacggtggcgaagag

SEQ ID NO: 147692 - DNA, 35 bp, Artificial Sequence
  Synthetic oligonucleotide
tcaccttccccacgtctcgtccgtcgctcaaaccg

SEQ ID NO: 147693 - DNA, 35 bp, Artificial Sequence
  Synthetic oligonucleotide
aaggtggctggtaggggacggtggcggagttagcg

SEQ ID NO: 147694 - DNA, 35 bp, Artificial Sequence
  Synthetic oligonucleotide
gccgcaggccctcttccgttcataatcttatatcg

SEQ ID NO: 147695 - DNA, 35 bp, Artificial Sequence
  Synthetic oligonucleotide
ttgtcttatccgcccgctctacacccgacacttcg

SEQ ID NO: 147696 - DNA, 35 bp, Artificial Sequence
  Synthetic oligonucleotide
ttgggtgtagtgagtgggggaggggtggagcaagg

SEQ ID NO: 147697 - DNA, 35 bp, Artificial Sequence
  Synthetic oligonucleotide
tgtacaccgccgcccccgaccagctcttgcttcgg

SEQ ID NO: 147698 - DNA, 35 bp, Artificial Sequence
  Synthetic oligonucleotide
acagggagggtgggagagtgttcgtcgtccccggg

SEQ ID NO: 147699 - DNA, 35 bp, Artificial Sequence
  Synthetic oligonucleotide
tgtgcaccgccccttctcccacgtactccctgctg

SEQ ID NO: 147700 - DNA, 35 bp, Artificial Sequence
  Synthetic oligonucleotide
gtcccctccctcgcccaactgactcctgcgccgtg

SEQ ID NO: 147701 - DNA, 35 bp, Artificial Sequence
  Synthetic oligonucleotide
tcccactcccccccgtaagcgcgcatcacaaacat

SEQ ID NO: 147702 - DNA, 35 bp, Artificial Sequence
  Synthetic oligonucleotide
tcagaagcaagcctcctcgtcgctccatgctctat

SEQ ID NO: 147703 - DNA, 35 bp, Artificial Sequence
  Synthetic oligonucleotide
atcctgggtcgttagccccggttttccgcctcact

SEQ ID NO: 147704 - DNA, 35 bp, Artificial Sequence
  Synthetic oligonucleotide
actccctccggcccacatgaccttaggacatcgct

SEQ ID NO: 147705 - DNA, 35 bp, Artificial Sequence
  Synthetic oligonucleotide
tccagcctcgcgcaccgtcagccacccccagcctt

SEQ ID NO: 147706 - DNA, 35 bp, Artificial Sequence
  Synthetic oligonucleotide
tatccgtcctcccgcatgcgcttctccttactgtt

SEQ ID NO: 147707 - DNA, 35 bp, Artificial Sequence
  Synthetic oligonucleotide
ttgggccgccatccatcgtcttatctacacgcaaa

SEQ ID NO: 147708 - DNA, 35 bp, Artificial Sequence
  Synthetic oligonucleotide
aattgagcccccgctcccttgttgataccacacca

SEQ ID NO: 147709 - DNA, 35 bp, Artificial Sequence
  Synthetic oligonucleotide
gagagggcgggcctcttgggtggggttccggacca

SEQ ID NO: 147710 - DNA, 35 bp, Artificial Sequence
  Synthetic oligonucleotide
gcaaaggagagtgcgggaagagcgcggggggggca

SEQ ID NO: 147711 - DNA, 36 bp, Artificial Sequence
  Synthetic oligonucleotide
acgccgaagccgccctccgcgtaccagcctcctgca

SEQ ID NO: 147712 - DNA, 35 bp, Artificial Sequence
  Synthetic oligonucleotide
gtgccacttgaatctggattgccaccctcctctca

SEQ ID NO: 147713 - DNA, 37 bp, Artificial Sequence
  Synthetic oligonucleotide
agacagaaaaggggggagggtccacggaggagcaaga

SEQ ID NO: 147714 - DNA, 36 bp, Artificial Sequence
  Synthetic oligonucleotide
tgcgaccctcctagctgtctcggaccccgtttccga

SEQ ID NO: 147715 - DNA, 36 bp, Artificial Sequence
  Synthetic oligonucleotide
acttcaccccggtccctgtctcgttcttgttatcga

SEQ ID NO: 147716 - DNA, 37 bp, Artificial Sequence
  Synthetic oligonucleotide
gacgaaaagagggcacagaggggggcgcgggtaagga

SEQ ID NO: 147717 - DNA, 38 bp, Artificial Sequence
  Synthetic oligonucleotide
agtaagcccacgccccgtactgatccgtttcccgctga

SEQ ID NO: 147718 - DNA, 36 bp, Artificial Sequence
  Synthetic oligonucleotide
agggactggctgggtgggtggggtttcacctctgta

SEQ ID NO: 147719 - DNA, 34 bp, Artificial Sequence
  Synthetic oligonucleotide
gtccagcctatcagcgcacccgtcaccagcccac

SEQ ID NO: 147720 - DNA, 35 bp, Artificial Sequence
  Synthetic oligonucleotide
tccgcccgacccatcgtttaccatcttagctccac

SEQ ID NO: 147721 - DNA, 35 bp, Artificial Sequence
  Synthetic oligonucleotide
tcgcttgtcctttccctgtatcgcggctctctcac

SEQ ID NO: 147722 - DNA, 35 bp, Artificial Sequence
  Synthetic oligonucleotide
ttccgactgacagtaccgtgcccccaccgcccacc

SEQ ID NO: 147723 - DNA, 35 bp, Artificial Sequence
  Synthetic oligonucleotide
aaccctcctgcatgtctcgttcgctatcaggcacc

SEQ ID NO: 147724 - DNA, 35 bp, Artificial Sequence
  Synthetic oligonucleotide
gtgaccgttcgggtctacaatatgtttcctttgcc

SEQ ID NO: 147725 - DNA, 35 bp, Artificial Sequence
  Synthetic oligonucleotide
ggactgaggttagggcggggggaggtcggtgaagc

SEQ ID NO: 147726 - DNA, 35 bp, Artificial Sequence
  Synthetic oligonucleotide
gccaggttctggcctcacctcccaccccgccgagc

SEQ ID NO: 147727 - DNA, 35 bp, Artificial Sequence
  Synthetic oligonucleotide
atcatccctgggtgccccctcaaagtacatccatc

SEQ ID NO: 147728 - DNA, 34 bp, Artificial Sequence
  Synthetic oligonucleotide
tctacgccccattccatctggtgtaactaccctc

SEQ ID NO: 147729 - DNA, 35 bp, Artificial Sequence
  Synthetic oligonucleotide
taagggacggtaaggggggctgggagaacggtgtc

SEQ ID NO: 147730 - DNA, 35 bp, Artificial Sequence
  Synthetic oligonucleotide
gatgagggacgggcaagagcgggggaagggagttc

SEQ ID NO: 147731 - DNA, 35 bp, Artificial Sequence
  Synthetic oligonucleotide
gtgggtcatccactgctccctagcctcccgccacg

SEQ ID NO: 147732 - DNA, 35 bp, Artificial Sequence
  Synthetic oligonucleotide
ttactgcgacgcccctgctctctgtttctgccccg

SEQ ID NO: 147733 - DNA, 35 bp, Artificial Sequence
  Synthetic oligonucleotide
ttcgccccccaggccttctatcgttgaccactccg

SEQ ID NO: 147734 - DNA, 36 bp, Artificial Sequence
  Synthetic oligonucleotide
gctccccatccatgtctttatgtttcttcccaaggg

SEQ ID NO: 147735 - DNA, 35 bp, Artificial Sequence
  Synthetic oligonucleotide
tgttctccatccgctgggttctacgtccttccgtg

SEQ ID NO: 147736 - DNA, 35 bp, Artificial Sequence
  Synthetic oligonucleotide
atagccggggtggaggtatgggaataggcgggtat

SEQ ID NO: 147737 - DNA, 35 bp, Artificial Sequence
  Synthetic oligonucleotide
gacaggcctgcattgcgatcatcccctcgggccct

SEQ ID NO: 147738 - DNA, 35 bp, Artificial Sequence
  Synthetic oligonucleotide
cacgcccatccgccgtttgtaccatcccttaagtt

SEQ ID NO: 147739 - DNA, 35 bp, Artificial Sequence
  Synthetic oligonucleotide
atccgcacacgctagttcgttcttcaccttggttt

SEQ ID NO: 147740 - DNA, 35 bp, Artificial Sequence
  Synthetic oligonucleotide
gggaggaagacaaggggaggaggcaggaccagaaa

SEQ ID NO: 147741 - DNA, 36 bp, Artificial Sequence
  Synthetic oligonucleotide
tacccgccgggggggggtaaaatgctggggagggaa

SEQ ID NO: 147742 - DNA, 36 bp, Artificial Sequence
  Synthetic oligonucleotide
ccatcaacccgactcgaactggctcacatgctccca

SEQ ID NO: 147743 - DNA, 36 bp, Artificial Sequence
  Synthetic oligonucleotide
acccccgccatgttcgtacctgctcgcgaaaatcca

SEQ ID NO: 147744 - DNA, 35 bp, Artificial Sequence
  Synthetic oligonucleotide
cacgggtgggggacgggtgggaatgatgacctaga

SEQ ID NO: 147745 - DNA, 37 bp, Artificial Sequence
  Synthetic oligonucleotide
gcatcgccatgcccgtgcctttacttccccttgtaga

SEQ ID NO: 147746 - DNA, 37 bp, Artificial Sequence
  Synthetic oligonucleotide
taggggcgggtattgttaaccggggcgtgttcgggga

SEQ ID NO: 147747 - DNA, 37 bp, Artificial Sequence
  Synthetic oligonucleotide
tgacacggttggggggtggacttggtgaaagggtgga

SEQ ID NO: 147748 - DNA, 36 bp, Artificial Sequence
  Synthetic oligonucleotide
ttcaccgccctcgagccgactaccacacattttgga

SEQ ID NO: 147749 - DNA, 38 bp, Artificial Sequence
  Synthetic oligonucleotide
tccgacctccctcagacttgcgcatgcgagccccatga

SEQ ID NO: 147750 - DNA, 38 bp, Artificial Sequence
  Synthetic oligonucleotide
atgaaccacggtggtgggtgatgggaggggagggatga

SEQ ID NO: 147751 - DNA, 38 bp, Artificial Sequence
  Synthetic oligonucleotide
gtgaaacagggagggagggacaaatagagcagttctga

SEQ ID NO: 147752 - DNA, 37 bp, Artificial Sequence
  Synthetic oligonucleotide
tgcggggagggggagttgagggtgcggttatcggtga

SEQ ID NO: 147753 - DNA, 38 bp, Artificial Sequence
  Synthetic oligonucleotide
gtcatcccctatctgcgcgcccaccactccctcggtga

SEQ ID NO: 147754 - DNA, 38 bp, Artificial Sequence
  Synthetic oligonucleotide
ttcgacccatccattctacttgagtccttcacttgtga

SEQ ID NO: 147755 - DNA, 37 bp, Artificial Sequence
  Synthetic oligonucleotide
agccacccctccttcacgcgtacggtcgagtacttga

SEQ ID NO: 147756 - DNA, 38 bp, Artificial Sequence
  Synthetic oligonucleotide
gacggtcaaagggaggtggggaaggcggggagggttga

SEQ ID NO: 147757 - DNA, 35 bp, Artificial Sequence
  Synthetic oligonucleotide
agtcaggacccagccgttcatctacgcaccctcta

SEQ ID NO: 147758 - DNA, 35 bp, Artificial Sequence
  Synthetic oligonucleotide
tgctaaacgcattatactgtctcacgcctgctaac

SEQ ID NO: 147759 - DNA, 35 bp, Artificial Sequence
  Synthetic oligonucleotide
tctacccacgacgttacggcttttgctccatttac

SEQ ID NO: 147760 - DNA, 35 bp, Artificial Sequence
  Synthetic oligonucleotide
acaacagccacagatggaacaatgccgcgtccccc

SEQ ID NO: 147761 - DNA, 35 bp, Artificial Sequence
  Synthetic oligonucleotide
ccactacctctcgtcagatccgctcttcatcgccc

SEQ ID NO: 147762 - DNA, 35 bp, Artificial Sequence
  Synthetic oligonucleotide
gccgggcacggctcagcgccattatcactcctccc

SEQ ID NO: 147763 - DNA, 35 bp, Artificial Sequence
  Synthetic oligonucleotide
tgactgcccgatgcttttgcactcccttgtacgcc

SEQ ID NO: 147764 - DNA, 35 bp, Artificial Sequence
  Synthetic oligonucleotide
accccactcgactttacgcccaggaacccctggcc

SEQ ID NO: 147765 - DNA, 35 bp, Artificial Sequence
  Synthetic oligonucleotide
gtttgagcctcgcattttgttctccctgctctgcc

SEQ ID NO: 147766 - DNA, 35 bp, Artificial Sequence
  Synthetic oligonucleotide
gcgagactcgcctgtttccacttccgttattatcc

SEQ ID NO: 147767 - DNA, 35 bp, Artificial Sequence
  Synthetic oligonucleotide
tccaaccgcctcagccctgactctacccgtggtcc

SEQ ID NO: 147768 - DNA, 35 bp, Artificial Sequence
  Synthetic oligonucleotide
ttcaccccacatacgtgtcaagttccatatgccgc

SEQ ID NO: 147769 - DNA, 35 bp, Artificial Sequence
  Synthetic oligonucleotide
gcacgaaaggtcgccgtcgctcgtttcaatccatc

SEQ ID NO: 147770 - DNA, 35 bp, Artificial Sequence
  Synthetic oligonucleotide
gcctcctccatatgctgcgtcgttggaccttcctc

SEQ ID NO: 147771 - DNA, 35 bp, Artificial Sequence
  Synthetic oligonucleotide
tgtgacccgctcgcgatgttccaacatgcttcctc

SEQ ID NO: 147772 - DNA, 35 bp, Artificial Sequence
  Synthetic oligonucleotide
gttgtcgttaacaccgtacatgccctgtccctctc

SEQ ID NO: 147773 - DNA, 35 bp, Artificial Sequence
  Synthetic oligonucleotide
tacaccttcatgccaaccctcctaggacaagagtc

SEQ ID NO: 147774 - DNA, 35 bp, Artificial Sequence
  Synthetic oligonucleotide
gccccttcctcgtcactcccccgcagtgcaatgtc

SEQ ID NO: 147775 - DNA, 35 bp, Artificial Sequence
  Synthetic oligonucleotide
ttaccgagcaggccccctccgtgaagcgccctgtc

SEQ ID NO: 147776 - DNA, 35 bp, Artificial Sequence
  Synthetic oligonucleotide
tccctgccccgccacactgggcatgctcctcattc

SEQ ID NO: 147777 - DNA, 35 bp, Artificial Sequence
  Synthetic oligonucleotide
attgcccccggaatacgtcctctcctttgcccccg

SEQ ID NO: 147778 - DNA, 35 bp, Artificial Sequence
  Synthetic oligonucleotide
gtgctcccgtttctcgaccccctgtaatgtccgcg

SEQ ID NO: 147779 - DNA, 35 bp, Artificial Sequence
  Synthetic oligonucleotide
acttcccccggtcccttgtatacgcatgatctgcg

SEQ ID NO: 147780 - DNA, 35 bp, Artificial Sequence
  Synthetic oligonucleotide
accgggtgaggagggcggggcatgtggctatctcg

SEQ ID NO: 147781 - DNA, 35 bp, Artificial Sequence
  Synthetic oligonucleotide
tgcaggaagccaggggaggcgggttcgaggagggg

SEQ ID NO: 147782 - DNA, 35 bp, Artificial Sequence
  Synthetic oligonucleotide
taagcgctggggcgggcggggttggggtgaagctg

SEQ ID NO: 147783 - DNA, 35 bp, Artificial Sequence
  Synthetic oligonucleotide
tgtacatacgccttcactgtactacccttacattg

SEQ ID NO: 147784 - DNA, 35 bp, Artificial Sequence
  Synthetic oligonucleotide
gaccccctcccgcttcggccccgtctagtgtggat

SEQ ID NO: 147785 - DNA, 35 bp, Artificial Sequence
  Synthetic oligonucleotide
aattcacccgctggctgagcccctgctactcctat

SEQ ID NO: 147786 - DNA, 35 bp, Artificial Sequence
  Synthetic oligonucleotide
tgctccacatctagtcagcgtgatccaccgtacct

SEQ ID NO: 147787 - DNA, 35 bp, Artificial Sequence
  Synthetic oligonucleotide
gctgcccgggtcgcgggtagctgttgtacccttct

SEQ ID NO: 147788 - DNA, 35 bp, Artificial Sequence
  Synthetic oligonucleotide
gacgggcgaagattggagggatagagggggggagt

SEQ ID NO: 147789 - DNA, 35 bp, Artificial Sequence
  Synthetic oligonucleotide
tgcgccccccgctcgttactgagtcaacttcccgt

SEQ ID NO: 147790 - DNA, 36 bp, Artificial Sequence
  Synthetic oligonucleotide
gcgaccatgcaggggggaagggggagtggaccttaa

SEQ ID NO: 147791 - DNA, 36 bp, Artificial Sequence
  Synthetic oligonucleotide
gcacccgccgttcgtaccgccctcggacagtgtaca

SEQ ID NO: 147792 - DNA, 36 bp, Artificial Sequence
  Synthetic oligonucleotide
tctcccgtcaattgtactcgtaccatcttctcacca

SEQ ID NO: 147793 - DNA, 36 bp, Artificial Sequence
  Synthetic oligonucleotide
tgagcacgcccccagtccctctcgttgacatcgcca

SEQ ID NO: 147794 - DNA, 34 bp, Artificial Sequence
  Synthetic oligonucleotide
tcagatacacgctccaccccctggcgtacctcca

SEQ ID NO: 147795 - DNA, 35 bp, Artificial Sequence
  Synthetic oligonucleotide
tgcacccctcattgttttgcctcatcgcctttcca

SEQ ID NO: 147796 - DNA, 36 bp, Artificial Sequence
  Synthetic oligonucleotide
gccccacgcacgacctcatatcctacttgccccgca

SEQ ID NO: 147797 - DNA, 35 bp, Artificial Sequence
  Synthetic oligonucleotide
tccctcagctcggtttccagtcgcctccttcttca

SEQ ID NO: 147798 - DNA, 36 bp, Artificial Sequence
  Synthetic oligonucleotide
tcacaggggtagggggtgggatgattaggggtcaga

SEQ ID NO: 147799 - DNA, 36 bp, Artificial Sequence
  Synthetic oligonucleotide
gtggacccttccccccatcgccccctgccctcgaga

SEQ ID NO: 147800 - DNA, 37 bp, Artificial Sequence
  Synthetic oligonucleotide
tgaccaacgcccccttgactcttttgctgccctccga

SEQ ID NO: 147801 - DNA, 37 bp, Artificial Sequence
  Synthetic oligonucleotide
gtgccgttcctacctgttcattaccgcccgtgcctga

SEQ ID NO: 147802 - DNA, 38 bp, Artificial Sequence
  Synthetic oligonucleotide
gaccacatctggcccgcaataattgcacctctctctga

SEQ ID NO: 147803 - DNA, 38 bp, Artificial Sequence
  Synthetic oligonucleotide
gctcgccgccctccactcctgtacgacgtggcccttga

SEQ ID NO: 147804 - DNA, 35 bp, Artificial Sequence
  Synthetic oligonucleotide
acgcaccggtcacacgctctttcacactgccaata

SEQ ID NO: 147805 - DNA, 34 bp, Artificial Sequence
  Synthetic oligonucleotide
gacgggagggaacggagggggggttaagtaacta

SEQ ID NO: 147806 - DNA, 35 bp, Artificial Sequence
  Synthetic oligonucleotide
agatcccttccgctgtatgttgccgtcagctccac

SEQ ID NO: 147807 - DNA, 35 bp, Artificial Sequence
  Synthetic oligonucleotide
gtccactggacaatatgactcaccttagtactccc

SEQ ID NO: 147808 - DNA, 35 bp, Artificial Sequence
  Synthetic oligonucleotide
tccgtcgctccccatggctttaaagaaccctatcc

SEQ ID NO: 147809 - DNA, 35 bp, Artificial Sequence
  Synthetic oligonucleotide
gtgacaccaggaggctggagggggggggaggaggc

SEQ ID NO: 147810 - DNA, 35 bp, Artificial Sequence
  Synthetic oligonucleotide
gccagaccaattttacaacaacaaccgcctcctgc

SEQ ID NO: 147811 - DNA, 35 bp, Artificial Sequence
  Synthetic oligonucleotide
ttgaacaggcccgcctcgggtgcttccttcccatc

SEQ ID NO: 147812 - DNA, 35 bp, Artificial Sequence
  Synthetic oligonucleotide
tttccatccggagcgaggcccaagccctgcccttc

SEQ ID NO: 147813 - DNA, 35 bp, Artificial Sequence
  Synthetic oligonucleotide
aacccactcccggcgcgccgctcgctactacgttc

SEQ ID NO: 147814 - DNA, 35 bp, Artificial Sequence
  Synthetic oligonucleotide
gccgaggggaaacgagtggggaagtggaataggag

SEQ ID NO: 147815 - DNA, 35 bp, Artificial Sequence
  Synthetic oligonucleotide
cccaacccacggtcccgttcctcgtcaccccctag

SEQ ID NO: 147816 - DNA, 35 bp, Artificial Sequence
  Synthetic oligonucleotide
actcttgccccgttgagccactattgccccgcccg

SEQ ID NO: 147817 - DNA, 34 bp, Artificial Sequence
  Synthetic oligonucleotide
acacgtacagccccccaattccggatcccccgcg

SEQ ID NO: 147818 - DNA, 35 bp, Artificial Sequence
  Synthetic oligonucleotide
ggatagagggcgggggggcttgtagagaattgagg

SEQ ID NO: 147819 - DNA, 35 bp, Artificial Sequence
  Synthetic oligonucleotide
gaacttcagcgcagacgtcccctgcccgtaccctt

SEQ ID NO: 147820 - DNA, 35 bp, Artificial Sequence
  Synthetic oligonucleotide
tgtcaaccgcctccatgtctacgtaatggtccctt

SEQ ID NO: 147821 - DNA, 36 bp, Artificial Sequence
  Synthetic oligonucleotide
atgtgcctcataacttttgccctgtctgtcctagaa

SEQ ID NO: 147822 - DNA, 35 bp, Artificial Sequence
  Synthetic oligonucleotide
gtcctcgcattccgtacgctccatacagccgacca

SEQ ID NO: 147823 - DNA, 36 bp, Artificial Sequence
  Synthetic oligonucleotide
ggtgtgcctgttcctatcgcgcccgttttgtcccca

SEQ ID NO: 147824 - DNA, 35 bp, Artificial Sequence
  Synthetic oligonucleotide
gatccctacctcagaccggtcatgccacggctcca

SEQ ID NO: 147825 - DNA, 35 bp, Artificial Sequence
  Synthetic oligonucleotide
tcaccaactcacatcgtgcactttctttcgtcgca

SEQ ID NO: 147826 - DNA, 35 bp, Artificial Sequence
  Synthetic oligonucleotide
accccgcaccagtggtcgctccccactagatttca

SEQ ID NO: 147827 - DNA, 36 bp, Artificial Sequence
  Synthetic oligonucleotide
atgcgcgtggagggggtgactgaacggggagaaaga

SEQ ID NO: 147828 - DNA, 36 bp, Artificial Sequence
  Synthetic oligonucleotide
actttccccaccgcctccgattggtcttggaccaga

SEQ ID NO: 147829 - DNA, 37 bp, Artificial Sequence
  Synthetic oligonucleotide
acgatgtgggatgggttagggttgggcatagaaggga

SEQ ID NO: 147830 - DNA, 35 bp, Artificial Sequence
  Synthetic oligonucleotide
tgttgcaacctgatccctgtttcccccgctatgga

SEQ ID NO: 147831 - DNA, 36 bp, Artificial Sequence
  Synthetic oligonucleotide
atccgcgcctgcctgcttccccttttttcatttgga

SEQ ID NO: 147832 - DNA, 38 bp, Artificial Sequence
  Synthetic oligonucleotide
acagatggggatcaaaggagggggggataagacaatga

SEQ ID NO: 147833 - DNA, 38 bp, Artificial Sequence
  Synthetic oligonucleotide
tgctcatccgtcctgatcacttgcctctcctgccttga

SEQ ID NO: 147834 - DNA, 36 bp, Artificial Sequence
  Synthetic oligonucleotide
gtccgttctcacatcctcgtccccctacctccggta

SEQ ID NO: 147835 - DNA, 36 bp, Artificial Sequence
  Synthetic oligonucleotide
atgcacccttcgacgcggtccctttagccccctgta

SEQ ID NO: 147836 - DNA, 35 bp, Artificial Sequence
  Synthetic oligonucleotide
gtggtaccagcctgcatactgatctcccttgtaac

SEQ ID NO: 147837 - DNA, 35 bp, Artificial Sequence
  Synthetic oligonucleotide
atgaccaccgctgtatctcacacgatccgtagtac

SEQ ID NO: 147838 - DNA, 35 bp, Artificial Sequence
  Synthetic oligonucleotide
gagaaccgcaccctcgcaccctgaccgtgcctacc

SEQ ID NO: 147839 - DNA, 35 bp, Artificial Sequence
  Synthetic oligonucleotide
tagccggaacgtcgcggttgtcttcggcctttccc

SEQ ID NO: 147840 - DNA, 35 bp, Artificial Sequence
  Synthetic oligonucleotide
aagcttgcaccctgttgcccctctcacgaaccgcc

SEQ ID NO: 147841 - DNA, 35 bp, Artificial Sequence
  Synthetic oligonucleotide
ggacatattcagcgtggtttctagtcctgtcctcc

SEQ ID NO: 147842 - DNA, 35 bp, Artificial Sequence
  Synthetic oligonucleotide
acccccccacccgtacacgactctcgctacgatgc

SEQ ID NO: 147843 - DNA, 35 bp, Artificial Sequence
  Synthetic oligonucleotide
tcctaactccacctggtcgagcctatgtaccctgc

SEQ ID NO: 147844 - DNA, 35 bp, Artificial Sequence
  Synthetic oligonucleotide
gttgcactgcactcctgcccctgtcgtaggcactc

SEQ ID NO: 147845 - DNA, 35 bp, Artificial Sequence
  Synthetic oligonucleotide
atggccctgcgccgatccgcttacctcccggtctc

SEQ ID NO: 147846 - DNA, 35 bp, Artificial Sequence
  Synthetic oligonucleotide
gcccctcagtagtccccgcttacactccttaggtc

SEQ ID NO: 147847 - DNA, 35 bp, Artificial Sequence
  Synthetic oligonucleotide
ggtcacgaggggggggcacttatcgggagggattc

SEQ ID NO: 147848 - DNA, 35 bp, Artificial Sequence
  Synthetic oligonucleotide
ttgtcctcgacgtccaagtctcattggctctcttc

SEQ ID NO: 147849 - DNA, 35 bp, Artificial Sequence
  Synthetic oligonucleotide
tcgccctgccccgcatttctatactgacgccgttc

SEQ ID NO: 147850 - DNA, 35 bp, Artificial Sequence
  Synthetic oligonucleotide
tagagcgggtctacgcatccccatctgcctgtttc

SEQ ID NO: 147851 - DNA, 35 bp, Artificial Sequence
  Synthetic oligonucleotide
aaccgctgcagatcccccgccacccccgcgcatag

SEQ ID NO: 147852 - DNA, 35 bp, Artificial Sequence
  Synthetic oligonucleotide
tccgtcgccgtagtcttatccttgagcccccctag

SEQ ID NO: 147853 - DNA, 35 bp, Artificial Sequence
  Synthetic oligonucleotide
caccctcctccgttcaaccgccgtttccccgcgcg

SEQ ID NO: 147854 - DNA, 35 bp, Artificial Sequence
  Synthetic oligonucleotide
gcacactctcggttggatcttccccgtcacctgcg

SEQ ID NO: 147855 - DNA, 35 bp, Artificial Sequence
  Synthetic oligonucleotide
gaatcgccgatgggcttccctgtctcttcatatcg

SEQ ID NO: 147856 - DNA, 35 bp, Artificial Sequence
  Synthetic oligonucleotide
tcgcgacgacctcgttttctgactacaccctatcg

SEQ ID NO: 147857 - DNA, 36 bp, Artificial Sequence
  Synthetic oligonucleotide
aggacgggccgcccttctgtttactctcatttctcg

SEQ ID NO: 147858 - DNA, 35 bp, Artificial Sequence
  Synthetic oligonucleotide
gaccccatcacctgttttagcacctacttcggagg

SEQ ID NO: 147859 - DNA, 35 bp, Artificial Sequence
  Synthetic oligonucleotide
atgtgacccagccacagcttccacctcccaactgg

SEQ ID NO: 147860 - DNA, 35 bp, Artificial Sequence
  Synthetic oligonucleotide
gaacgcccctcgccgcatctggtcctcatttcctg

SEQ ID NO: 147861 - DNA, 35 bp, Artificial Sequence
  Synthetic oligonucleotide
gtcggtatagtgggggaaaggaacgggggttggtg

SEQ ID NO: 147862 - DNA, 35 bp, Artificial Sequence
  Synthetic oligonucleotide
acattaccatcccctattgtgccgccacctctttg

SEQ ID NO: 147863 - DNA, 35 bp, Artificial Sequence
  Synthetic oligonucleotide
gagagagtcagtggaggaggcgtgtaggggggtat

SEQ ID NO: 147864 - DNA, 35 bp, Artificial Sequence
  Synthetic oligonucleotide
tatgaccgcacgggcgtgaccgacctcctgtacct

SEQ ID NO: 147865 - DNA, 35 bp, Artificial Sequence
  Synthetic oligonucleotide
tgcgcccgcggcctgccctgtcctatctttccagt

SEQ ID NO: 147866 - DNA, 35 bp, Artificial Sequence
  Synthetic oligonucleotide
agcctatcgcagccattctccaacgcgacccgctt

SEQ ID NO: 147867 - DNA, 35 bp, Artificial Sequence
  Synthetic oligonucleotide
tcatcgccaatcggtccctcgcaaatttacctctt

SEQ ID NO: 147868 - DNA, 34 bp, Artificial Sequence
  Synthetic oligonucleotide
agtgactcctccaatcgtattgactccctctaca

SEQ ID NO: 147869 - DNA, 35 bp, Artificial Sequence
  Synthetic oligonucleotide
tgccgactctgctgctgccaccggaaacttctaca

SEQ ID NO: 147870 - DNA, 36 bp, Artificial Sequence
  Synthetic oligonucleotide
gtccagcttccctcatctgtttgcgtagccctccca

SEQ ID NO: 147871 - DNA, 36 bp, Artificial Sequence
  Synthetic oligonucleotide
accgtcaggtcccaatgcactaccttcccctctcca

SEQ ID NO: 147872 - DNA, 36 bp, Artificial Sequence
  Synthetic oligonucleotide
tcatcgacgccaactacccatgtcagactctctcca

SEQ ID NO: 147873 - DNA, 36 bp, Artificial Sequence
  Synthetic oligonucleotide
gtgtgtcgaggagggggggtcgggtcagtcgtagca

SEQ ID NO: 147874 - DNA, 36 bp, Artificial Sequence
  Synthetic oligonucleotide
taaccgctccacctgccccaatcgtaacgccccgca

SEQ ID NO: 147875 - DNA, 35 bp, Artificial Sequence
  Synthetic oligonucleotide
gtctccacccaattgtcgcctttgcacctcgatca

SEQ ID NO: 147876 - DNA, 30 bp, Artificial Sequence
  Synthetic oligonucleotide
tacatcccccctgcctgcccgtatctatca

SEQ ID NO: 147877 - DNA, 36 bp, Artificial Sequence
  Synthetic oligonucleotide
ttggcacgggtagggcggggcggggaatggggaaga

SEQ ID NO: 147878 - DNA, 37 bp, Artificial Sequence
  Synthetic oligonucleotide
accccccgttgcctgaacccgttatccgtcattacga

SEQ ID NO: 147879 - DNA, 37 bp, Artificial Sequence
  Synthetic oligonucleotide
gcctacgaccagctatcttttggccaccatcatccga

SEQ ID NO: 147880 - DNA, 34 bp, Artificial Sequence
  Synthetic oligonucleotide
ttcgcccctttcgccaactacgtatctccccgga

SEQ ID NO: 147881 - DNA, 37 bp, Artificial Sequence
  Synthetic oligonucleotide
gatgctcagctccttctacgccgcctcgtccctcgga

SEQ ID NO: 147882 - DNA, 35 bp, Artificial Sequence
  Synthetic oligonucleotide
tacactaagaaggaggagaggagtgggcaaaggga

SEQ ID NO: 147883 - DNA, 37 bp, Artificial Sequence
  Synthetic oligonucleotide
taaggtggaggaggggttggacggacagcatggtgga

SEQ ID NO: 147884 - DNA, 37 bp, Artificial Sequence
  Synthetic oligonucleotide
actcgcgggaggggggggtattggggaattaattgga

SEQ ID NO: 147885 - DNA, 37 bp, Artificial Sequence
  Synthetic oligonucleotide
attggatgggagggaagtaggaaggtggaacgactga

SEQ ID NO: 147886 - DNA, 37 bp, Artificial Sequence
  Synthetic oligonucleotide
accctcaccaccgccgcgcagtctcccctacttctga

SEQ ID NO: 147887 - DNA, 38 bp, Artificial Sequence
  Synthetic oligonucleotide
gtgcttacccacctgtttccttgccagtttcctcgtga

SEQ ID NO: 147888 - DNA, 37 bp, Artificial Sequence
  Synthetic oligonucleotide
acacccaccgcattttggtctcacctccgattattga

SEQ ID NO: 147889 - DNA, 37 bp, Artificial Sequence
  Synthetic oligonucleotide
atccactcccttccatgccctattgctgccattttga

SEQ ID NO: 147890 - DNA, 36 bp, Artificial Sequence
  Synthetic oligonucleotide
gtgaatagtagaggggtgtgggatgggcggagtata

SEQ ID NO: 147891 - DNA, 36 bp, Artificial Sequence
  Synthetic oligonucleotide
gttggcggcccccccgctgttgcccggtccccttta

SEQ ID NO: 147892 - DNA, 35 bp, Artificial Sequence
  Synthetic oligonucleotide
atctgcgctcctcttcgtccctccgagtcacacac

SEQ ID NO: 147893 - DNA, 35 bp, Artificial Sequence
  Synthetic oligonucleotide
taccaccctccgccgatatcgctgggaaagaccac

SEQ ID NO: 147894 - DNA, 35 bp, Artificial Sequence
  Synthetic oligonucleotide
ggtctcgcttccctgccccgcctccgctctgcgac

SEQ ID NO: 147895 - DNA, 35 bp, Artificial Sequence
  Synthetic oligonucleotide
taaccgaacactctgctgtctctcctgcctaatac

SEQ ID NO: 147896 - DNA, 35 bp, Artificial Sequence
  Synthetic oligonucleotide
tcccacttacggattgctggccgtatcccattacc

SEQ ID NO: 147897 - DNA, 35 bp, Artificial Sequence
  Synthetic oligonucleotide
ggactggtctcagttagtaacccccgtgcctcccc

SEQ ID NO: 147898 - DNA, 35 bp, Artificial Sequence
  Synthetic oligonucleotide
gaccatcccccgaggtaaaatgaccatcacgcgcc

SEQ ID NO: 147899 - DNA, 35 bp, Artificial Sequence
  Synthetic oligonucleotide
gatgcctctcctccggcctcctaaccgtatgctcc

SEQ ID NO: 147900 - DNA, 35 bp, Artificial Sequence
  Synthetic oligonucleotide
aaccgtctggtcttgccttgttacgcgccatctcc

SEQ ID NO: 147901 - DNA, 35 bp, Artificial Sequence
  Synthetic oligonucleotide
gtgaggaatgaagggaataggacaagatacggagc

SEQ ID NO: 147902 - DNA, 35 bp, Artificial Sequence
  Synthetic oligonucleotide
tcccgccgacctccacaccagtattggtcttatgc

SEQ ID NO: 147903 - DNA, 35 bp, Artificial Sequence
  Synthetic oligonucleotide
ttccactgcctcgcaaaacgttcgccccatgctgc

SEQ ID NO: 147904 - DNA, 35 bp, Artificial Sequence
  Synthetic oligonucleotide
ggtgtcccccctccaaatccgtgttatcgtgcctc

SEQ ID NO: 147905 - DNA, 35 bp, Artificial Sequence
  Synthetic oligonucleotide
gagagaagccagtgccaccgtcccgcccgtcgctc

SEQ ID NO: 147906 - DNA, 35 bp, Artificial Sequence
  Synthetic oligonucleotide
gttccccagccatcagtccgtacgctcttggtctc

SEQ ID NO: 147907 - DNA, 35 bp, Artificial Sequence
  Synthetic oligonucleotide
tgaccccgcaagctgcctccgacacgctctcgttc

SEQ ID NO: 147908 - DNA, 35 bp, Artificial Sequence
  Synthetic oligonucleotide
gtgatgacctctttgtaaactcgaccctgtatttc

SEQ ID NO: 147909 - DNA, 35 bp, Artificial Sequence
  Synthetic oligonucleotide
gcgatcatccccgttgcgaagcgccccccctctag

SEQ ID NO: 147910 - DNA, 35 bp, Artificial Sequence
  Synthetic oligonucleotide
accaacttccctcagccgagccgcccgctacagcg

SEQ ID NO: 147911 - DNA, 35 bp, Artificial Sequence
  Synthetic oligonucleotide
acgaactggtgggaagggctcgcgtgggaaagggg

SEQ ID NO: 147912 - DNA, 35 bp, Artificial Sequence
  Synthetic oligonucleotide
gcgatgttgcgcgcaaatgcttctctcctccgtgg

SEQ ID NO: 147913 - DNA, 35 bp, Artificial Sequence
  Synthetic oligonucleotide
ctactgagggggggggaagagagaggagagggtgg

SEQ ID NO: 147914 - DNA, 35 bp, Artificial Sequence
  Synthetic oligonucleotide
gtgaacgcctcacttcgaccctcacctccatttgg

SEQ ID NO: 147915 - DNA, 34 bp, Artificial Sequence
  Synthetic oligonucleotide
tccccccttccgcgacctccgatttacagtcact

SEQ ID NO: 147916 - DNA, 35 bp, Artificial Sequence
  Synthetic oligonucleotide
gtcctccctcctgtttatcccgggctggcattact

SEQ ID NO: 147917 - DNA, 35 bp, Artificial Sequence
  Synthetic oligonucleotide
gtgggagggcttgaaagaatcgggacgggtaacct

SEQ ID NO: 147918 - DNA, 35 bp, Artificial Sequence
  Synthetic oligonucleotide
taccgacacacgtcacttctgtaccccctccacct

SEQ ID NO: 147919 - DNA, 35 bp, Artificial Sequence
  Synthetic oligonucleotide
gcaatgcggtagcgattgccagtttccatctccct

SEQ ID NO: 147920 - DNA, 35 bp, Artificial Sequence
  Synthetic oligonucleotide
accccctccgcctgcccgtccgcaccctatgtgct

SEQ ID NO: 147921 - DNA, 35 bp, Artificial Sequence
  Synthetic oligonucleotide
gctgttgcgtttcatgtcactttccgctattctct

SEQ ID NO: 147922 - DNA, 35 bp, Artificial Sequence
  Synthetic oligonucleotide
gacccagttcccgttgccgcagttcccttccactt

SEQ ID NO: 147923 - DNA, 35 bp, Artificial Sequence
  Synthetic oligonucleotide
tgtccaccaaccctcctacctgtcgttaggctttt

SEQ ID NO: 147924 - DNA, 35 bp, Artificial Sequence
  Synthetic oligonucleotide
ggtaacggggaatcgggaacacggggcatagtgaa

SEQ ID NO: 147925 - DNA, 35 bp, Artificial Sequence
  Synthetic oligonucleotide
tcacatgccgctatctatcctgcctgcgttactaa

SEQ ID NO: 147926 - DNA, 35 bp, Artificial Sequence
  Synthetic oligonucleotide
gtcgtagccccggcctctttcacccccctgtgaca

SEQ ID NO: 147927 - DNA, 35 bp, Artificial Sequence
  Synthetic oligonucleotide
gcaccatccaaagcgttcactcatctagctaccca

SEQ ID NO: 147928 - DNA, 36 bp, Artificial Sequence
  Synthetic oligonucleotide
tgattcgcccttcagccttatatatccgcccgccca

SEQ ID NO: 147929 - DNA, 35 bp, Artificial Sequence
  Synthetic oligonucleotide
tccccccgccctctctctatagtgtgtcatgccca

SEQ ID NO: 147930 - DNA, 36 bp, Artificial Sequence
  Synthetic oligonucleotide
ttcgcgacactagtctttgccccattgctgccgcca

SEQ ID NO: 147931 - DNA, 36 bp, Artificial Sequence
  Synthetic oligonucleotide
acaacattgccaccgcggtatcagcccgcactatca

SEQ ID NO: 147932 - DNA, 36 bp, Artificial Sequence
  Synthetic oligonucleotide
gaagggtagagggggattacggatgggggtgtatca

SEQ ID NO: 147933 - DNA, 36 bp, Artificial Sequence
  Synthetic oligonucleotide
gcacatccttccgacgtcaaaacccgttatctttca

SEQ ID NO: 147934 - DNA, 37 bp, Artificial Sequence
  Synthetic oligonucleotide
agaacgcaggaaagggggggcggtagctcaaggaaga

SEQ ID NO: 147935 - DNA, 37 bp, Artificial Sequence
  Synthetic oligonucleotide
tcccttccccccgcgctaccctagagacgtgctccga

SEQ ID NO: 147936 - DNA, 37 bp, Artificial Sequence
  Synthetic oligonucleotide
gagactaagggaggggaagggggagctcggaccagga

SEQ ID NO: 147937 - DNA, 37 bp, Artificial Sequence
  Synthetic oligonucleotide
tgtgcaagtctagcagaagggagggtgggacaaggga

SEQ ID NO: 147938 - DNA, 35 bp, Artificial Sequence
  Synthetic oligonucleotide
aatgccccgccccaccttttcttctttcacaggga

SEQ ID NO: 147939 - DNA, 37 bp, Artificial Sequence
  Synthetic oligonucleotide
aaacggaggtgacggaggaggaagatgagttcgggga

SEQ ID NO: 147940 - DNA, 37 bp, Artificial Sequence
  Synthetic oligonucleotide
gccagtagtaagcagggaaggtggattggggaatgga

SEQ ID NO: 147941 - DNA, 37 bp, Artificial Sequence
  Synthetic oligonucleotide
gccactcctcccattcccttattacagaccctctgga

SEQ ID NO: 147942 - DNA, 38 bp, Artificial Sequence
  Synthetic oligonucleotide
gagggggtgtgggacggggatgatgaccgaatggatga

SEQ ID NO: 147943 - DNA, 38 bp, Artificial Sequence
  Synthetic oligonucleotide
tccactggtgcacatgttttttgggccctcttccctga

SEQ ID NO: 147944 - DNA, 38 bp, Artificial Sequence
  Synthetic oligonucleotide
gctaagcaaagggaggttaggagggtaggggtaggtga

SEQ ID NO: 147945 - DNA, 38 bp, Artificial Sequence
  Synthetic oligonucleotide
ttgtgcggagatgatggggctggggggccggggggtga

SEQ ID NO: 147946 - DNA, 36 bp, Artificial Sequence
  Synthetic oligonucleotide
tgcacttcgcggtttgccttctctgcctgccccata

SEQ ID NO: 147947 - DNA, 36 bp, Artificial Sequence
  Synthetic oligonucleotide
tcacgggcgtttcgatcttcacactgttcccgccta

SEQ ID NO: 147948 - DNA, 36 bp, Artificial Sequence
  Synthetic oligonucleotide
tccgcccacaacggttttggtctgtcacacactcta

SEQ ID NO: 147949 - DNA, 35 bp, Artificial Sequence
  Synthetic oligonucleotide
gaccttcgcagtcatcatctcttgctgcattccac

SEQ ID NO: 147950 - DNA, 35 bp, Artificial Sequence
  Synthetic oligonucleotide
gatgcccgttccaatccgattagcgttgttttacc

SEQ ID NO: 147951 - DNA, 35 bp, Artificial Sequence
  Synthetic oligonucleotide
ggtcaagccccctcccgaggctgtccccacgaccc

SEQ ID NO: 147952 - DNA, 35 bp, Artificial Sequence
  Synthetic oligonucleotide
agagcggaccgcccgtatctccatcagtatttccc

SEQ ID NO: 147953 - DNA, 35 bp, Artificial Sequence
  Synthetic oligonucleotide
tgtctgtcccaaattgcctagtatcgctacccgcc

SEQ ID NO: 147954 - DNA, 35 bp, Artificial Sequence
  Synthetic oligonucleotide
acacctccgtccttatgcgatatgccctatgcgcc

SEQ ID NO: 147955 - DNA, 35 bp, Artificial Sequence
  Synthetic oligonucleotide
gtcgatcgctggtggctttcgcgaccccccctgcc

SEQ ID NO: 147956 - DNA, 35 bp, Artificial Sequence
  Synthetic oligonucleotide
tctgtcgtccatgtcacgtgaagcgctgtccctcc

SEQ ID NO: 147957 - DNA, 35 bp, Artificial Sequence
  Synthetic oligonucleotide
gcaagtggtcggctccgaattcgcatcctcctcgc

SEQ ID NO: 147958 - DNA, 35 bp, Artificial Sequence
  Synthetic oligonucleotide
tgaccgctccgcattccgtctttctgccagaactc

SEQ ID NO: 147959 - DNA, 35 bp, Artificial Sequence
  Synthetic oligonucleotide
tactgcccacacagctgctgctttcctactcgctc

SEQ ID NO: 147960 - DNA, 35 bp, Artificial Sequence
  Synthetic oligonucleotide
gcgacctcaggtttccgtactccccggttttggtc

SEQ ID NO: 147961 - DNA, 35 bp, Artificial Sequence
  Synthetic oligonucleotide
acaccatagttgcgattcctcacccaccgatcctg

SEQ ID NO: 147962 - DNA, 35 bp, Artificial Sequence
  Synthetic oligonucleotide
gggaccagggccatggcgtctcccctccttttcat

SEQ ID NO: 147963 - DNA, 35 bp, Artificial Sequence
  Synthetic oligonucleotide
gtacaccatcatcacccacgagcttcttcgtacct

SEQ ID NO: 147964 - DNA, 35 bp, Artificial Sequence
  Synthetic oligonucleotide
tgacggcctcacgtgacgtaactgcgctccatcct

SEQ ID NO: 147965 - DNA, 35 bp, Artificial Sequence
  Synthetic oligonucleotide
acccgctcattctgcctatgttacatctaagtcct

SEQ ID NO: 147966 - DNA, 35 bp, Artificial Sequence
  Synthetic oligonucleotide
ccatcaccccggacgcacgtttcttagccttcctt

SEQ ID NO: 147967 - DNA, 36 bp, Artificial Sequence
  Synthetic oligonucleotide
tacctgccgggggggggtaaaatgctggtgagggaa

SEQ ID NO: 147968 - DNA, 34 bp, Artificial Sequence
  Synthetic oligonucleotide
gcgtgagaactacaggggagggagagtaggggaa

SEQ ID NO: 147969 - DNA, 36 bp, Artificial Sequence
  Synthetic oligonucleotide
tgagcaccgactgtcttcaatcctgcggtcccctca

SEQ ID NO: 147970 - DNA, 35 bp, Artificial Sequence
  Synthetic oligonucleotide
acaaagcaggggagcggggagtagagattgcgtca

SEQ ID NO: 147971 - DNA, 36 bp, Artificial Sequence
  Synthetic oligonucleotide
ggtgctacaccgggtgggttgggagggccaagacga

SEQ ID NO: 147972 - DNA, 36 bp, Artificial Sequence
  Synthetic oligonucleotide
gggaagcaaagggggggaaaagggccgagcgtacga

SEQ ID NO: 147973 - DNA, 37 bp, Artificial Sequence
  Synthetic oligonucleotide
atccaacctctcatgattatatcagctctccacccga

SEQ ID NO: 147974 - DNA, 37 bp, Artificial Sequence
  Synthetic oligonucleotide
gacgagggaggtgagggcaaaaggagacggtatccga

SEQ ID NO: 147975 - DNA, 37 bp, Artificial Sequence
  Synthetic oligonucleotide
ggatcacgtagtttgtccaccatcatcctccctccga

SEQ ID NO: 147976 - DNA, 36 bp, Artificial Sequence
  Synthetic oligonucleotide
ttggcacgcagtgctatcgccccaactactctccga

SEQ ID NO: 147977 - DNA, 37 bp, Artificial Sequence
  Synthetic oligonucleotide
accgcacccgaccttatatccgccctggttctctcga

SEQ ID NO: 147978 - DNA, 37 bp, Artificial Sequence
  Synthetic oligonucleotide
ttgggcgctaggggagcaggggggaagttgtgtggga

SEQ ID NO: 147979 - DNA, 38 bp, Artificial Sequence
  Synthetic oligonucleotide
aagaacaggaggggtcgcggggaacgggggacagatga

SEQ ID NO: 147980 - DNA, 36 bp, Artificial Sequence
  Synthetic oligonucleotide
ccataccccctgctgacttgcctttagaccctctga

SEQ ID NO: 147981 - DNA, 37 bp, Artificial Sequence
  Synthetic oligonucleotide
tcctacaccgtcacctgctcccacatctagtcagtga

SEQ ID NO: 147982 - DNA, 38 bp, Artificial Sequence
  Synthetic oligonucleotide
gaccctcgtccaccccgcccatgtaccaccgccggtga

SEQ ID NO: 147983 - DNA, 38 bp, Artificial Sequence
  Synthetic oligonucleotide
aacgccactcccttgtctatattatatcgcctcgttga

SEQ ID NO: 147984 - DNA, 36 bp, Artificial Sequence
  Synthetic oligonucleotide
actctcgcccgcaggatcgcatattctgcctcctta

SEQ ID NO: 147985 - DNA, 36 bp, Artificial Sequence
  Synthetic oligonucleotide
gcgctggctcagcgttgtctcctcttcgttccgtta

SEQ ID NO: 147986 - DNA, 34 bp, Artificial Sequence
  Synthetic oligonucleotide
ttacgtaacaacgcccagtgccccgtaccactac

SEQ ID NO: 147987 - DNA, 35 bp, Artificial Sequence
  Synthetic oligonucleotide
aaccagtgcatgaccgtacaccatctccgttttac

SEQ ID NO: 147988 - DNA, 35 bp, Artificial Sequence
  Synthetic oligonucleotide
gacattccccctgtgaggccagcacaccccccccc

SEQ ID NO: 147989 - DNA, 35 bp, Artificial Sequence
  Synthetic oligonucleotide
gtatacatcactgtgcccgctgcattgcacctccc

SEQ ID NO: 147990 - DNA, 35 bp, Artificial Sequence
  Synthetic oligonucleotide
tgacctaacttgcgacctgcattatcgcccttccc

SEQ ID NO: 147991 - DNA, 35 bp, Artificial Sequence
  Synthetic oligonucleotide
tgcatgtacgcacattctgaacccgaggcctttcc

SEQ ID NO: 147992 - DNA, 35 bp, Artificial Sequence
  Synthetic oligonucleotide
atgccccccttcgccctatgcgccgctaatggcgc

SEQ ID NO: 147993 - DNA, 35 bp, Artificial Sequence
  Synthetic oligonucleotide
tgcacccccccgtagactagtgccctgttcctcgc

SEQ ID NO: 147994 - DNA, 35 bp, Artificial Sequence
  Synthetic oligonucleotide
gaccgtcacaaataatgcccctgcaccacttcggc

SEQ ID NO: 147995 - DNA, 33 bp, Artificial Sequence
  Synthetic oligonucleotide
tgaccccccccccatatgtattccaccagctgc

SEQ ID NO: 147996 - DNA, 35 bp, Artificial Sequence
  Synthetic oligonucleotide
gccggcccgtccctttcccccgttcgttctgctgc

SEQ ID NO: 147997 - DNA, 35 bp, Artificial Sequence
  Synthetic oligonucleotide
atggtgccgtagcccgtttctccagttcatattgc

SEQ ID NO: 147998 - DNA, 35 bp, Artificial Sequence
  Synthetic oligonucleotide
ttcaccccggtctcttagcatggttctgccttctc

SEQ ID NO: 147999 - DNA, 35 bp, Artificial Sequence
  Synthetic oligonucleotide
acgcaaccgccccaagcttccgttttagttcgttc

SEQ ID NO: 148000 - DNA, 35 bp, Artificial Sequence
  Synthetic oligonucleotide
ttggaggggagggtgcttgggaaggatggcccggg

SEQ ID NO: 148001 - DNA, 35 bp, Artificial Sequence
  Synthetic oligonucleotide
gagcctgcacggactcgtcccccccttatccatgg

SEQ ID NO: 148002 - DNA, 35 bp, Artificial Sequence
  Synthetic oligonucleotide
ttgtccaccgcacgagacgcaatctacaccacctg

SEQ ID NO: 148003 - DNA, 35 bp, Artificial Sequence
  Synthetic oligonucleotide
agtccaaccctttgccacgagcccgcgccctcact

SEQ ID NO: 148004 - DNA, 35 bp, Artificial Sequence
  Synthetic oligonucleotide
atcgccacagccatttttgagagttctccctgcct

SEQ ID NO: 148005 - DNA, 35 bp, Artificial Sequence
  Synthetic oligonucleotide
acatcccgcacatcgccctaagaccattgtcctct

SEQ ID NO: 148006 - DNA, 35 bp, Artificial Sequence
  Synthetic oligonucleotide
gccctcccccgtgtagcagcgcagttcctctctct

SEQ ID NO: 148007 - DNA, 35 bp, Artificial Sequence
  Synthetic oligonucleotide
gtcatcctcagccccgcaagtttccccccgatggt

SEQ ID NO: 148008 - DNA, 35 bp, Artificial Sequence
  Synthetic oligonucleotide
gttcagggatcacctgttcttcacgttcctccttt

SEQ ID NO: 148009 - DNA, 35 bp, Artificial Sequence
  Synthetic oligonucleotide
tccgtatacgccctctgagtccatccaacttgttt

SEQ ID NO: 148010 - DNA, 36 bp, Artificial Sequence
  Synthetic oligonucleotide
ggtggggggggagcgggttaagacgggagaagataa

SEQ ID NO: 148011 - DNA, 36 bp, Artificial Sequence
  Synthetic oligonucleotide
gcccacccccgagccttgtctcccctgctttgttaa

SEQ ID NO: 148012 - DNA, 36 bp, Artificial Sequence
  Synthetic oligonucleotide
tgaaccagcatcccgtccctcccacaagcgtctcca

SEQ ID NO: 148013 - DNA, 36 bp, Artificial Sequence
  Synthetic oligonucleotide
gagattgcgctttgttacctgtccctccccgtcgca

SEQ ID NO: 148014 - DNA, 36 bp, Artificial Sequence
  Synthetic oligonucleotide
tcgagagcccacccattctatcacgaccgccgttca

SEQ ID NO: 148015 - DNA, 35 bp, Artificial Sequence
  Synthetic oligonucleotide
gccattctcacttggtggttatcccttgcttttca

SEQ ID NO: 148016 - DNA, 36 bp, Artificial Sequence
  Synthetic oligonucleotide
gcattacccgctccatcaattacggcctggttttca

SEQ ID NO: 148017 - DNA, 37 bp, Artificial Sequence
  Synthetic oligonucleotide
gttgaggggcgggtgggtttcgggtagacgtcccaga

SEQ ID NO: 148018 - DNA, 37 bp, Artificial Sequence
  Synthetic oligonucleotide
gcgttctcccgccagaccccctgcctgtacctttaga

SEQ ID NO: 148019 - DNA, 37 bp, Artificial Sequence
  Synthetic oligonucleotide
gtgaccacgtgacgttattcctcttccatccttgcga

SEQ ID NO: 148020 - DNA, 37 bp, Artificial Sequence
  Synthetic oligonucleotide
gtaagagggcgggagggatcacagagccaagggagga

SEQ ID NO: 148021 - DNA, 36 bp, Artificial Sequence
  Synthetic oligonucleotide
gtgcaataaggagggggggggtggtacctgggagga

SEQ ID NO: 148022 - DNA, 37 bp, Artificial Sequence
  Synthetic oligonucleotide
tccggtccatgcagccgccatccctgctcttcactga

SEQ ID NO: 148023 - DNA, 38 bp, Artificial Sequence
  Synthetic oligonucleotide
atgcccggcacattcccttcttgtgagcctatccctga

SEQ ID NO: 148024 - DNA, 38 bp, Artificial Sequence
  Synthetic oligonucleotide
tctccatctcgctgacccacctagtgtcctgtctctga

SEQ ID NO: 148025 - DNA, 37 bp, Artificial Sequence
  Synthetic oligonucleotide
atcgcgggcgggtagggtacttatgggactcgagtga

SEQ ID NO: 148026 - DNA, 38 bp, Artificial Sequence
  Synthetic oligonucleotide
gcaaccgaccgggtgggcgtgggagacgtgtggggtga

SEQ ID NO: 148027 - DNA, 38 bp, Artificial Sequence
  Synthetic oligonucleotide
gaccacccatccgctgttgctcaagctttactggttga

SEQ ID NO: 148028 - DNA, 36 bp, Artificial Sequence
  Synthetic oligonucleotide
atgcaccatcgcccgatctttgttccatcaagcata

SEQ ID NO: 148029 - DNA, 36 bp, Artificial Sequence
  Synthetic oligonucleotide
acagggcgggcgtggggcggggttatggctgggtta

SEQ ID NO: 148030 - DNA, 35 bp, Artificial Sequence
  Synthetic oligonucleotide
gcgcaaacgcatgcacggcctttcggacctaccac

SEQ ID NO: 148031 - DNA, 35 bp, Artificial Sequence
  Synthetic oligonucleotide
gtacgcgcccccgaaattgaacgccatgccttccc

SEQ ID NO: 148032 - DNA, 35 bp, Artificial Sequence
  Synthetic oligonucleotide
acgcgaagcgcttatgtcactcgcccgtagcctgc

SEQ ID NO: 148033 - DNA, 33 bp, Artificial Sequence
  Synthetic oligonucleotide
acaccgctctgtaactgcgtcttaacttctatc

SEQ ID NO: 148034 - DNA, 35 bp, Artificial Sequence
  Synthetic oligonucleotide
atgctcctcaccacccactttccatatgacacttc

SEQ ID NO: 148035 - DNA, 35 bp, Artificial Sequence
  Synthetic oligonucleotide
acccccccgcctcccagcctaagagctactagttc

SEQ ID NO: 148036 - DNA, 35 bp, Artificial Sequence
  Synthetic oligonucleotide
tccacacgatgtaagcaccgcccccgccacgaccg

SEQ ID NO: 148037 - DNA, 35 bp, Artificial Sequence
  Synthetic oligonucleotide
gtactctcctgcctacgttatgtatctactctccg

SEQ ID NO: 148038 - DNA, 35 bp, Artificial Sequence
  Synthetic oligonucleotide
gtcgtcgcttcattccctgcttaccctacaccttg

SEQ ID NO: 148039 - DNA, 35 bp, Artificial Sequence
  Synthetic oligonucleotide
acgtccctgtccttgcttaccgctctgcatcacct

SEQ ID NO: 148040 - DNA, 35 bp, Artificial Sequence
  Synthetic oligonucleotide
gtgcgtgtcacacccgcgttccctgcctgtttcct

SEQ ID NO: 148041 - DNA, 35 bp, Artificial Sequence
  Synthetic oligonucleotide
actgacccctagcctgtctaccctgccgtgcctgt

SEQ ID NO: 148042 - DNA, 35 bp, Artificial Sequence
  Synthetic oligonucleotide
tactcgccgctcctcttgcgtcagggccctctgtt

SEQ ID NO: 148043 - DNA, 35 bp, Artificial Sequence
  Synthetic oligonucleotide
accgcccggttcgccctgtcttactcgcaaatttt

SEQ ID NO: 148044 - DNA, 36 bp, Artificial Sequence
  Synthetic oligonucleotide
aacaccaccccaatcgtacctgccttgagcctgaaa

SEQ ID NO: 148045 - DNA, 35 bp, Artificial Sequence
  Synthetic oligonucleotide
accgtacgcctccgccgggttccgcctagacccca

SEQ ID NO: 148046 - DNA, 36 bp, Artificial Sequence
  Synthetic oligonucleotide
tgccatggccatctgttgttcattaatcctcgccca

SEQ ID NO: 148047 - DNA, 36 bp, Artificial Sequence
  Synthetic oligonucleotide
gccttaccgccctaactctggattatgatttgccca

SEQ ID NO: 148048 - DNA, 36 bp, Artificial Sequence
  Synthetic oligonucleotide
tgcttacgtccatcgttacccttcctttgaccgcca

SEQ ID NO: 148049 - DNA, 35 bp, Artificial Sequence
  Synthetic oligonucleotide
tatcccgtcggtccctctttggtttagctcttcca

SEQ ID NO: 148050 - DNA, 35 bp, Artificial Sequence
  Synthetic oligonucleotide
atcgcccgtgctcttctatcccgccgcttctagca

SEQ ID NO: 148051 - DNA, 35 bp, Artificial Sequence
  Synthetic oligonucleotide
tcagcacccgccccagtcgtcccttatccttatca

SEQ ID NO: 148052 - DNA, 35 bp, Artificial Sequence
  Synthetic oligonucleotide
gttgggaggggggcgttttggggcacgggaggtca

SEQ ID NO: 148053 - DNA, 36 bp, Artificial Sequence
  Synthetic oligonucleotide
gatccacctcggaatggtacctcgttggtttcttca

SEQ ID NO: 148054 - DNA, 37 bp, Artificial Sequence
  Synthetic oligonucleotide
gacatgtccaccactccctcgtaccgttcgtcccaga

SEQ ID NO: 148055 - DNA, 36 bp, Artificial Sequence
  Synthetic oligonucleotide
tccacccgacccatatatcgaagagttcacctacga

SEQ ID NO: 148056 - DNA, 35 bp, Artificial Sequence
  Synthetic oligonucleotide
agcccgcactgcttagtttctatccctcaccccga

SEQ ID NO: 148057 - DNA, 37 bp, Artificial Sequence
  Synthetic oligonucleotide
accctatgcctccccatgttggtgattcgccccccga

SEQ ID NO: 148058 - DNA, 37 bp, Artificial Sequence
  Synthetic oligonucleotide
gtacatgtcccatccgtacttaagttatcttgctcga

SEQ ID NO: 148059 - DNA, 36 bp, Artificial Sequence
  Synthetic oligonucleotide
tatgttcgaacgtggagggggggcgaggaggccgga

SEQ ID NO: 148060 - DNA, 37 bp, Artificial Sequence
  Synthetic oligonucleotide
ggacgattgggagggtgggactaggggaccaggggga

SEQ ID NO: 148061 - DNA, 37 bp, Artificial Sequence
  Synthetic oligonucleotide
ttgtagtgcggggttagggagggtgagaggggatgga

SEQ ID NO: 148062 - DNA, 37 bp, Artificial Sequence
  Synthetic oligonucleotide
ataaccgggatggggaagggagggcgtattcactgga

SEQ ID NO: 148063 - DNA, 37 bp, Artificial Sequence
  Synthetic oligonucleotide
ttccgcaccactcgtcagtccttagcgcgccccatga

SEQ ID NO: 148064 - DNA, 37 bp, Artificial Sequence
  Synthetic oligonucleotide
tgtcaacgcggaattgtaccggcccatcctcacctga

SEQ ID NO: 148065 - DNA, 38 bp, Artificial Sequence
  Synthetic oligonucleotide
ttccgcctgacgccacactttgttaccgcttgtcctga

SEQ ID NO: 148066 - DNA, 38 bp, Artificial Sequence
  Synthetic oligonucleotide
gatgtgtgcaaggggggagcaataaggacgagtggtga

SEQ ID NO: 148067 - DNA, 38 bp, Artificial Sequence
  Synthetic oligonucleotide
atcgacagacgggggagcgggagggctgagatggttga

SEQ ID NO: 148068 - DNA, 38 bp, Artificial Sequence
  Synthetic oligonucleotide
ggatgcgcctcctgctaactacgccccccgccctttga

SEQ ID NO: 148069 - DNA, 36 bp, Artificial Sequence
  Synthetic oligonucleotide
tcaacagtctccacgctgtgcaccttacctcgccta

SEQ ID NO: 148070 - DNA, 36 bp, Artificial Sequence
  Synthetic oligonucleotide
gcacagctaggtcagccccgcctcactcccattgta

SEQ ID NO: 148071 - DNA, 33 bp, Artificial Sequence
  Synthetic oligonucleotide
tctccctccgtactacgttgaatacttcgctta

SEQ ID NO: 148072 - DNA, 35 bp, Artificial Sequence
  Synthetic oligonucleotide
atgtccacatactgaagtctttattcggcctccac

SEQ ID NO: 148073 - DNA, 35 bp, Artificial Sequence
  Synthetic oligonucleotide
ggtgacgcgcgcacagccccccatttagttgcacc

SEQ ID NO: 148074 - DNA, 35 bp, Artificial Sequence
  Synthetic oligonucleotide
tcacctacgatcctgctagacacaccttgtgctcc

SEQ ID NO: 148075 - DNA, 35 bp, Artificial Sequence
  Synthetic oligonucleotide
atgacgccctgctttacacccaactggggttttcc

SEQ ID NO: 148076 - DNA, 35 bp, Artificial Sequence
  Synthetic oligonucleotide
tgctgtctagatgtgttcccccccccgcccaatgc

SEQ ID NO: 148077 - DNA, 35 bp, Artificial Sequence
  Synthetic oligonucleotide
actcccagacaacagcgtgttacttgcaccccgtc

SEQ ID NO: 148078 - DNA, 35 bp, Artificial Sequence
  Synthetic oligonucleotide
gcatccccgccacctgtcttttctccgtttctacg

SEQ ID NO: 148079 - DNA, 35 bp, Artificial Sequence
  Synthetic oligonucleotide
acgagcctgacccatttgccttcatatcccttgcg

SEQ ID NO: 148080 - DNA, 35 bp, Artificial Sequence
  Synthetic oligonucleotide
agccgtggcggttgtccatcttcctcgtcccctgg

SEQ ID NO: 148081 - DNA, 35 bp, Artificial Sequence
  Synthetic oligonucleotide
tcagtctgcagctcgccccatattccaccacttgg

SEQ ID NO: 148082 - DNA, 35 bp, Artificial Sequence
  Synthetic oligonucleotide
tgtgcctccgagcccccccatgatttatggtcctg

SEQ ID NO: 148083 - DNA, 35 bp, Artificial Sequence
  Synthetic oligonucleotide
gcgcaaagaaagggaggacggagggttagtcggtg

SEQ ID NO: 148084 - DNA, 35 bp, Artificial Sequence
  Synthetic oligonucleotide
atgcctgcccgtgtgcttccgtttccgctcatgtg

SEQ ID NO: 148085 - DNA, 33 bp, Artificial Sequence
  Synthetic oligonucleotide
gactcgccgatctgtacaccccttacccttaat

SEQ ID NO: 148086 - DNA, 35 bp, Artificial Sequence
  Synthetic oligonucleotide
tcatcggagagtctataccttttctcctgtaccat

SEQ ID NO: 148087 - DNA, 35 bp, Artificial Sequence
  Synthetic oligonucleotide
tactcgtgcagtccgcacccgatcagtatcgccct

SEQ ID NO: 148088 - DNA, 35 bp, Artificial Sequence
  Synthetic oligonucleotide
tcaacaatccagaatttgccgccgagctacctcct

SEQ ID NO: 148089 - DNA, 36 bp, Artificial Sequence
  Synthetic oligonucleotide
acgcgccacttttctgattcccgacccctgttgcca

SEQ ID NO: 148090 - DNA, 35 bp, Artificial Sequence
  Synthetic oligonucleotide
aacccctgtcgcctcccgtcccaatatgtcaggca

SEQ ID NO: 148091 - DNA, 36 bp, Artificial Sequence
  Synthetic oligonucleotide
tctcctacctcaccccggtatatctacgcccctgca

SEQ ID NO: 148092 - DNA, 35 bp, Artificial Sequence
  Synthetic oligonucleotide
ttcgtccccagtactctgcctgtttgtttgttgca

SEQ ID NO: 148093 - DNA, 36 bp, Artificial Sequence
  Synthetic oligonucleotide
ttcaccccgcgcctcttctatcctgtttttggttca

SEQ ID NO: 148094 - DNA, 37 bp, Artificial Sequence
  Synthetic oligonucleotide
ttgtccacctccgtcccgcttatcccacatgccgaga

SEQ ID NO: 148095 - DNA, 37 bp, Artificial Sequence
  Synthetic oligonucleotide
tgccatctacatctcagcccaggccgtctttacccga

SEQ ID NO: 148096 - DNA, 38 bp, Artificial Sequence
  Synthetic oligonucleotide
ttggctggtcggcctctgtttcttccctccactcatga

SEQ ID NO: 148097 - DNA, 37 bp, Artificial Sequence
  Synthetic oligonucleotide
tacacgcttagcttgcccaatctgcccgtccctctga

SEQ ID NO: 148098 - DNA, 37 bp, Artificial Sequence
  Synthetic oligonucleotide
gctaggagaggaagggaacggggaatgtcattcgtga

SEQ ID NO: 148099 - DNA, 35 bp, Artificial Sequence
  Synthetic oligonucleotide
gacaaaaagtagggggggtggaagaagctatgata

SEQ ID NO: 148100 - DNA, 35 bp, Artificial Sequence
  Synthetic oligonucleotide
gttcgacaccctttatgctttacccttgccagtta

SEQ ID NO: 148101 - DNA, 35 bp, Artificial Sequence
  Synthetic oligonucleotide
tgccaccgcccggtactgtcctgctctttcacaac

SEQ ID NO: 148102 - DNA, 35 bp, Artificial Sequence
  Synthetic oligonucleotide
tgacccccgcccctgggcttatacctcattccacc

SEQ ID NO: 148103 - DNA, 35 bp, Artificial Sequence
  Synthetic oligonucleotide
accctgggccccccgctgttacgcgcccctggacc

SEQ ID NO: 148104 - DNA, 35 bp, Artificial Sequence
  Synthetic oligonucleotide
tccgccgaacccccacactcgttgaaacgatgacc

SEQ ID NO: 148105 - DNA, 35 bp, Artificial Sequence
  Synthetic oligonucleotide
ttcgctccctcttgaatatatacagccctggaccc

SEQ ID NO: 148106 - DNA, 35 bp, Artificial Sequence
  Synthetic oligonucleotide
tcatcctccggcaaggaatctcgccacacctcccc

SEQ ID NO: 148107 - DNA, 35 bp, Artificial Sequence
  Synthetic oligonucleotide
tccccccgttgcctgaataaacacgcctgctggcc

SEQ ID NO: 148108 - DNA, 35 bp, Artificial Sequence
  Synthetic oligonucleotide
tgggaggtgcacctcttgctctccgtttccgttcc

SEQ ID NO: 148109 - DNA, 35 bp, Artificial Sequence
  Synthetic oligonucleotide
acccgacccaacaaagcattaacgtgccactccgc

SEQ ID NO: 148110 - DNA, 35 bp, Artificial Sequence
  Synthetic oligonucleotide
ttcgctccgccgcccatgcgattgcgctcctccgc

SEQ ID NO: 148111 - DNA, 35 bp, Artificial Sequence
  Synthetic oligonucleotide
atccccgcctttccgtttcttgtcaccatacgcgc

SEQ ID NO: 148112 - DNA, 34 bp, Artificial Sequence
  Synthetic oligonucleotide
tctgggcacgtttccgcctttttgcccccccatc

SEQ ID NO: 148113 - DNA, 35 bp, Artificial Sequence
  Synthetic oligonucleotide
gatcgcggctcacgatccgaccgtgcctttctatc

SEQ ID NO: 148114 - DNA, 35 bp, Artificial Sequence
  Synthetic oligonucleotide
tcacggttcagcaccattctctatactccgccctc

SEQ ID NO: 148115 - DNA, 35 bp, Artificial Sequence
  Synthetic oligonucleotide
tcctctgtcggtccgccactctatatactgctctc

SEQ ID NO: 148116 - DNA, 35 bp, Artificial Sequence
  Synthetic oligonucleotide
taccccccgcttataatgggctaatttgtccattc

SEQ ID NO: 148117 - DNA, 35 bp, Artificial Sequence
  Synthetic oligonucleotide
cccccgcctcctgtcttatccgggccgcatacttc

SEQ ID NO: 148118 - DNA, 35 bp, Artificial Sequence
  Synthetic oligonucleotide
gagggggagaacatgagagaaacttgagacgccag

SEQ ID NO: 148119 - DNA, 35 bp, Artificial Sequence
  Synthetic oligonucleotide
tttacctcacggtctattatgcccaccaacccctg

SEQ ID NO: 148120 - DNA, 35 bp, Artificial Sequence
  Synthetic oligonucleotide
ttcagcccgttacgcctccccctgcgatgcatttg

SEQ ID NO: 148121 - DNA, 35 bp, Artificial Sequence
  Synthetic oligonucleotide
agtttccgtccgcccggtttccatcctactttcat

SEQ ID NO: 148122 - DNA, 35 bp, Artificial Sequence
  Synthetic oligonucleotide
ttcccgcacggtcactcctcgctctgggccttgat

SEQ ID NO: 148123 - DNA, 35 bp, Artificial Sequence
  Synthetic oligonucleotide
gcgcctccgcgtcctcttattgttccatcgctact

SEQ ID NO: 148124 - DNA, 35 bp, Artificial Sequence
  Synthetic oligonucleotide
gggtccccccgacgtttagtcgacatcccgcccct

SEQ ID NO: 148125 - DNA, 35 bp, Artificial Sequence
  Synthetic oligonucleotide
gtcctacccgtgccaccgctcactcccgagatgct

SEQ ID NO: 148126 - DNA, 35 bp, Artificial Sequence
  Synthetic oligonucleotide
gaccctccccagctcctggtaccgcgattctttgt

SEQ ID NO: 148127 - DNA, 35 bp, Artificial Sequence
  Synthetic oligonucleotide
ggcccgccaatagcccctgctccgcccacctggtt

SEQ ID NO: 148128 - DNA, 36 bp, Artificial Sequence
  Synthetic oligonucleotide
agacaaccgatgtcatagcaccccccgctcgccaaa

SEQ ID NO: 148129 - DNA, 35 bp, Artificial Sequence
  Synthetic oligonucleotide
gtgacactgcgcctctgcacccacccacatcccaa

SEQ ID NO: 148130 - DNA, 36 bp, Artificial Sequence
  Synthetic oligonucleotide
atgcccctcgccctttgttgctacttctaccaataa

SEQ ID NO: 148131 - DNA, 36 bp, Artificial Sequence
  Synthetic oligonucleotide
gatgccggtatctgatgtttccccgtctgcccctaa

SEQ ID NO: 148132 - DNA, 35 bp, Artificial Sequence
  Synthetic oligonucleotide
gtccgcacgtcctcactgctcctgaaggtcttcca

SEQ ID NO: 148133 - DNA, 36 bp, Artificial Sequence
  Synthetic oligonucleotide
tgctagccgatcgatgttcttctcgtcacctcctca

SEQ ID NO: 148134 - DNA, 36 bp, Artificial Sequence
  Synthetic oligonucleotide
tccgtcacgcagtaagctccctggtttcgttcctca

SEQ ID NO: 148135 - DNA, 36 bp, Artificial Sequence
  Synthetic oligonucleotide
tgtgccccacaccttgtgattgctttactcacttca

SEQ ID NO: 148136 - DNA, 36 bp, Artificial Sequence
  Synthetic oligonucleotide
gttgcaccgccgatccacatacatctattgccttca

SEQ ID NO: 148137 - DNA, 35 bp, Artificial Sequence
  Synthetic oligonucleotide
tgcccgtccgtctccgggtcatcttgctgtcttca

SEQ ID NO: 148138 - DNA, 37 bp, Artificial Sequence
  Synthetic oligonucleotide
gttccacgtcgacgcgcgcttctgttctctgctccga

SEQ ID NO: 148139 - DNA, 37 bp, Artificial Sequence
  Synthetic oligonucleotide
gaggtggagggggggtgaggtgactacgtgtctgcga

SEQ ID NO: 148140 - DNA, 37 bp, Artificial Sequence
  Synthetic oligonucleotide
ggaatggacggtgggaggttaccgggtcacgggggga

SEQ ID NO: 148141 - DNA, 37 bp, Artificial Sequence
  Synthetic oligonucleotide
ttgctggtagggggtgggggtggagggcaattctgga

SEQ ID NO: 148142 - DNA, 37 bp, Artificial Sequence
  Synthetic oligonucleotide
tcagtcgcagtcctcgttaccactcgccattctgtga

SEQ ID NO: 148143 - DNA, 38 bp, Artificial Sequence
  Synthetic oligonucleotide
accagaccacatctctattgactccgcctccctattga

SEQ ID NO: 148144 - DNA, 35 bp, Artificial Sequence
  Synthetic oligonucleotide
gcccaggcttcattccggcccagctccacccacta

SEQ ID NO: 148145 - DNA, 35 bp, Artificial Sequence
  Synthetic oligonucleotide
gtacaccccgcaatatctcgtttcaggcccctcta

SEQ ID NO: 148146 - DNA, 36 bp, Artificial Sequence
  Synthetic oligonucleotide
gggttagggggggtggggaacgagataggcacagta

SEQ ID NO: 148147 - DNA, 35 bp, Artificial Sequence
  Synthetic oligonucleotide
gtgcgcacagtaccatactatcgttccacccagta

SEQ ID NO: 148148 - DNA, 36 bp, Artificial Sequence
  Synthetic oligonucleotide
gccaagccgccgagcttcgatctttccgcctttgta

SEQ ID NO: 148149 - DNA, 35 bp, Artificial Sequence
  Synthetic oligonucleotide
attccacccgccctgtacgaccaaataggacgaac

SEQ ID NO: 148150 - DNA, 35 bp, Artificial Sequence
  Synthetic oligonucleotide
gtaccgtcccgcgccttttagggcactgttacacc

SEQ ID NO: 148151 - DNA, 35 bp, Artificial Sequence
  Synthetic oligonucleotide
atgacgcacacaacgcgaacactgttccctccacc

SEQ ID NO: 148152 - DNA, 35 bp, Artificial Sequence
  Synthetic oligonucleotide
tccgttcctctgcgggctcaagaaacctcaccccc

SEQ ID NO: 148153 - DNA, 35 bp, Artificial Sequence
  Synthetic oligonucleotide
ttctcccgttccgctcgttcaagttcgtccgtccc

SEQ ID NO: 148154 - DNA, 35 bp, Artificial Sequence
  Synthetic oligonucleotide
aagattcccccccagttgcgccatggacctcacgc

SEQ ID NO: 148155 - DNA, 35 bp, Artificial Sequence
  Synthetic oligonucleotide
atgttcgatcctgctgacttttttactctcactgc

SEQ ID NO: 148156 - DNA, 35 bp, Artificial Sequence
  Synthetic oligonucleotide
gacccccgcaccctgtggcaaaaccgcccctactc

SEQ ID NO: 148157 - DNA, 34 bp, Artificial Sequence
  Synthetic oligonucleotide
ttcccaccgctaggtgtccctaatgtttgtcctc

SEQ ID NO: 148158 - DNA, 35 bp, Artificial Sequence
  Synthetic oligonucleotide
aatcgatctgcccgcccttgtcccttcagccgttc

SEQ ID NO: 148159 - DNA, 35 bp, Artificial Sequence
  Synthetic oligonucleotide
atcgcctcccgagaccactcaccctctctgtggcg

SEQ ID NO: 148160 - DNA, 35 bp, Artificial Sequence
  Synthetic oligonucleotide
atgtatccacccacctgtttttgccaaagcactcg

SEQ ID NO: 148161 - DNA, 35 bp, Artificial Sequence
  Synthetic oligonucleotide
tcacggtatggccccgggtgggtcgggaagggtcg

SEQ ID NO: 148162 - DNA, 35 bp, Artificial Sequence
  Synthetic oligonucleotide
acctaactgcagatcccgcttcatccgccctcaat

SEQ ID NO: 148163 - DNA, 35 bp, Artificial Sequence
  Synthetic oligonucleotide
tagcatctcagctctatcctcaccgaccgcaccat

SEQ ID NO: 148164 - DNA, 35 bp, Artificial Sequence
  Synthetic oligonucleotide
gaccccctccgtcaattcgcatcacaaccaggcat

SEQ ID NO: 148165 - DNA, 35 bp, Artificial Sequence
  Synthetic oligonucleotide
tgactcctcacgaccttttttgcccagttcattat

SEQ ID NO: 148166 - DNA, 35 bp, Artificial Sequence
  Synthetic oligonucleotide
catgggggagggtctagggggattcaacaaggggt

SEQ ID NO: 148167 - DNA, 35 bp, Artificial Sequence
  Synthetic oligonucleotide
gtaccgccctcataacacattgtcccacagttctt

SEQ ID NO: 148168 - DNA, 35 bp, Artificial Sequence
  Synthetic oligonucleotide
atcgcccaggtgcgcctacattcactgtccctgtt

SEQ ID NO: 148169 - DNA, 36 bp, Artificial Sequence
  Synthetic oligonucleotide
gcccacctccagggtcattatacccaccccttcaca

SEQ ID NO: 148170 - DNA, 36 bp, Artificial Sequence
  Synthetic oligonucleotide
acgtgtcacccggcgggtctctcactttccgttaca

SEQ ID NO: 148171 - DNA, 36 bp, Artificial Sequence
  Synthetic oligonucleotide
tgcccccccattttgaattggccgctccaccgccca

SEQ ID NO: 148172 - DNA, 36 bp, Artificial Sequence
  Synthetic oligonucleotide
tccacgcctgtggaactacaagtaaaactccgccca

SEQ ID NO: 148173 - DNA, 36 bp, Artificial Sequence
  Synthetic oligonucleotide
agtcaatcggggagcagggaagggagcgatgagcca

SEQ ID NO: 148174 - DNA, 35 bp, Artificial Sequence
  Synthetic oligonucleotide
gccatgttcgttccttgctgtcatttctcgctcca

SEQ ID NO: 148175 - DNA, 36 bp, Artificial Sequence
  Synthetic oligonucleotide
gcaacctcgtgctaatgggcccttcctcgtaactca

SEQ ID NO: 148176 - DNA, 36 bp, Artificial Sequence
  Synthetic oligonucleotide
ttactacgcctctcgctattggttacccgttcctca

SEQ ID NO: 148177 - DNA, 35 bp, Artificial Sequence
  Synthetic oligonucleotide
gtgtcctacctgtcccgtgcttatcgcgtagctca

SEQ ID NO: 148178 - DNA, 35 bp, Artificial Sequence
  Synthetic oligonucleotide
tcgtgcacagatcgtaactcctgttccacctttca

SEQ ID NO: 148179 - DNA, 37 bp, Artificial Sequence
  Synthetic oligonucleotide
atggtggggggaatgggacgagggggaagtgcaacga

SEQ ID NO: 148180 - DNA, 37 bp, Artificial Sequence
  Synthetic oligonucleotide
gacgccctacactgttctgaacaccctctactcccga

SEQ ID NO: 148181 - DNA, 37 bp, Artificial Sequence
  Synthetic oligonucleotide
gatgcaacatctatatggtcaccctgtccctcttcga

SEQ ID NO: 148182 - DNA, 38 bp, Artificial Sequence
  Synthetic oligonucleotide
agcgccttcgctttgtcccgttgctgcctccatcatga

SEQ ID NO: 148183 - DNA, 38 bp, Artificial Sequence
  Synthetic oligonucleotide
ataggagaatgcgggaagggggaggggggaagtcatga

SEQ ID NO: 148184 - DNA, 38 bp, Artificial Sequence
  Synthetic oligonucleotide
ataggggagggagccatggagatggggaggggtgatga

SEQ ID NO: 148185 - DNA, 38 bp, Artificial Sequence
  Synthetic oligonucleotide
gtcgtcatccgctttgcgcctccatcttccgtccctga

SEQ ID NO: 148186 - DNA, 38 bp, Artificial Sequence
  Synthetic oligonucleotide
tgcacccccctgctttgacttgctgattgaccctctga

SEQ ID NO: 148187 - DNA, 34 bp, Artificial Sequence
  Synthetic oligonucleotide
tcgttgtccccccttgtccttccgcgcaccttga

SEQ ID NO: 148188 - DNA, 38 bp, Artificial Sequence
  Synthetic oligonucleotide
gcatcgcactcccccctctgtactacgatcgcccttga

SEQ ID NO: 148189 - DNA, 35 bp, Artificial Sequence
  Synthetic oligonucleotide
catttacccacgtatcagttgccttccctgatcta

SEQ ID NO: 148190 - DNA, 36 bp, Artificial Sequence
  Synthetic oligonucleotide
gccccgcgctcactattgctcatggctccgtttcta

SEQ ID NO: 148191 - DNA, 36 bp, Artificial Sequence
  Synthetic oligonucleotide
gtgacagaggaagaggaaggcgccgagagaagggta

SEQ ID NO: 148192 - DNA, 33 bp, Artificial Sequence
  Synthetic oligonucleotide
tttatgccgcctgttacccatcatccgtttgta

SEQ ID NO: 148193 - DNA, 36 bp, Artificial Sequence
  Synthetic oligonucleotide
gaccctgggtgggggaggtgggtagtacgcatgtta

SEQ ID NO: 148194 - DNA, 35 bp, Artificial Sequence
  Synthetic oligonucleotide
atacacccgcccaacagcaccgctccgccagaacc

SEQ ID NO: 148195 - DNA, 35 bp, Artificial Sequence
  Synthetic oligonucleotide
gttgcactcagcgattaatcatacctccccccccc

SEQ ID NO: 148196 - DNA, 35 bp, Artificial Sequence
  Synthetic oligonucleotide
gatgcccgccgtgcacacgcctccatgctcccgcc

SEQ ID NO: 148197 - DNA, 35 bp, Artificial Sequence
  Synthetic oligonucleotide
gttcccacagcgtgtctccctctcgcagtgcatcc

SEQ ID NO: 148198 - DNA, 35 bp, Artificial Sequence
  Synthetic oligonucleotide
tgccaacgtttaagtgcaactcgccatcaccctcc

SEQ ID NO: 148199 - DNA, 35 bp, Artificial Sequence
  Synthetic oligonucleotide
gccgtagccacgcatgtaatccgcctactccacgc

SEQ ID NO: 148200 - DNA, 35 bp, Artificial Sequence
  Synthetic oligonucleotide
gtccacgcccccgtatttaatgatctattatccgc

SEQ ID NO: 148201 - DNA, 35 bp, Artificial Sequence
  Synthetic oligonucleotide
tttgacccccctgtcgaattatgtgacctccgcgc

SEQ ID NO: 148202 - DNA, 35 bp, Artificial Sequence
  Synthetic oligonucleotide
gccgtcaacgccggccattcttcgtttgtctctgc

SEQ ID NO: 148203 - DNA, 35 bp, Artificial Sequence
  Synthetic oligonucleotide
tgcccaccagtacttgtttcgcaactaccttctgc

SEQ ID NO: 148204 - DNA, 35 bp, Artificial Sequence
  Synthetic oligonucleotide
ttgccccaccatggtacatttcccctgctgtttgc

SEQ ID NO: 148205 - DNA, 35 bp, Artificial Sequence
  Synthetic oligonucleotide
tacctggtcctccccgacgcctctggtctttcatc

SEQ ID NO: 148206 - DNA, 35 bp, Artificial Sequence
  Synthetic oligonucleotide
accacacctcccgggtctcctcatatatggctatc

SEQ ID NO: 148207 - DNA, 35 bp, Artificial Sequence
  Synthetic oligonucleotide
acacggccaccgacgtgttcgcttaaccctgcctc

SEQ ID NO: 148208 - DNA, 35 bp, Artificial Sequence
  Synthetic oligonucleotide
aaccgccatgcaaccagttcaccttttgtccgctc

SEQ ID NO: 148209 - DNA, 35 bp, Artificial Sequence
  Synthetic oligonucleotide
tccgaccgaccgccgctgggtcacctaatgccttc

SEQ ID NO: 148210 - DNA, 35 bp, Artificial Sequence
  Synthetic oligonucleotide
tagtgccccgagccggtccctaggccccctatttc

SEQ ID NO: 148211 - DNA, 35 bp, Artificial Sequence
  Synthetic oligonucleotide
gagtgaaaggggggagtggggacgggggggtagag

SEQ ID NO: 148212 - DNA, 35 bp, Artificial Sequence
  Synthetic oligonucleotide
tcgagagccccccataagccccaacgccggacctg

SEQ ID NO: 148213 - DNA, 35 bp, Artificial Sequence
  Synthetic oligonucleotide
ttcggttggccccgcccccatgccctcttaactat

SEQ ID NO: 148214 - DNA, 35 bp, Artificial Sequence
  Synthetic oligonucleotide
gccatagcttcccgcgggtcttgccttctgtccct

SEQ ID NO: 148215 - DNA, 35 bp, Artificial Sequence
  Synthetic oligonucleotide
actccactccacctggttatcgccctgcctcgcct

SEQ ID NO: 148216 - DNA, 35 bp, Artificial Sequence
  Synthetic oligonucleotide
gatggatcagcgtgtcccagtcgtagccctcctct

SEQ ID NO: 148217 - DNA, 35 bp, Artificial Sequence
  Synthetic oligonucleotide
ttgtcgccccggtgcattgttcctcctgctttgtt

SEQ ID NO: 148218 - DNA, 35 bp, Artificial Sequence
  Synthetic oligonucleotide
atcgccatcatccgcggctctccccgtctcatttt

SEQ ID NO: 148219 - DNA, 35 bp, Artificial Sequence
  Synthetic oligonucleotide
gtcccccccagtgtgcatttctgtggccgcccaaa

SEQ ID NO: 148220 - DNA, 35 bp, Artificial Sequence
  Synthetic oligonucleotide
gatacctgcaccctccgcctcaatacagtagccaa

SEQ ID NO: 148221 - DNA, 36 bp, Artificial Sequence
  Synthetic oligonucleotide
tggatcgtactgccgcttacctctcgaccgttccaa

SEQ ID NO: 148222 - DNA, 36 bp, Artificial Sequence
  Synthetic oligonucleotide
atcgcccccccctccctctacgaccggtacacgtaa

SEQ ID NO: 148223 - DNA, 35 bp, Artificial Sequence
  Synthetic oligonucleotide
ggagacaggccaggaaagtcaggggggagttaaca

SEQ ID NO: 148224 - DNA, 35 bp, Artificial Sequence
  Synthetic oligonucleotide
gacgtggtcgccgcttttcctgacccccctgtaca

SEQ ID NO: 148225 - DNA, 36 bp, Artificial Sequence
  Synthetic oligonucleotide
tcctcccgtacataccctgaattcgaactgcaccca

SEQ ID NO: 148226 - DNA, 36 bp, Artificial Sequence
  Synthetic oligonucleotide
gtccaccgttccctcgcttttgcttgttgttactca

SEQ ID NO: 148227 - DNA, 35 bp, Artificial Sequence
  Synthetic oligonucleotide
gcgacaccgtgcccccatccgccttgtgctgttca

SEQ ID NO: 148228 - DNA, 37 bp, Artificial Sequence
  Synthetic oligonucleotide
tcaccaagggggacggaggggcggtggatggctgaga

SEQ ID NO: 148229 - DNA, 37 bp, Artificial Sequence
  Synthetic oligonucleotide
aatgaaaggcgggagggtggggaaagcacaacgtaga

SEQ ID NO: 148230 - DNA, 37 bp, Artificial Sequence
  Synthetic oligonucleotide
gcccccctccaatctgtccgtcagtcggttctttaga

SEQ ID NO: 148231 - DNA, 37 bp, Artificial Sequence
  Synthetic oligonucleotide
gtgccttccccagctcttgtaaccgcctttgtttaga

SEQ ID NO: 148232 - DNA, 37 bp, Artificial Sequence
  Synthetic oligonucleotide
gacaccctcctttgctgctgatatcgctgaatcccga

SEQ ID NO: 148233 - DNA, 37 bp, Artificial Sequence
  Synthetic oligonucleotide
aaacccatcccgcccgtatactgcaccccagtgccga

SEQ ID NO: 148234 - DNA, 37 bp, Artificial Sequence
  Synthetic oligonucleotide
tagcgcacaccacatgcctatttttttgcttcccgga

SEQ ID NO: 148235 - DNA, 37 bp, Artificial Sequence
  Synthetic oligonucleotide
tgtccggagagaggggggggtaggtgggttccgcgga

SEQ ID NO: 148236 - DNA, 37 bp, Artificial Sequence
  Synthetic oligonucleotide
tcccacggggggtggggcgagttagcggggaacggga

SEQ ID NO: 148237 - DNA, 37 bp, Artificial Sequence
  Synthetic oligonucleotide
atacgtgaaagtgagtgggggaggcgtggagggggga

SEQ ID NO: 148238 - DNA, 35 bp, Artificial Sequence
  Synthetic oligonucleotide
agagggcgacgcttagtagggggaagggtggtgga

SEQ ID NO: 148239 - DNA, 38 bp, Artificial Sequence
  Synthetic oligonucleotide
tcgcccctaccacacatgctctcccagttagtcgctga

SEQ ID NO: 148240 - DNA, 38 bp, Artificial Sequence
  Synthetic oligonucleotide
gcctcccgccttgatcagcactagcgccacacctttga

SEQ ID NO: 148241 - DNA, 35 bp, Artificial Sequence
  Synthetic oligonucleotide
gctccgacacggtcgcccccttaccgtccctttga

SEQ ID NO: 148242 - DNA, 37 bp, Artificial Sequence
  Synthetic oligonucleotide
accctcgccgttcgcattcgacccgtctgtcctttga

SEQ ID NO: 148243 - DNA, 36 bp, Artificial Sequence
  Synthetic oligonucleotide
atgtacatggcgtccttgatctcttccgcttcccta

SEQ ID NO: 148244 - DNA, 36 bp, Artificial Sequence
  Synthetic oligonucleotide
gccctgcccacacccgtgcatcccaatgccatccta

SEQ ID NO: 148245 - DNA, 36 bp, Artificial Sequence
  Synthetic oligonucleotide
ttacgcagccgccgccgctctctcgtacgcctagta

SEQ ID NO: 148246 - DNA, 35 bp, Artificial Sequence
  Synthetic oligonucleotide
gacgcccgccgtatccttggtccgttaatatacac

SEQ ID NO: 148247 - DNA, 35 bp, Artificial Sequence
  Synthetic oligonucleotide
acgcgcccttcagccaacgctcgatccaacaccac

SEQ ID NO: 148248 - DNA, 35 bp, Artificial Sequence
  Synthetic oligonucleotide
tcacggctgaagcctctctttgctactttccctac

SEQ ID NO: 148249 - DNA, 33 bp, Artificial Sequence
  Synthetic oligonucleotide
gtctcgccctcacccgcacacctcttgcattac

SEQ ID NO: 148250 - DNA, 35 bp, Artificial Sequence
  Synthetic oligonucleotide
acgcaactgcaatgcaacactgcgaaccatcttac

SEQ ID NO: 148251 - DNA, 35 bp, Artificial Sequence
  Synthetic oligonucleotide
tctcactgtcctatcttgctcctttgctgacaacc

SEQ ID NO: 148252 - DNA, 35 bp, Artificial Sequence
  Synthetic oligonucleotide
tatgtacctccgaacggtagtggcgctacaccacc

SEQ ID NO: 148253 - DNA, 35 bp, Artificial Sequence
  Synthetic oligonucleotide
acgtgcgaccgctgtcccccgccgtaccggttacc

SEQ ID NO: 148254 - DNA, 35 bp, Artificial Sequence
  Synthetic oligonucleotide
tgtaactcatcacatgatcccttcctacttttgcc

SEQ ID NO: 148255 - DNA, 35 bp, Artificial Sequence
  Synthetic oligonucleotide
cccgaaaccctctgtactgtccgctggttcactcc

SEQ ID NO: 148256 - DNA, 35 bp, Artificial Sequence
  Synthetic oligonucleotide
tagccactcgaccgcccacgcacttaccgtcccgc

SEQ ID NO: 148257 - DNA, 35 bp, Artificial Sequence
  Synthetic oligonucleotide
tcccacctacccagttgacccactccggcatatgc

SEQ ID NO: 148258 - DNA, 35 bp, Artificial Sequence
  Synthetic oligonucleotide
tcttcatccctccgctagtgtagctcgattactgc

SEQ ID NO: 148259 - DNA, 35 bp, Artificial Sequence
  Synthetic oligonucleotide
ttcgccggtgattgttgcccattacgccgccctgc

SEQ ID NO: 148260 - DNA, 35 bp, Artificial Sequence
  Synthetic oligonucleotide
tcagcacgttctcgctcctcgtcctcacatctcag

SEQ ID NO: 148261 - DNA, 35 bp, Artificial Sequence
  Synthetic oligonucleotide
gtgaggggtagtagcatgtctggggaacgggagag

SEQ ID NO: 148262 - DNA, 34 bp, Artificial Sequence
  Synthetic oligonucleotide
ggggggggggcaatggagggtgctgtcggtggag

SEQ ID NO: 148263 - DNA, 35 bp, Artificial Sequence
  Synthetic oligonucleotide
tgtcgcagatgtcttctctcgtgtccgtccatccg

SEQ ID NO: 148264 - DNA, 35 bp, Artificial Sequence
  Synthetic oligonucleotide
tcccagccgcctctcatagtcaaccctccgacgcg

SEQ ID NO: 148265 - DNA, 35 bp, Artificial Sequence
  Synthetic oligonucleotide
gacgagcaactgggtagaaagtggcgggtggaagg

SEQ ID NO: 148266 - DNA, 35 bp, Artificial Sequence
  Synthetic oligonucleotide
gtcgccccctcattgtcttatcttcagctattcgg

SEQ ID NO: 148267 - DNA, 35 bp, Artificial Sequence
  Synthetic oligonucleotide
aaggggacatgacaacggtaaaagggtgggaaggg

SEQ ID NO: 148268 - DNA, 35 bp, Artificial Sequence
  Synthetic oligonucleotide
gcctcccggcgtactgtctcacccgaactcctctg

SEQ ID NO: 148269 - DNA, 35 bp, Artificial Sequence
  Synthetic oligonucleotide
gaagtggggaggtgggtaggaggaaggggtgagat

SEQ ID NO: 148270 - DNA, 35 bp, Artificial Sequence
  Synthetic oligonucleotide
ttgtccggcggagctcgcttacgtacacatcccct

SEQ ID NO: 148271 - DNA, 35 bp, Artificial Sequence
  Synthetic oligonucleotide
tagacaagaggtaaagaacggtaaggggagtaagt

SEQ ID NO: 148272 - DNA, 35 bp, Artificial Sequence
  Synthetic oligonucleotide
gaaagcgcactgatcatcgcccctctgtcactagt

SEQ ID NO: 148273 - DNA, 35 bp, Artificial Sequence
  Synthetic oligonucleotide
gcccccccacacgccccgctaccgttctctggtgt

SEQ ID NO: 148274 - DNA, 35 bp, Artificial Sequence
  Synthetic oligonucleotide
gcacataaccgcgccagtcactgccaccctcttgt

SEQ ID NO: 148275 - DNA, 35 bp, Artificial Sequence
  Synthetic oligonucleotide
atgacacgcacctcccatgctgtccacttgtcctt

SEQ ID NO: 148276 - DNA, 35 bp, Artificial Sequence
  Synthetic oligonucleotide
tcagatgaacctgtctcgtggccgtatttgccttt

SEQ ID NO: 148277 - DNA, 36 bp, Artificial Sequence
  Synthetic oligonucleotide
acctatcctgcctcagtgactcacatccatcgccca

SEQ ID NO: 148278 - DNA, 35 bp, Artificial Sequence
  Synthetic oligonucleotide
tgtgtctcgccctccactgtatatgtttgttgcca

SEQ ID NO: 148279 - DNA, 35 bp, Artificial Sequence
  Synthetic oligonucleotide
gaatagggagtaggggaggataaaatacgggagca

SEQ ID NO: 148280 - DNA, 35 bp, Artificial Sequence
  Synthetic oligonucleotide
tcagtccatccgcctcatctactctttagctatca

SEQ ID NO: 148281 - DNA, 36 bp, Artificial Sequence
  Synthetic oligonucleotide
aaccaaccactcgtcctgccttacgacccgacctca

SEQ ID NO: 148282 - DNA, 35 bp, Artificial Sequence
  Synthetic oligonucleotide
ttagcctccgcaccccatacttttgtcgtatctca

SEQ ID NO: 148283 - DNA, 35 bp, Artificial Sequence
  Synthetic oligonucleotide
gttactctcgccgcacaccttccactgcctaccga

SEQ ID NO: 148284 - DNA, 35 bp, Artificial Sequence
  Synthetic oligonucleotide
aacccgccacccgcccttaagcggccccccaagga

SEQ ID NO: 148285 - DNA, 37 bp, Artificial Sequence
  Synthetic oligonucleotide
aaagccgctgaccaaaccgcctctcgtcctagtagga

SEQ ID NO: 148286 - DNA, 37 bp, Artificial Sequence
  Synthetic oligonucleotide
gatgggtttgggagggtgggaggcgcattgaacggga

SEQ ID NO: 148287 - DNA, 37 bp, Artificial Sequence
  Synthetic oligonucleotide
tcatattcgcaaacgggtggatgccgagggaggggga

SEQ ID NO: 148288 - DNA, 37 bp, Artificial Sequence
  Synthetic oligonucleotide
atctctcgccgcccgttaccgccccctcttcgatgga

SEQ ID NO: 148289 - DNA, 36 bp, Artificial Sequence
  Synthetic oligonucleotide
tcaccactccaccgatattctatgatcctcgaatga

SEQ ID NO: 148290 - DNA, 38 bp, Artificial Sequence
  Synthetic oligonucleotide
tgcgagtcaataggagagggcgaggatggggcgggtga

SEQ ID NO: 148291 - DNA, 37 bp, Artificial Sequence
  Synthetic oligonucleotide
acatcgcctcgaaccatctgtacaacttgccacttga

SEQ ID NO: 148292 - DNA, 38 bp, Artificial Sequence
  Synthetic oligonucleotide
tcacaccgcacttatccgaagcctccagccgcccttga

SEQ ID NO: 148293 - DNA, 38 bp, Artificial Sequence
  Synthetic oligonucleotide
tccagagggaggggagatacggaggggcgagtgcttga

SEQ ID NO: 148294 - DNA, 35 bp, Artificial Sequence
  Synthetic oligonucleotide
tgccctgcgtactgacggctcaccccctccgccta

SEQ ID NO: 148295 - DNA, 35 bp, Artificial Sequence
  Synthetic oligonucleotide
accctgactcccgtttgttgactttctgtacgcta

SEQ ID NO: 148296 - DNA, 35 bp, Artificial Sequence
  Synthetic oligonucleotide
tatagcggtagggcgggacggcgggggggggctta

SEQ ID NO: 148297 - DNA, 35 bp, Artificial Sequence
  Synthetic oligonucleotide
tcccgcaccatctcgctgccttacattacaggaac

SEQ ID NO: 148298 - DNA, 35 bp, Artificial Sequence
  Synthetic oligonucleotide
agttcccctgcgcctttgcgtttcagccctttcac

SEQ ID NO: 148299 - DNA, 35 bp, Artificial Sequence
  Synthetic oligonucleotide
tgaccgtcctgtctcatgaacacctccgttgcacc

SEQ ID NO: 148300 - DNA, 35 bp, Artificial Sequence
  Synthetic oligonucleotide
acaacgaacggcaatccgtgcactttctatccccc

SEQ ID NO: 148301 - DNA, 35 bp, Artificial Sequence
  Synthetic oligonucleotide
tacctccgggcgccctctggtggtcccatttgccc

SEQ ID NO: 148302 - DNA, 35 bp, Artificial Sequence
  Synthetic oligonucleotide
gatgtactcatccggcgctgacccctcgcccgtcc

SEQ ID NO: 148303 - DNA, 35 bp, Artificial Sequence
  Synthetic oligonucleotide
gaacatacggggatgcttcttcacgccacctttcc

SEQ ID NO: 148304 - DNA, 35 bp, Artificial Sequence
  Synthetic oligonucleotide
tgtcagattcaccgttgctacatgatctccttcgc

SEQ ID NO: 148305 - DNA, 35 bp, Artificial Sequence
  Synthetic oligonucleotide
gcgcccactgcttgcgagatcttttgccctcctgc

SEQ ID NO: 148306 - DNA, 35 bp, Artificial Sequence
  Synthetic oligonucleotide
gtgcgaaggaagtatggcactcatcccggcccctc

SEQ ID NO: 148307 - DNA, 35 bp, Artificial Sequence
  Synthetic oligonucleotide
tcgatcctgatgacttattcgttacgccttgcctc

SEQ ID NO: 148308 - DNA, 35 bp, Artificial Sequence
  Synthetic oligonucleotide
gtacacgttgtgccttatcgtacgttgccttcctc

SEQ ID NO: 148309 - DNA, 35 bp, Artificial Sequence
  Synthetic oligonucleotide
accatcaacatgtgcgcatcccaacaaccccgctc

SEQ ID NO: 148310 - DNA, 35 bp, Artificial Sequence
  Synthetic oligonucleotide
tagcggggggcctaccgtgttttgctttccttctc

SEQ ID NO: 148311 - DNA, 35 bp, Artificial Sequence
  Synthetic oligonucleotide
acatgccgtccgcgagtcgccgccatcatcttctc

SEQ ID NO: 148312 - DNA, 35 bp, Artificial Sequence
  Synthetic oligonucleotide
tcacaatgccttcccttaacctgcgtgtttttgtc

SEQ ID NO: 148313 - DNA, 30 bp, Artificial Sequence
  Synthetic oligonucleotide
gctcacctcggacctgcctctacggccttc

SEQ ID NO: 148314 - DNA, 35 bp, Artificial Sequence
  Synthetic oligonucleotide
gattgcccgccccctctatgtatgcctataaaacg

SEQ ID NO: 148315 - DNA, 35 bp, Artificial Sequence
  Synthetic oligonucleotide
aagccccctcctgcccctatgccctacgtgtttat

SEQ ID NO: 148316 - DNA, 35 bp, Artificial Sequence
  Synthetic oligonucleotide
tctcagaacgcatccccccgccgcaggtctcgcct

SEQ ID NO: 148317 - DNA, 35 bp, Artificial Sequence
  Synthetic oligonucleotide
atggccggtcattcaccacgtggcgaccctctcct

SEQ ID NO: 148318 - DNA, 35 bp, Artificial Sequence
  Synthetic oligonucleotide
tcactcctggatgcgaatttcgctaggcctttcct

SEQ ID NO: 148319 - DNA, 35 bp, Artificial Sequence
  Synthetic oligonucleotide
gctatccgggatagctcgacacttaacctcctgct

SEQ ID NO: 148320 - DNA, 35 bp, Artificial Sequence
  Synthetic oligonucleotide
tgctcaactggtctctcgtcaatacggctctctct

SEQ ID NO: 148321 - DNA, 35 bp, Artificial Sequence
  Synthetic oligonucleotide
gtcgccttcagagctggctcccgcattttccctgt

SEQ ID NO: 148322 - DNA, 34 bp, Artificial Sequence
  Synthetic oligonucleotide
agatctccacccccccggcctttgggcaccggtt

SEQ ID NO: 148323 - DNA, 36 bp, Artificial Sequence
  Synthetic oligonucleotide
tccccacccccatacggatcagcgatgcctccggaa

SEQ ID NO: 148324 - DNA, 36 bp, Artificial Sequence
  Synthetic oligonucleotide
tcacgctagggccacttcatcttcacgtcttcgcca

SEQ ID NO: 148325 - DNA, 36 bp, Artificial Sequence
  Synthetic oligonucleotide
tacgcatcacctatcgttatcctgcaccccggtcca

SEQ ID NO: 148326 - DNA, 35 bp, Artificial Sequence
  Synthetic oligonucleotide
gacacctccatcatctgttcatgctcatttcctca

SEQ ID NO: 148327 - DNA, 35 bp, Artificial Sequence
  Synthetic oligonucleotide
gtctgccccttactctgatgcccgtccctgcgtca

SEQ ID NO: 148328 - DNA, 36 bp, Artificial Sequence
  Synthetic oligonucleotide
tgcacatcccgcctgtcctggaactcaccgatttca

SEQ ID NO: 148329 - DNA, 37 bp, Artificial Sequence
  Synthetic oligonucleotide
ggagtgatggtagagggagcgggagggacgactaaga

SEQ ID NO: 148330 - DNA, 36 bp, Artificial Sequence
  Synthetic oligonucleotide
gcgatgaagcaaaaggggggggcgtgggaacgcaga

SEQ ID NO: 148331 - DNA, 37 bp, Artificial Sequence
  Synthetic oligonucleotide
acccgctcacccacccccggtcccttcatactgcaga

SEQ ID NO: 148332 - DNA, 37 bp, Artificial Sequence
  Synthetic oligonucleotide
tgctatgcgaccatttcgtcccccgccccacccgaga

SEQ ID NO: 148333 - DNA, 37 bp, Artificial Sequence
  Synthetic oligonucleotide
tccgcaccccaagctccccagcgtctctacggcccga

SEQ ID NO: 148334 - DNA, 37 bp, Artificial Sequence
  Synthetic oligonucleotide
accgccctcccatatgacgttttggcatttcattcga

SEQ ID NO: 148335 - DNA, 37 bp, Artificial Sequence
  Synthetic oligonucleotide
agtgactgcagccattccccggccttctccccccgga

SEQ ID NO: 148336 - DNA, 38 bp, Artificial Sequence
  Synthetic oligonucleotide
ggtgggcgggagggcgtaggggtggaggcggataatga

SEQ ID NO: 148337 - DNA, 38 bp, Artificial Sequence
  Synthetic oligonucleotide
gacacggtgcacggggggtacgaggaggacggggatga

SEQ ID NO: 148338 - DNA, 37 bp, Artificial Sequence
  Synthetic oligonucleotide
gggagggtgggacgataaaaacaagggcggtgtatga

SEQ ID NO: 148339 - DNA, 38 bp, Artificial Sequence
  Synthetic oligonucleotide
gagcccccccgtgacccgcactgccacttgctacctga

SEQ ID NO: 148340 - DNA, 38 bp, Artificial Sequence
  Synthetic oligonucleotide
acgaccactgtcctgatatccgatcccctccaccctga

SEQ ID NO: 148341 - DNA, 38 bp, Artificial Sequence
  Synthetic oligonucleotide
tcgacagggaagggggcgggcctagggggacggcgtga

SEQ ID NO: 148342 - DNA, 38 bp, Artificial Sequence
  Synthetic oligonucleotide
taacgagggacgaggaggagggaagagccgtgatgtga

SEQ ID NO: 148343 - DNA, 37 bp, Artificial Sequence
  Synthetic oligonucleotide
aggggagggagcatagggggatcaggagcgcgtgtga

SEQ ID NO: 148344 - DNA, 37 bp, Artificial Sequence
  Synthetic oligonucleotide
gactgtgcgcgacaggcgttctcgtgctccctcttga

SEQ ID NO: 148345 - DNA, 36 bp, Artificial Sequence
  Synthetic oligonucleotide
aactggtggggtggatcgtaaagggggtgggaaata

SEQ ID NO: 148346 - DNA, 35 bp, Artificial Sequence
  Synthetic oligonucleotide
gctggacggcccccagttccgctatccgacctcta

SEQ ID NO: 148347 - DNA, 35 bp, Artificial Sequence
  Synthetic oligonucleotide
acccaatcccgccacttgccgatacacttgtgaac

SEQ ID NO: 148348 - DNA, 35 bp, Artificial Sequence
  Synthetic oligonucleotide
tgtgagaccagcacctagaagtcctgccgttcccc

SEQ ID NO: 148349 - DNA, 35 bp, Artificial Sequence
  Synthetic oligonucleotide
gcttgtgccccgatgactatgtctcgatcgttccc

SEQ ID NO: 148350 - DNA, 35 bp, Artificial Sequence
  Synthetic oligonucleotide
ggatccatccctgccctgccctttctttgtccgcc

SEQ ID NO: 148351 - DNA, 35 bp, Artificial Sequence
  Synthetic oligonucleotide
cacatccccccgatgaacccggtgccccttccgcc

SEQ ID NO: 148352 - DNA, 35 bp, Artificial Sequence
  Synthetic oligonucleotide
tccatcccaatactgctcagccctgtctatactcc

SEQ ID NO: 148353 - DNA, 35 bp, Artificial Sequence
  Synthetic oligonucleotide
gacgtcaaccacgcgtccgcgctcgctccgcctcc

SEQ ID NO: 148354 - DNA, 35 bp, Artificial Sequence
  Synthetic oligonucleotide
tcgcactcccagcccccgttttatttgccccgtcc

SEQ ID NO: 148355 - DNA, 35 bp, Artificial Sequence
  Synthetic oligonucleotide
gacacacgcggatcaccccctttctcataccttcc

SEQ ID NO: 148356 - DNA, 35 bp, Artificial Sequence
  Synthetic oligonucleotide
tactcaccgactctgattatagctccatcttcggc

SEQ ID NO: 148357 - DNA, 35 bp, Artificial Sequence
  Synthetic oligonucleotide
ttcgctcaacaggccccccatgtacctccttctgc

SEQ ID NO: 148358 - DNA, 35 bp, Artificial Sequence
  Synthetic oligonucleotide
tacgagcacgcgcacagtcccgccctgctacttgc

SEQ ID NO: 148359 - DNA, 35 bp, Artificial Sequence
  Synthetic oligonucleotide
gccacttatcactgtacctccatcgggacgccctc

SEQ ID NO: 148360 - DNA, 35 bp, Artificial Sequence
  Synthetic oligonucleotide
acaccggctctcgtgttccctccccgcagctgctc

SEQ ID NO: 148361 - DNA, 35 bp, Artificial Sequence
  Synthetic oligonucleotide
cacaccgtttagccctcaccgccatgccatcggtc

SEQ ID NO: 148362 - DNA, 35 bp, Artificial Sequence
  Synthetic oligonucleotide
ggggagggggagtacggagcttgaaaggggcccag

SEQ ID NO: 148363 - DNA, 35 bp, Artificial Sequence
  Synthetic oligonucleotide
tagaccactccctccttgctttttgagattccctg

SEQ ID NO: 148364 - DNA, 35 bp, Artificial Sequence
  Synthetic oligonucleotide
tgtcgtgcccccaatcgtactgtacttcccgcttg

SEQ ID NO: 148365 - DNA, 35 bp, Artificial Sequence
  Synthetic oligonucleotide
gatgcgtcgttgccgcccccttgccaccacatgat

SEQ ID NO: 148366 - DNA, 35 bp, Artificial Sequence
  Synthetic oligonucleotide
ttacagcgcatctgctagctcccttattgttccct

SEQ ID NO: 148367 - DNA, 35 bp, Artificial Sequence
  Synthetic oligonucleotide
tgactacgctcctccccgtatcccccgagtttgct

SEQ ID NO: 148368 - DNA, 35 bp, Artificial Sequence
  Synthetic oligonucleotide
gcctatgtccgtgccgtccctcccgcctggtatct

SEQ ID NO: 148369 - DNA, 35 bp, Artificial Sequence
  Synthetic oligonucleotide
tgtaccgctctgtgcttaccccccggcccccgtct

SEQ ID NO: 148370 - DNA, 35 bp, Artificial Sequence
  Synthetic oligonucleotide
gcttaccaggtccgcatgtctcctctccgcccagt

SEQ ID NO: 148371 - DNA, 35 bp, Artificial Sequence
  Synthetic oligonucleotide
tgtcacccctgccatctttcgctgttacgtaccgt

SEQ ID NO: 148372 - DNA, 35 bp, Artificial Sequence
  Synthetic oligonucleotide
gtcgggcatcttgccttgatctcttattgctcctt

SEQ ID NO: 148373 - DNA, 35 bp, Artificial Sequence
  Synthetic oligonucleotide
taaaccgacatctccgccgctctattgcccatgtt

SEQ ID NO: 148374 - DNA, 35 bp, Artificial Sequence
  Synthetic oligonucleotide
cacctgccccacacatatatttgtcgtcctcccaa

SEQ ID NO: 148375 - DNA, 36 bp, Artificial Sequence
  Synthetic oligonucleotide
gacatcagtcaccgtcattatccgccgaccactcaa

SEQ ID NO: 148376 - DNA, 35 bp, Artificial Sequence
  Synthetic oligonucleotide
accagccgcaccacgccagctctgcccccaatgaa

SEQ ID NO: 148377 - DNA, 36 bp, Artificial Sequence
  Synthetic oligonucleotide
gcccatgcccccccacgtctcctaccgggacgcaca

SEQ ID NO: 148378 - DNA, 36 bp, Artificial Sequence
  Synthetic oligonucleotide
tccctgaccctcgccctagtcgttatcattgttaca

SEQ ID NO: 148379 - DNA, 36 bp, Artificial Sequence
  Synthetic oligonucleotide
ggtccaccccgctcactgtccaattccctgcactca

SEQ ID NO: 148380 - DNA, 35 bp, Artificial Sequence
  Synthetic oligonucleotide
gtcaaaccccgccaccgctctacgccttgagctca

SEQ ID NO: 148381 - DNA, 36 bp, Artificial Sequence
  Synthetic oligonucleotide
accttccccgcgcggttcggtcttccattactttca

SEQ ID NO: 148382 - DNA, 37 bp, Artificial Sequence
  Synthetic oligonucleotide
gggtgggggcatgggcggaaggaggactcgatggcga

SEQ ID NO: 148383 - DNA, 37 bp, Artificial Sequence
  Synthetic oligonucleotide
ggggtggtgggctaatatatggtaaggcgttggagga

SEQ ID NO: 148384 - DNA, 38 bp, Artificial Sequence
  Synthetic oligonucleotide
gacacgcactgagcccttccgaacacccgctctactga

SEQ ID NO: 148385 - DNA, 37 bp, Artificial Sequence
  Synthetic oligonucleotide
gtacattcagcccacgccgcctgccccagtcccctga

SEQ ID NO: 148386 - DNA, 38 bp, Artificial Sequence
  Synthetic oligonucleotide
attccgccccccacgcccactgtctcataatagcctga

SEQ ID NO: 148387 - DNA, 37 bp, Artificial Sequence
  Synthetic oligonucleotide
tcagcggtgggaggggtgggggtgctgcttagggtga

SEQ ID NO: 148388 - DNA, 37 bp, Artificial Sequence
  Synthetic oligonucleotide
gttccaccctctctatgagcacccctcactattgtga

SEQ ID NO: 148389 - DNA, 38 bp, Artificial Sequence
  Synthetic oligonucleotide
tgaataccgcctccctcgccacgacccagaccttgtga

SEQ ID NO: 148390 - DNA, 37 bp, Artificial Sequence
  Synthetic oligonucleotide
gtaccacatagcttgcactagcaccgccctgttttga

SEQ ID NO: 148391 - DNA, 36 bp, Artificial Sequence
  Synthetic oligonucleotide
tacacccgctccagacccgtccccagcttttttata

SEQ ID NO: 148392 - DNA, 36 bp, Artificial Sequence
  Synthetic oligonucleotide
tgatgctacccacatgctgattgctccgacgcacta

SEQ ID NO: 148393 - DNA, 35 bp, Artificial Sequence
  Synthetic oligonucleotide
gtacacccgccttacctgtctttttaacgtaccta

SEQ ID NO: 148394 - DNA, 35 bp, Artificial Sequence
  Synthetic oligonucleotide
ttgacccccagctcctgctagcaatggccacttta

SEQ ID NO: 148395 - DNA, 35 bp, Artificial Sequence
  Synthetic oligonucleotide
gacgcaactcgcgtccctgcctaaaaccctaccac

SEQ ID NO: 148396 - DNA, 35 bp, Artificial Sequence
  Synthetic oligonucleotide
atgcgacagacagtcgcccgctaacaacccgcccc

SEQ ID NO: 148397 - DNA, 35 bp, Artificial Sequence
  Synthetic oligonucleotide
ttcgctcctcaattttcgctctccgatccgagccc

SEQ ID NO: 148398 - DNA, 35 bp, Artificial Sequence
  Synthetic oligonucleotide
gtccaccttgcatcatctatatactgtcaacctcc

SEQ ID NO: 148399 - DNA, 35 bp, Artificial Sequence
  Synthetic oligonucleotide
accaccttggctgacactgcgacgtgcgcccctcc

SEQ ID NO: 148400 - DNA, 35 bp, Artificial Sequence
  Synthetic oligonucleotide
atccgtcccgcacattctatctcagtgtcccctcc

SEQ ID NO: 148401 - DNA, 35 bp, Artificial Sequence
  Synthetic oligonucleotide
ttccccgcgccttttcggtggtctatagtccttcc

SEQ ID NO: 148402 - DNA, 35 bp, Artificial Sequence
  Synthetic oligonucleotide
gaggccacctcctgtacctggtatcccccctgggc

SEQ ID NO: 148403 - DNA, 35 bp, Artificial Sequence
  Synthetic oligonucleotide
tggagaccccccgtttaccgttcgcgttcctcctc

SEQ ID NO: 148404 - DNA, 35 bp, Artificial Sequence
  Synthetic oligonucleotide
aacaggtcacctgcacatccgattccctccgtctc

SEQ ID NO: 148405 - DNA, 35 bp, Artificial Sequence
  Synthetic oligonucleotide
gagcacctctatagcgatttctgtttcacattctc

SEQ ID NO: 148406 - DNA, 35 bp, Artificial Sequence
  Synthetic oligonucleotide
agcccgtccacaagcccctataatcctccctcgtc

SEQ ID NO: 148407 - DNA, 35 bp, Artificial Sequence
  Synthetic oligonucleotide
tcaagaccacctcccctcctgtccagctcctggtc

SEQ ID NO: 148408 - DNA, 35 bp, Artificial Sequence
  Synthetic oligonucleotide
atgtcaccccatgcgccgcgtttttagcctatgtc

SEQ ID NO: 148409 - DNA, 35 bp, Artificial Sequence
  Synthetic oligonucleotide
gatctacccccgacgctaccttgtgccgccctgtc

SEQ ID NO: 148410 - DNA, 35 bp, Artificial Sequence
  Synthetic oligonucleotide
tgtaaccatccgttttcgcctgccattcctcgacg

SEQ ID NO: 148411 - DNA, 35 bp, Artificial Sequence
  Synthetic oligonucleotide
tccccgctacaccatcttaatccacgacacatacg

SEQ ID NO: 148412 - DNA, 35 bp, Artificial Sequence
  Synthetic oligonucleotide
atggggggggctttacggggaactgagacggggcg

SEQ ID NO: 148413 - DNA, 35 bp, Artificial Sequence
  Synthetic oligonucleotide
gcccgtcattgtctggtccacgccttctgtcttcg

SEQ ID NO: 148414 - DNA, 35 bp, Artificial Sequence
  Synthetic oligonucleotide
ggcctaacggggacacatgtaactaggtggggagg

SEQ ID NO: 148415 - DNA, 35 bp, Artificial Sequence
  Synthetic oligonucleotide
gaacgagtgggggcgggaggggctcagacaggggg

SEQ ID NO: 148416 - DNA, 32 bp, Artificial Sequence
  Synthetic oligonucleotide
ccgcagggggcatgatggctcctgtctccctg

SEQ ID NO: 148417 - DNA, 35 bp, Artificial Sequence
  Synthetic oligonucleotide
gagataagccgtcctggaatcccctgcctcgcctg

SEQ ID NO: 148418 - DNA, 35 bp, Artificial Sequence
  Synthetic oligonucleotide
atgccacggttacgttgctatgaatcccccactat

SEQ ID NO: 148419 - DNA, 35 bp, Artificial Sequence
  Synthetic oligonucleotide
ttagacccgccagcagaccccagctcgtccactat

SEQ ID NO: 148420 - DNA, 35 bp, Artificial Sequence
  Synthetic oligonucleotide
gccacgactcgccggctcggccttccccagtccct

SEQ ID NO: 148421 - DNA, 34 bp, Artificial Sequence
  Synthetic oligonucleotide
atcagccagccctccgtcctatatagccctgtct

SEQ ID NO: 148422 - DNA, 35 bp, Artificial Sequence
  Synthetic oligonucleotide
gcggggtggggaggaagggaggggagttgcttggt

SEQ ID NO: 148423 - DNA, 35 bp, Artificial Sequence
  Synthetic oligonucleotide
tgagttaccagcattgacgccctcaccccctttgt

SEQ ID NO: 148424 - DNA, 35 bp, Artificial Sequence
  Synthetic oligonucleotide
gtgccagcccgctcgccagactactatctgccatt

SEQ ID NO: 148425 - DNA, 36 bp, Artificial Sequence
  Synthetic oligonucleotide
gacccctccaccatccgtgttaaattacgccgacaa

SEQ ID NO: 148426 - DNA, 35 bp, Artificial Sequence
  Synthetic oligonucleotide
gaagagaacagtggggtgttgcgcgaagggaagaa

SEQ ID NO: 148427 - DNA, 36 bp, Artificial Sequence
  Synthetic oligonucleotide
accctacgcaccggtgttacgtgcgcctacccctaa

SEQ ID NO: 148428 - DNA, 35 bp, Artificial Sequence
  Synthetic oligonucleotide
tcctcaccccccaccaggttctttcatgacgctaa

SEQ ID NO: 148429 - DNA, 36 bp, Artificial Sequence
  Synthetic oligonucleotide
acataggtcccgcccctgccaattagatccacgcca

SEQ ID NO: 148430 - DNA, 37 bp, Artificial Sequence
  Synthetic oligonucleotide
tgcccccgatagccacgcgcgccgatcctccccccga

SEQ ID NO: 148431 - DNA, 37 bp, Artificial Sequence
  Synthetic oligonucleotide
tcccgccgtatcacctttcagcgtcacagttctccga

SEQ ID NO: 148432 - DNA, 36 bp, Artificial Sequence
  Synthetic oligonucleotide
tgatcggcgcacattctaattcccccgccctctcga

SEQ ID NO: 148433 - DNA, 37 bp, Artificial Sequence
  Synthetic oligonucleotide
agtgccgagtggaggaggtacgaggataagggcggga

SEQ ID NO: 148434 - DNA, 37 bp, Artificial Sequence
  Synthetic oligonucleotide
gagaggtgcaaggccggcattgaatagggagggtgga

SEQ ID NO: 148435 - DNA, 38 bp, Artificial Sequence
  Synthetic oligonucleotide
gccccgttgcctccactcgttactgccctgtacaatga

SEQ ID NO: 148436 - DNA, 38 bp, Artificial Sequence
  Synthetic oligonucleotide
acaggggacggaggagggagaatggctggagtagatga

SEQ ID NO: 148437 - DNA, 37 bp, Artificial Sequence
  Synthetic oligonucleotide
tgttgccctccagccgccgcgctttcactcctcctga

SEQ ID NO: 148438 - DNA, 38 bp, Artificial Sequence
  Synthetic oligonucleotide
actaccgcccttctgtgtcaacgacctctctttgctga

SEQ ID NO: 148439 - DNA, 38 bp, Artificial Sequence
  Synthetic oligonucleotide
gagggtggggagggcggtatgtagctgggctatggtga

SEQ ID NO: 148440 - DNA, 37 bp, Artificial Sequence
  Synthetic oligonucleotide
acccttgccccctttcgtgcacgcgatctctctttga

SEQ ID NO: 148441 - DNA, 38 bp, Artificial Sequence
  Synthetic oligonucleotide
gctggccgcacattgcattcgacccccgccctgtttga

SEQ ID NO: 148442 - DNA, 36 bp, Artificial Sequence
  Synthetic oligonucleotide
tcagaggaacgaggggaagggccggataacgttata

SEQ ID NO: 148443 - DNA, 35 bp, Artificial Sequence
  Synthetic oligonucleotide
ttcatccctctgttttacgtcgcgtggtcgcccta

SEQ ID NO: 148444 - DNA, 36 bp, Artificial Sequence
  Synthetic oligonucleotide
ttcgacgactcgccaactgtaacacctggtgcccta

SEQ ID NO: 148445 - DNA, 36 bp, Artificial Sequence
  Synthetic oligonucleotide
tacgtggccttgcatctgcctttacgccttcctcta

SEQ ID NO: 148446 - DNA, 35 bp, Artificial Sequence
  Synthetic oligonucleotide
gccaccccgcgtcctcatcttgccttctacgagta

SEQ ID NO: 148447 - DNA, 36 bp, Artificial Sequence
  Synthetic oligonucleotide
accatcctccgcgtccgtctcctttgtaacatcgta

SEQ ID NO: 148448 - DNA, 35 bp, Artificial Sequence
  Synthetic oligonucleotide
tcccactacacctttttaacggagcagttcaccac

SEQ ID NO: 148449 - DNA, 35 bp, Artificial Sequence
  Synthetic oligonucleotide
ggggccttaaggggcggggtaggacatagggggac

SEQ ID NO: 148450 - DNA, 35 bp, Artificial Sequence
  Synthetic oligonucleotide
tcacctctctctcaaagtgccgcttatatgccacc

SEQ ID NO: 148451 - DNA, 35 bp, Artificial Sequence
  Synthetic oligonucleotide
agtaccagtccctcaccatcggcttccgttccacc

SEQ ID NO: 148452 - DNA, 35 bp, Artificial Sequence
  Synthetic oligonucleotide
accccacctggtccttctgcttactatattgtacc

SEQ ID NO: 148453 - DNA, 35 bp, Artificial Sequence
  Synthetic oligonucleotide
atccctacgtcaggcaagcctttaacctgcccccc

SEQ ID NO: 148454 - DNA, 35 bp, Artificial Sequence
  Synthetic oligonucleotide
acacctgtccccaacgcgtggttagccatcccccc

SEQ ID NO: 148455 - DNA, 35 bp, Artificial Sequence
  Synthetic oligonucleotide
tccgctcggccagtacgaattcaatccctgtcgcc

SEQ ID NO: 148456 - DNA, 35 bp, Artificial Sequence
  Synthetic oligonucleotide
tctcaggccctggtctgtagtacgcacattcctcc

SEQ ID NO: 148457 - DNA, 35 bp, Artificial Sequence
  Synthetic oligonucleotide
tccaacggcgcttctgcctttccgtttacctttcc

SEQ ID NO: 148458 - DNA, 35 bp, Artificial Sequence
  Synthetic oligonucleotide
accatgtaaccatgctcgccgctatacgcctccgc

SEQ ID NO: 148459 - DNA, 35 bp, Artificial Sequence
  Synthetic oligonucleotide
atgcgcgaacgctccactgttgtctgaactctcgc

SEQ ID NO: 148460 - DNA, 35 bp, Artificial Sequence
  Synthetic oligonucleotide
gcgcaccacacgccctcgtgtcttggccttactgc

SEQ ID NO: 148461 - DNA, 36 bp, Artificial Sequence
  Synthetic oligonucleotide
tcccaggcccgccctcaccttaaggtcttcgtgctc

SEQ ID NO: 148462 - DNA, 35 bp, Artificial Sequence
  Synthetic oligonucleotide
tccccctcggtgtcgttttcattcttctgttcgtc

SEQ ID NO: 148463 - DNA, 35 bp, Artificial Sequence
  Synthetic oligonucleotide
gatccacccgccactcaccatcttagatttcggtc

SEQ ID NO: 148464 - DNA, 35 bp, Artificial Sequence
  Synthetic oligonucleotide
tatcccgccacaaccgccctgccaggctttccttc

SEQ ID NO: 148465 - DNA, 35 bp, Artificial Sequence
  Synthetic oligonucleotide
taccggaccgccgccgtatcatcgtccacccgttc

SEQ ID NO: 148466 - DNA, 35 bp, Artificial Sequence
  Synthetic oligonucleotide
ttagccctactactcgccccgtttggagccttttc

SEQ ID NO: 148467 - DNA, 35 bp, Artificial Sequence
  Synthetic oligonucleotide
tagatgcgaagcaacccgccgtacttccgccctcg

SEQ ID NO: 148468 - DNA, 32 bp, Artificial Sequence
  Synthetic oligonucleotide
attcctacgccccggtcctctccttggtaatg

SEQ ID NO: 148469 - DNA, 35 bp, Artificial Sequence
  Synthetic oligonucleotide
tgttcgtcactataccgcgctctaccttagccctg

SEQ ID NO: 148470 - DNA, 35 bp, Artificial Sequence
  Synthetic oligonucleotide
gattcgtcccctcgccactgtctatactacgtctg

SEQ ID NO: 148471 - DNA, 35 bp, Artificial Sequence
  Synthetic oligonucleotide
gaatcaggggggaactatatgacgcgggaggggtg

SEQ ID NO: 148472 - DNA, 35 bp, Artificial Sequence
  Synthetic oligonucleotide
tccgcacatgatgtacaatctccgcctccctattg

SEQ ID NO: 148473 - DNA, 35 bp, Artificial Sequence
  Synthetic oligonucleotide
accactcccgtgagagttttacccctgattcacat

SEQ ID NO: 148474 - DNA, 35 bp, Artificial Sequence
  Synthetic oligonucleotide
tcgcatccagtggtaccactgctctctcgctccat

SEQ ID NO: 148475 - DNA, 35 bp, Artificial Sequence
  Synthetic oligonucleotide
gcaatcttcccgcacgcaattctgtaccattccat

SEQ ID NO: 148476 - DNA, 35 bp, Artificial Sequence
  Synthetic oligonucleotide
aaccgaccccgcctccaaccatcacatggaatgat

SEQ ID NO: 148477 - DNA, 35 bp, Artificial Sequence
  Synthetic oligonucleotide
gatcgcccctatcctcgctttaatgccggagtcct

SEQ ID NO: 148478 - DNA, 35 bp, Artificial Sequence
  Synthetic oligonucleotide
atgaagggcgggagggagaggataggcccgatagt

SEQ ID NO: 148479 - DNA, 35 bp, Artificial Sequence
  Synthetic oligonucleotide
ttagcaacccacgtgtgccatcgcccccccctagt

SEQ ID NO: 148480 - DNA, 35 bp, Artificial Sequence
  Synthetic oligonucleotide
tagccgcttctctcaccttgtcccactgtccccgt

SEQ ID NO: 148481 - DNA, 35 bp, Artificial Sequence
  Synthetic oligonucleotide
atcgctcccctcttccctgtaccctgccatgtgtt

SEQ ID NO: 148482 - DNA, 35 bp, Artificial Sequence
  Synthetic oligonucleotide
aatcgttacccgcccagtcctgcctcgtccctaaa

SEQ ID NO: 148483 - DNA, 36 bp, Artificial Sequence
  Synthetic oligonucleotide
tatccgatccatgctacctctccgatcacagtttaa

SEQ ID NO: 148484 - DNA, 35 bp, Artificial Sequence
  Synthetic oligonucleotide
atggctcccgccccagtttcggttatcgctccaca

SEQ ID NO: 148485 - DNA, 36 bp, Artificial Sequence
  Synthetic oligonucleotide
gcagtctccatcctgccgtaaacgttttctgtacca

SEQ ID NO: 148486 - DNA, 35 bp, Artificial Sequence
  Synthetic oligonucleotide
tccatcctccgctcccggtctcttcaggccgccca

SEQ ID NO: 148487 - DNA, 36 bp, Artificial Sequence
  Synthetic oligonucleotide
gtcccgcaccctagttccaatagcacctgttgtcca

SEQ ID NO: 148488 - DNA, 36 bp, Artificial Sequence
  Synthetic oligonucleotide
tgcccgctcacggaattcccgcacccctccctcgca

SEQ ID NO: 148489 - DNA, 35 bp, Artificial Sequence
  Synthetic oligonucleotide
aacaccgcgctgcccacccttccgccttggttgca

SEQ ID NO: 148490 - DNA, 35 bp, Artificial Sequence
  Synthetic oligonucleotide
gacatgtacgacattcgtttagccactaccactca

SEQ ID NO: 148491 - DNA, 35 bp, Artificial Sequence
  Synthetic oligonucleotide
gtccacatgccgccctgtctatccatccacgctca

SEQ ID NO: 148492 - DNA, 34 bp, Artificial Sequence
  Synthetic oligonucleotide
gccatcagcgctctgtcttttccctcgccgctca

SEQ ID NO: 148493 - DNA, 35 bp, Artificial Sequence
  Synthetic oligonucleotide
tgccgagctgaattcctgggccacttgtttcttca

SEQ ID NO: 148494 - DNA, 35 bp, Artificial Sequence
  Synthetic oligonucleotide
gtcgtaccagtttccccgtaccatcccgtgtttca

SEQ ID NO: 148495 - DNA, 37 bp, Artificial Sequence
  Synthetic oligonucleotide
gtaagacacaggagggaagttgcaggcgggtagaaga

SEQ ID NO: 148496 - DNA, 37 bp, Artificial Sequence
  Synthetic oligonucleotide
aatggcggaggaggagggtcaggggacgttgagcaga

SEQ ID NO: 148497 - DNA, 35 bp, Artificial Sequence
  Synthetic oligonucleotide
tgcgacggggtgggtgaatggcataggggggtaga

SEQ ID NO: 148498 - DNA, 37 bp, Artificial Sequence
  Synthetic oligonucleotide
gggagaacacagtgatagggggggtggggcgccgcga

SEQ ID NO: 148499 - DNA, 37 bp, Artificial Sequence
  Synthetic oligonucleotide
agcactcgctctcctgtctaatcctcgttcctatcga

SEQ ID NO: 148500 - DNA, 36 bp, Artificial Sequence
  Synthetic oligonucleotide
tgtcctgtcgtcactgccatacgctccactactcga

SEQ ID NO: 148501 - DNA, 37 bp, Artificial Sequence
  Synthetic oligonucleotide
atccgccccttcacagttaacacaatttcctccagga

SEQ ID NO: 148502 - DNA, 35 bp, Artificial Sequence
  Synthetic oligonucleotide
gacggacttccgcttttgtcaccacaccccctgga

SEQ ID NO: 148503 - DNA, 35 bp, Artificial Sequence
  Synthetic oligonucleotide
gccacctatttgaattgtgccatcctttccgtgga

SEQ ID NO: 148504 - DNA, 38 bp, Artificial Sequence
  Synthetic oligonucleotide
actggagacggggtagggggcgggatgggctgggctga

SEQ ID NO: 148505 - DNA, 37 bp, Artificial Sequence
  Synthetic oligonucleotide
gacacccggccatcttgccttttcgctccatctctga

SEQ ID NO: 148506 - DNA, 37 bp, Artificial Sequence
  Synthetic oligonucleotide
ggacacccatcgctatatctatccatccgtccattga

SEQ ID NO: 148507 - DNA, 38 bp, Artificial Sequence
  Synthetic oligonucleotide
acctcagcctcctgttccaccacgccctgcctgattga

SEQ ID NO: 148508 - DNA, 38 bp, Artificial Sequence
  Synthetic oligonucleotide
gctccccgcctgctccctcccaatttcgtcaggcttga

SEQ ID NO: 148509 - DNA, 38 bp, Artificial Sequence
  Synthetic oligonucleotide
tgccggtctcgcctgcctgcaaccttcccacactttga

SEQ ID NO: 148510 - DNA, 36 bp, Artificial Sequence
  Synthetic oligonucleotide
gtttgcgccccccctgtaagcccgcctggttgacta

SEQ ID NO: 148511 - DNA, 36 bp, Artificial Sequence
  Synthetic oligonucleotide
tattcacgccctgaatgttgctccccgtaaccccta

SEQ ID NO: 148512 - DNA, 36 bp, Artificial Sequence
  Synthetic oligonucleotide
gcgcatccccgtgcgctattttccccgcttgtatta

SEQ ID NO: 148513 - DNA, 34 bp, Artificial Sequence
  Synthetic oligonucleotide
tattccacaccggagtgcgccaccctcgtataac

SEQ ID NO: 148514 - DNA, 35 bp, Artificial Sequence
  Synthetic oligonucleotide
gcaatgacacgctacatcctgtcccacgctttcac

SEQ ID NO: 148515 - DNA, 35 bp, Artificial Sequence
  Synthetic oligonucleotide
tccccctaccatcacatcctgtcactgctacatac

SEQ ID NO: 148516 - DNA, 35 bp, Artificial Sequence
  Synthetic oligonucleotide
acatgcgctgctctgctacatatctcggcctgtac

SEQ ID NO: 148517 - DNA, 35 bp, Artificial Sequence
  Synthetic oligonucleotide
gcctgctcctcagcgccgcaatatgcagttctacc

SEQ ID NO: 148518 - DNA, 35 bp, Artificial Sequence
  Synthetic oligonucleotide
aatcacgcaggaagtccttatttcggtttcccccc

SEQ ID NO: 148519 - DNA, 35 bp, Artificial Sequence
  Synthetic oligonucleotide
tgactcgaccggtctatcaccctgatccccctccc

SEQ ID NO: 148520 - DNA, 35 bp, Artificial Sequence
  Synthetic oligonucleotide
gacaactgcccccactaccaatccccaggcgagcc

SEQ ID NO: 148521 - DNA, 35 bp, Artificial Sequence
  Synthetic oligonucleotide
tcccccgcccgattttaatcttgctcgaggtctcc

SEQ ID NO: 148522 - DNA, 35 bp, Artificial Sequence
  Synthetic oligonucleotide
acccccagcgttacggtttctctcggcatgtctcc

SEQ ID NO: 148523 - DNA, 35 bp, Artificial Sequence
  Synthetic oligonucleotide
tagcacaactgtcccatcaaacccgacttagcggc

SEQ ID NO: 148524 - DNA, 35 bp, Artificial Sequence
  Synthetic oligonucleotide
ccgaaccctcgcaccatcatcgcccgtcgtgactc

SEQ ID NO: 148525 - DNA, 35 bp, Artificial Sequence
  Synthetic oligonucleotide
ttggttagcggaccgtccatgcctcacccctcctc

SEQ ID NO: 148526 - DNA, 35 bp, Artificial Sequence
  Synthetic oligonucleotide
tacgatggtcattgccatatttgccctcctagttc

SEQ ID NO: 148527 - DNA, 35 bp, Artificial Sequence
  Synthetic oligonucleotide
gtctcacgtcttgcagcgctatgcaccacctgttc

SEQ ID NO: 148528 - DNA, 35 bp, Artificial Sequence
  Synthetic oligonucleotide
tgacgcgcgtgtgggccttatcactctcttctttc

SEQ ID NO: 148529 - DNA, 35 bp, Artificial Sequence
  Synthetic oligonucleotide
tgcatcgccttcgtttaggccttgctacccgtttc

SEQ ID NO: 148530 - DNA, 35 bp, Artificial Sequence
  Synthetic oligonucleotide
gcgctccgaacccagtccaccatcacctcatgccg

SEQ ID NO: 148531 - DNA, 35 bp, Artificial Sequence
  Synthetic oligonucleotide
gccctacgcagtcggaataattagcctcccgtccg

SEQ ID NO: 148532 - DNA, 35 bp, Artificial Sequence
  Synthetic oligonucleotide
acccagcccttgtagttcactgtagcttcccatcg

SEQ ID NO: 148533 - DNA, 35 bp, Artificial Sequence
  Synthetic oligonucleotide
gcacccaccatcgtgcctgaccgcttccctcttcg

SEQ ID NO: 148534 - DNA, 35 bp, Artificial Sequence
  Synthetic oligonucleotide
agtccagctgctccattctcccctccttgcttcgg

SEQ ID NO: 148535 - DNA, 35 bp, Artificial Sequence
  Synthetic oligonucleotide
acgaccccagaccgcaaagtacacgccctctaact

SEQ ID NO: 148536 - DNA, 35 bp, Artificial Sequence
  Synthetic oligonucleotide
tgcacgtcatgagtactgccatctctccctccact

SEQ ID NO: 148537 - DNA, 35 bp, Artificial Sequence
  Synthetic oligonucleotide
atacacacctgcgccgatttctatacctccctcct

SEQ ID NO: 148538 - DNA, 35 bp, Artificial Sequence
  Synthetic oligonucleotide
atcgagcgcttggtccctttccccgtactggcctt

SEQ ID NO: 148539 - DNA, 34 bp, Artificial Sequence
  Synthetic oligonucleotide
agacagggggggagcggggaatggcgataaagtt

SEQ ID NO: 148540 - DNA, 35 bp, Artificial Sequence
  Synthetic oligonucleotide
tctcccgcctcccgagtaccgatatcccgaatttt

SEQ ID NO: 148541 - DNA, 36 bp, Artificial Sequence
  Synthetic oligonucleotide
acccaccctctcctgtaacttaatgctccttggaaa

SEQ ID NO: 148542 - DNA, 35 bp, Artificial Sequence
  Synthetic oligonucleotide
gaccactcgaattggcgctacacctcgtcccccaa

SEQ ID NO: 148543 - DNA, 36 bp, Artificial Sequence
  Synthetic oligonucleotide
tcacgccaaccccgctagcatgcctacaccagccaa

SEQ ID NO: 148544 - DNA, 36 bp, Artificial Sequence
  Synthetic oligonucleotide
atcacagatcgggctgccggtccttctcgcctccaa

SEQ ID NO: 148545 - DNA, 36 bp, Artificial Sequence
  Synthetic oligonucleotide
gcgctccaccccgccgttggcttgccttccttcaca

SEQ ID NO: 148546 - DNA, 35 bp, Artificial Sequence
  Synthetic oligonucleotide
gacgctcccgcctttttatggaccttaattctaca

SEQ ID NO: 148547 - DNA, 36 bp, Artificial Sequence
  Synthetic oligonucleotide
gcgcatccccgctttcctctatttatccggttgcca

SEQ ID NO: 148548 - DNA, 35 bp, Artificial Sequence
  Synthetic oligonucleotide
gcgaccgtcgacccgagctatttcgcctccttcca

SEQ ID NO: 148549 - DNA, 36 bp, Artificial Sequence
  Synthetic oligonucleotide
tgccgacgtacgtcttgtttctacctcctatgtgca

SEQ ID NO: 148550 - DNA, 37 bp, Artificial Sequence
  Synthetic oligonucleotide
ttcgaccccgcaaatccctcgagcccagttatgctca

SEQ ID NO: 148551 - DNA, 36 bp, Artificial Sequence
  Synthetic oligonucleotide
gcctacccacgtattaccttacagtccccttgctca

SEQ ID NO: 148552 - DNA, 37 bp, Artificial Sequence
  Synthetic oligonucleotide
tagatcggtgctgcgtgcttctcatggccccccccga

SEQ ID NO: 148553 - DNA, 37 bp, Artificial Sequence
  Synthetic oligonucleotide
ggggaggggcagggggggacaggaagcgggccggcga

SEQ ID NO: 148554 - DNA, 36 bp, Artificial Sequence
  Synthetic oligonucleotide
tccacccgctaccaccgaatctgatcgcctgtgcga

SEQ ID NO: 148555 - DNA, 37 bp, Artificial Sequence
  Synthetic oligonucleotide
tgttgaccccgccctgtccgccacgcgatgtcctcga

SEQ ID NO: 148556 - DNA, 37 bp, Artificial Sequence
  Synthetic oligonucleotide
gggaagggaaggccgggtgcgtgcagggacgaaggga

SEQ ID NO: 148557 - DNA, 37 bp, Artificial Sequence
  Synthetic oligonucleotide
tagtgacgaagtatggggggttagtggggaagaggga

SEQ ID NO: 148558 - DNA, 37 bp, Artificial Sequence
  Synthetic oligonucleotide
gaccgcccgccctcctagatccttcccaaccactgga

SEQ ID NO: 148559 - DNA, 38 bp, Artificial Sequence
  Synthetic oligonucleotide
aacccgcccaccctctgacgtcgtacttgatcctatga

SEQ ID NO: 148560 - DNA, 37 bp, Artificial Sequence
  Synthetic oligonucleotide
gcaggagcgaaagtaggagggttagggggggaagtga

SEQ ID NO: 148561 - DNA, 37 bp, Artificial Sequence
  Synthetic oligonucleotide
ttggatcaggggcgggggttaatgcggggtggagtga

SEQ ID NO: 148562 - DNA, 35 bp, Artificial Sequence
  Synthetic oligonucleotide
tgcacttgcccctcctgccaccttattagacgtga

SEQ ID NO: 148563 - DNA, 37 bp, Artificial Sequence
  Synthetic oligonucleotide
ttgagccatagggggggtgagggccgatggagggtga

SEQ ID NO: 148564 - DNA, 37 bp, Artificial Sequence
  Synthetic oligonucleotide
tcaccctagcccgattcgctaacattgcctgccttga

SEQ ID NO: 148565 - DNA, 35 bp, Artificial Sequence
  Synthetic oligonucleotide
gtggatgaggaggggggccgaggaggtacgtttga

SEQ ID NO: 148566 - DNA, 37 bp, Artificial Sequence
  Synthetic oligonucleotide
gaacccgctccgagcttttcctagccttctcttttga

SEQ ID NO: 148567 - DNA, 36 bp, Artificial Sequence
  Synthetic oligonucleotide
aaccaagcagtcacggccgtcccccatgttcccgta

SEQ ID NO: 148568 - DNA, 35 bp, Artificial Sequence
  Synthetic oligonucleotide
gtatccgggtggggaaactgcgggtggggtgctac

SEQ ID NO: 148569 - DNA, 35 bp, Artificial Sequence
  Synthetic oligonucleotide
gacttcagaatacgccgcccgctcccctacggtac

SEQ ID NO: 148570 - DNA, 35 bp, Artificial Sequence
  Synthetic oligonucleotide
acatagcgctggaccctattcccttggcttcgacc

SEQ ID NO: 148571 - DNA, 35 bp, Artificial Sequence
  Synthetic oligonucleotide
gcccgcccctgccgctaccgcccccctcggggacc

SEQ ID NO: 148572 - DNA, 35 bp, Artificial Sequence
  Synthetic oligonucleotide
tctgcgccgatgatccgtcacctgtttcacgcgcc

SEQ ID NO: 148573 - DNA, 35 bp, Artificial Sequence
  Synthetic oligonucleotide
tacctcctgatctcaccgccgtgtacattcttgcc

SEQ ID NO: 148574 - DNA, 35 bp, Artificial Sequence
  Synthetic oligonucleotide
gcgtcgtccggtcggtcctgcgctttatcctgtcc

SEQ ID NO: 148575 - DNA, 35 bp, Artificial Sequence
  Synthetic oligonucleotide
gcatgtgcacgaggggtggaggggggatatcgagc

SEQ ID NO: 148576 - DNA, 35 bp, Artificial Sequence
  Synthetic oligonucleotide
aaactccgccccgcatctagtccagagctccccgc

SEQ ID NO: 148577 - DNA, 35 bp, Artificial Sequence
  Synthetic oligonucleotide
actgtgtacatacgcccgttttctccgcctctcgc

SEQ ID NO: 148578 - DNA, 35 bp, Artificial Sequence
  Synthetic oligonucleotide
acaacacctctttcggtatactgctcactttaggc

SEQ ID NO: 148579 - DNA, 34 bp, Artificial Sequence
  Synthetic oligonucleotide
tcaccgccgccttcgtctacgactccgcgcatgc

SEQ ID NO: 148580 - DNA, 35 bp, Artificial Sequence
  Synthetic oligonucleotide
gacccgcctctcttcgcactacagacccaacaatc

SEQ ID NO: 148581 - DNA, 35 bp, Artificial Sequence
  Synthetic oligonucleotide
tgcggtagcctgccccccctcgtgtcggtcatatc

SEQ ID NO: 148582 - DNA, 35 bp, Artificial Sequence
  Synthetic oligonucleotide
gttccactggcgcatgtctggtaccccatcccctc

SEQ ID NO: 148583 - DNA, 35 bp, Artificial Sequence
  Synthetic oligonucleotide
gaatggccacccccataccgcaccgcttgttgctc

SEQ ID NO: 148584 - DNA, 35 bp, Artificial Sequence
  Synthetic oligonucleotide
tcccccattccgtcgtttcgtagccccgggctctc

SEQ ID NO: 148585 - DNA, 35 bp, Artificial Sequence
  Synthetic oligonucleotide
gcgcctcccctcatcccctcgctttacgcggagtc

SEQ ID NO: 148586 - DNA, 35 bp, Artificial Sequence
  Synthetic oligonucleotide
acggatacgccgcctcgctatgccttgttccggtc

SEQ ID NO: 148587 - DNA, 35 bp, Artificial Sequence
  Synthetic oligonucleotide
agctccatcatgccgaccgttgtttcgttcttttc

SEQ ID NO: 148588 - DNA, 35 bp, Artificial Sequence
  Synthetic oligonucleotide
tcgatgatgtgttgtctctcgtccctgtccgcacg

SEQ ID NO: 148589 - DNA, 35 bp, Artificial Sequence
  Synthetic oligonucleotide
gttcgttccctcgttgtgcgcccctcgatcaatcg

SEQ ID NO: 148590 - DNA, 35 bp, Artificial Sequence
  Synthetic oligonucleotide
tccaacccgcgtaagtccaccgttccttcaattcg

SEQ ID NO: 148591 - DNA, 35 bp, Artificial Sequence
  Synthetic oligonucleotide
accgacaccttaactgtttctgcaacaccccgact

SEQ ID NO: 148592 - DNA, 35 bp, Artificial Sequence
  Synthetic oligonucleotide
tacgcctatcccccctggttcacgaaacgagtact

SEQ ID NO: 148593 - DNA, 35 bp, Artificial Sequence
  Synthetic oligonucleotide
gaccccgcccgactgccattcgccatctattagct

SEQ ID NO: 148594 - DNA, 35 bp, Artificial Sequence
  Synthetic oligonucleotide
taaactcgcaccaccgtcgttcgccgcccccatct

SEQ ID NO: 148595 - DNA, 35 bp, Artificial Sequence
  Synthetic oligonucleotide
tcgcgtagcccatcctgctctcagtactgccttct

SEQ ID NO: 148596 - DNA, 35 bp, Artificial Sequence
  Synthetic oligonucleotide
tgcgtgcctggtcctcgttccctgattgttctcgt

SEQ ID NO: 148597 - DNA, 35 bp, Artificial Sequence
  Synthetic oligonucleotide
gctcggggtgggggggggaaccagggaaacgacaa

SEQ ID NO: 148598 - DNA, 36 bp, Artificial Sequence
  Synthetic oligonucleotide
gtagtcgccttagatcgtccctccacctcttgccaa

SEQ ID NO: 148599 - DNA, 36 bp, Artificial Sequence
  Synthetic oligonucleotide
ggaaagatgaaggggggcatgggcatggggaagcaa

SEQ ID NO: 148600 - DNA, 36 bp, Artificial Sequence
  Synthetic oligonucleotide
tgacgccccttccgcaccgaaccgctccgacgctaa

SEQ ID NO: 148601 - DNA, 36 bp, Artificial Sequence
  Synthetic oligonucleotide
tgatcgcaacatcctcagcgggctatgcctccaaca

SEQ ID NO: 148602 - DNA, 36 bp, Artificial Sequence
  Synthetic oligonucleotide
tcgacaccctctattcgctttctctcacgcacggca

SEQ ID NO: 148603 - DNA, 35 bp, Artificial Sequence
  Synthetic oligonucleotide
gcgccgcaatctgctggttttcttcggtcccctca

SEQ ID NO: 148604 - DNA, 37 bp, Artificial Sequence
  Synthetic oligonucleotide
gagagatgggaatgggaaaaaggggcaaaagatgaga

SEQ ID NO: 148605 - DNA, 37 bp, Artificial Sequence
  Synthetic oligonucleotide
tcaggaggaccacgatgagtggaggggggaagggcga

SEQ ID NO: 148606 - DNA, 37 bp, Artificial Sequence
  Synthetic oligonucleotide
gtggtggtgagggtgggtgaaaagcactaacaacgga

SEQ ID NO: 148607 - DNA, 37 bp, Artificial Sequence
  Synthetic oligonucleotide
tcccgggggaggtaggattagtggaaaacgggaggga

SEQ ID NO: 148608 - DNA, 37 bp, Artificial Sequence
  Synthetic oligonucleotide
tattggggtgggtgtcttatggggtgagtgctgggga

SEQ ID NO: 148609 - DNA, 37 bp, Artificial Sequence
  Synthetic oligonucleotide
tacgacctggttagggtggggggaacggggaactgga

SEQ ID NO: 148610 - DNA, 37 bp, Artificial Sequence
  Synthetic oligonucleotide
ggttggggggagtggaggtgacaattggaagtgtgga

SEQ ID NO: 148611 - DNA, 37 bp, Artificial Sequence
  Synthetic oligonucleotide
gggggaggggggaacggatgggacacaacggtttgga

SEQ ID NO: 148612 - DNA, 37 bp, Artificial Sequence
  Synthetic oligonucleotide
agcccctacgccatagtccagctactaccacgactga

SEQ ID NO: 148613 - DNA, 38 bp, Artificial Sequence
  Synthetic oligonucleotide
agcggtcaccctcctgcgcccaggcctctctgccctga

SEQ ID NO: 148614 - DNA, 38 bp, Artificial Sequence
  Synthetic oligonucleotide
ttgtgcccctccatgatacctccgccctatgatcgtga

SEQ ID NO: 148615 - DNA, 38 bp, Artificial Sequence
  Synthetic oligonucleotide
accatccggtggtttggagggggagtggagggaggtga

SEQ ID NO: 148616 - DNA, 38 bp, Artificial Sequence
  Synthetic oligonucleotide
tgcatgggtgggtggggttagtatgcgtgggacattga

SEQ ID NO: 148617 - DNA, 37 bp, Artificial Sequence
  Synthetic oligonucleotide
gtccacagctctagcgccttttttcgacccctcttga

SEQ ID NO: 148618 - DNA, 38 bp, Artificial Sequence
  Synthetic oligonucleotide
ttgtgcctgcctaacgtcgttttcgctcctttctttga

SEQ ID NO: 148619 - DNA, 35 bp, Artificial Sequence
  Synthetic oligonucleotide
gccccactggtccggtcctgctcttaaattcccta

SEQ ID NO: 148620 - DNA, 36 bp, Artificial Sequence
  Synthetic oligonucleotide
gtgttcctgcctcttcgtgtcgttcttcgctaatta

SEQ ID NO: 148621 - DNA, 35 bp, Artificial Sequence
  Synthetic oligonucleotide
acactacgtccggctccacacttatgatcttccac

SEQ ID NO: 148622 - DNA, 35 bp, Artificial Sequence
  Synthetic oligonucleotide
gtcctctgcctcctatttactactgcacggctccc

SEQ ID NO: 148623 - DNA, 35 bp, Artificial Sequence
  Synthetic oligonucleotide
atcgcactggcgtcagaggcccccctttcgtctcc

SEQ ID NO: 148624 - DNA, 35 bp, Artificial Sequence
  Synthetic oligonucleotide
gtgttgtgggctctgtttcttctctccacgtttcc

SEQ ID NO: 148625 - DNA, 35 bp, Artificial Sequence
  Synthetic oligonucleotide
gcccgccctcccgcatctgtttcttcgtttgcctc

SEQ ID NO: 148626 - DNA, 35 bp, Artificial Sequence
  Synthetic oligonucleotide
gccgagtccacacgcggtctcccgttactacgctc

SEQ ID NO: 148627 - DNA, 35 bp, Artificial Sequence
  Synthetic oligonucleotide
gactccgcaacccggtcccacttgccataccgctc

SEQ ID NO: 148628 - DNA, 35 bp, Artificial Sequence
  Synthetic oligonucleotide
gcgcaacgcccgcgcattgcatctcaacatttctc

SEQ ID NO: 148629 - DNA, 35 bp, Artificial Sequence
  Synthetic oligonucleotide
atgcctcacctctgcaggtaatgacgctccccgtc

SEQ ID NO: 148630 - DNA, 35 bp, Artificial Sequence
  Synthetic oligonucleotide
gaagttgccctcctgcctttttatgtcgctggttc

SEQ ID NO: 148631 - DNA, 35 bp, Artificial Sequence
  Synthetic oligonucleotide
tatcccgttaccgttaccgcccgcccctaaagggg

SEQ ID NO: 148632 - DNA, 35 bp, Artificial Sequence
  Synthetic oligonucleotide
gacacagcatagggtagggctaaggtggaggtggg

SEQ ID NO: 148633 - DNA, 35 bp, Artificial Sequence
  Synthetic oligonucleotide
aagcgcctcctgtcgcccttcctataccttgctgg

SEQ ID NO: 148634 - DNA, 35 bp, Artificial Sequence
  Synthetic oligonucleotide
aagtggagaaggggggggaaggaccaaatactcat

SEQ ID NO: 148635 - DNA, 35 bp, Artificial Sequence
  Synthetic oligonucleotide
ttggtgcctccgtcgcggcgtgcaggtttccatct

SEQ ID NO: 148636 - DNA, 35 bp, Artificial Sequence
  Synthetic oligonucleotide
tatgcgccagttagtcagcgcctccgaattcctct

SEQ ID NO: 148637 - DNA, 35 bp, Artificial Sequence
  Synthetic oligonucleotide
tgagcctgccacgcaatctctgtcaactgctttct

SEQ ID NO: 148638 - DNA, 35 bp, Artificial Sequence
  Synthetic oligonucleotide
atcgacacctttcccctcagtgcttttgacctcgt

SEQ ID NO: 148639 - DNA, 34 bp, Artificial Sequence
  Synthetic oligonucleotide
tgagcgccctgcccggttacatcgacctgacttt

SEQ ID NO: 148640 - DNA, 35 bp, Artificial Sequence
  Synthetic oligonucleotide
agtacccgccccgtcgtatcctcctcatatgctaa

SEQ ID NO: 148641 - DNA, 36 bp, Artificial Sequence
  Synthetic oligonucleotide
gacgctcctccatgcatggttccacgcacctcttaa

SEQ ID NO: 148642 - DNA, 34 bp, Artificial Sequence
  Synthetic oligonucleotide
taggtaggccggcctcattgttccgttgtcgaca

SEQ ID NO: 148643 - DNA, 36 bp, Artificial Sequence
  Synthetic oligonucleotide
ggtggggtgagccgcctaaagggtgggagggtgaca

SEQ ID NO: 148644 - DNA, 36 bp, Artificial Sequence
  Synthetic oligonucleotide
gccgaacgccatctgcacacattttccctggctaca

SEQ ID NO: 148645 - DNA, 36 bp, Artificial Sequence
  Synthetic oligonucleotide
accctgccctaccacaagcttacggacactccccca

SEQ ID NO: 148646 - DNA, 36 bp, Artificial Sequence
  Synthetic oligonucleotide
tgattcccatggccgcccccgtagcatcctcgccca

SEQ ID NO: 148647 - DNA, 36 bp, Artificial Sequence
  Synthetic oligonucleotide
tccgacgctttgcactgtaatctaccctaccacgca

SEQ ID NO: 148648 - DNA, 35 bp, Artificial Sequence
  Synthetic oligonucleotide
gcctgacgcacataccccatagcttcgttacatca

SEQ ID NO: 148649 - DNA, 36 bp, Artificial Sequence
  Synthetic oligonucleotide
tcactgtccgccaatgcacccccccacccatcaaga

SEQ ID NO: 148650 - DNA, 36 bp, Artificial Sequence
  Synthetic oligonucleotide
gtgggggaccggatgggggagcattgagtagtcaga

SEQ ID NO: 148651 - DNA, 37 bp, Artificial Sequence
  Synthetic oligonucleotide
gtgacaccggtcagccaccccctatttgaccacacga

SEQ ID NO: 148652 - DNA, 37 bp, Artificial Sequence
  Synthetic oligonucleotide
gtaacccctccgtgatcgccaccctctgacaagacga

SEQ ID NO: 148653 - DNA, 37 bp, Artificial Sequence
  Synthetic oligonucleotide
gaccctctgcccttttgtgacctctactcctatccga

SEQ ID NO: 148654 - DNA, 37 bp, Artificial Sequence
  Synthetic oligonucleotide
cccgcccagccacgctttcgttattcgcctctttcga

SEQ ID NO: 148655 - DNA, 37 bp, Artificial Sequence
  Synthetic oligonucleotide
gaggatgggggggtgacgcggggcgggggagttagga

SEQ ID NO: 148656 - DNA, 37 bp, Artificial Sequence
  Synthetic oligonucleotide
tggtggacggggggacgcaaggtgggtgggtatggga

SEQ ID NO: 148657 - DNA, 35 bp, Artificial Sequence
  Synthetic oligonucleotide
acccttccacccatcgaatcggtccagtcctggga

SEQ ID NO: 148658 - DNA, 38 bp, Artificial Sequence
  Synthetic oligonucleotide
gccctgccgactctccttgcgttctttgcctgtcatga

SEQ ID NO: 148659 - DNA, 36 bp, Artificial Sequence
  Synthetic oligonucleotide
tccacgctccgaccattgctctctccaggccgctga

SEQ ID NO: 148660 - DNA, 38 bp, Artificial Sequence
  Synthetic oligonucleotide
accacccgatcctgccctcctgcacatgtgctccgtga

SEQ ID NO: 148661 - DNA, 38 bp, Artificial Sequence
  Synthetic oligonucleotide
tgttcaccccagcccgccttttccacgacacactgtga

SEQ ID NO: 148662 - DNA, 35 bp, Artificial Sequence
  Synthetic oligonucleotide
ggaccccccacgccgttacaagccggtaggccata

SEQ ID NO: 148663 - DNA, 36 bp, Artificial Sequence
  Synthetic oligonucleotide
gacactcatatctgcgtactatcgctcgcctaccta

SEQ ID NO: 148664 - DNA, 36 bp, Artificial Sequence
  Synthetic oligonucleotide
tcatacccctgcccgacgcgttgttcaactccggta

SEQ ID NO: 148665 - DNA, 36 bp, Artificial Sequence
  Synthetic oligonucleotide
tccgcatagactccattgttcatccccccagctgta

SEQ ID NO: 148666 - DNA, 36 bp, Artificial Sequence
  Synthetic oligonucleotide
tttgaccgccctcctacaattgcgctatgacagtta

SEQ ID NO: 148667 - DNA, 35 bp, Artificial Sequence
  Synthetic oligonucleotide
gccatgaacgatggttacctctaccgaccctccac

SEQ ID NO: 148668 - DNA, 35 bp, Artificial Sequence
  Synthetic oligonucleotide
tatgtacatctgaccattttggtaggcccttcacc

SEQ ID NO: 148669 - DNA, 35 bp, Artificial Sequence
  Synthetic oligonucleotide
gtgacccgacccccacttgttaccagtgatgaccc

SEQ ID NO: 148670 - DNA, 35 bp, Artificial Sequence
  Synthetic oligonucleotide
tatgagtgcatcagcaaatagctcccggccccccc

SEQ ID NO: 148671 - DNA, 35 bp, Artificial Sequence
  Synthetic oligonucleotide
gttggcgttcacgcatcataccaagcctggccccc

SEQ ID NO: 148672 - DNA, 35 bp, Artificial Sequence
  Synthetic oligonucleotide
gaggcctctacacgctacctatagactgctccccc

SEQ ID NO: 148673 - DNA, 35 bp, Artificial Sequence
  Synthetic oligonucleotide
agtcaccctccgctgttggtcctccacccgttccc

SEQ ID NO: 148674 - DNA, 35 bp, Artificial Sequence
  Synthetic oligonucleotide
tgcaagccatccagccgctttacatctcactggcc

SEQ ID NO: 148675 - DNA, 35 bp, Artificial Sequence
  Synthetic oligonucleotide
gccgtttctgtcggttggtaccgcacctgccctcc

SEQ ID NO: 148676 - DNA, 35 bp, Artificial Sequence
  Synthetic oligonucleotide
tcgcgacgccagttccccttacatcgctggtccgc

SEQ ID NO: 148677 - DNA, 35 bp, Artificial Sequence
  Synthetic oligonucleotide
cctaggccgacgtctcccgcccctctcgctcgtgc

SEQ ID NO: 148678 - DNA, 35 bp, Artificial Sequence
  Synthetic oligonucleotide
gatcacgcgtccctttctttgcactgttatctatc

SEQ ID NO: 148679 - DNA, 35 bp, Artificial Sequence
  Synthetic oligonucleotide
gtgtgctgggagctgattgggagggtgggagtatc

SEQ ID NO: 148680 - DNA, 35 bp, Artificial Sequence
  Synthetic oligonucleotide
gatgtgtgacctgttcgttccgcccttgatcactc

SEQ ID NO: 148681 - DNA, 35 bp, Artificial Sequence
  Synthetic oligonucleotide
gtcccccccgaggcctccacacaccgcagcacctc

SEQ ID NO: 148682 - DNA, 35 bp, Artificial Sequence
  Synthetic oligonucleotide
atcccatcagcgactccgctgatctttatgacctc

SEQ ID NO: 148683 - DNA, 35 bp, Artificial Sequence
  Synthetic oligonucleotide
tacgtagctcgcctccgctcgtctttcgtcctctc

SEQ ID NO: 148684 - DNA, 35 bp, Artificial Sequence
  Synthetic oligonucleotide
acgtcccgcatctttgtcccgtccgcttttgggtc

SEQ ID NO: 148685 - DNA, 35 bp, Artificial Sequence
  Synthetic oligonucleotide
gaatagggcgacatccgggggggaacgggcaagag

SEQ ID NO: 148686 - DNA, 35 bp, Artificial Sequence
  Synthetic oligonucleotide
tacctgcccctattcagcgtatctgccgtgttacg

SEQ ID NO: 148687 - DNA, 35 bp, Artificial Sequence
  Synthetic oligonucleotide
ttgtgatgcgccccactctgttaaccgtacccgcg

SEQ ID NO: 148688 - DNA, 35 bp, Artificial Sequence
  Synthetic oligonucleotide
atgcgaggggttcggtggggatagttgggtgcggg

SEQ ID NO: 148689 - DNA, 35 bp, Artificial Sequence
  Synthetic oligonucleotide
tgccacaatccctcacttacgcaccatcgccatgg

SEQ ID NO: 148690 - DNA, 35 bp, Artificial Sequence
  Synthetic oligonucleotide
gactgcccccttctcgaccgtcttccctacgctgg

SEQ ID NO: 148691 - DNA, 35 bp, Artificial Sequence
  Synthetic oligonucleotide
gccacaacatatgcgcccctcaagcctggccccct

SEQ ID NO: 148692 - DNA, 35 bp, Artificial Sequence
  Synthetic oligonucleotide
gatcacctcagaaggccccccggaaacttgtccct

SEQ ID NO: 148693 - DNA, 36 bp, Artificial Sequence
  Synthetic oligonucleotide
acaccgcgctcccccagctgttggatggtcgctcct

SEQ ID NO: 148694 - DNA, 35 bp, Artificial Sequence
  Synthetic oligonucleotide
agcggtgcctcccccgcgattggtgactatcctct

SEQ ID NO: 148695 - DNA, 35 bp, Artificial Sequence
  Synthetic oligonucleotide
gtcacccacctccgcacatctctttcgagcaacaa

SEQ ID NO: 148696 - DNA, 36 bp, Artificial Sequence
  Synthetic oligonucleotide
tcgcggtaggtggggagaaggaagggggcaggggaa

SEQ ID NO: 148697 - DNA, 36 bp, Artificial Sequence
  Synthetic oligonucleotide
tctacgtccagtgggtggtgagggtgggccggggaa

SEQ ID NO: 148698 - DNA, 36 bp, Artificial Sequence
  Synthetic oligonucleotide
tagaccgtgccccaacatgcatatccgcctgactaa

SEQ ID NO: 148699 - DNA, 35 bp, Artificial Sequence
  Synthetic oligonucleotide
agtgcgcaatcgcccgatacaaggcccactcccca

SEQ ID NO: 148700 - DNA, 36 bp, Artificial Sequence
  Synthetic oligonucleotide
acctccggttagtgctgttcttcgtgccaccttcca

SEQ ID NO: 148701 - DNA, 36 bp, Artificial Sequence
  Synthetic oligonucleotide
actcgccctacgccttgcctaatctgttagttatca

SEQ ID NO: 148702 - DNA, 37 bp, Artificial Sequence
  Synthetic oligonucleotide
actgtagtggtggtggggtggcggaggtactgcaaga

SEQ ID NO: 148703 - DNA, 37 bp, Artificial Sequence
  Synthetic oligonucleotide
gtataaagtagggggagaagctgcagtggcggggaga

SEQ ID NO: 148704 - DNA, 37 bp, Artificial Sequence
  Synthetic oligonucleotide
tcacctcatcggagcttagacccaacgccctcaccga

SEQ ID NO: 148705 - DNA, 37 bp, Artificial Sequence
  Synthetic oligonucleotide
ttgcccctcgtgggtaacggccctgttcacgccccga

SEQ ID NO: 148706 - DNA, 37 bp, Artificial Sequence
  Synthetic oligonucleotide
acgcacggtagtggtttggacacgggggtaggaagga

SEQ ID NO: 148707 - DNA, 37 bp, Artificial Sequence
  Synthetic oligonucleotide
aatgaaagcggggggcctggggcggggtagggaagga

SEQ ID NO: 148708 - DNA, 37 bp, Artificial Sequence
  Synthetic oligonucleotide
gttggggacgacatggaagtggtggggggaagaggga

SEQ ID NO: 148709 - DNA, 36 bp, Artificial Sequence
  Synthetic oligonucleotide
ggaaaatgagcggacggaggggcggtaggttgggga

SEQ ID NO: 148710 - DNA, 38 bp, Artificial Sequence
  Synthetic oligonucleotide
atctgcgcccattactatactacctcaccacacgctga

SEQ ID NO: 148711 - DNA, 38 bp, Artificial Sequence
  Synthetic oligonucleotide
gcttgtacgcatgggagggaaatacgggaggggagtga

SEQ ID NO: 148712 - DNA, 38 bp, Artificial Sequence
  Synthetic oligonucleotide
gcacctctcgacacccccatataacgctgcccccgtga

SEQ ID NO: 148713 - DNA, 37 bp, Artificial Sequence
  Synthetic oligonucleotide
aatgggacggggtgaacggtggaggtagtaggcgtga

SEQ ID NO: 148714 - DNA, 36 bp, Artificial Sequence
  Synthetic oligonucleotide
atggggaggtggtttgtggcgggggtaacggggata

SEQ ID NO: 148715 - DNA, 36 bp, Artificial Sequence
  Synthetic oligonucleotide
tgcccacgcactcgatcccccagtccgtccgctata

SEQ ID NO: 148716 - DNA, 36 bp, Artificial Sequence
  Synthetic oligonucleotide
ttggcctcctcacaccgcgtctaaccgcatccccta

SEQ ID NO: 148717 - DNA, 36 bp, Artificial Sequence
  Synthetic oligonucleotide
gatcgcctccccagccttgtgtgttactccaccgta

SEQ ID NO: 148718 - DNA, 36 bp, Artificial Sequence
  Synthetic oligonucleotide
tcccggacaccccgcccttaaagtgaacactccgta

SEQ ID NO: 148719 - DNA, 36 bp, Artificial Sequence
  Synthetic oligonucleotide
tcccccaccgccctcccacttgcatcagtagcctta

SEQ ID NO: 148720 - DNA, 35 bp, Artificial Sequence
  Synthetic oligonucleotide
gacgccagtagctgcgttctccgtctccgttaaac

SEQ ID NO: 148721 - DNA, 35 bp, Artificial Sequence
  Synthetic oligonucleotide
ttcaccatcccacagagctcctcaacgaatacacc

SEQ ID NO: 148722 - DNA, 35 bp, Artificial Sequence
  Synthetic oligonucleotide
gttgccagcacatagcccttgtgattctgcccccc

SEQ ID NO: 148723 - DNA, 35 bp, Artificial Sequence
  Synthetic oligonucleotide
tccaccgtaagggtaaccctgctccaaagcgcccc

SEQ ID NO: 148724 - DNA, 35 bp, Artificial Sequence
  Synthetic oligonucleotide
atgttccactgcctcgatttctggacaccatcccc

SEQ ID NO: 148725 - DNA, 35 bp, Artificial Sequence
  Synthetic oligonucleotide
tgatccggcctacactcttccccatccccagggcc

SEQ ID NO: 148726 - DNA, 34 bp, Artificial Sequence
  Synthetic oligonucleotide
tcgtccgtacttccgtctgccccacccgcactcc

SEQ ID NO: 148727 - DNA, 35 bp, Artificial Sequence
  Synthetic oligonucleotide
ttgtgcccactaacggagcatcgttcctcctgtcc

SEQ ID NO: 148728 - DNA, 35 bp, Artificial Sequence
  Synthetic oligonucleotide
tcttaccacgcattattcgctgcatcatgccttcc

SEQ ID NO: 148729 - DNA, 35 bp, Artificial Sequence
  Synthetic oligonucleotide
tcatgccacgatcagtcttcacgtcatccatttcc

SEQ ID NO: 148730 - DNA, 35 bp, Artificial Sequence
  Synthetic oligonucleotide
tatacacccgtgccgtcagcccttgccacgtgcgc

SEQ ID NO: 148731 - DNA, 35 bp, Artificial Sequence
  Synthetic oligonucleotide
acagtcccggtgctactctatcttgctgccatcgc

SEQ ID NO: 148732 - DNA, 35 bp, Artificial Sequence
  Synthetic oligonucleotide
gcccagttcctcccgcttatcccacatgccattgc

SEQ ID NO: 148733 - DNA, 35 bp, Artificial Sequence
  Synthetic oligonucleotide
tcctcacagcgggcagttaacatccacccacgctc

SEQ ID NO: 148734 - DNA, 35 bp, Artificial Sequence
  Synthetic oligonucleotide
accgcccccccctcaacgatgcactagatctggtc

SEQ ID NO: 148735 - DNA, 35 bp, Artificial Sequence
  Synthetic oligonucleotide
gcacccccggtacatagctgagcttcccttctgtc

SEQ ID NO: 148736 - DNA, 35 bp, Artificial Sequence
  Synthetic oligonucleotide
tcgcttccatcgccctccgtaccatcaccggcttc

SEQ ID NO: 148737 - DNA, 35 bp, Artificial Sequence
  Synthetic oligonucleotide
catcccctagctatcagccttgtctttgcctctag

SEQ ID NO: 148738 - DNA, 35 bp, Artificial Sequence
  Synthetic oligonucleotide
gtacggagggcgcgtggggggcggggtggatcatg

SEQ ID NO: 148739 - DNA, 35 bp, Artificial Sequence
  Synthetic oligonucleotide
atcagcggagacaaagggtgcggaggaggaaagtg

SEQ ID NO: 148740 - DNA, 34 bp, Artificial Sequence
  Synthetic oligonucleotide
gagaagagagtatgacgcgggaaggagaggagat

SEQ ID NO: 148741 - DNA, 35 bp, Artificial Sequence
  Synthetic oligonucleotide
gagagggaagggctcgggaaggggatggtgatact

SEQ ID NO: 148742 - DNA, 35 bp, Artificial Sequence
  Synthetic oligonucleotide
tccccatcttacctgttgcgagccccccacgccct

SEQ ID NO: 148743 - DNA, 35 bp, Artificial Sequence
  Synthetic oligonucleotide
gagcctcactctgccacttttacactgtgcctcct

SEQ ID NO: 148744 - DNA, 35 bp, Artificial Sequence
  Synthetic oligonucleotide
tatccctcgcctgtaatggccgtactgacacatct

SEQ ID NO: 148745 - DNA, 35 bp, Artificial Sequence
  Synthetic oligonucleotide
accacctcgatgcttttcacccgcttgtaatatct

SEQ ID NO: 148746 - DNA, 35 bp, Artificial Sequence
  Synthetic oligonucleotide
tagccagctgcatttgccgccctcacagccgctct

SEQ ID NO: 148747 - DNA, 35 bp, Artificial Sequence
  Synthetic oligonucleotide
tgacctgcatcctgttttctcagccctttctgtct

SEQ ID NO: 148748 - DNA, 35 bp, Artificial Sequence
  Synthetic oligonucleotide
acccctgcctctgacccctcttgccaccctcaagt

SEQ ID NO: 148749 - DNA, 35 bp, Artificial Sequence
  Synthetic oligonucleotide
acgtacctcccccggcgccatatccgtgcccacgt

SEQ ID NO: 148750 - DNA, 35 bp, Artificial Sequence
  Synthetic oligonucleotide
tttccgcccgctgctactcattcgctttcatttgt

SEQ ID NO: 148751 - DNA, 35 bp, Artificial Sequence
  Synthetic oligonucleotide
tccattgcggctgtccccctagcgccatcaccatt

SEQ ID NO: 148752 - DNA, 35 bp, Artificial Sequence
  Synthetic oligonucleotide
tcacagccttgttgcttagcctcatcggtatcctt

SEQ ID NO: 148753 - DNA, 35 bp, Artificial Sequence
  Synthetic oligonucleotide
acagcccttcccatcctgcgacacccatgtgtctt

SEQ ID NO: 148754 - DNA, 35 bp, Artificial Sequence
  Synthetic oligonucleotide
tacgtaccctctcagccctcgcgtgccagtttttt

SEQ ID NO: 148755 - DNA, 35 bp, Artificial Sequence
  Synthetic oligonucleotide
acccgctacgccgcctcgcccactgcgctttaaaa

SEQ ID NO: 148756 - DNA, 35 bp, Artificial Sequence
  Synthetic oligonucleotide
aacgtccggcatagctgcactccacctcccaccaa

SEQ ID NO: 148757 - DNA, 36 bp, Artificial Sequence
  Synthetic oligonucleotide
aaactcccgcccatgctactggtactgcctcaccaa

SEQ ID NO: 148758 - DNA, 35 bp, Artificial Sequence
  Synthetic oligonucleotide
agcgacactgtcaccttcccatcgttcgtattcaa

SEQ ID NO: 148759 - DNA, 35 bp, Artificial Sequence
  Synthetic oligonucleotide
gtcggagccacgccatgttcgccaccccgcttcaa

SEQ ID NO: 148760 - DNA, 35 bp, Artificial Sequence
  Synthetic oligonucleotide
gggggtggaggaacggtggcgggcggagtacctaa

SEQ ID NO: 148761 - DNA, 35 bp, Artificial Sequence
  Synthetic oligonucleotide
tcccgccccgtccgacattcgcgaattcccatcca

SEQ ID NO: 148762 - DNA, 37 bp, Artificial Sequence
  Synthetic oligonucleotide
gggaaacaggtgaatggggaagggatgggggggaaga

SEQ ID NO: 148763 - DNA, 37 bp, Artificial Sequence
  Synthetic oligonucleotide
atcgcgcccactgggtgggaggggggggtgtgcccga

SEQ ID NO: 148764 - DNA, 36 bp, Artificial Sequence
  Synthetic oligonucleotide
gtcacaccgggtgactagtcctcctttccttgccga

SEQ ID NO: 148765 - DNA, 37 bp, Artificial Sequence
  Synthetic oligonucleotide
gctgatgagggcggaaaggggtggagcaatgtcagga

SEQ ID NO: 148766 - DNA, 37 bp, Artificial Sequence
  Synthetic oligonucleotide
gacccacgccgcattctgtacatcctccgtcatcgga

SEQ ID NO: 148767 - DNA, 37 bp, Artificial Sequence
  Synthetic oligonucleotide
tggggaaagaccagggctggggacgtctcttggggga

SEQ ID NO: 148768 - DNA, 38 bp, Artificial Sequence
  Synthetic oligonucleotide
acctgcccatccgttgcctttcacctttacgttactga

SEQ ID NO: 148769 - DNA, 36 bp, Artificial Sequence
  Synthetic oligonucleotide
gccatcccccagtcccgttcagaccttggcacctga

SEQ ID NO: 148770 - DNA, 38 bp, Artificial Sequence
  Synthetic oligonucleotide
tagccgggtcccgggtgggaagggcaacgcttccctga

SEQ ID NO: 148771 - DNA, 37 bp, Artificial Sequence
  Synthetic oligonucleotide
tctagccaccacgcgcgtcgacacctcatcacgctga

SEQ ID NO: 148772 - DNA, 36 bp, Artificial Sequence
  Synthetic oligonucleotide
gtaccgagataccgggtggacggggggagggagtga

SEQ ID NO: 148773 - DNA, 37 bp, Artificial Sequence
  Synthetic oligonucleotide
attgtctcaccgccctgctttctgcgcacacccttga

SEQ ID NO: 148774 - DNA, 36 bp, Artificial Sequence
  Synthetic oligonucleotide
tgagtatgtcgggggggggaaagatggcgagcgata

SEQ ID NO: 148775 - DNA, 36 bp, Artificial Sequence
  Synthetic oligonucleotide
aacgcagttccgttttgctgcgagcctccaccacta

SEQ ID NO: 148776 - DNA, 36 bp, Artificial Sequence
  Synthetic oligonucleotide
tacgcgcccctttgtgccacctgtccgtctttggta

SEQ ID NO: 148777 - DNA, 35 bp, Artificial Sequence
  Synthetic oligonucleotide
tctctgtcgtacctccctgttgcttatgttcctta

SEQ ID NO: 148778 - DNA, 35 bp, Artificial Sequence
  Synthetic oligonucleotide
acgttgccgcaccgccgtaccattaccacgcctac

SEQ ID NO: 148779 - DNA, 35 bp, Artificial Sequence
  Synthetic oligonucleotide
aacctgggcctgcagtcgtctatcaaccacctacc

SEQ ID NO: 148780 - DNA, 35 bp, Artificial Sequence
  Synthetic oligonucleotide
tgcacgtctccaagcgataccatgccctgcctacc

SEQ ID NO: 148781 - DNA, 35 bp, Artificial Sequence
  Synthetic oligonucleotide
accgtgaatcgcatagattgcacgtacggaccccc

SEQ ID NO: 148782 - DNA, 35 bp, Artificial Sequence
  Synthetic oligonucleotide
ttggctcctcctcctttctatgaacgggctccccc

SEQ ID NO: 148783 - DNA, 35 bp, Artificial Sequence
  Synthetic oligonucleotide
tacacccgcgcatcccgccgtttacgtgcacagcc

SEQ ID NO: 148784 - DNA, 35 bp, Artificial Sequence
  Synthetic oligonucleotide
tatcggtcccgcctctacacgcttctaggtcatcc

SEQ ID NO: 148785 - DNA, 35 bp, Artificial Sequence
  Synthetic oligonucleotide
taccgcataccacgccgggttttacgaccgcctcc

SEQ ID NO: 148786 - DNA, 35 bp, Artificial Sequence
  Synthetic oligonucleotide
gttgccgcccccgactcataatcgattgtgattcc

SEQ ID NO: 148787 - DNA, 35 bp, Artificial Sequence
  Synthetic oligonucleotide
tcacctcgctccctcgtagcaccttttagctttcc

SEQ ID NO: 148788 - DNA, 35 bp, Artificial Sequence
  Synthetic oligonucleotide
tcgtacaccttcgcaaccatgcctcacactctcgc

SEQ ID NO: 148789 - DNA, 35 bp, Artificial Sequence
  Synthetic oligonucleotide
gtcacctccaccgcctcggtttaactttacctggc

SEQ ID NO: 148790 - DNA, 35 bp, Artificial Sequence
  Synthetic oligonucleotide
ggggccggctttcttgtttctctgtccacacctgc

SEQ ID NO: 148791 - DNA, 35 bp, Artificial Sequence
  Synthetic oligonucleotide
atcgtacgcccggtccatatctgcacttagtaatc

SEQ ID NO: 148792 - DNA, 35 bp, Artificial Sequence
  Synthetic oligonucleotide
atgttccatggcctgatcattcttactgccttctc

SEQ ID NO: 148793 - DNA, 35 bp, Artificial Sequence
  Synthetic oligonucleotide
acgcccttcgcgttggatctcgctgctactccttc

SEQ ID NO: 148794 - DNA, 35 bp, Artificial Sequence
  Synthetic oligonucleotide
agaagggtggagtggagaaggagatggttggggag

SEQ ID NO: 148795 - DNA, 35 bp, Artificial Sequence
  Synthetic oligonucleotide
acaccgcccattgtctcccgcccctaacgctactg

SEQ ID NO: 148796 - DNA, 35 bp, Artificial Sequence
  Synthetic oligonucleotide
gatcgaaccgacccggacaccgtccctcccccact

SEQ ID NO: 148797 - DNA, 35 bp, Artificial Sequence
  Synthetic oligonucleotide
actgatgaccggcccctccaggcagcctcacccct

SEQ ID NO: 148798 - DNA, 35 bp, Artificial Sequence
  Synthetic oligonucleotide
ggaaacacctgacgccgcaagcacaaagcccccct

SEQ ID NO: 148799 - DNA, 35 bp, Artificial Sequence
  Synthetic oligonucleotide
atcgcacctcgcttgaaatccgctcttgtacctgt

SEQ ID NO: 148800 - DNA, 35 bp, Artificial Sequence
  Synthetic oligonucleotide
tgtactacgctctcacccgctttactccgttcatt

SEQ ID NO: 148801 - DNA, 35 bp, Artificial Sequence
  Synthetic oligonucleotide
tccacccgccttagtacagactataggcactcctt

SEQ ID NO: 148802 - DNA, 35 bp, Artificial Sequence
  Synthetic oligonucleotide
gtgcccgattcaggccgctccatgtccaccatttt

SEQ ID NO: 148803 - DNA, 36 bp, Artificial Sequence
  Synthetic oligonucleotide
gagaggaggtggagcagggggataatttgcggtaaa

SEQ ID NO: 148804 - DNA, 35 bp, Artificial Sequence
  Synthetic oligonucleotide
accgcactcttccagcctcccccacttggccgtaa

SEQ ID NO: 148805 - DNA, 36 bp, Artificial Sequence
  Synthetic oligonucleotide
taccacactttgttcgtgaattgccccacctgttaa

SEQ ID NO: 148806 - DNA, 35 bp, Artificial Sequence
  Synthetic oligonucleotide
gatcccacgatttcccgacacctgtccaccgcaca

SEQ ID NO: 148807 - DNA, 36 bp, Artificial Sequence
  Synthetic oligonucleotide
tctgcgcccacgtgccaccttcgtgttgttctacca

SEQ ID NO: 148808 - DNA, 35 bp, Artificial Sequence
  Synthetic oligonucleotide
tcccgaggcacatgttttatccacgtctttaccca

SEQ ID NO: 148809 - DNA, 36 bp, Artificial Sequence
  Synthetic oligonucleotide
tgtctcgccatcgcttccaaggcactcaccacccca

SEQ ID NO: 148810 - DNA, 35 bp, Artificial Sequence
  Synthetic oligonucleotide
cgaaccaaatcagatctccggacccgccccttcca

SEQ ID NO: 148811 - DNA, 36 bp, Artificial Sequence
  Synthetic oligonucleotide
tcccaccctcgcggcttggaccccaatctcttcgca

SEQ ID NO: 148812 - DNA, 36 bp, Artificial Sequence
  Synthetic oligonucleotide
ttaagggtagaggggaagggcatgggatgggtggca

SEQ ID NO: 148813 - DNA, 36 bp, Artificial Sequence
  Synthetic oligonucleotide
gcgctaccctcgcgcataatgccatcacaccatgca

SEQ ID NO: 148814 - DNA, 37 bp, Artificial Sequence
  Synthetic oligonucleotide
tcttgcgcatgtccgcccatccgtctccctcagccga

SEQ ID NO: 148815 - DNA, 36 bp, Artificial Sequence
  Synthetic oligonucleotide
acactctcctcgccgtttatgtcgactacaactcga

SEQ ID NO: 148816 - DNA, 37 bp, Artificial Sequence
  Synthetic oligonucleotide
tgaggtgagggaaaccgcagggggaaaggggaacgga

SEQ ID NO: 148817 - DNA, 36 bp, Artificial Sequence
  Synthetic oligonucleotide
tatggaagggggggcggtaggaccagaggatacgga

SEQ ID NO: 148818 - DNA, 36 bp, Artificial Sequence
  Synthetic oligonucleotide
tgggggagcaccgagggaggagggaggggatgatga

SEQ ID NO: 148819 - DNA, 37 bp, Artificial Sequence
  Synthetic oligonucleotide
acccccgactccccttaagcacgacacagttctatga

SEQ ID NO: 148820 - DNA, 38 bp, Artificial Sequence
  Synthetic oligonucleotide
ggacaggcggggtgggaagggaatggggtaatgtctga

SEQ ID NO: 148821 - DNA, 37 bp, Artificial Sequence
  Synthetic oligonucleotide
tggaggataggggggagggtaggtaagggtctagtga

SEQ ID NO: 148822 - DNA, 36 bp, Artificial Sequence
  Synthetic oligonucleotide
gatacacccgccccatctttctaacgatagccgtga

SEQ ID NO: 148823 - DNA, 35 bp, Artificial Sequence
  Synthetic oligonucleotide
gcacgtgaacgagtacggggtgggaggggaggtga

SEQ ID NO: 148824 - DNA, 38 bp, Artificial Sequence
  Synthetic oligonucleotide
ttagccccatcatacatgtcgtcagtactcctcgttga

SEQ ID NO: 148825 - DNA, 38 bp, Artificial Sequence
  Synthetic oligonucleotide
tcgaccttgccctcgcggtagcatattcacctctttga

SEQ ID NO: 148826 - DNA, 36 bp, Artificial Sequence
  Synthetic oligonucleotide
gcaacgtaggaagggcgggtaggaaatgggcgaata

SEQ ID NO: 148827 - DNA, 35 bp, Artificial Sequence
  Synthetic oligonucleotide
tgccgccccacctgtcgggccctacatttcgctta

SEQ ID NO: 148828 - DNA, 36 bp, Artificial Sequence
  Synthetic oligonucleotide
gttgtgtcgaccctgccgatcctgttccctccgtta

SEQ ID NO: 148829 - DNA, 36 bp, Artificial Sequence
  Synthetic oligonucleotide
tagcctcccccccgctctgtcgaacaattcgtgtta

SEQ ID NO: 148830 - DNA, 36 bp, Artificial Sequence
  Synthetic oligonucleotide
atcgcgccttacgcgtgtcgctcctcaccatcttta

SEQ ID NO: 148831 - DNA, 35 bp, Artificial Sequence
  Synthetic oligonucleotide
aagatgcccacgtcctcctaacgcctggccctcac

SEQ ID NO: 148832 - DNA, 35 bp, Artificial Sequence
  Synthetic oligonucleotide
gatcccattcccgcgctaacatcccgtcttgttac

SEQ ID NO: 148833 - DNA, 35 bp, Artificial Sequence
  Synthetic oligonucleotide
gcaccatcgagtaaattcattctcgccgttccacc

SEQ ID NO: 148834 - DNA, 35 bp, Artificial Sequence
  Synthetic oligonucleotide
agccgcgcaaccgtgcctaccgctaatctcccccc

SEQ ID NO: 148835 - DNA, 36 bp, Artificial Sequence
  Synthetic oligonucleotide
gcgccactttcgcttatggttaatgctcccggtccc

SEQ ID NO: 148836 - DNA, 35 bp, Artificial Sequence
  Synthetic oligonucleotide
acgccccgactgtatttacattatccgctgttccc

SEQ ID NO: 148837 - DNA, 35 bp, Artificial Sequence
  Synthetic oligonucleotide
taacgcgcctccccttaccttttgcccggtcgtcc

SEQ ID NO: 148838 - DNA, 35 bp, Artificial Sequence
  Synthetic oligonucleotide
tggagccacacggtccccactataacactctgtcc

SEQ ID NO: 148839 - DNA, 35 bp, Artificial Sequence
  Synthetic oligonucleotide
gcactcgtccactaggtacttcccctccatggcgc

SEQ ID NO: 148840 - DNA, 35 bp, Artificial Sequence
  Synthetic oligonucleotide
taagtcgtcaacagcttggttccctccgcactatc

SEQ ID NO: 148841 - DNA, 35 bp, Artificial Sequence
  Synthetic oligonucleotide
ttgtccgtaacgttggttttcgcctttacaccctc

SEQ ID NO: 148842 - DNA, 35 bp, Artificial Sequence
  Synthetic oligonucleotide
acccatcccccgaacgttacatatgcccacgcctc

SEQ ID NO: 148843 - DNA, 35 bp, Artificial Sequence
  Synthetic oligonucleotide
gcccgcctacaatgcaaattctgttagtttctctc

SEQ ID NO: 148844 - DNA, 35 bp, Artificial Sequence
  Synthetic oligonucleotide
tgagggcaaccttcagatccgtttcttcgcctgtc

SEQ ID NO: 148845 - DNA, 35 bp, Artificial Sequence
  Synthetic oligonucleotide
tggacccatccgctcgctctcttgatattgcaccg

SEQ ID NO: 148846 - DNA, 35 bp, Artificial Sequence
  Synthetic oligonucleotide
aagaacgggtaggtgaaggcacaggggcagagggg

SEQ ID NO: 148847 - DNA, 35 bp, Artificial Sequence
  Synthetic oligonucleotide
tgacatgaccagtcagaccgtaccattgtcccctg

SEQ ID NO: 148848 - DNA, 35 bp, Artificial Sequence
  Synthetic oligonucleotide
tactcgccaccgttccttgccgctcgactaacttg

SEQ ID NO: 148849 - DNA, 35 bp, Artificial Sequence
  Synthetic oligonucleotide
tcctgctttcacatgcctaccccatcccccccaat

SEQ ID NO: 148850 - DNA, 35 bp, Artificial Sequence
  Synthetic oligonucleotide
atgtaaccgcactgaggctcttgttctgcccccat

SEQ ID NO: 148851 - DNA, 35 bp, Artificial Sequence
  Synthetic oligonucleotide
atgggagggaggggggggtacgaggcagggggcat

SEQ ID NO: 148852 - DNA, 35 bp, Artificial Sequence
  Synthetic oligonucleotide
tggatgtgtcacacacgtccccagtgctcccccct

SEQ ID NO: 148853 - DNA, 35 bp, Artificial Sequence
  Synthetic oligonucleotide
gcaccgagtatctgctatttgttcaactccacgct

SEQ ID NO: 148854 - DNA, 35 bp, Artificial Sequence
  Synthetic oligonucleotide
gcaacaccacagtctgggtacttccgtttgcttct

SEQ ID NO: 148855 - DNA, 35 bp, Artificial Sequence
  Synthetic oligonucleotide
agcacggcatttcgcatttcggtccctgcttacgt

SEQ ID NO: 148856 - DNA, 35 bp, Artificial Sequence
  Synthetic oligonucleotide
gatcaggtgaatgggggtgggaaatgcgggcgtgt

SEQ ID NO: 148857 - DNA, 35 bp, Artificial Sequence
  Synthetic oligonucleotide
gtctgcgccgcatccctatcacgcgtgtcgccctt

SEQ ID NO: 148858 - DNA, 35 bp, Artificial Sequence
  Synthetic oligonucleotide
ttccgtccggtcgcgttgtccttccttcagctctt

SEQ ID NO: 148859 - DNA, 35 bp, Artificial Sequence
  Synthetic oligonucleotide
ttgctgggctcggtctactcgccacatcccctgtt

SEQ ID NO: 148860 - DNA, 36 bp, Artificial Sequence
  Synthetic oligonucleotide
gagggtgggttggggtatgggggattctcgttcaaa

SEQ ID NO: 148861 - DNA, 36 bp, Artificial Sequence
  Synthetic oligonucleotide
tacacctctagcttgtatgctggtcccttccttaaa

SEQ ID NO: 148862 - DNA, 35 bp, Artificial Sequence
  Synthetic oligonucleotide
atgcccccgcgtcctccctgctttggtcctttgaa

SEQ ID NO: 148863 - DNA, 36 bp, Artificial Sequence
  Synthetic oligonucleotide
acctaccgcccaatgctattgccaaccaagatctaa

SEQ ID NO: 148864 - DNA, 35 bp, Artificial Sequence
  Synthetic oligonucleotide
tccagcccccgtacagcatctcggtcacctcgcca

SEQ ID NO: 148865 - DNA, 35 bp, Artificial Sequence
  Synthetic oligonucleotide
tgtatggtggggaggggaacgtagtgagtgcggca

SEQ ID NO: 148866 - DNA, 36 bp, Artificial Sequence
  Synthetic oligonucleotide
aaacgggagggggagggtgggagagctgggggtgca

SEQ ID NO: 148867 - DNA, 35 bp, Artificial Sequence
  Synthetic oligonucleotide
ggtcagatgaactgctgccactcccgtccgtatca

SEQ ID NO: 148868 - DNA, 36 bp, Artificial Sequence
  Synthetic oligonucleotide
ttccgtcacagcctttctgcttctaccgttttatca

SEQ ID NO: 148869 - DNA, 37 bp, Artificial Sequence
  Synthetic oligonucleotide
gggtgggggaaagggaaggtgagagggtcctggaaga

SEQ ID NO: 148870 - DNA, 36 bp, Artificial Sequence
  Synthetic oligonucleotide
acagttagggggggagggtaaggaagccaggtcaga

SEQ ID NO: 148871 - DNA, 36 bp, Artificial Sequence
  Synthetic oligonucleotide
tgtgccgtcttcgcgcgccccgtccctaatttacga

SEQ ID NO: 148872 - DNA, 37 bp, Artificial Sequence
  Synthetic oligonucleotide
gccctacgccgtttcattggtctgttagctcccccga

SEQ ID NO: 148873 - DNA, 37 bp, Artificial Sequence
  Synthetic oligonucleotide
acccacctcctcgaccctgttatgtaccagtctcgga

SEQ ID NO: 148874 - DNA, 37 bp, Artificial Sequence
  Synthetic oligonucleotide
gatgcgagaaggggcatataggtggaaagtgaaggga

SEQ ID NO: 148875 - DNA, 37 bp, Artificial Sequence
  Synthetic oligonucleotide
gtcgccaggtagtaagggggggcgtggaggggttgga

SEQ ID NO: 148876 - DNA, 37 bp, Artificial Sequence
  Synthetic oligonucleotide
tgcgatctgtccattcgtcgaacatgccctttcctga

SEQ ID NO: 148877 - DNA, 38 bp, Artificial Sequence
  Synthetic oligonucleotide
gacggggagccgggtggaaatacaatggtgggcggtga

SEQ ID NO: 148878 - DNA, 38 bp, Artificial Sequence
  Synthetic oligonucleotide
gacgacggggaatgccttagaagggagggctcgggtga

SEQ ID NO: 148879 - DNA, 38 bp, Artificial Sequence
  Synthetic oligonucleotide
tctccgccaccgcacacgagccttacccactcacttga

SEQ ID NO: 148880 - DNA, 38 bp, Artificial Sequence
  Synthetic oligonucleotide
tacgcccatgtggcaccttcctgctcctgtttccttga

SEQ ID NO: 148881 - DNA, 38 bp, Artificial Sequence
  Synthetic oligonucleotide
aaccgaccgccactgcgtccagttccccgttcctttga

SEQ ID NO: 148882 - DNA, 36 bp, Artificial Sequence
  Synthetic oligonucleotide
aactcgagggtgggcggcgagtgggaagaaagacta

SEQ ID NO: 148883 - DNA, 36 bp, Artificial Sequence
  Synthetic oligonucleotide
actgggcgggcatgggtggggctgtaataggagcta

SEQ ID NO: 148884 - DNA, 36 bp, Artificial Sequence
  Synthetic oligonucleotide
tgtgataactggggggagaatgagacgagggtggta

SEQ ID NO: 148885 - DNA, 36 bp, Artificial Sequence
  Synthetic oligonucleotide
ttcaccccctctcctatgcgttgaagtgcgcatgta

SEQ ID NO: 148886 - DNA, 36 bp, Artificial Sequence
  Synthetic oligonucleotide
gtaccgacctgcatccccccccgtctacacagttta

SEQ ID NO: 148887 - DNA, 36 bp, Artificial Sequence
  Synthetic oligonucleotide
tcccatgccgtcggactccgcaccatcgtagtttta

SEQ ID NO: 148888 - DNA, 35 bp, Artificial Sequence
  Synthetic oligonucleotide
tgtgccgccaagcctctccgtaatctgccatctac

SEQ ID NO: 148889 - DNA, 35 bp, Artificial Sequence
  Synthetic oligonucleotide
tgctatccccctgccaccctcggacctggtacacc

SEQ ID NO: 148890 - DNA, 35 bp, Artificial Sequence
  Synthetic oligonucleotide
tatcgccgtgcgagttattcctatgttccccgccc

SEQ ID NO: 148891 - DNA, 35 bp, Artificial Sequence
  Synthetic oligonucleotide
atcgacaggcgccgtcgttattatctatccccgcc

SEQ ID NO: 148892 - DNA, 35 bp, Artificial Sequence
  Synthetic oligonucleotide
actcgctcccgcaatccttttcccttgcctgtgcc

SEQ ID NO: 148893 - DNA, 29 bp, Artificial Sequence
  Synthetic oligonucleotide
atttgacatctccgccggttccttgctcc

SEQ ID NO: 148894 - DNA, 35 bp, Artificial Sequence
  Synthetic oligonucleotide
atgccgcctacgggcctatattgcactttctctcc

SEQ ID NO: 148895 - DNA, 35 bp, Artificial Sequence
  Synthetic oligonucleotide
ataccaccttccatctgattcttgctgccgtgtcc

SEQ ID NO: 148896 - DNA, 35 bp, Artificial Sequence
  Synthetic oligonucleotide
agcgcgttctgtactctgccggcccctttgcgctc

SEQ ID NO: 148897 - DNA, 35 bp, Artificial Sequence
  Synthetic oligonucleotide
ttggtcgccgtcgcatctaccgtgttcccttggtc

SEQ ID NO: 148898 - DNA, 35 bp, Artificial Sequence
  Synthetic oligonucleotide
ttccgccgcgcgcacaccggccatcctttcttgtc

SEQ ID NO: 148899 - DNA, 35 bp, Artificial Sequence
  Synthetic oligonucleotide
tagaagggaggggcaaaacaggccggaaagggaag

SEQ ID NO: 148900 - DNA, 35 bp, Artificial Sequence
  Synthetic oligonucleotide
gacgtcgcccatcttcatagccacacttctctccg

SEQ ID NO: 148901 - DNA, 35 bp, Artificial Sequence
  Synthetic oligonucleotide
gacgcctccccatttcgtgccataccgggtcctcg

SEQ ID NO: 148902 - DNA, 35 bp, Artificial Sequence
  Synthetic oligonucleotide
tctcactccctgccagccccgtcaccgcgtaccgg

SEQ ID NO: 148903 - DNA, 35 bp, Artificial Sequence
  Synthetic oligonucleotide
atccccgctccgtccctgtaatcaattttccccgg

SEQ ID NO: 148904 - DNA, 35 bp, Artificial Sequence
  Synthetic oligonucleotide
taaccgtataggagagggcagggaaaatggggggg

SEQ ID NO: 148905 - DNA, 35 bp, Artificial Sequence
  Synthetic oligonucleotide
gagccctgcaactgtaccttcgtcactccccctgg

SEQ ID NO: 148906 - DNA, 35 bp, Artificial Sequence
  Synthetic oligonucleotide
acccccaacccggaccgactgctccatctatacct

SEQ ID NO: 148907 - DNA, 35 bp, Artificial Sequence
  Synthetic oligonucleotide
gctggtcccttcgcccttacgtgtgcaccggtcct

SEQ ID NO: 148908 - DNA, 35 bp, Artificial Sequence
  Synthetic oligonucleotide
tgtcatcaccgggttttgttggccttcctttcgct

SEQ ID NO: 148909 - DNA, 35 bp, Artificial Sequence
  Synthetic oligonucleotide
actacgctcaatcccgacttcgctacacccgatct

SEQ ID NO: 148910 - DNA, 35 bp, Artificial Sequence
  Synthetic oligonucleotide
gatgcacccctacccagcattgcctccaaaggtct

SEQ ID NO: 148911 - DNA, 35 bp, Artificial Sequence
  Synthetic oligonucleotide
accagccgcactcatctctctccggtatacatcgt

SEQ ID NO: 148912 - DNA, 35 bp, Artificial Sequence
  Synthetic oligonucleotide
gccccctccccatagtgcgttgttgctgccatggt

SEQ ID NO: 148913 - DNA, 35 bp, Artificial Sequence
  Synthetic oligonucleotide
gtgttcaccgcgcccttcgaacacctccctcttgt

SEQ ID NO: 148914 - DNA, 36 bp, Artificial Sequence
  Synthetic oligonucleotide
gcgaagtaggggaagggtagatcgggatagtccaaa

SEQ ID NO: 148915 - DNA, 36 bp, Artificial Sequence
  Synthetic oligonucleotide
actcaccgccggggtagcacccgattccttccttca

SEQ ID NO: 148916 - DNA, 35 bp, Artificial Sequence
  Synthetic oligonucleotide
gaccctctctgtagtctctatctccctgttgttca

SEQ ID NO: 148917 - DNA, 36 bp, Artificial Sequence
  Synthetic oligonucleotide
ggtagggtggacaaagggaaaggaggggccagaaga

SEQ ID NO: 148918 - DNA, 37 bp, Artificial Sequence
  Synthetic oligonucleotide
ttgatcaccgccatcaaccgccccttcgacctcgaga

SEQ ID NO: 148919 - DNA, 37 bp, Artificial Sequence
  Synthetic oligonucleotide
gtcacgacccggaccccccccttcgcctcgcttacga

SEQ ID NO: 148920 - DNA, 37 bp, Artificial Sequence
  Synthetic oligonucleotide
tcgatcgttcaaagcgtcgtaccgtgcccgcccccga

SEQ ID NO: 148921 - DNA, 37 bp, Artificial Sequence
  Synthetic oligonucleotide
gagggggggagatggggctgaacccgggcggacgcga

SEQ ID NO: 148922 - DNA, 36 bp, Artificial Sequence
  Synthetic oligonucleotide
ggaccgccagactagtcccgtacctgccaccatcga

SEQ ID NO: 148923 - DNA, 37 bp, Artificial Sequence
  Synthetic oligonucleotide
gagcggtgagggagggaggaaagaaaaagcatccgga

SEQ ID NO: 148924 - DNA, 37 bp, Artificial Sequence
  Synthetic oligonucleotide
gtggaggccgggggggtccgagggatggttcggggga

SEQ ID NO: 148925 - DNA, 37 bp, Artificial Sequence
  Synthetic oligonucleotide
gggtatgtcgaggggacggtaaggggagggtggggga

SEQ ID NO: 148926 - DNA, 36 bp, Artificial Sequence
  Synthetic oligonucleotide
actgagggtaggtgtacgggggggaaggcgcatgga

SEQ ID NO: 148927 - DNA, 37 bp, Artificial Sequence
  Synthetic oligonucleotide
tgaggaggctggtgtgtataggggcggagggggtgga

SEQ ID NO: 148928 - DNA, 38 bp, Artificial Sequence
  Synthetic oligonucleotide
gatgagggctgaaggaggttggagggagcgggtcatga

SEQ ID NO: 148929 - DNA, 37 bp, Artificial Sequence
  Synthetic oligonucleotide
atagccgatagccctgtaacaagcccctccgccctga

SEQ ID NO: 148930 - DNA, 36 bp, Artificial Sequence
  Synthetic oligonucleotide
gccaccgccagcagctcgcgcgttttcaccctttga

SEQ ID NO: 148931 - DNA, 35 bp, Artificial Sequence
  Synthetic oligonucleotide
accgtaccatcatttgcagaccagtctttatatta

SEQ ID NO: 148932 - DNA, 35 bp, Artificial Sequence
  Synthetic oligonucleotide
ttcgaccgcctgacagcgtagccgcacgcccctta

SEQ ID NO: 148933 - DNA, 36 bp, Artificial Sequence
  Synthetic oligonucleotide
tcatcctcatggaatagtttcattcgccccgccgac

SEQ ID NO: 148934 - DNA, 35 bp, Artificial Sequence
  Synthetic oligonucleotide
gccccttaacagatctctatggccccccctgtacc

SEQ ID NO: 148935 - DNA, 35 bp, Artificial Sequence
  Synthetic oligonucleotide
taccacgcagactgaaacccctgcgctttgaaccc

SEQ ID NO: 148936 - DNA, 35 bp, Artificial Sequence
  Synthetic oligonucleotide
agcgagccagcgatccatctactgagtccccgccc

SEQ ID NO: 148937 - DNA, 35 bp, Artificial Sequence
  Synthetic oligonucleotide
ttctgccggtcaccacctataccccgctatctgcc

SEQ ID NO: 148938 - DNA, 35 bp, Artificial Sequence
  Synthetic oligonucleotide
ttgccccccccacgctcccataaccgcaatcgagc

SEQ ID NO: 148939 - DNA, 35 bp, Artificial Sequence
  Synthetic oligonucleotide
ttatgccccgagacgcgcccctgtctgtttcccgc

SEQ ID NO: 148940 - DNA, 35 bp, Artificial Sequence
  Synthetic oligonucleotide
tcgaacaacatgtcctggtactcgcactacgccgc

SEQ ID NO: 148941 - DNA, 35 bp, Artificial Sequence
  Synthetic oligonucleotide
ttacgcctcccccatttcgccgttgtaccgatcgc

SEQ ID NO: 148942 - DNA, 35 bp, Artificial Sequence
  Synthetic oligonucleotide
actttcaccggcgatgttcggcccccttactcatc

SEQ ID NO: 148943 - DNA, 35 bp, Artificial Sequence
  Synthetic oligonucleotide
aaagcatgttccatctgttgccattgttgccgctc

SEQ ID NO: 148944 - DNA, 35 bp, Artificial Sequence
  Synthetic oligonucleotide
atccgttccgtcttccttgcgtctatgcttctgtc

SEQ ID NO: 148945 - DNA, 35 bp, Artificial Sequence
  Synthetic oligonucleotide
tagatcggcgcccagggtcctttctcgttctattc

SEQ ID NO: 148946 - DNA, 35 bp, Artificial Sequence
  Synthetic oligonucleotide
aattcccacccctcgctggtcctctgccctgtttc

SEQ ID NO: 148947 - DNA, 35 bp, Artificial Sequence
  Synthetic oligonucleotide
aatggcgagaggggggtgtctgggaggggagacag

SEQ ID NO: 148948 - DNA, 35 bp, Artificial Sequence
  Synthetic oligonucleotide
agccccgattaacgctttttgctcctgccgccccg

SEQ ID NO: 148949 - DNA, 35 bp, Artificial Sequence
  Synthetic oligonucleotide
tctcccccgcgggcgttgttttaccattccttccg

SEQ ID NO: 148950 - DNA, 35 bp, Artificial Sequence
  Synthetic oligonucleotide
atccccgccccgtcctatcttttagctgacagctg

SEQ ID NO: 148951 - DNA, 35 bp, Artificial Sequence
  Synthetic oligonucleotide
tctccgccagtcggcgacaccctcctccacctctg

SEQ ID NO: 148952 - DNA, 35 bp, Artificial Sequence
  Synthetic oligonucleotide
aacaccactcctgacaccttcattccatcgtgact

SEQ ID NO: 148953 - DNA, 35 bp, Artificial Sequence
  Synthetic oligonucleotide
gtctgccgcacatcgttgcaactgttctcaatcct

SEQ ID NO: 148954 - DNA, 35 bp, Artificial Sequence
  Synthetic oligonucleotide
aacacagccaatcatatcgcggcatcgaaacctct

SEQ ID NO: 148955 - DNA, 35 bp, Artificial Sequence
  Synthetic oligonucleotide
ggggcaacaaaaaggggcgggtggggttttatggt

SEQ ID NO: 148956 - DNA, 35 bp, Artificial Sequence
  Synthetic oligonucleotide
gccggagccgactgtaagatccactgtccgccctt

SEQ ID NO: 148957 - DNA, 35 bp, Artificial Sequence
  Synthetic oligonucleotide
acgaaactccgccacttgcctacccacggctattt

SEQ ID NO: 148958 - DNA, 35 bp, Artificial Sequence
  Synthetic oligonucleotide
acctccgcccagtctttacggttcgtcttgccttt

SEQ ID NO: 148959 - DNA, 35 bp, Artificial Sequence
  Synthetic oligonucleotide
tcccaccgcaggcactctgtcactctttctgcttt

SEQ ID NO: 148960 - DNA, 35 bp, Artificial Sequence
  Synthetic oligonucleotide
tgtgcacgtgcatctatctgcgcccacccctgttt

SEQ ID NO: 148961 - DNA, 35 bp, Artificial Sequence
  Synthetic oligonucleotide
tgactactgcacgctacgtctttaccgcccttttt

SEQ ID NO: 148962 - DNA, 35 bp, Artificial Sequence
  Synthetic oligonucleotide
atccatgcagctctcatccttcttcgggccgccaa

SEQ ID NO: 148963 - DNA, 36 bp, Artificial Sequence
  Synthetic oligonucleotide
ttgcacccccgatatttttctgtctctcctgcggaa

SEQ ID NO: 148964 - DNA, 36 bp, Artificial Sequence
  Synthetic oligonucleotide
tagtacggttccgcctcgatcgatcacttccctgaa

SEQ ID NO: 148965 - DNA, 36 bp, Artificial Sequence
  Synthetic oligonucleotide
tcagcacacgaccagttctccccttataatccgcca

SEQ ID NO: 148966 - DNA, 36 bp, Artificial Sequence
  Synthetic oligonucleotide
gaacctcacatcgattcttgccgcccatgcatgcca

SEQ ID NO: 148967 - DNA, 35 bp, Artificial Sequence
  Synthetic oligonucleotide
tcctcgtgcagtgattcgaccctgctacccctcca

SEQ ID NO: 148968 - DNA, 35 bp, Artificial Sequence
  Synthetic oligonucleotide
tcactccacctcacgccagttttctcagatctcca

SEQ ID NO: 148969 - DNA, 36 bp, Artificial Sequence
  Synthetic oligonucleotide
atcgagctctgtccagacgcttcgtttcttcttcca

SEQ ID NO: 148970 - DNA, 35 bp, Artificial Sequence
  Synthetic oligonucleotide
atactcccatcaagcctgtaacacggtacacctca

SEQ ID NO: 148971 - DNA, 37 bp, Artificial Sequence
  Synthetic oligonucleotide
tccgccctctgaagctgccattgtccgcgtcccacga

SEQ ID NO: 148972 - DNA, 37 bp, Artificial Sequence
  Synthetic oligonucleotide
acccgggatgggcgataatgggagggaaatgttacga

SEQ ID NO: 148973 - DNA, 35 bp, Artificial Sequence
  Synthetic oligonucleotide
acccacttgactttgctacatctgacatcctccga

SEQ ID NO: 148974 - DNA, 37 bp, Artificial Sequence
  Synthetic oligonucleotide
tccacctcggcctccccacgtaatgaccttcctccga

SEQ ID NO: 148975 - DNA, 37 bp, Artificial Sequence
  Synthetic oligonucleotide
taggaaggagtgagcggaaggaggaagctggtcggga

SEQ ID NO: 148976 - DNA, 37 bp, Artificial Sequence
  Synthetic oligonucleotide
ggaagagagtgggaatggaggtaggggtaggtatgga

SEQ ID NO: 148977 - DNA, 36 bp, Artificial Sequence
  Synthetic oligonucleotide
tgcctcggtcgacttgtcacgccttcactgatccta

SEQ ID NO: 148978 - DNA, 36 bp, Artificial Sequence
  Synthetic oligonucleotide
tgggtgaggggggcggggggaggcactctagttcta

SEQ ID NO: 148979 - DNA, 36 bp, Artificial Sequence
  Synthetic oligonucleotide
gtgggattggcaataggggacaagggggaacgggta

SEQ ID NO: 148980 - DNA, 35 bp, Artificial Sequence
  Synthetic oligonucleotide
ggacacgtctggcgtcgtcactttcatcctgccac

SEQ ID NO: 148981 - DNA, 35 bp, Artificial Sequence
  Synthetic oligonucleotide
gaccccgctccctgttgaaccctactctacgtgac

SEQ ID NO: 148982 - DNA, 35 bp, Artificial Sequence
  Synthetic oligonucleotide
aaccatcacctgcacccatgggaggcccttggccc

SEQ ID NO: 148983 - DNA, 34 bp, Artificial Sequence
  Synthetic oligonucleotide
tgccccacccctgaatcgtaaccccagggcatcc

SEQ ID NO: 148984 - DNA, 35 bp, Artificial Sequence
  Synthetic oligonucleotide
tatgggtgacacccatgttgattcgtttcccctcc

SEQ ID NO: 148985 - DNA, 35 bp, Artificial Sequence
  Synthetic oligonucleotide
acaatcaccgacctcactcgtgccttataggctcc

SEQ ID NO: 148986 - DNA, 35 bp, Artificial Sequence
  Synthetic oligonucleotide
tgcgtacacccaccaccgtgcgttaccacttctcc

SEQ ID NO: 148987 - DNA, 35 bp, Artificial Sequence
  Synthetic oligonucleotide
aaaccgccctccgccccagtgttacccacctgcgc

SEQ ID NO: 148988 - DNA, 35 bp, Artificial Sequence
  Synthetic oligonucleotide
gtgagaaggcgggaggggaccgtgggggacaaggc

SEQ ID NO: 148989 - DNA, 35 bp, Artificial Sequence
  Synthetic oligonucleotide
tagcccctgcccctatgctttgtattccctacctc

SEQ ID NO: 148990 - DNA, 35 bp, Artificial Sequence
  Synthetic oligonucleotide
acgatacgcgcttctggttggcgcactcccatctc

SEQ ID NO: 148991 - DNA, 35 bp, Artificial Sequence
  Synthetic oligonucleotide
taccccgatacattgtgagctcttggtcgtacttc

SEQ ID NO: 148992 - DNA, 35 bp, Artificial Sequence
  Synthetic oligonucleotide
atccgttcccatccgctccaaggccctttgtgacg

SEQ ID NO: 148993 - DNA, 35 bp, Artificial Sequence
  Synthetic oligonucleotide
gagaaagggggacggggtattagggagcgtgtccg

SEQ ID NO: 148994 - DNA, 35 bp, Artificial Sequence
  Synthetic oligonucleotide
tgcctgaccttctctgtctagtctacccccccgcg

SEQ ID NO: 148995 - DNA, 35 bp, Artificial Sequence
  Synthetic oligonucleotide
tgctggctgcaggggaggggttacacgggagaggg

SEQ ID NO: 148996 - DNA, 35 bp, Artificial Sequence
  Synthetic oligonucleotide
tcgaggacgtgcagtagggtgggacggggcgggtg

SEQ ID NO: 148997 - DNA, 35 bp, Artificial Sequence
  Synthetic oligonucleotide
gaagacgtgtacatccgccccgccccacgtatcat

SEQ ID NO: 148998 - DNA, 35 bp, Artificial Sequence
  Synthetic oligonucleotide
gtatgcaggccgtctacacccttctccgcaatgat

SEQ ID NO: 148999 - DNA, 35 bp, Artificial Sequence
  Synthetic oligonucleotide
tgcgaagtcactctgcgtccctcagtctctccgct

SEQ ID NO: 149000 - DNA, 35 bp, Artificial Sequence
  Synthetic oligonucleotide
ggggatgaacgcagggagggggagccagggggagt

SEQ ID NO: 149001 - DNA, 35 bp, Artificial Sequence
  Synthetic oligonucleotide
gttaggctgctcacctcctccagtcccttgtccgt

SEQ ID NO: 149002 - DNA, 35 bp, Artificial Sequence
  Synthetic oligonucleotide
tcagggagtgggggcgtggagtcgcagggaagggt

SEQ ID NO: 149003 - DNA, 35 bp, Artificial Sequence
  Synthetic oligonucleotide
atccccgtgcccccctccgtttgcaggtgtgtggt

SEQ ID NO: 149004 - DNA, 35 bp, Artificial Sequence
  Synthetic oligonucleotide
gatccccactcccgttcgcgccgctagcttgcatt

SEQ ID NO: 149005 - DNA, 35 bp, Artificial Sequence
  Synthetic oligonucleotide
gcacatccgtacgcgccattcccgtcctgtcggtt

SEQ ID NO: 149006 - DNA, 35 bp, Artificial Sequence
  Synthetic oligonucleotide
ggatacggtcctggtccgttcttaattttgccttt

SEQ ID NO: 149007 - DNA, 35 bp, Artificial Sequence
  Synthetic oligonucleotide
gcccgtgtcgttcgcagccttcccagctatccttt

SEQ ID NO: 149008 - DNA, 35 bp, Artificial Sequence
  Synthetic oligonucleotide
atacccctccatatgtgcgcttgcccgatcaccaa

SEQ ID NO: 149009 - DNA, 36 bp, Artificial Sequence
  Synthetic oligonucleotide
cacgtggcctttgttgagcgtcctttccccacgcca

SEQ ID NO: 149010 - DNA, 35 bp, Artificial Sequence
  Synthetic oligonucleotide
gtagagccccatcgccgcgcccccattttactgca

SEQ ID NO: 149011 - DNA, 36 bp, Artificial Sequence
  Synthetic oligonucleotide
tagttcgccaacagctatgtcccctggttccttgca

SEQ ID NO: 149012 - DNA, 37 bp, Artificial Sequence
  Synthetic oligonucleotide
gaggagtcacaagggaaggaatgggaggctgtacaga

SEQ ID NO: 149013 - DNA, 37 bp, Artificial Sequence
  Synthetic oligonucleotide
gggggtgacgggggaataggagagtgaggagatgaga

SEQ ID NO: 149014 - DNA, 37 bp, Artificial Sequence
  Synthetic oligonucleotide
gtgcgtgcaccgtacgtttgcccccgcttcccataga

SEQ ID NO: 149015 - DNA, 37 bp, Artificial Sequence
  Synthetic oligonucleotide
gtgggatccgtctgctctgccccccgtctttggccga

SEQ ID NO: 149016 - DNA, 37 bp, Artificial Sequence
  Synthetic oligonucleotide
ataccagcatcattgcctctcctcgccctgccatcga

SEQ ID NO: 149017 - DNA, 37 bp, Artificial Sequence
  Synthetic oligonucleotide
gtagacacgggggagggtgggcgcgggggtaggtcga

SEQ ID NO: 149018 - DNA, 37 bp, Artificial Sequence
  Synthetic oligonucleotide
agagtgggagcaaagctgtaggggctgaggggaggga

SEQ ID NO: 149019 - DNA, 38 bp, Artificial Sequence
  Synthetic oligonucleotide
gctgtcgcacccggtgtcatccacctatccatccctga

SEQ ID NO: 149020 - DNA, 37 bp, Artificial Sequence
  Synthetic oligonucleotide
gagtgccatccgattctccgcctgttaatccccgtga

SEQ ID NO: 149021 - DNA, 38 bp, Artificial Sequence
  Synthetic oligonucleotide
ttgagagcggggttgggcaatgggtgggggagtggtga

SEQ ID NO: 149022 - DNA, 37 bp, Artificial Sequence
  Synthetic oligonucleotide
atcgccctccacccatttcccaagcaagacggcttga

SEQ ID NO: 149023 - DNA, 38 bp, Artificial Sequence
  Synthetic oligonucleotide
gcagccacacctgaccgccgcctgtcccaccgtgttga

SEQ ID NO: 149024 - DNA, 35 bp, Artificial Sequence
  Synthetic oligonucleotide
attcgcatgccttctgtccgcgcccctcgcctgta

SEQ ID NO: 149025 - DNA, 35 bp, Artificial Sequence
  Synthetic oligonucleotide
tcccccgtgtgtgagctcgaccgtccgcccgccac

SEQ ID NO: 149026 - DNA, 35 bp, Artificial Sequence
  Synthetic oligonucleotide
acacgcagccaccccggacgcgcaaccccgactac

SEQ ID NO: 149027 - DNA, 35 bp, Artificial Sequence
  Synthetic oligonucleotide
atcgggaggggagggctatgagtccgggacagtac

SEQ ID NO: 149028 - DNA, 35 bp, Artificial Sequence
  Synthetic oligonucleotide
tcagaccatcaaccctgtagcctactgttcattac

SEQ ID NO: 149029 - DNA, 35 bp, Artificial Sequence
  Synthetic oligonucleotide
accgccacagaatatgtcttctgctccgattttac

SEQ ID NO: 149030 - DNA, 35 bp, Artificial Sequence
  Synthetic oligonucleotide
gacgctccaaagtatactacggttatcttcgcccc

SEQ ID NO: 149031 - DNA, 35 bp, Artificial Sequence
  Synthetic oligonucleotide
gtccctatgcctcctatttatagaccccgggcccc

SEQ ID NO: 149032 - DNA, 35 bp, Artificial Sequence
  Synthetic oligonucleotide
atcgagcggattgccgcaccatccccgttagtccc

SEQ ID NO: 149033 - DNA, 35 bp, Artificial Sequence
  Synthetic oligonucleotide
gactgccccaccataggtcacgtcccgttcttccc

SEQ ID NO: 149034 - DNA, 35 bp, Artificial Sequence
  Synthetic oligonucleotide
acaaccgcatggccgtttggaccgccattctatcc

SEQ ID NO: 149035 - DNA, 35 bp, Artificial Sequence
  Synthetic oligonucleotide
gttcgcgctgcgtgtcacgcccatggctccgctcc

SEQ ID NO: 149036 - DNA, 35 bp, Artificial Sequence
  Synthetic oligonucleotide
accttatgcaccgcctaccttccgagtctccccgc

SEQ ID NO: 149037 - DNA, 35 bp, Artificial Sequence
  Synthetic oligonucleotide
gcccacctgcgcagttgtctcctgccttcgaatgc

SEQ ID NO: 149038 - DNA, 35 bp, Artificial Sequence
  Synthetic oligonucleotide
acccgacctactgccctgacgattacctttgatgc

SEQ ID NO: 149039 - DNA, 35 bp, Artificial Sequence
  Synthetic oligonucleotide
cctgccatgctcccttttacatctgccttccgtgc

SEQ ID NO: 149040 - DNA, 35 bp, Artificial Sequence
  Synthetic oligonucleotide
ttcggacccgcaccctctcgagcgtatgttacctc

SEQ ID NO: 149041 - DNA, 35 bp, Artificial Sequence
  Synthetic oligonucleotide
tcgtacaccataccgcgcctcacactttgtccgtc

SEQ ID NO: 149042 - DNA, 35 bp, Artificial Sequence
  Synthetic oligonucleotide
acctcccgtttgctgggcccgagtcccatctgttc

SEQ ID NO: 149043 - DNA, 35 bp, Artificial Sequence
  Synthetic oligonucleotide
ttgagggggggagggaatttggatgccacatggag

SEQ ID NO: 149044 - DNA, 35 bp, Artificial Sequence
  Synthetic oligonucleotide
aaccccccttgcctccgcactcgccgctatgctag

SEQ ID NO: 149045 - DNA, 35 bp, Artificial Sequence
  Synthetic oligonucleotide
tccaccctgtgacctatcttctatctccgcccacg

SEQ ID NO: 149046 - DNA, 35 bp, Artificial Sequence
  Synthetic oligonucleotide
tacgttccacctccggcttaccaactgtgcccacg

SEQ ID NO: 149047 - DNA, 35 bp, Artificial Sequence
  Synthetic oligonucleotide
gccttaacgcccccttcctgcttttgacggctccg

SEQ ID NO: 149048 - DNA, 35 bp, Artificial Sequence
  Synthetic oligonucleotide
gctcagggtccggatcatcaacctctctctcgtcg

SEQ ID NO: 149049 - DNA, 35 bp, Artificial Sequence
  Synthetic oligonucleotide
gaggacgagtggttgaagggtgtgggaagtggggg

SEQ ID NO: 149050 - DNA, 35 bp, Artificial Sequence
  Synthetic oligonucleotide
atcccgcctcaacttccctgttagcctatcccttg

SEQ ID NO: 149051 - DNA, 35 bp, Artificial Sequence
  Synthetic oligonucleotide
gggaactgagggcaggagggcaaaagggggtacat

SEQ ID NO: 149052 - DNA, 35 bp, Artificial Sequence
  Synthetic oligonucleotide
aattcatccgtccgccaccgttttttgttacccat

SEQ ID NO: 149053 - DNA, 35 bp, Artificial Sequence
  Synthetic oligonucleotide
accaggccacacttgaaccgctttccccctggtat

SEQ ID NO: 149054 - DNA, 35 bp, Artificial Sequence
  Synthetic oligonucleotide
gtccacccctcgcccatgtgtcatcactatgtcct

SEQ ID NO: 149055 - DNA, 35 bp, Artificial Sequence
  Synthetic oligonucleotide
gtcgccccgtagtccccctcggtttctcctgatct

SEQ ID NO: 149056 - DNA, 35 bp, Artificial Sequence
  Synthetic oligonucleotide
atacgtcgctacgttacatccctgccctctatgtt

SEQ ID NO: 149057 - DNA, 35 bp, Artificial Sequence
  Synthetic oligonucleotide
gccgtgcatccaccccgcccggatcccgcctctaa

SEQ ID NO: 149058 - DNA, 36 bp, Artificial Sequence
  Synthetic oligonucleotide
gtgatcacctggcactgcgagacgcaccatcaacca

SEQ ID NO: 149059 - DNA, 35 bp, Artificial Sequence
  Synthetic oligonucleotide
ttattcccgcaatcctgtaagcacgttccctccca

SEQ ID NO: 149060 - DNA, 35 bp, Artificial Sequence
  Synthetic oligonucleotide
acccgtcacacctcctgccagtgtttgcttactca

SEQ ID NO: 149061 - DNA, 36 bp, Artificial Sequence
  Synthetic oligonucleotide
cctcgcctccacgtgccttccgaccttctctgctca

SEQ ID NO: 149062 - DNA, 36 bp, Artificial Sequence
  Synthetic oligonucleotide
acgaatggcccccaccgtccaccttcccgcctgtca

SEQ ID NO: 149063 - DNA, 36 bp, Artificial Sequence
  Synthetic oligonucleotide
accccccccgcccaacgccaatctactcttacgaga

SEQ ID NO: 149064 - DNA, 36 bp, Artificial Sequence
  Synthetic oligonucleotide
accccacccgtgtccagcacacctgttcttccgaga

SEQ ID NO: 149065 - DNA, 36 bp, Artificial Sequence
  Synthetic oligonucleotide
tccctccaccgcagttacctgacttcctccactaga

SEQ ID NO: 149066 - DNA, 37 bp, Artificial Sequence
  Synthetic oligonucleotide
ttgaccgactggccaccccctgctacaaagaccccga

SEQ ID NO: 149067 - DNA, 37 bp, Artificial Sequence
  Synthetic oligonucleotide
ggagagaagggatggggcgcaaagggcaagggcgcga

SEQ ID NO: 149068 - DNA, 37 bp, Artificial Sequence
  Synthetic oligonucleotide
ttagccgcccctccgtatctcccttccgccactgcga

SEQ ID NO: 149069 - DNA, 36 bp, Artificial Sequence
  Synthetic oligonucleotide
ggggtgggagcatgccataatatagtgaaagaggga

SEQ ID NO: 149070 - DNA, 38 bp, Artificial Sequence
  Synthetic oligonucleotide
gagagccaaacgagggacgagggggagtggtaacatga

SEQ ID NO: 149071 - DNA, 38 bp, Artificial Sequence
  Synthetic oligonucleotide
gtgcgggaacgggtagggcgggtgcgggagtagcctga

SEQ ID NO: 149072 - DNA, 38 bp, Artificial Sequence
  Synthetic oligonucleotide
gtccgtctcttctgctgcatcttccctgtctgtcctga

SEQ ID NO: 149073 - DNA, 38 bp, Artificial Sequence
  Synthetic oligonucleotide
aacaatgacgacagggaggtgggaggggaaagtcgtga

SEQ ID NO: 149074 - DNA, 38 bp, Artificial Sequence
  Synthetic oligonucleotide
gtcaagggccaagagcgtgccaagggtgggaagggtga

SEQ ID NO: 149075 - DNA, 38 bp, Artificial Sequence
  Synthetic oligonucleotide
aggggcggggacaactgcttattggggtcatggggtga

SEQ ID NO: 149076 - DNA, 38 bp, Artificial Sequence
  Synthetic oligonucleotide
gccctccgtcagatcgtacgcgctctcccgacccttga

SEQ ID NO: 149077 - DNA, 32 bp, Artificial Sequence
  Synthetic oligonucleotide
ttctcgcgcccaacccgttcttcaatagccta

SEQ ID NO: 149078 - DNA, 35 bp, Artificial Sequence
  Synthetic oligonucleotide
tcccccggtcctttctatgacgttacccctgccta

SEQ ID NO: 149079 - DNA, 35 bp, Artificial Sequence
  Synthetic oligonucleotide
acaccccccttagtctgtcccccgtccgagctcta

SEQ ID NO: 149080 - DNA, 36 bp, Artificial Sequence
  Synthetic oligonucleotide
tgtcgtcaattgcttagtcccgttgccctttccgta

SEQ ID NO: 149081 - DNA, 35 bp, Artificial Sequence
  Synthetic oligonucleotide
tcactacccccctgccgccgcactcgtttggcgta

SEQ ID NO: 149082 - DNA, 36 bp, Artificial Sequence
  Synthetic oligonucleotide
ttaccgccacacgctgccaccggtctttgccctgta

SEQ ID NO: 149083 - DNA, 35 bp, Artificial Sequence
  Synthetic oligonucleotide
ttacactccctcatggggattccgccccccggacc

SEQ ID NO: 149084 - DNA, 35 bp, Artificial Sequence
  Synthetic oligonucleotide
gacttgcatcatcccagcgataagtgttgcctccc

SEQ ID NO: 149085 - DNA, 35 bp, Artificial Sequence
  Synthetic oligonucleotide
gatcctaactgcgtcccccttgccgtttaattccc

SEQ ID NO: 149086 - DNA, 35 bp, Artificial Sequence
  Synthetic oligonucleotide
acgttcgctgccaatcaccgtctatcactgttccc

SEQ ID NO: 149087 - DNA, 35 bp, Artificial Sequence
  Synthetic oligonucleotide
gccgacactggtaccagccgtggtctttgcctgcc

SEQ ID NO: 149088 - DNA, 35 bp, Artificial Sequence
  Synthetic oligonucleotide
ttggtacgacctgggtcgctctcgctctcatctcc

SEQ ID NO: 149089 - DNA, 35 bp, Artificial Sequence
  Synthetic oligonucleotide
atgtcatcgttgtgttcccgcgtgcgctcccgtcc

SEQ ID NO: 149090 - DNA, 35 bp, Artificial Sequence
  Synthetic oligonucleotide
gtccctgtcctgtgcgctcagacaaagcctattcc

SEQ ID NO: 149091 - DNA, 35 bp, Artificial Sequence
  Synthetic oligonucleotide
acgcacccccgccacatcattatatcagtgcttcc

SEQ ID NO: 149092 - DNA, 35 bp, Artificial Sequence
  Synthetic oligonucleotide
gaatcgcattgtgccctcccgtggtcttccgtcgc

SEQ ID NO: 149093 - DNA, 35 bp, Artificial Sequence
  Synthetic oligonucleotide
tgaccccccccccccatatgtattccaccagctgc

SEQ ID NO: 149094 - DNA, 35 bp, Artificial Sequence
  Synthetic oligonucleotide
gaccgtccctccccctccggctgccgacgcggatc

SEQ ID NO: 149095 - DNA, 35 bp, Artificial Sequence
  Synthetic oligonucleotide
atgtcagtcccccgccagcaatctactcgttactc

SEQ ID NO: 149096 - DNA, 35 bp, Artificial Sequence
  Synthetic oligonucleotide
gccgtgtgagcagtgcctactcttccttcttgctc

SEQ ID NO: 149097 - DNA, 35 bp, Artificial Sequence
  Synthetic oligonucleotide
tgctcacctgcccgcccctgccctcaggctcagtc

SEQ ID NO: 149098 - DNA, 35 bp, Artificial Sequence
  Synthetic oligonucleotide
gtactgcaccatcccacatcgacgttagcaatgtc

SEQ ID NO: 149099 - DNA, 35 bp, Artificial Sequence
  Synthetic oligonucleotide
atcgctcccctgcgcacatgaccgtccactctgtc

SEQ ID NO: 149100 - DNA, 35 bp, Artificial Sequence
  Synthetic oligonucleotide
gtacgcccttctctattcctttggacggttacttc

SEQ ID NO: 149101 - DNA, 35 bp, Artificial Sequence
  Synthetic oligonucleotide
ttcgacctcccctagcctgtccatcgagcttttag

SEQ ID NO: 149102 - DNA, 35 bp, Artificial Sequence
  Synthetic oligonucleotide
gctccacgaccaggcctgccattggcctcctcccg

SEQ ID NO: 149103 - DNA, 35 bp, Artificial Sequence
  Synthetic oligonucleotide
tgctcggtctgccctctttcgtccattccggtccg

SEQ ID NO: 149104 - DNA, 35 bp, Artificial Sequence
  Synthetic oligonucleotide
tgatccagggttggtacggggcggggggctggagg

SEQ ID NO: 149105 - DNA, 35 bp, Artificial Sequence
  Synthetic oligonucleotide
accgtcattgctcgctcccatcttccttcaacatg

SEQ ID NO: 149106 - DNA, 35 bp, Artificial Sequence
  Synthetic oligonucleotide
acaatcgtcacttgtcattcttctgctcgtaccat

SEQ ID NO: 149107 - DNA, 35 bp, Artificial Sequence
  Synthetic oligonucleotide
tgaggtgggatgggggttgggggggtgtaggtgat

SEQ ID NO: 149108 - DNA, 35 bp, Artificial Sequence
  Synthetic oligonucleotide
tacaccacgcgccttcctatctcccgtctattgat

SEQ ID NO: 149109 - DNA, 35 bp, Artificial Sequence
  Synthetic oligonucleotide
tcacctgcacttggctaaaaacgctcacacatcct

SEQ ID NO: 149110 - DNA, 35 bp, Artificial Sequence
  Synthetic oligonucleotide
aagggacggcccacagctgtttctatccgcctcct

SEQ ID NO: 149111 - DNA, 35 bp, Artificial Sequence
  Synthetic oligonucleotide
tcgcgtctcccgtactgcggatccttttgccctct

SEQ ID NO: 149112 - DNA, 35 bp, Artificial Sequence
  Synthetic oligonucleotide
gtgggaaccccatatgtactttttccggtgcctct

SEQ ID NO: 149113 - DNA, 35 bp, Artificial Sequence
  Synthetic oligonucleotide
tccgccacccgttccttccgtccccgaaaccgctt

SEQ ID NO: 149114 - DNA, 35 bp, Artificial Sequence
  Synthetic oligonucleotide
tcaccgccgaacgcgctaactgttctcttccattt

SEQ ID NO: 149115 - DNA, 35 bp, Artificial Sequence
  Synthetic oligonucleotide
gccatgatagctctgcccccttcgccttctgcttt

SEQ ID NO: 149116 - DNA, 36 bp, Artificial Sequence
  Synthetic oligonucleotide
gacaccccccgatggtcgcgattctgcctatctaaa

SEQ ID NO: 149117 - DNA, 35 bp, Artificial Sequence
  Synthetic oligonucleotide
gcaatgcgtctccggcaatccatcgctcctcgcaa

SEQ ID NO: 149118 - DNA, 35 bp, Artificial Sequence
  Synthetic oligonucleotide
tctccgccccataccacccagttcagtaccatcaa

SEQ ID NO: 149119 - DNA, 36 bp, Artificial Sequence
  Synthetic oligonucleotide
acacccagccacctcgcaggttatcgacgcccctaa

SEQ ID NO: 149120 - DNA, 36 bp, Artificial Sequence
  Synthetic oligonucleotide
tgcccaatcacacccctcccctagccggcgggctaa

SEQ ID NO: 149121 - DNA, 35 bp, Artificial Sequence
  Synthetic oligonucleotide
tgctgatcgcctctggttaccctatttaccgccca

SEQ ID NO: 149122 - DNA, 35 bp, Artificial Sequence
  Synthetic oligonucleotide
tgagtgctcgtactgtatccgtcattccgctccca

SEQ ID NO: 149123 - DNA, 36 bp, Artificial Sequence
  Synthetic oligonucleotide
accatcacactctgtcaatctctggcatagctgcca

SEQ ID NO: 149124 - DNA, 36 bp, Artificial Sequence
  Synthetic oligonucleotide
agtcccctccatgccgcaccgcctttattctacgca

SEQ ID NO: 149125 - DNA, 36 bp, Artificial Sequence
  Synthetic oligonucleotide
gacttctccccccctgcacctctacgctcgcgcgca

SEQ ID NO: 149126 - DNA, 37 bp, Artificial Sequence
  Synthetic oligonucleotide
tcacccatgcgtcctccttacctttgctccatctaga

SEQ ID NO: 149127 - DNA, 37 bp, Artificial Sequence
  Synthetic oligonucleotide
gatcaccgaccggtttcatcttgtctcactccgccga

SEQ ID NO: 149128 - DNA, 37 bp, Artificial Sequence
  Synthetic oligonucleotide
tatgcaaccgcccatcttactttgttgaaccctccga

SEQ ID NO: 149129 - DNA, 37 bp, Artificial Sequence
  Synthetic oligonucleotide
gtacccacgtccttgccttgatcattgcaccactcga

SEQ ID NO: 149130 - DNA, 37 bp, Artificial Sequence
  Synthetic oligonucleotide
gggagggcacaggagatcaagaattagggcgggagga

SEQ ID NO: 149131 - DNA, 37 bp, Artificial Sequence
  Synthetic oligonucleotide
gtcccgccctcccgcactcataccaccgcatgccgga

SEQ ID NO: 149132 - DNA, 37 bp, Artificial Sequence
  Synthetic oligonucleotide
atcgccccgccttcgtttccctgtacacttcgatgga

SEQ ID NO: 149133 - DNA, 34 bp, Artificial Sequence
  Synthetic oligonucleotide
acttagtagtgcagggaggggaggagggtgtgga

SEQ ID NO: 149134 - DNA, 37 bp, Artificial Sequence
  Synthetic oligonucleotide
gccgtcccgcttacgtttaccccctccgttcgttgga

SEQ ID NO: 149135 - DNA, 38 bp, Artificial Sequence
  Synthetic oligonucleotide
acctaccccccagttttcctctcggacaggcaatatga

SEQ ID NO: 149136 - DNA, 38 bp, Artificial Sequence
  Synthetic oligonucleotide
gccacggagtgcttctcccccccgccgaatactgctga

SEQ ID NO: 149137 - DNA, 37 bp, Artificial Sequence
  Synthetic oligonucleotide
tctgcccccactgtcgcacccctgtcaattcttctga

SEQ ID NO: 149138 - DNA, 35 bp, Artificial Sequence
  Synthetic oligonucleotide
acatcaccatgcccgcctcctgatccttcaggtga

SEQ ID NO: 149139 - DNA, 37 bp, Artificial Sequence
  Synthetic oligonucleotide
tcctcccgctcctgccctcgttatgacaccagggtga

SEQ ID NO: 149140 - DNA, 38 bp, Artificial Sequence
  Synthetic oligonucleotide
tcctccccaggggtgctccacctatgcctgactcttga

SEQ ID NO: 149141 - DNA, 36 bp, Artificial Sequence
  Synthetic oligonucleotide
ggggagggcgggggatttgggttggcgcatgtgata

SEQ ID NO: 149142 - DNA, 36 bp, Artificial Sequence
  Synthetic oligonucleotide
gacggaacaaggagaatgggaggggaaatgttgata

SEQ ID NO: 149143 - DNA, 36 bp, Artificial Sequence
  Synthetic oligonucleotide
accagtgccactcccctctgttaaatgcccctgcta

SEQ ID NO: 149144 - DNA, 36 bp, Artificial Sequence
  Synthetic oligonucleotide
tccgtacatgcccattggtttcctttttgtccctta

SEQ ID NO: 149145 - DNA, 35 bp, Artificial Sequence
  Synthetic oligonucleotide
gaagtggggctcaaaatctgggggcggggttcaac

SEQ ID NO: 149146 - DNA, 35 bp, Artificial Sequence
  Synthetic oligonucleotide
gccaaccactctctgccggtcctccacgagggaac

SEQ ID NO: 149147 - DNA, 35 bp, Artificial Sequence
  Synthetic oligonucleotide
gctactcaccatcgcgctgcctcctactcacaccc

SEQ ID NO: 149148 - DNA, 35 bp, Artificial Sequence
  Synthetic oligonucleotide
actcctaactgcgacgttgcagttgcccgattccc

SEQ ID NO: 149149 - DNA, 35 bp, Artificial Sequence
  Synthetic oligonucleotide
tgatcgttcacccatggtttatgccctgttccgcc

SEQ ID NO: 149150 - DNA, 35 bp, Artificial Sequence
  Synthetic oligonucleotide
aacgatgttagcgctgtccccctgtgaccccttcc

SEQ ID NO: 149151 - DNA, 35 bp, Artificial Sequence
  Synthetic oligonucleotide
ggtgcaaccacttctgtcattacatgtctgtttcc

SEQ ID NO: 149152 - DNA, 35 bp, Artificial Sequence
  Synthetic oligonucleotide
gcccacctccaagcattggcacccactggactcgc

SEQ ID NO: 149153 - DNA, 35 bp, Artificial Sequence
  Synthetic oligonucleotide
tcgttcgcgcgcaatgcctggctccactcttcatc

SEQ ID NO: 149154 - DNA, 35 bp, Artificial Sequence
  Synthetic oligonucleotide
accgacccggtcgcggacgtgtaccttggcccctc

SEQ ID NO: 149155 - DNA, 34 bp, Artificial Sequence
  Synthetic oligonucleotide
atgttgccatcgaagcgtgacccccagttttctc

SEQ ID NO: 149156 - DNA, 35 bp, Artificial Sequence
  Synthetic oligonucleotide
gcggaccgcctcacctgctatgacctatcctcttc

SEQ ID NO: 149157 - DNA, 35 bp, Artificial Sequence
  Synthetic oligonucleotide
attccgccccaaatgacgaccgcctactgcctaag

SEQ ID NO: 149158 - DNA, 35 bp, Artificial Sequence
  Synthetic oligonucleotide
agtccgctaccactatgctatacctctgccgcacg

SEQ ID NO: 149159 - DNA, 35 bp, Artificial Sequence
  Synthetic oligonucleotide
tttgagaggggaggggcgacaccatgggagggggg

SEQ ID NO: 149160 - DNA, 35 bp, Artificial Sequence
  Synthetic oligonucleotide
actggtgggccaatgggaggggttccttggggaat

SEQ ID NO: 149161 - DNA, 35 bp, Artificial Sequence
  Synthetic oligonucleotide
ggacgatcccctacagacctccgctcgctccgcct

SEQ ID NO: 149162 - DNA, 35 bp, Artificial Sequence
  Synthetic oligonucleotide
ttgatgcaccaggctctacgcctccaccgattcct

SEQ ID NO: 149163 - DNA, 35 bp, Artificial Sequence
  Synthetic oligonucleotide
taagggggggggagggtggtaatgtaacgatggct

SEQ ID NO: 149164 - DNA, 34 bp, Artificial Sequence
  Synthetic oligonucleotide
attccccctctcgtgctcgttcttagatcactct

SEQ ID NO: 149165 - DNA, 35 bp, Artificial Sequence
  Synthetic oligonucleotide
ttgacacccccaatactaagagctcccgctgttct

SEQ ID NO: 149166 - DNA, 35 bp, Artificial Sequence
  Synthetic oligonucleotide
gcccctgacccacctgccgctcaaaccgccgaatt

SEQ ID NO: 149167 - DNA, 32 bp, Artificial Sequence
  Synthetic oligonucleotide
gacgtaggccggagggggggggtcgtgggaaa

SEQ ID NO: 149168 - DNA, 36 bp, Artificial Sequence
  Synthetic oligonucleotide
ggtggtggggccgatggggtggtaattggggtgaaa

SEQ ID NO: 149169 - DNA, 36 bp, Artificial Sequence
  Synthetic oligonucleotide
gtctttcgcccatgacctacgttgccggttcactca

SEQ ID NO: 149170 - DNA, 36 bp, Artificial Sequence
  Synthetic oligonucleotide
ggtggtccgcctttcgcttttgagttgtctcgttca

SEQ ID NO: 149171 - DNA, 36 bp, Artificial Sequence
  Synthetic oligonucleotide
acacaccccatgctcgcctcttcagcaccccaccga

SEQ ID NO: 149172 - DNA, 37 bp, Artificial Sequence
  Synthetic oligonucleotide
gtccgcacaactgacgcatcacaagcgccgcccccga

SEQ ID NO: 149173 - DNA, 35 bp, Artificial Sequence
  Synthetic oligonucleotide
acccacttcacctagcgtacgcctagtcccttcga

SEQ ID NO: 149174 - DNA, 35 bp, Artificial Sequence
  Synthetic oligonucleotide
gaggggagagggaacggtgatgaggaaaactagga

SEQ ID NO: 149175 - DNA, 37 bp, Artificial Sequence
  Synthetic oligonucleotide
ggtcatgggggaagtgagggtatgggggtggtcggga

SEQ ID NO: 149176 - DNA, 37 bp, Artificial Sequence
  Synthetic oligonucleotide
acagtggtcagaggggagggcggggatcgtggtggga

SEQ ID NO: 149177 - DNA, 36 bp, Artificial Sequence
  Synthetic oligonucleotide
tcaacgccacaccgtactcgccgaattcccattgga

SEQ ID NO: 149178 - DNA, 38 bp, Artificial Sequence
  Synthetic oligonucleotide
gcagaccgaagaataggggataggtgaggggcggatga

SEQ ID NO: 149179 - DNA, 37 bp, Artificial Sequence
  Synthetic oligonucleotide
gattaccgccctctgttctatctgtgatttttcgtga

SEQ ID NO: 149180 - DNA, 38 bp, Artificial Sequence
  Synthetic oligonucleotide
ggggcggggacagctggggttcaaggtacaggggttga

SEQ ID NO: 149181 - DNA, 36 bp, Artificial Sequence
  Synthetic oligonucleotide
gtcgccttgccacccgaaggtcctatccctcgcata

SEQ ID NO: 149182 - DNA, 35 bp, Artificial Sequence
  Synthetic oligonucleotide
tctcaatgtcggctacgcatgtaatcgcctctcta

SEQ ID NO: 149183 - DNA, 36 bp, Artificial Sequence
  Synthetic oligonucleotide
tcagtcccctccgcgttccccgcaagccttgccgta

SEQ ID NO: 149184 - DNA, 36 bp, Artificial Sequence
  Synthetic oligonucleotide
tccgtaccaccccgcatccagtaatcctctgcttta

SEQ ID NO: 149185 - DNA, 35 bp, Artificial Sequence
  Synthetic oligonucleotide
acgatatgcacaccggtgtttttggtccgctcccc

SEQ ID NO: 149186 - DNA, 35 bp, Artificial Sequence
  Synthetic oligonucleotide
aagtctcggcgcctacactcactcccctcacgccc

SEQ ID NO: 149187 - DNA, 35 bp, Artificial Sequence
  Synthetic oligonucleotide
gccttcttcagttactgtacttatctgctccgccc

SEQ ID NO: 149188 - DNA, 35 bp, Artificial Sequence
  Synthetic oligonucleotide
aatacctctgtcccgcccccgtcacgcacgggccc

SEQ ID NO: 149189 - DNA, 35 bp, Artificial Sequence
  Synthetic oligonucleotide
tacgtccccgcttcgttatgatttacccgtgcgcc

SEQ ID NO: 149190 - DNA, 35 bp, Artificial Sequence
  Synthetic oligonucleotide
ggcgtgcctcctgcttgtcttaccctcatcctagc

SEQ ID NO: 149191 - DNA, 35 bp, Artificial Sequence
  Synthetic oligonucleotide
gtgcggtgaactcctgtcctatcctgcttgtacgc

SEQ ID NO: 149192 - DNA, 35 bp, Artificial Sequence
  Synthetic oligonucleotide
agcagaccagcaccacaccctgccccaccaagcgc

SEQ ID NO: 149193 - DNA, 35 bp, Artificial Sequence
  Synthetic oligonucleotide
tctccgcaggccaaatcttcttcaccggtcgctgc

SEQ ID NO: 149194 - DNA, 35 bp, Artificial Sequence
  Synthetic oligonucleotide
agaccatgcctccattattctcggttacctgcctc

SEQ ID NO: 149195 - DNA, 35 bp, Artificial Sequence
  Synthetic oligonucleotide
tgagggtgtccgctctggttccgtaagcccccgtc

SEQ ID NO: 149196 - DNA, 34 bp, Artificial Sequence
  Synthetic oligonucleotide
gactgcgactcttcttctatgtcctactgccttc

SEQ ID NO: 149197 - DNA, 35 bp, Artificial Sequence
  Synthetic oligonucleotide
gatgcctccagctcttcacataccttccatcacct

SEQ ID NO: 149198 - DNA, 35 bp, Artificial Sequence
  Synthetic oligonucleotide
aagcgggcgccggccgccatacaacctttctgcct

SEQ ID NO: 149199 - DNA, 35 bp, Artificial Sequence
  Synthetic oligonucleotide
tctaccgtcagaacatccccgccgtcttctttcgt

SEQ ID NO: 149200 - DNA, 35 bp, Artificial Sequence
  Synthetic oligonucleotide
accctctcgctccatgtctcgtatacattctaggt

SEQ ID NO: 149201 - DNA, 35 bp, Artificial Sequence
  Synthetic oligonucleotide
gtcatagccgggggtcgaaaaagtgggtgggtggt

SEQ ID NO: 149202 - DNA, 35 bp, Artificial Sequence
  Synthetic oligonucleotide
tgcaagcttcaggaccgccccactgtcgctgcctt

SEQ ID NO: 149203 - DNA, 35 bp, Artificial Sequence
  Synthetic oligonucleotide
taacaccgttcacccggccaacataattgcttttt

SEQ ID NO: 149204 - DNA, 36 bp, Artificial Sequence
  Synthetic oligonucleotide
gtctcggagaaagggaaaaggaggcggggcatgaaa

SEQ ID NO: 149205 - DNA, 35 bp, Artificial Sequence
  Synthetic oligonucleotide
tccactccctggccactctgttcgatcttctgaaa

SEQ ID NO: 149206 - DNA, 36 bp, Artificial Sequence
  Synthetic oligonucleotide
atgtgacagccccgtccgacctatccgtccatccaa

SEQ ID NO: 149207 - DNA, 36 bp, Artificial Sequence
  Synthetic oligonucleotide
actcccactgccacatctgtactcatccgacgggaa

SEQ ID NO: 149208 - DNA, 35 bp, Artificial Sequence
  Synthetic oligonucleotide
atcgatgggaaagacgcatgggagcagggcgggaa

SEQ ID NO: 149209 - DNA, 35 bp, Artificial Sequence
  Synthetic oligonucleotide
gtctccacacaccgcttactctcgtacttaagcca

SEQ ID NO: 149210 - DNA, 35 bp, Artificial Sequence
  Synthetic oligonucleotide
ggggataggggggtagaaacacggtgaagggaaga

SEQ ID NO: 149211 - DNA, 37 bp, Artificial Sequence
  Synthetic oligonucleotide
acagctccgctacgtcacattcgctccatcgccccga

SEQ ID NO: 149212 - DNA, 37 bp, Artificial Sequence
  Synthetic oligonucleotide
acccgccatcacccgttattgtaaccccccactccga

SEQ ID NO: 149213 - DNA, 37 bp, Artificial Sequence
  Synthetic oligonucleotide
tgtcacgtcaaccttttgttcctaccgccaccttcga

SEQ ID NO: 149214 - DNA, 37 bp, Artificial Sequence
  Synthetic oligonucleotide
gagtaggggtggttggacctgaggaacgggagaggga

SEQ ID NO: 149215 - DNA, 37 bp, Artificial Sequence
  Synthetic oligonucleotide
taggagtgaagcaagcaagtgggtgggcatgggggga

SEQ ID NO: 149216 - DNA, 37 bp, Artificial Sequence
  Synthetic oligonucleotide
atggggacgggatcggcgggggactctcgtgggggga

SEQ ID NO: 149217 - DNA, 35 bp, Artificial Sequence
  Synthetic oligonucleotide
gaggaggtggggtgcaggggtggggaacactggga

SEQ ID NO: 149218 - DNA, 35 bp, Artificial Sequence
  Synthetic oligonucleotide
tctaccgccctaacataccctccgccttctttgga

SEQ ID NO: 149219 - DNA, 38 bp, Artificial Sequence
  Synthetic oligonucleotide
ccaggggcgcatttgggggaggcgggaggcataggtga

SEQ ID NO: 149220 - DNA, 38 bp, Artificial Sequence
  Synthetic oligonucleotide
gaaggagagggggaggtaggacataaggcccagcttga

SEQ ID NO: 149221 - DNA, 37 bp, Artificial Sequence
  Synthetic oligonucleotide
ggggagggacagatggggtactaggggtccactttga

SEQ ID NO: 149222 - DNA, 35 bp, Artificial Sequence
  Synthetic oligonucleotide
tgctctcatcggcaccagtgctacgcccacctcta

SEQ ID NO: 149223 - DNA, 35 bp, Artificial Sequence
  Synthetic oligonucleotide
ttgctgtcggatgccgctgcgcccctccacctcta

SEQ ID NO: 149224 - DNA, 36 bp, Artificial Sequence
  Synthetic oligonucleotide
tctgtacctcctcgccctcggacactacgtattgta

SEQ ID NO: 149225 - DNA, 36 bp, Artificial Sequence
  Synthetic oligonucleotide
tacgtactaccgcctgaaggtagctccaccacctta

SEQ ID NO: 149226 - DNA, 36 bp, Artificial Sequence
  Synthetic oligonucleotide
gaccacccgctacttcctctcgaattgtgactttta

SEQ ID NO: 149227 - DNA, 35 bp, Artificial Sequence
  Synthetic oligonucleotide
atccccgcgctggaacgcgtgccccaccttccacc

SEQ ID NO: 149228 - DNA, 35 bp, Artificial Sequence
  Synthetic oligonucleotide
ggttgggccccttgtctctttactatgcctgcacc

SEQ ID NO: 149229 - DNA, 35 bp, Artificial Sequence
  Synthetic oligonucleotide
tgtccgtactgctatgcttcaccgtttccgcgccc

SEQ ID NO: 149230 - DNA, 35 bp, Artificial Sequence
  Synthetic oligonucleotide
acgcaggctccacagtcccccccggtcttttgccc

SEQ ID NO: 149231 - DNA, 35 bp, Artificial Sequence
  Synthetic oligonucleotide
tcatgccgattctctcgcgccctacatgagctccc

SEQ ID NO: 149232 - DNA, 35 bp, Artificial Sequence
  Synthetic oligonucleotide
tgtacctatagctgaagccctgccatccacccgcc

SEQ ID NO: 149233 - DNA, 35 bp, Artificial Sequence
  Synthetic oligonucleotide
tcagtactggccatctatcgagtgtcatcctatcc

SEQ ID NO: 149234 - DNA, 35 bp, Artificial Sequence
  Synthetic oligonucleotide
tgagagcccatcctggcgtaagctccacacgttcc

SEQ ID NO: 149235 - DNA, 35 bp, Artificial Sequence
  Synthetic oligonucleotide
ggtatccccgtcgctacgtagcgcaacaccctctc

SEQ ID NO: 149236 - DNA, 35 bp, Artificial Sequence
  Synthetic oligonucleotide
gtggtagcatcataccgtcccttttgctgtacttc

SEQ ID NO: 149237 - DNA, 35 bp, Artificial Sequence
  Synthetic oligonucleotide
cacgctgagccgccatccgttcaccgcctctgttc

SEQ ID NO: 149238 - DNA, 35 bp, Artificial Sequence
  Synthetic oligonucleotide
tgctgcccgccctctcactagtccctcgttttccg

SEQ ID NO: 149239 - DNA, 35 bp, Artificial Sequence
  Synthetic oligonucleotide
acatccatacgtctgccgacaaccctgcgctctcg

SEQ ID NO: 149240 - DNA, 35 bp, Artificial Sequence
  Synthetic oligonucleotide
acgagtaggtagggcgcaaggggctgcaaaagggg

SEQ ID NO: 149241 - DNA, 35 bp, Artificial Sequence
  Synthetic oligonucleotide
gtgggccacctcacctacgtctttacttagccttg

SEQ ID NO: 149242 - DNA, 35 bp, Artificial Sequence
  Synthetic oligonucleotide
ttcgcccgttcacgagtgcacttccgaaccttcct

SEQ ID NO: 149243 - DNA, 35 bp, Artificial Sequence
  Synthetic oligonucleotide
taatcggtgcgggaggggagggtgagctgcatgct

SEQ ID NO: 149244 - DNA, 33 bp, Artificial Sequence
  Synthetic oligonucleotide
atactccgccgtttactgatccccacatccagt

SEQ ID NO: 149245 - DNA, 35 bp, Artificial Sequence
  Synthetic oligonucleotide
gccgggttatcctcagatcttatccacctccatgt

SEQ ID NO: 149246 - DNA, 35 bp, Artificial Sequence
  Synthetic oligonucleotide
aacatccgcctgttttatgcacacgactctgcaca

SEQ ID NO: 149247 - DNA, 35 bp, Artificial Sequence
  Synthetic oligonucleotide
ccctgccgccactccgctacccatttgactcttca

SEQ ID NO: 149248 - DNA, 35 bp, Artificial Sequence
  Synthetic oligonucleotide
gatcaccatctgcgccagaaccatctgcctgttca

SEQ ID NO: 149249 - DNA, 35 bp, Artificial Sequence
  Synthetic oligonucleotide
tttgtcaccctaggcgctccctccatgcttgttca

SEQ ID NO: 149250 - DNA, 37 bp, Artificial Sequence
  Synthetic oligonucleotide
atgtaggaggggtgcggtgagggcaggtttagacaga

SEQ ID NO: 149251 - DNA, 36 bp, Artificial Sequence
  Synthetic oligonucleotide
atcaccccgcccggtactcttcatcacacctgacga

SEQ ID NO: 149252 - DNA, 37 bp, Artificial Sequence
  Synthetic oligonucleotide
tcctacgtccctccctgcaatcacatgctctgtacga

SEQ ID NO: 149253 - DNA, 37 bp, Artificial Sequence
  Synthetic oligonucleotide
attcccgcatccactgagttatttgttcccatctcga

SEQ ID NO: 149254 - DNA, 37 bp, Artificial Sequence
  Synthetic oligonucleotide
tcagtcacagccatcattatcccagcctttcgttcga

SEQ ID NO: 149255 - DNA, 36 bp, Artificial Sequence
  Synthetic oligonucleotide
gctgggtgggtaggtaagagaggtttgggggcggga

SEQ ID NO: 149256 - DNA, 37 bp, Artificial Sequence
  Synthetic oligonucleotide
gtccgtgagcggggaaaggggggcggtcgacagtgga

SEQ ID NO: 149257 - DNA, 37 bp, Artificial Sequence
  Synthetic oligonucleotide
tgcatgtcgccttttggttttctccccctcctttgga

SEQ ID NO: 149258 - DNA, 38 bp, Artificial Sequence
  Synthetic oligonucleotide
tgtcctgccagatctcctgctcatactccgccaactga

SEQ ID NO: 149259 - DNA, 38 bp, Artificial Sequence
  Synthetic oligonucleotide
ggtcacggtggagaaaggggaaggcgggtagggggtga

SEQ ID NO: 149260 - DNA, 38 bp, Artificial Sequence
  Synthetic oligonucleotide
tccgcacgggccaactgcctgtcctccattacccttga

SEQ ID NO: 149261 - DNA, 37 bp, Artificial Sequence
  Synthetic oligonucleotide
tatcgtgccgccgctcttattggtccacctgccttga

SEQ ID NO: 149262 - DNA, 38 bp, Artificial Sequence
  Synthetic oligonucleotide
cgacttggtcgctatcttagccatttgacctctcttga

SEQ ID NO: 149263 - DNA, 35 bp, Artificial Sequence
  Synthetic oligonucleotide
gtggaggtaggaggataaggcaaaaagggtggata

SEQ ID NO: 149264 - DNA, 36 bp, Artificial Sequence
  Synthetic oligonucleotide
tgtgcgagccgccgtttcaccctcccccgtttatta

SEQ ID NO: 149265 - DNA, 36 bp, Artificial Sequence
  Synthetic oligonucleotide
tgactactgacactcgtacgatcgccactgccctta

SEQ ID NO: 149266 - DNA, 35 bp, Artificial Sequence
  Synthetic oligonucleotide
atcaatcggccactgctgcttaccccactacgtta

SEQ ID NO: 149267 - DNA, 35 bp, Artificial Sequence
  Synthetic oligonucleotide
acatgcgcacttgttttgcctccgtcctgtaccac

SEQ ID NO: 149268 - DNA, 34 bp, Artificial Sequence
  Synthetic oligonucleotide
tcatgcgcgccgcacgcatcatcacccagtcgac

SEQ ID NO: 149269 - DNA, 34 bp, Artificial Sequence
  Synthetic oligonucleotide
gtcgctgcacctgtacgactccttcctcctgccc

SEQ ID NO: 149270 - DNA, 35 bp, Artificial Sequence
  Synthetic oligonucleotide
tgtggcccccgaactgttttctcgcccttaccgcc

SEQ ID NO: 149271 - DNA, 35 bp, Artificial Sequence
  Synthetic oligonucleotide
aacaccaaagggggggggaccgagggagggcggcc

SEQ ID NO: 149272 - DNA, 35 bp, Artificial Sequence
  Synthetic oligonucleotide
gttccgtcataccattcagttcgccttttcttgcc

SEQ ID NO: 149273 - DNA, 35 bp, Artificial Sequence
  Synthetic oligonucleotide
ttcgcccccgctgcgagcacctccactttgttgcc

SEQ ID NO: 149274 - DNA, 35 bp, Artificial Sequence
  Synthetic oligonucleotide
ttttgcgcacagtgtttccttagtttcatctgtcc

SEQ ID NO: 149275 - DNA, 35 bp, Artificial Sequence
  Synthetic oligonucleotide
tcgcacttccgccgccgttcttaagctagttttcc

SEQ ID NO: 149276 - DNA, 34 bp, Artificial Sequence
  Synthetic oligonucleotide
gtgcacgactgcttctttagtactccacccccgc

SEQ ID NO: 149277 - DNA, 35 bp, Artificial Sequence
  Synthetic oligonucleotide
ggacctaccgaccccttcgtcacacaccatctggc

SEQ ID NO: 149278 - DNA, 35 bp, Artificial Sequence
  Synthetic oligonucleotide
gccgcgccaccaccgccgataaatctgccttctgc

SEQ ID NO: 149279 - DNA, 35 bp, Artificial Sequence
  Synthetic oligonucleotide
actgatccactctccgtgcgcacgcattaccaatc

SEQ ID NO: 149280 - DNA, 35 bp, Artificial Sequence
  Synthetic oligonucleotide
aagcccccgaagtagtccctgctcctccccatgtc

SEQ ID NO: 149281 - DNA, 35 bp, Artificial Sequence
  Synthetic oligonucleotide
tgcgatcatgcccttatcgcgttttctttcctgtc

SEQ ID NO: 149282 - DNA, 35 bp, Artificial Sequence
  Synthetic oligonucleotide
ttctcgccctcatagtttcccacggtgcagccttc

SEQ ID NO: 149283 - DNA, 35 bp, Artificial Sequence
  Synthetic oligonucleotide
atccctcctgtaacgctgtgaactgtcctgccttc

SEQ ID NO: 149284 - DNA, 33 bp, Artificial Sequence
  Synthetic oligonucleotide
ggggtcgcccacaccttaggtatttactgtttc

SEQ ID NO: 149285 - DNA, 35 bp, Artificial Sequence
  Synthetic oligonucleotide
aacacacggtctctttgttgtaccatccttagccg

SEQ ID NO: 149286 - DNA, 35 bp, Artificial Sequence
  Synthetic oligonucleotide
gtaacgggtgaggggtacggggaaaacggacagcg

SEQ ID NO: 149287 - DNA, 35 bp, Artificial Sequence
  Synthetic oligonucleotide
tgaacgcggaacctcgcctcttcacccctgccgcg

SEQ ID NO: 149288 - DNA, 32 bp, Artificial Sequence
  Synthetic oligonucleotide
aaccgccccttacctagctaaaccacctcgcg

SEQ ID NO: 149289 - DNA, 33 bp, Artificial Sequence
  Synthetic oligonucleotide
ttcgcacctctctatcattccgcccgggtgtcg

SEQ ID NO: 149290 - DNA, 35 bp, Artificial Sequence
  Synthetic oligonucleotide
gcacccaccatcgtgcctgcacgcttccctcttcg

SEQ ID NO: 149291 - DNA, 35 bp, Artificial Sequence
  Synthetic oligonucleotide
tccatcagcctccttctgcttcgttttcactaggg

SEQ ID NO: 149292 - DNA, 35 bp, Artificial Sequence
  Synthetic oligonucleotide
tcacgactcccgctgcctccgccatcattctcttg

SEQ ID NO: 149293 - DNA, 35 bp, Artificial Sequence
  Synthetic oligonucleotide
acacagttcacatcatgtccccccagtaccgcact

SEQ ID NO: 149294 - DNA, 35 bp, Artificial Sequence
  Synthetic oligonucleotide
gatcctcctcactctatgtttttcgatcccagact

SEQ ID NO: 149295 - DNA, 35 bp, Artificial Sequence
  Synthetic oligonucleotide
gagttcgtgccgccgccctcatagcctgactcgct

SEQ ID NO: 149296 - DNA, 35 bp, Artificial Sequence
  Synthetic oligonucleotide
tcccattgcttcaccacgtttacttgcatgtctct

SEQ ID NO: 149297 - DNA, 35 bp, Artificial Sequence
  Synthetic oligonucleotide
tgtgtacgtcaagccacttcctccgcttccagtct

SEQ ID NO: 149298 - DNA, 35 bp, Artificial Sequence
  Synthetic oligonucleotide
tggacgtcacgatcgtttcccctgtcatcatgtct

SEQ ID NO: 149299 - DNA, 35 bp, Artificial Sequence
  Synthetic oligonucleotide
aatgggagggcgggtcggataggtcgcactggggt

SEQ ID NO: 149300 - DNA, 36 bp, Artificial Sequence
  Synthetic oligonucleotide
attccgcccctctctgttcctcctctgcgaggaaaa

SEQ ID NO: 149301 - DNA, 36 bp, Artificial Sequence
  Synthetic oligonucleotide
gacatgccacgtagtcctcctcttcccacccgcgaa

SEQ ID NO: 149302 - DNA, 36 bp, Artificial Sequence
  Synthetic oligonucleotide
gtacgccccccgttaatacccatcggttctcctgaa

SEQ ID NO: 149303 - DNA, 35 bp, Artificial Sequence
  Synthetic oligonucleotide
gcccaccactcaaacacgaatgccggatggcctaa

SEQ ID NO: 149304 - DNA, 36 bp, Artificial Sequence
  Synthetic oligonucleotide
gatccacccctgctattatcccttatatgggcacca

SEQ ID NO: 149305 - DNA, 36 bp, Artificial Sequence
  Synthetic oligonucleotide
gcctgtcacgtgcctatttatttcgtcctgctcgca

SEQ ID NO: 149306 - DNA, 35 bp, Artificial Sequence
  Synthetic oligonucleotide
gtcacccccactgttccgagtgtcacttgcatgca

SEQ ID NO: 149307 - DNA, 36 bp, Artificial Sequence
  Synthetic oligonucleotide
gtcccctcccagcgggtcccacactatagccctgca

SEQ ID NO: 149308 - DNA, 36 bp, Artificial Sequence
  Synthetic oligonucleotide
agtccgcccacgactttattgcgccatcccgttgca

SEQ ID NO: 149309 - DNA, 37 bp, Artificial Sequence
  Synthetic oligonucleotide
gatcggggggcgagggcggggaggggctcaataacga

SEQ ID NO: 149310 - DNA, 37 bp, Artificial Sequence
  Synthetic oligonucleotide
tgtgccccaaggacgtgtcccttttccctgttcacga

SEQ ID NO: 149311 - DNA, 37 bp, Artificial Sequence
  Synthetic oligonucleotide
actcgccgtcctccttggccatttcacctgcctacga

SEQ ID NO: 149312 - DNA, 37 bp, Artificial Sequence
  Synthetic oligonucleotide
gtggccctccgccatctgtcttattagcctcccccga

SEQ ID NO: 149313 - DNA, 37 bp, Artificial Sequence
  Synthetic oligonucleotide
ttgtcccccgctcacactcgtatctatgtagttccga

SEQ ID NO: 149314 - DNA, 37 bp, Artificial Sequence
  Synthetic oligonucleotide
attgcgaacgaggtaagaagggggtggtacgaacgga

SEQ ID NO: 149315 - DNA, 37 bp, Artificial Sequence
  Synthetic oligonucleotide
attgcaccccctatgctacaacgctccaccccccgga

SEQ ID NO: 149316 - DNA, 37 bp, Artificial Sequence
  Synthetic oligonucleotide
tccccccgactccgcccatccgcgtgatacctccgga

SEQ ID NO: 149317 - DNA, 37 bp, Artificial Sequence
  Synthetic oligonucleotide
tgccaactccctgcctgtttcttcgggtccattcgga

SEQ ID NO: 149318 - DNA, 37 bp, Artificial Sequence
  Synthetic oligonucleotide
gtacagcccccccctcgccgtattggacgcccaatga

SEQ ID NO: 149319 - DNA, 37 bp, Artificial Sequence
  Synthetic oligonucleotide
tcccacttcacgtctgtctctcgctccccacgtatga

SEQ ID NO: 149320 - DNA, 38 bp, Artificial Sequence
  Synthetic oligonucleotide
atagcccgcccattgtcgtcacaccacctttcacctga

SEQ ID NO: 149321 - DNA, 38 bp, Artificial Sequence
  Synthetic oligonucleotide
tcccgccacacgccgccattcttagggactacccctga

SEQ ID NO: 149322 - DNA, 38 bp, Artificial Sequence
  Synthetic oligonucleotide
acgctccatcatgcacgttttgtccttccagtcggtga

SEQ ID NO: 149323 - DNA, 37 bp, Artificial Sequence
  Synthetic oligonucleotide
tcgcacttcccctgctgctactacggtaacccattga

SEQ ID NO: 149324 - DNA, 38 bp, Artificial Sequence
  Synthetic oligonucleotide
atcgatctaccccgccctgtttgtatgcgccgcattga

SEQ ID NO: 149325 - DNA, 36 bp, Artificial Sequence
  Synthetic oligonucleotide
tgctatcgctttctgtctcctatttgcccacctata

SEQ ID NO: 149326 - DNA, 35 bp, Artificial Sequence
  Synthetic oligonucleotide
ttccggctcggagcccgccctgccttcttgcccta

SEQ ID NO: 149327 - DNA, 36 bp, Artificial Sequence
  Synthetic oligonucleotide
tacttgcaccactgattcgccacagcacctttccta

SEQ ID NO: 149328 - DNA, 35 bp, Artificial Sequence
  Synthetic oligonucleotide
tagccgccttatgtaccgtcctgccatccccgcta

SEQ ID NO: 149329 - DNA, 35 bp, Artificial Sequence
  Synthetic oligonucleotide
ttgaccacccgcctctctgttggtacttggttgta

SEQ ID NO: 149330 - DNA, 36 bp, Artificial Sequence
  Synthetic oligonucleotide
tccccactgcaattgatctttgccatcctgtactta

SEQ ID NO: 149331 - DNA, 35 bp, Artificial Sequence
  Synthetic oligonucleotide
gaacgactcccccttaccgagtcctggtataccac

SEQ ID NO: 149332 - DNA, 35 bp, Artificial Sequence
  Synthetic oligonucleotide
accatacgcccttcccctacgttacaggcgcctac

SEQ ID NO: 149333 - DNA, 35 bp, Artificial Sequence
  Synthetic oligonucleotide
tagaccccctcccccaagaccggcgcactgcgtac

SEQ ID NO: 149334 - DNA, 35 bp, Artificial Sequence
  Synthetic oligonucleotide
tgcctccaccccggcctcacaagtcttcgagaccc

SEQ ID NO: 149335 - DNA, 35 bp, Artificial Sequence
  Synthetic oligonucleotide
gttgtcacctcggtgaattgcatgcctcccgaccc

SEQ ID NO: 149336 - DNA, 35 bp, Artificial Sequence
  Synthetic oligonucleotide
gagatgcctcggactaccttagatgctttccgccc

SEQ ID NO: 149337 - DNA, 35 bp, Artificial Sequence
  Synthetic oligonucleotide
gctgccgacgccgcctgaaaagatcgcatactccc

SEQ ID NO: 149338 - DNA, 35 bp, Artificial Sequence
  Synthetic oligonucleotide
atcgccacctccgcgcgcatatattttcgtaatcc

SEQ ID NO: 149339 - DNA, 35 bp, Artificial Sequence
  Synthetic oligonucleotide
accgccactggagttagcgtgcctcgttccggtcc

SEQ ID NO: 149340 - DNA, 35 bp, Artificial Sequence
  Synthetic oligonucleotide
gttaccacccacgcaattcaaagcatgctttgtcc

SEQ ID NO: 149341 - DNA, 35 bp, Artificial Sequence
  Synthetic oligonucleotide
gaacaaggacacgagggggggcgggacgacacggc

SEQ ID NO: 149342 - DNA, 35 bp, Artificial Sequence
  Synthetic oligonucleotide
atcgctgatgccacggtccatccacctcaacctgc

SEQ ID NO: 149343 - DNA, 34 bp, Artificial Sequence
  Synthetic oligonucleotide
ttgggcctccgctcgtttacacttccggttactc

SEQ ID NO: 149344 - DNA, 35 bp, Artificial Sequence
  Synthetic oligonucleotide
aacgcaaccttagctggccatttcctctaactctc

SEQ ID NO: 149345 - DNA, 35 bp, Artificial Sequence
  Synthetic oligonucleotide
gcgtagtacgtccgttttctcttcctatgtcggtc

SEQ ID NO: 149346 - DNA, 35 bp, Artificial Sequence
  Synthetic oligonucleotide
acaccttcgccctccacagcccgccatgcgatagg

SEQ ID NO: 149347 - DNA, 34 bp, Artificial Sequence
  Synthetic oligonucleotide
agcacatacaccccgccctactccgctagtccgg

SEQ ID NO: 149348 - DNA, 35 bp, Artificial Sequence
  Synthetic oligonucleotide
tctccgccccgatccaaccctcctagcgtgctctg

SEQ ID NO: 149349 - DNA, 35 bp, Artificial Sequence
  Synthetic oligonucleotide
gtcacgttcttccccgttgccgctacagcctattg

SEQ ID NO: 149350 - DNA, 35 bp, Artificial Sequence
  Synthetic oligonucleotide
ttgcgaccgttgctccggctctccccgttttcact

SEQ ID NO: 149351 - DNA, 35 bp, Artificial Sequence
  Synthetic oligonucleotide
tcacagaccgccctcaatagctgctgcactatact

SEQ ID NO: 149352 - DNA, 35 bp, Artificial Sequence
  Synthetic oligonucleotide
tccacaatcccacacaacggtattataccgaccct

SEQ ID NO: 149353 - DNA, 35 bp, Artificial Sequence
  Synthetic oligonucleotide
atgcccccagcccgtcaattccaccaggcgcgcct

SEQ ID NO: 149354 - DNA, 35 bp, Artificial Sequence
  Synthetic oligonucleotide
tgtccccgccacccccggaaaaaaggacctcgcct

SEQ ID NO: 149355 - DNA, 35 bp, Artificial Sequence
  Synthetic oligonucleotide
tagtgcgcagatcaacgtacatccctcccttttgt

SEQ ID NO: 149356 - DNA, 35 bp, Artificial Sequence
  Synthetic oligonucleotide
gccatcccggacaggcttcctccttctcacccgtt

SEQ ID NO: 149357 - DNA, 35 bp, Artificial Sequence
  Synthetic oligonucleotide
agcgcagacgcccggtgccgccgttactcctacca

SEQ ID NO: 149358 - DNA, 35 bp, Artificial Sequence
  Synthetic oligonucleotide
tccactgactccgactgttcgaccaaactcgccca

SEQ ID NO: 149359 - DNA, 35 bp, Artificial Sequence
  Synthetic oligonucleotide
atccatcgccgccgcacctggtaagcttgttgcca

SEQ ID NO: 149360 - DNA, 36 bp, Artificial Sequence
  Synthetic oligonucleotide
ttcacgccaccaccctcgcaggttaacactggtcca

SEQ ID NO: 149361 - DNA, 30 bp, Artificial Sequence
  Synthetic oligonucleotide
gtcctttcgtcgaccgctttcaccccatca

SEQ ID NO: 149362 - DNA, 35 bp, Artificial Sequence
  Synthetic oligonucleotide
accgcgcccacctttcgcgaatttcgacactatca

SEQ ID NO: 149363 - DNA, 36 bp, Artificial Sequence
  Synthetic oligonucleotide
tgccagacccgaaacgtcgtctttaataccgcctca

SEQ ID NO: 149364 - DNA, 33 bp, Artificial Sequence
  Synthetic oligonucleotide
agtaccgcccccctaaccgttcgatcggcctca

SEQ ID NO: 149365 - DNA, 37 bp, Artificial Sequence
  Synthetic oligonucleotide
gacgtagaggggagaggggccggacgggaggataaga

SEQ ID NO: 149366 - DNA, 36 bp, Artificial Sequence
  Synthetic oligonucleotide
aacagggtggagaaggggcgtttgccagggaggaga

SEQ ID NO: 149367 - DNA, 37 bp, Artificial Sequence
  Synthetic oligonucleotide
aagacgggactgttgtaggtgacgtgagggagggaga

SEQ ID NO: 149368 - DNA, 37 bp, Artificial Sequence
  Synthetic oligonucleotide
agatgggggtggcgggggagggtagccgttgcgacga

SEQ ID NO: 149369 - DNA, 37 bp, Artificial Sequence
  Synthetic oligonucleotide
ttccgcccacttcctggttcattgcccgcctcctcga

SEQ ID NO: 149370 - DNA, 37 bp, Artificial Sequence
  Synthetic oligonucleotide
tccgcatgcacgctagccgcggttcccatcttttcga

SEQ ID NO: 149371 - DNA, 36 bp, Artificial Sequence
  Synthetic oligonucleotide
gatgctcatccgacccacctagctcgtcccaacgga

SEQ ID NO: 149372 - DNA, 35 bp, Artificial Sequence
  Synthetic oligonucleotide
tgtacgacgggaaagggagggccatatgtaaggga

SEQ ID NO: 149373 - DNA, 36 bp, Artificial Sequence
  Synthetic oligonucleotide
ttgggcgggggtcatttggggacaggatttagggga

SEQ ID NO: 149374 - DNA, 37 bp, Artificial Sequence
  Synthetic oligonucleotide
accgtacctcccattgcaaacctgcgacgcccatgga

SEQ ID NO: 149375 - DNA, 37 bp, Artificial Sequence
  Synthetic oligonucleotide
atagaagtgggggtgggtgtgaggggagggtacctga

SEQ ID NO: 149376 - DNA, 38 bp, Artificial Sequence
  Synthetic oligonucleotide
gatgtcgcttgcacactattagcccctgtttcccctga

SEQ ID NO: 149377 - DNA, 36 bp, Artificial Sequence
  Synthetic oligonucleotide
tcatgttgcccggcccttcgactctactcgccctga

SEQ ID NO: 149378 - DNA, 38 bp, Artificial Sequence
  Synthetic oligonucleotide
gcaacctctccacacgcattgacgacctttcctcctga

SEQ ID NO: 149379 - DNA, 38 bp, Artificial Sequence
  Synthetic oligonucleotide
attcgaggacggattgggtggggatgggacggggctga

SEQ ID NO: 149380 - DNA, 38 bp, Artificial Sequence
  Synthetic oligonucleotide
gcacgccgcccagccagcaccgttattcgcccttctga

SEQ ID NO: 149381 - DNA, 38 bp, Artificial Sequence
  Synthetic oligonucleotide
aagtcacgcgccacctgctccatatgctccttttctga

SEQ ID NO: 149382 - DNA, 38 bp, Artificial Sequence
  Synthetic oligonucleotide
tagcgcgtaggggtgcaggatggagagggggggagtga

SEQ ID NO: 149383 - DNA, 36 bp, Artificial Sequence
  Synthetic oligonucleotide
gatcgcaccggttcgtctctcgttgcacctttcgta

SEQ ID NO: 149384 - DNA, 36 bp, Artificial Sequence
  Synthetic oligonucleotide
tgaggggccaatgtgtggggtgggcacccaggggta

SEQ ID NO: 149385 - DNA, 35 bp, Artificial Sequence
  Synthetic oligonucleotide
tcagggggacttgttgggggtccaagggcggggta

SEQ ID NO: 149386 - DNA, 35 bp, Artificial Sequence
  Synthetic oligonucleotide
gcccacatctcattgtctcaattcgcttcgcttta

SEQ ID NO: 149387 - DNA, 35 bp, Artificial Sequence
  Synthetic oligonucleotide
tctcgatcgcccaccgcctatacttacccagccac

SEQ ID NO: 149388 - DNA, 35 bp, Artificial Sequence
  Synthetic oligonucleotide
acgttgttccaaatctgtccgctggcccgccctac

SEQ ID NO: 149389 - DNA, 35 bp, Artificial Sequence
  Synthetic oligonucleotide
tctccgctgtcgacgtcacgtgccccggcctcacc

SEQ ID NO: 149390 - DNA, 35 bp, Artificial Sequence
  Synthetic oligonucleotide
tggacgaccttcagtgattacttccccacgtcccc

SEQ ID NO: 149391 - DNA, 35 bp, Artificial Sequence
  Synthetic oligonucleotide
atggtgggtgcgcatggcccttactgctgctttcc

SEQ ID NO: 149392 - DNA, 35 bp, Artificial Sequence
  Synthetic oligonucleotide
gtagaccagcatacgttctgtactgacccctccgc

SEQ ID NO: 149393 - DNA, 35 bp, Artificial Sequence
  Synthetic oligonucleotide
tcagcccgaacgccgcactcacttgaccctccggc

SEQ ID NO: 149394 - DNA, 35 bp, Artificial Sequence
  Synthetic oligonucleotide
tcctaacccgtccactgttccgccatccttgttgc

SEQ ID NO: 149395 - DNA, 35 bp, Artificial Sequence
  Synthetic oligonucleotide
gttccagtacgcacccccctgtcatacacatcatc

SEQ ID NO: 149396 - DNA, 35 bp, Artificial Sequence
  Synthetic oligonucleotide
gcccccacacttgtctatcccgggtaaaatccgtc

SEQ ID NO: 149397 - DNA, 35 bp, Artificial Sequence
  Synthetic oligonucleotide
gagctcctctgaccactctggcgccctactccgtc

SEQ ID NO: 149398 - DNA, 35 bp, Artificial Sequence
  Synthetic oligonucleotide
ggtcggagttgttgggtgggtgagggtgaagggag

SEQ ID NO: 149399 - DNA, 35 bp, Artificial Sequence
  Synthetic oligonucleotide
tttgccgcccaaacatcccctgccatcttcaatag

SEQ ID NO: 149400 - DNA, 35 bp, Artificial Sequence
  Synthetic oligonucleotide
tgccgaaaccagacgccacccccccccgtctcccg

SEQ ID NO: 149401 - DNA, 35 bp, Artificial Sequence
  Synthetic oligonucleotide
gtgcacatcagtctgtctcaaatccgccactgccg

SEQ ID NO: 149402 - DNA, 35 bp, Artificial Sequence
  Synthetic oligonucleotide
gaagggcgggcgggtcataaggggcgggaagtgcg

SEQ ID NO: 149403 - DNA, 35 bp, Artificial Sequence
  Synthetic oligonucleotide
tgcgatccaccccagcagttgcgccattaatatgg

SEQ ID NO: 149404 - DNA, 35 bp, Artificial Sequence
  Synthetic oligonucleotide
tgcacaaccccacgcgtgcgttcttggtacccctg

SEQ ID NO: 149405 - DNA, 35 bp, Artificial Sequence
  Synthetic oligonucleotide
tgttccaacgcacatcttccccttgggttccccat

SEQ ID NO: 149406 - DNA, 35 bp, Artificial Sequence
  Synthetic oligonucleotide
gatgtgtgactaacccccccgcgtctccgttccat

SEQ ID NO: 149407 - DNA, 35 bp, Artificial Sequence
  Synthetic oligonucleotide
tgaccaccgaacaccacgcgcccaccactagtcct

SEQ ID NO: 149408 - DNA, 35 bp, Artificial Sequence
  Synthetic oligonucleotide
gtcactcccatggtgttgggcctcccgctgtatct

SEQ ID NO: 149409 - DNA, 35 bp, Artificial Sequence
  Synthetic oligonucleotide
atgcacatcgcacatagagttgcgcccttccgttt

SEQ ID NO: 149410 - DNA, 36 bp, Artificial Sequence
  Synthetic oligonucleotide
accacacccgccccattgtacccatgtcgaccaaaa

SEQ ID NO: 149411 - DNA, 36 bp, Artificial Sequence
  Synthetic oligonucleotide
acttcaccgtgcgcccgtttcaccagtatcactaca

SEQ ID NO: 149412 - DNA, 36 bp, Artificial Sequence
  Synthetic oligonucleotide
accacacgccacgtaatttcttccccgactgcacca

SEQ ID NO: 149413 - DNA, 35 bp, Artificial Sequence
  Synthetic oligonucleotide
tcgcacatgtggcgcagtccaccacaccttactca

SEQ ID NO: 149414 - DNA, 36 bp, Artificial Sequence
  Synthetic oligonucleotide
tacctcccagcatctacgacacctgcgcccgtttca

SEQ ID NO: 149415 - DNA, 37 bp, Artificial Sequence
  Synthetic oligonucleotide
taggaattgggtggagggaaggtgaatatgggggaga

SEQ ID NO: 149416 - DNA, 37 bp, Artificial Sequence
  Synthetic oligonucleotide
gattcgccagggtgaagcggtggggttatgaggagga

SEQ ID NO: 149417 - DNA, 37 bp, Artificial Sequence
  Synthetic oligonucleotide
acggactcgagaagggaacgggtgggtagggtacgga

SEQ ID NO: 149418 - DNA, 37 bp, Artificial Sequence
  Synthetic oligonucleotide
tctgtaccaggcgaggaagagaaggggggagggcgga

SEQ ID NO: 149419 - DNA, 36 bp, Artificial Sequence
  Synthetic oligonucleotide
gggggacagttggggggagagagttacggggcggga

SEQ ID NO: 149420 - DNA, 37 bp, Artificial Sequence
  Synthetic oligonucleotide
ataggtggatgtcaacggaatgggggattgggcggga

SEQ ID NO: 149421 - DNA, 38 bp, Artificial Sequence
  Synthetic oligonucleotide
gagggaaggggagacggggtcgggaggaaggtgcatga

SEQ ID NO: 149422 - DNA, 38 bp, Artificial Sequence
  Synthetic oligonucleotide
tcagtcgccctaccactgtcccgcctgttcccttatga

SEQ ID NO: 149423 - DNA, 37 bp, Artificial Sequence
  Synthetic oligonucleotide
tgcgtctggtggagggggggacggttggacggactga

SEQ ID NO: 149424 - DNA, 37 bp, Artificial Sequence
  Synthetic oligonucleotide
tcatgtcgccgacatctggacctatctcactctctga

SEQ ID NO: 149425 - DNA, 35 bp, Artificial Sequence
  Synthetic oligonucleotide
ttgccgtctcgctaacgtatttacctcctctctga

SEQ ID NO: 149426 - DNA, 38 bp, Artificial Sequence
  Synthetic oligonucleotide
gtacaccctctgacgttctcaccgcacgcttttcttga

SEQ ID NO: 149427 - DNA, 36 bp, Artificial Sequence
  Synthetic oligonucleotide
gctcgcctcctctgctctgcgaacgccttaatttga

SEQ ID NO: 149428 - DNA, 35 bp, Artificial Sequence
  Synthetic oligonucleotide
gtacccgtcgacggtttctctgctttcctttgcta

SEQ ID NO: 149429 - DNA, 35 bp, Artificial Sequence
  Synthetic oligonucleotide
gacttgcgcggatccccccggcctatacctgtcta

SEQ ID NO: 149430 - DNA, 36 bp, Artificial Sequence
  Synthetic oligonucleotide
gtccgtccaccaccgagcgcctccgtttaaccctta

SEQ ID NO: 149431 - DNA, 35 bp, Artificial Sequence
  Synthetic oligonucleotide
agttcggccactcctacgccctgccgtgtgccccc

SEQ ID NO: 149432 - DNA, 35 bp, Artificial Sequence
  Synthetic oligonucleotide
tccctgcgcgcacttgataacttctacaacgcccc

SEQ ID NO: 149433 - DNA, 35 bp, Artificial Sequence
  Synthetic oligonucleotide
agcggagcccccccactgtccgtctttgggcgccc

SEQ ID NO: 149434 - DNA, 35 bp, Artificial Sequence
  Synthetic oligonucleotide
ttcatcgcaatggaccgccgtcctagcactctccc

SEQ ID NO: 149435 - DNA, 35 bp, Artificial Sequence
  Synthetic oligonucleotide
tctagccacaccatttgccgactatactgcctgcc

SEQ ID NO: 149436 - DNA, 35 bp, Artificial Sequence
  Synthetic oligonucleotide
ttcaccgacaccgtgatccatatagtctaccctcc

SEQ ID NO: 149437 - DNA, 35 bp, Artificial Sequence
  Synthetic oligonucleotide
tctttgcccctcaactcgcgttgcatcttggttcc

SEQ ID NO: 149438 - DNA, 35 bp, Artificial Sequence
  Synthetic oligonucleotide
gcctgcttatgcgacacctacgcggctcacccctc

SEQ ID NO: 149439 - DNA, 34 bp, Artificial Sequence
  Synthetic oligonucleotide
tacgcgttagtgtacggcttccaatgcgcccctc

SEQ ID NO: 149440 - DNA, 35 bp, Artificial Sequence
  Synthetic oligonucleotide
tcaaccaccgccccgtcttccgctaagcttgcgtc

SEQ ID NO: 149441 - DNA, 35 bp, Artificial Sequence
  Synthetic oligonucleotide
caccgtcctgtcaacattcctcctttgtctcggag

SEQ ID NO: 149442 - DNA, 35 bp, Artificial Sequence
  Synthetic oligonucleotide
atgctgttgcagctcccttcattgagcccatcccg

SEQ ID NO: 149443 - DNA, 35 bp, Artificial Sequence
  Synthetic oligonucleotide
gctggcacccccctcagctgatacttgccccatcg

SEQ ID NO: 149444 - DNA, 35 bp, Artificial Sequence
  Synthetic oligonucleotide
tccgcaccttgtcaacgccggccccccgaatattg

SEQ ID NO: 149445 - DNA, 35 bp, Artificial Sequence
  Synthetic oligonucleotide
tgtccgcctccaaacgcataaccgtgcccgtacct

SEQ ID NO: 149446 - DNA, 35 bp, Artificial Sequence
  Synthetic oligonucleotide
ttccgccccagtggcttcttgaagtatcaccccct

SEQ ID NO: 149447 - DNA, 35 bp, Artificial Sequence
  Synthetic oligonucleotide
gcaccaccctccgcctccccttgattagaagccct

SEQ ID NO: 149448 - DNA, 35 bp, Artificial Sequence
  Synthetic oligonucleotide
gatgtatgcggggatttggggaggcggataggggt

SEQ ID NO: 149449 - DNA, 35 bp, Artificial Sequence
  Synthetic oligonucleotide
gcaccgtaagccgtgacttcctgaacactctcctt

SEQ ID NO: 149450 - DNA, 35 bp, Artificial Sequence
  Synthetic oligonucleotide
tggatccaccaatgctgccctctccgttagtgaaa

SEQ ID NO: 149451 - DNA, 36 bp, Artificial Sequence
  Synthetic oligonucleotide
gagtgaaggggagggggcggagtgaacgggtggcaa

SEQ ID NO: 149452 - DNA, 35 bp, Artificial Sequence
  Synthetic oligonucleotide
gggaggagcacgggaccaggaggaagtagacgtaa

SEQ ID NO: 149453 - DNA, 35 bp, Artificial Sequence
  Synthetic oligonucleotide
acacctcctgaccgatcttccgtcactgtaaccca

SEQ ID NO: 149454 - DNA, 36 bp, Artificial Sequence
  Synthetic oligonucleotide
gtagtcgcccatttcccttatgtatccctgtccgca

SEQ ID NO: 149455 - DNA, 35 bp, Artificial Sequence
  Synthetic oligonucleotide
accccttccgctggtgagcacttaggtttctctca

SEQ ID NO: 149456 - DNA, 36 bp, Artificial Sequence
  Synthetic oligonucleotide
tttgcacctgcacccgggttcatgacttcgccttca

SEQ ID NO: 149457 - DNA, 37 bp, Artificial Sequence
  Synthetic oligonucleotide
gccaatcgcgtcgaacgggtggtcgggggaggggaga

SEQ ID NO: 149458 - DNA, 35 bp, Artificial Sequence
  Synthetic oligonucleotide
aactgcatccgcttcccgtatccgcctcatctaga

SEQ ID NO: 149459 - DNA, 37 bp, Artificial Sequence
  Synthetic oligonucleotide
tcgccgcccccaatgcacttccccccctctttgtaga

SEQ ID NO: 149460 - DNA, 37 bp, Artificial Sequence
  Synthetic oligonucleotide
atgtgcgctatcccgatttaggccctgttccccccga

SEQ ID NO: 149461 - DNA, 37 bp, Artificial Sequence
  Synthetic oligonucleotide
gtctcgaacgaaagggggggagagtgatgggagggga

SEQ ID NO: 149462 - DNA, 37 bp, Artificial Sequence
  Synthetic oligonucleotide
aatgtgcggggagcagtgtgggtgggtgcatggggga

SEQ ID NO: 149463 - DNA, 36 bp, Artificial Sequence
  Synthetic oligonucleotide
acaccgccctcttcatgctagttagtttccccatga

SEQ ID NO: 149464 - DNA, 38 bp, Artificial Sequence
  Synthetic oligonucleotide
gcgccacgcctggttcgttccttgtccatccgccatga

SEQ ID NO: 149465 - DNA, 35 bp, Artificial Sequence
  Synthetic oligonucleotide
gacctccgtcctcttggcgccatcttctcccctga

SEQ ID NO: 149466 - DNA, 38 bp, Artificial Sequence
  Synthetic oligonucleotide
tcgcacgtcgaccgacgaattgtgctctcctccgctga

SEQ ID NO: 149467 - DNA, 38 bp, Artificial Sequence
  Synthetic oligonucleotide
tcgggtgggagggcagggtgtgctaacaggggttctga

SEQ ID NO: 149468 - DNA, 38 bp, Artificial Sequence
  Synthetic oligonucleotide
gaagtggagaggaagacttggaagacggtggcgggtga

SEQ ID NO: 149469 - DNA, 38 bp, Artificial Sequence
  Synthetic oligonucleotide
gttactccccgctgaagtttacgtacgccatttcttga

SEQ ID NO: 149470 - DNA, 36 bp, Artificial Sequence
  Synthetic oligonucleotide
ttgcaccccgcctccccgctgtattgtacccgttga

SEQ ID NO: 149471 - DNA, 38 bp, Artificial Sequence
  Synthetic oligonucleotide
ttaactccgcccgcacgtaccgacggtacactctttga

SEQ ID NO: 149472 - DNA, 35 bp, Artificial Sequence
  Synthetic oligonucleotide
gtgccccttccttatgctcgcttgtcattacgtta

SEQ ID NO: 149473 - DNA, 36 bp, Artificial Sequence
  Synthetic oligonucleotide
ggatcgggagggcggggacaagggtccatagggtta

SEQ ID NO: 149474 - DNA, 35 bp, Artificial Sequence
  Synthetic oligonucleotide
atcacatcggccacttctcgccggcgctacttcac

SEQ ID NO: 149475 - DNA, 35 bp, Artificial Sequence
  Synthetic oligonucleotide
gatactacccgtcgccaccgcccttataatggccc

SEQ ID NO: 149476 - DNA, 35 bp, Artificial Sequence
  Synthetic oligonucleotide
gcactctccggtcaaaagcctcccatacggtgccc

SEQ ID NO: 149477 - DNA, 35 bp, Artificial Sequence
  Synthetic oligonucleotide
agacgcacgcctgggttccatcgttctcaagtccc

SEQ ID NO: 149478 - DNA, 35 bp, Artificial Sequence
  Synthetic oligonucleotide
tcctccccactcgaagtgcaacgagcgtaacacgc

SEQ ID NO: 149479 - DNA, 35 bp, Artificial Sequence
  Synthetic oligonucleotide
attacgctcgccattaccggtaacacccaccccgc

SEQ ID NO: 149480 - DNA, 35 bp, Artificial Sequence
  Synthetic oligonucleotide
tactaggggtgggaggggctatatagagagggcgc

SEQ ID NO: 149481 - DNA, 35 bp, Artificial Sequence
  Synthetic oligonucleotide
actgccggccgccacaagtgcctattccgtcactc

SEQ ID NO: 149482 - DNA, 35 bp, Artificial Sequence
  Synthetic oligonucleotide
ttcgcacatctgcgctctacgatccccgtacgctc

SEQ ID NO: 149483 - DNA, 35 bp, Artificial Sequence
  Synthetic oligonucleotide
gacaccctctgttgacccaaattcgctccgctctc

SEQ ID NO: 149484 - DNA, 35 bp, Artificial Sequence
  Synthetic oligonucleotide
tctccgccgccctctttgccctcgctcgttctctc

SEQ ID NO: 149485 - DNA, 35 bp, Artificial Sequence
  Synthetic oligonucleotide
atgcatccgtccttctaatcactgtccacatcgtc

SEQ ID NO: 149486 - DNA, 35 bp, Artificial Sequence
  Synthetic oligonucleotide
aacccgccctcgccacccggtttgagcatcctttc

SEQ ID NO: 149487 - DNA, 36 bp, Artificial Sequence
  Synthetic oligonucleotide
gcacccacaccccaacttgtacttccagtcctctag

SEQ ID NO: 149488 - DNA, 35 bp, Artificial Sequence
  Synthetic oligonucleotide
tctagctgcccaacgaccccttgctgtcttccccg

SEQ ID NO: 149489 - DNA, 35 bp, Artificial Sequence
  Synthetic oligonucleotide
atgccgacctgccacgtgttcctccaacggtcccg

SEQ ID NO: 149490 - DNA, 35 bp, Artificial Sequence
  Synthetic oligonucleotide
gagggtagtggctaaggggagaaaagggcaagtcg

SEQ ID NO: 149491 - DNA, 35 bp, Artificial Sequence
  Synthetic oligonucleotide
gatagacatgtgggtgggagggggctatactaggg

SEQ ID NO: 149492 - DNA, 35 bp, Artificial Sequence
  Synthetic oligonucleotide
gagccgtgaaggagggtgggcgggctcagggttgg

SEQ ID NO: 149493 - DNA, 35 bp, Artificial Sequence
  Synthetic oligonucleotide
agcgactcggggcggggagggacgtgggtacggtg

SEQ ID NO: 149494 - DNA, 35 bp, Artificial Sequence
  Synthetic oligonucleotide
atgggggggaggggcgggtacgaggcagggggcat

SEQ ID NO: 149495 - DNA, 35 bp, Artificial Sequence
  Synthetic oligonucleotide
gtgccaccagcttctcggttctctgccctcactat

SEQ ID NO: 149496 - DNA, 35 bp, Artificial Sequence
  Synthetic oligonucleotide
tgcgctctgtcgttccctttccgtccttgcaagct

SEQ ID NO: 149497 - DNA, 35 bp, Artificial Sequence
  Synthetic oligonucleotide
gttgccgcatccccccatcgtcacgtcccgaagct

SEQ ID NO: 149498 - DNA, 35 bp, Artificial Sequence
  Synthetic oligonucleotide
gccattccggatttgtgtttcccttgcccacctct

SEQ ID NO: 149499 - DNA, 35 bp, Artificial Sequence
  Synthetic oligonucleotide
aagcgccagcccccggcatgtacctcccattgttt

SEQ ID NO: 149500 - DNA, 35 bp, Artificial Sequence
  Synthetic oligonucleotide
tggggagaagcgagagaaggggggtaggacggaaa

SEQ ID NO: 149501 - DNA, 35 bp, Artificial Sequence
  Synthetic oligonucleotide
gtccacccgcctgaaaattagtttaccagcacaca

SEQ ID NO: 149502 - DNA, 36 bp, Artificial Sequence
  Synthetic oligonucleotide
gttgccaccctcacttgcgcctcccttgccgcccca

SEQ ID NO: 149503 - DNA, 36 bp, Artificial Sequence
  Synthetic oligonucleotide
tcagtaggtgctgccccgtctcgtttctgttgccca

SEQ ID NO: 149504 - DNA, 35 bp, Artificial Sequence
  Synthetic oligonucleotide
gactcgcgacagttttactttcatctgtcccgcca

SEQ ID NO: 149505 - DNA, 36 bp, Artificial Sequence
  Synthetic oligonucleotide
gcgcctacccttaccgcctgtctcgccacgcccgca

SEQ ID NO: 149506 - DNA, 36 bp, Artificial Sequence
  Synthetic oligonucleotide
aacccagcgcccattgtaccccgccgtttttgtgca

SEQ ID NO: 149507 - DNA, 35 bp, Artificial Sequence
  Synthetic oligonucleotide
tccgtcccatcctccaacagcagctcggttcatca

SEQ ID NO: 149508 - DNA, 37 bp, Artificial Sequence
  Synthetic oligonucleotide
tatcagcccgagggtgggcataggcggaggggggaga

SEQ ID NO: 149509 - DNA, 37 bp, Artificial Sequence
  Synthetic oligonucleotide
gagagagggtgagggcaaagggtgggttacgtttaga

SEQ ID NO: 149510 - DNA, 37 bp, Artificial Sequence
  Synthetic oligonucleotide
acccacctccactttgttgccactttctgaaggacga

SEQ ID NO: 149511 - DNA, 37 bp, Artificial Sequence
  Synthetic oligonucleotide
tcgatctcgccttccatagttttcttcgtctccccga

SEQ ID NO: 149512 - DNA, 37 bp, Artificial Sequence
  Synthetic oligonucleotide
gccatccttccgttcaatcgtacagcgctctccgcga

SEQ ID NO: 149513 - DNA, 35 bp, Artificial Sequence
  Synthetic oligonucleotide
taccaccgccgcctctgcccgcttagccttcgcga

SEQ ID NO: 149514 - DNA, 37 bp, Artificial Sequence
  Synthetic oligonucleotide
gacccccccatgtttaatccttcgtccgcccaatcga

SEQ ID NO: 149515 - DNA, 37 bp, Artificial Sequence
  Synthetic oligonucleotide
ggtgcctaagagggaatggtgaatggacggggcagga

SEQ ID NO: 149516 - DNA, 37 bp, Artificial Sequence
  Synthetic oligonucleotide
taacagtaaggcgggagggtgttgggggggacgagga

SEQ ID NO: 149517 - DNA, 37 bp, Artificial Sequence
  Synthetic oligonucleotide
gtggtaggagtacattgggaagggagactgggcggga

SEQ ID NO: 149518 - DNA, 36 bp, Artificial Sequence
  Synthetic oligonucleotide
agagaacagcctcaaggggggaagggggtcagggga

SEQ ID NO: 149519 - DNA, 37 bp, Artificial Sequence
  Synthetic oligonucleotide
aacccgaggtacgggaagggggggtgggtggagggga

SEQ ID NO: 149520 - DNA, 37 bp, Artificial Sequence
  Synthetic oligonucleotide
gacggaatgcggcaaatgcggagaggggcggggggga

SEQ ID NO: 149521 - DNA, 35 bp, Artificial Sequence
  Synthetic oligonucleotide
gggagggcgggaggagcaattagtgcgttggggga

SEQ ID NO: 149522 - DNA, 37 bp, Artificial Sequence
  Synthetic oligonucleotide
agtccaagcatccctacctgccatcgccgcccctgga

SEQ ID NO: 149523 - DNA, 36 bp, Artificial Sequence
  Synthetic oligonucleotide
gcaggagggcgatatccgtggggtgggcggggtgga

SEQ ID NO: 149524 - DNA, 38 bp, Artificial Sequence
  Synthetic oligonucleotide
acaacgtgaagggggaggggtgggtggagggtgcatga

SEQ ID NO: 149525 - DNA, 37 bp, Artificial Sequence
  Synthetic oligonucleotide
cccacacccaatgtcctcaacggccctgtcctcctga

SEQ ID NO: 149526 - DNA, 38 bp, Artificial Sequence
  Synthetic oligonucleotide
tgtcctcccgcatttgtttcgtaggccacttctcctga

SEQ ID NO: 149527 - DNA, 37 bp, Artificial Sequence
  Synthetic oligonucleotide
gggcggggacaggggaacgggggatagggaagtctga

SEQ ID NO: 149528 - DNA, 38 bp, Artificial Sequence
  Synthetic oligonucleotide
gtgccgcctccgttccgcccgctgcctccccggtctga

SEQ ID NO: 149529 - DNA, 37 bp, Artificial Sequence
  Synthetic oligonucleotide
tacaggggggagaaagaggtaggtggagcttaagtga

SEQ ID NO: 149530 - DNA, 38 bp, Artificial Sequence
  Synthetic oligonucleotide
ggagtgaccgggcaaggggaccgaaattgggtgggtga

SEQ ID NO: 149531 - DNA, 37 bp, Artificial Sequence
  Synthetic oligonucleotide
ggatgggagggataggggttatagggaggcggtgtga

SEQ ID NO: 149532 - DNA, 38 bp, Artificial Sequence
  Synthetic oligonucleotide
gtccgtcccacgcatatcgacgctacccttctccttga

SEQ ID NO: 149533 - DNA, 38 bp, Artificial Sequence
  Synthetic oligonucleotide
tcccagacccaccggtaaaccactctgtccacgcttga

SEQ ID NO: 149534 - DNA, 37 bp, Artificial Sequence
  Synthetic oligonucleotide
tagccgctcgcccgttaccgccctctctttctgttga

SEQ ID NO: 149535 - DNA, 35 bp, Artificial Sequence
  Synthetic oligonucleotide
tccgccacccgccctgcatacattctgtactacta

SEQ ID NO: 149536 - DNA, 36 bp, Artificial Sequence
  Synthetic oligonucleotide
gcccccctcttctcggccctgtgccccccatgggta

SEQ ID NO: 149537 - DNA, 35 bp, Artificial Sequence
  Synthetic oligonucleotide
tcccggtgcgcaccttgacgtctatgtttgcccac

SEQ ID NO: 149538 - DNA, 35 bp, Artificial Sequence
  Synthetic oligonucleotide
tcgaggagcctgcactgcacctcaccccctctcac

SEQ ID NO: 149539 - DNA, 34 bp, Artificial Sequence
  Synthetic oligonucleotide
tactgccgcctccaccgggtcaaggcctaattac

SEQ ID NO: 149540 - DNA, 35 bp, Artificial Sequence
  Synthetic oligonucleotide
acctcacctcgatcccaaggtctgaacattctacc

SEQ ID NO: 149541 - DNA, 35 bp, Artificial Sequence
  Synthetic oligonucleotide
tgaccattgcggcttgcttgcgaaacgccctcccc

SEQ ID NO: 149542 - DNA, 35 bp, Artificial Sequence
  Synthetic oligonucleotide
gcccagcccggcgctgcctgtgcctcgtcctcccc

SEQ ID NO: 149543 - DNA, 35 bp, Artificial Sequence
  Synthetic oligonucleotide
atgccgctggctcgccttttctccgcgccttcccc

SEQ ID NO: 149544 - DNA, 35 bp, Artificial Sequence
  Synthetic oligonucleotide
atcgtacaactgcctggtccgtacagtcttcatcc

SEQ ID NO: 149545 - DNA, 35 bp, Artificial Sequence
  Synthetic oligonucleotide
tcccccggcctgtatacacataaatcgcccagtcc

SEQ ID NO: 149546 - DNA, 35 bp, Artificial Sequence
  Synthetic oligonucleotide
ttacgcttgggcccccctccgttggtacctgttcc

SEQ ID NO: 149547 - DNA, 35 bp, Artificial Sequence
  Synthetic oligonucleotide
gcccatccgacctcggttactcgcatcaccatagc

SEQ ID NO: 149548 - DNA, 35 bp, Artificial Sequence
  Synthetic oligonucleotide
ttctggcaccctccggctgacgcgctgtacccatc

SEQ ID NO: 149549 - DNA, 35 bp, Artificial Sequence
  Synthetic oligonucleotide
gactggcgcgcaacctgctttgccacccttctatc

SEQ ID NO: 149550 - DNA, 35 bp, Artificial Sequence
  Synthetic oligonucleotide
tcccaaagcaatgttgcgccccaaggcctctcctc

SEQ ID NO: 149551 - DNA, 35 bp, Artificial Sequence
  Synthetic oligonucleotide
accacccgcccgcccggtcatcggtacggaacttc

SEQ ID NO: 149552 - DNA, 35 bp, Artificial Sequence
  Synthetic oligonucleotide
ggatgtcgacgtacatccgcatctatcccttgttc

SEQ ID NO: 149553 - DNA, 35 bp, Artificial Sequence
  Synthetic oligonucleotide
tgatgtcgccacattattaattaaccgccttcccg

SEQ ID NO: 149554 - DNA, 35 bp, Artificial Sequence
  Synthetic oligonucleotide
tcccgccgcccctcgcttgaaagcaccctgttccg

SEQ ID NO: 149555 - DNA, 35 bp, Artificial Sequence
  Synthetic oligonucleotide
atacacctgctattataaccacgcccatctcatcg

SEQ ID NO: 149556 - DNA, 35 bp, Artificial Sequence
  Synthetic oligonucleotide
gctcttgccattcagtgtctcccatcccgtcgtcg

SEQ ID NO: 149557 - DNA, 35 bp, Artificial Sequence
  Synthetic oligonucleotide
gttaggtagtgagcggggggagtaggtggtgtagg

SEQ ID NO: 149558 - DNA, 35 bp, Artificial Sequence
  Synthetic oligonucleotide
gatggggagaacgtggatggagcgtatctaggggg

SEQ ID NO: 149559 - DNA, 35 bp, Artificial Sequence
  Synthetic oligonucleotide
taacgcgaagtaaggagggacgggttggagttggg

SEQ ID NO: 149560 - DNA, 35 bp, Artificial Sequence
  Synthetic oligonucleotide
aaacaccccgccagttagcccgcgccgccgaacat

SEQ ID NO: 149561 - DNA, 35 bp, Artificial Sequence
  Synthetic oligonucleotide
ggtcacgccctctcgtcaagtctgctattccacat

SEQ ID NO: 149562 - DNA, 35 bp, Artificial Sequence
  Synthetic oligonucleotide
ggacgactcaccccgccccgccccggtcccggact

SEQ ID NO: 149563 - DNA, 35 bp, Artificial Sequence
  Synthetic oligonucleotide
ggtgcaccatgcaccgcctgttatatcctgcccct

SEQ ID NO: 149564 - DNA, 35 bp, Artificial Sequence
  Synthetic oligonucleotide
gcccatcttaatgttattacaccaactgccgccct

SEQ ID NO: 149565 - DNA, 35 bp, Artificial Sequence
  Synthetic oligonucleotide
gtgtcaatcgctcttcgtccgccggtttcactcct

SEQ ID NO: 149566 - DNA, 35 bp, Artificial Sequence
  Synthetic oligonucleotide
tagcaccttgccccggttcctttacatattgacgt

SEQ ID NO: 149567 - DNA, 35 bp, Artificial Sequence
  Synthetic oligonucleotide
gagggggtggtaggggggtacgtgcagtaacaggt

SEQ ID NO: 149568 - DNA, 35 bp, Artificial Sequence
  Synthetic oligonucleotide
accccagtgatcaccttgcctcacccttccattgt

SEQ ID NO: 149569 - DNA, 35 bp, Artificial Sequence
  Synthetic oligonucleotide
ttcaccccagccacacctggtctgaaactatcatt

SEQ ID NO: 149570 - DNA, 35 bp, Artificial Sequence
  Synthetic oligonucleotide
acccccgagatcggtcctaccccaaattggttatt

SEQ ID NO: 149571 - DNA, 35 bp, Artificial Sequence
  Synthetic oligonucleotide
tcgatccactccgtgctctaaaaaggtcccgcttt

SEQ ID NO: 149572 - DNA, 36 bp, Artificial Sequence
  Synthetic oligonucleotide
tacccaacccgcgcccccgtttttgagccccgaaca

SEQ ID NO: 149573 - DNA, 36 bp, Artificial Sequence
  Synthetic oligonucleotide
gactgtcaccattggccatatacgccaccacccaca

SEQ ID NO: 149574 - DNA, 35 bp, Artificial Sequence
  Synthetic oligonucleotide
ggacagccgcactttaccgccgcccagctcctaca

SEQ ID NO: 149575 - DNA, 36 bp, Artificial Sequence
  Synthetic oligonucleotide
actccctgtccgcttcccgtccttgtttttgctaca

SEQ ID NO: 149576 - DNA, 36 bp, Artificial Sequence
  Synthetic oligonucleotide
ggagtctgccctccgcatgtccctcttcgattacca

SEQ ID NO: 149577 - DNA, 36 bp, Artificial Sequence
  Synthetic oligonucleotide
tattttgcgcccttggtttcgttcctgtctttgcca

SEQ ID NO: 149578 - DNA, 35 bp, Artificial Sequence
  Synthetic oligonucleotide
atcatactgtcgcagcccaccgcccatggcctcca

SEQ ID NO: 149579 - DNA, 36 bp, Artificial Sequence
  Synthetic oligonucleotide
tgagacgcccggccctcgataatctgatcacttcca

SEQ ID NO: 149580 - DNA, 36 bp, Artificial Sequence
  Synthetic oligonucleotide
gactcacacaccttggcttacatctgcacttatgca

SEQ ID NO: 149581 - DNA, 35 bp, Artificial Sequence
  Synthetic oligonucleotide
tccaacatcgctccatcttcccctgtctccgatca

SEQ ID NO: 149582 - DNA, 35 bp, Artificial Sequence
  Synthetic oligonucleotide
gtctgactccacttgcttcccgctttagctactca

SEQ ID NO: 149583 - DNA, 35 bp, Artificial Sequence
  Synthetic oligonucleotide
gtcgcctagcctcatgcccgctacacttccgttca

SEQ ID NO: 149584 - DNA, 37 bp, Artificial Sequence
  Synthetic oligonucleotide
tcatacgtgggaggtgggaccgaaaggggggggaaga

SEQ ID NO: 149585 - DNA, 37 bp, Artificial Sequence
  Synthetic oligonucleotide
acagccccttcatggtctacaaatcgcctctgcccga

SEQ ID NO: 149586 - DNA, 37 bp, Artificial Sequence
  Synthetic oligonucleotide
atctctgtcactgtatcatgccttcccctcttgccga

SEQ ID NO: 149587 - DNA, 37 bp, Artificial Sequence
  Synthetic oligonucleotide
tgatcgtcggatcgcgtatcctcacctctcatctcga

SEQ ID NO: 149588 - DNA, 36 bp, Artificial Sequence
  Synthetic oligonucleotide
acccgaccacctccacttgtcatgttacgttccgga

SEQ ID NO: 149589 - DNA, 37 bp, Artificial Sequence
  Synthetic oligonucleotide
ttcacgcacgaaaggatggggctgggctcgggaggga

SEQ ID NO: 149590 - DNA, 35 bp, Artificial Sequence
  Synthetic oligonucleotide
actaaggggggtggagtgggttggcactggcggga

SEQ ID NO: 149591 - DNA, 36 bp, Artificial Sequence
  Synthetic oligonucleotide
ttgggtgggagggatgatggtcatgaaggaggggga

SEQ ID NO: 149592 - DNA, 38 bp, Artificial Sequence
  Synthetic oligonucleotide
tctcgactccgcccattgccctgtcttgcatttcatga

SEQ ID NO: 149593 - DNA, 37 bp, Artificial Sequence
  Synthetic oligonucleotide
tacaccccgtaggccctctgttgaaacgttctcctga

SEQ ID NO: 149594 - DNA, 37 bp, Artificial Sequence
  Synthetic oligonucleotide
tagcccctgcctcctatatcctatcagacagttctga

SEQ ID NO: 149595 - DNA, 38 bp, Artificial Sequence
  Synthetic oligonucleotide
gatccacgccgccttcctctgcaatacacctctgttga

SEQ ID NO: 149596 - DNA, 36 bp, Artificial Sequence
  Synthetic oligonucleotide
gcttcgtgctgcccccatagccttgttgtttcccta

SEQ ID NO: 149597 - DNA, 36 bp, Artificial Sequence
  Synthetic oligonucleotide
tagggacgtctgcccgcgataaggctccctcttgta

SEQ ID NO: 149598 - DNA, 35 bp, Artificial Sequence
  Synthetic oligonucleotide
gaagtaggtagggggtgaagagggttgagcgttta

SEQ ID NO: 149599 - DNA, 35 bp, Artificial Sequence
  Synthetic oligonucleotide
acgaccacgtatcgtttccttttttcgcggcctac

SEQ ID NO: 149600 - DNA, 35 bp, Artificial Sequence
  Synthetic oligonucleotide
tcacacctgcagggccccggtaccctcctgcaacc

SEQ ID NO: 149601 - DNA, 35 bp, Artificial Sequence
  Synthetic oligonucleotide
tatcgccaaccgctccaacctttgacacttccacc

SEQ ID NO: 149602 - DNA, 35 bp, Artificial Sequence
  Synthetic oligonucleotide
tgaccctccccattacgcgtatcccgattgcaccc

SEQ ID NO: 149603 - DNA, 35 bp, Artificial Sequence
  Synthetic oligonucleotide
aactggggcgactcccgttctgtttctatcacgcc

SEQ ID NO: 149604 - DNA, 35 bp, Artificial Sequence
  Synthetic oligonucleotide
attcagcggtgccgccccttctgaccgttatcgcc

SEQ ID NO: 149605 - DNA, 35 bp, Artificial Sequence
  Synthetic oligonucleotide
ggtaccgtccctactatgctatctctgtgtcctcc

SEQ ID NO: 149606 - DNA, 35 bp, Artificial Sequence
  Synthetic oligonucleotide
aaccgattggacgttgcagttcccgcgataattcc

SEQ ID NO: 149607 - DNA, 35 bp, Artificial Sequence
  Synthetic oligonucleotide
acagcccgctctcacactgttccaccgcccgccgc

SEQ ID NO: 149608 - DNA, 35 bp, Artificial Sequence
  Synthetic oligonucleotide
atcgcgtggcctcaccccgttatctcgccctgctc

SEQ ID NO: 149609 - DNA, 35 bp, Artificial Sequence
  Synthetic oligonucleotide
atcgggtcgggcaaaaggtggggaggggccgctag

SEQ ID NO: 149610 - DNA, 35 bp, Artificial Sequence
  Synthetic oligonucleotide
atttcccgcgtacttgtcacctgttctgttctacg

SEQ ID NO: 149611 - DNA, 35 bp, Artificial Sequence
  Synthetic oligonucleotide
tacatgagtggggagagataagggtgtggtggtcg

SEQ ID NO: 149612 - DNA, 35 bp, Artificial Sequence
  Synthetic oligonucleotide
tcactcgtccatggcccataacccatactctgtcg

SEQ ID NO: 149613 - DNA, 35 bp, Artificial Sequence
  Synthetic oligonucleotide
acgtccaccgttgcccccctatcccgatctattcg

SEQ ID NO: 149614 - DNA, 35 bp, Artificial Sequence
  Synthetic oligonucleotide
gtacgcatcccccctcagtgtccttcccgagcgtg

SEQ ID NO: 149615 - DNA, 35 bp, Artificial Sequence
  Synthetic oligonucleotide
gtggcggtaaggagggggggtggtggcggctcttg

SEQ ID NO: 149616 - DNA, 35 bp, Artificial Sequence
  Synthetic oligonucleotide
atcacctgccttaggtctacctgccacactttttg

SEQ ID NO: 149617 - DNA, 35 bp, Artificial Sequence
  Synthetic oligonucleotide
ttgaaggaagagggtgggatggggactcgggagat

SEQ ID NO: 149618 - DNA, 35 bp, Artificial Sequence
  Synthetic oligonucleotide
gatccgtatcgtgtgtctgcctgtctggttcccct

SEQ ID NO: 149619 - DNA, 35 bp, Artificial Sequence
  Synthetic oligonucleotide
agaccccctcctcactaacagctgacgctagctct

SEQ ID NO: 149620 - DNA, 35 bp, Artificial Sequence
  Synthetic oligonucleotide
gtatgccgtcctgccccgtcagcctatccctgatt

SEQ ID NO: 149621 - DNA, 35 bp, Artificial Sequence
  Synthetic oligonucleotide
gccatttcagcccttttgttgatcgcccctacgtt

SEQ ID NO: 149622 - DNA, 36 bp, Artificial Sequence
  Synthetic oligonucleotide
ttctgtaccgccccttctctgtgcctataacgccaa

SEQ ID NO: 149623 - DNA, 36 bp, Artificial Sequence
  Synthetic oligonucleotide
atccgcccccgaaacctgctctcctcctgtgtcaca

SEQ ID NO: 149624 - DNA, 36 bp, Artificial Sequence
  Synthetic oligonucleotide
tgtagccccgcatgtgcttggccacaacccgcccca

SEQ ID NO: 149625 - DNA, 36 bp, Artificial Sequence
  Synthetic oligonucleotide
atcagcatacgcacatagccgctttccatcgctcca

SEQ ID NO: 149626 - DNA, 36 bp, Artificial Sequence
  Synthetic oligonucleotide
atcgctccaacggcacattactacggtcgcattcca

SEQ ID NO: 149627 - DNA, 36 bp, Artificial Sequence
  Synthetic oligonucleotide
tcgacacgtaaggtcccgccatatcgtccacccgca

SEQ ID NO: 149628 - DNA, 36 bp, Artificial Sequence
  Synthetic oligonucleotide
atggccaccctttccgacgctttcaaccctgtctca

SEQ ID NO: 149629 - DNA, 36 bp, Artificial Sequence
  Synthetic oligonucleotide
tgtggggagcctggtagtttctttgcccacctttca

SEQ ID NO: 149630 - DNA, 37 bp, Artificial Sequence
  Synthetic oligonucleotide
gatgggcggaggtgcgtgggggggagatatccagaga

SEQ ID NO: 149631 - DNA, 37 bp, Artificial Sequence
  Synthetic oligonucleotide
tgtagtgacgagggggtagttaaggtggcgggtgaga

SEQ ID NO: 149632 - DNA, 37 bp, Artificial Sequence
  Synthetic oligonucleotide
agtccacccttagccgtatgtgtccaccaccctccga

SEQ ID NO: 149633 - DNA, 37 bp, Artificial Sequence
  Synthetic oligonucleotide
ggttgggaggaaaagtgaaggcagaagtagggaggga

SEQ ID NO: 149634 - DNA, 37 bp, Artificial Sequence
  Synthetic oligonucleotide
gccggggatggagggcgacaggcatggtgaacgggga

SEQ ID NO: 149635 - DNA, 37 bp, Artificial Sequence
  Synthetic oligonucleotide
gggggacctctatctgggggcggttcttgggcgggga

SEQ ID NO: 149636 - DNA, 37 bp, Artificial Sequence
  Synthetic oligonucleotide
agtgtaaatcgggtgggggggcagagacagggatgga

SEQ ID NO: 149637 - DNA, 37 bp, Artificial Sequence
  Synthetic oligonucleotide
tacgcgttctgcgctctgtttcccctctcgacttgga

SEQ ID NO: 149638 - DNA, 38 bp, Artificial Sequence
  Synthetic oligonucleotide
gccatacacacgaagtgtatgattactccctctcgtga

SEQ ID NO: 149639 - DNA, 38 bp, Artificial Sequence
  Synthetic oligonucleotide
gcaaagcagacgctcccctgttcattgccccttgttga

SEQ ID NO: 149640 - DNA, 35 bp, Artificial Sequence
  Synthetic oligonucleotide
gaagggatgatagaaggaggggtgatgcgggtgta

SEQ ID NO: 149641 - DNA, 36 bp, Artificial Sequence
  Synthetic oligonucleotide
gttgacccgctgccgtatgtcccagcctccccctta

SEQ ID NO: 149642 - DNA, 35 bp, Artificial Sequence
  Synthetic oligonucleotide
actgcctccctccagtattgctacccgttcagacc

SEQ ID NO: 149643 - DNA, 35 bp, Artificial Sequence
  Synthetic oligonucleotide
acatgcactcttcccacgcacttcgtacttaggcc

SEQ ID NO: 149644 - DNA, 35 bp, Artificial Sequence
  Synthetic oligonucleotide
tccatcccggatgcctgtctgtcgattcacctgcc

SEQ ID NO: 149645 - DNA, 35 bp, Artificial Sequence
  Synthetic oligonucleotide
ttaggccgtcataagctttccctgctgctctacgc

SEQ ID NO: 149646 - DNA, 35 bp, Artificial Sequence
  Synthetic oligonucleotide
accctggtctctgctaactgcttcctcactgccgc

SEQ ID NO: 149647 - DNA, 35 bp, Artificial Sequence
  Synthetic oligonucleotide
atgacacagcccccctttcgccatgcagtccgcgc

SEQ ID NO: 149648 - DNA, 35 bp, Artificial Sequence
  Synthetic oligonucleotide
tcccatgtccttaagttatcttgtcaacgccctgc

SEQ ID NO: 149649 - DNA, 35 bp, Artificial Sequence
  Synthetic oligonucleotide
atgaacacagtagtggtggttggggggggaagtgc

SEQ ID NO: 149650 - DNA, 35 bp, Artificial Sequence
  Synthetic oligonucleotide
acagtgcactctctaacgcatacgtccacccttgc

SEQ ID NO: 149651 - DNA, 35 bp, Artificial Sequence
  Synthetic oligonucleotide
gactagatcgccgcttatgtcgctagaccccttgc

SEQ ID NO: 149652 - DNA, 35 bp, Artificial Sequence
  Synthetic oligonucleotide
ggtgcccacgcctcgtttgacttacattattgatc

SEQ ID NO: 149653 - DNA, 35 bp, Artificial Sequence
  Synthetic oligonucleotide
acaaggagtaggtggacggatgggggaccaagtag

SEQ ID NO: 149654 - DNA, 35 bp, Artificial Sequence
  Synthetic oligonucleotide
tgcacaccactcgcctatattgattattttcaccg

SEQ ID NO: 149655 - DNA, 35 bp, Artificial Sequence
  Synthetic oligonucleotide
tggcgacttcccccttctgccctgagcctatcccg

SEQ ID NO: 149656 - DNA, 35 bp, Artificial Sequence
  Synthetic oligonucleotide
gcatgcttaagcaggaggagagggcaggttgggcg

SEQ ID NO: 149657 - DNA, 35 bp, Artificial Sequence
  Synthetic oligonucleotide
aagggcataggaggggatggggaatggatagtgcg

SEQ ID NO: 149658 - DNA, 35 bp, Artificial Sequence
  Synthetic oligonucleotide
atcgagactcagggggatgcgggggtgagatgggg

SEQ ID NO: 149659 - DNA, 35 bp, Artificial Sequence
  Synthetic oligonucleotide
ttggtgggggtagaaagtgggtgaagtgggtatgg

SEQ ID NO: 149660 - DNA, 35 bp, Artificial Sequence
  Synthetic oligonucleotide
tctagcctcgctcactctccccactcgtcctctgg

SEQ ID NO: 149661 - DNA, 35 bp, Artificial Sequence
  Synthetic oligonucleotide
actacgcgagctcccatgtccttccgtttccactg

SEQ ID NO: 149662 - DNA, 35 bp, Artificial Sequence
  Synthetic oligonucleotide
tccaacaccgccgtggcttcaaccaacaatatcat

SEQ ID NO: 149663 - DNA, 35 bp, Artificial Sequence
  Synthetic oligonucleotide
acaaccgtcgttccgcccccgttacgccccgaact

SEQ ID NO: 149664 - DNA, 35 bp, Artificial Sequence
  Synthetic oligonucleotide
ggtcaccttccgcacctacagtactcatgtttact

SEQ ID NO: 149665 - DNA, 35 bp, Artificial Sequence
  Synthetic oligonucleotide
accagggtcagcaccccggtaacccgcctccacct

SEQ ID NO: 149666 - DNA, 35 bp, Artificial Sequence
  Synthetic oligonucleotide
aatgtcccatcccgattctttgtgttgccacccct

SEQ ID NO: 149667 - DNA, 35 bp, Artificial Sequence
  Synthetic oligonucleotide
gtcctatcgtggcactattgtttaccgtcgttcct

SEQ ID NO: 149668 - DNA, 35 bp, Artificial Sequence
  Synthetic oligonucleotide
ttccggattgcctcctccgcttggtgttcgttcct

SEQ ID NO: 149669 - DNA, 35 bp, Artificial Sequence
  Synthetic oligonucleotide
acgctgcgccgcattacctgcctttcacccgcatt

SEQ ID NO: 149670 - DNA, 35 bp, Artificial Sequence
  Synthetic oligonucleotide
tccgtctcgctccggtaggtttcttagttttcttt

SEQ ID NO: 149671 - DNA, 35 bp, Artificial Sequence
  Synthetic oligonucleotide
tagtgcaaggggaatcgaagagaggtggggcaaaa

SEQ ID NO: 149672 - DNA, 35 bp, Artificial Sequence
  Synthetic oligonucleotide
gttccgggcctatggtgcctctgtcctctctcaaa

SEQ ID NO: 149673 - DNA, 36 bp, Artificial Sequence
  Synthetic oligonucleotide
tcccgcccgcctatgcctaatcttggccggttccaa

SEQ ID NO: 149674 - DNA, 36 bp, Artificial Sequence
  Synthetic oligonucleotide
tcagtgccgtgttcgtgccccatctacgcgtttaca

SEQ ID NO: 149675 - DNA, 35 bp, Artificial Sequence
  Synthetic oligonucleotide
accagccccgatgctggctttaaccccactcgcca

SEQ ID NO: 149676 - DNA, 34 bp, Artificial Sequence
  Synthetic oligonucleotide
tctccgcctcctgacccgcccgcccgagttgcca

SEQ ID NO: 149677 - DNA, 35 bp, Artificial Sequence
  Synthetic oligonucleotide
gacctgggaaagatatggggggagggggtacagca

SEQ ID NO: 149678 - DNA, 36 bp, Artificial Sequence
  Synthetic oligonucleotide
aagcggtgaggggcgacgggagggattgagggcgca

SEQ ID NO: 149679 - DNA, 35 bp, Artificial Sequence
  Synthetic oligonucleotide
accatccgcccctcactgtttacggaatcccctca

SEQ ID NO: 149680 - DNA, 35 bp, Artificial Sequence
  Synthetic oligonucleotide
agtacacgcacctgggctgttcgttaccatcttca

SEQ ID NO: 149681 - DNA, 36 bp, Artificial Sequence
  Synthetic oligonucleotide
gacgcgctcattgatacctgctatgcccttgcccga

SEQ ID NO: 149682 - DNA, 36 bp, Artificial Sequence
  Synthetic oligonucleotide
gccatatccgctagccgtgcgacacacctctctcga

SEQ ID NO: 149683 - DNA, 37 bp, Artificial Sequence
  Synthetic oligonucleotide
accacgggcggtgttgtgttttgttggggagagggga

SEQ ID NO: 149684 - DNA, 35 bp, Artificial Sequence
  Synthetic oligonucleotide
gacacggggtagggggggcatggcttaggcgggga

SEQ ID NO: 149685 - DNA, 37 bp, Artificial Sequence
  Synthetic oligonucleotide
tcccgctccatccagcggtgtacactcttacaatgga

SEQ ID NO: 149686 - DNA, 38 bp, Artificial Sequence
  Synthetic oligonucleotide
gtcacagggcggacgcgggaaagggggagatgggatga

SEQ ID NO: 149687 - DNA, 37 bp, Artificial Sequence
  Synthetic oligonucleotide
gcaccgctcagggaaccctctggtccgcccctcctga

SEQ ID NO: 149688 - DNA, 38 bp, Artificial Sequence
  Synthetic oligonucleotide
gggtggggttcggggtggcactggggttgatttcgtga

SEQ ID NO: 149689 - DNA, 37 bp, Artificial Sequence
  Synthetic oligonucleotide
gatacatgtatcggggtggtaaggggggggcgggtga

SEQ ID NO: 149690 - DNA, 38 bp, Artificial Sequence
  Synthetic oligonucleotide
gccaaccctccccaggacttatacgtacgcttccttga

SEQ ID NO: 149691 - DNA, 38 bp, Artificial Sequence
  Synthetic oligonucleotide
gtccatcccccctgccgttctgaggcgtcttctcttga

SEQ ID NO: 149692 - DNA, 37 bp, Artificial Sequence
  Synthetic oligonucleotide
gaccccgcccccccgaccatcatcaccctcctgttga

SEQ ID NO: 149693 - DNA, 37 bp, Artificial Sequence
  Synthetic oligonucleotide
gtcaagccctgcgccttctcgatcattaccttgttga

SEQ ID NO: 149694 - DNA, 36 bp, Artificial Sequence
  Synthetic oligonucleotide
gtgtccgaccgtcccgctatctacccgcttgtcata

SEQ ID NO: 149695 - DNA, 36 bp, Artificial Sequence
  Synthetic oligonucleotide
gcctactgcctgctgagcccgcataccctaccgcta

SEQ ID NO: 149696 - DNA, 36 bp, Artificial Sequence
  Synthetic oligonucleotide
tcccaccctctgacatgcgtgccttcgttcctagta

SEQ ID NO: 149697 - DNA, 36 bp, Artificial Sequence
  Synthetic oligonucleotide
tccaccaggaaaggggggggcggagggtatggggta

SEQ ID NO: 149698 - DNA, 35 bp, Artificial Sequence
  Synthetic oligonucleotide
tgttcgccgcccgcctgaatttcttacacgtttta

SEQ ID NO: 149699 - DNA, 35 bp, Artificial Sequence
  Synthetic oligonucleotide
aaggaccgccagctcgcccgtcccttaacctccac

SEQ ID NO: 149700 - DNA, 35 bp, Artificial Sequence
  Synthetic oligonucleotide
gccccgcaagcatgcccatcaaccagtagccgcac

SEQ ID NO: 149701 - DNA, 35 bp, Artificial Sequence
  Synthetic oligonucleotide
attctccgtcctcctacacctctgtgctgccgcac

SEQ ID NO: 149702 - DNA, 35 bp, Artificial Sequence
  Synthetic oligonucleotide
tcattcagcgccacgctcaccacctgcctacagac

SEQ ID NO: 149703 - DNA, 35 bp, Artificial Sequence
  Synthetic oligonucleotide
accgagcacaaggcattgcccgacgcacccgcccc

SEQ ID NO: 149704 - DNA, 35 bp, Artificial Sequence
  Synthetic oligonucleotide
acccgtccccgatgctctttcccttacggttgccc

SEQ ID NO: 149705 - DNA, 35 bp, Artificial Sequence
  Synthetic oligonucleotide
aataatgcgcgaatcgttctcttcagtcctgtccc

SEQ ID NO: 149706 - DNA, 35 bp, Artificial Sequence
  Synthetic oligonucleotide
gaatggacacctcgatctgttaactccccttcgcc

SEQ ID NO: 149707 - DNA, 35 bp, Artificial Sequence
  Synthetic oligonucleotide
tgtgccacccttcgccctctcttatccacagatgc

SEQ ID NO: 149708 - DNA, 35 bp, Artificial Sequence
  Synthetic oligonucleotide
atgagtccgtcccatggcgaccctctgttccaatc

SEQ ID NO: 149709 - DNA, 35 bp, Artificial Sequence
  Synthetic oligonucleotide
taataccccgcacctagtgcctgcgagaccgcctc

SEQ ID NO: 149710 - DNA, 35 bp, Artificial Sequence
  Synthetic oligonucleotide
gagaacgaagtttccgcccccctccatgtttgctc

SEQ ID NO: 149711 - DNA, 35 bp, Artificial Sequence
  Synthetic oligonucleotide
ggacctcgtgcgttgactcggctccttctaccttc

SEQ ID NO: 149712 - DNA, 35 bp, Artificial Sequence
  Synthetic oligonucleotide
gcaatgtcgccagtcgcttatcactccgcctgttc

SEQ ID NO: 149713 - DNA, 35 bp, Artificial Sequence
  Synthetic oligonucleotide
tcctgttccgccaaatgcttttccgtatttcttcg

SEQ ID NO: 149714 - DNA, 35 bp, Artificial Sequence
  Synthetic oligonucleotide
tcgccaaaccctgctgcccttctccacgtgtttcg

SEQ ID NO: 149715 - DNA, 35 bp, Artificial Sequence
  Synthetic oligonucleotide
aaccaccatttgcttactgtcccgacccgttttcg

SEQ ID NO: 149716 - DNA, 35 bp, Artificial Sequence
  Synthetic oligonucleotide
taggtggagaagggggctggggcaagaaattgagg

SEQ ID NO: 149717 - DNA, 35 bp, Artificial Sequence
  Synthetic oligonucleotide
taggcccacaatacgcgtaccccacccccggccgg

SEQ ID NO: 149718 - DNA, 35 bp, Artificial Sequence
  Synthetic oligonucleotide
gaaataggagtggggacaggaaggggcaatgatgg

SEQ ID NO: 149719 - DNA, 35 bp, Artificial Sequence
  Synthetic oligonucleotide
ttgctcccccatgctgcctctcccttctggatttg

SEQ ID NO: 149720 - DNA, 35 bp, Artificial Sequence
  Synthetic oligonucleotide
gctccacaccgactgctctctcaccgacctatttg

SEQ ID NO: 149721 - DNA, 28 bp, Artificial Sequence
  Synthetic oligonucleotide
ggggccatcacgccctcctcctcgccct

SEQ ID NO: 149722 - DNA, 35 bp, Artificial Sequence
  Synthetic oligonucleotide
acagcctgtaccgccttgttgctactccttccgct

SEQ ID NO: 149723 - DNA, 35 bp, Artificial Sequence
  Synthetic oligonucleotide
gtgtggcccacccttgttctcgtgactccctcgct

SEQ ID NO: 149724 - DNA, 35 bp, Artificial Sequence
  Synthetic oligonucleotide
gcacctcgtgccgttccgcccccggagtttattct

SEQ ID NO: 149725 - DNA, 35 bp, Artificial Sequence
  Synthetic oligonucleotide
ttccacgactcagcaacgcatcaccacctgcctgt

SEQ ID NO: 149726 - DNA, 35 bp, Artificial Sequence
  Synthetic oligonucleotide
accgcaaatgtcaatctgcgcaccttcaattcctt

SEQ ID NO: 149727 - DNA, 35 bp, Artificial Sequence
  Synthetic oligonucleotide
atcaatgacgttgggaggggtagggacgggtcttt

SEQ ID NO: 149728 - DNA, 35 bp, Artificial Sequence
  Synthetic oligonucleotide
gatggcggagcgggaaggaaggagggagagaataa

SEQ ID NO: 149729 - DNA, 35 bp, Artificial Sequence
  Synthetic oligonucleotide
ttgcccccctcccattctgacgacaagtacacaca

SEQ ID NO: 149730 - DNA, 36 bp, Artificial Sequence
  Synthetic oligonucleotide
gacgccacttctcccgtacaatgcctacttattcca

SEQ ID NO: 149731 - DNA, 36 bp, Artificial Sequence
  Synthetic oligonucleotide
gccaccggcgttccctctaaggccttatttcttcca

SEQ ID NO: 149732 - DNA, 35 bp, Artificial Sequence
  Synthetic oligonucleotide
gattcaccccattacgctcgcccttgctgaaagca

SEQ ID NO: 149733 - DNA, 36 bp, Artificial Sequence
  Synthetic oligonucleotide
tccgccccaccagttcttgctaggtcaacccccaga

SEQ ID NO: 149734 - DNA, 37 bp, Artificial Sequence
  Synthetic oligonucleotide
atctgcagcctcttgtcattgctccacccccccgaga

SEQ ID NO: 149735 - DNA, 37 bp, Artificial Sequence
  Synthetic oligonucleotide
tctgtgcggtccatcatcttgcattgaaccatcccga

SEQ ID NO: 149736 - DNA, 37 bp, Artificial Sequence
  Synthetic oligonucleotide
tgcactctacagtgccgacccgtaccccgccccgcga

SEQ ID NO: 149737 - DNA, 37 bp, Artificial Sequence
  Synthetic oligonucleotide
agtactcgctcattgtttcctccgccttgcccgtcga

SEQ ID NO: 149738 - DNA, 37 bp, Artificial Sequence
  Synthetic oligonucleotide
ggacgggggggatgacatgcaagcggcaatgggtcga

SEQ ID NO: 149739 - DNA, 37 bp, Artificial Sequence
  Synthetic oligonucleotide
tgagacggggcctgatggggcggggagataggcagga

SEQ ID NO: 149740 - DNA, 37 bp, Artificial Sequence
  Synthetic oligonucleotide
tcgctgttcaccacgtcttaccgctccccctcttgga

SEQ ID NO: 149741 - DNA, 38 bp, Artificial Sequence
  Synthetic oligonucleotide
gaaagtggaggctcgggggtggagggaaggtggtatga

SEQ ID NO: 149742 - DNA, 37 bp, Artificial Sequence
  Synthetic oligonucleotide
tcacccgtccagctcaggccattccttcatcccctga

SEQ ID NO: 149743 - DNA, 38 bp, Artificial Sequence
  Synthetic oligonucleotide
gtgactgctccgctctgggtttcgctcccacctcctga

SEQ ID NO: 149744 - DNA, 36 bp, Artificial Sequence
  Synthetic oligonucleotide
gtgcaggtccgccgccgtcccatctcataaccgtga

SEQ ID NO: 149745 - DNA, 37 bp, Artificial Sequence
  Synthetic oligonucleotide
accctcacaatgtggccactgcatatccctctcgtga

SEQ ID NO: 149746 - DNA, 36 bp, Artificial Sequence
  Synthetic oligonucleotide
tccccaaatcgctctcctgtctcgcgccgccattta

SEQ ID NO: 149747 - DNA, 35 bp, Artificial Sequence
  Synthetic oligonucleotide
gtgtacgtacatggagtgggaagggtgggctcaac

SEQ ID NO: 149748 - DNA, 35 bp, Artificial Sequence
  Synthetic oligonucleotide
agccattggccttgtttctctgcttctgtctccac

SEQ ID NO: 149749 - DNA, 35 bp, Artificial Sequence
  Synthetic oligonucleotide
gtcacagtagttgtttccctggccgcttttactac

SEQ ID NO: 149750 - DNA, 35 bp, Artificial Sequence
  Synthetic oligonucleotide
ggaacccgccgcttgctctacgatatcattatacc

SEQ ID NO: 149751 - DNA, 35 bp, Artificial Sequence
  Synthetic oligonucleotide
accggtgggcccgcatgtcttcatcgttttcaccc

SEQ ID NO: 149752 - DNA, 35 bp, Artificial Sequence
  Synthetic oligonucleotide
gccatcaccccctcctttcgtatggctgttagccc

SEQ ID NO: 149753 - DNA, 35 bp, Artificial Sequence
  Synthetic oligonucleotide
agtgtctagcagccacgaacccgccaccgccgccc

SEQ ID NO: 149754 - DNA, 35 bp, Artificial Sequence
  Synthetic oligonucleotide
accgtttcgcacctgtcttgctgcctggtccgccc

SEQ ID NO: 149755 - DNA, 35 bp, Artificial Sequence
  Synthetic oligonucleotide
ggactcgatccgttcttgcgttctttctttggccc

SEQ ID NO: 149756 - DNA, 35 bp, Artificial Sequence
  Synthetic oligonucleotide
ttcgcccctctcacgtaaccgttgggatactgccc

SEQ ID NO: 149757 - DNA, 35 bp, Artificial Sequence
  Synthetic oligonucleotide
tggacgagcttttctgtccccccgtttatctgccc

SEQ ID NO: 149758 - DNA, 35 bp, Artificial Sequence
  Synthetic oligonucleotide
gacgcccgtcctcataacaccgtgcactattgccc

SEQ ID NO: 149759 - DNA, 35 bp, Artificial Sequence
  Synthetic oligonucleotide
gatcctgtcgccactatccctgagtccatatagcc

SEQ ID NO: 149760 - DNA, 35 bp, Artificial Sequence
  Synthetic oligonucleotide
actcccgcggtaagcattgtttcgtcccccatgcc

SEQ ID NO: 149761 - DNA, 35 bp, Artificial Sequence
  Synthetic oligonucleotide
gtccccccgtgcgccactattcttcacctcgccgc

SEQ ID NO: 149762 - DNA, 35 bp, Artificial Sequence
  Synthetic oligonucleotide
ttcgaatgcgtaacgccacccgcctgccatatcgc

SEQ ID NO: 149763 - DNA, 35 bp, Artificial Sequence
  Synthetic oligonucleotide
tttgacccgcattttggccctgtacagtatcctgc

SEQ ID NO: 149764 - DNA, 35 bp, Artificial Sequence
  Synthetic oligonucleotide
gagtccatcccgccttgttccgctcaccctgctgc

SEQ ID NO: 149765 - DNA, 35 bp, Artificial Sequence
  Synthetic oligonucleotide
gatgccggtcgcccgccacacttgacatgcctctc

SEQ ID NO: 149766 - DNA, 35 bp, Artificial Sequence
  Synthetic oligonucleotide
gtagctcagcccctcttccgtcttcgaccccagtc

SEQ ID NO: 149767 - DNA, 35 bp, Artificial Sequence
  Synthetic oligonucleotide
tgcttccccccaagccccctcatggtccccgtgtc

SEQ ID NO: 149768 - DNA, 30 bp, Artificial Sequence
  Synthetic oligonucleotide
gagacgcacctacgcctcttttaacaattc

SEQ ID NO: 149769 - DNA, 35 bp, Artificial Sequence
  Synthetic oligonucleotide
ctccgccccctcatcgtacccctgatctacagtag

SEQ ID NO: 149770 - DNA, 35 bp, Artificial Sequence
  Synthetic oligonucleotide
tctccctcaccgcttccaacttgctttaccgaacg

SEQ ID NO: 149771 - DNA, 35 bp, Artificial Sequence
  Synthetic oligonucleotide
gcgtaccccggtccacgcgataccaccctacaccg

SEQ ID NO: 149772 - DNA, 35 bp, Artificial Sequence
  Synthetic oligonucleotide
acaacccctgcgctagtcccttcgccattcgagcg

SEQ ID NO: 149773 - DNA, 35 bp, Artificial Sequence
  Synthetic oligonucleotide
atgcccctatatgcccacgtctttctcgcttagcg

SEQ ID NO: 149774 - DNA, 35 bp, Artificial Sequence
  Synthetic oligonucleotide
cacatcatactgctgccctcccccgttcgaagatg

SEQ ID NO: 149775 - DNA, 35 bp, Artificial Sequence
  Synthetic oligonucleotide
tcccgtcgatgtccggtaccccaccctccgctctg

SEQ ID NO: 149776 - DNA, 35 bp, Artificial Sequence
  Synthetic oligonucleotide
gatgccgccccctgtgattcttgtaatctgctctg

SEQ ID NO: 149777 - DNA, 35 bp, Artificial Sequence
  Synthetic oligonucleotide
tcacctgccccccgttgtcgcctgctacatctttg

SEQ ID NO: 149778 - DNA, 35 bp, Artificial Sequence
  Synthetic oligonucleotide
gacttgaccctcacgccgttggagccctctgccat

SEQ ID NO: 149779 - DNA, 35 bp, Artificial Sequence
  Synthetic oligonucleotide
gtgtgtcaaagccgtgcttactatcctgttctcat

SEQ ID NO: 149780 - DNA, 35 bp, Artificial Sequence
  Synthetic oligonucleotide
gcacctcaagcccgcaattgcatcacccctgcact

SEQ ID NO: 149781 - DNA, 35 bp, Artificial Sequence
  Synthetic oligonucleotide
aagcaccatccccactgcttcggctcgcctatcct

SEQ ID NO: 149782 - DNA, 34 bp, Artificial Sequence
  Synthetic oligonucleotide
gcgaactccgttggcctaatttagctgcccttct

SEQ ID NO: 149783 - DNA, 35 bp, Artificial Sequence
  Synthetic oligonucleotide
gtcccagccatctaactcgatcccgcctgcatttt

SEQ ID NO: 149784 - DNA, 36 bp, Artificial Sequence
  Synthetic oligonucleotide
gttcctccgcccaccgtgttcatgaatatgcgcaca

SEQ ID NO: 149785 - DNA, 34 bp, Artificial Sequence
  Synthetic oligonucleotide
tttcgcccttgccttcctaattcgcccacgcgca

SEQ ID NO: 149786 - DNA, 36 bp, Artificial Sequence
  Synthetic oligonucleotide
gagacgcccagttcacacaacccaccgccctctgca

SEQ ID NO: 149787 - DNA, 37 bp, Artificial Sequence
  Synthetic oligonucleotide
aacaggcgggtgaaaggtgaagaagggtggcataaga

SEQ ID NO: 149788 - DNA, 37 bp, Artificial Sequence
  Synthetic oligonucleotide
ttacactcacactgaccacccgccgttcttgacgaga

SEQ ID NO: 149789 - DNA, 35 bp, Artificial Sequence
  Synthetic oligonucleotide
tgccctgcacccgcgcgaagcattccccaatgaga

SEQ ID NO: 149790 - DNA, 37 bp, Artificial Sequence
  Synthetic oligonucleotide
aacccactctcgctgttaccccgcctgtccagaacga

SEQ ID NO: 149791 - DNA, 37 bp, Artificial Sequence
  Synthetic oligonucleotide
tcccggccatccttggttctacccgtcgcttctacga

SEQ ID NO: 149792 - DNA, 37 bp, Artificial Sequence
  Synthetic oligonucleotide
accgtctcgcggccatccggctttaactcccacccga

SEQ ID NO: 149793 - DNA, 35 bp, Artificial Sequence
  Synthetic oligonucleotide
accgtgtagtcccatctggccgtaccctttcccga

SEQ ID NO: 149794 - DNA, 37 bp, Artificial Sequence
  Synthetic oligonucleotide
gtgatgccctctcgctcttgtctagtcctcagtccga

SEQ ID NO: 149795 - DNA, 37 bp, Artificial Sequence
  Synthetic oligonucleotide
gcaccgggaaattggtgtagcgggcgtgggagggcga

SEQ ID NO: 149796 - DNA, 37 bp, Artificial Sequence
  Synthetic oligonucleotide
atcgcccacatggctttcatgacatttcctctttcga

SEQ ID NO: 149797 - DNA, 36 bp, Artificial Sequence
  Synthetic oligonucleotide
aaccccgggcgggtgggtgtggccggttaaacagga

SEQ ID NO: 149798 - DNA, 36 bp, Artificial Sequence
  Synthetic oligonucleotide
agccgccctactgcgtcacatttccactccgccgga

SEQ ID NO: 149799 - DNA, 37 bp, Artificial Sequence
  Synthetic oligonucleotide
tgatggacgaacgagggggaagaaaggatctgcggga

SEQ ID NO: 149800 - DNA, 38 bp, Artificial Sequence
  Synthetic oligonucleotide
ggtggtgggacggggacggacggccgcgggaaaactga

SEQ ID NO: 149801 - DNA, 38 bp, Artificial Sequence
  Synthetic oligonucleotide
ggacgaggtggagggggaggtggtaagggtttaactga

SEQ ID NO: 149802 - DNA, 37 bp, Artificial Sequence
  Synthetic oligonucleotide
aacctccggccccatccctgctgatcacttctcctga

SEQ ID NO: 149803 - DNA, 36 bp, Artificial Sequence
  Synthetic oligonucleotide
tcacatctccacgcacctttagcaataccttgctga

SEQ ID NO: 149804 - DNA, 38 bp, Artificial Sequence
  Synthetic oligonucleotide
aagacgaaacggcgggaagggagatggaggggtggtga

SEQ ID NO: 149805 - DNA, 36 bp, Artificial Sequence
  Synthetic oligonucleotide
gctaggtgaggagagggaggggacgtcgcgcattga

SEQ ID NO: 149806 - DNA, 38 bp, Artificial Sequence
  Synthetic oligonucleotide
ttcgcggggcctcccttcgtgtctaacgccccctttga

SEQ ID NO: 149807 - DNA, 36 bp, Artificial Sequence
  Synthetic oligonucleotide
gcccccctgtctcgatccggcgtctcaactagccta

SEQ ID NO: 149808 - DNA, 35 bp, Artificial Sequence
  Synthetic oligonucleotide
gagtcaccccctggcgattttggagcccccccgta

SEQ ID NO: 149809 - DNA, 35 bp, Artificial Sequence
  Synthetic oligonucleotide
gcctgccacacttgctttcctatccgtttcccgta

SEQ ID NO: 149810 - DNA, 36 bp, Artificial Sequence
  Synthetic oligonucleotide
tgcaccattcgatcacgccgctagtcactgctctta

SEQ ID NO: 149811 - DNA, 36 bp, Artificial Sequence
  Synthetic oligonucleotide
actcccgccgctcatgccacgcacttcgccccttta

SEQ ID NO: 149812 - DNA, 36 bp, Artificial Sequence
  Synthetic oligonucleotide
gcccccgcaggatcgttcctgttctttacctcttta

SEQ ID NO: 149813 - DNA, 35 bp, Artificial Sequence
  Synthetic oligonucleotide
gcatcctcctcgcgtcactgggcctctgttacaac

SEQ ID NO: 149814 - DNA, 36 bp, Artificial Sequence
  Synthetic oligonucleotide
gtgggaggtcaatctgtcccgcttcgtgttcctcac

SEQ ID NO: 149815 - DNA, 35 bp, Artificial Sequence
  Synthetic oligonucleotide
accccgccccaagagtttcattcggtacacactac

SEQ ID NO: 149816 - DNA, 35 bp, Artificial Sequence
  Synthetic oligonucleotide
agccctatccgtagcactatggccctcgaacctac

SEQ ID NO: 149817 - DNA, 35 bp, Artificial Sequence
  Synthetic oligonucleotide
tccaccgtcacggcccccccttcctttgggtgacc

SEQ ID NO: 149818 - DNA, 35 bp, Artificial Sequence
  Synthetic oligonucleotide
tctatgtccacacagcccgcatactctatcgcccc

SEQ ID NO: 149819 - DNA, 35 bp, Artificial Sequence
  Synthetic oligonucleotide
acccaccctcgaatccatgcgcatccagccgctcc

SEQ ID NO: 149820 - DNA, 35 bp, Artificial Sequence
  Synthetic oligonucleotide
ggaccgtgccccctgtacccgtctgtgctggctcc

SEQ ID NO: 149821 - DNA, 35 bp, Artificial Sequence
  Synthetic oligonucleotide
tgcgcgcttttcggcctccggtatccctgttgtcc

SEQ ID NO: 149822 - DNA, 35 bp, Artificial Sequence
  Synthetic oligonucleotide
gttccccgccctccttacttacggatagcactcgc

SEQ ID NO: 149823 - DNA, 35 bp, Artificial Sequence
  Synthetic oligonucleotide
tcctcctgccctcaactcgctatccctgatccatc

SEQ ID NO: 149824 - DNA, 34 bp, Artificial Sequence
  Synthetic oligonucleotide
gccccattgcccctcttcttgcgcgcttgtactc

SEQ ID NO: 149825 - DNA, 34 bp, Artificial Sequence
  Synthetic oligonucleotide
tgaacactccgcacttcttcactggccctcgctc

SEQ ID NO: 149826 - DNA, 35 bp, Artificial Sequence
  Synthetic oligonucleotide
ttggtcctcacgccgaccgtccttctaaccaagtc

SEQ ID NO: 149827 - DNA, 35 bp, Artificial Sequence
  Synthetic oligonucleotide
acctcaccaacaggccgtattcctagtcccgattc

SEQ ID NO: 149828 - DNA, 35 bp, Artificial Sequence
  Synthetic oligonucleotide
ggaccatactgcagccgcttttgccgaccgccttc

SEQ ID NO: 149829 - DNA, 36 bp, Artificial Sequence
  Synthetic oligonucleotide
gcccaccccgtcatttcccgttttgtttgactagcg

SEQ ID NO: 149830 - DNA, 35 bp, Artificial Sequence
  Synthetic oligonucleotide
atctggagagggttgaagggggaagcaaaggacgg

SEQ ID NO: 149831 - DNA, 35 bp, Artificial Sequence
  Synthetic oligonucleotide
ggggacgttaaagggtgggcgcagttatcttgggg

SEQ ID NO: 149832 - DNA, 35 bp, Artificial Sequence
  Synthetic oligonucleotide
aagggcggaggagacggggaggcagggttcatgtg

SEQ ID NO: 149833 - DNA, 35 bp, Artificial Sequence
  Synthetic oligonucleotide
atgccggatgagccggtccctacttccccctcttg

SEQ ID NO: 149834 - DNA, 35 bp, Artificial Sequence
  Synthetic oligonucleotide
tcgtgaggtcagtcatccccctgtcggcaatacat

SEQ ID NO: 149835 - DNA, 35 bp, Artificial Sequence
  Synthetic oligonucleotide
tgcctccactcccattttaggtatacacgtaccat

SEQ ID NO: 149836 - DNA, 35 bp, Artificial Sequence
  Synthetic oligonucleotide
gtaggagccttaccgtccaagaacaccgccttcct

SEQ ID NO: 149837 - DNA, 35 bp, Artificial Sequence
  Synthetic oligonucleotide
gatgatcaactccaccccgccttgtggcccgctct

SEQ ID NO: 149838 - DNA, 35 bp, Artificial Sequence
  Synthetic oligonucleotide
gcgcaacgttaccatcactgtctgtgcaccttcgt

SEQ ID NO: 149839 - DNA, 35 bp, Artificial Sequence
  Synthetic oligonucleotide
gccactgcgctcgccccccttgtcatctgcttcgt

SEQ ID NO: 149840 - DNA, 35 bp, Artificial Sequence
  Synthetic oligonucleotide
ataccccccgtacagttctctcttcccttacctgt

SEQ ID NO: 149841 - DNA, 35 bp, Artificial Sequence
  Synthetic oligonucleotide
tccccccgttgcgcatacgccacctgatgatcctt

SEQ ID NO: 149842 - DNA, 35 bp, Artificial Sequence
  Synthetic oligonucleotide
gtgccccttcatattttcatgatcctgcgctcctt

SEQ ID NO: 149843 - DNA, 35 bp, Artificial Sequence
  Synthetic oligonucleotide
tccacgcgttcataacatgccatcgatgccttctt

SEQ ID NO: 149844 - DNA, 36 bp, Artificial Sequence
  Synthetic oligonucleotide
gaatcgaggaagaagggatgtcgggtgggggagaaa

SEQ ID NO: 149845 - DNA, 36 bp, Artificial Sequence
  Synthetic oligonucleotide
tatccgacgccccatctccttaggcgcactgtgaaa

SEQ ID NO: 149846 - DNA, 36 bp, Artificial Sequence
  Synthetic oligonucleotide
tgccacattcgctcgctgcctgttgttcacctctca

SEQ ID NO: 149847 - DNA, 35 bp, Artificial Sequence
  Synthetic oligonucleotide
tccaacatgcaatcattggtctaccctccctctca

SEQ ID NO: 149848 - DNA, 36 bp, Artificial Sequence
  Synthetic oligonucleotide
ttgtagagggggagggtgagggaggagggcttcaga

SEQ ID NO: 149849 - DNA, 37 bp, Artificial Sequence
  Synthetic oligonucleotide
gccgcctccttcctggtttcatgcttagccccataga

SEQ ID NO: 149850 - DNA, 35 bp, Artificial Sequence
  Synthetic oligonucleotide
atgtgcgagggagggcagggtggggccacgtccga

SEQ ID NO: 149851 - DNA, 36 bp, Artificial Sequence
  Synthetic oligonucleotide
accatactgttatccgctccgcctcgcccgactcga

SEQ ID NO: 149852 - DNA, 37 bp, Artificial Sequence
  Synthetic oligonucleotide
gccagatgctggtccacatgggacgggggggacggga

SEQ ID NO: 149853 - DNA, 36 bp, Artificial Sequence
  Synthetic oligonucleotide
atcacacaggagacggagggaagtgcgggtcgggga

SEQ ID NO: 149854 - DNA, 38 bp, Artificial Sequence
  Synthetic oligonucleotide
ttaggtggtacgggaggaggggaaggcgacacggatga

SEQ ID NO: 149855 - DNA, 38 bp, Artificial Sequence
  Synthetic oligonucleotide
gatgctcggcatgacgatatttccactctccaccctga

SEQ ID NO: 149856 - DNA, 37 bp, Artificial Sequence
  Synthetic oligonucleotide
atctgccggacttctctgcctcgttccattttcctga

SEQ ID NO: 149857 - DNA, 38 bp, Artificial Sequence
  Synthetic oligonucleotide
gagtgggggggagggaacaatacggatcgagaaagtga

SEQ ID NO: 149858 - DNA, 38 bp, Artificial Sequence
  Synthetic oligonucleotide
aagacaggggggcggtgggcaaatgggcctgagagtga

SEQ ID NO: 149859 - DNA, 38 bp, Artificial Sequence
  Synthetic oligonucleotide
tccccccgttctatcgcacccgttgtcacttgcggtga

SEQ ID NO: 149860 - DNA, 38 bp, Artificial Sequence
  Synthetic oligonucleotide
aatccccgcctagccactgttctccgtgccccttgtga

SEQ ID NO: 149861 - DNA, 38 bp, Artificial Sequence
  Synthetic oligonucleotide
gaccctcacacccccgcgacagtcatgacactaattga

SEQ ID NO: 149862 - DNA, 38 bp, Artificial Sequence
  Synthetic oligonucleotide
ggtctgacacgctgctgtcctcctcgtccctccattga

SEQ ID NO: 149863 - DNA, 38 bp, Artificial Sequence
  Synthetic oligonucleotide
gtgtcgcgcagtgagcttcactactccatgccccttga

SEQ ID NO: 149864 - DNA, 35 bp, Artificial Sequence
  Synthetic oligonucleotide
tcacaccccctgtggcacaacacctacctcgaata

SEQ ID NO: 149865 - DNA, 35 bp, Artificial Sequence
  Synthetic oligonucleotide
aagggctgttccgcctgcttccctccttcacccta

SEQ ID NO: 149866 - DNA, 34 bp, Artificial Sequence
  Synthetic oligonucleotide
tagtgagctgcatcagacctcttgccccccgaac

SEQ ID NO: 149867 - DNA, 35 bp, Artificial Sequence
  Synthetic oligonucleotide
tccccacggccacactcgctatcccatccccaccc

SEQ ID NO: 149868 - DNA, 35 bp, Artificial Sequence
  Synthetic oligonucleotide
gagctgcacgtatttgcacgccttccggattcccc

SEQ ID NO: 149869 - DNA, 35 bp, Artificial Sequence
  Synthetic oligonucleotide
gcgtgccaacgccggcccggtacaccttgcacgcc

SEQ ID NO: 149870 - DNA, 35 bp, Artificial Sequence
  Synthetic oligonucleotide
ggttgcccttcgctttgtagtttcattatcccgcc

SEQ ID NO: 149871 - DNA, 35 bp, Artificial Sequence
  Synthetic oligonucleotide
tgtatctgcccacctgtgcccgaattgtcatggcc

SEQ ID NO: 149872 - DNA, 35 bp, Artificial Sequence
  Synthetic oligonucleotide
acatcctaacccatcatgatactgatcaagcctcc

SEQ ID NO: 149873 - DNA, 35 bp, Artificial Sequence
  Synthetic oligonucleotide
acccgaccttggctttgttgtaactctaccgccgc

SEQ ID NO: 149874 - DNA, 35 bp, Artificial Sequence
  Synthetic oligonucleotide
tttccccccacgctattggagagtctcttgccatc

SEQ ID NO: 149875 - DNA, 35 bp, Artificial Sequence
  Synthetic oligonucleotide
gacttccgaccctaactcagcgcattatctcgctc

SEQ ID NO: 149876 - DNA, 35 bp, Artificial Sequence
  Synthetic oligonucleotide
gagtgcaccacctccgttttcgatcctgtctgctc

SEQ ID NO: 149877 - DNA, 35 bp, Artificial Sequence
  Synthetic oligonucleotide
ggggtccgggggggaaacaagggaaacggcaagtc

SEQ ID NO: 149878 - DNA, 35 bp, Artificial Sequence
  Synthetic oligonucleotide
gtccgggatgggaggggggatgcgaagggtgcacg

SEQ ID NO: 149879 - DNA, 35 bp, Artificial Sequence
  Synthetic oligonucleotide
ggcccctcactccatccaggtcctcgcctccatcg

SEQ ID NO: 149880 - DNA, 35 bp, Artificial Sequence
  Synthetic oligonucleotide
gagtccggggtagggaaagttaaggtggaaatggg

SEQ ID NO: 149881 - DNA, 35 bp, Artificial Sequence
  Synthetic oligonucleotide
ttgaaggggggggccatgtattatgggatggtggg

SEQ ID NO: 149882 - DNA, 35 bp, Artificial Sequence
  Synthetic oligonucleotide
acaatgcccgtgtcctccttaggttctttcccctg

SEQ ID NO: 149883 - DNA, 35 bp, Artificial Sequence
  Synthetic oligonucleotide
tcgcactcctcttgcattatccgcctgttgcgaat

SEQ ID NO: 149884 - DNA, 35 bp, Artificial Sequence
  Synthetic oligonucleotide
gttcaccgctcccttccacgtacgtgtgtccctat

SEQ ID NO: 149885 - DNA, 35 bp, Artificial Sequence
  Synthetic oligonucleotide
gccgcacggacgcgatcttgatcccccgctcccct

SEQ ID NO: 149886 - DNA, 35 bp, Artificial Sequence
  Synthetic oligonucleotide
gtaccaccccctcttgtaaaaggacgcgtcactct

SEQ ID NO: 149887 - DNA, 35 bp, Artificial Sequence
  Synthetic oligonucleotide
gtcactgccaccgtgttaacactgtttctcattct

SEQ ID NO: 149888 - DNA, 35 bp, Artificial Sequence
  Synthetic oligonucleotide
tgtccccgcgcccacctctgtccattagtctaagt

SEQ ID NO: 149889 - DNA, 35 bp, Artificial Sequence
  Synthetic oligonucleotide
gtgacaccgatgcctgtactgtcgccacccctctt

SEQ ID NO: 149890 - DNA, 35 bp, Artificial Sequence
  Synthetic oligonucleotide
ctacggctgcacctttggcattccgacccgttctt

SEQ ID NO: 149891 - DNA, 35 bp, Artificial Sequence
  Synthetic oligonucleotide
tccgcgggtcttcgccctccccttttggcccggtt

SEQ ID NO: 149892 - DNA, 35 bp, Artificial Sequence
  Synthetic oligonucleotide
agatatggaagggatggggggaggagcaggggttt

SEQ ID NO: 149893 - DNA, 35 bp, Artificial Sequence
  Synthetic oligonucleotide
tcgcaggtcaccattcgcctagcccgaccacccaa

SEQ ID NO: 149894 - DNA, 36 bp, Artificial Sequence
  Synthetic oligonucleotide
accaccgcttgcacatgctctatttagttcccccaa

SEQ ID NO: 149895 - DNA, 36 bp, Artificial Sequence
  Synthetic oligonucleotide
tgtgtcccgcccccgtcctacatgatccggctgtaa

SEQ ID NO: 149896 - DNA, 36 bp, Artificial Sequence
  Synthetic oligonucleotide
tgacctcctgctctcatgctgtcgcccttcgtaaca

SEQ ID NO: 149897 - DNA, 35 bp, Artificial Sequence
  Synthetic oligonucleotide
tgccgctcacaactggtctttgcctcatcactaca

SEQ ID NO: 149898 - DNA, 35 bp, Artificial Sequence
  Synthetic oligonucleotide
ggtccgctcggaccccaacccgtccatccgctcca

SEQ ID NO: 149899 - DNA, 35 bp, Artificial Sequence
  Synthetic oligonucleotide
tacgatctgacgggttccagccccttgcccttcca

SEQ ID NO: 149900 - DNA, 36 bp, Artificial Sequence
  Synthetic oligonucleotide
tcgatgggcgggtgtgctgctaggggagggtttgca

SEQ ID NO: 149901 - DNA, 35 bp, Artificial Sequence
  Synthetic oligonucleotide
gatggtcgacccgctaagcccacgttctttcttca

SEQ ID NO: 149902 - DNA, 37 bp, Artificial Sequence
  Synthetic oligonucleotide
ttctgccactccgccgccgtgattacgatcttcgaga

SEQ ID NO: 149903 - DNA, 37 bp, Artificial Sequence
  Synthetic oligonucleotide
gacacgggcgagtgcagggggcttaggggaggtacga

SEQ ID NO: 149904 - DNA, 37 bp, Artificial Sequence
  Synthetic oligonucleotide
gtaacgggagatagagggaggaaagcagaattggcga

SEQ ID NO: 149905 - DNA, 37 bp, Artificial Sequence
  Synthetic oligonucleotide
gcgggatgcgaaggaggagtgggtgggtgggcgagga

SEQ ID NO: 149906 - DNA, 37 bp, Artificial Sequence
  Synthetic oligonucleotide
gctgggcgggtgggcgaccgtaaacactacttcggga

SEQ ID NO: 149907 - DNA, 37 bp, Artificial Sequence
  Synthetic oligonucleotide
tggggagtgtcggtttccatcctagggcggtggggga

SEQ ID NO: 149908 - DNA, 37 bp, Artificial Sequence
  Synthetic oligonucleotide
gctgggcgaaataggaaagaaagcgggttgggtggga

SEQ ID NO: 149909 - DNA, 38 bp, Artificial Sequence
  Synthetic oligonucleotide
ggaacgggcataggggggggtgcggggtaggataatga

SEQ ID NO: 149910 - DNA, 37 bp, Artificial Sequence
  Synthetic oligonucleotide
atgccacccttctcttatgcagccactcttgctatga

SEQ ID NO: 149911 - DNA, 34 bp, Artificial Sequence
  Synthetic oligonucleotide
aaagcgctccccccccaccaccatcctggcctga

SEQ ID NO: 149912 - DNA, 38 bp, Artificial Sequence
  Synthetic oligonucleotide
tccacttgcccctgatccacccctctttctgtgagtga

SEQ ID NO: 149913 - DNA, 38 bp, Artificial Sequence
  Synthetic oligonucleotide
atgtcacgactgacaacacccccacacccttgtcgtga

SEQ ID NO: 149914 - DNA, 38 bp, Artificial Sequence
  Synthetic oligonucleotide
gatggcatgagggacaaggggagcaagggagagggtga

SEQ ID NO: 149915 - DNA, 35 bp, Artificial Sequence
  Synthetic oligonucleotide
ttcgccgtccacacatctgattcgcatcctcacta

SEQ ID NO: 149916 - DNA, 36 bp, Artificial Sequence
  Synthetic oligonucleotide
gccccttcccagtgaaatcatcccggttactccgta

SEQ ID NO: 149917 - DNA, 35 bp, Artificial Sequence
  Synthetic oligonucleotide
aaggacgggcggttaggggagcagggggttgcgta

SEQ ID NO: 149918 - DNA, 36 bp, Artificial Sequence
  Synthetic oligonucleotide
ttcacgtgcgcccctcttgttcctacgcctcaatta

SEQ ID NO: 149919 - DNA, 35 bp, Artificial Sequence
  Synthetic oligonucleotide
tcaggtggggggtataggggagggagccgggacac

SEQ ID NO: 149920 - DNA, 35 bp, Artificial Sequence
  Synthetic oligonucleotide
gattccctccgtccgcctctcctttgtcggggacc

SEQ ID NO: 149921 - DNA, 35 bp, Artificial Sequence
  Synthetic oligonucleotide
aaccgcctcgtagcctttccatgcggaccaacccc

SEQ ID NO: 149922 - DNA, 35 bp, Artificial Sequence
  Synthetic oligonucleotide
agcagactctcctccgtccatttccgtcttgcccc

SEQ ID NO: 149923 - DNA, 35 bp, Artificial Sequence
  Synthetic oligonucleotide
tctcttcccccgctcctcatgacgtaactaccgcc

SEQ ID NO: 149924 - DNA, 35 bp, Artificial Sequence
  Synthetic oligonucleotide
aagccacagatttagttggttccacgcttccctcc

SEQ ID NO: 149925 - DNA, 35 bp, Artificial Sequence
  Synthetic oligonucleotide
actcactccggcgctgggtcctacgttgattctcc

SEQ ID NO: 149926 - DNA, 35 bp, Artificial Sequence
  Synthetic oligonucleotide
tagtcatgccgcctccaataaagtcgttccgttcc

SEQ ID NO: 149927 - DNA, 35 bp, Artificial Sequence
  Synthetic oligonucleotide
taggtgggtcgagggaggaaggggggtcgtggcgc

SEQ ID NO: 149928 - DNA, 35 bp, Artificial Sequence
  Synthetic oligonucleotide
tagcgccccgcctcaatacatcacgaacccccatc

SEQ ID NO: 149929 - DNA, 35 bp, Artificial Sequence
  Synthetic oligonucleotide
gttgacaccagttccctccatcctcgggcttgatc

SEQ ID NO: 149930 - DNA, 34 bp, Artificial Sequence
  Synthetic oligonucleotide
tccacgccgccacacgctcgaaccttggcctatc

SEQ ID NO: 149931 - DNA, 35 bp, Artificial Sequence
  Synthetic oligonucleotide
gaattcctcctgcgctgtcctttgcctatcacgtc

SEQ ID NO: 149932 - DNA, 35 bp, Artificial Sequence
  Synthetic oligonucleotide
gacgcctgcctgcgtttaatacttagttcctggtc

SEQ ID NO: 149933 - DNA, 35 bp, Artificial Sequence
  Synthetic oligonucleotide
tcacgcccgtggtgtctgacacttgtctcccgttc

SEQ ID NO: 149934 - DNA, 35 bp, Artificial Sequence
  Synthetic oligonucleotide
aaagagggaacggggttggggcggaaggttcgaag

SEQ ID NO: 149935 - DNA, 35 bp, Artificial Sequence
  Synthetic oligonucleotide
gttgcctccgcgcctagccccttctctacccatag

SEQ ID NO: 149936 - DNA, 35 bp, Artificial Sequence
  Synthetic oligonucleotide
gaccgctccccattaggcctataatcactccttag

SEQ ID NO: 149937 - DNA, 35 bp, Artificial Sequence
  Synthetic oligonucleotide
atcaccatcgcagccaacctccctacttctctacg

SEQ ID NO: 149938 - DNA, 35 bp, Artificial Sequence
  Synthetic oligonucleotide
accacctatcgcccccgccagtagagcgtattacg

SEQ ID NO: 149939 - DNA, 35 bp, Artificial Sequence
  Synthetic oligonucleotide
tgccaacaatttatctgccgccgctactcgcctcg

SEQ ID NO: 149940 - DNA, 35 bp, Artificial Sequence
  Synthetic oligonucleotide
ccacgccggtcccatcctgccccatatactcctcg

SEQ ID NO: 149941 - DNA, 35 bp, Artificial Sequence
  Synthetic oligonucleotide
gagcattaggtggagcgaaaggtggtgcggggtgg

SEQ ID NO: 149942 - DNA, 35 bp, Artificial Sequence
  Synthetic oligonucleotide
gctccgctacctgttcgctgcattactgccccaat

SEQ ID NO: 149943 - DNA, 35 bp, Artificial Sequence
  Synthetic oligonucleotide
gagcaacaatcccgatcccacccacctgattccat

SEQ ID NO: 149944 - DNA, 35 bp, Artificial Sequence
  Synthetic oligonucleotide
tcatggcacacctcgcccggtcactcgcatattat

SEQ ID NO: 149945 - DNA, 35 bp, Artificial Sequence
  Synthetic oligonucleotide
ttgcaacgcatacaacaacgccctatctgtcgcct

SEQ ID NO: 149946 - DNA, 35 bp, Artificial Sequence
  Synthetic oligonucleotide
ttaaccgcatatcgcttagccgtcctttctgtcct

SEQ ID NO: 149947 - DNA, 35 bp, Artificial Sequence
  Synthetic oligonucleotide
gtctaaccgtgaggttcgagccacccgacccttct

SEQ ID NO: 149948 - DNA, 35 bp, Artificial Sequence
  Synthetic oligonucleotide
gccccactctctagctcgcattcgcccaggcttct

SEQ ID NO: 149949 - DNA, 35 bp, Artificial Sequence
  Synthetic oligonucleotide
tgccgcattacccgagcgtactccatcctacacgt

SEQ ID NO: 149950 - DNA, 35 bp, Artificial Sequence
  Synthetic oligonucleotide
tcacgccgcaatcccgcccctttcagagctaaggt

SEQ ID NO: 149951 - DNA, 35 bp, Artificial Sequence
  Synthetic oligonucleotide
acgccctccttcggccctgcttaactagccacggt

SEQ ID NO: 149952 - DNA, 35 bp, Artificial Sequence
  Synthetic oligonucleotide
gggtcaggcatcaccccccgcgccctaccaaatgt

SEQ ID NO: 149953 - DNA, 34 bp, Artificial Sequence
  Synthetic oligonucleotide
gctcccctaccctcttccgcgcccgtattcatgt

SEQ ID NO: 149954 - DNA, 35 bp, Artificial Sequence
  Synthetic oligonucleotide
atcgagcacatatggaaccctgcacttcatcctgt

SEQ ID NO: 149955 - DNA, 35 bp, Artificial Sequence
  Synthetic oligonucleotide
ttacgcccctctggactccatcttctacactgaaa

SEQ ID NO: 149956 - DNA, 36 bp, Artificial Sequence
  Synthetic oligonucleotide
ttgtccactcctgtacgcctattgggctcccccgaa

SEQ ID NO: 149957 - DNA, 36 bp, Artificial Sequence
  Synthetic oligonucleotide
tggacatgccgcctgttcgctcgttccactatttaa

SEQ ID NO: 149958 - DNA, 36 bp, Artificial Sequence
  Synthetic oligonucleotide
gtgatccgctgtctcatgctccccccagattctaca

SEQ ID NO: 149959 - DNA, 35 bp, Artificial Sequence
  Synthetic oligonucleotide
aactaccatctgcctgggccttagtacatttccca

SEQ ID NO: 149960 - DNA, 36 bp, Artificial Sequence
  Synthetic oligonucleotide
ggtgccctatccgccgtggtttttagcttgcccgca

SEQ ID NO: 149961 - DNA, 36 bp, Artificial Sequence
  Synthetic oligonucleotide
ggatgaacaaggggagcaaggtcgaccagcggggca

SEQ ID NO: 149962 - DNA, 35 bp, Artificial Sequence
  Synthetic oligonucleotide
tgtgggaccgtctcaaccttatatttgcgccatca

SEQ ID NO: 149963 - DNA, 36 bp, Artificial Sequence
  Synthetic oligonucleotide
gaagggggaggcagggaataagcgcgaagatggtca

SEQ ID NO: 149964 - DNA, 37 bp, Artificial Sequence
  Synthetic oligonucleotide
ggtgaggagggaacggtattggcgtgcggagaggaga

SEQ ID NO: 149965 - DNA, 37 bp, Artificial Sequence
  Synthetic oligonucleotide
gaagcggataggagagagggagggcagcgatttgaga

SEQ ID NO: 149966 - DNA, 37 bp, Artificial Sequence
  Synthetic oligonucleotide
aacgcgaaaggtggggcataggttaagggggggatga

SEQ ID NO: 149967 - DNA, 38 bp, Artificial Sequence
  Synthetic oligonucleotide
tttcgcaccatctcggctctctccacaggctattatga

SEQ ID NO: 149968 - DNA, 38 bp, Artificial Sequence
  Synthetic oligonucleotide
gtctcgccgccctcctattctgtgttaaccacccctga

SEQ ID NO: 149969 - DNA, 38 bp, Artificial Sequence
  Synthetic oligonucleotide
tcggggagggagtagggagggttggggcggttgcgtga

SEQ ID NO: 149970 - DNA, 38 bp, Artificial Sequence
  Synthetic oligonucleotide
gatgccgggcataggggggggagggcaggatgttttga

SEQ ID NO: 149971 - DNA, 36 bp, Artificial Sequence
  Synthetic oligonucleotide
gagggggagatgcagaggggcgatgagggcaagcta

SEQ ID NO: 149972 - DNA, 35 bp, Artificial Sequence
  Synthetic oligonucleotide
gagccccccgccccattaatattagccgtctaaac

SEQ ID NO: 149973 - DNA, 35 bp, Artificial Sequence
  Synthetic oligonucleotide
gatgcctcagcagactcgctccgccccaccgccac

SEQ ID NO: 149974 - DNA, 35 bp, Artificial Sequence
  Synthetic oligonucleotide
acatggtcgccttctccatggtctccattcactac

SEQ ID NO: 149975 - DNA, 35 bp, Artificial Sequence
  Synthetic oligonucleotide
ttgccccgcgccgaccaaaccgtttccctcttacc

SEQ ID NO: 149976 - DNA, 35 bp, Artificial Sequence
  Synthetic oligonucleotide
gccattccccctcggtcggccaacgggcccttccc

SEQ ID NO: 149977 - DNA, 35 bp, Artificial Sequence
  Synthetic oligonucleotide
tattcccgtgcctcctagtacatcagtaccccgcc

SEQ ID NO: 149978 - DNA, 35 bp, Artificial Sequence
  Synthetic oligonucleotide
tgcccggctcccccacgcggttggtccctcccgcc

SEQ ID NO: 149979 - DNA, 35 bp, Artificial Sequence
  Synthetic oligonucleotide
aaaaccagcatggtggtgcctcgccttacccttcc

SEQ ID NO: 149980 - DNA, 35 bp, Artificial Sequence
  Synthetic oligonucleotide
ttcccccccggccgtccgctgattccacgcctcgc

SEQ ID NO: 149981 - DNA, 35 bp, Artificial Sequence
  Synthetic oligonucleotide
ggttagtgcccccgtttgccctaggaccccacctc

SEQ ID NO: 149982 - DNA, 35 bp, Artificial Sequence
  Synthetic oligonucleotide
tatagcccatagctgtgtccccgccccacgacctc

SEQ ID NO: 149983 - DNA, 35 bp, Artificial Sequence
  Synthetic oligonucleotide
actgttgcctccgctgcgtgtcccgctccatcctc

SEQ ID NO: 149984 - DNA, 35 bp, Artificial Sequence
  Synthetic oligonucleotide
atcttcagccggtcacgccgctcctgttgcttttc

SEQ ID NO: 149985 - DNA, 35 bp, Artificial Sequence
  Synthetic oligonucleotide
tgtgagtacgggagagggagggagtgggggccacg

SEQ ID NO: 149986 - DNA, 35 bp, Artificial Sequence
  Synthetic oligonucleotide
ttctttccaccgcctgatgcgcctcttcacccccg

SEQ ID NO: 149987 - DNA, 35 bp, Artificial Sequence
  Synthetic oligonucleotide
gctcgccctcgatcgtctgctcacaactggccccg

SEQ ID NO: 149988 - DNA, 35 bp, Artificial Sequence
  Synthetic oligonucleotide
tatcccccgccatttggcatcgagccttcttcccg

SEQ ID NO: 149989 - DNA, 35 bp, Artificial Sequence
  Synthetic oligonucleotide
gacaacggcccccaccgcctctcctcttcttgatg

SEQ ID NO: 149990 - DNA, 35 bp, Artificial Sequence
  Synthetic oligonucleotide
tttgggagggtacggtgattgggcgggtagggtat

SEQ ID NO: 149991 - DNA, 35 bp, Artificial Sequence
  Synthetic oligonucleotide
gccacgcaaatcgccccctatcttgccatcgaact

SEQ ID NO: 149992 - DNA, 35 bp, Artificial Sequence
  Synthetic oligonucleotide
tactcgttacggacctgtaggtcatcttccctcct

SEQ ID NO: 149993 - DNA, 35 bp, Artificial Sequence
  Synthetic oligonucleotide
acacctgcctccctctctagaagcgtaagctggct

SEQ ID NO: 149994 - DNA, 35 bp, Artificial Sequence
  Synthetic oligonucleotide
tctggcgggaagggtggtggagtgtggggggctct

SEQ ID NO: 149995 - DNA, 35 bp, Artificial Sequence
  Synthetic oligonucleotide
tcgatcactggccccggatcccttcgttattctct

SEQ ID NO: 149996 - DNA, 34 bp, Artificial Sequence
  Synthetic oligonucleotide
gtgccccagagcggtaacccaccctttcatgtct

SEQ ID NO: 149997 - DNA, 35 bp, Artificial Sequence
  Synthetic oligonucleotide
acaacgtgtctctgctccccaccgcctcccggagt

SEQ ID NO: 149998 - DNA, 35 bp, Artificial Sequence
  Synthetic oligonucleotide
tcaaacgcatgaggagtagggggagcggggtgagt

SEQ ID NO: 149999 - DNA, 35 bp, Artificial Sequence
  Synthetic oligonucleotide
tatacgcctcacacccggcacaacccttccactgt

SEQ ID NO: 150000 - DNA, 35 bp, Artificial Sequence
  Synthetic oligonucleotide
tattgctcatccgtagcgtgcattcactatcctgt

SEQ ID NO: 150001 - DNA, 36 bp, Artificial Sequence
  Synthetic oligonucleotide
gtagacgggggggacgggctgggcctttaccagcaa

SEQ ID NO: 150002 - DNA, 36 bp, Artificial Sequence
  Synthetic oligonucleotide
gaggggctggcatggtgggcggtaaggggcaaagaa

SEQ ID NO: 150003 - DNA, 36 bp, Artificial Sequence
  Synthetic oligonucleotide
gacgaccccgtcattaccgccctcttacttagtgca

SEQ ID NO: 150004 - DNA, 33 bp, Artificial Sequence
  Synthetic oligonucleotide
gtccacccactcgctcgcctggacttttcatca

SEQ ID NO: 150005 - DNA, 36 bp, Artificial Sequence
  Synthetic oligonucleotide
atccatagccatcatgtgcgtctaatccacccctca

SEQ ID NO: 150006 - DNA, 37 bp, Artificial Sequence
  Synthetic oligonucleotide
tatcagggtgggagggtaggggttcggtcctcggaga

SEQ ID NO: 150007 - DNA, 37 bp, Artificial Sequence
  Synthetic oligonucleotide
gtcgtgcgacctgggtgttgggggggtgggcaaccga

SEQ ID NO: 150008 - DNA, 37 bp, Artificial Sequence
  Synthetic oligonucleotide
agcccggaggtggaggggatggatgggtggaatccga

SEQ ID NO: 150009 - DNA, 37 bp, Artificial Sequence
  Synthetic oligonucleotide
gatgtgcgcgcataagcctgttttctgttccatccga

SEQ ID NO: 150010 - DNA, 37 bp, Artificial Sequence
  Synthetic oligonucleotide
tttcccccaccgccctctataacgaacctgattcgga

SEQ ID NO: 150011 - DNA, 37 bp, Artificial Sequence
  Synthetic oligonucleotide
gcccctgaccccccagcctgctacaggcctttctgga

SEQ ID NO: 150012 - DNA, 36 bp, Artificial Sequence
  Synthetic oligonucleotide
taaccgcaacacggtatgcccatcctccgaccctga

SEQ ID NO: 150013 - DNA, 38 bp, Artificial Sequence
  Synthetic oligonucleotide
ggaggggaagagggatacgggggctatgcgcggagtga

SEQ ID NO: 150014 - DNA, 38 bp, Artificial Sequence
  Synthetic oligonucleotide
ttcgcacgcccccctcccatcccgagcctcggacgtga

SEQ ID NO: 150015 - DNA, 38 bp, Artificial Sequence
  Synthetic oligonucleotide
ggtaacggtgaaggggggaacgagggtcggtcgcgtga

SEQ ID NO: 150016 - DNA, 38 bp, Artificial Sequence
  Synthetic oligonucleotide
tgacgtcactaaccgctccacgctctccacctgcgtga

SEQ ID NO: 150017 - DNA, 38 bp, Artificial Sequence
  Synthetic oligonucleotide
atccgcgagggggggagtgggagggcattggtttgtga

SEQ ID NO: 150018 - DNA, 36 bp, Artificial Sequence
  Synthetic oligonucleotide
gtagtacgtccatcttgtaacccacccctgccttga

SEQ ID NO: 150019 - DNA, 38 bp, Artificial Sequence
  Synthetic oligonucleotide
cacgtcaactctgtactcctgttgcatcgtatccttga

SEQ ID NO: 150020 - DNA, 38 bp, Artificial Sequence
  Synthetic oligonucleotide
gtgttcgccaacagctcgttattaccttccctctttga

SEQ ID NO: 150021 - DNA, 37 bp, Artificial Sequence
  Synthetic oligonucleotide
gttccgcacacacctcctattgatacctccagtttga

SEQ ID NO: 150022 - DNA, 37 bp, Artificial Sequence
  Synthetic oligonucleotide
tgacataagggagttgtggggggggaggggagtttga

SEQ ID NO: 150023 - DNA, 36 bp, Artificial Sequence
  Synthetic oligonucleotide
gacagagcagcaagggcgtggagggggcgatggtta

SEQ ID NO: 150024 - DNA, 35 bp, Artificial Sequence
  Synthetic oligonucleotide
gttcgccaacactgtcccgctcgactcgccacaac

SEQ ID NO: 150025 - DNA, 35 bp, Artificial Sequence
  Synthetic oligonucleotide
tgacgacctccctgcactcatgcgtccatcctcac

SEQ ID NO: 150026 - DNA, 35 bp, Artificial Sequence
  Synthetic oligonucleotide
ttggtcaggtccacctcgccgatattactcctcac

SEQ ID NO: 150027 - DNA, 35 bp, Artificial Sequence
  Synthetic oligonucleotide
gtggtcccccatgtaatatacttctgctctctgac

SEQ ID NO: 150028 - DNA, 35 bp, Artificial Sequence
  Synthetic oligonucleotide
acgcccgccatagaatgccgccttcccttccatac

SEQ ID NO: 150029 - DNA, 35 bp, Artificial Sequence
  Synthetic oligonucleotide
taccatctggatcgattccagcccgcttgcccacc

SEQ ID NO: 150030 - DNA, 35 bp, Artificial Sequence
  Synthetic oligonucleotide
tccctctgcactcacctccggatcatctcatgtcc

SEQ ID NO: 150031 - DNA, 35 bp, Artificial Sequence
  Synthetic oligonucleotide
aacgacaccttacgaggagtcctctcccctgttcc

SEQ ID NO: 150032 - DNA, 35 bp, Artificial Sequence
  Synthetic oligonucleotide
gccactcgtgtactgtccccgtctatcctttttgc

SEQ ID NO: 150033 - DNA, 30 bp, Artificial Sequence
  Synthetic oligonucleotide
gagtccacccatccagggcgtcctaccatc

SEQ ID NO: 150034 - DNA, 35 bp, Artificial Sequence
  Synthetic oligonucleotide
gtacgtaaccccaggcctccttcttgatctgcatc

SEQ ID NO: 150035 - DNA, 35 bp, Artificial Sequence
  Synthetic oligonucleotide
tcacgtggccactcttccgtaatgtcatctcactc

SEQ ID NO: 150036 - DNA, 35 bp, Artificial Sequence
  Synthetic oligonucleotide
tccctgctgccaatgctcgtcgtacctccttcgtc

SEQ ID NO: 150037 - DNA, 35 bp, Artificial Sequence
  Synthetic oligonucleotide
tgccccgtacccttgattgctttgcacccgttgtc

SEQ ID NO: 150038 - DNA, 35 bp, Artificial Sequence
  Synthetic oligonucleotide
gggatgcgttccggacttgccttaatcctgccttc

SEQ ID NO: 150039 - DNA, 35 bp, Artificial Sequence
  Synthetic oligonucleotide
tccactgcgtcatgatttcggccgccccctgtttc

SEQ ID NO: 150040 - DNA, 35 bp, Artificial Sequence
  Synthetic oligonucleotide
aggggacacaagaaggataggggggtatggcggag

SEQ ID NO: 150041 - DNA, 35 bp, Artificial Sequence
  Synthetic oligonucleotide
tcccatagatgtcgcctcgctccctggtactcccg

SEQ ID NO: 150042 - DNA, 35 bp, Artificial Sequence
  Synthetic oligonucleotide
tacaccacgcctctcaatagtacccaaccttcccg

SEQ ID NO: 150043 - DNA, 35 bp, Artificial Sequence
  Synthetic oligonucleotide
tcacttgtggccgtacccttccttctctcgttctg

SEQ ID NO: 150044 - DNA, 35 bp, Artificial Sequence
  Synthetic oligonucleotide
acctccacgctccgacaccgtgtctgttttactat

SEQ ID NO: 150045 - DNA, 35 bp, Artificial Sequence
  Synthetic oligonucleotide
atcccaccccttgtccggccttcgtcccctacgct

SEQ ID NO: 150046 - DNA, 35 bp, Artificial Sequence
  Synthetic oligonucleotide
gttgcccctggttgctcctgaccctccgacgggct

SEQ ID NO: 150047 - DNA, 35 bp, Artificial Sequence
  Synthetic oligonucleotide
atccctgtacacctgcgtcttcgggccccctatct

SEQ ID NO: 150048 - DNA, 35 bp, Artificial Sequence
  Synthetic oligonucleotide
ggtcgacagtctgttgcgcccccccgttgttatct

SEQ ID NO: 150049 - DNA, 35 bp, Artificial Sequence
  Synthetic oligonucleotide
actcgccccatcaccagcgttgtattcacgcctct

SEQ ID NO: 150050 - DNA, 36 bp, Artificial Sequence
  Synthetic oligonucleotide
gcaagtaggaaggggggagggagtacaataacaggt

SEQ ID NO: 150051 - DNA, 35 bp, Artificial Sequence
  Synthetic oligonucleotide
tggaccggggactaggggggagtaaaggtgggggt

SEQ ID NO: 150052 - DNA, 35 bp, Artificial Sequence
  Synthetic oligonucleotide
tcaaggccacaatccctgcgccttaacacacctgt

SEQ ID NO: 150053 - DNA, 35 bp, Artificial Sequence
  Synthetic oligonucleotide
gtccgaccccgtagatcgctacgtatccgccttgt

SEQ ID NO: 150054 - DNA, 35 bp, Artificial Sequence
  Synthetic oligonucleotide
gatgccccgctcgcgttggcctcgttccctttgtt

SEQ ID NO: 150055 - DNA, 36 bp, Artificial Sequence
  Synthetic oligonucleotide
agtgcaagggagagtatggggagggtatattagaca

SEQ ID NO: 150056 - DNA, 36 bp, Artificial Sequence
  Synthetic oligonucleotide
ggtcgccctgtcacaccttcctgccactggtctaca

SEQ ID NO: 150057 - DNA, 35 bp, Artificial Sequence
  Synthetic oligonucleotide
tccccccgttttatgcgcacctagtcttgctacca

SEQ ID NO: 150058 - DNA, 35 bp, Artificial Sequence
  Synthetic oligonucleotide
gcccccttcctgtcctgcaatactccacattcgca

SEQ ID NO: 150059 - DNA, 36 bp, Artificial Sequence
  Synthetic oligonucleotide
atgtcgtgtgggcctgggggggacggggacggtgca

SEQ ID NO: 150060 - DNA, 35 bp, Artificial Sequence
  Synthetic oligonucleotide
gtaactccgcccctttgcctaattgacttggtgca

SEQ ID NO: 150061 - DNA, 35 bp, Artificial Sequence
  Synthetic oligonucleotide
gatccaccgctgtagcaatcgacgctagaccctca

SEQ ID NO: 150062 - DNA, 36 bp, Artificial Sequence
  Synthetic oligonucleotide
attccagccgcctaccctgtcgatcctatgcagtca

SEQ ID NO: 150063 - DNA, 37 bp, Artificial Sequence
  Synthetic oligonucleotide
gaacctaaggggtggggacggggagagggggacaaga

SEQ ID NO: 150064 - DNA, 37 bp, Artificial Sequence
  Synthetic oligonucleotide
gagggggtgggtaggggggacaagatacaggtccaga

SEQ ID NO: 150065 - DNA, 35 bp, Artificial Sequence
  Synthetic oligonucleotide
tacgatccatctgccccgcctccgcgaatccgaga

SEQ ID NO: 150066 - DNA, 36 bp, Artificial Sequence
  Synthetic oligonucleotide
acttcaccgcaccactccacggtcacttgtcgccga

SEQ ID NO: 150067 - DNA, 37 bp, Artificial Sequence
  Synthetic oligonucleotide
gtgcgggatgagggagggaagagggtcgggacaagga

SEQ ID NO: 150068 - DNA, 37 bp, Artificial Sequence
  Synthetic oligonucleotide
atctacgctcaatctgctcacacctccttgaaacgga

SEQ ID NO: 150069 - DNA, 37 bp, Artificial Sequence
  Synthetic oligonucleotide
tcattcccccgctactgtcaccatctgctttggcgga

SEQ ID NO: 150070 - DNA, 37 bp, Artificial Sequence
  Synthetic oligonucleotide
aaaaggagagggggggaagagcggctggagcgaggga

SEQ ID NO: 150071 - DNA, 37 bp, Artificial Sequence
  Synthetic oligonucleotide
gatcagtagggtggggatggaagaccacgggagggga

SEQ ID NO: 150072 - DNA, 38 bp, Artificial Sequence
  Synthetic oligonucleotide
agcgcccccccggtccctgtgccatcgttcttttatga

SEQ ID NO: 150073 - DNA, 37 bp, Artificial Sequence
  Synthetic oligonucleotide
agccttgctgcagcttatttacgcctgccactcctga

SEQ ID NO: 150074 - DNA, 38 bp, Artificial Sequence
  Synthetic oligonucleotide
gcggaggagtgggggtgggcggggagagctacacgtga

SEQ ID NO: 150075 - DNA, 38 bp, Artificial Sequence
  Synthetic oligonucleotide
aaccgcccctcacttagccgagccatactttaccgtga

SEQ ID NO: 150076 - DNA, 38 bp, Artificial Sequence
  Synthetic oligonucleotide
agagccgtgacggacggggaaggggtgggggatattga

SEQ ID NO: 150077 - DNA, 38 bp, Artificial Sequence
  Synthetic oligonucleotide
gtccacccgccggagcataacaatcgattcgcccttga

SEQ ID NO: 150078 - DNA, 36 bp, Artificial Sequence
  Synthetic oligonucleotide
atgccacaacttccgttcaggagccgcctttaccta

SEQ ID NO: 150079 - DNA, 37 bp, Artificial Sequence
  Synthetic oligonucleotide
acgtacccgcctgctacccccctttggcatcacccta

SEQ ID NO: 150080 - DNA, 36 bp, Artificial Sequence
  Synthetic oligonucleotide
gagcccctccagtgactgccatctgacccttgctta

SEQ ID NO: 150081 - DNA, 35 bp, Artificial Sequence
  Synthetic oligonucleotide
gccaccatctgggtagctcccccgaccaaaccacc

SEQ ID NO: 150082 - DNA, 35 bp, Artificial Sequence
  Synthetic oligonucleotide
atcagccactaagccctcataccagtctgttaccc

SEQ ID NO: 150083 - DNA, 35 bp, Artificial Sequence
  Synthetic oligonucleotide
atccaccgccgaagttgatagcgatcaatttaccc

SEQ ID NO: 150084 - DNA, 35 bp, Artificial Sequence
  Synthetic oligonucleotide
gtgcgaatcgcccaccgttgcccttcactaacccc

SEQ ID NO: 150085 - DNA, 34 bp, Artificial Sequence
  Synthetic oligonucleotide
ttagccccctgtcagccccattgcctgctcgccc

SEQ ID NO: 150086 - DNA, 35 bp, Artificial Sequence
  Synthetic oligonucleotide
gagatcccagaatttcgtgcccgctcccgcctccc

SEQ ID NO: 150087 - DNA, 35 bp, Artificial Sequence
  Synthetic oligonucleotide
gaacactcgccgctctgcagagagcgacctactcc

SEQ ID NO: 150088 - DNA, 35 bp, Artificial Sequence
  Synthetic oligonucleotide
acacgggagggcatgggctgtgatgggcacttcgc

SEQ ID NO: 150089 - DNA, 35 bp, Artificial Sequence
  Synthetic oligonucleotide
tacacctatggattgtcgtgcccttgtgatccctc

SEQ ID NO: 150090 - DNA, 35 bp, Artificial Sequence
  Synthetic oligonucleotide
tgcccaccccgtacggtatcatcatctcggtcctc

SEQ ID NO: 150091 - DNA, 35 bp, Artificial Sequence
  Synthetic oligonucleotide
aatgcacattctgacgtcacacctgcattttcctc

SEQ ID NO: 150092 - DNA, 35 bp, Artificial Sequence
  Synthetic oligonucleotide
gagtgccccttgcctgttgccttcctgagtccttc

SEQ ID NO: 150093 - DNA, 35 bp, Artificial Sequence
  Synthetic oligonucleotide
tgacacgacgacttacgcaccaacgcactatcccg

SEQ ID NO: 150094 - DNA, 35 bp, Artificial Sequence
  Synthetic oligonucleotide
gacgtcacccaagcatatttgatatccgccctccg

SEQ ID NO: 150095 - DNA, 35 bp, Artificial Sequence
  Synthetic oligonucleotide
aattccccctcgcccatctatgtttctttgaatcg

SEQ ID NO: 150096 - DNA, 35 bp, Artificial Sequence
  Synthetic oligonucleotide
gacgcaaggacaccgtttcaacaccactaccctcg

SEQ ID NO: 150097 - DNA, 35 bp, Artificial Sequence
  Synthetic oligonucleotide
ttcgcctcatccgttgcattacatcctccagtggg

SEQ ID NO: 150098 - DNA, 35 bp, Artificial Sequence
  Synthetic oligonucleotide
gtggtatgtccaactgttctatcgattcctcgctg

SEQ ID NO: 150099 - DNA, 35 bp, Artificial Sequence
  Synthetic oligonucleotide
gccgcccccctatgatagattatcgccgtgttctg

SEQ ID NO: 150100 - DNA, 34 bp, Artificial Sequence
  Synthetic oligonucleotide
gcactcgcctccgcaccctaccccttcccacgtg

SEQ ID NO: 150101 - DNA, 35 bp, Artificial Sequence
  Synthetic oligonucleotide
ttccaccgactgtctgcatcctttctcgtgcgcat

SEQ ID NO: 150102 - DNA, 35 bp, Artificial Sequence
  Synthetic oligonucleotide
gcccaacctctgttcattgccacccgtgaccctat

SEQ ID NO: 150103 - DNA, 35 bp, Artificial Sequence
  Synthetic oligonucleotide
tgatcccaccgctggcgatacgttctactcaccct

SEQ ID NO: 150104 - DNA, 35 bp, Artificial Sequence
  Synthetic oligonucleotide
tgtgagaggagtgggcagggggtggggaggttcct

SEQ ID NO: 150105 - DNA, 35 bp, Artificial Sequence
  Synthetic oligonucleotide
actgccccggatgcctaacccgagcttaccacctt

SEQ ID NO: 150106 - DNA, 35 bp, Artificial Sequence
  Synthetic oligonucleotide
accgctgactcccgaccacacacaaccgactcgtt

SEQ ID NO: 150107 - DNA, 35 bp, Artificial Sequence
  Synthetic oligonucleotide
aagtcacaccgttcctcgtatccctgtttggcttt

SEQ ID NO: 150108 - DNA, 34 bp, Artificial Sequence
  Synthetic oligonucleotide
agtacacctcgcgaatgagcctggccatcctttt

SEQ ID NO: 150109 - DNA, 35 bp, Artificial Sequence
  Synthetic oligonucleotide
tctgccccgcatttcgttttaatctggcccaacaa

SEQ ID NO: 150110 - DNA, 26 bp, Artificial Sequence
  Synthetic oligonucleotide
atgcctccccacatgccatgtgccaa

SEQ ID NO: 150111 - DNA, 35 bp, Artificial Sequence
  Synthetic oligonucleotide
tatcaacccggacctgtctaaactacgtgcctcaa

SEQ ID NO: 150112 - DNA, 35 bp, Artificial Sequence
  Synthetic oligonucleotide
gcgcgggctccgactgcatacgctccccacctgaa

SEQ ID NO: 150113 - DNA, 36 bp, Artificial Sequence
  Synthetic oligonucleotide
acatccctacccaatttgcctgacgcgccccctgaa

SEQ ID NO: 150114 - DNA, 35 bp, Artificial Sequence
  Synthetic oligonucleotide
agagccccctcgcaattgtcctatcctacacttaa

SEQ ID NO: 150115 - DNA, 36 bp, Artificial Sequence
  Synthetic oligonucleotide
tacgtaccgccctgagtcctcgtaactctcccaaca

SEQ ID NO: 150116 - DNA, 36 bp, Artificial Sequence
  Synthetic oligonucleotide
agtcaccttcccgtgttttctcctctgccatatgca

SEQ ID NO: 150117 - DNA, 36 bp, Artificial Sequence
  Synthetic oligonucleotide
tccccctccactgaacgcgactccgccccggttgca

SEQ ID NO: 150118 - DNA, 35 bp, Artificial Sequence
  Synthetic oligonucleotide
tgcttcctccggtgccgtatgttcattccttgtca

SEQ ID NO: 150119 - DNA, 35 bp, Artificial Sequence
  Synthetic oligonucleotide
gccgggttcccacgccatccgcctccatggtttca

SEQ ID NO: 150120 - DNA, 37 bp, Artificial Sequence
  Synthetic oligonucleotide
gccacccacttattgcagcactcgcgttatccgccga

SEQ ID NO: 150121 - DNA, 37 bp, Artificial Sequence
  Synthetic oligonucleotide
gacattgggaagtatgggcgggtggggggcatgccga

SEQ ID NO: 150122 - DNA, 37 bp, Artificial Sequence
  Synthetic oligonucleotide
gtcccacctcgactcctgtttacaccctatcttccga

SEQ ID NO: 150123 - DNA, 36 bp, Artificial Sequence
  Synthetic oligonucleotide
ccacccccgcctaccgtgtctgcctcctcgttgcga

SEQ ID NO: 150124 - DNA, 35 bp, Artificial Sequence
  Synthetic oligonucleotide
accagcgggaggaggggaagcaagggggggaagga

SEQ ID NO: 150125 - DNA, 37 bp, Artificial Sequence
  Synthetic oligonucleotide
gatacgtaacgcgggctagagaagggcggggcgggga

SEQ ID NO: 150126 - DNA, 37 bp, Artificial Sequence
  Synthetic oligonucleotide
gccggtggccggacctgtagggtaggggggtggggga

SEQ ID NO: 150127 - DNA, 37 bp, Artificial Sequence
  Synthetic oligonucleotide
gttctaccgcacctccctcattgagcctgccaatgga

SEQ ID NO: 150128 - DNA, 37 bp, Artificial Sequence
  Synthetic oligonucleotide
acagggcctggtgtcggggggggagggccctattgga

SEQ ID NO: 150129 - DNA, 35 bp, Artificial Sequence
  Synthetic oligonucleotide
gcacctcacccatctcccgccttgacggctttgga

SEQ ID NO: 150130 - DNA, 38 bp, Artificial Sequence
  Synthetic oligonucleotide
atcaggagggggccagggagtcaacggggaggaggtga

SEQ ID NO: 150131 - DNA, 37 bp, Artificial Sequence
  Synthetic oligonucleotide
gagcaaccccgccctccgtgtaaatctgcccggttga

SEQ ID NO: 150132 - DNA, 36 bp, Artificial Sequence
  Synthetic oligonucleotide
agttacgccacccattgtcctttcgcctcgttgcta

SEQ ID NO: 150133 - DNA, 35 bp, Artificial Sequence
  Synthetic oligonucleotide
ccagtctacccgcctcacgcccgtccgcttttcta

SEQ ID NO: 150134 - DNA, 36 bp, Artificial Sequence
  Synthetic oligonucleotide
taccgtcatcacccctcccgctgtcgagcccccgta

SEQ ID NO: 150135 - DNA, 35 bp, Artificial Sequence
  Synthetic oligonucleotide
atgggctggtcgataggggggtggggtagggcgta

SEQ ID NO: 150136 - DNA, 36 bp, Artificial Sequence
  Synthetic oligonucleotide
taatcgcatcggagggacttgggagggaacggggta

SEQ ID NO: 150137 - DNA, 35 bp, Artificial Sequence
  Synthetic oligonucleotide
gttccaccacccggtacgccgactatggccaccac

SEQ ID NO: 150138 - DNA, 35 bp, Artificial Sequence
  Synthetic oligonucleotide
tttgccggccatctatgtacgaccaccaacttcac

SEQ ID NO: 150139 - DNA, 35 bp, Artificial Sequence
  Synthetic oligonucleotide
ttggatgcaacggtctgaggctcccttccccttac

SEQ ID NO: 150140 - DNA, 35 bp, Artificial Sequence
  Synthetic oligonucleotide
ctcgccaggtcatttctttggttcgccccccaccc

SEQ ID NO: 150141 - DNA, 35 bp, Artificial Sequence
  Synthetic oligonucleotide
tccagacgtttagtggccatgaccctgcgctcccc

SEQ ID NO: 150142 - DNA, 35 bp, Artificial Sequence
  Synthetic oligonucleotide
acccgcccatgagcgttcgtttcgttactcatccc

SEQ ID NO: 150143 - DNA, 35 bp, Artificial Sequence
  Synthetic oligonucleotide
ttgaggccgctccttgctcacctctgtcctatccc

SEQ ID NO: 150144 - DNA, 35 bp, Artificial Sequence
  Synthetic oligonucleotide
gccggcgagagtgttatcgccattccatcgctccc

SEQ ID NO: 150145 - DNA, 35 bp, Artificial Sequence
  Synthetic oligonucleotide
gctactgccttcacatccgtcctgcccactagtcc

SEQ ID NO: 150146 - DNA, 35 bp, Artificial Sequence
  Synthetic oligonucleotide
ggagggacaaaaatgggcggcggaggcgaacgggc

SEQ ID NO: 150147 - DNA, 35 bp, Artificial Sequence
  Synthetic oligonucleotide
gcctcgcacgcacttgacgacgtaacacccgctgc

SEQ ID NO: 150148 - DNA, 35 bp, Artificial Sequence
  Synthetic oligonucleotide
gataccgctgccatgactaacacgtccttccttgc

SEQ ID NO: 150149 - DNA, 32 bp, Artificial Sequence
  Synthetic oligonucleotide
tgcgcctttatctgctgcccctatgttctatc

SEQ ID NO: 150150 - DNA, 32 bp, Artificial Sequence
  Synthetic oligonucleotide
ttgtcccgccggtgtactcacgcatgcacctc

SEQ ID NO: 150151 - DNA, 35 bp, Artificial Sequence
  Synthetic oligonucleotide
gaagacccctttcggccatcccctcccctgtgctc

SEQ ID NO: 150152 - DNA, 35 bp, Artificial Sequence
  Synthetic oligonucleotide
gagcctcccgtacggccccgttcccttcctccgtc

SEQ ID NO: 150153 - DNA, 35 bp, Artificial Sequence
  Synthetic oligonucleotide
aatatgcccggccgacccgtctatctgtcttcgtc

SEQ ID NO: 150154 - DNA, 35 bp, Artificial Sequence
  Synthetic oligonucleotide
agctccacccgactgactgttcccgtactgatgtc

SEQ ID NO: 150155 - DNA, 35 bp, Artificial Sequence
  Synthetic oligonucleotide
acccatccttctgcacgtatacttatcgtagattc

SEQ ID NO: 150156 - DNA, 35 bp, Artificial Sequence
  Synthetic oligonucleotide
gagccagcctctcccgagccttatccctggtattc

SEQ ID NO: 150157 - DNA, 35 bp, Artificial Sequence
  Synthetic oligonucleotide
aagccaaacgcttccaccgtttcttcatgcccttc

SEQ ID NO: 150158 - DNA, 35 bp, Artificial Sequence
  Synthetic oligonucleotide
gcggaggtgaggagcgagggggggtacgtataaag

SEQ ID NO: 150159 - DNA, 35 bp, Artificial Sequence
  Synthetic oligonucleotide
tacatccgcccaatcagcgatccgccatatccacg

SEQ ID NO: 150160 - DNA, 35 bp, Artificial Sequence
  Synthetic oligonucleotide
tccctagctcccttcctgttcttgtactatgtacg

SEQ ID NO: 150161 - DNA, 35 bp, Artificial Sequence
  Synthetic oligonucleotide
aagagcggatcacgccgttttttatccccccctcg

SEQ ID NO: 150162 - DNA, 35 bp, Artificial Sequence
  Synthetic oligonucleotide
gcccacaccgtctgtaacttgcatccaacttctcg

SEQ ID NO: 150163 - DNA, 35 bp, Artificial Sequence
  Synthetic oligonucleotide
agcaccctcgccctgtccgaaccaacgccttgtcg

SEQ ID NO: 150164 - DNA, 35 bp, Artificial Sequence
  Synthetic oligonucleotide
gaaacccctcggcccccccttacaccgtactttgg

SEQ ID NO: 150165 - DNA, 35 bp, Artificial Sequence
  Synthetic oligonucleotide
tcgcacgtcatacctcttccctgtgtcctgtcatg

SEQ ID NO: 150166 - DNA, 35 bp, Artificial Sequence
  Synthetic oligonucleotide
ggaatagaagggggatgcaatgatagggagcgatg

SEQ ID NO: 150167 - DNA, 35 bp, Artificial Sequence
  Synthetic oligonucleotide
tttcgcggccgttgctggcttcccgttctcatctg

SEQ ID NO: 150168 - DNA, 35 bp, Artificial Sequence
  Synthetic oligonucleotide
tcattatcgctccgttatgtaaccttccccctctg

SEQ ID NO: 150169 - DNA, 35 bp, Artificial Sequence
  Synthetic oligonucleotide
acaccccgacatcccgcaaacaacgcgctttctat

SEQ ID NO: 150170 - DNA, 35 bp, Artificial Sequence
  Synthetic oligonucleotide
ttgctccgcttgcccttcgtatcagtcgctgcact

SEQ ID NO: 150171 - DNA, 35 bp, Artificial Sequence
  Synthetic oligonucleotide
taaccgcccaacctgctcacctcaacgtacatact

SEQ ID NO: 150172 - DNA, 35 bp, Artificial Sequence
  Synthetic oligonucleotide
gtgagtgccgctgttttaccgttcctgcctctact

SEQ ID NO: 150173 - DNA, 35 bp, Artificial Sequence
  Synthetic oligonucleotide
ttgcctaaacgctgtcgtcactcctccgttaccct

SEQ ID NO: 150174 - DNA, 35 bp, Artificial Sequence
  Synthetic oligonucleotide
atgcacgacattcagccatttctcgttcgccccct

SEQ ID NO: 150175 - DNA, 35 bp, Artificial Sequence
  Synthetic oligonucleotide
atcccccacgcacatttaacagaccttccgaatct

SEQ ID NO: 150176 - DNA, 35 bp, Artificial Sequence
  Synthetic oligonucleotide
ttgccattctcgtccattatttgcttttgcgcctt

SEQ ID NO: 150177 - DNA, 35 bp, Artificial Sequence
  Synthetic oligonucleotide
tcgatgcacgtagctcgtcccggacattcctcctt

SEQ ID NO: 150178 - DNA, 35 bp, Artificial Sequence
  Synthetic oligonucleotide
gtccgggggcatctctagggggagggaagggggtt

SEQ ID NO: 150179 - DNA, 35 bp, Artificial Sequence
  Synthetic oligonucleotide
agccccctcgcccgtgtcctggtctcatgcgcttt

SEQ ID NO: 150180 - DNA, 35 bp, Artificial Sequence
  Synthetic oligonucleotide
gagatgcgtatagcttccctgtctgtcctagtttt

SEQ ID NO: 150181 - DNA, 36 bp, Artificial Sequence
  Synthetic oligonucleotide
ggtatggagggggggagaggaggagtgcggttaaaa

SEQ ID NO: 150182 - DNA, 36 bp, Artificial Sequence
  Synthetic oligonucleotide
acatgacgcccacttgacctactcgctaccccgtaa

SEQ ID NO: 150183 - DNA, 35 bp, Artificial Sequence
  Synthetic oligonucleotide
tcataccccgacccttgttcgcttatagcctgtaa

SEQ ID NO: 150184 - DNA, 34 bp, Artificial Sequence
  Synthetic oligonucleotide
actagaggcgccgtatccgttgcccttccattaa

SEQ ID NO: 150185 - DNA, 34 bp, Artificial Sequence
  Synthetic oligonucleotide
accttaacgctggccctgttctactcacgtttca

SEQ ID NO: 150186 - DNA, 37 bp, Artificial Sequence
  Synthetic oligonucleotide
tgcgccgcccctccgtcatttgtccttccgccacaga

SEQ ID NO: 150187 - DNA, 37 bp, Artificial Sequence
  Synthetic oligonucleotide
tacatcagtcgtacacatggtacctcgcttctcccga

SEQ ID NO: 150188 - DNA, 37 bp, Artificial Sequence
  Synthetic oligonucleotide
gaaggggaggagagaggaaacggttgaagcgccgcga

SEQ ID NO: 150189 - DNA, 37 bp, Artificial Sequence
  Synthetic oligonucleotide
ttacccaccccgcctcgacgctatcgctcccgttcga

SEQ ID NO: 150190 - DNA, 37 bp, Artificial Sequence
  Synthetic oligonucleotide
atatcgcgcacagactacgttctatccctctgttcga

SEQ ID NO: 150191 - DNA, 37 bp, Artificial Sequence
  Synthetic oligonucleotide
tcaacctgtgccaatattgctcctccccagtcccgga

SEQ ID NO: 150192 - DNA, 37 bp, Artificial Sequence
  Synthetic oligonucleotide
ggtgggaggaggccgttgtggggtctggcgaggggga

SEQ ID NO: 150193 - DNA, 35 bp, Artificial Sequence
  Synthetic oligonucleotide
taacgcgggtgagggggggtggaatgctgttggga

SEQ ID NO: 150194 - DNA, 36 bp, Artificial Sequence
  Synthetic oligonucleotide
gcacccccctcgatttttcctcaacatccgcatgga

SEQ ID NO: 150195 - DNA, 37 bp, Artificial Sequence
  Synthetic oligonucleotide
tgttctgcctcccgcgcctacccttacctgctttgga

SEQ ID NO: 150196 - DNA, 37 bp, Artificial Sequence
  Synthetic oligonucleotide
tgcatcacgcaccctcacgcataacgcgccgccctga

SEQ ID NO: 150197 - DNA, 37 bp, Artificial Sequence
  Synthetic oligonucleotide
tgcacagcatctgttccatccttttgtcttcgcctga

SEQ ID NO: 150198 - DNA, 38 bp, Artificial Sequence
  Synthetic oligonucleotide
agacacgcgcagctgggctttagggacgggcgggctga

SEQ ID NO: 150199 - DNA, 37 bp, Artificial Sequence
  Synthetic oligonucleotide
gttctgctccatccgtcgtttgctagcccgtttctga

SEQ ID NO: 150200 - DNA, 38 bp, Artificial Sequence
  Synthetic oligonucleotide
gcatgccgcaccacttgtatcatcccttgtttccgtga

SEQ ID NO: 150201 - DNA, 36 bp, Artificial Sequence
  Synthetic oligonucleotide
gaccatccgttgcttctccgcgccgcttgttttcta

SEQ ID NO: 150202 - DNA, 36 bp, Artificial Sequence
  Synthetic oligonucleotide
acccgctcccttacattgtcaagctcgtaccctgta

SEQ ID NO: 150203 - DNA, 35 bp, Artificial Sequence
  Synthetic oligonucleotide
tgcacattgttgttttctctcggaccgctgcttta

SEQ ID NO: 150204 - DNA, 35 bp, Artificial Sequence
  Synthetic oligonucleotide
gcagagcacctcttcccgccccgctcgtttgttta

SEQ ID NO: 150205 - DNA, 36 bp, Artificial Sequence
  Synthetic oligonucleotide
gttctaggcagaaaacgggggagggacggggagaac

SEQ ID NO: 150206 - DNA, 35 bp, Artificial Sequence
  Synthetic oligonucleotide
aatcgcccggtccccgcgcactgccccacgcacac

SEQ ID NO: 150207 - DNA, 35 bp, Artificial Sequence
  Synthetic oligonucleotide
acccttcgccccgtttacaatcgcacactagccac

SEQ ID NO: 150208 - DNA, 35 bp, Artificial Sequence
  Synthetic oligonucleotide
tgaccggcgcctccatccgggaccctccgccttac

SEQ ID NO: 150209 - DNA, 35 bp, Artificial Sequence
  Synthetic oligonucleotide
gtctgacactcgttgttgcttcccttactgccacc

SEQ ID NO: 150210 - DNA, 35 bp, Artificial Sequence
  Synthetic oligonucleotide
gagacaccggagatctcggttcgctttcttccacc

SEQ ID NO: 150211 - DNA, 34 bp, Artificial Sequence
  Synthetic oligonucleotide
atgtctgaccctgcccatggcccacaccactacc

SEQ ID NO: 150212 - DNA, 35 bp, Artificial Sequence
  Synthetic oligonucleotide
gacacttgtccatgccgcaggcagccacccttccc

SEQ ID NO: 150213 - DNA, 35 bp, Artificial Sequence
  Synthetic oligonucleotide
ttatgtcaaccccacgctgcgcttgctcccacgcc

SEQ ID NO: 150214 - DNA, 34 bp, Artificial Sequence
  Synthetic oligonucleotide
gggtcgctccctcactctcgccgctcttcacgcc

SEQ ID NO: 150215 - DNA, 35 bp, Artificial Sequence
  Synthetic oligonucleotide
tgggcgggtgggagcgtagtgcgggtcaatcatcc

SEQ ID NO: 150216 - DNA, 35 bp, Artificial Sequence
  Synthetic oligonucleotide
tccggacgcatctctttccggcccgcgccccctcc

SEQ ID NO: 150217 - DNA, 35 bp, Artificial Sequence
  Synthetic oligonucleotide
tccacatccgcactgcacagacctcagccccttcc

SEQ ID NO: 150218 - DNA, 35 bp, Artificial Sequence
  Synthetic oligonucleotide
tctctacgttcccgccgtctcccacacacccttgc

SEQ ID NO: 150219 - DNA, 35 bp, Artificial Sequence
  Synthetic oligonucleotide
gaatccatgggtgggagggaggcgggcactctatc

SEQ ID NO: 150220 - DNA, 35 bp, Artificial Sequence
  Synthetic oligonucleotide
acgtagactgccagtccgttcacccccgttcagtc

SEQ ID NO: 150221 - DNA, 35 bp, Artificial Sequence
  Synthetic oligonucleotide
gtagccgccctcccggacatcccctttgcaccgcg

SEQ ID NO: 150222 - DNA, 35 bp, Artificial Sequence
  Synthetic oligonucleotide
acacttgccctcggtctgtctttccaaccaacatg

SEQ ID NO: 150223 - DNA, 35 bp, Artificial Sequence
  Synthetic oligonucleotide
gactctacctcgcctcatgatttcgccatcttatg

SEQ ID NO: 150224 - DNA, 35 bp, Artificial Sequence
  Synthetic oligonucleotide
gctcgtacccggctccctctcgctatgatcgcctg

SEQ ID NO: 150225 - DNA, 35 bp, Artificial Sequence
  Synthetic oligonucleotide
atgtgggtgggattgggtgggacaatcaccacaat

SEQ ID NO: 150226 - DNA, 35 bp, Artificial Sequence
  Synthetic oligonucleotide
caccacccttcctcgtgtccgtcgccttataccat

SEQ ID NO: 150227 - DNA, 35 bp, Artificial Sequence
  Synthetic oligonucleotide
gggggacaagcgggcgaggggggtacagagggtat

SEQ ID NO: 150228 - DNA, 35 bp, Artificial Sequence
  Synthetic oligonucleotide
tgcgctccgacgcacctatccgccctctgggtcct

SEQ ID NO: 150229 - DNA, 35 bp, Artificial Sequence
  Synthetic oligonucleotide
tagctgcatccggcgtctccttagcgtgcccatct

SEQ ID NO: 150230 - DNA, 35 bp, Artificial Sequence
  Synthetic oligonucleotide
atgctaccacctccgttcccgttatactgtgctct

SEQ ID NO: 150231 - DNA, 35 bp, Artificial Sequence
  Synthetic oligonucleotide
cactaccgtgcctaggaccgccgtccctgccctgt

SEQ ID NO: 150232 - DNA, 35 bp, Artificial Sequence
  Synthetic oligonucleotide
ttgacctccgcgcgtttgactcataccccgtcctt

SEQ ID NO: 150233 - DNA, 35 bp, Artificial Sequence
  Synthetic oligonucleotide
ggcaaacgccgctctcgtctctccgcctcttgctt

SEQ ID NO: 150234 - DNA, 35 bp, Artificial Sequence
  Synthetic oligonucleotide
accaccactggcctggtgagttgcactacctcgtt

SEQ ID NO: 150235 - DNA, 34 bp, Artificial Sequence
  Synthetic oligonucleotide
gcaaccaatcgtactccgccccccccgcccagaa

SEQ ID NO: 150236 - DNA, 36 bp, Artificial Sequence
  Synthetic oligonucleotide
tcccacggccactagtctattgaccaccaccccgaa

SEQ ID NO: 150237 - DNA, 36 bp, Artificial Sequence
  Synthetic oligonucleotide
tacgggaggtggcgggggtaaggtctacggcgggaa

SEQ ID NO: 150238 - DNA, 36 bp, Artificial Sequence
  Synthetic oligonucleotide
tgccacccgcctatccctgcgcttcaccgccgttaa

SEQ ID NO: 150239 - DNA, 36 bp, Artificial Sequence
  Synthetic oligonucleotide
gtcgacctgacggttagctctgttacccttccacca

SEQ ID NO: 150240 - DNA, 35 bp, Artificial Sequence
  Synthetic oligonucleotide
gtcccccgccccttctgttcaatccccgtggccca

SEQ ID NO: 150241 - DNA, 36 bp, Artificial Sequence
  Synthetic oligonucleotide
agacgaaggaacagggatgatggggggtggcggcca

SEQ ID NO: 150242 - DNA, 37 bp, Artificial Sequence
  Synthetic oligonucleotide
atggaaccctcccgcgcccgcacccttcgctctgcga

SEQ ID NO: 150243 - DNA, 38 bp, Artificial Sequence
  Synthetic oligonucleotide
agtaggtgaagaggggggacggcgacggtgattaatga

SEQ ID NO: 150244 - DNA, 38 bp, Artificial Sequence
  Synthetic oligonucleotide
tgaggggggagggaggggggtggatttggacggtatga

SEQ ID NO: 150245 - DNA, 38 bp, Artificial Sequence
  Synthetic oligonucleotide
tacgcctcgcctgctgccccctcaagaggcgcttctga

SEQ ID NO: 150246 - DNA, 37 bp, Artificial Sequence
  Synthetic oligonucleotide
gaggaagtgctgaaaggcaggagggaccagggagtga

SEQ ID NO: 150247 - DNA, 37 bp, Artificial Sequence
  Synthetic oligonucleotide
gagagggaagaaggtgaacgtggaggggaaaaggtga

SEQ ID NO: 150248 - DNA, 38 bp, Artificial Sequence
  Synthetic oligonucleotide
tccgatctccaccgatgttcacaccctcgtccaattga

SEQ ID NO: 150249 - DNA, 38 bp, Artificial Sequence
  Synthetic oligonucleotide
aggggacggggtgaggggaggattgaccacaggattga

SEQ ID NO: 150250 - DNA, 37 bp, Artificial Sequence
  Synthetic oligonucleotide
ggaggtggtgtggtggacttatggcggtacctgttga

SEQ ID NO: 150251 - DNA, 38 bp, Artificial Sequence
  Synthetic oligonucleotide
tctcgaccgtctgctgccctttcattgccgctctttga

SEQ ID NO: 150252 - DNA, 36 bp, Artificial Sequence
  Synthetic oligonucleotide
gcccgacccgtacgtgtagcaccgccctctctcata

SEQ ID NO: 150253 - DNA, 36 bp, Artificial Sequence
  Synthetic oligonucleotide
gaggtcaacttccgcctgcctgttcctatcttcata

SEQ ID NO: 150254 - DNA, 35 bp, Artificial Sequence
  Synthetic oligonucleotide
aagcaaaggacgagggattggaggggggcggacta

SEQ ID NO: 150255 - DNA, 36 bp, Artificial Sequence
  Synthetic oligonucleotide
gcccggagggacctagcttgggagggaggggcccta

SEQ ID NO: 150256 - DNA, 35 bp, Artificial Sequence
  Synthetic oligonucleotide
aaccgatgctaacccgctgcacctccactgtacac

SEQ ID NO: 150257 - DNA, 34 bp, Artificial Sequence
  Synthetic oligonucleotide
tacgtgcctcctccgactccatccagccgattac

SEQ ID NO: 150258 - DNA, 35 bp, Artificial Sequence
  Synthetic oligonucleotide
accgtctcggtcgcacattagggtccctccccacc

SEQ ID NO: 150259 - DNA, 35 bp, Artificial Sequence
  Synthetic oligonucleotide
atcctcccccccgttcactttaccgtcctcagacc

SEQ ID NO: 150260 - DNA, 35 bp, Artificial Sequence
  Synthetic oligonucleotide
gaggcacctcccgctgttactaggatgccgccccc

SEQ ID NO: 150261 - DNA, 35 bp, Artificial Sequence
  Synthetic oligonucleotide
acgacacggcatttcggttccactctccatactcc

SEQ ID NO: 150262 - DNA, 35 bp, Artificial Sequence
  Synthetic oligonucleotide
ttaggcacccgcccccttgctgcactggcccttcc

SEQ ID NO: 150263 - DNA, 35 bp, Artificial Sequence
  Synthetic oligonucleotide
tcctagcccctctctcccataacgagcttccttgc

SEQ ID NO: 150264 - DNA, 35 bp, Artificial Sequence
  Synthetic oligonucleotide
gtagcaaagccgccttactgttcctcctagcttgc

SEQ ID NO: 150265 - DNA, 35 bp, Artificial Sequence
  Synthetic oligonucleotide
gaccagccatttaggtacacttgtcgcttcccctc

SEQ ID NO: 150266 - DNA, 35 bp, Artificial Sequence
  Synthetic oligonucleotide
tgcctttgcaccacaagccctcgtaagcccgcctc

SEQ ID NO: 150267 - DNA, 35 bp, Artificial Sequence
  Synthetic oligonucleotide
tgaggcccctgttcaaccctcgacttacctggctc

SEQ ID NO: 150268 - DNA, 35 bp, Artificial Sequence
  Synthetic oligonucleotide
gttcacgacctgtcaacgcatagggcgaccccttc

SEQ ID NO: 150269 - DNA, 35 bp, Artificial Sequence
  Synthetic oligonucleotide
gacccaccttatgacatgaccacagctgtatctag

SEQ ID NO: 150270 - DNA, 35 bp, Artificial Sequence
  Synthetic oligonucleotide
tgctgggggtgggggactctggggacggtggtccg

SEQ ID NO: 150271 - DNA, 35 bp, Artificial Sequence
  Synthetic oligonucleotide
aaggatagggaagggggggagataccgctagatgg

SEQ ID NO: 150272 - DNA, 35 bp, Artificial Sequence
  Synthetic oligonucleotide
ttggagagtgggtgggaggtttctggcaccactgg

SEQ ID NO: 150273 - DNA, 35 bp, Artificial Sequence
  Synthetic oligonucleotide
gactcaagtaagttcgggaagaaggaagagggtgg

SEQ ID NO: 150274 - DNA, 35 bp, Artificial Sequence
  Synthetic oligonucleotide
taacccaccctgcccctggtgccttcctcacgatg

SEQ ID NO: 150275 - DNA, 35 bp, Artificial Sequence
  Synthetic oligonucleotide
acccccccgttgcttcttgtctgtctctctgactg

SEQ ID NO: 150276 - DNA, 35 bp, Artificial Sequence
  Synthetic oligonucleotide
gaagtccagatgcccttcttcctgtttcctgcctg

SEQ ID NO: 150277 - DNA, 35 bp, Artificial Sequence
  Synthetic oligonucleotide
aaagggggagtagatagggggagagtgtcgacgtg

SEQ ID NO: 150278 - DNA, 35 bp, Artificial Sequence
  Synthetic oligonucleotide
aacagcacggtcgctcgctacactgtctcctcact

SEQ ID NO: 150279 - DNA, 35 bp, Artificial Sequence
  Synthetic oligonucleotide
gatactcgatgcagcctcggcaccgctctcgccct

SEQ ID NO: 150280 - DNA, 35 bp, Artificial Sequence
  Synthetic oligonucleotide
accgaggtctatggggccacctgctgttcgttcct

SEQ ID NO: 150281 - DNA, 35 bp, Artificial Sequence
  Synthetic oligonucleotide
tcaactagccgcccctactcctggccttgacctgt

SEQ ID NO: 150282 - DNA, 35 bp, Artificial Sequence
  Synthetic oligonucleotide
ttctcaccctccgtgacttattacgcctcgaactt

SEQ ID NO: 150283 - DNA, 35 bp, Artificial Sequence
  Synthetic oligonucleotide
gattgccgaactctatcggtatttgtcgccctctt

SEQ ID NO: 150284 - DNA, 35 bp, Artificial Sequence
  Synthetic oligonucleotide
actccctgccaccgacattcatttaagcccggttt

SEQ ID NO: 150285 - DNA, 36 bp, Artificial Sequence
  Synthetic oligonucleotide
gatctccacccgcataagcacgttgctttagtacaa

SEQ ID NO: 150286 - DNA, 35 bp, Artificial Sequence
  Synthetic oligonucleotide
attgcctcccctccagtcaccctgatccggtgaca

SEQ ID NO: 150287 - DNA, 35 bp, Artificial Sequence
  Synthetic oligonucleotide
tgctccaccacccatagggccgctttccagttaca

SEQ ID NO: 150288 - DNA, 35 bp, Artificial Sequence
  Synthetic oligonucleotide
tgacatcccgtttatacccgccctgtccacttcca

SEQ ID NO: 150289 - DNA, 35 bp, Artificial Sequence
  Synthetic oligonucleotide
tcagtgtgttggttgcctatatcacatctcttcca

SEQ ID NO: 150290 - DNA, 36 bp, Artificial Sequence
  Synthetic oligonucleotide
gtgtccgctgcctcccttgcctacatatggtttgca

SEQ ID NO: 150291 - DNA, 36 bp, Artificial Sequence
  Synthetic oligonucleotide
gtaccctcgcccactggtattttttactaaccctca

SEQ ID NO: 150292 - DNA, 37 bp, Artificial Sequence
  Synthetic oligonucleotide
gagatcacctctgctcccttaatacgccatctgtaga

SEQ ID NO: 150293 - DNA, 37 bp, Artificial Sequence
  Synthetic oligonucleotide
tctgcgatcaatgcgcattttcccccttccttctcga

SEQ ID NO: 150294 - DNA, 37 bp, Artificial Sequence
  Synthetic oligonucleotide
ggagggaaccagggcgacgcgtgaagcggggggggga

SEQ ID NO: 150295 - DNA, 37 bp, Artificial Sequence
  Synthetic oligonucleotide
atcacatggggtaggaaaagggtatggaggcggtgga

SEQ ID NO: 150296 - DNA, 37 bp, Artificial Sequence
  Synthetic oligonucleotide
tcgatcaaccctcggtgcgtcctgacctcctttctga

SEQ ID NO: 150297 - DNA, 37 bp, Artificial Sequence
  Synthetic oligonucleotide
tgaaagcccacatttacttgctccctcacgttcgtga

SEQ ID NO: 150298 - DNA, 37 bp, Artificial Sequence
  Synthetic oligonucleotide
gacctgccgtctcatttgcgcgcgcccaacaccttga

SEQ ID NO: 150299 - DNA, 36 bp, Artificial Sequence
  Synthetic oligonucleotide
ggagaacacgctgctgccctaccaatgcctccttga

SEQ ID NO: 150300 - DNA, 35 bp, Artificial Sequence
  Synthetic oligonucleotide
tatgccgcccatacttcgctgacctgcccatcata

SEQ ID NO: 150301 - DNA, 35 bp, Artificial Sequence
  Synthetic oligonucleotide
gcgtagcacccatgcgctccgaactgctctctata

SEQ ID NO: 150302 - DNA, 35 bp, Artificial Sequence
  Synthetic oligonucleotide
gatccatcgcctttcacatagccccagtggaccac

SEQ ID NO: 150303 - DNA, 35 bp, Artificial Sequence
  Synthetic oligonucleotide
actcagctacgacctatgttgcattcacctcccac

SEQ ID NO: 150304 - DNA, 35 bp, Artificial Sequence
  Synthetic oligonucleotide
gcccttggctgtccaggcccttttcccggttccac

SEQ ID NO: 150305 - DNA, 35 bp, Artificial Sequence
  Synthetic oligonucleotide
tccacagtaccagctccccgcgaacttagccctac

SEQ ID NO: 150306 - DNA, 35 bp, Artificial Sequence
  Synthetic oligonucleotide
atcagcggagcacgtcctctctgtttgtccacacc

SEQ ID NO: 150307 - DNA, 35 bp, Artificial Sequence
  Synthetic oligonucleotide
gaaccactggcctatgcacttgaagctgatccacc

SEQ ID NO: 150308 - DNA, 35 bp, Artificial Sequence
  Synthetic oligonucleotide
tctcacacctaggtgtctctcattggacccgcacc

SEQ ID NO: 150309 - DNA, 35 bp, Artificial Sequence
  Synthetic oligonucleotide
gccgccggttttcgtttcaagccccctgacccccc

SEQ ID NO: 150310 - DNA, 35 bp, Artificial Sequence
  Synthetic oligonucleotide
atcgctccatgaagcctggtccgtttagctcgccc

SEQ ID NO: 150311 - DNA, 35 bp, Artificial Sequence
  Synthetic oligonucleotide
tccaagcatcgtgtcgtgcaatgctatctcgttcc

SEQ ID NO: 150312 - DNA, 35 bp, Artificial Sequence
  Synthetic oligonucleotide
ccatcttgcaccccatgcctcgtcctcccgtacgc

SEQ ID NO: 150313 - DNA, 35 bp, Artificial Sequence
  Synthetic oligonucleotide
agtggcctcccataccgttcgtcgacttgatccgc

SEQ ID NO: 150314 - DNA, 35 bp, Artificial Sequence
  Synthetic oligonucleotide
atactcgccacatccgtttcatagtcatgtttcgc

SEQ ID NO: 150315 - DNA, 35 bp, Artificial Sequence
  Synthetic oligonucleotide
tcaagcggagggagtggggggggagcttgaaaggc

SEQ ID NO: 150316 - DNA, 35 bp, Artificial Sequence
  Synthetic oligonucleotide
gatgagggtgggatgagtcagatgcgcgggggggc

SEQ ID NO: 150317 - DNA, 35 bp, Artificial Sequence
  Synthetic oligonucleotide
gtgtccacggcctcggacctatctattctgcctgc

SEQ ID NO: 150318 - DNA, 35 bp, Artificial Sequence
  Synthetic oligonucleotide
catctccgccgcatggatcaaagcccacgcccctc

SEQ ID NO: 150319 - DNA, 35 bp, Artificial Sequence
  Synthetic oligonucleotide
taagacagcggctcctcatatgcatgcgctccctc

SEQ ID NO: 150320 - DNA, 35 bp, Artificial Sequence
  Synthetic oligonucleotide
tccgctcgctcctcgtgcaactctccgtgttcctc

SEQ ID NO: 150321 - DNA, 35 bp, Artificial Sequence
  Synthetic oligonucleotide
acccctgctgccaacgtagcaccggcttacatctc

SEQ ID NO: 150322 - DNA, 35 bp, Artificial Sequence
  Synthetic oligonucleotide
gcgcacgcccccgatcttgtagtgtcatcctatcg

SEQ ID NO: 150323 - DNA, 35 bp, Artificial Sequence
  Synthetic oligonucleotide
gcacgtctgtcctcacgcccgatcgccttccctcg

SEQ ID NO: 150324 - DNA, 35 bp, Artificial Sequence
  Synthetic oligonucleotide
cacccggtccgcctgcctctgtttcagtccctttg

SEQ ID NO: 150325 - DNA, 35 bp, Artificial Sequence
  Synthetic oligonucleotide
tgaccggacagaaacccccgctcatccgcctcgat

SEQ ID NO: 150326 - DNA, 35 bp, Artificial Sequence
  Synthetic oligonucleotide
ttgtgcacccgcacgaaacatcatagacctcccct

SEQ ID NO: 150327 - DNA, 35 bp, Artificial Sequence
  Synthetic oligonucleotide
aaccgaccaccaaataccgcgctctcctgtacgct

SEQ ID NO: 150328 - DNA, 35 bp, Artificial Sequence
  Synthetic oligonucleotide
tctcagtcgtttagccgaactgccaccatgccctt

SEQ ID NO: 150329 - DNA, 35 bp, Artificial Sequence
  Synthetic oligonucleotide
tccccccgccgagcacgcctaccagcgacgtcttt

SEQ ID NO: 150330 - DNA, 34 bp, Artificial Sequence
  Synthetic oligonucleotide
gcctatcggcgcctcacactctctttcgttcttt

SEQ ID NO: 150331 - DNA, 36 bp, Artificial Sequence
  Synthetic oligonucleotide
tggaagggaaggaggagggagctttgagcagccaaa

SEQ ID NO: 150332 - DNA, 35 bp, Artificial Sequence
  Synthetic oligonucleotide
tcgacctctccgccacctattctacccgaatgaca

SEQ ID NO: 150333 - DNA, 35 bp, Artificial Sequence
  Synthetic oligonucleotide
ttcatccactcccccccgtccggtccgcggggcca

SEQ ID NO: 150334 - DNA, 36 bp, Artificial Sequence
  Synthetic oligonucleotide
aacgcgagctttcatggttcgttctctgcccttcca

SEQ ID NO: 150335 - DNA, 36 bp, Artificial Sequence
  Synthetic oligonucleotide
tccccccctgcgccacggcacctagcgacgcattca

SEQ ID NO: 150336 - DNA, 36 bp, Artificial Sequence
  Synthetic oligonucleotide
tcgagggaggagggcgggtgcgaaggcgaacgaaga

SEQ ID NO: 150337 - DNA, 37 bp, Artificial Sequence
  Synthetic oligonucleotide
tacagcgggcctcgacgtatcgttctctcttctccga

SEQ ID NO: 150338 - DNA, 37 bp, Artificial Sequence
  Synthetic oligonucleotide
ataagggtcgcggccggggatggcgggaagggagcga

SEQ ID NO: 150339 - DNA, 37 bp, Artificial Sequence
  Synthetic oligonucleotide
gaaggttaaggggcgggggggtaacgggaggatgcga

SEQ ID NO: 150340 - DNA, 36 bp, Artificial Sequence
  Synthetic oligonucleotide
tgcctccggcatgatgggagggagggggggagtcga

SEQ ID NO: 150341 - DNA, 37 bp, Artificial Sequence
  Synthetic oligonucleotide
ggagaaagcaataggtaagggaccgggcgagacagga

SEQ ID NO: 150342 - DNA, 37 bp, Artificial Sequence
  Synthetic oligonucleotide
gctgaaggtgggtcgcaggggaggggattgagaggga

SEQ ID NO: 150343 - DNA, 37 bp, Artificial Sequence
  Synthetic oligonucleotide
tagtgagatccgcataacgggaaaagggggggaggga

SEQ ID NO: 150344 - DNA, 36 bp, Artificial Sequence
  Synthetic oligonucleotide
ggaggatagggggcataccgaaggggaagggcggga

SEQ ID NO: 150345 - DNA, 37 bp, Artificial Sequence
  Synthetic oligonucleotide
agtccgggcggggtcttgtggggtaaaatcatgggga

SEQ ID NO: 150346 - DNA, 37 bp, Artificial Sequence
  Synthetic oligonucleotide
tgcgcgtgaggaaccggggagggaagggctgctggga

SEQ ID NO: 150347 - DNA, 38 bp, Artificial Sequence
  Synthetic oligonucleotide
atccggaagggtggcgagggggggtgcaggcagaatga

SEQ ID NO: 150348 - DNA, 38 bp, Artificial Sequence
  Synthetic oligonucleotide
gagagaggagagaagggaataggcgcacgaatgaatga

SEQ ID NO: 150349 - DNA, 37 bp, Artificial Sequence
  Synthetic oligonucleotide
gacccccgcgcccattatccccggccaatcccactga

SEQ ID NO: 150350 - DNA, 37 bp, Artificial Sequence
  Synthetic oligonucleotide
ttggcaatcgttgggggcgggcaggaggaagggctga

SEQ ID NO: 150351 - DNA, 37 bp, Artificial Sequence
  Synthetic oligonucleotide
tcaccccacactctggatttttgttactcgttgctga

SEQ ID NO: 150352 - DNA, 38 bp, Artificial Sequence
  Synthetic oligonucleotide
agacgccgagttcggcatgaggggagtggagggggtga

SEQ ID NO: 150353 - DNA, 38 bp, Artificial Sequence
  Synthetic oligonucleotide
tagggagggggggagagaccaagccatctgggcattga

SEQ ID NO: 150354 - DNA, 37 bp, Artificial Sequence
  Synthetic oligonucleotide
gactgcccccgctcccttaacgacgaataggccttga

SEQ ID NO: 150355 - DNA, 36 bp, Artificial Sequence
  Synthetic oligonucleotide
tctcccccccacaggtacggctcccattcttgttga

SEQ ID NO: 150356 - DNA, 35 bp, Artificial Sequence
  Synthetic oligonucleotide
gccgtcccatccagcatttaccctcctgttgccta

SEQ ID NO: 150357 - DNA, 36 bp, Artificial Sequence
  Synthetic oligonucleotide
gtcatccccatcaatgtcttacattggttccacgta

SEQ ID NO: 150358 - DNA, 35 bp, Artificial Sequence
  Synthetic oligonucleotide
tgacgtgcatatctgctttgtcctccccggcctta

SEQ ID NO: 150359 - DNA, 35 bp, Artificial Sequence
  Synthetic oligonucleotide
gctctctaccccatgcctttagccacgcgttccac

SEQ ID NO: 150360 - DNA, 35 bp, Artificial Sequence
  Synthetic oligonucleotide
atcccctgcatactgtggcccagttacgcttttac

SEQ ID NO: 150361 - DNA, 35 bp, Artificial Sequence
  Synthetic oligonucleotide
tgactccccccacagacctatcgtgtggccacacc

SEQ ID NO: 150362 - DNA, 35 bp, Artificial Sequence
  Synthetic oligonucleotide
tgtgcccgcctcacttattgccttttcttgcagcc

SEQ ID NO: 150363 - DNA, 35 bp, Artificial Sequence
  Synthetic oligonucleotide
acctcacccgtgtggtctgatttccctccgatgcc

SEQ ID NO: 150364 - DNA, 35 bp, Artificial Sequence
  Synthetic oligonucleotide
tagcaggtcactggccgtgataactctcccttgcc

SEQ ID NO: 150365 - DNA, 35 bp, Artificial Sequence
  Synthetic oligonucleotide
tgttatcagccggtgctaccagtgctttctcctcc

SEQ ID NO: 150366 - DNA, 35 bp, Artificial Sequence
  Synthetic oligonucleotide
aataggcgcacccagaccggctaacccgcccttcc

SEQ ID NO: 150367 - DNA, 35 bp, Artificial Sequence
  Synthetic oligonucleotide
tgaattcacccgctgatcttcccgccctgagtggc

SEQ ID NO: 150368 - DNA, 34 bp, Artificial Sequence
  Synthetic oligonucleotide
tacccgtaaagactcacgcatctcctccccctgc

SEQ ID NO: 150369 - DNA, 35 bp, Artificial Sequence
  Synthetic oligonucleotide
gcctcccatccgcagtgtgtctcacagcttgctgc

SEQ ID NO: 150370 - DNA, 35 bp, Artificial Sequence
  Synthetic oligonucleotide
acagatgccctcctgataaatgttgtcacccaatc

SEQ ID NO: 150371 - DNA, 35 bp, Artificial Sequence
  Synthetic oligonucleotide
atgtccccgtttcaggcacaaggttccacttcctc

SEQ ID NO: 150372 - DNA, 35 bp, Artificial Sequence
  Synthetic oligonucleotide
gatagcccactggatggtccccgctctgcctgctc

SEQ ID NO: 150373 - DNA, 35 bp, Artificial Sequence
  Synthetic oligonucleotide
gcatcgtagcccccgtctcccgatatcgccgtctc

SEQ ID NO: 150374 - DNA, 35 bp, Artificial Sequence
  Synthetic oligonucleotide
agatcaagcgcaatgaccccggatcccacgttctc

SEQ ID NO: 150375 - DNA, 35 bp, Artificial Sequence
  Synthetic oligonucleotide
ggcgtgatccccattcgttcgttgccagtcctgtc

SEQ ID NO: 150376 - DNA, 35 bp, Artificial Sequence
  Synthetic oligonucleotide
agtactaccgccctacgtctaaaaccatcacgttc

SEQ ID NO: 150377 - DNA, 35 bp, Artificial Sequence
  Synthetic oligonucleotide
gcgaacaccccgaccatatatgttgtctttcgttc

SEQ ID NO: 150378 - DNA, 35 bp, Artificial Sequence
  Synthetic oligonucleotide
gccttactcccgcgcactcccgtcactctgggacg

SEQ ID NO: 150379 - DNA, 35 bp, Artificial Sequence
  Synthetic oligonucleotide
gacgaccagcaggctcccatgtcttttccacgccg

SEQ ID NO: 150380 - DNA, 35 bp, Artificial Sequence
  Synthetic oligonucleotide
agtatgcctcgccgccctttcacgccttcgctccg

SEQ ID NO: 150381 - DNA, 35 bp, Artificial Sequence
  Synthetic oligonucleotide
tgaagtgggggaggagtcgggagtagttcgcggcg

SEQ ID NO: 150382 - DNA, 35 bp, Artificial Sequence
  Synthetic oligonucleotide
acagtgcagcccacttcgttatcgtacacttctcg

SEQ ID NO: 150383 - DNA, 35 bp, Artificial Sequence
  Synthetic oligonucleotide
ggacaatggcgataaaaggaggggggggcaaaggg

SEQ ID NO: 150384 - DNA, 35 bp, Artificial Sequence
  Synthetic oligonucleotide
gccacattccctgtcatcttcagctgttgccacct

SEQ ID NO: 150385 - DNA, 33 bp, Artificial Sequence
  Synthetic oligonucleotide
actgtcctgccttgactacgccccgccatacct

SEQ ID NO: 150386 - DNA, 36 bp, Artificial Sequence
  Synthetic oligonucleotide
acttcatccttcccagcccagagctacatcgtacct

SEQ ID NO: 150387 - DNA, 35 bp, Artificial Sequence
  Synthetic oligonucleotide
gtgccccaaaccacgttgcccgattatacacgcct

SEQ ID NO: 150388 - DNA, 35 bp, Artificial Sequence
  Synthetic oligonucleotide
tcctccgccgaacctatacttaagactttctgcct

SEQ ID NO: 150389 - DNA, 35 bp, Artificial Sequence
  Synthetic oligonucleotide
gacgcgatcatcatgactgcaactgcacatattct

SEQ ID NO: 150390 - DNA, 35 bp, Artificial Sequence
  Synthetic oligonucleotide
gtcactcaccgcaaacgctccctgccctatagctt

SEQ ID NO: 150391 - DNA, 35 bp, Artificial Sequence
  Synthetic oligonucleotide
attacccgcaccatgttcctacttttcaccggttt

SEQ ID NO: 150392 - DNA, 36 bp, Artificial Sequence
  Synthetic oligonucleotide
aaagtgcgggagggaggaattactggacgagggaaa

SEQ ID NO: 150393 - DNA, 36 bp, Artificial Sequence
  Synthetic oligonucleotide
gccctcgccccgtattactatccgcccgtagttaaa

SEQ ID NO: 150394 - DNA, 35 bp, Artificial Sequence
  Synthetic oligonucleotide
atgatgcgcccggagtcctcgtcaccaaccaccca

SEQ ID NO: 150395 - DNA, 36 bp, Artificial Sequence
  Synthetic oligonucleotide
tgatcgatcctgagctggtagtctggccccccccca

SEQ ID NO: 150396 - DNA, 36 bp, Artificial Sequence
  Synthetic oligonucleotide
atggtcgccctggtactatactcctgttcgccccca

SEQ ID NO: 150397 - DNA, 36 bp, Artificial Sequence
  Synthetic oligonucleotide
gcacacccaccgtctgttcgcatatcttacacgcca

SEQ ID NO: 150398 - DNA, 36 bp, Artificial Sequence
  Synthetic oligonucleotide
atcccgctccctctgacacctacaacagatatgcca

SEQ ID NO: 150399 - DNA, 35 bp, Artificial Sequence
  Synthetic oligonucleotide
atgcacacccgttcgtccgcacatacgttgttcca

SEQ ID NO: 150400 - DNA, 35 bp, Artificial Sequence
  Synthetic oligonucleotide
gatacggcctcctgtacttgcccgttgtttgctca

SEQ ID NO: 150401 - DNA, 37 bp, Artificial Sequence
  Synthetic oligonucleotide
atgcccccccgccccacgtactggtcgtggaatacga

SEQ ID NO: 150402 - DNA, 37 bp, Artificial Sequence
  Synthetic oligonucleotide
attcctccgactatgctgaagcctccctcgttaccga

SEQ ID NO: 150403 - DNA, 37 bp, Artificial Sequence
  Synthetic oligonucleotide
agtctccccctgtgtcacgtttccgccgtcccatcga

SEQ ID NO: 150404 - DNA, 37 bp, Artificial Sequence
  Synthetic oligonucleotide
aagagaggcgactcgaagtcgatgaggggggggcgga

SEQ ID NO: 150405 - DNA, 37 bp, Artificial Sequence
  Synthetic oligonucleotide
ttcacatcacgtcctgtcataccatcactcgctcgga

SEQ ID NO: 150406 - DNA, 37 bp, Artificial Sequence
  Synthetic oligonucleotide
gtgtcacaccgactccgccctgttattgctttactga

SEQ ID NO: 150407 - DNA, 37 bp, Artificial Sequence
  Synthetic oligonucleotide
tagcacgcactgcgagtgtcctccgcctccttcctga

SEQ ID NO: 150408 - DNA, 38 bp, Artificial Sequence
  Synthetic oligonucleotide
tctccaccctgccgcactgaatttcgccgtagccttga

SEQ ID NO: 150409 - DNA, 38 bp, Artificial Sequence
  Synthetic oligonucleotide
gcaccgatcccatccgccccattgagacgacgtcttga

SEQ ID NO: 150410 - DNA, 37 bp, Artificial Sequence
  Synthetic oligonucleotide
tccccaccgccctatactgttctcacctgttcgttga

SEQ ID NO: 150411 - DNA, 36 bp, Artificial Sequence
  Synthetic oligonucleotide
acccgtcccgcactcccctttaccctcggtttttga

SEQ ID NO: 150412 - DNA, 36 bp, Artificial Sequence
  Synthetic oligonucleotide
tgacataccgcaggttgttgcccttaccgccctata

SEQ ID NO: 150413 - DNA, 36 bp, Artificial Sequence
  Synthetic oligonucleotide
gtagacaccgcctccgccctggggttatggccccta

SEQ ID NO: 150414 - DNA, 36 bp, Artificial Sequence
  Synthetic oligonucleotide
ttggtgccctcctgctaagcacatacttaaccgcta

SEQ ID NO: 150415 - DNA, 36 bp, Artificial Sequence
  Synthetic oligonucleotide
tacagtacaggggggggggagcgacttgcggaggta

SEQ ID NO: 150416 - DNA, 35 bp, Artificial Sequence
  Synthetic oligonucleotide
acaagaggaggaacgggaagagtggaagtggctta

SEQ ID NO: 150417 - DNA, 36 bp, Artificial Sequence
  Synthetic oligonucleotide
gcgcaaggggaaggaggggtaagtaatggaaggtta

SEQ ID NO: 150418 - DNA, 35 bp, Artificial Sequence
  Synthetic oligonucleotide
gagtgccccggacacggaagtgcatctgctccccc

SEQ ID NO: 150419 - DNA, 35 bp, Artificial Sequence
  Synthetic oligonucleotide
atgcccgaaacggtactgccctccttacctgtccc

SEQ ID NO: 150420 - DNA, 35 bp, Artificial Sequence
  Synthetic oligonucleotide
ttgtccgcctcgaggttcccccttatcatttggcc

SEQ ID NO: 150421 - DNA, 35 bp, Artificial Sequence
  Synthetic oligonucleotide
tgaggcagatctcccatcgcttcctcgcccgtgcc

SEQ ID NO: 150422 - DNA, 35 bp, Artificial Sequence
  Synthetic oligonucleotide
actcctcgatgcgactcacctttgcgctgttctcc

SEQ ID NO: 150423 - DNA, 35 bp, Artificial Sequence
  Synthetic oligonucleotide
tatcaggcaacaacgtcgctgccatcacccgttcc

SEQ ID NO: 150424 - DNA, 35 bp, Artificial Sequence
  Synthetic oligonucleotide
acccacccactgtttcttcaatgcacttcgctagc

SEQ ID NO: 150425 - DNA, 35 bp, Artificial Sequence
  Synthetic oligonucleotide
tcttctgcccctcgcccaccttacagttccgtggc

SEQ ID NO: 150426 - DNA, 35 bp, Artificial Sequence
  Synthetic oligonucleotide
gatgccccactattgccacgtactggatagcaatc

SEQ ID NO: 150427 - DNA, 35 bp, Artificial Sequence
  Synthetic oligonucleotide
tcatggctccttcccatcattatgacccgtgtctc

SEQ ID NO: 150428 - DNA, 35 bp, Artificial Sequence
  Synthetic oligonucleotide
tccccgcaaacctgcttctcgcccgctgatcggtc

SEQ ID NO: 150429 - DNA, 35 bp, Artificial Sequence
  Synthetic oligonucleotide
actgccggggatgtcctaccaaccgccgccgattc

SEQ ID NO: 150430 - DNA, 35 bp, Artificial Sequence
  Synthetic oligonucleotide
gactccccctgcatgcatttgaccctcttcgcttc

SEQ ID NO: 150431 - DNA, 35 bp, Artificial Sequence
  Synthetic oligonucleotide
tacctgacttccgagtagcgatgccacgccttttc

SEQ ID NO: 150432 - DNA, 35 bp, Artificial Sequence
  Synthetic oligonucleotide
atccgccccgggtcactcgtccctgctcctctaag

SEQ ID NO: 150433 - DNA, 35 bp, Artificial Sequence
  Synthetic oligonucleotide
ggtggtggaggggggtgcttaggataggttggccg

SEQ ID NO: 150434 - DNA, 35 bp, Artificial Sequence
  Synthetic oligonucleotide
gtgccatgaggtggtggtggagcgcggaaggacgg

SEQ ID NO: 150435 - DNA, 35 bp, Artificial Sequence
  Synthetic oligonucleotide
tgtattcccctgccttccgccgtcctccccatcgg

SEQ ID NO: 150436 - DNA, 35 bp, Artificial Sequence
  Synthetic oligonucleotide
tcgacgaaccatcccttgtctttgcccctcttatg

SEQ ID NO: 150437 - DNA, 35 bp, Artificial Sequence
  Synthetic oligonucleotide
acccgcaggcgtgttaaaccgttccttccactctg

SEQ ID NO: 150438 - DNA, 35 bp, Artificial Sequence
  Synthetic oligonucleotide
attctccacaccgctttgatctccgccgctacgtg

SEQ ID NO: 150439 - DNA, 35 bp, Artificial Sequence
  Synthetic oligonucleotide
gaccaccgcacacgctggctttataaatcgcctat

SEQ ID NO: 150440 - DNA, 35 bp, Artificial Sequence
  Synthetic oligonucleotide
tgcccctccgacgttccgagtccatgtccctcact

SEQ ID NO: 150441 - DNA, 34 bp, Artificial Sequence
  Synthetic oligonucleotide
tcacgaatggagggggggaggaaccgtattgact

SEQ ID NO: 150442 - DNA, 35 bp, Artificial Sequence
  Synthetic oligonucleotide
taacgcacccgttttatcgtcttctacataggcct

SEQ ID NO: 150443 - DNA, 35 bp, Artificial Sequence
  Synthetic oligonucleotide
tcacatactccgggctgtcctgttctcgggctcct

SEQ ID NO: 150444 - DNA, 35 bp, Artificial Sequence
  Synthetic oligonucleotide
tagtgcgccctaactgcctttcttgctacgtctct

SEQ ID NO: 150445 - DNA, 35 bp, Artificial Sequence
  Synthetic oligonucleotide
tattgcggtcgccccatccgtgttccttccccctt

SEQ ID NO: 150446 - DNA, 35 bp, Artificial Sequence
  Synthetic oligonucleotide
tccaaccaacgtccggacgcgcccttccgcccctt

SEQ ID NO: 150447 - DNA, 35 bp, Artificial Sequence
  Synthetic oligonucleotide
aacgccaatcgccatctaacgaggatcacgccctt

SEQ ID NO: 150448 - DNA, 35 bp, Artificial Sequence
  Synthetic oligonucleotide
gaccgcctgcccctgtcgtctatacccttgcgctt

SEQ ID NO: 150449 - DNA, 36 bp, Artificial Sequence
  Synthetic oligonucleotide
aatggccctcccctcctatcgtgcttatttgccgaa

SEQ ID NO: 150450 - DNA, 36 bp, Artificial Sequence
  Synthetic oligonucleotide
agtcaagagacaaagggggaaggggcgaaggctgaa

SEQ ID NO: 150451 - DNA, 36 bp, Artificial Sequence
  Synthetic oligonucleotide
acgagccgtattgcccgtttcctctcacgcatgcca

SEQ ID NO: 150452 - DNA, 36 bp, Artificial Sequence
  Synthetic oligonucleotide
ttccccccgtaagccgcaatcttggtaccgttgcca

SEQ ID NO: 150453 - DNA, 36 bp, Artificial Sequence
  Synthetic oligonucleotide
gttgccgtataggcaccgcgcctgttcctctgtcca

SEQ ID NO: 150454 - DNA, 35 bp, Artificial Sequence
  Synthetic oligonucleotide
tccagcctctggccggaggaccaccctgcattcca

SEQ ID NO: 150455 - DNA, 35 bp, Artificial Sequence
  Synthetic oligonucleotide
gcccgttgccgctggaaatagtcccctgcctttca

SEQ ID NO: 150456 - DNA, 36 bp, Artificial Sequence
  Synthetic oligonucleotide
tgtgaagtccgccttcccctttctcgttctgtttca

SEQ ID NO: 150457 - DNA, 37 bp, Artificial Sequence
  Synthetic oligonucleotide
tcgagggaggaggaggataggggtaagagagccgaga

SEQ ID NO: 150458 - DNA, 36 bp, Artificial Sequence
  Synthetic oligonucleotide
tgtgctgccgtgcgttaccatccccatcccttccga

SEQ ID NO: 150459 - DNA, 37 bp, Artificial Sequence
  Synthetic oligonucleotide
tcacgcctgccccgctctcgccattaccgcccggcga

SEQ ID NO: 150460 - DNA, 37 bp, Artificial Sequence
  Synthetic oligonucleotide
attcacccctcccagtccattaccggaacagtttcga

SEQ ID NO: 150461 - DNA, 37 bp, Artificial Sequence
  Synthetic oligonucleotide
gcatagccgccattatccctgtcacttcttcaccgga

SEQ ID NO: 150462 - DNA, 37 bp, Artificial Sequence
  Synthetic oligonucleotide
atgaactgggggttgttggggagggccatattgggga

SEQ ID NO: 150463 - DNA, 37 bp, Artificial Sequence
  Synthetic oligonucleotide
gcccccagccccccccccagcagtcatggcacgtgga

SEQ ID NO: 150464 - DNA, 37 bp, Artificial Sequence
  Synthetic oligonucleotide
ggagggagagcggaggatataggttggtaagggtgga

SEQ ID NO: 150465 - DNA, 38 bp, Artificial Sequence
  Synthetic oligonucleotide
tcagcgactcctgccaccaatcgccctgtcccgcatga

SEQ ID NO: 150466 - DNA, 38 bp, Artificial Sequence
  Synthetic oligonucleotide
atgcgaccgcagttaaataggggaggaagggaggatga

SEQ ID NO: 150467 - DNA, 38 bp, Artificial Sequence
  Synthetic oligonucleotide
tgcaaccccctctatggccccagtggaccttgccctga

SEQ ID NO: 150468 - DNA, 35 bp, Artificial Sequence
  Synthetic oligonucleotide
tccaccccggtctagttcttttcgccctcgcctga

SEQ ID NO: 150469 - DNA, 38 bp, Artificial Sequence
  Synthetic oligonucleotide
gttggatgcgtgaccccccgtccgcccagttcttctga

SEQ ID NO: 150470 - DNA, 35 bp, Artificial Sequence
  Synthetic oligonucleotide
acaccgcgccgcccctgccgttgcctgactagtga

SEQ ID NO: 150471 - DNA, 38 bp, Artificial Sequence
  Synthetic oligonucleotide
acatccgccattcgcgtaggcttatacaccctctttga

SEQ ID NO: 150472 - DNA, 36 bp, Artificial Sequence
  Synthetic oligonucleotide
gtacctcggtgtgactccgccgcctgatactaccta

SEQ ID NO: 150473 - DNA, 35 bp, Artificial Sequence
  Synthetic oligonucleotide
atgcacgcttttagtctcgagtcccgtccgcccta

SEQ ID NO: 150474 - DNA, 35 bp, Artificial Sequence
  Synthetic oligonucleotide
accgtgccacgctcagcaattgctctccgcctcta

SEQ ID NO: 150475 - DNA, 35 bp, Artificial Sequence
  Synthetic oligonucleotide
gcatttccctctgtgttgcgtttccgtcccttcta

SEQ ID NO: 150476 - DNA, 36 bp, Artificial Sequence
  Synthetic oligonucleotide
gaatcggaaggataggggcggggattccgggaagta

SEQ ID NO: 150477 - DNA, 36 bp, Artificial Sequence
  Synthetic oligonucleotide
gccctgcctgcccaccatcatcgtggtttatacgta

SEQ ID NO: 150478 - DNA, 36 bp, Artificial Sequence
  Synthetic oligonucleotide
gaagaaggagcgcggtcaggaatggaggggggggta

SEQ ID NO: 150479 - DNA, 35 bp, Artificial Sequence
  Synthetic oligonucleotide
tagctcgcctttacttcatgcactgtcctcactac

SEQ ID NO: 150480 - DNA, 35 bp, Artificial Sequence
  Synthetic oligonucleotide
tgcctcacccgggattggagtacccccctgcgccc

SEQ ID NO: 150481 - DNA, 35 bp, Artificial Sequence
  Synthetic oligonucleotide
tgttctgctcgacgaatcgctaccctgccccggcc

SEQ ID NO: 150482 - DNA, 35 bp, Artificial Sequence
  Synthetic oligonucleotide
gtttgtcctgccttgatagaaccatcctccgtgcc

SEQ ID NO: 150483 - DNA, 35 bp, Artificial Sequence
  Synthetic oligonucleotide
agccacgccttgcattcgctcgatacataccatcc

SEQ ID NO: 150484 - DNA, 35 bp, Artificial Sequence
  Synthetic oligonucleotide
ttgccctccccgtttgccaatagtaccctgctggc

SEQ ID NO: 150485 - DNA, 35 bp, Artificial Sequence
  Synthetic oligonucleotide
tagcaacccggtcggcctattccacttcactttgc

SEQ ID NO: 150486 - DNA, 35 bp, Artificial Sequence
  Synthetic oligonucleotide
gaacagcaacgtagttagcttttcaccccttactc

SEQ ID NO: 150487 - DNA, 35 bp, Artificial Sequence
  Synthetic oligonucleotide
aagacaagccctcgccgctccctccgcgcaacctc

SEQ ID NO: 150488 - DNA, 35 bp, Artificial Sequence
  Synthetic oligonucleotide
acagaccttcctctagtcgtctatctctagtcctc

SEQ ID NO: 150489 - DNA, 35 bp, Artificial Sequence
  Synthetic oligonucleotide
gcgccgtaggctggcattccacgtgaacacttctc

SEQ ID NO: 150490 - DNA, 35 bp, Artificial Sequence
  Synthetic oligonucleotide
gcactccaatggcacccatgcttcaaccgcctgtc

SEQ ID NO: 150491 - DNA, 35 bp, Artificial Sequence
  Synthetic oligonucleotide
tcaatgggtgggagggagggaccctatattgattc

SEQ ID NO: 150492 - DNA, 35 bp, Artificial Sequence
  Synthetic oligonucleotide
gaaagtgcagcatcgcctcatgccactgtccgttc

SEQ ID NO: 150493 - DNA, 35 bp, Artificial Sequence
  Synthetic oligonucleotide
atccgctcgcgaatccgacttctggtctgcctttc

SEQ ID NO: 150494 - DNA, 35 bp, Artificial Sequence
  Synthetic oligonucleotide
gggtggcgggggggttttgcggatggcacatcgag

SEQ ID NO: 150495 - DNA, 35 bp, Artificial Sequence
  Synthetic oligonucleotide
tccaacccccagcttactatccacgtagttccacg

SEQ ID NO: 150496 - DNA, 35 bp, Artificial Sequence
  Synthetic oligonucleotide
gtgctttttccccgtgccccccgctctaccgtgcg

SEQ ID NO: 150497 - DNA, 35 bp, Artificial Sequence
  Synthetic oligonucleotide
agagatgacgagggagggctggaaaagaggtgggg

SEQ ID NO: 150498 - DNA, 35 bp, Artificial Sequence
  Synthetic oligonucleotide
tacgtacgacctccttcagcattgctcgtttccat

SEQ ID NO: 150499 - DNA, 35 bp, Artificial Sequence
  Synthetic oligonucleotide
actgtcccgtgccatctcagcctatcctcgtacct

SEQ ID NO: 150500 - DNA, 35 bp, Artificial Sequence
  Synthetic oligonucleotide
tcgagtgggtccgcccaactatccatccgctccct

SEQ ID NO: 150501 - DNA, 35 bp, Artificial Sequence
  Synthetic oligonucleotide
gtgtggcccaccctgtttctcgtgactccctcgct

SEQ ID NO: 150502 - DNA, 35 bp, Artificial Sequence
  Synthetic oligonucleotide
aatgcggtcgccttatccgcctcaactcccgtgct

SEQ ID NO: 150503 - DNA, 35 bp, Artificial Sequence
  Synthetic oligonucleotide
tacttccctgtctgtagtgctgcatggccccttct

SEQ ID NO: 150504 - DNA, 35 bp, Artificial Sequence
  Synthetic oligonucleotide
tacccgccccatcccgccgaatcgcatgccgtagt

SEQ ID NO: 150505 - DNA, 35 bp, Artificial Sequence
  Synthetic oligonucleotide
aaagagtcaagggcgggaacgaagaggggggtagt

SEQ ID NO: 150506 - DNA, 35 bp, Artificial Sequence
  Synthetic oligonucleotide
tcatccgccaggcgtctcggtccacccccgcttgt

SEQ ID NO: 150507 - DNA, 35 bp, Artificial Sequence
  Synthetic oligonucleotide
gctctgccccgaccgctgttagcatcactaccatt

SEQ ID NO: 150508 - DNA, 35 bp, Artificial Sequence
  Synthetic oligonucleotide
tgacgcgtgccctcccagcgtgcccgttcacactt

SEQ ID NO: 150509 - DNA, 36 bp, Artificial Sequence
  Synthetic oligonucleotide
tactccacgccgcctgtaactaacctgggccctcaa

SEQ ID NO: 150510 - DNA, 36 bp, Artificial Sequence
  Synthetic oligonucleotide
accacaacctgctctatgctcattgccgcttactaa

SEQ ID NO: 150511 - DNA, 35 bp, Artificial Sequence
  Synthetic oligonucleotide
gggacgaggggtagctgggcgggttgtgggggtaa

SEQ ID NO: 150512 - DNA, 35 bp, Artificial Sequence
  Synthetic oligonucleotide
accgccataccatcctgtcgccgttatgtgtcaca

SEQ ID NO: 150513 - DNA, 36 bp, Artificial Sequence
  Synthetic oligonucleotide
agcacctgtatcatcgttacacactgtctccctaca

SEQ ID NO: 150514 - DNA, 36 bp, Artificial Sequence
  Synthetic oligonucleotide
gagcaccagccccgatctcgcggtcatacactctca

SEQ ID NO: 150515 - DNA, 36 bp, Artificial Sequence
  Synthetic oligonucleotide
tcgcacacttcgttcccctggctatatttccccgga

SEQ ID NO: 150516 - DNA, 38 bp, Artificial Sequence
  Synthetic oligonucleotide
catcacttccaccctcgggttgcatcccagtcaattga

SEQ ID NO: 150517 - DNA, 36 bp, Artificial Sequence
  Synthetic oligonucleotide
acatcctgtctgccgtccctctactcgcgttgtcta

SEQ ID NO: 150518 - DNA, 36 bp, Artificial Sequence
  Synthetic oligonucleotide
acctgcctcccttcgatatacgtttccgtctttgta

SEQ ID NO: 150519 - DNA, 36 bp, Artificial Sequence
  Synthetic oligonucleotide
tcagactctacctgctgccccccctgttgttcgtta

SEQ ID NO: 150520 - DNA, 36 bp, Artificial Sequence
  Synthetic oligonucleotide
tcctgacgtcgtccagcctcgttagtcctccgttta

SEQ ID NO: 150521 - DNA, 35 bp, Artificial Sequence
  Synthetic oligonucleotide
gccacccgtgctatagtacgctcactcagctccac

SEQ ID NO: 150522 - DNA, 35 bp, Artificial Sequence
  Synthetic oligonucleotide
ttctgcgcctcccttggatcctggtccagccctac

SEQ ID NO: 150523 - DNA, 35 bp, Artificial Sequence
  Synthetic oligonucleotide
ttccaccataggacctgtctgtcaccaccaccacc

SEQ ID NO: 150524 - DNA, 35 bp, Artificial Sequence
  Synthetic oligonucleotide
tctgagactcgaggaggctcgcctggttcttcccc

SEQ ID NO: 150525 - DNA, 35 bp, Artificial Sequence
  Synthetic oligonucleotide
gtgactcacccctgccctgtgaccctctataagcc

SEQ ID NO: 150526 - DNA, 35 bp, Artificial Sequence
  Synthetic oligonucleotide
gttcgcctagtgaacgagttattggtccaccttcc

SEQ ID NO: 150527 - DNA, 35 bp, Artificial Sequence
  Synthetic oligonucleotide
tagccacccttgcatgtccattcactccctctcgc

SEQ ID NO: 150528 - DNA, 35 bp, Artificial Sequence
  Synthetic oligonucleotide
actcaccccgatgacatcgattctctaccttatgc

SEQ ID NO: 150529 - DNA, 35 bp, Artificial Sequence
  Synthetic oligonucleotide
gcctacagtccgtctactatcccctcccgctttgc

SEQ ID NO: 150530 - DNA, 35 bp, Artificial Sequence
  Synthetic oligonucleotide
gcttgaggtggggagggggaacgatagacggatag

SEQ ID NO: 150531 - DNA, 35 bp, Artificial Sequence
  Synthetic oligonucleotide
acctccaccgacgctgggtctctttctgtccgtag

SEQ ID NO: 150532 - DNA, 35 bp, Artificial Sequence
  Synthetic oligonucleotide
ttacggacgcccgattctacctcaccgccccccgg

SEQ ID NO: 150533 - DNA, 35 bp, Artificial Sequence
  Synthetic oligonucleotide
tgtcctggccctccacccgtgaaacacgcgcactg

SEQ ID NO: 150534 - DNA, 35 bp, Artificial Sequence
  Synthetic oligonucleotide
gcgtacttgcctgtccctctcccgatcccgtgttg

SEQ ID NO: 150535 - DNA, 35 bp, Artificial Sequence
  Synthetic oligonucleotide
gtgatccactgccacgtttgccctcttctttccat

SEQ ID NO: 150536 - DNA, 35 bp, Artificial Sequence
  Synthetic oligonucleotide
ttactcccccccatgcggccgcgcgtagcctctat

SEQ ID NO: 150537 - DNA, 35 bp, Artificial Sequence
  Synthetic oligonucleotide
tatgccgacgccccatctcgtatttttgcatccct

SEQ ID NO: 150538 - DNA, 35 bp, Artificial Sequence
  Synthetic oligonucleotide
actgcctcctgcagccaaactctatcccctgcatt

SEQ ID NO: 150539 - DNA, 35 bp, Artificial Sequence
  Synthetic oligonucleotide
gaccccatcccgctcagctcgtgcgcgctacactt

SEQ ID NO: 150540 - DNA, 35 bp, Artificial Sequence
  Synthetic oligonucleotide
gccatcgacatcattatgcattgtggccgcccctt

SEQ ID NO: 150541 - DNA, 35 bp, Artificial Sequence
  Synthetic oligonucleotide
tggttgcactcactatgaccctcttcgttgccctt

SEQ ID NO: 150542 - DNA, 35 bp, Artificial Sequence
  Synthetic oligonucleotide
gtacaatctcgcccgctgtccctagcacgcccgtt

SEQ ID NO: 150543 - DNA, 36 bp, Artificial Sequence
  Synthetic oligonucleotide
tgacgcatgccattctttcgggccaataccctcgtt

SEQ ID NO: 150544 - DNA, 34 bp, Artificial Sequence
  Synthetic oligonucleotide
tcatgaccgtactcgggcgttttgtactatcttt

SEQ ID NO: 150545 - DNA, 35 bp, Artificial Sequence
  Synthetic oligonucleotide
gccccccgcctctgttactagtcagtgcacagttt

SEQ ID NO: 150546 - DNA, 35 bp, Artificial Sequence
  Synthetic oligonucleotide
aagaacaaccctcccccccgcagagagacgatttt

SEQ ID NO: 150547 - DNA, 35 bp, Artificial Sequence
  Synthetic oligonucleotide
tacacgctccagcttctatctcccaacggccccaa

SEQ ID NO: 150548 - DNA, 36 bp, Artificial Sequence
  Synthetic oligonucleotide
aaggggaagatgggaggaaggaggtgcggtagtcaa

SEQ ID NO: 150549 - DNA, 36 bp, Artificial Sequence
  Synthetic oligonucleotide
accccacctcgctctggatctccagattcttcttaa

SEQ ID NO: 150550 - DNA, 36 bp, Artificial Sequence
  Synthetic oligonucleotide
agcaagagacgaatcggggaggaggagaggataaca

SEQ ID NO: 150551 - DNA, 36 bp, Artificial Sequence
  Synthetic oligonucleotide
tccccacccactgagttctaccaggcacagttaaca

SEQ ID NO: 150552 - DNA, 36 bp, Artificial Sequence
  Synthetic oligonucleotide
gcctgacagggcgggtgggtggtgccgggttggaca

SEQ ID NO: 150553 - DNA, 32 bp, Artificial Sequence
  Synthetic oligonucleotide
ttctccccgagctgttatccacgtttactaca

SEQ ID NO: 150554 - DNA, 35 bp, Artificial Sequence
  Synthetic oligonucleotide
atcctcaggtcacgctacctgtctcttctctctca

SEQ ID NO: 150555 - DNA, 35 bp, Artificial Sequence
  Synthetic oligonucleotide
tttacgccaccgcatatagcttccgttccttctca

SEQ ID NO: 150556 - DNA, 35 bp, Artificial Sequence
  Synthetic oligonucleotide
tctcggacccacgacgcaaatatgacccaccttca

SEQ ID NO: 150557 - DNA, 35 bp, Artificial Sequence
  Synthetic oligonucleotide
gagacgcacccatactctgcttttgcactgtttca

SEQ ID NO: 150558 - DNA, 36 bp, Artificial Sequence
  Synthetic oligonucleotide
gctccccgccccatatcctttaaggtacttctaaga

SEQ ID NO: 150559 - DNA, 37 bp, Artificial Sequence
  Synthetic oligonucleotide
agtctcgtcccgccgtacctccgcaccaccatacaga

SEQ ID NO: 150560 - DNA, 37 bp, Artificial Sequence
  Synthetic oligonucleotide
tctgacggtccatagtttcatagccccatcccgcgga

SEQ ID NO: 150561 - DNA, 35 bp, Artificial Sequence
  Synthetic oligonucleotide
actccaccgctgcacatccccactatcaggctgga

SEQ ID NO: 150562 - DNA, 38 bp, Artificial Sequence
  Synthetic oligonucleotide
gtccgggagggggatagtgaagggtgtggggaggatga

SEQ ID NO: 150563 - DNA, 37 bp, Artificial Sequence
  Synthetic oligonucleotide
tgagtcaccccccacgttgtttcacctgccgttatga

SEQ ID NO: 150564 - DNA, 38 bp, Artificial Sequence
  Synthetic oligonucleotide
gtgccgctcaccgggggaaggggagggtgggggcctga

SEQ ID NO: 150565 - DNA, 38 bp, Artificial Sequence
  Synthetic oligonucleotide
aatgtcgcacgtcgttcggctccgtaggctctatctga

SEQ ID NO: 150566 - DNA, 37 bp, Artificial Sequence
  Synthetic oligonucleotide
tagtatggcgggtgaacgggagtagggggggtcgtga

SEQ ID NO: 150567 - DNA, 38 bp, Artificial Sequence
  Synthetic oligonucleotide
tggaggcgcagagggggtggcggagggtaaatcggtga

SEQ ID NO: 150568 - DNA, 38 bp, Artificial Sequence
  Synthetic oligonucleotide
tcaccggtcgccgtacagcccccctactccccgtgtga

SEQ ID NO: 150569 - DNA, 38 bp, Artificial Sequence
  Synthetic oligonucleotide
tcactccctccctgtcagcctcgtacttgaacccttga

SEQ ID NO: 150570 - DNA, 36 bp, Artificial Sequence
  Synthetic oligonucleotide
gtcgcctccgcctcatcgtgacactaaatgtccata

SEQ ID NO: 150571 - DNA, 35 bp, Artificial Sequence
  Synthetic oligonucleotide
gggacggtgacggaaatgggaggtgtgtgggtata

SEQ ID NO: 150572 - DNA, 35 bp, Artificial Sequence
  Synthetic oligonucleotide
aacgcaacaccgctggctatcatcatgttcctcta

SEQ ID NO: 150573 - DNA, 36 bp, Artificial Sequence
  Synthetic oligonucleotide
gaccagccaatccactgcggaccatcttgccactta

SEQ ID NO: 150574 - DNA, 35 bp, Artificial Sequence
  Synthetic oligonucleotide
gcacccatccagccgttccattcactcatgcctta

SEQ ID NO: 150575 - DNA, 35 bp, Artificial Sequence
  Synthetic oligonucleotide
ttaacagcgctcccgttctactccattctgtgccc

SEQ ID NO: 150576 - DNA, 35 bp, Artificial Sequence
  Synthetic oligonucleotide
tctcaccatggtcacacctggactcgttctttccc

SEQ ID NO: 150577 - DNA, 35 bp, Artificial Sequence
  Synthetic oligonucleotide
acccgacgacttcatatagttccagcccgtacgcc

SEQ ID NO: 150578 - DNA, 35 bp, Artificial Sequence
  Synthetic oligonucleotide
gtgggtgcgcctataactatttgctcacgttcgcc

SEQ ID NO: 150579 - DNA, 35 bp, Artificial Sequence
  Synthetic oligonucleotide
tgtatgcgctgtacccctgttcgatcccacgggcc

SEQ ID NO: 150580 - DNA, 35 bp, Artificial Sequence
  Synthetic oligonucleotide
tgtgaccaaccgtgcgcccccatgccctgaggtcc

SEQ ID NO: 150581 - DNA, 36 bp, Artificial Sequence
  Synthetic oligonucleotide
tcacgcccctcttgagcttattatacactgaacggc

SEQ ID NO: 150582 - DNA, 35 bp, Artificial Sequence
  Synthetic oligonucleotide
tcaccttccgccgattgcttttgtcgcttacgggc

SEQ ID NO: 150583 - DNA, 35 bp, Artificial Sequence
  Synthetic oligonucleotide
tcaacccgcagggtttcataaacatttgtccctgc

SEQ ID NO: 150584 - DNA, 34 bp, Artificial Sequence
  Synthetic oligonucleotide
acatccgcccagcacttgcctttttcgttcctgc

SEQ ID NO: 150585 - DNA, 35 bp, Artificial Sequence
  Synthetic oligonucleotide
gcctcccgtccaacactcacttcttcgcctcgtgc

SEQ ID NO: 150586 - DNA, 35 bp, Artificial Sequence
  Synthetic oligonucleotide
cagcgacaagaatgttcttcgtgccgtcatccctc

SEQ ID NO: 150587 - DNA, 35 bp, Artificial Sequence
  Synthetic oligonucleotide
gccctccttcctggccctatccaccgcaaccggtc

SEQ ID NO: 150588 - DNA, 35 bp, Artificial Sequence
  Synthetic oligonucleotide
tagttagcgcacaaatgcccctttgtctcttcttc

SEQ ID NO: 150589 - DNA, 35 bp, Artificial Sequence
  Synthetic oligonucleotide
ggtcaccaagtcggtaccgccttcaccactacccg

SEQ ID NO: 150590 - DNA, 35 bp, Artificial Sequence
  Synthetic oligonucleotide
ttgcccgcccgtgctttctatctgtctggaccccg

SEQ ID NO: 150591 - DNA, 35 bp, Artificial Sequence
  Synthetic oligonucleotide
gtacaccacccccgctcagtcccttcaaggcatat

SEQ ID NO: 150592 - DNA, 35 bp, Artificial Sequence
  Synthetic oligonucleotide
tctagccttctccacgcgtgttccgttgtccttat

SEQ ID NO: 150593 - DNA, 35 bp, Artificial Sequence
  Synthetic oligonucleotide
tagacgcctcccgcatccccttagttcgcgactct

SEQ ID NO: 150594 - DNA, 35 bp, Artificial Sequence
  Synthetic oligonucleotide
agcataaaaccggcgggtggtggggaggcggaggt

SEQ ID NO: 150595 - DNA, 35 bp, Artificial Sequence
  Synthetic oligonucleotide
gtggatccggtcggagtctgttcacccgttccctt

SEQ ID NO: 150596 - DNA, 37 bp, Artificial Sequence
  Synthetic oligonucleotide
atgacaaggcacggggtggtggtcacagggggaggaa

SEQ ID NO: 150597 - DNA, 36 bp, Artificial Sequence
  Synthetic oligonucleotide
gttcgcactgctcctgctcgctttgtaccctgctaa

SEQ ID NO: 150598 - DNA, 35 bp, Artificial Sequence
  Synthetic oligonucleotide
ggggagggtgctgggggggaaggcaaacttggaca

SEQ ID NO: 150599 - DNA, 36 bp, Artificial Sequence
  Synthetic oligonucleotide
tgagacctccgatacccgcccgttgtgagcccgcca

SEQ ID NO: 150600 - DNA, 36 bp, Artificial Sequence
  Synthetic oligonucleotide
tcactacccaccctctgccagacggccttcgattca

SEQ ID NO: 150601 - DNA, 36 bp, Artificial Sequence
  Synthetic oligonucleotide
acgcgcaatagtgctgcttataccgccaccccttca

SEQ ID NO: 150602 - DNA, 37 bp, Artificial Sequence
  Synthetic oligonucleotide
gagacacggtcctgctttttcgttttgccccttgaga

SEQ ID NO: 150603 - DNA, 35 bp, Artificial Sequence
  Synthetic oligonucleotide
atgtcccgccacctggagaatcccccgtaatccga

SEQ ID NO: 150604 - DNA, 35 bp, Artificial Sequence
  Synthetic oligonucleotide
tagccgcgtaggaaaggggaaaggatggaagggga

SEQ ID NO: 150605 - DNA, 38 bp, Artificial Sequence
  Synthetic oligonucleotide
tcgcatcctcccccgctcctataggtcgttctttatga

SEQ ID NO: 150606 - DNA, 38 bp, Artificial Sequence
  Synthetic oligonucleotide
gacacagacccctgcacgccgccgcaccgtttccctga

SEQ ID NO: 150607 - DNA, 38 bp, Artificial Sequence
  Synthetic oligonucleotide
aacccacctcgaagtgtcatactcatacctctccgtga

SEQ ID NO: 150608 - DNA, 35 bp, Artificial Sequence
  Synthetic oligonucleotide
ggaatgagcagggggggggaggttccattgggtga

SEQ ID NO: 150609 - DNA, 25 bp, Artificial Sequence
  Synthetic oligonucleotide
gatcgcctcttgccacccctattga

SEQ ID NO: 150610 - DNA, 35 bp, Artificial Sequence
  Synthetic oligonucleotide
tcacgacgctctgtgcccttcctttgcgtacccta

SEQ ID NO: 150611 - DNA, 36 bp, Artificial Sequence
  Synthetic oligonucleotide
acaccggtcattgatgtttcgtcccgttccattcta

SEQ ID NO: 150612 - DNA, 35 bp, Artificial Sequence
  Synthetic oligonucleotide
tcacgttcgctctcaggtcgcccgcatttttctta

SEQ ID NO: 150613 - DNA, 35 bp, Artificial Sequence
  Synthetic oligonucleotide
tgttgcatgcaacgtgacacccgtaccgccccaac

SEQ ID NO: 150614 - DNA, 35 bp, Artificial Sequence
  Synthetic oligonucleotide
tcccaccccgtctctaatgctcgtcggaatacacc

SEQ ID NO: 150615 - DNA, 35 bp, Artificial Sequence
  Synthetic oligonucleotide
gtctccgcagcctatgtggcacgcccatacccccc

SEQ ID NO: 150616 - DNA, 34 bp, Artificial Sequence
  Synthetic oligonucleotide
gtcaactgcacgatgaaaattgagggcattctcc

SEQ ID NO: 150617 - DNA, 35 bp, Artificial Sequence
  Synthetic oligonucleotide
ttccccatcgctcccgggtcacaggcatcttaagc

SEQ ID NO: 150618 - DNA, 35 bp, Artificial Sequence
  Synthetic oligonucleotide
ttggctccctccccccttgtttagcccaattttgc

SEQ ID NO: 150619 - DNA, 35 bp, Artificial Sequence
  Synthetic oligonucleotide
agtgcgctcctgccctgccagtttctgtacccctc

SEQ ID NO: 150620 - DNA, 35 bp, Artificial Sequence
  Synthetic oligonucleotide
ccccacgcggtatttccatgccatccccccccgcg

SEQ ID NO: 150621 - DNA, 35 bp, Artificial Sequence
  Synthetic oligonucleotide
gggtaggtatggggaagggattagggtgacggagg

SEQ ID NO: 150622 - DNA, 36 bp, Artificial Sequence
  Synthetic oligonucleotide
ttccaccaccacctgcagtgtactgccttgttaggg

SEQ ID NO: 150623 - DNA, 35 bp, Artificial Sequence
  Synthetic oligonucleotide
tacacctcatgagcccactacagtctcctttcact

SEQ ID NO: 150624 - DNA, 35 bp, Artificial Sequence
  Synthetic oligonucleotide
gcgtccaaccctgccgccttgatcggaccccacct

SEQ ID NO: 150625 - DNA, 35 bp, Artificial Sequence
  Synthetic oligonucleotide
tccggtcacccgccctaccgatggcagtcccgcct

SEQ ID NO: 150626 - DNA, 35 bp, Artificial Sequence
  Synthetic oligonucleotide
tgtgcatccctgctagcccctaccctcaccccgct

SEQ ID NO: 150627 - DNA, 35 bp, Artificial Sequence
  Synthetic oligonucleotide
agcatagctccccgctgcctagtacagcctcctct

SEQ ID NO: 150628 - DNA, 35 bp, Artificial Sequence
  Synthetic oligonucleotide
tcgagcacctctatatcattcgaacacggccttct

SEQ ID NO: 150629 - DNA, 36 bp, Artificial Sequence
  Synthetic oligonucleotide
acaccgccttatggtttcgtcctcgcttccctccgt

SEQ ID NO: 150630 - DNA, 35 bp, Artificial Sequence
  Synthetic oligonucleotide
ggtggaatcgaggagaggatagggatgggagatgt

SEQ ID NO: 150631 - DNA, 35 bp, Artificial Sequence
  Synthetic oligonucleotide
gtcggataactgccacaccacacctactgtcctgt

SEQ ID NO: 150632 - DNA, 35 bp, Artificial Sequence
  Synthetic oligonucleotide
tcgctcacccccgctccacgacacggtatacaatt

SEQ ID NO: 150633 - DNA, 34 bp, Artificial Sequence
  Synthetic oligonucleotide
gatgccccccccccgctgtaccaccccgataatt

SEQ ID NO: 150634 - DNA, 35 bp, Artificial Sequence
  Synthetic oligonucleotide
gtcacgacgctcgattccgcgttctctccgccatt

SEQ ID NO: 150635 - DNA, 35 bp, Artificial Sequence
  Synthetic oligonucleotide
atgtgctccccgccacctcagccagcattgccctt

SEQ ID NO: 150636 - DNA, 35 bp, Artificial Sequence
  Synthetic oligonucleotide
gccgtgccccagttcctttagtcaagctcccggtt

SEQ ID NO: 150637 - DNA, 35 bp, Artificial Sequence
  Synthetic oligonucleotide
tcccctgcccactacgtagttacgcaatacgtttt

SEQ ID NO: 150638 - DNA, 35 bp, Artificial Sequence
  Synthetic oligonucleotide
tgtactccccgccttggttctggtttggtcttttt

SEQ ID NO: 150639 - DNA, 35 bp, Artificial Sequence
  Synthetic oligonucleotide
actatcccgccttctccgtccagtcatccgtgaaa

SEQ ID NO: 150640 - DNA, 36 bp, Artificial Sequence
  Synthetic oligonucleotide
gcacatcaccgaccacgtgcttctaacccgtaccaa

SEQ ID NO: 150641 - DNA, 36 bp, Artificial Sequence
  Synthetic oligonucleotide
aatgccccgcctccaagccgcccgcgcctcattgaa

SEQ ID NO: 150642 - DNA, 35 bp, Artificial Sequence
  Synthetic oligonucleotide
acactcaccgggcatttggctcacctcctcgccca

SEQ ID NO: 150643 - DNA, 35 bp, Artificial Sequence
  Synthetic oligonucleotide
gatcccgcactcccgcttagcgtacttgctgccca

SEQ ID NO: 150644 - DNA, 36 bp, Artificial Sequence
  Synthetic oligonucleotide
tgcccgtgtccgctgctggcccgcttcactatccca

SEQ ID NO: 150645 - DNA, 36 bp, Artificial Sequence
  Synthetic oligonucleotide
ttgacaaggggaggagtggggtaaagtatgatagca

SEQ ID NO: 150646 - DNA, 36 bp, Artificial Sequence
  Synthetic oligonucleotide
tgctgcccccctagccgtacggcccgaacctccgca

SEQ ID NO: 150647 - DNA, 36 bp, Artificial Sequence
  Synthetic oligonucleotide
gtgccgccctcaccgtcctttcacctgcatgcggca

SEQ ID NO: 150648 - DNA, 35 bp, Artificial Sequence
  Synthetic oligonucleotide
gttcgccttccatgtcccaccacgttccccgtgca

SEQ ID NO: 150649 - DNA, 35 bp, Artificial Sequence
  Synthetic oligonucleotide
gcaccccttctgatctcacctgtccgctaccatca

SEQ ID NO: 150650 - DNA, 37 bp, Artificial Sequence
  Synthetic oligonucleotide
acaggcgagggcggagttggtagggcgtggggtcaga

SEQ ID NO: 150651 - DNA, 37 bp, Artificial Sequence
  Synthetic oligonucleotide
tcactcaccgttttgcctttagtatcttccccctaga

SEQ ID NO: 150652 - DNA, 37 bp, Artificial Sequence
  Synthetic oligonucleotide
gcccacccagtggcttctgactccctcatccgctaga

SEQ ID NO: 150653 - DNA, 37 bp, Artificial Sequence
  Synthetic oligonucleotide
tagtgggcaagggggagacggggaagtgcgaggacga

SEQ ID NO: 150654 - DNA, 37 bp, Artificial Sequence
  Synthetic oligonucleotide
tgtgcaccactctgcccccgaactcgttacgccgcga

SEQ ID NO: 150655 - DNA, 37 bp, Artificial Sequence
  Synthetic oligonucleotide
aacgccgaaagggcaagtaggggggggccggaggcga

SEQ ID NO: 150656 - DNA, 37 bp, Artificial Sequence
  Synthetic oligonucleotide
acagtctgccactggcgtattcatgttccctcttcga

SEQ ID NO: 150657 - DNA, 37 bp, Artificial Sequence
  Synthetic oligonucleotide
atgccaccgcagctcccatctacgtctcacccacgga

SEQ ID NO: 150658 - DNA, 37 bp, Artificial Sequence
  Synthetic oligonucleotide
gccgccacgcattcacctgccctttctgtaacccgga

SEQ ID NO: 150659 - DNA, 37 bp, Artificial Sequence
  Synthetic oligonucleotide
agccacgacgcccgctgcctctgtctgtttttcctga

SEQ ID NO: 150660 - DNA, 37 bp, Artificial Sequence
  Synthetic oligonucleotide
tttaccccgcgccccctgcccctttaacttgatgtga

SEQ ID NO: 150661 - DNA, 38 bp, Artificial Sequence
  Synthetic oligonucleotide
gggaggggctggttgggcgcaaagtagggggggtgtga

SEQ ID NO: 150662 - DNA, 37 bp, Artificial Sequence
  Synthetic oligonucleotide
gcaccatcgtgttatttgcccttccatattctcttga

SEQ ID NO: 150663 - DNA, 36 bp, Artificial Sequence
  Synthetic oligonucleotide
acttcccgcccactcaccaagggaccctacttccta

SEQ ID NO: 150664 - DNA, 36 bp, Artificial Sequence
  Synthetic oligonucleotide
gccacaacgcctcacatctccatcccatgtggctta

SEQ ID NO: 150665 - DNA, 35 bp, Artificial Sequence
  Synthetic oligonucleotide
tgatagtggggggtaggacggtggagtgctggtta

SEQ ID NO: 150666 - DNA, 35 bp, Artificial Sequence
  Synthetic oligonucleotide
tatgccaccggccactgagaagcccatcaccttta

SEQ ID NO: 150667 - DNA, 36 bp, Artificial Sequence
  Synthetic oligonucleotide
tcacactctccgctttgtttcatttttcaggcttta

SEQ ID NO: 150668 - DNA, 35 bp, Artificial Sequence
  Synthetic oligonucleotide
gtcgcacactattttcataacgccccgctccgcac

SEQ ID NO: 150669 - DNA, 35 bp, Artificial Sequence
  Synthetic oligonucleotide
ttgtcaccgctcttgctactaacgctttattctac

SEQ ID NO: 150670 - DNA, 35 bp, Artificial Sequence
  Synthetic oligonucleotide
attgaagggggctgggaggacggagggcactttac

SEQ ID NO: 150671 - DNA, 35 bp, Artificial Sequence
  Synthetic oligonucleotide
cggtcacccacccgcttcgcctgcgtgatactacc

SEQ ID NO: 150672 - DNA, 35 bp, Artificial Sequence
  Synthetic oligonucleotide
atcgcggcttgcagttcggtaaacgtcgccgcccc

SEQ ID NO: 150673 - DNA, 35 bp, Artificial Sequence
  Synthetic oligonucleotide
agccacgcggctcctctcgcgctcgccttcgcccc

SEQ ID NO: 150674 - DNA, 35 bp, Artificial Sequence
  Synthetic oligonucleotide
gactcatgcttacatgccgcccgatctccatgccc

SEQ ID NO: 150675 - DNA, 35 bp, Artificial Sequence
  Synthetic oligonucleotide
ccccacctgtgccacgttgttctgctcctgtcgcc

SEQ ID NO: 150676 - DNA, 35 bp, Artificial Sequence
  Synthetic oligonucleotide
ggtggtgaccgcccggcatcctttgtcccccctcc

SEQ ID NO: 150677 - DNA, 35 bp, Artificial Sequence
  Synthetic oligonucleotide
tgatttgcccaggtttcgattccttctggccctcc

SEQ ID NO: 150678 - DNA, 35 bp, Artificial Sequence
  Synthetic oligonucleotide
tgagctcgactttccgtactcatgtctccccgtcc

SEQ ID NO: 150679 - DNA, 35 bp, Artificial Sequence
  Synthetic oligonucleotide
gttaggccctggtgatctgcacgctttactattcc

SEQ ID NO: 150680 - DNA, 35 bp, Artificial Sequence
  Synthetic oligonucleotide
tcgcccccgtactccgtatcgcatccgccacaagc

SEQ ID NO: 150681 - DNA, 35 bp, Artificial Sequence
  Synthetic oligonucleotide
ttgccccaaactgagcattcgtacaccttcgcctc

SEQ ID NO: 150682 - DNA, 35 bp, Artificial Sequence
  Synthetic oligonucleotide
gtgcctgccatcgctttattcctacaagtagtctc

SEQ ID NO: 150683 - DNA, 35 bp, Artificial Sequence
  Synthetic oligonucleotide
tgaatgctggcgtgggggaaggaagaataggggcg

SEQ ID NO: 150684 - DNA, 35 bp, Artificial Sequence
  Synthetic oligonucleotide
acactccccgcactctgaacacatggtaatgctcg

SEQ ID NO: 150685 - DNA, 35 bp, Artificial Sequence
  Synthetic oligonucleotide
taagggagtgggaggggtacagacaggggagttgg

SEQ ID NO: 150686 - DNA, 35 bp, Artificial Sequence
  Synthetic oligonucleotide
aacaccctcggcctagactttacatactccccttg

SEQ ID NO: 150687 - DNA, 35 bp, Artificial Sequence
  Synthetic oligonucleotide
atcgcgccctgggcctcatacctgctcctttccat

SEQ ID NO: 150688 - DNA, 35 bp, Artificial Sequence
  Synthetic oligonucleotide
acccctcctccgttggtccctaggtcctgctttat

SEQ ID NO: 150689 - DNA, 35 bp, Artificial Sequence
  Synthetic oligonucleotide
aacatccgccgttcccagtaatacgacaccgcact

SEQ ID NO: 150690 - DNA, 35 bp, Artificial Sequence
  Synthetic oligonucleotide
gttgcgctaaaccggctatgctccctcttggtact

SEQ ID NO: 150691 - DNA, 35 bp, Artificial Sequence
  Synthetic oligonucleotide
gaaccccgcggtacaagggttgccctcctgcccct

SEQ ID NO: 150692 - DNA, 35 bp, Artificial Sequence
  Synthetic oligonucleotide
tttgtatccccctagactgttttgacacgctccct

SEQ ID NO: 150693 - DNA, 35 bp, Artificial Sequence
  Synthetic oligonucleotide
tctatcatgtccgctcactgtcctttcttcacggt

SEQ ID NO: 150694 - DNA, 35 bp, Artificial Sequence
  Synthetic oligonucleotide
actacgttccacgccggacccgatccacctcatgt

SEQ ID NO: 150695 - DNA, 35 bp, Artificial Sequence
  Synthetic oligonucleotide
atcaacgcagcttgctattctatccttccgtggtt

SEQ ID NO: 150696 - DNA, 36 bp, Artificial Sequence
  Synthetic oligonucleotide
attgcggtccgggctgcttaatccgttccctcttaa

SEQ ID NO: 150697 - DNA, 36 bp, Artificial Sequence
  Synthetic oligonucleotide
tagtgtgacggggggggttggaagaaaggtaataca

SEQ ID NO: 150698 - DNA, 36 bp, Artificial Sequence
  Synthetic oligonucleotide
gcgccctgcccgtttctggtacctatcgcgcttaca

SEQ ID NO: 150699 - DNA, 36 bp, Artificial Sequence
  Synthetic oligonucleotide
gcaacccccggtacgtgatcaacccgtgtcacccca

SEQ ID NO: 150700 - DNA, 36 bp, Artificial Sequence
  Synthetic oligonucleotide
tcgctaaccatcaccgtacaccgcccgccgtcccca

SEQ ID NO: 150701 - DNA, 36 bp, Artificial Sequence
  Synthetic oligonucleotide
gtccgcggtccttccgctcgagtatgcctccctcca

SEQ ID NO: 150702 - DNA, 35 bp, Artificial Sequence
  Synthetic oligonucleotide
catgaccccgacttctttttttgcgacctgctcca

SEQ ID NO: 150703 - DNA, 35 bp, Artificial Sequence
  Synthetic oligonucleotide
gaccatccctctctgcctagtgttagcaatgcgca

SEQ ID NO: 150704 - DNA, 37 bp, Artificial Sequence
  Synthetic oligonucleotide
acccctcaccgcaatattgctcctgcctcccgcaaga

SEQ ID NO: 150705 - DNA, 36 bp, Artificial Sequence
  Synthetic oligonucleotide
gagcagaggtggggagtaatgatgggcgggcgaaga

SEQ ID NO: 150706 - DNA, 37 bp, Artificial Sequence
  Synthetic oligonucleotide
aagtggaaaggggggagatctagggcgggtaaagaga

SEQ ID NO: 150707 - DNA, 37 bp, Artificial Sequence
  Synthetic oligonucleotide
ttatcgcagggggacaagggaagggcgggaacggaga

SEQ ID NO: 150708 - DNA, 35 bp, Artificial Sequence
  Synthetic oligonucleotide
tagggaggggtaggcggggtggccgaacatggaga

SEQ ID NO: 150709 - DNA, 37 bp, Artificial Sequence
  Synthetic oligonucleotide
acagaccgtcagggagcgtagggaagggagggctaga

SEQ ID NO: 150710 - DNA, 35 bp, Artificial Sequence
  Synthetic oligonucleotide
gacgtctcccccgctttgcctacgcttccgaacga

SEQ ID NO: 150711 - DNA, 37 bp, Artificial Sequence
  Synthetic oligonucleotide
ggatcagtcgccgcccatgcaacgtcactttctacga

SEQ ID NO: 150712 - DNA, 36 bp, Artificial Sequence
  Synthetic oligonucleotide
gttcgcctccctgattctcatccatgttttctccga

SEQ ID NO: 150713 - DNA, 37 bp, Artificial Sequence
  Synthetic oligonucleotide
gccacttgttatgtctcgtccttcccgttctcctcga

SEQ ID NO: 150714 - DNA, 37 bp, Artificial Sequence
  Synthetic oligonucleotide
gtcacccccggatcagcgcacactcactaccgctcga

SEQ ID NO: 150715 - DNA, 37 bp, Artificial Sequence
  Synthetic oligonucleotide
acggtgaggggggggcggaccggagacgggcgtagga

SEQ ID NO: 150716 - DNA, 37 bp, Artificial Sequence
  Synthetic oligonucleotide
acacaccggtaatgtctctttgccccccactttagga

SEQ ID NO: 150717 - DNA, 37 bp, Artificial Sequence
  Synthetic oligonucleotide
acgtcaccacaggacccccactcgcctttcccacgga

SEQ ID NO: 150718 - DNA, 35 bp, Artificial Sequence
  Synthetic oligonucleotide
gcctgccgctacgtattgttctctcttctgccgga

SEQ ID NO: 150719 - DNA, 38 bp, Artificial Sequence
  Synthetic oligonucleotide
aacaacgatcctgccgaccttaccgactcctttactga

SEQ ID NO: 150720 - DNA, 37 bp, Artificial Sequence
  Synthetic oligonucleotide
acgccttgctgcctgcttttatcccctgctatcctga

SEQ ID NO: 150721 - DNA, 37 bp, Artificial Sequence
  Synthetic oligonucleotide
accccgccgcaacggtaaccgtccccatcccgagtga

SEQ ID NO: 150722 - DNA, 38 bp, Artificial Sequence
  Synthetic oligonucleotide
gtctcactgccgatcttccctttctcctgtcatcgtga

SEQ ID NO: 150723 - DNA, 38 bp, Artificial Sequence
  Synthetic oligonucleotide
attcgccccgtgcgttgagtcccccttcgtttccttga

SEQ ID NO: 150724 - DNA, 38 bp, Artificial Sequence
  Synthetic oligonucleotide
gtgatgactctgcgcatttgatcctgccccattgttga

SEQ ID NO: 150725 - DNA, 38 bp, Artificial Sequence
  Synthetic oligonucleotide
tgaggcgggctctacctgcattacgtaccaccctttga

SEQ ID NO: 150726 - DNA, 35 bp, Artificial Sequence
  Synthetic oligonucleotide
agtcacatggggggacggagggggaggtgtaacta

SEQ ID NO: 150727 - DNA, 36 bp, Artificial Sequence
  Synthetic oligonucleotide
tccacctgcgagttcccgtaaggctcccgctcccta

SEQ ID NO: 150728 - DNA, 35 bp, Artificial Sequence
  Synthetic oligonucleotide
tacacctccttgcctattagccatatcctgaagta

SEQ ID NO: 150729 - DNA, 35 bp, Artificial Sequence
  Synthetic oligonucleotide
gcgccctgcattggtctagctcatcctctcacgta

SEQ ID NO: 150730 - DNA, 36 bp, Artificial Sequence
  Synthetic oligonucleotide
ggaccatgcacccggtcattgcctccctgttcctta

SEQ ID NO: 150731 - DNA, 36 bp, Artificial Sequence
  Synthetic oligonucleotide
tccgccccactgcacgtttctcctccctgcgcgtta

SEQ ID NO: 150732 - DNA, 35 bp, Artificial Sequence
  Synthetic oligonucleotide
gtcgcaatccccctcagaatgaacccggcccacac

SEQ ID NO: 150733 - DNA, 35 bp, Artificial Sequence
  Synthetic oligonucleotide
tcatccgtcagcacttcgcatccacctcgattgac

SEQ ID NO: 150734 - DNA, 35 bp, Artificial Sequence
  Synthetic oligonucleotide
tatgtggtcgccagtctcctcctattggtcccacc

SEQ ID NO: 150735 - DNA, 35 bp, Artificial Sequence
  Synthetic oligonucleotide
gcatccaggaccccttccgccacacaggtctgacc

SEQ ID NO: 150736 - DNA, 35 bp, Artificial Sequence
  Synthetic oligonucleotide
gccgaccgaccgccccctccgcccagtatgctacc

SEQ ID NO: 150737 - DNA, 35 bp, Artificial Sequence
  Synthetic oligonucleotide
gctctacccagcgccggtctcactgacctttcgcc

SEQ ID NO: 150738 - DNA, 35 bp, Artificial Sequence
  Synthetic oligonucleotide
gtccgccctgcacttgctttatatcattgttctcc

SEQ ID NO: 150739 - DNA, 35 bp, Artificial Sequence
  Synthetic oligonucleotide
tgacttatgccctacgcagcctctagcttgattcc

SEQ ID NO: 150740 - DNA, 35 bp, Artificial Sequence
  Synthetic oligonucleotide
tgccgacgcaggcacctccaagctggcgctcttcc

SEQ ID NO: 150741 - DNA, 35 bp, Artificial Sequence
  Synthetic oligonucleotide
agatacgctcgttcccccgcgtcaggctcacccgc

SEQ ID NO: 150742 - DNA, 35 bp, Artificial Sequence
  Synthetic oligonucleotide
gccatcccccgcttgttcctgtgccctgtttactc

SEQ ID NO: 150743 - DNA, 35 bp, Artificial Sequence
  Synthetic oligonucleotide
gtgtgccccttgtgcaggctctttggttgttcctc

SEQ ID NO: 150744 - DNA, 35 bp, Artificial Sequence
  Synthetic oligonucleotide
tgggcccttgttcgttacacccgccaccctgtctc

SEQ ID NO: 150745 - DNA, 35 bp, Artificial Sequence
  Synthetic oligonucleotide
tcctgccatagcgcagacccgtcgatttccgcttc

SEQ ID NO: 150746 - DNA, 35 bp, Artificial Sequence
  Synthetic oligonucleotide
gaccgcattccctctgtctctccaaacacgccacg

SEQ ID NO: 150747 - DNA, 35 bp, Artificial Sequence
  Synthetic oligonucleotide
gtcaccatcatgtaggacctgtgggccatcttacg

SEQ ID NO: 150748 - DNA, 35 bp, Artificial Sequence
  Synthetic oligonucleotide
accactcgcttgcgtacaatctgatcctcctgtcg

SEQ ID NO: 150749 - DNA, 35 bp, Artificial Sequence
  Synthetic oligonucleotide
gttgtgcctggcaggttcggggggacgggagtggg

SEQ ID NO: 150750 - DNA, 35 bp, Artificial Sequence
  Synthetic oligonucleotide
gcatgaggcaatggtgggtggggctgggattgaat

SEQ ID NO: 150751 - DNA, 34 bp, Artificial Sequence
  Synthetic oligonucleotide
gccactcctggccgtgtatccgccggctcatact

SEQ ID NO: 150752 - DNA, 35 bp, Artificial Sequence
  Synthetic oligonucleotide
acctcgtaccggacactgtttacaatgctttctct

SEQ ID NO: 150753 - DNA, 35 bp, Artificial Sequence
  Synthetic oligonucleotide
gtctatcgacgcgttattatctgctgctgccttct

SEQ ID NO: 150754 - DNA, 35 bp, Artificial Sequence
  Synthetic oligonucleotide
tgatcgttaggtcatttgcccgctcctttctttgt

SEQ ID NO: 150755 - DNA, 35 bp, Artificial Sequence
  Synthetic oligonucleotide
gtggcggacctctccgtttcatgcaagcacccctt

SEQ ID NO: 150756 - DNA, 35 bp, Artificial Sequence
  Synthetic oligonucleotide
tctctacgccccgccccccgactaggtctccgaaa

SEQ ID NO: 150757 - DNA, 36 bp, Artificial Sequence
  Synthetic oligonucleotide
gtctgcccctctgtagtccttctgccttggctaaca

SEQ ID NO: 150758 - DNA, 36 bp, Artificial Sequence
  Synthetic oligonucleotide
agtccactcctcgtgccgtacgtaccggattcccca

SEQ ID NO: 150759 - DNA, 35 bp, Artificial Sequence
  Synthetic oligonucleotide
gccctcaccatcaacacttctcgcgtgctgttcca

SEQ ID NO: 150760 - DNA, 36 bp, Artificial Sequence
  Synthetic oligonucleotide
ttgaaccgcgtcttgctgcccccatcctcccattca

SEQ ID NO: 150761 - DNA, 37 bp, Artificial Sequence
  Synthetic oligonucleotide
gctatcggcgccttatctgtcccatcctcactttaga

SEQ ID NO: 150762 - DNA, 37 bp, Artificial Sequence
  Synthetic oligonucleotide
gagcccgccacctgtatttccctgtctccgtttacga

SEQ ID NO: 150763 - DNA, 37 bp, Artificial Sequence
  Synthetic oligonucleotide
acacgtggaaggaaataggggggaggtacattgcgga

SEQ ID NO: 150764 - DNA, 37 bp, Artificial Sequence
  Synthetic oligonucleotide
gggggaaaaatggcggttaagggagggtggtgtcgga

SEQ ID NO: 150765 - DNA, 37 bp, Artificial Sequence
  Synthetic oligonucleotide
gtgggtgggagggttgggtggataacgaatgatggga

SEQ ID NO: 150766 - DNA, 35 bp, Artificial Sequence
  Synthetic oligonucleotide
gaacgccctgcctccctctccgtgttgttccatga

SEQ ID NO: 150767 - DNA, 36 bp, Artificial Sequence
  Synthetic oligonucleotide
gcgatggacgccacatttgcttttactaccctctga

SEQ ID NO: 150768 - DNA, 38 bp, Artificial Sequence
  Synthetic oligonucleotide
ggggtaagggcaagggaaaaggacggggatgcgcgtga

SEQ ID NO: 150769 - DNA, 37 bp, Artificial Sequence
  Synthetic oligonucleotide
gatgaggggtaaaggtagtgcggggtgagtgcggtga

SEQ ID NO: 150770 - DNA, 37 bp, Artificial Sequence
  Synthetic oligonucleotide
gttggccgtcactttacctcgctcgtcccgcctgtga

SEQ ID NO: 150771 - DNA, 38 bp, Artificial Sequence
  Synthetic oligonucleotide
ggagacccgcccccgtttcgtgaagctacaccccttga

SEQ ID NO: 150772 - DNA, 38 bp, Artificial Sequence
  Synthetic oligonucleotide
acccagacctcctgcagcctttttctacctgtccttga

SEQ ID NO: 150773 - DNA, 37 bp, Artificial Sequence
  Synthetic oligonucleotide
gcgctgccacctgtcctcccccggtcccctagcttga

SEQ ID NO: 150774 - DNA, 36 bp, Artificial Sequence
  Synthetic oligonucleotide
atgtcacatgttctctgcgatattgccgggccccta

SEQ ID NO: 150775 - DNA, 35 bp, Artificial Sequence
  Synthetic oligonucleotide
gcacactcagggtctgtccgcctccagccttccta

SEQ ID NO: 150776 - DNA, 36 bp, Artificial Sequence
  Synthetic oligonucleotide
taccccgccgccccttccagccgcgctctccactta

SEQ ID NO: 150777 - DNA, 35 bp, Artificial Sequence
  Synthetic oligonucleotide
tcgaccgtgcacaactgctcctttcaatccgctta

SEQ ID NO: 150778 - DNA, 36 bp, Artificial Sequence
  Synthetic oligonucleotide
tgtggtcgcctcccactttaatcgtgtcggttctta

SEQ ID NO: 150779 - DNA, 35 bp, Artificial Sequence
  Synthetic oligonucleotide
atgccctcctccagcctcgcctctcgaagttccac

SEQ ID NO: 150780 - DNA, 35 bp, Artificial Sequence
  Synthetic oligonucleotide
tgtccactaactgcattcctctgtagaccctgtac

SEQ ID NO: 150781 - DNA, 35 bp, Artificial Sequence
  Synthetic oligonucleotide
gcgtatcgatcgtcccgcctctctgtgccgttacc

SEQ ID NO: 150782 - DNA, 35 bp, Artificial Sequence
  Synthetic oligonucleotide
gtgaaccctcctgagccgttaaaatccgagtcccc

SEQ ID NO: 150783 - DNA, 36 bp, Artificial Sequence
  Synthetic oligonucleotide
aaccgccccgtccttggtactcttgtcatctctgcc

SEQ ID NO: 150784 - DNA, 35 bp, Artificial Sequence
  Synthetic oligonucleotide
gtgggagggaagggcgggcatcctagtggcttgcc

SEQ ID NO: 150785 - DNA, 35 bp, Artificial Sequence
  Synthetic oligonucleotide
gaccgtcgtcccttgctcccatttatgcctgttcc

SEQ ID NO: 150786 - DNA, 35 bp, Artificial Sequence
  Synthetic oligonucleotide
attgcagatgaaggatcgccccctgtcccgttcgc

SEQ ID NO: 150787 - DNA, 35 bp, Artificial Sequence
  Synthetic oligonucleotide
tcctacgccgcagtgtccttcaccctggcctactc

SEQ ID NO: 150788 - DNA, 35 bp, Artificial Sequence
  Synthetic oligonucleotide
aattgcccgatcagttgcctccagctcggcccttc

SEQ ID NO: 150789 - DNA, 35 bp, Artificial Sequence
  Synthetic oligonucleotide
tatgcgtggttggaagggcgtgcggggtaggaaag

SEQ ID NO: 150790 - DNA, 35 bp, Artificial Sequence
  Synthetic oligonucleotide
tcagtgcccctgccagttttcacaccctcacacag

SEQ ID NO: 150791 - DNA, 35 bp, Artificial Sequence
  Synthetic oligonucleotide
tactaaacgcctcattgtcatctcttgttgccccg

SEQ ID NO: 150792 - DNA, 35 bp, Artificial Sequence
  Synthetic oligonucleotide
acccccactccatgcctccgcgcttccctcatgcg

SEQ ID NO: 150793 - DNA, 35 bp, Artificial Sequence
  Synthetic oligonucleotide
gtgggtggggtggagctagggacgggtcactacgg

SEQ ID NO: 150794 - DNA, 35 bp, Artificial Sequence
  Synthetic oligonucleotide
tgtcacgttgccatccttcactcgcccttttggtg

SEQ ID NO: 150795 - DNA, 35 bp, Artificial Sequence
  Synthetic oligonucleotide
gttgtgctcctgcctgtttatttccctacgttaat

SEQ ID NO: 150796 - DNA, 35 bp, Artificial Sequence
  Synthetic oligonucleotide
gtgtaaccggctgaaacgccattatcgccaccact

SEQ ID NO: 150797 - DNA, 35 bp, Artificial Sequence
  Synthetic oligonucleotide
tccacctagcaaccaacggcacaccgccctgcact

SEQ ID NO: 150798 - DNA, 35 bp, Artificial Sequence
  Synthetic oligonucleotide
gacaactcaccatctggacttcaaactctccccct

SEQ ID NO: 150799 - DNA, 35 bp, Artificial Sequence
  Synthetic oligonucleotide
tacgactgcgaagtctttgccgtctgacctcccct

SEQ ID NO: 150800 - DNA, 35 bp, Artificial Sequence
  Synthetic oligonucleotide
tcgccccccaacatctgtactttccttatgaatct

SEQ ID NO: 150801 - DNA, 35 bp, Artificial Sequence
  Synthetic oligonucleotide
tcagcttccagcgtgcttccgtcctgcaattatct

SEQ ID NO: 150802 - DNA, 35 bp, Artificial Sequence
  Synthetic oligonucleotide
gtcgaggcgcagttccccgcatttatggccgctct

SEQ ID NO: 150803 - DNA, 35 bp, Artificial Sequence
  Synthetic oligonucleotide
tgtaccactccccgatcgtgtgctaaccgtgctct

SEQ ID NO: 150804 - DNA, 35 bp, Artificial Sequence
  Synthetic oligonucleotide
accatccttcaaccgcttccattgtcctcgggtct

SEQ ID NO: 150805 - DNA, 35 bp, Artificial Sequence
  Synthetic oligonucleotide
tcaatcgcctgcctctttttgccgtaaactacctt

SEQ ID NO: 150806 - DNA, 35 bp, Artificial Sequence
  Synthetic oligonucleotide
atgccaagcacctcccatgctgtccacttgtcctt

SEQ ID NO: 150807 - DNA, 35 bp, Artificial Sequence
  Synthetic oligonucleotide
accggacgagggggggaggataggacctgaagctt

SEQ ID NO: 150808 - DNA, 35 bp, Artificial Sequence
  Synthetic oligonucleotide
gtatcattgcccttgcccgccccgccacttatgtt

SEQ ID NO: 150809 - DNA, 35 bp, Artificial Sequence
  Synthetic oligonucleotide
ggtgagccgccgatagcgaccctgccccattcttt

SEQ ID NO: 150810 - DNA, 36 bp, Artificial Sequence
  Synthetic oligonucleotide
tcctgacgccatttgaatagatcccctccctccaaa

SEQ ID NO: 150811 - DNA, 36 bp, Artificial Sequence
  Synthetic oligonucleotide
tgttgccctattgtccgcccccgttttcgccgccaa

SEQ ID NO: 150812 - DNA, 36 bp, Artificial Sequence
  Synthetic oligonucleotide
gtgggggggaggatagtaagcgatttgggataggaa

SEQ ID NO: 150813 - DNA, 36 bp, Artificial Sequence
  Synthetic oligonucleotide
gacggtgacggcacgccctttttacctctcgtacca

SEQ ID NO: 150814 - DNA, 33 bp, Artificial Sequence
  Synthetic oligonucleotide
acctactcgctcctgcgttcgatacccacccca

SEQ ID NO: 150815 - DNA, 36 bp, Artificial Sequence
  Synthetic oligonucleotide
tacgacccgccacccgttttgcctagtgctcgccca

SEQ ID NO: 150816 - DNA, 35 bp, Artificial Sequence
  Synthetic oligonucleotide
tcttgccatcccttgcataaagcctgcatcctcca

SEQ ID NO: 150817 - DNA, 36 bp, Artificial Sequence
  Synthetic oligonucleotide
gtccttcccaggctcccgcatgttcctgcccttcca

SEQ ID NO: 150818 - DNA, 35 bp, Artificial Sequence
  Synthetic oligonucleotide
acaagccgctcttctgccagccatgatcacgctca

SEQ ID NO: 150819 - DNA, 35 bp, Artificial Sequence
  Synthetic oligonucleotide
tgcatagaccgcgtagcccccaccgctcctgttca

SEQ ID NO: 150820 - DNA, 36 bp, Artificial Sequence
  Synthetic oligonucleotide
tgtggccctaccccatggtcctcgcgcctcctttca

SEQ ID NO: 150821 - DNA, 35 bp, Artificial Sequence
  Synthetic oligonucleotide
atgtgcgtcaaggtccgggtctctcttccttttca

SEQ ID NO: 150822 - DNA, 37 bp, Artificial Sequence
  Synthetic oligonucleotide
acacccgcccgtattctgtccgttccgcaccagacga

SEQ ID NO: 150823 - DNA, 37 bp, Artificial Sequence
  Synthetic oligonucleotide
acttagcctcctgcactgccccgttgtctacttacga

SEQ ID NO: 150824 - DNA, 37 bp, Artificial Sequence
  Synthetic oligonucleotide
ttgtaacgacagcagcaccgacctcagcacttcccga

SEQ ID NO: 150825 - DNA, 37 bp, Artificial Sequence
  Synthetic oligonucleotide
agcggaacgctgcacgcctctattagatcctttccga

SEQ ID NO: 150826 - DNA, 36 bp, Artificial Sequence
  Synthetic oligonucleotide
accgcaacccacgccaccttttaccccgtcggtcga

SEQ ID NO: 150827 - DNA, 38 bp, Artificial Sequence
  Synthetic oligonucleotide
gtttcgccccgccctttcaatgatcgtgcattgcatga

SEQ ID NO: 150828 - DNA, 38 bp, Artificial Sequence
  Synthetic oligonucleotide
tatgccaagctctgacccgctccccgcccctgcgctga

SEQ ID NO: 150829 - DNA, 38 bp, Artificial Sequence
  Synthetic oligonucleotide
tgcgaagggatgaaggggattaagggaagggtgagtga

SEQ ID NO: 150830 - DNA, 38 bp, Artificial Sequence
  Synthetic oligonucleotide
atgtaccatcgcaccgtcaatttttcccccgcgcgtga

SEQ ID NO: 150831 - DNA, 36 bp, Artificial Sequence
  Synthetic oligonucleotide
gagggccttcgctgcatattggtgcctcccccttga

SEQ ID NO: 150832 - DNA, 36 bp, Artificial Sequence
  Synthetic oligonucleotide
tgccccgcacaccgccccgcctggacagtcgcgcta

SEQ ID NO: 150833 - DNA, 36 bp, Artificial Sequence
  Synthetic oligonucleotide
tgcccagcctcacctcttttcctcccgccatggcta

SEQ ID NO: 150834 - DNA, 36 bp, Artificial Sequence
  Synthetic oligonucleotide
agacccacccctatttgcatcaatgcctgtaacgta

SEQ ID NO: 150835 - DNA, 35 bp, Artificial Sequence
  Synthetic oligonucleotide
gatcccccctgctggcctttgggcgaacacttgta

SEQ ID NO: 150836 - DNA, 34 bp, Artificial Sequence
  Synthetic oligonucleotide
tcattccccgcccgttccagaagccttaatcaac

SEQ ID NO: 150837 - DNA, 35 bp, Artificial Sequence
  Synthetic oligonucleotide
gaccaccacattcttcgtttgacgctctcctccac

SEQ ID NO: 150838 - DNA, 35 bp, Artificial Sequence
  Synthetic oligonucleotide
aacccccgccgccttgttgatcaccgctcctcgac

SEQ ID NO: 150839 - DNA, 35 bp, Artificial Sequence
  Synthetic oligonucleotide
gtgcgctcgctgcaatctagtatctttcgtcttac

SEQ ID NO: 150840 - DNA, 35 bp, Artificial Sequence
  Synthetic oligonucleotide
gttacctcagttaaatgcagtccaccacgctcccc

SEQ ID NO: 150841 - DNA, 35 bp, Artificial Sequence
  Synthetic oligonucleotide
gccagcctgccttgcggaccgcaccacacttcccc

SEQ ID NO: 150842 - DNA, 35 bp, Artificial Sequence
  Synthetic oligonucleotide
ttacaccgcttagatatatcacccggcgcttcccc

SEQ ID NO: 150843 - DNA, 35 bp, Artificial Sequence
  Synthetic oligonucleotide
tcaacactatggccgtggttcactgatcacctccc

SEQ ID NO: 150844 - DNA, 35 bp, Artificial Sequence
  Synthetic oligonucleotide
gccctcccgcccatattaaccgccgtctgcctccc

SEQ ID NO: 150845 - DNA, 35 bp, Artificial Sequence
  Synthetic oligonucleotide
actgtctggttccgcccgtattcccagtctcatcc

SEQ ID NO: 150846 - DNA, 35 bp, Artificial Sequence
  Synthetic oligonucleotide
acagtcggatcggccgccttacgccttttcagtcc

SEQ ID NO: 150847 - DNA, 35 bp, Artificial Sequence
  Synthetic oligonucleotide
gcccgcagtgtttgcgactttcctgccttacgtcc

SEQ ID NO: 150848 - DNA, 35 bp, Artificial Sequence
  Synthetic oligonucleotide
tcctcagtcgccctctgttcatcgtagtccctcgc

SEQ ID NO: 150849 - DNA, 35 bp, Artificial Sequence
  Synthetic oligonucleotide
gagtggccacccttctgtcgaccgcctccctgatc

SEQ ID NO: 150850 - DNA, 35 bp, Artificial Sequence
  Synthetic oligonucleotide
agacccactcaggacgtcgttcgtccctcaacctc

SEQ ID NO: 150851 - DNA, 35 bp, Artificial Sequence
  Synthetic oligonucleotide
actgcttcggctctctgtctctgttgctgcccctc

SEQ ID NO: 150852 - DNA, 35 bp, Artificial Sequence
  Synthetic oligonucleotide
gcgattcgccataatcctacgtacactcgatcctc

SEQ ID NO: 150853 - DNA, 35 bp, Artificial Sequence
  Synthetic oligonucleotide
gagttctacgccacatctgtttgattccgttattc

SEQ ID NO: 150854 - DNA, 35 bp, Artificial Sequence
  Synthetic oligonucleotide
atccaccacatcccgtactaatactgagctacacg

SEQ ID NO: 150855 - DNA, 35 bp, Artificial Sequence
  Synthetic oligonucleotide
atgttctcacagacaaccctggcctatctccgacg

SEQ ID NO: 150856 - DNA, 35 bp, Artificial Sequence
  Synthetic oligonucleotide
gaaccccagccggtccagtttgcccatccctgacg

SEQ ID NO: 150857 - DNA, 35 bp, Artificial Sequence
  Synthetic oligonucleotide
gaagaggggcgcggggaaaggggcaaccacggtgg

SEQ ID NO: 150858 - DNA, 35 bp, Artificial Sequence
  Synthetic oligonucleotide
gacatgggtaggggcgggcctgtagtaggtgggat

SEQ ID NO: 150859 - DNA, 35 bp, Artificial Sequence
  Synthetic oligonucleotide
tacgcccaccactggctagtgcgcacccttaacct

SEQ ID NO: 150860 - DNA, 35 bp, Artificial Sequence
  Synthetic oligonucleotide
gcaccgtttctttgctccaagtcctaccaccgcct

SEQ ID NO: 150861 - DNA, 35 bp, Artificial Sequence
  Synthetic oligonucleotide
tccgctggtagagggggggtgaagtagagggagct

SEQ ID NO: 150862 - DNA, 35 bp, Artificial Sequence
  Synthetic oligonucleotide
gtacctgccccgggccccctaagattcatgccgct

SEQ ID NO: 150863 - DNA, 35 bp, Artificial Sequence
  Synthetic oligonucleotide
ggatcgctcacccgggcaagcgtgggcccctctct

SEQ ID NO: 150864 - DNA, 35 bp, Artificial Sequence
  Synthetic oligonucleotide
acctcgacgctccctggaatttcacatggccttct

SEQ ID NO: 150865 - DNA, 35 bp, Artificial Sequence
  Synthetic oligonucleotide
atacgcgcctcggcctggctccttgttacccgctt

SEQ ID NO: 150866 - DNA, 35 bp, Artificial Sequence
  Synthetic oligonucleotide
acgaccagtagtgttccttccgcccccccgcgctt

SEQ ID NO: 150867 - DNA, 35 bp, Artificial Sequence
  Synthetic oligonucleotide
tacacacgctccatgttgccaccccgcctcatctt

SEQ ID NO: 150868 - DNA, 35 bp, Artificial Sequence
  Synthetic oligonucleotide
attgatctacccgcccacgtccccgctgccccgtt

SEQ ID NO: 150869 - DNA, 35 bp, Artificial Sequence
  Synthetic oligonucleotide
acccccgcccccgagtgtacctacgtagatgcgtt

SEQ ID NO: 150870 - DNA, 35 bp, Artificial Sequence
  Synthetic oligonucleotide
ttaagtcaccgtcccacctcgtttaaacgtccttt

SEQ ID NO: 150871 - DNA, 35 bp, Artificial Sequence
  Synthetic oligonucleotide
ggttcgccctcgccttcttaccggtttccccgttt

SEQ ID NO: 150872 - DNA, 36 bp, Artificial Sequence
  Synthetic oligonucleotide
tatcgcgccccaactatgataacccacgtccccgaa

SEQ ID NO: 150873 - DNA, 36 bp, Artificial Sequence
  Synthetic oligonucleotide
aatggcctcacatttgtcaccgcgctcctttccgaa

SEQ ID NO: 150874 - DNA, 36 bp, Artificial Sequence
  Synthetic oligonucleotide
gggggtggaatgggtcaaaaaaggaatggtggtgaa

SEQ ID NO: 150875 - DNA, 35 bp, Artificial Sequence
  Synthetic oligonucleotide
gaccgcccgccttacccgtacctgtggggcccaca

SEQ ID NO: 150876 - DNA, 35 bp, Artificial Sequence
  Synthetic oligonucleotide
ttccgactccgcggtcttccgtttgttgccctaca

SEQ ID NO: 150877 - DNA, 35 bp, Artificial Sequence
  Synthetic oligonucleotide
tagcgcatctatgccctccgtttcagcccccccca

SEQ ID NO: 150878 - DNA, 37 bp, Artificial Sequence
  Synthetic oligonucleotide
gcacagccttcctcgttgcaatatccacgccgatcca

SEQ ID NO: 150879 - DNA, 36 bp, Artificial Sequence
  Synthetic oligonucleotide
actgtagcaatgggtggaatgtgggggggcatcgca

SEQ ID NO: 150880 - DNA, 36 bp, Artificial Sequence
  Synthetic oligonucleotide
gactcgccagtgatcttctgcacgacctcttaatca

SEQ ID NO: 150881 - DNA, 34 bp, Artificial Sequence
  Synthetic oligonucleotide
ttgcacgagatccgcaatacctgccccactctca

SEQ ID NO: 150882 - DNA, 36 bp, Artificial Sequence
  Synthetic oligonucleotide
atgtccgccaattggtttggctctccgtacctttca

SEQ ID NO: 150883 - DNA, 36 bp, Artificial Sequence
  Synthetic oligonucleotide
tagacaacgcacactcctctccttccgtcccataga

SEQ ID NO: 150884 - DNA, 37 bp, Artificial Sequence
  Synthetic oligonucleotide
acccgccagtctaacgtgctcctcccgtctgccccga

SEQ ID NO: 150885 - DNA, 36 bp, Artificial Sequence
  Synthetic oligonucleotide
gcagggatcgagggggggttaggaatcggacggcga

SEQ ID NO: 150886 - DNA, 37 bp, Artificial Sequence
  Synthetic oligonucleotide
gtccatgcggcatctgtattgccctctttctcttcga

SEQ ID NO: 150887 - DNA, 37 bp, Artificial Sequence
  Synthetic oligonucleotide
tcagctccatgcccgcccttcccgctccctccgagga

SEQ ID NO: 150888 - DNA, 36 bp, Artificial Sequence
  Synthetic oligonucleotide
gccggggaaggagaaaacgggggacgggggaccgga

SEQ ID NO: 150889 - DNA, 37 bp, Artificial Sequence
  Synthetic oligonucleotide
tggagacttgcggggacggggagggagtggaaaggga

SEQ ID NO: 150890 - DNA, 37 bp, Artificial Sequence
  Synthetic oligonucleotide
cttgggagggggcaaagtagaggggcgttaatgggga

SEQ ID NO: 150891 - DNA, 37 bp, Artificial Sequence
  Synthetic oligonucleotide
acaccccccgttctactgagtatccacccactgtgga

SEQ ID NO: 150892 - DNA, 37 bp, Artificial Sequence
  Synthetic oligonucleotide
ggtgccatgaaagcgggtagggggaggggcctgtgga

SEQ ID NO: 150893 - DNA, 37 bp, Artificial Sequence
  Synthetic oligonucleotide
tcatggccattccttccggtcccctctgcctccatga

SEQ ID NO: 150894 - DNA, 37 bp, Artificial Sequence
  Synthetic oligonucleotide
tccaacgcacacctgttatctgcctattctcgcatga

SEQ ID NO: 150895 - DNA, 38 bp, Artificial Sequence
  Synthetic oligonucleotide
gcccacctccgaatgccccactccgttcctctgactga

SEQ ID NO: 150896 - DNA, 38 bp, Artificial Sequence
  Synthetic oligonucleotide
tagaagcgcacgtttcgttcctaactccatcccgctga

SEQ ID NO: 150897 - DNA, 37 bp, Artificial Sequence
  Synthetic oligonucleotide
acaatggggacggatagggagggtgggagacgtctga

SEQ ID NO: 150898 - DNA, 38 bp, Artificial Sequence
  Synthetic oligonucleotide
ggacgacagtgcacattcttgcatccacgcccccttga

SEQ ID NO: 150899 - DNA, 37 bp, Artificial Sequence
  Synthetic oligonucleotide
gtcctgctacccccgttttttgctgccaatttcttga

SEQ ID NO: 150900 - DNA, 38 bp, Artificial Sequence
  Synthetic oligonucleotide
tcttgctccccagcccccgtttcatgattccatgttga

SEQ ID NO: 150901 - DNA, 35 bp, Artificial Sequence
  Synthetic oligonucleotide
tgcactccgtccgcctctttgcgcatcacctagta

SEQ ID NO: 150902 - DNA, 36 bp, Artificial Sequence
  Synthetic oligonucleotide
tctcacctgccacacttctacggtcatcccacctta

SEQ ID NO: 150903 - DNA, 36 bp, Artificial Sequence
  Synthetic oligonucleotide
acgacgccctgctcttagacggccccttccgcctta

SEQ ID NO: 150904 - DNA, 35 bp, Artificial Sequence
  Synthetic oligonucleotide
gatccgcccatcgtaccgcactgccttactggtac

SEQ ID NO: 150905 - DNA, 35 bp, Artificial Sequence
  Synthetic oligonucleotide
gtgttggccttcctagttcacccatctgctctacc

SEQ ID NO: 150906 - DNA, 35 bp, Artificial Sequence
  Synthetic oligonucleotide
atgctcgcactagttggtgccgcgcctcgaccccc

SEQ ID NO: 150907 - DNA, 34 bp, Artificial Sequence
  Synthetic oligonucleotide
acccgcctccgccaactgctcctagatctcgccc

SEQ ID NO: 150908 - DNA, 35 bp, Artificial Sequence
  Synthetic oligonucleotide
gttcgggcgccaatctgttcccttccatacggtcc

SEQ ID NO: 150909 - DNA, 35 bp, Artificial Sequence
  Synthetic oligonucleotide
gccgacgtttggcagccccttcctccacgctgtcc

SEQ ID NO: 150910 - DNA, 35 bp, Artificial Sequence
  Synthetic oligonucleotide
tgcgcgagctataaagtgttaacgccaccccccgc

SEQ ID NO: 150911 - DNA, 35 bp, Artificial Sequence
  Synthetic oligonucleotide
tgcactgctgcccctgccgaagcatgttctccatc

SEQ ID NO: 150912 - DNA, 35 bp, Artificial Sequence
  Synthetic oligonucleotide
atgcgcgccagtgtcgtctttttatgctcaccctc

SEQ ID NO: 150913 - DNA, 35 bp, Artificial Sequence
  Synthetic oligonucleotide
tcacagtagcgcacactctgtagccgctctctctc

SEQ ID NO: 150914 - DNA, 35 bp, Artificial Sequence
  Synthetic oligonucleotide
attctccacctctcatggtacgcctccgtattctc

SEQ ID NO: 150915 - DNA, 35 bp, Artificial Sequence
  Synthetic oligonucleotide
gtccatctagcctcacccctggaagtacgtttctc

SEQ ID NO: 150916 - DNA, 35 bp, Artificial Sequence
  Synthetic oligonucleotide
gcctccgcccttttgatttgctcctaagtaccgtc

SEQ ID NO: 150917 - DNA, 35 bp, Artificial Sequence
  Synthetic oligonucleotide
acatgccagcatgcaccccagccccgcccccgaag

SEQ ID NO: 150918 - DNA, 34 bp, Artificial Sequence
  Synthetic oligonucleotide
tcctactccaccctctgcgtcccgcctttccccg

SEQ ID NO: 150919 - DNA, 35 bp, Artificial Sequence
  Synthetic oligonucleotide
tacgagggcatgtaaatatacggggaaagggaggg

SEQ ID NO: 150920 - DNA, 35 bp, Artificial Sequence
  Synthetic oligonucleotide
tctggccccccatggcattaccccccacttctcat

SEQ ID NO: 150921 - DNA, 35 bp, Artificial Sequence
  Synthetic oligonucleotide
gcttggtcccctcatccgcatgctgtcccaccact

SEQ ID NO: 150922 - DNA, 34 bp, Artificial Sequence
  Synthetic oligonucleotide
gtcaacacccgcctcgcacttctcgtacatacct

SEQ ID NO: 150923 - DNA, 35 bp, Artificial Sequence
  Synthetic oligonucleotide
gaccaccgggcatggattatcaacatttctcccct

SEQ ID NO: 150924 - DNA, 35 bp, Artificial Sequence
  Synthetic oligonucleotide
gtacctctcagttttaactccccttccctccgggt

SEQ ID NO: 150925 - DNA, 36 bp, Artificial Sequence
  Synthetic oligonucleotide
ttcgcacctacgcttctcacagcccggactcacatt

SEQ ID NO: 150926 - DNA, 35 bp, Artificial Sequence
  Synthetic oligonucleotide
tagacaaccgccaaatctcgtggctgctccacctt

SEQ ID NO: 150927 - DNA, 35 bp, Artificial Sequence
  Synthetic oligonucleotide
gacccccccgctctatgtcacatcgaatcctgctt

SEQ ID NO: 150928 - DNA, 35 bp, Artificial Sequence
  Synthetic oligonucleotide
gatccatcttgacgcttgtatactcccttctggtt

SEQ ID NO: 150929 - DNA, 35 bp, Artificial Sequence
  Synthetic oligonucleotide
atcgcaaccttgcgaggtctatgattaccatcttt

SEQ ID NO: 150930 - DNA, 34 bp, Artificial Sequence
  Synthetic oligonucleotide
gctgaaagcgctccttttccaccgttcctgcaaa

SEQ ID NO: 150931 - DNA, 36 bp, Artificial Sequence
  Synthetic oligonucleotide
acagcccggcctccgaattctccgcttccgttctaa

SEQ ID NO: 150932 - DNA, 36 bp, Artificial Sequence
  Synthetic oligonucleotide
atcagtctccctgtgctgcccccccacatccaccca

SEQ ID NO: 150933 - DNA, 35 bp, Artificial Sequence
  Synthetic oligonucleotide
tgtgccagcatcgatagccgactcacctctcgcca

SEQ ID NO: 150934 - DNA, 36 bp, Artificial Sequence
  Synthetic oligonucleotide
tacgccaaagctcacgacgcccgcaaccgccttcca

SEQ ID NO: 150935 - DNA, 36 bp, Artificial Sequence
  Synthetic oligonucleotide
aatccgcgctacttcattctccgcctcctgtgtgca

SEQ ID NO: 150936 - DNA, 36 bp, Artificial Sequence
  Synthetic oligonucleotide
gttgccaccacacggtcgtactttaacacactttca

SEQ ID NO: 150937 - DNA, 37 bp, Artificial Sequence
  Synthetic oligonucleotide
accgcacttcctctttgctatcccagcccacactaga

SEQ ID NO: 150938 - DNA, 37 bp, Artificial Sequence
  Synthetic oligonucleotide
gtagcacggatgtcaaaggggggaggggagtggtaga

SEQ ID NO: 150939 - DNA, 37 bp, Artificial Sequence
  Synthetic oligonucleotide
tccccgccgccatttgtctcttagccgcataccacga

SEQ ID NO: 150940 - DNA, 36 bp, Artificial Sequence
  Synthetic oligonucleotide
gtgaggagggtggggagtctggaagggcaccagcga

SEQ ID NO: 150941 - DNA, 36 bp, Artificial Sequence
  Synthetic oligonucleotide
atcgcgtcaattctccgtccgtgccactcccgtcga

SEQ ID NO: 150942 - DNA, 37 bp, Artificial Sequence
  Synthetic oligonucleotide
actcacggcagatggagcggtgggttacgggggggga

SEQ ID NO: 150943 - DNA, 35 bp, Artificial Sequence
  Synthetic oligonucleotide
tccatccctcacgcctgccatccgtgctctctgga

SEQ ID NO: 150944 - DNA, 38 bp, Artificial Sequence
  Synthetic oligonucleotide
tcactcccccgctttctgtacagacagtttcgacgtga

SEQ ID NO: 150945 - DNA, 38 bp, Artificial Sequence
  Synthetic oligonucleotide
gagtacctctgtcggttttgcctcgcctccttccgtga

SEQ ID NO: 150946 - DNA, 38 bp, Artificial Sequence
  Synthetic oligonucleotide
ttcgccctgcgaatcagccgatattccgcccaccttga

SEQ ID NO: 150947 - DNA, 38 bp, Artificial Sequence
  Synthetic oligonucleotide
gttgccgttctagcgtatcctgcctgggcccatcttga

SEQ ID NO: 150948 - DNA, 38 bp, Artificial Sequence
  Synthetic oligonucleotide
tcaagggtgggaggggcatggggtctgttgaaggttga

SEQ ID NO: 150949 - DNA, 36 bp, Artificial Sequence
  Synthetic oligonucleotide
tcgttccctctcatgtcgcaatcatcatgtccccta

SEQ ID NO: 150950 - DNA, 36 bp, Artificial Sequence
  Synthetic oligonucleotide
tcgcaaccctcacattctctcgcctatcctgccgta

SEQ ID NO: 150951 - DNA, 36 bp, Artificial Sequence
  Synthetic oligonucleotide
tgcccccctgcgccatccagcatcatgcaatcctta

SEQ ID NO: 150952 - DNA, 35 bp, Artificial Sequence
  Synthetic oligonucleotide
tacacgggcatacctctatttgttcgttcctctta

SEQ ID NO: 150953 - DNA, 36 bp, Artificial Sequence
  Synthetic oligonucleotide
atcccacccgccttcttgatgcaattgacgccttta

SEQ ID NO: 150954 - DNA, 34 bp, Artificial Sequence
  Synthetic oligonucleotide
acctaaggggagggtaggcggagggggaggaaac

SEQ ID NO: 150955 - DNA, 35 bp, Artificial Sequence
  Synthetic oligonucleotide
gacttccaccgcacacggattcgttccattgtcac

SEQ ID NO: 150956 - DNA, 35 bp, Artificial Sequence
  Synthetic oligonucleotide
gtagcccgcactgaaacacccagtcccaactcgac

SEQ ID NO: 150957 - DNA, 35 bp, Artificial Sequence
  Synthetic oligonucleotide
gtcccaccgcgtaacttccgcctcgtctcaacccc

SEQ ID NO: 150958 - DNA, 35 bp, Artificial Sequence
  Synthetic oligonucleotide
gccgccacacgtacgctatgacctgccttttcccc

SEQ ID NO: 150959 - DNA, 35 bp, Artificial Sequence
  Synthetic oligonucleotide
atccccaatggtcccgccaccactgttttaagccc

SEQ ID NO: 150960 - DNA, 35 bp, Artificial Sequence
  Synthetic oligonucleotide
atcccgccttctccaatgttctattatattcctcc

SEQ ID NO: 150961 - DNA, 34 bp, Artificial Sequence
  Synthetic oligonucleotide
ttcgccgccccatttcttgttccatccgtcttcc

SEQ ID NO: 150962 - DNA, 35 bp, Artificial Sequence
  Synthetic oligonucleotide
taccgccggcgtagttagcctttttacgctgttcc

SEQ ID NO: 150963 - DNA, 35 bp, Artificial Sequence
  Synthetic oligonucleotide
tccgtatccgcacatctacccccggtggccatagc

SEQ ID NO: 150964 - DNA, 35 bp, Artificial Sequence
  Synthetic oligonucleotide
gcatacccagtatatctccgctcccctttcggcgc

SEQ ID NO: 150965 - DNA, 35 bp, Artificial Sequence
  Synthetic oligonucleotide
gacaccgttccttctagtgccccaaccgtcatggc

SEQ ID NO: 150966 - DNA, 35 bp, Artificial Sequence
  Synthetic oligonucleotide
tgcaccgaaccgacccaccgctgtctattcctggc

SEQ ID NO: 150967 - DNA, 35 bp, Artificial Sequence
  Synthetic oligonucleotide
acgtgaacaacgtctgcttacccgctttattcctc

SEQ ID NO: 150968 - DNA, 35 bp, Artificial Sequence
  Synthetic oligonucleotide
agatgcctccttcgcattgtacctttccgttcctc

SEQ ID NO: 150969 - DNA, 35 bp, Artificial Sequence
  Synthetic oligonucleotide
atcgcatctcctcgtcctgtaggaacccctctctc

SEQ ID NO: 150970 - DNA, 35 bp, Artificial Sequence
  Synthetic oligonucleotide
accgcccttgcaatcgtgcattcacaacatcaccg

SEQ ID NO: 150971 - DNA, 35 bp, Artificial Sequence
  Synthetic oligonucleotide
tcatacccgccaccgtacccagctgcgcaacagcg

SEQ ID NO: 150972 - DNA, 35 bp, Artificial Sequence
  Synthetic oligonucleotide
gtaccaccaccatccggctctcagctcgagtttcg

SEQ ID NO: 150973 - DNA, 35 bp, Artificial Sequence
  Synthetic oligonucleotide
tctcctcctcacatactacagctctacccgtccgg

SEQ ID NO: 150974 - DNA, 35 bp, Artificial Sequence
  Synthetic oligonucleotide
gtcaagtcgtcggacttcggttatcccctcccctg

SEQ ID NO: 150975 - DNA, 35 bp, Artificial Sequence
  Synthetic oligonucleotide
tatgcgcctaccaccgtcgtacagctattctcttg

SEQ ID NO: 150976 - DNA, 35 bp, Artificial Sequence
  Synthetic oligonucleotide
tgcacgccgcactatccattgatgtacctttctat

SEQ ID NO: 150977 - DNA, 35 bp, Artificial Sequence
  Synthetic oligonucleotide
tccctcggtccgttttttcccgtcacaggctaact

SEQ ID NO: 150978 - DNA, 35 bp, Artificial Sequence
  Synthetic oligonucleotide
tccatcctcccttgccctttagtaatgaggagact

SEQ ID NO: 150979 - DNA, 35 bp, Artificial Sequence
  Synthetic oligonucleotide
tagtccgcgttcgtctccttggcggcttcccccct

SEQ ID NO: 150980 - DNA, 32 bp, Artificial Sequence
  Synthetic oligonucleotide
gcagaaccgatgtctccgtgccctatctctct

SEQ ID NO: 150981 - DNA, 35 bp, Artificial Sequence
  Synthetic oligonucleotide
tgaggcacaggggagggccaaaatgaggggtaggt

SEQ ID NO: 150982 - DNA, 35 bp, Artificial Sequence
  Synthetic oligonucleotide
tccatgtcctgtatcatttcacccgtgccaggctt

SEQ ID NO: 150983 - DNA, 35 bp, Artificial Sequence
  Synthetic oligonucleotide
agcattccgcctctgtcgttctgttcaccacccaa

SEQ ID NO: 150984 - DNA, 36 bp, Artificial Sequence
  Synthetic oligonucleotide
tgccgaccttagtgcgatttcagctacacctcccaa

SEQ ID NO: 150985 - DNA, 36 bp, Artificial Sequence
  Synthetic oligonucleotide
tccatgccccactgccaggtccccacagttcgctaa

SEQ ID NO: 150986 - DNA, 36 bp, Artificial Sequence
  Synthetic oligonucleotide
acgagtcgggagggttgggtatgggtactactgtaa

SEQ ID NO: 150987 - DNA, 36 bp, Artificial Sequence
  Synthetic oligonucleotide
gtgagccgtcggatgcatcttctgcccctcgccaca

SEQ ID NO: 150988 - DNA, 35 bp, Artificial Sequence
  Synthetic oligonucleotide
gatgtaatccggatgggaagggtgggggagagaca

SEQ ID NO: 150989 - DNA, 35 bp, Artificial Sequence
  Synthetic oligonucleotide
ttctatcccgccgttatgaaccgtccctgttacca

SEQ ID NO: 150990 - DNA, 36 bp, Artificial Sequence
  Synthetic oligonucleotide
gtgacgcccccgatcgccttgaaaccgccgtagcca

SEQ ID NO: 150991 - DNA, 36 bp, Artificial Sequence
  Synthetic oligonucleotide
gagcgcgtagcagggaatcgcccccccaccaccgca

SEQ ID NO: 150992 - DNA, 37 bp, Artificial Sequence
  Synthetic oligonucleotide
gaggaacgggcaaggcaatgggcgtggggggggggca

SEQ ID NO: 150993 - DNA, 36 bp, Artificial Sequence
  Synthetic oligonucleotide
aacaccaatccgtaacgagtctatacggtcctctca

SEQ ID NO: 150994 - DNA, 36 bp, Artificial Sequence
  Synthetic oligonucleotide
gcctcccccctggttcctcccccgctttcggggtca

SEQ ID NO: 150995 - DNA, 36 bp, Artificial Sequence
  Synthetic oligonucleotide
ttctagcggacgtagctccaccgcccccctcgttca

SEQ ID NO: 150996 - DNA, 35 bp, Artificial Sequence
  Synthetic oligonucleotide
tcacgaagccttcaccgagagtctatccctgttca

SEQ ID NO: 150997 - DNA, 37 bp, Artificial Sequence
  Synthetic oligonucleotide
gtccactttgccctaccgcccgctccacaagagcaga

SEQ ID NO: 150998 - DNA, 37 bp, Artificial Sequence
  Synthetic oligonucleotide
gtgtgtggggggggtatggcggggacacaagaagaga

SEQ ID NO: 150999 - DNA, 37 bp, Artificial Sequence
  Synthetic oligonucleotide
actgataggggtgggagcgggggtgggatattaacga

SEQ ID NO: 151000 - DNA, 37 bp, Artificial Sequence
  Synthetic oligonucleotide
tgatgtagggtgtggtgggaggtggagattaatacga

SEQ ID NO: 151001 - DNA, 37 bp, Artificial Sequence
  Synthetic oligonucleotide
tgtcgcccctccgacctttctgaatttgcagtcgcga

SEQ ID NO: 151002 - DNA, 37 bp, Artificial Sequence
  Synthetic oligonucleotide
atgaggagacacagcgggaatagcacaggggaggcga

SEQ ID NO: 151003 - DNA, 35 bp, Artificial Sequence
  Synthetic oligonucleotide
gggggcgggaggggcacttaattggggccctcgga

SEQ ID NO: 151004 - DNA, 37 bp, Artificial Sequence
  Synthetic oligonucleotide
gcccgggtggacgggggtgcaaggggattttgaggga

SEQ ID NO: 151005 - DNA, 37 bp, Artificial Sequence
  Synthetic oligonucleotide
ttggggaatgttgtagtggggcgggatgcaatgggga

SEQ ID NO: 151006 - DNA, 38 bp, Artificial Sequence
  Synthetic oligonucleotide
acaaccgtcccatccatcagtagcgtgccaccccctga

SEQ ID NO: 151007 - DNA, 37 bp, Artificial Sequence
  Synthetic oligonucleotide
gttcgccgcctcttggatagcctccccactcatctga

SEQ ID NO: 151008 - DNA, 37 bp, Artificial Sequence
  Synthetic oligonucleotide
tccccaactagattccaccgcgctccagtccctctga

SEQ ID NO: 151009 - DNA, 38 bp, Artificial Sequence
  Synthetic oligonucleotide
gatcccctgccccccttcaagcctccatagagacgtga

SEQ ID NO: 151010 - DNA, 38 bp, Artificial Sequence
  Synthetic oligonucleotide
atgagaggaaaacggggaatcagtggagaggggcgtga

SEQ ID NO: 151011 - DNA, 38 bp, Artificial Sequence
  Synthetic oligonucleotide
gactgcccactcagcgtgtcaccctcccgcctttgtga

SEQ ID NO: 151012 - DNA, 38 bp, Artificial Sequence
  Synthetic oligonucleotide
atgaccgcgacatagggttgggcgggatgggagattga

SEQ ID NO: 151013 - DNA, 37 bp, Artificial Sequence
  Synthetic oligonucleotide
agccgcctatgtgccctgctctctccgcactccttga

SEQ ID NO: 151014 - DNA, 38 bp, Artificial Sequence
  Synthetic oligonucleotide
tccaccacccgaacgcatgtagcccttatggtccttga

SEQ ID NO: 151015 - DNA, 36 bp, Artificial Sequence
  Synthetic oligonucleotide
gtgcaaaggggaaaggcattaagggagggcgagata

SEQ ID NO: 151016 - DNA, 35 bp, Artificial Sequence
  Synthetic oligonucleotide
ttcacttcgccacccgtaacggtctcgtttcccta

SEQ ID NO: 151017 - DNA, 36 bp, Artificial Sequence
  Synthetic oligonucleotide
tcaccattcccgacgttaactgccacttcgtactta

SEQ ID NO: 151018 - DNA, 35 bp, Artificial Sequence
  Synthetic oligonucleotide
accatccacccgttgttactattagccttgtgcac

SEQ ID NO: 151019 - DNA, 35 bp, Artificial Sequence
  Synthetic oligonucleotide
acccggcttaactgttttctggcctcccggtttac

SEQ ID NO: 151020 - DNA, 35 bp, Artificial Sequence
  Synthetic oligonucleotide
ttgcgcaaggttcactggctttcttccacaccacc

SEQ ID NO: 151021 - DNA, 35 bp, Artificial Sequence
  Synthetic oligonucleotide
atcgctgagctgataaaagcgccacccacctcacc

SEQ ID NO: 151022 - DNA, 35 bp, Artificial Sequence
  Synthetic oligonucleotide
acctcctgatcctgctggtcccctcgtcgctgacc

SEQ ID NO: 151023 - DNA, 35 bp, Artificial Sequence
  Synthetic oligonucleotide
gttgccggtgctctgtccattgccaactgttaccc

SEQ ID NO: 151024 - DNA, 35 bp, Artificial Sequence
  Synthetic oligonucleotide
atgtccccatcaccctcagtctgggtggctacccc

SEQ ID NO: 151025 - DNA, 35 bp, Artificial Sequence
  Synthetic oligonucleotide
gatgtcgctacccgggccaaggccgcctgcccccc

SEQ ID NO: 151026 - DNA, 35 bp, Artificial Sequence
  Synthetic oligonucleotide
gtggccatgcgcgtatttcgccactttgatccccc

SEQ ID NO: 151027 - DNA, 35 bp, Artificial Sequence
  Synthetic oligonucleotide
tgcttgtgcagttcgtactatccttcagaatgtcc

SEQ ID NO: 151028 - DNA, 35 bp, Artificial Sequence
  Synthetic oligonucleotide
gtcgcaatacaggcctcgttcccagttacatttcc

SEQ ID NO: 151029 - DNA, 35 bp, Artificial Sequence
  Synthetic oligonucleotide
tcacgccgcatagcaatcaactcggttcccctggc

SEQ ID NO: 151030 - DNA, 35 bp, Artificial Sequence
  Synthetic oligonucleotide
acaaccgctacacgtatttggccccgttttacctc

SEQ ID NO: 151031 - DNA, 35 bp, Artificial Sequence
  Synthetic oligonucleotide
aactttcggccccgccctttcccttgtggtccctc

SEQ ID NO: 151032 - DNA, 31 bp, Artificial Sequence
  Synthetic oligonucleotide
gtacctccacctcagttcttactcgttcttc

SEQ ID NO: 151033 - DNA, 35 bp, Artificial Sequence
  Synthetic oligonucleotide
tacatccccaatcgctttctagtgaactgacgttc

SEQ ID NO: 151034 - DNA, 35 bp, Artificial Sequence
  Synthetic oligonucleotide
gcacgggtgggggagggcacatagtctagagggag

SEQ ID NO: 151035 - DNA, 35 bp, Artificial Sequence
  Synthetic oligonucleotide
gccccccgtttccatctgttggtatgcttcccacg

SEQ ID NO: 151036 - DNA, 35 bp, Artificial Sequence
  Synthetic oligonucleotide
tctgccacgagcctcaccacacttactgaccgccg

SEQ ID NO: 151037 - DNA, 35 bp, Artificial Sequence
  Synthetic oligonucleotide
ggtggtgcagtagcccttgtccccgtccctccgcg

SEQ ID NO: 151038 - DNA, 35 bp, Artificial Sequence
  Synthetic oligonucleotide
agagagtgggggtcgggtagggcaggaggttatgg

SEQ ID NO: 151039 - DNA, 35 bp, Artificial Sequence
  Synthetic oligonucleotide
agcatgtggcacacctccacgtcgcctccccctgg

SEQ ID NO: 151040 - DNA, 35 bp, Artificial Sequence
  Synthetic oligonucleotide
acatttcgcccaaccgttccttctccgccttgatg

SEQ ID NO: 151041 - DNA, 35 bp, Artificial Sequence
  Synthetic oligonucleotide
ttcattcctcgtgttgtcctttgccattttccttg

SEQ ID NO: 151042 - DNA, 35 bp, Artificial Sequence
  Synthetic oligonucleotide
acacaccacctaacatgttagccgttccgctcttg

SEQ ID NO: 151043 - DNA, 35 bp, Artificial Sequence
  Synthetic oligonucleotide
acacaccacctaaaatgttcgccgttccgctcttg

SEQ ID NO: 151044 - DNA, 35 bp, Artificial Sequence
  Synthetic oligonucleotide
ggtatgccactaactatatcctgtcctgcctgttg

SEQ ID NO: 151045 - DNA, 35 bp, Artificial Sequence
  Synthetic oligonucleotide
atggtcagtctccgtatccggtccggccttcccat

SEQ ID NO: 151046 - DNA, 35 bp, Artificial Sequence
  Synthetic oligonucleotide
gaccaacctcttcagcgtccctattcccctgtact

SEQ ID NO: 151047 - DNA, 35 bp, Artificial Sequence
  Synthetic oligonucleotide
ttcctcgcccggtccccggtgtccccgacgcccct

SEQ ID NO: 151048 - DNA, 35 bp, Artificial Sequence
  Synthetic oligonucleotide
ttactccaccttccccgcggatctgctaaggccct

SEQ ID NO: 151049 - DNA, 35 bp, Artificial Sequence
  Synthetic oligonucleotide
acttgccacccgccgcaaccggaaattcgatccct

SEQ ID NO: 151050 - DNA, 35 bp, Artificial Sequence
  Synthetic oligonucleotide
taccccatctacctaggtcagcgtaccgcatcgct

SEQ ID NO: 151051 - DNA, 35 bp, Artificial Sequence
  Synthetic oligonucleotide
gcagccgcgcgctacagctacccgcctgcccctct

SEQ ID NO: 151052 - DNA, 35 bp, Artificial Sequence
  Synthetic oligonucleotide
atgatcacctctctccaagtgccccccctgtatgt

SEQ ID NO: 151053 - DNA, 35 bp, Artificial Sequence
  Synthetic oligonucleotide
gtgacgtaggtcggggggggaagggcgagctgatt

SEQ ID NO: 151054 - DNA, 35 bp, Artificial Sequence
  Synthetic oligonucleotide
gccccctccgtttgctcattaccccacagttactt

SEQ ID NO: 151055 - DNA, 35 bp, Artificial Sequence
  Synthetic oligonucleotide
gttcacgaccctcacacgcgctgacgttctacctt

SEQ ID NO: 151056 - DNA, 35 bp, Artificial Sequence
  Synthetic oligonucleotide
gtgagcggtgcgtatgggggtgcgggggcggttaa

SEQ ID NO: 151057 - DNA, 36 bp, Artificial Sequence
  Synthetic oligonucleotide
tcccgcctcctccgggcctttacttggaacttcaca

SEQ ID NO: 151058 - DNA, 35 bp, Artificial Sequence
  Synthetic oligonucleotide
gagtgacctttcgctgtacctgttatcctgcccca

SEQ ID NO: 151059 - DNA, 36 bp, Artificial Sequence
  Synthetic oligonucleotide
aatgtcatgtcgcttcgtattttccgcccgctccca

SEQ ID NO: 151060 - DNA, 35 bp, Artificial Sequence
  Synthetic oligonucleotide
gatccaccgaccgttttctatatcctgatcacgca

SEQ ID NO: 151061 - DNA, 36 bp, Artificial Sequence
  Synthetic oligonucleotide
gagtcgcactcatctacgtttttaccactgttcgca

SEQ ID NO: 151062 - DNA, 36 bp, Artificial Sequence
  Synthetic oligonucleotide
gccaacttcctaccgattcgcctgtcacttctccga

SEQ ID NO: 151063 - DNA, 37 bp, Artificial Sequence
  Synthetic oligonucleotide
ggggagggtaggataacacaaacgggaagtctgagga

SEQ ID NO: 151064 - DNA, 36 bp, Artificial Sequence
  Synthetic oligonucleotide
gccataccctatcgccggccacatcccatccacgga

SEQ ID NO: 151065 - DNA, 37 bp, Artificial Sequence
  Synthetic oligonucleotide
tgcaggaggaggggcacggaaggcggagaagtccgga

SEQ ID NO: 151066 - DNA, 36 bp, Artificial Sequence
  Synthetic oligonucleotide
tgggtgggcgcatgccataatatagtgaaagaggga

SEQ ID NO: 151067 - DNA, 37 bp, Artificial Sequence
  Synthetic oligonucleotide
gtgtacacgagggggggaattaggggcgctgggggga

SEQ ID NO: 151068 - DNA, 37 bp, Artificial Sequence
  Synthetic oligonucleotide
tgcgggagtcgataaggcgggggggatcagggatgga

SEQ ID NO: 151069 - DNA, 38 bp, Artificial Sequence
  Synthetic oligonucleotide
aaatgcctgcgtgggagggggaggtaggagggaaatga

SEQ ID NO: 151070 - DNA, 38 bp, Artificial Sequence
  Synthetic oligonucleotide
gcagaagcaagataggggggaagggaagggttgcatga

SEQ ID NO: 151071 - DNA, 37 bp, Artificial Sequence
  Synthetic oligonucleotide
ggagggggaagtaggttgggaggtagtgagagattga

SEQ ID NO: 151072 - DNA, 36 bp, Artificial Sequence
  Synthetic oligonucleotide
tcgccctcccactgtttgcgttacaccaatcgacta

SEQ ID NO: 151073 - DNA, 36 bp, Artificial Sequence
  Synthetic oligonucleotide
tgacaaacgcctgttgccctcattttctgctgccta

SEQ ID NO: 151074 - DNA, 35 bp, Artificial Sequence
  Synthetic oligonucleotide
gcactcgccctcttattcgtgctttcaatggaaac

SEQ ID NO: 151075 - DNA, 35 bp, Artificial Sequence
  Synthetic oligonucleotide
attgccttcctgatcttccctcaggcatatctcac

SEQ ID NO: 151076 - DNA, 35 bp, Artificial Sequence
  Synthetic oligonucleotide
gtccacgggtagggtgggtcttcggggtacgagac

SEQ ID NO: 151077 - DNA, 35 bp, Artificial Sequence
  Synthetic oligonucleotide
gttactcgtgtcctaacagcagccccccgttctac

SEQ ID NO: 151078 - DNA, 35 bp, Artificial Sequence
  Synthetic oligonucleotide
tacgcatccactttagcacgctcccacctcgtacc

SEQ ID NO: 151079 - DNA, 35 bp, Artificial Sequence
  Synthetic oligonucleotide
tggtgcggcctacttgccacgtcccctattgtacc

SEQ ID NO: 151080 - DNA, 35 bp, Artificial Sequence
  Synthetic oligonucleotide
actgcacgtcctaccttctcgcactgttcccaccc

SEQ ID NO: 151081 - DNA, 35 bp, Artificial Sequence
  Synthetic oligonucleotide
acgcacccctcatggcttgcagaccacttgtaccc

SEQ ID NO: 151082 - DNA, 35 bp, Artificial Sequence
  Synthetic oligonucleotide
ggggcagtccagattcgctttacaccaccgtcccc

SEQ ID NO: 151083 - DNA, 35 bp, Artificial Sequence
  Synthetic oligonucleotide
aggtgcaccgtgaactgctgttcccctacccgccc

SEQ ID NO: 151084 - DNA, 35 bp, Artificial Sequence
  Synthetic oligonucleotide
gcccaccgccgttgctcatgaccttcactctagcc

SEQ ID NO: 151085 - DNA, 34 bp, Artificial Sequence
  Synthetic oligonucleotide
tgcaagcactcgctgacgttttggttccacctcc

SEQ ID NO: 151086 - DNA, 35 bp, Artificial Sequence
  Synthetic oligonucleotide
tactggtcatcacgctctacacggcatgaacttcc

SEQ ID NO: 151087 - DNA, 35 bp, Artificial Sequence
  Synthetic oligonucleotide
tcattccctctccttcatgcccacagtgccgttgc

SEQ ID NO: 151088 - DNA, 34 bp, Artificial Sequence
  Synthetic oligonucleotide
gaacgtcctggccgctctatacaccactcagctc

SEQ ID NO: 151089 - DNA, 35 bp, Artificial Sequence
  Synthetic oligonucleotide
gtgcatcccgcaccaataacacccgaagtgctctc

SEQ ID NO: 151090 - DNA, 35 bp, Artificial Sequence
  Synthetic oligonucleotide
tcttcagccaccacccctgctcgtaacaatacgtc

SEQ ID NO: 151091 - DNA, 35 bp, Artificial Sequence
  Synthetic oligonucleotide
atctgatccagccagcactcatgtcaacccccgtc

SEQ ID NO: 151092 - DNA, 35 bp, Artificial Sequence
  Synthetic oligonucleotide
acaccctcatccggcccatcgactattaggcggtc

SEQ ID NO: 151093 - DNA, 35 bp, Artificial Sequence
  Synthetic oligonucleotide
tccagatctttgccgtgttctatccctgtcctgtc

SEQ ID NO: 151094 - DNA, 35 bp, Artificial Sequence
  Synthetic oligonucleotide
gaggctcagagctttgtgtccttcccgccctgttc

SEQ ID NO: 151095 - DNA, 35 bp, Artificial Sequence
  Synthetic oligonucleotide
tccgcccctgactgccgacgtttcgatccttgttc

SEQ ID NO: 151096 - DNA, 35 bp, Artificial Sequence
  Synthetic oligonucleotide
ggacacgaaggcttcgttcatccgccccctatttc

SEQ ID NO: 151097 - DNA, 35 bp, Artificial Sequence
  Synthetic oligonucleotide
tttaaccccacggcccccgacctcgctgatccacg

SEQ ID NO: 151098 - DNA, 35 bp, Artificial Sequence
  Synthetic oligonucleotide
aaccaccgccctctaaattatctgttgcctactcg

SEQ ID NO: 151099 - DNA, 35 bp, Artificial Sequence
  Synthetic oligonucleotide
tccgccacacaaccagcctgcttattcgccccctg

SEQ ID NO: 151100 - DNA, 35 bp, Artificial Sequence
  Synthetic oligonucleotide
atcatctcggtgccctgttttgcttacacctacat

SEQ ID NO: 151101 - DNA, 35 bp, Artificial Sequence
  Synthetic oligonucleotide
gcccgcccacaagtctcgacacttgttctttctat

SEQ ID NO: 151102 - DNA, 35 bp, Artificial Sequence
  Synthetic oligonucleotide
tacgccatccccttcccttatttcagtaagagact

SEQ ID NO: 151103 - DNA, 35 bp, Artificial Sequence
  Synthetic oligonucleotide
gacgacaacaggaaggggcttagggggacggacct

SEQ ID NO: 151104 - DNA, 35 bp, Artificial Sequence
  Synthetic oligonucleotide
gcatacaatctgtgcgctaagcacctttaccctct

SEQ ID NO: 151105 - DNA, 35 bp, Artificial Sequence
  Synthetic oligonucleotide
tgaagtccggccttctgctgtcttttcattcctgt

SEQ ID NO: 151106 - DNA, 35 bp, Artificial Sequence
  Synthetic oligonucleotide
atcgccacccgatccggttaatctattccaacctt

SEQ ID NO: 151107 - DNA, 35 bp, Artificial Sequence
  Synthetic oligonucleotide
gctgcgcagatgctcgtttccatcctccacccctt

SEQ ID NO: 151108 - DNA, 35 bp, Artificial Sequence
  Synthetic oligonucleotide
gccctaatcgcacctgcccatagccttcagccctt

SEQ ID NO: 151109 - DNA, 35 bp, Artificial Sequence
  Synthetic oligonucleotide
tgtcttgccagcctgcaaattagccgcctgccctt

SEQ ID NO: 151110 - DNA, 35 bp, Artificial Sequence
  Synthetic oligonucleotide
tgttgctcgataccaccgcgcgttccctggggctt

SEQ ID NO: 151111 - DNA, 35 bp, Artificial Sequence
  Synthetic oligonucleotide
gaggccaccccctgttcttgtctctcggttctaca

SEQ ID NO: 151112 - DNA, 36 bp, Artificial Sequence
  Synthetic oligonucleotide
gaccgcactgccatccatgtacccgcgctcatccca

SEQ ID NO: 151113 - DNA, 35 bp, Artificial Sequence
  Synthetic oligonucleotide
gatcacccaccacctgtattcagataatccagcca

SEQ ID NO: 151114 - DNA, 36 bp, Artificial Sequence
  Synthetic oligonucleotide
tccgccccatctagatcatgcccgttggcctggcca

SEQ ID NO: 151115 - DNA, 35 bp, Artificial Sequence
  Synthetic oligonucleotide
tctagagccagggtccttctgctcactcctgtcca

SEQ ID NO: 151116 - DNA, 36 bp, Artificial Sequence
  Synthetic oligonucleotide
gaaggtcccgcctgttttcgactctatccgtgcgca

SEQ ID NO: 151117 - DNA, 35 bp, Artificial Sequence
  Synthetic oligonucleotide
atcgtaccccccggcagttaacagcctactaggca

SEQ ID NO: 151118 - DNA, 35 bp, Artificial Sequence
  Synthetic oligonucleotide
gtgccctctagatatccgctcccctggccccaaga

SEQ ID NO: 151119 - DNA, 37 bp, Artificial Sequence
  Synthetic oligonucleotide
atgctggcccccgctgttgtcccttcctatcgtcaga

SEQ ID NO: 151120 - DNA, 36 bp, Artificial Sequence
  Synthetic oligonucleotide
gcacctcctgtactcttggctatcttggacccccga

SEQ ID NO: 151121 - DNA, 37 bp, Artificial Sequence
  Synthetic oligonucleotide
gttttggtcagatgtccgatcccctgcccccactcga

SEQ ID NO: 151122 - DNA, 37 bp, Artificial Sequence
  Synthetic oligonucleotide
ttaagagactcagaaggaatgggaggatggaacagga

SEQ ID NO: 151123 - DNA, 37 bp, Artificial Sequence
  Synthetic oligonucleotide
tgcaccactgcgtcgtacctatgttccttgccccgga

SEQ ID NO: 151124 - DNA, 37 bp, Artificial Sequence
  Synthetic oligonucleotide
gaagtagccgggatggggggcggggggacagaaggga

SEQ ID NO: 151125 - DNA, 37 bp, Artificial Sequence
  Synthetic oligonucleotide
gtctgggggggacgggaatgggaggtatacagcatga

SEQ ID NO: 151126 - DNA, 37 bp, Artificial Sequence
  Synthetic oligonucleotide
gcaaccccccccctgcgagtcccctgcttcctgctga

SEQ ID NO: 151127 - DNA, 38 bp, Artificial Sequence
  Synthetic oligonucleotide
tagcgaggtcggggagggtaaacggggggctcgcgtga

SEQ ID NO: 151128 - DNA, 38 bp, Artificial Sequence
  Synthetic oligonucleotide
gccaggcaccagtttcttagcactctcccgccctgtga

SEQ ID NO: 151129 - DNA, 38 bp, Artificial Sequence
  Synthetic oligonucleotide
gcgctactgccctgttcgacctatatgctgcccattga

SEQ ID NO: 151130 - DNA, 38 bp, Artificial Sequence
  Synthetic oligonucleotide
tagatcatctcacctgccataaagccgccccctgttga

SEQ ID NO: 151131 - DNA, 36 bp, Artificial Sequence
  Synthetic oligonucleotide
gcctgacctctgttgttctccctcttcctgcccata

SEQ ID NO: 151132 - DNA, 35 bp, Artificial Sequence
  Synthetic oligonucleotide
attgccccgccccatgcctctctcagctggcccta

SEQ ID NO: 151133 - DNA, 29 bp, Artificial Sequence
  Synthetic oligonucleotide
tccgagctttctctctcccgtggccctta

SEQ ID NO: 151134 - DNA, 35 bp, Artificial Sequence
  Synthetic oligonucleotide
gacgccgcaaccgtgccctcagtctccccatctta

SEQ ID NO: 151135 - DNA, 35 bp, Artificial Sequence
  Synthetic oligonucleotide
acggaacgaagggagagaggaatggggggtgttta

SEQ ID NO: 151136 - DNA, 35 bp, Artificial Sequence
  Synthetic oligonucleotide
tgctggtttctctgtcacttgcccctggtcttcac

SEQ ID NO: 151137 - DNA, 34 bp, Artificial Sequence
  Synthetic oligonucleotide
accctgctgtgttcctttgacgccccctgtatac

SEQ ID NO: 151138 - DNA, 35 bp, Artificial Sequence
  Synthetic oligonucleotide
atgtcgcgtactcgaattgctaatgtttctcctcc

SEQ ID NO: 151139 - DNA, 35 bp, Artificial Sequence
  Synthetic oligonucleotide
attgcctgtcctcgtctcacgtacttagtctctcc

SEQ ID NO: 151140 - DNA, 35 bp, Artificial Sequence
  Synthetic oligonucleotide
gatgtgtgagcacgctacacctctgtcctctgtcc

SEQ ID NO: 151141 - DNA, 35 bp, Artificial Sequence
  Synthetic oligonucleotide
tgtgacgctctgcccgcatttgcacatcccacagc

SEQ ID NO: 151142 - DNA, 35 bp, Artificial Sequence
  Synthetic oligonucleotide
atactgccacatccttcctcctgcaatttgagagc

SEQ ID NO: 151143 - DNA, 35 bp, Artificial Sequence
  Synthetic oligonucleotide
ttgtccactccatcgcatcatctggtcatgcatgc

SEQ ID NO: 151144 - DNA, 35 bp, Artificial Sequence
  Synthetic oligonucleotide
atcccatgcctccattattctcggttacctgcctc

SEQ ID NO: 151145 - DNA, 35 bp, Artificial Sequence
  Synthetic oligonucleotide
tgcacgtgctgacatcgatgacctaccttcccgtc

SEQ ID NO: 151146 - DNA, 35 bp, Artificial Sequence
  Synthetic oligonucleotide
acattgggtggtacgagggtagggtggtgggaaag

SEQ ID NO: 151147 - DNA, 35 bp, Artificial Sequence
  Synthetic oligonucleotide
gggggagccacggtagcggtaataagggggtcggg

SEQ ID NO: 151148 - DNA, 35 bp, Artificial Sequence
  Synthetic oligonucleotide
acgaacttccgacgactccgtgccccctccgctgg

SEQ ID NO: 151149 - DNA, 35 bp, Artificial Sequence
  Synthetic oligonucleotide
tgtgtaagcctcctccccggcccctcgagccattg

SEQ ID NO: 151150 - DNA, 35 bp, Artificial Sequence
  Synthetic oligonucleotide
tcccacagtgacccgtccccagtgacctccccttg

SEQ ID NO: 151151 - DNA, 35 bp, Artificial Sequence
  Synthetic oligonucleotide
agaatgcgctgacccctcttgctcccatctttttg

SEQ ID NO: 151152 - DNA, 36 bp, Artificial Sequence
  Synthetic oligonucleotide
ggtgaatcgaggcacgggagggggactgggggacat

SEQ ID NO: 151153 - DNA, 35 bp, Artificial Sequence
  Synthetic oligonucleotide
ttacagcaatcgtccgcccctctacgctacaccat

SEQ ID NO: 151154 - DNA, 36 bp, Artificial Sequence
  Synthetic oligonucleotide
tccgtgaccctggccttcgaacatctactgtaccat

SEQ ID NO: 151155 - DNA, 35 bp, Artificial Sequence
  Synthetic oligonucleotide
gtccccgccaattcgtagttccctgcttgtgctct

SEQ ID NO: 151156 - DNA, 35 bp, Artificial Sequence
  Synthetic oligonucleotide
tggggaacgggcgggtaagtcgggcggggaaatgt

SEQ ID NO: 151157 - DNA, 35 bp, Artificial Sequence
  Synthetic oligonucleotide
ttcgcaccgccagcgggtctctttcctcacattgt

SEQ ID NO: 151158 - DNA, 35 bp, Artificial Sequence
  Synthetic oligonucleotide
aacctactgctgcctttcctgtcgtcgtcaacatt

SEQ ID NO: 151159 - DNA, 35 bp, Artificial Sequence
  Synthetic oligonucleotide
gtcgcccgccgtatacacctcctcgcgtaggcttt

SEQ ID NO: 151160 - DNA, 35 bp, Artificial Sequence
  Synthetic oligonucleotide
acgccccactagctgcattccgtcgttccctgttt

SEQ ID NO: 151161 - DNA, 35 bp, Artificial Sequence
  Synthetic oligonucleotide
tccccttcttgtcaccatgctgttctatcttgttt

SEQ ID NO: 151162 - DNA, 36 bp, Artificial Sequence
  Synthetic oligonucleotide
aagggacggggaggagtcgggtggcgagttaagtaa

SEQ ID NO: 151163 - DNA, 35 bp, Artificial Sequence
  Synthetic oligonucleotide
gtgcctccctccattcgatcaccgttccgttttaa

SEQ ID NO: 151164 - DNA, 36 bp, Artificial Sequence
  Synthetic oligonucleotide
tacgtgcccctttgccctcatgtccaagccttggca

SEQ ID NO: 151165 - DNA, 36 bp, Artificial Sequence
  Synthetic oligonucleotide
tctacacgtccgtctcccgttatcgcgcaccctgca

SEQ ID NO: 151166 - DNA, 36 bp, Artificial Sequence
  Synthetic oligonucleotide
gaaccgcccccccccgttgatggtatcgctcgatca

SEQ ID NO: 151167 - DNA, 36 bp, Artificial Sequence
  Synthetic oligonucleotide
aaccagtccgcacgtctctcgcgaccacaccactca

SEQ ID NO: 151168 - DNA, 35 bp, Artificial Sequence
  Synthetic oligonucleotide
ttgacgccacccctgagtttttgatttccgcttca

SEQ ID NO: 151169 - DNA, 35 bp, Artificial Sequence
  Synthetic oligonucleotide
tatgagacggggtgggcatcaggggtggggtttca

SEQ ID NO: 151170 - DNA, 37 bp, Artificial Sequence
  Synthetic oligonucleotide
aatcgcacccccggacctgccgcactcccattcgaga

SEQ ID NO: 151171 - DNA, 37 bp, Artificial Sequence
  Synthetic oligonucleotide
gaagtgggggggtgcgggtacataagcagcggggaga

SEQ ID NO: 151172 - DNA, 37 bp, Artificial Sequence
  Synthetic oligonucleotide
atgcatgccttactggtccagcgctcccctacaccga

SEQ ID NO: 151173 - DNA, 37 bp, Artificial Sequence
  Synthetic oligonucleotide
gcacgcccagccgatctactttagcttccctcaccga

SEQ ID NO: 151174 - DNA, 37 bp, Artificial Sequence
  Synthetic oligonucleotide
atccgcctccgccgctctcgtgtcagttctggaccga

SEQ ID NO: 151175 - DNA, 37 bp, Artificial Sequence
  Synthetic oligonucleotide
taccaacgcgcaaggtttcacgcaccccgttccccga

SEQ ID NO: 151176 - DNA, 37 bp, Artificial Sequence
  Synthetic oligonucleotide
taaagtggggggagatgcatggaggaggaactggcga

SEQ ID NO: 151177 - DNA, 37 bp, Artificial Sequence
  Synthetic oligonucleotide
gacgatccgacgtcccgccatcacctaccctctgcga

SEQ ID NO: 151178 - DNA, 37 bp, Artificial Sequence
  Synthetic oligonucleotide
atgggggggatcagcagggggtgcgagatcatgggga

SEQ ID NO: 151179 - DNA, 37 bp, Artificial Sequence
  Synthetic oligonucleotide
acctgcccgctgactcgccgttttaggtaccatctga

SEQ ID NO: 151180 - DNA, 38 bp, Artificial Sequence
  Synthetic oligonucleotide
gcacgggtaacggagggggaggcatagctgacgggtga

SEQ ID NO: 151181 - DNA, 38 bp, Artificial Sequence
  Synthetic oligonucleotide
tcatcgccccgcctcctgacgatccaagaccgccttga

SEQ ID NO: 151182 - DNA, 36 bp, Artificial Sequence
  Synthetic oligonucleotide
gcattgcacgtctgctctgcgaaccggtctcctcta

SEQ ID NO: 151183 - DNA, 36 bp, Artificial Sequence
  Synthetic oligonucleotide
tcctccatccgcttttgtcgttccagtccctttcta

SEQ ID NO: 151184 - DNA, 35 bp, Artificial Sequence
  Synthetic oligonucleotide
ttagcacatggcctgcgctgtccaccttctcgaac

SEQ ID NO: 151185 - DNA, 35 bp, Artificial Sequence
  Synthetic oligonucleotide
acacctcgctggctgacccgcccgctttttggaac

SEQ ID NO: 151186 - DNA, 35 bp, Artificial Sequence
  Synthetic oligonucleotide
gcctactgaggccggtactcctaagcccgtttcac

SEQ ID NO: 151187 - DNA, 35 bp, Artificial Sequence
  Synthetic oligonucleotide
gttagccgggtcctttctgctccaccgtgccctac

SEQ ID NO: 151188 - DNA, 35 bp, Artificial Sequence
  Synthetic oligonucleotide
agcgaacgcgagatattggcccccttcctctcacc

SEQ ID NO: 151189 - DNA, 35 bp, Artificial Sequence
  Synthetic oligonucleotide
tcctccgctcttcatttgcattacgtgcacgaccc

SEQ ID NO: 151190 - DNA, 35 bp, Artificial Sequence
  Synthetic oligonucleotide
tccccaacgtgcgcctcctgcccctttatctaccc

SEQ ID NO: 151191 - DNA, 35 bp, Artificial Sequence
  Synthetic oligonucleotide
ttgaccgttcttacccacccctcgaccttggtgcc

SEQ ID NO: 151192 - DNA, 35 bp, Artificial Sequence
  Synthetic oligonucleotide
tgcctccaccgaccgccacgcgatgaccacttgcc

SEQ ID NO: 151193 - DNA, 35 bp, Artificial Sequence
  Synthetic oligonucleotide
gacatctcgacactgctcctactacacgatttgcc

SEQ ID NO: 151194 - DNA, 35 bp, Artificial Sequence
  Synthetic oligonucleotide
atcacgcgcggggcggaggagtggagtgggggggc

SEQ ID NO: 151195 - DNA, 35 bp, Artificial Sequence
  Synthetic oligonucleotide
gccgacgcatgcccacgccttttgatgatccaatc

SEQ ID NO: 151196 - DNA, 35 bp, Artificial Sequence
  Synthetic oligonucleotide
atctacgtacactcagcatagcccggccgaccctc

SEQ ID NO: 151197 - DNA, 35 bp, Artificial Sequence
  Synthetic oligonucleotide
tcccatcccctgaggccctttctgttccagccctc

SEQ ID NO: 151198 - DNA, 35 bp, Artificial Sequence
  Synthetic oligonucleotide
gaccgaacgcgcgcgctgtcgtgacctgtcccttc

SEQ ID NO: 151199 - DNA, 35 bp, Artificial Sequence
  Synthetic oligonucleotide
gagtaagtagagggcaaacggagggccaggaagag

SEQ ID NO: 151200 - DNA, 35 bp, Artificial Sequence
  Synthetic oligonucleotide
cacacgtaagggagggggatggagaagtgagggtg

SEQ ID NO: 151201 - DNA, 34 bp, Artificial Sequence
  Synthetic oligonucleotide
tgtgtcacgctgattctttagtaacaccccccat

SEQ ID NO: 151202 - DNA, 35 bp, Artificial Sequence
  Synthetic oligonucleotide
tccaccacatcgtctacaactgctgcaatctccat

SEQ ID NO: 151203 - DNA, 33 bp, Artificial Sequence
  Synthetic oligonucleotide
gtgccaccaggtcccctccttcatgcctgtcct

SEQ ID NO: 151204 - DNA, 35 bp, Artificial Sequence
  Synthetic oligonucleotide
actcccgttggcgcgtcccaggctcactcgtctct

SEQ ID NO: 151205 - DNA, 35 bp, Artificial Sequence
  Synthetic oligonucleotide
tccgcactccatcctactgtagtctacctgtctct

SEQ ID NO: 151206 - DNA, 35 bp, Artificial Sequence
  Synthetic oligonucleotide
taaagccgtattcccccgtgcgctgcctattgtct

SEQ ID NO: 151207 - DNA, 35 bp, Artificial Sequence
  Synthetic oligonucleotide
tttttaccgccgcccgcccttcgattgtccgccgt

SEQ ID NO: 151208 - DNA, 35 bp, Artificial Sequence
  Synthetic oligonucleotide
tggaccttccctcagggtttttccacgcttccctt

SEQ ID NO: 151209 - DNA, 35 bp, Artificial Sequence
  Synthetic oligonucleotide
ttcgcctcaatcggttttccttacactccgcccaa

SEQ ID NO: 151210 - DNA, 36 bp, Artificial Sequence
  Synthetic oligonucleotide
atgccactgcctcccctccgcgatcgccactacaca

SEQ ID NO: 151211 - DNA, 35 bp, Artificial Sequence
  Synthetic oligonucleotide
ttcaggtcccgcccccgtttttattccgctcccca

SEQ ID NO: 151212 - DNA, 35 bp, Artificial Sequence
  Synthetic oligonucleotide
gctacctcggacgttatttgcctcccatatgccca

SEQ ID NO: 151213 - DNA, 37 bp, Artificial Sequence
  Synthetic oligonucleotide
gcccctagcctccgttttttttttgccgactcttcca

SEQ ID NO: 151214 - DNA, 35 bp, Artificial Sequence
  Synthetic oligonucleotide
gacccgattccgccccacctccactatggtgagca

SEQ ID NO: 151215 - DNA, 37 bp, Artificial Sequence
  Synthetic oligonucleotide
acaccgtccactaaaccgacccgtcccccgtgcacga

SEQ ID NO: 151216 - DNA, 35 bp, Artificial Sequence
  Synthetic oligonucleotide
actaacaaatgggttgggggcgggagggcaaccga

SEQ ID NO: 151217 - DNA, 37 bp, Artificial Sequence
  Synthetic oligonucleotide
gatcccacccctagttacgacggcccgcctctccgga

SEQ ID NO: 151218 - DNA, 37 bp, Artificial Sequence
  Synthetic oligonucleotide
actcgccgacgggatgttagcctgggagggacgggga

SEQ ID NO: 151219 - DNA, 37 bp, Artificial Sequence
  Synthetic oligonucleotide
aagtgggcgggcgggcggatgtttaggattattggga

SEQ ID NO: 151220 - DNA, 38 bp, Artificial Sequence
  Synthetic oligonucleotide
gcgcacgcaggttggtcttccttgcctccctttactga

SEQ ID NO: 151221 - DNA, 38 bp, Artificial Sequence
  Synthetic oligonucleotide
gtggaacgcacttggggttttgccgctccctcacctga

SEQ ID NO: 151222 - DNA, 37 bp, Artificial Sequence
  Synthetic oligonucleotide
tcccctgcccctaagagccccccttcgctccccgtga

SEQ ID NO: 151223 - DNA, 37 bp, Artificial Sequence
  Synthetic oligonucleotide
tgacgatcaccaggggttgggagtgggaagggcgtga

SEQ ID NO: 151224 - DNA, 37 bp, Artificial Sequence
  Synthetic oligonucleotide
gtgtgtcaaggggcggggcgaaagcagggaaaggtga

SEQ ID NO: 151225 - DNA, 38 bp, Artificial Sequence
  Synthetic oligonucleotide
ttggttgggagtaaggagggtaggaaggtgggtggtga

SEQ ID NO: 151226 - DNA, 37 bp, Artificial Sequence
  Synthetic oligonucleotide
atgtgccgggtggacgggttgggtaggggtaatgtga

SEQ ID NO: 151227 - DNA, 38 bp, Artificial Sequence
  Synthetic oligonucleotide
gctgcccccgccacttctgcactgtcccatagtcttga

SEQ ID NO: 151228 - DNA, 37 bp, Artificial Sequence
  Synthetic oligonucleotide
gtagtccaccgttcctgtcgttcctgcaattgtttga

SEQ ID NO: 151229 - DNA, 36 bp, Artificial Sequence
  Synthetic oligonucleotide
atccccacgcctaatgtctcccatgtaagccttcta

SEQ ID NO: 151230 - DNA, 35 bp, Artificial Sequence
  Synthetic oligonucleotide
aacgtgcacccgcttatggacgcctccctttctta

SEQ ID NO: 151231 - DNA, 35 bp, Artificial Sequence
  Synthetic oligonucleotide
tccatcctgtgggctccatcattcttgttcattta

SEQ ID NO: 151232 - DNA, 36 bp, Artificial Sequence
  Synthetic oligonucleotide
ggttgccccaccattgtcattgttacttctgcttta

SEQ ID NO: 151233 - DNA, 36 bp, Artificial Sequence
  Synthetic oligonucleotide
gcccaaccatacaaccgtgttttgttcctactttta

SEQ ID NO: 151234 - DNA, 35 bp, Artificial Sequence
  Synthetic oligonucleotide
attcccggaaccgccacacgtgatcgcgccttcac

SEQ ID NO: 151235 - DNA, 35 bp, Artificial Sequence
  Synthetic oligonucleotide
gcgacgtcgaagccgacgtctaccggtccttcccc

SEQ ID NO: 151236 - DNA, 35 bp, Artificial Sequence
  Synthetic oligonucleotide
gcgagatgggctccactcctcaccgctctatgtcc

SEQ ID NO: 151237 - DNA, 35 bp, Artificial Sequence
  Synthetic oligonucleotide
atcggtgctgggcgggaggttcggtgagggagggc

SEQ ID NO: 151238 - DNA, 35 bp, Artificial Sequence
  Synthetic oligonucleotide
gatccacatccgcttcgtcatcctacgttccatgc

SEQ ID NO: 151239 - DNA, 35 bp, Artificial Sequence
  Synthetic oligonucleotide
tgtcgtccatgggccccctcatcgtccgctcaatc

SEQ ID NO: 151240 - DNA, 35 bp, Artificial Sequence
  Synthetic oligonucleotide
acgacacccgcccgcttgactctatcctgcctatc

SEQ ID NO: 151241 - DNA, 35 bp, Artificial Sequence
  Synthetic oligonucleotide
ttttgcccgccccaccgatacctccgttagctatc

SEQ ID NO: 151242 - DNA, 35 bp, Artificial Sequence
  Synthetic oligonucleotide
taggatcgcatttgtccgcctgatcacgcccgctc

SEQ ID NO: 151243 - DNA, 35 bp, Artificial Sequence
  Synthetic oligonucleotide
tgccattccaagagtttacccgctgccgatttctc

SEQ ID NO: 151244 - DNA, 35 bp, Artificial Sequence
  Synthetic oligonucleotide
acagtgcccacgttcttcaggtccccccccccttc

SEQ ID NO: 151245 - DNA, 35 bp, Artificial Sequence
  Synthetic oligonucleotide
gccaatgtggtctgtatacgctcccacagcccttc

SEQ ID NO: 151246 - DNA, 35 bp, Artificial Sequence
  Synthetic oligonucleotide
tcccaccgccacatctttgcatatgccctgccacg

SEQ ID NO: 151247 - DNA, 35 bp, Artificial Sequence
  Synthetic oligonucleotide
tcctgtaccacctggcccttgcgcatgtccctacg

SEQ ID NO: 151248 - DNA, 35 bp, Artificial Sequence
  Synthetic oligonucleotide
tgtagggcccccttgctcgcttatctgttttaccg

SEQ ID NO: 151249 - DNA, 35 bp, Artificial Sequence
  Synthetic oligonucleotide
tcccggccaccgttctctgcatctactcttccccg

SEQ ID NO: 151250 - DNA, 35 bp, Artificial Sequence
  Synthetic oligonucleotide
gtgtgatgccctccccccgctagttcccgaagccg

SEQ ID NO: 151251 - DNA, 35 bp, Artificial Sequence
  Synthetic oligonucleotide
gaacggggaaggaagtgggggaggagccagagagg

SEQ ID NO: 151252 - DNA, 35 bp, Artificial Sequence
  Synthetic oligonucleotide
gtgatgggaggggttatttggaagggcgggtgtgg

SEQ ID NO: 151253 - DNA, 35 bp, Artificial Sequence
  Synthetic oligonucleotide
gtatctgcgtcacaccgcatttgcccgtccctctg

SEQ ID NO: 151254 - DNA, 35 bp, Artificial Sequence
  Synthetic oligonucleotide
tcaacacccctcccgtgcccgccaatgtattattg

SEQ ID NO: 151255 - DNA, 35 bp, Artificial Sequence
  Synthetic oligonucleotide
acgtataccctcgcgccggaaccgtttcatcgttg

SEQ ID NO: 151256 - DNA, 35 bp, Artificial Sequence
  Synthetic oligonucleotide
gcacgtatgccctgcccatatatgtaccgtactat

SEQ ID NO: 151257 - DNA, 35 bp, Artificial Sequence
  Synthetic oligonucleotide
gatgcttgaacaagggaagggcagggtggggggct

SEQ ID NO: 151258 - DNA, 35 bp, Artificial Sequence
  Synthetic oligonucleotide
gatgccgtgtccttttcatcttcgctctgttgtct

SEQ ID NO: 151259 - DNA, 35 bp, Artificial Sequence
  Synthetic oligonucleotide
atcgccgtccacccgtttagcctccccacgttctt

SEQ ID NO: 151260 - DNA, 36 bp, Artificial Sequence
  Synthetic oligonucleotide
tgaccctcacgaatatgaactaccgtccccctcgaa

SEQ ID NO: 151261 - DNA, 35 bp, Artificial Sequence
  Synthetic oligonucleotide
accatcacccccctcttgagcctgctcgttcataa

SEQ ID NO: 151262 - DNA, 36 bp, Artificial Sequence
  Synthetic oligonucleotide
tacggaacataggagagaggggggagcagtggttaa

SEQ ID NO: 151263 - DNA, 36 bp, Artificial Sequence
  Synthetic oligonucleotide
atgcccagcacacatgactccgaacgcaaccttcca

SEQ ID NO: 151264 - DNA, 35 bp, Artificial Sequence
  Synthetic oligonucleotide
tttatgcgccatggcccacgtaccttctcactgca

SEQ ID NO: 151265 - DNA, 36 bp, Artificial Sequence
  Synthetic oligonucleotide
tcaccgtcccccgcagcctttgtctaaaacacgtca

SEQ ID NO: 151266 - DNA, 36 bp, Artificial Sequence
  Synthetic oligonucleotide
gagggagggtgaggtgggtgggcgttctgttggaga

SEQ ID NO: 151267 - DNA, 35 bp, Artificial Sequence
  Synthetic oligonucleotide
ttccgaccacccgtcactcgcccactccatgacga

SEQ ID NO: 151268 - DNA, 37 bp, Artificial Sequence
  Synthetic oligonucleotide
gtcgcccaacgcccatccaattgataatgccctacga

SEQ ID NO: 151269 - DNA, 34 bp, Artificial Sequence
  Synthetic oligonucleotide
ggcgccctccgctaatgcacctagcctcccccga

SEQ ID NO: 151270 - DNA, 37 bp, Artificial Sequence
  Synthetic oligonucleotide
gcctcacactcgcctacgtatggcctccccttgccga

SEQ ID NO: 151271 - DNA, 37 bp, Artificial Sequence
  Synthetic oligonucleotide
ataggcggggggtagagaggagggcgcagaaacggga

SEQ ID NO: 151272 - DNA, 37 bp, Artificial Sequence
  Synthetic oligonucleotide
gaccacccgtctacctcctcctgtcttcatccatgga

SEQ ID NO: 151273 - DNA, 36 bp, Artificial Sequence
  Synthetic oligonucleotide
ttgaaacacagggcaaaggggggaggaatgggatga

SEQ ID NO: 151274 - DNA, 37 bp, Artificial Sequence
  Synthetic oligonucleotide
taggggggtggaggaggacttagggtagtaatggtga

SEQ ID NO: 151275 - DNA, 38 bp, Artificial Sequence
  Synthetic oligonucleotide
gtgatcgcccgttttttctggtcctctcactttggtga

SEQ ID NO: 151276 - DNA, 38 bp, Artificial Sequence
  Synthetic oligonucleotide
tgcagggagggaggtaagggggcagattgggactgtga

SEQ ID NO: 151277 - DNA, 38 bp, Artificial Sequence
  Synthetic oligonucleotide
tcaacgcaccgttccctccgccgcctgtacccgattga

SEQ ID NO: 151278 - DNA, 38 bp, Artificial Sequence
  Synthetic oligonucleotide
gcgtacccccgctccatgccttcctcggcgtttattga

SEQ ID NO: 151279 - DNA, 37 bp, Artificial Sequence
  Synthetic oligonucleotide
gtcccacagcatcgtaccgccacgctctctatcttga

SEQ ID NO: 151280 - DNA, 37 bp, Artificial Sequence
  Synthetic oligonucleotide
tcgagaggggcgaactggaggagggaaagcacgttga

SEQ ID NO: 151281 - DNA, 37 bp, Artificial Sequence
  Synthetic oligonucleotide
gcacccattgcttatcgttaccctggcctccatttga

SEQ ID NO: 151282 - DNA, 35 bp, Artificial Sequence
  Synthetic oligonucleotide
gcccttgtccactatggcaatccagtctcccccta

SEQ ID NO: 151283 - DNA, 36 bp, Artificial Sequence
  Synthetic oligonucleotide
gaggacgttcaacccctgccgcgccgttcgccccta

SEQ ID NO: 151284 - DNA, 35 bp, Artificial Sequence
  Synthetic oligonucleotide
acgaaccacttcaccagccgtatacatacttccta

SEQ ID NO: 151285 - DNA, 35 bp, Artificial Sequence
  Synthetic oligonucleotide
ttcgaacgcatttctttgttacctacgctcccgta

SEQ ID NO: 151286 - DNA, 35 bp, Artificial Sequence
  Synthetic oligonucleotide
taacacgtctagcgagctcttcaccggccccttta

SEQ ID NO: 151287 - DNA, 36 bp, Artificial Sequence
  Synthetic oligonucleotide
taccgctttcgcctctctgcccatgctcctcgttta

SEQ ID NO: 151288 - DNA, 36 bp, Artificial Sequence
  Synthetic oligonucleotide
accgcaaaccccatcgtgcattttgcttctatttta

SEQ ID NO: 151289 - DNA, 35 bp, Artificial Sequence
  Synthetic oligonucleotide
atcgctccgcccgtacacccaggttcctggccgac

SEQ ID NO: 151290 - DNA, 35 bp, Artificial Sequence
  Synthetic oligonucleotide
tccagtacgcatgccgagaggacgctgcccacccc

SEQ ID NO: 151291 - DNA, 35 bp, Artificial Sequence
  Synthetic oligonucleotide
gaactgcgccaaattatcgaatttccctggctccc

SEQ ID NO: 151292 - DNA, 35 bp, Artificial Sequence
  Synthetic oligonucleotide
accttgcctccactcccttcgggcgacttttagcc

SEQ ID NO: 151293 - DNA, 35 bp, Artificial Sequence
  Synthetic oligonucleotide
tagacccctacgtgatttcccacaacgaccccgcc

SEQ ID NO: 151294 - DNA, 35 bp, Artificial Sequence
  Synthetic oligonucleotide
actcccgccgttcgcgcttcgtgccatgctattcc

SEQ ID NO: 151295 - DNA, 35 bp, Artificial Sequence
  Synthetic oligonucleotide
gcccaaagtcgaggcccatcctaacgcccgccctc

SEQ ID NO: 151296 - DNA, 35 bp, Artificial Sequence
  Synthetic oligonucleotide
tcgcccaaccgcaaaccatatattcttgagtcctc

SEQ ID NO: 151297 - DNA, 35 bp, Artificial Sequence
  Synthetic oligonucleotide
gtgcatactgccccatcctgtctttgaagtgtctc

SEQ ID NO: 151298 - DNA, 35 bp, Artificial Sequence
  Synthetic oligonucleotide
acacgtcgccatcctttgctctggacatttacttc

SEQ ID NO: 151299 - DNA, 35 bp, Artificial Sequence
  Synthetic oligonucleotide
tcagaccccttaaataatgtccttgcctggccttc

SEQ ID NO: 151300 - DNA, 35 bp, Artificial Sequence
  Synthetic oligonucleotide
acagggggagagaggaagtaatgtagatcaggaag

SEQ ID NO: 151301 - DNA, 35 bp, Artificial Sequence
  Synthetic oligonucleotide
tgccaccctccgttcgggaccgacctccgcccacg

SEQ ID NO: 151302 - DNA, 35 bp, Artificial Sequence
  Synthetic oligonucleotide
gagctcacccgccatgtctgccacgaatatttccg

SEQ ID NO: 151303 - DNA, 35 bp, Artificial Sequence
  Synthetic oligonucleotide
accgaggacacagggtgagaggggaaagacggtgg

SEQ ID NO: 151304 - DNA, 35 bp, Artificial Sequence
  Synthetic oligonucleotide
acgggggggagggtggtaattttggcgaggggatg

SEQ ID NO: 151305 - DNA, 35 bp, Artificial Sequence
  Synthetic oligonucleotide
atgtggtgggacgcaccactatgggtctgactatg

SEQ ID NO: 151306 - DNA, 35 bp, Artificial Sequence
  Synthetic oligonucleotide
tgcccccatactaccagcgcctctatcgggtccct

SEQ ID NO: 151307 - DNA, 35 bp, Artificial Sequence
  Synthetic oligonucleotide
tagtccatccttatgccgctatgccaagtccctct

SEQ ID NO: 151308 - DNA, 35 bp, Artificial Sequence
  Synthetic oligonucleotide
tgcgcatgatcccacctcttcgtctcgttcgcctt

SEQ ID NO: 151309 - DNA, 35 bp, Artificial Sequence
  Synthetic oligonucleotide
acagtggtagcccagccctgattatttgtcctctt

SEQ ID NO: 151310 - DNA, 34 bp, Artificial Sequence
  Synthetic oligonucleotide
gttgccccactgagcgcatattaccctccctgtt

SEQ ID NO: 151311 - DNA, 36 bp, Artificial Sequence
  Synthetic oligonucleotide
gtcaaaacgagccggtgcgggagggtgggtttattt

SEQ ID NO: 151312 - DNA, 36 bp, Artificial Sequence
  Synthetic oligonucleotide
gtgcccgcccccacgcgtcgtagccttccttccgaa

SEQ ID NO: 151313 - DNA, 36 bp, Artificial Sequence
  Synthetic oligonucleotide
tacgcgcctcgcagtctctttgcctttgctcctaca

SEQ ID NO: 151314 - DNA, 35 bp, Artificial Sequence
  Synthetic oligonucleotide
tagcgccctcgctctgccccgttctcaagtctaca

SEQ ID NO: 151315 - DNA, 35 bp, Artificial Sequence
  Synthetic oligonucleotide
gtgtgccccggggagtctatatactgccgccccca

SEQ ID NO: 151316 - DNA, 36 bp, Artificial Sequence
  Synthetic oligonucleotide
gacacgttctatgccaccgcctgaccatcccgccca

SEQ ID NO: 151317 - DNA, 36 bp, Artificial Sequence
  Synthetic oligonucleotide
gccccccccctccgtgagttcaaaatatagtttcca

SEQ ID NO: 151318 - DNA, 34 bp, Artificial Sequence
  Synthetic oligonucleotide
gaatacggggtgggtaagacgtgggtgggacgca

SEQ ID NO: 151319 - DNA, 36 bp, Artificial Sequence
  Synthetic oligonucleotide
gactctcgaccaatgcaccttcaccagccttaggca

SEQ ID NO: 151320 - DNA, 35 bp, Artificial Sequence
  Synthetic oligonucleotide
ttcatacccctccagaccctgttaaatgttcatca

SEQ ID NO: 151321 - DNA, 35 bp, Artificial Sequence
  Synthetic oligonucleotide
atggactcccacacggctcctgctcccggttttca

SEQ ID NO: 151322 - DNA, 37 bp, Artificial Sequence
  Synthetic oligonucleotide
tgcgcccctcccctccgcttacgatgcttcatgcaga

SEQ ID NO: 151323 - DNA, 37 bp, Artificial Sequence
  Synthetic oligonucleotide
gaccacccaccgctcttcattgattatcgtgcaacga

SEQ ID NO: 151324 - DNA, 37 bp, Artificial Sequence
  Synthetic oligonucleotide
tagggcgggatgacggggggggacttgccatgaccga

SEQ ID NO: 151325 - DNA, 36 bp, Artificial Sequence
  Synthetic oligonucleotide
gatgccacccattttttgagcctctccattacccga

SEQ ID NO: 151326 - DNA, 37 bp, Artificial Sequence
  Synthetic oligonucleotide
agtaactccattgcgtttctgacccccgccatcccga

SEQ ID NO: 151327 - DNA, 37 bp, Artificial Sequence
  Synthetic oligonucleotide
tcctccccccgtaagctttaccacacagtattctcga

SEQ ID NO: 151328 - DNA, 37 bp, Artificial Sequence
  Synthetic oligonucleotide
tcgagacgcccattccggaccatcccactgccttcga

SEQ ID NO: 151329 - DNA, 37 bp, Artificial Sequence
  Synthetic oligonucleotide
aacgcgggcgatggtgtcaggtgggagggaatgggga

SEQ ID NO: 151330 - DNA, 38 bp, Artificial Sequence
  Synthetic oligonucleotide
taggagggaaaggaggttgacgggggtggacgttatga

SEQ ID NO: 151331 - DNA, 38 bp, Artificial Sequence
  Synthetic oligonucleotide
accgcccccggatccttctcgccgtgttccctcactga

SEQ ID NO: 151332 - DNA, 38 bp, Artificial Sequence
  Synthetic oligonucleotide
agagacccgaccgacgcctccagtaacatcccccctga

SEQ ID NO: 151333 - DNA, 37 bp, Artificial Sequence
  Synthetic oligonucleotide
tctacgcctatcctctgtcgctatcgtggtcccctga

SEQ ID NO: 151334 - DNA, 37 bp, Artificial Sequence
  Synthetic oligonucleotide
gaccccccgccacccagactagcaggctttggcctga

SEQ ID NO: 151335 - DNA, 38 bp, Artificial Sequence
  Synthetic oligonucleotide
gccgccgtcgtccatcgcctttaatccctgcctgctga

SEQ ID NO: 151336 - DNA, 38 bp, Artificial Sequence
  Synthetic oligonucleotide
acgcgtccaatcgtcctgttcgtgcacttcccctttga

SEQ ID NO: 151337 - DNA, 36 bp, Artificial Sequence
  Synthetic oligonucleotide
gtcgtggccgccttaccggttcctgagttttcccta

SEQ ID NO: 151338 - DNA, 35 bp, Artificial Sequence
  Synthetic oligonucleotide
gtcacccaaccttcaaatttcgcgcctgtttccta

SEQ ID NO: 151339 - DNA, 36 bp, Artificial Sequence
  Synthetic oligonucleotide
tctcgcatgtggtcagcacggcgcccctcccctcta

SEQ ID NO: 151340 - DNA, 35 bp, Artificial Sequence
  Synthetic oligonucleotide
ttaccacgtcctgcctcacctctgcgttgtttcta

SEQ ID NO: 151341 - DNA, 36 bp, Artificial Sequence
  Synthetic oligonucleotide
ttcacacctcagtcccaattgccgccactgtacgta

SEQ ID NO: 151342 - DNA, 36 bp, Artificial Sequence
  Synthetic oligonucleotide
tttagtccaggcggtcctccatcccgttctctcgta

SEQ ID NO: 151343 - DNA, 36 bp, Artificial Sequence
  Synthetic oligonucleotide
gcatgtggttccatcctagtcctgccgttcccttta

SEQ ID NO: 151344 - DNA, 36 bp, Artificial Sequence
  Synthetic oligonucleotide
tcaaacgctccctgccctagttatggccctccttta

SEQ ID NO: 151345 - DNA, 35 bp, Artificial Sequence
  Synthetic oligonucleotide
gactgatcgcatgccgccctttccgttctacccac

SEQ ID NO: 151346 - DNA, 35 bp, Artificial Sequence
  Synthetic oligonucleotide
ttgtcccttccgatcgcgttctgtcaagtcgtcac

SEQ ID NO: 151347 - DNA, 33 bp, Artificial Sequence
  Synthetic oligonucleotide
acatccgagcccactgccgtaccctgaccaccc

SEQ ID NO: 151348 - DNA, 35 bp, Artificial Sequence
  Synthetic oligonucleotide
gccaacccgtaccccctttcttgtcgcgttctgcc

SEQ ID NO: 151349 - DNA, 35 bp, Artificial Sequence
  Synthetic oligonucleotide
aacgctctacgacccccccctgcaccagacttgcc

SEQ ID NO: 151350 - DNA, 35 bp, Artificial Sequence
  Synthetic oligonucleotide
gctacagccgtgcacattttttttcgacctcctcc

SEQ ID NO: 151351 - DNA, 35 bp, Artificial Sequence
  Synthetic oligonucleotide
gccggccccgcatggtatccacacgctctcgctcc

SEQ ID NO: 151352 - DNA, 35 bp, Artificial Sequence
  Synthetic oligonucleotide
tgagcatcagccatcccaaacggctcccctgctcc

SEQ ID NO: 151353 - DNA, 36 bp, Artificial Sequence
  Synthetic oligonucleotide
accgcctcgccgtccctctggttccgcctcccaagc

SEQ ID NO: 151354 - DNA, 34 bp, Artificial Sequence
  Synthetic oligonucleotide
gcctgcgccccccctgctacgtcgatgcaatggc

SEQ ID NO: 151355 - DNA, 35 bp, Artificial Sequence
  Synthetic oligonucleotide
acctcgtaaatgtcctctgttgccactacaccatc

SEQ ID NO: 151356 - DNA, 35 bp, Artificial Sequence
  Synthetic oligonucleotide
agtacgcacgccgtttgagcgctccttccgttatc

SEQ ID NO: 151357 - DNA, 35 bp, Artificial Sequence
  Synthetic oligonucleotide
gatcattgcccctgccgctacttggagcctccctc

SEQ ID NO: 151358 - DNA, 35 bp, Artificial Sequence
  Synthetic oligonucleotide
tccgtgcacgagaacctgcctatctaccgccgctc

SEQ ID NO: 151359 - DNA, 36 bp, Artificial Sequence
  Synthetic oligonucleotide
tctgctgacacacatggggtcagctactgccctctc

SEQ ID NO: 151360 - DNA, 35 bp, Artificial Sequence
  Synthetic oligonucleotide
tagctcacttgtgtcctgtcgttcgtgcctccgtc

SEQ ID NO: 151361 - DNA, 35 bp, Artificial Sequence
  Synthetic oligonucleotide
tgtagtcctccacgtgcacctcacctgcccttgtc

SEQ ID NO: 151362 - DNA, 35 bp, Artificial Sequence
  Synthetic oligonucleotide
acaacgcccgcccagcgcctgtcactcgttacttc

SEQ ID NO: 151363 - DNA, 35 bp, Artificial Sequence
  Synthetic oligonucleotide
tcctgtggaagtttcgtcccgcctttaatgccttc

SEQ ID NO: 151364 - DNA, 35 bp, Artificial Sequence
  Synthetic oligonucleotide
tccaccacataccaggtttatgcttggactccttc

SEQ ID NO: 151365 - DNA, 35 bp, Artificial Sequence
  Synthetic oligonucleotide
acccgcacttacgcgcccatcgccttccccttttc

SEQ ID NO: 151366 - DNA, 35 bp, Artificial Sequence
  Synthetic oligonucleotide
gacattacgcctgccctctctaacgcccctcttag

SEQ ID NO: 151367 - DNA, 35 bp, Artificial Sequence
  Synthetic oligonucleotide
tcgcacccataattcctaccaccgcactgttctcg

SEQ ID NO: 151368 - DNA, 35 bp, Artificial Sequence
  Synthetic oligonucleotide
tcgattagcgggacgcgctgggagggagggtaggg

SEQ ID NO: 151369 - DNA, 35 bp, Artificial Sequence
  Synthetic oligonucleotide
acaccacaccgccttttaccttcccccagtcttgg

SEQ ID NO: 151370 - DNA, 35 bp, Artificial Sequence
  Synthetic oligonucleotide
gtgtccaccgtccttaatatatcatgtccgccgtg

SEQ ID NO: 151371 - DNA, 35 bp, Artificial Sequence
  Synthetic oligonucleotide
gtcaatcgccgtaccctttttacccgcgttccact

SEQ ID NO: 151372 - DNA, 35 bp, Artificial Sequence
  Synthetic oligonucleotide
gaacacggcatttgaattcctctctctccgtacct

SEQ ID NO: 151373 - DNA, 35 bp, Artificial Sequence
  Synthetic oligonucleotide
ggtgtgcagccaccgttattccgaacttcatgcct

SEQ ID NO: 151374 - DNA, 36 bp, Artificial Sequence
  Synthetic oligonucleotide
tgacaccatctctggcccctcaccgcttctgaggct

SEQ ID NO: 151375 - DNA, 35 bp, Artificial Sequence
  Synthetic oligonucleotide
tgcgctcgggtatggttcctacgtctgccctctct

SEQ ID NO: 151376 - DNA, 35 bp, Artificial Sequence
  Synthetic oligonucleotide
ttatagggcggccgaggggggctagaggggaaagt

SEQ ID NO: 151377 - DNA, 36 bp, Artificial Sequence
  Synthetic oligonucleotide
ggagcctccccgccctccagacgtttaccgccgcaa

SEQ ID NO: 151378 - DNA, 36 bp, Artificial Sequence
  Synthetic oligonucleotide
gatgcacgctcgtctataacctccgcttgtcccgaa

SEQ ID NO: 151379 - DNA, 35 bp, Artificial Sequence
  Synthetic oligonucleotide
atccaccgaacgctggtaaagcttccctgttccca

SEQ ID NO: 151380 - DNA, 36 bp, Artificial Sequence
  Synthetic oligonucleotide
tgcctacctagttggtgtctatgcattccccctcca

SEQ ID NO: 151381 - DNA, 36 bp, Artificial Sequence
  Synthetic oligonucleotide
gacccacctctcgattggaaccttgtacccgctcca

SEQ ID NO: 151382 - DNA, 36 bp, Artificial Sequence
  Synthetic oligonucleotide
gtgacagcctgcgcttgtgttcgccgccttgctcca

SEQ ID NO: 151383 - DNA, 36 bp, Artificial Sequence
  Synthetic oligonucleotide
gatcgcaccgcgggatgctgtcaatccgccctatca

SEQ ID NO: 151384 - DNA, 36 bp, Artificial Sequence
  Synthetic oligonucleotide
ggatgtaggcgcctacccgtgctttcgtacctttca

SEQ ID NO: 151385 - DNA, 35 bp, Artificial Sequence
  Synthetic oligonucleotide
gttcacacctccgccactcctttttcgctccaaga

SEQ ID NO: 151386 - DNA, 37 bp, Artificial Sequence
  Synthetic oligonucleotide
gaggtggggtttagggtgggaggtaatgaggaacaga

SEQ ID NO: 151387 - DNA, 37 bp, Artificial Sequence
  Synthetic oligonucleotide
gatgggagggagggagagaggatagtggtggcgcaga

SEQ ID NO: 151388 - DNA, 37 bp, Artificial Sequence
  Synthetic oligonucleotide
tctgaccttcgcatcttgcatccaccccccctggaga

SEQ ID NO: 151389 - DNA, 37 bp, Artificial Sequence
  Synthetic oligonucleotide
gacgagtgagggagaggacgagggagagagagtgaga

SEQ ID NO: 151390 - DNA, 36 bp, Artificial Sequence
  Synthetic oligonucleotide
gccgaccacttgcctccactaccgcgtatctcacga

SEQ ID NO: 151391 - DNA, 37 bp, Artificial Sequence
  Synthetic oligonucleotide
tcacccccccacagttgacaggcccaggacgccccga

SEQ ID NO: 151392 - DNA, 35 bp, Artificial Sequence
  Synthetic oligonucleotide
ttgcgacctctagttcacggcaccccccttcccga

SEQ ID NO: 151393 - DNA, 37 bp, Artificial Sequence
  Synthetic oligonucleotide
gtcacggaaaggtcgggagggggaaggccgggtgcga

SEQ ID NO: 151394 - DNA, 37 bp, Artificial Sequence
  Synthetic oligonucleotide
aaccaccccgtacgatcccatcagcctcacgtttcga

SEQ ID NO: 151395 - DNA, 36 bp, Artificial Sequence
  Synthetic oligonucleotide
agattgggcgggggggatgaactggcccagaaggga

SEQ ID NO: 151396 - DNA, 35 bp, Artificial Sequence
  Synthetic oligonucleotide
gctcagggagatgtccaagtgtgggagggcgggga

SEQ ID NO: 151397 - DNA, 36 bp, Artificial Sequence
  Synthetic oligonucleotide
ttgggagggcgggtattctccatgccagttttggga

SEQ ID NO: 151398 - DNA, 36 bp, Artificial Sequence
  Synthetic oligonucleotide
atcacctcctgccatattaatgaaacacctcctgga

SEQ ID NO: 151399 - DNA, 37 bp, Artificial Sequence
  Synthetic oligonucleotide
gaccctccttgttcctctcgctgtccgatccattgga

SEQ ID NO: 151400 - DNA, 38 bp, Artificial Sequence
  Synthetic oligonucleotide
gtctcgcgcatagtacgcacacactctttccaccttga

SEQ ID NO: 151401 - DNA, 38 bp, Artificial Sequence
  Synthetic oligonucleotide
gaacggtggccatcctgtttcgacccctctctgcttga

SEQ ID NO: 151402 - DNA, 38 bp, Artificial Sequence
  Synthetic oligonucleotide
actcaggagggggcgggtgggttacacgtgggagttga

SEQ ID NO: 151403 - DNA, 37 bp, Artificial Sequence
  Synthetic oligonucleotide
agtaccgtccgccttggtttttagccccaccgtttga

SEQ ID NO: 151404 - DNA, 36 bp, Artificial Sequence
  Synthetic oligonucleotide
gcaacaccagcgatgcatcacacacgctcctccata

SEQ ID NO: 151405 - DNA, 36 bp, Artificial Sequence
  Synthetic oligonucleotide
tgcccctccagcaattatgacgcgctcctttgccta

SEQ ID NO: 151406 - DNA, 36 bp, Artificial Sequence
  Synthetic oligonucleotide
gaccagccccgctcaacgtatctggttccatttcta

SEQ ID NO: 151407 - DNA, 35 bp, Artificial Sequence
  Synthetic oligonucleotide
gcgaccacaacgccgtgactagccctctctataac

SEQ ID NO: 151408 - DNA, 34 bp, Artificial Sequence
  Synthetic oligonucleotide
tctgtgtgccaggctcggtcgccacttattttac

SEQ ID NO: 151409 - DNA, 35 bp, Artificial Sequence
  Synthetic oligonucleotide
tcgctagggctcgaatcgttatcccgtacctcccc

SEQ ID NO: 151410 - DNA, 35 bp, Artificial Sequence
  Synthetic oligonucleotide
acagccacagacactctgccccagtatagcccgcc

SEQ ID NO: 151411 - DNA, 35 bp, Artificial Sequence
  Synthetic oligonucleotide
gtcagccacacaccagttttcctgaccactttgcc

SEQ ID NO: 151412 - DNA, 35 bp, Artificial Sequence
  Synthetic oligonucleotide
ttgagtgcgcatgcccgccccgtatcgtaccatcc

SEQ ID NO: 151413 - DNA, 35 bp, Artificial Sequence
  Synthetic oligonucleotide
caagacccgctggtatgtcactgcccacttgctcc

SEQ ID NO: 151414 - DNA, 35 bp, Artificial Sequence
  Synthetic oligonucleotide
gctgagcactctggtctggtccaccctcagtttcc

SEQ ID NO: 151415 - DNA, 35 bp, Artificial Sequence
  Synthetic oligonucleotide
tgtaaccatcctcccgcctttgtgcgaccataatc

SEQ ID NO: 151416 - DNA, 35 bp, Artificial Sequence
  Synthetic oligonucleotide
agtgcgctcctgcccttcccgtttctgtacccctc

SEQ ID NO: 151417 - DNA, 35 bp, Artificial Sequence
  Synthetic oligonucleotide
tttgtgcccctcggccggacacgttccgctccctc

SEQ ID NO: 151418 - DNA, 35 bp, Artificial Sequence
  Synthetic oligonucleotide
tctaactccgctcatccgttagtcgaaccacctcg

SEQ ID NO: 151419 - DNA, 35 bp, Artificial Sequence
  Synthetic oligonucleotide
gtccatcctctcgttgtaagccctgccgcccaatg

SEQ ID NO: 151420 - DNA, 36 bp, Artificial Sequence
  Synthetic oligonucleotide
tgcgtcgccgcttgtccttcgaggaattccatcctg

SEQ ID NO: 151421 - DNA, 35 bp, Artificial Sequence
  Synthetic oligonucleotide
gactacctggctcctgtctcattatcccgcaacat

SEQ ID NO: 151422 - DNA, 35 bp, Artificial Sequence
  Synthetic oligonucleotide
tctaaccggccatcccccccgaacgagcccactat

SEQ ID NO: 151423 - DNA, 35 bp, Artificial Sequence
  Synthetic oligonucleotide
atctcacctgactgactgtcctcgtacctttctat

SEQ ID NO: 151424 - DNA, 35 bp, Artificial Sequence
  Synthetic oligonucleotide
tgaaccggccctcttgtcataggtctcaccctact

SEQ ID NO: 151425 - DNA, 35 bp, Artificial Sequence
  Synthetic oligonucleotide
gaccgcctgccacacatcttccatacgcccctcct

SEQ ID NO: 151426 - DNA, 35 bp, Artificial Sequence
  Synthetic oligonucleotide
gtcagtgctcgttctagtttttccgcactctcgct

SEQ ID NO: 151427 - DNA, 35 bp, Artificial Sequence
  Synthetic oligonucleotide
aacacgatcaggtttagttctcccactcgcctgct

SEQ ID NO: 151428 - DNA, 35 bp, Artificial Sequence
  Synthetic oligonucleotide
acgaccgtctgctttttaccactgttgacccctct

SEQ ID NO: 151429 - DNA, 35 bp, Artificial Sequence
  Synthetic oligonucleotide
tcacaccgcggatgtctgcctattcccctgcctct

SEQ ID NO: 151430 - DNA, 35 bp, Artificial Sequence
  Synthetic oligonucleotide
cacatggccatattcttgttccaccgcccttacgt

SEQ ID NO: 151431 - DNA, 35 bp, Artificial Sequence
  Synthetic oligonucleotide
acgcctcctccgtttcgtcgccttttgaatctggt

SEQ ID NO: 151432 - DNA, 35 bp, Artificial Sequence
  Synthetic oligonucleotide
gccacttacgtgtaccttgcgccgaacttcacatt

SEQ ID NO: 151433 - DNA, 35 bp, Artificial Sequence
  Synthetic oligonucleotide
tcgatgaccgcattccaagcactgcccgacccctt

SEQ ID NO: 151434 - DNA, 35 bp, Artificial Sequence
  Synthetic oligonucleotide
acaccgacctcgatctacctcccgagtcatcgctt

SEQ ID NO: 151435 - DNA, 35 bp, Artificial Sequence
  Synthetic oligonucleotide
tatcaacggcattgcttgcgccccaacccgctctt

SEQ ID NO: 151436 - DNA, 35 bp, Artificial Sequence
  Synthetic oligonucleotide
gtgcccttccggtgctttattttcatcattctttt

SEQ ID NO: 151437 - DNA, 36 bp, Artificial Sequence
  Synthetic oligonucleotide
acaccccgcttacctttggttctagcccactgaaca

SEQ ID NO: 151438 - DNA, 36 bp, Artificial Sequence
  Synthetic oligonucleotide
gcccctcccacgtgctacctgatagacgcatgcaca

SEQ ID NO: 151439 - DNA, 36 bp, Artificial Sequence
  Synthetic oligonucleotide
gcatgccctcctacgtcctctctaagttgctttaca

SEQ ID NO: 151440 - DNA, 36 bp, Artificial Sequence
  Synthetic oligonucleotide
atgcccacccatccgcctcgaccggtagttaactca

SEQ ID NO: 151441 - DNA, 37 bp, Artificial Sequence
  Synthetic oligonucleotide
gaagggtgggaaggtgggtaaatcgagtgtggaccga

SEQ ID NO: 151442 - DNA, 37 bp, Artificial Sequence
  Synthetic oligonucleotide
ggtgcccagcgcggtatcacacacctcctacccccga

SEQ ID NO: 151443 - DNA, 37 bp, Artificial Sequence
  Synthetic oligonucleotide
tgcccgccgcactccttattcatgccaccgttatcga

SEQ ID NO: 151444 - DNA, 36 bp, Artificial Sequence
  Synthetic oligonucleotide
ccacaccccacgtgttcgggtcctccctttattcga

SEQ ID NO: 151445 - DNA, 37 bp, Artificial Sequence
  Synthetic oligonucleotide
ttgcacggatgcttaacggggggaaggagggacggga

SEQ ID NO: 151446 - DNA, 37 bp, Artificial Sequence
  Synthetic oligonucleotide
accgatccgccactcttttaattaccatccagctgga

SEQ ID NO: 151447 - DNA, 35 bp, Artificial Sequence
  Synthetic oligonucleotide
gctaaggaggggaaaaggatgagggatagattgga

SEQ ID NO: 151448 - DNA, 37 bp, Artificial Sequence
  Synthetic oligonucleotide
taaccccccgcaccgtggtactacccttgatccatga

SEQ ID NO: 151449 - DNA, 36 bp, Artificial Sequence
  Synthetic oligonucleotide
ggacagagccgcattaggcccaccgcccacccctga

SEQ ID NO: 151450 - DNA, 37 bp, Artificial Sequence
  Synthetic oligonucleotide
atgggcggggggaaaagcatgggatggagtggagtga

SEQ ID NO: 151451 - DNA, 38 bp, Artificial Sequence
  Synthetic oligonucleotide
gacatggaaggggaggcaaggggtgtaggaaggcgtga

SEQ ID NO: 151452 - DNA, 37 bp, Artificial Sequence
  Synthetic oligonucleotide
ttgggagatggggcggaggaaattaagggtacggtga

SEQ ID NO: 151453 - DNA, 38 bp, Artificial Sequence
  Synthetic oligonucleotide
atgtcggaggaagggagaggcgaagggaaggtgggtga

SEQ ID NO: 151454 - DNA, 38 bp, Artificial Sequence
  Synthetic oligonucleotide
acccccccctctggacttcgtatcgaacatcatattga

SEQ ID NO: 151455 - DNA, 35 bp, Artificial Sequence
  Synthetic oligonucleotide
tcccggtcacccctagccttcaacgagcctgcata

SEQ ID NO: 151456 - DNA, 36 bp, Artificial Sequence
  Synthetic oligonucleotide
tagcaagcccgcaccacgctgtagtcacctctcgta

SEQ ID NO: 151457 - DNA, 36 bp, Artificial Sequence
  Synthetic oligonucleotide
gacgcgaccctgccctcgtagctgtcgtgcccttta

SEQ ID NO: 151458 - DNA, 36 bp, Artificial Sequence
  Synthetic oligonucleotide
ggtatacatgcgggtgaggcggggggggtgagttta

SEQ ID NO: 151459 - DNA, 35 bp, Artificial Sequence
  Synthetic oligonucleotide
tgacgccctcctgcgttccactccaactgtcccac

SEQ ID NO: 151460 - DNA, 35 bp, Artificial Sequence
  Synthetic oligonucleotide
acaccggggcctccactgcattcgtccttccggac

SEQ ID NO: 151461 - DNA, 35 bp, Artificial Sequence
  Synthetic oligonucleotide
gaggccgacgggccgccttcgatcttcacctcacc

SEQ ID NO: 151462 - DNA, 35 bp, Artificial Sequence
  Synthetic oligonucleotide
gtgacgtttcccccctgagctaagcatcttcaccc

SEQ ID NO: 151463 - DNA, 35 bp, Artificial Sequence
  Synthetic oligonucleotide
gtaccgcgaggtacccgttaaactgatcacgcccc

SEQ ID NO: 151464 - DNA, 35 bp, Artificial Sequence
  Synthetic oligonucleotide
gtccgtgaacgcctctaatatatatgctgtcagcc

SEQ ID NO: 151465 - DNA, 35 bp, Artificial Sequence
  Synthetic oligonucleotide
gagcacgaccacaccgtttctcccttggctaggcc

SEQ ID NO: 151466 - DNA, 35 bp, Artificial Sequence
  Synthetic oligonucleotide
tgaccctcgcaccacgttacacatcctccggtgcc

SEQ ID NO: 151467 - DNA, 35 bp, Artificial Sequence
  Synthetic oligonucleotide
taaggtgcactcgtttctgcctcctgttgtttgcc

SEQ ID NO: 151468 - DNA, 35 bp, Artificial Sequence
  Synthetic oligonucleotide
tatttcaccatccgttgccagagcgccgctaatcc

SEQ ID NO: 151469 - DNA, 35 bp, Artificial Sequence
  Synthetic oligonucleotide
gtcacaacaatggccatcagttgcatccccaccgc

SEQ ID NO: 151470 - DNA, 35 bp, Artificial Sequence
  Synthetic oligonucleotide
aagccgaccgcatctgctccatctctgcaccccgc

SEQ ID NO: 151471 - DNA, 35 bp, Artificial Sequence
  Synthetic oligonucleotide
acaccggccggtgctccccattgctcacacttcgc

SEQ ID NO: 151472 - DNA, 35 bp, Artificial Sequence
  Synthetic oligonucleotide
gctgggagggtcggggggggcctactggaacgggc

SEQ ID NO: 151473 - DNA, 33 bp, Artificial Sequence
  Synthetic oligonucleotide
gacgcatccccggtttcttgtgctgctactggc

SEQ ID NO: 151474 - DNA, 35 bp, Artificial Sequence
  Synthetic oligonucleotide
catgatccgccactccctgctcttaagtttcactc

SEQ ID NO: 151475 - DNA, 35 bp, Artificial Sequence
  Synthetic oligonucleotide
tgccgcacttgtactcagcttacacatcttcgctc

SEQ ID NO: 151476 - DNA, 35 bp, Artificial Sequence
  Synthetic oligonucleotide
ggggggatggtggcctgagcgggaagggggtcgtc

SEQ ID NO: 151477 - DNA, 35 bp, Artificial Sequence
  Synthetic oligonucleotide
tgattcccgcgccccccttgcgtaccacactgttc

SEQ ID NO: 151478 - DNA, 35 bp, Artificial Sequence
  Synthetic oligonucleotide
tcaaagagcgtatcgtgccacttcttccgcctttc

SEQ ID NO: 151479 - DNA, 35 bp, Artificial Sequence
  Synthetic oligonucleotide
taccccgcatcaagtttttgcccctcacagcttag

SEQ ID NO: 151480 - DNA, 35 bp, Artificial Sequence
  Synthetic oligonucleotide
cccgcacgttgcagaacgtccgtcgcccacccccg

SEQ ID NO: 151481 - DNA, 35 bp, Artificial Sequence
  Synthetic oligonucleotide
atcgcccccatcccattgttgtcattgcccacgcg

SEQ ID NO: 151482 - DNA, 35 bp, Artificial Sequence
  Synthetic oligonucleotide
ttccatccccctttctgctacgagacctgcttcat

SEQ ID NO: 151483 - DNA, 35 bp, Artificial Sequence
  Synthetic oligonucleotide
actctacaccaccgcccgctcgcagtgtatcacct

SEQ ID NO: 151484 - DNA, 35 bp, Artificial Sequence
  Synthetic oligonucleotide
ggatgtcaccgctcccctaagtctactttgatcct

SEQ ID NO: 151485 - DNA, 35 bp, Artificial Sequence
  Synthetic oligonucleotide
accgcggtctcattttcgggccccttcacactgct

SEQ ID NO: 151486 - DNA, 35 bp, Artificial Sequence
  Synthetic oligonucleotide
gtgaacacccgacacccgatcggcatcattcctct

SEQ ID NO: 151487 - DNA, 35 bp, Artificial Sequence
  Synthetic oligonucleotide
tccgggagggaggggagaggaaacgggtagggtct

SEQ ID NO: 151488 - DNA, 35 bp, Artificial Sequence
  Synthetic oligonucleotide
tgaaccggtcccctttgcatccctggacttcttct

SEQ ID NO: 151489 - DNA, 35 bp, Artificial Sequence
  Synthetic oligonucleotide
ggtgccctggcctcccctgtctgatctctcctagt

SEQ ID NO: 151490 - DNA, 35 bp, Artificial Sequence
  Synthetic oligonucleotide
tccccacgcctcttgccctcctcatagtacctcgt

SEQ ID NO: 151491 - DNA, 35 bp, Artificial Sequence
  Synthetic oligonucleotide
gctccgatcgcgactgttgtagccccttccctcgt

SEQ ID NO: 151492 - DNA, 35 bp, Artificial Sequence
  Synthetic oligonucleotide
tcaaccgactcatcctcttgtatggcacctcttgt

SEQ ID NO: 151493 - DNA, 36 bp, Artificial Sequence
  Synthetic oligonucleotide
ttgcataagcctgttcgctccttcggtcctgttatt

SEQ ID NO: 151494 - DNA, 35 bp, Artificial Sequence
  Synthetic oligonucleotide
gcagtggggagaaggcggggggaccagggatgctt

SEQ ID NO: 151495 - DNA, 35 bp, Artificial Sequence
  Synthetic oligonucleotide
tccttgcggactgtacacctgtttggccccccgtt

SEQ ID NO: 151496 - DNA, 35 bp, Artificial Sequence
  Synthetic oligonucleotide
gggagccgctcccatccggattggtccatctcgtt

SEQ ID NO: 151497 - DNA, 35 bp, Artificial Sequence
  Synthetic oligonucleotide
tactatgcagcccgccgtctccgtcttcgcgcttt

SEQ ID NO: 151498 - DNA, 36 bp, Artificial Sequence
  Synthetic oligonucleotide
ttgaactcccgccctgtgacgtcgcgactatcctaa

SEQ ID NO: 151499 - DNA, 35 bp, Artificial Sequence
  Synthetic oligonucleotide
atgacgtcacatggttcccgtcttctcccgcttaa

SEQ ID NO: 151500 - DNA, 35 bp, Artificial Sequence
  Synthetic oligonucleotide
atgccacctagcgggcgttgggtgggtgggcaaca

SEQ ID NO: 151501 - DNA, 36 bp, Artificial Sequence
  Synthetic oligonucleotide
actgccctcgccataagtctgccatccgctactaca

SEQ ID NO: 151502 - DNA, 36 bp, Artificial Sequence
  Synthetic oligonucleotide
acctgaaccgcacaatctgcccaacgcccttttaca

SEQ ID NO: 151503 - DNA, 35 bp, Artificial Sequence
  Synthetic oligonucleotide
cctacgcctccctgctctagaccgtctggtcacca

SEQ ID NO: 151504 - DNA, 36 bp, Artificial Sequence
  Synthetic oligonucleotide
ttagccacatccctccgttacaaggtcttggcccca

SEQ ID NO: 151505 - DNA, 36 bp, Artificial Sequence
  Synthetic oligonucleotide
acgtccgtagctttagcctcccgccctgacttccca

SEQ ID NO: 151506 - DNA, 36 bp, Artificial Sequence
  Synthetic oligonucleotide
tcttacaccacaccattccccgcgcagatgtcctca

SEQ ID NO: 151507 - DNA, 36 bp, Artificial Sequence
  Synthetic oligonucleotide
gcactccagccttccagcctatactcacgcttttca

SEQ ID NO: 151508 - DNA, 37 bp, Artificial Sequence
  Synthetic oligonucleotide
tcgcggggaaagggcgggaaaactaaggtggagcaga

SEQ ID NO: 151509 - DNA, 37 bp, Artificial Sequence
  Synthetic oligonucleotide
ggttgacgggggaggaaggaatggggcggtttagcga

SEQ ID NO: 151510 - DNA, 37 bp, Artificial Sequence
  Synthetic oligonucleotide
gagacgggtgtggacgggcaagggagtcagaggtcga

SEQ ID NO: 151511 - DNA, 37 bp, Artificial Sequence
  Synthetic oligonucleotide
gaagggggggtgggggacggagtgcgacgcatacgga

SEQ ID NO: 151512 - DNA, 37 bp, Artificial Sequence
  Synthetic oligonucleotide
ggagggacggaggggggcggaaggtttgaaatctgga

SEQ ID NO: 151513 - DNA, 38 bp, Artificial Sequence
  Synthetic oligonucleotide
tgcgggggggatgggtgtgggacgcgaacacacaatga

SEQ ID NO: 151514 - DNA, 36 bp, Artificial Sequence
  Synthetic oligonucleotide
gcccctccgccagtcttcctctcaaccgccgcatga

SEQ ID NO: 151515 - DNA, 37 bp, Artificial Sequence
  Synthetic oligonucleotide
gcgaatccatcttccactcacccccgccctgggctga

SEQ ID NO: 151516 - DNA, 37 bp, Artificial Sequence
  Synthetic oligonucleotide
tactagcgagggggcgggagtacggtaagggatgtga

SEQ ID NO: 151517 - DNA, 38 bp, Artificial Sequence
  Synthetic oligonucleotide
tgaaggcaagtgggagggggaggagtgcaatgatgtga

SEQ ID NO: 151518 - DNA, 38 bp, Artificial Sequence
  Synthetic oligonucleotide
gacccgtcatgggaagggagggaaatgagtgggtgtga

SEQ ID NO: 151519 - DNA, 38 bp, Artificial Sequence
  Synthetic oligonucleotide
tatcacccgcacatgtttcccatcacctaagcccttga

SEQ ID NO: 151520 - DNA, 38 bp, Artificial Sequence
  Synthetic oligonucleotide
tgccacgtcccgactcggacgccccctcttcgccttga

SEQ ID NO: 151521 - DNA, 38 bp, Artificial Sequence
  Synthetic oligonucleotide
tcgggggagggctgcattggggatagtcggggtcttga

SEQ ID NO: 151522 - DNA, 36 bp, Artificial Sequence
  Synthetic oligonucleotide
ggtacctcctgcccctctctccaatgagcctgttga

SEQ ID NO: 151523 - DNA, 36 bp, Artificial Sequence
  Synthetic oligonucleotide
actcatccgccaccccacacgtcatgcaggaccata

SEQ ID NO: 151524 - DNA, 36 bp, Artificial Sequence
  Synthetic oligonucleotide
ttgaccatcccccagttacagtagcgaaccacccta

SEQ ID NO: 151525 - DNA, 36 bp, Artificial Sequence
  Synthetic oligonucleotide
tcttacgtcgcgcgtattactcttcacgccccccta

SEQ ID NO: 151526 - DNA, 36 bp, Artificial Sequence
  Synthetic oligonucleotide
aacgacaagagggggggtggggcgagcataggtgta

SEQ ID NO: 151527 - DNA, 36 bp, Artificial Sequence
  Synthetic oligonucleotide
gctcacgtcatggattcttcccccctgttcacgtta

SEQ ID NO: 151528 - DNA, 36 bp, Artificial Sequence
  Synthetic oligonucleotide
tgccaccgctcgccccaattccctgctgcatggtta

SEQ ID NO: 151529 - DNA, 35 bp, Artificial Sequence
  Synthetic oligonucleotide
gggggggaaggggaagggatagtgaatatgtttta

SEQ ID NO: 151530 - DNA, 35 bp, Artificial Sequence
  Synthetic oligonucleotide
tgccacctacagtcccttcacggcttctctataac

SEQ ID NO: 151531 - DNA, 35 bp, Artificial Sequence
  Synthetic oligonucleotide
aacccacctagcctcgttaagatcgagcctaacac

SEQ ID NO: 151532 - DNA, 35 bp, Artificial Sequence
  Synthetic oligonucleotide
tattcgcccgtcatgtatctccgccgtagcctcac

SEQ ID NO: 151533 - DNA, 35 bp, Artificial Sequence
  Synthetic oligonucleotide
ttcagctccgtgcccccttgcgatgcttcctcgac

SEQ ID NO: 151534 - DNA, 35 bp, Artificial Sequence
  Synthetic oligonucleotide
acccctgcccggtcggtaacatgttctacccaccc

SEQ ID NO: 151535 - DNA, 35 bp, Artificial Sequence
  Synthetic oligonucleotide
tccaacgtctggcactatcccatcctcacggcccc

SEQ ID NO: 151536 - DNA, 35 bp, Artificial Sequence
  Synthetic oligonucleotide
tgaccgtgcagagcctaaccgatacattgccgccc

SEQ ID NO: 151537 - DNA, 35 bp, Artificial Sequence
  Synthetic oligonucleotide
tcaccgaatacctgctccctgagtaaggcccttcc

SEQ ID NO: 151538 - DNA, 35 bp, Artificial Sequence
  Synthetic oligonucleotide
tgacgatgccacctgccaacaacacgacttttcgc

SEQ ID NO: 151539 - DNA, 35 bp, Artificial Sequence
  Synthetic oligonucleotide
agctaaccggacagctgccgttcccttcttcatgc

SEQ ID NO: 151540 - DNA, 35 bp, Artificial Sequence
  Synthetic oligonucleotide
gccacgtggtgctgccctccctggtcccggtttgc

SEQ ID NO: 151541 - DNA, 35 bp, Artificial Sequence
  Synthetic oligonucleotide
agactcggcctttgcgcccaactgccctttcactc

SEQ ID NO: 151542 - DNA, 35 bp, Artificial Sequence
  Synthetic oligonucleotide
atgatcgcagaggtgccaactccttatgctgcctc

SEQ ID NO: 151543 - DNA, 35 bp, Artificial Sequence
  Synthetic oligonucleotide
ggatgccactatcgcgcaattagtcgctgcctctc

SEQ ID NO: 151544 - DNA, 35 bp, Artificial Sequence
  Synthetic oligonucleotide
tccgatccaccgccgtatctcggttgactaacttc

SEQ ID NO: 151545 - DNA, 35 bp, Artificial Sequence
  Synthetic oligonucleotide
gcaacatccgcagccccatctcagcgctctcgttc

SEQ ID NO: 151546 - DNA, 35 bp, Artificial Sequence
  Synthetic oligonucleotide
ttcgcgaacgcatcgaactcatcccggtccctttc

SEQ ID NO: 151547 - DNA, 35 bp, Artificial Sequence
  Synthetic oligonucleotide
acgccgacctctcgcacgatacttgttacgctttc

SEQ ID NO: 151548 - DNA, 35 bp, Artificial Sequence
  Synthetic oligonucleotide
tgtgcgccctgccctattagtacctgacccctgag

SEQ ID NO: 151549 - DNA, 35 bp, Artificial Sequence
  Synthetic oligonucleotide
atcactgccactgaaacctcgcctccgactttgag

SEQ ID NO: 151550 - DNA, 35 bp, Artificial Sequence
  Synthetic oligonucleotide
tgttcccgtcctgcccattttgcgttctgcacgcg

SEQ ID NO: 151551 - DNA, 36 bp, Artificial Sequence
  Synthetic oligonucleotide
gaccacatccccgtattcacccaatcgatgcaatcg

SEQ ID NO: 151552 - DNA, 35 bp, Artificial Sequence
  Synthetic oligonucleotide
ttagggggcggacggggctaggggcggacattcgg

SEQ ID NO: 151553 - DNA, 33 bp, Artificial Sequence
  Synthetic oligonucleotide
gcagtgcggcaacgggaaggggtggggcgtggg

SEQ ID NO: 151554 - DNA, 35 bp, Artificial Sequence
  Synthetic oligonucleotide
gcctgggtacctcactgttctaccgttctccgatg

SEQ ID NO: 151555 - DNA, 35 bp, Artificial Sequence
  Synthetic oligonucleotide
gccctgtacttgccatatgatcccttccttgactg

SEQ ID NO: 151556 - DNA, 35 bp, Artificial Sequence
  Synthetic oligonucleotide
tactacccccagctgctctgttgatcccccctctg

SEQ ID NO: 151557 - DNA, 35 bp, Artificial Sequence
  Synthetic oligonucleotide
gcaacgatgcccctagttgcgtttcatcttttttg

SEQ ID NO: 151558 - DNA, 33 bp, Artificial Sequence
  Synthetic oligonucleotide
acaccccacagtgcatcatagttcctacgcact

SEQ ID NO: 151559 - DNA, 35 bp, Artificial Sequence
  Synthetic oligonucleotide
gagtgcacgtgccgccgcgacccgcccatttccct

SEQ ID NO: 151560 - DNA, 35 bp, Artificial Sequence
  Synthetic oligonucleotide
tcgagcccttctttggtctactatgctcccaatct

SEQ ID NO: 151561 - DNA, 35 bp, Artificial Sequence
  Synthetic oligonucleotide
gagctctagccccgttaatggcccccccgtcccgt

SEQ ID NO: 151562 - DNA, 35 bp, Artificial Sequence
  Synthetic oligonucleotide
gcacacgtgggcgggaggggggcctcgaagacctt

SEQ ID NO: 151563 - DNA, 35 bp, Artificial Sequence
  Synthetic oligonucleotide
gcaatcaggtcaagcaccttagcccacgatccctt

SEQ ID NO: 151564 - DNA, 35 bp, Artificial Sequence
  Synthetic oligonucleotide
tggtgggtcccacctatcgccccggttatctcctt

SEQ ID NO: 151565 - DNA, 35 bp, Artificial Sequence
  Synthetic oligonucleotide
tgccctggtgccgccactcgcttcctttcatcttt

SEQ ID NO: 151566 - DNA, 35 bp, Artificial Sequence
  Synthetic oligonucleotide
tttcgcgcgacccgttccaaggcactcccccgttt

SEQ ID NO: 151567 - DNA, 35 bp, Artificial Sequence
  Synthetic oligonucleotide
acggagccacactgcattgaccgccgactccgttt

SEQ ID NO: 151568 - DNA, 36 bp, Artificial Sequence
  Synthetic oligonucleotide
taaccacccgcacactgtatgccactatacacaaca

SEQ ID NO: 151569 - DNA, 35 bp, Artificial Sequence
  Synthetic oligonucleotide
atgccccagtagcgtatttcgcgccatcttgcaca

SEQ ID NO: 151570 - DNA, 36 bp, Artificial Sequence
  Synthetic oligonucleotide
gaagccgccactcgtgtctgcatttaccctacgcca

SEQ ID NO: 151571 - DNA, 36 bp, Artificial Sequence
  Synthetic oligonucleotide
gtgtgccccaatgctctatctaagcctgcatctgca

SEQ ID NO: 151572 - DNA, 35 bp, Artificial Sequence
  Synthetic oligonucleotide
agcggacgccgcgctctttaacctttctgtcctca

SEQ ID NO: 151573 - DNA, 35 bp, Artificial Sequence
  Synthetic oligonucleotide
atcggaggtcacggtggggcggaggacggatttca

SEQ ID NO: 151574 - DNA, 37 bp, Artificial Sequence
  Synthetic oligonucleotide
gacaccatcattgcgctctcgaagcttacttccacga

SEQ ID NO: 151575 - DNA, 38 bp, Artificial Sequence
  Synthetic oligonucleotide
gggaagggatggggggggccggctgtaaggcgtcacga

SEQ ID NO: 151576 - DNA, 36 bp, Artificial Sequence
  Synthetic oligonucleotide
ttgcggccctgttgcctattccaccacctgttccga

SEQ ID NO: 151577 - DNA, 37 bp, Artificial Sequence
  Synthetic oligonucleotide
gatacctgccgcacgttttctatgcaacttctcgcga

SEQ ID NO: 151578 - DNA, 37 bp, Artificial Sequence
  Synthetic oligonucleotide
tgacgagacacgtggaggagaagtatggaccaaggga

SEQ ID NO: 151579 - DNA, 35 bp, Artificial Sequence
  Synthetic oligonucleotide
tgcaacgggccggaagtaggtggaacgtgggggga

SEQ ID NO: 151580 - DNA, 37 bp, Artificial Sequence
  Synthetic oligonucleotide
gagggggcaaagcatacgaggggaggggtggtgggga

SEQ ID NO: 151581 - DNA, 38 bp, Artificial Sequence
  Synthetic oligonucleotide
gtgccacctcattagccatacgttctagcccaccatga

SEQ ID NO: 151582 - DNA, 35 bp, Artificial Sequence
  Synthetic oligonucleotide
tgcctgcgcaacatcgcactgcacccacatcctga

SEQ ID NO: 151583 - DNA, 38 bp, Artificial Sequence
  Synthetic oligonucleotide
gttcgcccatcggtcagttccttctctgtttcccgtga

SEQ ID NO: 151584 - DNA, 36 bp, Artificial Sequence
  Synthetic oligonucleotide
gcaatcatgggagggcggacaaggggaaggaattga

SEQ ID NO: 151585 - DNA, 35 bp, Artificial Sequence
  Synthetic oligonucleotide
ttccgctgagcccgcgtatccatgcttcctccata

SEQ ID NO: 151586 - DNA, 35 bp, Artificial Sequence
  Synthetic oligonucleotide
tctctgcccggcaccattccgttctgttgcccaac

SEQ ID NO: 151587 - DNA, 35 bp, Artificial Sequence
  Synthetic oligonucleotide
gacctcccatgtatcagtgcgaatcactgccccac

SEQ ID NO: 151588 - DNA, 35 bp, Artificial Sequence
  Synthetic oligonucleotide
gtgtgcccgcccgcctgtcggattttcacctaacc

SEQ ID NO: 151589 - DNA, 35 bp, Artificial Sequence
  Synthetic oligonucleotide
acatgcgcctgttgcgacaagcacctccgtccacc

SEQ ID NO: 151590 - DNA, 35 bp, Artificial Sequence
  Synthetic oligonucleotide
ggataccgacaaggtataaccgtgtccctcgcccc

SEQ ID NO: 151591 - DNA, 35 bp, Artificial Sequence
  Synthetic oligonucleotide
gagctccctcctcgtggtcaaaatcttagtgcccc

SEQ ID NO: 151592 - DNA, 35 bp, Artificial Sequence
  Synthetic oligonucleotide
gaggaccgtctatgttcccttacctactcctagcc

SEQ ID NO: 151593 - DNA, 35 bp, Artificial Sequence
  Synthetic oligonucleotide
tcatcctgatcgcaccaacctgtactacgtcctcc

SEQ ID NO: 151594 - DNA, 35 bp, Artificial Sequence
  Synthetic oligonucleotide
gcccgcaagtgttcacccccatcgtacgtccttcc

SEQ ID NO: 151595 - DNA, 35 bp, Artificial Sequence
  Synthetic oligonucleotide
tgctccgttacacctttcaagcgctgacactacgc

SEQ ID NO: 151596 - DNA, 35 bp, Artificial Sequence
  Synthetic oligonucleotide
agctctgtcccccagcattttcgacctaccaccgc

SEQ ID NO: 151597 - DNA, 35 bp, Artificial Sequence
  Synthetic oligonucleotide
acagcacgctcgcacactgttccaccgcccgccgc

SEQ ID NO: 151598 - DNA, 35 bp, Artificial Sequence
  Synthetic oligonucleotide
gcgtgctgttctgatacgcgccccccgtccactgc

SEQ ID NO: 151599 - DNA, 35 bp, Artificial Sequence
  Synthetic oligonucleotide
gttgatcagccgaccctcccagtaatcgatgcctc

SEQ ID NO: 151600 - DNA, 35 bp, Artificial Sequence
  Synthetic oligonucleotide
gcactgtgttgactgctacccgactcccacctctc

SEQ ID NO: 151601 - DNA, 35 bp, Artificial Sequence
  Synthetic oligonucleotide
actccatgtgttcacctcccgggatctccgctctc

SEQ ID NO: 151602 - DNA, 35 bp, Artificial Sequence
  Synthetic oligonucleotide
ggagatccgcgcacatctttcattctggtcaattc

SEQ ID NO: 151603 - DNA, 35 bp, Artificial Sequence
  Synthetic oligonucleotide
gcatcatagagcgccatccccgcccgccaaccttc

SEQ ID NO: 151604 - DNA, 35 bp, Artificial Sequence
  Synthetic oligonucleotide
acatccatctccactctggcttggtgcatatcttc

SEQ ID NO: 151605 - DNA, 35 bp, Artificial Sequence
  Synthetic oligonucleotide
atacgcccaaccccatcagctttacagacgcccgg

SEQ ID NO: 151606 - DNA, 35 bp, Artificial Sequence
  Synthetic oligonucleotide
acgagggttagtgggctgaggaacggataggaggg

SEQ ID NO: 151607 - DNA, 35 bp, Artificial Sequence
  Synthetic oligonucleotide
tcagccctaatccgcccgcctatcctttgttcctg

SEQ ID NO: 151608 - DNA, 35 bp, Artificial Sequence
  Synthetic oligonucleotide
gactccgccatatacctggtctctatcgcattctg

SEQ ID NO: 151609 - DNA, 35 bp, Artificial Sequence
  Synthetic oligonucleotide
gctgggcgggggagggttgggcggtcgatgtggtg

SEQ ID NO: 151610 - DNA, 35 bp, Artificial Sequence
  Synthetic oligonucleotide
agacagtgcgggagcggggggcgagggccatgtat

SEQ ID NO: 151611 - DNA, 35 bp, Artificial Sequence
  Synthetic oligonucleotide
gccttaccaacgccggccccaatttgccctgaact

SEQ ID NO: 151612 - DNA, 35 bp, Artificial Sequence
  Synthetic oligonucleotide
tcctacgcctggatcggcctaaatactcacacact

SEQ ID NO: 151613 - DNA, 35 bp, Artificial Sequence
  Synthetic oligonucleotide
tccgatccatctcttctgacacagattgcgcacct

SEQ ID NO: 151614 - DNA, 35 bp, Artificial Sequence
  Synthetic oligonucleotide
ccattgcctgcgccgccctttaggctcttattcct

SEQ ID NO: 151615 - DNA, 35 bp, Artificial Sequence
  Synthetic oligonucleotide
agaagacgcgggtgggtggagggcaaacgggggct

SEQ ID NO: 151616 - DNA, 35 bp, Artificial Sequence
  Synthetic oligonucleotide
acagattcgatcctgctgcctaaacctgttcctct

SEQ ID NO: 151617 - DNA, 35 bp, Artificial Sequence
  Synthetic oligonucleotide
gtttcccatcctgcgcccgtatctatcacgcctgt

SEQ ID NO: 151618 - DNA, 35 bp, Artificial Sequence
  Synthetic oligonucleotide
ggtacgcaaacgctccacgcttctccacattctgt

SEQ ID NO: 151619 - DNA, 35 bp, Artificial Sequence
  Synthetic oligonucleotide
gccctctgcctgcaggtccttatatactaaccctt

SEQ ID NO: 151620 - DNA, 35 bp, Artificial Sequence
  Synthetic oligonucleotide
atcccgtcgttggaccgcgtgtcttttgctccttt

SEQ ID NO: 151621 - DNA, 35 bp, Artificial Sequence
  Synthetic oligonucleotide
aagtcaacgcgctcgttacgcttccctcccggttt

SEQ ID NO: 151622 - DNA, 36 bp, Artificial Sequence
  Synthetic oligonucleotide
aggacggggggaatggagggaaagaggtgggtaaaa

SEQ ID NO: 151623 - DNA, 36 bp, Artificial Sequence
  Synthetic oligonucleotide
tccatccactgaccaactatagcgcatgtcccctaa

SEQ ID NO: 151624 - DNA, 36 bp, Artificial Sequence
  Synthetic oligonucleotide
tcaccatatccgccccattgttcgccggtgtgtaca

SEQ ID NO: 151625 - DNA, 36 bp, Artificial Sequence
  Synthetic oligonucleotide
tgactgtcgcaacccgccccttgtaacctagttaca

SEQ ID NO: 151626 - DNA, 35 bp, Artificial Sequence
  Synthetic oligonucleotide
gccggactctgcgtggaccctcacctccgtttaca

SEQ ID NO: 151627 - DNA, 36 bp, Artificial Sequence
  Synthetic oligonucleotide
atcacccccgtgcctcctgtgccgttaacggaacca

SEQ ID NO: 151628 - DNA, 35 bp, Artificial Sequence
  Synthetic oligonucleotide
accccgctgcccgcttacatcgctgtgatttgcca

SEQ ID NO: 151629 - DNA, 36 bp, Artificial Sequence
  Synthetic oligonucleotide
gacccgcctccgccatgaacttgaactgcgccgtca

SEQ ID NO: 151630 - DNA, 35 bp, Artificial Sequence
  Synthetic oligonucleotide
gcacatccgcttggggacttgctctttccgtttca

SEQ ID NO: 151631 - DNA, 37 bp, Artificial Sequence
  Synthetic oligonucleotide
gtgaggggggagaggggcctaaaaatgcagaatgaga

SEQ ID NO: 151632 - DNA, 37 bp, Artificial Sequence
  Synthetic oligonucleotide
gctgcatccctgttgtccccgcctatcgttgcttcga

SEQ ID NO: 151633 - DNA, 37 bp, Artificial Sequence
  Synthetic oligonucleotide
agccacgtaggaacgagtggggcggaggggtggagga

SEQ ID NO: 151634 - DNA, 36 bp, Artificial Sequence
  Synthetic oligonucleotide
gttcagaggggagggagggtgtgggaaagattagga

SEQ ID NO: 151635 - DNA, 37 bp, Artificial Sequence
  Synthetic oligonucleotide
gaaagaggatgggatggggttagtatgggcgggatga

SEQ ID NO: 151636 - DNA, 37 bp, Artificial Sequence
  Synthetic oligonucleotide
atgagggtaggcgggtggaaacaacgggggaggctga

SEQ ID NO: 151637 - DNA, 36 bp, Artificial Sequence
  Synthetic oligonucleotide
atccttcgcagaaatgggattgggtgggaagggtga

SEQ ID NO: 151638 - DNA, 35 bp, Artificial Sequence
  Synthetic oligonucleotide
gccggtgatgagagggggagggctttgacgggtga

SEQ ID NO: 151639 - DNA, 38 bp, Artificial Sequence
  Synthetic oligonucleotide
tcgaacgggaagggagggggggatgtaaaaagatttga

SEQ ID NO: 151640 - DNA, 38 bp, Artificial Sequence
  Synthetic oligonucleotide
tgccatgcccttgcctgcccacattgctccgcttttga

SEQ ID NO: 151641 - DNA, 35 bp, Artificial Sequence
  Synthetic oligonucleotide
acctccgccccgtcctggatccccgtgtttcgcta

SEQ ID NO: 151642 - DNA, 35 bp, Artificial Sequence
  Synthetic oligonucleotide
accgtaccgacggtttgattgcccgttccgcctta

SEQ ID NO: 151643 - DNA, 36 bp, Artificial Sequence
  Synthetic oligonucleotide
tccgatgcctcgggtcgctccctcgaaaccctctta

SEQ ID NO: 151644 - DNA, 35 bp, Artificial Sequence
  Synthetic oligonucleotide
agccagactgggggggtgggggacacgggtcaaac

SEQ ID NO: 151645 - DNA, 34 bp, Artificial Sequence
  Synthetic oligonucleotide
ggcctcccagccaccccgccgttcatgactgcac

SEQ ID NO: 151646 - DNA, 35 bp, Artificial Sequence
  Synthetic oligonucleotide
agccctgctgatctcatgtcccaccagctgctacc

SEQ ID NO: 151647 - DNA, 35 bp, Artificial Sequence
  Synthetic oligonucleotide
gtctgccaaacacgtgtcactcgccctgtcacccc

SEQ ID NO: 151648 - DNA, 35 bp, Artificial Sequence
  Synthetic oligonucleotide
gacaactaccattacgtcctccgatgacacgcccc

SEQ ID NO: 151649 - DNA, 35 bp, Artificial Sequence
  Synthetic oligonucleotide
acgaccactgtaagccgatctgctattccgcgccc

SEQ ID NO: 151650 - DNA, 35 bp, Artificial Sequence
  Synthetic oligonucleotide
ccacgtcacatcatagcgccgtcgcccgacctccc

SEQ ID NO: 151651 - DNA, 34 bp, Artificial Sequence
  Synthetic oligonucleotide
gaccccctctccgccccacaattgacgtagtccc

SEQ ID NO: 151652 - DNA, 35 bp, Artificial Sequence
  Synthetic oligonucleotide
atgccacctcctcctttctcgtagctactggatcc

SEQ ID NO: 151653 - DNA, 35 bp, Artificial Sequence
  Synthetic oligonucleotide
gtgattcctgcccttcgttggtcctttcatactcc

SEQ ID NO: 151654 - DNA, 35 bp, Artificial Sequence
  Synthetic oligonucleotide
gccacccccatatagttcaaactcgtgatgtctcc

SEQ ID NO: 151655 - DNA, 35 bp, Artificial Sequence
  Synthetic oligonucleotide
ggttgcgtagtcgtactatcctgtatcccgtccgc

SEQ ID NO: 151656 - DNA, 35 bp, Artificial Sequence
  Synthetic oligonucleotide
agtcaaccttcgcctcccgtcctatgggccctcgc

SEQ ID NO: 151657 - DNA, 35 bp, Artificial Sequence
  Synthetic oligonucleotide
gtcacccgctgttttgtcctcccttgtgccctggc

SEQ ID NO: 151658 - DNA, 35 bp, Artificial Sequence
  Synthetic oligonucleotide
gtcctctccgcctcatttccgcttttgcgatctgc

SEQ ID NO: 151659 - DNA, 35 bp, Artificial Sequence
  Synthetic oligonucleotide
gccctagcatacacgttaccctgagtgcccccatc

SEQ ID NO: 151660 - DNA, 35 bp, Artificial Sequence
  Synthetic oligonucleotide
atccccgtacgctcgaacatgccatatcgtccatc

SEQ ID NO: 151661 - DNA, 35 bp, Artificial Sequence
  Synthetic oligonucleotide
accgaaccgccacgggtatccgctgttgttccatc

SEQ ID NO: 151662 - DNA, 35 bp, Artificial Sequence
  Synthetic oligonucleotide
tcgaacgtccatgccgctgtccgtcgcacttcatc

SEQ ID NO: 151663 - DNA, 35 bp, Artificial Sequence
  Synthetic oligonucleotide
ttgggcactgtagatagttgtccctcctacccctc

SEQ ID NO: 151664 - DNA, 35 bp, Artificial Sequence
  Synthetic oligonucleotide
ccttgacacgcccttcctattcggtagatctgctc

SEQ ID NO: 151665 - DNA, 35 bp, Artificial Sequence
  Synthetic oligonucleotide
ggccaggtccgcacctctatcgaaacatcctcccg

SEQ ID NO: 151666 - DNA, 35 bp, Artificial Sequence
  Synthetic oligonucleotide
tgtgctgagcccttacgtccccgctttctcgtgcg

SEQ ID NO: 151667 - DNA, 35 bp, Artificial Sequence
  Synthetic oligonucleotide
gatccgacgcgcacctttccgtgtcttctccctcg

SEQ ID NO: 151668 - DNA, 34 bp, Artificial Sequence
  Synthetic oligonucleotide
gtgggtgactcgggtgggcgggcaattaggggtg

SEQ ID NO: 151669 - DNA, 35 bp, Artificial Sequence
  Synthetic oligonucleotide
ggtaccgcagggaggggcaaggggggcaaactcat

SEQ ID NO: 151670 - DNA, 35 bp, Artificial Sequence
  Synthetic oligonucleotide
gcattcccctcactgacattcgtttcagacatact

SEQ ID NO: 151671 - DNA, 35 bp, Artificial Sequence
  Synthetic oligonucleotide
gctcgttagccttagccatcgcctataacgcccct

SEQ ID NO: 151672 - DNA, 35 bp, Artificial Sequence
  Synthetic oligonucleotide
tacccgctccacgagtgctcaggttcttcactcct

SEQ ID NO: 151673 - DNA, 35 bp, Artificial Sequence
  Synthetic oligonucleotide
gcactataccggcatggccctccgtccgccttcct

SEQ ID NO: 151674 - DNA, 34 bp, Artificial Sequence
  Synthetic oligonucleotide
gtgaacacctcccccatatacgccgtaaagggct

SEQ ID NO: 151675 - DNA, 35 bp, Artificial Sequence
  Synthetic oligonucleotide
tcgctccgcgcagttatctacctccttccttccgt

SEQ ID NO: 151676 - DNA, 35 bp, Artificial Sequence
  Synthetic oligonucleotide
tagccccttcgatcccatgttccagtccatttcgt

SEQ ID NO: 151677 - DNA, 35 bp, Artificial Sequence
  Synthetic oligonucleotide
gaacaggcccttcgctactccctacatttcccggt

SEQ ID NO: 151678 - DNA, 35 bp, Artificial Sequence
  Synthetic oligonucleotide
gccgccattgtcctctgttgtttcctggtgtctgt

SEQ ID NO: 151679 - DNA, 35 bp, Artificial Sequence
  Synthetic oligonucleotide
tgcgagctcccccttggtctgacttagcacttctt

SEQ ID NO: 151680 - DNA, 35 bp, Artificial Sequence
  Synthetic oligonucleotide
gttgtcatcctcgttcgcgtacaattcgcatcttt

SEQ ID NO: 151681 - DNA, 35 bp, Artificial Sequence
  Synthetic oligonucleotide
gacttcgtgcccgaggtccctgatcaatcttgttt

SEQ ID NO: 151682 - DNA, 35 bp, Artificial Sequence
  Synthetic oligonucleotide
gtcgccgtcaccctccatcatccggtgcctctttt

SEQ ID NO: 151683 - DNA, 36 bp, Artificial Sequence
  Synthetic oligonucleotide
gctagggggtgtcgggtgggagggacttagactaaa

SEQ ID NO: 151684 - DNA, 35 bp, Artificial Sequence
  Synthetic oligonucleotide
agaaaaccaccgccaccgaccccgttccctcgcaa

SEQ ID NO: 151685 - DNA, 36 bp, Artificial Sequence
  Synthetic oligonucleotide
tcccgacaccttcacttgtcatcgcccttacggtaa

SEQ ID NO: 151686 - DNA, 36 bp, Artificial Sequence
  Synthetic oligonucleotide
ggagaacgcgtacccttgcgcctgtcatcttaaaca

SEQ ID NO: 151687 - DNA, 35 bp, Artificial Sequence
  Synthetic oligonucleotide
gcacgctaccgagcctcgcattattacaccgcaca

SEQ ID NO: 151688 - DNA, 36 bp, Artificial Sequence
  Synthetic oligonucleotide
gaccaggggggagagattacggtaggaagggggaca

SEQ ID NO: 151689 - DNA, 36 bp, Artificial Sequence
  Synthetic oligonucleotide
tgatcacgcccttgatttcggcgggacacttctcca

SEQ ID NO: 151690 - DNA, 35 bp, Artificial Sequence
  Synthetic oligonucleotide
ggacatcctccgcttccgtatacctcctgctcgca

SEQ ID NO: 151691 - DNA, 36 bp, Artificial Sequence
  Synthetic oligonucleotide
tgtgccagctctttgcacacacacgctcctcttgca

SEQ ID NO: 151692 - DNA, 35 bp, Artificial Sequence
  Synthetic oligonucleotide
tacccgcttatccaccatgccaatagtacctttca

SEQ ID NO: 151693 - DNA, 36 bp, Artificial Sequence
  Synthetic oligonucleotide
acgcccattcagccccccgccctcccgtgtccaaga

SEQ ID NO: 151694 - DNA, 36 bp, Artificial Sequence
  Synthetic oligonucleotide
gcaaacaggaggggaatcatggccggggtggagaga

SEQ ID NO: 151695 - DNA, 37 bp, Artificial Sequence
  Synthetic oligonucleotide
gttgctgcccccgtaaacgcgtcctcgttactaacga

SEQ ID NO: 151696 - DNA, 37 bp, Artificial Sequence
  Synthetic oligonucleotide
tagagcataccgcccgccagtccccgttccaccacga

SEQ ID NO: 151697 - DNA, 37 bp, Artificial Sequence
  Synthetic oligonucleotide
gatacaccgccctgttcttcaatgccccttgagacga

SEQ ID NO: 151698 - DNA, 37 bp, Artificial Sequence
  Synthetic oligonucleotide
gaatgggaacgtggaaagaggggaaagggcggtacga

SEQ ID NO: 151699 - DNA, 37 bp, Artificial Sequence
  Synthetic oligonucleotide
tagtacgggtcacatgttcgctcactgccccatccga

SEQ ID NO: 151700 - DNA, 36 bp, Artificial Sequence
  Synthetic oligonucleotide
gcgcacctcctcggcatcttgctctattctgttcga

SEQ ID NO: 151701 - DNA, 37 bp, Artificial Sequence
  Synthetic oligonucleotide
tgagaggggattggcgtggaggagccgtggggaggga

SEQ ID NO: 151702 - DNA, 38 bp, Artificial Sequence
  Synthetic oligonucleotide
gtcggggcatgtaaatatgggcggggctgacgacggga

SEQ ID NO: 151703 - DNA, 37 bp, Artificial Sequence
  Synthetic oligonucleotide
ggtgtgccgggtgggtagggtatggggttgttgggga

SEQ ID NO: 151704 - DNA, 37 bp, Artificial Sequence
  Synthetic oligonucleotide
atgcgccggaggtggtggagtggggatggctaatgga

SEQ ID NO: 151705 - DNA, 37 bp, Artificial Sequence
  Synthetic oligonucleotide
acacacctgcatctccgtaatttccccgctcgctgga

SEQ ID NO: 151706 - DNA, 35 bp, Artificial Sequence
  Synthetic oligonucleotide
tctgtaccacatgtttttcgctccgctctctatga

SEQ ID NO: 151707 - DNA, 38 bp, Artificial Sequence
  Synthetic oligonucleotide
tgaggtcggagggaggggggtggatttggacggtatga

SEQ ID NO: 151708 - DNA, 38 bp, Artificial Sequence
  Synthetic oligonucleotide
aatgggtgggcgggagatagggttaaaactcgtactga

SEQ ID NO: 151709 - DNA, 38 bp, Artificial Sequence
  Synthetic oligonucleotide
ttacgccagcctgtcttcgtttgcggcccccctcctga

SEQ ID NO: 151710 - DNA, 37 bp, Artificial Sequence
  Synthetic oligonucleotide
tcttcccaccgttatatgcgtgcactcccctcgttga

SEQ ID NO: 151711 - DNA, 36 bp, Artificial Sequence
  Synthetic oligonucleotide
tgatcgaaccgcccccatgccatacaacagcacata

SEQ ID NO: 151712 - DNA, 35 bp, Artificial Sequence
  Synthetic oligonucleotide
tgcctcgctcacaaccgctttgtctcttctgcccc

SEQ ID NO: 151713 - DNA, 35 bp, Artificial Sequence
  Synthetic oligonucleotide
gaccgccgttttctgatcaacacacttgctcgccc

SEQ ID NO: 151714 - DNA, 35 bp, Artificial Sequence
  Synthetic oligonucleotide
tattcaccgctggacgtttagcgtttttgcccgcc

SEQ ID NO: 151715 - DNA, 35 bp, Artificial Sequence
  Synthetic oligonucleotide
gcccgcacgggcccttgctccaccgctttttggcc

SEQ ID NO: 151716 - DNA, 35 bp, Artificial Sequence
  Synthetic oligonucleotide
tacaaaaggtagggggacggggcagaaggacaagc

SEQ ID NO: 151717 - DNA, 35 bp, Artificial Sequence
  Synthetic oligonucleotide
cagtgccctgcccgttgccccatctacctttgtgc

SEQ ID NO: 151718 - DNA, 28 bp, Artificial Sequence
  Synthetic oligonucleotide
gggtgagggcacccctatctcccccatc

SEQ ID NO: 151719 - DNA, 35 bp, Artificial Sequence
  Synthetic oligonucleotide
acatcccgctatcattgtatcttctttccagcatc

SEQ ID NO: 151720 - DNA, 35 bp, Artificial Sequence
  Synthetic oligonucleotide
acccattccccaacatctgtgatgctggccttgtc

SEQ ID NO: 151721 - DNA, 35 bp, Artificial Sequence
  Synthetic oligonucleotide
ggaactgccgtccctcgcgttacttctcggatttc

SEQ ID NO: 151722 - DNA, 35 bp, Artificial Sequence
  Synthetic oligonucleotide
gatgcgcgagactgagaggggtaggtgtagggaag

SEQ ID NO: 151723 - DNA, 35 bp, Artificial Sequence
  Synthetic oligonucleotide
acacccgggagaaggggcgatgggggtgaaatcag

SEQ ID NO: 151724 - DNA, 35 bp, Artificial Sequence
  Synthetic oligonucleotide
aaggtatcgagggggagtaggggaaggatagagag

SEQ ID NO: 151725 - DNA, 35 bp, Artificial Sequence
  Synthetic oligonucleotide
tccacgcgcacgctagttcctttttccggccgccg

SEQ ID NO: 151726 - DNA, 35 bp, Artificial Sequence
  Synthetic oligonucleotide
agcgtgtgcccttatcttacccagtcctgcctccg

SEQ ID NO: 151727 - DNA, 35 bp, Artificial Sequence
  Synthetic oligonucleotide
ccattagcctcactgtcctccccggatccgactcg

SEQ ID NO: 151728 - DNA, 35 bp, Artificial Sequence
  Synthetic oligonucleotide
acgtgccacctcacccttggtctctttccccctgg

SEQ ID NO: 151729 - DNA, 35 bp, Artificial Sequence
  Synthetic oligonucleotide
gttatgtggtgtggatggaagggagggtagggctg

SEQ ID NO: 151730 - DNA, 35 bp, Artificial Sequence
  Synthetic oligonucleotide
gcccatgttcatacccagtcctgttcactcctctg

SEQ ID NO: 151731 - DNA, 35 bp, Artificial Sequence
  Synthetic oligonucleotide
atccccacgtgtatgacatccgttatcgctccact

SEQ ID NO: 151732 - DNA, 35 bp, Artificial Sequence
  Synthetic oligonucleotide
tgttcgttccgtcctcatttgccgttactcaatct

SEQ ID NO: 151733 - DNA, 30 bp, Artificial Sequence
  Synthetic oligonucleotide
agtcgtgtaggacctcgcccgctcccatct

SEQ ID NO: 151734 - DNA, 35 bp, Artificial Sequence
  Synthetic oligonucleotide
tgcaaccgcctcttcgccttactgacttaagctct

SEQ ID NO: 151735 - DNA, 35 bp, Artificial Sequence
  Synthetic oligonucleotide
ttccagggccatgctttaaacgtcaacacccttct

SEQ ID NO: 151736 - DNA, 35 bp, Artificial Sequence
  Synthetic oligonucleotide
ttgtcccccgtagttgtcccttgttcgtttgtagt

SEQ ID NO: 151737 - DNA, 35 bp, Artificial Sequence
  Synthetic oligonucleotide
gccccttccgccctgtaccgcccgatacttgttgt

SEQ ID NO: 151738 - DNA, 35 bp, Artificial Sequence
  Synthetic oligonucleotide
gtcattacctctgcttggtttcacacattctcgtt

SEQ ID NO: 151739 - DNA, 36 bp, Artificial Sequence
  Synthetic oligonucleotide
gtccagcagagcgtgggggggaggcggaatgagaaa

SEQ ID NO: 151740 - DNA, 36 bp, Artificial Sequence
  Synthetic oligonucleotide
acgccccctccgctgcgtggtcacgcatcacccgaa

SEQ ID NO: 151741 - DNA, 36 bp, Artificial Sequence
  Synthetic oligonucleotide
atgttccgcaccgtgttaacgtagtccctccccgaa

SEQ ID NO: 151742 - DNA, 35 bp, Artificial Sequence
  Synthetic oligonucleotide
tgagtccgccaccgccttagtctgttcatactcca

SEQ ID NO: 151743 - DNA, 35 bp, Artificial Sequence
  Synthetic oligonucleotide
gtgggggtgggagggtgtagtcgttcggggactca

SEQ ID NO: 151744 - DNA, 36 bp, Artificial Sequence
  Synthetic oligonucleotide
ttgggtgcaagggaaaggagggagccgaacggaaga

SEQ ID NO: 151745 - DNA, 37 bp, Artificial Sequence
  Synthetic oligonucleotide
gcatgcaacccgcctgtcaccactccctcccgctaga

SEQ ID NO: 151746 - DNA, 35 bp, Artificial Sequence
  Synthetic oligonucleotide
ttaggccggcccattgtcctctttcctgcacacga

SEQ ID NO: 151747 - DNA, 37 bp, Artificial Sequence
  Synthetic oligonucleotide
atgacaggccgtttatatttgtcgcaccatcccagga

SEQ ID NO: 151748 - DNA, 37 bp, Artificial Sequence
  Synthetic oligonucleotide
gacccgccctcgcgcccccttttcacctggacccgga

SEQ ID NO: 151749 - DNA, 36 bp, Artificial Sequence
  Synthetic oligonucleotide
gaataagtgtgggggtgtggcgataggggagttgga

SEQ ID NO: 151750 - DNA, 37 bp, Artificial Sequence
  Synthetic oligonucleotide
atgtccaccgtaccgctccacatgttcactaccatga

SEQ ID NO: 151751 - DNA, 37 bp, Artificial Sequence
  Synthetic oligonucleotide
tgtaggcgaacggacgcgggtgggggggcggtgctga

SEQ ID NO: 151752 - DNA, 37 bp, Artificial Sequence
  Synthetic oligonucleotide
taagggagggcgggggaacgggtcttattgaacgtga

SEQ ID NO: 151753 - DNA, 38 bp, Artificial Sequence
  Synthetic oligonucleotide
tccgactcgcatctccgtaatccatccaccacgcgtga

SEQ ID NO: 151754 - DNA, 37 bp, Artificial Sequence
  Synthetic oligonucleotide
gtccaagacatagtgaagggagggacgaggagggtga

SEQ ID NO: 151755 - DNA, 37 bp, Artificial Sequence
  Synthetic oligonucleotide
gaacccgcccctcgcccgtccctagaaccagtggtga

SEQ ID NO: 151756 - DNA, 37 bp, Artificial Sequence
  Synthetic oligonucleotide
actcacccccatagttttagtacattccttctattga

SEQ ID NO: 151757 - DNA, 37 bp, Artificial Sequence
  Synthetic oligonucleotide
tctcctgagccaatcccgtatcgtccgcccctcttga

SEQ ID NO: 151758 - DNA, 37 bp, Artificial Sequence
  Synthetic oligonucleotide
atgccctccctgcttgcccgactagtacacccgttga

SEQ ID NO: 151759 - DNA, 37 bp, Artificial Sequence
  Synthetic oligonucleotide
acatagcgaccggcgtattcacctccttcctcgttga

SEQ ID NO: 151760 - DNA, 35 bp, Artificial Sequence
  Synthetic oligonucleotide
aacccccccacgctactcgacggtccgtgacacta

SEQ ID NO: 151761 - DNA, 32 bp, Artificial Sequence
  Synthetic oligonucleotide
gtatggctcgccttctcgtcccatcgacccac

SEQ ID NO: 151762 - DNA, 35 bp, Artificial Sequence
  Synthetic oligonucleotide
acgacgcacaatatgctgctgtcgttgcaccctcc

SEQ ID NO: 151763 - DNA, 35 bp, Artificial Sequence
  Synthetic oligonucleotide
ttcacacctgtagctgttcgtcatgagccgtttcc

SEQ ID NO: 151764 - DNA, 35 bp, Artificial Sequence
  Synthetic oligonucleotide
tgcatgaagggggaaactactagtgaggagggagc

SEQ ID NO: 151765 - DNA, 35 bp, Artificial Sequence
  Synthetic oligonucleotide
tccactccccagttatcgacacttgtcagcccggc

SEQ ID NO: 151766 - DNA, 35 bp, Artificial Sequence
  Synthetic oligonucleotide
gtcccccccgcacccgataaagaccgctcatgggc

SEQ ID NO: 151767 - DNA, 35 bp, Artificial Sequence
  Synthetic oligonucleotide
atcgcccaatccgagttgcttttacgtgcgccctc

SEQ ID NO: 151768 - DNA, 35 bp, Artificial Sequence
  Synthetic oligonucleotide
tgtacgagcaattcgtcacagccccgatttccctc

SEQ ID NO: 151769 - DNA, 35 bp, Artificial Sequence
  Synthetic oligonucleotide
tgcgcaatcaacgtaccgtccgctggttctctctc

SEQ ID NO: 151770 - DNA, 35 bp, Artificial Sequence
  Synthetic oligonucleotide
tcgcacattagcgtaagccccgtcgttccaccttc

SEQ ID NO: 151771 - DNA, 35 bp, Artificial Sequence
  Synthetic oligonucleotide
gatggagaatgcaggatgactaggggcgaaggaag

SEQ ID NO: 151772 - DNA, 35 bp, Artificial Sequence
  Synthetic oligonucleotide
aaagccaccacgaactcgtgtctactccctgcccg

SEQ ID NO: 151773 - DNA, 35 bp, Artificial Sequence
  Synthetic oligonucleotide
atgtccctgccccggatggcccctatgttctagcg

SEQ ID NO: 151774 - DNA, 35 bp, Artificial Sequence
  Synthetic oligonucleotide
agcggaccgcccccacaaccgccccgaacaccgcg

SEQ ID NO: 151775 - DNA, 35 bp, Artificial Sequence
  Synthetic oligonucleotide
attgtgtggtgggcgcgtgggggcggaggagggat

SEQ ID NO: 151776 - DNA, 35 bp, Artificial Sequence
  Synthetic oligonucleotide
ggtggtccgtccacgcgcaatcccccccctatgat

SEQ ID NO: 151777 - DNA, 35 bp, Artificial Sequence
  Synthetic oligonucleotide
tcccctcgcccccctagtttgattgcgtaccatat

SEQ ID NO: 151778 - DNA, 35 bp, Artificial Sequence
  Synthetic oligonucleotide
tctgaccccactcatgttagaacttccatcgtact

SEQ ID NO: 151779 - DNA, 35 bp, Artificial Sequence
  Synthetic oligonucleotide
gtcgcactcgcctgccattaggggcgcatccacct

SEQ ID NO: 151780 - DNA, 35 bp, Artificial Sequence
  Synthetic oligonucleotide
gtgagaccctcgtccctctgcccgtttgttgccct

SEQ ID NO: 151781 - DNA, 35 bp, Artificial Sequence
  Synthetic oligonucleotide
cacgtcgtccgcattccctctcgccccgtcctcct

SEQ ID NO: 151782 - DNA, 36 bp, Artificial Sequence
  Synthetic oligonucleotide
tcatgtgcgcgcacttagttgccatgccctacttct

SEQ ID NO: 151783 - DNA, 35 bp, Artificial Sequence
  Synthetic oligonucleotide
tcaaacaccctgcccgccccgtcgccaattacagt

SEQ ID NO: 151784 - DNA, 35 bp, Artificial Sequence
  Synthetic oligonucleotide
tcacccgccaattgccctgtccatctgcccccagt

SEQ ID NO: 151785 - DNA, 35 bp, Artificial Sequence
  Synthetic oligonucleotide
taccgtccccagacgcttatgatccttctccctgt

SEQ ID NO: 151786 - DNA, 35 bp, Artificial Sequence
  Synthetic oligonucleotide
accacctagattagcagcctcttgccgtcctcctt

SEQ ID NO: 151787 - DNA, 35 bp, Artificial Sequence
  Synthetic oligonucleotide
gtatggtcgccgttcgcacctccatccctatcgtt

SEQ ID NO: 151788 - DNA, 35 bp, Artificial Sequence
  Synthetic oligonucleotide
acctccatctgtaatgctttctcaccgacgctgtt

SEQ ID NO: 151789 - DNA, 35 bp, Artificial Sequence
  Synthetic oligonucleotide
gacacgctaggactccgtatccccgtcactccttt

SEQ ID NO: 151790 - DNA, 36 bp, Artificial Sequence
  Synthetic oligonucleotide
atgtgcatgcccctcgatctatcatgaccacccaaa

SEQ ID NO: 151791 - DNA, 36 bp, Artificial Sequence
  Synthetic oligonucleotide
gttatgcacctggccccgcgatacgcctctggcgaa

SEQ ID NO: 151792 - DNA, 36 bp, Artificial Sequence
  Synthetic oligonucleotide
aagcccgaccggctgctattgtacgccctctcttaa

SEQ ID NO: 151793 - DNA, 36 bp, Artificial Sequence
  Synthetic oligonucleotide
gttccatccgcaagtgcatcacagtgacaccgccca

SEQ ID NO: 151794 - DNA, 36 bp, Artificial Sequence
  Synthetic oligonucleotide
accctgcccagctatttcggttagcatcccccgcca

SEQ ID NO: 151795 - DNA, 36 bp, Artificial Sequence
  Synthetic oligonucleotide
ttcgctcattgtactccgccccctcggcctctgcca

SEQ ID NO: 151796 - DNA, 36 bp, Artificial Sequence
  Synthetic oligonucleotide
aatgcccccgacggccgccccagtttccttcaggca

SEQ ID NO: 151797 - DNA, 36 bp, Artificial Sequence
  Synthetic oligonucleotide
gcgcacccgcccatattctccccagctcagtaggca

SEQ ID NO: 151798 - DNA, 35 bp, Artificial Sequence
  Synthetic oligonucleotide
gctcacccgccccatgtccccctccgatgtgacga

SEQ ID NO: 151799 - DNA, 36 bp, Artificial Sequence
  Synthetic oligonucleotide
gatcctgccgctgttcccctctgtaaaacccaccga

SEQ ID NO: 151800 - DNA, 37 bp, Artificial Sequence
  Synthetic oligonucleotide
gaacgggcaatgggaggggtgatcagctagggggcga

SEQ ID NO: 151801 - DNA, 37 bp, Artificial Sequence
  Synthetic oligonucleotide
tcctgcaccctcccacgactttattctctggcttcga

SEQ ID NO: 151802 - DNA, 37 bp, Artificial Sequence
  Synthetic oligonucleotide
tgtgtgggggggagggtaaggggcgaggatgagggga

SEQ ID NO: 151803 - DNA, 37 bp, Artificial Sequence
  Synthetic oligonucleotide
aatggaggatcgacggaactgggaggggtgaggggga

SEQ ID NO: 151804 - DNA, 37 bp, Artificial Sequence
  Synthetic oligonucleotide
tgggaggggcagatccagtaacgggggcgccggggga

SEQ ID NO: 151805 - DNA, 36 bp, Artificial Sequence
  Synthetic oligonucleotide
agcgcccccacgcctgctgcaccctgttaccatgga

SEQ ID NO: 151806 - DNA, 37 bp, Artificial Sequence
  Synthetic oligonucleotide
gtgacgccgatctatcctaccctatcccccggctgga

SEQ ID NO: 151807 - DNA, 37 bp, Artificial Sequence
  Synthetic oligonucleotide
gatgtgcgctgtccgttcttgttatctccactcatga

SEQ ID NO: 151808 - DNA, 38 bp, Artificial Sequence
  Synthetic oligonucleotide
tgagggcggagggaggggggtggatttggaaggtatga

SEQ ID NO: 151809 - DNA, 38 bp, Artificial Sequence
  Synthetic oligonucleotide
ggttaggcggacaggggggacggaggaaggcgaactga

SEQ ID NO: 151810 - DNA, 38 bp, Artificial Sequence
  Synthetic oligonucleotide
gactgggggggcggtggggtggcgggacgttggactga

SEQ ID NO: 151811 - DNA, 37 bp, Artificial Sequence
  Synthetic oligonucleotide
gtagcacagctttagccacccctcgttaccctgctga

SEQ ID NO: 151812 - DNA, 33 bp, Artificial Sequence
  Synthetic oligonucleotide
gttggtggtcggggatagggggagggggagtga

SEQ ID NO: 151813 - DNA, 36 bp, Artificial Sequence
  Synthetic oligonucleotide
gaatggggtggagggagtggtgagcaggaatattga

SEQ ID NO: 151814 - DNA, 35 bp, Artificial Sequence
  Synthetic oligonucleotide
gcacgcaagcatgagccgtgcacctccccgcttga

SEQ ID NO: 151815 - DNA, 38 bp, Artificial Sequence
  Synthetic oligonucleotide
gcatggagtgaacaggaggggtgagggtggggggttga

SEQ ID NO: 151816 - DNA, 35 bp, Artificial Sequence
  Synthetic oligonucleotide
gtgcgccagcgctgtctttcttgccgttacctcta

SEQ ID NO: 151817 - DNA, 35 bp, Artificial Sequence
  Synthetic oligonucleotide
taaccctgcgccatctctcggttttgtgccacgta

SEQ ID NO: 151818 - DNA, 35 bp, Artificial Sequence
  Synthetic oligonucleotide
gaggtggaagggaaggataggacagtatgacatta

SEQ ID NO: 151819 - DNA, 35 bp, Artificial Sequence
  Synthetic oligonucleotide
accccccgctttgatctcggcctggaccgggaaac

SEQ ID NO: 151820 - DNA, 35 bp, Artificial Sequence
  Synthetic oligonucleotide
aacccgttcggacacccccccctgcctacatgaac

SEQ ID NO: 151821 - DNA, 35 bp, Artificial Sequence
  Synthetic oligonucleotide
aactcccccgacgacgggacacatttcgactacac

SEQ ID NO: 151822 - DNA, 35 bp, Artificial Sequence
  Synthetic oligonucleotide
gatgcccccaataccgtgtcgtcacggccttacac

SEQ ID NO: 151823 - DNA, 35 bp, Artificial Sequence
  Synthetic oligonucleotide
acatcccccgtaagcgtgtctcctccgttcccacc

SEQ ID NO: 151824 - DNA, 35 bp, Artificial Sequence
  Synthetic oligonucleotide
gaagcacatagtgcgattctctcttccctgaaccc

SEQ ID NO: 151825 - DNA, 35 bp, Artificial Sequence
  Synthetic oligonucleotide
tccacgttttgctatcgtactgtgcctcaaccccc

SEQ ID NO: 151826 - DNA, 35 bp, Artificial Sequence
  Synthetic oligonucleotide
ttggacgccgcggcgctagacgttctccctccccc

SEQ ID NO: 151827 - DNA, 35 bp, Artificial Sequence
  Synthetic oligonucleotide
tggaccagtttgcgatgtcttctgctctctctccc

SEQ ID NO: 151828 - DNA, 35 bp, Artificial Sequence
  Synthetic oligonucleotide
ttctaacgccaggatgcacaccgatgccttctccc

SEQ ID NO: 151829 - DNA, 35 bp, Artificial Sequence
  Synthetic oligonucleotide
acgaatctcgcttgccatgccaataacctgcctcc

SEQ ID NO: 151830 - DNA, 35 bp, Artificial Sequence
  Synthetic oligonucleotide
aagtgtcggggtgcgtaaggtgggcggggtagagc

SEQ ID NO: 151831 - DNA, 35 bp, Artificial Sequence
  Synthetic oligonucleotide
gcatgccgccctgccttcactttggttgtttccgc

SEQ ID NO: 151832 - DNA, 35 bp, Artificial Sequence
  Synthetic oligonucleotide
actgggatcgggggggccgggggacattcgcttgc

SEQ ID NO: 151833 - DNA, 35 bp, Artificial Sequence
  Synthetic oligonucleotide
atgagcattatccgctgcctccctacgttgcttgc

SEQ ID NO: 151834 - DNA, 35 bp, Artificial Sequence
  Synthetic oligonucleotide
aaccccacctctgccctgttatctctgtgaccatc

SEQ ID NO: 151835 - DNA, 35 bp, Artificial Sequence
  Synthetic oligonucleotide
tgttcgtgtgccggcattttaggcctgtttttatc

SEQ ID NO: 151836 - DNA, 35 bp, Artificial Sequence
  Synthetic oligonucleotide
tcgagactgctcagttcctcttcatagcacgcctc

SEQ ID NO: 151837 - DNA, 35 bp, Artificial Sequence
  Synthetic oligonucleotide
gccatccgccttgaacctcgcctgaaagttagctc

SEQ ID NO: 151838 - DNA, 35 bp, Artificial Sequence
  Synthetic oligonucleotide
atctccgtacttatctgcttgtgcttcccccggtc

SEQ ID NO: 151839 - DNA, 35 bp, Artificial Sequence
  Synthetic oligonucleotide
tacaccccggcacacactctcccgttcgtgcggtc

SEQ ID NO: 151840 - DNA, 35 bp, Artificial Sequence
  Synthetic oligonucleotide
tccatcccccgccctccgtatactgcgctcccgag

SEQ ID NO: 151841 - DNA, 35 bp, Artificial Sequence
  Synthetic oligonucleotide
gttccctcgcctctttgttgtctccaggtaatccg

SEQ ID NO: 151842 - DNA, 35 bp, Artificial Sequence
  Synthetic oligonucleotide
atgggaaggaggggagatgggggtaccgggtgtgg

SEQ ID NO: 151843 - DNA, 35 bp, Artificial Sequence
  Synthetic oligonucleotide
gcttccagccgaagttgcgacgccgcctgtaccat

SEQ ID NO: 151844 - DNA, 35 bp, Artificial Sequence
  Synthetic oligonucleotide
aactgggagggcggggacgaagttgggaaagctat

SEQ ID NO: 151845 - DNA, 35 bp, Artificial Sequence
  Synthetic oligonucleotide
gccgaccgtacttgctgttcgcgaactccctccct

SEQ ID NO: 151846 - DNA, 35 bp, Artificial Sequence
  Synthetic oligonucleotide
gttacctccgcactatcataatggcatactctcct

SEQ ID NO: 151847 - DNA, 35 bp, Artificial Sequence
  Synthetic oligonucleotide
tcagatgcacacatggttgccctcttgcctcttct

SEQ ID NO: 151848 - DNA, 35 bp, Artificial Sequence
  Synthetic oligonucleotide
tccaccttccgttccttgcgccgaatatcatgagt

SEQ ID NO: 151849 - DNA, 35 bp, Artificial Sequence
  Synthetic oligonucleotide
ttgcgtcgctttatctttgggcccttcttccacgt

SEQ ID NO: 151850 - DNA, 35 bp, Artificial Sequence
  Synthetic oligonucleotide
tacgccccgcctctcgcccgtgcctatttcctctt

SEQ ID NO: 151851 - DNA, 35 bp, Artificial Sequence
  Synthetic oligonucleotide
gtcgtgtcgcacagtcctatcagtcgcccagtttt

SEQ ID NO: 151852 - DNA, 36 bp, Artificial Sequence
  Synthetic oligonucleotide
acccacgtgtccaacgctcccctagccctcctcgaa

SEQ ID NO: 151853 - DNA, 36 bp, Artificial Sequence
  Synthetic oligonucleotide
ggtccgggagtgtgggggcaagtggagggaagggaa

SEQ ID NO: 151854 - DNA, 35 bp, Artificial Sequence
  Synthetic oligonucleotide
gtgagatggggggccggggggaggcagagtgataa

SEQ ID NO: 151855 - DNA, 36 bp, Artificial Sequence
  Synthetic oligonucleotide
ttgaacttcctcgcccacgctacgctacactggtaa

SEQ ID NO: 151856 - DNA, 36 bp, Artificial Sequence
  Synthetic oligonucleotide
tgtttcccagccgctccgaccgctccgagccttaca

SEQ ID NO: 151857 - DNA, 36 bp, Artificial Sequence
  Synthetic oligonucleotide
agtgagccccgcccgcgcattcttttccctgcacca

SEQ ID NO: 151858 - DNA, 26 bp, Artificial Sequence
  Synthetic oligonucleotide
tcccctgggcctacatttacctccca

SEQ ID NO: 151859 - DNA, 36 bp, Artificial Sequence
  Synthetic oligonucleotide
ttcagccccccactgcaccaggacccgcgagccgca

SEQ ID NO: 151860 - DNA, 36 bp, Artificial Sequence
  Synthetic oligonucleotide
tgaggggcaaatggtggatgggggtggtggggcgca

SEQ ID NO: 151861 - DNA, 36 bp, Artificial Sequence
  Synthetic oligonucleotide
gaatgcctagcgtgatataacatcgccgcccactca

SEQ ID NO: 151862 - DNA, 37 bp, Artificial Sequence
  Synthetic oligonucleotide
atgtagggccatgacaagaataaggaggggaggcaga

SEQ ID NO: 151863 - DNA, 35 bp, Artificial Sequence
  Synthetic oligonucleotide
acgagggggaggtgttggagggaggtaggaaacga

SEQ ID NO: 151864 - DNA, 37 bp, Artificial Sequence
  Synthetic oligonucleotide
tgcgaccgccctccgtctcaactgccatccgtcccga

SEQ ID NO: 151865 - DNA, 35 bp, Artificial Sequence
  Synthetic oligonucleotide
actgcatacgccccatgcacctgacgtacctccga

SEQ ID NO: 151866 - DNA, 37 bp, Artificial Sequence
  Synthetic oligonucleotide
ttgactgcatcgggtcagggaggtgggcggggggcga

SEQ ID NO: 151867 - DNA, 37 bp, Artificial Sequence
  Synthetic oligonucleotide
atgcggggaggggagggatgtggttatggggaacgga

SEQ ID NO: 151868 - DNA, 37 bp, Artificial Sequence
  Synthetic oligonucleotide
tatccactcctcccatggtcaatctctgtccaccgga

SEQ ID NO: 151869 - DNA, 36 bp, Artificial Sequence
  Synthetic oligonucleotide
acgcacctccgcccgtcaacatcgcctccgaaggga

SEQ ID NO: 151870 - DNA, 37 bp, Artificial Sequence
  Synthetic oligonucleotide
ttagggccagagggtggaggaggttaggacgagggga

SEQ ID NO: 151871 - DNA, 37 bp, Artificial Sequence
  Synthetic oligonucleotide
gcccacgtcggctccccagcctctgccctcctatgga

SEQ ID NO: 151872 - DNA, 37 bp, Artificial Sequence
  Synthetic oligonucleotide
gtacgaccgatcgttcccgcttcactccgctacctga

SEQ ID NO: 151873 - DNA, 38 bp, Artificial Sequence
  Synthetic oligonucleotide
attgccgtcaccggcgttctcaccatcttccatcctga

SEQ ID NO: 151874 - DNA, 37 bp, Artificial Sequence
  Synthetic oligonucleotide
actccaccctcaatccggcttcatcccacttagctga

SEQ ID NO: 151875 - DNA, 38 bp, Artificial Sequence
  Synthetic oligonucleotide
tctgtccgcagattccccacgcccgctcttcacgctga

SEQ ID NO: 151876 - DNA, 38 bp, Artificial Sequence
  Synthetic oligonucleotide
tatcacctccttgcctatcgagtttcgctgtatagtga

SEQ ID NO: 151877 - DNA, 37 bp, Artificial Sequence
  Synthetic oligonucleotide
gctggtgggggggagcaggatagaggaaaagctgtga

SEQ ID NO: 151878 - DNA, 38 bp, Artificial Sequence
  Synthetic oligonucleotide
tacaccttcttgcctgtactcacccggcccccttgtga

SEQ ID NO: 151879 - DNA, 38 bp, Artificial Sequence
  Synthetic oligonucleotide
acgggccccctcccccctcacgcgctgacagcccttga

SEQ ID NO: 151880 - DNA, 37 bp, Artificial Sequence
  Synthetic oligonucleotide
gtgctaggctcgggttgcgtctatcacctctccttga

SEQ ID NO: 151881 - DNA, 38 bp, Artificial Sequence
  Synthetic oligonucleotide
acagccactggcagtttgcctttcccgttcctgcttga

SEQ ID NO: 151882 - DNA, 37 bp, Artificial Sequence
  Synthetic oligonucleotide
gtatgccccgccctgtttcagctagtacactatttga

SEQ ID NO: 151883 - DNA, 35 bp, Artificial Sequence
  Synthetic oligonucleotide
gcaccacccgcgggctctctcttcctagacgaata

SEQ ID NO: 151884 - DNA, 35 bp, Artificial Sequence
  Synthetic oligonucleotide
ggagaacgtacgtgtggcgggatgggtgggtagta

SEQ ID NO: 151885 - DNA, 36 bp, Artificial Sequence
  Synthetic oligonucleotide
aggaagagaaggcgggtgcggaacaaaaggaaggta

SEQ ID NO: 151886 - DNA, 36 bp, Artificial Sequence
  Synthetic oligonucleotide
tctcgccaccgccttgctcagacaactctctctgta

SEQ ID NO: 151887 - DNA, 35 bp, Artificial Sequence
  Synthetic oligonucleotide
gcacatcgcgaacgttcacagtacactcctaccac

SEQ ID NO: 151888 - DNA, 35 bp, Artificial Sequence
  Synthetic oligonucleotide
acaccgctgctggcccactccggcggtcactttac

SEQ ID NO: 151889 - DNA, 35 bp, Artificial Sequence
  Synthetic oligonucleotide
gtcacaccggactcacggtatgacatgatccaccc

SEQ ID NO: 151890 - DNA, 35 bp, Artificial Sequence
  Synthetic oligonucleotide
tgtttcgcagggctatattgtactgctccatcccc

SEQ ID NO: 151891 - DNA, 35 bp, Artificial Sequence
  Synthetic oligonucleotide
tggacatcgaacagtccgtccccacttttgctccc

SEQ ID NO: 151892 - DNA, 35 bp, Artificial Sequence
  Synthetic oligonucleotide
atagtcgccgagttgccttatccacgccaccagcc

SEQ ID NO: 151893 - DNA, 35 bp, Artificial Sequence
  Synthetic oligonucleotide
gctgggttcactccgcgcctaccgtgctcagctcc

SEQ ID NO: 151894 - DNA, 35 bp, Artificial Sequence
  Synthetic oligonucleotide
taccaggtgccctgcttcccgatagagttctctcc

SEQ ID NO: 151895 - DNA, 35 bp, Artificial Sequence
  Synthetic oligonucleotide
accaagcctgccccctgcattaagtcaacatttcc

SEQ ID NO: 151896 - DNA, 34 bp, Artificial Sequence
  Synthetic oligonucleotide
gaggccaccactcggcgtttccgcgcttccccgc

SEQ ID NO: 151897 - DNA, 35 bp, Artificial Sequence
  Synthetic oligonucleotide
ttgacccctgtgcttacgtgccttttgatctctgc

SEQ ID NO: 151898 - DNA, 35 bp, Artificial Sequence
  Synthetic oligonucleotide
tatacccccggtcttgtgcctgtctccttcccttc

SEQ ID NO: 151899 - DNA, 35 bp, Artificial Sequence
  Synthetic oligonucleotide
gactccggactagatgtccgagttgtcttcccttc

SEQ ID NO: 151900 - DNA, 35 bp, Artificial Sequence
  Synthetic oligonucleotide
tgcgtttacgcagcccctctgttgaggttcccttc

SEQ ID NO: 151901 - DNA, 35 bp, Artificial Sequence
  Synthetic oligonucleotide
taacaccctgttgttcatcacattcaaggcctttc

SEQ ID NO: 151902 - DNA, 35 bp, Artificial Sequence
  Synthetic oligonucleotide
ggaccgactcctgcctgcaccgcccgtatttctag

SEQ ID NO: 151903 - DNA, 35 bp, Artificial Sequence
  Synthetic oligonucleotide
ttgtgctccactaatcctatgttacacctcttccg

SEQ ID NO: 151904 - DNA, 35 bp, Artificial Sequence
  Synthetic oligonucleotide
gcccactctctccgcaagcccactttctggctgtg

SEQ ID NO: 151905 - DNA, 35 bp, Artificial Sequence
  Synthetic oligonucleotide
gccgagatcgaccgccccgacttaccaccgcttat

SEQ ID NO: 151906 - DNA, 35 bp, Artificial Sequence
  Synthetic oligonucleotide
gtggctggtcagcattatattctccgtcactctct

SEQ ID NO: 151907 - DNA, 35 bp, Artificial Sequence
  Synthetic oligonucleotide
gcgctccacttcgggcctcctcgtatccccttggt

SEQ ID NO: 151908 - DNA, 35 bp, Artificial Sequence
  Synthetic oligonucleotide
ttcgcctaacacccgtccacgctcgttcccactgt

SEQ ID NO: 151909 - DNA, 36 bp, Artificial Sequence
  Synthetic oligonucleotide
tctggggaggggtgggggtagtcgggcgaaaccgaa

SEQ ID NO: 151910 - DNA, 36 bp, Artificial Sequence
  Synthetic oligonucleotide
aggagggagggtgggtccaaacggtgggcactttaa

SEQ ID NO: 151911 - DNA, 36 bp, Artificial Sequence
  Synthetic oligonucleotide
tccaaccatccgctcggtacaccacacacccgccca

SEQ ID NO: 151912 - DNA, 36 bp, Artificial Sequence
  Synthetic oligonucleotide
actgtttgacccctttgcgtactagctgccctccca

SEQ ID NO: 151913 - DNA, 36 bp, Artificial Sequence
  Synthetic oligonucleotide
aaacaacgcaaagtcatcccgctccctcacctggca

SEQ ID NO: 151914 - DNA, 36 bp, Artificial Sequence
  Synthetic oligonucleotide
tccgagcatcgccgtatgacttctggcctcccctca

SEQ ID NO: 151915 - DNA, 35 bp, Artificial Sequence
  Synthetic oligonucleotide
tttcaccaaaactgtgctctattgcccgtccctca

SEQ ID NO: 151916 - DNA, 35 bp, Artificial Sequence
  Synthetic oligonucleotide
ttgcccgtgttgtcaactccttcttagcgctctca

SEQ ID NO: 151917 - DNA, 35 bp, Artificial Sequence
  Synthetic oligonucleotide
gtacccgcccccccgcaattatagaagactggaga

SEQ ID NO: 151918 - DNA, 37 bp, Artificial Sequence
  Synthetic oligonucleotide
gctgcgactatatccacatatgcccgccgtaccccga

SEQ ID NO: 151919 - DNA, 37 bp, Artificial Sequence
  Synthetic oligonucleotide
aagagagcgaaggataaacgggtaatggggcgtcgga

SEQ ID NO: 151920 - DNA, 36 bp, Artificial Sequence
  Synthetic oligonucleotide
taaggaggggtcgccgggggcacagagggacgggga

SEQ ID NO: 151921 - DNA, 38 bp, Artificial Sequence
  Synthetic oligonucleotide
gtgcaacccacacgcgcgtccacgccctcacaccctga

SEQ ID NO: 151922 - DNA, 35 bp, Artificial Sequence
  Synthetic oligonucleotide
attccgtccattcgccgaccctctcctgtctctga

SEQ ID NO: 151923 - DNA, 38 bp, Artificial Sequence
  Synthetic oligonucleotide
aagggaggggcgggggggcgatgagtcggatagtgtga

SEQ ID NO: 151924 - DNA, 36 bp, Artificial Sequence
  Synthetic oligonucleotide
tgtgagagaggggcgggaatactgggcaggtacata

SEQ ID NO: 151925 - DNA, 36 bp, Artificial Sequence
  Synthetic oligonucleotide
ggtacgccacggcttttctgaccccatctcgcccta

SEQ ID NO: 151926 - DNA, 36 bp, Artificial Sequence
  Synthetic oligonucleotide
acccgctgtgtcccgcttgatttgctcgctcccgta

SEQ ID NO: 151927 - DNA, 35 bp, Artificial Sequence
  Synthetic oligonucleotide
ttctctgcctcctccttgcccactcggtgtttgta

SEQ ID NO: 151928 - DNA, 35 bp, Artificial Sequence
  Synthetic oligonucleotide
tcgcctccacattgaccgcctctgaccacccgtta

SEQ ID NO: 151929 - DNA, 35 bp, Artificial Sequence
  Synthetic oligonucleotide
agttcccgcccccgtggcatgcacttgtaatttac

SEQ ID NO: 151930 - DNA, 35 bp, Artificial Sequence
  Synthetic oligonucleotide
gccccgcgcctggtcttaccacgttgttgcacacc

SEQ ID NO: 151931 - DNA, 35 bp, Artificial Sequence
  Synthetic oligonucleotide
tcgaaacgtagtctgcatgacgccgcaccctaccc

SEQ ID NO: 151932 - DNA, 35 bp, Artificial Sequence
  Synthetic oligonucleotide
gtccttgccggttccacgtgagcccccattccgcc

SEQ ID NO: 151933 - DNA, 35 bp, Artificial Sequence
  Synthetic oligonucleotide
acgcaaccccggcccgttacttcagaacactcgcc

SEQ ID NO: 151934 - DNA, 35 bp, Artificial Sequence
  Synthetic oligonucleotide
gctgtaccctgcattagtcctagacgcctctttcc

SEQ ID NO: 151935 - DNA, 35 bp, Artificial Sequence
  Synthetic oligonucleotide
agcggagccacaatttcgttccctgctgtacccgc

SEQ ID NO: 151936 - DNA, 35 bp, Artificial Sequence
  Synthetic oligonucleotide
tgatccccacctttcacgatccagtcagtccccgc

SEQ ID NO: 151937 - DNA, 35 bp, Artificial Sequence
  Synthetic oligonucleotide
ataggtccagctgccgtttctgttcctctccgcgc

SEQ ID NO: 151938 - DNA, 35 bp, Artificial Sequence
  Synthetic oligonucleotide
atcccgcacctggcatgttcgccctactttctcgc

SEQ ID NO: 151939 - DNA, 35 bp, Artificial Sequence
  Synthetic oligonucleotide
gagtgcgcaaccacatcccgtcccctaatttgggc

SEQ ID NO: 151940 - DNA, 35 bp, Artificial Sequence
  Synthetic oligonucleotide
gcactgtttatccctgttacccgcccctccgtggc

SEQ ID NO: 151941 - DNA, 35 bp, Artificial Sequence
  Synthetic oligonucleotide
acgtactcccgccacatcgtacagcccaaccctgc

SEQ ID NO: 151942 - DNA, 35 bp, Artificial Sequence
  Synthetic oligonucleotide
ggtgtcgcaccattcctcgaatcgtcctcccgttc

SEQ ID NO: 151943 - DNA, 35 bp, Artificial Sequence
  Synthetic oligonucleotide
aaccgtacaagcgcacctcagcaatccgtccgttc

SEQ ID NO: 151944 - DNA, 35 bp, Artificial Sequence
  Synthetic oligonucleotide
attcaccccgtcaccgatactaatcctccttgcag

SEQ ID NO: 151945 - DNA, 35 bp, Artificial Sequence
  Synthetic oligonucleotide
tgcacctggcctcacttcacgccttccctgtaacg

SEQ ID NO: 151946 - DNA, 35 bp, Artificial Sequence
  Synthetic oligonucleotide
gacatctgtatacaccactcaccgccttcccgacg

SEQ ID NO: 151947 - DNA, 35 bp, Artificial Sequence
  Synthetic oligonucleotide
gtccccaacgctccgttgccgctgagatctccccg

SEQ ID NO: 151948 - DNA, 35 bp, Artificial Sequence
  Synthetic oligonucleotide
gcccccattcacacgcgtccccgttccactattcg

SEQ ID NO: 151949 - DNA, 35 bp, Artificial Sequence
  Synthetic oligonucleotide
accgagagagggacggggatatagaggggcctggg

SEQ ID NO: 151950 - DNA, 35 bp, Artificial Sequence
  Synthetic oligonucleotide
taaccagggagcaagggaggggggtgttgaaatgg

SEQ ID NO: 151951 - DNA, 35 bp, Artificial Sequence
  Synthetic oligonucleotide
gtgggggggtagggaggtgaccgcaagtacggtgg

SEQ ID NO: 151952 - DNA, 34 bp, Artificial Sequence
  Synthetic oligonucleotide
gtactgcgcactgtctttctcccgccgctaggtg

SEQ ID NO: 151953 - DNA, 33 bp, Artificial Sequence
  Synthetic oligonucleotide
tgtgttgactccatggacctgtcgccccttttg

SEQ ID NO: 151954 - DNA, 35 bp, Artificial Sequence
  Synthetic oligonucleotide
tctcgtgcatccaccgacacccctatctgtttttg

SEQ ID NO: 151955 - DNA, 35 bp, Artificial Sequence
  Synthetic oligonucleotide
acagacatacggcattcagtgccatcgcccaccat

SEQ ID NO: 151956 - DNA, 35 bp, Artificial Sequence
  Synthetic oligonucleotide
agtcccgcccctgagagaaagccctctgctcccat

SEQ ID NO: 151957 - DNA, 35 bp, Artificial Sequence
  Synthetic oligonucleotide
gttgccccatccgactcccatctctctaaagacct

SEQ ID NO: 151958 - DNA, 35 bp, Artificial Sequence
  Synthetic oligonucleotide
acgctgcccgtgcgagcggtcgcgcccttttccct

SEQ ID NO: 151959 - DNA, 35 bp, Artificial Sequence
  Synthetic oligonucleotide
agatcacagggtgtcgctccttgtccattcctcct

SEQ ID NO: 151960 - DNA, 35 bp, Artificial Sequence
  Synthetic oligonucleotide
gccccgtgggcattgaatgtgtttcctttcctcct

SEQ ID NO: 151961 - DNA, 35 bp, Artificial Sequence
  Synthetic oligonucleotide
gaccgacccgtaacatcgggcctcacttttctcct

SEQ ID NO: 151962 - DNA, 35 bp, Artificial Sequence
  Synthetic oligonucleotide
gagtccatcagctagcgccctcaccactgcctgct

SEQ ID NO: 151963 - DNA, 35 bp, Artificial Sequence
  Synthetic oligonucleotide
agcaagcggaagcgcaaactcggttcgtcacctct

SEQ ID NO: 151964 - DNA, 35 bp, Artificial Sequence
  Synthetic oligonucleotide
tttgacgccgctgaggagtcccgccatttatttct

SEQ ID NO: 151965 - DNA, 35 bp, Artificial Sequence
  Synthetic oligonucleotide
gactccctccctgtttgacgcctgcgttaagcagt

SEQ ID NO: 151966 - DNA, 35 bp, Artificial Sequence
  Synthetic oligonucleotide
agcttgaccctgcctccaatcgcctttcctgatgt

SEQ ID NO: 151967 - DNA, 35 bp, Artificial Sequence
  Synthetic oligonucleotide
tcagcacccgtcgtcattatacctgaatcccctgt

SEQ ID NO: 151968 - DNA, 35 bp, Artificial Sequence
  Synthetic oligonucleotide
tacccgatcctcctgcgccttcagcaattcctgtt

SEQ ID NO: 151969 - DNA, 35 bp, Artificial Sequence
  Synthetic oligonucleotide
accccccctgtccttacgtgtaagttccatctgtt

SEQ ID NO: 151970 - DNA, 35 bp, Artificial Sequence
  Synthetic oligonucleotide
tagaccaccgcgatcctgtcctgccgacgcctttt

SEQ ID NO: 151971 - DNA, 36 bp, Artificial Sequence
  Synthetic oligonucleotide
accgaccccgcccgtttcctccccgcatggaaggaa

SEQ ID NO: 151972 - DNA, 36 bp, Artificial Sequence
  Synthetic oligonucleotide
gccacctcacacggctttgagaactctttttatcca

SEQ ID NO: 151973 - DNA, 35 bp, Artificial Sequence
  Synthetic oligonucleotide
tcaaccgcacgaccctcagctcactagtgcctcca

SEQ ID NO: 151974 - DNA, 35 bp, Artificial Sequence
  Synthetic oligonucleotide
acatctgcaatcactcgttatctagtcactctcca

SEQ ID NO: 151975 - DNA, 36 bp, Artificial Sequence
  Synthetic oligonucleotide
gtctgcaccattcctgtggctctttccctgatcgca

SEQ ID NO: 151976 - DNA, 36 bp, Artificial Sequence
  Synthetic oligonucleotide
atgcccttccgtatgcctatccttgctgatttctca

SEQ ID NO: 151977 - DNA, 37 bp, Artificial Sequence
  Synthetic oligonucleotide
ttcgaagcgcgccgcctgtttgtttgtcctccaccga

SEQ ID NO: 151978 - DNA, 37 bp, Artificial Sequence
  Synthetic oligonucleotide
tcaaccacatgtcttcgttataggctccacacctcga

SEQ ID NO: 151979 - DNA, 37 bp, Artificial Sequence
  Synthetic oligonucleotide
ttgggtgggaggggcataggttacacaacgaccggga

SEQ ID NO: 151980 - DNA, 36 bp, Artificial Sequence
  Synthetic oligonucleotide
tagacgtacggggaggggtatgataggggtgcggga

SEQ ID NO: 151981 - DNA, 35 bp, Artificial Sequence
  Synthetic oligonucleotide
tttcggagggggaaagcggggagagaattagggga

SEQ ID NO: 151982 - DNA, 37 bp, Artificial Sequence
  Synthetic oligonucleotide
gagtagtacagagggggaaagtgcggtaggaatggga

SEQ ID NO: 151983 - DNA, 35 bp, Artificial Sequence
  Synthetic oligonucleotide
taacctccccgatcgcctcccggtccaaccctgga

SEQ ID NO: 151984 - DNA, 37 bp, Artificial Sequence
  Synthetic oligonucleotide
ggggggagtggatcgggtgtaggcgggcgcgcgatga

SEQ ID NO: 151985 - DNA, 37 bp, Artificial Sequence
  Synthetic oligonucleotide
gtcccagctctgcgcctctaccgccacgtttgcctga

SEQ ID NO: 151986 - DNA, 35 bp, Artificial Sequence
  Synthetic oligonucleotide
aacgcgcacccttttgctgacgatctaccctctga

SEQ ID NO: 151987 - DNA, 38 bp, Artificial Sequence
  Synthetic oligonucleotide
gcgccacccgtcacctgaaaatgcccgccccgttctga

SEQ ID NO: 151988 - DNA, 37 bp, Artificial Sequence
  Synthetic oligonucleotide
aatggtcccgcccactataagccctccccctcggtga

SEQ ID NO: 151989 - DNA, 38 bp, Artificial Sequence
  Synthetic oligonucleotide
gtggggcgtgggaagggcggaaaaggagtggaaattga

SEQ ID NO: 151990 - DNA, 37 bp, Artificial Sequence
  Synthetic oligonucleotide
gttcacgccaattagcatcccctctggctccacttga

SEQ ID NO: 151991 - DNA, 37 bp, Artificial Sequence
  Synthetic oligonucleotide
tatccgcctactgtcgttcctcgtacgtcctccttga

SEQ ID NO: 151992 - DNA, 38 bp, Artificial Sequence
  Synthetic oligonucleotide
gtcactgctggcgtgaccggttcccttctcttgcttga

SEQ ID NO: 151993 - DNA, 36 bp, Artificial Sequence
  Synthetic oligonucleotide
gcccccgccccgctttctcgttaggaatcacccata

SEQ ID NO: 151994 - DNA, 36 bp, Artificial Sequence
  Synthetic oligonucleotide
tgctccaccggtttctgtgcttctcgtcgctccata

SEQ ID NO: 151995 - DNA, 35 bp, Artificial Sequence
  Synthetic oligonucleotide
atgcctcccctctacttgtcccacgctcgtgctta

SEQ ID NO: 151996 - DNA, 36 bp, Artificial Sequence
  Synthetic oligonucleotide
ggacacctcgacctaggtcagtccttccacctttta

SEQ ID NO: 151997 - DNA, 35 bp, Artificial Sequence
  Synthetic oligonucleotide
ccccgacctcccttccgatgttgtgctccacacac

SEQ ID NO: 151998 - DNA, 35 bp, Artificial Sequence
  Synthetic oligonucleotide
ggacaactgccctggccgtcccccgctcttttcac

SEQ ID NO: 151999 - DNA, 35 bp, Artificial Sequence
  Synthetic oligonucleotide
acccaacacctcgacgtaggaagtcaacaccaccc

SEQ ID NO: 152000 - DNA, 35 bp, Artificial Sequence
  Synthetic oligonucleotide
acagactcgctgagagctccatcagttcttccccc

SEQ ID NO: 152001 - DNA, 35 bp, Artificial Sequence
  Synthetic oligonucleotide
cctgtgcagtcgcgttatcatcctatctgctgccc

SEQ ID NO: 152002 - DNA, 35 bp, Artificial Sequence
  Synthetic oligonucleotide
cgtatcgaggcgttctatcttatgcttctgtctcc

SEQ ID NO: 152003 - DNA, 35 bp, Artificial Sequence
  Synthetic oligonucleotide
ggacccccatcacagtccaccgttacatttcgatc

SEQ ID NO: 152004 - DNA, 35 bp, Artificial Sequence
  Synthetic oligonucleotide
tcaacggccgttctgctaatttggtgctctccctc

SEQ ID NO: 152005 - DNA, 35 bp, Artificial Sequence
  Synthetic oligonucleotide
gtgggattggggaggggttgtgatgggggggcccg

SEQ ID NO: 152006 - DNA, 35 bp, Artificial Sequence
  Synthetic oligonucleotide
ggccaaccccctccccgtctcgttactgccgtgcg

SEQ ID NO: 152007 - DNA, 35 bp, Artificial Sequence
  Synthetic oligonucleotide
accccgacgtaggtcgattctgttcatatctttcg

SEQ ID NO: 152008 - DNA, 35 bp, Artificial Sequence
  Synthetic oligonucleotide
agcgaccaccgcgctatcttaatcccttctgcact

SEQ ID NO: 152009 - DNA, 35 bp, Artificial Sequence
  Synthetic oligonucleotide
atgtgccgcagcccattttttacagtcctatgcct

SEQ ID NO: 152010 - DNA, 35 bp, Artificial Sequence
  Synthetic oligonucleotide
gccccctcaccgtgatcgccgccacgtaccctgct

SEQ ID NO: 152011 - DNA, 35 bp, Artificial Sequence
  Synthetic oligonucleotide
tccatcctacaggcgagttgtacctccgtccccgt

SEQ ID NO: 152012 - DNA, 35 bp, Artificial Sequence
  Synthetic oligonucleotide
aacccatcaccgccactcacaagcgtttgcccctt

SEQ ID NO: 152013 - DNA, 35 bp, Artificial Sequence
  Synthetic oligonucleotide
gccactctcttcgctcctacccacatgtgcacgtt

SEQ ID NO: 152014 - DNA, 35 bp, Artificial Sequence
  Synthetic oligonucleotide
ggagccgtactgcactttaaccactccctcgtgtt

SEQ ID NO: 152015 - DNA, 36 bp, Artificial Sequence
  Synthetic oligonucleotide
ttgggagggtgaggagggttaagtggaaccggaaaa

SEQ ID NO: 152016 - DNA, 36 bp, Artificial Sequence
  Synthetic oligonucleotide
gacccccccctcattgttcgttaaacgaggcccaaa

SEQ ID NO: 152017 - DNA, 36 bp, Artificial Sequence
  Synthetic oligonucleotide
gtacactccgactactgatcctgtccgcctttcgaa

SEQ ID NO: 152018 - DNA, 36 bp, Artificial Sequence
  Synthetic oligonucleotide
aactaccgcctctgtaagcaacacttgccttgataa

SEQ ID NO: 152019 - DNA, 35 bp, Artificial Sequence
  Synthetic oligonucleotide
acttgcccgccatccgttacgtgtttccgctaaca

SEQ ID NO: 152020 - DNA, 35 bp, Artificial Sequence
  Synthetic oligonucleotide
tgcacatcccaccccgcccgtcacagtgttcacca

SEQ ID NO: 152021 - DNA, 36 bp, Artificial Sequence
  Synthetic oligonucleotide
ttacaccctcttgcccattgtatcgagtccaaccca

SEQ ID NO: 152022 - DNA, 36 bp, Artificial Sequence
  Synthetic oligonucleotide
gcatgccgcccacacgccgtcgtatcccttccccca

SEQ ID NO: 152023 - DNA, 36 bp, Artificial Sequence
  Synthetic oligonucleotide
gatgtgccgccccatctgtgtcgccaggcttcccca

SEQ ID NO: 152024 - DNA, 35 bp, Artificial Sequence
  Synthetic oligonucleotide
tccaccctcgacctgcattgccatccacccatcca

SEQ ID NO: 152025 - DNA, 36 bp, Artificial Sequence
  Synthetic oligonucleotide
tccgcctccctcagcacttccgttaggccttgtcca

SEQ ID NO: 152026 - DNA, 36 bp, Artificial Sequence
  Synthetic oligonucleotide
gccattgccatacgaggcgccgagctaccccttcca

SEQ ID NO: 152027 - DNA, 34 bp, Artificial Sequence
  Synthetic oligonucleotide
aattcccgacacaccgcccactgcatttaatgca

SEQ ID NO: 152028 - DNA, 36 bp, Artificial Sequence
  Synthetic oligonucleotide
tcacgtcagattgcgccggcccgacttcttgcttca

SEQ ID NO: 152029 - DNA, 36 bp, Artificial Sequence
  Synthetic oligonucleotide
tcacccaccccccagtaacggtgccacatttccaga

SEQ ID NO: 152030 - DNA, 37 bp, Artificial Sequence
  Synthetic oligonucleotide
agaaccaagggggacgatagggggcgagggatagaga

SEQ ID NO: 152031 - DNA, 36 bp, Artificial Sequence
  Synthetic oligonucleotide
tactccgacaacgggagatacgggaagggcgggcga

SEQ ID NO: 152032 - DNA, 36 bp, Artificial Sequence
  Synthetic oligonucleotide
gtagcctgtcacacgaactcccttcccttcctgcga

SEQ ID NO: 152033 - DNA, 37 bp, Artificial Sequence
  Synthetic oligonucleotide
gtcacagccccatctcgcctccgctaggtctcgcgga

SEQ ID NO: 152034 - DNA, 37 bp, Artificial Sequence
  Synthetic oligonucleotide
gatgtaagaggaaggtggtgggatgtggggagtggga

SEQ ID NO: 152035 - DNA, 37 bp, Artificial Sequence
  Synthetic oligonucleotide
tagcgcacgcccctcgctgatatatcgtcttactgga

SEQ ID NO: 152036 - DNA, 38 bp, Artificial Sequence
  Synthetic oligonucleotide
tgactgtgaagtggggtgctggtgacgggggagtatga

SEQ ID NO: 152037 - DNA, 37 bp, Artificial Sequence
  Synthetic oligonucleotide
agcatgctacctcgtgctgcttttctgttctccctga

SEQ ID NO: 152038 - DNA, 38 bp, Artificial Sequence
  Synthetic oligonucleotide
tcgacccccacgaatgtaattgccaccagccctgctga

SEQ ID NO: 152039 - DNA, 38 bp, Artificial Sequence
  Synthetic oligonucleotide
gccgagttgagggaaggggagggcacgggctacagtga

SEQ ID NO: 152040 - DNA, 36 bp, Artificial Sequence
  Synthetic oligonucleotide
gttaccgccacaatcaaaacgcgccccctaccgtga

SEQ ID NO: 152041 - DNA, 37 bp, Artificial Sequence
  Synthetic oligonucleotide
tgccgacgtgtggcctctctgtacgttccatccttga

SEQ ID NO: 152042 - DNA, 36 bp, Artificial Sequence
  Synthetic oligonucleotide
accccgaccccactacctatcgatgtgtctttttga

SEQ ID NO: 152043 - DNA, 35 bp, Artificial Sequence
  Synthetic oligonucleotide
actcacccgccgtgctcaatacctattcacccata

SEQ ID NO: 152044 - DNA, 35 bp, Artificial Sequence
  Synthetic oligonucleotide
gcctcccgtagcattgttatgtccgccttccgata

SEQ ID NO: 152045 - DNA, 36 bp, Artificial Sequence
  Synthetic oligonucleotide
gcacacccggtagtcctcgctctgttacaccctcta

SEQ ID NO: 152046 - DNA, 35 bp, Artificial Sequence
  Synthetic oligonucleotide
gaaggggagatagggcgtgtgggcgggaatgtcta

SEQ ID NO: 152047 - DNA, 35 bp, Artificial Sequence
  Synthetic oligonucleotide
tcaccgtttgtcggcctcctaccctccttttagta

SEQ ID NO: 152048 - DNA, 35 bp, Artificial Sequence
  Synthetic oligonucleotide
tacgacactcgtgttatccccgcccacattctgta

SEQ ID NO: 152049 - DNA, 36 bp, Artificial Sequence
  Synthetic oligonucleotide
actctccaccgctagaacggacccgagccttactta

SEQ ID NO: 152050 - DNA, 35 bp, Artificial Sequence
  Synthetic oligonucleotide
taccgactcatcttgtcctggaccttgccacttta

SEQ ID NO: 152051 - DNA, 35 bp, Artificial Sequence
  Synthetic oligonucleotide
gactccggcatcccacgcttaggccaccctgccac

SEQ ID NO: 152052 - DNA, 35 bp, Artificial Sequence
  Synthetic oligonucleotide
gctagggagggtagggggattggggttggtggcac

SEQ ID NO: 152053 - DNA, 35 bp, Artificial Sequence
  Synthetic oligonucleotide
gtactgcgccacccccctcttgcccccgttgcacc

SEQ ID NO: 152054 - DNA, 35 bp, Artificial Sequence
  Synthetic oligonucleotide
tctggcaaacgccggccgcggcactccgccccccc

SEQ ID NO: 152055 - DNA, 35 bp, Artificial Sequence
  Synthetic oligonucleotide
tcagctgatccagctctgtcctgcccctgttgccc

SEQ ID NO: 152056 - DNA, 35 bp, Artificial Sequence
  Synthetic oligonucleotide
ggtcacacatcacacccgctaccagaggacacgcc

SEQ ID NO: 152057 - DNA, 34 bp, Artificial Sequence
  Synthetic oligonucleotide
atgtcatcccacctgtctaatgcctgactccgcc

SEQ ID NO: 152058 - DNA, 35 bp, Artificial Sequence
  Synthetic oligonucleotide
ttaggccgttcctgtccagctgcataatcctcgcc

SEQ ID NO: 152059 - DNA, 35 bp, Artificial Sequence
  Synthetic oligonucleotide
gtcactccgaaatacgtcgactcctctgctctcgc

SEQ ID NO: 152060 - DNA, 35 bp, Artificial Sequence
  Synthetic oligonucleotide
tacgggacggtcatatcagcttctttccccttcgc

SEQ ID NO: 152061 - DNA, 35 bp, Artificial Sequence
  Synthetic oligonucleotide
gtgtgcctctcctcccatcgaagacgccccaatgc

SEQ ID NO: 152062 - DNA, 35 bp, Artificial Sequence
  Synthetic oligonucleotide
gttctgctcccccgcacctagacacattgtcatgc

SEQ ID NO: 152063 - DNA, 35 bp, Artificial Sequence
  Synthetic oligonucleotide
gatcgagccccgatttccccatcatcatgcattgc

SEQ ID NO: 152064 - DNA, 35 bp, Artificial Sequence
  Synthetic oligonucleotide
tcccaacttaggtatggcattgcccgcccgccctc

SEQ ID NO: 152065 - DNA, 35 bp, Artificial Sequence
  Synthetic oligonucleotide
aagttgcacggcctccgcacctctccgtctcagtc

SEQ ID NO: 152066 - DNA, 35 bp, Artificial Sequence
  Synthetic oligonucleotide
aactgcagtagccacctccgtcaccttcgcacgtc

SEQ ID NO: 152067 - DNA, 35 bp, Artificial Sequence
  Synthetic oligonucleotide
agtccaatcccctgggcctgtctattatcccgttc

SEQ ID NO: 152068 - DNA, 35 bp, Artificial Sequence
  Synthetic oligonucleotide
gcacccaccctggcgacactgcctacacacccaag

SEQ ID NO: 152069 - DNA, 35 bp, Artificial Sequence
  Synthetic oligonucleotide
tcgcgccctcccagtttccacatcgttcttaagcg

SEQ ID NO: 152070 - DNA, 35 bp, Artificial Sequence
  Synthetic oligonucleotide
accccatccaacagtatagttcgttcctcttagcg

SEQ ID NO: 152071 - DNA, 35 bp, Artificial Sequence
  Synthetic oligonucleotide
gttgccgcctgcaaatcccagcgtaatttccctcg

SEQ ID NO: 152072 - DNA, 35 bp, Artificial Sequence
  Synthetic oligonucleotide
tcatgaatgcggggggaggtgggataggggcctgg

SEQ ID NO: 152073 - DNA, 35 bp, Artificial Sequence
  Synthetic oligonucleotide
tgtgagtctcccctctgttgtctgcaatccacctg

SEQ ID NO: 152074 - DNA, 35 bp, Artificial Sequence
  Synthetic oligonucleotide
tccatggccaccacactcggttatagacttccctg

SEQ ID NO: 152075 - DNA, 35 bp, Artificial Sequence
  Synthetic oligonucleotide
ttggagagtgggtgggagggttctggcaccacttg

SEQ ID NO: 152076 - DNA, 35 bp, Artificial Sequence
  Synthetic oligonucleotide
ttctgccgcctgccatcctatcaggtacaccgttg

SEQ ID NO: 152077 - DNA, 35 bp, Artificial Sequence
  Synthetic oligonucleotide
atgcccccgacttcttgcactttgctggccctact

SEQ ID NO: 152078 - DNA, 35 bp, Artificial Sequence
  Synthetic oligonucleotide
attgtctcgcctgttgacgctactccccacaatct

SEQ ID NO: 152079 - DNA, 35 bp, Artificial Sequence
  Synthetic oligonucleotide
ggtggaggcgggttgggacggtagggctgatatct

SEQ ID NO: 152080 - DNA, 35 bp, Artificial Sequence
  Synthetic oligonucleotide
atccccaccgccttttgcttctagctctgcacttt

SEQ ID NO: 152081 - DNA, 35 bp, Artificial Sequence
  Synthetic oligonucleotide
agcgccacatcatgccagttagttcgccccgcttt

SEQ ID NO: 152082 - DNA, 36 bp, Artificial Sequence
  Synthetic oligonucleotide
accacaccagccccattgtacccatgtcgcccaaaa

SEQ ID NO: 152083 - DNA, 35 bp, Artificial Sequence
  Synthetic oligonucleotide
tttcgcccgacccccgccttgttatgtttgtccaa

SEQ ID NO: 152084 - DNA, 35 bp, Artificial Sequence
  Synthetic oligonucleotide
gccattcctccatcttagtcccagttcgtcaggaa

SEQ ID NO: 152085 - DNA, 35 bp, Artificial Sequence
  Synthetic oligonucleotide
agaggaggtacgagaaggagggtacgggaacggaa

SEQ ID NO: 152086 - DNA, 35 bp, Artificial Sequence
  Synthetic oligonucleotide
tcataatgcccccacctgttgtacgtactctttaa

SEQ ID NO: 152087 - DNA, 36 bp, Artificial Sequence
  Synthetic oligonucleotide
atatgggcgggaggggcttttaggaatgtggggaca

SEQ ID NO: 152088 - DNA, 36 bp, Artificial Sequence
  Synthetic oligonucleotide
accgttttgcccaccgcccgctgttctcgcattcca

SEQ ID NO: 152089 - DNA, 36 bp, Artificial Sequence
  Synthetic oligonucleotide
gactccctcctccctgctaaatgggcacttcccgca

SEQ ID NO: 152090 - DNA, 37 bp, Artificial Sequence
  Synthetic oligonucleotide
ggtcgtcccccgctgccttgtttcttacactctacga

SEQ ID NO: 152091 - DNA, 37 bp, Artificial Sequence
  Synthetic oligonucleotide
tcgccgtcctcttacgcgtctataacacttcctccga

SEQ ID NO: 152092 - DNA, 37 bp, Artificial Sequence
  Synthetic oligonucleotide
aacgctgcagcacatctacgtcacagcctctctccga

SEQ ID NO: 152093 - DNA, 37 bp, Artificial Sequence
  Synthetic oligonucleotide
atccgtgcccctcctgccttattcgtcgtttctccga

SEQ ID NO: 152094 - DNA, 37 bp, Artificial Sequence
  Synthetic oligonucleotide
gaccgggaaggggtgtacgatgggggcgggctagcga

SEQ ID NO: 152095 - DNA, 37 bp, Artificial Sequence
  Synthetic oligonucleotide
gccctccccatcacgccgcctcatgctcgcatatcga

SEQ ID NO: 152096 - DNA, 37 bp, Artificial Sequence
  Synthetic oligonucleotide
gcaggggggtgaggggctggcgtgggctagggaagga

SEQ ID NO: 152097 - DNA, 37 bp, Artificial Sequence
  Synthetic oligonucleotide
gcccacctgttacgcctgtcttttcttcccgactgga

SEQ ID NO: 152098 - DNA, 36 bp, Artificial Sequence
  Synthetic oligonucleotide
tcaggtgggcctacgggggggacgggaattcttgga

SEQ ID NO: 152099 - DNA, 38 bp, Artificial Sequence
  Synthetic oligonucleotide
ttcacctcaagttgcctcttacccacgtcttccactga

SEQ ID NO: 152100 - DNA, 38 bp, Artificial Sequence
  Synthetic oligonucleotide
ttagctcactgcctgccctaaccgctcttgtttcctga

SEQ ID NO: 152101 - DNA, 36 bp, Artificial Sequence
  Synthetic oligonucleotide
gcagtccatccgcggccgcccctgttatctttctga

SEQ ID NO: 152102 - DNA, 38 bp, Artificial Sequence
  Synthetic oligonucleotide
accgacggtgcacttcctacgacgccccttgcccgtga

SEQ ID NO: 152103 - DNA, 37 bp, Artificial Sequence
  Synthetic oligonucleotide
atgggtagtggaaccgtgaagggaagggaaagggtga

SEQ ID NO: 152104 - DNA, 38 bp, Artificial Sequence
  Synthetic oligonucleotide
tgacaagcaaaggagttgaaaagggggagaaggggtga

SEQ ID NO: 152105 - DNA, 37 bp, Artificial Sequence
  Synthetic oligonucleotide
gtctactcaccgccgccacacgtcacaagttttgtga

SEQ ID NO: 152106 - DNA, 38 bp, Artificial Sequence
  Synthetic oligonucleotide
gcccagccctttttgtgccacgctctccccggccttga

SEQ ID NO: 152107 - DNA, 38 bp, Artificial Sequence
  Synthetic oligonucleotide
accacccgccgacatcgttgcgtctaccatggccttga

SEQ ID NO: 152108 - DNA, 36 bp, Artificial Sequence
  Synthetic oligonucleotide
gcctcacgccttccctgcccgccttaatggctcata

SEQ ID NO: 152109 - DNA, 36 bp, Artificial Sequence
  Synthetic oligonucleotide
taccgacgctgcctgtcaaacggccattccccacta

SEQ ID NO: 152110 - DNA, 36 bp, Artificial Sequence
  Synthetic oligonucleotide
tattccgcgcgagttacaacgagtccacttccccta

SEQ ID NO: 152111 - DNA, 36 bp, Artificial Sequence
  Synthetic oligonucleotide
tacacctccctacgccgacacggtttccctgggcta

SEQ ID NO: 152112 - DNA, 35 bp, Artificial Sequence
  Synthetic oligonucleotide
taagtcaacgccgccctcctatacacagtatgcta

SEQ ID NO: 152113 - DNA, 36 bp, Artificial Sequence
  Synthetic oligonucleotide
tatcgcgcctctcttgccttagtactgacctttcta

SEQ ID NO: 152114 - DNA, 35 bp, Artificial Sequence
  Synthetic oligonucleotide
tccgaacccacctgctctctgccgtacccatcgta

SEQ ID NO: 152115 - DNA, 35 bp, Artificial Sequence
  Synthetic oligonucleotide
tgtgctggcccgtaatggaccccgccacgcccccc

SEQ ID NO: 152116 - DNA, 35 bp, Artificial Sequence
  Synthetic oligonucleotide
aacattcgcaccgtccctaattccttgcggccccc

SEQ ID NO: 152117 - DNA, 35 bp, Artificial Sequence
  Synthetic oligonucleotide
tgcctgtcccaccatcagtctggctaggctttccc

SEQ ID NO: 152118 - DNA, 35 bp, Artificial Sequence
  Synthetic oligonucleotide
atcacctgttcgccccctgagttgcttcttttccc

SEQ ID NO: 152119 - DNA, 35 bp, Artificial Sequence
  Synthetic oligonucleotide
tgaagtgccgctcctggtagtccttgtacctcgcc

SEQ ID NO: 152120 - DNA, 35 bp, Artificial Sequence
  Synthetic oligonucleotide
tgcctccatcttactgttcctttcgtggactatcc

SEQ ID NO: 152121 - DNA, 35 bp, Artificial Sequence
  Synthetic oligonucleotide
gaacgctagtgtttctttgccccacccgcttatcc

SEQ ID NO: 152122 - DNA, 35 bp, Artificial Sequence
  Synthetic oligonucleotide
gagccgcccatctgttcttaccgttccacctgtgc

SEQ ID NO: 152123 - DNA, 35 bp, Artificial Sequence
  Synthetic oligonucleotide
gttctccacatgttcacaccaggtctttcaccatc

SEQ ID NO: 152124 - DNA, 35 bp, Artificial Sequence
  Synthetic oligonucleotide
acctgcgacagaccctcaatagcaccctccctatc

SEQ ID NO: 152125 - DNA, 35 bp, Artificial Sequence
  Synthetic oligonucleotide
atccaatccgccctctccgttacgacagacagttc

SEQ ID NO: 152126 - DNA, 35 bp, Artificial Sequence
  Synthetic oligonucleotide
gtctcgcactcctcccgtttcacaaggacttgttc

SEQ ID NO: 152127 - DNA, 35 bp, Artificial Sequence
  Synthetic oligonucleotide
atccatccaatgcattgaccgtatcccttagtttc

SEQ ID NO: 152128 - DNA, 35 bp, Artificial Sequence
  Synthetic oligonucleotide
tcagctcgcggcccccgctatcacatcctcccgag

SEQ ID NO: 152129 - DNA, 35 bp, Artificial Sequence
  Synthetic oligonucleotide
tgttcaggggggggtggtctcgaaaggggaagacg

SEQ ID NO: 152130 - DNA, 35 bp, Artificial Sequence
  Synthetic oligonucleotide
acccacgaaaccaaccgcttaacagctgccacccg

SEQ ID NO: 152131 - DNA, 35 bp, Artificial Sequence
  Synthetic oligonucleotide
tgtgaccccgtcctctctgccatctccactgcccg

SEQ ID NO: 152132 - DNA, 35 bp, Artificial Sequence
  Synthetic oligonucleotide
tgctcatccaatcatccacccgcgtacccccatcg

SEQ ID NO: 152133 - DNA, 35 bp, Artificial Sequence
  Synthetic oligonucleotide
gttgtgcagtcaaccggcccttcttcactgcttcg

SEQ ID NO: 152134 - DNA, 34 bp, Artificial Sequence
  Synthetic oligonucleotide
atagggcatagggatcgggggtgctggggggagg

SEQ ID NO: 152135 - DNA, 35 bp, Artificial Sequence
  Synthetic oligonucleotide
accacctcaccatgtctcacctcgttcgccctatg

SEQ ID NO: 152136 - DNA, 35 bp, Artificial Sequence
  Synthetic oligonucleotide
gacgtcctgtgtcatcttctatagttcctcgccat

SEQ ID NO: 152137 - DNA, 35 bp, Artificial Sequence
  Synthetic oligonucleotide
tctctacgtgccccccctgcttggttacttcacct

SEQ ID NO: 152138 - DNA, 35 bp, Artificial Sequence
  Synthetic oligonucleotide
tacatgccctttccgacggcaatcaagtgctccct

SEQ ID NO: 152139 - DNA, 35 bp, Artificial Sequence
  Synthetic oligonucleotide
gatgcatggcgagggatggtggtggggacggtgct

SEQ ID NO: 152140 - DNA, 35 bp, Artificial Sequence
  Synthetic oligonucleotide
tccgcccaacgcaaattacttctccgttcgcctct

SEQ ID NO: 152141 - DNA, 35 bp, Artificial Sequence
  Synthetic oligonucleotide
tcccctcgccccccagtttaaaaaagatccgcatt

SEQ ID NO: 152142 - DNA, 35 bp, Artificial Sequence
  Synthetic oligonucleotide
tcgacttgcctggaacacacgccaccatagccctt

SEQ ID NO: 152143 - DNA, 35 bp, Artificial Sequence
  Synthetic oligonucleotide
actccgattcgtacgctgcacacctgtaccatctt

SEQ ID NO: 152144 - DNA, 35 bp, Artificial Sequence
  Synthetic oligonucleotide
tccagccctcaggacattcgctttcactccttctt

SEQ ID NO: 152145 - DNA, 35 bp, Artificial Sequence
  Synthetic oligonucleotide
tgttatcgcaaccccgtgcattcgttacgcccttt

SEQ ID NO: 152146 - DNA, 35 bp, Artificial Sequence
  Synthetic oligonucleotide
gtgacgagggtgttttggggtggggcggtggggaa

SEQ ID NO: 152147 - DNA, 35 bp, Artificial Sequence
  Synthetic oligonucleotide
tgacggagcattaggagggaagtgggtgtggggaa

SEQ ID NO: 152148 - DNA, 36 bp, Artificial Sequence
  Synthetic oligonucleotide
gacctgtcgaccgggaggaggatgggggggggttaa

SEQ ID NO: 152149 - DNA, 36 bp, Artificial Sequence
  Synthetic oligonucleotide
acactacatccccgacgcttagttccgtgttttaca

SEQ ID NO: 152150 - DNA, 35 bp, Artificial Sequence
  Synthetic oligonucleotide
gctcaggtcgctgctttcacggttctctcccacca

SEQ ID NO: 152151 - DNA, 36 bp, Artificial Sequence
  Synthetic oligonucleotide
gcctgccgcgacagataacgtccgccgtccctgtca

SEQ ID NO: 152152 - DNA, 37 bp, Artificial Sequence
  Synthetic oligonucleotide
cccgggagggtgggaggggttaatgttttcgcacaga

SEQ ID NO: 152153 - DNA, 36 bp, Artificial Sequence
  Synthetic oligonucleotide
aaaaccaacagacagggaaagagcggagaggggaga

SEQ ID NO: 152154 - DNA, 37 bp, Artificial Sequence
  Synthetic oligonucleotide
gccacccccctctccgcatgatatcgccccctgtaga

SEQ ID NO: 152155 - DNA, 37 bp, Artificial Sequence
  Synthetic oligonucleotide
tcccacatccgcccgacaatcagtaccttcaccccga

SEQ ID NO: 152156 - DNA, 36 bp, Artificial Sequence
  Synthetic oligonucleotide
gcacagtcgctcctgttctgccgcccacgttcccga

SEQ ID NO: 152157 - DNA, 37 bp, Artificial Sequence
  Synthetic oligonucleotide
tccggtaggggtggaggaggggttgatgccagcgcga

SEQ ID NO: 152158 - DNA, 37 bp, Artificial Sequence
  Synthetic oligonucleotide
gatgcgactgggagattcagggggggcgtggaaagga

SEQ ID NO: 152159 - DNA, 37 bp, Artificial Sequence
  Synthetic oligonucleotide
ttggttccggaggtggggggaggcggggtaccaggga

SEQ ID NO: 152160 - DNA, 37 bp, Artificial Sequence
  Synthetic oligonucleotide
gacgtgagtgggggcggaaagctagtcgggggtggga

SEQ ID NO: 152161 - DNA, 38 bp, Artificial Sequence
  Synthetic oligonucleotide
aactgacgcctgccgcatgtacatccctcgccccatga

SEQ ID NO: 152162 - DNA, 38 bp, Artificial Sequence
  Synthetic oligonucleotide
atcaacgcaccgtcccgcgaccgccgctccatctatga

SEQ ID NO: 152163 - DNA, 38 bp, Artificial Sequence
  Synthetic oligonucleotide
aagcggggggcaaaagggttggcgcaagggggtagtga

SEQ ID NO: 152164 - DNA, 36 bp, Artificial Sequence
  Synthetic oligonucleotide
accccccctagttcgtcctaccctgtcagtctgtga

SEQ ID NO: 152165 - DNA, 38 bp, Artificial Sequence
  Synthetic oligonucleotide
ggggaaggggaagggatagtgaaggatgtaatgtgtga

SEQ ID NO: 152166 - DNA, 38 bp, Artificial Sequence
  Synthetic oligonucleotide
gccacccccgctccctacgcgctcagtcgcccatttga

SEQ ID NO: 152167 - DNA, 38 bp, Artificial Sequence
  Synthetic oligonucleotide
gggagggagggaggcggagcgagcgatagcaggtttga

SEQ ID NO: 152168 - DNA, 38 bp, Artificial Sequence
  Synthetic oligonucleotide
actgcccgctccatgttcccgttatgctccatgtttga

SEQ ID NO: 152169 - DNA, 35 bp, Artificial Sequence
  Synthetic oligonucleotide
gcacctcctgccccccgatcactgacggtacacta

SEQ ID NO: 152170 - DNA, 36 bp, Artificial Sequence
  Synthetic oligonucleotide
tatcaacatccctgtggtaaggccactccgccccta

SEQ ID NO: 152171 - DNA, 36 bp, Artificial Sequence
  Synthetic oligonucleotide
ttgtcacaccccaagtgctcccttcgatcgttgcta

SEQ ID NO: 152172 - DNA, 35 bp, Artificial Sequence
  Synthetic oligonucleotide
acgcccctcctatcgcccctatgactttgtctgta

SEQ ID NO: 152173 - DNA, 32 bp, Artificial Sequence
  Synthetic oligonucleotide
gttaccatcagtctaccgaggaccgcccctta

SEQ ID NO: 152174 - DNA, 36 bp, Artificial Sequence
  Synthetic oligonucleotide
acgccccctccagtccgtctatcgcctgtcccgtta

SEQ ID NO: 152175 - DNA, 36 bp, Artificial Sequence
  Synthetic oligonucleotide
ttcgagagcggtggaggcggcggacggggcgggtta

SEQ ID NO: 152176 - DNA, 35 bp, Artificial Sequence
  Synthetic oligonucleotide
agtccacatccaatcatcgttccttgtagccaaac

SEQ ID NO: 152177 - DNA, 35 bp, Artificial Sequence
  Synthetic oligonucleotide
gttacttccgtgatcccccgcgccacgttgcccac

SEQ ID NO: 152178 - DNA, 35 bp, Artificial Sequence
  Synthetic oligonucleotide
gccatcccctgtaatttcgagccccgtgcctccac

SEQ ID NO: 152179 - DNA, 35 bp, Artificial Sequence
  Synthetic oligonucleotide
atgaccgggctgttgctgcagtcttctcttcgtac

SEQ ID NO: 152180 - DNA, 35 bp, Artificial Sequence
  Synthetic oligonucleotide
gcaccgcggtcccattatccctaccgatgcgcacc

SEQ ID NO: 152181 - DNA, 35 bp, Artificial Sequence
  Synthetic oligonucleotide
tcgatcatactggtaacgacccaccgcctctaccc

SEQ ID NO: 152182 - DNA, 35 bp, Artificial Sequence
  Synthetic oligonucleotide
ttcaatgcccctcgttttaatccaccgggaccgcc

SEQ ID NO: 152183 - DNA, 35 bp, Artificial Sequence
  Synthetic oligonucleotide
gtgcgcccccccgaaggcatttcgatatccaggcc

SEQ ID NO: 152184 - DNA, 35 bp, Artificial Sequence
  Synthetic oligonucleotide
gagcaactcgcctgtccctcgcgcgctcccttgcc

SEQ ID NO: 152185 - DNA, 35 bp, Artificial Sequence
  Synthetic oligonucleotide
gtgtacgccgtcgcgcgtgctccatcgcctctcgc

SEQ ID NO: 152186 - DNA, 35 bp, Artificial Sequence
  Synthetic oligonucleotide
tgtactcccctgtgcttgattgcttcggccattgc

SEQ ID NO: 152187 - DNA, 35 bp, Artificial Sequence
  Synthetic oligonucleotide
tttgccgtcgcctgacatacgacccccatcgcctc

SEQ ID NO: 152188 - DNA, 35 bp, Artificial Sequence
  Synthetic oligonucleotide
tccgtgtcccatggctgagttctgtcactgtcctc

SEQ ID NO: 152189 - DNA, 35 bp, Artificial Sequence
  Synthetic oligonucleotide
agagacggggaggggccgaagaagctaactagaag

SEQ ID NO: 152190 - DNA, 35 bp, Artificial Sequence
  Synthetic oligonucleotide
ttaagggggaggtatcatggggagtcggggggaag

SEQ ID NO: 152191 - DNA, 35 bp, Artificial Sequence
  Synthetic oligonucleotide
ttgtccccgcacatggtcaattgccctccctctag

SEQ ID NO: 152192 - DNA, 35 bp, Artificial Sequence
  Synthetic oligonucleotide
gcgtactctccgccactcattaggtgccaaccccg

SEQ ID NO: 152193 - DNA, 35 bp, Artificial Sequence
  Synthetic oligonucleotide
tgcctatcctcggtatcggttaccttccttctccg

SEQ ID NO: 152194 - DNA, 35 bp, Artificial Sequence
  Synthetic oligonucleotide
atgcccaccggatctaaggcctctacccacacctg

SEQ ID NO: 152195 - DNA, 35 bp, Artificial Sequence
  Synthetic oligonucleotide
gcccagccacgcaagctcccccttcctaacccctg

SEQ ID NO: 152196 - DNA, 35 bp, Artificial Sequence
  Synthetic oligonucleotide
ttgccgtacctcgcccgcaccccgtttctcacaat

SEQ ID NO: 152197 - DNA, 35 bp, Artificial Sequence
  Synthetic oligonucleotide
tgagacgcattgtatttactgtccatttgtaccat

SEQ ID NO: 152198 - DNA, 35 bp, Artificial Sequence
  Synthetic oligonucleotide
gtcactccgcctctttacagcttaccgctgtccat

SEQ ID NO: 152199 - DNA, 35 bp, Artificial Sequence
  Synthetic oligonucleotide
atgggagggagggtcgggtacgaggcagggggcat

SEQ ID NO: 152200 - DNA, 35 bp, Artificial Sequence
  Synthetic oligonucleotide
gacaccctgcttaacttccctaggactcagatcct

SEQ ID NO: 152201 - DNA, 35 bp, Artificial Sequence
  Synthetic oligonucleotide
ttcaacacccccgccaacatttgcgtctttgcgct

SEQ ID NO: 152202 - DNA, 35 bp, Artificial Sequence
  Synthetic oligonucleotide
actgtgtggctgccgtacgtatccttcccatctct

SEQ ID NO: 152203 - DNA, 35 bp, Artificial Sequence
  Synthetic oligonucleotide
atccgccacgcccaatctgtgctaatgcacacatt

SEQ ID NO: 152204 - DNA, 35 bp, Artificial Sequence
  Synthetic oligonucleotide
gccatcccgggttcccttttagcctttctctggtt

SEQ ID NO: 152205 - DNA, 36 bp, Artificial Sequence
  Synthetic oligonucleotide
gacagtcgtccccctttgtcatcaccgcacttccaa

SEQ ID NO: 152206 - DNA, 36 bp, Artificial Sequence
  Synthetic oligonucleotide
atcctaagcgcgccccttctcccgacctattccgaa

SEQ ID NO: 152207 - DNA, 35 bp, Artificial Sequence
  Synthetic oligonucleotide
gactagccttcacgcccgccagaccctttcttaca

SEQ ID NO: 152208 - DNA, 36 bp, Artificial Sequence
  Synthetic oligonucleotide
tacccgccaatacgcccaccgtcccgacacacccca

SEQ ID NO: 152209 - DNA, 36 bp, Artificial Sequence
  Synthetic oligonucleotide
atcgcctagccacgagctctttttacctttgcccca

SEQ ID NO: 152210 - DNA, 35 bp, Artificial Sequence
  Synthetic oligonucleotide
gatcactgacgctcttggtccaaggtcccctatca

SEQ ID NO: 152211 - DNA, 36 bp, Artificial Sequence
  Synthetic oligonucleotide
tatgcccctctttgcatgctgttaaaacctccctca

SEQ ID NO: 152212 - DNA, 37 bp, Artificial Sequence
  Synthetic oligonucleotide
tccgccgaacccaagctgatttccgtgccttcctaga

SEQ ID NO: 152213 - DNA, 37 bp, Artificial Sequence
  Synthetic oligonucleotide
ttggtcgttgaagggggcggagaggggcgagggtaga

SEQ ID NO: 152214 - DNA, 36 bp, Artificial Sequence
  Synthetic oligonucleotide
tcaccgcctctcctcaatccctgtaccggcccacga

SEQ ID NO: 152215 - DNA, 36 bp, Artificial Sequence
  Synthetic oligonucleotide
ggggcggatggtgctgttcggaggaaggaggggcga

SEQ ID NO: 152216 - DNA, 35 bp, Artificial Sequence
  Synthetic oligonucleotide
gaggtcaacggggtaggcggaggagggaggggcga

SEQ ID NO: 152217 - DNA, 35 bp, Artificial Sequence
  Synthetic oligonucleotide
ttcagacaccactgccctacatacaagcctctcga

SEQ ID NO: 152218 - DNA, 37 bp, Artificial Sequence
  Synthetic oligonucleotide
gaacggacgcaggggtggaggaaggtgattgcaatga

SEQ ID NO: 152219 - DNA, 38 bp, Artificial Sequence
  Synthetic oligonucleotide
gcacgcctccgtacgttagtgttcccccctgctattga

SEQ ID NO: 152220 - DNA, 38 bp, Artificial Sequence
  Synthetic oligonucleotide
atcacctcgaccgtagcactgcaccacttttcgcttga

SEQ ID NO: 152221 - DNA, 36 bp, Artificial Sequence
  Synthetic oligonucleotide
gatcgaccatacaccccgcactccgctaacggtaac

SEQ ID NO: 152222 - DNA, 35 bp, Artificial Sequence
  Synthetic oligonucleotide
atctaccaccgctcacctgtaaaccattcgttaac

SEQ ID NO: 152223 - DNA, 34 bp, Artificial Sequence
  Synthetic oligonucleotide
tcccccgtaccgaacgttcccggcttgtgccgac

SEQ ID NO: 152224 - DNA, 35 bp, Artificial Sequence
  Synthetic oligonucleotide
gtcctcccatatgctgactctgttccatctacacc

SEQ ID NO: 152225 - DNA, 35 bp, Artificial Sequence
  Synthetic oligonucleotide
tgctcaacactggtcactgcggcacccgtaccacc

SEQ ID NO: 152226 - DNA, 35 bp, Artificial Sequence
  Synthetic oligonucleotide
tgccaaccagtccccactgcccctgctagatcacc

SEQ ID NO: 152227 - DNA, 35 bp, Artificial Sequence
  Synthetic oligonucleotide
aaccaccgtcatgctccacgtttagcccgcccccc

SEQ ID NO: 152228 - DNA, 33 bp, Artificial Sequence
  Synthetic oligonucleotide
actccgctagtccccttcaccgtacatcagccc

SEQ ID NO: 152229 - DNA, 35 bp, Artificial Sequence
  Synthetic oligonucleotide
tagcacccactgccttcccgcgccatctgtcgccc

SEQ ID NO: 152230 - DNA, 35 bp, Artificial Sequence
  Synthetic oligonucleotide
tcctaaccgtcggccatcactgttcccggatcgcc

SEQ ID NO: 152231 - DNA, 35 bp, Artificial Sequence
  Synthetic oligonucleotide
tagacgacgtcccacggttccgatttcctactgcc

SEQ ID NO: 152232 - DNA, 35 bp, Artificial Sequence
  Synthetic oligonucleotide
actcccaccatctgattagccctttgcgtccatgc

SEQ ID NO: 152233 - DNA, 35 bp, Artificial Sequence
  Synthetic oligonucleotide
gttgcttcccgttaggctccctgtcccttttcatc

SEQ ID NO: 152234 - DNA, 35 bp, Artificial Sequence
  Synthetic oligonucleotide
gcctactgtccgctcccacccttaacccggtagtc

SEQ ID NO: 152235 - DNA, 35 bp, Artificial Sequence
  Synthetic oligonucleotide
gcaacccccatcctcagccttctccgcaataggtc

SEQ ID NO: 152236 - DNA, 35 bp, Artificial Sequence
  Synthetic oligonucleotide
gaagccgccagtagcactccccgtcttagtccttc

SEQ ID NO: 152237 - DNA, 35 bp, Artificial Sequence
  Synthetic oligonucleotide
gctgtctctatcctctgcgtcgttttcagcctttc

SEQ ID NO: 152238 - DNA, 35 bp, Artificial Sequence
  Synthetic oligonucleotide
tgaggtgcctacacttctttgattatgcctgtttc

SEQ ID NO: 152239 - DNA, 35 bp, Artificial Sequence
  Synthetic oligonucleotide
gccaccactccgcactaaggcgccagcctcatccg

SEQ ID NO: 152240 - DNA, 35 bp, Artificial Sequence
  Synthetic oligonucleotide
gtctcctcactattggtttatcggttacctctccg

SEQ ID NO: 152241 - DNA, 35 bp, Artificial Sequence
  Synthetic oligonucleotide
tgcgctctcgccttccccgcctgttctggcccgcg

SEQ ID NO: 152242 - DNA, 35 bp, Artificial Sequence
  Synthetic oligonucleotide
gcacccatcacatcccgcattcctttctgttgcgg

SEQ ID NO: 152243 - DNA, 35 bp, Artificial Sequence
  Synthetic oligonucleotide
tcacccgcctctccactcccccagctcactactgg

SEQ ID NO: 152244 - DNA, 35 bp, Artificial Sequence
  Synthetic oligonucleotide
aaccaagcgactttgcgccctgcccgacgaacctg

SEQ ID NO: 152245 - DNA, 35 bp, Artificial Sequence
  Synthetic oligonucleotide
cccaccactacctgatccgctgttctccacccgtg

SEQ ID NO: 152246 - DNA, 35 bp, Artificial Sequence
  Synthetic oligonucleotide
tagacgcgaaatagtctcccctgtccttggccgtg

SEQ ID NO: 152247 - DNA, 35 bp, Artificial Sequence
  Synthetic oligonucleotide
tgttgggccgcaatgcggaggggaggggagtggtg

SEQ ID NO: 152248 - DNA, 35 bp, Artificial Sequence
  Synthetic oligonucleotide
tgacctgaccgcaactttgatagctacctttcact

SEQ ID NO: 152249 - DNA, 33 bp, Artificial Sequence
  Synthetic oligonucleotide
tgccgcctcgctccggctcccacgtcccttact

SEQ ID NO: 152250 - DNA, 35 bp, Artificial Sequence
  Synthetic oligonucleotide
tacgcctcattcggtgatggccttttctgttacct

SEQ ID NO: 152251 - DNA, 35 bp, Artificial Sequence
  Synthetic oligonucleotide
tgaggcgatcatccggtgcctctgcctcttaccct

SEQ ID NO: 152252 - DNA, 35 bp, Artificial Sequence
  Synthetic oligonucleotide
ttacgcctccccgacagacgtctctgcaccactct

SEQ ID NO: 152253 - DNA, 35 bp, Artificial Sequence
  Synthetic oligonucleotide
atccgctcgacatggtccccgggttctgcttttct

SEQ ID NO: 152254 - DNA, 35 bp, Artificial Sequence
  Synthetic oligonucleotide
atcgccgccacgtggttctgctcgtcccgccccgt

SEQ ID NO: 152255 - DNA, 35 bp, Artificial Sequence
  Synthetic oligonucleotide
gtcgcccatccgcccatacccccgatatgtacttt

SEQ ID NO: 152256 - DNA, 35 bp, Artificial Sequence
  Synthetic oligonucleotide
tgcctgcccctcacccacccgtcagagcgcaccaa

SEQ ID NO: 152257 - DNA, 35 bp, Artificial Sequence
  Synthetic oligonucleotide
gtactggagaagggaagggcggtagaaggtgtcaa

SEQ ID NO: 152258 - DNA, 36 bp, Artificial Sequence
  Synthetic oligonucleotide
gctgccgtacgtcactcacctgccccctcgccagaa

SEQ ID NO: 152259 - DNA, 36 bp, Artificial Sequence
  Synthetic oligonucleotide
gagagggctgagcgggcggggggtgaggcgtgggaa

SEQ ID NO: 152260 - DNA, 34 bp, Artificial Sequence
  Synthetic oligonucleotide
acgaccaccctctatagcaaagccatctttctaa

SEQ ID NO: 152261 - DNA, 35 bp, Artificial Sequence
  Synthetic oligonucleotide
tctctgtccacgcctctagtgcccccaagcctaca

SEQ ID NO: 152262 - DNA, 35 bp, Artificial Sequence
  Synthetic oligonucleotide
tgaaccccatgtgctgtgattcttacgttgcccca

SEQ ID NO: 152263 - DNA, 36 bp, Artificial Sequence
  Synthetic oligonucleotide
tagccggtccaagctgcctccccgtggtcgatctca

SEQ ID NO: 152264 - DNA, 35 bp, Artificial Sequence
  Synthetic oligonucleotide
tagcgaccgacactttgctgctgtcacacctttca

SEQ ID NO: 152265 - DNA, 37 bp, Artificial Sequence
  Synthetic oligonucleotide
tccgccccccgtttcgtagcctttctcgttctcaaga

SEQ ID NO: 152266 - DNA, 37 bp, Artificial Sequence
  Synthetic oligonucleotide
aagacgggactgttgtagggtacgtgagggagggaga

SEQ ID NO: 152267 - DNA, 37 bp, Artificial Sequence
  Synthetic oligonucleotide
gattgggtgggcgggtttagtgtagccccgcacggga

SEQ ID NO: 152268 - DNA, 36 bp, Artificial Sequence
  Synthetic oligonucleotide
gaccctaccccccgtcaccgaccgcccatgacggga

SEQ ID NO: 152269 - DNA, 37 bp, Artificial Sequence
  Synthetic oligonucleotide
atccgactcaccgctccacctcattagaccaccggga

SEQ ID NO: 152270 - DNA, 35 bp, Artificial Sequence
  Synthetic oligonucleotide
accccgcccctgctttctaaactgtttgttttgga

SEQ ID NO: 152271 - DNA, 38 bp, Artificial Sequence
  Synthetic oligonucleotide
gacgctgtaggatagagcgggtggagggggcgggatga

SEQ ID NO: 152272 - DNA, 35 bp, Artificial Sequence
  Synthetic oligonucleotide
ttctccccgctgccttatcctgcccttgtaactga

SEQ ID NO: 152273 - DNA, 37 bp, Artificial Sequence
  Synthetic oligonucleotide
agacaccctccatatagtaacctctgtcctcctctga

SEQ ID NO: 152274 - DNA, 38 bp, Artificial Sequence
  Synthetic oligonucleotide
agcaggcctccgccattttacctccatcgcccgggtga

SEQ ID NO: 152275 - DNA, 38 bp, Artificial Sequence
  Synthetic oligonucleotide
gtgggtcggggaacggaggacgggaggtagaaaattga

SEQ ID NO: 152276 - DNA, 38 bp, Artificial Sequence
  Synthetic oligonucleotide
tagtccacgcccgccattacacacccgtctcaacttga

SEQ ID NO: 152277 - DNA, 38 bp, Artificial Sequence
  Synthetic oligonucleotide
gatgatgaggagaagggatggagcggtgcgagggttga

SEQ ID NO: 152278 - DNA, 36 bp, Artificial Sequence
  Synthetic oligonucleotide
gtccggaacatgcgtcctcctgtctgcgcccttata

SEQ ID NO: 152279 - DNA, 35 bp, Artificial Sequence
  Synthetic oligonucleotide
tcatcgccacaaccgtggaccccccactgatccta

SEQ ID NO: 152280 - DNA, 36 bp, Artificial Sequence
  Synthetic oligonucleotide
tccgatcccccttgcgtgcctgttgctttactctta

SEQ ID NO: 152281 - DNA, 35 bp, Artificial Sequence
  Synthetic oligonucleotide
acacctacccggccgtatttgacgattgcttccac

SEQ ID NO: 152282 - DNA, 35 bp, Artificial Sequence
  Synthetic oligonucleotide
gtacacatcaccggccgccactcccgcgcccttac

SEQ ID NO: 152283 - DNA, 35 bp, Artificial Sequence
  Synthetic oligonucleotide
gctggacaactgctcacgttgctcaatctccttac

SEQ ID NO: 152284 - DNA, 35 bp, Artificial Sequence
  Synthetic oligonucleotide
tgtggccctctcattaaacttgagcctgctacccc

SEQ ID NO: 152285 - DNA, 35 bp, Artificial Sequence
  Synthetic oligonucleotide
tacgcatccatgggcactcggttcctgttatcccc

SEQ ID NO: 152286 - DNA, 35 bp, Artificial Sequence
  Synthetic oligonucleotide
atcagcaccgccacatgccaatcctgttcctcccc

SEQ ID NO: 152287 - DNA, 35 bp, Artificial Sequence
  Synthetic oligonucleotide
ggataccactcacctattcagagagcctttcgccc

SEQ ID NO: 152288 - DNA, 35 bp, Artificial Sequence
  Synthetic oligonucleotide
tcacacgtgtctgtccctgtagtccgtcgttgccc

SEQ ID NO: 152289 - DNA, 35 bp, Artificial Sequence
  Synthetic oligonucleotide
atctcatacgccctccgacaacacgcaggattccc

SEQ ID NO: 152290 - DNA, 35 bp, Artificial Sequence
  Synthetic oligonucleotide
aaaccgcccttcagtgtcatccgcaatcttctgcc

SEQ ID NO: 152291 - DNA, 35 bp, Artificial Sequence
  Synthetic oligonucleotide
tccccttccgtttggatctgttcgcgccgacttcc

SEQ ID NO: 152292 - DNA, 35 bp, Artificial Sequence
  Synthetic oligonucleotide
aacgctcatcgggagcagcgcctcccaccctttcc

SEQ ID NO: 152293 - DNA, 35 bp, Artificial Sequence
  Synthetic oligonucleotide
tcacattgccttgccttatgaaggccacacttcgc

SEQ ID NO: 152294 - DNA, 35 bp, Artificial Sequence
  Synthetic oligonucleotide
ttggtgtcgcggttgtctcccactcattctcgtgc

SEQ ID NO: 152295 - DNA, 35 bp, Artificial Sequence
  Synthetic oligonucleotide
gcctgctggatctccatgccctgtacctctgttgc

SEQ ID NO: 152296 - DNA, 35 bp, Artificial Sequence
  Synthetic oligonucleotide
tccgtggccccaccttgacttagacctgccccctc

SEQ ID NO: 152297 - DNA, 35 bp, Artificial Sequence
  Synthetic oligonucleotide
gtgcaacccataggatttcgtcccttactcgcctc

SEQ ID NO: 152298 - DNA, 35 bp, Artificial Sequence
  Synthetic oligonucleotide
gcaccacaattgcccgagccgctgtgattctcctc

SEQ ID NO: 152299 - DNA, 35 bp, Artificial Sequence
  Synthetic oligonucleotide
gacgagattgccgccctctgttttggtcactggtc

SEQ ID NO: 152300 - DNA, 35 bp, Artificial Sequence
  Synthetic oligonucleotide
ttcctcctgccatacattgttacgcacttcgtgtc

SEQ ID NO: 152301 - DNA, 35 bp, Artificial Sequence
  Synthetic oligonucleotide
tatcgacgtccgcccgcctgtatcacgttctcttc

SEQ ID NO: 152302 - DNA, 35 bp, Artificial Sequence
  Synthetic oligonucleotide
gtgatgccaaatatgccccggagcccccccctcag

SEQ ID NO: 152303 - DNA, 35 bp, Artificial Sequence
  Synthetic oligonucleotide
ggaggtggggggataggggggagagcgtggtcgag

SEQ ID NO: 152304 - DNA, 35 bp, Artificial Sequence
  Synthetic oligonucleotide
gcctcttgccccctctgtcgactcgctccgatacg

SEQ ID NO: 152305 - DNA, 35 bp, Artificial Sequence
  Synthetic oligonucleotide
tcgagcggcctcctctcgtcatccgtaaactgccg

SEQ ID NO: 152306 - DNA, 35 bp, Artificial Sequence
  Synthetic oligonucleotide
ttgcggcactagaccgcctattatgcgcccctccg

SEQ ID NO: 152307 - DNA, 35 bp, Artificial Sequence
  Synthetic oligonucleotide
accggtcaataagggggggataggaaatgggtgtg

SEQ ID NO: 152308 - DNA, 35 bp, Artificial Sequence
  Synthetic oligonucleotide
gccactatctaaatgcgtacgtacccttcctgaat

SEQ ID NO: 152309 - DNA, 35 bp, Artificial Sequence
  Synthetic oligonucleotide
acgtgctcagcccatctactgtctatgcaccacat

SEQ ID NO: 152310 - DNA, 35 bp, Artificial Sequence
  Synthetic oligonucleotide
gccgggaaacgggtggcagagcggagggacggcat

SEQ ID NO: 152311 - DNA, 35 bp, Artificial Sequence
  Synthetic oligonucleotide
atcagctgcccctgcgaacttccgccgttcactat

SEQ ID NO: 152312 - DNA, 35 bp, Artificial Sequence
  Synthetic oligonucleotide
tctccccacacacggtgaacgctatgcccctccct

SEQ ID NO: 152313 - DNA, 35 bp, Artificial Sequence
  Synthetic oligonucleotide
atcgccccactgtgtccgttgagtcccttgtttct

SEQ ID NO: 152314 - DNA, 35 bp, Artificial Sequence
  Synthetic oligonucleotide
tacatcggtcacactcatcccgccggtcgttccgt

SEQ ID NO: 152315 - DNA, 35 bp, Artificial Sequence
  Synthetic oligonucleotide
gagccactgcacgctgaatgtcgcccacaccttgt

SEQ ID NO: 152316 - DNA, 35 bp, Artificial Sequence
  Synthetic oligonucleotide
tgccccgcctacttttgctacatctgactcatgaa

SEQ ID NO: 152317 - DNA, 35 bp, Artificial Sequence
  Synthetic oligonucleotide
gtttcaggggaggtggtcggggcatggggcggtaa

SEQ ID NO: 152318 - DNA, 36 bp, Artificial Sequence
  Synthetic oligonucleotide
tcacaaggcgacgagggggggggagccggggataca

SEQ ID NO: 152319 - DNA, 34 bp, Artificial Sequence
  Synthetic oligonucleotide
ttacagtgggccgcctcgtttctgaccttcacca

SEQ ID NO: 152320 - DNA, 36 bp, Artificial Sequence
  Synthetic oligonucleotide
tttccctccgacgcattataccaggcttgttgccca

SEQ ID NO: 152321 - DNA, 36 bp, Artificial Sequence
  Synthetic oligonucleotide
gtacatagcctctctgaactgtccaccctgtatcca

SEQ ID NO: 152322 - DNA, 35 bp, Artificial Sequence
  Synthetic oligonucleotide
tacaccgcccccctccggcccttccgatctacgca

SEQ ID NO: 152323 - DNA, 36 bp, Artificial Sequence
  Synthetic oligonucleotide
acaccgtagttgtttagccccggttcccccttgtca

SEQ ID NO: 152324 - DNA, 35 bp, Artificial Sequence
  Synthetic oligonucleotide
tcatgcatgctccggtactcacgcccatgccttca

SEQ ID NO: 152325 - DNA, 35 bp, Artificial Sequence
  Synthetic oligonucleotide
tttccgcaacagcgtacaccctcgccactgcttca

SEQ ID NO: 152326 - DNA, 36 bp, Artificial Sequence
  Synthetic oligonucleotide
gcccgtacgcctcccgttgtacacttctgtttttca

SEQ ID NO: 152327 - DNA, 37 bp, Artificial Sequence
  Synthetic oligonucleotide
ttggaggtggtggggtggcttgaggaggataacgaga

SEQ ID NO: 152328 - DNA, 37 bp, Artificial Sequence
  Synthetic oligonucleotide
tacgaaagcgcgggcgggttagttgggggggctacga

SEQ ID NO: 152329 - DNA, 36 bp, Artificial Sequence
  Synthetic oligonucleotide
gtccaccctccaaaatttgcgagttcccatctccga

SEQ ID NO: 152330 - DNA, 35 bp, Artificial Sequence
  Synthetic oligonucleotide
gagcccccaccattccccgagcaaccatctcgcga

SEQ ID NO: 152331 - DNA, 36 bp, Artificial Sequence
  Synthetic oligonucleotide
actcgctctgctgcgccccaccctacacccatgcga

SEQ ID NO: 152332 - DNA, 37 bp, Artificial Sequence
  Synthetic oligonucleotide
ggtgaaggaaagcggaaggaaaagggggggtagtcga

SEQ ID NO: 152333 - DNA, 36 bp, Artificial Sequence
  Synthetic oligonucleotide
aacgtgtcaggcccttgctgacttccccctcttcga

SEQ ID NO: 152334 - DNA, 37 bp, Artificial Sequence
  Synthetic oligonucleotide
tcctgatccccgcctcgatctccactgccactaggga

SEQ ID NO: 152335 - DNA, 38 bp, Artificial Sequence
  Synthetic oligonucleotide
gaccagggaggggggcacgaaactaactgaaggaatga

SEQ ID NO: 152336 - DNA, 38 bp, Artificial Sequence
  Synthetic oligonucleotide
tgtgctcgcaacattgctatctcacacttcctctatga

SEQ ID NO: 152337 - DNA, 38 bp, Artificial Sequence
  Synthetic oligonucleotide
ttgcaacctttgagttgttttccaccgcccttgcctga

SEQ ID NO: 152338 - DNA, 37 bp, Artificial Sequence
  Synthetic oligonucleotide
attacgaccaaagcaaagggtggaggggggaaggtga

SEQ ID NO: 152339 - DNA, 38 bp, Artificial Sequence
  Synthetic oligonucleotide
gttgtagcgataaagaaggagcggggggtgagtggtga

SEQ ID NO: 152340 - DNA, 37 bp, Artificial Sequence
  Synthetic oligonucleotide
gacggaacggtgcagggaggggggggccgggaattga

SEQ ID NO: 152341 - DNA, 37 bp, Artificial Sequence
  Synthetic oligonucleotide
tctatcgccgatcagcccttccttgccccccgattga

SEQ ID NO: 152342 - DNA, 38 bp, Artificial Sequence
  Synthetic oligonucleotide
gacccaacccgcagattactacggcccccctcacttga

SEQ ID NO: 152343 - DNA, 37 bp, Artificial Sequence
  Synthetic oligonucleotide
gcaccctcgacttcgctttgtgctccatccttcttga

SEQ ID NO: 152344 - DNA, 38 bp, Artificial Sequence
  Synthetic oligonucleotide
acccgcaacctatgttcacaccccatgccccgtgttga

SEQ ID NO: 152345 - DNA, 37 bp, Artificial Sequence
  Synthetic oligonucleotide
gccaaacctctgtgcattgttgcccccccttatttga

SEQ ID NO: 152346 - DNA, 35 bp, Artificial Sequence
  Synthetic oligonucleotide
actcccgatcgccggatccttcacatctttccata

SEQ ID NO: 152347 - DNA, 36 bp, Artificial Sequence
  Synthetic oligonucleotide
actccgaccgctcacattgattccggccatctacta

SEQ ID NO: 152348 - DNA, 36 bp, Artificial Sequence
  Synthetic oligonucleotide
gtcgcaccactctgcctgttgcctgaccacccccta

SEQ ID NO: 152349 - DNA, 36 bp, Artificial Sequence
  Synthetic oligonucleotide
taacccgcaggacagacccacgattcgcccgcccta

SEQ ID NO: 152350 - DNA, 36 bp, Artificial Sequence
  Synthetic oligonucleotide
gataggcacccgattctgcacgcttattaattatta

SEQ ID NO: 152351 - DNA, 35 bp, Artificial Sequence
  Synthetic oligonucleotide
gcgagaggagtcatgtaattattgtcctgctccac

SEQ ID NO: 152352 - DNA, 35 bp, Artificial Sequence
  Synthetic oligonucleotide
gaccccctcgctccgttttcccacgtaccccggac

SEQ ID NO: 152353 - DNA, 35 bp, Artificial Sequence
  Synthetic oligonucleotide
gtagacagagggaagggagcggatggttgatggac

SEQ ID NO: 152354 - DNA, 35 bp, Artificial Sequence
  Synthetic oligonucleotide
gttgtcgtcatgaagtgccccatctcgtccgttac

SEQ ID NO: 152355 - DNA, 35 bp, Artificial Sequence
  Synthetic oligonucleotide
tgtgccctttccttgccgtgctcctatcaactccc

SEQ ID NO: 152356 - DNA, 35 bp, Artificial Sequence
  Synthetic oligonucleotide
tcatcggcctggtttacttttagcccttctttccc

SEQ ID NO: 152357 - DNA, 35 bp, Artificial Sequence
  Synthetic oligonucleotide
tagccatgccagtaagctgcctccacccacctagc

SEQ ID NO: 152358 - DNA, 35 bp, Artificial Sequence
  Synthetic oligonucleotide
gcgccttccttgattgcaccttcacttgcccacgc

SEQ ID NO: 152359 - DNA, 35 bp, Artificial Sequence
  Synthetic oligonucleotide
tcgatcggccgcccgtactgcgtttgctcccgcgc

SEQ ID NO: 152360 - DNA, 35 bp, Artificial Sequence
  Synthetic oligonucleotide
acgccctcgtgccgaagcatgacaacacacctcgc

SEQ ID NO: 152361 - DNA, 35 bp, Artificial Sequence
  Synthetic oligonucleotide
tatccccaccgtactccgccactgtctatccttgc

SEQ ID NO: 152362 - DNA, 35 bp, Artificial Sequence
  Synthetic oligonucleotide
tcaacactctggctccccccatccagagacttatc

SEQ ID NO: 152363 - DNA, 35 bp, Artificial Sequence
  Synthetic oligonucleotide
gtccaacgccacggcccgcccgggatcctcccctc

SEQ ID NO: 152364 - DNA, 35 bp, Artificial Sequence
  Synthetic oligonucleotide
gcccttttccgctccataactgtacgtttcctgtc

SEQ ID NO: 152365 - DNA, 35 bp, Artificial Sequence
  Synthetic oligonucleotide
gaacgggaggattggggggagataaaaaatcagag

SEQ ID NO: 152366 - DNA, 35 bp, Artificial Sequence
  Synthetic oligonucleotide
gaagaggggggagaagatatgcgacgggagacgag

SEQ ID NO: 152367 - DNA, 35 bp, Artificial Sequence
  Synthetic oligonucleotide
gagatgggaagggagggtgtggcgattgcgactag

SEQ ID NO: 152368 - DNA, 35 bp, Artificial Sequence
  Synthetic oligonucleotide
tgtgcacctccctgttacacacaacctttttttag

SEQ ID NO: 152369 - DNA, 35 bp, Artificial Sequence
  Synthetic oligonucleotide
gacgcccctcatttctgtactgcccgccctgtacg

SEQ ID NO: 152370 - DNA, 35 bp, Artificial Sequence
  Synthetic oligonucleotide
cgcacgcatcccatctattgtctttccagtcctcg

SEQ ID NO: 152371 - DNA, 35 bp, Artificial Sequence
  Synthetic oligonucleotide
tcacacgcccttctgctaactgtactcgcctttcg

SEQ ID NO: 152372 - DNA, 35 bp, Artificial Sequence
  Synthetic oligonucleotide
gacgacaagggatagaattatggggcggaatgagg

SEQ ID NO: 152373 - DNA, 35 bp, Artificial Sequence
  Synthetic oligonucleotide
tcaaacccgccgccccgcccacattcggacatttg

SEQ ID NO: 152374 - DNA, 35 bp, Artificial Sequence
  Synthetic oligonucleotide
gccgacttccgctgtagctaccccgcggccaccct

SEQ ID NO: 152375 - DNA, 35 bp, Artificial Sequence
  Synthetic oligonucleotide
acccttacgcccacgagatttcgaactccacccct

SEQ ID NO: 152376 - DNA, 35 bp, Artificial Sequence
  Synthetic oligonucleotide
gtcacgccggtgtctatgtccgcccttgcccgcct

SEQ ID NO: 152377 - DNA, 35 bp, Artificial Sequence
  Synthetic oligonucleotide
gccgaccgcccccccgtatagcttgtcaccctcct

SEQ ID NO: 152378 - DNA, 35 bp, Artificial Sequence
  Synthetic oligonucleotide
gggacgtcgcgcatcactccgccttctcactgtct

SEQ ID NO: 152379 - DNA, 35 bp, Artificial Sequence
  Synthetic oligonucleotide
gccatgtaaggtcaagcacgctcctccctcccggt

SEQ ID NO: 152380 - DNA, 35 bp, Artificial Sequence
  Synthetic oligonucleotide
tcccggaccacacccctctgtttctagttccaatt

SEQ ID NO: 152381 - DNA, 35 bp, Artificial Sequence
  Synthetic oligonucleotide
gacgagtgtcacagtatgtttgtcccgccctcttt

SEQ ID NO: 152382 - DNA, 35 bp, Artificial Sequence
  Synthetic oligonucleotide
tagactcccgtccactatctgttcttcccacgttt

SEQ ID NO: 152383 - DNA, 36 bp, Artificial Sequence
  Synthetic oligonucleotide
ggatatggtggggtgggtgaactgggggaggtaaca

SEQ ID NO: 152384 - DNA, 35 bp, Artificial Sequence
  Synthetic oligonucleotide
tcccaactcgatcctattgcttcatatgcctcaca

SEQ ID NO: 152385 - DNA, 35 bp, Artificial Sequence
  Synthetic oligonucleotide
tgccacctttcatgtaacataccctggccgctcca

SEQ ID NO: 152386 - DNA, 35 bp, Artificial Sequence
  Synthetic oligonucleotide
tatcacccgcccatgaaatttgcacgatccttcca

SEQ ID NO: 152387 - DNA, 35 bp, Artificial Sequence
  Synthetic oligonucleotide
tcctcgtccatagagtctctgtccgtcccgttcca

SEQ ID NO: 152388 - DNA, 35 bp, Artificial Sequence
  Synthetic oligonucleotide
aatgcgagggggggaggggctttgctcacggggca

SEQ ID NO: 152389 - DNA, 36 bp, Artificial Sequence
  Synthetic oligonucleotide
gtccgggccccggctcgcttttctattcatcactca

SEQ ID NO: 152390 - DNA, 36 bp, Artificial Sequence
  Synthetic oligonucleotide
tcccctgcactccatctgccccttctctgtcagtca

SEQ ID NO: 152391 - DNA, 35 bp, Artificial Sequence
  Synthetic oligonucleotide
accccatcagccgggcaacaggcccctttccttca

SEQ ID NO: 152392 - DNA, 37 bp, Artificial Sequence
  Synthetic oligonucleotide
gtaggaggattgaagaaaggagtgagggggggggaga

SEQ ID NO: 152393 - DNA, 37 bp, Artificial Sequence
  Synthetic oligonucleotide
tccccacgtccggcctctttcgttcattctgcttaga

SEQ ID NO: 152394 - DNA, 37 bp, Artificial Sequence
  Synthetic oligonucleotide
tcccgcaccgctgtaatcccgcctattaatttgccga

SEQ ID NO: 152395 - DNA, 37 bp, Artificial Sequence
  Synthetic oligonucleotide
agattgggtggaagagagaagggggaaggtgggagga

SEQ ID NO: 152396 - DNA, 35 bp, Artificial Sequence
  Synthetic oligonucleotide
ttgagctcagtcttgactcccgccctcccgcatga

SEQ ID NO: 152397 - DNA, 35 bp, Artificial Sequence
  Synthetic oligonucleotide
accaccatcatgtaacacctcgactccgtgactga

SEQ ID NO: 152398 - DNA, 37 bp, Artificial Sequence
  Synthetic oligonucleotide
tgccagtccgccgcaccgctcgcatttccgcccgtga

SEQ ID NO: 152399 - DNA, 38 bp, Artificial Sequence
  Synthetic oligonucleotide
tcccaggccgggtgggatagtggcgtacgggagggtga

SEQ ID NO: 152400 - DNA, 38 bp, Artificial Sequence
  Synthetic oligonucleotide
gatcaccccctcttatgctcctgtcatgttaacgttga

SEQ ID NO: 152401 - DNA, 35 bp, Artificial Sequence
  Synthetic oligonucleotide
gcccgcccgcacgccacgactcacgccatcaaata

SEQ ID NO: 152402 - DNA, 34 bp, Artificial Sequence
  Synthetic oligonucleotide
tcaccctgcccccgttgactccctaaatgcacta

SEQ ID NO: 152403 - DNA, 35 bp, Artificial Sequence
  Synthetic oligonucleotide
tcgagacggggtaaagccggggtagggtgggagta

SEQ ID NO: 152404 - DNA, 36 bp, Artificial Sequence
  Synthetic oligonucleotide
tccccccgcagacttgcacccctgtttatcgcctta

SEQ ID NO: 152405 - DNA, 36 bp, Artificial Sequence
  Synthetic oligonucleotide
gctacgagccctccgcactccgctgtacttcgctta

SEQ ID NO: 152406 - DNA, 35 bp, Artificial Sequence
  Synthetic oligonucleotide
gatccacctcacgccctacggagccgtctccttta

SEQ ID NO: 152407 - DNA, 35 bp, Artificial Sequence
  Synthetic oligonucleotide
tcgcggtgtagccctctatcggtcttggttcctac

SEQ ID NO: 152408 - DNA, 35 bp, Artificial Sequence
  Synthetic oligonucleotide
tgttccgttcccatccgtgttcgcttactctttac

SEQ ID NO: 152409 - DNA, 35 bp, Artificial Sequence
  Synthetic oligonucleotide
acacccgacacattcgaaagaccgccgctgccacc

SEQ ID NO: 152410 - DNA, 35 bp, Artificial Sequence
  Synthetic oligonucleotide
tctatgcaacggccacagtcctccctgattacgcc

SEQ ID NO: 152411 - DNA, 36 bp, Artificial Sequence
  Synthetic oligonucleotide
tcccttccgcagacggtattcttatccaaactgtcc

SEQ ID NO: 152412 - DNA, 35 bp, Artificial Sequence
  Synthetic oligonucleotide
acctcctccccctctgttcacttaagggactgagc

SEQ ID NO: 152413 - DNA, 35 bp, Artificial Sequence
  Synthetic oligonucleotide
gactcctcactatcggcgataatcttctcttccgc

SEQ ID NO: 152414 - DNA, 35 bp, Artificial Sequence
  Synthetic oligonucleotide
cctaccgccctcctaagctccctgtccctgtctgc

SEQ ID NO: 152415 - DNA, 35 bp, Artificial Sequence
  Synthetic oligonucleotide
tgtgccctccccatggtttttccggtcctacttgc

SEQ ID NO: 152416 - DNA, 35 bp, Artificial Sequence
  Synthetic oligonucleotide
aatccgctttccctgcatgtcccacacatccttgc

SEQ ID NO: 152417 - DNA, 35 bp, Artificial Sequence
  Synthetic oligonucleotide
gacaccgccttcccacctggggacgaatcgccatc

SEQ ID NO: 152418 - DNA, 35 bp, Artificial Sequence
  Synthetic oligonucleotide
aagcggacggcactgcgacgacttactgaaccctc

SEQ ID NO: 152419 - DNA, 35 bp, Artificial Sequence
  Synthetic oligonucleotide
cccacccgcctagacccgtagggcctcacaccctc

SEQ ID NO: 152420 - DNA, 35 bp, Artificial Sequence
  Synthetic oligonucleotide
gccccgggcgccttccccacagtatctacaccctc

SEQ ID NO: 152421 - DNA, 35 bp, Artificial Sequence
  Synthetic oligonucleotide
ttgtctaccactggactgtttgcttcttcaccctc

SEQ ID NO: 152422 - DNA, 35 bp, Artificial Sequence
  Synthetic oligonucleotide
actcctggcaaccccgatgccctgaactccctctc

SEQ ID NO: 152423 - DNA, 35 bp, Artificial Sequence
  Synthetic oligonucleotide
gcactccaaatcgagttatcgtctacgccctggtc

SEQ ID NO: 152424 - DNA, 35 bp, Artificial Sequence
  Synthetic oligonucleotide
gtgcgccgtccgttagccgttctcatttgcccttc

SEQ ID NO: 152425 - DNA, 35 bp, Artificial Sequence
  Synthetic oligonucleotide
tccgcccctactgcgtaccaaggcacatcactttc

SEQ ID NO: 152426 - DNA, 35 bp, Artificial Sequence
  Synthetic oligonucleotide
gtggaaacgggttgggatactcgggaggggagacg

SEQ ID NO: 152427 - DNA, 35 bp, Artificial Sequence
  Synthetic oligonucleotide
atggaacgacagctattacacaccccttaccaccg

SEQ ID NO: 152428 - DNA, 35 bp, Artificial Sequence
  Synthetic oligonucleotide
tgtgtgtgacgagcggggtgggttaagggcggggg

SEQ ID NO: 152429 - DNA, 35 bp, Artificial Sequence
  Synthetic oligonucleotide
gaacccgcactcgccatttatcgttcgcccattgg

SEQ ID NO: 152430 - DNA, 35 bp, Artificial Sequence
  Synthetic oligonucleotide
gcaggtaccatccgacgtcagcatacacgttcctg

SEQ ID NO: 152431 - DNA, 30 bp, Artificial Sequence
  Synthetic oligonucleotide
ttgcacttatgccgttctatccttcttctg

SEQ ID NO: 152432 - DNA, 35 bp, Artificial Sequence
  Synthetic oligonucleotide
cccgaatccgctgacccccgtctaacaaacccttg

SEQ ID NO: 152433 - DNA, 35 bp, Artificial Sequence
  Synthetic oligonucleotide
aactcgtggtcaggtttccgtcccctccccttact

SEQ ID NO: 152434 - DNA, 35 bp, Artificial Sequence
  Synthetic oligonucleotide
tattgcacatgcctctctgacctcggtggttgcct

SEQ ID NO: 152435 - DNA, 35 bp, Artificial Sequence
  Synthetic oligonucleotide
gccgagtcattagctcggcgctctatcaccatcct

SEQ ID NO: 152436 - DNA, 35 bp, Artificial Sequence
  Synthetic oligonucleotide
accgagcccggcgtcacttttttgccttcactcct

SEQ ID NO: 152437 - DNA, 35 bp, Artificial Sequence
  Synthetic oligonucleotide
gtctagctggctcctgttcggtaccttctgcttct

SEQ ID NO: 152438 - DNA, 35 bp, Artificial Sequence
  Synthetic oligonucleotide
tgcggaccatccccgcgtgttatctcaactttagt

SEQ ID NO: 152439 - DNA, 35 bp, Artificial Sequence
  Synthetic oligonucleotide
tgcttgctccatcattcatcttaaagcagcccctt

SEQ ID NO: 152440 - DNA, 35 bp, Artificial Sequence
  Synthetic oligonucleotide
gaactcgctccccacctctgttattgcttgccctt

SEQ ID NO: 152441 - DNA, 36 bp, Artificial Sequence
  Synthetic oligonucleotide
ttctgtcccctgccctgtttacttcgtttcacggaa

SEQ ID NO: 152442 - DNA, 35 bp, Artificial Sequence
  Synthetic oligonucleotide
gtctcccccacgctaactggtgcccatctgtaaca

SEQ ID NO: 152443 - DNA, 35 bp, Artificial Sequence
  Synthetic oligonucleotide
gtatcacccgccaacccatcacgtccaccccgaca

SEQ ID NO: 152444 - DNA, 36 bp, Artificial Sequence
  Synthetic oligonucleotide
tacaccgtccttatgctccctctgcttatacgctca

SEQ ID NO: 152445 - DNA, 36 bp, Artificial Sequence
  Synthetic oligonucleotide
cccgaacgcgccctcttcgctatacgtacactctca

SEQ ID NO: 152446 - DNA, 36 bp, Artificial Sequence
  Synthetic oligonucleotide
tttcacccctactgccctgcccttctgactgtctca

SEQ ID NO: 152447 - DNA, 36 bp, Artificial Sequence
  Synthetic oligonucleotide
aagggggtgccggagagatagggggatgtggggtca

SEQ ID NO: 152448 - DNA, 36 bp, Artificial Sequence
  Synthetic oligonucleotide
tggaccccgccctaccaatcttccgccacgctgtca

SEQ ID NO: 152449 - DNA, 36 bp, Artificial Sequence
  Synthetic oligonucleotide
actacctccgccgttgaatcagcatcttacccttca

SEQ ID NO: 152450 - DNA, 37 bp, Artificial Sequence
  Synthetic oligonucleotide
ggggaggggggaggtccgggcagaggacggtacgaga

SEQ ID NO: 152451 - DNA, 37 bp, Artificial Sequence
  Synthetic oligonucleotide
ttgcccctgcgcccgtttaatcctcgcgtcccctaga

SEQ ID NO: 152452 - DNA, 37 bp, Artificial Sequence
  Synthetic oligonucleotide
agtgggggaggggcttggggattataggtggaaccga

SEQ ID NO: 152453 - DNA, 37 bp, Artificial Sequence
  Synthetic oligonucleotide
actcgccgacgtctgtccgtaaaacctccttcctcga

SEQ ID NO: 152454 - DNA, 37 bp, Artificial Sequence
  Synthetic oligonucleotide
taggagggtgggataagccattccctcccgggcggga

SEQ ID NO: 152455 - DNA, 38 bp, Artificial Sequence
  Synthetic oligonucleotide
gacgcacagattagccgcccccgcctgcccccgttgga

SEQ ID NO: 152456 - DNA, 38 bp, Artificial Sequence
  Synthetic oligonucleotide
agcccccccgacgcattacctttgaggtcctccactga

SEQ ID NO: 152457 - DNA, 38 bp, Artificial Sequence
  Synthetic oligonucleotide
ttcgtcaccaggctgcccctcactcctgtccctactga

SEQ ID NO: 152458 - DNA, 37 bp, Artificial Sequence
  Synthetic oligonucleotide
accgccccgcctaagccttccatgcatttttccttga

SEQ ID NO: 152459 - DNA, 38 bp, Artificial Sequence
  Synthetic oligonucleotide
gaccactgttgcctttaggtgcgcccctcccttcttga

SEQ ID NO: 152460 - DNA, 38 bp, Artificial Sequence
  Synthetic oligonucleotide
gtacgaaggcacaaggtgggaaggaatagcggggttga

SEQ ID NO: 152461 - DNA, 36 bp, Artificial Sequence
  Synthetic oligonucleotide
gatcgggacgggggaaatgcgggggcggtaggtata

SEQ ID NO: 152462 - DNA, 36 bp, Artificial Sequence
  Synthetic oligonucleotide
gcccactaccgccgccacaaacgctcgtgaatccta

SEQ ID NO: 152463 - DNA, 36 bp, Artificial Sequence
  Synthetic oligonucleotide
tcacctctcgccaccagttcttgatttacatgtcta

SEQ ID NO: 152464 - DNA, 35 bp, Artificial Sequence
  Synthetic oligonucleotide
gggtccgcctcaatgccctcttctacacgccgcac

SEQ ID NO: 152465 - DNA, 35 bp, Artificial Sequence
  Synthetic oligonucleotide
gatgcagacgtagcctcttggtgccttcacactac

SEQ ID NO: 152466 - DNA, 35 bp, Artificial Sequence
  Synthetic oligonucleotide
gatggtcatccttctcgctgcctcgtgcccattac

SEQ ID NO: 152467 - DNA, 35 bp, Artificial Sequence
  Synthetic oligonucleotide
gtgctgcctcctcatataagccgatgccgcacccc

SEQ ID NO: 152468 - DNA, 35 bp, Artificial Sequence
  Synthetic oligonucleotide
gtttcgtccatccatcctaacactggttgctcccc

SEQ ID NO: 152469 - DNA, 35 bp, Artificial Sequence
  Synthetic oligonucleotide
atcacaggtgcctaatgcggtcccttccctttccc

SEQ ID NO: 152470 - DNA, 35 bp, Artificial Sequence
  Synthetic oligonucleotide
gcaatcgtacgcattagcacgcgcctcttttttcc

SEQ ID NO: 152471 - DNA, 35 bp, Artificial Sequence
  Synthetic oligonucleotide
gtggaccgctaccctgcttacgacttatctcacgc

SEQ ID NO: 152472 - DNA, 33 bp, Artificial Sequence
  Synthetic oligonucleotide
tcagacgctctgcgcttgttactacacccccgc

SEQ ID NO: 152473 - DNA, 34 bp, Artificial Sequence
  Synthetic oligonucleotide
acatggacacgcaccccgaccctgctcaatccgc

SEQ ID NO: 152474 - DNA, 35 bp, Artificial Sequence
  Synthetic oligonucleotide
gttgcagaataccccgccccacacgcgacctccgc

SEQ ID NO: 152475 - DNA, 35 bp, Artificial Sequence
  Synthetic oligonucleotide
tgaacactgtcgactcgacggccatgcaccccatc

SEQ ID NO: 152476 - DNA, 35 bp, Artificial Sequence
  Synthetic oligonucleotide
acccccccgtcaatgttagtctccatcctgctgtc

SEQ ID NO: 152477 - DNA, 35 bp, Artificial Sequence
  Synthetic oligonucleotide
gatcactcctccgtatcgcgaattgtccccccacg

SEQ ID NO: 152478 - DNA, 35 bp, Artificial Sequence
  Synthetic oligonucleotide
gctgactgaaccattaaagcccgccgctacccccg

SEQ ID NO: 152479 - DNA, 35 bp, Artificial Sequence
  Synthetic oligonucleotide
agttccacccctcaataccatggcctacaactccg

SEQ ID NO: 152480 - DNA, 35 bp, Artificial Sequence
  Synthetic oligonucleotide
tgcatgctccggtatttgttatctcttccctggcg

SEQ ID NO: 152481 - DNA, 35 bp, Artificial Sequence
  Synthetic oligonucleotide
tgctatcggctgtccctaggttctctctcctctcg

SEQ ID NO: 152482 - DNA, 35 bp, Artificial Sequence
  Synthetic oligonucleotide
gtcgcgaagcatcgacccccccctcaccgctaagg

SEQ ID NO: 152483 - DNA, 35 bp, Artificial Sequence
  Synthetic oligonucleotide
gctgcctgccacaccaactgtctttaataaccatg

SEQ ID NO: 152484 - DNA, 35 bp, Artificial Sequence
  Synthetic oligonucleotide
gtgtccgatgggcgtcctccctccgctttttcctg

SEQ ID NO: 152485 - DNA, 35 bp, Artificial Sequence
  Synthetic oligonucleotide
tgcctcgcaatgctttccttccctgtctcgattat

SEQ ID NO: 152486 - DNA, 35 bp, Artificial Sequence
  Synthetic oligonucleotide
tttccgtacgccactgtccgttaacatcctcgact

SEQ ID NO: 152487 - DNA, 35 bp, Artificial Sequence
  Synthetic oligonucleotide
gtgtcacccagtctccccgttttgcaatccatcct

SEQ ID NO: 152488 - DNA, 35 bp, Artificial Sequence
  Synthetic oligonucleotide
tctgacagccctccgctactcgggctttctttcct

SEQ ID NO: 152489 - DNA, 35 bp, Artificial Sequence
  Synthetic oligonucleotide
tcatccctgatccctcgtggcggagccatttatct

SEQ ID NO: 152490 - DNA, 35 bp, Artificial Sequence
  Synthetic oligonucleotide
gcatcgcgtaatggcctgcatcctccgccctacgt

SEQ ID NO: 152491 - DNA, 35 bp, Artificial Sequence
  Synthetic oligonucleotide
tcaagcagggcatgggagtgggaggttaggggcgt

SEQ ID NO: 152492 - DNA, 35 bp, Artificial Sequence
  Synthetic oligonucleotide
gcgctcctatgcacatgttcctgcttctccgtggt

SEQ ID NO: 152493 - DNA, 35 bp, Artificial Sequence
  Synthetic oligonucleotide
gtcacgcctttgactatcccggctcacttgacctt

SEQ ID NO: 152494 - DNA, 35 bp, Artificial Sequence
  Synthetic oligonucleotide
acagcatgtgtgtttccttccgtgtcactgtcctt

SEQ ID NO: 152495 - DNA, 35 bp, Artificial Sequence
  Synthetic oligonucleotide
gtcaccataccctcgattattgctcgcctcccgtt

SEQ ID NO: 152496 - DNA, 35 bp, Artificial Sequence
  Synthetic oligonucleotide
agatccaccctctcagtctcacattacgggtcttt

SEQ ID NO: 152497 - DNA, 36 bp, Artificial Sequence
  Synthetic oligonucleotide
acagactccgtccgctcccaggtcccatcgccgcaa

SEQ ID NO: 152498 - DNA, 36 bp, Artificial Sequence
  Synthetic oligonucleotide
ggttgagacgatgggggctgggaaggaagaaggtaa

SEQ ID NO: 152499 - DNA, 36 bp, Artificial Sequence
  Synthetic oligonucleotide
tccacatgttccgcctttttgtctatgtcgacccca

SEQ ID NO: 152500 - DNA, 36 bp, Artificial Sequence
  Synthetic oligonucleotide
tctgcacggtcgcgtacttactcggttgatccccca

SEQ ID NO: 152501 - DNA, 36 bp, Artificial Sequence
  Synthetic oligonucleotide
gtggcccccgacagctgttcacaccatcgtcctcca

SEQ ID NO: 152502 - DNA, 35 bp, Artificial Sequence
  Synthetic oligonucleotide
tacgttagccgccctttcgtacttagtttagtcca

SEQ ID NO: 152503 - DNA, 35 bp, Artificial Sequence
  Synthetic oligonucleotide
gcccctagcctccgttttttttgccgactcttcca

SEQ ID NO: 152504 - DNA, 35 bp, Artificial Sequence
  Synthetic oligonucleotide
atgccccggtctgtatcatcttcccgcctgttcca

SEQ ID NO: 152505 - DNA, 35 bp, Artificial Sequence
  Synthetic oligonucleotide
gaggcactcccgcctctcttgtaagactccccgca

SEQ ID NO: 152506 - DNA, 35 bp, Artificial Sequence
  Synthetic oligonucleotide
gcgagaggagacaaaggggtactggagggggtgca

SEQ ID NO: 152507 - DNA, 36 bp, Artificial Sequence
  Synthetic oligonucleotide
gcactcacatatgcccacgcgccttgtacttcatca

SEQ ID NO: 152508 - DNA, 36 bp, Artificial Sequence
  Synthetic oligonucleotide
gtcgtacccccgccctatgtctcgttctatcgatca

SEQ ID NO: 152509 - DNA, 36 bp, Artificial Sequence
  Synthetic oligonucleotide
tcacctgcctctatagttctaacctgtcctgcctca

SEQ ID NO: 152510 - DNA, 37 bp, Artificial Sequence
  Synthetic oligonucleotide
agcgacgtcactccgcttcaacagaccccgccaccga

SEQ ID NO: 152511 - DNA, 37 bp, Artificial Sequence
  Synthetic oligonucleotide
agcatggcccccatcgtcccccgtcctcgtacgccga

SEQ ID NO: 152512 - DNA, 37 bp, Artificial Sequence
  Synthetic oligonucleotide
atgctgtttgttccgacccgccccgttcccgtgccga

SEQ ID NO: 152513 - DNA, 36 bp, Artificial Sequence
  Synthetic oligonucleotide
tagtcccaccgcttatcactgttactaccacacgga

SEQ ID NO: 152514 - DNA, 37 bp, Artificial Sequence
  Synthetic oligonucleotide
gccgatgcccctgacctggatgtcttcctcctgcgga

SEQ ID NO: 152515 - DNA, 37 bp, Artificial Sequence
  Synthetic oligonucleotide
gatagggccgacgtccgggcggggctagtgccaggga

SEQ ID NO: 152516 - DNA, 37 bp, Artificial Sequence
  Synthetic oligonucleotide
gtcgctgcctcctaatctgtcgccctgtatccttgga

SEQ ID NO: 152517 - DNA, 38 bp, Artificial Sequence
  Synthetic oligonucleotide
gtcgacatgtgaagggggggtaggataacgcggggtga

SEQ ID NO: 152518 - DNA, 36 bp, Artificial Sequence
  Synthetic oligonucleotide
acctccttcgctgtacgaccagaccacccccgccta

SEQ ID NO: 152519 - DNA, 37 bp, Artificial Sequence
  Synthetic oligonucleotide
tacctactcctgactgcgttctacgcgcacccctcta

SEQ ID NO: 152520 - DNA, 36 bp, Artificial Sequence
  Synthetic oligonucleotide
ttagaccacgcccgttgctgcggtgcaatcccctta

SEQ ID NO: 152521 - DNA, 36 bp, Artificial Sequence
  Synthetic oligonucleotide
tccctgccctgacccgagcgttcccctgatctctta

SEQ ID NO: 152522 - DNA, 36 bp, Artificial Sequence
  Synthetic oligonucleotide
gttcctccccgccgcaccacccgtactaacgtgtta

SEQ ID NO: 152523 - DNA, 35 bp, Artificial Sequence
  Synthetic oligonucleotide
attccacctctgaacgatagaccgcctgcttgtta

SEQ ID NO: 152524 - DNA, 34 bp, Artificial Sequence
  Synthetic oligonucleotide
gaccgactaaccaacgtgcgcacctcgcctacac

SEQ ID NO: 152525 - DNA, 35 bp, Artificial Sequence
  Synthetic oligonucleotide
tcatctccacctccgtacagcccacgtatctttac

SEQ ID NO: 152526 - DNA, 35 bp, Artificial Sequence
  Synthetic oligonucleotide
tgtatcgaccgccccttgttgcatttcttccaacc

SEQ ID NO: 152527 - DNA, 35 bp, Artificial Sequence
  Synthetic oligonucleotide
gaaaccccgtcccgccctctcctatcatatcgacc

SEQ ID NO: 152528 - DNA, 36 bp, Artificial Sequence
  Synthetic oligonucleotide
gtgccggccctatcgtgacgaagtctctcggcaccc

SEQ ID NO: 152529 - DNA, 35 bp, Artificial Sequence
  Synthetic oligonucleotide
acgtacggtacgcagtgacccgaccccgccgaccc

SEQ ID NO: 152530 - DNA, 35 bp, Artificial Sequence
  Synthetic oligonucleotide
gatcgcggacggccgccccactttctgttacgccc

SEQ ID NO: 152531 - DNA, 35 bp, Artificial Sequence
  Synthetic oligonucleotide
tactcccacattcgcccgacagtcatagggctccc

SEQ ID NO: 152532 - DNA, 28 bp, Artificial Sequence
  Synthetic oligonucleotide
atgtatcaatctgtcttccgctgccgcc

SEQ ID NO: 152533 - DNA, 35 bp, Artificial Sequence
  Synthetic oligonucleotide
atcagactgctctagccgcgcaaaacacctcgtcc

SEQ ID NO: 152534 - DNA, 35 bp, Artificial Sequence
  Synthetic oligonucleotide
acgctcgctgttctgcctaacaattcatccaccgc

SEQ ID NO: 152535 - DNA, 35 bp, Artificial Sequence
  Synthetic oligonucleotide
ggagccgcctgtcgcgtctaccgcctacatctcgc

SEQ ID NO: 152536 - DNA, 35 bp, Artificial Sequence
  Synthetic oligonucleotide
agatatagtccgccctcgtcccggtctcgccctgc

SEQ ID NO: 152537 - DNA, 35 bp, Artificial Sequence
  Synthetic oligonucleotide
tcgcatattcaggtctatccgcataccgttccctc

SEQ ID NO: 152538 - DNA, 35 bp, Artificial Sequence
  Synthetic oligonucleotide
gctttaccgcacgctcgatcgcctgtcctctcctc

SEQ ID NO: 152539 - DNA, 35 bp, Artificial Sequence
  Synthetic oligonucleotide
gttgccccccacactgcgtagtcactaaaggtctc

SEQ ID NO: 152540 - DNA, 35 bp, Artificial Sequence
  Synthetic oligonucleotide
gctgcacgtacgtctttcatggcacactttacttc

SEQ ID NO: 152541 - DNA, 35 bp, Artificial Sequence
  Synthetic oligonucleotide
actcccccgcctgaaacgtttcgcacgactttaag

SEQ ID NO: 152542 - DNA, 35 bp, Artificial Sequence
  Synthetic oligonucleotide
gcaagcaccgcactatccgtcccttcgccgacgag

SEQ ID NO: 152543 - DNA, 35 bp, Artificial Sequence
  Synthetic oligonucleotide
gcctcacccactcgtccgttttttacggttcaccg

SEQ ID NO: 152544 - DNA, 35 bp, Artificial Sequence
  Synthetic oligonucleotide
taggaccttcaaccctataacgctgccccccgccg

SEQ ID NO: 152545 - DNA, 35 bp, Artificial Sequence
  Synthetic oligonucleotide
tcccacttcactgttatgacctcctcatatttccg

SEQ ID NO: 152546 - DNA, 35 bp, Artificial Sequence
  Synthetic oligonucleotide
acgttcaatgggcggagggtgggggggctcgctcg

SEQ ID NO: 152547 - DNA, 35 bp, Artificial Sequence
  Synthetic oligonucleotide
aatcgcgaccgctacccccccggaggttcctcctg

SEQ ID NO: 152548 - DNA, 35 bp, Artificial Sequence
  Synthetic oligonucleotide
gaggtggggtgggtgcgttggtgagaagggcacat

SEQ ID NO: 152549 - DNA, 35 bp, Artificial Sequence
  Synthetic oligonucleotide
tgcccaccagctgttgcctctaaagttttacccat

SEQ ID NO: 152550 - DNA, 35 bp, Artificial Sequence
  Synthetic oligonucleotide
ttatcgccccgcttctcgcccgtttgcgaccaact

SEQ ID NO: 152551 - DNA, 35 bp, Artificial Sequence
  Synthetic oligonucleotide
tagatgcacagccggcctcgaaacgtttctcacct

SEQ ID NO: 152552 - DNA, 35 bp, Artificial Sequence
  Synthetic oligonucleotide
attcgccctgtctgtaacgtttggctacctcccct

SEQ ID NO: 152553 - DNA, 35 bp, Artificial Sequence
  Synthetic oligonucleotide
actcatgcctccgggttcccgttgtacttttgcct

SEQ ID NO: 152554 - DNA, 35 bp, Artificial Sequence
  Synthetic oligonucleotide
acacgtccgccatagtcgctagcatcttcctgtct

SEQ ID NO: 152555 - DNA, 34 bp, Artificial Sequence
  Synthetic oligonucleotide
gttaaccgtgcccctgaccccgcccctttgtcgt

SEQ ID NO: 152556 - DNA, 35 bp, Artificial Sequence
  Synthetic oligonucleotide
gccgcccctctctcgccgcggtgacaccagacttt

SEQ ID NO: 152557 - DNA, 36 bp, Artificial Sequence
  Synthetic oligonucleotide
gtacactcagctcgatttgctcccactcgccggaaa

SEQ ID NO: 152558 - DNA, 36 bp, Artificial Sequence
  Synthetic oligonucleotide
gacgccccgcctcctggtgcaacactatgttctgaa

SEQ ID NO: 152559 - DNA, 36 bp, Artificial Sequence
  Synthetic oligonucleotide
tccactagacgggcgggaaggggaatgggtcattaa

SEQ ID NO: 152560 - DNA, 36 bp, Artificial Sequence
  Synthetic oligonucleotide
gtagcacctcagcgcatctatcatcccgggccaaca

SEQ ID NO: 152561 - DNA, 35 bp, Artificial Sequence
  Synthetic oligonucleotide
accccggcccatagcatgcgatcgtccccgctaca

SEQ ID NO: 152562 - DNA, 36 bp, Artificial Sequence
  Synthetic oligonucleotide
gactcctctttggtcctaattcccgccttccgcgca

SEQ ID NO: 152563 - DNA, 36 bp, Artificial Sequence
  Synthetic oligonucleotide
gtggaggcgctccgtggacgggaaggggaggaggca

SEQ ID NO: 152564 - DNA, 36 bp, Artificial Sequence
  Synthetic oligonucleotide
tgacgcccacaccactgccgcccgcattagaatgca

SEQ ID NO: 152565 - DNA, 36 bp, Artificial Sequence
  Synthetic oligonucleotide
tcatctgcgacagtatcaccttccgctctatcgtca

SEQ ID NO: 152566 - DNA, 36 bp, Artificial Sequence
  Synthetic oligonucleotide
tcgaccctgcccctacgcacctaggccgactcttca

SEQ ID NO: 152567 - DNA, 37 bp, Artificial Sequence
  Synthetic oligonucleotide
tgtggctctgttccctgtttatgtccctccgccgaga

SEQ ID NO: 152568 - DNA, 37 bp, Artificial Sequence
  Synthetic oligonucleotide
atggatgacaggtggtggggccacgagaggggggaga

SEQ ID NO: 152569 - DNA, 35 bp, Artificial Sequence
  Synthetic oligonucleotide
gtagccctcgttgcttgtacccgctcacccataga

SEQ ID NO: 152570 - DNA, 35 bp, Artificial Sequence
  Synthetic oligonucleotide
acctacctcattggcttgtacttccaccccgacga

SEQ ID NO: 152571 - DNA, 37 bp, Artificial Sequence
  Synthetic oligonucleotide
gtgtgacggtggagaggatgagggaacgggtgtacga

SEQ ID NO: 152572 - DNA, 37 bp, Artificial Sequence
  Synthetic oligonucleotide
tcaccacactcccatggaataccgaaccgccaatcga

SEQ ID NO: 152573 - DNA, 37 bp, Artificial Sequence
  Synthetic oligonucleotide
tcccttaccctctcgatctgtaacctctgctcatcga

SEQ ID NO: 152574 - DNA, 37 bp, Artificial Sequence
  Synthetic oligonucleotide
tgataagtggggaggaggtgggacgagcggtggcgga

SEQ ID NO: 152575 - DNA, 37 bp, Artificial Sequence
  Synthetic oligonucleotide
tgtgggcgggtgggggaagcgatacttttgttaggga

SEQ ID NO: 152576 - DNA, 36 bp, Artificial Sequence
  Synthetic oligonucleotide
tccataccacctgggcactccgagaactgtccatga

SEQ ID NO: 152577 - DNA, 38 bp, Artificial Sequence
  Synthetic oligonucleotide
taacacgagacgcctgggagtgggtaggggagggatga

SEQ ID NO: 152578 - DNA, 38 bp, Artificial Sequence
  Synthetic oligonucleotide
gtggggcctggacagaatataggggaggggggggatga

SEQ ID NO: 152579 - DNA, 35 bp, Artificial Sequence
  Synthetic oligonucleotide
gctccgcacctccgtggttcctgctcataccctga

SEQ ID NO: 152580 - DNA, 38 bp, Artificial Sequence
  Synthetic oligonucleotide
ttcgctcccgcgctgtggttccctctccgccctcctga

SEQ ID NO: 152581 - DNA, 38 bp, Artificial Sequence
  Synthetic oligonucleotide
atcccaccgcccgccccccgccttacagaaccacgtga

SEQ ID NO: 152582 - DNA, 38 bp, Artificial Sequence
  Synthetic oligonucleotide
ttgaaccgcctttgcccgtttctcccctccccttgtga

SEQ ID NO: 152583 - DNA, 38 bp, Artificial Sequence
  Synthetic oligonucleotide
aacttggcagagtgatggttcgccgcccccccccttga

SEQ ID NO: 152584 - DNA, 38 bp, Artificial Sequence
  Synthetic oligonucleotide
aacacctccatcgcggccatgcatgcccccttcgttga

SEQ ID NO: 152585 - DNA, 38 bp, Artificial Sequence
  Synthetic oligonucleotide
tcgacacctacgcctgctcgcccaccgacccattttga

SEQ ID NO: 152586 - DNA, 35 bp, Artificial Sequence
  Synthetic oligonucleotide
acctcccttctgccattggttcatcgaacgcccta

SEQ ID NO: 152587 - DNA, 35 bp, Artificial Sequence
  Synthetic oligonucleotide
acccacattcacgcctctagttctcgtttttggta

SEQ ID NO: 152588 - DNA, 35 bp, Artificial Sequence
  Synthetic oligonucleotide
gccgggtttgggtgggcagggcgatttgatcacac

SEQ ID NO: 152589 - DNA, 35 bp, Artificial Sequence
  Synthetic oligonucleotide
agcgccccctggattttttgcgtacacctttacac

SEQ ID NO: 152590 - DNA, 35 bp, Artificial Sequence
  Synthetic oligonucleotide
tcattggctgttctgccgccgtttcccatctgcac

SEQ ID NO: 152591 - DNA, 35 bp, Artificial Sequence
  Synthetic oligonucleotide
gtcgccatgttgccgaatggtccttcatctccccc

SEQ ID NO: 152592 - DNA, 35 bp, Artificial Sequence
  Synthetic oligonucleotide
agccaagtccttttacgttgatacgcccaccgccc

SEQ ID NO: 152593 - DNA, 35 bp, Artificial Sequence
  Synthetic oligonucleotide
tttatcgggtcagattgccgcctgctgccgccgcc

SEQ ID NO: 152594 - DNA, 35 bp, Artificial Sequence
  Synthetic oligonucleotide
tactccgcctgttgacatcatcactgtgccttgcc

SEQ ID NO: 152595 - DNA, 35 bp, Artificial Sequence
  Synthetic oligonucleotide
actcccatttgcccatggtataactcgttcttgcc

SEQ ID NO: 152596 - DNA, 35 bp, Artificial Sequence
  Synthetic oligonucleotide
atcgtacatcacttccgtaagcttggtccccatcc

SEQ ID NO: 152597 - DNA, 35 bp, Artificial Sequence
  Synthetic oligonucleotide
tgagatccccctctgctgttttttcttgcgcctcc

SEQ ID NO: 152598 - DNA, 35 bp, Artificial Sequence
  Synthetic oligonucleotide
attcccgatgcgcgcgtttgcatacgtccctgtcc

SEQ ID NO: 152599 - DNA, 35 bp, Artificial Sequence
  Synthetic oligonucleotide
tccgcccgcgatccattccccactgtaggttgtcc

SEQ ID NO: 152600 - DNA, 35 bp, Artificial Sequence
  Synthetic oligonucleotide
taacggtcgcactaccatttgctattgttccttcc

SEQ ID NO: 152601 - DNA, 35 bp, Artificial Sequence
  Synthetic oligonucleotide
taggacatccgcacggtcattagcctttctctcgc

SEQ ID NO: 152602 - DNA, 35 bp, Artificial Sequence
  Synthetic oligonucleotide
ggagccaaccgaacttcccccgcccggatatctgc

SEQ ID NO: 152603 - DNA, 35 bp, Artificial Sequence
  Synthetic oligonucleotide
atcgggtccagccggtcgtgcctttccgcccactc

SEQ ID NO: 152604 - DNA, 35 bp, Artificial Sequence
  Synthetic oligonucleotide
gcgtggcctccaatcctgtattgcgcataccgctc

SEQ ID NO: 152605 - DNA, 35 bp, Artificial Sequence
  Synthetic oligonucleotide
tcctgtcgccgccccatgttcgtttcctcctcgtc

SEQ ID NO: 152606 - DNA, 35 bp, Artificial Sequence
  Synthetic oligonucleotide
acgcctgtcccgccccgtactttcgccttgttgtc

SEQ ID NO: 152607 - DNA, 35 bp, Artificial Sequence
  Synthetic oligonucleotide
gccacgccttgcctggccttcttcccgagggattc

SEQ ID NO: 152608 - DNA, 35 bp, Artificial Sequence
  Synthetic oligonucleotide
tgcgtctccgtcctcggctattgttttttcgcccg

SEQ ID NO: 152609 - DNA, 35 bp, Artificial Sequence
  Synthetic oligonucleotide
tcaccacccactcctggtaagctgacattctcgcg

SEQ ID NO: 152610 - DNA, 35 bp, Artificial Sequence
  Synthetic oligonucleotide
tcgccaaccgaccgtcctttcatcgccttttctcg

SEQ ID NO: 152611 - DNA, 35 bp, Artificial Sequence
  Synthetic oligonucleotide
gtcaataaaagggtagagcaggggtgcgggggggg

SEQ ID NO: 152612 - DNA, 35 bp, Artificial Sequence
  Synthetic oligonucleotide
atgtgggaaaggcgacgaggggggcggacgaatgg

SEQ ID NO: 152613 - DNA, 35 bp, Artificial Sequence
  Synthetic oligonucleotide
ttggtgctcttccggtatcctcactctttccctgg

SEQ ID NO: 152614 - DNA, 35 bp, Artificial Sequence
  Synthetic oligonucleotide
ggtgtggaggggaggggtaaatccggatggaggtg

SEQ ID NO: 152615 - DNA, 35 bp, Artificial Sequence
  Synthetic oligonucleotide
ttgccacacgtgacctcttagaattcgtcctccat

SEQ ID NO: 152616 - DNA, 35 bp, Artificial Sequence
  Synthetic oligonucleotide
gttatgccccattgccgccccaggtcccgacgtat

SEQ ID NO: 152617 - DNA, 35 bp, Artificial Sequence
  Synthetic oligonucleotide
ggaaagaggggggtggtaagagaaaaaggcgttat

SEQ ID NO: 152618 - DNA, 35 bp, Artificial Sequence
  Synthetic oligonucleotide
aagtgctgcacggagggatagcggccgggggttat

SEQ ID NO: 152619 - DNA, 35 bp, Artificial Sequence
  Synthetic oligonucleotide
atcccgtcctccttaccacagtcatggcctcacct

SEQ ID NO: 152620 - DNA, 35 bp, Artificial Sequence
  Synthetic oligonucleotide
gtctcatgcgccacattctccggcgtgtccaccct

SEQ ID NO: 152621 - DNA, 35 bp, Artificial Sequence
  Synthetic oligonucleotide
tccccgacgcgatccaccgtttattttctgctcgt

SEQ ID NO: 152622 - DNA, 35 bp, Artificial Sequence
  Synthetic oligonucleotide
cccgtcgccacctcgtcaacgcgacctttctcctt

SEQ ID NO: 152623 - DNA, 35 bp, Artificial Sequence
  Synthetic oligonucleotide
acctatgcgcccccccgttcgctcttttattggtt

SEQ ID NO: 152624 - DNA, 35 bp, Artificial Sequence
  Synthetic oligonucleotide
aaccgcacacccccctcccagtgtcgacaacattt

SEQ ID NO: 152625 - DNA, 36 bp, Artificial Sequence
  Synthetic oligonucleotide
acgcccacattgtgccctgtttctcgaaccctccaa

SEQ ID NO: 152626 - DNA, 36 bp, Artificial Sequence
  Synthetic oligonucleotide
ttccgcatccgaacgcccccccccaacaggtgtcaa

SEQ ID NO: 152627 - DNA, 36 bp, Artificial Sequence
  Synthetic oligonucleotide
tccccccaggagtctatttcggtcgccccaacccca

SEQ ID NO: 152628 - DNA, 35 bp, Artificial Sequence
  Synthetic oligonucleotide
tcccccgcatcatagcgactggcttgctccctcca

SEQ ID NO: 152629 - DNA, 34 bp, Artificial Sequence
  Synthetic oligonucleotide
tccccgctggccctccatcatcaacgtgcagtca

SEQ ID NO: 152630 - DNA, 37 bp, Artificial Sequence
  Synthetic oligonucleotide
tgcctgccctccttgtctaccccggccccgccaccga

SEQ ID NO: 152631 - DNA, 37 bp, Artificial Sequence
  Synthetic oligonucleotide
tttagcaaaggtgggtaggtggatggagggggccgga

SEQ ID NO: 152632 - DNA, 37 bp, Artificial Sequence
  Synthetic oligonucleotide
tccaagagggcatagataggggggaggggtgggcgga

SEQ ID NO: 152633 - DNA, 37 bp, Artificial Sequence
  Synthetic oligonucleotide
acacgggggggggtggagagggcataccagctcggga

SEQ ID NO: 152634 - DNA, 37 bp, Artificial Sequence
  Synthetic oligonucleotide
taagataggagggtaggagggagggggttacagtgga

SEQ ID NO: 152635 - DNA, 36 bp, Artificial Sequence
  Synthetic oligonucleotide
tccgtgtgccgcccgccttttagatttacctcatga

SEQ ID NO: 152636 - DNA, 38 bp, Artificial Sequence
  Synthetic oligonucleotide
gcagacgacgggagggttaacgggtaggggtgttatga

SEQ ID NO: 152637 - DNA, 36 bp, Artificial Sequence
  Synthetic oligonucleotide
gcccagtaagagcgttaagggggggatgggcggtga

SEQ ID NO: 152638 - DNA, 37 bp, Artificial Sequence
  Synthetic oligonucleotide
ttgttcccccctccgccgatcgcgagcagtgctttga

SEQ ID NO: 152639 - DNA, 36 bp, Artificial Sequence
  Synthetic oligonucleotide
accgcactgtatcgtgctcctccctctccggtttga

SEQ ID NO: 152640 - DNA, 36 bp, Artificial Sequence
  Synthetic oligonucleotide
aacccgtgcgccgcccgtgctgccattgctttacta

SEQ ID NO: 152641 - DNA, 36 bp, Artificial Sequence
  Synthetic oligonucleotide
tgtcactctgtctgtctgcctgatcctccacacgta

SEQ ID NO: 152642 - DNA, 36 bp, Artificial Sequence
  Synthetic oligonucleotide
tgtacggtcattctccccgcgcccttcgcctggtta

SEQ ID NO: 152643 - DNA, 34 bp, Artificial Sequence
  Synthetic oligonucleotide
accgccacaaggaaccattcgcctgtaccactac

SEQ ID NO: 152644 - DNA, 35 bp, Artificial Sequence
  Synthetic oligonucleotide
gacgcccgctcttcgtactcagtctttgggcctac

SEQ ID NO: 152645 - DNA, 35 bp, Artificial Sequence
  Synthetic oligonucleotide
ttcgcccctgtccgtcgattcaccattgctagtac

SEQ ID NO: 152646 - DNA, 35 bp, Artificial Sequence
  Synthetic oligonucleotide
tgtctccctcctccgacgtgccactagttagatcc

SEQ ID NO: 152647 - DNA, 35 bp, Artificial Sequence
  Synthetic oligonucleotide
gacaggcgatcgtctatcccacctgtccgtactcc

SEQ ID NO: 152648 - DNA, 35 bp, Artificial Sequence
  Synthetic oligonucleotide
tcaaccacccccccgacgtttccgctggaaaaagc

SEQ ID NO: 152649 - DNA, 35 bp, Artificial Sequence
  Synthetic oligonucleotide
gaggacctcacagtatcaccgcctcttattcacgc

SEQ ID NO: 152650 - DNA, 35 bp, Artificial Sequence
  Synthetic oligonucleotide
attgacgtgggaggtgtgagggagggtctgagcgc

SEQ ID NO: 152651 - DNA, 36 bp, Artificial Sequence
  Synthetic oligonucleotide
gacctcccctccgtgttacccctgacttcggaatgc

SEQ ID NO: 152652 - DNA, 35 bp, Artificial Sequence
  Synthetic oligonucleotide
gctcgagcctgtcctggtatccatcgcctcgttgc

SEQ ID NO: 152653 - DNA, 35 bp, Artificial Sequence
  Synthetic oligonucleotide
atgacgcgccgttatggcaactgctctatcacctc

SEQ ID NO: 152654 - DNA, 35 bp, Artificial Sequence
  Synthetic oligonucleotide
gctaccttgcgcacccccgtagctatgttcacctc

SEQ ID NO: 152655 - DNA, 35 bp, Artificial Sequence
  Synthetic oligonucleotide
ttgccccatagaccccgtctgctttttatcgcctc

SEQ ID NO: 152656 - DNA, 35 bp, Artificial Sequence
  Synthetic oligonucleotide
gctaccggcctcccctcgttctggcccctggtctc

SEQ ID NO: 152657 - DNA, 35 bp, Artificial Sequence
  Synthetic oligonucleotide
aaactcccaccctctttgtgcactagacctgtctc

SEQ ID NO: 152658 - DNA, 35 bp, Artificial Sequence
  Synthetic oligonucleotide
gatgggccgcgctcccctacgcctctctgttggtc

SEQ ID NO: 152659 - DNA, 35 bp, Artificial Sequence
  Synthetic oligonucleotide
gtcacctcccatctggaacacctcgctccgcgacg

SEQ ID NO: 152660 - DNA, 35 bp, Artificial Sequence
  Synthetic oligonucleotide
gcccccacaagctcctatgcttctctccactgacg

SEQ ID NO: 152661 - DNA, 35 bp, Artificial Sequence
  Synthetic oligonucleotide
tacgcccctcacctctcctgttccggtattaaccg

SEQ ID NO: 152662 - DNA, 35 bp, Artificial Sequence
  Synthetic oligonucleotide
gcccccttcacctcgctatgtcgctctgcctaccg

SEQ ID NO: 152663 - DNA, 35 bp, Artificial Sequence
  Synthetic oligonucleotide
atcaacgcagtactcaaccacgttctaccttcccg

SEQ ID NO: 152664 - DNA, 35 bp, Artificial Sequence
  Synthetic oligonucleotide
tgctcaccaccgcccgcccgcctgcactctctctg

SEQ ID NO: 152665 - DNA, 35 bp, Artificial Sequence
  Synthetic oligonucleotide
accctccccctagcgcaagtgctcgtcgccctcat

SEQ ID NO: 152666 - DNA, 35 bp, Artificial Sequence
  Synthetic oligonucleotide
atcaccgcccctctcgtgtctctggagctccctat

SEQ ID NO: 152667 - DNA, 35 bp, Artificial Sequence
  Synthetic oligonucleotide
gttgcccgcccactacctgaccgagaggccgccct

SEQ ID NO: 152668 - DNA, 35 bp, Artificial Sequence
  Synthetic oligonucleotide
gcctgtcatccgttccctcgcgccttcattttcct

SEQ ID NO: 152669 - DNA, 35 bp, Artificial Sequence
  Synthetic oligonucleotide
tagtcctgtcccttgcccaccgcacgctttgttct

SEQ ID NO: 152670 - DNA, 35 bp, Artificial Sequence
  Synthetic oligonucleotide
tgccatgtatcatagttgcgctccttcccttcatt

SEQ ID NO: 152671 - DNA, 35 bp, Artificial Sequence
  Synthetic oligonucleotide
tgagtcaacgctcgcgtcctggccctaccatcttt

SEQ ID NO: 152672 - DNA, 35 bp, Artificial Sequence
  Synthetic oligonucleotide
gtccgccgttgtctccagttctggtcacgcctttt

SEQ ID NO: 152673 - DNA, 35 bp, Artificial Sequence
  Synthetic oligonucleotide
gtgaccggacctgcttaccgttttggcctcttttt

SEQ ID NO: 152674 - DNA, 36 bp, Artificial Sequence
  Synthetic oligonucleotide
ttacccccgcagacccgcattcgccagtactctaaa

SEQ ID NO: 152675 - DNA, 32 bp, Artificial Sequence
  Synthetic oligonucleotide
gctccaccgtgccctcttgcctagcaaatcaa

SEQ ID NO: 152676 - DNA, 36 bp, Artificial Sequence
  Synthetic oligonucleotide
tacctgccgggggtgggtaaaatgctggggagggaa

SEQ ID NO: 152677 - DNA, 36 bp, Artificial Sequence
  Synthetic oligonucleotide
tcagtcgctcgctggccccccgcatagttctcctaa

SEQ ID NO: 152678 - DNA, 36 bp, Artificial Sequence
  Synthetic oligonucleotide
tctgccctaggcaacgtgcatctcccgtcctgctaa

SEQ ID NO: 152679 - DNA, 35 bp, Artificial Sequence
  Synthetic oligonucleotide
gaccgggtgggggaatatggggcccatggggtaca

SEQ ID NO: 152680 - DNA, 36 bp, Artificial Sequence
  Synthetic oligonucleotide
tcatcgcgccctgttagccgcctcacaaacgtacca

SEQ ID NO: 152681 - DNA, 35 bp, Artificial Sequence
  Synthetic oligonucleotide
gttgtgcgcacatctgttctcgccccctataccca

SEQ ID NO: 152682 - DNA, 35 bp, Artificial Sequence
  Synthetic oligonucleotide
atcctcctcattgtgccgccctgcccgagccccca

SEQ ID NO: 152683 - DNA, 36 bp, Artificial Sequence
  Synthetic oligonucleotide
ttggcattccgctatcgtctcttgcaccggcctcca

SEQ ID NO: 152684 - DNA, 35 bp, Artificial Sequence
  Synthetic oligonucleotide
gtagtgccgcgcgtccctgtatcctgtttgctcca

SEQ ID NO: 152685 - DNA, 36 bp, Artificial Sequence
  Synthetic oligonucleotide
ttagcgagccacctgctcctgcaccacctattagca

SEQ ID NO: 152686 - DNA, 38 bp, Artificial Sequence
  Synthetic oligonucleotide
acgaacactccgccacacgtaccgatccacgacgccga

SEQ ID NO: 152687 - DNA, 37 bp, Artificial Sequence
  Synthetic oligonucleotide
gagtggaagacaggaaaggtgcggggaatgtggagga

SEQ ID NO: 152688 - DNA, 37 bp, Artificial Sequence
  Synthetic oligonucleotide
gaccagggtggctgtaaaagagaggagaaggagcgga

SEQ ID NO: 152689 - DNA, 38 bp, Artificial Sequence
  Synthetic oligonucleotide
ggggggagggtaaagggtttaggaaatgcctgggatga

SEQ ID NO: 152690 - DNA, 37 bp, Artificial Sequence
  Synthetic oligonucleotide
atgccacctctgcctatacctcgacgtcctgctatga

SEQ ID NO: 152691 - DNA, 37 bp, Artificial Sequence
  Synthetic oligonucleotide
gactccccatcccatgtaccgcacgttgacagtatga

SEQ ID NO: 152692 - DNA, 37 bp, Artificial Sequence
  Synthetic oligonucleotide
taaggggggagggggaaccatgcaaggaggacactga

SEQ ID NO: 152693 - DNA, 38 bp, Artificial Sequence
  Synthetic oligonucleotide
gcacggcctgatcgccgctctttgtctcgctcacctga

SEQ ID NO: 152694 - DNA, 38 bp, Artificial Sequence
  Synthetic oligonucleotide
gtcaaccagcaggttagcgccaccccttcgccccctga

SEQ ID NO: 152695 - DNA, 38 bp, Artificial Sequence
  Synthetic oligonucleotide
gccgggaatggagtgggggggtggagagacctggctga

SEQ ID NO: 152696 - DNA, 38 bp, Artificial Sequence
  Synthetic oligonucleotide
aatggaggagcaagggtggccgggggagctcacggtga

SEQ ID NO: 152697 - DNA, 37 bp, Artificial Sequence
  Synthetic oligonucleotide
tctgcataaggccggggtgggttggggagggctgtga

SEQ ID NO: 152698 - DNA, 38 bp, Artificial Sequence
  Synthetic oligonucleotide
gcgagagccctactttcctgtattaatcccgcccttga

SEQ ID NO: 152699 - DNA, 36 bp, Artificial Sequence
  Synthetic oligonucleotide
ttctcccgtcctgcctgtctgcttcacctctttata

SEQ ID NO: 152700 - DNA, 36 bp, Artificial Sequence
  Synthetic oligonucleotide
tctacgcctcccttggttagtaactgataccttcta

SEQ ID NO: 152701 - DNA, 36 bp, Artificial Sequence
  Synthetic oligonucleotide
gtcaccccttattgtctatccctcgctggtatcgta

SEQ ID NO: 152702 - DNA, 35 bp, Artificial Sequence
  Synthetic oligonucleotide
tccctgccctccgttcgtaaaatacactacgtgta

SEQ ID NO: 152703 - DNA, 35 bp, Artificial Sequence
  Synthetic oligonucleotide
gacagccagatctttaactccctcctgccccatta

SEQ ID NO: 152704 - DNA, 36 bp, Artificial Sequence
  Synthetic oligonucleotide
gtcctcctccgctcgcttctactaatggctgtctta

SEQ ID NO: 152705 - DNA, 35 bp, Artificial Sequence
  Synthetic oligonucleotide
actaccgccgccatgagctctttaccatattacac

SEQ ID NO: 152706 - DNA, 35 bp, Artificial Sequence
  Synthetic oligonucleotide
aaccgaacccgccttacgatagctttactgttgac

SEQ ID NO: 152707 - DNA, 35 bp, Artificial Sequence
  Synthetic oligonucleotide
tcccgccccattcagcagtatttagctgccctccc

SEQ ID NO: 152708 - DNA, 34 bp, Artificial Sequence
  Synthetic oligonucleotide
gcgttatgcacaccttgtcttatcctcgtctccc

SEQ ID NO: 152709 - DNA, 35 bp, Artificial Sequence
  Synthetic oligonucleotide
ggatctcccgaccctctatttcgccatgagctgcc

SEQ ID NO: 152710 - DNA, 35 bp, Artificial Sequence
  Synthetic oligonucleotide
gtgcctccccagtctcatcccttcccggttgttcc

SEQ ID NO: 152711 - DNA, 35 bp, Artificial Sequence
  Synthetic oligonucleotide
accagtctcacgcacgggtctacctcctgatttcc

SEQ ID NO: 152712 - DNA, 35 bp, Artificial Sequence
  Synthetic oligonucleotide
gccccaggcacaccctgggttttaactgatcctgc

SEQ ID NO: 152713 - DNA, 35 bp, Artificial Sequence
  Synthetic oligonucleotide
atccgcatgcccattgctcaaccacttacagctgc

SEQ ID NO: 152714 - DNA, 35 bp, Artificial Sequence
  Synthetic oligonucleotide
acccactaccacacccgccaacattaccacgttgc

SEQ ID NO: 152715 - DNA, 35 bp, Artificial Sequence
  Synthetic oligonucleotide
tcacctcgctacgtgcctctgggcgggcttccatc

SEQ ID NO: 152716 - DNA, 35 bp, Artificial Sequence
  Synthetic oligonucleotide
tcaacatcgccgagcatacctgagccctcttgatc

SEQ ID NO: 152717 - DNA, 35 bp, Artificial Sequence
  Synthetic oligonucleotide
gcgctaacgttgccgtgggccccctcccgatcctc

SEQ ID NO: 152718 - DNA, 35 bp, Artificial Sequence
  Synthetic oligonucleotide
actgcgtaccgcctggaattagtacctcaccgctc

SEQ ID NO: 152719 - DNA, 35 bp, Artificial Sequence
  Synthetic oligonucleotide
gacccgccactttcattgccaattacgtagtgctc

SEQ ID NO: 152720 - DNA, 35 bp, Artificial Sequence
  Synthetic oligonucleotide
gcatactgccctatcgtacaaagtccactaccgtc

SEQ ID NO: 152721 - DNA, 35 bp, Artificial Sequence
  Synthetic oligonucleotide
aggtgggtaaggagggggagaggagggcagatacg

SEQ ID NO: 152722 - DNA, 35 bp, Artificial Sequence
  Synthetic oligonucleotide
tatgacggccagcaaacacgaccacccctcgcccg

SEQ ID NO: 152723 - DNA, 35 bp, Artificial Sequence
  Synthetic oligonucleotide
tacacgcaacggaggaacggcaagggaatgggctg

SEQ ID NO: 152724 - DNA, 35 bp, Artificial Sequence
  Synthetic oligonucleotide
tccgcggataatgcgccaccccccatcccgctcat

SEQ ID NO: 152725 - DNA, 35 bp, Artificial Sequence
  Synthetic oligonucleotide
gcgtgaccatgagctccgtagtttgccccatccct

SEQ ID NO: 152726 - DNA, 34 bp, Artificial Sequence
  Synthetic oligonucleotide
tatccgcctatcagagtcctttctctccccttct

SEQ ID NO: 152727 - DNA, 35 bp, Artificial Sequence
  Synthetic oligonucleotide
tccgccgtattgctctgtggtatgctccatctcgt

SEQ ID NO: 152728 - DNA, 35 bp, Artificial Sequence
  Synthetic oligonucleotide
taccatccctgttctctttggcttcattccttggt

SEQ ID NO: 152729 - DNA, 35 bp, Artificial Sequence
  Synthetic oligonucleotide
tacacctcacctatgcccggtcctgccctccctgt

SEQ ID NO: 152730 - DNA, 34 bp, Artificial Sequence
  Synthetic oligonucleotide
tgcgagccgcctgccttcggtatttttgcccttt

SEQ ID NO: 152731 - DNA, 35 bp, Artificial Sequence
  Synthetic oligonucleotide
tcttcgggccggtttgccgttctattattgccttt

SEQ ID NO: 152732 - DNA, 35 bp, Artificial Sequence
  Synthetic oligonucleotide
cacatactgtcaatgctcctctccgtcctgatcaa

SEQ ID NO: 152733 - DNA, 36 bp, Artificial Sequence
  Synthetic oligonucleotide
tacgagaaggtgagggggagtggcgtgggattagaa

SEQ ID NO: 152734 - DNA, 36 bp, Artificial Sequence
  Synthetic oligonucleotide
gcccgagggaggggagtagaatgggcgggaatttaa

SEQ ID NO: 152735 - DNA, 36 bp, Artificial Sequence
  Synthetic oligonucleotide
gaccaatgtgctgccgataagcttacgctcccccca

SEQ ID NO: 152736 - DNA, 35 bp, Artificial Sequence
  Synthetic oligonucleotide
actagcccgccgccactttgaacccacatccccca

SEQ ID NO: 152737 - DNA, 35 bp, Artificial Sequence
  Synthetic oligonucleotide
gattcacctctcacctcacctattgtattgtccca

SEQ ID NO: 152738 - DNA, 36 bp, Artificial Sequence
  Synthetic oligonucleotide
atccaccctacgacgtgttcgtcactttacaagcca

SEQ ID NO: 152739 - DNA, 36 bp, Artificial Sequence
  Synthetic oligonucleotide
aactgtccttccgcatcttgtgccccccggcctcca

SEQ ID NO: 152740 - DNA, 36 bp, Artificial Sequence
  Synthetic oligonucleotide
tgacccctccagcaaccgtgcgcccccttcagttca

SEQ ID NO: 152741 - DNA, 35 bp, Artificial Sequence
  Synthetic oligonucleotide
gatcgcagtccgccctgtctgcttcttgcctttca

SEQ ID NO: 152742 - DNA, 37 bp, Artificial Sequence
  Synthetic oligonucleotide
aatcgggaggtcgggaggggagggtagatgggggaga

SEQ ID NO: 152743 - DNA, 36 bp, Artificial Sequence
  Synthetic oligonucleotide
tgtgcgctactgcactcgccgcctaccccgctgaga

SEQ ID NO: 152744 - DNA, 37 bp, Artificial Sequence
  Synthetic oligonucleotide
tgtgcaaccgtgttgcctgtgcctccatccgcctaga

SEQ ID NO: 152745 - DNA, 37 bp, Artificial Sequence
  Synthetic oligonucleotide
acgcccccaccatctgttctctgacaatcgggaacga

SEQ ID NO: 152746 - DNA, 37 bp, Artificial Sequence
  Synthetic oligonucleotide
tcctccctacgccccatctaccggtcattgaagacga

SEQ ID NO: 152747 - DNA, 37 bp, Artificial Sequence
  Synthetic oligonucleotide
gacttgccccccctcggtcacaggtccgttctcccga

SEQ ID NO: 152748 - DNA, 35 bp, Artificial Sequence
  Synthetic oligonucleotide
tacattccgttgccgtgccctactcccgtgttcga

SEQ ID NO: 152749 - DNA, 37 bp, Artificial Sequence
  Synthetic oligonucleotide
gagggagaatgggtcggaggggtgcgggagaggagga

SEQ ID NO: 152750 - DNA, 37 bp, Artificial Sequence
  Synthetic oligonucleotide
gaagggaacgggtggagaacattggacgcagcaggga

SEQ ID NO: 152751 - DNA, 38 bp, Artificial Sequence
  Synthetic oligonucleotide
agaggcggggaggggaggagtatgggggcatgtcatga

SEQ ID NO: 152752 - DNA, 38 bp, Artificial Sequence
  Synthetic oligonucleotide
ttccatgcctgccgggttgcaacactttctgtccctga

SEQ ID NO: 152753 - DNA, 38 bp, Artificial Sequence
  Synthetic oligonucleotide
ttagcgcagagccctccgtaccatcattttcctgctga

SEQ ID NO: 152754 - DNA, 37 bp, Artificial Sequence
  Synthetic oligonucleotide
gtgacatccctcggcatatcttacagaccatcattga

SEQ ID NO: 152755 - DNA, 35 bp, Artificial Sequence
  Synthetic oligonucleotide
ttacctcccacctgtcgtgttgccttccatattga

SEQ ID NO: 152756 - DNA, 37 bp, Artificial Sequence
  Synthetic oligonucleotide
acccacctcttccctcgacgttgtaagtccatcttga

SEQ ID NO: 152757 - DNA, 37 bp, Artificial Sequence
  Synthetic oligonucleotide
gacaccgcttagttcttcactgctgacccattcttga

SEQ ID NO: 152758 - DNA, 38 bp, Artificial Sequence
  Synthetic oligonucleotide
atgtcacgcgccttcccgcctcccactcgccattttga

SEQ ID NO: 152759 - DNA, 35 bp, Artificial Sequence
  Synthetic oligonucleotide
tccctcgtaactgccccgtccgttgccctgtgcta

SEQ ID NO: 152760 - DNA, 35 bp, Artificial Sequence
  Synthetic oligonucleotide
tacagccgaacacgcgcccgtcctttgcccttgta

SEQ ID NO: 152761 - DNA, 36 bp, Artificial Sequence
  Synthetic oligonucleotide
atgatcccgccaccatgtcccctcattccagtctta

SEQ ID NO: 152762 - DNA, 37 bp, Artificial Sequence
  Synthetic oligonucleotide
ggggagggacagatgggggactaggggtccactttta

SEQ ID NO: 152763 - DNA, 35 bp, Artificial Sequence
  Synthetic oligonucleotide
ttgcgccgtcggtctatgttgtccccccgctgcac

SEQ ID NO: 152764 - DNA, 35 bp, Artificial Sequence
  Synthetic oligonucleotide
tgctcctgccctataacatccccttgctgttgcac

SEQ ID NO: 152765 - DNA, 35 bp, Artificial Sequence
  Synthetic oligonucleotide
gtcccgcccctactttgatgcccggacctgttcac

SEQ ID NO: 152766 - DNA, 35 bp, Artificial Sequence
  Synthetic oligonucleotide
accgtccacccaatcaatcgccgagcccgtccccc

SEQ ID NO: 152767 - DNA, 35 bp, Artificial Sequence
  Synthetic oligonucleotide
atctggccgatactgctcgccttcctcgtaatccc

SEQ ID NO: 152768 - DNA, 35 bp, Artificial Sequence
  Synthetic oligonucleotide
aatcagatcacatccgtctatagccctgacccgcc

SEQ ID NO: 152769 - DNA, 35 bp, Artificial Sequence
  Synthetic oligonucleotide
gaaacagcgcatcgtaggtcaaaactgctcgctcc

SEQ ID NO: 152770 - DNA, 35 bp, Artificial Sequence
  Synthetic oligonucleotide
tggagacgcctcccataagtcaatgatcaccttcc

SEQ ID NO: 152771 - DNA, 35 bp, Artificial Sequence
  Synthetic oligonucleotide
tagccgccacgtcctgattctcccactcactaggc

SEQ ID NO: 152772 - DNA, 35 bp, Artificial Sequence
  Synthetic oligonucleotide
gacttcacccgacctccgacccgagcctgacatgc

SEQ ID NO: 152773 - DNA, 35 bp, Artificial Sequence
  Synthetic oligonucleotide
tactgcagatcaagtcatcatctagcccgtcctgc

SEQ ID NO: 152774 - DNA, 35 bp, Artificial Sequence
  Synthetic oligonucleotide
tcccgccccctcccgggttgtttgtgtggtacctc

SEQ ID NO: 152775 - DNA, 35 bp, Artificial Sequence
  Synthetic oligonucleotide
aacacctacgcgctttttcctctgtccagtatctc

SEQ ID NO: 152776 - DNA, 35 bp, Artificial Sequence
  Synthetic oligonucleotide
gcgcctccttccgctgccatttctgaccctgtttc

SEQ ID NO: 152777 - DNA, 34 bp, Artificial Sequence
  Synthetic oligonucleotide
gtacggtaggcgtgaggggctggacggtgggacg

SEQ ID NO: 152778 - DNA, 35 bp, Artificial Sequence
  Synthetic oligonucleotide
gtacgttgctcgtgtccgcccttttctcaccgccg

SEQ ID NO: 152779 - DNA, 35 bp, Artificial Sequence
  Synthetic oligonucleotide
tcatcgctgggctatgtcttgtcctcacttttccg

SEQ ID NO: 152780 - DNA, 35 bp, Artificial Sequence
  Synthetic oligonucleotide
gagaccccgtatagtttgccacctgccatcactcg

SEQ ID NO: 152781 - DNA, 35 bp, Artificial Sequence
  Synthetic oligonucleotide
gtcattgggagggagggtggtgctaacccatgggg

SEQ ID NO: 152782 - DNA, 35 bp, Artificial Sequence
  Synthetic oligonucleotide
gccacccgcaactgggccgctatcactccgcctgg

SEQ ID NO: 152783 - DNA, 35 bp, Artificial Sequence
  Synthetic oligonucleotide
gcaaaaaggtggaagagggcggagggggcatactg

SEQ ID NO: 152784 - DNA, 35 bp, Artificial Sequence
  Synthetic oligonucleotide
ggaggtggaaaggtgaagagaggaagggactcgtg

SEQ ID NO: 152785 - DNA, 35 bp, Artificial Sequence
  Synthetic oligonucleotide
ggaaagggacgggggagatactaagtgagaatgtg

SEQ ID NO: 152786 - DNA, 35 bp, Artificial Sequence
  Synthetic oligonucleotide
tttgcaccgccattattttctttgcgcgttaccct

SEQ ID NO: 152787 - DNA, 35 bp, Artificial Sequence
  Synthetic oligonucleotide
tccgccccgtgttgcgatgcctggttcgtgcccct

SEQ ID NO: 152788 - DNA, 35 bp, Artificial Sequence
  Synthetic oligonucleotide
gtcgccgccgatcccacatccccatgctacctcct

SEQ ID NO: 152789 - DNA, 35 bp, Artificial Sequence
  Synthetic oligonucleotide
gcacggagaggagggggaagggacaagcacgctct

SEQ ID NO: 152790 - DNA, 35 bp, Artificial Sequence
  Synthetic oligonucleotide
tagggggagagtcctgtgggtggggagggggctgt

SEQ ID NO: 152791 - DNA, 35 bp, Artificial Sequence
  Synthetic oligonucleotide
ttggccacccgcccccccacgaattggaatatctt

SEQ ID NO: 152792 - DNA, 35 bp, Artificial Sequence
  Synthetic oligonucleotide
tgacacgtggttcggttacggcctcctaccctctt

SEQ ID NO: 152793 - DNA, 35 bp, Artificial Sequence
  Synthetic oligonucleotide
tacagcaaatagggagggggggcgagggactcgtt

SEQ ID NO: 152794 - DNA, 35 bp, Artificial Sequence
  Synthetic oligonucleotide
accatgagaggcgccctgcctggttcctatccttt

SEQ ID NO: 152795 - DNA, 35 bp, Artificial Sequence
  Synthetic oligonucleotide
agtcagacactgccctgacttttctcgtgatcttt

SEQ ID NO: 152796 - DNA, 35 bp, Artificial Sequence
  Synthetic oligonucleotide
gaggtcgccgcactggttcatttttcttcgcgttt

SEQ ID NO: 152797 - DNA, 35 bp, Artificial Sequence
  Synthetic oligonucleotide
gacccgcccgcctggaccactcatgacattaacaa

SEQ ID NO: 152798 - DNA, 36 bp, Artificial Sequence
  Synthetic oligonucleotide
tctatacctcgaccgatccgccttgctaccgtgcaa

SEQ ID NO: 152799 - DNA, 36 bp, Artificial Sequence
  Synthetic oligonucleotide
gactccctatcgcgtatcaacccgcgtgtttacaca

SEQ ID NO: 152800 - DNA, 36 bp, Artificial Sequence
  Synthetic oligonucleotide
tcgttctcgcacgctgttcattcccgctccaccaca

SEQ ID NO: 152801 - DNA, 36 bp, Artificial Sequence
  Synthetic oligonucleotide
acgttctgccgcgagctcgtacctctctttttgcca

SEQ ID NO: 152802 - DNA, 35 bp, Artificial Sequence
  Synthetic oligonucleotide
agaccccccgtccgaacgacgctaactaccctgca

SEQ ID NO: 152803 - DNA, 36 bp, Artificial Sequence
  Synthetic oligonucleotide
tccatgccatcatgtcttgccatttgcttatcatca

SEQ ID NO: 152804 - DNA, 36 bp, Artificial Sequence
  Synthetic oligonucleotide
aacgcccttcgcccaccctgcattattgccttgtca

SEQ ID NO: 152805 - DNA, 36 bp, Artificial Sequence
  Synthetic oligonucleotide
tgccatgagttgcctccgccagtttctcctcgttca

SEQ ID NO: 152806 - DNA, 37 bp, Artificial Sequence
  Synthetic oligonucleotide
tgtgtaggatggggtggaacatggaagaacgtaaaga

SEQ ID NO: 152807 - DNA, 37 bp, Artificial Sequence
  Synthetic oligonucleotide
gacacccccatgtgtctccactttccccgagaccaga

SEQ ID NO: 152808 - DNA, 37 bp, Artificial Sequence
  Synthetic oligonucleotide
aatgagagggtgagcgagggggcgaaaggtgcgtaga

SEQ ID NO: 152809 - DNA, 37 bp, Artificial Sequence
  Synthetic oligonucleotide
acatcctcacgttgacgaactttctcctgtcccacga

SEQ ID NO: 152810 - DNA, 36 bp, Artificial Sequence
  Synthetic oligonucleotide
gtgaacgtaccagccctcgatcagctacactcccga

SEQ ID NO: 152811 - DNA, 37 bp, Artificial Sequence
  Synthetic oligonucleotide
tcgatcgctgtttgcatcatccacaccgacctcccga

SEQ ID NO: 152812 - DNA, 37 bp, Artificial Sequence
  Synthetic oligonucleotide
ggaccccaccgcacatacttccttcgtcgtcgttcga

SEQ ID NO: 152813 - DNA, 37 bp, Artificial Sequence
  Synthetic oligonucleotide
aggaggagtgggggcggaatcggggtgcctggaggga

SEQ ID NO: 152814 - DNA, 37 bp, Artificial Sequence
  Synthetic oligonucleotide
aaacggcggtgggaggaggaggcgaggtaatggggga

SEQ ID NO: 152815 - DNA, 37 bp, Artificial Sequence
  Synthetic oligonucleotide
tgacggccggagggggggggcgatatgggcagatgga

SEQ ID NO: 152816 - DNA, 35 bp, Artificial Sequence
  Synthetic oligonucleotide
taaccacccccaggccgtgtttgttttttcttgga

SEQ ID NO: 152817 - DNA, 38 bp, Artificial Sequence
  Synthetic oligonucleotide
gagagaggatgggcgggttaggggggaggataagctga

SEQ ID NO: 152818 - DNA, 37 bp, Artificial Sequence
  Synthetic oligonucleotide
gttcgacggcgggagggaggtggggttggtcagctga

SEQ ID NO: 152819 - DNA, 37 bp, Artificial Sequence
  Synthetic oligonucleotide
gtctcgctcccgccatctacgtctgtcaccacgctga

SEQ ID NO: 152820 - DNA, 37 bp, Artificial Sequence
  Synthetic oligonucleotide
gcgtgcgcaatggtacacaccgccccccccgctctga

SEQ ID NO: 152821 - DNA, 38 bp, Artificial Sequence
  Synthetic oligonucleotide
ggttgtggcgcgatgagtcaggggcggggagggagtga

SEQ ID NO: 152822 - DNA, 38 bp, Artificial Sequence
  Synthetic oligonucleotide
agtccgcaccctcccacgttttatccggtcctacgtga

SEQ ID NO: 152823 - DNA, 38 bp, Artificial Sequence
  Synthetic oligonucleotide
tgagtacagggagggtgggactgggactaggtaattga

SEQ ID NO: 152824 - DNA, 38 bp, Artificial Sequence
  Synthetic oligonucleotide
acatgaccatgtctataaggctctcgccctctccttga

SEQ ID NO: 152825 - DNA, 35 bp, Artificial Sequence
  Synthetic oligonucleotide
atctcgggagggtggggaaagaccgcgggtgacta

SEQ ID NO: 152826 - DNA, 36 bp, Artificial Sequence
  Synthetic oligonucleotide
gccgcagtactccctgctgtatcaatgccctctcta

SEQ ID NO: 152827 - DNA, 36 bp, Artificial Sequence
  Synthetic oligonucleotide
gaggaggggactaagtgggaatggaggtctgcggta

SEQ ID NO: 152828 - DNA, 30 bp, Artificial Sequence
  Synthetic oligonucleotide
gtctctacgcactcctcccactccggatta

SEQ ID NO: 152829 - DNA, 35 bp, Artificial Sequence
  Synthetic oligonucleotide
aaccgcatagcgaccccgccgatgctgccccctta

SEQ ID NO: 152830 - DNA, 35 bp, Artificial Sequence
  Synthetic oligonucleotide
agcggggggagaagcgggagacgagggtgcagtta

SEQ ID NO: 152831 - DNA, 35 bp, Artificial Sequence
  Synthetic oligonucleotide
tctcacctgctcaccctttcttatggcaccattta

SEQ ID NO: 152832 - DNA, 35 bp, Artificial Sequence
  Synthetic oligonucleotide
gtagcgcaagtcgtgtcctactccgcccattgtac

SEQ ID NO: 152833 - DNA, 35 bp, Artificial Sequence
  Synthetic oligonucleotide
aacaagccgcaaggctctgaggatccaccccttac

SEQ ID NO: 152834 - DNA, 34 bp, Artificial Sequence
  Synthetic oligonucleotide
aggtctcgcccgaagtaccatcatccttcccacc

SEQ ID NO: 152835 - DNA, 35 bp, Artificial Sequence
  Synthetic oligonucleotide
gttcgagcccccgttcccagtccccggggtccacc

SEQ ID NO: 152836 - DNA, 34 bp, Artificial Sequence
  Synthetic oligonucleotide
ccaacaccggaaccatatagtaccccgcccgccc

SEQ ID NO: 152837 - DNA, 35 bp, Artificial Sequence
  Synthetic oligonucleotide
agccgacgccacgtttctgcctcccttttgctccc

SEQ ID NO: 152838 - DNA, 35 bp, Artificial Sequence
  Synthetic oligonucleotide
tagtgcactactgatccgatctatcgcactgtccc

SEQ ID NO: 152839 - DNA, 35 bp, Artificial Sequence
  Synthetic oligonucleotide
agcgatacccgggtcccttttgcttgtgcctcgcc

SEQ ID NO: 152840 - DNA, 36 bp, Artificial Sequence
  Synthetic oligonucleotide
tgattcgcaactgctaatactagcactcccccggcc

SEQ ID NO: 152841 - DNA, 35 bp, Artificial Sequence
  Synthetic oligonucleotide
tatggcgcctactcctgttgtccctcacccactcc

SEQ ID NO: 152842 - DNA, 35 bp, Artificial Sequence
  Synthetic oligonucleotide
ttgtacatgttccctatcgcgtatgccagcactcc

SEQ ID NO: 152843 - DNA, 35 bp, Artificial Sequence
  Synthetic oligonucleotide
ttggtcgcccagagcacccttggacccaactttcc

SEQ ID NO: 152844 - DNA, 34 bp, Artificial Sequence
  Synthetic oligonucleotide
acatccctagtgcctctgtatcgtttctccacgc

SEQ ID NO: 152845 - DNA, 35 bp, Artificial Sequence
  Synthetic oligonucleotide
aaccccctgacaatgatccgctccgaccaagtcgc

SEQ ID NO: 152846 - DNA, 33 bp, Artificial Sequence
  Synthetic oligonucleotide
gatttccatctggtttagtgacccctccttcgc

SEQ ID NO: 152847 - DNA, 35 bp, Artificial Sequence
  Synthetic oligonucleotide
gcctttgccgatccgccgactccctttcactaggc

SEQ ID NO: 152848 - DNA, 35 bp, Artificial Sequence
  Synthetic oligonucleotide
tacgccccgcaacgcctccgcaatacaaccgctgc

SEQ ID NO: 152849 - DNA, 33 bp, Artificial Sequence
  Synthetic oligonucleotide
tctgtcccccccctcggcctgtatttcagaatc

SEQ ID NO: 152850 - DNA, 35 bp, Artificial Sequence
  Synthetic oligonucleotide
tccgtccacagtttgcctgtggcatatgcaccatc

SEQ ID NO: 152851 - DNA, 34 bp, Artificial Sequence
  Synthetic oligonucleotide
ccgacactcgtacgcgcatgtctccgcctcgctc

SEQ ID NO: 152852 - DNA, 35 bp, Artificial Sequence
  Synthetic oligonucleotide
ggagtcccatgatctggcttttggtcccgcccttc

SEQ ID NO: 152853 - DNA, 35 bp, Artificial Sequence
  Synthetic oligonucleotide
ttcggtcctcactaagtgcttctgccccttgtttc

SEQ ID NO: 152854 - DNA, 35 bp, Artificial Sequence
  Synthetic oligonucleotide
gagaagttatggtgggaagcaaggggtcgagggag

SEQ ID NO: 152855 - DNA, 35 bp, Artificial Sequence
  Synthetic oligonucleotide
gacccctccgctctccttccatctacgacgcaccg

SEQ ID NO: 152856 - DNA, 35 bp, Artificial Sequence
  Synthetic oligonucleotide
tgatcttgggtgggtggggaaggggtccccgaatg

SEQ ID NO: 152857 - DNA, 35 bp, Artificial Sequence
  Synthetic oligonucleotide
acaccccccgccacgccagtaccacgtaccaagtg

SEQ ID NO: 152858 - DNA, 35 bp, Artificial Sequence
  Synthetic oligonucleotide
aactacagccagaagtggttccgcccccccgtaat

SEQ ID NO: 152859 - DNA, 35 bp, Artificial Sequence
  Synthetic oligonucleotide
acccccactttcccatccgtatatgcagcagccat

SEQ ID NO: 152860 - DNA, 35 bp, Artificial Sequence
  Synthetic oligonucleotide
gagaccatagcatcaatgcgaccgtcctcttccat

SEQ ID NO: 152861 - DNA, 35 bp, Artificial Sequence
  Synthetic oligonucleotide
acgaaaggcgctgtccggtctattctcccgtgcct

SEQ ID NO: 152862 - DNA, 35 bp, Artificial Sequence
  Synthetic oligonucleotide
gcgcactccattcccgtttatttcttgctattgct

SEQ ID NO: 152863 - DNA, 35 bp, Artificial Sequence
  Synthetic oligonucleotide
gatgcatgttgccatagttattaccggtttcctct

SEQ ID NO: 152864 - DNA, 35 bp, Artificial Sequence
  Synthetic oligonucleotide
gtctagcgcctctgccctgacccatatctttgtct

SEQ ID NO: 152865 - DNA, 35 bp, Artificial Sequence
  Synthetic oligonucleotide
gtctgtccctccctagcccgtacgtttgtcgttct

SEQ ID NO: 152866 - DNA, 35 bp, Artificial Sequence
  Synthetic oligonucleotide
acagcgcattaccatgccatatgttcacctctcgt

SEQ ID NO: 152867 - DNA, 35 bp, Artificial Sequence
  Synthetic oligonucleotide
tacgccgcccgttggccatcagggattccttcctt

SEQ ID NO: 152868 - DNA, 35 bp, Artificial Sequence
  Synthetic oligonucleotide
gccctgtgaagcttgtaacccgccgtcaccctctt

SEQ ID NO: 152869 - DNA, 35 bp, Artificial Sequence
  Synthetic oligonucleotide
taccccgctcagtctcttcccgccccacaagtctt

SEQ ID NO: 152870 - DNA, 35 bp, Artificial Sequence
  Synthetic oligonucleotide
tcccaacctgtcattcgccaacacaccatcccttt

SEQ ID NO: 152871 - DNA, 36 bp, Artificial Sequence
  Synthetic oligonucleotide
acatgtccaccgtgagtagcccccgtccttatccaa

SEQ ID NO: 152872 - DNA, 33 bp, Artificial Sequence
  Synthetic oligonucleotide
gcaactagctgcccgttggcccctcctctagaa

SEQ ID NO: 152873 - DNA, 36 bp, Artificial Sequence
  Synthetic oligonucleotide
tgcaacaggtaggtgtctacctctcatgtctctaca

SEQ ID NO: 152874 - DNA, 36 bp, Artificial Sequence
  Synthetic oligonucleotide
tcgctgcacggggtcagtcctcctattccacctgca

SEQ ID NO: 152875 - DNA, 37 bp, Artificial Sequence
  Synthetic oligonucleotide
ataagaggcgaggggttgagcgagacgggggggaaga

SEQ ID NO: 152876 - DNA, 37 bp, Artificial Sequence
  Synthetic oligonucleotide
tcactccacaatagtgcacatcctcctccagtcgaga

SEQ ID NO: 152877 - DNA, 37 bp, Artificial Sequence
  Synthetic oligonucleotide
atctgcacgggtggtggggaacggggactcgggacga

SEQ ID NO: 152878 - DNA, 37 bp, Artificial Sequence
  Synthetic oligonucleotide
agcaccacctggccatcatcaaccaccgcccctccga

SEQ ID NO: 152879 - DNA, 37 bp, Artificial Sequence
  Synthetic oligonucleotide
gatcgtggaactcaggtgcaaggaacgggggggcgga

SEQ ID NO: 152880 - DNA, 37 bp, Artificial Sequence
  Synthetic oligonucleotide
ttaacgagcaggggggcacggggggttattaaaggga

SEQ ID NO: 152881 - DNA, 37 bp, Artificial Sequence
  Synthetic oligonucleotide
gcccactacaccttccccaatagacgattcttaggga

SEQ ID NO: 152882 - DNA, 37 bp, Artificial Sequence
  Synthetic oligonucleotide
tagccacccctatcctgtctgtcccttcaaagcctga

SEQ ID NO: 152883 - DNA, 37 bp, Artificial Sequence
  Synthetic oligonucleotide
gcacgctgccccatctatagactacgccccccgctga

SEQ ID NO: 152884 - DNA, 37 bp, Artificial Sequence
  Synthetic oligonucleotide
tgtcacatcgggtgggacgggggatctggggatgtga

SEQ ID NO: 152885 - DNA, 37 bp, Artificial Sequence
  Synthetic oligonucleotide
gaccgccctccacccgccgtttcagatgtatctgtga

SEQ ID NO: 152886 - DNA, 38 bp, Artificial Sequence
  Synthetic oligonucleotide
tccacaccgctatagtttctcctgcaatggaacattga

SEQ ID NO: 152887 - DNA, 38 bp, Artificial Sequence
  Synthetic oligonucleotide
gatgcctggttataccgcgttaccgcccttcatattga

SEQ ID NO: 152888 - DNA, 35 bp, Artificial Sequence
  Synthetic oligonucleotide
ttcgcatcaccgccacaccatttcgtacttttata

SEQ ID NO: 152889 - DNA, 36 bp, Artificial Sequence
  Synthetic oligonucleotide
tagtcacgtccattctcctactgcggcacctaacta

SEQ ID NO: 152890 - DNA, 36 bp, Artificial Sequence
  Synthetic oligonucleotide
gacccgccctcatctgagcttccttctggtttagta

SEQ ID NO: 152891 - DNA, 35 bp, Artificial Sequence
  Synthetic oligonucleotide
tgcaacggtccaccgcgttaactcaccacagccac

SEQ ID NO: 152892 - DNA, 35 bp, Artificial Sequence
  Synthetic oligonucleotide
gctgctcgttcagcctgtccctaggatcccccacc

SEQ ID NO: 152893 - DNA, 35 bp, Artificial Sequence
  Synthetic oligonucleotide
acaagcgccatgcccaccatccccgatgtccgccc

SEQ ID NO: 152894 - DNA, 35 bp, Artificial Sequence
  Synthetic oligonucleotide
gacaccgtgacgtgaagccccccttccctaaggcc

SEQ ID NO: 152895 - DNA, 35 bp, Artificial Sequence
  Synthetic oligonucleotide
ggaacctcccgtgtgcccacgctccgcctgtatcc

SEQ ID NO: 152896 - DNA, 35 bp, Artificial Sequence
  Synthetic oligonucleotide
tggacgttccttgcgccctccacttccgtgagtcc

SEQ ID NO: 152897 - DNA, 33 bp, Artificial Sequence
  Synthetic oligonucleotide
gaccgactcccccgcgtcgagcatacttggtcc

SEQ ID NO: 152898 - DNA, 35 bp, Artificial Sequence
  Synthetic oligonucleotide
acacacgcggactgagccgtcattcccggccttcc

SEQ ID NO: 152899 - DNA, 35 bp, Artificial Sequence
  Synthetic oligonucleotide
gcactcccgcctccgtaactgtacgcacccgacgc

SEQ ID NO: 152900 - DNA, 35 bp, Artificial Sequence
  Synthetic oligonucleotide
tttgcacctggttgttatggcctccccatgcccgc

SEQ ID NO: 152901 - DNA, 35 bp, Artificial Sequence
  Synthetic oligonucleotide
tccccatgcctaactaatactggtaagtttccatc

SEQ ID NO: 152902 - DNA, 35 bp, Artificial Sequence
  Synthetic oligonucleotide
tggagcccggtccccacgaacctaacggctaactc

SEQ ID NO: 152903 - DNA, 35 bp, Artificial Sequence
  Synthetic oligonucleotide
tcgaagcctctttctgtccccacgtcatcctactc

SEQ ID NO: 152904 - DNA, 35 bp, Artificial Sequence
  Synthetic oligonucleotide
atgatcaccgctctagctcctgtccaccggtcctc

SEQ ID NO: 152905 - DNA, 35 bp, Artificial Sequence
  Synthetic oligonucleotide
gagccccagccccgccttgttttcaagcccatgtc

SEQ ID NO: 152906 - DNA, 35 bp, Artificial Sequence
  Synthetic oligonucleotide
gcccctgacctctatatactgcatactccctcccg

SEQ ID NO: 152907 - DNA, 35 bp, Artificial Sequence
  Synthetic oligonucleotide
tccgcacaatcgccccatgttcgccgcaccacgcg

SEQ ID NO: 152908 - DNA, 35 bp, Artificial Sequence
  Synthetic oligonucleotide
gacgcgggggggattagggatagtctgggcgatcg

SEQ ID NO: 152909 - DNA, 35 bp, Artificial Sequence
  Synthetic oligonucleotide
acctgcccaccagtccccctcccgcaactacgcgg

SEQ ID NO: 152910 - DNA, 35 bp, Artificial Sequence
  Synthetic oligonucleotide
ttcgatccacccttcacgcgcgccttgccaagggg

SEQ ID NO: 152911 - DNA, 35 bp, Artificial Sequence
  Synthetic oligonucleotide
tcatcgtggccaccccccgccccctacacctttgg

SEQ ID NO: 152912 - DNA, 35 bp, Artificial Sequence
  Synthetic oligonucleotide
gcaagaacggaggagggaacattgacggcatgctg

SEQ ID NO: 152913 - DNA, 35 bp, Artificial Sequence
  Synthetic oligonucleotide
ttgtacagctccaacatctaccgccgttccttctg

SEQ ID NO: 152914 - DNA, 35 bp, Artificial Sequence
  Synthetic oligonucleotide
taccacggtcatgtccccgcccgcccccatttctg

SEQ ID NO: 152915 - DNA, 35 bp, Artificial Sequence
  Synthetic oligonucleotide
gatctatccgctgtccaattttttcaccacctgtg

SEQ ID NO: 152916 - DNA, 35 bp, Artificial Sequence
  Synthetic oligonucleotide
tcaacccctcccgctcctccctcatgctatcgttg

SEQ ID NO: 152917 - DNA, 35 bp, Artificial Sequence
  Synthetic oligonucleotide
taccgttgcctgccaccccgacccgcacagacgat

SEQ ID NO: 152918 - DNA, 35 bp, Artificial Sequence
  Synthetic oligonucleotide
gctggtcattctgttcgtccttctcgccgttatat

SEQ ID NO: 152919 - DNA, 35 bp, Artificial Sequence
  Synthetic oligonucleotide
agtacgtctgagtcaagtcccatccccccacctct

SEQ ID NO: 152920 - DNA, 35 bp, Artificial Sequence
  Synthetic oligonucleotide
tcccatccccatgcaggtcagcttccttctcctct

SEQ ID NO: 152921 - DNA, 35 bp, Artificial Sequence
  Synthetic oligonucleotide
gccgtgtagccatcctttatgccttatcctgttct

SEQ ID NO: 152922 - DNA, 35 bp, Artificial Sequence
  Synthetic oligonucleotide
gcctcgcgcctaactctgaatctgtccctttacgt

SEQ ID NO: 152923 - DNA, 35 bp, Artificial Sequence
  Synthetic oligonucleotide
acatggtgcatacccgcgtctaacgccccccgctt

SEQ ID NO: 152924 - DNA, 34 bp, Artificial Sequence
  Synthetic oligonucleotide
gcgttccgccccattttcgtgattgtccatgctt

SEQ ID NO: 152925 - DNA, 35 bp, Artificial Sequence
  Synthetic oligonucleotide
gtcacatacgggcccttctgtgcagttcctccttt

SEQ ID NO: 152926 - DNA, 35 bp, Artificial Sequence
  Synthetic oligonucleotide
tgccacctcctgcgttctagcagagttcttgcttt

SEQ ID NO: 152927 - DNA, 36 bp, Artificial Sequence
  Synthetic oligonucleotide
tcttcacctccgcgcgtaacacctcacatgcaccaa

SEQ ID NO: 152928 - DNA, 36 bp, Artificial Sequence
  Synthetic oligonucleotide
ttcctgcctactctgcgcccgtccatcctgttccca

SEQ ID NO: 152929 - DNA, 35 bp, Artificial Sequence
  Synthetic oligonucleotide
ttcgcatatccctccatctgtcgattaactagcca

SEQ ID NO: 152930 - DNA, 36 bp, Artificial Sequence
  Synthetic oligonucleotide
gtcccgttacctatcacgcatatcgccactgtgcca

SEQ ID NO: 152931 - DNA, 36 bp, Artificial Sequence
  Synthetic oligonucleotide
gccaacgggtgggtggagtgggcgtgactattgcca

SEQ ID NO: 152932 - DNA, 36 bp, Artificial Sequence
  Synthetic oligonucleotide
gtcacccactcctccgtcatgtagatgttccctcca

SEQ ID NO: 152933 - DNA, 35 bp, Artificial Sequence
  Synthetic oligonucleotide
tgacaccctgcctacgggccaatactaccgttcca

SEQ ID NO: 152934 - DNA, 36 bp, Artificial Sequence
  Synthetic oligonucleotide
gttggcggttcagcggtctctagttcttcaccttca

SEQ ID NO: 152935 - DNA, 36 bp, Artificial Sequence
  Synthetic oligonucleotide
actgtccgctgttacgccctctaagcccccagttca

SEQ ID NO: 152936 - DNA, 36 bp, Artificial Sequence
  Synthetic oligonucleotide
tcagtgcaaggagggacgggaggggggtggtgaaga

SEQ ID NO: 152937 - DNA, 37 bp, Artificial Sequence
  Synthetic oligonucleotide
cttccaccccggcttgatcgtgacatcctccgctaga

SEQ ID NO: 152938 - DNA, 37 bp, Artificial Sequence
  Synthetic oligonucleotide
gcacacccaacgctgcgtctgattcccgcactctcga

SEQ ID NO: 152939 - DNA, 35 bp, Artificial Sequence
  Synthetic oligonucleotide
actggtgcgcgggaagggcgggatcattgggggga

SEQ ID NO: 152940 - DNA, 37 bp, Artificial Sequence
  Synthetic oligonucleotide
tccaatgggggtggggatagggatggatccaatggga

SEQ ID NO: 152941 - DNA, 35 bp, Artificial Sequence
  Synthetic oligonucleotide
gcctcccactgccactcttcgcgagcccctatgga

SEQ ID NO: 152942 - DNA, 37 bp, Artificial Sequence
  Synthetic oligonucleotide
agttgtgcagtgggggggagggtgtgtcagggctgga

SEQ ID NO: 152943 - DNA, 36 bp, Artificial Sequence
  Synthetic oligonucleotide
tgcgcatcatttcgccctccccacaaccgtccatga

SEQ ID NO: 152944 - DNA, 38 bp, Artificial Sequence
  Synthetic oligonucleotide
aatgacaccgagccgattttgctattgctcctccctga

SEQ ID NO: 152945 - DNA, 37 bp, Artificial Sequence
  Synthetic oligonucleotide
acgtggcaccctcttccctgtttacccacctcgctga

SEQ ID NO: 152946 - DNA, 37 bp, Artificial Sequence
  Synthetic oligonucleotide
gaagggggcagtaatagggagagcgagcggagggtga

SEQ ID NO: 152947 - DNA, 38 bp, Artificial Sequence
  Synthetic oligonucleotide
gcgcgacgacctgcctcgacccctacctgccattgtga

SEQ ID NO: 152948 - DNA, 38 bp, Artificial Sequence
  Synthetic oligonucleotide
tgcgggcctctcgtatcgtcttcttgcgccgcccttga

SEQ ID NO: 152949 - DNA, 38 bp, Artificial Sequence
  Synthetic oligonucleotide
tcgcatgtaccatcttcctgtttcactctgtcccttga

SEQ ID NO: 152950 - DNA, 38 bp, Artificial Sequence
  Synthetic oligonucleotide
accgacaggggtgagggggagacgggaggaggggttga

SEQ ID NO: 152951 - DNA, 37 bp, Artificial Sequence
  Synthetic oligonucleotide
gacaactacggaaccgggcgggagggcagggggttga

SEQ ID NO: 152952 - DNA, 38 bp, Artificial Sequence
  Synthetic oligonucleotide
tgctaagcacgggtaagggagggaaggaatggggttga

SEQ ID NO: 152953 - DNA, 36 bp, Artificial Sequence
  Synthetic oligonucleotide
accgtccaccccgttgtcgtttaccattttcatata

SEQ ID NO: 152954 - DNA, 35 bp, Artificial Sequence
  Synthetic oligonucleotide
gccctctccactggccatgtcctccgttcaccgta

SEQ ID NO: 152955 - DNA, 36 bp, Artificial Sequence
  Synthetic oligonucleotide
gactgacccccaactatgtacttccgaccttcctta

SEQ ID NO: 152956 - DNA, 35 bp, Artificial Sequence
  Synthetic oligonucleotide
tgtccactgccctgcccacttgctcccccgtgcac

SEQ ID NO: 152957 - DNA, 35 bp, Artificial Sequence
  Synthetic oligonucleotide
gttgcccttgagcatgttgtccatatccatccgac

SEQ ID NO: 152958 - DNA, 35 bp, Artificial Sequence
  Synthetic oligonucleotide
tgtgtcatgtgtagcccggcacccactccctttac

SEQ ID NO: 152959 - DNA, 35 bp, Artificial Sequence
  Synthetic oligonucleotide
tcctcccgactcgtgccactaagcagcacgcaacc

SEQ ID NO: 152960 - DNA, 35 bp, Artificial Sequence
  Synthetic oligonucleotide
gcaaatgccacgtcaccattctcggtacatccacc

SEQ ID NO: 152961 - DNA, 35 bp, Artificial Sequence
  Synthetic oligonucleotide
tccaggcttaccgtagtttaaagcctccctgcccc

SEQ ID NO: 152962 - DNA, 35 bp, Artificial Sequence
  Synthetic oligonucleotide
gtttggccccgccccatgtcctcagatacttcgcc

SEQ ID NO: 152963 - DNA, 35 bp, Artificial Sequence
  Synthetic oligonucleotide
gtttggcctacgtgttcttcgccatatagccctcc

SEQ ID NO: 152964 - DNA, 36 bp, Artificial Sequence
  Synthetic oligonucleotide
actaccgtccacaagccgaccagcgctatcacgtcc

SEQ ID NO: 152965 - DNA, 35 bp, Artificial Sequence
  Synthetic oligonucleotide
gacgggatagggtgggtacatgggtaggtcggtcc

SEQ ID NO: 152966 - DNA, 35 bp, Artificial Sequence
  Synthetic oligonucleotide
gaccatagtcctgccgttgttcccaaattccctgc

SEQ ID NO: 152967 - DNA, 35 bp, Artificial Sequence
  Synthetic oligonucleotide
gcccgctacccactcgtcacatcttggccccagtc

SEQ ID NO: 152968 - DNA, 35 bp, Artificial Sequence
  Synthetic oligonucleotide
gtctcaccatgtccaaggcgcacgcccctactgtc

SEQ ID NO: 152969 - DNA, 35 bp, Artificial Sequence
  Synthetic oligonucleotide
gacacttctcgcatcgtgacaacttttcccccttc

SEQ ID NO: 152970 - DNA, 35 bp, Artificial Sequence
  Synthetic oligonucleotide
tgtgtcgcaccatgcctcgaatcgtcctcccgttc

SEQ ID NO: 152971 - DNA, 35 bp, Artificial Sequence
  Synthetic oligonucleotide
tgccccaacccatgttccttccccgactactcacg

SEQ ID NO: 152972 - DNA, 35 bp, Artificial Sequence
  Synthetic oligonucleotide
gagagatgaaatgggtggggcaggggcttcggccg

SEQ ID NO: 152973 - DNA, 35 bp, Artificial Sequence
  Synthetic oligonucleotide
acatggatgcctcgatgctcacgtccactctttcg

SEQ ID NO: 152974 - DNA, 35 bp, Artificial Sequence
  Synthetic oligonucleotide
tgagaggagaaagagggagaacaacgggatgacgg

SEQ ID NO: 152975 - DNA, 35 bp, Artificial Sequence
  Synthetic oligonucleotide
atcaattgctgttcgccgccccccacccgttccgg

SEQ ID NO: 152976 - DNA, 35 bp, Artificial Sequence
  Synthetic oligonucleotide
accacccacgtcgaaatccccccttcagatgttgg

SEQ ID NO: 152977 - DNA, 35 bp, Artificial Sequence
  Synthetic oligonucleotide
tgctccctcccccttacctgcaagtcatcttttgg

SEQ ID NO: 152978 - DNA, 35 bp, Artificial Sequence
  Synthetic oligonucleotide
atgtgccctcctccgcgaccctcgaccgccgtgat

SEQ ID NO: 152979 - DNA, 35 bp, Artificial Sequence
  Synthetic oligonucleotide
gtgggggtcgaggcaacgaaagggggagggaatat

SEQ ID NO: 152980 - DNA, 35 bp, Artificial Sequence
  Synthetic oligonucleotide
gtctgcgcacacccccttcgtgcctgcttgccact

SEQ ID NO: 152981 - DNA, 35 bp, Artificial Sequence
  Synthetic oligonucleotide
gatgtccctccttcgcaccgctatcagccgccgct

SEQ ID NO: 152982 - DNA, 35 bp, Artificial Sequence
  Synthetic oligonucleotide
gactgcgggcagtttcttccggccaccgtatctct

SEQ ID NO: 152983 - DNA, 35 bp, Artificial Sequence
  Synthetic oligonucleotide
gtgcacgcacaaaccgtcgccctcctgattctggt

SEQ ID NO: 152984 - DNA, 35 bp, Artificial Sequence
  Synthetic oligonucleotide
atgctccatccgttctcatcaacttccgtgtcctt

SEQ ID NO: 152985 - DNA, 35 bp, Artificial Sequence
  Synthetic oligonucleotide
ggtcaacacacaccgcccgtcctgctccctataaa

SEQ ID NO: 152986 - DNA, 35 bp, Artificial Sequence
  Synthetic oligonucleotide
agccatgtccctgtcagcccgtcctacgccaccaa

SEQ ID NO: 152987 - DNA, 36 bp, Artificial Sequence
  Synthetic oligonucleotide
cccatctccgtgcctatccacacttgcccacatcaa

SEQ ID NO: 152988 - DNA, 36 bp, Artificial Sequence
  Synthetic oligonucleotide
gccccttccagccatagacgtttcgcgccccatcaa

SEQ ID NO: 152989 - DNA, 36 bp, Artificial Sequence
  Synthetic oligonucleotide
atccgatccccccgccctgtcccactgttaccgtaa

SEQ ID NO: 152990 - DNA, 36 bp, Artificial Sequence
  Synthetic oligonucleotide
ttcaccgccgtgttccactcttcctctcagttgaca

SEQ ID NO: 152991 - DNA, 35 bp, Artificial Sequence
  Synthetic oligonucleotide
agtgtcccacaccgctcctcacatccttaccgcca

SEQ ID NO: 152992 - DNA, 36 bp, Artificial Sequence
  Synthetic oligonucleotide
ttcacaccaccacaatgcgactgtctgctcaccgca

SEQ ID NO: 152993 - DNA, 36 bp, Artificial Sequence
  Synthetic oligonucleotide
attcacctcacaggacgttctttcccagtgcctgca

SEQ ID NO: 152994 - DNA, 35 bp, Artificial Sequence
  Synthetic oligonucleotide
tgcgccctcccgtccgccctgccatattgcttgca

SEQ ID NO: 152995 - DNA, 36 bp, Artificial Sequence
  Synthetic oligonucleotide
gtgttcagcctagtttgcattccccttctcccccga

SEQ ID NO: 152996 - DNA, 37 bp, Artificial Sequence
  Synthetic oligonucleotide
aaggacgtagctgcccttgttcccctcctctgatcga

SEQ ID NO: 152997 - DNA, 37 bp, Artificial Sequence
  Synthetic oligonucleotide
gcgatgcccggccctgctcccaatacccgtaattcga

SEQ ID NO: 152998 - DNA, 36 bp, Artificial Sequence
  Synthetic oligonucleotide
atgacgcaactggtaatagggggggaggggaaagga

SEQ ID NO: 152999 - DNA, 37 bp, Artificial Sequence
  Synthetic oligonucleotide
gagcgggtgaggaaacgcgcgcgaggaaaagggggga

SEQ ID NO: 153000 - DNA, 35 bp, Artificial Sequence
  Synthetic oligonucleotide
tcccatgtgcctcgtgccctcgctttattactgga

SEQ ID NO: 153001 - DNA, 37 bp, Artificial Sequence
  Synthetic oligonucleotide
ttcgtagagcgggggtagggaggggagtggcaagtga

SEQ ID NO: 153002 - DNA, 38 bp, Artificial Sequence
  Synthetic oligonucleotide
tcaccccgccgatcctctcatgcgttttgacacagtga

SEQ ID NO: 153003 - DNA, 37 bp, Artificial Sequence
  Synthetic oligonucleotide
tagtacgtacagggaggtgagggagggggtttagtga

SEQ ID NO: 153004 - DNA, 38 bp, Artificial Sequence
  Synthetic oligonucleotide
aaggggaggaatcaggtggaggagggaagcgcgattga

SEQ ID NO: 153005 - DNA, 37 bp, Artificial Sequence
  Synthetic oligonucleotide
tccacctcttcgttgcattttgattcctgcttattga

SEQ ID NO: 153006 - DNA, 37 bp, Artificial Sequence
  Synthetic oligonucleotide
gcccacgtccggtaggtctgcgcttcctcccccttga

SEQ ID NO: 153007 - DNA, 35 bp, Artificial Sequence
  Synthetic oligonucleotide
accgcacgactgcgttctacctggtcctttaaata

SEQ ID NO: 153008 - DNA, 35 bp, Artificial Sequence
  Synthetic oligonucleotide
atccaccacccttgccttcgagtctcgcatttcta

SEQ ID NO: 153009 - DNA, 36 bp, Artificial Sequence
  Synthetic oligonucleotide
gcaatgccgccatcgtcctccgtccgccaccatgta

SEQ ID NO: 153010 - DNA, 35 bp, Artificial Sequence
  Synthetic oligonucleotide
gacgggcgctcacacgttcggtccttcgttgctac

SEQ ID NO: 153011 - DNA, 35 bp, Artificial Sequence
  Synthetic oligonucleotide
actcagtcccacatatctgttatttttgctgcacc

SEQ ID NO: 153012 - DNA, 35 bp, Artificial Sequence
  Synthetic oligonucleotide
ttcgttctcgtacgccctaaactagcctgttcacc

SEQ ID NO: 153013 - DNA, 35 bp, Artificial Sequence
  Synthetic oligonucleotide
aacgactcacctcgttgtaacgctaccactcgacc

SEQ ID NO: 153014 - DNA, 35 bp, Artificial Sequence
  Synthetic oligonucleotide
gatggccgcccatgttagccatcggaccacctacc

SEQ ID NO: 153015 - DNA, 35 bp, Artificial Sequence
  Synthetic oligonucleotide
tttgcgatgaagccgatccgtctagtccactcccc

SEQ ID NO: 153016 - DNA, 35 bp, Artificial Sequence
  Synthetic oligonucleotide
aaccctaccagcggataattcccgtttctgccgcc

SEQ ID NO: 153017 - DNA, 35 bp, Artificial Sequence
  Synthetic oligonucleotide
tatggtgcgcgcaggaccataacatctgtcactcc

SEQ ID NO: 153018 - DNA, 35 bp, Artificial Sequence
  Synthetic oligonucleotide
gtcagggagttggtaactgctcgctccccctgtcc

SEQ ID NO: 153019 - DNA, 35 bp, Artificial Sequence
  Synthetic oligonucleotide
tcagtgtccccttggcctaacctctgctcgcctgc

SEQ ID NO: 153020 - DNA, 35 bp, Artificial Sequence
  Synthetic oligonucleotide
tccatcacacatcattacgactggacctgttcatc

SEQ ID NO: 153021 - DNA, 35 bp, Artificial Sequence
  Synthetic oligonucleotide
taatacgccaatctgtaccaccccctcaccacctc

SEQ ID NO: 153022 - DNA, 35 bp, Artificial Sequence
  Synthetic oligonucleotide
tatggccgtactcgttcccccttatgctaggtctc

SEQ ID NO: 153023 - DNA, 35 bp, Artificial Sequence
  Synthetic oligonucleotide
aaccacccccctgaccgcctggctggactcctgtc

SEQ ID NO: 153024 - DNA, 35 bp, Artificial Sequence
  Synthetic oligonucleotide
tgatgcgccaccctcgcattattcctgccgccttc

SEQ ID NO: 153025 - DNA, 35 bp, Artificial Sequence
  Synthetic oligonucleotide
gggaagagcggaggaacggggaggaagctagccag

SEQ ID NO: 153026 - DNA, 35 bp, Artificial Sequence
  Synthetic oligonucleotide
cccccgtcccagcccttccgtttccgccttcgtag

SEQ ID NO: 153027 - DNA, 35 bp, Artificial Sequence
  Synthetic oligonucleotide
gtggacctgcatgcctactcattctccgcctgacg

SEQ ID NO: 153028 - DNA, 35 bp, Artificial Sequence
  Synthetic oligonucleotide
atatgttggggtgggtgggtatgggagataagccg

SEQ ID NO: 153029 - DNA, 35 bp, Artificial Sequence
  Synthetic oligonucleotide
tgacggaagatcgggaaggagggaaggaggtgtcg

SEQ ID NO: 153030 - DNA, 35 bp, Artificial Sequence
  Synthetic oligonucleotide
tcactcccccatcacgcacagcatacatatcgtgg

SEQ ID NO: 153031 - DNA, 35 bp, Artificial Sequence
  Synthetic oligonucleotide
gatgcactcccgccctaacaaagcctcgctttatg

SEQ ID NO: 153032 - DNA, 35 bp, Artificial Sequence
  Synthetic oligonucleotide
ggactggaggagtgacgggggggtaatgcaaggtg

SEQ ID NO: 153033 - DNA, 35 bp, Artificial Sequence
  Synthetic oligonucleotide
agtcgcgcctctccttttcggtcctgtcctgccat

SEQ ID NO: 153034 - DNA, 35 bp, Artificial Sequence
  Synthetic oligonucleotide
ttggcccctgttccggccttcccttaaacgacact

SEQ ID NO: 153035 - DNA, 35 bp, Artificial Sequence
  Synthetic oligonucleotide
tcatcccgcaggcgatactctccattgggccacct

SEQ ID NO: 153036 - DNA, 35 bp, Artificial Sequence
  Synthetic oligonucleotide
cacacaattcgaccgctcggacggttttcgcacct

SEQ ID NO: 153037 - DNA, 35 bp, Artificial Sequence
  Synthetic oligonucleotide
atccgaacacccgccgccccgagtcattgatacct

SEQ ID NO: 153038 - DNA, 35 bp, Artificial Sequence
  Synthetic oligonucleotide
tgctgctacacccgcccctctgtttgcatggccct

SEQ ID NO: 153039 - DNA, 35 bp, Artificial Sequence
  Synthetic oligonucleotide
gacatcatttgctgttgaattgtacccctccctct

SEQ ID NO: 153040 - DNA, 35 bp, Artificial Sequence
  Synthetic oligonucleotide
ggagccttgaccatccccgtctctccctcaggtct

SEQ ID NO: 153041 - DNA, 35 bp, Artificial Sequence
  Synthetic oligonucleotide
tgtacacccgattgcttcgcccccctgcatgttct

SEQ ID NO: 153042 - DNA, 35 bp, Artificial Sequence
  Synthetic oligonucleotide
gacagggggggggtaagaagacacaaaggcaacgt

SEQ ID NO: 153043 - DNA, 35 bp, Artificial Sequence
  Synthetic oligonucleotide
tccatcctgttccgtaatgaaggaccttcctccgt

SEQ ID NO: 153044 - DNA, 35 bp, Artificial Sequence
  Synthetic oligonucleotide
accgatggtctcacacctgcaatctactgtacctt

SEQ ID NO: 153045 - DNA, 35 bp, Artificial Sequence
  Synthetic oligonucleotide
agcataacggtcgcatcctctgtttaacacccctt

SEQ ID NO: 153046 - DNA, 35 bp, Artificial Sequence
  Synthetic oligonucleotide
aacactgttcgacggcccaccctgttccctctctt

SEQ ID NO: 153047 - DNA, 35 bp, Artificial Sequence
  Synthetic oligonucleotide
tccaaagtgcaccacgctccatcgcccattacgtt

SEQ ID NO: 153048 - DNA, 35 bp, Artificial Sequence
  Synthetic oligonucleotide
tgccatggccacctctgctttacaccctgttgttt

SEQ ID NO: 153049 - DNA, 36 bp, Artificial Sequence
  Synthetic oligonucleotide
atatgccaccgaccacgtgctccctatagtacccca

SEQ ID NO: 153050 - DNA, 35 bp, Artificial Sequence
  Synthetic oligonucleotide
tgtacctcaaacgccctgagtgctccaactcccca

SEQ ID NO: 153051 - DNA, 35 bp, Artificial Sequence
  Synthetic oligonucleotide
tgtgcgccctcacctcttgttcaccgtgtctccca

SEQ ID NO: 153052 - DNA, 36 bp, Artificial Sequence
  Synthetic oligonucleotide
acgcccaccgccttcatcgcaccgagcattccgcca

SEQ ID NO: 153053 - DNA, 36 bp, Artificial Sequence
  Synthetic oligonucleotide
tgcctctgcaaactctatagttcgtgtctccctcca

SEQ ID NO: 153054 - DNA, 35 bp, Artificial Sequence
  Synthetic oligonucleotide
caattggggaagggtgggcggggagaccgtgagca

SEQ ID NO: 153055 - DNA, 36 bp, Artificial Sequence
  Synthetic oligonucleotide
aactgtccgtctgccttatccattgactctgcctca

SEQ ID NO: 153056 - DNA, 37 bp, Artificial Sequence
  Synthetic oligonucleotide
tccgcggactggagaaggaggggggctgacgaaaaga

SEQ ID NO: 153057 - DNA, 37 bp, Artificial Sequence
  Synthetic oligonucleotide
gtaagtggagggggtagggagtggaatgagcgacaga

SEQ ID NO: 153058 - DNA, 37 bp, Artificial Sequence
  Synthetic oligonucleotide
aagggggagagaggggagtggggtgtagccaagcaga

SEQ ID NO: 153059 - DNA, 37 bp, Artificial Sequence
  Synthetic oligonucleotide
agccctccgccgccctctagtctccctcctcagcaga

SEQ ID NO: 153060 - DNA, 36 bp, Artificial Sequence
  Synthetic oligonucleotide
gcacccgccgaattttttaccccagcctacgcgaga

SEQ ID NO: 153061 - DNA, 36 bp, Artificial Sequence
  Synthetic oligonucleotide
gcgggaaggccggccggaagcaggaaaggaaggaga

SEQ ID NO: 153062 - DNA, 36 bp, Artificial Sequence
  Synthetic oligonucleotide
gcagggggagggcgaggaggggggctgtgtaggaga

SEQ ID NO: 153063 - DNA, 36 bp, Artificial Sequence
  Synthetic oligonucleotide
tccacgtcgcccgtgcccgcccctcaggtcgataga

SEQ ID NO: 153064 - DNA, 36 bp, Artificial Sequence
  Synthetic oligonucleotide
gttcccatcacgactggttcgtcccttccctgtaga

SEQ ID NO: 153065 - DNA, 35 bp, Artificial Sequence
  Synthetic oligonucleotide
gcaccatctcggctccctcacaacataggcaccga

SEQ ID NO: 153066 - DNA, 37 bp, Artificial Sequence
  Synthetic oligonucleotide
agcacggaggtggcggggatggatgggtggaatccga

SEQ ID NO: 153067 - DNA, 37 bp, Artificial Sequence
  Synthetic oligonucleotide
acacatcagggtggggagggacaattgggttaacgga

SEQ ID NO: 153068 - DNA, 37 bp, Artificial Sequence
  Synthetic oligonucleotide
ttctcctccgccccgattccactgctcctctctggga

SEQ ID NO: 153069 - DNA, 38 bp, Artificial Sequence
  Synthetic oligonucleotide
acacccaccacgccactcaaccctcgccgtccgcctga

SEQ ID NO: 153070 - DNA, 38 bp, Artificial Sequence
  Synthetic oligonucleotide
gtgaactgcaggctgggaggaggaaggggcgcatctga

SEQ ID NO: 153071 - DNA, 37 bp, Artificial Sequence
  Synthetic oligonucleotide
gactggggaggaggtgggaaaaactggacatgagtga

SEQ ID NO: 153072 - DNA, 36 bp, Artificial Sequence
  Synthetic oligonucleotide
gtcgcacgacgcttcctccgaccccatattccgtga

SEQ ID NO: 153073 - DNA, 38 bp, Artificial Sequence
  Synthetic oligonucleotide
agactgggagggagggaagttcaagggacaaccgttga

SEQ ID NO: 153074 - DNA, 38 bp, Artificial Sequence
  Synthetic oligonucleotide
ttgcccctcaccggcctaagacgctatccccattttga

SEQ ID NO: 153075 - DNA, 36 bp, Artificial Sequence
  Synthetic oligonucleotide
acgcctccccccgccgtgctctttattatctgtata

SEQ ID NO: 153076 - DNA, 36 bp, Artificial Sequence
  Synthetic oligonucleotide
tcaccatgaccgctttctgttcgtttctatcgccta

SEQ ID NO: 153077 - DNA, 36 bp, Artificial Sequence
  Synthetic oligonucleotide
gtctcacctctcgttttgtccgatcatgcattccta

SEQ ID NO: 153078 - DNA, 36 bp, Artificial Sequence
  Synthetic oligonucleotide
gaacgtgcggtggaggagaggtagatagggagggta

SEQ ID NO: 153079 - DNA, 36 bp, Artificial Sequence
  Synthetic oligonucleotide
gttaccccgcggtgctattccgttctcattcctgta

SEQ ID NO: 153080 - DNA, 36 bp, Artificial Sequence
  Synthetic oligonucleotide
acaaccatgacagccgccgcaccctaccccattgta

SEQ ID NO: 153081 - DNA, 35 bp, Artificial Sequence
  Synthetic oligonucleotide
gtccgctcactctgctaaattgtcgtcttcatcac

SEQ ID NO: 153082 - DNA, 34 bp, Artificial Sequence
  Synthetic oligonucleotide
gcccatctcgccccctggacttttgcttacatac

SEQ ID NO: 153083 - DNA, 35 bp, Artificial Sequence
  Synthetic oligonucleotide
ttagtggtagcccctgtcgttatccccccacctac

SEQ ID NO: 153084 - DNA, 35 bp, Artificial Sequence
  Synthetic oligonucleotide
tacgccccaatgttcctgtcttcgctgtttccacc

SEQ ID NO: 153085 - DNA, 35 bp, Artificial Sequence
  Synthetic oligonucleotide
tctgtccaatccctttgtgctcttgactatgtccc

SEQ ID NO: 153086 - DNA, 35 bp, Artificial Sequence
  Synthetic oligonucleotide
tcatccacgtggctggttccctttctttctaggcc

SEQ ID NO: 153087 - DNA, 35 bp, Artificial Sequence
  Synthetic oligonucleotide
tccatgacccagccatgttccgcagtttgtgctcc

SEQ ID NO: 153088 - DNA, 35 bp, Artificial Sequence
  Synthetic oligonucleotide
gccggtggtgcttttgtcttaattctccgctgtcc

SEQ ID NO: 153089 - DNA, 35 bp, Artificial Sequence
  Synthetic oligonucleotide
aaggcattgccctgtcgttttcgcctgtccattcc

SEQ ID NO: 153090 - DNA, 35 bp, Artificial Sequence
  Synthetic oligonucleotide
tatgtgccggcccgacgcagaccacgcctgtttcc

SEQ ID NO: 153091 - DNA, 35 bp, Artificial Sequence
  Synthetic oligonucleotide
gtcctcctccacagctgactcttagagttgcccgc

SEQ ID NO: 153092 - DNA, 35 bp, Artificial Sequence
  Synthetic oligonucleotide
cccctcaccgatcccctgcccttccgaccgctggc

SEQ ID NO: 153093 - DNA, 35 bp, Artificial Sequence
  Synthetic oligonucleotide
aaccaacgcacaattattcttgccacagttactgc

SEQ ID NO: 153094 - DNA, 35 bp, Artificial Sequence
  Synthetic oligonucleotide
gccagacgcctccatgccatcttgtcccgctcatc

SEQ ID NO: 153095 - DNA, 35 bp, Artificial Sequence
  Synthetic oligonucleotide
tgccgtatgccccaagtttcttcgtttctgtcatc

SEQ ID NO: 153096 - DNA, 35 bp, Artificial Sequence
  Synthetic oligonucleotide
atgccgcggttggcataccacatcgttccaccgtc

SEQ ID NO: 153097 - DNA, 35 bp, Artificial Sequence
  Synthetic oligonucleotide
gcacggacgttctttcataggtcacctgtttcttc

SEQ ID NO: 153098 - DNA, 35 bp, Artificial Sequence
  Synthetic oligonucleotide
gcttactgccccccacacgatgcatatttttgttc

SEQ ID NO: 153099 - DNA, 35 bp, Artificial Sequence
  Synthetic oligonucleotide
tcagacctccatcccgcttggacaaatacacaccg

SEQ ID NO: 153100 - DNA, 35 bp, Artificial Sequence
  Synthetic oligonucleotide
atagactgccgcctggcctacctgtgttctccccg

SEQ ID NO: 153101 - DNA, 35 bp, Artificial Sequence
  Synthetic oligonucleotide
ttgaagccgcaacactattgatccaccactcgccg

SEQ ID NO: 153102 - DNA, 35 bp, Artificial Sequence
  Synthetic oligonucleotide
ttgcccatctcgttttctttagaacccccgtgccg

SEQ ID NO: 153103 - DNA, 34 bp, Artificial Sequence
  Synthetic oligonucleotide
gggtggcggggggttttgcggatggcacatcgcg

SEQ ID NO: 153104 - DNA, 35 bp, Artificial Sequence
  Synthetic oligonucleotide
gtgtagctgggcgggatggggggaagggctatgcg

SEQ ID NO: 153105 - DNA, 35 bp, Artificial Sequence
  Synthetic oligonucleotide
gccaacggcattgcctgcgattctatcttccctcg

SEQ ID NO: 153106 - DNA, 35 bp, Artificial Sequence
  Synthetic oligonucleotide
aagtgcgcctgttctcgtagctggtccatctctcg

SEQ ID NO: 153107 - DNA, 35 bp, Artificial Sequence
  Synthetic oligonucleotide
gctccgccagcatcgctcttcatatcgctccccgg

SEQ ID NO: 153108 - DNA, 35 bp, Artificial Sequence
  Synthetic oligonucleotide
ggctcatcgcccgccactgccaccactgttcctat

SEQ ID NO: 153109 - DNA, 35 bp, Artificial Sequence
  Synthetic oligonucleotide
gcaacctccgggtgccgtgccattttcccttccct

SEQ ID NO: 153110 - DNA, 35 bp, Artificial Sequence
  Synthetic oligonucleotide
gcacatgacagcagattgctctactcacccccgct

SEQ ID NO: 153111 - DNA, 35 bp, Artificial Sequence
  Synthetic oligonucleotide
gtgcaatcgccgcattttaccccgcagttttttct

SEQ ID NO: 153112 - DNA, 35 bp, Artificial Sequence
  Synthetic oligonucleotide
gctggccttccccgcgctaagtcttgcctttcctt

SEQ ID NO: 153113 - DNA, 35 bp, Artificial Sequence
  Synthetic oligonucleotide
acccccgctggttcggtcctgccactagttttctt

SEQ ID NO: 153114 - DNA, 36 bp, Artificial Sequence
  Synthetic oligonucleotide
tatcacactcggtgtgcattcaatctatcctcccaa

SEQ ID NO: 153115 - DNA, 36 bp, Artificial Sequence
  Synthetic oligonucleotide
atcctcgcccgagtactacttaataccgttcctcaa

SEQ ID NO: 153116 - DNA, 35 bp, Artificial Sequence
  Synthetic oligonucleotide
actcacgcgctcggatactacacccttctcgctaa

SEQ ID NO: 153117 - DNA, 35 bp, Artificial Sequence
  Synthetic oligonucleotide
ttgacccgcctcctgtctgctaacgcctccttaca

SEQ ID NO: 153118 - DNA, 36 bp, Artificial Sequence
  Synthetic oligonucleotide
tccagctgacagccctgcctttcttccgtatcgcca

SEQ ID NO: 153119 - DNA, 35 bp, Artificial Sequence
  Synthetic oligonucleotide
ggtgccccaccccctgagtagaattgcccctatca

SEQ ID NO: 153120 - DNA, 36 bp, Artificial Sequence
  Synthetic oligonucleotide
aatccgcactcattatttatacgcacctcgccctca

SEQ ID NO: 153121 - DNA, 37 bp, Artificial Sequence
  Synthetic oligonucleotide
gagtgggggagggaggccggggtgaaaagggcagaga

SEQ ID NO: 153122 - DNA, 37 bp, Artificial Sequence
  Synthetic oligonucleotide
ttttgccccccgccccgccccgcctagtgtatcacga

SEQ ID NO: 153123 - DNA, 36 bp, Artificial Sequence
  Synthetic oligonucleotide
tgtccactcccatcctgggttttgacctctctacga

SEQ ID NO: 153124 - DNA, 35 bp, Artificial Sequence
  Synthetic oligonucleotide
agtccatcgccgtccccagcccaagcccctcccga

SEQ ID NO: 153125 - DNA, 37 bp, Artificial Sequence
  Synthetic oligonucleotide
tccgttccgccctttctccgtacaggagagtaatcga

SEQ ID NO: 153126 - DNA, 37 bp, Artificial Sequence
  Synthetic oligonucleotide
caccgccgacttcagccctgcgccctgttcctgagga

SEQ ID NO: 153127 - DNA, 37 bp, Artificial Sequence
  Synthetic oligonucleotide
gggggggaagggcggtaactgaagaagttacaaggga

SEQ ID NO: 153128 - DNA, 37 bp, Artificial Sequence
  Synthetic oligonucleotide
tcacccctcacctcccgataatgctatccctaaggga

SEQ ID NO: 153129 - DNA, 38 bp, Artificial Sequence
  Synthetic oligonucleotide
gcaccggggaaaagattgcggcggggacactctgggga

SEQ ID NO: 153130 - DNA, 37 bp, Artificial Sequence
  Synthetic oligonucleotide
gggggatcgggaagggcaaggtgggggagttctggga

SEQ ID NO: 153131 - DNA, 37 bp, Artificial Sequence
  Synthetic oligonucleotide
gcttgtgggaggcggctggggcgtggtggtcgtggga

SEQ ID NO: 153132 - DNA, 37 bp, Artificial Sequence
  Synthetic oligonucleotide
aacccgtctgcctgctttcatcaacttcccgcttgga

SEQ ID NO: 153133 - DNA, 37 bp, Artificial Sequence
  Synthetic oligonucleotide
gcccccacccctgtgcgctccttgactggccatctga

SEQ ID NO: 153134 - DNA, 37 bp, Artificial Sequence
  Synthetic oligonucleotide
gagctgagtacgggggttgggcggggtgaaagagtga

SEQ ID NO: 153135 - DNA, 38 bp, Artificial Sequence
  Synthetic oligonucleotide
tgacttccccctgcctaattattgcgcccactacgtga

SEQ ID NO: 153136 - DNA, 38 bp, Artificial Sequence
  Synthetic oligonucleotide
ttagggtggggatagaggggagcgagaggggtcattga

SEQ ID NO: 153137 - DNA, 37 bp, Artificial Sequence
  Synthetic oligonucleotide
gtgcccctcattttgtaccgcttcctggcctatttga

SEQ ID NO: 153138 - DNA, 36 bp, Artificial Sequence
  Synthetic oligonucleotide
gcctcatgccgtctccactcgtcactgctgcaccta

SEQ ID NO: 153139 - DNA, 36 bp, Artificial Sequence
  Synthetic oligonucleotide
agccgcggtccatctgctattaggcctccccctgta

SEQ ID NO: 153140 - DNA, 35 bp, Artificial Sequence
  Synthetic oligonucleotide
tcagggtgttatccccgccgcggtcttattcgtta

SEQ ID NO: 153141 - DNA, 35 bp, Artificial Sequence
  Synthetic oligonucleotide
tccgacgggtcccgctctagctatattcccatcac

SEQ ID NO: 153142 - DNA, 35 bp, Artificial Sequence
  Synthetic oligonucleotide
tgcgcgacagcccttacatggccctcctccttcac

SEQ ID NO: 153143 - DNA, 35 bp, Artificial Sequence
  Synthetic oligonucleotide
agcgtacccgcctacgtcctccttccgtctgggac

SEQ ID NO: 153144 - DNA, 35 bp, Artificial Sequence
  Synthetic oligonucleotide
actagcactccgcgaacacatctacaccgccgacc

SEQ ID NO: 153145 - DNA, 35 bp, Artificial Sequence
  Synthetic oligonucleotide
attgcgccgcggttatcaccgaccctgctgccccc

SEQ ID NO: 153146 - DNA, 35 bp, Artificial Sequence
  Synthetic oligonucleotide
tgagccacgccctcccgccgagtttcgtccccgcc

SEQ ID NO: 153147 - DNA, 35 bp, Artificial Sequence
  Synthetic oligonucleotide
gtcctccgccagcacggtcctcttccccttgcgcc

SEQ ID NO: 153148 - DNA, 35 bp, Artificial Sequence
  Synthetic oligonucleotide
tgcgtgcactgttgtccgtgtccctcattcatgcc

SEQ ID NO: 153149 - DNA, 35 bp, Artificial Sequence
  Synthetic oligonucleotide
ggtcatctccctagccgcctgagcaccctctccgc

SEQ ID NO: 153150 - DNA, 35 bp, Artificial Sequence
  Synthetic oligonucleotide
tcagtacggtcctcgcccacgtcctccgacgctgc

SEQ ID NO: 153151 - DNA, 35 bp, Artificial Sequence
  Synthetic oligonucleotide
tcactgcgttggcacacgcttcatcgaatcccctc

SEQ ID NO: 153152 - DNA, 35 bp, Artificial Sequence
  Synthetic oligonucleotide
tggtcctccctccctgaccatgttcttgtaagctc

SEQ ID NO: 153153 - DNA, 35 bp, Artificial Sequence
  Synthetic oligonucleotide
tgggtcggcttcttagtttctgctgcctctttgtc

SEQ ID NO: 153154 - DNA, 35 bp, Artificial Sequence
  Synthetic oligonucleotide
tcaatccacctcctccacccgactgcccgttaacg

SEQ ID NO: 153155 - DNA, 35 bp, Artificial Sequence
  Synthetic oligonucleotide
tcacactgataccgatacttgccccaccgtacacg

SEQ ID NO: 153156 - DNA, 35 bp, Artificial Sequence
  Synthetic oligonucleotide
aaagagacgcgggagggaagtagggtgccgaatgg

SEQ ID NO: 153157 - DNA, 35 bp, Artificial Sequence
  Synthetic oligonucleotide
gtgtccgcgactatcccgcctcgtttcctgctatg

SEQ ID NO: 153158 - DNA, 35 bp, Artificial Sequence
  Synthetic oligonucleotide
gaacggtctcatctgcaccacgcatactccctctg

SEQ ID NO: 153159 - DNA, 35 bp, Artificial Sequence
  Synthetic oligonucleotide
tgagaccttgtcctgcctcgacgccccccctcaat

SEQ ID NO: 153160 - DNA, 35 bp, Artificial Sequence
  Synthetic oligonucleotide
atgaatcgaaccaacgcgtatgccttccactccat

SEQ ID NO: 153161 - DNA, 35 bp, Artificial Sequence
  Synthetic oligonucleotide
atgcgctgttggttcccgttcctttgtcttctcat

SEQ ID NO: 153162 - DNA, 35 bp, Artificial Sequence
  Synthetic oligonucleotide
tcaacgtcatggatcggctaggcccactgtccctt

SEQ ID NO: 153163 - DNA, 35 bp, Artificial Sequence
  Synthetic oligonucleotide
acctacacgtgcctacaccacacctccctccggtt

SEQ ID NO: 153164 - DNA, 35 bp, Artificial Sequence
  Synthetic oligonucleotide
gtcggaagatgctgctgttgcaccgtccttccttt

SEQ ID NO: 153165 - DNA, 36 bp, Artificial Sequence
  Synthetic oligonucleotide
gttagaggtgaggggtactagggaagaggggagaaa

SEQ ID NO: 153166 - DNA, 36 bp, Artificial Sequence
  Synthetic oligonucleotide
gtgatacgtaaatagggggcggaggaagacagttaa

SEQ ID NO: 153167 - DNA, 36 bp, Artificial Sequence
  Synthetic oligonucleotide
acctcacgctggtagctgttctctcgtttccctaca

SEQ ID NO: 153168 - DNA, 36 bp, Artificial Sequence
  Synthetic oligonucleotide
tagattgcccgcctgtttctatcccatctccgtaca

SEQ ID NO: 153169 - DNA, 36 bp, Artificial Sequence
  Synthetic oligonucleotide
ttacccgccggcgctcccctgccttctcactaccca

SEQ ID NO: 153170 - DNA, 35 bp, Artificial Sequence
  Synthetic oligonucleotide
tcaaccgccggcaagtgcgtacgtctataccccca

SEQ ID NO: 153171 - DNA, 36 bp, Artificial Sequence
  Synthetic oligonucleotide
ttacggcaccatccattccctgtcaccgcgcctcca

SEQ ID NO: 153172 - DNA, 36 bp, Artificial Sequence
  Synthetic oligonucleotide
gacccatctacaggtagttgtgccttccctcctcca

SEQ ID NO: 153173 - DNA, 36 bp, Artificial Sequence
  Synthetic oligonucleotide
gttgagtcgccgcccgttcagtctccatcgattcca

SEQ ID NO: 153174 - DNA, 36 bp, Artificial Sequence
  Synthetic oligonucleotide
agtgctcgaacagcggaggcaaggggggtggacgca

SEQ ID NO: 153175 - DNA, 36 bp, Artificial Sequence
  Synthetic oligonucleotide
atagttcgccccccctgatattggccctcgtaatca

SEQ ID NO: 153176 - DNA, 35 bp, Artificial Sequence
  Synthetic oligonucleotide
tccgttcgccccctatctcccggtgtgtagcctca

SEQ ID NO: 153177 - DNA, 36 bp, Artificial Sequence
  Synthetic oligonucleotide
aaatcgacgggcaagggggcgggaaagaggaattca

SEQ ID NO: 153178 - DNA, 36 bp, Artificial Sequence
  Synthetic oligonucleotide
tcactccacccgtcctgttggtcttgaatggtttca

SEQ ID NO: 153179 - DNA, 37 bp, Artificial Sequence
  Synthetic oligonucleotide
gtccgcgacatcctgcatccgttcccactccctacga

SEQ ID NO: 153180 - DNA, 37 bp, Artificial Sequence
  Synthetic oligonucleotide
gcacccctgccctactcttcaccgatatgtttatcga

SEQ ID NO: 153181 - DNA, 37 bp, Artificial Sequence
  Synthetic oligonucleotide
accgcacgcctcattttccccccggttggtctctcga

SEQ ID NO: 153182 - DNA, 37 bp, Artificial Sequence
  Synthetic oligonucleotide
gagttggagcgaatggcggctagggttgggggaagga

SEQ ID NO: 153183 - DNA, 37 bp, Artificial Sequence
  Synthetic oligonucleotide
tagccccaacactgccccaccatgctccccagcagga

SEQ ID NO: 153184 - DNA, 37 bp, Artificial Sequence
  Synthetic oligonucleotide
gtggtaggaggacagggggggagatgaaaacgatgga

SEQ ID NO: 153185 - DNA, 37 bp, Artificial Sequence
  Synthetic oligonucleotide
tagcggaagtaaggggggtgggggatgcgacggtgga

SEQ ID NO: 153186 - DNA, 38 bp, Artificial Sequence
  Synthetic oligonucleotide
tggggtaagaggcggaagggccaggggtggtgtgatga

SEQ ID NO: 153187 - DNA, 37 bp, Artificial Sequence
  Synthetic oligonucleotide
tgaactgcccctcgtttaccgcgctctccgttcctga

SEQ ID NO: 153188 - DNA, 37 bp, Artificial Sequence
  Synthetic oligonucleotide
gcgggccgcctagcccgtctccagttcctcctgctga

SEQ ID NO: 153189 - DNA, 37 bp, Artificial Sequence
  Synthetic oligonucleotide
atgcgcggcggagcggtaaggggggctgggggagtga

SEQ ID NO: 153190 - DNA, 38 bp, Artificial Sequence
  Synthetic oligonucleotide
gcgaccacccctgagcactcccccccattgagacgtga

SEQ ID NO: 153191 - DNA, 35 bp, Artificial Sequence
  Synthetic oligonucleotide
actgcgttgctgccccttatcgtgatccttcttga

SEQ ID NO: 153192 - DNA, 37 bp, Artificial Sequence
  Synthetic oligonucleotide
gtccatggtgatccgttccaagccgcccccctgttga

SEQ ID NO: 153193 - DNA, 34 bp, Artificial Sequence
  Synthetic oligonucleotide
tgttcacttgccattgtctttcacctgattcata

SEQ ID NO: 153194 - DNA, 35 bp, Artificial Sequence
  Synthetic oligonucleotide
tggagggggcggggaaaaagggatcggtcggcgta

SEQ ID NO: 153195 - DNA, 37 bp, Artificial Sequence
  Synthetic oligonucleotide
gtgccctgactgacttttgttgccgttccactcgtta

SEQ ID NO: 153196 - DNA, 35 bp, Artificial Sequence
  Synthetic oligonucleotide
ggttcgtcgccccgtgctatccggctctctcaacc

SEQ ID NO: 153197 - DNA, 35 bp, Artificial Sequence
  Synthetic oligonucleotide
gaagcaaacctcccgttatgtacattcccttcacc

SEQ ID NO: 153198 - DNA, 35 bp, Artificial Sequence
  Synthetic oligonucleotide
atcttccctgcccggttcgtaatcgagctttcacc

SEQ ID NO: 153199 - DNA, 35 bp, Artificial Sequence
  Synthetic oligonucleotide
tgcccgagccgtgtcccaagcctcggttcccgccc

SEQ ID NO: 153200 - DNA, 35 bp, Artificial Sequence
  Synthetic oligonucleotide
accctcccttacgtgctggccacttctttggtccc

SEQ ID NO: 153201 - DNA, 35 bp, Artificial Sequence
  Synthetic oligonucleotide
tttaccgctcgctctgcatttagtctccctgcgcc

SEQ ID NO: 153202 - DNA, 35 bp, Artificial Sequence
  Synthetic oligonucleotide
taatcgcgtccgaaccactccactcgccgatcgcc

SEQ ID NO: 153203 - DNA, 35 bp, Artificial Sequence
  Synthetic oligonucleotide
tgtaccttcctcgtgaacctttgttacagctatcc

SEQ ID NO: 153204 - DNA, 35 bp, Artificial Sequence
  Synthetic oligonucleotide
gctccaccgtagtccgccactactccgcgtgctcc

SEQ ID NO: 153205 - DNA, 35 bp, Artificial Sequence
  Synthetic oligonucleotide
tcatccccacacatccaggtctctcatcccggtcc

SEQ ID NO: 153206 - DNA, 35 bp, Artificial Sequence
  Synthetic oligonucleotide
gtacccatgcgcgcccgctcaacctctttctgtcc

SEQ ID NO: 153207 - DNA, 35 bp, Artificial Sequence
  Synthetic oligonucleotide
tgccccccccttgcctcagacgtcgtcgaccacgc

SEQ ID NO: 153208 - DNA, 35 bp, Artificial Sequence
  Synthetic oligonucleotide
gtaacacggtcaggagtgccgtgcccttctctcgc

SEQ ID NO: 153209 - DNA, 35 bp, Artificial Sequence
  Synthetic oligonucleotide
tccgaatgtcccaccctgcgtgccctcgtgcttgc

SEQ ID NO: 153210 - DNA, 35 bp, Artificial Sequence
  Synthetic oligonucleotide
tctcctagcaggtccatatcgcgtcattacccctc

SEQ ID NO: 153211 - DNA, 35 bp, Artificial Sequence
  Synthetic oligonucleotide
gcgaacgccccgccgttgtgtaggctacctccctc

SEQ ID NO: 153212 - DNA, 35 bp, Artificial Sequence
  Synthetic oligonucleotide
agcctagccgcgaggtttatgtcggccttctcctc

SEQ ID NO: 153213 - DNA, 35 bp, Artificial Sequence
  Synthetic oligonucleotide
gctgcgcgcgtttccgtgactttatgcgccctctc

SEQ ID NO: 153214 - DNA, 35 bp, Artificial Sequence
  Synthetic oligonucleotide
ggtataatgacaggggcgggtaggggacgggacag

SEQ ID NO: 153215 - DNA, 35 bp, Artificial Sequence
  Synthetic oligonucleotide
cacgccgaccttccctagtcaactgccttcacccg

SEQ ID NO: 153216 - DNA, 35 bp, Artificial Sequence
  Synthetic oligonucleotide
atacgggaaaggagtggaggaggtgggttagagcg

SEQ ID NO: 153217 - DNA, 35 bp, Artificial Sequence
  Synthetic oligonucleotide
gtcacccctccgcactgtcatgtgacagatcctcg

SEQ ID NO: 153218 - DNA, 33 bp, Artificial Sequence
  Synthetic oligonucleotide
gggccgtgcccgtctcttatatatgtcctgtcg

SEQ ID NO: 153219 - DNA, 35 bp, Artificial Sequence
  Synthetic oligonucleotide
tagagttgaggaggagaggctaaaataagggcggg

SEQ ID NO: 153220 - DNA, 38 bp, Artificial Sequence
  Synthetic oligonucleotide
tgagggcggagggaggggggtggatttggacggtatgg

SEQ ID NO: 153221 - DNA, 35 bp, Artificial Sequence
  Synthetic oligonucleotide
gccgatccctgagttcctactgtctcttttacctg

SEQ ID NO: 153222 - DNA, 35 bp, Artificial Sequence
  Synthetic oligonucleotide
gtcgtccgcaccgcctgttctttcactcgtcattg

SEQ ID NO: 153223 - DNA, 35 bp, Artificial Sequence
  Synthetic oligonucleotide
tctagccgtccccgctcaagttgaagtctcccact

SEQ ID NO: 153224 - DNA, 35 bp, Artificial Sequence
  Synthetic oligonucleotide
tgaggacccccatctgttattctcgccgcctgact

SEQ ID NO: 153225 - DNA, 35 bp, Artificial Sequence
  Synthetic oligonucleotide
gtcttacccgccttacctgatctggtcgaattcct

SEQ ID NO: 153226 - DNA, 35 bp, Artificial Sequence
  Synthetic oligonucleotide
gcgaacgccactaatctgttgtctcctccatctct

SEQ ID NO: 153227 - DNA, 35 bp, Artificial Sequence
  Synthetic oligonucleotide
gccccctgcccagccatttatgggccacaccttct

SEQ ID NO: 153228 - DNA, 35 bp, Artificial Sequence
  Synthetic oligonucleotide
tccagactctccccgccatggactcacctacttgt

SEQ ID NO: 153229 - DNA, 35 bp, Artificial Sequence
  Synthetic oligonucleotide
gggtcaggtgtcgccctgcaccatcgctctccatt

SEQ ID NO: 153230 - DNA, 35 bp, Artificial Sequence
  Synthetic oligonucleotide
gcccgctcccctttttagtgccataccgtgtcatt

SEQ ID NO: 153231 - DNA, 35 bp, Artificial Sequence
  Synthetic oligonucleotide
tgaatcgcgtgacttcttgcgtccccgttgccctt

SEQ ID NO: 153232 - DNA, 35 bp, Artificial Sequence
  Synthetic oligonucleotide
gctctcacgcttgtactttatgtcccctgtccctt

SEQ ID NO: 153233 - DNA, 35 bp, Artificial Sequence
  Synthetic oligonucleotide
tgtgctcgcccagcctccttctcactactcggttt

SEQ ID NO: 153234 - DNA, 35 bp, Artificial Sequence
  Synthetic oligonucleotide
gatcgatcgccactgcctttctcccccgaatacaa

SEQ ID NO: 153235 - DNA, 36 bp, Artificial Sequence
  Synthetic oligonucleotide
gatcagcctcccattctatccggagcggccctctaa

SEQ ID NO: 153236 - DNA, 35 bp, Artificial Sequence
  Synthetic oligonucleotide
agccgacctccctagcttttctataactgcccaca

SEQ ID NO: 153237 - DNA, 36 bp, Artificial Sequence
  Synthetic oligonucleotide
gtcccgccgctgcacaccgtctactttcctgcgaca

SEQ ID NO: 153238 - DNA, 36 bp, Artificial Sequence
  Synthetic oligonucleotide
tcccaagtcctgttctgctccatcgcgcctatacca

SEQ ID NO: 153239 - DNA, 36 bp, Artificial Sequence
  Synthetic oligonucleotide
tccgtcgttcaccctagtgctcctctcctcgtgcca

SEQ ID NO: 153240 - DNA, 36 bp, Artificial Sequence
  Synthetic oligonucleotide
gtcgacacagtcgttttttccgtacggtctatctca

SEQ ID NO: 153241 - DNA, 37 bp, Artificial Sequence
  Synthetic oligonucleotide
ggggacgggagggtatagaaggggacccggaggcaga

SEQ ID NO: 153242 - DNA, 36 bp, Artificial Sequence
  Synthetic oligonucleotide
atacgcgccgggagggtggaagggggcaaggcacga

SEQ ID NO: 153243 - DNA, 37 bp, Artificial Sequence
  Synthetic oligonucleotide
tgtcctaccctccgaccggttaacacacctagcccga

SEQ ID NO: 153244 - DNA, 35 bp, Artificial Sequence
  Synthetic oligonucleotide
aatttgcgcccgtatcgtactccgcacccttccga

SEQ ID NO: 153245 - DNA, 36 bp, Artificial Sequence
  Synthetic oligonucleotide
aacgtggggacgggcgccgggggggaggaatacgga

SEQ ID NO: 153246 - DNA, 35 bp, Artificial Sequence
  Synthetic oligonucleotide
tcaagacccagcctcccctccgtcgtccttccgga

SEQ ID NO: 153247 - DNA, 37 bp, Artificial Sequence
  Synthetic oligonucleotide
ggggcctcgacgagggtggggtattctgccaagggga

SEQ ID NO: 153248 - DNA, 37 bp, Artificial Sequence
  Synthetic oligonucleotide
gcctgctccacccttctcgcacagtctcagatctgga

SEQ ID NO: 153249 - DNA, 38 bp, Artificial Sequence
  Synthetic oligonucleotide
tcctgccacctcactcctgccacgaggactgcccatga

SEQ ID NO: 153250 - DNA, 35 bp, Artificial Sequence
  Synthetic oligonucleotide
gacatgccgcaccatgcccatcgattcctccctga

SEQ ID NO: 153251 - DNA, 38 bp, Artificial Sequence
  Synthetic oligonucleotide
gccgacaccgccaacgaatattccttcccactgcctga

SEQ ID NO: 153252 - DNA, 38 bp, Artificial Sequence
  Synthetic oligonucleotide
aacacctcggcatgcccccttccacccgcccacgctga

SEQ ID NO: 153253 - DNA, 36 bp, Artificial Sequence
  Synthetic oligonucleotide
ttcggaacccttctcccttgtctatgtactctctga

SEQ ID NO: 153254 - DNA, 35 bp, Artificial Sequence
  Synthetic oligonucleotide
accatcctcatttccccaccggacgttccttctga

SEQ ID NO: 153255 - DNA, 38 bp, Artificial Sequence
  Synthetic oligonucleotide
gtgcgcatggaaaaggtagaacggagggtggagagtga

SEQ ID NO: 153256 - DNA, 38 bp, Artificial Sequence
  Synthetic oligonucleotide
agggtgagaggaaggtcggggggggcggtcgggagtga

SEQ ID NO: 153257 - DNA, 38 bp, Artificial Sequence
  Synthetic oligonucleotide
atcccctcccccgtccacgcttgagccttgagccttga

SEQ ID NO: 153258 - DNA, 38 bp, Artificial Sequence
  Synthetic oligonucleotide
tgcgccctccctgactcccagcaacccagccatcttga

SEQ ID NO: 153259 - DNA, 38 bp, Artificial Sequence
  Synthetic oligonucleotide
ggggggacgggaaaccatgggagcatagggaaagttga

SEQ ID NO: 153260 - DNA, 37 bp, Artificial Sequence
  Synthetic oligonucleotide
gtcacacacctgctgttaatacccatatttcctttga

SEQ ID NO: 153261 - DNA, 35 bp, Artificial Sequence
  Synthetic oligonucleotide
atcccccctgccgaacaccccctgctcgagacgta

SEQ ID NO: 153262 - DNA, 35 bp, Artificial Sequence
  Synthetic oligonucleotide
gtgggaagagggggggaggtacaatggctcggtta

SEQ ID NO: 153263 - DNA, 35 bp, Artificial Sequence
  Synthetic oligonucleotide
tgcccctgccaccaaccgtacctatcgacgggtta

SEQ ID NO: 153264 - DNA, 35 bp, Artificial Sequence
  Synthetic oligonucleotide
tgccaccccgtccgtttctttgtagtacgctgcac

SEQ ID NO: 153265 - DNA, 35 bp, Artificial Sequence
  Synthetic oligonucleotide
tcacggctcgtgtgcaacacgtcatttcttctcac

SEQ ID NO: 153266 - DNA, 35 bp, Artificial Sequence
  Synthetic oligonucleotide
ttgtaccctccgttacctgtccggacagacttacc

SEQ ID NO: 153267 - DNA, 35 bp, Artificial Sequence
  Synthetic oligonucleotide
tcccgcccctcccctctcttaacttcgggagcccc

SEQ ID NO: 153268 - DNA, 35 bp, Artificial Sequence
  Synthetic oligonucleotide
gtgctgggtacaggcatctctccacccgcttgccc

SEQ ID NO: 153269 - DNA, 35 bp, Artificial Sequence
  Synthetic oligonucleotide
gctcactgcgtctctgccgcccccatgactaagcc

SEQ ID NO: 153270 - DNA, 35 bp, Artificial Sequence
  Synthetic oligonucleotide
tgtggccccctaactgttttctcgcccgtaccgcc

SEQ ID NO: 153271 - DNA, 35 bp, Artificial Sequence
  Synthetic oligonucleotide
agaccgtgccgttaagccccgttgcccagtcctcc

SEQ ID NO: 153272 - DNA, 35 bp, Artificial Sequence
  Synthetic oligonucleotide
tgctgactgtacctctctgtcactggattccccgc

SEQ ID NO: 153273 - DNA, 35 bp, Artificial Sequence
  Synthetic oligonucleotide
aagactccgaaccagctgctctccgcactctccgc

SEQ ID NO: 153274 - DNA, 35 bp, Artificial Sequence
  Synthetic oligonucleotide
gctgccgcgttctacctgtactccgcccctttcgc

SEQ ID NO: 153275 - DNA, 35 bp, Artificial Sequence
  Synthetic oligonucleotide
gccatcttctctgtcctgtttccactcgttggggc

SEQ ID NO: 153276 - DNA, 35 bp, Artificial Sequence
  Synthetic oligonucleotide
tgctgcccaccatcccgtttctgacccatgcatgc

SEQ ID NO: 153277 - DNA, 35 bp, Artificial Sequence
  Synthetic oligonucleotide
gactccatcttttctgttgtccttggtgcctttgc

SEQ ID NO: 153278 - DNA, 35 bp, Artificial Sequence
  Synthetic oligonucleotide
acacctcgggctctccgttttgagtacctgccatc

SEQ ID NO: 153279 - DNA, 35 bp, Artificial Sequence
  Synthetic oligonucleotide
tccttgcaggtcctgcacttttagcccccatactc

SEQ ID NO: 153280 - DNA, 35 bp, Artificial Sequence
  Synthetic oligonucleotide
acggtcaccccgcatagttaccatcgatcttgttc

SEQ ID NO: 153281 - DNA, 35 bp, Artificial Sequence
  Synthetic oligonucleotide
gcaccgccctccgcctcaaaagtcctttccgtttc

SEQ ID NO: 153282 - DNA, 35 bp, Artificial Sequence
  Synthetic oligonucleotide
taggagagggtagcggggggcagttcagcaagcag

SEQ ID NO: 153283 - DNA, 35 bp, Artificial Sequence
  Synthetic oligonucleotide
atcctccgtacctacgccgccgtacctctgtttag

SEQ ID NO: 153284 - DNA, 35 bp, Artificial Sequence
  Synthetic oligonucleotide
ttactccccgcgcccccttaccgtaccttcctacg

SEQ ID NO: 153285 - DNA, 35 bp, Artificial Sequence
  Synthetic oligonucleotide
acaacccgaccatcctcgaaccacgactgccccgg

SEQ ID NO: 153286 - DNA, 35 bp, Artificial Sequence
  Synthetic oligonucleotide
acccacgtttcatccttctgccaccccataacggg

SEQ ID NO: 153287 - DNA, 35 bp, Artificial Sequence
  Synthetic oligonucleotide
gccagggaagatccgctcccatcctgtttgacttg

SEQ ID NO: 153288 - DNA, 35 bp, Artificial Sequence
  Synthetic oligonucleotide
aactccgtcgatcctccgccttgcaactgattcct

SEQ ID NO: 153289 - DNA, 35 bp, Artificial Sequence
  Synthetic oligonucleotide
gtcccccttctcctgtgatgttgtcgcattattct

SEQ ID NO: 153290 - DNA, 35 bp, Artificial Sequence
  Synthetic oligonucleotide
gatcgtccttccgtgttgtcgccggcctaatttct

SEQ ID NO: 153291 - DNA, 35 bp, Artificial Sequence
  Synthetic oligonucleotide
tcccccctcgccacctgagccccccgcttttcggt

SEQ ID NO: 153292 - DNA, 35 bp, Artificial Sequence
  Synthetic oligonucleotide
ggtcggtgacgggttgggcaggggcgggcacgggt

SEQ ID NO: 153293 - DNA, 35 bp, Artificial Sequence
  Synthetic oligonucleotide
accactctcacggtttgatatctcgctcaccatgt

SEQ ID NO: 153294 - DNA, 35 bp, Artificial Sequence
  Synthetic oligonucleotide
tcatcacctactcgagttcacgtaaacactcctgt

SEQ ID NO: 153295 - DNA, 35 bp, Artificial Sequence
  Synthetic oligonucleotide
tcatgaaagggcgggggtggtggggacgccgcatt

SEQ ID NO: 153296 - DNA, 35 bp, Artificial Sequence
  Synthetic oligonucleotide
ataccattcgctccactgtttcgttattcatcctt

SEQ ID NO: 153297 - DNA, 35 bp, Artificial Sequence
  Synthetic oligonucleotide
aagccatgcagcctttgaatccgccatgcctcctt

SEQ ID NO: 153298 - DNA, 36 bp, Artificial Sequence
  Synthetic oligonucleotide
gaggaggaggacatcgaaagagacatgaggtgaaaa

SEQ ID NO: 153299 - DNA, 35 bp, Artificial Sequence
  Synthetic oligonucleotide
tccactccagttgggttcccgcccccgttagccaa

SEQ ID NO: 153300 - DNA, 35 bp, Artificial Sequence
  Synthetic oligonucleotide
ataaggaggagaaagggagcaaaagggaccgggaa

SEQ ID NO: 153301 - DNA, 35 bp, Artificial Sequence
  Synthetic oligonucleotide
tgctgccctcgtcgtcattatgtctgcccttctaa

SEQ ID NO: 153302 - DNA, 36 bp, Artificial Sequence
  Synthetic oligonucleotide
tgccgcagacctcctccctggcccgagtcgtaaaca

SEQ ID NO: 153303 - DNA, 36 bp, Artificial Sequence
  Synthetic oligonucleotide
ttccgtaggtcgaacgtttcagcacccctcctgcca

SEQ ID NO: 153304 - DNA, 35 bp, Artificial Sequence
  Synthetic oligonucleotide
gtttcccacatgtcctgtatcgcatccgcttgcca

SEQ ID NO: 153305 - DNA, 36 bp, Artificial Sequence
  Synthetic oligonucleotide
atcctgcgcactactcttgctcccatcagtgacgca

SEQ ID NO: 153306 - DNA, 35 bp, Artificial Sequence
  Synthetic oligonucleotide
tcaatggggcggggagcggggaaaatcgggattca

SEQ ID NO: 153307 - DNA, 35 bp, Artificial Sequence
  Synthetic oligonucleotide
gttcatcagccctggcatgcgcgacctacccttca

SEQ ID NO: 153308 - DNA, 36 bp, Artificial Sequence
  Synthetic oligonucleotide
tgtgacctcctccgtaataggcgcaattcttcttca

SEQ ID NO: 153309 - DNA, 37 bp, Artificial Sequence
  Synthetic oligonucleotide
gaggtaaagtgacggtggtgaaacaggggaagagaga

SEQ ID NO: 153310 - DNA, 37 bp, Artificial Sequence
  Synthetic oligonucleotide
ggatggaggagtgggtacggagcgatgatccagtaga

SEQ ID NO: 153311 - DNA, 37 bp, Artificial Sequence
  Synthetic oligonucleotide
gccccaacctgccgcttgtcgtctttgaccccttaga

SEQ ID NO: 153312 - DNA, 37 bp, Artificial Sequence
  Synthetic oligonucleotide
aagcctccaccagcatttcgccagcccccacgcccga

SEQ ID NO: 153313 - DNA, 36 bp, Artificial Sequence
  Synthetic oligonucleotide
gatgcaacacggtctataacacgcccatctatccga

SEQ ID NO: 153314 - DNA, 37 bp, Artificial Sequence
  Synthetic oligonucleotide
tcaaagggcatgggatgtaacgggggggagcttgcga

SEQ ID NO: 153315 - DNA, 37 bp, Artificial Sequence
  Synthetic oligonucleotide
tagccaacgccccgcgatacattagtcctgccatcga

SEQ ID NO: 153316 - DNA, 37 bp, Artificial Sequence
  Synthetic oligonucleotide
tgctccacactgcccatcccgcccttctatgaaagga

SEQ ID NO: 153317 - DNA, 37 bp, Artificial Sequence
  Synthetic oligonucleotide
atccacccgaccccgatccaccgttcgttcctacgga

SEQ ID NO: 153318 - DNA, 36 bp, Artificial Sequence
  Synthetic oligonucleotide
tcacgggtgggcgggctgtcggagcaacatcaggga

SEQ ID NO: 153319 - DNA, 37 bp, Artificial Sequence
  Synthetic oligonucleotide
taaacggaaatgaggtggggggcgcaatacggaggga

SEQ ID NO: 153320 - DNA, 37 bp, Artificial Sequence
  Synthetic oligonucleotide
tttggacaaaggagagtaaggagggcggtgaggggga

SEQ ID NO: 153321 - DNA, 37 bp, Artificial Sequence
  Synthetic oligonucleotide
tgagtgggtgggtgggtggtccgtcgatactggggga

SEQ ID NO: 153322 - DNA, 37 bp, Artificial Sequence
  Synthetic oligonucleotide
accccgtccctggcataactctctctgctcctgtgga

SEQ ID NO: 153323 - DNA, 35 bp, Artificial Sequence
  Synthetic oligonucleotide
gtcacaaagggagtcgggggatcggggagggatga

SEQ ID NO: 153324 - DNA, 38 bp, Artificial Sequence
  Synthetic oligonucleotide
gatgacgtggagggaatgcgggaggcgggaatcactga

SEQ ID NO: 153325 - DNA, 37 bp, Artificial Sequence
  Synthetic oligonucleotide
tacagggagtggtgcggggggtggagaggcttgctga

SEQ ID NO: 153326 - DNA, 37 bp, Artificial Sequence
  Synthetic oligonucleotide
gcatgggtaggtggggtagagagggtgcgggaggtga

SEQ ID NO: 153327 - DNA, 37 bp, Artificial Sequence
  Synthetic oligonucleotide
gaccccccctctcttgtgaagaatttgccctcggtga

SEQ ID NO: 153328 - DNA, 38 bp, Artificial Sequence
  Synthetic oligonucleotide
tagagcgagaggggagggggacggcacggatctattga

SEQ ID NO: 153329 - DNA, 38 bp, Artificial Sequence
  Synthetic oligonucleotide
tggatggcgactgtgatctcccgccgccgttcccttga

SEQ ID NO: 153330 - DNA, 36 bp, Artificial Sequence
  Synthetic oligonucleotide
tcctgccccacatataggttattcgctccagcttga

SEQ ID NO: 153331 - DNA, 37 bp, Artificial Sequence
  Synthetic oligonucleotide
tcgagcgcaccgatcgatcgctctcgtcctctcttga

SEQ ID NO: 153332 - DNA, 38 bp, Artificial Sequence
  Synthetic oligonucleotide
gttactgcgcaccctcttattactgctcgctcctttga

SEQ ID NO: 153333 - DNA, 36 bp, Artificial Sequence
  Synthetic oligonucleotide
ttcgcacgatcgcacattttgtccgccctcacgcta

SEQ ID NO: 153334 - DNA, 35 bp, Artificial Sequence
  Synthetic oligonucleotide
tagtaccgcccatttactgtgcactcacccctaac

SEQ ID NO: 153335 - DNA, 35 bp, Artificial Sequence
  Synthetic oligonucleotide
aacccccaccgtccacggagcttcacctcaaacac

SEQ ID NO: 153336 - DNA, 35 bp, Artificial Sequence
  Synthetic oligonucleotide
acccgtactgccttttcccggtgctaacaccccac

SEQ ID NO: 153337 - DNA, 35 bp, Artificial Sequence
  Synthetic oligonucleotide
tgacaccatccagcgagtcaccctgcagtcccgac

SEQ ID NO: 153338 - DNA, 35 bp, Artificial Sequence
  Synthetic oligonucleotide
gcctgccccgtcgccctggttatcctctgtcctac

SEQ ID NO: 153339 - DNA, 35 bp, Artificial Sequence
  Synthetic oligonucleotide
ttgtcctcccgctgtaactggatatttcgtacacc

SEQ ID NO: 153340 - DNA, 35 bp, Artificial Sequence
  Synthetic oligonucleotide
tccgtcccccgcacctgctgtaaggtccgttaccc

SEQ ID NO: 153341 - DNA, 35 bp, Artificial Sequence
  Synthetic oligonucleotide
tctgcgccctgccccactgactccttctggacccc

SEQ ID NO: 153342 - DNA, 35 bp, Artificial Sequence
  Synthetic oligonucleotide
aactgacttgtcccagcccccacgtgcctgccccc

SEQ ID NO: 153343 - DNA, 35 bp, Artificial Sequence
  Synthetic oligonucleotide
gaacagcggcccgccgcctgtaaccgtatgttccc

SEQ ID NO: 153344 - DNA, 35 bp, Artificial Sequence
  Synthetic oligonucleotide
tacagcgataggctcagctactttccccccggtcc

SEQ ID NO: 153345 - DNA, 35 bp, Artificial Sequence
  Synthetic oligonucleotide
aaccgccttcctccgttttttgccttacccggggc

SEQ ID NO: 153346 - DNA, 35 bp, Artificial Sequence
  Synthetic oligonucleotide
tgttcacccccttgcccacttgttactaccgtggc

SEQ ID NO: 153347 - DNA, 35 bp, Artificial Sequence
  Synthetic oligonucleotide
gacccgccacccatccatcgctattggccgtttgc

SEQ ID NO: 153348 - DNA, 35 bp, Artificial Sequence
  Synthetic oligonucleotide
gttgcgccgcctccattccgctatgctgcttttgc

SEQ ID NO: 153349 - DNA, 35 bp, Artificial Sequence
  Synthetic oligonucleotide
ttagttcatccactgggcccgccgttcgttccatc

SEQ ID NO: 153350 - DNA, 35 bp, Artificial Sequence
  Synthetic oligonucleotide
tgggatgccgacgcgttaaccaccatccgccgctc

SEQ ID NO: 153351 - DNA, 35 bp, Artificial Sequence
  Synthetic oligonucleotide
gttgcccttcctcgttcgttgacgacccgcttctc

SEQ ID NO: 153352 - DNA, 35 bp, Artificial Sequence
  Synthetic oligonucleotide
atcccacatcggttttgctgttctcccatcccgtc

SEQ ID NO: 153353 - DNA, 35 bp, Artificial Sequence
  Synthetic oligonucleotide
tcaccgccacccgtattgggcccgaactaactgtc

SEQ ID NO: 153354 - DNA, 35 bp, Artificial Sequence
  Synthetic oligonucleotide
ggtctgcccagctcagttaccgcccctctttcgag

SEQ ID NO: 153355 - DNA, 35 bp, Artificial Sequence
  Synthetic oligonucleotide
tcaaccgctggtttgcccccacccacatgctctgg

SEQ ID NO: 153356 - DNA, 35 bp, Artificial Sequence
  Synthetic oligonucleotide
tgcacaccccactgttcagttctgtcgcctccctg

SEQ ID NO: 153357 - DNA, 35 bp, Artificial Sequence
  Synthetic oligonucleotide
acctacacaccacgcgcacccttcgctccatgctg

SEQ ID NO: 153358 - DNA, 35 bp, Artificial Sequence
  Synthetic oligonucleotide
taacgagtcgctcctaccccccgcacctgttattg

SEQ ID NO: 153359 - DNA, 35 bp, Artificial Sequence
  Synthetic oligonucleotide
tatcgttgcatgccctcatttgctccatcatcaat

SEQ ID NO: 153360 - DNA, 35 bp, Artificial Sequence
  Synthetic oligonucleotide
gaagtcgttgcagtgcacgcgcgcctgttctacct

SEQ ID NO: 153361 - DNA, 35 bp, Artificial Sequence
  Synthetic oligonucleotide
gttcatcctcagccatctcaaagtgccctcgccct

SEQ ID NO: 153362 - DNA, 35 bp, Artificial Sequence
  Synthetic oligonucleotide
ttcgggcgccaccgcgattctgtgcccgcccttct

SEQ ID NO: 153363 - DNA, 35 bp, Artificial Sequence
  Synthetic oligonucleotide
tcacacctctcggttccggtcgagaatcaccgttt

SEQ ID NO: 153364 - DNA, 36 bp, Artificial Sequence
  Synthetic oligonucleotide
tacctgcagggggggggtaaaatgctggggagggaa

SEQ ID NO: 153365 - DNA, 35 bp, Artificial Sequence
  Synthetic oligonucleotide
ccccaacgccctcccaattggagcacctttgctaa

SEQ ID NO: 153366 - DNA, 36 bp, Artificial Sequence
  Synthetic oligonucleotide
tctgagagccatccccccatgcacatatagccacca

SEQ ID NO: 153367 - DNA, 36 bp, Artificial Sequence
  Synthetic oligonucleotide
gtcgcccttaattgatttccttgcctcccgtttgca

SEQ ID NO: 153368 - DNA, 37 bp, Artificial Sequence
  Synthetic oligonucleotide
actccaccatcccgatatgtccttggacttcccgaga

SEQ ID NO: 153369 - DNA, 35 bp, Artificial Sequence
  Synthetic oligonucleotide
agacgctgaccctctcgcggccgtttaccccccga

SEQ ID NO: 153370 - DNA, 37 bp, Artificial Sequence
  Synthetic oligonucleotide
ttagtcccgcccatgttcattccacatctgttccgga

SEQ ID NO: 153371 - DNA, 37 bp, Artificial Sequence
  Synthetic oligonucleotide
gtgtgggcaggaggggaaaggtgttggcgggatggga

SEQ ID NO: 153372 - DNA, 35 bp, Artificial Sequence
  Synthetic oligonucleotide
gcgatgaggcgccccttcctgtttcaccttctgga

SEQ ID NO: 153373 - DNA, 37 bp, Artificial Sequence
  Synthetic oligonucleotide
gacccccgtacccgtccctgtcccatttctcacgtga

SEQ ID NO: 153374 - DNA, 36 bp, Artificial Sequence
  Synthetic oligonucleotide
gcgagcctgcatccacattattgtctcgcctcttga

SEQ ID NO: 153375 - DNA, 37 bp, Artificial Sequence
  Synthetic oligonucleotide
acttgcgcgatactgctatgttccacgccctctttga

SEQ ID NO: 153376 - DNA, 35 bp, Artificial Sequence
  Synthetic oligonucleotide
tgcaacccacatgcgttcaccaccccgcgcaccta

SEQ ID NO: 153377 - DNA, 35 bp, Artificial Sequence
  Synthetic oligonucleotide
acgtctcgcccctcctgccccagtcctggcaccta

SEQ ID NO: 153378 - DNA, 35 bp, Artificial Sequence
  Synthetic oligonucleotide
gtccatcgccaactccacacggtcctcttacgcta

SEQ ID NO: 153379 - DNA, 36 bp, Artificial Sequence
  Synthetic oligonucleotide
acctgccccacactattctgtctcctacattgagta

SEQ ID NO: 153380 - DNA, 36 bp, Artificial Sequence
  Synthetic oligonucleotide
ccacgccaccgccctctatggacctgcttgtcttta

SEQ ID NO: 153381 - DNA, 35 bp, Artificial Sequence
  Synthetic oligonucleotide
aatgccgcgcaccctacgctccgacactttaccac

SEQ ID NO: 153382 - DNA, 35 bp, Artificial Sequence
  Synthetic oligonucleotide
atgacccaccacaacgcctattgatacaacccgac

SEQ ID NO: 153383 - DNA, 35 bp, Artificial Sequence
  Synthetic oligonucleotide
ttttacgccactgactccgctccaggtcctcaacc

SEQ ID NO: 153384 - DNA, 35 bp, Artificial Sequence
  Synthetic oligonucleotide
tcaagcacgatctcatcgtccatctcctcctcccc

SEQ ID NO: 153385 - DNA, 35 bp, Artificial Sequence
  Synthetic oligonucleotide
gtgcctcccttcgttctcgccgcgctcttgctgcc

SEQ ID NO: 153386 - DNA, 35 bp, Artificial Sequence
  Synthetic oligonucleotide
gaaagccacccgcgacctatgccctactgtctgcc

SEQ ID NO: 153387 - DNA, 35 bp, Artificial Sequence
  Synthetic oligonucleotide
aatacacccgatgagcccattagtctgtccaatcc

SEQ ID NO: 153388 - DNA, 35 bp, Artificial Sequence
  Synthetic oligonucleotide
ttcgcaccatccagaacggcagacttaccgagtcc

SEQ ID NO: 153389 - DNA, 35 bp, Artificial Sequence
  Synthetic oligonucleotide
tccccgacgcaacgttccgtggcatggctccttcc

SEQ ID NO: 153390 - DNA, 35 bp, Artificial Sequence
  Synthetic oligonucleotide
tgacgcacttgatcctgcccgagcggacttcttcc

SEQ ID NO: 153391 - DNA, 35 bp, Artificial Sequence
  Synthetic oligonucleotide
gcatgctcggagattgcgtgctcccttgttgttcc

SEQ ID NO: 153392 - DNA, 35 bp, Artificial Sequence
  Synthetic oligonucleotide
atcccccatccttgttccacgcgccttgttccagc

SEQ ID NO: 153393 - DNA, 35 bp, Artificial Sequence
  Synthetic oligonucleotide
ttcaccatcaccgtgtcctccgtcttgccgtacgc

SEQ ID NO: 153394 - DNA, 35 bp, Artificial Sequence
  Synthetic oligonucleotide
agtgtcattgctcgccgcttacccctagcccccgc

SEQ ID NO: 153395 - DNA, 35 bp, Artificial Sequence
  Synthetic oligonucleotide
actcgagcgcatttgttatccgcctcaacacctgc

SEQ ID NO: 153396 - DNA, 35 bp, Artificial Sequence
  Synthetic oligonucleotide
ggacagttcgccacacgtcctcttgcgtaccctgc

SEQ ID NO: 153397 - DNA, 36 bp, Artificial Sequence
  Synthetic oligonucleotide
tccgcctgttctccctgtaactttgtgactctttgc

SEQ ID NO: 153398 - DNA, 35 bp, Artificial Sequence
  Synthetic oligonucleotide
gtcgcccccgacgagcgcgaattactcactcaatc

SEQ ID NO: 153399 - DNA, 35 bp, Artificial Sequence
  Synthetic oligonucleotide
ccgaacacgtcctatcacccgccgatttgccactc

SEQ ID NO: 153400 - DNA, 35 bp, Artificial Sequence
  Synthetic oligonucleotide
ttgcggtgtacgactctctctgccgcctatctgtc

SEQ ID NO: 153401 - DNA, 35 bp, Artificial Sequence
  Synthetic oligonucleotide
tgacatcggccaattacgcgttacccttcttgttc

SEQ ID NO: 153402 - DNA, 35 bp, Artificial Sequence
  Synthetic oligonucleotide
attcagccgttccaccttcgtacgtccccttcaag

SEQ ID NO: 153403 - DNA, 35 bp, Artificial Sequence
  Synthetic oligonucleotide
gttgctgcccccctgtccttgggtctaactcccag

SEQ ID NO: 153404 - DNA, 35 bp, Artificial Sequence
  Synthetic oligonucleotide
aatgagcccagcccgccaacaccacgccaaatgcg

SEQ ID NO: 153405 - DNA, 35 bp, Artificial Sequence
  Synthetic oligonucleotide
gaaagagaacggaaacggggagggcgtggcatggg

SEQ ID NO: 153406 - DNA, 35 bp, Artificial Sequence
  Synthetic oligonucleotide
gagcctgccccgcattttccaacatcctccaatgg

SEQ ID NO: 153407 - DNA, 35 bp, Artificial Sequence
  Synthetic oligonucleotide
gacacggagggaagtactcgggtgggaaacggtgg

SEQ ID NO: 153408 - DNA, 35 bp, Artificial Sequence
  Synthetic oligonucleotide
aatccgtcgctcaacccgcctctacttcgttcatg

SEQ ID NO: 153409 - DNA, 35 bp, Artificial Sequence
  Synthetic oligonucleotide
gccatctaccggttgctaacctcttcgtcaacttg

SEQ ID NO: 153410 - DNA, 35 bp, Artificial Sequence
  Synthetic oligonucleotide
acagccgcctggccccctttgcgattccagccact

SEQ ID NO: 153411 - DNA, 35 bp, Artificial Sequence
  Synthetic oligonucleotide
atgatcccacttcgcccgggtcccgttgactccct

SEQ ID NO: 153412 - DNA, 35 bp, Artificial Sequence
  Synthetic oligonucleotide
tagcccgctgccactatctcttgttcctgagcgct

SEQ ID NO: 153413 - DNA, 35 bp, Artificial Sequence
  Synthetic oligonucleotide
tttgcgtcaccccccgtcaccggtaccaaggcgct

SEQ ID NO: 153414 - DNA, 35 bp, Artificial Sequence
  Synthetic oligonucleotide
accacatcaccgtgcaccaagcttccgactttgct

SEQ ID NO: 153415 - DNA, 35 bp, Artificial Sequence
  Synthetic oligonucleotide
tggagcctgttctgttcgtcttcggtcgtgcctct

SEQ ID NO: 153416 - DNA, 35 bp, Artificial Sequence
  Synthetic oligonucleotide
tcacacgccttctacccttgcgtcacttttctgtt

SEQ ID NO: 153417 - DNA, 35 bp, Artificial Sequence
  Synthetic oligonucleotide
tcttgcctgtcctcttctggtgtcaccatctcttt

SEQ ID NO: 153418 - DNA, 36 bp, Artificial Sequence
  Synthetic oligonucleotide
tgggtggggtaggcaggaaaagctagggcggaggaa

SEQ ID NO: 153419 - DNA, 36 bp, Artificial Sequence
  Synthetic oligonucleotide
gccctccacccgccggtactcttggctacttactaa

SEQ ID NO: 153420 - DNA, 35 bp, Artificial Sequence
  Synthetic oligonucleotide
tggacacccgcaccaccttaaattgtcgcctttaa

SEQ ID NO: 153421 - DNA, 36 bp, Artificial Sequence
  Synthetic oligonucleotide
tcaccaactccccatgttgaccaccggtgatccaca

SEQ ID NO: 153422 - DNA, 36 bp, Artificial Sequence
  Synthetic oligonucleotide
ggacaactgacccgctggacacccctcgaccctcca

SEQ ID NO: 153423 - DNA, 36 bp, Artificial Sequence
  Synthetic oligonucleotide
tccaccccacgcactacatcttggtatttgtccgca

SEQ ID NO: 153424 - DNA, 35 bp, Artificial Sequence
  Synthetic oligonucleotide
gcgataacacttcccccgcccgtccctcgctggca

SEQ ID NO: 153425 - DNA, 35 bp, Artificial Sequence
  Synthetic oligonucleotide
ttcgcctccgctccacccaggactgataacattca

SEQ ID NO: 153426 - DNA, 35 bp, Artificial Sequence
  Synthetic oligonucleotide
atcccaacgttgggagggtgggggtgactgggaga

SEQ ID NO: 153427 - DNA, 36 bp, Artificial Sequence
  Synthetic oligonucleotide
tcatcctcacatgctgacaacccggcccatcaacga

SEQ ID NO: 153428 - DNA, 37 bp, Artificial Sequence
  Synthetic oligonucleotide
gtcgcatacccctgttcattacatgacttcacctcga

SEQ ID NO: 153429 - DNA, 36 bp, Artificial Sequence
  Synthetic oligonucleotide
gcccgaggccaccccacgtaactgaacacccttcga

SEQ ID NO: 153430 - DNA, 37 bp, Artificial Sequence
  Synthetic oligonucleotide
gtgcaacatgagcggggaactaatgggaggtgaagga

SEQ ID NO: 153431 - DNA, 37 bp, Artificial Sequence
  Synthetic oligonucleotide
gagtacgggagcgaggagggaggggctgaaagtagga

SEQ ID NO: 153432 - DNA, 37 bp, Artificial Sequence
  Synthetic oligonucleotide
gacgaactgtggaaatatgggagggggacggaatgga

SEQ ID NO: 153433 - DNA, 37 bp, Artificial Sequence
  Synthetic oligonucleotide
aacaccacacccccatggttttccgactgtcattgga

SEQ ID NO: 153434 - DNA, 38 bp, Artificial Sequence
  Synthetic oligonucleotide
gagtggaggaagggacggcgggatgggggggatagtga

SEQ ID NO: 153435 - DNA, 38 bp, Artificial Sequence
  Synthetic oligonucleotide
atcccaccgcccgggaaccctcgtccctttctttgtga

SEQ ID NO: 153436 - DNA, 36 bp, Artificial Sequence
  Synthetic oligonucleotide
ccgtgcacctgcacatcctgtttcttgccttctata

SEQ ID NO: 153437 - DNA, 36 bp, Artificial Sequence
  Synthetic oligonucleotide
tcgtgtgcccgcccgaaaccgtcccttcccgcacta

SEQ ID NO: 153438 - DNA, 35 bp, Artificial Sequence
  Synthetic oligonucleotide
tgcctccccacctacgcccgcgcgacgtgcgccta

SEQ ID NO: 153439 - DNA, 36 bp, Artificial Sequence
  Synthetic oligonucleotide
gaatcggacagctcactcttgtcgcccgccgttcta

SEQ ID NO: 153440 - DNA, 35 bp, Artificial Sequence
  Synthetic oligonucleotide
ttccctgcccagctccgtctatcctcgcaatggta

SEQ ID NO: 153441 - DNA, 36 bp, Artificial Sequence
  Synthetic oligonucleotide
ggacggacctccggcgctgactcccccccatcctta

SEQ ID NO: 153442 - DNA, 36 bp, Artificial Sequence
  Synthetic oligonucleotide
gctaccgccggcttattccgctccttaccaccgtta

SEQ ID NO: 153443 - DNA, 35 bp, Artificial Sequence
  Synthetic oligonucleotide
acctgcgtgccccttctgccttagaacctggtaac

SEQ ID NO: 153444 - DNA, 35 bp, Artificial Sequence
  Synthetic oligonucleotide
gtacagggaagtagggatcacgggcgggaagacac

SEQ ID NO: 153445 - DNA, 36 bp, Artificial Sequence
  Synthetic oligonucleotide
tacccgaaacccgctccgacagttcattcgcgcccc

SEQ ID NO: 153446 - DNA, 35 bp, Artificial Sequence
  Synthetic oligonucleotide
acgtcccctcctcgccgtacgaaacttactgcccc

SEQ ID NO: 153447 - DNA, 35 bp, Artificial Sequence
  Synthetic oligonucleotide
acgcaccttatcagcgccgattagtcttcccgccc

SEQ ID NO: 153448 - DNA, 35 bp, Artificial Sequence
  Synthetic oligonucleotide
ttgtgcacgcccgagtaccgcggtgcatctctccc

SEQ ID NO: 153449 - DNA, 35 bp, Artificial Sequence
  Synthetic oligonucleotide
ttgatcgccctgcataactggttcttgaactcgcc

SEQ ID NO: 153450 - DNA, 35 bp, Artificial Sequence
  Synthetic oligonucleotide
ggagctcaactatccgaccgcccctgatttctgcc

SEQ ID NO: 153451 - DNA, 35 bp, Artificial Sequence
  Synthetic oligonucleotide
atacctgtgacggcatgttgctgccttctacctcc

SEQ ID NO: 153452 - DNA, 35 bp, Artificial Sequence
  Synthetic oligonucleotide
gctacacccggcttatgcgccctgccccactgcgc

SEQ ID NO: 153453 - DNA, 35 bp, Artificial Sequence
  Synthetic oligonucleotide
aatcaccaccggtgtggtttaatgtttttcctcgc

SEQ ID NO: 153454 - DNA, 35 bp, Artificial Sequence
  Synthetic oligonucleotide
agtccctgcctccacccctcatattgctgctgggc

SEQ ID NO: 153455 - DNA, 36 bp, Artificial Sequence
  Synthetic oligonucleotide
actgttgcatacagccacgactcccgtcctgccatc

SEQ ID NO: 153456 - DNA, 35 bp, Artificial Sequence
  Synthetic oligonucleotide
acaccgtccagtacatgtacacctccggtcacctc

SEQ ID NO: 153457 - DNA, 35 bp, Artificial Sequence
  Synthetic oligonucleotide
gcacatcgctccgtggcccccccgagtccgccctc

SEQ ID NO: 153458 - DNA, 35 bp, Artificial Sequence
  Synthetic oligonucleotide
tagcggcgttggcttaccgtttttgtcctcgcctc

SEQ ID NO: 153459 - DNA, 35 bp, Artificial Sequence
  Synthetic oligonucleotide
atagccccccatcactcccacctcatgtggtgctc

SEQ ID NO: 153460 - DNA, 35 bp, Artificial Sequence
  Synthetic oligonucleotide
ttgtgcctctggcattttgttttgcccgacctctc

SEQ ID NO: 153461 - DNA, 35 bp, Artificial Sequence
  Synthetic oligonucleotide
tcctgacctgcaccacatagaatatttcctctgtc

SEQ ID NO: 153462 - DNA, 35 bp, Artificial Sequence
  Synthetic oligonucleotide
accctcaccatctatgtaattgtcggcatttattc

SEQ ID NO: 153463 - DNA, 35 bp, Artificial Sequence
  Synthetic oligonucleotide
tgtccgatcgcctcccgttcttctgtataacaccg

SEQ ID NO: 153464 - DNA, 35 bp, Artificial Sequence
  Synthetic oligonucleotide
gactccactccgtacccgagccaaccttttgcccg

SEQ ID NO: 153465 - DNA, 35 bp, Artificial Sequence
  Synthetic oligonucleotide
aatgggaggataggtatgggatggaccaaggaggg

SEQ ID NO: 153466 - DNA, 35 bp, Artificial Sequence
  Synthetic oligonucleotide
ttatcgcacctgacctaatctgccacctggtattg

SEQ ID NO: 153467 - DNA, 35 bp, Artificial Sequence
  Synthetic oligonucleotide
accccatgcgccccccggttagacggcacctacat

SEQ ID NO: 153468 - DNA, 35 bp, Artificial Sequence
  Synthetic oligonucleotide
ttagcgcttgcctctcacccatatcccctcgcgat

SEQ ID NO: 153469 - DNA, 35 bp, Artificial Sequence
  Synthetic oligonucleotide
gccaccctgaacgaccccccttcccctggcgcact

SEQ ID NO: 153470 - DNA, 35 bp, Artificial Sequence
  Synthetic oligonucleotide
tcaacgacctaatgcgcttagagtcgcctcctcct

SEQ ID NO: 153471 - DNA, 35 bp, Artificial Sequence
  Synthetic oligonucleotide
taacaacgcagcggtttagttacacacttcttcct

SEQ ID NO: 153472 - DNA, 35 bp, Artificial Sequence
  Synthetic oligonucleotide
gtggggcgttggctacggggggggtggggtccgct

SEQ ID NO: 153473 - DNA, 35 bp, Artificial Sequence
  Synthetic oligonucleotide
gataccgtatgcgccctctcacacacatgcctgct

SEQ ID NO: 153474 - DNA, 35 bp, Artificial Sequence
  Synthetic oligonucleotide
accaccatccgctacttgtctttcgccaccttgct

SEQ ID NO: 153475 - DNA, 35 bp, Artificial Sequence
  Synthetic oligonucleotide
gaaacccgcgctcccttcccttaccgccttagagt

SEQ ID NO: 153476 - DNA, 34 bp, Artificial Sequence
  Synthetic oligonucleotide
tgccaaacccccccctcgcctctgccacccatgt

SEQ ID NO: 153477 - DNA, 35 bp, Artificial Sequence
  Synthetic oligonucleotide
gggggagggagggtcgcctctcaattaaaggggtt

SEQ ID NO: 153478 - DNA, 36 bp, Artificial Sequence
  Synthetic oligonucleotide
aattgggggaggaagtggcggagggtcacagtaaaa

SEQ ID NO: 153479 - DNA, 35 bp, Artificial Sequence
  Synthetic oligonucleotide
tcaccaccccccaacatgaccgcgttgctcgtcaa

SEQ ID NO: 153480 - DNA, 36 bp, Artificial Sequence
  Synthetic oligonucleotide
gacgccgcagccacccgcgttgtcctttctactgaa

SEQ ID NO: 153481 - DNA, 35 bp, Artificial Sequence
  Synthetic oligonucleotide
tctgtcgtcgacgcttattctacccttcccgctaa

SEQ ID NO: 153482 - DNA, 35 bp, Artificial Sequence
  Synthetic oligonucleotide
agccaccgtataccatccgcccgtccagtcgctaa

SEQ ID NO: 153483 - DNA, 36 bp, Artificial Sequence
  Synthetic oligonucleotide
gactccctccatgcatcccgacgaccaattgtgaca

SEQ ID NO: 153484 - DNA, 36 bp, Artificial Sequence
  Synthetic oligonucleotide
tgccattcgtcgaagccgtcccgttactcattcgca

SEQ ID NO: 153485 - DNA, 36 bp, Artificial Sequence
  Synthetic oligonucleotide
gccagtcatccgcgtcttacccgctgccctccgtca

SEQ ID NO: 153486 - DNA, 37 bp, Artificial Sequence
  Synthetic oligonucleotide
gagccggaccgggagagctaggggaggggacgtgaga

SEQ ID NO: 153487 - DNA, 37 bp, Artificial Sequence
  Synthetic oligonucleotide
tccgccaccctatttattgcacggtccgttcacccga

SEQ ID NO: 153488 - DNA, 37 bp, Artificial Sequence
  Synthetic oligonucleotide
gagtgccacgttagcgttgtttcgcccgtttccccga

SEQ ID NO: 153489 - DNA, 37 bp, Artificial Sequence
  Synthetic oligonucleotide
gtcgcgcatgtgatgttttaccgcctatcctctccga

SEQ ID NO: 153490 - DNA, 37 bp, Artificial Sequence
  Synthetic oligonucleotide
taccggaaggaagggtgaaggggtaagaagcgggcga

SEQ ID NO: 153491 - DNA, 37 bp, Artificial Sequence
  Synthetic oligonucleotide
tagtatgaccaggtggttagcaggaggggggaacgga

SEQ ID NO: 153492 - DNA, 37 bp, Artificial Sequence
  Synthetic oligonucleotide
ggggagggccacttccgaaaacggggaagccagggga

SEQ ID NO: 153493 - DNA, 37 bp, Artificial Sequence
  Synthetic oligonucleotide
acaggtgggaaagttgggtgggaacaggcaacgggga

SEQ ID NO: 153494 - DNA, 36 bp, Artificial Sequence
  Synthetic oligonucleotide
atgcccgccagtttttgcccctcttgctctactgga

SEQ ID NO: 153495 - DNA, 37 bp, Artificial Sequence
  Synthetic oligonucleotide
gatccgccccacaatcgcctctgttcgttattcatga

SEQ ID NO: 153496 - DNA, 38 bp, Artificial Sequence
  Synthetic oligonucleotide
gggggggagggttaggggttacgtattgggggccctga

SEQ ID NO: 153497 - DNA, 37 bp, Artificial Sequence
  Synthetic oligonucleotide
ttggggaagggctgggaggacagggggagtcatctga

SEQ ID NO: 153498 - DNA, 37 bp, Artificial Sequence
  Synthetic oligonucleotide
acgtaggggcggggtggtgaagatcggatgtatgtga

SEQ ID NO: 153499 - DNA, 38 bp, Artificial Sequence
  Synthetic oligonucleotide
gactgcgccatgaaaatatgttccctctccgcctgtga

SEQ ID NO: 153500 - DNA, 38 bp, Artificial Sequence
  Synthetic oligonucleotide
tagcgccgccccgcccacctcagcccacgagctattga

SEQ ID NO: 153501 - DNA, 38 bp, Artificial Sequence
  Synthetic oligonucleotide
ggagtagacggaggtgcggttggggagggagatgttga

SEQ ID NO: 153502 - DNA, 36 bp, Artificial Sequence
  Synthetic oligonucleotide
ggtcccgccggaactcccgccaccttttgctgcata

SEQ ID NO: 153503 - DNA, 36 bp, Artificial Sequence
  Synthetic oligonucleotide
actccgcactccgtccttcccttcctaatgggccta

SEQ ID NO: 153504 - DNA, 36 bp, Artificial Sequence
  Synthetic oligonucleotide
acaccgtaaattgctgcctttggggtgccacctcta

SEQ ID NO: 153505 - DNA, 36 bp, Artificial Sequence
  Synthetic oligonucleotide
acgaacgagaggcggggggtgaaattcgggaaggta

SEQ ID NO: 153506 - DNA, 36 bp, Artificial Sequence
  Synthetic oligonucleotide
accactcgccttcccgtgccgttttgctttccggta

SEQ ID NO: 153507 - DNA, 35 bp, Artificial Sequence
  Synthetic oligonucleotide
taccatccgaccatgtggctcgctctctcttatta

SEQ ID NO: 153508 - DNA, 36 bp, Artificial Sequence
  Synthetic oligonucleotide
actctgccttaggtcccgttcctacccagtttctta

SEQ ID NO: 153509 - DNA, 35 bp, Artificial Sequence
  Synthetic oligonucleotide
ttggggggggggggggtagcacgagttggggccac

SEQ ID NO: 153510 - DNA, 35 bp, Artificial Sequence
  Synthetic oligonucleotide
cacacctcctcgctttagtcacgctctctccggac

SEQ ID NO: 153511 - DNA, 35 bp, Artificial Sequence
  Synthetic oligonucleotide
tgccccgccggaccgttcgaccaatcgtgcactac

SEQ ID NO: 153512 - DNA, 35 bp, Artificial Sequence
  Synthetic oligonucleotide
tacgataaccccctgctgagtaacgattcctttac

SEQ ID NO: 153513 - DNA, 35 bp, Artificial Sequence
  Synthetic oligonucleotide
tgcctgtcctccatcggggccattttcgctacacc

SEQ ID NO: 153514 - DNA, 35 bp, Artificial Sequence
  Synthetic oligonucleotide
gatacccccagggatctttcccgttgctcccgccc

SEQ ID NO: 153515 - DNA, 35 bp, Artificial Sequence
  Synthetic oligonucleotide
ttgttcccgacgcttccatcaggttctctccgccc

SEQ ID NO: 153516 - DNA, 35 bp, Artificial Sequence
  Synthetic oligonucleotide
ttcgtgcgccatcttctcccgacctgcttttgccc

SEQ ID NO: 153517 - DNA, 35 bp, Artificial Sequence
  Synthetic oligonucleotide
gcgccaagccatttcctactcgcgacgactgctcc

SEQ ID NO: 153518 - DNA, 35 bp, Artificial Sequence
  Synthetic oligonucleotide
tctcccaccgctttgcgtcgacccgttcccatggc

SEQ ID NO: 153519 - DNA, 35 bp, Artificial Sequence
  Synthetic oligonucleotide
gacgccccccgccagggactttcctggtttccatc

SEQ ID NO: 153520 - DNA, 35 bp, Artificial Sequence
  Synthetic oligonucleotide
ttcagctgatgcgcccggcaccctcccctcgtatc

SEQ ID NO: 153521 - DNA, 35 bp, Artificial Sequence
  Synthetic oligonucleotide
atacaactcccgccatgtaaccgccatcatctgtc

SEQ ID NO: 153522 - DNA, 35 bp, Artificial Sequence
  Synthetic oligonucleotide
atgcgcactcggcctttatcaccactcgacgtgtc

SEQ ID NO: 153523 - DNA, 35 bp, Artificial Sequence
  Synthetic oligonucleotide
tgctgcgggtcgccgtatctgttctgttcccgttc

SEQ ID NO: 153524 - DNA, 35 bp, Artificial Sequence
  Synthetic oligonucleotide
aagtcagctctggcaattccctgctccccccgccg

SEQ ID NO: 153525 - DNA, 35 bp, Artificial Sequence
  Synthetic oligonucleotide
agccctgtcctggcttttctgtccaaccattctcg

SEQ ID NO: 153526 - DNA, 35 bp, Artificial Sequence
  Synthetic oligonucleotide
acgccacacattgctatgacctcgcccttttcatg

SEQ ID NO: 153527 - DNA, 35 bp, Artificial Sequence
  Synthetic oligonucleotide
tgcaccgtgcttctatctccgctcgtcctagactg

SEQ ID NO: 153528 - DNA, 35 bp, Artificial Sequence
  Synthetic oligonucleotide
gaaagctgccggcaatatcatcccacctgcccctg

SEQ ID NO: 153529 - DNA, 35 bp, Artificial Sequence
  Synthetic oligonucleotide
acctaaccgacagtgtttcttctccacgtacgctg

SEQ ID NO: 153530 - DNA, 35 bp, Artificial Sequence
  Synthetic oligonucleotide
gtcgtggaagcgcaccgctataccctccgtaccat

SEQ ID NO: 153531 - DNA, 35 bp, Artificial Sequence
  Synthetic oligonucleotide
tttccgccgctctcccgtttcctctagtcccgact

SEQ ID NO: 153532 - DNA, 35 bp, Artificial Sequence
  Synthetic oligonucleotide
acaccgcctcgccctcgtagaacccatcatcccct

SEQ ID NO: 153533 - DNA, 35 bp, Artificial Sequence
  Synthetic oligonucleotide
tcttgtgcagcctagagtcctgccctttctccgct

SEQ ID NO: 153534 - DNA, 35 bp, Artificial Sequence
  Synthetic oligonucleotide
accgaccctgcgacgaaccgcccttccgcccccgt

SEQ ID NO: 153535 - DNA, 35 bp, Artificial Sequence
  Synthetic oligonucleotide
gggagtcaccacccgatgccacccgccactattgt

SEQ ID NO: 153536 - DNA, 35 bp, Artificial Sequence
  Synthetic oligonucleotide
gcccaggctgtccgcactctgtccacattccttgt

SEQ ID NO: 153537 - DNA, 35 bp, Artificial Sequence
  Synthetic oligonucleotide
gtgcactccaagatctgcttcgcacgctcgccctt

SEQ ID NO: 153538 - DNA, 35 bp, Artificial Sequence
  Synthetic oligonucleotide
gctcccttgccacatgattaccgtcccatgctttt

SEQ ID NO: 153539 - DNA, 36 bp, Artificial Sequence
  Synthetic oligonucleotide
acatgccctccgctcctagttggtcctgccttataa

SEQ ID NO: 153540 - DNA, 35 bp, Artificial Sequence
  Synthetic oligonucleotide
gcgcatgctatcctgcccgtgctccacgcctgcca

SEQ ID NO: 153541 - DNA, 34 bp, Artificial Sequence
  Synthetic oligonucleotide
catacctccgactgagccgcttattgcccctcca

SEQ ID NO: 153542 - DNA, 36 bp, Artificial Sequence
  Synthetic oligonucleotide
agattgcagggggaagagggaaatggtagggtagca

SEQ ID NO: 153543 - DNA, 35 bp, Artificial Sequence
  Synthetic oligonucleotide
tccattgcttgaccggtctattcccagcctccgca

SEQ ID NO: 153544 - DNA, 37 bp, Artificial Sequence
  Synthetic oligonucleotide
gacgcctctcccgcttcccagtacagtgacctccaga

SEQ ID NO: 153545 - DNA, 37 bp, Artificial Sequence
  Synthetic oligonucleotide
gatagcaccgtccaggagtagcccgccaccaccccga

SEQ ID NO: 153546 - DNA, 37 bp, Artificial Sequence
  Synthetic oligonucleotide
tgatctgaccccctcgttcccccacaccgcttcgcga

SEQ ID NO: 153547 - DNA, 35 bp, Artificial Sequence
  Synthetic oligonucleotide
accacaccatcctcgtcacccctgccttggaagga

SEQ ID NO: 153548 - DNA, 37 bp, Artificial Sequence
  Synthetic oligonucleotide
acaaggagagggtacgggctggggtggtagtgaagga

SEQ ID NO: 153549 - DNA, 37 bp, Artificial Sequence
  Synthetic oligonucleotide
acgtacggtcaattggcactctcctcacttacccgga

SEQ ID NO: 153550 - DNA, 37 bp, Artificial Sequence
  Synthetic oligonucleotide
gaaagcgaaccagggagccggggagagaggatgggga

SEQ ID NO: 153551 - DNA, 37 bp, Artificial Sequence
  Synthetic oligonucleotide
ggggggagggtgggaaatgaggacaagggcaaatgga

SEQ ID NO: 153552 - DNA, 37 bp, Artificial Sequence
  Synthetic oligonucleotide
actagctgtccaccgccgctgcttacctccctatgga

SEQ ID NO: 153553 - DNA, 35 bp, Artificial Sequence
  Synthetic oligonucleotide
agtgagcggtcctctgcgctcccttccgccactga

SEQ ID NO: 153554 - DNA, 38 bp, Artificial Sequence
  Synthetic oligonucleotide
tcctcctcctacctgttcgtatgtcgcgcccttcgtga

SEQ ID NO: 153555 - DNA, 37 bp, Artificial Sequence
  Synthetic oligonucleotide
gatcagtaccaccctgcgttttgctcgcccttcgtga

SEQ ID NO: 153556 - DNA, 38 bp, Artificial Sequence
  Synthetic oligonucleotide
atcgaacctgcgctactctgttttgtgcccccctgtga

SEQ ID NO: 153557 - DNA, 36 bp, Artificial Sequence
  Synthetic oligonucleotide
tccacgctgtcccatcgcattttgtgctttcccata

SEQ ID NO: 153558 - DNA, 36 bp, Artificial Sequence
  Synthetic oligonucleotide
agatagagggtgagggcggtgggaagcagcagtcta

SEQ ID NO: 153559 - DNA, 35 bp, Artificial Sequence
  Synthetic oligonucleotide
gtgcacgcactccatcaccttctccgggccaagta

SEQ ID NO: 153560 - DNA, 36 bp, Artificial Sequence
  Synthetic oligonucleotide
gactcccgcctgttactcccatcctccactaccgta

SEQ ID NO: 153561 - DNA, 36 bp, Artificial Sequence
  Synthetic oligonucleotide
gttcccaccgggtgtaccctccactcgctgccctta

SEQ ID NO: 153562 - DNA, 35 bp, Artificial Sequence
  Synthetic oligonucleotide
gtgagggacgggaggatacagttaagaggagagac

SEQ ID NO: 153563 - DNA, 35 bp, Artificial Sequence
  Synthetic oligonucleotide
ttgaatgtgtcactatcctggtctacgccccttac

SEQ ID NO: 153564 - DNA, 36 bp, Artificial Sequence
  Synthetic oligonucleotide
acactcgcccctgtccttctgctgcctctacgcacc

SEQ ID NO: 153565 - DNA, 35 bp, Artificial Sequence
  Synthetic oligonucleotide
aaaaggcgctccatgtccgcttgattcttgccgcc

SEQ ID NO: 153566 - DNA, 35 bp, Artificial Sequence
  Synthetic oligonucleotide
atctccagtcccgcccgaacgagggccttacttcc

SEQ ID NO: 153567 - DNA, 35 bp, Artificial Sequence
  Synthetic oligonucleotide
tcaagcccgttgcttgtttgatctttcaccttcgc

SEQ ID NO: 153568 - DNA, 35 bp, Artificial Sequence
  Synthetic oligonucleotide
tgccccacccgcaacatatatgggacccttgctgc

SEQ ID NO: 153569 - DNA, 35 bp, Artificial Sequence
  Synthetic oligonucleotide
accgattgtcatgtcactttcatcgcccgttgctc

SEQ ID NO: 153570 - DNA, 35 bp, Artificial Sequence
  Synthetic oligonucleotide
acgaccaacatccgacgatgcgcttgtccgttctc

SEQ ID NO: 153571 - DNA, 35 bp, Artificial Sequence
  Synthetic oligonucleotide
gtgccagctacgcactgtcacctttgctcttggtc

SEQ ID NO: 153572 - DNA, 35 bp, Artificial Sequence
  Synthetic oligonucleotide
actggtgtcggcgcccctgctagcccgtgcccttc

SEQ ID NO: 153573 - DNA, 34 bp, Artificial Sequence
  Synthetic oligonucleotide
tccgcacctgctgacccctcgccgaactgagttc

SEQ ID NO: 153574 - DNA, 35 bp, Artificial Sequence
  Synthetic oligonucleotide
gtgcccacgccccatatcgacctctagcaaggttc

SEQ ID NO: 153575 - DNA, 35 bp, Artificial Sequence
  Synthetic oligonucleotide
gcccattcccgtcgccccatctattggtagttttc

SEQ ID NO: 153576 - DNA, 35 bp, Artificial Sequence
  Synthetic oligonucleotide
gctgacctcttcgcccgctacacgcatttctttcg

SEQ ID NO: 153577 - DNA, 35 bp, Artificial Sequence
  Synthetic oligonucleotide
ttacccacgcccatcttccagggttctcttccatg

SEQ ID NO: 153578 - DNA, 35 bp, Artificial Sequence
  Synthetic oligonucleotide
taactcgcccggcccacaccctcgacattcacgtg

SEQ ID NO: 153579 - DNA, 35 bp, Artificial Sequence
  Synthetic oligonucleotide
taccagctacagccatcgtccatcttcttgtccat

SEQ ID NO: 153580 - DNA, 35 bp, Artificial Sequence
  Synthetic oligonucleotide
gctccgccgtgttttcatctttcgcaccgtttcat

SEQ ID NO: 153581 - DNA, 35 bp, Artificial Sequence
  Synthetic oligonucleotide
accgcgaccccctcgccacgccgctttgacgacct

SEQ ID NO: 153582 - DNA, 35 bp, Artificial Sequence
  Synthetic oligonucleotide
gcacagcctgtcccgtctccgcaaactttgggcct

SEQ ID NO: 153583 - DNA, 35 bp, Artificial Sequence
  Synthetic oligonucleotide
gcaccacgttcacagttacatccttcgcacatagt

SEQ ID NO: 153584 - DNA, 35 bp, Artificial Sequence
  Synthetic oligonucleotide
aatgaggcgaggcggggttacgtactggggggggt

SEQ ID NO: 153585 - DNA, 35 bp, Artificial Sequence
  Synthetic oligonucleotide
acgcacacaatttccagcactaccggtttgccttt

SEQ ID NO: 153586 - DNA, 36 bp, Artificial Sequence
  Synthetic oligonucleotide
atcacgtaccaccactacggcccgttcgctagcgaa

SEQ ID NO: 153587 - DNA, 35 bp, Artificial Sequence
  Synthetic oligonucleotide
tcccgccctcttgatcggcattcgtgctctcgtaa

SEQ ID NO: 153588 - DNA, 36 bp, Artificial Sequence
  Synthetic oligonucleotide
gttgccgacacgttccgggctcctattgttcctaca

SEQ ID NO: 153589 - DNA, 35 bp, Artificial Sequence
  Synthetic oligonucleotide
gggacggggacgggagggaggagtgatacaaacca

SEQ ID NO: 153590 - DNA, 36 bp, Artificial Sequence
  Synthetic oligonucleotide
acgccaccccccgcttgtgtctcagcacaaccacca

SEQ ID NO: 153591 - DNA, 35 bp, Artificial Sequence
  Synthetic oligonucleotide
tgctttgacgccgtagttcccctgccatcctacca

SEQ ID NO: 153592 - DNA, 36 bp, Artificial Sequence
  Synthetic oligonucleotide
gcaccctttcactgattactaagtcttcccgtctca

SEQ ID NO: 153593 - DNA, 37 bp, Artificial Sequence
  Synthetic oligonucleotide
atcgggtagacaggatttgcttagggtgggtgggaga

SEQ ID NO: 153594 - DNA, 37 bp, Artificial Sequence
  Synthetic oligonucleotide
aactcccacccctctgtctcaatagccggccccacga

SEQ ID NO: 153595 - DNA, 37 bp, Artificial Sequence
  Synthetic oligonucleotide
atcccggaggtggcggggatggatgggtggaatccga

SEQ ID NO: 153596 - DNA, 37 bp, Artificial Sequence
  Synthetic oligonucleotide
tagggagagaagggaggggtaatgggggggaatgcga

SEQ ID NO: 153597 - DNA, 35 bp, Artificial Sequence
  Synthetic oligonucleotide
gtaaggagagagaaggcagaaacgagcgagaagga

SEQ ID NO: 153598 - DNA, 36 bp, Artificial Sequence
  Synthetic oligonucleotide
agtgcacccctctctttgcccactcctgctgaagga

SEQ ID NO: 153599 - DNA, 35 bp, Artificial Sequence
  Synthetic oligonucleotide
acacgcaagcagggtatagtgggagcgggaaggga

SEQ ID NO: 153600 - DNA, 36 bp, Artificial Sequence
  Synthetic oligonucleotide
cccaccatcaccgtatcgctcgccaccatcccggga

SEQ ID NO: 153601 - DNA, 36 bp, Artificial Sequence
  Synthetic oligonucleotide
ggggaggggtccctcatccttggggaatacagggga

SEQ ID NO: 153602 - DNA, 37 bp, Artificial Sequence
  Synthetic oligonucleotide
gatacatgctggggggggttcggggcccatctgggga

SEQ ID NO: 153603 - DNA, 35 bp, Artificial Sequence
  Synthetic oligonucleotide
atgacttgcaacaagggggtggggggataatggga

SEQ ID NO: 153604 - DNA, 37 bp, Artificial Sequence
  Synthetic oligonucleotide
accgcccagctcagcttatctcctgcctctcatggga

SEQ ID NO: 153605 - DNA, 37 bp, Artificial Sequence
  Synthetic oligonucleotide
tggaaaaccggggtggaatattagggcggtagatgga

SEQ ID NO: 153606 - DNA, 38 bp, Artificial Sequence
  Synthetic oligonucleotide
gtgaaggtggaggggaggataatcaaacgaggcaatga

SEQ ID NO: 153607 - DNA, 37 bp, Artificial Sequence
  Synthetic oligonucleotide
atgcaccgcggtggtttcgctcctcgttttcaactga

SEQ ID NO: 153608 - DNA, 37 bp, Artificial Sequence
  Synthetic oligonucleotide
gcccccccagtggcctcgtttccgtccaccccactga

SEQ ID NO: 153609 - DNA, 38 bp, Artificial Sequence
  Synthetic oligonucleotide
tgcaacccggtctgtcgcaaccccgcccactatcctga

SEQ ID NO: 153610 - DNA, 38 bp, Artificial Sequence
  Synthetic oligonucleotide
gccaccccctccttgtatttgcctatagcggttcctga

SEQ ID NO: 153611 - DNA, 37 bp, Artificial Sequence
  Synthetic oligonucleotide
gtcgccacccccctgtacctgtattactgtgctgtga

SEQ ID NO: 153612 - DNA, 36 bp, Artificial Sequence
  Synthetic oligonucleotide
gactctcctcagtgccgccctcgtattcacacttga

SEQ ID NO: 153613 - DNA, 37 bp, Artificial Sequence
  Synthetic oligonucleotide
gaggtcgcaccggccgtcgcaatttctccacccttga

SEQ ID NO: 153614 - DNA, 37 bp, Artificial Sequence
  Synthetic oligonucleotide
aaccccggcacccccgccgcgataatacctcctttga

SEQ ID NO: 153615 - DNA, 38 bp, Artificial Sequence
  Synthetic oligonucleotide
tgtaccgccgccgaatcccctcctgatctcgtctttga

SEQ ID NO: 153616 - DNA, 35 bp, Artificial Sequence
  Synthetic oligonucleotide
gcatatgcctctctcgcccctcgcctcaagacgta

SEQ ID NO: 153617 - DNA, 36 bp, Artificial Sequence
  Synthetic oligonucleotide
tccctccgatcctgttcacgcgtactaccccgcgta

SEQ ID NO: 153618 - DNA, 35 bp, Artificial Sequence
  Synthetic oligonucleotide
acccccccgcccgttcgtcgacaaagtgtccggta

SEQ ID NO: 153619 - DNA, 36 bp, Artificial Sequence
  Synthetic oligonucleotide
ttgcccctggctaacatcatgccctcctgacctgta

SEQ ID NO: 153620 - DNA, 36 bp, Artificial Sequence
  Synthetic oligonucleotide
tgcatccgcttcccattcgcattccaccatgctgta

SEQ ID NO: 153621 - DNA, 35 bp, Artificial Sequence
  Synthetic oligonucleotide
gccacgatccaccttatccgaagtctacgctacac

SEQ ID NO: 153622 - DNA, 35 bp, Artificial Sequence
  Synthetic oligonucleotide
gtcacagtgcccattctattgactgtctactccac

SEQ ID NO: 153623 - DNA, 35 bp, Artificial Sequence
  Synthetic oligonucleotide
accggctcggtagcatcttcatccgtgccttccac

SEQ ID NO: 153624 - DNA, 35 bp, Artificial Sequence
  Synthetic oligonucleotide
gagaacagggtggaggggatagagcgccggacgac

SEQ ID NO: 153625 - DNA, 34 bp, Artificial Sequence
  Synthetic oligonucleotide
tagctcaccccaggtatggaacacacgctctacc

SEQ ID NO: 153626 - DNA, 35 bp, Artificial Sequence
  Synthetic oligonucleotide
tacccgtctttgcgtgcatcatccgctcactaccc

SEQ ID NO: 153627 - DNA, 35 bp, Artificial Sequence
  Synthetic oligonucleotide
acccagtgcagaaaactccccgatcctccccggcc

SEQ ID NO: 153628 - DNA, 35 bp, Artificial Sequence
  Synthetic oligonucleotide
agccggtccccatatctgcgcacgctgtttctgcc

SEQ ID NO: 153629 - DNA, 35 bp, Artificial Sequence
  Synthetic oligonucleotide
atgcgacaccgcatatatagtctcctttccaacgc

SEQ ID NO: 153630 - DNA, 35 bp, Artificial Sequence
  Synthetic oligonucleotide
tgccatgccttggtaccatcttaggccttccctgc

SEQ ID NO: 153631 - DNA, 35 bp, Artificial Sequence
  Synthetic oligonucleotide
ctgcactaccgccgaccgtacttgaacacccttgc

SEQ ID NO: 153632 - DNA, 35 bp, Artificial Sequence
  Synthetic oligonucleotide
accaccattggctgtgctttaattctatcccaatc

SEQ ID NO: 153633 - DNA, 35 bp, Artificial Sequence
  Synthetic oligonucleotide
tgtagccaccaatgatcccccccccccgacctctc

SEQ ID NO: 153634 - DNA, 34 bp, Artificial Sequence
  Synthetic oligonucleotide
ctgacccccctcgccgaccgctactgagcctgtc

SEQ ID NO: 153635 - DNA, 35 bp, Artificial Sequence
  Synthetic oligonucleotide
tgtggcaatcccagtgattactccgcctcccattc

SEQ ID NO: 153636 - DNA, 35 bp, Artificial Sequence
  Synthetic oligonucleotide
ggtcaacccgctgctaaacccagttatggtccttc

SEQ ID NO: 153637 - DNA, 35 bp, Artificial Sequence
  Synthetic oligonucleotide
gtctacccttcctcgtatgcaccaccttcgtgttc

SEQ ID NO: 153638 - DNA, 35 bp, Artificial Sequence
  Synthetic oligonucleotide
atcgccgctctggattacactggctgccctctttc

SEQ ID NO: 153639 - DNA, 35 bp, Artificial Sequence
  Synthetic oligonucleotide
gccacccctgcctgtacacttgcttagtgcttttc

SEQ ID NO: 153640 - DNA, 34 bp, Artificial Sequence
  Synthetic oligonucleotide
atagcggtgggagggccgggttgggaactacgag

SEQ ID NO: 153641 - DNA, 35 bp, Artificial Sequence
  Synthetic oligonucleotide
ggtcgcattcgcgggtagggagggatggggttgcg

SEQ ID NO: 153642 - DNA, 35 bp, Artificial Sequence
  Synthetic oligonucleotide
tccagttctaccgcacatgcttcaaaccgatctcg

SEQ ID NO: 153643 - DNA, 36 bp, Artificial Sequence
  Synthetic oligonucleotide
tagtaaaggggagggtgtgggtatgggtagagttcg

SEQ ID NO: 153644 - DNA, 35 bp, Artificial Sequence
  Synthetic oligonucleotide
tagcccgccctgcaattaagcaacttttcccctgg

SEQ ID NO: 153645 - DNA, 35 bp, Artificial Sequence
  Synthetic oligonucleotide
gccatccctgttcgtaccaggcttaactatcattg

SEQ ID NO: 153646 - DNA, 35 bp, Artificial Sequence
  Synthetic oligonucleotide
tcctcgcttctcatgcaccctagatcacgccctat

SEQ ID NO: 153647 - DNA, 35 bp, Artificial Sequence
  Synthetic oligonucleotide
gcgcgaacctcactgcttctctcacccctgtttat

SEQ ID NO: 153648 - DNA, 35 bp, Artificial Sequence
  Synthetic oligonucleotide
gaggtggggaggggacggattggtaaggaaaaact

SEQ ID NO: 153649 - DNA, 35 bp, Artificial Sequence
  Synthetic oligonucleotide
gctcaacgccagggtcttggcgcaactcctcacct

SEQ ID NO: 153650 - DNA, 34 bp, Artificial Sequence
  Synthetic oligonucleotide
tccgccccccgttcattatatctggtcttacgct

SEQ ID NO: 153651 - DNA, 35 bp, Artificial Sequence
  Synthetic oligonucleotide
actccagtctcgcaacatgctgctcatcccccgct

SEQ ID NO: 153652 - DNA, 35 bp, Artificial Sequence
  Synthetic oligonucleotide
acctgcgccattcagtccaccccagctgcaaatct

SEQ ID NO: 153653 - DNA, 35 bp, Artificial Sequence
  Synthetic oligonucleotide
atccgccctgcctcggattgcgctccgtccaatct

SEQ ID NO: 153654 - DNA, 35 bp, Artificial Sequence
  Synthetic oligonucleotide
gttgtcctcccgcacgtacccccatgtcaactggt

SEQ ID NO: 153655 - DNA, 35 bp, Artificial Sequence
  Synthetic oligonucleotide
tgcacttacacacccgttattttgcacatctttgt

SEQ ID NO: 153656 - DNA, 35 bp, Artificial Sequence
  Synthetic oligonucleotide
gccccgccacgccctcatgcaggtacccctccctt

SEQ ID NO: 153657 - DNA, 36 bp, Artificial Sequence
  Synthetic oligonucleotide
gccaacctccattccctctgcatctcatcttgtgtt

SEQ ID NO: 153658 - DNA, 35 bp, Artificial Sequence
  Synthetic oligonucleotide
aaacgacgtcaacatgtctccattgtcaccccttt

SEQ ID NO: 153659 - DNA, 35 bp, Artificial Sequence
  Synthetic oligonucleotide
aatccgcccgtatcctatctcccgcgccctcgttt

SEQ ID NO: 153660 - DNA, 36 bp, Artificial Sequence
  Synthetic oligonucleotide
tactgcccatccccatcgttatacgcgcggcttaaa

SEQ ID NO: 153661 - DNA, 34 bp, Artificial Sequence
  Synthetic oligonucleotide
gattggcctcacccccagcgcctctgtctggcca

SEQ ID NO: 153662 - DNA, 35 bp, Artificial Sequence
  Synthetic oligonucleotide
gccccgcgaacaagctctttattgccaacatgcca

SEQ ID NO: 153663 - DNA, 34 bp, Artificial Sequence
  Synthetic oligonucleotide
gtatgcacacactccagcggcacttcctcttcca

SEQ ID NO: 153664 - DNA, 35 bp, Artificial Sequence
  Synthetic oligonucleotide
tgtcaccctcacgagccgctagccgaccttttgca

SEQ ID NO: 153665 - DNA, 35 bp, Artificial Sequence
  Synthetic oligonucleotide
aaccatgtcgacaagaccctgcccgtacccattca

SEQ ID NO: 153666 - DNA, 36 bp, Artificial Sequence
  Synthetic oligonucleotide
gtcaccccgaacagggtaccctccgccccatcttca

SEQ ID NO: 153667 - DNA, 37 bp, Artificial Sequence
  Synthetic oligonucleotide
gcctactccctggtccccgctccaatccctgccaaga

SEQ ID NO: 153668 - DNA, 37 bp, Artificial Sequence
  Synthetic oligonucleotide
tctcgaccaatccgccctattcaggttcaccctccga

SEQ ID NO: 153669 - DNA, 35 bp, Artificial Sequence
  Synthetic oligonucleotide
tcccgctttcgccgctcgctgccatcttcaccgga

SEQ ID NO: 153670 - DNA, 37 bp, Artificial Sequence
  Synthetic oligonucleotide
gagaagggagtgcgagaaggtgggaagggggggcgga

SEQ ID NO: 153671 - DNA, 38 bp, Artificial Sequence
  Synthetic oligonucleotide
atgggagggtgacagatgggcgaagtagcgggggggga

SEQ ID NO: 153672 - DNA, 35 bp, Artificial Sequence
  Synthetic oligonucleotide
ggggccggcaggaaccatcactaggtgggggggga

SEQ ID NO: 153673 - DNA, 37 bp, Artificial Sequence
  Synthetic oligonucleotide
ttgcgaggggtgaaagggggaggacgatgcatgggga

SEQ ID NO: 153674 - DNA, 35 bp, Artificial Sequence
  Synthetic oligonucleotide
gaaaagcaccgctggggtgggcgggggaattggga

SEQ ID NO: 153675 - DNA, 38 bp, Artificial Sequence
  Synthetic oligonucleotide
tgaccggtactgttgccccgactcacttccatccatga

SEQ ID NO: 153676 - DNA, 37 bp, Artificial Sequence
  Synthetic oligonucleotide
acccaactcgccctcgttatgccgtctcgtcccttga

SEQ ID NO: 153677 - DNA, 35 bp, Artificial Sequence
  Synthetic oligonucleotide
tattacacccccctgccctttatatgtgcctttga

SEQ ID NO: 153678 - DNA, 38 bp, Artificial Sequence
  Synthetic oligonucleotide
gaggaagggtggggtgggttatggggcaagccgtttga

SEQ ID NO: 153679 - DNA, 36 bp, Artificial Sequence
  Synthetic oligonucleotide
gtcacgggggggtaatgggagcgatgggtatgcata

SEQ ID NO: 153680 - DNA, 35 bp, Artificial Sequence
  Synthetic oligonucleotide
accccccttttgtcccaccctccaatatgtgtata

SEQ ID NO: 153681 - DNA, 35 bp, Artificial Sequence
  Synthetic oligonucleotide
gtagactcgcatctggtttcccgttgttgcccaac

SEQ ID NO: 153682 - DNA, 35 bp, Artificial Sequence
  Synthetic oligonucleotide
acatgcgcacgtgtttttcctccgtcctgtaccac

SEQ ID NO: 153683 - DNA, 35 bp, Artificial Sequence
  Synthetic oligonucleotide
tacgtacatccttgccaattgcggagccttcccac

SEQ ID NO: 153684 - DNA, 35 bp, Artificial Sequence
  Synthetic oligonucleotide
gctccctctgctttcgttgttcctgcatatatacc

SEQ ID NO: 153685 - DNA, 35 bp, Artificial Sequence
  Synthetic oligonucleotide
gtgatccgtatgatctgccaggccctacttcaccc

SEQ ID NO: 153686 - DNA, 35 bp, Artificial Sequence
  Synthetic oligonucleotide
tttagcgtccatactcccggtggttctatctcgcc

SEQ ID NO: 153687 - DNA, 35 bp, Artificial Sequence
  Synthetic oligonucleotide
tgtccaccatcaattatggcctctctccacgtgcc

SEQ ID NO: 153688 - DNA, 35 bp, Artificial Sequence
  Synthetic oligonucleotide
ttgatttgctcccgtgagtaccacccaccccgtcc

SEQ ID NO: 153689 - DNA, 35 bp, Artificial Sequence
  Synthetic oligonucleotide
acccgcgcaatcaacaccatccacgtgcagcacgc

SEQ ID NO: 153690 - DNA, 35 bp, Artificial Sequence
  Synthetic oligonucleotide
tgcaccgaatacagctcttgttccaccttatacgc

SEQ ID NO: 153691 - DNA, 35 bp, Artificial Sequence
  Synthetic oligonucleotide
gacttgctctgtctgcaacaatactcccgtaccgc

SEQ ID NO: 153692 - DNA, 35 bp, Artificial Sequence
  Synthetic oligonucleotide
actccgtagagtgattatctacctgctctccccgc

SEQ ID NO: 153693 - DNA, 35 bp, Artificial Sequence
  Synthetic oligonucleotide
gtactctgtaagccgttttcatgccgtcctcccgc

SEQ ID NO: 153694 - DNA, 35 bp, Artificial Sequence
  Synthetic oligonucleotide
gtagtcgatcgatgcccgcccatctctgctccctc

SEQ ID NO: 153695 - DNA, 35 bp, Artificial Sequence
  Synthetic oligonucleotide
gccatggccgatagcaattccgccttcatcttctc

SEQ ID NO: 153696 - DNA, 35 bp, Artificial Sequence
  Synthetic oligonucleotide
tgttcgcgcaagtttccatgtctctcgcccgggtc

SEQ ID NO: 153697 - DNA, 35 bp, Artificial Sequence
  Synthetic oligonucleotide
tcccgccaacctctcgggttcccagatttcacttc

SEQ ID NO: 153698 - DNA, 35 bp, Artificial Sequence
  Synthetic oligonucleotide
acatctcgcccttctacgtatagacacccactttc

SEQ ID NO: 153699 - DNA, 35 bp, Artificial Sequence
  Synthetic oligonucleotide
tgccccctcacttccacaacctgttcgttccacag

SEQ ID NO: 153700 - DNA, 35 bp, Artificial Sequence
  Synthetic oligonucleotide
tcccatcagtacctgccggggcttctccactctcg

SEQ ID NO: 153701 - DNA, 35 bp, Artificial Sequence
  Synthetic oligonucleotide
tccggactggcccttcttgcgaccccattgcttgg

SEQ ID NO: 153702 - DNA, 35 bp, Artificial Sequence
  Synthetic oligonucleotide
tcccccacgatgtgttttttttctgtgttatcatg

SEQ ID NO: 153703 - DNA, 35 bp, Artificial Sequence
  Synthetic oligonucleotide
tgtgttgcctccgaccgtacctcccatactggcat

SEQ ID NO: 153704 - DNA, 35 bp, Artificial Sequence
  Synthetic oligonucleotide
gtaccgtcaatccctcctgatcaccgcactgctat

SEQ ID NO: 153705 - DNA, 35 bp, Artificial Sequence
  Synthetic oligonucleotide
tcatgtaaccgccattgactcaaactgttgtccct

SEQ ID NO: 153706 - DNA, 35 bp, Artificial Sequence
  Synthetic oligonucleotide
gcccccgttctaccgcttcctgtttggcctattct

SEQ ID NO: 153707 - DNA, 35 bp, Artificial Sequence
  Synthetic oligonucleotide
gccttcccctcaactgcattttcgtacgcctgctt

SEQ ID NO: 153708 - DNA, 35 bp, Artificial Sequence
  Synthetic oligonucleotide
ggtccgccctcactcagtcgctatttgtcgttctt

SEQ ID NO: 153709 - DNA, 35 bp, Artificial Sequence
  Synthetic oligonucleotide
ggggacgggtgggtaacgacaaaacgggaatggtt

SEQ ID NO: 153710 - DNA, 35 bp, Artificial Sequence
  Synthetic oligonucleotide
gtctgtgcccaatttgctgttccgccctttagttt

SEQ ID NO: 153711 - DNA, 36 bp, Artificial Sequence
  Synthetic oligonucleotide
tcgagccaccccccctgccgatctggtatcctgttt

SEQ ID NO: 153712 - DNA, 36 bp, Artificial Sequence
  Synthetic oligonucleotide
gttgagcggtcagcacctgtccacccactttttcaa

SEQ ID NO: 153713 - DNA, 36 bp, Artificial Sequence
  Synthetic oligonucleotide
gccaccccacctggtttctgtttgacgctgcaggaa

SEQ ID NO: 153714 - DNA, 36 bp, Artificial Sequence
  Synthetic oligonucleotide
acagcaccatcgtcctttgttcccgtcaccccgtaa

SEQ ID NO: 153715 - DNA, 35 bp, Artificial Sequence
  Synthetic oligonucleotide
tgtaccccgcacacgctcttggcctcttaagcaca

SEQ ID NO: 153716 - DNA, 36 bp, Artificial Sequence
  Synthetic oligonucleotide
aggagcacatacctgtctcttcgccttccgttccca

SEQ ID NO: 153717 - DNA, 30 bp, Artificial Sequence
  Synthetic oligonucleotide
tacatccccccttcctgcccgtatctagca

SEQ ID NO: 153718 - DNA, 37 bp, Artificial Sequence
  Synthetic oligonucleotide
gtgaagtcggtggagggggagagatcgtggggacaga

SEQ ID NO: 153719 - DNA, 37 bp, Artificial Sequence
  Synthetic oligonucleotide
actcgatgcacgccgcccccgtccgacccgtctcaga

SEQ ID NO: 153720 - DNA, 37 bp, Artificial Sequence
  Synthetic oligonucleotide
aagccggagtagtggggcgaagagggaggcagggaga

SEQ ID NO: 153721 - DNA, 35 bp, Artificial Sequence
  Synthetic oligonucleotide
ttgagcgcacctagtatttcacccccatgccccga

SEQ ID NO: 153722 - DNA, 37 bp, Artificial Sequence
  Synthetic oligonucleotide
atcggagggtgggtggggggtgcgctgttcgtgccga

SEQ ID NO: 153723 - DNA, 37 bp, Artificial Sequence
  Synthetic oligonucleotide
tgagcgtagaaagcacgggaaggaagggtgagggcga

SEQ ID NO: 153724 - DNA, 37 bp, Artificial Sequence
  Synthetic oligonucleotide
gtcaacccttcgatcttttgccccatcacagtctcga

SEQ ID NO: 153725 - DNA, 37 bp, Artificial Sequence
  Synthetic oligonucleotide
gtcacccttctcccatctcacgtagagcagttccgga

SEQ ID NO: 153726 - DNA, 37 bp, Artificial Sequence
  Synthetic oligonucleotide
tagcgtgcgggaacttagggcgggaatagggggcgga

SEQ ID NO: 153727 - DNA, 36 bp, Artificial Sequence
  Synthetic oligonucleotide
tgctaccaccttttgtgcagggcccttctcctcgga

SEQ ID NO: 153728 - DNA, 37 bp, Artificial Sequence
  Synthetic oligonucleotide
agcggagtgagatcggctgaagggggtcgggagggga

SEQ ID NO: 153729 - DNA, 37 bp, Artificial Sequence
  Synthetic oligonucleotide
acacgtggaggcgatagggtgggaagatgagggggga

SEQ ID NO: 153730 - DNA, 36 bp, Artificial Sequence
  Synthetic oligonucleotide
tccgttactccctcgcgcttatacagtactcctgga

SEQ ID NO: 153731 - DNA, 37 bp, Artificial Sequence
  Synthetic oligonucleotide
atctcccccgccctgcctccgttagcccagtgctgga

SEQ ID NO: 153732 - DNA, 38 bp, Artificial Sequence
  Synthetic oligonucleotide
gggtgggaggggcagaatagcgggaaggagggaaatga

SEQ ID NO: 153733 - DNA, 38 bp, Artificial Sequence
  Synthetic oligonucleotide
tcgagagcagatgtcatcgcacctcctaacccccctga

SEQ ID NO: 153734 - DNA, 38 bp, Artificial Sequence
  Synthetic oligonucleotide
tgatccggccaagcttgggtatccctctccgccgctga

SEQ ID NO: 153735 - DNA, 36 bp, Artificial Sequence
  Synthetic oligonucleotide
accgctgtagcattcccgctcccgtcccgaccgtga

SEQ ID NO: 153736 - DNA, 37 bp, Artificial Sequence
  Synthetic oligonucleotide
gaacatggactagtaatgggcgaaggagggggggtga

SEQ ID NO: 153737 - DNA, 36 bp, Artificial Sequence
  Synthetic oligonucleotide
tgcctctgcgttctcgcctctctttagccatcttga

SEQ ID NO: 153738 - DNA, 38 bp, Artificial Sequence
  Synthetic oligonucleotide
gccgccctcgctgcgtcttctgctcttctcatgtttga

SEQ ID NO: 153739 - DNA, 37 bp, Artificial Sequence
  Synthetic oligonucleotide
gattgcgtagttctgcttccctcgcccttcattttga

SEQ ID NO: 153740 - DNA, 38 bp, Artificial Sequence
  Synthetic oligonucleotide
tacgtcccgcctccgacgcgctacccctgcacttttga

SEQ ID NO: 153741 - DNA, 35 bp, Artificial Sequence
  Synthetic oligonucleotide
atactagccacccctgctcacacctgatctccgta

SEQ ID NO: 153742 - DNA, 35 bp, Artificial Sequence
  Synthetic oligonucleotide
gcattgccgccacacttcctccggaccacgtacac

SEQ ID NO: 153743 - DNA, 35 bp, Artificial Sequence
  Synthetic oligonucleotide
ggaacatccgcccgctgttgctatcccgctaccac

SEQ ID NO: 153744 - DNA, 35 bp, Artificial Sequence
  Synthetic oligonucleotide
atcggtccaagagctggccgcccccctcaccccac

SEQ ID NO: 153745 - DNA, 35 bp, Artificial Sequence
  Synthetic oligonucleotide
agacaacacgtttgccaaagctacacctcctcacc

SEQ ID NO: 153746 - DNA, 35 bp, Artificial Sequence
  Synthetic oligonucleotide
agcgtggtccctgctatcgtcatcgtttttctacc

SEQ ID NO: 153747 - DNA, 35 bp, Artificial Sequence
  Synthetic oligonucleotide
aagctggccggctagaccgtaactgtccctcgccc

SEQ ID NO: 153748 - DNA, 35 bp, Artificial Sequence
  Synthetic oligonucleotide
agtcgcctccaggtgactacctaccgcctttgccc

SEQ ID NO: 153749 - DNA, 35 bp, Artificial Sequence
  Synthetic oligonucleotide
gctggcggtcgcttccatacccccgcgtctctgcc

SEQ ID NO: 153750 - DNA, 35 bp, Artificial Sequence
  Synthetic oligonucleotide
tctggactaccgcctcatcttgtcccctattttcc

SEQ ID NO: 153751 - DNA, 35 bp, Artificial Sequence
  Synthetic oligonucleotide
gtcccccgccttttctcatgcagttaagtcgccgc

SEQ ID NO: 153752 - DNA, 35 bp, Artificial Sequence
  Synthetic oligonucleotide
attgtcctcgcttttcctgctgtaccccgtgaggc

SEQ ID NO: 153753 - DNA, 35 bp, Artificial Sequence
  Synthetic oligonucleotide
tttccagccccccgtcctagtcggcccctgccatc

SEQ ID NO: 153754 - DNA, 35 bp, Artificial Sequence
  Synthetic oligonucleotide
gccaaacctctctgtacgtaacattgctaccgatc

SEQ ID NO: 153755 - DNA, 35 bp, Artificial Sequence
  Synthetic oligonucleotide
agccatccctcctccgatccagtgcgttttttatc

SEQ ID NO: 153756 - DNA, 35 bp, Artificial Sequence
  Synthetic oligonucleotide
aatgccactgaccgtgcactcaccccggagtcctc

SEQ ID NO: 153757 - DNA, 35 bp, Artificial Sequence
  Synthetic oligonucleotide
tcgaaagccttgctccctcgccccagactttcctc

SEQ ID NO: 153758 - DNA, 35 bp, Artificial Sequence
  Synthetic oligonucleotide
gccacactcctctgccgtactcagccttcactctc

SEQ ID NO: 153759 - DNA, 35 bp, Artificial Sequence
  Synthetic oligonucleotide
aacacccgcacccttttttgctcccgacgctggtc

SEQ ID NO: 153760 - DNA, 35 bp, Artificial Sequence
  Synthetic oligonucleotide
acccctgctcacaattgctttgtacttccttggtc

SEQ ID NO: 153761 - DNA, 35 bp, Artificial Sequence
  Synthetic oligonucleotide
gatgattcgccccttcactgcgcaccgcctccttc

SEQ ID NO: 153762 - DNA, 35 bp, Artificial Sequence
  Synthetic oligonucleotide
tcaacgcccctcgcacgctcaacaccctccgccag

SEQ ID NO: 153763 - DNA, 35 bp, Artificial Sequence
  Synthetic oligonucleotide
gcctgccctccaagcacttcatcctgtcctcatgg

SEQ ID NO: 153764 - DNA, 35 bp, Artificial Sequence
  Synthetic oligonucleotide
acccgttccgcgtctttctgtcttcgtgccccatg

SEQ ID NO: 153765 - DNA, 35 bp, Artificial Sequence
  Synthetic oligonucleotide
tccgaacacatccatgcgcatttgcctcccttctg

SEQ ID NO: 153766 - DNA, 35 bp, Artificial Sequence
  Synthetic oligonucleotide
ggacgataagcaggtggcgtgaaggggggcgagtg

SEQ ID NO: 153767 - DNA, 35 bp, Artificial Sequence
  Synthetic oligonucleotide
attgtcccgcccgccccttacttctttcttgcgat

SEQ ID NO: 153768 - DNA, 35 bp, Artificial Sequence
  Synthetic oligonucleotide
tctccacctccgggctggagctatgacccatctat

SEQ ID NO: 153769 - DNA, 35 bp, Artificial Sequence
  Synthetic oligonucleotide
acgggagggagggagggcaattcatgtacttttat

SEQ ID NO: 153770 - DNA, 34 bp, Artificial Sequence
  Synthetic oligonucleotide
gccccctgcacctggccgaaacgagtgcgcctct

SEQ ID NO: 153771 - DNA, 35 bp, Artificial Sequence
  Synthetic oligonucleotide
acgaaagccaagggagggaggcggggagcgcgcgt

SEQ ID NO: 153772 - DNA, 35 bp, Artificial Sequence
  Synthetic oligonucleotide
ggtccacgcgctcgctcgtattcttcacccactgt

SEQ ID NO: 153773 - DNA, 35 bp, Artificial Sequence
  Synthetic oligonucleotide
tagccgtgctcgttcctcctgtgcacaccaatctt

SEQ ID NO: 153774 - DNA, 36 bp, Artificial Sequence
  Synthetic oligonucleotide
gcggttcacctccgatcctgtccttacccgtgcaaa

SEQ ID NO: 153775 - DNA, 35 bp, Artificial Sequence
  Synthetic oligonucleotide
tggtgagagaagggaggggtgtgagcgggtataaa

SEQ ID NO: 153776 - DNA, 36 bp, Artificial Sequence
  Synthetic oligonucleotide
aggaacaccgcctcgtagtcacttagcccctcttaa

SEQ ID NO: 153777 - DNA, 35 bp, Artificial Sequence
  Synthetic oligonucleotide
tgttcccccaccgatatccgctaatggagttacca

SEQ ID NO: 153778 - DNA, 35 bp, Artificial Sequence
  Synthetic oligonucleotide
gccgttctctctgctcgccacaattgttactgcca

SEQ ID NO: 153779 - DNA, 36 bp, Artificial Sequence
  Synthetic oligonucleotide
tgatcagtcgccttgctctgaactcttgaccccgca

SEQ ID NO: 153780 - DNA, 35 bp, Artificial Sequence
  Synthetic oligonucleotide
atttcgctccccccactgcccttgagaggcccgca

SEQ ID NO: 153781 - DNA, 36 bp, Artificial Sequence
  Synthetic oligonucleotide
attgtcccatccgatcttgaagattagcccgccgca

SEQ ID NO: 153782 - DNA, 36 bp, Artificial Sequence
  Synthetic oligonucleotide
atcgacccctccgcagttcctcacgcacttactaga

SEQ ID NO: 153783 - DNA, 37 bp, Artificial Sequence
  Synthetic oligonucleotide
agggacggggagctggacggggaagggagctggacga

SEQ ID NO: 153784 - DNA, 36 bp, Artificial Sequence
  Synthetic oligonucleotide
gccgcccgatcagtctcacattacctcaccccgcga

SEQ ID NO: 153785 - DNA, 37 bp, Artificial Sequence
  Synthetic oligonucleotide
attagggaacgcggtagggggaaaaaagggagggcga

SEQ ID NO: 153786 - DNA, 37 bp, Artificial Sequence
  Synthetic oligonucleotide
gccacgtccatcaattctcaccggcctgtctcctcga

SEQ ID NO: 153787 - DNA, 37 bp, Artificial Sequence
  Synthetic oligonucleotide
tgctacaccagtttcgaccacatcccgcacccttcga

SEQ ID NO: 153788 - DNA, 37 bp, Artificial Sequence
  Synthetic oligonucleotide
aaccagggggaggagagggacaggtgaagttcgagga

SEQ ID NO: 153789 - DNA, 37 bp, Artificial Sequence
  Synthetic oligonucleotide
agcgaacgggtttgaggcggtggaggctgggaaggga

SEQ ID NO: 153790 - DNA, 37 bp, Artificial Sequence
  Synthetic oligonucleotide
gaactaaggtgagggggtagggaggggatgtgcggga

SEQ ID NO: 153791 - DNA, 37 bp, Artificial Sequence
  Synthetic oligonucleotide
acatgggtgggcgggggatggacctagttacgtggga

SEQ ID NO: 153792 - DNA, 38 bp, Artificial Sequence
  Synthetic oligonucleotide
gggacgggcacgggtcgacaaaagggagggaatgatga

SEQ ID NO: 153793 - DNA, 38 bp, Artificial Sequence
  Synthetic oligonucleotide
acccccaccgactccagtcaattgcgacctcatcctga

SEQ ID NO: 153794 - DNA, 37 bp, Artificial Sequence
  Synthetic oligonucleotide
acaggagccagccgttgcatcaccccagccctcctga

SEQ ID NO: 153795 - DNA, 37 bp, Artificial Sequence
  Synthetic oligonucleotide
gcccatacgcatgtcctctaggttccattcttcctga

SEQ ID NO: 153796 - DNA, 37 bp, Artificial Sequence
  Synthetic oligonucleotide
gaggacaggtgagagggggacgggttgggaacagtga

SEQ ID NO: 153797 - DNA, 38 bp, Artificial Sequence
  Synthetic oligonucleotide
atctgggacgggtgggtcggggtacggaattacggtga

SEQ ID NO: 153798 - DNA, 37 bp, Artificial Sequence
  Synthetic oligonucleotide
atcaggggaggtgggcgggggggttccgatcgggtga

SEQ ID NO: 153799 - DNA, 38 bp, Artificial Sequence
  Synthetic oligonucleotide
ccccacccgctgttgctccctagttagtcccatcttga

SEQ ID NO: 153800 - DNA, 36 bp, Artificial Sequence
  Synthetic oligonucleotide
gtgccatcgatgttccatacccgaacttgcccccta

SEQ ID NO: 153801 - DNA, 36 bp, Artificial Sequence
  Synthetic oligonucleotide
accgccgggcgcagctgccacctttatactgtccta

SEQ ID NO: 153802 - DNA, 36 bp, Artificial Sequence
  Synthetic oligonucleotide
agacccgcctgccagctctcgtcctcacccgaatta

SEQ ID NO: 153803 - DNA, 34 bp, Artificial Sequence
  Synthetic oligonucleotide
gcaacctcccccctccgctgtcggtctgagatta

SEQ ID NO: 153804 - DNA, 35 bp, Artificial Sequence
  Synthetic oligonucleotide
gcaaccacaccttttggagcccgtacttcgcctta

SEQ ID NO: 153805 - DNA, 36 bp, Artificial Sequence
  Synthetic oligonucleotide
tgccccgccctacaaggttgatttcgccatgcttta

SEQ ID NO: 153806 - DNA, 35 bp, Artificial Sequence
  Synthetic oligonucleotide
agccccacatgtcattttcgttcaatgcctgcacc

SEQ ID NO: 153807 - DNA, 35 bp, Artificial Sequence
  Synthetic oligonucleotide
ataggccgctcttagctccagtcggctcttccccc

SEQ ID NO: 153808 - DNA, 35 bp, Artificial Sequence
  Synthetic oligonucleotide
tctggggcgtccagtcctgcacttgcttaccgccc

SEQ ID NO: 153809 - DNA, 34 bp, Artificial Sequence
  Synthetic oligonucleotide
attgcgacgcacgatagcgtcctagcccccgccc

SEQ ID NO: 153810 - DNA, 35 bp, Artificial Sequence
  Synthetic oligonucleotide
gtatccgccacaccagcgtttgtcaatggtctccc

SEQ ID NO: 153811 - DNA, 35 bp, Artificial Sequence
  Synthetic oligonucleotide
tcccgcccccatctctatctcatgtctctaatgcc

SEQ ID NO: 153812 - DNA, 34 bp, Artificial Sequence
  Synthetic oligonucleotide
atagtccatcatctccacatgcgataacgcctcc

SEQ ID NO: 153813 - DNA, 35 bp, Artificial Sequence
  Synthetic oligonucleotide
ccccgaccgctccctgtactggcacgtaatcttcc

SEQ ID NO: 153814 - DNA, 35 bp, Artificial Sequence
  Synthetic oligonucleotide
cccatccgcacgattagctcccgtcctgttcgcgc

SEQ ID NO: 153815 - DNA, 35 bp, Artificial Sequence
  Synthetic oligonucleotide
ttaagcccacgaatacgtctccgccccagctcggc

SEQ ID NO: 153816 - DNA, 35 bp, Artificial Sequence
  Synthetic oligonucleotide
tgtccattccccttcccccggggcctcgtgctatc

SEQ ID NO: 153817 - DNA, 35 bp, Artificial Sequence
  Synthetic oligonucleotide
gtcctctctccacggcctgtgcacgcacctctatc

SEQ ID NO: 153818 - DNA, 35 bp, Artificial Sequence
  Synthetic oligonucleotide
acgcccacgactactgacggtttactccgcgcctc

SEQ ID NO: 153819 - DNA, 35 bp, Artificial Sequence
  Synthetic oligonucleotide
acgctgtaccgcctccttcaccagagcccaatctc

SEQ ID NO: 153820 - DNA, 35 bp, Artificial Sequence
  Synthetic oligonucleotide
gcgaccacgcatggtcttagcatcatttactcttc

SEQ ID NO: 153821 - DNA, 35 bp, Artificial Sequence
  Synthetic oligonucleotide
aacactcgcgcacaatatgtgagcccccctgtttc

SEQ ID NO: 153822 - DNA, 35 bp, Artificial Sequence
  Synthetic oligonucleotide
gccaccctcacatttcgaatacaatcggagttttc

SEQ ID NO: 153823 - DNA, 35 bp, Artificial Sequence
  Synthetic oligonucleotide
attgaggggctggggaggcggaggttacggttacg

SEQ ID NO: 153824 - DNA, 35 bp, Artificial Sequence
  Synthetic oligonucleotide
taatcacgcccataaatgctcccgactcctttacg

SEQ ID NO: 153825 - DNA, 35 bp, Artificial Sequence
  Synthetic oligonucleotide
tcacctgggcacttcgccacttttcttctgtcctg

SEQ ID NO: 153826 - DNA, 35 bp, Artificial Sequence
  Synthetic oligonucleotide
tgatggaccacatgcagcctgttacgaccccattg

SEQ ID NO: 153827 - DNA, 35 bp, Artificial Sequence
  Synthetic oligonucleotide
gaccccacagccactatgttagtaccatcctttat

SEQ ID NO: 153828 - DNA, 35 bp, Artificial Sequence
  Synthetic oligonucleotide
tcgccatgccatgtgctccctcgtgtcccttgcct

SEQ ID NO: 153829 - DNA, 35 bp, Artificial Sequence
  Synthetic oligonucleotide
aagccccgctcaccgcctgacctctacattgcgct

SEQ ID NO: 153830 - DNA, 35 bp, Artificial Sequence
  Synthetic oligonucleotide
tttacaccatccgtacgtgcattcacctgccatct

SEQ ID NO: 153831 - DNA, 35 bp, Artificial Sequence
  Synthetic oligonucleotide
actccccgcactatctctttcgctcgaaggtatct

SEQ ID NO: 153832 - DNA, 35 bp, Artificial Sequence
  Synthetic oligonucleotide
ttagcaagaacggccccacgtcccacctcgcctct

SEQ ID NO: 153833 - DNA, 35 bp, Artificial Sequence
  Synthetic oligonucleotide
gaacccctgctcctaccctctgccgcccacgttgt

SEQ ID NO: 153834 - DNA, 35 bp, Artificial Sequence
  Synthetic oligonucleotide
agtgccgtcgtccgtcattctcttctgccccattt

SEQ ID NO: 153835 - DNA, 36 bp, Artificial Sequence
  Synthetic oligonucleotide
gaccagcccccacgatcgccgtttcgcgcttctaca

SEQ ID NO: 153836 - DNA, 35 bp, Artificial Sequence
  Synthetic oligonucleotide
gacgacctagtcgcttgctgcccacctgcccacca

SEQ ID NO: 153837 - DNA, 35 bp, Artificial Sequence
  Synthetic oligonucleotide
gcgtgtgagcctcatcgtcctgccatattacgcca

SEQ ID NO: 153838 - DNA, 36 bp, Artificial Sequence
  Synthetic oligonucleotide
atcgtcagaatccatcgcgcgccttgttcttctcca

SEQ ID NO: 153839 - DNA, 35 bp, Artificial Sequence
  Synthetic oligonucleotide
atcccaaccgagtatccaacgtgccctgtcttcca

SEQ ID NO: 153840 - DNA, 34 bp, Artificial Sequence
  Synthetic oligonucleotide
gcgcctccagcactatccgtccacacatctggca

SEQ ID NO: 153841 - DNA, 35 bp, Artificial Sequence
  Synthetic oligonucleotide
gcagacgcatcattctatcccgcctagccttatca

SEQ ID NO: 153842 - DNA, 37 bp, Artificial Sequence
  Synthetic oligonucleotide
acagaagagggaggacgacggaacatggaaggacaga

SEQ ID NO: 153843 - DNA, 36 bp, Artificial Sequence
  Synthetic oligonucleotide
tggtcaacccctaccgccgtatctatgcttccacga

SEQ ID NO: 153844 - DNA, 37 bp, Artificial Sequence
  Synthetic oligonucleotide
tagcacgcatcacccaatttccccctcgctgctccga

SEQ ID NO: 153845 - DNA, 37 bp, Artificial Sequence
  Synthetic oligonucleotide
tcctccgtccgacgattacatcgcctcttttcctcga

SEQ ID NO: 153846 - DNA, 36 bp, Artificial Sequence
  Synthetic oligonucleotide
tcactcccgcaccctcctgaatagcgtatccgcgga

SEQ ID NO: 153847 - DNA, 36 bp, Artificial Sequence
  Synthetic oligonucleotide
acacacgccttttccgccctcgccacagctccggga

SEQ ID NO: 153848 - DNA, 37 bp, Artificial Sequence
  Synthetic oligonucleotide
gaaagagcgcctaaggggagaatggggtggtagggga

SEQ ID NO: 153849 - DNA, 37 bp, Artificial Sequence
  Synthetic oligonucleotide
ttgggtaggtgggagcggttcgggggatatcggggga

SEQ ID NO: 153850 - DNA, 37 bp, Artificial Sequence
  Synthetic oligonucleotide
atagccacatgggggtcggggaagggatgcctgggga

SEQ ID NO: 153851 - DNA, 37 bp, Artificial Sequence
  Synthetic oligonucleotide
tttgaaggcgtcacacgtttgcccttcttcacctgga

SEQ ID NO: 153852 - DNA, 36 bp, Artificial Sequence
  Synthetic oligonucleotide
atcatcccaccgcttatcccgggaccccgccttgga

SEQ ID NO: 153853 - DNA, 38 bp, Artificial Sequence
  Synthetic oligonucleotide
gccgacggggtaaggccataagggagcaaggggaatga

SEQ ID NO: 153854 - DNA, 38 bp, Artificial Sequence
  Synthetic oligonucleotide
gacacctcctgatcttagcatagcgtgtttttccctga

SEQ ID NO: 153855 - DNA, 38 bp, Artificial Sequence
  Synthetic oligonucleotide
tcgagtaggaggaaggaagatagagggaaacctggtga

SEQ ID NO: 153856 - DNA, 37 bp, Artificial Sequence
  Synthetic oligonucleotide
ccacaacccatgagtctccgttcctgccgctagttga

SEQ ID NO: 153857 - DNA, 37 bp, Artificial Sequence
  Synthetic oligonucleotide
gcacccatcgttcgcctcgtacttccacctgatttga

SEQ ID NO: 153858 - DNA, 36 bp, Artificial Sequence
  Synthetic oligonucleotide
aacaggccgtgccttatcctcccttccgttgtgcta

SEQ ID NO: 153859 - DNA, 36 bp, Artificial Sequence
  Synthetic oligonucleotide
tactgcatccacatctctatcctttagcccgctcta

SEQ ID NO: 153860 - DNA, 36 bp, Artificial Sequence
  Synthetic oligonucleotide
gaggggtggtacgggggaagaagacaaccgcgagta

SEQ ID NO: 153861 - DNA, 36 bp, Artificial Sequence
  Synthetic oligonucleotide
tcagatggacagttgtagtagcagggggagggcgta

SEQ ID NO: 153862 - DNA, 35 bp, Artificial Sequence
  Synthetic oligonucleotide
ttggaccgctttcccatgcctatgccactctcgta

SEQ ID NO: 153863 - DNA, 36 bp, Artificial Sequence
  Synthetic oligonucleotide
ttcgcacccgaccgctctctctgctaccttacatta

SEQ ID NO: 153864 - DNA, 36 bp, Artificial Sequence
  Synthetic oligonucleotide
ttccgctccccccgttcgggctccaactggccttta

SEQ ID NO: 153865 - DNA, 35 bp, Artificial Sequence
  Synthetic oligonucleotide
agcgccgcccccaatcttctgctgccgacttttta

SEQ ID NO: 153866 - DNA, 35 bp, Artificial Sequence
  Synthetic oligonucleotide
acgctcgtgcatcattttccgttctatagtcccac

SEQ ID NO: 153867 - DNA, 35 bp, Artificial Sequence
  Synthetic oligonucleotide
acccgcaccgatccgaaaccgctcctagtttgcac

SEQ ID NO: 153868 - DNA, 35 bp, Artificial Sequence
  Synthetic oligonucleotide
gcttggtccttgtctttttccgccgcgatgccacc

SEQ ID NO: 153869 - DNA, 35 bp, Artificial Sequence
  Synthetic oligonucleotide
gggactgcccccctcagagccgattcagttccccc

SEQ ID NO: 153870 - DNA, 36 bp, Artificial Sequence
  Synthetic oligonucleotide
gtcacccctcaccattcgtacctagggatccgcccc

SEQ ID NO: 153871 - DNA, 35 bp, Artificial Sequence
  Synthetic oligonucleotide
tcacacctcgctcgccgcttaagggttgcctcccc

SEQ ID NO: 153872 - DNA, 35 bp, Artificial Sequence
  Synthetic oligonucleotide
gagactaacgaagcggaatcgcttaccctccgccc

SEQ ID NO: 153873 - DNA, 35 bp, Artificial Sequence
  Synthetic oligonucleotide
atggcccgccgcatctgaggaatgattcgcccgcc

SEQ ID NO: 153874 - DNA, 35 bp, Artificial Sequence
  Synthetic oligonucleotide
gctctagccacttctcgttccatcccggattcgcc

SEQ ID NO: 153875 - DNA, 35 bp, Artificial Sequence
  Synthetic oligonucleotide
tagaccgacctttatgcgtcccttcacaatctgcc

SEQ ID NO: 153876 - DNA, 35 bp, Artificial Sequence
  Synthetic oligonucleotide
acatcgtagccctacccactctgcgcgtgttatcc

SEQ ID NO: 153877 - DNA, 35 bp, Artificial Sequence
  Synthetic oligonucleotide
tgtggtgccatccctgccttttcggcccttggtcc

SEQ ID NO: 153878 - DNA, 35 bp, Artificial Sequence
  Synthetic oligonucleotide
ttcccgctggtgttaccgcttgtcacgcttattcc

SEQ ID NO: 153879 - DNA, 35 bp, Artificial Sequence
  Synthetic oligonucleotide
ggtctccgtagtccgccttatgcacgccctcttcc

SEQ ID NO: 153880 - DNA, 35 bp, Artificial Sequence
  Synthetic oligonucleotide
acccctcctaccggttatagcgagccctgttctgc

SEQ ID NO: 153881 - DNA, 35 bp, Artificial Sequence
  Synthetic oligonucleotide
ggtgtccttcctgctgagtcgcgacactcccttgc

SEQ ID NO: 153882 - DNA, 35 bp, Artificial Sequence
  Synthetic oligonucleotide
tggtactccgctccttctcttgcatttagcccatc

SEQ ID NO: 153883 - DNA, 35 bp, Artificial Sequence
  Synthetic oligonucleotide
aacccacatgcaataccgtatgacgcacgcacctc

SEQ ID NO: 153884 - DNA, 35 bp, Artificial Sequence
  Synthetic oligonucleotide
gtaggtcatcgcacgctgccataaccgcatccctc

SEQ ID NO: 153885 - DNA, 35 bp, Artificial Sequence
  Synthetic oligonucleotide
aacccgccactgcttgcggaatgccccctgtcctc

SEQ ID NO: 153886 - DNA, 35 bp, Artificial Sequence
  Synthetic oligonucleotide
tagcctacatcgctttgccgcctcactttacgctc

SEQ ID NO: 153887 - DNA, 35 bp, Artificial Sequence
  Synthetic oligonucleotide
gcttccatctgatccccccccgtcatgcactggtc

SEQ ID NO: 153888 - DNA, 35 bp, Artificial Sequence
  Synthetic oligonucleotide
tgacgacattttctgatccgtcttttgccctcccg

SEQ ID NO: 153889 - DNA, 35 bp, Artificial Sequence
  Synthetic oligonucleotide
gcacaaccctgtcacgttcgcctatgctcccttcg

SEQ ID NO: 153890 - DNA, 35 bp, Artificial Sequence
  Synthetic oligonucleotide
tacgtcccgccctctctgtctttcggactctttcg

SEQ ID NO: 153891 - DNA, 35 bp, Artificial Sequence
  Synthetic oligonucleotide
tagtgcggggccgggagtattgggtgtagggtgtg

SEQ ID NO: 153892 - DNA, 35 bp, Artificial Sequence
  Synthetic oligonucleotide
gcgacgcgatgacgctcgtcctgcccgttcctttg

SEQ ID NO: 153893 - DNA, 35 bp, Artificial Sequence
  Synthetic oligonucleotide
gcaagcctacgctgctgttccctcaacactatcat

SEQ ID NO: 153894 - DNA, 35 bp, Artificial Sequence
  Synthetic oligonucleotide
agaggagtaggggggggtcgtgggagatatgggat

SEQ ID NO: 153895 - DNA, 35 bp, Artificial Sequence
  Synthetic oligonucleotide
cccccaacgcccctgccccggtacgtactccaact

SEQ ID NO: 153896 - DNA, 35 bp, Artificial Sequence
  Synthetic oligonucleotide
ttctgcccctctcgtattctttggaacacatacct

SEQ ID NO: 153897 - DNA, 35 bp, Artificial Sequence
  Synthetic oligonucleotide
atccatggcacgtctctgcctctactggtgcccct

SEQ ID NO: 153898 - DNA, 35 bp, Artificial Sequence
  Synthetic oligonucleotide
tcacgcctccgcctaatgttctcggtactttccct

SEQ ID NO: 153899 - DNA, 35 bp, Artificial Sequence
  Synthetic oligonucleotide
gtcgtacttcgcatgtcggtcaggacccttctcct

SEQ ID NO: 153900 - DNA, 34 bp, Artificial Sequence
  Synthetic oligonucleotide
gactgactctgaccccgttcactcgccatgatct

SEQ ID NO: 153901 - DNA, 35 bp, Artificial Sequence
  Synthetic oligonucleotide
gtgccaacgtccctgggggcctattcgttcactct

SEQ ID NO: 153902 - DNA, 35 bp, Artificial Sequence
  Synthetic oligonucleotide
gagctgggtggggccgggcgggaaggtgaatcggt

SEQ ID NO: 153903 - DNA, 35 bp, Artificial Sequence
  Synthetic oligonucleotide
ttccatcataggatggccacctttccctgcctggt

SEQ ID NO: 153904 - DNA, 35 bp, Artificial Sequence
  Synthetic oligonucleotide
gctcagacggctctcgagtttacatcacctccctt

SEQ ID NO: 153905 - DNA, 36 bp, Artificial Sequence
  Synthetic oligonucleotide
gttcgcccaccacctgccgtccccataagctgtaaa

SEQ ID NO: 153906 - DNA, 36 bp, Artificial Sequence
  Synthetic oligonucleotide
gcccccgcgctggccgccatatacaccttcccgtaa

SEQ ID NO: 153907 - DNA, 35 bp, Artificial Sequence
  Synthetic oligonucleotide
attggtgggaaagtcgggaagaagcggggagacca

SEQ ID NO: 153908 - DNA, 34 bp, Artificial Sequence
  Synthetic oligonucleotide
atcagaccagcgcacttttagccacctccgccca

SEQ ID NO: 153909 - DNA, 35 bp, Artificial Sequence
  Synthetic oligonucleotide
acttcccccgtaccccgccacctcaccttggggca

SEQ ID NO: 153910 - DNA, 36 bp, Artificial Sequence
  Synthetic oligonucleotide
tgacggcgacgctgcatctccctctgcttacctgca

SEQ ID NO: 153911 - DNA, 36 bp, Artificial Sequence
  Synthetic oligonucleotide
aacgccggctgcctgctcctccttttctagccatca

SEQ ID NO: 153912 - DNA, 37 bp, Artificial Sequence
  Synthetic oligonucleotide
gaccgttaagggaggattagggagcatggaaggaaga

SEQ ID NO: 153913 - DNA, 37 bp, Artificial Sequence
  Synthetic oligonucleotide
gttaaggcgggcgggttgggggcatgggcggggcaga

SEQ ID NO: 153914 - DNA, 37 bp, Artificial Sequence
  Synthetic oligonucleotide
tctcagcacgcacgtccccgtcagcccatcctttaga

SEQ ID NO: 153915 - DNA, 37 bp, Artificial Sequence
  Synthetic oligonucleotide
atgtaaacgccgactcccatagccacctcgcacacga

SEQ ID NO: 153916 - DNA, 37 bp, Artificial Sequence
  Synthetic oligonucleotide
tccatcgcccccgtacggttttcaacacacgccccga

SEQ ID NO: 153917 - DNA, 37 bp, Artificial Sequence
  Synthetic oligonucleotide
gtcaacgacgcgccctgtcctttgtaaaccgcctcga

SEQ ID NO: 153918 - DNA, 35 bp, Artificial Sequence
  Synthetic oligonucleotide
acatcccgttcacgtcccccagcctatcccgtcga

SEQ ID NO: 153919 - DNA, 37 bp, Artificial Sequence
  Synthetic oligonucleotide
gtgggtggagacagtgtttgtgaaggatggagaagga

SEQ ID NO: 153920 - DNA, 37 bp, Artificial Sequence
  Synthetic oligonucleotide
ggggtgttggttgggcgtactgggaagggcgggagga

SEQ ID NO: 153921 - DNA, 36 bp, Artificial Sequence
  Synthetic oligonucleotide
ggtgataggggcggggcggggaaataaagaagggga

SEQ ID NO: 153922 - DNA, 37 bp, Artificial Sequence
  Synthetic oligonucleotide
gcgacggaaaaagggtggacatgatcggggcggggga

SEQ ID NO: 153923 - DNA, 35 bp, Artificial Sequence
  Synthetic oligonucleotide
gaagtggacaagaacggggatagaagtggggggga

SEQ ID NO: 153924 - DNA, 37 bp, Artificial Sequence
  Synthetic oligonucleotide
gttccgggcggtgttgtttggggtgtcgctctgggga

SEQ ID NO: 153925 - DNA, 37 bp, Artificial Sequence
  Synthetic oligonucleotide
actgggcgggcgggcatgggcagtagaggtgtgggga

SEQ ID NO: 153926 - DNA, 37 bp, Artificial Sequence
  Synthetic oligonucleotide
gtcaccccacaagctcaagcctcatcctcgctctgga

SEQ ID NO: 153927 - DNA, 37 bp, Artificial Sequence
  Synthetic oligonucleotide
taggtgcgctccatcccgctgccgtaatttgccatga

SEQ ID NO: 153928 - DNA, 38 bp, Artificial Sequence
  Synthetic oligonucleotide
gtcgggcgaagaagaggagggaacggggtgcagggtga

SEQ ID NO: 153929 - DNA, 38 bp, Artificial Sequence
  Synthetic oligonucleotide
gacacgggggggcaaaaccgggtgacctggtagggtga

SEQ ID NO: 153930 - DNA, 37 bp, Artificial Sequence
  Synthetic oligonucleotide
tgtgccccacctctgctttcactgttcagaccgttga

SEQ ID NO: 153931 - DNA, 37 bp, Artificial Sequence
  Synthetic oligonucleotide
aagacgggactgttgtaggggacgtgagggagggata

SEQ ID NO: 153932 - DNA, 36 bp, Artificial Sequence
  Synthetic oligonucleotide
gtcgcctccatgcactttcagtccaccgtagtccta

SEQ ID NO: 153933 - DNA, 36 bp, Artificial Sequence
  Synthetic oligonucleotide
gcatgctttagccgttctgacctacccctcttgcta

SEQ ID NO: 153934 - DNA, 35 bp, Artificial Sequence
  Synthetic oligonucleotide
gtcaccctggcttatgacgccgatcatcccttcta

SEQ ID NO: 153935 - DNA, 36 bp, Artificial Sequence
  Synthetic oligonucleotide
gtaccacctatgaccatgactgcctgtactcccgta

SEQ ID NO: 153936 - DNA, 35 bp, Artificial Sequence
  Synthetic oligonucleotide
taccgccacctgccgagccttcgtactcaggccac

SEQ ID NO: 153937 - DNA, 35 bp, Artificial Sequence
  Synthetic oligonucleotide
gccatccggactgaacgcactgccttacctcgcac

SEQ ID NO: 153938 - DNA, 35 bp, Artificial Sequence
  Synthetic oligonucleotide
tgtgttcccgtcatcctctactatggccgccgtac

SEQ ID NO: 153939 - DNA, 35 bp, Artificial Sequence
  Synthetic oligonucleotide
taagacgcccgctctgatcagctaacccatccacc

SEQ ID NO: 153940 - DNA, 35 bp, Artificial Sequence
  Synthetic oligonucleotide
gcgcccccggcctcggattctcgccgcctgccccc

SEQ ID NO: 153941 - DNA, 35 bp, Artificial Sequence
  Synthetic oligonucleotide
gccaccaagattggccacgtctgacgcgctccccc

SEQ ID NO: 153942 - DNA, 35 bp, Artificial Sequence
  Synthetic oligonucleotide
tagctacgagcagagtatcgcctcatcgcccgccc

SEQ ID NO: 153943 - DNA, 34 bp, Artificial Sequence
  Synthetic oligonucleotide
agtcgtagcgccgcctcgtcacctctagttgccc

SEQ ID NO: 153944 - DNA, 35 bp, Artificial Sequence
  Synthetic oligonucleotide
aacaccttacttgcgcaacagcgagcccttcatcc

SEQ ID NO: 153945 - DNA, 35 bp, Artificial Sequence
  Synthetic oligonucleotide
gtccgttcaatcgcttatacctatttgtccgctcc

SEQ ID NO: 153946 - DNA, 35 bp, Artificial Sequence
  Synthetic oligonucleotide
tgtgtgcctcgcctgattatccctgctgcccttcc

SEQ ID NO: 153947 - DNA, 35 bp, Artificial Sequence
  Synthetic oligonucleotide
taccgtcgtcgcacttttgcccccgctcatacagc

SEQ ID NO: 153948 - DNA, 35 bp, Artificial Sequence
  Synthetic oligonucleotide
aaggaccgagggggtggaggtcggaggagtgaggc

SEQ ID NO: 153949 - DNA, 35 bp, Artificial Sequence
  Synthetic oligonucleotide
tcacatgttccgagctttctgtcaccttaccgggc

SEQ ID NO: 153950 - DNA, 35 bp, Artificial Sequence
  Synthetic oligonucleotide
ttgcgtagcagaacgccttccaactccacgcctgc

SEQ ID NO: 153951 - DNA, 35 bp, Artificial Sequence
  Synthetic oligonucleotide
gatgctcaacctgttctatctcagccgtttttatc

SEQ ID NO: 153952 - DNA, 35 bp, Artificial Sequence
  Synthetic oligonucleotide
gactgttgccctgggtacttagctcatcgttactc

SEQ ID NO: 153953 - DNA, 35 bp, Artificial Sequence
  Synthetic oligonucleotide
aacgcactccgccggtgcatgtgccgtcgcccctc

SEQ ID NO: 153954 - DNA, 35 bp, Artificial Sequence
  Synthetic oligonucleotide
agacaaggtgccctgttcccggtctttactgcctc

SEQ ID NO: 153955 - DNA, 35 bp, Artificial Sequence
  Synthetic oligonucleotide
atgtgtagggggcacctcgcaatctttccttcctc

SEQ ID NO: 153956 - DNA, 35 bp, Artificial Sequence
  Synthetic oligonucleotide
aataccccgctgttttacgcctacctggtaacttc

SEQ ID NO: 153957 - DNA, 35 bp, Artificial Sequence
  Synthetic oligonucleotide
gactgcccttccgcactcgataattctctcctgag

SEQ ID NO: 153958 - DNA, 35 bp, Artificial Sequence
  Synthetic oligonucleotide
tacgttgtgcaggtcagttcttttctcgccatccg

SEQ ID NO: 153959 - DNA, 35 bp, Artificial Sequence
  Synthetic oligonucleotide
tgcctcacccagggccgtcctcgatctctcttgcg

SEQ ID NO: 153960 - DNA, 35 bp, Artificial Sequence
  Synthetic oligonucleotide
acaggtaacgggtgggagggagggaacgaccttgg

SEQ ID NO: 153961 - DNA, 35 bp, Artificial Sequence
  Synthetic oligonucleotide
gtgacccgagagtcggggggtagagggggggttgg

SEQ ID NO: 153962 - DNA, 35 bp, Artificial Sequence
  Synthetic oligonucleotide
gccctccccggttaacccgtcactgcagtcccctg

SEQ ID NO: 153963 - DNA, 35 bp, Artificial Sequence
  Synthetic oligonucleotide
ttgcgcctcttctgtccttcgtgcttcaccttctg

SEQ ID NO: 153964 - DNA, 35 bp, Artificial Sequence
  Synthetic oligonucleotide
acatccacttcaagcctccccgtccctgtctattg

SEQ ID NO: 153965 - DNA, 35 bp, Artificial Sequence
  Synthetic oligonucleotide
ggtgactcctctgtcctaaatgctcccactacttg

SEQ ID NO: 153966 - DNA, 35 bp, Artificial Sequence
  Synthetic oligonucleotide
tccaccactaggtcgtccctcctgccccggctgat

SEQ ID NO: 153967 - DNA, 35 bp, Artificial Sequence
  Synthetic oligonucleotide
tgcggtccctgccctgttatgttcgtgtttttcct

SEQ ID NO: 153968 - DNA, 35 bp, Artificial Sequence
  Synthetic oligonucleotide
taagtctccctccgccggctattcactaccatgct

SEQ ID NO: 153969 - DNA, 35 bp, Artificial Sequence
  Synthetic oligonucleotide
gcgggcaccctccccaccccccacttgcgtgacgt

SEQ ID NO: 153970 - DNA, 35 bp, Artificial Sequence
  Synthetic oligonucleotide
atcccccccagtacgcccacttcatgttctactgt

SEQ ID NO: 153971 - DNA, 35 bp, Artificial Sequence
  Synthetic oligonucleotide
tgacgcagagtacgtgccgcccctacccttattgt

SEQ ID NO: 153972 - DNA, 31 bp, Artificial Sequence
  Synthetic oligonucleotide
ggttgcatcgactgcactacccattaccctt

SEQ ID NO: 153973 - DNA, 35 bp, Artificial Sequence
  Synthetic oligonucleotide
atccccctcgaccacgcttgtcttgaccagttttt

SEQ ID NO: 153974 - DNA, 35 bp, Artificial Sequence
  Synthetic oligonucleotide
gttctagcaacagctcacaattccgtccccgttaa

SEQ ID NO: 153975 - DNA, 36 bp, Artificial Sequence
  Synthetic oligonucleotide
actccccgccccactagtaggacctctgaataccca

SEQ ID NO: 153976 - DNA, 35 bp, Artificial Sequence
  Synthetic oligonucleotide
caccaactgcccgccgtggcggtccgacctcccca

SEQ ID NO: 153977 - DNA, 35 bp, Artificial Sequence
  Synthetic oligonucleotide
tctcaatctgcatcacgcctccatacgcccgccca

SEQ ID NO: 153978 - DNA, 35 bp, Artificial Sequence
  Synthetic oligonucleotide
atccaggcctcacactagcactttgattcacgcca

SEQ ID NO: 153979 - DNA, 36 bp, Artificial Sequence
  Synthetic oligonucleotide
gaccaccaccgccaagtataccgatgtcgcgctcca

SEQ ID NO: 153980 - DNA, 36 bp, Artificial Sequence
  Synthetic oligonucleotide
ggagcatgccctcctttgcgcgctgtaaccacctca

SEQ ID NO: 153981 - DNA, 37 bp, Artificial Sequence
  Synthetic oligonucleotide
gttgacgatcgaagctggggagaggcggggggggcga

SEQ ID NO: 153982 - DNA, 35 bp, Artificial Sequence
  Synthetic oligonucleotide
gtactgccacctgctaccttacgactacgcttcga

SEQ ID NO: 153983 - DNA, 37 bp, Artificial Sequence
  Synthetic oligonucleotide
gggggcacggggaaacaaaaagggagcaggacaagga

SEQ ID NO: 153984 - DNA, 37 bp, Artificial Sequence
  Synthetic oligonucleotide
ttgccatcgggagggggggtaacggggcgtaagagga

SEQ ID NO: 153985 - DNA, 37 bp, Artificial Sequence
  Synthetic oligonucleotide
acccccatcagccgctgacgctccacccaagtacgga

SEQ ID NO: 153986 - DNA, 37 bp, Artificial Sequence
  Synthetic oligonucleotide
gtagtaagggtgagctgaagcgagagggaagggggga

SEQ ID NO: 153987 - DNA, 37 bp, Artificial Sequence
  Synthetic oligonucleotide
taccgcagtagcaatcccttaccatccgccgcctgga

SEQ ID NO: 153988 - DNA, 37 bp, Artificial Sequence
  Synthetic oligonucleotide
gtctgcccatcctgtccagagccccgccttcaactga

SEQ ID NO: 153989 - DNA, 37 bp, Artificial Sequence
  Synthetic oligonucleotide
tccttcaaccggtccgccaccatccgtccgcccctga

SEQ ID NO: 153990 - DNA, 38 bp, Artificial Sequence
  Synthetic oligonucleotide
tgcgcctccgctgtcgctctcctccatgcacgccctga

SEQ ID NO: 153991 - DNA, 37 bp, Artificial Sequence
  Synthetic oligonucleotide
acgaacgtacacgataatcctgcatcccccccgctga

SEQ ID NO: 153992 - DNA, 38 bp, Artificial Sequence
  Synthetic oligonucleotide
tgtccagtcctcccgtgcctatccgccttcttcgctga

SEQ ID NO: 153993 - DNA, 38 bp, Artificial Sequence
  Synthetic oligonucleotide
ttggccatccgtccagttttccgtgccactccttctga

SEQ ID NO: 153994 - DNA, 38 bp, Artificial Sequence
  Synthetic oligonucleotide
gcacccccccgcccgtgcgcccaactagaccgcggtga

SEQ ID NO: 153995 - DNA, 36 bp, Artificial Sequence
  Synthetic oligonucleotide
ggtgggaggcagtgagaggagtgggtggggcggtga

SEQ ID NO: 153996 - DNA, 38 bp, Artificial Sequence
  Synthetic oligonucleotide
agagcggcgaaaaggcgaaggcggggcgggaagggtga

SEQ ID NO: 153997 - DNA, 38 bp, Artificial Sequence
  Synthetic oligonucleotide
aaacgggggtacagtgatcgggggatcgggtggggtga

SEQ ID NO: 153998 - DNA, 38 bp, Artificial Sequence
  Synthetic oligonucleotide
actctcgccccccccagtctagccaccctacttggtga

SEQ ID NO: 153999 - DNA, 38 bp, Artificial Sequence
  Synthetic oligonucleotide
gagcaaaggccgggtagagggaggagagggctttgtga

SEQ ID NO: 154000 - DNA, 35 bp, Artificial Sequence
  Synthetic oligonucleotide
tgtgcaccttcgccatttttcaccgccttttgtga

SEQ ID NO: 154001 - DNA, 37 bp, Artificial Sequence
  Synthetic oligonucleotide
gttccattccgccatccgtgaccgcggccttccttga

SEQ ID NO: 154002 - DNA, 35 bp, Artificial Sequence
  Synthetic oligonucleotide
gttgttctccccccttcccatgagacacgttcata

SEQ ID NO: 154003 - DNA, 36 bp, Artificial Sequence
  Synthetic oligonucleotide
gtcccctttatgccgttaccaccgaggccttgccta

SEQ ID NO: 154004 - DNA, 36 bp, Artificial Sequence
  Synthetic oligonucleotide
gcgcatcggacactgccccacgcctgtttgttccta

SEQ ID NO: 154005 - DNA, 36 bp, Artificial Sequence
  Synthetic oligonucleotide
gatctgccccttgacgctctttatggaccatagcta

SEQ ID NO: 154006 - DNA, 35 bp, Artificial Sequence
  Synthetic oligonucleotide
aaggtgggatcgggtgggcaagggatcgctagcta

SEQ ID NO: 154007 - DNA, 35 bp, Artificial Sequence
  Synthetic oligonucleotide
gtgaggtccatcgaagcgtgcggccatctctccac

SEQ ID NO: 154008 - DNA, 35 bp, Artificial Sequence
  Synthetic oligonucleotide
actcctgcccccgcgtgacttcgaatctttgcgac

SEQ ID NO: 154009 - DNA, 35 bp, Artificial Sequence
  Synthetic oligonucleotide
tccaggttaccgccatcttgtgctgtcccttctac

SEQ ID NO: 154010 - DNA, 36 bp, Artificial Sequence
  Synthetic oligonucleotide
tgtctgcctccccattccgaactgtacccgtcgacc

SEQ ID NO: 154011 - DNA, 35 bp, Artificial Sequence
  Synthetic oligonucleotide
acaccaactgatgtcgtgttggctagtccgccccc

SEQ ID NO: 154012 - DNA, 35 bp, Artificial Sequence
  Synthetic oligonucleotide
gcctctccgccagacgttccgtcatgccctcgccc

SEQ ID NO: 154013 - DNA, 35 bp, Artificial Sequence
  Synthetic oligonucleotide
gacgaagcgctgttatagtggtctaccttcctccc

SEQ ID NO: 154014 - DNA, 35 bp, Artificial Sequence
  Synthetic oligonucleotide
ggtccctgaacccccgccccccagttttatagtcc

SEQ ID NO: 154015 - DNA, 35 bp, Artificial Sequence
  Synthetic oligonucleotide
gacccgccatccccttgagtgaactcatctggtcc

SEQ ID NO: 154016 - DNA, 35 bp, Artificial Sequence
  Synthetic oligonucleotide
agacgcggtcagggcgtctcacgttgttgccttcc

SEQ ID NO: 154017 - DNA, 35 bp, Artificial Sequence
  Synthetic oligonucleotide
gagacactcgaatgaattactccagccccgtttcc

SEQ ID NO: 154018 - DNA, 35 bp, Artificial Sequence
  Synthetic oligonucleotide
actcgcccgataagtttttggtcacatcctaccgc

SEQ ID NO: 154019 - DNA, 35 bp, Artificial Sequence
  Synthetic oligonucleotide
gcactctcacatcgcagctctgaccacccggccgc

SEQ ID NO: 154020 - DNA, 35 bp, Artificial Sequence
  Synthetic oligonucleotide
gaccctcctgtggaaatcgtccaatctcgccctgc

SEQ ID NO: 154021 - DNA, 35 bp, Artificial Sequence
  Synthetic oligonucleotide
gccgcatttcctcgactctcctcagtcccgcttgc

SEQ ID NO: 154022 - DNA, 35 bp, Artificial Sequence
  Synthetic oligonucleotide
atgcccctccttccctttcagcgcaagttccggtc

SEQ ID NO: 154023 - DNA, 35 bp, Artificial Sequence
  Synthetic oligonucleotide
gttcaccgtttgctactatctcccgtgtaacgttc

SEQ ID NO: 154024 - DNA, 35 bp, Artificial Sequence
  Synthetic oligonucleotide
taccgctcaggtccggcgctattcaacacccatag

SEQ ID NO: 154025 - DNA, 35 bp, Artificial Sequence
  Synthetic oligonucleotide
gtactcgcctatcactgtatttcatcatttttccg

SEQ ID NO: 154026 - DNA, 35 bp, Artificial Sequence
  Synthetic oligonucleotide
tcatgccgaccgtccccgcgttagcgtcacacctg

SEQ ID NO: 154027 - DNA, 35 bp, Artificial Sequence
  Synthetic oligonucleotide
tatgtctccggcagtcttaacatactcttaccctg

SEQ ID NO: 154028 - DNA, 35 bp, Artificial Sequence
  Synthetic oligonucleotide
ggagggggtgagggagggggcatgaatgaagcgtg

SEQ ID NO: 154029 - DNA, 37 bp, Artificial Sequence
  Synthetic oligonucleotide
ttgcacccggcacactcgagcacactgacccaccttg

SEQ ID NO: 154030 - DNA, 35 bp, Artificial Sequence
  Synthetic oligonucleotide
gaccatgcctcttaataccccctgtcatagttact

SEQ ID NO: 154031 - DNA, 35 bp, Artificial Sequence
  Synthetic oligonucleotide
gacgcgcccgccgcctactctgccgacacacgcct

SEQ ID NO: 154032 - DNA, 35 bp, Artificial Sequence
  Synthetic oligonucleotide
agatcgcgcttcagcctccacactatctctcgcct

SEQ ID NO: 154033 - DNA, 35 bp, Artificial Sequence
  Synthetic oligonucleotide
acgctccctcccttatgcactctccggcattgcct

SEQ ID NO: 154034 - DNA, 35 bp, Artificial Sequence
  Synthetic oligonucleotide
ggagcaactctgcgctccccctcaccgcaccctct

SEQ ID NO: 154035 - DNA, 35 bp, Artificial Sequence
  Synthetic oligonucleotide
gcccatccagtatgatcacgacaccattaccctct

SEQ ID NO: 154036 - DNA, 35 bp, Artificial Sequence
  Synthetic oligonucleotide
tgcagtaccacccgtgtaatcgcttcaccatccgt

SEQ ID NO: 154037 - DNA, 35 bp, Artificial Sequence
  Synthetic oligonucleotide
gccaccctcgctcaccgattgccgcccaatggcgt

SEQ ID NO: 154038 - DNA, 35 bp, Artificial Sequence
  Synthetic oligonucleotide
gttgcacccctcgacatgccccacgtctgcaaatt

SEQ ID NO: 154039 - DNA, 35 bp, Artificial Sequence
  Synthetic oligonucleotide
agccgggagccgctgttcgtttcactcgcttcctt

SEQ ID NO: 154040 - DNA, 36 bp, Artificial Sequence
  Synthetic oligonucleotide
ttccgcacttcctccgtctccgccctgtttccgaca

SEQ ID NO: 154041 - DNA, 36 bp, Artificial Sequence
  Synthetic oligonucleotide
tgcacacgctctaatttgaacttcctccgtacgcca

SEQ ID NO: 154042 - DNA, 36 bp, Artificial Sequence
  Synthetic oligonucleotide
gctccgccccggacccccttggatgctttagctcca

SEQ ID NO: 154043 - DNA, 36 bp, Artificial Sequence
  Synthetic oligonucleotide
actgcaccccggctcaatcaggcgccctcttctcca

SEQ ID NO: 154044 - DNA, 35 bp, Artificial Sequence
  Synthetic oligonucleotide
gagcccctttgcccctctctatgagtttttgtcca

SEQ ID NO: 154045 - DNA, 36 bp, Artificial Sequence
  Synthetic oligonucleotide
tcccggctcgccctgtttgcctcgtcttctattcca

SEQ ID NO: 154046 - DNA, 36 bp, Artificial Sequence
  Synthetic oligonucleotide
accaccctcataggccccgcaaacagcatcgctgca

SEQ ID NO: 154047 - DNA, 36 bp, Artificial Sequence
  Synthetic oligonucleotide
tgccgcaccatcccagccactgtttctttcaaatca

SEQ ID NO: 154048 - DNA, 35 bp, Artificial Sequence
  Synthetic oligonucleotide
attgtgtgaccacatctgtatccctggttttatca

SEQ ID NO: 154049 - DNA, 36 bp, Artificial Sequence
  Synthetic oligonucleotide
tgctggcctcgaaggtttttttgaccccgcccctca

SEQ ID NO: 154050 - DNA, 36 bp, Artificial Sequence
  Synthetic oligonucleotide
gcaggctcccgcccgtttttcaaggttctctgttca

SEQ ID NO: 154051 - DNA, 36 bp, Artificial Sequence
  Synthetic oligonucleotide
tcatcacacccggccacgagagccctccttttttca

SEQ ID NO: 154052 - DNA, 37 bp, Artificial Sequence
  Synthetic oligonucleotide
tcctgtccgcccgatctctttagtcaccatctttaga

SEQ ID NO: 154053 - DNA, 37 bp, Artificial Sequence
  Synthetic oligonucleotide
gacactacggtccggcctattccgctccatccctcga

SEQ ID NO: 154054 - DNA, 35 bp, Artificial Sequence
  Synthetic oligonucleotide
ttgaccctccgctgacctggcgtccccttattcga

SEQ ID NO: 154055 - DNA, 37 bp, Artificial Sequence
  Synthetic oligonucleotide
tacacctcgcatggttttcgtacccgcgcctcttcga

SEQ ID NO: 154056 - DNA, 37 bp, Artificial Sequence
  Synthetic oligonucleotide
tctgtgggagggtgggtaataggggatgacttttcga

SEQ ID NO: 154057 - DNA, 36 bp, Artificial Sequence
  Synthetic oligonucleotide
atgcgtacggcggggggggtgaaggggtacatcgga

SEQ ID NO: 154058 - DNA, 37 bp, Artificial Sequence
  Synthetic oligonucleotide
gggtggggagggtttagaatgagatgagtgttgggga

SEQ ID NO: 154059 - DNA, 37 bp, Artificial Sequence
  Synthetic oligonucleotide
agtaatggacgggcgggtaagtagacggggggctgga

SEQ ID NO: 154060 - DNA, 38 bp, Artificial Sequence
  Synthetic oligonucleotide
tcaaaccccgccgctgaaccacgcaccacgccacctga

SEQ ID NO: 154061 - DNA, 38 bp, Artificial Sequence
  Synthetic oligonucleotide
gaggggaaggaagaaatgtggaagggaagggtttgtga

SEQ ID NO: 154062 - DNA, 38 bp, Artificial Sequence
  Synthetic oligonucleotide
tatcgcgcccctgcctttctgccgtgacacacaattga

SEQ ID NO: 154063 - DNA, 38 bp, Artificial Sequence
  Synthetic oligonucleotide
taatcggaggcggatgggggaaggccttggtggtttga

SEQ ID NO: 154064 - DNA, 36 bp, Artificial Sequence
  Synthetic oligonucleotide
gaacgcccgccgctgaacaagccctacacctgaata

SEQ ID NO: 154065 - DNA, 36 bp, Artificial Sequence
  Synthetic oligonucleotide
tagtcgccctccttgcctctccatgctctagtgcta

SEQ ID NO: 154066 - DNA, 35 bp, Artificial Sequence
  Synthetic oligonucleotide
actgcccacaatatggtctctcgccggtcttgcta

SEQ ID NO: 154067 - DNA, 35 bp, Artificial Sequence
  Synthetic oligonucleotide
ggaacgcccgccctgtacatgtgacccgccgtaac

SEQ ID NO: 154068 - DNA, 35 bp, Artificial Sequence
  Synthetic oligonucleotide
gtctcgcagtacggtactttagctcgttctaccac

SEQ ID NO: 154069 - DNA, 35 bp, Artificial Sequence
  Synthetic oligonucleotide
ttaccagacggccccctgctccgacctattctcac

SEQ ID NO: 154070 - DNA, 35 bp, Artificial Sequence
  Synthetic oligonucleotide
gcctacaacctcacatctggactctctctggggac

SEQ ID NO: 154071 - DNA, 35 bp, Artificial Sequence
  Synthetic oligonucleotide
accgatccgtccatcctccaagctagtgtccatac

SEQ ID NO: 154072 - DNA, 35 bp, Artificial Sequence
  Synthetic oligonucleotide
ccacccctccacctatgcgactgcgccccttatac

SEQ ID NO: 154073 - DNA, 35 bp, Artificial Sequence
  Synthetic oligonucleotide
atggtaggccccccctggccttggtccacccaacc

SEQ ID NO: 154074 - DNA, 35 bp, Artificial Sequence
  Synthetic oligonucleotide
tgttgcgcccctacctttacacactggccgtaacc

SEQ ID NO: 154075 - DNA, 35 bp, Artificial Sequence
  Synthetic oligonucleotide
tctccccccaggtccacggggccaaatcttcgacc

SEQ ID NO: 154076 - DNA, 35 bp, Artificial Sequence
  Synthetic oligonucleotide
tgtctcccccttgctacttagtaaccggtttgacc

SEQ ID NO: 154077 - DNA, 35 bp, Artificial Sequence
  Synthetic oligonucleotide
atagtgcgcctgcttaattgtttacccgctctacc

SEQ ID NO: 154078 - DNA, 35 bp, Artificial Sequence
  Synthetic oligonucleotide
cacggtccgactctcatgccgcccttagatccccc

SEQ ID NO: 154079 - DNA, 35 bp, Artificial Sequence
  Synthetic oligonucleotide
ttgctacgtgcctgtcactcgcgccttttttgccc

SEQ ID NO: 154080 - DNA, 35 bp, Artificial Sequence
  Synthetic oligonucleotide
gcctcccccccggtggtagtacaacctgcgatccc

SEQ ID NO: 154081 - DNA, 35 bp, Artificial Sequence
  Synthetic oligonucleotide
ccagtgccgtttgtcccggtgtccctcccgttccc

SEQ ID NO: 154082 - DNA, 35 bp, Artificial Sequence
  Synthetic oligonucleotide
gtaagggcgggaaggggaagtgggcgcggggagcc

SEQ ID NO: 154083 - DNA, 35 bp, Artificial Sequence
  Synthetic oligonucleotide
tcgtgggctaccaatacgtttatcatcccgccgcc

SEQ ID NO: 154084 - DNA, 35 bp, Artificial Sequence
  Synthetic oligonucleotide
gccgctgtgcattcttggtcccgttccgtctcgcc

SEQ ID NO: 154085 - DNA, 35 bp, Artificial Sequence
  Synthetic oligonucleotide
tccccgccaagggattctggttcgacgcgccctcc

SEQ ID NO: 154086 - DNA, 35 bp, Artificial Sequence
  Synthetic oligonucleotide
taccatgccggtcctcatcatgccttaggcgctcc

SEQ ID NO: 154087 - DNA, 35 bp, Artificial Sequence
  Synthetic oligonucleotide
aacgcccccaaggccctccgtccctccttaggtcc

SEQ ID NO: 154088 - DNA, 35 bp, Artificial Sequence
  Synthetic oligonucleotide
tattaccaccgtgctcatcattcatacgctccagc

SEQ ID NO: 154089 - DNA, 35 bp, Artificial Sequence
  Synthetic oligonucleotide
tccaatgaccagtgccccgctgcccctgcactcgc

SEQ ID NO: 154090 - DNA, 35 bp, Artificial Sequence
  Synthetic oligonucleotide
tgttgcctgcccgttcccgatccaccgccctctgc

SEQ ID NO: 154091 - DNA, 35 bp, Artificial Sequence
  Synthetic oligonucleotide
ttgctccccctttcccgactcactttcttatgtgc

SEQ ID NO: 154092 - DNA, 35 bp, Artificial Sequence
  Synthetic oligonucleotide
tattccgtccacagttctcgcatatgtagcttctc

SEQ ID NO: 154093 - DNA, 35 bp, Artificial Sequence
  Synthetic oligonucleotide
gcccgccccgcccgtcgttcacccgttactctttc

SEQ ID NO: 154094 - DNA, 35 bp, Artificial Sequence
  Synthetic oligonucleotide
accgaagttgggtaggggtgggtgggggcgtgacg

SEQ ID NO: 154095 - DNA, 35 bp, Artificial Sequence
  Synthetic oligonucleotide
gggacccgccgctccgtctatgtccgcaattcccg

SEQ ID NO: 154096 - DNA, 35 bp, Artificial Sequence
  Synthetic oligonucleotide
attacctcatcatcgtacttggtcccgctgttccg

SEQ ID NO: 154097 - DNA, 35 bp, Artificial Sequence
  Synthetic oligonucleotide
accccatttcacttgttccgctttcctgccgtagg

SEQ ID NO: 154098 - DNA, 35 bp, Artificial Sequence
  Synthetic oligonucleotide
ggaaacgggcgggtgggcttatcgaattccctggg

SEQ ID NO: 154099 - DNA, 35 bp, Artificial Sequence
  Synthetic oligonucleotide
acccgtctcccctgcccactgactctctttccatg

SEQ ID NO: 154100 - DNA, 35 bp, Artificial Sequence
  Synthetic oligonucleotide
gtaccccgatccctctgactgcgtgacttacccat

SEQ ID NO: 154101 - DNA, 35 bp, Artificial Sequence
  Synthetic oligonucleotide
accgaccgccttcattcgcgctgcctgacagtcat

SEQ ID NO: 154102 - DNA, 35 bp, Artificial Sequence
  Synthetic oligonucleotide
gctgggggggacagcagaggggcgggcagagaact

SEQ ID NO: 154103 - DNA, 35 bp, Artificial Sequence
  Synthetic oligonucleotide
gttcgcagggccactccgtccgaccatattgctct

SEQ ID NO: 154104 - DNA, 35 bp, Artificial Sequence
  Synthetic oligonucleotide
ttgcacgctgtcttgtcgtcccctctccgccgtct

SEQ ID NO: 154105 - DNA, 34 bp, Artificial Sequence
  Synthetic oligonucleotide
gccatccgctttcgcgccacgttccgcactcctt

SEQ ID NO: 154106 - DNA, 35 bp, Artificial Sequence
  Synthetic oligonucleotide
ttaaacgtgcgccccctcactactgctgtctcctt

SEQ ID NO: 154107 - DNA, 35 bp, Artificial Sequence
  Synthetic oligonucleotide
gacgcaccctgttcacagccattccgcgctatctt

SEQ ID NO: 154108 - DNA, 35 bp, Artificial Sequence
  Synthetic oligonucleotide
gtgttgatgcatacgtcgtcagtccccgccctctt

SEQ ID NO: 154109 - DNA, 36 bp, Artificial Sequence
  Synthetic oligonucleotide
tgatctccatatgtccatcagccctgccacttcgaa

SEQ ID NO: 154110 - DNA, 34 bp, Artificial Sequence
  Synthetic oligonucleotide
aattcgccctctataccctgcggagacatcgtaa

SEQ ID NO: 154111 - DNA, 36 bp, Artificial Sequence
  Synthetic oligonucleotide
gcacgatccgctccccacgtccactgaggcttgcca

SEQ ID NO: 154112 - DNA, 35 bp, Artificial Sequence
  Synthetic oligonucleotide
gtactcgacatcagtcccctccatgcccgcctcca

SEQ ID NO: 154113 - DNA, 35 bp, Artificial Sequence
  Synthetic oligonucleotide
tcctactcccagcctgcgcatccgccctgatagca

SEQ ID NO: 154114 - DNA, 36 bp, Artificial Sequence
  Synthetic oligonucleotide
tcaccgcacctccgtattcagtcctcatacattgca

SEQ ID NO: 154115 - DNA, 36 bp, Artificial Sequence
  Synthetic oligonucleotide
gcgacccaagcccacgtcgcgcagacccccccctca

SEQ ID NO: 154116 - DNA, 36 bp, Artificial Sequence
  Synthetic oligonucleotide
taaccccgcctgaaactgggcatgaccgctccctca

SEQ ID NO: 154117 - DNA, 37 bp, Artificial Sequence
  Synthetic oligonucleotide
gaaccaacttccggcgtgtcccccttgcctttacaga

SEQ ID NO: 154118 - DNA, 37 bp, Artificial Sequence
  Synthetic oligonucleotide
ttgtatgcgttcgggaggggaggggtgaaggtggaga

SEQ ID NO: 154119 - DNA, 36 bp, Artificial Sequence
  Synthetic oligonucleotide
actcaccacctgtaacctctatactcgtcgcctaga

SEQ ID NO: 154120 - DNA, 37 bp, Artificial Sequence
  Synthetic oligonucleotide
gacggaggtaagggaaaaagcaatgggagcgcgtaga

SEQ ID NO: 154121 - DNA, 37 bp, Artificial Sequence
  Synthetic oligonucleotide
ggaggaggtggtgcgtgcggagagtgggcagggtaga

SEQ ID NO: 154122 - DNA, 36 bp, Artificial Sequence
  Synthetic oligonucleotide
gctgatgccagaactcctcctctacccgctctacga

SEQ ID NO: 154123 - DNA, 37 bp, Artificial Sequence
  Synthetic oligonucleotide
gcaaaacgtcaaatatcgttcatcccgccgcacccga

SEQ ID NO: 154124 - DNA, 37 bp, Artificial Sequence
  Synthetic oligonucleotide
gctgagcacggcacctatgtatcgctcccttatccga

SEQ ID NO: 154125 - DNA, 37 bp, Artificial Sequence
  Synthetic oligonucleotide
tgaagatgggacgagcgtaaaagagggtggggggcga

SEQ ID NO: 154126 - DNA, 37 bp, Artificial Sequence
  Synthetic oligonucleotide
tcaagggaatcatggtgaggggaacggggcaaacgga

SEQ ID NO: 154127 - DNA, 37 bp, Artificial Sequence
  Synthetic oligonucleotide
gcgagaggtcattggcggggggggtgatgggcgggga

SEQ ID NO: 154128 - DNA, 36 bp, Artificial Sequence
  Synthetic oligonucleotide
aaccggacttcctccgcccagttccgtgccatggga

SEQ ID NO: 154129 - DNA, 35 bp, Artificial Sequence
  Synthetic oligonucleotide
gatccctcctctgaacctcccccgtccgtgctgga

SEQ ID NO: 154130 - DNA, 38 bp, Artificial Sequence
  Synthetic oligonucleotide
gtgccgcctcccgacgctcgctcctcactctgttctga

SEQ ID NO: 154131 - DNA, 38 bp, Artificial Sequence
  Synthetic oligonucleotide
acctccacatccgagtactatttgcctttgccacgtga

SEQ ID NO: 154132 - DNA, 38 bp, Artificial Sequence
  Synthetic oligonucleotide
ggggcggggacagctggggttcaagatacagggggtga

SEQ ID NO: 154133 - DNA, 38 bp, Artificial Sequence
  Synthetic oligonucleotide
atgtcaagcctttgacgtcactcccgaccgccctttga

SEQ ID NO: 154134 - DNA, 36 bp, Artificial Sequence
  Synthetic oligonucleotide
gttacacctacccgtggcctcccagtcaatgtttga

SEQ ID NO: 154135 - DNA, 36 bp, Artificial Sequence
  Synthetic oligonucleotide
ggagagaggtaagggaagggcaaaggtcgtcaaata

SEQ ID NO: 154136 - DNA, 35 bp, Artificial Sequence
  Synthetic oligonucleotide
accccctgcccttgtatgcttgaagacactgcata

SEQ ID NO: 154137 - DNA, 36 bp, Artificial Sequence
  Synthetic oligonucleotide
tcacacagtatcatacgctgttgttttctccaccta

SEQ ID NO: 154138 - DNA, 35 bp, Artificial Sequence
  Synthetic oligonucleotide
gccttgccttacctggtacctccgctcggttccta

SEQ ID NO: 154139 - DNA, 36 bp, Artificial Sequence
  Synthetic oligonucleotide
accgtgcggacccatgcgcctctgtccctgtacgta

SEQ ID NO: 154140 - DNA, 36 bp, Artificial Sequence
  Synthetic oligonucleotide
gaacagatggggagtaggtgggaaatgtaggcggta

SEQ ID NO: 154141 - DNA, 36 bp, Artificial Sequence
  Synthetic oligonucleotide
tgaaaaccgggaggagtgtaacgagcgggaggggta

SEQ ID NO: 154142 - DNA, 35 bp, Artificial Sequence
  Synthetic oligonucleotide
tgtagggcctcacctgttctttatacattttgcac

SEQ ID NO: 154143 - DNA, 35 bp, Artificial Sequence
  Synthetic oligonucleotide
tctgtaccccgccttaattttcaggtttactagac

SEQ ID NO: 154144 - DNA, 35 bp, Artificial Sequence
  Synthetic oligonucleotide
tcatcacactcctgtggacacttcgcgcccatccc

SEQ ID NO: 154145 - DNA, 35 bp, Artificial Sequence
  Synthetic oligonucleotide
acgctccatgcctgttcccagctcgtttcgtcgcc

SEQ ID NO: 154146 - DNA, 35 bp, Artificial Sequence
  Synthetic oligonucleotide
tcgcacatcaccagcctgcggccattcctgctgcc

SEQ ID NO: 154147 - DNA, 35 bp, Artificial Sequence
  Synthetic oligonucleotide
tccactgccacacacgggtccagttaggtcttgcc

SEQ ID NO: 154148 - DNA, 35 bp, Artificial Sequence
  Synthetic oligonucleotide
agaacatcgctcacatcgattcttgatccacctgc

SEQ ID NO: 154149 - DNA, 34 bp, Artificial Sequence
  Synthetic oligonucleotide
gaccctgcctccactgttattgtaccgacccgtc

SEQ ID NO: 154150 - DNA, 35 bp, Artificial Sequence
  Synthetic oligonucleotide
aatactccccctcactgacccgctgctccccctag

SEQ ID NO: 154151 - DNA, 34 bp, Artificial Sequence
  Synthetic oligonucleotide
gagcgcactccatgtgccaactcccgatcccgcg

SEQ ID NO: 154152 - DNA, 35 bp, Artificial Sequence
  Synthetic oligonucleotide
agccggtccctgcactgtaacatctatttgtcgcg

SEQ ID NO: 154153 - DNA, 35 bp, Artificial Sequence
  Synthetic oligonucleotide
agcgagggggaggtgggactaagcaggtctcgtgg

SEQ ID NO: 154154 - DNA, 35 bp, Artificial Sequence
  Synthetic oligonucleotide
agcggatcgccctgtcctccaaactaccgcactat

SEQ ID NO: 154155 - DNA, 35 bp, Artificial Sequence
  Synthetic oligonucleotide
atacccagctccctcccaggttccgcgccctccct

SEQ ID NO: 154156 - DNA, 35 bp, Artificial Sequence
  Synthetic oligonucleotide
tgtctattcaccgtcagcccgtctcagcgcctcct

SEQ ID NO: 154157 - DNA, 32 bp, Artificial Sequence
  Synthetic oligonucleotide
tgtacgtcgcttactacgtgcgttttcttcct

SEQ ID NO: 154158 - DNA, 35 bp, Artificial Sequence
  Synthetic oligonucleotide
atgccaccccatttgtcttctcgttcgctttagct

SEQ ID NO: 154159 - DNA, 33 bp, Artificial Sequence
  Synthetic oligonucleotide
gcgggcccactgttgctcgccccctttaactgt

SEQ ID NO: 154160 - DNA, 35 bp, Artificial Sequence
  Synthetic oligonucleotide
gtggggcccccctgatttcagttacgttccctatt

SEQ ID NO: 154161 - DNA, 35 bp, Artificial Sequence
  Synthetic oligonucleotide
gacccgctttttgctgtttggtcgctactctcgtt

SEQ ID NO: 154162 - DNA, 35 bp, Artificial Sequence
  Synthetic oligonucleotide
attcgcaccccgtacaacggcacaaaccacccttt

SEQ ID NO: 154163 - DNA, 33 bp, Artificial Sequence
  Synthetic oligonucleotide
gatgcgcgcgcattttcttacctgtcctccttt

SEQ ID NO: 154164 - DNA, 35 bp, Artificial Sequence
  Synthetic oligonucleotide
gttgggcacctcccactcatggtttagtacctttt

SEQ ID NO: 154165 - DNA, 35 bp, Artificial Sequence
  Synthetic oligonucleotide
gagcattgcccgttcgccaccctttagccccgcaa

SEQ ID NO: 154166 - DNA, 36 bp, Artificial Sequence
  Synthetic oligonucleotide
tccacctgtacacacttgcacccttaacagacgtaa

SEQ ID NO: 154167 - DNA, 36 bp, Artificial Sequence
  Synthetic oligonucleotide
gccgatccatcggtttgtctcaccctttcattgtaa

SEQ ID NO: 154168 - DNA, 35 bp, Artificial Sequence
  Synthetic oligonucleotide
tcagggggggtggggaaaccagagatcgggattaa

SEQ ID NO: 154169 - DNA, 36 bp, Artificial Sequence
  Synthetic oligonucleotide
gtcccctcccctctgattataggccgaatctcgaca

SEQ ID NO: 154170 - DNA, 36 bp, Artificial Sequence
  Synthetic oligonucleotide
gacgctgtctacctgcgcttcgcctttctacgccca

SEQ ID NO: 154171 - DNA, 36 bp, Artificial Sequence
  Synthetic oligonucleotide
aagacgacgcccacattagtttgatcccaccgcgca

SEQ ID NO: 154172 - DNA, 35 bp, Artificial Sequence
  Synthetic oligonucleotide
gcctcgcgcctgtcgcgaaaactccctctcctgca

SEQ ID NO: 154173 - DNA, 36 bp, Artificial Sequence
  Synthetic oligonucleotide
ttcgccaccgactttcggtaacatacccctatctca

SEQ ID NO: 154174 - DNA, 34 bp, Artificial Sequence
  Synthetic oligonucleotide
tgctctgccgcccaacccttctcatcctgcgtca

SEQ ID NO: 154175 - DNA, 36 bp, Artificial Sequence
  Synthetic oligonucleotide
accccccgccgtacattgtcgacccatcttccttca

SEQ ID NO: 154176 - DNA, 37 bp, Artificial Sequence
  Synthetic oligonucleotide
gcaaccaaaaggttagagaaggaaaggggtggtacga

SEQ ID NO: 154177 - DNA, 37 bp, Artificial Sequence
  Synthetic oligonucleotide
gtagagggggtggagcggggtgagagcgtttgcgcga

SEQ ID NO: 154178 - DNA, 37 bp, Artificial Sequence
  Synthetic oligonucleotide
tgcaacccttcctccgcttcgcctacgcgactcgcga

SEQ ID NO: 154179 - DNA, 37 bp, Artificial Sequence
  Synthetic oligonucleotide
tcacatgggcctggtattccgccgttcactttctcga

SEQ ID NO: 154180 - DNA, 37 bp, Artificial Sequence
  Synthetic oligonucleotide
gtaggggaggggaatgatgactagacgggggggtcga

SEQ ID NO: 154181 - DNA, 37 bp, Artificial Sequence
  Synthetic oligonucleotide
acccaaccacacatggttggaatcacccccccttcga

SEQ ID NO: 154182 - DNA, 37 bp, Artificial Sequence
  Synthetic oligonucleotide
gaatggtgacggaggtttacgggaggaaaggtgcgga

SEQ ID NO: 154183 - DNA, 37 bp, Artificial Sequence
  Synthetic oligonucleotide
gtggggaggaatcgggagttcgggcgggatcaaggga

SEQ ID NO: 154184 - DNA, 35 bp, Artificial Sequence
  Synthetic oligonucleotide
atgggggaatacagaggggagatcgggagcaggga

SEQ ID NO: 154185 - DNA, 37 bp, Artificial Sequence
  Synthetic oligonucleotide
agggtgagggagggtgggtaacaaaccggatcgggga

SEQ ID NO: 154186 - DNA, 37 bp, Artificial Sequence
  Synthetic oligonucleotide
atgctgggtgggaatggggatacctgacatgggggga

SEQ ID NO: 154187 - DNA, 36 bp, Artificial Sequence
  Synthetic oligonucleotide
tcttacctcccgttgttttctgcccgcttgcttgga

SEQ ID NO: 154188 - DNA, 38 bp, Artificial Sequence
  Synthetic oligonucleotide
atcgatgtgtttcacgcctgcctccccctcacatatga

SEQ ID NO: 154189 - DNA, 37 bp, Artificial Sequence
  Synthetic oligonucleotide
gagacagaggtcaagcaggaaggagcagaaggtatga

SEQ ID NO: 154190 - DNA, 37 bp, Artificial Sequence
  Synthetic oligonucleotide
tctcaacgccagattttacatccgttcgctcccctga

SEQ ID NO: 154191 - DNA, 38 bp, Artificial Sequence
  Synthetic oligonucleotide
tacaccacccttgccgtttagtgcgcgtctcttcctga

SEQ ID NO: 154192 - DNA, 38 bp, Artificial Sequence
  Synthetic oligonucleotide
acctccaacccccgaaagttcattagttctgttcctga

SEQ ID NO: 154193 - DNA, 38 bp, Artificial Sequence
  Synthetic oligonucleotide
gatggacacaggggaagaggcggatggtcgggcggtga

SEQ ID NO: 154194 - DNA, 38 bp, Artificial Sequence
  Synthetic oligonucleotide
ggggccggtggcgcaatttattaaggtcgggggggtga

SEQ ID NO: 154195 - DNA, 37 bp, Artificial Sequence
  Synthetic oligonucleotide
tctgaccttccctccgctgcactcacggaacctgtga

SEQ ID NO: 154196 - DNA, 38 bp, Artificial Sequence
  Synthetic oligonucleotide
gattaccgtcacgtgcttaccatcggccccttctgtga

SEQ ID NO: 154197 - DNA, 37 bp, Artificial Sequence
  Synthetic oligonucleotide
gccggccccctcgctcctcctcctggacagtcgttga

SEQ ID NO: 154198 - DNA, 36 bp, Artificial Sequence
  Synthetic oligonucleotide
accggggtgggtgcacaaggggagggaccactcata

SEQ ID NO: 154199 - DNA, 36 bp, Artificial Sequence
  Synthetic oligonucleotide
tcagcaactttgttgtcccttcctccactcccacta

SEQ ID NO: 154200 - DNA, 36 bp, Artificial Sequence
  Synthetic oligonucleotide
gccaggttcccgccacttctcgtccttctgggacta

SEQ ID NO: 154201 - DNA, 36 bp, Artificial Sequence
  Synthetic oligonucleotide
ggtccctccgccgtatccaccacttctcccggggta

SEQ ID NO: 154202 - DNA, 36 bp, Artificial Sequence
  Synthetic oligonucleotide
ggggggggagggaaggctgatggaaatatgatggta

SEQ ID NO: 154203 - DNA, 36 bp, Artificial Sequence
  Synthetic oligonucleotide
attgccgagggggtggtaggagggatgggcgggtta

SEQ ID NO: 154204 - DNA, 35 bp, Artificial Sequence
  Synthetic oligonucleotide
ttccaccgcatgcctgttacaccctgtgggtacac

SEQ ID NO: 154205 - DNA, 35 bp, Artificial Sequence
  Synthetic oligonucleotide
tgcccggacacttcgcctcccgtctcgcctaccac

SEQ ID NO: 154206 - DNA, 35 bp, Artificial Sequence
  Synthetic oligonucleotide
ggacgctatccctgatctcacgctgaccattgcac

SEQ ID NO: 154207 - DNA, 35 bp, Artificial Sequence
  Synthetic oligonucleotide
gaggtggaaggatgcatgggcggaggggtggtcac

SEQ ID NO: 154208 - DNA, 35 bp, Artificial Sequence
  Synthetic oligonucleotide
attgtagcacgggtcctgtcctccccccgattcac

SEQ ID NO: 154209 - DNA, 35 bp, Artificial Sequence
  Synthetic oligonucleotide
gttccgttcctctgagggcgatccatcttacttac

SEQ ID NO: 154210 - DNA, 35 bp, Artificial Sequence
  Synthetic oligonucleotide
gatccacccgcccttggagtacgaccgtactttac

SEQ ID NO: 154211 - DNA, 35 bp, Artificial Sequence
  Synthetic oligonucleotide
gttactcccgatgctttctgttcctggtttatacc

SEQ ID NO: 154212 - DNA, 35 bp, Artificial Sequence
  Synthetic oligonucleotide
gcccccctccatatcaagaggcacgttaacttacc

SEQ ID NO: 154213 - DNA, 35 bp, Artificial Sequence
  Synthetic oligonucleotide
acattgctcgtcgccctaccggtgaactgctcccc

SEQ ID NO: 154214 - DNA, 35 bp, Artificial Sequence
  Synthetic oligonucleotide
gtcatcccttatgcattatcgctggcccaccgccc

SEQ ID NO: 154215 - DNA, 35 bp, Artificial Sequence
  Synthetic oligonucleotide
gaatcccgcctgaacggcaccaccaccctccgtcc

SEQ ID NO: 154216 - DNA, 35 bp, Artificial Sequence
  Synthetic oligonucleotide
ttacgccctcagccgtcccccgatgctccgggtcc

SEQ ID NO: 154217 - DNA, 35 bp, Artificial Sequence
  Synthetic oligonucleotide
actctggcgctagtagctttcttattgtcccttcc

SEQ ID NO: 154218 - DNA, 35 bp, Artificial Sequence
  Synthetic oligonucleotide
ttacacttcatcattcgcatattatccacgctcgc

SEQ ID NO: 154219 - DNA, 35 bp, Artificial Sequence
  Synthetic oligonucleotide
gccaactcctcctgcttatcataagactattcggc

SEQ ID NO: 154220 - DNA, 35 bp, Artificial Sequence
  Synthetic oligonucleotide
gccccaatagttgcatcctgtccattttctctggc

SEQ ID NO: 154221 - DNA, 35 bp, Artificial Sequence
  Synthetic oligonucleotide
acctcaacctcgttttgtctgcccatcacgttggc

SEQ ID NO: 154222 - DNA, 35 bp, Artificial Sequence
  Synthetic oligonucleotide
gctcaagtagggtcgggagggaatgaagggacatc

SEQ ID NO: 154223 - DNA, 35 bp, Artificial Sequence
  Synthetic oligonucleotide
gttgagccccttcacatgattatgtccgcttcatc

SEQ ID NO: 154224 - DNA, 34 bp, Artificial Sequence
  Synthetic oligonucleotide
tcagcacgcattccgcgaccccctttctgtactc

SEQ ID NO: 154225 - DNA, 35 bp, Artificial Sequence
  Synthetic oligonucleotide
gcaccccctctttcgcttttcatgagcatttactc

SEQ ID NO: 154226 - DNA, 35 bp, Artificial Sequence
  Synthetic oligonucleotide
atcacataccaccgccaggccgctcctatttactc

SEQ ID NO: 154227 - DNA, 35 bp, Artificial Sequence
  Synthetic oligonucleotide
tacgtcagtaggctctttagttcttgttgtccctc

SEQ ID NO: 154228 - DNA, 35 bp, Artificial Sequence
  Synthetic oligonucleotide
tgactcctcgacgtgtttcgatttcggtccttctc

SEQ ID NO: 154229 - DNA, 35 bp, Artificial Sequence
  Synthetic oligonucleotide
ttgttcaccccgcctcgattatatacgttctagtc

SEQ ID NO: 154230 - DNA, 35 bp, Artificial Sequence
  Synthetic oligonucleotide
tctctacccagtgttttctgcatccaccactgttc

SEQ ID NO: 154231 - DNA, 35 bp, Artificial Sequence
  Synthetic oligonucleotide
gtggagctcgcttttgtctgtctgtatccctgttc

SEQ ID NO: 154232 - DNA, 35 bp, Artificial Sequence
  Synthetic oligonucleotide
atgatcaggagggaggaggaacgcgcacgagaaag

SEQ ID NO: 154233 - DNA, 35 bp, Artificial Sequence
  Synthetic oligonucleotide
atacctcctcatctgatcccacctcccgcaaggag

SEQ ID NO: 154234 - DNA, 35 bp, Artificial Sequence
  Synthetic oligonucleotide
atcgctgtgctgtttcccccatatctccaacttag

SEQ ID NO: 154235 - DNA, 35 bp, Artificial Sequence
  Synthetic oligonucleotide
aaaagggaggaggcatgcgggggcacggaggaacg

SEQ ID NO: 154236 - DNA, 35 bp, Artificial Sequence
  Synthetic oligonucleotide
ttgtcctccaccacttaacatccgtaccagccacg

SEQ ID NO: 154237 - DNA, 35 bp, Artificial Sequence
  Synthetic oligonucleotide
tactccgacagcatacacctgcactcgccgactcg

SEQ ID NO: 154238 - DNA, 35 bp, Artificial Sequence
  Synthetic oligonucleotide
aaccctcaccacacgccttaaacgcagcccaccgg

SEQ ID NO: 154239 - DNA, 35 bp, Artificial Sequence
  Synthetic oligonucleotide
tccgagtcagatccgtattgttccctttttccctg

SEQ ID NO: 154240 - DNA, 35 bp, Artificial Sequence
  Synthetic oligonucleotide
aaagtgaacggtagttggggggaatgacaaaggtg

SEQ ID NO: 154241 - DNA, 35 bp, Artificial Sequence
  Synthetic oligonucleotide
gtcccccccctgtacgatcggaccataggtcgaat

SEQ ID NO: 154242 - DNA, 35 bp, Artificial Sequence
  Synthetic oligonucleotide
acttcgaggcgaaaaccgccgccggtccctgtact

SEQ ID NO: 154243 - DNA, 35 bp, Artificial Sequence
  Synthetic oligonucleotide
acgccccgagcaaacgccacagtgccccgatccct

SEQ ID NO: 154244 - DNA, 35 bp, Artificial Sequence
  Synthetic oligonucleotide
gccacatccgacactgaccactgccctttttgcct

SEQ ID NO: 154245 - DNA, 35 bp, Artificial Sequence
  Synthetic oligonucleotide
atcggggatacgtacggccggcctctccgcttcct

SEQ ID NO: 154246 - DNA, 35 bp, Artificial Sequence
  Synthetic oligonucleotide
agtggcaacaccacgtgggtccaggcccttcttct

SEQ ID NO: 154247 - DNA, 35 bp, Artificial Sequence
  Synthetic oligonucleotide
atcgccgaatcggcaattacacctgcttttcttct

SEQ ID NO: 154248 - DNA, 35 bp, Artificial Sequence
  Synthetic oligonucleotide
tgcctcgggccccagttgccacgtttacctcactt

SEQ ID NO: 154249 - DNA, 35 bp, Artificial Sequence
  Synthetic oligonucleotide
acactctgcttcctatctgccccgatcagttactt

SEQ ID NO: 154250 - DNA, 35 bp, Artificial Sequence
  Synthetic oligonucleotide
gttgtgaacccacccgccgacccagcaaatcgctt

SEQ ID NO: 154251 - DNA, 35 bp, Artificial Sequence
  Synthetic oligonucleotide
ttcgccatcacaatcgcgcagttcgccccttcttt

SEQ ID NO: 154252 - DNA, 36 bp, Artificial Sequence
  Synthetic oligonucleotide
ggtcgcgcaccccgtccgaagcctgtccatccaaca

SEQ ID NO: 154253 - DNA, 36 bp, Artificial Sequence
  Synthetic oligonucleotide
gtcaggcccactgtcgccacctactgtctttccaca

SEQ ID NO: 154254 - DNA, 36 bp, Artificial Sequence
  Synthetic oligonucleotide
ttccactcgcctcctccatgtttagccgatcctcca

SEQ ID NO: 154255 - DNA, 36 bp, Artificial Sequence
  Synthetic oligonucleotide
cctcaccacctgcggtttccttatcgtactgctcca

SEQ ID NO: 154256 - DNA, 36 bp, Artificial Sequence
  Synthetic oligonucleotide
tcgcacgtgctatacctggtcactccccgtcccgca

SEQ ID NO: 154257 - DNA, 35 bp, Artificial Sequence
  Synthetic oligonucleotide
gtgatatccgccccctctcgctgtgctcttgcgca

SEQ ID NO: 154258 - DNA, 36 bp, Artificial Sequence
  Synthetic oligonucleotide
ttgagtgaaagggggggtggtacggggagagatgca

SEQ ID NO: 154259 - DNA, 36 bp, Artificial Sequence
  Synthetic oligonucleotide
ttctccaccctcgtctagccccgcctgattgcatca

SEQ ID NO: 154260 - DNA, 36 bp, Artificial Sequence
  Synthetic oligonucleotide
tcgagcgcctaatctgtcttgtagcccggctcctca

SEQ ID NO: 154261 - DNA, 36 bp, Artificial Sequence
  Synthetic oligonucleotide
atggcactgcaccttctgctttggtgccacctttca

SEQ ID NO: 154262 - DNA, 37 bp, Artificial Sequence
  Synthetic oligonucleotide
gcggtggaaggggaaaggaacgggcggacctgagaga

SEQ ID NO: 154263 - DNA, 37 bp, Artificial Sequence
  Synthetic oligonucleotide
agcccatccccatatgttagtggcccacctgttacga

SEQ ID NO: 154264 - DNA, 37 bp, Artificial Sequence
  Synthetic oligonucleotide
tcaccacgcccccatctacgttattgtcactaaccga

SEQ ID NO: 154265 - DNA, 37 bp, Artificial Sequence
  Synthetic oligonucleotide
gcatccccccactcccgtcaggtccctatctacccga

SEQ ID NO: 154266 - DNA, 37 bp, Artificial Sequence
  Synthetic oligonucleotide
tcgcacccttcctgctattcctatcgatatgccccga

SEQ ID NO: 154267 - DNA, 37 bp, Artificial Sequence
  Synthetic oligonucleotide
ttggcatctctggccttgcacgttctcgccctctcga

SEQ ID NO: 154268 - DNA, 37 bp, Artificial Sequence
  Synthetic oligonucleotide
gaccacgcggtcgtgtcccctgtaccttgtgcttcga

SEQ ID NO: 154269 - DNA, 36 bp, Artificial Sequence
  Synthetic oligonucleotide
gaactgagggtccaggggggacaagggggggaagga

SEQ ID NO: 154270 - DNA, 37 bp, Artificial Sequence
  Synthetic oligonucleotide
tcagaggcggtggggtaatcagggggtcagaggagga

SEQ ID NO: 154271 - DNA, 37 bp, Artificial Sequence
  Synthetic oligonucleotide
tcagccacctgtttcccgcgtgccgttctgttccgga

SEQ ID NO: 154272 - DNA, 37 bp, Artificial Sequence
  Synthetic oligonucleotide
gagtgagagggaaggaagagcgggccagaaaggggga

SEQ ID NO: 154273 - DNA, 36 bp, Artificial Sequence
  Synthetic oligonucleotide
gccctcgtgccggatcacaccttactccccctggga

SEQ ID NO: 154274 - DNA, 38 bp, Artificial Sequence
  Synthetic oligonucleotide
cctcactgcgcaccgcccatagctactcttccccatga

SEQ ID NO: 154275 - DNA, 36 bp, Artificial Sequence
  Synthetic oligonucleotide
tgtgtgcacgctgctcgcactgttccatcaccctga

SEQ ID NO: 154276 - DNA, 36 bp, Artificial Sequence
  Synthetic oligonucleotide
acccccgtgcctctgtattcactacgttctccctga

SEQ ID NO: 154277 - DNA, 38 bp, Artificial Sequence
  Synthetic oligonucleotide
agggcgggaggggctttaaggggcccttaacatcctga

SEQ ID NO: 154278 - DNA, 38 bp, Artificial Sequence
  Synthetic oligonucleotide
tacatttacccgccctcacctatgatcacgctccgtga

SEQ ID NO: 154279 - DNA, 38 bp, Artificial Sequence
  Synthetic oligonucleotide
gcatgggtggaaggagggtggggtccgaacattggtga

SEQ ID NO: 154280 - DNA, 36 bp, Artificial Sequence
  Synthetic oligonucleotide
gatcacctgtcctttctctcttttgaggccacttga

SEQ ID NO: 154281 - DNA, 37 bp, Artificial Sequence
  Synthetic oligonucleotide
tgcacgctgcggctctgtctccttaatgccctcttga

SEQ ID NO: 154282 - DNA, 37 bp, Artificial Sequence
  Synthetic oligonucleotide
tctttccaccctctctgatatagttcctgcctgttga

SEQ ID NO: 154283 - DNA, 36 bp, Artificial Sequence
  Synthetic oligonucleotide
tcccccctgcagcgcttgctataccaccgcaactta

SEQ ID NO: 154284 - DNA, 36 bp, Artificial Sequence
  Synthetic oligonucleotide
actcaccccgattcctgcaggcccctcctccggtta

SEQ ID NO: 154285 - DNA, 36 bp, Artificial Sequence
  Synthetic oligonucleotide
gtctcctccctcgagccctatggtggtaccccaaac

SEQ ID NO: 154286 - DNA, 34 bp, Artificial Sequence
  Synthetic oligonucleotide
tcctccaccgccctgttgaatcttgtgcttacac

SEQ ID NO: 154287 - DNA, 35 bp, Artificial Sequence
  Synthetic oligonucleotide
ggtcccatccgtctgtcgctataaccctgccccac

SEQ ID NO: 154288 - DNA, 35 bp, Artificial Sequence
  Synthetic oligonucleotide
tgtccactgacctgcccacttgcgcccccgtgcac

SEQ ID NO: 154289 - DNA, 35 bp, Artificial Sequence
  Synthetic oligonucleotide
tcaccgatggtgcatctccttacctccgctatcac

SEQ ID NO: 154290 - DNA, 35 bp, Artificial Sequence
  Synthetic oligonucleotide
gagagggtgggatggtactcattgctccgggggac

SEQ ID NO: 154291 - DNA, 35 bp, Artificial Sequence
  Synthetic oligonucleotide
gaacctccactcgatcggtgccccctcgaatgacc

SEQ ID NO: 154292 - DNA, 35 bp, Artificial Sequence
  Synthetic oligonucleotide
gccttgttcgcgtgcccctccgccttagtaaaccc

SEQ ID NO: 154293 - DNA, 35 bp, Artificial Sequence
  Synthetic oligonucleotide
acccccgccccagaggaggtgaccgagctcgcccc

SEQ ID NO: 154294 - DNA, 35 bp, Artificial Sequence
  Synthetic oligonucleotide
gtgtcgcaggatacttcgcttttacccgttgcccc

SEQ ID NO: 154295 - DNA, 35 bp, Artificial Sequence
  Synthetic oligonucleotide
gtctaccctaggtccttcgtgctctggccgcctcc

SEQ ID NO: 154296 - DNA, 35 bp, Artificial Sequence
  Synthetic oligonucleotide
tgccctgaacagccagactaactcccccgtcctgc

SEQ ID NO: 154297 - DNA, 35 bp, Artificial Sequence
  Synthetic oligonucleotide
tacgctgtctacttttgtccctgacctgttctatc

SEQ ID NO: 154298 - DNA, 35 bp, Artificial Sequence
  Synthetic oligonucleotide
agtccacggtctagcccgccggtaattagcccctc

SEQ ID NO: 154299 - DNA, 35 bp, Artificial Sequence
  Synthetic oligonucleotide
gtggcccagcatcgctaagtcccctgcctctcctc

SEQ ID NO: 154300 - DNA, 35 bp, Artificial Sequence
  Synthetic oligonucleotide
agcgggttgcctgttgctgtcgttggttccctctc

SEQ ID NO: 154301 - DNA, 35 bp, Artificial Sequence
  Synthetic oligonucleotide
aactgccacacacttgtttagcctctccacttctc

SEQ ID NO: 154302 - DNA, 35 bp, Artificial Sequence
  Synthetic oligonucleotide
gggtgccggcattttatctcgctgccctcctagtc

SEQ ID NO: 154303 - DNA, 35 bp, Artificial Sequence
  Synthetic oligonucleotide
gctaaccgggagctgattgggggagggggggcaag

SEQ ID NO: 154304 - DNA, 35 bp, Artificial Sequence
  Synthetic oligonucleotide
acgcacctacacctactactcggaccatctctacg

SEQ ID NO: 154305 - DNA, 35 bp, Artificial Sequence
  Synthetic oligonucleotide
accgaccaccctggcttcacttcctttttcaggcg

SEQ ID NO: 154306 - DNA, 35 bp, Artificial Sequence
  Synthetic oligonucleotide
gcccccatctccgcactcgctcccgtctgcattgg

SEQ ID NO: 154307 - DNA, 35 bp, Artificial Sequence
  Synthetic oligonucleotide
ggaggggggcggcgaacgggatatacggatggctg

SEQ ID NO: 154308 - DNA, 35 bp, Artificial Sequence
  Synthetic oligonucleotide
accgacccgcatttgccgtcacacctgaggtccct

SEQ ID NO: 154309 - DNA, 35 bp, Artificial Sequence
  Synthetic oligonucleotide
ggtattcgttacagcgccatccttccttcccgcct

SEQ ID NO: 154310 - DNA, 36 bp, Artificial Sequence
  Synthetic oligonucleotide
ttcgctcgcgcagttccactatcatcatccgtgcct

SEQ ID NO: 154311 - DNA, 35 bp, Artificial Sequence
  Synthetic oligonucleotide
acgatccactttgggtttcttcacttcccgatcct

SEQ ID NO: 154312 - DNA, 35 bp, Artificial Sequence
  Synthetic oligonucleotide
accacagaaactgctttcatcatcaacaccttgct

SEQ ID NO: 154313 - DNA, 35 bp, Artificial Sequence
  Synthetic oligonucleotide
gtttgcgccgcgcagcttccgctcgacctgcctct

SEQ ID NO: 154314 - DNA, 35 bp, Artificial Sequence
  Synthetic oligonucleotide
tagtacgcacgccccgctcacaccccatcattcgt

SEQ ID NO: 154315 - DNA, 35 bp, Artificial Sequence
  Synthetic oligonucleotide
tcctgggcgggagtggcggaggggggcggattggt

SEQ ID NO: 154316 - DNA, 35 bp, Artificial Sequence
  Synthetic oligonucleotide
gtcctcgctctccgggtccttgattacatcctctt

SEQ ID NO: 154317 - DNA, 35 bp, Artificial Sequence
  Synthetic oligonucleotide
gacgaccctcctttgccttccttatttataaggtt

SEQ ID NO: 154318 - DNA, 35 bp, Artificial Sequence
  Synthetic oligonucleotide
gaggagggggcgggaggagagcgcagagcttccaa

SEQ ID NO: 154319 - DNA, 35 bp, Artificial Sequence
  Synthetic oligonucleotide
gggaagaaggtcggggggcgtgatcatgggggtaa

SEQ ID NO: 154320 - DNA, 36 bp, Artificial Sequence
  Synthetic oligonucleotide
acccatcatcagcgtacgtcacttccctccatgtaa

SEQ ID NO: 154321 - DNA, 36 bp, Artificial Sequence
  Synthetic oligonucleotide
tcacaccgtgcgcgcctctagcaccatctcacaaca

SEQ ID NO: 154322 - DNA, 36 bp, Artificial Sequence
  Synthetic oligonucleotide
gttccccaacgttgtctgctccagtcgaccccccca

SEQ ID NO: 154323 - DNA, 36 bp, Artificial Sequence
  Synthetic oligonucleotide
gcccacatcagtgattcatcctcctcgccttccgca

SEQ ID NO: 154324 - DNA, 36 bp, Artificial Sequence
  Synthetic oligonucleotide
tacgtactccgttgtccgtggcccatgcattcctca

SEQ ID NO: 154325 - DNA, 35 bp, Artificial Sequence
  Synthetic oligonucleotide
tcacgtttcctcggttccgtacagcccctgcttca

SEQ ID NO: 154326 - DNA, 37 bp, Artificial Sequence
  Synthetic oligonucleotide
gtggagaatagaacatggatggcgggaaggaggaaga

SEQ ID NO: 154327 - DNA, 37 bp, Artificial Sequence
  Synthetic oligonucleotide
gccggagggcaggaaggaaagggggaggtctttgaga

SEQ ID NO: 154328 - DNA, 36 bp, Artificial Sequence
  Synthetic oligonucleotide
agccgtgccctctttgtccctatgccctgttataga

SEQ ID NO: 154329 - DNA, 36 bp, Artificial Sequence
  Synthetic oligonucleotide
tcatatgccgcgctgttctcatcgtctcgcccccga

SEQ ID NO: 154330 - DNA, 37 bp, Artificial Sequence
  Synthetic oligonucleotide
ggtggtgcacagtgggatgggcgttggggggggccga

SEQ ID NO: 154331 - DNA, 37 bp, Artificial Sequence
  Synthetic oligonucleotide
accaacattccgtttggcccatgacactctcctccga

SEQ ID NO: 154332 - DNA, 37 bp, Artificial Sequence
  Synthetic oligonucleotide
tgatggaggaggggtggtgagggttaaacggactcga

SEQ ID NO: 154333 - DNA, 37 bp, Artificial Sequence
  Synthetic oligonucleotide
ttgcgagcctcccttattatgttctggccctactcga

SEQ ID NO: 154334 - DNA, 37 bp, Artificial Sequence
  Synthetic oligonucleotide
agcgtacggctccattcgtccctttgctccatctcga

SEQ ID NO: 154335 - DNA, 35 bp, Artificial Sequence
  Synthetic oligonucleotide
gccacctcgcgtacattacgccgattccctctcga

SEQ ID NO: 154336 - DNA, 37 bp, Artificial Sequence
  Synthetic oligonucleotide
tactgcgctcgccatcacctctatcctgtccgacgga

SEQ ID NO: 154337 - DNA, 37 bp, Artificial Sequence
  Synthetic oligonucleotide
atgagaggggaaatgggaatgatactgggtgggggga

SEQ ID NO: 154338 - DNA, 37 bp, Artificial Sequence
  Synthetic oligonucleotide
gccgtctccgccctcgacgccatcgtttcctactgga

SEQ ID NO: 154339 - DNA, 38 bp, Artificial Sequence
  Synthetic oligonucleotide
gcccacctaccgcccaattttatgacctgccacgctga

SEQ ID NO: 154340 - DNA, 38 bp, Artificial Sequence
  Synthetic oligonucleotide
ggagggaaacaaagaggaaatacggaagggcatggtga

SEQ ID NO: 154341 - DNA, 36 bp, Artificial Sequence
  Synthetic oligonucleotide
atcgtacccaggccacttgtctcgcgccacgcccta

SEQ ID NO: 154342 - DNA, 36 bp, Artificial Sequence
  Synthetic oligonucleotide
agacgacggggagtaaggtagtggggcaaggcggta

SEQ ID NO: 154343 - DNA, 35 bp, Artificial Sequence
  Synthetic oligonucleotide
gataccatgccgcctgaatggccttgactccctac

SEQ ID NO: 154344 - DNA, 35 bp, Artificial Sequence
  Synthetic oligonucleotide
tcatactttgccctcatgtcctccaagggaccacc

SEQ ID NO: 154345 - DNA, 35 bp, Artificial Sequence
  Synthetic oligonucleotide
tgccagactgcctccgaattgagcttacgccaccc

SEQ ID NO: 154346 - DNA, 35 bp, Artificial Sequence
  Synthetic oligonucleotide
ggtgccgcattaggtacttgcctcgccccggcccc

SEQ ID NO: 154347 - DNA, 35 bp, Artificial Sequence
  Synthetic oligonucleotide
ttgtgcacctttatccgtcctgtaaacacgttccc

SEQ ID NO: 154348 - DNA, 35 bp, Artificial Sequence
  Synthetic oligonucleotide
gcacattccgcaatgcttctgcgggctccttcgcc

SEQ ID NO: 154349 - DNA, 35 bp, Artificial Sequence
  Synthetic oligonucleotide
gttgcacgctcaccccttttagtcgccgattttcc

SEQ ID NO: 154350 - DNA, 35 bp, Artificial Sequence
  Synthetic oligonucleotide
acccaccttgtttcgatccgtaattacattcacgc

SEQ ID NO: 154351 - DNA, 35 bp, Artificial Sequence
  Synthetic oligonucleotide
tacctgtgcctgtttcgggatcatacaggttacgc

SEQ ID NO: 154352 - DNA, 35 bp, Artificial Sequence
  Synthetic oligonucleotide
gacattagcccgtggttcatcctgcagccctccgc

SEQ ID NO: 154353 - DNA, 35 bp, Artificial Sequence
  Synthetic oligonucleotide
tggtccgcctcactatcctccaccgcctgcactgc

SEQ ID NO: 154354 - DNA, 35 bp, Artificial Sequence
  Synthetic oligonucleotide
tgcccaattccacgtgctatcgttgttcctgcctc

SEQ ID NO: 154355 - DNA, 35 bp, Artificial Sequence
  Synthetic oligonucleotide
aaacactcactctgctgtcaagccaagccgctctc

SEQ ID NO: 154356 - DNA, 35 bp, Artificial Sequence
  Synthetic oligonucleotide
acaccccgctggacctcctcacacgcgacccggtc

SEQ ID NO: 154357 - DNA, 35 bp, Artificial Sequence
  Synthetic oligonucleotide
ggagtggggggaaggctggaaggaaacggtggttc

SEQ ID NO: 154358 - DNA, 35 bp, Artificial Sequence
  Synthetic oligonucleotide
agatcggcgcccagcgttttcgccatactcccccg

SEQ ID NO: 154359 - DNA, 35 bp, Artificial Sequence
  Synthetic oligonucleotide
tgaaatcccacacaatgactcacagcctatcctcg

SEQ ID NO: 154360 - DNA, 35 bp, Artificial Sequence
  Synthetic oligonucleotide
tactcatgtgcgtaccccactttatcgtgttcctg

SEQ ID NO: 154361 - DNA, 35 bp, Artificial Sequence
  Synthetic oligonucleotide
agactacatccgttcccctgtcccgcccatccgtg

SEQ ID NO: 154362 - DNA, 35 bp, Artificial Sequence
  Synthetic oligonucleotide
gtggaggcactgccctgccctcgttgtctacctat

SEQ ID NO: 154363 - DNA, 35 bp, Artificial Sequence
  Synthetic oligonucleotide
atgagcaaacacccgctatcattcgcctgggctct

SEQ ID NO: 154364 - DNA, 35 bp, Artificial Sequence
  Synthetic oligonucleotide
ttggcacgacattgcctttctagtccctatccctt

SEQ ID NO: 154365 - DNA, 36 bp, Artificial Sequence
  Synthetic oligonucleotide
gtgacgggtgtagggcgggaagggtcctattgtcaa

SEQ ID NO: 154366 - DNA, 36 bp, Artificial Sequence
  Synthetic oligonucleotide
gtcgccccaaggtctcctcgctccagttatgccgaa

SEQ ID NO: 154367 - DNA, 36 bp, Artificial Sequence
  Synthetic oligonucleotide
tgacacgcccacctgctctcagtgcaccgctccaca

SEQ ID NO: 154368 - DNA, 35 bp, Artificial Sequence
  Synthetic oligonucleotide
attcccgccagttctccccgttgacgcttggctca

SEQ ID NO: 154369 - DNA, 36 bp, Artificial Sequence
  Synthetic oligonucleotide
acggaacgcccaccacgcccctccttgcacgtttca

SEQ ID NO: 154370 - DNA, 37 bp, Artificial Sequence
  Synthetic oligonucleotide
gggtggggggggagggcaccgtgcgtacatagagaga

SEQ ID NO: 154371 - DNA, 36 bp, Artificial Sequence
  Synthetic oligonucleotide
acactacgccgatctccctacacttttgttgcacga

SEQ ID NO: 154372 - DNA, 37 bp, Artificial Sequence
  Synthetic oligonucleotide
aagcggaaggggaggtaagaaccgagaaggagggcga

SEQ ID NO: 154373 - DNA, 37 bp, Artificial Sequence
  Synthetic oligonucleotide
ggggggtgggagagaatagagagggttatgttggcga

SEQ ID NO: 154374 - DNA, 37 bp, Artificial Sequence
  Synthetic oligonucleotide
accagtcacgacccatgttcatggcatcccttctcga

SEQ ID NO: 154375 - DNA, 37 bp, Artificial Sequence
  Synthetic oligonucleotide
gtagccgaaaaggagtgcggatggggacggggcagga

SEQ ID NO: 154376 - DNA, 37 bp, Artificial Sequence
  Synthetic oligonucleotide
ttacggtagaggggacgggcggtgtgagcggggagga

SEQ ID NO: 154377 - DNA, 36 bp, Artificial Sequence
  Synthetic oligonucleotide
ttatggcgacgggtaactagggaggggctgggagga

SEQ ID NO: 154378 - DNA, 35 bp, Artificial Sequence
  Synthetic oligonucleotide
tacgctcctcccttctgttccgtttgagccccgga

SEQ ID NO: 154379 - DNA, 36 bp, Artificial Sequence
  Synthetic oligonucleotide
ggactggtcctgttctcgcgttcccccccggccgga

SEQ ID NO: 154380 - DNA, 37 bp, Artificial Sequence
  Synthetic oligonucleotide
tggaggagagtggggagtcgggcgggttgaagaggga

SEQ ID NO: 154381 - DNA, 37 bp, Artificial Sequence
  Synthetic oligonucleotide
ttagtgcatggcggaacggcgagttgggggaggggga

SEQ ID NO: 154382 - DNA, 37 bp, Artificial Sequence
  Synthetic oligonucleotide
agtaccccccgccttgtcctctcagccctggctatga

SEQ ID NO: 154383 - DNA, 38 bp, Artificial Sequence
  Synthetic oligonucleotide
gacgctgtcacatgctgctcgctctcccgcccccctga

SEQ ID NO: 154384 - DNA, 38 bp, Artificial Sequence
  Synthetic oligonucleotide
tcccaatccgtgtacacgccgtgctcctctcccggtga

SEQ ID NO: 154385 - DNA, 38 bp, Artificial Sequence
  Synthetic oligonucleotide
agaaagggccagggcgaagaggggggaagaaagggtga

SEQ ID NO: 154386 - DNA, 38 bp, Artificial Sequence
  Synthetic oligonucleotide
tgcctcgctccagtattccctcgcccttgcccatttga

SEQ ID NO: 154387 - DNA, 35 bp, Artificial Sequence
  Synthetic oligonucleotide
agaggggaggggcgggtctgctggggagttaccta

SEQ ID NO: 154388 - DNA, 35 bp, Artificial Sequence
  Synthetic oligonucleotide
gtggaagagcgacgagggggggtgggggttacgta

SEQ ID NO: 154389 - DNA, 35 bp, Artificial Sequence
  Synthetic oligonucleotide
tgttgcacgccttcccgcattcacttcgccgctta

SEQ ID NO: 154390 - DNA, 35 bp, Artificial Sequence
  Synthetic oligonucleotide
tgtagcactggtcctctcctcacacctgccttgac

SEQ ID NO: 154391 - DNA, 34 bp, Artificial Sequence
  Synthetic oligonucleotide
tcaccactgatcctcgatataccgtgccggttac

SEQ ID NO: 154392 - DNA, 35 bp, Artificial Sequence
  Synthetic oligonucleotide
tgtgcctctgttcagtctgctttttctgttccacc

SEQ ID NO: 154393 - DNA, 35 bp, Artificial Sequence
  Synthetic oligonucleotide
atctcccccctccagcagtgcccttaggcccatcc

SEQ ID NO: 154394 - DNA, 35 bp, Artificial Sequence
  Synthetic oligonucleotide
gttccactctcacacagttatgtggcttcccttcc

SEQ ID NO: 154395 - DNA, 35 bp, Artificial Sequence
  Synthetic oligonucleotide
tcactgtccccttagcaacaattgtctgccctcgc

SEQ ID NO: 154396 - DNA, 35 bp, Artificial Sequence
  Synthetic oligonucleotide
gataggcggtggttgggggacttggagcggatggc

SEQ ID NO: 154397 - DNA, 35 bp, Artificial Sequence
  Synthetic oligonucleotide
aggaccacgcattgatccaccacacagccctactc

SEQ ID NO: 154398 - DNA, 35 bp, Artificial Sequence
  Synthetic oligonucleotide
gttaccatccgctatgactcaacagcaggtacctc

SEQ ID NO: 154399 - DNA, 35 bp, Artificial Sequence
  Synthetic oligonucleotide
gataacgcattgaatatacctaggcgccccctctc

SEQ ID NO: 154400 - DNA, 35 bp, Artificial Sequence
  Synthetic oligonucleotide
gatgcctctcttaggtccgcacccgaatcctggtc

SEQ ID NO: 154401 - DNA, 35 bp, Artificial Sequence
  Synthetic oligonucleotide
tctttgccacctctagttcgcgcttccccgtggtc

SEQ ID NO: 154402 - DNA, 35 bp, Artificial Sequence
  Synthetic oligonucleotide
gtgacctatctccccgattgtcttagcattccttc

SEQ ID NO: 154403 - DNA, 35 bp, Artificial Sequence
  Synthetic oligonucleotide
acgttgatgtgtcaccctctccgtgtccctcgttc

SEQ ID NO: 154404 - DNA, 35 bp, Artificial Sequence
  Synthetic oligonucleotide
gtccacttaacggctactgtattatccctgctttc

SEQ ID NO: 154405 - DNA, 35 bp, Artificial Sequence
  Synthetic oligonucleotide
gacgccatccaccctcgcccaagaatagacacccg

SEQ ID NO: 154406 - DNA, 35 bp, Artificial Sequence
  Synthetic oligonucleotide
gcctggtaccgccctgtgttcttcatattctatcg

SEQ ID NO: 154407 - DNA, 35 bp, Artificial Sequence
  Synthetic oligonucleotide
gttcctgccccatcgtagcccggccttcaataagg

SEQ ID NO: 154408 - DNA, 35 bp, Artificial Sequence
  Synthetic oligonucleotide
gtggggcgaagggcgtaggggtccgggtgcgtggg

SEQ ID NO: 154409 - DNA, 35 bp, Artificial Sequence
  Synthetic oligonucleotide
cattcgcatactccgctgatttcaactcttgtttg

SEQ ID NO: 154410 - DNA, 35 bp, Artificial Sequence
  Synthetic oligonucleotide
gtccactcgccgcagtttgcttgcgcccacatcat

SEQ ID NO: 154411 - DNA, 35 bp, Artificial Sequence
  Synthetic oligonucleotide
gacgagcctcgatgcctttgtcccccccccgcact

SEQ ID NO: 154412 - DNA, 35 bp, Artificial Sequence
  Synthetic oligonucleotide
gtgcgaacgccctcttgtttcgagtcctcgcccct

SEQ ID NO: 154413 - DNA, 35 bp, Artificial Sequence
  Synthetic oligonucleotide
gcctaaacccgctttcgccagccctgctccgccct

SEQ ID NO: 154414 - DNA, 35 bp, Artificial Sequence
  Synthetic oligonucleotide
gccgaacgcccctcatcctctaacgggcttgtcct

SEQ ID NO: 154415 - DNA, 35 bp, Artificial Sequence
  Synthetic oligonucleotide
gtcaactacgctccttgccttatctcgcctatgct

SEQ ID NO: 154416 - DNA, 35 bp, Artificial Sequence
  Synthetic oligonucleotide
atcccctcgcgctccacggtccatcccttgtgtct

SEQ ID NO: 154417 - DNA, 35 bp, Artificial Sequence
  Synthetic oligonucleotide
acccagcgttgcctgcagttcttccccctcccggt

SEQ ID NO: 154418 - DNA, 35 bp, Artificial Sequence
  Synthetic oligonucleotide
ggggaggacgacgggcttgggagggaattgagggt

SEQ ID NO: 154419 - DNA, 34 bp, Artificial Sequence
  Synthetic oligonucleotide
atcgacccgactgccctccgcgttccaaccaatt

SEQ ID NO: 154420 - DNA, 36 bp, Artificial Sequence
  Synthetic oligonucleotide
attgggagctccgggagggagggagtgagaggcaaa

SEQ ID NO: 154421 - DNA, 35 bp, Artificial Sequence
  Synthetic oligonucleotide
gcgagccccgcctctgcttttacaaaccgcccgaa

SEQ ID NO: 154422 - DNA, 36 bp, Artificial Sequence
  Synthetic oligonucleotide
acccacctctggcagccgccgtttcaagcccccaca

SEQ ID NO: 154423 - DNA, 36 bp, Artificial Sequence
  Synthetic oligonucleotide
ttagaacggagggagtgggacggtggagtagcagca

SEQ ID NO: 154424 - DNA, 36 bp, Artificial Sequence
  Synthetic oligonucleotide
acatcactctcaatacgggattagctccccgcctca

SEQ ID NO: 154425 - DNA, 35 bp, Artificial Sequence
  Synthetic oligonucleotide
gcccgatcgttacatgcccttgccctatccattca

SEQ ID NO: 154426 - DNA, 35 bp, Artificial Sequence
  Synthetic oligonucleotide
tgtttccccgctccgttcttcttgcagtgcgttca

SEQ ID NO: 154427 - DNA, 35 bp, Artificial Sequence
  Synthetic oligonucleotide
accgccctcgttctttgcggttcctcctatgttca

SEQ ID NO: 154428 - DNA, 37 bp, Artificial Sequence
  Synthetic oligonucleotide
tcggagacgtcccgccttcatattgcacgctccccga

SEQ ID NO: 154429 - DNA, 36 bp, Artificial Sequence
  Synthetic oligonucleotide
accccggcgcccgctcccttaccgaaacgtccgcga

SEQ ID NO: 154430 - DNA, 37 bp, Artificial Sequence
  Synthetic oligonucleotide
gtgccccgtccccttcgtacctttgctataccttcga

SEQ ID NO: 154431 - DNA, 37 bp, Artificial Sequence
  Synthetic oligonucleotide
tgaactagcggcggaggacaacggatgggacggggga

SEQ ID NO: 154432 - DNA, 37 bp, Artificial Sequence
  Synthetic oligonucleotide
ttgtctcaccctccatgttatacatccttccgctgga

SEQ ID NO: 154433 - DNA, 38 bp, Artificial Sequence
  Synthetic oligonucleotide
actgccgcccctgtcgaccgcccgaacctccaccatga

SEQ ID NO: 154434 - DNA, 38 bp, Artificial Sequence
  Synthetic oligonucleotide
gacttagcgaacgggatgggggggggatgggtggatga

SEQ ID NO: 154435 - DNA, 38 bp, Artificial Sequence
  Synthetic oligonucleotide
gtatgggagaggtggtatgggagggcggggaattatga

SEQ ID NO: 154436 - DNA, 38 bp, Artificial Sequence
  Synthetic oligonucleotide
gcccgggcaggcggggaacggggacggggcgattatga

SEQ ID NO: 154437 - DNA, 37 bp, Artificial Sequence
  Synthetic oligonucleotide
agcgcctcacctgccctcgaccttcctcgcgtactga

SEQ ID NO: 154438 - DNA, 37 bp, Artificial Sequence
  Synthetic oligonucleotide
gtgccgcccgattcccccaggagcctccctccgctga

SEQ ID NO: 154439 - DNA, 38 bp, Artificial Sequence
  Synthetic oligonucleotide
gtaaaactcaccatctgtttggccccctcaccctgtga

SEQ ID NO: 154440 - DNA, 38 bp, Artificial Sequence
  Synthetic oligonucleotide
agccatccccgcgggccatagaccgacctacaccttga

SEQ ID NO: 154441 - DNA, 36 bp, Artificial Sequence
  Synthetic oligonucleotide
tcgcacaacgccatcccaatttcgctcgttctttga

SEQ ID NO: 154442 - DNA, 38 bp, Artificial Sequence
  Synthetic oligonucleotide
gccccacccactgatccggcgcaccatccattttttga

SEQ ID NO: 154443 - DNA, 36 bp, Artificial Sequence
  Synthetic oligonucleotide
tcgatcggcctcacaatcgaacctccccccagtcta

SEQ ID NO: 154444 - DNA, 35 bp, Artificial Sequence
  Synthetic oligonucleotide
gaagcgtgcggggacgggagggaagggtttgtcta

SEQ ID NO: 154445 - DNA, 36 bp, Artificial Sequence
  Synthetic oligonucleotide
taggcatggtaggggagggcagggatggacgggtta

SEQ ID NO: 154446 - DNA, 35 bp, Artificial Sequence
  Synthetic oligonucleotide
ttcgacgtcacttgaccttagtctaccttggccac

SEQ ID NO: 154447 - DNA, 35 bp, Artificial Sequence
  Synthetic oligonucleotide
gtgacccgccctaagggaatcctttctgtatccac

SEQ ID NO: 154448 - DNA, 35 bp, Artificial Sequence
  Synthetic oligonucleotide
ttcacgaacgctaggtcggtgcatatccccttcac

SEQ ID NO: 154449 - DNA, 35 bp, Artificial Sequence
  Synthetic oligonucleotide
tccgcacttcaacccaccgctgcctcccccgggac

SEQ ID NO: 154450 - DNA, 35 bp, Artificial Sequence
  Synthetic oligonucleotide
acatggtcgaagcgggtgggaaacgggagtgggac

SEQ ID NO: 154451 - DNA, 35 bp, Artificial Sequence
  Synthetic oligonucleotide
acagaccgtcagcctgccgcgatactccttgcacc

SEQ ID NO: 154452 - DNA, 35 bp, Artificial Sequence
  Synthetic oligonucleotide
ggtcaacctgcattcccagtcctcctgttatcacc

SEQ ID NO: 154453 - DNA, 35 bp, Artificial Sequence
  Synthetic oligonucleotide
gtggcgagcacgttactcgacacgcgatccccccc

SEQ ID NO: 154454 - DNA, 35 bp, Artificial Sequence
  Synthetic oligonucleotide
atccgccctttgtactgcgctaatgtagtccctcc

SEQ ID NO: 154455 - DNA, 35 bp, Artificial Sequence
  Synthetic oligonucleotide
gtacggtatccgccaggtcctccgttaatccttcc

SEQ ID NO: 154456 - DNA, 35 bp, Artificial Sequence
  Synthetic oligonucleotide
tcttgacctccgcctccacctgctgtttttgttcc

SEQ ID NO: 154457 - DNA, 35 bp, Artificial Sequence
  Synthetic oligonucleotide
ttgcggctactttcgcgcctgtcccgtccattcgc

SEQ ID NO: 154458 - DNA, 35 bp, Artificial Sequence
  Synthetic oligonucleotide
aaaccgtacctgcacactccgcattccatccgatc

SEQ ID NO: 154459 - DNA, 35 bp, Artificial Sequence
  Synthetic oligonucleotide
tcgcccccccctgaatgttggtttcctgtggcctc

SEQ ID NO: 154460 - DNA, 35 bp, Artificial Sequence
  Synthetic oligonucleotide
gtaccagtgccaatcgacgtttccttcacatcctc

SEQ ID NO: 154461 - DNA, 35 bp, Artificial Sequence
  Synthetic oligonucleotide
ttgtaccgctttatcgcccccacaggatgccggtc

SEQ ID NO: 154462 - DNA, 35 bp, Artificial Sequence
  Synthetic oligonucleotide
acgctccacatgtccatccctcgttctgttccttc

SEQ ID NO: 154463 - DNA, 35 bp, Artificial Sequence
  Synthetic oligonucleotide
gtgtcgcctgcctcactccagctttgccacctttc

SEQ ID NO: 154464 - DNA, 35 bp, Artificial Sequence
  Synthetic oligonucleotide
tcatccggtcgtgtaaactgatcccgccatctttc

SEQ ID NO: 154465 - DNA, 35 bp, Artificial Sequence
  Synthetic oligonucleotide
caaacccgccccgttttgcaactatcccgccgccg

SEQ ID NO: 154466 - DNA, 35 bp, Artificial Sequence
  Synthetic oligonucleotide
tcatgaccctcgtccgagccattaacacctcatcg

SEQ ID NO: 154467 - DNA, 35 bp, Artificial Sequence
  Synthetic oligonucleotide
gggggacaagaaatgagcagtatgggggagcgggg

SEQ ID NO: 154468 - DNA, 35 bp, Artificial Sequence
  Synthetic oligonucleotide
agtgggacgaagacaatgggtggtgaggagtggtg

SEQ ID NO: 154469 - DNA, 35 bp, Artificial Sequence
  Synthetic oligonucleotide
tgctccacccgccggtctacagtttccacatcttg

SEQ ID NO: 154470 - DNA, 35 bp, Artificial Sequence
  Synthetic oligonucleotide
gtgcctcgcctctctaagtaattgccccgacgcct

SEQ ID NO: 154471 - DNA, 35 bp, Artificial Sequence
  Synthetic oligonucleotide
ttcaaccgcccctccagcatcaaagtcactggcct

SEQ ID NO: 154472 - DNA, 35 bp, Artificial Sequence
  Synthetic oligonucleotide
gctaccatcaagcactccagctcccctcccatgct

SEQ ID NO: 154473 - DNA, 35 bp, Artificial Sequence
  Synthetic oligonucleotide
tagcgctcacctcgccttttcattgccatctctgt

SEQ ID NO: 154474 - DNA, 35 bp, Artificial Sequence
  Synthetic oligonucleotide
atctggccagctacacgccagttccttctagcctt

SEQ ID NO: 154475 - DNA, 35 bp, Artificial Sequence
  Synthetic oligonucleotide
gccaacttcaattctcctccggtgccacctgcctt

SEQ ID NO: 154476 - DNA, 35 bp, Artificial Sequence
  Synthetic oligonucleotide
gacttggtacacctacctcattcccactcctggtt

SEQ ID NO: 154477 - DNA, 35 bp, Artificial Sequence
  Synthetic oligonucleotide
tccgaccacttctctctgctttctatggtgcgttt

SEQ ID NO: 154478 - DNA, 36 bp, Artificial Sequence
  Synthetic oligonucleotide
gtacggagggaacttagagggaggtggtgagggaaa

SEQ ID NO: 154479 - DNA, 36 bp, Artificial Sequence
  Synthetic oligonucleotide
tacaccggccaataccctcgcccccgcccctgacaa

SEQ ID NO: 154480 - DNA, 35 bp, Artificial Sequence
  Synthetic oligonucleotide
ttacgtgcctccagaattacctgctccactctgaa

SEQ ID NO: 154481 - DNA, 36 bp, Artificial Sequence
  Synthetic oligonucleotide
tcaagccaccgtccaccagccccctagtctcaccca

SEQ ID NO: 154482 - DNA, 35 bp, Artificial Sequence
  Synthetic oligonucleotide
tcccactccccgttagcgatctgtgttcttcccca

SEQ ID NO: 154483 - DNA, 36 bp, Artificial Sequence
  Synthetic oligonucleotide
gctcaccgccccgatatcatccttcccaagtgtgca

SEQ ID NO: 154484 - DNA, 35 bp, Artificial Sequence
  Synthetic oligonucleotide
ttacccccattgtgacttcaaagttcttcgtttca

SEQ ID NO: 154485 - DNA, 37 bp, Artificial Sequence
  Synthetic oligonucleotide
acccgccctttccgcacgcatcttcgcacatagaaga

SEQ ID NO: 154486 - DNA, 37 bp, Artificial Sequence
  Synthetic oligonucleotide
aaggacgcaagcgtgggcgggaaaggggaggatgaga

SEQ ID NO: 154487 - DNA, 36 bp, Artificial Sequence
  Synthetic oligonucleotide
gcctagcctgtggtttgtcccgtcatctctctccga

SEQ ID NO: 154488 - DNA, 37 bp, Artificial Sequence
  Synthetic oligonucleotide
gggtgagaggtaggggaaacgggggggtagggtgcga

SEQ ID NO: 154489 - DNA, 37 bp, Artificial Sequence
  Synthetic oligonucleotide
acacccgtctatgcctgtccctgggaaaccgtttcga

SEQ ID NO: 154490 - DNA, 37 bp, Artificial Sequence
  Synthetic oligonucleotide
gccctcgcccatcctatgatcgtcctcctgataagga

SEQ ID NO: 154491 - DNA, 37 bp, Artificial Sequence
  Synthetic oligonucleotide
tagctgggaggagtgggtagggattgggggccgagga

SEQ ID NO: 154492 - DNA, 37 bp, Artificial Sequence
  Synthetic oligonucleotide
atgacgcgtgccaccctccgctccctctagtaccgga

SEQ ID NO: 154493 - DNA, 38 bp, Artificial Sequence
  Synthetic oligonucleotide
tcaatgggcggaggcgtgggtgggggtcatcggcatga

SEQ ID NO: 154494 - DNA, 38 bp, Artificial Sequence
  Synthetic oligonucleotide
acgcggacacgatggtaggtgaaggcggggggagatga

SEQ ID NO: 154495 - DNA, 37 bp, Artificial Sequence
  Synthetic oligonucleotide
tgaagccatcctctctgctgttcgaaccccacactga

SEQ ID NO: 154496 - DNA, 38 bp, Artificial Sequence
  Synthetic oligonucleotide
tttgacctcgcccctgtccataacatttcactcagtga

SEQ ID NO: 154497 - DNA, 38 bp, Artificial Sequence
  Synthetic oligonucleotide
aaacgcgcctcaggaggtcgtccgccgtttctccttga

SEQ ID NO: 154498 - DNA, 37 bp, Artificial Sequence
  Synthetic oligonucleotide
acaccgctcatgcccttaactcccgtcactgcgttga

SEQ ID NO: 154499 - DNA, 36 bp, Artificial Sequence
  Synthetic oligonucleotide
gtcccctccacgccactttagcgttagcgaaaccta

SEQ ID NO: 154500 - DNA, 35 bp, Artificial Sequence
  Synthetic oligonucleotide
acctccgccccccagcattcctagcgcccccgtta

SEQ ID NO: 154501 - DNA, 35 bp, Artificial Sequence
  Synthetic oligonucleotide
tcctctccgctggccatgtcactcagctcacttta

SEQ ID NO: 154502 - DNA, 35 bp, Artificial Sequence
  Synthetic oligonucleotide
tcgccatgccaatcctgcttatcctccatccatac

SEQ ID NO: 154503 - DNA, 35 bp, Artificial Sequence
  Synthetic oligonucleotide
tacccggtaacgctgttctatccgctcccgagtac

SEQ ID NO: 154504 - DNA, 35 bp, Artificial Sequence
  Synthetic oligonucleotide
aagcgccctcctgaccgccttaatatcgacccccc

SEQ ID NO: 154505 - DNA, 35 bp, Artificial Sequence
  Synthetic oligonucleotide
aacacgagtccacccgcgcgcgccgatcacgcccc

SEQ ID NO: 154506 - DNA, 35 bp, Artificial Sequence
  Synthetic oligonucleotide
atgcccctagttgtccgacgcctccatcgagtccc

SEQ ID NO: 154507 - DNA, 35 bp, Artificial Sequence
  Synthetic oligonucleotide
ttgatggtgtcgctccctctcgacttttgttctcc

SEQ ID NO: 154508 - DNA, 35 bp, Artificial Sequence
  Synthetic oligonucleotide
tccacatgtccgctgtttccacccgtatatcgtcc

SEQ ID NO: 154509 - DNA, 35 bp, Artificial Sequence
  Synthetic oligonucleotide
acagatcgcatgcctgtggcacttcgcgcttttcc

SEQ ID NO: 154510 - DNA, 35 bp, Artificial Sequence
  Synthetic oligonucleotide
gaacaaagagaagggaagaaagcgcggaggtcagc

SEQ ID NO: 154511 - DNA, 34 bp, Artificial Sequence
  Synthetic oligonucleotide
tgttacaacgtgaggacctcccgatcccgcccgc

SEQ ID NO: 154512 - DNA, 35 bp, Artificial Sequence
  Synthetic oligonucleotide
gatacccgcctcatgagtcactagccccgtcccgc

SEQ ID NO: 154513 - DNA, 36 bp, Artificial Sequence
  Synthetic oligonucleotide
tcctcgccccagggttcacaaatctgcctatctcgc

SEQ ID NO: 154514 - DNA, 35 bp, Artificial Sequence
  Synthetic oligonucleotide
tcccccaccccaccatgttcccacgacgagcaggc

SEQ ID NO: 154515 - DNA, 35 bp, Artificial Sequence
  Synthetic oligonucleotide
gccttacgtcgcctcctgcctagtctctcggggtc

SEQ ID NO: 154516 - DNA, 35 bp, Artificial Sequence
  Synthetic oligonucleotide
gttccgatcctccttgtgattaccacacttatgtc

SEQ ID NO: 154517 - DNA, 35 bp, Artificial Sequence
  Synthetic oligonucleotide
agaccaccacacacgctacccagggttaactattc

SEQ ID NO: 154518 - DNA, 35 bp, Artificial Sequence
  Synthetic oligonucleotide
gttgtagcaggcctgtatactcgcgtcccaccttc

SEQ ID NO: 154519 - DNA, 35 bp, Artificial Sequence
  Synthetic oligonucleotide
gccaccccggattgcttggcctcatattcttccag

SEQ ID NO: 154520 - DNA, 35 bp, Artificial Sequence
  Synthetic oligonucleotide
tatgaagagtgggcggagggtggaggtctacggag

SEQ ID NO: 154521 - DNA, 35 bp, Artificial Sequence
  Synthetic oligonucleotide
acgacacccggcgcccgttatcaattccccattag

SEQ ID NO: 154522 - DNA, 35 bp, Artificial Sequence
  Synthetic oligonucleotide
tagcaccctaatgttgactggaccacccctctccg

SEQ ID NO: 154523 - DNA, 35 bp, Artificial Sequence
  Synthetic oligonucleotide
gcactgagggggttaggaaatagggaagaagagcg

SEQ ID NO: 154524 - DNA, 35 bp, Artificial Sequence
  Synthetic oligonucleotide
gtaggatggatgggagggtggaagggttcacaagg

SEQ ID NO: 154525 - DNA, 35 bp, Artificial Sequence
  Synthetic oligonucleotide
tgcccacacacctgcgaattaacaacccgctccgg

SEQ ID NO: 154526 - DNA, 36 bp, Artificial Sequence
  Synthetic oligonucleotide
gggcggtggtgggaggggcgtaggggatcaggtatg

SEQ ID NO: 154527 - DNA, 35 bp, Artificial Sequence
  Synthetic oligonucleotide
tgccccattctcattttctatctgtgctcgccctg

SEQ ID NO: 154528 - DNA, 35 bp, Artificial Sequence
  Synthetic oligonucleotide
gcaccacgggggagggaggactggaaaataagctg

SEQ ID NO: 154529 - DNA, 35 bp, Artificial Sequence
  Synthetic oligonucleotide
atatggcacctccctatcgcaaccggacccctctg

SEQ ID NO: 154530 - DNA, 35 bp, Artificial Sequence
  Synthetic oligonucleotide
tcaccccgccgggccattgacgtagtcctctccat

SEQ ID NO: 154531 - DNA, 35 bp, Artificial Sequence
  Synthetic oligonucleotide
ggagcactccgactctgttcactccgattcacact

SEQ ID NO: 154532 - DNA, 35 bp, Artificial Sequence
  Synthetic oligonucleotide
gatggatccatccctgccttggtttacacgaacct

SEQ ID NO: 154533 - DNA, 35 bp, Artificial Sequence
  Synthetic oligonucleotide
gacatgccttggttagccttctctgttttgcacct

SEQ ID NO: 154534 - DNA, 35 bp, Artificial Sequence
  Synthetic oligonucleotide
gcacacctcgcgtaccattaccatctgcatgtcct

SEQ ID NO: 154535 - DNA, 35 bp, Artificial Sequence
  Synthetic oligonucleotide
tgcctgctcatcgttggttcagcctctcactcgct

SEQ ID NO: 154536 - DNA, 35 bp, Artificial Sequence
  Synthetic oligonucleotide
tgctgacctgtacgctattgcatcgactcctctct

SEQ ID NO: 154537 - DNA, 34 bp, Artificial Sequence
  Synthetic oligonucleotide
gacctcccatgctcagccctgcgtcctctctagt

SEQ ID NO: 154538 - DNA, 35 bp, Artificial Sequence
  Synthetic oligonucleotide
ggcccaaagtggggcaacgggagggagggggaggt

SEQ ID NO: 154539 - DNA, 35 bp, Artificial Sequence
  Synthetic oligonucleotide
gacaccccggggtttttatctcttacatccaatgt

SEQ ID NO: 154540 - DNA, 35 bp, Artificial Sequence
  Synthetic oligonucleotide
gctgcggtacagatcgcgccttcctgctctattgt

SEQ ID NO: 154541 - DNA, 35 bp, Artificial Sequence
  Synthetic oligonucleotide
gctccaggtcactacgcgcgtccgcccgcccactt

SEQ ID NO: 154542 - DNA, 35 bp, Artificial Sequence
  Synthetic oligonucleotide
gtggacccaccgcagttgcgactgtgccactgttt

SEQ ID NO: 154543 - DNA, 35 bp, Artificial Sequence
  Synthetic oligonucleotide
gtactcgcctcccgctatcagggactccccctcaa

SEQ ID NO: 154544 - DNA, 36 bp, Artificial Sequence
  Synthetic oligonucleotide
aggaccagaggacaaggggcatgtgagggtgggtaa

SEQ ID NO: 154545 - DNA, 36 bp, Artificial Sequence
  Synthetic oligonucleotide
gaagtgccatgactataggctcgccccccttcacca

SEQ ID NO: 154546 - DNA, 37 bp, Artificial Sequence
  Synthetic oligonucleotide
agaccgcgaggggccatatacggagggggggggtaga

SEQ ID NO: 154547 - DNA, 37 bp, Artificial Sequence
  Synthetic oligonucleotide
gctgacaccctccctcttgctgaaaggagctccacga

SEQ ID NO: 154548 - DNA, 37 bp, Artificial Sequence
  Synthetic oligonucleotide
acatgtgtacagcagtaggcgagggagggataacgga

SEQ ID NO: 154549 - DNA, 37 bp, Artificial Sequence
  Synthetic oligonucleotide
gacggatgaaatgagggggaggaggttcaggtgggga

SEQ ID NO: 154550 - DNA, 38 bp, Artificial Sequence
  Synthetic oligonucleotide
gtgggtgagggggatgggatgtatggtacgggggatga

SEQ ID NO: 154551 - DNA, 38 bp, Artificial Sequence
  Synthetic oligonucleotide
tcgctcccccgggctgccatcgctcatcatcctcctga

SEQ ID NO: 154552 - DNA, 38 bp, Artificial Sequence
  Synthetic oligonucleotide
tgacaccctatgccgctttcactatgccacacctctga

SEQ ID NO: 154553 - DNA, 37 bp, Artificial Sequence
  Synthetic oligonucleotide
gggagaagcgggggggggggaggggaggcaggtctga

SEQ ID NO: 154554 - DNA, 38 bp, Artificial Sequence
  Synthetic oligonucleotide
gtgtcctctgcctggaattgcgccctccatctacgtga

SEQ ID NO: 154555 - DNA, 38 bp, Artificial Sequence
  Synthetic oligonucleotide
gtcacacccgttagctcctgctgccagcccttccgtga

SEQ ID NO: 154556 - DNA, 38 bp, Artificial Sequence
  Synthetic oligonucleotide
aaccgcgccttcccagctgctccctctgttttccgtga

SEQ ID NO: 154557 - DNA, 38 bp, Artificial Sequence
  Synthetic oligonucleotide
tatccgctactgtttgctactaccttgttcccctgtga

SEQ ID NO: 154558 - DNA, 37 bp, Artificial Sequence
  Synthetic oligonucleotide
acatcatgccacgcgtttgccccaccatccctcttga

SEQ ID NO: 154559 - DNA, 38 bp, Artificial Sequence
  Synthetic oligonucleotide
acgggtggggcgggatgggctctgctccaagactttga

SEQ ID NO: 154560 - DNA, 38 bp, Artificial Sequence
  Synthetic oligonucleotide
tacccctgtcgccggagttcatagcgcgccctctttga

SEQ ID NO: 154561 - DNA, 37 bp, Artificial Sequence
  Synthetic oligonucleotide
ggaccacctcttcaagtagtactaccgctccttttga

SEQ ID NO: 154562 - DNA, 36 bp, Artificial Sequence
  Synthetic oligonucleotide
atgttcatgcggcacctgtctctctgtcaccttata

SEQ ID NO: 154563 - DNA, 36 bp, Artificial Sequence
  Synthetic oligonucleotide
tcatcaccggcttctcctatgacccgtcttgcccta

SEQ ID NO: 154564 - DNA, 36 bp, Artificial Sequence
  Synthetic oligonucleotide
tctacctcctcatcgcttttagttagactcgttcta

SEQ ID NO: 154565 - DNA, 36 bp, Artificial Sequence
  Synthetic oligonucleotide
tacccctgtgccctcccgttgtaaccatggatgtta

SEQ ID NO: 154566 - DNA, 35 bp, Artificial Sequence
  Synthetic oligonucleotide
accgtagctcacctgtccgccctgttcctgcttta

SEQ ID NO: 154567 - DNA, 35 bp, Artificial Sequence
  Synthetic oligonucleotide
aaccttccgcctcacaccgttacgcgcacatacac

SEQ ID NO: 154568 - DNA, 35 bp, Artificial Sequence
  Synthetic oligonucleotide
gtcgtcaccccagccaatccattcacaccacgcac

SEQ ID NO: 154569 - DNA, 35 bp, Artificial Sequence
  Synthetic oligonucleotide
gggaccacctcctattgcgcatatcttactcgcac

SEQ ID NO: 154570 - DNA, 35 bp, Artificial Sequence
  Synthetic oligonucleotide
gccccaaactcagacgctagtttgcctctccaacc

SEQ ID NO: 154571 - DNA, 35 bp, Artificial Sequence
  Synthetic oligonucleotide
ttgttgccctccctgcttgtttacagaccctgacc

SEQ ID NO: 154572 - DNA, 35 bp, Artificial Sequence
  Synthetic oligonucleotide
gatcgcactatacctcgccccgcacctcgctgacc

SEQ ID NO: 154573 - DNA, 35 bp, Artificial Sequence
  Synthetic oligonucleotide
ttcaccacagcattatatccgttttcttgccagcc

SEQ ID NO: 154574 - DNA, 35 bp, Artificial Sequence
  Synthetic oligonucleotide
gctgaccggctgtctcttcggggtcccgctcttgc

SEQ ID NO: 154575 - DNA, 35 bp, Artificial Sequence
  Synthetic oligonucleotide
tacatccgacacagcgtgcgccccacaaaggttgc

SEQ ID NO: 154576 - DNA, 35 bp, Artificial Sequence
  Synthetic oligonucleotide
gaccacctgccatacgtaaaaccgctgattacctc

SEQ ID NO: 154577 - DNA, 35 bp, Artificial Sequence
  Synthetic oligonucleotide
tcacacgccactccttgttttctgatccacccctc

SEQ ID NO: 154578 - DNA, 35 bp, Artificial Sequence
  Synthetic oligonucleotide
atctcgccgtctctgcctagctctttctgtctctc

SEQ ID NO: 154579 - DNA, 35 bp, Artificial Sequence
  Synthetic oligonucleotide
aattgcccccctctgtcctattgcgtacgcaggtc

SEQ ID NO: 154580 - DNA, 35 bp, Artificial Sequence
  Synthetic oligonucleotide
aacgaaagggggaaatggtctttaacggggaggag

SEQ ID NO: 154581 - DNA, 35 bp, Artificial Sequence
  Synthetic oligonucleotide
agtctgccatccgttaccccgctctcaaaccgccg

SEQ ID NO: 154582 - DNA, 35 bp, Artificial Sequence
  Synthetic oligonucleotide
gcccgccgcccctcgcttgaaatcaccctgttccg

SEQ ID NO: 154583 - DNA, 35 bp, Artificial Sequence
  Synthetic oligonucleotide
tatgactgagggggacgcgggaggggcaagtaagg

SEQ ID NO: 154584 - DNA, 35 bp, Artificial Sequence
  Synthetic oligonucleotide
tatggtgggcggggagtaaggtgagacgagggggg

SEQ ID NO: 154585 - DNA, 35 bp, Artificial Sequence
  Synthetic oligonucleotide
acgctagccacacgttctccggaccctcccccttg

SEQ ID NO: 154586 - DNA, 35 bp, Artificial Sequence
  Synthetic oligonucleotide
tccacgtgccgccaatacctcttcagtatcgccct

SEQ ID NO: 154587 - DNA, 35 bp, Artificial Sequence
  Synthetic oligonucleotide
tccgcggtacattccggccctcacatcctagtgct

SEQ ID NO: 154588 - DNA, 35 bp, Artificial Sequence
  Synthetic oligonucleotide
agtcgccccgcctgccccctaagctgtcctccagt

SEQ ID NO: 154589 - DNA, 35 bp, Artificial Sequence
  Synthetic oligonucleotide
aaagagggggtagagggtatcggatgggggggagt

SEQ ID NO: 154590 - DNA, 35 bp, Artificial Sequence
  Synthetic oligonucleotide
tgcaccccgtggcactgtttcttctcagtttttgt

SEQ ID NO: 154591 - DNA, 35 bp, Artificial Sequence
  Synthetic oligonucleotide
gaccccgtacccatggctcctatctgaaatatatt

SEQ ID NO: 154592 - DNA, 35 bp, Artificial Sequence
  Synthetic oligonucleotide
tgccttcttccctgcgtatagctttgcactatctt

SEQ ID NO: 154593 - DNA, 35 bp, Artificial Sequence
  Synthetic oligonucleotide
tcgctcccagatgcggcttccctcatcctactctt

SEQ ID NO: 154594 - DNA, 35 bp, Artificial Sequence
  Synthetic oligonucleotide
atcgtgcccccctggctattattaaactccttgtt

SEQ ID NO: 154595 - DNA, 36 bp, Artificial Sequence
  Synthetic oligonucleotide
gcctccccaattgttcacatgatcccgggttcccaa

SEQ ID NO: 154596 - DNA, 36 bp, Artificial Sequence
  Synthetic oligonucleotide
agctaccccacacagccacagacctcccccccgcaa

SEQ ID NO: 154597 - DNA, 36 bp, Artificial Sequence
  Synthetic oligonucleotide
gtcattcccagcgccctccccccgcatacgccagaa

SEQ ID NO: 154598 - DNA, 36 bp, Artificial Sequence
  Synthetic oligonucleotide
aaacggtggacgcaagccgggcgggaacggggggaa

SEQ ID NO: 154599 - DNA, 36 bp, Artificial Sequence
  Synthetic oligonucleotide
gcgggtggggacaagcttcgtggggtttctggggaa

SEQ ID NO: 154600 - DNA, 35 bp, Artificial Sequence
  Synthetic oligonucleotide
tcgaactgttacattgttagctcccctccttccca

SEQ ID NO: 154601 - DNA, 35 bp, Artificial Sequence
  Synthetic oligonucleotide
tccgtccaccacccatgcagaacctcattgatcca

SEQ ID NO: 154602 - DNA, 36 bp, Artificial Sequence
  Synthetic oligonucleotide
taagcgcctctggttttcatcgttccgtcctgtcca

SEQ ID NO: 154603 - DNA, 35 bp, Artificial Sequence
  Synthetic oligonucleotide
actgacgagacgcccgaattttgtaccaccttcca

SEQ ID NO: 154604 - DNA, 36 bp, Artificial Sequence
  Synthetic oligonucleotide
gtgcgtttgcggaagtgttacgccgtctccctctca

SEQ ID NO: 154605 - DNA, 37 bp, Artificial Sequence
  Synthetic oligonucleotide
tgacgcctcgctggtcttccgacgcctcgcataccga

SEQ ID NO: 154606 - DNA, 36 bp, Artificial Sequence
  Synthetic oligonucleotide
gactaacgccacggactccttctcaagctcctccga

SEQ ID NO: 154607 - DNA, 37 bp, Artificial Sequence
  Synthetic oligonucleotide
agctaccgctcacacgtcaaacccttccccctgtcga

SEQ ID NO: 154608 - DNA, 37 bp, Artificial Sequence
  Synthetic oligonucleotide
gaggccctgggcagtgaggggtaggggtaggggagga

SEQ ID NO: 154609 - DNA, 37 bp, Artificial Sequence
  Synthetic oligonucleotide
tgagacaaggcgggataggtaatggaagagggaggga

SEQ ID NO: 154610 - DNA, 37 bp, Artificial Sequence
  Synthetic oligonucleotide
acagggtgggggggttttgtagggccagagtggggga

SEQ ID NO: 154611 - DNA, 38 bp, Artificial Sequence
  Synthetic oligonucleotide
gcgagtgcaagtggaaggggcgggtgttagttaaatga

SEQ ID NO: 154612 - DNA, 38 bp, Artificial Sequence
  Synthetic oligonucleotide
gggagggtatggggatgaaagggagcgaggaggactga

SEQ ID NO: 154613 - DNA, 38 bp, Artificial Sequence
  Synthetic oligonucleotide
gagaatgaggtaaggtgaggaggcgaatggcgaggtga

SEQ ID NO: 154614 - DNA, 37 bp, Artificial Sequence
  Synthetic oligonucleotide
gtgaatggcgtgggggggaggaacatgctggaggtga

SEQ ID NO: 154615 - DNA, 38 bp, Artificial Sequence
  Synthetic oligonucleotide
gggacgggaggaatgctagggaggggacgagacggtga

SEQ ID NO: 154616 - DNA, 38 bp, Artificial Sequence
  Synthetic oligonucleotide
gaggtggacggagtagggtggctcggggtggacggtga

SEQ ID NO: 154617 - DNA, 38 bp, Artificial Sequence
  Synthetic oligonucleotide
atgcgacggagagggagggtgaaggcaacggactgtga

SEQ ID NO: 154618 - DNA, 38 bp, Artificial Sequence
  Synthetic oligonucleotide
taccgccttgtccccgttcctatacctgtctcacttga

SEQ ID NO: 154619 - DNA, 36 bp, Artificial Sequence
  Synthetic oligonucleotide
acgtaccctcctccgctactggactgacaggtttga

SEQ ID NO: 154620 - DNA, 35 bp, Artificial Sequence
  Synthetic oligonucleotide
aggtcgtgggggcggaggacactaggactggggta

SEQ ID NO: 154621 - DNA, 35 bp, Artificial Sequence
  Synthetic oligonucleotide
gaccccccgcccccaccgctccggtaagatcgtta

SEQ ID NO: 154622 - DNA, 36 bp, Artificial Sequence
  Synthetic oligonucleotide
tgtcccaccgcaccttatgatttacttcatgcttta

SEQ ID NO: 154623 - DNA, 35 bp, Artificial Sequence
  Synthetic oligonucleotide
gccgtcacaggcatcccccgctttatgtaactaac

SEQ ID NO: 154624 - DNA, 35 bp, Artificial Sequence
  Synthetic oligonucleotide
tccgcctctcacgtctgctctcttcttcgcaccac

SEQ ID NO: 154625 - DNA, 36 bp, Artificial Sequence
  Synthetic oligonucleotide
acgttgttcggcacctcctccgtcagcttctgccac

SEQ ID NO: 154626 - DNA, 35 bp, Artificial Sequence
  Synthetic oligonucleotide
ggaccaccgcgtgtgttccctcccctccttcgcac

SEQ ID NO: 154627 - DNA, 35 bp, Artificial Sequence
  Synthetic oligonucleotide
gtggcctcggtcccatctccggtcatttcgatcac

SEQ ID NO: 154628 - DNA, 34 bp, Artificial Sequence
  Synthetic oligonucleotide
tgcttcacctcgtaccttcgtttcggacctcgac

SEQ ID NO: 154629 - DNA, 35 bp, Artificial Sequence
  Synthetic oligonucleotide
gcattcagcatgcacctgctctgtactctcgttac

SEQ ID NO: 154630 - DNA, 35 bp, Artificial Sequence
  Synthetic oligonucleotide
ttccgcccttattcgcttgtgtgcgatcccgaacc

SEQ ID NO: 154631 - DNA, 35 bp, Artificial Sequence
  Synthetic oligonucleotide
tccatccacctaccgtgcatcatggccctcctacc

SEQ ID NO: 154632 - DNA, 35 bp, Artificial Sequence
  Synthetic oligonucleotide
tgcctgagccgcccgtccgctctcaaatcgctacc

SEQ ID NO: 154633 - DNA, 35 bp, Artificial Sequence
  Synthetic oligonucleotide
ggtcctgtccagtcgcgacctctgcagttcccccc

SEQ ID NO: 154634 - DNA, 35 bp, Artificial Sequence
  Synthetic oligonucleotide
tcattcgccttgagatggcgacttacttttccccc

SEQ ID NO: 154635 - DNA, 35 bp, Artificial Sequence
  Synthetic oligonucleotide
gcactaccctcgattgcgtatttcattcaatcccc

SEQ ID NO: 154636 - DNA, 35 bp, Artificial Sequence
  Synthetic oligonucleotide
tctcgtcctagtcgtggttatccagcccttcgccc

SEQ ID NO: 154637 - DNA, 35 bp, Artificial Sequence
  Synthetic oligonucleotide
acgcatcgacagacccccgtgcgcctgttagtccc

SEQ ID NO: 154638 - DNA, 34 bp, Artificial Sequence
  Synthetic oligonucleotide
taccgtacgcctcgttcggttgacctcaattccc

SEQ ID NO: 154639 - DNA, 35 bp, Artificial Sequence
  Synthetic oligonucleotide
tcccatcccccgccgttctcgcatgcgaacatgcc

SEQ ID NO: 154640 - DNA, 35 bp, Artificial Sequence
  Synthetic oligonucleotide
acgcaaccacaatgaatttttattatctccctgcc

SEQ ID NO: 154641 - DNA, 35 bp, Artificial Sequence
  Synthetic oligonucleotide
gagcccatctgtcatctaggttccctagcccctcc

SEQ ID NO: 154642 - DNA, 35 bp, Artificial Sequence
  Synthetic oligonucleotide
ccgaggggacgagtaggaaggaggagggtgagagc

SEQ ID NO: 154643 - DNA, 35 bp, Artificial Sequence
  Synthetic oligonucleotide
ggcccgccaagggctgccccacgtacctctttctc

SEQ ID NO: 154644 - DNA, 35 bp, Artificial Sequence
  Synthetic oligonucleotide
gtcccccgcgacttttttgcactctggtacggttc

SEQ ID NO: 154645 - DNA, 35 bp, Artificial Sequence
  Synthetic oligonucleotide
tccccggcccatctgtacaccccgtatcgattttc

SEQ ID NO: 154646 - DNA, 35 bp, Artificial Sequence
  Synthetic oligonucleotide
ttgcgcttatacccgcctccgccccctatcgatcg

SEQ ID NO: 154647 - DNA, 35 bp, Artificial Sequence
  Synthetic oligonucleotide
tctacgcccacctctacttgcctacccagtgatcg

SEQ ID NO: 154648 - DNA, 35 bp, Artificial Sequence
  Synthetic oligonucleotide
ggggcctggtgaaggggacggtggagggatagcgg

SEQ ID NO: 154649 - DNA, 35 bp, Artificial Sequence
  Synthetic oligonucleotide
gatggagagagggagaatgagacagtggggtgggg

SEQ ID NO: 154650 - DNA, 35 bp, Artificial Sequence
  Synthetic oligonucleotide
gacccacccctgaccttccgacccatcttcctggg

SEQ ID NO: 154651 - DNA, 35 bp, Artificial Sequence
  Synthetic oligonucleotide
gtcacggactcctccgctgcccatcacgcctactg

SEQ ID NO: 154652 - DNA, 35 bp, Artificial Sequence
  Synthetic oligonucleotide
ttaccagcacgccatccgtcttacaagtcgtacat

SEQ ID NO: 154653 - DNA, 35 bp, Artificial Sequence
  Synthetic oligonucleotide
tcatcccggcgatgagctcctccaaccctacccat

SEQ ID NO: 154654 - DNA, 35 bp, Artificial Sequence
  Synthetic oligonucleotide
agtgctcggcctgacttttcccgctgccccacact

SEQ ID NO: 154655 - DNA, 35 bp, Artificial Sequence
  Synthetic oligonucleotide
taaccgcgacatcagtctcggcataccatcccact

SEQ ID NO: 154656 - DNA, 35 bp, Artificial Sequence
  Synthetic oligonucleotide
acccccctcctccgtatggccttttcaaggtacct

SEQ ID NO: 154657 - DNA, 35 bp, Artificial Sequence
  Synthetic oligonucleotide
tgcctcatgccctccactggtgcgtggtcacctct

SEQ ID NO: 154658 - DNA, 35 bp, Artificial Sequence
  Synthetic oligonucleotide
tacccccgtagctgacctcctacttttgttccagt

SEQ ID NO: 154659 - DNA, 35 bp, Artificial Sequence
  Synthetic oligonucleotide
tcaccggaacgacgtctctgctttctatcattggt

SEQ ID NO: 154660 - DNA, 34 bp, Artificial Sequence
  Synthetic oligonucleotide
tcaagtggaacgcctccgtcagtccttgtccctt

SEQ ID NO: 154661 - DNA, 35 bp, Artificial Sequence
  Synthetic oligonucleotide
gacccggtggtggtaaagccggcggaggaggggtt

SEQ ID NO: 154662 - DNA, 35 bp, Artificial Sequence
  Synthetic oligonucleotide
atgatgctcgtgcgcctgtcccgcctgctttattt

SEQ ID NO: 154663 - DNA, 35 bp, Artificial Sequence
  Synthetic oligonucleotide
ttccaccatcgacttcccggcgcaagttttacttt

SEQ ID NO: 154664 - DNA, 35 bp, Artificial Sequence
  Synthetic oligonucleotide
gcccatcctatgcttttaatctacgtctctcgttt

SEQ ID NO: 154665 - DNA, 36 bp, Artificial Sequence
  Synthetic oligonucleotide
atccccccgctttgtatcttggtcggtatgaccaaa

SEQ ID NO: 154666 - DNA, 36 bp, Artificial Sequence
  Synthetic oligonucleotide
gtccacaccgcctctccttaccccgtcagtgcgaaa

SEQ ID NO: 154667 - DNA, 34 bp, Artificial Sequence
  Synthetic oligonucleotide
gacgcaatccccccgctaccgtgacttatttcaa

SEQ ID NO: 154668 - DNA, 36 bp, Artificial Sequence
  Synthetic oligonucleotide
tatttggaggtgagtgggagggatatgtgggttgaa

SEQ ID NO: 154669 - DNA, 36 bp, Artificial Sequence
  Synthetic oligonucleotide
tcgttcctcaagacccctgcccccgtgctgtgcaca

SEQ ID NO: 154670 - DNA, 35 bp, Artificial Sequence
  Synthetic oligonucleotide
tcgcgatcacatactcgtgcccggttacctgccca

SEQ ID NO: 154671 - DNA, 36 bp, Artificial Sequence
  Synthetic oligonucleotide
agtacccactacatgtgccaagctaacttcccgcca

SEQ ID NO: 154672 - DNA, 36 bp, Artificial Sequence
  Synthetic oligonucleotide
accaatcacccccagcattccaaccgacctgctcca

SEQ ID NO: 154673 - DNA, 36 bp, Artificial Sequence
  Synthetic oligonucleotide
aatggccccagcctctctccgcccttgcccgtagca

SEQ ID NO: 154674 - DNA, 35 bp, Artificial Sequence
  Synthetic oligonucleotide
accccagcaaccccctactagcccaggtccatgca

SEQ ID NO: 154675 - DNA, 35 bp, Artificial Sequence
  Synthetic oligonucleotide
gagaggcgcctccagccccgtccttttcctttgca

SEQ ID NO: 154676 - DNA, 35 bp, Artificial Sequence
  Synthetic oligonucleotide
acccacgtacctgctcaaatatgcctcgtacttca

SEQ ID NO: 154677 - DNA, 36 bp, Artificial Sequence
  Synthetic oligonucleotide
atatccagcgcggatgacctctttccacccctttca

SEQ ID NO: 154678 - DNA, 34 bp, Artificial Sequence
  Synthetic oligonucleotide
atgcacccctcatttgcacgatccgccccgacga

SEQ ID NO: 154679 - DNA, 37 bp, Artificial Sequence
  Synthetic oligonucleotide
gtgggcaatagggcgggggtaaagtagggggttacga

SEQ ID NO: 154680 - DNA, 36 bp, Artificial Sequence
  Synthetic oligonucleotide
acaaggggggtgggaggaatagtgggacgctttcga

SEQ ID NO: 154681 - DNA, 36 bp, Artificial Sequence
  Synthetic oligonucleotide
ccatcatcgccacatcgctcccgcacgccgcccgga

SEQ ID NO: 154682 - DNA, 37 bp, Artificial Sequence
  Synthetic oligonucleotide
gacaaatcggattcgaacgggagagggggggggcgga

SEQ ID NO: 154683 - DNA, 38 bp, Artificial Sequence
  Synthetic oligonucleotide
tcccccgccccggaaatggccatccccgacctatcgga

SEQ ID NO: 154684 - DNA, 36 bp, Artificial Sequence
  Synthetic oligonucleotide
tacgaccgccacgaccctcccgctcattccctggga

SEQ ID NO: 154685 - DNA, 37 bp, Artificial Sequence
  Synthetic oligonucleotide
gccacctcacactgctgcctccatccgtttatatgga

SEQ ID NO: 154686 - DNA, 38 bp, Artificial Sequence
  Synthetic oligonucleotide
tgcaacgggggggcgagggagggtatgacggtaactga

SEQ ID NO: 154687 - DNA, 38 bp, Artificial Sequence
  Synthetic oligonucleotide
acgtggaggacggtggctggggatggtgggcttactga

SEQ ID NO: 154688 - DNA, 38 bp, Artificial Sequence
  Synthetic oligonucleotide
atacgcccagctcccctggtgtttaacctccccgctga

SEQ ID NO: 154689 - DNA, 37 bp, Artificial Sequence
  Synthetic oligonucleotide
atgggtatggggcgggtggggtgatgtcacatcgtga

SEQ ID NO: 154690 - DNA, 38 bp, Artificial Sequence
  Synthetic oligonucleotide
gactagggaggggtgggggagaaggatccacggcttga

SEQ ID NO: 154691 - DNA, 37 bp, Artificial Sequence
  Synthetic oligonucleotide
gccgtgtcgccccgtcccctcgttgtttagctcttga

SEQ ID NO: 154692 - DNA, 38 bp, Artificial Sequence
  Synthetic oligonucleotide
gcgccccgacgtacccggttttgcccctgcctatttga

SEQ ID NO: 154693 - DNA, 35 bp, Artificial Sequence
  Synthetic oligonucleotide
tcagcgcgagtttgcttcacgtcttgcctccctta

SEQ ID NO: 154694 - DNA, 35 bp, Artificial Sequence
  Synthetic oligonucleotide
aacccatctcacccagtacgttcatttcgccacac

SEQ ID NO: 154695 - DNA, 35 bp, Artificial Sequence
  Synthetic oligonucleotide
ttcaccagcccttctcgtatgacgcattctgccac

SEQ ID NO: 154696 - DNA, 35 bp, Artificial Sequence
  Synthetic oligonucleotide
tgccctgtgcatttgttgatcccttccgctttcac

SEQ ID NO: 154697 - DNA, 35 bp, Artificial Sequence
  Synthetic oligonucleotide
attagcgagctgtctcctaccacctcgtcacttac

SEQ ID NO: 154698 - DNA, 35 bp, Artificial Sequence
  Synthetic oligonucleotide
accggacgacttttgctgctcccttcctctcaacc

SEQ ID NO: 154699 - DNA, 35 bp, Artificial Sequence
  Synthetic oligonucleotide
gaatagcggcggttctggtccgtcttactttcccc

SEQ ID NO: 154700 - DNA, 35 bp, Artificial Sequence
  Synthetic oligonucleotide
atcgatcaatcgcgcaattaacgccccgctcgccc

SEQ ID NO: 154701 - DNA, 35 bp, Artificial Sequence
  Synthetic oligonucleotide
gccgcttagtgccggtctgcccgactgtctccgcc

SEQ ID NO: 154702 - DNA, 35 bp, Artificial Sequence
  Synthetic oligonucleotide
gtctggcagtcacattattgtaacgtcccctcgcc

SEQ ID NO: 154703 - DNA, 35 bp, Artificial Sequence
  Synthetic oligonucleotide
ttcgctgcctccacttcgcctccgccccagctgcc

SEQ ID NO: 154704 - DNA, 35 bp, Artificial Sequence
  Synthetic oligonucleotide
accaccacatgccctgtgacgtctacggggactcc

SEQ ID NO: 154705 - DNA, 35 bp, Artificial Sequence
  Synthetic oligonucleotide
ttgatcgccaatcccagcctaggcacccaggttcc

SEQ ID NO: 154706 - DNA, 35 bp, Artificial Sequence
  Synthetic oligonucleotide
tactcgattgccggatagtcctgccgttcctttcc

SEQ ID NO: 154707 - DNA, 34 bp, Artificial Sequence
  Synthetic oligonucleotide
attgtgtccgtacgctgctgtacgccttgcccgc

SEQ ID NO: 154708 - DNA, 35 bp, Artificial Sequence
  Synthetic oligonucleotide
tcagtcctcaagcgctccccccgtatcgtccctgc

SEQ ID NO: 154709 - DNA, 35 bp, Artificial Sequence
  Synthetic oligonucleotide
tccaccccacccgccgtatatagggccaagagtgc

SEQ ID NO: 154710 - DNA, 35 bp, Artificial Sequence
  Synthetic oligonucleotide
tgttcctgtctatcccgtccgctgcccgttcttgc

SEQ ID NO: 154711 - DNA, 35 bp, Artificial Sequence
  Synthetic oligonucleotide
tgtacgccgctgttccaaacctgtttcgctctatc

SEQ ID NO: 154712 - DNA, 35 bp, Artificial Sequence
  Synthetic oligonucleotide
tagtgcacccctgttcagccgatcccgtctcgctc

SEQ ID NO: 154713 - DNA, 35 bp, Artificial Sequence
  Synthetic oligonucleotide
acgtgtactgacgtgcagctctctccttccgcttc

SEQ ID NO: 154714 - DNA, 35 bp, Artificial Sequence
  Synthetic oligonucleotide
tctcaccccctgacgctgctttcttaaaacttttc

SEQ ID NO: 154715 - DNA, 35 bp, Artificial Sequence
  Synthetic oligonucleotide
gacgatcccgctccctgtcccatctcttatgaaag

SEQ ID NO: 154716 - DNA, 35 bp, Artificial Sequence
  Synthetic oligonucleotide
gtgccagacgttcggtgcgtagccgctccccctcg

SEQ ID NO: 154717 - DNA, 35 bp, Artificial Sequence
  Synthetic oligonucleotide
ttggctgggtccgtgtgtccctgtcccgtccctcg

SEQ ID NO: 154718 - DNA, 35 bp, Artificial Sequence
  Synthetic oligonucleotide
tcatcgctctccagtcgcatacagttccctattcg

SEQ ID NO: 154719 - DNA, 35 bp, Artificial Sequence
  Synthetic oligonucleotide
accacccggctctatccctacaagcaccgtcccgg

SEQ ID NO: 154720 - DNA, 34 bp, Artificial Sequence
  Synthetic oligonucleotide
taccttcgggtggtaggctggggaccgcggccgg

SEQ ID NO: 154721 - DNA, 35 bp, Artificial Sequence
  Synthetic oligonucleotide
gcacagtcgggagtggtgggtgttgggtcacagtg

SEQ ID NO: 154722 - DNA, 35 bp, Artificial Sequence
  Synthetic oligonucleotide
tagatgtcgccgtgcaatcgccctatactcccgtg

SEQ ID NO: 154723 - DNA, 35 bp, Artificial Sequence
  Synthetic oligonucleotide
tcccccacacctccacgccccctcacaaaagtgtg

SEQ ID NO: 154724 - DNA, 35 bp, Artificial Sequence
  Synthetic oligonucleotide
agaaggatcggtaggtggaagagggaaggtgtcat

SEQ ID NO: 154725 - DNA, 35 bp, Artificial Sequence
  Synthetic oligonucleotide
gccatgcctcaccgttcctctgtgccaacgggcct

SEQ ID NO: 154726 - DNA, 35 bp, Artificial Sequence
  Synthetic oligonucleotide
accttcccagatgtgcatgatgcttatctcctcct

SEQ ID NO: 154727 - DNA, 35 bp, Artificial Sequence
  Synthetic oligonucleotide
gcagtcgcatgttcgttgtcttcgtgcttcattct

SEQ ID NO: 154728 - DNA, 35 bp, Artificial Sequence
  Synthetic oligonucleotide
gcaccctccccactgtcgcgcccgtcccttcgagt

SEQ ID NO: 154729 - DNA, 35 bp, Artificial Sequence
  Synthetic oligonucleotide
tgttcgatccacccccccgtctctgggctgcccgt

SEQ ID NO: 154730 - DNA, 35 bp, Artificial Sequence
  Synthetic oligonucleotide
ttaggggcgtccgttcctgttcgggcttctctctt

SEQ ID NO: 154731 - DNA, 35 bp, Artificial Sequence
  Synthetic oligonucleotide
gtcctcgcgccccgcccctttcttgcaccaccttt

SEQ ID NO: 154732 - DNA, 35 bp, Artificial Sequence
  Synthetic oligonucleotide
tttcgacctgcaccactcgtactacttcccggttt

SEQ ID NO: 154733 - DNA, 35 bp, Artificial Sequence
  Synthetic oligonucleotide
gcccggtccctcacctcgtcccatctcgttccaaa

SEQ ID NO: 154734 - DNA, 35 bp, Artificial Sequence
  Synthetic oligonucleotide
gtaccctcttgcgctccctccttcgtcgtttaaca

SEQ ID NO: 154735 - DNA, 36 bp, Artificial Sequence
  Synthetic oligonucleotide
gccacactgttccctcgttcgctgaatcgcgaccca

SEQ ID NO: 154736 - DNA, 36 bp, Artificial Sequence
  Synthetic oligonucleotide
gacgacgtaccgatcgaccacatctacactttccca

SEQ ID NO: 154737 - DNA, 35 bp, Artificial Sequence
  Synthetic oligonucleotide
tgtccatgcctctcgcatcgattccgttttggcca

SEQ ID NO: 154738 - DNA, 36 bp, Artificial Sequence
  Synthetic oligonucleotide
ttcatccgcccatgttagccctgctgacgatatcca

SEQ ID NO: 154739 - DNA, 36 bp, Artificial Sequence
  Synthetic oligonucleotide
actacccctgcccggtgccaacccacttctggatca

SEQ ID NO: 154740 - DNA, 35 bp, Artificial Sequence
  Synthetic oligonucleotide
tccgagctccccccagccaggtgtattcgccccga

SEQ ID NO: 154741 - DNA, 37 bp, Artificial Sequence
  Synthetic oligonucleotide
accctcccgccctgtgaaatcgctcttcttgagccga

SEQ ID NO: 154742 - DNA, 37 bp, Artificial Sequence
  Synthetic oligonucleotide
tgccttccgctatctgctgtacaccctcgccaccgga

SEQ ID NO: 154743 - DNA, 37 bp, Artificial Sequence
  Synthetic oligonucleotide
gtaccacccatcacctcattcgaccctgtcgtccgga

SEQ ID NO: 154744 - DNA, 36 bp, Artificial Sequence
  Synthetic oligonucleotide
atgggggacatggaaataggaggtaaagggcaggga

SEQ ID NO: 154745 - DNA, 36 bp, Artificial Sequence
  Synthetic oligonucleotide
acaggggagttggggttcacaaacggcgagggggga

SEQ ID NO: 154746 - DNA, 37 bp, Artificial Sequence
  Synthetic oligonucleotide
atctgtgccaaggccctatcaccgcccccctcgtgga

SEQ ID NO: 154747 - DNA, 37 bp, Artificial Sequence
  Synthetic oligonucleotide
gtacaacgtgaacgggcgagagaggaaggggggatga

SEQ ID NO: 154748 - DNA, 37 bp, Artificial Sequence
  Synthetic oligonucleotide
tggatccgccgagtgccctccctgtttcactccctga

SEQ ID NO: 154749 - DNA, 37 bp, Artificial Sequence
  Synthetic oligonucleotide
tccgcactcccctgccatttcgatcgcatccagctga

SEQ ID NO: 154750 - DNA, 38 bp, Artificial Sequence
  Synthetic oligonucleotide
tgcacttgcacattgcttacttgacctctcttggctga

SEQ ID NO: 154751 - DNA, 37 bp, Artificial Sequence
  Synthetic oligonucleotide
tagggtagtgcagtggcggctagagcgggggaggtga

SEQ ID NO: 154752 - DNA, 38 bp, Artificial Sequence
  Synthetic oligonucleotide
gtactgcgaggcgggggggaagaaagaacatcgggtga

SEQ ID NO: 154753 - DNA, 35 bp, Artificial Sequence
  Synthetic oligonucleotide
gcctggctggtcgctgcatctcttccccatcttga

SEQ ID NO: 154754 - DNA, 38 bp, Artificial Sequence
  Synthetic oligonucleotide
accacactccatactgctatcggttcacatcctgttga

SEQ ID NO: 154755 - DNA, 34 bp, Artificial Sequence
  Synthetic oligonucleotide
tgcacctccttgagccccactcccacttttttga

SEQ ID NO: 154756 - DNA, 36 bp, Artificial Sequence
  Synthetic oligonucleotide
tgaactgtgtacgtccgtcgttcctctagccctcta

SEQ ID NO: 154757 - DNA, 36 bp, Artificial Sequence
  Synthetic oligonucleotide
gccgccaggctgccctgcctattccccgagatcgta

SEQ ID NO: 154758 - DNA, 35 bp, Artificial Sequence
  Synthetic oligonucleotide
tcgcacttgcctccctgaccttgattgtctcatta

SEQ ID NO: 154759 - DNA, 35 bp, Artificial Sequence
  Synthetic oligonucleotide
gacattcctctatcgtgtctaccgccccacactta

SEQ ID NO: 154760 - DNA, 35 bp, Artificial Sequence
  Synthetic oligonucleotide
tacacctccactcttgtcaaccgactctcctgtta

SEQ ID NO: 154761 - DNA, 35 bp, Artificial Sequence
  Synthetic oligonucleotide
tatctgccctcgttcccattaatggctccggtacc

SEQ ID NO: 154762 - DNA, 35 bp, Artificial Sequence
  Synthetic oligonucleotide
accccacgcgtctgtccctgctatcccaccttgcc

SEQ ID NO: 154763 - DNA, 35 bp, Artificial Sequence
  Synthetic oligonucleotide
tgccatatccatcatcggtgtcgttgtggccctcc

SEQ ID NO: 154764 - DNA, 35 bp, Artificial Sequence
  Synthetic oligonucleotide
aagagcatccctggtatttgtcttctgtctcctcc

SEQ ID NO: 154765 - DNA, 35 bp, Artificial Sequence
  Synthetic oligonucleotide
aaccccgaatggtaaatgcctggccctatcgctcc

SEQ ID NO: 154766 - DNA, 35 bp, Artificial Sequence
  Synthetic oligonucleotide
atccccgacgtttggtattaaccatgatcctgtcc

SEQ ID NO: 154767 - DNA, 35 bp, Artificial Sequence
  Synthetic oligonucleotide
tgatcggttgcatgcgtttccttccctttttttcc

SEQ ID NO: 154768 - DNA, 35 bp, Artificial Sequence
  Synthetic oligonucleotide
acgccggtctctgccccgaacatgccattcgccgc

SEQ ID NO: 154769 - DNA, 35 bp, Artificial Sequence
  Synthetic oligonucleotide
atgtggggggggtgggggctatactagggcatcgc

SEQ ID NO: 154770 - DNA, 35 bp, Artificial Sequence
  Synthetic oligonucleotide
actcaagtcgacaactcccaccgtcctgtccttgc

SEQ ID NO: 154771 - DNA, 35 bp, Artificial Sequence
  Synthetic oligonucleotide
tccatcacttagccggactgctttcttggtcactc

SEQ ID NO: 154772 - DNA, 35 bp, Artificial Sequence
  Synthetic oligonucleotide
gcacacgcgatgaatctatgccgcctgctcccctc

SEQ ID NO: 154773 - DNA, 35 bp, Artificial Sequence
  Synthetic oligonucleotide
tatccgtgcgcttgctcctcagcatccattttctc

SEQ ID NO: 154774 - DNA, 35 bp, Artificial Sequence
  Synthetic oligonucleotide
attgacacagccaccctcggtcctaatgccacttc

SEQ ID NO: 154775 - DNA, 35 bp, Artificial Sequence
  Synthetic oligonucleotide
attcggtccgctgcctgtcgtccatccgcggtttc

SEQ ID NO: 154776 - DNA, 35 bp, Artificial Sequence
  Synthetic oligonucleotide
acagtgccccttgttctatatctcaccacccatag

SEQ ID NO: 154777 - DNA, 35 bp, Artificial Sequence
  Synthetic oligonucleotide
gtccttcactcggtcgccgccacttgttgtccccg

SEQ ID NO: 154778 - DNA, 35 bp, Artificial Sequence
  Synthetic oligonucleotide
ttgacgccgtacgtttcgttatcttcatccgcccg

SEQ ID NO: 154779 - DNA, 35 bp, Artificial Sequence
  Synthetic oligonucleotide
tcaccggggagaataggatagggaaagggcaagcg

SEQ ID NO: 154780 - DNA, 35 bp, Artificial Sequence
  Synthetic oligonucleotide
tcgaccctttgatcgtctctcacctcctaattagg

SEQ ID NO: 154781 - DNA, 35 bp, Artificial Sequence
  Synthetic oligonucleotide
tcctcgacgcgatcactctttccggtccctcttgg

SEQ ID NO: 154782 - DNA, 35 bp, Artificial Sequence
  Synthetic oligonucleotide
tacctgttacaactgccgccccatcatgagacctg

SEQ ID NO: 154783 - DNA, 35 bp, Artificial Sequence
  Synthetic oligonucleotide
ggagtcccaatccctcccgttcacctcgcccaaat

SEQ ID NO: 154784 - DNA, 35 bp, Artificial Sequence
  Synthetic oligonucleotide
gccccatcgtggcctccccaaccctctcatttgat

SEQ ID NO: 154785 - DNA, 35 bp, Artificial Sequence
  Synthetic oligonucleotide
tgactcccccccatgcgtccgcgcgtagcctctat

SEQ ID NO: 154786 - DNA, 35 bp, Artificial Sequence
  Synthetic oligonucleotide
ttgctacctccttctaggcttaacgacccgcctct

SEQ ID NO: 154787 - DNA, 35 bp, Artificial Sequence
  Synthetic oligonucleotide
acccatgcctactcccgcctcatatctgtttttct

SEQ ID NO: 154788 - DNA, 35 bp, Artificial Sequence
  Synthetic oligonucleotide
gaaaggagtggagatcaaggaggtaggggagtggt

SEQ ID NO: 154789 - DNA, 35 bp, Artificial Sequence
  Synthetic oligonucleotide
tgccccacgcaaggttagctacccgtttcctcctt

SEQ ID NO: 154790 - DNA, 35 bp, Artificial Sequence
  Synthetic oligonucleotide
gtaaagacgaaaggggggggtagagggtagtggtt

SEQ ID NO: 154791 - DNA, 35 bp, Artificial Sequence
  Synthetic oligonucleotide
atctattcgccacgcctccttatccgttccatgtt

SEQ ID NO: 154792 - DNA, 35 bp, Artificial Sequence
  Synthetic oligonucleotide
ttccacccctagccctgttggttaccccttagaaa

SEQ ID NO: 154793 - DNA, 36 bp, Artificial Sequence
  Synthetic oligonucleotide
atgagaagggggagggtggctactggaggcaggcaa

SEQ ID NO: 154794 - DNA, 36 bp, Artificial Sequence
  Synthetic oligonucleotide
acgccccccatcgccacgttaaaaacaccccctgaa

SEQ ID NO: 154795 - DNA, 36 bp, Artificial Sequence
  Synthetic oligonucleotide
tttacatccgtcccttgtcattctctgcccccgaca

SEQ ID NO: 154796 - DNA, 36 bp, Artificial Sequence
  Synthetic oligonucleotide
tcgaacgtgccatccttcataagccggtaactccca

SEQ ID NO: 154797 - DNA, 36 bp, Artificial Sequence
  Synthetic oligonucleotide
tagccgctgtccataatgaaccgcgctctacctcca

SEQ ID NO: 154798 - DNA, 36 bp, Artificial Sequence
  Synthetic oligonucleotide
gttaccagcctcaccgcgctatccgacccgtgtcca

SEQ ID NO: 154799 - DNA, 36 bp, Artificial Sequence
  Synthetic oligonucleotide
ttgccgtatagaaggccgccgctccctgcactctca

SEQ ID NO: 154800 - DNA, 36 bp, Artificial Sequence
  Synthetic oligonucleotide
tccatgcatcaccgtcttcctccctcctcgtgttca

SEQ ID NO: 154801 - DNA, 36 bp, Artificial Sequence
  Synthetic oligonucleotide
gtcatgaggggggaggaatgagggcagtcaatacga

SEQ ID NO: 154802 - DNA, 36 bp, Artificial Sequence
  Synthetic oligonucleotide
gggttggtgggggagggtaaacgtaggacgctacga

SEQ ID NO: 154803 - DNA, 36 bp, Artificial Sequence
  Synthetic oligonucleotide
gtccactcccccaatgtaacgcttattcttgtacga

SEQ ID NO: 154804 - DNA, 37 bp, Artificial Sequence
  Synthetic oligonucleotide
tgtgctatcgccaccatctgccgttcatacccaccga

SEQ ID NO: 154805 - DNA, 37 bp, Artificial Sequence
  Synthetic oligonucleotide
acaccccgccctcatcgtgtctcgtccacctcctcga

SEQ ID NO: 154806 - DNA, 37 bp, Artificial Sequence
  Synthetic oligonucleotide
taaagcatcgggggggactcaagggggtgtgggcgga

SEQ ID NO: 154807 - DNA, 37 bp, Artificial Sequence
  Synthetic oligonucleotide
ggatgaatcgggagtaggagggcagggacgcgaggga

SEQ ID NO: 154808 - DNA, 37 bp, Artificial Sequence
  Synthetic oligonucleotide
ggtcaccgcaggcgagaaggggggcacgataggggga

SEQ ID NO: 154809 - DNA, 37 bp, Artificial Sequence
  Synthetic oligonucleotide
tgggtagtggcggtttccatcctagggcggtggggga

SEQ ID NO: 154810 - DNA, 38 bp, Artificial Sequence
  Synthetic oligonucleotide
gtggggagaaggaagaaaagggacagcatggaagatga

SEQ ID NO: 154811 - DNA, 38 bp, Artificial Sequence
  Synthetic oligonucleotide
ggggagttgaacgggtgagggacaattatgggggatga

SEQ ID NO: 154812 - DNA, 38 bp, Artificial Sequence
  Synthetic oligonucleotide
gtaggtgggggagcatggggcccgggcggataaactga

SEQ ID NO: 154813 - DNA, 38 bp, Artificial Sequence
  Synthetic oligonucleotide
gccagactcttgcgtagccccacattgttccaccctga

SEQ ID NO: 154814 - DNA, 38 bp, Artificial Sequence
  Synthetic oligonucleotide
tgacaacctgatcctgagcactgccgcccatcccctga

SEQ ID NO: 154815 - DNA, 38 bp, Artificial Sequence
  Synthetic oligonucleotide
aagtcatcagggaggggagggcagggcacgagatctga

SEQ ID NO: 154816 - DNA, 37 bp, Artificial Sequence
  Synthetic oligonucleotide
tagccaactcccttgtttactacctccccataggtga

SEQ ID NO: 154817 - DNA, 36 bp, Artificial Sequence
  Synthetic oligonucleotide
gcctgcccccttgtgccccacttcccttccctgtga

SEQ ID NO: 154818 - DNA, 38 bp, Artificial Sequence
  Synthetic oligonucleotide
aaccgccaccacacccgcgccacgttatctatctgtga

SEQ ID NO: 154819 - DNA, 36 bp, Artificial Sequence
  Synthetic oligonucleotide
actcgatgccacactcttccgtaagttcaacccata

SEQ ID NO: 154820 - DNA, 35 bp, Artificial Sequence
  Synthetic oligonucleotide
tacgttcacctgtgtctcattcgttccctgcccta

SEQ ID NO: 154821 - DNA, 36 bp, Artificial Sequence
  Synthetic oligonucleotide
tcgactgtccccacaccctcctccagcactgtagta

SEQ ID NO: 154822 - DNA, 35 bp, Artificial Sequence
  Synthetic oligonucleotide
actccccctccgtaacgaacgtttctgctgcttta

SEQ ID NO: 154823 - DNA, 35 bp, Artificial Sequence
  Synthetic oligonucleotide
tgtacactgcccccctccatctttcccgcggttta

SEQ ID NO: 154824 - DNA, 35 bp, Artificial Sequence
  Synthetic oligonucleotide
acgcactcagagccgctcactcgaaccctctttta

SEQ ID NO: 154825 - DNA, 35 bp, Artificial Sequence
  Synthetic oligonucleotide
atgacagactgctctatacgaccgccctcctcaac

SEQ ID NO: 154826 - DNA, 35 bp, Artificial Sequence
  Synthetic oligonucleotide
tcacccccgcttgtaacccgagcgcacgcttccac

SEQ ID NO: 154827 - DNA, 35 bp, Artificial Sequence
  Synthetic oligonucleotide
agcccaaactgtttgacatcgtcctgctcttcacc

SEQ ID NO: 154828 - DNA, 35 bp, Artificial Sequence
  Synthetic oligonucleotide
gtgccactcctcgaatgacagccctgcgaccgccc

SEQ ID NO: 154829 - DNA, 35 bp, Artificial Sequence
  Synthetic oligonucleotide
cactccggtccatgtctgcctcgctacctatgccc

SEQ ID NO: 154830 - DNA, 35 bp, Artificial Sequence
  Synthetic oligonucleotide
tacgtactctggccccggtaaaacgatctctcgcc

SEQ ID NO: 154831 - DNA, 35 bp, Artificial Sequence
  Synthetic oligonucleotide
taggccatccttctcgttatcttcactctgtcgcc

SEQ ID NO: 154832 - DNA, 35 bp, Artificial Sequence
  Synthetic oligonucleotide
ttgtccgtagccgggagtgtcctcgccgtttcgcc

SEQ ID NO: 154833 - DNA, 35 bp, Artificial Sequence
  Synthetic oligonucleotide
gataccacgtacgttatggggccgcccacctccgc

SEQ ID NO: 154834 - DNA, 33 bp, Artificial Sequence
  Synthetic oligonucleotide
ttgacatcttggtcaccgcatccccgttttcgc

SEQ ID NO: 154835 - DNA, 35 bp, Artificial Sequence
  Synthetic oligonucleotide
gtccccgccgttgttcaccccccgcctttcccggc

SEQ ID NO: 154836 - DNA, 35 bp, Artificial Sequence
  Synthetic oligonucleotide
taccagcattccgttgccaacgcccatttgccatc

SEQ ID NO: 154837 - DNA, 35 bp, Artificial Sequence
  Synthetic oligonucleotide
tcagcctgtcatcgatcttgtccttccagcatatc

SEQ ID NO: 154838 - DNA, 35 bp, Artificial Sequence
  Synthetic oligonucleotide
tctatccgctctcaatctgtcttcaaagcgccctc

SEQ ID NO: 154839 - DNA, 35 bp, Artificial Sequence
  Synthetic oligonucleotide
acccagcaacctggcactccccctttgttacgctc

SEQ ID NO: 154840 - DNA, 35 bp, Artificial Sequence
  Synthetic oligonucleotide
gggagccctgttggtcgcttggtcgttctcctctc

SEQ ID NO: 154841 - DNA, 35 bp, Artificial Sequence
  Synthetic oligonucleotide
atgcgctccgtagctctgtgcctgttcgcgttgtc

SEQ ID NO: 154842 - DNA, 35 bp, Artificial Sequence
  Synthetic oligonucleotide
tagggtctggtccgtccgctttctcctcgtttgtc

SEQ ID NO: 154843 - DNA, 35 bp, Artificial Sequence
  Synthetic oligonucleotide
atccctgtcgactagtgccctcgttcctctccttc

SEQ ID NO: 154844 - DNA, 35 bp, Artificial Sequence
  Synthetic oligonucleotide
atggggggggagtgagactggaaggggaagagaag

SEQ ID NO: 154845 - DNA, 35 bp, Artificial Sequence
  Synthetic oligonucleotide
gtaggcccctcacccggttcctgttttgcctaacg

SEQ ID NO: 154846 - DNA, 35 bp, Artificial Sequence
  Synthetic oligonucleotide
gggacgggtggagccgggggggaggtcggatgtcg

SEQ ID NO: 154847 - DNA, 35 bp, Artificial Sequence
  Synthetic oligonucleotide
atgcatccccttgcctgatctcccttttgctgtgg

SEQ ID NO: 154848 - DNA, 35 bp, Artificial Sequence
  Synthetic oligonucleotide
tgcaccctccggccccgacaccctattggcttaat

SEQ ID NO: 154849 - DNA, 35 bp, Artificial Sequence
  Synthetic oligonucleotide
tccgtgcgcctaccgtcctttacgtacccccccat

SEQ ID NO: 154850 - DNA, 35 bp, Artificial Sequence
  Synthetic oligonucleotide
agcccccacccgccgtcgtcgctaaaaaggcccat

SEQ ID NO: 154851 - DNA, 35 bp, Artificial Sequence
  Synthetic oligonucleotide
ttacacgcgatcgcttgttcttcgccaattcccct

SEQ ID NO: 154852 - DNA, 35 bp, Artificial Sequence
  Synthetic oligonucleotide
gcctcattgctggtacgctccaccttctacacgct

SEQ ID NO: 154853 - DNA, 35 bp, Artificial Sequence
  Synthetic oligonucleotide
ttcgcaccccagccctccagaccctcctgctgtct

SEQ ID NO: 154854 - DNA, 35 bp, Artificial Sequence
  Synthetic oligonucleotide
gcacgttcacaccgtcatcttatggctcccgttct

SEQ ID NO: 154855 - DNA, 35 bp, Artificial Sequence
  Synthetic oligonucleotide
actcctgcacctgtcccggaacccacacctcccgt

SEQ ID NO: 154856 - DNA, 35 bp, Artificial Sequence
  Synthetic oligonucleotide
ttgtggctgcccatcccgaccgttcccccccgcgt

SEQ ID NO: 154857 - DNA, 35 bp, Artificial Sequence
  Synthetic oligonucleotide
ggagtgggggacggagctggggtcggagacggggt

SEQ ID NO: 154858 - DNA, 35 bp, Artificial Sequence
  Synthetic oligonucleotide
ttgacgtaccgcccaacactgtctgtaaaccctgt

SEQ ID NO: 154859 - DNA, 35 bp, Artificial Sequence
  Synthetic oligonucleotide
acgatcccctgctacgtaagcctttcatttcctgt

SEQ ID NO: 154860 - DNA, 35 bp, Artificial Sequence
  Synthetic oligonucleotide
ttctaccgcccctgccacccccgccaacttcttgt

SEQ ID NO: 154861 - DNA, 35 bp, Artificial Sequence
  Synthetic oligonucleotide
gagggcgaggtgggaggtaggggtgacttgcgatt

SEQ ID NO: 154862 - DNA, 35 bp, Artificial Sequence
  Synthetic oligonucleotide
gcccgtgcgccctatcacctaccctgcccaacgtt

SEQ ID NO: 154863 - DNA, 35 bp, Artificial Sequence
  Synthetic oligonucleotide
agccgctttcaccctgttacacccggcccactgtt

SEQ ID NO: 154864 - DNA, 36 bp, Artificial Sequence
  Synthetic oligonucleotide
accccccccctgccgtgcacttcactggacgcaaaa

SEQ ID NO: 154865 - DNA, 36 bp, Artificial Sequence
  Synthetic oligonucleotide
gcctccgcctcccgccgtatgattaaggcctcctaa

SEQ ID NO: 154866 - DNA, 34 bp, Artificial Sequence
  Synthetic oligonucleotide
tcgcccaccatcatacgcgcctccatttttctaa

SEQ ID NO: 154867 - DNA, 36 bp, Artificial Sequence
  Synthetic oligonucleotide
tcctccccccccgcacgagtagagctatgttcgaca

SEQ ID NO: 154868 - DNA, 36 bp, Artificial Sequence
  Synthetic oligonucleotide
attagacaacgtgccactgctaagccttcctctaca

SEQ ID NO: 154869 - DNA, 36 bp, Artificial Sequence
  Synthetic oligonucleotide
acccgccctccagctattaatttcgctacctcacca

SEQ ID NO: 154870 - DNA, 35 bp, Artificial Sequence
  Synthetic oligonucleotide
tatccacgagtcggcctgtccctgtccatcgccca

SEQ ID NO: 154871 - DNA, 36 bp, Artificial Sequence
  Synthetic oligonucleotide
ggtccactttgccatttaacgccccagccctgccca

SEQ ID NO: 154872 - DNA, 36 bp, Artificial Sequence
  Synthetic oligonucleotide
agttaaccactcccatccagcgtcatcttgccgcca

SEQ ID NO: 154873 - DNA, 36 bp, Artificial Sequence
  Synthetic oligonucleotide
tgtcacctccggtcttagccacccagccccttcgca

SEQ ID NO: 154874 - DNA, 36 bp, Artificial Sequence
  Synthetic oligonucleotide
ttggtgtggcgcagcagggacggggggattacggca

SEQ ID NO: 154875 - DNA, 36 bp, Artificial Sequence
  Synthetic oligonucleotide
gccttccccccgtgtgtcctatctaggtagcatgca

SEQ ID NO: 154876 - DNA, 36 bp, Artificial Sequence
  Synthetic oligonucleotide
tcccatccgtctatcggcaccccttatacgcctgca

SEQ ID NO: 154877 - DNA, 36 bp, Artificial Sequence
  Synthetic oligonucleotide
ttgcaactgctgccccctactcctctgccgattgca

SEQ ID NO: 154878 - DNA, 36 bp, Artificial Sequence
  Synthetic oligonucleotide
tgtgctcgcccaccgtaccctccgcctacagtaaga

SEQ ID NO: 154879 - DNA, 37 bp, Artificial Sequence
  Synthetic oligonucleotide
tcatcaacgactaggtccgccgccgcccctgcgcaga

SEQ ID NO: 154880 - DNA, 37 bp, Artificial Sequence
  Synthetic oligonucleotide
gaggtcgcaggagatagaaggaacaaatggtggcaga

SEQ ID NO: 154881 - DNA, 37 bp, Artificial Sequence
  Synthetic oligonucleotide
gatccctccctgggccctgtactgtctttagcctaga

SEQ ID NO: 154882 - DNA, 36 bp, Artificial Sequence
  Synthetic oligonucleotide
gagaggcgagacaacgggggaaggtagtaggctaga

SEQ ID NO: 154883 - DNA, 37 bp, Artificial Sequence
  Synthetic oligonucleotide
gggtgggcgggtttgggttcttgagaattcgcaccga

SEQ ID NO: 154884 - DNA, 36 bp, Artificial Sequence
  Synthetic oligonucleotide
agcctccctcccgagtggtttcctccccatccgcga

SEQ ID NO: 154885 - DNA, 37 bp, Artificial Sequence
  Synthetic oligonucleotide
agggaggtagggcgcgtaggcaaggggcgggcatcga

SEQ ID NO: 154886 - DNA, 37 bp, Artificial Sequence
  Synthetic oligonucleotide
tcccacccatggccacctgccgacctttcccaacgga

SEQ ID NO: 154887 - DNA, 37 bp, Artificial Sequence
  Synthetic oligonucleotide
tacgacccccccctcagattgtcagcccagcctcgga

SEQ ID NO: 154888 - DNA, 37 bp, Artificial Sequence
  Synthetic oligonucleotide
accctaccaccttcaatgcacatgttccgtccgggga

SEQ ID NO: 154889 - DNA, 35 bp, Artificial Sequence
  Synthetic oligonucleotide
tgtgcacgccccgtctcctccgctatgacctatga

SEQ ID NO: 154890 - DNA, 38 bp, Artificial Sequence
  Synthetic oligonucleotide
accccaccaccacagaccctccgcagtctgaccactga

SEQ ID NO: 154891 - DNA, 38 bp, Artificial Sequence
  Synthetic oligonucleotide
gagcccgtgccctgtaatttgctatccctcgtgcctga

SEQ ID NO: 154892 - DNA, 38 bp, Artificial Sequence
  Synthetic oligonucleotide
ttggtcccgccctctgctttctcgagctgtgctcctga

SEQ ID NO: 154893 - DNA, 35 bp, Artificial Sequence
  Synthetic oligonucleotide
agagagcaggggggtgattggcatgaggggagtga

SEQ ID NO: 154894 - DNA, 38 bp, Artificial Sequence
  Synthetic oligonucleotide
ggttaggggagggggggtggagatgagggggctattga

SEQ ID NO: 154895 - DNA, 35 bp, Artificial Sequence
  Synthetic oligonucleotide
gtcgaccttgactccgccgctttataatgccttga

SEQ ID NO: 154896 - DNA, 36 bp, Artificial Sequence
  Synthetic oligonucleotide
gaaccctcctctctgatctcgatctatgccatgcta

SEQ ID NO: 154897 - DNA, 36 bp, Artificial Sequence
  Synthetic oligonucleotide
gaacgccgttgctttttttggtcccgactccatcta

SEQ ID NO: 154898 - DNA, 36 bp, Artificial Sequence
  Synthetic oligonucleotide
taagcggtgtgggtgcgggttcgggggagtaaggta

SEQ ID NO: 154899 - DNA, 36 bp, Artificial Sequence
  Synthetic oligonucleotide
actcgacctgacctccttagtgctaccacatttgta

SEQ ID NO: 154900 - DNA, 36 bp, Artificial Sequence
  Synthetic oligonucleotide
tgtgaaccctctatgtcccgttccacccggatttta

SEQ ID NO: 154901 - DNA, 35 bp, Artificial Sequence
  Synthetic oligonucleotide
actatgcgagggcgtcgttcgttcttgcttcctac

SEQ ID NO: 154902 - DNA, 35 bp, Artificial Sequence
  Synthetic oligonucleotide
agacccgccccgccgccaccatttacgggtattac

SEQ ID NO: 154903 - DNA, 35 bp, Artificial Sequence
  Synthetic oligonucleotide
gcttaacgcaaacctctatcccagccctggtcccc

SEQ ID NO: 154904 - DNA, 35 bp, Artificial Sequence
  Synthetic oligonucleotide
gatcgtgaccgcccggtgcctcctgtaaatacgcc

SEQ ID NO: 154905 - DNA, 35 bp, Artificial Sequence
  Synthetic oligonucleotide
ttacaccagtctacccatccacggcccccgctgcc

SEQ ID NO: 154906 - DNA, 35 bp, Artificial Sequence
  Synthetic oligonucleotide
tttcgcggtcagtttccgcttcccggtcccgtgcc

SEQ ID NO: 154907 - DNA, 35 bp, Artificial Sequence
  Synthetic oligonucleotide
tcacgcaggccacgattcccccacgttccacctcc

SEQ ID NO: 154908 - DNA, 35 bp, Artificial Sequence
  Synthetic oligonucleotide
tacgtaccgtagcccatagaatagtctggccctcc

SEQ ID NO: 154909 - DNA, 35 bp, Artificial Sequence
  Synthetic oligonucleotide
tgtgatgtaccctccgcgtcctgatgcccccgtcc

SEQ ID NO: 154910 - DNA, 35 bp, Artificial Sequence
  Synthetic oligonucleotide
acgcccccattctcatgtttcgttatcacttgtcc

SEQ ID NO: 154911 - DNA, 35 bp, Artificial Sequence
  Synthetic oligonucleotide
actgccccccgctcaacggtttagcccttccacgc

SEQ ID NO: 154912 - DNA, 35 bp, Artificial Sequence
  Synthetic oligonucleotide
accatcacccgccctgtgagagggcccagccttgc

SEQ ID NO: 154913 - DNA, 35 bp, Artificial Sequence
  Synthetic oligonucleotide
gtccacccccgcgagccggaacggaatccattatc

SEQ ID NO: 154914 - DNA, 35 bp, Artificial Sequence
  Synthetic oligonucleotide
gaacttacccccccgtgttgttgtcgactatactc

SEQ ID NO: 154915 - DNA, 35 bp, Artificial Sequence
  Synthetic oligonucleotide
ttcaagtcacgtgcctggtgccacccctcattttc

SEQ ID NO: 154916 - DNA, 35 bp, Artificial Sequence
  Synthetic oligonucleotide
tgactacaccacactatttgaacatctgtttcccg

SEQ ID NO: 154917 - DNA, 35 bp, Artificial Sequence
  Synthetic oligonucleotide
tgcccgctccgccccccccctaactttaggatagg

SEQ ID NO: 154918 - DNA, 35 bp, Artificial Sequence
  Synthetic oligonucleotide
ttatgtggggctaaggagaggagaggaactggggg

SEQ ID NO: 154919 - DNA, 35 bp, Artificial Sequence
  Synthetic oligonucleotide
tctgtccgctacattgctctcccctcacttatggg

SEQ ID NO: 154920 - DNA, 35 bp, Artificial Sequence
  Synthetic oligonucleotide
tgcgggagtggtgggggggctgcatacgcaatatg

SEQ ID NO: 154921 - DNA, 35 bp, Artificial Sequence
  Synthetic oligonucleotide
gacccctcggttcctgtatcacccttctcgtacct

SEQ ID NO: 154922 - DNA, 35 bp, Artificial Sequence
  Synthetic oligonucleotide
tccacactcctgatgccatccgcgtttcgttccct

SEQ ID NO: 154923 - DNA, 35 bp, Artificial Sequence
  Synthetic oligonucleotide
tatgccaagcagtccgcgaacccccctctttggct

SEQ ID NO: 154924 - DNA, 35 bp, Artificial Sequence
  Synthetic oligonucleotide
gtccgagcactgttcccgatcacgcgaccttctct

SEQ ID NO: 154925 - DNA, 35 bp, Artificial Sequence
  Synthetic oligonucleotide
ggtctacctaagtgcgtgatcgcctccacccttct

SEQ ID NO: 154926 - DNA, 35 bp, Artificial Sequence
  Synthetic oligonucleotide
agcagtatcatcactcgcccggcccccgtttccgt

SEQ ID NO: 154927 - DNA, 35 bp, Artificial Sequence
  Synthetic oligonucleotide
tccgacaccaccgaaccccgacctggtcggccctt

SEQ ID NO: 154928 - DNA, 35 bp, Artificial Sequence
  Synthetic oligonucleotide
tgttacgtgcaagaacaagcgcacttacctccctt

SEQ ID NO: 154929 - DNA, 36 bp, Artificial Sequence
  Synthetic oligonucleotide
gtgggacgggaccagggtgacactggtgaggggaaa

SEQ ID NO: 154930 - DNA, 36 bp, Artificial Sequence
  Synthetic oligonucleotide
tgccgaacctcccgcgattagtcctgtttcactgaa

SEQ ID NO: 154931 - DNA, 35 bp, Artificial Sequence
  Synthetic oligonucleotide
gcgaacgccacaattatgcccaccccttcagtgaa

SEQ ID NO: 154932 - DNA, 36 bp, Artificial Sequence
  Synthetic oligonucleotide
acgcccgcctgccgcccctataacttggctttacca

SEQ ID NO: 154933 - DNA, 36 bp, Artificial Sequence
  Synthetic oligonucleotide
gactacccgattgttgttcgcgattccaccctgcca

SEQ ID NO: 154934 - DNA, 35 bp, Artificial Sequence
  Synthetic oligonucleotide
aaatcacgcgacacatgctcccgtccgcccttcca

SEQ ID NO: 154935 - DNA, 35 bp, Artificial Sequence
  Synthetic oligonucleotide
tcgcccctgctttcacattcccatccgcctgatca

SEQ ID NO: 154936 - DNA, 36 bp, Artificial Sequence
  Synthetic oligonucleotide
tgcgtgtgcctgcgatcgtcttcacttatcctctca

SEQ ID NO: 154937 - DNA, 37 bp, Artificial Sequence
  Synthetic oligonucleotide
gtgcaggagggacgatggataggtagtgatggtcaga

SEQ ID NO: 154938 - DNA, 37 bp, Artificial Sequence
  Synthetic oligonucleotide
gtggaagtcagggggaacagggaggcatgtgaggaga

SEQ ID NO: 154939 - DNA, 37 bp, Artificial Sequence
  Synthetic oligonucleotide
tgcacctcggtcatatttgccctttccgttttgccga

SEQ ID NO: 154940 - DNA, 37 bp, Artificial Sequence
  Synthetic oligonucleotide
atagacacggaggtgggcataagggaagggtgggcga

SEQ ID NO: 154941 - DNA, 37 bp, Artificial Sequence
  Synthetic oligonucleotide
gcaaagagcggaagatgtcgggtggagggggggagga

SEQ ID NO: 154942 - DNA, 37 bp, Artificial Sequence
  Synthetic oligonucleotide
tgcgcaagccgcagcgtacgctccattcttcccggga

SEQ ID NO: 154943 - DNA, 37 bp, Artificial Sequence
  Synthetic oligonucleotide
tgacaagacaagacgatggatggcgggggaacgggga

SEQ ID NO: 154944 - DNA, 36 bp, Artificial Sequence
  Synthetic oligonucleotide
tagcggtgaggggggactatcaaagcagggtgggga

SEQ ID NO: 154945 - DNA, 37 bp, Artificial Sequence
  Synthetic oligonucleotide
gatttccgcccctgtctggtactcgggccttccctga

SEQ ID NO: 154946 - DNA, 37 bp, Artificial Sequence
  Synthetic oligonucleotide
ggatcacgcgcaccgttggtatcatctttcccgctga

SEQ ID NO: 154947 - DNA, 38 bp, Artificial Sequence
  Synthetic oligonucleotide
tcccagggagacgggaagggtattgtggggggggctga

SEQ ID NO: 154948 - DNA, 38 bp, Artificial Sequence
  Synthetic oligonucleotide
tcgaaccatcccgtgcaccacctgtcacttaacagtga

SEQ ID NO: 154949 - DNA, 38 bp, Artificial Sequence
  Synthetic oligonucleotide
gaccgctccccatggcttctgttctctcccggacgtga

SEQ ID NO: 154950 - DNA, 38 bp, Artificial Sequence
  Synthetic oligonucleotide
gatgcccgacgacctgttcgcctcccgttatcccgtga

SEQ ID NO: 154951 - DNA, 36 bp, Artificial Sequence
  Synthetic oligonucleotide
gatgacgccgcgaatgaagaatggagggggaggtga

SEQ ID NO: 154952 - DNA, 37 bp, Artificial Sequence
  Synthetic oligonucleotide
gacccgggaggggtaaaggggaactaagtaagggtga

SEQ ID NO: 154953 - DNA, 36 bp, Artificial Sequence
  Synthetic oligonucleotide
ggtgttaggggctggagggaaatggggcacgggtga

SEQ ID NO: 154954 - DNA, 38 bp, Artificial Sequence
  Synthetic oligonucleotide
gactcaccctcaactgagccttgttccatccaatgtga

SEQ ID NO: 154955 - DNA, 38 bp, Artificial Sequence
  Synthetic oligonucleotide
gatcgtccggtcgcctgccacatcttcacctgacttga

SEQ ID NO: 154956 - DNA, 38 bp, Artificial Sequence
  Synthetic oligonucleotide
gacttcacgccctggatcgtttaatttctcgcccttga

SEQ ID NO: 154957 - DNA, 35 bp, Artificial Sequence
  Synthetic oligonucleotide
tgctccgctgtgccacatccgttatccttgcgcta

SEQ ID NO: 154958 - DNA, 34 bp, Artificial Sequence
  Synthetic oligonucleotide
gacttccttccccccgcacgtgcataatactgta

SEQ ID NO: 154959 - DNA, 36 bp, Artificial Sequence
  Synthetic oligonucleotide
tccatcactcgctttgacctatccaccagaacatta

SEQ ID NO: 154960 - DNA, 35 bp, Artificial Sequence
  Synthetic oligonucleotide
gaaggggggctcaaaatctgggtgcggggttcaac

SEQ ID NO: 154961 - DNA, 35 bp, Artificial Sequence
  Synthetic oligonucleotide
tgttccttcaggccgagattttgtcctgctttcac

SEQ ID NO: 154962 - DNA, 35 bp, Artificial Sequence
  Synthetic oligonucleotide
tgtcccccccacatgttgtcgttcggtcccgggac

SEQ ID NO: 154963 - DNA, 35 bp, Artificial Sequence
  Synthetic oligonucleotide
tgaccttccccaagttcggctttttagtgcccccc

SEQ ID NO: 154964 - DNA, 35 bp, Artificial Sequence
  Synthetic oligonucleotide
tgtgattcccccgcagtacgaccccaaccggtccc

SEQ ID NO: 154965 - DNA, 35 bp, Artificial Sequence
  Synthetic oligonucleotide
acttgacccgcccgcttgtttttgaacccgttccc

SEQ ID NO: 154966 - DNA, 35 bp, Artificial Sequence
  Synthetic oligonucleotide
gtcgccaagctctcctcgtcactttttagctcgcc

SEQ ID NO: 154967 - DNA, 35 bp, Artificial Sequence
  Synthetic oligonucleotide
gtatcaactcggtatcactcgcccctggttcatcc

SEQ ID NO: 154968 - DNA, 35 bp, Artificial Sequence
  Synthetic oligonucleotide
gcccatgtaacagacgccgtctatcacgtccctcc

SEQ ID NO: 154969 - DNA, 35 bp, Artificial Sequence
  Synthetic oligonucleotide
aattgcctcgctccgcccctgcgtaccccgaacgc

SEQ ID NO: 154970 - DNA, 35 bp, Artificial Sequence
  Synthetic oligonucleotide
ttcgggtcgctccattctgacttccttctgtccgc

SEQ ID NO: 154971 - DNA, 35 bp, Artificial Sequence
  Synthetic oligonucleotide
tctgcccctcctgcaaattgccttcacccttccgc

SEQ ID NO: 154972 - DNA, 35 bp, Artificial Sequence
  Synthetic oligonucleotide
aggggggtggggcccagggtggggaattatctcgc

SEQ ID NO: 154973 - DNA, 35 bp, Artificial Sequence
  Synthetic oligonucleotide
acagggaggagggaggttggggactttcgagaggc

SEQ ID NO: 154974 - DNA, 35 bp, Artificial Sequence
  Synthetic oligonucleotide
accctcgcttctggcatccattctgggcctcctgc

SEQ ID NO: 154975 - DNA, 35 bp, Artificial Sequence
  Synthetic oligonucleotide
agtacacattgcttacggccacccacccttgctgc

SEQ ID NO: 154976 - DNA, 35 bp, Artificial Sequence
  Synthetic oligonucleotide
tgtattccaccctgccttatcccccctggttgtgc

SEQ ID NO: 154977 - DNA, 35 bp, Artificial Sequence
  Synthetic oligonucleotide
gcctcccgccgacttttctttgcattagcttttgc

SEQ ID NO: 154978 - DNA, 35 bp, Artificial Sequence
  Synthetic oligonucleotide
tacaccttcacacaactatcgtcctgtgctcgctc

SEQ ID NO: 154979 - DNA, 35 bp, Artificial Sequence
  Synthetic oligonucleotide
gcccacctccggtctgagccaccgcacatttgctc

SEQ ID NO: 154980 - DNA, 35 bp, Artificial Sequence
  Synthetic oligonucleotide
tgactgcacgtgccttctccttccgacgtagagtc

SEQ ID NO: 154981 - DNA, 35 bp, Artificial Sequence
  Synthetic oligonucleotide
gccaactcccgttcgcacccgtatcaatatctgtc

SEQ ID NO: 154982 - DNA, 35 bp, Artificial Sequence
  Synthetic oligonucleotide
gcaatgcggtcacccctattgctgcggtccctttc

SEQ ID NO: 154983 - DNA, 35 bp, Artificial Sequence
  Synthetic oligonucleotide
atctcccgcacatcctgttttctaggcccgtaccg

SEQ ID NO: 154984 - DNA, 35 bp, Artificial Sequence
  Synthetic oligonucleotide
gacggaattgggcaataggagaggggtgaacgggg

SEQ ID NO: 154985 - DNA, 35 bp, Artificial Sequence
  Synthetic oligonucleotide
tgcgacgcacgatgactctcaagtcctacctcctg

SEQ ID NO: 154986 - DNA, 35 bp, Artificial Sequence
  Synthetic oligonucleotide
ttgagtcaccgcagcctcgccttcccggagtccct

SEQ ID NO: 154987 - DNA, 35 bp, Artificial Sequence
  Synthetic oligonucleotide
gatgctgtgcgttaccccgccctggtccctcgcct

SEQ ID NO: 154988 - DNA, 35 bp, Artificial Sequence
  Synthetic oligonucleotide
ataggggagggcgggccgggtaggactctcaggct

SEQ ID NO: 154989 - DNA, 35 bp, Artificial Sequence
  Synthetic oligonucleotide
acccagcccctccctgctgaacccttttccgtggt

SEQ ID NO: 154990 - DNA, 35 bp, Artificial Sequence
  Synthetic oligonucleotide
ttgcccctccccacagtacccagagcctgtgctgt

SEQ ID NO: 154991 - DNA, 35 bp, Artificial Sequence
  Synthetic oligonucleotide
atcgtggcgtccatcgcgtgatgcctccccttatt

SEQ ID NO: 154992 - DNA, 35 bp, Artificial Sequence
  Synthetic oligonucleotide
tcccagccccgataccccgttccagtccacgcctt

SEQ ID NO: 154993 - DNA, 34 bp, Artificial Sequence
  Synthetic oligonucleotide
caatcctggtcgaactacccgcagttccgctctt

SEQ ID NO: 154994 - DNA, 35 bp, Artificial Sequence
  Synthetic oligonucleotide
tccccctcctctgatacctcgccctgtgtcgtctt

SEQ ID NO: 154995 - DNA, 35 bp, Artificial Sequence
  Synthetic oligonucleotide
agaccgagctgggagaaagggtgcggggaggagtt

SEQ ID NO: 154996 - DNA, 35 bp, Artificial Sequence
  Synthetic oligonucleotide
tgtcacccgccgggtgcatcccgtcctctacgttt

SEQ ID NO: 154997 - DNA, 35 bp, Artificial Sequence
  Synthetic oligonucleotide
gatcagcgcaagcactccgcacctcgacctctttt

SEQ ID NO: 154998 - DNA, 36 bp, Artificial Sequence
  Synthetic oligonucleotide
gacatccacccccctccatgctgtagcctgcacaaa

SEQ ID NO: 154999 - DNA, 36 bp, Artificial Sequence
  Synthetic oligonucleotide
gcagcctgcttttccgcctctacgccttctgccgaa

SEQ ID NO: 155000 - DNA, 35 bp, Artificial Sequence
  Synthetic oligonucleotide
atggagggggtggcgatcgggaggccgacggggaa

SEQ ID NO: 155001 - DNA, 35 bp, Artificial Sequence
  Synthetic oligonucleotide
gcgtggggggggtatgataacgggtaggaggtgaa

SEQ ID NO: 155002 - DNA, 34 bp, Artificial Sequence
  Synthetic oligonucleotide
gcacatggaacatgactgcccttagcccccttaa

SEQ ID NO: 155003 - DNA, 35 bp, Artificial Sequence
  Synthetic oligonucleotide
atcgccgccggccccgacagtatatagcctcccca

SEQ ID NO: 155004 - DNA, 36 bp, Artificial Sequence
  Synthetic oligonucleotide
gcacaactgcacaggctcggtatacttctcctccca

SEQ ID NO: 155005 - DNA, 36 bp, Artificial Sequence
  Synthetic oligonucleotide
tcgctaccgccgtattactcgcctgtcctcttgcca

SEQ ID NO: 155006 - DNA, 35 bp, Artificial Sequence
  Synthetic oligonucleotide
tctgcacattccgtcctgccaactcgttatatcca

SEQ ID NO: 155007 - DNA, 36 bp, Artificial Sequence
  Synthetic oligonucleotide
tctgctctcaccccatcccgcccggacacttgtcca

SEQ ID NO: 155008 - DNA, 35 bp, Artificial Sequence
  Synthetic oligonucleotide
attcacgcctccgagtgtcgtccgcccccctggca

SEQ ID NO: 155009 - DNA, 36 bp, Artificial Sequence
  Synthetic oligonucleotide
agccgaacagtaagggatgggtgggtaaggggatca

SEQ ID NO: 155010 - DNA, 36 bp, Artificial Sequence
  Synthetic oligonucleotide
taccagcgcgttgctcctcggccaggttcccgctca

SEQ ID NO: 155011 - DNA, 36 bp, Artificial Sequence
  Synthetic oligonucleotide
gctccccgaccgcctccacagtgcagagctacttca

SEQ ID NO: 155012 - DNA, 36 bp, Artificial Sequence
  Synthetic oligonucleotide
gattgctgccacatgtttggtctcgcgccgctttca

SEQ ID NO: 155013 - DNA, 36 bp, Artificial Sequence
  Synthetic oligonucleotide
acgatccctcgtgagctcgctaccttttctgtttca

SEQ ID NO: 155014 - DNA, 36 bp, Artificial Sequence
  Synthetic oligonucleotide
atccacgcgctcacgtttcccctgccatcagtacga

SEQ ID NO: 155015 - DNA, 37 bp, Artificial Sequence
  Synthetic oligonucleotide
ttgacacgccgcctcggcacatctatacacacctcga

SEQ ID NO: 155016 - DNA, 37 bp, Artificial Sequence
  Synthetic oligonucleotide
gccaccgcccctcgcttgcactttcactatctacgga

SEQ ID NO: 155017 - DNA, 37 bp, Artificial Sequence
  Synthetic oligonucleotide
acgagtgcatgcaggggaggggagcgggaccagggga

SEQ ID NO: 155018 - DNA, 36 bp, Artificial Sequence
  Synthetic oligonucleotide
tgcggaggggttaagttgagcggggaagaaggggga

SEQ ID NO: 155019 - DNA, 35 bp, Artificial Sequence
  Synthetic oligonucleotide
gatgggatggacgcgggtgggcatgtagacaatga

SEQ ID NO: 155020 - DNA, 38 bp, Artificial Sequence
  Synthetic oligonucleotide
tcgttgggtccctgttgccttcttccccccctcgatga

SEQ ID NO: 155021 - DNA, 37 bp, Artificial Sequence
  Synthetic oligonucleotide
tcttgtgggcgggaaggggggtgcgtggagggactga

SEQ ID NO: 155022 - DNA, 36 bp, Artificial Sequence
  Synthetic oligonucleotide
taccccccccgcaggtcttgcactttttcgacctga

SEQ ID NO: 155023 - DNA, 38 bp, Artificial Sequence
  Synthetic oligonucleotide
gcagtacagggaataagggcgggagggaaggagcctga

SEQ ID NO: 155024 - DNA, 38 bp, Artificial Sequence
  Synthetic oligonucleotide
gccccacctcctcatgtctctccacgttggtatcctga

SEQ ID NO: 155025 - DNA, 36 bp, Artificial Sequence
  Synthetic oligonucleotide
gtgcgcccgcccggtcattaactagccctcatctga

SEQ ID NO: 155026 - DNA, 38 bp, Artificial Sequence
  Synthetic oligonucleotide
accaggcccaatgcccccaactgcctgccaatatctga

SEQ ID NO: 155027 - DNA, 37 bp, Artificial Sequence
  Synthetic oligonucleotide
acgatgacgtaccgttgctcccttgcacctccattga

SEQ ID NO: 155028 - DNA, 36 bp, Artificial Sequence
  Synthetic oligonucleotide
ttcagtgcaaatgttgccctcgttcatccttacata

SEQ ID NO: 155029 - DNA, 36 bp, Artificial Sequence
  Synthetic oligonucleotide
gcccccccgcttttccccgtacaatgcctcctgata

SEQ ID NO: 155030 - DNA, 36 bp, Artificial Sequence
  Synthetic oligonucleotide
ttgggtagggaacgcggggagccggggggacgagta

SEQ ID NO: 155031 - DNA, 36 bp, Artificial Sequence
  Synthetic oligonucleotide
tatgtacccgcagtctcttctcctccgtgcactgta

SEQ ID NO: 155032 - DNA, 35 bp, Artificial Sequence
  Synthetic oligonucleotide
gttgtcccccgccgtgtcacacccaccccggtgta

SEQ ID NO: 155033 - DNA, 36 bp, Artificial Sequence
  Synthetic oligonucleotide
ttcgactcacgcaacttgcttgaaccaatcacatta

SEQ ID NO: 155034 - DNA, 35 bp, Artificial Sequence
  Synthetic oligonucleotide
ttcatcgccacccttccagctagctctgcctttta

SEQ ID NO: 155035 - DNA, 35 bp, Artificial Sequence
  Synthetic oligonucleotide
tcactgcccccgcccccggtgatcgaaggtaaaac

SEQ ID NO: 155036 - DNA, 35 bp, Artificial Sequence
  Synthetic oligonucleotide
gtacgacgcattgcgagtaattattcttctgtacc

SEQ ID NO: 155037 - DNA, 35 bp, Artificial Sequence
  Synthetic oligonucleotide
tcagcctccttattctacccacttgggccggtccc

SEQ ID NO: 155038 - DNA, 35 bp, Artificial Sequence
  Synthetic oligonucleotide
tgtccagtgtaggactatacgctcttctcctcgcc

SEQ ID NO: 155039 - DNA, 35 bp, Artificial Sequence
  Synthetic oligonucleotide
agaacaccgcccctttgtttcggtaccctggtgcc

SEQ ID NO: 155040 - DNA, 35 bp, Artificial Sequence
  Synthetic oligonucleotide
tacgaccgcacgcgtcgcctgttttacaccactcc

SEQ ID NO: 155041 - DNA, 35 bp, Artificial Sequence
  Synthetic oligonucleotide
tccaccaccaacctatgtattaccttgctacgtcc

SEQ ID NO: 155042 - DNA, 35 bp, Artificial Sequence
  Synthetic oligonucleotide
atcgcctcttcaccgctgttgcctcccattcaagc

SEQ ID NO: 155043 - DNA, 35 bp, Artificial Sequence
  Synthetic oligonucleotide
gggactggttctcgttctgtcctataatcccccgc

SEQ ID NO: 155044 - DNA, 35 bp, Artificial Sequence
  Synthetic oligonucleotide
tgttctccctcaagtttagtatcatccgccatcgc

SEQ ID NO: 155045 - DNA, 35 bp, Artificial Sequence
  Synthetic oligonucleotide
ttcgtatccctgccacactgctccatcggtatcgc

SEQ ID NO: 155046 - DNA, 35 bp, Artificial Sequence
  Synthetic oligonucleotide
aactgcccagaggatcttattccgccccccttggc

SEQ ID NO: 155047 - DNA, 35 bp, Artificial Sequence
  Synthetic oligonucleotide
tccctgccaccgctaaggacacacctagaccctgc

SEQ ID NO: 155048 - DNA, 35 bp, Artificial Sequence
  Synthetic oligonucleotide
tcgtgggtcgcacgttcgattaacatcacctctgc

SEQ ID NO: 155049 - DNA, 35 bp, Artificial Sequence
  Synthetic oligonucleotide
gcattgtctcgccttggtttccctatagttccctc

SEQ ID NO: 155050 - DNA, 35 bp, Artificial Sequence
  Synthetic oligonucleotide
taccgaactgacggtttgaagtctctacgctcctc

SEQ ID NO: 155051 - DNA, 35 bp, Artificial Sequence
  Synthetic oligonucleotide
gccaaccctccatcgtcgacccgctcaatcggctc

SEQ ID NO: 155052 - DNA, 35 bp, Artificial Sequence
  Synthetic oligonucleotide
agtaacctcacgcctccatgtccatttcccaagtc

SEQ ID NO: 155053 - DNA, 35 bp, Artificial Sequence
  Synthetic oligonucleotide
ggtatggtcccgtagttgaagtcccccccgtcgtc

SEQ ID NO: 155054 - DNA, 35 bp, Artificial Sequence
  Synthetic oligonucleotide
acacaacctccgctcccagaccgtcgctttttgtc

SEQ ID NO: 155055 - DNA, 35 bp, Artificial Sequence
  Synthetic oligonucleotide
gcgtacgatcacggttgccatcctagtgttccttc

SEQ ID NO: 155056 - DNA, 35 bp, Artificial Sequence
  Synthetic oligonucleotide
gtatgtgccccgcctgtgcctcgctcccctgtttc

SEQ ID NO: 155057 - DNA, 35 bp, Artificial Sequence
  Synthetic oligonucleotide
tttgcatgccacaatcgcttcttctccgtctcagg

SEQ ID NO: 155058 - DNA, 35 bp, Artificial Sequence
  Synthetic oligonucleotide
tgataaagcgggggacggattggaacgggggtatg

SEQ ID NO: 155059 - DNA, 35 bp, Artificial Sequence
  Synthetic oligonucleotide
tccgagcggacctattctcacgcccgtcacacctg

SEQ ID NO: 155060 - DNA, 35 bp, Artificial Sequence
  Synthetic oligonucleotide
gctgcccacattgtcatgatctcccccatgccttg

SEQ ID NO: 155061 - DNA, 35 bp, Artificial Sequence
  Synthetic oligonucleotide
taccattgctgaaccggccactcgccccccgccat

SEQ ID NO: 155062 - DNA, 32 bp, Artificial Sequence
  Synthetic oligonucleotide
gatgcgcgtccccgccctccttccgtaaacct

SEQ ID NO: 155063 - DNA, 35 bp, Artificial Sequence
  Synthetic oligonucleotide
gcctccaccgcccaccactcccgtcctcggaacct

SEQ ID NO: 155064 - DNA, 35 bp, Artificial Sequence
  Synthetic oligonucleotide
gctaaccgcctcgacagtatttcgccgttcaccct

SEQ ID NO: 155065 - DNA, 35 bp, Artificial Sequence
  Synthetic oligonucleotide
tgccaccgccccataatccccgcaattgctaggct

SEQ ID NO: 155066 - DNA, 35 bp, Artificial Sequence
  Synthetic oligonucleotide
gactcccaccggaatagtcgcaaccgctcccctct

SEQ ID NO: 155067 - DNA, 35 bp, Artificial Sequence
  Synthetic oligonucleotide
tatcctcagacatcgccgccacgggccccatcctt

SEQ ID NO: 155068 - DNA, 35 bp, Artificial Sequence
  Synthetic oligonucleotide
gtttcagcccgcccctccgtctcagcccttgtcaa

SEQ ID NO: 155069 - DNA, 35 bp, Artificial Sequence
  Synthetic oligonucleotide
agttgaccggggtgtagggacgggcgggggtaaca

SEQ ID NO: 155070 - DNA, 35 bp, Artificial Sequence
  Synthetic oligonucleotide
gctgcaccctgggttgctacggctcacctccccca

SEQ ID NO: 155071 - DNA, 36 bp, Artificial Sequence
  Synthetic oligonucleotide
aaggccaggccaccgcccgtttttccatccgctcca

SEQ ID NO: 155072 - DNA, 36 bp, Artificial Sequence
  Synthetic oligonucleotide
gttctgccctcgctcgtgccaaacctgctactcgca

SEQ ID NO: 155073 - DNA, 35 bp, Artificial Sequence
  Synthetic oligonucleotide
tgctcttccccacagctgtgtccctttgtccctca

SEQ ID NO: 155074 - DNA, 35 bp, Artificial Sequence
  Synthetic oligonucleotide
ggatcgccacatctgatccagccgactccctctca

SEQ ID NO: 155075 - DNA, 37 bp, Artificial Sequence
  Synthetic oligonucleotide
ggggagagtagaaaaaggggagtgcgggggggtacga

SEQ ID NO: 155076 - DNA, 37 bp, Artificial Sequence
  Synthetic oligonucleotide
tgcctgttctcagacaccgtatctgccttccttccga

SEQ ID NO: 155077 - DNA, 36 bp, Artificial Sequence
  Synthetic oligonucleotide
tccaagcacaaatgctatcgcgttcccccccatcga

SEQ ID NO: 155078 - DNA, 37 bp, Artificial Sequence
  Synthetic oligonucleotide
gccagccccctgagtctctgccgcgcgtacacctcga

SEQ ID NO: 155079 - DNA, 37 bp, Artificial Sequence
  Synthetic oligonucleotide
ttcacccctccgttcgcataacgccctaacatccgga

SEQ ID NO: 155080 - DNA, 37 bp, Artificial Sequence
  Synthetic oligonucleotide
gacacccctgccctcgcgtaaccagtctacgatcgga

SEQ ID NO: 155081 - DNA, 36 bp, Artificial Sequence
  Synthetic oligonucleotide
ggttggacagcaaggaaaagcgggcgggtagaggga

SEQ ID NO: 155082 - DNA, 36 bp, Artificial Sequence
  Synthetic oligonucleotide
accggggtgggacggaaccgaataatgaaggaggga

SEQ ID NO: 155083 - DNA, 37 bp, Artificial Sequence
  Synthetic oligonucleotide
gacaacaggcgggagagggaccggaagggtgtaggga

SEQ ID NO: 155084 - DNA, 37 bp, Artificial Sequence
  Synthetic oligonucleotide
ggggtacttgcgtgggggggccatttcacggtgggga

SEQ ID NO: 155085 - DNA, 38 bp, Artificial Sequence
  Synthetic oligonucleotide
atcgcacttccgccactcgatccgttccgccatcatga

SEQ ID NO: 155086 - DNA, 38 bp, Artificial Sequence
  Synthetic oligonucleotide
gggtgggagggagggattgaggtccggagaaggactga

SEQ ID NO: 155087 - DNA, 38 bp, Artificial Sequence
  Synthetic oligonucleotide
gccaggcctcctgctttacgcgttaccttgcctactga

SEQ ID NO: 155088 - DNA, 38 bp, Artificial Sequence
  Synthetic oligonucleotide
tgtgtgcccattgcgctttcccgtgactttattcctga

SEQ ID NO: 155089 - DNA, 38 bp, Artificial Sequence
  Synthetic oligonucleotide
tagcccggcatgtgtgccccccgttcgtcccttgctga

SEQ ID NO: 155090 - DNA, 38 bp, Artificial Sequence
  Synthetic oligonucleotide
tccattcctcctctggtgcattttacttcagtccgtga

SEQ ID NO: 155091 - DNA, 38 bp, Artificial Sequence
  Synthetic oligonucleotide
atccctccctgctgtgccccccaggccgccgtgcgtga

SEQ ID NO: 155092 - DNA, 38 bp, Artificial Sequence
  Synthetic oligonucleotide
aagcgtaggtggctaggaagcggggacgggggaggtga

SEQ ID NO: 155093 - DNA, 37 bp, Artificial Sequence
  Synthetic oligonucleotide
gtccagccttcgcacgttctactatgacctccgttga

SEQ ID NO: 155094 - DNA, 36 bp, Artificial Sequence
  Synthetic oligonucleotide
tgcatccaattctcgctggttcataatgccccccta

SEQ ID NO: 155095 - DNA, 35 bp, Artificial Sequence
  Synthetic oligonucleotide
tgacgactgccagcaatttccgctaccaccatgta

SEQ ID NO: 155096 - DNA, 35 bp, Artificial Sequence
  Synthetic oligonucleotide
tcacgaatccgtgtatttgcctttaagttccccac

SEQ ID NO: 155097 - DNA, 35 bp, Artificial Sequence
  Synthetic oligonucleotide
atgtgccctctgtactgcgaccacggtctcttcac

SEQ ID NO: 155098 - DNA, 35 bp, Artificial Sequence
  Synthetic oligonucleotide
tagcactcctcatcgtactccttttgcagcacgcc

SEQ ID NO: 155099 - DNA, 35 bp, Artificial Sequence
  Synthetic oligonucleotide
acaccgcgtgcgcgctacccgacaccagacccgcc

SEQ ID NO: 155100 - DNA, 35 bp, Artificial Sequence
  Synthetic oligonucleotide
accgatcacctctccagtgttgcgtccttttcgcc

SEQ ID NO: 155101 - DNA, 35 bp, Artificial Sequence
  Synthetic oligonucleotide
gtacgccccacccatccgttatcagcatcccggcc

SEQ ID NO: 155102 - DNA, 35 bp, Artificial Sequence
  Synthetic oligonucleotide
tgaacgtacacgttctgcttacaaacatgccatcc

SEQ ID NO: 155103 - DNA, 35 bp, Artificial Sequence
  Synthetic oligonucleotide
ttgacgcatgcacttcctatgcgttattctcctcc

SEQ ID NO: 155104 - DNA, 35 bp, Artificial Sequence
  Synthetic oligonucleotide
tgtacaacatctactcgctcaccgtgtccgtgtcc

SEQ ID NO: 155105 - DNA, 35 bp, Artificial Sequence
  Synthetic oligonucleotide
tacttggcgcaacccacccccattcgctacgttcc

SEQ ID NO: 155106 - DNA, 35 bp, Artificial Sequence
  Synthetic oligonucleotide
tccccgcatctgaaatgtttctccgccctgaatgc

SEQ ID NO: 155107 - DNA, 35 bp, Artificial Sequence
  Synthetic oligonucleotide
acctactctctcacctcgcgcccaggctgctatgc

SEQ ID NO: 155108 - DNA, 35 bp, Artificial Sequence
  Synthetic oligonucleotide
tactcagcctggtcctcaccaactcaatgccttgc

SEQ ID NO: 155109 - DNA, 35 bp, Artificial Sequence
  Synthetic oligonucleotide
gttctacaccccatccgtcccgggcacatacactc

SEQ ID NO: 155110 - DNA, 35 bp, Artificial Sequence
  Synthetic oligonucleotide
gatgcccaactctcagtttgggtaccgcccccctc

SEQ ID NO: 155111 - DNA, 34 bp, Artificial Sequence
  Synthetic oligonucleotide
ggaacgcgcccggttaccccctgtctagatcctc

SEQ ID NO: 155112 - DNA, 35 bp, Artificial Sequence
  Synthetic oligonucleotide
aagagagcgcacatcccgccaagtcgatccatctc

SEQ ID NO: 155113 - DNA, 35 bp, Artificial Sequence
  Synthetic oligonucleotide
tcctaccatccctctgtcccgtttgctactatgtc

SEQ ID NO: 155114 - DNA, 35 bp, Artificial Sequence
  Synthetic oligonucleotide
tcagccgccccctctgacgatgcatcaataccttc

SEQ ID NO: 155115 - DNA, 35 bp, Artificial Sequence
  Synthetic oligonucleotide
atcacgtcctggggttacacgtgcccacctccttc

SEQ ID NO: 155116 - DNA, 35 bp, Artificial Sequence
  Synthetic oligonucleotide
acatcgcaggcttactctggaccctgtactctttc

SEQ ID NO: 155117 - DNA, 35 bp, Artificial Sequence
  Synthetic oligonucleotide
gcggacggcctttcccaggttcattagcctccccg

SEQ ID NO: 155118 - DNA, 35 bp, Artificial Sequence
  Synthetic oligonucleotide
ttgcgtagttcgttcgccccgtttttctgttgccg

SEQ ID NO: 155119 - DNA, 35 bp, Artificial Sequence
  Synthetic oligonucleotide
tgcgtgttctaacatgtcctagttgcccccttccg

SEQ ID NO: 155120 - DNA, 35 bp, Artificial Sequence
  Synthetic oligonucleotide
agccgattgacccgccttgcccccgtttgtttccg

SEQ ID NO: 155121 - DNA, 35 bp, Artificial Sequence
  Synthetic oligonucleotide
acacatgaacagggggaggatggaagcttcatgcg

SEQ ID NO: 155122 - DNA, 35 bp, Artificial Sequence
  Synthetic oligonucleotide
gtttatccgtcgtcctgccattgcccgttctatcg

SEQ ID NO: 155123 - DNA, 35 bp, Artificial Sequence
  Synthetic oligonucleotide
acacaagggagaatgggggtaagcgtagtagcagg

SEQ ID NO: 155124 - DNA, 35 bp, Artificial Sequence
  Synthetic oligonucleotide
gtctctaccgttcattgctccgcccagtttctctg

SEQ ID NO: 155125 - DNA, 35 bp, Artificial Sequence
  Synthetic oligonucleotide
agtattcccctcagccttgcacgccgctgtcccat

SEQ ID NO: 155126 - DNA, 35 bp, Artificial Sequence
  Synthetic oligonucleotide
gaaccggccaagcacatctctgttccttgccctat

SEQ ID NO: 155127 - DNA, 35 bp, Artificial Sequence
  Synthetic oligonucleotide
ttccctcatcaggttgcgcgcgtgccggccctcct

SEQ ID NO: 155128 - DNA, 35 bp, Artificial Sequence
  Synthetic oligonucleotide
atgctcgatcgctggtatgtctcgcctcgcccgct

SEQ ID NO: 155129 - DNA, 35 bp, Artificial Sequence
  Synthetic oligonucleotide
tgctgcgcgctgcccccactgtcattcatttcgct

SEQ ID NO: 155130 - DNA, 35 bp, Artificial Sequence
  Synthetic oligonucleotide
ttcctcgccatgaagatctcccgtcacccctacgt

SEQ ID NO: 155131 - DNA, 35 bp, Artificial Sequence
  Synthetic oligonucleotide
agtccccgcacttaacactccctcgccccggtggt

SEQ ID NO: 155132 - DNA, 35 bp, Artificial Sequence
  Synthetic oligonucleotide
tgcctgccttctctcgttccctgccctgcttactt

SEQ ID NO: 155133 - DNA, 36 bp, Artificial Sequence
  Synthetic oligonucleotide
gatccaggtaggaagggaggcattgggggcatggaa

SEQ ID NO: 155134 - DNA, 36 bp, Artificial Sequence
  Synthetic oligonucleotide
tccttgcacaccgttccctgcggctcctcccccaca

SEQ ID NO: 155135 - DNA, 36 bp, Artificial Sequence
  Synthetic oligonucleotide
gcgtagcaagtccacgctttaccttcgccgcccaca

SEQ ID NO: 155136 - DNA, 36 bp, Artificial Sequence
  Synthetic oligonucleotide
acccggaacgccaccccgcgtgtcctttttcctcca

SEQ ID NO: 155137 - DNA, 36 bp, Artificial Sequence
  Synthetic oligonucleotide
tagctccgcactgcacactccagccatctcgcttca

SEQ ID NO: 155138 - DNA, 37 bp, Artificial Sequence
  Synthetic oligonucleotide
atcgcccccatacgcactgctcgcttctctccgacga

SEQ ID NO: 155139 - DNA, 37 bp, Artificial Sequence
  Synthetic oligonucleotide
acctcaatcgcaccttggacccccacagccctgacga

SEQ ID NO: 155140 - DNA, 37 bp, Artificial Sequence
  Synthetic oligonucleotide
accaccccccagcccacgacttcgctgtttactacga

SEQ ID NO: 155141 - DNA, 37 bp, Artificial Sequence
  Synthetic oligonucleotide
tgctacaccaacttcgtgtgtatccgttccaccccga

SEQ ID NO: 155142 - DNA, 37 bp, Artificial Sequence
  Synthetic oligonucleotide
tcacgccccgttttcacgtcaccccctccgcgctcga

SEQ ID NO: 155143 - DNA, 37 bp, Artificial Sequence
  Synthetic oligonucleotide
gacgcacggaggttagggagagcgggaaaagggcgga

SEQ ID NO: 155144 - DNA, 35 bp, Artificial Sequence
  Synthetic oligonucleotide
gagctgggtggggtcgaactccagggggacgggga

SEQ ID NO: 155145 - DNA, 37 bp, Artificial Sequence
  Synthetic oligonucleotide
gtggaggacgtcgcgggggaggttaggagaactggga

SEQ ID NO: 155146 - DNA, 36 bp, Artificial Sequence
  Synthetic oligonucleotide
cctgccccgccctccatgagttaattccacccctga

SEQ ID NO: 155147 - DNA, 38 bp, Artificial Sequence
  Synthetic oligonucleotide
tacacgccaacgtcacatgtcccttccttctgtcctga

SEQ ID NO: 155148 - DNA, 36 bp, Artificial Sequence
  Synthetic oligonucleotide
tcattgacgccgatctcgctttgatccacttattga

SEQ ID NO: 155149 - DNA, 37 bp, Artificial Sequence
  Synthetic oligonucleotide
accgttccctacgtctatgtaccccgcccttccttga

SEQ ID NO: 155150 - DNA, 36 bp, Artificial Sequence
  Synthetic oligonucleotide
actactccccaacgtgactgctgcccttcaccacta

SEQ ID NO: 155151 - DNA, 35 bp, Artificial Sequence
  Synthetic oligonucleotide
atactgccacactgttgtcgtcccctccacagcta

SEQ ID NO: 155152 - DNA, 36 bp, Artificial Sequence
  Synthetic oligonucleotide
gccgggatcgcggtgagggaaagaagggggatagta

SEQ ID NO: 155153 - DNA, 35 bp, Artificial Sequence
  Synthetic oligonucleotide
tagacacccaccatgtccaatcgtattactccgta

SEQ ID NO: 155154 - DNA, 36 bp, Artificial Sequence
  Synthetic oligonucleotide
tgcctaccccctgttgttttattcttgcattgcgta

SEQ ID NO: 155155 - DNA, 36 bp, Artificial Sequence
  Synthetic oligonucleotide
aacccaccgctgcttttctctgttatgccgccctta

SEQ ID NO: 155156 - DNA, 36 bp, Artificial Sequence
  Synthetic oligonucleotide
atgccgatcaacggtcgtcctatctaccctgtctta

SEQ ID NO: 155157 - DNA, 36 bp, Artificial Sequence
  Synthetic oligonucleotide
tgtggcgggtgtgcgtgggtagggggggaacggtta

SEQ ID NO: 155158 - DNA, 35 bp, Artificial Sequence
  Synthetic oligonucleotide
tcatcccgcgtgttatatctcacgctccaccttta

SEQ ID NO: 155159 - DNA, 35 bp, Artificial Sequence
  Synthetic oligonucleotide
gacgtcagtgtggccgtctccgcccgttactttta

SEQ ID NO: 155160 - DNA, 35 bp, Artificial Sequence
  Synthetic oligonucleotide
tccaccccgccactcgcgccctcgacgccctacac

SEQ ID NO: 155161 - DNA, 35 bp, Artificial Sequence
  Synthetic oligonucleotide
gcctgtcccaacccatctgctgccccgggtccgac

SEQ ID NO: 155162 - DNA, 35 bp, Artificial Sequence
  Synthetic oligonucleotide
gatcaccccccggctcctcaccagggcattattac

SEQ ID NO: 155163 - DNA, 35 bp, Artificial Sequence
  Synthetic oligonucleotide
tgaaccatcaccacgctacaatccaccaggtgacc

SEQ ID NO: 155164 - DNA, 35 bp, Artificial Sequence
  Synthetic oligonucleotide
acatctctgccgttccttgaccttgcatacctccc

SEQ ID NO: 155165 - DNA, 35 bp, Artificial Sequence
  Synthetic oligonucleotide
gaccacccaccatccagtaaacgcatccaatggcc

SEQ ID NO: 155166 - DNA, 35 bp, Artificial Sequence
  Synthetic oligonucleotide
ggtcaactgtaagcactttttcacgtcaccctgcc

SEQ ID NO: 155167 - DNA, 35 bp, Artificial Sequence
  Synthetic oligonucleotide
actgccctcacagcttcgccacatcacggctatcc

SEQ ID NO: 155168 - DNA, 35 bp, Artificial Sequence
  Synthetic oligonucleotide
tttcgccacgcgcatttattgtttaccccatttcc

SEQ ID NO: 155169 - DNA, 35 bp, Artificial Sequence
  Synthetic oligonucleotide
accgtgtacagcccctccgtctctcgtcgcctcgc

SEQ ID NO: 155170 - DNA, 35 bp, Artificial Sequence
  Synthetic oligonucleotide
acacgctatcccatccgacacccgtatcgatctgc

SEQ ID NO: 155171 - DNA, 35 bp, Artificial Sequence
  Synthetic oligonucleotide
tccatctctgtcaacacactcgccttttccagtgc

SEQ ID NO: 155172 - DNA, 33 bp, Artificial Sequence
  Synthetic oligonucleotide
gagcgccttgcctatgtgcagctatcctccatc

SEQ ID NO: 155173 - DNA, 35 bp, Artificial Sequence
  Synthetic oligonucleotide
gtcgcgccacagacacgatagtcagcccttccatc

SEQ ID NO: 155174 - DNA, 35 bp, Artificial Sequence
  Synthetic oligonucleotide
gcacccttcgtcccttatgccgccagccactgatc

SEQ ID NO: 155175 - DNA, 35 bp, Artificial Sequence
  Synthetic oligonucleotide
ttgtgcattacccgcatcgtggtctggcccttatc

SEQ ID NO: 155176 - DNA, 35 bp, Artificial Sequence
  Synthetic oligonucleotide
ggtattcccccgctaagccgccctccgccgtactc

SEQ ID NO: 155177 - DNA, 35 bp, Artificial Sequence
  Synthetic oligonucleotide
actccgtacgctgtaattgctcccacgggcccctc

SEQ ID NO: 155178 - DNA, 35 bp, Artificial Sequence
  Synthetic oligonucleotide
acgacccaccacgttgctcagtgcttcttactgtc

SEQ ID NO: 155179 - DNA, 35 bp, Artificial Sequence
  Synthetic oligonucleotide
agtacgcggaaggtaaggggaggtcacagggggag

SEQ ID NO: 155180 - DNA, 35 bp, Artificial Sequence
  Synthetic oligonucleotide
tgcaccacccgcacgccccccgttccccgtcttag

SEQ ID NO: 155181 - DNA, 35 bp, Artificial Sequence
  Synthetic oligonucleotide
gtcgcagttcagcaggctgaatccccgtctccccg

SEQ ID NO: 155182 - DNA, 35 bp, Artificial Sequence
  Synthetic oligonucleotide
ggccccatcctccggtcactcgcctcattaacgcg

SEQ ID NO: 155183 - DNA, 35 bp, Artificial Sequence
  Synthetic oligonucleotide
ttccagtcgccatcctcccgctaatctatctatcg

SEQ ID NO: 155184 - DNA, 35 bp, Artificial Sequence
  Synthetic oligonucleotide
taagcgcgctaacgtcatccccggtcttgccctcg

SEQ ID NO: 155185 - DNA, 35 bp, Artificial Sequence
  Synthetic oligonucleotide
gccaaccgattgttgcagtgcaccccccccttcgg

SEQ ID NO: 155186 - DNA, 35 bp, Artificial Sequence
  Synthetic oligonucleotide
gaccgtttgcttcccgccctttcttaggatttatg

SEQ ID NO: 155187 - DNA, 35 bp, Artificial Sequence
  Synthetic oligonucleotide
gatgcgtaggcaccgcttccaatcacctcatcctg

SEQ ID NO: 155188 - DNA, 35 bp, Artificial Sequence
  Synthetic oligonucleotide
acccatctccacaccatgtctggcctgactttact

SEQ ID NO: 155189 - DNA, 34 bp, Artificial Sequence
  Synthetic oligonucleotide
tcatccagacggcatttgatgcacacaccgccct

SEQ ID NO: 155190 - DNA, 35 bp, Artificial Sequence
  Synthetic oligonucleotide
tgcatctactcctccctgacctatttgtgcactct

SEQ ID NO: 155191 - DNA, 35 bp, Artificial Sequence
  Synthetic oligonucleotide
gggagccacatcttgcgtccacatacacctactct

SEQ ID NO: 155192 - DNA, 35 bp, Artificial Sequence
  Synthetic oligonucleotide
tacgaggtagggcgggcggggagaccgggtactct

SEQ ID NO: 155193 - DNA, 35 bp, Artificial Sequence
  Synthetic oligonucleotide
tgtgtgtcaacgccctttcacactgcccctgcctt

SEQ ID NO: 155194 - DNA, 35 bp, Artificial Sequence
  Synthetic oligonucleotide
gcaattggcaacatgtcttagccgttctccccttt

SEQ ID NO: 155195 - DNA, 35 bp, Artificial Sequence
  Synthetic oligonucleotide
ttgtgcattcgcgtccggtccttccctctcttttt

SEQ ID NO: 155196 - DNA, 36 bp, Artificial Sequence
  Synthetic oligonucleotide
gtaggagtggagaaggcggtgtagctagtgagacaa

SEQ ID NO: 155197 - DNA, 35 bp, Artificial Sequence
  Synthetic oligonucleotide
gctggagggtgcaaggggactacggaaaggggcaa

SEQ ID NO: 155198 - DNA, 36 bp, Artificial Sequence
  Synthetic oligonucleotide
tacatgacaggccgcgtcaagggggcggggggggaa

SEQ ID NO: 155199 - DNA, 35 bp, Artificial Sequence
  Synthetic oligonucleotide
gcaagggacatagatattgggggggggcgggctaa

SEQ ID NO: 155200 - DNA, 36 bp, Artificial Sequence
  Synthetic oligonucleotide
tcccccgccgcacgagccgggtccatctctttgtaa

SEQ ID NO: 155201 - DNA, 36 bp, Artificial Sequence
  Synthetic oligonucleotide
catcacgccccatcgttgctgcccgataccctcgca

SEQ ID NO: 155202 - DNA, 35 bp, Artificial Sequence
  Synthetic oligonucleotide
acaacgagggaaggatagggtggggaaggggggca

SEQ ID NO: 155203 - DNA, 35 bp, Artificial Sequence
  Synthetic oligonucleotide
ggggccgcccatatagcctccctgttttcctgtca

SEQ ID NO: 155204 - DNA, 35 bp, Artificial Sequence
  Synthetic oligonucleotide
gggaagtcggggaaggctacggacggggtggacga

SEQ ID NO: 155205 - DNA, 37 bp, Artificial Sequence
  Synthetic oligonucleotide
gtcaagccatggttgtatcgttacttcctccgcccga

SEQ ID NO: 155206 - DNA, 36 bp, Artificial Sequence
  Synthetic oligonucleotide
ccgctgcatgtaactcccggcccccatatcgcgcga

SEQ ID NO: 155207 - DNA, 37 bp, Artificial Sequence
  Synthetic oligonucleotide
ttccatcacgctgacgaacaagtcccccgcctctcga

SEQ ID NO: 155208 - DNA, 37 bp, Artificial Sequence
  Synthetic oligonucleotide
gcatgactccgataaggggtaagggagtggggaggga

SEQ ID NO: 155209 - DNA, 37 bp, Artificial Sequence
  Synthetic oligonucleotide
gatggtagggacggtgaagcgggcgtgcggtcgggga

SEQ ID NO: 155210 - DNA, 36 bp, Artificial Sequence
  Synthetic oligonucleotide
gggggaagtacggcacgggggggagcaaacggggga

SEQ ID NO: 155211 - DNA, 37 bp, Artificial Sequence
  Synthetic oligonucleotide
aagaacggagaggagaactgagtggaaagtgggggga

SEQ ID NO: 155212 - DNA, 37 bp, Artificial Sequence
  Synthetic oligonucleotide
gacaagcaccactgtaattcgtactcttcttcgctga

SEQ ID NO: 155213 - DNA, 35 bp, Artificial Sequence
  Synthetic oligonucleotide
ttgaaggaggactcgggggagcaaaggagtagtga

SEQ ID NO: 155214 - DNA, 38 bp, Artificial Sequence
  Synthetic oligonucleotide
gccaggccccctcacgttctattcgccaccgcccgtga

SEQ ID NO: 155215 - DNA, 38 bp, Artificial Sequence
  Synthetic oligonucleotide
tccacccgtccgccgcctcttagattattctcccgtga

SEQ ID NO: 155216 - DNA, 37 bp, Artificial Sequence
  Synthetic oligonucleotide
gtgtgggcggggcacttgttatattgagggcgggtga

SEQ ID NO: 155217 - DNA, 37 bp, Artificial Sequence
  Synthetic oligonucleotide
agagacgtgggggcatgagaggtaggggtcggattga

SEQ ID NO: 155218 - DNA, 35 bp, Artificial Sequence
  Synthetic oligonucleotide
gctcggaccacattgctctttcactccacacttga

SEQ ID NO: 155219 - DNA, 38 bp, Artificial Sequence
  Synthetic oligonucleotide
aatacccgtcccctctgcctttccagcggtctccttga

SEQ ID NO: 155220 - DNA, 38 bp, Artificial Sequence
  Synthetic oligonucleotide
gaacaacccttcaccatctgtcgagactcccaggttga

SEQ ID NO: 155221 - DNA, 38 bp, Artificial Sequence
  Synthetic oligonucleotide
gacgccctgccccccttctgccaaacgatagtttttga

SEQ ID NO: 155222 - DNA, 35 bp, Artificial Sequence
  Synthetic oligonucleotide
gagtacgcgcccctgatcgtcctttccatcgcata

SEQ ID NO: 155223 - DNA, 36 bp, Artificial Sequence
  Synthetic oligonucleotide
tagtgtgccagggaaagaatgaggggatggaggata

SEQ ID NO: 155224 - DNA, 36 bp, Artificial Sequence
  Synthetic oligonucleotide
atggacaccttgatcgcccccgctgtaattttcgta

SEQ ID NO: 155225 - DNA, 35 bp, Artificial Sequence
  Synthetic oligonucleotide
cgcctccactctgctcaggcattcctctgccatta

SEQ ID NO: 155226 - DNA, 36 bp, Artificial Sequence
  Synthetic oligonucleotide
gaagagggacaagagagaacagggtggggtacgtta

SEQ ID NO: 155227 - DNA, 35 bp, Artificial Sequence
  Synthetic oligonucleotide
ttacctcgcccgtacaccgttcctgctttgcttta

SEQ ID NO: 155228 - DNA, 36 bp, Artificial Sequence
  Synthetic oligonucleotide
tgagactggtcactgaatagtgctgcaccatcttta

SEQ ID NO: 155229 - DNA, 35 bp, Artificial Sequence
  Synthetic oligonucleotide
tccacctgaccaccagatgtcccaacaacctacac

SEQ ID NO: 155230 - DNA, 35 bp, Artificial Sequence
  Synthetic oligonucleotide
tcctacgcttcggtatctggaagcccctcacccac

SEQ ID NO: 155231 - DNA, 35 bp, Artificial Sequence
  Synthetic oligonucleotide
tgccccatagctgccaagtaccggctatcccccac

SEQ ID NO: 155232 - DNA, 35 bp, Artificial Sequence
  Synthetic oligonucleotide
gcgtacgcctcagccccatctgtagtccatcatac

SEQ ID NO: 155233 - DNA, 35 bp, Artificial Sequence
  Synthetic oligonucleotide
agtttcccgccccctgtggtacacggctgttctac

SEQ ID NO: 155234 - DNA, 35 bp, Artificial Sequence
  Synthetic oligonucleotide
gtctacgcgctccggttccgtcccatcaacgcacc

SEQ ID NO: 155235 - DNA, 35 bp, Artificial Sequence
  Synthetic oligonucleotide
gtgacactcggtcttttctggtaagccgcccaccc

SEQ ID NO: 155236 - DNA, 35 bp, Artificial Sequence
  Synthetic oligonucleotide
tgtgtgcaccggcgcggcgctttcccctttagccc

SEQ ID NO: 155237 - DNA, 35 bp, Artificial Sequence
  Synthetic oligonucleotide
gagcatacgcccgccccgaacctagctctgtgccc

SEQ ID NO: 155238 - DNA, 35 bp, Artificial Sequence
  Synthetic oligonucleotide
gctcccaccactgtaaatctaagattgcacccgcc

SEQ ID NO: 155239 - DNA, 35 bp, Artificial Sequence
  Synthetic oligonucleotide
ttttgcacacaatgctactgctcgaccgtttttcc

SEQ ID NO: 155240 - DNA, 35 bp, Artificial Sequence
  Synthetic oligonucleotide
acgacaagccgctatcctccctgactatctttcgc

SEQ ID NO: 155241 - DNA, 35 bp, Artificial Sequence
  Synthetic oligonucleotide
tcaccgtccagcaacgttggtctctcactgcctgc

SEQ ID NO: 155242 - DNA, 35 bp, Artificial Sequence
  Synthetic oligonucleotide
tctgccggccccagaccattgttgtccccattatc

SEQ ID NO: 155243 - DNA, 35 bp, Artificial Sequence
  Synthetic oligonucleotide
gtgacgctccctacccgcctgcgccgcgctgactc

SEQ ID NO: 155244 - DNA, 35 bp, Artificial Sequence
  Synthetic oligonucleotide
gagcgcgccgctgcttccttttcccggtcatactc

SEQ ID NO: 155245 - DNA, 36 bp, Artificial Sequence
  Synthetic oligonucleotide
gttttgcgccagcgcaagtcctgcccctcctcgctc

SEQ ID NO: 155246 - DNA, 35 bp, Artificial Sequence
  Synthetic oligonucleotide
taccatcacccgcgcattgccgtaaagcccctctc

SEQ ID NO: 155247 - DNA, 35 bp, Artificial Sequence
  Synthetic oligonucleotide
tccattacgtgcccgaatctatgcctccgcctctc

SEQ ID NO: 155248 - DNA, 35 bp, Artificial Sequence
  Synthetic oligonucleotide
aaccgacaagcatttgtgcaccgttccaccctgtc

SEQ ID NO: 155249 - DNA, 35 bp, Artificial Sequence
  Synthetic oligonucleotide
gcattgcttcgacgttaggcctttcccccgctgtc

SEQ ID NO: 155250 - DNA, 35 bp, Artificial Sequence
  Synthetic oligonucleotide
gccgacgccgttcactggattttgttctcctgttc

SEQ ID NO: 155251 - DNA, 35 bp, Artificial Sequence
  Synthetic oligonucleotide
gatcaggcaagggaaggatagtgtgggggagggag

SEQ ID NO: 155252 - DNA, 35 bp, Artificial Sequence
  Synthetic oligonucleotide
tccccgccgttcatccgtttacccatccctgcagg

SEQ ID NO: 155253 - DNA, 35 bp, Artificial Sequence
  Synthetic oligonucleotide
atcgacccccttagaatctggctaccccaccatgg

SEQ ID NO: 155254 - DNA, 35 bp, Artificial Sequence
  Synthetic oligonucleotide
acacgccccctatactgtgtcccacccgcacctgg

SEQ ID NO: 155255 - DNA, 35 bp, Artificial Sequence
  Synthetic oligonucleotide
tgctgccgttccacccaccgtcctcatgtatcatg

SEQ ID NO: 155256 - DNA, 35 bp, Artificial Sequence
  Synthetic oligonucleotide
tggttacgtagaagttcgcccttccctgcccactg

SEQ ID NO: 155257 - DNA, 35 bp, Artificial Sequence
  Synthetic oligonucleotide
tgcagtcaccttctccctcatacgtggcctctctg

SEQ ID NO: 155258 - DNA, 36 bp, Artificial Sequence
  Synthetic oligonucleotide
gtgccctatcctattcttgcccgagtctgtcttttg

SEQ ID NO: 155259 - DNA, 35 bp, Artificial Sequence
  Synthetic oligonucleotide
gttccgacacatcccacaatagccgttcccctgat

SEQ ID NO: 155260 - DNA, 35 bp, Artificial Sequence
  Synthetic oligonucleotide
atgccgtcactcgccgccccactaaactagcctat

SEQ ID NO: 155261 - DNA, 35 bp, Artificial Sequence
  Synthetic oligonucleotide
ttagtcacccggtacagcgatcattcttctcccct

SEQ ID NO: 155262 - DNA, 35 bp, Artificial Sequence
  Synthetic oligonucleotide
gtccccaacgtgctcgcctttttttgggcttccct

SEQ ID NO: 155263 - DNA, 35 bp, Artificial Sequence
  Synthetic oligonucleotide
atacgacgtatccgccaacagtctacttcccgcct

SEQ ID NO: 155264 - DNA, 35 bp, Artificial Sequence
  Synthetic oligonucleotide
tgcacgcattggagttcgtcttggtcgcttcctct

SEQ ID NO: 155265 - DNA, 35 bp, Artificial Sequence
  Synthetic oligonucleotide
accatgcccttctagttctggttgctacctgctct

SEQ ID NO: 155266 - DNA, 36 bp, Artificial Sequence
  Synthetic oligonucleotide
aacaacaagggaaaacaggggaagagggtacgatgt

SEQ ID NO: 155267 - DNA, 35 bp, Artificial Sequence
  Synthetic oligonucleotide
ggcccccgccctcaccttatgattcgcccccgtgt

SEQ ID NO: 155268 - DNA, 35 bp, Artificial Sequence
  Synthetic oligonucleotide
accccttgcctactgggttaaccgccccaccactt

SEQ ID NO: 155269 - DNA, 35 bp, Artificial Sequence
  Synthetic oligonucleotide
acaacaccccttcatacgtctgcagatttgccctt

SEQ ID NO: 155270 - DNA, 35 bp, Artificial Sequence
  Synthetic oligonucleotide
acagttggggaaggcgggtttatggggttgcggaa

SEQ ID NO: 155271 - DNA, 35 bp, Artificial Sequence
  Synthetic oligonucleotide
gagagcctccttgcctttttatagccgcctttgaa

SEQ ID NO: 155272 - DNA, 35 bp, Artificial Sequence
  Synthetic oligonucleotide
gagcccccgcaccgctcacaagagttcatatcaca

SEQ ID NO: 155273 - DNA, 36 bp, Artificial Sequence
  Synthetic oligonucleotide
gctcccccctttcggtcagcctggcgcgtccgccca

SEQ ID NO: 155274 - DNA, 35 bp, Artificial Sequence
  Synthetic oligonucleotide
acctcacgccgagccttcgccgcccttatgggcca

SEQ ID NO: 155275 - DNA, 35 bp, Artificial Sequence
  Synthetic oligonucleotide
tttgagcctcactctggccctaaaacgggtctcca

SEQ ID NO: 155276 - DNA, 35 bp, Artificial Sequence
  Synthetic oligonucleotide
agccgctgcaccgcccggttaatatcccttccgca

SEQ ID NO: 155277 - DNA, 36 bp, Artificial Sequence
  Synthetic oligonucleotide
tagcggcccggttctgtcgctccttttcgcctgtca

SEQ ID NO: 155278 - DNA, 36 bp, Artificial Sequence
  Synthetic oligonucleotide
gttgccccaatctctgtttactctagctgtggttca

SEQ ID NO: 155279 - DNA, 37 bp, Artificial Sequence
  Synthetic oligonucleotide
ggaccgggggaaggggtggtaggtggacgcgtgcaga

SEQ ID NO: 155280 - DNA, 37 bp, Artificial Sequence
  Synthetic oligonucleotide
gtacacacgccacatgtcacgttcatctcgttaccga

SEQ ID NO: 155281 - DNA, 36 bp, Artificial Sequence
  Synthetic oligonucleotide
tctccaatcgccacttgttttttatctgtaccccga

SEQ ID NO: 155282 - DNA, 35 bp, Artificial Sequence
  Synthetic oligonucleotide
gacccacttagcttgagtaatttacccctcccgga

SEQ ID NO: 155283 - DNA, 37 bp, Artificial Sequence
  Synthetic oligonucleotide
tggagacgtaagagaagggatgggagcatgaggggga

SEQ ID NO: 155284 - DNA, 36 bp, Artificial Sequence
  Synthetic oligonucleotide
tacaccctcttgtcgtccctgtcccccagcgtggga

SEQ ID NO: 155285 - DNA, 36 bp, Artificial Sequence
  Synthetic oligonucleotide
tgatctgggataggggtggaaatgggtgaggtggga

SEQ ID NO: 155286 - DNA, 37 bp, Artificial Sequence
  Synthetic oligonucleotide
gcaagagagagagggcgggatggcatgggtagaatga

SEQ ID NO: 155287 - DNA, 35 bp, Artificial Sequence
  Synthetic oligonucleotide
tcctccctcccgcccacgacacctgattgccatga

SEQ ID NO: 155288 - DNA, 38 bp, Artificial Sequence
  Synthetic oligonucleotide
gtcacaccgccacgatcacgcctactgaccacctatga

SEQ ID NO: 155289 - DNA, 38 bp, Artificial Sequence
  Synthetic oligonucleotide
gtacccgccctcctgccccaaccgccgacatgcactga

SEQ ID NO: 155290 - DNA, 37 bp, Artificial Sequence
  Synthetic oligonucleotide
tgacctccctgagtactatgatcctatttccacctga

SEQ ID NO: 155291 - DNA, 38 bp, Artificial Sequence
  Synthetic oligonucleotide
agcacgagacgagagaagggaggggaagcgcgctgtga

SEQ ID NO: 155292 - DNA, 36 bp, Artificial Sequence
  Synthetic oligonucleotide
tcttccaccgacacttgccgcctatgcctcgttata

SEQ ID NO: 155293 - DNA, 34 bp, Artificial Sequence
  Synthetic oligonucleotide
gcccccccccggccattgttaatgtacacaacta

SEQ ID NO: 155294 - DNA, 36 bp, Artificial Sequence
  Synthetic oligonucleotide
gcctccaaacatcttgctacttttgccccagttcta

SEQ ID NO: 155295 - DNA, 36 bp, Artificial Sequence
  Synthetic oligonucleotide
gtggccacacgttcgtctctataaccatccctcgta

SEQ ID NO: 155296 - DNA, 35 bp, Artificial Sequence
  Synthetic oligonucleotide
gtgggacctcactcactgcaaagccgaccatccac

SEQ ID NO: 155297 - DNA, 35 bp, Artificial Sequence
  Synthetic oligonucleotide
ttgatccgctgacccgagttccattggtccccccc

SEQ ID NO: 155298 - DNA, 34 bp, Artificial Sequence
  Synthetic oligonucleotide
agcaccgtaccttccttagttgctcgtatccccc

SEQ ID NO: 155299 - DNA, 35 bp, Artificial Sequence
  Synthetic oligonucleotide
tctcaacatgaccctgtgtggtccaaacccgcccc

SEQ ID NO: 155300 - DNA, 35 bp, Artificial Sequence
  Synthetic oligonucleotide
accgtgagcgattcgttccctcttgtaaccagccc

SEQ ID NO: 155301 - DNA, 35 bp, Artificial Sequence
  Synthetic oligonucleotide
tcccaccaacacgggaactgcgctcatcctcgccc

SEQ ID NO: 155302 - DNA, 35 bp, Artificial Sequence
  Synthetic oligonucleotide
tgtgtccgaatgacttgttcggcccttgttttccc

SEQ ID NO: 155303 - DNA, 34 bp, Artificial Sequence
  Synthetic oligonucleotide
cacagaccgcccctctgctgtttcagtaacctcc

SEQ ID NO: 155304 - DNA, 35 bp, Artificial Sequence
  Synthetic oligonucleotide
atcgatagtgttcacctggtccgggtctgtcctcc

SEQ ID NO: 155305 - DNA, 35 bp, Artificial Sequence
  Synthetic oligonucleotide
tcaacaagcccttacctatgatctacctgtcgtcc

SEQ ID NO: 155306 - DNA, 35 bp, Artificial Sequence
  Synthetic oligonucleotide
accctgcaacatcccattcggccactagttcgtcc

SEQ ID NO: 155307 - DNA, 35 bp, Artificial Sequence
  Synthetic oligonucleotide
gcgccgattcggcaccttaattacgcacgccttcc

SEQ ID NO: 155308 - DNA, 35 bp, Artificial Sequence
  Synthetic oligonucleotide
tctgccggtcggtctctgctgcctattaccgttcc

SEQ ID NO: 155309 - DNA, 35 bp, Artificial Sequence
  Synthetic oligonucleotide
gcctcctcgtgcatggctacttcccgacggtttcc

SEQ ID NO: 155310 - DNA, 35 bp, Artificial Sequence
  Synthetic oligonucleotide
ggtgcaccgttattccagcccacgttcccttatgc

SEQ ID NO: 155311 - DNA, 35 bp, Artificial Sequence
  Synthetic oligonucleotide
gatcacctgattcgttacccgcgtgccggtccatc

SEQ ID NO: 155312 - DNA, 35 bp, Artificial Sequence
  Synthetic oligonucleotide
aagagcgccgattggtttcccgctgcttccatatc

SEQ ID NO: 155313 - DNA, 35 bp, Artificial Sequence
  Synthetic oligonucleotide
tctgcaggccgcctgtcccgttgttctgccctctc

SEQ ID NO: 155314 - DNA, 35 bp, Artificial Sequence
  Synthetic oligonucleotide
tccgcgctccaagtcgcctttctgtccttgttctc

SEQ ID NO: 155315 - DNA, 34 bp, Artificial Sequence
  Synthetic oligonucleotide
tcaccaccgctcgctactgtatctcactcgtgtc

SEQ ID NO: 155316 - DNA, 35 bp, Artificial Sequence
  Synthetic oligonucleotide
accgttcgttcctccactttctctgcctttcggag

SEQ ID NO: 155317 - DNA, 35 bp, Artificial Sequence
  Synthetic oligonucleotide
gtggggaggagggttgaggaccagggaggggctag

SEQ ID NO: 155318 - DNA, 35 bp, Artificial Sequence
  Synthetic oligonucleotide
taagatcgcctcattactccgccctcgtacacccg

SEQ ID NO: 155319 - DNA, 35 bp, Artificial Sequence
  Synthetic oligonucleotide
gtctcctcccccatcgtagccgttcatccagtgcg

SEQ ID NO: 155320 - DNA, 35 bp, Artificial Sequence
  Synthetic oligonucleotide
aggatcgcccgagctacactgtccttccccccagg

SEQ ID NO: 155321 - DNA, 35 bp, Artificial Sequence
  Synthetic oligonucleotide
gtcccacatagacatcctcttccgcacattctctg

SEQ ID NO: 155322 - DNA, 35 bp, Artificial Sequence
  Synthetic oligonucleotide
agtgcaccaccatactattccacctagccattctg

SEQ ID NO: 155323 - DNA, 35 bp, Artificial Sequence
  Synthetic oligonucleotide
agcctacccaccccgtcaagaccaccgacatcgtg

SEQ ID NO: 155324 - DNA, 35 bp, Artificial Sequence
  Synthetic oligonucleotide
tgcctctctcagcataatgttctaccccccgattg

SEQ ID NO: 155325 - DNA, 35 bp, Artificial Sequence
  Synthetic oligonucleotide
gctctgccactgctttccccggtcgacgccttttg

SEQ ID NO: 155326 - DNA, 35 bp, Artificial Sequence
  Synthetic oligonucleotide
acacacggccctttcggctttacacgacgttccat

SEQ ID NO: 155327 - DNA, 36 bp, Artificial Sequence
  Synthetic oligonucleotide
gtcgccctatcgtcccgggtacggttttttgcccct

SEQ ID NO: 155328 - DNA, 35 bp, Artificial Sequence
  Synthetic oligonucleotide
ggggtcaaggggggggatgggaattaactggggct

SEQ ID NO: 155329 - DNA, 35 bp, Artificial Sequence
  Synthetic oligonucleotide
tgcacgggcactcggggactcgtttctctccctct

SEQ ID NO: 155330 - DNA, 35 bp, Artificial Sequence
  Synthetic oligonucleotide
gccctgccttgacaacgtcgctttccttgctctct

SEQ ID NO: 155331 - DNA, 35 bp, Artificial Sequence
  Synthetic oligonucleotide
actcccccgttctgtcctggcccagagaccttagt

SEQ ID NO: 155332 - DNA, 35 bp, Artificial Sequence
  Synthetic oligonucleotide
atgcatccctctcatcccccagtcatgccgttcgt

SEQ ID NO: 155333 - DNA, 35 bp, Artificial Sequence
  Synthetic oligonucleotide
attgcccccgccttttgttttattccttagatgtt

SEQ ID NO: 155334 - DNA, 35 bp, Artificial Sequence
  Synthetic oligonucleotide
tcgtccatccccccccgtttgttgtacggttcttt

SEQ ID NO: 155335 - DNA, 36 bp, Artificial Sequence
  Synthetic oligonucleotide
ggaccctctctctctcgctacccgcgccgtgccaca

SEQ ID NO: 155336 - DNA, 36 bp, Artificial Sequence
  Synthetic oligonucleotide
tcacccctccatgttagccgtggttggtccctcaca

SEQ ID NO: 155337 - DNA, 35 bp, Artificial Sequence
  Synthetic oligonucleotide
aaaaacgatggagcgggaggaaaggcgggctgaca

SEQ ID NO: 155338 - DNA, 35 bp, Artificial Sequence
  Synthetic oligonucleotide
accccactggtcctgttactaaccctgttactaca

SEQ ID NO: 155339 - DNA, 35 bp, Artificial Sequence
  Synthetic oligonucleotide
gccaccaggtgctccctcccagcattttccgtaca

SEQ ID NO: 155340 - DNA, 36 bp, Artificial Sequence
  Synthetic oligonucleotide
ggtgctacagccttactcgccagccccgcctaccca

SEQ ID NO: 155341 - DNA, 36 bp, Artificial Sequence
  Synthetic oligonucleotide
atccgctgttgcacccccagtgattcggaactccca

SEQ ID NO: 155342 - DNA, 36 bp, Artificial Sequence
  Synthetic oligonucleotide
accccacccatggtaccgccgttccagttaactcca

SEQ ID NO: 155343 - DNA, 36 bp, Artificial Sequence
  Synthetic oligonucleotide
aaaggagggagggcgtagcggggagggggggctcca

SEQ ID NO: 155344 - DNA, 36 bp, Artificial Sequence
  Synthetic oligonucleotide
gtgccgacgcacctgtcctctccgtagcttattcca

SEQ ID NO: 155345 - DNA, 36 bp, Artificial Sequence
  Synthetic oligonucleotide
tgcacctcatccgtcttgtaccctcattcaccggca

SEQ ID NO: 155346 - DNA, 35 bp, Artificial Sequence
  Synthetic oligonucleotide
tgcgaactaccctacgctgctgtcatgtctcatca

SEQ ID NO: 155347 - DNA, 35 bp, Artificial Sequence
  Synthetic oligonucleotide
tgccccgcccactgccctgtccgggatagaattca

SEQ ID NO: 155348 - DNA, 36 bp, Artificial Sequence
  Synthetic oligonucleotide
tgtgtcccgactccgcgttgttactccttggcttca

SEQ ID NO: 155349 - DNA, 37 bp, Artificial Sequence
  Synthetic oligonucleotide
ttcgcactgcctcctcatgcctctccgtaaccaccga

SEQ ID NO: 155350 - DNA, 36 bp, Artificial Sequence
  Synthetic oligonucleotide
gagccctcagcccgtcttctagtttcgtctatccga

SEQ ID NO: 155351 - DNA, 37 bp, Artificial Sequence
  Synthetic oligonucleotide
gtccgcctagccctcgtcctctccagcgctaccgcga

SEQ ID NO: 155352 - DNA, 37 bp, Artificial Sequence
  Synthetic oligonucleotide
taaggaggggactgagggggggaatgggacaaacgga

SEQ ID NO: 155353 - DNA, 37 bp, Artificial Sequence
  Synthetic oligonucleotide
ttcgtgcaggcccccccattccgtcgacccccatgga

SEQ ID NO: 155354 - DNA, 38 bp, Artificial Sequence
  Synthetic oligonucleotide
gcaagagggccagtcgagacgggaagggagggaaatga

SEQ ID NO: 155355 - DNA, 37 bp, Artificial Sequence
  Synthetic oligonucleotide
gtaaccaccattgtgtacccgtgccttccctaactga

SEQ ID NO: 155356 - DNA, 38 bp, Artificial Sequence
  Synthetic oligonucleotide
agcacagtggagggaggcttgagcgggagggaacctga

SEQ ID NO: 155357 - DNA, 37 bp, Artificial Sequence
  Synthetic oligonucleotide
tcacgcactcgttcttcacgtttttgctcttccctga

SEQ ID NO: 155358 - DNA, 38 bp, Artificial Sequence
  Synthetic oligonucleotide
tgtaaaccgcctcttgtgcccgtagcctctctgcctga

SEQ ID NO: 155359 - DNA, 35 bp, Artificial Sequence
  Synthetic oligonucleotide
gtcatcctcatgggttgcctcctctctcctagtga

SEQ ID NO: 155360 - DNA, 38 bp, Artificial Sequence
  Synthetic oligonucleotide
gcaaaggaggaggcatgggggggtgcggaagtcggtga

SEQ ID NO: 155361 - DNA, 38 bp, Artificial Sequence
  Synthetic oligonucleotide
gtctccttgccgtctcgcccgcttactcccactggtga

SEQ ID NO: 155362 - DNA, 36 bp, Artificial Sequence
  Synthetic oligonucleotide
gacactgcccgccctttcacacgaggttgaccttga

SEQ ID NO: 155363 - DNA, 37 bp, Artificial Sequence
  Synthetic oligonucleotide
ttcctcccctggtccgtgtacgccttacactccttga

SEQ ID NO: 155364 - DNA, 36 bp, Artificial Sequence
  Synthetic oligonucleotide
atccacatccgcagccaccccttccctgcggccata

SEQ ID NO: 155365 - DNA, 36 bp, Artificial Sequence
  Synthetic oligonucleotide
atgacaccaccaactgttgcgtaaccgctgtttcta

SEQ ID NO: 155366 - DNA, 36 bp, Artificial Sequence
  Synthetic oligonucleotide
ttagcccaccgcacacggaattcacacctttgttta

SEQ ID NO: 155367 - DNA, 35 bp, Artificial Sequence
  Synthetic oligonucleotide
gaagggtggctcaaaatctgggggcggggttcaac

SEQ ID NO: 155368 - DNA, 35 bp, Artificial Sequence
  Synthetic oligonucleotide
gagggagaagcatggacgtggtgatagtgcgtcac

SEQ ID NO: 155369 - DNA, 35 bp, Artificial Sequence
  Synthetic oligonucleotide
ggggtgggtcgtcgctgtcaattgtgggagggtac

SEQ ID NO: 155370 - DNA, 35 bp, Artificial Sequence
  Synthetic oligonucleotide
agatcgatcaacgtgcatacctcccacccatgtac

SEQ ID NO: 155371 - DNA, 35 bp, Artificial Sequence
  Synthetic oligonucleotide
aactgccggctccacccgttgtctcaaacgcttac

SEQ ID NO: 155372 - DNA, 35 bp, Artificial Sequence
  Synthetic oligonucleotide
gtccctcgtttcaccatctgcaaagccgactcacc

SEQ ID NO: 155373 - DNA, 35 bp, Artificial Sequence
  Synthetic oligonucleotide
gagccgaccgacttctaactcattcacctggcccc

SEQ ID NO: 155374 - DNA, 35 bp, Artificial Sequence
  Synthetic oligonucleotide
actatgaccaccgccacgttattatcgtaacctcc

SEQ ID NO: 155375 - DNA, 35 bp, Artificial Sequence
  Synthetic oligonucleotide
accgtccgagctctaggatgtctgtcccctgctcc

SEQ ID NO: 155376 - DNA, 35 bp, Artificial Sequence
  Synthetic oligonucleotide
ttgtgacgtcttgcccgtgcagtcctgtccattcc

SEQ ID NO: 155377 - DNA, 35 bp, Artificial Sequence
  Synthetic oligonucleotide
gtcaatgcctttgcgagaagcaacccgcccctagc

SEQ ID NO: 155378 - DNA, 35 bp, Artificial Sequence
  Synthetic oligonucleotide
tcgaactgcctcccgctgcctaaccaggcattagc

SEQ ID NO: 155379 - DNA, 35 bp, Artificial Sequence
  Synthetic oligonucleotide
tccgggtcccatgcagcacttcggttttcactcgc

SEQ ID NO: 155380 - DNA, 35 bp, Artificial Sequence
  Synthetic oligonucleotide
tccatgcttaccttcgatcctgagtctcctgctgc

SEQ ID NO: 155381 - DNA, 36 bp, Artificial Sequence
  Synthetic oligonucleotide
tccgctcctaactgacgtccttctgtctgccatatc

SEQ ID NO: 155382 - DNA, 35 bp, Artificial Sequence
  Synthetic oligonucleotide
aattcgcgctacccctgtccgccggcctacttatc

SEQ ID NO: 155383 - DNA, 35 bp, Artificial Sequence
  Synthetic oligonucleotide
tcgacggtccctcaaatttcgtaccgcccacgctc

SEQ ID NO: 155384 - DNA, 35 bp, Artificial Sequence
  Synthetic oligonucleotide
agcaatgccccaataatctatctggaccgcttctc

SEQ ID NO: 155385 - DNA, 35 bp, Artificial Sequence
  Synthetic oligonucleotide
gtacacgccccagcctccgcacgccttactttctc

SEQ ID NO: 155386 - DNA, 35 bp, Artificial Sequence
  Synthetic oligonucleotide
tcccacctacattctcccgcacccactcgggcttc

SEQ ID NO: 155387 - DNA, 35 bp, Artificial Sequence
  Synthetic oligonucleotide
tgtcgcagtcatcctgcgtctctttagcctcgttc

SEQ ID NO: 155388 - DNA, 35 bp, Artificial Sequence
  Synthetic oligonucleotide
ggacctcaggagggatggacaggggggaggggaag

SEQ ID NO: 155389 - DNA, 35 bp, Artificial Sequence
  Synthetic oligonucleotide
acatcgtacgtaattgcgttcttctccactccccg

SEQ ID NO: 155390 - DNA, 35 bp, Artificial Sequence
  Synthetic oligonucleotide
tgtttcgccggtcccgaatgcgccctattgcctcg

SEQ ID NO: 155391 - DNA, 35 bp, Artificial Sequence
  Synthetic oligonucleotide
gagccgaattcgcagtgcccttagccccttcttcg

SEQ ID NO: 155392 - DNA, 35 bp, Artificial Sequence
  Synthetic oligonucleotide
gaccaggtgggtggggattaacgaggagggacagg

SEQ ID NO: 155393 - DNA, 35 bp, Artificial Sequence
  Synthetic oligonucleotide
aggagaggagggcaaagagggagaaagaaattggg

SEQ ID NO: 155394 - DNA, 35 bp, Artificial Sequence
  Synthetic oligonucleotide
atcgcgcgcagctccaagcgcttcctctgtccctg

SEQ ID NO: 155395 - DNA, 35 bp, Artificial Sequence
  Synthetic oligonucleotide
ttgaacatcatccgcccctctttctgagcccattg

SEQ ID NO: 155396 - DNA, 35 bp, Artificial Sequence
  Synthetic oligonucleotide
tatcgccgagtgccccattgtcgccctcccctcat

SEQ ID NO: 155397 - DNA, 35 bp, Artificial Sequence
  Synthetic oligonucleotide
ttgggaaccatcacctccatgcattagactcctat

SEQ ID NO: 155398 - DNA, 35 bp, Artificial Sequence
  Synthetic oligonucleotide
gcttgcgcaacgcacctcctccccgtctgagctat

SEQ ID NO: 155399 - DNA, 35 bp, Artificial Sequence
  Synthetic oligonucleotide
atcctcacagccggttcctgcatccttcctccgct

SEQ ID NO: 155400 - DNA, 36 bp, Artificial Sequence
  Synthetic oligonucleotide
gcccatgccagtccagtcgtttacatccgccctatt

SEQ ID NO: 155401 - DNA, 34 bp, Artificial Sequence
  Synthetic oligonucleotide
tactgacgcactccttggttatcatgctcccgtt

SEQ ID NO: 155402 - DNA, 35 bp, Artificial Sequence
  Synthetic oligonucleotide
gatccacacactgccccattcagcgttccgccgtt

SEQ ID NO: 155403 - DNA, 36 bp, Artificial Sequence
  Synthetic oligonucleotide
tgccatccgatggccccagagtgcttctcctccaca

SEQ ID NO: 155404 - DNA, 36 bp, Artificial Sequence
  Synthetic oligonucleotide
gatcgccgctccactctccactcaggccctggtaca

SEQ ID NO: 155405 - DNA, 35 bp, Artificial Sequence
  Synthetic oligonucleotide
atttcagcccatcccctcgtccgatacacgcccca

SEQ ID NO: 155406 - DNA, 36 bp, Artificial Sequence
  Synthetic oligonucleotide
agcccacctcagggtctcagcttactacgccgccca

SEQ ID NO: 155407 - DNA, 36 bp, Artificial Sequence
  Synthetic oligonucleotide
ttgtttcccgcccgcattgatctttgacgcctgcca

SEQ ID NO: 155408 - DNA, 35 bp, Artificial Sequence
  Synthetic oligonucleotide
actcacacacccccctcttatagacggccctggca

SEQ ID NO: 155409 - DNA, 37 bp, Artificial Sequence
  Synthetic oligonucleotide
gccaccccccgcccgaataggccgcccttttcacaga

SEQ ID NO: 155410 - DNA, 37 bp, Artificial Sequence
  Synthetic oligonucleotide
ttcgaataggggtgtgggtagcaagggggggattaga

SEQ ID NO: 155411 - DNA, 37 bp, Artificial Sequence
  Synthetic oligonucleotide
accacgtccctccgtccttggtgcacatttctaacga

SEQ ID NO: 155412 - DNA, 37 bp, Artificial Sequence
  Synthetic oligonucleotide
ttgacccgcaagatctttcatcctatacccgccccga

SEQ ID NO: 155413 - DNA, 31 bp, Artificial Sequence
  Synthetic oligonucleotide
tcctacgcgcgcttcgtagcccctctgccga

SEQ ID NO: 155414 - DNA, 37 bp, Artificial Sequence
  Synthetic oligonucleotide
tccccgctacctcacccttctttatgtgcccgatcga

SEQ ID NO: 155415 - DNA, 36 bp, Artificial Sequence
  Synthetic oligonucleotide
agacatggggaggaggcactggtcggagggggagga

SEQ ID NO: 155416 - DNA, 37 bp, Artificial Sequence
  Synthetic oligonucleotide
accaaccacatctcacttacgacgctcactcctagga

SEQ ID NO: 155417 - DNA, 36 bp, Artificial Sequence
  Synthetic oligonucleotide
tctgagacacggatgggggaaaagtggggtgacgga

SEQ ID NO: 155418 - DNA, 37 bp, Artificial Sequence
  Synthetic oligonucleotide
ggtggaggaggggactagcaaggtacgatcggtggga

SEQ ID NO: 155419 - DNA, 36 bp, Artificial Sequence
  Synthetic oligonucleotide
tgcaaaggtaagaggggaggtgggaaggtacgtgga

SEQ ID NO: 155420 - DNA, 37 bp, Artificial Sequence
  Synthetic oligonucleotide
ttcgcaacttccgcccgctttcccgctccagcttgga

SEQ ID NO: 155421 - DNA, 37 bp, Artificial Sequence
  Synthetic oligonucleotide
tcccatgtccttgtcaattccgctccagtacccatga

SEQ ID NO: 155422 - DNA, 38 bp, Artificial Sequence
  Synthetic oligonucleotide
gacgcctccacttgtacggcatccccattcattcctga

SEQ ID NO: 155423 - DNA, 38 bp, Artificial Sequence
  Synthetic oligonucleotide
atgatggaggagcagggcggacgggggggatcagctga

SEQ ID NO: 155424 - DNA, 38 bp, Artificial Sequence
  Synthetic oligonucleotide
acatgacaaccgccttcatgtgattcccctcccgctga

SEQ ID NO: 155425 - DNA, 38 bp, Artificial Sequence
  Synthetic oligonucleotide
atgcacgtcaccattgccgccaccctatgattctctga

SEQ ID NO: 155426 - DNA, 38 bp, Artificial Sequence
  Synthetic oligonucleotide
acacctcgcagctttcacctttgccgtcctttctctga

SEQ ID NO: 155427 - DNA, 38 bp, Artificial Sequence
  Synthetic oligonucleotide
tacgagggaaagggtgggctatcggggagacgttctga

SEQ ID NO: 155428 - DNA, 37 bp, Artificial Sequence
  Synthetic oligonucleotide
tacgcataccgctgacttctgaccacccgctttctga

SEQ ID NO: 155429 - DNA, 37 bp, Artificial Sequence
  Synthetic oligonucleotide
actcgtcaccgcgcaccagctgcctacctttccgtga

SEQ ID NO: 155430 - DNA, 38 bp, Artificial Sequence
  Synthetic oligonucleotide
gttggtctaggtcagacggggtggtggtgggtgggtga

SEQ ID NO: 155431 - DNA, 37 bp, Artificial Sequence
  Synthetic oligonucleotide
gagagcgactgttccatttacatgcccgccgccttga

SEQ ID NO: 155432 - DNA, 37 bp, Artificial Sequence
  Synthetic oligonucleotide
tcgcattcatcctgtacctgccgttcctcctgcttga

SEQ ID NO: 155433 - DNA, 36 bp, Artificial Sequence
  Synthetic oligonucleotide
ggggactcaggggcatgacagcattgggcggggata

SEQ ID NO: 155434 - DNA, 35 bp, Artificial Sequence
  Synthetic oligonucleotide
atcacatccgctctcttgcttatgcccttgctata

SEQ ID NO: 155435 - DNA, 36 bp, Artificial Sequence
  Synthetic oligonucleotide
gaacaaagggtagaagggggggaatatgggattata

SEQ ID NO: 155436 - DNA, 35 bp, Artificial Sequence
  Synthetic oligonucleotide
aagaacgggcgggaaagggacggggcgcagaacta

SEQ ID NO: 155437 - DNA, 36 bp, Artificial Sequence
  Synthetic oligonucleotide
aggatcagggagggttggggtgagggtgaggcgcta

SEQ ID NO: 155438 - DNA, 36 bp, Artificial Sequence
  Synthetic oligonucleotide
gatcgaccggacgtgtcctgccatcccgtttttcta

SEQ ID NO: 155439 - DNA, 36 bp, Artificial Sequence
  Synthetic oligonucleotide
tccgcatggccgcccttacatttacacttctgcgta

SEQ ID NO: 155440 - DNA, 36 bp, Artificial Sequence
  Synthetic oligonucleotide
atctgttgccctcgatttatgttgccctgttcctta

SEQ ID NO: 155441 - DNA, 35 bp, Artificial Sequence
  Synthetic oligonucleotide
gtgactgtccacgtttttaccccagtgccgtacac

SEQ ID NO: 155442 - DNA, 36 bp, Artificial Sequence
  Synthetic oligonucleotide
aatctgcactcccccttatctgtcttacgccatgac

SEQ ID NO: 155443 - DNA, 35 bp, Artificial Sequence
  Synthetic oligonucleotide
tgcacaagatgggtggggagccgggtgggttgtac

SEQ ID NO: 155444 - DNA, 35 bp, Artificial Sequence
  Synthetic oligonucleotide
tttaggcactactccgctgactgtctttttgcacc

SEQ ID NO: 155445 - DNA, 35 bp, Artificial Sequence
  Synthetic oligonucleotide
tatgaggagcacgcgtccgtcgtcccatctacccc

SEQ ID NO: 155446 - DNA, 35 bp, Artificial Sequence
  Synthetic oligonucleotide
gcactgtactggaccgcccactagcgctgccgccc

SEQ ID NO: 155447 - DNA, 35 bp, Artificial Sequence
  Synthetic oligonucleotide
gatgcgtcacacatctccgactgcactactcgccc

SEQ ID NO: 155448 - DNA, 35 bp, Artificial Sequence
  Synthetic oligonucleotide
tgccagtcgcatcctctccatatatgtccctatcc

SEQ ID NO: 155449 - DNA, 29 bp, Artificial Sequence
  Synthetic oligonucleotide
gctcctggttagttccttcatgccactcc

SEQ ID NO: 155450 - DNA, 35 bp, Artificial Sequence
  Synthetic oligonucleotide
tctattccaccatcaatgcggttgggtccccttcc

SEQ ID NO: 155451 - DNA, 35 bp, Artificial Sequence
  Synthetic oligonucleotide
tcgccggcccgtccatccttttttctcgactccgc

SEQ ID NO: 155452 - DNA, 35 bp, Artificial Sequence
  Synthetic oligonucleotide
gtcgcacaaggacccactcactgttcgctccctgc

SEQ ID NO: 155453 - DNA, 35 bp, Artificial Sequence
  Synthetic oligonucleotide
gtgacctacgtgggctcgcacatctccgcctgttc

SEQ ID NO: 155454 - DNA, 35 bp, Artificial Sequence
  Synthetic oligonucleotide
aagcccacatgtggggtgcccttcttgattctttc

SEQ ID NO: 155455 - DNA, 35 bp, Artificial Sequence
  Synthetic oligonucleotide
gacacctccgcaccctctctgctgcacactaaaag

SEQ ID NO: 155456 - DNA, 35 bp, Artificial Sequence
  Synthetic oligonucleotide
ggtgtcacgctgcgggagggagtcgggcgggggag

SEQ ID NO: 155457 - DNA, 35 bp, Artificial Sequence
  Synthetic oligonucleotide
aatgctccactcgcttatcgccctactcctagtag

SEQ ID NO: 155458 - DNA, 35 bp, Artificial Sequence
  Synthetic oligonucleotide
gttcagacgtgcctcttccgtctcactctccaccg

SEQ ID NO: 155459 - DNA, 35 bp, Artificial Sequence
  Synthetic oligonucleotide
agttgtggagagggggaattcggggtcgaaggggg

SEQ ID NO: 155460 - DNA, 35 bp, Artificial Sequence
  Synthetic oligonucleotide
ttacgtccgtctacattcgctagcacctgcccctg

SEQ ID NO: 155461 - DNA, 35 bp, Artificial Sequence
  Synthetic oligonucleotide
agcccgcccatgccactgagcccattcacatcctg

SEQ ID NO: 155462 - DNA, 35 bp, Artificial Sequence
  Synthetic oligonucleotide
ttggaccatcacacctttcctgcacccctgaggtg

SEQ ID NO: 155463 - DNA, 35 bp, Artificial Sequence
  Synthetic oligonucleotide
gcccgccccatgatgcgccctccctttattatgat

SEQ ID NO: 155464 - DNA, 35 bp, Artificial Sequence
  Synthetic oligonucleotide
gatggcgtttagtttgcgcctcgtctattgtccct

SEQ ID NO: 155465 - DNA, 35 bp, Artificial Sequence
  Synthetic oligonucleotide
tgaccctggcgcaatcgccgtatctgcccaccgct

SEQ ID NO: 155466 - DNA, 35 bp, Artificial Sequence
  Synthetic oligonucleotide
tcacgcacccatatgcctgttcatttgcctctcgt

SEQ ID NO: 155467 - DNA, 35 bp, Artificial Sequence
  Synthetic oligonucleotide
tttacgactgtccgcccgcttatttctgtaacctt

SEQ ID NO: 155468 - DNA, 35 bp, Artificial Sequence
  Synthetic oligonucleotide
acgacgtctcgttgtccatctctccgtctcaattt

SEQ ID NO: 155469 - DNA, 36 bp, Artificial Sequence
  Synthetic oligonucleotide
gcacacatctcataatgcacgttttagccacctaca

SEQ ID NO: 155470 - DNA, 35 bp, Artificial Sequence
  Synthetic oligonucleotide
ttcgagttgcgacacgccttggtcccttctctaca

SEQ ID NO: 155471 - DNA, 35 bp, Artificial Sequence
  Synthetic oligonucleotide
actaccgctgttgaactatccccgtgccgacacca

SEQ ID NO: 155472 - DNA, 36 bp, Artificial Sequence
  Synthetic oligonucleotide
atcgaagcatcaccgctgccacacttactgtaccca

SEQ ID NO: 155473 - DNA, 35 bp, Artificial Sequence
  Synthetic oligonucleotide
acgtcgtccgtccgccgttgccagcatactcccca

SEQ ID NO: 155474 - DNA, 35 bp, Artificial Sequence
  Synthetic oligonucleotide
gcaggcgtagtccccccgctcacgtaccgccgcca

SEQ ID NO: 155475 - DNA, 35 bp, Artificial Sequence
  Synthetic oligonucleotide
atcctttgcgcggatcgccccttgtcgcctctcca

SEQ ID NO: 155476 - DNA, 35 bp, Artificial Sequence
  Synthetic oligonucleotide
tacagcctccccaccgtcccactgccgaccccgca

SEQ ID NO: 155477 - DNA, 36 bp, Artificial Sequence
  Synthetic oligonucleotide
gtgccaccgccctgccaagcaaccgccatttgttca

SEQ ID NO: 155478 - DNA, 37 bp, Artificial Sequence
  Synthetic oligonucleotide
gttccccccgttcacatcaccgccacaactttgacga

SEQ ID NO: 155479 - DNA, 37 bp, Artificial Sequence
  Synthetic oligonucleotide
gaggacgcttctcttctgttcatgctcgctcccccga

SEQ ID NO: 155480 - DNA, 36 bp, Artificial Sequence
  Synthetic oligonucleotide
aaccgtcccggtcactctgtaacaccaatcgcccga

SEQ ID NO: 155481 - DNA, 37 bp, Artificial Sequence
  Synthetic oligonucleotide
ccttgcctcgccctgttgcttgctttccgtactccga

SEQ ID NO: 155482 - DNA, 37 bp, Artificial Sequence
  Synthetic oligonucleotide
aacggggcggacaatacggaggggttggtggtggcga

SEQ ID NO: 155483 - DNA, 37 bp, Artificial Sequence
  Synthetic oligonucleotide
atcgtgcgcattcactctgtacctctcttcgaatcga

SEQ ID NO: 155484 - DNA, 36 bp, Artificial Sequence
  Synthetic oligonucleotide
aggggaggtagccagaaaaagggggtggggggtcga

SEQ ID NO: 155485 - DNA, 37 bp, Artificial Sequence
  Synthetic oligonucleotide
ggtgaagagagaaacacggaaaaaggggtggtaagga

SEQ ID NO: 155486 - DNA, 36 bp, Artificial Sequence
  Synthetic oligonucleotide
aagacggcgggaggtgggtcgaaagatgggggagga

SEQ ID NO: 155487 - DNA, 37 bp, Artificial Sequence
  Synthetic oligonucleotide
ggtgaacgctgagagcaaggcgggcgggtaaggggga

SEQ ID NO: 155488 - DNA, 38 bp, Artificial Sequence
  Synthetic oligonucleotide
ataccgcccccatgttatgccacgcacctcttacatga

SEQ ID NO: 155489 - DNA, 38 bp, Artificial Sequence
  Synthetic oligonucleotide
gaacaatcgccgaccgccttaagtcttgcccttcgtga

SEQ ID NO: 155490 - DNA, 36 bp, Artificial Sequence
  Synthetic oligonucleotide
gagggggtggcaggggagaatgaagggaaggggtga

SEQ ID NO: 155491 - DNA, 38 bp, Artificial Sequence
  Synthetic oligonucleotide
gcatcgccatggacctcccccgctgcgctcttgcttga

SEQ ID NO: 155492 - DNA, 35 bp, Artificial Sequence
  Synthetic oligonucleotide
tgccccgacgctttgtacacggtgcccctcttata

SEQ ID NO: 155493 - DNA, 35 bp, Artificial Sequence
  Synthetic oligonucleotide
atgtcatggacgcctctatgcccgtttaccaccta

SEQ ID NO: 155494 - DNA, 36 bp, Artificial Sequence
  Synthetic oligonucleotide
tcccaaccaacacctgttccttatagacgcaagcta

SEQ ID NO: 155495 - DNA, 36 bp, Artificial Sequence
  Synthetic oligonucleotide
gtatgccccctccgctcgtttgtggtcccctctcta

SEQ ID NO: 155496 - DNA, 35 bp, Artificial Sequence
  Synthetic oligonucleotide
aaagggagcgagtaatatgggggatggggggcgta

SEQ ID NO: 155497 - DNA, 35 bp, Artificial Sequence
  Synthetic oligonucleotide
tttggccgatccagcactccccctcattgaaccac

SEQ ID NO: 155498 - DNA, 35 bp, Artificial Sequence
  Synthetic oligonucleotide
tcgacaggtccactgctcacatacggcccctgcac

SEQ ID NO: 155499 - DNA, 35 bp, Artificial Sequence
  Synthetic oligonucleotide
gatcgctcgccgtacattccccaggccttgttccc

SEQ ID NO: 155500 - DNA, 35 bp, Artificial Sequence
  Synthetic oligonucleotide
gtacaatccgcactgcgcacccctgatcatgatcc

SEQ ID NO: 155501 - DNA, 35 bp, Artificial Sequence
  Synthetic oligonucleotide
gtagatggcggtctcccgtacctcccccgtgctcc

SEQ ID NO: 155502 - DNA, 35 bp, Artificial Sequence
  Synthetic oligonucleotide
attgccaatgcttccgtcgtctactcgttccttcc

SEQ ID NO: 155503 - DNA, 35 bp, Artificial Sequence
  Synthetic oligonucleotide
taaccgatccgcgccggcctcctgttccctttagc

SEQ ID NO: 155504 - DNA, 30 bp, Artificial Sequence
  Synthetic oligonucleotide
ataccctaccgttcacacgagctattacgc

SEQ ID NO: 155505 - DNA, 35 bp, Artificial Sequence
  Synthetic oligonucleotide
tacgccgctgcagcggtgatcctatgccgtcccgc

SEQ ID NO: 155506 - DNA, 35 bp, Artificial Sequence
  Synthetic oligonucleotide
tcggagtcgcattccagtcgctccaacacctccgc

SEQ ID NO: 155507 - DNA, 35 bp, Artificial Sequence
  Synthetic oligonucleotide
gcctcttccccacagtattcgcctttgccactcgc

SEQ ID NO: 155508 - DNA, 33 bp, Artificial Sequence
  Synthetic oligonucleotide
tccccccccgccgacacctattgtcatcatggc

SEQ ID NO: 155509 - DNA, 35 bp, Artificial Sequence
  Synthetic oligonucleotide
gatttcgcctccactcatgtttaattagtccgctc

SEQ ID NO: 155510 - DNA, 35 bp, Artificial Sequence
  Synthetic oligonucleotide
tagcaagccggccctcgcctctactcatcgttctc

SEQ ID NO: 155511 - DNA, 35 bp, Artificial Sequence
  Synthetic oligonucleotide
tgtcaacgttccatcccgcgcgcccccgcacagtc

SEQ ID NO: 155512 - DNA, 35 bp, Artificial Sequence
  Synthetic oligonucleotide
tacgactgcccacgccgaacgcgacgtctcccgtc

SEQ ID NO: 155513 - DNA, 35 bp, Artificial Sequence
  Synthetic oligonucleotide
gaaatggggggatcacgagggtaggatagggcagg

SEQ ID NO: 155514 - DNA, 35 bp, Artificial Sequence
  Synthetic oligonucleotide
ggtcaccacagggacagggacggggggacggactg

SEQ ID NO: 155515 - DNA, 35 bp, Artificial Sequence
  Synthetic oligonucleotide
aacacgtccgatcttctttttgccccacccccgtg

SEQ ID NO: 155516 - DNA, 35 bp, Artificial Sequence
  Synthetic oligonucleotide
ttgctcccgcccctaccctttaggtcatatccttg

SEQ ID NO: 155517 - DNA, 35 bp, Artificial Sequence
  Synthetic oligonucleotide
acgcatctctctccatcgtgccccccgactcttat

SEQ ID NO: 155518 - DNA, 35 bp, Artificial Sequence
  Synthetic oligonucleotide
gatcccaccccaggtctctcgattctatccgaact

SEQ ID NO: 155519 - DNA, 35 bp, Artificial Sequence
  Synthetic oligonucleotide
gagacctccgtgtttgcccagctcgcctcgccact

SEQ ID NO: 155520 - DNA, 35 bp, Artificial Sequence
  Synthetic oligonucleotide
gatgccgcctgctctcaagtcacaattggcaccct

SEQ ID NO: 155521 - DNA, 35 bp, Artificial Sequence
  Synthetic oligonucleotide
ttggggcgatcctgattttgccggcgttccctcct

SEQ ID NO: 155522 - DNA, 35 bp, Artificial Sequence
  Synthetic oligonucleotide
tgttaaacgccgcgcgcacctacttgccccttcct

SEQ ID NO: 155523 - DNA, 34 bp, Artificial Sequence
  Synthetic oligonucleotide
ttctgtccccctgtacgtctagtccctgttcgct

SEQ ID NO: 155524 - DNA, 35 bp, Artificial Sequence
  Synthetic oligonucleotide
atgaggcaccgctctaggacctatcctgcccctct

SEQ ID NO: 155525 - DNA, 35 bp, Artificial Sequence
  Synthetic oligonucleotide
gaccgccacacactctggtctgaactctcacttct

SEQ ID NO: 155526 - DNA, 35 bp, Artificial Sequence
  Synthetic oligonucleotide
gagagccagggagcgagagaaatatgggggtgagt

SEQ ID NO: 155527 - DNA, 34 bp, Artificial Sequence
  Synthetic oligonucleotide
tgctctcctcacacttaggcccttgtttcacatt

SEQ ID NO: 155528 - DNA, 34 bp, Artificial Sequence
  Synthetic oligonucleotide
tctaccccgcccataaacttcggacatacccgaa

SEQ ID NO: 155529 - DNA, 35 bp, Artificial Sequence
  Synthetic oligonucleotide
gtgcaggccaacgtcaccgtcccgccgccttgcca

SEQ ID NO: 155530 - DNA, 36 bp, Artificial Sequence
  Synthetic oligonucleotide
tgacgcgcctgtatatctgctccctgtctcattcca

SEQ ID NO: 155531 - DNA, 36 bp, Artificial Sequence
  Synthetic oligonucleotide
gcccctcacatagaccgctcgtgccatttactatca

SEQ ID NO: 155532 - DNA, 35 bp, Artificial Sequence
  Synthetic oligonucleotide
ccaacccatgcactgccgtatacggtcctccctca

SEQ ID NO: 155533 - DNA, 34 bp, Artificial Sequence
  Synthetic oligonucleotide
tgtccactactgtttaagcctccttcgtttctca

SEQ ID NO: 155534 - DNA, 32 bp, Artificial Sequence
  Synthetic oligonucleotide
atgactgaaggggatgggggggaaattacaga

SEQ ID NO: 155535 - DNA, 37 bp, Artificial Sequence
  Synthetic oligonucleotide
ggcggtggagggtggaaggaatggggaggtggaacga

SEQ ID NO: 155536 - DNA, 37 bp, Artificial Sequence
  Synthetic oligonucleotide
attgccgggctcatcgtttgcattaaccttcctccga

SEQ ID NO: 155537 - DNA, 37 bp, Artificial Sequence
  Synthetic oligonucleotide
acgaccccccctcggaccttatttgagcacacggcga

SEQ ID NO: 155538 - DNA, 36 bp, Artificial Sequence
  Synthetic oligonucleotide
tcccgcataccatctattgcaccatgatcacttcga

SEQ ID NO: 155539 - DNA, 37 bp, Artificial Sequence
  Synthetic oligonucleotide
gtgggcaaaggcaaacgggcgggcggggggcaaagga

SEQ ID NO: 155540 - DNA, 36 bp, Artificial Sequence
  Synthetic oligonucleotide
agtgggcgggacgggttgttacagccattacaggga

SEQ ID NO: 155541 - DNA, 36 bp, Artificial Sequence
  Synthetic oligonucleotide
tggtgatagaggggggtgaagagcgcggggacggga

SEQ ID NO: 155542 - DNA, 36 bp, Artificial Sequence
  Synthetic oligonucleotide
ggggagccatctagggtggggaggtctctaggggga

SEQ ID NO: 155543 - DNA, 37 bp, Artificial Sequence
  Synthetic oligonucleotide
aacgtgtaaggggtcatagagggtggggaactgggga

SEQ ID NO: 155544 - DNA, 37 bp, Artificial Sequence
  Synthetic oligonucleotide
agatgggaaggggagcatacggtggggcgcaggtgga

SEQ ID NO: 155545 - DNA, 38 bp, Artificial Sequence
  Synthetic oligonucleotide
tagatggagggtggacggggggacgggtactcagatga

SEQ ID NO: 155546 - DNA, 37 bp, Artificial Sequence
  Synthetic oligonucleotide
atgtgccatccgcatcctgactctcttcgaaccctga

SEQ ID NO: 155547 - DNA, 37 bp, Artificial Sequence
  Synthetic oligonucleotide
accgtacgctgtacctgttccgctcccccgaccctga

SEQ ID NO: 155548 - DNA, 36 bp, Artificial Sequence
  Synthetic oligonucleotide
gcactcgcgggctcttcttcggtacctctcacttga

SEQ ID NO: 155549 - DNA, 38 bp, Artificial Sequence
  Synthetic oligonucleotide
ttcctcccgcggcaccctgttagcctcctactcgttga

SEQ ID NO: 155550 - DNA, 38 bp, Artificial Sequence
  Synthetic oligonucleotide
atagccagtgaggggtctatgggggaggcgggggttga

SEQ ID NO: 155551 - DNA, 36 bp, Artificial Sequence
  Synthetic oligonucleotide
tacgcccttccgccactcgctatttgctaaaaacta

SEQ ID NO: 155552 - DNA, 35 bp, Artificial Sequence
  Synthetic oligonucleotide
gtcacccccgcataatggtttccgccgcaccacta

SEQ ID NO: 155553 - DNA, 36 bp, Artificial Sequence
  Synthetic oligonucleotide
tcagcccctcctgcctgttgtcagttccataaccta

SEQ ID NO: 155554 - DNA, 35 bp, Artificial Sequence
  Synthetic oligonucleotide
ttcgtccgacgggcgtactgcatatccccccccta

SEQ ID NO: 155555 - DNA, 36 bp, Artificial Sequence
  Synthetic oligonucleotide
tcttgccaccgcctaatttcatgctacaacacgcta

SEQ ID NO: 155556 - DNA, 36 bp, Artificial Sequence
  Synthetic oligonucleotide
aagcccgccgaccctcgttatcgatgccaactgcta

SEQ ID NO: 155557 - DNA, 36 bp, Artificial Sequence
  Synthetic oligonucleotide
gatgccctgtctcacatgccccttaacacgctgcta

SEQ ID NO: 155558 - DNA, 35 bp, Artificial Sequence
  Synthetic oligonucleotide
tccttgcacccaccacccgatgaagatcgttcgta

SEQ ID NO: 155559 - DNA, 36 bp, Artificial Sequence
  Synthetic oligonucleotide
acgcgcccaacatgcctgtcttacacgttctcatta

SEQ ID NO: 155560 - DNA, 36 bp, Artificial Sequence
  Synthetic oligonucleotide
agcgcaccttccactccctgcctaactccagcttta

SEQ ID NO: 155561 - DNA, 35 bp, Artificial Sequence
  Synthetic oligonucleotide
taatgcagggggatggacgtacgggaaatcggcac

SEQ ID NO: 155562 - DNA, 35 bp, Artificial Sequence
  Synthetic oligonucleotide
gcccaagccgcgtttccaatagacactgccccccc

SEQ ID NO: 155563 - DNA, 35 bp, Artificial Sequence
  Synthetic oligonucleotide
tcccgctgagcagcggaactttgctttcacgcccc

SEQ ID NO: 155564 - DNA, 35 bp, Artificial Sequence
  Synthetic oligonucleotide
cgcaccaggctttccaggctgcagaaccccgcccc

SEQ ID NO: 155565 - DNA, 35 bp, Artificial Sequence
  Synthetic oligonucleotide
tccgttatccgcttagccgttttttgccccttccc

SEQ ID NO: 155566 - DNA, 35 bp, Artificial Sequence
  Synthetic oligonucleotide
ttcatgccacagcctcttaagccccttgttgcgcc

SEQ ID NO: 155567 - DNA, 35 bp, Artificial Sequence
  Synthetic oligonucleotide
aatgcacgtctttgccccgcgctctccattcgtcc

SEQ ID NO: 155568 - DNA, 35 bp, Artificial Sequence
  Synthetic oligonucleotide
tgattcgatacgaaccaccatcatgggacccttcc

SEQ ID NO: 155569 - DNA, 35 bp, Artificial Sequence
  Synthetic oligonucleotide
acacttgtgataccctgtgcccctgttttagttcc

SEQ ID NO: 155570 - DNA, 35 bp, Artificial Sequence
  Synthetic oligonucleotide
tccatcttgtctggaggcatagcacacccatttcc

SEQ ID NO: 155571 - DNA, 35 bp, Artificial Sequence
  Synthetic oligonucleotide
ggacgtcgttcgccgcccctcttctgcaccaacgc

SEQ ID NO: 155572 - DNA, 35 bp, Artificial Sequence
  Synthetic oligonucleotide
acccatggcgcccatcgataccgttcttacaccgc

SEQ ID NO: 155573 - DNA, 32 bp, Artificial Sequence
  Synthetic oligonucleotide
gcaaccgtaatccatctcttcccttagcaggc

SEQ ID NO: 155574 - DNA, 35 bp, Artificial Sequence
  Synthetic oligonucleotide
acccgtcccctccgttcgcgatcccgagggcaggc

SEQ ID NO: 155575 - DNA, 35 bp, Artificial Sequence
  Synthetic oligonucleotide
aacacccattcgcacccaccgctagcatttactgc

SEQ ID NO: 155576 - DNA, 35 bp, Artificial Sequence
  Synthetic oligonucleotide
tccctccctcgcccccgttcacgcacccatcgtgc

SEQ ID NO: 155577 - DNA, 35 bp, Artificial Sequence
  Synthetic oligonucleotide
gagccgacgcccgtttatctttcccggacacactc

SEQ ID NO: 155578 - DNA, 35 bp, Artificial Sequence
  Synthetic oligonucleotide
acaacaccctctggttcgccaaattgactgtactc

SEQ ID NO: 155579 - DNA, 32 bp, Artificial Sequence
  Synthetic oligonucleotide
tcaacctcgctctggaccaaccacaccttgtc

SEQ ID NO: 155580 - DNA, 35 bp, Artificial Sequence
  Synthetic oligonucleotide
taatcaccgccaaatagccatcggtctgtgccttc

SEQ ID NO: 155581 - DNA, 35 bp, Artificial Sequence
  Synthetic oligonucleotide
gccctgtctattgttgtccagctgcccgtcctttc

SEQ ID NO: 155582 - DNA, 35 bp, Artificial Sequence
  Synthetic oligonucleotide
ttgtcaccgcaccacacatgttaacttaccctcag

SEQ ID NO: 155583 - DNA, 35 bp, Artificial Sequence
  Synthetic oligonucleotide
tatggcctcgttcgttcactataatactccctccg

SEQ ID NO: 155584 - DNA, 35 bp, Artificial Sequence
  Synthetic oligonucleotide
tccccgcccaaacgcaggctgttagaccttctccg

SEQ ID NO: 155585 - DNA, 35 bp, Artificial Sequence
  Synthetic oligonucleotide
tgcgacgccgccttctattgccccccgacatgcgg

SEQ ID NO: 155586 - DNA, 35 bp, Artificial Sequence
  Synthetic oligonucleotide
gtggggtctataacagggggacggatcaaaagggg

SEQ ID NO: 155587 - DNA, 35 bp, Artificial Sequence
  Synthetic oligonucleotide
ggatagccgaccacttatcgccgttcccccacctg

SEQ ID NO: 155588 - DNA, 35 bp, Artificial Sequence
  Synthetic oligonucleotide
ttgactgtccgccactccctcgggctcctttcgat

SEQ ID NO: 155589 - DNA, 35 bp, Artificial Sequence
  Synthetic oligonucleotide
acatggggggtgaggggagatgcaggaaagatgat

SEQ ID NO: 155590 - DNA, 35 bp, Artificial Sequence
  Synthetic oligonucleotide
tgtcacacttgctgacttcttcgccttgttcctat

SEQ ID NO: 155591 - DNA, 35 bp, Artificial Sequence
  Synthetic oligonucleotide
tggggtcatcacgccctgtctgttaactgtcccct

SEQ ID NO: 155592 - DNA, 35 bp, Artificial Sequence
  Synthetic oligonucleotide
ttgtctcgcacccctgtcttgagccggttttccct

SEQ ID NO: 155593 - DNA, 35 bp, Artificial Sequence
  Synthetic oligonucleotide
ggtggactgccggtccatctgtcctatccttcgct

SEQ ID NO: 155594 - DNA, 35 bp, Artificial Sequence
  Synthetic oligonucleotide
agaccccgcctccgcctcgctcattatttgcggct

SEQ ID NO: 155595 - DNA, 35 bp, Artificial Sequence
  Synthetic oligonucleotide
tgcaccgctcttaacttgctatggtctttcactct

SEQ ID NO: 155596 - DNA, 35 bp, Artificial Sequence
  Synthetic oligonucleotide
acacatgctgtgggatcgcgttttgctctgcctct

SEQ ID NO: 155597 - DNA, 35 bp, Artificial Sequence
  Synthetic oligonucleotide
gaacgggtggaagggagggaacgttggttgtaagt

SEQ ID NO: 155598 - DNA, 35 bp, Artificial Sequence
  Synthetic oligonucleotide
aggagggtcggccgggggggagatcgggagagagt

SEQ ID NO: 155599 - DNA, 35 bp, Artificial Sequence
  Synthetic oligonucleotide
accgtgcccctcccacacgacatcgggggaccctt

SEQ ID NO: 155600 - DNA, 35 bp, Artificial Sequence
  Synthetic oligonucleotide
aaagcaggtctggttctgatcccgttgctgccctt

SEQ ID NO: 155601 - DNA, 35 bp, Artificial Sequence
  Synthetic oligonucleotide
tcccattcgatgcctatttcgtccattccgtcctt

SEQ ID NO: 155602 - DNA, 35 bp, Artificial Sequence
  Synthetic oligonucleotide
ttgataacgccctccatttgtcccatcagttgctt

SEQ ID NO: 155603 - DNA, 36 bp, Artificial Sequence
  Synthetic oligonucleotide
tcaccgctgttgcctctactcgcactttcatataaa

SEQ ID NO: 155604 - DNA, 36 bp, Artificial Sequence
  Synthetic oligonucleotide
gacccacctcacgagcctctacgaccctcagcccaa

SEQ ID NO: 155605 - DNA, 36 bp, Artificial Sequence
  Synthetic oligonucleotide
tgtccacccgcttttgaatactactcacggtcctaa

SEQ ID NO: 155606 - DNA, 36 bp, Artificial Sequence
  Synthetic oligonucleotide
gcccattgcgcactgggtgggggggtttagggttaa

SEQ ID NO: 155607 - DNA, 36 bp, Artificial Sequence
  Synthetic oligonucleotide
gttgcagggactaaaggggagggaggggagcgccca

SEQ ID NO: 155608 - DNA, 35 bp, Artificial Sequence
  Synthetic oligonucleotide
taccacctgcacgaccccttggcactacgcttcca

SEQ ID NO: 155609 - DNA, 35 bp, Artificial Sequence
  Synthetic oligonucleotide
tcccaacgctgttcccatgagccttgacccttgca

SEQ ID NO: 155610 - DNA, 35 bp, Artificial Sequence
  Synthetic oligonucleotide
acgtgggcctgccggttggctcctggttcctctca

SEQ ID NO: 155611 - DNA, 37 bp, Artificial Sequence
  Synthetic oligonucleotide
gcctccagccgcccgacacgcctacctatatctcaga

SEQ ID NO: 155612 - DNA, 37 bp, Artificial Sequence
  Synthetic oligonucleotide
gtcgtcgcactgccatatcgctcccatgccttttaga

SEQ ID NO: 155613 - DNA, 37 bp, Artificial Sequence
  Synthetic oligonucleotide
ggcgaggccacggtatggggtatcggggggggaagga

SEQ ID NO: 155614 - DNA, 37 bp, Artificial Sequence
  Synthetic oligonucleotide
tccccctccacccagtgtgctactatactttttagga

SEQ ID NO: 155615 - DNA, 37 bp, Artificial Sequence
  Synthetic oligonucleotide
tgagggtgggtgacgcctccgccctctttgggtggga

SEQ ID NO: 155616 - DNA, 37 bp, Artificial Sequence
  Synthetic oligonucleotide
gctgggcttaagtgatgggaggggtcggtccttggga

SEQ ID NO: 155617 - DNA, 36 bp, Artificial Sequence
  Synthetic oligonucleotide
gtggcccttacccttatgcgccctactgccccatga

SEQ ID NO: 155618 - DNA, 38 bp, Artificial Sequence
  Synthetic oligonucleotide
tgaacgggtgtatatggcttaagggcgggcgggtatga

SEQ ID NO: 155619 - DNA, 38 bp, Artificial Sequence
  Synthetic oligonucleotide
acccctcattgtcctatccatgccaccccgtccactga

SEQ ID NO: 155620 - DNA, 38 bp, Artificial Sequence
  Synthetic oligonucleotide
gagtagatcggaggagggggacagggatgtggggctga

SEQ ID NO: 155621 - DNA, 38 bp, Artificial Sequence
  Synthetic oligonucleotide
atcagtgtagcgtgggcgggagtggggggcaggagtga

SEQ ID NO: 155622 - DNA, 38 bp, Artificial Sequence
  Synthetic oligonucleotide
atgcatttcccgccttgtagtttccgtcttctctgtga

SEQ ID NO: 155623 - DNA, 35 bp, Artificial Sequence
  Synthetic oligonucleotide
gaccagggactggtctcatggaacctcccccttga

SEQ ID NO: 155624 - DNA, 37 bp, Artificial Sequence
  Synthetic oligonucleotide
ggagggggggtggggaattgccggcggtcaggcttga

SEQ ID NO: 155625 - DNA, 35 bp, Artificial Sequence
  Synthetic oligonucleotide
tccacctcgcaaccacattagtcgctatttccata

SEQ ID NO: 155626 - DNA, 36 bp, Artificial Sequence
  Synthetic oligonucleotide
acaccatccctccttggtctagaactagtattccta

SEQ ID NO: 155627 - DNA, 35 bp, Artificial Sequence
  Synthetic oligonucleotide
ttgccatcaccttgagctttcgtacttgttttcta

SEQ ID NO: 155628 - DNA, 36 bp, Artificial Sequence
  Synthetic oligonucleotide
gactaggctgtgaaacatggaggggtggaggcggta

SEQ ID NO: 155629 - DNA, 36 bp, Artificial Sequence
  Synthetic oligonucleotide
gaacccgctccaccgaactatgctcccattagggta

SEQ ID NO: 155630 - DNA, 36 bp, Artificial Sequence
  Synthetic oligonucleotide
aagtgacggggtggaaatgaggaagtaaggatggta

SEQ ID NO: 155631 - DNA, 36 bp, Artificial Sequence
  Synthetic oligonucleotide
aacagactgccctcactctcgcctttacacacttta

SEQ ID NO: 155632 - DNA, 35 bp, Artificial Sequence
  Synthetic oligonucleotide
acagtaaggctgccgatctaatctttcgaccacac

SEQ ID NO: 155633 - DNA, 35 bp, Artificial Sequence
  Synthetic oligonucleotide
cccatacctgtctcgtactcgcctgttttatcgcc

SEQ ID NO: 155634 - DNA, 35 bp, Artificial Sequence
  Synthetic oligonucleotide
accgactccccagctctcgctgatactcacgatcc

SEQ ID NO: 155635 - DNA, 35 bp, Artificial Sequence
  Synthetic oligonucleotide
tacatccgtcggtaggtcctctagtgatatcctcc

SEQ ID NO: 155636 - DNA, 35 bp, Artificial Sequence
  Synthetic oligonucleotide
tcctaagagcggtttcagatccccgccctgtctcc

SEQ ID NO: 155637 - DNA, 35 bp, Artificial Sequence
  Synthetic oligonucleotide
tccacctgcccgcctcatgacatttaccacgttcc

SEQ ID NO: 155638 - DNA, 35 bp, Artificial Sequence
  Synthetic oligonucleotide
acacattccttgtcttccgctatgctgcccgttcc

SEQ ID NO: 155639 - DNA, 35 bp, Artificial Sequence
  Synthetic oligonucleotide
cacacccctgcctcgccccctgccgcctccaacgc

SEQ ID NO: 155640 - DNA, 35 bp, Artificial Sequence
  Synthetic oligonucleotide
accatatgcacatccatctcacgaccgttgctgtc

SEQ ID NO: 155641 - DNA, 35 bp, Artificial Sequence
  Synthetic oligonucleotide
gaccccatcactccatgtaaggtattcatcttgtc

SEQ ID NO: 155642 - DNA, 35 bp, Artificial Sequence
  Synthetic oligonucleotide
atgccatctccttgggccctccgatcctgccattc

SEQ ID NO: 155643 - DNA, 35 bp, Artificial Sequence
  Synthetic oligonucleotide
tgtaacatcgaaggtacccctgccgacaccctttc

SEQ ID NO: 155644 - DNA, 35 bp, Artificial Sequence
  Synthetic oligonucleotide
gagtgcatgggggtggtaaggggtagtctgggaag

SEQ ID NO: 155645 - DNA, 35 bp, Artificial Sequence
  Synthetic oligonucleotide
gaaggaacggtggagggagggtacgagtgaaagcg

SEQ ID NO: 155646 - DNA, 35 bp, Artificial Sequence
  Synthetic oligonucleotide
gcacacccgtaatgagtttttctccatccctttcg

SEQ ID NO: 155647 - DNA, 35 bp, Artificial Sequence
  Synthetic oligonucleotide
tcaccacccgccactgcttatacggtcttacaagg

SEQ ID NO: 155648 - DNA, 35 bp, Artificial Sequence
  Synthetic oligonucleotide
tacatcccctcctggctcggccactactactgtgg

SEQ ID NO: 155649 - DNA, 35 bp, Artificial Sequence
  Synthetic oligonucleotide
ccatcgccccctatgctctctgccacgctacactg

SEQ ID NO: 155650 - DNA, 35 bp, Artificial Sequence
  Synthetic oligonucleotide
agcgtaaagtcgtcccccccgtcaccatccgcctg

SEQ ID NO: 155651 - DNA, 35 bp, Artificial Sequence
  Synthetic oligonucleotide
tagctagcccaccacattttcgccccaccaagctg

SEQ ID NO: 155652 - DNA, 35 bp, Artificial Sequence
  Synthetic oligonucleotide
tctacccgtgcgcctgtcccctattttctcgcgtg

SEQ ID NO: 155653 - DNA, 35 bp, Artificial Sequence
  Synthetic oligonucleotide
gaccgcatgttctccgctaggcacctccccttttg

SEQ ID NO: 155654 - DNA, 35 bp, Artificial Sequence
  Synthetic oligonucleotide
tacaggcgcctcgaccctcgctgcaccaccttcat

SEQ ID NO: 155655 - DNA, 35 bp, Artificial Sequence
  Synthetic oligonucleotide
ggttcgccctctgtcccccctgctatcttgctact

SEQ ID NO: 155656 - DNA, 34 bp, Artificial Sequence
  Synthetic oligonucleotide
actgtctccatgcatcctttaagcatctgcccct

SEQ ID NO: 155657 - DNA, 35 bp, Artificial Sequence
  Synthetic oligonucleotide
aaagccgccccccctgtgtccgtttagctcaggct

SEQ ID NO: 155658 - DNA, 35 bp, Artificial Sequence
  Synthetic oligonucleotide
gatccccgtgtcgcttactcctggaataccaatct

SEQ ID NO: 155659 - DNA, 35 bp, Artificial Sequence
  Synthetic oligonucleotide
gaaccatccctcgcgccaaacctatgtatcgttct

SEQ ID NO: 155660 - DNA, 35 bp, Artificial Sequence
  Synthetic oligonucleotide
tcatgtgccctttgtcgacccgtttctccttgagt

SEQ ID NO: 155661 - DNA, 35 bp, Artificial Sequence
  Synthetic oligonucleotide
gtccgactgccgcttcccatccgccgctcgctcgt

SEQ ID NO: 155662 - DNA, 35 bp, Artificial Sequence
  Synthetic oligonucleotide
gatgtcccacatctgttaatcaccgccttataatt

SEQ ID NO: 155663 - DNA, 35 bp, Artificial Sequence
  Synthetic oligonucleotide
tctcagcctttgccgcctttgtcttccagttcatt

SEQ ID NO: 155664 - DNA, 34 bp, Artificial Sequence
  Synthetic oligonucleotide
gccctgcaccccggacgtcgtacgccgctgcctt

SEQ ID NO: 155665 - DNA, 35 bp, Artificial Sequence
  Synthetic oligonucleotide
ttgctccaggccccggttgtttccccttccagctt

SEQ ID NO: 155666 - DNA, 35 bp, Artificial Sequence
  Synthetic oligonucleotide
ggagcaacatccaacccaggccgccctccttgctt

SEQ ID NO: 155667 - DNA, 34 bp, Artificial Sequence
  Synthetic oligonucleotide
tgcgagcctgttcgatccgcaccccggcccattt

SEQ ID NO: 155668 - DNA, 35 bp, Artificial Sequence
  Synthetic oligonucleotide
aatctgcctcccccatcgtctccatactggtcttt

SEQ ID NO: 155669 - DNA, 36 bp, Artificial Sequence
  Synthetic oligonucleotide
gatggggcaaatgatctagaaggaggggaggggcaa

SEQ ID NO: 155670 - DNA, 35 bp, Artificial Sequence
  Synthetic oligonucleotide
gcaaccaatcgtactccgcccccccccgcccagaa

SEQ ID NO: 155671 - DNA, 36 bp, Artificial Sequence
  Synthetic oligonucleotide
tgtgtggggggaggcggaaaagatatcacactagaa

SEQ ID NO: 155672 - DNA, 35 bp, Artificial Sequence
  Synthetic oligonucleotide
acaggtaactggggggcacggggggggcgagggaa

SEQ ID NO: 155673 - DNA, 36 bp, Artificial Sequence
  Synthetic oligonucleotide
tacctccgcccttccgcgttaacttagcgccgctaa

SEQ ID NO: 155674 - DNA, 35 bp, Artificial Sequence
  Synthetic oligonucleotide
gatcgcctgtcctgctaggttacgctcttcaccca

SEQ ID NO: 155675 - DNA, 35 bp, Artificial Sequence
  Synthetic oligonucleotide
acgaccgtgccactaacaccatctgcttcgagcca

SEQ ID NO: 155676 - DNA, 36 bp, Artificial Sequence
  Synthetic oligonucleotide
tcgtatctactgccgccctatcactgccagccgcca

SEQ ID NO: 155677 - DNA, 36 bp, Artificial Sequence
  Synthetic oligonucleotide
tattactgccgtcagttccgccaccgactttccgca

SEQ ID NO: 155678 - DNA, 36 bp, Artificial Sequence
  Synthetic oligonucleotide
tgggccagcaccacgctatgcacgtttctcctctca

SEQ ID NO: 155679 - DNA, 36 bp, Artificial Sequence
  Synthetic oligonucleotide
ttcggagaacgccattaatgctccccacgcccttca

SEQ ID NO: 155680 - DNA, 36 bp, Artificial Sequence
  Synthetic oligonucleotide
tagcaccgaccgccacacctacaccagcctgcttca

SEQ ID NO: 155681 - DNA, 37 bp, Artificial Sequence
  Synthetic oligonucleotide
tagggtggggccgcagagtgtgtattgggagggacga

SEQ ID NO: 155682 - DNA, 36 bp, Artificial Sequence
  Synthetic oligonucleotide
gagtcatgccgggggaagggtgagcagggtgggcga

SEQ ID NO: 155683 - DNA, 38 bp, Artificial Sequence
  Synthetic oligonucleotide
agatccgggaagaagggcgtgtaaaagaagggggcgga

SEQ ID NO: 155684 - DNA, 37 bp, Artificial Sequence
  Synthetic oligonucleotide
ttaaagcgtggggcggaggagggtgcggtttgaggga

SEQ ID NO: 155685 - DNA, 36 bp, Artificial Sequence
  Synthetic oligonucleotide
tgacggggaaaaggggataggggggggcaggtggga

SEQ ID NO: 155686 - DNA, 37 bp, Artificial Sequence
  Synthetic oligonucleotide
ttccactgcaacacctttgtccgcgcacagtcctgga

SEQ ID NO: 155687 - DNA, 38 bp, Artificial Sequence
  Synthetic oligonucleotide
gccttgcaaggggttggggtgtgggagggatgggatga

SEQ ID NO: 155688 - DNA, 36 bp, Artificial Sequence
  Synthetic oligonucleotide
ggaaaagggaggagaagggactggtgcgaagagata

SEQ ID NO: 155689 - DNA, 36 bp, Artificial Sequence
  Synthetic oligonucleotide
tccggccgaccttcacgccccgccaccgccgtacta

SEQ ID NO: 155690 - DNA, 36 bp, Artificial Sequence
  Synthetic oligonucleotide
aagaaagggagtgggggcgggaagcagatcaacgta

SEQ ID NO: 155691 - DNA, 35 bp, Artificial Sequence
  Synthetic oligonucleotide
gtggcgcctcgagtctactccccgctccacactta

SEQ ID NO: 155692 - DNA, 36 bp, Artificial Sequence
  Synthetic oligonucleotide
gttgcccttctctgttgagcccactaaatgccgtta

SEQ ID NO: 155693 - DNA, 35 bp, Artificial Sequence
  Synthetic oligonucleotide
atgccgtgctctccgcgctccttccatgcccgaac

SEQ ID NO: 155694 - DNA, 35 bp, Artificial Sequence
  Synthetic oligonucleotide
ttacccgatcccttgcctgttcatgctcttagcac

SEQ ID NO: 155695 - DNA, 35 bp, Artificial Sequence
  Synthetic oligonucleotide
gcgcctgtcagcccgccgttcgttccgcacctcac

SEQ ID NO: 155696 - DNA, 35 bp, Artificial Sequence
  Synthetic oligonucleotide
tcaccttccttcctccgtagcggtacaggtttgac

SEQ ID NO: 155697 - DNA, 35 bp, Artificial Sequence
  Synthetic oligonucleotide
tcaccttgacccacatagcttccgaaatgcgcacc

SEQ ID NO: 155698 - DNA, 35 bp, Artificial Sequence
  Synthetic oligonucleotide
gcaccgctgacctatcgggtactgctcatctcacc

SEQ ID NO: 155699 - DNA, 35 bp, Artificial Sequence
  Synthetic oligonucleotide
gccgtgctccacatgaccgcagtcctttatgcccc

SEQ ID NO: 155700 - DNA, 35 bp, Artificial Sequence
  Synthetic oligonucleotide
gcgcccgctgcataatccttttagtgcctcttccc

SEQ ID NO: 155701 - DNA, 35 bp, Artificial Sequence
  Synthetic oligonucleotide
tgccacatcactatcgcttcctagtactagccgcc

SEQ ID NO: 155702 - DNA, 35 bp, Artificial Sequence
  Synthetic oligonucleotide
ttacgcgctcatccttgccgtggtgtgatccctcc

SEQ ID NO: 155703 - DNA, 36 bp, Artificial Sequence
  Synthetic oligonucleotide
gtggggggacgcgggggggcaaagtaatagcgatgc

SEQ ID NO: 155704 - DNA, 35 bp, Artificial Sequence
  Synthetic oligonucleotide
gttcgcctcatccttagtaaacgtcacctgtactc

SEQ ID NO: 155705 - DNA, 35 bp, Artificial Sequence
  Synthetic oligonucleotide
gcgtgctccagccctctgttctctcattacgcctc

SEQ ID NO: 155706 - DNA, 35 bp, Artificial Sequence
  Synthetic oligonucleotide
tcactccggacggcatgacacgtgatccccgcctc

SEQ ID NO: 155707 - DNA, 35 bp, Artificial Sequence
  Synthetic oligonucleotide
agtctccaccgaagtttagcccatccagtttgctc

SEQ ID NO: 155708 - DNA, 35 bp, Artificial Sequence
  Synthetic oligonucleotide
gatcgaaaccctcgctagttgttctgcctgttctc

SEQ ID NO: 155709 - DNA, 35 bp, Artificial Sequence
  Synthetic oligonucleotide
gtgccagttcgtcacgtgatttcgcccgtccagtc

SEQ ID NO: 155710 - DNA, 35 bp, Artificial Sequence
  Synthetic oligonucleotide
actctccacatgtccatccctcggtctgttccttc

SEQ ID NO: 155711 - DNA, 35 bp, Artificial Sequence
  Synthetic oligonucleotide
tgccacctccgctcgctaccaatcattgcggtttc

SEQ ID NO: 155712 - DNA, 35 bp, Artificial Sequence
  Synthetic oligonucleotide
tcatcccgtacctctatcgctagtcgcacacctag

SEQ ID NO: 155713 - DNA, 35 bp, Artificial Sequence
  Synthetic oligonucleotide
acgcctccctcccatgtccgcacatcccttccacg

SEQ ID NO: 155714 - DNA, 35 bp, Artificial Sequence
  Synthetic oligonucleotide
tcgcatggccgggtgggtgagcgaagggaaatggg

SEQ ID NO: 155715 - DNA, 35 bp, Artificial Sequence
  Synthetic oligonucleotide
tgcgagacgggatgcttcgggtgggatcgggtaat

SEQ ID NO: 155716 - DNA, 33 bp, Artificial Sequence
  Synthetic oligonucleotide
actactcccgccagccctggacgtacaccatat

SEQ ID NO: 155717 - DNA, 34 bp, Artificial Sequence
  Synthetic oligonucleotide
tcaacgcatgtgaagattcgtcattcgcccccct

SEQ ID NO: 155718 - DNA, 35 bp, Artificial Sequence
  Synthetic oligonucleotide
ttagacagcgcgctcccggtagttctcttgctcct

SEQ ID NO: 155719 - DNA, 35 bp, Artificial Sequence
  Synthetic oligonucleotide
tccttggcctcccttcctccaccgtgtatccagct

SEQ ID NO: 155720 - DNA, 35 bp, Artificial Sequence
  Synthetic oligonucleotide
ggacaccactggtccctctcagtccgcctccaagt

SEQ ID NO: 155721 - DNA, 35 bp, Artificial Sequence
  Synthetic oligonucleotide
gtctcacgtcgcactccaccgtccttaatgggatt

SEQ ID NO: 155722 - DNA, 35 bp, Artificial Sequence
  Synthetic oligonucleotide
gaagccgccctcgcttcgcaattgaatctaccctt

SEQ ID NO: 155723 - DNA, 36 bp, Artificial Sequence
  Synthetic oligonucleotide
tatcgggaggtgggggtggtggtccgggcggttaaa

SEQ ID NO: 155724 - DNA, 36 bp, Artificial Sequence
  Synthetic oligonucleotide
tacctgacgggggggggtaaaatgctggggagggaa

SEQ ID NO: 155725 - DNA, 36 bp, Artificial Sequence
  Synthetic oligonucleotide
tcaccgctgattggcctatcgtgtcgcgccctttaa

SEQ ID NO: 155726 - DNA, 35 bp, Artificial Sequence
  Synthetic oligonucleotide
accgacccatccgaggaggcccttactaatctaca

SEQ ID NO: 155727 - DNA, 36 bp, Artificial Sequence
  Synthetic oligonucleotide
ttccacccacacgcactttcggagcccgccttgcca

SEQ ID NO: 155728 - DNA, 36 bp, Artificial Sequence
  Synthetic oligonucleotide
attggcccgcttggtgcctccgactttctctgtcca

SEQ ID NO: 155729 - DNA, 35 bp, Artificial Sequence
  Synthetic oligonucleotide
tcagaaccaccccaccgcgcccgctgctgagctca

SEQ ID NO: 155730 - DNA, 36 bp, Artificial Sequence
  Synthetic oligonucleotide
gccttcacacgcaatgctgcccatctcccatgctca

SEQ ID NO: 155731 - DNA, 36 bp, Artificial Sequence
  Synthetic oligonucleotide
gagcgcccgtgctctctatttcgccttgtgctctca

SEQ ID NO: 155732 - DNA, 35 bp, Artificial Sequence
  Synthetic oligonucleotide
ttcctccatcagcatctcgtactgggccctgttca

SEQ ID NO: 155733 - DNA, 37 bp, Artificial Sequence
  Synthetic oligonucleotide
tgtagaggacgggtgaacaaaggggtaggatgaaaga

SEQ ID NO: 155734 - DNA, 37 bp, Artificial Sequence
  Synthetic oligonucleotide
tccacgcggcactgcgcaccacctctagcttcccaga

SEQ ID NO: 155735 - DNA, 37 bp, Artificial Sequence
  Synthetic oligonucleotide
gtgacagtcgcagtaaaggatggagagggcaacgaga

SEQ ID NO: 155736 - DNA, 37 bp, Artificial Sequence
  Synthetic oligonucleotide
atcgaacgccggcccctttgttttgtcactatcccga

SEQ ID NO: 155737 - DNA, 37 bp, Artificial Sequence
  Synthetic oligonucleotide
tcagtcatcactatcgtcgtactcgtgccttttccga

SEQ ID NO: 155738 - DNA, 37 bp, Artificial Sequence
  Synthetic oligonucleotide
gcggacacaccgggagaagaggggggaaaggcaagga

SEQ ID NO: 155739 - DNA, 36 bp, Artificial Sequence
  Synthetic oligonucleotide
ggttcgaacggaggggggggaaagggtgggcaagga

SEQ ID NO: 155740 - DNA, 37 bp, Artificial Sequence
  Synthetic oligonucleotide
agtggggggaaaggacggaggaatgcgataaggggga

SEQ ID NO: 155741 - DNA, 37 bp, Artificial Sequence
  Synthetic oligonucleotide
atccgagggctggggatggggtatacggcctggggga

SEQ ID NO: 155742 - DNA, 37 bp, Artificial Sequence
  Synthetic oligonucleotide
atgcgcattcgccccacgccgtcataacttccctgga

SEQ ID NO: 155743 - DNA, 37 bp, Artificial Sequence
  Synthetic oligonucleotide
ggtggctcacgatagggggataagccggggtggtgga

SEQ ID NO: 155744 - DNA, 37 bp, Artificial Sequence
  Synthetic oligonucleotide
ggttcagggtgggtggaggtatggtgggggggaatga

SEQ ID NO: 155745 - DNA, 37 bp, Artificial Sequence
  Synthetic oligonucleotide
gcccatcacccctcccccgtcaagctgtggttactga

SEQ ID NO: 155746 - DNA, 38 bp, Artificial Sequence
  Synthetic oligonucleotide
gagaggggtgggtgcaagtgcggagggacgtagagtga

SEQ ID NO: 155747 - DNA, 36 bp, Artificial Sequence
  Synthetic oligonucleotide
gtcccctcctgcattaagtcgcgccttactgcgtga

SEQ ID NO: 155748 - DNA, 38 bp, Artificial Sequence
  Synthetic oligonucleotide
ggatggggtggagcaaaggagcaagcgcggtgaggtga

SEQ ID NO: 155749 - DNA, 38 bp, Artificial Sequence
  Synthetic oligonucleotide
tttgcacgttgcgcgctccaccttttcgcaccacttga

SEQ ID NO: 155750 - DNA, 37 bp, Artificial Sequence
  Synthetic oligonucleotide
accccacgtcgcccttccaatccttcgcgccacttga

SEQ ID NO: 155751 - DNA, 36 bp, Artificial Sequence
  Synthetic oligonucleotide
gatgggggtaagaaggagggggaacagacaggaata

SEQ ID NO: 155752 - DNA, 35 bp, Artificial Sequence
  Synthetic oligonucleotide
gtacgccacacccgtttacacccctgtgctgccta

SEQ ID NO: 155753 - DNA, 35 bp, Artificial Sequence
  Synthetic oligonucleotide
gtgtctcccctgcttactgctcgcttccttacgta

SEQ ID NO: 155754 - DNA, 35 bp, Artificial Sequence
  Synthetic oligonucleotide
tgccacccctcctaacagtgctcttggtttcctta

SEQ ID NO: 155755 - DNA, 35 bp, Artificial Sequence
  Synthetic oligonucleotide
tccatcggcgcgagctgcttatccgtcgcctgtta

SEQ ID NO: 155756 - DNA, 36 bp, Artificial Sequence
  Synthetic oligonucleotide
tccccgccgacccacaggcctacaatggtacattta

SEQ ID NO: 155757 - DNA, 35 bp, Artificial Sequence
  Synthetic oligonucleotide
gttgtgtatagccactccacccgcatcgcccacac

SEQ ID NO: 155758 - DNA, 35 bp, Artificial Sequence
  Synthetic oligonucleotide
tcacccctcgctcaaacgtttcggatattcctcac

SEQ ID NO: 155759 - DNA, 35 bp, Artificial Sequence
  Synthetic oligonucleotide
acactgtgctccttgctccgtatcgcacctgctac

SEQ ID NO: 155760 - DNA, 35 bp, Artificial Sequence
  Synthetic oligonucleotide
tcgactaccccgctgcctgtcgacccacccggtac

SEQ ID NO: 155761 - DNA, 35 bp, Artificial Sequence
  Synthetic oligonucleotide
attgcaccagcggcttgtgtcgcccttccttgtac

SEQ ID NO: 155762 - DNA, 35 bp, Artificial Sequence
  Synthetic oligonucleotide
tcaacattagagcctgatcccccggacgctcgccc

SEQ ID NO: 155763 - DNA, 35 bp, Artificial Sequence
  Synthetic oligonucleotide
tgaacgtccgacctccgttctgggataccttgccc

SEQ ID NO: 155764 - DNA, 35 bp, Artificial Sequence
  Synthetic oligonucleotide
acgactcccgttccatcccgtgccctccagctccc

SEQ ID NO: 155765 - DNA, 32 bp, Artificial Sequence
  Synthetic oligonucleotide
gtccatacattggttattattagcccccgtcc

SEQ ID NO: 155766 - DNA, 35 bp, Artificial Sequence
  Synthetic oligonucleotide
gtgatcctcgccattattacctaaatagaccttcc

SEQ ID NO: 155767 - DNA, 35 bp, Artificial Sequence
  Synthetic oligonucleotide
gttgcgcattgggccacgtgccttctttgttttcc

SEQ ID NO: 155768 - DNA, 35 bp, Artificial Sequence
  Synthetic oligonucleotide
tttacgtgccgtccctgcttacccctgcacatggc

SEQ ID NO: 155769 - DNA, 35 bp, Artificial Sequence
  Synthetic oligonucleotide
atgctaggggcgggacggtgagggatgcgcgttgc

SEQ ID NO: 155770 - DNA, 35 bp, Artificial Sequence
  Synthetic oligonucleotide
tgagcaccgttcacttgtcgctgttttacctcatc

SEQ ID NO: 155771 - DNA, 35 bp, Artificial Sequence
  Synthetic oligonucleotide
tgccaaagccaccgccggccccagggtactcactc

SEQ ID NO: 155772 - DNA, 34 bp, Artificial Sequence
  Synthetic oligonucleotide
aacgtccaggtgtgaccctcattagccgcccgtc

SEQ ID NO: 155773 - DNA, 35 bp, Artificial Sequence
  Synthetic oligonucleotide
gccaaaccccccatgccccctcgccagtgtccgtc

SEQ ID NO: 155774 - DNA, 36 bp, Artificial Sequence
  Synthetic oligonucleotide
tcccccccgcttggacgatctcactgttcctttgtc

SEQ ID NO: 155775 - DNA, 35 bp, Artificial Sequence
  Synthetic oligonucleotide
ttgtgggcggggggggcgagagcaagggctttttc

SEQ ID NO: 155776 - DNA, 35 bp, Artificial Sequence
  Synthetic oligonucleotide
aagccgcacaggaatcagtaggggggcaaggggag

SEQ ID NO: 155777 - DNA, 35 bp, Artificial Sequence
  Synthetic oligonucleotide
tcaccatacatccatatgcagcccttaatcccgcg

SEQ ID NO: 155778 - DNA, 35 bp, Artificial Sequence
  Synthetic oligonucleotide
tagccacccacagccctcctgccacccggacttgg

SEQ ID NO: 155779 - DNA, 35 bp, Artificial Sequence
  Synthetic oligonucleotide
gccgggcatgaggggggatggaagtgggggctatg

SEQ ID NO: 155780 - DNA, 35 bp, Artificial Sequence
  Synthetic oligonucleotide
acaccggagcgtgcatattatctggtccctccctg

SEQ ID NO: 155781 - DNA, 33 bp, Artificial Sequence
  Synthetic oligonucleotide
ttccacgtagtgggatttatgtgtctccctctg

SEQ ID NO: 155782 - DNA, 35 bp, Artificial Sequence
  Synthetic oligonucleotide
acagcaccgtaccgccccatcttgtgtgtcccgtg

SEQ ID NO: 155783 - DNA, 35 bp, Artificial Sequence
  Synthetic oligonucleotide
gtggggggttggttgaggagggaaaggcggtaaat

SEQ ID NO: 155784 - DNA, 35 bp, Artificial Sequence
  Synthetic oligonucleotide
ggagagacgtgagagggttaggggggttgcgcgat

SEQ ID NO: 155785 - DNA, 35 bp, Artificial Sequence
  Synthetic oligonucleotide
gtcgcaccgacgtgtctactcttattttcgtcact

SEQ ID NO: 155786 - DNA, 35 bp, Artificial Sequence
  Synthetic oligonucleotide
tccaacctcactggagggccccccctcgcccacct

SEQ ID NO: 155787 - DNA, 35 bp, Artificial Sequence
  Synthetic oligonucleotide
aacggacccgcaatagtttaggattccgccaccct

SEQ ID NO: 155788 - DNA, 35 bp, Artificial Sequence
  Synthetic oligonucleotide
acctttggtggccgcatctaatgcccgttactcct

SEQ ID NO: 155789 - DNA, 35 bp, Artificial Sequence
  Synthetic oligonucleotide
tgatggcgcttgctgcctcctgttcccgccgttct

SEQ ID NO: 155790 - DNA, 36 bp, Artificial Sequence
  Synthetic oligonucleotide
gtccccacctcagatcatagccgccgctaacttgtt

SEQ ID NO: 155791 - DNA, 35 bp, Artificial Sequence
  Synthetic oligonucleotide
ttagcacccaactagtgcgcctctgcctgcccttt

SEQ ID NO: 155792 - DNA, 36 bp, Artificial Sequence
  Synthetic oligonucleotide
acatgacgtaggggagggggccaagaacggcgagaa

SEQ ID NO: 155793 - DNA, 36 bp, Artificial Sequence
  Synthetic oligonucleotide
gttgcgccgttccgactgccccctcgcgtaatcaca

SEQ ID NO: 155794 - DNA, 35 bp, Artificial Sequence
  Synthetic oligonucleotide
gtgcatcccaacccatggtttacttcaccacccca

SEQ ID NO: 155795 - DNA, 36 bp, Artificial Sequence
  Synthetic oligonucleotide
agtgcgccctccatcggccggatcgttcactcccca

SEQ ID NO: 155796 - DNA, 36 bp, Artificial Sequence
  Synthetic oligonucleotide
accacaccgccacatgtcccacggaagcaaatccca

SEQ ID NO: 155797 - DNA, 36 bp, Artificial Sequence
  Synthetic oligonucleotide
gccacatgccatttgcttaacacctacgccctgcca

SEQ ID NO: 155798 - DNA, 36 bp, Artificial Sequence
  Synthetic oligonucleotide
taccgttcaagcgtctcaaacgccagcccccctgca

SEQ ID NO: 155799 - DNA, 37 bp, Artificial Sequence
  Synthetic oligonucleotide
ggaggaaggggtggtgtgacggttgtggggcgcaaga

SEQ ID NO: 155800 - DNA, 37 bp, Artificial Sequence
  Synthetic oligonucleotide
agtgggaaacggggaagggcttggagggaatcgaaga

SEQ ID NO: 155801 - DNA, 37 bp, Artificial Sequence
  Synthetic oligonucleotide
gacgagggaaacgatggggaagggccgccgcgtgaga

SEQ ID NO: 155802 - DNA, 37 bp, Artificial Sequence
  Synthetic oligonucleotide
ttgtccgcacccccgaaagcgcatcccatcccgccga

SEQ ID NO: 155803 - DNA, 37 bp, Artificial Sequence
  Synthetic oligonucleotide
tgcctcccttccgaaaccctgagtcacccgtttccga

SEQ ID NO: 155804 - DNA, 37 bp, Artificial Sequence
  Synthetic oligonucleotide
gccgttccctccgccgccgcttcccttcctcgcagga

SEQ ID NO: 155805 - DNA, 37 bp, Artificial Sequence
  Synthetic oligonucleotide
gcacacccgctctcttgttcttccagctgtacgagga

SEQ ID NO: 155806 - DNA, 37 bp, Artificial Sequence
  Synthetic oligonucleotide
ggagggagggtagggggaaggatgcgctacactagga

SEQ ID NO: 155807 - DNA, 37 bp, Artificial Sequence
  Synthetic oligonucleotide
gaaaacgcacggggggaaaacggggccactatatgga

SEQ ID NO: 155808 - DNA, 38 bp, Artificial Sequence
  Synthetic oligonucleotide
gttgcaccacccgaccctatcaccgcatgcccccctga

SEQ ID NO: 155809 - DNA, 38 bp, Artificial Sequence
  Synthetic oligonucleotide
tgcgacccctgccccaacatgtttgaatgccgccgtga

SEQ ID NO: 155810 - DNA, 38 bp, Artificial Sequence
  Synthetic oligonucleotide
gtacaaggtgggaatgcggtaggagggggaaatggtga

SEQ ID NO: 155811 - DNA, 38 bp, Artificial Sequence
  Synthetic oligonucleotide
tgtctaccgccgcatcttcactttcctgccaccattga

SEQ ID NO: 155812 - DNA, 38 bp, Artificial Sequence
  Synthetic oligonucleotide
taggagcggaaccatcgttttggcccgttctcctttga

SEQ ID NO: 155813 - DNA, 37 bp, Artificial Sequence
  Synthetic oligonucleotide
tcgctgtcggtccgcctgttccgtcttccctttttga

SEQ ID NO: 155814 - DNA, 35 bp, Artificial Sequence
  Synthetic oligonucleotide
gacaagatccccccgtccatcgtactctggccata

SEQ ID NO: 155815 - DNA, 36 bp, Artificial Sequence
  Synthetic oligonucleotide
accgcacccacttgcagccccttgcttattacgcta

SEQ ID NO: 155816 - DNA, 36 bp, Artificial Sequence
  Synthetic oligonucleotide
actacgcacgttccatccgctgctttacctgcttta

SEQ ID NO: 155817 - DNA, 35 bp, Artificial Sequence
  Synthetic oligonucleotide
aacaccgaccgtcttttccattatagcttggccac

SEQ ID NO: 155818 - DNA, 35 bp, Artificial Sequence
  Synthetic oligonucleotide
gatggtccagccatactatcgtaacaacattccac

SEQ ID NO: 155819 - DNA, 35 bp, Artificial Sequence
  Synthetic oligonucleotide
actcgccccacatgcctatggggatcaccccgcac

SEQ ID NO: 155820 - DNA, 35 bp, Artificial Sequence
  Synthetic oligonucleotide
gtctccgctatgtggttctcctgtcgcacgtgccc

SEQ ID NO: 155821 - DNA, 35 bp, Artificial Sequence
  Synthetic oligonucleotide
tgtgcatcctgttcgatcacagccactgtttgccc

SEQ ID NO: 155822 - DNA, 35 bp, Artificial Sequence
  Synthetic oligonucleotide
attgctcgatctgcagtacacctgtccgtttatcc

SEQ ID NO: 155823 - DNA, 29 bp, Artificial Sequence
  Synthetic oligonucleotide
atgtgacatctccgccggttcctttctcc

SEQ ID NO: 155824 - DNA, 35 bp, Artificial Sequence
  Synthetic oligonucleotide
ttacttcaccgcacgggtatctctgaactcattcc

SEQ ID NO: 155825 - DNA, 35 bp, Artificial Sequence
  Synthetic oligonucleotide
acctggttgcccatcaggaaaccacgcgaacttcc

SEQ ID NO: 155826 - DNA, 35 bp, Artificial Sequence
  Synthetic oligonucleotide
tccaacaccgcaccccccgcctcgctgctttaggc

SEQ ID NO: 155827 - DNA, 35 bp, Artificial Sequence
  Synthetic oligonucleotide
gaactgctgcctttagtcttttccccgagcctggc

SEQ ID NO: 155828 - DNA, 35 bp, Artificial Sequence
  Synthetic oligonucleotide
accgcaaggcgctcttttcctcccttcgatactgc

SEQ ID NO: 155829 - DNA, 33 bp, Artificial Sequence
  Synthetic oligonucleotide
tgtgttacccagtcgcccccaatatcgctactc

SEQ ID NO: 155830 - DNA, 35 bp, Artificial Sequence
  Synthetic oligonucleotide
acagtcgacgcaaagcgtaacacctgcctctcctc

SEQ ID NO: 155831 - DNA, 35 bp, Artificial Sequence
  Synthetic oligonucleotide
acagcggtgccatcacgtgcctgcgtaacttcctc

SEQ ID NO: 155832 - DNA, 35 bp, Artificial Sequence
  Synthetic oligonucleotide
gtgccgcccacatcctgaacccagcctgatcgctc

SEQ ID NO: 155833 - DNA, 35 bp, Artificial Sequence
  Synthetic oligonucleotide
actgtgctcgcattaacgttgacccgctttccttc

SEQ ID NO: 155834 - DNA, 35 bp, Artificial Sequence
  Synthetic oligonucleotide
acaatgggatcacctccgctgcattatggcctttc

SEQ ID NO: 155835 - DNA, 35 bp, Artificial Sequence
  Synthetic oligonucleotide
gaaccaccgtacgtgcgtgcccaatgccccttttc

SEQ ID NO: 155836 - DNA, 35 bp, Artificial Sequence
  Synthetic oligonucleotide
accgtgccacttctactcgttcttaggtcctttag

SEQ ID NO: 155837 - DNA, 35 bp, Artificial Sequence
  Synthetic oligonucleotide
gtcacctccttactgggtcactacatctttgtccg

SEQ ID NO: 155838 - DNA, 35 bp, Artificial Sequence
  Synthetic oligonucleotide
atgggaagggaagaggtgggtgtgtaaaggccgcg

SEQ ID NO: 155839 - DNA, 35 bp, Artificial Sequence
  Synthetic oligonucleotide
tccccgcccgcctccatcagcccaatctttcggcg

SEQ ID NO: 155840 - DNA, 35 bp, Artificial Sequence
  Synthetic oligonucleotide
tcttacgccccattatgaggtcccgatctacctcg

SEQ ID NO: 155841 - DNA, 35 bp, Artificial Sequence
  Synthetic oligonucleotide
gcacccttcctcaaaaccgtgtttgctcctacctg

SEQ ID NO: 155842 - DNA, 35 bp, Artificial Sequence
  Synthetic oligonucleotide
gatccagcagagttctccgccctttcccccgcctg

SEQ ID NO: 155843 - DNA, 35 bp, Artificial Sequence
  Synthetic oligonucleotide
ttgtgtacacgcgccctcctccgcttacagtggtg

SEQ ID NO: 155844 - DNA, 35 bp, Artificial Sequence
  Synthetic oligonucleotide
gaccatccattgccagaattagcaccattctccat

SEQ ID NO: 155845 - DNA, 35 bp, Artificial Sequence
  Synthetic oligonucleotide
gtagaggggggtggtaggaaaggtattcacggtat

SEQ ID NO: 155846 - DNA, 35 bp, Artificial Sequence
  Synthetic oligonucleotide
tctttatcgcaccactgccctttgagcctcttgct

SEQ ID NO: 155847 - DNA, 35 bp, Artificial Sequence
  Synthetic oligonucleotide
accgctgttgccctgttagttccgcaccacccggt

SEQ ID NO: 155848 - DNA, 35 bp, Artificial Sequence
  Synthetic oligonucleotide
acccatctccccttgtgtgcactaactttcacctt

SEQ ID NO: 155849 - DNA, 35 bp, Artificial Sequence
  Synthetic oligonucleotide
tcacctgcccccgcacattgcggctagaactcctt

SEQ ID NO: 155850 - DNA, 35 bp, Artificial Sequence
  Synthetic oligonucleotide
acactcagctatctggttgccctcccatccatctt

SEQ ID NO: 155851 - DNA, 35 bp, Artificial Sequence
  Synthetic oligonucleotide
gacacgccgtttcgttatttctgtgagtccctgtt

SEQ ID NO: 155852 - DNA, 35 bp, Artificial Sequence
  Synthetic oligonucleotide
tccacactcggccagagatactcccgccccactaa

SEQ ID NO: 155853 - DNA, 35 bp, Artificial Sequence
  Synthetic oligonucleotide
gcacatcgctgttctgcctagggttgctctcttaa

SEQ ID NO: 155854 - DNA, 36 bp, Artificial Sequence
  Synthetic oligonucleotide
taccgctctgctgtttctcgcgccaccatttacaca

SEQ ID NO: 155855 - DNA, 35 bp, Artificial Sequence
  Synthetic oligonucleotide
gttgctcagcctgccgcctcgttaaacccacgcca

SEQ ID NO: 155856 - DNA, 36 bp, Artificial Sequence
  Synthetic oligonucleotide
tacttcgacactgtacgttaatgcctcctcccgcca

SEQ ID NO: 155857 - DNA, 35 bp, Artificial Sequence
  Synthetic oligonucleotide
ttgtgacgtccccctctgcccattgtttcacagca

SEQ ID NO: 155858 - DNA, 35 bp, Artificial Sequence
  Synthetic oligonucleotide
gtctgcccccatgtccgtctcctccacgctgtgca

SEQ ID NO: 155859 - DNA, 36 bp, Artificial Sequence
  Synthetic oligonucleotide
accacctccgcggtcttatcctacagtcccaactca

SEQ ID NO: 155860 - DNA, 36 bp, Artificial Sequence
  Synthetic oligonucleotide
tgtggctccacccggattctagacctgcctttttca

SEQ ID NO: 155861 - DNA, 37 bp, Artificial Sequence
  Synthetic oligonucleotide
tagggccggtgaggtgaggcgggaggaggggggtaga

SEQ ID NO: 155862 - DNA, 37 bp, Artificial Sequence
  Synthetic oligonucleotide
tcatcagttgcaagtactgctcagcccacccccccga

SEQ ID NO: 155863 - DNA, 37 bp, Artificial Sequence
  Synthetic oligonucleotide
gcaacaccgccccactgttatcatcgtaccactccga

SEQ ID NO: 155864 - DNA, 36 bp, Artificial Sequence
  Synthetic oligonucleotide
gcagattgttaggggcgggaagggttaggggggcga

SEQ ID NO: 155865 - DNA, 37 bp, Artificial Sequence
  Synthetic oligonucleotide
atggcctcggcatccttgtttctctagcccccctcga

SEQ ID NO: 155866 - DNA, 37 bp, Artificial Sequence
  Synthetic oligonucleotide
tgcatacaccgtgtgtccatccccccaactccttcga

SEQ ID NO: 155867 - DNA, 37 bp, Artificial Sequence
  Synthetic oligonucleotide
ccatgggaggccgggggttagcggtccttttggggga

SEQ ID NO: 155868 - DNA, 37 bp, Artificial Sequence
  Synthetic oligonucleotide
ttgggtgagaaagagggaaggggggacacagatggga

SEQ ID NO: 155869 - DNA, 37 bp, Artificial Sequence
  Synthetic oligonucleotide
gatcaacagggcgtaattggggaagggggtagtggga

SEQ ID NO: 155870 - DNA, 37 bp, Artificial Sequence
  Synthetic oligonucleotide
tcagccatgcctttctcgtaatcgcgcctcccgtgga

SEQ ID NO: 155871 - DNA, 37 bp, Artificial Sequence
  Synthetic oligonucleotide
tgtcccatccccccgcctggtgtaaagcctctttgga

SEQ ID NO: 155872 - DNA, 38 bp, Artificial Sequence
  Synthetic oligonucleotide
gagacgtcgcgcgagggtgggtggggcgtgggaactga

SEQ ID NO: 155873 - DNA, 37 bp, Artificial Sequence
  Synthetic oligonucleotide
tccgtacgctcctccactgactgtgacaccaccctga

SEQ ID NO: 155874 - DNA, 36 bp, Artificial Sequence
  Synthetic oligonucleotide
gcctcctgctcccttgtaccgaccgttttttcctga

SEQ ID NO: 155875 - DNA, 38 bp, Artificial Sequence
  Synthetic oligonucleotide
accccgctcccaccgtaattgccgccgtgtttccgtga

SEQ ID NO: 155876 - DNA, 38 bp, Artificial Sequence
  Synthetic oligonucleotide
acccgcgcccacatcctccgttgcaccttcgttcgtga

SEQ ID NO: 155877 - DNA, 37 bp, Artificial Sequence
  Synthetic oligonucleotide
gtccactccgcccgtgcctgccgtttttactcggtga

SEQ ID NO: 155878 - DNA, 37 bp, Artificial Sequence
  Synthetic oligonucleotide
gacagacaacaatcgtctagccgctcccccttattga

SEQ ID NO: 155879 - DNA, 37 bp, Artificial Sequence
  Synthetic oligonucleotide
gctggggggctagggaggaacatagggcgggtcttga

SEQ ID NO: 155880 - DNA, 36 bp, Artificial Sequence
  Synthetic oligonucleotide
ataggctgggagggaggggtgcacgggttaacaata

SEQ ID NO: 155881 - DNA, 35 bp, Artificial Sequence
  Synthetic oligonucleotide
taccctcgtcctgtcgtacacgttttcactcccta

SEQ ID NO: 155882 - DNA, 35 bp, Artificial Sequence
  Synthetic oligonucleotide
gtcttgcctttgccccatctctgtcttgccacgta

SEQ ID NO: 155883 - DNA, 36 bp, Artificial Sequence
  Synthetic oligonucleotide
atcgtgccaagccatactccgccgttcccgatcgta

SEQ ID NO: 155884 - DNA, 35 bp, Artificial Sequence
  Synthetic oligonucleotide
gatggaggggagggggagcatcaatgtaggcgcac

SEQ ID NO: 155885 - DNA, 35 bp, Artificial Sequence
  Synthetic oligonucleotide
actgcgcctccgcccgtcctacgccgctacatcac

SEQ ID NO: 155886 - DNA, 35 bp, Artificial Sequence
  Synthetic oligonucleotide
tcagacgcgctcagccttgttgtcgccccattcac

SEQ ID NO: 155887 - DNA, 35 bp, Artificial Sequence
  Synthetic oligonucleotide
accatccgaaatgtactagccgctctcatgcctac

SEQ ID NO: 155888 - DNA, 34 bp, Artificial Sequence
  Synthetic oligonucleotide
tcaccccttcgagtcattacttgctccacgtacc

SEQ ID NO: 155889 - DNA, 35 bp, Artificial Sequence
  Synthetic oligonucleotide
atccaaacaccaccgtccgccgtcgcctaccgccc

SEQ ID NO: 155890 - DNA, 35 bp, Artificial Sequence
  Synthetic oligonucleotide
aagcacgtgcgccgcacagtccatccacgcctccc

SEQ ID NO: 155891 - DNA, 35 bp, Artificial Sequence
  Synthetic oligonucleotide
atggtgcggtcgccccctcgccctccggatacgcc

SEQ ID NO: 155892 - DNA, 35 bp, Artificial Sequence
  Synthetic oligonucleotide
tgccaccatgttttgtgccgcagtatcctcctgcc

SEQ ID NO: 155893 - DNA, 35 bp, Artificial Sequence
  Synthetic oligonucleotide
actgccatcccggccttgctccggacacacgtgcc

SEQ ID NO: 155894 - DNA, 35 bp, Artificial Sequence
  Synthetic oligonucleotide
ggaagccccgtgtccatctcgccacctgtattgcc

SEQ ID NO: 155895 - DNA, 35 bp, Artificial Sequence
  Synthetic oligonucleotide
gcctgcctcgccaccctgacctaaattagcacagc

SEQ ID NO: 155896 - DNA, 35 bp, Artificial Sequence
  Synthetic oligonucleotide
tgtccccccctcctgtgttctaacactctcttagc

SEQ ID NO: 155897 - DNA, 35 bp, Artificial Sequence
  Synthetic oligonucleotide
acgatcacccttcgacgtctttaatgacttcacgc

SEQ ID NO: 155898 - DNA, 35 bp, Artificial Sequence
  Synthetic oligonucleotide
gtctcgcccgacctggcattgccgtctcatttcgc

SEQ ID NO: 155899 - DNA, 35 bp, Artificial Sequence
  Synthetic oligonucleotide
gatgcccacccgatcggtacgaccgaacattttgc

SEQ ID NO: 155900 - DNA, 35 bp, Artificial Sequence
  Synthetic oligonucleotide
tacctccgcccatctctgatacagtctgttacctc

SEQ ID NO: 155901 - DNA, 35 bp, Artificial Sequence
  Synthetic oligonucleotide
gccaacggccttatttgtttttcttattctgcctc

SEQ ID NO: 155902 - DNA, 35 bp, Artificial Sequence
  Synthetic oligonucleotide
gtagcacgtcgtcgttcaccctccttggctttctc

SEQ ID NO: 155903 - DNA, 35 bp, Artificial Sequence
  Synthetic oligonucleotide
gtcaccttccgccagccccttacgacttttgttag

SEQ ID NO: 155904 - DNA, 35 bp, Artificial Sequence
  Synthetic oligonucleotide
gtgttcccgcacacctccttgcttacacatttacg

SEQ ID NO: 155905 - DNA, 35 bp, Artificial Sequence
  Synthetic oligonucleotide
atgagcacctgcaaactcaaagttctatctccccg

SEQ ID NO: 155906 - DNA, 35 bp, Artificial Sequence
  Synthetic oligonucleotide
tcccgcatgtcctcagcgtttttgtctctctgccg

SEQ ID NO: 155907 - DNA, 35 bp, Artificial Sequence
  Synthetic oligonucleotide
tatttgcgccaacctcctgcccgttttttcaatcg

SEQ ID NO: 155908 - DNA, 35 bp, Artificial Sequence
  Synthetic oligonucleotide
ggggggagggaagtaggaagagggtgggccccagg

SEQ ID NO: 155909 - DNA, 35 bp, Artificial Sequence
  Synthetic oligonucleotide
actcatgcccgccccctccgaccctgttttaactg

SEQ ID NO: 155910 - DNA, 35 bp, Artificial Sequence
  Synthetic oligonucleotide
tgcacgccccgcgcacaaatcacaacacgcacctg

SEQ ID NO: 155911 - DNA, 35 bp, Artificial Sequence
  Synthetic oligonucleotide
tctgtcccatctcgcgcccgaccgccatcacgaat

SEQ ID NO: 155912 - DNA, 35 bp, Artificial Sequence
  Synthetic oligonucleotide
tgtcgagcagtctcgctcccttagccgtactccat

SEQ ID NO: 155913 - DNA, 35 bp, Artificial Sequence
  Synthetic oligonucleotide
tgtagggtggtgggggtggcgacacgggtgagcat

SEQ ID NO: 155914 - DNA, 35 bp, Artificial Sequence
  Synthetic oligonucleotide
gcccacactcccttacttcgcgcgctttggcctat

SEQ ID NO: 155915 - DNA, 35 bp, Artificial Sequence
  Synthetic oligonucleotide
gtcgtcctaacgaccgctctcttcctacactctat

SEQ ID NO: 155916 - DNA, 35 bp, Artificial Sequence
  Synthetic oligonucleotide
acgtgtagctcgaatttcctttgccccgttgccct

SEQ ID NO: 155917 - DNA, 35 bp, Artificial Sequence
  Synthetic oligonucleotide
gaacagccagcgttaatggctcccttatcctccct

SEQ ID NO: 155918 - DNA, 35 bp, Artificial Sequence
  Synthetic oligonucleotide
aaccagtccgccgcacgctacctcctgcgttatct

SEQ ID NO: 155919 - DNA, 35 bp, Artificial Sequence
  Synthetic oligonucleotide
agaccgcggtctacgttttatcttacgctccctct

SEQ ID NO: 155920 - DNA, 35 bp, Artificial Sequence
  Synthetic oligonucleotide
gagcaacgctgcccccgtctcgttccaactgttct

SEQ ID NO: 155921 - DNA, 35 bp, Artificial Sequence
  Synthetic oligonucleotide
gaccaccctccgatctgcacacggactctgcgcgt

SEQ ID NO: 155922 - DNA, 35 bp, Artificial Sequence
  Synthetic oligonucleotide
gacctcacagctgccgctattacaccacccatggt

SEQ ID NO: 155923 - DNA, 35 bp, Artificial Sequence
  Synthetic oligonucleotide
tctacaccacacctgtccttaatgccctcgtagtt

SEQ ID NO: 155924 - DNA, 35 bp, Artificial Sequence
  Synthetic oligonucleotide
gcgcacggatatcgttacacccagtcaattccttt

SEQ ID NO: 155925 - DNA, 36 bp, Artificial Sequence
  Synthetic oligonucleotide
tgtgcgtacgcaaggggggcaaggtggtggcaaaaa

SEQ ID NO: 155926 - DNA, 35 bp, Artificial Sequence
  Synthetic oligonucleotide
atcccatgccctatgtctcagtgctctccatcaaa

SEQ ID NO: 155927 - DNA, 35 bp, Artificial Sequence
  Synthetic oligonucleotide
tatgctgaaggagggagggtgggcctgaaggtaaa

SEQ ID NO: 155928 - DNA, 36 bp, Artificial Sequence
  Synthetic oligonucleotide
acgcccccctgcacttttaggatcgccctctgacaa

SEQ ID NO: 155929 - DNA, 35 bp, Artificial Sequence
  Synthetic oligonucleotide
gtcccccgatagcttgcatgaacacccgcgcccaa

SEQ ID NO: 155930 - DNA, 35 bp, Artificial Sequence
  Synthetic oligonucleotide
gcacaccgtccgccttcggctccacctcgtatcaa

SEQ ID NO: 155931 - DNA, 35 bp, Artificial Sequence
  Synthetic oligonucleotide
tttgcgttactgcccttagtccggttccaccccca

SEQ ID NO: 155932 - DNA, 35 bp, Artificial Sequence
  Synthetic oligonucleotide
gattcccccccccgtatcgctgccatgatccgcca

SEQ ID NO: 155933 - DNA, 36 bp, Artificial Sequence
  Synthetic oligonucleotide
aacacgtctgacgtccactttttcatccgccccgca

SEQ ID NO: 155934 - DNA, 33 bp, Artificial Sequence
  Synthetic oligonucleotide
acaccccccgtttgaactgacttagtccgtgca

SEQ ID NO: 155935 - DNA, 35 bp, Artificial Sequence
  Synthetic oligonucleotide
atgcacttccagacgacccacccttctccgcctca

SEQ ID NO: 155936 - DNA, 37 bp, Artificial Sequence
  Synthetic oligonucleotide
gtttggggggggagacaagggaaaggcgtttggcaga

SEQ ID NO: 155937 - DNA, 37 bp, Artificial Sequence
  Synthetic oligonucleotide
atgggggggaacgaaagggagggcgacgggagagaga

SEQ ID NO: 155938 - DNA, 37 bp, Artificial Sequence
  Synthetic oligonucleotide
ggacaaggggggggcaaaggagtgggcctgccggaga

SEQ ID NO: 155939 - DNA, 37 bp, Artificial Sequence
  Synthetic oligonucleotide
tccagcgaacttgactcacgctgtccactcctcccga

SEQ ID NO: 155940 - DNA, 36 bp, Artificial Sequence
  Synthetic oligonucleotide
gccgccacctccgaccagcactgttccacgtcccga

SEQ ID NO: 155941 - DNA, 37 bp, Artificial Sequence
  Synthetic oligonucleotide
tttacgcactgccatcgtcccgccctctcttggccga

SEQ ID NO: 155942 - DNA, 35 bp, Artificial Sequence
  Synthetic oligonucleotide
agcccctccgccctctttgagccgattattggcga

SEQ ID NO: 155943 - DNA, 37 bp, Artificial Sequence
  Synthetic oligonucleotide
gtcaccctccctttcttgctgaaggtcaagtcctcga

SEQ ID NO: 155944 - DNA, 37 bp, Artificial Sequence
  Synthetic oligonucleotide
gtgtccccgtgcgcaccctcgcctcccttgtaaagga

SEQ ID NO: 155945 - DNA, 36 bp, Artificial Sequence
  Synthetic oligonucleotide
gagaagtagcggggggacgggtgtgaaagggtagga

SEQ ID NO: 155946 - DNA, 36 bp, Artificial Sequence
  Synthetic oligonucleotide
gttgggagggtgcggtgggcgtatatatgtgaggga

SEQ ID NO: 155947 - DNA, 37 bp, Artificial Sequence
  Synthetic oligonucleotide
gggggacccaatccgggagggaacagcttcctcggga

SEQ ID NO: 155948 - DNA, 36 bp, Artificial Sequence
  Synthetic oligonucleotide
gaaagggagggaggggtagatacgagctcttcggga

SEQ ID NO: 155949 - DNA, 36 bp, Artificial Sequence
  Synthetic oligonucleotide
ggggagtgtttgtagcgtaggggggggagttgggga

SEQ ID NO: 155950 - DNA, 38 bp, Artificial Sequence
  Synthetic oligonucleotide
ggaacgggggaaagggggtagggcacagcccgggctga

SEQ ID NO: 155951 - DNA, 38 bp, Artificial Sequence
  Synthetic oligonucleotide
tgcccacggtctgatcgttccattcgttcaccatctga

SEQ ID NO: 155952 - DNA, 35 bp, Artificial Sequence
  Synthetic oligonucleotide
taatcgccctcctcctagatcgtgccgttctctga

SEQ ID NO: 155953 - DNA, 38 bp, Artificial Sequence
  Synthetic oligonucleotide
cgcgcgttacattcagcatccaccgtccgtccttctga

SEQ ID NO: 155954 - DNA, 36 bp, Artificial Sequence
  Synthetic oligonucleotide
gaggtggaggtggttgcggggctgtagggggagtga

SEQ ID NO: 155955 - DNA, 37 bp, Artificial Sequence
  Synthetic oligonucleotide
gttgggaggagggatcaggggggatagcacactgtga

SEQ ID NO: 155956 - DNA, 38 bp, Artificial Sequence
  Synthetic oligonucleotide
gggattgggcgggggggcgtgaagcagtacagttgtga

SEQ ID NO: 155957 - DNA, 37 bp, Artificial Sequence
  Synthetic oligonucleotide
accatcaccattggttgtagcctcatccctctcttga

SEQ ID NO: 155958 - DNA, 37 bp, Artificial Sequence
  Synthetic oligonucleotide
ttcccgccttggtgtttcgtcctctgctccattttga

SEQ ID NO: 155959 - DNA, 35 bp, Artificial Sequence
  Synthetic oligonucleotide
tacatccccgctgcgcagctcaccatttcctcgta

SEQ ID NO: 155960 - DNA, 35 bp, Artificial Sequence
  Synthetic oligonucleotide
gtgtcccgaatcatgcatgcgtaatccatctgcac

SEQ ID NO: 155961 - DNA, 35 bp, Artificial Sequence
  Synthetic oligonucleotide
acaccccgcgaccactcgtcttcatagcgttgcac

SEQ ID NO: 155962 - DNA, 35 bp, Artificial Sequence
  Synthetic oligonucleotide
ttcacgcctcctcttgctctgcccaacgacgggac

SEQ ID NO: 155963 - DNA, 35 bp, Artificial Sequence
  Synthetic oligonucleotide
accgatcccgccaactaatccatttgacctgtgac

SEQ ID NO: 155964 - DNA, 35 bp, Artificial Sequence
  Synthetic oligonucleotide
agttcagccgcctcgctgcagacctacccccgtac

SEQ ID NO: 155965 - DNA, 35 bp, Artificial Sequence
  Synthetic oligonucleotide
gccccccccggtcggacgttcttccatgtacaacc

SEQ ID NO: 155966 - DNA, 35 bp, Artificial Sequence
  Synthetic oligonucleotide
gagcgacggtagaattgtctctgctcccatccacc

SEQ ID NO: 155967 - DNA, 30 bp, Artificial Sequence
  Synthetic oligonucleotide
ttaacacaaccgactatctatagcctcacc

SEQ ID NO: 155968 - DNA, 35 bp, Artificial Sequence
  Synthetic oligonucleotide
gcatcatctcacctggcccctgcttttggcgtacc

SEQ ID NO: 155969 - DNA, 35 bp, Artificial Sequence
  Synthetic oligonucleotide
ggaaccaaagcgtccagtcgccccccctagtgccc

SEQ ID NO: 155970 - DNA, 34 bp, Artificial Sequence
  Synthetic oligonucleotide
gtcccatcatcacttgccttgacgactgcctccc

SEQ ID NO: 155971 - DNA, 35 bp, Artificial Sequence
  Synthetic oligonucleotide
tttgcgcgttgttctatgcccttattcgccactcc

SEQ ID NO: 155972 - DNA, 35 bp, Artificial Sequence
  Synthetic oligonucleotide
tgtttctggtcatagttccttgcggtccgtactcc

SEQ ID NO: 155973 - DNA, 35 bp, Artificial Sequence
  Synthetic oligonucleotide
gttgtcactcccctcatcatgtcatcgccccttcc

SEQ ID NO: 155974 - DNA, 35 bp, Artificial Sequence
  Synthetic oligonucleotide
gaccatgtcccctcggaatctgcgcccgactttcc

SEQ ID NO: 155975 - DNA, 35 bp, Artificial Sequence
  Synthetic oligonucleotide
tacgcaccggttgtctcttccatggttcgatccgc

SEQ ID NO: 155976 - DNA, 34 bp, Artificial Sequence
  Synthetic oligonucleotide
tttgaaccggtggtcgcctcccactcctttccgc

SEQ ID NO: 155977 - DNA, 35 bp, Artificial Sequence
  Synthetic oligonucleotide
tcacctctccaccgctgcctcatagccgtctaggc

SEQ ID NO: 155978 - DNA, 35 bp, Artificial Sequence
  Synthetic oligonucleotide
gattcagctcacctcagacacctcctacctccggc

SEQ ID NO: 155979 - DNA, 35 bp, Artificial Sequence
  Synthetic oligonucleotide
tgcacatgcgcttcacttcgcccgtaccctgttgc

SEQ ID NO: 155980 - DNA, 35 bp, Artificial Sequence
  Synthetic oligonucleotide
gtaggccattcaggcgcatccccaacttccccctc

SEQ ID NO: 155981 - DNA, 35 bp, Artificial Sequence
  Synthetic oligonucleotide
accacttgcccgccgaacagttcggaatccttgtc

SEQ ID NO: 155982 - DNA, 35 bp, Artificial Sequence
  Synthetic oligonucleotide
gcctccgctagcttgtgtggcttacttcaccgttc

SEQ ID NO: 155983 - DNA, 35 bp, Artificial Sequence
  Synthetic oligonucleotide
gtacccggtcctcctctatagctggtcctcatttc

SEQ ID NO: 155984 - DNA, 35 bp, Artificial Sequence
  Synthetic oligonucleotide
tagaaccccgtcctagccccagcccgagccccacg

SEQ ID NO: 155985 - DNA, 35 bp, Artificial Sequence
  Synthetic oligonucleotide
tacagctgccacgaagccgtttacctcaattcccg

SEQ ID NO: 155986 - DNA, 34 bp, Artificial Sequence
  Synthetic oligonucleotide
tacgccctcctaccctcactgtgtttttttcatg

SEQ ID NO: 155987 - DNA, 35 bp, Artificial Sequence
  Synthetic oligonucleotide
tgccccgcacacactttcagtaatccctatccctg

SEQ ID NO: 155988 - DNA, 35 bp, Artificial Sequence
  Synthetic oligonucleotide
attcaccctcctctgcgtctccctattatggcctg

SEQ ID NO: 155989 - DNA, 35 bp, Artificial Sequence
  Synthetic oligonucleotide
tctcggtcacttggttcttccgcatctcgttcctg

SEQ ID NO: 155990 - DNA, 35 bp, Artificial Sequence
  Synthetic oligonucleotide
acacccccgcgccctgcgatctgttgcacccgaat

SEQ ID NO: 155991 - DNA, 35 bp, Artificial Sequence
  Synthetic oligonucleotide
cacactcccctgtcatcgcgaactacgccgcccct

SEQ ID NO: 155992 - DNA, 35 bp, Artificial Sequence
  Synthetic oligonucleotide
tgaccccctcctattagtccatccgttctaggcct

SEQ ID NO: 155993 - DNA, 35 bp, Artificial Sequence
  Synthetic oligonucleotide
aaccgagctggtgtccacggccatccctattcgct

SEQ ID NO: 155994 - DNA, 35 bp, Artificial Sequence
  Synthetic oligonucleotide
acttgacgccccaagttcccaatgcctgactatct

SEQ ID NO: 155995 - DNA, 35 bp, Artificial Sequence
  Synthetic oligonucleotide
tcgtgcaacctgcctccctcccagcgtgcacttct

SEQ ID NO: 155996 - DNA, 35 bp, Artificial Sequence
  Synthetic oligonucleotide
taccctccccccagatgcctacgaaagctatgcgt

SEQ ID NO: 155997 - DNA, 35 bp, Artificial Sequence
  Synthetic oligonucleotide
ggaacccccgccgaaagccctcacgccacactatt

SEQ ID NO: 155998 - DNA, 35 bp, Artificial Sequence
  Synthetic oligonucleotide
ttccgtcctcccgcagcgatccttggagggccctt

SEQ ID NO: 155999 - DNA, 35 bp, Artificial Sequence
  Synthetic oligonucleotide
ttgtcaccctgtcctcagctctacgtgcgcttgtt

SEQ ID NO: 156000 - DNA, 36 bp, Artificial Sequence
  Synthetic oligonucleotide
ggagaccagcagaggtggtaaagggagggggaataa

SEQ ID NO: 156001 - DNA, 36 bp, Artificial Sequence
  Synthetic oligonucleotide
aacgccacttctacctcgctatatgctgggccccca

SEQ ID NO: 156002 - DNA, 36 bp, Artificial Sequence
  Synthetic oligonucleotide
tgatcagggagacgggggtatgaaggggccgggcca

SEQ ID NO: 156003 - DNA, 36 bp, Artificial Sequence
  Synthetic oligonucleotide
taccaccgacgggcgatgtccctgccgccgcctcca

SEQ ID NO: 156004 - DNA, 35 bp, Artificial Sequence
  Synthetic oligonucleotide
tccccgggccactggttcgttgaggtctcgctcca

SEQ ID NO: 156005 - DNA, 35 bp, Artificial Sequence
  Synthetic oligonucleotide
tacgtgacaccggcgaaatgtctctcacctgtcca

SEQ ID NO: 156006 - DNA, 36 bp, Artificial Sequence
  Synthetic oligonucleotide
agcggaacacgcgatcgtactctgcccgtccttcca

SEQ ID NO: 156007 - DNA, 35 bp, Artificial Sequence
  Synthetic oligonucleotide
tcacgccgcatttcgttacttctcttcctgtatca

SEQ ID NO: 156008 - DNA, 35 bp, Artificial Sequence
  Synthetic oligonucleotide
tgctccgtcgctagcttgctgccatcggtccttca

SEQ ID NO: 156009 - DNA, 36 bp, Artificial Sequence
  Synthetic oligonucleotide
gtttggcccctccccttgtacttccgatacctttca

SEQ ID NO: 156010 - DNA, 37 bp, Artificial Sequence
  Synthetic oligonucleotide
cacacccctccgcttgccgttcacgttctcttccaga

SEQ ID NO: 156011 - DNA, 37 bp, Artificial Sequence
  Synthetic oligonucleotide
atgcgacgcgagactgggggggtcgggtgaggctaga

SEQ ID NO: 156012 - DNA, 37 bp, Artificial Sequence
  Synthetic oligonucleotide
acgggcggtaggtcgggggcgggtggcggtggcccga

SEQ ID NO: 156013 - DNA, 37 bp, Artificial Sequence
  Synthetic oligonucleotide
ggaatccagccccacatctacctatatgccctcccga

SEQ ID NO: 156014 - DNA, 37 bp, Artificial Sequence
  Synthetic oligonucleotide
tgcctcatccctgttgcgtttaacccctccatatcga

SEQ ID NO: 156015 - DNA, 36 bp, Artificial Sequence
  Synthetic oligonucleotide
gatcctctgccatcctgtttggatttccaccctcga

SEQ ID NO: 156016 - DNA, 36 bp, Artificial Sequence
  Synthetic oligonucleotide
tgatcgcccacttgacttctatcgattcgtcttcga

SEQ ID NO: 156017 - DNA, 36 bp, Artificial Sequence
  Synthetic oligonucleotide
tagagcgggtggtgagggtggggggaacagaacgga

SEQ ID NO: 156018 - DNA, 36 bp, Artificial Sequence
  Synthetic oligonucleotide
agtatgggcagagggggaaaaggctgattgggcgga

SEQ ID NO: 156019 - DNA, 37 bp, Artificial Sequence
  Synthetic oligonucleotide
gctggggtggtgggaatacacataggcgaaggaggga

SEQ ID NO: 156020 - DNA, 36 bp, Artificial Sequence
  Synthetic oligonucleotide
ggggcgggcatcggggtattgttcggtgcgggggga

SEQ ID NO: 156021 - DNA, 37 bp, Artificial Sequence
  Synthetic oligonucleotide
gatccacgtgagtgcgctctctgtctcctgttcctga

SEQ ID NO: 156022 - DNA, 37 bp, Artificial Sequence
  Synthetic oligonucleotide
agacgatgcgcagtagtctccccaccccgtttcctga

SEQ ID NO: 156023 - DNA, 38 bp, Artificial Sequence
  Synthetic oligonucleotide
tgcattgcccctactgcaccggccactttcctttctga

SEQ ID NO: 156024 - DNA, 37 bp, Artificial Sequence
  Synthetic oligonucleotide
gctcggggagggggcataggagaggacccggccgtga

SEQ ID NO: 156025 - DNA, 38 bp, Artificial Sequence
  Synthetic oligonucleotide
tgcaggggtgcggtggtggccaatggggaagggcgtga

SEQ ID NO: 156026 - DNA, 38 bp, Artificial Sequence
  Synthetic oligonucleotide
aatggagagggcgaggtggcggtggcgggagacattga

SEQ ID NO: 156027 - DNA, 38 bp, Artificial Sequence
  Synthetic oligonucleotide
tgctgcttagctataccgaagccaccccctttccttga

SEQ ID NO: 156028 - DNA, 38 bp, Artificial Sequence
  Synthetic oligonucleotide
tcaccgaggcagtgttaatattgccgccctcttcttga

SEQ ID NO: 156029 - DNA, 37 bp, Artificial Sequence
  Synthetic oligonucleotide
ttcacctccattgtcgtcacaggtaccccccgtttga

SEQ ID NO: 156030 - DNA, 35 bp, Artificial Sequence
  Synthetic oligonucleotide
gcacagcccatagctggacactctccttcattcta

SEQ ID NO: 156031 - DNA, 35 bp, Artificial Sequence
  Synthetic oligonucleotide
gcggggggtagggggagggaagatacagtcttcta

SEQ ID NO: 156032 - DNA, 35 bp, Artificial Sequence
  Synthetic oligonucleotide
gggtcaagtaaggggaagggttcaggcgggaatta

SEQ ID NO: 156033 - DNA, 36 bp, Artificial Sequence
  Synthetic oligonucleotide
accgatcctgccctgttcgaaagtatcacaccctta

SEQ ID NO: 156034 - DNA, 36 bp, Artificial Sequence
  Synthetic oligonucleotide
gcacacgctatatcttcccccgcgtacatgttctta

SEQ ID NO: 156035 - DNA, 35 bp, Artificial Sequence
  Synthetic oligonucleotide
ttgtgcgtccgcccttcctggtcttatccccgtta

SEQ ID NO: 156036 - DNA, 35 bp, Artificial Sequence
  Synthetic oligonucleotide
gaatgagctccatcgtgatacctggccccccaacc

SEQ ID NO: 156037 - DNA, 35 bp, Artificial Sequence
  Synthetic oligonucleotide
tcacgccccttctccagcgattattggcacacacc

SEQ ID NO: 156038 - DNA, 35 bp, Artificial Sequence
  Synthetic oligonucleotide
gtgcccccacgccctggtggccaactcgtaccccc

SEQ ID NO: 156039 - DNA, 32 bp, Artificial Sequence
  Synthetic oligonucleotide
gcacaccctccagcggtcgcatcgctctcccc

SEQ ID NO: 156040 - DNA, 35 bp, Artificial Sequence
  Synthetic oligonucleotide
ctcaccatctcgtctttacctcctactccgggtcc

SEQ ID NO: 156041 - DNA, 35 bp, Artificial Sequence
  Synthetic oligonucleotide
ggatccggcggtcgtaaacttgccgtctttcttcc

SEQ ID NO: 156042 - DNA, 35 bp, Artificial Sequence
  Synthetic oligonucleotide
gcgatgcaccggttgtaccatcctgctcttctagc

SEQ ID NO: 156043 - DNA, 35 bp, Artificial Sequence
  Synthetic oligonucleotide
aaacccctgactcgccctgaccgctccacacgcgc

SEQ ID NO: 156044 - DNA, 35 bp, Artificial Sequence
  Synthetic oligonucleotide
tgccacaccctgctgctttggtcctcccgataggc

SEQ ID NO: 156045 - DNA, 35 bp, Artificial Sequence
  Synthetic oligonucleotide
aaggggaagtcaagaaggttggagggcgggagggc

SEQ ID NO: 156046 - DNA, 35 bp, Artificial Sequence
  Synthetic oligonucleotide
accaggcgattagccgcgtacgccccacaccgtgc

SEQ ID NO: 156047 - DNA, 35 bp, Artificial Sequence
  Synthetic oligonucleotide
gtcgtgcccctgtccctgccttttacagtttgtgc

SEQ ID NO: 156048 - DNA, 35 bp, Artificial Sequence
  Synthetic oligonucleotide
atagccaccaccttcacggattaagttccgcttgc

SEQ ID NO: 156049 - DNA, 35 bp, Artificial Sequence
  Synthetic oligonucleotide
agatccaccccgtcactggcattcttccaatactc

SEQ ID NO: 156050 - DNA, 35 bp, Artificial Sequence
  Synthetic oligonucleotide
agctggagctccgattcacgccctccgacgtcctc

SEQ ID NO: 156051 - DNA, 35 bp, Artificial Sequence
  Synthetic oligonucleotide
aaactggacctcccccgctggcacgctacgctgtc

SEQ ID NO: 156052 - DNA, 35 bp, Artificial Sequence
  Synthetic oligonucleotide
atcccccccgcccacctgatgggcagtatcgcttc

SEQ ID NO: 156053 - DNA, 35 bp, Artificial Sequence
  Synthetic oligonucleotide
tattgaacgaaagacaagggggaggcggagggacg

SEQ ID NO: 156054 - DNA, 35 bp, Artificial Sequence
  Synthetic oligonucleotide
gtgcgtaacctcgcggcctgtaatatcctcccccg

SEQ ID NO: 156055 - DNA, 35 bp, Artificial Sequence
  Synthetic oligonucleotide
acgctccctgtccctgccgatcctaattttcttcg

SEQ ID NO: 156056 - DNA, 35 bp, Artificial Sequence
  Synthetic oligonucleotide
tgactcctcaacacggttacccctcgccgctaagg

SEQ ID NO: 156057 - DNA, 35 bp, Artificial Sequence
  Synthetic oligonucleotide
gccagtggggggggtggggaagtaactgaggcggg

SEQ ID NO: 156058 - DNA, 35 bp, Artificial Sequence
  Synthetic oligonucleotide
tggggtggtaggagaggattaagggagtcgagggg

SEQ ID NO: 156059 - DNA, 35 bp, Artificial Sequence
  Synthetic oligonucleotide
ttgctgctatgcatatctacttctccactccctgg

SEQ ID NO: 156060 - DNA, 35 bp, Artificial Sequence
  Synthetic oligonucleotide
catcctccgctgtgccgctcttaccaccactcgtg

SEQ ID NO: 156061 - DNA, 35 bp, Artificial Sequence
  Synthetic oligonucleotide
gtgacatcttgcgctgcccttcttcctcactgttg

SEQ ID NO: 156062 - DNA, 35 bp, Artificial Sequence
  Synthetic oligonucleotide
gcacggtcataccgcttatgagcccgtctccacct

SEQ ID NO: 156063 - DNA, 35 bp, Artificial Sequence
  Synthetic oligonucleotide
gagcgccagaggcgtgcctctactccccgtcccct

SEQ ID NO: 156064 - DNA, 35 bp, Artificial Sequence
  Synthetic oligonucleotide
acgaccctcacagcttaataaacgcatctgcctct

SEQ ID NO: 156065 - DNA, 35 bp, Artificial Sequence
  Synthetic oligonucleotide
gtgcatgctcctatccggctaacaggcacccttct

SEQ ID NO: 156066 - DNA, 35 bp, Artificial Sequence
  Synthetic oligonucleotide
gcaccaccattcgcatccacccgtgccctgtcggt

SEQ ID NO: 156067 - DNA, 35 bp, Artificial Sequence
  Synthetic oligonucleotide
tgagtccgccccctcctgcttacattctggaatgt

SEQ ID NO: 156068 - DNA, 35 bp, Artificial Sequence
  Synthetic oligonucleotide
gatgctaggcgtcccattcttaccacccatgtctt

SEQ ID NO: 156069 - DNA, 35 bp, Artificial Sequence
  Synthetic oligonucleotide
tgcccccagtccgcgccccgcattcgcgccaattt

SEQ ID NO: 156070 - DNA, 36 bp, Artificial Sequence
  Synthetic oligonucleotide
gcaagatggactaggtgaacacggggaagggggcaa

SEQ ID NO: 156071 - DNA, 34 bp, Artificial Sequence
  Synthetic oligonucleotide
gaccatgcgcccgagccccacgtgtcccccgtaa

SEQ ID NO: 156072 - DNA, 36 bp, Artificial Sequence
  Synthetic oligonucleotide
gtcatccatcaacagcgattaagccgcctccataca

SEQ ID NO: 156073 - DNA, 36 bp, Artificial Sequence
  Synthetic oligonucleotide
ttaccatcgcagttagtcattcccccgcggttacca

SEQ ID NO: 156074 - DNA, 36 bp, Artificial Sequence
  Synthetic oligonucleotide
accgcgaccactccccccacctgcgcccgtagccca

SEQ ID NO: 156075 - DNA, 35 bp, Artificial Sequence
  Synthetic oligonucleotide
gagacaggagctccgccgccacttttcccctcgca

SEQ ID NO: 156076 - DNA, 36 bp, Artificial Sequence
  Synthetic oligonucleotide
gtccctcaccttagttgttctagtttcgcctgttca

SEQ ID NO: 156077 - DNA, 37 bp, Artificial Sequence
  Synthetic oligonucleotide
ggggtaggaagcagaagggggggcaatcagagtcaga

SEQ ID NO: 156078 - DNA, 37 bp, Artificial Sequence
  Synthetic oligonucleotide
ggatccatctgcctgccgtattaccttgcctacgaga

SEQ ID NO: 156079 - DNA, 37 bp, Artificial Sequence
  Synthetic oligonucleotide
gcgaacaggggtggagcaaaaaaggttaggtgtgaga

SEQ ID NO: 156080 - DNA, 37 bp, Artificial Sequence
  Synthetic oligonucleotide
aacgacacgcgcctcgactctagcacccctcttccga

SEQ ID NO: 156081 - DNA, 37 bp, Artificial Sequence
  Synthetic oligonucleotide
tgaccgtgccacacgcgcgactatttccgcctctcga

SEQ ID NO: 156082 - DNA, 37 bp, Artificial Sequence
  Synthetic oligonucleotide
gtggggagggagaattgaaggggagacatgtggggga

SEQ ID NO: 156083 - DNA, 37 bp, Artificial Sequence
  Synthetic oligonucleotide
accaccaccccccgcacgtcccagctttatacatgga

SEQ ID NO: 156084 - DNA, 37 bp, Artificial Sequence
  Synthetic oligonucleotide
acgaaggccacaccggccccacgctactccacctgga

SEQ ID NO: 156085 - DNA, 37 bp, Artificial Sequence
  Synthetic oligonucleotide
gtcattccccatgctaacgtggcgcctcttccttgga

SEQ ID NO: 156086 - DNA, 37 bp, Artificial Sequence
  Synthetic oligonucleotide
ggggggaccgtagggggcaattgaggcgggaatatga

SEQ ID NO: 156087 - DNA, 36 bp, Artificial Sequence
  Synthetic oligonucleotide
gcgttagggggtggtggactatagggaagggggtga

SEQ ID NO: 156088 - DNA, 35 bp, Artificial Sequence
  Synthetic oligonucleotide
gacacgagtcgggtctcgcctgcacttctccttga

SEQ ID NO: 156089 - DNA, 37 bp, Artificial Sequence
  Synthetic oligonucleotide
tctgacccttgtccatgtctttcgcctgatttcttga

SEQ ID NO: 156090 - DNA, 37 bp, Artificial Sequence
  Synthetic oligonucleotide
tgtcgagaggcgcaggaggaggaagggtgattgttga

SEQ ID NO: 156091 - DNA, 35 bp, Artificial Sequence
  Synthetic oligonucleotide
tccatttgcctccactgaagtatactccagcccac

SEQ ID NO: 156092 - DNA, 35 bp, Artificial Sequence
  Synthetic oligonucleotide
gagacacttcgaagtctaccatgcttcacctccac

SEQ ID NO: 156093 - DNA, 35 bp, Artificial Sequence
  Synthetic oligonucleotide
actctcactcacggttctttaactctgacttccac

SEQ ID NO: 156094 - DNA, 35 bp, Artificial Sequence
  Synthetic oligonucleotide
gtcagtcgcccccgtacacgtttacctgcataacc

SEQ ID NO: 156095 - DNA, 35 bp, Artificial Sequence
  Synthetic oligonucleotide
gtcgtaccgctccaaccgcgaacgtgacattcacc

SEQ ID NO: 156096 - DNA, 34 bp, Artificial Sequence
  Synthetic oligonucleotide
gacactccgatcggacgctttaaaaccactcccc

SEQ ID NO: 156097 - DNA, 35 bp, Artificial Sequence
  Synthetic oligonucleotide
gcacataccccgccctctaccgcgtaatatcagcc

SEQ ID NO: 156098 - DNA, 35 bp, Artificial Sequence
  Synthetic oligonucleotide
taaccacagattcttcattgtgcctcgtttcctcc

SEQ ID NO: 156099 - DNA, 35 bp, Artificial Sequence
  Synthetic oligonucleotide
atagctgcagctgctcgaattcaccccctcgtcgc

SEQ ID NO: 156100 - DNA, 35 bp, Artificial Sequence
  Synthetic oligonucleotide
gggccccccctgctcactcctgtgctccgcccggc

SEQ ID NO: 156101 - DNA, 35 bp, Artificial Sequence
  Synthetic oligonucleotide
gtagccttctaagaccctcgctttataccccgtgc

SEQ ID NO: 156102 - DNA, 35 bp, Artificial Sequence
  Synthetic oligonucleotide
acgaagccattggcattgcttctcgttaccccatc

SEQ ID NO: 156103 - DNA, 35 bp, Artificial Sequence
  Synthetic oligonucleotide
gatcttcgcccaccatgcatagttaggccgccatc

SEQ ID NO: 156104 - DNA, 35 bp, Artificial Sequence
  Synthetic oligonucleotide
atgcacaactgacccgcagcccgtctccccctatc

SEQ ID NO: 156105 - DNA, 35 bp, Artificial Sequence
  Synthetic oligonucleotide
tgtctcgcccgtttccatgtagcagcatttaactc

SEQ ID NO: 156106 - DNA, 35 bp, Artificial Sequence
  Synthetic oligonucleotide
aactctccgcccaagaggatggccttccgtacctc

SEQ ID NO: 156107 - DNA, 35 bp, Artificial Sequence
  Synthetic oligonucleotide
taccacaccacccgtccacccggtgacagaccgtc

SEQ ID NO: 156108 - DNA, 35 bp, Artificial Sequence
  Synthetic oligonucleotide
tccagcaggctcatccctgagtaccccgccaattc

SEQ ID NO: 156109 - DNA, 35 bp, Artificial Sequence
  Synthetic oligonucleotide
ggacgtgaccgtcgcctttacgcccatatctgttc

SEQ ID NO: 156110 - DNA, 35 bp, Artificial Sequence
  Synthetic oligonucleotide
agaggaggggagaaaatggggtacaatgaggccag

SEQ ID NO: 156111 - DNA, 35 bp, Artificial Sequence
  Synthetic oligonucleotide
gcgatcacatgtacgctcgccacgccaccccaccg

SEQ ID NO: 156112 - DNA, 35 bp, Artificial Sequence
  Synthetic oligonucleotide
actgggcccacgacgagccctccgcccttttaccg

SEQ ID NO: 156113 - DNA, 35 bp, Artificial Sequence
  Synthetic oligonucleotide
ggggaacgcagcgcggggggggcccgtaaaagggg

SEQ ID NO: 156114 - DNA, 35 bp, Artificial Sequence
  Synthetic oligonucleotide
ttagcccaactcctctgtactattgctcccccctg

SEQ ID NO: 156115 - DNA, 35 bp, Artificial Sequence
  Synthetic oligonucleotide
tgtttaccactcttagcgtccgtctgtccctcctg

SEQ ID NO: 156116 - DNA, 35 bp, Artificial Sequence
  Synthetic oligonucleotide
tctggccccctctgttagctccaccccattccttg

SEQ ID NO: 156117 - DNA, 35 bp, Artificial Sequence
  Synthetic oligonucleotide
tcgcaaccacacctaagatgccgatcgcctccact

SEQ ID NO: 156118 - DNA, 35 bp, Artificial Sequence
  Synthetic oligonucleotide
tacgtccgctgccccggtactcagccattgctact

SEQ ID NO: 156119 - DNA, 35 bp, Artificial Sequence
  Synthetic oligonucleotide
gatactgtgtctcgatgcccgctccgcccgatcct

SEQ ID NO: 156120 - DNA, 35 bp, Artificial Sequence
  Synthetic oligonucleotide
taatggcaccaactgacctgtccctattcactgct

SEQ ID NO: 156121 - DNA, 35 bp, Artificial Sequence
  Synthetic oligonucleotide
tatgcgcctcgaccccgtgcatttttttgtcctct

SEQ ID NO: 156122 - DNA, 35 bp, Artificial Sequence
  Synthetic oligonucleotide
atgaccggcccacttcctttaaccgcgcgaacctt

SEQ ID NO: 156123 - DNA, 35 bp, Artificial Sequence
  Synthetic oligonucleotide
ttgacaaacgctattgcccgactccgccttccgtt

SEQ ID NO: 156124 - DNA, 34 bp, Artificial Sequence
  Synthetic oligonucleotide
tccacgtactatccctgccggcgcactccaacaa

SEQ ID NO: 156125 - DNA, 36 bp, Artificial Sequence
  Synthetic oligonucleotide
tccccccgactgcccgtgcagcctcacactattcaa

SEQ ID NO: 156126 - DNA, 36 bp, Artificial Sequence
  Synthetic oligonucleotide
gatcccgccggtcctgtccaatactctagcttaaca

SEQ ID NO: 156127 - DNA, 35 bp, Artificial Sequence
  Synthetic oligonucleotide
gtaccgcccgtaggatagatccgacccccacgcca

SEQ ID NO: 156128 - DNA, 36 bp, Artificial Sequence
  Synthetic oligonucleotide
acttcacgccgcccttatacggtttcgtcttcgcca

SEQ ID NO: 156129 - DNA, 35 bp, Artificial Sequence
  Synthetic oligonucleotide
gtgccggtcgcagtctttcgttatcgacccctcca

SEQ ID NO: 156130 - DNA, 36 bp, Artificial Sequence
  Synthetic oligonucleotide
gtcacagttcctcccaccgcagcgcccttgcgtgca

SEQ ID NO: 156131 - DNA, 36 bp, Artificial Sequence
  Synthetic oligonucleotide
tttaacgcccgccctcctatcgccgcttctgcctca

SEQ ID NO: 156132 - DNA, 36 bp, Artificial Sequence
  Synthetic oligonucleotide
gccgcccttgtacgtacacatccccctcccggttca

SEQ ID NO: 156133 - DNA, 37 bp, Artificial Sequence
  Synthetic oligonucleotide
tgggggggatgggagggttgcgagaatcagcgataga

SEQ ID NO: 156134 - DNA, 36 bp, Artificial Sequence
  Synthetic oligonucleotide
atcaccgtgattcctgccgcactgcccgccatccga

SEQ ID NO: 156135 - DNA, 36 bp, Artificial Sequence
  Synthetic oligonucleotide
atcctcctccgccatcatgggccttagacccctcga

SEQ ID NO: 156136 - DNA, 36 bp, Artificial Sequence
  Synthetic oligonucleotide
taccccccgcacctcacacgtcctctgggagacgga

SEQ ID NO: 156137 - DNA, 37 bp, Artificial Sequence
  Synthetic oligonucleotide
gttggggttaaccgcacagggaggggtagccggggga

SEQ ID NO: 156138 - DNA, 37 bp, Artificial Sequence
  Synthetic oligonucleotide
gccccaccgttcggtagccgctttcgtttccctggga

SEQ ID NO: 156139 - DNA, 37 bp, Artificial Sequence
  Synthetic oligonucleotide
gagggtgccttctggaggggcgataggggatagtgga

SEQ ID NO: 156140 - DNA, 38 bp, Artificial Sequence
  Synthetic oligonucleotide
gtcccccccctattgcgtaccgaacaggcattgcatga

SEQ ID NO: 156141 - DNA, 38 bp, Artificial Sequence
  Synthetic oligonucleotide
gttgcctcctcgtctatccggtacaccatttctactga

SEQ ID NO: 156142 - DNA, 38 bp, Artificial Sequence
  Synthetic oligonucleotide
tccagccccctgcgctcgagttctcttacccaccgtga

SEQ ID NO: 156143 - DNA, 37 bp, Artificial Sequence
  Synthetic oligonucleotide
agagagcggggggttggagcgaggcggggagcggtga

SEQ ID NO: 156144 - DNA, 38 bp, Artificial Sequence
  Synthetic oligonucleotide
acgaccacatccctgttccccccgtccattgttcttga

SEQ ID NO: 156145 - DNA, 37 bp, Artificial Sequence
  Synthetic oligonucleotide
tccgcatcagctctccgtattccatccatcacgttga

SEQ ID NO: 156146 - DNA, 37 bp, Artificial Sequence
  Synthetic oligonucleotide
accccataccgcctgaacgaccttagccattcgttga

SEQ ID NO: 156147 - DNA, 35 bp, Artificial Sequence
  Synthetic oligonucleotide
tcaacgccacctctgcctaagtccgtccgccgcta

SEQ ID NO: 156148 - DNA, 36 bp, Artificial Sequence
  Synthetic oligonucleotide
tgcgcccatttccacccgtccccgtttcgtttggta

SEQ ID NO: 156149 - DNA, 36 bp, Artificial Sequence
  Synthetic oligonucleotide
tacgcctccccaccatcttggcttgactgtcaatta

SEQ ID NO: 156150 - DNA, 36 bp, Artificial Sequence
  Synthetic oligonucleotide
acccgccccctagattgactgcttattgtcgcgtta

SEQ ID NO: 156151 - DNA, 35 bp, Artificial Sequence
  Synthetic oligonucleotide
gaccctcgcacggttgacctctaccctgtctcacc

SEQ ID NO: 156152 - DNA, 35 bp, Artificial Sequence
  Synthetic oligonucleotide
aacaccgagcaccagcgataatacgccacacaccc

SEQ ID NO: 156153 - DNA, 35 bp, Artificial Sequence
  Synthetic oligonucleotide
tacgcactcaccaaagccgtcggtcacaccacccc

SEQ ID NO: 156154 - DNA, 35 bp, Artificial Sequence
  Synthetic oligonucleotide
atcgaatcctcgcacctgcccttgcaccggtcccc

SEQ ID NO: 156155 - DNA, 35 bp, Artificial Sequence
  Synthetic oligonucleotide
tacagcacggttgtgcttatcgtacgtccttcccc

SEQ ID NO: 156156 - DNA, 35 bp, Artificial Sequence
  Synthetic oligonucleotide
gcccacgtcctcgccacacacctaccctcgcatcc

SEQ ID NO: 156157 - DNA, 35 bp, Artificial Sequence
  Synthetic oligonucleotide
gtgacgcgcctccgcttatgcctgtgccctgctcc

SEQ ID NO: 156158 - DNA, 35 bp, Artificial Sequence
  Synthetic oligonucleotide
tgctcgtcaaccgtcattgtacgcccccgttgtcc

SEQ ID NO: 156159 - DNA, 35 bp, Artificial Sequence
  Synthetic oligonucleotide
tcagcccgctgcttttatccgaccagctcctttcc

SEQ ID NO: 156160 - DNA, 35 bp, Artificial Sequence
  Synthetic oligonucleotide
ccacctgtcctcacttgccccttcctccgccgagc

SEQ ID NO: 156161 - DNA, 35 bp, Artificial Sequence
  Synthetic oligonucleotide
cacaccccctcgttatcacacactgactccttagc

SEQ ID NO: 156162 - DNA, 35 bp, Artificial Sequence
  Synthetic oligonucleotide
gcaggcgatcctgccccgccccgcattcttcgcgc

SEQ ID NO: 156163 - DNA, 35 bp, Artificial Sequence
  Synthetic oligonucleotide
cattgtcccacctgctggcgccgttcctgcccatc

SEQ ID NO: 156164 - DNA, 35 bp, Artificial Sequence
  Synthetic oligonucleotide
tcaccacatcacgcacctgctttagaccccccctc

SEQ ID NO: 156165 - DNA, 35 bp, Artificial Sequence
  Synthetic oligonucleotide
gtccaactctgtctattaggccacgcgctcccctc

SEQ ID NO: 156166 - DNA, 35 bp, Artificial Sequence
  Synthetic oligonucleotide
tgtgccctagcctcactggtatcactttcttcctc

SEQ ID NO: 156167 - DNA, 35 bp, Artificial Sequence
  Synthetic oligonucleotide
ccctgactcttctgtatgcccaaccctcaccgctc

SEQ ID NO: 156168 - DNA, 35 bp, Artificial Sequence
  Synthetic oligonucleotide
atccgaccatcacagctcctggggctccatatctc

SEQ ID NO: 156169 - DNA, 35 bp, Artificial Sequence
  Synthetic oligonucleotide
gccctgtcaccccttcccacagccgatttggtgtc

SEQ ID NO: 156170 - DNA, 35 bp, Artificial Sequence
  Synthetic oligonucleotide
tgactcaccctacgctcccgtatagccaccgattc

SEQ ID NO: 156171 - DNA, 35 bp, Artificial Sequence
  Synthetic oligonucleotide
gatgtggcgtggggggtaataccaaggaagggaag

SEQ ID NO: 156172 - DNA, 35 bp, Artificial Sequence
  Synthetic oligonucleotide
atcccaccttgcatcacttcaggccctgccccacg

SEQ ID NO: 156173 - DNA, 35 bp, Artificial Sequence
  Synthetic oligonucleotide
acatcgcctccgttctgacaccctcttaagtcacg

SEQ ID NO: 156174 - DNA, 35 bp, Artificial Sequence
  Synthetic oligonucleotide
gagcaccaacctatctgtgtcacgtatctactccg

SEQ ID NO: 156175 - DNA, 35 bp, Artificial Sequence
  Synthetic oligonucleotide
ttggccttccgaccgcccgtctccacttccgtccg

SEQ ID NO: 156176 - DNA, 35 bp, Artificial Sequence
  Synthetic oligonucleotide
gtccttgacacgttgacccccccctcgaccctgcg

SEQ ID NO: 156177 - DNA, 35 bp, Artificial Sequence
  Synthetic oligonucleotide
tccccacccggcttatgctttttgattgctcttcg

SEQ ID NO: 156178 - DNA, 35 bp, Artificial Sequence
  Synthetic oligonucleotide
tgttccctcctgtgccggccattaccctctgtatg

SEQ ID NO: 156179 - DNA, 35 bp, Artificial Sequence
  Synthetic oligonucleotide
tccccacctcccgaagaaccaacaaacgctccttg

SEQ ID NO: 156180 - DNA, 35 bp, Artificial Sequence
  Synthetic oligonucleotide
gttaactgtcgcgccctctcatctccgtctgttat

SEQ ID NO: 156181 - DNA, 35 bp, Artificial Sequence
  Synthetic oligonucleotide
gggtgtgcccgcccttatgcccttctacaggaact

SEQ ID NO: 156182 - DNA, 35 bp, Artificial Sequence
  Synthetic oligonucleotide
gtcccccagaaggtactaatgatttcccctctact

SEQ ID NO: 156183 - DNA, 35 bp, Artificial Sequence
  Synthetic oligonucleotide
acccgatgacatgattgccaggccccacctcccct

SEQ ID NO: 156184 - DNA, 35 bp, Artificial Sequence
  Synthetic oligonucleotide
ggacgcatctcctgcgcaccggtgttccgctccct

SEQ ID NO: 156185 - DNA, 35 bp, Artificial Sequence
  Synthetic oligonucleotide
acgtaagtgcagcattatatcaactgttctctcct

SEQ ID NO: 156186 - DNA, 35 bp, Artificial Sequence
  Synthetic oligonucleotide
ttgcacggactctttgcatgggcccttgatcctct

SEQ ID NO: 156187 - DNA, 35 bp, Artificial Sequence
  Synthetic oligonucleotide
gctgcacacgtttgcaccagccggttcccctctgt

SEQ ID NO: 156188 - DNA, 35 bp, Artificial Sequence
  Synthetic oligonucleotide
tcacctgcccccagccgataagctccttaggaatt

SEQ ID NO: 156189 - DNA, 35 bp, Artificial Sequence
  Synthetic oligonucleotide
taccccaccccgcacgtgccccatcagtcaacctt

SEQ ID NO: 156190 - DNA, 35 bp, Artificial Sequence
  Synthetic oligonucleotide
gtgtgacagtccagatcgccgccgcaaccgccttt

SEQ ID NO: 156191 - DNA, 35 bp, Artificial Sequence
  Synthetic oligonucleotide
gatcccactctcatatgatatgccctgttgtcttt

SEQ ID NO: 156192 - DNA, 36 bp, Artificial Sequence
  Synthetic oligonucleotide
gcgaagcacccggcttatgatccgaccaccctacaa

SEQ ID NO: 156193 - DNA, 36 bp, Artificial Sequence
  Synthetic oligonucleotide
aaaagggcgggcgacgggaggggaattcacgtagaa

SEQ ID NO: 156194 - DNA, 36 bp, Artificial Sequence
  Synthetic oligonucleotide
gccgtatccgcctctgacctctatactggattctaa

SEQ ID NO: 156195 - DNA, 36 bp, Artificial Sequence
  Synthetic oligonucleotide
tagggtcagcccgccaaatctgcctctgtcctttaa

SEQ ID NO: 156196 - DNA, 35 bp, Artificial Sequence
  Synthetic oligonucleotide
ggagccagaggatggtgggcgggtgggagctttaa

SEQ ID NO: 156197 - DNA, 36 bp, Artificial Sequence
  Synthetic oligonucleotide
attgccctctactgctgccccttagtggcttgacca

SEQ ID NO: 156198 - DNA, 35 bp, Artificial Sequence
  Synthetic oligonucleotide
acgacggccgttctcgtttgcccccgttgccccca

SEQ ID NO: 156199 - DNA, 36 bp, Artificial Sequence
  Synthetic oligonucleotide
acacccgaccccgctgcgtgcaccacctcgttccca

SEQ ID NO: 156200 - DNA, 36 bp, Artificial Sequence
  Synthetic oligonucleotide
ttgtcacgtctcgccccgtccgcaatctaccatcca

SEQ ID NO: 156201 - DNA, 36 bp, Artificial Sequence
  Synthetic oligonucleotide
atgcccgctgggactcccaccccatatgttgctcca

SEQ ID NO: 156202 - DNA, 35 bp, Artificial Sequence
  Synthetic oligonucleotide
tgcccccctcacctctgcgctttccctgacgtcca

SEQ ID NO: 156203 - DNA, 36 bp, Artificial Sequence
  Synthetic oligonucleotide
gttgctgtgcccgccccctctacggatcgcattcca

SEQ ID NO: 156204 - DNA, 36 bp, Artificial Sequence
  Synthetic oligonucleotide
taccagtccgcccgcaggtttcttagtccccagtca

SEQ ID NO: 156205 - DNA, 37 bp, Artificial Sequence
  Synthetic oligonucleotide
tgttgccgcctcatcatctctttggtcaaccgtacga

SEQ ID NO: 156206 - DNA, 35 bp, Artificial Sequence
  Synthetic oligonucleotide
tgctaaccaccggccttcaccattgcgtcctccga

SEQ ID NO: 156207 - DNA, 37 bp, Artificial Sequence
  Synthetic oligonucleotide
tcctcccctgttgctaattggaccattccatctccga

SEQ ID NO: 156208 - DNA, 38 bp, Artificial Sequence
  Synthetic oligonucleotide
atccccatagcgtcccccgtgccgcactcctatcctga

SEQ ID NO: 156209 - DNA, 38 bp, Artificial Sequence
  Synthetic oligonucleotide
gcgcacctccccggagtgatccgtccatgccctcctga

SEQ ID NO: 156210 - DNA, 36 bp, Artificial Sequence
  Synthetic oligonucleotide
attaccccccggccgttcacccatccgcccctctga

SEQ ID NO: 156211 - DNA, 37 bp, Artificial Sequence
  Synthetic oligonucleotide
aatccgcatccgtgcgcgcttcccctactctttctga

SEQ ID NO: 156212 - DNA, 38 bp, Artificial Sequence
  Synthetic oligonucleotide
gggggaggaccagagggggcaatcagggggaagagtga

SEQ ID NO: 156213 - DNA, 37 bp, Artificial Sequence
  Synthetic oligonucleotide
gcactgttagtcccccgctccgtccatctctccgtga

SEQ ID NO: 156214 - DNA, 37 bp, Artificial Sequence
  Synthetic oligonucleotide
agacggatggggtggtggagaaggaaggggtcggtga

SEQ ID NO: 156215 - DNA, 37 bp, Artificial Sequence
  Synthetic oligonucleotide
gcgagacggggaatggatggaggggcctgacgattga

SEQ ID NO: 156216 - DNA, 36 bp, Artificial Sequence
  Synthetic oligonucleotide
tttcgcccgccggcacagctcctttcaacgccgcta

SEQ ID NO: 156217 - DNA, 35 bp, Artificial Sequence
  Synthetic oligonucleotide
tacacggtcctggttacatcctcgccacgattcta

SEQ ID NO: 156218 - DNA, 35 bp, Artificial Sequence
  Synthetic oligonucleotide
atggtacatcgacgccgcccccgaacacagtatta

SEQ ID NO: 156219 - DNA, 35 bp, Artificial Sequence
  Synthetic oligonucleotide
gtccatcgcaccgccacgttacacctgtttgcacc

SEQ ID NO: 156220 - DNA, 35 bp, Artificial Sequence
  Synthetic oligonucleotide
tgtgcctccagccgcctgatttatcactctacccc

SEQ ID NO: 156221 - DNA, 34 bp, Artificial Sequence
  Synthetic oligonucleotide
tgttgccccttgtacttgtttggccactgttccc

SEQ ID NO: 156222 - DNA, 35 bp, Artificial Sequence
  Synthetic oligonucleotide
tatccaccacaggggagctatacctccattttgcc

SEQ ID NO: 156223 - DNA, 35 bp, Artificial Sequence
  Synthetic oligonucleotide
cctgtggagcccccagtttgcccccgtctacctcc

SEQ ID NO: 156224 - DNA, 35 bp, Artificial Sequence
  Synthetic oligonucleotide
ttgccgatctctgcgcactcctcagccactggtcc

SEQ ID NO: 156225 - DNA, 35 bp, Artificial Sequence
  Synthetic oligonucleotide
tgcgtactgcccctcgagcgtatcacatcctgtcc
